United States Patent 11,369,692 (MATERIALS AND METHODS FOR TREATMENT OF DUCHENNE MUSCULAR DYSTROPHY) - sequence listing, part 5

SEQ ID NO: 134304 - DNA, 20 bp, Artificial Sequence
  chemically synthesized
catttcaatcagcagacttt

SEQ ID NO: 134305 - DNA, 20 bp, Artificial Sequence
  chemically synthesized
caatcagcagactttgagta

SEQ ID NO: 134306 - DNA, 20 bp, Artificial Sequence
  chemically synthesized
agggtaatctgctttactca

SEQ ID NO: 134307 - DNA, 20 bp, Artificial Sequence
  chemically synthesized
tcagcagactttgagtaaag

SEQ ID NO: 134308 - DNA, 20 bp, Artificial Sequence
  chemically synthesized
aggcccacccacattgtgga

SEQ ID NO: 134309 - DNA, 20 bp, Artificial Sequence
  chemically synthesized
aaggcccacccacattgtgg

SEQ ID NO: 134310 - DNA, 20 bp, Artificial Sequence
  chemically synthesized
gcagattaccctccacaatg

SEQ ID NO: 134311 - DNA, 20 bp, Artificial Sequence
  chemically synthesized
gaaggcccacccacattgtg

SEQ ID NO: 134312 - DNA, 20 bp, Artificial Sequence
  chemically synthesized
cagattaccctccacaatgt

SEQ ID NO: 134313 - DNA, 20 bp, Artificial Sequence
  chemically synthesized
gagaaggcccacccacattg

SEQ ID NO: 134314 - DNA, 20 bp, Artificial Sequence
  chemically synthesized
attaccctccacaatgtggg

SEQ ID NO: 134315 - DNA, 20 bp, Artificial Sequence
  chemically synthesized
ttaccctccacaatgtgggt

SEQ ID NO: 134316 - DNA, 20 bp, Artificial Sequence
  chemically synthesized
acttcaaaattgattggaga

SEQ ID NO: 134317 - DNA, 20 bp, Artificial Sequence
  chemically synthesized
gacttcaaaattgattggag

SEQ ID NO: 134318 - DNA, 20 bp, Artificial Sequence
  chemically synthesized
aaggacttcaaaattgattg

SEQ ID NO: 134319 - DNA, 20 bp, Artificial Sequence
  chemically synthesized
ttaaggacttcaaaattgat

SEQ ID NO: 134320 - DNA, 20 bp, Artificial Sequence
  chemically synthesized
gccttctccaatcaattttg

SEQ ID NO: 134321 - DNA, 20 bp, Artificial Sequence
  chemically synthesized
caatcaattttgaagtcctt

SEQ ID NO: 134322 - DNA, 20 bp, Artificial Sequence
  chemically synthesized
atcaattttgaagtccttaa

SEQ ID NO: 134323 - DNA, 20 bp, Artificial Sequence
  chemically synthesized
gacttcagtcttttctctta

SEQ ID NO: 134324 - DNA, 20 bp, Artificial Sequence
  chemically synthesized
ttttgaagtccttaagagaa

SEQ ID NO: 134325 - DNA, 20 bp, Artificial Sequence
  chemically synthesized
ggacttcagtcttttctctt

SEQ ID NO: 134326 - DNA, 20 bp, Artificial Sequence
  chemically synthesized
gtccttaagagaaaagactg

SEQ ID NO: 134327 - DNA, 20 bp, Artificial Sequence
  chemically synthesized
agagaaaagactgaagtccc

SEQ ID NO: 134328 - DNA, 20 bp, Artificial Sequence
  chemically synthesized
ccttccttttctggggactt

SEQ ID NO: 134329 - DNA, 20 bp, Artificial Sequence
  chemically synthesized
aaagactgaagtccccagaa

SEQ ID NO: 134330 - DNA, 20 bp, Artificial Sequence
  chemically synthesized
aagactgaagtccccagaaa

SEQ ID NO: 134331 - DNA, 20 bp, Artificial Sequence
  chemically synthesized
cagaattccttccttttctg

SEQ ID NO: 134332 - DNA, 20 bp, Artificial Sequence
  chemically synthesized
gcagaattccttccttttct

SEQ ID NO: 134333 - DNA, 20 bp, Artificial Sequence
  chemically synthesized
actgaagtccccagaaaagg

SEQ ID NO: 134334 - DNA, 20 bp, Artificial Sequence
  chemically synthesized
agcagaattccttccttttc

SEQ ID NO: 134335 - DNA, 20 bp, Artificial Sequence
  chemically synthesized
ctgaagtccccagaaaagga

SEQ ID NO: 134336 - DNA, 20 bp, Artificial Sequence
  chemically synthesized
aaaggaaggaattctgctat

SEQ ID NO: 134337 - DNA, 20 bp, Artificial Sequence
  chemically synthesized
gtccaaaggtaatccgatag

SEQ ID NO: 134338 - DNA, 20 bp, Artificial Sequence
  chemically synthesized
tgagtccaaaggtaatccga

SEQ ID NO: 134339 - DNA, 20 bp, Artificial Sequence
  chemically synthesized
ttctgctatcggattacctt

SEQ ID NO: 134340 - DNA, 20 bp, Artificial Sequence
  chemically synthesized
tgttgcaatcttgagtccaa

SEQ ID NO: 134341 - DNA, 20 bp, Artificial Sequence
  chemically synthesized
atcggattacctttggactc

SEQ ID NO: 134342 - DNA, 20 bp, Artificial Sequence
  chemically synthesized
atgttgcaatcttgagtcca

SEQ ID NO: 134343 - DNA, 20 bp, Artificial Sequence
  chemically synthesized
agagttgatgttgcaatctt

SEQ ID NO: 134344 - DNA, 20 bp, Artificial Sequence
  chemically synthesized
tgcaacatcaactcttccct

SEQ ID NO: 134345 - DNA, 20 bp, Artificial Sequence
  chemically synthesized
caggatggagaccaagggaa

SEQ ID NO: 134346 - DNA, 20 bp, Artificial Sequence
  chemically synthesized
ggcaggatggagaccaaggg

SEQ ID NO: 134347 - DNA, 20 bp, Artificial Sequence
  chemically synthesized
cctggcaggatggagaccaa

SEQ ID NO: 134348 - DNA, 20 bp, Artificial Sequence
  chemically synthesized
gcctggcaggatggagacca

SEQ ID NO: 134349 - DNA, 20 bp, Artificial Sequence
  chemically synthesized
agcctggcaggatggagacc

SEQ ID NO: 134350 - DNA, 20 bp, Artificial Sequence
  chemically synthesized
tccaaaagcctggcaggatg

SEQ ID NO: 134351 - DNA, 20 bp, Artificial Sequence
  chemically synthesized
tcccttggtctccatcctgc

SEQ ID NO: 134352 - DNA, 20 bp, Artificial Sequence
  chemically synthesized
cccttggtctccatcctgcc

SEQ ID NO: 134353 - DNA, 20 bp, Artificial Sequence
  chemically synthesized
aatccaaaagcctggcagga

SEQ ID NO: 134354 - DNA, 20 bp, Artificial Sequence
  chemically synthesized
gtaaaatccaaaagcctggc

SEQ ID NO: 134355 - DNA, 20 bp, Artificial Sequence
  chemically synthesized
tgtaaaatccaaaagcctgg

SEQ ID NO: 134356 - DNA, 20 bp, Artificial Sequence
  chemically synthesized
tctccatcctgccaggcttt

SEQ ID NO: 134357 - DNA, 20 bp, Artificial Sequence
  chemically synthesized
atctgtaaaatccaaaagcc

SEQ ID NO: 134358 - DNA, 20 bp, Artificial Sequence
  chemically synthesized
caaaaatctgtaaaatccaa

SEQ ID NO: 134359 - DNA, 20 bp, Artificial Sequence
  chemically synthesized
tgccaggcttttggatttta

SEQ ID NO: 134360 - DNA, 20 bp, Artificial Sequence
  chemically synthesized
tttacagatttttgactttt

SEQ ID NO: 134361 - DNA, 20 bp, Artificial Sequence
  chemically synthesized
atatgattgtgggagctgaa

SEQ ID NO: 134362 - DNA, 20 bp, Artificial Sequence
  chemically synthesized
attaactcatatgattgtgg

SEQ ID NO: 134363 - DNA, 20 bp, Artificial Sequence
  chemically synthesized
ccattaactcatatgattgt

SEQ ID NO: 134364 - DNA, 20 bp, Artificial Sequence
  chemically synthesized
gccattaactcatatgattg

SEQ ID NO: 134365 - DNA, 20 bp, Artificial Sequence
  chemically synthesized
ttcagctcccacaatcatat

SEQ ID NO: 134366 - DNA, 20 bp, Artificial Sequence
  chemically synthesized
cccacaatcatatgagttaa

SEQ ID NO: 134367 - DNA, 20 bp, Artificial Sequence
  chemically synthesized
gagagagagagattgatttt

SEQ ID NO: 134368 - DNA, 20 bp, Artificial Sequence
  chemically synthesized
gagagagagagagagagaga

SEQ ID NO: 134369 - DNA, 20 bp, Artificial Sequence
  chemically synthesized
gagagagagagagagagaga

SEQ ID NO: 134370 - DNA, 20 bp, Artificial Sequence
  chemically synthesized
gagagagagagagagagaga

SEQ ID NO: 134371 - DNA, 20 bp, Artificial Sequence
  chemically synthesized
cagagagagagagagagaga

SEQ ID NO: 134372 - DNA, 20 bp, Artificial Sequence
  chemically synthesized
tacagagagagagagagaga

SEQ ID NO: 134373 - DNA, 20 bp, Artificial Sequence
  chemically synthesized
catacagagagagagagaga

SEQ ID NO: 134374 - DNA, 20 bp, Artificial Sequence
  chemically synthesized
cacatacagagagagagaga

SEQ ID NO: 134375 - DNA, 20 bp, Artificial Sequence
  chemically synthesized
cacacatacagagagagaga

SEQ ID NO: 134376 - DNA, 20 bp, Artificial Sequence
  chemically synthesized
tacacacatacagagagaga

SEQ ID NO: 134377 - DNA, 20 bp, Artificial Sequence
  chemically synthesized
tatacacacatacagagaga

SEQ ID NO: 134378 - DNA, 20 bp, Artificial Sequence
  chemically synthesized
tatatacacacatacagaga

SEQ ID NO: 134379 - DNA, 20 bp, Artificial Sequence
  chemically synthesized
tatatatacacacatacaga

SEQ ID NO: 134380 - DNA, 20 bp, Artificial Sequence
  chemically synthesized
tatatatatacacacataca

SEQ ID NO: 134381 - DNA, 20 bp, Artificial Sequence
  chemically synthesized
attatatatatacacacata

SEQ ID NO: 134382 - DNA, 20 bp, Artificial Sequence
  chemically synthesized
tataatattattatatatat

SEQ ID NO: 134383 - DNA, 20 bp, Artificial Sequence
  chemically synthesized
agtgagagagagagagagat

SEQ ID NO: 134384 - DNA, 20 bp, Artificial Sequence
  chemically synthesized
gagagagtgagagagagaga

SEQ ID NO: 134385 - DNA, 20 bp, Artificial Sequence
  chemically synthesized
gagagagagtgagagagaga

SEQ ID NO: 134386 - DNA, 20 bp, Artificial Sequence
  chemically synthesized
gagagagagagtgagagaga

SEQ ID NO: 134387 - DNA, 20 bp, Artificial Sequence
  chemically synthesized
gagagagagagagtgagaga

SEQ ID NO: 134388 - DNA, 20 bp, Artificial Sequence
  chemically synthesized
gagagagagagagagtgaga

SEQ ID NO: 134389 - DNA, 20 bp, Artificial Sequence
  chemically synthesized
gagagagagagagagagtga

SEQ ID NO: 134390 - DNA, 20 bp, Artificial Sequence
  chemically synthesized
gagagagagagagagagagt

SEQ ID NO: 134391 - DNA, 20 bp, Artificial Sequence
  chemically synthesized
gagagagagagagagagaga

SEQ ID NO: 134392 - DNA, 20 bp, Artificial Sequence
  chemically synthesized
gagagagagagagagagaga

SEQ ID NO: 134393 - DNA, 20 bp, Artificial Sequence
  chemically synthesized
gagagagagagagagagaga

SEQ ID NO: 134394 - DNA, 20 bp, Artificial Sequence
  chemically synthesized
gagagagagagagagagaga

SEQ ID NO: 134395 - DNA, 20 bp, Artificial Sequence
  chemically synthesized
gagagagagagagagagaga

SEQ ID NO: 134396 - DNA, 20 bp, Artificial Sequence
  chemically synthesized
gagagagagagagagagaga

SEQ ID NO: 134397 - DNA, 20 bp, Artificial Sequence
  chemically synthesized
tagagagagagagagagaga

SEQ ID NO: 134398 - DNA, 20 bp, Artificial Sequence
  chemically synthesized
tatagagagagagagagaga

SEQ ID NO: 134399 - DNA, 20 bp, Artificial Sequence
  chemically synthesized
tatatagagagagagagaga

SEQ ID NO: 134400 - DNA, 20 bp, Artificial Sequence
  chemically synthesized
tatatatagagagagagaga

SEQ ID NO: 134401 - DNA, 20 bp, Artificial Sequence
  chemically synthesized
tatatatatagagagagaga

SEQ ID NO: 134402 - DNA, 20 bp, Artificial Sequence
  chemically synthesized
tatatatatatagagagaga

SEQ ID NO: 134403 - DNA, 20 bp, Artificial Sequence
  chemically synthesized
tatatatatatatagagaga

SEQ ID NO: 134404 - DNA, 20 bp, Artificial Sequence
  chemically synthesized
tatatatatatatatagaga

SEQ ID NO: 134405 - DNA, 20 bp, Artificial Sequence
  chemically synthesized
tatatatatatatatataga

SEQ ID NO: 134406 - DNA, 20 bp, Artificial Sequence
  chemically synthesized
tatatatatatatatatata

SEQ ID NO: 134407 - DNA, 20 bp, Artificial Sequence
  chemically synthesized
tatatatatatatatatata

SEQ ID NO: 134408 - DNA, 20 bp, Artificial Sequence
  chemically synthesized
ctgttgtatctaataattag

SEQ ID NO: 134409 - DNA, 20 bp, Artificial Sequence
  chemically synthesized
tatatatatctcctaattat

SEQ ID NO: 134410 - DNA, 20 bp, Artificial Sequence
  chemically synthesized
ttctgttgtatctaataatt

SEQ ID NO: 134411 - DNA, 20 bp, Artificial Sequence
  chemically synthesized
cttctgttgtatctaataat

SEQ ID NO: 134412 - DNA, 20 bp, Artificial Sequence
  chemically synthesized
ctcctaattattagatacaa

SEQ ID NO: 134413 - DNA, 20 bp, Artificial Sequence
  chemically synthesized
ctaattattagatacaacag

SEQ ID NO: 134414 - DNA, 20 bp, Artificial Sequence
  chemically synthesized
ttattagatacaacagaaga

SEQ ID NO: 134415 - DNA, 20 bp, Artificial Sequence
  chemically synthesized
tagatacaacagaagataga

SEQ ID NO: 134416 - DNA, 20 bp, Artificial Sequence
  chemically synthesized
tacaacagaagatagatgga

SEQ ID NO: 134417 - DNA, 20 bp, Artificial Sequence
  chemically synthesized
caacagaagatagatggaaa

SEQ ID NO: 134418 - DNA, 20 bp, Artificial Sequence
  chemically synthesized
agaagatagatggaaagaga

SEQ ID NO: 134419 - DNA, 20 bp, Artificial Sequence
  chemically synthesized
agatagatggaaagagacag

SEQ ID NO: 134420 - DNA, 20 bp, Artificial Sequence
  chemically synthesized
tcaccattatcattagagtt

SEQ ID NO: 134421 - DNA, 20 bp, Artificial Sequence
  chemically synthesized
tcaattcaccattatcatta

SEQ ID NO: 134422 - DNA, 20 bp, Artificial Sequence
  chemically synthesized
attctaaactctaatgataa

SEQ ID NO: 134423 - DNA, 20 bp, Artificial Sequence
  chemically synthesized
tatcaattcaccattatcat

SEQ ID NO: 134424 - DNA, 20 bp, Artificial Sequence
  chemically synthesized
ataatggtgaattgataata

SEQ ID NO: 134425 - DNA, 20 bp, Artificial Sequence
  chemically synthesized
taatggtgaattgataatac

SEQ ID NO: 134426 - DNA, 20 bp, Artificial Sequence
  chemically synthesized
tgataatacaggtgaaatat

SEQ ID NO: 134427 - DNA, 20 bp, Artificial Sequence
  chemically synthesized
caggtgaaatattggactgt

SEQ ID NO: 134428 - DNA, 20 bp, Artificial Sequence
  chemically synthesized
tttcatcatctgaaaactca

SEQ ID NO: 134429 - DNA, 20 bp, Artificial Sequence
  chemically synthesized
aatattggactgtgagtttt

SEQ ID NO: 134430 - DNA, 20 bp, Artificial Sequence
  chemically synthesized
gttttcagatgatgaaaacc

SEQ ID NO: 134431 - DNA, 20 bp, Artificial Sequence
  chemically synthesized
gggcctgagaacatttatct

SEQ ID NO: 134432 - DNA, 20 bp, Artificial Sequence
  chemically synthesized
tgggcctgagaacatttatc

SEQ ID NO: 134433 - DNA, 20 bp, Artificial Sequence
  chemically synthesized
aaaacctagataaatgttct

SEQ ID NO: 134434 - DNA, 20 bp, Artificial Sequence
  chemically synthesized
aaacctagataaatgttctc

SEQ ID NO: 134435 - DNA, 20 bp, Artificial Sequence
  chemically synthesized
agataaatgttctcaggccc

SEQ ID NO: 134436 - DNA, 20 bp, Artificial Sequence
  chemically synthesized
gataaatgttctcaggccca

SEQ ID NO: 134437 - DNA, 20 bp, Artificial Sequence
  chemically synthesized
attaatcagtccttgggcct

SEQ ID NO: 134438 - DNA, 20 bp, Artificial Sequence
  chemically synthesized
ttgtgcattaatcagtcctt

SEQ ID NO: 134439 - DNA, 20 bp, Artificial Sequence
  chemically synthesized
attgtgcattaatcagtcct

SEQ ID NO: 134440 - DNA, 20 bp, Artificial Sequence
  chemically synthesized
gaaatatattgtgcattaat

SEQ ID NO: 134441 - DNA, 20 bp, Artificial Sequence
  chemically synthesized
gcacaatatatttctaatga

SEQ ID NO: 134442 - DNA, 20 bp, Artificial Sequence
  chemically synthesized
tcatatttcctttctgtcat

SEQ ID NO: 134443 - DNA, 20 bp, Artificial Sequence
  chemically synthesized
aatatatttctaatgacaga

SEQ ID NO: 134444 - DNA, 20 bp, Artificial Sequence
  chemically synthesized
atatatttctaatgacagaa

SEQ ID NO: 134445 - DNA, 20 bp, Artificial Sequence
  chemically synthesized
cttcctgttgaataattaag

SEQ ID NO: 134446 - DNA, 20 bp, Artificial Sequence
  chemically synthesized
gttcttcctgttgaataatt

SEQ ID NO: 134447 - DNA, 20 bp, Artificial Sequence
  chemically synthesized
taatccacttaattattcaa

SEQ ID NO: 134448 - DNA, 20 bp, Artificial Sequence
  chemically synthesized
aatccacttaattattcaac

SEQ ID NO: 134449 - DNA, 20 bp, Artificial Sequence
  chemically synthesized
ccacttaattattcaacagg

SEQ ID NO: 134450 - DNA, 20 bp, Artificial Sequence
  chemically synthesized
acagctaatattatgtggtg

SEQ ID NO: 134451 - DNA, 20 bp, Artificial Sequence
  chemically synthesized
ttcttacagctaatattatg

SEQ ID NO: 134452 - DNA, 20 bp, Artificial Sequence
  chemically synthesized
agaacttcaccacataatat

SEQ ID NO: 134453 - DNA, 20 bp, Artificial Sequence
  chemically synthesized
caccacataatattagctgt

SEQ ID NO: 134454 - DNA, 20 bp, Artificial Sequence
  chemically synthesized
caggattgttaaaattctta

SEQ ID NO: 134455 - DNA, 20 bp, Artificial Sequence
  chemically synthesized
cacacatcctttagcaaaac

SEQ ID NO: 134456 - DNA, 20 bp, Artificial Sequence
  chemically synthesized
tcacacatcctttagcaaaa

SEQ ID NO: 134457 - DNA, 20 bp, Artificial Sequence
  chemically synthesized
ttaacaatcctgttttgcta

SEQ ID NO: 134458 - DNA, 20 bp, Artificial Sequence
  chemically synthesized
taacaatcctgttttgctaa

SEQ ID NO: 134459 - DNA, 20 bp, Artificial Sequence
  chemically synthesized
aatatctgtcacacatcctt

SEQ ID NO: 134460 - DNA, 20 bp, Artificial Sequence
  chemically synthesized
ttttgctaaaggatgtgtga

SEQ ID NO: 134461 - DNA, 20 bp, Artificial Sequence
  chemically synthesized
tttttgtatcaaataaattt

SEQ ID NO: 134462 - DNA, 20 bp, Artificial Sequence
  chemically synthesized
caaaatttatttgatacaaa

SEQ ID NO: 134463 - DNA, 20 bp, Artificial Sequence
  chemically synthesized
atttatttgatacaaaaagt

SEQ ID NO: 134464 - DNA, 20 bp, Artificial Sequence
  chemically synthesized
taaataaataaataataaaa

SEQ ID NO: 134465 - DNA, 20 bp, Artificial Sequence
  chemically synthesized
atttatttatttatttacga

SEQ ID NO: 134466 - DNA, 20 bp, Artificial Sequence
  chemically synthesized
ttatttatttatttacgatg

SEQ ID NO: 134467 - DNA, 20 bp, Artificial Sequence
  chemically synthesized
cactctaacctgggcaacaa

SEQ ID NO: 134468 - DNA, 20 bp, Artificial Sequence
  chemically synthesized
ggagtttcactcttgttgcc

SEQ ID NO: 134469 - DNA, 20 bp, Artificial Sequence
  chemically synthesized
gagtttcactcttgttgccc

SEQ ID NO: 134470 - DNA, 20 bp, Artificial Sequence
  chemically synthesized
tgcactctaacctgggcaac

SEQ ID NO: 134471 - DNA, 20 bp, Artificial Sequence
  chemically synthesized
ttcactcttgttgcccaggt

SEQ ID NO: 134472 - DNA, 20 bp, Artificial Sequence
  chemically synthesized
cactcttgttgcccaggtta

SEQ ID NO: 134473 - DNA, 20 bp, Artificial Sequence
  chemically synthesized
acgccattgcactctaacct

SEQ ID NO: 134474 - DNA, 20 bp, Artificial Sequence
  chemically synthesized
cacgccattgcactctaacc

SEQ ID NO: 134475 - DNA, 20 bp, Artificial Sequence
  chemically synthesized
ttgcccaggttagagtgcaa

SEQ ID NO: 134476 - DNA, 20 bp, Artificial Sequence
  chemically synthesized
agagtgcaatggcgtgatct

SEQ ID NO: 134477 - DNA, 20 bp, Artificial Sequence
  chemically synthesized
gcaatggcgtgatctcggct

SEQ ID NO: 134478 - DNA, 20 bp, Artificial Sequence
  chemically synthesized
ggcggaggttgcactgagcc

SEQ ID NO: 134479 - DNA, 20 bp, Artificial Sequence
  chemically synthesized
cgggaggcggaggttgcact

SEQ ID NO: 134480 - DNA, 20 bp, Artificial Sequence
  chemically synthesized
tgcttgaacccgggaggcgg

SEQ ID NO: 134481 - DNA, 20 bp, Artificial Sequence
  chemically synthesized
tcagtgcaacctccgcctcc

SEQ ID NO: 134482 - DNA, 20 bp, Artificial Sequence
  chemically synthesized
ttgcttgaacccgggaggcg

SEQ ID NO: 134483 - DNA, 20 bp, Artificial Sequence
  chemically synthesized
cagtgcaacctccgcctccc

SEQ ID NO: 134484 - DNA, 20 bp, Artificial Sequence
  chemically synthesized
aattgcttgaacccgggagg

SEQ ID NO: 134485 - DNA, 20 bp, Artificial Sequence
  chemically synthesized
gagaattgcttgaacccggg

SEQ ID NO: 134486 - DNA, 20 bp, Artificial Sequence
  chemically synthesized
ggagaattgcttgaacccgg

SEQ ID NO: 134487 - DNA, 20 bp, Artificial Sequence
  chemically synthesized
aacctccgcctcccgggttc

SEQ ID NO: 134488 - DNA, 20 bp, Artificial Sequence
  chemically synthesized
caggagaattgcttgaaccc

SEQ ID NO: 134489 - DNA, 20 bp, Artificial Sequence
  chemically synthesized
gcaggagaattgcttgaacc

SEQ ID NO: 134490 - DNA, 20 bp, Artificial Sequence
  chemically synthesized
ttcaagcaattctcctgcct

SEQ ID NO: 134491 - DNA, 20 bp, Artificial Sequence
  chemically synthesized
tactcgggaggctgaggcag

SEQ ID NO: 134492 - DNA, 20 bp, Artificial Sequence
  chemically synthesized
gctactcgggaggctgaggc

SEQ ID NO: 134493 - DNA, 20 bp, Artificial Sequence
  chemically synthesized
agctactcgggaggctgagg

SEQ ID NO: 134494 - DNA, 20 bp, Artificial Sequence
  chemically synthesized
cccagctactcgggaggctg

SEQ ID NO: 134495 - DNA, 20 bp, Artificial Sequence
  chemically synthesized
tcccagctactcgggaggct

SEQ ID NO: 134496 - DNA, 20 bp, Artificial Sequence
  chemically synthesized
ttctcctgcctcagcctccc

SEQ ID NO: 134497 - DNA, 20 bp, Artificial Sequence
  chemically synthesized
tcctgcctcagcctcccgag

SEQ ID NO: 134498 - DNA, 20 bp, Artificial Sequence
  chemically synthesized
tgtaatcccagctactcggg

SEQ ID NO: 134499 - DNA, 20 bp, Artificial Sequence
  chemically synthesized
ctgtaatcccagctactcgg

SEQ ID NO: 134500 - DNA, 20 bp, Artificial Sequence
  chemically synthesized
gcctcagcctcccgagtagc

SEQ ID NO: 134501 - DNA, 20 bp, Artificial Sequence
  chemically synthesized
acctgtaatcccagctactc

SEQ ID NO: 134502 - DNA, 20 bp, Artificial Sequence
  chemically synthesized
cctcagcctcccgagtagct

SEQ ID NO: 134503 - DNA, 20 bp, Artificial Sequence
  chemically synthesized
cacctgtaatcccagctact

SEQ ID NO: 134504 - DNA, 20 bp, Artificial Sequence
  chemically synthesized
ctcccgagtagctgggatta

SEQ ID NO: 134505 - DNA, 20 bp, Artificial Sequence
  chemically synthesized
tcccgagtagctgggattac

SEQ ID NO: 134506 - DNA, 20 bp, Artificial Sequence
  chemically synthesized
gtggcgggcacctgtaatcc

SEQ ID NO: 134507 - DNA, 20 bp, Artificial Sequence
  chemically synthesized
aattagccaggcatggtggc

SEQ ID NO: 134508 - DNA, 20 bp, Artificial Sequence
  chemically synthesized
aaattagccaggcatggtgg

SEQ ID NO: 134509 - DNA, 20 bp, Artificial Sequence
  chemically synthesized
caggtgcccgccaccatgcc

SEQ ID NO: 134510 - DNA, 20 bp, Artificial Sequence
  chemically synthesized
aaaaaattagccaggcatgg

SEQ ID NO: 134511 - DNA, 20 bp, Artificial Sequence
  chemically synthesized
acaaaaaaattagccaggca

SEQ ID NO: 134512 - DNA, 20 bp, Artificial Sequence
  chemically synthesized
aaaatacaaaaaaattagcc

SEQ ID NO: 134513 - DNA, 20 bp, Artificial Sequence
  chemically synthesized
aaaaatacaaaaaaattagc

SEQ ID NO: 134514 - DNA, 20 bp, Artificial Sequence
  chemically synthesized
tactaaaaatacaaaaaaat

SEQ ID NO: 134515 - DNA, 20 bp, Artificial Sequence
  chemically synthesized
ggctaatttttttgtatttt

SEQ ID NO: 134516 - DNA, 20 bp, Artificial Sequence
  chemically synthesized
taatttttttgtatttttag

SEQ ID NO: 134517 - DNA, 20 bp, Artificial Sequence
  chemically synthesized
atttttttgtatttttagta

SEQ ID NO: 134518 - DNA, 20 bp, Artificial Sequence
  chemically synthesized
ttttgtatttttagtagaga

SEQ ID NO: 134519 - DNA, 20 bp, Artificial Sequence
  chemically synthesized
tttgtatttttagtagagat

SEQ ID NO: 134520 - DNA, 20 bp, Artificial Sequence
  chemically synthesized
ttgtatttttagtagagatg

SEQ ID NO: 134521 - DNA, 20 bp, Artificial Sequence
  chemically synthesized
ccagcctggctaacatggtg

SEQ ID NO: 134522 - DNA, 20 bp, Artificial Sequence
  chemically synthesized
gagatggggcttcaccatgt

SEQ ID NO: 134523 - DNA, 20 bp, Artificial Sequence
  chemically synthesized
tggggcttcaccatgttagc

SEQ ID NO: 134524 - DNA, 20 bp, Artificial Sequence
  chemically synthesized
cgaaaccagcctggctaaca

SEQ ID NO: 134525 - DNA, 20 bp, Artificial Sequence
  chemically synthesized
ggggcttcaccatgttagcc

SEQ ID NO: 134526 - DNA, 20 bp, Artificial Sequence
  chemically synthesized
cttcaccatgttagccaggc

SEQ ID NO: 134527 - DNA, 20 bp, Artificial Sequence
  chemically synthesized
tcaggagttcgaaaccagcc

SEQ ID NO: 134528 - DNA, 20 bp, Artificial Sequence
  chemically synthesized
tgaggtcaggagttcgaaac

SEQ ID NO: 134529 - DNA, 20 bp, Artificial Sequence
  chemically synthesized
tggtttcgaactcctgacct

SEQ ID NO: 134530 - DNA, 20 bp, Artificial Sequence
  chemically synthesized
gatggatcacctgaggtcag

SEQ ID NO: 134531 - DNA, 20 bp, Artificial Sequence
  chemically synthesized
ggtttcgaactcctgacctc

SEQ ID NO: 134532 - DNA, 20 bp, Artificial Sequence
  chemically synthesized
gcgatggatcacctgaggtc

SEQ ID NO: 134533 - DNA, 20 bp, Artificial Sequence
  chemically synthesized
agcgatggatcacctgaggt

SEQ ID NO: 134534 - DNA, 20 bp, Artificial Sequence
  chemically synthesized
ctgaagcgatggatcacctg

SEQ ID NO: 134535 - DNA, 20 bp, Artificial Sequence
  chemically synthesized
gctgaagcgatggatcacct

SEQ ID NO: 134536 - DNA, 20 bp, Artificial Sequence
  chemically synthesized
cctcaggtgatccatcgctt

SEQ ID NO: 134537 - DNA, 20 bp, Artificial Sequence
  chemically synthesized
actttgggaggctgaagcga

SEQ ID NO: 134538 - DNA, 20 bp, Artificial Sequence
  chemically synthesized
tccagcactttgggaggctg

SEQ ID NO: 134539 - DNA, 20 bp, Artificial Sequence
  chemically synthesized
tccatcgcttcagcctccca

SEQ ID NO: 134540 - DNA, 20 bp, Artificial Sequence
  chemically synthesized
tgtaattccagcactttggg

SEQ ID NO: 134541 - DNA, 20 bp, Artificial Sequence
  chemically synthesized
ctgtaattccagcactttgg

SEQ ID NO: 134542 - DNA, 20 bp, Artificial Sequence
  chemically synthesized
gcttcagcctcccaaagtgc

SEQ ID NO: 134543 - DNA, 20 bp, Artificial Sequence
  chemically synthesized
tcctgtaattccagcacttt

SEQ ID NO: 134544 - DNA, 20 bp, Artificial Sequence
  chemically synthesized
ctcctgtaattccagcactt

SEQ ID NO: 134545 - DNA, 20 bp, Artificial Sequence
  chemically synthesized
ctcccaaagtgctggaatta

SEQ ID NO: 134546 - DNA, 20 bp, Artificial Sequence
  chemically synthesized
tcccaaagtgctggaattac

SEQ ID NO: 134547 - DNA, 20 bp, Artificial Sequence
  chemically synthesized
gtggctcactcctgtaattc

SEQ ID NO: 134548 - DNA, 20 bp, Artificial Sequence
  chemically synthesized
ccaaagtgctggaattacag

SEQ ID NO: 134549 - DNA, 20 bp, Artificial Sequence
  chemically synthesized
agtgctggaattacaggagt

SEQ ID NO: 134550 - DNA, 20 bp, Artificial Sequence
  chemically synthesized
caggagtgagccactgtgcc

SEQ ID NO: 134551 - DNA, 20 bp, Artificial Sequence
  chemically synthesized
gaaatacaggctgggcacag

SEQ ID NO: 134552 - DNA, 20 bp, Artificial Sequence
  chemically synthesized
attgaaatacaggctgggca

SEQ ID NO: 134553 - DNA, 20 bp, Artificial Sequence
  chemically synthesized
taagaattgaaatacaggct

SEQ ID NO: 134554 - DNA, 20 bp, Artificial Sequence
  chemically synthesized
ataagaattgaaatacaggc

SEQ ID NO: 134555 - DNA, 20 bp, Artificial Sequence
  chemically synthesized
tttaataagaattgaaatac

SEQ ID NO: 134556 - DNA, 20 bp, Artificial Sequence
  chemically synthesized
ttttaataagaattgaaata

SEQ ID NO: 134557 - DNA, 20 bp, Artificial Sequence
  chemically synthesized
atcttatgagaaattttaat

SEQ ID NO: 134558 - DNA, 20 bp, Artificial Sequence
  chemically synthesized
ttcttattaaaatttctcat

SEQ ID NO: 134559 - DNA, 20 bp, Artificial Sequence
  chemically synthesized
atagtgaaagacaatcttat

SEQ ID NO: 134560 - DNA, 20 bp, Artificial Sequence
  chemically synthesized
gaagtataaagagatagtga

SEQ ID NO: 134561 - DNA, 20 bp, Artificial Sequence
  chemically synthesized
cttatggaagtataaagaga

SEQ ID NO: 134562 - DNA, 20 bp, Artificial Sequence
  chemically synthesized
aattcttatggaagtataaa

SEQ ID NO: 134563 - DNA, 20 bp, Artificial Sequence
  chemically synthesized
caaattcttatggaagtata

SEQ ID NO: 134564 - DNA, 20 bp, Artificial Sequence
  chemically synthesized
ctatctctttatacttccat

SEQ ID NO: 134565 - DNA, 20 bp, Artificial Sequence
  chemically synthesized
tactctacaaattcttatgg

SEQ ID NO: 134566 - DNA, 20 bp, Artificial Sequence
  chemically synthesized
agttactctacaaattctta

SEQ ID NO: 134567 - DNA, 20 bp, Artificial Sequence
  chemically synthesized
tatacttccataagaatttg

SEQ ID NO: 134568 - DNA, 20 bp, Artificial Sequence
  chemically synthesized
tacttccataagaatttgta

SEQ ID NO: 134569 - DNA, 20 bp, Artificial Sequence
  chemically synthesized
taagaatttgtagagtaact

SEQ ID NO: 134570 - DNA, 20 bp, Artificial Sequence
  chemically synthesized
tttttattttgtatatgtct

SEQ ID NO: 134571 - DNA, 20 bp, Artificial Sequence
  chemically synthesized
ttagacatatacaaaataaa

SEQ ID NO: 134572 - DNA, 20 bp, Artificial Sequence
  chemically synthesized
atatacaaaataaaaagcta

SEQ ID NO: 134573 - DNA, 20 bp, Artificial Sequence
  chemically synthesized
tatacaaaataaaaagctaa

SEQ ID NO: 134574 - DNA, 20 bp, Artificial Sequence
  chemically synthesized
atacaaaataaaaagctaaa

SEQ ID NO: 134575 - DNA, 20 bp, Artificial Sequence
  chemically synthesized
tgtaggtctaatgaaccctt

SEQ ID NO: 134576 - DNA, 20 bp, Artificial Sequence
  chemically synthesized
taaaaagctaaagggttcat

SEQ ID NO: 134577 - DNA, 20 bp, Artificial Sequence
  chemically synthesized
aaagggttcattagacctac

SEQ ID NO: 134578 - DNA, 20 bp, Artificial Sequence
  chemically synthesized
aagggttcattagacctaca

SEQ ID NO: 134579 - DNA, 20 bp, Artificial Sequence
  chemically synthesized
gccattactgtttgccttgt

SEQ ID NO: 134580 - DNA, 20 bp, Artificial Sequence
  chemically synthesized
agccattactgtttgccttg

SEQ ID NO: 134581 - DNA, 20 bp, Artificial Sequence
  chemically synthesized
cattagacctacaaggcaaa

SEQ ID NO: 134582 - DNA, 20 bp, Artificial Sequence
  chemically synthesized
acctacaaggcaaacagtaa

SEQ ID NO: 134583 - DNA, 20 bp, Artificial Sequence
  chemically synthesized
acagtaatggctaatttccc

SEQ ID NO: 134584 - DNA, 20 bp, Artificial Sequence
  chemically synthesized
cctcagtataccagggaaat

SEQ ID NO: 134585 - DNA, 20 bp, Artificial Sequence
  chemically synthesized
atgcagccctcagtatacca

SEQ ID NO: 134586 - DNA, 20 bp, Artificial Sequence
  chemically synthesized
gatgcagccctcagtatacc

SEQ ID NO: 134587 - DNA, 20 bp, Artificial Sequence
  chemically synthesized
gctaatttccctggtatact

SEQ ID NO: 134588 - DNA, 20 bp, Artificial Sequence
  chemically synthesized
tgatgcagccctcagtatac

SEQ ID NO: 134589 - DNA, 20 bp, Artificial Sequence
  chemically synthesized
ctaatttccctggtatactg

SEQ ID NO: 134590 - DNA, 20 bp, Artificial Sequence
  chemically synthesized
taatttccctggtatactga

SEQ ID NO: 134591 - DNA, 20 bp, Artificial Sequence
  chemically synthesized
caggtttctgatgcagccct

SEQ ID NO: 134592 - DNA, 20 bp, Artificial Sequence
  chemically synthesized
tggtatactgagggctgcat

SEQ ID NO: 134593 - DNA, 20 bp, Artificial Sequence
  chemically synthesized
ggtagaccaggtttctgatg

SEQ ID NO: 134594 - DNA, 20 bp, Artificial Sequence
  chemically synthesized
tgagggctgcatcagaaacc

SEQ ID NO: 134595 - DNA, 20 bp, Artificial Sequence
  chemically synthesized
ttgttgtgtttaggtagacc

SEQ ID NO: 134596 - DNA, 20 bp, Artificial Sequence
  chemically synthesized
attgttgtgtttaggtagac

SEQ ID NO: 134597 - DNA, 20 bp, Artificial Sequence
  chemically synthesized
taaagattgttgtgtttagg

SEQ ID NO: 134598 - DNA, 20 bp, Artificial Sequence
  chemically synthesized
gattaaagattgttgtgttt

SEQ ID NO: 134599 - DNA, 20 bp, Artificial Sequence
  chemically synthesized
ggattaaagattgttgtgtt

SEQ ID NO: 134600 - DNA, 20 bp, Artificial Sequence
  chemically synthesized
acacaacaatctttaatcct

SEQ ID NO: 134601 - DNA, 20 bp, Artificial Sequence
  chemically synthesized
aactctttagctgaggatta

SEQ ID NO: 134602 - DNA, 20 bp, Artificial Sequence
  chemically synthesized
caatctttaatcctcagcta

SEQ ID NO: 134603 - DNA, 20 bp, Artificial Sequence
  chemically synthesized
gtatagaaactctttagctg

SEQ ID NO: 134604 - DNA, 20 bp, Artificial Sequence
  chemically synthesized
atctttaatcctcagctaaa

SEQ ID NO: 134605 - DNA, 20 bp, Artificial Sequence
  chemically synthesized
agtatagaaactctttagct

SEQ ID NO: 134606 - DNA, 20 bp, Artificial Sequence
  chemically synthesized
aataaagtatagaaactctt

SEQ ID NO: 134607 - DNA, 20 bp, Artificial Sequence
  chemically synthesized
atgataccatgaataaagta

SEQ ID NO: 134608 - DNA, 20 bp, Artificial Sequence
  chemically synthesized
gagtttctatactttattca

SEQ ID NO: 134609 - DNA, 20 bp, Artificial Sequence
  chemically synthesized
tcttaatgataccatgaata

SEQ ID NO: 134610 - DNA, 20 bp, Artificial Sequence
  chemically synthesized
actttattcatggtatcatt

SEQ ID NO: 134611 - DNA, 20 bp, Artificial Sequence
  chemically synthesized
ttcatggtatcattaagaac

SEQ ID NO: 134612 - DNA, 20 bp, Artificial Sequence
  chemically synthesized
tcatggtatcattaagaacc

SEQ ID NO: 134613 - DNA, 20 bp, Artificial Sequence
  chemically synthesized
aagtaacataagtttcatcc

SEQ ID NO: 134614 - DNA, 20 bp, Artificial Sequence
  chemically synthesized
tacaaccattcaagtaacat

SEQ ID NO: 134615 - DNA, 20 bp, Artificial Sequence
  chemically synthesized
tgaaacttatgttacttgaa

SEQ ID NO: 134616 - DNA, 20 bp, Artificial Sequence
  chemically synthesized
ctgctgctgtacaaccattc

SEQ ID NO: 134617 - DNA, 20 bp, Artificial Sequence
  chemically synthesized
atgttacttgaatggttgta

SEQ ID NO: 134618 - DNA, 20 bp, Artificial Sequence
  chemically synthesized
ttacttgaatggttgtacag

SEQ ID NO: 134619 - DNA, 20 bp, Artificial Sequence
  chemically synthesized
cttgaatggttgtacagcag

SEQ ID NO: 134620 - DNA, 20 bp, Artificial Sequence
  chemically synthesized
tggttgtacagcagcagaaa

SEQ ID NO: 134621 - DNA, 20 bp, Artificial Sequence
  chemically synthesized
ggttgtacagcagcagaaaa

SEQ ID NO: 134622 - DNA, 20 bp, Artificial Sequence
  chemically synthesized
agcagaaaaaggaaaccata

SEQ ID NO: 134623 - DNA, 20 bp, Artificial Sequence
  chemically synthesized
aaaaaggaaaccatacagtg

SEQ ID NO: 134624 - DNA, 20 bp, Artificial Sequence
  chemically synthesized
tttatagatgctacactgta

SEQ ID NO: 134625 - DNA, 20 bp, Artificial Sequence
  chemically synthesized
cagcctaaataatgaattta

SEQ ID NO: 134626 - DNA, 20 bp, Artificial Sequence
  chemically synthesized
gcatctataaattcattatt

SEQ ID NO: 134627 - DNA, 20 bp, Artificial Sequence
  chemically synthesized
catctataaattcattattt

SEQ ID NO: 134628 - DNA, 20 bp, Artificial Sequence
  chemically synthesized
tataaattcattatttaggc

SEQ ID NO: 134629 - DNA, 20 bp, Artificial Sequence
  chemically synthesized
ataaattcattatttaggct

SEQ ID NO: 134630 - DNA, 20 bp, Artificial Sequence
  chemically synthesized
ttcattatttaggctgggcg

SEQ ID NO: 134631 - DNA, 20 bp, Artificial Sequence
  chemically synthesized
attatttaggctgggcgcgg

SEQ ID NO: 134632 - DNA, 20 bp, Artificial Sequence
  chemically synthesized
cagacctgagccaccgcgcc

SEQ ID NO: 134633 - DNA, 20 bp, Artificial Sequence
  chemically synthesized
ttaggctgggcgcggtggct

SEQ ID NO: 134634 - DNA, 20 bp, Artificial Sequence
  chemically synthesized
taggctgggcgcggtggctc

SEQ ID NO: 134635 - DNA, 20 bp, Artificial Sequence
  chemically synthesized
agtgctgggattacagacct

SEQ ID NO: 134636 - DNA, 20 bp, Artificial Sequence
  chemically synthesized
gtggctcaggtctgtaatcc

SEQ ID NO: 134637 - DNA, 20 bp, Artificial Sequence
  chemically synthesized
ctcccaaagtgctgggatta

SEQ ID NO: 134638 - DNA, 20 bp, Artificial Sequence
  chemically synthesized
ggtctgtaatcccagcactt

SEQ ID NO: 134639 - DNA, 20 bp, Artificial Sequence
  chemically synthesized
cctcggcctcccaaagtgct

SEQ ID NO: 134640 - DNA, 20 bp, Artificial Sequence
  chemically synthesized
gtctgtaatcccagcacttt

SEQ ID NO: 134641 - DNA, 20 bp, Artificial Sequence
  chemically synthesized
gcctcggcctcccaaagtgc

SEQ ID NO: 134642 - DNA, 20 bp, Artificial Sequence
  chemically synthesized
ctgtaatcccagcactttgg

SEQ ID NO: 134643 - DNA, 20 bp, Artificial Sequence
  chemically synthesized
tgtaatcccagcactttggg

SEQ ID NO: 134644 - DNA, 20 bp, Artificial Sequence
  chemically synthesized
ccacccgcctcggcctccca

SEQ ID NO: 134645 - DNA, 20 bp, Artificial Sequence
  chemically synthesized
tcccagcactttgggaggcc

SEQ ID NO: 134646 - DNA, 20 bp, Artificial Sequence
  chemically synthesized
cccagcactttgggaggccg

SEQ ID NO: 134647 - DNA, 20 bp, Artificial Sequence
  chemically synthesized
agcactttgggaggccgagg

SEQ ID NO: 134648 - DNA, 20 bp, Artificial Sequence
  chemically synthesized
gcactttgggaggccgaggc

SEQ ID NO: 134649 - DNA, 20 bp, Artificial Sequence
  chemically synthesized
ctttgggaggccgaggcggg

SEQ ID NO: 134650 - DNA, 20 bp, Artificial Sequence
  chemically synthesized
ttcaggtgatccacccgcct

SEQ ID NO: 134651 - DNA, 20 bp, Artificial Sequence
  chemically synthesized
cgaggcgggtggatcacctg

SEQ ID NO: 134652 - DNA, 20 bp, Artificial Sequence
  chemically synthesized
cgggtggatcacctgaagtc

SEQ ID NO: 134653 - DNA, 20 bp, Artificial Sequence
  chemically synthesized
ggtctcaaactcttgacttc

SEQ ID NO: 134654 - DNA, 20 bp, Artificial Sequence
  chemically synthesized
ggtggatcacctgaagtcaa

SEQ ID NO: 134655 - DNA, 20 bp, Artificial Sequence
  chemically synthesized
tggtctcaaactcttgactt

SEQ ID NO: 134656 - DNA, 20 bp, Artificial Sequence
  chemically synthesized
tcacctgaagtcaagagttt

SEQ ID NO: 134657 - DNA, 20 bp, Artificial Sequence
  chemically synthesized
tgaagtcaagagtttgagac

SEQ ID NO: 134658 - DNA, 20 bp, Artificial Sequence
  chemically synthesized
tcaagagtttgagaccagcc

SEQ ID NO: 134659 - DNA, 20 bp, Artificial Sequence
  chemically synthesized
tttcgtcatgttggccaggc

SEQ ID NO: 134660 - DNA, 20 bp, Artificial Sequence
  chemically synthesized
ggggtttcgtcatgttggcc

SEQ ID NO: 134661 - DNA, 20 bp, Artificial Sequence
  chemically synthesized
cggggtttcgtcatgttggc

SEQ ID NO: 134662 - DNA, 20 bp, Artificial Sequence
  chemically synthesized
gggacggggtttcgtcatgt

SEQ ID NO: 134663 - DNA, 20 bp, Artificial Sequence
  chemically synthesized
ttgtatttttagtagggacg

SEQ ID NO: 134664 - DNA, 20 bp, Artificial Sequence
  chemically synthesized
tttgtatttttagtagggac

SEQ ID NO: 134665 - DNA, 20 bp, Artificial Sequence
  chemically synthesized
ttttgtatttttagtaggga

SEQ ID NO: 134666 - DNA, 20 bp, Artificial Sequence
  chemically synthesized
atttttttgtatttttagta

SEQ ID NO: 134667 - DNA, 20 bp, Artificial Sequence
  chemically synthesized
aatttttttgtatttttagt

SEQ ID NO: 134668 - DNA, 20 bp, Artificial Sequence
  chemically synthesized
taatttttttgtatttttag

SEQ ID NO: 134669 - DNA, 20 bp, Artificial Sequence
  chemically synthesized
agctaatttttttgtatttt

SEQ ID NO: 134670 - DNA, 20 bp, Artificial Sequence
  chemically synthesized
tactaaaaatacaaaaaaat

SEQ ID NO: 134671 - DNA, 20 bp, Artificial Sequence
  chemically synthesized
aaaaatacaaaaaaattagc

SEQ ID NO: 134672 - DNA, 20 bp, Artificial Sequence
  chemically synthesized
aaaatacaaaaaaattagct

SEQ ID NO: 134673 - DNA, 20 bp, Artificial Sequence
  chemically synthesized
aaaaaattagctgggcatga

SEQ ID NO: 134674 - DNA, 20 bp, Artificial Sequence
  chemically synthesized
caggctcccaccatcatgcc

SEQ ID NO: 134675 - DNA, 20 bp, Artificial Sequence
  chemically synthesized
aaattagctgggcatgatgg

SEQ ID NO: 134676 - DNA, 20 bp, Artificial Sequence
  chemically synthesized
aattagctgggcatgatggt

SEQ ID NO: 134677 - DNA, 20 bp, Artificial Sequence
  chemically synthesized
ttagctgggcatgatggtgg

SEQ ID NO: 134678 - DNA, 20 bp, Artificial Sequence
  chemically synthesized
atggtgggagcctgtaatgc

SEQ ID NO: 134679 - DNA, 20 bp, Artificial Sequence
  chemically synthesized
taccgagtagctggcattac

SEQ ID NO: 134680 - DNA, 20 bp, Artificial Sequence
  chemically synthesized
ctaccgagtagctggcatta

SEQ ID NO: 134681 - DNA, 20 bp, Artificial Sequence
  chemically synthesized
agcctgtaatgccagctact

SEQ ID NO: 134682 - DNA, 20 bp, Artificial Sequence
  chemically synthesized
gcctcagcctaccgagtagc

SEQ ID NO: 134683 - DNA, 20 bp, Artificial Sequence
  chemically synthesized
ctgtaatgccagctactcgg

SEQ ID NO: 134684 - DNA, 20 bp, Artificial Sequence
  chemically synthesized
tgtaatgccagctactcggt

SEQ ID NO: 134685 - DNA, 20 bp, Artificial Sequence
  chemically synthesized
tcttgcctcagcctaccgag

SEQ ID NO: 134686 - DNA, 20 bp, Artificial Sequence
  chemically synthesized
ttctcttgcctcagcctacc

SEQ ID NO: 134687 - DNA, 20 bp, Artificial Sequence
  chemically synthesized
tgccagctactcggtaggct

SEQ ID NO: 134688 - DNA, 20 bp, Artificial Sequence
  chemically synthesized
gccagctactcggtaggctg

SEQ ID NO: 134689 - DNA, 20 bp, Artificial Sequence
  chemically synthesized
gctactcggtaggctgaggc

SEQ ID NO: 134690 - DNA, 20 bp, Artificial Sequence
  chemically synthesized
tactcggtaggctgaggcaa

SEQ ID NO: 134691 - DNA, 20 bp, Artificial Sequence
  chemically synthesized
ttcaagctattctcttgcct

SEQ ID NO: 134692 - DNA, 20 bp, Artificial Sequence
  chemically synthesized
ggtaggctgaggcaagagaa

SEQ ID NO: 134693 - DNA, 20 bp, Artificial Sequence
  chemically synthesized
gcaagagaatagcttgaatc

SEQ ID NO: 134694 - DNA, 20 bp, Artificial Sequence
  chemically synthesized
caagagaatagcttgaatct

SEQ ID NO: 134695 - DNA, 20 bp, Artificial Sequence
  chemically synthesized
caactccgcctcccagattc

SEQ ID NO: 134696 - DNA, 20 bp, Artificial Sequence
  chemically synthesized
agagaatagcttgaatctgg

SEQ ID NO: 134697 - DNA, 20 bp, Artificial Sequence
  chemically synthesized
gagaatagcttgaatctggg

SEQ ID NO: 134698 - DNA, 20 bp, Artificial Sequence
  chemically synthesized
aatagcttgaatctgggagg

SEQ ID NO: 134699 - DNA, 20 bp, Artificial Sequence
  chemically synthesized
tagcttgaatctgggaggcg

SEQ ID NO: 134700 - DNA, 20 bp, Artificial Sequence
  chemically synthesized
ctcactgcaactccgcctcc

SEQ ID NO: 134701 - DNA, 20 bp, Artificial Sequence
  chemically synthesized
gaatctgggaggcggagttg

SEQ ID NO: 134702 - DNA, 20 bp, Artificial Sequence
  chemically synthesized
ctgggaggcggagttgcagt

SEQ ID NO: 134703 - DNA, 20 bp, Artificial Sequence
  chemically synthesized
aggcggagttgcagtgagca

SEQ ID NO: 134704 - DNA, 20 bp, Artificial Sequence
  chemically synthesized
ggagttgcagtgagcaaaga

SEQ ID NO: 134705 - DNA, 20 bp, Artificial Sequence
  chemically synthesized
ttgcccaggctggagtgcag

SEQ ID NO: 134706 - DNA, 20 bp, Artificial Sequence
  chemically synthesized
aagatggcaccactgcactc

SEQ ID NO: 134707 - DNA, 20 bp, Artificial Sequence
  chemically synthesized
ccattgcccaggctggagtg

SEQ ID NO: 134708 - DNA, 20 bp, Artificial Sequence
  chemically synthesized
ggcaccactgcactccagcc

SEQ ID NO: 134709 - DNA, 20 bp, Artificial Sequence
  chemically synthesized
gcaccactgcactccagcct

SEQ ID NO: 134710 - DNA, 20 bp, Artificial Sequence
  chemically synthesized
ctgctccattgcccaggctg

SEQ ID NO: 134711 - DNA, 20 bp, Artificial Sequence
  chemically synthesized
tcctgctccattgcccaggc

SEQ ID NO: 134712 - DNA, 20 bp, Artificial Sequence
  chemically synthesized
ctgcactccagcctgggcaa

SEQ ID NO: 134713 - DNA, 20 bp, Artificial Sequence
  chemically synthesized
agagtcctgctccattgccc

SEQ ID NO: 134714 - DNA, 20 bp, Artificial Sequence
  chemically synthesized
gcactccagcctgggcaatg

SEQ ID NO: 134715 - DNA, 20 bp, Artificial Sequence
  chemically synthesized
cagagtcctgctccattgcc

SEQ ID NO: 134716 - DNA, 20 bp, Artificial Sequence
  chemically synthesized
ctccagcctgggcaatggag

SEQ ID NO: 134717 - DNA, 20 bp, Artificial Sequence
  chemically synthesized
tccagcctgggcaatggagc

SEQ ID NO: 134718 - DNA, 20 bp, Artificial Sequence
  chemically synthesized
ataattttttttttgagaca

SEQ ID NO: 134719 - DNA, 20 bp, Artificial Sequence
  chemically synthesized
taataattttttttttgaga

SEQ ID NO: 134720 - DNA, 20 bp, Artificial Sequence
  chemically synthesized
tgaataataatttttttttt

SEQ ID NO: 134721 - DNA, 20 bp, Artificial Sequence
  chemically synthesized
tcaaaaaaaaaattattatt

SEQ ID NO: 134722 - DNA, 20 bp, Artificial Sequence
  chemically synthesized
acttacaatatagaagcatt

SEQ ID NO: 134723 - DNA, 20 bp, Artificial Sequence
  chemically synthesized
cctgccaacttacaatatag

SEQ ID NO: 134724 - DNA, 20 bp, Artificial Sequence
  chemically synthesized
tctaaatgcttctatattgt

SEQ ID NO: 134725 - DNA, 20 bp, Artificial Sequence
  chemically synthesized
aaccctgccaacttacaata

SEQ ID NO: 134726 - DNA, 20 bp, Artificial Sequence
  chemically synthesized
aatgcttctatattgtaagt

SEQ ID NO: 134727 - DNA, 20 bp, Artificial Sequence
  chemically synthesized
gcttctatattgtaagttgg

SEQ ID NO: 134728 - DNA, 20 bp, Artificial Sequence
  chemically synthesized
cttctatattgtaagttggc

SEQ ID NO: 134729 - DNA, 20 bp, Artificial Sequence
  chemically synthesized
ttctatattgtaagttggca

SEQ ID NO: 134730 - DNA, 20 bp, Artificial Sequence
  chemically synthesized
atattgtaagttggcagggt

SEQ ID NO: 134731 - DNA, 20 bp, Artificial Sequence
  chemically synthesized
tattgtaagttggcagggtt

SEQ ID NO: 134732 - DNA, 20 bp, Artificial Sequence
  chemically synthesized
attgtaagttggcagggttg

SEQ ID NO: 134733 - DNA, 20 bp, Artificial Sequence
  chemically synthesized
ttgtaagttggcagggttgg

SEQ ID NO: 134734 - DNA, 20 bp, Artificial Sequence
  chemically synthesized
tggcagggttgggggttgtg

SEQ ID NO: 134735 - DNA, 20 bp, Artificial Sequence
  chemically synthesized
ggcagggttgggggttgtgt

SEQ ID NO: 134736 - DNA, 20 bp, Artificial Sequence
  chemically synthesized
gcagggttgggggttgtgtg

SEQ ID NO: 134737 - DNA, 20 bp, Artificial Sequence
  chemically synthesized
cagggttgggggttgtgtgg

SEQ ID NO: 134738 - DNA, 20 bp, Artificial Sequence
  chemically synthesized
agggttgggggttgtgtggg

SEQ ID NO: 134739 - DNA, 20 bp, Artificial Sequence
  chemically synthesized
gttgggggttgtgtgggggg

SEQ ID NO: 134740 - DNA, 20 bp, Artificial Sequence
  chemically synthesized
ttgggggttgtgtggggggt

SEQ ID NO: 134741 - DNA, 20 bp, Artificial Sequence
  chemically synthesized
ggggttgtgtggggggtggg

SEQ ID NO: 134742 - DNA, 20 bp, Artificial Sequence
  chemically synthesized
ttaaggaatttgagaagagg

SEQ ID NO: 134743 - DNA, 20 bp, Artificial Sequence
  chemically synthesized
catttaaggaatttgagaag

SEQ ID NO: 134744 - DNA, 20 bp, Artificial Sequence
  chemically synthesized
acatttaaggaatttgagaa

SEQ ID NO: 134745 - DNA, 20 bp, Artificial Sequence
  chemically synthesized
ttacatttaaggaatttgag

SEQ ID NO: 134746 - DNA, 20 bp, Artificial Sequence
  chemically synthesized
ggtttacatttaaggaattt

SEQ ID NO: 134747 - DNA, 20 bp, Artificial Sequence
  chemically synthesized
tagaagttggtttacattta

SEQ ID NO: 134748 - DNA, 20 bp, Artificial Sequence
  chemically synthesized
ctagaagttggtttacattt

SEQ ID NO: 134749 - DNA, 20 bp, Artificial Sequence
  chemically synthesized
cttaaatgtaaaccaacttc

SEQ ID NO: 134750 - DNA, 20 bp, Artificial Sequence
  chemically synthesized
ttaaatgtaaaccaacttct

SEQ ID NO: 134751 - DNA, 20 bp, Artificial Sequence
  chemically synthesized
ctaggaaaaagcctagaagt

SEQ ID NO: 134752 - DNA, 20 bp, Artificial Sequence
  chemically synthesized
gaacctaggaaaaagcctag

SEQ ID NO: 134753 - DNA, 20 bp, Artificial Sequence
  chemically synthesized
agtgaacctaggaaaaagcc

SEQ ID NO: 134754 - DNA, 20 bp, Artificial Sequence
  chemically synthesized
ccaacttctaggctttttcc

SEQ ID NO: 134755 - DNA, 20 bp, Artificial Sequence
  chemically synthesized
caacttctaggctttttcct

SEQ ID NO: 134756 - DNA, 20 bp, Artificial Sequence
  chemically synthesized
agaaaagtgaacctaggaaa

SEQ ID NO: 134757 - DNA, 20 bp, Artificial Sequence
  chemically synthesized
gtgcaaagaaaagtgaacct

SEQ ID NO: 134758 - DNA, 20 bp, Artificial Sequence
  chemically synthesized
ggtgcaaagaaaagtgaacc

SEQ ID NO: 134759 - DNA, 20 bp, Artificial Sequence
  chemically synthesized
agggtacctggtgcaaagaa

SEQ ID NO: 134760 - DNA, 20 bp, Artificial Sequence
  chemically synthesized
aggttcacttttctttgcac

SEQ ID NO: 134761 - DNA, 20 bp, Artificial Sequence
  chemically synthesized
ggttcacttttctttgcacc

SEQ ID NO: 134762 - DNA, 20 bp, Artificial Sequence
  chemically synthesized
gagagagggtacctggtgca

SEQ ID NO: 134763 - DNA, 20 bp, Artificial Sequence
  chemically synthesized
ttgcacagagagagggtacc

SEQ ID NO: 134764 - DNA, 20 bp, Artificial Sequence
  chemically synthesized
tctgagcttgcacagagaga

SEQ ID NO: 134765 - DNA, 20 bp, Artificial Sequence
  chemically synthesized
gtctgagcttgcacagagag

SEQ ID NO: 134766 - DNA, 20 bp, Artificial Sequence
  chemically synthesized
tgtctgagcttgcacagaga

SEQ ID NO: 134767 - DNA, 20 bp, Artificial Sequence
  chemically synthesized
caggtaccctctctctgtgc

SEQ ID NO: 134768 - DNA, 20 bp, Artificial Sequence
  chemically synthesized
aatgtctgagcttgcacaga

SEQ ID NO: 134769 - DNA, 20 bp, Artificial Sequence
  chemically synthesized
ggaatgtctgagcttgcaca

SEQ ID NO: 134770 - DNA, 20 bp, Artificial Sequence
  chemically synthesized
ctggaatgtctgagcttgca

SEQ ID NO: 134771 - DNA, 20 bp, Artificial Sequence
  chemically synthesized
accctctctctgtgcaagct

SEQ ID NO: 134772 - DNA, 20 bp, Artificial Sequence
  chemically synthesized
aaaagttacctggaatgtct

SEQ ID NO: 134773 - DNA, 20 bp, Artificial Sequence
  chemically synthesized
ctgtgcaagctcagacattc

SEQ ID NO: 134774 - DNA, 20 bp, Artificial Sequence
  chemically synthesized
tgtgcaagctcagacattcc

SEQ ID NO: 134775 - DNA, 20 bp, Artificial Sequence
  chemically synthesized
acaagaattcaaaagttacc

SEQ ID NO: 134776 - DNA, 20 bp, Artificial Sequence
  chemically synthesized
acttttggacaagaattcaa

SEQ ID NO: 134777 - DNA, 20 bp, Artificial Sequence
  chemically synthesized
acttttgaattcttgtccaa

SEQ ID NO: 134778 - DNA, 20 bp, Artificial Sequence
  chemically synthesized
gagtgatgttacttttggac

SEQ ID NO: 134779 - DNA, 20 bp, Artificial Sequence
  chemically synthesized
tgcaggagtgatgttacttt

SEQ ID NO: 134780 - DNA, 20 bp, Artificial Sequence
  chemically synthesized
tgaaaacatagagattgcag

SEQ ID NO: 134781 - DNA, 20 bp, Artificial Sequence
  chemically synthesized
gttgaaaacatagagattgc

SEQ ID NO: 134782 - DNA, 20 bp, Artificial Sequence
  chemically synthesized
ggttgaaaacatagagattg

SEQ ID NO: 134783 - DNA, 20 bp, Artificial Sequence
  chemically synthesized
aagaaatggttgaaaacata

SEQ ID NO: 134784 - DNA, 20 bp, Artificial Sequence
  chemically synthesized
taaagaaatggttgaaaaca

SEQ ID NO: 134785 - DNA, 20 bp, Artificial Sequence
  chemically synthesized
atactgagattttaaagaaa

SEQ ID NO: 134786 - DNA, 20 bp, Artificial Sequence
  chemically synthesized
atgaccatactgagatttta

SEQ ID NO: 134787 - DNA, 20 bp, Artificial Sequence
  chemically synthesized
caaccatttctttaaaatct

SEQ ID NO: 134788 - DNA, 20 bp, Artificial Sequence
  chemically synthesized
atttctttaaaatctcagta

SEQ ID NO: 134789 - DNA, 20 bp, Artificial Sequence
  chemically synthesized
tgaagctagatgaccatact

SEQ ID NO: 134790 - DNA, 20 bp, Artificial Sequence
  chemically synthesized
aaaatctcagtatggtcatc

SEQ ID NO: 134791 - DNA, 20 bp, Artificial Sequence
  chemically synthesized
taatgtgcttaacatgaagc

SEQ ID NO: 134792 - DNA, 20 bp, Artificial Sequence
  chemically synthesized
tggtcatctagcttcatgtt

SEQ ID NO: 134793 - DNA, 20 bp, Artificial Sequence
  chemically synthesized
aaagtaatgtgcttaacatg

SEQ ID NO: 134794 - DNA, 20 bp, Artificial Sequence
  chemically synthesized
ggagttgattatgggagaca

SEQ ID NO: 134795 - DNA, 20 bp, Artificial Sequence
  chemically synthesized
ggataaggagttgattatgg

SEQ ID NO: 134796 - DNA, 20 bp, Artificial Sequence
  chemically synthesized
caggataaggagttgattat

SEQ ID NO: 134797 - DNA, 20 bp, Artificial Sequence
  chemically synthesized
tcaggataaggagttgatta

SEQ ID NO: 134798 - DNA, 20 bp, Artificial Sequence
  chemically synthesized
agagacaaactcaggataag

SEQ ID NO: 134799 - DNA, 20 bp, Artificial Sequence
  chemically synthesized
cataatcaactccttatcct

SEQ ID NO: 134800 - DNA, 20 bp, Artificial Sequence
  chemically synthesized
ccagagacaaactcaggata

SEQ ID NO: 134801 - DNA, 20 bp, Artificial Sequence
  chemically synthesized
accagagacaaactcaggat

SEQ ID NO: 134802 - DNA, 20 bp, Artificial Sequence
  chemically synthesized
tcataaccagagacaaactc

SEQ ID NO: 134803 - DNA, 20 bp, Artificial Sequence
  chemically synthesized
gtcataaccagagacaaact

SEQ ID NO: 134804 - DNA, 20 bp, Artificial Sequence
  chemically synthesized
ccttatcctgagtttgtctc

SEQ ID NO: 134805 - DNA, 20 bp, Artificial Sequence
  chemically synthesized
gaagattaatgtcataacca

SEQ ID NO: 134806 - DNA, 20 bp, Artificial Sequence
  chemically synthesized
tggaagattaatgtcataac

SEQ ID NO: 134807 - DNA, 20 bp, Artificial Sequence
  chemically synthesized
gttatgacattaatcttcca

SEQ ID NO: 134808 - DNA, 20 bp, Artificial Sequence
  chemically synthesized
ttggagattgaattctttgg

SEQ ID NO: 134809 - DNA, 20 bp, Artificial Sequence
  chemically synthesized
gagttggagattgaattctt

SEQ ID NO: 134810 - DNA, 20 bp, Artificial Sequence
  chemically synthesized
agaattcaatctccaactct

SEQ ID NO: 134811 - DNA, 20 bp, Artificial Sequence
  chemically synthesized
aggcctgcctctaagagttg

SEQ ID NO: 134812 - DNA, 20 bp, Artificial Sequence
  chemically synthesized
aattcaatctccaactctta

SEQ ID NO: 134813 - DNA, 20 bp, Artificial Sequence
  chemically synthesized
gaaggcctgcctctaagagt

SEQ ID NO: 134814 - DNA, 20 bp, Artificial Sequence
  chemically synthesized
attcaatctccaactcttag

SEQ ID NO: 134815 - DNA, 20 bp, Artificial Sequence
  chemically synthesized
caatctccaactcttagagg

SEQ ID NO: 134816 - DNA, 20 bp, Artificial Sequence
  chemically synthesized
aagagaaggcctgcctctaa

SEQ ID NO: 134817 - DNA, 20 bp, Artificial Sequence
  chemically synthesized
aatctccaactcttagaggc

SEQ ID NO: 134818 - DNA, 20 bp, Artificial Sequence
  chemically synthesized
ctaagagaaggcctgcctct

SEQ ID NO: 134819 - DNA, 20 bp, Artificial Sequence
  chemically synthesized
cttagaggcaggccttctct

SEQ ID NO: 134820 - DNA, 20 bp, Artificial Sequence
  chemically synthesized
aaaactgtcaatctaagaga

SEQ ID NO: 134821 - DNA, 20 bp, Artificial Sequence
  chemically synthesized
taaaactgtcaatctaagag

SEQ ID NO: 134822 - DNA, 20 bp, Artificial Sequence
  chemically synthesized
atataaaactgtcaatctaa

SEQ ID NO: 134823 - DNA, 20 bp, Artificial Sequence
  chemically synthesized
caggccttctcttagattga

SEQ ID NO: 134824 - DNA, 20 bp, Artificial Sequence
  chemically synthesized
atatataaaactgtcaatct

SEQ ID NO: 134825 - DNA, 20 bp, Artificial Sequence
  chemically synthesized
aaggtggagctagaattaac

SEQ ID NO: 134826 - DNA, 20 bp, Artificial Sequence
  chemically synthesized
tgtcaaaatcctgttaattc

SEQ ID NO: 134827 - DNA, 20 bp, Artificial Sequence
  chemically synthesized
taaggtggagctagaattaa

SEQ ID NO: 134828 - DNA, 20 bp, Artificial Sequence
  chemically synthesized
attgagacataaggtggagc

SEQ ID NO: 134829 - DNA, 20 bp, Artificial Sequence
  chemically synthesized
tgaaattgagacataaggtg

SEQ ID NO: 134830 - DNA, 20 bp, Artificial Sequence
  chemically synthesized
agtgaaattgagacataagg

SEQ ID NO: 134831 - DNA, 20 bp, Artificial Sequence
  chemically synthesized
agaagtgaaattgagacata

SEQ ID NO: 134832 - DNA, 20 bp, Artificial Sequence
  chemically synthesized
aagaagtgaaattgagacat

SEQ ID NO: 134833 - DNA, 20 bp, Artificial Sequence
  chemically synthesized
aaaaagaaagaagtgaaatt

SEQ ID NO: 134834 - DNA, 20 bp, Artificial Sequence
  chemically synthesized
accatggagtaaaaagaaag

SEQ ID NO: 134835 - DNA, 20 bp, Artificial Sequence
  chemically synthesized
gtgaccatggagtaaaaaga

SEQ ID NO: 134836 - DNA, 20 bp, Artificial Sequence
  chemically synthesized
agcagtgaccatggagtaaa

SEQ ID NO: 134837 - DNA, 20 bp, Artificial Sequence
  chemically synthesized
acttctttctttttactcca

SEQ ID NO: 134838 - DNA, 20 bp, Artificial Sequence
  chemically synthesized
aagctggagcagtgaccatg

SEQ ID NO: 134839 - DNA, 20 bp, Artificial Sequence
  chemically synthesized
ccaagctggagcagtgacca

SEQ ID NO: 134840 - DNA, 20 bp, Artificial Sequence
  chemically synthesized
ttactccatggtcactgctc

SEQ ID NO: 134841 - DNA, 20 bp, Artificial Sequence
  chemically synthesized
caagagagcccaagctggag

SEQ ID NO: 134842 - DNA, 20 bp, Artificial Sequence
  chemically synthesized
ccatggtcactgctccagct

SEQ ID NO: 134843 - DNA, 20 bp, Artificial Sequence
  chemically synthesized
catggtcactgctccagctt

SEQ ID NO: 134844 - DNA, 20 bp, Artificial Sequence
  chemically synthesized
aggcaagagagcccaagctg

SEQ ID NO: 134845 - DNA, 20 bp, Artificial Sequence
  chemically synthesized
gaaggcaagagagcccaagc

SEQ ID NO: 134846 - DNA, 20 bp, Artificial Sequence
  chemically synthesized
gttagaaggcaagagagccc

SEQ ID NO: 134847 - DNA, 20 bp, Artificial Sequence
  chemically synthesized
agaccagttagaaggcaaga

SEQ ID NO: 134848 - DNA, 20 bp, Artificial Sequence
  chemically synthesized
taagaccagttagaaggcaa

SEQ ID NO: 134849 - DNA, 20 bp, Artificial Sequence
  chemically synthesized
agtaagaccagttagaaggc

SEQ ID NO: 134850 - DNA, 20 bp, Artificial Sequence
  chemically synthesized
gggctctcttgccttctaac

SEQ ID NO: 134851 - DNA, 20 bp, Artificial Sequence
  chemically synthesized
agtcagtaagaccagttaga

SEQ ID NO: 134852 - DNA, 20 bp, Artificial Sequence
  chemically synthesized
aagtcagtaagaccagttag

SEQ ID NO: 134853 - DNA, 20 bp, Artificial Sequence
  chemically synthesized
atgaagtcagtaagaccagt

SEQ ID NO: 134854 - DNA, 20 bp, Artificial Sequence
  chemically synthesized
gtaaatgaagtcagtaagac

SEQ ID NO: 134855 - DNA, 20 bp, Artificial Sequence
  chemically synthesized
agggagtaaatgaagtcagt

SEQ ID NO: 134856 - DNA, 20 bp, Artificial Sequence
  chemically synthesized
gataagggagtaaatgaagt

SEQ ID NO: 134857 - DNA, 20 bp, Artificial Sequence
  chemically synthesized
ggaggataagggagtaaatg

SEQ ID NO: 134858 - DNA, 20 bp, Artificial Sequence
  chemically synthesized
gtgtgttgtggaggataagg

SEQ ID NO: 134859 - DNA, 20 bp, Artificial Sequence
  chemically synthesized
gtgtgtgttgtggaggataa

SEQ ID NO: 134860 - DNA, 20 bp, Artificial Sequence
  chemically synthesized
tgtgtgtgttgtggaggata

SEQ ID NO: 134861 - DNA, 20 bp, Artificial Sequence
  chemically synthesized
gtgtgtgtgttgtggaggat

SEQ ID NO: 134862 - DNA, 20 bp, Artificial Sequence
  chemically synthesized
tgtgtgtgtgtgtgttgtgg

SEQ ID NO: 134863 - DNA, 20 bp, Artificial Sequence
  chemically synthesized
gtgtgtgtgtgtgtgttgtg

SEQ ID NO: 134864 - DNA, 20 bp, Artificial Sequence
  chemically synthesized
gtgtgtgtgtgtgtgtgttg

SEQ ID NO: 134865 - DNA, 20 bp, Artificial Sequence
  chemically synthesized
gaagacgaatatcagcatgg

SEQ ID NO: 134866 - DNA, 20 bp, Artificial Sequence
  chemically synthesized
tggaagacgaatatcagcat

SEQ ID NO: 134867 - DNA, 20 bp, Artificial Sequence
  chemically synthesized
gtggaagacgaatatcagca

SEQ ID NO: 134868 - DNA, 20 bp, Artificial Sequence
  chemically synthesized
gtggggtggaagacgaatat

SEQ ID NO: 134869 - DNA, 20 bp, Artificial Sequence
  chemically synthesized
acctgttaacagtggggtgg

SEQ ID NO: 134870 - DNA, 20 bp, Artificial Sequence
  chemically synthesized
tagacctgttaacagtgggg

SEQ ID NO: 134871 - DNA, 20 bp, Artificial Sequence
  chemically synthesized
aattagacctgttaacagtg

SEQ ID NO: 134872 - DNA, 20 bp, Artificial Sequence
  chemically synthesized
taattagacctgttaacagt

SEQ ID NO: 134873 - DNA, 20 bp, Artificial Sequence
  chemically synthesized
gtcttccaccccactgttaa

SEQ ID NO: 134874 - DNA, 20 bp, Artificial Sequence
  chemically synthesized
ataattagacctgttaacag

SEQ ID NO: 134875 - DNA, 20 bp, Artificial Sequence
  chemically synthesized
tcttccaccccactgttaac

SEQ ID NO: 134876 - DNA, 20 bp, Artificial Sequence
  chemically synthesized
tacataattagacctgttaa

SEQ ID NO: 134877 - DNA, 20 bp, Artificial Sequence
  chemically synthesized
atgacaggagaatacataat

SEQ ID NO: 134878 - DNA, 20 bp, Artificial Sequence
  chemically synthesized
atttcaggaattgatgacag

SEQ ID NO: 134879 - DNA, 20 bp, Artificial Sequence
  chemically synthesized
gtatttcaggaattgatgac

SEQ ID NO: 134880 - DNA, 20 bp, Artificial Sequence
  chemically synthesized
ggtatttcaggaattgatga

SEQ ID NO: 134881 - DNA, 20 bp, Artificial Sequence
  chemically synthesized
tggagagggaagggtatttc

SEQ ID NO: 134882 - DNA, 20 bp, Artificial Sequence
  chemically synthesized
ctggagagggaagggtattt

SEQ ID NO: 134883 - DNA, 20 bp, Artificial Sequence
  chemically synthesized
gaaggaagctggagagggaa

SEQ ID NO: 134884 - DNA, 20 bp, Artificial Sequence
  chemically synthesized
agaaggaagctggagaggga

SEQ ID NO: 134885 - DNA, 20 bp, Artificial Sequence
  chemically synthesized
ctgaaatacccttccctctc

SEQ ID NO: 134886 - DNA, 20 bp, Artificial Sequence
  chemically synthesized
cagaaggaagctggagaggg

SEQ ID NO: 134887 - DNA, 20 bp, Artificial Sequence
  chemically synthesized
aagcagaaggaagctggaga

SEQ ID NO: 134888 - DNA, 20 bp, Artificial Sequence
  chemically synthesized
aaagcagaaggaagctggag

SEQ ID NO: 134889 - DNA, 20 bp, Artificial Sequence
  chemically synthesized
aaaagcagaaggaagctgga

SEQ ID NO: 134890 - DNA, 20 bp, Artificial Sequence
  chemically synthesized
tgaaaagcagaaggaagctg

SEQ ID NO: 134891 - DNA, 20 bp, Artificial Sequence
  chemically synthesized
tttgaaaagcagaaggaagc

SEQ ID NO: 134892 - DNA, 20 bp, Artificial Sequence
  chemically synthesized
agactttgaaaagcagaagg

SEQ ID NO: 134893 - DNA, 20 bp, Artificial Sequence
  chemically synthesized
ataagactttgaaaagcaga

SEQ ID NO: 134894 - DNA, 20 bp, Artificial Sequence
  chemically synthesized
aataagactttgaaaagcag

SEQ ID NO: 134895 - DNA, 20 bp, Artificial Sequence
  chemically synthesized
cagcttccttctgcttttca

SEQ ID NO: 134896 - DNA, 20 bp, Artificial Sequence
  chemically synthesized
atgaataagactttgaaaag

SEQ ID NO: 134897 - DNA, 20 bp, Artificial Sequence
  chemically synthesized
gtcatgaataagactttgaa

SEQ ID NO: 134898 - DNA, 20 bp, Artificial Sequence
  chemically synthesized
aatttgacctggtcatgaat

SEQ ID NO: 134899 - DNA, 20 bp, Artificial Sequence
  chemically synthesized
ttcaaagtcttattcatgac

SEQ ID NO: 134900 - DNA, 20 bp, Artificial Sequence
  chemically synthesized
tcaaagtcttattcatgacc

SEQ ID NO: 134901 - DNA, 20 bp, Artificial Sequence
  chemically synthesized
ggaggaggctgaatttgacc

SEQ ID NO: 134902 - DNA, 20 bp, Artificial Sequence
  chemically synthesized
attcatgaccaggtcaaatt

SEQ ID NO: 134903 - DNA, 20 bp, Artificial Sequence
  chemically synthesized
ggtcaaattcagcctcctcc

SEQ ID NO: 134904 - DNA, 20 bp, Artificial Sequence
  chemically synthesized
agtggaatgcttccaggagg

SEQ ID NO: 134905 - DNA, 20 bp, Artificial Sequence
  chemically synthesized
caaattcagcctcctcctgg

SEQ ID NO: 134906 - DNA, 20 bp, Artificial Sequence
  chemically synthesized
tagtggaatgcttccaggag

SEQ ID NO: 134907 - DNA, 20 bp, Artificial Sequence
  chemically synthesized
cttagtggaatgcttccagg

SEQ ID NO: 134908 - DNA, 20 bp, Artificial Sequence
  chemically synthesized
gcttagtggaatgcttccag

SEQ ID NO: 134909 - DNA, 20 bp, Artificial Sequence
  chemically synthesized
gggcttagtggaatgcttcc

SEQ ID NO: 134910 - DNA, 20 bp, Artificial Sequence
  chemically synthesized
agggcttagtggaatgcttc

SEQ ID NO: 134911 - DNA, 20 bp, Artificial Sequence
  chemically synthesized
cctcctggaagcattccact

SEQ ID NO: 134912 - DNA, 20 bp, Artificial Sequence
  chemically synthesized
agttttaaatgagggcttag

SEQ ID NO: 134913 - DNA, 20 bp, Artificial Sequence
  chemically synthesized
aggagttttaaatgagggct

SEQ ID NO: 134914 - DNA, 20 bp, Artificial Sequence
  chemically synthesized
agaggaggagttttaaatga

SEQ ID NO: 134915 - DNA, 20 bp, Artificial Sequence
  chemically synthesized
tagaggaggagttttaaatg

SEQ ID NO: 134916 - DNA, 20 bp, Artificial Sequence
  chemically synthesized
ctagaggaggagttttaaat

SEQ ID NO: 134917 - DNA, 20 bp, Artificial Sequence
  chemically synthesized
ctcatttaaaactcctcctc

SEQ ID NO: 134918 - DNA, 20 bp, Artificial Sequence
  chemically synthesized
ttgagagaaaactagaggag

SEQ ID NO: 134919 - DNA, 20 bp, Artificial Sequence
  chemically synthesized
tgttgagagaaaactagagg

SEQ ID NO: 134920 - DNA, 20 bp, Artificial Sequence
  chemically synthesized
atgttgagagaaaactagag

SEQ ID NO: 134921 - DNA, 20 bp, Artificial Sequence
  chemically synthesized
aaatgttgagagaaaactag

SEQ ID NO: 134922 - DNA, 20 bp, Artificial Sequence
  chemically synthesized
aaaatgttgagagaaaacta

SEQ ID NO: 134923 - DNA, 20 bp, Artificial Sequence
  chemically synthesized
acaaaatgttgagagaaaac

SEQ ID NO: 134924 - DNA, 20 bp, Artificial Sequence
  chemically synthesized
gcagtattacaaaatgttga

SEQ ID NO: 134925 - DNA, 20 bp, Artificial Sequence
  chemically synthesized
gagcagtattacaaaatgtt

SEQ ID NO: 134926 - DNA, 20 bp, Artificial Sequence
  chemically synthesized
ggataggtgcttcagtagag

SEQ ID NO: 134927 - DNA, 20 bp, Artificial Sequence
  chemically synthesized
tttgtaatactgctctactg

SEQ ID NO: 134928 - DNA, 20 bp, Artificial Sequence
  chemically synthesized
ttaggataggtgcttcagta

SEQ ID NO: 134929 - DNA, 20 bp, Artificial Sequence
  chemically synthesized
gtttaggataggtgcttcag

SEQ ID NO: 134930 - DNA, 20 bp, Artificial Sequence
  chemically synthesized
gcagtttaggataggtgctt

SEQ ID NO: 134931 - DNA, 20 bp, Artificial Sequence
  chemically synthesized
taggcaaggcagtttaggat

SEQ ID NO: 134932 - DNA, 20 bp, Artificial Sequence
  chemically synthesized
ttaggcaaggcagtttagga

SEQ ID NO: 134933 - DNA, 20 bp, Artificial Sequence
  chemically synthesized
atatttaggcaaggcagttt

SEQ ID NO: 134934 - DNA, 20 bp, Artificial Sequence
  chemically synthesized
tatatttaggcaaggcagtt

SEQ ID NO: 134935 - DNA, 20 bp, Artificial Sequence
  chemically synthesized
acaagtatatttaggcaagg

SEQ ID NO: 134936 - DNA, 20 bp, Artificial Sequence
  chemically synthesized
tggacaagtatatttaggca

SEQ ID NO: 134937 - DNA, 20 bp, Artificial Sequence
  chemically synthesized
ttggacaagtatatttaggc

SEQ ID NO: 134938 - DNA, 20 bp, Artificial Sequence
  chemically synthesized
gtatttggacaagtatattt

SEQ ID NO: 134939 - DNA, 20 bp, Artificial Sequence
  chemically synthesized
ggtatttggacaagtatatt

SEQ ID NO: 134940 - DNA, 20 bp, Artificial Sequence
  chemically synthesized
tcaaatgtgggtatttggac

SEQ ID NO: 134941 - DNA, 20 bp, Artificial Sequence
  chemically synthesized
cacaatcaaatgtgggtatt

SEQ ID NO: 134942 - DNA, 20 bp, Artificial Sequence
  chemically synthesized
aagagctcacaatcaaatgt

SEQ ID NO: 134943 - DNA, 20 bp, Artificial Sequence
  chemically synthesized
aaagagctcacaatcaaatg

SEQ ID NO: 134944 - DNA, 20 bp, Artificial Sequence
  chemically synthesized
aaatacccacatttgattgt

SEQ ID NO: 134945 - DNA, 20 bp, Artificial Sequence
  chemically synthesized
atttgattgtgagctcttta

SEQ ID NO: 134946 - DNA, 20 bp, Artificial Sequence
  chemically synthesized
attcagcctttgtctttaaa

SEQ ID NO: 134947 - DNA, 20 bp, Artificial Sequence
  chemically synthesized
agattcagcctttgtcttta

SEQ ID NO: 134948 - DNA, 20 bp, Artificial Sequence
  chemically synthesized
ttgtgagctctttaaagaca

SEQ ID NO: 134949 - DNA, 20 bp, Artificial Sequence
  chemically synthesized
tgtgagctctttaaagacaa

SEQ ID NO: 134950 - DNA, 20 bp, Artificial Sequence
  chemically synthesized
tacaggaaaaaagtaagatt

SEQ ID NO: 134951 - DNA, 20 bp, Artificial Sequence
  chemically synthesized
aggggatacaggaaaaaagt

SEQ ID NO: 134952 - DNA, 20 bp, Artificial Sequence
  chemically synthesized
gtagaggggatacaggaaaa

SEQ ID NO: 134953 - DNA, 20 bp, Artificial Sequence
  chemically synthesized
agagatggtagaggggatac

SEQ ID NO: 134954 - DNA, 20 bp, Artificial Sequence
  chemically synthesized
cagagatggtagaggggata

SEQ ID NO: 134955 - DNA, 20 bp, Artificial Sequence
  chemically synthesized
taatatcagagatggtagag

SEQ ID NO: 134956 - DNA, 20 bp, Artificial Sequence
  chemically synthesized
ctaatatcagagatggtaga

SEQ ID NO: 134957 - DNA, 20 bp, Artificial Sequence
  chemically synthesized
tctaatatcagagatggtag

SEQ ID NO: 134958 - DNA, 20 bp, Artificial Sequence
  chemically synthesized
atctaatatcagagatggta

SEQ ID NO: 134959 - DNA, 20 bp, Artificial Sequence
  chemically synthesized
ctatctaatatcagagatgg

SEQ ID NO: 134960 - DNA, 20 bp, Artificial Sequence
  chemically synthesized
gtgctatctaatatcagaga

SEQ ID NO: 134961 - DNA, 20 bp, Artificial Sequence
  chemically synthesized
ccctctaccatctctgatat

SEQ ID NO: 134962 - DNA, 20 bp, Artificial Sequence
  chemically synthesized
ctctgtgctatctaatatca

SEQ ID NO: 134963 - DNA, 20 bp, Artificial Sequence
  chemically synthesized
tactctgtgctatctaatat

SEQ ID NO: 134964 - DNA, 20 bp, Artificial Sequence
  chemically synthesized
ctaccatctctgatattaga

SEQ ID NO: 134965 - DNA, 20 bp, Artificial Sequence
  chemically synthesized
atctctgatattagatagca

SEQ ID NO: 134966 - DNA, 20 bp, Artificial Sequence
  chemically synthesized
ctctgatattagatagcaca

SEQ ID NO: 134967 - DNA, 20 bp, Artificial Sequence
  chemically synthesized
tgatattagatagcacagag

SEQ ID NO: 134968 - DNA, 20 bp, Artificial Sequence
  chemically synthesized
gatattagatagcacagagt

SEQ ID NO: 134969 - DNA, 20 bp, Artificial Sequence
  chemically synthesized
ccaaagagttcagttcagtt

SEQ ID NO: 134970 - DNA, 20 bp, Artificial Sequence
  chemically synthesized
ggcaaccaaagagttcagtt

SEQ ID NO: 134971 - DNA, 20 bp, Artificial Sequence
  chemically synthesized
ctgaactgaactgaactctt

SEQ ID NO: 134972 - DNA, 20 bp, Artificial Sequence
  chemically synthesized
ccgctggcaaccaaagagtt

SEQ ID NO: 134973 - DNA, 20 bp, Artificial Sequence
  chemically synthesized
ggatgccgctggcaaccaaa

SEQ ID NO: 134974 - DNA, 20 bp, Artificial Sequence
  chemically synthesized
gaactgaactctttggttgc

SEQ ID NO: 134975 - DNA, 20 bp, Artificial Sequence
  chemically synthesized
taggatgccgctggcaacca

SEQ ID NO: 134976 - DNA, 20 bp, Artificial Sequence
  chemically synthesized
ctgaactctttggttgccag

SEQ ID NO: 134977 - DNA, 20 bp, Artificial Sequence
  chemically synthesized
cacatccactaggatgccgc

SEQ ID NO: 134978 - DNA, 20 bp, Artificial Sequence
  chemically synthesized
tttggttgccagcggcatcc

SEQ ID NO: 134979 - DNA, 20 bp, Artificial Sequence
  chemically synthesized
ggttgccagcggcatcctag

SEQ ID NO: 134980 - DNA, 20 bp, Artificial Sequence
  chemically synthesized
tctcaaaattcacatccact

SEQ ID NO: 134981 - DNA, 20 bp, Artificial Sequence
  chemically synthesized
ctctcaaaattcacatccac

SEQ ID NO: 134982 - DNA, 20 bp, Artificial Sequence
  chemically synthesized
tcctagtggatgtgaatttt

SEQ ID NO: 134983 - DNA, 20 bp, Artificial Sequence
  chemically synthesized
ctagtggatgtgaattttga

SEQ ID NO: 134984 - DNA, 20 bp, Artificial Sequence
  chemically synthesized
tgaattttgagagctgcttg

SEQ ID NO: 134985 - DNA, 20 bp, Artificial Sequence
  chemically synthesized
caacctgttatagctacaag

SEQ ID NO: 134986 - DNA, 20 bp, Artificial Sequence
  chemically synthesized
tgtcaacctgttatagctac

SEQ ID NO: 134987 - DNA, 20 bp, Artificial Sequence
  chemically synthesized
agagctgcttgtagctataa

SEQ ID NO: 134988 - DNA, 20 bp, Artificial Sequence
  chemically synthesized
gagctgcttgtagctataac

SEQ ID NO: 134989 - DNA, 20 bp, Artificial Sequence
  chemically synthesized
cacctgctgtcaacctgtta

SEQ ID NO: 134990 - DNA, 20 bp, Artificial Sequence
  chemically synthesized
ttgtagctataacaggttga

SEQ ID NO: 134991 - DNA, 20 bp, Artificial Sequence
  chemically synthesized
tagctataacaggttgacag

SEQ ID NO: 134992 - DNA, 20 bp, Artificial Sequence
  chemically synthesized
agctataacaggttgacagc

SEQ ID NO: 134993 - DNA, 20 bp, Artificial Sequence
  chemically synthesized
aacaggttgacagcaggtgc

SEQ ID NO: 134994 - DNA, 20 bp, Artificial Sequence
  chemically synthesized
aatttccttcttttgacatc

SEQ ID NO: 134995 - DNA, 20 bp, Artificial Sequence
  chemically synthesized
cagcaggtgctagatgtcaa

SEQ ID NO: 134996 - DNA, 20 bp, Artificial Sequence
  chemically synthesized
caggtgctagatgtcaaaag

SEQ ID NO: 134997 - DNA, 20 bp, Artificial Sequence
  chemically synthesized
aggtgctagatgtcaaaaga

SEQ ID NO: 134998 - DNA, 20 bp, Artificial Sequence
  chemically synthesized
tcaaaagaaggaaatttata

SEQ ID NO: 134999 - DNA, 20 bp, Artificial Sequence
  chemically synthesized
tgcttattttagaagaagtg

SEQ ID NO: 135000 - DNA, 20 bp, Artificial Sequence
  chemically synthesized
gttgcttattttagaagaag

SEQ ID NO: 135001 - DNA, 20 bp, Artificial Sequence
  chemically synthesized
atggttgcttattttagaag

SEQ ID NO: 135002 - DNA, 20 bp, Artificial Sequence
  chemically synthesized
gactccacttcttctaaaat

SEQ ID NO: 135003 - DNA, 20 bp, Artificial Sequence
  chemically synthesized
tagatggttgcttattttag

SEQ ID NO: 135004 - DNA, 20 bp, Artificial Sequence
  chemically synthesized
tattagatggttgcttattt

SEQ ID NO: 135005 - DNA, 20 bp, Artificial Sequence
  chemically synthesized
taaaataagcaaccatctaa

SEQ ID NO: 135006 - DNA, 20 bp, Artificial Sequence
  chemically synthesized
ctcaggtattgtctattaga

SEQ ID NO: 135007 - DNA, 20 bp, Artificial Sequence
  chemically synthesized
tcctctcaggtattgtctat

SEQ ID NO: 135008 - DNA, 20 bp, Artificial Sequence
  chemically synthesized
ccatctaatagacaatacct

SEQ ID NO: 135009 - DNA, 20 bp, Artificial Sequence
  chemically synthesized
atctaatagacaatacctga

SEQ ID NO: 135010 - DNA, 20 bp, Artificial Sequence
  chemically synthesized
tctaatagacaatacctgag

SEQ ID NO: 135011 - DNA, 20 bp, Artificial Sequence
  chemically synthesized
aatagacaatacctgagagg

SEQ ID NO: 135012 - DNA, 20 bp, Artificial Sequence
  chemically synthesized
ccagccagtatcttcctctc

SEQ ID NO: 135013 - DNA, 20 bp, Artificial Sequence
  chemically synthesized
gccagccagtatcttcctct

SEQ ID NO: 135014 - DNA, 20 bp, Artificial Sequence
  chemically synthesized
aatacctgagaggaagatac

SEQ ID NO: 135015 - DNA, 20 bp, Artificial Sequence
  chemically synthesized
cctgagaggaagatactggc

SEQ ID NO: 135016 - DNA, 20 bp, Artificial Sequence
  chemically synthesized
gttgctaatgaaatgccagc

SEQ ID NO: 135017 - DNA, 20 bp, Artificial Sequence
  chemically synthesized
ctctgttgctaatgaaatgc

SEQ ID NO: 135018 - DNA, 20 bp, Artificial Sequence
  chemically synthesized
gatactggctggcatttcat

SEQ ID NO: 135019 - DNA, 20 bp, Artificial Sequence
  chemically synthesized
ggctggcatttcattagcaa

SEQ ID NO: 135020 - DNA, 20 bp, Artificial Sequence
  chemically synthesized
ctggcatttcattagcaaca

SEQ ID NO: 135021 - DNA, 20 bp, Artificial Sequence
  chemically synthesized
acagagatttcatacaaatg

SEQ ID NO: 135022 - DNA, 20 bp, Artificial Sequence
  chemically synthesized
agagatttcatacaaatgtg

SEQ ID NO: 135023 - DNA, 20 bp, Artificial Sequence
  chemically synthesized
catacaaatgtggagaacaa

SEQ ID NO: 135024 - DNA, 20 bp, Artificial Sequence
  chemically synthesized
tacaaatgtggagaacaaca

SEQ ID NO: 135025 - DNA, 20 bp, Artificial Sequence
  chemically synthesized
tccttcatggcgaaataaaa

SEQ ID NO: 135026 - DNA, 20 bp, Artificial Sequence
  chemically synthesized
atccttcatggcgaaataaa

SEQ ID NO: 135027 - DNA, 20 bp, Artificial Sequence
  chemically synthesized
agcctttttatttcgccatg

SEQ ID NO: 135028 - DNA, 20 bp, Artificial Sequence
  chemically synthesized
gcctttttatttcgccatga

SEQ ID NO: 135029 - DNA, 20 bp, Artificial Sequence
  chemically synthesized
caaatctatgaaatccttca

SEQ ID NO: 135030 - DNA, 20 bp, Artificial Sequence
  chemically synthesized
tttcgccatgaaggatttca

SEQ ID NO: 135031 - DNA, 20 bp, Artificial Sequence
  chemically synthesized
catgaaggatttcatagatt

SEQ ID NO: 135032 - DNA, 20 bp, Artificial Sequence
  chemically synthesized
ggatttcatagatttggttg

SEQ ID NO: 135033 - DNA, 20 bp, Artificial Sequence
  chemically synthesized
ttggttgcagcaatgaatga

SEQ ID NO: 135034 - DNA, 20 bp, Artificial Sequence
  chemically synthesized
tggttgcagcaatgaatgat

SEQ ID NO: 135035 - DNA, 20 bp, Artificial Sequence
  chemically synthesized
caatgaatgatgggttgaca

SEQ ID NO: 135036 - DNA, 20 bp, Artificial Sequence
  chemically synthesized
attaactgacagttttatag

SEQ ID NO: 135037 - DNA, 20 bp, Artificial Sequence
  chemically synthesized
tgaattaactgacagtttta

SEQ ID NO: 135038 - DNA, 20 bp, Artificial Sequence
  chemically synthesized
caaagctgctataaaactgt

SEQ ID NO: 135039 - DNA, 20 bp, Artificial Sequence
  chemically synthesized
acgatttttgaattaactga

SEQ ID NO: 135040 - DNA, 20 bp, Artificial Sequence
  chemically synthesized
agttaattcaaaaatcgtgt

SEQ ID NO: 135041 - DNA, 20 bp, Artificial Sequence
  chemically synthesized
ttaattcaaaaatcgtgtga

SEQ ID NO: 135042 - DNA, 20 bp, Artificial Sequence
  chemically synthesized
tgtttttttttattctcata

SEQ ID NO: 135043 - DNA, 20 bp, Artificial Sequence
  chemically synthesized
ttttttttattctcatacag

SEQ ID NO: 135044 - DNA, 20 bp, Artificial Sequence
  chemically synthesized
gggagaatgttcttctgtat

SEQ ID NO: 135045 - DNA, 20 bp, Artificial Sequence
  chemically synthesized
tatacagggccatagaaggg

SEQ ID NO: 135046 - DNA, 20 bp, Artificial Sequence
  chemically synthesized
aagaacattctccccttcta

SEQ ID NO: 135047 - DNA, 20 bp, Artificial Sequence
  chemically synthesized
ggtatacagggccatagaag

SEQ ID NO: 135048 - DNA, 20 bp, Artificial Sequence
  chemically synthesized
tggtatacagggccatagaa

SEQ ID NO: 135049 - DNA, 20 bp, Artificial Sequence
  chemically synthesized
ctggtatacagggccataga

SEQ ID NO: 135050 - DNA, 20 bp, Artificial Sequence
  chemically synthesized
actggtatacagggccatag

SEQ ID NO: 135051 - DNA, 20 bp, Artificial Sequence
  chemically synthesized
agaactggtatacagggcca

SEQ ID NO: 135052 - DNA, 20 bp, Artificial Sequence
  chemically synthesized
ccttctatggccctgtatac

SEQ ID NO: 135053 - DNA, 20 bp, Artificial Sequence
  chemically synthesized
gcataaagaactggtataca

SEQ ID NO: 135054 - DNA, 20 bp, Artificial Sequence
  chemically synthesized
tgcataaagaactggtatac

SEQ ID NO: 135055 - DNA, 20 bp, Artificial Sequence
  chemically synthesized
ttgcataaagaactggtata

SEQ ID NO: 135056 - DNA, 20 bp, Artificial Sequence
  chemically synthesized
cattatattgcataaagaac

SEQ ID NO: 135057 - DNA, 20 bp, Artificial Sequence
  chemically synthesized
aattcacattatattgcata

SEQ ID NO: 135058 - DNA, 20 bp, Artificial Sequence
  chemically synthesized
agcttataaattttaagaaa

SEQ ID NO: 135059 - DNA, 20 bp, Artificial Sequence
  chemically synthesized
tagcttataaattttaagaa

SEQ ID NO: 135060 - DNA, 20 bp, Artificial Sequence
  chemically synthesized
agtgatagcttataaatttt

SEQ ID NO: 135061 - DNA, 20 bp, Artificial Sequence
  chemically synthesized
ttccttttcttaaaatttat

SEQ ID NO: 135062 - DNA, 20 bp, Artificial Sequence
  chemically synthesized
ttcttagagaaatttagtga

SEQ ID NO: 135063 - DNA, 20 bp, Artificial Sequence
  chemically synthesized
ccagaattcttagagaaatt

SEQ ID NO: 135064 - DNA, 20 bp, Artificial Sequence
  chemically synthesized
agctatcactaaatttctct

SEQ ID NO: 135065 - DNA, 20 bp, Artificial Sequence
  chemically synthesized
aacccagtccagaattctta

SEQ ID NO: 135066 - DNA, 20 bp, Artificial Sequence
  chemically synthesized
ctaaatttctctaagaattc

SEQ ID NO: 135067 - DNA, 20 bp, Artificial Sequence
  chemically synthesized
tcaacccagtccagaattct

SEQ ID NO: 135068 - DNA, 20 bp, Artificial Sequence
  chemically synthesized
tttctctaagaattctggac

SEQ ID NO: 135069 - DNA, 20 bp, Artificial Sequence
  chemically synthesized
ttctctaagaattctggact

SEQ ID NO: 135070 - DNA, 20 bp, Artificial Sequence
  chemically synthesized
aaggatttttcaacccagtc

SEQ ID NO: 135071 - DNA, 20 bp, Artificial Sequence
  chemically synthesized
cagctaaggatttttcaacc

SEQ ID NO: 135072 - DNA, 20 bp, Artificial Sequence
  chemically synthesized
ggactgggttgaaaaatcct

SEQ ID NO: 135073 - DNA, 20 bp, Artificial Sequence
  chemically synthesized
tggaattattttttcagcta

SEQ ID NO: 135074 - DNA, 20 bp, Artificial Sequence
  chemically synthesized
ttggaattattttttcagct

SEQ ID NO: 135075 - DNA, 20 bp, Artificial Sequence
  chemically synthesized
ttattttggaattatttttt

SEQ ID NO: 135076 - DNA, 20 bp, Artificial Sequence
  chemically synthesized
taagagggagtcgtttattt

SEQ ID NO: 135077 - DNA, 20 bp, Artificial Sequence
  chemically synthesized
gaattccaagttttaagagg

SEQ ID NO: 135078 - DNA, 20 bp, Artificial Sequence
  chemically synthesized
cagaattccaagttttaaga

SEQ ID NO: 135079 - DNA, 20 bp, Artificial Sequence
  chemically synthesized
acagaattccaagttttaag

SEQ ID NO: 135080 - DNA, 20 bp, Artificial Sequence
  chemically synthesized
aacagaattccaagttttaa

SEQ ID NO: 135081 - DNA, 20 bp, Artificial Sequence
  chemically synthesized
aacgactccctcttaaaact

SEQ ID NO: 135082 - DNA, 20 bp, Artificial Sequence
  chemically synthesized
gaaacagaattccaagtttt

SEQ ID NO: 135083 - DNA, 20 bp, Artificial Sequence
  chemically synthesized
gacttctgaaacagaattcc

SEQ ID NO: 135084 - DNA, 20 bp, Artificial Sequence
  chemically synthesized
taaaacttggaattctgttt

SEQ ID NO: 135085 - DNA, 20 bp, Artificial Sequence
  chemically synthesized
aacttggaattctgtttcag

SEQ ID NO: 135086 - DNA, 20 bp, Artificial Sequence
  chemically synthesized
caagggaaggacttctgaaa

SEQ ID NO: 135087 - DNA, 20 bp, Artificial Sequence
  chemically synthesized
tgtttcagaagtccttccct

SEQ ID NO: 135088 - DNA, 20 bp, Artificial Sequence
  chemically synthesized
ttattagctaaaccaaggga

SEQ ID NO: 135089 - DNA, 20 bp, Artificial Sequence
  chemically synthesized
tttattagctaaaccaaggg

SEQ ID NO: 135090 - DNA, 20 bp, Artificial Sequence
  chemically synthesized
cagaagtccttcccttggtt

SEQ ID NO: 135091 - DNA, 20 bp, Artificial Sequence
  chemically synthesized
ccttttattagctaaaccaa

SEQ ID NO: 135092 - DNA, 20 bp, Artificial Sequence
  chemically synthesized
gccttttattagctaaacca

SEQ ID NO: 135093 - DNA, 20 bp, Artificial Sequence
  chemically synthesized
ggccttttattagctaaacc

SEQ ID NO: 135094 - DNA, 20 bp, Artificial Sequence
  chemically synthesized
tcccttggtttagctaataa

SEQ ID NO: 135095 - DNA, 20 bp, Artificial Sequence
  chemically synthesized
cccttggtttagctaataaa

SEQ ID NO: 135096 - DNA, 20 bp, Artificial Sequence
  chemically synthesized
tgtataatgtggccttttat

SEQ ID NO: 135097 - DNA, 20 bp, Artificial Sequence
  chemically synthesized
aatatgaagggtgtataatg

SEQ ID NO: 135098 - DNA, 20 bp, Artificial Sequence
  chemically synthesized
tggagatgggagaatatgaa

SEQ ID NO: 135099 - DNA, 20 bp, Artificial Sequence
  chemically synthesized
ctggagatgggagaatatga

SEQ ID NO: 135100 - DNA, 20 bp, Artificial Sequence
  chemically synthesized
actggagatgggagaatatg

SEQ ID NO: 135101 - DNA, 20 bp, Artificial Sequence
  chemically synthesized
ccttcatattctcccatctc

SEQ ID NO: 135102 - DNA, 20 bp, Artificial Sequence
  chemically synthesized
acagagagaactggagatgg

SEQ ID NO: 135103 - DNA, 20 bp, Artificial Sequence
  chemically synthesized
gtacagagagaactggagat

SEQ ID NO: 135104 - DNA, 20 bp, Artificial Sequence
  chemically synthesized
ggtacagagagaactggaga

SEQ ID NO: 135105 - DNA, 20 bp, Artificial Sequence
  chemically synthesized
atttggtacagagagaactg

SEQ ID NO: 135106 - DNA, 20 bp, Artificial Sequence
  chemically synthesized
ggatttggtacagagagaac

SEQ ID NO: 135107 - DNA, 20 bp, Artificial Sequence
  chemically synthesized
tgagatggatttggtacaga

SEQ ID NO: 135108 - DNA, 20 bp, Artificial Sequence
  chemically synthesized
ggtgagatggatttggtaca

SEQ ID NO: 135109 - DNA, 20 bp, Artificial Sequence
  chemically synthesized
atggtgagatggatttggta

SEQ ID NO: 135110 - DNA, 20 bp, Artificial Sequence
  chemically synthesized
ttgttatggtgagatggatt

SEQ ID NO: 135111 - DNA, 20 bp, Artificial Sequence
  chemically synthesized
tacatattgttatggtgaga

SEQ ID NO: 135112 - DNA, 20 bp, Artificial Sequence
  chemically synthesized
atggtacatattgttatggt

SEQ ID NO: 135113 - DNA, 20 bp, Artificial Sequence
  chemically synthesized
ttaaatggtacatattgtta

SEQ ID NO: 135114 - DNA, 20 bp, Artificial Sequence
  chemically synthesized
aacaatatgtaccatttaat

SEQ ID NO: 135115 - DNA, 20 bp, Artificial Sequence
  chemically synthesized
catattagatgctcattaaa

SEQ ID NO: 135116 - DNA, 20 bp, Artificial Sequence
  chemically synthesized
agtaaatatgtggcacatat

SEQ ID NO: 135117 - DNA, 20 bp, Artificial Sequence
  chemically synthesized
gtgtttctaaagtaaatatg

SEQ ID NO: 135118 - DNA, 20 bp, Artificial Sequence
  chemically synthesized
tatgtgccacatatttactt

SEQ ID NO: 135119 - DNA, 20 bp, Artificial Sequence
  chemically synthesized
taaaataattggtgtttcta

SEQ ID NO: 135120 - DNA, 20 bp, Artificial Sequence
  chemically synthesized
gattaagaaagtaaaataat

SEQ ID NO: 135121 - DNA, 20 bp, Artificial Sequence
  chemically synthesized
tgctggtagggtgattaaga

SEQ ID NO: 135122 - DNA, 20 bp, Artificial Sequence
  chemically synthesized
cttatgctggtagggtgatt

SEQ ID NO: 135123 - DNA, 20 bp, Artificial Sequence
  chemically synthesized
tactttcttaatcaccctac

SEQ ID NO: 135124 - DNA, 20 bp, Artificial Sequence
  chemically synthesized
taatagtacttatgctggta

SEQ ID NO: 135125 - DNA, 20 bp, Artificial Sequence
  chemically synthesized
ataatagtacttatgctggt

SEQ ID NO: 135126 - DNA, 20 bp, Artificial Sequence
  chemically synthesized
cttaatcaccctaccagcat

SEQ ID NO: 135127 - DNA, 20 bp, Artificial Sequence
  chemically synthesized
aataatagtacttatgctgg

SEQ ID NO: 135128 - DNA, 20 bp, Artificial Sequence
  chemically synthesized
gctaataatagtacttatgc

SEQ ID NO: 135129 - DNA, 20 bp, Artificial Sequence
  chemically synthesized
accagcataagtactattat

SEQ ID NO: 135130 - DNA, 20 bp, Artificial Sequence
  chemically synthesized
ctgtcatgtggggctaataa

SEQ ID NO: 135131 - DNA, 20 bp, Artificial Sequence
  chemically synthesized
ctattattagccccacatga

SEQ ID NO: 135132 - DNA, 20 bp, Artificial Sequence
  chemically synthesized
gttctctcatctgtcatgtg

SEQ ID NO: 135133 - DNA, 20 bp, Artificial Sequence
  chemically synthesized
ggttctctcatctgtcatgt

SEQ ID NO: 135134 - DNA, 20 bp, Artificial Sequence
  chemically synthesized
tggttctctcatctgtcatg

SEQ ID NO: 135135 - DNA, 20 bp, Artificial Sequence
  chemically synthesized
attagccccacatgacagat

SEQ ID NO: 135136 - DNA, 20 bp, Artificial Sequence
  chemically synthesized
tagccccacatgacagatga

SEQ ID NO: 135137 - DNA, 20 bp, Artificial Sequence
  chemically synthesized
catgacagatgagagaacca

SEQ ID NO: 135138 - DNA, 20 bp, Artificial Sequence
  chemically synthesized
cagatgagagaaccacagtt

SEQ ID NO: 135139 - DNA, 20 bp, Artificial Sequence
  chemically synthesized
agatgagagaaccacagttt

SEQ ID NO: 135140 - DNA, 20 bp, Artificial Sequence
  chemically synthesized
taattctctttcctaaactg

SEQ ID NO: 135141 - DNA, 20 bp, Artificial Sequence
  chemically synthesized
gagagaaccacagtttagga

SEQ ID NO: 135142 - DNA, 20 bp, Artificial Sequence
  chemically synthesized
gagaaccacagtttaggaaa

SEQ ID NO: 135143 - DNA, 20 bp, Artificial Sequence
  chemically synthesized
tttaggaaagagaattaact

SEQ ID NO: 135144 - DNA, 20 bp, Artificial Sequence
  chemically synthesized
gaaagagaattaacttggct

SEQ ID NO: 135145 - DNA, 20 bp, Artificial Sequence
  chemically synthesized
aaagagaattaacttggcta

SEQ ID NO: 135146 - DNA, 20 bp, Artificial Sequence
  chemically synthesized
ttagctgtgtaaccttagcc

SEQ ID NO: 135147 - DNA, 20 bp, Artificial Sequence
  chemically synthesized
atctattagctgtgtaacct

SEQ ID NO: 135148 - DNA, 20 bp, Artificial Sequence
  chemically synthesized
ttaacttggctaaggttaca

SEQ ID NO: 135149 - DNA, 20 bp, Artificial Sequence
  chemically synthesized
ggctaaggttacacagctaa

SEQ ID NO: 135150 - DNA, 20 bp, Artificial Sequence
  chemically synthesized
agtggaccccaatgatctat

SEQ ID NO: 135151 - DNA, 20 bp, Artificial Sequence
  chemically synthesized
ttacacagctaatagatcat

SEQ ID NO: 135152 - DNA, 20 bp, Artificial Sequence
  chemically synthesized
tacacagctaatagatcatt

SEQ ID NO: 135153 - DNA, 20 bp, Artificial Sequence
  chemically synthesized
acacagctaatagatcattg

SEQ ID NO: 135154 - DNA, 20 bp, Artificial Sequence
  chemically synthesized
aatagatcattggggtccac

SEQ ID NO: 135155 - DNA, 20 bp, Artificial Sequence
  chemically synthesized
gttggagatgtacagactag

SEQ ID NO: 135156 - DNA, 20 bp, Artificial Sequence
  chemically synthesized
tgtgttggagatgtacagac

SEQ ID NO: 135157 - DNA, 20 bp, Artificial Sequence
  chemically synthesized
ttacatgtgttggagatgta

SEQ ID NO: 135158 - DNA, 20 bp, Artificial Sequence
  chemically synthesized
attgtcttttacatgtgttg

SEQ ID NO: 135159 - DNA, 20 bp, Artificial Sequence
  chemically synthesized
ggattgtcttttacatgtgt

SEQ ID NO: 135160 - DNA, 20 bp, Artificial Sequence
  chemically synthesized
tacatctccaacacatgtaa

SEQ ID NO: 135161 - DNA, 20 bp, Artificial Sequence
  chemically synthesized
gtaaaagacaatcctttgat

SEQ ID NO: 135162 - DNA, 20 bp, Artificial Sequence
  chemically synthesized
gtatttgagtgtctaatcaa

SEQ ID NO: 135163 - DNA, 20 bp, Artificial Sequence
  chemically synthesized
tgtatttgagtgtctaatca

SEQ ID NO: 135164 - DNA, 20 bp, Artificial Sequence
  chemically synthesized
tgattagacactcaaataca

SEQ ID NO: 135165 - DNA, 20 bp, Artificial Sequence
  chemically synthesized
cttttgacttctgtgtattt

SEQ ID NO: 135166 - DNA, 20 bp, Artificial Sequence
  chemically synthesized
ttagacactcaaatacacag

SEQ ID NO: 135167 - DNA, 20 bp, Artificial Sequence
  chemically synthesized
ctcaaatacacagaagtcaa

SEQ ID NO: 135168 - DNA, 20 bp, Artificial Sequence
  chemically synthesized
acagaagtcaaaagtataaa

SEQ ID NO: 135169 - DNA, 20 bp, Artificial Sequence
  chemically synthesized
cagaagtcaaaagtataaac

SEQ ID NO: 135170 - DNA, 20 bp, Artificial Sequence
  chemically synthesized
gaagtcaaaagtataaacag

SEQ ID NO: 135171 - DNA, 20 bp, Artificial Sequence
  chemically synthesized
gtcaaaagtataaacaggag

SEQ ID NO: 135172 - DNA, 20 bp, Artificial Sequence
  chemically synthesized
gagcagcaaaaatgtatatc

SEQ ID NO: 135173 - DNA, 20 bp, Artificial Sequence
  chemically synthesized
aacctcaggtaattatagtc

SEQ ID NO: 135174 - DNA, 20 bp, Artificial Sequence
  chemically synthesized
ggactaacctcaggtaatta

SEQ ID NO: 135175 - DNA, 20 bp, Artificial Sequence
  chemically synthesized
tatccagactataattacct

SEQ ID NO: 135176 - DNA, 20 bp, Artificial Sequence
  chemically synthesized
atccagactataattacctg

SEQ ID NO: 135177 - DNA, 20 bp, Artificial Sequence
  chemically synthesized
agactataattacctgaggt

SEQ ID NO: 135178 - DNA, 20 bp, Artificial Sequence
  chemically synthesized
aaaatattaggactaacctc

SEQ ID NO: 135179 - DNA, 20 bp, Artificial Sequence
  chemically synthesized
taaaatattaggactaacct

SEQ ID NO: 135180 - DNA, 20 bp, Artificial Sequence
  chemically synthesized
atctgacaacttaaaatatt

SEQ ID NO: 135181 - DNA, 20 bp, Artificial Sequence
  chemically synthesized
gaggttagtcctaatatttt

SEQ ID NO: 135182 - DNA, 20 bp, Artificial Sequence
  chemically synthesized
tatctgacaacttaaaatat

SEQ ID NO: 135183 - DNA, 20 bp, Artificial Sequence
  chemically synthesized
gtcctaatattttaagttgt

SEQ ID NO: 135184 - DNA, 20 bp, Artificial Sequence
  chemically synthesized
ggttagtcagaaaaatagga

SEQ ID NO: 135185 - DNA, 20 bp, Artificial Sequence
  chemically synthesized
tggttagtcagaaaaatagg

SEQ ID NO: 135186 - DNA, 20 bp, Artificial Sequence
  chemically synthesized
ggctggttagtcagaaaaat

SEQ ID NO: 135187 - DNA, 20 bp, Artificial Sequence
  chemically synthesized
aggctggttagtcagaaaaa

SEQ ID NO: 135188 - DNA, 20 bp, Artificial Sequence
  chemically synthesized
ttcctatttttctgactaac

SEQ ID NO: 135189 - DNA, 20 bp, Artificial Sequence
  chemically synthesized
aatggaaaaggctggttagt

SEQ ID NO: 135190 - DNA, 20 bp, Artificial Sequence
  chemically synthesized
atcaaatggaaaaggctggt

SEQ ID NO: 135191 - DNA, 20 bp, Artificial Sequence
  chemically synthesized
gcacatcaaatggaaaaggc

SEQ ID NO: 135192 - DNA, 20 bp, Artificial Sequence
  chemically synthesized
cgaggcacatcaaatggaaa

SEQ ID NO: 135193 - DNA, 20 bp, Artificial Sequence
  chemically synthesized
ccgaggcacatcaaatggaa

SEQ ID NO: 135194 - DNA, 20 bp, Artificial Sequence
  chemically synthesized
aaagcccgaggcacatcaaa

SEQ ID NO: 135195 - DNA, 20 bp, Artificial Sequence
  chemically synthesized
cttttccatttgatgtgcct

SEQ ID NO: 135196 - DNA, 20 bp, Artificial Sequence
  chemically synthesized
ttttccatttgatgtgcctc

SEQ ID NO: 135197 - DNA, 20 bp, Artificial Sequence
  chemically synthesized
ctatatgattttaaagcccg

SEQ ID NO: 135198 - DNA, 20 bp, Artificial Sequence
  chemically synthesized
tctatatgattttaaagccc

SEQ ID NO: 135199 - DNA, 20 bp, Artificial Sequence
  chemically synthesized
cccacgtctatatgatttta

SEQ ID NO: 135200 - DNA, 20 bp, Artificial Sequence
  chemically synthesized
cctcgggctttaaaatcata

SEQ ID NO: 135201 - DNA, 20 bp, Artificial Sequence
  chemically synthesized
gctttaaaatcatatagacg

SEQ ID NO: 135202 - DNA, 20 bp, Artificial Sequence
  chemically synthesized
ctttaaaatcatatagacgt

SEQ ID NO: 135203 - DNA, 20 bp, Artificial Sequence
  chemically synthesized
caagtgaggaagtagaattc

SEQ ID NO: 135204 - DNA, 20 bp, Artificial Sequence
  chemically synthesized
gaagatgacaagtgaggaag

SEQ ID NO: 135205 - DNA, 20 bp, Artificial Sequence
  chemically synthesized
taggaagatgacaagtgagg

SEQ ID NO: 135206 - DNA, 20 bp, Artificial Sequence
  chemically synthesized
tcttaggaagatgacaagtg

SEQ ID NO: 135207 - DNA, 20 bp, Artificial Sequence
  chemically synthesized
gtcttaggaagatgacaagt

SEQ ID NO: 135208 - DNA, 20 bp, Artificial Sequence
  chemically synthesized
tagggtcttaggaagatgac

SEQ ID NO: 135209 - DNA, 20 bp, Artificial Sequence
  chemically synthesized
tcctcacttgtcatcttcct

SEQ ID NO: 135210 - DNA, 20 bp, Artificial Sequence
  chemically synthesized
aacttgtctagggtcttagg

SEQ ID NO: 135211 - DNA, 20 bp, Artificial Sequence
  chemically synthesized
ttgtcatcttcctaagaccc

SEQ ID NO: 135212 - DNA, 20 bp, Artificial Sequence
  chemically synthesized
cgtaacttgtctagggtctt

SEQ ID NO: 135213 - DNA, 20 bp, Artificial Sequence
  chemically synthesized
acgtaacttgtctagggtct

SEQ ID NO: 135214 - DNA, 20 bp, Artificial Sequence
  chemically synthesized
atcttcctaagaccctagac

SEQ ID NO: 135215 - DNA, 20 bp, Artificial Sequence
  chemically synthesized
gagctaacgtaacttgtcta

SEQ ID NO: 135216 - DNA, 20 bp, Artificial Sequence
  chemically synthesized
agagctaacgtaacttgtct

SEQ ID NO: 135217 - DNA, 20 bp, Artificial Sequence
  chemically synthesized
gagagctaacgtaacttgtc

SEQ ID NO: 135218 - DNA, 20 bp, Artificial Sequence
  chemically synthesized
agaccctagacaagttacgt

SEQ ID NO: 135219 - DNA, 20 bp, Artificial Sequence
  chemically synthesized
acaagttacgttagctctcc

SEQ ID NO: 135220 - DNA, 20 bp, Artificial Sequence
  chemically synthesized
acagaaaaccgagactcgga

SEQ ID NO: 135221 - DNA, 20 bp, Artificial Sequence
  chemically synthesized
tacgttagctctccgagtct

SEQ ID NO: 135222 - DNA, 20 bp, Artificial Sequence
  chemically synthesized
agacagaaaaccgagactcg

SEQ ID NO: 135223 - DNA, 20 bp, Artificial Sequence
  chemically synthesized
agagacagaaaaccgagact

SEQ ID NO: 135224 - DNA, 20 bp, Artificial Sequence
  chemically synthesized
cattttagagacagaaaacc

SEQ ID NO: 135225 - DNA, 20 bp, Artificial Sequence
  chemically synthesized
tactactcccattttagaga

SEQ ID NO: 135226 - DNA, 20 bp, Artificial Sequence
  chemically synthesized
tcggttttctgtctctaaaa

SEQ ID NO: 135227 - DNA, 20 bp, Artificial Sequence
  chemically synthesized
cggttttctgtctctaaaat

SEQ ID NO: 135228 - DNA, 20 bp, Artificial Sequence
  chemically synthesized
aaattactactcccatttta

SEQ ID NO: 135229 - DNA, 20 bp, Artificial Sequence
  chemically synthesized
gttttctgtctctaaaatgg

SEQ ID NO: 135230 - DNA, 20 bp, Artificial Sequence
  chemically synthesized
taaaattactactcccattt

SEQ ID NO: 135231 - DNA, 20 bp, Artificial Sequence
  chemically synthesized
ttctgtctctaaaatgggag

SEQ ID NO: 135232 - DNA, 20 bp, Artificial Sequence
  chemically synthesized
ttatctataaatttaatagg

SEQ ID NO: 135233 - DNA, 20 bp, Artificial Sequence
  chemically synthesized
ttattatctataaatttaat

SEQ ID NO: 135234 - DNA, 20 bp, Artificial Sequence
  chemically synthesized
tttattatctataaatttaa

SEQ ID NO: 135235 - DNA, 20 bp, Artificial Sequence
  chemically synthesized
ttatctacctattaaattta

SEQ ID NO: 135236 - DNA, 20 bp, Artificial Sequence
  chemically synthesized
tatagataataaaaattttg

SEQ ID NO: 135237 - DNA, 20 bp, Artificial Sequence
  chemically synthesized
ttttgcagtatttcccacaa

SEQ ID NO: 135238 - DNA, 20 bp, Artificial Sequence
  chemically synthesized
tttgcagtatttcccacaaa

SEQ ID NO: 135239 - DNA, 20 bp, Artificial Sequence
  chemically synthesized
tattcaggaaagccttttgt

SEQ ID NO: 135240 - DNA, 20 bp, Artificial Sequence
  chemically synthesized
atattcaggaaagccttttg

SEQ ID NO: 135241 - DNA, 20 bp, Artificial Sequence
  chemically synthesized
aattaaacaaatattcagga

SEQ ID NO: 135242 - DNA, 20 bp, Artificial Sequence
  chemically synthesized
atagaattaaacaaatattc

SEQ ID NO: 135243 - DNA, 20 bp, Artificial Sequence
  chemically synthesized
aatagaattaaacaaatatt

SEQ ID NO: 135244 - DNA, 20 bp, Artificial Sequence
  chemically synthesized
tatttgtttaattctattta

SEQ ID NO: 135245 - DNA, 20 bp, Artificial Sequence
  chemically synthesized
gatggaataagatctataaa

SEQ ID NO: 135246 - DNA, 20 bp, Artificial Sequence
  chemically synthesized
ttgcttggaaaagatggaat

SEQ ID NO: 135247 - DNA, 20 bp, Artificial Sequence
  chemically synthesized
agaaggttgcttggaaaaga

SEQ ID NO: 135248 - DNA, 20 bp, Artificial Sequence
  chemically synthesized
gatcttattccatcttttcc

SEQ ID NO: 135249 - DNA, 20 bp, Artificial Sequence
  chemically synthesized
caggagaaggttgcttggaa

SEQ ID NO: 135250 - DNA, 20 bp, Artificial Sequence
  chemically synthesized
accgacaggagaaggttgct

SEQ ID NO: 135251 - DNA, 20 bp, Artificial Sequence
  chemically synthesized
tttaaaagaccgacaggaga

SEQ ID NO: 135252 - DNA, 20 bp, Artificial Sequence
  chemically synthesized
tccaagcaaccttctcctgt

SEQ ID NO: 135253 - DNA, 20 bp, Artificial Sequence
  chemically synthesized
atttaaaagaccgacaggag

SEQ ID NO: 135254 - DNA, 20 bp, Artificial Sequence
  chemically synthesized
gagatttaaaagaccgacag

SEQ ID NO: 135255 - DNA, 20 bp, Artificial Sequence
  chemically synthesized
gagagatttaaaagaccgac

SEQ ID NO: 135256 - DNA, 20 bp, Artificial Sequence
  chemically synthesized
ggagagatttaaaagaccga

SEQ ID NO: 135257 - DNA, 20 bp, Artificial Sequence
  chemically synthesized
ccccaaaaggagagatttaa

SEQ ID NO: 135258 - DNA, 20 bp, Artificial Sequence
  chemically synthesized
gtcttttaaatctctccttt

SEQ ID NO: 135259 - DNA, 20 bp, Artificial Sequence
  chemically synthesized
tcttttaaatctctcctttt

SEQ ID NO: 135260 - DNA, 20 bp, Artificial Sequence
  chemically synthesized
ccaccaccaccccaaaagga

SEQ ID NO: 135261 - DNA, 20 bp, Artificial Sequence
  chemically synthesized
cttttaaatctctccttttg

SEQ ID NO: 135262 - DNA, 20 bp, Artificial Sequence
  chemically synthesized
ccccaccaccaccccaaaag

SEQ ID NO: 135263 - DNA, 20 bp, Artificial Sequence
  chemically synthesized
ttaaatctctccttttgggg

SEQ ID NO: 135264 - DNA, 20 bp, Artificial Sequence
  chemically synthesized
ccccccaccaccaccccaaa

SEQ ID NO: 135265 - DNA, 20 bp, Artificial Sequence
  chemically synthesized
gccccccaccaccaccccaa

SEQ ID NO: 135266 - DNA, 20 bp, Artificial Sequence
  chemically synthesized
aatctctccttttggggtgg

SEQ ID NO: 135267 - DNA, 20 bp, Artificial Sequence
  chemically synthesized
ctctccttttggggtggtgg

SEQ ID NO: 135268 - DNA, 20 bp, Artificial Sequence
  chemically synthesized
tctccttttggggtggtggt

SEQ ID NO: 135269 - DNA, 20 bp, Artificial Sequence
  chemically synthesized
ctccttttggggtggtggtg

SEQ ID NO: 135270 - DNA, 20 bp, Artificial Sequence
  chemically synthesized
tccttttggggtggtggtgg

SEQ ID NO: 135271 - DNA, 20 bp, Artificial Sequence
  chemically synthesized
ccttttggggtggtggtggg

SEQ ID NO: 135272 - DNA, 20 bp, Artificial Sequence
  chemically synthesized
tggggggcgaaataactaaa

SEQ ID NO: 135273 - DNA, 20 bp, Artificial Sequence
  chemically synthesized
tgagctttttggtagctgtt

SEQ ID NO: 135274 - DNA, 20 bp, Artificial Sequence
  chemically synthesized
ataactaaacagctaccaaa

SEQ ID NO: 135275 - DNA, 20 bp, Artificial Sequence
  chemically synthesized
atacttaatgagctttttgg

SEQ ID NO: 135276 - DNA, 20 bp, Artificial Sequence
  chemically synthesized
aaaatacttaatgagctttt

SEQ ID NO: 135277 - DNA, 20 bp, Artificial Sequence
  chemically synthesized
cagctaccaaaaagctcatt

SEQ ID NO: 135278 - DNA, 20 bp, Artificial Sequence
  chemically synthesized
cttaatgcaaaatacttaat

SEQ ID NO: 135279 - DNA, 20 bp, Artificial Sequence
  chemically synthesized
ctcattaagtattttgcatt

SEQ ID NO: 135280 - DNA, 20 bp, Artificial Sequence
  chemically synthesized
tattttgcattaagccttca

SEQ ID NO: 135281 - DNA, 20 bp, Artificial Sequence
  chemically synthesized
aatctattggggtgctttga

SEQ ID NO: 135282 - DNA, 20 bp, Artificial Sequence
  chemically synthesized
taatctattggggtgctttg

SEQ ID NO: 135283 - DNA, 20 bp, Artificial Sequence
  chemically synthesized
aagccttcaaagcaccccaa

SEQ ID NO: 135284 - DNA, 20 bp, Artificial Sequence
  chemically synthesized
attttaattataatctattg

SEQ ID NO: 135285 - DNA, 20 bp, Artificial Sequence
  chemically synthesized
tattttaattataatctatt

SEQ ID NO: 135286 - DNA, 20 bp, Artificial Sequence
  chemically synthesized
ttattttaattataatctat

SEQ ID NO: 135287 - DNA, 20 bp, Artificial Sequence
  chemically synthesized
agtaaaagctgaatgaatgt

SEQ ID NO: 135288 - DNA, 20 bp, Artificial Sequence
  chemically synthesized
aacaaatgctaacattcatt

SEQ ID NO: 135289 - DNA, 20 bp, Artificial Sequence
  chemically synthesized
cattcattcagcttttacta

SEQ ID NO: 135290 - DNA, 20 bp, Artificial Sequence
  chemically synthesized
ttagatcagggccatagtaa

SEQ ID NO: 135291 - DNA, 20 bp, Artificial Sequence
  chemically synthesized
gagcccttagatcagggcca

SEQ ID NO: 135292 - DNA, 20 bp, Artificial Sequence
  chemically synthesized
ttttactatggccctgatct

SEQ ID NO: 135293 - DNA, 20 bp, Artificial Sequence
  chemically synthesized
tttactatggccctgatcta

SEQ ID NO: 135294 - DNA, 20 bp, Artificial Sequence
  chemically synthesized
aatgtagagcccttagatca

SEQ ID NO: 135295 - DNA, 20 bp, Artificial Sequence
  chemically synthesized
ttactatggccctgatctaa

SEQ ID NO: 135296 - DNA, 20 bp, Artificial Sequence
  chemically synthesized
taatgtagagcccttagatc

SEQ ID NO: 135297 - DNA, 20 bp, Artificial Sequence
  chemically synthesized
ttaatgtagagcccttagat

SEQ ID NO: 135298 - DNA, 20 bp, Artificial Sequence
  chemically synthesized
aataattaatgtagagccct

SEQ ID NO: 135299 - DNA, 20 bp, Artificial Sequence
  chemically synthesized
tagatgaaataattaatgta

SEQ ID NO: 135300 - DNA, 20 bp, Artificial Sequence
  chemically synthesized
attagatgaaataattaatg

SEQ ID NO: 135301 - DNA, 20 bp, Artificial Sequence
  chemically synthesized
atctcatgggttgggaggat

SEQ ID NO: 135302 - DNA, 20 bp, Artificial Sequence
  chemically synthesized
taactatctcatgggttggg

SEQ ID NO: 135303 - DNA, 20 bp, Artificial Sequence
  chemically synthesized
ataactatctcatgggttgg

SEQ ID NO: 135304 - DNA, 20 bp, Artificial Sequence
  chemically synthesized
atctaatcctcccaacccat

SEQ ID NO: 135305 - DNA, 20 bp, Artificial Sequence
  chemically synthesized
ttataactatctcatgggtt

SEQ ID NO: 135306 - DNA, 20 bp, Artificial Sequence
  chemically synthesized
cttataactatctcatgggt

SEQ ID NO: 135307 - DNA, 20 bp, Artificial Sequence
  chemically synthesized
aatcctcccaacccatgaga

SEQ ID NO: 135308 - DNA, 20 bp, Artificial Sequence
  chemically synthesized
ctcacttataactatctcat

SEQ ID NO: 135309 - DNA, 20 bp, Artificial Sequence
  chemically synthesized
gctcacttataactatctca

SEQ ID NO: 135310 - DNA, 20 bp, Artificial Sequence
  chemically synthesized
ccaacccatgagatagttat

SEQ ID NO: 135311 - DNA, 20 bp, Artificial Sequence
  chemically synthesized
cccatgagatagttataagt

SEQ ID NO: 135312 - DNA, 20 bp, Artificial Sequence
  chemically synthesized
ttataagtgagcctatttta

SEQ ID NO: 135313 - DNA, 20 bp, Artificial Sequence
  chemically synthesized
agtttccttctctgtaaaat

SEQ ID NO: 135314 - DNA, 20 bp, Artificial Sequence
  chemically synthesized
ataagtgagcctattttaca

SEQ ID NO: 135315 - DNA, 20 bp, Artificial Sequence
  chemically synthesized
tagtttccttctctgtaaaa

SEQ ID NO: 135316 - DNA, 20 bp, Artificial Sequence
  chemically synthesized
agtgagcctattttacagag

SEQ ID NO: 135317 - DNA, 20 bp, Artificial Sequence
  chemically synthesized
gtgagcctattttacagaga

SEQ ID NO: 135318 - DNA, 20 bp, Artificial Sequence
  chemically synthesized
attttacagagaaggaaact

SEQ ID NO: 135319 - DNA, 20 bp, Artificial Sequence
  chemically synthesized
tttacagagaaggaaactaa

SEQ ID NO: 135320 - DNA, 20 bp, Artificial Sequence
  chemically synthesized
acagagaaggaaactaagag

SEQ ID NO: 135321 - DNA, 20 bp, Artificial Sequence
  chemically synthesized
ctcagtaaactatctgctct

SEQ ID NO: 135322 - DNA, 20 bp, Artificial Sequence
  chemically synthesized
agaaggaaactaagagcaga

SEQ ID NO: 135323 - DNA, 20 bp, Artificial Sequence
  chemically synthesized
ctaagagcagatagtttact

SEQ ID NO: 135324 - DNA, 20 bp, Artificial Sequence
  chemically synthesized
agcagatagtttactgagat

SEQ ID NO: 135325 - DNA, 20 bp, Artificial Sequence
  chemically synthesized
cttgagcaaatgactaatct

SEQ ID NO: 135326 - DNA, 20 bp, Artificial Sequence
  chemically synthesized
ctgagattagtcatttgctc

SEQ ID NO: 135327 - DNA, 20 bp, Artificial Sequence
  chemically synthesized
tgagattagtcatttgctca

SEQ ID NO: 135328 - DNA, 20 bp, Artificial Sequence
  chemically synthesized
cttgttagctttgtggcctt

SEQ ID NO: 135329 - DNA, 20 bp, Artificial Sequence
  chemically synthesized
gtcatttgctcaaggccaca

SEQ ID NO: 135330 - DNA, 20 bp, Artificial Sequence
  chemically synthesized
ctggccacttgttagctttg

SEQ ID NO: 135331 - DNA, 20 bp, Artificial Sequence
  chemically synthesized
ctcaaggccacaaagctaac

SEQ ID NO: 135332 - DNA, 20 bp, Artificial Sequence
  chemically synthesized
aaggccacaaagctaacaag

SEQ ID NO: 135333 - DNA, 20 bp, Artificial Sequence
  chemically synthesized
tgcctagactggccacttgt

SEQ ID NO: 135334 - DNA, 20 bp, Artificial Sequence
  chemically synthesized
ccacaaagctaacaagtggc

SEQ ID NO: 135335 - DNA, 20 bp, Artificial Sequence
  chemically synthesized
aagctaacaagtggccagtc

SEQ ID NO: 135336 - DNA, 20 bp, Artificial Sequence
  chemically synthesized
agctaacaagtggccagtct

SEQ ID NO: 135337 - DNA, 20 bp, Artificial Sequence
  chemically synthesized
taacaagtggccagtctagg

SEQ ID NO: 135338 - DNA, 20 bp, Artificial Sequence
  chemically synthesized
aaaaggcaggctgcctagac

SEQ ID NO: 135339 - DNA, 20 bp, Artificial Sequence
  chemically synthesized
actttaaaaggcaggctgcc

SEQ ID NO: 135340 - DNA, 20 bp, Artificial Sequence
  chemically synthesized
catgcattactttaaaaggc

SEQ ID NO: 135341 - DNA, 20 bp, Artificial Sequence
  chemically synthesized
tctaggcagcctgcctttta

SEQ ID NO: 135342 - DNA, 20 bp, Artificial Sequence
  chemically synthesized
gcatgcattactttaaaagg

SEQ ID NO: 135343 - DNA, 20 bp, Artificial Sequence
  chemically synthesized
atagcatgcattactttaaa

SEQ ID NO: 135344 - DNA, 20 bp, Artificial Sequence
  chemically synthesized
aatagcatgcattactttaa

SEQ ID NO: 135345 - DNA, 20 bp, Artificial Sequence
  chemically synthesized
atttcggggctatacagcaa

SEQ ID NO: 135346 - DNA, 20 bp, Artificial Sequence
  chemically synthesized
taatgcatgctattgctgta

SEQ ID NO: 135347 - DNA, 20 bp, Artificial Sequence
  chemically synthesized
actaccatttcggggctata

SEQ ID NO: 135348 - DNA, 20 bp, Artificial Sequence
  chemically synthesized
attgctgtatagccccgaaa

SEQ ID NO: 135349 - DNA, 20 bp, Artificial Sequence
  chemically synthesized
cccccaccactaccatttcg

SEQ ID NO: 135350 - DNA, 20 bp, Artificial Sequence
  chemically synthesized
gctgtatagccccgaaatgg

SEQ ID NO: 135351 - DNA, 20 bp, Artificial Sequence
  chemically synthesized
acccccaccactaccatttc

SEQ ID NO: 135352 - DNA, 20 bp, Artificial Sequence
  chemically synthesized
aacccccaccactaccattt

SEQ ID NO: 135353 - DNA, 20 bp, Artificial Sequence
  chemically synthesized
gtatagccccgaaatggtag

SEQ ID NO: 135354 - DNA, 20 bp, Artificial Sequence
  chemically synthesized
tagccccgaaatggtagtgg

SEQ ID NO: 135355 - DNA, 20 bp, Artificial Sequence
  chemically synthesized
agccccgaaatggtagtggt

SEQ ID NO: 135356 - DNA, 20 bp, Artificial Sequence
  chemically synthesized
gccccgaaatggtagtggtg

SEQ ID NO: 135357 - DNA, 20 bp, Artificial Sequence
  chemically synthesized
ccccgaaatggtagtggtgg

SEQ ID NO: 135358 - DNA, 20 bp, Artificial Sequence
  chemically synthesized
aatggtagtggtgggggtta

SEQ ID NO: 135359 - DNA, 20 bp, Artificial Sequence
  chemically synthesized
tggtagtggtgggggttacg

SEQ ID NO: 135360 - DNA, 20 bp, Artificial Sequence
  chemically synthesized
ggtagtggtgggggttacgg

SEQ ID NO: 135361 - DNA, 20 bp, Artificial Sequence
  chemically synthesized
gtagtggtgggggttacgga

SEQ ID NO: 135362 - DNA, 20 bp, Artificial Sequence
  chemically synthesized
agtggtgggggttacggagg

SEQ ID NO: 135363 - DNA, 20 bp, Artificial Sequence
  chemically synthesized
ggtgggggttacggagggag

SEQ ID NO: 135364 - DNA, 20 bp, Artificial Sequence
  chemically synthesized
ggttacggagggagaagcta

SEQ ID NO: 135365 - DNA, 20 bp, Artificial Sequence
  chemically synthesized
gagggagaagctacagaaac

SEQ ID NO: 135366 - DNA, 20 bp, Artificial Sequence
  chemically synthesized
atttaagagccttgtttctg

SEQ ID NO: 135367 - DNA, 20 bp, Artificial Sequence
  chemically synthesized
agggagaagctacagaaaca

SEQ ID NO: 135368 - DNA, 20 bp, Artificial Sequence
  chemically synthesized
cctgtaacatttggatttaa

SEQ ID NO: 135369 - DNA, 20 bp, Artificial Sequence
  chemically synthesized
ttcctgtaacatttggattt

SEQ ID NO: 135370 - DNA, 20 bp, Artificial Sequence
  chemically synthesized
gctcttaaatccaaatgtta

SEQ ID NO: 135371 - DNA, 20 bp, Artificial Sequence
  chemically synthesized
aatgtcgttcctgtaacatt

SEQ ID NO: 135372 - DNA, 20 bp, Artificial Sequence
  chemically synthesized
ctcttaaatccaaatgttac

SEQ ID NO: 135373 - DNA, 20 bp, Artificial Sequence
  chemically synthesized
gtttatttcacaaacaatat

SEQ ID NO: 135374 - DNA, 20 bp, Artificial Sequence
  chemically synthesized
aatattgtttgtgaaataaa

SEQ ID NO: 135375 - DNA, 20 bp, Artificial Sequence
  chemically synthesized
tgaaataaacagaatgataa

SEQ ID NO: 135376 - DNA, 20 bp, Artificial Sequence
  chemically synthesized
gaaataaacagaatgataaa

SEQ ID NO: 135377 - DNA, 20 bp, Artificial Sequence
  chemically synthesized
ataaacagaatgataaaagg

SEQ ID NO: 135378 - DNA, 20 bp, Artificial Sequence
  chemically synthesized
aacagaatgataaaaggaag

SEQ ID NO: 135379 - DNA, 20 bp, Artificial Sequence
  chemically synthesized
agcagtgaagaggatttgga

SEQ ID NO: 135380 - DNA, 20 bp, Artificial Sequence
  chemically synthesized
gcatagcagtgaagaggatt

SEQ ID NO: 135381 - DNA, 20 bp, Artificial Sequence
  chemically synthesized
taccttgcatagcagtgaag

SEQ ID NO: 135382 - DNA, 20 bp, Artificial Sequence
  chemically synthesized
ataccttgcatagcagtgaa

SEQ ID NO: 135383 - DNA, 20 bp, Artificial Sequence
  chemically synthesized
taataccttgcatagcagtg

SEQ ID NO: 135384 - DNA, 20 bp, Artificial Sequence
  chemically synthesized
aatcctcttcactgctatgc

SEQ ID NO: 135385 - DNA, 20 bp, Artificial Sequence
  chemically synthesized
atcctcttcactgctatgca

SEQ ID NO: 135386 - DNA, 20 bp, Artificial Sequence
  chemically synthesized
taccataataccttgcatag

SEQ ID NO: 135387 - DNA, 20 bp, Artificial Sequence
  chemically synthesized
taataccataataccttgca

SEQ ID NO: 135388 - DNA, 20 bp, Artificial Sequence
  chemically synthesized
cactgctatgcaaggtatta

SEQ ID NO: 135389 - DNA, 20 bp, Artificial Sequence
  chemically synthesized
tattatggtattatgccttg

SEQ ID NO: 135390 - DNA, 20 bp, Artificial Sequence
  chemically synthesized
tcgtgtctgttaatactgca

SEQ ID NO: 135391 - DNA, 20 bp, Artificial Sequence
  chemically synthesized
ttcgtgtctgttaatactgc

SEQ ID NO: 135392 - DNA, 20 bp, Artificial Sequence
  chemically synthesized
attatgccttgcagtattaa

SEQ ID NO: 135393 - DNA, 20 bp, Artificial Sequence
  chemically synthesized
cagtattaacagacacgaac

SEQ ID NO: 135394 - DNA, 20 bp, Artificial Sequence
  chemically synthesized
gtattaacagacacgaacaa

SEQ ID NO: 135395 - DNA, 20 bp, Artificial Sequence
  chemically synthesized
aacaagagtttcatgtaatt

SEQ ID NO: 135396 - DNA, 20 bp, Artificial Sequence
  chemically synthesized
catgtaattcagacgcctcc

SEQ ID NO: 135397 - DNA, 20 bp, Artificial Sequence
  chemically synthesized
atgtaattcagacgcctcca

SEQ ID NO: 135398 - DNA, 20 bp, Artificial Sequence
  chemically synthesized
taattcagacgcctccaagg

SEQ ID NO: 135399 - DNA, 20 bp, Artificial Sequence
  chemically synthesized
atttaaattttcttccttgg

SEQ ID NO: 135400 - DNA, 20 bp, Artificial Sequence
  chemically synthesized
aatttaaattttcttccttg

SEQ ID NO: 135401 - DNA, 20 bp, Artificial Sequence
  chemically synthesized
agaatttaaattttcttcct

SEQ ID NO: 135402 - DNA, 20 bp, Artificial Sequence
  chemically synthesized
ccaaaagcagataagattag

SEQ ID NO: 135403 - DNA, 20 bp, Artificial Sequence
  chemically synthesized
ggaccaaaagcagataagat

SEQ ID NO: 135404 - DNA, 20 bp, Artificial Sequence
  chemically synthesized
tcaggggaccaaaagcagat

SEQ ID NO: 135405 - DNA, 20 bp, Artificial Sequence
  chemically synthesized
cttctaatcttatctgcttt

SEQ ID NO: 135406 - DNA, 20 bp, Artificial Sequence
  chemically synthesized
ctgggtcaggggaccaaaag

SEQ ID NO: 135407 - DNA, 20 bp, Artificial Sequence
  chemically synthesized
gggctgggtcaggggaccaa

SEQ ID NO: 135408 - DNA, 20 bp, Artificial Sequence
  chemically synthesized
ctgcttttggtcccctgacc

SEQ ID NO: 135409 - DNA, 20 bp, Artificial Sequence
  chemically synthesized
ctgcaaaagggctgggtcag

SEQ ID NO: 135410 - DNA, 20 bp, Artificial Sequence
  chemically synthesized
tctgcaaaagggctgggtca

SEQ ID NO: 135411 - DNA, 20 bp, Artificial Sequence
  chemically synthesized
ttctgcaaaagggctgggtc

SEQ ID NO: 135412 - DNA, 20 bp, Artificial Sequence
  chemically synthesized
cttctgcaaaagggctgggt

SEQ ID NO: 135413 - DNA, 20 bp, Artificial Sequence
  chemically synthesized
ttttcttctgcaaaagggct

SEQ ID NO: 135414 - DNA, 20 bp, Artificial Sequence
  chemically synthesized
attttcttctgcaaaagggc

SEQ ID NO: 135415 - DNA, 20 bp, Artificial Sequence
  chemically synthesized
cccctgacccagcccttttg

SEQ ID NO: 135416 - DNA, 20 bp, Artificial Sequence
  chemically synthesized
ggccattttcttctgcaaaa

SEQ ID NO: 135417 - DNA, 20 bp, Artificial Sequence
  chemically synthesized
ctgacccagcccttttgcag

SEQ ID NO: 135418 - DNA, 20 bp, Artificial Sequence
  chemically synthesized
tggccattttcttctgcaaa

SEQ ID NO: 135419 - DNA, 20 bp, Artificial Sequence
  chemically synthesized
ctggccattttcttctgcaa

SEQ ID NO: 135420 - DNA, 20 bp, Artificial Sequence
  chemically synthesized
agcccttttgcagaagaaaa

SEQ ID NO: 135421 - DNA, 20 bp, Artificial Sequence
  chemically synthesized
cttttgcagaagaaaatggc

SEQ ID NO: 135422 - DNA, 20 bp, Artificial Sequence
  chemically synthesized
ttttgcagaagaaaatggcc

SEQ ID NO: 135423 - DNA, 20 bp, Artificial Sequence
  chemically synthesized
ctgaatttgtcaatcattcc

SEQ ID NO: 135424 - DNA, 20 bp, Artificial Sequence
  chemically synthesized
ccaggaatgattgacaaatt

SEQ ID NO: 135425 - DNA, 20 bp, Artificial Sequence
  chemically synthesized
attgacaaattcagacacca

SEQ ID NO: 135426 - DNA, 20 bp, Artificial Sequence
  chemically synthesized
tgacaaattcagacaccaaa

SEQ ID NO: 135427 - DNA, 20 bp, Artificial Sequence
  chemically synthesized
ctcatttttctttaactctt

SEQ ID NO: 135428 - DNA, 20 bp, Artificial Sequence
  chemically synthesized
attcagacaccaaagagtta

SEQ ID NO: 135429 - DNA, 20 bp, Artificial Sequence
  chemically synthesized
ccaaagagttaaagaaaaat

SEQ ID NO: 135430 - DNA, 20 bp, Artificial Sequence
  chemically synthesized
aaaatgagcaattcgaatat

SEQ ID NO: 135431 - DNA, 20 bp, Artificial Sequence
  chemically synthesized
tgagcaattcgaatattaga

SEQ ID NO: 135432 - DNA, 20 bp, Artificial Sequence
  chemically synthesized
agcaattcgaatattagaaa

SEQ ID NO: 135433 - DNA, 20 bp, Artificial Sequence
  chemically synthesized
gcaattcgaatattagaaag

SEQ ID NO: 135434 - DNA, 20 bp, Artificial Sequence
  chemically synthesized
caattcgaatattagaaaga

SEQ ID NO: 135435 - DNA, 20 bp, Artificial Sequence
  chemically synthesized
attcgaatattagaaagagg

SEQ ID NO: 135436 - DNA, 20 bp, Artificial Sequence
  chemically synthesized
atttttcatttgatctgatt

SEQ ID NO: 135437 - DNA, 20 bp, Artificial Sequence
  chemically synthesized
agagtaaattttgtctaaat

SEQ ID NO: 135438 - DNA, 20 bp, Artificial Sequence
  chemically synthesized
acaaaatttactctcttacc

SEQ ID NO: 135439 - DNA, 20 bp, Artificial Sequence
  chemically synthesized
cagtaataatctaggtaaga

SEQ ID NO: 135440 - DNA, 20 bp, Artificial Sequence
  chemically synthesized
tgcagtaataatctaggtaa

SEQ ID NO: 135441 - DNA, 20 bp, Artificial Sequence
  chemically synthesized
catgcagtaataatctaggt

SEQ ID NO: 135442 - DNA, 20 bp, Artificial Sequence
  chemically synthesized
aaatcatgcagtaataatct

SEQ ID NO: 135443 - DNA, 20 bp, Artificial Sequence
  chemically synthesized
gaaatcatgcagtaataatc

SEQ ID NO: 135444 - DNA, 20 bp, Artificial Sequence
  chemically synthesized
ttatattgatggaaatcatg

SEQ ID NO: 135445 - DNA, 20 bp, Artificial Sequence
  chemically synthesized
tattcaggtaattatattga

SEQ ID NO: 135446 - DNA, 20 bp, Artificial Sequence
  chemically synthesized
ccgtggtatctgttgtattc

SEQ ID NO: 135447 - DNA, 20 bp, Artificial Sequence
  chemically synthesized
atataattacctgaatacaa

SEQ ID NO: 135448 - DNA, 20 bp, Artificial Sequence
  chemically synthesized
accgtggtatctgttgtatt

SEQ ID NO: 135449 - DNA, 20 bp, Artificial Sequence
  chemically synthesized
cctgaatacaacagatacca

SEQ ID NO: 135450 - DNA, 20 bp, Artificial Sequence
  chemically synthesized
tacaacagataccacggtaa

SEQ ID NO: 135451 - DNA, 20 bp, Artificial Sequence
  chemically synthesized
actatatgaaactattaccg

SEQ ID NO: 135452 - DNA, 20 bp, Artificial Sequence
  chemically synthesized
accacggtaatagtttcata

SEQ ID NO: 135453 - DNA, 20 bp, Artificial Sequence
  chemically synthesized
tagtttcatatagtaaaaca

SEQ ID NO: 135454 - DNA, 20 bp, Artificial Sequence
  chemically synthesized
tttcatatagtaaaacatgg

SEQ ID NO: 135455 - DNA, 20 bp, Artificial Sequence
  chemically synthesized
catatagtaaaacatggtgg

SEQ ID NO: 135456 - DNA, 20 bp, Artificial Sequence
  chemically synthesized
cttcaagtaattgggtgtgc

SEQ ID NO: 135457 - DNA, 20 bp, Artificial Sequence
  chemically synthesized
atgttaaacttcaagtaatt

SEQ ID NO: 135458 - DNA, 20 bp, Artificial Sequence
  chemically synthesized
catgttaaacttcaagtaat

SEQ ID NO: 135459 - DNA, 20 bp, Artificial Sequence
  chemically synthesized
cttgcacacccaattacttg

SEQ ID NO: 135460 - DNA, 20 bp, Artificial Sequence
  chemically synthesized
aaatattcatgttaaacttc

SEQ ID NO: 135461 - DNA, 20 bp, Artificial Sequence
  chemically synthesized
aagtttaacatgaatatttc

SEQ ID NO: 135462 - DNA, 20 bp, Artificial Sequence
  chemically synthesized
tttaacatgaatatttctag

SEQ ID NO: 135463 - DNA, 20 bp, Artificial Sequence
  chemically synthesized
acaaagctatttatgtctac

SEQ ID NO: 135464 - DNA, 20 bp, Artificial Sequence
  chemically synthesized
atatttctagtagacataaa

SEQ ID NO: 135465 - DNA, 20 bp, Artificial Sequence
  chemically synthesized
caagagaaaagttcagtaca

SEQ ID NO: 135466 - DNA, 20 bp, Artificial Sequence
  chemically synthesized
agtctatcaagagaaaagtt

SEQ ID NO: 135467 - DNA, 20 bp, Artificial Sequence
  chemically synthesized
attgcagtctatcaagagaa

SEQ ID NO: 135468 - DNA, 20 bp, Artificial Sequence
  chemically synthesized
gtactgaacttttctcttga

SEQ ID NO: 135469 - DNA, 20 bp, Artificial Sequence
  chemically synthesized
tagttattgcagtctatcaa

SEQ ID NO: 135470 - DNA, 20 bp, Artificial Sequence
  chemically synthesized
catagttattgcagtctatc

SEQ ID NO: 135471 - DNA, 20 bp, Artificial Sequence
  chemically synthesized
aaatctatacatagttattg

SEQ ID NO: 135472 - DNA, 20 bp, Artificial Sequence
  chemically synthesized
tagactgcaataactatgta

SEQ ID NO: 135473 - DNA, 20 bp, Artificial Sequence
  chemically synthesized
cagttgggaaaatctataca

SEQ ID NO: 135474 - DNA, 20 bp, Artificial Sequence
  chemically synthesized
tttcataactttgaacagtt

SEQ ID NO: 135475 - DNA, 20 bp, Artificial Sequence
  chemically synthesized
atttcataactttgaacagt

SEQ ID NO: 135476 - DNA, 20 bp, Artificial Sequence
  chemically synthesized
tagattttcccaactgttca

SEQ ID NO: 135477 - DNA, 20 bp, Artificial Sequence
  chemically synthesized
tcccatttcataactttgaa

SEQ ID NO: 135478 - DNA, 20 bp, Artificial Sequence
  chemically synthesized
aactgttcaaagttatgaaa

SEQ ID NO: 135479 - DNA, 20 bp, Artificial Sequence
  chemically synthesized
actgttcaaagttatgaaat

SEQ ID NO: 135480 - DNA, 20 bp, Artificial Sequence
  chemically synthesized
agttatgaaatgggatttac

SEQ ID NO: 135481 - DNA, 20 bp, Artificial Sequence
  chemically synthesized
ttatgaaatgggatttacca

SEQ ID NO: 135482 - DNA, 20 bp, Artificial Sequence
  chemically synthesized
gaaatgggatttaccagaga

SEQ ID NO: 135483 - DNA, 20 bp, Artificial Sequence
  chemically synthesized
ttgaaacatttttctttctc

SEQ ID NO: 135484 - DNA, 20 bp, Artificial Sequence
  chemically synthesized
gaaagaaaaatgtttcaata

SEQ ID NO: 135485 - DNA, 20 bp, Artificial Sequence
  chemically synthesized
tcagctaaataaagaaaaaa

SEQ ID NO: 135486 - DNA, 20 bp, Artificial Sequence
  chemically synthesized
ttaactattttttctttatt

SEQ ID NO: 135487 - DNA, 20 bp, Artificial Sequence
  chemically synthesized
aaaaagaaatcagctaaata

SEQ ID NO: 135488 - DNA, 20 bp, Artificial Sequence
  chemically synthesized
agaaatgctcaaaaagaaat

SEQ ID NO: 135489 - DNA, 20 bp, Artificial Sequence
  chemically synthesized
tatttagctgatttcttttt

SEQ ID NO: 135490 - DNA, 20 bp, Artificial Sequence
  chemically synthesized
aacttctagaaatgctcaaa

SEQ ID NO: 135491 - DNA, 20 bp, Artificial Sequence
  chemically synthesized
gatttctttttgagcatttc

SEQ ID NO: 135492 - DNA, 20 bp, Artificial Sequence
  chemically synthesized
ttctttttgagcatttctag

SEQ ID NO: 135493 - DNA, 20 bp, Artificial Sequence
  chemically synthesized
ttttattgccatgaaacttc

SEQ ID NO: 135494 - DNA, 20 bp, Artificial Sequence
  chemically synthesized
gagcatttctagaagtttca

SEQ ID NO: 135495 - DNA, 20 bp, Artificial Sequence
  chemically synthesized
agaagtttcatggcaataaa

SEQ ID NO: 135496 - DNA, 20 bp, Artificial Sequence
  chemically synthesized
gaagtttcatggcaataaaa

SEQ ID NO: 135497 - DNA, 20 bp, Artificial Sequence
  chemically synthesized
gtttcatggcaataaaaagg

SEQ ID NO: 135498 - DNA, 20 bp, Artificial Sequence
  chemically synthesized
attttctcatttgatgattt

SEQ ID NO: 135499 - DNA, 20 bp, Artificial Sequence
  chemically synthesized
gaagaccaaaatcatcaaat

SEQ ID NO: 135500 - DNA, 20 bp, Artificial Sequence
  chemically synthesized
atgagaaaatacaattttat

SEQ ID NO: 135501 - DNA, 20 bp, Artificial Sequence
  chemically synthesized
gaaaatacaattttatgagc

SEQ ID NO: 135502 - DNA, 20 bp, Artificial Sequence
  chemically synthesized
tttggttttcaggaaaagga

SEQ ID NO: 135503 - DNA, 20 bp, Artificial Sequence
  chemically synthesized
aagatttggttttcaggaaa

SEQ ID NO: 135504 - DNA, 20 bp, Artificial Sequence
  chemically synthesized
aaagatttggttttcaggaa

SEQ ID NO: 135505 - DNA, 20 bp, Artificial Sequence
  chemically synthesized
ttagtaaagatttggttttc

SEQ ID NO: 135506 - DNA, 20 bp, Artificial Sequence
  chemically synthesized
cttagtaaagatttggtttt

SEQ ID NO: 135507 - DNA, 20 bp, Artificial Sequence
  chemically synthesized
aatttttcttagtaaagatt

SEQ ID NO: 135508 - DNA, 20 bp, Artificial Sequence
  chemically synthesized
ctgaaaaccaaatctttact

SEQ ID NO: 135509 - DNA, 20 bp, Artificial Sequence
  chemically synthesized
aaatagaatttttcttagta

SEQ ID NO: 135510 - DNA, 20 bp, Artificial Sequence
  chemically synthesized
gttcaaaatagaatttttct

SEQ ID NO: 135511 - DNA, 20 bp, Artificial Sequence
  chemically synthesized
cttttcgatcgtgttcaaaa

SEQ ID NO: 135512 - DNA, 20 bp, Artificial Sequence
  chemically synthesized
ctattttgaacacgatcgaa

SEQ ID NO: 135513 - DNA, 20 bp, Artificial Sequence
  chemically synthesized
aacacgatcgaaaagtttat

SEQ ID NO: 135514 - DNA, 20 bp, Artificial Sequence
  chemically synthesized
ttgaaatctataaaatggga

SEQ ID NO: 135515 - DNA, 20 bp, Artificial Sequence
  chemically synthesized
tgaatttccatcccatttta

SEQ ID NO: 135516 - DNA, 20 bp, Artificial Sequence
  chemically synthesized
ccctttgaaatctataaaat

SEQ ID NO: 135517 - DNA, 20 bp, Artificial Sequence
  chemically synthesized
tccctttgaaatctataaaa

SEQ ID NO: 135518 - DNA, 20 bp, Artificial Sequence
  chemically synthesized
atcccattttatagatttca

SEQ ID NO: 135519 - DNA, 20 bp, Artificial Sequence
  chemically synthesized
tcccattttatagatttcaa

SEQ ID NO: 135520 - DNA, 20 bp, Artificial Sequence
  chemically synthesized
cccattttatagatttcaaa

SEQ ID NO: 135521 - DNA, 20 bp, Artificial Sequence
  chemically synthesized
cattttatagatttcaaagg

SEQ ID NO: 135522 - DNA, 20 bp, Artificial Sequence
  chemically synthesized
ttttatagatttcaaaggga

SEQ ID NO: 135523 - DNA, 20 bp, Artificial Sequence
  chemically synthesized
tcaaagggagagataaactg

SEQ ID NO: 135524 - DNA, 20 bp, Artificial Sequence
  chemically synthesized
gggagagataaactgaagtg

SEQ ID NO: 135525 - DNA, 20 bp, Artificial Sequence
  chemically synthesized
tttgcagccctgctacactt

SEQ ID NO: 135526 - DNA, 20 bp, Artificial Sequence
  chemically synthesized
agagataaactgaagtgtag

SEQ ID NO: 135527 - DNA, 20 bp, Artificial Sequence
  chemically synthesized
gagataaactgaagtgtagc

SEQ ID NO: 135528 - DNA, 20 bp, Artificial Sequence
  chemically synthesized
agataaactgaagtgtagca

SEQ ID NO: 135529 - DNA, 20 bp, Artificial Sequence
  chemically synthesized
tatctaaacaatgtcatttg

SEQ ID NO: 135530 - DNA, 20 bp, Artificial Sequence
  chemically synthesized
gggctgcaaatgacattgtt

SEQ ID NO: 135531 - DNA, 20 bp, Artificial Sequence
  chemically synthesized
tttagataaacatatcttgt

SEQ ID NO: 135532 - DNA, 20 bp, Artificial Sequence
  chemically synthesized
ggtaccaggataattctgac

SEQ ID NO: 135533 - DNA, 20 bp, Artificial Sequence
  chemically synthesized
atatcttgtcagaattatcc

SEQ ID NO: 135534 - DNA, 20 bp, Artificial Sequence
  chemically synthesized
tggagcctctaaatggtacc

SEQ ID NO: 135535 - DNA, 20 bp, Artificial Sequence
  chemically synthesized
ctggagcctctaaatggtac

SEQ ID NO: 135536 - DNA, 20 bp, Artificial Sequence
  chemically synthesized
agaattatcctggtaccatt

SEQ ID NO: 135537 - DNA, 20 bp, Artificial Sequence
  chemically synthesized
aattatcctggtaccattta

SEQ ID NO: 135538 - DNA, 20 bp, Artificial Sequence
  chemically synthesized
attatcctggtaccatttag

SEQ ID NO: 135539 - DNA, 20 bp, Artificial Sequence
  chemically synthesized
atatgcctggagcctctaaa

SEQ ID NO: 135540 - DNA, 20 bp, Artificial Sequence
  chemically synthesized
ctggtaccatttagaggctc

SEQ ID NO: 135541 - DNA, 20 bp, Artificial Sequence
  chemically synthesized
tggtaccatttagaggctcc

SEQ ID NO: 135542 - DNA, 20 bp, Artificial Sequence
  chemically synthesized
cttagttccaaatatgcctg

SEQ ID NO: 135543 - DNA, 20 bp, Artificial Sequence
  chemically synthesized
atcttagttccaaatatgcc

SEQ ID NO: 135544 - DNA, 20 bp, Artificial Sequence
  chemically synthesized
ttagaggctccaggcatatt

SEQ ID NO: 135545 - DNA, 20 bp, Artificial Sequence
  chemically synthesized
ctccaggcatatttggaact

SEQ ID NO: 135546 - DNA, 20 bp, Artificial Sequence
  chemically synthesized
catatttggaactaagattc

SEQ ID NO: 135547 - DNA, 20 bp, Artificial Sequence
  chemically synthesized
aagagtctaagctggaatct

SEQ ID NO: 135548 - DNA, 20 bp, Artificial Sequence
  chemically synthesized
ttggaactaagattccagct

SEQ ID NO: 135549 - DNA, 20 bp, Artificial Sequence
  chemically synthesized
cgcttattaagagtctaagc

SEQ ID NO: 135550 - DNA, 20 bp, Artificial Sequence
  chemically synthesized
atagcgcttattaagagtct

SEQ ID NO: 135551 - DNA, 20 bp, Artificial Sequence
  chemically synthesized
ttccagcttagactcttaat

SEQ ID NO: 135552 - DNA, 20 bp, Artificial Sequence
  chemically synthesized
tgtgtcatagcgcttattaa

SEQ ID NO: 135553 - DNA, 20 bp, Artificial Sequence
  chemically synthesized
gatgtgtcatagcgcttatt

SEQ ID NO: 135554 - DNA, 20 bp, Artificial Sequence
  chemically synthesized
gtgtctgtcgagatgtgtca

SEQ ID NO: 135555 - DNA, 20 bp, Artificial Sequence
  chemically synthesized
agcgctatgacacatctcga

SEQ ID NO: 135556 - DNA, 20 bp, Artificial Sequence
  chemically synthesized
cttaaaagcaagtgtctgtc

SEQ ID NO: 135557 - DNA, 20 bp, Artificial Sequence
  chemically synthesized
ctcgacagacacttgctttt

SEQ ID NO: 135558 - DNA, 20 bp, Artificial Sequence
  chemically synthesized
gaaagcattttcttaaaagc

SEQ ID NO: 135559 - DNA, 20 bp, Artificial Sequence
  chemically synthesized
ccaagaaagcattttcttaa

SEQ ID NO: 135560 - DNA, 20 bp, Artificial Sequence
  chemically synthesized
cttttaagaaaatgctttct

SEQ ID NO: 135561 - DNA, 20 bp, Artificial Sequence
  chemically synthesized
gtaatccaaatggtccaaga

SEQ ID NO: 135562 - DNA, 20 bp, Artificial Sequence
  chemically synthesized
ggctgtaatccaaatggtcc

SEQ ID NO: 135563 - DNA, 20 bp, Artificial Sequence
  chemically synthesized
aaatgctttcttggaccatt

SEQ ID NO: 135564 - DNA, 20 bp, Artificial Sequence
  chemically synthesized
tggaaaggctgtaatccaaa

SEQ ID NO: 135565 - DNA, 20 bp, Artificial Sequence
  chemically synthesized
ttcttggaccatttggatta

SEQ ID NO: 135566 - DNA, 20 bp, Artificial Sequence
  chemically synthesized
ttggattacagcctttccac

SEQ ID NO: 135567 - DNA, 20 bp, Artificial Sequence
  chemically synthesized
tggattacagcctttccact

SEQ ID NO: 135568 - DNA, 20 bp, Artificial Sequence
  chemically synthesized
atatttgcagcctagtggaa

SEQ ID NO: 135569 - DNA, 20 bp, Artificial Sequence
  chemically synthesized
aatatttgcagcctagtgga

SEQ ID NO: 135570 - DNA, 20 bp, Artificial Sequence
  chemically synthesized
tatgaatatttgcagcctag

SEQ ID NO: 135571 - DNA, 20 bp, Artificial Sequence
  chemically synthesized
ctttatgaatatttgcagcc

SEQ ID NO: 135572 - DNA, 20 bp, Artificial Sequence
  chemically synthesized
aatacctttatgaatatttg

SEQ ID NO: 135573 - DNA, 20 bp, Artificial Sequence
  chemically synthesized
ctaggctgcaaatattcata

SEQ ID NO: 135574 - DNA, 20 bp, Artificial Sequence
  chemically synthesized
taggctgcaaatattcataa

SEQ ID NO: 135575 - DNA, 20 bp, Artificial Sequence
  chemically synthesized
ataaaggtattcattcctaa

SEQ ID NO: 135576 - DNA, 20 bp, Artificial Sequence
  chemically synthesized
tttctaagcttttgtctttt

SEQ ID NO: 135577 - DNA, 20 bp, Artificial Sequence
  chemically synthesized
ttttctaagcttttgtcttt

SEQ ID NO: 135578 - DNA, 20 bp, Artificial Sequence
  chemically synthesized
tattcattcctaaaagacaa

SEQ ID NO: 135579 - DNA, 20 bp, Artificial Sequence
  chemically synthesized
attcctaaaagacaaaagct

SEQ ID NO: 135580 - DNA, 20 bp, Artificial Sequence
  chemically synthesized
taaaagacaaaagcttagaa

SEQ ID NO: 135581 - DNA, 20 bp, Artificial Sequence
  chemically synthesized
aagacaaaagcttagaaaag

SEQ ID NO: 135582 - DNA, 20 bp, Artificial Sequence
  chemically synthesized
ttgaatagttcttcttttct

SEQ ID NO: 135583 - DNA, 20 bp, Artificial Sequence
  chemically synthesized
ccaatattcagtgatttgaa

SEQ ID NO: 135584 - DNA, 20 bp, Artificial Sequence
  chemically synthesized
ctattcaaatcactgaatat

SEQ ID NO: 135585 - DNA, 20 bp, Artificial Sequence
  chemically synthesized
tgtatctctctgccaatatt

SEQ ID NO: 135586 - DNA, 20 bp, Artificial Sequence
  chemically synthesized
ttcaaatcactgaatattgg

SEQ ID NO: 135587 - DNA, 20 bp, Artificial Sequence
  chemically synthesized
caaatcactgaatattggca

SEQ ID NO: 135588 - DNA, 20 bp, Artificial Sequence
  chemically synthesized
aatcactgaatattggcaga

SEQ ID NO: 135589 - DNA, 20 bp, Artificial Sequence
  chemically synthesized
agagatacaaacttgccctc

SEQ ID NO: 135590 - DNA, 20 bp, Artificial Sequence
  chemically synthesized
aaattgaatgaccggagggc

SEQ ID NO: 135591 - DNA, 20 bp, Artificial Sequence
  chemically synthesized
attaaaattgaatgaccgga

SEQ ID NO: 135592 - DNA, 20 bp, Artificial Sequence
  chemically synthesized
gattaaaattgaatgaccgg

SEQ ID NO: 135593 - DNA, 20 bp, Artificial Sequence
  chemically synthesized
agattaaaattgaatgaccg

SEQ ID NO: 135594 - DNA, 20 bp, Artificial Sequence
  chemically synthesized
agagattaaaattgaatgac

SEQ ID NO: 135595 - DNA, 20 bp, Artificial Sequence
  chemically synthesized
gcattgactttttcatgata

SEQ ID NO: 135596 - DNA, 20 bp, Artificial Sequence
  chemically synthesized
ttgcattgactttttcatga

SEQ ID NO: 135597 - DNA, 20 bp, Artificial Sequence
  chemically synthesized
ttttaatctctatcatgaaa

SEQ ID NO: 135598 - DNA, 20 bp, Artificial Sequence
  chemically synthesized
tgcaatatgaaaaaaaaatg

SEQ ID NO: 135599 - DNA, 20 bp, Artificial Sequence
  chemically synthesized
gcaatatgaaaaaaaaatgc

SEQ ID NO: 135600 - DNA, 20 bp, Artificial Sequence
  chemically synthesized
caatatgaaaaaaaaatgca

SEQ ID NO: 135601 - DNA, 20 bp, Artificial Sequence
  chemically synthesized
aatatgaaaaaaaaatgcag

SEQ ID NO: 135602 - DNA, 20 bp, Artificial Sequence
  chemically synthesized
aaaaaaaatgcaggggataa

SEQ ID NO: 135603 - DNA, 20 bp, Artificial Sequence
  chemically synthesized
aggggataatggaaaatgtt

SEQ ID NO: 135604 - DNA, 20 bp, Artificial Sequence
  chemically synthesized
gacaatatgaatgtattata

SEQ ID NO: 135605 - DNA, 20 bp, Artificial Sequence
  chemically synthesized
cattcatattgtcttcctct

SEQ ID NO: 135606 - DNA, 20 bp, Artificial Sequence
  chemically synthesized
attcatattgtcttcctctt

SEQ ID NO: 135607 - DNA, 20 bp, Artificial Sequence
  chemically synthesized
ttcatattgtcttcctctta

SEQ ID NO: 135608 - DNA, 20 bp, Artificial Sequence
  chemically synthesized
tcaattttttccctaagagg

SEQ ID NO: 135609 - DNA, 20 bp, Artificial Sequence
  chemically synthesized
acttcaattttttccctaag

SEQ ID NO: 135610 - DNA, 20 bp, Artificial Sequence
  chemically synthesized
cacttcaattttttccctaa

SEQ ID NO: 135611 - DNA, 20 bp, Artificial Sequence
  chemically synthesized
atcacttcaattttttccct

SEQ ID NO: 135612 - DNA, 20 bp, Artificial Sequence
  chemically synthesized
tcctcttagggaaaaaattg

SEQ ID NO: 135613 - DNA, 20 bp, Artificial Sequence
  chemically synthesized
aaattgaagtgatttttcat

SEQ ID NO: 135614 - DNA, 20 bp, Artificial Sequence
  chemically synthesized
ataacaaatgactctctgta

SEQ ID NO: 135615 - DNA, 20 bp, Artificial Sequence
  chemically synthesized
atctgaacatactatacaga

SEQ ID NO: 135616 - DNA, 20 bp, Artificial Sequence
  chemically synthesized
aaatctgaacatactataca

SEQ ID NO: 135617 - DNA, 20 bp, Artificial Sequence
  chemically synthesized
gcaaatctgaacatactata

SEQ ID NO: 135618 - DNA, 20 bp, Artificial Sequence
  chemically synthesized
gactctctgtatagtatgtt

SEQ ID NO: 135619 - DNA, 20 bp, Artificial Sequence
  chemically synthesized
aatatggaaatttggcagtg

SEQ ID NO: 135620 - DNA, 20 bp, Artificial Sequence
  chemically synthesized
aaatatggaaatttggcagt

SEQ ID NO: 135621 - DNA, 20 bp, Artificial Sequence
  chemically synthesized
tgagaaatatggaaatttgg

SEQ ID NO: 135622 - DNA, 20 bp, Artificial Sequence
  chemically synthesized
gcctgagaaatatggaaatt

SEQ ID NO: 135623 - DNA, 20 bp, Artificial Sequence
  chemically synthesized
tgccaaatttccatatttct

SEQ ID NO: 135624 - DNA, 20 bp, Artificial Sequence
  chemically synthesized
agtttcttgcctgagaaata

SEQ ID NO: 135625 - DNA, 20 bp, Artificial Sequence
  chemically synthesized
gccaaatttccatatttctc

SEQ ID NO: 135626 - DNA, 20 bp, Artificial Sequence
  chemically synthesized
aatttccatatttctcaggc

SEQ ID NO: 135627 - DNA, 20 bp, Artificial Sequence
  chemically synthesized
aagtgatcagtttcttgcct

SEQ ID NO: 135628 - DNA, 20 bp, Artificial Sequence
  chemically synthesized
ccattacacaggtaagtgat

SEQ ID NO: 135629 - DNA, 20 bp, Artificial Sequence
  chemically synthesized
tgaattcccattacacaggt

SEQ ID NO: 135630 - DNA, 20 bp, Artificial Sequence
  chemically synthesized
ctgatcacttacctgtgtaa

SEQ ID NO: 135631 - DNA, 20 bp, Artificial Sequence
  chemically synthesized
tgatcacttacctgtgtaat

SEQ ID NO: 135632 - DNA, 20 bp, Artificial Sequence
  chemically synthesized
agactgaattcccattacac

SEQ ID NO: 135633 - DNA, 20 bp, Artificial Sequence
  chemically synthesized
gagactgaattcccattaca

SEQ ID NO: 135634 - DNA, 20 bp, Artificial Sequence
  chemically synthesized
ttacctgtgtaatgggaatt

SEQ ID NO: 135635 - DNA, 20 bp, Artificial Sequence
  chemically synthesized
tgggaattcagtctcatatt

SEQ ID NO: 135636 - DNA, 20 bp, Artificial Sequence
  chemically synthesized
gtgagtgatttactcaatat

SEQ ID NO: 135637 - DNA, 20 bp, Artificial Sequence
  chemically synthesized
tattgagtaaatcactcact

SEQ ID NO: 135638 - DNA, 20 bp, Artificial Sequence
  chemically synthesized
ccaaaagagtgaatcttagt

SEQ ID NO: 135639 - DNA, 20 bp, Artificial Sequence
  chemically synthesized
tgacccaaaagagtgaatct

SEQ ID NO: 135640 - DNA, 20 bp, Artificial Sequence
  chemically synthesized
ctcactaagattcactcttt

SEQ ID NO: 135641 - DNA, 20 bp, Artificial Sequence
  chemically synthesized
tcactaagattcactctttt

SEQ ID NO: 135642 - DNA, 20 bp, Artificial Sequence
  chemically synthesized
tgcaacacactgacccaaaa

SEQ ID NO: 135643 - DNA, 20 bp, Artificial Sequence
  chemically synthesized
taagattcactcttttgggt

SEQ ID NO: 135644 - DNA, 20 bp, Artificial Sequence
  chemically synthesized
gttgcaacacactgacccaa

SEQ ID NO: 135645 - DNA, 20 bp, Artificial Sequence
  chemically synthesized
gtcagtgtgttgcaacttgt

SEQ ID NO: 135646 - DNA, 20 bp, Artificial Sequence
  chemically synthesized
cagtgtgttgcaacttgttg

SEQ ID NO: 135647 - DNA, 20 bp, Artificial Sequence
  chemically synthesized
aaccttgagggttctccaac

SEQ ID NO: 135648 - DNA, 20 bp, Artificial Sequence
  chemically synthesized
caacttgttggagaaccctc

SEQ ID NO: 135649 - DNA, 20 bp, Artificial Sequence
  chemically synthesized
aacttgttggagaaccctca

SEQ ID NO: 135650 - DNA, 20 bp, Artificial Sequence
  chemically synthesized
ccaccatactggaaccttga

SEQ ID NO: 135651 - DNA, 20 bp, Artificial Sequence
  chemically synthesized
tccaccatactggaaccttg

SEQ ID NO: 135652 - DNA, 20 bp, Artificial Sequence
  chemically synthesized
ttggagaaccctcaaggttc

SEQ ID NO: 135653 - DNA, 20 bp, Artificial Sequence
  chemically synthesized
ctccaccatactggaacctt

SEQ ID NO: 135654 - DNA, 20 bp, Artificial Sequence
  chemically synthesized
gaaccctcaaggttccagta

SEQ ID NO: 135655 - DNA, 20 bp, Artificial Sequence
  chemically synthesized
ccctcaaggttccagtatgg

SEQ ID NO: 135656 - DNA, 20 bp, Artificial Sequence
  chemically synthesized
agagcattcctccaccatac

SEQ ID NO: 135657 - DNA, 20 bp, Artificial Sequence
  chemically synthesized
ctcaaggttccagtatggtg

SEQ ID NO: 135658 - DNA, 20 bp, Artificial Sequence
  chemically synthesized
tcaaggttccagtatggtgg

SEQ ID NO: 135659 - DNA, 20 bp, Artificial Sequence
  chemically synthesized
gccatacaattgatttagca

SEQ ID NO: 135660 - DNA, 20 bp, Artificial Sequence
  chemically synthesized
tagccatacaattgatttag

SEQ ID NO: 135661 - DNA, 20 bp, Artificial Sequence
  chemically synthesized
agatagccatacaattgatt

SEQ ID NO: 135662 - DNA, 20 bp, Artificial Sequence
  chemically synthesized
gctctgctaaatcaattgta

SEQ ID NO: 135663 - DNA, 20 bp, Artificial Sequence
  chemically synthesized
gaggaacagatttggtaaga

SEQ ID NO: 135664 - DNA, 20 bp, Artificial Sequence
  chemically synthesized
ggaagaggaacagatttggt

SEQ ID NO: 135665 - DNA, 20 bp, Artificial Sequence
  chemically synthesized
cctaggaagaggaacagatt

SEQ ID NO: 135666 - DNA, 20 bp, Artificial Sequence
  chemically synthesized
gttgagcctaggaagaggaa

SEQ ID NO: 135667 - DNA, 20 bp, Artificial Sequence
  chemically synthesized
accaaatctgttcctcttcc

SEQ ID NO: 135668 - DNA, 20 bp, Artificial Sequence
  chemically synthesized
ccaaatctgttcctcttcct

SEQ ID NO: 135669 - DNA, 20 bp, Artificial Sequence
  chemically synthesized
acactgttgagcctaggaag

SEQ ID NO: 135670 - DNA, 20 bp, Artificial Sequence
  chemically synthesized
tacactgttgagcctaggaa

SEQ ID NO: 135671 - DNA, 20 bp, Artificial Sequence
  chemically synthesized
tgtacactgttgagcctagg

SEQ ID NO: 135672 - DNA, 20 bp, Artificial Sequence
  chemically synthesized
tagtgtacactgttgagcct

SEQ ID NO: 135673 - DNA, 20 bp, Artificial Sequence
  chemically synthesized
gttcctcttcctaggctcaa

SEQ ID NO: 135674 - DNA, 20 bp, Artificial Sequence
  chemically synthesized
atagtgtacactgttgagcc

SEQ ID NO: 135675 - DNA, 20 bp, Artificial Sequence
  chemically synthesized
gggaaatagtgtacactgtt

SEQ ID NO: 135676 - DNA, 20 bp, Artificial Sequence
  chemically synthesized
ctgcgagggaattagggaaa

SEQ ID NO: 135677 - DNA, 20 bp, Artificial Sequence
  chemically synthesized
acctaactgcgagggaatta

SEQ ID NO: 135678 - DNA, 20 bp, Artificial Sequence
  chemically synthesized
cacctaactgcgagggaatt

SEQ ID NO: 135679 - DNA, 20 bp, Artificial Sequence
  chemically synthesized
acacctaactgcgagggaat

SEQ ID NO: 135680 - DNA, 20 bp, Artificial Sequence
  chemically synthesized
ctatttccctaattccctcg

SEQ ID NO: 135681 - DNA, 20 bp, Artificial Sequence
  chemically synthesized
ttccctaattccctcgcagt

SEQ ID NO: 135682 - DNA, 20 bp, Artificial Sequence
  chemically synthesized
atggtcacacctaactgcga

SEQ ID NO: 135683 - DNA, 20 bp, Artificial Sequence
  chemically synthesized
tccctaattccctcgcagtt

SEQ ID NO: 135684 - DNA, 20 bp, Artificial Sequence
  chemically synthesized
catggtcacacctaactgcg

SEQ ID NO: 135685 - DNA, 20 bp, Artificial Sequence
  chemically synthesized
acatggtcacacctaactgc

SEQ ID NO: 135686 - DNA, 20 bp, Artificial Sequence
  chemically synthesized
gttaggtgtgaccatgtgac

SEQ ID NO: 135687 - DNA, 20 bp, Artificial Sequence
  chemically synthesized
gttggatggatcttgtcaca

SEQ ID NO: 135688 - DNA, 20 bp, Artificial Sequence
  chemically synthesized
atgtgacaagatccatccaa

SEQ ID NO: 135689 - DNA, 20 bp, Artificial Sequence
  chemically synthesized
tttgttcatattctgttgga

SEQ ID NO: 135690 - DNA, 20 bp, Artificial Sequence
  chemically synthesized
taattttgttcatattctgt

SEQ ID NO: 135691 - DNA, 20 bp, Artificial Sequence
  chemically synthesized
aaattaacacacaccatttc

SEQ ID NO: 135692 - DNA, 20 bp, Artificial Sequence
  chemically synthesized
aattaacacacaccatttcc

SEQ ID NO: 135693 - DNA, 20 bp, Artificial Sequence
  chemically synthesized
tcatgagccacgcctggaaa

SEQ ID NO: 135694 - DNA, 20 bp, Artificial Sequence
  chemically synthesized
acacacaccatttccaggcg

SEQ ID NO: 135695 - DNA, 20 bp, Artificial Sequence
  chemically synthesized
aatttgtcatgagccacgcc

SEQ ID NO: 135696 - DNA, 20 bp, Artificial Sequence
  chemically synthesized
tactcatgaaaatttgtcat

SEQ ID NO: 135697 - DNA, 20 bp, Artificial Sequence
  chemically synthesized
ggctcatgacaaattttcat

SEQ ID NO: 135698 - DNA, 20 bp, Artificial Sequence
  chemically synthesized
ttaatgggcagatgaagaat

SEQ ID NO: 135699 - DNA, 20 bp, Artificial Sequence
  chemically synthesized
atgcatttaatgggcagatg

SEQ ID NO: 135700 - DNA, 20 bp, Artificial Sequence
  chemically synthesized
actcatatgcatttaatggg

SEQ ID NO: 135701 - DNA, 20 bp, Artificial Sequence
  chemically synthesized
aagactcatatgcatttaat

SEQ ID NO: 135702 - DNA, 20 bp, Artificial Sequence
  chemically synthesized
taagactcatatgcatttaa

SEQ ID NO: 135703 - DNA, 20 bp, Artificial Sequence
  chemically synthesized
tctgcccattaaatgcatat

SEQ ID NO: 135704 - DNA, 20 bp, Artificial Sequence
  chemically synthesized
tgcatatgagtcttatgctc

SEQ ID NO: 135705 - DNA, 20 bp, Artificial Sequence
  chemically synthesized
atcttttgtgtccagagcat

SEQ ID NO: 135706 - DNA, 20 bp, Artificial Sequence
  chemically synthesized
ccttccatcttttgtgtcca

SEQ ID NO: 135707 - DNA, 20 bp, Artificial Sequence
  chemically synthesized
gtcttatgctctggacacaa

SEQ ID NO: 135708 - DNA, 20 bp, Artificial Sequence
  chemically synthesized
ctccttccatcttttgtgtc

SEQ ID NO: 135709 - DNA, 20 bp, Artificial Sequence
  chemically synthesized
tatgctctggacacaaaaga

SEQ ID NO: 135710 - DNA, 20 bp, Artificial Sequence
  chemically synthesized
gctctggacacaaaagatgg

SEQ ID NO: 135711 - DNA, 20 bp, Artificial Sequence
  chemically synthesized
ctctggacacaaaagatgga

SEQ ID NO: 135712 - DNA, 20 bp, Artificial Sequence
  chemically synthesized
ctggacacaaaagatggaag

SEQ ID NO: 135713 - DNA, 20 bp, Artificial Sequence
  chemically synthesized
cacaaaagatggaaggagct

SEQ ID NO: 135714 - DNA, 20 bp, Artificial Sequence
  chemically synthesized
acaaaagatggaaggagctt

SEQ ID NO: 135715 - DNA, 20 bp, Artificial Sequence
  chemically synthesized
atgaagtcattcaggaaccc

SEQ ID NO: 135716 - DNA, 20 bp, Artificial Sequence
  chemically synthesized
agccctctatgaagtcattc

SEQ ID NO: 135717 - DNA, 20 bp, Artificial Sequence
  chemically synthesized
cagccctctatgaagtcatt

SEQ ID NO: 135718 - DNA, 20 bp, Artificial Sequence
  chemically synthesized
tgggttcctgaatgacttca

SEQ ID NO: 135719 - DNA, 20 bp, Artificial Sequence
  chemically synthesized
ggttcctgaatgacttcata

SEQ ID NO: 135720 - DNA, 20 bp, Artificial Sequence
  chemically synthesized
gttcctgaatgacttcatag

SEQ ID NO: 135721 - DNA, 20 bp, Artificial Sequence
  chemically synthesized
ttcctgaatgacttcataga

SEQ ID NO: 135722 - DNA, 20 bp, Artificial Sequence
  chemically synthesized
aaaataagcagccctctatg

SEQ ID NO: 135723 - DNA, 20 bp, Artificial Sequence
  chemically synthesized
tcatagagggctgcttattt

SEQ ID NO: 135724 - DNA, 20 bp, Artificial Sequence
  chemically synthesized
ttagtgcagtccaaaataag

SEQ ID NO: 135725 - DNA, 20 bp, Artificial Sequence
  chemically synthesized
attttagtgcagtccaaaat

SEQ ID NO: 135726 - DNA, 20 bp, Artificial Sequence
  chemically synthesized
atttacttcttattttagtg

SEQ ID NO: 135727 - DNA, 20 bp, Artificial Sequence
  chemically synthesized
attttggactgcactaaaat

SEQ ID NO: 135728 - DNA, 20 bp, Artificial Sequence
  chemically synthesized
ttggactgcactaaaataag

SEQ ID NO: 135729 - DNA, 20 bp, Artificial Sequence
  chemically synthesized
cagaaatttacttcttattt

SEQ ID NO: 135730 - DNA, 20 bp, Artificial Sequence
  chemically synthesized
taagaagtaaatttctgctg

SEQ ID NO: 135731 - DNA, 20 bp, Artificial Sequence
  chemically synthesized
aagtaaatttctgctgtagt

SEQ ID NO: 135732 - DNA, 20 bp, Artificial Sequence
  chemically synthesized
atcttggaggcttactacag

SEQ ID NO: 135733 - DNA, 20 bp, Artificial Sequence
  chemically synthesized
caaatcttggaggcttacta

SEQ ID NO: 135734 - DNA, 20 bp, Artificial Sequence
  chemically synthesized
ttctgctgtagtaagcctcc

SEQ ID NO: 135735 - DNA, 20 bp, Artificial Sequence
  chemically synthesized
ggtaatctcccaaatcttgg

SEQ ID NO: 135736 - DNA, 20 bp, Artificial Sequence
  chemically synthesized
tgtagtaagcctccaagatt

SEQ ID NO: 135737 - DNA, 20 bp, Artificial Sequence
  chemically synthesized
aggtaatctcccaaatcttg

SEQ ID NO: 135738 - DNA, 20 bp, Artificial Sequence
  chemically synthesized
gtagtaagcctccaagattt

SEQ ID NO: 135739 - DNA, 20 bp, Artificial Sequence
  chemically synthesized
acaggtaatctcccaaatct

SEQ ID NO: 135740 - DNA, 20 bp, Artificial Sequence
  chemically synthesized
agtaagcctccaagatttgg

SEQ ID NO: 135741 - DNA, 20 bp, Artificial Sequence
  chemically synthesized
atttgggagattacctgtta

SEQ ID NO: 135742 - DNA, 20 bp, Artificial Sequence
  chemically synthesized
tgggagattacctgttatag

SEQ ID NO: 135743 - DNA, 20 bp, Artificial Sequence
  chemically synthesized
gtaacactagccactataac

SEQ ID NO: 135744 - DNA, 20 bp, Artificial Sequence
  chemically synthesized
agtaacactagccactataa

SEQ ID NO: 135745 - DNA, 20 bp, Artificial Sequence
  chemically synthesized
agattacctgttatagtggc

SEQ ID NO: 135746 - DNA, 20 bp, Artificial Sequence
  chemically synthesized
atgtattatttcagtaacac

SEQ ID NO: 135747 - DNA, 20 bp, Artificial Sequence
  chemically synthesized
tgtatgctaatgtattattt

SEQ ID NO: 135748 - DNA, 20 bp, Artificial Sequence
  chemically synthesized
gtgttactgaaataatacat

SEQ ID NO: 135749 - DNA, 20 bp, Artificial Sequence
  chemically synthesized
tgttgcttaaacaatgaatg

SEQ ID NO: 135750 - DNA, 20 bp, Artificial Sequence
  chemically synthesized
tacatccacattcattgttt

SEQ ID NO: 135751 - DNA, 20 bp, Artificial Sequence
  chemically synthesized
tcattgtttaagcaacaata

SEQ ID NO: 135752 - DNA, 20 bp, Artificial Sequence
  chemically synthesized
attgtttaagcaacaataaa

SEQ ID NO: 135753 - DNA, 20 bp, Artificial Sequence
  chemically synthesized
taggctgttcttggttttga

SEQ ID NO: 135754 - DNA, 20 bp, Artificial Sequence
  chemically synthesized
agagttaaactttcaaaacc

SEQ ID NO: 135755 - DNA, 20 bp, Artificial Sequence
  chemically synthesized
taaactttcaaaaccaagaa

SEQ ID NO: 135756 - DNA, 20 bp, Artificial Sequence
  chemically synthesized
taattaaaataggctgttct

SEQ ID NO: 135757 - DNA, 20 bp, Artificial Sequence
  chemically synthesized
tagtgattgctaattaaaat

SEQ ID NO: 135758 - DNA, 20 bp, Artificial Sequence
  chemically synthesized
caagaacagcctattttaat

SEQ ID NO: 135759 - DNA, 20 bp, Artificial Sequence
  chemically synthesized
gtagtgattgctaattaaaa

SEQ ID NO: 135760 - DNA, 20 bp, Artificial Sequence
  chemically synthesized
ttagcaatcactacaactga

SEQ ID NO: 135761 - DNA, 20 bp, Artificial Sequence
  chemically synthesized
gacatgtcttctttcagttg

SEQ ID NO: 135762 - DNA, 20 bp, Artificial Sequence
  chemically synthesized
gcaatcactacaactgaaag

SEQ ID NO: 135763 - DNA, 20 bp, Artificial Sequence
  chemically synthesized
cctaaagacatgtcttcttt

SEQ ID NO: 135764 - DNA, 20 bp, Artificial Sequence
  chemically synthesized
actgaaagaagacatgtctt

SEQ ID NO: 135765 - DNA, 20 bp, Artificial Sequence
  chemically synthesized
ctgaaagaagacatgtcttt

SEQ ID NO: 135766 - DNA, 20 bp, Artificial Sequence
  chemically synthesized
aaagaagacatgtctttagg

SEQ ID NO: 135767 - DNA, 20 bp, Artificial Sequence
  chemically synthesized
atgttttgattcacttccta

SEQ ID NO: 135768 - DNA, 20 bp, Artificial Sequence
  chemically synthesized
aatcaaaacatacataattt

SEQ ID NO: 135769 - DNA, 20 bp, Artificial Sequence
  chemically synthesized
acatacataatttcagacaa

SEQ ID NO: 135770 - DNA, 20 bp, Artificial Sequence
  chemically synthesized
tacataatttcagacaaaag

SEQ ID NO: 135771 - DNA, 20 bp, Artificial Sequence
  chemically synthesized
tttcagacaaaagaagtatt

SEQ ID NO: 135772 - DNA, 20 bp, Artificial Sequence
  chemically synthesized
acaaaagaagtatttagtct

SEQ ID NO: 135773 - DNA, 20 bp, Artificial Sequence
  chemically synthesized
atgaccttaatcattgtact

SEQ ID NO: 135774 - DNA, 20 bp, Artificial Sequence
  chemically synthesized
ttagtcttagtacaatgatt

SEQ ID NO: 135775 - DNA, 20 bp, Artificial Sequence
  chemically synthesized
tagtcttagtacaatgatta

SEQ ID NO: 135776 - DNA, 20 bp, Artificial Sequence
  chemically synthesized
atgattaaggtcattaacaa

SEQ ID NO: 135777 - DNA, 20 bp, Artificial Sequence
  chemically synthesized
attaacaaaagcaacaaaac

SEQ ID NO: 135778 - DNA, 20 bp, Artificial Sequence
  chemically synthesized
acaaaagcaacaaaacaaga

SEQ ID NO: 135779 - DNA, 20 bp, Artificial Sequence
  chemically synthesized
caaaagcaacaaaacaagat

SEQ ID NO: 135780 - DNA, 20 bp, Artificial Sequence
  chemically synthesized
caacaaaacaagatgggaaa

SEQ ID NO: 135781 - DNA, 20 bp, Artificial Sequence
  chemically synthesized
atgggaaatggtaaacatac

SEQ ID NO: 135782 - DNA, 20 bp, Artificial Sequence
  chemically synthesized
gaaatggtaaacatactaga

SEQ ID NO: 135783 - DNA, 20 bp, Artificial Sequence
  chemically synthesized
aatggtaaacatactagaaa

SEQ ID NO: 135784 - DNA, 20 bp, Artificial Sequence
  chemically synthesized
ttgaaaatctgcgctctttc

SEQ ID NO: 135785 - DNA, 20 bp, Artificial Sequence
  chemically synthesized
taaacatactagaaagagcg

SEQ ID NO: 135786 - DNA, 20 bp, Artificial Sequence
  chemically synthesized
tagaaagagcgcagattttc

SEQ ID NO: 135787 - DNA, 20 bp, Artificial Sequence
  chemically synthesized
aagagcgcagattttcaagt

SEQ ID NO: 135788 - DNA, 20 bp, Artificial Sequence
  chemically synthesized
gcgcagattttcaagtcaga

SEQ ID NO: 135789 - DNA, 20 bp, Artificial Sequence
  chemically synthesized
gcagattttcaagtcagaaa

SEQ ID NO: 135790 - DNA, 20 bp, Artificial Sequence
  chemically synthesized
aagagacatttacaaattcc

SEQ ID NO: 135791 - DNA, 20 bp, Artificial Sequence
  chemically synthesized
aacaagcaaagaacagagct

SEQ ID NO: 135792 - DNA, 20 bp, Artificial Sequence
  chemically synthesized
ttacaaacaagcaaagaaca

SEQ ID NO: 135793 - DNA, 20 bp, Artificial Sequence
  chemically synthesized
gtttacaaacaagcaaagaa

SEQ ID NO: 135794 - DNA, 20 bp, Artificial Sequence
  chemically synthesized
gcgtcgtttacaaacaagca

SEQ ID NO: 135795 - DNA, 20 bp, Artificial Sequence
  chemically synthesized
agactgcgtcgtttacaaac

SEQ ID NO: 135796 - DNA, 20 bp, Artificial Sequence
  chemically synthesized
ttgcttgtttgtaaacgacg

SEQ ID NO: 135797 - DNA, 20 bp, Artificial Sequence
  chemically synthesized
tccagcctgggcgacagagc

SEQ ID NO: 135798 - DNA, 20 bp, Artificial Sequence
  chemically synthesized
cgcagtctcgctctgtcgcc

SEQ ID NO: 135799 - DNA, 20 bp, Artificial Sequence
  chemically synthesized
gcactccagcctgggcgaca

SEQ ID NO: 135800 - DNA, 20 bp, Artificial Sequence
  chemically synthesized
gcagtctcgctctgtcgccc

SEQ ID NO: 135801 - DNA, 20 bp, Artificial Sequence
  chemically synthesized
ctgcactccagcctgggcga

SEQ ID NO: 135802 - DNA, 20 bp, Artificial Sequence
  chemically synthesized
tctcgctctgtcgcccaggc

SEQ ID NO: 135803 - DNA, 20 bp, Artificial Sequence
  chemically synthesized
tcgctctgtcgcccaggctg

SEQ ID NO: 135804 - DNA, 20 bp, Artificial Sequence
  chemically synthesized
gcgccactgcactccagcct

SEQ ID NO: 135805 - DNA, 20 bp, Artificial Sequence
  chemically synthesized
tgcgccactgcactccagcc

SEQ ID NO: 135806 - DNA, 20 bp, Artificial Sequence
  chemically synthesized
ctgtcgcccaggctggagtg

SEQ ID NO: 135807 - DNA, 20 bp, Artificial Sequence
  chemically synthesized
gagattgcgccactgcactc

SEQ ID NO: 135808 - DNA, 20 bp, Artificial Sequence
  chemically synthesized
tcgcccaggctggagtgcag

SEQ ID NO: 135809 - DNA, 20 bp, Artificial Sequence
  chemically synthesized
ggagtgcagtggcgcaatct

SEQ ID NO: 135810 - DNA, 20 bp, Artificial Sequence
  chemically synthesized
ggcggagcttgcagtgagcc

SEQ ID NO: 135811 - DNA, 20 bp, Artificial Sequence
  chemically synthesized
gcgcaatctcggctcactgc

SEQ ID NO: 135812 - DNA, 20 bp, Artificial Sequence
  chemically synthesized
cgggaggcggagcttgcagt

SEQ ID NO: 135813 - DNA, 20 bp, Artificial Sequence
  chemically synthesized
aacccgggaggcggagcttg

SEQ ID NO: 135814 - DNA, 20 bp, Artificial Sequence
  chemically synthesized
tcactgcaagctccgcctcc

SEQ ID NO: 135815 - DNA, 20 bp, Artificial Sequence
  chemically synthesized
tggcgtgaacccgggaggcg

SEQ ID NO: 135816 - DNA, 20 bp, Artificial Sequence
  chemically synthesized
cactgcaagctccgcctccc

SEQ ID NO: 135817 - DNA, 20 bp, Artificial Sequence
  chemically synthesized
aatggcgtgaacccgggagg

SEQ ID NO: 135818 - DNA, 20 bp, Artificial Sequence
  chemically synthesized
gagaatggcgtgaacccggg

SEQ ID NO: 135819 - DNA, 20 bp, Artificial Sequence
  chemically synthesized
ggagaatggcgtgaacccgg

SEQ ID NO: 135820 - DNA, 20 bp, Artificial Sequence
  chemically synthesized
caggagaatggcgtgaaccc

SEQ ID NO: 135821 - DNA, 20 bp, Artificial Sequence
  chemically synthesized
gcaggagaatggcgtgaacc

SEQ ID NO: 135822 - DNA, 20 bp, Artificial Sequence
  chemically synthesized
gggaggctgaggcaggagaa

SEQ ID NO: 135823 - DNA, 20 bp, Artificial Sequence
  chemically synthesized
ttcacgccattctcctgcct

SEQ ID NO: 135824 - DNA, 20 bp, Artificial Sequence
  chemically synthesized
tacttgggaggctgaggcag

SEQ ID NO: 135825 - DNA, 20 bp, Artificial Sequence
  chemically synthesized
gctacttgggaggctgaggc

SEQ ID NO: 135826 - DNA, 20 bp, Artificial Sequence
  chemically synthesized
agctacttgggaggctgagg

SEQ ID NO: 135827 - DNA, 20 bp, Artificial Sequence
  chemically synthesized
cccagctacttgggaggctg

SEQ ID NO: 135828 - DNA, 20 bp, Artificial Sequence
  chemically synthesized
tcccagctacttgggaggct

SEQ ID NO: 135829 - DNA, 20 bp, Artificial Sequence
  chemically synthesized
ttctcctgcctcagcctccc

SEQ ID NO: 135830 - DNA, 20 bp, Artificial Sequence
  chemically synthesized
tcctgcctcagcctcccaag

SEQ ID NO: 135831 - DNA, 20 bp, Artificial Sequence
  chemically synthesized
tgtagtcccagctacttggg

SEQ ID NO: 135832 - DNA, 20 bp, Artificial Sequence
  chemically synthesized
ctgtagtcccagctacttgg

SEQ ID NO: 135833 - DNA, 20 bp, Artificial Sequence
  chemically synthesized
gcctcagcctcccaagtagc

SEQ ID NO: 135834 - DNA, 20 bp, Artificial Sequence
  chemically synthesized
gcctgtagtcccagctactt

SEQ ID NO: 135835 - DNA, 20 bp, Artificial Sequence
  chemically synthesized
cctcagcctcccaagtagct

SEQ ID NO: 135836 - DNA, 20 bp, Artificial Sequence
  chemically synthesized
cgcctgtagtcccagctact

SEQ ID NO: 135837 - DNA, 20 bp, Artificial Sequence
  chemically synthesized
ctcccaagtagctgggacta

SEQ ID NO: 135838 - DNA, 20 bp, Artificial Sequence
  chemically synthesized
tcccaagtagctgggactac

SEQ ID NO: 135839 - DNA, 20 bp, Artificial Sequence
  chemically synthesized
gtggcgggcgcctgtagtcc

SEQ ID NO: 135840 - DNA, 20 bp, Artificial Sequence
  chemically synthesized
ggcgtggtggcgggcgcctg

SEQ ID NO: 135841 - DNA, 20 bp, Artificial Sequence
  chemically synthesized
aattagccgggcgtggtggc

SEQ ID NO: 135842 - DNA, 20 bp, Artificial Sequence
  chemically synthesized
aaattagccgggcgtggtgg

SEQ ID NO: 135843 - DNA, 20 bp, Artificial Sequence
  chemically synthesized
caggcgcccgccaccacgcc

SEQ ID NO: 135844 - DNA, 20 bp, Artificial Sequence
  chemically synthesized
aaaaaattagccgggcgtgg

SEQ ID NO: 135845 - DNA, 20 bp, Artificial Sequence
  chemically synthesized
aaaaaaaaattagccgggcg

SEQ ID NO: 135846 - DNA, 20 bp, Artificial Sequence
  chemically synthesized
aatacaaaaaaaaattagcc

SEQ ID NO: 135847 - DNA, 20 bp, Artificial Sequence
  chemically synthesized
aaatacaaaaaaaaattagc

SEQ ID NO: 135848 - DNA, 20 bp, Artificial Sequence
  chemically synthesized
ctaaaaatacaaaaaaaaat

SEQ ID NO: 135849 - DNA, 20 bp, Artificial Sequence
  chemically synthesized
ctaatttttttttgtatttt

SEQ ID NO: 135850 - DNA, 20 bp, Artificial Sequence
  chemically synthesized
atttttttttgtatttttag

SEQ ID NO: 135851 - DNA, 20 bp, Artificial Sequence
  chemically synthesized
ttttttttgtatttttagta

SEQ ID NO: 135852 - DNA, 20 bp, Artificial Sequence
  chemically synthesized
ttttgtatttttagtagaga

SEQ ID NO: 135853 - DNA, 20 bp, Artificial Sequence
  chemically synthesized
tttgtatttttagtagagac

SEQ ID NO: 135854 - DNA, 20 bp, Artificial Sequence
  chemically synthesized
ttgtatttttagtagagacg

SEQ ID NO: 135855 - DNA, 20 bp, Artificial Sequence
  chemically synthesized
gagacggggtttcaccgtgt

SEQ ID NO: 135856 - DNA, 20 bp, Artificial Sequence
  chemically synthesized
cggggtttcaccgtgttagc

SEQ ID NO: 135857 - DNA, 20 bp, Artificial Sequence
  chemically synthesized
cgagaccatcctggctaaca

SEQ ID NO: 135858 - DNA, 20 bp, Artificial Sequence
  chemically synthesized
ggggtttcaccgtgttagcc

SEQ ID NO: 135859 - DNA, 20 bp, Artificial Sequence
  chemically synthesized
tttcaccgtgttagccagga

SEQ ID NO: 135860 - DNA, 20 bp, Artificial Sequence
  chemically synthesized
tcaggagatcgagaccatcc

SEQ ID NO: 135861 - DNA, 20 bp, Artificial Sequence
  chemically synthesized
gatcacgaggtcaggagatc

SEQ ID NO: 135862 - DNA, 20 bp, Artificial Sequence
  chemically synthesized
cgggcggatcacgaggtcag

SEQ ID NO: 135863 - DNA, 20 bp, Artificial Sequence
  chemically synthesized
ggcgggcggatcacgaggtc

SEQ ID NO: 135864 - DNA, 20 bp, Artificial Sequence
  chemically synthesized
aggcgggcggatcacgaggt

SEQ ID NO: 135865 - DNA, 20 bp, Artificial Sequence
  chemically synthesized
gccgaggcgggcggatcacg

SEQ ID NO: 135866 - DNA, 20 bp, Artificial Sequence
  chemically synthesized
ggccgaggcgggcggatcac

SEQ ID NO: 135867 - DNA, 20 bp, Artificial Sequence
  chemically synthesized
acctcgtgatccgcccgcct

SEQ ID NO: 135868 - DNA, 20 bp, Artificial Sequence
  chemically synthesized
cttggggaggccgaggcggg

SEQ ID NO: 135869 - DNA, 20 bp, Artificial Sequence
  chemically synthesized
gcacttggggaggccgaggc

SEQ ID NO: 135870 - DNA, 20 bp, Artificial Sequence
  chemically synthesized
agcacttggggaggccgagg

SEQ ID NO: 135871 - DNA, 20 bp, Artificial Sequence
  chemically synthesized
cccagcacttggggaggccg

SEQ ID NO: 135872 - DNA, 20 bp, Artificial Sequence
  chemically synthesized
tcccagcacttggggaggcc

SEQ ID NO: 135873 - DNA, 20 bp, Artificial Sequence
  chemically synthesized
ccgcccgcctcggcctcccc

SEQ ID NO: 135874 - DNA, 20 bp, Artificial Sequence
  chemically synthesized
tgtaatcccagcacttgggg

SEQ ID NO: 135875 - DNA, 20 bp, Artificial Sequence
  chemically synthesized
ctgtaatcccagcacttggg

SEQ ID NO: 135876 - DNA, 20 bp, Artificial Sequence
  chemically synthesized
gcctcggcctccccaagtgc

SEQ ID NO: 135877 - DNA, 20 bp, Artificial Sequence
  chemically synthesized
gcctgtaatcccagcacttg

SEQ ID NO: 135878 - DNA, 20 bp, Artificial Sequence
  chemically synthesized
cctcggcctccccaagtgct

SEQ ID NO: 135879 - DNA, 20 bp, Artificial Sequence
  chemically synthesized
cgcctgtaatcccagcactt

SEQ ID NO: 135880 - DNA, 20 bp, Artificial Sequence
  chemically synthesized
acgcctgtaatcccagcact

SEQ ID NO: 135881 - DNA, 20 bp, Artificial Sequence
  chemically synthesized
ctccccaagtgctgggatta

SEQ ID NO: 135882 - DNA, 20 bp, Artificial Sequence
  chemically synthesized
tccccaagtgctgggattac

SEQ ID NO: 135883 - DNA, 20 bp, Artificial Sequence
  chemically synthesized
gtggctcacgcctgtaatcc

SEQ ID NO: 135884 - DNA, 20 bp, Artificial Sequence
  chemically synthesized
agtgctgggattacaggcgt

SEQ ID NO: 135885 - DNA, 20 bp, Artificial Sequence
  chemically synthesized
caggcgtgagccaccgcgcc

SEQ ID NO: 135886 - DNA, 20 bp, Artificial Sequence
  chemically synthesized
agttactcggccgggcgcgg

SEQ ID NO: 135887 - DNA, 20 bp, Artificial Sequence
  chemically synthesized
aacagttactcggccgggcg

SEQ ID NO: 135888 - DNA, 20 bp, Artificial Sequence
  chemically synthesized
gtgagccaccgcgcccggcc

SEQ ID NO: 135889 - DNA, 20 bp, Artificial Sequence
  chemically synthesized
ccaagaacagttactcggcc

SEQ ID NO: 135890 - DNA, 20 bp, Artificial Sequence
  chemically synthesized
tccaagaacagttactcggc

SEQ ID NO: 135891 - DNA, 20 bp, Artificial Sequence
  chemically synthesized
aggttccaagaacagttact

SEQ ID NO: 135892 - DNA, 20 bp, Artificial Sequence
  chemically synthesized
cccggccgagtaactgttct

SEQ ID NO: 135893 - DNA, 20 bp, Artificial Sequence
  chemically synthesized
gagaaaacaggttccaagaa

SEQ ID NO: 135894 - DNA, 20 bp, Artificial Sequence
  chemically synthesized
tagacgagaaaacaggttcc

SEQ ID NO: 135895 - DNA, 20 bp, Artificial Sequence
  chemically synthesized
cattttatagacgagaaaac

SEQ ID NO: 135896 - DNA, 20 bp, Artificial Sequence
  chemically synthesized
ccattttatagacgagaaaa

SEQ ID NO: 135897 - DNA, 20 bp, Artificial Sequence
  chemically synthesized
ataatccccattttatagac

SEQ ID NO: 135898 - DNA, 20 bp, Artificial Sequence
  chemically synthesized
ctgttttctcgtctataaaa

SEQ ID NO: 135899 - DNA, 20 bp, Artificial Sequence
  chemically synthesized
tgttttctcgtctataaaat

SEQ ID NO: 135900 - DNA, 20 bp, Artificial Sequence
  chemically synthesized
gttttctcgtctataaaatg

SEQ ID NO: 135901 - DNA, 20 bp, Artificial Sequence
  chemically synthesized
attttataatccccatttta

SEQ ID NO: 135902 - DNA, 20 bp, Artificial Sequence
  chemically synthesized
aaaatggggattataaaata

SEQ ID NO: 135903 - DNA, 20 bp, Artificial Sequence
  chemically synthesized
gattataaaatatagctcac

SEQ ID NO: 135904 - DNA, 20 bp, Artificial Sequence
  chemically synthesized
aaatctttacagaatcttgt

SEQ ID NO: 135905 - DNA, 20 bp, Artificial Sequence
  chemically synthesized
atagctcacaagattctgta

SEQ ID NO: 135906 - DNA, 20 bp, Artificial Sequence
  chemically synthesized
gtgtgtgtacaaaatcttta

SEQ ID NO: 135907 - DNA, 20 bp, Artificial Sequence
  chemically synthesized
aaagattttgtacacacaca

SEQ ID NO: 135908 - DNA, 20 bp, Artificial Sequence
  chemically synthesized
tacacacacacagaaacaca

SEQ ID NO: 135909 - DNA, 20 bp, Artificial Sequence
  chemically synthesized
agtacctcataagcattaga

SEQ ID NO: 135910 - DNA, 20 bp, Artificial Sequence
  chemically synthesized
attcagtacctcataagcat

SEQ ID NO: 135911 - DNA, 20 bp, Artificial Sequence
  chemically synthesized
acacaccatctaatgcttat

SEQ ID NO: 135912 - DNA, 20 bp, Artificial Sequence
  chemically synthesized
cacaccatctaatgcttatg

SEQ ID NO: 135913 - DNA, 20 bp, Artificial Sequence
  chemically synthesized
gtatttattcagtacctcat

SEQ ID NO: 135914 - DNA, 20 bp, Artificial Sequence
  chemically synthesized
gataatagctagtatttatt

SEQ ID NO: 135915 - DNA, 20 bp, Artificial Sequence
  chemically synthesized
atgaggtactgaataaatac

SEQ ID NO: 135916 - DNA, 20 bp, Artificial Sequence
  chemically synthesized
aagtacttattgataatagc

SEQ ID NO: 135917 - DNA, 20 bp, Artificial Sequence
  chemically synthesized
gggtaagtacttattgataa

SEQ ID NO: 135918 - DNA, 20 bp, Artificial Sequence
  chemically synthesized
aaatactagctattatcaat

SEQ ID NO: 135919 - DNA, 20 bp, Artificial Sequence
  chemically synthesized
catacttccacatattgggt

SEQ ID NO: 135920 - DNA, 20 bp, Artificial Sequence
  chemically synthesized
ataagtacttacccaatatg

SEQ ID NO: 135921 - DNA, 20 bp, Artificial Sequence
  chemically synthesized
tagtcatacttccacatatt

SEQ ID NO: 135922 - DNA, 20 bp, Artificial Sequence
  chemically synthesized
ttagtcatacttccacatat

SEQ ID NO: 135923 - DNA, 20 bp, Artificial Sequence
  chemically synthesized
agtacttacccaatatgtgg

SEQ ID NO: 135924 - DNA, 20 bp, Artificial Sequence
  chemically synthesized
ttaatattttaaaatattat

SEQ ID NO: 135925 - DNA, 20 bp, Artificial Sequence
  chemically synthesized
aaaatattaaccttttactc

SEQ ID NO: 135926 - DNA, 20 bp, Artificial Sequence
  chemically synthesized
gaaagagtaaccagagtaaa

SEQ ID NO: 135927 - DNA, 20 bp, Artificial Sequence
  chemically synthesized
tgaaagagtaaccagagtaa

SEQ ID NO: 135928 - DNA, 20 bp, Artificial Sequence
  chemically synthesized
ggaaagtgaaagagtaacca

SEQ ID NO: 135929 - DNA, 20 bp, Artificial Sequence
  chemically synthesized
ggggaaagtgaaagagtaac

SEQ ID NO: 135930 - DNA, 20 bp, Artificial Sequence
  chemically synthesized
atatgttggggaaagtgaaa

SEQ ID NO: 135931 - DNA, 20 bp, Artificial Sequence
  chemically synthesized
caatatgttggggaaagtga

SEQ ID NO: 135932 - DNA, 20 bp, Artificial Sequence
  chemically synthesized
agttgtcaatatgttgggga

SEQ ID NO: 135933 - DNA, 20 bp, Artificial Sequence
  chemically synthesized
gactagttgtcaatatgttg

SEQ ID NO: 135934 - DNA, 20 bp, Artificial Sequence
  chemically synthesized
tgactagttgtcaatatgtt

SEQ ID NO: 135935 - DNA, 20 bp, Artificial Sequence
  chemically synthesized
atgactagttgtcaatatgt

SEQ ID NO: 135936 - DNA, 20 bp, Artificial Sequence
  chemically synthesized
ttccccaacatattgacaac

SEQ ID NO: 135937 - DNA, 20 bp, Artificial Sequence
  chemically synthesized
cccttccctaaggaaatgac

SEQ ID NO: 135938 - DNA, 20 bp, Artificial Sequence
  chemically synthesized
ttgacaactagtcatttcct

SEQ ID NO: 135939 - DNA, 20 bp, Artificial Sequence
  chemically synthesized
tgacaactagtcatttcctt

SEQ ID NO: 135940 - DNA, 20 bp, Artificial Sequence
  chemically synthesized
gacaactagtcatttcctta

SEQ ID NO: 135941 - DNA, 20 bp, Artificial Sequence
  chemically synthesized
aactagtcatttccttaggg

SEQ ID NO: 135942 - DNA, 20 bp, Artificial Sequence
  chemically synthesized
actagtcatttccttaggga

SEQ ID NO: 135943 - DNA, 20 bp, Artificial Sequence
  chemically synthesized
ctagtcatttccttagggaa

SEQ ID NO: 135944 - DNA, 20 bp, Artificial Sequence
  chemically synthesized
gctatgttaacccttcccta

SEQ ID NO: 135945 - DNA, 20 bp, Artificial Sequence
  chemically synthesized
tgctatgttaacccttccct

SEQ ID NO: 135946 - DNA, 20 bp, Artificial Sequence
  chemically synthesized
tccttagggaagggttaaca

SEQ ID NO: 135947 - DNA, 20 bp, Artificial Sequence
  chemically synthesized
ttagggaagggttaacatag

SEQ ID NO: 135948 - DNA, 20 bp, Artificial Sequence
  chemically synthesized
atagcagaatataaattatg

SEQ ID NO: 135949 - DNA, 20 bp, Artificial Sequence
  chemically synthesized
gaatataaattatgaagata

SEQ ID NO: 135950 - DNA, 20 bp, Artificial Sequence
  chemically synthesized
tatgaagatatagactctca

SEQ ID NO: 135951 - DNA, 20 bp, Artificial Sequence
  chemically synthesized
ttcaaactcggaaaccatga

SEQ ID NO: 135952 - DNA, 20 bp, Artificial Sequence
  chemically synthesized
ttttcaaactcggaaaccat

SEQ ID NO: 135953 - DNA, 20 bp, Artificial Sequence
  chemically synthesized
tatagactctcatggtttcc

SEQ ID NO: 135954 - DNA, 20 bp, Artificial Sequence
  chemically synthesized
aggcttagacttttcaaact

SEQ ID NO: 135955 - DNA, 20 bp, Artificial Sequence
  chemically synthesized
tcatggtttccgagtttgaa

SEQ ID NO: 135956 - DNA, 20 bp, Artificial Sequence
  chemically synthesized
tttccgagtttgaaaagtct

SEQ ID NO: 135957 - DNA, 20 bp, Artificial Sequence
  chemically synthesized
gagtttgaaaagtctaagcc

SEQ ID NO: 135958 - DNA, 20 bp, Artificial Sequence
  chemically synthesized
cttttgtcttttaccaggct

SEQ ID NO: 135959 - DNA, 20 bp, Artificial Sequence
  chemically synthesized
gaaaagtctaagcctggtaa

SEQ ID NO: 135960 - DNA, 20 bp, Artificial Sequence
  chemically synthesized
gaaatcttttgtcttttacc

SEQ ID NO: 135961 - DNA, 20 bp, Artificial Sequence
  chemically synthesized
tgaaatcttttgtcttttac

SEQ ID NO: 135962 - DNA, 20 bp, Artificial Sequence
  chemically synthesized
ctaagcctggtaaaagacaa

SEQ ID NO: 135963 - DNA, 20 bp, Artificial Sequence
  chemically synthesized
gtaaaagacaaaagatttca

SEQ ID NO: 135964 - DNA, 20 bp, Artificial Sequence
  chemically synthesized
aaaagacaaaagatttcaaa

SEQ ID NO: 135965 - DNA, 20 bp, Artificial Sequence
  chemically synthesized
agatttcaaagagaaaaaaa

SEQ ID NO: 135966 - DNA, 20 bp, Artificial Sequence
  chemically synthesized
ttcaaagagaaaaaaaaaga

SEQ ID NO: 135967 - DNA, 20 bp, Artificial Sequence
  chemically synthesized
agaaaaaaaaagatggctga

SEQ ID NO: 135968 - DNA, 20 bp, Artificial Sequence
  chemically synthesized
gaaaaaaaaagatggctgaa

SEQ ID NO: 135969 - DNA, 20 bp, Artificial Sequence
  chemically synthesized
caggaaggaggaaaaccttt

SEQ ID NO: 135970 - DNA, 20 bp, Artificial Sequence
  chemically synthesized
tcctttgtagtgcaggaagg

SEQ ID NO: 135971 - DNA, 20 bp, Artificial Sequence
  chemically synthesized
atcctttgtagtgcaggaag

SEQ ID NO: 135972 - DNA, 20 bp, Artificial Sequence
  chemically synthesized
gaatcctttgtagtgcagga

SEQ ID NO: 135973 - DNA, 20 bp, Artificial Sequence
  chemically synthesized
agaatcctttgtagtgcagg

SEQ ID NO: 135974 - DNA, 20 bp, Artificial Sequence
  chemically synthesized
cgaagaatcctttgtagtgc

SEQ ID NO: 135975 - DNA, 20 bp, Artificial Sequence
  chemically synthesized
ttcctccttcctgcactaca

SEQ ID NO: 135976 - DNA, 20 bp, Artificial Sequence
  chemically synthesized
ccgaagaatcctttgtagtg

SEQ ID NO: 135977 - DNA, 20 bp, Artificial Sequence
  chemically synthesized
tcctccttcctgcactacaa

SEQ ID NO: 135978 - DNA, 20 bp, Artificial Sequence
  chemically synthesized
acaacccgaagaatcctttg

SEQ ID NO: 135979 - DNA, 20 bp, Artificial Sequence
  chemically synthesized
ctgcactacaaaggattctt

SEQ ID NO: 135980 - DNA, 20 bp, Artificial Sequence
  chemically synthesized
tgcactacaaaggattcttc

SEQ ID NO: 135981 - DNA, 20 bp, Artificial Sequence
  chemically synthesized
acaaaggattcttcgggttg

SEQ ID NO: 135982 - DNA, 20 bp, Artificial Sequence
  chemically synthesized
attttccttcccacaacccg

SEQ ID NO: 135983 - DNA, 20 bp, Artificial Sequence
  chemically synthesized
caaaggattcttcgggttgt

SEQ ID NO: 135984 - DNA, 20 bp, Artificial Sequence
  chemically synthesized
aggattcttcgggttgtggg

SEQ ID NO: 135985 - DNA, 20 bp, Artificial Sequence
  chemically synthesized
ggattcttcgggttgtggga

SEQ ID NO: 135986 - DNA, 20 bp, Artificial Sequence
  chemically synthesized
cgggttgtgggaaggaaaat

SEQ ID NO: 135987 - DNA, 20 bp, Artificial Sequence
  chemically synthesized
gggttgtgggaaggaaaatg

SEQ ID NO: 135988 - DNA, 20 bp, Artificial Sequence
  chemically synthesized
ggttgtgggaaggaaaatga

SEQ ID NO: 135989 - DNA, 20 bp, Artificial Sequence
  chemically synthesized
gttgtgggaaggaaaatgag

SEQ ID NO: 135990 - DNA, 20 bp, Artificial Sequence
  chemically synthesized
aggaaaatgaggggatattg

SEQ ID NO: 135991 - DNA, 20 bp, Artificial Sequence
  chemically synthesized
gaaaatgaggggatattgca

SEQ ID NO: 135992 - DNA, 20 bp, Artificial Sequence
  chemically synthesized
aaaatgaggggatattgcag

SEQ ID NO: 135993 - DNA, 20 bp, Artificial Sequence
  chemically synthesized
atgaggggatattgcagagg

SEQ ID NO: 135994 - DNA, 20 bp, Artificial Sequence
  chemically synthesized
ggggatattgcagaggaagc

SEQ ID NO: 135995 - DNA, 20 bp, Artificial Sequence
  chemically synthesized
gaagcaagaaaattcaatac

SEQ ID NO: 135996 - DNA, 20 bp, Artificial Sequence
  chemically synthesized
ttccctccagggacacacac

SEQ ID NO: 135997 - DNA, 20 bp, Artificial Sequence
  chemically synthesized
tcaataccagtgtgtgtccc

SEQ ID NO: 135998 - DNA, 20 bp, Artificial Sequence
  chemically synthesized
aataccagtgtgtgtccctg

SEQ ID NO: 135999 - DNA, 20 bp, Artificial Sequence
  chemically synthesized
ataccagtgtgtgtccctgg

SEQ ID NO: 136000 - DNA, 20 bp, Artificial Sequence
  chemically synthesized
taccagtgtgtgtccctgga

SEQ ID NO: 136001 - DNA, 20 bp, Artificial Sequence
  chemically synthesized
cagtgtgtgtccctggaggg

SEQ ID NO: 136002 - DNA, 20 bp, Artificial Sequence
  chemically synthesized
ctctaccttccttccctcca

SEQ ID NO: 136003 - DNA, 20 bp, Artificial Sequence
  chemically synthesized
agtgtgtgtccctggaggga

SEQ ID NO: 136004 - DNA, 20 bp, Artificial Sequence
  chemically synthesized
tctctaccttccttccctcc

SEQ ID NO: 136005 - DNA, 20 bp, Artificial Sequence
  chemically synthesized
ctctctaccttccttccctc

SEQ ID NO: 136006 - DNA, 20 bp, Artificial Sequence
  chemically synthesized
gtgtgtccctggagggaagg

SEQ ID NO: 136007 - DNA, 20 bp, Artificial Sequence
  chemically synthesized
tgtgtccctggagggaagga

SEQ ID NO: 136008 - DNA, 20 bp, Artificial Sequence
  chemically synthesized
gtccctggagggaaggaagg

SEQ ID NO: 136009 - DNA, 20 bp, Artificial Sequence
  chemically synthesized
ccctggagggaaggaaggta

SEQ ID NO: 136010 - DNA, 20 bp, Artificial Sequence
  chemically synthesized
ctggagggaaggaaggtaga

SEQ ID NO: 136011 - DNA, 20 bp, Artificial Sequence
  chemically synthesized
gagggaaggaaggtagagag

SEQ ID NO: 136012 - DNA, 20 bp, Artificial Sequence
  chemically synthesized
aaggaaggtagagagaagtg

SEQ ID NO: 136013 - DNA, 20 bp, Artificial Sequence
  chemically synthesized
tagagagaagtgaagaaacc

SEQ ID NO: 136014 - DNA, 20 bp, Artificial Sequence
  chemically synthesized
gagagaagtgaagaaaccga

SEQ ID NO: 136015 - DNA, 20 bp, Artificial Sequence
  chemically synthesized
gagaagtgaagaaaccgaga

SEQ ID NO: 136016 - DNA, 20 bp, Artificial Sequence
  chemically synthesized
aggttctctcagatctctct

SEQ ID NO: 136017 - DNA, 20 bp, Artificial Sequence
  chemically synthesized
gaagaaaccgagagagatct

SEQ ID NO: 136018 - DNA, 20 bp, Artificial Sequence
  chemically synthesized
agaaaccgagagagatctga

SEQ ID NO: 136019 - DNA, 20 bp, Artificial Sequence
  chemically synthesized
gctctgctttcaggttctct

SEQ ID NO: 136020 - DNA, 20 bp, Artificial Sequence
  chemically synthesized
agagatctgagagaacctga

SEQ ID NO: 136021 - DNA, 20 bp, Artificial Sequence
  chemically synthesized
gatctgagagaacctgaaag

SEQ ID NO: 136022 - DNA, 20 bp, Artificial Sequence
  chemically synthesized
tctgagagaacctgaaagca

SEQ ID NO: 136023 - DNA, 20 bp, Artificial Sequence
  chemically synthesized
tccaagtcagctctgctttc

SEQ ID NO: 136024 - DNA, 20 bp, Artificial Sequence
  chemically synthesized
gtccaagtcagctctgcttt

SEQ ID NO: 136025 - DNA, 20 bp, Artificial Sequence
  chemically synthesized
acctgaaagcagagctgact

SEQ ID NO: 136026 - DNA, 20 bp, Artificial Sequence
  chemically synthesized
ctcagaaatgaggtccaagt

SEQ ID NO: 136027 - DNA, 20 bp, Artificial Sequence
  chemically synthesized
tctcctcagaaatgaggtcc

SEQ ID NO: 136028 - DNA, 20 bp, Artificial Sequence
  chemically synthesized
ctgacttggacctcatttct

SEQ ID NO: 136029 - DNA, 20 bp, Artificial Sequence
  chemically synthesized
agagattctcctcagaaatg

SEQ ID NO: 136030 - DNA, 20 bp, Artificial Sequence
  chemically synthesized
tgacttggacctcatttctg

SEQ ID NO: 136031 - DNA, 20 bp, Artificial Sequence
  chemically synthesized
cagagattctcctcagaaat

SEQ ID NO: 136032 - DNA, 20 bp, Artificial Sequence
  chemically synthesized
acttggacctcatttctgag

SEQ ID NO: 136033 - DNA, 20 bp, Artificial Sequence
  chemically synthesized
tttccctcagagattctcct

SEQ ID NO: 136034 - DNA, 20 bp, Artificial Sequence
  chemically synthesized
catttctgaggagaatctct

SEQ ID NO: 136035 - DNA, 20 bp, Artificial Sequence
  chemically synthesized
atttctgaggagaatctctg

SEQ ID NO: 136036 - DNA, 20 bp, Artificial Sequence
  chemically synthesized
tttctgaggagaatctctga

SEQ ID NO: 136037 - DNA, 20 bp, Artificial Sequence
  chemically synthesized
tcgccacccggtttccctca

SEQ ID NO: 136038 - DNA, 20 bp, Artificial Sequence
  chemically synthesized
actcgccacccggtttccct

SEQ ID NO: 136039 - DNA, 20 bp, Artificial Sequence
  chemically synthesized
ggagaatctctgagggaaac

SEQ ID NO: 136040 - DNA, 20 bp, Artificial Sequence
  chemically synthesized
gagaatctctgagggaaacc

SEQ ID NO: 136041 - DNA, 20 bp, Artificial Sequence
  chemically synthesized
aatctctgagggaaaccggg

SEQ ID NO: 136042 - DNA, 20 bp, Artificial Sequence
  chemically synthesized
tctgagggaaaccgggtggc

SEQ ID NO: 136043 - DNA, 20 bp, Artificial Sequence
  chemically synthesized
agtaggggaaactcgccacc

SEQ ID NO: 136044 - DNA, 20 bp, Artificial Sequence
  chemically synthesized
agtgacagacgaaggagtag

SEQ ID NO: 136045 - DNA, 20 bp, Artificial Sequence
  chemically synthesized
gagtgacagacgaaggagta

SEQ ID NO: 136046 - DNA, 20 bp, Artificial Sequence
  chemically synthesized
agagtgacagacgaaggagt

SEQ ID NO: 136047 - DNA, 20 bp, Artificial Sequence
  chemically synthesized
aagagtgacagacgaaggag

SEQ ID NO: 136048 - DNA, 20 bp, Artificial Sequence
  chemically synthesized
aggaagagtgacagacgaag

SEQ ID NO: 136049 - DNA, 20 bp, Artificial Sequence
  chemically synthesized
tcaggaagagtgacagacga

SEQ ID NO: 136050 - DNA, 20 bp, Artificial Sequence
  chemically synthesized
gtcaggaagagtgacagacg

SEQ ID NO: 136051 - DNA, 20 bp, Artificial Sequence
  chemically synthesized
catggggtcaggaagagtga

SEQ ID NO: 136052 - DNA, 20 bp, Artificial Sequence
  chemically synthesized
agtttccatggggtcaggaa

SEQ ID NO: 136053 - DNA, 20 bp, Artificial Sequence
  chemically synthesized
tgagtttccatggggtcagg

SEQ ID NO: 136054 - DNA, 20 bp, Artificial Sequence
  chemically synthesized
tgtcactcttcctgacccca

SEQ ID NO: 136055 - DNA, 20 bp, Artificial Sequence
  chemically synthesized
cagtgagtttccatggggtc

SEQ ID NO: 136056 - DNA, 20 bp, Artificial Sequence
  chemically synthesized
tcagtgagtttccatggggt

SEQ ID NO: 136057 - DNA, 20 bp, Artificial Sequence
  chemically synthesized
tgtgtcagtgagtttccatg

SEQ ID NO: 136058 - DNA, 20 bp, Artificial Sequence
  chemically synthesized
ttgtgtcagtgagtttccat

SEQ ID NO: 136059 - DNA, 20 bp, Artificial Sequence
  chemically synthesized
gttgtgtcagtgagtttcca

SEQ ID NO: 136060 - DNA, 20 bp, Artificial Sequence
  chemically synthesized
tgattgtgtgttgtgtcagt

SEQ ID NO: 136061 - DNA, 20 bp, Artificial Sequence
  chemically synthesized
gcagtgattgtgtgttgtgt

SEQ ID NO: 136062 - DNA, 20 bp, Artificial Sequence
  chemically synthesized
ttaatggggagagtgattcg

SEQ ID NO: 136063 - DNA, 20 bp, Artificial Sequence
  chemically synthesized
tcctatccatttaatgggga

SEQ ID NO: 136064 - DNA, 20 bp, Artificial Sequence
  chemically synthesized
actcctatccatttaatggg

SEQ ID NO: 136065 - DNA, 20 bp, Artificial Sequence
  chemically synthesized
gaatcactctccccattaaa

SEQ ID NO: 136066 - DNA, 20 bp, Artificial Sequence
  chemically synthesized
acactcctatccatttaatg

SEQ ID NO: 136067 - DNA, 20 bp, Artificial Sequence
  chemically synthesized
tacactcctatccatttaat

SEQ ID NO: 136068 - DNA, 20 bp, Artificial Sequence
  chemically synthesized
atacactcctatccatttaa

SEQ ID NO: 136069 - DNA, 20 bp, Artificial Sequence
  chemically synthesized
cactctccccattaaatgga

SEQ ID NO: 136070 - DNA, 20 bp, Artificial Sequence
  chemically synthesized
actctccccattaaatggat

SEQ ID NO: 136071 - DNA, 20 bp, Artificial Sequence
  chemically synthesized
tctccccattaaatggatag

SEQ ID NO: 136072 - DNA, 20 bp, Artificial Sequence
  chemically synthesized
aaatggataggagtgtatgt

SEQ ID NO: 136073 - DNA, 20 bp, Artificial Sequence
  chemically synthesized
tggataggagtgtatgtcag

SEQ ID NO: 136074 - DNA, 20 bp, Artificial Sequence
  chemically synthesized
aggagtgtatgtcagaagaa

SEQ ID NO: 136075 - DNA, 20 bp, Artificial Sequence
  chemically synthesized
tcagaagaaaagaatatgca

SEQ ID NO: 136076 - DNA, 20 bp, Artificial Sequence
  chemically synthesized
aaaagaatatgcacagcgtc

SEQ ID NO: 136077 - DNA, 20 bp, Artificial Sequence
  chemically synthesized
gaatatgcacagcgtctagt

SEQ ID NO: 136078 - DNA, 20 bp, Artificial Sequence
  chemically synthesized
atgcacagcgtctagtcaga

SEQ ID NO: 136079 - DNA, 20 bp, Artificial Sequence
  chemically synthesized
tgcacagcgtctagtcagat

SEQ ID NO: 136080 - DNA, 20 bp, Artificial Sequence
  chemically synthesized
tttggtaagacccatctgac

SEQ ID NO: 136081 - DNA, 20 bp, Artificial Sequence
  chemically synthesized
tagtcagatgggtcttacca

SEQ ID NO: 136082 - DNA, 20 bp, Artificial Sequence
  chemically synthesized
gggtgggcaggaactttggt

SEQ ID NO: 136083 - DNA, 20 bp, Artificial Sequence
  chemically synthesized
agtagggtgggcaggaactt

SEQ ID NO: 136084 - DNA, 20 bp, Artificial Sequence
  chemically synthesized
tatgccgtagtagggtgggc

SEQ ID NO: 136085 - DNA, 20 bp, Artificial Sequence
  chemically synthesized
ttatgccgtagtagggtggg

SEQ ID NO: 136086 - DNA, 20 bp, Artificial Sequence
  chemically synthesized
accttatgccgtagtagggt

SEQ ID NO: 136087 - DNA, 20 bp, Artificial Sequence
  chemically synthesized
taccttatgccgtagtaggg

SEQ ID NO: 136088 - DNA, 20 bp, Artificial Sequence
  chemically synthesized
agttcctgcccaccctacta

SEQ ID NO: 136089 - DNA, 20 bp, Artificial Sequence
  chemically synthesized
ctgtaccttatgccgtagta

SEQ ID NO: 136090 - DNA, 20 bp, Artificial Sequence
  chemically synthesized
actgtaccttatgccgtagt

SEQ ID NO: 136091 - DNA, 20 bp, Artificial Sequence
  chemically synthesized
tactgtaccttatgccgtag

SEQ ID NO: 136092 - DNA, 20 bp, Artificial Sequence
  chemically synthesized
tgcccaccctactacggcat

SEQ ID NO: 136093 - DNA, 20 bp, Artificial Sequence
  chemically synthesized
gcccaccctactacggcata

SEQ ID NO: 136094 - DNA, 20 bp, Artificial Sequence
  chemically synthesized
tcgtactgtaccttatgccg

SEQ ID NO: 136095 - DNA, 20 bp, Artificial Sequence
  chemically synthesized
ccctactacggcataaggta

SEQ ID NO: 136096 - DNA, 20 bp, Artificial Sequence
  chemically synthesized
tgatttttgatattacaaaa

SEQ ID NO: 136097 - DNA, 20 bp, Artificial Sequence
  chemically synthesized
gatttttgatattacaaaat

SEQ ID NO: 136098 - DNA, 20 bp, Artificial Sequence
  chemically synthesized
atttttgatattacaaaatg

SEQ ID NO: 136099 - DNA, 20 bp, Artificial Sequence
  chemically synthesized
tttttgatattacaaaatgg

SEQ ID NO: 136100 - DNA, 20 bp, Artificial Sequence
  chemically synthesized
attacaaaatgggggcatca

SEQ ID NO: 136101 - DNA, 20 bp, Artificial Sequence
  chemically synthesized
acaaaatgggggcatcaaag

SEQ ID NO: 136102 - DNA, 20 bp, Artificial Sequence
  chemically synthesized
aaatgggggcatcaaagtag

SEQ ID NO: 136103 - DNA, 20 bp, Artificial Sequence
  chemically synthesized
atgggggcatcaaagtagcg

SEQ ID NO: 136104 - DNA, 20 bp, Artificial Sequence
  chemically synthesized
gggggcatcaaagtagcgga

SEQ ID NO: 136105 - DNA, 20 bp, Artificial Sequence
  chemically synthesized
caaagtagcggagagatatc

SEQ ID NO: 136106 - DNA, 20 bp, Artificial Sequence
  chemically synthesized
ggagagatatccagatctga

SEQ ID NO: 136107 - DNA, 20 bp, Artificial Sequence
  chemically synthesized
tgtgcagtgactttcagatc

SEQ ID NO: 136108 - DNA, 20 bp, Artificial Sequence
  chemically synthesized
ttcccatgtgcagtgacttt

SEQ ID NO: 136109 - DNA, 20 bp, Artificial Sequence
  chemically synthesized
gatctgaaagtcactgcaca

SEQ ID NO: 136110 - DNA, 20 bp, Artificial Sequence
  chemically synthesized
atctgaaagtcactgcacat

SEQ ID NO: 136111 - DNA, 20 bp, Artificial Sequence
  chemically synthesized
ccatctttcattcccatgtg

SEQ ID NO: 136112 - DNA, 20 bp, Artificial Sequence
  chemically synthesized
gtcactgcacatgggaatga

SEQ ID NO: 136113 - DNA, 20 bp, Artificial Sequence
  chemically synthesized
ctgcacatgggaatgaaaga

SEQ ID NO: 136114 - DNA, 20 bp, Artificial Sequence
  chemically synthesized
catgggaatgaaagatggcc

SEQ ID NO: 136115 - DNA, 20 bp, Artificial Sequence
  chemically synthesized
atgggaatgaaagatggccc

SEQ ID NO: 136116 - DNA, 20 bp, Artificial Sequence
  chemically synthesized
ggaatgaaagatggcccagg

SEQ ID NO: 136117 - DNA, 20 bp, Artificial Sequence
  chemically synthesized
atgaaagatggcccaggaag

SEQ ID NO: 136118 - DNA, 20 bp, Artificial Sequence
  chemically synthesized
gcaggcagtggcttcttcct

SEQ ID NO: 136119 - DNA, 20 bp, Artificial Sequence
  chemically synthesized
agcaggcagtggcttcttcc

SEQ ID NO: 136120 - DNA, 20 bp, Artificial Sequence
  chemically synthesized
ctgttggtccaagcaggcag

SEQ ID NO: 136121 - DNA, 20 bp, Artificial Sequence
  chemically synthesized
ggaagaagccactgcctgct

SEQ ID NO: 136122 - DNA, 20 bp, Artificial Sequence
  chemically synthesized
tggctgttggtccaagcagg

SEQ ID NO: 136123 - DNA, 20 bp, Artificial Sequence
  chemically synthesized
ccttggctgttggtccaagc

SEQ ID NO: 136124 - DNA, 20 bp, Artificial Sequence
  chemically synthesized
tccttggctgttggtccaag

SEQ ID NO: 136125 - DNA, 20 bp, Artificial Sequence
  chemically synthesized
ccactgcctgcttggaccaa

SEQ ID NO: 136126 - DNA, 20 bp, Artificial Sequence
  chemically synthesized
atatccttggctgttggtcc

SEQ ID NO: 136127 - DNA, 20 bp, Artificial Sequence
  chemically synthesized
gcctgcttggaccaacagcc

SEQ ID NO: 136128 - DNA, 20 bp, Artificial Sequence
  chemically synthesized
cctgcttggaccaacagcca

SEQ ID NO: 136129 - DNA, 20 bp, Artificial Sequence
  chemically synthesized
tccctcatatccttggctgt

SEQ ID NO: 136130 - DNA, 20 bp, Artificial Sequence
  chemically synthesized
ggaccaacagccaaggatat

SEQ ID NO: 136131 - DNA, 20 bp, Artificial Sequence
  chemically synthesized
cagtctctccctcatatcct

SEQ ID NO: 136132 - DNA, 20 bp, Artificial Sequence
  chemically synthesized
gaccaacagccaaggatatg

SEQ ID NO: 136133 - DNA, 20 bp, Artificial Sequence
  chemically synthesized
accaacagccaaggatatga

SEQ ID NO: 136134 - DNA, 20 bp, Artificial Sequence
  chemically synthesized
caacagccaaggatatgagg

SEQ ID NO: 136135 - DNA, 20 bp, Artificial Sequence
  chemically synthesized
acagccaaggatatgaggga

SEQ ID NO: 136136 - DNA, 20 bp, Artificial Sequence
  chemically synthesized
caaggatatgagggagagac

SEQ ID NO: 136137 - DNA, 20 bp, Artificial Sequence
  chemically synthesized
gctggcatccatggagatgc

SEQ ID NO: 136138 - DNA, 20 bp, Artificial Sequence
  chemically synthesized
gggagagactggcatctcca

SEQ ID NO: 136139 - DNA, 20 bp, Artificial Sequence
  chemically synthesized
catctgggctggcatccatg

SEQ ID NO: 136140 - DNA, 20 bp, Artificial Sequence
  chemically synthesized
actggcatctccatggatgc

SEQ ID NO: 136141 - DNA, 20 bp, Artificial Sequence
  chemically synthesized
gtcatctgggctggcatcca

SEQ ID NO: 136142 - DNA, 20 bp, Artificial Sequence
  chemically synthesized
catctccatggatgccagcc

SEQ ID NO: 136143 - DNA, 20 bp, Artificial Sequence
  chemically synthesized
tctttagttgtcatctgggc

SEQ ID NO: 136144 - DNA, 20 bp, Artificial Sequence
  chemically synthesized
ttgttctttagttgtcatct

SEQ ID NO: 136145 - DNA, 20 bp, Artificial Sequence
  chemically synthesized
tttgttctttagttgtcatc

SEQ ID NO: 136146 - DNA, 20 bp, Artificial Sequence
  chemically synthesized
gccagcccagatgacaacta

SEQ ID NO: 136147 - DNA, 20 bp, Artificial Sequence
  chemically synthesized
gtggcagaacatttgttctt

SEQ ID NO: 136148 - DNA, 20 bp, Artificial Sequence
  chemically synthesized
gtgtggcagaacatttgtgg

SEQ ID NO: 136149 - DNA, 20 bp, Artificial Sequence
  chemically synthesized
acagtgtggcagaacatttg

SEQ ID NO: 136150 - DNA, 20 bp, Artificial Sequence
  chemically synthesized
gtgtggtgaccacagtgtgg

SEQ ID NO: 136151 - DNA, 20 bp, Artificial Sequence
  chemically synthesized
acaaatgttctgccacactg

SEQ ID NO: 136152 - DNA, 20 bp, Artificial Sequence
  chemically synthesized
tgggtgtggtgaccacagtg

SEQ ID NO: 136153 - DNA, 20 bp, Artificial Sequence
  chemically synthesized
attgatgggtgtggtgacca

SEQ ID NO: 136154 - DNA, 20 bp, Artificial Sequence
  chemically synthesized
aaagcatgcattgatgggtg

SEQ ID NO: 136155 - DNA, 20 bp, Artificial Sequence
  chemically synthesized
gttgcaaagcatgcattgat

SEQ ID NO: 136156 - DNA, 20 bp, Artificial Sequence
  chemically synthesized
agttgcaaagcatgcattga

SEQ ID NO: 136157 - DNA, 20 bp, Artificial Sequence
  chemically synthesized
tcagggcttatatagttgca

SEQ ID NO: 136158 - DNA, 20 bp, Artificial Sequence
  chemically synthesized
tgcatgctttgcaactatat

SEQ ID NO: 136159 - DNA, 20 bp, Artificial Sequence
  chemically synthesized
aaatcaattcagggcttata

SEQ ID NO: 136160 - DNA, 20 bp, Artificial Sequence
  chemically synthesized
tacatttttaaatcaattca

SEQ ID NO: 136161 - DNA, 20 bp, Artificial Sequence
  chemically synthesized
atacatttttaaatcaattc

SEQ ID NO: 136162 - DNA, 20 bp, Artificial Sequence
  chemically synthesized
aatacatttttaaatcaatt

SEQ ID NO: 136163 - DNA, 20 bp, Artificial Sequence
  chemically synthesized
aatgtaattccattgaatag

SEQ ID NO: 136164 - DNA, 20 bp, Artificial Sequence
  chemically synthesized
aatgtatttcttctattcaa

SEQ ID NO: 136165 - DNA, 20 bp, Artificial Sequence
  chemically synthesized
atgaatgtaattccattgaa

SEQ ID NO: 136166 - DNA, 20 bp, Artificial Sequence
  chemically synthesized
gaattacattcatttattaa

SEQ ID NO: 136167 - DNA, 20 bp, Artificial Sequence
  chemically synthesized
aattacattcatttattaaa

SEQ ID NO: 136168 - DNA, 20 bp, Artificial Sequence
  chemically synthesized
tttattaaaaggtaacatta

SEQ ID NO: 136169 - DNA, 20 bp, Artificial Sequence
  chemically synthesized
acattatggactgaaaatct

SEQ ID NO: 136170 - DNA, 20 bp, Artificial Sequence
  chemically synthesized
aacaattgtgctgagatttt

SEQ ID NO: 136171 - DNA, 20 bp, Artificial Sequence
  chemically synthesized
taaatgataacaattgtgct

SEQ ID NO: 136172 - DNA, 20 bp, Artificial Sequence
  chemically synthesized
cacattatttttataaatgt

SEQ ID NO: 136173 - DNA, 20 bp, Artificial Sequence
  chemically synthesized
acattatttttataaatgtg

SEQ ID NO: 136174 - DNA, 20 bp, Artificial Sequence
  chemically synthesized
cattatttttataaatgtga

SEQ ID NO: 136175 - DNA, 20 bp, Artificial Sequence
  chemically synthesized
attatttttataaatgtgag

SEQ ID NO: 136176 - DNA, 20 bp, Artificial Sequence
  chemically synthesized
ttatttttataaatgtgagg

SEQ ID NO: 136177 - DNA, 20 bp, Artificial Sequence
  chemically synthesized
tgagggggatatatgaactt

SEQ ID NO: 136178 - DNA, 20 bp, Artificial Sequence
  chemically synthesized
acaagtttcaataaaaactt

SEQ ID NO: 136179 - DNA, 20 bp, Artificial Sequence
  chemically synthesized
cacaaagcaagatgcatgac

SEQ ID NO: 136180 - DNA, 20 bp, Artificial Sequence
  chemically synthesized
aagcatgggacacacaaagc

SEQ ID NO: 136181 - DNA, 20 bp, Artificial Sequence
  chemically synthesized
taacaagcatgggacacaca

SEQ ID NO: 136182 - DNA, 20 bp, Artificial Sequence
  chemically synthesized
gtaagttttttaacaagcat

SEQ ID NO: 136183 - DNA, 20 bp, Artificial Sequence
  chemically synthesized
agtaagttttttaacaagca

SEQ ID NO: 136184 - DNA, 20 bp, Artificial Sequence
  chemically synthesized
atcgaagtaagttttttaac

SEQ ID NO: 136185 - DNA, 20 bp, Artificial Sequence
  chemically synthesized
caatcattacggatcgaagt

SEQ ID NO: 136186 - DNA, 20 bp, Artificial Sequence
  chemically synthesized
agaacaatcattacggatcg

SEQ ID NO: 136187 - DNA, 20 bp, Artificial Sequence
  chemically synthesized
agaggctagaacaatcatta

SEQ ID NO: 136188 - DNA, 20 bp, Artificial Sequence
  chemically synthesized
tcgatccgtaatgattgttc

SEQ ID NO: 136189 - DNA, 20 bp, Artificial Sequence
  chemically synthesized
aagaccagcaatcaagaggc

SEQ ID NO: 136190 - DNA, 20 bp, Artificial Sequence
  chemically synthesized
aaacaagaccagcaatcaag

SEQ ID NO: 136191 - DNA, 20 bp, Artificial Sequence
  chemically synthesized
aaaacaagaccagcaatcaa

SEQ ID NO: 136192 - DNA, 20 bp, Artificial Sequence
  chemically synthesized
tgttctagcctcttgattgc

SEQ ID NO: 136193 - DNA, 20 bp, Artificial Sequence
  chemically synthesized
gaaaaacaagaccagcaatc

SEQ ID NO: 136194 - DNA, 20 bp, Artificial Sequence
  chemically synthesized
caaaatttgaaaaacaagac

SEQ ID NO: 136195 - DNA, 20 bp, Artificial Sequence
  chemically synthesized
ctgcccaaaatttgaaaaac

SEQ ID NO: 136196 - DNA, 20 bp, Artificial Sequence
  chemically synthesized
tggtcttgtttttcaaattt

SEQ ID NO: 136197 - DNA, 20 bp, Artificial Sequence
  chemically synthesized
ggtcttgtttttcaaatttt

SEQ ID NO: 136198 - DNA, 20 bp, Artificial Sequence
  chemically synthesized
cttgtttttcaaattttggg

SEQ ID NO: 136199 - DNA, 20 bp, Artificial Sequence
  chemically synthesized
gtttttcaaattttgggcag

SEQ ID NO: 136200 - DNA, 20 bp, Artificial Sequence
  chemically synthesized
aaattttgggcagcggtaat

SEQ ID NO: 136201 - DNA, 20 bp, Artificial Sequence
  chemically synthesized
cggtaatgagttcttccaac

SEQ ID NO: 136202 - DNA, 20 bp, Artificial Sequence
  chemically synthesized
ggtaatgagttcttccaact

SEQ ID NO: 136203 - DNA, 20 bp, Artificial Sequence
  chemically synthesized
gtaatgagttcttccaactg

SEQ ID NO: 136204 - DNA, 20 bp, Artificial Sequence
  chemically synthesized
acagaggcgtccccagttgg

SEQ ID NO: 136205 - DNA, 20 bp, Artificial Sequence
  chemically synthesized
ggaacagaggcgtccccagt

SEQ ID NO: 136206 - DNA, 20 bp, Artificial Sequence
  chemically synthesized
atttggaacagaggcgtccc

SEQ ID NO: 136207 - DNA, 20 bp, Artificial Sequence
  chemically synthesized
caatgcaggatttggaacag

SEQ ID NO: 136208 - DNA, 20 bp, Artificial Sequence
  chemically synthesized
acaatgcaggatttggaaca

SEQ ID NO: 136209 - DNA, 20 bp, Artificial Sequence
  chemically synthesized
caacaatgcaggatttggaa

SEQ ID NO: 136210 - DNA, 20 bp, Artificial Sequence
  chemically synthesized
acaggcaacaatgcaggatt

SEQ ID NO: 136211 - DNA, 20 bp, Artificial Sequence
  chemically synthesized
gttcttacaggcaacaatgc

SEQ ID NO: 136212 - DNA, 20 bp, Artificial Sequence
  chemically synthesized
tgttcttacaggcaacaatg

SEQ ID NO: 136213 - DNA, 20 bp, Artificial Sequence
  chemically synthesized
aatcctgcattgttgcctgt

SEQ ID NO: 136214 - DNA, 20 bp, Artificial Sequence
  chemically synthesized
taagggatatttgttcttac

SEQ ID NO: 136215 - DNA, 20 bp, Artificial Sequence
  chemically synthesized
ctaagggatatttgttctta

SEQ ID NO: 136216 - DNA, 20 bp, Artificial Sequence
  chemically synthesized
ctgtaagaacaaatatccct

SEQ ID NO: 136217 - DNA, 20 bp, Artificial Sequence
  chemically synthesized
gaacaaatatcccttagtat

SEQ ID NO: 136218 - DNA, 20 bp, Artificial Sequence
  chemically synthesized
ctgaagaaccctgatactaa

SEQ ID NO: 136219 - DNA, 20 bp, Artificial Sequence
  chemically synthesized
aacaaatatcccttagtatc

SEQ ID NO: 136220 - DNA, 20 bp, Artificial Sequence
  chemically synthesized
gctgaagaaccctgatacta

SEQ ID NO: 136221 - DNA, 20 bp, Artificial Sequence
  chemically synthesized
acaaatatcccttagtatca

SEQ ID NO: 136222 - DNA, 20 bp, Artificial Sequence
  chemically synthesized
cgctgaagaaccctgatact

SEQ ID NO: 136223 - DNA, 20 bp, Artificial Sequence
  chemically synthesized
cccttagtatcagggttctt

SEQ ID NO: 136224 - DNA, 20 bp, Artificial Sequence
  chemically synthesized
aaaaggaatacacaacgctg

SEQ ID NO: 136225 - DNA, 20 bp, Artificial Sequence
  chemically synthesized
tttactttgtattatgtaaa

SEQ ID NO: 136226 - DNA, 20 bp, Artificial Sequence
  chemically synthesized
ctttactttgtattatgtaa

SEQ ID NO: 136227 - DNA, 20 bp, Artificial Sequence
  chemically synthesized
tattccttttacataataca

SEQ ID NO: 136228 - DNA, 20 bp, Artificial Sequence
  chemically synthesized
cttttacataatacaaagta

SEQ ID NO: 136229 - DNA, 20 bp, Artificial Sequence
  chemically synthesized
acaaagtaaagtacaattgt

SEQ ID NO: 136230 - DNA, 20 bp, Artificial Sequence
  chemically synthesized
gtaaagtacaattgtgagac

SEQ ID NO: 136231 - DNA, 20 bp, Artificial Sequence
  chemically synthesized
atttctaaaagtgttttggc

SEQ ID NO: 136232 - DNA, 20 bp, Artificial Sequence
  chemically synthesized
ttttatttctaaaagtgttt

SEQ ID NO: 136233 - DNA, 20 bp, Artificial Sequence
  chemically synthesized
gagaccagccaaaacacttt

SEQ ID NO: 136234 - DNA, 20 bp, Artificial Sequence
  chemically synthesized
aacatcttttttatttctaa

SEQ ID NO: 136235 - DNA, 20 bp, Artificial Sequence
  chemically synthesized
aaacacttttagaaataaaa

SEQ ID NO: 136236 - DNA, 20 bp, Artificial Sequence
  chemically synthesized
taaaaaagatgttactgtat

SEQ ID NO: 136237 - DNA, 20 bp, Artificial Sequence
  chemically synthesized
aaaaaagatgttactgtata

SEQ ID NO: 136238 - DNA, 20 bp, Artificial Sequence
  chemically synthesized
aaaaagatgttactgtataa

SEQ ID NO: 136239 - DNA, 20 bp, Artificial Sequence
  chemically synthesized
gttttctataaacccttata

SEQ ID NO: 136240 - DNA, 20 bp, Artificial Sequence
  chemically synthesized
tgttactgtataagggttta

SEQ ID NO: 136241 - DNA, 20 bp, Artificial Sequence
  chemically synthesized
gtttatagaaaacaatttaa

SEQ ID NO: 136242 - DNA, 20 bp, Artificial Sequence
  chemically synthesized
tttatagaaaacaatttaac

SEQ ID NO: 136243 - DNA, 20 bp, Artificial Sequence
  chemically synthesized
caggaaatatgtttcattct

SEQ ID NO: 136244 - DNA, 20 bp, Artificial Sequence
  chemically synthesized
ttgaaatatttttgatatct

SEQ ID NO: 136245 - DNA, 20 bp, Artificial Sequence
  chemically synthesized
tcaaatgaaaatcttgacta

SEQ ID NO: 136246 - DNA, 20 bp, Artificial Sequence
  chemically synthesized
aatgaagaaaatctatagtc

SEQ ID NO: 136247 - DNA, 20 bp, Artificial Sequence
  chemically synthesized
ctttaaatgaagaaaatcta

SEQ ID NO: 136248 - DNA, 20 bp, Artificial Sequence
  chemically synthesized
ctatagattttcttcattta

SEQ ID NO: 136249 - DNA, 20 bp, Artificial Sequence
  chemically synthesized
tatagattttcttcatttaa

SEQ ID NO: 136250 - DNA, 20 bp, Artificial Sequence
  chemically synthesized
tccatttgagcctttaaatg

SEQ ID NO: 136251 - DNA, 20 bp, Artificial Sequence
  chemically synthesized
tcttcatttaaaggctcaaa

SEQ ID NO: 136252 - DNA, 20 bp, Artificial Sequence
  chemically synthesized
ttcatttaaaggctcaaatg

SEQ ID NO: 136253 - DNA, 20 bp, Artificial Sequence
  chemically synthesized
actccggaatgtctccattt

SEQ ID NO: 136254 - DNA, 20 bp, Artificial Sequence
  chemically synthesized
aggctcaaatggagacattc

SEQ ID NO: 136255 - DNA, 20 bp, Artificial Sequence
  chemically synthesized
gctcaaatggagacattccg

SEQ ID NO: 136256 - DNA, 20 bp, Artificial Sequence
  chemically synthesized
ttaagtaatccgaggtactc

SEQ ID NO: 136257 - DNA, 20 bp, Artificial Sequence
  chemically synthesized
ggagacattccggagtacct

SEQ ID NO: 136258 - DNA, 20 bp, Artificial Sequence
  chemically synthesized
acagtggtttaagtaatccg

SEQ ID NO: 136259 - DNA, 20 bp, Artificial Sequence
  chemically synthesized
gacagtggtttaagtaatcc

SEQ ID NO: 136260 - DNA, 20 bp, Artificial Sequence
  chemically synthesized
aggcattcagacagtggttt

SEQ ID NO: 136261 - DNA, 20 bp, Artificial Sequence
  chemically synthesized
tactcaaggcattcagacag

SEQ ID NO: 136262 - DNA, 20 bp, Artificial Sequence
  chemically synthesized
tcttactcaaggcattcaga

SEQ ID NO: 136263 - DNA, 20 bp, Artificial Sequence
  chemically synthesized
catttcttactcaaggcatt

SEQ ID NO: 136264 - DNA, 20 bp, Artificial Sequence
  chemically synthesized
aaccactgtctgaatgcctt

SEQ ID NO: 136265 - DNA, 20 bp, Artificial Sequence
  chemically synthesized
actgtctgaatgccttgagt

SEQ ID NO: 136266 - DNA, 20 bp, Artificial Sequence
  chemically synthesized
agaataacatttcttactca

SEQ ID NO: 136267 - DNA, 20 bp, Artificial Sequence
  chemically synthesized
cagaataacatttcttactc

SEQ ID NO: 136268 - DNA, 20 bp, Artificial Sequence
  chemically synthesized
ttaaatacattgtcgtaatt

SEQ ID NO: 136269 - DNA, 20 bp, Artificial Sequence
  chemically synthesized
aattacgacaatgtatttaa

SEQ ID NO: 136270 - DNA, 20 bp, Artificial Sequence
  chemically synthesized
acgacaatgtatttaaaaga

SEQ ID NO: 136271 - DNA, 20 bp, Artificial Sequence
  chemically synthesized
aatgatattataagtataaa

SEQ ID NO: 136272 - DNA, 20 bp, Artificial Sequence
  chemically synthesized
gtcacacagaatgatattat

SEQ ID NO: 136273 - DNA, 20 bp, Artificial Sequence
  chemically synthesized
accttaattttgacgtcaca

SEQ ID NO: 136274 - DNA, 20 bp, Artificial Sequence
  chemically synthesized
ttctgtgtgacgtcaaaatt

SEQ ID NO: 136275 - DNA, 20 bp, Artificial Sequence
  chemically synthesized
tctgtgtgacgtcaaaatta

SEQ ID NO: 136276 - DNA, 20 bp, Artificial Sequence
  chemically synthesized
aggtatatttattttaaaaa

SEQ ID NO: 136277 - DNA, 20 bp, Artificial Sequence
  chemically synthesized
atttattttaaaaacagaaa

SEQ ID NO: 136278 - DNA, 20 bp, Artificial Sequence
  chemically synthesized
ttttaaaaacagaaaaagca

SEQ ID NO: 136279 - DNA, 20 bp, Artificial Sequence
  chemically synthesized
aaaaagcacagaaccgattt

SEQ ID NO: 136280 - DNA, 20 bp, Artificial Sequence
  chemically synthesized
aaagcacagaaccgatttaa

SEQ ID NO: 136281 - DNA, 20 bp, Artificial Sequence
  chemically synthesized
ataagtaatatctcttaaat

SEQ ID NO: 136282 - DNA, 20 bp, Artificial Sequence
  chemically synthesized
ggggtacaatgaagttaaat

SEQ ID NO: 136283 - DNA, 20 bp, Artificial Sequence
  chemically synthesized
gaaatctcaggggtacaatg

SEQ ID NO: 136284 - DNA, 20 bp, Artificial Sequence
  chemically synthesized
tttaacttcattgtacccct

SEQ ID NO: 136285 - DNA, 20 bp, Artificial Sequence
  chemically synthesized
tgacaggtgagaaatctcag

SEQ ID NO: 136286 - DNA, 20 bp, Artificial Sequence
  chemically synthesized
ttgacaggtgagaaatctca

SEQ ID NO: 136287 - DNA, 20 bp, Artificial Sequence
  chemically synthesized
tttgacaggtgagaaatctc

SEQ ID NO: 136288 - DNA, 20 bp, Artificial Sequence
  chemically synthesized
atttgacaggtgagaaatct

SEQ ID NO: 136289 - DNA, 20 bp, Artificial Sequence
  chemically synthesized
caccttttcatttgacaggt

SEQ ID NO: 136290 - DNA, 20 bp, Artificial Sequence
  chemically synthesized
acttcaccttttcatttgac

SEQ ID NO: 136291 - DNA, 20 bp, Artificial Sequence
  chemically synthesized
tacttcaccttttcatttga

SEQ ID NO: 136292 - DNA, 20 bp, Artificial Sequence
  chemically synthesized
tttctcacctgtcaaatgaa

SEQ ID NO: 136293 - DNA, 20 bp, Artificial Sequence
  chemically synthesized
ttctcacctgtcaaatgaaa

SEQ ID NO: 136294 - DNA, 20 bp, Artificial Sequence
  chemically synthesized
acctgtcaaatgaaaaggtg

SEQ ID NO: 136295 - DNA, 20 bp, Artificial Sequence
  chemically synthesized
tgtcaaatgaaaaggtgaag

SEQ ID NO: 136296 - DNA, 20 bp, Artificial Sequence
  chemically synthesized
aatgaaaaggtgaagtagac

SEQ ID NO: 136297 - DNA, 20 bp, Artificial Sequence
  chemically synthesized
gtgaagtagacgagctaaat

SEQ ID NO: 136298 - DNA, 20 bp, Artificial Sequence
  chemically synthesized
gcttaggagaaaagctgatt

SEQ ID NO: 136299 - DNA, 20 bp, Artificial Sequence
  chemically synthesized
gctaaatcagcttttctcct

SEQ ID NO: 136300 - DNA, 20 bp, Artificial Sequence
  chemically synthesized
ggacaggcagcttaggagaa

SEQ ID NO: 136301 - DNA, 20 bp, Artificial Sequence
  chemically synthesized
cttacggacaggcagcttag

SEQ ID NO: 136302 - DNA, 20 bp, Artificial Sequence
  chemically synthesized
ttcttacggacaggcagctt

SEQ ID NO: 136303 - DNA, 20 bp, Artificial Sequence
  chemically synthesized
attcttacggacaggcagct

SEQ ID NO: 136304 - DNA, 20 bp, Artificial Sequence
  chemically synthesized
tggtgattcttacggacagg

SEQ ID NO: 136305 - DNA, 20 bp, Artificial Sequence
  chemically synthesized
ctcctaagctgcctgtccgt

SEQ ID NO: 136306 - DNA, 20 bp, Artificial Sequence
  chemically synthesized
gtttggtgattcttacggac

SEQ ID NO: 136307 - DNA, 20 bp, Artificial Sequence
  chemically synthesized
ggtttggtgattcttacgga

SEQ ID NO: 136308 - DNA, 20 bp, Artificial Sequence
  chemically synthesized
aaaaggtttggtgattctta

SEQ ID NO: 136309 - DNA, 20 bp, Artificial Sequence
  chemically synthesized
tggagggaggcaaaaaggtt

SEQ ID NO: 136310 - DNA, 20 bp, Artificial Sequence
  chemically synthesized
agttctggagggaggcaaaa

SEQ ID NO: 136311 - DNA, 20 bp, Artificial Sequence
  chemically synthesized
tagttctggagggaggcaaa

SEQ ID NO: 136312 - DNA, 20 bp, Artificial Sequence
  chemically synthesized
caaacctttttgcctccctc

SEQ ID NO: 136313 - DNA, 20 bp, Artificial Sequence
  chemically synthesized
tattcattagttctggaggg

SEQ ID NO: 136314 - DNA, 20 bp, Artificial Sequence
  chemically synthesized
atattcattagttctggagg

SEQ ID NO: 136315 - DNA, 20 bp, Artificial Sequence
  chemically synthesized
acatattcattagttctgga

SEQ ID NO: 136316 - DNA, 20 bp, Artificial Sequence
  chemically synthesized
tacatattcattagttctgg

SEQ ID NO: 136317 - DNA, 20 bp, Artificial Sequence
  chemically synthesized
ctacatattcattagttctg

SEQ ID NO: 136318 - DNA, 20 bp, Artificial Sequence
  chemically synthesized
cactacatattcattagttc

SEQ ID NO: 136319 - DNA, 20 bp, Artificial Sequence
  chemically synthesized
cctttccactacatattcat

SEQ ID NO: 136320 - DNA, 20 bp, Artificial Sequence
  chemically synthesized
ctccagaactaatgaatatg

SEQ ID NO: 136321 - DNA, 20 bp, Artificial Sequence
  chemically synthesized
cagaactaatgaatatgtag

SEQ ID NO: 136322 - DNA, 20 bp, Artificial Sequence
  chemically synthesized
actaatgaatatgtagtgga

SEQ ID NO: 136323 - DNA, 20 bp, Artificial Sequence
  chemically synthesized
ctaatgaatatgtagtggaa

SEQ ID NO: 136324 - DNA, 20 bp, Artificial Sequence
  chemically synthesized
taatgaatatgtagtggaaa

SEQ ID NO: 136325 - DNA, 20 bp, Artificial Sequence
  chemically synthesized
tatttaaaatgcaagatttg

SEQ ID NO: 136326 - DNA, 20 bp, Artificial Sequence
  chemically synthesized
agataatttatttaaaatgc

SEQ ID NO: 136327 - DNA, 20 bp, Artificial Sequence
  chemically synthesized
cctaaatcataaaagttaat

SEQ ID NO: 136328 - DNA, 20 bp, Artificial Sequence
  chemically synthesized
caaacttgcctaaatcataa

SEQ ID NO: 136329 - DNA, 20 bp, Artificial Sequence
  chemically synthesized
tctaattaacttttatgatt

SEQ ID NO: 136330 - DNA, 20 bp, Artificial Sequence
  chemically synthesized
ctaattaacttttatgattt

SEQ ID NO: 136331 - DNA, 20 bp, Artificial Sequence
  chemically synthesized
ttaacttttatgatttaggc

SEQ ID NO: 136332 - DNA, 20 bp, Artificial Sequence
  chemically synthesized
ttttatgatttaggcaagtt

SEQ ID NO: 136333 - DNA, 20 bp, Artificial Sequence
  chemically synthesized
ttatgatttaggcaagtttg

SEQ ID NO: 136334 - DNA, 20 bp, Artificial Sequence
  chemically synthesized
atgatttaggcaagtttgga

SEQ ID NO: 136335 - DNA, 20 bp, Artificial Sequence
  chemically synthesized
taggcaagtttggagagcat

SEQ ID NO: 136336 - DNA, 20 bp, Artificial Sequence
  chemically synthesized
gtttggagagcatcagatta

SEQ ID NO: 136337 - DNA, 20 bp, Artificial Sequence
  chemically synthesized
tttggagagcatcagattac

SEQ ID NO: 136338 - DNA, 20 bp, Artificial Sequence
  chemically synthesized
gagagcatcagattacaggt

SEQ ID NO: 136339 - DNA, 20 bp, Artificial Sequence
  chemically synthesized
catttataatacaggggaat

SEQ ID NO: 136340 - DNA, 20 bp, Artificial Sequence
  chemically synthesized
tcatttataatacaggggaa

SEQ ID NO: 136341 - DNA, 20 bp, Artificial Sequence
  chemically synthesized
taaagtcatttataatacag

SEQ ID NO: 136342 - DNA, 20 bp, Artificial Sequence
  chemically synthesized
ttaaagtcatttataataca

SEQ ID NO: 136343 - DNA, 20 bp, Artificial Sequence
  chemically synthesized
attaaagtcatttataatac

SEQ ID NO: 136344 - DNA, 20 bp, Artificial Sequence
  chemically synthesized
tattaaagtcatttataata

SEQ ID NO: 136345 - DNA, 20 bp, Artificial Sequence
  chemically synthesized
tattataaatgactttaata

SEQ ID NO: 136346 - DNA, 20 bp, Artificial Sequence
  chemically synthesized
tttaaaatagtgctatatta

SEQ ID NO: 136347 - DNA, 20 bp, Artificial Sequence
  chemically synthesized
atttgtatttttatttaaaa

SEQ ID NO: 136348 - DNA, 20 bp, Artificial Sequence
  chemically synthesized
ataaaaatacaaatataata

SEQ ID NO: 136349 - DNA, 20 bp, Artificial Sequence
  chemically synthesized
agttaacaatttttaattta

SEQ ID NO: 136350 - DNA, 20 bp, Artificial Sequence
  chemically synthesized
gttaacaatttttaatttat

SEQ ID NO: 136351 - DNA, 20 bp, Artificial Sequence
  chemically synthesized
aacaatttttaatttatagg

SEQ ID NO: 136352 - DNA, 20 bp, Artificial Sequence
  chemically synthesized
aggtagtaatgtaaatcatt

SEQ ID NO: 136353 - DNA, 20 bp, Artificial Sequence
  chemically synthesized
aatagacactgaagaaaggg

SEQ ID NO: 136354 - DNA, 20 bp, Artificial Sequence
  chemically synthesized
aagatattcttccctttctt

SEQ ID NO: 136355 - DNA, 20 bp, Artificial Sequence
  chemically synthesized
gaaaatagacactgaagaaa

SEQ ID NO: 136356 - DNA, 20 bp, Artificial Sequence
  chemically synthesized
agaaaatagacactgaagaa

SEQ ID NO: 136357 - DNA, 20 bp, Artificial Sequence
  chemically synthesized
gagaaaatagacactgaaga

SEQ ID NO: 136358 - DNA, 20 bp, Artificial Sequence
  chemically synthesized
gacagagaaaatagacactg

SEQ ID NO: 136359 - DNA, 20 bp, Artificial Sequence
  chemically synthesized
gactaagatgacagagaaaa

SEQ ID NO: 136360 - DNA, 20 bp, Artificial Sequence
  chemically synthesized
ctagagagactaagatgaca

SEQ ID NO: 136361 - DNA, 20 bp, Artificial Sequence
  chemically synthesized
gtctattttctctgtcatct

SEQ ID NO: 136362 - DNA, 20 bp, Artificial Sequence
  chemically synthesized
atctagagagactaagatga

SEQ ID NO: 136363 - DNA, 20 bp, Artificial Sequence
  chemically synthesized
tccttaaatctagagagact

SEQ ID NO: 136364 - DNA, 20 bp, Artificial Sequence
  chemically synthesized
ctctgtcatcttagtctctc

SEQ ID NO: 136365 - DNA, 20 bp, Artificial Sequence
  chemically synthesized
ttgtggtccttaaatctaga

SEQ ID NO: 136366 - DNA, 20 bp, Artificial Sequence
  chemically synthesized
atcttagtctctctagattt

SEQ ID NO: 136367 - DNA, 20 bp, Artificial Sequence
  chemically synthesized
gattgtggtccttaaatcta

SEQ ID NO: 136368 - DNA, 20 bp, Artificial Sequence
  chemically synthesized
tcttagtctctctagattta

SEQ ID NO: 136369 - DNA, 20 bp, Artificial Sequence
  chemically synthesized
gagattgtggtccttaaatc

SEQ ID NO: 136370 - DNA, 20 bp, Artificial Sequence
  chemically synthesized
agatttaaggaccacaatct

SEQ ID NO: 136371 - DNA, 20 bp, Artificial Sequence
  chemically synthesized
cataaatacctctgagattg

SEQ ID NO: 136372 - DNA, 20 bp, Artificial Sequence
  chemically synthesized
atttaaggaccacaatctca

SEQ ID NO: 136373 - DNA, 20 bp, Artificial Sequence
  chemically synthesized
tttaaggaccacaatctcag

SEQ ID NO: 136374 - DNA, 20 bp, Artificial Sequence
  chemically synthesized
atttcttcataaatacctct

SEQ ID NO: 136375 - DNA, 20 bp, Artificial Sequence
  chemically synthesized
caatctcagaggtatttatg

SEQ ID NO: 136376 - DNA, 20 bp, Artificial Sequence
  chemically synthesized
atgaagaaatttatgaaaaa

SEQ ID NO: 136377 - DNA, 20 bp, Artificial Sequence
  chemically synthesized
tgaagaaatttatgaaaaaa

SEQ ID NO: 136378 - DNA, 20 bp, Artificial Sequence
  chemically synthesized
atgaaaaaaaggcatctgac

SEQ ID NO: 136379 - DNA, 20 bp, Artificial Sequence
  chemically synthesized
gttttagaaccagagctagt

SEQ ID NO: 136380 - DNA, 20 bp, Artificial Sequence
  chemically synthesized
aaaaggcatctgactagctc

SEQ ID NO: 136381 - DNA, 20 bp, Artificial Sequence
  chemically synthesized
ctgagttttagaaccagagc

SEQ ID NO: 136382 - DNA, 20 bp, Artificial Sequence
  chemically synthesized
tttactgagttttagaacca

SEQ ID NO: 136383 - DNA, 20 bp, Artificial Sequence
  chemically synthesized
aatttactgagttttagaac

SEQ ID NO: 136384 - DNA, 20 bp, Artificial Sequence
  chemically synthesized
ctagctctggttctaaaact

SEQ ID NO: 136385 - DNA, 20 bp, Artificial Sequence
  chemically synthesized
aaataaaatttactgagttt

SEQ ID NO: 136386 - DNA, 20 bp, Artificial Sequence
  chemically synthesized
caattaaaataaaatttact

SEQ ID NO: 136387 - DNA, 20 bp, Artificial Sequence
  chemically synthesized
tcagtaaattttattttaat

SEQ ID NO: 136388 - DNA, 20 bp, Artificial Sequence
  chemically synthesized
cagtaaattttattttaatt

SEQ ID NO: 136389 - DNA, 20 bp, Artificial Sequence
  chemically synthesized
agtaaattttattttaattg

SEQ ID NO: 136390 - DNA, 20 bp, Artificial Sequence
  chemically synthesized
attttaattggggaaaatac

SEQ ID NO: 136391 - DNA, 20 bp, Artificial Sequence
  chemically synthesized
atacaagtaatatttactgt

SEQ ID NO: 136392 - DNA, 20 bp, Artificial Sequence
  chemically synthesized
acatattgcttataaactaa

SEQ ID NO: 136393 - DNA, 20 bp, Artificial Sequence
  chemically synthesized
aatatttactgttagtttat

SEQ ID NO: 136394 - DNA, 20 bp, Artificial Sequence
  chemically synthesized
agtttataagcaatatgtga

SEQ ID NO: 136395 - DNA, 20 bp, Artificial Sequence
  chemically synthesized
aagaaaaaaatgagaaaata

SEQ ID NO: 136396 - DNA, 20 bp, Artificial Sequence
  chemically synthesized
ggttattataagaaaaaaat

SEQ ID NO: 136397 - DNA, 20 bp, Artificial Sequence
  chemically synthesized
tttactagtgtggttattat

SEQ ID NO: 136398 - DNA, 20 bp, Artificial Sequence
  chemically synthesized
ttttcttataataaccacac

SEQ ID NO: 136399 - DNA, 20 bp, Artificial Sequence
  chemically synthesized
tgctggcttgtttactagtg

SEQ ID NO: 136400 - DNA, 20 bp, Artificial Sequence
  chemically synthesized
taataaccacactagtaaac

SEQ ID NO: 136401 - DNA, 20 bp, Artificial Sequence
  chemically synthesized
aaacttgctggcttgtttac

SEQ ID NO: 136402 - DNA, 20 bp, Artificial Sequence
  chemically synthesized
aaccacactagtaaacaagc

SEQ ID NO: 136403 - DNA, 20 bp, Artificial Sequence
  chemically synthesized
acactagtaaacaagccagc

SEQ ID NO: 136404 - DNA, 20 bp, Artificial Sequence
  chemically synthesized
ttaaaattatacaaacttgc

SEQ ID NO: 136405 - DNA, 20 bp, Artificial Sequence
  chemically synthesized
aatatgatgttctaccacat

SEQ ID NO: 136406 - DNA, 20 bp, Artificial Sequence
  chemically synthesized
atatgatgttctaccacatg

SEQ ID NO: 136407 - DNA, 20 bp, Artificial Sequence
  chemically synthesized
tcttcattggcctcatgtgg

SEQ ID NO: 136408 - DNA, 20 bp, Artificial Sequence
  chemically synthesized
tcatcttcattggcctcatg

SEQ ID NO: 136409 - DNA, 20 bp, Artificial Sequence
  chemically synthesized
tctaccacatgaggccaatg

SEQ ID NO: 136410 - DNA, 20 bp, Artificial Sequence
  chemically synthesized
tttcatctcttcatcttcat

SEQ ID NO: 136411 - DNA, 20 bp, Artificial Sequence
  chemically synthesized
acatgaggccaatgaagatg

SEQ ID NO: 136412 - DNA, 20 bp, Artificial Sequence
  chemically synthesized
atgaggccaatgaagatgaa

SEQ ID NO: 136413 - DNA, 20 bp, Artificial Sequence
  chemically synthesized
caatgaagatgaagagatga

SEQ ID NO: 136414 - DNA, 20 bp, Artificial Sequence
  chemically synthesized
tgaagatgaagagatgaaag

SEQ ID NO: 136415 - DNA, 20 bp, Artificial Sequence
  chemically synthesized
agatgaagagatgaaagtgg

SEQ ID NO: 136416 - DNA, 20 bp, Artificial Sequence
  chemically synthesized
gaagagatgaaagtggtaga

SEQ ID NO: 136417 - DNA, 20 bp, Artificial Sequence
  chemically synthesized
actaagtttcatataagttt

SEQ ID NO: 136418 - DNA, 20 bp, Artificial Sequence
  chemically synthesized
taaataactaagtttcatat

SEQ ID NO: 136419 - DNA, 20 bp, Artificial Sequence
  chemically synthesized
tctgaaacttatatgaaact

SEQ ID NO: 136420 - DNA, 20 bp, Artificial Sequence
  chemically synthesized
aaagtacagagtaaataact

SEQ ID NO: 136421 - DNA, 20 bp, Artificial Sequence
  chemically synthesized
tcagcaggagtcaaagtaca

SEQ ID NO: 136422 - DNA, 20 bp, Artificial Sequence
  chemically synthesized
aatcagcaggagtcaaagta

SEQ ID NO: 136423 - DNA, 20 bp, Artificial Sequence
  chemically synthesized
tagaaaatcagcaggagtca

SEQ ID NO: 136424 - DNA, 20 bp, Artificial Sequence
  chemically synthesized
attcgttagaaaatcagcag

SEQ ID NO: 136425 - DNA, 20 bp, Artificial Sequence
  chemically synthesized
aaattcgttagaaaatcagc

SEQ ID NO: 136426 - DNA, 20 bp, Artificial Sequence
  chemically synthesized
aaaattcgttagaaaatcag

SEQ ID NO: 136427 - DNA, 20 bp, Artificial Sequence
  chemically synthesized
accaaaattcgttagaaaat

SEQ ID NO: 136428 - DNA, 20 bp, Artificial Sequence
  chemically synthesized
tttccaaaaccaaaattcgt

SEQ ID NO: 136429 - DNA, 20 bp, Artificial Sequence
  chemically synthesized
gctgattttctaacgaattt

SEQ ID NO: 136430 - DNA, 20 bp, Artificial Sequence
  chemically synthesized
tttctaacgaattttggttt

SEQ ID NO: 136431 - DNA, 20 bp, Artificial Sequence
  chemically synthesized
taacgaattttggttttgga

SEQ ID NO: 136432 - DNA, 20 bp, Artificial Sequence
  chemically synthesized
aacgaattttggttttggaa

SEQ ID NO: 136433 - DNA, 20 bp, Artificial Sequence
  chemically synthesized
actacagaatgatcaaaatt

SEQ ID NO: 136434 - DNA, 20 bp, Artificial Sequence
  chemically synthesized
gccaaattttgatcattctg

SEQ ID NO: 136435 - DNA, 20 bp, Artificial Sequence
  chemically synthesized
tcttcacagaagaaacacta

SEQ ID NO: 136436 - DNA, 20 bp, Artificial Sequence
  chemically synthesized
tctgtagtgtttcttctgtg

SEQ ID NO: 136437 - DNA, 20 bp, Artificial Sequence
  chemically synthesized
tgtagtgtttcttctgtgaa

SEQ ID NO: 136438 - DNA, 20 bp, Artificial Sequence
  chemically synthesized
gtctccctacctcttcacag

SEQ ID NO: 136439 - DNA, 20 bp, Artificial Sequence
  chemically synthesized
gtagtgtttcttctgtgaag

SEQ ID NO: 136440 - DNA, 20 bp, Artificial Sequence
  chemically synthesized
cctgtctccctacctcttca

SEQ ID NO: 136441 - DNA, 20 bp, Artificial Sequence
  chemically synthesized
gtgtttcttctgtgaagagg

SEQ ID NO: 136442 - DNA, 20 bp, Artificial Sequence
  chemically synthesized
tgtttcttctgtgaagaggt

SEQ ID NO: 136443 - DNA, 20 bp, Artificial Sequence
  chemically synthesized
gtttcttctgtgaagaggta

SEQ ID NO: 136444 - DNA, 20 bp, Artificial Sequence
  chemically synthesized
ttcttctgtgaagaggtagg

SEQ ID NO: 136445 - DNA, 20 bp, Artificial Sequence
  chemically synthesized
tctgtgaagaggtagggaga

SEQ ID NO: 136446 - DNA, 20 bp, Artificial Sequence
  chemically synthesized
ctgtgaagaggtagggagac

SEQ ID NO: 136447 - DNA, 20 bp, Artificial Sequence
  chemically synthesized
gcaattgagtttaaatcaca

SEQ ID NO: 136448 - DNA, 20 bp, Artificial Sequence
  chemically synthesized
tactattaccaaaagcaatt

SEQ ID NO: 136449 - DNA, 20 bp, Artificial Sequence
  chemically synthesized
gatttaaactcaattgcttt

SEQ ID NO: 136450 - DNA, 20 bp, Artificial Sequence
  chemically synthesized
aactcaattgcttttggtaa

SEQ ID NO: 136451 - DNA, 20 bp, Artificial Sequence
  chemically synthesized
cattattttactattaccaa

SEQ ID NO: 136452 - DNA, 20 bp, Artificial Sequence
  chemically synthesized
tagatgtacaatgtttggaa

SEQ ID NO: 136453 - DNA, 20 bp, Artificial Sequence
  chemically synthesized
taaagtagatgtacaatgtt

SEQ ID NO: 136454 - DNA, 20 bp, Artificial Sequence
  chemically synthesized
caaacattgtacatctactt

SEQ ID NO: 136455 - DNA, 20 bp, Artificial Sequence
  chemically synthesized
aaacattgtacatctacttt

SEQ ID NO: 136456 - DNA, 20 bp, Artificial Sequence
  chemically synthesized
agaggagaaagtgcctaaag

SEQ ID NO: 136457 - DNA, 20 bp, Artificial Sequence
  chemically synthesized
cagagaggagaaagtgccta

SEQ ID NO: 136458 - DNA, 20 bp, Artificial Sequence
  chemically synthesized
ttttcaatacagagaggaga

SEQ ID NO: 136459 - DNA, 20 bp, Artificial Sequence
  chemically synthesized
caatttttcaatacagagag

SEQ ID NO: 136460 - DNA, 20 bp, Artificial Sequence
  chemically synthesized
tccaatttttcaatacagag

SEQ ID NO: 136461 - DNA, 20 bp, Artificial Sequence
  chemically synthesized
ctccaatttttcaatacaga

SEQ ID NO: 136462 - DNA, 20 bp, Artificial Sequence
  chemically synthesized
ccctccaatttttcaataca

SEQ ID NO: 136463 - DNA, 20 bp, Artificial Sequence
  chemically synthesized
gcccctccaatttttcaata

SEQ ID NO: 136464 - DNA, 20 bp, Artificial Sequence
  chemically synthesized
tcctctctgtattgaaaaat

SEQ ID NO: 136465 - DNA, 20 bp, Artificial Sequence
  chemically synthesized
ctctctgtattgaaaaattg

SEQ ID NO: 136466 - DNA, 20 bp, Artificial Sequence
  chemically synthesized
tctctgtattgaaaaattgg

SEQ ID NO: 136467 - DNA, 20 bp, Artificial Sequence
  chemically synthesized
ctctgtattgaaaaattgga

SEQ ID NO: 136468 - DNA, 20 bp, Artificial Sequence
  chemically synthesized
tctgtattgaaaaattggag

SEQ ID NO: 136469 - DNA, 20 bp, Artificial Sequence
  chemically synthesized
gtggaaaatttgttaaaagt

SEQ ID NO: 136470 - DNA, 20 bp, Artificial Sequence
  chemically synthesized
aaatgtggaaaatttgttaa

SEQ ID NO: 136471 - DNA, 20 bp, Artificial Sequence
  chemically synthesized
aacaaattttccacatttgt

SEQ ID NO: 136472 - DNA, 20 bp, Artificial Sequence
  chemically synthesized
gcaatcacagcttacaaatg

SEQ ID NO: 136473 - DNA, 20 bp, Artificial Sequence
  chemically synthesized
attttttttctgagcaatca

SEQ ID NO: 136474 - DNA, 20 bp, Artificial Sequence
  chemically synthesized
atttgtaagctgtgattgct

SEQ ID NO: 136475 - DNA, 20 bp, Artificial Sequence
  chemically synthesized
gaaaattggattttttttct

SEQ ID NO: 136476 - DNA, 20 bp, Artificial Sequence
  chemically synthesized
cagaaaaaaaatccaatttt

SEQ ID NO: 136477 - DNA, 20 bp, Artificial Sequence
  chemically synthesized
agaaaaaaaatccaattttc

SEQ ID NO: 136478 - DNA, 20 bp, Artificial Sequence
  chemically synthesized
aaagttagaaacctgaaaat

SEQ ID NO: 136479 - DNA, 20 bp, Artificial Sequence
  chemically synthesized
tttcaggtttctaactttta

SEQ ID NO: 136480 - DNA, 20 bp, Artificial Sequence
  chemically synthesized
tgtaaagaaaccataaaagt

SEQ ID NO: 136481 - DNA, 20 bp, Artificial Sequence
  chemically synthesized
gttgtgtaaagaaaccataa

SEQ ID NO: 136482 - DNA, 20 bp, Artificial Sequence
  chemically synthesized
tttatggtttctttacacaa

SEQ ID NO: 136483 - DNA, 20 bp, Artificial Sequence
  chemically synthesized
ttcaaacactctgttgtgta

SEQ ID NO: 136484 - DNA, 20 bp, Artificial Sequence
  chemically synthesized
tatggtttctttacacaaca

SEQ ID NO: 136485 - DNA, 20 bp, Artificial Sequence
  chemically synthesized
acaacagagtgtttgaaata

SEQ ID NO: 136486 - DNA, 20 bp, Artificial Sequence
  chemically synthesized
aaatatggaacaaattgcca

SEQ ID NO: 136487 - DNA, 20 bp, Artificial Sequence
  chemically synthesized
atggaacaaattgccaaaga

SEQ ID NO: 136488 - DNA, 20 bp, Artificial Sequence
  chemically synthesized
cttacttcaatagctgtctt

SEQ ID NO: 136489 - DNA, 20 bp, Artificial Sequence
  chemically synthesized
attgccaaagacagctattg

SEQ ID NO: 136490 - DNA, 20 bp, Artificial Sequence
  chemically synthesized
ccaaagacagctattgaagt

SEQ ID NO: 136491 - DNA, 20 bp, Artificial Sequence
  chemically synthesized
acttatgccacttacttcaa

SEQ ID NO: 136492 - DNA, 20 bp, Artificial Sequence
  chemically synthesized
aagacagctattgaagtaag

SEQ ID NO: 136493 - DNA, 20 bp, Artificial Sequence
  chemically synthesized
gctattgaagtaagtggcat

SEQ ID NO: 136494 - DNA, 20 bp, Artificial Sequence
  chemically synthesized
ttgaagtaagtggcataagt

SEQ ID NO: 136495 - DNA, 20 bp, Artificial Sequence
  chemically synthesized
agtaagtggcataagtcagc

SEQ ID NO: 136496 - DNA, 20 bp, Artificial Sequence
  chemically synthesized
taagtggcataagtcagctg

SEQ ID NO: 136497 - DNA, 20 bp, Artificial Sequence
  chemically synthesized
agtggcataagtcagctgga

SEQ ID NO: 136498 - DNA, 20 bp, Artificial Sequence
  chemically synthesized
aaaatttgttcagtactctc

SEQ ID NO: 136499 - DNA, 20 bp, Artificial Sequence
  chemically synthesized
ttcctactttaaaatttgtt

SEQ ID NO: 136500 - DNA, 20 bp, Artificial Sequence
  chemically synthesized
agagtactgaacaaatttta

SEQ ID NO: 136501 - DNA, 20 bp, Artificial Sequence
  chemically synthesized
gtactgaacaaattttaaag

SEQ ID NO: 136502 - DNA, 20 bp, Artificial Sequence
  chemically synthesized
tactgaacaaattttaaagt

SEQ ID NO: 136503 - DNA, 20 bp, Artificial Sequence
  chemically synthesized
attttaaagtaggaaccata

SEQ ID NO: 136504 - DNA, 20 bp, Artificial Sequence
  chemically synthesized
ttaaagtaggaaccatatag

SEQ ID NO: 136505 - DNA, 20 bp, Artificial Sequence
  chemically synthesized
aaaatctacctgctactata

SEQ ID NO: 136506 - DNA, 20 bp, Artificial Sequence
  chemically synthesized
aagtaggaaccatatagtag

SEQ ID NO: 136507 - DNA, 20 bp, Artificial Sequence
  chemically synthesized
agtaggaaccatatagtagc

SEQ ID NO: 136508 - DNA, 20 bp, Artificial Sequence
  chemically synthesized
aggaaccatatagtagcagg

SEQ ID NO: 136509 - DNA, 20 bp, Artificial Sequence
  chemically synthesized
gcaggtagattttatgaaat

SEQ ID NO: 136510 - DNA, 20 bp, Artificial Sequence
  chemically synthesized
ttatgaaataagatgttttc

SEQ ID NO: 136511 - DNA, 20 bp, Artificial Sequence
  chemically synthesized
aataagatgttttccagtgt

SEQ ID NO: 136512 - DNA, 20 bp, Artificial Sequence
  chemically synthesized
agagtttcacattctaacac

SEQ ID NO: 136513 - DNA, 20 bp, Artificial Sequence
  chemically synthesized
agtgttagaatgtgaaactc

SEQ ID NO: 136514 - DNA, 20 bp, Artificial Sequence
  chemically synthesized
tcccatgtcacagatgacca

SEQ ID NO: 136515 - DNA, 20 bp, Artificial Sequence
  chemically synthesized
cttcccatgtcacagatgac

SEQ ID NO: 136516 - DNA, 20 bp, Artificial Sequence
  chemically synthesized
aactctggtcatctgtgaca

SEQ ID NO: 136517 - DNA, 20 bp, Artificial Sequence
  chemically synthesized
actctggtcatctgtgacat

SEQ ID NO: 136518 - DNA, 20 bp, Artificial Sequence
  chemically synthesized
cctttcagcttcccatgtca

SEQ ID NO: 136519 - DNA, 20 bp, Artificial Sequence
  chemically synthesized
ctggtcatctgtgacatggg

SEQ ID NO: 136520 - DNA, 20 bp, Artificial Sequence
  chemically synthesized
tctgtgacatgggaagctga

SEQ ID NO: 136521 - DNA, 20 bp, Artificial Sequence
  chemically synthesized
ctgtgacatgggaagctgaa

SEQ ID NO: 136522 - DNA, 20 bp, Artificial Sequence
  chemically synthesized
gcaattccaaagcaaccttt

SEQ ID NO: 136523 - DNA, 20 bp, Artificial Sequence
  chemically synthesized
gggaagctgaaaggttgctt

SEQ ID NO: 136524 - DNA, 20 bp, Artificial Sequence
  chemically synthesized
ttttagggtaggcaattcca

SEQ ID NO: 136525 - DNA, 20 bp, Artificial Sequence
  chemically synthesized
atattcaaacattttagggt

SEQ ID NO: 136526 - DNA, 20 bp, Artificial Sequence
  chemically synthesized
catattcaaacattttaggg

SEQ ID NO: 136527 - DNA, 20 bp, Artificial Sequence
  chemically synthesized
gaacatattcaaacatttta

SEQ ID NO: 136528 - DNA, 20 bp, Artificial Sequence
  chemically synthesized
tgaacatattcaaacatttt

SEQ ID NO: 136529 - DNA, 20 bp, Artificial Sequence
  chemically synthesized
ttgaacatattcaaacattt

SEQ ID NO: 136530 - DNA, 20 bp, Artificial Sequence
  chemically synthesized
aaatgtttgaatatgttcaa

SEQ ID NO: 136531 - DNA, 20 bp, Artificial Sequence
  chemically synthesized
gttcaatagaatttttaaaa

SEQ ID NO: 136532 - DNA, 20 bp, Artificial Sequence
  chemically synthesized
atttttaaaacggacttacc

SEQ ID NO: 136533 - DNA, 20 bp, Artificial Sequence
  chemically synthesized
ttcatctgaggtttctgggt

SEQ ID NO: 136534 - DNA, 20 bp, Artificial Sequence
  chemically synthesized
tgacttcatctgaggtttct

SEQ ID NO: 136535 - DNA, 20 bp, Artificial Sequence
  chemically synthesized
acggacttacccagaaacct

SEQ ID NO: 136536 - DNA, 20 bp, Artificial Sequence
  chemically synthesized
ttgacttcatctgaggtttc

SEQ ID NO: 136537 - DNA, 20 bp, Artificial Sequence
  chemically synthesized
ttacccagaaacctcagatg

SEQ ID NO: 136538 - DNA, 20 bp, Artificial Sequence
  chemically synthesized
tgaaaatttgacttcatctg

SEQ ID NO: 136539 - DNA, 20 bp, Artificial Sequence
  chemically synthesized
gtgaaaatttgacttcatct

SEQ ID NO: 136540 - DNA, 20 bp, Artificial Sequence
  chemically synthesized
gaagtcaaattttcacctca

SEQ ID NO: 136541 - DNA, 20 bp, Artificial Sequence
  chemically synthesized
aaagttctctgttaactttg

SEQ ID NO: 136542 - DNA, 20 bp, Artificial Sequence
  chemically synthesized
taaagttctctgttaacttt

SEQ ID NO: 136543 - DNA, 20 bp, Artificial Sequence
  chemically synthesized
aattttcacctcaaagttaa

SEQ ID NO: 136544 - DNA, 20 bp, Artificial Sequence
  chemically synthesized
ttttcacctcaaagttaaca

SEQ ID NO: 136545 - DNA, 20 bp, Artificial Sequence
  chemically synthesized
ttgccagccctgtgtattta

SEQ ID NO: 136546 - DNA, 20 bp, Artificial Sequence
  chemically synthesized
aacagagaactttaaataca

SEQ ID NO: 136547 - DNA, 20 bp, Artificial Sequence
  chemically synthesized
acagagaactttaaatacac

SEQ ID NO: 136548 - DNA, 20 bp, Artificial Sequence
  chemically synthesized
cagagaactttaaatacaca

SEQ ID NO: 136549 - DNA, 20 bp, Artificial Sequence
  chemically synthesized
gaactttaaatacacagggc

SEQ ID NO: 136550 - DNA, 20 bp, Artificial Sequence
  chemically synthesized
aatgaatttatgtattttgc

SEQ ID NO: 136551 - DNA, 20 bp, Artificial Sequence
  chemically synthesized
atttattaaaatgaatggat

SEQ ID NO: 136552 - DNA, 20 bp, Artificial Sequence
  chemically synthesized
aaaatatttattaaaatgaa

SEQ ID NO: 136553 - DNA, 20 bp, Artificial Sequence
  chemically synthesized
tcattttaataaatattttt

SEQ ID NO: 136554 - DNA, 20 bp, Artificial Sequence
  chemically synthesized
taataaatatttttcagcac

SEQ ID NO: 136555 - DNA, 20 bp, Artificial Sequence
  chemically synthesized
aataaatatttttcagcact

SEQ ID NO: 136556 - DNA, 20 bp, Artificial Sequence
  chemically synthesized
atagtccctagaatagtgcc

SEQ ID NO: 136557 - DNA, 20 bp, Artificial Sequence
  chemically synthesized
ttcagcactaggcactattc

SEQ ID NO: 136558 - DNA, 20 bp, Artificial Sequence
  chemically synthesized
tcagcactaggcactattct

SEQ ID NO: 136559 - DNA, 20 bp, Artificial Sequence
  chemically synthesized
cagcactaggcactattcta

SEQ ID NO: 136560 - DNA, 20 bp, Artificial Sequence
  chemically synthesized
cacatgcatagtccctagaa

SEQ ID NO: 136561 - DNA, 20 bp, Artificial Sequence
  chemically synthesized
actgccacatgcatagtccc

SEQ ID NO: 136562 - DNA, 20 bp, Artificial Sequence
  chemically synthesized
tattctagggactatgcatg

SEQ ID NO: 136563 - DNA, 20 bp, Artificial Sequence
  chemically synthesized
tttgtccactgccacatgca

SEQ ID NO: 136564 - DNA, 20 bp, Artificial Sequence
  chemically synthesized
tctagggactatgcatgtgg

SEQ ID NO: 136565 - DNA, 20 bp, Artificial Sequence
  chemically synthesized
agggactatgcatgtggcag

SEQ ID NO: 136566 - DNA, 20 bp, Artificial Sequence
  chemically synthesized
tggcagtggacaaatatatt

SEQ ID NO: 136567 - DNA, 20 bp, Artificial Sequence
  chemically synthesized
gtggacaaatatattcggta

SEQ ID NO: 136568 - DNA, 20 bp, Artificial Sequence
  chemically synthesized
aaaagcacgatttttcatgt

SEQ ID NO: 136569 - DNA, 20 bp, Artificial Sequence
  chemically synthesized
aaaaatttccaagtatcgaa

SEQ ID NO: 136570 - DNA, 20 bp, Artificial Sequence
  chemically synthesized
aaatcgtgcttttcgatact

SEQ ID NO: 136571 - DNA, 20 bp, Artificial Sequence
  chemically synthesized
tttgttatataaaaatttcc

SEQ ID NO: 136572 - DNA, 20 bp, Artificial Sequence
  chemically synthesized
ttggaaatttttatataaca

SEQ ID NO: 136573 - DNA, 20 bp, Artificial Sequence
  chemically synthesized
ataacaaagattatctttat

SEQ ID NO: 136574 - DNA, 20 bp, Artificial Sequence
  chemically synthesized
taacaaagattatctttatt

SEQ ID NO: 136575 - DNA, 20 bp, Artificial Sequence
  chemically synthesized
aaaagaagaacaacccaata

SEQ ID NO: 136576 - DNA, 20 bp, Artificial Sequence
  chemically synthesized
atgtgagagtgaattaaaag

SEQ ID NO: 136577 - DNA, 20 bp, Artificial Sequence
  chemically synthesized
gttatgtgagagtgaattaa

SEQ ID NO: 136578 - DNA, 20 bp, Artificial Sequence
  chemically synthesized
aaaaaaatctggttatgtga

SEQ ID NO: 136579 - DNA, 20 bp, Artificial Sequence
  chemically synthesized
ttaattcactctcacataac

SEQ ID NO: 136580 - DNA, 20 bp, Artificial Sequence
  chemically synthesized
caaaaaaaatctggttatgt

SEQ ID NO: 136581 - DNA, 20 bp, Artificial Sequence
  chemically synthesized
actgagaagcaaaaaaaatc

SEQ ID NO: 136582 - DNA, 20 bp, Artificial Sequence
  chemically synthesized
accagattttttttgcttct

SEQ ID NO: 136583 - DNA, 20 bp, Artificial Sequence
  chemically synthesized
ataatgtatctaaaactgag

SEQ ID NO: 136584 - DNA, 20 bp, Artificial Sequence
  chemically synthesized
ttttttttgcttctcagttt

SEQ ID NO: 136585 - DNA, 20 bp, Artificial Sequence
  chemically synthesized
tgaataatgtatctaaaact

SEQ ID NO: 136586 - DNA, 20 bp, Artificial Sequence
  chemically synthesized
aaggaaaaaagtatagcaaa

SEQ ID NO: 136587 - DNA, 20 bp, Artificial Sequence
  chemically synthesized
ttaaaagaaggaaaaaagta

SEQ ID NO: 136588 - DNA, 20 bp, Artificial Sequence
  chemically synthesized
aaatcttaaaagaaggaaaa

SEQ ID NO: 136589 - DNA, 20 bp, Artificial Sequence
  chemically synthesized
tatacttttttccttctttt

SEQ ID NO: 136590 - DNA, 20 bp, Artificial Sequence
  chemically synthesized
aactttgaaatcttaaaaga

SEQ ID NO: 136591 - DNA, 20 bp, Artificial Sequence
  chemically synthesized
gaactttgaaatcttaaaag

SEQ ID NO: 136592 - DNA, 20 bp, Artificial Sequence
  chemically synthesized
aatgaactttgaaatcttaa

SEQ ID NO: 136593 - DNA, 20 bp, Artificial Sequence
  chemically synthesized
ttccttcttttaagatttca

SEQ ID NO: 136594 - DNA, 20 bp, Artificial Sequence
  chemically synthesized
taagatttcaaagttcattt

SEQ ID NO: 136595 - DNA, 20 bp, Artificial Sequence
  chemically synthesized
gatttcaaagttcatttaag

SEQ ID NO: 136596 - DNA, 20 bp, Artificial Sequence
  chemically synthesized
atttaagaagtatgttgtaa

SEQ ID NO: 136597 - DNA, 20 bp, Artificial Sequence
  chemically synthesized
aagaagtatgttgtaaaagt

SEQ ID NO: 136598 - DNA, 20 bp, Artificial Sequence
  chemically synthesized
gcctggtaaggttcagatta

SEQ ID NO: 136599 - DNA, 20 bp, Artificial Sequence
  chemically synthesized
atttagagcctggtaaggtt

SEQ ID NO: 136600 - DNA, 20 bp, Artificial Sequence
  chemically synthesized
aactttaatctgaaccttac

SEQ ID NO: 136601 - DNA, 20 bp, Artificial Sequence
  chemically synthesized
actttaatctgaaccttacc

SEQ ID NO: 136602 - DNA, 20 bp, Artificial Sequence
  chemically synthesized
gtttaatttagagcctggta

SEQ ID NO: 136603 - DNA, 20 bp, Artificial Sequence
  chemically synthesized
ggtttaatttagagcctggt

SEQ ID NO: 136604 - DNA, 20 bp, Artificial Sequence
  chemically synthesized
gtcaggtttaatttagagcc

SEQ ID NO: 136605 - DNA, 20 bp, Artificial Sequence
  chemically synthesized
ttgtggtcaggtttaattta

SEQ ID NO: 136606 - DNA, 20 bp, Artificial Sequence
  chemically synthesized
cattgtggtcaggtttaatt

SEQ ID NO: 136607 - DNA, 20 bp, Artificial Sequence
  chemically synthesized
aaaagctgttcattgtggtc

SEQ ID NO: 136608 - DNA, 20 bp, Artificial Sequence
  chemically synthesized
taaaagctgttcattgtggt

SEQ ID NO: 136609 - DNA, 20 bp, Artificial Sequence
  chemically synthesized
ttaaacctgaccacaatgaa

SEQ ID NO: 136610 - DNA, 20 bp, Artificial Sequence
  chemically synthesized
gcaataaaagctgttcattg

SEQ ID NO: 136611 - DNA, 20 bp, Artificial Sequence
  chemically synthesized
cttgctaatttcagcaataa

SEQ ID NO: 136612 - DNA, 20 bp, Artificial Sequence
  chemically synthesized
acagcttttattgctgaaat

SEQ ID NO: 136613 - DNA, 20 bp, Artificial Sequence
  chemically synthesized
gttgacatgcttgctaattt

SEQ ID NO: 136614 - DNA, 20 bp, Artificial Sequence
  chemically synthesized
cttttattgctgaaattagc

SEQ ID NO: 136615 - DNA, 20 bp, Artificial Sequence
  chemically synthesized
aattagcaagcatgtcaact

SEQ ID NO: 136616 - DNA, 20 bp, Artificial Sequence
  chemically synthesized
aaatggcttgttttgagtct

SEQ ID NO: 136617 - DNA, 20 bp, Artificial Sequence
  chemically synthesized
tgtcaacttagactcaaaac

SEQ ID NO: 136618 - DNA, 20 bp, Artificial Sequence
  chemically synthesized
agaggaaaatggcttgtttt

SEQ ID NO: 136619 - DNA, 20 bp, Artificial Sequence
  chemically synthesized
ttgttcattagagaggaaaa

SEQ ID NO: 136620 - DNA, 20 bp, Artificial Sequence
  chemically synthesized
acctattttgttcattagag

SEQ ID NO: 136621 - DNA, 20 bp, Artificial Sequence
  chemically synthesized
gacctattttgttcattaga

SEQ ID NO: 136622 - DNA, 20 bp, Artificial Sequence
  chemically synthesized
gagacctattttgttcatta

SEQ ID NO: 136623 - DNA, 20 bp, Artificial Sequence
  chemically synthesized
ctgagacctattttgttcat

SEQ ID NO: 136624 - DNA, 20 bp, Artificial Sequence
  chemically synthesized
ttcctctctaatgaacaaaa

SEQ ID NO: 136625 - DNA, 20 bp, Artificial Sequence
  chemically synthesized
tcctctctaatgaacaaaat

SEQ ID NO: 136626 - DNA, 20 bp, Artificial Sequence
  chemically synthesized
ctaatgaacaaaataggtct

SEQ ID NO: 136627 - DNA, 20 bp, Artificial Sequence
  chemically synthesized
taatgaacaaaataggtctc

SEQ ID NO: 136628 - DNA, 20 bp, Artificial Sequence
  chemically synthesized
aatgaacaaaataggtctca

SEQ ID NO: 136629 - DNA, 20 bp, Artificial Sequence
  chemically synthesized
aacaggtttcacaataccct

SEQ ID NO: 136630 - DNA, 20 bp, Artificial Sequence
  chemically synthesized
gtattgtgaaacctgttctc

SEQ ID NO: 136631 - DNA, 20 bp, Artificial Sequence
  chemically synthesized
gaatcacccaactagagaac

SEQ ID NO: 136632 - DNA, 20 bp, Artificial Sequence
  chemically synthesized
agaatcacccaactagagaa

SEQ ID NO: 136633 - DNA, 20 bp, Artificial Sequence
  chemically synthesized
tgtgaaacctgttctctagt

SEQ ID NO: 136634 - DNA, 20 bp, Artificial Sequence
  chemically synthesized
gtgaaacctgttctctagtt

SEQ ID NO: 136635 - DNA, 20 bp, Artificial Sequence
  chemically synthesized
attagagaatcacccaacta

SEQ ID NO: 136636 - DNA, 20 bp, Artificial Sequence
  chemically synthesized
gaattagagaatcacccaac

SEQ ID NO: 136637 - DNA, 20 bp, Artificial Sequence
  chemically synthesized
tgtgtctgtcagcagaatta

SEQ ID NO: 136638 - DNA, 20 bp, Artificial Sequence
  chemically synthesized
catgtgtctgtcagcagaat

SEQ ID NO: 136639 - DNA, 20 bp, Artificial Sequence
  chemically synthesized
tgattctctaattctgctga

SEQ ID NO: 136640 - DNA, 20 bp, Artificial Sequence
  chemically synthesized
acaaagcatgtgtctgtcag

SEQ ID NO: 136641 - DNA, 20 bp, Artificial Sequence
  chemically synthesized
cttacaaagcatgtgtctgt

SEQ ID NO: 136642 - DNA, 20 bp, Artificial Sequence
  chemically synthesized
ctgacagacacatgctttgt

SEQ ID NO: 136643 - DNA, 20 bp, Artificial Sequence
  chemically synthesized
aatcttctcaggtgcttaca

SEQ ID NO: 136644 - DNA, 20 bp, Artificial Sequence
  chemically synthesized
cacatgctttgtaagcacct

SEQ ID NO: 136645 - DNA, 20 bp, Artificial Sequence
  chemically synthesized
atgctttgtaagcacctgag

SEQ ID NO: 136646 - DNA, 20 bp, Artificial Sequence
  chemically synthesized
atctcattaataatcttctc

SEQ ID NO: 136647 - DNA, 20 bp, Artificial Sequence
  chemically synthesized
gatctcattaataatcttct

SEQ ID NO: 136648 - DNA, 20 bp, Artificial Sequence
  chemically synthesized
cacctgagaagattattaat

SEQ ID NO: 136649 - DNA, 20 bp, Artificial Sequence
  chemically synthesized
attattaatgagatcctttg

SEQ ID NO: 136650 - DNA, 20 bp, Artificial Sequence
  chemically synthesized
attaatgagatcctttgaag

SEQ ID NO: 136651 - DNA, 20 bp, Artificial Sequence
  chemically synthesized
ttttaaggaggctgcttcaa

SEQ ID NO: 136652 - DNA, 20 bp, Artificial Sequence
  chemically synthesized
tttttaaggaggctgcttca

SEQ ID NO: 136653 - DNA, 20 bp, Artificial Sequence
  chemically synthesized
acctccttagatttttaagg

SEQ ID NO: 136654 - DNA, 20 bp, Artificial Sequence
  chemically synthesized
aacctccttagatttttaag

SEQ ID NO: 136655 - DNA, 20 bp, Artificial Sequence
  chemically synthesized
tgaacctccttagattttta

SEQ ID NO: 136656 - DNA, 20 bp, Artificial Sequence
  chemically synthesized
gtgaacctccttagattttt

SEQ ID NO: 136657 - DNA, 20 bp, Artificial Sequence
  chemically synthesized
agcagcctccttaaaaatct

SEQ ID NO: 136658 - DNA, 20 bp, Artificial Sequence
  chemically synthesized
gcagcctccttaaaaatcta

SEQ ID NO: 136659 - DNA, 20 bp, Artificial Sequence
  chemically synthesized
agcctccttaaaaatctaag

SEQ ID NO: 136660 - DNA, 20 bp, Artificial Sequence
  chemically synthesized
gcctccttaaaaatctaagg

SEQ ID NO: 136661 - DNA, 20 bp, Artificial Sequence
  chemically synthesized
actgcagttgtgaacctcct

SEQ ID NO: 136662 - DNA, 20 bp, Artificial Sequence
  chemically synthesized
tctaaggaggttcacaactg

SEQ ID NO: 136663 - DNA, 20 bp, Artificial Sequence
  chemically synthesized
agaaatgcatagttgtactg

SEQ ID NO: 136664 - DNA, 20 bp, Artificial Sequence
  chemically synthesized
tgaaatattttagaaatgca

SEQ ID NO: 136665 - DNA, 20 bp, Artificial Sequence
  chemically synthesized
aattttgttttgaaatattt

SEQ ID NO: 136666 - DNA, 20 bp, Artificial Sequence
  chemically synthesized
tgaccatagagtgggataaa

SEQ ID NO: 136667 - DNA, 20 bp, Artificial Sequence
  chemically synthesized
caactttttatcccactcta

SEQ ID NO: 136668 - DNA, 20 bp, Artificial Sequence
  chemically synthesized
gtatgtgttgaccatagagt

SEQ ID NO: 136669 - DNA, 20 bp, Artificial Sequence
  chemically synthesized
tgtatgtgttgaccatagag

SEQ ID NO: 136670 - DNA, 20 bp, Artificial Sequence
  chemically synthesized
gtttgtatgtgttgaccata

SEQ ID NO: 136671 - DNA, 20 bp, Artificial Sequence
  chemically synthesized
atgtttgtatgtgttgacca

SEQ ID NO: 136672 - DNA, 20 bp, Artificial Sequence
  chemically synthesized
tacaaacattcatttcaaca

SEQ ID NO: 136673 - DNA, 20 bp, Artificial Sequence
  chemically synthesized
aaacattcatttcaacaaag

SEQ ID NO: 136674 - DNA, 20 bp, Artificial Sequence
  chemically synthesized
caatatacattatcatttta

SEQ ID NO: 136675 - DNA, 20 bp, Artificial Sequence
  chemically synthesized
aatgataatgtatattgcta

SEQ ID NO: 136676 - DNA, 20 bp, Artificial Sequence
  chemically synthesized
atgataatgtatattgctat

SEQ ID NO: 136677 - DNA, 20 bp, Artificial Sequence
  chemically synthesized
ttagtgtatgataaatccca

SEQ ID NO: 136678 - DNA, 20 bp, Artificial Sequence
  chemically synthesized
tgggatttatcatacactaa

SEQ ID NO: 136679 - DNA, 20 bp, Artificial Sequence
  chemically synthesized
gggatttatcatacactaat

SEQ ID NO: 136680 - DNA, 20 bp, Artificial Sequence
  chemically synthesized
ccactaagtaaagagcctat

SEQ ID NO: 136681 - DNA, 20 bp, Artificial Sequence
  chemically synthesized
acactaataggctctttact

SEQ ID NO: 136682 - DNA, 20 bp, Artificial Sequence
  chemically synthesized
ctaaaagaccactaagtaaa

SEQ ID NO: 136683 - DNA, 20 bp, Artificial Sequence
  chemically synthesized
ctaataggctctttacttag

SEQ ID NO: 136684 - DNA, 20 bp, Artificial Sequence
  chemically synthesized
tactaaaagaccactaagta

SEQ ID NO: 136685 - DNA, 20 bp, Artificial Sequence
  chemically synthesized
tgctatactaaaagaccact

SEQ ID NO: 136686 - DNA, 20 bp, Artificial Sequence
  chemically synthesized
ctctttacttagtggtcttt

SEQ ID NO: 136687 - DNA, 20 bp, Artificial Sequence
  chemically synthesized
tacttagtggtcttttagta

SEQ ID NO: 136688 - DNA, 20 bp, Artificial Sequence
  chemically synthesized
ttcccattctgctatactaa

SEQ ID NO: 136689 - DNA, 20 bp, Artificial Sequence
  chemically synthesized
ttagtggtcttttagtatag

SEQ ID NO: 136690 - DNA, 20 bp, Artificial Sequence
  chemically synthesized
ggtcttttagtatagcagaa

SEQ ID NO: 136691 - DNA, 20 bp, Artificial Sequence
  chemically synthesized
gtcttttagtatagcagaat

SEQ ID NO: 136692 - DNA, 20 bp, Artificial Sequence
  chemically synthesized
ttctagaaagggaatcaaag

SEQ ID NO: 136693 - DNA, 20 bp, Artificial Sequence
  chemically synthesized
atttctagaaagggaatcaa

SEQ ID NO: 136694 - DNA, 20 bp, Artificial Sequence
  chemically synthesized
tatttctagaaagggaatca

SEQ ID NO: 136695 - DNA, 20 bp, Artificial Sequence
  chemically synthesized
ttctcctttgattccctttc

SEQ ID NO: 136696 - DNA, 20 bp, Artificial Sequence
  chemically synthesized
cctctctttatttctagaaa

SEQ ID NO: 136697 - DNA, 20 bp, Artificial Sequence
  chemically synthesized
ccctctctttatttctagaa

SEQ ID NO: 136698 - DNA, 20 bp, Artificial Sequence
  chemically synthesized
tccctctctttatttctaga

SEQ ID NO: 136699 - DNA, 20 bp, Artificial Sequence
  chemically synthesized
tgattccctttctagaaata

SEQ ID NO: 136700 - DNA, 20 bp, Artificial Sequence
  chemically synthesized
taaatccctctctttatttc

SEQ ID NO: 136701 - DNA, 20 bp, Artificial Sequence
  chemically synthesized
attccctttctagaaataaa

SEQ ID NO: 136702 - DNA, 20 bp, Artificial Sequence
  chemically synthesized
tccctttctagaaataaaga

SEQ ID NO: 136703 - DNA, 20 bp, Artificial Sequence
  chemically synthesized
ccctttctagaaataaagag

SEQ ID NO: 136704 - DNA, 20 bp, Artificial Sequence
  chemically synthesized
cctttctagaaataaagaga

SEQ ID NO: 136705 - DNA, 20 bp, Artificial Sequence
  chemically synthesized
ataaagagagggatttaata

SEQ ID NO: 136706 - DNA, 20 bp, Artificial Sequence
  chemically synthesized
atttaatatggcatacgctt

SEQ ID NO: 136707 - DNA, 20 bp, Artificial Sequence
  chemically synthesized
atcttaatgaaaaaatactg

SEQ ID NO: 136708 - DNA, 20 bp, Artificial Sequence
  chemically synthesized
cgcttcagtattttttcatt

SEQ ID NO: 136709 - DNA, 20 bp, Artificial Sequence
  chemically synthesized
tcattaagatattataaaaa

SEQ ID NO: 136710 - DNA, 20 bp, Artificial Sequence
  chemically synthesized
ttaagatattataaaaacag

SEQ ID NO: 136711 - DNA, 20 bp, Artificial Sequence
  chemically synthesized
attataaaaacagtggttaa

SEQ ID NO: 136712 - DNA, 20 bp, Artificial Sequence
  chemically synthesized
taaaagaatttcttgctaat

SEQ ID NO: 136713 - DNA, 20 bp, Artificial Sequence
  chemically synthesized
atgcttgtgttcttattagc

SEQ ID NO: 136714 - DNA, 20 bp, Artificial Sequence
  chemically synthesized
ccatatgcttgtgttcttat

SEQ ID NO: 136715 - DNA, 20 bp, Artificial Sequence
  chemically synthesized
tttcttgctaataagaacac

SEQ ID NO: 136716 - DNA, 20 bp, Artificial Sequence
  chemically synthesized
ctaataagaacacaagcata

SEQ ID NO: 136717 - DNA, 20 bp, Artificial Sequence
  chemically synthesized
taagaacacaagcatatggt

SEQ ID NO: 136718 - DNA, 20 bp, Artificial Sequence
  chemically synthesized
agaacacaagcatatggtga

SEQ ID NO: 136719 - DNA, 20 bp, Artificial Sequence
  chemically synthesized
agtaacgattatttttcatt

SEQ ID NO: 136720 - DNA, 20 bp, Artificial Sequence
  chemically synthesized
ttttcatttggtttcctttt

SEQ ID NO: 136721 - DNA, 20 bp, Artificial Sequence
  chemically synthesized
tttcatttggtttcctttta

SEQ ID NO: 136722 - DNA, 20 bp, Artificial Sequence
  chemically synthesized
ttcatttggtttccttttaa

SEQ ID NO: 136723 - DNA, 20 bp, Artificial Sequence
  chemically synthesized
ataaatagaatacccttaaa

SEQ ID NO: 136724 - DNA, 20 bp, Artificial Sequence
  chemically synthesized
aataaatagaatacccttaa

SEQ ID NO: 136725 - DNA, 20 bp, Artificial Sequence
  chemically synthesized
aaagtatagtagcaaataaa

SEQ ID NO: 136726 - DNA, 20 bp, Artificial Sequence
  chemically synthesized
tgaagtcaaagaaagtatag

SEQ ID NO: 136727 - DNA, 20 bp, Artificial Sequence
  chemically synthesized
agttgaagtcaaagaaagta

SEQ ID NO: 136728 - DNA, 20 bp, Artificial Sequence
  chemically synthesized
aactaagttgaagtcaaaga

SEQ ID NO: 136729 - DNA, 20 bp, Artificial Sequence
  chemically synthesized
ataaaactaagttgaagtca

SEQ ID NO: 136730 - DNA, 20 bp, Artificial Sequence
  chemically synthesized
tactttctttgacttcaact

SEQ ID NO: 136731 - DNA, 20 bp, Artificial Sequence
  chemically synthesized
ggaattataaaactaagttg

SEQ ID NO: 136732 - DNA, 20 bp, Artificial Sequence
  chemically synthesized
agttctggaattataaaact

SEQ ID NO: 136733 - DNA, 20 bp, Artificial Sequence
  chemically synthesized
tcaacttagttttataattc

SEQ ID NO: 136734 - DNA, 20 bp, Artificial Sequence
  chemically synthesized
tcagtttatttgagaagttc

SEQ ID NO: 136735 - DNA, 20 bp, Artificial Sequence
  chemically synthesized
tgaaggtcagtttatttgag

SEQ ID NO: 136736 - DNA, 20 bp, Artificial Sequence
  chemically synthesized
aggtgaaggtcagtttattt

SEQ ID NO: 136737 - DNA, 20 bp, Artificial Sequence
  chemically synthesized
gaaggaatagaggtgaaggt

SEQ ID NO: 136738 - DNA, 20 bp, Artificial Sequence
  chemically synthesized
gctcgaaggaatagaggtga

SEQ ID NO: 136739 - DNA, 20 bp, Artificial Sequence
  chemically synthesized
ggctcgaaggaatagaggtg

SEQ ID NO: 136740 - DNA, 20 bp, Artificial Sequence
  chemically synthesized
tgggtggctcgaaggaatag

SEQ ID NO: 136741 - DNA, 20 bp, Artificial Sequence
  chemically synthesized
gtgggtggctcgaaggaata

SEQ ID NO: 136742 - DNA, 20 bp, Artificial Sequence
  chemically synthesized
accttcacctctattccttc

SEQ ID NO: 136743 - DNA, 20 bp, Artificial Sequence
  chemically synthesized
ctgtgggtggctcgaaggaa

SEQ ID NO: 136744 - DNA, 20 bp, Artificial Sequence
  chemically synthesized
ctcatctgtgggtggctcga

SEQ ID NO: 136745 - DNA, 20 bp, Artificial Sequence
  chemically synthesized
tctcatctgtgggtggctcg

SEQ ID NO: 136746 - DNA, 20 bp, Artificial Sequence
  chemically synthesized
ctattccttcgagccaccca

SEQ ID NO: 136747 - DNA, 20 bp, Artificial Sequence
  chemically synthesized
ggtgttttctcatctgtggg

SEQ ID NO: 136748 - DNA, 20 bp, Artificial Sequence
  chemically synthesized
ccttcgagccacccacagat

SEQ ID NO: 136749 - DNA, 20 bp, Artificial Sequence
  chemically synthesized
taaggtgttttctcatctgt

SEQ ID NO: 136750 - DNA, 20 bp, Artificial Sequence
  chemically synthesized
ctaaggtgttttctcatctg

SEQ ID NO: 136751 - DNA, 20 bp, Artificial Sequence
  chemically synthesized
ccacagatgagaaaacacct

SEQ ID NO: 136752 - DNA, 20 bp, Artificial Sequence
  chemically synthesized
ttgagtaatgattagatcta

SEQ ID NO: 136753 - DNA, 20 bp, Artificial Sequence
  chemically synthesized
tttgagtaatgattagatct

SEQ ID NO: 136754 - DNA, 20 bp, Artificial Sequence
  chemically synthesized
caagtagtttgagtaatgat

SEQ ID NO: 136755 - DNA, 20 bp, Artificial Sequence
  chemically synthesized
attttggaggcaagtagttt

SEQ ID NO: 136756 - DNA, 20 bp, Artificial Sequence
  chemically synthesized
atggatattttggaggcaag

SEQ ID NO: 136757 - DNA, 20 bp, Artificial Sequence
  chemically synthesized
tagatggatattttggaggc

SEQ ID NO: 136758 - DNA, 20 bp, Artificial Sequence
  chemically synthesized
tttatagatggatattttgg

SEQ ID NO: 136759 - DNA, 20 bp, Artificial Sequence
  chemically synthesized
ttttatagatggatattttg

SEQ ID NO: 136760 - DNA, 20 bp, Artificial Sequence
  chemically synthesized
aattttatagatggatattt

SEQ ID NO: 136761 - DNA, 20 bp, Artificial Sequence
  chemically synthesized
agagaacagaattttataga

SEQ ID NO: 136762 - DNA, 20 bp, Artificial Sequence
  chemically synthesized
gggcagagaacagaatttta

SEQ ID NO: 136763 - DNA, 20 bp, Artificial Sequence
  chemically synthesized
agcagattgggggcagagaa

SEQ ID NO: 136764 - DNA, 20 bp, Artificial Sequence
  chemically synthesized
ggggtagcagattgggggca

SEQ ID NO: 136765 - DNA, 20 bp, Artificial Sequence
  chemically synthesized
taggggtagcagattggggg

SEQ ID NO: 136766 - DNA, 20 bp, Artificial Sequence
  chemically synthesized
tggtaggggtagcagattgg

SEQ ID NO: 136767 - DNA, 20 bp, Artificial Sequence
  chemically synthesized
ctggtaggggtagcagattg

SEQ ID NO: 136768 - DNA, 20 bp, Artificial Sequence
  chemically synthesized
tctggtaggggtagcagatt

SEQ ID NO: 136769 - DNA, 20 bp, Artificial Sequence
  chemically synthesized
atctggtaggggtagcagat

SEQ ID NO: 136770 - DNA, 20 bp, Artificial Sequence
  chemically synthesized
gtaacatctggtaggggtag

SEQ ID NO: 136771 - DNA, 20 bp, Artificial Sequence
  chemically synthesized
ccccaatctgctacccctac

SEQ ID NO: 136772 - DNA, 20 bp, Artificial Sequence
  chemically synthesized
agagtaacatctggtagggg

SEQ ID NO: 136773 - DNA, 20 bp, Artificial Sequence
  chemically synthesized
gggagagtaacatctggtag

SEQ ID NO: 136774 - DNA, 20 bp, Artificial Sequence
  chemically synthesized
tgggagagtaacatctggta

SEQ ID NO: 136775 - DNA, 20 bp, Artificial Sequence
  chemically synthesized
ttgggagagtaacatctggt

SEQ ID NO: 136776 - DNA, 20 bp, Artificial Sequence
  chemically synthesized
tttgggagagtaacatctgg

SEQ ID NO: 136777 - DNA, 20 bp, Artificial Sequence
  chemically synthesized
atgtttgggagagtaacatc

SEQ ID NO: 136778 - DNA, 20 bp, Artificial Sequence
  chemically synthesized
taggaacagcatgtttggga

SEQ ID NO: 136779 - DNA, 20 bp, Artificial Sequence
  chemically synthesized
actaggaacagcatgtttgg

SEQ ID NO: 136780 - DNA, 20 bp, Artificial Sequence
  chemically synthesized
atactaggaacagcatgttt

SEQ ID NO: 136781 - DNA, 20 bp, Artificial Sequence
  chemically synthesized
aatactaggaacagcatgtt

SEQ ID NO: 136782 - DNA, 20 bp, Artificial Sequence
  chemically synthesized
tctcccaaacatgctgttcc

SEQ ID NO: 136783 - DNA, 20 bp, Artificial Sequence
  chemically synthesized
gatgaagataatactaggaa

SEQ ID NO: 136784 - DNA, 20 bp, Artificial Sequence
  chemically synthesized
atgaggatgaagataatact

SEQ ID NO: 136785 - DNA, 20 bp, Artificial Sequence
  chemically synthesized
tatgaggatgaagataatac

SEQ ID NO: 136786 - DNA, 20 bp, Artificial Sequence
  chemically synthesized
ccagaggtcatatgaggatg

SEQ ID NO: 136787 - DNA, 20 bp, Artificial Sequence
  chemically synthesized
aaaggaccagaggtcatatg

SEQ ID NO: 136788 - DNA, 20 bp, Artificial Sequence
  chemically synthesized
aaaaggaccagaggtcatat

SEQ ID NO: 136789 - DNA, 20 bp, Artificial Sequence
  chemically synthesized
cttcatcctcatatgacctc

SEQ ID NO: 136790 - DNA, 20 bp, Artificial Sequence
  chemically synthesized
aggaaacagaaaaggaccag

SEQ ID NO: 136791 - DNA, 20 bp, Artificial Sequence
  chemically synthesized
gaggaaacagaaaaggacca

SEQ ID NO: 136792 - DNA, 20 bp, Artificial Sequence
  chemically synthesized
ttgaggaaacagaaaaggac

SEQ ID NO: 136793 - DNA, 20 bp, Artificial Sequence
  chemically synthesized
ctaggttgaggaaacagaaa

SEQ ID NO: 136794 - DNA, 20 bp, Artificial Sequence
  chemically synthesized
gctaggttgaggaaacagaa

SEQ ID NO: 136795 - DNA, 20 bp, Artificial Sequence
  chemically synthesized
ctaaagctaggttgaggaaa

SEQ ID NO: 136796 - DNA, 20 bp, Artificial Sequence
  chemically synthesized
ccttttctgtttcctcaacc

SEQ ID NO: 136797 - DNA, 20 bp, Artificial Sequence
  chemically synthesized
ttatgactaaagctaggttg

SEQ ID NO: 136798 - DNA, 20 bp, Artificial Sequence
  chemically synthesized
gttatgactaaagctaggtt

SEQ ID NO: 136799 - DNA, 20 bp, Artificial Sequence
  chemically synthesized
ctgtttcctcaacctagctt

SEQ ID NO: 136800 - DNA, 20 bp, Artificial Sequence
  chemically synthesized
tgtttgttatgactaaagct

SEQ ID NO: 136801 - DNA, 20 bp, Artificial Sequence
  chemically synthesized
ttgtttgttatgactaaagc

SEQ ID NO: 136802 - DNA, 20 bp, Artificial Sequence
  chemically synthesized
ctacttgtttgttatgacta

SEQ ID NO: 136803 - DNA, 20 bp, Artificial Sequence
  chemically synthesized
tagctttagtcataacaaac

SEQ ID NO: 136804 - DNA, 20 bp, Artificial Sequence
  chemically synthesized
ctttagtcataacaaacaag

SEQ ID NO: 136805 - DNA, 20 bp, Artificial Sequence
  chemically synthesized
gagaaataaataagcacaat

SEQ ID NO: 136806 - DNA, 20 bp, Artificial Sequence
  chemically synthesized
atcatatcagagaaataaat

SEQ ID NO: 136807 - DNA, 20 bp, Artificial Sequence
  chemically synthesized
aaatatctgggatcatatca

SEQ ID NO: 136808 - DNA, 20 bp, Artificial Sequence
  chemically synthesized
acaaatatctgggatcatat

SEQ ID NO: 136809 - DNA, 20 bp, Artificial Sequence
  chemically synthesized
ttatttctctgatatgatcc

SEQ ID NO: 136810 - DNA, 20 bp, Artificial Sequence
  chemically synthesized
tatttgtgtcacaaatatct

SEQ ID NO: 136811 - DNA, 20 bp, Artificial Sequence
  chemically synthesized
ttatttgtgtcacaaatatc

SEQ ID NO: 136812 - DNA, 20 bp, Artificial Sequence
  chemically synthesized
tttgtgacacaaataactta

SEQ ID NO: 136813 - DNA, 20 bp, Artificial Sequence
  chemically synthesized
attttagttttgttcgcttt

SEQ ID NO: 136814 - DNA, 20 bp, Artificial Sequence
  chemically synthesized
tggtaagcatgtaatgattt

SEQ ID NO: 136815 - DNA, 20 bp, Artificial Sequence
  chemically synthesized
taaaatcattacatgcttac

SEQ ID NO: 136816 - DNA, 20 bp, Artificial Sequence
  chemically synthesized
tatcatgcttaggtactggt

SEQ ID NO: 136817 - DNA, 20 bp, Artificial Sequence
  chemically synthesized
ttacatgcttaccagtacct

SEQ ID NO: 136818 - DNA, 20 bp, Artificial Sequence
  chemically synthesized
ccattatcatgcttaggtac

SEQ ID NO: 136819 - DNA, 20 bp, Artificial Sequence
  chemically synthesized
cacgatccattatcatgctt

SEQ ID NO: 136820 - DNA, 20 bp, Artificial Sequence
  chemically synthesized
acacgatccattatcatgct

SEQ ID NO: 136821 - DNA, 20 bp, Artificial Sequence
  chemically synthesized
ccagtacctaagcatgataa

SEQ ID NO: 136822 - DNA, 20 bp, Artificial Sequence
  chemically synthesized
gataatggatcgtgtctaca

SEQ ID NO: 136823 - DNA, 20 bp, Artificial Sequence
  chemically synthesized
ctagaatgatagaatccatg

SEQ ID NO: 136824 - DNA, 20 bp, Artificial Sequence
  chemically synthesized
ctacatggattctatcattc

SEQ ID NO: 136825 - DNA, 20 bp, Artificial Sequence
  chemically synthesized
ttttgtttcctctagaatga

SEQ ID NO: 136826 - DNA, 20 bp, Artificial Sequence
  chemically synthesized
acatggattctatcattcta

SEQ ID NO: 136827 - DNA, 20 bp, Artificial Sequence
  chemically synthesized
catggattctatcattctag

SEQ ID NO: 136828 - DNA, 20 bp, Artificial Sequence
  chemically synthesized
ctcctgtgttttgtttcctc

SEQ ID NO: 136829 - DNA, 20 bp, Artificial Sequence
  chemically synthesized
attctagaggaaacaaaaca

SEQ ID NO: 136830 - DNA, 20 bp, Artificial Sequence
  chemically synthesized
ttctagaggaaacaaaacac

SEQ ID NO: 136831 - DNA, 20 bp, Artificial Sequence
  chemically synthesized
ctagaggaaacaaaacacag

SEQ ID NO: 136832 - DNA, 20 bp, Artificial Sequence
  chemically synthesized
gaggaaacaaaacacaggag

SEQ ID NO: 136833 - DNA, 20 bp, Artificial Sequence
  chemically synthesized
aggaaacaaaacacaggaga

SEQ ID NO: 136834 - DNA, 20 bp, Artificial Sequence
  chemically synthesized
aaacaaaacacaggagaagg

SEQ ID NO: 136835 - DNA, 20 bp, Artificial Sequence
  chemically synthesized
aacaaaacacaggagaagga

SEQ ID NO: 136836 - DNA, 20 bp, Artificial Sequence
  chemically synthesized
aaggaatcaatgctatttct

SEQ ID NO: 136837 - DNA, 20 bp, Artificial Sequence
  chemically synthesized
aggaatcaatgctatttcta

SEQ ID NO: 136838 - DNA, 20 bp, Artificial Sequence
  chemically synthesized
gacttatgactccttagaaa

SEQ ID NO: 136839 - DNA, 20 bp, Artificial Sequence
  chemically synthesized
gaatcaatgctatttctaag

SEQ ID NO: 136840 - DNA, 20 bp, Artificial Sequence
  chemically synthesized
gtagctgacttatgactcct

SEQ ID NO: 136841 - DNA, 20 bp, Artificial Sequence
  chemically synthesized
tgctatttctaaggagtcat

SEQ ID NO: 136842 - DNA, 20 bp, Artificial Sequence
  chemically synthesized
atttctaaggagtcataagt

SEQ ID NO: 136843 - DNA, 20 bp, Artificial Sequence
  chemically synthesized
aggagtcataagtcagctac

SEQ ID NO: 136844 - DNA, 20 bp, Artificial Sequence
  chemically synthesized
ggagtcataagtcagctact

SEQ ID NO: 136845 - DNA, 20 bp, Artificial Sequence
  chemically synthesized
cagtttttagtaaagcccag

SEQ ID NO: 136846 - DNA, 20 bp, Artificial Sequence
  chemically synthesized
aagcagtttttagtaaagcc

SEQ ID NO: 136847 - DNA, 20 bp, Artificial Sequence
  chemically synthesized
ggggtaagcagtttttagta

SEQ ID NO: 136848 - DNA, 20 bp, Artificial Sequence
  chemically synthesized
tccaaggggtaagcagtttt

SEQ ID NO: 136849 - DNA, 20 bp, Artificial Sequence
  chemically synthesized
tctcatctccaaggggtaag

SEQ ID NO: 136850 - DNA, 20 bp, Artificial Sequence
  chemically synthesized
actaaaaactgcttacccct

SEQ ID NO: 136851 - DNA, 20 bp, Artificial Sequence
  chemically synthesized
aattctcatctccaaggggt

SEQ ID NO: 136852 - DNA, 20 bp, Artificial Sequence
  chemically synthesized
taaaaactgcttaccccttg

SEQ ID NO: 136853 - DNA, 20 bp, Artificial Sequence
  chemically synthesized
gatgaattctcatctccaag

SEQ ID NO: 136854 - DNA, 20 bp, Artificial Sequence
  chemically synthesized
tgatgaattctcatctccaa

SEQ ID NO: 136855 - DNA, 20 bp, Artificial Sequence
  chemically synthesized
actgcttaccccttggagat

SEQ ID NO: 136856 - DNA, 20 bp, Artificial Sequence
  chemically synthesized
atgatgaattctcatctcca

SEQ ID NO: 136857 - DNA, 20 bp, Artificial Sequence
  chemically synthesized
catgatgaattctcatctcc

SEQ ID NO: 136858 - DNA, 20 bp, Artificial Sequence
  chemically synthesized
ttggagatgagaattcatca

SEQ ID NO: 136859 - DNA, 20 bp, Artificial Sequence
  chemically synthesized
gaattcatcatggattccac

SEQ ID NO: 136860 - DNA, 20 bp, Artificial Sequence
  chemically synthesized
catcatggattccactagct

SEQ ID NO: 136861 - DNA, 20 bp, Artificial Sequence
  chemically synthesized
ctccatctttgctcagctag

SEQ ID NO: 136862 - DNA, 20 bp, Artificial Sequence
  chemically synthesized
ttcctccatctttgctcagc

SEQ ID NO: 136863 - DNA, 20 bp, Artificial Sequence
  chemically synthesized
tggattccactagctgagca

SEQ ID NO: 136864 - DNA, 20 bp, Artificial Sequence
  chemically synthesized
ttttttcctccatctttgct

SEQ ID NO: 136865 - DNA, 20 bp, Artificial Sequence
  chemically synthesized
ttccactagctgagcaaaga

SEQ ID NO: 136866 - DNA, 20 bp, Artificial Sequence
  chemically synthesized
ccactagctgagcaaagatg

SEQ ID NO: 136867 - DNA, 20 bp, Artificial Sequence
  chemically synthesized
cactagctgagcaaagatgg

SEQ ID NO: 136868 - DNA, 20 bp, Artificial Sequence
  chemically synthesized
tctgattcactttgtatttg

SEQ ID NO: 136869 - DNA, 20 bp, Artificial Sequence
  chemically synthesized
aaaaaaattcttcaaataca

SEQ ID NO: 136870 - DNA, 20 bp, Artificial Sequence
  chemically synthesized
tcttcaaatacaaagtgaat

SEQ ID NO: 136871 - DNA, 20 bp, Artificial Sequence
  chemically synthesized
tcaaatacaaagtgaatcag

SEQ ID NO: 136872 - DNA, 20 bp, Artificial Sequence
  chemically synthesized
ggggggacttagtgagatta

SEQ ID NO: 136873 - DNA, 20 bp, Artificial Sequence
  chemically synthesized
cagaagtctttaatctcact

SEQ ID NO: 136874 - DNA, 20 bp, Artificial Sequence
  chemically synthesized
caactctggggggacttagt

SEQ ID NO: 136875 - DNA, 20 bp, Artificial Sequence
  chemically synthesized
cactcaactctggggggact

SEQ ID NO: 136876 - DNA, 20 bp, Artificial Sequence
  chemically synthesized
ttaatctcactaagtccccc

SEQ ID NO: 136877 - DNA, 20 bp, Artificial Sequence
  chemically synthesized
aatctcactaagtcccccca

SEQ ID NO: 136878 - DNA, 20 bp, Artificial Sequence
  chemically synthesized
ccacttcactcaactctggg

SEQ ID NO: 136879 - DNA, 20 bp, Artificial Sequence
  chemically synthesized
accacttcactcaactctgg

SEQ ID NO: 136880 - DNA, 20 bp, Artificial Sequence
  chemically synthesized
cactaagtccccccagagtt

SEQ ID NO: 136881 - DNA, 20 bp, Artificial Sequence
  chemically synthesized
aaccacttcactcaactctg

SEQ ID NO: 136882 - DNA, 20 bp, Artificial Sequence
  chemically synthesized
taaccacttcactcaactct

SEQ ID NO: 136883 - DNA, 20 bp, Artificial Sequence
  chemically synthesized
ataaccacttcactcaactc

SEQ ID NO: 136884 - DNA, 20 bp, Artificial Sequence
  chemically synthesized
agtccccccagagttgagtg

SEQ ID NO: 136885 - DNA, 20 bp, Artificial Sequence
  chemically synthesized
ccccccagagttgagtgaag

SEQ ID NO: 136886 - DNA, 20 bp, Artificial Sequence
  chemically synthesized
ttgagtgaagtggttataaa

SEQ ID NO: 136887 - DNA, 20 bp, Artificial Sequence
  chemically synthesized
taaatagcaaccctatgaaa

SEQ ID NO: 136888 - DNA, 20 bp, Artificial Sequence
  chemically synthesized
gtttaacttcctatttcata

SEQ ID NO: 136889 - DNA, 20 bp, Artificial Sequence
  chemically synthesized
aaatagcaaccctatgaaat

SEQ ID NO: 136890 - DNA, 20 bp, Artificial Sequence
  chemically synthesized
tgtttaacttcctatttcat

SEQ ID NO: 136891 - DNA, 20 bp, Artificial Sequence
  chemically synthesized
ctgtttaacttcctatttca

SEQ ID NO: 136892 - DNA, 20 bp, Artificial Sequence
  chemically synthesized
tagcaaccctatgaaatagg

SEQ ID NO: 136893 - DNA, 20 bp, Artificial Sequence
  chemically synthesized
ctatgaaataggaagttaaa

SEQ ID NO: 136894 - DNA, 20 bp, Artificial Sequence
  chemically synthesized
gaaatcatacatattataac

SEQ ID NO: 136895 - DNA, 20 bp, Artificial Sequence
  chemically synthesized
aaatcatacatattataact

SEQ ID NO: 136896 - DNA, 20 bp, Artificial Sequence
  chemically synthesized
aatcatacatattataacta

SEQ ID NO: 136897 - DNA, 20 bp, Artificial Sequence
  chemically synthesized
tctaaaagcctaaaatgccc

SEQ ID NO: 136898 - DNA, 20 bp, Artificial Sequence
  chemically synthesized
atattataactagggcattt

SEQ ID NO: 136899 - DNA, 20 bp, Artificial Sequence
  chemically synthesized
tattataactagggcatttt

SEQ ID NO: 136900 - DNA, 20 bp, Artificial Sequence
  chemically synthesized
actagggcattttaggcttt

SEQ ID NO: 136901 - DNA, 20 bp, Artificial Sequence
  chemically synthesized
aaaattgtaattttgtctaa

SEQ ID NO: 136902 - DNA, 20 bp, Artificial Sequence
  chemically synthesized
ttttattgtattcattaaaa

SEQ ID NO: 136903 - DNA, 20 bp, Artificial Sequence
  chemically synthesized
ttatttgagtattatttagg

SEQ ID NO: 136904 - DNA, 20 bp, Artificial Sequence
  chemically synthesized
tttttatttgagtattattt

SEQ ID NO: 136905 - DNA, 20 bp, Artificial Sequence
  chemically synthesized
gtttttatttgagtattatt

SEQ ID NO: 136906 - DNA, 20 bp, Artificial Sequence
  chemically synthesized
aacatatagagtttttattt

SEQ ID NO: 136907 - DNA, 20 bp, Artificial Sequence
  chemically synthesized
agcattcaactcaacatata

SEQ ID NO: 136908 - DNA, 20 bp, Artificial Sequence
  chemically synthesized
aaataaaaactctatatgtt

SEQ ID NO: 136909 - DNA, 20 bp, Artificial Sequence
  chemically synthesized
taagcattcaactcaacata

SEQ ID NO: 136910 - DNA, 20 bp, Artificial Sequence
  chemically synthesized
tatatgttgagttgaatgct

SEQ ID NO: 136911 - DNA, 20 bp, Artificial Sequence
  chemically synthesized
ttcttagacatgtaaatact

SEQ ID NO: 136912 - DNA, 20 bp, Artificial Sequence
  chemically synthesized
tgcttagtatttacatgtct

SEQ ID NO: 136913 - DNA, 20 bp, Artificial Sequence
  chemically synthesized
agtatttacatgtctaagaa

SEQ ID NO: 136914 - DNA, 20 bp, Artificial Sequence
  chemically synthesized
tgattttcaaagtcttttct

SEQ ID NO: 136915 - DNA, 20 bp, Artificial Sequence
  chemically synthesized
tatgaccagtttgattttca

SEQ ID NO: 136916 - DNA, 20 bp, Artificial Sequence
  chemically synthesized
aaagactttgaaaatcaaac

SEQ ID NO: 136917 - DNA, 20 bp, Artificial Sequence
  chemically synthesized
gaaaaatataaaaatatgac

SEQ ID NO: 136918 - DNA, 20 bp, Artificial Sequence
  chemically synthesized
atgtagattgttgattttta

SEQ ID NO: 136919 - DNA, 20 bp, Artificial Sequence
  chemically synthesized
ataaaaatcaacaatctaca

SEQ ID NO: 136920 - DNA, 20 bp, Artificial Sequence
  chemically synthesized
tcatgggcatttatgctatg

SEQ ID NO: 136921 - DNA, 20 bp, Artificial Sequence
  chemically synthesized
aacatttgaaaaatcatcat

SEQ ID NO: 136922 - DNA, 20 bp, Artificial Sequence
  chemically synthesized
gaacatttgaaaaatcatca

SEQ ID NO: 136923 - DNA, 20 bp, Artificial Sequence
  chemically synthesized
ttttcaaatgttcccatttt

SEQ ID NO: 136924 - DNA, 20 bp, Artificial Sequence
  chemically synthesized
catattcatttactgaaaat

SEQ ID NO: 136925 - DNA, 20 bp, Artificial Sequence
  chemically synthesized
tcatattcatttactgaaaa

SEQ ID NO: 136926 - DNA, 20 bp, Artificial Sequence
  chemically synthesized
tcagtaaatgaatatgaatt

SEQ ID NO: 136927 - DNA, 20 bp, Artificial Sequence
  chemically synthesized
agttctacattgttacattt

SEQ ID NO: 136928 - DNA, 20 bp, Artificial Sequence
  chemically synthesized
taagctgaaatgtaacaatg

SEQ ID NO: 136929 - DNA, 20 bp, Artificial Sequence
  chemically synthesized
agttgtaaataaaatagcat

SEQ ID NO: 136930 - DNA, 20 bp, Artificial Sequence
  chemically synthesized
ttttgaagttgtaaataaaa

SEQ ID NO: 136931 - DNA, 20 bp, Artificial Sequence
  chemically synthesized
ttctttatattaattttttg

SEQ ID NO: 136932 - DNA, 20 bp, Artificial Sequence
  chemically synthesized
aacttcaaaaaattaatata

SEQ ID NO: 136933 - DNA, 20 bp, Artificial Sequence
  chemically synthesized
aaaaattaatataaagaatt

SEQ ID NO: 136934 - DNA, 20 bp, Artificial Sequence
  chemically synthesized
aattaatataaagaattcag

SEQ ID NO: 136935 - DNA, 20 bp, Artificial Sequence
  chemically synthesized
attaatataaagaattcaga

SEQ ID NO: 136936 - DNA, 20 bp, Artificial Sequence
  chemically synthesized
ataaagaattcagaaggtaa

SEQ ID NO: 136937 - DNA, 20 bp, Artificial Sequence
  chemically synthesized
aaagaattcagaaggtaaaa

SEQ ID NO: 136938 - DNA, 20 bp, Artificial Sequence
  chemically synthesized
tcagaaggtaaaagagttta

SEQ ID NO: 136939 - DNA, 20 bp, Artificial Sequence
  chemically synthesized
attttcttcaatacataaaa

SEQ ID NO: 136940 - DNA, 20 bp, Artificial Sequence
  chemically synthesized
cggaaccattttatgtattg

SEQ ID NO: 136941 - DNA, 20 bp, Artificial Sequence
  chemically synthesized
ttttatgtattgaagaaaat

SEQ ID NO: 136942 - DNA, 20 bp, Artificial Sequence
  chemically synthesized
tgtattgaagaaaataagca

SEQ ID NO: 136943 - DNA, 20 bp, Artificial Sequence
  chemically synthesized
attgaagaaaataagcatag

SEQ ID NO: 136944 - DNA, 20 bp, Artificial Sequence
  chemically synthesized
aagaaaataagcatagaagt

SEQ ID NO: 136945 - DNA, 20 bp, Artificial Sequence
  chemically synthesized
agaaaataagcatagaagtc

SEQ ID NO: 136946 - DNA, 20 bp, Artificial Sequence
  chemically synthesized
aaataagcatagaagtcagg

SEQ ID NO: 136947 - DNA, 20 bp, Artificial Sequence
  chemically synthesized
aataagcatagaagtcagga

SEQ ID NO: 136948 - DNA, 20 bp, Artificial Sequence
  chemically synthesized
gtcaggaaggtactaaattg

SEQ ID NO: 136949 - DNA, 20 bp, Artificial Sequence
  chemically synthesized
taactagaaaggctacaatt

SEQ ID NO: 136950 - DNA, 20 bp, Artificial Sequence
  chemically synthesized
gtactaaattgtagcctttc

SEQ ID NO: 136951 - DNA, 20 bp, Artificial Sequence
  chemically synthesized
aaccctttcggtaactagaa

SEQ ID NO: 136952 - DNA, 20 bp, Artificial Sequence
  chemically synthesized
aaaccctttcggtaactaga

SEQ ID NO: 136953 - DNA, 20 bp, Artificial Sequence
  chemically synthesized
agtaaaaccctttcggtaac

SEQ ID NO: 136954 - DNA, 20 bp, Artificial Sequence
  chemically synthesized
gtagcctttctagttaccga

SEQ ID NO: 136955 - DNA, 20 bp, Artificial Sequence
  chemically synthesized
tagcctttctagttaccgaa

SEQ ID NO: 136956 - DNA, 20 bp, Artificial Sequence
  chemically synthesized
agcctttctagttaccgaaa

SEQ ID NO: 136957 - DNA, 20 bp, Artificial Sequence
  chemically synthesized
cctcaccagtaaaacccttt

SEQ ID NO: 136958 - DNA, 20 bp, Artificial Sequence
  chemically synthesized
agttaccgaaagggttttac

SEQ ID NO: 136959 - DNA, 20 bp, Artificial Sequence
  chemically synthesized
accgaaagggttttactggt

SEQ ID NO: 136960 - DNA, 20 bp, Artificial Sequence
  chemically synthesized
ccgaaagggttttactggtg

SEQ ID NO: 136961 - DNA, 20 bp, Artificial Sequence
  chemically synthesized
atagattacagcatcctcac

SEQ ID NO: 136962 - DNA, 20 bp, Artificial Sequence
  chemically synthesized
gttgaaagctagatagatta

SEQ ID NO: 136963 - DNA, 20 bp, Artificial Sequence
  chemically synthesized
tgaggatgctgtaatctatc

SEQ ID NO: 136964 - DNA, 20 bp, Artificial Sequence
  chemically synthesized
tgagatggttgaaagctaga

SEQ ID NO: 136965 - DNA, 20 bp, Artificial Sequence
  chemically synthesized
tcagtgagatggttgaaagc

SEQ ID NO: 136966 - DNA, 20 bp, Artificial Sequence
  chemically synthesized
atgctcagtgagatggttga

SEQ ID NO: 136967 - DNA, 20 bp, Artificial Sequence
  chemically synthesized
tagctttcaaccatctcact

SEQ ID NO: 136968 - DNA, 20 bp, Artificial Sequence
  chemically synthesized
gaagaagatgctcagtgaga

SEQ ID NO: 136969 - DNA, 20 bp, Artificial Sequence
  chemically synthesized
gccagaagaagatgctcagt

SEQ ID NO: 136970 - DNA, 20 bp, Artificial Sequence
  chemically synthesized
agaagccagaagaagatgct

SEQ ID NO: 136971 - DNA, 20 bp, Artificial Sequence
  chemically synthesized
tctcactgagcatcttcttc

SEQ ID NO: 136972 - DNA, 20 bp, Artificial Sequence
  chemically synthesized
gcaagaatagaagccagaag

SEQ ID NO: 136973 - DNA, 20 bp, Artificial Sequence
  chemically synthesized
aatgcaagaatagaagccag

SEQ ID NO: 136974 - DNA, 20 bp, Artificial Sequence
  chemically synthesized
ccgaatgcaagaatagaagc

SEQ ID NO: 136975 - DNA, 20 bp, Artificial Sequence
  chemically synthesized
gcagccgaatgcaagaatag

SEQ ID NO: 136976 - DNA, 20 bp, Artificial Sequence
  chemically synthesized
gaggcagccgaatgcaagaa

SEQ ID NO: 136977 - DNA, 20 bp, Artificial Sequence
  chemically synthesized
ctggcttctattcttgcatt

SEQ ID NO: 136978 - DNA, 20 bp, Artificial Sequence
  chemically synthesized
ttggagaggcagccgaatgc

SEQ ID NO: 136979 - DNA, 20 bp, Artificial Sequence
  chemically synthesized
ggccactctatttggagagg

SEQ ID NO: 136980 - DNA, 20 bp, Artificial Sequence
  chemically synthesized
cattcggctgcctctccaaa

SEQ ID NO: 136981 - DNA, 20 bp, Artificial Sequence
  chemically synthesized
tttggccactctatttggag

SEQ ID NO: 136982 - DNA, 20 bp, Artificial Sequence
  chemically synthesized
atttggccactctatttgga

SEQ ID NO: 136983 - DNA, 20 bp, Artificial Sequence
  chemically synthesized
ttcggctgcctctccaaata

SEQ ID NO: 136984 - DNA, 20 bp, Artificial Sequence
  chemically synthesized
cgatttggccactctatttg

SEQ ID NO: 136985 - DNA, 20 bp, Artificial Sequence
  chemically synthesized
ggctgcctctccaaatagag

SEQ ID NO: 136986 - DNA, 20 bp, Artificial Sequence
  chemically synthesized
ttcgatttggccactctatt

SEQ ID NO: 136987 - DNA, 20 bp, Artificial Sequence
  chemically synthesized
aatgaggatggttttcgatt

SEQ ID NO: 136988 - DNA, 20 bp, Artificial Sequence
  chemically synthesized
taagtggaagacaatgagga

SEQ ID NO: 136989 - DNA, 20 bp, Artificial Sequence
  chemically synthesized
gaagtaagtggaagacaatg

SEQ ID NO: 136990 - DNA, 20 bp, Artificial Sequence
  chemically synthesized
ggaagtaagtggaagacaat

SEQ ID NO: 136991 - DNA, 20 bp, Artificial Sequence
  chemically synthesized
agaagtgaggaagtaagtgg

SEQ ID NO: 136992 - DNA, 20 bp, Artificial Sequence
  chemically synthesized
atgagaagtgaggaagtaag

SEQ ID NO: 136993 - DNA, 20 bp, Artificial Sequence
  chemically synthesized
gaaatgagaagtgaggaagt

SEQ ID NO: 136994 - DNA, 20 bp, Artificial Sequence
  chemically synthesized
aatggaaatgagaagtgagg

SEQ ID NO: 136995 - DNA, 20 bp, Artificial Sequence
  chemically synthesized
taaaatggaaatgagaagtg

SEQ ID NO: 136996 - DNA, 20 bp, Artificial Sequence
  chemically synthesized
ataaaatggaaatgagaagt

SEQ ID NO: 136997 - DNA, 20 bp, Artificial Sequence
  chemically synthesized
cagtataaaatggaaatgag

SEQ ID NO: 136998 - DNA, 20 bp, Artificial Sequence
  chemically synthesized
agccagtataaaatggaaat

SEQ ID NO: 136999 - DNA, 20 bp, Artificial Sequence
  chemically synthesized
atatccaagccagtataaaa

SEQ ID NO: 137000 - DNA, 20 bp, Artificial Sequence
  chemically synthesized
ttctcatttccattttatac

SEQ ID NO: 137001 - DNA, 20 bp, Artificial Sequence
  chemically synthesized
atttccattttatactggct

SEQ ID NO: 137002 - DNA, 20 bp, Artificial Sequence
  chemically synthesized
gaaaatatcaatatccaagc

SEQ ID NO: 137003 - DNA, 20 bp, Artificial Sequence
  chemically synthesized
gtaggaaaatatcaatatcc

SEQ ID NO: 137004 - DNA, 20 bp, Artificial Sequence
  chemically synthesized
gatattgatattttcctact

SEQ ID NO: 137005 - DNA, 20 bp, Artificial Sequence
  chemically synthesized
gtagggaaggttgaccaagt

SEQ ID NO: 137006 - DNA, 20 bp, Artificial Sequence
  chemically synthesized
agtagggaaggttgaccaag

SEQ ID NO: 137007 - DNA, 20 bp, Artificial Sequence
  chemically synthesized
agaagtagggaaggttgacc

SEQ ID NO: 137008 - DNA, 20 bp, Artificial Sequence
  chemically synthesized
attcaaaaaagaagtaggga

SEQ ID NO: 137009 - DNA, 20 bp, Artificial Sequence
  chemically synthesized
cattcaaaaaagaagtaggg

SEQ ID NO: 137010 - DNA, 20 bp, Artificial Sequence
  chemically synthesized
gaacattcaaaaaagaagta

SEQ ID NO: 137011 - DNA, 20 bp, Artificial Sequence
  chemically synthesized
agaacattcaaaaaagaagt

SEQ ID NO: 137012 - DNA, 20 bp, Artificial Sequence
  chemically synthesized
tagaacattcaaaaaagaag

SEQ ID NO: 137013 - DNA, 20 bp, Artificial Sequence
  chemically synthesized
tagtagaacattcaaaaaag

SEQ ID NO: 137014 - DNA, 20 bp, Artificial Sequence
  chemically synthesized
tgctagtagaacattcaaaa

SEQ ID NO: 137015 - DNA, 20 bp, Artificial Sequence
  chemically synthesized
ttcttttttgaatgttctac

SEQ ID NO: 137016 - DNA, 20 bp, Artificial Sequence
  chemically synthesized
gttaccgatggaggtgctag

SEQ ID NO: 137017 - DNA, 20 bp, Artificial Sequence
  chemically synthesized
gaagttaccgatggaggtgc

SEQ ID NO: 137018 - DNA, 20 bp, Artificial Sequence
  chemically synthesized
tgttctactagcacctccat

SEQ ID NO: 137019 - DNA, 20 bp, Artificial Sequence
  chemically synthesized
tcttaagaagttaccgatgg

SEQ ID NO: 137020 - DNA, 20 bp, Artificial Sequence
  chemically synthesized
ttcttaagaagttaccgatg

SEQ ID NO: 137021 - DNA, 20 bp, Artificial Sequence
  chemically synthesized
gattcttaagaagttaccga

SEQ ID NO: 137022 - DNA, 20 bp, Artificial Sequence
  chemically synthesized
acctccatcggtaacttctt

SEQ ID NO: 137023 - DNA, 20 bp, Artificial Sequence
  chemically synthesized
tggttatgaagattcttaag

SEQ ID NO: 137024 - DNA, 20 bp, Artificial Sequence
  chemically synthesized
agttggttatgaagattctt

SEQ ID NO: 137025 - DNA, 20 bp, Artificial Sequence
  chemically synthesized
tatttatgaagttggttatg

SEQ ID NO: 137026 - DNA, 20 bp, Artificial Sequence
  chemically synthesized
ttggaagatatttatgaagt

SEQ ID NO: 137027 - DNA, 20 bp, Artificial Sequence
  chemically synthesized
gcagttggaagatatttatg

SEQ ID NO: 137028 - DNA, 20 bp, Artificial Sequence
  chemically synthesized
tcataaatatcttccaactg

SEQ ID NO: 137029 - DNA, 20 bp, Artificial Sequence
  chemically synthesized
aaaaggctaactgcagttgg

SEQ ID NO: 137030 - DNA, 20 bp, Artificial Sequence
  chemically synthesized
caaaaaaggctaactgcagt

SEQ ID NO: 137031 - DNA, 20 bp, Artificial Sequence
  chemically synthesized
aaatatcttccaactgcagt

SEQ ID NO: 137032 - DNA, 20 bp, Artificial Sequence
  chemically synthesized
agaacaaaaaaggctaactg

SEQ ID NO: 137033 - DNA, 20 bp, Artificial Sequence
  chemically synthesized
cagtgaataaagaacaaaaa

SEQ ID NO: 137034 - DNA, 20 bp, Artificial Sequence
  chemically synthesized
tcagtgaataaagaacaaaa

SEQ ID NO: 137035 - DNA, 20 bp, Artificial Sequence
  chemically synthesized
aagtatttattcagtgaata

SEQ ID NO: 137036 - DNA, 20 bp, Artificial Sequence
  chemically synthesized
catcttataaagtatttatt

SEQ ID NO: 137037 - DNA, 20 bp, Artificial Sequence
  chemically synthesized
tcactgaataaatactttat

SEQ ID NO: 137038 - DNA, 20 bp, Artificial Sequence
  chemically synthesized
aaaataaaatgcatcttata

SEQ ID NO: 137039 - DNA, 20 bp, Artificial Sequence
  chemically synthesized
ttttatttttatataatttc

SEQ ID NO: 137040 - DNA, 20 bp, Artificial Sequence
  chemically synthesized
tttatataatttcaagcttg

SEQ ID NO: 137041 - DNA, 20 bp, Artificial Sequence
  chemically synthesized
ttatcttgcaaatattctgc

SEQ ID NO: 137042 - DNA, 20 bp, Artificial Sequence
  chemically synthesized
caagcttgcagaatatttgc

SEQ ID NO: 137043 - DNA, 20 bp, Artificial Sequence
  chemically synthesized
tgcagaatatttgcaagata

SEQ ID NO: 137044 - DNA, 20 bp, Artificial Sequence
  chemically synthesized
tttgcaagataaagaactcc

SEQ ID NO: 137045 - DNA, 20 bp, Artificial Sequence
  chemically synthesized
ttgcaagataaagaactccc

SEQ ID NO: 137046 - DNA, 20 bp, Artificial Sequence
  chemically synthesized
tccgggcaagggttacctgg

SEQ ID NO: 137047 - DNA, 20 bp, Artificial Sequence
  chemically synthesized
aatccgggcaagggttacct

SEQ ID NO: 137048 - DNA, 20 bp, Artificial Sequence
  chemically synthesized
gaatccgggcaagggttacc

SEQ ID NO: 137049 - DNA, 20 bp, Artificial Sequence
  chemically synthesized
actcccaggtaacccttgcc

SEQ ID NO: 137050 - DNA, 20 bp, Artificial Sequence
  chemically synthesized
caaatggtgaatccgggcaa

SEQ ID NO: 137051 - DNA, 20 bp, Artificial Sequence
  chemically synthesized
acaaatggtgaatccgggca

SEQ ID NO: 137052 - DNA, 20 bp, Artificial Sequence
  chemically synthesized
aacaaatggtgaatccgggc

SEQ ID NO: 137053 - DNA, 20 bp, Artificial Sequence
  chemically synthesized
tgttaacaaatggtgaatcc

SEQ ID NO: 137054 - DNA, 20 bp, Artificial Sequence
  chemically synthesized
atgttaacaaatggtgaatc

SEQ ID NO: 137055 - DNA, 20 bp, Artificial Sequence
  chemically synthesized
tgtggcaaaatgttaacaaa

SEQ ID NO: 137056 - DNA, 20 bp, Artificial Sequence
  chemically synthesized
ataaataattaaaaataatg

SEQ ID NO: 137057 - DNA, 20 bp, Artificial Sequence
  chemically synthesized
tatatatctatacacacaga

SEQ ID NO: 137058 - DNA, 20 bp, Artificial Sequence
  chemically synthesized
gttatatatctatacacaca

SEQ ID NO: 137059 - DNA, 20 bp, Artificial Sequence
  chemically synthesized
tatcattctctctgtgtgta

SEQ ID NO: 137060 - DNA, 20 bp, Artificial Sequence
  chemically synthesized
cagttatatatctatacaca

SEQ ID NO: 137061 - DNA, 20 bp, Artificial Sequence
  chemically synthesized
tatataaaacattacatata

SEQ ID NO: 137062 - DNA, 20 bp, Artificial Sequence
  chemically synthesized
caaattattctcaaatgatt

SEQ ID NO: 137063 - DNA, 20 bp, Artificial Sequence
  chemically synthesized
attttttttctgaatcattt

SEQ ID NO: 137064 - DNA, 20 bp, Artificial Sequence
  chemically synthesized
aatcatttgagaataatttg

SEQ ID NO: 137065 - DNA, 20 bp, Artificial Sequence
  chemically synthesized
taaagtatttaagggtaaag

SEQ ID NO: 137066 - DNA, 20 bp, Artificial Sequence
  chemically synthesized
ctaaagtatttaagggtaaa

SEQ ID NO: 137067 - DNA, 20 bp, Artificial Sequence
  chemically synthesized
cctaaagtatttaagggtaa

SEQ ID NO: 137068 - DNA, 20 bp, Artificial Sequence
  chemically synthesized
acctaaagtatttaagggta

SEQ ID NO: 137069 - DNA, 20 bp, Artificial Sequence
  chemically synthesized
ataaaacctaaagtatttaa

SEQ ID NO: 137070 - DNA, 20 bp, Artificial Sequence
  chemically synthesized
aataaaacctaaagtattta

SEQ ID NO: 137071 - DNA, 20 bp, Artificial Sequence
  chemically synthesized
aaataaaacctaaagtattt

SEQ ID NO: 137072 - DNA, 20 bp, Artificial Sequence
  chemically synthesized
ccctttacccttaaatactt

SEQ ID NO: 137073 - DNA, 20 bp, Artificial Sequence
  chemically synthesized
cctttacccttaaatacttt

SEQ ID NO: 137074 - DNA, 20 bp, Artificial Sequence
  chemically synthesized
ctattaagaaataaaaccta

SEQ ID NO: 137075 - DNA, 20 bp, Artificial Sequence
  chemically synthesized
ctttaggttttatttcttaa

SEQ ID NO: 137076 - DNA, 20 bp, Artificial Sequence
  chemically synthesized
ggttttatttcttaatagca

SEQ ID NO: 137077 - DNA, 20 bp, Artificial Sequence
  chemically synthesized
aagagaatgtctttgctatt

SEQ ID NO: 137078 - DNA, 20 bp, Artificial Sequence
  chemically synthesized
actgagctgaggttatttaa

SEQ ID NO: 137079 - DNA, 20 bp, Artificial Sequence
  chemically synthesized
aaactgagctgaggttattt

SEQ ID NO: 137080 - DNA, 20 bp, Artificial Sequence
  chemically synthesized
gacattctcttaaataacct

SEQ ID NO: 137081 - DNA, 20 bp, Artificial Sequence
  chemically synthesized
tctcttaaataacctcagct

SEQ ID NO: 137082 - DNA, 20 bp, Artificial Sequence
  chemically synthesized
ctgactttgaaactgagctg

SEQ ID NO: 137083 - DNA, 20 bp, Artificial Sequence
  chemically synthesized
cctgactttgaaactgagct

SEQ ID NO: 137084 - DNA, 20 bp, Artificial Sequence
  chemically synthesized
ataacctcagctcagtttca

SEQ ID NO: 137085 - DNA, 20 bp, Artificial Sequence
  chemically synthesized
aatttcctgactttgaaact

SEQ ID NO: 137086 - DNA, 20 bp, Artificial Sequence
  chemically synthesized
cctcagctcagtttcaaagt

SEQ ID NO: 137087 - DNA, 20 bp, Artificial Sequence
  chemically synthesized
ctcagctcagtttcaaagtc

SEQ ID NO: 137088 - DNA, 20 bp, Artificial Sequence
  chemically synthesized
agtttcaaagtcaggaaatt

SEQ ID NO: 137089 - DNA, 20 bp, Artificial Sequence
  chemically synthesized
caaagtcaggaaatttagcg

SEQ ID NO: 137090 - DNA, 20 bp, Artificial Sequence
  chemically synthesized
caggaaatttagcgtggctt

SEQ ID NO: 137091 - DNA, 20 bp, Artificial Sequence
  chemically synthesized
tggataagattatggtacta

SEQ ID NO: 137092 - DNA, 20 bp, Artificial Sequence
  chemically synthesized
atagagtatggataagatta

SEQ ID NO: 137093 - DNA, 20 bp, Artificial Sequence
  chemically synthesized
tctgaatatagagtatggat

SEQ ID NO: 137094 - DNA, 20 bp, Artificial Sequence
  chemically synthesized
catactctgaatatagagta

SEQ ID NO: 137095 - DNA, 20 bp, Artificial Sequence
  chemically synthesized
tcttatccatactctatatt

SEQ ID NO: 137096 - DNA, 20 bp, Artificial Sequence
  chemically synthesized
attgtcatactctgaatata

SEQ ID NO: 137097 - DNA, 20 bp, Artificial Sequence
  chemically synthesized
ttatccatactctatattca

SEQ ID NO: 137098 - DNA, 20 bp, Artificial Sequence
  chemically synthesized
taattgtcatactctgaata

SEQ ID NO: 137099 - DNA, 20 bp, Artificial Sequence
  chemically synthesized
agctataaagttcattaatg

SEQ ID NO: 137100 - DNA, 20 bp, Artificial Sequence
  chemically synthesized
tagctataaagttcattaat

SEQ ID NO: 137101 - DNA, 20 bp, Artificial Sequence
  chemically synthesized
atagctataaagttcattaa

SEQ ID NO: 137102 - DNA, 20 bp, Artificial Sequence
  chemically synthesized
taccccattaatgaacttta

SEQ ID NO: 137103 - DNA, 20 bp, Artificial Sequence
  chemically synthesized
gaaataaaaatatagctata

SEQ ID NO: 137104 - DNA, 20 bp, Artificial Sequence
  chemically synthesized
cagaccaggaaataaaaata

SEQ ID NO: 137105 - DNA, 20 bp, Artificial Sequence
  chemically synthesized
atagctatatttttatttcc

SEQ ID NO: 137106 - DNA, 20 bp, Artificial Sequence
  chemically synthesized
tatatttttatttcctggtc

SEQ ID NO: 137107 - DNA, 20 bp, Artificial Sequence
  chemically synthesized
gcgtgagtctggaccagacc

SEQ ID NO: 137108 - DNA, 20 bp, Artificial Sequence
  chemically synthesized
tgcgtgagtctggaccagac

SEQ ID NO: 137109 - DNA, 20 bp, Artificial Sequence
  chemically synthesized
ttttatttcctggtctggtc

SEQ ID NO: 137110 - DNA, 20 bp, Artificial Sequence
  chemically synthesized
agcaatgcgtgagtctggac

SEQ ID NO: 137111 - DNA, 20 bp, Artificial Sequence
  chemically synthesized
ctaaaagcaatgcgtgagtc

SEQ ID NO: 137112 - DNA, 20 bp, Artificial Sequence
  chemically synthesized
gacaactaaaagcaatgcgt

SEQ ID NO: 137113 - DNA, 20 bp, Artificial Sequence
  chemically synthesized
ccagactcacgcattgcttt

SEQ ID NO: 137114 - DNA, 20 bp, Artificial Sequence
  chemically synthesized
taaggagatacgacaactaa

SEQ ID NO: 137115 - DNA, 20 bp, Artificial Sequence
  chemically synthesized
ttttagttgtcgtatctcct

SEQ ID NO: 137116 - DNA, 20 bp, Artificial Sequence
  chemically synthesized
tcaacttaaaaaagactaag

SEQ ID NO: 137117 - DNA, 20 bp, Artificial Sequence
  chemically synthesized
tttcaacttaaaaaagacta

SEQ ID NO: 137118 - DNA, 20 bp, Artificial Sequence
  chemically synthesized
atttcaacttaaaaaagact

SEQ ID NO: 137119 - DNA, 20 bp, Artificial Sequence
  chemically synthesized
gtatctccttagtctttttt

SEQ ID NO: 137120 - DNA, 20 bp, Artificial Sequence
  chemically synthesized
ataactatttcaacttaaaa

SEQ ID NO: 137121 - DNA, 20 bp, Artificial Sequence
  chemically synthesized
tagtcttttttaagttgaaa

SEQ ID NO: 137122 - DNA, 20 bp, Artificial Sequence
  chemically synthesized
gtgttataaagttcaaagaa

SEQ ID NO: 137123 - DNA, 20 bp, Artificial Sequence
  chemically synthesized
agtgttataaagttcaaaga

SEQ ID NO: 137124 - DNA, 20 bp, Artificial Sequence
  chemically synthesized
tgtaagtgttataaagttca

SEQ ID NO: 137125 - DNA, 20 bp, Artificial Sequence
  chemically synthesized
tcaaaactgtaagtgttata

SEQ ID NO: 137126 - DNA, 20 bp, Artificial Sequence
  chemically synthesized
tttgaactttataacactta

SEQ ID NO: 137127 - DNA, 20 bp, Artificial Sequence
  chemically synthesized
cctctgttggtcaaaactgt

SEQ ID NO: 137128 - DNA, 20 bp, Artificial Sequence
  chemically synthesized
acacttacagttttgaccaa

SEQ ID NO: 137129 - DNA, 20 bp, Artificial Sequence
  chemically synthesized
acttacagttttgaccaaca

SEQ ID NO: 137130 - DNA, 20 bp, Artificial Sequence
  chemically synthesized
cttacagttttgaccaacag

SEQ ID NO: 137131 - DNA, 20 bp, Artificial Sequence
  chemically synthesized
acaaaatacctggcctctgt

SEQ ID NO: 137132 - DNA, 20 bp, Artificial Sequence
  chemically synthesized
cagttttgaccaacagaggc

SEQ ID NO: 137133 - DNA, 20 bp, Artificial Sequence
  chemically synthesized
agttttgaccaacagaggcc

SEQ ID NO: 137134 - DNA, 20 bp, Artificial Sequence
  chemically synthesized
gggatattctacaaaatacc

SEQ ID NO: 137135 - DNA, 20 bp, Artificial Sequence
  chemically synthesized
aacagaggccaggtattttg

SEQ ID NO: 137136 - DNA, 20 bp, Artificial Sequence
  chemically synthesized
ttgctataactcaaatttgg

SEQ ID NO: 137137 - DNA, 20 bp, Artificial Sequence
  chemically synthesized
gtagaatatcccccaaattt

SEQ ID NO: 137138 - DNA, 20 bp, Artificial Sequence
  chemically synthesized
attgctataactcaaatttg

SEQ ID NO: 137139 - DNA, 20 bp, Artificial Sequence
  chemically synthesized
aattgctataactcaaattt

SEQ ID NO: 137140 - DNA, 20 bp, Artificial Sequence
  chemically synthesized
aaattgctataactcaaatt

SEQ ID NO: 137141 - DNA, 20 bp, Artificial Sequence
  chemically synthesized
tatcccccaaatttgagtta

SEQ ID NO: 137142 - DNA, 20 bp, Artificial Sequence
  chemically synthesized
ttgagttatagcaatttttt

SEQ ID NO: 137143 - DNA, 20 bp, Artificial Sequence
  chemically synthesized
ctcaatgagtgacacaacag

SEQ ID NO: 137144 - DNA, 20 bp, Artificial Sequence
  chemically synthesized
tagctcaatgagtgacacaa

SEQ ID NO: 137145 - DNA, 20 bp, Artificial Sequence
  chemically synthesized
cttctgttgtgtcactcatt

SEQ ID NO: 137146 - DNA, 20 bp, Artificial Sequence
  chemically synthesized
tgttgtgtcactcattgagc

SEQ ID NO: 137147 - DNA, 20 bp, Artificial Sequence
  chemically synthesized
gcccctgcacctagctcaat

SEQ ID NO: 137148 - DNA, 20 bp, Artificial Sequence
  chemically synthesized
gttgtgtcactcattgagct

SEQ ID NO: 137149 - DNA, 20 bp, Artificial Sequence
  chemically synthesized
gtcactcattgagctaggtg

SEQ ID NO: 137150 - DNA, 20 bp, Artificial Sequence
  chemically synthesized
tcactcattgagctaggtgc

SEQ ID NO: 137151 - DNA, 20 bp, Artificial Sequence
  chemically synthesized
cactcattgagctaggtgca

SEQ ID NO: 137152 - DNA, 20 bp, Artificial Sequence
  chemically synthesized
actcattgagctaggtgcag

SEQ ID NO: 137153 - DNA, 20 bp, Artificial Sequence
  chemically synthesized
actgctacagcccctgcacc

SEQ ID NO: 137154 - DNA, 20 bp, Artificial Sequence
  chemically synthesized
tgagctaggtgcaggggctg

SEQ ID NO: 137155 - DNA, 20 bp, Artificial Sequence
  chemically synthesized
gctaggtgcaggggctgtag

SEQ ID NO: 137156 - DNA, 20 bp, Artificial Sequence
  chemically synthesized
tattttctccttcactgcta

SEQ ID NO: 137157 - DNA, 20 bp, Artificial Sequence
  chemically synthesized
gtgcaggggctgtagcagtg

SEQ ID NO: 137158 - DNA, 20 bp, Artificial Sequence
  chemically synthesized
tgcaggggctgtagcagtga

SEQ ID NO: 137159 - DNA, 20 bp, Artificial Sequence
  chemically synthesized
caggggctgtagcagtgaag

SEQ ID NO: 137160 - DNA, 20 bp, Artificial Sequence
  chemically synthesized
gaaaataattcctgttctca

SEQ ID NO: 137161 - DNA, 20 bp, Artificial Sequence
  chemically synthesized
tttgttttctctttgagaac

SEQ ID NO: 137162 - DNA, 20 bp, Artificial Sequence
  chemically synthesized
gtttgttttctctttgagaa

SEQ ID NO: 137163 - DNA, 20 bp, Artificial Sequence
  chemically synthesized
aaataattcctgttctcaaa

SEQ ID NO: 137164 - DNA, 20 bp, Artificial Sequence
  chemically synthesized
tactcgtttgttttctcttt

SEQ ID NO: 137165 - DNA, 20 bp, Artificial Sequence
  chemically synthesized
ttctcaaagagaaaacaaac

SEQ ID NO: 137166 - DNA, 20 bp, Artificial Sequence
  chemically synthesized
tcaaagagaaaacaaacgag

SEQ ID NO: 137167 - DNA, 20 bp, Artificial Sequence
  chemically synthesized
aaacaaacgagtagtgatga

SEQ ID NO: 137168 - DNA, 20 bp, Artificial Sequence
  chemically synthesized
aacaaacgagtagtgatgac

SEQ ID NO: 137169 - DNA, 20 bp, Artificial Sequence
  chemically synthesized
agtgatgacaggcaataaaa

SEQ ID NO: 137170 - DNA, 20 bp, Artificial Sequence
  chemically synthesized
aaaagcaattgcaacaacct

SEQ ID NO: 137171 - DNA, 20 bp, Artificial Sequence
  chemically synthesized
aaagcaattgcaacaacctg

SEQ ID NO: 137172 - DNA, 20 bp, Artificial Sequence
  chemically synthesized
ttcccctaccataatacctc

SEQ ID NO: 137173 - DNA, 20 bp, Artificial Sequence
  chemically synthesized
tttcccctaccataatacct

SEQ ID NO: 137174 - DNA, 20 bp, Artificial Sequence
  chemically synthesized
tgcaacaacctgaggtatta

SEQ ID NO: 137175 - DNA, 20 bp, Artificial Sequence
  chemically synthesized
aacaacctgaggtattatgg

SEQ ID NO: 137176 - DNA, 20 bp, Artificial Sequence
  chemically synthesized
acaacctgaggtattatggt

SEQ ID NO: 137177 - DNA, 20 bp, Artificial Sequence
  chemically synthesized
caacctgaggtattatggta

SEQ ID NO: 137178 - DNA, 20 bp, Artificial Sequence
  chemically synthesized
aacctgaggtattatggtag

SEQ ID NO: 137179 - DNA, 20 bp, Artificial Sequence
  chemically synthesized
gtattatggtaggggaaaca

SEQ ID NO: 137180 - DNA, 20 bp, Artificial Sequence
  chemically synthesized
attatggtaggggaaacatg

SEQ ID NO: 137181 - DNA, 20 bp, Artificial Sequence
  chemically synthesized
tatggtaggggaaacatgga

SEQ ID NO: 137182 - DNA, 20 bp, Artificial Sequence
  chemically synthesized
ggggaaacatggagagttat

SEQ ID NO: 137183 - DNA, 20 bp, Artificial Sequence
  chemically synthesized
ggaaacatggagagttatca

SEQ ID NO: 137184 - DNA, 20 bp, Artificial Sequence
  chemically synthesized
tggagagttatcagagcata

SEQ ID NO: 137185 - DNA, 20 bp, Artificial Sequence
  chemically synthesized
agttatcagagcatatggca

SEQ ID NO: 137186 - DNA, 20 bp, Artificial Sequence
  chemically synthesized
aagatatcacatgaaatata

SEQ ID NO: 137187 - DNA, 20 bp, Artificial Sequence
  chemically synthesized
agatatcacatgaaatataa

SEQ ID NO: 137188 - DNA, 20 bp, Artificial Sequence
  chemically synthesized
cacatgaaatataaaggcca

SEQ ID NO: 137189 - DNA, 20 bp, Artificial Sequence
  chemically synthesized
ttccttcagaagacagtctt

SEQ ID NO: 137190 - DNA, 20 bp, Artificial Sequence
  chemically synthesized
aggccaaagactgtcttctg

SEQ ID NO: 137191 - DNA, 20 bp, Artificial Sequence
  chemically synthesized
agcttgattccttcagaaga

SEQ ID NO: 137192 - DNA, 20 bp, Artificial Sequence
  chemically synthesized
ggccaaagactgtcttctga

SEQ ID NO: 137193 - DNA, 20 bp, Artificial Sequence
  chemically synthesized
cttaagcttgattccttcag

SEQ ID NO: 137194 - DNA, 20 bp, Artificial Sequence
  chemically synthesized
ctacttaagcttgattcctt

SEQ ID NO: 137195 - DNA, 20 bp, Artificial Sequence
  chemically synthesized
gactgtcttctgaaggaatc

SEQ ID NO: 137196 - DNA, 20 bp, Artificial Sequence
  chemically synthesized
cttctgaaggaatcaagctt

SEQ ID NO: 137197 - DNA, 20 bp, Artificial Sequence
  chemically synthesized
ctgaaggaatcaagcttaag

SEQ ID NO: 137198 - DNA, 20 bp, Artificial Sequence
  chemically synthesized
agaaaagctgaggactactt

SEQ ID NO: 137199 - DNA, 20 bp, Artificial Sequence
  chemically synthesized
aatcaagcttaagtagtcct

SEQ ID NO: 137200 - DNA, 20 bp, Artificial Sequence
  chemically synthesized
atttaaataaagaaaagctg

SEQ ID NO: 137201 - DNA, 20 bp, Artificial Sequence
  chemically synthesized
aatttaaataaagaaaagct

SEQ ID NO: 137202 - DNA, 20 bp, Artificial Sequence
  chemically synthesized
tgtataatttaaataaagaa

SEQ ID NO: 137203 - DNA, 20 bp, Artificial Sequence
  chemically synthesized
tgttttgtataatttaaata

SEQ ID NO: 137204 - DNA, 20 bp, Artificial Sequence
  chemically synthesized
tttatttaaattatacaaaa

SEQ ID NO: 137205 - DNA, 20 bp, Artificial Sequence
  chemically synthesized
cacttgggtatgaggagcag

SEQ ID NO: 137206 - DNA, 20 bp, Artificial Sequence
  chemically synthesized
ggccacttgggtatgaggag

SEQ ID NO: 137207 - DNA, 20 bp, Artificial Sequence
  chemically synthesized
ggtggccacttgggtatgag

SEQ ID NO: 137208 - DNA, 20 bp, Artificial Sequence
  chemically synthesized
caccactgctcctcataccc

SEQ ID NO: 137209 - DNA, 20 bp, Artificial Sequence
  chemically synthesized
atggtggccacttgggtatg

SEQ ID NO: 137210 - DNA, 20 bp, Artificial Sequence
  chemically synthesized
catggtggccacttgggtat

SEQ ID NO: 137211 - DNA, 20 bp, Artificial Sequence
  chemically synthesized
cactgctcctcatacccaag

SEQ ID NO: 137212 - DNA, 20 bp, Artificial Sequence
  chemically synthesized
tattctcatggtggccactt

SEQ ID NO: 137213 - DNA, 20 bp, Artificial Sequence
  chemically synthesized
atattctcatggtggccact

SEQ ID NO: 137214 - DNA, 20 bp, Artificial Sequence
  chemically synthesized
catacccaagtggccaccat

SEQ ID NO: 137215 - DNA, 20 bp, Artificial Sequence
  chemically synthesized
aggcctgcatattctcatgg

SEQ ID NO: 137216 - DNA, 20 bp, Artificial Sequence
  chemically synthesized
agaaggcctgcatattctca

SEQ ID NO: 137217 - DNA, 20 bp, Artificial Sequence
  chemically synthesized
gtggccaccatgagaatatg

SEQ ID NO: 137218 - DNA, 20 bp, Artificial Sequence
  chemically synthesized
tggccaccatgagaatatgc

SEQ ID NO: 137219 - DNA, 20 bp, Artificial Sequence
  chemically synthesized
agttaagacccaataataga

SEQ ID NO: 137220 - DNA, 20 bp, Artificial Sequence
  chemically synthesized
atatgcaggccttctattat

SEQ ID NO: 137221 - DNA, 20 bp, Artificial Sequence
  chemically synthesized
cagttaagacccaataatag

SEQ ID NO: 137222 - DNA, 20 bp, Artificial Sequence
  chemically synthesized
tatgcaggccttctattatt

SEQ ID NO: 137223 - DNA, 20 bp, Artificial Sequence
  chemically synthesized
agtcagttaagacccaataa

SEQ ID NO: 137224 - DNA, 20 bp, Artificial Sequence
  chemically synthesized
acaggagtcctcagtcagtt

SEQ ID NO: 137225 - DNA, 20 bp, Artificial Sequence
  chemically synthesized
ttattgggtcttaactgact

SEQ ID NO: 137226 - DNA, 20 bp, Artificial Sequence
  chemically synthesized
tattgggtcttaactgactg

SEQ ID NO: 137227 - DNA, 20 bp, Artificial Sequence
  chemically synthesized
cagtaacaggagtcctcagt

SEQ ID NO: 137228 - DNA, 20 bp, Artificial Sequence
  chemically synthesized
aatgcagtaacaggagtcct

SEQ ID NO: 137229 - DNA, 20 bp, Artificial Sequence
  chemically synthesized
atttcaaaatgcagtaacag

SEQ ID NO: 137230 - DNA, 20 bp, Artificial Sequence
  chemically synthesized
ggatttcaaaatgcagtaac

SEQ ID NO: 137231 - DNA, 20 bp, Artificial Sequence
  chemically synthesized
tggatttcaaaatgcagtaa

SEQ ID NO: 137232 - DNA, 20 bp, Artificial Sequence
  chemically synthesized
caatcatggatttcaaaatg

SEQ ID NO: 137233 - DNA, 20 bp, Artificial Sequence
  chemically synthesized
gctttggtgcagtgcaatca

SEQ ID NO: 137234 - DNA, 20 bp, Artificial Sequence
  chemically synthesized
tccatgattgcactgcacca

SEQ ID NO: 137235 - DNA, 20 bp, Artificial Sequence
  chemically synthesized
tgagaagcttggctttggtg

SEQ ID NO: 137236 - DNA, 20 bp, Artificial Sequence
  chemically synthesized
gattgcactgcaccaaagcc

SEQ ID NO: 137237 - DNA, 20 bp, Artificial Sequence
  chemically synthesized
gtctgtgagaagcttggctt

SEQ ID NO: 137238 - DNA, 20 bp, Artificial Sequence
  chemically synthesized
ggagaagtctgtgagaagct

SEQ ID NO: 137239 - DNA, 20 bp, Artificial Sequence
  chemically synthesized
caccaaagccaagcttctca

SEQ ID NO: 137240 - DNA, 20 bp, Artificial Sequence
  chemically synthesized
ggtgaggagaagtctgtgag

SEQ ID NO: 137241 - DNA, 20 bp, Artificial Sequence
  chemically synthesized
ttgggtgaggagaagtctgt

SEQ ID NO: 137242 - DNA, 20 bp, Artificial Sequence
  chemically synthesized
cccaatcattgggtgaggag

SEQ ID NO: 137243 - DNA, 20 bp, Artificial Sequence
  chemically synthesized
acacccaatcattgggtgag

SEQ ID NO: 137244 - DNA, 20 bp, Artificial Sequence
  chemically synthesized
ccacacccaatcattgggtg

SEQ ID NO: 137245 - DNA, 20 bp, Artificial Sequence
  chemically synthesized
accacacccaatcattgggt

SEQ ID NO: 137246 - DNA, 20 bp, Artificial Sequence
  chemically synthesized
acttctcctcacccaatgat

SEQ ID NO: 137247 - DNA, 20 bp, Artificial Sequence
  chemically synthesized
cttctcctcacccaatgatt

SEQ ID NO: 137248 - DNA, 20 bp, Artificial Sequence
  chemically synthesized
tcccaccacacccaatcatt

SEQ ID NO: 137249 - DNA, 20 bp, Artificial Sequence
  chemically synthesized
ttcccaccacacccaatcat

SEQ ID NO: 137250 - DNA, 20 bp, Artificial Sequence
  chemically synthesized
cctcacccaatgattgggtg

SEQ ID NO: 137251 - DNA, 20 bp, Artificial Sequence
  chemically synthesized
cacccaatgattgggtgtgg

SEQ ID NO: 137252 - DNA, 20 bp, Artificial Sequence
  chemically synthesized
acccaatgattgggtgtggt

SEQ ID NO: 137253 - DNA, 20 bp, Artificial Sequence
  chemically synthesized
ttgggtgtggtgggaatact

SEQ ID NO: 137254 - DNA, 20 bp, Artificial Sequence
  chemically synthesized
tgggtgtggtgggaatacta

SEQ ID NO: 137255 - DNA, 20 bp, Artificial Sequence
  chemically synthesized
gtgtggtgggaatactaagg

SEQ ID NO: 137256 - DNA, 20 bp, Artificial Sequence
  chemically synthesized
gtggtgggaatactaaggca

SEQ ID NO: 137257 - DNA, 20 bp, Artificial Sequence
  chemically synthesized
ggtgggaatactaaggcaga

SEQ ID NO: 137258 - DNA, 20 bp, Artificial Sequence
  chemically synthesized
ccaaggaaggctctctgcct

SEQ ID NO: 137259 - DNA, 20 bp, Artificial Sequence
  chemically synthesized
ctaaggcagagagccttcct

SEQ ID NO: 137260 - DNA, 20 bp, Artificial Sequence
  chemically synthesized
taaggcagagagccttcctt

SEQ ID NO: 137261 - DNA, 20 bp, Artificial Sequence
  chemically synthesized
aggcagagagccttccttgg

SEQ ID NO: 137262 - DNA, 20 bp, Artificial Sequence
  chemically synthesized
agtcccatgtctcccaagga

SEQ ID NO: 137263 - DNA, 20 bp, Artificial Sequence
  chemically synthesized
aagtcccatgtctcccaagg

SEQ ID NO: 137264 - DNA, 20 bp, Artificial Sequence
  chemically synthesized
aagaagtcccatgtctccca

SEQ ID NO: 137265 - DNA, 20 bp, Artificial Sequence
  chemically synthesized
aaagaagtcccatgtctccc

SEQ ID NO: 137266 - DNA, 20 bp, Artificial Sequence
  chemically synthesized
agagccttccttgggagaca

SEQ ID NO: 137267 - DNA, 20 bp, Artificial Sequence
  chemically synthesized
gagccttccttgggagacat

SEQ ID NO: 137268 - DNA, 20 bp, Artificial Sequence
  chemically synthesized
agacatgggacttctttgcc

SEQ ID NO: 137269 - DNA, 20 bp, Artificial Sequence
  chemically synthesized
tgaggcagagccaggcaaag

SEQ ID NO: 137270 - DNA, 20 bp, Artificial Sequence
  chemically synthesized
cattgaggcagagccaggca

SEQ ID NO: 137271 - DNA, 20 bp, Artificial Sequence
  chemically synthesized
gaagtcattgaggcagagcc

SEQ ID NO: 137272 - DNA, 20 bp, Artificial Sequence
  chemically synthesized
ggaagtcattgaggcagagc

SEQ ID NO: 137273 - DNA, 20 bp, Artificial Sequence
  chemically synthesized
gttgggaagtcattgaggca

SEQ ID NO: 137274 - DNA, 20 bp, Artificial Sequence
  chemically synthesized
ctgttgggaagtcattgagg

SEQ ID NO: 137275 - DNA, 20 bp, Artificial Sequence
  chemically synthesized
aagctgttgggaagtcattg

SEQ ID NO: 137276 - DNA, 20 bp, Artificial Sequence
  chemically synthesized
aaagctgttgggaagtcatt

SEQ ID NO: 137277 - DNA, 20 bp, Artificial Sequence
  chemically synthesized
ctgcctcaatgacttcccaa

SEQ ID NO: 137278 - DNA, 20 bp, Artificial Sequence
  chemically synthesized
attttggcaaagctgttggg

SEQ ID NO: 137279 - DNA, 20 bp, Artificial Sequence
  chemically synthesized
gaaattttggcaaagctgtt

SEQ ID NO: 137280 - DNA, 20 bp, Artificial Sequence
  chemically synthesized
ggaaattttggcaaagctgt

SEQ ID NO: 137281 - DNA, 20 bp, Artificial Sequence
  chemically synthesized
agtggaaggaaattttggca

SEQ ID NO: 137282 - DNA, 20 bp, Artificial Sequence
  chemically synthesized
ggtctagtggaaggaaattt

SEQ ID NO: 137283 - DNA, 20 bp, Artificial Sequence
  chemically synthesized
ttgccaaaatttccttccac

SEQ ID NO: 137284 - DNA, 20 bp, Artificial Sequence
  chemically synthesized
ccagtgtgcggtctagtgga

SEQ ID NO: 137285 - DNA, 20 bp, Artificial Sequence
  chemically synthesized
cccagtgtgcggtctagtgg

SEQ ID NO: 137286 - DNA, 20 bp, Artificial Sequence
  chemically synthesized
catcccagtgtgcggtctag

SEQ ID NO: 137287 - DNA, 20 bp, Artificial Sequence
  chemically synthesized
aagcatcccagtgtgcggtc

SEQ ID NO: 137288 - DNA, 20 bp, Artificial Sequence
  chemically synthesized
ccttccactagaccgcacac

SEQ ID NO: 137289 - DNA, 20 bp, Artificial Sequence
  chemically synthesized
cttccactagaccgcacact

SEQ ID NO: 137290 - DNA, 20 bp, Artificial Sequence
  chemically synthesized
ggcagaagcatcccagtgtg

SEQ ID NO: 137291 - DNA, 20 bp, Artificial Sequence
  chemically synthesized
aaggctaggcagaagcatcc

SEQ ID NO: 137292 - DNA, 20 bp, Artificial Sequence
  chemically synthesized
cacactgggatgcttctgcc

SEQ ID NO: 137293 - DNA, 20 bp, Artificial Sequence
  chemically synthesized
agggagagaaggctaggcag

SEQ ID NO: 137294 - DNA, 20 bp, Artificial Sequence
  chemically synthesized
gagagggagagaaggctagg

SEQ ID NO: 137295 - DNA, 20 bp, Artificial Sequence
  chemically synthesized
agagagagggagagaaggct

SEQ ID NO: 137296 - DNA, 20 bp, Artificial Sequence
  chemically synthesized
aagagagagggagagaaggc

SEQ ID NO: 137297 - DNA, 20 bp, Artificial Sequence
  chemically synthesized
aaggaagagagagggagaga

SEQ ID NO: 137298 - DNA, 20 bp, Artificial Sequence
  chemically synthesized
caaggaagagagagggagag

SEQ ID NO: 137299 - DNA, 20 bp, Artificial Sequence
  chemically synthesized
ctgcaaggaagagagaggga

SEQ ID NO: 137300 - DNA, 20 bp, Artificial Sequence
  chemically synthesized
ctctgcaaggaagagagagg

SEQ ID NO: 137301 - DNA, 20 bp, Artificial Sequence
  chemically synthesized
gactctgcaaggaagagaga

SEQ ID NO: 137302 - DNA, 20 bp, Artificial Sequence
  chemically synthesized
tgactctgcaaggaagagag

SEQ ID NO: 137303 - DNA, 20 bp, Artificial Sequence
  chemically synthesized
ctgactctgcaaggaagaga

SEQ ID NO: 137304 - DNA, 20 bp, Artificial Sequence
  chemically synthesized
ttctgactctgcaaggaaga

SEQ ID NO: 137305 - DNA, 20 bp, Artificial Sequence
  chemically synthesized
ctctccctctctcttccttg

SEQ ID NO: 137306 - DNA, 20 bp, Artificial Sequence
  chemically synthesized
aattctgactctgcaaggaa

SEQ ID NO: 137307 - DNA, 20 bp, Artificial Sequence
  chemically synthesized
ctccctctctcttccttgca

SEQ ID NO: 137308 - DNA, 20 bp, Artificial Sequence
  chemically synthesized
gcaattctgactctgcaagg

SEQ ID NO: 137309 - DNA, 20 bp, Artificial Sequence
  chemically synthesized
gatgcaattctgactctgca

SEQ ID NO: 137310 - DNA, 20 bp, Artificial Sequence
  chemically synthesized
ctctctcttccttgcagagt

SEQ ID NO: 137311 - DNA, 20 bp, Artificial Sequence
  chemically synthesized
agatgcaattctgactctgc

SEQ ID NO: 137312 - DNA, 20 bp, Artificial Sequence
  chemically synthesized
ggtgcaagagatgttagatc

SEQ ID NO: 137313 - DNA, 20 bp, Artificial Sequence
  chemically synthesized
aaggaaggtgcaagagatgt

SEQ ID NO: 137314 - DNA, 20 bp, Artificial Sequence
  chemically synthesized
ggaagccaaggaaggtgcaa

SEQ ID NO: 137315 - DNA, 20 bp, Artificial Sequence
  chemically synthesized
gaggaagccaaggaaggtgc

SEQ ID NO: 137316 - DNA, 20 bp, Artificial Sequence
  chemically synthesized
aacatctcttgcaccttcct

SEQ ID NO: 137317 - DNA, 20 bp, Artificial Sequence
  chemically synthesized
aagaaggaggaagccaagga

SEQ ID NO: 137318 - DNA, 20 bp, Artificial Sequence
  chemically synthesized
aaagaaggaggaagccaagg

SEQ ID NO: 137319 - DNA, 20 bp, Artificial Sequence
  chemically synthesized
agaaaagaaggaggaagcca

SEQ ID NO: 137320 - DNA, 20 bp, Artificial Sequence
  chemically synthesized
aagaaaagaaggaggaagcc

SEQ ID NO: 137321 - DNA, 20 bp, Artificial Sequence
  chemically synthesized
tgtgaaagaaaagaaggagg

SEQ ID NO: 137322 - DNA, 20 bp, Artificial Sequence
  chemically synthesized
ctatgtgaaagaaaagaagg

SEQ ID NO: 137323 - DNA, 20 bp, Artificial Sequence
  chemically synthesized
tctatgtgaaagaaaagaag

SEQ ID NO: 137324 - DNA, 20 bp, Artificial Sequence
  chemically synthesized
tatctatgtgaaagaaaaga

SEQ ID NO: 137325 - DNA, 20 bp, Artificial Sequence
  chemically synthesized
atatctatgtgaaagaaaag

SEQ ID NO: 137326 - DNA, 20 bp, Artificial Sequence
  chemically synthesized
gaaatatctatgtgaaagaa

SEQ ID NO: 137327 - DNA, 20 bp, Artificial Sequence
  chemically synthesized
cctccttcttttctttcaca

SEQ ID NO: 137328 - DNA, 20 bp, Artificial Sequence
  chemically synthesized
tagtggaaatatctatgtga

SEQ ID NO: 137329 - DNA, 20 bp, Artificial Sequence
  chemically synthesized
atgggacaatattttattag

SEQ ID NO: 137330 - DNA, 20 bp, Artificial Sequence
  chemically synthesized
aaaatgggacaatattttat

SEQ ID NO: 137331 - DNA, 20 bp, Artificial Sequence
  chemically synthesized
gtacccagacaggataaaat

SEQ ID NO: 137332 - DNA, 20 bp, Artificial Sequence
  chemically synthesized
tgtacccagacaggataaaa

SEQ ID NO: 137333 - DNA, 20 bp, Artificial Sequence
  chemically synthesized
ttgtcccattttatcctgtc

SEQ ID NO: 137334 - DNA, 20 bp, Artificial Sequence
  chemically synthesized
tgtcccattttatcctgtct

SEQ ID NO: 137335 - DNA, 20 bp, Artificial Sequence
  chemically synthesized
gaggttatatgtacccagac

SEQ ID NO: 137336 - DNA, 20 bp, Artificial Sequence
  chemically synthesized
tgaggttatatgtacccaga

SEQ ID NO: 137337 - DNA, 20 bp, Artificial Sequence
  chemically synthesized
ggcctgaggttatatgtacc

SEQ ID NO: 137338 - DNA, 20 bp, Artificial Sequence
  chemically synthesized
tgtctgggtacatataacct

SEQ ID NO: 137339 - DNA, 20 bp, Artificial Sequence
  chemically synthesized
gtctgggtacatataacctc

SEQ ID NO: 137340 - DNA, 20 bp, Artificial Sequence
  chemically synthesized
agtgtattagtcagggcctg

SEQ ID NO: 137341 - DNA, 20 bp, Artificial Sequence
  chemically synthesized
gagtgtattagtcagggcct

SEQ ID NO: 137342 - DNA, 20 bp, Artificial Sequence
  chemically synthesized
aaaagtgagtgtattagtca

SEQ ID NO: 137343 - DNA, 20 bp, Artificial Sequence
  chemically synthesized
caaaagtgagtgtattagtc

SEQ ID NO: 137344 - DNA, 20 bp, Artificial Sequence
  chemically synthesized
acaaaagtgagtgtattagt

SEQ ID NO: 137345 - DNA, 20 bp, Artificial Sequence
  chemically synthesized
gaggacaaaagtgagtgtat

SEQ ID NO: 137346 - DNA, 20 bp, Artificial Sequence
  chemically synthesized
gggtctaggaggacaaaagt

SEQ ID NO: 137347 - DNA, 20 bp, Artificial Sequence
  chemically synthesized
tttagggtctaggaggacaa

SEQ ID NO: 137348 - DNA, 20 bp, Artificial Sequence
  chemically synthesized
tacactcacttttgtcctcc

SEQ ID NO: 137349 - DNA, 20 bp, Artificial Sequence
  chemically synthesized
tgagaggtttagggtctagg

SEQ ID NO: 137350 - DNA, 20 bp, Artificial Sequence
  chemically synthesized
atgagaggtttagggtctag

SEQ ID NO: 137351 - DNA, 20 bp, Artificial Sequence
  chemically synthesized
tgatgagaggtttagggtct

SEQ ID NO: 137352 - DNA, 20 bp, Artificial Sequence
  chemically synthesized
ctgatgagaggtttagggtc

SEQ ID NO: 137353 - DNA, 20 bp, Artificial Sequence
  chemically synthesized
aagagctgatgagaggttta

SEQ ID NO: 137354 - DNA, 20 bp, Artificial Sequence
  chemically synthesized
gaagagctgatgagaggttt

SEQ ID NO: 137355 - DNA, 20 bp, Artificial Sequence
  chemically synthesized
tgaagagctgatgagaggtt

SEQ ID NO: 137356 - DNA, 20 bp, Artificial Sequence
  chemically synthesized
ctagaccctaaacctctcat

SEQ ID NO: 137357 - DNA, 20 bp, Artificial Sequence
  chemically synthesized
ggaactgaagagctgatgag

SEQ ID NO: 137358 - DNA, 20 bp, Artificial Sequence
  chemically synthesized
tggaactgaagagctgatga

SEQ ID NO: 137359 - DNA, 20 bp, Artificial Sequence
  chemically synthesized
catggaactgaagagctgat

SEQ ID NO: 137360 - DNA, 20 bp, Artificial Sequence
  chemically synthesized
taaacctctcatcagctctt

SEQ ID NO: 137361 - DNA, 20 bp, Artificial Sequence
  chemically synthesized
tcacgttacatggaactgaa

SEQ ID NO: 137362 - DNA, 20 bp, Artificial Sequence
  chemically synthesized
catcacgttacatggaactg

SEQ ID NO: 137363 - DNA, 20 bp, Artificial Sequence
  chemically synthesized
catggaaccatcacgttaca

SEQ ID NO: 137364 - DNA, 20 bp, Artificial Sequence
  chemically synthesized
ttcagttccatgtaacgtga

SEQ ID NO: 137365 - DNA, 20 bp, Artificial Sequence
  chemically synthesized
acattcaggtagtagtgtca

SEQ ID NO: 137366 - DNA, 20 bp, Artificial Sequence
  chemically synthesized
acagttacacattcaggtag

SEQ ID NO: 137367 - DNA, 20 bp, Artificial Sequence
  chemically synthesized
ttgacagttacacattcagg

SEQ ID NO: 137368 - DNA, 20 bp, Artificial Sequence
  chemically synthesized
taattgacagttacacattc

SEQ ID NO: 137369 - DNA, 20 bp, Artificial Sequence
  chemically synthesized
ataattgacagttacacatt

SEQ ID NO: 137370 - DNA, 20 bp, Artificial Sequence
  chemically synthesized
aattaatattcaataattga

SEQ ID NO: 137371 - DNA, 20 bp, Artificial Sequence
  chemically synthesized
gtcaattattgaatattaat

SEQ ID NO: 137372 - DNA, 20 bp, Artificial Sequence
  chemically synthesized
ttgaatattaattagtaaca

SEQ ID NO: 137373 - DNA, 20 bp, Artificial Sequence
  chemically synthesized
tgaatattaattagtaacat

SEQ ID NO: 137374 - DNA, 20 bp, Artificial Sequence
  chemically synthesized
gccagcccatgggaggcatg

SEQ ID NO: 137375 - DNA, 20 bp, Artificial Sequence
  chemically synthesized
aggtttcttcatgcctccca

SEQ ID NO: 137376 - DNA, 20 bp, Artificial Sequence
  chemically synthesized
ggtttcttcatgcctcccat

SEQ ID NO: 137377 - DNA, 20 bp, Artificial Sequence
  chemically synthesized
ttaagaggccagcccatggg

SEQ ID NO: 137378 - DNA, 20 bp, Artificial Sequence
  chemically synthesized
cttaagaggccagcccatgg

SEQ ID NO: 137379 - DNA, 20 bp, Artificial Sequence
  chemically synthesized
tcttcatgcctcccatgggc

SEQ ID NO: 137380 - DNA, 20 bp, Artificial Sequence
  chemically synthesized
atcttaagaggccagcccat

SEQ ID NO: 137381 - DNA, 20 bp, Artificial Sequence
  chemically synthesized
catcttaagaggccagccca

SEQ ID NO: 137382 - DNA, 20 bp, Artificial Sequence
  chemically synthesized
ctcccatgggctggcctctt

SEQ ID NO: 137383 - DNA, 20 bp, Artificial Sequence
  chemically synthesized
tgaattgcatcttaagaggc

SEQ ID NO: 137384 - DNA, 20 bp, Artificial Sequence
  chemically synthesized
tacttgaattgcatcttaag

SEQ ID NO: 137385 - DNA, 20 bp, Artificial Sequence
  chemically synthesized
ttacttgaattgcatcttaa

SEQ ID NO: 137386 - DNA, 20 bp, Artificial Sequence
  chemically synthesized
atttacttgaattgcatctt

SEQ ID NO: 137387 - DNA, 20 bp, Artificial Sequence
  chemically synthesized
ggcctcttaagatgcaattc

SEQ ID NO: 137388 - DNA, 20 bp, Artificial Sequence
  chemically synthesized
tagtgatttctaaatagagg

SEQ ID NO: 137389 - DNA, 20 bp, Artificial Sequence
  chemically synthesized
ttttacatactacctctatt

SEQ ID NO: 137390 - DNA, 20 bp, Artificial Sequence
  chemically synthesized
ccttagtgatttctaaatag

SEQ ID NO: 137391 - DNA, 20 bp, Artificial Sequence
  chemically synthesized
accttagtgatttctaaata

SEQ ID NO: 137392 - DNA, 20 bp, Artificial Sequence
  chemically synthesized
ctaccttagtgatttctaaa

SEQ ID NO: 137393 - DNA, 20 bp, Artificial Sequence
  chemically synthesized
acctctatttagaaatcact

SEQ ID NO: 137394 - DNA, 20 bp, Artificial Sequence
  chemically synthesized
cctctatttagaaatcacta

SEQ ID NO: 137395 - DNA, 20 bp, Artificial Sequence
  chemically synthesized
ctatttagaaatcactaagg

SEQ ID NO: 137396 - DNA, 20 bp, Artificial Sequence
  chemically synthesized
tatttagaaatcactaaggt

SEQ ID NO: 137397 - DNA, 20 bp, Artificial Sequence
  chemically synthesized
atttagaaatcactaaggta

SEQ ID NO: 137398 - DNA, 20 bp, Artificial Sequence
  chemically synthesized
aatggtcatgcaccctacct

SEQ ID NO: 137399 - DNA, 20 bp, Artificial Sequence
  chemically synthesized
tctgcgctccttggaaataa

SEQ ID NO: 137400 - DNA, 20 bp, Artificial Sequence
  chemically synthesized
ggtgcatgaccattatttcc

SEQ ID NO: 137401 - DNA, 20 bp, Artificial Sequence
  chemically synthesized
gtgcatgaccattatttcca

SEQ ID NO: 137402 - DNA, 20 bp, Artificial Sequence
  chemically synthesized
gcatgaccattatttccaag

SEQ ID NO: 137403 - DNA, 20 bp, Artificial Sequence
  chemically synthesized
accattatttccaaggagcg

SEQ ID NO: 137404 - DNA, 20 bp, Artificial Sequence
  chemically synthesized
cagttaaattctgcgctcct

SEQ ID NO: 137405 - DNA, 20 bp, Artificial Sequence
  chemically synthesized
caaggagcgcagaatttaac

SEQ ID NO: 137406 - DNA, 20 bp, Artificial Sequence
  chemically synthesized
aggagcgcagaatttaactg

SEQ ID NO: 137407 - DNA, 20 bp, Artificial Sequence
  chemically synthesized
ggagcgcagaatttaactgg

SEQ ID NO: 137408 - DNA, 20 bp, Artificial Sequence
  chemically synthesized
tgaatactcttattttcctc

SEQ ID NO: 137409 - DNA, 20 bp, Artificial Sequence
  chemically synthesized
gaatttaactggaggaaaat

SEQ ID NO: 137410 - DNA, 20 bp, Artificial Sequence
  chemically synthesized
atttaactggaggaaaataa

SEQ ID NO: 137411 - DNA, 20 bp, Artificial Sequence
  chemically synthesized
tggaggaaaataagagtatt

SEQ ID NO: 137412 - DNA, 20 bp, Artificial Sequence
  chemically synthesized
gagtattcagatgtgttaca

SEQ ID NO: 137413 - DNA, 20 bp, Artificial Sequence
  chemically synthesized
tcagatgtgttacatggtaa

SEQ ID NO: 137414 - DNA, 20 bp, Artificial Sequence
  chemically synthesized
gatgtgttacatggtaatgg

SEQ ID NO: 137415 - DNA, 20 bp, Artificial Sequence
  chemically synthesized
tgtgttacatggtaatggtg

SEQ ID NO: 137416 - DNA, 20 bp, Artificial Sequence
  chemically synthesized
cttgagctgcatgtgttgaa

SEQ ID NO: 137417 - DNA, 20 bp, Artificial Sequence
  chemically synthesized
ggagttccattcaacacatg

SEQ ID NO: 137418 - DNA, 20 bp, Artificial Sequence
  chemically synthesized
ccattcaacacatgcagctc

SEQ ID NO: 137419 - DNA, 20 bp, Artificial Sequence
  chemically synthesized
tttagtttcctacagttctt

SEQ ID NO: 137420 - DNA, 20 bp, Artificial Sequence
  chemically synthesized
cacatgcagctcaagaactg

SEQ ID NO: 137421 - DNA, 20 bp, Artificial Sequence
  chemically synthesized
acatgcagctcaagaactgt

SEQ ID NO: 137422 - DNA, 20 bp, Artificial Sequence
  chemically synthesized
tggcttgctttagtttccta

SEQ ID NO: 137423 - DNA, 20 bp, Artificial Sequence
  chemically synthesized
tcaagaactgtaggaaacta

SEQ ID NO: 137424 - DNA, 20 bp, Artificial Sequence
  chemically synthesized
gaactgtaggaaactaaagc

SEQ ID NO: 137425 - DNA, 20 bp, Artificial Sequence
  chemically synthesized
ggattcctggtggcttgctt

SEQ ID NO: 137426 - DNA, 20 bp, Artificial Sequence
  chemically synthesized
aggaaactaaagcaagccac

SEQ ID NO: 137427 - DNA, 20 bp, Artificial Sequence
  chemically synthesized
ggaaactaaagcaagccacc

SEQ ID NO: 137428 - DNA, 20 bp, Artificial Sequence
  chemically synthesized
tatctgttaaggattcctgg

SEQ ID NO: 137429 - DNA, 20 bp, Artificial Sequence
  chemically synthesized
tgttatctgttaaggattcc

SEQ ID NO: 137430 - DNA, 20 bp, Artificial Sequence
  chemically synthesized
aagccaccaggaatccttaa

SEQ ID NO: 137431 - DNA, 20 bp, Artificial Sequence
  chemically synthesized
ctagtggttgttatctgtta

SEQ ID NO: 137432 - DNA, 20 bp, Artificial Sequence
  chemically synthesized
cctagtggttgttatctgtt

SEQ ID NO: 137433 - DNA, 20 bp, Artificial Sequence
  chemically synthesized
ccttaacagataacaaccac

SEQ ID NO: 137434 - DNA, 20 bp, Artificial Sequence
  chemically synthesized
cttaacagataacaaccact

SEQ ID NO: 137435 - DNA, 20 bp, Artificial Sequence
  chemically synthesized
atctcttgcagcaaacctag

SEQ ID NO: 137436 - DNA, 20 bp, Artificial Sequence
  chemically synthesized
gccatctcttgcagcaaacc

SEQ ID NO: 137437 - DNA, 20 bp, Artificial Sequence
  chemically synthesized
acaaccactaggtttgctgc

SEQ ID NO: 137438 - DNA, 20 bp, Artificial Sequence
  chemically synthesized
aaccactaggtttgctgcaa

SEQ ID NO: 137439 - DNA, 20 bp, Artificial Sequence
  chemically synthesized
actaggtttgctgcaagaga

SEQ ID NO: 137440 - DNA, 20 bp, Artificial Sequence
  chemically synthesized
gttccttttgccatctcttg

SEQ ID NO: 137441 - DNA, 20 bp, Artificial Sequence
  chemically synthesized
tttgctgcaagagatggcaa

SEQ ID NO: 137442 - DNA, 20 bp, Artificial Sequence
  chemically synthesized
ttgctgcaagagatggcaaa

SEQ ID NO: 137443 - DNA, 20 bp, Artificial Sequence
  chemically synthesized
agagatggcaaaaggaactt

SEQ ID NO: 137444 - DNA, 20 bp, Artificial Sequence
  chemically synthesized
gagatggcaaaaggaacttt

SEQ ID NO: 137445 - DNA, 20 bp, Artificial Sequence
  chemically synthesized
agatggcaaaaggaactttg

SEQ ID NO: 137446 - DNA, 20 bp, Artificial Sequence
  chemically synthesized
ggcaaaaggaactttggggc

SEQ ID NO: 137447 - DNA, 20 bp, Artificial Sequence
  chemically synthesized
tcatctgaaaacttgcccca

SEQ ID NO: 137448 - DNA, 20 bp, Artificial Sequence
  chemically synthesized
ggaactttggggcaagtttt

SEQ ID NO: 137449 - DNA, 20 bp, Artificial Sequence
  chemically synthesized
tggggcaagttttcagatga

SEQ ID NO: 137450 - DNA, 20 bp, Artificial Sequence
  chemically synthesized
ggcaagttttcagatgacgg

SEQ ID NO: 137451 - DNA, 20 bp, Artificial Sequence
  chemically synthesized
agttttcagatgacggaaga

SEQ ID NO: 137452 - DNA, 20 bp, Artificial Sequence
  chemically synthesized
ttcagatgacggaagacaga

SEQ ID NO: 137453 - DNA, 20 bp, Artificial Sequence
  chemically synthesized
atgacggaagacagaaagtt

SEQ ID NO: 137454 - DNA, 20 bp, Artificial Sequence
  chemically synthesized
taagattattccacctctct

SEQ ID NO: 137455 - DNA, 20 bp, Artificial Sequence
  chemically synthesized
gcacttctcactcagagagg

SEQ ID NO: 137456 - DNA, 20 bp, Artificial Sequence
  chemically synthesized
agggcacttctcactcagag

SEQ ID NO: 137457 - DNA, 20 bp, Artificial Sequence
  chemically synthesized
attattccacctctctgagt

SEQ ID NO: 137458 - DNA, 20 bp, Artificial Sequence
  chemically synthesized
tagggcacttctcactcaga

SEQ ID NO: 137459 - DNA, 20 bp, Artificial Sequence
  chemically synthesized
cctagggcacttctcactca

SEQ ID NO: 137460 - DNA, 20 bp, Artificial Sequence
  chemically synthesized
attccacctctctgagtgag

SEQ ID NO: 137461 - DNA, 20 bp, Artificial Sequence
  chemically synthesized
tacctagggcacttctcact

SEQ ID NO: 137462 - DNA, 20 bp, Artificial Sequence
  chemically synthesized
tctctgagtgagaagtgccc

SEQ ID NO: 137463 - DNA, 20 bp, Artificial Sequence
  chemically synthesized
ctctgagtgagaagtgccct

SEQ ID NO: 137464 - DNA, 20 bp, Artificial Sequence
  chemically synthesized
tgagtgagaagtgccctagg

SEQ ID NO: 137465 - DNA, 20 bp, Artificial Sequence
  chemically synthesized
ttgaggtctttgtctaccta

SEQ ID NO: 137466 - DNA, 20 bp, Artificial Sequence
  chemically synthesized
gttgaggtctttgtctacct

SEQ ID NO: 137467 - DNA, 20 bp, Artificial Sequence
  chemically synthesized
ggttgaggtctttgtctacc

SEQ ID NO: 137468 - DNA, 20 bp, Artificial Sequence
  chemically synthesized
agaagtgccctaggtagaca

SEQ ID NO: 137469 - DNA, 20 bp, Artificial Sequence
  chemically synthesized
aggtagacaaagacctcaac

SEQ ID NO: 137470 - DNA, 20 bp, Artificial Sequence
  chemically synthesized
ggtagacaaagacctcaacc

SEQ ID NO: 137471 - DNA, 20 bp, Artificial Sequence
  chemically synthesized
caagaagctggtcctggttg

SEQ ID NO: 137472 - DNA, 20 bp, Artificial Sequence
  chemically synthesized
tcaagaagctggtcctggtt

SEQ ID NO: 137473 - DNA, 20 bp, Artificial Sequence
  chemically synthesized
acaaagacctcaaccaggac

SEQ ID NO: 137474 - DNA, 20 bp, Artificial Sequence
  chemically synthesized
tacgttcaagaagctggtcc

SEQ ID NO: 137475 - DNA, 20 bp, Artificial Sequence
  chemically synthesized
aagttatacgttcaagaagc

SEQ ID NO: 137476 - DNA, 20 bp, Artificial Sequence
  chemically synthesized
gcacaagttatacgttcaag

SEQ ID NO: 137477 - DNA, 20 bp, Artificial Sequence
  chemically synthesized
actgcacaagttatacgttc

SEQ ID NO: 137478 - DNA, 20 bp, Artificial Sequence
  chemically synthesized
tcttgaacgtataacttgtg

SEQ ID NO: 137479 - DNA, 20 bp, Artificial Sequence
  chemically synthesized
gaacgtataacttgtgcagt

SEQ ID NO: 137480 - DNA, 20 bp, Artificial Sequence
  chemically synthesized
ccttgtgtaactaactgcac

SEQ ID NO: 137481 - DNA, 20 bp, Artificial Sequence
  chemically synthesized
acttgtgcagttagttacac

SEQ ID NO: 137482 - DNA, 20 bp, Artificial Sequence
  chemically synthesized
cttgtgcagttagttacaca

SEQ ID NO: 137483 - DNA, 20 bp, Artificial Sequence
  chemically synthesized
agttacacaaggatctgcat

SEQ ID NO: 137484 - DNA, 20 bp, Artificial Sequence
  chemically synthesized
tacacaaggatctgcattag

SEQ ID NO: 137485 - DNA, 20 bp, Artificial Sequence
  chemically synthesized
acacaaggatctgcattaga

SEQ ID NO: 137486 - DNA, 20 bp, Artificial Sequence
  chemically synthesized
agtatgaatcccttctaatg

SEQ ID NO: 137487 - DNA, 20 bp, Artificial Sequence
  chemically synthesized
cacaaggatctgcattagaa

SEQ ID NO: 137488 - DNA, 20 bp, Artificial Sequence
  chemically synthesized
cattagaagggattcatact

SEQ ID NO: 137489 - DNA, 20 bp, Artificial Sequence
  chemically synthesized
caacagtagagcatgaaacc

SEQ ID NO: 137490 - DNA, 20 bp, Artificial Sequence
  chemically synthesized
atttcaagatggcaacagta

SEQ ID NO: 137491 - DNA, 20 bp, Artificial Sequence
  chemically synthesized
gaatttcaagatggcaacag

SEQ ID NO: 137492 - DNA, 20 bp, Artificial Sequence
  chemically synthesized
taagaatttcaagatggcaa

SEQ ID NO: 137493 - DNA, 20 bp, Artificial Sequence
  chemically synthesized
aaaaattaagaatttcaaga

SEQ ID NO: 137494 - DNA, 20 bp, Artificial Sequence
  chemically synthesized
aaaaaaaaattaagaatttc

SEQ ID NO: 137495 - DNA, 20 bp, Artificial Sequence
  chemically synthesized
cccttggttaaaaaaaaatt

SEQ ID NO: 137496 - DNA, 20 bp, Artificial Sequence
  chemically synthesized
ttcttaatttttttttaacc

SEQ ID NO: 137497 - DNA, 20 bp, Artificial Sequence
  chemically synthesized
tcttaatttttttttaacca

SEQ ID NO: 137498 - DNA, 20 bp, Artificial Sequence
  chemically synthesized
cttaatttttttttaaccaa

SEQ ID NO: 137499 - DNA, 20 bp, Artificial Sequence
  chemically synthesized
aaatgaaaacgcagggccct

SEQ ID NO: 137500 - DNA, 20 bp, Artificial Sequence
  chemically synthesized
cagtgaaaaatgaaaacgca

SEQ ID NO: 137501 - DNA, 20 bp, Artificial Sequence
  chemically synthesized
ccagtgaaaaatgaaaacgc

SEQ ID NO: 137502 - DNA, 20 bp, Artificial Sequence
  chemically synthesized
cccagtgaaaaatgaaaacg

SEQ ID NO: 137503 - DNA, 20 bp, Artificial Sequence
  chemically synthesized
cctgcgttttcatttttcac

SEQ ID NO: 137504 - DNA, 20 bp, Artificial Sequence
  chemically synthesized
ctgcgttttcatttttcact

SEQ ID NO: 137505 - DNA, 20 bp, Artificial Sequence
  chemically synthesized
tcatttttcactgggctcta

SEQ ID NO: 137506 - DNA, 20 bp, Artificial Sequence
  chemically synthesized
ggtacgtaatctgtagagcc

SEQ ID NO: 137507 - DNA, 20 bp, Artificial Sequence
  chemically synthesized
aatcaggtacgtaatctgta

SEQ ID NO: 137508 - DNA, 20 bp, Artificial Sequence
  chemically synthesized
acaatcaggtacgtaatctg

SEQ ID NO: 137509 - DNA, 20 bp, Artificial Sequence
  chemically synthesized
ttagggttgaggtcacaatc

SEQ ID NO: 137510 - DNA, 20 bp, Artificial Sequence
  chemically synthesized
cttagggttgaggtcacaat

SEQ ID NO: 137511 - DNA, 20 bp, Artificial Sequence
  chemically synthesized
ctgattgtgacctcaaccct

SEQ ID NO: 137512 - DNA, 20 bp, Artificial Sequence
  chemically synthesized
ctccactaaccttagggttg

SEQ ID NO: 137513 - DNA, 20 bp, Artificial Sequence
  chemically synthesized
tgattgtgacctcaacccta

SEQ ID NO: 137514 - DNA, 20 bp, Artificial Sequence
  chemically synthesized
tctccactaaccttagggtt

SEQ ID NO: 137515 - DNA, 20 bp, Artificial Sequence
  chemically synthesized
tgtgacctcaaccctaaggt

SEQ ID NO: 137516 - DNA, 20 bp, Artificial Sequence
  chemically synthesized
tttattctccactaacctta

SEQ ID NO: 137517 - DNA, 20 bp, Artificial Sequence
  chemically synthesized
ttttattctccactaacctt

SEQ ID NO: 137518 - DNA, 20 bp, Artificial Sequence
  chemically synthesized
gacctcaaccctaaggttag

SEQ ID NO: 137519 - DNA, 20 bp, Artificial Sequence
  chemically synthesized
cttttattctccactaacct

SEQ ID NO: 137520 - DNA, 20 bp, Artificial Sequence
  chemically synthesized
cctcaaccctaaggttagtg

SEQ ID NO: 137521 - DNA, 20 bp, Artificial Sequence
  chemically synthesized
ctaaggttagtggagaataa

SEQ ID NO: 137522 - DNA, 20 bp, Artificial Sequence
  chemically synthesized
agaataaaagttatgtatct

SEQ ID NO: 137523 - DNA, 20 bp, Artificial Sequence
  chemically synthesized
aaagttatgtatcttggctg

SEQ ID NO: 137524 - DNA, 20 bp, Artificial Sequence
  chemically synthesized
gattaaccagtgcttcagcc

SEQ ID NO: 137525 - DNA, 20 bp, Artificial Sequence
  chemically synthesized
atgtatcttggctgaagcac

SEQ ID NO: 137526 - DNA, 20 bp, Artificial Sequence
  chemically synthesized
tcaacgattaaccagtgctt

SEQ ID NO: 137527 - DNA, 20 bp, Artificial Sequence
  chemically synthesized
tcttcccatcaacgattaac

SEQ ID NO: 137528 - DNA, 20 bp, Artificial Sequence
  chemically synthesized
aagcactggttaatcgttga

SEQ ID NO: 137529 - DNA, 20 bp, Artificial Sequence
  chemically synthesized
agcactggttaatcgttgat

SEQ ID NO: 137530 - DNA, 20 bp, Artificial Sequence
  chemically synthesized
actggttaatcgttgatggg

SEQ ID NO: 137531 - DNA, 20 bp, Artificial Sequence
  chemically synthesized
attctcaggaattaagcaag

SEQ ID NO: 137532 - DNA, 20 bp, Artificial Sequence
  chemically synthesized
cattctcaggaattaagcaa

SEQ ID NO: 137533 - DNA, 20 bp, Artificial Sequence
  chemically synthesized
cgcattctcaggaattaagc

SEQ ID NO: 137534 - DNA, 20 bp, Artificial Sequence
  chemically synthesized
atgcctcttgcttaattcct

SEQ ID NO: 137535 - DNA, 20 bp, Artificial Sequence
  chemically synthesized
gaaacgcattctcaggaatt

SEQ ID NO: 137536 - DNA, 20 bp, Artificial Sequence
  chemically synthesized
gaaatttgaaacgcattctc

SEQ ID NO: 137537 - DNA, 20 bp, Artificial Sequence
  chemically synthesized
agaaatttgaaacgcattct

SEQ ID NO: 137538 - DNA, 20 bp, Artificial Sequence
  chemically synthesized
gagaatgcgtttcaaatttc

SEQ ID NO: 137539 - DNA, 20 bp, Artificial Sequence
  chemically synthesized
aatgcgtttcaaatttctgg

SEQ ID NO: 137540 - DNA, 20 bp, Artificial Sequence
  chemically synthesized
atgcgtttcaaatttctgga

SEQ ID NO: 137541 - DNA, 20 bp, Artificial Sequence
  chemically synthesized
gcgtttcaaatttctggaag

SEQ ID NO: 137542 - DNA, 20 bp, Artificial Sequence
  chemically synthesized
tttcaaatttctggaaggag

SEQ ID NO: 137543 - DNA, 20 bp, Artificial Sequence
  chemically synthesized
agcttcataactgctccttc

SEQ ID NO: 137544 - DNA, 20 bp, Artificial Sequence
  chemically synthesized
ttctggaaggagcagttatg

SEQ ID NO: 137545 - DNA, 20 bp, Artificial Sequence
  chemically synthesized
ttcccccaaaatacattttt

SEQ ID NO: 137546 - DNA, 20 bp, Artificial Sequence
  chemically synthesized
tgaagctaaaaaatgtattt

SEQ ID NO: 137547 - DNA, 20 bp, Artificial Sequence
  chemically synthesized
gaagctaaaaaatgtatttt

SEQ ID NO: 137548 - DNA, 20 bp, Artificial Sequence
  chemically synthesized
aagctaaaaaatgtattttg

SEQ ID NO: 137549 - DNA, 20 bp, Artificial Sequence
  chemically synthesized
agctaaaaaatgtattttgg

SEQ ID NO: 137550 - DNA, 20 bp, Artificial Sequence
  chemically synthesized
aatgtattttgggggaaatc

SEQ ID NO: 137551 - DNA, 20 bp, Artificial Sequence
  chemically synthesized
ttttgggggaaatctggcct

SEQ ID NO: 137552 - DNA, 20 bp, Artificial Sequence
  chemically synthesized
tttgggggaaatctggcctc

SEQ ID NO: 137553 - DNA, 20 bp, Artificial Sequence
  chemically synthesized
tgttcagcttttcctgaggc

SEQ ID NO: 137554 - DNA, 20 bp, Artificial Sequence
  chemically synthesized
gggaaatctggcctcaggaa

SEQ ID NO: 137555 - DNA, 20 bp, Artificial Sequence
  chemically synthesized
gtcctgttcagcttttcctg

SEQ ID NO: 137556 - DNA, 20 bp, Artificial Sequence
  chemically synthesized
tgtcctgttcagcttttcct

SEQ ID NO: 137557 - DNA, 20 bp, Artificial Sequence
  chemically synthesized
tggcctcaggaaaagctgaa

SEQ ID NO: 137558 - DNA, 20 bp, Artificial Sequence
  chemically synthesized
ggcctcaggaaaagctgaac

SEQ ID NO: 137559 - DNA, 20 bp, Artificial Sequence
  chemically synthesized
tcaggaaaagctgaacagga

SEQ ID NO: 137560 - DNA, 20 bp, Artificial Sequence
  chemically synthesized
ccacttctaactgtcctgtt

SEQ ID NO: 137561 - DNA, 20 bp, Artificial Sequence
  chemically synthesized
gaaaagctgaacaggacagt

SEQ ID NO: 137562 - DNA, 20 bp, Artificial Sequence
  chemically synthesized
aagctgaacaggacagttag

SEQ ID NO: 137563 - DNA, 20 bp, Artificial Sequence
  chemically synthesized
ctgaacaggacagttagaag

SEQ ID NO: 137564 - DNA, 20 bp, Artificial Sequence
  chemically synthesized
ggacagttagaagtggttcc

SEQ ID NO: 137565 - DNA, 20 bp, Artificial Sequence
  chemically synthesized
gacagttagaagtggttcca

SEQ ID NO: 137566 - DNA, 20 bp, Artificial Sequence
  chemically synthesized
agttagaagtggttccaagg

SEQ ID NO: 137567 - DNA, 20 bp, Artificial Sequence
  chemically synthesized
gttagaagtggttccaaggt

SEQ ID NO: 137568 - DNA, 20 bp, Artificial Sequence
  chemically synthesized
tagtgatgacagtcccacct

SEQ ID NO: 137569 - DNA, 20 bp, Artificial Sequence
  chemically synthesized
ataaccattgatagtgatga

SEQ ID NO: 137570 - DNA, 20 bp, Artificial Sequence
  chemically synthesized
gggactgtcatcactatcaa

SEQ ID NO: 137571 - DNA, 20 bp, Artificial Sequence
  chemically synthesized
tgttctccaataaccattga

SEQ ID NO: 137572 - DNA, 20 bp, Artificial Sequence
  chemically synthesized
tcatcactatcaatggttat

SEQ ID NO: 137573 - DNA, 20 bp, Artificial Sequence
  chemically synthesized
atcactatcaatggttattg

SEQ ID NO: 137574 - DNA, 20 bp, Artificial Sequence
  chemically synthesized
caatggttattggagaacaa

SEQ ID NO: 137575 - DNA, 20 bp, Artificial Sequence
  chemically synthesized
ttggagaacaaaagtcacta

SEQ ID NO: 137576 - DNA, 20 bp, Artificial Sequence
  chemically synthesized
tggagaacaaaagtcactat

SEQ ID NO: 137577 - DNA, 20 bp, Artificial Sequence
  chemically synthesized
tccctacttcatttttccta

SEQ ID NO: 137578 - DNA, 20 bp, Artificial Sequence
  chemically synthesized
aagtcactataggaaaaatg

SEQ ID NO: 137579 - DNA, 20 bp, Artificial Sequence
  chemically synthesized
tcactataggaaaaatgaag

SEQ ID NO: 137580 - DNA, 20 bp, Artificial Sequence
  chemically synthesized
cactataggaaaaatgaagt

SEQ ID NO: 137581 - DNA, 20 bp, Artificial Sequence
  chemically synthesized
actataggaaaaatgaagta

SEQ ID NO: 137582 - DNA, 20 bp, Artificial Sequence
  chemically synthesized
aatgaagtagggaaacgaca

SEQ ID NO: 137583 - DNA, 20 bp, Artificial Sequence
  chemically synthesized
aagtagggaaacgacaaaga

SEQ ID NO: 137584 - DNA, 20 bp, Artificial Sequence
  chemically synthesized
tagggaaacgacaaagaaag

SEQ ID NO: 137585 - DNA, 20 bp, Artificial Sequence
  chemically synthesized
aagaaagtggtgaatcatct

SEQ ID NO: 137586 - DNA, 20 bp, Artificial Sequence
  chemically synthesized
agaaagtggtgaatcatctg

SEQ ID NO: 137587 - DNA, 20 bp, Artificial Sequence
  chemically synthesized
aagtggtgaatcatctgagg

SEQ ID NO: 137588 - DNA, 20 bp, Artificial Sequence
  chemically synthesized
tttatctccaatttcttcct

SEQ ID NO: 137589 - DNA, 20 bp, Artificial Sequence
  chemically synthesized
gaatcatctgaggaagaaat

SEQ ID NO: 137590 - DNA, 20 bp, Artificial Sequence
  chemically synthesized
atcatctgaggaagaaattg

SEQ ID NO: 137591 - DNA, 20 bp, Artificial Sequence
  chemically synthesized
aggaagaaattggagataaa

SEQ ID NO: 137592 - DNA, 20 bp, Artificial Sequence
  chemically synthesized
ggaagaaattggagataaaa

SEQ ID NO: 137593 - DNA, 20 bp, Artificial Sequence
  chemically synthesized
aagaaattggagataaaaag

SEQ ID NO: 137594 - DNA, 20 bp, Artificial Sequence
  chemically synthesized
gagataaaaaggagaacctg

SEQ ID NO: 137595 - DNA, 20 bp, Artificial Sequence
  chemically synthesized
aaaaggagaacctgtggctt

SEQ ID NO: 137596 - DNA, 20 bp, Artificial Sequence
  chemically synthesized
atcattgttgctgaagccac

SEQ ID NO: 137597 - DNA, 20 bp, Artificial Sequence
  chemically synthesized
catcattgttgctgaagcca

SEQ ID NO: 137598 - DNA, 20 bp, Artificial Sequence
  chemically synthesized
agcagccatcattgttgctg

SEQ ID NO: 137599 - DNA, 20 bp, Artificial Sequence
  chemically synthesized
tgtggcttcagcaacaatga

SEQ ID NO: 137600 - DNA, 20 bp, Artificial Sequence
  chemically synthesized
aatgtcatttgagatttcag

SEQ ID NO: 137601 - DNA, 20 bp, Artificial Sequence
  chemically synthesized
agaaatgtcatttgagattt

SEQ ID NO: 137602 - DNA, 20 bp, Artificial Sequence
  chemically synthesized
taaacctagaaatgtcattt

SEQ ID NO: 137603 - DNA, 20 bp, Artificial Sequence
  chemically synthesized
gaaatctcaaatgacatttc

SEQ ID NO: 137604 - DNA, 20 bp, Artificial Sequence
  chemically synthesized
aaatctcaaatgacatttct

SEQ ID NO: 137605 - DNA, 20 bp, Artificial Sequence
  chemically synthesized
tcaaatgacatttctaggtt

SEQ ID NO: 137606 - DNA, 20 bp, Artificial Sequence
  chemically synthesized
agctaacacttagctaaacc

SEQ ID NO: 137607 - DNA, 20 bp, Artificial Sequence
  chemically synthesized
tgacatttctaggtttagct

SEQ ID NO: 137608 - DNA, 20 bp, Artificial Sequence
  chemically synthesized
ttctaggtttagctaagtgt

SEQ ID NO: 137609 - DNA, 20 bp, Artificial Sequence
  chemically synthesized
ccttggaaacagctaacact

SEQ ID NO: 137610 - DNA, 20 bp, Artificial Sequence
  chemically synthesized
gctaagtgttagctgtttcc

SEQ ID NO: 137611 - DNA, 20 bp, Artificial Sequence
  chemically synthesized
ctaagtgttagctgtttcca

SEQ ID NO: 137612 - DNA, 20 bp, Artificial Sequence
  chemically synthesized
gtctatcctagccttggaaa

SEQ ID NO: 137613 - DNA, 20 bp, Artificial Sequence
  chemically synthesized
gtgttagctgtttccaaggc

SEQ ID NO: 137614 - DNA, 20 bp, Artificial Sequence
  chemically synthesized
tgttagctgtttccaaggct

SEQ ID NO: 137615 - DNA, 20 bp, Artificial Sequence
  chemically synthesized
tcccaagtctatcctagcct

SEQ ID NO: 137616 - DNA, 20 bp, Artificial Sequence
  chemically synthesized
agctgtttccaaggctagga

SEQ ID NO: 137617 - DNA, 20 bp, Artificial Sequence
  chemically synthesized
tgtatttcccaagtctatcc

SEQ ID NO: 137618 - DNA, 20 bp, Artificial Sequence
  chemically synthesized
ttccaaggctaggatagact

SEQ ID NO: 137619 - DNA, 20 bp, Artificial Sequence
  chemically synthesized
tccaaggctaggatagactt

SEQ ID NO: 137620 - DNA, 20 bp, Artificial Sequence
  chemically synthesized
ttgtttcttatgtatttccc

SEQ ID NO: 137621 - DNA, 20 bp, Artificial Sequence
  chemically synthesized
gatagacttgggaaatacat

SEQ ID NO: 137622 - DNA, 20 bp, Artificial Sequence
  chemically synthesized
atgtttctaaaacaaattat

SEQ ID NO: 137623 - DNA, 20 bp, Artificial Sequence
  chemically synthesized
aaacaactaataatttgttt

SEQ ID NO: 137624 - DNA, 20 bp, Artificial Sequence
  chemically synthesized
cttggcaaatagttgcagtt

SEQ ID NO: 137625 - DNA, 20 bp, Artificial Sequence
  chemically synthesized
gagtgcttggcaaatagttg

SEQ ID NO: 137626 - DNA, 20 bp, Artificial Sequence
  chemically synthesized
ctaaactgcaactatttgcc

SEQ ID NO: 137627 - DNA, 20 bp, Artificial Sequence
  chemically synthesized
ctagctgagtgcttggcaaa

SEQ ID NO: 137628 - DNA, 20 bp, Artificial Sequence
  chemically synthesized
gcaactatttgccaagcact

SEQ ID NO: 137629 - DNA, 20 bp, Artificial Sequence
  chemically synthesized
atgtgtactagctgagtgct

SEQ ID NO: 137630 - DNA, 20 bp, Artificial Sequence
  chemically synthesized
ctatttgccaagcactcagc

SEQ ID NO: 137631 - DNA, 20 bp, Artificial Sequence
  chemically synthesized
tttgtctatgtgtactagct

SEQ ID NO: 137632 - DNA, 20 bp, Artificial Sequence
  chemically synthesized
aagcactcagctagtacaca

SEQ ID NO: 137633 - DNA, 20 bp, Artificial Sequence
  chemically synthesized
ttttatttgtctatgtgtac

SEQ ID NO: 137634 - DNA, 20 bp, Artificial Sequence
  chemically synthesized
gttccttgaaaaaagaagac

SEQ ID NO: 137635 - DNA, 20 bp, Artificial Sequence
  chemically synthesized
tataagttccttgaaaaaag

SEQ ID NO: 137636 - DNA, 20 bp, Artificial Sequence
  chemically synthesized
aaaacttgtcttcttttttc

SEQ ID NO: 137637 - DNA, 20 bp, Artificial Sequence
  chemically synthesized
aaacttgtcttcttttttca

SEQ ID NO: 137638 - DNA, 20 bp, Artificial Sequence
  chemically synthesized
gattataagttccttgaaaa

SEQ ID NO: 137639 - DNA, 20 bp, Artificial Sequence
  chemically synthesized
ttttcaaggaacttataatc

SEQ ID NO: 137640 - DNA, 20 bp, Artificial Sequence
  chemically synthesized
gtatttgtttgctagattat

SEQ ID NO: 137641 - DNA, 20 bp, Artificial Sequence
  chemically synthesized
gtttatgagtatttgtttgc

SEQ ID NO: 137642 - DNA, 20 bp, Artificial Sequence
  chemically synthesized
cacaaaaaataattgtttat

SEQ ID NO: 137643 - DNA, 20 bp, Artificial Sequence
  chemically synthesized
ttttttgtgtaataatacaa

SEQ ID NO: 137644 - DNA, 20 bp, Artificial Sequence
  chemically synthesized
tttttgtgtaataatacaat

SEQ ID NO: 137645 - DNA, 20 bp, Artificial Sequence
  chemically synthesized
ttgtgtaataatacaatggg

SEQ ID NO: 137646 - DNA, 20 bp, Artificial Sequence
  chemically synthesized
acaactattgttgttgtcgt

SEQ ID NO: 137647 - DNA, 20 bp, Artificial Sequence
  chemically synthesized
aatgctaacgacaacaacaa

SEQ ID NO: 137648 - DNA, 20 bp, Artificial Sequence
  chemically synthesized
aacaacaatagttgtttatt

SEQ ID NO: 137649 - DNA, 20 bp, Artificial Sequence
  chemically synthesized
tgatagactcttttggcata

SEQ ID NO: 137650 - DNA, 20 bp, Artificial Sequence
  chemically synthesized
gagtgcataccatatgccaa

SEQ ID NO: 137651 - DNA, 20 bp, Artificial Sequence
  chemically synthesized
gtgcataccatatgccaaaa

SEQ ID NO: 137652 - DNA, 20 bp, Artificial Sequence
  chemically synthesized
tatgctgtgatagactcttt

SEQ ID NO: 137653 - DNA, 20 bp, Artificial Sequence
  chemically synthesized
tatgccaaaagagtctatca

SEQ ID NO: 137654 - DNA, 20 bp, Artificial Sequence
  chemically synthesized
ttttaactagtatgctgtga

SEQ ID NO: 137655 - DNA, 20 bp, Artificial Sequence
  chemically synthesized
aagagtctatcacagcatac

SEQ ID NO: 137656 - DNA, 20 bp, Artificial Sequence
  chemically synthesized
tatcacagcatactagttaa

SEQ ID NO: 137657 - DNA, 20 bp, Artificial Sequence
  chemically synthesized
ccagagttcattcttttaac

SEQ ID NO: 137658 - DNA, 20 bp, Artificial Sequence
  chemically synthesized
ctagttaaaagaatgaactc

SEQ ID NO: 137659 - DNA, 20 bp, Artificial Sequence
  chemically synthesized
agttaaaagaatgaactctg

SEQ ID NO: 137660 - DNA, 20 bp, Artificial Sequence
  chemically synthesized
aaaagaatgaactctggagt

SEQ ID NO: 137661 - DNA, 20 bp, Artificial Sequence
  chemically synthesized
aaagaatgaactctggagtc

SEQ ID NO: 137662 - DNA, 20 bp, Artificial Sequence
  chemically synthesized
attgggaaagcctgactcca

SEQ ID NO: 137663 - DNA, 20 bp, Artificial Sequence
  chemically synthesized
aaattgggaaagcctgactc

SEQ ID NO: 137664 - DNA, 20 bp, Artificial Sequence
  chemically synthesized
agccagtatgcaaattggga

SEQ ID NO: 137665 - DNA, 20 bp, Artificial Sequence
  chemically synthesized
tggcagccagtatgcaaatt

SEQ ID NO: 137666 - DNA, 20 bp, Artificial Sequence
  chemically synthesized
gtggcagccagtatgcaaat

SEQ ID NO: 137667 - DNA, 20 bp, Artificial Sequence
  chemically synthesized
ggctttcccaatttgcatac

SEQ ID NO: 137668 - DNA, 20 bp, Artificial Sequence
  chemically synthesized
taaaccgaataggtggcagc

SEQ ID NO: 137669 - DNA, 20 bp, Artificial Sequence
  chemically synthesized
atagtaaaccgaataggtgg

SEQ ID NO: 137670 - DNA, 20 bp, Artificial Sequence
  chemically synthesized
catactggctgccacctatt

SEQ ID NO: 137671 - DNA, 20 bp, Artificial Sequence
  chemically synthesized
aaaatagtaaaccgaatagg

SEQ ID NO: 137672 - DNA, 20 bp, Artificial Sequence
  chemically synthesized
ctgaaaatagtaaaccgaat

SEQ ID NO: 137673 - DNA, 20 bp, Artificial Sequence
  chemically synthesized
actgaaaatagtaaaccgaa

SEQ ID NO: 137674 - DNA, 20 bp, Artificial Sequence
  chemically synthesized
cctattcggtttactatttt

SEQ ID NO: 137675 - DNA, 20 bp, Artificial Sequence
  chemically synthesized
tttaagtaacatactgaaaa

SEQ ID NO: 137676 - DNA, 20 bp, Artificial Sequence
  chemically synthesized
aaatgatacagacagcattt

SEQ ID NO: 137677 - DNA, 20 bp, Artificial Sequence
  chemically synthesized
agtgctggaaatgatacaga

SEQ ID NO: 137678 - DNA, 20 bp, Artificial Sequence
  chemically synthesized
tcacagtgctggaaatgata

SEQ ID NO: 137679 - DNA, 20 bp, Artificial Sequence
  chemically synthesized
aatgctgtctgtatcatttc

SEQ ID NO: 137680 - DNA, 20 bp, Artificial Sequence
  chemically synthesized
gtatctccatttcacagtgc

SEQ ID NO: 137681 - DNA, 20 bp, Artificial Sequence
  chemically synthesized
tcatttccagcactgtgaaa

SEQ ID NO: 137682 - DNA, 20 bp, Artificial Sequence
  chemically synthesized
atttccagcactgtgaaatg

SEQ ID NO: 137683 - DNA, 20 bp, Artificial Sequence
  chemically synthesized
gactcagtatctccatttca

SEQ ID NO: 137684 - DNA, 20 bp, Artificial Sequence
  chemically synthesized
cactgtgaaatggagatact

SEQ ID NO: 137685 - DNA, 20 bp, Artificial Sequence
  chemically synthesized
gaatctgagaggtagagact

SEQ ID NO: 137686 - DNA, 20 bp, Artificial Sequence
  chemically synthesized
gatactgagtctctacctct

SEQ ID NO: 137687 - DNA, 20 bp, Artificial Sequence
  chemically synthesized
cataatgaatctgagaggta

SEQ ID NO: 137688 - DNA, 20 bp, Artificial Sequence
  chemically synthesized
ctcataatgaatctgagagg

SEQ ID NO: 137689 - DNA, 20 bp, Artificial Sequence
  chemically synthesized
attctcataatgaatctgag

SEQ ID NO: 137690 - DNA, 20 bp, Artificial Sequence
  chemically synthesized
aattctcataatgaatctga

SEQ ID NO: 137691 - DNA, 20 bp, Artificial Sequence
  chemically synthesized
ttaattctcataatgaatct

SEQ ID NO: 137692 - DNA, 20 bp, Artificial Sequence
  chemically synthesized
ctacctctcagattcattat

SEQ ID NO: 137693 - DNA, 20 bp, Artificial Sequence
  chemically synthesized
agattcattatgagaattaa

SEQ ID NO: 137694 - DNA, 20 bp, Artificial Sequence
  chemically synthesized
attcattatgagaattaata

SEQ ID NO: 137695 - DNA, 20 bp, Artificial Sequence
  chemically synthesized
ttaatagagttaatatttgt

SEQ ID NO: 137696 - DNA, 20 bp, Artificial Sequence
  chemically synthesized
taatagagttaatatttgta

SEQ ID NO: 137697 - DNA, 20 bp, Artificial Sequence
  chemically synthesized
gttaatatttgtaaggtgtt

SEQ ID NO: 137698 - DNA, 20 bp, Artificial Sequence
  chemically synthesized
ttagaacatttcccatttca

SEQ ID NO: 137699 - DNA, 20 bp, Artificial Sequence
  chemically synthesized
tattgttcttactatgaaat

SEQ ID NO: 137700 - DNA, 20 bp, Artificial Sequence
  chemically synthesized
ttattgttcttactatgaaa

SEQ ID NO: 137701 - DNA, 20 bp, Artificial Sequence
  chemically synthesized
aacatttcccatttcatagt

SEQ ID NO: 137702 - DNA, 20 bp, Artificial Sequence
  chemically synthesized
tttcatagtaagaacaataa

SEQ ID NO: 137703 - DNA, 20 bp, Artificial Sequence
  chemically synthesized
aagttttaaataaaaactat

SEQ ID NO: 137704 - DNA, 20 bp, Artificial Sequence
  chemically synthesized
atgataattacattgactga

SEQ ID NO: 137705 - DNA, 20 bp, Artificial Sequence
  chemically synthesized
taattatcatattactctgt

SEQ ID NO: 137706 - DNA, 20 bp, Artificial Sequence
  chemically synthesized
aattatcatattactctgtg

SEQ ID NO: 137707 - DNA, 20 bp, Artificial Sequence
  chemically synthesized
tatcatattactctgtgagg

SEQ ID NO: 137708 - DNA, 20 bp, Artificial Sequence
  chemically synthesized
atattagtacccacctcaca

SEQ ID NO: 137709 - DNA, 20 bp, Artificial Sequence
  chemically synthesized
atcatattactctgtgaggt

SEQ ID NO: 137710 - DNA, 20 bp, Artificial Sequence
  chemically synthesized
caatattagtacccacctca

SEQ ID NO: 137711 - DNA, 20 bp, Artificial Sequence
  chemically synthesized
tagtaaaataggggcaatat

SEQ ID NO: 137712 - DNA, 20 bp, Artificial Sequence
  chemically synthesized
tttctttactagtaaaatag

SEQ ID NO: 137713 - DNA, 20 bp, Artificial Sequence
  chemically synthesized
ttttctttactagtaaaata

SEQ ID NO: 137714 - DNA, 20 bp, Artificial Sequence
  chemically synthesized
taatattgcccctattttac

SEQ ID NO: 137715 - DNA, 20 bp, Artificial Sequence
  chemically synthesized
attttctttactagtaaaat

SEQ ID NO: 137716 - DNA, 20 bp, Artificial Sequence
  chemically synthesized
cattttctttactagtaaaa

SEQ ID NO: 137717 - DNA, 20 bp, Artificial Sequence
  chemically synthesized
ttgcccctattttactagta

SEQ ID NO: 137718 - DNA, 20 bp, Artificial Sequence
  chemically synthesized
ttttcattcattttctttac

SEQ ID NO: 137719 - DNA, 20 bp, Artificial Sequence
  chemically synthesized
agtaaagaaaatgaatgaaa

SEQ ID NO: 137720 - DNA, 20 bp, Artificial Sequence
  chemically synthesized
aaagaaaatgaatgaaaaag

SEQ ID NO: 137721 - DNA, 20 bp, Artificial Sequence
  chemically synthesized
aagaagttaaacaatttgtc

SEQ ID NO: 137722 - DNA, 20 bp, Artificial Sequence
  chemically synthesized
agaagttaaacaatttgtct

SEQ ID NO: 137723 - DNA, 20 bp, Artificial Sequence
  chemically synthesized
cacttattaccatgtgatcc

SEQ ID NO: 137724 - DNA, 20 bp, Artificial Sequence
  chemically synthesized
acaatttgtctaggatcaca

SEQ ID NO: 137725 - DNA, 20 bp, Artificial Sequence
  chemically synthesized
gtctaggatcacatggtaat

SEQ ID NO: 137726 - DNA, 20 bp, Artificial Sequence
  chemically synthesized
taggatcacatggtaataag

SEQ ID NO: 137727 - DNA, 20 bp, Artificial Sequence
  chemically synthesized
gatcacatggtaataagtgg

SEQ ID NO: 137728 - DNA, 20 bp, Artificial Sequence
  chemically synthesized
aagtggcagaacttctaaca

SEQ ID NO: 137729 - DNA, 20 bp, Artificial Sequence
  chemically synthesized
agtggcagaacttctaacat

SEQ ID NO: 137730 - DNA, 20 bp, Artificial Sequence
  chemically synthesized
ggccaacttacctatgttag

SEQ ID NO: 137731 - DNA, 20 bp, Artificial Sequence
  chemically synthesized
tggggccaacttacctatgt

SEQ ID NO: 137732 - DNA, 20 bp, Artificial Sequence
  chemically synthesized
gcagaacttctaacataggt

SEQ ID NO: 137733 - DNA, 20 bp, Artificial Sequence
  chemically synthesized
aacttctaacataggtaagt

SEQ ID NO: 137734 - DNA, 20 bp, Artificial Sequence
  chemically synthesized
acataggtaagttggcccca

SEQ ID NO: 137735 - DNA, 20 bp, Artificial Sequence
  chemically synthesized
tcttaagtgtgtgggctttg

SEQ ID NO: 137736 - DNA, 20 bp, Artificial Sequence
  chemically synthesized
ttcttaagtgtgtgggcttt

SEQ ID NO: 137737 - DNA, 20 bp, Artificial Sequence
  chemically synthesized
gttcttaagtgtgtgggctt

SEQ ID NO: 137738 - DNA, 20 bp, Artificial Sequence
  chemically synthesized
attatagttcttaagtgtgt

SEQ ID NO: 137739 - DNA, 20 bp, Artificial Sequence
  chemically synthesized
gccccaaagcccacacactt

SEQ ID NO: 137740 - DNA, 20 bp, Artificial Sequence
  chemically synthesized
tattatagttcttaagtgtg

SEQ ID NO: 137741 - DNA, 20 bp, Artificial Sequence
  chemically synthesized
catgctatattatagttctt

SEQ ID NO: 137742 - DNA, 20 bp, Artificial Sequence
  chemically synthesized
cacacttaagaactataata

SEQ ID NO: 137743 - DNA, 20 bp, Artificial Sequence
  chemically synthesized
aagtatatcatgctatatta

SEQ ID NO: 137744 - DNA, 20 bp, Artificial Sequence
  chemically synthesized
atatagcatgatatacttac

SEQ ID NO: 137745 - DNA, 20 bp, Artificial Sequence
  chemically synthesized
tatagcatgatatacttaca

SEQ ID NO: 137746 - DNA, 20 bp, Artificial Sequence
  chemically synthesized
ctatgacatgagtaccttgt

SEQ ID NO: 137747 - DNA, 20 bp, Artificial Sequence
  chemically synthesized
cttacaaggtactcatgtca

SEQ ID NO: 137748 - DNA, 20 bp, Artificial Sequence
  chemically synthesized
cttatattatactatgacat

SEQ ID NO: 137749 - DNA, 20 bp, Artificial Sequence
  chemically synthesized
ctcatgtcatagtataatat

SEQ ID NO: 137750 - DNA, 20 bp, Artificial Sequence
  chemically synthesized
tcatgtcatagtataatata

SEQ ID NO: 137751 - DNA, 20 bp, Artificial Sequence
  chemically synthesized
tgtcatagtataatataagg

SEQ ID NO: 137752 - DNA, 20 bp, Artificial Sequence
  chemically synthesized
aatataaggtagctatatga

SEQ ID NO: 137753 - DNA, 20 bp, Artificial Sequence
  chemically synthesized
tattatatcatactatcata

SEQ ID NO: 137754 - DNA, 20 bp, Artificial Sequence
  chemically synthesized
tatgatagtatgatataata

SEQ ID NO: 137755 - DNA, 20 bp, Artificial Sequence
  chemically synthesized
atgatagtatgatataatat

SEQ ID NO: 137756 - DNA, 20 bp, Artificial Sequence
  chemically synthesized
agtatgatataatataggaa

SEQ ID NO: 137757 - DNA, 20 bp, Artificial Sequence
  chemically synthesized
atataatataggaatggata

SEQ ID NO: 137758 - DNA, 20 bp, Artificial Sequence
  chemically synthesized
tataatataggaatggataa

SEQ ID NO: 137759 - DNA, 20 bp, Artificial Sequence
  chemically synthesized
ataatataggaatggataaa

SEQ ID NO: 137760 - DNA, 20 bp, Artificial Sequence
  chemically synthesized
tataggaatggataaaggga

SEQ ID NO: 137761 - DNA, 20 bp, Artificial Sequence
  chemically synthesized
ataggaatggataaagggac

SEQ ID NO: 137762 - DNA, 20 bp, Artificial Sequence
  chemically synthesized
taggaatggataaagggaca

SEQ ID NO: 137763 - DNA, 20 bp, Artificial Sequence
  chemically synthesized
aagggacagggatatgaaac

SEQ ID NO: 137764 - DNA, 20 bp, Artificial Sequence
  chemically synthesized
gatatgaaacgagaatacaa

SEQ ID NO: 137765 - DNA, 20 bp, Artificial Sequence
  chemically synthesized
atatgaaacgagaatacaaa

SEQ ID NO: 137766 - DNA, 20 bp, Artificial Sequence
  chemically synthesized
tatgaaacgagaatacaaaa

SEQ ID NO: 137767 - DNA, 20 bp, Artificial Sequence
  chemically synthesized
atgaaacgagaatacaaaag

SEQ ID NO: 137768 - DNA, 20 bp, Artificial Sequence
  chemically synthesized
taatctgtccttgaatgaaa

SEQ ID NO: 137769 - DNA, 20 bp, Artificial Sequence
  chemically synthesized
ggaaattaactatttcattc

SEQ ID NO: 137770 - DNA, 20 bp, Artificial Sequence
  chemically synthesized
gaaattaactatttcattca

SEQ ID NO: 137771 - DNA, 20 bp, Artificial Sequence
  chemically synthesized
ttaactatttcattcaagga

SEQ ID NO: 137772 - DNA, 20 bp, Artificial Sequence
  chemically synthesized
ggacagattatattctgaat

SEQ ID NO: 137773 - DNA, 20 bp, Artificial Sequence
  chemically synthesized
tgcaagaaccatgactgatt

SEQ ID NO: 137774 - DNA, 20 bp, Artificial Sequence
  chemically synthesized
attatattctgaatcagtca

SEQ ID NO: 137775 - DNA, 20 bp, Artificial Sequence
  chemically synthesized
ttgaatgaactatttattgc

SEQ ID NO: 137776 - DNA, 20 bp, Artificial Sequence
  chemically synthesized
gtcatggttcttgcaataaa

SEQ ID NO: 137777 - DNA, 20 bp, Artificial Sequence
  chemically synthesized
tgcaataaatagttcattca

SEQ ID NO: 137778 - DNA, 20 bp, Artificial Sequence
  chemically synthesized
aataaatagttcattcaaag

SEQ ID NO: 137779 - DNA, 20 bp, Artificial Sequence
  chemically synthesized
ataaatagttcattcaaagt

SEQ ID NO: 137780 - DNA, 20 bp, Artificial Sequence
  chemically synthesized
tagttcattcaaagtgggat

SEQ ID NO: 137781 - DNA, 20 bp, Artificial Sequence
  chemically synthesized
agttcattcaaagtgggatg

SEQ ID NO: 137782 - DNA, 20 bp, Artificial Sequence
  chemically synthesized
ttcattcaaagtgggatgag

SEQ ID NO: 137783 - DNA, 20 bp, Artificial Sequence
  chemically synthesized
tcattcaaagtgggatgagg

SEQ ID NO: 137784 - DNA, 20 bp, Artificial Sequence
  chemically synthesized
ctttcaggccttgaggagga

SEQ ID NO: 137785 - DNA, 20 bp, Artificial Sequence
  chemically synthesized
atgaggaggctttcctcctc

SEQ ID NO: 137786 - DNA, 20 bp, Artificial Sequence
  chemically synthesized
tgaggaggctttcctcctca

SEQ ID NO: 137787 - DNA, 20 bp, Artificial Sequence
  chemically synthesized
tagcctttcaggccttgagg

SEQ ID NO: 137788 - DNA, 20 bp, Artificial Sequence
  chemically synthesized
ttagcctttcaggccttgag

SEQ ID NO: 137789 - DNA, 20 bp, Artificial Sequence
  chemically synthesized
ccttagcctttcaggccttg

SEQ ID NO: 137790 - DNA, 20 bp, Artificial Sequence
  chemically synthesized
cccttagcctttcaggcctt

SEQ ID NO: 137791 - DNA, 20 bp, Artificial Sequence
  chemically synthesized
ctttcctcctcaaggcctga

SEQ ID NO: 137792 - DNA, 20 bp, Artificial Sequence
  chemically synthesized
tttcctcctcaaggcctgaa

SEQ ID NO: 137793 - DNA, 20 bp, Artificial Sequence
  chemically synthesized
taccctccccttagcctttc

SEQ ID NO: 137794 - DNA, 20 bp, Artificial Sequence
  chemically synthesized
tcctcaaggcctgaaaggct

SEQ ID NO: 137795 - DNA, 20 bp, Artificial Sequence
  chemically synthesized
ataccctccccttagccttt

SEQ ID NO: 137796 - DNA, 20 bp, Artificial Sequence
  chemically synthesized
cctcaaggcctgaaaggcta

SEQ ID NO: 137797 - DNA, 20 bp, Artificial Sequence
  chemically synthesized
ctcaaggcctgaaaggctaa

SEQ ID NO: 137798 - DNA, 20 bp, Artificial Sequence
  chemically synthesized
tcaaggcctgaaaggctaag

SEQ ID NO: 137799 - DNA, 20 bp, Artificial Sequence
  chemically synthesized
aaggcctgaaaggctaaggg

SEQ ID NO: 137800 - DNA, 20 bp, Artificial Sequence
  chemically synthesized
aggcctgaaaggctaagggg

SEQ ID NO: 137801 - DNA, 20 bp, Artificial Sequence
  chemically synthesized
ggcctgaaaggctaagggga

SEQ ID NO: 137802 - DNA, 20 bp, Artificial Sequence
  chemically synthesized
tactaactataccctcccct

SEQ ID NO: 137803 - DNA, 20 bp, Artificial Sequence
  chemically synthesized
gaaaggctaaggggagggta

SEQ ID NO: 137804 - DNA, 20 bp, Artificial Sequence
  chemically synthesized
ggctaaggggagggtatagt

SEQ ID NO: 137805 - DNA, 20 bp, Artificial Sequence
  chemically synthesized
taaggggagggtatagttag

SEQ ID NO: 137806 - DNA, 20 bp, Artificial Sequence
  chemically synthesized
gggtatagttagtagaatct

SEQ ID NO: 137807 - DNA, 20 bp, Artificial Sequence
  chemically synthesized
tatagttagtagaatctgag

SEQ ID NO: 137808 - DNA, 20 bp, Artificial Sequence
  chemically synthesized
agttagtagaatctgagaag

SEQ ID NO: 137809 - DNA, 20 bp, Artificial Sequence
  chemically synthesized
ttgtccctgcagccacttct

SEQ ID NO: 137810 - DNA, 20 bp, Artificial Sequence
  chemically synthesized
tagaatctgagaagtggctg

SEQ ID NO: 137811 - DNA, 20 bp, Artificial Sequence
  chemically synthesized
agaatctgagaagtggctgc

SEQ ID NO: 137812 - DNA, 20 bp, Artificial Sequence
  chemically synthesized
gaatctgagaagtggctgca

SEQ ID NO: 137813 - DNA, 20 bp, Artificial Sequence
  chemically synthesized
tgagaagtggctgcagggac

SEQ ID NO: 137814 - DNA, 20 bp, Artificial Sequence
  chemically synthesized
gtcaagaggtcttgtccctg

SEQ ID NO: 137815 - DNA, 20 bp, Artificial Sequence
  chemically synthesized
gcagggacaagacctcttga

SEQ ID NO: 137816 - DNA, 20 bp, Artificial Sequence
  chemically synthesized
cagggacaagacctcttgac

SEQ ID NO: 137817 - DNA, 20 bp, Artificial Sequence
  chemically synthesized
cagccccagctcctgtcaag

SEQ ID NO: 137818 - DNA, 20 bp, Artificial Sequence
  chemically synthesized
gggacaagacctcttgacag

SEQ ID NO: 137819 - DNA, 20 bp, Artificial Sequence
  chemically synthesized
acagccccagctcctgtcaa

SEQ ID NO: 137820 - DNA, 20 bp, Artificial Sequence
  chemically synthesized
tcacagccccagctcctgtc

SEQ ID NO: 137821 - DNA, 20 bp, Artificial Sequence
  chemically synthesized
caagacctcttgacaggagc

SEQ ID NO: 137822 - DNA, 20 bp, Artificial Sequence
  chemically synthesized
aagacctcttgacaggagct

SEQ ID NO: 137823 - DNA, 20 bp, Artificial Sequence
  chemically synthesized
agacctcttgacaggagctg

SEQ ID NO: 137824 - DNA, 20 bp, Artificial Sequence
  chemically synthesized
ttgacaggagctggggctgt

SEQ ID NO: 137825 - DNA, 20 bp, Artificial Sequence
  chemically synthesized
ggttcctttactcacagccc

SEQ ID NO: 137826 - DNA, 20 bp, Artificial Sequence
  chemically synthesized
aggagctggggctgtgagta

SEQ ID NO: 137827 - DNA, 20 bp, Artificial Sequence
  chemically synthesized
ggagctggggctgtgagtaa

SEQ ID NO: 137828 - DNA, 20 bp, Artificial Sequence
  chemically synthesized
tggctaggttcctttactca

SEQ ID NO: 137829 - DNA, 20 bp, Artificial Sequence
  chemically synthesized
gggctgtgagtaaaggaacc

SEQ ID NO: 137830 - DNA, 20 bp, Artificial Sequence
  chemically synthesized
gagtgagtcgagggatggct

SEQ ID NO: 137831 - DNA, 20 bp, Artificial Sequence
  chemically synthesized
agagtgagtcgagggatggc

SEQ ID NO: 137832 - DNA, 20 bp, Artificial Sequence
  chemically synthesized
gaggagagtgagtcgaggga

SEQ ID NO: 137833 - DNA, 20 bp, Artificial Sequence
  chemically synthesized
atgagaggagagtgagtcga

SEQ ID NO: 137834 - DNA, 20 bp, Artificial Sequence
  chemically synthesized
gatgagaggagagtgagtcg

SEQ ID NO: 137835 - DNA, 20 bp, Artificial Sequence
  chemically synthesized
ggatgagaggagagtgagtc

SEQ ID NO: 137836 - DNA, 20 bp, Artificial Sequence
  chemically synthesized
tcaatggatgagaggagagt

SEQ ID NO: 137837 - DNA, 20 bp, Artificial Sequence
  chemically synthesized
cagatcaatggatgagagga

SEQ ID NO: 137838 - DNA, 20 bp, Artificial Sequence
  chemically synthesized
agcagatcaatggatgagag

SEQ ID NO: 137839 - DNA, 20 bp, Artificial Sequence
  chemically synthesized
tcagcagatcaatggatgag

SEQ ID NO: 137840 - DNA, 20 bp, Artificial Sequence
  chemically synthesized
atcagcagatcaatggatga

SEQ ID NO: 137841 - DNA, 20 bp, Artificial Sequence
  chemically synthesized
gcatcagcagatcaatggat

SEQ ID NO: 137842 - DNA, 20 bp, Artificial Sequence
  chemically synthesized
gggaggcatcagcagatcaa

SEQ ID NO: 137843 - DNA, 20 bp, Artificial Sequence
  chemically synthesized
cttgtgttgggaggcatcag

SEQ ID NO: 137844 - DNA, 20 bp, Artificial Sequence
  chemically synthesized
gtccttgtgttgggaggcat

SEQ ID NO: 137845 - DNA, 20 bp, Artificial Sequence
  chemically synthesized
ggcttggtccttgtgttggg

SEQ ID NO: 137846 - DNA, 20 bp, Artificial Sequence
  chemically synthesized
ctgctgatgcctcccaacac

SEQ ID NO: 137847 - DNA, 20 bp, Artificial Sequence
  chemically synthesized
tggcttggtccttgtgttgg

SEQ ID NO: 137848 - DNA, 20 bp, Artificial Sequence
  chemically synthesized
tgctgatgcctcccaacaca

SEQ ID NO: 137849 - DNA, 20 bp, Artificial Sequence
  chemically synthesized
attggcttggtccttgtgtt

SEQ ID NO: 137850 - DNA, 20 bp, Artificial Sequence
  chemically synthesized
tattggcttggtccttgtgt

SEQ ID NO: 137851 - DNA, 20 bp, Artificial Sequence
  chemically synthesized
tgcctcccaacacaaggacc

SEQ ID NO: 137852 - DNA, 20 bp, Artificial Sequence
  chemically synthesized
caacacaaggaccaagccaa

SEQ ID NO: 137853 - DNA, 20 bp, Artificial Sequence
  chemically synthesized
ggcttgcttgtctattggct

SEQ ID NO: 137854 - DNA, 20 bp, Artificial Sequence
  chemically synthesized
caaggaccaagccaatagac

SEQ ID NO: 137855 - DNA, 20 bp, Artificial Sequence
  chemically synthesized
cattgggcttgcttgtctat

SEQ ID NO: 137856 - DNA, 20 bp, Artificial Sequence
  chemically synthesized
gaccaagccaatagacaagc

SEQ ID NO: 137857 - DNA, 20 bp, Artificial Sequence
  chemically synthesized
accaatatggcagtagcatt

SEQ ID NO: 137858 - DNA, 20 bp, Artificial Sequence
  chemically synthesized
gaccaatatggcagtagcat

SEQ ID NO: 137859 - DNA, 20 bp, Artificial Sequence
  chemically synthesized
gaggttgaccaatatggcag

SEQ ID NO: 137860 - DNA, 20 bp, Artificial Sequence
  chemically synthesized
gcccaatgctactgccatat

SEQ ID NO: 137861 - DNA, 20 bp, Artificial Sequence
  chemically synthesized
taggaggttgaccaatatgg

SEQ ID NO: 137862 - DNA, 20 bp, Artificial Sequence
  chemically synthesized
ccctaggaggttgaccaata

SEQ ID NO: 137863 - DNA, 20 bp, Artificial Sequence
  chemically synthesized
tgccatattggtcaacctcc

SEQ ID NO: 137864 - DNA, 20 bp, Artificial Sequence
  chemically synthesized
gccatattggtcaacctcct

SEQ ID NO: 137865 - DNA, 20 bp, Artificial Sequence
  chemically synthesized
ccatattggtcaacctccta

SEQ ID NO: 137866 - DNA, 20 bp, Artificial Sequence
  chemically synthesized
tattggtcaacctcctaggg

SEQ ID NO: 137867 - DNA, 20 bp, Artificial Sequence
  chemically synthesized
acctgttgttctaccctagg

SEQ ID NO: 137868 - DNA, 20 bp, Artificial Sequence
  chemically synthesized
aacctgttgttctaccctag

SEQ ID NO: 137869 - DNA, 20 bp, Artificial Sequence
  chemically synthesized
ctaacctgttgttctaccct

SEQ ID NO: 137870 - DNA, 20 bp, Artificial Sequence
  chemically synthesized
tctaacctgttgttctaccc

SEQ ID NO: 137871 - DNA, 20 bp, Artificial Sequence
  chemically synthesized
aacctcctagggtagaacaa

SEQ ID NO: 137872 - DNA, 20 bp, Artificial Sequence
  chemically synthesized
acctcctagggtagaacaac

SEQ ID NO: 137873 - DNA, 20 bp, Artificial Sequence
  chemically synthesized
cctagggtagaacaacaggt

SEQ ID NO: 137874 - DNA, 20 bp, Artificial Sequence
  chemically synthesized
tagggtagaacaacaggtta

SEQ ID NO: 137875 - DNA, 20 bp, Artificial Sequence
  chemically synthesized
tagaacaacaggttagagat

SEQ ID NO: 137876 - DNA, 20 bp, Artificial Sequence
  chemically synthesized
gttagagattggatctgcga

SEQ ID NO: 137877 - DNA, 20 bp, Artificial Sequence
  chemically synthesized
actgttgctggatactttcg

SEQ ID NO: 137878 - DNA, 20 bp, Artificial Sequence
  chemically synthesized
attggatctgcgaaagtatc

SEQ ID NO: 137879 - DNA, 20 bp, Artificial Sequence
  chemically synthesized
tctgcgaaagtatccagcaa

SEQ ID NO: 137880 - DNA, 20 bp, Artificial Sequence
  chemically synthesized
tattttttttatactgttgc

SEQ ID NO: 137881 - DNA, 20 bp, Artificial Sequence
  chemically synthesized
tataaaaaaaataataataa

SEQ ID NO: 137882 - DNA, 20 bp, Artificial Sequence
  chemically synthesized
ccttcactgatttgtttcaa

SEQ ID NO: 137883 - DNA, 20 bp, Artificial Sequence
  chemically synthesized
caacaactattgaaacaaat

SEQ ID NO: 137884 - DNA, 20 bp, Artificial Sequence
  chemically synthesized
actattgaaacaaatcagtg

SEQ ID NO: 137885 - DNA, 20 bp, Artificial Sequence
  chemically synthesized
ctattgaaacaaatcagtga

SEQ ID NO: 137886 - DNA, 20 bp, Artificial Sequence
  chemically synthesized
gtgaaggaaatgaccacata

SEQ ID NO: 137887 - DNA, 20 bp, Artificial Sequence
  chemically synthesized
tgaaggaaatgaccacatat

SEQ ID NO: 137888 - DNA, 20 bp, Artificial Sequence
  chemically synthesized
ttgctgagaattcccatatg

SEQ ID NO: 137889 - DNA, 20 bp, Artificial Sequence
  chemically synthesized
tgaccacatatgggaattct

SEQ ID NO: 137890 - DNA, 20 bp, Artificial Sequence
  chemically synthesized
acatatgggaattctcagca

SEQ ID NO: 137891 - DNA, 20 bp, Artificial Sequence
  chemically synthesized
cttgatatgaagtctttgct

SEQ ID NO: 137892 - DNA, 20 bp, Artificial Sequence
  chemically synthesized
ctcagcaaagacttcatatc

SEQ ID NO: 137893 - DNA, 20 bp, Artificial Sequence
  chemically synthesized
gtagtgccatacttgatatg

SEQ ID NO: 137894 - DNA, 20 bp, Artificial Sequence
  chemically synthesized
caaagacttcatatcaagta

SEQ ID NO: 137895 - DNA, 20 bp, Artificial Sequence
  chemically synthesized
tcatatcaagtatggcacta

SEQ ID NO: 137896 - DNA, 20 bp, Artificial Sequence
  chemically synthesized
aatctgccaaagttcagctg

SEQ ID NO: 137897 - DNA, 20 bp, Artificial Sequence
  chemically synthesized
atggcactacagctgaactt

SEQ ID NO: 137898 - DNA, 20 bp, Artificial Sequence
  chemically synthesized
tagccaaatctgccaaagtt

SEQ ID NO: 137899 - DNA, 20 bp, Artificial Sequence
  chemically synthesized
gcactacagctgaactttgg

SEQ ID NO: 137900 - DNA, 20 bp, Artificial Sequence
  chemically synthesized
ttctctagccaaatctgcca

SEQ ID NO: 137901 - DNA, 20 bp, Artificial Sequence
  chemically synthesized
cagctgaactttggcagatt

SEQ ID NO: 137902 - DNA, 20 bp, Artificial Sequence
  chemically synthesized
tgaactttggcagatttggc

SEQ ID NO: 137903 - DNA, 20 bp, Artificial Sequence
  chemically synthesized
aactttggcagatttggcta

SEQ ID NO: 137904 - DNA, 20 bp, Artificial Sequence
  chemically synthesized
ggcagatttggctagagaat

SEQ ID NO: 137905 - DNA, 20 bp, Artificial Sequence
  chemically synthesized
ataatgctcttctcattctc

SEQ ID NO: 137906 - DNA, 20 bp, Artificial Sequence
  chemically synthesized
agatttggctagagaatgag

SEQ ID NO: 137907 - DNA, 20 bp, Artificial Sequence
  chemically synthesized
atttggctagagaatgagaa

SEQ ID NO: 137908 - DNA, 20 bp, Artificial Sequence
  chemically synthesized
gagaatgagaagagcattat

SEQ ID NO: 137909 - DNA, 20 bp, Artificial Sequence
  chemically synthesized
agaatgagaagagcattata

SEQ ID NO: 137910 - DNA, 20 bp, Artificial Sequence
  chemically synthesized
gaatgagaagagcattataa

SEQ ID NO: 137911 - DNA, 20 bp, Artificial Sequence
  chemically synthesized
gagaagagcattataaggga

SEQ ID NO: 137912 - DNA, 20 bp, Artificial Sequence
  chemically synthesized
agagcattataagggaaaga

SEQ ID NO: 137913 - DNA, 20 bp, Artificial Sequence
  chemically synthesized
gggaaagacagacatgaaca

SEQ ID NO: 137914 - DNA, 20 bp, Artificial Sequence
  chemically synthesized
ggaaagacagacatgaacaa

SEQ ID NO: 137915 - DNA, 20 bp, Artificial Sequence
  chemically synthesized
aaaggcatgaacgtaaaata

SEQ ID NO: 137916 - DNA, 20 bp, Artificial Sequence
  chemically synthesized
acgtaaaataaagcctcaaa

SEQ ID NO: 137917 - DNA, 20 bp, Artificial Sequence
  chemically synthesized
cgtaaaataaagcctcaaat

SEQ ID NO: 137918 - DNA, 20 bp, Artificial Sequence
  chemically synthesized
ggctctaaccagcccatttg

SEQ ID NO: 137919 - DNA, 20 bp, Artificial Sequence
  chemically synthesized
aggctctaaccagcccattt

SEQ ID NO: 137920 - DNA, 20 bp, Artificial Sequence
  chemically synthesized
aaataaagcctcaaatgggc

SEQ ID NO: 137921 - DNA, 20 bp, Artificial Sequence
  chemically synthesized
aaagcctcaaatgggctggt

SEQ ID NO: 137922 - DNA, 20 bp, Artificial Sequence
  chemically synthesized
agcctcaaatgggctggtta

SEQ ID NO: 137923 - DNA, 20 bp, Artificial Sequence
  chemically synthesized
aaagaattccaggctctaac

SEQ ID NO: 137924 - DNA, 20 bp, Artificial Sequence
  chemically synthesized
caaatgggctggttagagcc

SEQ ID NO: 137925 - DNA, 20 bp, Artificial Sequence
  chemically synthesized
cattatttgtaaagaattcc

SEQ ID NO: 137926 - DNA, 20 bp, Artificial Sequence
  chemically synthesized
ccattatttgtaaagaattc

SEQ ID NO: 137927 - DNA, 20 bp, Artificial Sequence
  chemically synthesized
cttatttgccattatttgta

SEQ ID NO: 137928 - DNA, 20 bp, Artificial Sequence
  chemically synthesized
ctggaattctttacaaataa

SEQ ID NO: 137929 - DNA, 20 bp, Artificial Sequence
  chemically synthesized
ctttacaaataatggcaaat

SEQ ID NO: 137930 - DNA, 20 bp, Artificial Sequence
  chemically synthesized
caaataatggcaaataagtt

SEQ ID NO: 137931 - DNA, 20 bp, Artificial Sequence
  chemically synthesized
aaataatggcaaataagttt

SEQ ID NO: 137932 - DNA, 20 bp, Artificial Sequence
  chemically synthesized
taatggcaaataagtttagg

SEQ ID NO: 137933 - DNA, 20 bp, Artificial Sequence
  chemically synthesized
caaataagtttaggtagaca

SEQ ID NO: 137934 - DNA, 20 bp, Artificial Sequence
  chemically synthesized
ataagtttaggtagacatag

SEQ ID NO: 137935 - DNA, 20 bp, Artificial Sequence
  chemically synthesized
agtttaggtagacatagtag

SEQ ID NO: 137936 - DNA, 20 bp, Artificial Sequence
  chemically synthesized
ttaggtagacatagtagaag

SEQ ID NO: 137937 - DNA, 20 bp, Artificial Sequence
  chemically synthesized
gacatagtagaagcagtata

SEQ ID NO: 137938 - DNA, 20 bp, Artificial Sequence
  chemically synthesized
tagtagaagcagtatatagt

SEQ ID NO: 137939 - DNA, 20 bp, Artificial Sequence
  chemically synthesized
acctcaaactgatttttaaa

SEQ ID NO: 137940 - DNA, 20 bp, Artificial Sequence
  chemically synthesized
atagttggctttttaaaaat

SEQ ID NO: 137941 - DNA, 20 bp, Artificial Sequence
  chemically synthesized
ggctttttaaaaatcagttt

SEQ ID NO: 137942 - DNA, 20 bp, Artificial Sequence
  chemically synthesized
gctttttaaaaatcagtttg

SEQ ID NO: 137943 - DNA, 20 bp, Artificial Sequence
  chemically synthesized
gaggttttgaattttatcac

SEQ ID NO: 137944 - DNA, 20 bp, Artificial Sequence
  chemically synthesized
aggttttgaattttatcaca

SEQ ID NO: 137945 - DNA, 20 bp, Artificial Sequence
  chemically synthesized
aattttatcacaaggacaac

SEQ ID NO: 137946 - DNA, 20 bp, Artificial Sequence
  chemically synthesized
attttatcacaaggacaact

SEQ ID NO: 137947 - DNA, 20 bp, Artificial Sequence
  chemically synthesized
ttatcacaaggacaactggg

SEQ ID NO: 137948 - DNA, 20 bp, Artificial Sequence
  chemically synthesized
tcacaaggacaactgggaag

SEQ ID NO: 137949 - DNA, 20 bp, Artificial Sequence
  chemically synthesized
tctgcaagttcgctgcttcc

SEQ ID NO: 137950 - DNA, 20 bp, Artificial Sequence
  chemically synthesized
actgggaagcagcgaacttg

SEQ ID NO: 137951 - DNA, 20 bp, Artificial Sequence
  chemically synthesized
tagcctcagtttttttctgc

SEQ ID NO: 137952 - DNA, 20 bp, Artificial Sequence
  chemically synthesized
cgaacttgcagaaaaaaact

SEQ ID NO: 137953 - DNA, 20 bp, Artificial Sequence
  chemically synthesized
gaacttgcagaaaaaaactg

SEQ ID NO: 137954 - DNA, 20 bp, Artificial Sequence
  chemically synthesized
gcagaaaaaaactgaggcta

SEQ ID NO: 137955 - DNA, 20 bp, Artificial Sequence
  chemically synthesized
cagaaaaaaactgaggctat

SEQ ID NO: 137956 - DNA, 20 bp, Artificial Sequence
  chemically synthesized
aagctttgctcctatagcct

SEQ ID NO: 137957 - DNA, 20 bp, Artificial Sequence
  chemically synthesized
gaaaaaaactgaggctatag

SEQ ID NO: 137958 - DNA, 20 bp, Artificial Sequence
  chemically synthesized
tactgaaagctttgctccta

SEQ ID NO: 137959 - DNA, 20 bp, Artificial Sequence
  chemically synthesized
aaactgaggctataggagca

SEQ ID NO: 137960 - DNA, 20 bp, Artificial Sequence
  chemically synthesized
ggctataggagcaaagcttt

SEQ ID NO: 137961 - DNA, 20 bp, Artificial Sequence
  chemically synthesized
tggaggcacaggattactga

SEQ ID NO: 137962 - DNA, 20 bp, Artificial Sequence
  chemically synthesized
aacaaaatctatggaggcac

SEQ ID NO: 137963 - DNA, 20 bp, Artificial Sequence
  chemically synthesized
gaacaaaatctatggaggca

SEQ ID NO: 137964 - DNA, 20 bp, Artificial Sequence
  chemically synthesized
tcagtaatcctgtgcctcca

SEQ ID NO: 137965 - DNA, 20 bp, Artificial Sequence
  chemically synthesized
agaaagaacaaaatctatgg

SEQ ID NO: 137966 - DNA, 20 bp, Artificial Sequence
  chemically synthesized
cagaaagaacaaaatctatg

SEQ ID NO: 137967 - DNA, 20 bp, Artificial Sequence
  chemically synthesized
accagaaagaacaaaatcta

SEQ ID NO: 137968 - DNA, 20 bp, Artificial Sequence
  chemically synthesized
tccatagattttgttctttc

SEQ ID NO: 137969 - DNA, 20 bp, Artificial Sequence
  chemically synthesized
tagattttgttctttctggt

SEQ ID NO: 137970 - DNA, 20 bp, Artificial Sequence
  chemically synthesized
agattttgttctttctggtt

SEQ ID NO: 137971 - DNA, 20 bp, Artificial Sequence
  chemically synthesized
agaaatttatcccaaccaga

SEQ ID NO: 137972 - DNA, 20 bp, Artificial Sequence
  chemically synthesized
attgagaaatttatcccaac

SEQ ID NO: 137973 - DNA, 20 bp, Artificial Sequence
  chemically synthesized
gggataaatttctcaattct

SEQ ID NO: 137974 - DNA, 20 bp, Artificial Sequence
  chemically synthesized
ctaggaatggaccaagaatt

SEQ ID NO: 137975 - DNA, 20 bp, Artificial Sequence
  chemically synthesized
tgtatttctaggaatggacc

SEQ ID NO: 137976 - DNA, 20 bp, Artificial Sequence
  chemically synthesized
ctcaattcttggtccattcc

SEQ ID NO: 137977 - DNA, 20 bp, Artificial Sequence
  chemically synthesized
gttaactgtatttctaggaa

SEQ ID NO: 137978 - DNA, 20 bp, Artificial Sequence
  chemically synthesized
ttggtccattcctagaaata

SEQ ID NO: 137979 - DNA, 20 bp, Artificial Sequence
  chemically synthesized
tatctgttaactgtatttct

SEQ ID NO: 137980 - DNA, 20 bp, Artificial Sequence
  chemically synthesized
gtatctgttaactgtatttc

SEQ ID NO: 137981 - DNA, 20 bp, Artificial Sequence
  chemically synthesized
attcctagaaatacagttaa

SEQ ID NO: 137982 - DNA, 20 bp, Artificial Sequence
  chemically synthesized
aatcaacactttttacgtat

SEQ ID NO: 137983 - DNA, 20 bp, Artificial Sequence
  chemically synthesized
caatcaacactttttacgta

SEQ ID NO: 137984 - DNA, 20 bp, Artificial Sequence
  chemically synthesized
aacagatacccatacgtaaa

SEQ ID NO: 137985 - DNA, 20 bp, Artificial Sequence
  chemically synthesized
cttcattgtagtcagtgatt

SEQ ID NO: 137986 - DNA, 20 bp, Artificial Sequence
  chemically synthesized
ctgtttcccttcattgtagt

SEQ ID NO: 137987 - DNA, 20 bp, Artificial Sequence
  chemically synthesized
ccaaatcactgactacaatg

SEQ ID NO: 137988 - DNA, 20 bp, Artificial Sequence
  chemically synthesized
caaatcactgactacaatga

SEQ ID NO: 137989 - DNA, 20 bp, Artificial Sequence
  chemically synthesized
aaatcactgactacaatgaa

SEQ ID NO: 137990 - DNA, 20 bp, Artificial Sequence
  chemically synthesized
accactgtttcccttcattg

SEQ ID NO: 137991 - DNA, 20 bp, Artificial Sequence
  chemically synthesized
ctgactacaatgaagggaaa

SEQ ID NO: 137992 - DNA, 20 bp, Artificial Sequence
  chemically synthesized
actacaatgaagggaaacag

SEQ ID NO: 137993 - DNA, 20 bp, Artificial Sequence
  chemically synthesized
atgaagggaaacagtggtac

SEQ ID NO: 137994 - DNA, 20 bp, Artificial Sequence
  chemically synthesized
gaaacagtggtacaagaaac

SEQ ID NO: 137995 - DNA, 20 bp, Artificial Sequence
  chemically synthesized
tggtacaagaaacaagtaat

SEQ ID NO: 137996 - DNA, 20 bp, Artificial Sequence
  chemically synthesized
gtacaagaaacaagtaatta

SEQ ID NO: 137997 - DNA, 20 bp, Artificial Sequence
  chemically synthesized
aacaagtaattagagacttg

SEQ ID NO: 137998 - DNA, 20 bp, Artificial Sequence
  chemically synthesized
aagtaattagagacttgtgg

SEQ ID NO: 137999 - DNA, 20 bp, Artificial Sequence
  chemically synthesized
atgtattcttgatctgccac

SEQ ID NO: 138000 - DNA, 20 bp, Artificial Sequence
  chemically synthesized
ttagagacttgtggcagatc

SEQ ID NO: 138001 - DNA, 20 bp, Artificial Sequence
  chemically synthesized
agatcaagaatacatacaaa

SEQ ID NO: 138002 - DNA, 20 bp, Artificial Sequence
  chemically synthesized
aatacatacaaatggcaaac

SEQ ID NO: 138003 - DNA, 20 bp, Artificial Sequence
  chemically synthesized
atggcaaacaagcatatgaa

SEQ ID NO: 138004 - DNA, 20 bp, Artificial Sequence
  chemically synthesized
tggcaaacaagcatatgaaa

SEQ ID NO: 138005 - DNA, 20 bp, Artificial Sequence
  chemically synthesized
atcaatgattcagtgatgtt

SEQ ID NO: 138006 - DNA, 20 bp, Artificial Sequence
  chemically synthesized
ttctctggttatcaatgatt

SEQ ID NO: 138007 - DNA, 20 bp, Artificial Sequence
  chemically synthesized
atcactgaatcattgataac

SEQ ID NO: 138008 - DNA, 20 bp, Artificial Sequence
  chemically synthesized
cactgaatcattgataacca

SEQ ID NO: 138009 - DNA, 20 bp, Artificial Sequence
  chemically synthesized
aattttgattttcatttctc

SEQ ID NO: 138010 - DNA, 20 bp, Artificial Sequence
  chemically synthesized
aagccattttaacgggagtg

SEQ ID NO: 138011 - DNA, 20 bp, Artificial Sequence
  chemically synthesized
taagccattttaacgggagt

SEQ ID NO: 138012 - DNA, 20 bp, Artificial Sequence
  chemically synthesized
gatataagccattttaacgg

SEQ ID NO: 138013 - DNA, 20 bp, Artificial Sequence
  chemically synthesized
ttacctcactcccgttaaaa

SEQ ID NO: 138014 - DNA, 20 bp, Artificial Sequence
  chemically synthesized
tggatataagccattttaac

SEQ ID NO: 138015 - DNA, 20 bp, Artificial Sequence
  chemically synthesized
ttggatataagccattttaa

SEQ ID NO: 138016 - DNA, 20 bp, Artificial Sequence
  chemically synthesized
attgcctgtcttttggatat

SEQ ID NO: 138017 - DNA, 20 bp, Artificial Sequence
  chemically synthesized
ttaaaatggcttatatccaa

SEQ ID NO: 138018 - DNA, 20 bp, Artificial Sequence
  chemically synthesized
aatggcttatatccaaaaga

SEQ ID NO: 138019 - DNA, 20 bp, Artificial Sequence
  chemically synthesized
atggcttatatccaaaagac

SEQ ID NO: 138020 - DNA, 20 bp, Artificial Sequence
  chemically synthesized
attggttattgcctgtcttt

SEQ ID NO: 138021 - DNA, 20 bp, Artificial Sequence
  chemically synthesized
cttcacatacttgtcaacat

SEQ ID NO: 138022 - DNA, 20 bp, Artificial Sequence
  chemically synthesized
aggcaataaccaatgttgac

SEQ ID NO: 138023 - DNA, 20 bp, Artificial Sequence
  chemically synthesized
ccaatgttgacaagtatgtg

SEQ ID NO: 138024 - DNA, 20 bp, Artificial Sequence
  chemically synthesized
ttgacaagtatgtgaagaaa

SEQ ID NO: 138025 - DNA, 20 bp, Artificial Sequence
  chemically synthesized
tgacaagtatgtgaagaaaa

SEQ ID NO: 138026 - DNA, 20 bp, Artificial Sequence
  chemically synthesized
tttccaccaacagtatacaa

SEQ ID NO: 138027 - DNA, 20 bp, Artificial Sequence
  chemically synthesized
atttccaccaacagtataca

SEQ ID NO: 138028 - DNA, 20 bp, Artificial Sequence
  chemically synthesized
catttccaccaacagtatac

SEQ ID NO: 138029 - DNA, 20 bp, Artificial Sequence
  chemically synthesized
aaggaacccttgtatactgt

SEQ ID NO: 138030 - DNA, 20 bp, Artificial Sequence
  chemically synthesized
gaacccttgtatactgttgg

SEQ ID NO: 138031 - DNA, 20 bp, Artificial Sequence
  chemically synthesized
ctaatttacatttccaccaa

SEQ ID NO: 138032 - DNA, 20 bp, Artificial Sequence
  chemically synthesized
ctgttggtggaaatgtaaat

SEQ ID NO: 138033 - DNA, 20 bp, Artificial Sequence
  chemically synthesized
gtaaattagcacaaccacta

SEQ ID NO: 138034 - DNA, 20 bp, Artificial Sequence
  chemically synthesized
aaattagcacaaccactatg

SEQ ID NO: 138035 - DNA, 20 bp, Artificial Sequence
  chemically synthesized
ctccaaacggttctccatag

SEQ ID NO: 138036 - DNA, 20 bp, Artificial Sequence
  chemically synthesized
aacctccaaacggttctcca

SEQ ID NO: 138037 - DNA, 20 bp, Artificial Sequence
  chemically synthesized
aaccactatggagaaccgtt

SEQ ID NO: 138038 - DNA, 20 bp, Artificial Sequence
  chemically synthesized
ccactatggagaaccgtttg

SEQ ID NO: 138039 - DNA, 20 bp, Artificial Sequence
  chemically synthesized
cactatggagaaccgtttgg

SEQ ID NO: 138040 - DNA, 20 bp, Artificial Sequence
  chemically synthesized
ttttttgaggaacctccaaa

SEQ ID NO: 138041 - DNA, 20 bp, Artificial Sequence
  chemically synthesized
gctctatttttagttttttg

SEQ ID NO: 138042 - DNA, 20 bp, Artificial Sequence
  chemically synthesized
agctctatttttagtttttt

SEQ ID NO: 138043 - DNA, 20 bp, Artificial Sequence
  chemically synthesized
gttcctcaaaaaactaaaaa

SEQ ID NO: 138044 - DNA, 20 bp, Artificial Sequence
  chemically synthesized
tcctcaaaaaactaaaaata

SEQ ID NO: 138045 - DNA, 20 bp, Artificial Sequence
  chemically synthesized
ttatatggtagctctatttt

SEQ ID NO: 138046 - DNA, 20 bp, Artificial Sequence
  chemically synthesized
gggaatgctatattatatgg

SEQ ID NO: 138047 - DNA, 20 bp, Artificial Sequence
  chemically synthesized
aatagagctaccatataata

SEQ ID NO: 138048 - DNA, 20 bp, Artificial Sequence
  chemically synthesized
agcgggaatgctatattata

SEQ ID NO: 138049 - DNA, 20 bp, Artificial Sequence
  chemically synthesized
taatatagcattcccgctgc

SEQ ID NO: 138050 - DNA, 20 bp, Artificial Sequence
  chemically synthesized
aatatagcattcccgctgct

SEQ ID NO: 138051 - DNA, 20 bp, Artificial Sequence
  chemically synthesized
ttgggtatatacccagcagc

SEQ ID NO: 138052 - DNA, 20 bp, Artificial Sequence
  chemically synthesized
tttgggtatatacccagcag

SEQ ID NO: 138053 - DNA, 20 bp, Artificial Sequence
  chemically synthesized
tcttttgggtatatacccag

SEQ ID NO: 138054 - DNA, 20 bp, Artificial Sequence
  chemically synthesized
ttttcttttgggtatatacc

SEQ ID NO: 138055 - DNA, 20 bp, Artificial Sequence
  chemically synthesized
gctgctgggtatatacccaa

SEQ ID NO: 138056 - DNA, 20 bp, Artificial Sequence
  chemically synthesized
atactgatttattttctttt

SEQ ID NO: 138057 - DNA, 20 bp, Artificial Sequence
  chemically synthesized
tatactgatttattttcttt

SEQ ID NO: 138058 - DNA, 20 bp, Artificial Sequence
  chemically synthesized
atacccaaaagaaaataaat

SEQ ID NO: 138059 - DNA, 20 bp, Artificial Sequence
  chemically synthesized
gaaaataaatcagtatattg

SEQ ID NO: 138060 - DNA, 20 bp, Artificial Sequence
  chemically synthesized
aaataaatcagtatattgaa

SEQ ID NO: 138061 - DNA, 20 bp, Artificial Sequence
  chemically synthesized
ctgcaataaacatgggagtg

SEQ ID NO: 138062 - DNA, 20 bp, Artificial Sequence
  chemically synthesized
tagcgctgcaataaacatgg

SEQ ID NO: 138063 - DNA, 20 bp, Artificial Sequence
  chemically synthesized
aatagcgctgcaataaacat

SEQ ID NO: 138064 - DNA, 20 bp, Artificial Sequence
  chemically synthesized
gaatagcgctgcaataaaca

SEQ ID NO: 138065 - DNA, 20 bp, Artificial Sequence
  chemically synthesized
ctgcactcccatgtttattg

SEQ ID NO: 138066 - DNA, 20 bp, Artificial Sequence
  chemically synthesized
tattgcagcgctattcacaa

SEQ ID NO: 138067 - DNA, 20 bp, Artificial Sequence
  chemically synthesized
caaatcttggctattgtgaa

SEQ ID NO: 138068 - DNA, 20 bp, Artificial Sequence
  chemically synthesized
cagcgctattcacaatagcc

SEQ ID NO: 138069 - DNA, 20 bp, Artificial Sequence
  chemically synthesized
tattcacaatagccaagatt

SEQ ID NO: 138070 - DNA, 20 bp, Artificial Sequence
  chemically synthesized
cttaggttgcttccaaatct

SEQ ID NO: 138071 - DNA, 20 bp, Artificial Sequence
  chemically synthesized
tcacaatagccaagatttgg

SEQ ID NO: 138072 - DNA, 20 bp, Artificial Sequence
  chemically synthesized
ccaagatttggaagcaacct

SEQ ID NO: 138073 - DNA, 20 bp, Artificial Sequence
  chemically synthesized
tcatctactgatggacactt

SEQ ID NO: 138074 - DNA, 20 bp, Artificial Sequence
  chemically synthesized
ttcatctactgatggacact

SEQ ID NO: 138075 - DNA, 20 bp, Artificial Sequence
  chemically synthesized
gaagcaacctaagtgtccat

SEQ ID NO: 138076 - DNA, 20 bp, Artificial Sequence
  chemically synthesized
gcaacctaagtgtccatcag

SEQ ID NO: 138077 - DNA, 20 bp, Artificial Sequence
  chemically synthesized
tttgtccattcatctactga

SEQ ID NO: 138078 - DNA, 20 bp, Artificial Sequence
  chemically synthesized
agtgtccatcagtagatgaa

SEQ ID NO: 138079 - DNA, 20 bp, Artificial Sequence
  chemically synthesized
catcagtagatgaatggaca

SEQ ID NO: 138080 - DNA, 20 bp, Artificial Sequence
  chemically synthesized
atgaatggacaaagaacatg

SEQ ID NO: 138081 - DNA, 20 bp, Artificial Sequence
  chemically synthesized
agtagtattccattgtgcat

SEQ ID NO: 138082 - DNA, 20 bp, Artificial Sequence
  chemically synthesized
catgtggtacctatgcacaa

SEQ ID NO: 138083 - DNA, 20 bp, Artificial Sequence
  chemically synthesized
gagtagtattccattgtgca

SEQ ID NO: 138084 - DNA, 20 bp, Artificial Sequence
  chemically synthesized
atgcacaatggaatactact

SEQ ID NO: 138085 - DNA, 20 bp, Artificial Sequence
  chemically synthesized
cattcttttttgtggctgag

SEQ ID NO: 138086 - DNA, 20 bp, Artificial Sequence
  chemically synthesized
tctcattcttttttgtggct

SEQ ID NO: 138087 - DNA, 20 bp, Artificial Sequence
  chemically synthesized
aatactactcagccacaaaa

SEQ ID NO: 138088 - DNA, 20 bp, Artificial Sequence
  chemically synthesized
cagaatctcattcttttttg

SEQ ID NO: 138089 - DNA, 20 bp, Artificial Sequence
  chemically synthesized
actcagccacaaaaaagaat

SEQ ID NO: 138090 - DNA, 20 bp, Artificial Sequence
  chemically synthesized
aacaatgttgttgcagatga

SEQ ID NO: 138091 - DNA, 20 bp, Artificial Sequence
  chemically synthesized
catttccaacaatgttgttg

SEQ ID NO: 138092 - DNA, 20 bp, Artificial Sequence
  chemically synthesized
gtcatctgcaacaacattgt

SEQ ID NO: 138093 - DNA, 20 bp, Artificial Sequence
  chemically synthesized
tgcaacaacattgttggaaa

SEQ ID NO: 138094 - DNA, 20 bp, Artificial Sequence
  chemically synthesized
caacaacattgttggaaatg

SEQ ID NO: 138095 - DNA, 20 bp, Artificial Sequence
  chemically synthesized
aacaacattgttggaaatgg

SEQ ID NO: 138096 - DNA, 20 bp, Artificial Sequence
  chemically synthesized
acattgttggaaatggaggt

SEQ ID NO: 138097 - DNA, 20 bp, Artificial Sequence
  chemically synthesized
ggaaatggaggtcagtatgc

SEQ ID NO: 138098 - DNA, 20 bp, Artificial Sequence
  chemically synthesized
gaaatggaggtcagtatgct

SEQ ID NO: 138099 - DNA, 20 bp, Artificial Sequence
  chemically synthesized
tgtgtctgatttatttcacc

SEQ ID NO: 138100 - DNA, 20 bp, Artificial Sequence
  chemically synthesized
gtatgctaggtgaaataaat

SEQ ID NO: 138101 - DNA, 20 bp, Artificial Sequence
  chemically synthesized
taggtgaaataaatcagaca

SEQ ID NO: 138102 - DNA, 20 bp, Artificial Sequence
  chemically synthesized
tgaaataaatcagacacaga

SEQ ID NO: 138103 - DNA, 20 bp, Artificial Sequence
  chemically synthesized
tttaaatcccacaaataagt

SEQ ID NO: 138104 - DNA, 20 bp, Artificial Sequence
  chemically synthesized
tgcatgttctcacttatttg

SEQ ID NO: 138105 - DNA, 20 bp, Artificial Sequence
  chemically synthesized
gcatgttctcacttatttgt

SEQ ID NO: 138106 - DNA, 20 bp, Artificial Sequence
  chemically synthesized
gaattttaaatcccacaaat

SEQ ID NO: 138107 - DNA, 20 bp, Artificial Sequence
  chemically synthesized
attcaaaacaattgaactca

SEQ ID NO: 138108 - DNA, 20 bp, Artificial Sequence
  chemically synthesized
aacaattgaactcatggaca

SEQ ID NO: 138109 - DNA, 20 bp, Artificial Sequence
  chemically synthesized
cttctactctctatgtccat

SEQ ID NO: 138110 - DNA, 20 bp, Artificial Sequence
  chemically synthesized
caattgaactcatggacata

SEQ ID NO: 138111 - DNA, 20 bp, Artificial Sequence
  chemically synthesized
attgaactcatggacataga

SEQ ID NO: 138112 - DNA, 20 bp, Artificial Sequence
  chemically synthesized
gaactcatggacatagagag

SEQ ID NO: 138113 - DNA, 20 bp, Artificial Sequence
  chemically synthesized
ctcatggacatagagagtag

SEQ ID NO: 138114 - DNA, 20 bp, Artificial Sequence
  chemically synthesized
tcatggacatagagagtaga

SEQ ID NO: 138115 - DNA, 20 bp, Artificial Sequence
  chemically synthesized
ggacatagagagtagaagga

SEQ ID NO: 138116 - DNA, 20 bp, Artificial Sequence
  chemically synthesized
gagtagaaggatggttacct

SEQ ID NO: 138117 - DNA, 20 bp, Artificial Sequence
  chemically synthesized
agtagaaggatggttacctg

SEQ ID NO: 138118 - DNA, 20 bp, Artificial Sequence
  chemically synthesized
gaaggatggttacctgagga

SEQ ID NO: 138119 - DNA, 20 bp, Artificial Sequence
  chemically synthesized
aaggatggttacctgaggat

SEQ ID NO: 138120 - DNA, 20 bp, Artificial Sequence
  chemically synthesized
ccacgacccttcccatcctc

SEQ ID NO: 138121 - DNA, 20 bp, Artificial Sequence
  chemically synthesized
cccacgacccttcccatcct

SEQ ID NO: 138122 - DNA, 20 bp, Artificial Sequence
  chemically synthesized
gatggttacctgaggatggg

SEQ ID NO: 138123 - DNA, 20 bp, Artificial Sequence
  chemically synthesized
atggttacctgaggatggga

SEQ ID NO: 138124 - DNA, 20 bp, Artificial Sequence
  chemically synthesized
tggttacctgaggatgggaa

SEQ ID NO: 138125 - DNA, 20 bp, Artificial Sequence
  chemically synthesized
cctgaggatgggaagggtcg

SEQ ID NO: 138126 - DNA, 20 bp, Artificial Sequence
  chemically synthesized
ctgaggatgggaagggtcgt

SEQ ID NO: 138127 - DNA, 20 bp, Artificial Sequence
  chemically synthesized
tgaggatgggaagggtcgtg

SEQ ID NO: 138128 - DNA, 20 bp, Artificial Sequence
  chemically synthesized
aggatgggaagggtcgtggg

SEQ ID NO: 138129 - DNA, 20 bp, Artificial Sequence
  chemically synthesized
ggatgggaagggtcgtgggg

SEQ ID NO: 138130 - DNA, 20 bp, Artificial Sequence
  chemically synthesized
tgggaagggtcgtggggagg

SEQ ID NO: 138131 - DNA, 20 bp, Artificial Sequence
  chemically synthesized
gggaagggtcgtggggaggt

SEQ ID NO: 138132 - DNA, 20 bp, Artificial Sequence
  chemically synthesized
ggaagggtcgtggggaggtg

SEQ ID NO: 138133 - DNA, 20 bp, Artificial Sequence
  chemically synthesized
gaagggtcgtggggaggtgg

SEQ ID NO: 138134 - DNA, 20 bp, Artificial Sequence
  chemically synthesized
gggtcgtggggaggtggggg

SEQ ID NO: 138135 - DNA, 20 bp, Artificial Sequence
  chemically synthesized
gtggggaggtgggggtggtg

SEQ ID NO: 138136 - DNA, 20 bp, Artificial Sequence
  chemically synthesized
tggggaggtgggggtggtgt

SEQ ID NO: 138137 - DNA, 20 bp, Artificial Sequence
  chemically synthesized
aggtgggggtggtgtaggta

SEQ ID NO: 138138 - DNA, 20 bp, Artificial Sequence
  chemically synthesized
ggtggtgtaggtatagttac

SEQ ID NO: 138139 - DNA, 20 bp, Artificial Sequence
  chemically synthesized
gtggtgtaggtatagttact

SEQ ID NO: 138140 - DNA, 20 bp, Artificial Sequence
  chemically synthesized
tctaactaattttttgtacc

SEQ ID NO: 138141 - DNA, 20 bp, Artificial Sequence
  chemically synthesized
agttactgggtacaaaaaat

SEQ ID NO: 138142 - DNA, 20 bp, Artificial Sequence
  chemically synthesized
actgggtacaaaaaattagt

SEQ ID NO: 138143 - DNA, 20 bp, Artificial Sequence
  chemically synthesized
ggtacaaaaaattagttaga

SEQ ID NO: 138144 - DNA, 20 bp, Artificial Sequence
  chemically synthesized
aaaaattagttagaaagaat

SEQ ID NO: 138145 - DNA, 20 bp, Artificial Sequence
  chemically synthesized
attagttagaaagaatgagt

SEQ ID NO: 138146 - DNA, 20 bp, Artificial Sequence
  chemically synthesized
ctgttgtgctatcaaatagt

SEQ ID NO: 138147 - DNA, 20 bp, Artificial Sequence
  chemically synthesized
cctgttgtgctatcaaatag

SEQ ID NO: 138148 - DNA, 20 bp, Artificial Sequence
  chemically synthesized
gagtaagacctactatttga

SEQ ID NO: 138149 - DNA, 20 bp, Artificial Sequence
  chemically synthesized
ccccctgttgtgctatcaaa

SEQ ID NO: 138150 - DNA, 20 bp, Artificial Sequence
  chemically synthesized
cctactatttgatagcacaa

SEQ ID NO: 138151 - DNA, 20 bp, Artificial Sequence
  chemically synthesized
ctactatttgatagcacaac

SEQ ID NO: 138152 - DNA, 20 bp, Artificial Sequence
  chemically synthesized
tactatttgatagcacaaca

SEQ ID NO: 138153 - DNA, 20 bp, Artificial Sequence
  chemically synthesized
actatttgatagcacaacag

SEQ ID NO: 138154 - DNA, 20 bp, Artificial Sequence
  chemically synthesized
ctatttgatagcacaacagg

SEQ ID NO: 138155 - DNA, 20 bp, Artificial Sequence
  chemically synthesized
aattaaatcattattggtta

SEQ ID NO: 138156 - DNA, 20 bp, Artificial Sequence
  chemically synthesized
atgtacaattaaatcattat

SEQ ID NO: 138157 - DNA, 20 bp, Artificial Sequence
  chemically synthesized
gtacattttacattaattaa

SEQ ID NO: 138158 - DNA, 20 bp, Artificial Sequence
  chemically synthesized
acattttacattaattaaaa

SEQ ID NO: 138159 - DNA, 20 bp, Artificial Sequence
  chemically synthesized
attaattaaaagagtataat

SEQ ID NO: 138160 - DNA, 20 bp, Artificial Sequence
  chemically synthesized
aagagtataattggattgtt

SEQ ID NO: 138161 - DNA, 20 bp, Artificial Sequence
  chemically synthesized
attggattgtttggaacata

SEQ ID NO: 138162 - DNA, 20 bp, Artificial Sequence
  chemically synthesized
aacataaagaataaatgctt

SEQ ID NO: 138163 - DNA, 20 bp, Artificial Sequence
  chemically synthesized
acataaagaataaatgcttg

SEQ ID NO: 138164 - DNA, 20 bp, Artificial Sequence
  chemically synthesized
cataaagaataaatgcttga

SEQ ID NO: 138165 - DNA, 20 bp, Artificial Sequence
  chemically synthesized
ataaagaataaatgcttgag

SEQ ID NO: 138166 - DNA, 20 bp, Artificial Sequence
  chemically synthesized
aatggggtattcaacccctc

SEQ ID NO: 138167 - DNA, 20 bp, Artificial Sequence
  chemically synthesized
taagcacatcatgtaaaatg

SEQ ID NO: 138168 - DNA, 20 bp, Artificial Sequence
  chemically synthesized
gtaagcacatcatgtaaaat

SEQ ID NO: 138169 - DNA, 20 bp, Artificial Sequence
  chemically synthesized
agtaagcacatcatgtaaaa

SEQ ID NO: 138170 - DNA, 20 bp, Artificial Sequence
  chemically synthesized
acaggcatgcaatgtgtagt

SEQ ID NO: 138171 - DNA, 20 bp, Artificial Sequence
  chemically synthesized
tgatacaggcatgcaatgtg

SEQ ID NO: 138172 - DNA, 20 bp, Artificial Sequence
  chemically synthesized
tacttgagatgttttgatac

SEQ ID NO: 138173 - DNA, 20 bp, Artificial Sequence
  chemically synthesized
gtacttgagatgttttgata

SEQ ID NO: 138174 - DNA, 20 bp, Artificial Sequence
  chemically synthesized
tgcctgtatcaaaacatctc

SEQ ID NO: 138175 - DNA, 20 bp, Artificial Sequence
  chemically synthesized
tatatatttatttggtactt

SEQ ID NO: 138176 - DNA, 20 bp, Artificial Sequence
  chemically synthesized
agcaggtgtatatatttatt

SEQ ID NO: 138177 - DNA, 20 bp, Artificial Sequence
  chemically synthesized
aaataaatatatacacctgc

SEQ ID NO: 138178 - DNA, 20 bp, Artificial Sequence
  chemically synthesized
aataaatatatacacctgct

SEQ ID NO: 138179 - DNA, 20 bp, Artificial Sequence
  chemically synthesized
aagttttgtgagtacctagc

SEQ ID NO: 138180 - DNA, 20 bp, Artificial Sequence
  chemically synthesized
taagttttgtgagtacctag

SEQ ID NO: 138181 - DNA, 20 bp, Artificial Sequence
  chemically synthesized
ttttaagttttgtgagtacc

SEQ ID NO: 138182 - DNA, 20 bp, Artificial Sequence
  chemically synthesized
tttatatttttaagttttgt

SEQ ID NO: 138183 - DNA, 20 bp, Artificial Sequence
  chemically synthesized
tgttttatttttatattttt

SEQ ID NO: 138184 - DNA, 20 bp, Artificial Sequence
  chemically synthesized
aaatataaaaataaaacaaa

SEQ ID NO: 138185 - DNA, 20 bp, Artificial Sequence
  chemically synthesized
aaaataaaacaaaaagaaac

SEQ ID NO: 138186 - DNA, 20 bp, Artificial Sequence
  chemically synthesized
aacaaaaagaaacaagtaat

SEQ ID NO: 138187 - DNA, 20 bp, Artificial Sequence
  chemically synthesized
aagaaacaagtaattagaat

SEQ ID NO: 138188 - DNA, 20 bp, Artificial Sequence
  chemically synthesized
taattagaatcagaaatgtg

SEQ ID NO: 138189 - DNA, 20 bp, Artificial Sequence
  chemically synthesized
cagaaatgtgtggaaattgc

SEQ ID NO: 138190 - DNA, 20 bp, Artificial Sequence
  chemically synthesized
tagaaaaggaacatgtgttc

SEQ ID NO: 138191 - DNA, 20 bp, Artificial Sequence
  chemically synthesized
agaacacatgttccttttct

SEQ ID NO: 138192 - DNA, 20 bp, Artificial Sequence
  chemically synthesized
tgataaatactgcttagaaa

SEQ ID NO: 138193 - DNA, 20 bp, Artificial Sequence
  chemically synthesized
acacatgttccttttctaag

SEQ ID NO: 138194 - DNA, 20 bp, Artificial Sequence
  chemically synthesized
ctgataaatactgcttagaa

SEQ ID NO: 138195 - DNA, 20 bp, Artificial Sequence
  chemically synthesized
taatactgataaatactgct

SEQ ID NO: 138196 - DNA, 20 bp, Artificial Sequence
  chemically synthesized
cttttctaagcagtatttat

SEQ ID NO: 138197 - DNA, 20 bp, Artificial Sequence
  chemically synthesized
tataaaaatcactgatcatt

SEQ ID NO: 138198 - DNA, 20 bp, Artificial Sequence
  chemically synthesized
tttaaagctagccaaatgat

SEQ ID NO: 138199 - DNA, 20 bp, Artificial Sequence
  chemically synthesized
aaaatcactgatcatttggc

SEQ ID NO: 138200 - DNA, 20 bp, Artificial Sequence
  chemically synthesized
atattttttatttttaaagc

SEQ ID NO: 138201 - DNA, 20 bp, Artificial Sequence
  chemically synthesized
tatcatattttttattttta

SEQ ID NO: 138202 - DNA, 20 bp, Artificial Sequence
  chemically synthesized
tttaaaaataaaaaatatga

SEQ ID NO: 138203 - DNA, 20 bp, Artificial Sequence
  chemically synthesized
aaaaaatatgatagctgttt

SEQ ID NO: 138204 - DNA, 20 bp, Artificial Sequence
  chemically synthesized
gctaataatgatttcttaaa

SEQ ID NO: 138205 - DNA, 20 bp, Artificial Sequence
  chemically synthesized
gctgtttaagaaatcattat

SEQ ID NO: 138206 - DNA, 20 bp, Artificial Sequence
  chemically synthesized
tattgttttttaagtttgaa

SEQ ID NO: 138207 - DNA, 20 bp, Artificial Sequence
  chemically synthesized
tgactgtcttattgtttttt

SEQ ID NO: 138208 - DNA, 20 bp, Artificial Sequence
  chemically synthesized
attcaaacttaaaaaacaat

SEQ ID NO: 138209 - DNA, 20 bp, Artificial Sequence
  chemically synthesized
aaacttaaaaaacaataaga

SEQ ID NO: 138210 - DNA, 20 bp, Artificial Sequence
  chemically synthesized
ttaaaaaacaataagacagt

SEQ ID NO: 138211 - DNA, 20 bp, Artificial Sequence
  chemically synthesized
aacattactacaaagaaata

SEQ ID NO: 138212 - DNA, 20 bp, Artificial Sequence
  chemically synthesized
gaaacattactacaaagaaa

SEQ ID NO: 138213 - DNA, 20 bp, Artificial Sequence
  chemically synthesized
tttatttctctatttctttg

SEQ ID NO: 138214 - DNA, 20 bp, Artificial Sequence
  chemically synthesized
caaattgaaacattactaca

SEQ ID NO: 138215 - DNA, 20 bp, Artificial Sequence
  chemically synthesized
gtttcaatttgttgatattt

SEQ ID NO: 138216 - DNA, 20 bp, Artificial Sequence
  chemically synthesized
tttcaatttgttgatatttt

SEQ ID NO: 138217 - DNA, 20 bp, Artificial Sequence
  chemically synthesized
ttcaatttgttgatattttg

SEQ ID NO: 138218 - DNA, 20 bp, Artificial Sequence
  chemically synthesized
caatttgttgatattttggg

SEQ ID NO: 138219 - DNA, 20 bp, Artificial Sequence
  chemically synthesized
ggggagttaaaaaaactctt

SEQ ID NO: 138220 - DNA, 20 bp, Artificial Sequence
  chemically synthesized
gttaaaaaaactcttaagcc

SEQ ID NO: 138221 - DNA, 20 bp, Artificial Sequence
  chemically synthesized
acatgcagtgctaggcttaa

SEQ ID NO: 138222 - DNA, 20 bp, Artificial Sequence
  chemically synthesized
gaacatgcagtgctaggctt

SEQ ID NO: 138223 - DNA, 20 bp, Artificial Sequence
  chemically synthesized
gagtgagaacatgcagtgct

SEQ ID NO: 138224 - DNA, 20 bp, Artificial Sequence
  chemically synthesized
cgagtgagaacatgcagtgc

SEQ ID NO: 138225 - DNA, 20 bp, Artificial Sequence
  chemically synthesized
cacttacgagtgagaacatg

SEQ ID NO: 138226 - DNA, 20 bp, Artificial Sequence
  chemically synthesized
cactgcatgttctcactcgt

SEQ ID NO: 138227 - DNA, 20 bp, Artificial Sequence
  chemically synthesized
ttcaattcccacttacgagt

SEQ ID NO: 138228 - DNA, 20 bp, Artificial Sequence
  chemically synthesized
tgcatgttctcactcgtaag

SEQ ID NO: 138229 - DNA, 20 bp, Artificial Sequence
  chemically synthesized
gcatgttctcactcgtaagt

SEQ ID NO: 138230 - DNA, 20 bp, Artificial Sequence
  chemically synthesized
attgttcaattcccacttac

SEQ ID NO: 138231 - DNA, 20 bp, Artificial Sequence
  chemically synthesized
gtaagtgggaattgaacaat

SEQ ID NO: 138232 - DNA, 20 bp, Artificial Sequence
  chemically synthesized
aattgaacaatgagaacaca

SEQ ID NO: 138233 - DNA, 20 bp, Artificial Sequence
  chemically synthesized
acaatgagaacacatggaca

SEQ ID NO: 138234 - DNA, 20 bp, Artificial Sequence
  chemically synthesized
caatgagaacacatggacac

SEQ ID NO: 138235 - DNA, 20 bp, Artificial Sequence
  chemically synthesized
aatgagaacacatggacaca

SEQ ID NO: 138236 - DNA, 20 bp, Artificial Sequence
  chemically synthesized
tgagaacacatggacacagg

SEQ ID NO: 138237 - DNA, 20 bp, Artificial Sequence
  chemically synthesized
gagaacacatggacacaggg

SEQ ID NO: 138238 - DNA, 20 bp, Artificial Sequence
  chemically synthesized
agaacacatggacacaggga

SEQ ID NO: 138239 - DNA, 20 bp, Artificial Sequence
  chemically synthesized
gaacacatggacacagggag

SEQ ID NO: 138240 - DNA, 20 bp, Artificial Sequence
  chemically synthesized
gggaggggaacatcacacac

SEQ ID NO: 138241 - DNA, 20 bp, Artificial Sequence
  chemically synthesized
ggaggggaacatcacacacc

SEQ ID NO: 138242 - DNA, 20 bp, Artificial Sequence
  chemically synthesized
gaggggaacatcacacaccg

SEQ ID NO: 138243 - DNA, 20 bp, Artificial Sequence
  chemically synthesized
cctcaccccttgacaggccc

SEQ ID NO: 138244 - DNA, 20 bp, Artificial Sequence
  chemically synthesized
atcacacaccggggcctgtc

SEQ ID NO: 138245 - DNA, 20 bp, Artificial Sequence
  chemically synthesized
tcacacaccggggcctgtca

SEQ ID NO: 138246 - DNA, 20 bp, Artificial Sequence
  chemically synthesized
cacacaccggggcctgtcaa

SEQ ID NO: 138247 - DNA, 20 bp, Artificial Sequence
  chemically synthesized
acacaccggggcctgtcaag

SEQ ID NO: 138248 - DNA, 20 bp, Artificial Sequence
  chemically synthesized
cttgcccctcaccccttgac

SEQ ID NO: 138249 - DNA, 20 bp, Artificial Sequence
  chemically synthesized
ccttgcccctcaccccttga

SEQ ID NO: 138250 - DNA, 20 bp, Artificial Sequence
  chemically synthesized
accggggcctgtcaaggggt

SEQ ID NO: 138251 - DNA, 20 bp, Artificial Sequence
  chemically synthesized
ccggggcctgtcaaggggtg

SEQ ID NO: 138252 - DNA, 20 bp, Artificial Sequence
  chemically synthesized
cggggcctgtcaaggggtga

SEQ ID NO: 138253 - DNA, 20 bp, Artificial Sequence
  chemically synthesized
ggggcctgtcaaggggtgag

SEQ ID NO: 138254 - DNA, 20 bp, Artificial Sequence
  chemically synthesized
cctgtcaaggggtgaggggc

SEQ ID NO: 138255 - DNA, 20 bp, Artificial Sequence
  chemically synthesized
ctgtcaaggggtgaggggca

SEQ ID NO: 138256 - DNA, 20 bp, Artificial Sequence
  chemically synthesized
tgtcaaggggtgaggggcaa

SEQ ID NO: 138257 - DNA, 20 bp, Artificial Sequence
  chemically synthesized
gtcaaggggtgaggggcaag

SEQ ID NO: 138258 - DNA, 20 bp, Artificial Sequence
  chemically synthesized
aggggtgaggggcaagggga

SEQ ID NO: 138259 - DNA, 20 bp, Artificial Sequence
  chemically synthesized
gggtgaggggcaaggggaca

SEQ ID NO: 138260 - DNA, 20 bp, Artificial Sequence
  chemically synthesized
gtgaggggcaaggggacaga

SEQ ID NO: 138261 - DNA, 20 bp, Artificial Sequence
  chemically synthesized
ggcaaggggacagagagcat

SEQ ID NO: 138262 - DNA, 20 bp, Artificial Sequence
  chemically synthesized
gcaaggggacagagagcatt

SEQ ID NO: 138263 - DNA, 20 bp, Artificial Sequence
  chemically synthesized
aggacaaatacctaatgcat

SEQ ID NO: 138264 - DNA, 20 bp, Artificial Sequence
  chemically synthesized
ttttaagcccccaatgcatt

SEQ ID NO: 138265 - DNA, 20 bp, Artificial Sequence
  chemically synthesized
ggacaaatacctaatgcatt

SEQ ID NO: 138266 - DNA, 20 bp, Artificial Sequence
  chemically synthesized
gttttaagcccccaatgcat

SEQ ID NO: 138267 - DNA, 20 bp, Artificial Sequence
  chemically synthesized
gacaaatacctaatgcattg

SEQ ID NO: 138268 - DNA, 20 bp, Artificial Sequence
  chemically synthesized
acaaatacctaatgcattgg

SEQ ID NO: 138269 - DNA, 20 bp, Artificial Sequence
  chemically synthesized
tgcattgggggcttaaaacc

SEQ ID NO: 138270 - DNA, 20 bp, Artificial Sequence
  chemically synthesized
caacccaacatccaggtttt

SEQ ID NO: 138271 - DNA, 20 bp, Artificial Sequence
  chemically synthesized
ggggcttaaaacctggatgt

SEQ ID NO: 138272 - DNA, 20 bp, Artificial Sequence
  chemically synthesized
gggcttaaaacctggatgtt

SEQ ID NO: 138273 - DNA, 20 bp, Artificial Sequence
  chemically synthesized
tactcatcaacccaacatcc

SEQ ID NO: 138274 - DNA, 20 bp, Artificial Sequence
  chemically synthesized
atactcatcaacccaacatc

SEQ ID NO: 138275 - DNA, 20 bp, Artificial Sequence
  chemically synthesized
aacctggatgttgggttgat

SEQ ID NO: 138276 - DNA, 20 bp, Artificial Sequence
  chemically synthesized
ggatgttgggttgatgagta

SEQ ID NO: 138277 - DNA, 20 bp, Artificial Sequence
  chemically synthesized
taggtatacatgtatcatgg

SEQ ID NO: 138278 - DNA, 20 bp, Artificial Sequence
  chemically synthesized
acctaggtatacatgtatca

SEQ ID NO: 138279 - DNA, 20 bp, Artificial Sequence
  chemically synthesized
caccatgatacatgtatacc

SEQ ID NO: 138280 - DNA, 20 bp, Artificial Sequence
  chemically synthesized
accatgatacatgtatacct

SEQ ID NO: 138281 - DNA, 20 bp, Artificial Sequence
  chemically synthesized
aacgtgcaggtttgttacct

SEQ ID NO: 138282 - DNA, 20 bp, Artificial Sequence
  chemically synthesized
gaacgtgcaggtttgttacc

SEQ ID NO: 138283 - DNA, 20 bp, Artificial Sequence
  chemically synthesized
gatacatgtgcagaacgtgc

SEQ ID NO: 138284 - DNA, 20 bp, Artificial Sequence
  chemically synthesized
ggatacatgtgcagaacgtg

SEQ ID NO: 138285 - DNA, 20 bp, Artificial Sequence
  chemically synthesized
taagttctgggatacatgtg

SEQ ID NO: 138286 - DNA, 20 bp, Artificial Sequence
  chemically synthesized
cacgttctgcacatgtatcc

SEQ ID NO: 138287 - DNA, 20 bp, Artificial Sequence
  chemically synthesized
ttaattttactttaagttct

SEQ ID NO: 138288 - DNA, 20 bp, Artificial Sequence
  chemically synthesized
cacatgtatcccagaactta

SEQ ID NO: 138289 - DNA, 20 bp, Artificial Sequence
  chemically synthesized
tttaattttactttaagttc

SEQ ID NO: 138290 - DNA, 20 bp, Artificial Sequence
  chemically synthesized
tagttttttaattttacttt

SEQ ID NO: 138291 - DNA, 20 bp, Artificial Sequence
  chemically synthesized
atatttatttatttattttt

SEQ ID NO: 138292 - DNA, 20 bp, Artificial Sequence
  chemically synthesized
taaaataaataaaataaaaa

SEQ ID NO: 138293 - DNA, 20 bp, Artificial Sequence
  chemically synthesized
aaataaataaaataaaaaaa

SEQ ID NO: 138294 - DNA, 20 bp, Artificial Sequence
  chemically synthesized
aataaaataaaaaaagagca

SEQ ID NO: 138295 - DNA, 20 bp, Artificial Sequence
  chemically synthesized
gaggtttttttttttttttt

SEQ ID NO: 138296 - DNA, 20 bp, Artificial Sequence
  chemically synthesized
aaaaaaaaaaaaaacctctt

SEQ ID NO: 138297 - DNA, 20 bp, Artificial Sequence
  chemically synthesized
ccaaatttggtaggcttaag

SEQ ID NO: 138298 - DNA, 20 bp, Artificial Sequence
  chemically synthesized
accaaatttggtaggcttaa

SEQ ID NO: 138299 - DNA, 20 bp, Artificial Sequence
  chemically synthesized
tcaccaaatttggtaggctt

SEQ ID NO: 138300 - DNA, 20 bp, Artificial Sequence
  chemically synthesized
aagaagtcaccaaatttggt

SEQ ID NO: 138301 - DNA, 20 bp, Artificial Sequence
  chemically synthesized
cctcttaagcctaccaaatt

SEQ ID NO: 138302 - DNA, 20 bp, Artificial Sequence
  chemically synthesized
aaagaagtcaccaaatttgg

SEQ ID NO: 138303 - DNA, 20 bp, Artificial Sequence
  chemically synthesized
ttcaaagaagtcaccaaatt

SEQ ID NO: 138304 - DNA, 20 bp, Artificial Sequence
  chemically synthesized
atattattaccatttcaaag

SEQ ID NO: 138305 - DNA, 20 bp, Artificial Sequence
  chemically synthesized
atttggtgacttctttgaaa

SEQ ID NO: 138306 - DNA, 20 bp, Artificial Sequence
  chemically synthesized
ttaatattattaccatttca

SEQ ID NO: 138307 - DNA, 20 bp, Artificial Sequence
  chemically synthesized
taataatattaatctactat

SEQ ID NO: 138308 - DNA, 20 bp, Artificial Sequence
  chemically synthesized
taaaaataacacactaatag

SEQ ID NO: 138309 - DNA, 20 bp, Artificial Sequence
  chemically synthesized
ttttaaaaataacacactaa

SEQ ID NO: 138310 - DNA, 20 bp, Artificial Sequence
  chemically synthesized
aatctttttttcaacacagg

SEQ ID NO: 138311 - DNA, 20 bp, Artificial Sequence
  chemically synthesized
ttaatctttttttcaacaca

SEQ ID NO: 138312 - DNA, 20 bp, Artificial Sequence
  chemically synthesized
cttaatctttttttcaacac

SEQ ID NO: 138313 - DNA, 20 bp, Artificial Sequence
  chemically synthesized
tcttaatctttttttcaaca

SEQ ID NO: 138314 - DNA, 20 bp, Artificial Sequence
  chemically synthesized
tatctccctgtgttgaaaaa

SEQ ID NO: 138315 - DNA, 20 bp, Artificial Sequence
  chemically synthesized
cctgtgttgaaaaaaagatt

SEQ ID NO: 138316 - DNA, 20 bp, Artificial Sequence
  chemically synthesized
tgttgaaaaaaagattaaga

SEQ ID NO: 138317 - DNA, 20 bp, Artificial Sequence
  chemically synthesized
agattaagatggtcctttcc

SEQ ID NO: 138318 - DNA, 20 bp, Artificial Sequence
  chemically synthesized
tgtggtataatagcttggaa

SEQ ID NO: 138319 - DNA, 20 bp, Artificial Sequence
  chemically synthesized
gtgtggtataatagcttgga

SEQ ID NO: 138320 - DNA, 20 bp, Artificial Sequence
  chemically synthesized
ttccgtgtggtataatagct

SEQ ID NO: 138321 - DNA, 20 bp, Artificial Sequence
  chemically synthesized
ttaagttccgtgtggtataa

SEQ ID NO: 138322 - DNA, 20 bp, Artificial Sequence
  chemically synthesized
ttccaagctattataccaca

SEQ ID NO: 138323 - DNA, 20 bp, Artificial Sequence
  chemically synthesized
tcaatcctttaagttccgtg

SEQ ID NO: 138324 - DNA, 20 bp, Artificial Sequence
  chemically synthesized
attataccacacggaactta

SEQ ID NO: 138325 - DNA, 20 bp, Artificial Sequence
  chemically synthesized
ttataccacacggaacttaa

SEQ ID NO: 138326 - DNA, 20 bp, Artificial Sequence
  chemically synthesized
gacaagtaaatcaatccttt

SEQ ID NO: 138327 - DNA, 20 bp, Artificial Sequence
  chemically synthesized
taagggttttagtaaatgac

SEQ ID NO: 138328 - DNA, 20 bp, Artificial Sequence
  chemically synthesized
tttttggatgttaagggttt

SEQ ID NO: 138329 - DNA, 20 bp, Artificial Sequence
  chemically synthesized
ttttcatttttggatgttaa

SEQ ID NO: 138330 - DNA, 20 bp, Artificial Sequence
  chemically synthesized
attttcatttttggatgtta

SEQ ID NO: 138331 - DNA, 20 bp, Artificial Sequence
  chemically synthesized
cattttcatttttggatgtt

SEQ ID NO: 138332 - DNA, 20 bp, Artificial Sequence
  chemically synthesized
gtgaaaggcattttcatttt

SEQ ID NO: 138333 - DNA, 20 bp, Artificial Sequence
  chemically synthesized
tactggcttgtgaaagtgaa

SEQ ID NO: 138334 - DNA, 20 bp, Artificial Sequence
  chemically synthesized
ttactggcttgtgaaagtga

SEQ ID NO: 138335 - DNA, 20 bp, Artificial Sequence
  chemically synthesized
aaaatgcctttcactttcac

SEQ ID NO: 138336 - DNA, 20 bp, Artificial Sequence
  chemically synthesized
atttacttactggcttgtga

SEQ ID NO: 138337 - DNA, 20 bp, Artificial Sequence
  chemically synthesized
tgcctttcactttcacaagc

SEQ ID NO: 138338 - DNA, 20 bp, Artificial Sequence
  chemically synthesized
tttcactttcacaagccagt

SEQ ID NO: 138339 - DNA, 20 bp, Artificial Sequence
  chemically synthesized
acaccacattatttacttac

SEQ ID NO: 138340 - DNA, 20 bp, Artificial Sequence
  chemically synthesized
aagccagtaagtaaataatg

SEQ ID NO: 138341 - DNA, 20 bp, Artificial Sequence
  chemically synthesized
aaataatgtggtgtaaattg

SEQ ID NO: 138342 - DNA, 20 bp, Artificial Sequence
  chemically synthesized
tgactttgaaattgtatttc

SEQ ID NO: 138343 - DNA, 20 bp, Artificial Sequence
  chemically synthesized
gatcttgaaatacaatttca

SEQ ID NO: 138344 - DNA, 20 bp, Artificial Sequence
  chemically synthesized
tgaaatacaatttcaaagtc

SEQ ID NO: 138345 - DNA, 20 bp, Artificial Sequence
  chemically synthesized
tttcaaagtcaagaaaaaaa

SEQ ID NO: 138346 - DNA, 20 bp, Artificial Sequence
  chemically synthesized
aaatcattatcaacaaattg

SEQ ID NO: 138347 - DNA, 20 bp, Artificial Sequence
  chemically synthesized
gatttgcaaacgcatttcta

SEQ ID NO: 138348 - DNA, 20 bp, Artificial Sequence
  chemically synthesized
caacgccctttatatcactt

SEQ ID NO: 138349 - DNA, 20 bp, Artificial Sequence
  chemically synthesized
cgcatttctaaagtgatata

SEQ ID NO: 138350 - DNA, 20 bp, Artificial Sequence
  chemically synthesized
gcatttctaaagtgatataa

SEQ ID NO: 138351 - DNA, 20 bp, Artificial Sequence
  chemically synthesized
catttctaaagtgatataaa

SEQ ID NO: 138352 - DNA, 20 bp, Artificial Sequence
  chemically synthesized
ataaagggcgttgataattt

SEQ ID NO: 138353 - DNA, 20 bp, Artificial Sequence
  chemically synthesized
ctaaaagatctaacgttgaa

SEQ ID NO: 138354 - DNA, 20 bp, Artificial Sequence
  chemically synthesized
taattttagctattcaacgt

SEQ ID NO: 138355 - DNA, 20 bp, Artificial Sequence
  chemically synthesized
ctattcaacgttagatcttt

SEQ ID NO: 138356 - DNA, 20 bp, Artificial Sequence
  chemically synthesized
gaacaatgtagaataactaa

SEQ ID NO: 138357 - DNA, 20 bp, Artificial Sequence
  chemically synthesized
ttcaagaaatgtgaacaatg

SEQ ID NO: 138358 - DNA, 20 bp, Artificial Sequence
  chemically synthesized
ttatagaacaatagagtttc

SEQ ID NO: 138359 - DNA, 20 bp, Artificial Sequence
  chemically synthesized
gccaaatttatagaacaata

SEQ ID NO: 138360 - DNA, 20 bp, Artificial Sequence
  chemically synthesized
atgccaaatttatagaacaa

SEQ ID NO: 138361 - DNA, 20 bp, Artificial Sequence
  chemically synthesized
actctattgttctataaatt

SEQ ID NO: 138362 - DNA, 20 bp, Artificial Sequence
  chemically synthesized
ttgttaatatgccaaattta

SEQ ID NO: 138363 - DNA, 20 bp, Artificial Sequence
  chemically synthesized
ataaatttggcatattaaca

SEQ ID NO: 138364 - DNA, 20 bp, Artificial Sequence
  chemically synthesized
taaatttggcatattaacaa

SEQ ID NO: 138365 - DNA, 20 bp, Artificial Sequence
  chemically synthesized
catattaacaaaggataatc

SEQ ID NO: 138366 - DNA, 20 bp, Artificial Sequence
  chemically synthesized
ttaacaaaggataatcaaga

SEQ ID NO: 138367 - DNA, 20 bp, Artificial Sequence
  chemically synthesized
taacaaaggataatcaagac

SEQ ID NO: 138368 - DNA, 20 bp, Artificial Sequence
  chemically synthesized
aggataatcaagacaggttt

SEQ ID NO: 138369 - DNA, 20 bp, Artificial Sequence
  chemically synthesized
aatcaagacaggtttaagac

SEQ ID NO: 138370 - DNA, 20 bp, Artificial Sequence
  chemically synthesized
ctgatgcacatgataaaaac

SEQ ID NO: 138371 - DNA, 20 bp, Artificial Sequence
  chemically synthesized
ccagtttttatcatgtgcat

SEQ ID NO: 138372 - DNA, 20 bp, Artificial Sequence
  chemically synthesized
tatcatgtgcatcagattcg

SEQ ID NO: 138373 - DNA, 20 bp, Artificial Sequence
  chemically synthesized
atcatgtgcatcagattcgc

SEQ ID NO: 138374 - DNA, 20 bp, Artificial Sequence
  chemically synthesized
ttactgggccataatatcaa

SEQ ID NO: 138375 - DNA, 20 bp, Artificial Sequence
  chemically synthesized
ttcgcaggcttttgatatta

SEQ ID NO: 138376 - DNA, 20 bp, Artificial Sequence
  chemically synthesized
aggcttttgatattatggcc

SEQ ID NO: 138377 - DNA, 20 bp, Artificial Sequence
  chemically synthesized
attatatcacttatgttact

SEQ ID NO: 138378 - DNA, 20 bp, Artificial Sequence
  chemically synthesized
atattatggcccagtaacat

SEQ ID NO: 138379 - DNA, 20 bp, Artificial Sequence
  chemically synthesized
aattatatcacttatgttac

SEQ ID NO: 138380 - DNA, 20 bp, Artificial Sequence
  chemically synthesized
ttcttctaaaatgtgtgtag

SEQ ID NO: 138381 - DNA, 20 bp, Artificial Sequence
  chemically synthesized
ctttcttctaaaatgtgtgt

SEQ ID NO: 138382 - DNA, 20 bp, Artificial Sequence
  chemically synthesized
tctttcttctaaaatgtgtg

SEQ ID NO: 138383 - DNA, 20 bp, Artificial Sequence
  chemically synthesized
tttttctcctacacacattt

SEQ ID NO: 138384 - DNA, 20 bp, Artificial Sequence
  chemically synthesized
ttctcctacacacattttag

SEQ ID NO: 138385 - DNA, 20 bp, Artificial Sequence
  chemically synthesized
cctacacacattttagaaga

SEQ ID NO: 138386 - DNA, 20 bp, Artificial Sequence
  chemically synthesized
tacacacattttagaagaaa

SEQ ID NO: 138387 - DNA, 20 bp, Artificial Sequence
  chemically synthesized
cacacattttagaagaaaga

SEQ ID NO: 138388 - DNA, 20 bp, Artificial Sequence
  chemically synthesized
gagagacatgaaacaatata

SEQ ID NO: 138389 - DNA, 20 bp, Artificial Sequence
  chemically synthesized
agagacatgaaacaatatat

SEQ ID NO: 138390 - DNA, 20 bp, Artificial Sequence
  chemically synthesized
aacaatatataggactgcct

SEQ ID NO: 138391 - DNA, 20 bp, Artificial Sequence
  chemically synthesized
aaacacacaatattccaagg

SEQ ID NO: 138392 - DNA, 20 bp, Artificial Sequence
  chemically synthesized
accaaacacacaatattcca

SEQ ID NO: 138393 - DNA, 20 bp, Artificial Sequence
  chemically synthesized
aaccaaacacacaatattcc

SEQ ID NO: 138394 - DNA, 20 bp, Artificial Sequence
  chemically synthesized
gccttggaatattgtgtgtt

SEQ ID NO: 138395 - DNA, 20 bp, Artificial Sequence
  chemically synthesized
gaatattgtgtgtttggttc

SEQ ID NO: 138396 - DNA, 20 bp, Artificial Sequence
  chemically synthesized
tttactttattgcagcagtc

SEQ ID NO: 138397 - DNA, 20 bp, Artificial Sequence
  chemically synthesized
tgatatttactttattgcag

SEQ ID NO: 138398 - DNA, 20 bp, Artificial Sequence
  chemically synthesized
ggttccagactgctgcaata

SEQ ID NO: 138399 - DNA, 20 bp, Artificial Sequence
  chemically synthesized
ttgtgatatttactttattg

SEQ ID NO: 138400 - DNA, 20 bp, Artificial Sequence
  chemically synthesized
agtaaatatcacaataaaat

SEQ ID NO: 138401 - DNA, 20 bp, Artificial Sequence
  chemically synthesized
gtaaatatcacaataaaatg

SEQ ID NO: 138402 - DNA, 20 bp, Artificial Sequence
  chemically synthesized
atgaggcacacgaatatttt

SEQ ID NO: 138403 - DNA, 20 bp, Artificial Sequence
  chemically synthesized
cacgaatatttttggttccc

SEQ ID NO: 138404 - DNA, 20 bp, Artificial Sequence
  chemically synthesized
acataacatttaatgcactg

SEQ ID NO: 138405 - DNA, 20 bp, Artificial Sequence
  chemically synthesized
aacataacatttaatgcact

SEQ ID NO: 138406 - DNA, 20 bp, Artificial Sequence
  chemically synthesized
aaacataacatttaatgcac

SEQ ID NO: 138407 - DNA, 20 bp, Artificial Sequence
  chemically synthesized
acacttgacagatgatagta

SEQ ID NO: 138408 - DNA, 20 bp, Artificial Sequence
  chemically synthesized
gcacacttgacagatgatag

SEQ ID NO: 138409 - DNA, 20 bp, Artificial Sequence
  chemically synthesized
attgcacacttgacagatga

SEQ ID NO: 138410 - DNA, 20 bp, Artificial Sequence
  chemically synthesized
acactctactatcatctgtc

SEQ ID NO: 138411 - DNA, 20 bp, Artificial Sequence
  chemically synthesized
caatgctattgcacacttga

SEQ ID NO: 138412 - DNA, 20 bp, Artificial Sequence
  chemically synthesized
atcatctgtcaagtgtgcaa

SEQ ID NO: 138413 - DNA, 20 bp, Artificial Sequence
  chemically synthesized
attaaggtatgtacattttt

SEQ ID NO: 138414 - DNA, 20 bp, Artificial Sequence
  chemically synthesized
agtaatgtattttcaaatta

SEQ ID NO: 138415 - DNA, 20 bp, Artificial Sequence
  chemically synthesized
gagtaatgtattttcaaatt

SEQ ID NO: 138416 - DNA, 20 bp, Artificial Sequence
  chemically synthesized
attgttaccattttttttag

SEQ ID NO: 138417 - DNA, 20 bp, Artificial Sequence
  chemically synthesized
tgattgttaccatttttttt

SEQ ID NO: 138418 - DNA, 20 bp, Artificial Sequence
  chemically synthesized
tacattactcctaaaaaaaa

SEQ ID NO: 138419 - DNA, 20 bp, Artificial Sequence
  chemically synthesized
atgattgttaccattttttt

SEQ ID NO: 138420 - DNA, 20 bp, Artificial Sequence
  chemically synthesized
aaaaatggtaacaatcatct

SEQ ID NO: 138421 - DNA, 20 bp, Artificial Sequence
  chemically synthesized
gtaacaatcatctgagcctg

SEQ ID NO: 138422 - DNA, 20 bp, Artificial Sequence
  chemically synthesized
taacaatcatctgagcctgc

SEQ ID NO: 138423 - DNA, 20 bp, Artificial Sequence
  chemically synthesized
attatgactccctgcaggct

SEQ ID NO: 138424 - DNA, 20 bp, Artificial Sequence
  chemically synthesized
aacaatcatctgagcctgca

SEQ ID NO: 138425 - DNA, 20 bp, Artificial Sequence
  chemically synthesized
caatcatctgagcctgcagg

SEQ ID NO: 138426 - DNA, 20 bp, Artificial Sequence
  chemically synthesized
aaaagattatgactccctgc

SEQ ID NO: 138427 - DNA, 20 bp, Artificial Sequence
  chemically synthesized
aaaaagattatgactccctg

SEQ ID NO: 138428 - DNA, 20 bp, Artificial Sequence
  chemically synthesized
gggagtcataatctttttgc

SEQ ID NO: 138429 - DNA, 20 bp, Artificial Sequence
  chemically synthesized
caagagcctgtaccagcaaa

SEQ ID NO: 138430 - DNA, 20 bp, Artificial Sequence
  chemically synthesized
tcataatctttttgctggta

SEQ ID NO: 138431 - DNA, 20 bp, Artificial Sequence
  chemically synthesized
cataatctttttgctggtac

SEQ ID NO: 138432 - DNA, 20 bp, Artificial Sequence
  chemically synthesized
actgaggcaagagcctgtac

SEQ ID NO: 138433 - DNA, 20 bp, Artificial Sequence
  chemically synthesized
gctggtacaggctcttgcct

SEQ ID NO: 138434 - DNA, 20 bp, Artificial Sequence
  chemically synthesized
agccatcctcactgaggcaa

SEQ ID NO: 138435 - DNA, 20 bp, Artificial Sequence
  chemically synthesized
gcagccatcctcactgaggc

SEQ ID NO: 138436 - DNA, 20 bp, Artificial Sequence
  chemically synthesized
gtacaggctcttgcctcagt

SEQ ID NO: 138437 - DNA, 20 bp, Artificial Sequence
  chemically synthesized
tacaggctcttgcctcagtg

SEQ ID NO: 138438 - DNA, 20 bp, Artificial Sequence
  chemically synthesized
atcagcagccatcctcactg

SEQ ID NO: 138439 - DNA, 20 bp, Artificial Sequence
  chemically synthesized
aatcagcagccatcctcact

SEQ ID NO: 138440 - DNA, 20 bp, Artificial Sequence
  chemically synthesized
ggctcttgcctcagtgagga

SEQ ID NO: 138441 - DNA, 20 bp, Artificial Sequence
  chemically synthesized
ccgccaccctgatcaatcag

SEQ ID NO: 138442 - DNA, 20 bp, Artificial Sequence
  chemically synthesized
gaggatggctgctgattgat

SEQ ID NO: 138443 - DNA, 20 bp, Artificial Sequence
  chemically synthesized
aggatggctgctgattgatc

SEQ ID NO: 138444 - DNA, 20 bp, Artificial Sequence
  chemically synthesized
caaccgccaccctgatcaat

SEQ ID NO: 138445 - DNA, 20 bp, Artificial Sequence
  chemically synthesized
ggatggctgctgattgatca

SEQ ID NO: 138446 - DNA, 20 bp, Artificial Sequence
  chemically synthesized
tggctgctgattgatcaggg

SEQ ID NO: 138447 - DNA, 20 bp, Artificial Sequence
  chemically synthesized
ctgctgattgatcagggtgg

SEQ ID NO: 138448 - DNA, 20 bp, Artificial Sequence
  chemically synthesized
gatcagggtggcggttgctg

SEQ ID NO: 138449 - DNA, 20 bp, Artificial Sequence
  chemically synthesized
atcagggtggcggttgctga

SEQ ID NO: 138450 - DNA, 20 bp, Artificial Sequence
  chemically synthesized
gggtggcggttgctgaaggt

SEQ ID NO: 138451 - DNA, 20 bp, Artificial Sequence
  chemically synthesized
ggtggcggttgctgaaggtc

SEQ ID NO: 138452 - DNA, 20 bp, Artificial Sequence
  chemically synthesized
gctacagccatcccgacctt

SEQ ID NO: 138453 - DNA, 20 bp, Artificial Sequence
  chemically synthesized
gcggttgctgaaggtcggga

SEQ ID NO: 138454 - DNA, 20 bp, Artificial Sequence
  chemically synthesized
gctgaaggtcgggatggctg

SEQ ID NO: 138455 - DNA, 20 bp, Artificial Sequence
  chemically synthesized
cttattttaagaaattgcta

SEQ ID NO: 138456 - DNA, 20 bp, Artificial Sequence
  chemically synthesized
ctgtagcaatttcttaaaat

SEQ ID NO: 138457 - DNA, 20 bp, Artificial Sequence
  chemically synthesized
cttcgttgttgtcttatttt

SEQ ID NO: 138458 - DNA, 20 bp, Artificial Sequence
  chemically synthesized
cttaaaataagacaacaacg

SEQ ID NO: 138459 - DNA, 20 bp, Artificial Sequence
  chemically synthesized
acgaagtttgctgcatcgat

SEQ ID NO: 138460 - DNA, 20 bp, Artificial Sequence
  chemically synthesized
taaaggagagccaatcgatg

SEQ ID NO: 138461 - DNA, 20 bp, Artificial Sequence
  chemically synthesized
catcgattggctctccttta

SEQ ID NO: 138462 - DNA, 20 bp, Artificial Sequence
  chemically synthesized
aaatcattggctataaagga

SEQ ID NO: 138463 - DNA, 20 bp, Artificial Sequence
  chemically synthesized
agaaatcattggctataaag

SEQ ID NO: 138464 - DNA, 20 bp, Artificial Sequence
  chemically synthesized
aaagaaatcattggctataa

SEQ ID NO: 138465 - DNA, 20 bp, Artificial Sequence
  chemically synthesized
caaagaaatcattggctata

SEQ ID NO: 138466 - DNA, 20 bp, Artificial Sequence
  chemically synthesized
acatgctacaaagaaatcat

SEQ ID NO: 138467 - DNA, 20 bp, Artificial Sequence
  chemically synthesized
tatagccaatgatttctttg

SEQ ID NO: 138468 - DNA, 20 bp, Artificial Sequence
  chemically synthesized
aaacagcatcacatgctaca

SEQ ID NO: 138469 - DNA, 20 bp, Artificial Sequence
  chemically synthesized
tagcatgtgatgctgtttga

SEQ ID NO: 138470 - DNA, 20 bp, Artificial Sequence
  chemically synthesized
ctgagtaaaatgctatcaaa

SEQ ID NO: 138471 - DNA, 20 bp, Artificial Sequence
  chemically synthesized
ctgtttgatagcattttact

SEQ ID NO: 138472 - DNA, 20 bp, Artificial Sequence
  chemically synthesized
tttgatagcattttactcag

SEQ ID NO: 138473 - DNA, 20 bp, Artificial Sequence
  chemically synthesized
attttgaaagaagttctact

SEQ ID NO: 138474 - DNA, 20 bp, Artificial Sequence
  chemically synthesized
attgactcaaattttgaaag

SEQ ID NO: 138475 - DNA, 20 bp, Artificial Sequence
  chemically synthesized
aagattgactcaaattttga

SEQ ID NO: 138476 - DNA, 20 bp, Artificial Sequence
  chemically synthesized
tagaacttctttcaaaattt

SEQ ID NO: 138477 - DNA, 20 bp, Artificial Sequence
  chemically synthesized
aattagcatcagggtttgag

SEQ ID NO: 138478 - DNA, 20 bp, Artificial Sequence
  chemically synthesized
ataaattagcatcagggttt

SEQ ID NO: 138479 - DNA, 20 bp, Artificial Sequence
  chemically synthesized
tagttgataaattagcatca

SEQ ID NO: 138480 - DNA, 20 bp, Artificial Sequence
  chemically synthesized
ttagttgataaattagcatc

SEQ ID NO: 138481 - DNA, 20 bp, Artificial Sequence
  chemically synthesized
cttagttgataaattagcat

SEQ ID NO: 138482 - DNA, 20 bp, Artificial Sequence
  chemically synthesized
cataaacttagttgataaat

SEQ ID NO: 138483 - DNA, 20 bp, Artificial Sequence
  chemically synthesized
ctgatgctaatttatcaact

SEQ ID NO: 138484 - DNA, 20 bp, Artificial Sequence
  chemically synthesized
taatttatcaactaagttta

SEQ ID NO: 138485 - DNA, 20 bp, Artificial Sequence
  chemically synthesized
tttagaatattccataaact

SEQ ID NO: 138486 - DNA, 20 bp, Artificial Sequence
  chemically synthesized
tgaaatgacaacaaaggatt

SEQ ID NO: 138487 - DNA, 20 bp, Artificial Sequence
  chemically synthesized
cattgttgaaatgacaacaa

SEQ ID NO: 138488 - DNA, 20 bp, Artificial Sequence
  chemically synthesized
acattgttgaaatgacaaca

SEQ ID NO: 138489 - DNA, 20 bp, Artificial Sequence
  chemically synthesized
tgtcatttcaacaatgttca

SEQ ID NO: 138490 - DNA, 20 bp, Artificial Sequence
  chemically synthesized
atgttcacagcatcatcacc

SEQ ID NO: 138491 - DNA, 20 bp, Artificial Sequence
  chemically synthesized
gttcacagcatcatcaccaa

SEQ ID NO: 138492 - DNA, 20 bp, Artificial Sequence
  chemically synthesized
cacagcatcatcaccaagag

SEQ ID NO: 138493 - DNA, 20 bp, Artificial Sequence
  chemically synthesized
cagcatcatcaccaagagta

SEQ ID NO: 138494 - DNA, 20 bp, Artificial Sequence
  chemically synthesized
catgagatgcactctactct

SEQ ID NO: 138495 - DNA, 20 bp, Artificial Sequence
  chemically synthesized
agcaaagattgtggtttcat

SEQ ID NO: 138496 - DNA, 20 bp, Artificial Sequence
  chemically synthesized
ttatggatgagcaaagattg

SEQ ID NO: 138497 - DNA, 20 bp, Artificial Sequence
  chemically synthesized
ttgctgcttatggatgagca

SEQ ID NO: 138498 - DNA, 20 bp, Artificial Sequence
  chemically synthesized
cacaatctttgctcatccat

SEQ ID NO: 138499 - DNA, 20 bp, Artificial Sequence
  chemically synthesized
cagagttgctgcttatggat

SEQ ID NO: 138500 - DNA, 20 bp, Artificial Sequence
  chemically synthesized
aatctttgctcatccataag

SEQ ID NO: 138501 - DNA, 20 bp, Artificial Sequence
  chemically synthesized
ggatccagagttgctgctta

SEQ ID NO: 138502 - DNA, 20 bp, Artificial Sequence
  chemically synthesized
tcatccataagcagcaactc

SEQ ID NO: 138503 - DNA, 20 bp, Artificial Sequence
  chemically synthesized
gtaaaacttcagcggatcca

SEQ ID NO: 138504 - DNA, 20 bp, Artificial Sequence
  chemically synthesized
aggtaaaacttcagcggatc

SEQ ID NO: 138505 - DNA, 20 bp, Artificial Sequence
  chemically synthesized
cagcaactctggatccgctg

SEQ ID NO: 138506 - DNA, 20 bp, Artificial Sequence
  chemically synthesized
atctcaaggtaaaacttcag

SEQ ID NO: 138507 - DNA, 20 bp, Artificial Sequence
  chemically synthesized
gtaatctcaaggtaaaactt

SEQ ID NO: 138508 - DNA, 20 bp, Artificial Sequence
  chemically synthesized
atccgctgaagttttacctt

SEQ ID NO: 138509 - DNA, 20 bp, Artificial Sequence
  chemically synthesized
actgaatagctgtaatctca

SEQ ID NO: 138510 - DNA, 20 bp, Artificial Sequence
  chemically synthesized
gaagttttaccttgagatta

SEQ ID NO: 138511 - DNA, 20 bp, Artificial Sequence
  chemically synthesized
gactgaatagctgtaatctc

SEQ ID NO: 138512 - DNA, 20 bp, Artificial Sequence
  chemically synthesized
accttgagattacagctatt

SEQ ID NO: 138513 - DNA, 20 bp, Artificial Sequence
  chemically synthesized
agtcagaaggtgtgactgaa

SEQ ID NO: 138514 - DNA, 20 bp, Artificial Sequence
  chemically synthesized
gaatgagaagtggagtcaga

SEQ ID NO: 138515 - DNA, 20 bp, Artificial Sequence
  chemically synthesized
agaatgagaagtggagtcag

SEQ ID NO: 138516 - DNA, 20 bp, Artificial Sequence
  chemically synthesized
accagaatgagaagtggagt

SEQ ID NO: 138517 - DNA, 20 bp, Artificial Sequence
  chemically synthesized
gagaaccagaatgagaagtg

SEQ ID NO: 138518 - DNA, 20 bp, Artificial Sequence
  chemically synthesized
atgagaaccagaatgagaag

SEQ ID NO: 138519 - DNA, 20 bp, Artificial Sequence
  chemically synthesized
tctgactccacttctcattc

SEQ ID NO: 138520 - DNA, 20 bp, Artificial Sequence
  chemically synthesized
agcatgagaaccagaatgag

SEQ ID NO: 138521 - DNA, 20 bp, Artificial Sequence
  chemically synthesized
aatagcatgagaaccagaat

SEQ ID NO: 138522 - DNA, 20 bp, Artificial Sequence
  chemically synthesized
ggtagaaatagcatgagaac

SEQ ID NO: 138523 - DNA, 20 bp, Artificial Sequence
  chemically synthesized
agatgtggtagaaatagcat

SEQ ID NO: 138524 - DNA, 20 bp, Artificial Sequence
  chemically synthesized
cactgcagatgtggtagaaa

SEQ ID NO: 138525 - DNA, 20 bp, Artificial Sequence
  chemically synthesized
agaagtcactgcagatgtgg

SEQ ID NO: 138526 - DNA, 20 bp, Artificial Sequence
  chemically synthesized
tgctatttctaccacatctg

SEQ ID NO: 138527 - DNA, 20 bp, Artificial Sequence
  chemically synthesized
agaagaagtcactgcagatg

SEQ ID NO: 138528 - DNA, 20 bp, Artificial Sequence
  chemically synthesized
ttcagtagaagaagtcactg

SEQ ID NO: 138529 - DNA, 20 bp, Artificial Sequence
  chemically synthesized
gtccaagacttcagtagaag

SEQ ID NO: 138530 - DNA, 20 bp, Artificial Sequence
  chemically synthesized
tgcagtgacttcttctactg

SEQ ID NO: 138531 - DNA, 20 bp, Artificial Sequence
  chemically synthesized
agggtccaagacttcagtag

SEQ ID NO: 138532 - DNA, 20 bp, Artificial Sequence
  chemically synthesized
ttgagggtccaagacttcag

SEQ ID NO: 138533 - DNA, 20 bp, Artificial Sequence
  chemically synthesized
gacttcttctactgaagtct

SEQ ID NO: 138534 - DNA, 20 bp, Artificial Sequence
  chemically synthesized
actttgagggtccaagactt

SEQ ID NO: 138535 - DNA, 20 bp, Artificial Sequence
  chemically synthesized
atcaatgactttgagggtcc

SEQ ID NO: 138536 - DNA, 20 bp, Artificial Sequence
  chemically synthesized
actgaagtcttggaccctca

SEQ ID NO: 138537 - DNA, 20 bp, Artificial Sequence
  chemically synthesized
acactcatcaatgactttga

SEQ ID NO: 138538 - DNA, 20 bp, Artificial Sequence
  chemically synthesized
aacactcatcaatgactttg

SEQ ID NO: 138539 - DNA, 20 bp, Artificial Sequence
  chemically synthesized
caacactcatcaatgacttt

SEQ ID NO: 138540 - DNA, 20 bp, Artificial Sequence
  chemically synthesized
ggaccctcaaagtcattgat

SEQ ID NO: 138541 - DNA, 20 bp, Artificial Sequence
  chemically synthesized
tcaaagtcattgatgagtgt

SEQ ID NO: 138542 - DNA, 20 bp, Artificial Sequence
  chemically synthesized
cattatcaggagtttggaag

SEQ ID NO: 138543 - DNA, 20 bp, Artificial Sequence
  chemically synthesized
caacattatcaggagtttgg

SEQ ID NO: 138544 - DNA, 20 bp, Artificial Sequence
  chemically synthesized
tatcaacattatcaggagtt

SEQ ID NO: 138545 - DNA, 20 bp, Artificial Sequence
  chemically synthesized
caaaatatcaacattatcag

SEQ ID NO: 138546 - DNA, 20 bp, Artificial Sequence
  chemically synthesized
gtcaaaatatcaacattatc

SEQ ID NO: 138547 - DNA, 20 bp, Artificial Sequence
  chemically synthesized
ggtcaaaatatcaacattat

SEQ ID NO: 138548 - DNA, 20 bp, Artificial Sequence
  chemically synthesized
aattcatgattgaggggagg

SEQ ID NO: 138549 - DNA, 20 bp, Artificial Sequence
  chemically synthesized
aaattcatgattgaggggag

SEQ ID NO: 138550 - DNA, 20 bp, Artificial Sequence
  chemically synthesized
gaaaattcatgattgagggg

SEQ ID NO: 138551 - DNA, 20 bp, Artificial Sequence
  chemically synthesized
agaaaattcatgattgaggg

SEQ ID NO: 138552 - DNA, 20 bp, Artificial Sequence
  chemically synthesized
gaagaaaattcatgattgag

SEQ ID NO: 138553 - DNA, 20 bp, Artificial Sequence
  chemically synthesized
tgaagaaaattcatgattga

SEQ ID NO: 138554 - DNA, 20 bp, Artificial Sequence
  chemically synthesized
atgaagaaaattcatgattg

SEQ ID NO: 138555 - DNA, 20 bp, Artificial Sequence
  chemically synthesized
catgaagaaaattcatgatt

SEQ ID NO: 138556 - DNA, 20 bp, Artificial Sequence
  chemically synthesized
tcaatcatgaattttcttca

SEQ ID NO: 138557 - DNA, 20 bp, Artificial Sequence
  chemically synthesized
tcaccattccagatgccatg

SEQ ID NO: 138558 - DNA, 20 bp, Artificial Sequence
  chemically synthesized
tgaattttcttcatggcatc

SEQ ID NO: 138559 - DNA, 20 bp, Artificial Sequence
  chemically synthesized
tttcttcatggcatctggaa

SEQ ID NO: 138560 - DNA, 20 bp, Artificial Sequence
  chemically synthesized
ttcatggcatctggaatggt

SEQ ID NO: 138561 - DNA, 20 bp, Artificial Sequence
  chemically synthesized
acggaaagtcctcaccattc

SEQ ID NO: 138562 - DNA, 20 bp, Artificial Sequence
  chemically synthesized
tcatggcatctggaatggtg

SEQ ID NO: 138563 - DNA, 20 bp, Artificial Sequence
  chemically synthesized
taaagtaaactgaaaacgga

SEQ ID NO: 138564 - DNA, 20 bp, Artificial Sequence
  chemically synthesized
tggtgaggactttccgtttt

SEQ ID NO: 138565 - DNA, 20 bp, Artificial Sequence
  chemically synthesized
tggataaagtaaactgaaaa

SEQ ID NO: 138566 - DNA, 20 bp, Artificial Sequence
  chemically synthesized
cgttttcagtttactttatc

SEQ ID NO: 138567 - DNA, 20 bp, Artificial Sequence
  chemically synthesized
tccactgatggatctggata

SEQ ID NO: 138568 - DNA, 20 bp, Artificial Sequence
  chemically synthesized
tttactttatccagatccat

SEQ ID NO: 138569 - DNA, 20 bp, Artificial Sequence
  chemically synthesized
ggtgagtccactgatggatc

SEQ ID NO: 138570 - DNA, 20 bp, Artificial Sequence
  chemically synthesized
actttatccagatccatcag

SEQ ID NO: 138571 - DNA, 20 bp, Artificial Sequence
  chemically synthesized
tattgtggtgagtccactga

SEQ ID NO: 138572 - DNA, 20 bp, Artificial Sequence
  chemically synthesized
tatagctgctatattgtggt

SEQ ID NO: 138573 - DNA, 20 bp, Artificial Sequence
  chemically synthesized
tcagtggactcaccacaata

SEQ ID NO: 138574 - DNA, 20 bp, Artificial Sequence
  chemically synthesized
aaggtatagctgctatattg

SEQ ID NO: 138575 - DNA, 20 bp, Artificial Sequence
  chemically synthesized
gtggactcaccacaatatag

SEQ ID NO: 138576 - DNA, 20 bp, Artificial Sequence
  chemically synthesized
tcatacatttcataaaggta

SEQ ID NO: 138577 - DNA, 20 bp, Artificial Sequence
  chemically synthesized
ttaaatcatacatttcataa

SEQ ID NO: 138578 - DNA, 20 bp, Artificial Sequence
  chemically synthesized
cttaaatcatacatttcata

SEQ ID NO: 138579 - DNA, 20 bp, Artificial Sequence
  chemically synthesized
ctttatgaaatgtatgattt

SEQ ID NO: 138580 - DNA, 20 bp, Artificial Sequence
  chemically synthesized
aaatgtatgatttaagtaat

SEQ ID NO: 138581 - DNA, 20 bp, Artificial Sequence
  chemically synthesized
atttaagtaataagacttga

SEQ ID NO: 138582 - DNA, 20 bp, Artificial Sequence
  chemically synthesized
aagaagtcacttcaactttc

SEQ ID NO: 138583 - DNA, 20 bp, Artificial Sequence
  chemically synthesized
gtaataagacttgaaagttg

SEQ ID NO: 138584 - DNA, 20 bp, Artificial Sequence
  chemically synthesized
tctgcagtccttggatcaag

SEQ ID NO: 138585 - DNA, 20 bp, Artificial Sequence
  chemically synthesized
ttgaagtgacttcttgatcc

SEQ ID NO: 138586 - DNA, 20 bp, Artificial Sequence
  chemically synthesized
tgaagtgacttcttgatcca

SEQ ID NO: 138587 - DNA, 20 bp, Artificial Sequence
  chemically synthesized
cattctgcagtccttggatc

SEQ ID NO: 138588 - DNA, 20 bp, Artificial Sequence
  chemically synthesized
acttcttgatccaaggactg

SEQ ID NO: 138589 - DNA, 20 bp, Artificial Sequence
  chemically synthesized
aacatccattctgcagtcct

SEQ ID NO: 138590 - DNA, 20 bp, Artificial Sequence
  chemically synthesized
ttgatccaaggactgcagaa

SEQ ID NO: 138591 - DNA, 20 bp, Artificial Sequence
  chemically synthesized
ctaacacaacatccattctg

SEQ ID NO: 138592 - DNA, 20 bp, Artificial Sequence
  chemically synthesized
ctgcagaatggatgttgtgt

SEQ ID NO: 138593 - DNA, 20 bp, Artificial Sequence
  chemically synthesized
cagaatggatgttgtgttag

SEQ ID NO: 138594 - DNA, 20 bp, Artificial Sequence
  chemically synthesized
agaatggatgttgtgttagc

SEQ ID NO: 138595 - DNA, 20 bp, Artificial Sequence
  chemically synthesized
gaaaataaaatcattctctt

SEQ ID NO: 138596 - DNA, 20 bp, Artificial Sequence
  chemically synthesized
ccctgaggaatatgtccaaa

SEQ ID NO: 138597 - DNA, 20 bp, Artificial Sequence
  chemically synthesized
agccctgaggaatatgtcca

SEQ ID NO: 138598 - DNA, 20 bp, Artificial Sequence
  chemically synthesized
ttctctttggacatattcct

SEQ ID NO: 138599 - DNA, 20 bp, Artificial Sequence
  chemically synthesized
tctctttggacatattcctc

SEQ ID NO: 138600 - DNA, 20 bp, Artificial Sequence
  chemically synthesized
ctctttggacatattcctca

SEQ ID NO: 138601 - DNA, 20 bp, Artificial Sequence
  chemically synthesized
ctggtcacccaagagccctg

SEQ ID NO: 138602 - DNA, 20 bp, Artificial Sequence
  chemically synthesized
cctggtcacccaagagccct

SEQ ID NO: 138603 - DNA, 20 bp, Artificial Sequence
  chemically synthesized
gacatattcctcagggctct

SEQ ID NO: 138604 - DNA, 20 bp, Artificial Sequence
  chemically synthesized
acatattcctcagggctctt

SEQ ID NO: 138605 - DNA, 20 bp, Artificial Sequence
  chemically synthesized
caatgtccctggtcacccaa

SEQ ID NO: 138606 - DNA, 20 bp, Artificial Sequence
  chemically synthesized
cctcagggctcttgggtgac

SEQ ID NO: 138607 - DNA, 20 bp, Artificial Sequence
  chemically synthesized
gacaatgtccctggtcaccc

SEQ ID NO: 138608 - DNA, 20 bp, Artificial Sequence
  chemically synthesized
ctcagggctcttgggtgacc

SEQ ID NO: 138609 - DNA, 20 bp, Artificial Sequence
  chemically synthesized
tcagggctcttgggtgacca

SEQ ID NO: 138610 - DNA, 20 bp, Artificial Sequence
  chemically synthesized
ctgctctttgacaatgtccc

SEQ ID NO: 138611 - DNA, 20 bp, Artificial Sequence
  chemically synthesized
ggtgaccagggacattgtca

SEQ ID NO: 138612 - DNA, 20 bp, Artificial Sequence
  chemically synthesized
tgaccagggacattgtcaaa

SEQ ID NO: 138613 - DNA, 20 bp, Artificial Sequence
  chemically synthesized
ccagggacattgtcaaagag

SEQ ID NO: 138614 - DNA, 20 bp, Artificial Sequence
  chemically synthesized
aaagagcagtaatattttga

SEQ ID NO: 138615 - DNA, 20 bp, Artificial Sequence
  chemically synthesized
tttgaaagacacattttttt

SEQ ID NO: 138616 - DNA, 20 bp, Artificial Sequence
  chemically synthesized
gaaagacacatttttttgag

SEQ ID NO: 138617 - DNA, 20 bp, Artificial Sequence
  chemically synthesized
agacacatttttttgagaag

SEQ ID NO: 138618 - DNA, 20 bp, Artificial Sequence
  chemically synthesized
gacacatttttttgagaagt

SEQ ID NO: 138619 - DNA, 20 bp, Artificial Sequence
  chemically synthesized
ttttgagaagtaggtctcaa

SEQ ID NO: 138620 - DNA, 20 bp, Artificial Sequence
  chemically synthesized
ttgagaagtaggtctcaaca

SEQ ID NO: 138621 - DNA, 20 bp, Artificial Sequence
  chemically synthesized
tgagaagtaggtctcaacag

SEQ ID NO: 138622 - DNA, 20 bp, Artificial Sequence
  chemically synthesized
gagaagtaggtctcaacaga

SEQ ID NO: 138623 - DNA, 20 bp, Artificial Sequence
  chemically synthesized
aacattttgagccctctgtt

SEQ ID NO: 138624 - DNA, 20 bp, Artificial Sequence
  chemically synthesized
catggtttgatgaacatttt

SEQ ID NO: 138625 - DNA, 20 bp, Artificial Sequence
  chemically synthesized
gttcatcaaaccatgctgta

SEQ ID NO: 138626 - DNA, 20 bp, Artificial Sequence
  chemically synthesized
ctgcacatctctttacagca

SEQ ID NO: 138627 - DNA, 20 bp, Artificial Sequence
  chemically synthesized
tcatcaaaccatgctgtaaa

SEQ ID NO: 138628 - DNA, 20 bp, Artificial Sequence
  chemically synthesized
gatgactgcacatctcttta

SEQ ID NO: 138629 - DNA, 20 bp, Artificial Sequence
  chemically synthesized
ccatgctgtaaagagatgtg

SEQ ID NO: 138630 - DNA, 20 bp, Artificial Sequence
  chemically synthesized
taaagagatgtgcagtcatc

SEQ ID NO: 138631 - DNA, 20 bp, Artificial Sequence
  chemically synthesized
gtaaatcaaacaacaaagac

SEQ ID NO: 138632 - DNA, 20 bp, Artificial Sequence
  chemically synthesized
gctctgtaaatcaaacaaca

SEQ ID NO: 138633 - DNA, 20 bp, Artificial Sequence
  chemically synthesized
agtctttgttgtttgattta

SEQ ID NO: 138634 - DNA, 20 bp, Artificial Sequence
  chemically synthesized
tctttgttgtttgatttaca

SEQ ID NO: 138635 - DNA, 20 bp, Artificial Sequence
  chemically synthesized
gttgtttgatttacagagca

SEQ ID NO: 138636 - DNA, 20 bp, Artificial Sequence
  chemically synthesized
ttgtttgatttacagagcat

SEQ ID NO: 138637 - DNA, 20 bp, Artificial Sequence
  chemically synthesized
tttgatttacagagcatagg

SEQ ID NO: 138638 - DNA, 20 bp, Artificial Sequence
  chemically synthesized
tttacagagcataggcagac

SEQ ID NO: 138639 - DNA, 20 bp, Artificial Sequence
  chemically synthesized
gagcataggcagactagatc

SEQ ID NO: 138640 - DNA, 20 bp, Artificial Sequence
  chemically synthesized
ccttcaggttatgctagatc

SEQ ID NO: 138641 - DNA, 20 bp, Artificial Sequence
  chemically synthesized
tagggcccttcaggttatgc

SEQ ID NO: 138642 - DNA, 20 bp, Artificial Sequence
  chemically synthesized
actagatctagcataacctg

SEQ ID NO: 138643 - DNA, 20 bp, Artificial Sequence
  chemically synthesized
ctagatctagcataacctga

SEQ ID NO: 138644 - DNA, 20 bp, Artificial Sequence
  chemically synthesized
tagatctagcataacctgaa

SEQ ID NO: 138645 - DNA, 20 bp, Artificial Sequence
  chemically synthesized
caaaaatcctagggcccttc

SEQ ID NO: 138646 - DNA, 20 bp, Artificial Sequence
  chemically synthesized
ccaaaaatcctagggccctt

SEQ ID NO: 138647 - DNA, 20 bp, Artificial Sequence
  chemically synthesized
tagcataacctgaagggccc

SEQ ID NO: 138648 - DNA, 20 bp, Artificial Sequence
  chemically synthesized
agcataacctgaagggccct

SEQ ID NO: 138649 - DNA, 20 bp, Artificial Sequence
  chemically synthesized
ttaccattccaaaaatccta

SEQ ID NO: 138650 - DNA, 20 bp, Artificial Sequence
  chemically synthesized
tttaccattccaaaaatcct

SEQ ID NO: 138651 - DNA, 20 bp, Artificial Sequence
  chemically synthesized
ctgaagggccctaggatttt

SEQ ID NO: 138652 - DNA, 20 bp, Artificial Sequence
  chemically synthesized
gtttaccattccaaaaatcc

SEQ ID NO: 138653 - DNA, 20 bp, Artificial Sequence
  chemically synthesized
gggccctaggatttttggaa

SEQ ID NO: 138654 - DNA, 20 bp, Artificial Sequence
  chemically synthesized
ggatttttggaatggtaaac

SEQ ID NO: 138655 - DNA, 20 bp, Artificial Sequence
  chemically synthesized
ttggaatggtaaacgagcac

SEQ ID NO: 138656 - DNA, 20 bp, Artificial Sequence
  chemically synthesized
tggtgactttcagttgaagc

SEQ ID NO: 138657 - DNA, 20 bp, Artificial Sequence
  chemically synthesized
cgagcactggcttcaactga

SEQ ID NO: 138658 - DNA, 20 bp, Artificial Sequence
  chemically synthesized
caactggtgactttcagttg

SEQ ID NO: 138659 - DNA, 20 bp, Artificial Sequence
  chemically synthesized
ctaatgcaactggtgacttt

SEQ ID NO: 138660 - DNA, 20 bp, Artificial Sequence
  chemically synthesized
tggcttcaactgaaagtcac

SEQ ID NO: 138661 - DNA, 20 bp, Artificial Sequence
  chemically synthesized
ctgaaagtcaccagttgcat

SEQ ID NO: 138662 - DNA, 20 bp, Artificial Sequence
  chemically synthesized
ttgtgaggggctaatgcaac

SEQ ID NO: 138663 - DNA, 20 bp, Artificial Sequence
  chemically synthesized
cagttgcattagcccctcac

SEQ ID NO: 138664 - DNA, 20 bp, Artificial Sequence
  chemically synthesized
caggctgactgtcttgtgag

SEQ ID NO: 138665 - DNA, 20 bp, Artificial Sequence
  chemically synthesized
acaggctgactgtcttgtga

SEQ ID NO: 138666 - DNA, 20 bp, Artificial Sequence
  chemically synthesized
tgcattagcccctcacaaga

SEQ ID NO: 138667 - DNA, 20 bp, Artificial Sequence
  chemically synthesized
gacaggctgactgtcttgtg

SEQ ID NO: 138668 - DNA, 20 bp, Artificial Sequence
  chemically synthesized
ggacaggctgactgtcttgt

SEQ ID NO: 138669 - DNA, 20 bp, Artificial Sequence
  chemically synthesized
ttagcccctcacaagacagt

SEQ ID NO: 138670 - DNA, 20 bp, Artificial Sequence
  chemically synthesized
gcttcaaaagttcaaaggac

SEQ ID NO: 138671 - DNA, 20 bp, Artificial Sequence
  chemically synthesized
ggcttcaaaagttcaaagga

SEQ ID NO: 138672 - DNA, 20 bp, Artificial Sequence
  chemically synthesized
gcctggcttcaaaagttcaa

SEQ ID NO: 138673 - DNA, 20 bp, Artificial Sequence
  chemically synthesized
tgcctggcttcaaaagttca

SEQ ID NO: 138674 - DNA, 20 bp, Artificial Sequence
  chemically synthesized
gcctgtcctttgaacttttg

SEQ ID NO: 138675 - DNA, 20 bp, Artificial Sequence
  chemically synthesized
gtcctttgaacttttgaagc

SEQ ID NO: 138676 - DNA, 20 bp, Artificial Sequence
  chemically synthesized
aagtcaatgcctggcttcaa

SEQ ID NO: 138677 - DNA, 20 bp, Artificial Sequence
  chemically synthesized
tcctttgaacttttgaagcc

SEQ ID NO: 138678 - DNA, 20 bp, Artificial Sequence
  chemically synthesized
gctagagagaagtcaatgcc

SEQ ID NO: 138679 - DNA, 20 bp, Artificial Sequence
  chemically synthesized
gccaggcattgacttctctc

SEQ ID NO: 138680 - DNA, 20 bp, Artificial Sequence
  chemically synthesized
ggactttcatagctagagag

SEQ ID NO: 138681 - DNA, 20 bp, Artificial Sequence
  chemically synthesized
ctaggactttcatagctaga

SEQ ID NO: 138682 - DNA, 20 bp, Artificial Sequence
  chemically synthesized
atctaggactttcatagcta

SEQ ID NO: 138683 - DNA, 20 bp, Artificial Sequence
  chemically synthesized
tgacttctctctagctatga

SEQ ID NO: 138684 - DNA, 20 bp, Artificial Sequence
  chemically synthesized
ccatctaggactttcatagc

SEQ ID NO: 138685 - DNA, 20 bp, Artificial Sequence
  chemically synthesized
gatgccatctaggactttca

SEQ ID NO: 138686 - DNA, 20 bp, Artificial Sequence
  chemically synthesized
ctctctagctatgaaagtcc

SEQ ID NO: 138687 - DNA, 20 bp, Artificial Sequence
  chemically synthesized
ctagctatgaaagtcctaga

SEQ ID NO: 138688 - DNA, 20 bp, Artificial Sequence
  chemically synthesized
attggaaaaggatgccatct

SEQ ID NO: 138689 - DNA, 20 bp, Artificial Sequence
  chemically synthesized
tattggaaaaggatgccatc

SEQ ID NO: 138690 - DNA, 20 bp, Artificial Sequence
  chemically synthesized
tagatggcatccttttccaa

SEQ ID NO: 138691 - DNA, 20 bp, Artificial Sequence
  chemically synthesized
aaacagccttctattggaaa

SEQ ID NO: 138692 - DNA, 20 bp, Artificial Sequence
  chemically synthesized
gaaacagccttctattggaa

SEQ ID NO: 138693 - DNA, 20 bp, Artificial Sequence
  chemically synthesized
atggcatccttttccaatag

SEQ ID NO: 138694 - DNA, 20 bp, Artificial Sequence
  chemically synthesized
tggcatccttttccaataga

SEQ ID NO: 138695 - DNA, 20 bp, Artificial Sequence
  chemically synthesized
tagacgaaacagccttctat

SEQ ID NO: 138696 - DNA, 20 bp, Artificial Sequence
  chemically synthesized
cattttcaatatagacgaaa

SEQ ID NO: 138697 - DNA, 20 bp, Artificial Sequence
  chemically synthesized
taaacaacacattttcaata

SEQ ID NO: 138698 - DNA, 20 bp, Artificial Sequence
  chemically synthesized
tatattgaaaatgtgttgtt

SEQ ID NO: 138699 - DNA, 20 bp, Artificial Sequence
  chemically synthesized
aacatctaagttaataaagg

SEQ ID NO: 138700 - DNA, 20 bp, Artificial Sequence
  chemically synthesized
actaacatctaagttaataa

SEQ ID NO: 138701 - DNA, 20 bp, Artificial Sequence
  chemically synthesized
aactaacatctaagttaata

SEQ ID NO: 138702 - DNA, 20 bp, Artificial Sequence
  chemically synthesized
tattgccacctttattaact

SEQ ID NO: 138703 - DNA, 20 bp, Artificial Sequence
  chemically synthesized
acctttattaacttagatgt

SEQ ID NO: 138704 - DNA, 20 bp, Artificial Sequence
  chemically synthesized
agaagatcaaactaacatct

SEQ ID NO: 138705 - DNA, 20 bp, Artificial Sequence
  chemically synthesized
tagatgttagtttgatcttc

SEQ ID NO: 138706 - DNA, 20 bp, Artificial Sequence
  chemically synthesized
tgttagtttgatcttctgga

SEQ ID NO: 138707 - DNA, 20 bp, Artificial Sequence
  chemically synthesized
agctgcagcaaactatccag

SEQ ID NO: 138708 - DNA, 20 bp, Artificial Sequence
  chemically synthesized
agaagctgcagcaaactatc

SEQ ID NO: 138709 - DNA, 20 bp, Artificial Sequence
  chemically synthesized
atcttctggatagtttgctg

SEQ ID NO: 138710 - DNA, 20 bp, Artificial Sequence
  chemically synthesized
aagtgctgatggagaagctg

SEQ ID NO: 138711 - DNA, 20 bp, Artificial Sequence
  chemically synthesized
gtttgctgcagcttctccat

SEQ ID NO: 138712 - DNA, 20 bp, Artificial Sequence
  chemically synthesized
agcaacaagtgctgatggag

SEQ ID NO: 138713 - DNA, 20 bp, Artificial Sequence
  chemically synthesized
cagagcaacaagtgctgatg

SEQ ID NO: 138714 - DNA, 20 bp, Artificial Sequence
  chemically synthesized
ggcagagcaacaagtgctga

SEQ ID NO: 138715 - DNA, 20 bp, Artificial Sequence
  chemically synthesized
aaagtgcaaggcagagcaac

SEQ ID NO: 138716 - DNA, 20 bp, Artificial Sequence
  chemically synthesized
taacataaaagtgcaaggca

SEQ ID NO: 138717 - DNA, 20 bp, Artificial Sequence
  chemically synthesized
tataacataaaagtgcaagg

SEQ ID NO: 138718 - DNA, 20 bp, Artificial Sequence
  chemically synthesized
ctctataacataaaagtgca

SEQ ID NO: 138719 - DNA, 20 bp, Artificial Sequence
  chemically synthesized
tctctataacataaaagtgc

SEQ ID NO: 138720 - DNA, 20 bp, Artificial Sequence
  chemically synthesized
aagccctctctataacataa

SEQ ID NO: 138721 - DNA, 20 bp, Artificial Sequence
  chemically synthesized
tgccttgcacttttatgtta

SEQ ID NO: 138722 - DNA, 20 bp, Artificial Sequence
  chemically synthesized
ccttgcacttttatgttata

SEQ ID NO: 138723 - DNA, 20 bp, Artificial Sequence
  chemically synthesized
ttgcacttttatgttataga

SEQ ID NO: 138724 - DNA, 20 bp, Artificial Sequence
  chemically synthesized
tgcacttttatgttatagag

SEQ ID NO: 138725 - DNA, 20 bp, Artificial Sequence
  chemically synthesized
gcacttttatgttatagaga

SEQ ID NO: 138726 - DNA, 20 bp, Artificial Sequence
  chemically synthesized
atagagagggcttattcatt

SEQ ID NO: 138727 - DNA, 20 bp, Artificial Sequence
  chemically synthesized
gttcatgagccttaatgaat

SEQ ID NO: 138728 - DNA, 20 bp, Artificial Sequence
  chemically synthesized
tagagagggcttattcatta

SEQ ID NO: 138729 - DNA, 20 bp, Artificial Sequence
  chemically synthesized
gctagcagaagtatgttcat

SEQ ID NO: 138730 - DNA, 20 bp, Artificial Sequence
  chemically synthesized
gctcatgaacatacttctgc

SEQ ID NO: 138731 - DNA, 20 bp, Artificial Sequence
  chemically synthesized
gaaaagttggaagctagcag

SEQ ID NO: 138732 - DNA, 20 bp, Artificial Sequence
  chemically synthesized
gcagaaaagttggaagctag

SEQ ID NO: 138733 - DNA, 20 bp, Artificial Sequence
  chemically synthesized
gcagcagaaaagttggaagc

SEQ ID NO: 138734 - DNA, 20 bp, Artificial Sequence
  chemically synthesized
agctgcagcagaaaagttgg

SEQ ID NO: 138735 - DNA, 20 bp, Artificial Sequence
  chemically synthesized
ggaagctgcagcagaaaagt

SEQ ID NO: 138736 - DNA, 20 bp, Artificial Sequence
  chemically synthesized
gtgaggaagctgcagcagaa

SEQ ID NO: 138737 - DNA, 20 bp, Artificial Sequence
  chemically synthesized
agcttccaacttttctgctg

SEQ ID NO: 138738 - DNA, 20 bp, Artificial Sequence
  chemically synthesized
gagaggtgaggaagctgcag

SEQ ID NO: 138739 - DNA, 20 bp, Artificial Sequence
  chemically synthesized
cgagagaggtgaggaagctg

SEQ ID NO: 138740 - DNA, 20 bp, Artificial Sequence
  chemically synthesized
gaatgccgagagaggtgagg

SEQ ID NO: 138741 - DNA, 20 bp, Artificial Sequence
  chemically synthesized
tgtgaatgccgagagaggtg

SEQ ID NO: 138742 - DNA, 20 bp, Artificial Sequence
  chemically synthesized
ctgtgaatgccgagagaggt

SEQ ID NO: 138743 - DNA, 20 bp, Artificial Sequence
  chemically synthesized
tgcagcttcctcacctctct

SEQ ID NO: 138744 - DNA, 20 bp, Artificial Sequence
  chemically synthesized
aattctgtgaatgccgagag

SEQ ID NO: 138745 - DNA, 20 bp, Artificial Sequence
  chemically synthesized
caattctgtgaatgccgaga

SEQ ID NO: 138746 - DNA, 20 bp, Artificial Sequence
  chemically synthesized
tgcaattctgtgaatgccga

SEQ ID NO: 138747 - DNA, 20 bp, Artificial Sequence
  chemically synthesized
tctgcaattctgtgaatgcc

SEQ ID NO: 138748 - DNA, 20 bp, Artificial Sequence
  chemically synthesized
ctcacctctctcggcattca

SEQ ID NO: 138749 - DNA, 20 bp, Artificial Sequence
  chemically synthesized
tctcggcattcacagaattg

SEQ ID NO: 138750 - DNA, 20 bp, Artificial Sequence
  chemically synthesized
tcggcattcacagaattgca

SEQ ID NO: 138751 - DNA, 20 bp, Artificial Sequence
  chemically synthesized
ttcacagaattgcagagaat

SEQ ID NO: 138752 - DNA, 20 bp, Artificial Sequence
  chemically synthesized
agagaattagtcctttgctt

SEQ ID NO: 138753 - DNA, 20 bp, Artificial Sequence
  chemically synthesized
aaaaggctaatctaaagcaa

SEQ ID NO: 138754 - DNA, 20 bp, Artificial Sequence
  chemically synthesized
caaaaggctaatctaaagca

SEQ ID NO: 138755 - DNA, 20 bp, Artificial Sequence
  chemically synthesized
attagtcctttgctttagat

SEQ ID NO: 138756 - DNA, 20 bp, Artificial Sequence
  chemically synthesized
ttaagcaaaaggctaatcta

SEQ ID NO: 138757 - DNA, 20 bp, Artificial Sequence
  chemically synthesized
tttagattagccttttgctt

SEQ ID NO: 138758 - DNA, 20 bp, Artificial Sequence
  chemically synthesized
acaccattatcttaagcaaa

SEQ ID NO: 138759 - DNA, 20 bp, Artificial Sequence
  chemically synthesized
cacaccattatcttaagcaa

SEQ ID NO: 138760 - DNA, 20 bp, Artificial Sequence
  chemically synthesized
tagccttttgcttaagataa

SEQ ID NO: 138761 - DNA, 20 bp, Artificial Sequence
  chemically synthesized
aacagccacaccattatctt

SEQ ID NO: 138762 - DNA, 20 bp, Artificial Sequence
  chemically synthesized
ttttgcttaagataatggtg

SEQ ID NO: 138763 - DNA, 20 bp, Artificial Sequence
  chemically synthesized
gtctggatagaggatcaaaa

SEQ ID NO: 138764 - DNA, 20 bp, Artificial Sequence
  chemically synthesized
ggctgttttgatcctctatc

SEQ ID NO: 138765 - DNA, 20 bp, Artificial Sequence
  chemically synthesized
tgtcttagtggtctggatag

SEQ ID NO: 138766 - DNA, 20 bp, Artificial Sequence
  chemically synthesized
atgtcttagtggtctggata

SEQ ID NO: 138767 - DNA, 20 bp, Artificial Sequence
  chemically synthesized
gaatgtcttagtggtctgga

SEQ ID NO: 138768 - DNA, 20 bp, Artificial Sequence
  chemically synthesized
gatcctctatccagaccact

SEQ ID NO: 138769 - DNA, 20 bp, Artificial Sequence
  chemically synthesized
tggagaatgtcttagtggtc

SEQ ID NO: 138770 - DNA, 20 bp, Artificial Sequence
  chemically synthesized
taatatggagaatgtcttag

SEQ ID NO: 138771 - DNA, 20 bp, Artificial Sequence
  chemically synthesized
ttttaatatggagaatgtct

SEQ ID NO: 138772 - DNA, 20 bp, Artificial Sequence
  chemically synthesized
acggccttatttttaatatg

SEQ ID NO: 138773 - DNA, 20 bp, Artificial Sequence
  chemically synthesized
gaacggccttatttttaata

SEQ ID NO: 138774 - DNA, 20 bp, Artificial Sequence
  chemically synthesized
acattctccatattaaaaat

SEQ ID NO: 138775 - DNA, 20 bp, Artificial Sequence
  chemically synthesized
cattctccatattaaaaata

SEQ ID NO: 138776 - DNA, 20 bp, Artificial Sequence
  chemically synthesized
acaggaataagaaagtggaa

SEQ ID NO: 138777 - DNA, 20 bp, Artificial Sequence
  chemically synthesized
tgaacacaggaataagaaag

SEQ ID NO: 138778 - DNA, 20 bp, Artificial Sequence
  chemically synthesized
tgttgaacacaggaataaga

SEQ ID NO: 138779 - DNA, 20 bp, Artificial Sequence
  chemically synthesized
actctgttgaacacaggaat

SEQ ID NO: 138780 - DNA, 20 bp, Artificial Sequence
  chemically synthesized
agtgctactctgttgaacac

SEQ ID NO: 138781 - DNA, 20 bp, Artificial Sequence
  chemically synthesized
tttcttattcctgtgttcaa

SEQ ID NO: 138782 - DNA, 20 bp, Artificial Sequence
  chemically synthesized
aagtgctactctgttgaaca

SEQ ID NO: 138783 - DNA, 20 bp, Artificial Sequence
  chemically synthesized
tcttattcctgtgttcaaca

SEQ ID NO: 138784 - DNA, 20 bp, Artificial Sequence
  chemically synthesized
tattcctgtgttcaacagag

SEQ ID NO: 138785 - DNA, 20 bp, Artificial Sequence
  chemically synthesized
acgttcttgaagaaaattaa

SEQ ID NO: 138786 - DNA, 20 bp, Artificial Sequence
  chemically synthesized
tagcacttttaattttcttc

SEQ ID NO: 138787 - DNA, 20 bp, Artificial Sequence
  chemically synthesized
atgcaaaggaaacgttcttg

SEQ ID NO: 138788 - DNA, 20 bp, Artificial Sequence
  chemically synthesized
tggccaagttgtgaatgcaa

SEQ ID NO: 138789 - DNA, 20 bp, Artificial Sequence
  chemically synthesized
ttggccaagttgtgaatgca

SEQ ID NO: 138790 - DNA, 20 bp, Artificial Sequence
  chemically synthesized
tttcctttgcattcacaact

SEQ ID NO: 138791 - DNA, 20 bp, Artificial Sequence
  chemically synthesized
gcattcacaacttggccaac

SEQ ID NO: 138792 - DNA, 20 bp, Artificial Sequence
  chemically synthesized
acctcttgtgccagttggcc

SEQ ID NO: 138793 - DNA, 20 bp, Artificial Sequence
  chemically synthesized
gccagacctcttgtgccagt

SEQ ID NO: 138794 - DNA, 20 bp, Artificial Sequence
  chemically synthesized
acaacttggccaactggcac

SEQ ID NO: 138795 - DNA, 20 bp, Artificial Sequence
  chemically synthesized
aacttggccaactggcacaa

SEQ ID NO: 138796 - DNA, 20 bp, Artificial Sequence
  chemically synthesized
acttggccaactggcacaag

SEQ ID NO: 138797 - DNA, 20 bp, Artificial Sequence
  chemically synthesized
gaaagccagacctcttgtgc

SEQ ID NO: 138798 - DNA, 20 bp, Artificial Sequence
  chemically synthesized
gccaactggcacaagaggtc

SEQ ID NO: 138799 - DNA, 20 bp, Artificial Sequence
  chemically synthesized
ggcacaagaggtctggcttt

SEQ ID NO: 138800 - DNA, 20 bp, Artificial Sequence
  chemically synthesized
agccaagacaggctgaaagc

SEQ ID NO: 138801 - DNA, 20 bp, Artificial Sequence
  chemically synthesized
caaaagccaagacaggctga

SEQ ID NO: 138802 - DNA, 20 bp, Artificial Sequence
  chemically synthesized
gtctggctttcagcctgtct

SEQ ID NO: 138803 - DNA, 20 bp, Artificial Sequence
  chemically synthesized
ggcatgtcaaaagccaagac

SEQ ID NO: 138804 - DNA, 20 bp, Artificial Sequence
  chemically synthesized
aggcatgtcaaaagccaaga

SEQ ID NO: 138805 - DNA, 20 bp, Artificial Sequence
  chemically synthesized
aggaaggcatgtcaaaagcc

SEQ ID NO: 138806 - DNA, 20 bp, Artificial Sequence
  chemically synthesized
tggtgaggaaggcatgtcaa

SEQ ID NO: 138807 - DNA, 20 bp, Artificial Sequence
  chemically synthesized
atgattaagattggtgagga

SEQ ID NO: 138808 - DNA, 20 bp, Artificial Sequence
  chemically synthesized
aatgattaagattggtgagg

SEQ ID NO: 138809 - DNA, 20 bp, Artificial Sequence
  chemically synthesized
agaaatgattaagattggtg

SEQ ID NO: 138810 - DNA, 20 bp, Artificial Sequence
  chemically synthesized
cagaaatgattaagattggt

SEQ ID NO: 138811 - DNA, 20 bp, Artificial Sequence
  chemically synthesized
aagtcagaaatgattaagat

SEQ ID NO: 138812 - DNA, 20 bp, Artificial Sequence
  chemically synthesized
atcaaaagtcagaaatgatt

SEQ ID NO: 138813 - DNA, 20 bp, Artificial Sequence
  chemically synthesized
tgtcactttaaatcaaaagt

SEQ ID NO: 138814 - DNA, 20 bp, Artificial Sequence
  chemically synthesized
tgtttgtcactttaaatcaa

SEQ ID NO: 138815 - DNA, 20 bp, Artificial Sequence
  chemically synthesized
catttctgacttttgattta

SEQ ID NO: 138816 - DNA, 20 bp, Artificial Sequence
  chemically synthesized
agtgttcatgggaaaaaaaa

SEQ ID NO: 138817 - DNA, 20 bp, Artificial Sequence
  chemically synthesized
taagtgttcatgggaaaaaa

SEQ ID NO: 138818 - DNA, 20 bp, Artificial Sequence
  chemically synthesized
aatgtcctctaagtgttcat

SEQ ID NO: 138819 - DNA, 20 bp, Artificial Sequence
  chemically synthesized
caatgtcctctaagtgttca

SEQ ID NO: 138820 - DNA, 20 bp, Artificial Sequence
  chemically synthesized
ttttttttcccatgaacact

SEQ ID NO: 138821 - DNA, 20 bp, Artificial Sequence
  chemically synthesized
ttttttcccatgaacactta

SEQ ID NO: 138822 - DNA, 20 bp, Artificial Sequence
  chemically synthesized
tttttcccatgaacacttag

SEQ ID NO: 138823 - DNA, 20 bp, Artificial Sequence
  chemically synthesized
gtaaccctacaatgtcctct

SEQ ID NO: 138824 - DNA, 20 bp, Artificial Sequence
  chemically synthesized
tgaacacttagaggacattg

SEQ ID NO: 138825 - DNA, 20 bp, Artificial Sequence
  chemically synthesized
gaacacttagaggacattgt

SEQ ID NO: 138826 - DNA, 20 bp, Artificial Sequence
  chemically synthesized
aacacttagaggacattgta

SEQ ID NO: 138827 - DNA, 20 bp, Artificial Sequence
  chemically synthesized
gacattgtagggttactgac

SEQ ID NO: 138828 - DNA, 20 bp, Artificial Sequence
  chemically synthesized
aatattgaaattatgccagt

SEQ ID NO: 138829 - DNA, 20 bp, Artificial Sequence
  chemically synthesized
caacaatattgaaattatgc

SEQ ID NO: 138830 - DNA, 20 bp, Artificial Sequence
  chemically synthesized
atttcaatattgttgtgtct

SEQ ID NO: 138831 - DNA, 20 bp, Artificial Sequence
  chemically synthesized
tttcaatattgttgtgtctc

SEQ ID NO: 138832 - DNA, 20 bp, Artificial Sequence
  chemically synthesized
ttcaatattgttgtgtctca

SEQ ID NO: 138833 - DNA, 20 bp, Artificial Sequence
  chemically synthesized
tattgttgtgtctcagggaa

SEQ ID NO: 138834 - DNA, 20 bp, Artificial Sequence
  chemically synthesized
attgttgtgtctcagggaat

SEQ ID NO: 138835 - DNA, 20 bp, Artificial Sequence
  chemically synthesized
cttgggcctccctattccct

SEQ ID NO: 138836 - DNA, 20 bp, Artificial Sequence
  chemically synthesized
ttgttgtgtctcagggaata

SEQ ID NO: 138837 - DNA, 20 bp, Artificial Sequence
  chemically synthesized
gttgtgtctcagggaatagg

SEQ ID NO: 138838 - DNA, 20 bp, Artificial Sequence
  chemically synthesized
ttgtgtctcagggaataggg

SEQ ID NO: 138839 - DNA, 20 bp, Artificial Sequence
  chemically synthesized
ctcagggaatagggaggccc

SEQ ID NO: 138840 - DNA, 20 bp, Artificial Sequence
  chemically synthesized
tcagggaatagggaggccca

SEQ ID NO: 138841 - DNA, 20 bp, Artificial Sequence
  chemically synthesized
agggaatagggaggcccaag

SEQ ID NO: 138842 - DNA, 20 bp, Artificial Sequence
  chemically synthesized
ggaatagggaggcccaagga

SEQ ID NO: 138843 - DNA, 20 bp, Artificial Sequence
  chemically synthesized
gaatagggaggcccaaggag

SEQ ID NO: 138844 - DNA, 20 bp, Artificial Sequence
  chemically synthesized
tcatctctcttcctctcctt

SEQ ID NO: 138845 - DNA, 20 bp, Artificial Sequence
  chemically synthesized
ctcatctctcttcctctcct

SEQ ID NO: 138846 - DNA, 20 bp, Artificial Sequence
  chemically synthesized
tagggaggcccaaggagagg

SEQ ID NO: 138847 - DNA, 20 bp, Artificial Sequence
  chemically synthesized
gggaggcccaaggagaggaa

SEQ ID NO: 138848 - DNA, 20 bp, Artificial Sequence
  chemically synthesized
gaggcccaaggagaggaaga

SEQ ID NO: 138849 - DNA, 20 bp, Artificial Sequence
  chemically synthesized
ccaaggagaggaagagagat

SEQ ID NO: 138850 - DNA, 20 bp, Artificial Sequence
  chemically synthesized
caaggagaggaagagagatg

SEQ ID NO: 138851 - DNA, 20 bp, Artificial Sequence
  chemically synthesized
aaggagaggaagagagatga

SEQ ID NO: 138852 - DNA, 20 bp, Artificial Sequence
  chemically synthesized
gaggaagagagatgagggaa

SEQ ID NO: 138853 - DNA, 20 bp, Artificial Sequence
  chemically synthesized
gagatgagggaatggctgat

SEQ ID NO: 138854 - DNA, 20 bp, Artificial Sequence
  chemically synthesized
atgagggaatggctgatcag

SEQ ID NO: 138855 - DNA, 20 bp, Artificial Sequence
  chemically synthesized
gagggaatggctgatcagtg

SEQ ID NO: 138856 - DNA, 20 bp, Artificial Sequence
  chemically synthesized
gttctggctactccactgat

SEQ ID NO: 138857 - DNA, 20 bp, Artificial Sequence
  chemically synthesized
ggaatggctgatcagtggag

SEQ ID NO: 138858 - DNA, 20 bp, Artificial Sequence
  chemically synthesized
tggctgatcagtggagtagc

SEQ ID NO: 138859 - DNA, 20 bp, Artificial Sequence
  chemically synthesized
aatcaatgttttgtgtgttc

SEQ ID NO: 138860 - DNA, 20 bp, Artificial Sequence
  chemically synthesized
acacaaaacattgattgatt

SEQ ID NO: 138861 - DNA, 20 bp, Artificial Sequence
  chemically synthesized
cattacttattttcataaga

SEQ ID NO: 138862 - DNA, 20 bp, Artificial Sequence
  chemically synthesized
ttcccattacttattttcat

SEQ ID NO: 138863 - DNA, 20 bp, Artificial Sequence
  chemically synthesized
gtttgccatcttatgaaaat

SEQ ID NO: 138864 - DNA, 20 bp, Artificial Sequence
  chemically synthesized
catcttatgaaaataagtaa

SEQ ID NO: 138865 - DNA, 20 bp, Artificial Sequence
  chemically synthesized
atcttatgaaaataagtaat

SEQ ID NO: 138866 - DNA, 20 bp, Artificial Sequence
  chemically synthesized
atgaaaataagtaatgggaa

SEQ ID NO: 138867 - DNA, 20 bp, Artificial Sequence
  chemically synthesized
tgaaaataagtaatgggaaa

SEQ ID NO: 138868 - DNA, 20 bp, Artificial Sequence
  chemically synthesized
gggaaaaggactctgtattt

SEQ ID NO: 138869 - DNA, 20 bp, Artificial Sequence
  chemically synthesized
agcatcatgtcttaaataca

SEQ ID NO: 138870 - DNA, 20 bp, Artificial Sequence
  chemically synthesized
ccagcatcatgtcttaaata

SEQ ID NO: 138871 - DNA, 20 bp, Artificial Sequence
  chemically synthesized
ctgtatttaagacatgatgc

SEQ ID NO: 138872 - DNA, 20 bp, Artificial Sequence
  chemically synthesized
tgtatttaagacatgatgct

SEQ ID NO: 138873 - DNA, 20 bp, Artificial Sequence
  chemically synthesized
tttaagacatgatgctggga

SEQ ID NO: 138874 - DNA, 20 bp, Artificial Sequence
  chemically synthesized
agacatgatgctgggatggc

SEQ ID NO: 138875 - DNA, 20 bp, Artificial Sequence
  chemically synthesized
atatggctaaccagccatcc

SEQ ID NO: 138876 - DNA, 20 bp, Artificial Sequence
  chemically synthesized
atgatgctgggatggctggt

SEQ ID NO: 138877 - DNA, 20 bp, Artificial Sequence
  chemically synthesized
ttcttctgcatatggctaac

SEQ ID NO: 138878 - DNA, 20 bp, Artificial Sequence
  chemically synthesized
gatggctggttagccatatg

SEQ ID NO: 138879 - DNA, 20 bp, Artificial Sequence
  chemically synthesized
ggctggttagccatatgcag

SEQ ID NO: 138880 - DNA, 20 bp, Artificial Sequence
  chemically synthesized
cagttgcattcttctgcata

SEQ ID NO: 138881 - DNA, 20 bp, Artificial Sequence
  chemically synthesized
catatgcagaagaatgcaac

SEQ ID NO: 138882 - DNA, 20 bp, Artificial Sequence
  chemically synthesized
tatggtgtaaggagggggtc

SEQ ID NO: 138883 - DNA, 20 bp, Artificial Sequence
  chemically synthesized
ttgtatatggtgtaaggagg

SEQ ID NO: 138884 - DNA, 20 bp, Artificial Sequence
  chemically synthesized
tttgtatatggtgtaaggag

SEQ ID NO: 138885 - DNA, 20 bp, Artificial Sequence
  chemically synthesized
ttttgtatatggtgtaagga

SEQ ID NO: 138886 - DNA, 20 bp, Artificial Sequence
  chemically synthesized
tttttgtatatggtgtaagg

SEQ ID NO: 138887 - DNA, 20 bp, Artificial Sequence
  chemically synthesized
atttttgtatatggtgtaag

SEQ ID NO: 138888 - DNA, 20 bp, Artificial Sequence
  chemically synthesized
taatttttgtatatggtgta

SEQ ID NO: 138889 - DNA, 20 bp, Artificial Sequence
  chemically synthesized
ttaatttttgtatatggtgt

SEQ ID NO: 138890 - DNA, 20 bp, Artificial Sequence
  chemically synthesized
cttgagttaatttttgtata

SEQ ID NO: 138891 - DNA, 20 bp, Artificial Sequence
  chemically synthesized
ccatatacaaaaattaactc

SEQ ID NO: 138892 - DNA, 20 bp, Artificial Sequence
  chemically synthesized
atacaaaaattaactcaaga

SEQ ID NO: 138893 - DNA, 20 bp, Artificial Sequence
  chemically synthesized
ttaaacctttattccatctt

SEQ ID NO: 138894 - DNA, 20 bp, Artificial Sequence
  chemically synthesized
aattaactcaagatggaata

SEQ ID NO: 138895 - DNA, 20 bp, Artificial Sequence
  chemically synthesized
attaactcaagatggaataa

SEQ ID NO: 138896 - DNA, 20 bp, Artificial Sequence
  chemically synthesized
tggaataaaggtttaaacat

SEQ ID NO: 138897 - DNA, 20 bp, Artificial Sequence
  chemically synthesized
aacattagatctcaaattat

SEQ ID NO: 138898 - DNA, 20 bp, Artificial Sequence
  chemically synthesized
ttataggattcttataattt

SEQ ID NO: 138899 - DNA, 20 bp, Artificial Sequence
  chemically synthesized
tcaaattataagaatcctat

SEQ ID NO: 138900 - DNA, 20 bp, Artificial Sequence
  chemically synthesized
attataagaatcctataaga

SEQ ID NO: 138901 - DNA, 20 bp, Artificial Sequence
  chemically synthesized
tgtttcctaggctttcttat

SEQ ID NO: 138902 - DNA, 20 bp, Artificial Sequence
  chemically synthesized
gtgtttcctaggctttctta

SEQ ID NO: 138903 - DNA, 20 bp, Artificial Sequence
  chemically synthesized
aagaatcctataagaaagcc

SEQ ID NO: 138904 - DNA, 20 bp, Artificial Sequence
  chemically synthesized
agaatcctataagaaagcct

SEQ ID NO: 138905 - DNA, 20 bp, Artificial Sequence
  chemically synthesized
tgtccagagtggtgtttcct

SEQ ID NO: 138906 - DNA, 20 bp, Artificial Sequence
  chemically synthesized
atgtccagagtggtgtttcc

SEQ ID NO: 138907 - DNA, 20 bp, Artificial Sequence
  chemically synthesized
aagcctaggaaacaccactc

SEQ ID NO: 138908 - DNA, 20 bp, Artificial Sequence
  chemically synthesized
cccaagtctgatgtccagag

SEQ ID NO: 138909 - DNA, 20 bp, Artificial Sequence
  chemically synthesized
ggaaacaccactctggacat

SEQ ID NO: 138910 - DNA, 20 bp, Artificial Sequence
  chemically synthesized
tttcccaagtctgatgtcca

SEQ ID NO: 138911 - DNA, 20 bp, Artificial Sequence
  chemically synthesized
tctttcccaagtctgatgtc

SEQ ID NO: 138912 - DNA, 20 bp, Artificial Sequence
  chemically synthesized
accactctggacatcagact

SEQ ID NO: 138913 - DNA, 20 bp, Artificial Sequence
  chemically synthesized
ccactctggacatcagactt

SEQ ID NO: 138914 - DNA, 20 bp, Artificial Sequence
  chemically synthesized
tctggacatcagacttggga

SEQ ID NO: 138915 - DNA, 20 bp, Artificial Sequence
  chemically synthesized
ttagttataaattctttccc

SEQ ID NO: 138916 - DNA, 20 bp, Artificial Sequence
  chemically synthesized
ttgggaaagaatttataact

SEQ ID NO: 138917 - DNA, 20 bp, Artificial Sequence
  chemically synthesized
tataattgcttttgaggact

SEQ ID NO: 138918 - DNA, 20 bp, Artificial Sequence
  chemically synthesized
atttataactaagtcctcaa

SEQ ID NO: 138919 - DNA, 20 bp, Artificial Sequence
  chemically synthesized
ttttgttataattgcttttg

SEQ ID NO: 138920 - DNA, 20 bp, Artificial Sequence
  chemically synthesized
gttttgttataattgctttt

SEQ ID NO: 138921 - DNA, 20 bp, Artificial Sequence
  chemically synthesized
aagttccacttgtcaatttt

SEQ ID NO: 138922 - DNA, 20 bp, Artificial Sequence
  chemically synthesized
taacaaaaccaaaaattgac

SEQ ID NO: 138923 - DNA, 20 bp, Artificial Sequence
  chemically synthesized
caaaaccaaaaattgacaag

SEQ ID NO: 138924 - DNA, 20 bp, Artificial Sequence
  chemically synthesized
aagagctctttagtttaatt

SEQ ID NO: 138925 - DNA, 20 bp, Artificial Sequence
  chemically synthesized
agtggaacttaattaaacta

SEQ ID NO: 138926 - DNA, 20 bp, Artificial Sequence
  chemically synthesized
tggaacttaattaaactaaa

SEQ ID NO: 138927 - DNA, 20 bp, Artificial Sequence
  chemically synthesized
tttcactgtgaagagctctt

SEQ ID NO: 138928 - DNA, 20 bp, Artificial Sequence
  chemically synthesized
ttaaactaaagagctcttca

SEQ ID NO: 138929 - DNA, 20 bp, Artificial Sequence
  chemically synthesized
ataaattctttcactgtgaa

SEQ ID NO: 138930 - DNA, 20 bp, Artificial Sequence
  chemically synthesized
tgataaattctttcactgtg

SEQ ID NO: 138931 - DNA, 20 bp, Artificial Sequence
  chemically synthesized
taaagagctcttcacagtga

SEQ ID NO: 138932 - DNA, 20 bp, Artificial Sequence
  chemically synthesized
acagtgaaagaatttatcaa

SEQ ID NO: 138933 - DNA, 20 bp, Artificial Sequence
  chemically synthesized
agtgaaagaatttatcaaca

SEQ ID NO: 138934 - DNA, 20 bp, Artificial Sequence
  chemically synthesized
gaatttatcaacagagtaaa

SEQ ID NO: 138935 - DNA, 20 bp, Artificial Sequence
  chemically synthesized
ttatcaacagagtaaacaga

SEQ ID NO: 138936 - DNA, 20 bp, Artificial Sequence
  chemically synthesized
cagagtaaacagacagtcta

SEQ ID NO: 138937 - DNA, 20 bp, Artificial Sequence
  chemically synthesized
aaacagacagtctacagaat

SEQ ID NO: 138938 - DNA, 20 bp, Artificial Sequence
  chemically synthesized
aaatatattctcttattctg

SEQ ID NO: 138939 - DNA, 20 bp, Artificial Sequence
  chemically synthesized
acagacagtctacagaataa

SEQ ID NO: 138940 - DNA, 20 bp, Artificial Sequence
  chemically synthesized
ttagacctttgtcagatgca

SEQ ID NO: 138941 - DNA, 20 bp, Artificial Sequence
  chemically synthesized
tgcaaactatgcatctgaca

SEQ ID NO: 138942 - DNA, 20 bp, Artificial Sequence
  chemically synthesized
gcaaactatgcatctgacaa

SEQ ID NO: 138943 - DNA, 20 bp, Artificial Sequence
  chemically synthesized
tctgaatattagacctttgt

SEQ ID NO: 138944 - DNA, 20 bp, Artificial Sequence
  chemically synthesized
tctgacaaaggtctaatatt

SEQ ID NO: 138945 - DNA, 20 bp, Artificial Sequence
  chemically synthesized
tccctatagattctgaatat

SEQ ID NO: 138946 - DNA, 20 bp, Artificial Sequence
  chemically synthesized
ggtctaatattcagaatcta

SEQ ID NO: 138947 - DNA, 20 bp, Artificial Sequence
  chemically synthesized
gtctaatattcagaatctat

SEQ ID NO: 138948 - DNA, 20 bp, Artificial Sequence
  chemically synthesized
tctaatattcagaatctata

SEQ ID NO: 138949 - DNA, 20 bp, Artificial Sequence
  chemically synthesized
tgaattgtttaagttcccta

SEQ ID NO: 138950 - DNA, 20 bp, Artificial Sequence
  chemically synthesized
tttgacttgttgaattgttt

SEQ ID NO: 138951 - DNA, 20 bp, Artificial Sequence
  chemically synthesized
gggaacttaaacaattcaac

SEQ ID NO: 138952 - DNA, 20 bp, Artificial Sequence
  chemically synthesized
tttgcccattttttttgatg

SEQ ID NO: 138953 - DNA, 20 bp, Artificial Sequence
  chemically synthesized
ttttgcccattttttttgat

SEQ ID NO: 138954 - DNA, 20 bp, Artificial Sequence
  chemically synthesized
cttttgcccattttttttga

SEQ ID NO: 138955 - DNA, 20 bp, Artificial Sequence
  chemically synthesized
aataaccccatcaaaaaaaa

SEQ ID NO: 138956 - DNA, 20 bp, Artificial Sequence
  chemically synthesized
ataaccccatcaaaaaaaat

SEQ ID NO: 138957 - DNA, 20 bp, Artificial Sequence
  chemically synthesized
ccatcaaaaaaaatgggcaa

SEQ ID NO: 138958 - DNA, 20 bp, Artificial Sequence
  chemically synthesized
aaatgggcaaaagacataaa

SEQ ID NO: 138959 - DNA, 20 bp, Artificial Sequence
  chemically synthesized
cataaacagacactactcaa

SEQ ID NO: 138960 - DNA, 20 bp, Artificial Sequence
  chemically synthesized
cttgtatgtcttcttttgag

SEQ ID NO: 138961 - DNA, 20 bp, Artificial Sequence
  chemically synthesized
aaacagacactactcaaaag

SEQ ID NO: 138962 - DNA, 20 bp, Artificial Sequence
  chemically synthesized
ccacttgtatgtcttctttt

SEQ ID NO: 138963 - DNA, 20 bp, Artificial Sequence
  chemically synthesized
ctactcaaaagaagacatac

SEQ ID NO: 138964 - DNA, 20 bp, Artificial Sequence
  chemically synthesized
ctcaaaagaagacatacaag

SEQ ID NO: 138965 - DNA, 20 bp, Artificial Sequence
  chemically synthesized
gagcattttttcatgtttgt

SEQ ID NO: 138966 - DNA, 20 bp, Artificial Sequence
  chemically synthesized
ctctgatgttgagtgatgtg

SEQ ID NO: 138967 - DNA, 20 bp, Artificial Sequence
  chemically synthesized
ttctctgatgttgagtgatg

SEQ ID NO: 138968 - DNA, 20 bp, Artificial Sequence
  chemically synthesized
tgctccacatcactcaacat

SEQ ID NO: 138969 - DNA, 20 bp, Artificial Sequence
  chemically synthesized
ctccacatcactcaacatca

SEQ ID NO: 138970 - DNA, 20 bp, Artificial Sequence
  chemically synthesized
atttgcatttctctgatgtt

SEQ ID NO: 138971 - DNA, 20 bp, Artificial Sequence
  chemically synthesized
atgcaaatcaaaaccacaac

SEQ ID NO: 138972 - DNA, 20 bp, Artificial Sequence
  chemically synthesized
tgtgagacggtatctcgttg

SEQ ID NO: 138973 - DNA, 20 bp, Artificial Sequence
  chemically synthesized
ccagtatgaatggtgtgaga

SEQ ID NO: 138974 - DNA, 20 bp, Artificial Sequence
  chemically synthesized
atagccagtatgaatggtgt

SEQ ID NO: 138975 - DNA, 20 bp, Artificial Sequence
  chemically synthesized
ccgtctcacaccattcatac

SEQ ID NO: 138976 - DNA, 20 bp, Artificial Sequence
  chemically synthesized
ttaataatagccagtatgaa

SEQ ID NO: 138977 - DNA, 20 bp, Artificial Sequence
  chemically synthesized
tttgactttttaataatagc

SEQ ID NO: 138978 - DNA, 20 bp, Artificial Sequence
  chemically synthesized
tttttttgactttttaataa

SEQ ID NO: 138979 - DNA, 20 bp, Artificial Sequence
  chemically synthesized
tcatactggctattattaaa

SEQ ID NO: 138980 - DNA, 20 bp, Artificial Sequence
  chemically synthesized
ttaaaaagtcaaaaaaatga

SEQ ID NO: 138981 - DNA, 20 bp, Artificial Sequence
  chemically synthesized
cctcttctctacagcgtcag

SEQ ID NO: 138982 - DNA, 20 bp, Artificial Sequence
  chemically synthesized
gacagatgctgctgacgctg

SEQ ID NO: 138983 - DNA, 20 bp, Artificial Sequence
  chemically synthesized
ttccctcttctctacagcgt

SEQ ID NO: 138984 - DNA, 20 bp, Artificial Sequence
  chemically synthesized
cagatgctgctgacgctgta

SEQ ID NO: 138985 - DNA, 20 bp, Artificial Sequence
  chemically synthesized
atgctgctgacgctgtagag

SEQ ID NO: 138986 - DNA, 20 bp, Artificial Sequence
  chemically synthesized
gctgctgacgctgtagagaa

SEQ ID NO: 138987 - DNA, 20 bp, Artificial Sequence
  chemically synthesized
tcagagttccctcttctcta

SEQ ID NO: 138988 - DNA, 20 bp, Artificial Sequence
  chemically synthesized
ctgctgacgctgtagagaag

SEQ ID NO: 138989 - DNA, 20 bp, Artificial Sequence
  chemically synthesized
tgctgacgctgtagagaaga

SEQ ID NO: 138990 - DNA, 20 bp, Artificial Sequence
  chemically synthesized
ttcccagcaacagtgtatca

SEQ ID NO: 138991 - DNA, 20 bp, Artificial Sequence
  chemically synthesized
cattcccagcaacagtgtat

SEQ ID NO: 138992 - DNA, 20 bp, Artificial Sequence
  chemically synthesized
gaactctgatacactgttgc

SEQ ID NO: 138993 - DNA, 20 bp, Artificial Sequence
  chemically synthesized
aactctgatacactgttgct

SEQ ID NO: 138994 - DNA, 20 bp, Artificial Sequence
  chemically synthesized
ctaatttgcattcccagcaa

SEQ ID NO: 138995 - DNA, 20 bp, Artificial Sequence
  chemically synthesized
gctgaactaatttgcattcc

SEQ ID NO: 138996 - DNA, 20 bp, Artificial Sequence
  chemically synthesized
ctgttgctgggaatgcaaat

SEQ ID NO: 138997 - DNA, 20 bp, Artificial Sequence
  chemically synthesized
gctgggaatgcaaattagtt

SEQ ID NO: 138998 - DNA, 20 bp, Artificial Sequence
  chemically synthesized
aatgcaaattagttcagcca

SEQ ID NO: 138999 - DNA, 20 bp, Artificial Sequence
  chemically synthesized
atcttcaaactgtttcactg

SEQ ID NO: 139000 - DNA, 20 bp, Artificial Sequence
  chemically synthesized
ttagttcagccacagtgaaa

SEQ ID NO: 139001 - DNA, 20 bp, Artificial Sequence
  chemically synthesized
agccacagtgaaacagtttg

SEQ ID NO: 139002 - DNA, 20 bp, Artificial Sequence
  chemically synthesized
aacagtttgaagatttctca

SEQ ID NO: 139003 - DNA, 20 bp, Artificial Sequence
  chemically synthesized
acagtttgaagatttctcaa

SEQ ID NO: 139004 - DNA, 20 bp, Artificial Sequence
  chemically synthesized
agttgtgttttaagtccttt

SEQ ID NO: 139005 - DNA, 20 bp, Artificial Sequence
  chemically synthesized
ttgaacgatagttgtgtttt

SEQ ID NO: 139006 - DNA, 20 bp, Artificial Sequence
  chemically synthesized
gggatcactaggttgaacga

SEQ ID NO: 139007 - DNA, 20 bp, Artificial Sequence
  chemically synthesized
aacacaactatcgttcaacc

SEQ ID NO: 139008 - DNA, 20 bp, Artificial Sequence
  chemically synthesized
tgcccagtaatgggatcact

SEQ ID NO: 139009 - DNA, 20 bp, Artificial Sequence
  chemically synthesized
atgcccagtaatgggatcac

SEQ ID NO: 139010 - DNA, 20 bp, Artificial Sequence
  chemically synthesized
caacctagtgatcccattac

SEQ ID NO: 139011 - DNA, 20 bp, Artificial Sequence
  chemically synthesized
aacctagtgatcccattact

SEQ ID NO: 139012 - DNA, 20 bp, Artificial Sequence
  chemically synthesized
tgggctatatgcccagtaat

SEQ ID NO: 139013 - DNA, 20 bp, Artificial Sequence
  chemically synthesized
ttgggctatatgcccagtaa

SEQ ID NO: 139014 - DNA, 20 bp, Artificial Sequence
  chemically synthesized
tgatcccattactgggcata

SEQ ID NO: 139015 - DNA, 20 bp, Artificial Sequence
  chemically synthesized
ttttatttgggctatatgcc

SEQ ID NO: 139016 - DNA, 20 bp, Artificial Sequence
  chemically synthesized
taaagcaatttgttttattt

SEQ ID NO: 139017 - DNA, 20 bp, Artificial Sequence
  chemically synthesized
gtaaagcaatttgttttatt

SEQ ID NO: 139018 - DNA, 20 bp, Artificial Sequence
  chemically synthesized
atacatgtggttttttagta

SEQ ID NO: 139019 - DNA, 20 bp, Artificial Sequence
  chemically synthesized
tgagaatacatgtggttttt

SEQ ID NO: 139020 - DNA, 20 bp, Artificial Sequence
  chemically synthesized
aatgaggatgagaatacatg

SEQ ID NO: 139021 - DNA, 20 bp, Artificial Sequence
  chemically synthesized
aatagtgctgaaatgaggat

SEQ ID NO: 139022 - DNA, 20 bp, Artificial Sequence
  chemically synthesized
atgtattctcatcctcattt

SEQ ID NO: 139023 - DNA, 20 bp, Artificial Sequence
  chemically synthesized
ttgtgaatagtgctgaaatg

SEQ ID NO: 139024 - DNA, 20 bp, Artificial Sequence
  chemically synthesized
attgtgaatagtgctgaaat

SEQ ID NO: 139025 - DNA, 20 bp, Artificial Sequence
  chemically synthesized
catttcagcactattcacaa

SEQ ID NO: 139026 - DNA, 20 bp, Artificial Sequence
  chemically synthesized
catacctttgctattgtgaa

SEQ ID NO: 139027 - DNA, 20 bp, Artificial Sequence
  chemically synthesized
cagcactattcacaatagca

SEQ ID NO: 139028 - DNA, 20 bp, Artificial Sequence
  chemically synthesized
agcactattcacaatagcaa

SEQ ID NO: 139029 - DNA, 20 bp, Artificial Sequence
  chemically synthesized
ttcacaatagcaaaggtatg

SEQ ID NO: 139030 - DNA, 20 bp, Artificial Sequence
  chemically synthesized
caatagcaaaggtatgaagt

SEQ ID NO: 139031 - DNA, 20 bp, Artificial Sequence
  chemically synthesized
gcaaaggtatgaagtcagcc

SEQ ID NO: 139032 - DNA, 20 bp, Artificial Sequence
  chemically synthesized
caaaggtatgaagtcagcct

SEQ ID NO: 139033 - DNA, 20 bp, Artificial Sequence
  chemically synthesized
tctgccactgatgggcacct

SEQ ID NO: 139034 - DNA, 20 bp, Artificial Sequence
  chemically synthesized
gtctgccactgatgggcacc

SEQ ID NO: 139035 - DNA, 20 bp, Artificial Sequence
  chemically synthesized
aagtcagcctaggtgcccat

SEQ ID NO: 139036 - DNA, 20 bp, Artificial Sequence
  chemically synthesized
tcagcctaggtgcccatcag

SEQ ID NO: 139037 - DNA, 20 bp, Artificial Sequence
  chemically synthesized
ttctccagtctgccactgat

SEQ ID NO: 139038 - DNA, 20 bp, Artificial Sequence
  chemically synthesized
gcctaggtgcccatcagtgg

SEQ ID NO: 139039 - DNA, 20 bp, Artificial Sequence
  chemically synthesized
tttctccagtctgccactga

SEQ ID NO: 139040 - DNA, 20 bp, Artificial Sequence
  chemically synthesized
ggtgcccatcagtggcagac

SEQ ID NO: 139041 - DNA, 20 bp, Artificial Sequence
  chemically synthesized
tgcccatcagtggcagactg

SEQ ID NO: 139042 - DNA, 20 bp, Artificial Sequence
  chemically synthesized
catcagtggcagactggaga

SEQ ID NO: 139043 - DNA, 20 bp, Artificial Sequence
  chemically synthesized
tgcaccgtattttctttctc

SEQ ID NO: 139044 - DNA, 20 bp, Artificial Sequence
  chemically synthesized
cagactggagaaagaaaata

SEQ ID NO: 139045 - DNA, 20 bp, Artificial Sequence
  chemically synthesized
aatacggtgcatatacacca

SEQ ID NO: 139046 - DNA, 20 bp, Artificial Sequence
  chemically synthesized
tatggctgcatagtattcca

SEQ ID NO: 139047 - DNA, 20 bp, Artificial Sequence
  chemically synthesized
atacaccatggaatactatg

SEQ ID NO: 139048 - DNA, 20 bp, Artificial Sequence
  chemically synthesized
tgttcttttttatggctgca

SEQ ID NO: 139049 - DNA, 20 bp, Artificial Sequence
  chemically synthesized
aatactatgcagccataaaa

SEQ ID NO: 139050 - DNA, 20 bp, Artificial Sequence
  chemically synthesized
catgattttgttctttttta

SEQ ID NO: 139051 - DNA, 20 bp, Artificial Sequence
  chemically synthesized
gaacaaaatcatgtcctttg

SEQ ID NO: 139052 - DNA, 20 bp, Artificial Sequence
  chemically synthesized
ctgcatccatgttgctgcaa

SEQ ID NO: 139053 - DNA, 20 bp, Artificial Sequence
  chemically synthesized
gctgcatccatgttgctgca

SEQ ID NO: 139054 - DNA, 20 bp, Artificial Sequence
  chemically synthesized
tcatgtcctttgcagcaaca

SEQ ID NO: 139055 - DNA, 20 bp, Artificial Sequence
  chemically synthesized
cctttgcagcaacatggatg

SEQ ID NO: 139056 - DNA, 20 bp, Artificial Sequence
  chemically synthesized
tgcagcaacatggatgcagc

SEQ ID NO: 139057 - DNA, 20 bp, Artificial Sequence
  chemically synthesized
cagcaacatggatgcagctg

SEQ ID NO: 139058 - DNA, 20 bp, Artificial Sequence
  chemically synthesized
agcaacatggatgcagctgg

SEQ ID NO: 139059 - DNA, 20 bp, Artificial Sequence
  chemically synthesized
tcacttagaataatggcctc

SEQ ID NO: 139060 - DNA, 20 bp, Artificial Sequence
  chemically synthesized
cagctggaggccattattct

SEQ ID NO: 139061 - DNA, 20 bp, Artificial Sequence
  chemically synthesized
cattaattcacttagaataa

SEQ ID NO: 139062 - DNA, 20 bp, Artificial Sequence
  chemically synthesized
tgtttctgcattaattcact

SEQ ID NO: 139063 - DNA, 20 bp, Artificial Sequence
  chemically synthesized
ttattctaagtgaattaatg

SEQ ID NO: 139064 - DNA, 20 bp, Artificial Sequence
  chemically synthesized
acatgagaacacgtggtatt

SEQ ID NO: 139065 - DNA, 20 bp, Artificial Sequence
  chemically synthesized
tagctccacatgagaacacg

SEQ ID NO: 139066 - DNA, 20 bp, Artificial Sequence
  chemically synthesized
aaataccacgtgttctcatg

SEQ ID NO: 139067 - DNA, 20 bp, Artificial Sequence
  chemically synthesized
ataccacgtgttctcatgtg

SEQ ID NO: 139068 - DNA, 20 bp, Artificial Sequence
  chemically synthesized
cgcactgtttagctccacat

SEQ ID NO: 139069 - DNA, 20 bp, Artificial Sequence
  chemically synthesized
tgttctcatgtggagctaaa

SEQ ID NO: 139070 - DNA, 20 bp, Artificial Sequence
  chemically synthesized
gtccatgacaacgcactgtt

SEQ ID NO: 139071 - DNA, 20 bp, Artificial Sequence
  chemically synthesized
agctaaacagtgcgttgtca

SEQ ID NO: 139072 - DNA, 20 bp, Artificial Sequence
  chemically synthesized
cgttgtcatggacataatga

SEQ ID NO: 139073 - DNA, 20 bp, Artificial Sequence
  chemically synthesized
ggacataatgatggcaacaa

SEQ ID NO: 139074 - DNA, 20 bp, Artificial Sequence
  chemically synthesized
aatgatggcaacaatagaaa

SEQ ID NO: 139075 - DNA, 20 bp, Artificial Sequence
  chemically synthesized
tgatggcaacaatagaaacg

SEQ ID NO: 139076 - DNA, 20 bp, Artificial Sequence
  chemically synthesized
gatggcaacaatagaaacgg

SEQ ID NO: 139077 - DNA, 20 bp, Artificial Sequence
  chemically synthesized
caatagaaacggaggactac

SEQ ID NO: 139078 - DNA, 20 bp, Artificial Sequence
  chemically synthesized
atagaaacggaggactacta

SEQ ID NO: 139079 - DNA, 20 bp, Artificial Sequence
  chemically synthesized
gaaacggaggactactagag

SEQ ID NO: 139080 - DNA, 20 bp, Artificial Sequence
  chemically synthesized
aaacggaggactactagagt

SEQ ID NO: 139081 - DNA, 20 bp, Artificial Sequence
  chemically synthesized
tccctccctccccactctag

SEQ ID NO: 139082 - DNA, 20 bp, Artificial Sequence
  chemically synthesized
aacggaggactactagagtg

SEQ ID NO: 139083 - DNA, 20 bp, Artificial Sequence
  chemically synthesized
cggaggactactagagtggg

SEQ ID NO: 139084 - DNA, 20 bp, Artificial Sequence
  chemically synthesized
gtttccctccctccccactc

SEQ ID NO: 139085 - DNA, 20 bp, Artificial Sequence
  chemically synthesized
ggaggactactagagtgggg

SEQ ID NO: 139086 - DNA, 20 bp, Artificial Sequence
  chemically synthesized
gaggactactagagtgggga

SEQ ID NO: 139087 - DNA, 20 bp, Artificial Sequence
  chemically synthesized
ggactactagagtggggagg

SEQ ID NO: 139088 - DNA, 20 bp, Artificial Sequence
  chemically synthesized
gactactagagtggggaggg

SEQ ID NO: 139089 - DNA, 20 bp, Artificial Sequence
  chemically synthesized
actactagagtggggaggga

SEQ ID NO: 139090 - DNA, 20 bp, Artificial Sequence
  chemically synthesized
gagtggggagggagggaaac

SEQ ID NO: 139091 - DNA, 20 bp, Artificial Sequence
  chemically synthesized
agtggggagggagggaaaca

SEQ ID NO: 139092 - DNA, 20 bp, Artificial Sequence
  chemically synthesized
gtggggagggagggaaacaa

SEQ ID NO: 139093 - DNA, 20 bp, Artificial Sequence
  chemically synthesized
agggttgaaaaactaactat

SEQ ID NO: 139094 - DNA, 20 bp, Artificial Sequence
  chemically synthesized
tgagcatagtaaccgatagt

SEQ ID NO: 139095 - DNA, 20 bp, Artificial Sequence
  chemically synthesized
gtactgagcatagtaaccga

SEQ ID NO: 139096 - DNA, 20 bp, Artificial Sequence
  chemically synthesized
taactatcggttactatgct

SEQ ID NO: 139097 - DNA, 20 bp, Artificial Sequence
  chemically synthesized
tgtcacccaggtactgagca

SEQ ID NO: 139098 - DNA, 20 bp, Artificial Sequence
  chemically synthesized
cggttactatgctcagtacc

SEQ ID NO: 139099 - DNA, 20 bp, Artificial Sequence
  chemically synthesized
ggttactatgctcagtacct

SEQ ID NO: 139100 - DNA, 20 bp, Artificial Sequence
  chemically synthesized
gatactgtcacccaggtact

SEQ ID NO: 139101 - DNA, 20 bp, Artificial Sequence
  chemically synthesized
tatgctcagtacctgggtga

SEQ ID NO: 139102 - DNA, 20 bp, Artificial Sequence
  chemically synthesized
tacaaatgatactgtcaccc

SEQ ID NO: 139103 - DNA, 20 bp, Artificial Sequence
  chemically synthesized
gtacaaatgatactgtcacc

SEQ ID NO: 139104 - DNA, 20 bp, Artificial Sequence
  chemically synthesized
atcatttgtactccaaacct

SEQ ID NO: 139105 - DNA, 20 bp, Artificial Sequence
  chemically synthesized
ttacatgatgccgaggtttg

SEQ ID NO: 139106 - DNA, 20 bp, Artificial Sequence
  chemically synthesized
tattacatgatgccgaggtt

SEQ ID NO: 139107 - DNA, 20 bp, Artificial Sequence
  chemically synthesized
tgatatattacatgatgccg

SEQ ID NO: 139108 - DNA, 20 bp, Artificial Sequence
  chemically synthesized
ttgatatattacatgatgcc

SEQ ID NO: 139109 - DNA, 20 bp, Artificial Sequence
  chemically synthesized
tcggcatcatgtaatatatc

SEQ ID NO: 139110 - DNA, 20 bp, Artificial Sequence
  chemically synthesized
cggcatcatgtaatatatca

SEQ ID NO: 139111 - DNA, 20 bp, Artificial Sequence
  chemically synthesized
gattcagggagtacatgtgt

SEQ ID NO: 139112 - DNA, 20 bp, Artificial Sequence
  chemically synthesized
agattcagggagtacatgtg

SEQ ID NO: 139113 - DNA, 20 bp, Artificial Sequence
  chemically synthesized
actttgattttagattcagg

SEQ ID NO: 139114 - DNA, 20 bp, Artificial Sequence
  chemically synthesized
caactttgattttagattca

SEQ ID NO: 139115 - DNA, 20 bp, Artificial Sequence
  chemically synthesized
tcaactttgattttagattc

SEQ ID NO: 139116 - DNA, 20 bp, Artificial Sequence
  chemically synthesized
ttcaactttgattttagatt

SEQ ID NO: 139117 - DNA, 20 bp, Artificial Sequence
  chemically synthesized
actccctgaatctaaaatca

SEQ ID NO: 139118 - DNA, 20 bp, Artificial Sequence
  chemically synthesized
cattttttcaactttgattt

SEQ ID NO: 139119 - DNA, 20 bp, Artificial Sequence
  chemically synthesized
cctgtgtggaaaaaaaaaaa

SEQ ID NO: 139120 - DNA, 20 bp, Artificial Sequence
  chemically synthesized
tctttttttttttttccaca

SEQ ID NO: 139121 - DNA, 20 bp, Artificial Sequence
  chemically synthesized
ctttttttttttttccacac

SEQ ID NO: 139122 - DNA, 20 bp, Artificial Sequence
  chemically synthesized
tttttttttttttccacaca

SEQ ID NO: 139123 - DNA, 20 bp, Artificial Sequence
  chemically synthesized
tgacagagcaagaccctgtg

SEQ ID NO: 139124 - DNA, 20 bp, Artificial Sequence
  chemically synthesized
tccagccagaatgacagagc

SEQ ID NO: 139125 - DNA, 20 bp, Artificial Sequence
  chemically synthesized
gccctccagccagaatgaca

SEQ ID NO: 139126 - DNA, 20 bp, Artificial Sequence
  chemically synthesized
agggtcttgctctgtcattc

SEQ ID NO: 139127 - DNA, 20 bp, Artificial Sequence
  chemically synthesized
gtgccctccagccagaatga

SEQ ID NO: 139128 - DNA, 20 bp, Artificial Sequence
  chemically synthesized
tcttgctctgtcattctggc

SEQ ID NO: 139129 - DNA, 20 bp, Artificial Sequence
  chemically synthesized
ttgctctgtcattctggctg

SEQ ID NO: 139130 - DNA, 20 bp, Artificial Sequence
  chemically synthesized
tgctctgtcattctggctgg

SEQ ID NO: 139131 - DNA, 20 bp, Artificial Sequence
  chemically synthesized
gctctgtcattctggctgga

SEQ ID NO: 139132 - DNA, 20 bp, Artificial Sequence
  chemically synthesized
tcactccagtgccctccagc

SEQ ID NO: 139133 - DNA, 20 bp, Artificial Sequence
  chemically synthesized
atgttcactccagtgccctc

SEQ ID NO: 139134 - DNA, 20 bp, Artificial Sequence
  chemically synthesized
tcattctggctggagggcac

SEQ ID NO: 139135 - DNA, 20 bp, Artificial Sequence
  chemically synthesized
attctggctggagggcactg

SEQ ID NO: 139136 - DNA, 20 bp, Artificial Sequence
  chemically synthesized
gcagtaagccatgttcactc

SEQ ID NO: 139137 - DNA, 20 bp, Artificial Sequence
  chemically synthesized
ggagggcactggagtgaaca

SEQ ID NO: 139138 - DNA, 20 bp, Artificial Sequence
  chemically synthesized
caggaggtcaaggcggcagt

SEQ ID NO: 139139 - DNA, 20 bp, Artificial Sequence
  chemically synthesized
agcccaggaggtcaaggcgg

SEQ ID NO: 139140 - DNA, 20 bp, Artificial Sequence
  chemically synthesized
ttgagcccaggaggtcaagg

SEQ ID NO: 139141 - DNA, 20 bp, Artificial Sequence
  chemically synthesized
cacttgagcccaggaggtca

SEQ ID NO: 139142 - DNA, 20 bp, Artificial Sequence
  chemically synthesized
ttactgccgccttgacctcc

SEQ ID NO: 139143 - DNA, 20 bp, Artificial Sequence
  chemically synthesized
tcacttgagcccaggaggtc

SEQ ID NO: 139144 - DNA, 20 bp, Artificial Sequence
  chemically synthesized
tactgccgccttgacctcct

SEQ ID NO: 139145 - DNA, 20 bp, Artificial Sequence
  chemically synthesized
gaggatcacttgagcccagg

SEQ ID NO: 139146 - DNA, 20 bp, Artificial Sequence
  chemically synthesized
ggaggatcacttgagcccag

SEQ ID NO: 139147 - DNA, 20 bp, Artificial Sequence
  chemically synthesized
cgccttgacctcctgggctc

SEQ ID NO: 139148 - DNA, 20 bp, Artificial Sequence
  chemically synthesized
caggaggatcacttgagccc

SEQ ID NO: 139149 - DNA, 20 bp, Artificial Sequence
  chemically synthesized
acaggaggatcacttgagcc

SEQ ID NO: 139150 - DNA, 20 bp, Artificial Sequence
  chemically synthesized
ctgacacaggaggatcactt

SEQ ID NO: 139151 - DNA, 20 bp, Artificial Sequence
  chemically synthesized
ctcaagtgatcctcctgtgt

SEQ ID NO: 139152 - DNA, 20 bp, Artificial Sequence
  chemically synthesized
gcatgggaggctgacacagg

SEQ ID NO: 139153 - DNA, 20 bp, Artificial Sequence
  chemically synthesized
tgcatgggaggctgacacag

SEQ ID NO: 139154 - DNA, 20 bp, Artificial Sequence
  chemically synthesized
gctgcatgggaggctgacac

SEQ ID NO: 139155 - DNA, 20 bp, Artificial Sequence
  chemically synthesized
agctgcatgggaggctgaca

SEQ ID NO: 139156 - DNA, 20 bp, Artificial Sequence
  chemically synthesized
tcctgtgtcagcctcccatg

SEQ ID NO: 139157 - DNA, 20 bp, Artificial Sequence
  chemically synthesized
agccctgccagctgcatggg

SEQ ID NO: 139158 - DNA, 20 bp, Artificial Sequence
  chemically synthesized
gagccctgccagctgcatgg

SEQ ID NO: 139159 - DNA, 20 bp, Artificial Sequence
  chemically synthesized
gtgtcagcctcccatgcagc

SEQ ID NO: 139160 - DNA, 20 bp, Artificial Sequence
  chemically synthesized
aggagccctgccagctgcat

SEQ ID NO: 139161 - DNA, 20 bp, Artificial Sequence
  chemically synthesized
aaggagccctgccagctgca

SEQ ID NO: 139162 - DNA, 20 bp, Artificial Sequence
  chemically synthesized
tcagcctcccatgcagctgg

SEQ ID NO: 139163 - DNA, 20 bp, Artificial Sequence
  chemically synthesized
cagcctcccatgcagctggc

SEQ ID NO: 139164 - DNA, 20 bp, Artificial Sequence
  chemically synthesized
agcctcccatgcagctggca

SEQ ID NO: 139165 - DNA, 20 bp, Artificial Sequence
  chemically synthesized
atggctgtaaggagccctgc

SEQ ID NO: 139166 - DNA, 20 bp, Artificial Sequence
  chemically synthesized
gcagctggcagggctcctta

SEQ ID NO: 139167 - DNA, 20 bp, Artificial Sequence
  chemically synthesized
tggtggcacatggctgtaag

SEQ ID NO: 139168 - DNA, 20 bp, Artificial Sequence
  chemically synthesized
catggtggcacatggctgta

SEQ ID NO: 139169 - DNA, 20 bp, Artificial Sequence
  chemically synthesized
gcatggtggcacatggctgt

SEQ ID NO: 139170 - DNA, 20 bp, Artificial Sequence
  chemically synthesized
taactgggcatggtggcaca

SEQ ID NO: 139171 - DNA, 20 bp, Artificial Sequence
  chemically synthesized
cagccatgtgccaccatgcc

SEQ ID NO: 139172 - DNA, 20 bp, Artificial Sequence
  chemically synthesized
gaaaaattaactgggcatgg

SEQ ID NO: 139173 - DNA, 20 bp, Artificial Sequence
  chemically synthesized
gtagaaaaattaactgggca

SEQ ID NO: 139174 - DNA, 20 bp, Artificial Sequence
  chemically synthesized
tatatgtagaaaaattaact

SEQ ID NO: 139175 - DNA, 20 bp, Artificial Sequence
  chemically synthesized
atatatgtagaaaaattaac

SEQ ID NO: 139176 - DNA, 20 bp, Artificial Sequence
  chemically synthesized
ctgtctttaaaatatatatg

SEQ ID NO: 139177 - DNA, 20 bp, Artificial Sequence
  chemically synthesized
ttttctacatatatatttta

SEQ ID NO: 139178 - DNA, 20 bp, Artificial Sequence
  chemically synthesized
ctacatatatattttaaaga

SEQ ID NO: 139179 - DNA, 20 bp, Artificial Sequence
  chemically synthesized
tacatatatattttaaagac

SEQ ID NO: 139180 - DNA, 20 bp, Artificial Sequence
  chemically synthesized
acatatatattttaaagaca

SEQ ID NO: 139181 - DNA, 20 bp, Artificial Sequence
  chemically synthesized
accagtctgggaaacaaagt

SEQ ID NO: 139182 - DNA, 20 bp, Artificial Sequence
  chemically synthesized
cagggtctcactttgtttcc

SEQ ID NO: 139183 - DNA, 20 bp, Artificial Sequence
  chemically synthesized
tgagaccagtctgggaaaca

SEQ ID NO: 139184 - DNA, 20 bp, Artificial Sequence
  chemically synthesized
tctcactttgtttcccagac

SEQ ID NO: 139185 - DNA, 20 bp, Artificial Sequence
  chemically synthesized
cagaagtttgagaccagtct

SEQ ID NO: 139186 - DNA, 20 bp, Artificial Sequence
  chemically synthesized
ccagaagtttgagaccagtc

SEQ ID NO: 139187 - DNA, 20 bp, Artificial Sequence
  chemically synthesized
ttagcccagaagtttgagac

SEQ ID NO: 139188 - DNA, 20 bp, Artificial Sequence
  chemically synthesized
ccagactggtctcaaacttc

SEQ ID NO: 139189 - DNA, 20 bp, Artificial Sequence
  chemically synthesized
tcgtgttagcccagaagttt

SEQ ID NO: 139190 - DNA, 20 bp, Artificial Sequence
  chemically synthesized
cagactggtctcaaacttct

SEQ ID NO: 139191 - DNA, 20 bp, Artificial Sequence
  chemically synthesized
ggaggatcgtgttagcccag

SEQ ID NO: 139192 - DNA, 20 bp, Artificial Sequence
  chemically synthesized
gcaggaggatcgtgttagcc

SEQ ID NO: 139193 - DNA, 20 bp, Artificial Sequence
  chemically synthesized
ccaaggcaggaggatcgtgt

SEQ ID NO: 139194 - DNA, 20 bp, Artificial Sequence
  chemically synthesized
ctaacacgatcctcctgcct

SEQ ID NO: 139195 - DNA, 20 bp, Artificial Sequence
  chemically synthesized
ctttgggaggccaaggcagg

SEQ ID NO: 139196 - DNA, 20 bp, Artificial Sequence
  chemically synthesized
actttgggaggccaaggcag

SEQ ID NO: 139197 - DNA, 20 bp, Artificial Sequence
  chemically synthesized
acactttgggaggccaaggc

SEQ ID NO: 139198 - DNA, 20 bp, Artificial Sequence
  chemically synthesized
aacactttgggaggccaagg

SEQ ID NO: 139199 - DNA, 20 bp, Artificial Sequence
  chemically synthesized
cctaacactttgggaggcca

SEQ ID NO: 139200 - DNA, 20 bp, Artificial Sequence
  chemically synthesized
tcctaacactttgggaggcc

SEQ ID NO: 139201 - DNA, 20 bp, Artificial Sequence
  chemically synthesized
cctcctgccttggcctccca

SEQ ID NO: 139202 - DNA, 20 bp, Artificial Sequence
  chemically synthesized
tgtaatcctaacactttggg

SEQ ID NO: 139203 - DNA, 20 bp, Artificial Sequence
  chemically synthesized
ctgtaatcctaacactttgg

SEQ ID NO: 139204 - DNA, 20 bp, Artificial Sequence
  chemically synthesized
gccttggcctcccaaagtgt

SEQ ID NO: 139205 - DNA, 20 bp, Artificial Sequence
  chemically synthesized
acctgtaatcctaacacttt

SEQ ID NO: 139206 - DNA, 20 bp, Artificial Sequence
  chemically synthesized
ccttggcctcccaaagtgtt

SEQ ID NO: 139207 - DNA, 20 bp, Artificial Sequence
  chemically synthesized
cacctgtaatcctaacactt

SEQ ID NO: 139208 - DNA, 20 bp, Artificial Sequence
  chemically synthesized
ctcccaaagtgttaggatta

SEQ ID NO: 139209 - DNA, 20 bp, Artificial Sequence
  chemically synthesized
tcccaaagtgttaggattac

SEQ ID NO: 139210 - DNA, 20 bp, Artificial Sequence
  chemically synthesized
agtgttaggattacaggtgt

SEQ ID NO: 139211 - DNA, 20 bp, Artificial Sequence
  chemically synthesized
gcaaactttgtggggtgcag

SEQ ID NO: 139212 - DNA, 20 bp, Artificial Sequence
  chemically synthesized
atggcaaactttgtggggtg

SEQ ID NO: 139213 - DNA, 20 bp, Artificial Sequence
  chemically synthesized
gtgagccactgcaccccaca

SEQ ID NO: 139214 - DNA, 20 bp, Artificial Sequence
  chemically synthesized
atgagatggcaaactttgtg

SEQ ID NO: 139215 - DNA, 20 bp, Artificial Sequence
  chemically synthesized
tatgagatggcaaactttgt

SEQ ID NO: 139216 - DNA, 20 bp, Artificial Sequence
  chemically synthesized
atatgagatggcaaactttg

SEQ ID NO: 139217 - DNA, 20 bp, Artificial Sequence
  chemically synthesized
tgaactgcactcatatgaga

SEQ ID NO: 139218 - DNA, 20 bp, Artificial Sequence
  chemically synthesized
caaagtttgccatctcatat

SEQ ID NO: 139219 - DNA, 20 bp, Artificial Sequence
  chemically synthesized
gtcatgaactgcactcatat

SEQ ID NO: 139220 - DNA, 20 bp, Artificial Sequence
  chemically synthesized
tttgccatctcatatgagtg

SEQ ID NO: 139221 - DNA, 20 bp, Artificial Sequence
  chemically synthesized
gttactattgtaattgtttt

SEQ ID NO: 139222 - DNA, 20 bp, Artificial Sequence
  chemically synthesized
acatctcaaaacaattacaa

SEQ ID NO: 139223 - DNA, 20 bp, Artificial Sequence
  chemically synthesized
caattacaatagtaacatca

SEQ ID NO: 139224 - DNA, 20 bp, Artificial Sequence
  chemically synthesized
aattacaatagtaacatcaa

SEQ ID NO: 139225 - DNA, 20 bp, Artificial Sequence
  chemically synthesized
acatcaaaggtcactgatca

SEQ ID NO: 139226 - DNA, 20 bp, Artificial Sequence
  chemically synthesized
tatttgttatgatctgtgat

SEQ ID NO: 139227 - DNA, 20 bp, Artificial Sequence
  chemically synthesized
ataataatgtttgaaatatt

SEQ ID NO: 139228 - DNA, 20 bp, Artificial Sequence
  chemically synthesized
tacgtctctgtgtcacgttt

SEQ ID NO: 139229 - DNA, 20 bp, Artificial Sequence
  chemically synthesized
caaattaccaaaacgtgaca

SEQ ID NO: 139230 - DNA, 20 bp, Artificial Sequence
  chemically synthesized
aattaccaaaacgtgacaca

SEQ ID NO: 139231 - DNA, 20 bp, Artificial Sequence
  chemically synthesized
aaacgtgacacagagacgta

SEQ ID NO: 139232 - DNA, 20 bp, Artificial Sequence
  chemically synthesized
gtgacacagagacgtaaagc

SEQ ID NO: 139233 - DNA, 20 bp, Artificial Sequence
  chemically synthesized
gtaaagcgagcacatgctgt

SEQ ID NO: 139234 - DNA, 20 bp, Artificial Sequence
  chemically synthesized
gtcgggcacaatttttccaa

SEQ ID NO: 139235 - DNA, 20 bp, Artificial Sequence
  chemically synthesized
gttggaaaaattgtgcccga

SEQ ID NO: 139236 - DNA, 20 bp, Artificial Sequence
  chemically synthesized
ctgcattgagcaagtccgtc

SEQ ID NO: 139237 - DNA, 20 bp, Artificial Sequence
  chemically synthesized
gctgcattgagcaagtccgt

SEQ ID NO: 139238 - DNA, 20 bp, Artificial Sequence
  chemically synthesized
gtggcaaggctgcattgagc

SEQ ID NO: 139239 - DNA, 20 bp, Artificial Sequence
  chemically synthesized
cccgacggacttgctcaatg

SEQ ID NO: 139240 - DNA, 20 bp, Artificial Sequence
  chemically synthesized
gtttgtggcaaggctgcatt

SEQ ID NO: 139241 - DNA, 20 bp, Artificial Sequence
  chemically synthesized
taaattgaaagtttgtggca

SEQ ID NO: 139242 - DNA, 20 bp, Artificial Sequence
  chemically synthesized
gtaaattgaaagtttgtggc

SEQ ID NO: 139243 - DNA, 20 bp, Artificial Sequence
  chemically synthesized
ttttgtaaattgaaagtttg

SEQ ID NO: 139244 - DNA, 20 bp, Artificial Sequence
  chemically synthesized
tttcactttttgtaaattga

SEQ ID NO: 139245 - DNA, 20 bp, Artificial Sequence
  chemically synthesized
acaaactttcaatttacaaa

SEQ ID NO: 139246 - DNA, 20 bp, Artificial Sequence
  chemically synthesized
caaaaagtgaaatatctgca

SEQ ID NO: 139247 - DNA, 20 bp, Artificial Sequence
  chemically synthesized
tttcactttattgcactttg

SEQ ID NO: 139248 - DNA, 20 bp, Artificial Sequence
  chemically synthesized
aatatctgcaaagtgcaata

SEQ ID NO: 139249 - DNA, 20 bp, Artificial Sequence
  chemically synthesized
catgcgtatctcgttttatt

SEQ ID NO: 139250 - DNA, 20 bp, Artificial Sequence
  chemically synthesized
aaagtgaaacccaataaaac

SEQ ID NO: 139251 - DNA, 20 bp, Artificial Sequence
  chemically synthesized
acatgcgtatctcgttttat

SEQ ID NO: 139252 - DNA, 20 bp, Artificial Sequence
  chemically synthesized
gagatacgcatgtacatatt

SEQ ID NO: 139253 - DNA, 20 bp, Artificial Sequence
  chemically synthesized
agatacgcatgtacatattt

SEQ ID NO: 139254 - DNA, 20 bp, Artificial Sequence
  chemically synthesized
gatacgcatgtacatatttg

SEQ ID NO: 139255 - DNA, 20 bp, Artificial Sequence
  chemically synthesized
ttaatactgaaaaaattgag

SEQ ID NO: 139256 - DNA, 20 bp, Artificial Sequence
  chemically synthesized
aattaatactgaaaaaattg

SEQ ID NO: 139257 - DNA, 20 bp, Artificial Sequence
  chemically synthesized
aaattaatactgaaaaaatt

SEQ ID NO: 139258 - DNA, 20 bp, Artificial Sequence
  chemically synthesized
ttattactcctcaatttttt

SEQ ID NO: 139259 - DNA, 20 bp, Artificial Sequence
  chemically synthesized
gatgttattcaaggtagaac

SEQ ID NO: 139260 - DNA, 20 bp, Artificial Sequence
  chemically synthesized
caaaatgatgttattcaagg

SEQ ID NO: 139261 - DNA, 20 bp, Artificial Sequence
  chemically synthesized
ttccaaaatgatgttattca

SEQ ID NO: 139262 - DNA, 20 bp, Artificial Sequence
  chemically synthesized
attccaaaatgatgttattc

SEQ ID NO: 139263 - DNA, 20 bp, Artificial Sequence
  chemically synthesized
taccttgaataacatcattt

SEQ ID NO: 139264 - DNA, 20 bp, Artificial Sequence
  chemically synthesized
cttgataagtggaagttcga

SEQ ID NO: 139265 - DNA, 20 bp, Artificial Sequence
  chemically synthesized
tcttgataagtggaagttcg

SEQ ID NO: 139266 - DNA, 20 bp, Artificial Sequence
  chemically synthesized
gaattcgtcttgataagtgg

SEQ ID NO: 139267 - DNA, 20 bp, Artificial Sequence
  chemically synthesized
ccttcgaacttccacttatc

SEQ ID NO: 139268 - DNA, 20 bp, Artificial Sequence
  chemically synthesized
agagaattcgtcttgataag

SEQ ID NO: 139269 - DNA, 20 bp, Artificial Sequence
  chemically synthesized
acaagagaattcgtcttgat

SEQ ID NO: 139270 - DNA, 20 bp, Artificial Sequence
  chemically synthesized
attcctctgaatagggacaa

SEQ ID NO: 139271 - DNA, 20 bp, Artificial Sequence
  chemically synthesized
agattcctctgaatagggac

SEQ ID NO: 139272 - DNA, 20 bp, Artificial Sequence
  chemically synthesized
cgaattctcttgtccctatt

SEQ ID NO: 139273 - DNA, 20 bp, Artificial Sequence
  chemically synthesized
aattctcttgtccctattca

SEQ ID NO: 139274 - DNA, 20 bp, Artificial Sequence
  chemically synthesized
attctcttgtccctattcag

SEQ ID NO: 139275 - DNA, 20 bp, Artificial Sequence
  chemically synthesized
tgtatagattcctctgaata

SEQ ID NO: 139276 - DNA, 20 bp, Artificial Sequence
  chemically synthesized
ctgtatagattcctctgaat

SEQ ID NO: 139277 - DNA, 20 bp, Artificial Sequence
  chemically synthesized
gctgtatagattcctctgaa

SEQ ID NO: 139278 - DNA, 20 bp, Artificial Sequence
  chemically synthesized
cctattcagaggaatctata

SEQ ID NO: 139279 - DNA, 20 bp, Artificial Sequence
  chemically synthesized
ttatgattcaatttgctgta

SEQ ID NO: 139280 - DNA, 20 bp, Artificial Sequence
  chemically synthesized
tatacagcaaattgaatcat

SEQ ID NO: 139281 - DNA, 20 bp, Artificial Sequence
  chemically synthesized
tatcttctgctttggtattt

SEQ ID NO: 139282 - DNA, 20 bp, Artificial Sequence
  chemically synthesized
ataagtgtactaaaatacca

SEQ ID NO: 139283 - DNA, 20 bp, Artificial Sequence
  chemically synthesized
agtgtactaaaataccaaag

SEQ ID NO: 139284 - DNA, 20 bp, Artificial Sequence
  chemically synthesized
gtactaaaataccaaagcag

SEQ ID NO: 139285 - DNA, 20 bp, Artificial Sequence
  chemically synthesized
ttgtaatttatcttctgctt

SEQ ID NO: 139286 - DNA, 20 bp, Artificial Sequence
  chemically synthesized
caaagcagaagataaattac

SEQ ID NO: 139287 - DNA, 20 bp, Artificial Sequence
  chemically synthesized
gataaattacaagacatgaa

SEQ ID NO: 139288 - DNA, 20 bp, Artificial Sequence
  chemically synthesized
atagtgaaatgtaactattt

SEQ ID NO: 139289 - DNA, 20 bp, Artificial Sequence
  chemically synthesized
tagtgaaatgtaactatttg

SEQ ID NO: 139290 - DNA, 20 bp, Artificial Sequence
  chemically synthesized
agtgaaatgtaactatttga

SEQ ID NO: 139291 - DNA, 20 bp, Artificial Sequence
  chemically synthesized
ttacaaataatgccctcaaa

SEQ ID NO: 139292 - DNA, 20 bp, Artificial Sequence
  chemically synthesized
tttgagggcattatttgtaa

SEQ ID NO: 139293 - DNA, 20 bp, Artificial Sequence
  chemically synthesized
attatttgtaatagtttgcc

SEQ ID NO: 139294 - DNA, 20 bp, Artificial Sequence
  chemically synthesized
aattaggaggagtatgtacc

SEQ ID NO: 139295 - DNA, 20 bp, Artificial Sequence
  chemically synthesized
aaattaggaggagtatgtac

SEQ ID NO: 139296 - DNA, 20 bp, Artificial Sequence
  chemically synthesized
ttaggatgcaaaattaggag

SEQ ID NO: 139297 - DNA, 20 bp, Artificial Sequence
  chemically synthesized
ctttaggatgcaaaattagg

SEQ ID NO: 139298 - DNA, 20 bp, Artificial Sequence
  chemically synthesized
tctttaggatgcaaaattag

SEQ ID NO: 139299 - DNA, 20 bp, Artificial Sequence
  chemically synthesized
tatctttaggatgcaaaatt

SEQ ID NO: 139300 - DNA, 20 bp, Artificial Sequence
  chemically synthesized
gtatctttaggatgcaaaat

SEQ ID NO: 139301 - DNA, 20 bp, Artificial Sequence
  chemically synthesized
cctcctaattttgcatccta

SEQ ID NO: 139302 - DNA, 20 bp, Artificial Sequence
  chemically synthesized
agtctttggatagtatcttt

SEQ ID NO: 139303 - DNA, 20 bp, Artificial Sequence
  chemically synthesized
cagtctttggatagtatctt

SEQ ID NO: 139304 - DNA, 20 bp, Artificial Sequence
  chemically synthesized
catcctaaagatactatcca

SEQ ID NO: 139305 - DNA, 20 bp, Artificial Sequence
  chemically synthesized
gaatttctacagtctttgga

SEQ ID NO: 139306 - DNA, 20 bp, Artificial Sequence
  chemically synthesized
aagatactatccaaagactg

SEQ ID NO: 139307 - DNA, 20 bp, Artificial Sequence
  chemically synthesized
tctggaatttctacagtctt

SEQ ID NO: 139308 - DNA, 20 bp, Artificial Sequence
  chemically synthesized
tcttgtatctggaatttcta

SEQ ID NO: 139309 - DNA, 20 bp, Artificial Sequence
  chemically synthesized
tccaaagactgtagaaattc

SEQ ID NO: 139310 - DNA, 20 bp, Artificial Sequence
  chemically synthesized
actgtagaaattccagatac

SEQ ID NO: 139311 - DNA, 20 bp, Artificial Sequence
  chemically synthesized
tgtagaaattccagatacaa

SEQ ID NO: 139312 - DNA, 20 bp, Artificial Sequence
  chemically synthesized
caactctagcctcttgtatc

SEQ ID NO: 139313 - DNA, 20 bp, Artificial Sequence
  chemically synthesized
gtagaaattccagatacaag

SEQ ID NO: 139314 - DNA, 20 bp, Artificial Sequence
  chemically synthesized
aaattccagatacaagaggc

SEQ ID NO: 139315 - DNA, 20 bp, Artificial Sequence
  chemically synthesized
attccagatacaagaggcta

SEQ ID NO: 139316 - DNA, 20 bp, Artificial Sequence
  chemically synthesized
atacaagaggctagagttga

SEQ ID NO: 139317 - DNA, 20 bp, Artificial Sequence
  chemically synthesized
gcttaattacctgtcaactc

SEQ ID NO: 139318 - DNA, 20 bp, Artificial Sequence
  chemically synthesized
tacaagaggctagagttgac

SEQ ID NO: 139319 - DNA, 20 bp, Artificial Sequence
  chemically synthesized
gctagagttgacaggtaatt

SEQ ID NO: 139320 - DNA, 20 bp, Artificial Sequence
  chemically synthesized
gttgacaggtaattaagctt

SEQ ID NO: 139321 - DNA, 20 bp, Artificial Sequence
  chemically synthesized
tctagctctttgattgacca

SEQ ID NO: 139322 - DNA, 20 bp, Artificial Sequence
  chemically synthesized
aattaagctttggtcaatca

SEQ ID NO: 139323 - DNA, 20 bp, Artificial Sequence
  chemically synthesized
ttaagctttggtcaatcaaa

SEQ ID NO: 139324 - DNA, 20 bp, Artificial Sequence
  chemically synthesized
gctttggtcaatcaaagagc

SEQ ID NO: 139325 - DNA, 20 bp, Artificial Sequence
  chemically synthesized
ttatttcaataaatattttc

SEQ ID NO: 139326 - DNA, 20 bp, Artificial Sequence
  chemically synthesized
attgtatgcataacacatca

SEQ ID NO: 139327 - DNA, 20 bp, Artificial Sequence
  chemically synthesized
gtatgcataacacatcacag

SEQ ID NO: 139328 - DNA, 20 bp, Artificial Sequence
  chemically synthesized
tatgcataacacatcacagt

SEQ ID NO: 139329 - DNA, 20 bp, Artificial Sequence
  chemically synthesized
atgcataacacatcacagta

SEQ ID NO: 139330 - DNA, 20 bp, Artificial Sequence
  chemically synthesized
acagtagggaatgtgcctca

SEQ ID NO: 139331 - DNA, 20 bp, Artificial Sequence
  chemically synthesized
tctctttcatgtcatccatg

SEQ ID NO: 139332 - DNA, 20 bp, Artificial Sequence
  chemically synthesized
gtctctttcatgtcatccat

SEQ ID NO: 139333 - DNA, 20 bp, Artificial Sequence
  chemically synthesized
gtgcctcatggatgacatga

SEQ ID NO: 139334 - DNA, 20 bp, Artificial Sequence
  chemically synthesized
gcctcatggatgacatgaaa

SEQ ID NO: 139335 - DNA, 20 bp, Artificial Sequence
  chemically synthesized
atgacatgaaagagactctc

SEQ ID NO: 139336 - DNA, 20 bp, Artificial Sequence
  chemically synthesized
agttcaattatttcactaga

SEQ ID NO: 139337 - DNA, 20 bp, Artificial Sequence
  chemically synthesized
caagttcaattatttcacta

SEQ ID NO: 139338 - DNA, 20 bp, Artificial Sequence
  chemically synthesized
cacaagttcaattatttcac

SEQ ID NO: 139339 - DNA, 20 bp, Artificial Sequence
  chemically synthesized
ctgcattgaaagttcatcac

SEQ ID NO: 139340 - DNA, 20 bp, Artificial Sequence
  chemically synthesized
cttgtgatgaactttcaatg

SEQ ID NO: 139341 - DNA, 20 bp, Artificial Sequence
  chemically synthesized
cacctccccaactgcattga

SEQ ID NO: 139342 - DNA, 20 bp, Artificial Sequence
  chemically synthesized
tgatgaactttcaatgcagt

SEQ ID NO: 139343 - DNA, 20 bp, Artificial Sequence
  chemically synthesized
gatgaactttcaatgcagtt

SEQ ID NO: 139344 - DNA, 20 bp, Artificial Sequence
  chemically synthesized
atgaactttcaatgcagttg

SEQ ID NO: 139345 - DNA, 20 bp, Artificial Sequence
  chemically synthesized
gaactttcaatgcagttggg

SEQ ID NO: 139346 - DNA, 20 bp, Artificial Sequence
  chemically synthesized
aactttcaatgcagttgggg

SEQ ID NO: 139347 - DNA, 20 bp, Artificial Sequence
  chemically synthesized
gcagttggggaggtgacctt

SEQ ID NO: 139348 - DNA, 20 bp, Artificial Sequence
  chemically synthesized
cagttggggaggtgaccttc

SEQ ID NO: 139349 - DNA, 20 bp, Artificial Sequence
  chemically synthesized
tggggaggtgaccttcaggc

SEQ ID NO: 139350 - DNA, 20 bp, Artificial Sequence
  chemically synthesized
gcatgcatgggctggcctga

SEQ ID NO: 139351 - DNA, 20 bp, Artificial Sequence
  chemically synthesized
agcatgcatgggctggcctg

SEQ ID NO: 139352 - DNA, 20 bp, Artificial Sequence
  chemically synthesized
gtgtgcgagcatgcatgggc

SEQ ID NO: 139353 - DNA, 20 bp, Artificial Sequence
  chemically synthesized
ctgcgtgtgcgagcatgcat

SEQ ID NO: 139354 - DNA, 20 bp, Artificial Sequence
  chemically synthesized
actgcgtgtgcgagcatgca

SEQ ID NO: 139355 - DNA, 20 bp, Artificial Sequence
  chemically synthesized
cccatgcatgctcgcacacg

SEQ ID NO: 139356 - DNA, 20 bp, Artificial Sequence
  chemically synthesized
tattgggtaactgcgtgtgc

SEQ ID NO: 139357 - DNA, 20 bp, Artificial Sequence
  chemically synthesized
cacacgcagttacccaataa

SEQ ID NO: 139358 - DNA, 20 bp, Artificial Sequence
  chemically synthesized
acatattgtcttctattatt

SEQ ID NO: 139359 - DNA, 20 bp, Artificial Sequence
  chemically synthesized
acgcagttacccaataatag

SEQ ID NO: 139360 - DNA, 20 bp, Artificial Sequence
  chemically synthesized
tacatattgtcttctattat

SEQ ID NO: 139361 - DNA, 20 bp, Artificial Sequence
  chemically synthesized
tatgtaaatgacaaacgtaa

SEQ ID NO: 139362 - DNA, 20 bp, Artificial Sequence
  chemically synthesized
atgacaaacgtaatagtcta

SEQ ID NO: 139363 - DNA, 20 bp, Artificial Sequence
  chemically synthesized
agggtaggatatgtggtctg

SEQ ID NO: 139364 - DNA, 20 bp, Artificial Sequence
  chemically synthesized
tcccattagggtaggatatg

SEQ ID NO: 139365 - DNA, 20 bp, Artificial Sequence
  chemically synthesized
gaccacatatcctaccctaa

SEQ ID NO: 139366 - DNA, 20 bp, Artificial Sequence
  chemically synthesized
tctcagaatcccattagggt

SEQ ID NO: 139367 - DNA, 20 bp, Artificial Sequence
  chemically synthesized
accacatatcctaccctaat

SEQ ID NO: 139368 - DNA, 20 bp, Artificial Sequence
  chemically synthesized
ctctcagaatcccattaggg

SEQ ID NO: 139369 - DNA, 20 bp, Artificial Sequence
  chemically synthesized
catctctcagaatcccatta

SEQ ID NO: 139370 - DNA, 20 bp, Artificial Sequence
  chemically synthesized
ccatctctcagaatcccatt

SEQ ID NO: 139371 - DNA, 20 bp, Artificial Sequence
  chemically synthesized
cccatctctcagaatcccat

SEQ ID NO: 139372 - DNA, 20 bp, Artificial Sequence
  chemically synthesized
tcctaccctaatgggattct

SEQ ID NO: 139373 - DNA, 20 bp, Artificial Sequence
  chemically synthesized
ctaccctaatgggattctga

SEQ ID NO: 139374 - DNA, 20 bp, Artificial Sequence
  chemically synthesized
cctaatgggattctgagaga

SEQ ID NO: 139375 - DNA, 20 bp, Artificial Sequence
  chemically synthesized
ctaatgggattctgagagat

SEQ ID NO: 139376 - DNA, 20 bp, Artificial Sequence
  chemically synthesized
ccatataaaatcccatctct

SEQ ID NO: 139377 - DNA, 20 bp, Artificial Sequence
  chemically synthesized
ctgagagatgggattttata

SEQ ID NO: 139378 - DNA, 20 bp, Artificial Sequence
  chemically synthesized
tgagagatgggattttatat

SEQ ID NO: 139379 - DNA, 20 bp, Artificial Sequence
  chemically synthesized
gatgggattttatatgggac

SEQ ID NO: 139380 - DNA, 20 bp, Artificial Sequence
  chemically synthesized
atgggattttatatgggacc

SEQ ID NO: 139381 - DNA, 20 bp, Artificial Sequence
  chemically synthesized
attttatatgggaccaggtt

SEQ ID NO: 139382 - DNA, 20 bp, Artificial Sequence
  chemically synthesized
ttttatatgggaccaggttc

SEQ ID NO: 139383 - DNA, 20 bp, Artificial Sequence
  chemically synthesized
tttatatgggaccaggttca

SEQ ID NO: 139384 - DNA, 20 bp, Artificial Sequence
  chemically synthesized
tatggcaccttccctgaacc

SEQ ID NO: 139385 - DNA, 20 bp, Artificial Sequence
  chemically synthesized
atatgggaccaggttcaggg

SEQ ID NO: 139386 - DNA, 20 bp, Artificial Sequence
  chemically synthesized
tatgggaccaggttcaggga

SEQ ID NO: 139387 - DNA, 20 bp, Artificial Sequence
  chemically synthesized
caggttcagggaaggtgcca

SEQ ID NO: 139388 - DNA, 20 bp, Artificial Sequence
  chemically synthesized
ggttcagggaaggtgccata

SEQ ID NO: 139389 - DNA, 20 bp, Artificial Sequence
  chemically synthesized
gttcagggaaggtgccatag

SEQ ID NO: 139390 - DNA, 20 bp, Artificial Sequence
  chemically synthesized
ttcatgttgctgttcctcta

SEQ ID NO: 139391 - DNA, 20 bp, Artificial Sequence
  chemically synthesized
gggaaggtgccatagaggaa

SEQ ID NO: 139392 - DNA, 20 bp, Artificial Sequence
  chemically synthesized
cagcaacatgaactgtaact

SEQ ID NO: 139393 - DNA, 20 bp, Artificial Sequence
  chemically synthesized
gcaacatgaactgtaactta

SEQ ID NO: 139394 - DNA, 20 bp, Artificial Sequence
  chemically synthesized
tgagttcatcctctaagtta

SEQ ID NO: 139395 - DNA, 20 bp, Artificial Sequence
  chemically synthesized
caacatgaactgtaacttag

SEQ ID NO: 139396 - DNA, 20 bp, Artificial Sequence
  chemically synthesized
attaattgagttcatcctct

SEQ ID NO: 139397 - DNA, 20 bp, Artificial Sequence
  chemically synthesized
ccattaggtcattattaatt

SEQ ID NO: 139398 - DNA, 20 bp, Artificial Sequence
  chemically synthesized
ctcaattaataatgacctaa

SEQ ID NO: 139399 - DNA, 20 bp, Artificial Sequence
  chemically synthesized
tcaattaataatgacctaat

SEQ ID NO: 139400 - DNA, 20 bp, Artificial Sequence
  chemically synthesized
aattaataatgacctaatgg

SEQ ID NO: 139401 - DNA, 20 bp, Artificial Sequence
  chemically synthesized
ctgaaattccttctcccatt

SEQ ID NO: 139402 - DNA, 20 bp, Artificial Sequence
  chemically synthesized
taataatgacctaatgggag

SEQ ID NO: 139403 - DNA, 20 bp, Artificial Sequence
  chemically synthesized
cctgaaattccttctcccat

SEQ ID NO: 139404 - DNA, 20 bp, Artificial Sequence
  chemically synthesized
aataatgacctaatgggaga

SEQ ID NO: 139405 - DNA, 20 bp, Artificial Sequence
  chemically synthesized
cctaatgggagaaggaattt

SEQ ID NO: 139406 - DNA, 20 bp, Artificial Sequence
  chemically synthesized
ctaatgggagaaggaatttc

SEQ ID NO: 139407 - DNA, 20 bp, Artificial Sequence
  chemically synthesized
gggagaaggaatttcaggac

SEQ ID NO: 139408 - DNA, 20 bp, Artificial Sequence
  chemically synthesized
ggagaaggaatttcaggaca

SEQ ID NO: 139409 - DNA, 20 bp, Artificial Sequence
  chemically synthesized
agaaggaatttcaggacaag

SEQ ID NO: 139410 - DNA, 20 bp, Artificial Sequence
  chemically synthesized
aggaatttcaggacaaggag

SEQ ID NO: 139411 - DNA, 20 bp, Artificial Sequence
  chemically synthesized
acttctacactttagtttta

SEQ ID NO: 139412 - DNA, 20 bp, Artificial Sequence
  chemically synthesized
aaggagtagctttaaaacta

SEQ ID NO: 139413 - DNA, 20 bp, Artificial Sequence
  chemically synthesized
gtagctttaaaactaaagtg

SEQ ID NO: 139414 - DNA, 20 bp, Artificial Sequence
  chemically synthesized
gtattctgacttctacactt

SEQ ID NO: 139415 - DNA, 20 bp, Artificial Sequence
  chemically synthesized
gctttaaaactaaagtgtag

SEQ ID NO: 139416 - DNA, 20 bp, Artificial Sequence
  chemically synthesized
taaaactaaagtgtagaagt

SEQ ID NO: 139417 - DNA, 20 bp, Artificial Sequence
  chemically synthesized
aaagtgtagaagtcagaata

SEQ ID NO: 139418 - DNA, 20 bp, Artificial Sequence
  chemically synthesized
gtgtagaagtcagaatacag

SEQ ID NO: 139419 - DNA, 20 bp, Artificial Sequence
  chemically synthesized
gtagaagtcagaatacagca

SEQ ID NO: 139420 - DNA, 20 bp, Artificial Sequence
  chemically synthesized
gaagtcagaatacagcagag

SEQ ID NO: 139421 - DNA, 20 bp, Artificial Sequence
  chemically synthesized
cagaatacagcagagtggtt

SEQ ID NO: 139422 - DNA, 20 bp, Artificial Sequence
  chemically synthesized
atacagcagagtggttgaga

SEQ ID NO: 139423 - DNA, 20 bp, Artificial Sequence
  chemically synthesized
acagcagagtggttgagaaa

SEQ ID NO: 139424 - DNA, 20 bp, Artificial Sequence
  chemically synthesized
gcagagtggttgagaaagag

SEQ ID NO: 139425 - DNA, 20 bp, Artificial Sequence
  chemically synthesized
cagagtggttgagaaagagt

SEQ ID NO: 139426 - DNA, 20 bp, Artificial Sequence
  chemically synthesized
agtggttgagaaagagtggg

SEQ ID NO: 139427 - DNA, 20 bp, Artificial Sequence
  chemically synthesized
gtggttgagaaagagtggga

SEQ ID NO: 139428 - DNA, 20 bp, Artificial Sequence
  chemically synthesized
tggttgagaaagagtgggaa

SEQ ID NO: 139429 - DNA, 20 bp, Artificial Sequence
  chemically synthesized
ttgagaaagagtgggaaggg

SEQ ID NO: 139430 - DNA, 20 bp, Artificial Sequence
  chemically synthesized
gggaagggcagctgtgtaat

SEQ ID NO: 139431 - DNA, 20 bp, Artificial Sequence
  chemically synthesized
aattctgctaactaattaca

SEQ ID NO: 139432 - DNA, 20 bp, Artificial Sequence
  chemically synthesized
agggcagctgtgtaattagt

SEQ ID NO: 139433 - DNA, 20 bp, Artificial Sequence
  chemically synthesized
gcagctgtgtaattagttag

SEQ ID NO: 139434 - DNA, 20 bp, Artificial Sequence
  chemically synthesized
attagttagcagaattacga

SEQ ID NO: 139435 - DNA, 20 bp, Artificial Sequence
  chemically synthesized
gaattacgatggctgtgatc

SEQ ID NO: 139436 - DNA, 20 bp, Artificial Sequence
  chemically synthesized
ttcccttctcaacttgatca

SEQ ID NO: 139437 - DNA, 20 bp, Artificial Sequence
  chemically synthesized
acgatggctgtgatcaagtt

SEQ ID NO: 139438 - DNA, 20 bp, Artificial Sequence
  chemically synthesized
atggctgtgatcaagttgag

SEQ ID NO: 139439 - DNA, 20 bp, Artificial Sequence
  chemically synthesized
tggctgtgatcaagttgaga

SEQ ID NO: 139440 - DNA, 20 bp, Artificial Sequence
  chemically synthesized
ggctgtgatcaagttgagaa

SEQ ID NO: 139441 - DNA, 20 bp, Artificial Sequence
  chemically synthesized
tgtgatcaagttgagaaggg

SEQ ID NO: 139442 - DNA, 20 bp, Artificial Sequence
  chemically synthesized
atcaagttgagaagggaagc

SEQ ID NO: 139443 - DNA, 20 bp, Artificial Sequence
  chemically synthesized
tcaagttgagaagggaagct

SEQ ID NO: 139444 - DNA, 20 bp, Artificial Sequence
  chemically synthesized
caagttgagaagggaagctg

SEQ ID NO: 139445 - DNA, 20 bp, Artificial Sequence
  chemically synthesized
ttgagaagggaagctggggc

SEQ ID NO: 139446 - DNA, 20 bp, Artificial Sequence
  chemically synthesized
gagccctcacattctggccc

SEQ ID NO: 139447 - DNA, 20 bp, Artificial Sequence
  chemically synthesized
ggaagctggggccagaatgt

SEQ ID NO: 139448 - DNA, 20 bp, Artificial Sequence
  chemically synthesized
gaagctggggccagaatgtg

SEQ ID NO: 139449 - DNA, 20 bp, Artificial Sequence
  chemically synthesized
tgttctgagccctcacattc

SEQ ID NO: 139450 - DNA, 20 bp, Artificial Sequence
  chemically synthesized
aagctggggccagaatgtga

SEQ ID NO: 139451 - DNA, 20 bp, Artificial Sequence
  chemically synthesized
ggggccagaatgtgagggct

SEQ ID NO: 139452 - DNA, 20 bp, Artificial Sequence
  chemically synthesized
aatgtgagggctcagaacac

SEQ ID NO: 139453 - DNA, 20 bp, Artificial Sequence
  chemically synthesized
atttgggcatctagtgttct

SEQ ID NO: 139454 - DNA, 20 bp, Artificial Sequence
  chemically synthesized
gatgtccttatttgggcatc

SEQ ID NO: 139455 - DNA, 20 bp, Artificial Sequence
  chemically synthesized
agaacactagatgcccaaat

SEQ ID NO: 139456 - DNA, 20 bp, Artificial Sequence
  chemically synthesized
gaacactagatgcccaaata

SEQ ID NO: 139457 - DNA, 20 bp, Artificial Sequence
  chemically synthesized
tcaacatgatgtccttattt

SEQ ID NO: 139458 - DNA, 20 bp, Artificial Sequence
  chemically synthesized
ttcaacatgatgtccttatt

SEQ ID NO: 139459 - DNA, 20 bp, Artificial Sequence
  chemically synthesized
caaataaggacatcatgttg

SEQ ID NO: 139460 - DNA, 20 bp, Artificial Sequence
  chemically synthesized
aaataaggacatcatgttga

SEQ ID NO: 139461 - DNA, 20 bp, Artificial Sequence
  chemically synthesized
ggacatcatgttgaaggcca

SEQ ID NO: 139462 - DNA, 20 bp, Artificial Sequence
  chemically synthesized
gacatcatgttgaaggccat

SEQ ID NO: 139463 - DNA, 20 bp, Artificial Sequence
  chemically synthesized
aaacctctgatgatttccca

SEQ ID NO: 139464 - DNA, 20 bp, Artificial Sequence
  chemically synthesized
tgaaggccatgggaaatcat

SEQ ID NO: 139465 - DNA, 20 bp, Artificial Sequence
  chemically synthesized
aaggccatgggaaatcatca

SEQ ID NO: 139466 - DNA, 20 bp, Artificial Sequence
  chemically synthesized
aggccatgggaaatcatcag

SEQ ID NO: 139467 - DNA, 20 bp, Artificial Sequence
  chemically synthesized
tgggaaatcatcagaggttt

SEQ ID NO: 139468 - DNA, 20 bp, Artificial Sequence
  chemically synthesized
ggaaatcatcagaggtttga

SEQ ID NO: 139469 - DNA, 20 bp, Artificial Sequence
  chemically synthesized
aatcatcagaggtttgagag

SEQ ID NO: 139470 - DNA, 20 bp, Artificial Sequence
  chemically synthesized
catcagaggtttgagagcag

SEQ ID NO: 139471 - DNA, 20 bp, Artificial Sequence
  chemically synthesized
gcagaagaatgccacaataa

SEQ ID NO: 139472 - DNA, 20 bp, Artificial Sequence
  chemically synthesized
ctaacatgccacttttattg

SEQ ID NO: 139473 - DNA, 20 bp, Artificial Sequence
  chemically synthesized
gaagaatgccacaataaaag

SEQ ID NO: 139474 - DNA, 20 bp, Artificial Sequence
  chemically synthesized
ccacaataaaagtggcatgt

SEQ ID NO: 139475 - DNA, 20 bp, Artificial Sequence
  chemically synthesized
acattggatgcagttgtacg

SEQ ID NO: 139476 - DNA, 20 bp, Artificial Sequence
  chemically synthesized
gacattggatgcagttgtac

SEQ ID NO: 139477 - DNA, 20 bp, Artificial Sequence
  chemically synthesized
cttggaagggacattggatg

SEQ ID NO: 139478 - DNA, 20 bp, Artificial Sequence
  chemically synthesized
ttctttcttggaagggacat

SEQ ID NO: 139479 - DNA, 20 bp, Artificial Sequence
  chemically synthesized
ctgcatccaatgtcccttcc

SEQ ID NO: 139480 - DNA, 20 bp, Artificial Sequence
  chemically synthesized
tttccatttctttcttggaa

SEQ ID NO: 139481 - DNA, 20 bp, Artificial Sequence
  chemically synthesized
atccaatgtcccttccaaga

SEQ ID NO: 139482 - DNA, 20 bp, Artificial Sequence
  chemically synthesized
ttttccatttctttcttgga

SEQ ID NO: 139483 - DNA, 20 bp, Artificial Sequence
  chemically synthesized
attttccatttctttcttgg

SEQ ID NO: 139484 - DNA, 20 bp, Artificial Sequence
  chemically synthesized
ttaattttccatttctttct

SEQ ID NO: 139485 - DNA, 20 bp, Artificial Sequence
  chemically synthesized
tgtcccttccaagaaagaaa

SEQ ID NO: 139486 - DNA, 20 bp, Artificial Sequence
  chemically synthesized
agaaatggaaaattaaattg

SEQ ID NO: 139487 - DNA, 20 bp, Artificial Sequence
  chemically synthesized
aaattaaattgcagtaaccc

SEQ ID NO: 139488 - DNA, 20 bp, Artificial Sequence
  chemically synthesized
aaattgcagtaacccaagaa

SEQ ID NO: 139489 - DNA, 20 bp, Artificial Sequence
  chemically synthesized
agatacaagaggcttttctt

SEQ ID NO: 139490 - DNA, 20 bp, Artificial Sequence
  chemically synthesized
gagatacaagaggcttttct

SEQ ID NO: 139491 - DNA, 20 bp, Artificial Sequence
  chemically synthesized
aatcaaagaggagatacaag

SEQ ID NO: 139492 - DNA, 20 bp, Artificial Sequence
  chemically synthesized
taatcaaagaggagatacaa

SEQ ID NO: 139493 - DNA, 20 bp, Artificial Sequence
  chemically synthesized
tttaatcaaagaggagatac

SEQ ID NO: 139494 - DNA, 20 bp, Artificial Sequence
  chemically synthesized
caggacatttaatcaaagag

SEQ ID NO: 139495 - DNA, 20 bp, Artificial Sequence
  chemically synthesized
gacaggacatttaatcaaag

SEQ ID NO: 139496 - DNA, 20 bp, Artificial Sequence
  chemically synthesized
tgacaggacatttaatcaaa

SEQ ID NO: 139497 - DNA, 20 bp, Artificial Sequence
  chemically synthesized
catgacaggacatttaatca

SEQ ID NO: 139498 - DNA, 20 bp, Artificial Sequence
  chemically synthesized
gttttacatgttttcatgac

SEQ ID NO: 139499 - DNA, 20 bp, Artificial Sequence
  chemically synthesized
tgttttacatgttttcatga

SEQ ID NO: 139500 - DNA, 20 bp, Artificial Sequence
  chemically synthesized
aaagatgcatgaaggtaaat

SEQ ID NO: 139501 - DNA, 20 bp, Artificial Sequence
  chemically synthesized
cttcttaaaaagatgcatga

SEQ ID NO: 139502 - DNA, 20 bp, Artificial Sequence
  chemically synthesized
tcttcttaaaaagatgcatg

SEQ ID NO: 139503 - DNA, 20 bp, Artificial Sequence
  chemically synthesized
ttaccttcatgcatcttttt

SEQ ID NO: 139504 - DNA, 20 bp, Artificial Sequence
  chemically synthesized
ccttcatgcatctttttaag

SEQ ID NO: 139505 - DNA, 20 bp, Artificial Sequence
  chemically synthesized
gttattatattcttcttaaa

SEQ ID NO: 139506 - DNA, 20 bp, Artificial Sequence
  chemically synthesized
tatgttccttgtgtgcagtg

SEQ ID NO: 139507 - DNA, 20 bp, Artificial Sequence
  chemically synthesized
tttatgttccttgtgtgcag

SEQ ID NO: 139508 - DNA, 20 bp, Artificial Sequence
  chemically synthesized
ataataactccactgcacac

SEQ ID NO: 139509 - DNA, 20 bp, Artificial Sequence
  chemically synthesized
taataactccactgcacaca

SEQ ID NO: 139510 - DNA, 20 bp, Artificial Sequence
  chemically synthesized
gaatttatgttccttgtgtg

SEQ ID NO: 139511 - DNA, 20 bp, Artificial Sequence
  chemically synthesized
gacagtttttacaagcaatg

SEQ ID NO: 139512 - DNA, 20 bp, Artificial Sequence
  chemically synthesized
ggacagtttttacaagcaat

SEQ ID NO: 139513 - DNA, 20 bp, Artificial Sequence
  chemically synthesized
gggacagtttttacaagcaa

SEQ ID NO: 139514 - DNA, 20 bp, Artificial Sequence
  chemically synthesized
ttctttgggacagtttttac

SEQ ID NO: 139515 - DNA, 20 bp, Artificial Sequence
  chemically synthesized
tgcttgtaaaaactgtccca

SEQ ID NO: 139516 - DNA, 20 bp, Artificial Sequence
  chemically synthesized
tgtttaataattctttggga

SEQ ID NO: 139517 - DNA, 20 bp, Artificial Sequence
  chemically synthesized
aatttgtttaataattcttt

SEQ ID NO: 139518 - DNA, 20 bp, Artificial Sequence
  chemically synthesized
aaatttgtttaataattctt

SEQ ID NO: 139519 - DNA, 20 bp, Artificial Sequence
  chemically synthesized
tataatattacaagtagaat

SEQ ID NO: 139520 - DNA, 20 bp, Artificial Sequence
  chemically synthesized
gtaaaatataatattacaag

SEQ ID NO: 139521 - DNA, 20 bp, Artificial Sequence
  chemically synthesized
atagtaaaatataatattac

SEQ ID NO: 139522 - DNA, 20 bp, Artificial Sequence
  chemically synthesized
taatattatattttactata

SEQ ID NO: 139523 - DNA, 20 bp, Artificial Sequence
  chemically synthesized
aatattatattttactatat

SEQ ID NO: 139524 - DNA, 20 bp, Artificial Sequence
  chemically synthesized
atattatattttactatata

SEQ ID NO: 139525 - DNA, 20 bp, Artificial Sequence
  chemically synthesized
tattatattttactatatag

SEQ ID NO: 139526 - DNA, 20 bp, Artificial Sequence
  chemically synthesized
aatccctttttacccctata

SEQ ID NO: 139527 - DNA, 20 bp, Artificial Sequence
  chemically synthesized
ttttactatataggggtaaa

SEQ ID NO: 139528 - DNA, 20 bp, Artificial Sequence
  chemically synthesized
tttactatataggggtaaaa

SEQ ID NO: 139529 - DNA, 20 bp, Artificial Sequence
  chemically synthesized
ttactatataggggtaaaaa

SEQ ID NO: 139530 - DNA, 20 bp, Artificial Sequence
  chemically synthesized
ataggggtaaaaagggattg

SEQ ID NO: 139531 - DNA, 20 bp, Artificial Sequence
  chemically synthesized
gtaaaaagggattgtagttt

SEQ ID NO: 139532 - DNA, 20 bp, Artificial Sequence
  chemically synthesized
aagggattgtagtttcagtt

SEQ ID NO: 139533 - DNA, 20 bp, Artificial Sequence
  chemically synthesized
tgtagtttcagtttagaaaa

SEQ ID NO: 139534 - DNA, 20 bp, Artificial Sequence
  chemically synthesized
gtagtttcagtttagaaaaa

SEQ ID NO: 139535 - DNA, 20 bp, Artificial Sequence
  chemically synthesized
ttagaaaaaaggtaaacatt

SEQ ID NO: 139536 - DNA, 20 bp, Artificial Sequence
  chemically synthesized
atcctttagagtaggaatgt

SEQ ID NO: 139537 - DNA, 20 bp, Artificial Sequence
  chemically synthesized
attcttacattcctactcta

SEQ ID NO: 139538 - DNA, 20 bp, Artificial Sequence
  chemically synthesized
ttcttacattcctactctaa

SEQ ID NO: 139539 - DNA, 20 bp, Artificial Sequence
  chemically synthesized
ctctgtttatcctttagagt

SEQ ID NO: 139540 - DNA, 20 bp, Artificial Sequence
  chemically synthesized
tctctgtttatcctttagag

SEQ ID NO: 139541 - DNA, 20 bp, Artificial Sequence
  chemically synthesized
aagtctctgtttatccttta

SEQ ID NO: 139542 - DNA, 20 bp, Artificial Sequence
  chemically synthesized
gaaagtctctgtttatcctt

SEQ ID NO: 139543 - DNA, 20 bp, Artificial Sequence
  chemically synthesized
ttcctactctaaaggataaa

SEQ ID NO: 139544 - DNA, 20 bp, Artificial Sequence
  chemically synthesized
cctactctaaaggataaaca

SEQ ID NO: 139545 - DNA, 20 bp, Artificial Sequence
  chemically synthesized
aaaggataaacagagacttt

SEQ ID NO: 139546 - DNA, 20 bp, Artificial Sequence
  chemically synthesized
aggataaacagagactttca

SEQ ID NO: 139547 - DNA, 20 bp, Artificial Sequence
  chemically synthesized
aatttcttctcacactctga

SEQ ID NO: 139548 - DNA, 20 bp, Artificial Sequence
  chemically synthesized
aacagagactttcagagtgt

SEQ ID NO: 139549 - DNA, 20 bp, Artificial Sequence
  chemically synthesized
agagactttcagagtgtgag

SEQ ID NO: 139550 - DNA, 20 bp, Artificial Sequence
  chemically synthesized
tcagagtgtgagaagaaatt

SEQ ID NO: 139551 - DNA, 20 bp, Artificial Sequence
  chemically synthesized
agaagaaattgagatctctc

SEQ ID NO: 139552 - DNA, 20 bp, Artificial Sequence
  chemically synthesized
cttgaagttgtatttccaga

SEQ ID NO: 139553 - DNA, 20 bp, Artificial Sequence
  chemically synthesized
tccttgaagttgtatttcca

SEQ ID NO: 139554 - DNA, 20 bp, Artificial Sequence
  chemically synthesized
aatccttgaagttgtatttc

SEQ ID NO: 139555 - DNA, 20 bp, Artificial Sequence
  chemically synthesized
ctctctggaaatacaacttc

SEQ ID NO: 139556 - DNA, 20 bp, Artificial Sequence
  chemically synthesized
tctctggaaatacaacttca

SEQ ID NO: 139557 - DNA, 20 bp, Artificial Sequence
  chemically synthesized
atcactgataataatccttg

SEQ ID NO: 139558 - DNA, 20 bp, Artificial Sequence
  chemically synthesized
acaacttcaaggattattat

SEQ ID NO: 139559 - DNA, 20 bp, Artificial Sequence
  chemically synthesized
caaggattattatcagtgat

SEQ ID NO: 139560 - DNA, 20 bp, Artificial Sequence
  chemically synthesized
ggattattatcagtgataag

SEQ ID NO: 139561 - DNA, 20 bp, Artificial Sequence
  chemically synthesized
tacgtattaagggcattgaa

SEQ ID NO: 139562 - DNA, 20 bp, Artificial Sequence
  chemically synthesized
agtgcagcaatacgtattaa

SEQ ID NO: 139563 - DNA, 20 bp, Artificial Sequence
  chemically synthesized
tagtgcagcaatacgtatta

SEQ ID NO: 139564 - DNA, 20 bp, Artificial Sequence
  chemically synthesized
ctagtgcagcaatacgtatt

SEQ ID NO: 139565 - DNA, 20 bp, Artificial Sequence
  chemically synthesized
cttaatacgtattgctgcac

SEQ ID NO: 139566 - DNA, 20 bp, Artificial Sequence
  chemically synthesized
gaaaaatatcaggtctagtg

SEQ ID NO: 139567 - DNA, 20 bp, Artificial Sequence
  chemically synthesized
ccaaagaaaaatatcaggtc

SEQ ID NO: 139568 - DNA, 20 bp, Artificial Sequence
  chemically synthesized
atttcccaaagaaaaatatc

SEQ ID NO: 139569 - DNA, 20 bp, Artificial Sequence
  chemically synthesized
tatttcccaaagaaaaatat

SEQ ID NO: 139570 - DNA, 20 bp, Artificial Sequence
  chemically synthesized
ctagacctgatatttttctt

SEQ ID NO: 139571 - DNA, 20 bp, Artificial Sequence
  chemically synthesized
tagacctgatatttttcttt

SEQ ID NO: 139572 - DNA, 20 bp, Artificial Sequence
  chemically synthesized
acctgaagacttatttccca

SEQ ID NO: 139573 - DNA, 20 bp, Artificial Sequence
  chemically synthesized
gatatttttctttgggaaat

SEQ ID NO: 139574 - DNA, 20 bp, Artificial Sequence
  chemically synthesized
ttctttgggaaataagtctt

SEQ ID NO: 139575 - DNA, 20 bp, Artificial Sequence
  chemically synthesized
tctttgggaaataagtcttc

SEQ ID NO: 139576 - DNA, 20 bp, Artificial Sequence
  chemically synthesized
ttgggaaataagtcttcagg

SEQ ID NO: 139577 - DNA, 20 bp, Artificial Sequence
  chemically synthesized
agaaataggagtactacctg

SEQ ID NO: 139578 - DNA, 20 bp, Artificial Sequence
  chemically synthesized
tcaggtagtactcctatttc

SEQ ID NO: 139579 - DNA, 20 bp, Artificial Sequence
  chemically synthesized
tactcctttcctagaaatag

SEQ ID NO: 139580 - DNA, 20 bp, Artificial Sequence
  chemically synthesized
caggtagtactcctatttct

SEQ ID NO: 139581 - DNA, 20 bp, Artificial Sequence
  chemically synthesized
agtactcctttcctagaaat

SEQ ID NO: 139582 - DNA, 20 bp, Artificial Sequence
  chemically synthesized
cagtactcctttcctagaaa

SEQ ID NO: 139583 - DNA, 20 bp, Artificial Sequence
  chemically synthesized
tagtactcctatttctagga

SEQ ID NO: 139584 - DNA, 20 bp, Artificial Sequence
  chemically synthesized
agtactcctatttctaggaa

SEQ ID NO: 139585 - DNA, 20 bp, Artificial Sequence
  chemically synthesized
tactcctatttctaggaaag

SEQ ID NO: 139586 - DNA, 20 bp, Artificial Sequence
  chemically synthesized
ataccccagtactcctttcc

SEQ ID NO: 139587 - DNA, 20 bp, Artificial Sequence
  chemically synthesized
tatttctaggaaaggagtac

SEQ ID NO: 139588 - DNA, 20 bp, Artificial Sequence
  chemically synthesized
atttctaggaaaggagtact

SEQ ID NO: 139589 - DNA, 20 bp, Artificial Sequence
  chemically synthesized
tttctaggaaaggagtactg

SEQ ID NO: 139590 - DNA, 20 bp, Artificial Sequence
  chemically synthesized
aacagatgagcacaataccc

SEQ ID NO: 139591 - DNA, 20 bp, Artificial Sequence
  chemically synthesized
acttttatttttgaacagat

SEQ ID NO: 139592 - DNA, 20 bp, Artificial Sequence
  chemically synthesized
ctttgacttttatttttgaa

SEQ ID NO: 139593 - DNA, 20 bp, Artificial Sequence
  chemically synthesized
gctcatctgttcaaaaataa

SEQ ID NO: 139594 - DNA, 20 bp, Artificial Sequence
  chemically synthesized
ctgttcaaaaataaaagtca

SEQ ID NO: 139595 - DNA, 20 bp, Artificial Sequence
  chemically synthesized
atttttaacaaatgttttgt

SEQ ID NO: 139596 - DNA, 20 bp, Artificial Sequence
  chemically synthesized
aatgtttttaaaacgtgaaa

SEQ ID NO: 139597 - DNA, 20 bp, Artificial Sequence
  chemically synthesized
aaatgtttttaaaacgtgaa

SEQ ID NO: 139598 - DNA, 20 bp, Artificial Sequence
  chemically synthesized
cacgttttaaaaacattttg

SEQ ID NO: 139599 - DNA, 20 bp, Artificial Sequence
  chemically synthesized
tttgaagatattattcattt

SEQ ID NO: 139600 - DNA, 20 bp, Artificial Sequence
  chemically synthesized
taaaaagcatggttttgttt

SEQ ID NO: 139601 - DNA, 20 bp, Artificial Sequence
  chemically synthesized
gccgttagaaataaaaagca

SEQ ID NO: 139602 - DNA, 20 bp, Artificial Sequence
  chemically synthesized
tggctgccgttagaaataaa

SEQ ID NO: 139603 - DNA, 20 bp, Artificial Sequence
  chemically synthesized
accatgctttttatttctaa

SEQ ID NO: 139604 - DNA, 20 bp, Artificial Sequence
  chemically synthesized
atgctttttatttctaacgg

SEQ ID NO: 139605 - DNA, 20 bp, Artificial Sequence
  chemically synthesized
agtttattgatggctgccgt

SEQ ID NO: 139606 - DNA, 20 bp, Artificial Sequence
  chemically synthesized
gctttgcctcagtttattga

SEQ ID NO: 139607 - DNA, 20 bp, Artificial Sequence
  chemically synthesized
acggcagccatcaataaact

SEQ ID NO: 139608 - DNA, 20 bp, Artificial Sequence
  chemically synthesized
cggcagccatcaataaactg

SEQ ID NO: 139609 - DNA, 20 bp, Artificial Sequence
  chemically synthesized
gccatcaataaactgaggca

SEQ ID NO: 139610 - DNA, 20 bp, Artificial Sequence
  chemically synthesized
taacatctcttgctttgcct

SEQ ID NO: 139611 - DNA, 20 bp, Artificial Sequence
  chemically synthesized
tcaataaactgaggcaaagc

SEQ ID NO: 139612 - DNA, 20 bp, Artificial Sequence
  chemically synthesized
aataaactgaggcaaagcaa

SEQ ID NO: 139613 - DNA, 20 bp, Artificial Sequence
  chemically synthesized
ctacaggtagtatcagcgaa

SEQ ID NO: 139614 - DNA, 20 bp, Artificial Sequence
  chemically synthesized
ttcccatctacaggtagtat

SEQ ID NO: 139615 - DNA, 20 bp, Artificial Sequence
  chemically synthesized
ccattcgctgatactacctg

SEQ ID NO: 139616 - DNA, 20 bp, Artificial Sequence
  chemically synthesized
cttcacttcccatctacagg

SEQ ID NO: 139617 - DNA, 20 bp, Artificial Sequence
  chemically synthesized
tcgctgatactacctgtaga

SEQ ID NO: 139618 - DNA, 20 bp, Artificial Sequence
  chemically synthesized
cgctgatactacctgtagat

SEQ ID NO: 139619 - DNA, 20 bp, Artificial Sequence
  chemically synthesized
tcacttcacttcccatctac

SEQ ID NO: 139620 - DNA, 20 bp, Artificial Sequence
  chemically synthesized
ttcacttcacttcccatcta

SEQ ID NO: 139621 - DNA, 20 bp, Artificial Sequence
  chemically synthesized
tgatactacctgtagatggg

SEQ ID NO: 139622 - DNA, 20 bp, Artificial Sequence
  chemically synthesized
ctacctgtagatgggaagtg

SEQ ID NO: 139623 - DNA, 20 bp, Artificial Sequence
  chemically synthesized
tgtagatgggaagtgaagtg

SEQ ID NO: 139624 - DNA, 20 bp, Artificial Sequence
  chemically synthesized
gggaagtgaagtgaagaaat

SEQ ID NO: 139625 - DNA, 20 bp, Artificial Sequence
  chemically synthesized
tgaagaaatgagtgattatc

SEQ ID NO: 139626 - DNA, 20 bp, Artificial Sequence
  chemically synthesized
aagaaatgagtgattatcta

SEQ ID NO: 139627 - DNA, 20 bp, Artificial Sequence
  chemically synthesized
agaaatgagtgattatctag

SEQ ID NO: 139628 - DNA, 20 bp, Artificial Sequence
  chemically synthesized
ttcatgagtgtaatcgcctc

SEQ ID NO: 139629 - DNA, 20 bp, Artificial Sequence
  chemically synthesized
ggcgattacactcatgaaca

SEQ ID NO: 139630 - DNA, 20 bp, Artificial Sequence
  chemically synthesized
ttctgattaactgtgttcat

SEQ ID NO: 139631 - DNA, 20 bp, Artificial Sequence
  chemically synthesized
cactcatgaacacagttaat

SEQ ID NO: 139632 - DNA, 20 bp, Artificial Sequence
  chemically synthesized
acagttaatcagaataattc

SEQ ID NO: 139633 - DNA, 20 bp, Artificial Sequence
  chemically synthesized
gacagcagaagagggttagg

SEQ ID NO: 139634 - DNA, 20 bp, Artificial Sequence
  chemically synthesized
agacagcagaagagggttag

SEQ ID NO: 139635 - DNA, 20 bp, Artificial Sequence
  chemically synthesized
aagacagcagaagagggtta

SEQ ID NO: 139636 - DNA, 20 bp, Artificial Sequence
  chemically synthesized
gaagacagcagaagagggtt

SEQ ID NO: 139637 - DNA, 20 bp, Artificial Sequence
  chemically synthesized
tgaagacagcagaagagggt

SEQ ID NO: 139638 - DNA, 20 bp, Artificial Sequence
  chemically synthesized
catgtgaagacagcagaaga

SEQ ID NO: 139639 - DNA, 20 bp, Artificial Sequence
  chemically synthesized
ccatgtgaagacagcagaag

SEQ ID NO: 139640 - DNA, 20 bp, Artificial Sequence
  chemically synthesized
accatgtgaagacagcagaa

SEQ ID NO: 139641 - DNA, 20 bp, Artificial Sequence
  chemically synthesized
ctaccatgtgaagacagcag

SEQ ID NO: 139642 - DNA, 20 bp, Artificial Sequence
  chemically synthesized
catctaccatgtgaagacag

SEQ ID NO: 139643 - DNA, 20 bp, Artificial Sequence
  chemically synthesized
tcacatctaccatgtgaaga

SEQ ID NO: 139644 - DNA, 20 bp, Artificial Sequence
  chemically synthesized
cctcttctgctgtcttcaca

SEQ ID NO: 139645 - DNA, 20 bp, Artificial Sequence
  chemically synthesized
cttctgctgtcttcacatgg

SEQ ID NO: 139646 - DNA, 20 bp, Artificial Sequence
  chemically synthesized
aatttcacatctaccatgtg

SEQ ID NO: 139647 - DNA, 20 bp, Artificial Sequence
  chemically synthesized
atttgaattatcaaaataat

SEQ ID NO: 139648 - DNA, 20 bp, Artificial Sequence
  chemically synthesized
aattatcaaaataattggca

SEQ ID NO: 139649 - DNA, 20 bp, Artificial Sequence
  chemically synthesized
tatgggaaacatgaattgaa

SEQ ID NO: 139650 - DNA, 20 bp, Artificial Sequence
  chemically synthesized
ttcaattcatgtttcccata

SEQ ID NO: 139651 - DNA, 20 bp, Artificial Sequence
  chemically synthesized
tcaattcatgtttcccatat

SEQ ID NO: 139652 - DNA, 20 bp, Artificial Sequence
  chemically synthesized
caattcatgtttcccatata

SEQ ID NO: 139653 - DNA, 20 bp, Artificial Sequence
  chemically synthesized
gcctgattctatccctatat

SEQ ID NO: 139654 - DNA, 20 bp, Artificial Sequence
  chemically synthesized
agcctgattctatccctata

SEQ ID NO: 139655 - DNA, 20 bp, Artificial Sequence
  chemically synthesized
tcatgtttcccatataggga

SEQ ID NO: 139656 - DNA, 20 bp, Artificial Sequence
  chemically synthesized
ttcccatatagggatagaat

SEQ ID NO: 139657 - DNA, 20 bp, Artificial Sequence
  chemically synthesized
tcccatatagggatagaatc

SEQ ID NO: 139658 - DNA, 20 bp, Artificial Sequence
  chemically synthesized
tatagggatagaatcaggct

SEQ ID NO: 139659 - DNA, 20 bp, Artificial Sequence
  chemically synthesized
actttatagctgaataaact

SEQ ID NO: 139660 - DNA, 20 bp, Artificial Sequence
  chemically synthesized
agaatcaggctcagtttatt

SEQ ID NO: 139661 - DNA, 20 bp, Artificial Sequence
  chemically synthesized
gctcagtttattcagctata

SEQ ID NO: 139662 - DNA, 20 bp, Artificial Sequence
  chemically synthesized
cagtttattcagctataaag

SEQ ID NO: 139663 - DNA, 20 bp, Artificial Sequence
  chemically synthesized
gtttattcagctataaagtg

SEQ ID NO: 139664 - DNA, 20 bp, Artificial Sequence
  chemically synthesized
atgtaattatctccacttta

SEQ ID NO: 139665 - DNA, 20 bp, Artificial Sequence
  chemically synthesized
ttgctttaatcacacaagag

SEQ ID NO: 139666 - DNA, 20 bp, Artificial Sequence
  chemically synthesized
tcattgctttaatcacacaa

SEQ ID NO: 139667 - DNA, 20 bp, Artificial Sequence
  chemically synthesized
attcattgctttaatcacac

SEQ ID NO: 139668 - DNA, 20 bp, Artificial Sequence
  chemically synthesized
aaaccactcttgtgtgatta

SEQ ID NO: 139669 - DNA, 20 bp, Artificial Sequence
  chemically synthesized
aaagcaatgaatctatttat

SEQ ID NO: 139670 - DNA, 20 bp, Artificial Sequence
  chemically synthesized
ggtatttgaattcttataaa

SEQ ID NO: 139671 - DNA, 20 bp, Artificial Sequence
  chemically synthesized
ttataagaattcaaatacct

SEQ ID NO: 139672 - DNA, 20 bp, Artificial Sequence
  chemically synthesized
tataagaattcaaatacctt

SEQ ID NO: 139673 - DNA, 20 bp, Artificial Sequence
  chemically synthesized
aagaattcaaataccttagg

SEQ ID NO: 139674 - DNA, 20 bp, Artificial Sequence
  chemically synthesized
atttgactaatttctaccta

SEQ ID NO: 139675 - DNA, 20 bp, Artificial Sequence
  chemically synthesized
tatttgactaatttctacct

SEQ ID NO: 139676 - DNA, 20 bp, Artificial Sequence
  chemically synthesized
caaataccttaggtagaaat

SEQ ID NO: 139677 - DNA, 20 bp, Artificial Sequence
  chemically synthesized
aggtagaaattagtcaaata

SEQ ID NO: 139678 - DNA, 20 bp, Artificial Sequence
  chemically synthesized
agaaattagtcaaatatggc

SEQ ID NO: 139679 - DNA, 20 bp, Artificial Sequence
  chemically synthesized
ttagtcaaatatggctagtc

SEQ ID NO: 139680 - DNA, 20 bp, Artificial Sequence
  chemically synthesized
tagtcaaatatggctagtcc

SEQ ID NO: 139681 - DNA, 20 bp, Artificial Sequence
  chemically synthesized
tactgtaaagaaacctggac

SEQ ID NO: 139682 - DNA, 20 bp, Artificial Sequence
  chemically synthesized
gctgttactgtaaagaaacc

SEQ ID NO: 139683 - DNA, 20 bp, Artificial Sequence
  chemically synthesized
ggctagtccaggtttcttta

SEQ ID NO: 139684 - DNA, 20 bp, Artificial Sequence
  chemically synthesized
tcttaattgctgttactgta

SEQ ID NO: 139685 - DNA, 20 bp, Artificial Sequence
  chemically synthesized
tccaggtttctttacagtaa

SEQ ID NO: 139686 - DNA, 20 bp, Artificial Sequence
  chemically synthesized
tctttacagtaacagcaatt

SEQ ID NO: 139687 - DNA, 20 bp, Artificial Sequence
  chemically synthesized
caattaagacatatgttata

SEQ ID NO: 139688 - DNA, 20 bp, Artificial Sequence
  chemically synthesized
atagaatatatttaatccat

SEQ ID NO: 139689 - DNA, 20 bp, Artificial Sequence
  chemically synthesized
tagaatatatttaatccatg

SEQ ID NO: 139690 - DNA, 20 bp, Artificial Sequence
  chemically synthesized
atcagaaggctgaaacctca

SEQ ID NO: 139691 - DNA, 20 bp, Artificial Sequence
  chemically synthesized
atatttaatccatgaggttt

SEQ ID NO: 139692 - DNA, 20 bp, Artificial Sequence
  chemically synthesized
cagaatttggcaaaatcaga

SEQ ID NO: 139693 - DNA, 20 bp, Artificial Sequence
  chemically synthesized
tcagaatttggcaaaatcag

SEQ ID NO: 139694 - DNA, 20 bp, Artificial Sequence
  chemically synthesized
cactcagaatttggcaaaat

SEQ ID NO: 139695 - DNA, 20 bp, Artificial Sequence
  chemically synthesized
ttctgattttgccaaattct

SEQ ID NO: 139696 - DNA, 20 bp, Artificial Sequence
  chemically synthesized
actttgtagcactcagaatt

SEQ ID NO: 139697 - DNA, 20 bp, Artificial Sequence
  chemically synthesized
tatcttcactttgtagcact

SEQ ID NO: 139698 - DNA, 20 bp, Artificial Sequence
  chemically synthesized
gccaaattctgagtgctaca

SEQ ID NO: 139699 - DNA, 20 bp, Artificial Sequence
  chemically synthesized
attctgagtgctacaaagtg

SEQ ID NO: 139700 - DNA, 20 bp, Artificial Sequence
  chemically synthesized
ccatatgtatcttcactttg

SEQ ID NO: 139701 - DNA, 20 bp, Artificial Sequence
  chemically synthesized
ctacaaagtgaagatacata

SEQ ID NO: 139702 - DNA, 20 bp, Artificial Sequence
  chemically synthesized
aaagtgaagatacatatgga

SEQ ID NO: 139703 - DNA, 20 bp, Artificial Sequence
  chemically synthesized
cattgtttaaggtgaacaca

SEQ ID NO: 139704 - DNA, 20 bp, Artificial Sequence
  chemically synthesized
cattaatatagcattgttta

SEQ ID NO: 139705 - DNA, 20 bp, Artificial Sequence
  chemically synthesized
ccattaatatagcattgttt

SEQ ID NO: 139706 - DNA, 20 bp, Artificial Sequence
  chemically synthesized
cttaaacaatgctatattaa

SEQ ID NO: 139707 - DNA, 20 bp, Artificial Sequence
  chemically synthesized
ggatttccaagccattaata

SEQ ID NO: 139708 - DNA, 20 bp, Artificial Sequence
  chemically synthesized
acaatgctatattaatggct

SEQ ID NO: 139709 - DNA, 20 bp, Artificial Sequence
  chemically synthesized
taaaactcacaaggatttcc

SEQ ID NO: 139710 - DNA, 20 bp, Artificial Sequence
  chemically synthesized
aatggcttggaaatccttgt

SEQ ID NO: 139711 - DNA, 20 bp, Artificial Sequence
  chemically synthesized
acttatttgtaaaactcaca

SEQ ID NO: 139712 - DNA, 20 bp, Artificial Sequence
  chemically synthesized
cacttatttgtaaaactcac

SEQ ID NO: 139713 - DNA, 20 bp, Artificial Sequence
  chemically synthesized
tccttgtgagttttacaaat

SEQ ID NO: 139714 - DNA, 20 bp, Artificial Sequence
  chemically synthesized
ttttacaaataagtgtgaaa

SEQ ID NO: 139715 - DNA, 20 bp, Artificial Sequence
  chemically synthesized
tttacaaataagtgtgaaac

SEQ ID NO: 139716 - DNA, 20 bp, Artificial Sequence
  chemically synthesized
tacaaataagtgtgaaacag

SEQ ID NO: 139717 - DNA, 20 bp, Artificial Sequence
  chemically synthesized
gtatgtgtgcatgtgtctgt

SEQ ID NO: 139718 - DNA, 20 bp, Artificial Sequence
  chemically synthesized
gttgtctgtgtgagtgctca

SEQ ID NO: 139719 - DNA, 20 bp, Artificial Sequence
  chemically synthesized
tgtgtctgtgagcactcaca

SEQ ID NO: 139720 - DNA, 20 bp, Artificial Sequence
  chemically synthesized
cattcggatgttgtctgtgt

SEQ ID NO: 139721 - DNA, 20 bp, Artificial Sequence
  chemically synthesized
tcacacagacaacatccgaa

SEQ ID NO: 139722 - DNA, 20 bp, Artificial Sequence
  chemically synthesized
acacagacaacatccgaatg

SEQ ID NO: 139723 - DNA, 20 bp, Artificial Sequence
  chemically synthesized
cagacaacatccgaatggag

SEQ ID NO: 139724 - DNA, 20 bp, Artificial Sequence
  chemically synthesized
tcatacctctcttctccatt

SEQ ID NO: 139725 - DNA, 20 bp, Artificial Sequence
  chemically synthesized
gacaacatccgaatggagaa

SEQ ID NO: 139726 - DNA, 20 bp, Artificial Sequence
  chemically synthesized
caacatccgaatggagaaga

SEQ ID NO: 139727 - DNA, 20 bp, Artificial Sequence
  chemically synthesized
aacatccgaatggagaagag

SEQ ID NO: 139728 - DNA, 20 bp, Artificial Sequence
  chemically synthesized
caccattttgatgcaaattt

SEQ ID NO: 139729 - DNA, 20 bp, Artificial Sequence
  chemically synthesized
acaccattttgatgcaaatt

SEQ ID NO: 139730 - DNA, 20 bp, Artificial Sequence
  chemically synthesized
atcctaaatttgcatcaaaa

SEQ ID NO: 139731 - DNA, 20 bp, Artificial Sequence
  chemically synthesized
tttgcatcaaaatggtgtaa

SEQ ID NO: 139732 - DNA, 20 bp, Artificial Sequence
  chemically synthesized
aatggtgtaatggttacctt

SEQ ID NO: 139733 - DNA, 20 bp, Artificial Sequence
  chemically synthesized
ccccttatatgtacgtccaa

SEQ ID NO: 139734 - DNA, 20 bp, Artificial Sequence
  chemically synthesized
tccccttatatgtacgtcca

SEQ ID NO: 139735 - DNA, 20 bp, Artificial Sequence
  chemically synthesized
ttacctttggacgtacatat

SEQ ID NO: 139736 - DNA, 20 bp, Artificial Sequence
  chemically synthesized
tacctttggacgtacatata

SEQ ID NO: 139737 - DNA, 20 bp, Artificial Sequence
  chemically synthesized
acctttggacgtacatataa

SEQ ID NO: 139738 - DNA, 20 bp, Artificial Sequence
  chemically synthesized
cctttggacgtacatataag

SEQ ID NO: 139739 - DNA, 20 bp, Artificial Sequence
  chemically synthesized
gacgtacatataaggggaaa

SEQ ID NO: 139740 - DNA, 20 bp, Artificial Sequence
  chemically synthesized
gggaaaaagtgcttaacaac

SEQ ID NO: 139741 - DNA, 20 bp, Artificial Sequence
  chemically synthesized
ggaaaaagtgcttaacaact

SEQ ID NO: 139742 - DNA, 20 bp, Artificial Sequence
  chemically synthesized
aagaatgagacctagttgtt

SEQ ID NO: 139743 - DNA, 20 bp, Artificial Sequence
  chemically synthesized
ttattttgaagaatgagacc

SEQ ID NO: 139744 - DNA, 20 bp, Artificial Sequence
  chemically synthesized
tgttgtttattttgaagaat

SEQ ID NO: 139745 - DNA, 20 bp, Artificial Sequence
  chemically synthesized
aaaggatgttgtttattttg

SEQ ID NO: 139746 - DNA, 20 bp, Artificial Sequence
  chemically synthesized
actgctgagaaaatgtacaa

SEQ ID NO: 139747 - DNA, 20 bp, Artificial Sequence
  chemically synthesized
aactgctgagaaaatgtaca

SEQ ID NO: 139748 - DNA, 20 bp, Artificial Sequence
  chemically synthesized
acatcctttgtacattttct

SEQ ID NO: 139749 - DNA, 20 bp, Artificial Sequence
  chemically synthesized
tcctttgtacattttctcag

SEQ ID NO: 139750 - DNA, 20 bp, Artificial Sequence
  chemically synthesized
tgatctcccagacaactgct

SEQ ID NO: 139751 - DNA, 20 bp, Artificial Sequence
  chemically synthesized
acattttctcagcagttgtc

SEQ ID NO: 139752 - DNA, 20 bp, Artificial Sequence
  chemically synthesized
cattttctcagcagttgtct

SEQ ID NO: 139753 - DNA, 20 bp, Artificial Sequence
  chemically synthesized
ttttctcagcagttgtctgg

SEQ ID NO: 139754 - DNA, 20 bp, Artificial Sequence
  chemically synthesized
atagattaatgttgatctcc

SEQ ID NO: 139755 - DNA, 20 bp, Artificial Sequence
  chemically synthesized
atataagttctgagaagaaa

SEQ ID NO: 139756 - DNA, 20 bp, Artificial Sequence
  chemically synthesized
aacattaatctatttcttct

SEQ ID NO: 139757 - DNA, 20 bp, Artificial Sequence
  chemically synthesized
ccagtcatataagttctgag

SEQ ID NO: 139758 - DNA, 20 bp, Artificial Sequence
  chemically synthesized
ttcccagtcatataagttct

SEQ ID NO: 139759 - DNA, 20 bp, Artificial Sequence
  chemically synthesized
cttctcagaacttatatgac

SEQ ID NO: 139760 - DNA, 20 bp, Artificial Sequence
  chemically synthesized
tatctttttcccagtcatat

SEQ ID NO: 139761 - DNA, 20 bp, Artificial Sequence
  chemically synthesized
ttctcagaacttatatgact

SEQ ID NO: 139762 - DNA, 20 bp, Artificial Sequence
  chemically synthesized
gaacttatatgactgggaaa

SEQ ID NO: 139763 - DNA, 20 bp, Artificial Sequence
  chemically synthesized
gcagatttttatctttttcc

SEQ ID NO: 139764 - DNA, 20 bp, Artificial Sequence
  chemically synthesized
acatagcacccaatcaaggg

SEQ ID NO: 139765 - DNA, 20 bp, Artificial Sequence
  chemically synthesized
gataaaaatctgcccttgat

SEQ ID NO: 139766 - DNA, 20 bp, Artificial Sequence
  chemically synthesized
ataaaaatctgcccttgatt

SEQ ID NO: 139767 - DNA, 20 bp, Artificial Sequence
  chemically synthesized
aacacatagcacccaatcaa

SEQ ID NO: 139768 - DNA, 20 bp, Artificial Sequence
  chemically synthesized
aaacacatagcacccaatca

SEQ ID NO: 139769 - DNA, 20 bp, Artificial Sequence
  chemically synthesized
taaacacatagcacccaatc

SEQ ID NO: 139770 - DNA, 20 bp, Artificial Sequence
  chemically synthesized
tgattgggtgctatgtgttt

SEQ ID NO: 139771 - DNA, 20 bp, Artificial Sequence
  chemically synthesized
taaaccagagcttaaacaca

SEQ ID NO: 139772 - DNA, 20 bp, Artificial Sequence
  chemically synthesized
ggtgctatgtgtttaagctc

SEQ ID NO: 139773 - DNA, 20 bp, Artificial Sequence
  chemically synthesized
tatgtgtttaagctctggtt

SEQ ID NO: 139774 - DNA, 20 bp, Artificial Sequence
  chemically synthesized
aatgatttacagctaaacca

SEQ ID NO: 139775 - DNA, 20 bp, Artificial Sequence
  chemically synthesized
caaatgatttacagctaaac

SEQ ID NO: 139776 - DNA, 20 bp, Artificial Sequence
  chemically synthesized
tgatcttcacaaatgattta

SEQ ID NO: 139777 - DNA, 20 bp, Artificial Sequence
  chemically synthesized
ttagctgtaaatcatttgtg

SEQ ID NO: 139778 - DNA, 20 bp, Artificial Sequence
  chemically synthesized
catttgtgaagatcatttct

SEQ ID NO: 139779 - DNA, 20 bp, Artificial Sequence
  chemically synthesized
ttgtgaagatcatttcttgg

SEQ ID NO: 139780 - DNA, 20 bp, Artificial Sequence
  chemically synthesized
tgtgaagatcatttcttggt

SEQ ID NO: 139781 - DNA, 20 bp, Artificial Sequence
  chemically synthesized
aagatcatttcttggtaggt

SEQ ID NO: 139782 - DNA, 20 bp, Artificial Sequence
  chemically synthesized
agcaattccactcacctacc

SEQ ID NO: 139783 - DNA, 20 bp, Artificial Sequence
  chemically synthesized
atcatttcttggtaggtgag

SEQ ID NO: 139784 - DNA, 20 bp, Artificial Sequence
  chemically synthesized
ggtgagtggaattgctatta

SEQ ID NO: 139785 - DNA, 20 bp, Artificial Sequence
  chemically synthesized
tgagtggaattgctattata

SEQ ID NO: 139786 - DNA, 20 bp, Artificial Sequence
  chemically synthesized
agtatattaacactctataa

SEQ ID NO: 139787 - DNA, 20 bp, Artificial Sequence
  chemically synthesized
atagagtgttaatatacttg

SEQ ID NO: 139788 - DNA, 20 bp, Artificial Sequence
  chemically synthesized
gtgttaatatacttgcagtg

SEQ ID NO: 139789 - DNA, 20 bp, Artificial Sequence
  chemically synthesized
ccccagcaacacttcactgc

SEQ ID NO: 139790 - DNA, 20 bp, Artificial Sequence
  chemically synthesized
tacttgcagtgaagtgttgc

SEQ ID NO: 139791 - DNA, 20 bp, Artificial Sequence
  chemically synthesized
acttgcagtgaagtgttgct

SEQ ID NO: 139792 - DNA, 20 bp, Artificial Sequence
  chemically synthesized
cttgcagtgaagtgttgctg

SEQ ID NO: 139793 - DNA, 20 bp, Artificial Sequence
  chemically synthesized
ttgcagtgaagtgttgctgg

SEQ ID NO: 139794 - DNA, 20 bp, Artificial Sequence
  chemically synthesized
cagtgaagtgttgctggggg

SEQ ID NO: 139795 - DNA, 20 bp, Artificial Sequence
  chemically synthesized
agtgaagtgttgctgggggt

SEQ ID NO: 139796 - DNA, 20 bp, Artificial Sequence
  chemically synthesized
tgaagtgttgctgggggtag

SEQ ID NO: 139797 - DNA, 20 bp, Artificial Sequence
  chemically synthesized
tgtctaacacctcctacccc

SEQ ID NO: 139798 - DNA, 20 bp, Artificial Sequence
  chemically synthesized
gaagtgttgctgggggtagg

SEQ ID NO: 139799 - DNA, 20 bp, Artificial Sequence
  chemically synthesized
ttgctgggggtaggaggtgt

SEQ ID NO: 139800 - DNA, 20 bp, Artificial Sequence
  chemically synthesized
aggaggtgttagacattgat

SEQ ID NO: 139801 - DNA, 20 bp, Artificial Sequence
  chemically synthesized
ggaggtgttagacattgatc

SEQ ID NO: 139802 - DNA, 20 bp, Artificial Sequence
  chemically synthesized
aggtgttagacattgatcag

SEQ ID NO: 139803 - DNA, 20 bp, Artificial Sequence
  chemically synthesized
tagacattgatcaggagctt

SEQ ID NO: 139804 - DNA, 20 bp, Artificial Sequence
  chemically synthesized
gacattgatcaggagcttaa

SEQ ID NO: 139805 - DNA, 20 bp, Artificial Sequence
  chemically synthesized
tgatcaggagcttaagagat

SEQ ID NO: 139806 - DNA, 20 bp, Artificial Sequence
  chemically synthesized
aaataaatagctcatctctt

SEQ ID NO: 139807 - DNA, 20 bp, Artificial Sequence
  chemically synthesized
cttacaacagcaaaaataaa

SEQ ID NO: 139808 - DNA, 20 bp, Artificial Sequence
  chemically synthesized
ctatttatttttgctgttgt

SEQ ID NO: 139809 - DNA, 20 bp, Artificial Sequence
  chemically synthesized
atttatttttgctgttgtaa

SEQ ID NO: 139810 - DNA, 20 bp, Artificial Sequence
  chemically synthesized
atagaaatttgctcttacaa

SEQ ID NO: 139811 - DNA, 20 bp, Artificial Sequence
  chemically synthesized
gcagaatcattgttttatta

SEQ ID NO: 139812 - DNA, 20 bp, Artificial Sequence
  chemically synthesized
ggtgttttttgacagagaag

SEQ ID NO: 139813 - DNA, 20 bp, Artificial Sequence
  chemically synthesized
aatggtgttttttgacagag

SEQ ID NO: 139814 - DNA, 20 bp, Artificial Sequence
  chemically synthesized
taaaatggtgttttttgaca

SEQ ID NO: 139815 - DNA, 20 bp, Artificial Sequence
  chemically synthesized
cataaaatggtgttttttga

SEQ ID NO: 139816 - DNA, 20 bp, Artificial Sequence
  chemically synthesized
agagctttcatgtcataaaa

SEQ ID NO: 139817 - DNA, 20 bp, Artificial Sequence
  chemically synthesized
aacaccattttatgacatga

SEQ ID NO: 139818 - DNA, 20 bp, Artificial Sequence
  chemically synthesized
tatgacatgaaagctctctt

SEQ ID NO: 139819 - DNA, 20 bp, Artificial Sequence
  chemically synthesized
tgttctttgtttactgaaga

SEQ ID NO: 139820 - DNA, 20 bp, Artificial Sequence
  chemically synthesized
tctgttctttgtttactgaa

SEQ ID NO: 139821 - DNA, 20 bp, Artificial Sequence
  chemically synthesized
agtctgttctttgtttactg

SEQ ID NO: 139822 - DNA, 20 bp, Artificial Sequence
  chemically synthesized
aaagctctcttcagtaaaca

SEQ ID NO: 139823 - DNA, 20 bp, Artificial Sequence
  chemically synthesized
tctcttcagtaaacaaagaa

SEQ ID NO: 139824 - DNA, 20 bp, Artificial Sequence
  chemically synthesized
aacaaagaacagactgttat

SEQ ID NO: 139825 - DNA, 20 bp, Artificial Sequence
  chemically synthesized
caaagaacagactgttattg

SEQ ID NO: 139826 - DNA, 20 bp, Artificial Sequence
  chemically synthesized
atttttacgttctccaataa

SEQ ID NO: 139827 - DNA, 20 bp, Artificial Sequence
  chemically synthesized
ggagaacgtaaaaattacaa

SEQ ID NO: 139828 - DNA, 20 bp, Artificial Sequence
  chemically synthesized
caatagaatatatttcccta

SEQ ID NO: 139829 - DNA, 20 bp, Artificial Sequence
  chemically synthesized
aatagaatatatttccctat

SEQ ID NO: 139830 - DNA, 20 bp, Artificial Sequence
  chemically synthesized
tagaatatatttccctatag

SEQ ID NO: 139831 - DNA, 20 bp, Artificial Sequence
  chemically synthesized
aaggccactgtgctcctata

SEQ ID NO: 139832 - DNA, 20 bp, Artificial Sequence
  chemically synthesized
aaaggccactgtgctcctat

SEQ ID NO: 139833 - DNA, 20 bp, Artificial Sequence
  chemically synthesized
taaaggccactgtgctccta

SEQ ID NO: 139834 - DNA, 20 bp, Artificial Sequence
  chemically synthesized
tatatttccctataggagca

SEQ ID NO: 139835 - DNA, 20 bp, Artificial Sequence
  chemically synthesized
atttccctataggagcacag

SEQ ID NO: 139836 - DNA, 20 bp, Artificial Sequence
  chemically synthesized
gagcacagtggcctttaact

SEQ ID NO: 139837 - DNA, 20 bp, Artificial Sequence
  chemically synthesized
gtaagttccagctgagttaa

SEQ ID NO: 139838 - DNA, 20 bp, Artificial Sequence
  chemically synthesized
tgtaagttccagctgagtta

SEQ ID NO: 139839 - DNA, 20 bp, Artificial Sequence
  chemically synthesized
acagtggcctttaactcagc

SEQ ID NO: 139840 - DNA, 20 bp, Artificial Sequence
  chemically synthesized
tcatactgtaagttccagct

SEQ ID NO: 139841 - DNA, 20 bp, Artificial Sequence
  chemically synthesized
tttaactcagctggaactta

SEQ ID NO: 139842 - DNA, 20 bp, Artificial Sequence
  chemically synthesized
agctgtcatactgtaagttc

SEQ ID NO: 139843 - DNA, 20 bp, Artificial Sequence
  chemically synthesized
tttaaaagctgtcatactgt

SEQ ID NO: 139844 - DNA, 20 bp, Artificial Sequence
  chemically synthesized
agctggaacttacagtatga

SEQ ID NO: 139845 - DNA, 20 bp, Artificial Sequence
  chemically synthesized
ttacagtatgacagctttta

SEQ ID NO: 139846 - DNA, 20 bp, Artificial Sequence
  chemically synthesized
tacagtatgacagcttttaa

SEQ ID NO: 139847 - DNA, 20 bp, Artificial Sequence
  chemically synthesized
agtatgacagcttttaaagg

SEQ ID NO: 139848 - DNA, 20 bp, Artificial Sequence
  chemically synthesized
gaatatgtcccttcctttaa

SEQ ID NO: 139849 - DNA, 20 bp, Artificial Sequence
  chemically synthesized
gtatgacagcttttaaagga

SEQ ID NO: 139850 - DNA, 20 bp, Artificial Sequence
  chemically synthesized
tatgacagcttttaaaggaa

SEQ ID NO: 139851 - DNA, 20 bp, Artificial Sequence
  chemically synthesized
aaaggaagggacatattcta

SEQ ID NO: 139852 - DNA, 20 bp, Artificial Sequence
  chemically synthesized
aaggaagggacatattctat

SEQ ID NO: 139853 - DNA, 20 bp, Artificial Sequence
  chemically synthesized
aggaagggacatattctatg

SEQ ID NO: 139854 - DNA, 20 bp, Artificial Sequence
  chemically synthesized
gaagggacatattctatggg

SEQ ID NO: 139855 - DNA, 20 bp, Artificial Sequence
  chemically synthesized
aagggacatattctatgggg

SEQ ID NO: 139856 - DNA, 20 bp, Artificial Sequence
  chemically synthesized
tatgtctaaaatcctcccca

SEQ ID NO: 139857 - DNA, 20 bp, Artificial Sequence
  chemically synthesized
atattctatggggaggattt

SEQ ID NO: 139858 - DNA, 20 bp, Artificial Sequence
  chemically synthesized
gtacggcctagggaatagac

SEQ ID NO: 139859 - DNA, 20 bp, Artificial Sequence
  chemically synthesized
agacatacttgtctattccc

SEQ ID NO: 139860 - DNA, 20 bp, Artificial Sequence
  chemically synthesized
gacatacttgtctattccct

SEQ ID NO: 139861 - DNA, 20 bp, Artificial Sequence
  chemically synthesized
aattagtacggcctagggaa

SEQ ID NO: 139862 - DNA, 20 bp, Artificial Sequence
  chemically synthesized
ataagaattagtacggccta

SEQ ID NO: 139863 - DNA, 20 bp, Artificial Sequence
  chemically synthesized
gataagaattagtacggcct

SEQ ID NO: 139864 - DNA, 20 bp, Artificial Sequence
  chemically synthesized
tgataagaattagtacggcc

SEQ ID NO: 139865 - DNA, 20 bp, Artificial Sequence
  chemically synthesized
ttatatgataagaattagta

SEQ ID NO: 139866 - DNA, 20 bp, Artificial Sequence
  chemically synthesized
catttttatatgataagaat

SEQ ID NO: 139867 - DNA, 20 bp, Artificial Sequence
  chemically synthesized
tagacccatttttatatgat

SEQ ID NO: 139868 - DNA, 20 bp, Artificial Sequence
  chemically synthesized
taattcttatcatataaaaa

SEQ ID NO: 139869 - DNA, 20 bp, Artificial Sequence
  chemically synthesized
aattcttatcatataaaaat

SEQ ID NO: 139870 - DNA, 20 bp, Artificial Sequence
  chemically synthesized
atataaaaatgggtctacat

SEQ ID NO: 139871 - DNA, 20 bp, Artificial Sequence
  chemically synthesized
actggcaccatgtgctaatg

SEQ ID NO: 139872 - DNA, 20 bp, Artificial Sequence
  chemically synthesized
aatgggtctacattagcaca

SEQ ID NO: 139873 - DNA, 20 bp, Artificial Sequence
  chemically synthesized
tctacattagcacatggtgc

SEQ ID NO: 139874 - DNA, 20 bp, Artificial Sequence
  chemically synthesized
agtgcaagtgtgtgatatac

SEQ ID NO: 139875 - DNA, 20 bp, Artificial Sequence
  chemically synthesized
tatatcacacacttgcactg

SEQ ID NO: 139876 - DNA, 20 bp, Artificial Sequence
  chemically synthesized
ctcctttcatgccgcagtgc

SEQ ID NO: 139877 - DNA, 20 bp, Artificial Sequence
  chemically synthesized
gctgggctcctttcatgccg

SEQ ID NO: 139878 - DNA, 20 bp, Artificial Sequence
  chemically synthesized
acacttgcactgcggcatga

SEQ ID NO: 139879 - DNA, 20 bp, Artificial Sequence
  chemically synthesized
cacttgcactgcggcatgaa

SEQ ID NO: 139880 - DNA, 20 bp, Artificial Sequence
  chemically synthesized
cttgcactgcggcatgaaag

SEQ ID NO: 139881 - DNA, 20 bp, Artificial Sequence
  chemically synthesized
actgcggcatgaaaggagcc

SEQ ID NO: 139882 - DNA, 20 bp, Artificial Sequence
  chemically synthesized
gcatgaaaggagcccagctt

SEQ ID NO: 139883 - DNA, 20 bp, Artificial Sequence
  chemically synthesized
catgaaaggagcccagcttg

SEQ ID NO: 139884 - DNA, 20 bp, Artificial Sequence
  chemically synthesized
atgaaaggagcccagcttga

SEQ ID NO: 139885 - DNA, 20 bp, Artificial Sequence
  chemically synthesized
gcagttctccccctcaagct

SEQ ID NO: 139886 - DNA, 20 bp, Artificial Sequence
  chemically synthesized
tgaaaggagcccagcttgag

SEQ ID NO: 139887 - DNA, 20 bp, Artificial Sequence
  chemically synthesized
agcagttctccccctcaagc

SEQ ID NO: 139888 - DNA, 20 bp, Artificial Sequence
  chemically synthesized
gaaaggagcccagcttgagg

SEQ ID NO: 139889 - DNA, 20 bp, Artificial Sequence
  chemically synthesized
aaggagcccagcttgagggg

SEQ ID NO: 139890 - DNA, 20 bp, Artificial Sequence
  chemically synthesized
agaaagcagttctccccctc

SEQ ID NO: 139891 - DNA, 20 bp, Artificial Sequence
  chemically synthesized
agggggagaactgctttctg

SEQ ID NO: 139892 - DNA, 20 bp, Artificial Sequence
  chemically synthesized
tggaactatgccacagaaag

SEQ ID NO: 139893 - DNA, 20 bp, Artificial Sequence
  chemically synthesized
gcttggaactatgccacaga

SEQ ID NO: 139894 - DNA, 20 bp, Artificial Sequence
  chemically synthesized
gagaactgctttctgtggca

SEQ ID NO: 139895 - DNA, 20 bp, Artificial Sequence
  chemically synthesized
gtttgcttggaactatgcca

SEQ ID NO: 139896 - DNA, 20 bp, Artificial Sequence
  chemically synthesized
gctttctgtggcatagttcc

SEQ ID NO: 139897 - DNA, 20 bp, Artificial Sequence
  chemically synthesized
atttgtgccatgtgtttgct

SEQ ID NO: 139898 - DNA, 20 bp, Artificial Sequence
  chemically synthesized
catagttccaagcaaacaca

SEQ ID NO: 139899 - DNA, 20 bp, Artificial Sequence
  chemically synthesized
gcaaacacatggcacaaatg

SEQ ID NO: 139900 - DNA, 20 bp, Artificial Sequence
  chemically synthesized
gcacaaatgaagccgattct

SEQ ID NO: 139901 - DNA, 20 bp, Artificial Sequence
  chemically synthesized
cacaaatgaagccgattctg

SEQ ID NO: 139902 - DNA, 20 bp, Artificial Sequence
  chemically synthesized
gtttccatattcctcagaat

SEQ ID NO: 139903 - DNA, 20 bp, Artificial Sequence
  chemically synthesized
gaagccgattctgaggaata

SEQ ID NO: 139904 - DNA, 20 bp, Artificial Sequence
  chemically synthesized
cataaagtttccatattcct

SEQ ID NO: 139905 - DNA, 20 bp, Artificial Sequence
  chemically synthesized
tccctatcaaacagtacata

SEQ ID NO: 139906 - DNA, 20 bp, Artificial Sequence
  chemically synthesized
aaactttatgtactgtttga

SEQ ID NO: 139907 - DNA, 20 bp, Artificial Sequence
  chemically synthesized
aactttatgtactgtttgat

SEQ ID NO: 139908 - DNA, 20 bp, Artificial Sequence
  chemically synthesized
actttatgtactgtttgata

SEQ ID NO: 139909 - DNA, 20 bp, Artificial Sequence
  chemically synthesized
gtgcacatttccctatcaaa

SEQ ID NO: 139910 - DNA, 20 bp, Artificial Sequence
  chemically synthesized
gtttgatagggaaatgtgca

SEQ ID NO: 139911 - DNA, 20 bp, Artificial Sequence
  chemically synthesized
aaatgtgcacagcttctaaa

SEQ ID NO: 139912 - DNA, 20 bp, Artificial Sequence
  chemically synthesized
actagaagctcaccgtttag

SEQ ID NO: 139913 - DNA, 20 bp, Artificial Sequence
  chemically synthesized
gtgcacagcttctaaacggt

SEQ ID NO: 139914 - DNA, 20 bp, Artificial Sequence
  chemically synthesized
agaactagaagctcaccgtt

SEQ ID NO: 139915 - DNA, 20 bp, Artificial Sequence
  chemically synthesized
gcttctaaacggtgagcttc

SEQ ID NO: 139916 - DNA, 20 bp, Artificial Sequence
  chemically synthesized
tgttcttggagcagaactag

SEQ ID NO: 139917 - DNA, 20 bp, Artificial Sequence
  chemically synthesized
acttgttcttggagcagaac

SEQ ID NO: 139918 - DNA, 20 bp, Artificial Sequence
  chemically synthesized
tgagcttctagttctgctcc

SEQ ID NO: 139919 - DNA, 20 bp, Artificial Sequence
  chemically synthesized
gattgtacttgttcttggag

SEQ ID NO: 139920 - DNA, 20 bp, Artificial Sequence
  chemically synthesized
tctagttctgctccaagaac

SEQ ID NO: 139921 - DNA, 20 bp, Artificial Sequence
  chemically synthesized
attgattgtacttgttcttg

SEQ ID NO: 139922 - DNA, 20 bp, Artificial Sequence
  chemically synthesized
gaattgattgtacttgttct

SEQ ID NO: 139923 - DNA, 20 bp, Artificial Sequence
  chemically synthesized
aacaagtacaatcaattctt

SEQ ID NO: 139924 - DNA, 20 bp, Artificial Sequence
  chemically synthesized
aagtacaatcaattcttaag

SEQ ID NO: 139925 - DNA, 20 bp, Artificial Sequence
  chemically synthesized
caacattacagaaaccactt

SEQ ID NO: 139926 - DNA, 20 bp, Artificial Sequence
  chemically synthesized
cggttaggaacacaacatta

SEQ ID NO: 139927 - DNA, 20 bp, Artificial Sequence
  chemically synthesized
gtaatgttgtgttcctaacc

SEQ ID NO: 139928 - DNA, 20 bp, Artificial Sequence
  chemically synthesized
ataatgtaaacagctcggtt

SEQ ID NO: 139929 - DNA, 20 bp, Artificial Sequence
  chemically synthesized
tataatgtaaacagctcggt

SEQ ID NO: 139930 - DNA, 20 bp, Artificial Sequence
  chemically synthesized
tccctataatgtaaacagct

SEQ ID NO: 139931 - DNA, 20 bp, Artificial Sequence
  chemically synthesized
acacttccctataatgtaaa

SEQ ID NO: 139932 - DNA, 20 bp, Artificial Sequence
  chemically synthesized
taaccgagctgtttacatta

SEQ ID NO: 139933 - DNA, 20 bp, Artificial Sequence
  chemically synthesized
aaccgagctgtttacattat

SEQ ID NO: 139934 - DNA, 20 bp, Artificial Sequence
  chemically synthesized
accgagctgtttacattata

SEQ ID NO: 139935 - DNA, 20 bp, Artificial Sequence
  chemically synthesized
gagctgtttacattataggg

SEQ ID NO: 139936 - DNA, 20 bp, Artificial Sequence
  chemically synthesized
ttacattatagggaagtgtt

SEQ ID NO: 139937 - DNA, 20 bp, Artificial Sequence
  chemically synthesized
agtttaattttctgttttat

SEQ ID NO: 139938 - DNA, 20 bp, Artificial Sequence
  chemically synthesized
gtttaattttctgttttatt

SEQ ID NO: 139939 - DNA, 20 bp, Artificial Sequence
  chemically synthesized
gagaaacctgcctaataaaa

SEQ ID NO: 139940 - DNA, 20 bp, Artificial Sequence
  chemically synthesized
taattttctgttttattagg

SEQ ID NO: 139941 - DNA, 20 bp, Artificial Sequence
  chemically synthesized
aattttctgttttattaggc

SEQ ID NO: 139942 - DNA, 20 bp, Artificial Sequence
  chemically synthesized
ttgaaattattgttcataat

SEQ ID NO: 139943 - DNA, 20 bp, Artificial Sequence
  chemically synthesized
caataatttcaatacctttt

SEQ ID NO: 139944 - DNA, 20 bp, Artificial Sequence
  chemically synthesized
ttatttttaaattacttaaa

SEQ ID NO: 139945 - DNA, 20 bp, Artificial Sequence
  chemically synthesized
cttatttttaaattacttaa

SEQ ID NO: 139946 - DNA, 20 bp, Artificial Sequence
  chemically synthesized
cttttaagtaatttaaaaat

SEQ ID NO: 139947 - DNA, 20 bp, Artificial Sequence
  chemically synthesized
ttaagtaatttaaaaataag

SEQ ID NO: 139948 - DNA, 20 bp, Artificial Sequence
  chemically synthesized
aaaataagcagtaatccctg

SEQ ID NO: 139949 - DNA, 20 bp, Artificial Sequence
  chemically synthesized
taagcagtaatccctgcaga

SEQ ID NO: 139950 - DNA, 20 bp, Artificial Sequence
  chemically synthesized
aagcagtaatccctgcagaa

SEQ ID NO: 139951 - DNA, 20 bp, Artificial Sequence
  chemically synthesized
ggtactgcagcctttctgca

SEQ ID NO: 139952 - DNA, 20 bp, Artificial Sequence
  chemically synthesized
tggtactgcagcctttctgc

SEQ ID NO: 139953 - DNA, 20 bp, Artificial Sequence
  chemically synthesized
atggtactgcagcctttctg

SEQ ID NO: 139954 - DNA, 20 bp, Artificial Sequence
  chemically synthesized
taatccctgcagaaaggctg

SEQ ID NO: 139955 - DNA, 20 bp, Artificial Sequence
  chemically synthesized
tcactagagaaatggtactg

SEQ ID NO: 139956 - DNA, 20 bp, Artificial Sequence
  chemically synthesized
aggctgcagtaccatttctc

SEQ ID NO: 139957 - DNA, 20 bp, Artificial Sequence
  chemically synthesized
aaaaggaatcactagagaaa

SEQ ID NO: 139958 - DNA, 20 bp, Artificial Sequence
  chemically synthesized
cacagaaaaaggaatcacta

SEQ ID NO: 139959 - DNA, 20 bp, Artificial Sequence
  chemically synthesized
aacacagaaaaaggaatcac

SEQ ID NO: 139960 - DNA, 20 bp, Artificial Sequence
  chemically synthesized
tacaaataaaacacagaaaa

SEQ ID NO: 139961 - DNA, 20 bp, Artificial Sequence
  chemically synthesized
atacaaataaaacacagaaa

SEQ ID NO: 139962 - DNA, 20 bp, Artificial Sequence
  chemically synthesized
caccttatacaaataaaaca

SEQ ID NO: 139963 - DNA, 20 bp, Artificial Sequence
  chemically synthesized
tttctgtgttttatttgtat

SEQ ID NO: 139964 - DNA, 20 bp, Artificial Sequence
  chemically synthesized
ttctgtgttttatttgtata

SEQ ID NO: 139965 - DNA, 20 bp, Artificial Sequence
  chemically synthesized
gtgttttatttgtataaggt

SEQ ID NO: 139966 - DNA, 20 bp, Artificial Sequence
  chemically synthesized
tctctgaggcaacaaagaat

SEQ ID NO: 139967 - DNA, 20 bp, Artificial Sequence
  chemically synthesized
ctaaagtctctgaggcaaca

SEQ ID NO: 139968 - DNA, 20 bp, Artificial Sequence
  chemically synthesized
ttgcttattctttgttgcct

SEQ ID NO: 139969 - DNA, 20 bp, Artificial Sequence
  chemically synthesized
gcttattctttgttgcctca

SEQ ID NO: 139970 - DNA, 20 bp, Artificial Sequence
  chemically synthesized
tcatgccactaaagtctctg

SEQ ID NO: 139971 - DNA, 20 bp, Artificial Sequence
  chemically synthesized
ctcatgccactaaagtctct

SEQ ID NO: 139972 - DNA, 20 bp, Artificial Sequence
  chemically synthesized
ctttgttgcctcagagactt

SEQ ID NO: 139973 - DNA, 20 bp, Artificial Sequence
  chemically synthesized
tgttgcctcagagactttag

SEQ ID NO: 139974 - DNA, 20 bp, Artificial Sequence
  chemically synthesized
tgcctagcctcatgccacta

SEQ ID NO: 139975 - DNA, 20 bp, Artificial Sequence
  chemically synthesized
ctcagagactttagtggcat

SEQ ID NO: 139976 - DNA, 20 bp, Artificial Sequence
  chemically synthesized
tcagagactttagtggcatg

SEQ ID NO: 139977 - DNA, 20 bp, Artificial Sequence
  chemically synthesized
agactttagtggcatgaggc

SEQ ID NO: 139978 - DNA, 20 bp, Artificial Sequence
  chemically synthesized
gactttagtggcatgaggct

SEQ ID NO: 139979 - DNA, 20 bp, Artificial Sequence
  chemically synthesized
tttagtggcatgaggctagg

SEQ ID NO: 139980 - DNA, 20 bp, Artificial Sequence
  chemically synthesized
tagtggcatgaggctaggca

SEQ ID NO: 139981 - DNA, 20 bp, Artificial Sequence
  chemically synthesized
tatcagtttttgtctctgcc

SEQ ID NO: 139982 - DNA, 20 bp, Artificial Sequence
  chemically synthesized
gttgatttatttatgattat

SEQ ID NO: 139983 - DNA, 20 bp, Artificial Sequence
  chemically synthesized
cataaataaatcaacactat

SEQ ID NO: 139984 - DNA, 20 bp, Artificial Sequence
  chemically synthesized
ataaataaatcaacactatt

SEQ ID NO: 139985 - DNA, 20 bp, Artificial Sequence
  chemically synthesized
aataaatcaacactattggg

SEQ ID NO: 139986 - DNA, 20 bp, Artificial Sequence
  chemically synthesized
tggatattggaaccacccaa

SEQ ID NO: 139987 - DNA, 20 bp, Artificial Sequence
  chemically synthesized
tattgggtggttccaatatc

SEQ ID NO: 139988 - DNA, 20 bp, Artificial Sequence
  chemically synthesized
aacattgagatactggatat

SEQ ID NO: 139989 - DNA, 20 bp, Artificial Sequence
  chemically synthesized
ggcagagaacattgagatac

SEQ ID NO: 139990 - DNA, 20 bp, Artificial Sequence
  chemically synthesized
gacaaagggcagagaacatt

SEQ ID NO: 139991 - DNA, 20 bp, Artificial Sequence
  chemically synthesized
gcagaaagagacaaagggca

SEQ ID NO: 139992 - DNA, 20 bp, Artificial Sequence
  chemically synthesized
tagcagaaagagacaaaggg

SEQ ID NO: 139993 - DNA, 20 bp, Artificial Sequence
  chemically synthesized
atatagcagaaagagacaaa

SEQ ID NO: 139994 - DNA, 20 bp, Artificial Sequence
  chemically synthesized
aatatagcagaaagagacaa

SEQ ID NO: 139995 - DNA, 20 bp, Artificial Sequence
  chemically synthesized
taatatagcagaaagagaca

SEQ ID NO: 139996 - DNA, 20 bp, Artificial Sequence
  chemically synthesized
gatcattaatatagcagaaa

SEQ ID NO: 139997 - DNA, 20 bp, Artificial Sequence
  chemically synthesized
cagatcattaatatagcaga

SEQ ID NO: 139998 - DNA, 20 bp, Artificial Sequence
  chemically synthesized
aagacagatcattaatatag

SEQ ID NO: 139999 - DNA, 20 bp, Artificial Sequence
  chemically synthesized
attaagacagatcattaata

SEQ ID NO: 140000 - DNA, 20 bp, Artificial Sequence
  chemically synthesized
gaaaacttgtaaaattaaga

SEQ ID NO: 140001 - DNA, 20 bp, Artificial Sequence
  chemically synthesized
tacagaaaacttgtaaaatt

SEQ ID NO: 140002 - DNA, 20 bp, Artificial Sequence
  chemically synthesized
atgatctgtcttaattttac

SEQ ID NO: 140003 - DNA, 20 bp, Artificial Sequence
  chemically synthesized
taattttacaagttttctgt

SEQ ID NO: 140004 - DNA, 20 bp, Artificial Sequence
  chemically synthesized
tttacaagttttctgtaaga

SEQ ID NO: 140005 - DNA, 20 bp, Artificial Sequence
  chemically synthesized
ctattctgtctactatctta

SEQ ID NO: 140006 - DNA, 20 bp, Artificial Sequence
  chemically synthesized
acaagttttctgtaagatag

SEQ ID NO: 140007 - DNA, 20 bp, Artificial Sequence
  chemically synthesized
gttttctgtaagatagtaga

SEQ ID NO: 140008 - DNA, 20 bp, Artificial Sequence
  chemically synthesized
ctgtaagatagtagacagaa

SEQ ID NO: 140009 - DNA, 20 bp, Artificial Sequence
  chemically synthesized
tgtaagatagtagacagaat

SEQ ID NO: 140010 - DNA, 20 bp, Artificial Sequence
  chemically synthesized
tagacagaataggtgttact

SEQ ID NO: 140011 - DNA, 20 bp, Artificial Sequence
  chemically synthesized
agacagaataggtgttactg

SEQ ID NO: 140012 - DNA, 20 bp, Artificial Sequence
  chemically synthesized
gaataggtgttactgaggtg

SEQ ID NO: 140013 - DNA, 20 bp, Artificial Sequence
  chemically synthesized
aataggtgttactgaggtga

SEQ ID NO: 140014 - DNA, 20 bp, Artificial Sequence
  chemically synthesized
ttggattgaagccttcacct

SEQ ID NO: 140015 - DNA, 20 bp, Artificial Sequence
  chemically synthesized
tagttttgtagtttggattg

SEQ ID NO: 140016 - DNA, 20 bp, Artificial Sequence
  chemically synthesized
ggctacctagttttgtagtt

SEQ ID NO: 140017 - DNA, 20 bp, Artificial Sequence
  chemically synthesized
ttcaatccaaactacaaaac

SEQ ID NO: 140018 - DNA, 20 bp, Artificial Sequence
  chemically synthesized
tcaatccaaactacaaaact

SEQ ID NO: 140019 - DNA, 20 bp, Artificial Sequence
  chemically synthesized
ctctaggctacctagttttg

SEQ ID NO: 140020 - DNA, 20 bp, Artificial Sequence
  chemically synthesized
atccaaactacaaaactagg

SEQ ID NO: 140021 - DNA, 20 bp, Artificial Sequence
  chemically synthesized
aactacaaaactaggtagcc

SEQ ID NO: 140022 - DNA, 20 bp, Artificial Sequence
  chemically synthesized
gctgttgcctctaggctacc

SEQ ID NO: 140023 - DNA, 20 bp, Artificial Sequence
  chemically synthesized
ctacaaaactaggtagccta

SEQ ID NO: 140024 - DNA, 20 bp, Artificial Sequence
  chemically synthesized
tacaaaactaggtagcctag

SEQ ID NO: 140025 - DNA, 20 bp, Artificial Sequence
  chemically synthesized
tggaattagctgttgcctct

SEQ ID NO: 140026 - DNA, 20 bp, Artificial Sequence
  chemically synthesized
actaggtagcctagaggcaa

SEQ ID NO: 140027 - DNA, 20 bp, Artificial Sequence
  chemically synthesized
atggaattagctgttgcctc

SEQ ID NO: 140028 - DNA, 20 bp, Artificial Sequence
  chemically synthesized
gtgaaccaaaagcatggaat

SEQ ID NO: 140029 - DNA, 20 bp, Artificial Sequence
  chemically synthesized
aacagctaattccatgcttt

SEQ ID NO: 140030 - DNA, 20 bp, Artificial Sequence
  chemically synthesized
tcctttgtgaaccaaaagca

SEQ ID NO: 140031 - DNA, 20 bp, Artificial Sequence
  chemically synthesized
agcattcctttgtgaaccaa

SEQ ID NO: 140032 - DNA, 20 bp, Artificial Sequence
  chemically synthesized
ttccatgcttttggttcaca

SEQ ID NO: 140033 - DNA, 20 bp, Artificial Sequence
  chemically synthesized
tccatgcttttggttcacaa

SEQ ID NO: 140034 - DNA, 20 bp, Artificial Sequence
  chemically synthesized
ttgttattacttgtgtgtat

SEQ ID NO: 140035 - DNA, 20 bp, Artificial Sequence
  chemically synthesized
aaaggaatgctaatacacac

SEQ ID NO: 140036 - DNA, 20 bp, Artificial Sequence
  chemically synthesized
gtaataacaaaacaaactca

SEQ ID NO: 140037 - DNA, 20 bp, Artificial Sequence
  chemically synthesized
ttcagtagcacatgtactgt

SEQ ID NO: 140038 - DNA, 20 bp, Artificial Sequence
  chemically synthesized
tcacagtacatgtgctactg

SEQ ID NO: 140039 - DNA, 20 bp, Artificial Sequence
  chemically synthesized
acagtacatgtgctactgaa

SEQ ID NO: 140040 - DNA, 20 bp, Artificial Sequence
  chemically synthesized
cagtacatgtgctactgaag

SEQ ID NO: 140041 - DNA, 20 bp, Artificial Sequence
  chemically synthesized
tgctcccaacacctcttcag

SEQ ID NO: 140042 - DNA, 20 bp, Artificial Sequence
  chemically synthesized
taatgctcccaacacctctt

SEQ ID NO: 140043 - DNA, 20 bp, Artificial Sequence
  chemically synthesized
atgtgctactgaagaggtgt

SEQ ID NO: 140044 - DNA, 20 bp, Artificial Sequence
  chemically synthesized
tgtgctactgaagaggtgtt

SEQ ID NO: 140045 - DNA, 20 bp, Artificial Sequence
  chemically synthesized
tgctactgaagaggtgttgg

SEQ ID NO: 140046 - DNA, 20 bp, Artificial Sequence
  chemically synthesized
gagcattaaatattcgtaca

SEQ ID NO: 140047 - DNA, 20 bp, Artificial Sequence
  chemically synthesized
agcattaaatattcgtacaa

SEQ ID NO: 140048 - DNA, 20 bp, Artificial Sequence
  chemically synthesized
gcattaaatattcgtacaaa

SEQ ID NO: 140049 - DNA, 20 bp, Artificial Sequence
  chemically synthesized
ttaaatattcgtacaaaggg

SEQ ID NO: 140050 - DNA, 20 bp, Artificial Sequence
  chemically synthesized
gtacaaagggcagcacaaaa

SEQ ID NO: 140051 - DNA, 20 bp, Artificial Sequence
  chemically synthesized
tacaaagggcagcacaaaat

SEQ ID NO: 140052 - DNA, 20 bp, Artificial Sequence
  chemically synthesized
caaagggcagcacaaaatgg

SEQ ID NO: 140053 - DNA, 20 bp, Artificial Sequence
  chemically synthesized
aaagggcagcacaaaatggg

SEQ ID NO: 140054 - DNA, 20 bp, Artificial Sequence
  chemically synthesized
aaatgggaggttaaaaaatt

SEQ ID NO: 140055 - DNA, 20 bp, Artificial Sequence
  chemically synthesized
gttaaaaaattaagcaacat

SEQ ID NO: 140056 - DNA, 20 bp, Artificial Sequence
  chemically synthesized
ttaaaaaattaagcaacatt

SEQ ID NO: 140057 - DNA, 20 bp, Artificial Sequence
  chemically synthesized
ttaagcaacattaggaacct

SEQ ID NO: 140058 - DNA, 20 bp, Artificial Sequence
  chemically synthesized
aagcaacattaggaacctga

SEQ ID NO: 140059 - DNA, 20 bp, Artificial Sequence
  chemically synthesized
gttaattagttgcatctctc

SEQ ID NO: 140060 - DNA, 20 bp, Artificial Sequence
  chemically synthesized
ggttaattagttgcatctct

SEQ ID NO: 140061 - DNA, 20 bp, Artificial Sequence
  chemically synthesized
gagagatgcaactaattaac

SEQ ID NO: 140062 - DNA, 20 bp, Artificial Sequence
  chemically synthesized
ttaaggccaaactggttaat

SEQ ID NO: 140063 - DNA, 20 bp, Artificial Sequence
  chemically synthesized
atgcaactaattaaccagtt

SEQ ID NO: 140064 - DNA, 20 bp, Artificial Sequence
  chemically synthesized
gatatttattaaggccaaac

SEQ ID NO: 140065 - DNA, 20 bp, Artificial Sequence
  chemically synthesized
tacagcatggatatttatta

SEQ ID NO: 140066 - DNA, 20 bp, Artificial Sequence
  chemically synthesized
ttacagcatggatatttatt

SEQ ID NO: 140067 - DNA, 20 bp, Artificial Sequence
  chemically synthesized
actattaaaatattacagca

SEQ ID NO: 140068 - DNA, 20 bp, Artificial Sequence
  chemically synthesized
atattactattaaaatatta

SEQ ID NO: 140069 - DNA, 20 bp, Artificial Sequence
  chemically synthesized
tccatgctgtaatattttaa

SEQ ID NO: 140070 - DNA, 20 bp, Artificial Sequence
  chemically synthesized
aaatggatagatattagggg

SEQ ID NO: 140071 - DNA, 20 bp, Artificial Sequence
  chemically synthesized
cataaatggatagatattag

SEQ ID NO: 140072 - DNA, 20 bp, Artificial Sequence
  chemically synthesized
acataaatggatagatatta

SEQ ID NO: 140073 - DNA, 20 bp, Artificial Sequence
  chemically synthesized
tacataaatggatagatatt

SEQ ID NO: 140074 - DNA, 20 bp, Artificial Sequence
  chemically synthesized
ttacataaatggatagatat

SEQ ID NO: 140075 - DNA, 20 bp, Artificial Sequence
  chemically synthesized
gggaatattacataaatgga

SEQ ID NO: 140076 - DNA, 20 bp, Artificial Sequence
  chemically synthesized
aatggggaatattacataaa

SEQ ID NO: 140077 - DNA, 20 bp, Artificial Sequence
  chemically synthesized
catttgagtagatagtaatg

SEQ ID NO: 140078 - DNA, 20 bp, Artificial Sequence
  chemically synthesized
acatttgagtagatagtaat

SEQ ID NO: 140079 - DNA, 20 bp, Artificial Sequence
  chemically synthesized
aacatttgagtagatagtaa

SEQ ID NO: 140080 - DNA, 20 bp, Artificial Sequence
  chemically synthesized
tagcagaacatttgagtaga

SEQ ID NO: 140081 - DNA, 20 bp, Artificial Sequence
  chemically synthesized
agtgtagcagaacatttgag

SEQ ID NO: 140082 - DNA, 20 bp, Artificial Sequence
  chemically synthesized
gaaagtgtagcagaacattt

SEQ ID NO: 140083 - DNA, 20 bp, Artificial Sequence
  chemically synthesized
acctttacgagaaagtgtag

SEQ ID NO: 140084 - DNA, 20 bp, Artificial Sequence
  chemically synthesized
ctgacctttacgagaaagtg

SEQ ID NO: 140085 - DNA, 20 bp, Artificial Sequence
  chemically synthesized
ttctgctacactttctcgta

SEQ ID NO: 140086 - DNA, 20 bp, Artificial Sequence
  chemically synthesized
agtcactgacctttacgaga

SEQ ID NO: 140087 - DNA, 20 bp, Artificial Sequence
  chemically synthesized
tctgctacactttctcgtaa

SEQ ID NO: 140088 - DNA, 20 bp, Artificial Sequence
  chemically synthesized
ggagagtcactgacctttac

SEQ ID NO: 140089 - DNA, 20 bp, Artificial Sequence
  chemically synthesized
ctacactttctcgtaaaggt

SEQ ID NO: 140090 - DNA, 20 bp, Artificial Sequence
  chemically synthesized
ttgaattgtaaggcagtgga

SEQ ID NO: 140091 - DNA, 20 bp, Artificial Sequence
  chemically synthesized
gtttgaattgtaaggcagtg

SEQ ID NO: 140092 - DNA, 20 bp, Artificial Sequence
  chemically synthesized
gagtttgaattgtaaggcag

SEQ ID NO: 140093 - DNA, 20 bp, Artificial Sequence
  chemically synthesized
taggagtttgaattgtaagg

SEQ ID NO: 140094 - DNA, 20 bp, Artificial Sequence
  chemically synthesized
ctgtaggagtttgaattgta

SEQ ID NO: 140095 - DNA, 20 bp, Artificial Sequence
  chemically synthesized
gctgtaggagtttgaattgt

SEQ ID NO: 140096 - DNA, 20 bp, Artificial Sequence
  chemically synthesized
ccttacaattcaaactccta

SEQ ID NO: 140097 - DNA, 20 bp, Artificial Sequence
  chemically synthesized
tagtaattgctacgctgtag

SEQ ID NO: 140098 - DNA, 20 bp, Artificial Sequence
  chemically synthesized
caattcaaactcctacagcg

SEQ ID NO: 140099 - DNA, 20 bp, Artificial Sequence
  chemically synthesized
tgtagtaattgctacgctgt

SEQ ID NO: 140100 - DNA, 20 bp, Artificial Sequence
  chemically synthesized
ttgtagtaattgctacgctg

SEQ ID NO: 140101 - DNA, 20 bp, Artificial Sequence
  chemically synthesized
agcgtagcaattactacaac

SEQ ID NO: 140102 - DNA, 20 bp, Artificial Sequence
  chemically synthesized
cgtagcaattactacaacaa

SEQ ID NO: 140103 - DNA, 20 bp, Artificial Sequence
  chemically synthesized
actagttattactcttgttg

SEQ ID NO: 140104 - DNA, 20 bp, Artificial Sequence
  chemically synthesized
actacaacaagagtaataac

SEQ ID NO: 140105 - DNA, 20 bp, Artificial Sequence
  chemically synthesized
cataggaaaagcacaataac

SEQ ID NO: 140106 - DNA, 20 bp, Artificial Sequence
  chemically synthesized
caatatctagcacataggaa

SEQ ID NO: 140107 - DNA, 20 bp, Artificial Sequence
  chemically synthesized
attgtgcttttcctatgtgc

SEQ ID NO: 140108 - DNA, 20 bp, Artificial Sequence
  chemically synthesized
atgtgcaatatctagcacat

SEQ ID NO: 140109 - DNA, 20 bp, Artificial Sequence
  chemically synthesized
catgtgcaatatctagcaca

SEQ ID NO: 140110 - DNA, 20 bp, Artificial Sequence
  chemically synthesized
tccatcccatgtgcaatatc

SEQ ID NO: 140111 - DNA, 20 bp, Artificial Sequence
  chemically synthesized
tatgtgctagatattgcaca

SEQ ID NO: 140112 - DNA, 20 bp, Artificial Sequence
  chemically synthesized
atgtgctagatattgcacat

SEQ ID NO: 140113 - DNA, 20 bp, Artificial Sequence
  chemically synthesized
gctagatattgcacatggga

SEQ ID NO: 140114 - DNA, 20 bp, Artificial Sequence
  chemically synthesized
tttgatttgtaattatgtgc

SEQ ID NO: 140115 - DNA, 20 bp, Artificial Sequence
  chemically synthesized
cttttcctatgtacaatatc

SEQ ID NO: 140116 - DNA, 20 bp, Artificial Sequence
  chemically synthesized
tatgtgctagatattgtaca

SEQ ID NO: 140117 - DNA, 20 bp, Artificial Sequence
  chemically synthesized
atgtgctagatattgtacat

SEQ ID NO: 140118 - DNA, 20 bp, Artificial Sequence
  chemically synthesized
ctagatattgtacataggaa

SEQ ID NO: 140119 - DNA, 20 bp, Artificial Sequence
  chemically synthesized
gcacaatatatattaactta

SEQ ID NO: 140120 - DNA, 20 bp, Artificial Sequence
  chemically synthesized
ctacctcaaatggtgtctgt

SEQ ID NO: 140121 - DNA, 20 bp, Artificial Sequence
  chemically synthesized
ttaacttacagacaccattt

SEQ ID NO: 140122 - DNA, 20 bp, Artificial Sequence
  chemically synthesized
taacttacagacaccatttg

SEQ ID NO: 140123 - DNA, 20 bp, Artificial Sequence
  chemically synthesized
cttacagacaccatttgagg

SEQ ID NO: 140124 - DNA, 20 bp, Artificial Sequence
  chemically synthesized
cattattaacctacctcaaa

SEQ ID NO: 140125 - DNA, 20 bp, Artificial Sequence
  chemically synthesized
ttacagacaccatttgaggt

SEQ ID NO: 140126 - DNA, 20 bp, Artificial Sequence
  chemically synthesized
agtacagaaccattgagggg

SEQ ID NO: 140127 - DNA, 20 bp, Artificial Sequence
  chemically synthesized
taataatgaccacccctcaa

SEQ ID NO: 140128 - DNA, 20 bp, Artificial Sequence
  chemically synthesized
gtaagtacagaaccattgag

SEQ ID NO: 140129 - DNA, 20 bp, Artificial Sequence
  chemically synthesized
tgtaagtacagaaccattga

SEQ ID NO: 140130 - DNA, 20 bp, Artificial Sequence
  chemically synthesized
gtgtaagtacagaaccattg

SEQ ID NO: 140131 - DNA, 20 bp, Artificial Sequence
  chemically synthesized
ggtgtaagtacagaaccatt

SEQ ID NO: 140132 - DNA, 20 bp, Artificial Sequence
  chemically synthesized
tctataaaagggtgtaagta

SEQ ID NO: 140133 - DNA, 20 bp, Artificial Sequence
  chemically synthesized
ccttgtctataaaagggtgt

SEQ ID NO: 140134 - DNA, 20 bp, Artificial Sequence
  chemically synthesized
tctgtacttacaccctttta

SEQ ID NO: 140135 - DNA, 20 bp, Artificial Sequence
  chemically synthesized
cattttccttgtctataaaa

SEQ ID NO: 140136 - DNA, 20 bp, Artificial Sequence
  chemically synthesized
tcattttccttgtctataaa

SEQ ID NO: 140137 - DNA, 20 bp, Artificial Sequence
  chemically synthesized
ttcattttccttgtctataa

SEQ ID NO: 140138 - DNA, 20 bp, Artificial Sequence
  chemically synthesized
acttacacccttttatagac

SEQ ID NO: 140139 - DNA, 20 bp, Artificial Sequence
  chemically synthesized
cttacacccttttatagaca

SEQ ID NO: 140140 - DNA, 20 bp, Artificial Sequence
  chemically synthesized
ttttatagacaaggaaaatg

SEQ ID NO: 140141 - DNA, 20 bp, Artificial Sequence
  chemically synthesized
tagacaaggaaaatgaagca

SEQ ID NO: 140142 - DNA, 20 bp, Artificial Sequence
  chemically synthesized
ggaaaatgaagcacggaatg

SEQ ID NO: 140143 - DNA, 20 bp, Artificial Sequence
  chemically synthesized
gaatgaagcataatttgccc

SEQ ID NO: 140144 - DNA, 20 bp, Artificial Sequence
  chemically synthesized
aatgaagcataatttgccca

SEQ ID NO: 140145 - DNA, 20 bp, Artificial Sequence
  chemically synthesized
ccttttagcttggtgacctt

SEQ ID NO: 140146 - DNA, 20 bp, Artificial Sequence
  chemically synthesized
accttttagcttggtgacct

SEQ ID NO: 140147 - DNA, 20 bp, Artificial Sequence
  chemically synthesized
ataatttgcccaaggtcacc

SEQ ID NO: 140148 - DNA, 20 bp, Artificial Sequence
  chemically synthesized
gcccaaggtcaccaagctaa

SEQ ID NO: 140149 - DNA, 20 bp, Artificial Sequence
  chemically synthesized
cccaaggtcaccaagctaaa

SEQ ID NO: 140150 - DNA, 20 bp, Artificial Sequence
  chemically synthesized
accttcaccaccttttagct

SEQ ID NO: 140151 - DNA, 20 bp, Artificial Sequence
  chemically synthesized
aaggtcaccaagctaaaagg

SEQ ID NO: 140152 - DNA, 20 bp, Artificial Sequence
  chemically synthesized
attccaccttcaccaccttt

SEQ ID NO: 140153 - DNA, 20 bp, Artificial Sequence
  chemically synthesized
caccaagctaaaaggtggtg

SEQ ID NO: 140154 - DNA, 20 bp, Artificial Sequence
  chemically synthesized
accaagctaaaaggtggtga

SEQ ID NO: 140155 - DNA, 20 bp, Artificial Sequence
  chemically synthesized
aagctaaaaggtggtgaagg

SEQ ID NO: 140156 - DNA, 20 bp, Artificial Sequence
  chemically synthesized
gtggtgaaggtggaataaaa

SEQ ID NO: 140157 - DNA, 20 bp, Artificial Sequence
  chemically synthesized
acactggaaaaggaggatat

SEQ ID NO: 140158 - DNA, 20 bp, Artificial Sequence
  chemically synthesized
aacactggaaaaggaggata

SEQ ID NO: 140159 - DNA, 20 bp, Artificial Sequence
  chemically synthesized
tggcccatatcctccttttc

SEQ ID NO: 140160 - DNA, 20 bp, Artificial Sequence
  chemically synthesized
gagaaaaacactggaaaagg

SEQ ID NO: 140161 - DNA, 20 bp, Artificial Sequence
  chemically synthesized
agagaaaaacactggaaaag

SEQ ID NO: 140162 - DNA, 20 bp, Artificial Sequence
  chemically synthesized
aaagagaaaaacactggaaa

SEQ ID NO: 140163 - DNA, 20 bp, Artificial Sequence
  chemically synthesized
aaaagagaaaaacactggaa

SEQ ID NO: 140164 - DNA, 20 bp, Artificial Sequence
  chemically synthesized
gatgtaaaagagaaaaacac

SEQ ID NO: 140165 - DNA, 20 bp, Artificial Sequence
  chemically synthesized
attgtagttacgatgtaaaa

SEQ ID NO: 140166 - DNA, 20 bp, Artificial Sequence
  chemically synthesized
aaattgtagttacgatgtaa

SEQ ID NO: 140167 - DNA, 20 bp, Artificial Sequence
  chemically synthesized
tatagctgcttacgaaattg

SEQ ID NO: 140168 - DNA, 20 bp, Artificial Sequence
  chemically synthesized
catcgtaactacaatttcgt

SEQ ID NO: 140169 - DNA, 20 bp, Artificial Sequence
  chemically synthesized
cgtaactacaatttcgtaag

SEQ ID NO: 140170 - DNA, 20 bp, Artificial Sequence
  chemically synthesized
tttcgtaagcagctataatg

SEQ ID NO: 140171 - DNA, 20 bp, Artificial Sequence
  chemically synthesized
gcccagcttcggctacatta

SEQ ID NO: 140172 - DNA, 20 bp, Artificial Sequence
  chemically synthesized
aagcagctataatgtagccg

SEQ ID NO: 140173 - DNA, 20 bp, Artificial Sequence
  chemically synthesized
agctataatgtagccgaagc

SEQ ID NO: 140174 - DNA, 20 bp, Artificial Sequence
  chemically synthesized
gctataatgtagccgaagct

SEQ ID NO: 140175 - DNA, 20 bp, Artificial Sequence
  chemically synthesized
taaagcatctagcccagctt

SEQ ID NO: 140176 - DNA, 20 bp, Artificial Sequence
  chemically synthesized
taatgtagccgaagctgggc

SEQ ID NO: 140177 - DNA, 20 bp, Artificial Sequence
  chemically synthesized
tgactataaagcatctagcc

SEQ ID NO: 140178 - DNA, 20 bp, Artificial Sequence
  chemically synthesized
aatgatgactataaagcatc

SEQ ID NO: 140179 - DNA, 20 bp, Artificial Sequence
  chemically synthesized
aagctgggctagatgcttta

SEQ ID NO: 140180 - DNA, 20 bp, Artificial Sequence
  chemically synthesized
gggattaaatgatgactata

SEQ ID NO: 140181 - DNA, 20 bp, Artificial Sequence
  chemically synthesized
agctaggtagagttgttgtt

SEQ ID NO: 140182 - DNA, 20 bp, Artificial Sequence
  chemically synthesized
cagctaggtagagttgttgt

SEQ ID NO: 140183 - DNA, 20 bp, Artificial Sequence
  chemically synthesized
atcccaacaacaactctacc

SEQ ID NO: 140184 - DNA, 20 bp, Artificial Sequence
  chemically synthesized
atatagtacccagctaggta

SEQ ID NO: 140185 - DNA, 20 bp, Artificial Sequence
  chemically synthesized
caacaacaactctacctagc

SEQ ID NO: 140186 - DNA, 20 bp, Artificial Sequence
  chemically synthesized
aacaacaactctacctagct

SEQ ID NO: 140187 - DNA, 20 bp, Artificial Sequence
  chemically synthesized
gaatatagtacccagctagg

SEQ ID NO: 140188 - DNA, 20 bp, Artificial Sequence
  chemically synthesized
aatgaatatagtacccagct

SEQ ID NO: 140189 - DNA, 20 bp, Artificial Sequence
  chemically synthesized
aaatgaatatagtacccagc

SEQ ID NO: 140190 - DNA, 20 bp, Artificial Sequence
  chemically synthesized
aaaaaaatgaatatagtacc

SEQ ID NO: 140191 - DNA, 20 bp, Artificial Sequence
  chemically synthesized
catgtgtaaaaaaatgaata

SEQ ID NO: 140192 - DNA, 20 bp, Artificial Sequence
  chemically synthesized
atattcatttttttacacat

SEQ ID NO: 140193 - DNA, 20 bp, Artificial Sequence
  chemically synthesized
tattcatttttttacacatg

SEQ ID NO: 140194 - DNA, 20 bp, Artificial Sequence
  chemically synthesized
ttttttacacatgaggaaat

SEQ ID NO: 140195 - DNA, 20 bp, Artificial Sequence
  chemically synthesized
tacacatgaggaaataagca

SEQ ID NO: 140196 - DNA, 20 bp, Artificial Sequence
  chemically synthesized
atgaggaaataagcacagaa

SEQ ID NO: 140197 - DNA, 20 bp, Artificial Sequence
  chemically synthesized
ctggctgtctttggggaagt

SEQ ID NO: 140198 - DNA, 20 bp, Artificial Sequence
  chemically synthesized
aaagattaccaacttcccca

SEQ ID NO: 140199 - DNA, 20 bp, Artificial Sequence
  chemically synthesized
ctggctggctgtctttgggg

SEQ ID NO: 140200 - DNA, 20 bp, Artificial Sequence
  chemically synthesized
attaccaacttccccaaaga

SEQ ID NO: 140201 - DNA, 20 bp, Artificial Sequence
  chemically synthesized
taactggctggctgtctttg

SEQ ID NO: 140202 - DNA, 20 bp, Artificial Sequence
  chemically synthesized
ctaactggctggctgtcttt

SEQ ID NO: 140203 - DNA, 20 bp, Artificial Sequence
  chemically synthesized
cctaactggctggctgtctt

SEQ ID NO: 140204 - DNA, 20 bp, Artificial Sequence
  chemically synthesized
ccaacttccccaaagacagc

SEQ ID NO: 140205 - DNA, 20 bp, Artificial Sequence
  chemically synthesized
cttccccaaagacagccagc

SEQ ID NO: 140206 - DNA, 20 bp, Artificial Sequence
  chemically synthesized
cccaaagacagccagccagt

SEQ ID NO: 140207 - DNA, 20 bp, Artificial Sequence
  chemically synthesized
ccaaagacagccagccagtt

SEQ ID NO: 140208 - DNA, 20 bp, Artificial Sequence
  chemically synthesized
ctatcctgatcctaactggc

SEQ ID NO: 140209 - DNA, 20 bp, Artificial Sequence
  chemically synthesized
aatgctatcctgatcctaac

SEQ ID NO: 140210 - DNA, 20 bp, Artificial Sequence
  chemically synthesized
gacagccagccagttaggat

SEQ ID NO: 140211 - DNA, 20 bp, Artificial Sequence
  chemically synthesized
acagccagccagttaggatc

SEQ ID NO: 140212 - DNA, 20 bp, Artificial Sequence
  chemically synthesized
ccagccagttaggatcagga

SEQ ID NO: 140213 - DNA, 20 bp, Artificial Sequence
  chemically synthesized
aatctcaaaataattaaaaa

SEQ ID NO: 140214 - DNA, 20 bp, Artificial Sequence
  chemically synthesized
tttctttttttaattatttt

SEQ ID NO: 140215 - DNA, 20 bp, Artificial Sequence
  chemically synthesized
tattattattattatacttt

SEQ ID NO: 140216 - DNA, 20 bp, Artificial Sequence
  chemically synthesized
tattattatactttaagttt

SEQ ID NO: 140217 - DNA, 20 bp, Artificial Sequence
  chemically synthesized
cacatgtaccctaaaactta

SEQ ID NO: 140218 - DNA, 20 bp, Artificial Sequence
  chemically synthesized
attattatactttaagtttt

SEQ ID NO: 140219 - DNA, 20 bp, Artificial Sequence
  chemically synthesized
ttattatactttaagtttta

SEQ ID NO: 140220 - DNA, 20 bp, Artificial Sequence
  chemically synthesized
gggtacatgtgcacaatgtg

SEQ ID NO: 140221 - DNA, 20 bp, Artificial Sequence
  chemically synthesized
ggtacatgtgcacaatgtgc

SEQ ID NO: 140222 - DNA, 20 bp, Artificial Sequence
  chemically synthesized
catgtgcacaatgtgcaggt

SEQ ID NO: 140223 - DNA, 20 bp, Artificial Sequence
  chemically synthesized
tatgtatacatgtgccatgc

SEQ ID NO: 140224 - DNA, 20 bp, Artificial Sequence
  chemically synthesized
gtgggtgcagcgtgccagca

SEQ ID NO: 140225 - DNA, 20 bp, Artificial Sequence
  chemically synthesized
ggttagtgggtgcagcgtgc

SEQ ID NO: 140226 - DNA, 20 bp, Artificial Sequence
  chemically synthesized
agatgacgggttagtgggtg

SEQ ID NO: 140227 - DNA, 20 bp, Artificial Sequence
  chemically synthesized
atgctagatgacgggttagt

SEQ ID NO: 140228 - DNA, 20 bp, Artificial Sequence
  chemically synthesized
aatgctagatgacgggttag

SEQ ID NO: 140229 - DNA, 20 bp, Artificial Sequence
  chemically synthesized
cctaatgctagatgacgggt

SEQ ID NO: 140230 - DNA, 20 bp, Artificial Sequence
  chemically synthesized
gcacccactaacccgtcatc

SEQ ID NO: 140231 - DNA, 20 bp, Artificial Sequence
  chemically synthesized
tatacctaatgctagatgac

SEQ ID NO: 140232 - DNA, 20 bp, Artificial Sequence
  chemically synthesized
atatacctaatgctagatga

SEQ ID NO: 140233 - DNA, 20 bp, Artificial Sequence
  chemically synthesized
actaacccgtcatctagcat

SEQ ID NO: 140234 - DNA, 20 bp, Artificial Sequence
  chemically synthesized
ctaacccgtcatctagcatt

SEQ ID NO: 140235 - DNA, 20 bp, Artificial Sequence
  chemically synthesized
ttgggagatatacctaatgc

SEQ ID NO: 140236 - DNA, 20 bp, Artificial Sequence
  chemically synthesized
ggggggagggatggcattgg

SEQ ID NO: 140237 - DNA, 20 bp, Artificial Sequence
  chemically synthesized
gaggggggagggatggcatt

SEQ ID NO: 140238 - DNA, 20 bp, Artificial Sequence
  chemically synthesized
ggaggggggagggatggcat

SEQ ID NO: 140239 - DNA, 20 bp, Artificial Sequence
  chemically synthesized
gtggggggaggggggaggga

SEQ ID NO: 140240 - DNA, 20 bp, Artificial Sequence
  chemically synthesized
tggggtggggggagggggga

SEQ ID NO: 140241 - DNA, 20 bp, Artificial Sequence
  chemically synthesized
gtggggtggggggagggggg

SEQ ID NO: 140242 - DNA, 20 bp, Artificial Sequence
  chemically synthesized
tgtggggtggggggaggggg

SEQ ID NO: 140243 - DNA, 20 bp, Artificial Sequence
  chemically synthesized
gttgtggggtggggggaggg

SEQ ID NO: 140244 - DNA, 20 bp, Artificial Sequence
  chemically synthesized
tgttgtggggtggggggagg

SEQ ID NO: 140245 - DNA, 20 bp, Artificial Sequence
  chemically synthesized
ctgttgtggggtggggggag

SEQ ID NO: 140246 - DNA, 20 bp, Artificial Sequence
  chemically synthesized
actgttgtggggtgggggga

SEQ ID NO: 140247 - DNA, 20 bp, Artificial Sequence
  chemically synthesized
gactgttgtggggtgggggg

SEQ ID NO: 140248 - DNA, 20 bp, Artificial Sequence
  chemically synthesized
ggactgttgtggggtggggg

SEQ ID NO: 140249 - DNA, 20 bp, Artificial Sequence
  chemically synthesized
ggggactgttgtggggtggg

SEQ ID NO: 140250 - DNA, 20 bp, Artificial Sequence
  chemically synthesized
tggggactgttgtggggtgg

SEQ ID NO: 140251 - DNA, 20 bp, Artificial Sequence
  chemically synthesized
ctggggactgttgtggggtg

SEQ ID NO: 140252 - DNA, 20 bp, Artificial Sequence
  chemically synthesized
tctggggactgttgtggggt

SEQ ID NO: 140253 - DNA, 20 bp, Artificial Sequence
  chemically synthesized
ctctggggactgttgtgggg

SEQ ID NO: 140254 - DNA, 20 bp, Artificial Sequence
  chemically synthesized
cccctccccccaccccacaa

SEQ ID NO: 140255 - DNA, 20 bp, Artificial Sequence
  chemically synthesized
acactctggggactgttgtg

SEQ ID NO: 140256 - DNA, 20 bp, Artificial Sequence
  chemically synthesized
cacactctggggactgttgt

SEQ ID NO: 140257 - DNA, 20 bp, Artificial Sequence
  chemically synthesized
tcacactctggggactgttg

SEQ ID NO: 140258 - DNA, 20 bp, Artificial Sequence
  chemically synthesized
ccccaccccacaacagtccc

SEQ ID NO: 140259 - DNA, 20 bp, Artificial Sequence
  chemically synthesized
ccaccccacaacagtcccca

SEQ ID NO: 140260 - DNA, 20 bp, Artificial Sequence
  chemically synthesized
aaggggaacatcacactctg

SEQ ID NO: 140261 - DNA, 20 bp, Artificial Sequence
  chemically synthesized
gaaggggaacatcacactct

SEQ ID NO: 140262 - DNA, 20 bp, Artificial Sequence
  chemically synthesized
ggaaggggaacatcacactc

SEQ ID NO: 140263 - DNA, 20 bp, Artificial Sequence
  chemically synthesized
gaacacatggacacaggaag

SEQ ID NO: 140264 - DNA, 20 bp, Artificial Sequence
  chemically synthesized
agaacacatggacacaggaa

SEQ ID NO: 140265 - DNA, 20 bp, Artificial Sequence
  chemically synthesized
gagaacacatggacacagga

SEQ ID NO: 140266 - DNA, 20 bp, Artificial Sequence
  chemically synthesized
tgagaacacatggacacagg

SEQ ID NO: 140267 - DNA, 20 bp, Artificial Sequence
  chemically synthesized
caatgagaacacatggacac

SEQ ID NO: 140268 - DNA, 20 bp, Artificial Sequence
  chemically synthesized
acaatgagaacacatggaca

SEQ ID NO: 140269 - DNA, 20 bp, Artificial Sequence
  chemically synthesized
aattgaacaatgagaacaca

SEQ ID NO: 140270 - DNA, 20 bp, Artificial Sequence
  chemically synthesized
ataggtgggaattgaacaat

SEQ ID NO: 140271 - DNA, 20 bp, Artificial Sequence
  chemically synthesized
gcatattctcattcataggt

SEQ ID NO: 140272 - DNA, 20 bp, Artificial Sequence
  chemically synthesized
cgcatattctcattcatagg

SEQ ID NO: 140273 - DNA, 20 bp, Artificial Sequence
  chemically synthesized
ttcaattcccacctatgaat

SEQ ID NO: 140274 - DNA, 20 bp, Artificial Sequence
  chemically synthesized
caccgcatattctcattcat

SEQ ID NO: 140275 - DNA, 20 bp, Artificial Sequence
  chemically synthesized
acaccgcatattctcattca

SEQ ID NO: 140276 - DNA, 20 bp, Artificial Sequence
  chemically synthesized
cacctatgaatgagaatatg

SEQ ID NO: 140277 - DNA, 20 bp, Artificial Sequence
  chemically synthesized
gaatgagaatatgcggtgtt

SEQ ID NO: 140278 - DNA, 20 bp, Artificial Sequence
  chemically synthesized
ttggttttttgttcttgcaa

SEQ ID NO: 140279 - DNA, 20 bp, Artificial Sequence
  chemically synthesized
cattctcagtaaactattgc

SEQ ID NO: 140280 - DNA, 20 bp, Artificial Sequence
  chemically synthesized
tgttcttgcaatagtttact

SEQ ID NO: 140281 - DNA, 20 bp, Artificial Sequence
  chemically synthesized
aaattggaaatcatcattct

SEQ ID NO: 140282 - DNA, 20 bp, Artificial Sequence
  chemically synthesized
tgtagggacatggatgaaat

SEQ ID NO: 140283 - DNA, 20 bp, Artificial Sequence
  chemically synthesized
tcatgtcctttgtagggaca

SEQ ID NO: 140284 - DNA, 20 bp, Artificial Sequence
  chemically synthesized
atttcatccatgtccctaca

SEQ ID NO: 140285 - DNA, 20 bp, Artificial Sequence
  chemically synthesized
tttcatccatgtccctacaa

SEQ ID NO: 140286 - DNA, 20 bp, Artificial Sequence
  chemically synthesized
atgagttcatgtcctttgta

SEQ ID NO: 140287 - DNA, 20 bp, Artificial Sequence
  chemically synthesized
gatgagttcatgtcctttgt

SEQ ID NO: 140288 - DNA, 20 bp, Artificial Sequence
  chemically synthesized
ggatgagttcatgtcctttg

SEQ ID NO: 140289 - DNA, 20 bp, Artificial Sequence
  chemically synthesized
atgcagccataaaaaaggat

SEQ ID NO: 140290 - DNA, 20 bp, Artificial Sequence
  chemically synthesized
catgaactcatcctttttta

SEQ ID NO: 140291 - DNA, 20 bp, Artificial Sequence
  chemically synthesized
atactatgcagccataaaaa

SEQ ID NO: 140292 - DNA, 20 bp, Artificial Sequence
  chemically synthesized
aatactatgcagccataaaa

SEQ ID NO: 140293 - DNA, 20 bp, Artificial Sequence
  chemically synthesized
catccttttttatggctgca

SEQ ID NO: 140294 - DNA, 20 bp, Artificial Sequence
  chemically synthesized
atacaccatggaatactatg

SEQ ID NO: 140295 - DNA, 20 bp, Artificial Sequence
  chemically synthesized
tatggctgcatagtattcca

SEQ ID NO: 140296 - DNA, 20 bp, Artificial Sequence
  chemically synthesized
aatgtggcacatatacacca

SEQ ID NO: 140297 - DNA, 20 bp, Artificial Sequence
  chemically synthesized
tagactggattaagaaaatg

SEQ ID NO: 140298 - DNA, 20 bp, Artificial Sequence
  chemically synthesized
tgtgccacattttcttaatc

SEQ ID NO: 140299 - DNA, 20 bp, Artificial Sequence
  chemically synthesized
caacaatgatagactggatt

SEQ ID NO: 140300 - DNA, 20 bp, Artificial Sequence
  chemically synthesized
aatgtccaacaatgatagac

SEQ ID NO: 140301 - DNA, 20 bp, Artificial Sequence
  chemically synthesized
ttaatccagtctatcattgt

SEQ ID NO: 140302 - DNA, 20 bp, Artificial Sequence
  chemically synthesized
acccaaatgtccaacaatga

SEQ ID NO: 140303 - DNA, 20 bp, Artificial Sequence
  chemically synthesized
gtctatcattgttggacatt

SEQ ID NO: 140304 - DNA, 20 bp, Artificial Sequence
  chemically synthesized
tctatcattgttggacattt

SEQ ID NO: 140305 - DNA, 20 bp, Artificial Sequence
  chemically synthesized
tcattgttggacatttgggt

SEQ ID NO: 140306 - DNA, 20 bp, Artificial Sequence
  chemically synthesized
tggacatttgggttggttcc

SEQ ID NO: 140307 - DNA, 20 bp, Artificial Sequence
  chemically synthesized
tatttacaatagcaaagact

SEQ ID NO: 140308 - DNA, 20 bp, Artificial Sequence
  chemically synthesized
aggcactatttacaatagca

SEQ ID NO: 140309 - DNA, 20 bp, Artificial Sequence
  chemically synthesized
caagtctttgctattgtaaa

SEQ ID NO: 140310 - DNA, 20 bp, Artificial Sequence
  chemically synthesized
tattgaggcactatttacaa

SEQ ID NO: 140311 - DNA, 20 bp, Artificial Sequence
  chemically synthesized
atgcacatgtatgtttattg

SEQ ID NO: 140312 - DNA, 20 bp, Artificial Sequence
  chemically synthesized
catgcacatgtatgtttatt

SEQ ID NO: 140313 - DNA, 20 bp, Artificial Sequence
  chemically synthesized
tacatgtgcatgtgtcttta

SEQ ID NO: 140314 - DNA, 20 bp, Artificial Sequence
  chemically synthesized
atgtgcatgtgtctttatag

SEQ ID NO: 140315 - DNA, 20 bp, Artificial Sequence
  chemically synthesized
ctataaatcatgctgctata

SEQ ID NO: 140316 - DNA, 20 bp, Artificial Sequence
  chemically synthesized
ctttatagcagcatgattta

SEQ ID NO: 140317 - DNA, 20 bp, Artificial Sequence
  chemically synthesized
cagcatgatttatagtcctt

SEQ ID NO: 140318 - DNA, 20 bp, Artificial Sequence
  chemically synthesized
agcatgatttatagtccttt

SEQ ID NO: 140319 - DNA, 20 bp, Artificial Sequence
  chemically synthesized
attactgggtatatacccaa

SEQ ID NO: 140320 - DNA, 20 bp, Artificial Sequence
  chemically synthesized
cattactgggtatataccca

SEQ ID NO: 140321 - DNA, 20 bp, Artificial Sequence
  chemically synthesized
tagtcctttgggtatatacc

SEQ ID NO: 140322 - DNA, 20 bp, Artificial Sequence
  chemically synthesized
tttgggtatatacccagtaa

SEQ ID NO: 140323 - DNA, 20 bp, Artificial Sequence
  chemically synthesized
ttgggtatatacccagtaat

SEQ ID NO: 140324 - DNA, 20 bp, Artificial Sequence
  chemically synthesized
gacccagccatcccattact

SEQ ID NO: 140325 - DNA, 20 bp, Artificial Sequence
  chemically synthesized
tgacccagccatcccattac

SEQ ID NO: 140326 - DNA, 20 bp, Artificial Sequence
  chemically synthesized
gtatatacccagtaatggga

SEQ ID NO: 140327 - DNA, 20 bp, Artificial Sequence
  chemically synthesized
atacccagtaatgggatggc

SEQ ID NO: 140328 - DNA, 20 bp, Artificial Sequence
  chemically synthesized
tacccagtaatgggatggct

SEQ ID NO: 140329 - DNA, 20 bp, Artificial Sequence
  chemically synthesized
aatgggatggctgggtcaaa

SEQ ID NO: 140330 - DNA, 20 bp, Artificial Sequence
  chemically synthesized
actagaaataccatttgacc

SEQ ID NO: 140331 - DNA, 20 bp, Artificial Sequence
  chemically synthesized
gctgggtcaaatggtatttc

SEQ ID NO: 140332 - DNA, 20 bp, Artificial Sequence
  chemically synthesized
tcaaatggtatttctagttc

SEQ ID NO: 140333 - DNA, 20 bp, Artificial Sequence
  chemically synthesized
attcctcagggatctagaac

SEQ ID NO: 140334 - DNA, 20 bp, Artificial Sequence
  chemically synthesized
atttctagttctagatccct

SEQ ID NO: 140335 - DNA, 20 bp, Artificial Sequence
  chemically synthesized
gtggcgattcctcagggatc

SEQ ID NO: 140336 - DNA, 20 bp, Artificial Sequence
  chemically synthesized
tttctagttctagatccctg

SEQ ID NO: 140337 - DNA, 20 bp, Artificial Sequence
  chemically synthesized
gtcagtgtggcgattcctca

SEQ ID NO: 140338 - DNA, 20 bp, Artificial Sequence
  chemically synthesized
agtcagtgtggcgattcctc

SEQ ID NO: 140339 - DNA, 20 bp, Artificial Sequence
  chemically synthesized
aagtcagtgtggcgattcct

SEQ ID NO: 140340 - DNA, 20 bp, Artificial Sequence
  chemically synthesized
aaccattgtggaagtcagtg

SEQ ID NO: 140341 - DNA, 20 bp, Artificial Sequence
  chemically synthesized
agttcaaccattgtggaagt

SEQ ID NO: 140342 - DNA, 20 bp, Artificial Sequence
  chemically synthesized
cgccacactgacttccacaa

SEQ ID NO: 140343 - DNA, 20 bp, Artificial Sequence
  chemically synthesized
aactagttcaaccattgtgg

SEQ ID NO: 140344 - DNA, 20 bp, Artificial Sequence
  chemically synthesized
gtaaactagttcaaccattg

SEQ ID NO: 140345 - DNA, 20 bp, Artificial Sequence
  chemically synthesized
gacttccacaatggttgaac

SEQ ID NO: 140346 - DNA, 20 bp, Artificial Sequence
  chemically synthesized
acaatggttgaactagttta

SEQ ID NO: 140347 - DNA, 20 bp, Artificial Sequence
  chemically synthesized
ctgttggtgggactgtaaac

SEQ ID NO: 140348 - DNA, 20 bp, Artificial Sequence
  chemically synthesized
ctagtttacagtcccaccaa

SEQ ID NO: 140349 - DNA, 20 bp, Artificial Sequence
  chemically synthesized
aacactcttacactgttggt

SEQ ID NO: 140350 - DNA, 20 bp, Artificial Sequence
  chemically synthesized
gaacactcttacactgttgg

SEQ ID NO: 140351 - DNA, 20 bp, Artificial Sequence
  chemically synthesized
tacagtcccaccaacagtgt

SEQ ID NO: 140352 - DNA, 20 bp, Artificial Sequence
  chemically synthesized
taggaacactcttacactgt

SEQ ID NO: 140353 - DNA, 20 bp, Artificial Sequence
  chemically synthesized
cagtcccaccaacagtgtaa

SEQ ID NO: 140354 - DNA, 20 bp, Artificial Sequence
  chemically synthesized
tggagaggatgtggagaaat

SEQ ID NO: 140355 - DNA, 20 bp, Artificial Sequence
  chemically synthesized
ctggagaggatgtggagaaa

SEQ ID NO: 140356 - DNA, 20 bp, Artificial Sequence
  chemically synthesized
caggtgctggagaggatgtg

SEQ ID NO: 140357 - DNA, 20 bp, Artificial Sequence
  chemically synthesized
aacaggtgctggagaggatg

SEQ ID NO: 140358 - DNA, 20 bp, Artificial Sequence
  chemically synthesized
ctatttctccacatcctctc

SEQ ID NO: 140359 - DNA, 20 bp, Artificial Sequence
  chemically synthesized
ggaaacaacaggtgctggag

SEQ ID NO: 140360 - DNA, 20 bp, Artificial Sequence
  chemically synthesized
aggaaacaacaggtgctgga

SEQ ID NO: 140361 - DNA, 20 bp, Artificial Sequence
  chemically synthesized
tcaggaaacaacaggtgctg

SEQ ID NO: 140362 - DNA, 20 bp, Artificial Sequence
  chemically synthesized
agtcaggaaacaacaggtgc

SEQ ID NO: 140363 - DNA, 20 bp, Artificial Sequence
  chemically synthesized
ttaaaaagtcaggaaacaac

SEQ ID NO: 140364 - DNA, 20 bp, Artificial Sequence
  chemically synthesized
attaaaaagtcaggaaacaa

SEQ ID NO: 140365 - DNA, 20 bp, Artificial Sequence
  chemically synthesized
atggcaatcattaaaaagtc

SEQ ID NO: 140366 - DNA, 20 bp, Artificial Sequence
  chemically synthesized
aatggcaatcattaaaaagt

SEQ ID NO: 140367 - DNA, 20 bp, Artificial Sequence
  chemically synthesized
ttagaatggcaatcattaaa

SEQ ID NO: 140368 - DNA, 20 bp, Artificial Sequence
  chemically synthesized
ttaatgattgccattctaac

SEQ ID NO: 140369 - DNA, 20 bp, Artificial Sequence
  chemically synthesized
ccatctcacaccagttagaa

SEQ ID NO: 140370 - DNA, 20 bp, Artificial Sequence
  chemically synthesized
agataccatctcacaccagt

SEQ ID NO: 140371 - DNA, 20 bp, Artificial Sequence
  chemically synthesized
attgccattctaactggtgt

SEQ ID NO: 140372 - DNA, 20 bp, Artificial Sequence
  chemically synthesized
aatgagataccatctcacac

SEQ ID NO: 140373 - DNA, 20 bp, Artificial Sequence
  chemically synthesized
ccattctaactggtgtgaga

SEQ ID NO: 140374 - DNA, 20 bp, Artificial Sequence
  chemically synthesized
tgtgagatggtatctcattg

SEQ ID NO: 140375 - DNA, 20 bp, Artificial Sequence
  chemically synthesized
atgcaaatcaaaaccacaat

SEQ ID NO: 140376 - DNA, 20 bp, Artificial Sequence
  chemically synthesized
tttgatttgcatttctctga

SEQ ID NO: 140377 - DNA, 20 bp, Artificial Sequence
  chemically synthesized
atttgcatttctctgatggc

SEQ ID NO: 140378 - DNA, 20 bp, Artificial Sequence
  chemically synthesized
ctcaccatcactggccatca

SEQ ID NO: 140379 - DNA, 20 bp, Artificial Sequence
  chemically synthesized
tgctcaccatcactggccat

SEQ ID NO: 140380 - DNA, 20 bp, Artificial Sequence
  chemically synthesized
atttctctgatggccagtga

SEQ ID NO: 140381 - DNA, 20 bp, Artificial Sequence
  chemically synthesized
gaaaaaatgctcaccatcac

SEQ ID NO: 140382 - DNA, 20 bp, Artificial Sequence
  chemically synthesized
ctctgatggccagtgatggt

SEQ ID NO: 140383 - DNA, 20 bp, Artificial Sequence
  chemically synthesized
gcattttttcatgtgtcttt

SEQ ID NO: 140384 - DNA, 20 bp, Artificial Sequence
  chemically synthesized
gaagacatttatgcagccaa

SEQ ID NO: 140385 - DNA, 20 bp, Artificial Sequence
  chemically synthesized
ctcaaaagaagacatttatg

SEQ ID NO: 140386 - DNA, 20 bp, Artificial Sequence
  chemically synthesized
ctgcataaatgtcttctttt

SEQ ID NO: 140387 - DNA, 20 bp, Artificial Sequence
  chemically synthesized
gaacagacacttctcaaaag

SEQ ID NO: 140388 - DNA, 20 bp, Artificial Sequence
  chemically synthesized
cataaatgtcttcttttgag

SEQ ID NO: 140389 - DNA, 20 bp, Artificial Sequence
  chemically synthesized
catgaacagacacttctcaa

SEQ ID NO: 140390 - DNA, 20 bp, Artificial Sequence
  chemically synthesized
aagtgggcgaaggacatgaa

SEQ ID NO: 140391 - DNA, 20 bp, Artificial Sequence
  chemically synthesized
ccccatccaaaagtgggcga

SEQ ID NO: 140392 - DNA, 20 bp, Artificial Sequence
  chemically synthesized
accccatccaaaagtgggcg

SEQ ID NO: 140393 - DNA, 20 bp, Artificial Sequence
  chemically synthesized
tcatgtccttcgcccacttt

SEQ ID NO: 140394 - DNA, 20 bp, Artificial Sequence
  chemically synthesized
aaacaaccccatccaaaagt

SEQ ID NO: 140395 - DNA, 20 bp, Artificial Sequence
  chemically synthesized
caaacaaccccatccaaaag

SEQ ID NO: 140396 - DNA, 20 bp, Artificial Sequence
  chemically synthesized
gtccttcgcccacttttgga

SEQ ID NO: 140397 - DNA, 20 bp, Artificial Sequence
  chemically synthesized
tccttcgcccacttttggat

SEQ ID NO: 140398 - DNA, 20 bp, Artificial Sequence
  chemically synthesized
ccttcgcccacttttggatg

SEQ ID NO: 140399 - DNA, 20 bp, Artificial Sequence
  chemically synthesized
aaacaaacaaccccatccaa

SEQ ID NO: 140400 - DNA, 20 bp, Artificial Sequence
  chemically synthesized
atgaactccaacaaatttac

SEQ ID NO: 140401 - DNA, 20 bp, Artificial Sequence
  chemically synthesized
tttttttcttgtaaatttgt

SEQ ID NO: 140402 - DNA, 20 bp, Artificial Sequence
  chemically synthesized
tttttcttgtaaatttgttg

SEQ ID NO: 140403 - DNA, 20 bp, Artificial Sequence
  chemically synthesized
aaatttgttggagttcattg

SEQ ID NO: 140404 - DNA, 20 bp, Artificial Sequence
  chemically synthesized
ttggagttcattgtagattc

SEQ ID NO: 140405 - DNA, 20 bp, Artificial Sequence
  chemically synthesized
tcattgtagattctggatat

SEQ ID NO: 140406 - DNA, 20 bp, Artificial Sequence
  chemically synthesized
tctgacaaagagctaatatc

SEQ ID NO: 140407 - DNA, 20 bp, Artificial Sequence
  chemically synthesized
tctggatattagctctttgt

SEQ ID NO: 140408 - DNA, 20 bp, Artificial Sequence
  chemically synthesized
caacctgcttatctgacaaa

SEQ ID NO: 140409 - DNA, 20 bp, Artificial Sequence
  chemically synthesized
cgcaacctgcttatctgaca

SEQ ID NO: 140410 - DNA, 20 bp, Artificial Sequence
  chemically synthesized
atattagctctttgtcagat

SEQ ID NO: 140411 - DNA, 20 bp, Artificial Sequence
  chemically synthesized
ttagctctttgtcagataag

SEQ ID NO: 140412 - DNA, 20 bp, Artificial Sequence
  chemically synthesized
tagctctttgtcagataagc

SEQ ID NO: 140413 - DNA, 20 bp, Artificial Sequence
  chemically synthesized
acaggcaacctacaacatgg

SEQ ID NO: 140414 - DNA, 20 bp, Artificial Sequence
  chemically synthesized
gaaaattttctcccatgttg

SEQ ID NO: 140415 - DNA, 20 bp, Artificial Sequence
  chemically synthesized
aaaattttctcccatgttgt

SEQ ID NO: 140416 - DNA, 20 bp, Artificial Sequence
  chemically synthesized
gaacaggcaacctacaacat

SEQ ID NO: 140417 - DNA, 20 bp, Artificial Sequence
  chemically synthesized
tgaacaggcaacctacaaca

SEQ ID NO: 140418 - DNA, 20 bp, Artificial Sequence
  chemically synthesized
aaactaccatcagagtgaac

SEQ ID NO: 140419 - DNA, 20 bp, Artificial Sequence
  chemically synthesized
gaaactaccatcagagtgaa

SEQ ID NO: 140420 - DNA, 20 bp, Artificial Sequence
  chemically synthesized
aggttgcctgttcactctga

SEQ ID NO: 140421 - DNA, 20 bp, Artificial Sequence
  chemically synthesized
ttgcctgttcactctgatgg

SEQ ID NO: 140422 - DNA, 20 bp, Artificial Sequence
  chemically synthesized
agcaaaagaaactaccatca

SEQ ID NO: 140423 - DNA, 20 bp, Artificial Sequence
  chemically synthesized
acagcaaaagaaactaccat

SEQ ID NO: 140424 - DNA, 20 bp, Artificial Sequence
  chemically synthesized
aaagagcttctgcacagcaa

SEQ ID NO: 140425 - DNA, 20 bp, Artificial Sequence
  chemically synthesized
tggtagtttcttttgctgtg

SEQ ID NO: 140426 - DNA, 20 bp, Artificial Sequence
  chemically synthesized
tagtttcttttgctgtgcag

SEQ ID NO: 140427 - DNA, 20 bp, Artificial Sequence
  chemically synthesized
taaactaaagagcttctgca

SEQ ID NO: 140428 - DNA, 20 bp, Artificial Sequence
  chemically synthesized
tttgctgtgcagaagctctt

SEQ ID NO: 140429 - DNA, 20 bp, Artificial Sequence
  chemically synthesized
tgtgcagaagctctttagtt

SEQ ID NO: 140430 - DNA, 20 bp, Artificial Sequence
  chemically synthesized
tgggatctaactaaactaaa

SEQ ID NO: 140431 - DNA, 20 bp, Artificial Sequence
  chemically synthesized
aatgggatctaactaaacta

SEQ ID NO: 140432 - DNA, 20 bp, Artificial Sequence
  chemically synthesized
cagaagctctttagtttagt

SEQ ID NO: 140433 - DNA, 20 bp, Artificial Sequence
  chemically synthesized
aaaagccaaaattgacaaat

SEQ ID NO: 140434 - DNA, 20 bp, Artificial Sequence
  chemically synthesized
caaaagccaaaattgacaaa

SEQ ID NO: 140435 - DNA, 20 bp, Artificial Sequence
  chemically synthesized
tagatcccatttgtcaattt

SEQ ID NO: 140436 - DNA, 20 bp, Artificial Sequence
  chemically synthesized
accaaaagcaagggcaacaa

SEQ ID NO: 140437 - DNA, 20 bp, Artificial Sequence
  chemically synthesized
gcttttgttgcccttgcttt

SEQ ID NO: 140438 - DNA, 20 bp, Artificial Sequence
  chemically synthesized
gtctaaaacaccaaaagcaa

SEQ ID NO: 140439 - DNA, 20 bp, Artificial Sequence
  chemically synthesized
tgtctaaaacaccaaaagca

SEQ ID NO: 140440 - DNA, 20 bp, Artificial Sequence
  chemically synthesized
atgtctaaaacaccaaaagc

SEQ ID NO: 140441 - DNA, 20 bp, Artificial Sequence
  chemically synthesized
cttcatgtctaaaacaccaa

SEQ ID NO: 140442 - DNA, 20 bp, Artificial Sequence
  chemically synthesized
tgcccttgcttttggtgttt

SEQ ID NO: 140443 - DNA, 20 bp, Artificial Sequence
  chemically synthesized
cttttggtgttttagacatg

SEQ ID NO: 140444 - DNA, 20 bp, Artificial Sequence
  chemically synthesized
tcaggacataggcatgggca

SEQ ID NO: 140445 - DNA, 20 bp, Artificial Sequence
  chemically synthesized
ttcaggacataggcatgggc

SEQ ID NO: 140446 - DNA, 20 bp, Artificial Sequence
  chemically synthesized
accattcaggacataggcat

SEQ ID NO: 140447 - DNA, 20 bp, Artificial Sequence
  chemically synthesized
taccattcaggacataggca

SEQ ID NO: 140448 - DNA, 20 bp, Artificial Sequence
  chemically synthesized
ggcattaccattcaggacat

SEQ ID NO: 140449 - DNA, 20 bp, Artificial Sequence
  chemically synthesized
aggcattaccattcaggaca

SEQ ID NO: 140450 - DNA, 20 bp, Artificial Sequence
  chemically synthesized
gcccatgcctatgtcctgaa

SEQ ID NO: 140451 - DNA, 20 bp, Artificial Sequence
  chemically synthesized
aaacctaggcattaccattc

SEQ ID NO: 140452 - DNA, 20 bp, Artificial Sequence
  chemically synthesized
aaaacctaggcattaccatt

SEQ ID NO: 140453 - DNA, 20 bp, Artificial Sequence
  chemically synthesized
atgtcctgaatggtaatgcc

SEQ ID NO: 140454 - DNA, 20 bp, Artificial Sequence
  chemically synthesized
tgtcctgaatggtaatgcct

SEQ ID NO: 140455 - DNA, 20 bp, Artificial Sequence
  chemically synthesized
aaaaccctagaagaaaacct

SEQ ID NO: 140456 - DNA, 20 bp, Artificial Sequence
  chemically synthesized
aaaaaccctagaagaaaacc

SEQ ID NO: 140457 - DNA, 20 bp, Artificial Sequence
  chemically synthesized
gtaatgcctaggttttcttc

SEQ ID NO: 140458 - DNA, 20 bp, Artificial Sequence
  chemically synthesized
taatgcctaggttttcttct

SEQ ID NO: 140459 - DNA, 20 bp, Artificial Sequence
  chemically synthesized
aatgcctaggttttcttcta

SEQ ID NO: 140460 - DNA, 20 bp, Artificial Sequence
  chemically synthesized
taaaaccataaaaaccctag

SEQ ID NO: 140461 - DNA, 20 bp, Artificial Sequence
  chemically synthesized
acctaaaaccataaaaaccc

SEQ ID NO: 140462 - DNA, 20 bp, Artificial Sequence
  chemically synthesized
gttttcttctagggttttta

SEQ ID NO: 140463 - DNA, 20 bp, Artificial Sequence
  chemically synthesized
ttctagggtttttatggttt

SEQ ID NO: 140464 - DNA, 20 bp, Artificial Sequence
  chemically synthesized
tctagggtttttatggtttt

SEQ ID NO: 140465 - DNA, 20 bp, Artificial Sequence
  chemically synthesized
tggttttaggtctaacgttt

SEQ ID NO: 140466 - DNA, 20 bp, Artificial Sequence
  chemically synthesized
tggattaaagacttaaacgt

SEQ ID NO: 140467 - DNA, 20 bp, Artificial Sequence
  chemically synthesized
aatcaattcaagatggatta

SEQ ID NO: 140468 - DNA, 20 bp, Artificial Sequence
  chemically synthesized
atacaaaaatcaattcaaga

SEQ ID NO: 140469 - DNA, 20 bp, Artificial Sequence
  chemically synthesized
ccttatacaaaaatcaattc

SEQ ID NO: 140470 - DNA, 20 bp, Artificial Sequence
  chemically synthesized
tcttgaattgatttttgtat

SEQ ID NO: 140471 - DNA, 20 bp, Artificial Sequence
  chemically synthesized
cttgaattgatttttgtata

SEQ ID NO: 140472 - DNA, 20 bp, Artificial Sequence
  chemically synthesized
ttgatttttgtataaggtgt

SEQ ID NO: 140473 - DNA, 20 bp, Artificial Sequence
  chemically synthesized
tgatttttgtataaggtgta

SEQ ID NO: 140474 - DNA, 20 bp, Artificial Sequence
  chemically synthesized
tttttgtataaggtgtaagg

SEQ ID NO: 140475 - DNA, 20 bp, Artificial Sequence
  chemically synthesized
ttttgtataaggtgtaagga

SEQ ID NO: 140476 - DNA, 20 bp, Artificial Sequence
  chemically synthesized
tttgtataaggtgtaaggaa

SEQ ID NO: 140477 - DNA, 20 bp, Artificial Sequence
  chemically synthesized
taaggtgtaaggaagggatc

SEQ ID NO: 140478 - DNA, 20 bp, Artificial Sequence
  chemically synthesized
gtaaggaagggatccagttt

SEQ ID NO: 140479 - DNA, 20 bp, Artificial Sequence
  chemically synthesized
catatgtagaaagctgaaac

SEQ ID NO: 140480 - DNA, 20 bp, Artificial Sequence
  chemically synthesized
actggctagccatatgtaga

SEQ ID NO: 140481 - DNA, 20 bp, Artificial Sequence
  chemically synthesized
cagtttcagctttctacata

SEQ ID NO: 140482 - DNA, 20 bp, Artificial Sequence
  chemically synthesized
gaaaactggctagccatatg

SEQ ID NO: 140483 - DNA, 20 bp, Artificial Sequence
  chemically synthesized
ttcagctttctacatatggc

SEQ ID NO: 140484 - DNA, 20 bp, Artificial Sequence
  chemically synthesized
gctttctacatatggctagc

SEQ ID NO: 140485 - DNA, 20 bp, Artificial Sequence
  chemically synthesized
atggtgctgggaaaactggc

SEQ ID NO: 140486 - DNA, 20 bp, Artificial Sequence
  chemically synthesized
atatggctagccagttttcc

SEQ ID NO: 140487 - DNA, 20 bp, Artificial Sequence
  chemically synthesized
ataaatggtgctgggaaaac

SEQ ID NO: 140488 - DNA, 20 bp, Artificial Sequence
  chemically synthesized
cctatttaataaatggtgct

SEQ ID NO: 140489 - DNA, 20 bp, Artificial Sequence
  chemically synthesized
ccctatttaataaatggtgc

SEQ ID NO: 140490 - DNA, 20 bp, Artificial Sequence
  chemically synthesized
aggattccctatttaataaa

SEQ ID NO: 140491 - DNA, 20 bp, Artificial Sequence
  chemically synthesized
tcccagcaccatttattaaa

SEQ ID NO: 140492 - DNA, 20 bp, Artificial Sequence
  chemically synthesized
cccagcaccatttattaaat

SEQ ID NO: 140493 - DNA, 20 bp, Artificial Sequence
  chemically synthesized
ccagcaccatttattaaata

SEQ ID NO: 140494 - DNA, 20 bp, Artificial Sequence
  chemically synthesized
gaaaaacaagcaatggggaa

SEQ ID NO: 140495 - DNA, 20 bp, Artificial Sequence
  chemically synthesized
agaaaaacaagcaatgggga

SEQ ID NO: 140496 - DNA, 20 bp, Artificial Sequence
  chemically synthesized
cctgagaaaaacaagcaatg

SEQ ID NO: 140497 - DNA, 20 bp, Artificial Sequence
  chemically synthesized
acctgagaaaaacaagcaat

SEQ ID NO: 140498 - DNA, 20 bp, Artificial Sequence
  chemically synthesized
aacctgagaaaaacaagcaa

SEQ ID NO: 140499 - DNA, 20 bp, Artificial Sequence
  chemically synthesized
ttgacaaacctgagaaaaac

SEQ ID NO: 140500 - DNA, 20 bp, Artificial Sequence
  chemically synthesized
tccccattgcttgtttttct

SEQ ID NO: 140501 - DNA, 20 bp, Artificial Sequence
  chemically synthesized
ccccattgcttgtttttctc

SEQ ID NO: 140502 - DNA, 20 bp, Artificial Sequence
  chemically synthesized
atctgatctttgacaaacct

SEQ ID NO: 140503 - DNA, 20 bp, Artificial Sequence
  chemically synthesized
tgtttttctcaggtttgtca

SEQ ID NO: 140504 - DNA, 20 bp, Artificial Sequence
  chemically synthesized
ttctcaggtttgtcaaagat

SEQ ID NO: 140505 - DNA, 20 bp, Artificial Sequence
  chemically synthesized
caggtttgtcaaagatcaga

SEQ ID NO: 140506 - DNA, 20 bp, Artificial Sequence
  chemically synthesized
gtttgtcaaagatcagatag

SEQ ID NO: 140507 - DNA, 20 bp, Artificial Sequence
  chemically synthesized
tgtcaaagatcagatagtgg

SEQ ID NO: 140508 - DNA, 20 bp, Artificial Sequence
  chemically synthesized
atcagatagtggtagatatg

SEQ ID NO: 140509 - DNA, 20 bp, Artificial Sequence
  chemically synthesized
agatatgcggcgttacttct

SEQ ID NO: 140510 - DNA, 20 bp, Artificial Sequence
  chemically synthesized
gatatgcggcgttacttctg

SEQ ID NO: 140511 - DNA, 20 bp, Artificial Sequence
  chemically synthesized
atatgcggcgttacttctga

SEQ ID NO: 140512 - DNA, 20 bp, Artificial Sequence
  chemically synthesized
gaacagaacagagccctcag

SEQ ID NO: 140513 - DNA, 20 bp, Artificial Sequence
  chemically synthesized
atggaacagaacagagccct

SEQ ID NO: 140514 - DNA, 20 bp, Artificial Sequence
  chemically synthesized
tagatcaatggaacagaaca

SEQ ID NO: 140515 - DNA, 20 bp, Artificial Sequence
  chemically synthesized
tatagatcaatggaacagaa

SEQ ID NO: 140516 - DNA, 20 bp, Artificial Sequence
  chemically synthesized
agacatatagatcaatggaa

SEQ ID NO: 140517 - DNA, 20 bp, Artificial Sequence
  chemically synthesized
aaaacagacatatagatcaa

SEQ ID NO: 140518 - DNA, 20 bp, Artificial Sequence
  chemically synthesized
ctggtaccaaaacagacata

SEQ ID NO: 140519 - DNA, 20 bp, Artificial Sequence
  chemically synthesized
attgatctatatgtctgttt

SEQ ID NO: 140520 - DNA, 20 bp, Artificial Sequence
  chemically synthesized
gcatggtactggtaccaaaa

SEQ ID NO: 140521 - DNA, 20 bp, Artificial Sequence
  chemically synthesized
ctatatgtctgttttggtac

SEQ ID NO: 140522 - DNA, 20 bp, Artificial Sequence
  chemically synthesized
taaccaaaacagcatggtac

SEQ ID NO: 140523 - DNA, 20 bp, Artificial Sequence
  chemically synthesized
ctacagtaaccaaaacagca

SEQ ID NO: 140524 - DNA, 20 bp, Artificial Sequence
  chemically synthesized
gtaccagtaccatgctgttt

SEQ ID NO: 140525 - DNA, 20 bp, Artificial Sequence
  chemically synthesized
caaggctacagtaaccaaaa

SEQ ID NO: 140526 - DNA, 20 bp, Artificial Sequence
  chemically synthesized
ccatgctgttttggttactg

SEQ ID NO: 140527 - DNA, 20 bp, Artificial Sequence
  chemically synthesized
gcttctatagtacaaggcta

SEQ ID NO: 140528 - DNA, 20 bp, Artificial Sequence
  chemically synthesized
gttactgtagccttgtacta

SEQ ID NO: 140529 - DNA, 20 bp, Artificial Sequence
  chemically synthesized
gggaatgcttctatagtaca

SEQ ID NO: 140530 - DNA, 20 bp, Artificial Sequence
  chemically synthesized
agggaatgcttctatagtac

SEQ ID NO: 140531 - DNA, 20 bp, Artificial Sequence
  chemically synthesized
actgtagccttgtactatag

SEQ ID NO: 140532 - DNA, 20 bp, Artificial Sequence
  chemically synthesized
tttcaaagggaatgcttcta

SEQ ID NO: 140533 - DNA, 20 bp, Artificial Sequence
  chemically synthesized
gtcttgtgccagttttcaaa

SEQ ID NO: 140534 - DNA, 20 bp, Artificial Sequence
  chemically synthesized
tgtcttgtgccagttttcaa

SEQ ID NO: 140535 - DNA, 20 bp, Artificial Sequence
  chemically synthesized
gaagcattccctttgaaaac

SEQ ID NO: 140536 - DNA, 20 bp, Artificial Sequence
  chemically synthesized
ctgtcttgtgccagttttca

SEQ ID NO: 140537 - DNA, 20 bp, Artificial Sequence
  chemically synthesized
ttccctttgaaaactggcac

SEQ ID NO: 140538 - DNA, 20 bp, Artificial Sequence
  chemically synthesized
agggcatccctgtcttgtgc

SEQ ID NO: 140539 - DNA, 20 bp, Artificial Sequence
  chemically synthesized
ctttgaaaactggcacaaga

SEQ ID NO: 140540 - DNA, 20 bp, Artificial Sequence
  chemically synthesized
tttgaaaactggcacaagac

SEQ ID NO: 140541 - DNA, 20 bp, Artificial Sequence
  chemically synthesized
ttgaaaactggcacaagaca

SEQ ID NO: 140542 - DNA, 20 bp, Artificial Sequence
  chemically synthesized
tgaataggagtggtgagaga

SEQ ID NO: 140543 - DNA, 20 bp, Artificial Sequence
  chemically synthesized
ttgaataggagtggtgagag

SEQ ID NO: 140544 - DNA, 20 bp, Artificial Sequence
  chemically synthesized
gttgaataggagtggtgaga

SEQ ID NO: 140545 - DNA, 20 bp, Artificial Sequence
  chemically synthesized
atgttgaataggagtggtga

SEQ ID NO: 140546 - DNA, 20 bp, Artificial Sequence
  chemically synthesized
ctatgttgaataggagtggt

SEQ ID NO: 140547 - DNA, 20 bp, Artificial Sequence
  chemically synthesized
aacactatgttgaataggag

SEQ ID NO: 140548 - DNA, 20 bp, Artificial Sequence
  chemically synthesized
tccaacactatgttgaatag

SEQ ID NO: 140549 - DNA, 20 bp, Artificial Sequence
  chemically synthesized
cttccaacactatgttgaat

SEQ ID NO: 140550 - DNA, 20 bp, Artificial Sequence
  chemically synthesized
ctcaccactcctattcaaca

SEQ ID NO: 140551 - DNA, 20 bp, Artificial Sequence
  chemically synthesized
acttccaacactatgttgaa

SEQ ID NO: 140552 - DNA, 20 bp, Artificial Sequence
  chemically synthesized
actcctattcaacatagtgt

SEQ ID NO: 140553 - DNA, 20 bp, Artificial Sequence
  chemically synthesized
cctattcaacatagtgttgg

SEQ ID NO: 140554 - DNA, 20 bp, Artificial Sequence
  chemically synthesized
caacatagtgttggaagttc

SEQ ID NO: 140555 - DNA, 20 bp, Artificial Sequence
  chemically synthesized
atagtgttggaagttctggc

SEQ ID NO: 140556 - DNA, 20 bp, Artificial Sequence
  chemically synthesized
tagtgttggaagttctggcc

SEQ ID NO: 140557 - DNA, 20 bp, Artificial Sequence
  chemically synthesized
agtgttggaagttctggcca

SEQ ID NO: 140558 - DNA, 20 bp, Artificial Sequence
  chemically synthesized
tcctgcctgattgccctggc

SEQ ID NO: 140559 - DNA, 20 bp, Artificial Sequence
  chemically synthesized
gaagttctggccagggcaat

SEQ ID NO: 140560 - DNA, 20 bp, Artificial Sequence
  chemically synthesized
cttctcctgcctgattgccc

SEQ ID NO: 140561 - DNA, 20 bp, Artificial Sequence
  chemically synthesized
aagttctggccagggcaatc

SEQ ID NO: 140562 - DNA, 20 bp, Artificial Sequence
  chemically synthesized
ttctggccagggcaatcagg

SEQ ID NO: 140563 - DNA, 20 bp, Artificial Sequence
  chemically synthesized
tctggccagggcaatcaggc

SEQ ID NO: 140564 - DNA, 20 bp, Artificial Sequence
  chemically synthesized
tggccagggcaatcaggcag

SEQ ID NO: 140565 - DNA, 20 bp, Artificial Sequence
  chemically synthesized
ccagggcaatcaggcaggag

SEQ ID NO: 140566 - DNA, 20 bp, Artificial Sequence
  chemically synthesized
cagggcaatcaggcaggaga

SEQ ID NO: 140567 - DNA, 20 bp, Artificial Sequence
  chemically synthesized
tcaggcaggagaaggaaata

SEQ ID NO: 140568 - DNA, 20 bp, Artificial Sequence
  chemically synthesized
caggcaggagaaggaaataa

SEQ ID NO: 140569 - DNA, 20 bp, Artificial Sequence
  chemically synthesized
aggcaggagaaggaaataaa

SEQ ID NO: 140570 - DNA, 20 bp, Artificial Sequence
  chemically synthesized
ggaaataaagggtattcaat

SEQ ID NO: 140571 - DNA, 20 bp, Artificial Sequence
  chemically synthesized
gaaataaagggtattcaatt

SEQ ID NO: 140572 - DNA, 20 bp, Artificial Sequence
  chemically synthesized
aataaagggtattcaattag

SEQ ID NO: 140573 - DNA, 20 bp, Artificial Sequence
  chemically synthesized
aaagggtattcaattaggag

SEQ ID NO: 140574 - DNA, 20 bp, Artificial Sequence
  chemically synthesized
agggtattcaattaggagaa

SEQ ID NO: 140575 - DNA, 20 bp, Artificial Sequence
  chemically synthesized
gggtattcaattaggagaag

SEQ ID NO: 140576 - DNA, 20 bp, Artificial Sequence
  chemically synthesized
tattcaattaggagaagagg

SEQ ID NO: 140577 - DNA, 20 bp, Artificial Sequence
  chemically synthesized
agtcaaattgtccctgtttg

SEQ ID NO: 140578 - DNA, 20 bp, Artificial Sequence
  chemically synthesized
aatcatgtcgtctgcaaaca

SEQ ID NO: 140579 - DNA, 20 bp, Artificial Sequence
  chemically synthesized
caatcatgtcgtctgcaaac

SEQ ID NO: 140580 - DNA, 20 bp, Artificial Sequence
  chemically synthesized
acaatcatgtcgtctgcaaa

SEQ ID NO: 140581 - DNA, 20 bp, Artificial Sequence
  chemically synthesized
agacgacatgattgtatatc

SEQ ID NO: 140582 - DNA, 20 bp, Artificial Sequence
  chemically synthesized
gctgagacaatggggttttc

SEQ ID NO: 140583 - DNA, 20 bp, Artificial Sequence
  chemically synthesized
gattttgggctgagacaatg

SEQ ID NO: 140584 - DNA, 20 bp, Artificial Sequence
  chemically synthesized
tctagaaaaccccattgtct

SEQ ID NO: 140585 - DNA, 20 bp, Artificial Sequence
  chemically synthesized
agattttgggctgagacaat

SEQ ID NO: 140586 - DNA, 20 bp, Artificial Sequence
  chemically synthesized
gagattttgggctgagacaa

SEQ ID NO: 140587 - DNA, 20 bp, Artificial Sequence
  chemically synthesized
gcttaaggagattttgggct

SEQ ID NO: 140588 - DNA, 20 bp, Artificial Sequence
  chemically synthesized
tatcagcttaaggagatttt

SEQ ID NO: 140589 - DNA, 20 bp, Artificial Sequence
  chemically synthesized
ttatcagcttaaggagattt

SEQ ID NO: 140590 - DNA, 20 bp, Artificial Sequence
  chemically synthesized
tctcagcccaaaatctcctt

SEQ ID NO: 140591 - DNA, 20 bp, Artificial Sequence
  chemically synthesized
aagttgcttatcagcttaag

SEQ ID NO: 140592 - DNA, 20 bp, Artificial Sequence
  chemically synthesized
tgaagttgcttatcagctta

SEQ ID NO: 140593 - DNA, 20 bp, Artificial Sequence
  chemically synthesized
ctgaagttgcttatcagctt

SEQ ID NO: 140594 - DNA, 20 bp, Artificial Sequence
  chemically synthesized
caaaatctccttaagctgat

SEQ ID NO: 140595 - DNA, 20 bp, Artificial Sequence
  chemically synthesized
actttgctgaagttgcttat

SEQ ID NO: 140596 - DNA, 20 bp, Artificial Sequence
  chemically synthesized
cttaagctgataagcaactt

SEQ ID NO: 140597 - DNA, 20 bp, Artificial Sequence
  chemically synthesized
gctgataagcaacttcagca

SEQ ID NO: 140598 - DNA, 20 bp, Artificial Sequence
  chemically synthesized
tgtatcctgagactttgctg

SEQ ID NO: 140599 - DNA, 20 bp, Artificial Sequence
  chemically synthesized
aagcaacttcagcaaagtct

SEQ ID NO: 140600 - DNA, 20 bp, Artificial Sequence
  chemically synthesized
agcaacttcagcaaagtctc

SEQ ID NO: 140601 - DNA, 20 bp, Artificial Sequence
  chemically synthesized
gtacattgattttgtatcct

SEQ ID NO: 140602 - DNA, 20 bp, Artificial Sequence
  chemically synthesized
aatcaatgtacaaaaatcac

SEQ ID NO: 140603 - DNA, 20 bp, Artificial Sequence
  chemically synthesized
tttgtctgtcgttggtgtat

SEQ ID NO: 140604 - DNA, 20 bp, Artificial Sequence
  chemically synthesized
gcattcttatacaccaacga

SEQ ID NO: 140605 - DNA, 20 bp, Artificial Sequence
  chemically synthesized
gctctctgtttgtctgtcgt

SEQ ID NO: 140606 - DNA, 20 bp, Artificial Sequence
  chemically synthesized
atacaccaacgacagacaaa

SEQ ID NO: 140607 - DNA, 20 bp, Artificial Sequence
  chemically synthesized
acaccaacgacagacaaaca

SEQ ID NO: 140608 - DNA, 20 bp, Artificial Sequence
  chemically synthesized
accaacgacagacaaacaga

SEQ ID NO: 140609 - DNA, 20 bp, Artificial Sequence
  chemically synthesized
caaacagagagccaaatcat

SEQ ID NO: 140610 - DNA, 20 bp, Artificial Sequence
  chemically synthesized
atgggagttcactcatgatt

SEQ ID NO: 140611 - DNA, 20 bp, Artificial Sequence
  chemically synthesized
tttgaagcaattgtgaatgg

SEQ ID NO: 140612 - DNA, 20 bp, Artificial Sequence
  chemically synthesized
tctttgaagcaattgtgaat

SEQ ID NO: 140613 - DNA, 20 bp, Artificial Sequence
  chemically synthesized
ctctttgaagcaattgtgaa

SEQ ID NO: 140614 - DNA, 20 bp, Artificial Sequence
  chemically synthesized
tcccattcacaattgcttca

SEQ ID NO: 140615 - DNA, 20 bp, Artificial Sequence
  chemically synthesized
ccattcacaattgcttcaaa

SEQ ID NO: 140616 - DNA, 20 bp, Artificial Sequence
  chemically synthesized
taggtattttattctctttg

SEQ ID NO: 140617 - DNA, 20 bp, Artificial Sequence
  chemically synthesized
ttcaaagagaataaaatacc

SEQ ID NO: 140618 - DNA, 20 bp, Artificial Sequence
  chemically synthesized
tcaaagagaataaaatacct

SEQ ID NO: 140619 - DNA, 20 bp, Artificial Sequence
  chemically synthesized
cgcttgtaagttggattcct

SEQ ID NO: 140620 - DNA, 20 bp, Artificial Sequence
  chemically synthesized
tcgcttgtaagttggattcc

SEQ ID NO: 140621 - DNA, 20 bp, Artificial Sequence
  chemically synthesized
tacctaggaatccaacttac

SEQ ID NO: 140622 - DNA, 20 bp, Artificial Sequence
  chemically synthesized
ccttcacatcgcttgtaagt

SEQ ID NO: 140623 - DNA, 20 bp, Artificial Sequence
  chemically synthesized
aggtccttcacatcgcttgt

SEQ ID NO: 140624 - DNA, 20 bp, Artificial Sequence
  chemically synthesized
tccaacttacaagcgatgtg

SEQ ID NO: 140625 - DNA, 20 bp, Artificial Sequence
  chemically synthesized
ccaacttacaagcgatgtga

SEQ ID NO: 140626 - DNA, 20 bp, Artificial Sequence
  chemically synthesized
gcgatgtgaaggacctcttc

SEQ ID NO: 140627 - DNA, 20 bp, Artificial Sequence
  chemically synthesized
cgatgtgaaggacctcttca

SEQ ID NO: 140628 - DNA, 20 bp, Artificial Sequence
  chemically synthesized
atgtgaaggacctcttcaag

SEQ ID NO: 140629 - DNA, 20 bp, Artificial Sequence
  chemically synthesized
gtttgtagttctccttgaag

SEQ ID NO: 140630 - DNA, 20 bp, Artificial Sequence
  chemically synthesized
ggtttgtagttctccttgaa

SEQ ID NO: 140631 - DNA, 20 bp, Artificial Sequence
  chemically synthesized
gtggtttgtagttctccttg

SEQ ID NO: 140632 - DNA, 20 bp, Artificial Sequence
  chemically synthesized
tttccttgagcagtggtttg

SEQ ID NO: 140633 - DNA, 20 bp, Artificial Sequence
  chemically synthesized
agaactacaaaccactgctc

SEQ ID NO: 140634 - DNA, 20 bp, Artificial Sequence
  chemically synthesized
gaactacaaaccactgctca

SEQ ID NO: 140635 - DNA, 20 bp, Artificial Sequence
  chemically synthesized
tcttttatttccttgagcag

SEQ ID NO: 140636 - DNA, 20 bp, Artificial Sequence
  chemically synthesized
tcctcttttatttccttgag

SEQ ID NO: 140637 - DNA, 20 bp, Artificial Sequence
  chemically synthesized
gtgtcctcttttatttcctt

SEQ ID NO: 140638 - DNA, 20 bp, Artificial Sequence
  chemically synthesized
accactgctcaaggaaataa

SEQ ID NO: 140639 - DNA, 20 bp, Artificial Sequence
  chemically synthesized
cactgctcaaggaaataaaa

SEQ ID NO: 140640 - DNA, 20 bp, Artificial Sequence
  chemically synthesized
actgctcaaggaaataaaag

SEQ ID NO: 140641 - DNA, 20 bp, Artificial Sequence
  chemically synthesized
taaaagaggacacaaacaaa

SEQ ID NO: 140642 - DNA, 20 bp, Artificial Sequence
  chemically synthesized
aagaggacacaaacaaatgg

SEQ ID NO: 140643 - DNA, 20 bp, Artificial Sequence
  chemically synthesized
ggaagaacattccgtgctca

SEQ ID NO: 140644 - DNA, 20 bp, Artificial Sequence
  chemically synthesized
gaagaacattccgtgctcat

SEQ ID NO: 140645 - DNA, 20 bp, Artificial Sequence
  chemically synthesized
attcttcctacccatgagca

SEQ ID NO: 140646 - DNA, 20 bp, Artificial Sequence
  chemically synthesized
gaacattccgtgctcatggg

SEQ ID NO: 140647 - DNA, 20 bp, Artificial Sequence
  chemically synthesized
aacattccgtgctcatgggt

SEQ ID NO: 140648 - DNA, 20 bp, Artificial Sequence
  chemically synthesized
tattgattcttcctacccat

SEQ ID NO: 140649 - DNA, 20 bp, Artificial Sequence
  chemically synthesized
attccgtgctcatgggtagg

SEQ ID NO: 140650 - DNA, 20 bp, Artificial Sequence
  chemically synthesized
aagaatcaatatcgtgtaaa

SEQ ID NO: 140651 - DNA, 20 bp, Artificial Sequence
  chemically synthesized
gtaaattaccttgggcagta

SEQ ID NO: 140652 - DNA, 20 bp, Artificial Sequence
  chemically synthesized
tgtaaatggccatactgccc

SEQ ID NO: 140653 - DNA, 20 bp, Artificial Sequence
  chemically synthesized
gtaaatggccatactgccca

SEQ ID NO: 140654 - DNA, 20 bp, Artificial Sequence
  chemically synthesized
aatctgtaaattaccttggg

SEQ ID NO: 140655 - DNA, 20 bp, Artificial Sequence
  chemically synthesized
ttgaatctgtaaattacctt

SEQ ID NO: 140656 - DNA, 20 bp, Artificial Sequence
  chemically synthesized
attgaatctgtaaattacct

SEQ ID NO: 140657 - DNA, 20 bp, Artificial Sequence
  chemically synthesized
atactgcccaaggtaattta

SEQ ID NO: 140658 - DNA, 20 bp, Artificial Sequence
  chemically synthesized
cattggtagcttgatgggga

SEQ ID NO: 140659 - DNA, 20 bp, Artificial Sequence
  chemically synthesized
gattcaatgccatccccatc

SEQ ID NO: 140660 - DNA, 20 bp, Artificial Sequence
  chemically synthesized
aagtcattggtagcttgatg

SEQ ID NO: 140661 - DNA, 20 bp, Artificial Sequence
  chemically synthesized
aaagtcattggtagcttgat

SEQ ID NO: 140662 - DNA, 20 bp, Artificial Sequence
  chemically synthesized
gaaagtcattggtagcttga

SEQ ID NO: 140663 - DNA, 20 bp, Artificial Sequence
  chemically synthesized
tctgtgaagaaagtcattgg

SEQ ID NO: 140664 - DNA, 20 bp, Artificial Sequence
  chemically synthesized
aattctgtgaagaaagtcat

SEQ ID NO: 140665 - DNA, 20 bp, Artificial Sequence
  chemically synthesized
gctaccaatgactttcttca

SEQ ID NO: 140666 - DNA, 20 bp, Artificial Sequence
  chemically synthesized
tttttccaattctgtgaaga

SEQ ID NO: 140667 - DNA, 20 bp, Artificial Sequence
  chemically synthesized
tagttttttccaattctgtg

SEQ ID NO: 140668 - DNA, 20 bp, Artificial Sequence
  chemically synthesized
aatgactttcttcacagaat

SEQ ID NO: 140669 - DNA, 20 bp, Artificial Sequence
  chemically synthesized
aattggaaaaaactacttta

SEQ ID NO: 140670 - DNA, 20 bp, Artificial Sequence
  chemically synthesized
gttccatatgaactttaaag

SEQ ID NO: 140671 - DNA, 20 bp, Artificial Sequence
  chemically synthesized
ttggttccatatgaacttta

SEQ ID NO: 140672 - DNA, 20 bp, Artificial Sequence
  chemically synthesized
aaactactttaaagttcata

SEQ ID NO: 140673 - DNA, 20 bp, Artificial Sequence
  chemically synthesized
aagttcatatggaaccaaaa

SEQ ID NO: 140674 - DNA, 20 bp, Artificial Sequence
  chemically synthesized
gttcatatggaaccaaaaaa

SEQ ID NO: 140675 - DNA, 20 bp, Artificial Sequence
  chemically synthesized
tggcgatgcgggctcttttt

SEQ ID NO: 140676 - DNA, 20 bp, Artificial Sequence
  chemically synthesized
taggattgacttggcgatgc

SEQ ID NO: 140677 - DNA, 20 bp, Artificial Sequence
  chemically synthesized
aaaaaagagcccgcatcgcc

SEQ ID NO: 140678 - DNA, 20 bp, Artificial Sequence
  chemically synthesized
ttaggattgacttggcgatg

SEQ ID NO: 140679 - DNA, 20 bp, Artificial Sequence
  chemically synthesized
cttttggcttaggattgact

SEQ ID NO: 140680 - DNA, 20 bp, Artificial Sequence
  chemically synthesized
cgcatcgccaagtcaatcct

SEQ ID NO: 140681 - DNA, 20 bp, Artificial Sequence
  chemically synthesized
ccaagtcaatcctaagccaa

SEQ ID NO: 140682 - DNA, 20 bp, Artificial Sequence
  chemically synthesized
cagctttgttcttttggctt

SEQ ID NO: 140683 - DNA, 20 bp, Artificial Sequence
  chemically synthesized
ccagctttgttcttttggct

SEQ ID NO: 140684 - DNA, 20 bp, Artificial Sequence
  chemically synthesized
tgcctccagctttgttcttt

SEQ ID NO: 140685 - DNA, 20 bp, Artificial Sequence
  chemically synthesized
aatcctaagccaaaagaaca

SEQ ID NO: 140686 - DNA, 20 bp, Artificial Sequence
  chemically synthesized
ctaagccaaaagaacaaagc

SEQ ID NO: 140687 - DNA, 20 bp, Artificial Sequence
  chemically synthesized
aagccaaaagaacaaagctg

SEQ ID NO: 140688 - DNA, 20 bp, Artificial Sequence
  chemically synthesized
agccaaaagaacaaagctgg

SEQ ID NO: 140689 - DNA, 20 bp, Artificial Sequence
  chemically synthesized
gtcaggtagcgtgatgcctc

SEQ ID NO: 140690 - DNA, 20 bp, Artificial Sequence
  chemically synthesized
tagtatagtttgaagtcagg

SEQ ID NO: 140691 - DNA, 20 bp, Artificial Sequence
  chemically synthesized
ctttagtatagtttgaagtc

SEQ ID NO: 140692 - DNA, 20 bp, Artificial Sequence
  chemically synthesized
cctttagtatagtttgaagt

SEQ ID NO: 140693 - DNA, 20 bp, Artificial Sequence
  chemically synthesized
ctatcctttagtatagtttg

SEQ ID NO: 140694 - DNA, 20 bp, Artificial Sequence
  chemically synthesized
cctgacttcaaactatacta

SEQ ID NO: 140695 - DNA, 20 bp, Artificial Sequence
  chemically synthesized
ctgacttcaaactatactaa

SEQ ID NO: 140696 - DNA, 20 bp, Artificial Sequence
  chemically synthesized
tcaaatgctatcctttagta

SEQ ID NO: 140697 - DNA, 20 bp, Artificial Sequence
  chemically synthesized
cttcaaactatactaaagga

SEQ ID NO: 140698 - DNA, 20 bp, Artificial Sequence
  chemically synthesized
tgagttcaaatgctatcctt

SEQ ID NO: 140699 - DNA, 20 bp, Artificial Sequence
  chemically synthesized
taaaggatagcatttgaact

SEQ ID NO: 140700 - DNA, 20 bp, Artificial Sequence
  chemically synthesized
aaaggatagcatttgaactc

SEQ ID NO: 140701 - DNA, 20 bp, Artificial Sequence
  chemically synthesized
cttaggagtcagaaagacct

SEQ ID NO: 140702 - DNA, 20 bp, Artificial Sequence
  chemically synthesized
ggctagacttaggagtcaga

SEQ ID NO: 140703 - DNA, 20 bp, Artificial Sequence
  chemically synthesized
ctcaggtctttctgactcct

SEQ ID NO: 140704 - DNA, 20 bp, Artificial Sequence
  chemically synthesized
acagggctagacttaggagt

SEQ ID NO: 140705 - DNA, 20 bp, Artificial Sequence
  chemically synthesized
gtctttctgactcctaagtc

SEQ ID NO: 140706 - DNA, 20 bp, Artificial Sequence
  chemically synthesized
gtggacagggctagacttag

SEQ ID NO: 140707 - DNA, 20 bp, Artificial Sequence
  chemically synthesized
atgtggacagggctagactt

SEQ ID NO: 140708 - DNA, 20 bp, Artificial Sequence
  chemically synthesized
catgtggacagggctagact

SEQ ID NO: 140709 - DNA, 20 bp, Artificial Sequence
  chemically synthesized
ttatgacatgtggacagggc

SEQ ID NO: 140710 - DNA, 20 bp, Artificial Sequence
  chemically synthesized
gaccttatgacatgtggaca

SEQ ID NO: 140711 - DNA, 20 bp, Artificial Sequence
  chemically synthesized
agaccttatgacatgtggac

SEQ ID NO: 140712 - DNA, 20 bp, Artificial Sequence
  chemically synthesized
gagaccttatgacatgtgga

SEQ ID NO: 140713 - DNA, 20 bp, Artificial Sequence
  chemically synthesized
ggaagagaccttatgacatg

SEQ ID NO: 140714 - DNA, 20 bp, Artificial Sequence
  chemically synthesized
tagccctgtccacatgtcat

SEQ ID NO: 140715 - DNA, 20 bp, Artificial Sequence
  chemically synthesized
agccctgtccacatgtcata

SEQ ID NO: 140716 - DNA, 20 bp, Artificial Sequence
  chemically synthesized
atgtcataaggtctcttccc

SEQ ID NO: 140717 - DNA, 20 bp, Artificial Sequence
  chemically synthesized
gaagcagagttgcttgggaa

SEQ ID NO: 140718 - DNA, 20 bp, Artificial Sequence
  chemically synthesized
aggaagcagagttgcttggg

SEQ ID NO: 140719 - DNA, 20 bp, Artificial Sequence
  chemically synthesized
aataggaagcagagttgctt

SEQ ID NO: 140720 - DNA, 20 bp, Artificial Sequence
  chemically synthesized
gaataggaagcagagttgct

SEQ ID NO: 140721 - DNA, 20 bp, Artificial Sequence
  chemically synthesized
aagtgttagaataggaagca

SEQ ID NO: 140722 - DNA, 20 bp, Artificial Sequence
  chemically synthesized
ataagtgttagaataggaag

SEQ ID NO: 140723 - DNA, 20 bp, Artificial Sequence
  chemically synthesized
ggaataagtgttagaatagg

SEQ ID NO: 140724 - DNA, 20 bp, Artificial Sequence
  chemically synthesized
taaggaataagtgttagaat

SEQ ID NO: 140725 - DNA, 20 bp, Artificial Sequence
  chemically synthesized
gtaaggaataagtgttagaa

SEQ ID NO: 140726 - DNA, 20 bp, Artificial Sequence
  chemically synthesized
ggaaagtaaggaataagtgt

SEQ ID NO: 140727 - DNA, 20 bp, Artificial Sequence
  chemically synthesized
gaggcaggaaagtaaggaat

SEQ ID NO: 140728 - DNA, 20 bp, Artificial Sequence
  chemically synthesized
gtcacagaggcaggaaagta

SEQ ID NO: 140729 - DNA, 20 bp, Artificial Sequence
  chemically synthesized
agtcacagaggcaggaaagt

SEQ ID NO: 140730 - DNA, 20 bp, Artificial Sequence
  chemically synthesized
ccagagtcacagaggcagga

SEQ ID NO: 140731 - DNA, 20 bp, Artificial Sequence
  chemically synthesized
agaaccagagtcacagaggc

SEQ ID NO: 140732 - DNA, 20 bp, Artificial Sequence
  chemically synthesized
gagaaccagagtcacagagg

SEQ ID NO: 140733 - DNA, 20 bp, Artificial Sequence
  chemically synthesized
catgagaaccagagtcacag

SEQ ID NO: 140734 - DNA, 20 bp, Artificial Sequence
  chemically synthesized
gcatgagaaccagagtcaca

SEQ ID NO: 140735 - DNA, 20 bp, Artificial Sequence
  chemically synthesized
ctttcctgcctctgtgactc

SEQ ID NO: 140736 - DNA, 20 bp, Artificial Sequence
  chemically synthesized
tggcatgagaaccagagtca

SEQ ID NO: 140737 - DNA, 20 bp, Artificial Sequence
  chemically synthesized
atttggtggcatgagaacca

SEQ ID NO: 140738 - DNA, 20 bp, Artificial Sequence
  chemically synthesized
ggatttggtggcatgagaac

SEQ ID NO: 140739 - DNA, 20 bp, Artificial Sequence
  chemically synthesized
gttgatggatttggtggcat

SEQ ID NO: 140740 - DNA, 20 bp, Artificial Sequence
  chemically synthesized
ggaagtgttgatggatttgg

SEQ ID NO: 140741 - DNA, 20 bp, Artificial Sequence
  chemically synthesized
caaggaagtgttgatggatt

SEQ ID NO: 140742 - DNA, 20 bp, Artificial Sequence
  chemically synthesized
ggactgcaaggaagtgttga

SEQ ID NO: 140743 - DNA, 20 bp, Artificial Sequence
  chemically synthesized
aatccatcaacacttccttg

SEQ ID NO: 140744 - DNA, 20 bp, Artificial Sequence
  chemically synthesized
ttagaaacaggactgcaagg

SEQ ID NO: 140745 - DNA, 20 bp, Artificial Sequence
  chemically synthesized
attttagaaacaggactgca

SEQ ID NO: 140746 - DNA, 20 bp, Artificial Sequence
  chemically synthesized
tattttagaaacaggactgc

SEQ ID NO: 140747 - DNA, 20 bp, Artificial Sequence
  chemically synthesized
ctgaattctattttagaaac

SEQ ID NO: 140748 - DNA, 20 bp, Artificial Sequence
  chemically synthesized
actgaattctattttagaaa

SEQ ID NO: 140749 - DNA, 20 bp, Artificial Sequence
  chemically synthesized
ttgcagtcctgtttctaaaa

SEQ ID NO: 140750 - DNA, 20 bp, Artificial Sequence
  chemically synthesized
taacccactgaattctattt

SEQ ID NO: 140751 - DNA, 20 bp, Artificial Sequence
  chemically synthesized
cctgtttctaaaatagaatt

SEQ ID NO: 140752 - DNA, 20 bp, Artificial Sequence
  chemically synthesized
gtttctaaaatagaattcag

SEQ ID NO: 140753 - DNA, 20 bp, Artificial Sequence
  chemically synthesized
tttctaaaatagaattcagt

SEQ ID NO: 140754 - DNA, 20 bp, Artificial Sequence
  chemically synthesized
aaacaaatcatgattttaaa

SEQ ID NO: 140755 - DNA, 20 bp, Artificial Sequence
  chemically synthesized
caaatcatgattttaaaaag

SEQ ID NO: 140756 - DNA, 20 bp, Artificial Sequence
  chemically synthesized
atcatgattttaaaaagcag

SEQ ID NO: 140757 - DNA, 20 bp, Artificial Sequence
  chemically synthesized
tcatgattttaaaaagcaga

SEQ ID NO: 140758 - DNA, 20 bp, Artificial Sequence
  chemically synthesized
catgattttaaaaagcagaa

SEQ ID NO: 140759 - DNA, 20 bp, Artificial Sequence
  chemically synthesized
agaagggaaaactacacaat

SEQ ID NO: 140760 - DNA, 20 bp, Artificial Sequence
  chemically synthesized
ggagaagcaagccaattgtg

SEQ ID NO: 140761 - DNA, 20 bp, Artificial Sequence
  chemically synthesized
agagaaagatgaggagaagc

SEQ ID NO: 140762 - DNA, 20 bp, Artificial Sequence
  chemically synthesized
agttagagaaagatgaggag

SEQ ID NO: 140763 - DNA, 20 bp, Artificial Sequence
  chemically synthesized
tgaagttagagaaagatgag

SEQ ID NO: 140764 - DNA, 20 bp, Artificial Sequence
  chemically synthesized
aatgaagttagagaaagatg

SEQ ID NO: 140765 - DNA, 20 bp, Artificial Sequence
  chemically synthesized
aaatgaagttagagaaagat

SEQ ID NO: 140766 - DNA, 20 bp, Artificial Sequence
  chemically synthesized
gctggaaatgaagttagaga

SEQ ID NO: 140767 - DNA, 20 bp, Artificial Sequence
  chemically synthesized
tccagctggaaatgaagtta

SEQ ID NO: 140768 - DNA, 20 bp, Artificial Sequence
  chemically synthesized
tgtccagctggaaatgaagt

SEQ ID NO: 140769 - DNA, 20 bp, Artificial Sequence
  chemically synthesized
tctttctctaacttcatttc

SEQ ID NO: 140770 - DNA, 20 bp, Artificial Sequence
  chemically synthesized
aaagtgtccagctggaaatg

SEQ ID NO: 140771 - DNA, 20 bp, Artificial Sequence
  chemically synthesized
tctctaacttcatttccagc

SEQ ID NO: 140772 - DNA, 20 bp, Artificial Sequence
  chemically synthesized
aaaagggaaaagtgtccagc

SEQ ID NO: 140773 - DNA, 20 bp, Artificial Sequence
  chemically synthesized
aacaaaaagggaaaagtgtc

SEQ ID NO: 140774 - DNA, 20 bp, Artificial Sequence
  chemically synthesized
aaagcagaacaaaaagggaa

SEQ ID NO: 140775 - DNA, 20 bp, Artificial Sequence
  chemically synthesized
ataataaagcagaacaaaaa

SEQ ID NO: 140776 - DNA, 20 bp, Artificial Sequence
  chemically synthesized
aataataaagcagaacaaaa

SEQ ID NO: 140777 - DNA, 20 bp, Artificial Sequence
  chemically synthesized
taataataaagcagaacaaa

SEQ ID NO: 140778 - DNA, 20 bp, Artificial Sequence
  chemically synthesized
tgtgtgaaataataataaag

SEQ ID NO: 140779 - DNA, 20 bp, Artificial Sequence
  chemically synthesized
atttgtgtgaaataataata

SEQ ID NO: 140780 - DNA, 20 bp, Artificial Sequence
  chemically synthesized
ttatttcacacaaatacatt

SEQ ID NO: 140781 - DNA, 20 bp, Artificial Sequence
  chemically synthesized
atttccagcattagaacaaa

SEQ ID NO: 140782 - DNA, 20 bp, Artificial Sequence
  chemically synthesized
tatttccagcattagaacaa

SEQ ID NO: 140783 - DNA, 20 bp, Artificial Sequence
  chemically synthesized
gtcaccttttgttctaatgc

SEQ ID NO: 140784 - DNA, 20 bp, Artificial Sequence
  chemically synthesized
tgaatttgtatttccagcat

SEQ ID NO: 140785 - DNA, 20 bp, Artificial Sequence
  chemically synthesized
gccatatgaatttgtatttc

SEQ ID NO: 140786 - DNA, 20 bp, Artificial Sequence
  chemically synthesized
gctggaaatacaaattcata

SEQ ID NO: 140787 - DNA, 20 bp, Artificial Sequence
  chemically synthesized
acaaattcatatggctaaaa

SEQ ID NO: 140788 - DNA, 20 bp, Artificial Sequence
  chemically synthesized
aaattcatatggctaaaacg

SEQ ID NO: 140789 - DNA, 20 bp, Artificial Sequence
  chemically synthesized
tgtcatggtccactccgttt

SEQ ID NO: 140790 - DNA, 20 bp, Artificial Sequence
  chemically synthesized
ttcatatggctaaaacggag

SEQ ID NO: 140791 - DNA, 20 bp, Artificial Sequence
  chemically synthesized
ggggtctgggggcaatgtca

SEQ ID NO: 140792 - DNA, 20 bp, Artificial Sequence
  chemically synthesized
gtggaccatgacattgcccc

SEQ ID NO: 140793 - DNA, 20 bp, Artificial Sequence
  chemically synthesized
ggaataaaagtggggtctgg

SEQ ID NO: 140794 - DNA, 20 bp, Artificial Sequence
  chemically synthesized
aggaataaaagtggggtctg

SEQ ID NO: 140795 - DNA, 20 bp, Artificial Sequence
  chemically synthesized
aaggaataaaagtggggtct

SEQ ID NO: 140796 - DNA, 20 bp, Artificial Sequence
  chemically synthesized
caaggaataaaagtggggtc

SEQ ID NO: 140797 - DNA, 20 bp, Artificial Sequence
  chemically synthesized
aattacaaggaataaaagtg

SEQ ID NO: 140798 - DNA, 20 bp, Artificial Sequence
  chemically synthesized
taattacaaggaataaaagt

SEQ ID NO: 140799 - DNA, 20 bp, Artificial Sequence
  chemically synthesized
ttaattacaaggaataaaag

SEQ ID NO: 140800 - DNA, 20 bp, Artificial Sequence
  chemically synthesized
ttcttaattacaaggaataa

SEQ ID NO: 140801 - DNA, 20 bp, Artificial Sequence
  chemically synthesized
cacttttattccttgtaatt

SEQ ID NO: 140802 - DNA, 20 bp, Artificial Sequence
  chemically synthesized
tttattttttcttaattaca

SEQ ID NO: 140803 - DNA, 20 bp, Artificial Sequence
  chemically synthesized
gtttattttttcttaattac

SEQ ID NO: 140804 - DNA, 20 bp, Artificial Sequence
  chemically synthesized
aagaaaaaataaaccttaat

SEQ ID NO: 140805 - DNA, 20 bp, Artificial Sequence
  chemically synthesized
aaaaaataaaccttaataag

SEQ ID NO: 140806 - DNA, 20 bp, Artificial Sequence
  chemically synthesized
ttaatacaagcttcttatta

SEQ ID NO: 140807 - DNA, 20 bp, Artificial Sequence
  chemically synthesized
tttaatacaagcttcttatt

SEQ ID NO: 140808 - DNA, 20 bp, Artificial Sequence
  chemically synthesized
actttgcacaattttaatac

SEQ ID NO: 140809 - DNA, 20 bp, Artificial Sequence
  chemically synthesized
gcttgtattaaaattgtgca

SEQ ID NO: 140810 - DNA, 20 bp, Artificial Sequence
  chemically synthesized
gtattaaaattgtgcaaagt

SEQ ID NO: 140811 - DNA, 20 bp, Artificial Sequence
  chemically synthesized
ctaatacagccatgaacatt

SEQ ID NO: 140812 - DNA, 20 bp, Artificial Sequence
  chemically synthesized
tagtcattactaaatgttca

SEQ ID NO: 140813 - DNA, 20 bp, Artificial Sequence
  chemically synthesized
ctaaatgttcatggctgtat

SEQ ID NO: 140814 - DNA, 20 bp, Artificial Sequence
  chemically synthesized
acagccacaggcagctaata

SEQ ID NO: 140815 - DNA, 20 bp, Artificial Sequence
  chemically synthesized
atggctgtattagctgcctg

SEQ ID NO: 140816 - DNA, 20 bp, Artificial Sequence
  chemically synthesized
tttgttacaacagccacagg

SEQ ID NO: 140817 - DNA, 20 bp, Artificial Sequence
  chemically synthesized
tcatttgttacaacagccac

SEQ ID NO: 140818 - DNA, 20 bp, Artificial Sequence
  chemically synthesized
atcatttgttacaacagcca

SEQ ID NO: 140819 - DNA, 20 bp, Artificial Sequence
  chemically synthesized
tctgtaatcatttgttacaa

SEQ ID NO: 140820 - DNA, 20 bp, Artificial Sequence
  chemically synthesized
gctgttgtaacaaatgatta

SEQ ID NO: 140821 - DNA, 20 bp, Artificial Sequence
  chemically synthesized
acaaatgattacagacttaa

SEQ ID NO: 140822 - DNA, 20 bp, Artificial Sequence
  chemically synthesized
ttgggttgttttaagccatt

SEQ ID NO: 140823 - DNA, 20 bp, Artificial Sequence
  chemically synthesized
taataaatttgggttgtttt

SEQ ID NO: 140824 - DNA, 20 bp, Artificial Sequence
  chemically synthesized
aattgtaagataataaattt

SEQ ID NO: 140825 - DNA, 20 bp, Artificial Sequence
  chemically synthesized
aaattgtaagataataaatt

SEQ ID NO: 140826 - DNA, 20 bp, Artificial Sequence
  chemically synthesized
aatttattatcttacaattt

SEQ ID NO: 140827 - DNA, 20 bp, Artificial Sequence
  chemically synthesized
ctttggacctccaaaattgt

SEQ ID NO: 140828 - DNA, 20 bp, Artificial Sequence
  chemically synthesized
tttattatcttacaattttg

SEQ ID NO: 140829 - DNA, 20 bp, Artificial Sequence
  chemically synthesized
ttattatcttacaattttgg

SEQ ID NO: 140830 - DNA, 20 bp, Artificial Sequence
  chemically synthesized
cttacaattttggaggtcca

SEQ ID NO: 140831 - DNA, 20 bp, Artificial Sequence
  chemically synthesized
gagacccattttttggactt

SEQ ID NO: 140832 - DNA, 20 bp, Artificial Sequence
  chemically synthesized
gaggtccaaagtccaaaaaa

SEQ ID NO: 140833 - DNA, 20 bp, Artificial Sequence
  chemically synthesized
aggtccaaagtccaaaaaat

SEQ ID NO: 140834 - DNA, 20 bp, Artificial Sequence
  chemically synthesized
agcttgtgagacccattttt

SEQ ID NO: 140835 - DNA, 20 bp, Artificial Sequence
  chemically synthesized
gtccaaaaaatgggtctcac

SEQ ID NO: 140836 - DNA, 20 bp, Artificial Sequence
  chemically synthesized
aaaaaatgggtctcacaagc

SEQ ID NO: 140837 - DNA, 20 bp, Artificial Sequence
  chemically synthesized
acacattgtttctagcttgt

SEQ ID NO: 140838 - DNA, 20 bp, Artificial Sequence
  chemically synthesized
ctctgccaacacattgtttc

SEQ ID NO: 140839 - DNA, 20 bp, Artificial Sequence
  chemically synthesized
acaagctagaaacaatgtgt

SEQ ID NO: 140840 - DNA, 20 bp, Artificial Sequence
  chemically synthesized
agctagaaacaatgtgttgg

SEQ ID NO: 140841 - DNA, 20 bp, Artificial Sequence
  chemically synthesized
ctagaaacaatgtgttggca

SEQ ID NO: 140842 - DNA, 20 bp, Artificial Sequence
  chemically synthesized
acatcccttagagggaatgc

SEQ ID NO: 140843 - DNA, 20 bp, Artificial Sequence
  chemically synthesized
gcagagcttgcattccctct

SEQ ID NO: 140844 - DNA, 20 bp, Artificial Sequence
  chemically synthesized
cagagcttgcattccctcta

SEQ ID NO: 140845 - DNA, 20 bp, Artificial Sequence
  chemically synthesized
agagcttgcattccctctaa

SEQ ID NO: 140846 - DNA, 20 bp, Artificial Sequence
  chemically synthesized
cctcccctacatcccttaga

SEQ ID NO: 140847 - DNA, 20 bp, Artificial Sequence
  chemically synthesized
tcctcccctacatcccttag

SEQ ID NO: 140848 - DNA, 20 bp, Artificial Sequence
  chemically synthesized
atcctcccctacatccctta

SEQ ID NO: 140849 - DNA, 20 bp, Artificial Sequence
  chemically synthesized
tgcattccctctaagggatg

SEQ ID NO: 140850 - DNA, 20 bp, Artificial Sequence
  chemically synthesized
gaatcctcccctacatccct

SEQ ID NO: 140851 - DNA, 20 bp, Artificial Sequence
  chemically synthesized
gcattccctctaagggatgt

SEQ ID NO: 140852 - DNA, 20 bp, Artificial Sequence
  chemically synthesized
cattccctctaagggatgta

SEQ ID NO: 140853 - DNA, 20 bp, Artificial Sequence
  chemically synthesized
attccctctaagggatgtag

SEQ ID NO: 140854 - DNA, 20 bp, Artificial Sequence
  chemically synthesized
tccctctaagggatgtaggg

SEQ ID NO: 140855 - DNA, 20 bp, Artificial Sequence
  chemically synthesized
ccctctaagggatgtagggg

SEQ ID NO: 140856 - DNA, 20 bp, Artificial Sequence
  chemically synthesized
aagctggaaaaggcatggaa

SEQ ID NO: 140857 - DNA, 20 bp, Artificial Sequence
  chemically synthesized
tctaaaagctggaaaaggca

SEQ ID NO: 140858 - DNA, 20 bp, Artificial Sequence
  chemically synthesized
attcttttccatgccttttc

SEQ ID NO: 140859 - DNA, 20 bp, Artificial Sequence
  chemically synthesized
caggctctaaaagctggaaa

SEQ ID NO: 140860 - DNA, 20 bp, Artificial Sequence
  chemically synthesized
gcaggctctaaaagctggaa

SEQ ID NO: 140861 - DNA, 20 bp, Artificial Sequence
  chemically synthesized
tccatgccttttccagcttt

SEQ ID NO: 140862 - DNA, 20 bp, Artificial Sequence
  chemically synthesized
catgccttttccagctttta

SEQ ID NO: 140863 - DNA, 20 bp, Artificial Sequence
  chemically synthesized
tgcaggcaggctctaaaagc

SEQ ID NO: 140864 - DNA, 20 bp, Artificial Sequence
  chemically synthesized
gaaatgcaggcaggctctaa

SEQ ID NO: 140865 - DNA, 20 bp, Artificial Sequence
  chemically synthesized
aagagccaagaaatgcaggc

SEQ ID NO: 140866 - DNA, 20 bp, Artificial Sequence
  chemically synthesized
caagagccaagaaatgcagg

SEQ ID NO: 140867 - DNA, 20 bp, Artificial Sequence
  chemically synthesized
ggccaagagccaagaaatgc

SEQ ID NO: 140868 - DNA, 20 bp, Artificial Sequence
  chemically synthesized
tagagcctgcctgcatttct

SEQ ID NO: 140869 - DNA, 20 bp, Artificial Sequence
  chemically synthesized
gggccaagagccaagaaatg

SEQ ID NO: 140870 - DNA, 20 bp, Artificial Sequence
  chemically synthesized
tgcctgcatttcttggctct

SEQ ID NO: 140871 - DNA, 20 bp, Artificial Sequence
  chemically synthesized
gaaggacagggccaagagcc

SEQ ID NO: 140872 - DNA, 20 bp, Artificial Sequence
  chemically synthesized
aagatgaaggacagggccaa

SEQ ID NO: 140873 - DNA, 20 bp, Artificial Sequence
  chemically synthesized
tgaagatgaaggacagggcc

SEQ ID NO: 140874 - DNA, 20 bp, Artificial Sequence
  chemically synthesized
ggcattgaagatgaaggaca

SEQ ID NO: 140875 - DNA, 20 bp, Artificial Sequence
  chemically synthesized
tggcattgaagatgaaggac

SEQ ID NO: 140876 - DNA, 20 bp, Artificial Sequence
  chemically synthesized
ctggcattgaagatgaagga

SEQ ID NO: 140877 - DNA, 20 bp, Artificial Sequence
  chemically synthesized
actactggcattgaagatga

SEQ ID NO: 140878 - DNA, 20 bp, Artificial Sequence
  chemically synthesized
cactactggcattgaagatg

SEQ ID NO: 140879 - DNA, 20 bp, Artificial Sequence
  chemically synthesized
ctgtccttcatcttcaatgc

SEQ ID NO: 140880 - DNA, 20 bp, Artificial Sequence
  chemically synthesized
atgctacactactggcattg

SEQ ID NO: 140881 - DNA, 20 bp, Artificial Sequence
  chemically synthesized
tccttcatcttcaatgccag

SEQ ID NO: 140882 - DNA, 20 bp, Artificial Sequence
  chemically synthesized
catcttcaatgccagtagtg

SEQ ID NO: 140883 - DNA, 20 bp, Artificial Sequence
  chemically synthesized
attggaagatgctacactac

SEQ ID NO: 140884 - DNA, 20 bp, Artificial Sequence
  chemically synthesized
cagagtaaaagagagattgg

SEQ ID NO: 140885 - DNA, 20 bp, Artificial Sequence
  chemically synthesized
aagcagagtaaaagagagat

SEQ ID NO: 140886 - DNA, 20 bp, Artificial Sequence
  chemically synthesized
gatacaagcagagtaaaaga

SEQ ID NO: 140887 - DNA, 20 bp, Artificial Sequence
  chemically synthesized
atgatacaagcagagtaaaa

SEQ ID NO: 140888 - DNA, 20 bp, Artificial Sequence
  chemically synthesized
tgatgatacaagcagagtaa

SEQ ID NO: 140889 - DNA, 20 bp, Artificial Sequence
  chemically synthesized
aggaggtgatgatacaagca

SEQ ID NO: 140890 - DNA, 20 bp, Artificial Sequence
  chemically synthesized
gaaggaggtgatgatacaag

SEQ ID NO: 140891 - DNA, 20 bp, Artificial Sequence
  chemically synthesized
agagaaggaggtgatgatac

SEQ ID NO: 140892 - DNA, 20 bp, Artificial Sequence
  chemically synthesized
agtcctcctaagagagaagg

SEQ ID NO: 140893 - DNA, 20 bp, Artificial Sequence
  chemically synthesized
gagtcctcctaagagagaag

SEQ ID NO: 140894 - DNA, 20 bp, Artificial Sequence
  chemically synthesized
atcatcacctccttctctct

SEQ ID NO: 140895 - DNA, 20 bp, Artificial Sequence
  chemically synthesized
aagagtcctcctaagagaga

SEQ ID NO: 140896 - DNA, 20 bp, Artificial Sequence
  chemically synthesized
tcatcacctccttctctctt

SEQ ID NO: 140897 - DNA, 20 bp, Artificial Sequence
  chemically synthesized
caagagtcctcctaagagag

SEQ ID NO: 140898 - DNA, 20 bp, Artificial Sequence
  chemically synthesized
atcacctccttctctcttag

SEQ ID NO: 140899 - DNA, 20 bp, Artificial Sequence
  chemically synthesized
tcacctccttctctcttagg

SEQ ID NO: 140900 - DNA, 20 bp, Artificial Sequence
  chemically synthesized
tcacaagagtcctcctaaga

SEQ ID NO: 140901 - DNA, 20 bp, Artificial Sequence
  chemically synthesized
aatcacaagagtcctcctaa

SEQ ID NO: 140902 - DNA, 20 bp, Artificial Sequence
  chemically synthesized
gtaatcacaagagtcctcct

SEQ ID NO: 140903 - DNA, 20 bp, Artificial Sequence
  chemically synthesized
tgcgcccaatgtaatcacaa

SEQ ID NO: 140904 - DNA, 20 bp, Artificial Sequence
  chemically synthesized
agtgcgcccaatgtaatcac

SEQ ID NO: 140905 - DNA, 20 bp, Artificial Sequence
  chemically synthesized
gaggactcttgtgattacat

SEQ ID NO: 140906 - DNA, 20 bp, Artificial Sequence
  chemically synthesized
aggactcttgtgattacatt

SEQ ID NO: 140907 - DNA, 20 bp, Artificial Sequence
  chemically synthesized
tgtgattacattgggcgcac

SEQ ID NO: 140908 - DNA, 20 bp, Artificial Sequence
  chemically synthesized
gtgattacattgggcgcact

SEQ ID NO: 140909 - DNA, 20 bp, Artificial Sequence
  chemically synthesized
tgattacattgggcgcactg

SEQ ID NO: 140910 - DNA, 20 bp, Artificial Sequence
  chemically synthesized
agagatagcctgggttaccc

SEQ ID NO: 140911 - DNA, 20 bp, Artificial Sequence
  chemically synthesized
ttgggcgcactggggtaacc

SEQ ID NO: 140912 - DNA, 20 bp, Artificial Sequence
  chemically synthesized
tgggcgcactggggtaaccc

SEQ ID NO: 140913 - DNA, 20 bp, Artificial Sequence
  chemically synthesized
ttgacacggagagatagcct

SEQ ID NO: 140914 - DNA, 20 bp, Artificial Sequence
  chemically synthesized
cttgacacggagagatagcc

SEQ ID NO: 140915 - DNA, 20 bp, Artificial Sequence
  chemically synthesized
aaaatcttgacacggagaga

SEQ ID NO: 140916 - DNA, 20 bp, Artificial Sequence
  chemically synthesized
gttaaaaatcttgacacgga

SEQ ID NO: 140917 - DNA, 20 bp, Artificial Sequence
  chemically synthesized
ccaggctatctctccgtgtc

SEQ ID NO: 140918 - DNA, 20 bp, Artificial Sequence
  chemically synthesized
aagttaaaaatcttgacacg

SEQ ID NO: 140919 - DNA, 20 bp, Artificial Sequence
  chemically synthesized
ttaagttaaaaatcttgaca

SEQ ID NO: 140920 - DNA, 20 bp, Artificial Sequence
  chemically synthesized
ttgtattaacagatgtggtt

SEQ ID NO: 140921 - DNA, 20 bp, Artificial Sequence
  chemically synthesized
aggctttgtattaacagatg

SEQ ID NO: 140922 - DNA, 20 bp, Artificial Sequence
  chemically synthesized
ggcaaaaggctttgtattaa

SEQ ID NO: 140923 - DNA, 20 bp, Artificial Sequence
  chemically synthesized
taaccacatctgttaataca

SEQ ID NO: 140924 - DNA, 20 bp, Artificial Sequence
  chemically synthesized
atgttaccttacatggcaaa

SEQ ID NO: 140925 - DNA, 20 bp, Artificial Sequence
  chemically synthesized
tatgttaccttacatggcaa

SEQ ID NO: 140926 - DNA, 20 bp, Artificial Sequence
  chemically synthesized
tacaaagccttttgccatgt

SEQ ID NO: 140927 - DNA, 20 bp, Artificial Sequence
  chemically synthesized
acaaagccttttgccatgta

SEQ ID NO: 140928 - DNA, 20 bp, Artificial Sequence
  chemically synthesized
tgtgaatatgttaccttaca

SEQ ID NO: 140929 - DNA, 20 bp, Artificial Sequence
  chemically synthesized
catgtaaggtaacatattca

SEQ ID NO: 140930 - DNA, 20 bp, Artificial Sequence
  chemically synthesized
atgtaaggtaacatattcac

SEQ ID NO: 140931 - DNA, 20 bp, Artificial Sequence
  chemically synthesized
gtaacatattcacaggttcc

SEQ ID NO: 140932 - DNA, 20 bp, Artificial Sequence
  chemically synthesized
taacatattcacaggttcct

SEQ ID NO: 140933 - DNA, 20 bp, Artificial Sequence
  chemically synthesized
tattcacaggttcctgggat

SEQ ID NO: 140934 - DNA, 20 bp, Artificial Sequence
  chemically synthesized
attcacaggttcctgggatt

SEQ ID NO: 140935 - DNA, 20 bp, Artificial Sequence
  chemically synthesized
gatgtccatatcctaatccc

SEQ ID NO: 140936 - DNA, 20 bp, Artificial Sequence
  chemically synthesized
agatgtccatatcctaatcc

SEQ ID NO: 140937 - DNA, 20 bp, Artificial Sequence
  chemically synthesized
aggttcctgggattaggata

SEQ ID NO: 140938 - DNA, 20 bp, Artificial Sequence
  chemically synthesized
gattaggatatggacatctt

SEQ ID NO: 140939 - DNA, 20 bp, Artificial Sequence
  chemically synthesized
taggatatggacatctttgg

SEQ ID NO: 140940 - DNA, 20 bp, Artificial Sequence
  chemically synthesized
aggatatggacatctttggc

SEQ ID NO: 140941 - DNA, 20 bp, Artificial Sequence
  chemically synthesized
ggatatggacatctttggcg

SEQ ID NO: 140942 - DNA, 20 bp, Artificial Sequence
  chemically synthesized
gatatggacatctttggcgg

SEQ ID NO: 140943 - DNA, 20 bp, Artificial Sequence
  chemically synthesized
tgcccactcctcccccgcca

SEQ ID NO: 140944 - DNA, 20 bp, Artificial Sequence
  chemically synthesized
tatggacatctttggcgggg

SEQ ID NO: 140945 - DNA, 20 bp, Artificial Sequence
  chemically synthesized
atggacatctttggcggggg

SEQ ID NO: 140946 - DNA, 20 bp, Artificial Sequence
  chemically synthesized
ggacatctttggcgggggag

SEQ ID NO: 140947 - DNA, 20 bp, Artificial Sequence
  chemically synthesized
catctttggcgggggaggag

SEQ ID NO: 140948 - DNA, 20 bp, Artificial Sequence
  chemically synthesized
atctttggcgggggaggagt

SEQ ID NO: 140949 - DNA, 20 bp, Artificial Sequence
  chemically synthesized
cattattaaacctttcacaa

SEQ ID NO: 140950 - DNA, 20 bp, Artificial Sequence
  chemically synthesized
aaatgcagaaccattgtgaa

SEQ ID NO: 140951 - DNA, 20 bp, Artificial Sequence
  chemically synthesized
taaatgcagaaccattgtga

SEQ ID NO: 140952 - DNA, 20 bp, Artificial Sequence
  chemically synthesized
cttctcatgctaagtaaatg

SEQ ID NO: 140953 - DNA, 20 bp, Artificial Sequence
  chemically synthesized
acaatggttctgcatttact

SEQ ID NO: 140954 - DNA, 20 bp, Artificial Sequence
  chemically synthesized
gttctgcatttacttagcat

SEQ ID NO: 140955 - DNA, 20 bp, Artificial Sequence
  chemically synthesized
gacaaacagcttctcatgct

SEQ ID NO: 140956 - DNA, 20 bp, Artificial Sequence
  chemically synthesized
ctgcatttacttagcatgag

SEQ ID NO: 140957 - DNA, 20 bp, Artificial Sequence
  chemically synthesized
gtatgtcacattgtgacaaa

SEQ ID NO: 140958 - DNA, 20 bp, Artificial Sequence
  chemically synthesized
acccacccgaagaagtatgt

SEQ ID NO: 140959 - DNA, 20 bp, Artificial Sequence
  chemically synthesized
gacatactgacatacttctt

SEQ ID NO: 140960 - DNA, 20 bp, Artificial Sequence
  chemically synthesized
acatactgacatacttcttc

SEQ ID NO: 140961 - DNA, 20 bp, Artificial Sequence
  chemically synthesized
tactgacatacttcttcggg

SEQ ID NO: 140962 - DNA, 20 bp, Artificial Sequence
  chemically synthesized
agtaccgaacccacccgaag

SEQ ID NO: 140963 - DNA, 20 bp, Artificial Sequence
  chemically synthesized
actgacatacttcttcgggt

SEQ ID NO: 140964 - DNA, 20 bp, Artificial Sequence
  chemically synthesized
catagtaccgaacccacccg

SEQ ID NO: 140965 - DNA, 20 bp, Artificial Sequence
  chemically synthesized
catacttcttcgggtgggtt

SEQ ID NO: 140966 - DNA, 20 bp, Artificial Sequence
  chemically synthesized
taactcttgtcgatgacaca

SEQ ID NO: 140967 - DNA, 20 bp, Artificial Sequence
  chemically synthesized
cggtactatgtgtcatcgac

SEQ ID NO: 140968 - DNA, 20 bp, Artificial Sequence
  chemically synthesized
gtactatgtgtcatcgacaa

SEQ ID NO: 140969 - DNA, 20 bp, Artificial Sequence
  chemically synthesized
tgtgtcatcgacaagagtta

SEQ ID NO: 140970 - DNA, 20 bp, Artificial Sequence
  chemically synthesized
agttacagtatctcacaatc

SEQ ID NO: 140971 - DNA, 20 bp, Artificial Sequence
  chemically synthesized
tcctgtgctttctagattgt

SEQ ID NO: 140972 - DNA, 20 bp, Artificial Sequence
  chemically synthesized
acagtatctcacaatctaga

SEQ ID NO: 140973 - DNA, 20 bp, Artificial Sequence
  chemically synthesized
atctcacaatctagaaagca

SEQ ID NO: 140974 - DNA, 20 bp, Artificial Sequence
  chemically synthesized
tttttgcctcctgtgctttc

SEQ ID NO: 140975 - DNA, 20 bp, Artificial Sequence
  chemically synthesized
tctcacaatctagaaagcac

SEQ ID NO: 140976 - DNA, 20 bp, Artificial Sequence
  chemically synthesized
tcacaatctagaaagcacag

SEQ ID NO: 140977 - DNA, 20 bp, Artificial Sequence
  chemically synthesized
cacaatctagaaagcacagg

SEQ ID NO: 140978 - DNA, 20 bp, Artificial Sequence
  chemically synthesized
agaaagcacaggaggcaaaa

SEQ ID NO: 140979 - DNA, 20 bp, Artificial Sequence
  chemically synthesized
aaaagcaaacaaaaaacaac

SEQ ID NO: 140980 - DNA, 20 bp, Artificial Sequence
  chemically synthesized
caaaaaacaaccagtcatac

SEQ ID NO: 140981 - DNA, 20 bp, Artificial Sequence
  chemically synthesized
acacaggagcctggtatgac

SEQ ID NO: 140982 - DNA, 20 bp, Artificial Sequence
  chemically synthesized
aaaaaacaaccagtcatacc

SEQ ID NO: 140983 - DNA, 20 bp, Artificial Sequence
  chemically synthesized
gccacaaggacacaggagcc

SEQ ID NO: 140984 - DNA, 20 bp, Artificial Sequence
  chemically synthesized
tgtctgccacaaggacacag

SEQ ID NO: 140985 - DNA, 20 bp, Artificial Sequence
  chemically synthesized
catgtctgccacaaggacac

SEQ ID NO: 140986 - DNA, 20 bp, Artificial Sequence
  chemically synthesized
ccatgtctgccacaaggaca

SEQ ID NO: 140987 - DNA, 20 bp, Artificial Sequence
  chemically synthesized
accaggctcctgtgtccttg

SEQ ID NO: 140988 - DNA, 20 bp, Artificial Sequence
  chemically synthesized
aggctcctgtgtccttgtgg

SEQ ID NO: 140989 - DNA, 20 bp, Artificial Sequence
  chemically synthesized
gttaaaccatgtctgccaca

SEQ ID NO: 140990 - DNA, 20 bp, Artificial Sequence
  chemically synthesized
ggttaaaccatgtctgccac

SEQ ID NO: 140991 - DNA, 20 bp, Artificial Sequence
  chemically synthesized
ctgtgtccttgtggcagaca

SEQ ID NO: 140992 - DNA, 20 bp, Artificial Sequence
  chemically synthesized
tggcagacatggtttaacca

SEQ ID NO: 140993 - DNA, 20 bp, Artificial Sequence
  chemically synthesized
ggcagacatggtttaaccaa

SEQ ID NO: 140994 - DNA, 20 bp, Artificial Sequence
  chemically synthesized
ttcccacttccggaggcctt

SEQ ID NO: 140995 - DNA, 20 bp, Artificial Sequence
  chemically synthesized
atggtttaaccaaaggcctc

SEQ ID NO: 140996 - DNA, 20 bp, Artificial Sequence
  chemically synthesized
gtttaaccaaaggcctccgg

SEQ ID NO: 140997 - DNA, 20 bp, Artificial Sequence
  chemically synthesized
taaccaaaggcctccggaag

SEQ ID NO: 140998 - DNA, 20 bp, Artificial Sequence
  chemically synthesized
tacacctttcccacttccgg

SEQ ID NO: 140999 - DNA, 20 bp, Artificial Sequence
  chemically synthesized
aaccaaaggcctccggaagt

SEQ ID NO: 141000 - DNA, 20 bp, Artificial Sequence
  chemically synthesized
atacacctttcccacttccg

SEQ ID NO: 141001 - DNA, 20 bp, Artificial Sequence
  chemically synthesized
caatacacctttcccacttc

SEQ ID NO: 141002 - DNA, 20 bp, Artificial Sequence
  chemically synthesized
aaaggcctccggaagtggga

SEQ ID NO: 141003 - DNA, 20 bp, Artificial Sequence
  chemically synthesized
aaggcctccggaagtgggaa

SEQ ID NO: 141004 - DNA, 20 bp, Artificial Sequence
  chemically synthesized
aagtgggaaaggtgtattgt

SEQ ID NO: 141005 - DNA, 20 bp, Artificial Sequence
  chemically synthesized
agtgggaaaggtgtattgtt

SEQ ID NO: 141006 - DNA, 20 bp, Artificial Sequence
  chemically synthesized
cttttggttacagggtgaaa

SEQ ID NO: 141007 - DNA, 20 bp, Artificial Sequence
  chemically synthesized
gtcttttggttacagggtga

SEQ ID NO: 141008 - DNA, 20 bp, Artificial Sequence
  chemically synthesized
caaatggtcttttggttaca

SEQ ID NO: 141009 - DNA, 20 bp, Artificial Sequence
  chemically synthesized
tcaaatggtcttttggttac

SEQ ID NO: 141010 - DNA, 20 bp, Artificial Sequence
  chemically synthesized
ctctttcaccctgtaaccaa

SEQ ID NO: 141011 - DNA, 20 bp, Artificial Sequence
  chemically synthesized
ttcaaatggtcttttggtta

SEQ ID NO: 141012 - DNA, 20 bp, Artificial Sequence
  chemically synthesized
cctcaattcaaatggtcttt

SEQ ID NO: 141013 - DNA, 20 bp, Artificial Sequence
  chemically synthesized
agtttccacctcaattcaaa

SEQ ID NO: 141014 - DNA, 20 bp, Artificial Sequence
  chemically synthesized
accaaaagaccatttgaatt

SEQ ID NO: 141015 - DNA, 20 bp, Artificial Sequence
  chemically synthesized
ccaaaagaccatttgaattg

SEQ ID NO: 141016 - DNA, 20 bp, Artificial Sequence
  chemically synthesized
aaagaccatttgaattgagg

SEQ ID NO: 141017 - DNA, 20 bp, Artificial Sequence
  chemically synthesized
atttgaattgaggtggaaac

SEQ ID NO: 141018 - DNA, 20 bp, Artificial Sequence
  chemically synthesized
ttgaattgaggtggaaactg

SEQ ID NO: 141019 - DNA, 20 bp, Artificial Sequence
  chemically synthesized
tgtaacgcttttgtgaactc

SEQ ID NO: 141020 - DNA, 20 bp, Artificial Sequence
  chemically synthesized
gtggaaactggagttcacaa

SEQ ID NO: 141021 - DNA, 20 bp, Artificial Sequence
  chemically synthesized
gtgatttcctcagggagtca

SEQ ID NO: 141022 - DNA, 20 bp, Artificial Sequence
  chemically synthesized
ataataaactgtgactccct

SEQ ID NO: 141023 - DNA, 20 bp, Artificial Sequence
  chemically synthesized
taataaactgtgactccctg

SEQ ID NO: 141024 - DNA, 20 bp, Artificial Sequence
  chemically synthesized
aacactgtgatttcctcagg

SEQ ID NO: 141025 - DNA, 20 bp, Artificial Sequence
  chemically synthesized
gaaacactgtgatttcctca

SEQ ID NO: 141026 - DNA, 20 bp, Artificial Sequence
  chemically synthesized
agaaacactgtgatttcctc

SEQ ID NO: 141027 - DNA, 20 bp, Artificial Sequence
  chemically synthesized
cagaaacactgtgatttcct

SEQ ID NO: 141028 - DNA, 20 bp, Artificial Sequence
  chemically synthesized
gtgactccctgaggaaatca

SEQ ID NO: 141029 - DNA, 20 bp, Artificial Sequence
  chemically synthesized
gaaatcacagtgtttctgtt

SEQ ID NO: 141030 - DNA, 20 bp, Artificial Sequence
  chemically synthesized
aagagcagcttgtcaccaaa

SEQ ID NO: 141031 - DNA, 20 bp, Artificial Sequence
  chemically synthesized
cagtgtttctgtttggtgac

SEQ ID NO: 141032 - DNA, 20 bp, Artificial Sequence
  chemically synthesized
tttggtgacaagctgctctt

SEQ ID NO: 141033 - DNA, 20 bp, Artificial Sequence
  chemically synthesized
ttggtgacaagctgctcttc

SEQ ID NO: 141034 - DNA, 20 bp, Artificial Sequence
  chemically synthesized
taggattcattcctgaagag

SEQ ID NO: 141035 - DNA, 20 bp, Artificial Sequence
  chemically synthesized
ttataggattcattcctgaa

SEQ ID NO: 141036 - DNA, 20 bp, Artificial Sequence
  chemically synthesized
tcttataggattcattcctg

SEQ ID NO: 141037 - DNA, 20 bp, Artificial Sequence
  chemically synthesized
tcttcaggaatgaatcctat

SEQ ID NO: 141038 - DNA, 20 bp, Artificial Sequence
  chemically synthesized
gctttatctgaaattcttat

SEQ ID NO: 141039 - DNA, 20 bp, Artificial Sequence
  chemically synthesized
agctttatctgaaattctta

SEQ ID NO: 141040 - DNA, 20 bp, Artificial Sequence
  chemically synthesized
aatgaatcctataagaattt

SEQ ID NO: 141041 - DNA, 20 bp, Artificial Sequence
  chemically synthesized
tcctataagaatttcagata

SEQ ID NO: 141042 - DNA, 20 bp, Artificial Sequence
  chemically synthesized
cttcactccccaaaagataa

SEQ ID NO: 141043 - DNA, 20 bp, Artificial Sequence
  chemically synthesized
cagataaagctcttatcttt

SEQ ID NO: 141044 - DNA, 20 bp, Artificial Sequence
  chemically synthesized
agataaagctcttatctttt

SEQ ID NO: 141045 - DNA, 20 bp, Artificial Sequence
  chemically synthesized
gccttcactccccaaaagat

SEQ ID NO: 141046 - DNA, 20 bp, Artificial Sequence
  chemically synthesized
gataaagctcttatcttttg

SEQ ID NO: 141047 - DNA, 20 bp, Artificial Sequence
  chemically synthesized
taaagctcttatcttttggg

SEQ ID NO: 141048 - DNA, 20 bp, Artificial Sequence
  chemically synthesized
ctgcagccttcactccccaa

SEQ ID NO: 141049 - DNA, 20 bp, Artificial Sequence
  chemically synthesized
ctcttatcttttggggagtg

SEQ ID NO: 141050 - DNA, 20 bp, Artificial Sequence
  chemically synthesized
tcttatcttttggggagtga

SEQ ID NO: 141051 - DNA, 20 bp, Artificial Sequence
  chemically synthesized
cttttggggagtgaaggctg

SEQ ID NO: 141052 - DNA, 20 bp, Artificial Sequence
  chemically synthesized
ttttggggagtgaaggctgc

SEQ ID NO: 141053 - DNA, 20 bp, Artificial Sequence
  chemically synthesized
ggggagtgaaggctgcagga

SEQ ID NO: 141054 - DNA, 20 bp, Artificial Sequence
  chemically synthesized
gggagtgaaggctgcaggaa

SEQ ID NO: 141055 - DNA, 20 bp, Artificial Sequence
  chemically synthesized
caataccctagcctttcctg

SEQ ID NO: 141056 - DNA, 20 bp, Artificial Sequence
  chemically synthesized
gtgaaggctgcaggaaaggc

SEQ ID NO: 141057 - DNA, 20 bp, Artificial Sequence
  chemically synthesized
tgaaggctgcaggaaaggct

SEQ ID NO: 141058 - DNA, 20 bp, Artificial Sequence
  chemically synthesized
gaaggctgcaggaaaggcta

SEQ ID NO: 141059 - DNA, 20 bp, Artificial Sequence
  chemically synthesized
catcccagaaggcaataccc

SEQ ID NO: 141060 - DNA, 20 bp, Artificial Sequence
  chemically synthesized
aaggctagggtattgccttc

SEQ ID NO: 141061 - DNA, 20 bp, Artificial Sequence
  chemically synthesized
aggctagggtattgccttct

SEQ ID NO: 141062 - DNA, 20 bp, Artificial Sequence
  chemically synthesized
tggtttttctgcatcccaga

SEQ ID NO: 141063 - DNA, 20 bp, Artificial Sequence
  chemically synthesized
atggtttttctgcatcccag

SEQ ID NO: 141064 - DNA, 20 bp, Artificial Sequence
  chemically synthesized
gggtattgccttctgggatg

SEQ ID NO: 141065 - DNA, 20 bp, Artificial Sequence
  chemically synthesized
aagatggtttttctgcatcc

SEQ ID NO: 141066 - DNA, 20 bp, Artificial Sequence
  chemically synthesized
aagctgagctaaggggaaga

SEQ ID NO: 141067 - DNA, 20 bp, Artificial Sequence
  chemically synthesized
cagaaaaaccatcttcccct

SEQ ID NO: 141068 - DNA, 20 bp, Artificial Sequence
  chemically synthesized
aacaaagctgagctaagggg

SEQ ID NO: 141069 - DNA, 20 bp, Artificial Sequence
  chemically synthesized
aaaccatcttccccttagct

SEQ ID NO: 141070 - DNA, 20 bp, Artificial Sequence
  chemically synthesized
atgaacaaagctgagctaag

SEQ ID NO: 141071 - DNA, 20 bp, Artificial Sequence
  chemically synthesized
aatgaacaaagctgagctaa

SEQ ID NO: 141072 - DNA, 20 bp, Artificial Sequence
  chemically synthesized
gaatgaacaaagctgagcta

SEQ ID NO: 141073 - DNA, 20 bp, Artificial Sequence
  chemically synthesized
tgaatgaacaaagctgagct

SEQ ID NO: 141074 - DNA, 20 bp, Artificial Sequence
  chemically synthesized
taagttgaatgaacaaagct

SEQ ID NO: 141075 - DNA, 20 bp, Artificial Sequence
  chemically synthesized
agaactaagttgaatgaaca

SEQ ID NO: 141076 - DNA, 20 bp, Artificial Sequence
  chemically synthesized
tcagctttgttcattcaact

SEQ ID NO: 141077 - DNA, 20 bp, Artificial Sequence
  chemically synthesized
gggtgtggaggggaagaact

SEQ ID NO: 141078 - DNA, 20 bp, Artificial Sequence
  chemically synthesized
tatgagtgggtgtggagggg

SEQ ID NO: 141079 - DNA, 20 bp, Artificial Sequence
  chemically synthesized
gtttatgagtgggtgtggag

SEQ ID NO: 141080 - DNA, 20 bp, Artificial Sequence
  chemically synthesized
tgtttatgagtgggtgtgga

SEQ ID NO: 141081 - DNA, 20 bp, Artificial Sequence
  chemically synthesized
atgtttatgagtgggtgtgg

SEQ ID NO: 141082 - DNA, 20 bp, Artificial Sequence
  chemically synthesized
aatgtttatgagtgggtgtg

SEQ ID NO: 141083 - DNA, 20 bp, Artificial Sequence
  chemically synthesized
ttaatgtttatgagtgggtg

SEQ ID NO: 141084 - DNA, 20 bp, Artificial Sequence
  chemically synthesized
aaggcttaatgtttatgagt

SEQ ID NO: 141085 - DNA, 20 bp, Artificial Sequence
  chemically synthesized
gaaggcttaatgtttatgag

SEQ ID NO: 141086 - DNA, 20 bp, Artificial Sequence
  chemically synthesized
gaagaaggcttaatgtttat

SEQ ID NO: 141087 - DNA, 20 bp, Artificial Sequence
  chemically synthesized
cacacccactcataaacatt

SEQ ID NO: 141088 - DNA, 20 bp, Artificial Sequence
  chemically synthesized
taaacattaagccttcttcc

SEQ ID NO: 141089 - DNA, 20 bp, Artificial Sequence
  chemically synthesized
gaggaagacagctgggaaga

SEQ ID NO: 141090 - DNA, 20 bp, Artificial Sequence
  chemically synthesized
agaggaagacagctgggaag

SEQ ID NO: 141091 - DNA, 20 bp, Artificial Sequence
  chemically synthesized
gagagaggaagacagctggg

SEQ ID NO: 141092 - DNA, 20 bp, Artificial Sequence
  chemically synthesized
aaagagagaggaagacagct

SEQ ID NO: 141093 - DNA, 20 bp, Artificial Sequence
  chemically synthesized
aaaagagagaggaagacagc

SEQ ID NO: 141094 - DNA, 20 bp, Artificial Sequence
  chemically synthesized
atgaaaaagagagaggaaga

SEQ ID NO: 141095 - DNA, 20 bp, Artificial Sequence
  chemically synthesized
aaaaatgaaaaagagagagg

SEQ ID NO: 141096 - DNA, 20 bp, Artificial Sequence
  chemically synthesized
tttaaaaatgaaaaagagag

SEQ ID NO: 141097 - DNA, 20 bp, Artificial Sequence
  chemically synthesized
gtttaaaaatgaaaaagaga

SEQ ID NO: 141098 - DNA, 20 bp, Artificial Sequence
  chemically synthesized
aagtttaaaaatgaaaaaga

SEQ ID NO: 141099 - DNA, 20 bp, Artificial Sequence
  chemically synthesized
tgaagtttaaaaatgaaaaa

SEQ ID NO: 141100 - DNA, 20 bp, Artificial Sequence
  chemically synthesized
gatgaagtttaaaaatgaaa

SEQ ID NO: 141101 - DNA, 20 bp, Artificial Sequence
  chemically synthesized
aagaattcaaaaagtagatg

SEQ ID NO: 141102 - DNA, 20 bp, Artificial Sequence
  chemically synthesized
agagaaaagaattcaaaaag

SEQ ID NO: 141103 - DNA, 20 bp, Artificial Sequence
  chemically synthesized
tgcagagaaaagaattcaaa

SEQ ID NO: 141104 - DNA, 20 bp, Artificial Sequence
  chemically synthesized
gtagtagttgttgcagagaa

SEQ ID NO: 141105 - DNA, 20 bp, Artificial Sequence
  chemically synthesized
ttttagtagtagttgttgca

SEQ ID NO: 141106 - DNA, 20 bp, Artificial Sequence
  chemically synthesized
gattttagtagtagttgttg

SEQ ID NO: 141107 - DNA, 20 bp, Artificial Sequence
  chemically synthesized
aagctttcagattttagtag

SEQ ID NO: 141108 - DNA, 20 bp, Artificial Sequence
  chemically synthesized
aagaagctttcagattttag

SEQ ID NO: 141109 - DNA, 20 bp, Artificial Sequence
  chemically synthesized
tagaagaagctttcagattt

SEQ ID NO: 141110 - DNA, 20 bp, Artificial Sequence
  chemically synthesized
caactactactaaaatctga

SEQ ID NO: 141111 - DNA, 20 bp, Artificial Sequence
  chemically synthesized
gtaacaatagaagaagcttt

SEQ ID NO: 141112 - DNA, 20 bp, Artificial Sequence
  chemically synthesized
ctccatggtaacaatagaag

SEQ ID NO: 141113 - DNA, 20 bp, Artificial Sequence
  chemically synthesized
cctctccatggtaacaatag

SEQ ID NO: 141114 - DNA, 20 bp, Artificial Sequence
  chemically synthesized
tgccctctccatggtaacaa

SEQ ID NO: 141115 - DNA, 20 bp, Artificial Sequence
  chemically synthesized
agcttcttctattgttacca

SEQ ID NO: 141116 - DNA, 20 bp, Artificial Sequence
  chemically synthesized
cttcttctattgttaccatg

SEQ ID NO: 141117 - DNA, 20 bp, Artificial Sequence
  chemically synthesized
tcttctattgttaccatgga

SEQ ID NO: 141118 - DNA, 20 bp, Artificial Sequence
  chemically synthesized
cttctattgttaccatggag

SEQ ID NO: 141119 - DNA, 20 bp, Artificial Sequence
  chemically synthesized
ttctattgttaccatggaga

SEQ ID NO: 141120 - DNA, 20 bp, Artificial Sequence
  chemically synthesized
tgagaaaattgccctctcca

SEQ ID NO: 141121 - DNA, 20 bp, Artificial Sequence
  chemically synthesized
gagagggcaattttctcaac

SEQ ID NO: 141122 - DNA, 20 bp, Artificial Sequence
  chemically synthesized
caccacctcctttacttgtt

SEQ ID NO: 141123 - DNA, 20 bp, Artificial Sequence
  chemically synthesized
ggcaattttctcaacaagta

SEQ ID NO: 141124 - DNA, 20 bp, Artificial Sequence
  chemically synthesized
gcaattttctcaacaagtaa

SEQ ID NO: 141125 - DNA, 20 bp, Artificial Sequence
  chemically synthesized
aattttctcaacaagtaaag

SEQ ID NO: 141126 - DNA, 20 bp, Artificial Sequence
  chemically synthesized
attttctcaacaagtaaagg

SEQ ID NO: 141127 - DNA, 20 bp, Artificial Sequence
  chemically synthesized
ttctcaacaagtaaaggagg

SEQ ID NO: 141128 - DNA, 20 bp, Artificial Sequence
  chemically synthesized
aacaagtaaaggaggtggtg

SEQ ID NO: 141129 - DNA, 20 bp, Artificial Sequence
  chemically synthesized
caagtaaaggaggtggtgca

SEQ ID NO: 141130 - DNA, 20 bp, Artificial Sequence
  chemically synthesized
aagtaaaggaggtggtgcag

SEQ ID NO: 141131 - DNA, 20 bp, Artificial Sequence
  chemically synthesized
agtaaaggaggtggtgcaga

SEQ ID NO: 141132 - DNA, 20 bp, Artificial Sequence
  chemically synthesized
taaaggaggtggtgcagagg

SEQ ID NO: 141133 - DNA, 20 bp, Artificial Sequence
  chemically synthesized
aaggaggtggtgcagaggga

SEQ ID NO: 141134 - DNA, 20 bp, Artificial Sequence
  chemically synthesized
aggaggtggtgcagagggag

SEQ ID NO: 141135 - DNA, 20 bp, Artificial Sequence
  chemically synthesized
ggaggtggtgcagagggaga

SEQ ID NO: 141136 - DNA, 20 bp, Artificial Sequence
  chemically synthesized
ggtggtgcagagggagaggg

SEQ ID NO: 141137 - DNA, 20 bp, Artificial Sequence
  chemically synthesized
taactttcaattttcatatg

SEQ ID NO: 141138 - DNA, 20 bp, Artificial Sequence
  chemically synthesized
gaactacatatgaaaattga

SEQ ID NO: 141139 - DNA, 20 bp, Artificial Sequence
  chemically synthesized
tacatatgaaaattgaaagt

SEQ ID NO: 141140 - DNA, 20 bp, Artificial Sequence
  chemically synthesized
atgttgttgaaaagacacag

SEQ ID NO: 141141 - DNA, 20 bp, Artificial Sequence
  chemically synthesized
gatgttgttgaaaagacaca

SEQ ID NO: 141142 - DNA, 20 bp, Artificial Sequence
  chemically synthesized
ttgatgttgttgaaaagaca

SEQ ID NO: 141143 - DNA, 20 bp, Artificial Sequence
  chemically synthesized
tttaatttgatgttgttgaa

SEQ ID NO: 141144 - DNA, 20 bp, Artificial Sequence
  chemically synthesized
gttttgtgtatggaagtgaa

SEQ ID NO: 141145 - DNA, 20 bp, Artificial Sequence
  chemically synthesized
tcctgttgttttgtgtatgg

SEQ ID NO: 141146 - DNA, 20 bp, Artificial Sequence
  chemically synthesized
tgttcctgttgttttgtgta

SEQ ID NO: 141147 - DNA, 20 bp, Artificial Sequence
  chemically synthesized
cacttccatacacaaaacaa

SEQ ID NO: 141148 - DNA, 20 bp, Artificial Sequence
  chemically synthesized
acttccatacacaaaacaac

SEQ ID NO: 141149 - DNA, 20 bp, Artificial Sequence
  chemically synthesized
cacaaaacaacaggaacaca

SEQ ID NO: 141150 - DNA, 20 bp, Artificial Sequence
  chemically synthesized
aaaacaacaggaacacacag

SEQ ID NO: 141151 - DNA, 20 bp, Artificial Sequence
  chemically synthesized
aaacaacaggaacacacagt

SEQ ID NO: 141152 - DNA, 20 bp, Artificial Sequence
  chemically synthesized
caacaggaacacacagtggg

SEQ ID NO: 141153 - DNA, 20 bp, Artificial Sequence
  chemically synthesized
cacacagtgggtggcaaatt

SEQ ID NO: 141154 - DNA, 20 bp, Artificial Sequence
  chemically synthesized
agtgggtggcaaattcagcc

SEQ ID NO: 141155 - DNA, 20 bp, Artificial Sequence
  chemically synthesized
gtgggtggcaaattcagccc

SEQ ID NO: 141156 - DNA, 20 bp, Artificial Sequence
  chemically synthesized
tgggtggcaaattcagccca

SEQ ID NO: 141157 - DNA, 20 bp, Artificial Sequence
  chemically synthesized
actgattcattcacatccct

SEQ ID NO: 141158 - DNA, 20 bp, Artificial Sequence
  chemically synthesized
tactgattcattcacatccc

SEQ ID NO: 141159 - DNA, 20 bp, Artificial Sequence
  chemically synthesized
gcccagggatgtgaatgaat

SEQ ID NO: 141160 - DNA, 20 bp, Artificial Sequence
  chemically synthesized
cagggatgtgaatgaatcag

SEQ ID NO: 141161 - DNA, 20 bp, Artificial Sequence
  chemically synthesized
agggatgtgaatgaatcagt

SEQ ID NO: 141162 - DNA, 20 bp, Artificial Sequence
  chemically synthesized
acccccagcatattatcaca

SEQ ID NO: 141163 - DNA, 20 bp, Artificial Sequence
  chemically synthesized
taggctttgtgataatatgc

SEQ ID NO: 141164 - DNA, 20 bp, Artificial Sequence
  chemically synthesized
aggctttgtgataatatgct

SEQ ID NO: 141165 - DNA, 20 bp, Artificial Sequence
  chemically synthesized
ggctttgtgataatatgctg

SEQ ID NO: 141166 - DNA, 20 bp, Artificial Sequence
  chemically synthesized
gctttgtgataatatgctgg

SEQ ID NO: 141167 - DNA, 20 bp, Artificial Sequence
  chemically synthesized
tgataatatgctgggggtgt

SEQ ID NO: 141168 - DNA, 20 bp, Artificial Sequence
  chemically synthesized
cgccacctccctcacacccc

SEQ ID NO: 141169 - DNA, 20 bp, Artificial Sequence
  chemically synthesized
gataatatgctgggggtgtg

SEQ ID NO: 141170 - DNA, 20 bp, Artificial Sequence
  chemically synthesized
ataatatgctgggggtgtga

SEQ ID NO: 141171 - DNA, 20 bp, Artificial Sequence
  chemically synthesized
aatatgctgggggtgtgagg

SEQ ID NO: 141172 - DNA, 20 bp, Artificial Sequence
  chemically synthesized
atatgctgggggtgtgaggg

SEQ ID NO: 141173 - DNA, 20 bp, Artificial Sequence
  chemically synthesized
tgctgggggtgtgagggagg

SEQ ID NO: 141174 - DNA, 20 bp, Artificial Sequence
  chemically synthesized
gggggtgtgagggaggtggc

SEQ ID NO: 141175 - DNA, 20 bp, Artificial Sequence
  chemically synthesized
ggggtgtgagggaggtggcg

SEQ ID NO: 141176 - DNA, 20 bp, Artificial Sequence
  chemically synthesized
gtgtgagggaggtggcgagg

SEQ ID NO: 141177 - DNA, 20 bp, Artificial Sequence
  chemically synthesized
ttttctgttttaggattgag

SEQ ID NO: 141178 - DNA, 20 bp, Artificial Sequence
  chemically synthesized
cttttctgttttaggattga

SEQ ID NO: 141179 - DNA, 20 bp, Artificial Sequence
  chemically synthesized
acttttctgttttaggattg

SEQ ID NO: 141180 - DNA, 20 bp, Artificial Sequence
  chemically synthesized
tacttttctgttttaggatt

SEQ ID NO: 141181 - DNA, 20 bp, Artificial Sequence
  chemically synthesized
gcagcccctcaatcctaaaa

SEQ ID NO: 141182 - DNA, 20 bp, Artificial Sequence
  chemically synthesized
gttcattacttttctgtttt

SEQ ID NO: 141183 - DNA, 20 bp, Artificial Sequence
  chemically synthesized
tgttcattacttttctgttt

SEQ ID NO: 141184 - DNA, 20 bp, Artificial Sequence
  chemically synthesized
ccctcaatcctaaaacagaa

SEQ ID NO: 141185 - DNA, 20 bp, Artificial Sequence
  chemically synthesized
atgaacaatgataactgata

SEQ ID NO: 141186 - DNA, 20 bp, Artificial Sequence
  chemically synthesized
tgcagagtaattgtctatat

SEQ ID NO: 141187 - DNA, 20 bp, Artificial Sequence
  chemically synthesized
tgatatagacaattactctg

SEQ ID NO: 141188 - DNA, 20 bp, Artificial Sequence
  chemically synthesized
catatattcaaacaactgca

SEQ ID NO: 141189 - DNA, 20 bp, Artificial Sequence
  chemically synthesized
agcatatattcaaacaactg

SEQ ID NO: 141190 - DNA, 20 bp, Artificial Sequence
  chemically synthesized
tacctgaaaatgatagaaag

SEQ ID NO: 141191 - DNA, 20 bp, Artificial Sequence
  chemically synthesized
atttacctgaaaatgataga

SEQ ID NO: 141192 - DNA, 20 bp, Artificial Sequence
  chemically synthesized
atgctgctttctatcatttt

SEQ ID NO: 141193 - DNA, 20 bp, Artificial Sequence
  chemically synthesized
ggtcatttacctgaaaatga

SEQ ID NO: 141194 - DNA, 20 bp, Artificial Sequence
  chemically synthesized
tgctgctttctatcattttc

SEQ ID NO: 141195 - DNA, 20 bp, Artificial Sequence
  chemically synthesized
attttcaggtaaatgacctt

SEQ ID NO: 141196 - DNA, 20 bp, Artificial Sequence
  chemically synthesized
caggtaaatgaccttcagaa

SEQ ID NO: 141197 - DNA, 20 bp, Artificial Sequence
  chemically synthesized
tccatctactgccattctga

SEQ ID NO: 141198 - DNA, 20 bp, Artificial Sequence
  chemically synthesized
atccatctactgccattctg

SEQ ID NO: 141199 - DNA, 20 bp, Artificial Sequence
  chemically synthesized
gtaaatgaccttcagaatgg

SEQ ID NO: 141200 - DNA, 20 bp, Artificial Sequence
  chemically synthesized
aatgaccttcagaatggcag

SEQ ID NO: 141201 - DNA, 20 bp, Artificial Sequence
  chemically synthesized
accttcagaatggcagtaga

SEQ ID NO: 141202 - DNA, 20 bp, Artificial Sequence
  chemically synthesized
atggcagtagatggatttct

SEQ ID NO: 141203 - DNA, 20 bp, Artificial Sequence
  chemically synthesized
gtttgtatttcatgatttct

SEQ ID NO: 141204 - DNA, 20 bp, Artificial Sequence
  chemically synthesized
aatcatgaaatacaaacatg

SEQ ID NO: 141205 - DNA, 20 bp, Artificial Sequence
  chemically synthesized
tacaaacatgtagacaaaca

SEQ ID NO: 141206 - DNA, 20 bp, Artificial Sequence
  chemically synthesized
aaacatgtagacaaacaaag

SEQ ID NO: 141207 - DNA, 20 bp, Artificial Sequence
  chemically synthesized
aacatgtagacaaacaaagc

SEQ ID NO: 141208 - DNA, 20 bp, Artificial Sequence
  chemically synthesized
atgtagacaaacaaagcagg

SEQ ID NO: 141209 - DNA, 20 bp, Artificial Sequence
  chemically synthesized
tagacaaacaaagcaggcag

SEQ ID NO: 141210 - DNA, 20 bp, Artificial Sequence
  chemically synthesized
agacaaacaaagcaggcaga

SEQ ID NO: 141211 - DNA, 20 bp, Artificial Sequence
  chemically synthesized
caaacaaagcaggcagaagg

SEQ ID NO: 141212 - DNA, 20 bp, Artificial Sequence
  chemically synthesized
agcaggcagaaggaagtaat

SEQ ID NO: 141213 - DNA, 20 bp, Artificial Sequence
  chemically synthesized
agtaataagtttaaaaaatg

SEQ ID NO: 141214 - DNA, 20 bp, Artificial Sequence
  chemically synthesized
tttaaaaaatgaagtgctat

SEQ ID NO: 141215 - DNA, 20 bp, Artificial Sequence
  chemically synthesized
tctttctctctcagttctta

SEQ ID NO: 141216 - DNA, 20 bp, Artificial Sequence
  chemically synthesized
aatgaagtgctataagaact

SEQ ID NO: 141217 - DNA, 20 bp, Artificial Sequence
  chemically synthesized
tgaagtgctataagaactga

SEQ ID NO: 141218 - DNA, 20 bp, Artificial Sequence
  chemically synthesized
aagtgctataagaactgaga

SEQ ID NO: 141219 - DNA, 20 bp, Artificial Sequence
  chemically synthesized
gctataagaactgagagaga

SEQ ID NO: 141220 - DNA, 20 bp, Artificial Sequence
  chemically synthesized
gattgataatctttctctct

SEQ ID NO: 141221 - DNA, 20 bp, Artificial Sequence
  chemically synthesized
aatagaagaaagaaaaaggg

SEQ ID NO: 141222 - DNA, 20 bp, Artificial Sequence
  chemically synthesized
gaatagaagaaagaaaaagg

SEQ ID NO: 141223 - DNA, 20 bp, Artificial Sequence
  chemically synthesized
aagaatagaagaaagaaaaa

SEQ ID NO: 141224 - DNA, 20 bp, Artificial Sequence
  chemically synthesized
gaagaatagaagaaagaaaa

SEQ ID NO: 141225 - DNA, 20 bp, Artificial Sequence
  chemically synthesized
agaagaatagaagaaagaaa

SEQ ID NO: 141226 - DNA, 20 bp, Artificial Sequence
  chemically synthesized
gtatagagaagaatagaaga

SEQ ID NO: 141227 - DNA, 20 bp, Artificial Sequence
  chemically synthesized
acttgtatagagaagaatag

SEQ ID NO: 141228 - DNA, 20 bp, Artificial Sequence
  chemically synthesized
ataacttgtatagagaagaa

SEQ ID NO: 141229 - DNA, 20 bp, Artificial Sequence
  chemically synthesized
acttcataacttgtatagag

SEQ ID NO: 141230 - DNA, 20 bp, Artificial Sequence
  chemically synthesized
tcttctattcttctctatac

SEQ ID NO: 141231 - DNA, 20 bp, Artificial Sequence
  chemically synthesized
tccacttcataacttgtata

SEQ ID NO: 141232 - DNA, 20 bp, Artificial Sequence
  chemically synthesized
cttccacttcataacttgta

SEQ ID NO: 141233 - DNA, 20 bp, Artificial Sequence
  chemically synthesized
tcttctctatacaagttatg

SEQ ID NO: 141234 - DNA, 20 bp, Artificial Sequence
  chemically synthesized
tctctatacaagttatgaag

SEQ ID NO: 141235 - DNA, 20 bp, Artificial Sequence
  chemically synthesized
ctatacaagttatgaagtgg

SEQ ID NO: 141236 - DNA, 20 bp, Artificial Sequence
  chemically synthesized
acaaatataaaatcatctga

SEQ ID NO: 141237 - DNA, 20 bp, Artificial Sequence
  chemically synthesized
tctcactgatgtttcaccat

SEQ ID NO: 141238 - DNA, 20 bp, Artificial Sequence
  chemically synthesized
atcatctgatggtgaaacat

SEQ ID NO: 141239 - DNA, 20 bp, Artificial Sequence
  chemically synthesized
tctgatggtgaaacatcagt

SEQ ID NO: 141240 - DNA, 20 bp, Artificial Sequence
  chemically synthesized
agtgagattttaattatatc

SEQ ID NO: 141241 - DNA, 20 bp, Artificial Sequence
  chemically synthesized
agtttgagatttaaaaaatc

SEQ ID NO: 141242 - DNA, 20 bp, Artificial Sequence
  chemically synthesized
agattttttaaatctcaaac

SEQ ID NO: 141243 - DNA, 20 bp, Artificial Sequence
  chemically synthesized
gattttttaaatctcaaact

SEQ ID NO: 141244 - DNA, 20 bp, Artificial Sequence
  chemically synthesized
cagcagatttttcctagttt

SEQ ID NO: 141245 - DNA, 20 bp, Artificial Sequence
  chemically synthesized
gtgaatcagcagatttttcc

SEQ ID NO: 141246 - DNA, 20 bp, Artificial Sequence
  chemically synthesized
ttttcatgtttgtgaatcag

SEQ ID NO: 141247 - DNA, 20 bp, Artificial Sequence
  chemically synthesized
atattttcatgtttgtgaat

SEQ ID NO: 141248 - DNA, 20 bp, Artificial Sequence
  chemically synthesized
caaacatgaaaatattttaa

SEQ ID NO: 141249 - DNA, 20 bp, Artificial Sequence
  chemically synthesized
atgaaaatattttaaaagat

SEQ ID NO: 141250 - DNA, 20 bp, Artificial Sequence
  chemically synthesized
gaaaatattttaaaagatca

SEQ ID NO: 141251 - DNA, 20 bp, Artificial Sequence
  chemically synthesized
tgtcaggagaattagaacat

SEQ ID NO: 141252 - DNA, 20 bp, Artificial Sequence
  chemically synthesized
atggttcatgtcaggagaat

SEQ ID NO: 141253 - DNA, 20 bp, Artificial Sequence
  chemically synthesized
atatatatggttcatgtcag

SEQ ID NO: 141254 - DNA, 20 bp, Artificial Sequence
  chemically synthesized
gcatatatatggttcatgtc

SEQ ID NO: 141255 - DNA, 20 bp, Artificial Sequence
  chemically synthesized
agcatatatatggttcatgt

SEQ ID NO: 141256 - DNA, 20 bp, Artificial Sequence
  chemically synthesized
gaaagaataaagcatatata

SEQ ID NO: 141257 - DNA, 20 bp, Artificial Sequence
  chemically synthesized
cagaatcatcagaaagaata

SEQ ID NO: 141258 - DNA, 20 bp, Artificial Sequence
  chemically synthesized
tttttctcagaatcatcaga

SEQ ID NO: 141259 - DNA, 20 bp, Artificial Sequence
  chemically synthesized
ttgatttttctcagaatcat

SEQ ID NO: 141260 - DNA, 20 bp, Artificial Sequence
  chemically synthesized
ttattctttctgatgattct

SEQ ID NO: 141261 - DNA, 20 bp, Artificial Sequence
  chemically synthesized
attcagaatttgatttttct

SEQ ID NO: 141262 - DNA, 20 bp, Artificial Sequence
  chemically synthesized
acatcatcattttaaaaatt

SEQ ID NO: 141263 - DNA, 20 bp, Artificial Sequence
  chemically synthesized
atggtgatttattacaattt

SEQ ID NO: 141264 - DNA, 20 bp, Artificial Sequence
  chemically synthesized
tatggtgatttattacaatt

SEQ ID NO: 141265 - DNA, 20 bp, Artificial Sequence
  chemically synthesized
gaatttttctttggaaaata

SEQ ID NO: 141266 - DNA, 20 bp, Artificial Sequence
  chemically synthesized
ataaatcaccatattttcca

SEQ ID NO: 141267 - DNA, 20 bp, Artificial Sequence
  chemically synthesized
aattgtgtagaatttttctt

SEQ ID NO: 141268 - DNA, 20 bp, Artificial Sequence
  chemically synthesized
atttatgtacaggaattgtg

SEQ ID NO: 141269 - DNA, 20 bp, Artificial Sequence
  chemically synthesized
tccacacaaaatttatgtac

SEQ ID NO: 141270 - DNA, 20 bp, Artificial Sequence
  chemically synthesized
ttccacacaaaatttatgta

SEQ ID NO: 141271 - DNA, 20 bp, Artificial Sequence
  chemically synthesized
tcctgtacataaattttgtg

SEQ ID NO: 141272 - DNA, 20 bp, Artificial Sequence
  chemically synthesized
gtacataaattttgtgtgga

SEQ ID NO: 141273 - DNA, 20 bp, Artificial Sequence
  chemically synthesized
tacataaattttgtgtggaa

SEQ ID NO: 141274 - DNA, 20 bp, Artificial Sequence
  chemically synthesized
tgtggaaaggcttgtatcat

SEQ ID NO: 141275 - DNA, 20 bp, Artificial Sequence
  chemically synthesized
tttgattattcttatgatac

SEQ ID NO: 141276 - DNA, 20 bp, Artificial Sequence
  chemically synthesized
ttgtatcataagaataatca

SEQ ID NO: 141277 - DNA, 20 bp, Artificial Sequence
  chemically synthesized
tgtatcataagaataatcaa

SEQ ID NO: 141278 - DNA, 20 bp, Artificial Sequence
  chemically synthesized
cataagaataatcaaaggaa

SEQ ID NO: 141279 - DNA, 20 bp, Artificial Sequence
  chemically synthesized
aaaggaaaagaactgcaaac

SEQ ID NO: 141280 - DNA, 20 bp, Artificial Sequence
  chemically synthesized
tttatgcttctactagtttg

SEQ ID NO: 141281 - DNA, 20 bp, Artificial Sequence
  chemically synthesized
ggaaaagaactgcaaactag

SEQ ID NO: 141282 - DNA, 20 bp, Artificial Sequence
  chemically synthesized
aaagaactgcaaactagtag

SEQ ID NO: 141283 - DNA, 20 bp, Artificial Sequence
  chemically synthesized
ttttaaatttatgcttctac

SEQ ID NO: 141284 - DNA, 20 bp, Artificial Sequence
  chemically synthesized
tctttactcgatgtcatcat

SEQ ID NO: 141285 - DNA, 20 bp, Artificial Sequence
  chemically synthesized
atgttgctgatgatgacatc

SEQ ID NO: 141286 - DNA, 20 bp, Artificial Sequence
  chemically synthesized
gctgatgatgacatcgagta

SEQ ID NO: 141287 - DNA, 20 bp, Artificial Sequence
  chemically synthesized
tgacatcgagtaaagatttg

SEQ ID NO: 141288 - DNA, 20 bp, Artificial Sequence
  chemically synthesized
gagtaaagatttgaagtgtt

SEQ ID NO: 141289 - DNA, 20 bp, Artificial Sequence
  chemically synthesized
taaagatttgaagtgttaag

SEQ ID NO: 141290 - DNA, 20 bp, Artificial Sequence
  chemically synthesized
aagaggatcatagaaaaagt

SEQ ID NO: 141291 - DNA, 20 bp, Artificial Sequence
  chemically synthesized
ggggaagaggatcatagaaa

SEQ ID NO: 141292 - DNA, 20 bp, Artificial Sequence
  chemically synthesized
tgagaaggggaagaggatca

SEQ ID NO: 141293 - DNA, 20 bp, Artificial Sequence
  chemically synthesized
tgggtattgagaaggggaag

SEQ ID NO: 141294 - DNA, 20 bp, Artificial Sequence
  chemically synthesized
gtgggtattgagaaggggaa

SEQ ID NO: 141295 - DNA, 20 bp, Artificial Sequence
  chemically synthesized
gagtgggtattgagaagggg

SEQ ID NO: 141296 - DNA, 20 bp, Artificial Sequence
  chemically synthesized
ctagagtgggtattgagaag

SEQ ID NO: 141297 - DNA, 20 bp, Artificial Sequence
  chemically synthesized
gctagagtgggtattgagaa

SEQ ID NO: 141298 - DNA, 20 bp, Artificial Sequence
  chemically synthesized
agctagagtgggtattgaga

SEQ ID NO: 141299 - DNA, 20 bp, Artificial Sequence
  chemically synthesized
aagctagagtgggtattgag

SEQ ID NO: 141300 - DNA, 20 bp, Artificial Sequence
  chemically synthesized
taaaagctagagtgggtatt

SEQ ID NO: 141301 - DNA, 20 bp, Artificial Sequence
  chemically synthesized
ccccttctcaatacccactc

SEQ ID NO: 141302 - DNA, 20 bp, Artificial Sequence
  chemically synthesized
gtgtttttaaaagctagagt

SEQ ID NO: 141303 - DNA, 20 bp, Artificial Sequence
  chemically synthesized
tgtgtttttaaaagctagag

SEQ ID NO: 141304 - DNA, 20 bp, Artificial Sequence
  chemically synthesized
cattgtgtttttaaaagcta

SEQ ID NO: 141305 - DNA, 20 bp, Artificial Sequence
  chemically synthesized
ctcattgtgtttttaaaagc

SEQ ID NO: 141306 - DNA, 20 bp, Artificial Sequence
  chemically synthesized
caatctcattgtgtttttaa

SEQ ID NO: 141307 - DNA, 20 bp, Artificial Sequence
  chemically synthesized
ctagcttttaaaaacacaat

SEQ ID NO: 141308 - DNA, 20 bp, Artificial Sequence
  chemically synthesized
cacaatgagattgttttcta

SEQ ID NO: 141309 - DNA, 20 bp, Artificial Sequence
  chemically synthesized
aaatgttcatcattgtgctg

SEQ ID NO: 141310 - DNA, 20 bp, Artificial Sequence
  chemically synthesized
cagcacaatgatgaacattt

SEQ ID NO: 141311 - DNA, 20 bp, Artificial Sequence
  chemically synthesized
agcacaatgatgaacatttc

SEQ ID NO: 141312 - DNA, 20 bp, Artificial Sequence
  chemically synthesized
tcaggtgtataaaaaatata

SEQ ID NO: 141313 - DNA, 20 bp, Artificial Sequence
  chemically synthesized
tgtataaaaaatataaagaa

SEQ ID NO: 141314 - DNA, 20 bp, Artificial Sequence
  chemically synthesized
aaatataaagaaaagattac

SEQ ID NO: 141315 - DNA, 20 bp, Artificial Sequence
  chemically synthesized
taaagaaaagattacaagtg

SEQ ID NO: 141316 - DNA, 20 bp, Artificial Sequence
  chemically synthesized
aagattacaagtgaagtcta

SEQ ID NO: 141317 - DNA, 20 bp, Artificial Sequence
  chemically synthesized
tacaagtgaagtctatggca

SEQ ID NO: 141318 - DNA, 20 bp, Artificial Sequence
  chemically synthesized
ggattagtacagccatgcca

SEQ ID NO: 141319 - DNA, 20 bp, Artificial Sequence
  chemically synthesized
tacgtgtgtgtggattagta

SEQ ID NO: 141320 - DNA, 20 bp, Artificial Sequence
  chemically synthesized
gagcgtacgtgtgtgtggat

SEQ ID NO: 141321 - DNA, 20 bp, Artificial Sequence
  chemically synthesized
ctgccgagcgtacgtgtgtg

SEQ ID NO: 141322 - DNA, 20 bp, Artificial Sequence
  chemically synthesized
aatccacacacacgtacgct

SEQ ID NO: 141323 - DNA, 20 bp, Artificial Sequence
  chemically synthesized
ccacacacacgtacgctcgg

SEQ ID NO: 141324 - DNA, 20 bp, Artificial Sequence
  chemically synthesized
gaggtaacttttacactgcc

SEQ ID NO: 141325 - DNA, 20 bp, Artificial Sequence
  chemically synthesized
acgtacgctcggcagtgtaa

SEQ ID NO: 141326 - DNA, 20 bp, Artificial Sequence
  chemically synthesized
ttaattcaagcaaatcagtg

SEQ ID NO: 141327 - DNA, 20 bp, Artificial Sequence
  chemically synthesized
gttaattcaagcaaatcagt

SEQ ID NO: 141328 - DNA, 20 bp, Artificial Sequence
  chemically synthesized
aattgttaattcaagcaaat

SEQ ID NO: 141329 - DNA, 20 bp, Artificial Sequence
  chemically synthesized
ttattttaaattgttaattc

SEQ ID NO: 141330 - DNA, 20 bp, Artificial Sequence
  chemically synthesized
tataaaaataaacattaatt

SEQ ID NO: 141331 - DNA, 20 bp, Artificial Sequence
  chemically synthesized
taatgtttatttttataaaa

SEQ ID NO: 141332 - DNA, 20 bp, Artificial Sequence
  chemically synthesized
tgtttatttttataaaatag

SEQ ID NO: 141333 - DNA, 20 bp, Artificial Sequence
  chemically synthesized
ttataaaatagcagtgttat

SEQ ID NO: 141334 - DNA, 20 bp, Artificial Sequence
  chemically synthesized
aaaatagcagtgttattaga

SEQ ID NO: 141335 - DNA, 20 bp, Artificial Sequence
  chemically synthesized
ttattagaaagatttctgac

SEQ ID NO: 141336 - DNA, 20 bp, Artificial Sequence
  chemically synthesized
ttagaaagatttctgacaag

SEQ ID NO: 141337 - DNA, 20 bp, Artificial Sequence
  chemically synthesized
tgtaatcgtacactacttgt

SEQ ID NO: 141338 - DNA, 20 bp, Artificial Sequence
  chemically synthesized
attacaaatatcatctacct

SEQ ID NO: 141339 - DNA, 20 bp, Artificial Sequence
  chemically synthesized
tacaaatatcatctaccttg

SEQ ID NO: 141340 - DNA, 20 bp, Artificial Sequence
  chemically synthesized
atttcatggtaactccaagg

SEQ ID NO: 141341 - DNA, 20 bp, Artificial Sequence
  chemically synthesized
ctaatttcatggtaactcca

SEQ ID NO: 141342 - DNA, 20 bp, Artificial Sequence
  chemically synthesized
cctaatttcatggtaactcc

SEQ ID NO: 141343 - DNA, 20 bp, Artificial Sequence
  chemically synthesized
ccttggagttaccatgaaat

SEQ ID NO: 141344 - DNA, 20 bp, Artificial Sequence
  chemically synthesized
cttggagttaccatgaaatt

SEQ ID NO: 141345 - DNA, 20 bp, Artificial Sequence
  chemically synthesized
tttttaccctcctaatttca

SEQ ID NO: 141346 - DNA, 20 bp, Artificial Sequence
  chemically synthesized
tggagttaccatgaaattag

SEQ ID NO: 141347 - DNA, 20 bp, Artificial Sequence
  chemically synthesized
ggagttaccatgaaattagg

SEQ ID NO: 141348 - DNA, 20 bp, Artificial Sequence
  chemically synthesized
gagttaccatgaaattagga

SEQ ID NO: 141349 - DNA, 20 bp, Artificial Sequence
  chemically synthesized
tgaaattaggagggtaaaaa

SEQ ID NO: 141350 - DNA, 20 bp, Artificial Sequence
  chemically synthesized
gagggtaaaaatagtaaata

SEQ ID NO: 141351 - DNA, 20 bp, Artificial Sequence
  chemically synthesized
agtaaataaagatcctattc

SEQ ID NO: 141352 - DNA, 20 bp, Artificial Sequence
  chemically synthesized
ataggccagatgtctagaat

SEQ ID NO: 141353 - DNA, 20 bp, Artificial Sequence
  chemically synthesized
tataggccagatgtctagaa

SEQ ID NO: 141354 - DNA, 20 bp, Artificial Sequence
  chemically synthesized
aagatcctattctagacatc

SEQ ID NO: 141355 - DNA, 20 bp, Artificial Sequence
  chemically synthesized
ctgcatataggccagatgtc

SEQ ID NO: 141356 - DNA, 20 bp, Artificial Sequence
  chemically synthesized
ctggttgtctgcatataggc

SEQ ID NO: 141357 - DNA, 20 bp, Artificial Sequence
  chemically synthesized
ctagacatctggcctatatg

SEQ ID NO: 141358 - DNA, 20 bp, Artificial Sequence
  chemically synthesized
ctgcctggttgtctgcatat

SEQ ID NO: 141359 - DNA, 20 bp, Artificial Sequence
  chemically synthesized
gctgcctggttgtctgcata

SEQ ID NO: 141360 - DNA, 20 bp, Artificial Sequence
  chemically synthesized
ctggcctatatgcagacaac

SEQ ID NO: 141361 - DNA, 20 bp, Artificial Sequence
  chemically synthesized
tggcctatatgcagacaacc

SEQ ID NO: 141362 - DNA, 20 bp, Artificial Sequence
  chemically synthesized
cctatatgcagacaaccagg

SEQ ID NO: 141363 - DNA, 20 bp, Artificial Sequence
  chemically synthesized
actcttgagtttgtgctgcc

SEQ ID NO: 141364 - DNA, 20 bp, Artificial Sequence
  chemically synthesized
caaccaggcagcacaaactc

SEQ ID NO: 141365 - DNA, 20 bp, Artificial Sequence
  chemically synthesized
accaggcagcacaaactcaa

SEQ ID NO: 141366 - DNA, 20 bp, Artificial Sequence
  chemically synthesized
gcaattacaagcggactctt

SEQ ID NO: 141367 - DNA, 20 bp, Artificial Sequence
  chemically synthesized
aattcaaaagcaattacaag

SEQ ID NO: 141368 - DNA, 20 bp, Artificial Sequence
  chemically synthesized
ctgaattcaaaagcaattac

SEQ ID NO: 141369 - DNA, 20 bp, Artificial Sequence
  chemically synthesized
cttgtaattgcttttgaatt

SEQ ID NO: 141370 - DNA, 20 bp, Artificial Sequence
  chemically synthesized
ttaattttctctgaattcaa

SEQ ID NO: 141371 - DNA, 20 bp, Artificial Sequence
  chemically synthesized
tgtaattgcttttgaattca

SEQ ID NO: 141372 - DNA, 20 bp, Artificial Sequence
  chemically synthesized
ttgaattcagagaaaattaa

SEQ ID NO: 141373 - DNA, 20 bp, Artificial Sequence
  chemically synthesized
attcagagaaaattaatggt

SEQ ID NO: 141374 - DNA, 20 bp, Artificial Sequence
  chemically synthesized
agagaaaattaatggtaagt

SEQ ID NO: 141375 - DNA, 20 bp, Artificial Sequence
  chemically synthesized
aaaattaatggtaagttggt

SEQ ID NO: 141376 - DNA, 20 bp, Artificial Sequence
  chemically synthesized
cagttttgctttgcaaataa

SEQ ID NO: 141377 - DNA, 20 bp, Artificial Sequence
  chemically synthesized
acacaattctcttatttgca

SEQ ID NO: 141378 - DNA, 20 bp, Artificial Sequence
  chemically synthesized
ttcagttttgctttgcaaat

SEQ ID NO: 141379 - DNA, 20 bp, Artificial Sequence
  chemically synthesized
caaagcaaaactgaaaaata

SEQ ID NO: 141380 - DNA, 20 bp, Artificial Sequence
  chemically synthesized
ggctatctatctgtattttt

SEQ ID NO: 141381 - DNA, 20 bp, Artificial Sequence
  chemically synthesized
gcaaaactgaaaaatacaga

SEQ ID NO: 141382 - DNA, 20 bp, Artificial Sequence
  chemically synthesized
aactgaaaaatacagataga

SEQ ID NO: 141383 - DNA, 20 bp, Artificial Sequence
  chemically synthesized
gaaaaatacagatagatagc

SEQ ID NO: 141384 - DNA, 20 bp, Artificial Sequence
  chemically synthesized
aaaaatacagatagatagcc

SEQ ID NO: 141385 - DNA, 20 bp, Artificial Sequence
  chemically synthesized
aatacagatagatagccagg

SEQ ID NO: 141386 - DNA, 20 bp, Artificial Sequence
  chemically synthesized
atacagatagatagccaggc

SEQ ID NO: 141387 - DNA, 20 bp, Artificial Sequence
  chemically synthesized
tacagatagatagccaggca

SEQ ID NO: 141388 - DNA, 20 bp, Artificial Sequence
  chemically synthesized
tctctctctttttccctgcc

SEQ ID NO: 141389 - DNA, 20 bp, Artificial Sequence
  chemically synthesized
tagatagccaggcagggaaa

SEQ ID NO: 141390 - DNA, 20 bp, Artificial Sequence
  chemically synthesized
gatagccaggcagggaaaaa

SEQ ID NO: 141391 - DNA, 20 bp, Artificial Sequence
  chemically synthesized
tagccaggcagggaaaaaga

SEQ ID NO: 141392 - DNA, 20 bp, Artificial Sequence
  chemically synthesized
gccaggcagggaaaaagaga

SEQ ID NO: 141393 - DNA, 20 bp, Artificial Sequence
  chemically synthesized
caggcagggaaaaagagaga

SEQ ID NO: 141394 - DNA, 20 bp, Artificial Sequence
  chemically synthesized
cagggaaaaagagagagaga

SEQ ID NO: 141395 - DNA, 20 bp, Artificial Sequence
  chemically synthesized
ctctctctcttttaatgagt

SEQ ID NO: 141396 - DNA, 20 bp, Artificial Sequence
  chemically synthesized
gagacagactgactcattaa

SEQ ID NO: 141397 - DNA, 20 bp, Artificial Sequence
  chemically synthesized
gacagactgactcattaaaa

SEQ ID NO: 141398 - DNA, 20 bp, Artificial Sequence
  chemically synthesized
ctctctctctctcttttaat

SEQ ID NO: 141399 - DNA, 20 bp, Artificial Sequence
  chemically synthesized
cagactgactcattaaaaga

SEQ ID NO: 141400 - DNA, 20 bp, Artificial Sequence
  chemically synthesized
gactgactcattaaaagaga

SEQ ID NO: 141401 - DNA, 20 bp, Artificial Sequence
  chemically synthesized
ctgactcattaaaagagaga

SEQ ID NO: 141402 - DNA, 20 bp, Artificial Sequence
  chemically synthesized
gactcattaaaagagagaga

SEQ ID NO: 141403 - DNA, 20 bp, Artificial Sequence
  chemically synthesized
ctcattaaaagagagagaga

SEQ ID NO: 141404 - DNA, 20 bp, Artificial Sequence
  chemically synthesized
agtatcctataaatcagagt

SEQ ID NO: 141405 - DNA, 20 bp, Artificial Sequence
  chemically synthesized
gagacactgactctgattta

SEQ ID NO: 141406 - DNA, 20 bp, Artificial Sequence
  chemically synthesized
agcaagtatcctataaatca

SEQ ID NO: 141407 - DNA, 20 bp, Artificial Sequence
  chemically synthesized
agacactgactctgatttat

SEQ ID NO: 141408 - DNA, 20 bp, Artificial Sequence
  chemically synthesized
taagcaagtatcctataaat

SEQ ID NO: 141409 - DNA, 20 bp, Artificial Sequence
  chemically synthesized
tctaacaggaatagataagc

SEQ ID NO: 141410 - DNA, 20 bp, Artificial Sequence
  chemically synthesized
aaattctaacaggaatagat

SEQ ID NO: 141411 - DNA, 20 bp, Artificial Sequence
  chemically synthesized
acttgcttatctattcctgt

SEQ ID NO: 141412 - DNA, 20 bp, Artificial Sequence
  chemically synthesized
gcagaaaattctaacaggaa

SEQ ID NO: 141413 - DNA, 20 bp, Artificial Sequence
  chemically synthesized
ggcaagcagaaaattctaac

SEQ ID NO: 141414 - DNA, 20 bp, Artificial Sequence
  chemically synthesized
tggcaagcagaaaattctaa

SEQ ID NO: 141415 - DNA, 20 bp, Artificial Sequence
  chemically synthesized
atactatgtgaagtggcaag

SEQ ID NO: 141416 - DNA, 20 bp, Artificial Sequence
  chemically synthesized
ttgatactatgtgaagtggc

SEQ ID NO: 141417 - DNA, 20 bp, Artificial Sequence
  chemically synthesized
tttctgcttgccacttcaca

SEQ ID NO: 141418 - DNA, 20 bp, Artificial Sequence
  chemically synthesized
tttgttgatactatgtgaag

SEQ ID NO: 141419 - DNA, 20 bp, Artificial Sequence
  chemically synthesized
cgttttgttgatactatgtg

SEQ ID NO: 141420 - DNA, 20 bp, Artificial Sequence
  chemically synthesized
tttaatagtctgtaatttgg

SEQ ID NO: 141421 - DNA, 20 bp, Artificial Sequence
  chemically synthesized
aatgtattacccccaaatta

SEQ ID NO: 141422 - DNA, 20 bp, Artificial Sequence
  chemically synthesized
atttaatagtctgtaatttg

SEQ ID NO: 141423 - DNA, 20 bp, Artificial Sequence
  chemically synthesized
tatttaatagtctgtaattt

SEQ ID NO: 141424 - DNA, 20 bp, Artificial Sequence
  chemically synthesized
ttatttaatagtctgtaatt

SEQ ID NO: 141425 - DNA, 20 bp, Artificial Sequence
  chemically synthesized
aaattacagactattaaata

SEQ ID NO: 141426 - DNA, 20 bp, Artificial Sequence
  chemically synthesized
tagtttttatctttatttaa

SEQ ID NO: 141427 - DNA, 20 bp, Artificial Sequence
  chemically synthesized
attaaataaagataaaaact

SEQ ID NO: 141428 - DNA, 20 bp, Artificial Sequence
  chemically synthesized
acttctcatgaaaatcatct

SEQ ID NO: 141429 - DNA, 20 bp, Artificial Sequence
  chemically synthesized
aaaactaagatgattttcat

SEQ ID NO: 141430 - DNA, 20 bp, Artificial Sequence
  chemically synthesized
actaagatgattttcatgag

SEQ ID NO: 141431 - DNA, 20 bp, Artificial Sequence
  chemically synthesized
tttcatgagaagtaaacaat

SEQ ID NO: 141432 - DNA, 20 bp, Artificial Sequence
  chemically synthesized
taaacaataagctttttaca

SEQ ID NO: 141433 - DNA, 20 bp, Artificial Sequence
  chemically synthesized
ctcagtttgtgctgtgtaaa

SEQ ID NO: 141434 - DNA, 20 bp, Artificial Sequence
  chemically synthesized
ctttttacacagcacaaact

SEQ ID NO: 141435 - DNA, 20 bp, Artificial Sequence
  chemically synthesized
tttttacacagcacaaactg

SEQ ID NO: 141436 - DNA, 20 bp, Artificial Sequence
  chemically synthesized
actttgtgtaatgaaatcct

SEQ ID NO: 141437 - DNA, 20 bp, Artificial Sequence
  chemically synthesized
actgaggatttcattacaca

SEQ ID NO: 141438 - DNA, 20 bp, Artificial Sequence
  chemically synthesized
gatttcattacacaaagtta

SEQ ID NO: 141439 - DNA, 20 bp, Artificial Sequence
  chemically synthesized
atttcattacacaaagttat

SEQ ID NO: 141440 - DNA, 20 bp, Artificial Sequence
  chemically synthesized
attacacaaagttatgggaa

SEQ ID NO: 141441 - DNA, 20 bp, Artificial Sequence
  chemically synthesized
ataacaaagatatcaatatg

SEQ ID NO: 141442 - DNA, 20 bp, Artificial Sequence
  chemically synthesized
ctgagatattcacaataaca

SEQ ID NO: 141443 - DNA, 20 bp, Artificial Sequence
  chemically synthesized
ctttgttattgtgaatatct

SEQ ID NO: 141444 - DNA, 20 bp, Artificial Sequence
  chemically synthesized
tttacagattcacaataact

SEQ ID NO: 141445 - DNA, 20 bp, Artificial Sequence
  chemically synthesized
gtaatagggcatggaattta

SEQ ID NO: 141446 - DNA, 20 bp, Artificial Sequence
  chemically synthesized
tgtatgggggtaatagggca

SEQ ID NO: 141447 - DNA, 20 bp, Artificial Sequence
  chemically synthesized
tggcttgtatgggggtaata

SEQ ID NO: 141448 - DNA, 20 bp, Artificial Sequence
  chemically synthesized
ctggcttgtatgggggtaat

SEQ ID NO: 141449 - DNA, 20 bp, Artificial Sequence
  chemically synthesized
cctggcttgtatgggggtaa

SEQ ID NO: 141450 - DNA, 20 bp, Artificial Sequence
  chemically synthesized
atgccctattacccccatac

SEQ ID NO: 141451 - DNA, 20 bp, Artificial Sequence
  chemically synthesized
catctccctggcttgtatgg

SEQ ID NO: 141452 - DNA, 20 bp, Artificial Sequence
  chemically synthesized
acatctccctggcttgtatg

SEQ ID NO: 141453 - DNA, 20 bp, Artificial Sequence
  chemically synthesized
tacatctccctggcttgtat

SEQ ID NO: 141454 - DNA, 20 bp, Artificial Sequence
  chemically synthesized
cctattacccccatacaagc

SEQ ID NO: 141455 - DNA, 20 bp, Artificial Sequence
  chemically synthesized
gtacatctccctggcttgta

SEQ ID NO: 141456 - DNA, 20 bp, Artificial Sequence
  chemically synthesized
ctattacccccatacaagcc

SEQ ID NO: 141457 - DNA, 20 bp, Artificial Sequence
  chemically synthesized
tattacccccatacaagcca

SEQ ID NO: 141458 - DNA, 20 bp, Artificial Sequence
  chemically synthesized
ttacccccatacaagccagg

SEQ ID NO: 141459 - DNA, 20 bp, Artificial Sequence
  chemically synthesized
attatacgagtacatctccc

SEQ ID NO: 141460 - DNA, 20 bp, Artificial Sequence
  chemically synthesized
agggagatgtactcgtataa

SEQ ID NO: 141461 - DNA, 20 bp, Artificial Sequence
  chemically synthesized
tgagtgaaatgctattatac

SEQ ID NO: 141462 - DNA, 20 bp, Artificial Sequence
  chemically synthesized
tttggtgtcaattcaatcat

SEQ ID NO: 141463 - DNA, 20 bp, Artificial Sequence
  chemically synthesized
atgattgaattgacaccaaa

SEQ ID NO: 141464 - DNA, 20 bp, Artificial Sequence
  chemically synthesized
attgcaaagaggcaaccatt

SEQ ID NO: 141465 - DNA, 20 bp, Artificial Sequence
  chemically synthesized
tctttgtatatattgcaaag

SEQ ID NO: 141466 - DNA, 20 bp, Artificial Sequence
  chemically synthesized
ttctttgtatatattgcaaa

SEQ ID NO: 141467 - DNA, 20 bp, Artificial Sequence
  chemically synthesized
atttctttgtatatattgca

SEQ ID NO: 141468 - DNA, 20 bp, Artificial Sequence
  chemically synthesized
gcctctttgcaatatataca

SEQ ID NO: 141469 - DNA, 20 bp, Artificial Sequence
  chemically synthesized
aatatatacaaagaaatttt

SEQ ID NO: 141470 - DNA, 20 bp, Artificial Sequence
  chemically synthesized
tacaaagaaatttttagttg

SEQ ID NO: 141471 - DNA, 20 bp, Artificial Sequence
  chemically synthesized
acaaagaaatttttagttgt

SEQ ID NO: 141472 - DNA, 20 bp, Artificial Sequence
  chemically synthesized
taactacaaaacaaaacaca

SEQ ID NO: 141473 - DNA, 20 bp, Artificial Sequence
  chemically synthesized
gggctttgtgttttgttttg

SEQ ID NO: 141474 - DNA, 20 bp, Artificial Sequence
  chemically synthesized
tttgtgttttgttttgtagt

SEQ ID NO: 141475 - DNA, 20 bp, Artificial Sequence
  chemically synthesized
agacatttgattatttttag

SEQ ID NO: 141476 - DNA, 20 bp, Artificial Sequence
  chemically synthesized
atcagacatttgattatttt

SEQ ID NO: 141477 - DNA, 20 bp, Artificial Sequence
  chemically synthesized
aaataatcaaatgtctgata

SEQ ID NO: 141478 - DNA, 20 bp, Artificial Sequence
  chemically synthesized
tctttatggcttaactatat

SEQ ID NO: 141479 - DNA, 20 bp, Artificial Sequence
  chemically synthesized
atcaaatgtctgatatagtt

SEQ ID NO: 141480 - DNA, 20 bp, Artificial Sequence
  chemically synthesized
tctgatatagttaagccata

SEQ ID NO: 141481 - DNA, 20 bp, Artificial Sequence
  chemically synthesized
agacacttctttcatcttta

SEQ ID NO: 141482 - DNA, 20 bp, Artificial Sequence
  chemically synthesized
tagttaagccataaagatga

SEQ ID NO: 141483 - DNA, 20 bp, Artificial Sequence
  chemically synthesized
ttaagccataaagatgaaag

SEQ ID NO: 141484 - DNA, 20 bp, Artificial Sequence
  chemically synthesized
aattaataaatattttaagt

SEQ ID NO: 141485 - DNA, 20 bp, Artificial Sequence
  chemically synthesized
atgtaattaataaatatttt

SEQ ID NO: 141486 - DNA, 20 bp, Artificial Sequence
  chemically synthesized
atcagaatataagtatatta

SEQ ID NO: 141487 - DNA, 20 bp, Artificial Sequence
  chemically synthesized
gttcctgcacatcagaatat

SEQ ID NO: 141488 - DNA, 20 bp, Artificial Sequence
  chemically synthesized
tatacttatattctgatgtg

SEQ ID NO: 141489 - DNA, 20 bp, Artificial Sequence
  chemically synthesized
atacttatattctgatgtgc

SEQ ID NO: 141490 - DNA, 20 bp, Artificial Sequence
  chemically synthesized
gtaactgagttcctgcacat

SEQ ID NO: 141491 - DNA, 20 bp, Artificial Sequence
  chemically synthesized
tattctgatgtgcaggaact

SEQ ID NO: 141492 - DNA, 20 bp, Artificial Sequence
  chemically synthesized
aattcctgacttaagtaact

SEQ ID NO: 141493 - DNA, 20 bp, Artificial Sequence
  chemically synthesized
gtgcaggaactcagttactt

SEQ ID NO: 141494 - DNA, 20 bp, Artificial Sequence
  chemically synthesized
aggaactcagttacttaagt

SEQ ID NO: 141495 - DNA, 20 bp, Artificial Sequence
  chemically synthesized
ggaactcagttacttaagtc

SEQ ID NO: 141496 - DNA, 20 bp, Artificial Sequence
  chemically synthesized
cccacgtgaattcctgactt

SEQ ID NO: 141497 - DNA, 20 bp, Artificial Sequence
  chemically synthesized
acttaagtcaggaattcacg

SEQ ID NO: 141498 - DNA, 20 bp, Artificial Sequence
  chemically synthesized
cttaagtcaggaattcacgt

SEQ ID NO: 141499 - DNA, 20 bp, Artificial Sequence
  chemically synthesized
ttaagtcaggaattcacgtg

SEQ ID NO: 141500 - DNA, 20 bp, Artificial Sequence
  chemically synthesized
gtcaggaattcacgtgggga

SEQ ID NO: 141501 - DNA, 20 bp, Artificial Sequence
  chemically synthesized
caggaattcacgtggggata

SEQ ID NO: 141502 - DNA, 20 bp, Artificial Sequence
  chemically synthesized
aattcacgtggggatagagt

SEQ ID NO: 141503 - DNA, 20 bp, Artificial Sequence
  chemically synthesized
ggatagagttagaatttaat

SEQ ID NO: 141504 - DNA, 20 bp, Artificial Sequence
  chemically synthesized
agagttagaatttaatcaga

SEQ ID NO: 141505 - DNA, 20 bp, Artificial Sequence
  chemically synthesized
gagttagaatttaatcagaa

SEQ ID NO: 141506 - DNA, 20 bp, Artificial Sequence
  chemically synthesized
tagaatttaatcagaaaggc

SEQ ID NO: 141507 - DNA, 20 bp, Artificial Sequence
  chemically synthesized
aatcagaaaggccagtctcc

SEQ ID NO: 141508 - DNA, 20 bp, Artificial Sequence
  chemically synthesized
atcagaaaggccagtctcct

SEQ ID NO: 141509 - DNA, 20 bp, Artificial Sequence
  chemically synthesized
tagaacccaccccaggagac

SEQ ID NO: 141510 - DNA, 20 bp, Artificial Sequence
  chemically synthesized
tcagaaaggccagtctcctg

SEQ ID NO: 141511 - DNA, 20 bp, Artificial Sequence
  chemically synthesized
gaaaggccagtctcctgggg

SEQ ID NO: 141512 - DNA, 20 bp, Artificial Sequence
  chemically synthesized
aaaggccagtctcctggggt

SEQ ID NO: 141513 - DNA, 20 bp, Artificial Sequence
  chemically synthesized
gctggtagaacccaccccag

SEQ ID NO: 141514 - DNA, 20 bp, Artificial Sequence
  chemically synthesized
atgctggtagaacccacccc

SEQ ID NO: 141515 - DNA, 20 bp, Artificial Sequence
  chemically synthesized
aatgctggtagaacccaccc

SEQ ID NO: 141516 - DNA, 20 bp, Artificial Sequence
  chemically synthesized
tctcctggggtgggttctac

SEQ ID NO: 141517 - DNA, 20 bp, Artificial Sequence
  chemically synthesized
aaaaatagttcaaatgctgg

SEQ ID NO: 141518 - DNA, 20 bp, Artificial Sequence
  chemically synthesized
ataaaaaatagttcaaatgc

SEQ ID NO: 141519 - DNA, 20 bp, Artificial Sequence
  chemically synthesized
gtgttgactgtgataaaaaa

SEQ ID NO: 141520 - DNA, 20 bp, Artificial Sequence
  chemically synthesized
atttgaactattttttatca

SEQ ID NO: 141521 - DNA, 20 bp, Artificial Sequence
  chemically synthesized
ttttttatcacagtcaacac

SEQ ID NO: 141522 - DNA, 20 bp, Artificial Sequence
  chemically synthesized
ttttatcacagtcaacacta

SEQ ID NO: 141523 - DNA, 20 bp, Artificial Sequence
  chemically synthesized
tttatcacagtcaacactag

SEQ ID NO: 141524 - DNA, 20 bp, Artificial Sequence
  chemically synthesized
ttgctcattagcaaggcctc

SEQ ID NO: 141525 - DNA, 20 bp, Artificial Sequence
  chemically synthesized
acactagaggccttgctaat

SEQ ID NO: 141526 - DNA, 20 bp, Artificial Sequence
  chemically synthesized
attcattttgctcattagca

SEQ ID NO: 141527 - DNA, 20 bp, Artificial Sequence
  chemically synthesized
tattcattttgctcattagc

SEQ ID NO: 141528 - DNA, 20 bp, Artificial Sequence
  chemically synthesized
ctaatattcattttgctcat

SEQ ID NO: 141529 - DNA, 20 bp, Artificial Sequence
  chemically synthesized
ctaatgagcaaaatgaatat

SEQ ID NO: 141530 - DNA, 20 bp, Artificial Sequence
  chemically synthesized
gcaaaatgaatattagaaat

SEQ ID NO: 141531 - DNA, 20 bp, Artificial Sequence
  chemically synthesized
agaaatgagttttcacttat

SEQ ID NO: 141532 - DNA, 20 bp, Artificial Sequence
  chemically synthesized
tgagttttcacttatgagat

SEQ ID NO: 141533 - DNA, 20 bp, Artificial Sequence
  chemically synthesized
ttaagtaacactaatctcat

SEQ ID NO: 141534 - DNA, 20 bp, Artificial Sequence
  chemically synthesized
ttatgagattagtgttactt

SEQ ID NO: 141535 - DNA, 20 bp, Artificial Sequence
  chemically synthesized
ttaaccaaagcatgtatctt

SEQ ID NO: 141536 - DNA, 20 bp, Artificial Sequence
  chemically synthesized
gttacttaagatacatgctt

SEQ ID NO: 141537 - DNA, 20 bp, Artificial Sequence
  chemically synthesized
gctctcaaatattttaacca

SEQ ID NO: 141538 - DNA, 20 bp, Artificial Sequence
  chemically synthesized
atgctttggttaaaatattt

SEQ ID NO: 141539 - DNA, 20 bp, Artificial Sequence
  chemically synthesized
gctttggttaaaatatttga

SEQ ID NO: 141540 - DNA, 20 bp, Artificial Sequence
  chemically synthesized
tgagagcaattcctcatctc

SEQ ID NO: 141541 - DNA, 20 bp, Artificial Sequence
  chemically synthesized
tacctagcaagctagagatg

SEQ ID NO: 141542 - DNA, 20 bp, Artificial Sequence
  chemically synthesized
atacctagcaagctagagat

SEQ ID NO: 141543 - DNA, 20 bp, Artificial Sequence
  chemically synthesized
tttttatacctagcaagcta

SEQ ID NO: 141544 - DNA, 20 bp, Artificial Sequence
  chemically synthesized
attcctcatctctagcttgc

SEQ ID NO: 141545 - DNA, 20 bp, Artificial Sequence
  chemically synthesized
ttcctcatctctagcttgct

SEQ ID NO: 141546 - DNA, 20 bp, Artificial Sequence
  chemically synthesized
tatttttatacctagcaagc

SEQ ID NO: 141547 - DNA, 20 bp, Artificial Sequence
  chemically synthesized
actatatttttatacctagc

SEQ ID NO: 141548 - DNA, 20 bp, Artificial Sequence
  chemically synthesized
acttactatatttttatacc

SEQ ID NO: 141549 - DNA, 20 bp, Artificial Sequence
  chemically synthesized
gcttgctaggtataaaaata

SEQ ID NO: 141550 - DNA, 20 bp, Artificial Sequence
  chemically synthesized
gctaggtataaaaatatagt

SEQ ID NO: 141551 - DNA, 20 bp, Artificial Sequence
  chemically synthesized
tataaaaatatagtaagtta

SEQ ID NO: 141552 - DNA, 20 bp, Artificial Sequence
  chemically synthesized
ggcaccattccaaagaatac

SEQ ID NO: 141553 - DNA, 20 bp, Artificial Sequence
  chemically synthesized
gttatggaacctgtattctt

SEQ ID NO: 141554 - DNA, 20 bp, Artificial Sequence
  chemically synthesized
gggcaccattccaaagaata

SEQ ID NO: 141555 - DNA, 20 bp, Artificial Sequence
  chemically synthesized
ggaacctgtattctttggaa

SEQ ID NO: 141556 - DNA, 20 bp, Artificial Sequence
  chemically synthesized
aaatcttgggcaccattcca

SEQ ID NO: 141557 - DNA, 20 bp, Artificial Sequence
  chemically synthesized
tattctttggaatggtgccc

SEQ ID NO: 141558 - DNA, 20 bp, Artificial Sequence
  chemically synthesized
tagtttaggcattaaatctt

SEQ ID NO: 141559 - DNA, 20 bp, Artificial Sequence
  chemically synthesized
atagtttaggcattaaatct

SEQ ID NO: 141560 - DNA, 20 bp, Artificial Sequence
  chemically synthesized
gtggaaacaaagcatagttt

SEQ ID NO: 141561 - DNA, 20 bp, Artificial Sequence
  chemically synthesized
tgtggaaacaaagcatagtt

SEQ ID NO: 141562 - DNA, 20 bp, Artificial Sequence
  chemically synthesized
ttcaatgtggaaacaaagca

SEQ ID NO: 141563 - DNA, 20 bp, Artificial Sequence
  chemically synthesized
tcggattcaatgtggaaaca

SEQ ID NO: 141564 - DNA, 20 bp, Artificial Sequence
  chemically synthesized
tagaatcttcggattcaatg

SEQ ID NO: 141565 - DNA, 20 bp, Artificial Sequence
  chemically synthesized
ttgtttccacattgaatccg

SEQ ID NO: 141566 - DNA, 20 bp, Artificial Sequence
  chemically synthesized
cacattgaatccgaagattc

SEQ ID NO: 141567 - DNA, 20 bp, Artificial Sequence
  chemically synthesized
catcagacaactagaatctt

SEQ ID NO: 141568 - DNA, 20 bp, Artificial Sequence
  chemically synthesized
tagagaaggcatcagacaac

SEQ ID NO: 141569 - DNA, 20 bp, Artificial Sequence
  chemically synthesized
gttaaccttagagaaggcat

SEQ ID NO: 141570 - DNA, 20 bp, Artificial Sequence
  chemically synthesized
agttgtctgatgccttctct

SEQ ID NO: 141571 - DNA, 20 bp, Artificial Sequence
  chemically synthesized
gttgtctgatgccttctcta

SEQ ID NO: 141572 - DNA, 20 bp, Artificial Sequence
  chemically synthesized
gatgcagttaaccttagaga

SEQ ID NO: 141573 - DNA, 20 bp, Artificial Sequence
  chemically synthesized
ggatgcagttaaccttagag

SEQ ID NO: 141574 - DNA, 20 bp, Artificial Sequence
  chemically synthesized
gcaggatgcagttaacctta

SEQ ID NO: 141575 - DNA, 20 bp, Artificial Sequence
  chemically synthesized
aggcaggatgcagttaacct

SEQ ID NO: 141576 - DNA, 20 bp, Artificial Sequence
  chemically synthesized
cagaatctagaggcaggatg

SEQ ID NO: 141577 - DNA, 20 bp, Artificial Sequence
  chemically synthesized
ggttaactgcatcctgcctc

SEQ ID NO: 141578 - DNA, 20 bp, Artificial Sequence
  chemically synthesized
atattccagaatctagaggc

SEQ ID NO: 141579 - DNA, 20 bp, Artificial Sequence
  chemically synthesized
aatattccagaatctagagg

SEQ ID NO: 141580 - DNA, 20 bp, Artificial Sequence
  chemically synthesized
gagaatattccagaatctag

SEQ ID NO: 141581 - DNA, 20 bp, Artificial Sequence
  chemically synthesized
tgcatcctgcctctagattc

SEQ ID NO: 141582 - DNA, 20 bp, Artificial Sequence
  chemically synthesized
tgagaatattccagaatcta

SEQ ID NO: 141583 - DNA, 20 bp, Artificial Sequence
  chemically synthesized
catgagaatattccagaatc

SEQ ID NO: 141584 - DNA, 20 bp, Artificial Sequence
  chemically synthesized
agggagacatgagaatattc

SEQ ID NO: 141585 - DNA, 20 bp, Artificial Sequence
  chemically synthesized
ggttcaatcaagggagacat

SEQ ID NO: 141586 - DNA, 20 bp, Artificial Sequence
  chemically synthesized
tataaaaggttcaatcaagg

SEQ ID NO: 141587 - DNA, 20 bp, Artificial Sequence
  chemically synthesized
cgtataaaaggttcaatcaa

SEQ ID NO: 141588 - DNA, 20 bp, Artificial Sequence
  chemically synthesized
ccgtataaaaggttcaatca

SEQ ID NO: 141589 - DNA, 20 bp, Artificial Sequence
  chemically synthesized
tccgtataaaaggttcaatc

SEQ ID NO: 141590 - DNA, 20 bp, Artificial Sequence
  chemically synthesized
ccttgattgaaccttttata

SEQ ID NO: 141591 - DNA, 20 bp, Artificial Sequence
  chemically synthesized
gttgtcatactccgtataaa

SEQ ID NO: 141592 - DNA, 20 bp, Artificial Sequence
  chemically synthesized
ttgattgaaccttttatacg

SEQ ID NO: 141593 - DNA, 20 bp, Artificial Sequence
  chemically synthesized
tgttgtcatactccgtataa

SEQ ID NO: 141594 - DNA, 20 bp, Artificial Sequence
  chemically synthesized
tacggagtatgacaacacct

SEQ ID NO: 141595 - DNA, 20 bp, Artificial Sequence
  chemically synthesized
cggagtatgacaacacctga

SEQ ID NO: 141596 - DNA, 20 bp, Artificial Sequence
  chemically synthesized
gtatgacaacacctgagagt

SEQ ID NO: 141597 - DNA, 20 bp, Artificial Sequence
  chemically synthesized
tatgacaacacctgagagtg

SEQ ID NO: 141598 - DNA, 20 bp, Artificial Sequence
  chemically synthesized
actcccataccctcactctc

SEQ ID NO: 141599 - DNA, 20 bp, Artificial Sequence
  chemically synthesized
atgacaacacctgagagtga

SEQ ID NO: 141600 - DNA, 20 bp, Artificial Sequence
  chemically synthesized
cactcccataccctcactct

SEQ ID NO: 141601 - DNA, 20 bp, Artificial Sequence
  chemically synthesized
aacacctgagagtgagggta

SEQ ID NO: 141602 - DNA, 20 bp, Artificial Sequence
  chemically synthesized
acacctgagagtgagggtat

SEQ ID NO: 141603 - DNA, 20 bp, Artificial Sequence
  chemically synthesized
acctgagagtgagggtatgg

SEQ ID NO: 141604 - DNA, 20 bp, Artificial Sequence
  chemically synthesized
agagtgagggtatgggagtg

SEQ ID NO: 141605 - DNA, 20 bp, Artificial Sequence
  chemically synthesized
ttagtataataggtaaaggt

SEQ ID NO: 141606 - DNA, 20 bp, Artificial Sequence
  chemically synthesized
aactttagtataataggtaa

SEQ ID NO: 141607 - DNA, 20 bp, Artificial Sequence
  chemically synthesized
aaactttagtataataggta

SEQ ID NO: 141608 - DNA, 20 bp, Artificial Sequence
  chemically synthesized
cagcaaaactttagtataat

SEQ ID NO: 141609 - DNA, 20 bp, Artificial Sequence
  chemically synthesized
acagcaaaactttagtataa

SEQ ID NO: 141610 - DNA, 20 bp, Artificial Sequence
  chemically synthesized
aacctttacctattatacta

SEQ ID NO: 141611 - DNA, 20 bp, Artificial Sequence
  chemically synthesized
agataaccacagcaaaactt

SEQ ID NO: 141612 - DNA, 20 bp, Artificial Sequence
  chemically synthesized
attatactaaagttttgctg

SEQ ID NO: 141613 - DNA, 20 bp, Artificial Sequence
  chemically synthesized
ttatttttggtagataacca

SEQ ID NO: 141614 - DNA, 20 bp, Artificial Sequence
  chemically synthesized
aactattaggttatttttgg

SEQ ID NO: 141615 - DNA, 20 bp, Artificial Sequence
  chemically synthesized
gccaactattaggttatttt

SEQ ID NO: 141616 - DNA, 20 bp, Artificial Sequence
  chemically synthesized
atctaccaaaaataacctaa

SEQ ID NO: 141617 - DNA, 20 bp, Artificial Sequence
  chemically synthesized
accaaaaataacctaatagt

SEQ ID NO: 141618 - DNA, 20 bp, Artificial Sequence
  chemically synthesized
attatgcaaggccaactatt

SEQ ID NO: 141619 - DNA, 20 bp, Artificial Sequence
  chemically synthesized
tattatgcaaggccaactat

SEQ ID NO: 141620 - DNA, 20 bp, Artificial Sequence
  chemically synthesized
taatagttggccttgcataa

SEQ ID NO: 141621 - DNA, 20 bp, Artificial Sequence
  chemically synthesized
tagatcaacactattatgca

SEQ ID NO: 141622 - DNA, 20 bp, Artificial Sequence
  chemically synthesized
ctagatcaacactattatgc

SEQ ID NO: 141623 - DNA, 20 bp, Artificial Sequence
  chemically synthesized
cttgcataatagtgttgatc

SEQ ID NO: 141624 - DNA, 20 bp, Artificial Sequence
  chemically synthesized
ttgcataatagtgttgatct

SEQ ID NO: 141625 - DNA, 20 bp, Artificial Sequence
  chemically synthesized
tgcataatagtgttgatcta

SEQ ID NO: 141626 - DNA, 20 bp, Artificial Sequence
  chemically synthesized
cgtggtgttatgaattgccc

SEQ ID NO: 141627 - DNA, 20 bp, Artificial Sequence
  chemically synthesized
ggcaattcataacaccacgt

SEQ ID NO: 141628 - DNA, 20 bp, Artificial Sequence
  chemically synthesized
tttaaaatttgtggcttacg

SEQ ID NO: 141629 - DNA, 20 bp, Artificial Sequence
  chemically synthesized
ggaggttattttaaaatttg

SEQ ID NO: 141630 - DNA, 20 bp, Artificial Sequence
  chemically synthesized
tttaaaataacctccactat

SEQ ID NO: 141631 - DNA, 20 bp, Artificial Sequence
  chemically synthesized
gttacacttccttatagtgg

SEQ ID NO: 141632 - DNA, 20 bp, Artificial Sequence
  chemically synthesized
ttaaaataacctccactata

SEQ ID NO: 141633 - DNA, 20 bp, Artificial Sequence
  chemically synthesized
ggttacacttccttatagtg

SEQ ID NO: 141634 - DNA, 20 bp, Artificial Sequence
  chemically synthesized
ttggttacacttccttatag

SEQ ID NO: 141635 - DNA, 20 bp, Artificial Sequence
  chemically synthesized
aaataacctccactataagg

SEQ ID NO: 141636 - DNA, 20 bp, Artificial Sequence
  chemically synthesized
gagttggttacacttcctta

SEQ ID NO: 141637 - DNA, 20 bp, Artificial Sequence
  chemically synthesized
tattgttgaatgtaaggagt

SEQ ID NO: 141638 - DNA, 20 bp, Artificial Sequence
  chemically synthesized
aatgtattgttgaatgtaag

SEQ ID NO: 141639 - DNA, 20 bp, Artificial Sequence
  chemically synthesized
caaatgtattgttgaatgta

SEQ ID NO: 141640 - DNA, 20 bp, Artificial Sequence
  chemically synthesized
tcaaatgtattgttgaatgt

SEQ ID NO: 141641 - DNA, 20 bp, Artificial Sequence
  chemically synthesized
aatacatttgactttattct

SEQ ID NO: 141642 - DNA, 20 bp, Artificial Sequence
  chemically synthesized
aataatatactccaagaata

SEQ ID NO: 141643 - DNA, 20 bp, Artificial Sequence
  chemically synthesized
tacatttgactttattcttg

SEQ ID NO: 141644 - DNA, 20 bp, Artificial Sequence
  chemically synthesized
aaaatgtaataatatactcc

SEQ ID NO: 141645 - DNA, 20 bp, Artificial Sequence
  chemically synthesized
tataaccatgaggaaataaa

SEQ ID NO: 141646 - DNA, 20 bp, Artificial Sequence
  chemically synthesized
tttttctttttatttcctca

SEQ ID NO: 141647 - DNA, 20 bp, Artificial Sequence
  chemically synthesized
ttataacaaatataaccatg

SEQ ID NO: 141648 - DNA, 20 bp, Artificial Sequence
  chemically synthesized
tttataacaaatataaccat

SEQ ID NO: 141649 - DNA, 20 bp, Artificial Sequence
  chemically synthesized
tcatggttatatttgttata

SEQ ID NO: 141650 - DNA, 20 bp, Artificial Sequence
  chemically synthesized
gttatatttgttataaagca

SEQ ID NO: 141651 - DNA, 20 bp, Artificial Sequence
  chemically synthesized
ataaagcatggttttataac

SEQ ID NO: 141652 - DNA, 20 bp, Artificial Sequence
  chemically synthesized
taaagcatggttttataact

SEQ ID NO: 141653 - DNA, 20 bp, Artificial Sequence
  chemically synthesized
tttaaagatctttaacgacc

SEQ ID NO: 141654 - DNA, 20 bp, Artificial Sequence
  chemically synthesized
gttttataactaggtcgtta

SEQ ID NO: 141655 - DNA, 20 bp, Artificial Sequence
  chemically synthesized
taggtcgttaaagatcttta

SEQ ID NO: 141656 - DNA, 20 bp, Artificial Sequence
  chemically synthesized
aaaaaataacacaatcttta

SEQ ID NO: 141657 - DNA, 20 bp, Artificial Sequence
  chemically synthesized
aattattcatatgatagtaa

SEQ ID NO: 141658 - DNA, 20 bp, Artificial Sequence
  chemically synthesized
ttgtgaaattattcatatga

SEQ ID NO: 141659 - DNA, 20 bp, Artificial Sequence
  chemically synthesized
ctcaagatgaaagacaaggc

SEQ ID NO: 141660 - DNA, 20 bp, Artificial Sequence
  chemically synthesized
gtgcctcaagatgaaagaca

SEQ ID NO: 141661 - DNA, 20 bp, Artificial Sequence
  chemically synthesized
ggtgcctcaagatgaaagac

SEQ ID NO: 141662 - DNA, 20 bp, Artificial Sequence
  chemically synthesized
cttgccttgtctttcatctt

SEQ ID NO: 141663 - DNA, 20 bp, Artificial Sequence
  chemically synthesized
gaataggtgcctcaagatga

SEQ ID NO: 141664 - DNA, 20 bp, Artificial Sequence
  chemically synthesized
ttgccttgtctttcatcttg

SEQ ID NO: 141665 - DNA, 20 bp, Artificial Sequence
  chemically synthesized
attatgtgaataggtgcctc

SEQ ID NO: 141666 - DNA, 20 bp, Artificial Sequence
  chemically synthesized
gaaaaaataattatgtgaat

SEQ ID NO: 141667 - DNA, 20 bp, Artificial Sequence
  chemically synthesized
tgaaaaaataattatgtgaa

SEQ ID NO: 141668 - DNA, 20 bp, Artificial Sequence
  chemically synthesized
ttcacataattattttttca

SEQ ID NO: 141669 - DNA, 20 bp, Artificial Sequence
  chemically synthesized
tacaaggcctggttattgtt

SEQ ID NO: 141670 - DNA, 20 bp, Artificial Sequence
  chemically synthesized
ttcacagtccaaacaataac

SEQ ID NO: 141671 - DNA, 20 bp, Artificial Sequence
  chemically synthesized
tcacagtccaaacaataacc

SEQ ID NO: 141672 - DNA, 20 bp, Artificial Sequence
  chemically synthesized
cataactaaattacaaggcc

SEQ ID NO: 141673 - DNA, 20 bp, Artificial Sequence
  chemically synthesized
aataaccaggccttgtaatt

SEQ ID NO: 141674 - DNA, 20 bp, Artificial Sequence
  chemically synthesized
tatttcataactaaattaca

SEQ ID NO: 141675 - DNA, 20 bp, Artificial Sequence
  chemically synthesized
ttatttcataactaaattac

SEQ ID NO: 141676 - DNA, 20 bp, Artificial Sequence
  chemically synthesized
taatttagttatgaaataaa

SEQ ID NO: 141677 - DNA, 20 bp, Artificial Sequence
  chemically synthesized
aatttagttatgaaataaaa

SEQ ID NO: 141678 - DNA, 20 bp, Artificial Sequence
  chemically synthesized
tagttatgaaataaaaaggc

SEQ ID NO: 141679 - DNA, 20 bp, Artificial Sequence
  chemically synthesized
taagacgattatgtaaatac

SEQ ID NO: 141680 - DNA, 20 bp, Artificial Sequence
  chemically synthesized
tatttacataatcgtcttat

SEQ ID NO: 141681 - DNA, 20 bp, Artificial Sequence
  chemically synthesized
cttgcacatgcataactcat

SEQ ID NO: 141682 - DNA, 20 bp, Artificial Sequence
  chemically synthesized
cttatgagttatgcatgtgc

SEQ ID NO: 141683 - DNA, 20 bp, Artificial Sequence
  chemically synthesized
ctctcacgcacacaaacatg

SEQ ID NO: 141684 - DNA, 20 bp, Artificial Sequence
  chemically synthesized
ttctgcatgtttgtgtgcgt

SEQ ID NO: 141685 - DNA, 20 bp, Artificial Sequence
  chemically synthesized
ctgcatgtttgtgtgcgtga

SEQ ID NO: 141686 - DNA, 20 bp, Artificial Sequence
  chemically synthesized
gcatgtttgtgtgcgtgaga

SEQ ID NO: 141687 - DNA, 20 bp, Artificial Sequence
  chemically synthesized
ttgtgtgcgtgagagagaca

SEQ ID NO: 141688 - DNA, 20 bp, Artificial Sequence
  chemically synthesized
gtgtgcgtgagagagacaca

SEQ ID NO: 141689 - DNA, 20 bp, Artificial Sequence
  chemically synthesized
gtgcgtgagagagacacaga

SEQ ID NO: 141690 - DNA, 20 bp, Artificial Sequence
  chemically synthesized
gcgtgagagagacacagaga

SEQ ID NO: 141691 - DNA, 20 bp, Artificial Sequence
  chemically synthesized
gtgagagagacacagagaga

SEQ ID NO: 141692 - DNA, 20 bp, Artificial Sequence
  chemically synthesized
gagagacacagagagagagc

SEQ ID NO: 141693 - DNA, 20 bp, Artificial Sequence
  chemically synthesized
gagacacagagagagagcga

SEQ ID NO: 141694 - DNA, 20 bp, Artificial Sequence
  chemically synthesized
cagagagagagcgagagatt

SEQ ID NO: 141695 - DNA, 20 bp, Artificial Sequence
  chemically synthesized
gagagagagcgagagattga

SEQ ID NO: 141696 - DNA, 20 bp, Artificial Sequence
  chemically synthesized
gagagcgagagattgagagt

SEQ ID NO: 141697 - DNA, 20 bp, Artificial Sequence
  chemically synthesized
tacacccctcaataatgatc

SEQ ID NO: 141698 - DNA, 20 bp, Artificial Sequence
  chemically synthesized
ttacacccctcaataatgat

SEQ ID NO: 141699 - DNA, 20 bp, Artificial Sequence
  chemically synthesized
gagtaagcccgatcattatt

SEQ ID NO: 141700 - DNA, 20 bp, Artificial Sequence
  chemically synthesized
agtaagcccgatcattattg

SEQ ID NO: 141701 - DNA, 20 bp, Artificial Sequence
  chemically synthesized
gtaagcccgatcattattga

SEQ ID NO: 141702 - DNA, 20 bp, Artificial Sequence
  chemically synthesized
taagcccgatcattattgag

SEQ ID NO: 141703 - DNA, 20 bp, Artificial Sequence
  chemically synthesized
cgatcattattgaggggtgt

SEQ ID NO: 141704 - DNA, 20 bp, Artificial Sequence
  chemically synthesized
gggtgtaagaaattacttta

SEQ ID NO: 141705 - DNA, 20 bp, Artificial Sequence
  chemically synthesized
gtgtaagaaattactttatg

SEQ ID NO: 141706 - DNA, 20 bp, Artificial Sequence
  chemically synthesized
caggtttttgcatctccata

SEQ ID NO: 141707 - DNA, 20 bp, Artificial Sequence
  chemically synthesized
tttatggagatgcaaaaacc

SEQ ID NO: 141708 - DNA, 20 bp, Artificial Sequence
  chemically synthesized
ttatggagatgcaaaaacct

SEQ ID NO: 141709 - DNA, 20 bp, Artificial Sequence
  chemically synthesized
tatggagatgcaaaaacctg

SEQ ID NO: 141710 - DNA, 20 bp, Artificial Sequence
  chemically synthesized
agatgcaaaaacctggggtt

SEQ ID NO: 141711 - DNA, 20 bp, Artificial Sequence
  chemically synthesized
cagtctcgtatctgaacccc

SEQ ID NO: 141712 - DNA, 20 bp, Artificial Sequence
  chemically synthesized
gcagtctcgtatctgaaccc

SEQ ID NO: 141713 - DNA, 20 bp, Artificial Sequence
  chemically synthesized
aaaacctggggttcagatac

SEQ ID NO: 141714 - DNA, 20 bp, Artificial Sequence
  chemically synthesized
ggggttcagatacgagactg

SEQ ID NO: 141715 - DNA, 20 bp, Artificial Sequence
  chemically synthesized
ttcagatacgagactgcggt

SEQ ID NO: 141716 - DNA, 20 bp, Artificial Sequence
  chemically synthesized
gggaggcaatgatctcaccg

SEQ ID NO: 141717 - DNA, 20 bp, Artificial Sequence
  chemically synthesized
atgagcccccagagggtggg

SEQ ID NO: 141718 - DNA, 20 bp, Artificial Sequence
  chemically synthesized
gatgagcccccagagggtgg

SEQ ID NO: 141719 - DNA, 20 bp, Artificial Sequence
  chemically synthesized
gatcattgcctcccaccctc

SEQ ID NO: 141720 - DNA, 20 bp, Artificial Sequence
  chemically synthesized
atcattgcctcccaccctct

SEQ ID NO: 141721 - DNA, 20 bp, Artificial Sequence
  chemically synthesized
cagatgagcccccagagggt

SEQ ID NO: 141722 - DNA, 20 bp, Artificial Sequence
  chemically synthesized
tcattgcctcccaccctctg

SEQ ID NO: 141723 - DNA, 20 bp, Artificial Sequence
  chemically synthesized
tcagatgagcccccagaggg

SEQ ID NO: 141724 - DNA, 20 bp, Artificial Sequence
  chemically synthesized
cattgcctcccaccctctgg

SEQ ID NO: 141725 - DNA, 20 bp, Artificial Sequence
  chemically synthesized
agctcagatgagcccccaga

SEQ ID NO: 141726 - DNA, 20 bp, Artificial Sequence
  chemically synthesized
cagctcagatgagcccccag

SEQ ID NO: 141727 - DNA, 20 bp, Artificial Sequence
  chemically synthesized
gcagctcagatgagccccca

SEQ ID NO: 141728 - DNA, 20 bp, Artificial Sequence
  chemically synthesized
tggcagctcagatgagcccc

SEQ ID NO: 141729 - DNA, 20 bp, Artificial Sequence
  chemically synthesized
caccctctgggggctcatct

SEQ ID NO: 141730 - DNA, 20 bp, Artificial Sequence
  chemically synthesized
aatattttggcagctcagat

SEQ ID NO: 141731 - DNA, 20 bp, Artificial Sequence
  chemically synthesized
aggagaatattttggcagct

SEQ ID NO: 141732 - DNA, 20 bp, Artificial Sequence
  chemically synthesized
cagagaggagaatattttgg

SEQ ID NO: 141733 - DNA, 20 bp, Artificial Sequence
  chemically synthesized
tgtcagagaggagaatattt

SEQ ID NO: 141734 - DNA, 20 bp, Artificial Sequence
  chemically synthesized
aagataaaaatgtcagagag

SEQ ID NO: 141735 - DNA, 20 bp, Artificial Sequence
  chemically synthesized
ccaagataaaaatgtcagag

SEQ ID NO: 141736 - DNA, 20 bp, Artificial Sequence
  chemically synthesized
gccaagataaaaatgtcaga

SEQ ID NO: 141737 - DNA, 20 bp, Artificial Sequence
  chemically synthesized
gagccaagataaaaatgtca

SEQ ID NO: 141738 - DNA, 20 bp, Artificial Sequence
  chemically synthesized
aagagccaagataaaaatgt

SEQ ID NO: 141739 - DNA, 20 bp, Artificial Sequence
  chemically synthesized
cctctctgacatttttatct

SEQ ID NO: 141740 - DNA, 20 bp, Artificial Sequence
  chemically synthesized
tgagaacttgtcgaagagcc

SEQ ID NO: 141741 - DNA, 20 bp, Artificial Sequence
  chemically synthesized
ttttatcttggctcttcgac

SEQ ID NO: 141742 - DNA, 20 bp, Artificial Sequence
  chemically synthesized
gcaactgagaacttgtcgaa

SEQ ID NO: 141743 - DNA, 20 bp, Artificial Sequence
  chemically synthesized
aggcaactgagaacttgtcg

SEQ ID NO: 141744 - DNA, 20 bp, Artificial Sequence
  chemically synthesized
ttggctcttcgacaagttct

SEQ ID NO: 141745 - DNA, 20 bp, Artificial Sequence
  chemically synthesized
tgaatcttgagcaggcaact

SEQ ID NO: 141746 - DNA, 20 bp, Artificial Sequence
  chemically synthesized
aagttctcagttgcctgctc

SEQ ID NO: 141747 - DNA, 20 bp, Artificial Sequence
  chemically synthesized
agagaatatgaatcttgagc

SEQ ID NO: 141748 - DNA, 20 bp, Artificial Sequence
  chemically synthesized
tagagaatatgaatcttgag

SEQ ID NO: 141749 - DNA, 20 bp, Artificial Sequence
  chemically synthesized
taatagagaatatgaatctt

SEQ ID NO: 141750 - DNA, 20 bp, Artificial Sequence
  chemically synthesized
tacccagggaagaaataata

SEQ ID NO: 141751 - DNA, 20 bp, Artificial Sequence
  chemically synthesized
gatacccagggaagaaataa

SEQ ID NO: 141752 - DNA, 20 bp, Artificial Sequence
  chemically synthesized
attctctattatttcttccc

SEQ ID NO: 141753 - DNA, 20 bp, Artificial Sequence
  chemically synthesized
ttctctattatttcttccct

SEQ ID NO: 141754 - DNA, 20 bp, Artificial Sequence
  chemically synthesized
gtgaaaatagatacccaggg

SEQ ID NO: 141755 - DNA, 20 bp, Artificial Sequence
  chemically synthesized
tctgtgaaaatagataccca

SEQ ID NO: 141756 - DNA, 20 bp, Artificial Sequence
  chemically synthesized
ttctgtgaaaatagataccc

SEQ ID NO: 141757 - DNA, 20 bp, Artificial Sequence
  chemically synthesized
attctgtgaaaatagatacc

SEQ ID NO: 141758 - DNA, 20 bp, Artificial Sequence
  chemically synthesized
tccctgggtatctattttca

SEQ ID NO: 141759 - DNA, 20 bp, Artificial Sequence
  chemically synthesized
cttcaactattctgtgaaaa

SEQ ID NO: 141760 - DNA, 20 bp, Artificial Sequence
  chemically synthesized
gggtatctattttcacagaa

SEQ ID NO: 141761 - DNA, 20 bp, Artificial Sequence
  chemically synthesized
ctattttcacagaatagttg

SEQ ID NO: 141762 - DNA, 20 bp, Artificial Sequence
  chemically synthesized
atagttgaagactcataata

SEQ ID NO: 141763 - DNA, 20 bp, Artificial Sequence
  chemically synthesized
attaaaataggctttattat

SEQ ID NO: 141764 - DNA, 20 bp, Artificial Sequence
  chemically synthesized
gaaaaatgatacattaaaat

SEQ ID NO: 141765 - DNA, 20 bp, Artificial Sequence
  chemically synthesized
ggaaaaatgatacattaaaa

SEQ ID NO: 141766 - DNA, 20 bp, Artificial Sequence
  chemically synthesized
tttaatgtatcatttttcct

SEQ ID NO: 141767 - DNA, 20 bp, Artificial Sequence
  chemically synthesized
agattgaaatggatttgctt

SEQ ID NO: 141768 - DNA, 20 bp, Artificial Sequence
  chemically synthesized
gagattgaaatggatttgct

SEQ ID NO: 141769 - DNA, 20 bp, Artificial Sequence
  chemically synthesized
aaaaacagtggagattgaaa

SEQ ID NO: 141770 - DNA, 20 bp, Artificial Sequence
  chemically synthesized
tttggcaaataaaaacagtg

SEQ ID NO: 141771 - DNA, 20 bp, Artificial Sequence
  chemically synthesized
tgtttggcaaataaaaacag

SEQ ID NO: 141772 - DNA, 20 bp, Artificial Sequence
  chemically synthesized
acatgtttggcaaataaaaa

SEQ ID NO: 141773 - DNA, 20 bp, Artificial Sequence
  chemically synthesized
attagtatttaggacatgtt

SEQ ID NO: 141774 - DNA, 20 bp, Artificial Sequence
  chemically synthesized
tgcgtttataattagtattt

SEQ ID NO: 141775 - DNA, 20 bp, Artificial Sequence
  chemically synthesized
ctgcgtttataattagtatt

SEQ ID NO: 141776 - DNA, 20 bp, Artificial Sequence
  chemically synthesized
cattgagctgcgtttataat

SEQ ID NO: 141777 - DNA, 20 bp, Artificial Sequence
  chemically synthesized
ctaaatactaattataaacg

SEQ ID NO: 141778 - DNA, 20 bp, Artificial Sequence
  chemically synthesized
attataaacgcagctcaatg

SEQ ID NO: 141779 - DNA, 20 bp, Artificial Sequence
  chemically synthesized
gaaacataataaactgcatt

SEQ ID NO: 141780 - DNA, 20 bp, Artificial Sequence
  chemically synthesized
acatatatggtataaatacg

SEQ ID NO: 141781 - DNA, 20 bp, Artificial Sequence
  chemically synthesized
acatacacgaataacatata

SEQ ID NO: 141782 - DNA, 20 bp, Artificial Sequence
  chemically synthesized
cgcgcatgcacgcgcacata

SEQ ID NO: 141783 - DNA, 20 bp, Artificial Sequence
  chemically synthesized
agattctatcacaggtttat

SEQ ID NO: 141784 - DNA, 20 bp, Artificial Sequence
  chemically synthesized
tgttgccaataaacctgtga

SEQ ID NO: 141785 - DNA, 20 bp, Artificial Sequence
  chemically synthesized
taagtgccagattctatcac

SEQ ID NO: 141786 - DNA, 20 bp, Artificial Sequence
  chemically synthesized
ataagtgccagattctatca

SEQ ID NO: 141787 - DNA, 20 bp, Artificial Sequence
  chemically synthesized
aataaacctgtgatagaatc

SEQ ID NO: 141788 - DNA, 20 bp, Artificial Sequence
  chemically synthesized
gcaatgccattgataagtgc

SEQ ID NO: 141789 - DNA, 20 bp, Artificial Sequence
  chemically synthesized
tagaatctggcacttatcaa

SEQ ID NO: 141790 - DNA, 20 bp, Artificial Sequence
  chemically synthesized
cccaaggcaatgccattgat

SEQ ID NO: 141791 - DNA, 20 bp, Artificial Sequence
  chemically synthesized
acttatcaatggcattgcct

SEQ ID NO: 141792 - DNA, 20 bp, Artificial Sequence
  chemically synthesized
cttatcaatggcattgcctt

SEQ ID NO: 141793 - DNA, 20 bp, Artificial Sequence
  chemically synthesized
tcaatggcattgccttgggc

SEQ ID NO: 141794 - DNA, 20 bp, Artificial Sequence
  chemically synthesized
gaggttaagtgacttgccca

SEQ ID NO: 141795 - DNA, 20 bp, Artificial Sequence
  chemically synthesized
agaggttaagtgacttgccc

SEQ ID NO: 141796 - DNA, 20 bp, Artificial Sequence
  chemically synthesized
gggagaaactcagagaggtt

SEQ ID NO: 141797 - DNA, 20 bp, Artificial Sequence
  chemically synthesized
gcaagtcacttaacctctct

SEQ ID NO: 141798 - DNA, 20 bp, Artificial Sequence
  chemically synthesized
tgaaagggagaaactcagag

SEQ ID NO: 141799 - DNA, 20 bp, Artificial Sequence
  chemically synthesized
ttgaaagggagaaactcaga

SEQ ID NO: 141800 - DNA, 20 bp, Artificial Sequence
  chemically synthesized
ttttgaaagggagaaactca

SEQ ID NO: 141801 - DNA, 20 bp, Artificial Sequence
  chemically synthesized
tgttttgaaagggagaaact

SEQ ID NO: 141802 - DNA, 20 bp, Artificial Sequence
  chemically synthesized
gtttttcttgttttgaaagg

SEQ ID NO: 141803 - DNA, 20 bp, Artificial Sequence
  chemically synthesized
gcgtttttcttgttttgaaa

SEQ ID NO: 141804 - DNA, 20 bp, Artificial Sequence
  chemically synthesized
ggcgtttttcttgttttgaa

SEQ ID NO: 141805 - DNA, 20 bp, Artificial Sequence
  chemically synthesized
gagtttctccctttcaaaac

SEQ ID NO: 141806 - DNA, 20 bp, Artificial Sequence
  chemically synthesized
tggcgtttttcttgttttga

SEQ ID NO: 141807 - DNA, 20 bp, Artificial Sequence
  chemically synthesized
tttcaaaacaagaaaaacgc

SEQ ID NO: 141808 - DNA, 20 bp, Artificial Sequence
  chemically synthesized
aaaacaagaaaaacgccagt

SEQ ID NO: 141809 - DNA, 20 bp, Artificial Sequence
  chemically synthesized
caaaagtggtacaagctaac

SEQ ID NO: 141810 - DNA, 20 bp, Artificial Sequence
  chemically synthesized
aatcctctcaaaagtggtac

SEQ ID NO: 141811 - DNA, 20 bp, Artificial Sequence
  chemically synthesized
agttagcttgtaccactttt

SEQ ID NO: 141812 - DNA, 20 bp, Artificial Sequence
  chemically synthesized
ttagcttgtaccacttttga

SEQ ID NO: 141813 - DNA, 20 bp, Artificial Sequence
  chemically synthesized
atttctaatcctctcaaaag

SEQ ID NO: 141814 - DNA, 20 bp, Artificial Sequence
  chemically synthesized
tagcttgtaccacttttgag

SEQ ID NO: 141815 - DNA, 20 bp, Artificial Sequence
  chemically synthesized
aatatttctaatcctctcaa

SEQ ID NO: 141816 - DNA, 20 bp, Artificial Sequence
  chemically synthesized
tgtaccacttttgagaggat

SEQ ID NO: 141817 - DNA, 20 bp, Artificial Sequence
  chemically synthesized
aatattgaatatgatatgca

SEQ ID NO: 141818 - DNA, 20 bp, Artificial Sequence
  chemically synthesized
gatatgcatagcacaatgcc

SEQ ID NO: 141819 - DNA, 20 bp, Artificial Sequence
  chemically synthesized
attaatttctagtatatacc

SEQ ID NO: 141820 - DNA, 20 bp, Artificial Sequence
  chemically synthesized
cattaatttctagtatatac

SEQ ID NO: 141821 - DNA, 20 bp, Artificial Sequence
  chemically synthesized
gcacaatgcctggtatatac

SEQ ID NO: 141822 - DNA, 20 bp, Artificial Sequence
  chemically synthesized
gcttaccatgcattaatttc

SEQ ID NO: 141823 - DNA, 20 bp, Artificial Sequence
  chemically synthesized
atatactagaaattaatgca

SEQ ID NO: 141824 - DNA, 20 bp, Artificial Sequence
  chemically synthesized
actagaaattaatgcatggt

SEQ ID NO: 141825 - DNA, 20 bp, Artificial Sequence
  chemically synthesized
ggtaagcatcatgaatttta

SEQ ID NO: 141826 - DNA, 20 bp, Artificial Sequence
  chemically synthesized
aagcatcatgaattttatgg

SEQ ID NO: 141827 - DNA, 20 bp, Artificial Sequence
  chemically synthesized
gtatatatgacctaacattt

SEQ ID NO: 141828 - DNA, 20 bp, Artificial Sequence
  chemically synthesized
tccttttggcccaaaatgtt

SEQ ID NO: 141829 - DNA, 20 bp, Artificial Sequence
  chemically synthesized
tatatatgacctaacatttt

SEQ ID NO: 141830 - DNA, 20 bp, Artificial Sequence
  chemically synthesized
ttccttttggcccaaaatgt

SEQ ID NO: 141831 - DNA, 20 bp, Artificial Sequence
  chemically synthesized
gacctaacattttgggccaa

SEQ ID NO: 141832 - DNA, 20 bp, Artificial Sequence
  chemically synthesized
acctaacattttgggccaaa

SEQ ID NO: 141833 - DNA, 20 bp, Artificial Sequence
  chemically synthesized
taacattttgggccaaaagg

SEQ ID NO: 141834 - DNA, 20 bp, Artificial Sequence
  chemically synthesized
tgccttcaaacacttccttt

SEQ ID NO: 141835 - DNA, 20 bp, Artificial Sequence
  chemically synthesized
gggccaaaaggaagtgtttg

SEQ ID NO: 141836 - DNA, 20 bp, Artificial Sequence
  chemically synthesized
ggccaaaaggaagtgtttga

SEQ ID NO: 141837 - DNA, 20 bp, Artificial Sequence
  chemically synthesized
ggaagtgtttgaaggcaatt

SEQ ID NO: 141838 - DNA, 20 bp, Artificial Sequence
  chemically synthesized
gtttgaaggcaatttggtca

SEQ ID NO: 141839 - DNA, 20 bp, Artificial Sequence
  chemically synthesized
ttatttaaacatacagtgtt

SEQ ID NO: 141840 - DNA, 20 bp, Artificial Sequence
  chemically synthesized
accatcattatttaaacata

SEQ ID NO: 141841 - DNA, 20 bp, Artificial Sequence
  chemically synthesized
actgtatgtttaaataatga

SEQ ID NO: 141842 - DNA, 20 bp, Artificial Sequence
  chemically synthesized
tatgtttaaataatgatggt

SEQ ID NO: 141843 - DNA, 20 bp, Artificial Sequence
  chemically synthesized
atgtttaaataatgatggtt

SEQ ID NO: 141844 - DNA, 20 bp, Artificial Sequence
  chemically synthesized
ggcaacaatgctatgtcttt

SEQ ID NO: 141845 - DNA, 20 bp, Artificial Sequence
  chemically synthesized
gaaagaaatgcttaaagaca

SEQ ID NO: 141846 - DNA, 20 bp, Artificial Sequence
  chemically synthesized
aaaatggaaagaaatgctta

SEQ ID NO: 141847 - DNA, 20 bp, Artificial Sequence
  chemically synthesized
agcagattttgaaaaatgga

SEQ ID NO: 141848 - DNA, 20 bp, Artificial Sequence
  chemically synthesized
aaagagcagattttgaaaaa

SEQ ID NO: 141849 - DNA, 20 bp, Artificial Sequence
  chemically synthesized
taattgtgaataagaaagag

SEQ ID NO: 141850 - DNA, 20 bp, Artificial Sequence
  chemically synthesized
aaataattgtgaataagaaa

SEQ ID NO: 141851 - DNA, 20 bp, Artificial Sequence
  chemically synthesized
agaaataattgtgaataaga

SEQ ID NO: 141852 - DNA, 20 bp, Artificial Sequence
  chemically synthesized
tagtagaaataattgtgaat

SEQ ID NO: 141853 - DNA, 20 bp, Artificial Sequence
  chemically synthesized
cccattaaaatattaaatag

SEQ ID NO: 141854 - DNA, 20 bp, Artificial Sequence
  chemically synthesized
cttcccattaaaatattaaa

SEQ ID NO: 141855 - DNA, 20 bp, Artificial Sequence
  chemically synthesized
tctactatttaatattttaa

SEQ ID NO: 141856 - DNA, 20 bp, Artificial Sequence
  chemically synthesized
ctactatttaatattttaat

SEQ ID NO: 141857 - DNA, 20 bp, Artificial Sequence
  chemically synthesized
ctatttaatattttaatggg

SEQ ID NO: 141858 - DNA, 20 bp, Artificial Sequence
  chemically synthesized
atttaatattttaatgggaa

SEQ ID NO: 141859 - DNA, 20 bp, Artificial Sequence
  chemically synthesized
aatattttaatgggaagagt

SEQ ID NO: 141860 - DNA, 20 bp, Artificial Sequence
  chemically synthesized
gttggataaacctaaatgtg

SEQ ID NO: 141861 - DNA, 20 bp, Artificial Sequence
  chemically synthesized
aatcccaatgctgcacattt

SEQ ID NO: 141862 - DNA, 20 bp, Artificial Sequence
  chemically synthesized
gaatcccaatgctgcacatt

SEQ ID NO: 141863 - DNA, 20 bp, Artificial Sequence
  chemically synthesized
taaacctaaatgtgcagcat

SEQ ID NO: 141864 - DNA, 20 bp, Artificial Sequence
  chemically synthesized
aaacctaaatgtgcagcatt

SEQ ID NO: 141865 - DNA, 20 bp, Artificial Sequence
  chemically synthesized
cagcattgggattcttttca

SEQ ID NO: 141866 - DNA, 20 bp, Artificial Sequence
  chemically synthesized
ctttaagtgatcactatgaa

SEQ ID NO: 141867 - DNA, 20 bp, Artificial Sequence
  chemically synthesized
cttttcatagtgatcactta

SEQ ID NO: 141868 - DNA, 20 bp, Artificial Sequence
  chemically synthesized
aaaaaagcaaaacaaacttt

SEQ ID NO: 141869 - DNA, 20 bp, Artificial Sequence
  chemically synthesized
tgatataaggtaaaaaaaaa

SEQ ID NO: 141870 - DNA, 20 bp, Artificial Sequence
  chemically synthesized
ttttttttttaccttatatc

SEQ ID NO: 141871 - DNA, 20 bp, Artificial Sequence
  chemically synthesized
atatattatttcttgatata

SEQ ID NO: 141872 - DNA, 20 bp, Artificial Sequence
  chemically synthesized
tatatattatttcttgatat

SEQ ID NO: 141873 - DNA, 20 bp, Artificial Sequence
  chemically synthesized
gttttcatataattatgtat

SEQ ID NO: 141874 - DNA, 20 bp, Artificial Sequence
  chemically synthesized
gaaaacatcgatctttaaaa

SEQ ID NO: 141875 - DNA, 20 bp, Artificial Sequence
  chemically synthesized
atgttatttatgctatttta

SEQ ID NO: 141876 - DNA, 20 bp, Artificial Sequence
  chemically synthesized
attttatatacacataggga

SEQ ID NO: 141877 - DNA, 20 bp, Artificial Sequence
  chemically synthesized
tattttatatacacataggg

SEQ ID NO: 141878 - DNA, 20 bp, Artificial Sequence
  chemically synthesized
gaatattttatatacacata

SEQ ID NO: 141879 - DNA, 20 bp, Artificial Sequence
  chemically synthesized
tgaatattttatatacacat

SEQ ID NO: 141880 - DNA, 20 bp, Artificial Sequence
  chemically synthesized
atgaatattttatatacaca

SEQ ID NO: 141881 - DNA, 20 bp, Artificial Sequence
  chemically synthesized
atgtgtatataaaatattca

SEQ ID NO: 141882 - DNA, 20 bp, Artificial Sequence
  chemically synthesized
aatattcatagatatatatg

SEQ ID NO: 141883 - DNA, 20 bp, Artificial Sequence
  chemically synthesized
tatgtggtgtgtgtttctaa

SEQ ID NO: 141884 - DNA, 20 bp, Artificial Sequence
  chemically synthesized
aaacacacatatattacttt

SEQ ID NO: 141885 - DNA, 20 bp, Artificial Sequence
  chemically synthesized
aaaagtaatatatgtgtgtt

SEQ ID NO: 141886 - DNA, 20 bp, Artificial Sequence
  chemically synthesized
aaagtaatatatgtgtgttt

SEQ ID NO: 141887 - DNA, 20 bp, Artificial Sequence
  chemically synthesized
gcaacaaaaacaatatcatg

SEQ ID NO: 141888 - DNA, 20 bp, Artificial Sequence
  chemically synthesized
caatatcatgtagtacatac

SEQ ID NO: 141889 - DNA, 20 bp, Artificial Sequence
  chemically synthesized
atgtagtacatactggtttg

SEQ ID NO: 141890 - DNA, 20 bp, Artificial Sequence
  chemically synthesized
tgtagtacatactggtttga

SEQ ID NO: 141891 - DNA, 20 bp, Artificial Sequence
  chemically synthesized
tgaggagagcaccttcaaac

SEQ ID NO: 141892 - DNA, 20 bp, Artificial Sequence
  chemically synthesized
aaattggagtatagtgagga

SEQ ID NO: 141893 - DNA, 20 bp, Artificial Sequence
  chemically synthesized
gtaaattggagtatagtgag

SEQ ID NO: 141894 - DNA, 20 bp, Artificial Sequence
  chemically synthesized
gtgtaaattggagtatagtg

SEQ ID NO: 141895 - DNA, 20 bp, Artificial Sequence
  chemically synthesized
tgtgtaaattggagtatagt

SEQ ID NO: 141896 - DNA, 20 bp, Artificial Sequence
  chemically synthesized
gtggtgtgtaaattggagta

SEQ ID NO: 141897 - DNA, 20 bp, Artificial Sequence
  chemically synthesized
agattgtggtgtgtaaattg

SEQ ID NO: 141898 - DNA, 20 bp, Artificial Sequence
  chemically synthesized
atagattgtggtgtgtaaat

SEQ ID NO: 141899 - DNA, 20 bp, Artificial Sequence
  chemically synthesized
tgggatgctgaaatagattg

SEQ ID NO: 141900 - DNA, 20 bp, Artificial Sequence
  chemically synthesized
ttacacaccacaatctattt

SEQ ID NO: 141901 - DNA, 20 bp, Artificial Sequence
  chemically synthesized
aatttagtgggatgctgaaa

SEQ ID NO: 141902 - DNA, 20 bp, Artificial Sequence
  chemically synthesized
taaattgcccaaaatttagt

SEQ ID NO: 141903 - DNA, 20 bp, Artificial Sequence
  chemically synthesized
ttaaattgcccaaaatttag

SEQ ID NO: 141904 - DNA, 20 bp, Artificial Sequence
  chemically synthesized
ttcagcatcccactaaattt

SEQ ID NO: 141905 - DNA, 20 bp, Artificial Sequence
  chemically synthesized
tcagcatcccactaaatttt

SEQ ID NO: 141906 - DNA, 20 bp, Artificial Sequence
  chemically synthesized
aaattaaattgcccaaaatt

SEQ ID NO: 141907 - DNA, 20 bp, Artificial Sequence
  chemically synthesized
gcaatttaattttttcctgc

SEQ ID NO: 141908 - DNA, 20 bp, Artificial Sequence
  chemically synthesized
tatttcaaatagggactagc

SEQ ID NO: 141909 - DNA, 20 bp, Artificial Sequence
  chemically synthesized
ttatttcaaatagggactag

SEQ ID NO: 141910 - DNA, 20 bp, Artificial Sequence
  chemically synthesized
tcattatttcaaatagggac

SEQ ID NO: 141911 - DNA, 20 bp, Artificial Sequence
  chemically synthesized
taagctcattatttcaaata

SEQ ID NO: 141912 - DNA, 20 bp, Artificial Sequence
  chemically synthesized
ataagctcattatttcaaat

SEQ ID NO: 141913 - DNA, 20 bp, Artificial Sequence
  chemically synthesized
gataagctcattatttcaaa

SEQ ID NO: 141914 - DNA, 20 bp, Artificial Sequence
  chemically synthesized
tagtccctatttgaaataat

SEQ ID NO: 141915 - DNA, 20 bp, Artificial Sequence
  chemically synthesized
tgaaataatgagcttatctg

SEQ ID NO: 141916 - DNA, 20 bp, Artificial Sequence
  chemically synthesized
tacagcttttcactacagat

SEQ ID NO: 141917 - DNA, 20 bp, Artificial Sequence
  chemically synthesized
atgagcttatctgtagtgaa

SEQ ID NO: 141918 - DNA, 20 bp, Artificial Sequence
  chemically synthesized
atatttacagcttttcacta

SEQ ID NO: 141919 - DNA, 20 bp, Artificial Sequence
  chemically synthesized
gaatctaggcagcatattta

SEQ ID NO: 141920 - DNA, 20 bp, Artificial Sequence
  chemically synthesized
aaagctgtaaatatgctgcc

SEQ ID NO: 141921 - DNA, 20 bp, Artificial Sequence
  chemically synthesized
tttccaaaggggaatctagg

SEQ ID NO: 141922 - DNA, 20 bp, Artificial Sequence
  chemically synthesized
tcatttccaaaggggaatct

SEQ ID NO: 141923 - DNA, 20 bp, Artificial Sequence
  chemically synthesized
ttcatttccaaaggggaatc

SEQ ID NO: 141924 - DNA, 20 bp, Artificial Sequence
  chemically synthesized
atgctgcctagattcccctt

SEQ ID NO: 141925 - DNA, 20 bp, Artificial Sequence
  chemically synthesized
taagtccttcatttccaaag

SEQ ID NO: 141926 - DNA, 20 bp, Artificial Sequence
  chemically synthesized
ctaagtccttcatttccaaa

SEQ ID NO: 141927 - DNA, 20 bp, Artificial Sequence
  chemically synthesized
actaagtccttcatttccaa

SEQ ID NO: 141928 - DNA, 20 bp, Artificial Sequence
  chemically synthesized
aactaagtccttcatttcca

SEQ ID NO: 141929 - DNA, 20 bp, Artificial Sequence
  chemically synthesized
tagattcccctttggaaatg

SEQ ID NO: 141930 - DNA, 20 bp, Artificial Sequence
  chemically synthesized
agattcccctttggaaatga

SEQ ID NO: 141931 - DNA, 20 bp, Artificial Sequence
  chemically synthesized
ccctttggaaatgaaggact

SEQ ID NO: 141932 - DNA, 20 bp, Artificial Sequence
  chemically synthesized
aaatgaaggacttagttccc

SEQ ID NO: 141933 - DNA, 20 bp, Artificial Sequence
  chemically synthesized
ctcctagcagctggggaact

SEQ ID NO: 141934 - DNA, 20 bp, Artificial Sequence
  chemically synthesized
ggacttagttccccagctgc

SEQ ID NO: 141935 - DNA, 20 bp, Artificial Sequence
  chemically synthesized
agcagcactcctagcagctg

SEQ ID NO: 141936 - DNA, 20 bp, Artificial Sequence
  chemically synthesized
gacttagttccccagctgct

SEQ ID NO: 141937 - DNA, 20 bp, Artificial Sequence
  chemically synthesized
cagcagcactcctagcagct

SEQ ID NO: 141938 - DNA, 20 bp, Artificial Sequence
  chemically synthesized
ccagcagcactcctagcagc

SEQ ID NO: 141939 - DNA, 20 bp, Artificial Sequence
  chemically synthesized
cttagttccccagctgctag

SEQ ID NO: 141940 - DNA, 20 bp, Artificial Sequence
  chemically synthesized
tctaccagcagcactcctag

SEQ ID NO: 141941 - DNA, 20 bp, Artificial Sequence
  chemically synthesized
ctgtctaccagcagcactcc

SEQ ID NO: 141942 - DNA, 20 bp, Artificial Sequence
  chemically synthesized
ccagctgctaggagtgctgc

SEQ ID NO: 141943 - DNA, 20 bp, Artificial Sequence
  chemically synthesized
gctgctaggagtgctgctgg

SEQ ID NO: 141944 - DNA, 20 bp, Artificial Sequence
  chemically synthesized
agctgaaggctgtctaccag

SEQ ID NO: 141945 - DNA, 20 bp, Artificial Sequence
  chemically synthesized
ctaggagtgctgctggtaga

SEQ ID NO: 141946 - DNA, 20 bp, Artificial Sequence
  chemically synthesized
gacagctgaaggctgtctac

SEQ ID NO: 141947 - DNA, 20 bp, Artificial Sequence
  chemically synthesized
tgctgctggtagacagcctt

SEQ ID NO: 141948 - DNA, 20 bp, Artificial Sequence
  chemically synthesized
agacaagggctgacagctga

SEQ ID NO: 141949 - DNA, 20 bp, Artificial Sequence
  chemically synthesized
ggtagacagccttcagctgt

SEQ ID NO: 141950 - DNA, 20 bp, Artificial Sequence
  chemically synthesized
aagacaagggctgacagctg

SEQ ID NO: 141951 - DNA, 20 bp, Artificial Sequence
  chemically synthesized
cagactaagacaagggctga

SEQ ID NO: 141952 - DNA, 20 bp, Artificial Sequence
  chemically synthesized
tcagctgtcagcccttgtct

SEQ ID NO: 141953 - DNA, 20 bp, Artificial Sequence
  chemically synthesized
agcggcccagactaagacaa

SEQ ID NO: 141954 - DNA, 20 bp, Artificial Sequence
  chemically synthesized
tagcggcccagactaagaca

SEQ ID NO: 141955 - DNA, 20 bp, Artificial Sequence
  chemically synthesized
atagcggcccagactaagac

SEQ ID NO: 141956 - DNA, 20 bp, Artificial Sequence
  chemically synthesized
tgtcagcccttgtcttagtc

SEQ ID NO: 141957 - DNA, 20 bp, Artificial Sequence
  chemically synthesized
gtcagcccttgtcttagtct

SEQ ID NO: 141958 - DNA, 20 bp, Artificial Sequence
  chemically synthesized
tagctatagcggcccagact

SEQ ID NO: 141959 - DNA, 20 bp, Artificial Sequence
  chemically synthesized
ggtatttagctatagcggcc

SEQ ID NO: 141960 - DNA, 20 bp, Artificial Sequence
  chemically synthesized
tgtcttagtctgggccgcta

SEQ ID NO: 141961 - DNA, 20 bp, Artificial Sequence
  chemically synthesized
tctaaggtatttagctatag

SEQ ID NO: 141962 - DNA, 20 bp, Artificial Sequence
  chemically synthesized
cagtctaaggtatttagcta

SEQ ID NO: 141963 - DNA, 20 bp, Artificial Sequence
  chemically synthesized
gccgctatagctaaatacct

SEQ ID NO: 141964 - DNA, 20 bp, Artificial Sequence
  chemically synthesized
attacccagtctaaggtatt

SEQ ID NO: 141965 - DNA, 20 bp, Artificial Sequence
  chemically synthesized
tatagctaaataccttagac

SEQ ID NO: 141966 - DNA, 20 bp, Artificial Sequence
  chemically synthesized
atagctaaataccttagact

SEQ ID NO: 141967 - DNA, 20 bp, Artificial Sequence
  chemically synthesized
tttataaattacccagtcta

SEQ ID NO: 141968 - DNA, 20 bp, Artificial Sequence
  chemically synthesized
gtttataaattacccagtct

SEQ ID NO: 141969 - DNA, 20 bp, Artificial Sequence
  chemically synthesized
tctgttgtttataaattacc

SEQ ID NO: 141970 - DNA, 20 bp, Artificial Sequence
  chemically synthesized
actgggtaatttataaacaa

SEQ ID NO: 141971 - DNA, 20 bp, Artificial Sequence
  chemically synthesized
acaacagaatttattgctta

SEQ ID NO: 141972 - DNA, 20 bp, Artificial Sequence
  chemically synthesized
gaatttattgcttatagttc

SEQ ID NO: 141973 - DNA, 20 bp, Artificial Sequence
  chemically synthesized
ttcccagcctccagaactat

SEQ ID NO: 141974 - DNA, 20 bp, Artificial Sequence
  chemically synthesized
atttattgcttatagttctg

SEQ ID NO: 141975 - DNA, 20 bp, Artificial Sequence
  chemically synthesized
tttattgcttatagttctgg

SEQ ID NO: 141976 - DNA, 20 bp, Artificial Sequence
  chemically synthesized
ttgcttatagttctggaggc

SEQ ID NO: 141977 - DNA, 20 bp, Artificial Sequence
  chemically synthesized
tgcttatagttctggaggct

SEQ ID NO: 141978 - DNA, 20 bp, Artificial Sequence
  chemically synthesized
atcttggaattcccagcctc

SEQ ID NO: 141979 - DNA, 20 bp, Artificial Sequence
  chemically synthesized
tgtcttgatcttggaattcc

SEQ ID NO: 141980 - DNA, 20 bp, Artificial Sequence
  chemically synthesized
ttctggaggctgggaattcc

SEQ ID NO: 141981 - DNA, 20 bp, Artificial Sequence
  chemically synthesized
aggctgggaattccaagatc

SEQ ID NO: 141982 - DNA, 20 bp, Artificial Sequence
  chemically synthesized
atctgctgatgtcttgatct

SEQ ID NO: 141983 - DNA, 20 bp, Artificial Sequence
  chemically synthesized
gaattccaagatcaagacat

SEQ ID NO: 141984 - DNA, 20 bp, Artificial Sequence
  chemically synthesized
ttccaagatcaagacatcag

SEQ ID NO: 141985 - DNA, 20 bp, Artificial Sequence
  chemically synthesized
acatcagcagattcattgtc

SEQ ID NO: 141986 - DNA, 20 bp, Artificial Sequence
  chemically synthesized
cagcagattcattgtctggt

SEQ ID NO: 141987 - DNA, 20 bp, Artificial Sequence
  chemically synthesized
agcagattcattgtctggtg

SEQ ID NO: 141988 - DNA, 20 bp, Artificial Sequence
  chemically synthesized
gcagattcattgtctggtga

SEQ ID NO: 141989 - DNA, 20 bp, Artificial Sequence
  chemically synthesized
taacaggagtgggccctcac

SEQ ID NO: 141990 - DNA, 20 bp, Artificial Sequence
  chemically synthesized
agatgccatttaacaggagt

SEQ ID NO: 141991 - DNA, 20 bp, Artificial Sequence
  chemically synthesized
aagatgccatttaacaggag

SEQ ID NO: 141992 - DNA, 20 bp, Artificial Sequence
  chemically synthesized
ccgaagatgccatttaacag

SEQ ID NO: 141993 - DNA, 20 bp, Artificial Sequence
  chemically synthesized
gagggcccactcctgttaaa

SEQ ID NO: 141994 - DNA, 20 bp, Artificial Sequence
  chemically synthesized
caccgaagatgccatttaac

SEQ ID NO: 141995 - DNA, 20 bp, Artificial Sequence
  chemically synthesized
acaccgaagatgccatttaa

SEQ ID NO: 141996 - DNA, 20 bp, Artificial Sequence
  chemically synthesized
ctcctgttaaatggcatctt

SEQ ID NO: 141997 - DNA, 20 bp, Artificial Sequence
  chemically synthesized
caccatgtaaggacacaccg

SEQ ID NO: 141998 - DNA, 20 bp, Artificial Sequence
  chemically synthesized
atcttcggtgtgtccttaca

SEQ ID NO: 141999 - DNA, 20 bp, Artificial Sequence
  chemically synthesized
ttcggtgtgtccttacatgg

SEQ ID NO: 142000 - DNA, 20 bp, Artificial Sequence
  chemically synthesized
ccttgccctcccaccatgta

SEQ ID NO: 142001 - DNA, 20 bp, Artificial Sequence
  chemically synthesized
tcggtgtgtccttacatggt

SEQ ID NO: 142002 - DNA, 20 bp, Artificial Sequence
  chemically synthesized
tccttgccctcccaccatgt

SEQ ID NO: 142003 - DNA, 20 bp, Artificial Sequence
  chemically synthesized
ggtgtgtccttacatggtgg

SEQ ID NO: 142004 - DNA, 20 bp, Artificial Sequence
  chemically synthesized
gtgtgtccttacatggtggg

SEQ ID NO: 142005 - DNA, 20 bp, Artificial Sequence
  chemically synthesized
tgtgtccttacatggtggga

SEQ ID NO: 142006 - DNA, 20 bp, Artificial Sequence
  chemically synthesized
tccttacatggtgggagggc

SEQ ID NO: 142007 - DNA, 20 bp, Artificial Sequence
  chemically synthesized
ccttacatggtgggagggca

SEQ ID NO: 142008 - DNA, 20 bp, Artificial Sequence
  chemically synthesized
tacatggtgggagggcaagg

SEQ ID NO: 142009 - DNA, 20 bp, Artificial Sequence
  chemically synthesized
gggagggcaaggaagctttc

SEQ ID NO: 142010 - DNA, 20 bp, Artificial Sequence
  chemically synthesized
gagggcaaggaagctttctg

SEQ ID NO: 142011 - DNA, 20 bp, Artificial Sequence
  chemically synthesized
cttataaaagcggctccaga

SEQ ID NO: 142012 - DNA, 20 bp, Artificial Sequence
  chemically synthesized
tgcccttataaaagcggctc

SEQ ID NO: 142013 - DNA, 20 bp, Artificial Sequence
  chemically synthesized
ctttctggagccgcttttat

SEQ ID NO: 142014 - DNA, 20 bp, Artificial Sequence
  chemically synthesized
gatcagtgcccttataaaag

SEQ ID NO: 142015 - DNA, 20 bp, Artificial Sequence
  chemically synthesized
tttctggagccgcttttata

SEQ ID NO: 142016 - DNA, 20 bp, Artificial Sequence
  chemically synthesized
ttctggagccgcttttataa

SEQ ID NO: 142017 - DNA, 20 bp, Artificial Sequence
  chemically synthesized
caggatcagtgcccttataa

SEQ ID NO: 142018 - DNA, 20 bp, Artificial Sequence
  chemically synthesized
tctgccttcagaaacaggat

SEQ ID NO: 142019 - DNA, 20 bp, Artificial Sequence
  chemically synthesized
gggcactgatcctgtttctg

SEQ ID NO: 142020 - DNA, 20 bp, Artificial Sequence
  chemically synthesized
cgggctctgccttcagaaac

SEQ ID NO: 142021 - DNA, 20 bp, Artificial Sequence
  chemically synthesized
ggcactgatcctgtttctga

SEQ ID NO: 142022 - DNA, 20 bp, Artificial Sequence
  chemically synthesized
gcgggctctgccttcagaaa

SEQ ID NO: 142023 - DNA, 20 bp, Artificial Sequence
  chemically synthesized
actgatcctgtttctgaagg

SEQ ID NO: 142024 - DNA, 20 bp, Artificial Sequence
  chemically synthesized
tgatcctgtttctgaaggca

SEQ ID NO: 142025 - DNA, 20 bp, Artificial Sequence
  chemically synthesized
ggtcatgcgggctctgcctt

SEQ ID NO: 142026 - DNA, 20 bp, Artificial Sequence
  chemically synthesized
ggggggtgattaggtcatgc

SEQ ID NO: 142027 - DNA, 20 bp, Artificial Sequence
  chemically synthesized
gggggggtgattaggtcatg

SEQ ID NO: 142028 - DNA, 20 bp, Artificial Sequence
  chemically synthesized
gggggtttgggggggtgatt

SEQ ID NO: 142029 - DNA, 20 bp, Artificial Sequence
  chemically synthesized
tgggggtttgggggggtgat

SEQ ID NO: 142030 - DNA, 20 bp, Artificial Sequence
  chemically synthesized
tagaaggtgggggtttgggg

SEQ ID NO: 142031 - DNA, 20 bp, Artificial Sequence
  chemically synthesized
ttagaaggtgggggtttggg

SEQ ID NO: 142032 - DNA, 20 bp, Artificial Sequence
  chemically synthesized
attagaaggtgggggtttgg

SEQ ID NO: 142033 - DNA, 20 bp, Artificial Sequence
  chemically synthesized
tattagaaggtgggggtttg

SEQ ID NO: 142034 - DNA, 20 bp, Artificial Sequence
  chemically synthesized
gtattagaaggtgggggttt

SEQ ID NO: 142035 - DNA, 20 bp, Artificial Sequence
  chemically synthesized
ggtattagaaggtgggggtt

SEQ ID NO: 142036 - DNA, 20 bp, Artificial Sequence
  chemically synthesized
gtgatggtattagaaggtgg

SEQ ID NO: 142037 - DNA, 20 bp, Artificial Sequence
  chemically synthesized
ggtgatggtattagaaggtg

SEQ ID NO: 142038 - DNA, 20 bp, Artificial Sequence
  chemically synthesized
aggtgatggtattagaaggt

SEQ ID NO: 142039 - DNA, 20 bp, Artificial Sequence
  chemically synthesized
aaggtgatggtattagaagg

SEQ ID NO: 142040 - DNA, 20 bp, Artificial Sequence
  chemically synthesized
ctcaaggtgatggtattaga

SEQ ID NO: 142041 - DNA, 20 bp, Artificial Sequence
  chemically synthesized
actcaaggtgatggtattag

SEQ ID NO: 142042 - DNA, 20 bp, Artificial Sequence
  chemically synthesized
aacactcaaggtgatggtat

SEQ ID NO: 142043 - DNA, 20 bp, Artificial Sequence
  chemically synthesized
ccttctaataccatcacctt

SEQ ID NO: 142044 - DNA, 20 bp, Artificial Sequence
  chemically synthesized
aaacctaacactcaaggtga

SEQ ID NO: 142045 - DNA, 20 bp, Artificial Sequence
  chemically synthesized
aataccatcaccttgagtgt

SEQ ID NO: 142046 - DNA, 20 bp, Artificial Sequence
  chemically synthesized
atgttgaaacctaacactca

SEQ ID NO: 142047 - DNA, 20 bp, Artificial Sequence
  chemically synthesized
ataccatcaccttgagtgtt

SEQ ID NO: 142048 - DNA, 20 bp, Artificial Sequence
  chemically synthesized
tatgttgaaacctaacactc

SEQ ID NO: 142049 - DNA, 20 bp, Artificial Sequence
  chemically synthesized
aggtttcaacatacacattt

SEQ ID NO: 142050 - DNA, 20 bp, Artificial Sequence
  chemically synthesized
gtttcaacatacacattttg

SEQ ID NO: 142051 - DNA, 20 bp, Artificial Sequence
  chemically synthesized
tttcaacatacacattttgg

SEQ ID NO: 142052 - DNA, 20 bp, Artificial Sequence
  chemically synthesized
ttcaacatacacattttgga

SEQ ID NO: 142053 - DNA, 20 bp, Artificial Sequence
  chemically synthesized
tttggagggacaaaaacatt

SEQ ID NO: 142054 - DNA, 20 bp, Artificial Sequence
  chemically synthesized
ggacaaaaacattcagacca

SEQ ID NO: 142055 - DNA, 20 bp, Artificial Sequence
  chemically synthesized
caaaaacattcagaccatag

SEQ ID NO: 142056 - DNA, 20 bp, Artificial Sequence
  chemically synthesized
tttccataagggggctgcta

SEQ ID NO: 142057 - DNA, 20 bp, Artificial Sequence
  chemically synthesized
agaccatagcagccccctta

SEQ ID NO: 142058 - DNA, 20 bp, Artificial Sequence
  chemically synthesized
ccacgggaatttccataagg

SEQ ID NO: 142059 - DNA, 20 bp, Artificial Sequence
  chemically synthesized
gccacgggaatttccataag

SEQ ID NO: 142060 - DNA, 20 bp, Artificial Sequence
  chemically synthesized
agccacgggaatttccataa

SEQ ID NO: 142061 - DNA, 20 bp, Artificial Sequence
  chemically synthesized
tagccacgggaatttccata

SEQ ID NO: 142062 - DNA, 20 bp, Artificial Sequence
  chemically synthesized
ttagccacgggaatttccat

SEQ ID NO: 142063 - DNA, 20 bp, Artificial Sequence
  chemically synthesized
cccccttatggaaattcccg

SEQ ID NO: 142064 - DNA, 20 bp, Artificial Sequence
  chemically synthesized
tatggaaattcccgtggcta

SEQ ID NO: 142065 - DNA, 20 bp, Artificial Sequence
  chemically synthesized
agatgattctctttagccac

SEQ ID NO: 142066 - DNA, 20 bp, Artificial Sequence
  chemically synthesized
aagatgattctctttagcca

SEQ ID NO: 142067 - DNA, 20 bp, Artificial Sequence
  chemically synthesized
tggaaattcccgtggctaaa

SEQ ID NO: 142068 - DNA, 20 bp, Artificial Sequence
  chemically synthesized
tttagcaagatgattctctt

SEQ ID NO: 142069 - DNA, 20 bp, Artificial Sequence
  chemically synthesized
taaagagaatcatcttgcta

SEQ ID NO: 142070 - DNA, 20 bp, Artificial Sequence
  chemically synthesized
ggaaggcaacgaactttagc

SEQ ID NO: 142071 - DNA, 20 bp, Artificial Sequence
  chemically synthesized
tccaggaaggcaacgaactt

SEQ ID NO: 142072 - DNA, 20 bp, Artificial Sequence
  chemically synthesized
gctaaagttcgttgccttcc

SEQ ID NO: 142073 - DNA, 20 bp, Artificial Sequence
  chemically synthesized
taaagttcgttgccttcctg

SEQ ID NO: 142074 - DNA, 20 bp, Artificial Sequence
  chemically synthesized
ggatgtgggctactccagga

SEQ ID NO: 142075 - DNA, 20 bp, Artificial Sequence
  chemically synthesized
agttcgttgccttcctggag

SEQ ID NO: 142076 - DNA, 20 bp, Artificial Sequence
  chemically synthesized
tggatgtgggctactccagg

SEQ ID NO: 142077 - DNA, 20 bp, Artificial Sequence
  chemically synthesized
cactggatgtgggctactcc

SEQ ID NO: 142078 - DNA, 20 bp, Artificial Sequence
  chemically synthesized
gcactggatgtgggctactc

SEQ ID NO: 142079 - DNA, 20 bp, Artificial Sequence
  chemically synthesized
ttcctggagtagcccacatc

SEQ ID NO: 142080 - DNA, 20 bp, Artificial Sequence
  chemically synthesized
tcaagtcatgcactggatgt

SEQ ID NO: 142081 - DNA, 20 bp, Artificial Sequence
  chemically synthesized
gtcaagtcatgcactggatg

SEQ ID NO: 142082 - DNA, 20 bp, Artificial Sequence
  chemically synthesized
ccccgtgtcaagtcatgcac

SEQ ID NO: 142083 - DNA, 20 bp, Artificial Sequence
  chemically synthesized
atccagtgcatgacttgaca

SEQ ID NO: 142084 - DNA, 20 bp, Artificial Sequence
  chemically synthesized
tccagtgcatgacttgacac

SEQ ID NO: 142085 - DNA, 20 bp, Artificial Sequence
  chemically synthesized
ccagtgcatgacttgacacg

SEQ ID NO: 142086 - DNA, 20 bp, Artificial Sequence
  chemically synthesized
gatctttataaccccgtgtc

SEQ ID NO: 142087 - DNA, 20 bp, Artificial Sequence
  chemically synthesized
tgacttgacacggggttata

SEQ ID NO: 142088 - DNA, 20 bp, Artificial Sequence
  chemically synthesized
gacacggggttataaagatc

SEQ ID NO: 142089 - DNA, 20 bp, Artificial Sequence
  chemically synthesized
aggaaacgaagaaaggggac

SEQ ID NO: 142090 - DNA, 20 bp, Artificial Sequence
  chemically synthesized
gtgctaggaaacgaagaaag

SEQ ID NO: 142091 - DNA, 20 bp, Artificial Sequence
  chemically synthesized
agtgctaggaaacgaagaaa

SEQ ID NO: 142092 - DNA, 20 bp, Artificial Sequence
  chemically synthesized
aagtgctaggaaacgaagaa

SEQ ID NO: 142093 - DNA, 20 bp, Artificial Sequence
  chemically synthesized
gaagtgctaggaaacgaaga

SEQ ID NO: 142094 - DNA, 20 bp, Artificial Sequence
  chemically synthesized
agtcccctttcttcgtttcc

SEQ ID NO: 142095 - DNA, 20 bp, Artificial Sequence
  chemically synthesized
ttcagaagtgctaggaaacg

SEQ ID NO: 142096 - DNA, 20 bp, Artificial Sequence
  chemically synthesized
aatgacccttcagaagtgct

SEQ ID NO: 142097 - DNA, 20 bp, Artificial Sequence
  chemically synthesized
gaatgacccttcagaagtgc

SEQ ID NO: 142098 - DNA, 20 bp, Artificial Sequence
  chemically synthesized
ttcgtttcctagcacttctg

SEQ ID NO: 142099 - DNA, 20 bp, Artificial Sequence
  chemically synthesized
tcgtttcctagcacttctga

SEQ ID NO: 142100 - DNA, 20 bp, Artificial Sequence
  chemically synthesized
cgtttcctagcacttctgaa

SEQ ID NO: 142101 - DNA, 20 bp, Artificial Sequence
  chemically synthesized
aagctggaatgacccttcag

SEQ ID NO: 142102 - DNA, 20 bp, Artificial Sequence
  chemically synthesized
cttaagctggaatgaccctt

SEQ ID NO: 142103 - DNA, 20 bp, Artificial Sequence
  chemically synthesized
gcacttctgaagggtcattc

SEQ ID NO: 142104 - DNA, 20 bp, Artificial Sequence
  chemically synthesized
ctgaagggtcattccagctt

SEQ ID NO: 142105 - DNA, 20 bp, Artificial Sequence
  chemically synthesized
cgttcagggagttcttaagc

SEQ ID NO: 142106 - DNA, 20 bp, Artificial Sequence
  chemically synthesized
tgaccgttcagggagttctt

SEQ ID NO: 142107 - DNA, 20 bp, Artificial Sequence
  chemically synthesized
cagcttaagaactccctgaa

SEQ ID NO: 142108 - DNA, 20 bp, Artificial Sequence
  chemically synthesized
gcctcagctgaccgttcagg

SEQ ID NO: 142109 - DNA, 20 bp, Artificial Sequence
  chemically synthesized
gggcctcagctgaccgttca

SEQ ID NO: 142110 - DNA, 20 bp, Artificial Sequence
  chemically synthesized
ttaagaactccctgaacggt

SEQ ID NO: 142111 - DNA, 20 bp, Artificial Sequence
  chemically synthesized
agggcctcagctgaccgttc

SEQ ID NO: 142112 - DNA, 20 bp, Artificial Sequence
  chemically synthesized
aagggcctcagctgaccgtt

SEQ ID NO: 142113 - DNA, 20 bp, Artificial Sequence
  chemically synthesized
aactccctgaacggtcagct

SEQ ID NO: 142114 - DNA, 20 bp, Artificial Sequence
  chemically synthesized
actccctgaacggtcagctg

SEQ ID NO: 142115 - DNA, 20 bp, Artificial Sequence
  chemically synthesized
cgcagtcttagtaagggcct

SEQ ID NO: 142116 - DNA, 20 bp, Artificial Sequence
  chemically synthesized
ggtcagctgaggcccttact

SEQ ID NO: 142117 - DNA, 20 bp, Artificial Sequence
  chemically synthesized
ctctgacgcagtcttagtaa

SEQ ID NO: 142118 - DNA, 20 bp, Artificial Sequence
  chemically synthesized
gctctgacgcagtcttagta

SEQ ID NO: 142119 - DNA, 20 bp, Artificial Sequence
  chemically synthesized
agctctgacgcagtcttagt

SEQ ID NO: 142120 - DNA, 20 bp, Artificial Sequence
  chemically synthesized
gttgagctctgacgcagtct

SEQ ID NO: 142121 - DNA, 20 bp, Artificial Sequence
  chemically synthesized
ggcccttactaagactgcgt

SEQ ID NO: 142122 - DNA, 20 bp, Artificial Sequence
  chemically synthesized
cccttactaagactgcgtca

SEQ ID NO: 142123 - DNA, 20 bp, Artificial Sequence
  chemically synthesized
ggagaagttgagctctgacg

SEQ ID NO: 142124 - DNA, 20 bp, Artificial Sequence
  chemically synthesized
taggggcagagggagaagtt

SEQ ID NO: 142125 - DNA, 20 bp, Artificial Sequence
  chemically synthesized
acgtgtaggggcagagggag

SEQ ID NO: 142126 - DNA, 20 bp, Artificial Sequence
  chemically synthesized
tcaacgtgtaggggcagagg

SEQ ID NO: 142127 - DNA, 20 bp, Artificial Sequence
  chemically synthesized
ggtcaacgtgtaggggcaga

SEQ ID NO: 142128 - DNA, 20 bp, Artificial Sequence
  chemically synthesized
gggtcaacgtgtaggggcag

SEQ ID NO: 142129 - DNA, 20 bp, Artificial Sequence
  chemically synthesized
ggggtcaacgtgtaggggca

SEQ ID NO: 142130 - DNA, 20 bp, Artificial Sequence
  chemically synthesized
ttggggtcaacgtgtagggg

SEQ ID NO: 142131 - DNA, 20 bp, Artificial Sequence
  chemically synthesized
ttcttggggtcaacgtgtag

SEQ ID NO: 142132 - DNA, 20 bp, Artificial Sequence
  chemically synthesized
gttcttggggtcaacgtgta

SEQ ID NO: 142133 - DNA, 20 bp, Artificial Sequence
  chemically synthesized
tgttcttggggtcaacgtgt

SEQ ID NO: 142134 - DNA, 20 bp, Artificial Sequence
  chemically synthesized
gtgttcttggggtcaacgtg

SEQ ID NO: 142135 - DNA, 20 bp, Artificial Sequence
  chemically synthesized
tgcccctacacgttgacccc

SEQ ID NO: 142136 - DNA, 20 bp, Artificial Sequence
  chemically synthesized
tctatttaggagtgttcttg

SEQ ID NO: 142137 - DNA, 20 bp, Artificial Sequence
  chemically synthesized
gtctatttaggagtgttctt

SEQ ID NO: 142138 - DNA, 20 bp, Artificial Sequence
  chemically synthesized
tgtctatttaggagtgttct

SEQ ID NO: 142139 - DNA, 20 bp, Artificial Sequence
  chemically synthesized
accccaagaacactcctaaa

SEQ ID NO: 142140 - DNA, 20 bp, Artificial Sequence
  chemically synthesized
catgcagtatgtctatttag

SEQ ID NO: 142141 - DNA, 20 bp, Artificial Sequence
  chemically synthesized
agcatgcagtatgtctattt

SEQ ID NO: 142142 - DNA, 20 bp, Artificial Sequence
  chemically synthesized
gagcatgcagtatgtctatt

SEQ ID NO: 142143 - DNA, 20 bp, Artificial Sequence
  chemically synthesized
ctgagattgaggtgagcatg

SEQ ID NO: 142144 - DNA, 20 bp, Artificial Sequence
  chemically synthesized
gcataccctgagattgaggt

SEQ ID NO: 142145 - DNA, 20 bp, Artificial Sequence
  chemically synthesized
ctgcatgctcacctcaatct

SEQ ID NO: 142146 - DNA, 20 bp, Artificial Sequence
  chemically synthesized
tgcatgctcacctcaatctc

SEQ ID NO: 142147 - DNA, 20 bp, Artificial Sequence
  chemically synthesized
ggaagcataccctgagattg

SEQ ID NO: 142148 - DNA, 20 bp, Artificial Sequence
  chemically synthesized
gcatgctcacctcaatctca

SEQ ID NO: 142149 - DNA, 20 bp, Artificial Sequence
  chemically synthesized
gggaagcataccctgagatt

SEQ ID NO: 142150 - DNA, 20 bp, Artificial Sequence
  chemically synthesized
gtgactgggaagcataccct

SEQ ID NO: 142151 - DNA, 20 bp, Artificial Sequence
  chemically synthesized
caatctcagggtatgcttcc

SEQ ID NO: 142152 - DNA, 20 bp, Artificial Sequence
  chemically synthesized
tcatagtttgggtgactggg

SEQ ID NO: 142153 - DNA, 20 bp, Artificial Sequence
  chemically synthesized
atatcatagtttgggtgact

SEQ ID NO: 142154 - DNA, 20 bp, Artificial Sequence
  chemically synthesized
aatatcatagtttgggtgac

SEQ ID NO: 142155 - DNA, 20 bp, Artificial Sequence
  chemically synthesized
taaagataatatcatagttt

SEQ ID NO: 142156 - DNA, 20 bp, Artificial Sequence
  chemically synthesized
ttaaagataatatcatagtt

SEQ ID NO: 142157 - DNA, 20 bp, Artificial Sequence
  chemically synthesized
cttacttaaagataatatca

SEQ ID NO: 142158 - DNA, 20 bp, Artificial Sequence
  chemically synthesized
caaactatgatattatcttt

SEQ ID NO: 142159 - DNA, 20 bp, Artificial Sequence
  chemically synthesized
ctatgatattatctttaagt

SEQ ID NO: 142160 - DNA, 20 bp, Artificial Sequence
  chemically synthesized
gcctagggtttacttactta

SEQ ID NO: 142161 - DNA, 20 bp, Artificial Sequence
  chemically synthesized
atctttaagtaagtaaaccc

SEQ ID NO: 142162 - DNA, 20 bp, Artificial Sequence
  chemically synthesized
tctttaagtaagtaaaccct

SEQ ID NO: 142163 - DNA, 20 bp, Artificial Sequence
  chemically synthesized
aaatcagtcccaaatgccta

SEQ ID NO: 142164 - DNA, 20 bp, Artificial Sequence
  chemically synthesized
gtaagtaaaccctaggcatt

SEQ ID NO: 142165 - DNA, 20 bp, Artificial Sequence
  chemically synthesized
gaaatcagtcccaaatgcct

SEQ ID NO: 142166 - DNA, 20 bp, Artificial Sequence
  chemically synthesized
taagtaaaccctaggcattt

SEQ ID NO: 142167 - DNA, 20 bp, Artificial Sequence
  chemically synthesized
agaaatcagtcccaaatgcc

SEQ ID NO: 142168 - DNA, 20 bp, Artificial Sequence
  chemically synthesized
aggcatttgggactgatttc

SEQ ID NO: 142169 - DNA, 20 bp, Artificial Sequence
  chemically synthesized
attaagagcattctagaaat

SEQ ID NO: 142170 - DNA, 20 bp, Artificial Sequence
  chemically synthesized
gttttagattaagagcattc

SEQ ID NO: 142171 - DNA, 20 bp, Artificial Sequence
  chemically synthesized
tttggagagttttagattaa

SEQ ID NO: 142172 - DNA, 20 bp, Artificial Sequence
  chemically synthesized
actttggagagttttagatt

SEQ ID NO: 142173 - DNA, 20 bp, Artificial Sequence
  chemically synthesized
acctacactttggagagttt

SEQ ID NO: 142174 - DNA, 20 bp, Artificial Sequence
  chemically synthesized
tcttaatctaaaactctcca

SEQ ID NO: 142175 - DNA, 20 bp, Artificial Sequence
  chemically synthesized
gttttgacctacactttgga

SEQ ID NO: 142176 - DNA, 20 bp, Artificial Sequence
  chemically synthesized
atctaaaactctccaaagtg

SEQ ID NO: 142177 - DNA, 20 bp, Artificial Sequence
  chemically synthesized
aagttttgacctacactttg

SEQ ID NO: 142178 - DNA, 20 bp, Artificial Sequence
  chemically synthesized
tctaaaactctccaaagtgt

SEQ ID NO: 142179 - DNA, 20 bp, Artificial Sequence
  chemically synthesized
aaaagttttgacctacactt

SEQ ID NO: 142180 - DNA, 20 bp, Artificial Sequence
  chemically synthesized
atatgcacactattatggaa

SEQ ID NO: 142181 - DNA, 20 bp, Artificial Sequence
  chemically synthesized
aggtcaaaacttttccataa

SEQ ID NO: 142182 - DNA, 20 bp, Artificial Sequence
  chemically synthesized
agaaaatatgcacactatta

SEQ ID NO: 142183 - DNA, 20 bp, Artificial Sequence
  chemically synthesized
cttgataaaggagcaatggg

SEQ ID NO: 142184 - DNA, 20 bp, Artificial Sequence
  chemically synthesized
tacttgataaaggagcaatg

SEQ ID NO: 142185 - DNA, 20 bp, Artificial Sequence
  chemically synthesized
gtacttgataaaggagcaat

SEQ ID NO: 142186 - DNA, 20 bp, Artificial Sequence
  chemically synthesized
agtacttgataaaggagcaa

SEQ ID NO: 142187 - DNA, 20 bp, Artificial Sequence
  chemically synthesized
ctccccattgctcctttatc

SEQ ID NO: 142188 - DNA, 20 bp, Artificial Sequence
  chemically synthesized
ttcccaagtacttgataaag

SEQ ID NO: 142189 - DNA, 20 bp, Artificial Sequence
  chemically synthesized
aattcccaagtacttgataa

SEQ ID NO: 142190 - DNA, 20 bp, Artificial Sequence
  chemically synthesized
taattcccaagtacttgata

SEQ ID NO: 142191 - DNA, 20 bp, Artificial Sequence
  chemically synthesized
ttgctcctttatcaagtact

SEQ ID NO: 142192 - DNA, 20 bp, Artificial Sequence
  chemically synthesized
tgctcctttatcaagtactt

SEQ ID NO: 142193 - DNA, 20 bp, Artificial Sequence
  chemically synthesized
ttatcaagtacttgggaatt

SEQ ID NO: 142194 - DNA, 20 bp, Artificial Sequence
  chemically synthesized
tattctttaccttaattccc

SEQ ID NO: 142195 - DNA, 20 bp, Artificial Sequence
  chemically synthesized
tatcaagtacttgggaatta

SEQ ID NO: 142196 - DNA, 20 bp, Artificial Sequence
  chemically synthesized
agtacttgggaattaaggta

SEQ ID NO: 142197 - DNA, 20 bp, Artificial Sequence
  chemically synthesized
gaattaaggtaaagaatatt

SEQ ID NO: 142198 - DNA, 20 bp, Artificial Sequence
  chemically synthesized
ttaaggtaaagaatatttgg

SEQ ID NO: 142199 - DNA, 20 bp, Artificial Sequence
  chemically synthesized
aagaatatttggaagaatta

SEQ ID NO: 142200 - DNA, 20 bp, Artificial Sequence
  chemically synthesized
aatatttggaagaattaaag

SEQ ID NO: 142201 - DNA, 20 bp, Artificial Sequence
  chemically synthesized
atatttggaagaattaaagt

SEQ ID NO: 142202 - DNA, 20 bp, Artificial Sequence
  chemically synthesized
tatttggaagaattaaagtg

SEQ ID NO: 142203 - DNA, 20 bp, Artificial Sequence
  chemically synthesized
ttggaagaattaaagtgggg

SEQ ID NO: 142204 - DNA, 20 bp, Artificial Sequence
  chemically synthesized
acccctgagagatatgcagg

SEQ ID NO: 142205 - DNA, 20 bp, Artificial Sequence
  chemically synthesized
ttgacccctgagagatatgc

SEQ ID NO: 142206 - DNA, 20 bp, Artificial Sequence
  chemically synthesized
tttgacccctgagagatatg

SEQ ID NO: 142207 - DNA, 20 bp, Artificial Sequence
  chemically synthesized
tagacttcctgcatatctct

SEQ ID NO: 142208 - DNA, 20 bp, Artificial Sequence
  chemically synthesized
agacttcctgcatatctctc

SEQ ID NO: 142209 - DNA, 20 bp, Artificial Sequence
  chemically synthesized
gacttcctgcatatctctca

SEQ ID NO: 142210 - DNA, 20 bp, Artificial Sequence
  chemically synthesized
acttcctgcatatctctcag

SEQ ID NO: 142211 - DNA, 20 bp, Artificial Sequence
  chemically synthesized
caggtgtgtttgacccctga

SEQ ID NO: 142212 - DNA, 20 bp, Artificial Sequence
  chemically synthesized
aacaggtgtgtttgacccct

SEQ ID NO: 142213 - DNA, 20 bp, Artificial Sequence
  chemically synthesized
gggtcaaacacacctgtttg

SEQ ID NO: 142214 - DNA, 20 bp, Artificial Sequence
  chemically synthesized
gaaagtcagtggccacaaac

SEQ ID NO: 142215 - DNA, 20 bp, Artificial Sequence
  chemically synthesized
cgaaagtcagtggccacaaa

SEQ ID NO: 142216 - DNA, 20 bp, Artificial Sequence
  chemically synthesized
gatggttttgcgaaagtcag

SEQ ID NO: 142217 - DNA, 20 bp, Artificial Sequence
  chemically synthesized
tgagatggttttgcgaaagt

SEQ ID NO: 142218 - DNA, 20 bp, Artificial Sequence
  chemically synthesized
aagatgagatggttttgcga

SEQ ID NO: 142219 - DNA, 20 bp, Artificial Sequence
  chemically synthesized
gcccaaggccaaagatgaga

SEQ ID NO: 142220 - DNA, 20 bp, Artificial Sequence
  chemically synthesized
tcgcaaaaccatctcatctt

SEQ ID NO: 142221 - DNA, 20 bp, Artificial Sequence
  chemically synthesized
gtgtgcccaaggccaaagat

SEQ ID NO: 142222 - DNA, 20 bp, Artificial Sequence
  chemically synthesized
aaccatctcatctttggcct

SEQ ID NO: 142223 - DNA, 20 bp, Artificial Sequence
  chemically synthesized
accatctcatctttggcctt

SEQ ID NO: 142224 - DNA, 20 bp, Artificial Sequence
  chemically synthesized
acagagtgtgcccaaggcca

SEQ ID NO: 142225 - DNA, 20 bp, Artificial Sequence
  chemically synthesized
cagacgacagagtgtgccca

SEQ ID NO: 142226 - DNA, 20 bp, Artificial Sequence
  chemically synthesized
tcagacgacagagtgtgccc

SEQ ID NO: 142227 - DNA, 20 bp, Artificial Sequence
  chemically synthesized
tgagaggtgttcagacgaca

SEQ ID NO: 142228 - DNA, 20 bp, Artificial Sequence
  chemically synthesized
gttgagaggtgttcagacga

SEQ ID NO: 142229 - DNA, 20 bp, Artificial Sequence
  chemically synthesized
accttctgttgagaggtgtt

SEQ ID NO: 142230 - DNA, 20 bp, Artificial Sequence
  chemically synthesized
gtcgtctgaacacctctcaa

SEQ ID NO: 142231 - DNA, 20 bp, Artificial Sequence
  chemically synthesized
ggagggcaccttctgttgag

SEQ ID NO: 142232 - DNA, 20 bp, Artificial Sequence
  chemically synthesized
gtctgaacacctctcaacag

SEQ ID NO: 142233 - DNA, 20 bp, Artificial Sequence
  chemically synthesized
aggagggcaccttctgttga

SEQ ID NO: 142234 - DNA, 20 bp, Artificial Sequence
  chemically synthesized
tctgaacacctctcaacaga

SEQ ID NO: 142235 - DNA, 20 bp, Artificial Sequence
  chemically synthesized
tgaggagggcaccttctgtt

SEQ ID NO: 142236 - DNA, 20 bp, Artificial Sequence
  chemically synthesized
gtcttggagtgtagtgagga

SEQ ID NO: 142237 - DNA, 20 bp, Artificial Sequence
  chemically synthesized
agtcttggagtgtagtgagg

SEQ ID NO: 142238 - DNA, 20 bp, Artificial Sequence
  chemically synthesized
aagtcttggagtgtagtgag

SEQ ID NO: 142239 - DNA, 20 bp, Artificial Sequence
  chemically synthesized
ggaagtcttggagtgtagtg

SEQ ID NO: 142240 - DNA, 20 bp, Artificial Sequence
  chemically synthesized
gggaagtcttggagtgtagt

SEQ ID NO: 142241 - DNA, 20 bp, Artificial Sequence
  chemically synthesized
tgccctcctcactacactcc

SEQ ID NO: 142242 - DNA, 20 bp, Artificial Sequence
  chemically synthesized
gaaagggaagtcttggagtg

SEQ ID NO: 142243 - DNA, 20 bp, Artificial Sequence
  chemically synthesized
ggattgaaagggaagtcttg

SEQ ID NO: 142244 - DNA, 20 bp, Artificial Sequence
  chemically synthesized
ttggattgaaagggaagtct

SEQ ID NO: 142245 - DNA, 20 bp, Artificial Sequence
  chemically synthesized
tttcagttggattgaaaggg

SEQ ID NO: 142246 - DNA, 20 bp, Artificial Sequence
  chemically synthesized
atttttcagttggattgaaa

SEQ ID NO: 142247 - DNA, 20 bp, Artificial Sequence
  chemically synthesized
aatttttcagttggattgaa

SEQ ID NO: 142248 - DNA, 20 bp, Artificial Sequence
  chemically synthesized
aaatttttcagttggattga

SEQ ID NO: 142249 - DNA, 20 bp, Artificial Sequence
  chemically synthesized
atagattcaaatttttcagt

SEQ ID NO: 142250 - DNA, 20 bp, Artificial Sequence
  chemically synthesized
cttaatagattcaaattttt

SEQ ID NO: 142251 - DNA, 20 bp, Artificial Sequence
  chemically synthesized
ctgaaaaatttgaatctatt

SEQ ID NO: 142252 - DNA, 20 bp, Artificial Sequence
  chemically synthesized
aaaaaagcgtattttcttaa

SEQ ID NO: 142253 - DNA, 20 bp, Artificial Sequence
  chemically synthesized
attaagaaaatacgcttttt

SEQ ID NO: 142254 - DNA, 20 bp, Artificial Sequence
  chemically synthesized
aagaaaatacgcttttttgg

SEQ ID NO: 142255 - DNA, 20 bp, Artificial Sequence
  chemically synthesized
ttttctaagagcttccaaaa

SEQ ID NO: 142256 - DNA, 20 bp, Artificial Sequence
  chemically synthesized
tacgcttttttggaagctct

SEQ ID NO: 142257 - DNA, 20 bp, Artificial Sequence
  chemically synthesized
tcactgtaattgttttctaa

SEQ ID NO: 142258 - DNA, 20 bp, Artificial Sequence
  chemically synthesized
tttcactgtaattgttttct

SEQ ID NO: 142259 - DNA, 20 bp, Artificial Sequence
  chemically synthesized
aagctcttagaaaacaatta

SEQ ID NO: 142260 - DNA, 20 bp, Artificial Sequence
  chemically synthesized
tttaaaaagagagagagaga

SEQ ID NO: 142261 - DNA, 20 bp, Artificial Sequence
  chemically synthesized
aatttaaaaagagagagaga

SEQ ID NO: 142262 - DNA, 20 bp, Artificial Sequence
  chemically synthesized
caaatttaaaaagagagaga

SEQ ID NO: 142263 - DNA, 20 bp, Artificial Sequence
  chemically synthesized
tacaaatttaaaaagagaga

SEQ ID NO: 142264 - DNA, 20 bp, Artificial Sequence
  chemically synthesized
ggtacaaatttaaaaagaga

SEQ ID NO: 142265 - DNA, 20 bp, Artificial Sequence
  chemically synthesized
atggtacaaatttaaaaaga

SEQ ID NO: 142266 - DNA, 20 bp, Artificial Sequence
  chemically synthesized
tgatggtacaaatttaaaaa

SEQ ID NO: 142267 - DNA, 20 bp, Artificial Sequence
  chemically synthesized
attgatggtacaaatttaaa

SEQ ID NO: 142268 - DNA, 20 bp, Artificial Sequence
  chemically synthesized
tttaaatttgtaccatcaat

SEQ ID NO: 142269 - DNA, 20 bp, Artificial Sequence
  chemically synthesized
caaagcccctttccaattga

SEQ ID NO: 142270 - DNA, 20 bp, Artificial Sequence
  chemically synthesized
aatttgtaccatcaattgga

SEQ ID NO: 142271 - DNA, 20 bp, Artificial Sequence
  chemically synthesized
atttgtaccatcaattggaa

SEQ ID NO: 142272 - DNA, 20 bp, Artificial Sequence
  chemically synthesized
tttgtaccatcaattggaaa

SEQ ID NO: 142273 - DNA, 20 bp, Artificial Sequence
  chemically synthesized
ttgtaccatcaattggaaag

SEQ ID NO: 142274 - DNA, 20 bp, Artificial Sequence
  chemically synthesized
atcaattggaaaggggcttt

SEQ ID NO: 142275 - DNA, 20 bp, Artificial Sequence
  chemically synthesized
aatggtagtatagtgtctca

SEQ ID NO: 142276 - DNA, 20 bp, Artificial Sequence
  chemically synthesized
tcaaaagggcaatggtagta

SEQ ID NO: 142277 - DNA, 20 bp, Artificial Sequence
  chemically synthesized
gggaatcaaaagggcaatgg

SEQ ID NO: 142278 - DNA, 20 bp, Artificial Sequence
  chemically synthesized
agagggaatcaaaagggcaa

SEQ ID NO: 142279 - DNA, 20 bp, Artificial Sequence
  chemically synthesized
aatttgagagggaatcaaaa

SEQ ID NO: 142280 - DNA, 20 bp, Artificial Sequence
  chemically synthesized
aaatttgagagggaatcaaa

SEQ ID NO: 142281 - DNA, 20 bp, Artificial Sequence
  chemically synthesized
caaatttgagagggaatcaa

SEQ ID NO: 142282 - DNA, 20 bp, Artificial Sequence
  chemically synthesized
taaagctttcaaatttgaga

SEQ ID NO: 142283 - DNA, 20 bp, Artificial Sequence
  chemically synthesized
ataaagctttcaaatttgag

SEQ ID NO: 142284 - DNA, 20 bp, Artificial Sequence
  chemically synthesized
aataaagctttcaaatttga

SEQ ID NO: 142285 - DNA, 20 bp, Artificial Sequence
  chemically synthesized
taaataaagctttcaaattt

SEQ ID NO: 142286 - DNA, 20 bp, Artificial Sequence
  chemically synthesized
tgattccctctcaaatttga

SEQ ID NO: 142287 - DNA, 20 bp, Artificial Sequence
  chemically synthesized
ctatttttgcatcataaata

SEQ ID NO: 142288 - DNA, 20 bp, Artificial Sequence
  chemically synthesized
ctttatttatgatgcaaaaa

SEQ ID NO: 142289 - DNA, 20 bp, Artificial Sequence
  chemically synthesized
aaaaaaccaattaatcatga

SEQ ID NO: 142290 - DNA, 20 bp, Artificial Sequence
  chemically synthesized
aaatagccatcatgattaat

SEQ ID NO: 142291 - DNA, 20 bp, Artificial Sequence
  chemically synthesized
catgattaattggttttttc

SEQ ID NO: 142292 - DNA, 20 bp, Artificial Sequence
  chemically synthesized
ttatccttggtgaaaaatga

SEQ ID NO: 142293 - DNA, 20 bp, Artificial Sequence
  chemically synthesized
agtgtctatcatttttcacc

SEQ ID NO: 142294 - DNA, 20 bp, Artificial Sequence
  chemically synthesized
gtgtctatcatttttcacca

SEQ ID NO: 142295 - DNA, 20 bp, Artificial Sequence
  chemically synthesized
ctaatcatagcagttatcct

SEQ ID NO: 142296 - DNA, 20 bp, Artificial Sequence
  chemically synthesized
ccaaggataactgctatgat

SEQ ID NO: 142297 - DNA, 20 bp, Artificial Sequence
  chemically synthesized
gttcttcttgctaatcatag

SEQ ID NO: 142298 - DNA, 20 bp, Artificial Sequence
  chemically synthesized
gaggttcttcttgctaatca

SEQ ID NO: 142299 - DNA, 20 bp, Artificial Sequence
  chemically synthesized
ggataactgctatgattagc

SEQ ID NO: 142300 - DNA, 20 bp, Artificial Sequence
  chemically synthesized
taactgctatgattagcaag

SEQ ID NO: 142301 - DNA, 20 bp, Artificial Sequence
  chemically synthesized
gattaaatagatttgtatgg

SEQ ID NO: 142302 - DNA, 20 bp, Artificial Sequence
  chemically synthesized
tgattaaatagatttgtatg

SEQ ID NO: 142303 - DNA, 20 bp, Artificial Sequence
  chemically synthesized
gatgattaaatagatttgta

SEQ ID NO: 142304 - DNA, 20 bp, Artificial Sequence
  chemically synthesized
atgaattttagatgattaaa

SEQ ID NO: 142305 - DNA, 20 bp, Artificial Sequence
  chemically synthesized
cttaaaacaaatatgaattt

SEQ ID NO: 142306 - DNA, 20 bp, Artificial Sequence
  chemically synthesized
ctaaaattcatatttgtttt

SEQ ID NO: 142307 - DNA, 20 bp, Artificial Sequence
  chemically synthesized
taaaattcatatttgtttta

SEQ ID NO: 142308 - DNA, 20 bp, Artificial Sequence
  chemically synthesized
tacgttatcagtcaaaataa

SEQ ID NO: 142309 - DNA, 20 bp, Artificial Sequence
  chemically synthesized
atagtagtattttacgttat

SEQ ID NO: 142310 - DNA, 20 bp, Artificial Sequence
  chemically synthesized
actttgcgctgaaatcatag

SEQ ID NO: 142311 - DNA, 20 bp, Artificial Sequence
  chemically synthesized
gtaaaatactactatgattt

SEQ ID NO: 142312 - DNA, 20 bp, Artificial Sequence
  chemically synthesized
ttaactttgcgctgaaatca

SEQ ID NO: 142313 - DNA, 20 bp, Artificial Sequence
  chemically synthesized
actactatgatttcagcgca

SEQ ID NO: 142314 - DNA, 20 bp, Artificial Sequence
  chemically synthesized
atgatttcagcgcaaagtta

SEQ ID NO: 142315 - DNA, 20 bp, Artificial Sequence
  chemically synthesized
cagcgcaaagttaaagtgtg

SEQ ID NO: 142316 - DNA, 20 bp, Artificial Sequence
  chemically synthesized
caaagttaaagtgtgaagaa

SEQ ID NO: 142317 - DNA, 20 bp, Artificial Sequence
  chemically synthesized
aagtgtgaagaaaagtaata

SEQ ID NO: 142318 - DNA, 20 bp, Artificial Sequence
  chemically synthesized
gtgtgaagaaaagtaataca

SEQ ID NO: 142319 - DNA, 20 bp, Artificial Sequence
  chemically synthesized
tgtgaagaaaagtaatacag

SEQ ID NO: 142320 - DNA, 20 bp, Artificial Sequence
  chemically synthesized
aagaaaagtaatacagaggt

SEQ ID NO: 142321 - DNA, 20 bp, Artificial Sequence
  chemically synthesized
agaggttggcataaccatca

SEQ ID NO: 142322 - DNA, 20 bp, Artificial Sequence
  chemically synthesized
gaggttggcataaccatcaa

SEQ ID NO: 142323 - DNA, 20 bp, Artificial Sequence
  chemically synthesized
aggttggcataaccatcaaa

SEQ ID NO: 142324 - DNA, 20 bp, Artificial Sequence
  chemically synthesized
ctttaagaaattccctttga

SEQ ID NO: 142325 - DNA, 20 bp, Artificial Sequence
  chemically synthesized
ccatcaaagggaatttctta

SEQ ID NO: 142326 - DNA, 20 bp, Artificial Sequence
  chemically synthesized
gaatttgttctatattcttt

SEQ ID NO: 142327 - DNA, 20 bp, Artificial Sequence
  chemically synthesized
agggaatttcttaaagaata

SEQ ID NO: 142328 - DNA, 20 bp, Artificial Sequence
  chemically synthesized
atatagaacaaattcaacta

SEQ ID NO: 142329 - DNA, 20 bp, Artificial Sequence
  chemically synthesized
atagaacaaattcaactaca

SEQ ID NO: 142330 - DNA, 20 bp, Artificial Sequence
  chemically synthesized
gaacaaattcaactacagag

SEQ ID NO: 142331 - DNA, 20 bp, Artificial Sequence
  chemically synthesized
acaaattcaactacagagta

SEQ ID NO: 142332 - DNA, 20 bp, Artificial Sequence
  chemically synthesized
aataataaatctctactctg

SEQ ID NO: 142333 - DNA, 20 bp, Artificial Sequence
  chemically synthesized
gtagagatttattatttact

SEQ ID NO: 142334 - DNA, 20 bp, Artificial Sequence
  chemically synthesized
aaaagcatgttttaagatct

SEQ ID NO: 142335 - DNA, 20 bp, Artificial Sequence
  chemically synthesized
gaatttaaaaagcatgtttt

SEQ ID NO: 142336 - DNA, 20 bp, Artificial Sequence
  chemically synthesized
tttcgttatcagaatttaaa

SEQ ID NO: 142337 - DNA, 20 bp, Artificial Sequence
  chemically synthesized
ctatgtcatattttcgttat

SEQ ID NO: 142338 - DNA, 20 bp, Artificial Sequence
  chemically synthesized
ctgataacgaaaatatgaca

SEQ ID NO: 142339 - DNA, 20 bp, Artificial Sequence
  chemically synthesized
gataacgaaaatatgacata

SEQ ID NO: 142340 - DNA, 20 bp, Artificial Sequence
  chemically synthesized
tgacatagagtttgctatcc

SEQ ID NO: 142341 - DNA, 20 bp, Artificial Sequence
  chemically synthesized
gttcaactgtaaaactagga

SEQ ID NO: 142342 - DNA, 20 bp, Artificial Sequence
  chemically synthesized
agtttgctatcctagtttta

SEQ ID NO: 142343 - DNA, 20 bp, Artificial Sequence
  chemically synthesized
gtttgttcaactgtaaaact

SEQ ID NO: 142344 - DNA, 20 bp, Artificial Sequence
  chemically synthesized
agtttgttcaactgtaaaac

SEQ ID NO: 142345 - DNA, 20 bp, Artificial Sequence
  chemically synthesized
tacagttgaacaaactgtaa

SEQ ID NO: 142346 - DNA, 20 bp, Artificial Sequence
  chemically synthesized
ttttaggatctattctatta

SEQ ID NO: 142347 - DNA, 20 bp, Artificial Sequence
  chemically synthesized
ttgaacaaactgtaatagaa

SEQ ID NO: 142348 - DNA, 20 bp, Artificial Sequence
  chemically synthesized
tgacaacctgcacaaatttt

SEQ ID NO: 142349 - DNA, 20 bp, Artificial Sequence
  chemically synthesized
ttgacaacctgcacaaattt

SEQ ID NO: 142350 - DNA, 20 bp, Artificial Sequence
  chemically synthesized
aatagatcctaaaatttgtg

SEQ ID NO: 142351 - DNA, 20 bp, Artificial Sequence
  chemically synthesized
atagatcctaaaatttgtgc

SEQ ID NO: 142352 - DNA, 20 bp, Artificial Sequence
  chemically synthesized
tgcaggttgtcaataacata

SEQ ID NO: 142353 - DNA, 20 bp, Artificial Sequence
  chemically synthesized
gcaggttgtcaataacatac

SEQ ID NO: 142354 - DNA, 20 bp, Artificial Sequence
  chemically synthesized
caggttgtcaataacataca

SEQ ID NO: 142355 - DNA, 20 bp, Artificial Sequence
  chemically synthesized
ttgtcaataacatacagggc

SEQ ID NO: 142356 - DNA, 20 bp, Artificial Sequence
  chemically synthesized
tgtcaataacatacagggca

SEQ ID NO: 142357 - DNA, 20 bp, Artificial Sequence
  chemically synthesized
taacatacagggcaaggttt

SEQ ID NO: 142358 - DNA, 20 bp, Artificial Sequence
  chemically synthesized
catgagctttgtttaaagtc

SEQ ID NO: 142359 - DNA, 20 bp, Artificial Sequence
  chemically synthesized
gcatgagctttgtttaaagt

SEQ ID NO: 142360 - DNA, 20 bp, Artificial Sequence
  chemically synthesized
tagatgcctgactttaaaca

SEQ ID NO: 142361 - DNA, 20 bp, Artificial Sequence
  chemically synthesized
aatagcatgagctttgttta

SEQ ID NO: 142362 - DNA, 20 bp, Artificial Sequence
  chemically synthesized
tgtatttgtagaaatagcat

SEQ ID NO: 142363 - DNA, 20 bp, Artificial Sequence
  chemically synthesized
ttttcttgtatttgtagaaa

SEQ ID NO: 142364 - DNA, 20 bp, Artificial Sequence
  chemically synthesized
catgctatttctacaaatac

SEQ ID NO: 142365 - DNA, 20 bp, Artificial Sequence
  chemically synthesized
ttctggttttcttgtatttg

SEQ ID NO: 142366 - DNA, 20 bp, Artificial Sequence
  chemically synthesized
ttctacaaatacaagaaaac

SEQ ID NO: 142367 - DNA, 20 bp, Artificial Sequence
  chemically synthesized
actatgtgaatatttttttc

SEQ ID NO: 142368 - DNA, 20 bp, Artificial Sequence
  chemically synthesized
accagaaaaaaatattcaca

SEQ ID NO: 142369 - DNA, 20 bp, Artificial Sequence
  chemically synthesized
aaaatattcacatagtctta

SEQ ID NO: 142370 - DNA, 20 bp, Artificial Sequence
  chemically synthesized
ctgaaatatagagaagcttt

SEQ ID NO: 142371 - DNA, 20 bp, Artificial Sequence
  chemically synthesized
ccccctcctgaaatatagag

SEQ ID NO: 142372 - DNA, 20 bp, Artificial Sequence
  chemically synthesized
cttaaagcttctctatattt

SEQ ID NO: 142373 - DNA, 20 bp, Artificial Sequence
  chemically synthesized
tcaccccctcctgaaatata

SEQ ID NO: 142374 - DNA, 20 bp, Artificial Sequence
  chemically synthesized
ttaaagcttctctatatttc

SEQ ID NO: 142375 - DNA, 20 bp, Artificial Sequence
  chemically synthesized
cttcaccccctcctgaaata

SEQ ID NO: 142376 - DNA, 20 bp, Artificial Sequence
  chemically synthesized
aaagcttctctatatttcag

SEQ ID NO: 142377 - DNA, 20 bp, Artificial Sequence
  chemically synthesized
aagcttctctatatttcagg

SEQ ID NO: 142378 - DNA, 20 bp, Artificial Sequence
  chemically synthesized
agcttctctatatttcagga

SEQ ID NO: 142379 - DNA, 20 bp, Artificial Sequence
  chemically synthesized
gcttctctatatttcaggag

SEQ ID NO: 142380 - DNA, 20 bp, Artificial Sequence
  chemically synthesized
cttctctatatttcaggagg

SEQ ID NO: 142381 - DNA, 20 bp, Artificial Sequence
  chemically synthesized
ctatatttcaggagggggtg

SEQ ID NO: 142382 - DNA, 20 bp, Artificial Sequence
  chemically synthesized
agaacactgttaatataatt

SEQ ID NO: 142383 - DNA, 20 bp, Artificial Sequence
  chemically synthesized
aagtaactgaattatattaa

SEQ ID NO: 142384 - DNA, 20 bp, Artificial Sequence
  chemically synthesized
aagaattgggtatcatggta

SEQ ID NO: 142385 - DNA, 20 bp, Artificial Sequence
  chemically synthesized
atgacaagaattgggtatca

SEQ ID NO: 142386 - DNA, 20 bp, Artificial Sequence
  chemically synthesized
ttttattcatgacaagaatt

SEQ ID NO: 142387 - DNA, 20 bp, Artificial Sequence
  chemically synthesized
cttttattcatgacaagaat

SEQ ID NO: 142388 - DNA, 20 bp, Artificial Sequence
  chemically synthesized
catcaccttttattcatgac

SEQ ID NO: 142389 - DNA, 20 bp, Artificial Sequence
  chemically synthesized
ccaattcttgtcatgaataa

SEQ ID NO: 142390 - DNA, 20 bp, Artificial Sequence
  chemically synthesized
caattcttgtcatgaataaa

SEQ ID NO: 142391 - DNA, 20 bp, Artificial Sequence
  chemically synthesized
catgaataaaaggtgatgtt

SEQ ID NO: 142392 - DNA, 20 bp, Artificial Sequence
  chemically synthesized
tgaataaaaggtgatgttca

SEQ ID NO: 142393 - DNA, 20 bp, Artificial Sequence
  chemically synthesized
taattgacaaaaaaaaaaaa

SEQ ID NO: 142394 - DNA, 20 bp, Artificial Sequence
  chemically synthesized
aattgacaaaaaaaaaaaaa

SEQ ID NO: 142395 - DNA, 20 bp, Artificial Sequence
  chemically synthesized
acaaaaaaaaaaaaaaggat

SEQ ID NO: 142396 - DNA, 20 bp, Artificial Sequence
  chemically synthesized
aaaaaaaaaggataagaaaa

SEQ ID NO: 142397 - DNA, 20 bp, Artificial Sequence
  chemically synthesized
aaaaaaaaggataagaaaaa

SEQ ID NO: 142398 - DNA, 20 bp, Artificial Sequence
  chemically synthesized
taagaaaaaaggaatgaaat

SEQ ID NO: 142399 - DNA, 20 bp, Artificial Sequence
  chemically synthesized
aagaaaaaaggaatgaaata

SEQ ID NO: 142400 - DNA, 20 bp, Artificial Sequence
  chemically synthesized
aaaaaaggaatgaaataagg

SEQ ID NO: 142401 - DNA, 20 bp, Artificial Sequence
  chemically synthesized
actgataaaaagggaaggtt

SEQ ID NO: 142402 - DNA, 20 bp, Artificial Sequence
  chemically synthesized
tgatcactgataaaaaggga

SEQ ID NO: 142403 - DNA, 20 bp, Artificial Sequence
  chemically synthesized
ttgatcactgataaaaaggg

SEQ ID NO: 142404 - DNA, 20 bp, Artificial Sequence
  chemically synthesized
accaaaccttccctttttat

SEQ ID NO: 142405 - DNA, 20 bp, Artificial Sequence
  chemically synthesized
attttgatcactgataaaaa

SEQ ID NO: 142406 - DNA, 20 bp, Artificial Sequence
  chemically synthesized
gattttgatcactgataaaa

SEQ ID NO: 142407 - DNA, 20 bp, Artificial Sequence
  chemically synthesized
ggattttgatcactgataaa

SEQ ID NO: 142408 - DNA, 20 bp, Artificial Sequence
  chemically synthesized
tttataaatatgtaaaagca

SEQ ID NO: 142409 - DNA, 20 bp, Artificial Sequence
  chemically synthesized
ttttataaatatgtaaaagc

SEQ ID NO: 142410 - DNA, 20 bp, Artificial Sequence
  chemically synthesized
tggattttataaatatgtaa

SEQ ID NO: 142411 - DNA, 20 bp, Artificial Sequence
  chemically synthesized
acacatccagagaaatagaa

SEQ ID NO: 142412 - DNA, 20 bp, Artificial Sequence
  chemically synthesized
taaaatccattctatttctc

SEQ ID NO: 142413 - DNA, 20 bp, Artificial Sequence
  chemically synthesized
tcattacacatccagagaaa

SEQ ID NO: 142414 - DNA, 20 bp, Artificial Sequence
  chemically synthesized
tttctttcattacacatcca

SEQ ID NO: 142415 - DNA, 20 bp, Artificial Sequence
  chemically synthesized
attttctttcattacacatc

SEQ ID NO: 142416 - DNA, 20 bp, Artificial Sequence
  chemically synthesized
tttctctggatgtgtaatga

SEQ ID NO: 142417 - DNA, 20 bp, Artificial Sequence
  chemically synthesized
ttttgttatttcaaatggat

SEQ ID NO: 142418 - DNA, 20 bp, Artificial Sequence
  chemically synthesized
atctcttttgttatttcaaa

SEQ ID NO: 142419 - DNA, 20 bp, Artificial Sequence
  chemically synthesized
taatccatttgaaataacaa

SEQ ID NO: 142420 - DNA, 20 bp, Artificial Sequence
  chemically synthesized
atccatttgaaataacaaaa

SEQ ID NO: 142421 - DNA, 20 bp, Artificial Sequence
  chemically synthesized
atttgaaataacaaaagaga

SEQ ID NO: 142422 - DNA, 20 bp, Artificial Sequence
  chemically synthesized
aacaaaagagatggcattct

SEQ ID NO: 142423 - DNA, 20 bp, Artificial Sequence
  chemically synthesized
ctggaaagagaatgtggact

SEQ ID NO: 142424 - DNA, 20 bp, Artificial Sequence
  chemically synthesized
taaaatctggaaagagaatg

SEQ ID NO: 142425 - DNA, 20 bp, Artificial Sequence
  chemically synthesized
ctgagtccacattctctttc

SEQ ID NO: 142426 - DNA, 20 bp, Artificial Sequence
  chemically synthesized
taaaacttaaaatctggaaa

SEQ ID NO: 142427 - DNA, 20 bp, Artificial Sequence
  chemically synthesized
tataaaacttaaaatctgga

SEQ ID NO: 142428 - DNA, 20 bp, Artificial Sequence
  chemically synthesized
acattctctttccagatttt

SEQ ID NO: 142429 - DNA, 20 bp, Artificial Sequence
  chemically synthesized
taattataaaacttaaaatc

SEQ ID NO: 142430 - DNA, 20 bp, Artificial Sequence
  chemically synthesized
attcgttgatagtgttacgt

SEQ ID NO: 142431 - DNA, 20 bp, Artificial Sequence
  chemically synthesized
tctattgtcctattcgttga

SEQ ID NO: 142432 - DNA, 20 bp, Artificial Sequence
  chemically synthesized
tacgtaacactatcaacgaa

SEQ ID NO: 142433 - DNA, 20 bp, Artificial Sequence
  chemically synthesized
acgtaacactatcaacgaat

SEQ ID NO: 142434 - DNA, 20 bp, Artificial Sequence
  chemically synthesized
actatcaacgaataggacaa

SEQ ID NO: 142435 - DNA, 20 bp, Artificial Sequence
  chemically synthesized
gacaatagaatacaaacaaa

SEQ ID NO: 142436 - DNA, 20 bp, Artificial Sequence
  chemically synthesized
aacaaaaagtgaatcctttt

SEQ ID NO: 142437 - DNA, 20 bp, Artificial Sequence
  chemically synthesized
aaaaagtgaatcctttttag

SEQ ID NO: 142438 - DNA, 20 bp, Artificial Sequence
  chemically synthesized
actcaaactgtcttctaaaa

SEQ ID NO: 142439 - DNA, 20 bp, Artificial Sequence
  chemically synthesized
tactcaaactgtcttctaaa

SEQ ID NO: 142440 - DNA, 20 bp, Artificial Sequence
  chemically synthesized
agtgaatcctttttagaaga

SEQ ID NO: 142441 - DNA, 20 bp, Artificial Sequence
  chemically synthesized
tcctttttagaagacagttt

SEQ ID NO: 142442 - DNA, 20 bp, Artificial Sequence
  chemically synthesized
gagtagtacataatatatag

SEQ ID NO: 142443 - DNA, 20 bp, Artificial Sequence
  chemically synthesized
aaagagtagtacataatata

SEQ ID NO: 142444 - DNA, 20 bp, Artificial Sequence
  chemically synthesized
atattatgtactactcttta

SEQ ID NO: 142445 - DNA, 20 bp, Artificial Sequence
  chemically synthesized
tgcatgagagctttaaagag

SEQ ID NO: 142446 - DNA, 20 bp, Artificial Sequence
  chemically synthesized
atctgcatgagagctttaaa

SEQ ID NO: 142447 - DNA, 20 bp, Artificial Sequence
  chemically synthesized
aaatctgcatgagagcttta

SEQ ID NO: 142448 - DNA, 20 bp, Artificial Sequence
  chemically synthesized
tactctttaaagctctcatg

SEQ ID NO: 142449 - DNA, 20 bp, Artificial Sequence
  chemically synthesized
aattattaaaatctgcatga

SEQ ID NO: 142450 - DNA, 20 bp, Artificial Sequence
  chemically synthesized
ttaattattaaaatctgcat

SEQ ID NO: 142451 - DNA, 20 bp, Artificial Sequence
  chemically synthesized
tacatatagtaatttatatt

SEQ ID NO: 142452 - DNA, 20 bp, Artificial Sequence
  chemically synthesized
aatataaattactatatgta

SEQ ID NO: 142453 - DNA, 20 bp, Artificial Sequence
  chemically synthesized
atagattactgctttacata

SEQ ID NO: 142454 - DNA, 20 bp, Artificial Sequence
  chemically synthesized
ataaattactatatgtaaag

SEQ ID NO: 142455 - DNA, 20 bp, Artificial Sequence
  chemically synthesized
aatcattttatttataaaaa

SEQ ID NO: 142456 - DNA, 20 bp, Artificial Sequence
  chemically synthesized
ttataaataaaatgatttcg

SEQ ID NO: 142457 - DNA, 20 bp, Artificial Sequence
  chemically synthesized
ctgagggaaagaatttaaca

SEQ ID NO: 142458 - DNA, 20 bp, Artificial Sequence
  chemically synthesized
ctgtgttaaattctttccct

SEQ ID NO: 142459 - DNA, 20 bp, Artificial Sequence
  chemically synthesized
tagagcaactgtctgaggga

SEQ ID NO: 142460 - DNA, 20 bp, Artificial Sequence
  chemically synthesized
gttaaattctttccctcaga

SEQ ID NO: 142461 - DNA, 20 bp, Artificial Sequence
  chemically synthesized
tctctagagcaactgtctga

SEQ ID NO: 142462 - DNA, 20 bp, Artificial Sequence
  chemically synthesized
ttctctagagcaactgtctg

SEQ ID NO: 142463 - DNA, 20 bp, Artificial Sequence
  chemically synthesized
cttctctagagcaactgtct

SEQ ID NO: 142464 - DNA, 20 bp, Artificial Sequence
  chemically synthesized
tttccctcagacagttgctc

SEQ ID NO: 142465 - DNA, 20 bp, Artificial Sequence
  chemically synthesized
tccctcagacagttgctcta

SEQ ID NO: 142466 - DNA, 20 bp, Artificial Sequence
  chemically synthesized
ctcagacagttgctctagag

SEQ ID NO: 142467 - DNA, 20 bp, Artificial Sequence
  chemically synthesized
tcagacagttgctctagaga

SEQ ID NO: 142468 - DNA, 20 bp, Artificial Sequence
  chemically synthesized
aagcagccattccttctcta

SEQ ID NO: 142469 - DNA, 20 bp, Artificial Sequence
  chemically synthesized
ccaagcagccattccttctc

SEQ ID NO: 142470 - DNA, 20 bp, Artificial Sequence
  chemically synthesized
cagttgctctagagaaggaa

SEQ ID NO: 142471 - DNA, 20 bp, Artificial Sequence
  chemically synthesized
ctagagaaggaatggctgct

SEQ ID NO: 142472 - DNA, 20 bp, Artificial Sequence
  chemically synthesized
tgtacctaccagggtccaag

SEQ ID NO: 142473 - DNA, 20 bp, Artificial Sequence
  chemically synthesized
aggaatggctgcttggaccc

SEQ ID NO: 142474 - DNA, 20 bp, Artificial Sequence
  chemically synthesized
tgatgtacctaccagggtcc

SEQ ID NO: 142475 - DNA, 20 bp, Artificial Sequence
  chemically synthesized
aatggctgcttggaccctgg

SEQ ID NO: 142476 - DNA, 20 bp, Artificial Sequence
  chemically synthesized
atggctgcttggaccctggt

SEQ ID NO: 142477 - DNA, 20 bp, Artificial Sequence
  chemically synthesized
tcaccatgatgtacctacca

SEQ ID NO: 142478 - DNA, 20 bp, Artificial Sequence
  chemically synthesized
ctcaccatgatgtacctacc

SEQ ID NO: 142479 - DNA, 20 bp, Artificial Sequence
  chemically synthesized
tctcaccatgatgtacctac

SEQ ID NO: 142480 - DNA, 20 bp, Artificial Sequence
  chemically synthesized
ggaccctggtaggtacatca

SEQ ID NO: 142481 - DNA, 20 bp, Artificial Sequence
  chemically synthesized
cctggtaggtacatcatggt

SEQ ID NO: 142482 - DNA, 20 bp, Artificial Sequence
  chemically synthesized
tggtaggtacatcatggtga

SEQ ID NO: 142483 - DNA, 20 bp, Artificial Sequence
  chemically synthesized
ggtaggtacatcatggtgag

SEQ ID NO: 142484 - DNA, 20 bp, Artificial Sequence
  chemically synthesized
gagaggcacaaatgttatcc

SEQ ID NO: 142485 - DNA, 20 bp, Artificial Sequence
  chemically synthesized
taatttgtgaagttgttacc

SEQ ID NO: 142486 - DNA, 20 bp, Artificial Sequence
  chemically synthesized
ataatttgtgaagttgttac

SEQ ID NO: 142487 - DNA, 20 bp, Artificial Sequence
  chemically synthesized
cactatgtctataatttgtg

SEQ ID NO: 142488 - DNA, 20 bp, Artificial Sequence
  chemically synthesized
ggtaacaacttcacaaatta

SEQ ID NO: 142489 - DNA, 20 bp, Artificial Sequence
  chemically synthesized
aacttcacaaattatagaca

SEQ ID NO: 142490 - DNA, 20 bp, Artificial Sequence
  chemically synthesized
caaattatagacatagtgcg

SEQ ID NO: 142491 - DNA, 20 bp, Artificial Sequence
  chemically synthesized
aattatagacatagtgcgaa

SEQ ID NO: 142492 - DNA, 20 bp, Artificial Sequence
  chemically synthesized
tagacatagtgcgaagagaa

SEQ ID NO: 142493 - DNA, 20 bp, Artificial Sequence
  chemically synthesized
cgaagagaaaagatttctaa

SEQ ID NO: 142494 - DNA, 20 bp, Artificial Sequence
  chemically synthesized
cttttaccaaattaatcttt

SEQ ID NO: 142495 - DNA, 20 bp, Artificial Sequence
  chemically synthesized
agatttctaaaagattaatt

SEQ ID NO: 142496 - DNA, 20 bp, Artificial Sequence
  chemically synthesized
ctaaaagattaatttggtaa

SEQ ID NO: 142497 - DNA, 20 bp, Artificial Sequence
  chemically synthesized
taatttggtaaaagcatatg

SEQ ID NO: 142498 - DNA, 20 bp, Artificial Sequence
  chemically synthesized
atttggtaaaagcatatgta

SEQ ID NO: 142499 - DNA, 20 bp, Artificial Sequence
  chemically synthesized
aaagcatatgtagagaaatc

SEQ ID NO: 142500 - DNA, 20 bp, Artificial Sequence
  chemically synthesized
tgtagagaaatcaagtgact

SEQ ID NO: 142501 - DNA, 20 bp, Artificial Sequence
  chemically synthesized
tagagaaatcaagtgactca

SEQ ID NO: 142502 - DNA, 20 bp, Artificial Sequence
  chemically synthesized
agagaaatcaagtgactcag

SEQ ID NO: 142503 - DNA, 20 bp, Artificial Sequence
  chemically synthesized
gagaaatcaagtgactcaga

SEQ ID NO: 142504 - DNA, 20 bp, Artificial Sequence
  chemically synthesized
ttggatgtgtatgtccctct

SEQ ID NO: 142505 - DNA, 20 bp, Artificial Sequence
  chemically synthesized
agggacatacacatccaact

SEQ ID NO: 142506 - DNA, 20 bp, Artificial Sequence
  chemically synthesized
tgagagaacattatcttagt

SEQ ID NO: 142507 - DNA, 20 bp, Artificial Sequence
  chemically synthesized
cagctgagagaacattatct

SEQ ID NO: 142508 - DNA, 20 bp, Artificial Sequence
  chemically synthesized
caactaagataatgttctct

SEQ ID NO: 142509 - DNA, 20 bp, Artificial Sequence
  chemically synthesized
atcttgaggagcacagctga

SEQ ID NO: 142510 - DNA, 20 bp, Artificial Sequence
  chemically synthesized
gcatcttgaggagcacagct

SEQ ID NO: 142511 - DNA, 20 bp, Artificial Sequence
  chemically synthesized
gtagagcatcttgaggagca

SEQ ID NO: 142512 - DNA, 20 bp, Artificial Sequence
  chemically synthesized
ttctctcagctgtgctcctc

SEQ ID NO: 142513 - DNA, 20 bp, Artificial Sequence
  chemically synthesized
tttgtgtagagcatcttgag

SEQ ID NO: 142514 - DNA, 20 bp, Artificial Sequence
  chemically synthesized
catttgtgtagagcatcttg

SEQ ID NO: 142515 - DNA, 20 bp, Artificial Sequence
  chemically synthesized
ccatttgtgtagagcatctt

SEQ ID NO: 142516 - DNA, 20 bp, Artificial Sequence
  chemically synthesized
ccatggaaaccatttgtgta

SEQ ID NO: 142517 - DNA, 20 bp, Artificial Sequence
  chemically synthesized
ctcaagatgctctacacaaa

SEQ ID NO: 142518 - DNA, 20 bp, Artificial Sequence
  chemically synthesized
ctccatggaaaccatttgtg

SEQ ID NO: 142519 - DNA, 20 bp, Artificial Sequence
  chemically synthesized
ctctacacaaatggtttcca

SEQ ID NO: 142520 - DNA, 20 bp, Artificial Sequence
  chemically synthesized
ctacacaaatggtttccatg

SEQ ID NO: 142521 - DNA, 20 bp, Artificial Sequence
  chemically synthesized
atttctcagtgatttctcca

SEQ ID NO: 142522 - DNA, 20 bp, Artificial Sequence
  chemically synthesized
gtttccatggagaaatcact

SEQ ID NO: 142523 - DNA, 20 bp, Artificial Sequence
  chemically synthesized
attgttagctcagtatttct

SEQ ID NO: 142524 - DNA, 20 bp, Artificial Sequence
  chemically synthesized
agaaatcactgagaaatact

SEQ ID NO: 142525 - DNA, 20 bp, Artificial Sequence
  chemically synthesized
gaatgttagtattgttagct

SEQ ID NO: 142526 - DNA, 20 bp, Artificial Sequence
  chemically synthesized
tttaggaatgttagtattgt

SEQ ID NO: 142527 - DNA, 20 bp, Artificial Sequence
  chemically synthesized
gaaaagtcttttaggaatgt

SEQ ID NO: 142528 - DNA, 20 bp, Artificial Sequence
  chemically synthesized
aacaatactaacattcctaa

SEQ ID NO: 142529 - DNA, 20 bp, Artificial Sequence
  chemically synthesized
aggtcactgaaaagtctttt

SEQ ID NO: 142530 - DNA, 20 bp, Artificial Sequence
  chemically synthesized
aaggtcactgaaaagtcttt

SEQ ID NO: 142531 - DNA, 20 bp, Artificial Sequence
  chemically synthesized
aacattcctaaaagactttt

SEQ ID NO: 142532 - DNA, 20 bp, Artificial Sequence
  chemically synthesized
tccatagtaaggtcactgaa

SEQ ID NO: 142533 - DNA, 20 bp, Artificial Sequence
  chemically synthesized
acttttcagtgaccttacta

SEQ ID NO: 142534 - DNA, 20 bp, Artificial Sequence
  chemically synthesized
ttttcagtgaccttactatg

SEQ ID NO: 142535 - DNA, 20 bp, Artificial Sequence
  chemically synthesized
tgatgtacatctccatagta

SEQ ID NO: 142536 - DNA, 20 bp, Artificial Sequence
  chemically synthesized
atgatgtacatctccatagt

SEQ ID NO: 142537 - DNA, 20 bp, Artificial Sequence
  chemically synthesized
atctatgatgtacatctcca

SEQ ID NO: 142538 - DNA, 20 bp, Artificial Sequence
  chemically synthesized
tactatggagatgtacatca

SEQ ID NO: 142539 - DNA, 20 bp, Artificial Sequence
  chemically synthesized
agatgtacatcatagattgc

SEQ ID NO: 142540 - DNA, 20 bp, Artificial Sequence
  chemically synthesized
gatgtacatcatagattgct

SEQ ID NO: 142541 - DNA, 20 bp, Artificial Sequence
  chemically synthesized
tacatcatagattgctagga

SEQ ID NO: 142542 - DNA, 20 bp, Artificial Sequence
  chemically synthesized
acatcatagattgctaggat

SEQ ID NO: 142543 - DNA, 20 bp, Artificial Sequence
  chemically synthesized
tgcatagacgttgcctatcc

SEQ ID NO: 142544 - DNA, 20 bp, Artificial Sequence
  chemically synthesized
aataagctgaaaaacatgca

SEQ ID NO: 142545 - DNA, 20 bp, Artificial Sequence
  chemically synthesized
caacgtctatgcatgttttt

SEQ ID NO: 142546 - DNA, 20 bp, Artificial Sequence
  chemically synthesized
tcctcatgaaaaggtcaaat

SEQ ID NO: 142547 - DNA, 20 bp, Artificial Sequence
  chemically synthesized
agcttatttgaccttttcat

SEQ ID NO: 142548 - DNA, 20 bp, Artificial Sequence
  chemically synthesized
gcttatttgaccttttcatg

SEQ ID NO: 142549 - DNA, 20 bp, Artificial Sequence
  chemically synthesized
catacatgatcctcatgaaa

SEQ ID NO: 142550 - DNA, 20 bp, Artificial Sequence
  chemically synthesized
tcatacatgatcctcatgaa

SEQ ID NO: 142551 - DNA, 20 bp, Artificial Sequence
  chemically synthesized
tacagaaaaccaggttcatc

SEQ ID NO: 142552 - DNA, 20 bp, Artificial Sequence
  chemically synthesized
gtatgaacacctgatgaacc

SEQ ID NO: 142553 - DNA, 20 bp, Artificial Sequence
  chemically synthesized
ctacagaaaaccaggttcat

SEQ ID NO: 142554 - DNA, 20 bp, Artificial Sequence
  chemically synthesized
aaattgtcctacagaaaacc

SEQ ID NO: 142555 - DNA, 20 bp, Artificial Sequence
  chemically synthesized
aaaattgtcctacagaaaac

SEQ ID NO: 142556 - DNA, 20 bp, Artificial Sequence
  chemically synthesized
ctgatgaacctggttttctg

SEQ ID NO: 142557 - DNA, 20 bp, Artificial Sequence
  chemically synthesized
tgatgaacctggttttctgt

SEQ ID NO: 142558 - DNA, 20 bp, Artificial Sequence
  chemically synthesized
acatttccaaaattgtccta

SEQ ID NO: 142559 - DNA, 20 bp, Artificial Sequence
  chemically synthesized
ggttttctgtaggacaattt

SEQ ID NO: 142560 - DNA, 20 bp, Artificial Sequence
  chemically synthesized
aggacaattttggaaatgtt

SEQ ID NO: 142561 - DNA, 20 bp, Artificial Sequence
  chemically synthesized
ctatcatttctagttgataa

SEQ ID NO: 142562 - DNA, 20 bp, Artificial Sequence
  chemically synthesized
tgttgagatcttttatcaac

SEQ ID NO: 142563 - DNA, 20 bp, Artificial Sequence
  chemically synthesized
cttttatcaactagaaatga

SEQ ID NO: 142564 - DNA, 20 bp, Artificial Sequence
  chemically synthesized
aggaaatatactatcatttc

SEQ ID NO: 142565 - DNA, 20 bp, Artificial Sequence
  chemically synthesized
agaaatgatagtatatttcc

SEQ ID NO: 142566 - DNA, 20 bp, Artificial Sequence
  chemically synthesized
ggttaaaaaatattttgact

SEQ ID NO: 142567 - DNA, 20 bp, Artificial Sequence
  chemically synthesized
tggttaaaaaatattttgac

SEQ ID NO: 142568 - DNA, 20 bp, Artificial Sequence
  chemically synthesized
tggttaagaaatcaataaag

SEQ ID NO: 142569 - DNA, 20 bp, Artificial Sequence
  chemically synthesized
aagtggttaagaaatcaata

SEQ ID NO: 142570 - DNA, 20 bp, Artificial Sequence
  chemically synthesized
tttatgtcaataaagtggtt

SEQ ID NO: 142571 - DNA, 20 bp, Artificial Sequence
  chemically synthesized
agctttttatgtcaataaag

SEQ ID NO: 142572 - DNA, 20 bp, Artificial Sequence
  chemically synthesized
tatagctttttatgtcaata

SEQ ID NO: 142573 - DNA, 20 bp, Artificial Sequence
  chemically synthesized
aaccactttattgacataaa

SEQ ID NO: 142574 - DNA, 20 bp, Artificial Sequence
  chemically synthesized
ctgtgttcattaaatgtgta

SEQ ID NO: 142575 - DNA, 20 bp, Artificial Sequence
  chemically synthesized
ctatacacatttaatgaaca

SEQ ID NO: 142576 - DNA, 20 bp, Artificial Sequence
  chemically synthesized
tttaatgaacacagcttgat

SEQ ID NO: 142577 - DNA, 20 bp, Artificial Sequence
  chemically synthesized
taattatctcgaaactcatc

SEQ ID NO: 142578 - DNA, 20 bp, Artificial Sequence
  chemically synthesized
aacacagcttgatgagtttc

SEQ ID NO: 142579 - DNA, 20 bp, Artificial Sequence
  chemically synthesized
gatgagtttcgagataatta

SEQ ID NO: 142580 - DNA, 20 bp, Artificial Sequence
  chemically synthesized
attacagttatgtgctgcat

SEQ ID NO: 142581 - DNA, 20 bp, Artificial Sequence
  chemically synthesized
ttacagttatgtgctgcata

SEQ ID NO: 142582 - DNA, 20 bp, Artificial Sequence
  chemically synthesized
ttgatcaaaatgtccttatg

SEQ ID NO: 142583 - DNA, 20 bp, Artificial Sequence
  chemically synthesized
cataaggacattttgatcaa

SEQ ID NO: 142584 - DNA, 20 bp, Artificial Sequence
  chemically synthesized
acagactgtgcacatgatag

SEQ ID NO: 142585 - DNA, 20 bp, Artificial Sequence
  chemically synthesized
tatacagactgtgcacatga

SEQ ID NO: 142586 - DNA, 20 bp, Artificial Sequence
  chemically synthesized
atggaccactatcatgtgca

SEQ ID NO: 142587 - DNA, 20 bp, Artificial Sequence
  chemically synthesized
accactgtcctacatgtata

SEQ ID NO: 142588 - DNA, 20 bp, Artificial Sequence
  chemically synthesized
gtgcacagtctgtatacatg

SEQ ID NO: 142589 - DNA, 20 bp, Artificial Sequence
  chemically synthesized
tgcacagtctgtatacatgt

SEQ ID NO: 142590 - DNA, 20 bp, Artificial Sequence
  chemically synthesized
cagtctgtatacatgtagga

SEQ ID NO: 142591 - DNA, 20 bp, Artificial Sequence
  chemically synthesized
tctgtatacatgtaggacag

SEQ ID NO: 142592 - DNA, 20 bp, Artificial Sequence
  chemically synthesized
atgtaggacagtggtcctat

SEQ ID NO: 142593 - DNA, 20 bp, Artificial Sequence
  chemically synthesized
gaaaaatattataatcttat

SEQ ID NO: 142594 - DNA, 20 bp, Artificial Sequence
  chemically synthesized
agaaaaatattataatctta

SEQ ID NO: 142595 - DNA, 20 bp, Artificial Sequence
  chemically synthesized
atctaaacatagaaaagtta

SEQ ID NO: 142596 - DNA, 20 bp, Artificial Sequence
  chemically synthesized
aatcacatctaaacatagaa

SEQ ID NO: 142597 - DNA, 20 bp, Artificial Sequence
  chemically synthesized
ttctgtaacttttctatgtt

SEQ ID NO: 142598 - DNA, 20 bp, Artificial Sequence
  chemically synthesized
tatctaatcacatctaaaca

SEQ ID NO: 142599 - DNA, 20 bp, Artificial Sequence
  chemically synthesized
tttctatgtttagatgtgat

SEQ ID NO: 142600 - DNA, 20 bp, Artificial Sequence
  chemically synthesized
ggcaattggaacacgatggc

SEQ ID NO: 142601 - DNA, 20 bp, Artificial Sequence
  chemically synthesized
ttcaggcaattggaacacga

SEQ ID NO: 142602 - DNA, 20 bp, Artificial Sequence
  chemically synthesized
tactgaatacttcaggcaat

SEQ ID NO: 142603 - DNA, 20 bp, Artificial Sequence
  chemically synthesized
catcgtgttccaattgcctg

SEQ ID NO: 142604 - DNA, 20 bp, Artificial Sequence
  chemically synthesized
gtgactgtactgaatacttc

SEQ ID NO: 142605 - DNA, 20 bp, Artificial Sequence
  chemically synthesized
ttccaattgcctgaagtatt

SEQ ID NO: 142606 - DNA, 20 bp, Artificial Sequence
  chemically synthesized
tgtgactgtactgaatactt

SEQ ID NO: 142607 - DNA, 20 bp, Artificial Sequence
  chemically synthesized
attgcctgaagtattcagta

SEQ ID NO: 142608 - DNA, 20 bp, Artificial Sequence
  chemically synthesized
agtacagtcacatgctgtac

SEQ ID NO: 142609 - DNA, 20 bp, Artificial Sequence
  chemically synthesized
tcctaggctataaaccagta

SEQ ID NO: 142610 - DNA, 20 bp, Artificial Sequence
  chemically synthesized
tcacatgctgtactggttta

SEQ ID NO: 142611 - DNA, 20 bp, Artificial Sequence
  chemically synthesized
attgctcctaggctataaac

SEQ ID NO: 142612 - DNA, 20 bp, Artificial Sequence
  chemically synthesized
tgctgtactggtttatagcc

SEQ ID NO: 142613 - DNA, 20 bp, Artificial Sequence
  chemically synthesized
gctgtactggtttatagcct

SEQ ID NO: 142614 - DNA, 20 bp, Artificial Sequence
  chemically synthesized
tgtactggtttatagcctag

SEQ ID NO: 142615 - DNA, 20 bp, Artificial Sequence
  chemically synthesized
tggtatagcctattgctcct

SEQ ID NO: 142616 - DNA, 20 bp, Artificial Sequence
  chemically synthesized
ggtttatagcctaggagcaa

SEQ ID NO: 142617 - DNA, 20 bp, Artificial Sequence
  chemically synthesized
atggtatagcctattgctcc

SEQ ID NO: 142618 - DNA, 20 bp, Artificial Sequence
  chemically synthesized
gtttatagcctaggagcaat

SEQ ID NO: 142619 - DNA, 20 bp, Artificial Sequence
  chemically synthesized
tacatctaggttgtatggta

SEQ ID NO: 142620 - DNA, 20 bp, Artificial Sequence
  chemically synthesized
ataggctataccatacaacc

SEQ ID NO: 142621 - DNA, 20 bp, Artificial Sequence
  chemically synthesized
tactatacatctaggttgta

SEQ ID NO: 142622 - DNA, 20 bp, Artificial Sequence
  chemically synthesized
taccatacaacctagatgta

SEQ ID NO: 142623 - DNA, 20 bp, Artificial Sequence
  chemically synthesized
gtacatcctactatacatct

SEQ ID NO: 142624 - DNA, 20 bp, Artificial Sequence
  chemically synthesized
ggtacatcctactatacatc

SEQ ID NO: 142625 - DNA, 20 bp, Artificial Sequence
  chemically synthesized
catacaacctagatgtatag

SEQ ID NO: 142626 - DNA, 20 bp, Artificial Sequence
  chemically synthesized
atacaacctagatgtatagt

SEQ ID NO: 142627 - DNA, 20 bp, Artificial Sequence
  chemically synthesized
gtatagtaggatgtaccatc

SEQ ID NO: 142628 - DNA, 20 bp, Artificial Sequence
  chemically synthesized
tatagtaggatgtaccatct

SEQ ID NO: 142629 - DNA, 20 bp, Artificial Sequence
  chemically synthesized
tgtacttacacaaacctaga

SEQ ID NO: 142630 - DNA, 20 bp, Artificial Sequence
  chemically synthesized
acagtgtacttacacaaacc

SEQ ID NO: 142631 - DNA, 20 bp, Artificial Sequence
  chemically synthesized
tgtaccatctaggtttgtgt

SEQ ID NO: 142632 - DNA, 20 bp, Artificial Sequence
  chemically synthesized
cttgttgtgcaaacatcata

SEQ ID NO: 142633 - DNA, 20 bp, Artificial Sequence
  chemically synthesized
ctgtatgatgtttgcacaac

SEQ ID NO: 142634 - DNA, 20 bp, Artificial Sequence
  chemically synthesized
gtttgcacaacaagatcaat

SEQ ID NO: 142635 - DNA, 20 bp, Artificial Sequence
  chemically synthesized
cattcggagaaatgcatggt

SEQ ID NO: 142636 - DNA, 20 bp, Artificial Sequence
  chemically synthesized
tatacattcggagaaatgca

SEQ ID NO: 142637 - DNA, 20 bp, Artificial Sequence
  chemically synthesized
caacaacagatatacattcg

SEQ ID NO: 142638 - DNA, 20 bp, Artificial Sequence
  chemically synthesized
ctcaacaacagatatacatt

SEQ ID NO: 142639 - DNA, 20 bp, Artificial Sequence
  chemically synthesized
ccgaatgtatatctgttgtt

SEQ ID NO: 142640 - DNA, 20 bp, Artificial Sequence
  chemically synthesized
agtcatgcattgctcaacaa

SEQ ID NO: 142641 - DNA, 20 bp, Artificial Sequence
  chemically synthesized
catgatttcacaggggtata

SEQ ID NO: 142642 - DNA, 20 bp, Artificial Sequence
  chemically synthesized
ttctggacatgatttcacag

SEQ ID NO: 142643 - DNA, 20 bp, Artificial Sequence
  chemically synthesized
attctggacatgatttcaca

SEQ ID NO: 142644 - DNA, 20 bp, Artificial Sequence
  chemically synthesized
gattctggacatgatttcac

SEQ ID NO: 142645 - DNA, 20 bp, Artificial Sequence
  chemically synthesized
agattctggacatgatttca

SEQ ID NO: 142646 - DNA, 20 bp, Artificial Sequence
  chemically synthesized
tacccctgtgaaatcatgtc

SEQ ID NO: 142647 - DNA, 20 bp, Artificial Sequence
  chemically synthesized
taggtttatggcatagattc

SEQ ID NO: 142648 - DNA, 20 bp, Artificial Sequence
  chemically synthesized
tgatgcataggtttatggca

SEQ ID NO: 142649 - DNA, 20 bp, Artificial Sequence
  chemically synthesized
ggaggtgatgcataggttta

SEQ ID NO: 142650 - DNA, 20 bp, Artificial Sequence
  chemically synthesized
aaattttggaggtgatgcat

SEQ ID NO: 142651 - DNA, 20 bp, Artificial Sequence
  chemically synthesized
aaaattttggaggtgatgca

SEQ ID NO: 142652 - DNA, 20 bp, Artificial Sequence
  chemically synthesized
aggtaagagaaaaattttgg

SEQ ID NO: 142653 - DNA, 20 bp, Artificial Sequence
  chemically synthesized
aaggtaagagaaaaattttg

SEQ ID NO: 142654 - DNA, 20 bp, Artificial Sequence
  chemically synthesized
ggaaggtaagagaaaaattt

SEQ ID NO: 142655 - DNA, 20 bp, Artificial Sequence
  chemically synthesized
atagtaaataaggaaggtaa

SEQ ID NO: 142656 - DNA, 20 bp, Artificial Sequence
  chemically synthesized
taatagtaaataaggaaggt

SEQ ID NO: 142657 - DNA, 20 bp, Artificial Sequence
  chemically synthesized
aaaataatagtaaataagga

SEQ ID NO: 142658 - DNA, 20 bp, Artificial Sequence
  chemically synthesized
aaaaataatagtaaataagg

SEQ ID NO: 142659 - DNA, 20 bp, Artificial Sequence
  chemically synthesized
tgcaaaaataatagtaaata

SEQ ID NO: 142660 - DNA, 20 bp, Artificial Sequence
  chemically synthesized
atgcaaaaataatagtaaat

SEQ ID NO: 142661 - DNA, 20 bp, Artificial Sequence
  chemically synthesized
tatcgtacatgcaaaaataa

SEQ ID NO: 142662 - DNA, 20 bp, Artificial Sequence
  chemically synthesized
ttttgcatgtacgataataa

SEQ ID NO: 142663 - DNA, 20 bp, Artificial Sequence
  chemically synthesized
tttgcatgtacgataataac

SEQ ID NO: 142664 - DNA, 20 bp, Artificial Sequence
  chemically synthesized
acgataataacaggtaaaaa

SEQ ID NO: 142665 - DNA, 20 bp, Artificial Sequence
  chemically synthesized
taaaaaaagatttactctct

SEQ ID NO: 142666 - DNA, 20 bp, Artificial Sequence
  chemically synthesized
tatttaaaactttgctaaga

SEQ ID NO: 142667 - DNA, 20 bp, Artificial Sequence
  chemically synthesized
aaagatttactctcttagca

SEQ ID NO: 142668 - DNA, 20 bp, Artificial Sequence
  chemically synthesized
tatatttaaaactttgctaa

SEQ ID NO: 142669 - DNA, 20 bp, Artificial Sequence
  chemically synthesized
tttatatttaaaactttgct

SEQ ID NO: 142670 - DNA, 20 bp, Artificial Sequence
  chemically synthesized
tataaaacattgttaactac

SEQ ID NO: 142671 - DNA, 20 bp, Artificial Sequence
  chemically synthesized
acattgttaactacaagccc

SEQ ID NO: 142672 - DNA, 20 bp, Artificial Sequence
  chemically synthesized
tctgtacagcctagggcttg

SEQ ID NO: 142673 - DNA, 20 bp, Artificial Sequence
  chemically synthesized
cattgttaactacaagccct

SEQ ID NO: 142674 - DNA, 20 bp, Artificial Sequence
  chemically synthesized
ctacaaatctgtacagccta

SEQ ID NO: 142675 - DNA, 20 bp, Artificial Sequence
  chemically synthesized
cctacaaatctgtacagcct

SEQ ID NO: 142676 - DNA, 20 bp, Artificial Sequence
  chemically synthesized
actacaagccctaggctgta

SEQ ID NO: 142677 - DNA, 20 bp, Artificial Sequence
  chemically synthesized
tcctacaaatctgtacagcc

SEQ ID NO: 142678 - DNA, 20 bp, Artificial Sequence
  chemically synthesized
ataagtcctacaaatctgta

SEQ ID NO: 142679 - DNA, 20 bp, Artificial Sequence
  chemically synthesized
ccctaggctgtacagatttg

SEQ ID NO: 142680 - DNA, 20 bp, Artificial Sequence
  chemically synthesized
cctaggctgtacagatttgt

SEQ ID NO: 142681 - DNA, 20 bp, Artificial Sequence
  chemically synthesized
ttcagtcatatgagatgaat

SEQ ID NO: 142682 - DNA, 20 bp, Artificial Sequence
  chemically synthesized
taactaggtttcagtcatat

SEQ ID NO: 142683 - DNA, 20 bp, Artificial Sequence
  chemically synthesized
catctcatatgactgaaacc

SEQ ID NO: 142684 - DNA, 20 bp, Artificial Sequence
  chemically synthesized
aaaaaatactaactaggttt

SEQ ID NO: 142685 - DNA, 20 bp, Artificial Sequence
  chemically synthesized
tcatatgactgaaacctagt

SEQ ID NO: 142686 - DNA, 20 bp, Artificial Sequence
  chemically synthesized
aaaaaaaaaaaatactaact

SEQ ID NO: 142687 - DNA, 20 bp, Artificial Sequence
  chemically synthesized
aaaaaaaaaaaaatactaac

SEQ ID NO: 142688 - DNA, 20 bp, Artificial Sequence
  chemically synthesized
tttttttttttttttttttt

SEQ ID NO: 142689 - DNA, 20 bp, Artificial Sequence
  chemically synthesized
ttttttttttttttttgaga

SEQ ID NO: 142690 - DNA, 20 bp, Artificial Sequence
  chemically synthesized
ttttttttttttttgagatg

SEQ ID NO: 142691 - DNA, 20 bp, Artificial Sequence
  chemically synthesized
tccagcctgggcgacagagc

SEQ ID NO: 142692 - DNA, 20 bp, Artificial Sequence
  chemically synthesized
tggagtcttgctctgtcgcc

SEQ ID NO: 142693 - DNA, 20 bp, Artificial Sequence
  chemically synthesized
gcactccagcctgggcgaca

SEQ ID NO: 142694 - DNA, 20 bp, Artificial Sequence
  chemically synthesized
ggagtcttgctctgtcgccc

SEQ ID NO: 142695 - DNA, 20 bp, Artificial Sequence
  chemically synthesized
ctgcactccagcctgggcga

SEQ ID NO: 142696 - DNA, 20 bp, Artificial Sequence
  chemically synthesized
tcttgctctgtcgcccaggc

SEQ ID NO: 142697 - DNA, 20 bp, Artificial Sequence
  chemically synthesized
ttgctctgtcgcccaggctg

SEQ ID NO: 142698 - DNA, 20 bp, Artificial Sequence
  chemically synthesized
aggctactgcactccagcct

SEQ ID NO: 142699 - DNA, 20 bp, Artificial Sequence
  chemically synthesized
gaggctactgcactccagcc

SEQ ID NO: 142700 - DNA, 20 bp, Artificial Sequence
  chemically synthesized
ctgtcgcccaggctggagtg

SEQ ID NO: 142701 - DNA, 20 bp, Artificial Sequence
  chemically synthesized
ctcgggaggctactgcactc

SEQ ID NO: 142702 - DNA, 20 bp, Artificial Sequence
  chemically synthesized
tcgcccaggctggagtgcag

SEQ ID NO: 142703 - DNA, 20 bp, Artificial Sequence
  chemically synthesized
ctggagtgcagtagcctccc

SEQ ID NO: 142704 - DNA, 20 bp, Artificial Sequence
  chemically synthesized
gagtgcagtagcctcccgag

SEQ ID NO: 142705 - DNA, 20 bp, Artificial Sequence
  chemically synthesized
tgtggtcccagctactcggg

SEQ ID NO: 142706 - DNA, 20 bp, Artificial Sequence
  chemically synthesized
ctgtggtcccagctactcgg

SEQ ID NO: 142707 - DNA, 20 bp, Artificial Sequence
  chemically synthesized
gcagtagcctcccgagtagc

SEQ ID NO: 142708 - DNA, 20 bp, Artificial Sequence
  chemically synthesized
gcctgtggtcccagctactc

SEQ ID NO: 142709 - DNA, 20 bp, Artificial Sequence
  chemically synthesized
cagtagcctcccgagtagct

SEQ ID NO: 142710 - DNA, 20 bp, Artificial Sequence
  chemically synthesized
tgcctgtggtcccagctact

SEQ ID NO: 142711 - DNA, 20 bp, Artificial Sequence
  chemically synthesized
ctcccgagtagctgggacca

SEQ ID NO: 142712 - DNA, 20 bp, Artificial Sequence
  chemically synthesized
tcccgagtagctgggaccac

SEQ ID NO: 142713 - DNA, 20 bp, Artificial Sequence
  chemically synthesized
gtggtgggtgcctgtggtcc

SEQ ID NO: 142714 - DNA, 20 bp, Artificial Sequence
  chemically synthesized
ggcgtggtggtgggtgcctg

SEQ ID NO: 142715 - DNA, 20 bp, Artificial Sequence
  chemically synthesized
aattagccaggcgtggtggt

SEQ ID NO: 142716 - DNA, 20 bp, Artificial Sequence
  chemically synthesized
aaattagccaggcgtggtgg

SEQ ID NO: 142717 - DNA, 20 bp, Artificial Sequence
  chemically synthesized
caggcacccaccaccacgcc

SEQ ID NO: 142718 - DNA, 20 bp, Artificial Sequence
  chemically synthesized
aaaaaattagccaggcgtgg

SEQ ID NO: 142719 - DNA, 20 bp, Artificial Sequence
  chemically synthesized
tacaaaaaattagccaggcg

SEQ ID NO: 142720 - DNA, 20 bp, Artificial Sequence
  chemically synthesized
aaaaatacaaaaaattagcc

SEQ ID NO: 142721 - DNA, 20 bp, Artificial Sequence
  chemically synthesized
taaaaatacaaaaaattagc

SEQ ID NO: 142722 - DNA, 20 bp, Artificial Sequence
  chemically synthesized
ctactaaaaatacaaaaaat

SEQ ID NO: 142723 - DNA, 20 bp, Artificial Sequence
  chemically synthesized
tggctaattttttgtatttt

SEQ ID NO: 142724 - DNA, 20 bp, Artificial Sequence
  chemically synthesized
ctaattttttgtatttttag

SEQ ID NO: 142725 - DNA, 20 bp, Artificial Sequence
  chemically synthesized
aattttttgtatttttagta

SEQ ID NO: 142726 - DNA, 20 bp, Artificial Sequence
  chemically synthesized
ttgtatttttagtagagacg

SEQ ID NO: 142727 - DNA, 20 bp, Artificial Sequence
  chemically synthesized
gagacgtggtttcaccgtgt

SEQ ID NO: 142728 - DNA, 20 bp, Artificial Sequence
  chemically synthesized
cgtggtttcaccgtgttagc

SEQ ID NO: 142729 - DNA, 20 bp, Artificial Sequence
  chemically synthesized
tgagaccatcctggctaaca

SEQ ID NO: 142730 - DNA, 20 bp, Artificial Sequence
  chemically synthesized
gtggtttcaccgtgttagcc

SEQ ID NO: 142731 - DNA, 20 bp, Artificial Sequence
  chemically synthesized
tttcaccgtgttagccagga

SEQ ID NO: 142732 - DNA, 20 bp, Artificial Sequence
  chemically synthesized
tcagaagattgagaccatcc

SEQ ID NO: 142733 - DNA, 20 bp, Artificial Sequence
  chemically synthesized
gatcacgaggtcagaagatt

SEQ ID NO: 142734 - DNA, 20 bp, Artificial Sequence
  chemically synthesized
cgggcggatcacgaggtcag

SEQ ID NO: 142735 - DNA, 20 bp, Artificial Sequence
  chemically synthesized
aggcgggcggatcacgaggt

SEQ ID NO: 142736 - DNA, 20 bp, Artificial Sequence
  chemically synthesized
gatgaggcgggcggatcacg

SEQ ID NO: 142737 - DNA, 20 bp, Artificial Sequence
  chemically synthesized
ggatgaggcgggcggatcac

SEQ ID NO: 142738 - DNA, 20 bp, Artificial Sequence
  chemically synthesized
ctttgggaggatgaggcggg

SEQ ID NO: 142739 - DNA, 20 bp, Artificial Sequence
  chemically synthesized
gcactttgggaggatgaggc

SEQ ID NO: 142740 - DNA, 20 bp, Artificial Sequence
  chemically synthesized
agcactttgggaggatgagg

SEQ ID NO: 142741 - DNA, 20 bp, Artificial Sequence
  chemically synthesized
cccagcactttgggaggatg

SEQ ID NO: 142742 - DNA, 20 bp, Artificial Sequence
  chemically synthesized
tcccagcactttgggaggat

SEQ ID NO: 142743 - DNA, 20 bp, Artificial Sequence
  chemically synthesized
ccgcccgcctcatcctccca

SEQ ID NO: 142744 - DNA, 20 bp, Artificial Sequence
  chemically synthesized
tgtaatcccagcactttggg

SEQ ID NO: 142745 - DNA, 20 bp, Artificial Sequence
  chemically synthesized
ctgtaatcccagcactttgg

SEQ ID NO: 142746 - DNA, 20 bp, Artificial Sequence
  chemically synthesized
gcctcatcctcccaaagtgc

SEQ ID NO: 142747 - DNA, 20 bp, Artificial Sequence
  chemically synthesized
gcctgtaatcccagcacttt

SEQ ID NO: 142748 - DNA, 20 bp, Artificial Sequence
  chemically synthesized
cctcatcctcccaaagtgct

SEQ ID NO: 142749 - DNA, 20 bp, Artificial Sequence
  chemically synthesized
cgcctgtaatcccagcactt

SEQ ID NO: 142750 - DNA, 20 bp, Artificial Sequence
  chemically synthesized
ctcccaaagtgctgggatta

SEQ ID NO: 142751 - DNA, 20 bp, Artificial Sequence
  chemically synthesized
tcccaaagtgctgggattac

SEQ ID NO: 142752 - DNA, 20 bp, Artificial Sequence
  chemically synthesized
gtggctcacgcctgtaatcc

SEQ ID NO: 142753 - DNA, 20 bp, Artificial Sequence
  chemically synthesized
agtgctgggattacaggcgt

SEQ ID NO: 142754 - DNA, 20 bp, Artificial Sequence
  chemically synthesized
caggcgtgagccaccgcgcc

SEQ ID NO: 142755 - DNA, 20 bp, Artificial Sequence
  chemically synthesized
taactaggggccaggcgcgg

SEQ ID NO: 142756 - DNA, 20 bp, Artificial Sequence
  chemically synthesized
tactaactaggggccaggcg

SEQ ID NO: 142757 - DNA, 20 bp, Artificial Sequence
  chemically synthesized
gagccaccgcgcctggcccc

SEQ ID NO: 142758 - DNA, 20 bp, Artificial Sequence
  chemically synthesized
taagatactaactaggggcc

SEQ ID NO: 142759 - DNA, 20 bp, Artificial Sequence
  chemically synthesized
ttaagatactaactaggggc

SEQ ID NO: 142760 - DNA, 20 bp, Artificial Sequence
  chemically synthesized
caccgcgcctggcccctagt

SEQ ID NO: 142761 - DNA, 20 bp, Artificial Sequence
  chemically synthesized
agtattaagatactaactag

SEQ ID NO: 142762 - DNA, 20 bp, Artificial Sequence
  chemically synthesized
gagtattaagatactaacta

SEQ ID NO: 142763 - DNA, 20 bp, Artificial Sequence
  chemically synthesized
tgagtattaagatactaact

SEQ ID NO: 142764 - DNA, 20 bp, Artificial Sequence
  chemically synthesized
atgagtattaagatactaac

SEQ ID NO: 142765 - DNA, 20 bp, Artificial Sequence
  chemically synthesized
aatggaaaataatgagtatt

SEQ ID NO: 142766 - DNA, 20 bp, Artificial Sequence
  chemically synthesized
ccgttaaaatggaaaataat

SEQ ID NO: 142767 - DNA, 20 bp, Artificial Sequence
  chemically synthesized
ctcattattttccattttaa

SEQ ID NO: 142768 - DNA, 20 bp, Artificial Sequence
  chemically synthesized
gctgttttgtgccgttaaaa

SEQ ID NO: 142769 - DNA, 20 bp, Artificial Sequence
  chemically synthesized
tccattttaacggcacaaaa

SEQ ID NO: 142770 - DNA, 20 bp, Artificial Sequence
  chemically synthesized
tttaacggcacaaaacagct

SEQ ID NO: 142771 - DNA, 20 bp, Artificial Sequence
  chemically synthesized
cacaaaacagctgagattat

SEQ ID NO: 142772 - DNA, 20 bp, Artificial Sequence
  chemically synthesized
actcttgtctctcataatct

SEQ ID NO: 142773 - DNA, 20 bp, Artificial Sequence
  chemically synthesized
caaaacagctgagattatga

SEQ ID NO: 142774 - DNA, 20 bp, Artificial Sequence
  chemically synthesized
cagctgagattatgagagac

SEQ ID NO: 142775 - DNA, 20 bp, Artificial Sequence
  chemically synthesized
gctgagattatgagagacaa

SEQ ID NO: 142776 - DNA, 20 bp, Artificial Sequence
  chemically synthesized
gagattatgagagacaagag

SEQ ID NO: 142777 - DNA, 20 bp, Artificial Sequence
  chemically synthesized
acaagagtggttattcttat

SEQ ID NO: 142778 - DNA, 20 bp, Artificial Sequence
  chemically synthesized
ccttctatggttgttctaat

SEQ ID NO: 142779 - DNA, 20 bp, Artificial Sequence
  chemically synthesized
tattcttattagaacaacca

SEQ ID NO: 142780 - DNA, 20 bp, Artificial Sequence
  chemically synthesized
tcttattagaacaaccatag

SEQ ID NO: 142781 - DNA, 20 bp, Artificial Sequence
  chemically synthesized
cttattagaacaaccataga

SEQ ID NO: 142782 - DNA, 20 bp, Artificial Sequence
  chemically synthesized
tattagaacaaccatagaag

SEQ ID NO: 142783 - DNA, 20 bp, Artificial Sequence
  chemically synthesized
attagaacaaccatagaagg

SEQ ID NO: 142784 - DNA, 20 bp, Artificial Sequence
  chemically synthesized
tagatattgccctccttcta

SEQ ID NO: 142785 - DNA, 20 bp, Artificial Sequence
  chemically synthesized
ttagaacaaccatagaagga

SEQ ID NO: 142786 - DNA, 20 bp, Artificial Sequence
  chemically synthesized
agaaggagggcaatatctac

SEQ ID NO: 142787 - DNA, 20 bp, Artificial Sequence
  chemically synthesized
gagggcaatatctacaagtt

SEQ ID NO: 142788 - DNA, 20 bp, Artificial Sequence
  chemically synthesized
agggcaatatctacaagttt

SEQ ID NO: 142789 - DNA, 20 bp, Artificial Sequence
  chemically synthesized
caccccatggcccaaacttg

SEQ ID NO: 142790 - DNA, 20 bp, Artificial Sequence
  chemically synthesized
atatctacaagtttgggcca

SEQ ID NO: 142791 - DNA, 20 bp, Artificial Sequence
  chemically synthesized
tatctacaagtttgggccat

SEQ ID NO: 142792 - DNA, 20 bp, Artificial Sequence
  chemically synthesized
atctacaagtttgggccatg

SEQ ID NO: 142793 - DNA, 20 bp, Artificial Sequence
  chemically synthesized
tacaagtttgggccatgggg

SEQ ID NO: 142794 - DNA, 20 bp, Artificial Sequence
  chemically synthesized
ttcatagcagcaccacccca

SEQ ID NO: 142795 - DNA, 20 bp, Artificial Sequence
  chemically synthesized
tggggtggtgctgctatgaa

SEQ ID NO: 142796 - DNA, 20 bp, Artificial Sequence
  chemically synthesized
cattcgtagtctattcatag

SEQ ID NO: 142797 - DNA, 20 bp, Artificial Sequence
  chemically synthesized
ggccattcgtagtctattca

SEQ ID NO: 142798 - DNA, 20 bp, Artificial Sequence
  chemically synthesized
tgctatgaatagactacgaa

SEQ ID NO: 142799 - DNA, 20 bp, Artificial Sequence
  chemically synthesized
aatatttacatggccattcg

SEQ ID NO: 142800 - DNA, 20 bp, Artificial Sequence
  chemically synthesized
cacaaaccccaatatttaca

SEQ ID NO: 142801 - DNA, 20 bp, Artificial Sequence
  chemically synthesized
acgaatggccatgtaaatat

SEQ ID NO: 142802 - DNA, 20 bp, Artificial Sequence
  chemically synthesized
cgaatggccatgtaaatatt

SEQ ID NO: 142803 - DNA, 20 bp, Artificial Sequence
  chemically synthesized
gaatggccatgtaaatattg

SEQ ID NO: 142804 - DNA, 20 bp, Artificial Sequence
  chemically synthesized
aatattggggtttgtgacaa

SEQ ID NO: 142805 - DNA, 20 bp, Artificial Sequence
  chemically synthesized
ttggggtttgtgacaaaaga

SEQ ID NO: 142806 - DNA, 20 bp, Artificial Sequence
  chemically synthesized
tggggtttgtgacaaaagat

SEQ ID NO: 142807 - DNA, 20 bp, Artificial Sequence
  chemically synthesized
gtttgtgacaaaagatagga

SEQ ID NO: 142808 - DNA, 20 bp, Artificial Sequence
  chemically synthesized
aagataggaaagcctatctc

SEQ ID NO: 142809 - DNA, 20 bp, Artificial Sequence
  chemically synthesized
ttttttttccttcttgagat

SEQ ID NO: 142810 - DNA, 20 bp, Artificial Sequence
  chemically synthesized
ataggaaagcctatctcaag

SEQ ID NO: 142811 - DNA, 20 bp, Artificial Sequence
  chemically synthesized
cttttttttccttcttgaga

SEQ ID NO: 142812 - DNA, 20 bp, Artificial Sequence
  chemically synthesized
taggaaagcctatctcaaga

SEQ ID NO: 142813 - DNA, 20 bp, Artificial Sequence
  chemically synthesized
aacacttttttttccttctt

SEQ ID NO: 142814 - DNA, 20 bp, Artificial Sequence
  chemically synthesized
ctatctcaagaaggaaaaaa

SEQ ID NO: 142815 - DNA, 20 bp, Artificial Sequence
  chemically synthesized
gaaggaaaaaaaagtgttac

SEQ ID NO: 142816 - DNA, 20 bp, Artificial Sequence
  chemically synthesized
gaaaaaaaagtgttacaaga

SEQ ID NO: 142817 - DNA, 20 bp, Artificial Sequence
  chemically synthesized
aaaaaaaagtgttacaagaa

SEQ ID NO: 142818 - DNA, 20 bp, Artificial Sequence
  chemically synthesized
tgttacaagaaaggcaacat

SEQ ID NO: 142819 - DNA, 20 bp, Artificial Sequence
  chemically synthesized
acaagaaaggcaacattggt

SEQ ID NO: 142820 - DNA, 20 bp, Artificial Sequence
  chemically synthesized
caagaaaggcaacattggta

SEQ ID NO: 142821 - DNA, 20 bp, Artificial Sequence
  chemically synthesized
gaaaggcaacattggtaagg

SEQ ID NO: 142822 - DNA, 20 bp, Artificial Sequence
  chemically synthesized
aataacatgttttaaagatc

SEQ ID NO: 142823 - DNA, 20 bp, Artificial Sequence
  chemically synthesized
gtttagaataacatgtttta

SEQ ID NO: 142824 - DNA, 20 bp, Artificial Sequence
  chemically synthesized
ttaaaacatgttattctaaa

SEQ ID NO: 142825 - DNA, 20 bp, Artificial Sequence
  chemically synthesized
aacaagtaatatagtctgtt

SEQ ID NO: 142826 - DNA, 20 bp, Artificial Sequence
  chemically synthesized
aaacaagaaaacaagtaata

SEQ ID NO: 142827 - DNA, 20 bp, Artificial Sequence
  chemically synthesized
tgataatcaaacaagaaaac

SEQ ID NO: 142828 - DNA, 20 bp, Artificial Sequence
  chemically synthesized
tctagcaatgataatcaaac

SEQ ID NO: 142829 - DNA, 20 bp, Artificial Sequence
  chemically synthesized
tcttgtttgattatcattgc

SEQ ID NO: 142830 - DNA, 20 bp, Artificial Sequence
  chemically synthesized
ttgattatcattgctagaac

SEQ ID NO: 142831 - DNA, 20 bp, Artificial Sequence
  chemically synthesized
aataaaaacattaccagttc

SEQ ID NO: 142832 - DNA, 20 bp, Artificial Sequence
  chemically synthesized
ctgagcaataaaaacattac

SEQ ID NO: 142833 - DNA, 20 bp, Artificial Sequence
  chemically synthesized
ctggtaatgtttttattgct

SEQ ID NO: 142834 - DNA, 20 bp, Artificial Sequence
  chemically synthesized
ttcaagagaaagtatacact

SEQ ID NO: 142835 - DNA, 20 bp, Artificial Sequence
  chemically synthesized
aacccactgagttcaagaga

SEQ ID NO: 142836 - DNA, 20 bp, Artificial Sequence
  chemically synthesized
tgtatactttctcttgaact

SEQ ID NO: 142837 - DNA, 20 bp, Artificial Sequence
  chemically synthesized
aataaacccactgagttcaa

SEQ ID NO: 142838 - DNA, 20 bp, Artificial Sequence
  chemically synthesized
caaataaacccactgagttc

SEQ ID NO: 142839 - DNA, 20 bp, Artificial Sequence
  chemically synthesized
atactttctcttgaactcag

SEQ ID NO: 142840 - DNA, 20 bp, Artificial Sequence
  chemically synthesized
tactttctcttgaactcagt

SEQ ID NO: 142841 - DNA, 20 bp, Artificial Sequence
  chemically synthesized
aagacccaaataaacccact

SEQ ID NO: 142842 - DNA, 20 bp, Artificial Sequence
  chemically synthesized
ttgaactcagtgggtttatt

SEQ ID NO: 142843 - DNA, 20 bp, Artificial Sequence
  chemically synthesized
tgaactcagtgggtttattt

SEQ ID NO: 142844 - DNA, 20 bp, Artificial Sequence
  chemically synthesized
ttatttgggtcttaataatt

SEQ ID NO: 142845 - DNA, 20 bp, Artificial Sequence
  chemically synthesized
tttttatattctgaattatt

SEQ ID NO: 142846 - DNA, 20 bp, Artificial Sequence
  chemically synthesized
tatacgtggtattaggtcat

SEQ ID NO: 142847 - DNA, 20 bp, Artificial Sequence
  chemically synthesized
gcatcaatatacgtggtatt

SEQ ID NO: 142848 - DNA, 20 bp, Artificial Sequence
  chemically synthesized
agcatcaatatacgtggtat

SEQ ID NO: 142849 - DNA, 20 bp, Artificial Sequence
  chemically synthesized
tccgttagcatcaatatacg

SEQ ID NO: 142850 - DNA, 20 bp, Artificial Sequence
  chemically synthesized
accacgtatattgatgctaa

SEQ ID NO: 142851 - DNA, 20 bp, Artificial Sequence
  chemically synthesized
caaattctaaacatgtccgt

SEQ ID NO: 142852 - DNA, 20 bp, Artificial Sequence
  chemically synthesized
ttgatgctaacggacatgtt

SEQ ID NO: 142853 - DNA, 20 bp, Artificial Sequence
  chemically synthesized
cggacatgtttagaatttgt

SEQ ID NO: 142854 - DNA, 20 bp, Artificial Sequence
  chemically synthesized
tagaatttgtcagactatgt

SEQ ID NO: 142855 - DNA, 20 bp, Artificial Sequence
  chemically synthesized
aactttcataatagcttaca

SEQ ID NO: 142856 - DNA, 20 bp, Artificial Sequence
  chemically synthesized
gactatgtaagctattatga

SEQ ID NO: 142857 - DNA, 20 bp, Artificial Sequence
  chemically synthesized
gaaagcagtaactttcataa

SEQ ID NO: 142858 - DNA, 20 bp, Artificial Sequence
  chemically synthesized
tatgttggagaaagagaaag

SEQ ID NO: 142859 - DNA, 20 bp, Artificial Sequence
  chemically synthesized
ttttatgttggagaaagaga

SEQ ID NO: 142860 - DNA, 20 bp, Artificial Sequence
  chemically synthesized
atatttttatgttggagaaa

SEQ ID NO: 142861 - DNA, 20 bp, Artificial Sequence
  chemically synthesized
gaatatttttatgttggaga

SEQ ID NO: 142862 - DNA, 20 bp, Artificial Sequence
  chemically synthesized
ctctgaatatttttatgttg

SEQ ID NO: 142863 - DNA, 20 bp, Artificial Sequence
  chemically synthesized
gcctctgaatatttttatgt

SEQ ID NO: 142864 - DNA, 20 bp, Artificial Sequence
  chemically synthesized
ttctccaacataaaaatatt

SEQ ID NO: 142865 - DNA, 20 bp, Artificial Sequence
  chemically synthesized
ctccaacataaaaatattca

SEQ ID NO: 142866 - DNA, 20 bp, Artificial Sequence
  chemically synthesized
tccaacataaaaatattcag

SEQ ID NO: 142867 - DNA, 20 bp, Artificial Sequence
  chemically synthesized
aacataaaaatattcagagg

SEQ ID NO: 142868 - DNA, 20 bp, Artificial Sequence
  chemically synthesized
taaaaatattcagaggcaga

SEQ ID NO: 142869 - DNA, 20 bp, Artificial Sequence
  chemically synthesized
aatattcagaggcagaaaga

SEQ ID NO: 142870 - DNA, 20 bp, Artificial Sequence
  chemically synthesized
agaaagatagacatgaataa

SEQ ID NO: 142871 - DNA, 20 bp, Artificial Sequence
  chemically synthesized
aaagatagacatgaataata

SEQ ID NO: 142872 - DNA, 20 bp, Artificial Sequence
  chemically synthesized
gaaatcaaggaaataaaatg

SEQ ID NO: 142873 - DNA, 20 bp, Artificial Sequence
  chemically synthesized
cagaaatcaaggaaataaaa

SEQ ID NO: 142874 - DNA, 20 bp, Artificial Sequence
  chemically synthesized
taaatttgtttcagaaatca

SEQ ID NO: 142875 - DNA, 20 bp, Artificial Sequence
  chemically synthesized
ttaaatttgtttcagaaatc

SEQ ID NO: 142876 - DNA, 20 bp, Artificial Sequence
  chemically synthesized
agttctgtttaaatttgttt

SEQ ID NO: 142877 - DNA, 20 bp, Artificial Sequence
  chemically synthesized
atttctgaaacaaatttaaa

SEQ ID NO: 142878 - DNA, 20 bp, Artificial Sequence
  chemically synthesized
aaacaaatttaaacagaact

SEQ ID NO: 142879 - DNA, 20 bp, Artificial Sequence
  chemically synthesized
caaatttaaacagaactaag

SEQ ID NO: 142880 - DNA, 20 bp, Artificial Sequence
  chemically synthesized
tttaaacagaactaagaaga

SEQ ID NO: 142881 - DNA, 20 bp, Artificial Sequence
  chemically synthesized
ttaaacagaactaagaagac

SEQ ID NO: 142882 - DNA, 20 bp, Artificial Sequence
  chemically synthesized
tgattgttttcctgtcttct

SEQ ID NO: 142883 - DNA, 20 bp, Artificial Sequence
  chemically synthesized
gaaaacaatcacatcatatt

SEQ ID NO: 142884 - DNA, 20 bp, Artificial Sequence
  chemically synthesized
caatcacatcatatttagct

SEQ ID NO: 142885 - DNA, 20 bp, Artificial Sequence
  chemically synthesized
ggacataagcagttttaact

SEQ ID NO: 142886 - DNA, 20 bp, Artificial Sequence
  chemically synthesized
ttttcttctttggacataag

SEQ ID NO: 142887 - DNA, 20 bp, Artificial Sequence
  chemically synthesized
gttaaaactgcttatgtcca

SEQ ID NO: 142888 - DNA, 20 bp, Artificial Sequence
  chemically synthesized
catttttcttctttggacat

SEQ ID NO: 142889 - DNA, 20 bp, Artificial Sequence
  chemically synthesized
aaaactgcttatgtccaaag

SEQ ID NO: 142890 - DNA, 20 bp, Artificial Sequence
  chemically synthesized
taatgcacatttttcttctt

SEQ ID NO: 142891 - DNA, 20 bp, Artificial Sequence
  chemically synthesized
gaagaaaaatgtgcattatt

SEQ ID NO: 142892 - DNA, 20 bp, Artificial Sequence
  chemically synthesized
agaaaaatgtgcattattaa

SEQ ID NO: 142893 - DNA, 20 bp, Artificial Sequence
  chemically synthesized
gtgcattattaagagtatct

SEQ ID NO: 142894 - DNA, 20 bp, Artificial Sequence
  chemically synthesized
attattaagagtatcttggc

SEQ ID NO: 142895 - DNA, 20 bp, Artificial Sequence
  chemically synthesized
ggcagctggctatgctagcc

SEQ ID NO: 142896 - DNA, 20 bp, Artificial Sequence
  chemically synthesized
taagagtatcttggctagca

SEQ ID NO: 142897 - DNA, 20 bp, Artificial Sequence
  chemically synthesized
agtatcttggctagcatagc

SEQ ID NO: 142898 - DNA, 20 bp, Artificial Sequence
  chemically synthesized
ggataggcagctggctatgc

SEQ ID NO: 142899 - DNA, 20 bp, Artificial Sequence
  chemically synthesized
aagggtatcggataggcagc

SEQ ID NO: 142900 - DNA, 20 bp, Artificial Sequence
  chemically synthesized
aagaaagggtatcggatagg

SEQ ID NO: 142901 - DNA, 20 bp, Artificial Sequence
  chemically synthesized
ggaaagaaagggtatcggat

SEQ ID NO: 142902 - DNA, 20 bp, Artificial Sequence
  chemically synthesized
aggaaagaaagggtatcgga

SEQ ID NO: 142903 - DNA, 20 bp, Artificial Sequence
  chemically synthesized
aagaaggaaagaaagggtat

SEQ ID NO: 142904 - DNA, 20 bp, Artificial Sequence
  chemically synthesized
ttagctaagaaggaaagaaa

SEQ ID NO: 142905 - DNA, 20 bp, Artificial Sequence
  chemically synthesized
tttagctaagaaggaaagaa

SEQ ID NO: 142906 - DNA, 20 bp, Artificial Sequence
  chemically synthesized
ttttagctaagaaggaaaga

SEQ ID NO: 142907 - DNA, 20 bp, Artificial Sequence
  chemically synthesized
gataccctttctttccttct

SEQ ID NO: 142908 - DNA, 20 bp, Artificial Sequence
  chemically synthesized
atttttttagctaagaagga

SEQ ID NO: 142909 - DNA, 20 bp, Artificial Sequence
  chemically synthesized
ttggatttttttagctaaga

SEQ ID NO: 142910 - DNA, 20 bp, Artificial Sequence
  chemically synthesized
tttggatttttttagctaag

SEQ ID NO: 142911 - DNA, 20 bp, Artificial Sequence
  chemically synthesized
gaatttggatttttttagct

SEQ ID NO: 142912 - DNA, 20 bp, Artificial Sequence
  chemically synthesized
gaacagaatttggatttttt

SEQ ID NO: 142913 - DNA, 20 bp, Artificial Sequence
  chemically synthesized
ttgctagtctgaacagaatt

SEQ ID NO: 142914 - DNA, 20 bp, Artificial Sequence
  chemically synthesized
aaaaaaatccaaattctgtt

SEQ ID NO: 142915 - DNA, 20 bp, Artificial Sequence
  chemically synthesized
aatccaaattctgttcagac

SEQ ID NO: 142916 - DNA, 20 bp, Artificial Sequence
  chemically synthesized
taaaaccttgctagtctgaa

SEQ ID NO: 142917 - DNA, 20 bp, Artificial Sequence
  chemically synthesized
caaattctgttcagactagc

SEQ ID NO: 142918 - DNA, 20 bp, Artificial Sequence
  chemically synthesized
aaattctgttcagactagca

SEQ ID NO: 142919 - DNA, 20 bp, Artificial Sequence
  chemically synthesized
acttagttataaaaccttgc

SEQ ID NO: 142920 - DNA, 20 bp, Artificial Sequence
  chemically synthesized
actagcaaggttttataact

SEQ ID NO: 142921 - DNA, 20 bp, Artificial Sequence
  chemically synthesized
aaatgtgaaaattggtaact

SEQ ID NO: 142922 - DNA, 20 bp, Artificial Sequence
  chemically synthesized
ataattcaaaatgtgaaaat

SEQ ID NO: 142923 - DNA, 20 bp, Artificial Sequence
  chemically synthesized
ttttcacattttgaattatg

SEQ ID NO: 142924 - DNA, 20 bp, Artificial Sequence
  chemically synthesized
cacattttgaattatgaaga

SEQ ID NO: 142925 - DNA, 20 bp, Artificial Sequence
  chemically synthesized
aagaaagaaacacacctatt

SEQ ID NO: 142926 - DNA, 20 bp, Artificial Sequence
  chemically synthesized
attgagtgttttaactgaat

SEQ ID NO: 142927 - DNA, 20 bp, Artificial Sequence
  chemically synthesized
gattgagtgttttaactgaa

SEQ ID NO: 142928 - DNA, 20 bp, Artificial Sequence
  chemically synthesized
ctaaggatcttgggaggatt

SEQ ID NO: 142929 - DNA, 20 bp, Artificial Sequence
  chemically synthesized
ttaaaacactcaatcctccc

SEQ ID NO: 142930 - DNA, 20 bp, Artificial Sequence
  chemically synthesized
taacttctaaggatcttggg

SEQ ID NO: 142931 - DNA, 20 bp, Artificial Sequence
  chemically synthesized
ctaacttctaaggatcttgg

SEQ ID NO: 142932 - DNA, 20 bp, Artificial Sequence
  chemically synthesized
tcctaacttctaaggatctt

SEQ ID NO: 142933 - DNA, 20 bp, Artificial Sequence
  chemically synthesized
ctcaatcctcccaagatcct

SEQ ID NO: 142934 - DNA, 20 bp, Artificial Sequence
  chemically synthesized
ttcctaacttctaaggatct

SEQ ID NO: 142935 - DNA, 20 bp, Artificial Sequence
  chemically synthesized
aatcctcccaagatccttag

SEQ ID NO: 142936 - DNA, 20 bp, Artificial Sequence
  chemically synthesized
ctcccaagatccttagaagt

SEQ ID NO: 142937 - DNA, 20 bp, Artificial Sequence
  chemically synthesized
gtgaccattcctaacttcta

SEQ ID NO: 142938 - DNA, 20 bp, Artificial Sequence
  chemically synthesized
tcccaagatccttagaagtt

SEQ ID NO: 142939 - DNA, 20 bp, Artificial Sequence
  chemically synthesized
cgtgaccattcctaacttct

SEQ ID NO: 142940 - DNA, 20 bp, Artificial Sequence
  chemically synthesized
agatccttagaagttaggaa

SEQ ID NO: 142941 - DNA, 20 bp, Artificial Sequence
  chemically synthesized
atggtcacgtgacacatttc

SEQ ID NO: 142942 - DNA, 20 bp, Artificial Sequence
  chemically synthesized
tacttgaacagtgcattaac

SEQ ID NO: 142943 - DNA, 20 bp, Artificial Sequence
  chemically synthesized
ttctggttaatgcactgttc

SEQ ID NO: 142944 - DNA, 20 bp, Artificial Sequence
  chemically synthesized
tggttaatgcactgttcaag

SEQ ID NO: 142945 - DNA, 20 bp, Artificial Sequence
  chemically synthesized
cagaagagtttctacttgaa

SEQ ID NO: 142946 - DNA, 20 bp, Artificial Sequence
  chemically synthesized
caagtagaaactcttctgtg

SEQ ID NO: 142947 - DNA, 20 bp, Artificial Sequence
  chemically synthesized
tctggcagccccacacagaa

SEQ ID NO: 142948 - DNA, 20 bp, Artificial Sequence
  chemically synthesized
aagtagaaactcttctgtgt

SEQ ID NO: 142949 - DNA, 20 bp, Artificial Sequence
  chemically synthesized
agtagaaactcttctgtgtg

SEQ ID NO: 142950 - DNA, 20 bp, Artificial Sequence
  chemically synthesized
tttctggcagccccacacag

SEQ ID NO: 142951 - DNA, 20 bp, Artificial Sequence
  chemically synthesized
gcttttctggcagccccaca

SEQ ID NO: 142952 - DNA, 20 bp, Artificial Sequence
  chemically synthesized
actcttctgtgtggggctgc

SEQ ID NO: 142953 - DNA, 20 bp, Artificial Sequence
  chemically synthesized
tctgtgtggggctgccagaa

SEQ ID NO: 142954 - DNA, 20 bp, Artificial Sequence
  chemically synthesized
gaaaaccagtgcttttctgg

SEQ ID NO: 142955 - DNA, 20 bp, Artificial Sequence
  chemically synthesized
aaggaaaaccagtgcttttc

SEQ ID NO: 142956 - DNA, 20 bp, Artificial Sequence
  chemically synthesized
tggggctgccagaaaagcac

SEQ ID NO: 142957 - DNA, 20 bp, Artificial Sequence
  chemically synthesized
ctcctgtttgtaaggaaaac

SEQ ID NO: 142958 - DNA, 20 bp, Artificial Sequence
  chemically synthesized
gcactggttttccttacaaa

SEQ ID NO: 142959 - DNA, 20 bp, Artificial Sequence
  chemically synthesized
cactggttttccttacaaac

SEQ ID NO: 142960 - DNA, 20 bp, Artificial Sequence
  chemically synthesized
tgtgtcagctcctgtttgta

SEQ ID NO: 142961 - DNA, 20 bp, Artificial Sequence
  chemically synthesized
ctgtgtcagctcctgtttgt

SEQ ID NO: 142962 - DNA, 20 bp, Artificial Sequence
  chemically synthesized
ctggttttccttacaaacag

SEQ ID NO: 142963 - DNA, 20 bp, Artificial Sequence
  chemically synthesized
cttacaaacaggagctgaca

SEQ ID NO: 142964 - DNA, 20 bp, Artificial Sequence
  chemically synthesized
caaacaggagctgacacagc

SEQ ID NO: 142965 - DNA, 20 bp, Artificial Sequence
  chemically synthesized
aaagcatattccagctgtgt

SEQ ID NO: 142966 - DNA, 20 bp, Artificial Sequence
  chemically synthesized
gggaaagtaaaagcatattc

SEQ ID NO: 142967 - DNA, 20 bp, Artificial Sequence
  chemically synthesized
agggaaaatggggaaagtaa

SEQ ID NO: 142968 - DNA, 20 bp, Artificial Sequence
  chemically synthesized
ggaagaagggaaaatgggga

SEQ ID NO: 142969 - DNA, 20 bp, Artificial Sequence
  chemically synthesized
aaatggaagaagggaaaatg

SEQ ID NO: 142970 - DNA, 20 bp, Artificial Sequence
  chemically synthesized
aaaatggaagaagggaaaat

SEQ ID NO: 142971 - DNA, 20 bp, Artificial Sequence
  chemically synthesized
taaaatggaagaagggaaaa

SEQ ID NO: 142972 - DNA, 20 bp, Artificial Sequence
  chemically synthesized
tgtactttaaaatggaagaa

SEQ ID NO: 142973 - DNA, 20 bp, Artificial Sequence
  chemically synthesized
ctgtactttaaaatggaaga

SEQ ID NO: 142974 - DNA, 20 bp, Artificial Sequence
  chemically synthesized
tctgtactttaaaatggaag

SEQ ID NO: 142975 - DNA, 20 bp, Artificial Sequence
  chemically synthesized
atgtctgtactttaaaatgg

SEQ ID NO: 142976 - DNA, 20 bp, Artificial Sequence
  chemically synthesized
ttttcccttcttccatttta

SEQ ID NO: 142977 - DNA, 20 bp, Artificial Sequence
  chemically synthesized
actatgtctgtactttaaaa

SEQ ID NO: 142978 - DNA, 20 bp, Artificial Sequence
  chemically synthesized
ccttcttccattttaaagta

SEQ ID NO: 142979 - DNA, 20 bp, Artificial Sequence
  chemically synthesized
tccattttaaagtacagaca

SEQ ID NO: 142980 - DNA, 20 bp, Artificial Sequence
  chemically synthesized
taaagtacagacatagtgcc

SEQ ID NO: 142981 - DNA, 20 bp, Artificial Sequence
  chemically synthesized
aagtacagacatagtgcctg

SEQ ID NO: 142982 - DNA, 20 bp, Artificial Sequence
  chemically synthesized
agtacagacatagtgcctgg

SEQ ID NO: 142983 - DNA, 20 bp, Artificial Sequence
  chemically synthesized
acagacatagtgcctggagg

SEQ ID NO: 142984 - DNA, 20 bp, Artificial Sequence
  chemically synthesized
agacatagtgcctggaggca

SEQ ID NO: 142985 - DNA, 20 bp, Artificial Sequence
  chemically synthesized
aacatggctactctgcctcc

SEQ ID NO: 142986 - DNA, 20 bp, Artificial Sequence
  chemically synthesized
caacatggctactctgcctc

SEQ ID NO: 142987 - DNA, 20 bp, Artificial Sequence
  chemically synthesized
catagtgcctggaggcagag

SEQ ID NO: 142988 - DNA, 20 bp, Artificial Sequence
  chemically synthesized
ggaggcagagtagccatgtt

SEQ ID NO: 142989 - DNA, 20 bp, Artificial Sequence
  chemically synthesized
tttttcctgtggtctcaaca

SEQ ID NO: 142990 - DNA, 20 bp, Artificial Sequence
  chemically synthesized
gagtagccatgttgagacca

SEQ ID NO: 142991 - DNA, 20 bp, Artificial Sequence
  chemically synthesized
agtagccatgttgagaccac

SEQ ID NO: 142992 - DNA, 20 bp, Artificial Sequence
  chemically synthesized
cagcaagactttttttcctg

SEQ ID NO: 142993 - DNA, 20 bp, Artificial Sequence
  chemically synthesized
tgttgagaccacaggaaaaa

SEQ ID NO: 142994 - DNA, 20 bp, Artificial Sequence
  chemically synthesized
cacaggaaaaaaagtcttgc

SEQ ID NO: 142995 - DNA, 20 bp, Artificial Sequence
  chemically synthesized
acaggaaaaaaagtcttgct

SEQ ID NO: 142996 - DNA, 20 bp, Artificial Sequence
  chemically synthesized
cgtgagccaccgtgcccagc

SEQ ID NO: 142997 - DNA, 20 bp, Artificial Sequence
  chemically synthesized
aaaaaaagtcttgctgggca

SEQ ID NO: 142998 - DNA, 20 bp, Artificial Sequence
  chemically synthesized
aaaagtcttgctgggcacgg

SEQ ID NO: 142999 - DNA, 20 bp, Artificial Sequence
  chemically synthesized
caggcgtgagccaccgtgcc

SEQ ID NO: 143000 - DNA, 20 bp, Artificial Sequence
  chemically synthesized
agtggtgggattacaggcgt

SEQ ID NO: 143001 - DNA, 20 bp, Artificial Sequence
  chemically synthesized
tcccaaagtggtgggattac

SEQ ID NO: 143002 - DNA, 20 bp, Artificial Sequence
  chemically synthesized
ctcccaaagtggtgggatta

SEQ ID NO: 143003 - DNA, 20 bp, Artificial Sequence
  chemically synthesized
cgcctgtaatcccaccactt

SEQ ID NO: 143004 - DNA, 20 bp, Artificial Sequence
  chemically synthesized
cctcagcctcccaaagtggt

SEQ ID NO: 143005 - DNA, 20 bp, Artificial Sequence
  chemically synthesized
gcctgtaatcccaccacttt

SEQ ID NO: 143006 - DNA, 20 bp, Artificial Sequence
  chemically synthesized
gcctcagcctcccaaagtgg

SEQ ID NO: 143007 - DNA, 20 bp, Artificial Sequence
  chemically synthesized
ctgtaatcccaccactttgg

SEQ ID NO: 143008 - DNA, 20 bp, Artificial Sequence
  chemically synthesized
tgtaatcccaccactttggg

SEQ ID NO: 143009 - DNA, 20 bp, Artificial Sequence
  chemically synthesized
cctgcctcagcctcccaaag

SEQ ID NO: 143010 - DNA, 20 bp, Artificial Sequence
  chemically synthesized
ctgcctgcctcagcctccca

SEQ ID NO: 143011 - DNA, 20 bp, Artificial Sequence
  chemically synthesized
tcccaccactttgggaggct

SEQ ID NO: 143012 - DNA, 20 bp, Artificial Sequence
  chemically synthesized
cccaccactttgggaggctg

SEQ ID NO: 143013 - DNA, 20 bp, Artificial Sequence
  chemically synthesized
accactttgggaggctgagg

SEQ ID NO: 143014 - DNA, 20 bp, Artificial Sequence
  chemically synthesized
ccactttgggaggctgaggc

SEQ ID NO: 143015 - DNA, 20 bp, Artificial Sequence
  chemically synthesized
ctttgggaggctgaggcagg

SEQ ID NO: 143016 - DNA, 20 bp, Artificial Sequence
  chemically synthesized
acctcatgatctgcctgcct

SEQ ID NO: 143017 - DNA, 20 bp, Artificial Sequence
  chemically synthesized
ggctgaggcaggcagatcat

SEQ ID NO: 143018 - DNA, 20 bp, Artificial Sequence
  chemically synthesized
gctgaggcaggcagatcatg

SEQ ID NO: 143019 - DNA, 20 bp, Artificial Sequence
  chemically synthesized
aggcaggcagatcatgaggt

SEQ ID NO: 143020 - DNA, 20 bp, Artificial Sequence
  chemically synthesized
ggcaggcagatcatgaggtc

SEQ ID NO: 143021 - DNA, 20 bp, Artificial Sequence
  chemically synthesized
caggcagatcatgaggtcag

SEQ ID NO: 143022 - DNA, 20 bp, Artificial Sequence
  chemically synthesized
gatcatgaggtcaggagatc

SEQ ID NO: 143023 - DNA, 20 bp, Artificial Sequence
  chemically synthesized
tcaggagatcgagaccatcc

SEQ ID NO: 143024 - DNA, 20 bp, Artificial Sequence
  chemically synthesized
tttcaccatgttggccagga

SEQ ID NO: 143025 - DNA, 20 bp, Artificial Sequence
  chemically synthesized
ggggtttcaccatgttggcc

SEQ ID NO: 143026 - DNA, 20 bp, Artificial Sequence
  chemically synthesized
cgagaccatcctggccaaca

SEQ ID NO: 143027 - DNA, 20 bp, Artificial Sequence
  chemically synthesized
cggggtttcaccatgttggc

SEQ ID NO: 143028 - DNA, 20 bp, Artificial Sequence
  chemically synthesized
gagacggggtttcaccatgt

SEQ ID NO: 143029 - DNA, 20 bp, Artificial Sequence
  chemically synthesized
ttgtatttttagtagagacg

SEQ ID NO: 143030 - DNA, 20 bp, Artificial Sequence
  chemically synthesized
tttgtatttttagtagagac

SEQ ID NO: 143031 - DNA, 20 bp, Artificial Sequence
  chemically synthesized
ttttgtatttttagtagaga

SEQ ID NO: 143032 - DNA, 20 bp, Artificial Sequence
  chemically synthesized
taatttttgtatttttagta

SEQ ID NO: 143033 - DNA, 20 bp, Artificial Sequence
  chemically synthesized
gctaatttttgtatttttag

SEQ ID NO: 143034 - DNA, 20 bp, Artificial Sequence
  chemically synthesized
ccagctaatttttgtatttt

SEQ ID NO: 143035 - DNA, 20 bp, Artificial Sequence
  chemically synthesized
tctactaaaaatacaaaaat

SEQ ID NO: 143036 - DNA, 20 bp, Artificial Sequence
  chemically synthesized
ctaaaaatacaaaaattagc

SEQ ID NO: 143037 - DNA, 20 bp, Artificial Sequence
  chemically synthesized
taaaaatacaaaaattagct

SEQ ID NO: 143038 - DNA, 20 bp, Artificial Sequence
  chemically synthesized
atacaaaaattagctgggcg

SEQ ID NO: 143039 - DNA, 20 bp, Artificial Sequence
  chemically synthesized
caaaaattagctgggcgtgg

SEQ ID NO: 143040 - DNA, 20 bp, Artificial Sequence
  chemically synthesized
cgggaacgcaccaccacgcc

SEQ ID NO: 143041 - DNA, 20 bp, Artificial Sequence
  chemically synthesized
gtggtgcgttcccgtaatcc

SEQ ID NO: 143042 - DNA, 20 bp, Artificial Sequence
  chemically synthesized
tcctgagtagctgggattac

SEQ ID NO: 143043 - DNA, 20 bp, Artificial Sequence
  chemically synthesized
ctcctgagtagctgggatta

SEQ ID NO: 143044 - DNA, 20 bp, Artificial Sequence
  chemically synthesized
ttcccgtaatcccagctact

SEQ ID NO: 143045 - DNA, 20 bp, Artificial Sequence
  chemically synthesized
cctcagcctcctgagtagct

SEQ ID NO: 143046 - DNA, 20 bp, Artificial Sequence
  chemically synthesized
tcccgtaatcccagctactc

SEQ ID NO: 143047 - DNA, 20 bp, Artificial Sequence
  chemically synthesized
gcctcagcctcctgagtagc

SEQ ID NO: 143048 - DNA, 20 bp, Artificial Sequence
  chemically synthesized
ccgtaatcccagctactcag

SEQ ID NO: 143049 - DNA, 20 bp, Artificial Sequence
  chemically synthesized
cgtaatcccagctactcagg

SEQ ID NO: 143050 - DNA, 20 bp, Artificial Sequence
  chemically synthesized
tcctgcctcagcctcctgag

SEQ ID NO: 143051 - DNA, 20 bp, Artificial Sequence
  chemically synthesized
ttctcctgcctcagcctcct

SEQ ID NO: 143052 - DNA, 20 bp, Artificial Sequence
  chemically synthesized
tcccagctactcaggaggct

SEQ ID NO: 143053 - DNA, 20 bp, Artificial Sequence
  chemically synthesized
cccagctactcaggaggctg

SEQ ID NO: 143054 - DNA, 20 bp, Artificial Sequence
  chemically synthesized
agctactcaggaggctgagg

SEQ ID NO: 143055 - DNA, 20 bp, Artificial Sequence
  chemically synthesized
gctactcaggaggctgaggc

SEQ ID NO: 143056 - DNA, 20 bp, Artificial Sequence
  chemically synthesized
tactcaggaggctgaggcag

SEQ ID NO: 143057 - DNA, 20 bp, Artificial Sequence
  chemically synthesized
ttcaagggattctcctgcct

SEQ ID NO: 143058 - DNA, 20 bp, Artificial Sequence
  chemically synthesized
ggcaggagaatcccttgaac

SEQ ID NO: 143059 - DNA, 20 bp, Artificial Sequence
  chemically synthesized
gcaggagaatcccttgaacc

SEQ ID NO: 143060 - DNA, 20 bp, Artificial Sequence
  chemically synthesized
cctctgactccctggttcaa

SEQ ID NO: 143061 - DNA, 20 bp, Artificial Sequence
  chemically synthesized
caggagaatcccttgaacca

SEQ ID NO: 143062 - DNA, 20 bp, Artificial Sequence
  chemically synthesized
acctctgactccctggttca

SEQ ID NO: 143063 - DNA, 20 bp, Artificial Sequence
  chemically synthesized
aacctctgactccctggttc

SEQ ID NO: 143064 - DNA, 20 bp, Artificial Sequence
  chemically synthesized
ggagaatcccttgaaccagg

SEQ ID NO: 143065 - DNA, 20 bp, Artificial Sequence
  chemically synthesized
aatcccttgaaccagggagt

SEQ ID NO: 143066 - DNA, 20 bp, Artificial Sequence
  chemically synthesized
cactgcaacctctgactccc

SEQ ID NO: 143067 - DNA, 20 bp, Artificial Sequence
  chemically synthesized
tcccttgaaccagggagtca

SEQ ID NO: 143068 - DNA, 20 bp, Artificial Sequence
  chemically synthesized
cccttgaaccagggagtcag

SEQ ID NO: 143069 - DNA, 20 bp, Artificial Sequence
  chemically synthesized
aaccagggagtcagaggttg

SEQ ID NO: 143070 - DNA, 20 bp, Artificial Sequence
  chemically synthesized
agggagtcagaggttgcagt

SEQ ID NO: 143071 - DNA, 20 bp, Artificial Sequence
  chemically synthesized
gtcagaggttgcagtgagtc

SEQ ID NO: 143072 - DNA, 20 bp, Artificial Sequence
  chemically synthesized
gtcgccaggctggagtgcag

SEQ ID NO: 143073 - DNA, 20 bp, Artificial Sequence
  chemically synthesized
gagatcgcgccactgcactc

SEQ ID NO: 143074 - DNA, 20 bp, Artificial Sequence
  chemically synthesized
tctgtcgccaggctggagtg

SEQ ID NO: 143075 - DNA, 20 bp, Artificial Sequence
  chemically synthesized
cgcgccactgcactccagcc

SEQ ID NO: 143076 - DNA, 20 bp, Artificial Sequence
  chemically synthesized
gagtctctgtcgccaggctg

SEQ ID NO: 143077 - DNA, 20 bp, Artificial Sequence
  chemically synthesized
tggagtctctgtcgccaggc

SEQ ID NO: 143078 - DNA, 20 bp, Artificial Sequence
  chemically synthesized
actgcactccagcctggcga

SEQ ID NO: 143079 - DNA, 20 bp, Artificial Sequence
  chemically synthesized
tgcactccagcctggcgaca

SEQ ID NO: 143080 - DNA, 20 bp, Artificial Sequence
  chemically synthesized
gagatggagtctctgtcgcc

SEQ ID NO: 143081 - DNA, 20 bp, Artificial Sequence
  chemically synthesized
tgagatggagtctctgtcgc

SEQ ID NO: 143082 - DNA, 20 bp, Artificial Sequence
  chemically synthesized
tttgtttttgttttgagatg

SEQ ID NO: 143083 - DNA, 20 bp, Artificial Sequence
  chemically synthesized
tttttgtttttgttttgaga

SEQ ID NO: 143084 - DNA, 20 bp, Artificial Sequence
  chemically synthesized
tttgtttttgtttttgtttt

SEQ ID NO: 143085 - DNA, 20 bp, Artificial Sequence
  chemically synthesized
aaacaacaaaacaaaacaaa

SEQ ID NO: 143086 - DNA, 20 bp, Artificial Sequence
  chemically synthesized
aacaaaacaaaacaaaaaga

SEQ ID NO: 143087 - DNA, 20 bp, Artificial Sequence
  chemically synthesized
acaaaaagaaagtctcatgt

SEQ ID NO: 143088 - DNA, 20 bp, Artificial Sequence
  chemically synthesized
aaaaagaaagtctcatgttg

SEQ ID NO: 143089 - DNA, 20 bp, Artificial Sequence
  chemically synthesized
accccagtcatctccaacat

SEQ ID NO: 143090 - DNA, 20 bp, Artificial Sequence
  chemically synthesized
agtctcatgttggagatgac

SEQ ID NO: 143091 - DNA, 20 bp, Artificial Sequence
  chemically synthesized
gtctcatgttggagatgact

SEQ ID NO: 143092 - DNA, 20 bp, Artificial Sequence
  chemically synthesized
tctcatgttggagatgactg

SEQ ID NO: 143093 - DNA, 20 bp, Artificial Sequence
  chemically synthesized
atgttggagatgactggggt

SEQ ID NO: 143094 - DNA, 20 bp, Artificial Sequence
  chemically synthesized
gttggagatgactggggttg

SEQ ID NO: 143095 - DNA, 20 bp, Artificial Sequence
  chemically synthesized
ttggagatgactggggttgg

SEQ ID NO: 143096 - DNA, 20 bp, Artificial Sequence
  chemically synthesized
ccaactttttcctccaaccc

SEQ ID NO: 143097 - DNA, 20 bp, Artificial Sequence
  chemically synthesized
atgactggggttggaggaaa

SEQ ID NO: 143098 - DNA, 20 bp, Artificial Sequence
  chemically synthesized
ctggggttggaggaaaaagt

SEQ ID NO: 143099 - DNA, 20 bp, Artificial Sequence
  chemically synthesized
tggggttggaggaaaaagtt

SEQ ID NO: 143100 - DNA, 20 bp, Artificial Sequence
  chemically synthesized
gaggaaaaagttgggacata

SEQ ID NO: 143101 - DNA, 20 bp, Artificial Sequence
  chemically synthesized
aaagttgggacatacggttt

SEQ ID NO: 143102 - DNA, 20 bp, Artificial Sequence
  chemically synthesized
agttgggacatacggttttg

SEQ ID NO: 143103 - DNA, 20 bp, Artificial Sequence
  chemically synthesized
gttgggacatacggttttgg

SEQ ID NO: 143104 - DNA, 20 bp, Artificial Sequence
  chemically synthesized
tatgtgttccagggtcagtg

SEQ ID NO: 143105 - DNA, 20 bp, Artificial Sequence
  chemically synthesized
tggaggtgctgcactgaccc

SEQ ID NO: 143106 - DNA, 20 bp, Artificial Sequence
  chemically synthesized
agaattatgtgttccagggt

SEQ ID NO: 143107 - DNA, 20 bp, Artificial Sequence
  chemically synthesized
ttccagaattatgtgttcca

SEQ ID NO: 143108 - DNA, 20 bp, Artificial Sequence
  chemically synthesized
cttccagaattatgtgttcc

SEQ ID NO: 143109 - DNA, 20 bp, Artificial Sequence
  chemically synthesized
acttccagaattatgtgttc

SEQ ID NO: 143110 - DNA, 20 bp, Artificial Sequence
  chemically synthesized
gaccctggaacacataattc

SEQ ID NO: 143111 - DNA, 20 bp, Artificial Sequence
  chemically synthesized
cctggaacacataattctgg

SEQ ID NO: 143112 - DNA, 20 bp, Artificial Sequence
  chemically synthesized
ttctcatagagcaagacttc

SEQ ID NO: 143113 - DNA, 20 bp, Artificial Sequence
  chemically synthesized
ttctggaagtcttgctctat

SEQ ID NO: 143114 - DNA, 20 bp, Artificial Sequence
  chemically synthesized
gtttctttttctcatagagc

SEQ ID NO: 143115 - DNA, 20 bp, Artificial Sequence
  chemically synthesized
gatagtttctttttctcata

SEQ ID NO: 143116 - DNA, 20 bp, Artificial Sequence
  chemically synthesized
aagtcttgctctatgagaaa

SEQ ID NO: 143117 - DNA, 20 bp, Artificial Sequence
  chemically synthesized
cagatagtttctttttctca

SEQ ID NO: 143118 - DNA, 20 bp, Artificial Sequence
  chemically synthesized
tatgagaaaaagaaactatc

SEQ ID NO: 143119 - DNA, 20 bp, Artificial Sequence
  chemically synthesized
gaaaaagaaactatctggat

SEQ ID NO: 143120 - DNA, 20 bp, Artificial Sequence
  chemically synthesized
actacagtggcttatccaga

SEQ ID NO: 143121 - DNA, 20 bp, Artificial Sequence
  chemically synthesized
tctcactacagtggcttatc

SEQ ID NO: 143122 - DNA, 20 bp, Artificial Sequence
  chemically synthesized
actatctggataagccactg

SEQ ID NO: 143123 - DNA, 20 bp, Artificial Sequence
  chemically synthesized
tctggataagccactgtagt

SEQ ID NO: 143124 - DNA, 20 bp, Artificial Sequence
  chemically synthesized
tgacagcattctcactacag

SEQ ID NO: 143125 - DNA, 20 bp, Artificial Sequence
  chemically synthesized
gcgtgacagcattctcacta

SEQ ID NO: 143126 - DNA, 20 bp, Artificial Sequence
  chemically synthesized
agtgagaatgctgtcacgca

SEQ ID NO: 143127 - DNA, 20 bp, Artificial Sequence
  chemically synthesized
ttgtgtttagctatgcgtga

SEQ ID NO: 143128 - DNA, 20 bp, Artificial Sequence
  chemically synthesized
tactctgttaagattgtgtt

SEQ ID NO: 143129 - DNA, 20 bp, Artificial Sequence
  chemically synthesized
atagctaaacacaatcttaa

SEQ ID NO: 143130 - DNA, 20 bp, Artificial Sequence
  chemically synthesized
agctaaacacaatcttaaca

SEQ ID NO: 143131 - DNA, 20 bp, Artificial Sequence
  chemically synthesized
tttttccagtttactctgtt

SEQ ID NO: 143132 - DNA, 20 bp, Artificial Sequence
  chemically synthesized
acaatcttaacagagtaaac

SEQ ID NO: 143133 - DNA, 20 bp, Artificial Sequence
  chemically synthesized
attaaaggattttttttttc

SEQ ID NO: 143134 - DNA, 20 bp, Artificial Sequence
  chemically synthesized
ctaagaattttagaaattaa

SEQ ID NO: 143135 - DNA, 20 bp, Artificial Sequence
  chemically synthesized
tctaagaattttagaaatta

SEQ ID NO: 143136 - DNA, 20 bp, Artificial Sequence
  chemically synthesized
cctttaatttctaaaattct

SEQ ID NO: 143137 - DNA, 20 bp, Artificial Sequence
  chemically synthesized
tttagacactctaagaattt

SEQ ID NO: 143138 - DNA, 20 bp, Artificial Sequence
  chemically synthesized
tttaatttctaaaattctta

SEQ ID NO: 143139 - DNA, 20 bp, Artificial Sequence
  chemically synthesized
atcataattttagacactct

SEQ ID NO: 143140 - DNA, 20 bp, Artificial Sequence
  chemically synthesized
tgcaaaaacaatcataattt

SEQ ID NO: 143141 - DNA, 20 bp, Artificial Sequence
  chemically synthesized
tgattgtttttgcatcgatg

SEQ ID NO: 143142 - DNA, 20 bp, Artificial Sequence
  chemically synthesized
gatgcagtaaatttaattct

SEQ ID NO: 143143 - DNA, 20 bp, Artificial Sequence
  chemically synthesized
atgcagtaaatttaattctc

SEQ ID NO: 143144 - DNA, 20 bp, Artificial Sequence
  chemically synthesized
gcagtaaatttaattctcag

SEQ ID NO: 143145 - DNA, 20 bp, Artificial Sequence
  chemically synthesized
atgatgaatgaaagtctcct

SEQ ID NO: 143146 - DNA, 20 bp, Artificial Sequence
  chemically synthesized
ttttggtcaatgatgaatga

SEQ ID NO: 143147 - DNA, 20 bp, Artificial Sequence
  chemically synthesized
cattcatcattgaccaaaac

SEQ ID NO: 143148 - DNA, 20 bp, Artificial Sequence
  chemically synthesized
atatgattcatgtcttgttt

SEQ ID NO: 143149 - DNA, 20 bp, Artificial Sequence
  chemically synthesized
atgaatcatattgcatttaa

SEQ ID NO: 143150 - DNA, 20 bp, Artificial Sequence
  chemically synthesized
tcatattgcatttaacagtt

SEQ ID NO: 143151 - DNA, 20 bp, Artificial Sequence
  chemically synthesized
gataaacatatatatgaata

SEQ ID NO: 143152 - DNA, 20 bp, Artificial Sequence
  chemically synthesized
gaatatgacaacattttata

SEQ ID NO: 143153 - DNA, 20 bp, Artificial Sequence
  chemically synthesized
tggaatatgacaacatttta

SEQ ID NO: 143154 - DNA, 20 bp, Artificial Sequence
  chemically synthesized
gttgtcatattccaaatact

SEQ ID NO: 143155 - DNA, 20 bp, Artificial Sequence
  chemically synthesized
tactagttttacttagtatt

SEQ ID NO: 143156 - DNA, 20 bp, Artificial Sequence
  chemically synthesized
cacagattactagttttact

SEQ ID NO: 143157 - DNA, 20 bp, Artificial Sequence
  chemically synthesized
ttccaaatactaagtaaaac

SEQ ID NO: 143158 - DNA, 20 bp, Artificial Sequence
  chemically synthesized
actttatcttcacagattac

SEQ ID NO: 143159 - DNA, 20 bp, Artificial Sequence
  chemically synthesized
agtaaaactagtaatctgtg

SEQ ID NO: 143160 - DNA, 20 bp, Artificial Sequence
  chemically synthesized
gttgatttactttatcttca

SEQ ID NO: 143161 - DNA, 20 bp, Artificial Sequence
  chemically synthesized
actagtaatctgtgaagata

SEQ ID NO: 143162 - DNA, 20 bp, Artificial Sequence
  chemically synthesized
gtaaatcaacaatatttata

SEQ ID NO: 143163 - DNA, 20 bp, Artificial Sequence
  chemically synthesized
aacaatatttataaagcacc

SEQ ID NO: 143164 - DNA, 20 bp, Artificial Sequence
  chemically synthesized
atagccgctaaagatgtact

SEQ ID NO: 143165 - DNA, 20 bp, Artificial Sequence
  chemically synthesized
catagccgctaaagatgtac

SEQ ID NO: 143166 - DNA, 20 bp, Artificial Sequence
  chemically synthesized
taaagcacctagtacatctt

SEQ ID NO: 143167 - DNA, 20 bp, Artificial Sequence
  chemically synthesized
agcacctagtacatctttag

SEQ ID NO: 143168 - DNA, 20 bp, Artificial Sequence
  chemically synthesized
tctatttgacatagccgcta

SEQ ID NO: 143169 - DNA, 20 bp, Artificial Sequence
  chemically synthesized
tctttagcggctatgtcaaa

SEQ ID NO: 143170 - DNA, 20 bp, Artificial Sequence
  chemically synthesized
gtgtaatattctatttgaca

SEQ ID NO: 143171 - DNA, 20 bp, Artificial Sequence
  chemically synthesized
gaatattacaccttccttta

SEQ ID NO: 143172 - DNA, 20 bp, Artificial Sequence
  chemically synthesized
tttaaatttcctgtaaagga

SEQ ID NO: 143173 - DNA, 20 bp, Artificial Sequence
  chemically synthesized
aatattacaccttcctttac

SEQ ID NO: 143174 - DNA, 20 bp, Artificial Sequence
  chemically synthesized
atttaaatttcctgtaaagg

SEQ ID NO: 143175 - DNA, 20 bp, Artificial Sequence
  chemically synthesized
taaatttaaatttcctgtaa

SEQ ID NO: 143176 - DNA, 20 bp, Artificial Sequence
  chemically synthesized
ataaatttaaatttcctgta

SEQ ID NO: 143177 - DNA, 20 bp, Artificial Sequence
  chemically synthesized
aggaaatttaaatttatttc

SEQ ID NO: 143178 - DNA, 20 bp, Artificial Sequence
  chemically synthesized
ggaaatttaaatttatttcg

SEQ ID NO: 143179 - DNA, 20 bp, Artificial Sequence
  chemically synthesized
tttaaatttatttcgaggac

SEQ ID NO: 143180 - DNA, 20 bp, Artificial Sequence
  chemically synthesized
ctttttagattgttattttc

SEQ ID NO: 143181 - DNA, 20 bp, Artificial Sequence
  chemically synthesized
ccagaaaataacaatctaaa

SEQ ID NO: 143182 - DNA, 20 bp, Artificial Sequence
  chemically synthesized
tatgttgtcatttgactttt

SEQ ID NO: 143183 - DNA, 20 bp, Artificial Sequence
  chemically synthesized
aatgacaacatacatttgaa

SEQ ID NO: 143184 - DNA, 20 bp, Artificial Sequence
  chemically synthesized
caacatacatttgaaaagaa

SEQ ID NO: 143185 - DNA, 20 bp, Artificial Sequence
  chemically synthesized
acatttgaaaagaaaagttc

SEQ ID NO: 143186 - DNA, 20 bp, Artificial Sequence
  chemically synthesized
aaaagaaaagttcaagacaa

SEQ ID NO: 143187 - DNA, 20 bp, Artificial Sequence
  chemically synthesized
agaaaagttcaagacaacag

SEQ ID NO: 143188 - DNA, 20 bp, Artificial Sequence
  chemically synthesized
aaagttcaagacaacagaag

SEQ ID NO: 143189 - DNA, 20 bp, Artificial Sequence
  chemically synthesized
gacaacagaagcagctttac

SEQ ID NO: 143190 - DNA, 20 bp, Artificial Sequence
  chemically synthesized
taactatatattttcttgta

SEQ ID NO: 143191 - DNA, 20 bp, Artificial Sequence
  chemically synthesized
cagctttacaagaaaatata

SEQ ID NO: 143192 - DNA, 20 bp, Artificial Sequence
  chemically synthesized
tacaagaaaatatatagtta

SEQ ID NO: 143193 - DNA, 20 bp, Artificial Sequence
  chemically synthesized
acaagaaaatatatagttaa

SEQ ID NO: 143194 - DNA, 20 bp, Artificial Sequence
  chemically synthesized
gttaaaggacaaaatgattt

SEQ ID NO: 143195 - DNA, 20 bp, Artificial Sequence
  chemically synthesized
ggtctttttcatcaatgatt

SEQ ID NO: 143196 - DNA, 20 bp, Artificial Sequence
  chemically synthesized
ggactgaatcattgatgaaa

SEQ ID NO: 143197 - DNA, 20 bp, Artificial Sequence
  chemically synthesized
gcccggctgccaatatgtat

SEQ ID NO: 143198 - DNA, 20 bp, Artificial Sequence
  chemically synthesized
tgaaaaagaccaatacatat

SEQ ID NO: 143199 - DNA, 20 bp, Artificial Sequence
  chemically synthesized
aaaagaccaatacatattgg

SEQ ID NO: 143200 - DNA, 20 bp, Artificial Sequence
  chemically synthesized
gaccaatacatattggcagc

SEQ ID NO: 143201 - DNA, 20 bp, Artificial Sequence
  chemically synthesized
accaatacatattggcagcc

SEQ ID NO: 143202 - DNA, 20 bp, Artificial Sequence
  chemically synthesized
tacatattggcagccgggca

SEQ ID NO: 143203 - DNA, 20 bp, Artificial Sequence
  chemically synthesized
atattggcagccgggcacgg

SEQ ID NO: 143204 - DNA, 20 bp, Artificial Sequence
  chemically synthesized
caggcgtgagccaccgtgcc

SEQ ID NO: 143205 - DNA, 20 bp, Artificial Sequence
  chemically synthesized
agtgcggggattacaggcgt

SEQ ID NO: 143206 - DNA, 20 bp, Artificial Sequence
  chemically synthesized
tcccaaagtgcggggattac

SEQ ID NO: 143207 - DNA, 20 bp, Artificial Sequence
  chemically synthesized
ctcccaaagtgcggggatta

SEQ ID NO: 143208 - DNA, 20 bp, Artificial Sequence
  chemically synthesized
cgcctgtaatccccgcactt

SEQ ID NO: 143209 - DNA, 20 bp, Artificial Sequence
  chemically synthesized
ccttggcctcccaaagtgcg

SEQ ID NO: 143210 - DNA, 20 bp, Artificial Sequence
  chemically synthesized
gcctgtaatccccgcacttt

SEQ ID NO: 143211 - DNA, 20 bp, Artificial Sequence
  chemically synthesized
gccttggcctcccaaagtgc

SEQ ID NO: 143212 - DNA, 20 bp, Artificial Sequence
  chemically synthesized
tgccttggcctcccaaagtg

SEQ ID NO: 143213 - DNA, 20 bp, Artificial Sequence
  chemically synthesized
ctgtaatccccgcactttgg

SEQ ID NO: 143214 - DNA, 20 bp, Artificial Sequence
  chemically synthesized
tgtaatccccgcactttggg

SEQ ID NO: 143215 - DNA, 20 bp, Artificial Sequence
  chemically synthesized
ccacctgccttggcctccca

SEQ ID NO: 143216 - DNA, 20 bp, Artificial Sequence
  chemically synthesized
tccccgcactttgggaggcc

SEQ ID NO: 143217 - DNA, 20 bp, Artificial Sequence
  chemically synthesized
ccccgcactttgggaggcca

SEQ ID NO: 143218 - DNA, 20 bp, Artificial Sequence
  chemically synthesized
cgcactttgggaggccaagg

SEQ ID NO: 143219 - DNA, 20 bp, Artificial Sequence
  chemically synthesized
gcactttgggaggccaaggc

SEQ ID NO: 143220 - DNA, 20 bp, Artificial Sequence
  chemically synthesized
ctttgggaggccaaggcagg

SEQ ID NO: 143221 - DNA, 20 bp, Artificial Sequence
  chemically synthesized
acctcatgatccacctgcct

SEQ ID NO: 143222 - DNA, 20 bp, Artificial Sequence
  chemically synthesized
ggccaaggcaggtggatcat

SEQ ID NO: 143223 - DNA, 20 bp, Artificial Sequence
  chemically synthesized
gccaaggcaggtggatcatg

SEQ ID NO: 143224 - DNA, 20 bp, Artificial Sequence
  chemically synthesized
aggcaggtggatcatgaggt

SEQ ID NO: 143225 - DNA, 20 bp, Artificial Sequence
  chemically synthesized
ggcaggtggatcatgaggtc

SEQ ID NO: 143226 - DNA, 20 bp, Artificial Sequence
  chemically synthesized
gatcatgaggtcaggtattt

SEQ ID NO: 143227 - DNA, 20 bp, Artificial Sequence
  chemically synthesized
tgaggtcaggtatttgagac

SEQ ID NO: 143228 - DNA, 20 bp, Artificial Sequence
  chemically synthesized
tcaggtatttgagaccagcc

SEQ ID NO: 143229 - DNA, 20 bp, Artificial Sequence
  chemically synthesized
tttcactatggtggccaggc

SEQ ID NO: 143230 - DNA, 20 bp, Artificial Sequence
  chemically synthesized
ggggtttcactatggtggcc

SEQ ID NO: 143231 - DNA, 20 bp, Artificial Sequence
  chemically synthesized
tgagaccagcctggccacca

SEQ ID NO: 143232 - DNA, 20 bp, Artificial Sequence
  chemically synthesized
tggggtttcactatggtggc

SEQ ID NO: 143233 - DNA, 20 bp, Artificial Sequence
  chemically synthesized
gagatggggtttcactatgg

SEQ ID NO: 143234 - DNA, 20 bp, Artificial Sequence
  chemically synthesized
gtagagatggggtttcacta

SEQ ID NO: 143235 - DNA, 20 bp, Artificial Sequence
  chemically synthesized
ttttatttttagtagagatg

SEQ ID NO: 143236 - DNA, 20 bp, Artificial Sequence
  chemically synthesized
tttttatttttagtagagat

SEQ ID NO: 143237 - DNA, 20 bp, Artificial Sequence
  chemically synthesized
ttttttatttttagtagaga

SEQ ID NO: 143238 - DNA, 20 bp, Artificial Sequence
  chemically synthesized
aattttttttatttttagta

SEQ ID NO: 143239 - DNA, 20 bp, Artificial Sequence
  chemically synthesized
ctaattttttttatttttag

SEQ ID NO: 143240 - DNA, 20 bp, Artificial Sequence
  chemically synthesized
cggctaattttttttatttt

SEQ ID NO: 143241 - DNA, 20 bp, Artificial Sequence
  chemically synthesized
ctactaaaaataaaaaaaat

SEQ ID NO: 143242 - DNA, 20 bp, Artificial Sequence
  chemically synthesized
taaaaataaaaaaaattagc

SEQ ID NO: 143243 - DNA, 20 bp, Artificial Sequence
  chemically synthesized
aaaaataaaaaaaattagcc

SEQ ID NO: 143244 - DNA, 20 bp, Artificial Sequence
  chemically synthesized
taaaaaaaattagccgggtg

SEQ ID NO: 143245 - DNA, 20 bp, Artificial Sequence
  chemically synthesized
aaaaaattagccgggtgtgg

SEQ ID NO: 143246 - DNA, 20 bp, Artificial Sequence
  chemically synthesized
caggcactcaccaccacacc

SEQ ID NO: 143247 - DNA, 20 bp, Artificial Sequence
  chemically synthesized
aattagccgggtgtggtggt

SEQ ID NO: 143248 - DNA, 20 bp, Artificial Sequence
  chemically synthesized
gtggtgagtgcctgtaatcc

SEQ ID NO: 143249 - DNA, 20 bp, Artificial Sequence
  chemically synthesized
tcctgagtagctgggattac

SEQ ID NO: 143250 - DNA, 20 bp, Artificial Sequence
  chemically synthesized
ctcctgagtagctgggatta

SEQ ID NO: 143251 - DNA, 20 bp, Artificial Sequence
  chemically synthesized
tgcctgtaatcccagctact

SEQ ID NO: 143252 - DNA, 20 bp, Artificial Sequence
  chemically synthesized
cttcagcctcctgagtagct

SEQ ID NO: 143253 - DNA, 20 bp, Artificial Sequence
  chemically synthesized
gcctgtaatcccagctactc

SEQ ID NO: 143254 - DNA, 20 bp, Artificial Sequence
  chemically synthesized
gcttcagcctcctgagtagc

SEQ ID NO: 143255 - DNA, 20 bp, Artificial Sequence
  chemically synthesized
ctgtaatcccagctactcag

SEQ ID NO: 143256 - DNA, 20 bp, Artificial Sequence
  chemically synthesized
tgtaatcccagctactcagg

SEQ ID NO: 143257 - DNA, 20 bp, Artificial Sequence
  chemically synthesized
tcctgcttcagcctcctgag

SEQ ID NO: 143258 - DNA, 20 bp, Artificial Sequence
  chemically synthesized
ttctcctgcttcagcctcct

SEQ ID NO: 143259 - DNA, 20 bp, Artificial Sequence
  chemically synthesized
cccagctactcaggaggctg

SEQ ID NO: 143260 - DNA, 20 bp, Artificial Sequence
  chemically synthesized
agctactcaggaggctgaag

SEQ ID NO: 143261 - DNA, 20 bp, Artificial Sequence
  chemically synthesized
gctactcaggaggctgaagc

SEQ ID NO: 143262 - DNA, 20 bp, Artificial Sequence
  chemically synthesized
tactcaggaggctgaagcag

SEQ ID NO: 143263 - DNA, 20 bp, Artificial Sequence
  chemically synthesized
ttcaagcgattctcctgctt

SEQ ID NO: 143264 - DNA, 20 bp, Artificial Sequence
  chemically synthesized
gcaggagaatcgcttgaacc

SEQ ID NO: 143265 - DNA, 20 bp, Artificial Sequence
  chemically synthesized
caggagaatcgcttgaacct

SEQ ID NO: 143266 - DNA, 20 bp, Artificial Sequence
  chemically synthesized
aacctccgccacctaggttc

SEQ ID NO: 143267 - DNA, 20 bp, Artificial Sequence
  chemically synthesized
gagaatcgcttgaacctagg

SEQ ID NO: 143268 - DNA, 20 bp, Artificial Sequence
  chemically synthesized
aatcgcttgaacctaggtgg

SEQ ID NO: 143269 - DNA, 20 bp, Artificial Sequence
  chemically synthesized
cactgcaacctccgccacct

SEQ ID NO: 143270 - DNA, 20 bp, Artificial Sequence
  chemically synthesized
tcgcttgaacctaggtggcg

SEQ ID NO: 143271 - DNA, 20 bp, Artificial Sequence
  chemically synthesized
tcactgcaacctccgccacc

SEQ ID NO: 143272 - DNA, 20 bp, Artificial Sequence
  chemically synthesized
cgcttgaacctaggtggcgg

SEQ ID NO: 143273 - DNA, 20 bp, Artificial Sequence
  chemically synthesized
aacctaggtggcggaggttg

SEQ ID NO: 143274 - DNA, 20 bp, Artificial Sequence
  chemically synthesized
taggtggcggaggttgcagt

SEQ ID NO: 143275 - DNA, 20 bp, Artificial Sequence
  chemically synthesized
ggcggaggttgcagtgagcc

SEQ ID NO: 143276 - DNA, 20 bp, Artificial Sequence
  chemically synthesized
ggagtgcagtggcacgatct

SEQ ID NO: 143277 - DNA, 20 bp, Artificial Sequence
  chemically synthesized
ttgcccgggctggagtgcag

SEQ ID NO: 143278 - DNA, 20 bp, Artificial Sequence
  chemically synthesized
gagatcgtgccactgcactc

SEQ ID NO: 143279 - DNA, 20 bp, Artificial Sequence
  chemically synthesized
ctgttgcccgggctggagtg

SEQ ID NO: 143280 - DNA, 20 bp, Artificial Sequence
  chemically synthesized
cgtgccactgcactccagcc

SEQ ID NO: 143281 - DNA, 20 bp, Artificial Sequence
  chemically synthesized
gtgccactgcactccagccc

SEQ ID NO: 143282 - DNA, 20 bp, Artificial Sequence
  chemically synthesized
tcgcactgttgcccgggctg

SEQ ID NO: 143283 - DNA, 20 bp, Artificial Sequence
  chemically synthesized
tctcgcactgttgcccgggc

SEQ ID NO: 143284 - DNA, 20 bp, Artificial Sequence
  chemically synthesized
ctgcactccagcccgggcaa

SEQ ID NO: 143285 - DNA, 20 bp, Artificial Sequence
  chemically synthesized
ggagtctcgcactgttgccc

SEQ ID NO: 143286 - DNA, 20 bp, Artificial Sequence
  chemically synthesized
tggagtctcgcactgttgcc

SEQ ID NO: 143287 - DNA, 20 bp, Artificial Sequence
  chemically synthesized
tccagcccgggcaacagtgc

SEQ ID NO: 143288 - DNA, 20 bp, Artificial Sequence
  chemically synthesized
tgttttgtttttttgagatg

SEQ ID NO: 143289 - DNA, 20 bp, Artificial Sequence
  chemically synthesized
tttgttttgtttttttgaga

SEQ ID NO: 143290 - DNA, 20 bp, Artificial Sequence
  chemically synthesized
tgtttttgttttgttttttt

SEQ ID NO: 143291 - DNA, 20 bp, Artificial Sequence
  chemically synthesized
caaaacaaaacaaaaacgac

SEQ ID NO: 143292 - DNA, 20 bp, Artificial Sequence
  chemically synthesized
ttgttaattccagtatgtac

SEQ ID NO: 143293 - DNA, 20 bp, Artificial Sequence
  chemically synthesized
caaaaacgaccagtacatac

SEQ ID NO: 143294 - DNA, 20 bp, Artificial Sequence
  chemically synthesized
aaaggttgttttgttaattc

SEQ ID NO: 143295 - DNA, 20 bp, Artificial Sequence
  chemically synthesized
aattaacaaaacaaccttta

SEQ ID NO: 143296 - DNA, 20 bp, Artificial Sequence
  chemically synthesized
tattcctgccttttctgtaa

SEQ ID NO: 143297 - DNA, 20 bp, Artificial Sequence
  chemically synthesized
acaaaacaacctttacagaa

SEQ ID NO: 143298 - DNA, 20 bp, Artificial Sequence
  chemically synthesized
ttattcctgccttttctgta

SEQ ID NO: 143299 - DNA, 20 bp, Artificial Sequence
  chemically synthesized
caaaacaacctttacagaaa

SEQ ID NO: 143300 - DNA, 20 bp, Artificial Sequence
  chemically synthesized
aacaacctttacagaaaagg

SEQ ID NO: 143301 - DNA, 20 bp, Artificial Sequence
  chemically synthesized
acaacctttacagaaaaggc

SEQ ID NO: 143302 - DNA, 20 bp, Artificial Sequence
  chemically synthesized
aaaggcaggaataaatctca

SEQ ID NO: 143303 - DNA, 20 bp, Artificial Sequence
  chemically synthesized
aaggcaggaataaatctcaa

SEQ ID NO: 143304 - DNA, 20 bp, Artificial Sequence
  chemically synthesized
tgtcacagcttgaagccttt

SEQ ID NO: 143305 - DNA, 20 bp, Artificial Sequence
  chemically synthesized
gaataaatctcaaaggcttc

SEQ ID NO: 143306 - DNA, 20 bp, Artificial Sequence
  chemically synthesized
gactggtatgtcacagcttg

SEQ ID NO: 143307 - DNA, 20 bp, Artificial Sequence
  chemically synthesized
tatagttgactggtatgtca

SEQ ID NO: 143308 - DNA, 20 bp, Artificial Sequence
  chemically synthesized
ggcttcaagctgtgacatac

SEQ ID NO: 143309 - DNA, 20 bp, Artificial Sequence
  chemically synthesized
ataatgattatatagttgac

SEQ ID NO: 143310 - DNA, 20 bp, Artificial Sequence
  chemically synthesized
tgattaatataatgattata

SEQ ID NO: 143311 - DNA, 20 bp, Artificial Sequence
  chemically synthesized
tcattatattaatcaacttt

SEQ ID NO: 143312 - DNA, 20 bp, Artificial Sequence
  chemically synthesized
cattatattaatcaacttta

SEQ ID NO: 143313 - DNA, 20 bp, Artificial Sequence
  chemically synthesized
ttatattaatcaactttaag

SEQ ID NO: 143314 - DNA, 20 bp, Artificial Sequence
  chemically synthesized
aggtttcttcacactcctta

SEQ ID NO: 143315 - DNA, 20 bp, Artificial Sequence
  chemically synthesized
aatcaactttaaggagtgtg

SEQ ID NO: 143316 - DNA, 20 bp, Artificial Sequence
  chemically synthesized
aaggagtgtgaagaaacctt

SEQ ID NO: 143317 - DNA, 20 bp, Artificial Sequence
  chemically synthesized
ttaaccataccaatgactta

SEQ ID NO: 143318 - DNA, 20 bp, Artificial Sequence
  chemically synthesized
gtgaagaaaccttaagtcat

SEQ ID NO: 143319 - DNA, 20 bp, Artificial Sequence
  chemically synthesized
attaaccataccaatgactt

SEQ ID NO: 143320 - DNA, 20 bp, Artificial Sequence
  chemically synthesized
gaaaccttaagtcattggta

SEQ ID NO: 143321 - DNA, 20 bp, Artificial Sequence
  chemically synthesized
tcattggtatggttaataat

SEQ ID NO: 143322 - DNA, 20 bp, Artificial Sequence
  chemically synthesized
gtatggttaataattggatt

SEQ ID NO: 143323 - DNA, 20 bp, Artificial Sequence
  chemically synthesized
ggttaataattggatttggt

SEQ ID NO: 143324 - DNA, 20 bp, Artificial Sequence
  chemically synthesized
catgcaaacattcaaggtgt

SEQ ID NO: 143325 - DNA, 20 bp, Artificial Sequence
  chemically synthesized
gaggaccatgcaaacattca

SEQ ID NO: 143326 - DNA, 20 bp, Artificial Sequence
  chemically synthesized
tgaggaccatgcaaacattc

SEQ ID NO: 143327 - DNA, 20 bp, Artificial Sequence
  chemically synthesized
tcacaccttgaatgtttgca

SEQ ID NO: 143328 - DNA, 20 bp, Artificial Sequence
  chemically synthesized
atttggaaactttgtaggtg

SEQ ID NO: 143329 - DNA, 20 bp, Artificial Sequence
  chemically synthesized
ttgcatggtcctcacctaca

SEQ ID NO: 143330 - DNA, 20 bp, Artificial Sequence
  chemically synthesized
catttggaaactttgtaggt

SEQ ID NO: 143331 - DNA, 20 bp, Artificial Sequence
  chemically synthesized
ttaacatttggaaactttgt

SEQ ID NO: 143332 - DNA, 20 bp, Artificial Sequence
  chemically synthesized
tttaacatttggaaactttg

SEQ ID NO: 143333 - DNA, 20 bp, Artificial Sequence
  chemically synthesized
atatattttattttaacatt

SEQ ID NO: 143334 - DNA, 20 bp, Artificial Sequence
  chemically synthesized
ataataaataaataaaaatg

SEQ ID NO: 143335 - DNA, 20 bp, Artificial Sequence
  chemically synthesized
aataataaataaataaaaat

SEQ ID NO: 143336 - DNA, 20 bp, Artificial Sequence
  chemically synthesized
tttttatttatttattattt

SEQ ID NO: 143337 - DNA, 20 bp, Artificial Sequence
  chemically synthesized
ttttatattttattcttttt

SEQ ID NO: 143338 - DNA, 20 bp, Artificial Sequence
  chemically synthesized
acaaaactccatttctaaaa

SEQ ID NO: 143339 - DNA, 20 bp, Artificial Sequence
  chemically synthesized
attttattcttttttagaaa

SEQ ID NO: 143340 - DNA, 20 bp, Artificial Sequence
  chemically synthesized
tttattcttttttagaaatg

SEQ ID NO: 143341 - DNA, 20 bp, Artificial Sequence
  chemically synthesized
tggagttttgttccattgcc

SEQ ID NO: 143342 - DNA, 20 bp, Artificial Sequence
  chemically synthesized
ggagttttgttccattgccc

SEQ ID NO: 143343 - DNA, 20 bp, Artificial Sequence
  chemically synthesized
ctggattccaacctgggcaa

SEQ ID NO: 143344 - DNA, 20 bp, Artificial Sequence
  chemically synthesized
ttttgttccattgcccaggt

SEQ ID NO: 143345 - DNA, 20 bp, Artificial Sequence
  chemically synthesized
gcgccactggattccaacct

SEQ ID NO: 143346 - DNA, 20 bp, Artificial Sequence
  chemically synthesized
agcgccactggattccaacc

SEQ ID NO: 143347 - DNA, 20 bp, Artificial Sequence
  chemically synthesized
ccattgcccaggttggaatc

SEQ ID NO: 143348 - DNA, 20 bp, Artificial Sequence
  chemically synthesized
ttgcccaggttggaatccag

SEQ ID NO: 143349 - DNA, 20 bp, Artificial Sequence
  chemically synthesized
gtgagctatgatagcgccac

SEQ ID NO: 143350 - DNA, 20 bp, Artificial Sequence
  chemically synthesized
ggaatccagtggcgctatca

SEQ ID NO: 143351 - DNA, 20 bp, Artificial Sequence
  chemically synthesized
gaggctgcagtgagctatga

SEQ ID NO: 143352 - DNA, 20 bp, Artificial Sequence
  chemically synthesized
ggcgctatcatagctcactg

SEQ ID NO: 143353 - DNA, 20 bp, Artificial Sequence
  chemically synthesized
caggagttcgaggctgcagt

SEQ ID NO: 143354 - DNA, 20 bp, Artificial Sequence
  chemically synthesized
ggcccaggagttcgaggctg

SEQ ID NO: 143355 - DNA, 20 bp, Artificial Sequence
  chemically synthesized
ctcttgggcccaggagttcg

SEQ ID NO: 143356 - DNA, 20 bp, Artificial Sequence
  chemically synthesized
tcactgcagcctcgaactcc

SEQ ID NO: 143357 - DNA, 20 bp, Artificial Sequence
  chemically synthesized
tctcttgggcccaggagttc

SEQ ID NO: 143358 - DNA, 20 bp, Artificial Sequence
  chemically synthesized
cactgcagcctcgaactcct

SEQ ID NO: 143359 - DNA, 20 bp, Artificial Sequence
  chemically synthesized
acatgatctcttgggcccag

SEQ ID NO: 143360 - DNA, 20 bp, Artificial Sequence
  chemically synthesized
agcctcgaactcctgggccc

SEQ ID NO: 143361 - DNA, 20 bp, Artificial Sequence
  chemically synthesized
tgacatgatctcttgggccc

SEQ ID NO: 143362 - DNA, 20 bp, Artificial Sequence
  chemically synthesized
cctcgaactcctgggcccaa

SEQ ID NO: 143363 - DNA, 20 bp, Artificial Sequence
  chemically synthesized
gtgacatgatctcttgggcc

SEQ ID NO: 143364 - DNA, 20 bp, Artificial Sequence
  chemically synthesized
ctgaggtgacatgatctctt

SEQ ID NO: 143365 - DNA, 20 bp, Artificial Sequence
  chemically synthesized
gctgaggtgacatgatctct

SEQ ID NO: 143366 - DNA, 20 bp, Artificial Sequence
  chemically synthesized
cccaagagatcatgtcacct

SEQ ID NO: 143367 - DNA, 20 bp, Artificial Sequence
  chemically synthesized
cttagctactcaggaggctg

SEQ ID NO: 143368 - DNA, 20 bp, Artificial Sequence
  chemically synthesized
ccttagctactcaggaggct

SEQ ID NO: 143369 - DNA, 20 bp, Artificial Sequence
  chemically synthesized
tcatgtcacctcagcctcct

SEQ ID NO: 143370 - DNA, 20 bp, Artificial Sequence
  chemically synthesized
tgtcacctcagcctcctgag

SEQ ID NO: 143371 - DNA, 20 bp, Artificial Sequence
  chemically synthesized
tgtagccttagctactcagg

SEQ ID NO: 143372 - DNA, 20 bp, Artificial Sequence
  chemically synthesized
ttgtagccttagctactcag

SEQ ID NO: 143373 - DNA, 20 bp, Artificial Sequence
  chemically synthesized
gcttgtagccttagctactc

SEQ ID NO: 143374 - DNA, 20 bp, Artificial Sequence
  chemically synthesized
cctcagcctcctgagtagct

SEQ ID NO: 143375 - DNA, 20 bp, Artificial Sequence
  chemically synthesized
ggcttgtagccttagctact

SEQ ID NO: 143376 - DNA, 20 bp, Artificial Sequence
  chemically synthesized
ctcagcctcctgagtagcta

SEQ ID NO: 143377 - DNA, 20 bp, Artificial Sequence
  chemically synthesized
tcctgagtagctaaggctac

SEQ ID NO: 143378 - DNA, 20 bp, Artificial Sequence
  chemically synthesized
atggtgtgggcttgtagcct

SEQ ID NO: 143379 - DNA, 20 bp, Artificial Sequence
  chemically synthesized
gctgtgatggtgtgggcttg

SEQ ID NO: 143380 - DNA, 20 bp, Artificial Sequence
  chemically synthesized
ttagctggctgtgatggtgt

SEQ ID NO: 143381 - DNA, 20 bp, Artificial Sequence
  chemically synthesized
gttagctggctgtgatggtg

SEQ ID NO: 143382 - DNA, 20 bp, Artificial Sequence
  chemically synthesized
gctacaagcccacaccatca

SEQ ID NO: 143383 - DNA, 20 bp, Artificial Sequence
  chemically synthesized
caagcccacaccatcacagc

SEQ ID NO: 143384 - DNA, 20 bp, Artificial Sequence
  chemically synthesized
aaaaagttagctggctgtga

SEQ ID NO: 143385 - DNA, 20 bp, Artificial Sequence
  chemically synthesized
aaatgaaataaaaagttagc

SEQ ID NO: 143386 - DNA, 20 bp, Artificial Sequence
  chemically synthesized
aaaaaaatgaaataaaaagt

SEQ ID NO: 143387 - DNA, 20 bp, Artificial Sequence
  chemically synthesized
ctacaaaaaaatgaaataaa

SEQ ID NO: 143388 - DNA, 20 bp, Artificial Sequence
  chemically synthesized
ctttttatttcatttttttg

SEQ ID NO: 143389 - DNA, 20 bp, Artificial Sequence
  chemically synthesized
ttttatttcatttttttgta

SEQ ID NO: 143390 - DNA, 20 bp, Artificial Sequence
  chemically synthesized
ttcatttttttgtagagatg

SEQ ID NO: 143391 - DNA, 20 bp, Artificial Sequence
  chemically synthesized
agcaacctgggcaacagagt

SEQ ID NO: 143392 - DNA, 20 bp, Artificial Sequence
  chemically synthesized
tgaagtctcactctgttgcc

SEQ ID NO: 143393 - DNA, 20 bp, Artificial Sequence
  chemically synthesized
caagagcaacctgggcaaca

SEQ ID NO: 143394 - DNA, 20 bp, Artificial Sequence
  chemically synthesized
gaagtctcactctgttgccc

SEQ ID NO: 143395 - DNA, 20 bp, Artificial Sequence
  chemically synthesized
ttcaagagcaacctgggcaa

SEQ ID NO: 143396 - DNA, 20 bp, Artificial Sequence
  chemically synthesized
cagaagttcaagagcaacct

SEQ ID NO: 143397 - DNA, 20 bp, Artificial Sequence
  chemically synthesized
ccagaagttcaagagcaacc

SEQ ID NO: 143398 - DNA, 20 bp, Artificial Sequence
  chemically synthesized
ccttgaggccagaagttcaa

SEQ ID NO: 143399 - DNA, 20 bp, Artificial Sequence
  chemically synthesized
ccaggttgctcttgaacttc

SEQ ID NO: 143400 - DNA, 20 bp, Artificial Sequence
  chemically synthesized
tcccttgaggccagaagttc

SEQ ID NO: 143401 - DNA, 20 bp, Artificial Sequence
  chemically synthesized
ggaggatcccttgaggccag

SEQ ID NO: 143402 - DNA, 20 bp, Artificial Sequence
  chemically synthesized
gctcttgaacttctggcctc

SEQ ID NO: 143403 - DNA, 20 bp, Artificial Sequence
  chemically synthesized
ctcttgaacttctggcctca

SEQ ID NO: 143404 - DNA, 20 bp, Artificial Sequence
  chemically synthesized
tcttgaacttctggcctcaa

SEQ ID NO: 143405 - DNA, 20 bp, Artificial Sequence
  chemically synthesized
gatggaggatcccttgaggc

SEQ ID NO: 143406 - DNA, 20 bp, Artificial Sequence
  chemically synthesized
ccaggatggaggatcccttg

SEQ ID NO: 143407 - DNA, 20 bp, Artificial Sequence
  chemically synthesized
gccaggatggaggatccctt

SEQ ID NO: 143408 - DNA, 20 bp, Artificial Sequence
  chemically synthesized
cctcaagggatcctccatcc

SEQ ID NO: 143409 - DNA, 20 bp, Artificial Sequence
  chemically synthesized
taatatcagtgccaggatgg

SEQ ID NO: 143410 - DNA, 20 bp, Artificial Sequence
  chemically synthesized
gtaatatcagtgccaggatg

SEQ ID NO: 143411 - DNA, 20 bp, Artificial Sequence
  chemically synthesized
ttgtaatatcagtgccagga

SEQ ID NO: 143412 - DNA, 20 bp, Artificial Sequence
  chemically synthesized
acacttgtaatatcagtgcc

SEQ ID NO: 143413 - DNA, 20 bp, Artificial Sequence
  chemically synthesized
cacacttgtaatatcagtgc

SEQ ID NO: 143414 - DNA, 20 bp, Artificial Sequence
  chemically synthesized
catcctggcactgatattac

SEQ ID NO: 143415 - DNA, 20 bp, Artificial Sequence
  chemically synthesized
atggctcacacttgtaatat

SEQ ID NO: 143416 - DNA, 20 bp, Artificial Sequence
  chemically synthesized
ggcactgatattacaagtgt

SEQ ID NO: 143417 - DNA, 20 bp, Artificial Sequence
  chemically synthesized
caagtgtgagccattgtgtc

SEQ ID NO: 143418 - DNA, 20 bp, Artificial Sequence
  chemically synthesized
gaggacgggtccagacacaa

SEQ ID NO: 143419 - DNA, 20 bp, Artificial Sequence
  chemically synthesized
aatgaaaatgaggacgggtc

SEQ ID NO: 143420 - DNA, 20 bp, Artificial Sequence
  chemically synthesized
ttctaaatgaaaatgaggac

SEQ ID NO: 143421 - DNA, 20 bp, Artificial Sequence
  chemically synthesized
tttctaaatgaaaatgagga

SEQ ID NO: 143422 - DNA, 20 bp, Artificial Sequence
  chemically synthesized
ttgttttctaaatgaaaatg

SEQ ID NO: 143423 - DNA, 20 bp, Artificial Sequence
  chemically synthesized
attgttttctaaatgaaaat

SEQ ID NO: 143424 - DNA, 20 bp, Artificial Sequence
  chemically synthesized
gacccgtcctcattttcatt

SEQ ID NO: 143425 - DNA, 20 bp, Artificial Sequence
  chemically synthesized
ctatatataatgagatttta

SEQ ID NO: 143426 - DNA, 20 bp, Artificial Sequence
  chemically synthesized
ggcaagaagctatatataat

SEQ ID NO: 143427 - DNA, 20 bp, Artificial Sequence
  chemically synthesized
ctgtaaaatctcattatata

SEQ ID NO: 143428 - DNA, 20 bp, Artificial Sequence
  chemically synthesized
aaagaatgcaagcaggcaag

SEQ ID NO: 143429 - DNA, 20 bp, Artificial Sequence
  chemically synthesized
tggaaagaatgcaagcaggc

SEQ ID NO: 143430 - DNA, 20 bp, Artificial Sequence
  chemically synthesized
tagttggaaagaatgcaagc

SEQ ID NO: 143431 - DNA, 20 bp, Artificial Sequence
  chemically synthesized
gtagttggaaagaatgcaag

SEQ ID NO: 143432 - DNA, 20 bp, Artificial Sequence
  chemically synthesized
tcagtagttggaaagaatgc

SEQ ID NO: 143433 - DNA, 20 bp, Artificial Sequence
  chemically synthesized
ggcaaagatcagtagttgga

SEQ ID NO: 143434 - DNA, 20 bp, Artificial Sequence
  chemically synthesized
tgggggcaaagatcagtagt

SEQ ID NO: 143435 - DNA, 20 bp, Artificial Sequence
  chemically synthesized
ttactgggggcaaagatcag

SEQ ID NO: 143436 - DNA, 20 bp, Artificial Sequence
  chemically synthesized
catttactgggggcaaagat

SEQ ID NO: 143437 - DNA, 20 bp, Artificial Sequence
  chemically synthesized
caactactgatctttgcccc

SEQ ID NO: 143438 - DNA, 20 bp, Artificial Sequence
  chemically synthesized
gaggacatttactgggggca

SEQ ID NO: 143439 - DNA, 20 bp, Artificial Sequence
  chemically synthesized
tagaagaggacatttactgg

SEQ ID NO: 143440 - DNA, 20 bp, Artificial Sequence
  chemically synthesized
ctagaagaggacatttactg

SEQ ID NO: 143441 - DNA, 20 bp, Artificial Sequence
  chemically synthesized
actagaagaggacatttact

SEQ ID NO: 143442 - DNA, 20 bp, Artificial Sequence
  chemically synthesized
cactagaagaggacatttac

SEQ ID NO: 143443 - DNA, 20 bp, Artificial Sequence
  chemically synthesized
ccccagtaaatgtcctcttc

SEQ ID NO: 143444 - DNA, 20 bp, Artificial Sequence
  chemically synthesized
tagatgttaggcactagaag

SEQ ID NO: 143445 - DNA, 20 bp, Artificial Sequence
  chemically synthesized
atagatgttaggcactagaa

SEQ ID NO: 143446 - DNA, 20 bp, Artificial Sequence
  chemically synthesized
taatagatgttaggcactag

SEQ ID NO: 143447 - DNA, 20 bp, Artificial Sequence
  chemically synthesized
atgtaatagatgttaggcac

SEQ ID NO: 143448 - DNA, 20 bp, Artificial Sequence
  chemically synthesized
taagttatgtaatagatgtt

SEQ ID NO: 143449 - DNA, 20 bp, Artificial Sequence
  chemically synthesized
ttaagttatgtaatagatgt

SEQ ID NO: 143450 - DNA, 20 bp, Artificial Sequence
  chemically synthesized
gatttttttaagttatgtaa

SEQ ID NO: 143451 - DNA, 20 bp, Artificial Sequence
  chemically synthesized
tactcaagtttgattttttt

SEQ ID NO: 143452 - DNA, 20 bp, Artificial Sequence
  chemically synthesized
aacttaaaaaaatcaaactt

SEQ ID NO: 143453 - DNA, 20 bp, Artificial Sequence
  chemically synthesized
taaaaaaatcaaacttgagt

SEQ ID NO: 143454 - DNA, 20 bp, Artificial Sequence
  chemically synthesized
ccactttaccacacttactc

SEQ ID NO: 143455 - DNA, 20 bp, Artificial Sequence
  chemically synthesized
aaatcaaacttgagtaagtg

SEQ ID NO: 143456 - DNA, 20 bp, Artificial Sequence
  chemically synthesized
aaacttgagtaagtgtggta

SEQ ID NO: 143457 - DNA, 20 bp, Artificial Sequence
  chemically synthesized
cttgagtaagtgtggtaaag

SEQ ID NO: 143458 - DNA, 20 bp, Artificial Sequence
  chemically synthesized
gagtaagtgtggtaaagtgg

SEQ ID NO: 143459 - DNA, 20 bp, Artificial Sequence
  chemically synthesized
agtaagtgtggtaaagtggc

SEQ ID NO: 143460 - DNA, 20 bp, Artificial Sequence
  chemically synthesized
gagaaattctacataaaaat

SEQ ID NO: 143461 - DNA, 20 bp, Artificial Sequence
  chemically synthesized
gtggcaggctaatttttatg

SEQ ID NO: 143462 - DNA, 20 bp, Artificial Sequence
  chemically synthesized
aatttttatgtagaatttct

SEQ ID NO: 143463 - DNA, 20 bp, Artificial Sequence
  chemically synthesized
tttttatgtagaatttctca

SEQ ID NO: 143464 - DNA, 20 bp, Artificial Sequence
  chemically synthesized
ttttatgtagaatttctcag

SEQ ID NO: 143465 - DNA, 20 bp, Artificial Sequence
  chemically synthesized
tttatgtagaatttctcaga

SEQ ID NO: 143466 - DNA, 20 bp, Artificial Sequence
  chemically synthesized
ttatgtagaatttctcagag

SEQ ID NO: 143467 - DNA, 20 bp, Artificial Sequence
  chemically synthesized
tagaatcagaagtcccctct

SEQ ID NO: 143468 - DNA, 20 bp, Artificial Sequence
  chemically synthesized
gcttccacagatagaatcag

SEQ ID NO: 143469 - DNA, 20 bp, Artificial Sequence
  chemically synthesized
aatgcttccacagatagaat

SEQ ID NO: 143470 - DNA, 20 bp, Artificial Sequence
  chemically synthesized
gggacttctgattctatctg

SEQ ID NO: 143471 - DNA, 20 bp, Artificial Sequence
  chemically synthesized
acttctgattctatctgtgg

SEQ ID NO: 143472 - DNA, 20 bp, Artificial Sequence
  chemically synthesized
taatgaaatgcttccacaga

SEQ ID NO: 143473 - DNA, 20 bp, Artificial Sequence
  chemically synthesized
aaagtaatgaaatgcttcca

SEQ ID NO: 143474 - DNA, 20 bp, Artificial Sequence
  chemically synthesized
tgtcatgttatattatacga

SEQ ID NO: 143475 - DNA, 20 bp, Artificial Sequence
  chemically synthesized
tttcgtataatataacatga

SEQ ID NO: 143476 - DNA, 20 bp, Artificial Sequence
  chemically synthesized
gtataatataacatgacaga

SEQ ID NO: 143477 - DNA, 20 bp, Artificial Sequence
  chemically synthesized
atataacatgacagaaagct

SEQ ID NO: 143478 - DNA, 20 bp, Artificial Sequence
  chemically synthesized
gtagcaacttcattgaggct

SEQ ID NO: 143479 - DNA, 20 bp, Artificial Sequence
  chemically synthesized
cagaaagcttagcctcaatg

SEQ ID NO: 143480 - DNA, 20 bp, Artificial Sequence
  chemically synthesized
aacctgtagcaacttcattg

SEQ ID NO: 143481 - DNA, 20 bp, Artificial Sequence
  chemically synthesized
taacctgtagcaacttcatt

SEQ ID NO: 143482 - DNA, 20 bp, Artificial Sequence
  chemically synthesized
tagcctcaatgaagttgcta

SEQ ID NO: 143483 - DNA, 20 bp, Artificial Sequence
  chemically synthesized
agcctcaatgaagttgctac

SEQ ID NO: 143484 - DNA, 20 bp, Artificial Sequence
  chemically synthesized
gtgagagggaaaataacctg

SEQ ID NO: 143485 - DNA, 20 bp, Artificial Sequence
  chemically synthesized
agaagtagattgtagtgaga

SEQ ID NO: 143486 - DNA, 20 bp, Artificial Sequence
  chemically synthesized
aagaagtagattgtagtgag

SEQ ID NO: 143487 - DNA, 20 bp, Artificial Sequence
  chemically synthesized
aaagaagtagattgtagtga

SEQ ID NO: 143488 - DNA, 20 bp, Artificial Sequence
  chemically synthesized
tgaaagaagtagattgtagt

SEQ ID NO: 143489 - DNA, 20 bp, Artificial Sequence
  chemically synthesized
aatgtgaaagaagtagattg

SEQ ID NO: 143490 - DNA, 20 bp, Artificial Sequence
  chemically synthesized
ttccctaaatgtgaaagaag

SEQ ID NO: 143491 - DNA, 20 bp, Artificial Sequence
  chemically synthesized
tttttccctaaatgtgaaag

SEQ ID NO: 143492 - DNA, 20 bp, Artificial Sequence
  chemically synthesized
caatctacttctttcacatt

SEQ ID NO: 143493 - DNA, 20 bp, Artificial Sequence
  chemically synthesized
tattttttccctaaatgtga

SEQ ID NO: 143494 - DNA, 20 bp, Artificial Sequence
  chemically synthesized
aatctacttctttcacattt

SEQ ID NO: 143495 - DNA, 20 bp, Artificial Sequence
  chemically synthesized
atctacttctttcacattta

SEQ ID NO: 143496 - DNA, 20 bp, Artificial Sequence
  chemically synthesized
tcacatttagggaaaaaata

SEQ ID NO: 143497 - DNA, 20 bp, Artificial Sequence
  chemically synthesized
cacatttagggaaaaaatat

SEQ ID NO: 143498 - DNA, 20 bp, Artificial Sequence
  chemically synthesized
tagggaaaaaatatgggatt

SEQ ID NO: 143499 - DNA, 20 bp, Artificial Sequence
  chemically synthesized
gggaaaaaatatgggattaa

SEQ ID NO: 143500 - DNA, 20 bp, Artificial Sequence
  chemically synthesized
aggagagagtaatttggaga

SEQ ID NO: 143501 - DNA, 20 bp, Artificial Sequence
  chemically synthesized
agaggagagagtaatttgga

SEQ ID NO: 143502 - DNA, 20 bp, Artificial Sequence
  chemically synthesized
ggagaggagagagtaatttg

SEQ ID NO: 143503 - DNA, 20 bp, Artificial Sequence
  chemically synthesized
gtggagaggagagagtaatt

SEQ ID NO: 143504 - DNA, 20 bp, Artificial Sequence
  chemically synthesized
ttaagaaagtggagaggaga

SEQ ID NO: 143505 - DNA, 20 bp, Artificial Sequence
  chemically synthesized
acttaagaaagtggagagga

SEQ ID NO: 143506 - DNA, 20 bp, Artificial Sequence
  chemically synthesized
atacttaagaaagtggagag

SEQ ID NO: 143507 - DNA, 20 bp, Artificial Sequence
  chemically synthesized
ctatacttaagaaagtggag

SEQ ID NO: 143508 - DNA, 20 bp, Artificial Sequence
  chemically synthesized
tctatacttaagaaagtgga

SEQ ID NO: 143509 - DNA, 20 bp, Artificial Sequence
  chemically synthesized
attctatacttaagaaagtg

SEQ ID NO: 143510 - DNA, 20 bp, Artificial Sequence
  chemically synthesized
tctctcctctccactttctt

SEQ ID NO: 143511 - DNA, 20 bp, Artificial Sequence
  chemically synthesized
tgattctatacttaagaaag

SEQ ID NO: 143512 - DNA, 20 bp, Artificial Sequence
  chemically synthesized
agttgattctatacttaaga

SEQ ID NO: 143513 - DNA, 20 bp, Artificial Sequence
  chemically synthesized
cctctccactttcttaagta

SEQ ID NO: 143514 - DNA, 20 bp, Artificial Sequence
  chemically synthesized
attgagttgattctatactt

SEQ ID NO: 143515 - DNA, 20 bp, Artificial Sequence
  chemically synthesized
caaaagcatatagataaatt

SEQ ID NO: 143516 - DNA, 20 bp, Artificial Sequence
  chemically synthesized
cgatttttgccaaaagcata

SEQ ID NO: 143517 - DNA, 20 bp, Artificial Sequence
  chemically synthesized
tcaatttatctatatgcttt

SEQ ID NO: 143518 - DNA, 20 bp, Artificial Sequence
  chemically synthesized
atgaagacgatttttgccaa

SEQ ID NO: 143519 - DNA, 20 bp, Artificial Sequence
  chemically synthesized
tttggcaaaaatcgtcttca

SEQ ID NO: 143520 - DNA, 20 bp, Artificial Sequence
  chemically synthesized
taaaaaaaattaaatccatg

SEQ ID NO: 143521 - DNA, 20 bp, Artificial Sequence
  chemically synthesized
atttaattttttttaatttc

SEQ ID NO: 143522 - DNA, 20 bp, Artificial Sequence
  chemically synthesized
ttttttttaatttctagttt

SEQ ID NO: 143523 - DNA, 20 bp, Artificial Sequence
  chemically synthesized
ttatttttgaacactcaaac

SEQ ID NO: 143524 - DNA, 20 bp, Artificial Sequence
  chemically synthesized
tgagtgttcaaaaataattc

SEQ ID NO: 143525 - DNA, 20 bp, Artificial Sequence
  chemically synthesized
agtgttcaaaaataattctg

SEQ ID NO: 143526 - DNA, 20 bp, Artificial Sequence
  chemically synthesized
agttaatctatgttcaactc

SEQ ID NO: 143527 - DNA, 20 bp, Artificial Sequence
  chemically synthesized
aataattctggagttgaaca

SEQ ID NO: 143528 - DNA, 20 bp, Artificial Sequence
  chemically synthesized
gaacatagattaacttgata

SEQ ID NO: 143529 - DNA, 20 bp, Artificial Sequence
  chemically synthesized
aacatagattaacttgatat

SEQ ID NO: 143530 - DNA, 20 bp, Artificial Sequence
  chemically synthesized
acatagattaacttgatatg

SEQ ID NO: 143531 - DNA, 20 bp, Artificial Sequence
  chemically synthesized
catagattaacttgatatgg

SEQ ID NO: 143532 - DNA, 20 bp, Artificial Sequence
  chemically synthesized
tgtaacccctcccccatatc

SEQ ID NO: 143533 - DNA, 20 bp, Artificial Sequence
  chemically synthesized
tagattaacttgatatgggg

SEQ ID NO: 143534 - DNA, 20 bp, Artificial Sequence
  chemically synthesized
agattaacttgatatggggg

SEQ ID NO: 143535 - DNA, 20 bp, Artificial Sequence
  chemically synthesized
gattaacttgatatggggga

SEQ ID NO: 143536 - DNA, 20 bp, Artificial Sequence
  chemically synthesized
attaacttgatatgggggag

SEQ ID NO: 143537 - DNA, 20 bp, Artificial Sequence
  chemically synthesized
atatgggggaggggttacat

SEQ ID NO: 143538 - DNA, 20 bp, Artificial Sequence
  chemically synthesized
aggggttacattggtcatta

SEQ ID NO: 143539 - DNA, 20 bp, Artificial Sequence
  chemically synthesized
tcttctctcttcaattatgg

SEQ ID NO: 143540 - DNA, 20 bp, Artificial Sequence
  chemically synthesized
ttattttgcttccataattg

SEQ ID NO: 143541 - DNA, 20 bp, Artificial Sequence
  chemically synthesized
tcatcttctctcttcaatta

SEQ ID NO: 143542 - DNA, 20 bp, Artificial Sequence
  chemically synthesized
attttgcttccataattgaa

SEQ ID NO: 143543 - DNA, 20 bp, Artificial Sequence
  chemically synthesized
tttgcttccataattgaaga

SEQ ID NO: 143544 - DNA, 20 bp, Artificial Sequence
  chemically synthesized
gcttccataattgaagagag

SEQ ID NO: 143545 - DNA, 20 bp, Artificial Sequence
  chemically synthesized
taattgaagagagaagatga

SEQ ID NO: 143546 - DNA, 20 bp, Artificial Sequence
  chemically synthesized
agaagatgacagttaaatca

SEQ ID NO: 143547 - DNA, 20 bp, Artificial Sequence
  chemically synthesized
tgtattatttatttcaagaa

SEQ ID NO: 143548 - DNA, 20 bp, Artificial Sequence
  chemically synthesized
tatactgtattatttatttc

SEQ ID NO: 143549 - DNA, 20 bp, Artificial Sequence
  chemically synthesized
tgttcttgaaataaataata

SEQ ID NO: 143550 - DNA, 20 bp, Artificial Sequence
  chemically synthesized
tcctatgatttattcaagaa

SEQ ID NO: 143551 - DNA, 20 bp, Artificial Sequence
  chemically synthesized
atatctcctatgatttattc

SEQ ID NO: 143552 - DNA, 20 bp, Artificial Sequence
  chemically synthesized
ttcttttcttgaataaatca

SEQ ID NO: 143553 - DNA, 20 bp, Artificial Sequence
  chemically synthesized
tcttttcttgaataaatcat

SEQ ID NO: 143554 - DNA, 20 bp, Artificial Sequence
  chemically synthesized
ttttcttgaataaatcatag

SEQ ID NO: 143555 - DNA, 20 bp, Artificial Sequence
  chemically synthesized
aaacaagtgacataatattt

SEQ ID NO: 143556 - DNA, 20 bp, Artificial Sequence
  chemically synthesized
tattatgtcacttgtttaca

SEQ ID NO: 143557 - DNA, 20 bp, Artificial Sequence
  chemically synthesized
attttatattctgtgtaaac

SEQ ID NO: 143558 - DNA, 20 bp, Artificial Sequence
  chemically synthesized
tacacagaatataaaatata

SEQ ID NO: 143559 - DNA, 20 bp, Artificial Sequence
  chemically synthesized
acacagaatataaaatataa

SEQ ID NO: 143560 - DNA, 20 bp, Artificial Sequence
  chemically synthesized
agaatataaaatataaaggt

SEQ ID NO: 143561 - DNA, 20 bp, Artificial Sequence
  chemically synthesized
gaatataaaatataaaggta

SEQ ID NO: 143562 - DNA, 20 bp, Artificial Sequence
  chemically synthesized
aatataaaatataaaggtaa

SEQ ID NO: 143563 - DNA, 20 bp, Artificial Sequence
  chemically synthesized
tataaaggtaagggaactga

SEQ ID NO: 143564 - DNA, 20 bp, Artificial Sequence
  chemically synthesized
tagtaattcacaaatgcttt

SEQ ID NO: 143565 - DNA, 20 bp, Artificial Sequence
  chemically synthesized
aataactttgaatacaattt

SEQ ID NO: 143566 - DNA, 20 bp, Artificial Sequence
  chemically synthesized
aattactaaaattgtattca

SEQ ID NO: 143567 - DNA, 20 bp, Artificial Sequence
  chemically synthesized
gttatttttataaatcgaat

SEQ ID NO: 143568 - DNA, 20 bp, Artificial Sequence
  chemically synthesized
cacggtttctaaaatgattt

SEQ ID NO: 143569 - DNA, 20 bp, Artificial Sequence
  chemically synthesized
gaaattgactcaaatcattt

SEQ ID NO: 143570 - DNA, 20 bp, Artificial Sequence
  chemically synthesized
tcaaatcattttagaaaccg

SEQ ID NO: 143571 - DNA, 20 bp, Artificial Sequence
  chemically synthesized
attcattaaaaataatgcca

SEQ ID NO: 143572 - DNA, 20 bp, Artificial Sequence
  chemically synthesized
ttgtgcttttatgattttta

SEQ ID NO: 143573 - DNA, 20 bp, Artificial Sequence
  chemically synthesized
gaattctttaaaaatcataa

SEQ ID NO: 143574 - DNA, 20 bp, Artificial Sequence
  chemically synthesized
tttgaaaaaaaaaaagcaac

SEQ ID NO: 143575 - DNA, 20 bp, Artificial Sequence
  chemically synthesized
ttttgaaaaaaaaaaagcaa

SEQ ID NO: 143576 - DNA, 20 bp, Artificial Sequence
  chemically synthesized
cattgtttttgaaaaaaaaa

SEQ ID NO: 143577 - DNA, 20 bp, Artificial Sequence
  chemically synthesized
tttttttttcaaaaacaatg

SEQ ID NO: 143578 - DNA, 20 bp, Artificial Sequence
  chemically synthesized
agtaatttccaaggtagtaa

SEQ ID NO: 143579 - DNA, 20 bp, Artificial Sequence
  chemically synthesized
caatgcagccattactacct

SEQ ID NO: 143580 - DNA, 20 bp, Artificial Sequence
  chemically synthesized
ttgatcagtaatttccaagg

SEQ ID NO: 143581 - DNA, 20 bp, Artificial Sequence
  chemically synthesized
gaattgatcagtaatttcca

SEQ ID NO: 143582 - DNA, 20 bp, Artificial Sequence
  chemically synthesized
tgaattgatcagtaatttcc

SEQ ID NO: 143583 - DNA, 20 bp, Artificial Sequence
  chemically synthesized
aatttcataaatgaattgat

SEQ ID NO: 143584 - DNA, 20 bp, Artificial Sequence
  chemically synthesized
attcaataacttgggagtga

SEQ ID NO: 143585 - DNA, 20 bp, Artificial Sequence
  chemically synthesized
aaaaatcaactttcactccc

SEQ ID NO: 143586 - DNA, 20 bp, Artificial Sequence
  chemically synthesized
atttttattcaataacttgg

SEQ ID NO: 143587 - DNA, 20 bp, Artificial Sequence
  chemically synthesized
tgatttttattcaataactt

SEQ ID NO: 143588 - DNA, 20 bp, Artificial Sequence
  chemically synthesized
ttgatttttattcaataact

SEQ ID NO: 143589 - DNA, 20 bp, Artificial Sequence
  chemically synthesized
gttattgaataaaaatcaac

SEQ ID NO: 143590 - DNA, 20 bp, Artificial Sequence
  chemically synthesized
ataaaaatcaacaagatccc

SEQ ID NO: 143591 - DNA, 20 bp, Artificial Sequence
  chemically synthesized
aaatcaacaagatccctgga

SEQ ID NO: 143592 - DNA, 20 bp, Artificial Sequence
  chemically synthesized
aagctatgtttatctttcca

SEQ ID NO: 143593 - DNA, 20 bp, Artificial Sequence
  chemically synthesized
taagctatgtttatctttcc

SEQ ID NO: 143594 - DNA, 20 bp, Artificial Sequence
  chemically synthesized
ttaagctatgtttatctttc

SEQ ID NO: 143595 - DNA, 20 bp, Artificial Sequence
  chemically synthesized
gatccctggaaagataaaca

SEQ ID NO: 143596 - DNA, 20 bp, Artificial Sequence
  chemically synthesized
ttttcatatagatgaaaatt

SEQ ID NO: 143597 - DNA, 20 bp, Artificial Sequence
  chemically synthesized
taattttcatctatatgaaa

SEQ ID NO: 143598 - DNA, 20 bp, Artificial Sequence
  chemically synthesized
atgtgcctgcctttttcata

SEQ ID NO: 143599 - DNA, 20 bp, Artificial Sequence
  chemically synthesized
aattttcatctatatgaaaa

SEQ ID NO: 143600 - DNA, 20 bp, Artificial Sequence
  chemically synthesized
tttcatctatatgaaaaagg

SEQ ID NO: 143601 - DNA, 20 bp, Artificial Sequence
  chemically synthesized
ttcatctatatgaaaaaggc

SEQ ID NO: 143602 - DNA, 20 bp, Artificial Sequence
  chemically synthesized
gaaaaaggcaggcacatatt

SEQ ID NO: 143603 - DNA, 20 bp, Artificial Sequence
  chemically synthesized
ggcaggcacatatttagaat

SEQ ID NO: 143604 - DNA, 20 bp, Artificial Sequence
  chemically synthesized
aataagaaatcacaattgat

SEQ ID NO: 143605 - DNA, 20 bp, Artificial Sequence
  chemically synthesized
ggtttcaatcatatatgtat

SEQ ID NO: 143606 - DNA, 20 bp, Artificial Sequence
  chemically synthesized
aaaagaaaaaagtgttatgg

SEQ ID NO: 143607 - DNA, 20 bp, Artificial Sequence
  chemically synthesized
cacaaaagaaaaaagtgtta

SEQ ID NO: 143608 - DNA, 20 bp, Artificial Sequence
  chemically synthesized
gtcatggccacaaaagaaaa

SEQ ID NO: 143609 - DNA, 20 bp, Artificial Sequence
  chemically synthesized
cataacacttttttcttttg

SEQ ID NO: 143610 - DNA, 20 bp, Artificial Sequence
  chemically synthesized
tagggcagtcatggccacaa

SEQ ID NO: 143611 - DNA, 20 bp, Artificial Sequence
  chemically synthesized
cataaaagatagggcagtca

SEQ ID NO: 143612 - DNA, 20 bp, Artificial Sequence
  chemically synthesized
gaaaaacataaaagataggg

SEQ ID NO: 143613 - DNA, 20 bp, Artificial Sequence
  chemically synthesized
taagaaaaacataaaagata

SEQ ID NO: 143614 - DNA, 20 bp, Artificial Sequence
  chemically synthesized
ataagaaaaacataaaagat

SEQ ID NO: 143615 - DNA, 20 bp, Artificial Sequence
  chemically synthesized
tataagaaaaacataaaaga

SEQ ID NO: 143616 - DNA, 20 bp, Artificial Sequence
  chemically synthesized
cctctataagaaaaacataa

SEQ ID NO: 143617 - DNA, 20 bp, Artificial Sequence
  chemically synthesized
tatcttttatgtttttctta

SEQ ID NO: 143618 - DNA, 20 bp, Artificial Sequence
  chemically synthesized
tcttttatgtttttcttata

SEQ ID NO: 143619 - DNA, 20 bp, Artificial Sequence
  chemically synthesized
cttttatgtttttcttatag

SEQ ID NO: 143620 - DNA, 20 bp, Artificial Sequence
  chemically synthesized
ttttagagtgtatcctctat

SEQ ID NO: 143621 - DNA, 20 bp, Artificial Sequence
  chemically synthesized
tagaggatacactctaaaat

SEQ ID NO: 143622 - DNA, 20 bp, Artificial Sequence
  chemically synthesized
agaggatacactctaaaatt

SEQ ID NO: 143623 - DNA, 20 bp, Artificial Sequence
  chemically synthesized
agggataggccctaatttta

SEQ ID NO: 143624 - DNA, 20 bp, Artificial Sequence
  chemically synthesized
gaggatacactctaaaatta

SEQ ID NO: 143625 - DNA, 20 bp, Artificial Sequence
  chemically synthesized
aaagggataggccctaattt

SEQ ID NO: 143626 - DNA, 20 bp, Artificial Sequence
  chemically synthesized
aacaaaaattaaaaagggat

SEQ ID NO: 143627 - DNA, 20 bp, Artificial Sequence
  chemically synthesized
gaacaaaaattaaaaaggga

SEQ ID NO: 143628 - DNA, 20 bp, Artificial Sequence
  chemically synthesized
tagggaacaaaaattaaaaa

SEQ ID NO: 143629 - DNA, 20 bp, Artificial Sequence
  chemically synthesized
ttagggaacaaaaattaaaa

SEQ ID NO: 143630 - DNA, 20 bp, Artificial Sequence
  chemically synthesized
cttagggaacaaaaattaaa

SEQ ID NO: 143631 - DNA, 20 bp, Artificial Sequence
  chemically synthesized
ctttttaatttttgttccct

SEQ ID NO: 143632 - DNA, 20 bp, Artificial Sequence
  chemically synthesized
ttttaatttttgttccctaa

SEQ ID NO: 143633 - DNA, 20 bp, Artificial Sequence
  chemically synthesized
taatttttgttccctaagag

SEQ ID NO: 143634 - DNA, 20 bp, Artificial Sequence
  chemically synthesized
atcagtgttatctgctctta

SEQ ID NO: 143635 - DNA, 20 bp, Artificial Sequence
  chemically synthesized
catcagtgttatctgctctt

SEQ ID NO: 143636 - DNA, 20 bp, Artificial Sequence
  chemically synthesized
gcatcagtgttatctgctct

SEQ ID NO: 143637 - DNA, 20 bp, Artificial Sequence
  chemically synthesized
cacttgctggtgaaaggcat

SEQ ID NO: 143638 - DNA, 20 bp, Artificial Sequence
  chemically synthesized
ataacactgatgcctttcac

SEQ ID NO: 143639 - DNA, 20 bp, Artificial Sequence
  chemically synthesized
attgaacacttgctggtgaa

SEQ ID NO: 143640 - DNA, 20 bp, Artificial Sequence
  chemically synthesized
tattgaacacttgctggtga

SEQ ID NO: 143641 - DNA, 20 bp, Artificial Sequence
  chemically synthesized
cactgatgcctttcaccagc

SEQ ID NO: 143642 - DNA, 20 bp, Artificial Sequence
  chemically synthesized
gttatttattgaacacttgc

SEQ ID NO: 143643 - DNA, 20 bp, Artificial Sequence
  chemically synthesized
agcaagtgttcaataaataa

SEQ ID NO: 143644 - DNA, 20 bp, Artificial Sequence
  chemically synthesized
ataacagatgaatgtaaact

SEQ ID NO: 143645 - DNA, 20 bp, Artificial Sequence
  chemically synthesized
agagcttttgatacaatact

SEQ ID NO: 143646 - DNA, 20 bp, Artificial Sequence
  chemically synthesized
taaactcagtattgtatcaa

SEQ ID NO: 143647 - DNA, 20 bp, Artificial Sequence
  chemically synthesized
attgtatcaaaagctcttaa

SEQ ID NO: 143648 - DNA, 20 bp, Artificial Sequence
  chemically synthesized
atatattgactgtcttttaa

SEQ ID NO: 143649 - DNA, 20 bp, Artificial Sequence
  chemically synthesized
tatcaaaagctcttaaaaga

SEQ ID NO: 143650 - DNA, 20 bp, Artificial Sequence
  chemically synthesized
aaatatattgactgtctttt

SEQ ID NO: 143651 - DNA, 20 bp, Artificial Sequence
  chemically synthesized
agacagtcaatatatttcta

SEQ ID NO: 143652 - DNA, 20 bp, Artificial Sequence
  chemically synthesized
acagtgtcataaagattctt

SEQ ID NO: 143653 - DNA, 20 bp, Artificial Sequence
  chemically synthesized
cctcgagttacagtgtcata

SEQ ID NO: 143654 - DNA, 20 bp, Artificial Sequence
  chemically synthesized
tctttatgacactgtaactc

SEQ ID NO: 143655 - DNA, 20 bp, Artificial Sequence
  chemically synthesized
ctttatgacactgtaactcg

SEQ ID NO: 143656 - DNA, 20 bp, Artificial Sequence
  chemically synthesized
acttttgatacctcgagtta

SEQ ID NO: 143657 - DNA, 20 bp, Artificial Sequence
  chemically synthesized
gtgcttacttttgatacctc

SEQ ID NO: 143658 - DNA, 20 bp, Artificial Sequence
  chemically synthesized
actgtaactcgaggtatcaa

SEQ ID NO: 143659 - DNA, 20 bp, Artificial Sequence
  chemically synthesized
taactcgaggtatcaaaagt

SEQ ID NO: 143660 - DNA, 20 bp, Artificial Sequence
  chemically synthesized
gtatcaaaagtaagcacttg

SEQ ID NO: 143661 - DNA, 20 bp, Artificial Sequence
  chemically synthesized
tatcaaaagtaagcacttga

SEQ ID NO: 143662 - DNA, 20 bp, Artificial Sequence
  chemically synthesized
tcaaaagtaagcacttgaag

SEQ ID NO: 143663 - DNA, 20 bp, Artificial Sequence
  chemically synthesized
caaaagtaagcacttgaagg

SEQ ID NO: 143664 - DNA, 20 bp, Artificial Sequence
  chemically synthesized
agtattttctttcctccttc

SEQ ID NO: 143665 - DNA, 20 bp, Artificial Sequence
  chemically synthesized
agtaagcacttgaaggagga

SEQ ID NO: 143666 - DNA, 20 bp, Artificial Sequence
  chemically synthesized
tgaaggaggaaagaaaatac

SEQ ID NO: 143667 - DNA, 20 bp, Artificial Sequence
  chemically synthesized
aggaggaaagaaaatactag

SEQ ID NO: 143668 - DNA, 20 bp, Artificial Sequence
  chemically synthesized
agtctgtaattaaatactac

SEQ ID NO: 143669 - DNA, 20 bp, Artificial Sequence
  chemically synthesized
atactagtagtatttaatta

SEQ ID NO: 143670 - DNA, 20 bp, Artificial Sequence
  chemically synthesized
acattaagtagatattttaa

SEQ ID NO: 143671 - DNA, 20 bp, Artificial Sequence
  chemically synthesized
aaattaacgtatacattaag

SEQ ID NO: 143672 - DNA, 20 bp, Artificial Sequence
  chemically synthesized
ataaaattaacgtatacatt

SEQ ID NO: 143673 - DNA, 20 bp, Artificial Sequence
  chemically synthesized
aatatgtatcactttaacat

SEQ ID NO: 143674 - DNA, 20 bp, Artificial Sequence
  chemically synthesized
gtatatggttacttatgtta

SEQ ID NO: 143675 - DNA, 20 bp, Artificial Sequence
  chemically synthesized
tatccacacttttatgtata

SEQ ID NO: 143676 - DNA, 20 bp, Artificial Sequence
  chemically synthesized
ataagtaaccatatacataa

SEQ ID NO: 143677 - DNA, 20 bp, Artificial Sequence
  chemically synthesized
taaccatatacataaaagtg

SEQ ID NO: 143678 - DNA, 20 bp, Artificial Sequence
  chemically synthesized
tatacataaaagtgtggata

SEQ ID NO: 143679 - DNA, 20 bp, Artificial Sequence
  chemically synthesized
atacataaaagtgtggatac

SEQ ID NO: 143680 - DNA, 20 bp, Artificial Sequence
  chemically synthesized
taaaagtgtggatacaggta

SEQ ID NO: 143681 - DNA, 20 bp, Artificial Sequence
  chemically synthesized
tacagaaacacttttactaa

SEQ ID NO: 143682 - DNA, 20 bp, Artificial Sequence
  chemically synthesized
tcacacatcactattagtaa

SEQ ID NO: 143683 - DNA, 20 bp, Artificial Sequence
  chemically synthesized
cagtgatcacacatcactat

SEQ ID NO: 143684 - DNA, 20 bp, Artificial Sequence
  chemically synthesized
taagtgtgaataagatgagg

SEQ ID NO: 143685 - DNA, 20 bp, Artificial Sequence
  chemically synthesized
gaataagtgtgaataagatg

SEQ ID NO: 143686 - DNA, 20 bp, Artificial Sequence
  chemically synthesized
tgaataagtgtgaataagat

SEQ ID NO: 143687 - DNA, 20 bp, Artificial Sequence
  chemically synthesized
gatagtgaataagtgtgaat

SEQ ID NO: 143688 - DNA, 20 bp, Artificial Sequence
  chemically synthesized
ccttgtgtatgatagtgaat

SEQ ID NO: 143689 - DNA, 20 bp, Artificial Sequence
  chemically synthesized
tttgatttccttgtgtatga

SEQ ID NO: 143690 - DNA, 20 bp, Artificial Sequence
  chemically synthesized
acttattcactatcatacac

SEQ ID NO: 143691 - DNA, 20 bp, Artificial Sequence
  chemically synthesized
cttattcactatcatacaca

SEQ ID NO: 143692 - DNA, 20 bp, Artificial Sequence
  chemically synthesized
gagacactagagtaataatt

SEQ ID NO: 143693 - DNA, 20 bp, Artificial Sequence
  chemically synthesized
ttaaatccaaattattactc

SEQ ID NO: 143694 - DNA, 20 bp, Artificial Sequence
  chemically synthesized
gagaatagaaagagacacta

SEQ ID NO: 143695 - DNA, 20 bp, Artificial Sequence
  chemically synthesized
aggagaatagaaagagacac

SEQ ID NO: 143696 - DNA, 20 bp, Artificial Sequence
  chemically synthesized
ttaagaaaggagaatagaaa

SEQ ID NO: 143697 - DNA, 20 bp, Artificial Sequence
  chemically synthesized
tattaagaaaggagaataga

SEQ ID NO: 143698 - DNA, 20 bp, Artificial Sequence
  chemically synthesized
agactattaagaaaggagaa

SEQ ID NO: 143699 - DNA, 20 bp, Artificial Sequence
  chemically synthesized
gttgaagactattaagaaag

SEQ ID NO: 143700 - DNA, 20 bp, Artificial Sequence
  chemically synthesized
tttctattctcctttcttaa

SEQ ID NO: 143701 - DNA, 20 bp, Artificial Sequence
  chemically synthesized
aggttgaagactattaagaa

SEQ ID NO: 143702 - DNA, 20 bp, Artificial Sequence
  chemically synthesized
caggttgaagactattaaga

SEQ ID NO: 143703 - DNA, 20 bp, Artificial Sequence
  chemically synthesized
gagtcaggttgaagactatt

SEQ ID NO: 143704 - DNA, 20 bp, Artificial Sequence
  chemically synthesized
agcactctagagtcaggttg

SEQ ID NO: 143705 - DNA, 20 bp, Artificial Sequence
  chemically synthesized
aatagtcttcaacctgactc

SEQ ID NO: 143706 - DNA, 20 bp, Artificial Sequence
  chemically synthesized
tagtcttcaacctgactcta

SEQ ID NO: 143707 - DNA, 20 bp, Artificial Sequence
  chemically synthesized
ttacaaagcactctagagtc

SEQ ID NO: 143708 - DNA, 20 bp, Artificial Sequence
  chemically synthesized
gttacaaagcactctagagt

SEQ ID NO: 143709 - DNA, 20 bp, Artificial Sequence
  chemically synthesized
ccatgttacaaagcactcta

SEQ ID NO: 143710 - DNA, 20 bp, Artificial Sequence
  chemically synthesized
acccatgttacaaagcactc

SEQ ID NO: 143711 - DNA, 20 bp, Artificial Sequence
  chemically synthesized
ctctagagtgctttgtaaca

SEQ ID NO: 143712 - DNA, 20 bp, Artificial Sequence
  chemically synthesized
tctttgaaacccatgttaca

SEQ ID NO: 143713 - DNA, 20 bp, Artificial Sequence
  chemically synthesized
tctagagtgctttgtaacat

SEQ ID NO: 143714 - DNA, 20 bp, Artificial Sequence
  chemically synthesized
gctttgtaacatgggtttca

SEQ ID NO: 143715 - DNA, 20 bp, Artificial Sequence
  chemically synthesized
caaagacaatttgttgaacg

SEQ ID NO: 143716 - DNA, 20 bp, Artificial Sequence
  chemically synthesized
aaagacaatttgttgaacga

SEQ ID NO: 143717 - DNA, 20 bp, Artificial Sequence
  chemically synthesized
taatgttaatgttaggtata

SEQ ID NO: 143718 - DNA, 20 bp, Artificial Sequence
  chemically synthesized
tgttaactaatgttaatgtt

SEQ ID NO: 143719 - DNA, 20 bp, Artificial Sequence
  chemically synthesized
atgttaactaatgttaatgt

SEQ ID NO: 143720 - DNA, 20 bp, Artificial Sequence
  chemically synthesized
catatacctaacattaacat

SEQ ID NO: 143721 - DNA, 20 bp, Artificial Sequence
  chemically synthesized
tattattacctttaatgtta

SEQ ID NO: 143722 - DNA, 20 bp, Artificial Sequence
  chemically synthesized
ttaacattaccctaacatta

SEQ ID NO: 143723 - DNA, 20 bp, Artificial Sequence
  chemically synthesized
ttattattacctttaatgtt

SEQ ID NO: 143724 - DNA, 20 bp, Artificial Sequence
  chemically synthesized
taacattaccctaacattaa

SEQ ID NO: 143725 - DNA, 20 bp, Artificial Sequence
  chemically synthesized
cttattattacctttaatgt

SEQ ID NO: 143726 - DNA, 20 bp, Artificial Sequence
  chemically synthesized
ctaacattaaaggtaataat

SEQ ID NO: 143727 - DNA, 20 bp, Artificial Sequence
  chemically synthesized
aaagtctgtaattgaagtta

SEQ ID NO: 143728 - DNA, 20 bp, Artificial Sequence
  chemically synthesized
acacactgtaacttcaatta

SEQ ID NO: 143729 - DNA, 20 bp, Artificial Sequence
  chemically synthesized
gtccttaaagtctgtaattg

SEQ ID NO: 143730 - DNA, 20 bp, Artificial Sequence
  chemically synthesized
taacttcaattacagacttt

SEQ ID NO: 143731 - DNA, 20 bp, Artificial Sequence
  chemically synthesized
aacttcaattacagacttta

SEQ ID NO: 143732 - DNA, 20 bp, Artificial Sequence
  chemically synthesized
accataacttttggtcctta

SEQ ID NO: 143733 - DNA, 20 bp, Artificial Sequence
  chemically synthesized
ttacagactttaaggaccaa

SEQ ID NO: 143734 - DNA, 20 bp, Artificial Sequence
  chemically synthesized
actttaaggaccaaaagtta

SEQ ID NO: 143735 - DNA, 20 bp, Artificial Sequence
  chemically synthesized
ttccatttcaccataacttt

SEQ ID NO: 143736 - DNA, 20 bp, Artificial Sequence
  chemically synthesized
gaccaaaagttatggtgaaa

SEQ ID NO: 143737 - DNA, 20 bp, Artificial Sequence
  chemically synthesized
aaaagttatggtgaaatgga

SEQ ID NO: 143738 - DNA, 20 bp, Artificial Sequence
  chemically synthesized
tggtgaaatggaaagcctaa

SEQ ID NO: 143739 - DNA, 20 bp, Artificial Sequence
  chemically synthesized
ggtgaaatggaaagcctaaa

SEQ ID NO: 143740 - DNA, 20 bp, Artificial Sequence
  chemically synthesized
gaaatggaaagcctaaaagg

SEQ ID NO: 143741 - DNA, 20 bp, Artificial Sequence
  chemically synthesized
aaatggaaagcctaaaaggc

SEQ ID NO: 143742 - DNA, 20 bp, Artificial Sequence
  chemically synthesized
aagtttaggacctgcctttt

SEQ ID NO: 143743 - DNA, 20 bp, Artificial Sequence
  chemically synthesized
aaagtttaggacctgccttt

SEQ ID NO: 143744 - DNA, 20 bp, Artificial Sequence
  chemically synthesized
aaaaggcaggtcctaaactt

SEQ ID NO: 143745 - DNA, 20 bp, Artificial Sequence
  chemically synthesized
aaaggcaggtcctaaacttt

SEQ ID NO: 143746 - DNA, 20 bp, Artificial Sequence
  chemically synthesized
gttattgttccctaaagttt

SEQ ID NO: 143747 - DNA, 20 bp, Artificial Sequence
  chemically synthesized
aaggcaggtcctaaacttta

SEQ ID NO: 143748 - DNA, 20 bp, Artificial Sequence
  chemically synthesized
tgttattgttccctaaagtt

SEQ ID NO: 143749 - DNA, 20 bp, Artificial Sequence
  chemically synthesized
tataatgttattgttcccta

SEQ ID NO: 143750 - DNA, 20 bp, Artificial Sequence
  chemically synthesized
caataacattatataacttt

SEQ ID NO: 143751 - DNA, 20 bp, Artificial Sequence
  chemically synthesized
gtttttttttaattttctga

SEQ ID NO: 143752 - DNA, 20 bp, Artificial Sequence
  chemically synthesized
tacaggaaagcaatgtaata

SEQ ID NO: 143753 - DNA, 20 bp, Artificial Sequence
  chemically synthesized
ttacaggaaagcaatgtaat

SEQ ID NO: 143754 - DNA, 20 bp, Artificial Sequence
  chemically synthesized
ttattacattgctttcctgt

SEQ ID NO: 143755 - DNA, 20 bp, Artificial Sequence
  chemically synthesized
tctctaactttcttacagga

SEQ ID NO: 143756 - DNA, 20 bp, Artificial Sequence
  chemically synthesized
tacattgctttcctgtaaga

SEQ ID NO: 143757 - DNA, 20 bp, Artificial Sequence
  chemically synthesized
gtcttctctaactttcttac

SEQ ID NO: 143758 - DNA, 20 bp, Artificial Sequence
  chemically synthesized
ggtcttctctaactttctta

SEQ ID NO: 143759 - DNA, 20 bp, Artificial Sequence
  chemically synthesized
ttgctttcctgtaagaaagt

SEQ ID NO: 143760 - DNA, 20 bp, Artificial Sequence
  chemically synthesized
gctttcctgtaagaaagtta

SEQ ID NO: 143761 - DNA, 20 bp, Artificial Sequence
  chemically synthesized
ttcctgtaagaaagttagag

SEQ ID NO: 143762 - DNA, 20 bp, Artificial Sequence
  chemically synthesized
taagaaagttagagaagacc

SEQ ID NO: 143763 - DNA, 20 bp, Artificial Sequence
  chemically synthesized
catagaaatacgtagaatct

SEQ ID NO: 143764 - DNA, 20 bp, Artificial Sequence
  chemically synthesized
tcatagaaatacgtagaatc

SEQ ID NO: 143765 - DNA, 20 bp, Artificial Sequence
  chemically synthesized
attgttttcatagaaatacg

SEQ ID NO: 143766 - DNA, 20 bp, Artificial Sequence
  chemically synthesized
agtgatttttattgttttca

SEQ ID NO: 143767 - DNA, 20 bp, Artificial Sequence
  chemically synthesized
aataaaaatcactccatata

SEQ ID NO: 143768 - DNA, 20 bp, Artificial Sequence
  chemically synthesized
ataaaaatcactccatataa

SEQ ID NO: 143769 - DNA, 20 bp, Artificial Sequence
  chemically synthesized
agttagggctcctttatatg

SEQ ID NO: 143770 - DNA, 20 bp, Artificial Sequence
  chemically synthesized
aaaaatcactccatataaag

SEQ ID NO: 143771 - DNA, 20 bp, Artificial Sequence
  chemically synthesized
ctagttagggctcctttata

SEQ ID NO: 143772 - DNA, 20 bp, Artificial Sequence
  chemically synthesized
ccatataaaggagccctaac

SEQ ID NO: 143773 - DNA, 20 bp, Artificial Sequence
  chemically synthesized
tcctttcttggatctagtta

SEQ ID NO: 143774 - DNA, 20 bp, Artificial Sequence
  chemically synthesized
ttcctttcttggatctagtt

SEQ ID NO: 143775 - DNA, 20 bp, Artificial Sequence
  chemically synthesized
tttcctttcttggatctagt

SEQ ID NO: 143776 - DNA, 20 bp, Artificial Sequence
  chemically synthesized
aaggagccctaactagatcc

SEQ ID NO: 143777 - DNA, 20 bp, Artificial Sequence
  chemically synthesized
caaatttcctttcttggatc

SEQ ID NO: 143778 - DNA, 20 bp, Artificial Sequence
  chemically synthesized
agccctaactagatccaaga

SEQ ID NO: 143779 - DNA, 20 bp, Artificial Sequence
  chemically synthesized
gccctaactagatccaagaa

SEQ ID NO: 143780 - DNA, 20 bp, Artificial Sequence
  chemically synthesized
tatttacaaatttcctttct

SEQ ID NO: 143781 - DNA, 20 bp, Artificial Sequence
  chemically synthesized
caagaaaggaaatttgtaaa

SEQ ID NO: 143782 - DNA, 20 bp, Artificial Sequence
  chemically synthesized
ctcaaataaataaataatta

SEQ ID NO: 143783 - DNA, 20 bp, Artificial Sequence
  chemically synthesized
gtctcaaataaataaataat

SEQ ID NO: 143784 - DNA, 20 bp, Artificial Sequence
  chemically synthesized
ctctaattatttatttattt

SEQ ID NO: 143785 - DNA, 20 bp, Artificial Sequence
  chemically synthesized
aattatttatttatttgaga

SEQ ID NO: 143786 - DNA, 20 bp, Artificial Sequence
  chemically synthesized
ttatttatttatttgagacg

SEQ ID NO: 143787 - DNA, 20 bp, Artificial Sequence
  chemically synthesized
cactccagcctgggcaacaa

SEQ ID NO: 143788 - DNA, 20 bp, Artificial Sequence
  chemically synthesized
ggagtttcgctcttgttgcc

SEQ ID NO: 143789 - DNA, 20 bp, Artificial Sequence
  chemically synthesized
gagtttcgctcttgttgccc

SEQ ID NO: 143790 - DNA, 20 bp, Artificial Sequence
  chemically synthesized
tgcactccagcctgggcaac

SEQ ID NO: 143791 - DNA, 20 bp, Artificial Sequence
  chemically synthesized
ttcgctcttgttgcccaggc

SEQ ID NO: 143792 - DNA, 20 bp, Artificial Sequence
  chemically synthesized
cgctcttgttgcccaggctg

SEQ ID NO: 143793 - DNA, 20 bp, Artificial Sequence
  chemically synthesized
acaccattgcactccagcct

SEQ ID NO: 143794 - DNA, 20 bp, Artificial Sequence
  chemically synthesized
cacaccattgcactccagcc

SEQ ID NO: 143795 - DNA, 20 bp, Artificial Sequence
  chemically synthesized
gagatcacaccattgcactc

SEQ ID NO: 143796 - DNA, 20 bp, Artificial Sequence
  chemically synthesized
ttgcccaggctggagtgcaa

SEQ ID NO: 143797 - DNA, 20 bp, Artificial Sequence
  chemically synthesized
ggagtgcaatggtgtgatct

SEQ ID NO: 143798 - DNA, 20 bp, Artificial Sequence
  chemically synthesized
ggcagatgttgcagtgagcc

SEQ ID NO: 143799 - DNA, 20 bp, Artificial Sequence
  chemically synthesized
cgggaggcagatgttgcagt

SEQ ID NO: 143800 - DNA, 20 bp, Artificial Sequence
  chemically synthesized
aacccgggaggcagatgttg

SEQ ID NO: 143801 - DNA, 20 bp, Artificial Sequence
  chemically synthesized
tcactgcaacatctgcctcc

SEQ ID NO: 143802 - DNA, 20 bp, Artificial Sequence
  chemically synthesized
cactgcaacatctgcctccc

SEQ ID NO: 143803 - DNA, 20 bp, Artificial Sequence
  chemically synthesized
aatcgcttgaacccgggagg

SEQ ID NO: 143804 - DNA, 20 bp, Artificial Sequence
  chemically synthesized
gagaatcgcttgaacccggg

SEQ ID NO: 143805 - DNA, 20 bp, Artificial Sequence
  chemically synthesized
ggagaatcgcttgaacccgg

SEQ ID NO: 143806 - DNA, 20 bp, Artificial Sequence
  chemically synthesized
aacatctgcctcccgggttc

SEQ ID NO: 143807 - DNA, 20 bp, Artificial Sequence
  chemically synthesized
caggagaatcgcttgaaccc

SEQ ID NO: 143808 - DNA, 20 bp, Artificial Sequence
  chemically synthesized
gcaggagaatcgcttgaacc

SEQ ID NO: 143809 - DNA, 20 bp, Artificial Sequence
  chemically synthesized
ttcaagcgattctcctgcct

SEQ ID NO: 143810 - DNA, 20 bp, Artificial Sequence
  chemically synthesized
tactcctgaggctgaggcag

SEQ ID NO: 143811 - DNA, 20 bp, Artificial Sequence
  chemically synthesized
gctactcctgaggctgaggc

SEQ ID NO: 143812 - DNA, 20 bp, Artificial Sequence
  chemically synthesized
agctactcctgaggctgagg

SEQ ID NO: 143813 - DNA, 20 bp, Artificial Sequence
  chemically synthesized
cgattctcctgcctcagcct

SEQ ID NO: 143814 - DNA, 20 bp, Artificial Sequence
  chemically synthesized
gattctcctgcctcagcctc

SEQ ID NO: 143815 - DNA, 20 bp, Artificial Sequence
  chemically synthesized
cccagctactcctgaggctg

SEQ ID NO: 143816 - DNA, 20 bp, Artificial Sequence
  chemically synthesized
ccccagctactcctgaggct

SEQ ID NO: 143817 - DNA, 20 bp, Artificial Sequence
  chemically synthesized
ttctcctgcctcagcctcag

SEQ ID NO: 143818 - DNA, 20 bp, Artificial Sequence
  chemically synthesized
tcctgcctcagcctcaggag

SEQ ID NO: 143819 - DNA, 20 bp, Artificial Sequence
  chemically synthesized
tgtagccccagctactcctg

SEQ ID NO: 143820 - DNA, 20 bp, Artificial Sequence
  chemically synthesized
ctgtagccccagctactcct

SEQ ID NO: 143821 - DNA, 20 bp, Artificial Sequence
  chemically synthesized
gcctcagcctcaggagtagc

SEQ ID NO: 143822 - DNA, 20 bp, Artificial Sequence
  chemically synthesized
cctcagcctcaggagtagct

SEQ ID NO: 143823 - DNA, 20 bp, Artificial Sequence
  chemically synthesized
ctcagcctcaggagtagctg

SEQ ID NO: 143824 - DNA, 20 bp, Artificial Sequence
  chemically synthesized
ctcaggagtagctggggcta

SEQ ID NO: 143825 - DNA, 20 bp, Artificial Sequence
  chemically synthesized
tcaggagtagctggggctac

SEQ ID NO: 143826 - DNA, 20 bp, Artificial Sequence
  chemically synthesized
gtggcgcatgcctgtagccc

SEQ ID NO: 143827 - DNA, 20 bp, Artificial Sequence
  chemically synthesized
ggcgtggtggcgcatgcctg

SEQ ID NO: 143828 - DNA, 20 bp, Artificial Sequence
  chemically synthesized
caggcatgcgccaccacgcc

SEQ ID NO: 143829 - DNA, 20 bp, Artificial Sequence
  chemically synthesized
acaaaattagccgggcgtgg

SEQ ID NO: 143830 - DNA, 20 bp, Artificial Sequence
  chemically synthesized
aatacaaaattagccgggcg

SEQ ID NO: 143831 - DNA, 20 bp, Artificial Sequence
  chemically synthesized
ctaaaaatacaaaattagcc

SEQ ID NO: 143832 - DNA, 20 bp, Artificial Sequence
  chemically synthesized
actaaaaatacaaaattagc

SEQ ID NO: 143833 - DNA, 20 bp, Artificial Sequence
  chemically synthesized
ctctactaaaaatacaaaat

SEQ ID NO: 143834 - DNA, 20 bp, Artificial Sequence
  chemically synthesized
cccggctaattttgtatttt

SEQ ID NO: 143835 - DNA, 20 bp, Artificial Sequence
  chemically synthesized
ggctaattttgtatttttag

SEQ ID NO: 143836 - DNA, 20 bp, Artificial Sequence
  chemically synthesized
ctaattttgtatttttagta

SEQ ID NO: 143837 - DNA, 20 bp, Artificial Sequence
  chemically synthesized
ttttgtatttttagtagaga

SEQ ID NO: 143838 - DNA, 20 bp, Artificial Sequence
  chemically synthesized
tttgtatttttagtagagac

SEQ ID NO: 143839 - DNA, 20 bp, Artificial Sequence
  chemically synthesized
ttgtatttttagtagagacg

SEQ ID NO: 143840 - DNA, 20 bp, Artificial Sequence
  chemically synthesized
gagacggggtttctccatgt

SEQ ID NO: 143841 - DNA, 20 bp, Artificial Sequence
  chemically synthesized
agaccagcctgaccaacatg

SEQ ID NO: 143842 - DNA, 20 bp, Artificial Sequence
  chemically synthesized
cggggtttctccatgttggt

SEQ ID NO: 143843 - DNA, 20 bp, Artificial Sequence
  chemically synthesized
tgagaccagcctgaccaaca

SEQ ID NO: 143844 - DNA, 20 bp, Artificial Sequence
  chemically synthesized
ggggtttctccatgttggtc

SEQ ID NO: 143845 - DNA, 20 bp, Artificial Sequence
  chemically synthesized
tttctccatgttggtcaggc

SEQ ID NO: 143846 - DNA, 20 bp, Artificial Sequence
  chemically synthesized
tgaggtcaggagtttgagac

SEQ ID NO: 143847 - DNA, 20 bp, Artificial Sequence
  chemically synthesized
tcacctgaggtcaggagttt

SEQ ID NO: 143848 - DNA, 20 bp, Artificial Sequence
  chemically synthesized
tggtctcaaactcctgacct

SEQ ID NO: 143849 - DNA, 20 bp, Artificial Sequence
  chemically synthesized
ggtgtatcacctgaggtcag

SEQ ID NO: 143850 - DNA, 20 bp, Artificial Sequence
  chemically synthesized
ggtctcaaactcctgacctc

SEQ ID NO: 143851 - DNA, 20 bp, Artificial Sequence
  chemically synthesized
cgggtgtatcacctgaggtc

SEQ ID NO: 143852 - DNA, 20 bp, Artificial Sequence
  chemically synthesized
gcgggtgtatcacctgaggt

SEQ ID NO: 143853 - DNA, 20 bp, Artificial Sequence
  chemically synthesized
tgaggcgggtgtatcacctg

SEQ ID NO: 143854 - DNA, 20 bp, Artificial Sequence
  chemically synthesized
ctgaggcgggtgtatcacct

SEQ ID NO: 143855 - DNA, 20 bp, Artificial Sequence
  chemically synthesized
ctcaggtgatacacccgcct

SEQ ID NO: 143856 - DNA, 20 bp, Artificial Sequence
  chemically synthesized
gcactttgggaggctgaggc

SEQ ID NO: 143857 - DNA, 20 bp, Artificial Sequence
  chemically synthesized
agcactttgggaggctgagg

SEQ ID NO: 143858 - DNA, 20 bp, Artificial Sequence
  chemically synthesized
cccagcactttgggaggctg

SEQ ID NO: 143859 - DNA, 20 bp, Artificial Sequence
  chemically synthesized
tcccagcactttgggaggct

SEQ ID NO: 143860 - DNA, 20 bp, Artificial Sequence
  chemically synthesized
acacccgcctcagcctccca

SEQ ID NO: 143861 - DNA, 20 bp, Artificial Sequence
  chemically synthesized
tgtaatcccagcactttggg

SEQ ID NO: 143862 - DNA, 20 bp, Artificial Sequence
  chemically synthesized
ctgtaatcccagcactttgg

SEQ ID NO: 143863 - DNA, 20 bp, Artificial Sequence
  chemically synthesized
gcctcagcctcccaaagtgc

SEQ ID NO: 143864 - DNA, 20 bp, Artificial Sequence
  chemically synthesized
gcctgtaatcccagcacttt

SEQ ID NO: 143865 - DNA, 20 bp, Artificial Sequence
  chemically synthesized
cctcagcctcccaaagtgct

SEQ ID NO: 143866 - DNA, 20 bp, Artificial Sequence
  chemically synthesized
cgcctgtaatcccagcactt

SEQ ID NO: 143867 - DNA, 20 bp, Artificial Sequence
  chemically synthesized
ctcccaaagtgctgggatta

SEQ ID NO: 143868 - DNA, 20 bp, Artificial Sequence
  chemically synthesized
tcccaaagtgctgggattac

SEQ ID NO: 143869 - DNA, 20 bp, Artificial Sequence
  chemically synthesized
gtagctcacgcctgtaatcc

SEQ ID NO: 143870 - DNA, 20 bp, Artificial Sequence
  chemically synthesized
agtgctgggattacaggcgt

SEQ ID NO: 143871 - DNA, 20 bp, Artificial Sequence
  chemically synthesized
caggcgtgagctaccatgcc

SEQ ID NO: 143872 - DNA, 20 bp, Artificial Sequence
  chemically synthesized
gaattctgggccgggcatgg

SEQ ID NO: 143873 - DNA, 20 bp, Artificial Sequence
  chemically synthesized
agagaattctgggccgggca

SEQ ID NO: 143874 - DNA, 20 bp, Artificial Sequence
  chemically synthesized
gtgagctaccatgcccggcc

SEQ ID NO: 143875 - DNA, 20 bp, Artificial Sequence
  chemically synthesized
taaatagagaattctgggcc

SEQ ID NO: 143876 - DNA, 20 bp, Artificial Sequence
  chemically synthesized
ttaaatagagaattctgggc

SEQ ID NO: 143877 - DNA, 20 bp, Artificial Sequence
  chemically synthesized
gtgtttaaatagagaattct

SEQ ID NO: 143878 - DNA, 20 bp, Artificial Sequence
  chemically synthesized
tgtgtttaaatagagaattc

SEQ ID NO: 143879 - DNA, 20 bp, Artificial Sequence
  chemically synthesized
tttgccattgtgtttaaata

SEQ ID NO: 143880 - DNA, 20 bp, Artificial Sequence
  chemically synthesized
tgtttgccattgtgtttaaa

SEQ ID NO: 143881 - DNA, 20 bp, Artificial Sequence
  chemically synthesized
aattctctatttaaacacaa

SEQ ID NO: 143882 - DNA, 20 bp, Artificial Sequence
  chemically synthesized
gcaaacataaacttccttat

SEQ ID NO: 143883 - DNA, 20 bp, Artificial Sequence
  chemically synthesized
ccagtgggattctgataagg

SEQ ID NO: 143884 - DNA, 20 bp, Artificial Sequence
  chemically synthesized
ataccagtgggattctgata

SEQ ID NO: 143885 - DNA, 20 bp, Artificial Sequence
  chemically synthesized
aataccagtgggattctgat

SEQ ID NO: 143886 - DNA, 20 bp, Artificial Sequence
  chemically synthesized
cttccttatcagaatcccac

SEQ ID NO: 143887 - DNA, 20 bp, Artificial Sequence
  chemically synthesized
gttttccataaaataccagt

SEQ ID NO: 143888 - DNA, 20 bp, Artificial Sequence
  chemically synthesized
tgttttccataaaataccag

SEQ ID NO: 143889 - DNA, 20 bp, Artificial Sequence
  chemically synthesized
ctgtgttttccataaaatac

SEQ ID NO: 143890 - DNA, 20 bp, Artificial Sequence
  chemically synthesized
agaatcccactggtatttta

SEQ ID NO: 143891 - DNA, 20 bp, Artificial Sequence
  chemically synthesized
ctggtattttatggaaaaca

SEQ ID NO: 143892 - DNA, 20 bp, Artificial Sequence
  chemically synthesized
attttatggaaaacacagta

SEQ ID NO: 143893 - DNA, 20 bp, Artificial Sequence
  chemically synthesized
cacagtacagtgacttccat

SEQ ID NO: 143894 - DNA, 20 bp, Artificial Sequence
  chemically synthesized
atttacatgaattctgatgg

SEQ ID NO: 143895 - DNA, 20 bp, Artificial Sequence
  chemically synthesized
gatatttacatgaattctga

SEQ ID NO: 143896 - DNA, 20 bp, Artificial Sequence
  chemically synthesized
cagaattcatgtaaatatcc

SEQ ID NO: 143897 - DNA, 20 bp, Artificial Sequence
  chemically synthesized
ttcatgtaaatatcctggat

SEQ ID NO: 143898 - DNA, 20 bp, Artificial Sequence
  chemically synthesized
ttatcaagcaaaactgatcc

SEQ ID NO: 143899 - DNA, 20 bp, Artificial Sequence
  chemically synthesized
cttatcaagcaaaactgatc

SEQ ID NO: 143900 - DNA, 20 bp, Artificial Sequence
  chemically synthesized
ctggatcagttttgcttgat

SEQ ID NO: 143901 - DNA, 20 bp, Artificial Sequence
  chemically synthesized
ttttctgtcaaaatcttatc

SEQ ID NO: 143902 - DNA, 20 bp, Artificial Sequence
  chemically synthesized
tttgcttgataagattttga

SEQ ID NO: 143903 - DNA, 20 bp, Artificial Sequence
  chemically synthesized
ttgataagattttgacagaa

SEQ ID NO: 143904 - DNA, 20 bp, Artificial Sequence
  chemically synthesized
gattttgacagaaaagttta

SEQ ID NO: 143905 - DNA, 20 bp, Artificial Sequence
  chemically synthesized
gaattgaattaaaatataat

SEQ ID NO: 143906 - DNA, 20 bp, Artificial Sequence
  chemically synthesized
aagatacacatttccattca

SEQ ID NO: 143907 - DNA, 20 bp, Artificial Sequence
  chemically synthesized
cacatttcaaagtctatgaa

SEQ ID NO: 143908 - DNA, 20 bp, Artificial Sequence
  chemically synthesized
atactaaactacacatttca

SEQ ID NO: 143909 - DNA, 20 bp, Artificial Sequence
  chemically synthesized
ttcatagactttgaaatgtg

SEQ ID NO: 143910 - DNA, 20 bp, Artificial Sequence
  chemically synthesized
agactttgaaatgtgtagtt

SEQ ID NO: 143911 - DNA, 20 bp, Artificial Sequence
  chemically synthesized
ttgaaatgtgtagtttagta

SEQ ID NO: 143912 - DNA, 20 bp, Artificial Sequence
  chemically synthesized
tgtagtttagtatagtttat

SEQ ID NO: 143913 - DNA, 20 bp, Artificial Sequence
  chemically synthesized
gtatagtttataagtttatg

SEQ ID NO: 143914 - DNA, 20 bp, Artificial Sequence
  chemically synthesized
taagtttatgtagtttcttt

SEQ ID NO: 143915 - DNA, 20 bp, Artificial Sequence
  chemically synthesized
taccatatgcttttttctta

SEQ ID NO: 143916 - DNA, 20 bp, Artificial Sequence
  chemically synthesized
atgtagtttctttaagaaaa

SEQ ID NO: 143917 - DNA, 20 bp, Artificial Sequence
  chemically synthesized
ttctttaagaaaaaagcata

SEQ ID NO: 143918 - DNA, 20 bp, Artificial Sequence
  chemically synthesized
atggtatcattttccataaa

SEQ ID NO: 143919 - DNA, 20 bp, Artificial Sequence
  chemically synthesized
tggtatcattttccataaaa

SEQ ID NO: 143920 - DNA, 20 bp, Artificial Sequence
  chemically synthesized
gtctcctaattaccttttta

SEQ ID NO: 143921 - DNA, 20 bp, Artificial Sequence
  chemically synthesized
attttccataaaaaggtaat

SEQ ID NO: 143922 - DNA, 20 bp, Artificial Sequence
  chemically synthesized
ttttccataaaaaggtaatt

SEQ ID NO: 143923 - DNA, 20 bp, Artificial Sequence
  chemically synthesized
ttccataaaaaggtaattag

SEQ ID NO: 143924 - DNA, 20 bp, Artificial Sequence
  chemically synthesized
aaaaaggtaattaggagact

SEQ ID NO: 143925 - DNA, 20 bp, Artificial Sequence
  chemically synthesized
cacacaaaatcatattttct

SEQ ID NO: 143926 - DNA, 20 bp, Artificial Sequence
  chemically synthesized
ccttaaataaaaaggtcata

SEQ ID NO: 143927 - DNA, 20 bp, Artificial Sequence
  chemically synthesized
ccccttaaataaaaaggtca

SEQ ID NO: 143928 - DNA, 20 bp, Artificial Sequence
  chemically synthesized
aaaccgccccttaaataaaa

SEQ ID NO: 143929 - DNA, 20 bp, Artificial Sequence
  chemically synthesized
actctatgacctttttattt

SEQ ID NO: 143930 - DNA, 20 bp, Artificial Sequence
  chemically synthesized
taaaccgccccttaaataaa

SEQ ID NO: 143931 - DNA, 20 bp, Artificial Sequence
  chemically synthesized
ctctatgacctttttattta

SEQ ID NO: 143932 - DNA, 20 bp, Artificial Sequence
  chemically synthesized
tctatgacctttttatttaa

SEQ ID NO: 143933 - DNA, 20 bp, Artificial Sequence
  chemically synthesized
ctatgacctttttatttaag

SEQ ID NO: 143934 - DNA, 20 bp, Artificial Sequence
  chemically synthesized
tgacctttttatttaagggg

SEQ ID NO: 143935 - DNA, 20 bp, Artificial Sequence
  chemically synthesized
cggtttatttttgttatgac

SEQ ID NO: 143936 - DNA, 20 bp, Artificial Sequence
  chemically synthesized
gtttatttttgttatgacca

SEQ ID NO: 143937 - DNA, 20 bp, Artificial Sequence
  chemically synthesized
gtgacttattttatattctc

SEQ ID NO: 143938 - DNA, 20 bp, Artificial Sequence
  chemically synthesized
atgaccagagaatataaaat

SEQ ID NO: 143939 - DNA, 20 bp, Artificial Sequence
  chemically synthesized
atgtaaagatatgtcagtgt

SEQ ID NO: 143940 - DNA, 20 bp, Artificial Sequence
  chemically synthesized
cgaaggatgtaaagatatgt

SEQ ID NO: 143941 - DNA, 20 bp, Artificial Sequence
  chemically synthesized
tatcttcaacgaaggatgta

SEQ ID NO: 143942 - DNA, 20 bp, Artificial Sequence
  chemically synthesized
tatctttacatccttcgttg

SEQ ID NO: 143943 - DNA, 20 bp, Artificial Sequence
  chemically synthesized
tccactattatcttcaacga

SEQ ID NO: 143944 - DNA, 20 bp, Artificial Sequence
  chemically synthesized
atccactattatcttcaacg

SEQ ID NO: 143945 - DNA, 20 bp, Artificial Sequence
  chemically synthesized
acatccttcgttgaagataa

SEQ ID NO: 143946 - DNA, 20 bp, Artificial Sequence
  chemically synthesized
tccttcgttgaagataatag

SEQ ID NO: 143947 - DNA, 20 bp, Artificial Sequence
  chemically synthesized
gttgaagataatagtggatt

SEQ ID NO: 143948 - DNA, 20 bp, Artificial Sequence
  chemically synthesized
aatagtggatttggtctcat

SEQ ID NO: 143949 - DNA, 20 bp, Artificial Sequence
  chemically synthesized
atagtggatttggtctcatt

SEQ ID NO: 143950 - DNA, 20 bp, Artificial Sequence
  chemically synthesized
attttctttctttacctaat

SEQ ID NO: 143951 - DNA, 20 bp, Artificial Sequence
  chemically synthesized
ggatttggtctcattaggta

SEQ ID NO: 143952 - DNA, 20 bp, Artificial Sequence
  chemically synthesized
ttggtctcattaggtaaaga

SEQ ID NO: 143953 - DNA, 20 bp, Artificial Sequence
  chemically synthesized
gaaagaaaattatataaata

SEQ ID NO: 143954 - DNA, 20 bp, Artificial Sequence
  chemically synthesized
aaaattatataaatatggat

SEQ ID NO: 143955 - DNA, 20 bp, Artificial Sequence
  chemically synthesized
ataaatatggatcagtcatc

SEQ ID NO: 143956 - DNA, 20 bp, Artificial Sequence
  chemically synthesized
atatggatcagtcatccaga

SEQ ID NO: 143957 - DNA, 20 bp, Artificial Sequence
  chemically synthesized
gtagacagcttgcgaccatc

SEQ ID NO: 143958 - DNA, 20 bp, Artificial Sequence
  chemically synthesized
tcagtcatccagatggtcgc

SEQ ID NO: 143959 - DNA, 20 bp, Artificial Sequence
  chemically synthesized
gatggtcgcaagctgtctac

SEQ ID NO: 143960 - DNA, 20 bp, Artificial Sequence
  chemically synthesized
tggtcgcaagctgtctacca

SEQ ID NO: 143961 - DNA, 20 bp, Artificial Sequence
  chemically synthesized
atgtacatgtctctggtaga

SEQ ID NO: 143962 - DNA, 20 bp, Artificial Sequence
  chemically synthesized
acaaatgtacatgtctctgg

SEQ ID NO: 143963 - DNA, 20 bp, Artificial Sequence
  chemically synthesized
ccaacaaatgtacatgtctc

SEQ ID NO: 143964 - DNA, 20 bp, Artificial Sequence
  chemically synthesized
ccagagacatgtacatttgt

SEQ ID NO: 143965 - DNA, 20 bp, Artificial Sequence
  chemically synthesized
gagacatgtacatttgttgg

SEQ ID NO: 143966 - DNA, 20 bp, Artificial Sequence
  chemically synthesized
catttgttggaagataatta

SEQ ID NO: 143967 - DNA, 20 bp, Artificial Sequence
  chemically synthesized
acaaaatttgtaaatatctt

SEQ ID NO: 143968 - DNA, 20 bp, Artificial Sequence
  chemically synthesized
tgttgtaatctgtttggctg

SEQ ID NO: 143969 - DNA, 20 bp, Artificial Sequence
  chemically synthesized
tgtaaatatcttcagccaaa

SEQ ID NO: 143970 - DNA, 20 bp, Artificial Sequence
  chemically synthesized
aattaatgttgtaatctgtt

SEQ ID NO: 143971 - DNA, 20 bp, Artificial Sequence
  chemically synthesized
taccaattaagaaattaatt

SEQ ID NO: 143972 - DNA, 20 bp, Artificial Sequence
  chemically synthesized
ttcttaattaatttcttaat

SEQ ID NO: 143973 - DNA, 20 bp, Artificial Sequence
  chemically synthesized
ttgtttaagaaataccaatt

SEQ ID NO: 143974 - DNA, 20 bp, Artificial Sequence
  chemically synthesized
ttaattggtatttcttaaac

SEQ ID NO: 143975 - DNA, 20 bp, Artificial Sequence
  chemically synthesized
atttctgcacaaacttgttt

SEQ ID NO: 143976 - DNA, 20 bp, Artificial Sequence
  chemically synthesized
atttcttaaacaagtttgtg

SEQ ID NO: 143977 - DNA, 20 bp, Artificial Sequence
  chemically synthesized
ttgtgcagaaatgaaatgat

SEQ ID NO: 143978 - DNA, 20 bp, Artificial Sequence
  chemically synthesized
cagaaatgaaatgatgagat

SEQ ID NO: 143979 - DNA, 20 bp, Artificial Sequence
  chemically synthesized
aaatgaaatgatgagatgag

SEQ ID NO: 143980 - DNA, 20 bp, Artificial Sequence
  chemically synthesized
aatgaaatgatgagatgaga

SEQ ID NO: 143981 - DNA, 20 bp, Artificial Sequence
  chemically synthesized
atgaaatgatgagatgagaa

SEQ ID NO: 143982 - DNA, 20 bp, Artificial Sequence
  chemically synthesized
aatgatgagatgagaagggc

SEQ ID NO: 143983 - DNA, 20 bp, Artificial Sequence
  chemically synthesized
tctttcatcgatcaacaatc

SEQ ID NO: 143984 - DNA, 20 bp, Artificial Sequence
  chemically synthesized
gctggattgttgatcgatga

SEQ ID NO: 143985 - DNA, 20 bp, Artificial Sequence
  chemically synthesized
tggattgttgatcgatgaaa

SEQ ID NO: 143986 - DNA, 20 bp, Artificial Sequence
  chemically synthesized
tgatcgatgaaagagaaaaa

SEQ ID NO: 143987 - DNA, 20 bp, Artificial Sequence
  chemically synthesized
gacagtcatcttagggtgag

SEQ ID NO: 143988 - DNA, 20 bp, Artificial Sequence
  chemically synthesized
ataatcaatctcctcaccct

SEQ ID NO: 143989 - DNA, 20 bp, Artificial Sequence
  chemically synthesized
gtgacagtcatcttagggtg

SEQ ID NO: 143990 - DNA, 20 bp, Artificial Sequence
  chemically synthesized
ggtgacagtcatcttagggt

SEQ ID NO: 143991 - DNA, 20 bp, Artificial Sequence
  chemically synthesized
gttgggtgacagtcatctta

SEQ ID NO: 143992 - DNA, 20 bp, Artificial Sequence
  chemically synthesized
ggttgggtgacagtcatctt

SEQ ID NO: 143993 - DNA, 20 bp, Artificial Sequence
  chemically synthesized
aggttgggtgacagtcatct

SEQ ID NO: 143994 - DNA, 20 bp, Artificial Sequence
  chemically synthesized
gatttcacgaggttgggtga

SEQ ID NO: 143995 - DNA, 20 bp, Artificial Sequence
  chemically synthesized
caaatggatttcacgaggtt

SEQ ID NO: 143996 - DNA, 20 bp, Artificial Sequence
  chemically synthesized
tcaaatggatttcacgaggt

SEQ ID NO: 143997 - DNA, 20 bp, Artificial Sequence
  chemically synthesized
ggcatcaaatggatttcacg

SEQ ID NO: 143998 - DNA, 20 bp, Artificial Sequence
  chemically synthesized
gggcatcaaatggatttcac

SEQ ID NO: 143999 - DNA, 20 bp, Artificial Sequence
  chemically synthesized
ttatttccatgggcatcaaa

SEQ ID NO: 144000 - DNA, 20 bp, Artificial Sequence
  chemically synthesized
tgaaatccatttgatgccca

SEQ ID NO: 144001 - DNA, 20 bp, Artificial Sequence
  chemically synthesized
caaacatggtttatttccat

SEQ ID NO: 144002 - DNA, 20 bp, Artificial Sequence
  chemically synthesized
gcaaacatggtttatttcca

SEQ ID NO: 144003 - DNA, 20 bp, Artificial Sequence
  chemically synthesized
ataacaaaacaaagcaaaca

SEQ ID NO: 144004 - DNA, 20 bp, Artificial Sequence
  chemically synthesized
atccaaattataacaaaaca

SEQ ID NO: 144005 - DNA, 20 bp, Artificial Sequence
  chemically synthesized
tgctttgttttgttataatt

SEQ ID NO: 144006 - DNA, 20 bp, Artificial Sequence
  chemically synthesized
ttgttttgttataatttgga

SEQ ID NO: 144007 - DNA, 20 bp, Artificial Sequence
  chemically synthesized
gttttgttataatttggatg

SEQ ID NO: 144008 - DNA, 20 bp, Artificial Sequence
  chemically synthesized
tataatttggatggagaaat

SEQ ID NO: 144009 - DNA, 20 bp, Artificial Sequence
  chemically synthesized
gatggagaaatgagatgtgt

SEQ ID NO: 144010 - DNA, 20 bp, Artificial Sequence
  chemically synthesized
ggagaaatgagatgtgtaag

SEQ ID NO: 144011 - DNA, 20 bp, Artificial Sequence
  chemically synthesized
aatgagatgtgtaagaagtt

SEQ ID NO: 144012 - DNA, 20 bp, Artificial Sequence
  chemically synthesized
atgagatgtgtaagaagttg

SEQ ID NO: 144013 - DNA, 20 bp, Artificial Sequence
  chemically synthesized
tgagatgtgtaagaagttga

SEQ ID NO: 144014 - DNA, 20 bp, Artificial Sequence
  chemically synthesized
gagatgtgtaagaagttgag

SEQ ID NO: 144015 - DNA, 20 bp, Artificial Sequence
  chemically synthesized
agatgtgtaagaagttgagg

SEQ ID NO: 144016 - DNA, 20 bp, Artificial Sequence
  chemically synthesized
gatgtgtaagaagttgaggg

SEQ ID NO: 144017 - DNA, 20 bp, Artificial Sequence
  chemically synthesized
gtgtaagaagttgagggggg

SEQ ID NO: 144018 - DNA, 20 bp, Artificial Sequence
  chemically synthesized
agaagttgaggggggtggct

SEQ ID NO: 144019 - DNA, 20 bp, Artificial Sequence
  chemically synthesized
gaagttgaggggggtggctg

SEQ ID NO: 144020 - DNA, 20 bp, Artificial Sequence
  chemically synthesized
gaggggggtggctgaggaaa

SEQ ID NO: 144021 - DNA, 20 bp, Artificial Sequence
  chemically synthesized
ttacttcttttctatttcct

SEQ ID NO: 144022 - DNA, 20 bp, Artificial Sequence
  chemically synthesized
gggtggctgaggaaatagaa

SEQ ID NO: 144023 - DNA, 20 bp, Artificial Sequence
  chemically synthesized
tggctgaggaaatagaaaag

SEQ ID NO: 144024 - DNA, 20 bp, Artificial Sequence
  chemically synthesized
tgaggaaatagaaaagaagt

SEQ ID NO: 144025 - DNA, 20 bp, Artificial Sequence
  chemically synthesized
aagaaacattatctattccc

SEQ ID NO: 144026 - DNA, 20 bp, Artificial Sequence
  chemically synthesized
gaaacattatctattcccaa

SEQ ID NO: 144027 - DNA, 20 bp, Artificial Sequence
  chemically synthesized
acccccagacctcttgggaa

SEQ ID NO: 144028 - DNA, 20 bp, Artificial Sequence
  chemically synthesized
aaacattatctattcccaag

SEQ ID NO: 144029 - DNA, 20 bp, Artificial Sequence
  chemically synthesized
cccagacccccagacctctt

SEQ ID NO: 144030 - DNA, 20 bp, Artificial Sequence
  chemically synthesized
ttatctattcccaagaggtc

SEQ ID NO: 144031 - DNA, 20 bp, Artificial Sequence
  chemically synthesized
acccagacccccagacctct

SEQ ID NO: 144032 - DNA, 20 bp, Artificial Sequence
  chemically synthesized
tatctattcccaagaggtct

SEQ ID NO: 144033 - DNA, 20 bp, Artificial Sequence
  chemically synthesized
atctattcccaagaggtctg

SEQ ID NO: 144034 - DNA, 20 bp, Artificial Sequence
  chemically synthesized
tctattcccaagaggtctgg

SEQ ID NO: 144035 - DNA, 20 bp, Artificial Sequence
  chemically synthesized
tcccaagaggtctgggggtc

SEQ ID NO: 144036 - DNA, 20 bp, Artificial Sequence
  chemically synthesized
cccaagaggtctgggggtct

SEQ ID NO: 144037 - DNA, 20 bp, Artificial Sequence
  chemically synthesized
ctaacataaacccagacccc

SEQ ID NO: 144038 - DNA, 20 bp, Artificial Sequence
  chemically synthesized
taattgtcctaacataaacc

SEQ ID NO: 144039 - DNA, 20 bp, Artificial Sequence
  chemically synthesized
ctgggggtctgggtttatgt

SEQ ID NO: 144040 - DNA, 20 bp, Artificial Sequence
  chemically synthesized
tgggggtctgggtttatgtt

SEQ ID NO: 144041 - DNA, 20 bp, Artificial Sequence
  chemically synthesized
ttaggacaattacatttact

SEQ ID NO: 144042 - DNA, 20 bp, Artificial Sequence
  chemically synthesized
ttaattgatctaaagtcact

SEQ ID NO: 144043 - DNA, 20 bp, Artificial Sequence
  chemically synthesized
ttacatttactaagtgactt

SEQ ID NO: 144044 - DNA, 20 bp, Artificial Sequence
  chemically synthesized
caatttagttaattgatcta

SEQ ID NO: 144045 - DNA, 20 bp, Artificial Sequence
  chemically synthesized
gagagaagttatagacaatt

SEQ ID NO: 144046 - DNA, 20 bp, Artificial Sequence
  chemically synthesized
tcaacaaatgagagaagtta

SEQ ID NO: 144047 - DNA, 20 bp, Artificial Sequence
  chemically synthesized
ccttattcaacaaatgagag

SEQ ID NO: 144048 - DNA, 20 bp, Artificial Sequence
  chemically synthesized
ttcccttattcaacaaatga

SEQ ID NO: 144049 - DNA, 20 bp, Artificial Sequence
  chemically synthesized
gtttcccttattcaacaaat

SEQ ID NO: 144050 - DNA, 20 bp, Artificial Sequence
  chemically synthesized
acttctctcatttgttgaat

SEQ ID NO: 144051 - DNA, 20 bp, Artificial Sequence
  chemically synthesized
cttctctcatttgttgaata

SEQ ID NO: 144052 - DNA, 20 bp, Artificial Sequence
  chemically synthesized
ttctctcatttgttgaataa

SEQ ID NO: 144053 - DNA, 20 bp, Artificial Sequence
  chemically synthesized
aataagggaaactattgtaa

SEQ ID NO: 144054 - DNA, 20 bp, Artificial Sequence
  chemically synthesized
gcagaaagtggctattacaa

SEQ ID NO: 144055 - DNA, 20 bp, Artificial Sequence
  chemically synthesized
gtcacaaacccagcagaaag

SEQ ID NO: 144056 - DNA, 20 bp, Artificial Sequence
  chemically synthesized
ttgtaatagccactttctgc

SEQ ID NO: 144057 - DNA, 20 bp, Artificial Sequence
  chemically synthesized
tgtaatagccactttctgct

SEQ ID NO: 144058 - DNA, 20 bp, Artificial Sequence
  chemically synthesized
gttgtcacaaacccagcaga

SEQ ID NO: 144059 - DNA, 20 bp, Artificial Sequence
  chemically synthesized
ttctgttgtcacaaacccag

SEQ ID NO: 144060 - DNA, 20 bp, Artificial Sequence
  chemically synthesized
ttattctgttgtcacaaacc

SEQ ID NO: 144061 - DNA, 20 bp, Artificial Sequence
  chemically synthesized
ttctgctgggtttgtgacaa

SEQ ID NO: 144062 - DNA, 20 bp, Artificial Sequence
  chemically synthesized
tgtgacaacagaataaaacc

SEQ ID NO: 144063 - DNA, 20 bp, Artificial Sequence
  chemically synthesized
atacaaaacagaatgtttct

SEQ ID NO: 144064 - DNA, 20 bp, Artificial Sequence
  chemically synthesized
aaactaaaagcaatacaaaa

SEQ ID NO: 144065 - DNA, 20 bp, Artificial Sequence
  chemically synthesized
attctgttttgtattgcttt

SEQ ID NO: 144066 - DNA, 20 bp, Artificial Sequence
  chemically synthesized
gcattggctatttaaactaa

SEQ ID NO: 144067 - DNA, 20 bp, Artificial Sequence
  chemically synthesized
tgtattgcttttagtttaaa

SEQ ID NO: 144068 - DNA, 20 bp, Artificial Sequence
  chemically synthesized
atgtgtgggtaaagtggcat

SEQ ID NO: 144069 - DNA, 20 bp, Artificial Sequence
  chemically synthesized
gggacaatgtgtgggtaaag

SEQ ID NO: 144070 - DNA, 20 bp, Artificial Sequence
  chemically synthesized
gatgggacaatgtgtgggta

SEQ ID NO: 144071 - DNA, 20 bp, Artificial Sequence
  chemically synthesized
gaattgatgggacaatgtgt

SEQ ID NO: 144072 - DNA, 20 bp, Artificial Sequence
  chemically synthesized
agaattgatgggacaatgtg

SEQ ID NO: 144073 - DNA, 20 bp, Artificial Sequence
  chemically synthesized
atagccctggaagaattgat

SEQ ID NO: 144074 - DNA, 20 bp, Artificial Sequence
  chemically synthesized
tatagccctggaagaattga

SEQ ID NO: 144075 - DNA, 20 bp, Artificial Sequence
  chemically synthesized
cattgtcccatcaattcttc

SEQ ID NO: 144076 - DNA, 20 bp, Artificial Sequence
  chemically synthesized
attgtcccatcaattcttcc

SEQ ID NO: 144077 - DNA, 20 bp, Artificial Sequence
  chemically synthesized
ttgtcccatcaattcttcca

SEQ ID NO: 144078 - DNA, 20 bp, Artificial Sequence
  chemically synthesized
cttgtgtagtatagccctgg

SEQ ID NO: 144079 - DNA, 20 bp, Artificial Sequence
  chemically synthesized
caacttgtgtagtatagccc

SEQ ID NO: 144080 - DNA, 20 bp, Artificial Sequence
  chemically synthesized
actaaacaacttgtgtagta

SEQ ID NO: 144081 - DNA, 20 bp, Artificial Sequence
  chemically synthesized
cttccagggctatactacac

SEQ ID NO: 144082 - DNA, 20 bp, Artificial Sequence
  chemically synthesized
tgattactaaacaacttgtg

SEQ ID NO: 144083 - DNA, 20 bp, Artificial Sequence
  chemically synthesized
gctatactacacaagttgtt

SEQ ID NO: 144084 - DNA, 20 bp, Artificial Sequence
  chemically synthesized
tacacaagttgtttagtaat

SEQ ID NO: 144085 - DNA, 20 bp, Artificial Sequence
  chemically synthesized
taacttttggtgaatagatt

SEQ ID NO: 144086 - DNA, 20 bp, Artificial Sequence
  chemically synthesized
tgattataacttttggtgaa

SEQ ID NO: 144087 - DNA, 20 bp, Artificial Sequence
  chemically synthesized
tgactgaatctattcaccaa

SEQ ID NO: 144088 - DNA, 20 bp, Artificial Sequence
  chemically synthesized
ataattctgattataacttt

SEQ ID NO: 144089 - DNA, 20 bp, Artificial Sequence
  chemically synthesized
tattcaccaaaagttataat

SEQ ID NO: 144090 - DNA, 20 bp, Artificial Sequence
  chemically synthesized
ttataatcagaattattctg

SEQ ID NO: 144091 - DNA, 20 bp, Artificial Sequence
  chemically synthesized
aaaagcatttgaattagcta

SEQ ID NO: 144092 - DNA, 20 bp, Artificial Sequence
  chemically synthesized
tacacaaaaagcatttgaat

SEQ ID NO: 144093 - DNA, 20 bp, Artificial Sequence
  chemically synthesized
aaactctgtctatacacaaa

SEQ ID NO: 144094 - DNA, 20 bp, Artificial Sequence
  chemically synthesized
attcaaatgctttttgtgta

SEQ ID NO: 144095 - DNA, 20 bp, Artificial Sequence
  chemically synthesized
aaatgctttttgtgtataga

SEQ ID NO: 144096 - DNA, 20 bp, Artificial Sequence
  chemically synthesized
atgctttttgtgtatagaca

SEQ ID NO: 144097 - DNA, 20 bp, Artificial Sequence
  chemically synthesized
tttaaaaaatcataattttt

SEQ ID NO: 144098 - DNA, 20 bp, Artificial Sequence
  chemically synthesized
tgttgttgttgttaaggtca

SEQ ID NO: 144099 - DNA, 20 bp, Artificial Sequence
  chemically synthesized
aatttttgttgttgttgtta

SEQ ID NO: 144100 - DNA, 20 bp, Artificial Sequence
  chemically synthesized
taatttttgttgttgttgtt

SEQ ID NO: 144101 - DNA, 20 bp, Artificial Sequence
  chemically synthesized
aacaaaaattaaactcattc

SEQ ID NO: 144102 - DNA, 20 bp, Artificial Sequence
  chemically synthesized
tgggacataattacttgaat

SEQ ID NO: 144103 - DNA, 20 bp, Artificial Sequence
  chemically synthesized
ggtatagtgtatatttaaat

SEQ ID NO: 144104 - DNA, 20 bp, Artificial Sequence
  chemically synthesized
gggtatagtgtatatttaaa

SEQ ID NO: 144105 - DNA, 20 bp, Artificial Sequence
  chemically synthesized
atgagcagttttagtgggta

SEQ ID NO: 144106 - DNA, 20 bp, Artificial Sequence
  chemically synthesized
attgaatgagcagttttagt

SEQ ID NO: 144107 - DNA, 20 bp, Artificial Sequence
  chemically synthesized
aattgaatgagcagttttag

SEQ ID NO: 144108 - DNA, 20 bp, Artificial Sequence
  chemically synthesized
aaaaattgaatgagcagttt

SEQ ID NO: 144109 - DNA, 20 bp, Artificial Sequence
  chemically synthesized
ttatctaaaaattgaatgag

SEQ ID NO: 144110 - DNA, 20 bp, Artificial Sequence
  chemically synthesized
tcattatctaaaaattgaat

SEQ ID NO: 144111 - DNA, 20 bp, Artificial Sequence
  chemically synthesized
aaaactgctcattcaatttt

SEQ ID NO: 144112 - DNA, 20 bp, Artificial Sequence
  chemically synthesized
ttttagataatgaaatctcc

SEQ ID NO: 144113 - DNA, 20 bp, Artificial Sequence
  chemically synthesized
tttagataatgaaatctccc

SEQ ID NO: 144114 - DNA, 20 bp, Artificial Sequence
  chemically synthesized
cacattgcactgttacctgg

SEQ ID NO: 144115 - DNA, 20 bp, Artificial Sequence
  chemically synthesized
taatgaaatctcccaggtaa

SEQ ID NO: 144116 - DNA, 20 bp, Artificial Sequence
  chemically synthesized
cacacattgcactgttacct

SEQ ID NO: 144117 - DNA, 20 bp, Artificial Sequence
  chemically synthesized
ccacacattgcactgttacc

SEQ ID NO: 144118 - DNA, 20 bp, Artificial Sequence
  chemically synthesized
ccaggtaacagtgcaatgtg

SEQ ID NO: 144119 - DNA, 20 bp, Artificial Sequence
  chemically synthesized
agatgataatagcattgttc

SEQ ID NO: 144120 - DNA, 20 bp, Artificial Sequence
  chemically synthesized
caatctggacaagatgataa

SEQ ID NO: 144121 - DNA, 20 bp, Artificial Sequence
  chemically synthesized
aatgctattatcatcttgtc

SEQ ID NO: 144122 - DNA, 20 bp, Artificial Sequence
  chemically synthesized
acaaattggccaatctggac

SEQ ID NO: 144123 - DNA, 20 bp, Artificial Sequence
  chemically synthesized
tattatcatcttgtccagat

SEQ ID NO: 144124 - DNA, 20 bp, Artificial Sequence
  chemically synthesized
ttgagacaaattggccaatc

SEQ ID NO: 144125 - DNA, 20 bp, Artificial Sequence
  chemically synthesized
agattggggttgagacaaat

SEQ ID NO: 144126 - DNA, 20 bp, Artificial Sequence
  chemically synthesized
gacctttccagattggggtt

SEQ ID NO: 144127 - DNA, 20 bp, Artificial Sequence
  chemically synthesized
aatttgtctcaaccccaatc

SEQ ID NO: 144128 - DNA, 20 bp, Artificial Sequence
  chemically synthesized
agtaagacctttccagattg

SEQ ID NO: 144129 - DNA, 20 bp, Artificial Sequence
  chemically synthesized
cagtaagacctttccagatt

SEQ ID NO: 144130 - DNA, 20 bp, Artificial Sequence
  chemically synthesized
tgtctcaaccccaatctgga

SEQ ID NO: 144131 - DNA, 20 bp, Artificial Sequence
  chemically synthesized
ccagtaagacctttccagat

SEQ ID NO: 144132 - DNA, 20 bp, Artificial Sequence
  chemically synthesized
gtctcaaccccaatctggaa

SEQ ID NO: 144133 - DNA, 20 bp, Artificial Sequence
  chemically synthesized
atcctccagtaagacctttc

SEQ ID NO: 144134 - DNA, 20 bp, Artificial Sequence
  chemically synthesized
ccaatctggaaaggtcttac

SEQ ID NO: 144135 - DNA, 20 bp, Artificial Sequence
  chemically synthesized
aatctggaaaggtcttactg

SEQ ID NO: 144136 - DNA, 20 bp, Artificial Sequence
  chemically synthesized
atctggaaaggtcttactgg

SEQ ID NO: 144137 - DNA, 20 bp, Artificial Sequence
  chemically synthesized
aaggcattttatcctccagt

SEQ ID NO: 144138 - DNA, 20 bp, Artificial Sequence
  chemically synthesized
ggcaaaggcattttatcctc

SEQ ID NO: 144139 - DNA, 20 bp, Artificial Sequence
  chemically synthesized
ataaagaattgagttggcaa

SEQ ID NO: 144140 - DNA, 20 bp, Artificial Sequence
  chemically synthesized
aataaagaattgagttggca

SEQ ID NO: 144141 - DNA, 20 bp, Artificial Sequence
  chemically synthesized
tattgaataaagaattgagt

SEQ ID NO: 144142 - DNA, 20 bp, Artificial Sequence
  chemically synthesized
cttgtattgaataaagaatt

SEQ ID NO: 144143 - DNA, 20 bp, Artificial Sequence
  chemically synthesized
cactgcacttgtattgaata

SEQ ID NO: 144144 - DNA, 20 bp, Artificial Sequence
  chemically synthesized
ctcaattctttattcaatac

SEQ ID NO: 144145 - DNA, 20 bp, Artificial Sequence
  chemically synthesized
ttctttattcaatacaagtg

SEQ ID NO: 144146 - DNA, 20 bp, Artificial Sequence
  chemically synthesized
tttattcaatacaagtgcag

SEQ ID NO: 144147 - DNA, 20 bp, Artificial Sequence
  chemically synthesized
tcaatacaagtgcagtggtt

SEQ ID NO: 144148 - DNA, 20 bp, Artificial Sequence
  chemically synthesized
gtgcagtggttgagattttg

SEQ ID NO: 144149 - DNA, 20 bp, Artificial Sequence
  chemically synthesized
ggtgaattatcctgaacacc

SEQ ID NO: 144150 - DNA, 20 bp, Artificial Sequence
  chemically synthesized
ttccgtttggccaggtgttc

SEQ ID NO: 144151 - DNA, 20 bp, Artificial Sequence
  chemically synthesized
attccgtttggccaggtgtt

SEQ ID NO: 144152 - DNA, 20 bp, Artificial Sequence
  chemically synthesized
atcctgaacacctggccaaa

SEQ ID NO: 144153 - DNA, 20 bp, Artificial Sequence
  chemically synthesized
tttttcaattccgtttggcc

SEQ ID NO: 144154 - DNA, 20 bp, Artificial Sequence
  chemically synthesized
ttttttcaattccgtttggc

SEQ ID NO: 144155 - DNA, 20 bp, Artificial Sequence
  chemically synthesized
tcttttttttcaattccgtt

SEQ ID NO: 144156 - DNA, 20 bp, Artificial Sequence
  chemically synthesized
gccaaacggaattgaaaaaa

SEQ ID NO: 144157 - DNA, 20 bp, Artificial Sequence
  chemically synthesized
tgcctgtgctgagttaattg

SEQ ID NO: 144158 - DNA, 20 bp, Artificial Sequence
  chemically synthesized
aaaaaagactacaattaact

SEQ ID NO: 144159 - DNA, 20 bp, Artificial Sequence
  chemically synthesized
agactacaattaactcagca

SEQ ID NO: 144160 - DNA, 20 bp, Artificial Sequence
  chemically synthesized
gactacaattaactcagcac

SEQ ID NO: 144161 - DNA, 20 bp, Artificial Sequence
  chemically synthesized
ggtgtctgattgcctgtgct

SEQ ID NO: 144162 - DNA, 20 bp, Artificial Sequence
  chemically synthesized
attaactcagcacaggcaat

SEQ ID NO: 144163 - DNA, 20 bp, Artificial Sequence
  chemically synthesized
cagcacaggcaatcagacac

SEQ ID NO: 144164 - DNA, 20 bp, Artificial Sequence
  chemically synthesized
gatattatttttcataatac

SEQ ID NO: 144165 - DNA, 20 bp, Artificial Sequence
  chemically synthesized
ttatgaaaaataatatcata

SEQ ID NO: 144166 - DNA, 20 bp, Artificial Sequence
  chemically synthesized
atcaacaaatagaatttaga

SEQ ID NO: 144167 - DNA, 20 bp, Artificial Sequence
  chemically synthesized
tgctatcaacaaatagaatt

SEQ ID NO: 144168 - DNA, 20 bp, Artificial Sequence
  chemically synthesized
ctagtgttgctatcaacaaa

SEQ ID NO: 144169 - DNA, 20 bp, Artificial Sequence
  chemically synthesized
atctaaattctatttgttga

SEQ ID NO: 144170 - DNA, 20 bp, Artificial Sequence
  chemically synthesized
ctatttgttgatagcaacac

SEQ ID NO: 144171 - DNA, 20 bp, Artificial Sequence
  chemically synthesized
aggttcccagcagtggagac

SEQ ID NO: 144172 - DNA, 20 bp, Artificial Sequence
  chemically synthesized
gcaacactagtctccactgc

SEQ ID NO: 144173 - DNA, 20 bp, Artificial Sequence
  chemically synthesized
caacactagtctccactgct

SEQ ID NO: 144174 - DNA, 20 bp, Artificial Sequence
  chemically synthesized
aagagaggttcccagcagtg

SEQ ID NO: 144175 - DNA, 20 bp, Artificial Sequence
  chemically synthesized
tgaagagaggttcccagcag

SEQ ID NO: 144176 - DNA, 20 bp, Artificial Sequence
  chemically synthesized
atatgaagagaggttcccag

SEQ ID NO: 144177 - DNA, 20 bp, Artificial Sequence
  chemically synthesized
gaaatatgaagagaggttcc

SEQ ID NO: 144178 - DNA, 20 bp, Artificial Sequence
  chemically synthesized
ggagggggaaatatgaagag

SEQ ID NO: 144179 - DNA, 20 bp, Artificial Sequence
  chemically synthesized
tggagggggaaatatgaaga

SEQ ID NO: 144180 - DNA, 20 bp, Artificial Sequence
  chemically synthesized
ggtggagggggaaatatgaa

SEQ ID NO: 144181 - DNA, 20 bp, Artificial Sequence
  chemically synthesized
aaggtggagggggaaatatg

SEQ ID NO: 144182 - DNA, 20 bp, Artificial Sequence
  chemically synthesized
aggagggagaaaggtggagg

SEQ ID NO: 144183 - DNA, 20 bp, Artificial Sequence
  chemically synthesized
caggagggagaaaggtggag

SEQ ID NO: 144184 - DNA, 20 bp, Artificial Sequence
  chemically synthesized
acaggagggagaaaggtgga

SEQ ID NO: 144185 - DNA, 20 bp, Artificial Sequence
  chemically synthesized
gacaggagggagaaaggtgg

SEQ ID NO: 144186 - DNA, 20 bp, Artificial Sequence
  chemically synthesized
agacaggagggagaaaggtg

SEQ ID NO: 144187 - DNA, 20 bp, Artificial Sequence
  chemically synthesized
ggagacaggagggagaaagg

SEQ ID NO: 144188 - DNA, 20 bp, Artificial Sequence
  chemically synthesized
gtgggagacaggagggagaa

SEQ ID NO: 144189 - DNA, 20 bp, Artificial Sequence
  chemically synthesized
ggtgggagacaggagggaga

SEQ ID NO: 144190 - DNA, 20 bp, Artificial Sequence
  chemically synthesized
ggatggtgggagacaggagg

SEQ ID NO: 144191 - DNA, 20 bp, Artificial Sequence
  chemically synthesized
agggatggtgggagacagga

SEQ ID NO: 144192 - DNA, 20 bp, Artificial Sequence
  chemically synthesized
gagggatggtgggagacagg

SEQ ID NO: 144193 - DNA, 20 bp, Artificial Sequence
  chemically synthesized
agagggatggtgggagacag

SEQ ID NO: 144194 - DNA, 20 bp, Artificial Sequence
  chemically synthesized
gaagagggatggtgggagac

SEQ ID NO: 144195 - DNA, 20 bp, Artificial Sequence
  chemically synthesized
ggaagagggatggtgggaga

SEQ ID NO: 144196 - DNA, 20 bp, Artificial Sequence
  chemically synthesized
aaatggaagagggatggtgg

SEQ ID NO: 144197 - DNA, 20 bp, Artificial Sequence
  chemically synthesized
ggaaatggaagagggatggt

SEQ ID NO: 144198 - DNA, 20 bp, Artificial Sequence
  chemically synthesized
aggaaatggaagagggatgg

SEQ ID NO: 144199 - DNA, 20 bp, Artificial Sequence
  chemically synthesized
aggaggaaatggaagaggga

SEQ ID NO: 144200 - DNA, 20 bp, Artificial Sequence
  chemically synthesized
ggaaaggaggaaatggaaga

SEQ ID NO: 144201 - DNA, 20 bp, Artificial Sequence
  chemically synthesized
aggaaaggaggaaatggaag

SEQ ID NO: 144202 - DNA, 20 bp, Artificial Sequence
  chemically synthesized
gaggaaaggaggaaatggaa

SEQ ID NO: 144203 - DNA, 20 bp, Artificial Sequence
  chemically synthesized
gtgaggaaaggaggaaatgg

SEQ ID NO: 144204 - DNA, 20 bp, Artificial Sequence
  chemically synthesized
ggagtgaggaaaggaggaaa

SEQ ID NO: 144205 - DNA, 20 bp, Artificial Sequence
  chemically synthesized
aaaagaggagtgaggaaagg

SEQ ID NO: 144206 - DNA, 20 bp, Artificial Sequence
  chemically synthesized
caaaagaggagtgaggaaag

SEQ ID NO: 144207 - DNA, 20 bp, Artificial Sequence
  chemically synthesized
gacaaaagaggagtgaggaa

SEQ ID NO: 144208 - DNA, 20 bp, Artificial Sequence
  chemically synthesized
ggacaaaagaggagtgagga

SEQ ID NO: 144209 - DNA, 20 bp, Artificial Sequence
  chemically synthesized
aagaggacaaaagaggagtg

SEQ ID NO: 144210 - DNA, 20 bp, Artificial Sequence
  chemically synthesized
aaagaggacaaaagaggagt

SEQ ID NO: 144211 - DNA, 20 bp, Artificial Sequence
  chemically synthesized
tattaaagaggacaaaagag

SEQ ID NO: 144212 - DNA, 20 bp, Artificial Sequence
  chemically synthesized
aatattaaagaggacaaaag

SEQ ID NO: 144213 - DNA, 20 bp, Artificial Sequence
  chemically synthesized
gaatattaaagaggacaaaa

SEQ ID NO: 144214 - DNA, 20 bp, Artificial Sequence
  chemically synthesized
aggaatattaaagaggacaa

SEQ ID NO: 144215 - DNA, 20 bp, Artificial Sequence
  chemically synthesized
acaagaaaggaatattaaag

SEQ ID NO: 144216 - DNA, 20 bp, Artificial Sequence
  chemically synthesized
gacaagaaaggaatattaaa

SEQ ID NO: 144217 - DNA, 20 bp, Artificial Sequence
  chemically synthesized
aagacaagaaaggaatatta

SEQ ID NO: 144218 - DNA, 20 bp, Artificial Sequence
  chemically synthesized
gaaagaaaaaaagacaagaa

SEQ ID NO: 144219 - DNA, 20 bp, Artificial Sequence
  chemically synthesized
ggaaagaaaaaaagacaaga

SEQ ID NO: 144220 - DNA, 20 bp, Artificial Sequence
  chemically synthesized
gcaaggaaagaaaaaaagac

SEQ ID NO: 144221 - DNA, 20 bp, Artificial Sequence
  chemically synthesized
aggtagcaaggaaagaaaaa

SEQ ID NO: 144222 - DNA, 20 bp, Artificial Sequence
  chemically synthesized
caaaagaaaggtagcaagga

SEQ ID NO: 144223 - DNA, 20 bp, Artificial Sequence
  chemically synthesized
aagacaaaagaaaggtagca

SEQ ID NO: 144224 - DNA, 20 bp, Artificial Sequence
  chemically synthesized
aaagacaaaagaaaggtagc

SEQ ID NO: 144225 - DNA, 20 bp, Artificial Sequence
  chemically synthesized
gagaaaagacaaaagaaagg

SEQ ID NO: 144226 - DNA, 20 bp, Artificial Sequence
  chemically synthesized
agagagaaaagacaaaagaa

SEQ ID NO: 144227 - DNA, 20 bp, Artificial Sequence
  chemically synthesized
gagagagaaaagacaaaaga

SEQ ID NO: 144228 - DNA, 20 bp, Artificial Sequence
  chemically synthesized
gaaggagagagaaaagacaa

SEQ ID NO: 144229 - DNA, 20 bp, Artificial Sequence
  chemically synthesized
aaaaggggaaggagagagaa

SEQ ID NO: 144230 - DNA, 20 bp, Artificial Sequence
  chemically synthesized
caggaaaaaggggaaggaga

SEQ ID NO: 144231 - DNA, 20 bp, Artificial Sequence
  chemically synthesized
agcaggaaaaaggggaagga

SEQ ID NO: 144232 - DNA, 20 bp, Artificial Sequence
  chemically synthesized
aaagcaggaaaaaggggaag

SEQ ID NO: 144233 - DNA, 20 bp, Artificial Sequence
  chemically synthesized
ggaaagcaggaaaaagggga

SEQ ID NO: 144234 - DNA, 20 bp, Artificial Sequence
  chemically synthesized
aggaaagcaggaaaaagggg

SEQ ID NO: 144235 - DNA, 20 bp, Artificial Sequence
  chemically synthesized
ggaaggaaagcaggaaaaag

SEQ ID NO: 144236 - DNA, 20 bp, Artificial Sequence
  chemically synthesized
aggaaggaaagcaggaaaaa

SEQ ID NO: 144237 - DNA, 20 bp, Artificial Sequence
  chemically synthesized
gaggaaggaaagcaggaaaa

SEQ ID NO: 144238 - DNA, 20 bp, Artificial Sequence
  chemically synthesized
agaggaaggaaagcaggaaa

SEQ ID NO: 144239 - DNA, 20 bp, Artificial Sequence
  chemically synthesized
aggaagagaggaaggaaagc

SEQ ID NO: 144240 - DNA, 20 bp, Artificial Sequence
  chemically synthesized
aaggaagagaggaaggaaag

SEQ ID NO: 144241 - DNA, 20 bp, Artificial Sequence
  chemically synthesized
aagaaggaagagaggaagga

SEQ ID NO: 144242 - DNA, 20 bp, Artificial Sequence
  chemically synthesized
aaaaaagaaggaagagagga

SEQ ID NO: 144243 - DNA, 20 bp, Artificial Sequence
  chemically synthesized
aaaaaaagaaggaagagagg

SEQ ID NO: 144244 - DNA, 20 bp, Artificial Sequence
  chemically synthesized
gggaaaaaaagaaggaagag

SEQ ID NO: 144245 - DNA, 20 bp, Artificial Sequence
  chemically synthesized
agggaaaaaaagaaggaaga

SEQ ID NO: 144246 - DNA, 20 bp, Artificial Sequence
  chemically synthesized
aaagggaaaaaaagaaggaa

SEQ ID NO: 144247 - DNA, 20 bp, Artificial Sequence
  chemically synthesized
ggaaagggaaaaaaagaagg

SEQ ID NO: 144248 - DNA, 20 bp, Artificial Sequence
  chemically synthesized
ggaggaaagggaaaaaaaga

SEQ ID NO: 144249 - DNA, 20 bp, Artificial Sequence
  chemically synthesized
aggaggaaagggaaaaaaag

SEQ ID NO: 144250 - DNA, 20 bp, Artificial Sequence
  chemically synthesized
aggaggaggaaagggaaaaa

SEQ ID NO: 144251 - DNA, 20 bp, Artificial Sequence
  chemically synthesized
gggaaggaaggaggaggaaa

SEQ ID NO: 144252 - DNA, 20 bp, Artificial Sequence
  chemically synthesized
agggaaggaaggaggaggaa

SEQ ID NO: 144253 - DNA, 20 bp, Artificial Sequence
  chemically synthesized
aagggaaggaaggaggagga

SEQ ID NO: 144254 - DNA, 20 bp, Artificial Sequence
  chemically synthesized
aagaaagggaaggaaggagg

SEQ ID NO: 144255 - DNA, 20 bp, Artificial Sequence
  chemically synthesized
aaagaaagggaaggaaggag

SEQ ID NO: 144256 - DNA, 20 bp, Artificial Sequence
  chemically synthesized
ggaaagaaagggaaggaagg

SEQ ID NO: 144257 - DNA, 20 bp, Artificial Sequence
  chemically synthesized
aggaaagaaagggaaggaag

SEQ ID NO: 144258 - DNA, 20 bp, Artificial Sequence
  chemically synthesized
ggaggaaagaaagggaagga

SEQ ID NO: 144259 - DNA, 20 bp, Artificial Sequence
  chemically synthesized
gggaggaaagaaagggaagg

SEQ ID NO: 144260 - DNA, 20 bp, Artificial Sequence
  chemically synthesized
gaagggaggaaagaaaggga

SEQ ID NO: 144261 - DNA, 20 bp, Artificial Sequence
  chemically synthesized
agaagggaggaaagaaaggg

SEQ ID NO: 144262 - DNA, 20 bp, Artificial Sequence
  chemically synthesized
caaagaagggaggaaagaaa

SEQ ID NO: 144263 - DNA, 20 bp, Artificial Sequence
  chemically synthesized
acaaagaagggaggaaagaa

SEQ ID NO: 144264 - DNA, 20 bp, Artificial Sequence
  chemically synthesized
aacaaagaagggaggaaaga

SEQ ID NO: 144265 - DNA, 20 bp, Artificial Sequence
  chemically synthesized
agagaacaaagaagggagga

SEQ ID NO: 144266 - DNA, 20 bp, Artificial Sequence
  chemically synthesized
aaggagagaacaaagaaggg

SEQ ID NO: 144267 - DNA, 20 bp, Artificial Sequence
  chemically synthesized
gaaggagagaacaaagaagg

SEQ ID NO: 144268 - DNA, 20 bp, Artificial Sequence
  chemically synthesized
aggaaggagagaacaaagaa

SEQ ID NO: 144269 - DNA, 20 bp, Artificial Sequence
  chemically synthesized
aaggaaggagagaacaaaga

SEQ ID NO: 144270 - DNA, 20 bp, Artificial Sequence
  chemically synthesized
aaaggaaggagagaacaaag

SEQ ID NO: 144271 - DNA, 20 bp, Artificial Sequence
  chemically synthesized
aggaaaggaaggagagaaca

SEQ ID NO: 144272 - DNA, 20 bp, Artificial Sequence
  chemically synthesized
acccttaaggaaaggaagga

SEQ ID NO: 144273 - DNA, 20 bp, Artificial Sequence
  chemically synthesized
tgacccttaaggaaaggaag

SEQ ID NO: 144274 - DNA, 20 bp, Artificial Sequence
  chemically synthesized
tctgacccttaaggaaagga

SEQ ID NO: 144275 - DNA, 20 bp, Artificial Sequence
  chemically synthesized
atctgacccttaaggaaagg

SEQ ID NO: 144276 - DNA, 20 bp, Artificial Sequence
  chemically synthesized
gttctctccttcctttcctt

SEQ ID NO: 144277 - DNA, 20 bp, Artificial Sequence
  chemically synthesized
ttctctccttcctttcctta

SEQ ID NO: 144278 - DNA, 20 bp, Artificial Sequence
  chemically synthesized
taaatctgacccttaaggaa

SEQ ID NO: 144279 - DNA, 20 bp, Artificial Sequence
  chemically synthesized
tctctccttcctttccttaa

SEQ ID NO: 144280 - DNA, 20 bp, Artificial Sequence
  chemically synthesized
ctaaatctgacccttaagga

SEQ ID NO: 144281 - DNA, 20 bp, Artificial Sequence
  chemically synthesized
tccttcctttccttaagggt

SEQ ID NO: 144282 - DNA, 20 bp, Artificial Sequence
  chemically synthesized
attactaaatctgaccctta

SEQ ID NO: 144283 - DNA, 20 bp, Artificial Sequence
  chemically synthesized
gattactaaatctgaccctt

SEQ ID NO: 144284 - DNA, 20 bp, Artificial Sequence
  chemically synthesized
ctttccttaagggtcagatt

SEQ ID NO: 144285 - DNA, 20 bp, Artificial Sequence
  chemically synthesized
agatttagtaatcactctca

SEQ ID NO: 144286 - DNA, 20 bp, Artificial Sequence
  chemically synthesized
tgtcctgggttttgctttga

SEQ ID NO: 144287 - DNA, 20 bp, Artificial Sequence
  chemically synthesized
tatgtcctgggttttgcttt

SEQ ID NO: 144288 - DNA, 20 bp, Artificial Sequence
  chemically synthesized
atcactctcaaagcaaaacc

SEQ ID NO: 144289 - DNA, 20 bp, Artificial Sequence
  chemically synthesized
tcactctcaaagcaaaaccc

SEQ ID NO: 144290 - DNA, 20 bp, Artificial Sequence
  chemically synthesized
tgaagggaaaaatatgtcct

SEQ ID NO: 144291 - DNA, 20 bp, Artificial Sequence
  chemically synthesized
atgaagggaaaaatatgtcc

SEQ ID NO: 144292 - DNA, 20 bp, Artificial Sequence
  chemically synthesized
gacataatctatcaaatgaa

SEQ ID NO: 144293 - DNA, 20 bp, Artificial Sequence
  chemically synthesized
tgacataatctatcaaatga

SEQ ID NO: 144294 - DNA, 20 bp, Artificial Sequence
  chemically synthesized
atatttttcccttcatttga

SEQ ID NO: 144295 - DNA, 20 bp, Artificial Sequence
  chemically synthesized
ttgacataatctatcaaatg

SEQ ID NO: 144296 - DNA, 20 bp, Artificial Sequence
  chemically synthesized
tttgatagattatgtcaaaa

SEQ ID NO: 144297 - DNA, 20 bp, Artificial Sequence
  chemically synthesized
caatatttgacaagaattag

SEQ ID NO: 144298 - DNA, 20 bp, Artificial Sequence
  chemically synthesized
caacaatatttgacaagaat

SEQ ID NO: 144299 - DNA, 20 bp, Artificial Sequence
  chemically synthesized
ctgaaacaacaatatttgac

SEQ ID NO: 144300 - DNA, 20 bp, Artificial Sequence
  chemically synthesized
cttgtcaaatattgttgttt

SEQ ID NO: 144301 - DNA, 20 bp, Artificial Sequence
  chemically synthesized
tgtcaaatattgttgtttca

SEQ ID NO: 144302 - DNA, 20 bp, Artificial Sequence
  chemically synthesized
ctgtttcatcacataaacat

SEQ ID NO: 144303 - DNA, 20 bp, Artificial Sequence
  chemically synthesized
cttatgtttatgtgatgaaa

SEQ ID NO: 144304 - DNA, 20 bp, Artificial Sequence
  chemically synthesized
tttatgtgatgaaacagaaa

SEQ ID NO: 144305 - DNA, 20 bp, Artificial Sequence
  chemically synthesized
cagaaaaagcattttttaat

SEQ ID NO: 144306 - DNA, 20 bp, Artificial Sequence
  chemically synthesized
aatcagatttctccgacact

SEQ ID NO: 144307 - DNA, 20 bp, Artificial Sequence
  chemically synthesized
tactttatagcttagtgtcg

SEQ ID NO: 144308 - DNA, 20 bp, Artificial Sequence
  chemically synthesized
tgtactttatagcttagtgt

SEQ ID NO: 144309 - DNA, 20 bp, Artificial Sequence
  chemically synthesized
ttctccgacactaagctata

SEQ ID NO: 144310 - DNA, 20 bp, Artificial Sequence
  chemically synthesized
atgatttgtactttatagct

SEQ ID NO: 144311 - DNA, 20 bp, Artificial Sequence
  chemically synthesized
agtggatgatttgtacttta

SEQ ID NO: 144312 - DNA, 20 bp, Artificial Sequence
  chemically synthesized
gaattgtgaatcaatagcag

SEQ ID NO: 144313 - DNA, 20 bp, Artificial Sequence
  chemically synthesized
ctagaattgtgaatcaatag

SEQ ID NO: 144314 - DNA, 20 bp, Artificial Sequence
  chemically synthesized
tttctagaattgtgaatcaa

SEQ ID NO: 144315 - DNA, 20 bp, Artificial Sequence
  chemically synthesized
ctgctattgattcacaattc

SEQ ID NO: 144316 - DNA, 20 bp, Artificial Sequence
  chemically synthesized
gaagttcaaagtttaatttc

SEQ ID NO: 144317 - DNA, 20 bp, Artificial Sequence
  chemically synthesized
taaagcacacatgaagttca

SEQ ID NO: 144318 - DNA, 20 bp, Artificial Sequence
  chemically synthesized
ttagaagtaaagcacacatg

SEQ ID NO: 144319 - DNA, 20 bp, Artificial Sequence
  chemically synthesized
aaattaagcctttagaagta

SEQ ID NO: 144320 - DNA, 20 bp, Artificial Sequence
  chemically synthesized
tcatgtgtgctttacttcta

SEQ ID NO: 144321 - DNA, 20 bp, Artificial Sequence
  chemically synthesized
catgtgtgctttacttctaa

SEQ ID NO: 144322 - DNA, 20 bp, Artificial Sequence
  chemically synthesized
tatgcaaattaagcctttag

SEQ ID NO: 144323 - DNA, 20 bp, Artificial Sequence
  chemically synthesized
aaatatgcaaattaagcctt

SEQ ID NO: 144324 - DNA, 20 bp, Artificial Sequence
  chemically synthesized
agatgtgaaatatgcaaatt

SEQ ID NO: 144325 - DNA, 20 bp, Artificial Sequence
  chemically synthesized
cattatcttttagaagaata

SEQ ID NO: 144326 - DNA, 20 bp, Artificial Sequence
  chemically synthesized
accattatcttttagaagaa

SEQ ID NO: 144327 - DNA, 20 bp, Artificial Sequence
  chemically synthesized
tcacatctctattcttctaa

SEQ ID NO: 144328 - DNA, 20 bp, Artificial Sequence
  chemically synthesized
aatataccattatcttttag

SEQ ID NO: 144329 - DNA, 20 bp, Artificial Sequence
  chemically synthesized
gaaaatataccattatcttt

SEQ ID NO: 144330 - DNA, 20 bp, Artificial Sequence
  chemically synthesized
tctattcttctaaaagataa

SEQ ID NO: 144331 - DNA, 20 bp, Artificial Sequence
  chemically synthesized
atctgcttcattttagacag

SEQ ID NO: 144332 - DNA, 20 bp, Artificial Sequence
  chemically synthesized
caaatctgcttcattttaga

SEQ ID NO: 144333 - DNA, 20 bp, Artificial Sequence
  chemically synthesized
attttctactgtctaaaatg

SEQ ID NO: 144334 - DNA, 20 bp, Artificial Sequence
  chemically synthesized
taagcaaatctgcttcattt

SEQ ID NO: 144335 - DNA, 20 bp, Artificial Sequence
  chemically synthesized
ttctactgtctaaaatgaag

SEQ ID NO: 144336 - DNA, 20 bp, Artificial Sequence
  chemically synthesized
tacagccatttaaaaaaatt

SEQ ID NO: 144337 - DNA, 20 bp, Artificial Sequence
  chemically synthesized
atttgcttaatttttttaaa

SEQ ID NO: 144338 - DNA, 20 bp, Artificial Sequence
  chemically synthesized
ttttttaagttttaagaata

SEQ ID NO: 144339 - DNA, 20 bp, Artificial Sequence
  chemically synthesized
ctttaatttttttaagtttt

SEQ ID NO: 144340 - DNA, 20 bp, Artificial Sequence
  chemically synthesized
attacaactttaattttttt

SEQ ID NO: 144341 - DNA, 20 bp, Artificial Sequence
  chemically synthesized
cttaaaacttaaaaaaatta

SEQ ID NO: 144342 - DNA, 20 bp, Artificial Sequence
  chemically synthesized
aaaaattaaagttgtaattg

SEQ ID NO: 144343 - DNA, 20 bp, Artificial Sequence
  chemically synthesized
atattcagtgaaaaaaatgg

SEQ ID NO: 144344 - DNA, 20 bp, Artificial Sequence
  chemically synthesized
attatattcagtgaaaaaaa

SEQ ID NO: 144345 - DNA, 20 bp, Artificial Sequence
  chemically synthesized
tttactaagtgaattatatt

SEQ ID NO: 144346 - DNA, 20 bp, Artificial Sequence
  chemically synthesized
ttcactgaatataattcact

SEQ ID NO: 144347 - DNA, 20 bp, Artificial Sequence
  chemically synthesized
aaataaaaataatttttact

SEQ ID NO: 144348 - DNA, 20 bp, Artificial Sequence
  chemically synthesized
aaattatttttatttcaaaa

SEQ ID NO: 144349 - DNA, 20 bp, Artificial Sequence
  chemically synthesized
ttatttttatttcaaaatgg

SEQ ID NO: 144350 - DNA, 20 bp, Artificial Sequence
  chemically synthesized
tttttatttcaaaatggaag

SEQ ID NO: 144351 - DNA, 20 bp, Artificial Sequence
  chemically synthesized
gtattattttagaaaatggt

SEQ ID NO: 144352 - DNA, 20 bp, Artificial Sequence
  chemically synthesized
taaagtattattttagaaaa

SEQ ID NO: 144353 - DNA, 20 bp, Artificial Sequence
  chemically synthesized
gcttgattaaagtattattt

SEQ ID NO: 144354 - DNA, 20 bp, Artificial Sequence
  chemically synthesized
tctaaaataatactttaatc

SEQ ID NO: 144355 - DNA, 20 bp, Artificial Sequence
  chemically synthesized
tagtatgtattgcttgatta

SEQ ID NO: 144356 - DNA, 20 bp, Artificial Sequence
  chemically synthesized
taatcaagcaatacatacta

SEQ ID NO: 144357 - DNA, 20 bp, Artificial Sequence
  chemically synthesized
aatcaagcaatacatactaa

SEQ ID NO: 144358 - DNA, 20 bp, Artificial Sequence
  chemically synthesized
atcaagcaatacatactaaa

SEQ ID NO: 144359 - DNA, 20 bp, Artificial Sequence
  chemically synthesized
tcaagcaatacatactaaag

SEQ ID NO: 144360 - DNA, 20 bp, Artificial Sequence
  chemically synthesized
gaaaagcttatggtcccctt

SEQ ID NO: 144361 - DNA, 20 bp, Artificial Sequence
  chemically synthesized
tacatactaaaggggaccat

SEQ ID NO: 144362 - DNA, 20 bp, Artificial Sequence
  chemically synthesized
catatttggtgaaaagctta

SEQ ID NO: 144363 - DNA, 20 bp, Artificial Sequence
  chemically synthesized
cagaaaacatatttggtgaa

SEQ ID NO: 144364 - DNA, 20 bp, Artificial Sequence
  chemically synthesized
ttgaactcagaaaacatatt

SEQ ID NO: 144365 - DNA, 20 bp, Artificial Sequence
  chemically synthesized
tttcaccaaatatgttttct

SEQ ID NO: 144366 - DNA, 20 bp, Artificial Sequence
  chemically synthesized
aaatatgttttctgagttca

SEQ ID NO: 144367 - DNA, 20 bp, Artificial Sequence
  chemically synthesized
ctagctttagactttgaact

SEQ ID NO: 144368 - DNA, 20 bp, Artificial Sequence
  chemically synthesized
ttttctgagttcaaagtcta

SEQ ID NO: 144369 - DNA, 20 bp, Artificial Sequence
  chemically synthesized
ctgagttcaaagtctaaagc

SEQ ID NO: 144370 - DNA, 20 bp, Artificial Sequence
  chemically synthesized
agctaacctttcactagctt

SEQ ID NO: 144371 - DNA, 20 bp, Artificial Sequence
  chemically synthesized
tcaaagtctaaagctagtga

SEQ ID NO: 144372 - DNA, 20 bp, Artificial Sequence
  chemically synthesized
caaagtctaaagctagtgaa

SEQ ID NO: 144373 - DNA, 20 bp, Artificial Sequence
  chemically synthesized
caagtaagctaacctttcac

SEQ ID NO: 144374 - DNA, 20 bp, Artificial Sequence
  chemically synthesized
gtctaaagctagtgaaaggt

SEQ ID NO: 144375 - DNA, 20 bp, Artificial Sequence
  chemically synthesized
taaggacatgacattcaagt

SEQ ID NO: 144376 - DNA, 20 bp, Artificial Sequence
  chemically synthesized
ggtataaggacatgacattc

SEQ ID NO: 144377 - DNA, 20 bp, Artificial Sequence
  chemically synthesized
tttgccacagaaggggtata

SEQ ID NO: 144378 - DNA, 20 bp, Artificial Sequence
  chemically synthesized
atttgccacagaaggggtat

SEQ ID NO: 144379 - DNA, 20 bp, Artificial Sequence
  chemically synthesized
atgtccttataccccttctg

SEQ ID NO: 144380 - DNA, 20 bp, Artificial Sequence
  chemically synthesized
tgaaatatttgccacagaag

SEQ ID NO: 144381 - DNA, 20 bp, Artificial Sequence
  chemically synthesized
ttgaaatatttgccacagaa

SEQ ID NO: 144382 - DNA, 20 bp, Artificial Sequence
  chemically synthesized
attgaaatatttgccacaga

SEQ ID NO: 144383 - DNA, 20 bp, Artificial Sequence
  chemically synthesized
aattgaaatatttgccacag

SEQ ID NO: 144384 - DNA, 20 bp, Artificial Sequence
  chemically synthesized
agtaattgaaatatttgcca

SEQ ID NO: 144385 - DNA, 20 bp, Artificial Sequence
  chemically synthesized
atttcaattactgcacgtct

SEQ ID NO: 144386 - DNA, 20 bp, Artificial Sequence
  chemically synthesized
cagaccaaaccttagacgtg

SEQ ID NO: 144387 - DNA, 20 bp, Artificial Sequence
  chemically synthesized
tttcaattactgcacgtcta

SEQ ID NO: 144388 - DNA, 20 bp, Artificial Sequence
  chemically synthesized
attactgcacgtctaaggtt

SEQ ID NO: 144389 - DNA, 20 bp, Artificial Sequence
  chemically synthesized
atgagattcagaccaaacct

SEQ ID NO: 144390 - DNA, 20 bp, Artificial Sequence
  chemically synthesized
gcaaagttagttatgagatt

SEQ ID NO: 144391 - DNA, 20 bp, Artificial Sequence
  chemically synthesized
ctcaaggcaaagttagttat

SEQ ID NO: 144392 - DNA, 20 bp, Artificial Sequence
  chemically synthesized
tttatgactcaaggcaaagt

SEQ ID NO: 144393 - DNA, 20 bp, Artificial Sequence
  chemically synthesized
ctcataactaactttgcctt

SEQ ID NO: 144394 - DNA, 20 bp, Artificial Sequence
  chemically synthesized
acattttatgactcaaggca

SEQ ID NO: 144395 - DNA, 20 bp, Artificial Sequence
  chemically synthesized
atgagacattttatgactca

SEQ ID NO: 144396 - DNA, 20 bp, Artificial Sequence
  chemically synthesized
aatgagacattttatgactc

SEQ ID NO: 144397 - DNA, 20 bp, Artificial Sequence
  chemically synthesized
gatagataagataatgcaat

SEQ ID NO: 144398 - DNA, 20 bp, Artificial Sequence
  chemically synthesized
caaagcaccagaagatagat

SEQ ID NO: 144399 - DNA, 20 bp, Artificial Sequence
  chemically synthesized
gcattatcttatctatcttc

SEQ ID NO: 144400 - DNA, 20 bp, Artificial Sequence
  chemically synthesized
aattccaaagcaccagaaga

SEQ ID NO: 144401 - DNA, 20 bp, Artificial Sequence
  chemically synthesized
ttataattccaaagcaccag

SEQ ID NO: 144402 - DNA, 20 bp, Artificial Sequence
  chemically synthesized
ttatctatcttctggtgctt

SEQ ID NO: 144403 - DNA, 20 bp, Artificial Sequence
  chemically synthesized
ggattataattccaaagcac

SEQ ID NO: 144404 - DNA, 20 bp, Artificial Sequence
  chemically synthesized
atgtgaggattataattcca

SEQ ID NO: 144405 - DNA, 20 bp, Artificial Sequence
  chemically synthesized
gaattataatcctcacattc

SEQ ID NO: 144406 - DNA, 20 bp, Artificial Sequence
  chemically synthesized
tcaacaaagactggaatgtg

SEQ ID NO: 144407 - DNA, 20 bp, Artificial Sequence
  chemically synthesized
ttcaacaaagactggaatgt

SEQ ID NO: 144408 - DNA, 20 bp, Artificial Sequence
  chemically synthesized
acttcatattcaacaaagac

SEQ ID NO: 144409 - DNA, 20 bp, Artificial Sequence
  chemically synthesized
aggaaacttcatattcaaca

SEQ ID NO: 144410 - DNA, 20 bp, Artificial Sequence
  chemically synthesized
tccagtctttgttgaatatg

SEQ ID NO: 144411 - DNA, 20 bp, Artificial Sequence
  chemically synthesized
aatgtgaatgcaatgtgata

SEQ ID NO: 144412 - DNA, 20 bp, Artificial Sequence
  chemically synthesized
taatgtgaatgcaatgtgat

SEQ ID NO: 144413 - DNA, 20 bp, Artificial Sequence
  chemically synthesized
ttgcattcacattatccatc

SEQ ID NO: 144414 - DNA, 20 bp, Artificial Sequence
  chemically synthesized
aataaatgtggatagcttga

SEQ ID NO: 144415 - DNA, 20 bp, Artificial Sequence
  chemically synthesized
tggttctcaataaatgtgga

SEQ ID NO: 144416 - DNA, 20 bp, Artificial Sequence
  chemically synthesized
taattggttctcaataaatg

SEQ ID NO: 144417 - DNA, 20 bp, Artificial Sequence
  chemically synthesized
tcaagctatccacatttatt

SEQ ID NO: 144418 - DNA, 20 bp, Artificial Sequence
  chemically synthesized
accatgacacgtacagtaat

SEQ ID NO: 144419 - DNA, 20 bp, Artificial Sequence
  chemically synthesized
ttgtttgaccatgacacgta

SEQ ID NO: 144420 - DNA, 20 bp, Artificial Sequence
  chemically synthesized
accaattactgtacgtgtca

SEQ ID NO: 144421 - DNA, 20 bp, Artificial Sequence
  chemically synthesized
ggtcaaacaaatttatattt

SEQ ID NO: 144422 - DNA, 20 bp, Artificial Sequence
  chemically synthesized
gtcaaacaaatttatatttc

SEQ ID NO: 144423 - DNA, 20 bp, Artificial Sequence
  chemically synthesized
caaatttatatttcaggtat

SEQ ID NO: 144424 - DNA, 20 bp, Artificial Sequence
  chemically synthesized
ttcaggtattggtatatgaa

SEQ ID NO: 144425 - DNA, 20 bp, Artificial Sequence
  chemically synthesized
tatatgaatggtctttattt

SEQ ID NO: 144426 - DNA, 20 bp, Artificial Sequence
  chemically synthesized
atatgaatggtctttatttc

SEQ ID NO: 144427 - DNA, 20 bp, Artificial Sequence
  chemically synthesized
caacgtgtagacctgaaata

SEQ ID NO: 144428 - DNA, 20 bp, Artificial Sequence
  chemically synthesized
ctactcaacttcacaacgtg

SEQ ID NO: 144429 - DNA, 20 bp, Artificial Sequence
  chemically synthesized
tttcaggtctacacgttgtg

SEQ ID NO: 144430 - DNA, 20 bp, Artificial Sequence
  chemically synthesized
ggtctacacgttgtgaagtt

SEQ ID NO: 144431 - DNA, 20 bp, Artificial Sequence
  chemically synthesized
ctacacgttgtgaagttgag

SEQ ID NO: 144432 - DNA, 20 bp, Artificial Sequence
  chemically synthesized
agtagatgaacctgttgctt

SEQ ID NO: 144433 - DNA, 20 bp, Artificial Sequence
  chemically synthesized
tacagctgatctaaagcaac

SEQ ID NO: 144434 - DNA, 20 bp, Artificial Sequence
  chemically synthesized
atacagctgatctaaagcaa

SEQ ID NO: 144435 - DNA, 20 bp, Artificial Sequence
  chemically synthesized
atgaacctgttgctttagat

SEQ ID NO: 144436 - DNA, 20 bp, Artificial Sequence
  chemically synthesized
gattggatacagctgatcta

SEQ ID NO: 144437 - DNA, 20 bp, Artificial Sequence
  chemically synthesized
ggaagccaaaagattggata

SEQ ID NO: 144438 - DNA, 20 bp, Artificial Sequence
  chemically synthesized
atcagctgtatccaatcttt

SEQ ID NO: 144439 - DNA, 20 bp, Artificial Sequence
  chemically synthesized
gcccagggaagccaaaagat

SEQ ID NO: 144440 - DNA, 20 bp, Artificial Sequence
  chemically synthesized
gtgtggcccagggaagccaa

SEQ ID NO: 144441 - DNA, 20 bp, Artificial Sequence
  chemically synthesized
atccaatcttttggcttccc

SEQ ID NO: 144442 - DNA, 20 bp, Artificial Sequence
  chemically synthesized
tccaatcttttggcttccct

SEQ ID NO: 144443 - DNA, 20 bp, Artificial Sequence
  chemically synthesized
tcttccagtgtggcccaggg

SEQ ID NO: 144444 - DNA, 20 bp, Artificial Sequence
  chemically synthesized
tcttcttccagtgtggccca

SEQ ID NO: 144445 - DNA, 20 bp, Artificial Sequence
  chemically synthesized
ttcttcttccagtgtggccc

SEQ ID NO: 144446 - DNA, 20 bp, Artificial Sequence
  chemically synthesized
attcttcttccagtgtggcc

SEQ ID NO: 144447 - DNA, 20 bp, Artificial Sequence
  chemically synthesized
ttggcttccctgggccacac

SEQ ID NO: 144448 - DNA, 20 bp, Artificial Sequence
  chemically synthesized
gcttccctgggccacactgg

SEQ ID NO: 144449 - DNA, 20 bp, Artificial Sequence
  chemically synthesized
ggacaattcttcttccagtg

SEQ ID NO: 144450 - DNA, 20 bp, Artificial Sequence
  chemically synthesized
tccctgggccacactggaag

SEQ ID NO: 144451 - DNA, 20 bp, Artificial Sequence
  chemically synthesized
gcccaggacaattcttcttc

SEQ ID NO: 144452 - DNA, 20 bp, Artificial Sequence
  chemically synthesized
cactggaagaagaattgtcc

SEQ ID NO: 144453 - DNA, 20 bp, Artificial Sequence
  chemically synthesized
actggaagaagaattgtcct

SEQ ID NO: 144454 - DNA, 20 bp, Artificial Sequence
  chemically synthesized
gtgtattttatgtgtggccc

SEQ ID NO: 144455 - DNA, 20 bp, Artificial Sequence
  chemically synthesized
agtgtattttatgtgtggcc

SEQ ID NO: 144456 - DNA, 20 bp, Artificial Sequence
  chemically synthesized
gtgttagtgtattttatgtg

SEQ ID NO: 144457 - DNA, 20 bp, Artificial Sequence
  chemically synthesized
tcatcagctatcattagtgt

SEQ ID NO: 144458 - DNA, 20 bp, Artificial Sequence
  chemically synthesized
aaatacactaacactaatga

SEQ ID NO: 144459 - DNA, 20 bp, Artificial Sequence
  chemically synthesized
ttttgctcatcagctatcat

SEQ ID NO: 144460 - DNA, 20 bp, Artificial Sequence
  chemically synthesized
taacactaatgatagctgat

SEQ ID NO: 144461 - DNA, 20 bp, Artificial Sequence
  chemically synthesized
tgtgacttttttttgctcat

SEQ ID NO: 144462 - DNA, 20 bp, Artificial Sequence
  chemically synthesized
gatagctgatgagcaaaaaa

SEQ ID NO: 144463 - DNA, 20 bp, Artificial Sequence
  chemically synthesized
gagcaaaaaaaagtcacaaa

SEQ ID NO: 144464 - DNA, 20 bp, Artificial Sequence
  chemically synthesized
caaaaagtatctcatgtttt

SEQ ID NO: 144465 - DNA, 20 bp, Artificial Sequence
  chemically synthesized
tgtaaactttcttaaaacat

SEQ ID NO: 144466 - DNA, 20 bp, Artificial Sequence
  chemically synthesized
aagtatctcatgttttaaga

SEQ ID NO: 144467 - DNA, 20 bp, Artificial Sequence
  chemically synthesized
gaaagtttacaaatttgtgt

SEQ ID NO: 144468 - DNA, 20 bp, Artificial Sequence
  chemically synthesized
aaagtttacaaatttgtgtt

SEQ ID NO: 144469 - DNA, 20 bp, Artificial Sequence
  chemically synthesized
tttgtgttgggccacattca

SEQ ID NO: 144470 - DNA, 20 bp, Artificial Sequence
  chemically synthesized
tcccaggatggctttgaatg

SEQ ID NO: 144471 - DNA, 20 bp, Artificial Sequence
  chemically synthesized
ggccacattcaaagccatcc

SEQ ID NO: 144472 - DNA, 20 bp, Artificial Sequence
  chemically synthesized
gccacattcaaagccatcct

SEQ ID NO: 144473 - DNA, 20 bp, Artificial Sequence
  chemically synthesized
gagccacatgcgtcccagga

SEQ ID NO: 144474 - DNA, 20 bp, Artificial Sequence
  chemically synthesized
ctgtgagccacatgcgtccc

SEQ ID NO: 144475 - DNA, 20 bp, Artificial Sequence
  chemically synthesized
cctgtgagccacatgcgtcc

SEQ ID NO: 144476 - DNA, 20 bp, Artificial Sequence
  chemically synthesized
aagccatcctgggacgcatg

SEQ ID NO: 144477 - DNA, 20 bp, Artificial Sequence
  chemically synthesized
cctgggacgcatgtggctca

SEQ ID NO: 144478 - DNA, 20 bp, Artificial Sequence
  chemically synthesized
ctgggacgcatgtggctcac

SEQ ID NO: 144479 - DNA, 20 bp, Artificial Sequence
  chemically synthesized
ttgttcaactcatggcctgt

SEQ ID NO: 144480 - DNA, 20 bp, Artificial Sequence
  chemically synthesized
gcatgtggctcacaggccat

SEQ ID NO: 144481 - DNA, 20 bp, Artificial Sequence
  chemically synthesized
aagcaagcttgttcaactca

SEQ ID NO: 144482 - DNA, 20 bp, Artificial Sequence
  chemically synthesized
tcacaggccatgagttgaac

SEQ ID NO: 144483 - DNA, 20 bp, Artificial Sequence
  chemically synthesized
tgagttgaacaagcttgctt

SEQ ID NO: 144484 - DNA, 20 bp, Artificial Sequence
  chemically synthesized
taattattatgatctaaagc

SEQ ID NO: 144485 - DNA, 20 bp, Artificial Sequence
  chemically synthesized
gaggtaattattatgatcta

SEQ ID NO: 144486 - DNA, 20 bp, Artificial Sequence
  chemically synthesized
aaataaaggagatttgtagg

SEQ ID NO: 144487 - DNA, 20 bp, Artificial Sequence
  chemically synthesized
caaataaaggagatttgtag

SEQ ID NO: 144488 - DNA, 20 bp, Artificial Sequence
  chemically synthesized
agcaaataaaggagatttgt

SEQ ID NO: 144489 - DNA, 20 bp, Artificial Sequence
  chemically synthesized
gagcaaataaaggagatttg

SEQ ID NO: 144490 - DNA, 20 bp, Artificial Sequence
  chemically synthesized
ggaggatagagcaaataaag

SEQ ID NO: 144491 - DNA, 20 bp, Artificial Sequence
  chemically synthesized
ttggaggatagagcaaataa

SEQ ID NO: 144492 - DNA, 20 bp, Artificial Sequence
  chemically synthesized
gttggaggatagagcaaata

SEQ ID NO: 144493 - DNA, 20 bp, Artificial Sequence
  chemically synthesized
gtagaataagttggaggata

SEQ ID NO: 144494 - DNA, 20 bp, Artificial Sequence
  chemically synthesized
atgtagaataagttggagga

SEQ ID NO: 144495 - DNA, 20 bp, Artificial Sequence
  chemically synthesized
gaacatgtagaataagttgg

SEQ ID NO: 144496 - DNA, 20 bp, Artificial Sequence
  chemically synthesized
agaacatgtagaataagttg

SEQ ID NO: 144497 - DNA, 20 bp, Artificial Sequence
  chemically synthesized
caagaacatgtagaataagt

SEQ ID NO: 144498 - DNA, 20 bp, Artificial Sequence
  chemically synthesized
cagtcaagaacatgtagaat

SEQ ID NO: 144499 - DNA, 20 bp, Artificial Sequence
  chemically synthesized
tgaactcagtcaagaacatg

SEQ ID NO: 144500 - DNA, 20 bp, Artificial Sequence
  chemically synthesized
tattctacatgttcttgact

SEQ ID NO: 144501 - DNA, 20 bp, Artificial Sequence
  chemically synthesized
attgtccactgaactcagtc

SEQ ID NO: 144502 - DNA, 20 bp, Artificial Sequence
  chemically synthesized
tacatgttcttgactgagtt

SEQ ID NO: 144503 - DNA, 20 bp, Artificial Sequence
  chemically synthesized
atgttcttgactgagttcag

SEQ ID NO: 144504 - DNA, 20 bp, Artificial Sequence
  chemically synthesized
caataattgtccactgaact

SEQ ID NO: 144505 - DNA, 20 bp, Artificial Sequence
  chemically synthesized
ttcagtggacaattattgtt

SEQ ID NO: 144506 - DNA, 20 bp, Artificial Sequence
  chemically synthesized
agtggacaattattgtttag

SEQ ID NO: 144507 - DNA, 20 bp, Artificial Sequence
  chemically synthesized
gacaattattgtttagtggt

SEQ ID NO: 144508 - DNA, 20 bp, Artificial Sequence
  chemically synthesized
attattgtttagtggttggt

SEQ ID NO: 144509 - DNA, 20 bp, Artificial Sequence
  chemically synthesized
gttctattgacaatagaaga

SEQ ID NO: 144510 - DNA, 20 bp, Artificial Sequence
  chemically synthesized
ggttctattgacaatagaag

SEQ ID NO: 144511 - DNA, 20 bp, Artificial Sequence
  chemically synthesized
ctgggttctattgacaatag

SEQ ID NO: 144512 - DNA, 20 bp, Artificial Sequence
  chemically synthesized
tttccttcttctattgtcaa

SEQ ID NO: 144513 - DNA, 20 bp, Artificial Sequence
  chemically synthesized
aaactgggttctattgacaa

SEQ ID NO: 144514 - DNA, 20 bp, Artificial Sequence
  chemically synthesized
cttctattgtcaatagaacc

SEQ ID NO: 144515 - DNA, 20 bp, Artificial Sequence
  chemically synthesized
aattctcctgaatagaaact

SEQ ID NO: 144516 - DNA, 20 bp, Artificial Sequence
  chemically synthesized
caattctcctgaatagaaac

SEQ ID NO: 144517 - DNA, 20 bp, Artificial Sequence
  chemically synthesized
aatagaacccagtttctatt

SEQ ID NO: 144518 - DNA, 20 bp, Artificial Sequence
  chemically synthesized
atagaacccagtttctattc

SEQ ID NO: 144519 - DNA, 20 bp, Artificial Sequence
  chemically synthesized
agaacccagtttctattcag

SEQ ID NO: 144520 - DNA, 20 bp, Artificial Sequence
  chemically synthesized
ggaaaggcaattctcctgaa

SEQ ID NO: 144521 - DNA, 20 bp, Artificial Sequence
  chemically synthesized
aaagtctcaaaattagggaa

SEQ ID NO: 144522 - DNA, 20 bp, Artificial Sequence
  chemically synthesized
caaagtctcaaaattaggga

SEQ ID NO: 144523 - DNA, 20 bp, Artificial Sequence
  chemically synthesized
aattgcctttccctaatttt

SEQ ID NO: 144524 - DNA, 20 bp, Artificial Sequence
  chemically synthesized
ctcccaaagtctcaaaatta

SEQ ID NO: 144525 - DNA, 20 bp, Artificial Sequence
  chemically synthesized
cctcccaaagtctcaaaatt

SEQ ID NO: 144526 - DNA, 20 bp, Artificial Sequence
  chemically synthesized
tcctcccaaagtctcaaaat

SEQ ID NO: 144527 - DNA, 20 bp, Artificial Sequence
  chemically synthesized
tttccctaattttgagactt

SEQ ID NO: 144528 - DNA, 20 bp, Artificial Sequence
  chemically synthesized
ttccctaattttgagacttt

SEQ ID NO: 144529 - DNA, 20 bp, Artificial Sequence
  chemically synthesized
ccctaattttgagactttgg

SEQ ID NO: 144530 - DNA, 20 bp, Artificial Sequence
  chemically synthesized
cctaattttgagactttggg

SEQ ID NO: 144531 - DNA, 20 bp, Artificial Sequence
  chemically synthesized
taattttgagactttgggag

SEQ ID NO: 144532 - DNA, 20 bp, Artificial Sequence
  chemically synthesized
tttaaatccctctcctccca

SEQ ID NO: 144533 - DNA, 20 bp, Artificial Sequence
  chemically synthesized
attttgagactttgggagga

SEQ ID NO: 144534 - DNA, 20 bp, Artificial Sequence
  chemically synthesized
ttttgagactttgggaggag

SEQ ID NO: 144535 - DNA, 20 bp, Artificial Sequence
  chemically synthesized
tttgagactttgggaggaga

SEQ ID NO: 144536 - DNA, 20 bp, Artificial Sequence
  chemically synthesized
gaggagagggatttaaatca

SEQ ID NO: 144537 - DNA, 20 bp, Artificial Sequence
  chemically synthesized
atacatgagctagaagggag

SEQ ID NO: 144538 - DNA, 20 bp, Artificial Sequence
  chemically synthesized
caaagttttctgctcccttc

SEQ ID NO: 144539 - DNA, 20 bp, Artificial Sequence
  chemically synthesized
ttaatacatgagctagaagg

SEQ ID NO: 144540 - DNA, 20 bp, Artificial Sequence
  chemically synthesized
tgttaatacatgagctagaa

SEQ ID NO: 144541 - DNA, 20 bp, Artificial Sequence
  chemically synthesized
atgttaatacatgagctaga

SEQ ID NO: 144542 - DNA, 20 bp, Artificial Sequence
  chemically synthesized
catgttaatacatgagctag

SEQ ID NO: 144543 - DNA, 20 bp, Artificial Sequence
  chemically synthesized
tcacatgttaatacatgagc

SEQ ID NO: 144544 - DNA, 20 bp, Artificial Sequence
  chemically synthesized
tgggtcacatgttaatacat

SEQ ID NO: 144545 - DNA, 20 bp, Artificial Sequence
  chemically synthesized
tattaacatgtgacccaaac

SEQ ID NO: 144546 - DNA, 20 bp, Artificial Sequence
  chemically synthesized
attaacatgtgacccaaaca

SEQ ID NO: 144547 - DNA, 20 bp, Artificial Sequence
  chemically synthesized
gagtccagttcaccttgttt

SEQ ID NO: 144548 - DNA, 20 bp, Artificial Sequence
  chemically synthesized
agagtccagttcaccttgtt

SEQ ID NO: 144549 - DNA, 20 bp, Artificial Sequence
  chemically synthesized
gtgacccaaacaaggtgaac

SEQ ID NO: 144550 - DNA, 20 bp, Artificial Sequence
  chemically synthesized
taaagtcttaaaagagagtc

SEQ ID NO: 144551 - DNA, 20 bp, Artificial Sequence
  chemically synthesized
ggtgaactggactctctttt

SEQ ID NO: 144552 - DNA, 20 bp, Artificial Sequence
  chemically synthesized
aattttaaagtcttaaaaga

SEQ ID NO: 144553 - DNA, 20 bp, Artificial Sequence
  chemically synthesized
caaattttaaagtcttaaaa

SEQ ID NO: 144554 - DNA, 20 bp, Artificial Sequence
  chemically synthesized
ttcaaattttaaagtcttaa

SEQ ID NO: 144555 - DNA, 20 bp, Artificial Sequence
  chemically synthesized
gtaactctgttcaaatttta

SEQ ID NO: 144556 - DNA, 20 bp, Artificial Sequence
  chemically synthesized
ttaagactttaaaatttgaa

SEQ ID NO: 144557 - DNA, 20 bp, Artificial Sequence
  chemically synthesized
aagactttaaaatttgaaca

SEQ ID NO: 144558 - DNA, 20 bp, Artificial Sequence
  chemically synthesized
aatttgaacagagttacaca

SEQ ID NO: 144559 - DNA, 20 bp, Artificial Sequence
  chemically synthesized
atttgaacagagttacacac

SEQ ID NO: 144560 - DNA, 20 bp, Artificial Sequence
  chemically synthesized
gaacagagttacacacagga

SEQ ID NO: 144561 - DNA, 20 bp, Artificial Sequence
  chemically synthesized
acagagttacacacaggatg

SEQ ID NO: 144562 - DNA, 20 bp, Artificial Sequence
  chemically synthesized
gttacacacaggatggagaa

SEQ ID NO: 144563 - DNA, 20 bp, Artificial Sequence
  chemically synthesized
tacacacaggatggagaaaa

SEQ ID NO: 144564 - DNA, 20 bp, Artificial Sequence
  chemically synthesized
cacacaggatggagaaaaga

SEQ ID NO: 144565 - DNA, 20 bp, Artificial Sequence
  chemically synthesized
agaaaagagagtatcacaaa

SEQ ID NO: 144566 - DNA, 20 bp, Artificial Sequence
  chemically synthesized
agagagtatcacaaacagac

SEQ ID NO: 144567 - DNA, 20 bp, Artificial Sequence
  chemically synthesized
gtggctagcaagaagtattc

SEQ ID NO: 144568 - DNA, 20 bp, Artificial Sequence
  chemically synthesized
cagactggaatacttcttgc

SEQ ID NO: 144569 - DNA, 20 bp, Artificial Sequence
  chemically synthesized
ctgggcatgtggctagcaag

SEQ ID NO: 144570 - DNA, 20 bp, Artificial Sequence
  chemically synthesized
tttctgggcatgtggctagc

SEQ ID NO: 144571 - DNA, 20 bp, Artificial Sequence
  chemically synthesized
tgcctttctgggcatgtggc

SEQ ID NO: 144572 - DNA, 20 bp, Artificial Sequence
  chemically synthesized
cttcttgctagccacatgcc

SEQ ID NO: 144573 - DNA, 20 bp, Artificial Sequence
  chemically synthesized
agcatgcctttctgggcatg

SEQ ID NO: 144574 - DNA, 20 bp, Artificial Sequence
  chemically synthesized
ttgctagccacatgcccaga

SEQ ID NO: 144575 - DNA, 20 bp, Artificial Sequence
  chemically synthesized
tgctagccacatgcccagaa

SEQ ID NO: 144576 - DNA, 20 bp, Artificial Sequence
  chemically synthesized
gaatctgagcatgcctttct

SEQ ID NO: 144577 - DNA, 20 bp, Artificial Sequence
  chemically synthesized
agaatctgagcatgcctttc

SEQ ID NO: 144578 - DNA, 20 bp, Artificial Sequence
  chemically synthesized
catgcccagaaaggcatgct

SEQ ID NO: 144579 - DNA, 20 bp, Artificial Sequence
  chemically synthesized
tacaaaaggaaaaagaatct

SEQ ID NO: 144580 - DNA, 20 bp, Artificial Sequence
  chemically synthesized
acaaaacttacaaaaggaaa

SEQ ID NO: 144581 - DNA, 20 bp, Artificial Sequence
  chemically synthesized
cagattctttttccttttgt

SEQ ID NO: 144582 - DNA, 20 bp, Artificial Sequence
  chemically synthesized
attggaacaaaacttacaaa

SEQ ID NO: 144583 - DNA, 20 bp, Artificial Sequence
  chemically synthesized
cattggaacaaaacttacaa

SEQ ID NO: 144584 - DNA, 20 bp, Artificial Sequence
  chemically synthesized
tgtaattagcacaaaggcat

SEQ ID NO: 144585 - DNA, 20 bp, Artificial Sequence
  chemically synthesized
atgtgctgtaattagcacaa

SEQ ID NO: 144586 - DNA, 20 bp, Artificial Sequence
  chemically synthesized
aatgtgctgtaattagcaca

SEQ ID NO: 144587 - DNA, 20 bp, Artificial Sequence
  chemically synthesized
caatgcctttgtgctaatta

SEQ ID NO: 144588 - DNA, 20 bp, Artificial Sequence
  chemically synthesized
gaaagtaaatgtgctgtaat

SEQ ID NO: 144589 - DNA, 20 bp, Artificial Sequence
  chemically synthesized
ctctgattaaatcaggcaga

SEQ ID NO: 144590 - DNA, 20 bp, Artificial Sequence
  chemically synthesized
cattctctgattaaatcagg

SEQ ID NO: 144591 - DNA, 20 bp, Artificial Sequence
  chemically synthesized
aatcattctctgattaaatc

SEQ ID NO: 144592 - DNA, 20 bp, Artificial Sequence
  chemically synthesized
tactttctgcctgatttaat

SEQ ID NO: 144593 - DNA, 20 bp, Artificial Sequence
  chemically synthesized
aaatcattctctgattaaat

SEQ ID NO: 144594 - DNA, 20 bp, Artificial Sequence
  chemically synthesized
ctttctgcctgatttaatca

SEQ ID NO: 144595 - DNA, 20 bp, Artificial Sequence
  chemically synthesized
agctctctggatgcaagcaa

SEQ ID NO: 144596 - DNA, 20 bp, Artificial Sequence
  chemically synthesized
tgatttctgttgcttgcatc

SEQ ID NO: 144597 - DNA, 20 bp, Artificial Sequence
  chemically synthesized
atttctgttgcttgcatcca

SEQ ID NO: 144598 - DNA, 20 bp, Artificial Sequence
  chemically synthesized
aattagagctctctggatgc

SEQ ID NO: 144599 - DNA, 20 bp, Artificial Sequence
  chemically synthesized
ttctgttgcttgcatccaga

SEQ ID NO: 144600 - DNA, 20 bp, Artificial Sequence
  chemically synthesized
gcctatcaattagagctctc

SEQ ID NO: 144601 - DNA, 20 bp, Artificial Sequence
  chemically synthesized
atccagagagctctaattga

SEQ ID NO: 144602 - DNA, 20 bp, Artificial Sequence
  chemically synthesized
gtttagttgcctatcaatta

SEQ ID NO: 144603 - DNA, 20 bp, Artificial Sequence
  chemically synthesized
tccagagagctctaattgat

SEQ ID NO: 144604 - DNA, 20 bp, Artificial Sequence
  chemically synthesized
tagtttagttgcctatcaat

SEQ ID NO: 144605 - DNA, 20 bp, Artificial Sequence
  chemically synthesized
taaaatcatcacatatagtt

SEQ ID NO: 144606 - DNA, 20 bp, Artificial Sequence
  chemically synthesized
gaaaataaaatcatcacata

SEQ ID NO: 144607 - DNA, 20 bp, Artificial Sequence
  chemically synthesized
actctgaaaggattgtaaac

SEQ ID NO: 144608 - DNA, 20 bp, Artificial Sequence
  chemically synthesized
aactctgaaaggattgtaaa

SEQ ID NO: 144609 - DNA, 20 bp, Artificial Sequence
  chemically synthesized
tttcctgtttacaatccttt

SEQ ID NO: 144610 - DNA, 20 bp, Artificial Sequence
  chemically synthesized
tcctgtttacaatcctttca

SEQ ID NO: 144611 - DNA, 20 bp, Artificial Sequence
  chemically synthesized
caggcagtggcaactctgaa

SEQ ID NO: 144612 - DNA, 20 bp, Artificial Sequence
  chemically synthesized
acaggcagtggcaactctga

SEQ ID NO: 144613 - DNA, 20 bp, Artificial Sequence
  chemically synthesized
ttcagagttgccactgcctg

SEQ ID NO: 144614 - DNA, 20 bp, Artificial Sequence
  chemically synthesized
tgatgatggcctacaggcag

SEQ ID NO: 144615 - DNA, 20 bp, Artificial Sequence
  chemically synthesized
tcagagttgccactgcctgt

SEQ ID NO: 144616 - DNA, 20 bp, Artificial Sequence
  chemically synthesized
ttttgatgatggcctacagg

SEQ ID NO: 144617 - DNA, 20 bp, Artificial Sequence
  chemically synthesized
gaattttgatgatggcctac

SEQ ID NO: 144618 - DNA, 20 bp, Artificial Sequence
  chemically synthesized
ggaattttgatgatggccta

SEQ ID NO: 144619 - DNA, 20 bp, Artificial Sequence
  chemically synthesized
agactgaggaattttgatga

SEQ ID NO: 144620 - DNA, 20 bp, Artificial Sequence
  chemically synthesized
aggccatcatcaaaattcct

SEQ ID NO: 144621 - DNA, 20 bp, Artificial Sequence
  chemically synthesized
atcatcaaaattcctcagtc

SEQ ID NO: 144622 - DNA, 20 bp, Artificial Sequence
  chemically synthesized
aatcctttgttgccagactg

SEQ ID NO: 144623 - DNA, 20 bp, Artificial Sequence
  chemically synthesized
gaatcctttgttgccagact

SEQ ID NO: 144624 - DNA, 20 bp, Artificial Sequence
  chemically synthesized
aattcctcagtctggcaaca

SEQ ID NO: 144625 - DNA, 20 bp, Artificial Sequence
  chemically synthesized
attcctcagtctggcaacaa

SEQ ID NO: 144626 - DNA, 20 bp, Artificial Sequence
  chemically synthesized
taatgggaatcctttgttgc

SEQ ID NO: 144627 - DNA, 20 bp, Artificial Sequence
  chemically synthesized
aacaaaggattcccattatt

SEQ ID NO: 144628 - DNA, 20 bp, Artificial Sequence
  chemically synthesized
gaggactggggctaaataat

SEQ ID NO: 144629 - DNA, 20 bp, Artificial Sequence
  chemically synthesized
agaggactggggctaaataa

SEQ ID NO: 144630 - DNA, 20 bp, Artificial Sequence
  chemically synthesized
ggattcccattatttagccc

SEQ ID NO: 144631 - DNA, 20 bp, Artificial Sequence
  chemically synthesized
aggttgaatagagaggactg

SEQ ID NO: 144632 - DNA, 20 bp, Artificial Sequence
  chemically synthesized
gaggttgaatagagaggact

SEQ ID NO: 144633 - DNA, 20 bp, Artificial Sequence
  chemically synthesized
tgaggttgaatagagaggac

SEQ ID NO: 144634 - DNA, 20 bp, Artificial Sequence
  chemically synthesized
attgatgaggttgaatagag

SEQ ID NO: 144635 - DNA, 20 bp, Artificial Sequence
  chemically synthesized
aattgatgaggttgaataga

SEQ ID NO: 144636 - DNA, 20 bp, Artificial Sequence
  chemically synthesized
gaaattgatgaggttgaata

SEQ ID NO: 144637 - DNA, 20 bp, Artificial Sequence
  chemically synthesized
aagaaattgatgaggttgaa

SEQ ID NO: 144638 - DNA, 20 bp, Artificial Sequence
  chemically synthesized
tgatgaggaagaaattgatg

SEQ ID NO: 144639 - DNA, 20 bp, Artificial Sequence
  chemically synthesized
atgatgaggaagaaattgat

SEQ ID NO: 144640 - DNA, 20 bp, Artificial Sequence
  chemically synthesized
gttaagggtatatgatgagg

SEQ ID NO: 144641 - DNA, 20 bp, Artificial Sequence
  chemically synthesized
gaagttaagggtatatgatg

SEQ ID NO: 144642 - DNA, 20 bp, Artificial Sequence
  chemically synthesized
tgaagttaagggtatatgat

SEQ ID NO: 144643 - DNA, 20 bp, Artificial Sequence
  chemically synthesized
tcatcatatacccttaactt

SEQ ID NO: 144644 - DNA, 20 bp, Artificial Sequence
  chemically synthesized
ttccatatggctgaagttaa

SEQ ID NO: 144645 - DNA, 20 bp, Artificial Sequence
  chemically synthesized
attccatatggctgaagtta

SEQ ID NO: 144646 - DNA, 20 bp, Artificial Sequence
  chemically synthesized
gattccatatggctgaagtt

SEQ ID NO: 144647 - DNA, 20 bp, Artificial Sequence
  chemically synthesized
attgtgattccatatggctg

SEQ ID NO: 144648 - DNA, 20 bp, Artificial Sequence
  chemically synthesized
tacccttaacttcagccata

SEQ ID NO: 144649 - DNA, 20 bp, Artificial Sequence
  chemically synthesized
agaggaattgtgattccata

SEQ ID NO: 144650 - DNA, 20 bp, Artificial Sequence
  chemically synthesized
aaaaaaacagagtatatcag

SEQ ID NO: 144651 - DNA, 20 bp, Artificial Sequence
  chemically synthesized
aaaaaaaacagagtatatca

SEQ ID NO: 144652 - DNA, 20 bp, Artificial Sequence
  chemically synthesized
ggaaaaaaaacagagtatat

SEQ ID NO: 144653 - DNA, 20 bp, Artificial Sequence
  chemically synthesized
actgaggtggaaaaaaaaca

SEQ ID NO: 144654 - DNA, 20 bp, Artificial Sequence
  chemically synthesized
tcactgaggtggaaaaaaaa

SEQ ID NO: 144655 - DNA, 20 bp, Artificial Sequence
  chemically synthesized
actctgttttttttccacct

SEQ ID NO: 144656 - DNA, 20 bp, Artificial Sequence
  chemically synthesized
gactgtgcttttcactgagg

SEQ ID NO: 144657 - DNA, 20 bp, Artificial Sequence
  chemically synthesized
tttttttccacctcagtgaa

SEQ ID NO: 144658 - DNA, 20 bp, Artificial Sequence
  chemically synthesized
acagactgtgcttttcactg

SEQ ID NO: 144659 - DNA, 20 bp, Artificial Sequence
  chemically synthesized
aacagactgtgcttttcact

SEQ ID NO: 144660 - DNA, 20 bp, Artificial Sequence
  chemically synthesized
ttccacctcagtgaaaagca

SEQ ID NO: 144661 - DNA, 20 bp, Artificial Sequence
  chemically synthesized
ggcaatccaggcagagggaa

SEQ ID NO: 144662 - DNA, 20 bp, Artificial Sequence
  chemically synthesized
cacagtctgttccctctgcc

SEQ ID NO: 144663 - DNA, 20 bp, Artificial Sequence
  chemically synthesized
agaagggcaatccaggcaga

SEQ ID NO: 144664 - DNA, 20 bp, Artificial Sequence
  chemically synthesized
gagaagggcaatccaggcag

SEQ ID NO: 144665 - DNA, 20 bp, Artificial Sequence
  chemically synthesized
cgagaagggcaatccaggca

SEQ ID NO: 144666 - DNA, 20 bp, Artificial Sequence
  chemically synthesized
aacgagaagggcaatccagg

SEQ ID NO: 144667 - DNA, 20 bp, Artificial Sequence
  chemically synthesized
taaaacgagaagggcaatcc

SEQ ID NO: 144668 - DNA, 20 bp, Artificial Sequence
  chemically synthesized
ataaaacgagaagggcaatc

SEQ ID NO: 144669 - DNA, 20 bp, Artificial Sequence
  chemically synthesized
ctagctagataaaacgagaa

SEQ ID NO: 144670 - DNA, 20 bp, Artificial Sequence
  chemically synthesized
cctagctagataaaacgaga

SEQ ID NO: 144671 - DNA, 20 bp, Artificial Sequence
  chemically synthesized
acctagctagataaaacgag

SEQ ID NO: 144672 - DNA, 20 bp, Artificial Sequence
  chemically synthesized
attacctagctagataaaac

SEQ ID NO: 144673 - DNA, 20 bp, Artificial Sequence
  chemically synthesized
attgcccttctcgttttatc

SEQ ID NO: 144674 - DNA, 20 bp, Artificial Sequence
  chemically synthesized
cccttctcgttttatctagc

SEQ ID NO: 144675 - DNA, 20 bp, Artificial Sequence
  chemically synthesized
ccttctcgttttatctagct

SEQ ID NO: 144676 - DNA, 20 bp, Artificial Sequence
  chemically synthesized
atgagttggaattacctagc

SEQ ID NO: 144677 - DNA, 20 bp, Artificial Sequence
  chemically synthesized
aagaatgagttggaattacc

SEQ ID NO: 144678 - DNA, 20 bp, Artificial Sequence
  chemically synthesized
ccaggcattaaagaatgagt

SEQ ID NO: 144679 - DNA, 20 bp, Artificial Sequence
  chemically synthesized
taagccaggcattaaagaat

SEQ ID NO: 144680 - DNA, 20 bp, Artificial Sequence
  chemically synthesized
ccaactcattctttaatgcc

SEQ ID NO: 144681 - DNA, 20 bp, Artificial Sequence
  chemically synthesized
aaaacttaagccaggcatta

SEQ ID NO: 144682 - DNA, 20 bp, Artificial Sequence
  chemically synthesized
cattctttaatgcctggctt

SEQ ID NO: 144683 - DNA, 20 bp, Artificial Sequence
  chemically synthesized
aagaaggaaaaacttaagcc

SEQ ID NO: 144684 - DNA, 20 bp, Artificial Sequence
  chemically synthesized
gaagaaggaaaaacttaagc

SEQ ID NO: 144685 - DNA, 20 bp, Artificial Sequence
  chemically synthesized
tcctgaagaaggaaaaactt

SEQ ID NO: 144686 - DNA, 20 bp, Artificial Sequence
  chemically synthesized
ggcttaagtttttccttctt

SEQ ID NO: 144687 - DNA, 20 bp, Artificial Sequence
  chemically synthesized
gcttaagtttttccttcttc

SEQ ID NO: 144688 - DNA, 20 bp, Artificial Sequence
  chemically synthesized
tagtgagatattcctgaaga

SEQ ID NO: 144689 - DNA, 20 bp, Artificial Sequence
  chemically synthesized
ctagtgagatattcctgaag

SEQ ID NO: 144690 - DNA, 20 bp, Artificial Sequence
  chemically synthesized
atgctagtgagatattcctg

SEQ ID NO: 144691 - DNA, 20 bp, Artificial Sequence
  chemically synthesized
cttcttcaggaatatctcac

SEQ ID NO: 144692 - DNA, 20 bp, Artificial Sequence
  chemically synthesized
gagagagaatggatgctagt

SEQ ID NO: 144693 - DNA, 20 bp, Artificial Sequence
  chemically synthesized
ccaggagagagaatggatgc

SEQ ID NO: 144694 - DNA, 20 bp, Artificial Sequence
  chemically synthesized
aactaagccaggagagagaa

SEQ ID NO: 144695 - DNA, 20 bp, Artificial Sequence
  chemically synthesized
ctagcatccattctctctcc

SEQ ID NO: 144696 - DNA, 20 bp, Artificial Sequence
  chemically synthesized
gggaaaactaagccaggaga

SEQ ID NO: 144697 - DNA, 20 bp, Artificial Sequence
  chemically synthesized
cagggaaaactaagccagga

SEQ ID NO: 144698 - DNA, 20 bp, Artificial Sequence
  chemically synthesized
atccattctctctcctggct

SEQ ID NO: 144699 - DNA, 20 bp, Artificial Sequence
  chemically synthesized
ttcagggaaaactaagccag

SEQ ID NO: 144700 - DNA, 20 bp, Artificial Sequence
  chemically synthesized
tcttcagggaaaactaagcc

SEQ ID NO: 144701 - DNA, 20 bp, Artificial Sequence
  chemically synthesized
ttcttcagggaaaactaagc

SEQ ID NO: 144702 - DNA, 20 bp, Artificial Sequence
  chemically synthesized
ggctttcttcagggaaaact

SEQ ID NO: 144703 - DNA, 20 bp, Artificial Sequence
  chemically synthesized
tcctggcttagttttccctg

SEQ ID NO: 144704 - DNA, 20 bp, Artificial Sequence
  chemically synthesized
ggcttagttttccctgaaga

SEQ ID NO: 144705 - DNA, 20 bp, Artificial Sequence
  chemically synthesized
tgctgttggggctttcttca

SEQ ID NO: 144706 - DNA, 20 bp, Artificial Sequence
  chemically synthesized
atgctgttggggctttcttc

SEQ ID NO: 144707 - DNA, 20 bp, Artificial Sequence
  chemically synthesized
gatgctgttggggctttctt

SEQ ID NO: 144708 - DNA, 20 bp, Artificial Sequence
  chemically synthesized
ttccctgaagaaagccccaa

SEQ ID NO: 144709 - DNA, 20 bp, Artificial Sequence
  chemically synthesized
ttgtgtgggtgatgctgttg

SEQ ID NO: 144710 - DNA, 20 bp, Artificial Sequence
  chemically synthesized
attgtgtgggtgatgctgtt

SEQ ID NO: 144711 - DNA, 20 bp, Artificial Sequence
  chemically synthesized
tattgtgtgggtgatgctgt

SEQ ID NO: 144712 - DNA, 20 bp, Artificial Sequence
  chemically synthesized
caacttctctgatattgtgt

SEQ ID NO: 144713 - DNA, 20 bp, Artificial Sequence
  chemically synthesized
tcaacttctctgatattgtg

SEQ ID NO: 144714 - DNA, 20 bp, Artificial Sequence
  chemically synthesized
cagcatcacccacacaatat

SEQ ID NO: 144715 - DNA, 20 bp, Artificial Sequence
  chemically synthesized
gcatcacccacacaatatca

SEQ ID NO: 144716 - DNA, 20 bp, Artificial Sequence
  chemically synthesized
tcacccacacaatatcagag

SEQ ID NO: 144717 - DNA, 20 bp, Artificial Sequence
  chemically synthesized
tcagagaagttgaaaactat

SEQ ID NO: 144718 - DNA, 20 bp, Artificial Sequence
  chemically synthesized
cagagaagttgaaaactatg

SEQ ID NO: 144719 - DNA, 20 bp, Artificial Sequence
  chemically synthesized
gtcctctcccttaaacctca

SEQ ID NO: 144720 - DNA, 20 bp, Artificial Sequence
  chemically synthesized
agttgaaaactatgaggttt

SEQ ID NO: 144721 - DNA, 20 bp, Artificial Sequence
  chemically synthesized
gttgaaaactatgaggttta

SEQ ID NO: 144722 - DNA, 20 bp, Artificial Sequence
  chemically synthesized
ttgaaaactatgaggtttaa

SEQ ID NO: 144723 - DNA, 20 bp, Artificial Sequence
  chemically synthesized
gaaaactatgaggtttaagg

SEQ ID NO: 144724 - DNA, 20 bp, Artificial Sequence
  chemically synthesized
aaactatgaggtttaaggga

SEQ ID NO: 144725 - DNA, 20 bp, Artificial Sequence
  chemically synthesized
aactatgaggtttaagggag

SEQ ID NO: 144726 - DNA, 20 bp, Artificial Sequence
  chemically synthesized
aggtttaagggagaggactc

SEQ ID NO: 144727 - DNA, 20 bp, Artificial Sequence
  chemically synthesized
actcaggcagtttggttcca

SEQ ID NO: 144728 - DNA, 20 bp, Artificial Sequence
  chemically synthesized
gaactcaggcagtttggttc

SEQ ID NO: 144729 - DNA, 20 bp, Artificial Sequence
  chemically synthesized
agatgtgaactcaggcagtt

SEQ ID NO: 144730 - DNA, 20 bp, Artificial Sequence
  chemically synthesized
actctggaaccaaactgcct

SEQ ID NO: 144731 - DNA, 20 bp, Artificial Sequence
  chemically synthesized
tgatgagatgtgaactcagg

SEQ ID NO: 144732 - DNA, 20 bp, Artificial Sequence
  chemically synthesized
caatgatgagatgtgaactc

SEQ ID NO: 144733 - DNA, 20 bp, Artificial Sequence
  chemically synthesized
acaatgatgagatgtgaact

SEQ ID NO: 144734 - DNA, 20 bp, Artificial Sequence
  chemically synthesized
cgaggaagaaagacaatgat

SEQ ID NO: 144735 - DNA, 20 bp, Artificial Sequence
  chemically synthesized
ctgcctgagatcgaggaaga

SEQ ID NO: 144736 - DNA, 20 bp, Artificial Sequence
  chemically synthesized
taacctgcctgagatcgagg

SEQ ID NO: 144737 - DNA, 20 bp, Artificial Sequence
  chemically synthesized
ttgtctttcttcctcgatct

SEQ ID NO: 144738 - DNA, 20 bp, Artificial Sequence
  chemically synthesized
tgtctttcttcctcgatctc

SEQ ID NO: 144739 - DNA, 20 bp, Artificial Sequence
  chemically synthesized
taataacctgcctgagatcg

SEQ ID NO: 144740 - DNA, 20 bp, Artificial Sequence
  chemically synthesized
ataataacctgcctgagatc

SEQ ID NO: 144741 - DNA, 20 bp, Artificial Sequence
  chemically synthesized
ctttcttcctcgatctcagg

SEQ ID NO: 144742 - DNA, 20 bp, Artificial Sequence
  chemically synthesized
tttcttcctcgatctcaggc

SEQ ID NO: 144743 - DNA, 20 bp, Artificial Sequence
  chemically synthesized
gtaaggataataacctgcct

SEQ ID NO: 144744 - DNA, 20 bp, Artificial Sequence
  chemically synthesized
gtagatagagaggcacagta

SEQ ID NO: 144745 - DNA, 20 bp, Artificial Sequence
  chemically synthesized
ggtagatagagaggcacagt

SEQ ID NO: 144746 - DNA, 20 bp, Artificial Sequence
  chemically synthesized
gtgaggtagatagagaggca

SEQ ID NO: 144747 - DNA, 20 bp, Artificial Sequence
  chemically synthesized
ttactgtgaggtagatagag

SEQ ID NO: 144748 - DNA, 20 bp, Artificial Sequence
  chemically synthesized
attactgtgaggtagataga

SEQ ID NO: 144749 - DNA, 20 bp, Artificial Sequence
  chemically synthesized
acattactgtgaggtagata

SEQ ID NO: 144750 - DNA, 20 bp, Artificial Sequence
  chemically synthesized
caacattactgtgaggtaga

SEQ ID NO: 144751 - DNA, 20 bp, Artificial Sequence
  chemically synthesized
gtgcctctctatctacctca

SEQ ID NO: 144752 - DNA, 20 bp, Artificial Sequence
  chemically synthesized
cttacaacattactgtgagg

SEQ ID NO: 144753 - DNA, 20 bp, Artificial Sequence
  chemically synthesized
atgcttacaacattactgtg

SEQ ID NO: 144754 - DNA, 20 bp, Artificial Sequence
  chemically synthesized
aatgcttacaacattactgt

SEQ ID NO: 144755 - DNA, 20 bp, Artificial Sequence
  chemically synthesized
ctacctcacagtaatgttgt

SEQ ID NO: 144756 - DNA, 20 bp, Artificial Sequence
  chemically synthesized
cagtaatgttgtaagcatta

SEQ ID NO: 144757 - DNA, 20 bp, Artificial Sequence
  chemically synthesized
agcattaaagaattcacgtg

SEQ ID NO: 144758 - DNA, 20 bp, Artificial Sequence
  chemically synthesized
aagaattcacgtgaagtact

SEQ ID NO: 144759 - DNA, 20 bp, Artificial Sequence
  chemically synthesized
gatatgccagtcattgatct

SEQ ID NO: 144760 - DNA, 20 bp, Artificial Sequence
  chemically synthesized
gaagtacttagatcaatgac

SEQ ID NO: 144761 - DNA, 20 bp, Artificial Sequence
  chemically synthesized
agctaacacatatgatatgc

SEQ ID NO: 144762 - DNA, 20 bp, Artificial Sequence
  chemically synthesized
gactggcatatcatatgtgt

SEQ ID NO: 144763 - DNA, 20 bp, Artificial Sequence
  chemically synthesized
agagataaattttaggataa

SEQ ID NO: 144764 - DNA, 20 bp, Artificial Sequence
  chemically synthesized
ctatgatagagataaatttt

SEQ ID NO: 144765 - DNA, 20 bp, Artificial Sequence
  chemically synthesized
actatgatagagataaattt

SEQ ID NO: 144766 - DNA, 20 bp, Artificial Sequence
  chemically synthesized
cctaaaatttatctctatca

SEQ ID NO: 144767 - DNA, 20 bp, Artificial Sequence
  chemically synthesized
aaaataataacactatgata

SEQ ID NO: 144768 - DNA, 20 bp, Artificial Sequence
  chemically synthesized
agaaaataataacactatga

SEQ ID NO: 144769 - DNA, 20 bp, Artificial Sequence
  chemically synthesized
caggtaaaagaggttgaagg

SEQ ID NO: 144770 - DNA, 20 bp, Artificial Sequence
  chemically synthesized
gtgcaggtaaaagaggttga

SEQ ID NO: 144771 - DNA, 20 bp, Artificial Sequence
  chemically synthesized
tgtgcaggtaaaagaggttg

SEQ ID NO: 144772 - DNA, 20 bp, Artificial Sequence
  chemically synthesized
atagaatgtgcaggtaaaag

SEQ ID NO: 144773 - DNA, 20 bp, Artificial Sequence
  chemically synthesized
catagaatgtgcaggtaaaa

SEQ ID NO: 144774 - DNA, 20 bp, Artificial Sequence
  chemically synthesized
aacatagaatgtgcaggtaa

SEQ ID NO: 144775 - DNA, 20 bp, Artificial Sequence
  chemically synthesized
ttgtacaacatagaatgtgc

SEQ ID NO: 144776 - DNA, 20 bp, Artificial Sequence
  chemically synthesized
gttgtacaacatagaatgtg

SEQ ID NO: 144777 - DNA, 20 bp, Artificial Sequence
  chemically synthesized
aaacataaagttgtacaaca

SEQ ID NO: 144778 - DNA, 20 bp, Artificial Sequence
  chemically synthesized
ctaagtacctgggaaacata

SEQ ID NO: 144779 - DNA, 20 bp, Artificial Sequence
  chemically synthesized
ttgtacaactttatgtttcc

SEQ ID NO: 144780 - DNA, 20 bp, Artificial Sequence
  chemically synthesized
tgtacaactttatgtttccc

SEQ ID NO: 144781 - DNA, 20 bp, Artificial Sequence
  chemically synthesized
ctttatgtttcccaggtact

SEQ ID NO: 144782 - DNA, 20 bp, Artificial Sequence
  chemically synthesized
tgagctgccactaagtacct

SEQ ID NO: 144783 - DNA, 20 bp, Artificial Sequence
  chemically synthesized
ttgagctgccactaagtacc

SEQ ID NO: 144784 - DNA, 20 bp, Artificial Sequence
  chemically synthesized
tatgtttcccaggtacttag

SEQ ID NO: 144785 - DNA, 20 bp, Artificial Sequence
  chemically synthesized
gtttcccaggtacttagtgg

SEQ ID NO: 144786 - DNA, 20 bp, Artificial Sequence
  chemically synthesized
acttctattgagctgccact

SEQ ID NO: 144787 - DNA, 20 bp, Artificial Sequence
  chemically synthesized
ggtacttagtggcagctcaa

SEQ ID NO: 144788 - DNA, 20 bp, Artificial Sequence
  chemically synthesized
acttagtggcagctcaatag

SEQ ID NO: 144789 - DNA, 20 bp, Artificial Sequence
  chemically synthesized
tattttaaccaacttctatt

SEQ ID NO: 144790 - DNA, 20 bp, Artificial Sequence
  chemically synthesized
agtggcagctcaatagaagt

SEQ ID NO: 144791 - DNA, 20 bp, Artificial Sequence
  chemically synthesized
gttggttaaaataataaaaa

SEQ ID NO: 144792 - DNA, 20 bp, Artificial Sequence
  chemically synthesized
gttaaaataataaaaatgga

SEQ ID NO: 144793 - DNA, 20 bp, Artificial Sequence
  chemically synthesized
ttaaaataataaaaatggat

SEQ ID NO: 144794 - DNA, 20 bp, Artificial Sequence
  chemically synthesized
taataaaaatggataggtgt

SEQ ID NO: 144795 - DNA, 20 bp, Artificial Sequence
  chemically synthesized
aaaatggataggtgttagta

SEQ ID NO: 144796 - DNA, 20 bp, Artificial Sequence
  chemically synthesized
ggtgttagtaaagttttttt

SEQ ID NO: 144797 - DNA, 20 bp, Artificial Sequence
  chemically synthesized
aaagtttttttcagtttata

SEQ ID NO: 144798 - DNA, 20 bp, Artificial Sequence
  chemically synthesized
ttcagtttataaagcccttt

SEQ ID NO: 144799 - DNA, 20 bp, Artificial Sequence
  chemically synthesized
aattaggcaaaattccaaaa

SEQ ID NO: 144800 - DNA, 20 bp, Artificial Sequence
  chemically synthesized
aaattaggcaaaattccaaa

SEQ ID NO: 144801 - DNA, 20 bp, Artificial Sequence
  chemically synthesized
aaaattaggcaaaattccaa

SEQ ID NO: 144802 - DNA, 20 bp, Artificial Sequence
  chemically synthesized
tgtttgatgtgtgaaaaatt

SEQ ID NO: 144803 - DNA, 20 bp, Artificial Sequence
  chemically synthesized
atgtttgatgtgtgaaaaat

SEQ ID NO: 144804 - DNA, 20 bp, Artificial Sequence
  chemically synthesized
ttttcacacatcaaacatta

SEQ ID NO: 144805 - DNA, 20 bp, Artificial Sequence
  chemically synthesized
cacacatcaaacattaaagt

SEQ ID NO: 144806 - DNA, 20 bp, Artificial Sequence
  chemically synthesized
acacatcaaacattaaagtt

SEQ ID NO: 144807 - DNA, 20 bp, Artificial Sequence
  chemically synthesized
tttatgtaaagttttaaata

SEQ ID NO: 144808 - DNA, 20 bp, Artificial Sequence
  chemically synthesized
atcaatatcaattttatgta

SEQ ID NO: 144809 - DNA, 20 bp, Artificial Sequence
  chemically synthesized
gaggattttgttataatttc

SEQ ID NO: 144810 - DNA, 20 bp, Artificial Sequence
  chemically synthesized
ggaggattttgttataattt

SEQ ID NO: 144811 - DNA, 20 bp, Artificial Sequence
  chemically synthesized
aaggataagtaagtatgggg

SEQ ID NO: 144812 - DNA, 20 bp, Artificial Sequence
  chemically synthesized
gaaggataagtaagtatggg

SEQ ID NO: 144813 - DNA, 20 bp, Artificial Sequence
  chemically synthesized
aagaaggataagtaagtatg

SEQ ID NO: 144814 - DNA, 20 bp, Artificial Sequence
  chemically synthesized
taagaaggataagtaagtat

SEQ ID NO: 144815 - DNA, 20 bp, Artificial Sequence
  chemically synthesized
ataagaaggataagtaagta

SEQ ID NO: 144816 - DNA, 20 bp, Artificial Sequence
  chemically synthesized
gggaaataagaaggataagt

SEQ ID NO: 144817 - DNA, 20 bp, Artificial Sequence
  chemically synthesized
agaggggaaataagaaggat

SEQ ID NO: 144818 - DNA, 20 bp, Artificial Sequence
  chemically synthesized
gtgtgagaggggaaataaga

SEQ ID NO: 144819 - DNA, 20 bp, Artificial Sequence
  chemically synthesized
tgtgtgagaggggaaataag

SEQ ID NO: 144820 - DNA, 20 bp, Artificial Sequence
  chemically synthesized
atgtgtgtgagaggggaaat

SEQ ID NO: 144821 - DNA, 20 bp, Artificial Sequence
  chemically synthesized
taaacaaatgtgtgtgagag

SEQ ID NO: 144822 - DNA, 20 bp, Artificial Sequence
  chemically synthesized
ttaaacaaatgtgtgtgaga

SEQ ID NO: 144823 - DNA, 20 bp, Artificial Sequence
  chemically synthesized
attaaacaaatgtgtgtgag

SEQ ID NO: 144824 - DNA, 20 bp, Artificial Sequence
  chemically synthesized
cattaaacaaatgtgtgtga

SEQ ID NO: 144825 - DNA, 20 bp, Artificial Sequence
  chemically synthesized
atcattaaacaaatgtgtgt

SEQ ID NO: 144826 - DNA, 20 bp, Artificial Sequence
  chemically synthesized
acatttgtttaatgattatt

SEQ ID NO: 144827 - DNA, 20 bp, Artificial Sequence
  chemically synthesized
catttgtttaatgattattt

SEQ ID NO: 144828 - DNA, 20 bp, Artificial Sequence
  chemically synthesized
atttgtttaatgattattta

SEQ ID NO: 144829 - DNA, 20 bp, Artificial Sequence
  chemically synthesized
tcaccaaattgtcggtaaaa

SEQ ID NO: 144830 - DNA, 20 bp, Artificial Sequence
  chemically synthesized
gggccattttaccgacaatt

SEQ ID NO: 144831 - DNA, 20 bp, Artificial Sequence
  chemically synthesized
agcctcaatcaccaaattgt

SEQ ID NO: 144832 - DNA, 20 bp, Artificial Sequence
  chemically synthesized
ttaccgacaatttggtgatt

SEQ ID NO: 144833 - DNA, 20 bp, Artificial Sequence
  chemically synthesized
taccgacaatttggtgattg

SEQ ID NO: 144834 - DNA, 20 bp, Artificial Sequence
  chemically synthesized
tttggtgattgaggctataa

SEQ ID NO: 144835 - DNA, 20 bp, Artificial Sequence
  chemically synthesized
ttgtcagttcttggctttta

SEQ ID NO: 144836 - DNA, 20 bp, Artificial Sequence
  chemically synthesized
tgattgaggctataaaagcc

SEQ ID NO: 144837 - DNA, 20 bp, Artificial Sequence
  chemically synthesized
ttaaagacattgtcagttct

SEQ ID NO: 144838 - DNA, 20 bp, Artificial Sequence
  chemically synthesized
ataattcttaaagacattgt

SEQ ID NO: 144839 - DNA, 20 bp, Artificial Sequence
  chemically synthesized
caagaactgacaatgtcttt

SEQ ID NO: 144840 - DNA, 20 bp, Artificial Sequence
  chemically synthesized
atattaaaaaataattctta

SEQ ID NO: 144841 - DNA, 20 bp, Artificial Sequence
  chemically synthesized
taagaattattttttaatat

SEQ ID NO: 144842 - DNA, 20 bp, Artificial Sequence
  chemically synthesized
agaattattttttaatataa

SEQ ID NO: 144843 - DNA, 20 bp, Artificial Sequence
  chemically synthesized
gaattattttttaatataag

SEQ ID NO: 144844 - DNA, 20 bp, Artificial Sequence
  chemically synthesized
ttattttttaatataagagg

SEQ ID NO: 144845 - DNA, 20 bp, Artificial Sequence
  chemically synthesized
attttttaatataagaggaa

SEQ ID NO: 144846 - DNA, 20 bp, Artificial Sequence
  chemically synthesized
ttttttaatataagaggaag

SEQ ID NO: 144847 - DNA, 20 bp, Artificial Sequence
  chemically synthesized
tttaatataagaggaagagg

SEQ ID NO: 144848 - DNA, 20 bp, Artificial Sequence
  chemically synthesized
ttaatataagaggaagaggc

SEQ ID NO: 144849 - DNA, 20 bp, Artificial Sequence
  chemically synthesized
ataagaggaagaggcaggca

SEQ ID NO: 144850 - DNA, 20 bp, Artificial Sequence
  chemically synthesized
aggcaaagcatccccctatt

SEQ ID NO: 144851 - DNA, 20 bp, Artificial Sequence
  chemically synthesized
tctcttgcttgctgaatagg

SEQ ID NO: 144852 - DNA, 20 bp, Artificial Sequence
  chemically synthesized
ttctcttgcttgctgaatag

SEQ ID NO: 144853 - DNA, 20 bp, Artificial Sequence
  chemically synthesized
cttctcttgcttgctgaata

SEQ ID NO: 144854 - DNA, 20 bp, Artificial Sequence
  chemically synthesized
aaagcatccccctattcagc

SEQ ID NO: 144855 - DNA, 20 bp, Artificial Sequence
  chemically synthesized
ccttctcttgcttgctgaat

SEQ ID NO: 144856 - DNA, 20 bp, Artificial Sequence
  chemically synthesized
cccttctcttgcttgctgaa

SEQ ID NO: 144857 - DNA, 20 bp, Artificial Sequence
  chemically synthesized
catccccctattcagcaagc

SEQ ID NO: 144858 - DNA, 20 bp, Artificial Sequence
  chemically synthesized
tccccctattcagcaagcaa

SEQ ID NO: 144859 - DNA, 20 bp, Artificial Sequence
  chemically synthesized
ccctattcagcaagcaagag

SEQ ID NO: 144860 - DNA, 20 bp, Artificial Sequence
  chemically synthesized
cctattcagcaagcaagaga

SEQ ID NO: 144861 - DNA, 20 bp, Artificial Sequence
  chemically synthesized
ctattcagcaagcaagagaa

SEQ ID NO: 144862 - DNA, 20 bp, Artificial Sequence
  chemically synthesized
attcagcaagcaagagaagg

SEQ ID NO: 144863 - DNA, 20 bp, Artificial Sequence
  chemically synthesized
gcaagcaagagaagggagat

SEQ ID NO: 144864 - DNA, 20 bp, Artificial Sequence
  chemically synthesized
tatttttaaaatagtatata

SEQ ID NO: 144865 - DNA, 20 bp, Artificial Sequence
  chemically synthesized
atataaaaatatttttaaaa

SEQ ID NO: 144866 - DNA, 20 bp, Artificial Sequence
  chemically synthesized
caggatttataaattatata

SEQ ID NO: 144867 - DNA, 20 bp, Artificial Sequence
  chemically synthesized
tttctgagacacaaaaatac

SEQ ID NO: 144868 - DNA, 20 bp, Artificial Sequence
  chemically synthesized
atttctgagacacaaaaata

SEQ ID NO: 144869 - DNA, 20 bp, Artificial Sequence
  chemically synthesized
aatcctgtatttttgtgtct

SEQ ID NO: 144870 - DNA, 20 bp, Artificial Sequence
  chemically synthesized
gtatttttgtgtctcagaaa

SEQ ID NO: 144871 - DNA, 20 bp, Artificial Sequence
  chemically synthesized
aaaaatcaaaagccatttct

SEQ ID NO: 144872 - DNA, 20 bp, Artificial Sequence
  chemically synthesized
aatttagggggaaaaatcaa

SEQ ID NO: 144873 - DNA, 20 bp, Artificial Sequence
  chemically synthesized
cagaaaaaaaaaaatttagg

SEQ ID NO: 144874 - DNA, 20 bp, Artificial Sequence
  chemically synthesized
tcagaaaaaaaaaaatttag

SEQ ID NO: 144875 - DNA, 20 bp, Artificial Sequence
  chemically synthesized
ctcagaaaaaaaaaaattta

SEQ ID NO: 144876 - DNA, 20 bp, Artificial Sequence
  chemically synthesized
tctcagaaaaaaaaaaattt

SEQ ID NO: 144877 - DNA, 20 bp, Artificial Sequence
  chemically synthesized
atctcagaaaaaaaaaaatt

SEQ ID NO: 144878 - DNA, 20 bp, Artificial Sequence
  chemically synthesized
ccctaaatttttttttttct

SEQ ID NO: 144879 - DNA, 20 bp, Artificial Sequence
  chemically synthesized
aaatttttttttttctgaga

SEQ ID NO: 144880 - DNA, 20 bp, Artificial Sequence
  chemically synthesized
atttttttttttctgagatg

SEQ ID NO: 144881 - DNA, 20 bp, Artificial Sequence
  chemically synthesized
gacagagtgagactccatct

SEQ ID NO: 144882 - DNA, 20 bp, Artificial Sequence
  chemically synthesized
tccagactgagtgacagagt

SEQ ID NO: 144883 - DNA, 20 bp, Artificial Sequence
  chemically synthesized
tggagtctcactctgtcact

SEQ ID NO: 144884 - DNA, 20 bp, Artificial Sequence
  chemically synthesized
gcactccagactgagtgaca

SEQ ID NO: 144885 - DNA, 20 bp, Artificial Sequence
  chemically synthesized
ttgcactccagactgagtga

SEQ ID NO: 144886 - DNA, 20 bp, Artificial Sequence
  chemically synthesized
tctcactctgtcactcagtc

SEQ ID NO: 144887 - DNA, 20 bp, Artificial Sequence
  chemically synthesized
tcactctgtcactcagtctg

SEQ ID NO: 144888 - DNA, 20 bp, Artificial Sequence
  chemically synthesized
acaccattgcactccagact

SEQ ID NO: 144889 - DNA, 20 bp, Artificial Sequence
  chemically synthesized
gagatcacaccattgcactc

SEQ ID NO: 144890 - DNA, 20 bp, Artificial Sequence
  chemically synthesized
tcactcagtctggagtgcaa

SEQ ID NO: 144891 - DNA, 20 bp, Artificial Sequence
  chemically synthesized
ggagtgcaatggtgtgatct

SEQ ID NO: 144892 - DNA, 20 bp, Artificial Sequence
  chemically synthesized
atggtgtgatctcagctcaa

SEQ ID NO: 144893 - DNA, 20 bp, Artificial Sequence
  chemically synthesized
accagaggttccattgagct

SEQ ID NO: 144894 - DNA, 20 bp, Artificial Sequence
  chemically synthesized
cctggaccagaggttccatt

SEQ ID NO: 144895 - DNA, 20 bp, Artificial Sequence
  chemically synthesized
tctcagctcaatggaacctc

SEQ ID NO: 144896 - DNA, 20 bp, Artificial Sequence
  chemically synthesized
gctcaatggaacctctggtc

SEQ ID NO: 144897 - DNA, 20 bp, Artificial Sequence
  chemically synthesized
ctcaatggaacctctggtcc

SEQ ID NO: 144898 - DNA, 20 bp, Artificial Sequence
  chemically synthesized
tcacttgaatcctggaccag

SEQ ID NO: 144899 - DNA, 20 bp, Artificial Sequence
  chemically synthesized
atcacttgaatcctggacca

SEQ ID NO: 144900 - DNA, 20 bp, Artificial Sequence
  chemically synthesized
gaatcacttgaatcctggac

SEQ ID NO: 144901 - DNA, 20 bp, Artificial Sequence
  chemically synthesized
gaacctctggtccaggattc

SEQ ID NO: 144902 - DNA, 20 bp, Artificial Sequence
  chemically synthesized
caggagaatcacttgaatcc

SEQ ID NO: 144903 - DNA, 20 bp, Artificial Sequence
  chemically synthesized
ttcaagtgattctcctgcct

SEQ ID NO: 144904 - DNA, 20 bp, Artificial Sequence
  chemically synthesized
tactagggaggctgaggcag

SEQ ID NO: 144905 - DNA, 20 bp, Artificial Sequence
  chemically synthesized
gctactagggaggctgaggc

SEQ ID NO: 144906 - DNA, 20 bp, Artificial Sequence
  chemically synthesized
agctactagggaggctgagg

SEQ ID NO: 144907 - DNA, 20 bp, Artificial Sequence
  chemically synthesized
cccagctactagggaggctg

SEQ ID NO: 144908 - DNA, 20 bp, Artificial Sequence
  chemically synthesized
tcccagctactagggaggct

SEQ ID NO: 144909 - DNA, 20 bp, Artificial Sequence
  chemically synthesized
ttctcctgcctcagcctccc

SEQ ID NO: 144910 - DNA, 20 bp, Artificial Sequence
  chemically synthesized
tcctgcctcagcctccctag

SEQ ID NO: 144911 - DNA, 20 bp, Artificial Sequence
  chemically synthesized
tataatcccagctactaggg

SEQ ID NO: 144912 - DNA, 20 bp, Artificial Sequence
  chemically synthesized
ctataatcccagctactagg

SEQ ID NO: 144913 - DNA, 20 bp, Artificial Sequence
  chemically synthesized
gcctcagcctccctagtagc

SEQ ID NO: 144914 - DNA, 20 bp, Artificial Sequence
  chemically synthesized
gcctataatcccagctacta

SEQ ID NO: 144915 - DNA, 20 bp, Artificial Sequence
  chemically synthesized
cctcagcctccctagtagct

SEQ ID NO: 144916 - DNA, 20 bp, Artificial Sequence
  chemically synthesized
tgcctataatcccagctact

SEQ ID NO: 144917 - DNA, 20 bp, Artificial Sequence
  chemically synthesized
atgcctataatcccagctac

SEQ ID NO: 144918 - DNA, 20 bp, Artificial Sequence
  chemically synthesized
ctccctagtagctgggatta

SEQ ID NO: 144919 - DNA, 20 bp, Artificial Sequence
  chemically synthesized
tccctagtagctgggattat

SEQ ID NO: 144920 - DNA, 20 bp, Artificial Sequence
  chemically synthesized
gtggcccatgcctataatcc

SEQ ID NO: 144921 - DNA, 20 bp, Artificial Sequence
  chemically synthesized
agtagctgggattataggca

SEQ ID NO: 144922 - DNA, 20 bp, Artificial Sequence
  chemically synthesized
gtagctgggattataggcat

SEQ ID NO: 144923 - DNA, 20 bp, Artificial Sequence
  chemically synthesized
ataggcatgggccaccacac

SEQ ID NO: 144924 - DNA, 20 bp, Artificial Sequence
  chemically synthesized
aaaaaaattagctggtgtgg

SEQ ID NO: 144925 - DNA, 20 bp, Artificial Sequence
  chemically synthesized
aataaaaaaattagctggtg

SEQ ID NO: 144926 - DNA, 20 bp, Artificial Sequence
  chemically synthesized
ctgaaaataaaaaaattagc

SEQ ID NO: 144927 - DNA, 20 bp, Artificial Sequence
  chemically synthesized
tctactgaaaataaaaaaat

SEQ ID NO: 144928 - DNA, 20 bp, Artificial Sequence
  chemically synthesized
ccagctaatttttttatttt

SEQ ID NO: 144929 - DNA, 20 bp, Artificial Sequence
  chemically synthesized
gctaatttttttattttcag

SEQ ID NO: 144930 - DNA, 20 bp, Artificial Sequence
  chemically synthesized
taatttttttattttcagta

SEQ ID NO: 144931 - DNA, 20 bp, Artificial Sequence
  chemically synthesized
ttttttattttcagtagaga

SEQ ID NO: 144932 - DNA, 20 bp, Artificial Sequence
  chemically synthesized
tttttattttcagtagagat

SEQ ID NO: 144933 - DNA, 20 bp, Artificial Sequence
  chemically synthesized
ttttattttcagtagagatg

SEQ ID NO: 144934 - DNA, 20 bp, Artificial Sequence
  chemically synthesized
ttttcagtagagatggggtt

SEQ ID NO: 144935 - DNA, 20 bp, Artificial Sequence
  chemically synthesized
tggggtttggccatgttgac

SEQ ID NO: 144936 - DNA, 20 bp, Artificial Sequence
  chemically synthesized
tgagaccagcctggtcaaca

SEQ ID NO: 144937 - DNA, 20 bp, Artificial Sequence
  chemically synthesized
ggggtttggccatgttgacc

SEQ ID NO: 144938 - DNA, 20 bp, Artificial Sequence
  chemically synthesized
tttggccatgttgaccaggc

SEQ ID NO: 144939 - DNA, 20 bp, Artificial Sequence
  chemically synthesized
tcaggagtttgagaccagcc

SEQ ID NO: 144940 - DNA, 20 bp, Artificial Sequence
  chemically synthesized
tgaggtcaggagtttgagac

SEQ ID NO: 144941 - DNA, 20 bp, Artificial Sequence
  chemically synthesized
tcacttgaggtcaggagttt

SEQ ID NO: 144942 - DNA, 20 bp, Artificial Sequence
  chemically synthesized
ggtggatcacttgaggtcag

SEQ ID NO: 144943 - DNA, 20 bp, Artificial Sequence
  chemically synthesized
ggtctcaaactcctgacctc

SEQ ID NO: 144944 - DNA, 20 bp, Artificial Sequence
  chemically synthesized
caggtggatcacttgaggtc

SEQ ID NO: 144945 - DNA, 20 bp, Artificial Sequence
  chemically synthesized
gcaggtggatcacttgaggt

SEQ ID NO: 144946 - DNA, 20 bp, Artificial Sequence
  chemically synthesized
tgaggcaggtggatcacttg

SEQ ID NO: 144947 - DNA, 20 bp, Artificial Sequence
  chemically synthesized
ctgaggcaggtggatcactt

SEQ ID NO: 144948 - DNA, 20 bp, Artificial Sequence
  chemically synthesized
ctcaagtgatccacctgcct

SEQ ID NO: 144949 - DNA, 20 bp, Artificial Sequence
  chemically synthesized
ctttgggaggctgaggcagg

SEQ ID NO: 144950 - DNA, 20 bp, Artificial Sequence
  chemically synthesized
gcgctttgggaggctgaggc

SEQ ID NO: 144951 - DNA, 20 bp, Artificial Sequence
  chemically synthesized
agcgctttgggaggctgagg

SEQ ID NO: 144952 - DNA, 20 bp, Artificial Sequence
  chemically synthesized
cccagcgctttgggaggctg

SEQ ID NO: 144953 - DNA, 20 bp, Artificial Sequence
  chemically synthesized
tcccagcgctttgggaggct

SEQ ID NO: 144954 - DNA, 20 bp, Artificial Sequence
  chemically synthesized
ccacctgcctcagcctccca

SEQ ID NO: 144955 - DNA, 20 bp, Artificial Sequence
  chemically synthesized
tgcactcccagcgctttggg

SEQ ID NO: 144956 - DNA, 20 bp, Artificial Sequence
  chemically synthesized
ctgcactcccagcgctttgg

SEQ ID NO: 144957 - DNA, 20 bp, Artificial Sequence
  chemically synthesized
gcctcagcctcccaaagcgc

SEQ ID NO: 144958 - DNA, 20 bp, Artificial Sequence
  chemically synthesized
gcctgcactcccagcgcttt

SEQ ID NO: 144959 - DNA, 20 bp, Artificial Sequence
  chemically synthesized
cctcagcctcccaaagcgct

SEQ ID NO: 144960 - DNA, 20 bp, Artificial Sequence
  chemically synthesized
cgcctgcactcccagcgctt

SEQ ID NO: 144961 - DNA, 20 bp, Artificial Sequence
  chemically synthesized
tcagcctcccaaagcgctgg

SEQ ID NO: 144962 - DNA, 20 bp, Artificial Sequence
  chemically synthesized
ctcccaaagcgctgggagtg

SEQ ID NO: 144963 - DNA, 20 bp, Artificial Sequence
  chemically synthesized
tcccaaagcgctgggagtgc

SEQ ID NO: 144964 - DNA, 20 bp, Artificial Sequence
  chemically synthesized
atgtttcacgcctgcactcc

SEQ ID NO: 144965 - DNA, 20 bp, Artificial Sequence
  chemically synthesized
caggcgtgaaacattgcacc

SEQ ID NO: 144966 - DNA, 20 bp, Artificial Sequence
  chemically synthesized
aaaaactaatgtagagggcc

SEQ ID NO: 144967 - DNA, 20 bp, Artificial Sequence
  chemically synthesized
caaaaactaatgtagagggc

SEQ ID NO: 144968 - DNA, 20 bp, Artificial Sequence
  chemically synthesized
ttgcacctggccctctacat

SEQ ID NO: 144969 - DNA, 20 bp, Artificial Sequence
  chemically synthesized
aggtcaaaaactaatgtaga

SEQ ID NO: 144970 - DNA, 20 bp, Artificial Sequence
  chemically synthesized
taggtcaaaaactaatgtag

SEQ ID NO: 144971 - DNA, 20 bp, Artificial Sequence
  chemically synthesized
ataggtcaaaaactaatgta

SEQ ID NO: 144972 - DNA, 20 bp, Artificial Sequence
  chemically synthesized
atataggtcaaaaactaatg

SEQ ID NO: 144973 - DNA, 20 bp, Artificial Sequence
  chemically synthesized
tagtttttgacctatattta

SEQ ID NO: 144974 - DNA, 20 bp, Artificial Sequence
  chemically synthesized
cagagatcgtctttaaatat

SEQ ID NO: 144975 - DNA, 20 bp, Artificial Sequence
  chemically synthesized
acagagatcgtctttaaata

SEQ ID NO: 144976 - DNA, 20 bp, Artificial Sequence
  chemically synthesized
tatttaaagacgatctctgt

SEQ ID NO: 144977 - DNA, 20 bp, Artificial Sequence
  chemically synthesized
atttaaagacgatctctgtg

SEQ ID NO: 144978 - DNA, 20 bp, Artificial Sequence
  chemically synthesized
tttaaagacgatctctgtga

SEQ ID NO: 144979 - DNA, 20 bp, Artificial Sequence
  chemically synthesized
ttaaagacgatctctgtgag

SEQ ID NO: 144980 - DNA, 20 bp, Artificial Sequence
  chemically synthesized
taaagacgatctctgtgagg

SEQ ID NO: 144981 - DNA, 20 bp, Artificial Sequence
  chemically synthesized
tgatttgatgccccctcaca

SEQ ID NO: 144982 - DNA, 20 bp, Artificial Sequence
  chemically synthesized
actgatttgatgccccctca

SEQ ID NO: 144983 - DNA, 20 bp, Artificial Sequence
  chemically synthesized
tctgtgagggggcatcaaat

SEQ ID NO: 144984 - DNA, 20 bp, Artificial Sequence
  chemically synthesized
gtgagggggcatcaaatcag

SEQ ID NO: 144985 - DNA, 20 bp, Artificial Sequence
  chemically synthesized
aatcagtagtcctttctgaa

SEQ ID NO: 144986 - DNA, 20 bp, Artificial Sequence
  chemically synthesized
taaatgtgtccttttcagaa

SEQ ID NO: 144987 - DNA, 20 bp, Artificial Sequence
  chemically synthesized
atcagtagtcctttctgaaa

SEQ ID NO: 144988 - DNA, 20 bp, Artificial Sequence
  chemically synthesized
ataaatgtgtccttttcaga

SEQ ID NO: 144989 - DNA, 20 bp, Artificial Sequence
  chemically synthesized
ctaaataaatgtgtcctttt

SEQ ID NO: 144990 - DNA, 20 bp, Artificial Sequence
  chemically synthesized
ctgaaaaggacacatttatt

SEQ ID NO: 144991 - DNA, 20 bp, Artificial Sequence
  chemically synthesized
gaaaaggacacatttattta

SEQ ID NO: 144992 - DNA, 20 bp, Artificial Sequence
  chemically synthesized
cacatttatttagagaactc

SEQ ID NO: 144993 - DNA, 20 bp, Artificial Sequence
  chemically synthesized
catttatttagagaactctg

SEQ ID NO: 144994 - DNA, 20 bp, Artificial Sequence
  chemically synthesized
gatgtgctcagtagtctcca

SEQ ID NO: 144995 - DNA, 20 bp, Artificial Sequence
  chemically synthesized
ttgatgtgctcagtagtctc

SEQ ID NO: 144996 - DNA, 20 bp, Artificial Sequence
  chemically synthesized
agagaactctggagactact

SEQ ID NO: 144997 - DNA, 20 bp, Artificial Sequence
  chemically synthesized
gaagccattgatgtgctcag

SEQ ID NO: 144998 - DNA, 20 bp, Artificial Sequence
  chemically synthesized
agggaagccattgatgtgct

SEQ ID NO: 144999 - DNA, 20 bp, Artificial Sequence
  chemically synthesized
gagactactgagcacatcaa

SEQ ID NO: 145000 - DNA, 20 bp, Artificial Sequence
  chemically synthesized
tgtgagtccagcatttaggg

SEQ ID NO: 145001 - DNA, 20 bp, Artificial Sequence
  chemically synthesized
tcaatggcttccctaaatgc

SEQ ID NO: 145002 - DNA, 20 bp, Artificial Sequence
  chemically synthesized
gtttgtgagtccagcattta

SEQ ID NO: 145003 - DNA, 20 bp, Artificial Sequence
  chemically synthesized
ggtttgtgagtccagcattt

SEQ ID NO: 145004 - DNA, 20 bp, Artificial Sequence
  chemically synthesized
gggtttgtgagtccagcatt

SEQ ID NO: 145005 - DNA, 20 bp, Artificial Sequence
  chemically synthesized
ttgtgacgggtttgtgagtc

SEQ ID NO: 145006 - DNA, 20 bp, Artificial Sequence
  chemically synthesized
cttccttgtgacgggtttgt

SEQ ID NO: 145007 - DNA, 20 bp, Artificial Sequence
  chemically synthesized
tggactcacaaacccgtcac

SEQ ID NO: 145008 - DNA, 20 bp, Artificial Sequence
  chemically synthesized
ggactcacaaacccgtcaca

SEQ ID NO: 145009 - DNA, 20 bp, Artificial Sequence
  chemically synthesized
agtccacacttccttgtgac

SEQ ID NO: 145010 - DNA, 20 bp, Artificial Sequence
  chemically synthesized
aagtccacacttccttgtga

SEQ ID NO: 145011 - DNA, 20 bp, Artificial Sequence
  chemically synthesized
ctcacaaacccgtcacaagg

SEQ ID NO: 145012 - DNA, 20 bp, Artificial Sequence
  chemically synthesized
aaacccgtcacaaggaagtg

SEQ ID NO: 145013 - DNA, 20 bp, Artificial Sequence
  chemically synthesized
agataatagattgggagaga

SEQ ID NO: 145014 - DNA, 20 bp, Artificial Sequence
  chemically synthesized
taccagataatagattggga

SEQ ID NO: 145015 - DNA, 20 bp, Artificial Sequence
  chemically synthesized
gttaccagataatagattgg

SEQ ID NO: 145016 - DNA, 20 bp, Artificial Sequence
  chemically synthesized
aagttaccagataatagatt

SEQ ID NO: 145017 - DNA, 20 bp, Artificial Sequence
  chemically synthesized
gaagttaccagataatagat

SEQ ID NO: 145018 - DNA, 20 bp, Artificial Sequence
  chemically synthesized
ttctctcccaatctattatc

SEQ ID NO: 145019 - DNA, 20 bp, Artificial Sequence
  chemically synthesized
ctgcagaagttaccagataa

SEQ ID NO: 145020 - DNA, 20 bp, Artificial Sequence
  chemically synthesized
tagcttcctgcagaagttac

SEQ ID NO: 145021 - DNA, 20 bp, Artificial Sequence
  chemically synthesized
ctattatctggtaacttctg

SEQ ID NO: 145022 - DNA, 20 bp, Artificial Sequence
  chemically synthesized
tattatctggtaacttctgc

SEQ ID NO: 145023 - DNA, 20 bp, Artificial Sequence
  chemically synthesized
tatctggtaacttctgcagg

SEQ ID NO: 145024 - DNA, 20 bp, Artificial Sequence
  chemically synthesized
attgacatagcttcctgcag

SEQ ID NO: 145025 - DNA, 20 bp, Artificial Sequence
  chemically synthesized
accattgacatagcttcctg

SEQ ID NO: 145026 - DNA, 20 bp, Artificial Sequence
  chemically synthesized
tctgcaggaagctatgtcaa

SEQ ID NO: 145027 - DNA, 20 bp, Artificial Sequence
  chemically synthesized
agcctagtctaccattgaca

SEQ ID NO: 145028 - DNA, 20 bp, Artificial Sequence
  chemically synthesized
gcaggaagctatgtcaatgg

SEQ ID NO: 145029 - DNA, 20 bp, Artificial Sequence
  chemically synthesized
aagctatgtcaatggtagac

SEQ ID NO: 145030 - DNA, 20 bp, Artificial Sequence
  chemically synthesized
agctatgtcaatggtagact

SEQ ID NO: 145031 - DNA, 20 bp, Artificial Sequence
  chemically synthesized
gtcaatggtagactaggcta

SEQ ID NO: 145032 - DNA, 20 bp, Artificial Sequence
  chemically synthesized
ttgtttccgcttctgtagcc

SEQ ID NO: 145033 - DNA, 20 bp, Artificial Sequence
  chemically synthesized
aatggtagactaggctacag

SEQ ID NO: 145034 - DNA, 20 bp, Artificial Sequence
  chemically synthesized
ggtagactaggctacagaag

SEQ ID NO: 145035 - DNA, 20 bp, Artificial Sequence
  chemically synthesized
agagcttgtttccgcttctg

SEQ ID NO: 145036 - DNA, 20 bp, Artificial Sequence
  chemically synthesized
taggctacagaagcggaaac

SEQ ID NO: 145037 - DNA, 20 bp, Artificial Sequence
  chemically synthesized
ataatattatatggaaatga

SEQ ID NO: 145038 - DNA, 20 bp, Artificial Sequence
  chemically synthesized
tcataatattatatggaaat

SEQ ID NO: 145039 - DNA, 20 bp, Artificial Sequence
  chemically synthesized
tatcacatcataatattata

SEQ ID NO: 145040 - DNA, 20 bp, Artificial Sequence
  chemically synthesized
taatattatgatgtgatata

SEQ ID NO: 145041 - DNA, 20 bp, Artificial Sequence
  chemically synthesized
cataatacaaatgccatcat

SEQ ID NO: 145042 - DNA, 20 bp, Artificial Sequence
  chemically synthesized
tctagaaatctaaccaatga

SEQ ID NO: 145043 - DNA, 20 bp, Artificial Sequence
  chemically synthesized
atacaaatgccatcattggt

SEQ ID NO: 145044 - DNA, 20 bp, Artificial Sequence
  chemically synthesized
gccatcattggttagatttc

SEQ ID NO: 145045 - DNA, 20 bp, Artificial Sequence
  chemically synthesized
catcattggttagatttcta

SEQ ID NO: 145046 - DNA, 20 bp, Artificial Sequence
  chemically synthesized
ggttagatttctagagttcg

SEQ ID NO: 145047 - DNA, 20 bp, Artificial Sequence
  chemically synthesized
tttggttccaccacgaactc

SEQ ID NO: 145048 - DNA, 20 bp, Artificial Sequence
  chemically synthesized
tagatttctagagttcgtgg

SEQ ID NO: 145049 - DNA, 20 bp, Artificial Sequence
  chemically synthesized
caaatgttagtaattatatt

SEQ ID NO: 145050 - DNA, 20 bp, Artificial Sequence
  chemically synthesized
tgctagtattgaacaaatgt

SEQ ID NO: 145051 - DNA, 20 bp, Artificial Sequence
  chemically synthesized
tactaacatttgttcaatac

SEQ ID NO: 145052 - DNA, 20 bp, Artificial Sequence
  chemically synthesized
taacatttgttcaatactag

SEQ ID NO: 145053 - DNA, 20 bp, Artificial Sequence
  chemically synthesized
atttgttcaatactagcagt

SEQ ID NO: 145054 - DNA, 20 bp, Artificial Sequence
  chemically synthesized
ccttgcttactgcttactgc

SEQ ID NO: 145055 - DNA, 20 bp, Artificial Sequence
  chemically synthesized
tgttcaatactagcagtaag

SEQ ID NO: 145056 - DNA, 20 bp, Artificial Sequence
  chemically synthesized
caatactagcagtaagcagt

SEQ ID NO: 145057 - DNA, 20 bp, Artificial Sequence
  chemically synthesized
actagcagtaagcagtaagc

SEQ ID NO: 145058 - DNA, 20 bp, Artificial Sequence
  chemically synthesized
ctagcagtaagcagtaagca

SEQ ID NO: 145059 - DNA, 20 bp, Artificial Sequence
  chemically synthesized
agtaagcagtaagcaaggca

SEQ ID NO: 145060 - DNA, 20 bp, Artificial Sequence
  chemically synthesized
aagcagtaagcaaggcaaag

SEQ ID NO: 145061 - DNA, 20 bp, Artificial Sequence
  chemically synthesized
agcagtaagcaaggcaaagt

SEQ ID NO: 145062 - DNA, 20 bp, Artificial Sequence
  chemically synthesized
agtaagcaaggcaaagtggg

SEQ ID NO: 145063 - DNA, 20 bp, Artificial Sequence
  chemically synthesized
gtcatcaggattaagttggt

SEQ ID NO: 145064 - DNA, 20 bp, Artificial Sequence
  chemically synthesized
gtttgtcatcaggattaagt

SEQ ID NO: 145065 - DNA, 20 bp, Artificial Sequence
  chemically synthesized
tgcagtttgtcatcaggatt

SEQ ID NO: 145066 - DNA, 20 bp, Artificial Sequence
  chemically synthesized
ctgccttgcagtttgtcatc

SEQ ID NO: 145067 - DNA, 20 bp, Artificial Sequence
  chemically synthesized
tctgccttgcagtttgtcat

SEQ ID NO: 145068 - DNA, 20 bp, Artificial Sequence
  chemically synthesized
taatcctgatgacaaactgc

SEQ ID NO: 145069 - DNA, 20 bp, Artificial Sequence
  chemically synthesized
aatcctgatgacaaactgca

SEQ ID NO: 145070 - DNA, 20 bp, Artificial Sequence
  chemically synthesized
cctgatgacaaactgcaagg

SEQ ID NO: 145071 - DNA, 20 bp, Artificial Sequence
  chemically synthesized
tagttgtactatctgccttg

SEQ ID NO: 145072 - DNA, 20 bp, Artificial Sequence
  chemically synthesized
atgacaaactgcaaggcaga

SEQ ID NO: 145073 - DNA, 20 bp, Artificial Sequence
  chemically synthesized
atctagctataaaatgggga

SEQ ID NO: 145074 - DNA, 20 bp, Artificial Sequence
  chemically synthesized
gtacaactatccccatttta

SEQ ID NO: 145075 - DNA, 20 bp, Artificial Sequence
  chemically synthesized
gtttatctagctataaaatg

SEQ ID NO: 145076 - DNA, 20 bp, Artificial Sequence
  chemically synthesized
agtttatctagctataaaat

SEQ ID NO: 145077 - DNA, 20 bp, Artificial Sequence
  chemically synthesized
aagtttatctagctataaaa

SEQ ID NO: 145078 - DNA, 20 bp, Artificial Sequence
  chemically synthesized
aactatccccattttatagc

SEQ ID NO: 145079 - DNA, 20 bp, Artificial Sequence
  chemically synthesized
tacctgagcccaagtttatc

SEQ ID NO: 145080 - DNA, 20 bp, Artificial Sequence
  chemically synthesized
attttatagctagataaact

SEQ ID NO: 145081 - DNA, 20 bp, Artificial Sequence
  chemically synthesized
ttttatagctagataaactt

SEQ ID NO: 145082 - DNA, 20 bp, Artificial Sequence
  chemically synthesized
tagctagataaacttgggct

SEQ ID NO: 145083 - DNA, 20 bp, Artificial Sequence
  chemically synthesized
agctagataaacttgggctc

SEQ ID NO: 145084 - DNA, 20 bp, Artificial Sequence
  chemically synthesized
tattctgcctacctgagccc

SEQ ID NO: 145085 - DNA, 20 bp, Artificial Sequence
  chemically synthesized
tagataaacttgggctcagg

SEQ ID NO: 145086 - DNA, 20 bp, Artificial Sequence
  chemically synthesized
agataaacttgggctcaggt

SEQ ID NO: 145087 - DNA, 20 bp, Artificial Sequence
  chemically synthesized
taaacttgggctcaggtagg

SEQ ID NO: 145088 - DNA, 20 bp, Artificial Sequence
  chemically synthesized
gtaagttattctgcctacct

SEQ ID NO: 145089 - DNA, 20 bp, Artificial Sequence
  chemically synthesized
gtaggcagaataacttactc

SEQ ID NO: 145090 - DNA, 20 bp, Artificial Sequence
  chemically synthesized
taggcagaataacttactca

SEQ ID NO: 145091 - DNA, 20 bp, Artificial Sequence
  chemically synthesized
caagctgtgtgaccttgagt

SEQ ID NO: 145092 - DNA, 20 bp, Artificial Sequence
  chemically synthesized
ctcccaagctgtgtgacctt

SEQ ID NO: 145093 - DNA, 20 bp, Artificial Sequence
  chemically synthesized
ataacttactcaaggtcaca

SEQ ID NO: 145094 - DNA, 20 bp, Artificial Sequence
  chemically synthesized
ttactcaaggtcacacagct

SEQ ID NO: 145095 - DNA, 20 bp, Artificial Sequence
  chemically synthesized
tactcaaggtcacacagctt

SEQ ID NO: 145096 - DNA, 20 bp, Artificial Sequence
  chemically synthesized
ctcaaggtcacacagcttgg

SEQ ID NO: 145097 - DNA, 20 bp, Artificial Sequence
  chemically synthesized
ggtcacacagcttgggagcc

SEQ ID NO: 145098 - DNA, 20 bp, Artificial Sequence
  chemically synthesized
gggttcaaagcttggctccc

SEQ ID NO: 145099 - DNA, 20 bp, Artificial Sequence
  chemically synthesized
cattgtctgggttcaaagct

SEQ ID NO: 145100 - DNA, 20 bp, Artificial Sequence
  chemically synthesized
tgggagccaagctttgaacc

SEQ ID NO: 145101 - DNA, 20 bp, Artificial Sequence
  chemically synthesized
agttacattgtctgggttca

SEQ ID NO: 145102 - DNA, 20 bp, Artificial Sequence
  chemically synthesized
gttttgaagttacattgtct

SEQ ID NO: 145103 - DNA, 20 bp, Artificial Sequence
  chemically synthesized
ggttttgaagttacattgtc

SEQ ID NO: 145104 - DNA, 20 bp, Artificial Sequence
  chemically synthesized
gacaatgtaacttcaaaacc

SEQ ID NO: 145105 - DNA, 20 bp, Artificial Sequence
  chemically synthesized
tgtttaaagcccaggttttg

SEQ ID NO: 145106 - DNA, 20 bp, Artificial Sequence
  chemically synthesized
acaatgtaacttcaaaacct

SEQ ID NO: 145107 - DNA, 20 bp, Artificial Sequence
  chemically synthesized
ttttataatgtttaaagccc

SEQ ID NO: 145108 - DNA, 20 bp, Artificial Sequence
  chemically synthesized
attttataatgtttaaagcc

SEQ ID NO: 145109 - DNA, 20 bp, Artificial Sequence
  chemically synthesized
acaatattttataatgttta

SEQ ID NO: 145110 - DNA, 20 bp, Artificial Sequence
  chemically synthesized
ttataaaatattgtttcctt

SEQ ID NO: 145111 - DNA, 20 bp, Artificial Sequence
  chemically synthesized
ccaggacttttatttaccaa

SEQ ID NO: 145112 - DNA, 20 bp, Artificial Sequence
  chemically synthesized
cccaggacttttatttacca

SEQ ID NO: 145113 - DNA, 20 bp, Artificial Sequence
  chemically synthesized
ttgtttcctttggtaaataa

SEQ ID NO: 145114 - DNA, 20 bp, Artificial Sequence
  chemically synthesized
cctttggtaaataaaagtcc

SEQ ID NO: 145115 - DNA, 20 bp, Artificial Sequence
  chemically synthesized
ctttggtaaataaaagtcct

SEQ ID NO: 145116 - DNA, 20 bp, Artificial Sequence
  chemically synthesized
ttggtaaataaaagtcctgg

SEQ ID NO: 145117 - DNA, 20 bp, Artificial Sequence
  chemically synthesized
ttgagttatataatactccc

SEQ ID NO: 145118 - DNA, 20 bp, Artificial Sequence
  chemically synthesized
attgagttatataatactcc

SEQ ID NO: 145119 - DNA, 20 bp, Artificial Sequence
  chemically synthesized
gagtattatataactcaata

SEQ ID NO: 145120 - DNA, 20 bp, Artificial Sequence
  chemically synthesized
ttcttttacaataccatatt

SEQ ID NO: 145121 - DNA, 20 bp, Artificial Sequence
  chemically synthesized
aactcaatatggtattgtaa

SEQ ID NO: 145122 - DNA, 20 bp, Artificial Sequence
  chemically synthesized
ctgatacatacagaaacaag

SEQ ID NO: 145123 - DNA, 20 bp, Artificial Sequence
  chemically synthesized
actgatacatacagaaacaa

SEQ ID NO: 145124 - DNA, 20 bp, Artificial Sequence
  chemically synthesized
gtactgatacatacagaaac

SEQ ID NO: 145125 - DNA, 20 bp, Artificial Sequence
  chemically synthesized
cctcttgtttctgtatgtat

SEQ ID NO: 145126 - DNA, 20 bp, Artificial Sequence
  chemically synthesized
ttgctatgtactgatacata

SEQ ID NO: 145127 - DNA, 20 bp, Artificial Sequence
  chemically synthesized
tttctgtatgtatcagtaca

SEQ ID NO: 145128 - DNA, 20 bp, Artificial Sequence
  chemically synthesized
acactatgctgagcatttta

SEQ ID NO: 145129 - DNA, 20 bp, Artificial Sequence
  chemically synthesized
catagcaaccataaaatgct

SEQ ID NO: 145130 - DNA, 20 bp, Artificial Sequence
  chemically synthesized
caaccataaaatgctcagca

SEQ ID NO: 145131 - DNA, 20 bp, Artificial Sequence
  chemically synthesized
tctatgtcagacactatgct

SEQ ID NO: 145132 - DNA, 20 bp, Artificial Sequence
  chemically synthesized
gctcagcatagtgtctgaca

SEQ ID NO: 145133 - DNA, 20 bp, Artificial Sequence
  chemically synthesized
gatgtagatgtagtctatgt

SEQ ID NO: 145134 - DNA, 20 bp, Artificial Sequence
  chemically synthesized
tttgtatgtagatgtagatg

SEQ ID NO: 145135 - DNA, 20 bp, Artificial Sequence
  chemically synthesized
tagtgatttgtatgtagatg

SEQ ID NO: 145136 - DNA, 20 bp, Artificial Sequence
  chemically synthesized
actatttagtgatttgtatg

SEQ ID NO: 145137 - DNA, 20 bp, Artificial Sequence
  chemically synthesized
tctacatacaaatcactaaa

SEQ ID NO: 145138 - DNA, 20 bp, Artificial Sequence
  chemically synthesized
ctgtaactgcagttactatt

SEQ ID NO: 145139 - DNA, 20 bp, Artificial Sequence
  chemically synthesized
aaatcactaaatagtaactg

SEQ ID NO: 145140 - DNA, 20 bp, Artificial Sequence
  chemically synthesized
ctaaatagtaactgcagtta

SEQ ID NO: 145141 - DNA, 20 bp, Artificial Sequence
  chemically synthesized
tgcggtaataactgtaactg

SEQ ID NO: 145142 - DNA, 20 bp, Artificial Sequence
  chemically synthesized
tgcagttacagttattaccg

SEQ ID NO: 145143 - DNA, 20 bp, Artificial Sequence
  chemically synthesized
tacagttattaccgcagcaa

SEQ ID NO: 145144 - DNA, 20 bp, Artificial Sequence
  chemically synthesized
agcaatacatactattgctg

SEQ ID NO: 145145 - DNA, 20 bp, Artificial Sequence
  chemically synthesized
gcaatagtatgtattgcttg

SEQ ID NO: 145146 - DNA, 20 bp, Artificial Sequence
  chemically synthesized
gcaagtaatatatgtactgc

SEQ ID NO: 145147 - DNA, 20 bp, Artificial Sequence
  chemically synthesized
ctgcagagagtatacgtagc

SEQ ID NO: 145148 - DNA, 20 bp, Artificial Sequence
  chemically synthesized
gctactgcagagagtatacg

SEQ ID NO: 145149 - DNA, 20 bp, Artificial Sequence
  chemically synthesized
cttgctacgtatactctctg

SEQ ID NO: 145150 - DNA, 20 bp, Artificial Sequence
  chemically synthesized
gctacgtatactctctgcag

SEQ ID NO: 145151 - DNA, 20 bp, Artificial Sequence
  chemically synthesized
ttattacttgctactgcaga

SEQ ID NO: 145152 - DNA, 20 bp, Artificial Sequence
  chemically synthesized
tgttattacttgctactgca

SEQ ID NO: 145153 - DNA, 20 bp, Artificial Sequence
  chemically synthesized
cgtatactctctgcagtagc

SEQ ID NO: 145154 - DNA, 20 bp, Artificial Sequence
  chemically synthesized
tgtgttattacttgctactg

SEQ ID NO: 145155 - DNA, 20 bp, Artificial Sequence
  chemically synthesized
gcagtagcaagtaataacac

SEQ ID NO: 145156 - DNA, 20 bp, Artificial Sequence
  chemically synthesized
agcaagtaataacacaagct

SEQ ID NO: 145157 - DNA, 20 bp, Artificial Sequence
  chemically synthesized
gcaagtaataacacaagctt

SEQ ID NO: 145158 - DNA, 20 bp, Artificial Sequence
  chemically synthesized
tccaagtccatttgattcct

SEQ ID NO: 145159 - DNA, 20 bp, Artificial Sequence
  chemically synthesized
acacaagcttaggaatcaaa

SEQ ID NO: 145160 - DNA, 20 bp, Artificial Sequence
  chemically synthesized
gcttaggaatcaaatggact

SEQ ID NO: 145161 - DNA, 20 bp, Artificial Sequence
  chemically synthesized
cagaacaaggattcaaatcc

SEQ ID NO: 145162 - DNA, 20 bp, Artificial Sequence
  chemically synthesized
tcccagtaagtagcagaaca

SEQ ID NO: 145163 - DNA, 20 bp, Artificial Sequence
  chemically synthesized
ttcccagtaagtagcagaac

SEQ ID NO: 145164 - DNA, 20 bp, Artificial Sequence
  chemically synthesized
gtcaaattcccagtaagtag

SEQ ID NO: 145165 - DNA, 20 bp, Artificial Sequence
  chemically synthesized
atccttgttctgctacttac

SEQ ID NO: 145166 - DNA, 20 bp, Artificial Sequence
  chemically synthesized
tccttgttctgctacttact

SEQ ID NO: 145167 - DNA, 20 bp, Artificial Sequence
  chemically synthesized
gatgtcaaattcccagtaag

SEQ ID NO: 145168 - DNA, 20 bp, Artificial Sequence
  chemically synthesized
atagatgtcaaattcccagt

SEQ ID NO: 145169 - DNA, 20 bp, Artificial Sequence
  chemically synthesized
gctcatagatgtcaaattcc

SEQ ID NO: 145170 - DNA, 20 bp, Artificial Sequence
  chemically synthesized
actgggaatttgacatctat

SEQ ID NO: 145171 - DNA, 20 bp, Artificial Sequence
  chemically synthesized
aatttgacatctatgagcct

SEQ ID NO: 145172 - DNA, 20 bp, Artificial Sequence
  chemically synthesized
gaaaaagtaactgaggctca

SEQ ID NO: 145173 - DNA, 20 bp, Artificial Sequence
  chemically synthesized
tttttcagaaaaagtaactg

SEQ ID NO: 145174 - DNA, 20 bp, Artificial Sequence
  chemically synthesized
atttttcagaaaaagtaact

SEQ ID NO: 145175 - DNA, 20 bp, Artificial Sequence
  chemically synthesized
atagccacatttttcagaaa

SEQ ID NO: 145176 - DNA, 20 bp, Artificial Sequence
  chemically synthesized
gttactttttctgaaaaatg

SEQ ID NO: 145177 - DNA, 20 bp, Artificial Sequence
  chemically synthesized
gtaattatagccacattttt

SEQ ID NO: 145178 - DNA, 20 bp, Artificial Sequence
  chemically synthesized
tgctttaaaaaaagtaatta

SEQ ID NO: 145179 - DNA, 20 bp, Artificial Sequence
  chemically synthesized
ggctataattacttttttta

SEQ ID NO: 145180 - DNA, 20 bp, Artificial Sequence
  chemically synthesized
ttttacttctgctttaaaaa

SEQ ID NO: 145181 - DNA, 20 bp, Artificial Sequence
  chemically synthesized
tataattactttttttaaag

SEQ ID NO: 145182 - DNA, 20 bp, Artificial Sequence
  chemically synthesized
aattactttttttaaagcag

SEQ ID NO: 145183 - DNA, 20 bp, Artificial Sequence
  chemically synthesized
agcagaagtaaaacaaattt

SEQ ID NO: 145184 - DNA, 20 bp, Artificial Sequence
  chemically synthesized
gcagaagtaaaacaaatttt

SEQ ID NO: 145185 - DNA, 20 bp, Artificial Sequence
  chemically synthesized
aaattttaggtacatatatg

SEQ ID NO: 145186 - DNA, 20 bp, Artificial Sequence
  chemically synthesized
tcacaatatagttatggata

SEQ ID NO: 145187 - DNA, 20 bp, Artificial Sequence
  chemically synthesized
tcacattcacaatatagtta

SEQ ID NO: 145188 - DNA, 20 bp, Artificial Sequence
  chemically synthesized
acacattcacattcacaata

SEQ ID NO: 145189 - DNA, 20 bp, Artificial Sequence
  chemically synthesized
ttctgagtacagagcataca

SEQ ID NO: 145190 - DNA, 20 bp, Artificial Sequence
  chemically synthesized
tattctgagtacagagcata

SEQ ID NO: 145191 - DNA, 20 bp, Artificial Sequence
  chemically synthesized
tactctgtatgctctgtact

SEQ ID NO: 145192 - DNA, 20 bp, Artificial Sequence
  chemically synthesized
cgtttcctattctgagtaca

SEQ ID NO: 145193 - DNA, 20 bp, Artificial Sequence
  chemically synthesized
ttcgtttcctattctgagta

SEQ ID NO: 145194 - DNA, 20 bp, Artificial Sequence
  chemically synthesized
tgtatgctctgtactcagaa

SEQ ID NO: 145195 - DNA, 20 bp, Artificial Sequence
  chemically synthesized
gtatgctctgtactcagaat

SEQ ID NO: 145196 - DNA, 20 bp, Artificial Sequence
  chemically synthesized
ggatcttcgtttcctattct

SEQ ID NO: 145197 - DNA, 20 bp, Artificial Sequence
  chemically synthesized
tgtactcagaataggaaacg

SEQ ID NO: 145198 - DNA, 20 bp, Artificial Sequence
  chemically synthesized
cagaataggaaacgaagatc

SEQ ID NO: 145199 - DNA, 20 bp, Artificial Sequence
  chemically synthesized
gaataggaaacgaagatcca

SEQ ID NO: 145200 - DNA, 20 bp, Artificial Sequence
  chemically synthesized
aggaaacgaagatccagaga

SEQ ID NO: 145201 - DNA, 20 bp, Artificial Sequence
  chemically synthesized
gattgtggtcaagccatctc

SEQ ID NO: 145202 - DNA, 20 bp, Artificial Sequence
  chemically synthesized
tgcaaatgatgattgtggtc

SEQ ID NO: 145203 - DNA, 20 bp, Artificial Sequence
  chemically synthesized
ccatttgcaaatgatgattg

SEQ ID NO: 145204 - DNA, 20 bp, Artificial Sequence
  chemically synthesized
ccacaatcatcatttgcaaa

SEQ ID NO: 145205 - DNA, 20 bp, Artificial Sequence
  chemically synthesized
tttgcaaatggcactgaatt

SEQ ID NO: 145206 - DNA, 20 bp, Artificial Sequence
  chemically synthesized
ttgcaaatggcactgaattc

SEQ ID NO: 145207 - DNA, 20 bp, Artificial Sequence
  chemically synthesized
gaatacagaagacctgaatt

SEQ ID NO: 145208 - DNA, 20 bp, Artificial Sequence
  chemically synthesized
ggccttgagcttgaatacag

SEQ ID NO: 145209 - DNA, 20 bp, Artificial Sequence
  chemically synthesized
aattcaggtcttctgtattc

SEQ ID NO: 145210 - DNA, 20 bp, Artificial Sequence
  chemically synthesized
aaaggccttgagcttgaata

SEQ ID NO: 145211 - DNA, 20 bp, Artificial Sequence
  chemically synthesized
ggtcttctgtattcaagctc

SEQ ID NO: 145212 - DNA, 20 bp, Artificial Sequence
  chemically synthesized
gtcttctgtattcaagctca

SEQ ID NO: 145213 - DNA, 20 bp, Artificial Sequence
  chemically synthesized
aacctgcatttaaaggcctt

SEQ ID NO: 145214 - DNA, 20 bp, Artificial Sequence
  chemically synthesized
aagctcaaggcctttaaatg

SEQ ID NO: 145215 - DNA, 20 bp, Artificial Sequence
  chemically synthesized
agtaaacaacctgcatttaa

SEQ ID NO: 145216 - DNA, 20 bp, Artificial Sequence
  chemically synthesized
agctcaaggcctttaaatgc

SEQ ID NO: 145217 - DNA, 20 bp, Artificial Sequence
  chemically synthesized
tagtaaacaacctgcattta

SEQ ID NO: 145218 - DNA, 20 bp, Artificial Sequence
  chemically synthesized
taggaataaaagtaatttga

SEQ ID NO: 145219 - DNA, 20 bp, Artificial Sequence
  chemically synthesized
caccaattccataggaataa

SEQ ID NO: 145220 - DNA, 20 bp, Artificial Sequence
  chemically synthesized
tcaaattacttttattccta

SEQ ID NO: 145221 - DNA, 20 bp, Artificial Sequence
  chemically synthesized
tacttttattcctatggaat

SEQ ID NO: 145222 - DNA, 20 bp, Artificial Sequence
  chemically synthesized
ataaacttcaccaattccat

SEQ ID NO: 145223 - DNA, 20 bp, Artificial Sequence
  chemically synthesized
aataaacttcaccaattcca

SEQ ID NO: 145224 - DNA, 20 bp, Artificial Sequence
  chemically synthesized
ttattcctatggaattggtg

SEQ ID NO: 145225 - DNA, 20 bp, Artificial Sequence
  chemically synthesized
ttggtgaagtttattttaca

SEQ ID NO: 145226 - DNA, 20 bp, Artificial Sequence
  chemically synthesized
agtgaggcagacagagtaag

SEQ ID NO: 145227 - DNA, 20 bp, Artificial Sequence
  chemically synthesized
aagtgaggcagacagagtaa

SEQ ID NO: 145228 - DNA, 20 bp, Artificial Sequence
  chemically synthesized
gaagtgaggcagacagagta

SEQ ID NO: 145229 - DNA, 20 bp, Artificial Sequence
  chemically synthesized
agaagtgaggcagacagagt

SEQ ID NO: 145230 - DNA, 20 bp, Artificial Sequence
  chemically synthesized
aacaagaagtgaggcagaca

SEQ ID NO: 145231 - DNA, 20 bp, Artificial Sequence
  chemically synthesized
aaaacaagaagtgaggcaga

SEQ ID NO: 145232 - DNA, 20 bp, Artificial Sequence
  chemically synthesized
tgaaaaaacaagaagtgagg

SEQ ID NO: 145233 - DNA, 20 bp, Artificial Sequence
  chemically synthesized
ttttgaaaaaacaagaagtg

SEQ ID NO: 145234 - DNA, 20 bp, Artificial Sequence
  chemically synthesized
cttttgaaaaaacaagaagt

SEQ ID NO: 145235 - DNA, 20 bp, Artificial Sequence
  chemically synthesized
ctaccttttgaaaaaacaag

SEQ ID NO: 145236 - DNA, 20 bp, Artificial Sequence
  chemically synthesized
gtactaccttttgaaaaaac

SEQ ID NO: 145237 - DNA, 20 bp, Artificial Sequence
  chemically synthesized
ctcacttcttgttttttcaa

SEQ ID NO: 145238 - DNA, 20 bp, Artificial Sequence
  chemically synthesized
tcacttcttgttttttcaaa

SEQ ID NO: 145239 - DNA, 20 bp, Artificial Sequence
  chemically synthesized
cttcttgttttttcaaaagg

SEQ ID NO: 145240 - DNA, 20 bp, Artificial Sequence
  chemically synthesized
ctgaaggtatttaggtatta

SEQ ID NO: 145241 - DNA, 20 bp, Artificial Sequence
  chemically synthesized
aagttgtgctgaaggtattt

SEQ ID NO: 145242 - DNA, 20 bp, Artificial Sequence
  chemically synthesized
aaagttgtgctgaaggtatt

SEQ ID NO: 145243 - DNA, 20 bp, Artificial Sequence
  chemically synthesized
ctttaatacctaaatacctt

SEQ ID NO: 145244 - DNA, 20 bp, Artificial Sequence
  chemically synthesized
gaaatacaaagttgtgctga

SEQ ID NO: 145245 - DNA, 20 bp, Artificial Sequence
  chemically synthesized
agaaatacaaagttgtgctg

SEQ ID NO: 145246 - DNA, 20 bp, Artificial Sequence
  chemically synthesized
agcctttctaaagaaataca

SEQ ID NO: 145247 - DNA, 20 bp, Artificial Sequence
  chemically synthesized
agcacaactttgtatttctt

SEQ ID NO: 145248 - DNA, 20 bp, Artificial Sequence
  chemically synthesized
caactttgtatttctttaga

SEQ ID NO: 145249 - DNA, 20 bp, Artificial Sequence
  chemically synthesized
aactttgtatttctttagaa

SEQ ID NO: 145250 - DNA, 20 bp, Artificial Sequence
  chemically synthesized
acagctttcaagcctttcta

SEQ ID NO: 145251 - DNA, 20 bp, Artificial Sequence
  chemically synthesized
atttctttagaaaggcttga

SEQ ID NO: 145252 - DNA, 20 bp, Artificial Sequence
  chemically synthesized
tttcacttgtaacagctttc

SEQ ID NO: 145253 - DNA, 20 bp, Artificial Sequence
  chemically synthesized
aaaggcttgaaagctgttac

SEQ ID NO: 145254 - DNA, 20 bp, Artificial Sequence
  chemically synthesized
taaagttttttcacttgtaa

SEQ ID NO: 145255 - DNA, 20 bp, Artificial Sequence
  chemically synthesized
gttggaattgttatacatta

SEQ ID NO: 145256 - DNA, 20 bp, Artificial Sequence
  chemically synthesized
atgattaagaaaaataatgt

SEQ ID NO: 145257 - DNA, 20 bp, Artificial Sequence
  chemically synthesized
ttttatatttgtgaatgatt

SEQ ID NO: 145258 - DNA, 20 bp, Artificial Sequence
  chemically synthesized
ttaatcattcacaaatataa

SEQ ID NO: 145259 - DNA, 20 bp, Artificial Sequence
  chemically synthesized
tcacaaatataaaagatata

SEQ ID NO: 145260 - DNA, 20 bp, Artificial Sequence
  chemically synthesized
gatatatagtatatttgatc

SEQ ID NO: 145261 - DNA, 20 bp, Artificial Sequence
  chemically synthesized
tatagtatatttgatctagc

SEQ ID NO: 145262 - DNA, 20 bp, Artificial Sequence
  chemically synthesized
atagtatatttgatctagct

SEQ ID NO: 145263 - DNA, 20 bp, Artificial Sequence
  chemically synthesized
gtaaatatggtttacctagc

SEQ ID NO: 145264 - DNA, 20 bp, Artificial Sequence
  chemically synthesized
tgatgtaaatatggtttacc

SEQ ID NO: 145265 - DNA, 20 bp, Artificial Sequence
  chemically synthesized
agaatacattgatgtaaata

SEQ ID NO: 145266 - DNA, 20 bp, Artificial Sequence
  chemically synthesized
tcaatgtattctaatgtttc

SEQ ID NO: 145267 - DNA, 20 bp, Artificial Sequence
  chemically synthesized
atgacatcaactagaaacat

SEQ ID NO: 145268 - DNA, 20 bp, Artificial Sequence
  chemically synthesized
ggtaaaattatgacatcaac

SEQ ID NO: 145269 - DNA, 20 bp, Artificial Sequence
  chemically synthesized
gatgtcataattttaccaaa

SEQ ID NO: 145270 - DNA, 20 bp, Artificial Sequence
  chemically synthesized
cagcctcagtgtaatccatt

SEQ ID NO: 145271 - DNA, 20 bp, Artificial Sequence
  chemically synthesized
tttaccaaatggattacact

SEQ ID NO: 145272 - DNA, 20 bp, Artificial Sequence
  chemically synthesized
ttaccaaatggattacactg

SEQ ID NO: 145273 - DNA, 20 bp, Artificial Sequence
  chemically synthesized
aatagtgcatttttcagcct

SEQ ID NO: 145274 - DNA, 20 bp, Artificial Sequence
  chemically synthesized
aatacaaatagtgcattttt

SEQ ID NO: 145275 - DNA, 20 bp, Artificial Sequence
  chemically synthesized
gaacatgtttttaatacaaa

SEQ ID NO: 145276 - DNA, 20 bp, Artificial Sequence
  chemically synthesized
aaaacatgttcatttgaaca

SEQ ID NO: 145277 - DNA, 20 bp, Artificial Sequence
  chemically synthesized
attgcataaatgccaacttt

SEQ ID NO: 145278 - DNA, 20 bp, Artificial Sequence
  chemically synthesized
attaccctagatcttaaagt

SEQ ID NO: 145279 - DNA, 20 bp, Artificial Sequence
  chemically synthesized
taaatgccaactttaagatc

SEQ ID NO: 145280 - DNA, 20 bp, Artificial Sequence
  chemically synthesized
taaaattaccctagatctta

SEQ ID NO: 145281 - DNA, 20 bp, Artificial Sequence
  chemically synthesized
aaatgccaactttaagatct

SEQ ID NO: 145282 - DNA, 20 bp, Artificial Sequence
  chemically synthesized
aatgccaactttaagatcta

SEQ ID NO: 145283 - DNA, 20 bp, Artificial Sequence
  chemically synthesized
taagatatttaaaattaccc

SEQ ID NO: 145284 - DNA, 20 bp, Artificial Sequence
  chemically synthesized
agagaaaagtaacaaaacat

SEQ ID NO: 145285 - DNA, 20 bp, Artificial Sequence
  chemically synthesized
gctataacttaaaaagagaa

SEQ ID NO: 145286 - DNA, 20 bp, Artificial Sequence
  chemically synthesized
tttgttacttttctcttttt

SEQ ID NO: 145287 - DNA, 20 bp, Artificial Sequence
  chemically synthesized
agagagctataacttaaaaa

SEQ ID NO: 145288 - DNA, 20 bp, Artificial Sequence
  chemically synthesized
aaagagagctataacttaaa

SEQ ID NO: 145289 - DNA, 20 bp, Artificial Sequence
  chemically synthesized
acttttctctttttaagtta

SEQ ID NO: 145290 - DNA, 20 bp, Artificial Sequence
  chemically synthesized
tgataaggataattgaaaga

SEQ ID NO: 145291 - DNA, 20 bp, Artificial Sequence
  chemically synthesized
aatgataaggataattgaaa

SEQ ID NO: 145292 - DNA, 20 bp, Artificial Sequence
  chemically synthesized
ccaatgataaggataattga

SEQ ID NO: 145293 - DNA, 20 bp, Artificial Sequence
  chemically synthesized
ctttcaattatccttatcat

SEQ ID NO: 145294 - DNA, 20 bp, Artificial Sequence
  chemically synthesized
atttgccttctccaatgata

SEQ ID NO: 145295 - DNA, 20 bp, Artificial Sequence
  chemically synthesized
ttcaattatccttatcattg

SEQ ID NO: 145296 - DNA, 20 bp, Artificial Sequence
  chemically synthesized
aatttgccttctccaatgat

SEQ ID NO: 145297 - DNA, 20 bp, Artificial Sequence
  chemically synthesized
aattatccttatcattggag

SEQ ID NO: 145298 - DNA, 20 bp, Artificial Sequence
  chemically synthesized
attatccttatcattggaga

SEQ ID NO: 145299 - DNA, 20 bp, Artificial Sequence
  chemically synthesized
tatcattggagaaggcaaat

SEQ ID NO: 145300 - DNA, 20 bp, Artificial Sequence
  chemically synthesized
ttggagaaggcaaattggca

SEQ ID NO: 145301 - DNA, 20 bp, Artificial Sequence
  chemically synthesized
gcaaattggcacagacaact

SEQ ID NO: 145302 - DNA, 20 bp, Artificial Sequence
  chemically synthesized
aattggcacagacaacttag

SEQ ID NO: 145303 - DNA, 20 bp, Artificial Sequence
  chemically synthesized
ttggcacagacaacttagaa

SEQ ID NO: 145304 - DNA, 20 bp, Artificial Sequence
  chemically synthesized
gcacagacaacttagaagag

SEQ ID NO: 145305 - DNA, 20 bp, Artificial Sequence
  chemically synthesized
tgattattatccactcttct

SEQ ID NO: 145306 - DNA, 20 bp, Artificial Sequence
  chemically synthesized
agtggataataatcaattcc

SEQ ID NO: 145307 - DNA, 20 bp, Artificial Sequence
  chemically synthesized
agaatcaaatataatagtct

SEQ ID NO: 145308 - DNA, 20 bp, Artificial Sequence
  chemically synthesized
cagaatcaaatataatagtc

SEQ ID NO: 145309 - DNA, 20 bp, Artificial Sequence
  chemically synthesized
tattgcagaatcaaatataa

SEQ ID NO: 145310 - DNA, 20 bp, Artificial Sequence
  chemically synthesized
ctacgcagcccaacatattg

SEQ ID NO: 145311 - DNA, 20 bp, Artificial Sequence
  chemically synthesized
tatttgattctgcaatatgt

SEQ ID NO: 145312 - DNA, 20 bp, Artificial Sequence
  chemically synthesized
atttgattctgcaatatgtt

SEQ ID NO: 145313 - DNA, 20 bp, Artificial Sequence
  chemically synthesized
ctgcaatatgttgggctgcg

SEQ ID NO: 145314 - DNA, 20 bp, Artificial Sequence
  chemically synthesized
ctgtttgttttggcactacg

SEQ ID NO: 145315 - DNA, 20 bp, Artificial Sequence
  chemically synthesized
ctgcgtagtgccaaaacaaa

SEQ ID NO: 145316 - DNA, 20 bp, Artificial Sequence
  chemically synthesized
tacatttaaactgtttgttt

SEQ ID NO: 145317 - DNA, 20 bp, Artificial Sequence
  chemically synthesized
acaaacagtttaaatgtaaa

SEQ ID NO: 145318 - DNA, 20 bp, Artificial Sequence
  chemically synthesized
cagtttaaatgtaaatagct

SEQ ID NO: 145319 - DNA, 20 bp, Artificial Sequence
  chemically synthesized
taaatgtaaatagctcagtt

SEQ ID NO: 145320 - DNA, 20 bp, Artificial Sequence
  chemically synthesized
accaaataagtcactcaact

SEQ ID NO: 145321 - DNA, 20 bp, Artificial Sequence
  chemically synthesized
gctcagttgagtgacttatt

SEQ ID NO: 145322 - DNA, 20 bp, Artificial Sequence
  chemically synthesized
aaatctattttataccaaat

SEQ ID NO: 145323 - DNA, 20 bp, Artificial Sequence
  chemically synthesized
gtgacttatttggtataaaa

SEQ ID NO: 145324 - DNA, 20 bp, Artificial Sequence
  chemically synthesized
aaaatagatttttaaaatac

SEQ ID NO: 145325 - DNA, 20 bp, Artificial Sequence
  chemically synthesized
aaatagatttttaaaatacc

SEQ ID NO: 145326 - DNA, 20 bp, Artificial Sequence
  chemically synthesized
ttttaaaataccaggttgtt

SEQ ID NO: 145327 - DNA, 20 bp, Artificial Sequence
  chemically synthesized
gttaaatttactaaacaacc

SEQ ID NO: 145328 - DNA, 20 bp, Artificial Sequence
  chemically synthesized
gttgtttagtaaatttaact

SEQ ID NO: 145329 - DNA, 20 bp, Artificial Sequence
  chemically synthesized
ccttacaagaatagttgtct

SEQ ID NO: 145330 - DNA, 20 bp, Artificial Sequence
  chemically synthesized
actgagacaactattcttgt

SEQ ID NO: 145331 - DNA, 20 bp, Artificial Sequence
  chemically synthesized
aagcagaaaccttacaagaa

SEQ ID NO: 145332 - DNA, 20 bp, Artificial Sequence
  chemically synthesized
ctgagacaactattcttgta

SEQ ID NO: 145333 - DNA, 20 bp, Artificial Sequence
  chemically synthesized
aaaaaaagcagaaaccttac

SEQ ID NO: 145334 - DNA, 20 bp, Artificial Sequence
  chemically synthesized
aaaaaaaaaaaaaaaaaaag

SEQ ID NO: 145335 - DNA, 20 bp, Artificial Sequence
  chemically synthesized
acaaaaaaaaaaaaaaaaaa

SEQ ID NO: 145336 - DNA, 20 bp, Artificial Sequence
  chemically synthesized
aaagtagccatacattaaaa

SEQ ID NO: 145337 - DNA, 20 bp, Artificial Sequence
  chemically synthesized
aaaagtagccatacattaaa

SEQ ID NO: 145338 - DNA, 20 bp, Artificial Sequence
  chemically synthesized
tatatttcctttttaatgta

SEQ ID NO: 145339 - DNA, 20 bp, Artificial Sequence
  chemically synthesized
attaatgcaaataacaaaag

SEQ ID NO: 145340 - DNA, 20 bp, Artificial Sequence
  chemically synthesized
taaattaatgcaaataacaa

SEQ ID NO: 145341 - DNA, 20 bp, Artificial Sequence
  chemically synthesized
attcagcctaagtataatca

SEQ ID NO: 145342 - DNA, 20 bp, Artificial Sequence
  chemically synthesized
tattcagcctaagtataatc

SEQ ID NO: 145343 - DNA, 20 bp, Artificial Sequence
  chemically synthesized
tttatatccttgattatact

SEQ ID NO: 145344 - DNA, 20 bp, Artificial Sequence
  chemically synthesized
ttatatccttgattatactt

SEQ ID NO: 145345 - DNA, 20 bp, Artificial Sequence
  chemically synthesized
ttactctcactattcagcct

SEQ ID NO: 145346 - DNA, 20 bp, Artificial Sequence
  chemically synthesized
ttgattatacttaggctgaa

SEQ ID NO: 145347 - DNA, 20 bp, Artificial Sequence
  chemically synthesized
ttatacttaggctgaatagt

SEQ ID NO: 145348 - DNA, 20 bp, Artificial Sequence
  chemically synthesized
aacacattactctcactatt

SEQ ID NO: 145349 - DNA, 20 bp, Artificial Sequence
  chemically synthesized
atacttaggctgaatagtga

SEQ ID NO: 145350 - DNA, 20 bp, Artificial Sequence
  chemically synthesized
gtgagagtaatgtgtttgct

SEQ ID NO: 145351 - DNA, 20 bp, Artificial Sequence
  chemically synthesized
gagagtaatgtgtttgctga

SEQ ID NO: 145352 - DNA, 20 bp, Artificial Sequence
  chemically synthesized
gagtaatgtgtttgctgaga

SEQ ID NO: 145353 - DNA, 20 bp, Artificial Sequence
  chemically synthesized
ttaggcaactgtttctctct

SEQ ID NO: 145354 - DNA, 20 bp, Artificial Sequence
  chemically synthesized
tgtgtttgctgagagagaaa

SEQ ID NO: 145355 - DNA, 20 bp, Artificial Sequence
  chemically synthesized
tgagagagaaacagttgcct

SEQ ID NO: 145356 - DNA, 20 bp, Artificial Sequence
  chemically synthesized
agaaacagttgcctaagaac

SEQ ID NO: 145357 - DNA, 20 bp, Artificial Sequence
  chemically synthesized
accatttcccaccagttctt

SEQ ID NO: 145358 - DNA, 20 bp, Artificial Sequence
  chemically synthesized
gaccatttcccaccagttct

SEQ ID NO: 145359 - DNA, 20 bp, Artificial Sequence
  chemically synthesized
aacagttgcctaagaactgg

SEQ ID NO: 145360 - DNA, 20 bp, Artificial Sequence
  chemically synthesized
acagttgcctaagaactggt

SEQ ID NO: 145361 - DNA, 20 bp, Artificial Sequence
  chemically synthesized
tctcctagaccatttcccac

SEQ ID NO: 145362 - DNA, 20 bp, Artificial Sequence
  chemically synthesized
gcctaagaactggtgggaaa

SEQ ID NO: 145363 - DNA, 20 bp, Artificial Sequence
  chemically synthesized
agaactggtgggaaatggtc

SEQ ID NO: 145364 - DNA, 20 bp, Artificial Sequence
  chemically synthesized
gaactggtgggaaatggtct

SEQ ID NO: 145365 - DNA, 20 bp, Artificial Sequence
  chemically synthesized
actggtgggaaatggtctag

SEQ ID NO: 145366 - DNA, 20 bp, Artificial Sequence
  chemically synthesized
tggtgggaaatggtctagga

SEQ ID NO: 145367 - DNA, 20 bp, Artificial Sequence
  chemically synthesized
caccaatcactttactctcc

SEQ ID NO: 145368 - DNA, 20 bp, Artificial Sequence
  chemically synthesized
ggaaatggtctaggagagta

SEQ ID NO: 145369 - DNA, 20 bp, Artificial Sequence
  chemically synthesized
gtctaggagagtaaagtgat

SEQ ID NO: 145370 - DNA, 20 bp, Artificial Sequence
  chemically synthesized
taggagagtaaagtgattgg

SEQ ID NO: 145371 - DNA, 20 bp, Artificial Sequence
  chemically synthesized
ggtggaaaatcttcatttta

SEQ ID NO: 145372 - DNA, 20 bp, Artificial Sequence
  chemically synthesized
agaagtttttctttaaaatg

SEQ ID NO: 145373 - DNA, 20 bp, Artificial Sequence
  chemically synthesized
aaaatgataaaagttggcag

SEQ ID NO: 145374 - DNA, 20 bp, Artificial Sequence
  chemically synthesized
gaaaaaatgataaaagttgg

SEQ ID NO: 145375 - DNA, 20 bp, Artificial Sequence
  chemically synthesized
tgagaaaaaatgataaaagt

SEQ ID NO: 145376 - DNA, 20 bp, Artificial Sequence
  chemically synthesized
ggtatgagaaaaaatgataa

SEQ ID NO: 145377 - DNA, 20 bp, Artificial Sequence
  chemically synthesized
gatcatcaagcagaaggtat

SEQ ID NO: 145378 - DNA, 20 bp, Artificial Sequence
  chemically synthesized
cgagatgatcatcaagcaga

SEQ ID NO: 145379 - DNA, 20 bp, Artificial Sequence
  chemically synthesized
acgagatgatcatcaagcag

SEQ ID NO: 145380 - DNA, 20 bp, Artificial Sequence
  chemically synthesized
tcaacgagatgatcatcaag

SEQ ID NO: 145381 - DNA, 20 bp, Artificial Sequence
  chemically synthesized
atatcaacgagatgatcatc

SEQ ID NO: 145382 - DNA, 20 bp, Artificial Sequence
  chemically synthesized
gtgaccttgaggatatcaac

SEQ ID NO: 145383 - DNA, 20 bp, Artificial Sequence
  chemically synthesized
atcatctcgttgatatcctc

SEQ ID NO: 145384 - DNA, 20 bp, Artificial Sequence
  chemically synthesized
tcatctcgttgatatcctca

SEQ ID NO: 145385 - DNA, 20 bp, Artificial Sequence
  chemically synthesized
ggtgatggtgggtgaccttg

SEQ ID NO: 145386 - DNA, 20 bp, Artificial Sequence
  chemically synthesized
gggtgatggtgggtgacctt

SEQ ID NO: 145387 - DNA, 20 bp, Artificial Sequence
  chemically synthesized
aaatcacagagggtgatggt

SEQ ID NO: 145388 - DNA, 20 bp, Artificial Sequence
  chemically synthesized
aaaatcacagagggtgatgg

SEQ ID NO: 145389 - DNA, 20 bp, Artificial Sequence
  chemically synthesized
tataaaatcacagagggtga

SEQ ID NO: 145390 - DNA, 20 bp, Artificial Sequence
  chemically synthesized
tcaagttataaaatcacaga

SEQ ID NO: 145391 - DNA, 20 bp, Artificial Sequence
  chemically synthesized
atcaagttataaaatcacag

SEQ ID NO: 145392 - DNA, 20 bp, Artificial Sequence
  chemically synthesized
gatcaagttataaaatcaca

SEQ ID NO: 145393 - DNA, 20 bp, Artificial Sequence
  chemically synthesized
ttgatcaagttataaaatca

SEQ ID NO: 145394 - DNA, 20 bp, Artificial Sequence
  chemically synthesized
tgtgattttataacttgatc

SEQ ID NO: 145395 - DNA, 20 bp, Artificial Sequence
  chemically synthesized
gattttataacttgatcaag

SEQ ID NO: 145396 - DNA, 20 bp, Artificial Sequence
  chemically synthesized
ctggctttctctgcttgatc

SEQ ID NO: 145397 - DNA, 20 bp, Artificial Sequence
  chemically synthesized
ttttataacttgatcaagca

SEQ ID NO: 145398 - DNA, 20 bp, Artificial Sequence
  chemically synthesized
ataacttgatcaagcagaga

SEQ ID NO: 145399 - DNA, 20 bp, Artificial Sequence
  chemically synthesized
cttgatcaagcagagaaagc

SEQ ID NO: 145400 - DNA, 20 bp, Artificial Sequence
  chemically synthesized
atcaagcagagaaagccagt

SEQ ID NO: 145401 - DNA, 20 bp, Artificial Sequence
  chemically synthesized
agcagagaaagccagtcggt

SEQ ID NO: 145402 - DNA, 20 bp, Artificial Sequence
  chemically synthesized
cttggacagaacttaccgac

SEQ ID NO: 145403 - DNA, 20 bp, Artificial Sequence
  chemically synthesized
ccagtcggtaagttctgtcc

SEQ ID NO: 145404 - DNA, 20 bp, Artificial Sequence
  chemically synthesized
agatttcaaccgggcttgga

SEQ ID NO: 145405 - DNA, 20 bp, Artificial Sequence
  chemically synthesized
cggtaagttctgtccaagcc

SEQ ID NO: 145406 - DNA, 20 bp, Artificial Sequence
  chemically synthesized
tggcagatttcaaccgggct

SEQ ID NO: 145407 - DNA, 20 bp, Artificial Sequence
  chemically synthesized
tgctctggcagatttcaacc

SEQ ID NO: 145408 - DNA, 20 bp, Artificial Sequence
  chemically synthesized
ctgctctggcagatttcaac

SEQ ID NO: 145409 - DNA, 20 bp, Artificial Sequence
  chemically synthesized
caagcccggttgaaatctgc

SEQ ID NO: 145410 - DNA, 20 bp, Artificial Sequence
  chemically synthesized
agcccggttgaaatctgcca

SEQ ID NO: 145411 - DNA, 20 bp, Artificial Sequence
  chemically synthesized
ccggttgaaatctgccagag

SEQ ID NO: 145412 - DNA, 20 bp, Artificial Sequence
  chemically synthesized
cggttgaaatctgccagagc

SEQ ID NO: 145413 - DNA, 20 bp, Artificial Sequence
  chemically synthesized
gttggaggtacctgctctgg

SEQ ID NO: 145414 - DNA, 20 bp, Artificial Sequence
  chemically synthesized
gatgttggaggtacctgctc

SEQ ID NO: 145415 - DNA, 20 bp, Artificial Sequence
  chemically synthesized
gccatcttccttgatgttgg

SEQ ID NO: 145416 - DNA, 20 bp, Artificial Sequence
  chemically synthesized
gagcaggtacctccaacatc

SEQ ID NO: 145417 - DNA, 20 bp, Artificial Sequence
  chemically synthesized
tgccatcttccttgatgttg

SEQ ID NO: 145418 - DNA, 20 bp, Artificial Sequence
  chemically synthesized
agcaggtacctccaacatca

SEQ ID NO: 145419 - DNA, 20 bp, Artificial Sequence
  chemically synthesized
aatgccatcttccttgatgt

SEQ ID NO: 145420 - DNA, 20 bp, Artificial Sequence
  chemically synthesized
aggtacctccaacatcaagg

SEQ ID NO: 145421 - DNA, 20 bp, Artificial Sequence
  chemically synthesized
acctccaacatcaaggaaga

SEQ ID NO: 145422 - DNA, 20 bp, Artificial Sequence
  chemically synthesized
atcaaggaagatggcatttc

SEQ ID NO: 145423 - DNA, 20 bp, Artificial Sequence
  chemically synthesized
ggaagatggcatttctagtt

SEQ ID NO: 145424 - DNA, 20 bp, Artificial Sequence
  chemically synthesized
aagatggcatttctagtttg

SEQ ID NO: 145425 - DNA, 20 bp, Artificial Sequence
  chemically synthesized
ggaaactgccatctccaaac

SEQ ID NO: 145426 - DNA, 20 bp, Artificial Sequence
  chemically synthesized
tggcatttctagtttggaga

SEQ ID NO: 145427 - DNA, 20 bp, Artificial Sequence
  chemically synthesized
catttctagtttggagatgg

SEQ ID NO: 145428 - DNA, 20 bp, Artificial Sequence
  chemically synthesized
tttggagatggcagtttcct

SEQ ID NO: 145429 - DNA, 20 bp, Artificial Sequence
  chemically synthesized
gacacaacctgtggttacta

SEQ ID NO: 145430 - DNA, 20 bp, Artificial Sequence
  chemically synthesized
tgacacaacctgtggttact

SEQ ID NO: 145431 - DNA, 20 bp, Artificial Sequence
  chemically synthesized
ggcagtttccttagtaacca

SEQ ID NO: 145432 - DNA, 20 bp, Artificial Sequence
  chemically synthesized
gcagtttccttagtaaccac

SEQ ID NO: 145433 - DNA, 20 bp, Artificial Sequence
  chemically synthesized
tactctggtgacacaacctg

SEQ ID NO: 145434 - DNA, 20 bp, Artificial Sequence
  chemically synthesized
gtaaccacaggttgtgtcac

SEQ ID NO: 145435 - DNA, 20 bp, Artificial Sequence
  chemically synthesized
aaccacaggttgtgtcacca

SEQ ID NO: 145436 - DNA, 20 bp, Artificial Sequence
  chemically synthesized
aggttgtgtcaccagagtaa

SEQ ID NO: 145437 - DNA, 20 bp, Artificial Sequence
  chemically synthesized
tcctactcagactgttactc

SEQ ID NO: 145438 - DNA, 20 bp, Artificial Sequence
  chemically synthesized
tgtcaccagagtaacagtct

SEQ ID NO: 145439 - DNA, 20 bp, Artificial Sequence
  chemically synthesized
caccagagtaacagtctgag

SEQ ID NO: 145440 - DNA, 20 bp, Artificial Sequence
  chemically synthesized
accagagtaacagtctgagt

SEQ ID NO: 145441 - DNA, 20 bp, Artificial Sequence
  chemically synthesized
cagagtaacagtctgagtag

SEQ ID NO: 145442 - DNA, 20 bp, Artificial Sequence
  chemically synthesized
aaaatattttagctcctact

SEQ ID NO: 145443 - DNA, 20 bp, Artificial Sequence
  chemically synthesized
tgcaaaaacccaaaatattt

SEQ ID NO: 145444 - DNA, 20 bp, Artificial Sequence
  chemically synthesized
gagtaggagctaaaatattt

SEQ ID NO: 145445 - DNA, 20 bp, Artificial Sequence
  chemically synthesized
agtaggagctaaaatatttt

SEQ ID NO: 145446 - DNA, 20 bp, Artificial Sequence
  chemically synthesized
atattttgggtttttgcaaa

SEQ ID NO: 145447 - DNA, 20 bp, Artificial Sequence
  chemically synthesized
tattttgggtttttgcaaaa

SEQ ID NO: 145448 - DNA, 20 bp, Artificial Sequence
  chemically synthesized
ggtttttgcaaaaaggaaaa

SEQ ID NO: 145449 - DNA, 20 bp, Artificial Sequence
  chemically synthesized
ttttgcaaaaaggaaaaaag

SEQ ID NO: 145450 - DNA, 20 bp, Artificial Sequence
  chemically synthesized
aaaaaggaaaaaagaagaaa

SEQ ID NO: 145451 - DNA, 20 bp, Artificial Sequence
  chemically synthesized
aaaagaagaaaaagaaaaat

SEQ ID NO: 145452 - DNA, 20 bp, Artificial Sequence
  chemically synthesized
aaaagaaaaattagaaacac

SEQ ID NO: 145453 - DNA, 20 bp, Artificial Sequence
  chemically synthesized
aaaattagaaacacaagcta

SEQ ID NO: 145454 - DNA, 20 bp, Artificial Sequence
  chemically synthesized
aattagaaacacaagctaaa

SEQ ID NO: 145455 - DNA, 20 bp, Artificial Sequence
  chemically synthesized
tgttattgaaattggctctt

SEQ ID NO: 145456 - DNA, 20 bp, Artificial Sequence
  chemically synthesized
tgacttattgttattgaaat

SEQ ID NO: 145457 - DNA, 20 bp, Artificial Sequence
  chemically synthesized
gagccaatttcaataacaat

SEQ ID NO: 145458 - DNA, 20 bp, Artificial Sequence
  chemically synthesized
caataagtcaaatttaattg

SEQ ID NO: 145459 - DNA, 20 bp, Artificial Sequence
  chemically synthesized
ataagtcaaatttaattgaa

SEQ ID NO: 145460 - DNA, 20 bp, Artificial Sequence
  chemically synthesized
taattgaagagtaacaattt

SEQ ID NO: 145461 - DNA, 20 bp, Artificial Sequence
  chemically synthesized
taatgtcatgaataagagtt

SEQ ID NO: 145462 - DNA, 20 bp, Artificial Sequence
  chemically synthesized
atatataatgtcatgaataa

SEQ ID NO: 145463 - DNA, 20 bp, Artificial Sequence
  chemically synthesized
agatatataatgtcatgaat

SEQ ID NO: 145464 - DNA, 20 bp, Artificial Sequence
  chemically synthesized
agtatccacattgttagaaa

SEQ ID NO: 145465 - DNA, 20 bp, Artificial Sequence
  chemically synthesized
tatatctttttctaacaatg

SEQ ID NO: 145466 - DNA, 20 bp, Artificial Sequence
  chemically synthesized
aaacaaagtatccacattgt

SEQ ID NO: 145467 - DNA, 20 bp, Artificial Sequence
  chemically synthesized
aacaatgtggatactttgtt

SEQ ID NO: 145468 - DNA, 20 bp, Artificial Sequence
  chemically synthesized
ctaccatgtattgctaaaca

SEQ ID NO: 145469 - DNA, 20 bp, Artificial Sequence
  chemically synthesized
atactttgtttagcaataca

SEQ ID NO: 145470 - DNA, 20 bp, Artificial Sequence
  chemically synthesized
ctttgtttagcaatacatgg

SEQ ID NO: 145471 - DNA, 20 bp, Artificial Sequence
  chemically synthesized
aatacatggtagaaaatgaa

SEQ ID NO: 145472 - DNA, 20 bp, Artificial Sequence
  chemically synthesized
ttaaatgtatattaatgaaa

SEQ ID NO: 145473 - DNA, 20 bp, Artificial Sequence
  chemically synthesized
gttaaatgtatattaatgaa

SEQ ID NO: 145474 - DNA, 20 bp, Artificial Sequence
  chemically synthesized
acttgtccaggcatgagaat

SEQ ID NO: 145475 - DNA, 20 bp, Artificial Sequence
  chemically synthesized
attttgctcattctcatgcc

SEQ ID NO: 145476 - DNA, 20 bp, Artificial Sequence
  chemically synthesized
taagttacttgtccaggcat

SEQ ID NO: 145477 - DNA, 20 bp, Artificial Sequence
  chemically synthesized
gctcattctcatgcctggac

SEQ ID NO: 145478 - DNA, 20 bp, Artificial Sequence
  chemically synthesized
ttaacttaagttacttgtcc

SEQ ID NO: 145479 - DNA, 20 bp, Artificial Sequence
  chemically synthesized
tttaacttaagttacttgtc

SEQ ID NO: 145480 - DNA, 20 bp, Artificial Sequence
  chemically synthesized
catgcctggacaagtaactt

SEQ ID NO: 145481 - DNA, 20 bp, Artificial Sequence
  chemically synthesized
tgagaaggcttatttaactt

SEQ ID NO: 145482 - DNA, 20 bp, Artificial Sequence
  chemically synthesized
acaagtaacttaagttaaat

SEQ ID NO: 145483 - DNA, 20 bp, Artificial Sequence
  chemically synthesized
ttaagttaaataagccttct

SEQ ID NO: 145484 - DNA, 20 bp, Artificial Sequence
  chemically synthesized
gtatatgattgttactgaga

SEQ ID NO: 145485 - DNA, 20 bp, Artificial Sequence
  chemically synthesized
tgtatatgattgttactgag

SEQ ID NO: 145486 - DNA, 20 bp, Artificial Sequence
  chemically synthesized
caatgtatatgattgttact

SEQ ID NO: 145487 - DNA, 20 bp, Artificial Sequence
  chemically synthesized
agtaacaatcatatacattg

SEQ ID NO: 145488 - DNA, 20 bp, Artificial Sequence
  chemically synthesized
aacaatcatatacattgtgg

SEQ ID NO: 145489 - DNA, 20 bp, Artificial Sequence
  chemically synthesized
aatcatatacattgtggaag

SEQ ID NO: 145490 - DNA, 20 bp, Artificial Sequence
  chemically synthesized
tatacattgtggaagtggta

SEQ ID NO: 145491 - DNA, 20 bp, Artificial Sequence
  chemically synthesized
ggaagtggtaaagaaaacaa

SEQ ID NO: 145492 - DNA, 20 bp, Artificial Sequence
  chemically synthesized
gtaaagaaaacaaaagtttt

SEQ ID NO: 145493 - DNA, 20 bp, Artificial Sequence
  chemically synthesized
caaaagttttcagaccttgc

SEQ ID NO: 145494 - DNA, 20 bp, Artificial Sequence
  chemically synthesized
aaaagttttcagaccttgcc

SEQ ID NO: 145495 - DNA, 20 bp, Artificial Sequence
  chemically synthesized
aaagttttcagaccttgcca

SEQ ID NO: 145496 - DNA, 20 bp, Artificial Sequence
  chemically synthesized
taaaatttatttccctggca

SEQ ID NO: 145497 - DNA, 20 bp, Artificial Sequence
  chemically synthesized
gtaaaatttatttccctggc

SEQ ID NO: 145498 - DNA, 20 bp, Artificial Sequence
  chemically synthesized
ataagtaaaatttatttccc

SEQ ID NO: 145499 - DNA, 20 bp, Artificial Sequence
  chemically synthesized
ttcttgaataaaaaaaaaat

SEQ ID NO: 145500 - DNA, 20 bp, Artificial Sequence
  chemically synthesized
tacttattttttttttattc

SEQ ID NO: 145501 - DNA, 20 bp, Artificial Sequence
  chemically synthesized
tttttattcaagaaaaaaca

SEQ ID NO: 145502 - DNA, 20 bp, Artificial Sequence
  chemically synthesized
ttttattcaagaaaaaacaa

SEQ ID NO: 145503 - DNA, 20 bp, Artificial Sequence
  chemically synthesized
agaaaaaacaaaggcaaaac

SEQ ID NO: 145504 - DNA, 20 bp, Artificial Sequence
  chemically synthesized
aaaacaaaggcaaaacaaga

SEQ ID NO: 145505 - DNA, 20 bp, Artificial Sequence
  chemically synthesized
aaacaaaggcaaaacaagat

SEQ ID NO: 145506 - DNA, 20 bp, Artificial Sequence
  chemically synthesized
aaggcaaaacaagatgggat

SEQ ID NO: 145507 - DNA, 20 bp, Artificial Sequence
  chemically synthesized
gggaattttaaatcagaaag

SEQ ID NO: 145508 - DNA, 20 bp, Artificial Sequence
  chemically synthesized
caagggaattttaaatcaga

SEQ ID NO: 145509 - DNA, 20 bp, Artificial Sequence
  chemically synthesized
tattcaagggaattttaaat

SEQ ID NO: 145510 - DNA, 20 bp, Artificial Sequence
  chemically synthesized
tgatttaaaattcccttgaa

SEQ ID NO: 145511 - DNA, 20 bp, Artificial Sequence
  chemically synthesized
gatttaaaattcccttgaat

SEQ ID NO: 145512 - DNA, 20 bp, Artificial Sequence
  chemically synthesized
ttaatttacttcctattcaa

SEQ ID NO: 145513 - DNA, 20 bp, Artificial Sequence
  chemically synthesized
attaatttacttcctattca

SEQ ID NO: 145514 - DNA, 20 bp, Artificial Sequence
  chemically synthesized
ttaaaattcccttgaatagg

SEQ ID NO: 145515 - DNA, 20 bp, Artificial Sequence
  chemically synthesized
aattaatttacttcctattc

SEQ ID NO: 145516 - DNA, 20 bp, Artificial Sequence
  chemically synthesized
ataggaagtaaattaatttg

SEQ ID NO: 145517 - DNA, 20 bp, Artificial Sequence
  chemically synthesized
gaagtaaattaatttgaagc

SEQ ID NO: 145518 - DNA, 20 bp, Artificial Sequence
  chemically synthesized
attaatttgaagctggaccc

SEQ ID NO: 145519 - DNA, 20 bp, Artificial Sequence
  chemically synthesized
ttaatttgaagctggaccct

SEQ ID NO: 145520 - DNA, 20 bp, Artificial Sequence
  chemically synthesized
taatttgaagctggacccta

SEQ ID NO: 145521 - DNA, 20 bp, Artificial Sequence
  chemically synthesized
gctttgatttccctagggtc

SEQ ID NO: 145522 - DNA, 20 bp, Artificial Sequence
  chemically synthesized
cattggctttgatttcccta

SEQ ID NO: 145523 - DNA, 20 bp, Artificial Sequence
  chemically synthesized
tcattggctttgatttccct

SEQ ID NO: 145524 - DNA, 20 bp, Artificial Sequence
  chemically synthesized
ttcattggctttgatttccc

SEQ ID NO: 145525 - DNA, 20 bp, Artificial Sequence
  chemically synthesized
gctggaccctagggaaatca

SEQ ID NO: 145526 - DNA, 20 bp, Artificial Sequence
  chemically synthesized
ctaagacaagaacgtttcat

SEQ ID NO: 145527 - DNA, 20 bp, Artificial Sequence
  chemically synthesized
ccaatgaaacgttcttgtct

SEQ ID NO: 145528 - DNA, 20 bp, Artificial Sequence
  chemically synthesized
ataaaatacagagctaagac

SEQ ID NO: 145529 - DNA, 20 bp, Artificial Sequence
  chemically synthesized
ccagtataaaatacagagct

SEQ ID NO: 145530 - DNA, 20 bp, Artificial Sequence
  chemically synthesized
tgctcccagtataaaataca

SEQ ID NO: 145531 - DNA, 20 bp, Artificial Sequence
  chemically synthesized
actgctcccagtataaaata

SEQ ID NO: 145532 - DNA, 20 bp, Artificial Sequence
  chemically synthesized
cttagctctgtattttatac

SEQ ID NO: 145533 - DNA, 20 bp, Artificial Sequence
  chemically synthesized
ttagctctgtattttatact

SEQ ID NO: 145534 - DNA, 20 bp, Artificial Sequence
  chemically synthesized
agctctgtattttatactgg

SEQ ID NO: 145535 - DNA, 20 bp, Artificial Sequence
  chemically synthesized
tctgtattttatactgggag

SEQ ID NO: 145536 - DNA, 20 bp, Artificial Sequence
  chemically synthesized
aaaatatgataaactgctcc

SEQ ID NO: 145537 - DNA, 20 bp, Artificial Sequence
  chemically synthesized
atatttttttctttttattt

SEQ ID NO: 145538 - DNA, 20 bp, Artificial Sequence
  chemically synthesized
tactaacaatctgaaataaa

SEQ ID NO: 145539 - DNA, 20 bp, Artificial Sequence
  chemically synthesized
ttctttttatttcagattgt

SEQ ID NO: 145540 - DNA, 20 bp, Artificial Sequence
  chemically synthesized
atttcagattgttagtaaac

SEQ ID NO: 145541 - DNA, 20 bp, Artificial Sequence
  chemically synthesized
cagattgttagtaaactggc

SEQ ID NO: 145542 - DNA, 20 bp, Artificial Sequence
  chemically synthesized
attgttagtaaactggccag

SEQ ID NO: 145543 - DNA, 20 bp, Artificial Sequence
  chemically synthesized
ggtttttcttcactgctggc

SEQ ID NO: 145544 - DNA, 20 bp, Artificial Sequence
  chemically synthesized
tagtaaactggccagcagtg

SEQ ID NO: 145545 - DNA, 20 bp, Artificial Sequence
  chemically synthesized
tcttggtttttcttcactgc

SEQ ID NO: 145546 - DNA, 20 bp, Artificial Sequence
  chemically synthesized
gccagcagtgaagaaaaacc

SEQ ID NO: 145547 - DNA, 20 bp, Artificial Sequence
  chemically synthesized
tttaagaaaatattgtatct

SEQ ID NO: 145548 - DNA, 20 bp, Artificial Sequence
  chemically synthesized
aactactaactcgcattttt

SEQ ID NO: 145549 - DNA, 20 bp, Artificial Sequence
  chemically synthesized
caatattttcttaaaaatgc

SEQ ID NO: 145550 - DNA, 20 bp, Artificial Sequence
  chemically synthesized
attttcttaaaaatgcgagt

SEQ ID NO: 145551 - DNA, 20 bp, Artificial Sequence
  chemically synthesized
ttcttaaaaatgcgagttag

SEQ ID NO: 145552 - DNA, 20 bp, Artificial Sequence
  chemically synthesized
gagttagtagtttttctatt

SEQ ID NO: 145553 - DNA, 20 bp, Artificial Sequence
  chemically synthesized
aacagtatttcatgtctaaa

SEQ ID NO: 145554 - DNA, 20 bp, Artificial Sequence
  chemically synthesized
agacatgaaatactgtttca

SEQ ID NO: 145555 - DNA, 20 bp, Artificial Sequence
  chemically synthesized
tttatttaatgactttgaaa

SEQ ID NO: 145556 - DNA, 20 bp, Artificial Sequence
  chemically synthesized
tgtccaacactattcatatt

SEQ ID NO: 145557 - DNA, 20 bp, Artificial Sequence
  chemically synthesized
taaataaatcttaatatgaa

SEQ ID NO: 145558 - DNA, 20 bp, Artificial Sequence
  chemically synthesized
aatcttaatatgaatagtgt

SEQ ID NO: 145559 - DNA, 20 bp, Artificial Sequence
  chemically synthesized
atgaatagtgttggacactg

SEQ ID NO: 145560 - DNA, 20 bp, Artificial Sequence
  chemically synthesized
gaatagtgttggacactgta

SEQ ID NO: 145561 - DNA, 20 bp, Artificial Sequence
  chemically synthesized
agtgttggacactgtagagt

SEQ ID NO: 145562 - DNA, 20 bp, Artificial Sequence
  chemically synthesized
ccataggctgacttactcta

SEQ ID NO: 145563 - DNA, 20 bp, Artificial Sequence
  chemically synthesized
ttggacactgtagagtaagt

SEQ ID NO: 145564 - DNA, 20 bp, Artificial Sequence
  chemically synthesized
ctgtagagtaagtcagccta

SEQ ID NO: 145565 - DNA, 20 bp, Artificial Sequence
  chemically synthesized
agtaagtcagcctatggtaa

SEQ ID NO: 145566 - DNA, 20 bp, Artificial Sequence
  chemically synthesized
tgcatcttaaccattaccat

SEQ ID NO: 145567 - DNA, 20 bp, Artificial Sequence
  chemically synthesized
atgcatcttaaccattacca

SEQ ID NO: 145568 - DNA, 20 bp, Artificial Sequence
  chemically synthesized
gtcagcctatggtaatggtt

SEQ ID NO: 145569 - DNA, 20 bp, Artificial Sequence
  chemically synthesized
atggtaatggttaagatgca

SEQ ID NO: 145570 - DNA, 20 bp, Artificial Sequence
  chemically synthesized
atggttaagatgcatagtac

SEQ ID NO: 145571 - DNA, 20 bp, Artificial Sequence
  chemically synthesized
tctaccagacattttaattc

SEQ ID NO: 145572 - DNA, 20 bp, Artificial Sequence
  chemically synthesized
agtactagaattaaaatgtc

SEQ ID NO: 145573 - DNA, 20 bp, Artificial Sequence
  chemically synthesized
actagaattaaaatgtctgg

SEQ ID NO: 145574 - DNA, 20 bp, Artificial Sequence
  chemically synthesized
cagagaacaggattgtctac

SEQ ID NO: 145575 - DNA, 20 bp, Artificial Sequence
  chemically synthesized
gagttcctagggcagagaac

SEQ ID NO: 145576 - DNA, 20 bp, Artificial Sequence
  chemically synthesized
agagttcctagggcagagaa

SEQ ID NO: 145577 - DNA, 20 bp, Artificial Sequence
  chemically synthesized
gacaatcctgttctctgccc

SEQ ID NO: 145578 - DNA, 20 bp, Artificial Sequence
  chemically synthesized
acaatcctgttctctgccct

SEQ ID NO: 145579 - DNA, 20 bp, Artificial Sequence
  chemically synthesized
gtcccagagttcctagggca

SEQ ID NO: 145580 - DNA, 20 bp, Artificial Sequence
  chemically synthesized
aggtcccagagttcctaggg

SEQ ID NO: 145581 - DNA, 20 bp, Artificial Sequence
  chemically synthesized
ccaaggtcccagagttccta

SEQ ID NO: 145582 - DNA, 20 bp, Artificial Sequence
  chemically synthesized
accaaggtcccagagttcct

SEQ ID NO: 145583 - DNA, 20 bp, Artificial Sequence
  chemically synthesized
gttctctgccctaggaactc

SEQ ID NO: 145584 - DNA, 20 bp, Artificial Sequence
  chemically synthesized
taccaaggtcccagagttcc

SEQ ID NO: 145585 - DNA, 20 bp, Artificial Sequence
  chemically synthesized
ttctctgccctaggaactct

SEQ ID NO: 145586 - DNA, 20 bp, Artificial Sequence
  chemically synthesized
gtggctttaccaaggtccca

SEQ ID NO: 145587 - DNA, 20 bp, Artificial Sequence
  chemically synthesized
ccctaggaactctgggacct

SEQ ID NO: 145588 - DNA, 20 bp, Artificial Sequence
  chemically synthesized
atgtggctttaccaaggtcc

SEQ ID NO: 145589 - DNA, 20 bp, Artificial Sequence
  chemically synthesized
ggaactctgggaccttggta

SEQ ID NO: 145590 - DNA, 20 bp, Artificial Sequence
  chemically synthesized
gaggttatgtggctttacca

SEQ ID NO: 145591 - DNA, 20 bp, Artificial Sequence
  chemically synthesized
agaggttatgtggctttacc

SEQ ID NO: 145592 - DNA, 20 bp, Artificial Sequence
  chemically synthesized
tgaaacttagagaggttatg

SEQ ID NO: 145593 - DNA, 20 bp, Artificial Sequence
  chemically synthesized
taaagccacataacctctct

SEQ ID NO: 145594 - DNA, 20 bp, Artificial Sequence
  chemically synthesized
gttagaactgaaacttagag

SEQ ID NO: 145595 - DNA, 20 bp, Artificial Sequence
  chemically synthesized
tgttagaactgaaacttaga

SEQ ID NO: 145596 - DNA, 20 bp, Artificial Sequence
  chemically synthesized
cacataacctctctaagttt

SEQ ID NO: 145597 - DNA, 20 bp, Artificial Sequence
  chemically synthesized
aatgttagaactgaaactta

SEQ ID NO: 145598 - DNA, 20 bp, Artificial Sequence
  chemically synthesized
caaatgttagaactgaaact

SEQ ID NO: 145599 - DNA, 20 bp, Artificial Sequence
  chemically synthesized
tgctagtactgaacaaatgt

SEQ ID NO: 145600 - DNA, 20 bp, Artificial Sequence
  chemically synthesized
tttcagttctaacatttgtt

SEQ ID NO: 145601 - DNA, 20 bp, Artificial Sequence
  chemically synthesized
ttctaacatttgttcagtac

SEQ ID NO: 145602 - DNA, 20 bp, Artificial Sequence
  chemically synthesized
atttgttcagtactagcaat

SEQ ID NO: 145603 - DNA, 20 bp, Artificial Sequence
  chemically synthesized
ccttgcttactgcttattgc

SEQ ID NO: 145604 - DNA, 20 bp, Artificial Sequence
  chemically synthesized
tgttcagtactagcaataag

SEQ ID NO: 145605 - DNA, 20 bp, Artificial Sequence
  chemically synthesized
cagtactagcaataagcagt

SEQ ID NO: 145606 - DNA, 20 bp, Artificial Sequence
  chemically synthesized
actagcaataagcagtaagc

SEQ ID NO: 145607 - DNA, 20 bp, Artificial Sequence
  chemically synthesized
ctagcaataagcagtaagca

SEQ ID NO: 145608 - DNA, 20 bp, Artificial Sequence
  chemically synthesized
aataagcagtaagcaaggca

SEQ ID NO: 145609 - DNA, 20 bp, Artificial Sequence
  chemically synthesized
aagcagtaagcaaggcaaag

SEQ ID NO: 145610 - DNA, 20 bp, Artificial Sequence
  chemically synthesized
agcagtaagcaaggcaaagt

SEQ ID NO: 145611 - DNA, 20 bp, Artificial Sequence
  chemically synthesized
agtaagcaaggcaaagtggg

SEQ ID NO: 145612 - DNA, 20 bp, Artificial Sequence
  chemically synthesized
ttttcatgtatttaccttaa

SEQ ID NO: 145613 - DNA, 20 bp, Artificial Sequence
  chemically synthesized
ttcatgtatttaccttaaaa

SEQ ID NO: 145614 - DNA, 20 bp, Artificial Sequence
  chemically synthesized
tcatgtatttaccttaaaag

SEQ ID NO: 145615 - DNA, 20 bp, Artificial Sequence
  chemically synthesized
ctgttattattcctctttta

SEQ ID NO: 145616 - DNA, 20 bp, Artificial Sequence
  chemically synthesized
cctgttattattcctctttt

SEQ ID NO: 145617 - DNA, 20 bp, Artificial Sequence
  chemically synthesized
ccttaaaagaggaataataa

SEQ ID NO: 145618 - DNA, 20 bp, Artificial Sequence
  chemically synthesized
cttaaaagaggaataataac

SEQ ID NO: 145619 - DNA, 20 bp, Artificial Sequence
  chemically synthesized
ttaaaagaggaataataaca

SEQ ID NO: 145620 - DNA, 20 bp, Artificial Sequence
  chemically synthesized
aataacagggtaaatgtcat

SEQ ID NO: 145621 - DNA, 20 bp, Artificial Sequence
  chemically synthesized
ataacagggtaaatgtcata

SEQ ID NO: 145622 - DNA, 20 bp, Artificial Sequence
  chemically synthesized
taacagggtaaatgtcataa

SEQ ID NO: 145623 - DNA, 20 bp, Artificial Sequence
  chemically synthesized
cagggtaaatgtcataaggg

SEQ ID NO: 145624 - DNA, 20 bp, Artificial Sequence
  chemically synthesized
atgtcataagggcagttgtg

SEQ ID NO: 145625 - DNA, 20 bp, Artificial Sequence
  chemically synthesized
taagggcagttgtgtagatt

SEQ ID NO: 145626 - DNA, 20 bp, Artificial Sequence
  chemically synthesized
ggcagttgtgtagattcagt

SEQ ID NO: 145627 - DNA, 20 bp, Artificial Sequence
  chemically synthesized
agttgtgtagattcagtgag

SEQ ID NO: 145628 - DNA, 20 bp, Artificial Sequence
  chemically synthesized
gtagattcagtgagtagtac

SEQ ID NO: 145629 - DNA, 20 bp, Artificial Sequence
  chemically synthesized
caatacacgtatgacaatgc

SEQ ID NO: 145630 - DNA, 20 bp, Artificial Sequence
  chemically synthesized
acacgtatgacaatgccaga

SEQ ID NO: 145631 - DNA, 20 bp, Artificial Sequence
  chemically synthesized
acgtatgacaatgccagaaa

SEQ ID NO: 145632 - DNA, 20 bp, Artificial Sequence
  chemically synthesized
tatgacaatgccagaaagag

SEQ ID NO: 145633 - DNA, 20 bp, Artificial Sequence
  chemically synthesized
gatgattatgctgctctttc

SEQ ID NO: 145634 - DNA, 20 bp, Artificial Sequence
  chemically synthesized
tcatcacaataatattatta

SEQ ID NO: 145635 - DNA, 20 bp, Artificial Sequence
  chemically synthesized
tattacagcgcctgacacta

SEQ ID NO: 145636 - DNA, 20 bp, Artificial Sequence
  chemically synthesized
tgatcacctactatagtgtc

SEQ ID NO: 145637 - DNA, 20 bp, Artificial Sequence
  chemically synthesized
ttgatcacctactatagtgt

SEQ ID NO: 145638 - DNA, 20 bp, Artificial Sequence
  chemically synthesized
tacagcgcctgacactatag

SEQ ID NO: 145639 - DNA, 20 bp, Artificial Sequence
  chemically synthesized
acagcgcctgacactatagt

SEQ ID NO: 145640 - DNA, 20 bp, Artificial Sequence
  chemically synthesized
acactattgatcacctacta

SEQ ID NO: 145641 - DNA, 20 bp, Artificial Sequence
  chemically synthesized
acactatagtaggtgatcaa

SEQ ID NO: 145642 - DNA, 20 bp, Artificial Sequence
  chemically synthesized
tagtaggtgatcaatagtgt

SEQ ID NO: 145643 - DNA, 20 bp, Artificial Sequence
  chemically synthesized
agtaggtgatcaatagtgtt

SEQ ID NO: 145644 - DNA, 20 bp, Artificial Sequence
  chemically synthesized
tagccaggcgtttataaaaa

SEQ ID NO: 145645 - DNA, 20 bp, Artificial Sequence
  chemically synthesized
ttactgtttttataaacgcc

SEQ ID NO: 145646 - DNA, 20 bp, Artificial Sequence
  chemically synthesized
tgtttttataaacgcctggc

SEQ ID NO: 145647 - DNA, 20 bp, Artificial Sequence
  chemically synthesized
tttataaacgcctggctagt

SEQ ID NO: 145648 - DNA, 20 bp, Artificial Sequence
  chemically synthesized
cactgtgtttcttactagcc

SEQ ID NO: 145649 - DNA, 20 bp, Artificial Sequence
  chemically synthesized
tcactgtgtttcttactagc

SEQ ID NO: 145650 - DNA, 20 bp, Artificial Sequence
  chemically synthesized
ttcatcactgtgtttcttac

SEQ ID NO: 145651 - DNA, 20 bp, Artificial Sequence
  chemically synthesized
cgcctggctagtaagaaaca

SEQ ID NO: 145652 - DNA, 20 bp, Artificial Sequence
  chemically synthesized
aacacagtgatgaacaactg

SEQ ID NO: 145653 - DNA, 20 bp, Artificial Sequence
  chemically synthesized
cagtgatgaacaactgtggt

SEQ ID NO: 145654 - DNA, 20 bp, Artificial Sequence
  chemically synthesized
ttatctccagtttctcacca

SEQ ID NO: 145655 - DNA, 20 bp, Artificial Sequence
  chemically synthesized
gaacaactgtggtgagaaac

SEQ ID NO: 145656 - DNA, 20 bp, Artificial Sequence
  chemically synthesized
acaactgtggtgagaaactg

SEQ ID NO: 145657 - DNA, 20 bp, Artificial Sequence
  chemically synthesized
tgtggtgagaaactggagat

SEQ ID NO: 145658 - DNA, 20 bp, Artificial Sequence
  chemically synthesized
gtggtgagaaactggagata

SEQ ID NO: 145659 - DNA, 20 bp, Artificial Sequence
  chemically synthesized
acattttggggccttatctc

SEQ ID NO: 145660 - DNA, 20 bp, Artificial Sequence
  chemically synthesized
cccaagtatttcacattttg

SEQ ID NO: 145661 - DNA, 20 bp, Artificial Sequence
  chemically synthesized
ccccaagtatttcacatttt

SEQ ID NO: 145662 - DNA, 20 bp, Artificial Sequence
  chemically synthesized
tccccaagtatttcacattt

SEQ ID NO: 145663 - DNA, 20 bp, Artificial Sequence
  chemically synthesized
gccccaaaatgtgaaatact

SEQ ID NO: 145664 - DNA, 20 bp, Artificial Sequence
  chemically synthesized
ccccaaaatgtgaaatactt

SEQ ID NO: 145665 - DNA, 20 bp, Artificial Sequence
  chemically synthesized
cccaaaatgtgaaatacttg

SEQ ID NO: 145666 - DNA, 20 bp, Artificial Sequence
  chemically synthesized
caaaatgtgaaatacttggg

SEQ ID NO: 145667 - DNA, 20 bp, Artificial Sequence
  chemically synthesized
aatgtgaaatacttggggag

SEQ ID NO: 145668 - DNA, 20 bp, Artificial Sequence
  chemically synthesized
cttttgactgactactcccc

SEQ ID NO: 145669 - DNA, 20 bp, Artificial Sequence
  chemically synthesized
tgaaatacttggggagtagt

SEQ ID NO: 145670 - DNA, 20 bp, Artificial Sequence
  chemically synthesized
cttggggagtagtcagtcaa

SEQ ID NO: 145671 - DNA, 20 bp, Artificial Sequence
  chemically synthesized
gtcagtcaaaagtccgtgtg

SEQ ID NO: 145672 - DNA, 20 bp, Artificial Sequence
  chemically synthesized
aatcaatatagggccacaca

SEQ ID NO: 145673 - DNA, 20 bp, Artificial Sequence
  chemically synthesized
agccctcttcaatcaatata

SEQ ID NO: 145674 - DNA, 20 bp, Artificial Sequence
  chemically synthesized
cagccctcttcaatcaatat

SEQ ID NO: 145675 - DNA, 20 bp, Artificial Sequence
  chemically synthesized
tcagccctcttcaatcaata

SEQ ID NO: 145676 - DNA, 20 bp, Artificial Sequence
  chemically synthesized
gtgtggccctatattgattg

SEQ ID NO: 145677 - DNA, 20 bp, Artificial Sequence
  chemically synthesized
gtggccctatattgattgaa

SEQ ID NO: 145678 - DNA, 20 bp, Artificial Sequence
  chemically synthesized
tggccctatattgattgaag

SEQ ID NO: 145679 - DNA, 20 bp, Artificial Sequence
  chemically synthesized
ggccctatattgattgaaga

SEQ ID NO: 145680 - DNA, 20 bp, Artificial Sequence
  chemically synthesized
ttgaagagggctgaacttgc

SEQ ID NO: 145681 - DNA, 20 bp, Artificial Sequence
  chemically synthesized
tcaattcacaccagcaagtt

SEQ ID NO: 145682 - DNA, 20 bp, Artificial Sequence
  chemically synthesized
tagtatcaattcacaccagc

SEQ ID NO: 145683 - DNA, 20 bp, Artificial Sequence
  chemically synthesized
tatttagtatcaattcacac

SEQ ID NO: 145684 - DNA, 20 bp, Artificial Sequence
  chemically synthesized
cccagctgtgtgttggtatt

SEQ ID NO: 145685 - DNA, 20 bp, Artificial Sequence
  chemically synthesized
tgatactaaataccaacaca

SEQ ID NO: 145686 - DNA, 20 bp, Artificial Sequence
  chemically synthesized
ctgataacccagctgtgtgt

SEQ ID NO: 145687 - DNA, 20 bp, Artificial Sequence
  chemically synthesized
actaaataccaacacacagc

SEQ ID NO: 145688 - DNA, 20 bp, Artificial Sequence
  chemically synthesized
ctaaataccaacacacagct

SEQ ID NO: 145689 - DNA, 20 bp, Artificial Sequence
  chemically synthesized
ccaacacacagctgggttat

SEQ ID NO: 145690 - DNA, 20 bp, Artificial Sequence
  chemically synthesized
accactcacctctgataacc

SEQ ID NO: 145691 - DNA, 20 bp, Artificial Sequence
  chemically synthesized
aacacacagctgggttatca

SEQ ID NO: 145692 - DNA, 20 bp, Artificial Sequence
  chemically synthesized
acacacagctgggttatcag

SEQ ID NO: 145693 - DNA, 20 bp, Artificial Sequence
  chemically synthesized
acagctgggttatcagaggt

SEQ ID NO: 145694 - DNA, 20 bp, Artificial Sequence
  chemically synthesized
gctgggttatcagaggtgag

SEQ ID NO: 145695 - DNA, 20 bp, Artificial Sequence
  chemically synthesized
ggttatcagaggtgagtggt

SEQ ID NO: 145696 - DNA, 20 bp, Artificial Sequence
  chemically synthesized
gttatcagaggtgagtggtg

SEQ ID NO: 145697 - DNA, 20 bp, Artificial Sequence
  chemically synthesized
ttatcagaggtgagtggtga

SEQ ID NO: 145698 - DNA, 20 bp, Artificial Sequence
  chemically synthesized
tatcagaggtgagtggtgag

SEQ ID NO: 145699 - DNA, 20 bp, Artificial Sequence
  chemically synthesized
cagaggtgagtggtgagggg

SEQ ID NO: 145700 - DNA, 20 bp, Artificial Sequence
  chemically synthesized
agaggtgagtggtgagggga

SEQ ID NO: 145701 - DNA, 20 bp, Artificial Sequence
  chemically synthesized
aggggaaggaatgcctaatc

SEQ ID NO: 145702 - DNA, 20 bp, Artificial Sequence
  chemically synthesized
tgttgtctataaacttgatt

SEQ ID NO: 145703 - DNA, 20 bp, Artificial Sequence
  chemically synthesized
ctgttgtctataaacttgat

SEQ ID NO: 145704 - DNA, 20 bp, Artificial Sequence
  chemically synthesized
ggaatgcctaatcaagttta

SEQ ID NO: 145705 - DNA, 20 bp, Artificial Sequence
  chemically synthesized
ctaatcaagtttatagacaa

SEQ ID NO: 145706 - DNA, 20 bp, Artificial Sequence
  chemically synthesized
agtttatagacaacagactc

SEQ ID NO: 145707 - DNA, 20 bp, Artificial Sequence
  chemically synthesized
tttatagacaacagactcaa

SEQ ID NO: 145708 - DNA, 20 bp, Artificial Sequence
  chemically synthesized
tctggttatattatgctctt

SEQ ID NO: 145709 - DNA, 20 bp, Artificial Sequence
  chemically synthesized
actcaagagcataatataac

SEQ ID NO: 145710 - DNA, 20 bp, Artificial Sequence
  chemically synthesized
caagagcataatataaccag

SEQ ID NO: 145711 - DNA, 20 bp, Artificial Sequence
  chemically synthesized
gcataatataaccagaagat

SEQ ID NO: 145712 - DNA, 20 bp, Artificial Sequence
  chemically synthesized
taattttgccaccaatcttc

SEQ ID NO: 145713 - DNA, 20 bp, Artificial Sequence
  chemically synthesized
taatataaccagaagattgg

SEQ ID NO: 145714 - DNA, 20 bp, Artificial Sequence
  chemically synthesized
aagattggtggcaaaattat

SEQ ID NO: 145715 - DNA, 20 bp, Artificial Sequence
  chemically synthesized
ggcaaaattattggactatg

SEQ ID NO: 145716 - DNA, 20 bp, Artificial Sequence
  chemically synthesized
aattattggactatgtagtt

SEQ ID NO: 145717 - DNA, 20 bp, Artificial Sequence
  chemically synthesized
acctttcattccaaactaca

SEQ ID NO: 145718 - DNA, 20 bp, Artificial Sequence
  chemically synthesized
gactatgtagtttggaatga

SEQ ID NO: 145719 - DNA, 20 bp, Artificial Sequence
  chemically synthesized
actatgtagtttggaatgaa

SEQ ID NO: 145720 - DNA, 20 bp, Artificial Sequence
  chemically synthesized
agtttggaatgaaaggtttc

SEQ ID NO: 145721 - DNA, 20 bp, Artificial Sequence
  chemically synthesized
gtttggaatgaaaggtttca

SEQ ID NO: 145722 - DNA, 20 bp, Artificial Sequence
  chemically synthesized
ggaatgaaaggtttcaagga

SEQ ID NO: 145723 - DNA, 20 bp, Artificial Sequence
  chemically synthesized
ggtttcaaggaaagctgcaa

SEQ ID NO: 145724 - DNA, 20 bp, Artificial Sequence
  chemically synthesized
tcctgttgagatgtcttttg

SEQ ID NO: 145725 - DNA, 20 bp, Artificial Sequence
  chemically synthesized
agctgcaaaagacatctcaa

SEQ ID NO: 145726 - DNA, 20 bp, Artificial Sequence
  chemically synthesized
gctgcaaaagacatctcaac

SEQ ID NO: 145727 - DNA, 20 bp, Artificial Sequence
  chemically synthesized
tgcaaaagacatctcaacag

SEQ ID NO: 145728 - DNA, 20 bp, Artificial Sequence
  chemically synthesized
tccagtgtgagtctcctgtt

SEQ ID NO: 145729 - DNA, 20 bp, Artificial Sequence
  chemically synthesized
tctcaacaggagactcacac

SEQ ID NO: 145730 - DNA, 20 bp, Artificial Sequence
  chemically synthesized
gttcactggttgtccagtgt

SEQ ID NO: 145731 - DNA, 20 bp, Artificial Sequence
  chemically synthesized
ggagactcacactggacaac

SEQ ID NO: 145732 - DNA, 20 bp, Artificial Sequence
  chemically synthesized
agaatcgttcactggttgtc

SEQ ID NO: 145733 - DNA, 20 bp, Artificial Sequence
  chemically synthesized
atattcttagaatcgttcac

SEQ ID NO: 145734 - DNA, 20 bp, Artificial Sequence
  chemically synthesized
gacaaccagtgaacgattct

SEQ ID NO: 145735 - DNA, 20 bp, Artificial Sequence
  chemically synthesized
tcatttttttttaatattct

SEQ ID NO: 145736 - DNA, 20 bp, Artificial Sequence
  chemically synthesized
taagaatattaaaaaaaaat

SEQ ID NO: 145737 - DNA, 20 bp, Artificial Sequence
  chemically synthesized
agacattgaattttcattct

SEQ ID NO: 145738 - DNA, 20 bp, Artificial Sequence
  chemically synthesized
gacattgaattttcattctg

SEQ ID NO: 145739 - DNA, 20 bp, Artificial Sequence
  chemically synthesized
attgaattttcattctgagg

SEQ ID NO: 145740 - DNA, 20 bp, Artificial Sequence
  chemically synthesized
aaattaatgattggctacct

SEQ ID NO: 145741 - DNA, 20 bp, Artificial Sequence
  chemically synthesized
tagccataaaaattaatgat

SEQ ID NO: 145742 - DNA, 20 bp, Artificial Sequence
  chemically synthesized
tagccaatcattaattttta

SEQ ID NO: 145743 - DNA, 20 bp, Artificial Sequence
  chemically synthesized
accttaaaagcacagttaca

SEQ ID NO: 145744 - DNA, 20 bp, Artificial Sequence
  chemically synthesized
ggctatgtaactgtgctttt

SEQ ID NO: 145745 - DNA, 20 bp, Artificial Sequence
  chemically synthesized
aggagacaaccttaaaagca

SEQ ID NO: 145746 - DNA, 20 bp, Artificial Sequence
  chemically synthesized
gctatgtaactgtgctttta

SEQ ID NO: 145747 - DNA, 20 bp, Artificial Sequence
  chemically synthesized
taatgaggagacaaccttaa

SEQ ID NO: 145748 - DNA, 20 bp, Artificial Sequence
  chemically synthesized
ttttaaggttgtctcctcat

SEQ ID NO: 145749 - DNA, 20 bp, Artificial Sequence
  chemically synthesized
ttaaggttgtctcctcatta

SEQ ID NO: 145750 - DNA, 20 bp, Artificial Sequence
  chemically synthesized
tcatcttcttctctaatgag

SEQ ID NO: 145751 - DNA, 20 bp, Artificial Sequence
  chemically synthesized
actcatcttcttctctaatg

SEQ ID NO: 145752 - DNA, 20 bp, Artificial Sequence
  chemically synthesized
aggttgtctcctcattagag

SEQ ID NO: 145753 - DNA, 20 bp, Artificial Sequence
  chemically synthesized
tactcatcttcttctctaat

SEQ ID NO: 145754 - DNA, 20 bp, Artificial Sequence
  chemically synthesized
ttgtctcctcattagagaag

SEQ ID NO: 145755 - DNA, 20 bp, Artificial Sequence
  chemically synthesized
tcctcattagagaagaagat

SEQ ID NO: 145756 - DNA, 20 bp, Artificial Sequence
  chemically synthesized
tcattagagaagaagatgag

SEQ ID NO: 145757 - DNA, 20 bp, Artificial Sequence
  chemically synthesized
agagaagaagatgagtagaa

SEQ ID NO: 145758 - DNA, 20 bp, Artificial Sequence
  chemically synthesized
gaagaagatgagtagaatgg

SEQ ID NO: 145759 - DNA, 20 bp, Artificial Sequence
  chemically synthesized
aagaatgtttcttgtctctc

SEQ ID NO: 145760 - DNA, 20 bp, Artificial Sequence
  chemically synthesized
ccctgagaagcttgagagac

SEQ ID NO: 145761 - DNA, 20 bp, Artificial Sequence
  chemically synthesized
ggtgtccctgagaagcttga

SEQ ID NO: 145762 - DNA, 20 bp, Artificial Sequence
  chemically synthesized
ttggtgtccctgagaagctt

SEQ ID NO: 145763 - DNA, 20 bp, Artificial Sequence
  chemically synthesized
ttcttgtctctcaagcttct

SEQ ID NO: 145764 - DNA, 20 bp, Artificial Sequence
  chemically synthesized
tcttgtctctcaagcttctc

SEQ ID NO: 145765 - DNA, 20 bp, Artificial Sequence
  chemically synthesized
cttgtctctcaagcttctca

SEQ ID NO: 145766 - DNA, 20 bp, Artificial Sequence
  chemically synthesized
aaactcttggtgtccctgag

SEQ ID NO: 145767 - DNA, 20 bp, Artificial Sequence
  chemically synthesized
agaaaactcttggtgtccct

SEQ ID NO: 145768 - DNA, 20 bp, Artificial Sequence
  chemically synthesized
tcaagcttctcagggacacc

SEQ ID NO: 145769 - DNA, 20 bp, Artificial Sequence
  chemically synthesized
aagcttctcagggacaccaa

SEQ ID NO: 145770 - DNA, 20 bp, Artificial Sequence
  chemically synthesized
cttcattcatagaaaactct

SEQ ID NO: 145771 - DNA, 20 bp, Artificial Sequence
  chemically synthesized
ccaagagttttctatgaatg

SEQ ID NO: 145772 - DNA, 20 bp, Artificial Sequence
  chemically synthesized
caagagttttctatgaatga

SEQ ID NO: 145773 - DNA, 20 bp, Artificial Sequence
  chemically synthesized
aaaattagttccttcattca

SEQ ID NO: 145774 - DNA, 20 bp, Artificial Sequence
  chemically synthesized
ctgtctgcattgatcaaaat

SEQ ID NO: 145775 - DNA, 20 bp, Artificial Sequence
  chemically synthesized
ggaactaattttgatcaatg

SEQ ID NO: 145776 - DNA, 20 bp, Artificial Sequence
  chemically synthesized
ctaattttgatcaatgcaga

SEQ ID NO: 145777 - DNA, 20 bp, Artificial Sequence
  chemically synthesized
tcaatgcagacagaaaaaaa

SEQ ID NO: 145778 - DNA, 20 bp, Artificial Sequence
  chemically synthesized
aaaaatagtgttttaattgt

SEQ ID NO: 145779 - DNA, 20 bp, Artificial Sequence
  chemically synthesized
aaatagtgttttaattgtca

SEQ ID NO: 145780 - DNA, 20 bp, Artificial Sequence
  chemically synthesized
atagtgttttaattgtcaga

SEQ ID NO: 145781 - DNA, 20 bp, Artificial Sequence
  chemically synthesized
tgtcacgaaacaatgattga

SEQ ID NO: 145782 - DNA, 20 bp, Artificial Sequence
  chemically synthesized
gtcacgaaacaatgattgaa

SEQ ID NO: 145783 - DNA, 20 bp, Artificial Sequence
  chemically synthesized
acgaaacaatgattgaaagg

SEQ ID NO: 145784 - DNA, 20 bp, Artificial Sequence
  chemically synthesized
caatgattgaaaggcagtaa

SEQ ID NO: 145785 - DNA, 20 bp, Artificial Sequence
  chemically synthesized
gattgaaaggcagtaacagt

SEQ ID NO: 145786 - DNA, 20 bp, Artificial Sequence
  chemically synthesized
attgaaaggcagtaacagtg

SEQ ID NO: 145787 - DNA, 20 bp, Artificial Sequence
  chemically synthesized
gcagtaacagtgaggcaata

SEQ ID NO: 145788 - DNA, 20 bp, Artificial Sequence
  chemically synthesized
acagtgaggcaataaagaaa

SEQ ID NO: 145789 - DNA, 20 bp, Artificial Sequence
  chemically synthesized
agaaaaagttttgtttctca

SEQ ID NO: 145790 - DNA, 20 bp, Artificial Sequence
  chemically synthesized
cagagtagtcagatagcttt

SEQ ID NO: 145791 - DNA, 20 bp, Artificial Sequence
  chemically synthesized
agagcctcagagtagtcaga

SEQ ID NO: 145792 - DNA, 20 bp, Artificial Sequence
  chemically synthesized
agaaagagcctcagagtagt

SEQ ID NO: 145793 - DNA, 20 bp, Artificial Sequence
  chemically synthesized
caaagctatctgactactct

SEQ ID NO: 145794 - DNA, 20 bp, Artificial Sequence
  chemically synthesized
aaagctatctgactactctg

SEQ ID NO: 145795 - DNA, 20 bp, Artificial Sequence
  chemically synthesized
ttctagaaagagcctcagag

SEQ ID NO: 145796 - DNA, 20 bp, Artificial Sequence
  chemically synthesized
tctttctagaaagagcctca

SEQ ID NO: 145797 - DNA, 20 bp, Artificial Sequence
  chemically synthesized
attctttctagaaagagcct

SEQ ID NO: 145798 - DNA, 20 bp, Artificial Sequence
  chemically synthesized
gactactctgaggctctttc

SEQ ID NO: 145799 - DNA, 20 bp, Artificial Sequence
  chemically synthesized
catttaattctttctagaaa

SEQ ID NO: 145800 - DNA, 20 bp, Artificial Sequence
  chemically synthesized
actctgaggctctttctaga

SEQ ID NO: 145801 - DNA, 20 bp, Artificial Sequence
  chemically synthesized
tacatttaattctttctaga

SEQ ID NO: 145802 - DNA, 20 bp, Artificial Sequence
  chemically synthesized
acattacatttaattctttc

SEQ ID NO: 145803 - DNA, 20 bp, Artificial Sequence
  chemically synthesized
aaagaattaaatgtaatgta

SEQ ID NO: 145804 - DNA, 20 bp, Artificial Sequence
  chemically synthesized
gaattaaatgtaatgtaaag

SEQ ID NO: 145805 - DNA, 20 bp, Artificial Sequence
  chemically synthesized
aatgtaatgtaaagaagaaa

SEQ ID NO: 145806 - DNA, 20 bp, Artificial Sequence
  chemically synthesized
agaaatagcattttgtgtca

SEQ ID NO: 145807 - DNA, 20 bp, Artificial Sequence
  chemically synthesized
tagcattttgtgtcacagtc

SEQ ID NO: 145808 - DNA, 20 bp, Artificial Sequence
  chemically synthesized
agcattttgtgtcacagtcc

SEQ ID NO: 145809 - DNA, 20 bp, Artificial Sequence
  chemically synthesized
cattttgtgtcacagtccag

SEQ ID NO: 145810 - DNA, 20 bp, Artificial Sequence
  chemically synthesized
tttgtgtcacagtccaggag

SEQ ID NO: 145811 - DNA, 20 bp, Artificial Sequence
  chemically synthesized
gcttccatgatttcttctcc

SEQ ID NO: 145812 - DNA, 20 bp, Artificial Sequence
  chemically synthesized
cagtccaggagaagaaatca

SEQ ID NO: 145813 - DNA, 20 bp, Artificial Sequence
  chemically synthesized
tccaggagaagaaatcatgg

SEQ ID NO: 145814 - DNA, 20 bp, Artificial Sequence
  chemically synthesized
gaagaaatcatggaagcaaa

SEQ ID NO: 145815 - DNA, 20 bp, Artificial Sequence
  chemically synthesized
atcatggaagcaaaaagatc

SEQ ID NO: 145816 - DNA, 20 bp, Artificial Sequence
  chemically synthesized
ggaatcccttttaagatttc

SEQ ID NO: 145817 - DNA, 20 bp, Artificial Sequence
  chemically synthesized
aaaagatctagaaatcttaa

SEQ ID NO: 145818 - DNA, 20 bp, Artificial Sequence
  chemically synthesized
aaagatctagaaatcttaaa

SEQ ID NO: 145819 - DNA, 20 bp, Artificial Sequence
  chemically synthesized
aagatctagaaatcttaaaa

SEQ ID NO: 145820 - DNA, 20 bp, Artificial Sequence
  chemically synthesized
cctttcctggaatccctttt

SEQ ID NO: 145821 - DNA, 20 bp, Artificial Sequence
  chemically synthesized
agaaatcttaaaagggattc

SEQ ID NO: 145822 - DNA, 20 bp, Artificial Sequence
  chemically synthesized
gaaatcttaaaagggattcc

SEQ ID NO: 145823 - DNA, 20 bp, Artificial Sequence
  chemically synthesized
tcttaaaagggattccagga

SEQ ID NO: 145824 - DNA, 20 bp, Artificial Sequence
  chemically synthesized
cttaaaagggattccaggaa

SEQ ID NO: 145825 - DNA, 20 bp, Artificial Sequence
  chemically synthesized
taaaagggattccaggaaag

SEQ ID NO: 145826 - DNA, 20 bp, Artificial Sequence
  chemically synthesized
tggatatttagctcctttcc

SEQ ID NO: 145827 - DNA, 20 bp, Artificial Sequence
  chemically synthesized
caggaaaggagctaaatatc

SEQ ID NO: 145828 - DNA, 20 bp, Artificial Sequence
  chemically synthesized
atgcatcctctctggatatt

SEQ ID NO: 145829 - DNA, 20 bp, Artificial Sequence
  chemically synthesized
ggaaaggagctaaatatcca

SEQ ID NO: 145830 - DNA, 20 bp, Artificial Sequence
  chemically synthesized
aaaggagctaaatatccaga

SEQ ID NO: 145831 - DNA, 20 bp, Artificial Sequence
  chemically synthesized
aaggagctaaatatccagag

SEQ ID NO: 145832 - DNA, 20 bp, Artificial Sequence
  chemically synthesized
cctcacacatgcatcctctc

SEQ ID NO: 145833 - DNA, 20 bp, Artificial Sequence
  chemically synthesized
tccagagaggatgcatgtgt

SEQ ID NO: 145834 - DNA, 20 bp, Artificial Sequence
  chemically synthesized
ccagagaggatgcatgtgtg

SEQ ID NO: 145835 - DNA, 20 bp, Artificial Sequence
  chemically synthesized
gatgcatgtgtgaggatgaa

SEQ ID NO: 145836 - DNA, 20 bp, Artificial Sequence
  chemically synthesized
tgcatgtgtgaggatgaaaa

SEQ ID NO: 145837 - DNA, 20 bp, Artificial Sequence
  chemically synthesized
catgtgtgaggatgaaaaga

SEQ ID NO: 145838 - DNA, 20 bp, Artificial Sequence
  chemically synthesized
cctacagtgatattttaatt

SEQ ID NO: 145839 - DNA, 20 bp, Artificial Sequence
  chemically synthesized
gctaaattaaaatatcactg

SEQ ID NO: 145840 - DNA, 20 bp, Artificial Sequence
  chemically synthesized
ctaaattaaaatatcactgt

SEQ ID NO: 145841 - DNA, 20 bp, Artificial Sequence
  chemically synthesized
tgttctgcagttagttccta

SEQ ID NO: 145842 - DNA, 20 bp, Artificial Sequence
  chemically synthesized
atcactgtaggaactaactg

SEQ ID NO: 145843 - DNA, 20 bp, Artificial Sequence
  chemically synthesized
tcagcctggtgttctgcagt

SEQ ID NO: 145844 - DNA, 20 bp, Artificial Sequence
  chemically synthesized
ccagtcagcctggtgttctg

SEQ ID NO: 145845 - DNA, 20 bp, Artificial Sequence
  chemically synthesized
aggaactaactgcagaacac

SEQ ID NO: 145846 - DNA, 20 bp, Artificial Sequence
  chemically synthesized
ggaactaactgcagaacacc

SEQ ID NO: 145847 - DNA, 20 bp, Artificial Sequence
  chemically synthesized
ctgcagaacaccaggctgac

SEQ ID NO: 145848 - DNA, 20 bp, Artificial Sequence
  chemically synthesized
tccacatttgccagtcagcc

SEQ ID NO: 145849 - DNA, 20 bp, Artificial Sequence
  chemically synthesized
ctccatccacatttgccagt

SEQ ID NO: 145850 - DNA, 20 bp, Artificial Sequence
  chemically synthesized
accaggctgactggcaaatg

SEQ ID NO: 145851 - DNA, 20 bp, Artificial Sequence
  chemically synthesized
aacactccatccacatttgc

SEQ ID NO: 145852 - DNA, 20 bp, Artificial Sequence
  chemically synthesized
ggctgactggcaaatgtgga

SEQ ID NO: 145853 - DNA, 20 bp, Artificial Sequence
  chemically synthesized
ctgactggcaaatgtggatg

SEQ ID NO: 145854 - DNA, 20 bp, Artificial Sequence
  chemically synthesized
tggatggagtgttcctaaaa

SEQ ID NO: 145855 - DNA, 20 bp, Artificial Sequence
  chemically synthesized
ataccttgtgtatctatttt

SEQ ID NO: 145856 - DNA, 20 bp, Artificial Sequence
  chemically synthesized
tataccttgtgtatctattt

SEQ ID NO: 145857 - DNA, 20 bp, Artificial Sequence
  chemically synthesized
tgttcctaaaatagatacac

SEQ ID NO: 145858 - DNA, 20 bp, Artificial Sequence
  chemically synthesized
gttcctaaaatagatacaca

SEQ ID NO: 145859 - DNA, 20 bp, Artificial Sequence
  chemically synthesized
atagatacacaaggtatact

SEQ ID NO: 145860 - DNA, 20 bp, Artificial Sequence
  chemically synthesized
tagatacacaaggtatactg

SEQ ID NO: 145861 - DNA, 20 bp, Artificial Sequence
  chemically synthesized
taaattgctgtatattgcct

SEQ ID NO: 145862 - DNA, 20 bp, Artificial Sequence
  chemically synthesized
aggtatactgaggcaatata

SEQ ID NO: 145863 - DNA, 20 bp, Artificial Sequence
  chemically synthesized
tgaggcaatatacagcaatt

SEQ ID NO: 145864 - DNA, 20 bp, Artificial Sequence
  chemically synthesized
gaggcaatatacagcaattt

SEQ ID NO: 145865 - DNA, 20 bp, Artificial Sequence
  chemically synthesized
ggcaatatacagcaatttag

SEQ ID NO: 145866 - DNA, 20 bp, Artificial Sequence
  chemically synthesized
gcaatatacagcaatttagg

SEQ ID NO: 145867 - DNA, 20 bp, Artificial Sequence
  chemically synthesized
cagcaatttaggaggatttc

SEQ ID NO: 145868 - DNA, 20 bp, Artificial Sequence
  chemically synthesized
ttaggaggatttcaagctta

SEQ ID NO: 145869 - DNA, 20 bp, Artificial Sequence
  chemically synthesized
taggaggatttcaagcttat

SEQ ID NO: 145870 - DNA, 20 bp, Artificial Sequence
  chemically synthesized
gaggatttcaagcttatggg

SEQ ID NO: 145871 - DNA, 20 bp, Artificial Sequence
  chemically synthesized
cattttctgacacttcccat

SEQ ID NO: 145872 - DNA, 20 bp, Artificial Sequence
  chemically synthesized
ttcaagcttatgggaagtgt

SEQ ID NO: 145873 - DNA, 20 bp, Artificial Sequence
  chemically synthesized
tcagaaaatgcttttttaaa

SEQ ID NO: 145874 - DNA, 20 bp, Artificial Sequence
  chemically synthesized
caataagtcactttttaaaa

SEQ ID NO: 145875 - DNA, 20 bp, Artificial Sequence
  chemically synthesized
ttgagggtcaaattttcaat

SEQ ID NO: 145876 - DNA, 20 bp, Artificial Sequence
  chemically synthesized
tgaaaatttgaccctcaaat

SEQ ID NO: 145877 - DNA, 20 bp, Artificial Sequence
  chemically synthesized
ttgtctctgctcttatttga

SEQ ID NO: 145878 - DNA, 20 bp, Artificial Sequence
  chemically synthesized
aaaatttgaccctcaaataa

SEQ ID NO: 145879 - DNA, 20 bp, Artificial Sequence
  chemically synthesized
cttgtctctgctcttatttg

SEQ ID NO: 145880 - DNA, 20 bp, Artificial Sequence
  chemically synthesized
tcttgtctctgctcttattt

SEQ ID NO: 145881 - DNA, 20 bp, Artificial Sequence
  chemically synthesized
atttgaccctcaaataagag

SEQ ID NO: 145882 - DNA, 20 bp, Artificial Sequence
  chemically synthesized
ttgaccctcaaataagagca

SEQ ID NO: 145883 - DNA, 20 bp, Artificial Sequence
  chemically synthesized
cctcaaataagagcagagac

SEQ ID NO: 145884 - DNA, 20 bp, Artificial Sequence
  chemically synthesized
tcaaataagagcagagacaa

SEQ ID NO: 145885 - DNA, 20 bp, Artificial Sequence
  chemically synthesized
agagattttttttttttctc

SEQ ID NO: 145886 - DNA, 20 bp, Artificial Sequence
  chemically synthesized
catggtcagaagtaagtctg

SEQ ID NO: 145887 - DNA, 20 bp, Artificial Sequence
  chemically synthesized
ttcatggtcagaagtaagtc

SEQ ID NO: 145888 - DNA, 20 bp, Artificial Sequence
  chemically synthesized
cttctttcatggtcagaagt

SEQ ID NO: 145889 - DNA, 20 bp, Artificial Sequence
  chemically synthesized
ggtacttctttcatggtcag

SEQ ID NO: 145890 - DNA, 20 bp, Artificial Sequence
  chemically synthesized
agacttacttctgaccatga

SEQ ID NO: 145891 - DNA, 20 bp, Artificial Sequence
  chemically synthesized
ttaggtacttctttcatggt

SEQ ID NO: 145892 - DNA, 20 bp, Artificial Sequence
  chemically synthesized
cttacttctgaccatgaaag

SEQ ID NO: 145893 - DNA, 20 bp, Artificial Sequence
  chemically synthesized
ctcattaggtacttctttca

SEQ ID NO: 145894 - DNA, 20 bp, Artificial Sequence
  chemically synthesized
ccatgaaagaagtacctaat

SEQ ID NO: 145895 - DNA, 20 bp, Artificial Sequence
  chemically synthesized
catgaaagaagtacctaatg

SEQ ID NO: 145896 - DNA, 20 bp, Artificial Sequence
  chemically synthesized
gaaagaagtacctaatgagg

SEQ ID NO: 145897 - DNA, 20 bp, Artificial Sequence
  chemically synthesized
atgatcatttccacctcatt

SEQ ID NO: 145898 - DNA, 20 bp, Artificial Sequence
  chemically synthesized
catgatcatttccacctcat

SEQ ID NO: 145899 - DNA, 20 bp, Artificial Sequence
  chemically synthesized
tccttcactttattgaaatt

SEQ ID NO: 145900 - DNA, 20 bp, Artificial Sequence
  chemically synthesized
tgtcacactaaatttcaata

SEQ ID NO: 145901 - DNA, 20 bp, Artificial Sequence
  chemically synthesized
cactaaatttcaataaagtg

SEQ ID NO: 145902 - DNA, 20 bp, Artificial Sequence
  chemically synthesized
actaaatttcaataaagtga

SEQ ID NO: 145903 - DNA, 20 bp, Artificial Sequence
  chemically synthesized
atttcaataaagtgaaggat

SEQ ID NO: 145904 - DNA, 20 bp, Artificial Sequence
  chemically synthesized
tttcaataaagtgaaggatg

SEQ ID NO: 145905 - DNA, 20 bp, Artificial Sequence
  chemically synthesized
taaagtgaaggatgaggaac

SEQ ID NO: 145906 - DNA, 20 bp, Artificial Sequence
  chemically synthesized
aagtgaaggatgaggaacta

SEQ ID NO: 145907 - DNA, 20 bp, Artificial Sequence
  chemically synthesized
gttgaagtctgataattctc

SEQ ID NO: 145908 - DNA, 20 bp, Artificial Sequence
  chemically synthesized
atgaggaactagagaattat

SEQ ID NO: 145909 - DNA, 20 bp, Artificial Sequence
  chemically synthesized
gagaattatcagacttcaac

SEQ ID NO: 145910 - DNA, 20 bp, Artificial Sequence
  chemically synthesized
aattatcagacttcaacaag

SEQ ID NO: 145911 - DNA, 20 bp, Artificial Sequence
  chemically synthesized
aaacagtggtctgcttgttg

SEQ ID NO: 145912 - DNA, 20 bp, Artificial Sequence
  chemically synthesized
acgtgcttttcaggaaacag

SEQ ID NO: 145913 - DNA, 20 bp, Artificial Sequence
  chemically synthesized
caaacgtgcttttcaggaaa

SEQ ID NO: 145914 - DNA, 20 bp, Artificial Sequence
  chemically synthesized
gcagaccactgtttcctgaa

SEQ ID NO: 145915 - DNA, 20 bp, Artificial Sequence
  chemically synthesized
tttttccaaacgtgcttttc

SEQ ID NO: 145916 - DNA, 20 bp, Artificial Sequence
  chemically synthesized
ctttttccaaacgtgctttt

SEQ ID NO: 145917 - DNA, 20 bp, Artificial Sequence
  chemically synthesized
tgtttcctgaaaagcacgtt

SEQ ID NO: 145918 - DNA, 20 bp, Artificial Sequence
  chemically synthesized
ctgaaaagcacgtttggaaa

SEQ ID NO: 145919 - DNA, 20 bp, Artificial Sequence
  chemically synthesized
aaagcacgtttggaaaaaga

SEQ ID NO: 145920 - DNA, 20 bp, Artificial Sequence
  chemically synthesized
cacgtttggaaaaagacaga

SEQ ID NO: 145921 - DNA, 20 bp, Artificial Sequence
  chemically synthesized
acgtttggaaaaagacagaa

SEQ ID NO: 145922 - DNA, 20 bp, Artificial Sequence
  chemically synthesized
tttggaaaaagacagaaagg

SEQ ID NO: 145923 - DNA, 20 bp, Artificial Sequence
  chemically synthesized
ggaaaaagacagaaaggaag

SEQ ID NO: 145924 - DNA, 20 bp, Artificial Sequence
  chemically synthesized
gaaaaagacagaaaggaaga

SEQ ID NO: 145925 - DNA, 20 bp, Artificial Sequence
  chemically synthesized
aagacagaaaggaagaagga

SEQ ID NO: 145926 - DNA, 20 bp, Artificial Sequence
  chemically synthesized
acagaaaggaagaaggaaag

SEQ ID NO: 145927 - DNA, 20 bp, Artificial Sequence
  chemically synthesized
aaaggaagaaggaaagaaga

SEQ ID NO: 145928 - DNA, 20 bp, Artificial Sequence
  chemically synthesized
gaagaaggaaagaagaaagt

SEQ ID NO: 145929 - DNA, 20 bp, Artificial Sequence
  chemically synthesized
aagaaggaaagaagaaagtc

SEQ ID NO: 145930 - DNA, 20 bp, Artificial Sequence
  chemically synthesized
agaaggaaagaagaaagtca

SEQ ID NO: 145931 - DNA, 20 bp, Artificial Sequence
  chemically synthesized
aaggaaagaagaaagtcagg

SEQ ID NO: 145932 - DNA, 20 bp, Artificial Sequence
  chemically synthesized
aggaaagaagaaagtcaggg

SEQ ID NO: 145933 - DNA, 20 bp, Artificial Sequence
  chemically synthesized
ggaaagaagaaagtcaggga

SEQ ID NO: 145934 - DNA, 20 bp, Artificial Sequence
  chemically synthesized
aaagaagaaagtcagggagg

SEQ ID NO: 145935 - DNA, 20 bp, Artificial Sequence
  chemically synthesized
aagaagaaagtcagggaggg

SEQ ID NO: 145936 - DNA, 20 bp, Artificial Sequence
  chemically synthesized
agaagaaagtcagggaggga

SEQ ID NO: 145937 - DNA, 20 bp, Artificial Sequence
  chemically synthesized
aagaaagtcagggagggagg

SEQ ID NO: 145938 - DNA, 20 bp, Artificial Sequence
  chemically synthesized
agaaagtcagggagggaggg

SEQ ID NO: 145939 - DNA, 20 bp, Artificial Sequence
  chemically synthesized
gaaagtcagggagggaggga

SEQ ID NO: 145940 - DNA, 20 bp, Artificial Sequence
  chemically synthesized
aagtcagggagggagggagg

SEQ ID NO: 145941 - DNA, 20 bp, Artificial Sequence
  chemically synthesized
agtcagggagggagggaggg

SEQ ID NO: 145942 - DNA, 20 bp, Artificial Sequence
  chemically synthesized
cagggagggagggagggagg

SEQ ID NO: 145943 - DNA, 20 bp, Artificial Sequence
  chemically synthesized
agggagggagggagggagga

SEQ ID NO: 145944 - DNA, 20 bp, Artificial Sequence
  chemically synthesized
ggagggagggagggaggaag

SEQ ID NO: 145945 - DNA, 20 bp, Artificial Sequence
  chemically synthesized
gagggagggagggaggaagg

SEQ ID NO: 145946 - DNA, 20 bp, Artificial Sequence
  chemically synthesized
agggagggagggaggaagga

SEQ ID NO: 145947 - DNA, 20 bp, Artificial Sequence
  chemically synthesized
ggagggagggaggaaggagg

SEQ ID NO: 145948 - DNA, 20 bp, Artificial Sequence
  chemically synthesized
gagggagggaggaaggaggg

SEQ ID NO: 145949 - DNA, 20 bp, Artificial Sequence
  chemically synthesized
agggagggaggaaggaggga

SEQ ID NO: 145950 - DNA, 20 bp, Artificial Sequence
  chemically synthesized
ggagggaggaaggagggagg

SEQ ID NO: 145951 - DNA, 20 bp, Artificial Sequence
  chemically synthesized
gagggaggaaggagggaggg

SEQ ID NO: 145952 - DNA, 20 bp, Artificial Sequence
  chemically synthesized
agggaggaaggagggaggga

SEQ ID NO: 145953 - DNA, 20 bp, Artificial Sequence
  chemically synthesized
ggaggaaggagggagggagg

SEQ ID NO: 145954 - DNA, 20 bp, Artificial Sequence
  chemically synthesized
gaggaaggagggagggaggg

SEQ ID NO: 145955 - DNA, 20 bp, Artificial Sequence
  chemically synthesized
aggaaggagggagggaggga

SEQ ID NO: 145956 - DNA, 20 bp, Artificial Sequence
  chemically synthesized
gaaggagggagggagggagg

SEQ ID NO: 145957 - DNA, 20 bp, Artificial Sequence
  chemically synthesized
aaggagggagggagggaggg

SEQ ID NO: 145958 - DNA, 20 bp, Artificial Sequence
  chemically synthesized
aggagggagggagggaggga

SEQ ID NO: 145959 - DNA, 20 bp, Artificial Sequence
  chemically synthesized
gagggagggaatctattgaa

SEQ ID NO: 145960 - DNA, 20 bp, Artificial Sequence
  chemically synthesized
tgtcttgccttgcttttcaa

SEQ ID NO: 145961 - DNA, 20 bp, Artificial Sequence
  chemically synthesized
gagggaatctattgaaaagc

SEQ ID NO: 145962 - DNA, 20 bp, Artificial Sequence
  chemically synthesized
agggaatctattgaaaagca

SEQ ID NO: 145963 - DNA, 20 bp, Artificial Sequence
  chemically synthesized
aatctattgaaaagcaaggc

SEQ ID NO: 145964 - DNA, 20 bp, Artificial Sequence
  chemically synthesized
attgaaaagcaaggcaagac

SEQ ID NO: 145965 - DNA, 20 bp, Artificial Sequence
  chemically synthesized
ttgaaaagcaaggcaagaca

SEQ ID NO: 145966 - DNA, 20 bp, Artificial Sequence
  chemically synthesized
aaaagcaaggcaagacaagg

SEQ ID NO: 145967 - DNA, 20 bp, Artificial Sequence
  chemically synthesized
aaagcaaggcaagacaaggc

SEQ ID NO: 145968 - DNA, 20 bp, Artificial Sequence
  chemically synthesized
gcaaggcaagacaaggcagg

SEQ ID NO: 145969 - DNA, 20 bp, Artificial Sequence
  chemically synthesized
caaggcaagacaaggcagga

SEQ ID NO: 145970 - DNA, 20 bp, Artificial Sequence
  chemically synthesized
ggcaagacaaggcaggaagg

SEQ ID NO: 145971 - DNA, 20 bp, Artificial Sequence
  chemically synthesized
gcaagacaaggcaggaaggc

SEQ ID NO: 145972 - DNA, 20 bp, Artificial Sequence
  chemically synthesized
agacaaggcaggaaggcagg

SEQ ID NO: 145973 - DNA, 20 bp, Artificial Sequence
  chemically synthesized
gacaaggcaggaaggcagga

SEQ ID NO: 145974 - DNA, 20 bp, Artificial Sequence
  chemically synthesized
aaggcaggaaggcaggaagg

SEQ ID NO: 145975 - DNA, 20 bp, Artificial Sequence
  chemically synthesized
aggcaggaaggcaggaagga

SEQ ID NO: 145976 - DNA, 20 bp, Artificial Sequence
  chemically synthesized
caggaaggcaggaaggaagg

SEQ ID NO: 145977 - DNA, 20 bp, Artificial Sequence
  chemically synthesized
aaggcaggaaggaaggaagt

SEQ ID NO: 145978 - DNA, 20 bp, Artificial Sequence
  chemically synthesized
aggcaggaaggaaggaagtc

SEQ ID NO: 145979 - DNA, 20 bp, Artificial Sequence
  chemically synthesized
caggaaggaaggaagtcagg

SEQ ID NO: 145980 - DNA, 20 bp, Artificial Sequence
  chemically synthesized
aaggaaggaagtcaggaagc

SEQ ID NO: 145981 - DNA, 20 bp, Artificial Sequence
  chemically synthesized
aggaaggaagtcaggaagcc

SEQ ID NO: 145982 - DNA, 20 bp, Artificial Sequence
  chemically synthesized
aaggaagtcaggaagccagg

SEQ ID NO: 145983 - DNA, 20 bp, Artificial Sequence
  chemically synthesized
aagtcaggaagccaggcagt

SEQ ID NO: 145984 - DNA, 20 bp, Artificial Sequence
  chemically synthesized
agtcaggaagccaggcagta

SEQ ID NO: 145985 - DNA, 20 bp, Artificial Sequence
  chemically synthesized
tccttccttcccttactgcc

SEQ ID NO: 145986 - DNA, 20 bp, Artificial Sequence
  chemically synthesized
gtcaggaagccaggcagtaa

SEQ ID NO: 145987 - DNA, 20 bp, Artificial Sequence
  chemically synthesized
aggaagccaggcagtaaggg

SEQ ID NO: 145988 - DNA, 20 bp, Artificial Sequence
  chemically synthesized
ggaagccaggcagtaaggga

SEQ ID NO: 145989 - DNA, 20 bp, Artificial Sequence
  chemically synthesized
agccaggcagtaagggaagg

SEQ ID NO: 145990 - DNA, 20 bp, Artificial Sequence
  chemically synthesized
gccaggcagtaagggaagga

SEQ ID NO: 145991 - DNA, 20 bp, Artificial Sequence
  chemically synthesized
caggcagtaagggaaggaag

SEQ ID NO: 145992 - DNA, 20 bp, Artificial Sequence
  chemically synthesized
aggcagtaagggaaggaagg

SEQ ID NO: 145993 - DNA, 20 bp, Artificial Sequence
  chemically synthesized
cagtaagggaaggaaggagg

SEQ ID NO: 145994 - DNA, 20 bp, Artificial Sequence
  chemically synthesized
agtaagggaaggaaggagga

SEQ ID NO: 145995 - DNA, 20 bp, Artificial Sequence
  chemically synthesized
ggaaggaggaaggaatctat

SEQ ID NO: 145996 - DNA, 20 bp, Artificial Sequence
  chemically synthesized
aggaggaaggaatctattgg

SEQ ID NO: 145997 - DNA, 20 bp, Artificial Sequence
  chemically synthesized
gcttttcaatagacttccaa

SEQ ID NO: 145998 - DNA, 20 bp, Artificial Sequence
  chemically synthesized
tctattggaagtctattgaa

SEQ ID NO: 145999 - DNA, 20 bp, Artificial Sequence
  chemically synthesized
gccctggccttgcttttcaa

SEQ ID NO: 146000 - DNA, 20 bp, Artificial Sequence
  chemically synthesized
ttggaagtctattgaaaagc

SEQ ID NO: 146001 - DNA, 20 bp, Artificial Sequence
  chemically synthesized
tggaagtctattgaaaagca

SEQ ID NO: 146002 - DNA, 20 bp, Artificial Sequence
  chemically synthesized
agtctattgaaaagcaaggc

SEQ ID NO: 146003 - DNA, 20 bp, Artificial Sequence
  chemically synthesized
gtctattgaaaagcaaggcc

SEQ ID NO: 146004 - DNA, 20 bp, Artificial Sequence
  chemically synthesized
tctattgaaaagcaaggcca

SEQ ID NO: 146005 - DNA, 20 bp, Artificial Sequence
  chemically synthesized
gaaaagcaaggccagggcct

SEQ ID NO: 146006 - DNA, 20 bp, Artificial Sequence
  chemically synthesized
tctttttgagtctcaggccc

SEQ ID NO: 146007 - DNA, 20 bp, Artificial Sequence
  chemically synthesized
attctctctttttgagtctc

SEQ ID NO: 146008 - DNA, 20 bp, Artificial Sequence
  chemically synthesized
cattctctctttttgagtct

SEQ ID NO: 146009 - DNA, 20 bp, Artificial Sequence
  chemically synthesized
gccagggcctgagactcaaa

SEQ ID NO: 146010 - DNA, 20 bp, Artificial Sequence
  chemically synthesized
cagggcctgagactcaaaaa

SEQ ID NO: 146011 - DNA, 20 bp, Artificial Sequence
  chemically synthesized
gggcctgagactcaaaaaga

SEQ ID NO: 146012 - DNA, 20 bp, Artificial Sequence
  chemically synthesized
atgaaccattctctcttttt

SEQ ID NO: 146013 - DNA, 20 bp, Artificial Sequence
  chemically synthesized
tgagactcaaaaagagagaa

SEQ ID NO: 146014 - DNA, 20 bp, Artificial Sequence
  chemically synthesized
tatcatcccaatggcatatt

SEQ ID NO: 146015 - DNA, 20 bp, Artificial Sequence
  chemically synthesized
atgatgactaaatatgccat

SEQ ID NO: 146016 - DNA, 20 bp, Artificial Sequence
  chemically synthesized
tgatgactaaatatgccatt

SEQ ID NO: 146017 - DNA, 20 bp, Artificial Sequence
  chemically synthesized
cagctaatttatcatcccaa

SEQ ID NO: 146018 - DNA, 20 bp, Artificial Sequence
  chemically synthesized
atgccattgggatgataaat

SEQ ID NO: 146019 - DNA, 20 bp, Artificial Sequence
  chemically synthesized
ttgggatgataaattagctg

SEQ ID NO: 146020 - DNA, 20 bp, Artificial Sequence
  chemically synthesized
atcatcctctgaatatgctt

SEQ ID NO: 146021 - DNA, 20 bp, Artificial Sequence
  chemically synthesized
taaattagctgaagcatatt

SEQ ID NO: 146022 - DNA, 20 bp, Artificial Sequence
  chemically synthesized
aattagctgaagcatattca

SEQ ID NO: 146023 - DNA, 20 bp, Artificial Sequence
  chemically synthesized
attagctgaagcatattcag

SEQ ID NO: 146024 - DNA, 20 bp, Artificial Sequence
  chemically synthesized
gaagcatattcagaggatga

SEQ ID NO: 146025 - DNA, 20 bp, Artificial Sequence
  chemically synthesized
agcatattcagaggatgatg

SEQ ID NO: 146026 - DNA, 20 bp, Artificial Sequence
  chemically synthesized
catattcagaggatgatgga

SEQ ID NO: 146027 - DNA, 20 bp, Artificial Sequence
  chemically synthesized
atattcagaggatgatggag

SEQ ID NO: 146028 - DNA, 20 bp, Artificial Sequence
  chemically synthesized
cagaggatgatggagaggtc

SEQ ID NO: 146029 - DNA, 20 bp, Artificial Sequence
  chemically synthesized
gatggagaggtctagcaatg

SEQ ID NO: 146030 - DNA, 20 bp, Artificial Sequence
  chemically synthesized
cgcagggatggccgcattgc

SEQ ID NO: 146031 - DNA, 20 bp, Artificial Sequence
  chemically synthesized
gcccatgactggcgcaggga

SEQ ID NO: 146032 - DNA, 20 bp, Artificial Sequence
  chemically synthesized
caatgcggccatccctgcgc

SEQ ID NO: 146033 - DNA, 20 bp, Artificial Sequence
  chemically synthesized
atctgcccatgactggcgca

SEQ ID NO: 146034 - DNA, 20 bp, Artificial Sequence
  chemically synthesized
tatctgcccatgactggcgc

SEQ ID NO: 146035 - DNA, 20 bp, Artificial Sequence
  chemically synthesized
ttatctgcccatgactggcg

SEQ ID NO: 146036 - DNA, 20 bp, Artificial Sequence
  chemically synthesized
ggccatccctgcgccagtca

SEQ ID NO: 146037 - DNA, 20 bp, Artificial Sequence
  chemically synthesized
gccatccctgcgccagtcat

SEQ ID NO: 146038 - DNA, 20 bp, Artificial Sequence
  chemically synthesized
tgagattatctgcccatgac

SEQ ID NO: 146039 - DNA, 20 bp, Artificial Sequence
  chemically synthesized
atccctgcgccagtcatggg

SEQ ID NO: 146040 - DNA, 20 bp, Artificial Sequence
  chemically synthesized
tgggcagataatctcatcta

SEQ ID NO: 146041 - DNA, 20 bp, Artificial Sequence
  chemically synthesized
ggcctgacgggtctatagat

SEQ ID NO: 146042 - DNA, 20 bp, Artificial Sequence
  chemically synthesized
atactggcctgacgggtcta

SEQ ID NO: 146043 - DNA, 20 bp, Artificial Sequence
  chemically synthesized
aatctcatctatagacccgt

SEQ ID NO: 146044 - DNA, 20 bp, Artificial Sequence
  chemically synthesized
atctcatctatagacccgtc

SEQ ID NO: 146045 - DNA, 20 bp, Artificial Sequence
  chemically synthesized
catctatagacccgtcaggc

SEQ ID NO: 146046 - DNA, 20 bp, Artificial Sequence
  chemically synthesized
accagaaatactggcctgac

SEQ ID NO: 146047 - DNA, 20 bp, Artificial Sequence
  chemically synthesized
gaccagaaatactggcctga

SEQ ID NO: 146048 - DNA, 20 bp, Artificial Sequence
  chemically synthesized
acccgtcaggccagtatttc

SEQ ID NO: 146049 - DNA, 20 bp, Artificial Sequence
  chemically synthesized
gaagagaagaccagaaatac

SEQ ID NO: 146050 - DNA, 20 bp, Artificial Sequence
  chemically synthesized
catgctggagaagagaagac

SEQ ID NO: 146051 - DNA, 20 bp, Artificial Sequence
  chemically synthesized
tggtgcatgctggagaagag

SEQ ID NO: 146052 - DNA, 20 bp, Artificial Sequence
  chemically synthesized
atttctggtcttctcttctc

SEQ ID NO: 146053 - DNA, 20 bp, Artificial Sequence
  chemically synthesized
aggtggtgcatgctggagaa

SEQ ID NO: 146054 - DNA, 20 bp, Artificial Sequence
  chemically synthesized
tcaggtggtgcatgctggag

SEQ ID NO: 146055 - DNA, 20 bp, Artificial Sequence
  chemically synthesized
tcttcaggtggtgcatgctg

SEQ ID NO: 146056 - DNA, 20 bp, Artificial Sequence
  chemically synthesized
gttcttcaggtggtgcatgc

SEQ ID NO: 146057 - DNA, 20 bp, Artificial Sequence
  chemically synthesized
tctccagcatgcaccacctg

SEQ ID NO: 146058 - DNA, 20 bp, Artificial Sequence
  chemically synthesized
acagatagatgttcttcagg

SEQ ID NO: 146059 - DNA, 20 bp, Artificial Sequence
  chemically synthesized
tgtacagatagatgttcttc

SEQ ID NO: 146060 - DNA, 20 bp, Artificial Sequence
  chemically synthesized
gtgtacagatagatgttctt

SEQ ID NO: 146061 - DNA, 20 bp, Artificial Sequence
  chemically synthesized
ctttcccagcagtgtacaga

SEQ ID NO: 146062 - DNA, 20 bp, Artificial Sequence
  chemically synthesized
ctccctttcccagcagtgta

SEQ ID NO: 146063 - DNA, 20 bp, Artificial Sequence
  chemically synthesized
aacatctatctgtacactgc

SEQ ID NO: 146064 - DNA, 20 bp, Artificial Sequence
  chemically synthesized
acatctatctgtacactgct

SEQ ID NO: 146065 - DNA, 20 bp, Artificial Sequence
  chemically synthesized
ctatctgtacactgctggga

SEQ ID NO: 146066 - DNA, 20 bp, Artificial Sequence
  chemically synthesized
tatctgtacactgctgggaa

SEQ ID NO: 146067 - DNA, 20 bp, Artificial Sequence
  chemically synthesized
gtttcccctccctttcccag

SEQ ID NO: 146068 - DNA, 20 bp, Artificial Sequence
  chemically synthesized
atctgtacactgctgggaaa

SEQ ID NO: 146069 - DNA, 20 bp, Artificial Sequence
  chemically synthesized
ctgtacactgctgggaaagg

SEQ ID NO: 146070 - DNA, 20 bp, Artificial Sequence
  chemically synthesized
aaggtttcccctccctttcc

SEQ ID NO: 146071 - DNA, 20 bp, Artificial Sequence
  chemically synthesized
tgtacactgctgggaaaggg

SEQ ID NO: 146072 - DNA, 20 bp, Artificial Sequence
  chemically synthesized
gtacactgctgggaaaggga

SEQ ID NO: 146073 - DNA, 20 bp, Artificial Sequence
  chemically synthesized
tacactgctgggaaagggag

SEQ ID NO: 146074 - DNA, 20 bp, Artificial Sequence
  chemically synthesized
aaagggaggggaaaccttat

SEQ ID NO: 146075 - DNA, 20 bp, Artificial Sequence
  chemically synthesized
agcagtgagaaagtctgata

SEQ ID NO: 146076 - DNA, 20 bp, Artificial Sequence
  chemically synthesized
gagcagtgagaaagtctgat

SEQ ID NO: 146077 - DNA, 20 bp, Artificial Sequence
  chemically synthesized
caagagatagagcagtgaga

SEQ ID NO: 146078 - DNA, 20 bp, Artificial Sequence
  chemically synthesized
gatgcaagagatagagcagt

SEQ ID NO: 146079 - DNA, 20 bp, Artificial Sequence
  chemically synthesized
gcaagatgcaagagatagag

SEQ ID NO: 146080 - DNA, 20 bp, Artificial Sequence
  chemically synthesized
tgtgcaagatgcaagagata

SEQ ID NO: 146081 - DNA, 20 bp, Artificial Sequence
  chemically synthesized
catgtgcaagatgcaagaga

SEQ ID NO: 146082 - DNA, 20 bp, Artificial Sequence
  chemically synthesized
aggacatgtgcaagatgcaa

SEQ ID NO: 146083 - DNA, 20 bp, Artificial Sequence
  chemically synthesized
ccaggacatgtgcaagatgc

SEQ ID NO: 146084 - DNA, 20 bp, Artificial Sequence
  chemically synthesized
ctatactccaggacatgtgc

SEQ ID NO: 146085 - DNA, 20 bp, Artificial Sequence
  chemically synthesized
cttgcatcttgcacatgtcc

SEQ ID NO: 146086 - DNA, 20 bp, Artificial Sequence
  chemically synthesized
tgcatcttgcacatgtcctg

SEQ ID NO: 146087 - DNA, 20 bp, Artificial Sequence
  chemically synthesized
cttgcacatgtcctggagta

SEQ ID NO: 146088 - DNA, 20 bp, Artificial Sequence
  chemically synthesized
ttgcacatgtcctggagtat

SEQ ID NO: 146089 - DNA, 20 bp, Artificial Sequence
  chemically synthesized
ttgagcacctcctatactcc

SEQ ID NO: 146090 - DNA, 20 bp, Artificial Sequence
  chemically synthesized
attgagcacctcctatactc

SEQ ID NO: 146091 - DNA, 20 bp, Artificial Sequence
  chemically synthesized
gcacatgtcctggagtatag

SEQ ID NO: 146092 - DNA, 20 bp, Artificial Sequence
  chemically synthesized
cacatgtcctggagtatagg

SEQ ID NO: 146093 - DNA, 20 bp, Artificial Sequence
  chemically synthesized
agattcaaagggaatcaatt

SEQ ID NO: 146094 - DNA, 20 bp, Artificial Sequence
  chemically synthesized
gacttttctttagattcaaa

SEQ ID NO: 146095 - DNA, 20 bp, Artificial Sequence
  chemically synthesized
tgacttttctttagattcaa

SEQ ID NO: 146096 - DNA, 20 bp, Artificial Sequence
  chemically synthesized
ttgacttttctttagattca

SEQ ID NO: 146097 - DNA, 20 bp, Artificial Sequence
  chemically synthesized
attgattccctttgaatcta

SEQ ID NO: 146098 - DNA, 20 bp, Artificial Sequence
  chemically synthesized
ttccctttgaatctaaagaa

SEQ ID NO: 146099 - DNA, 20 bp, Artificial Sequence
  chemically synthesized
actgcacattgacttttctt

SEQ ID NO: 146100 - DNA, 20 bp, Artificial Sequence
  chemically synthesized
tctaaagaaaagtcaatgtg

SEQ ID NO: 146101 - DNA, 20 bp, Artificial Sequence
  chemically synthesized
aagaaaagtcaatgtgcagt

SEQ ID NO: 146102 - DNA, 20 bp, Artificial Sequence
  chemically synthesized
tcaatgtgcagtaagctctt

SEQ ID NO: 146103 - DNA, 20 bp, Artificial Sequence
  chemically synthesized
agacctctaagttcactaaa

SEQ ID NO: 146104 - DNA, 20 bp, Artificial Sequence
  chemically synthesized
gaagacctctaagttcacta

SEQ ID NO: 146105 - DNA, 20 bp, Artificial Sequence
  chemically synthesized
agtaagctctttagtgaact

SEQ ID NO: 146106 - DNA, 20 bp, Artificial Sequence
  chemically synthesized
taagctctttagtgaactta

SEQ ID NO: 146107 - DNA, 20 bp, Artificial Sequence
  chemically synthesized
aagctctttagtgaacttag

SEQ ID NO: 146108 - DNA, 20 bp, Artificial Sequence
  chemically synthesized
attgtatgtagaagacctct

SEQ ID NO: 146109 - DNA, 20 bp, Artificial Sequence
  chemically synthesized
ttagtactcattgtatgtag

SEQ ID NO: 146110 - DNA, 20 bp, Artificial Sequence
  chemically synthesized
attttagtactcattgtatg

SEQ ID NO: 146111 - DNA, 20 bp, Artificial Sequence
  chemically synthesized
agaggtcttctacatacaat

SEQ ID NO: 146112 - DNA, 20 bp, Artificial Sequence
  chemically synthesized
aatgggtggctgttaaattt

SEQ ID NO: 146113 - DNA, 20 bp, Artificial Sequence
  chemically synthesized
caatgagtactaaaatttaa

SEQ ID NO: 146114 - DNA, 20 bp, Artificial Sequence
  chemically synthesized
aaaatttaacagccacccat

SEQ ID NO: 146115 - DNA, 20 bp, Artificial Sequence
  chemically synthesized
cattcttccattctaatggg

SEQ ID NO: 146116 - DNA, 20 bp, Artificial Sequence
  chemically synthesized
ttaacagccacccattagaa

SEQ ID NO: 146117 - DNA, 20 bp, Artificial Sequence
  chemically synthesized
ctccattcttccattctaat

SEQ ID NO: 146118 - DNA, 20 bp, Artificial Sequence
  chemically synthesized
cctccattcttccattctaa

SEQ ID NO: 146119 - DNA, 20 bp, Artificial Sequence
  chemically synthesized
acagccacccattagaatgg

SEQ ID NO: 146120 - DNA, 20 bp, Artificial Sequence
  chemically synthesized
cacccattagaatggaagaa

SEQ ID NO: 146121 - DNA, 20 bp, Artificial Sequence
  chemically synthesized
cccattagaatggaagaatg

SEQ ID NO: 146122 - DNA, 20 bp, Artificial Sequence
  chemically synthesized
ccattagaatggaagaatgg

SEQ ID NO: 146123 - DNA, 20 bp, Artificial Sequence
  chemically synthesized
tagaatggaagaatggaggc

SEQ ID NO: 146124 - DNA, 20 bp, Artificial Sequence
  chemically synthesized
cctaggcatgttttgtgttc

SEQ ID NO: 146125 - DNA, 20 bp, Artificial Sequence
  chemically synthesized
gctagaacacaaaacatgcc

SEQ ID NO: 146126 - DNA, 20 bp, Artificial Sequence
  chemically synthesized
ctagaacacaaaacatgcct

SEQ ID NO: 146127 - DNA, 20 bp, Artificial Sequence
  chemically synthesized
cacctaactagtaaaaacct

SEQ ID NO: 146128 - DNA, 20 bp, Artificial Sequence
  chemically synthesized
tcacctaactagtaaaaacc

SEQ ID NO: 146129 - DNA, 20 bp, Artificial Sequence
  chemically synthesized
aaacatgcctaggtttttac

SEQ ID NO: 146130 - DNA, 20 bp, Artificial Sequence
  chemically synthesized
atgcctaggtttttactagt

SEQ ID NO: 146131 - DNA, 20 bp, Artificial Sequence
  chemically synthesized
tgcctaggtttttactagtt

SEQ ID NO: 146132 - DNA, 20 bp, Artificial Sequence
  chemically synthesized
aatagctaaaatcacctaac

SEQ ID NO: 146133 - DNA, 20 bp, Artificial Sequence
  chemically synthesized
ttttactagttaggtgattt

SEQ ID NO: 146134 - DNA, 20 bp, Artificial Sequence
  chemically synthesized
gtgattttagctattttcac

SEQ ID NO: 146135 - DNA, 20 bp, Artificial Sequence
  chemically synthesized
ccattatcttctcgtgaaaa

SEQ ID NO: 146136 - DNA, 20 bp, Artificial Sequence
  chemically synthesized
attttagctattttcacgag

SEQ ID NO: 146137 - DNA, 20 bp, Artificial Sequence
  chemically synthesized
ctattttcacgagaagataa

SEQ ID NO: 146138 - DNA, 20 bp, Artificial Sequence
  chemically synthesized
attttcacgagaagataatg

SEQ ID NO: 146139 - DNA, 20 bp, Artificial Sequence
  chemically synthesized
ttttcacgagaagataatgg

SEQ ID NO: 146140 - DNA, 20 bp, Artificial Sequence
  chemically synthesized
tcacgagaagataatggagg

SEQ ID NO: 146141 - DNA, 20 bp, Artificial Sequence
  chemically synthesized
atggaggaagacccactgct

SEQ ID NO: 146142 - DNA, 20 bp, Artificial Sequence
  chemically synthesized
cattgtctgctccaagcagt

SEQ ID NO: 146143 - DNA, 20 bp, Artificial Sequence
  chemically synthesized
ggaggaagacccactgcttg

SEQ ID NO: 146144 - DNA, 20 bp, Artificial Sequence
  chemically synthesized
tcattgtctgctccaagcag

SEQ ID NO: 146145 - DNA, 20 bp, Artificial Sequence
  chemically synthesized
ggaagacccactgcttggag

SEQ ID NO: 146146 - DNA, 20 bp, Artificial Sequence
  chemically synthesized
ctttcattgtctgctccaag

SEQ ID NO: 146147 - DNA, 20 bp, Artificial Sequence
  chemically synthesized
gatctttcattgtctgctcc

SEQ ID NO: 146148 - DNA, 20 bp, Artificial Sequence
  chemically synthesized
ctgcttggagcagacaatga

SEQ ID NO: 146149 - DNA, 20 bp, Artificial Sequence
  chemically synthesized
caatgaaagatcaaatatta

SEQ ID NO: 146150 - DNA, 20 bp, Artificial Sequence
  chemically synthesized
atgaaagatcaaatattaaa

SEQ ID NO: 146151 - DNA, 20 bp, Artificial Sequence
  chemically synthesized
gaaagatcaaatattaaaga

SEQ ID NO: 146152 - DNA, 20 bp, Artificial Sequence
  chemically synthesized
aatattaaagagagaaaata

SEQ ID NO: 146153 - DNA, 20 bp, Artificial Sequence
  chemically synthesized
ttaaagagagaaaatacagc

SEQ ID NO: 146154 - DNA, 20 bp, Artificial Sequence
  chemically synthesized
ttgggggcaaataaattgac

SEQ ID NO: 146155 - DNA, 20 bp, Artificial Sequence
  chemically synthesized
atgtatgtgtgtggggttgg

SEQ ID NO: 146156 - DNA, 20 bp, Artificial Sequence
  chemically synthesized
aatgtatgtgtgtggggttg

SEQ ID NO: 146157 - DNA, 20 bp, Artificial Sequence
  chemically synthesized
aaatgtatgtgtgtggggtt

SEQ ID NO: 146158 - DNA, 20 bp, Artificial Sequence
  chemically synthesized
aaaatgtatgtgtgtggggt

SEQ ID NO: 146159 - DNA, 20 bp, Artificial Sequence
  chemically synthesized
aaaaaaaatgtatgtgtgtg

SEQ ID NO: 146160 - DNA, 20 bp, Artificial Sequence
  chemically synthesized
gaaaaaaaatgtatgtgtgt

SEQ ID NO: 146161 - DNA, 20 bp, Artificial Sequence
  chemically synthesized
ggaaaaaaaatgtatgtgtg

SEQ ID NO: 146162 - DNA, 20 bp, Artificial Sequence
  chemically synthesized
atacattttttttcctatcg

SEQ ID NO: 146163 - DNA, 20 bp, Artificial Sequence
  chemically synthesized
tacattttttttcctatcga

SEQ ID NO: 146164 - DNA, 20 bp, Artificial Sequence
  chemically synthesized
acattttttttcctatcgaa

SEQ ID NO: 146165 - DNA, 20 bp, Artificial Sequence
  chemically synthesized
cctgcttttctcccttcgat

SEQ ID NO: 146166 - DNA, 20 bp, Artificial Sequence
  chemically synthesized
attttttttcctatcgaagg

SEQ ID NO: 146167 - DNA, 20 bp, Artificial Sequence
  chemically synthesized
tcctgcttttctcccttcga

SEQ ID NO: 146168 - DNA, 20 bp, Artificial Sequence
  chemically synthesized
ttttcctatcgaagggagaa

SEQ ID NO: 146169 - DNA, 20 bp, Artificial Sequence
  chemically synthesized
tcctatcgaagggagaaaag

SEQ ID NO: 146170 - DNA, 20 bp, Artificial Sequence
  chemically synthesized
cctatcgaagggagaaaagc

SEQ ID NO: 146171 - DNA, 20 bp, Artificial Sequence
  chemically synthesized
gaagggagaaaagcaggaaa

SEQ ID NO: 146172 - DNA, 20 bp, Artificial Sequence
  chemically synthesized
agcaggaaatagctctgaat

SEQ ID NO: 146173 - DNA, 20 bp, Artificial Sequence
  chemically synthesized
acaccctgctttctgattca

SEQ ID NO: 146174 - DNA, 20 bp, Artificial Sequence
  chemically synthesized
ggaaatagctctgaatcaga

SEQ ID NO: 146175 - DNA, 20 bp, Artificial Sequence
  chemically synthesized
ctacaccctgctttctgatt

SEQ ID NO: 146176 - DNA, 20 bp, Artificial Sequence
  chemically synthesized
aatagctctgaatcagaaag

SEQ ID NO: 146177 - DNA, 20 bp, Artificial Sequence
  chemically synthesized
atagctctgaatcagaaagc

SEQ ID NO: 146178 - DNA, 20 bp, Artificial Sequence
  chemically synthesized
tagctctgaatcagaaagca

SEQ ID NO: 146179 - DNA, 20 bp, Artificial Sequence
  chemically synthesized
ctgaatcagaaagcagggtg

SEQ ID NO: 146180 - DNA, 20 bp, Artificial Sequence
  chemically synthesized
aaagcagggtgtagaatatt

SEQ ID NO: 146181 - DNA, 20 bp, Artificial Sequence
  chemically synthesized
aagcagggtgtagaatattt

SEQ ID NO: 146182 - DNA, 20 bp, Artificial Sequence
  chemically synthesized
tgtagaatatttaggctttc

SEQ ID NO: 146183 - DNA, 20 bp, Artificial Sequence
  chemically synthesized
gtagaatatttaggctttct

SEQ ID NO: 146184 - DNA, 20 bp, Artificial Sequence
  chemically synthesized
tacaacaatctggtcctaga

SEQ ID NO: 146185 - DNA, 20 bp, Artificial Sequence
  chemically synthesized
atatttaggctttctaggac

SEQ ID NO: 146186 - DNA, 20 bp, Artificial Sequence
  chemically synthesized
caaatacaacaatctggtcc

SEQ ID NO: 146187 - DNA, 20 bp, Artificial Sequence
  chemically synthesized
aggattcaaatacaacaatc

SEQ ID NO: 146188 - DNA, 20 bp, Artificial Sequence
  chemically synthesized
aaaaaaaaaattatagagca

SEQ ID NO: 146189 - DNA, 20 bp, Artificial Sequence
  chemically synthesized
aaaaaaaaaaattatagagc

SEQ ID NO: 146190 - DNA, 20 bp, Artificial Sequence
  chemically synthesized
taaaaaaaaaaaaaattata

SEQ ID NO: 146191 - DNA, 20 bp, Artificial Sequence
  chemically synthesized
gctaaaaaaaaaaaaaatta

SEQ ID NO: 146192 - DNA, 20 bp, Artificial Sequence
  chemically synthesized
tctataattttttttttttt

SEQ ID NO: 146193 - DNA, 20 bp, Artificial Sequence
  chemically synthesized
gtcatctgactatagttaca

SEQ ID NO: 146194 - DNA, 20 bp, Artificial Sequence
  chemically synthesized
tttttttagctgtgtaacta

SEQ ID NO: 146195 - DNA, 20 bp, Artificial Sequence
  chemically synthesized
tttagctgtgtaactatagt

SEQ ID NO: 146196 - DNA, 20 bp, Artificial Sequence
  chemically synthesized
gaggttaagtcatctgacta

SEQ ID NO: 146197 - DNA, 20 bp, Artificial Sequence
  chemically synthesized
aatggagattcagagaggtt

SEQ ID NO: 146198 - DNA, 20 bp, Artificial Sequence
  chemically synthesized
gagtaaatggagattcagag

SEQ ID NO: 146199 - DNA, 20 bp, Artificial Sequence
  chemically synthesized
ggagtaaatggagattcaga

SEQ ID NO: 146200 - DNA, 20 bp, Artificial Sequence
  chemically synthesized
gaggagtaaatggagattca

SEQ ID NO: 146201 - DNA, 20 bp, Artificial Sequence
  chemically synthesized
cagaggagtaaatggagatt

SEQ ID NO: 146202 - DNA, 20 bp, Artificial Sequence
  chemically synthesized
actttacagaggagtaaatg

SEQ ID NO: 146203 - DNA, 20 bp, Artificial Sequence
  chemically synthesized
ccactttacagaggagtaaa

SEQ ID NO: 146204 - DNA, 20 bp, Artificial Sequence
  chemically synthesized
tctccatttactcctctgta

SEQ ID NO: 146205 - DNA, 20 bp, Artificial Sequence
  chemically synthesized
ataatcgccactttacagag

SEQ ID NO: 146206 - DNA, 20 bp, Artificial Sequence
  chemically synthesized
ttataatcgccactttacag

SEQ ID NO: 146207 - DNA, 20 bp, Artificial Sequence
  chemically synthesized
ccatttactcctctgtaaag

SEQ ID NO: 146208 - DNA, 20 bp, Artificial Sequence
  chemically synthesized
attataatcgccactttaca

SEQ ID NO: 146209 - DNA, 20 bp, Artificial Sequence
  chemically synthesized
ctattataatcgccacttta

SEQ ID NO: 146210 - DNA, 20 bp, Artificial Sequence
  chemically synthesized
ctgtaaagtggcgattataa

SEQ ID NO: 146211 - DNA, 20 bp, Artificial Sequence
  chemically synthesized
ttataatagtacttccttca

SEQ ID NO: 146212 - DNA, 20 bp, Artificial Sequence
  chemically synthesized
aggccagttgtctatgaagg

SEQ ID NO: 146213 - DNA, 20 bp, Artificial Sequence
  chemically synthesized
gtaaggccagttgtctatga

SEQ ID NO: 146214 - DNA, 20 bp, Artificial Sequence
  chemically synthesized
agtaaggccagttgtctatg

SEQ ID NO: 146215 - DNA, 20 bp, Artificial Sequence
  chemically synthesized
gtacttccttcatagacaac

SEQ ID NO: 146216 - DNA, 20 bp, Artificial Sequence
  chemically synthesized
tatttaggaaaaagtaaggc

SEQ ID NO: 146217 - DNA, 20 bp, Artificial Sequence
  chemically synthesized
tgtctatttaggaaaaagta

SEQ ID NO: 146218 - DNA, 20 bp, Artificial Sequence
  chemically synthesized
ttgtctatttaggaaaaagt

SEQ ID NO: 146219 - DNA, 20 bp, Artificial Sequence
  chemically synthesized
aagattgtctatttaggaaa

SEQ ID NO: 146220 - DNA, 20 bp, Artificial Sequence
  chemically synthesized
tggccttactttttcctaaa

SEQ ID NO: 146221 - DNA, 20 bp, Artificial Sequence
  chemically synthesized
ttttccaagattgtctattt

SEQ ID NO: 146222 - DNA, 20 bp, Artificial Sequence
  chemically synthesized
cttttccaagattgtctatt

SEQ ID NO: 146223 - DNA, 20 bp, Artificial Sequence
  chemically synthesized
ttttcctaaatagacaatct

SEQ ID NO: 146224 - DNA, 20 bp, Artificial Sequence
  chemically synthesized
ctaaatagacaatcttggaa

SEQ ID NO: 146225 - DNA, 20 bp, Artificial Sequence
  chemically synthesized
tcagtgaacattacttttcc

SEQ ID NO: 146226 - DNA, 20 bp, Artificial Sequence
  chemically synthesized
aaagtaatgttcactgacat

SEQ ID NO: 146227 - DNA, 20 bp, Artificial Sequence
  chemically synthesized
agtaatgttcactgacattg

SEQ ID NO: 146228 - DNA, 20 bp, Artificial Sequence
  chemically synthesized
gtaatgttcactgacattgg

SEQ ID NO: 146229 - DNA, 20 bp, Artificial Sequence
  chemically synthesized
cctcaagatgcctccaatgt

SEQ ID NO: 146230 - DNA, 20 bp, Artificial Sequence
  chemically synthesized
actgacattggaggcatctt

SEQ ID NO: 146231 - DNA, 20 bp, Artificial Sequence
  chemically synthesized
ctgacattggaggcatcttg

SEQ ID NO: 146232 - DNA, 20 bp, Artificial Sequence
  chemically synthesized
cattggaggcatcttgaggt

SEQ ID NO: 146233 - DNA, 20 bp, Artificial Sequence
  chemically synthesized
attggaggcatcttgaggta

SEQ ID NO: 146234 - DNA, 20 bp, Artificial Sequence
  chemically synthesized
atagtataattccttacctc

SEQ ID NO: 146235 - DNA, 20 bp, Artificial Sequence
  chemically synthesized
gatgttcattgtagcaggca

SEQ ID NO: 146236 - DNA, 20 bp, Artificial Sequence
  chemically synthesized
gtcaagatgttcattgtagc

SEQ ID NO: 146237 - DNA, 20 bp, Artificial Sequence
  chemically synthesized
ggtcaagatgttcattgtag

SEQ ID NO: 146238 - DNA, 20 bp, Artificial Sequence
  chemically synthesized
gagggtcaagatgttcattg

SEQ ID NO: 146239 - DNA, 20 bp, Artificial Sequence
  chemically synthesized
ggtgaaaacttttgagggtc

SEQ ID NO: 146240 - DNA, 20 bp, Artificial Sequence
  chemically synthesized
atgaacatcttgaccctcaa

SEQ ID NO: 146241 - DNA, 20 bp, Artificial Sequence
  chemically synthesized
acacaggtgaaaacttttga

SEQ ID NO: 146242 - DNA, 20 bp, Artificial Sequence
  chemically synthesized
tacacaggtgaaaacttttg

SEQ ID NO: 146243 - DNA, 20 bp, Artificial Sequence
  chemically synthesized
ttacacaggtgaaaactttt

SEQ ID NO: 146244 - DNA, 20 bp, Artificial Sequence
  chemically synthesized
tactgttttcatagttacac

SEQ ID NO: 146245 - DNA, 20 bp, Artificial Sequence
  chemically synthesized
gtactgttttcatagttaca

SEQ ID NO: 146246 - DNA, 20 bp, Artificial Sequence
  chemically synthesized
cacctgtgtaactatgaaaa

SEQ ID NO: 146247 - DNA, 20 bp, Artificial Sequence
  chemically synthesized
ttagattggtactgttttca

SEQ ID NO: 146248 - DNA, 20 bp, Artificial Sequence
  chemically synthesized
tgaaaacagtaccaatctaa

SEQ ID NO: 146249 - DNA, 20 bp, Artificial Sequence
  chemically synthesized
gtaacacaattccattagat

SEQ ID NO: 146250 - DNA, 20 bp, Artificial Sequence
  chemically synthesized
aatccgtaacacaattccat

SEQ ID NO: 146251 - DNA, 20 bp, Artificial Sequence
  chemically synthesized
aatctaatggaattgtgtta

SEQ ID NO: 146252 - DNA, 20 bp, Artificial Sequence
  chemically synthesized
ttttatgacatcatacatgt

SEQ ID NO: 146253 - DNA, 20 bp, Artificial Sequence
  chemically synthesized
catacatgtaagtcacctcc

SEQ ID NO: 146254 - DNA, 20 bp, Artificial Sequence
  chemically synthesized
atacatgtaagtcacctcct

SEQ ID NO: 146255 - DNA, 20 bp, Artificial Sequence
  chemically synthesized
acagtcagaacaatcctagg

SEQ ID NO: 146256 - DNA, 20 bp, Artificial Sequence
  chemically synthesized
tacagtcagaacaatcctag

SEQ ID NO: 146257 - DNA, 20 bp, Artificial Sequence
  chemically synthesized
cttacagtcagaacaatcct

SEQ ID NO: 146258 - DNA, 20 bp, Artificial Sequence
  chemically synthesized
acttacagtcagaacaatcc

SEQ ID NO: 146259 - DNA, 20 bp, Artificial Sequence
  chemically synthesized
cctaggattgttctgactgt

SEQ ID NO: 146260 - DNA, 20 bp, Artificial Sequence
  chemically synthesized
ccacatagtgtacttacagt

SEQ ID NO: 146261 - DNA, 20 bp, Artificial Sequence
  chemically synthesized
aaatccacatagtgtactta

SEQ ID NO: 146262 - DNA, 20 bp, Artificial Sequence
  chemically synthesized
ctgactgtaagtacactatg

SEQ ID NO: 146263 - DNA, 20 bp, Artificial Sequence
  chemically synthesized
gaggaagaaaaaaatccaca

SEQ ID NO: 146264 - DNA, 20 bp, Artificial Sequence
  chemically synthesized
agaaatgcaggaaaaagagg

SEQ ID NO: 146265 - DNA, 20 bp, Artificial Sequence
  chemically synthesized
gtgagaaatgcaggaaaaag

SEQ ID NO: 146266 - DNA, 20 bp, Artificial Sequence
  chemically synthesized
tgtgagaaatgcaggaaaaa

SEQ ID NO: 146267 - DNA, 20 bp, Artificial Sequence
  chemically synthesized
tgtgtgagaaatgcaggaaa

SEQ ID NO: 146268 - DNA, 20 bp, Artificial Sequence
  chemically synthesized
aaccattgtgtgagaaatgc

SEQ ID NO: 146269 - DNA, 20 bp, Artificial Sequence
  chemically synthesized
taaccattgtgtgagaaatg

SEQ ID NO: 146270 - DNA, 20 bp, Artificial Sequence
  chemically synthesized
ttcctgcatttctcacacaa

SEQ ID NO: 146271 - DNA, 20 bp, Artificial Sequence
  chemically synthesized
ggagccaataaccattgtgt

SEQ ID NO: 146272 - DNA, 20 bp, Artificial Sequence
  chemically synthesized
atttctcacacaatggttat

SEQ ID NO: 146273 - DNA, 20 bp, Artificial Sequence
  chemically synthesized
atacgaatgtagaacatgag

SEQ ID NO: 146274 - DNA, 20 bp, Artificial Sequence
  chemically synthesized
ccatacgaatgtagaacatg

SEQ ID NO: 146275 - DNA, 20 bp, Artificial Sequence
  chemically synthesized
cccatacgaatgtagaacat

SEQ ID NO: 146276 - DNA, 20 bp, Artificial Sequence
  chemically synthesized
cataaaatcccatacgaatg

SEQ ID NO: 146277 - DNA, 20 bp, Artificial Sequence
  chemically synthesized
cctcatgttctacattcgta

SEQ ID NO: 146278 - DNA, 20 bp, Artificial Sequence
  chemically synthesized
ctcatgttctacattcgtat

SEQ ID NO: 146279 - DNA, 20 bp, Artificial Sequence
  chemically synthesized
caaatctggttcagagtaca

SEQ ID NO: 146280 - DNA, 20 bp, Artificial Sequence
  chemically synthesized
gtcaaatctggttcagagta

SEQ ID NO: 146281 - DNA, 20 bp, Artificial Sequence
  chemically synthesized
ttatgctctgtactctgaac

SEQ ID NO: 146282 - DNA, 20 bp, Artificial Sequence
  chemically synthesized
ggagggtcaaatctggttca

SEQ ID NO: 146283 - DNA, 20 bp, Artificial Sequence
  chemically synthesized
ctggagggtcaaatctggtt

SEQ ID NO: 146284 - DNA, 20 bp, Artificial Sequence
  chemically synthesized
taagtctggagggtcaaatc

SEQ ID NO: 146285 - DNA, 20 bp, Artificial Sequence
  chemically synthesized
ctgaaccagatttgaccctc

SEQ ID NO: 146286 - DNA, 20 bp, Artificial Sequence
  chemically synthesized
tggagagaggtaagtctgga

SEQ ID NO: 146287 - DNA, 20 bp, Artificial Sequence
  chemically synthesized
atggagagaggtaagtctgg

SEQ ID NO: 146288 - DNA, 20 bp, Artificial Sequence
  chemically synthesized
aatggagagaggtaagtctg

SEQ ID NO: 146289 - DNA, 20 bp, Artificial Sequence
  chemically synthesized
agaatggagagaggtaagtc

SEQ ID NO: 146290 - DNA, 20 bp, Artificial Sequence
  chemically synthesized
tggaaagaatggagagaggt

SEQ ID NO: 146291 - DNA, 20 bp, Artificial Sequence
  chemically synthesized
agcctggaaagaatggagag

SEQ ID NO: 146292 - DNA, 20 bp, Artificial Sequence
  chemically synthesized
gagcctggaaagaatggaga

SEQ ID NO: 146293 - DNA, 20 bp, Artificial Sequence
  chemically synthesized
aggagcctggaaagaatgga

SEQ ID NO: 146294 - DNA, 20 bp, Artificial Sequence
  chemically synthesized
ggaggagcctggaaagaatg

SEQ ID NO: 146295 - DNA, 20 bp, Artificial Sequence
  chemically synthesized
ttacctctctccattctttc

SEQ ID NO: 146296 - DNA, 20 bp, Artificial Sequence
  chemically synthesized
gtggaggagcctggaaagaa

SEQ ID NO: 146297 - DNA, 20 bp, Artificial Sequence
  chemically synthesized
tacctctctccattctttcc

SEQ ID NO: 146298 - DNA, 20 bp, Artificial Sequence
  chemically synthesized
tgggtgtggaggagcctgga

SEQ ID NO: 146299 - DNA, 20 bp, Artificial Sequence
  chemically synthesized
gacatgggtgtggaggagcc

SEQ ID NO: 146300 - DNA, 20 bp, Artificial Sequence
  chemically synthesized
caatagacatgggtgtggag

SEQ ID NO: 146301 - DNA, 20 bp, Artificial Sequence
  chemically synthesized
cacaatagacatgggtgtgg

SEQ ID NO: 146302 - DNA, 20 bp, Artificial Sequence
  chemically synthesized
gcacaatagacatgggtgtg

SEQ ID NO: 146303 - DNA, 20 bp, Artificial Sequence
  chemically synthesized
atgcacaatagacatgggtg

SEQ ID NO: 146304 - DNA, 20 bp, Artificial Sequence
  chemically synthesized
agagaatgcacaatagacat

SEQ ID NO: 146305 - DNA, 20 bp, Artificial Sequence
  chemically synthesized
gagagaatgcacaatagaca

SEQ ID NO: 146306 - DNA, 20 bp, Artificial Sequence
  chemically synthesized
gctcatgagagaatgcacaa

SEQ ID NO: 146307 - DNA, 20 bp, Artificial Sequence
  chemically synthesized
tctattgtgcattctctcat

SEQ ID NO: 146308 - DNA, 20 bp, Artificial Sequence
  chemically synthesized
gaaatggcctgtgctcatga

SEQ ID NO: 146309 - DNA, 20 bp, Artificial Sequence
  chemically synthesized
tgtgcattctctcatgagca

SEQ ID NO: 146310 - DNA, 20 bp, Artificial Sequence
  chemically synthesized
ttgaaatggcctgtgctcat

SEQ ID NO: 146311 - DNA, 20 bp, Artificial Sequence
  chemically synthesized
gtgcattctctcatgagcac

SEQ ID NO: 146312 - DNA, 20 bp, Artificial Sequence
  chemically synthesized
gaaaggacacaggtttgaaa

SEQ ID NO: 146313 - DNA, 20 bp, Artificial Sequence
  chemically synthesized
gaaagcgtatgaaaggacac

SEQ ID NO: 146314 - DNA, 20 bp, Artificial Sequence
  chemically synthesized
agaaagcgtatgaaaggaca

SEQ ID NO: 146315 - DNA, 20 bp, Artificial Sequence
  chemically synthesized
aagtatagaaagcgtatgaa

SEQ ID NO: 146316 - DNA, 20 bp, Artificial Sequence
  chemically synthesized
gaagtatagaaagcgtatga

SEQ ID NO: 146317 - DNA, 20 bp, Artificial Sequence
  chemically synthesized
aagttttcaagaagtataga

SEQ ID NO: 146318 - DNA, 20 bp, Artificial Sequence
  chemically synthesized
gaaaaagttttcaagaagta

SEQ ID NO: 146319 - DNA, 20 bp, Artificial Sequence
  chemically synthesized
ggagagaaaaagttttcaag

SEQ ID NO: 146320 - DNA, 20 bp, Artificial Sequence
  chemically synthesized
acaggagagaaaaagttttc

SEQ ID NO: 146321 - DNA, 20 bp, Artificial Sequence
  chemically synthesized
gtctggaaacaggagagaaa

SEQ ID NO: 146322 - DNA, 20 bp, Artificial Sequence
  chemically synthesized
atttttgtctggaaacagga

SEQ ID NO: 146323 - DNA, 20 bp, Artificial Sequence
  chemically synthesized
aactttttctctcctgtttc

SEQ ID NO: 146324 - DNA, 20 bp, Artificial Sequence
  chemically synthesized
agatttttgtctggaaacag

SEQ ID NO: 146325 - DNA, 20 bp, Artificial Sequence
  chemically synthesized
tgagatttttgtctggaaac

SEQ ID NO: 146326 - DNA, 20 bp, Artificial Sequence
  chemically synthesized
atgagatttttgtctggaaa

SEQ ID NO: 146327 - DNA, 20 bp, Artificial Sequence
  chemically synthesized
gagaaaatgagatttttgtc

SEQ ID NO: 146328 - DNA, 20 bp, Artificial Sequence
  chemically synthesized
ttgacatttaaagagaaaat

SEQ ID NO: 146329 - DNA, 20 bp, Artificial Sequence
  chemically synthesized
atctagagttgacatttaaa

SEQ ID NO: 146330 - DNA, 20 bp, Artificial Sequence
  chemically synthesized
aaatctagagttgacattta

SEQ ID NO: 146331 - DNA, 20 bp, Artificial Sequence
  chemically synthesized
ttctctttaaatgtcaactc

SEQ ID NO: 146332 - DNA, 20 bp, Artificial Sequence
  chemically synthesized
ccccaaaacacagaaatcta

SEQ ID NO: 146333 - DNA, 20 bp, Artificial Sequence
  chemically synthesized
ctccccaaaacacagaaatc

SEQ ID NO: 146334 - DNA, 20 bp, Artificial Sequence
  chemically synthesized
aactctagatttctgtgttt

SEQ ID NO: 146335 - DNA, 20 bp, Artificial Sequence
  chemically synthesized
actctagatttctgtgtttt

SEQ ID NO: 146336 - DNA, 20 bp, Artificial Sequence
  chemically synthesized
ctctagatttctgtgttttg

SEQ ID NO: 146337 - DNA, 20 bp, Artificial Sequence
  chemically synthesized
ttctggtcctccccaaaaca

SEQ ID NO: 146338 - DNA, 20 bp, Artificial Sequence
  chemically synthesized
ctagatttctgtgttttggg

SEQ ID NO: 146339 - DNA, 20 bp, Artificial Sequence
  chemically synthesized
tagatttctgtgttttgggg

SEQ ID NO: 146340 - DNA, 20 bp, Artificial Sequence
  chemically synthesized
ttctgtgttttggggaggac

SEQ ID NO: 146341 - DNA, 20 bp, Artificial Sequence
  chemically synthesized
gttttggggaggaccagaat

SEQ ID NO: 146342 - DNA, 20 bp, Artificial Sequence
  chemically synthesized
ttggggaggaccagaataag

SEQ ID NO: 146343 - DNA, 20 bp, Artificial Sequence
  chemically synthesized
tagttacacacttcttattc

SEQ ID NO: 146344 - DNA, 20 bp, Artificial Sequence
  chemically synthesized
tgttcctcatggagatattt

SEQ ID NO: 146345 - DNA, 20 bp, Artificial Sequence
  chemically synthesized
tgtaactaaaatatctccat

SEQ ID NO: 146346 - DNA, 20 bp, Artificial Sequence
  chemically synthesized
gtaactaaaatatctccatg

SEQ ID NO: 146347 - DNA, 20 bp, Artificial Sequence
  chemically synthesized
gtgtaattctgttcctcatg

SEQ ID NO: 146348 - DNA, 20 bp, Artificial Sequence
  chemically synthesized
taaaatatctccatgaggaa

SEQ ID NO: 146349 - DNA, 20 bp, Artificial Sequence
  chemically synthesized
aggtgtaattctgttcctca

SEQ ID NO: 146350 - DNA, 20 bp, Artificial Sequence
  chemically synthesized
acagaattacacctttcttg

SEQ ID NO: 146351 - DNA, 20 bp, Artificial Sequence
  chemically synthesized
cagaattacacctttcttgt

SEQ ID NO: 146352 - DNA, 20 bp, Artificial Sequence
  chemically synthesized
gtgtttaggacccacaagaa

SEQ ID NO: 146353 - DNA, 20 bp, Artificial Sequence
  chemically synthesized
agtgtttaggacccacaaga

SEQ ID NO: 146354 - DNA, 20 bp, Artificial Sequence
  chemically synthesized
aaaaagtgtttaggacccac

SEQ ID NO: 146355 - DNA, 20 bp, Artificial Sequence
  chemically synthesized
ttaaagactaaaaagtgttt

SEQ ID NO: 146356 - DNA, 20 bp, Artificial Sequence
  chemically synthesized
gttaaagactaaaaagtgtt

SEQ ID NO: 146357 - DNA, 20 bp, Artificial Sequence
  chemically synthesized
tgtgggtcctaaacactttt

SEQ ID NO: 146358 - DNA, 20 bp, Artificial Sequence
  chemically synthesized
agaaaacgttaaagactaaa

SEQ ID NO: 146359 - DNA, 20 bp, Artificial Sequence
  chemically synthesized
atttaagtaagaaaacgtta

SEQ ID NO: 146360 - DNA, 20 bp, Artificial Sequence
  chemically synthesized
agtgataactagatttaagt

SEQ ID NO: 146361 - DNA, 20 bp, Artificial Sequence
  chemically synthesized
aacgttttcttacttaaatc

SEQ ID NO: 146362 - DNA, 20 bp, Artificial Sequence
  chemically synthesized
tcctagtgataactagattt

SEQ ID NO: 146363 - DNA, 20 bp, Artificial Sequence
  chemically synthesized
ttgtccttcctagtgataac

SEQ ID NO: 146364 - DNA, 20 bp, Artificial Sequence
  chemically synthesized
tacttaaatctagttatcac

SEQ ID NO: 146365 - DNA, 20 bp, Artificial Sequence
  chemically synthesized
acttaaatctagttatcact

SEQ ID NO: 146366 - DNA, 20 bp, Artificial Sequence
  chemically synthesized
taaatctagttatcactagg

SEQ ID NO: 146367 - DNA, 20 bp, Artificial Sequence
  chemically synthesized
aaatctagttatcactagga

SEQ ID NO: 146368 - DNA, 20 bp, Artificial Sequence
  chemically synthesized
gtgcaagattttgtccttcc

SEQ ID NO: 146369 - DNA, 20 bp, Artificial Sequence
  chemically synthesized
ccaaaacctaatagtggtgc

SEQ ID NO: 146370 - DNA, 20 bp, Artificial Sequence
  chemically synthesized
acaaaatcttgcaccactat

SEQ ID NO: 146371 - DNA, 20 bp, Artificial Sequence
  chemically synthesized
caaaatcttgcaccactatt

SEQ ID NO: 146372 - DNA, 20 bp, Artificial Sequence
  chemically synthesized
aatcctccaaaacctaatag

SEQ ID NO: 146373 - DNA, 20 bp, Artificial Sequence
  chemically synthesized
caaaatcctccaaaacctaa

SEQ ID NO: 146374 - DNA, 20 bp, Artificial Sequence
  chemically synthesized
cttgcaccactattaggttt

SEQ ID NO: 146375 - DNA, 20 bp, Artificial Sequence
  chemically synthesized
tgcaccactattaggttttg

SEQ ID NO: 146376 - DNA, 20 bp, Artificial Sequence
  chemically synthesized
gcaccactattaggttttgg

SEQ ID NO: 146377 - DNA, 20 bp, Artificial Sequence
  chemically synthesized
taggttttggaggattttga

SEQ ID NO: 146378 - DNA, 20 bp, Artificial Sequence
  chemically synthesized
tggaggattttgaaagtgtc

SEQ ID NO: 146379 - DNA, 20 bp, Artificial Sequence
  chemically synthesized
gaggattttgaaagtgtcta

SEQ ID NO: 146380 - DNA, 20 bp, Artificial Sequence
  chemically synthesized
aggattttgaaagtgtctag

SEQ ID NO: 146381 - DNA, 20 bp, Artificial Sequence
  chemically synthesized
ttttgaaagtgtctagagga

SEQ ID NO: 146382 - DNA, 20 bp, Artificial Sequence
  chemically synthesized
aactactatcagctatcctc

SEQ ID NO: 146383 - DNA, 20 bp, Artificial Sequence
  chemically synthesized
agtgtctagaggatagctga

SEQ ID NO: 146384 - DNA, 20 bp, Artificial Sequence
  chemically synthesized
gtctagaggatagctgatag

SEQ ID NO: 146385 - DNA, 20 bp, Artificial Sequence
  chemically synthesized
atccaactctcaactactat

SEQ ID NO: 146386 - DNA, 20 bp, Artificial Sequence
  chemically synthesized
gaggatagctgatagtagtt

SEQ ID NO: 146387 - DNA, 20 bp, Artificial Sequence
  chemically synthesized
ggatagctgatagtagttga

SEQ ID NO: 146388 - DNA, 20 bp, Artificial Sequence
  chemically synthesized
agctgatagtagttgagagt

SEQ ID NO: 146389 - DNA, 20 bp, Artificial Sequence
  chemically synthesized
tagttgagagttggattcta

SEQ ID NO: 146390 - DNA, 20 bp, Artificial Sequence
  chemically synthesized
tgagagttggattctaaagt

SEQ ID NO: 146391 - DNA, 20 bp, Artificial Sequence
  chemically synthesized
agacccaaagtttctgactt

SEQ ID NO: 146392 - DNA, 20 bp, Artificial Sequence
  chemically synthesized
gattctaaagtcagaaactt

SEQ ID NO: 146393 - DNA, 20 bp, Artificial Sequence
  chemically synthesized
attctaaagtcagaaacttt

SEQ ID NO: 146394 - DNA, 20 bp, Artificial Sequence
  chemically synthesized
agtatattccttgagaccca

SEQ ID NO: 146395 - DNA, 20 bp, Artificial Sequence
  chemically synthesized
agtcagaaactttgggtctc

SEQ ID NO: 146396 - DNA, 20 bp, Artificial Sequence
  chemically synthesized
gtcagaaactttgggtctca

SEQ ID NO: 146397 - DNA, 20 bp, Artificial Sequence
  chemically synthesized
tgttttaaagtatattcctt

SEQ ID NO: 146398 - DNA, 20 bp, Artificial Sequence
  chemically synthesized
tcttgcttctttatgtttta

SEQ ID NO: 146399 - DNA, 20 bp, Artificial Sequence
  chemically synthesized
ggaatatactttaaaacata

SEQ ID NO: 146400 - DNA, 20 bp, Artificial Sequence
  chemically synthesized
atatactttaaaacataaag

SEQ ID NO: 146401 - DNA, 20 bp, Artificial Sequence
  chemically synthesized
actttaaaacataaagaagc

SEQ ID NO: 146402 - DNA, 20 bp, Artificial Sequence
  chemically synthesized
tttaaaacataaagaagcaa

SEQ ID NO: 146403 - DNA, 20 bp, Artificial Sequence
  chemically synthesized
ttaaaacataaagaagcaag

SEQ ID NO: 146404 - DNA, 20 bp, Artificial Sequence
  chemically synthesized
tgtgagaggtcgatgaagat

SEQ ID NO: 146405 - DNA, 20 bp, Artificial Sequence
  chemically synthesized
tctaatgtgagaggtcgatg

SEQ ID NO: 146406 - DNA, 20 bp, Artificial Sequence
  chemically synthesized
tcttcatcgacctctcacat

SEQ ID NO: 146407 - DNA, 20 bp, Artificial Sequence
  chemically synthesized
agaaatggctctaatgtgag

SEQ ID NO: 146408 - DNA, 20 bp, Artificial Sequence
  chemically synthesized
cagaaatggctctaatgtga

SEQ ID NO: 146409 - DNA, 20 bp, Artificial Sequence
  chemically synthesized
ttcatcgacctctcacatta

SEQ ID NO: 146410 - DNA, 20 bp, Artificial Sequence
  chemically synthesized
aacagaaatggctctaatgt

SEQ ID NO: 146411 - DNA, 20 bp, Artificial Sequence
  chemically synthesized
aatgtttttctgaacagaaa

SEQ ID NO: 146412 - DNA, 20 bp, Artificial Sequence
  chemically synthesized
acattagagccatttctgtt

SEQ ID NO: 146413 - DNA, 20 bp, Artificial Sequence
  chemically synthesized
ttaagtaatgtttttctgaa

SEQ ID NO: 146414 - DNA, 20 bp, Artificial Sequence
  chemically synthesized
tagaaaacataaaatatttt

SEQ ID NO: 146415 - DNA, 20 bp, Artificial Sequence
  chemically synthesized
aatattttatgttttctaaa

SEQ ID NO: 146416 - DNA, 20 bp, Artificial Sequence
  chemically synthesized
aatccagaggcaagtctttt

SEQ ID NO: 146417 - DNA, 20 bp, Artificial Sequence
  chemically synthesized
tttctaaaaagacttgcctc

SEQ ID NO: 146418 - DNA, 20 bp, Artificial Sequence
  chemically synthesized
acatgcctgaatccagaggc

SEQ ID NO: 146419 - DNA, 20 bp, Artificial Sequence
  chemically synthesized
aaaagacttgcctctggatt

SEQ ID NO: 146420 - DNA, 20 bp, Artificial Sequence
  chemically synthesized
atatacatgcctgaatccag

SEQ ID NO: 146421 - DNA, 20 bp, Artificial Sequence
  chemically synthesized
aaagacttgcctctggattc

SEQ ID NO: 146422 - DNA, 20 bp, Artificial Sequence
  chemically synthesized
tatatacatgcctgaatcca

SEQ ID NO: 146423 - DNA, 20 bp, Artificial Sequence
  chemically synthesized
aatatatacatgcctgaatc

SEQ ID NO: 146424 - DNA, 20 bp, Artificial Sequence
  chemically synthesized
tttttttcattttttaatca

SEQ ID NO: 146425 - DNA, 20 bp, Artificial Sequence
  chemically synthesized
tttttaatcaaagtgtttca

SEQ ID NO: 146426 - DNA, 20 bp, Artificial Sequence
  chemically synthesized
ttttaatcaaagtgtttcaa

SEQ ID NO: 146427 - DNA, 20 bp, Artificial Sequence
  chemically synthesized
aatcaaagtgtttcaaagga

SEQ ID NO: 146428 - DNA, 20 bp, Artificial Sequence
  chemically synthesized
caaagtgtttcaaaggacag

SEQ ID NO: 146429 - DNA, 20 bp, Artificial Sequence
  chemically synthesized
ttcaaaggacagaagttttg

SEQ ID NO: 146430 - DNA, 20 bp, Artificial Sequence
  chemically synthesized
aaaaaaaaaaaaaaaatttc

SEQ ID NO: 146431 - DNA, 20 bp, Artificial Sequence
  chemically synthesized
aaaaaaaaaaaaaaaaattt

SEQ ID NO: 146432 - DNA, 20 bp, Artificial Sequence
  chemically synthesized
tttttttttttttttttttt

SEQ ID NO: 146433 - DNA, 20 bp, Artificial Sequence
  chemically synthesized
ttttttttttttttttgaga

SEQ ID NO: 146434 - DNA, 20 bp, Artificial Sequence
  chemically synthesized
ttttttttttttttgagaca

SEQ ID NO: 146435 - DNA, 20 bp, Artificial Sequence
  chemically synthesized
acagagtgttgctctgttgc

SEQ ID NO: 146436 - DNA, 20 bp, Artificial Sequence
  chemically synthesized
cagagtgttgctctgttgcc

SEQ ID NO: 146437 - DNA, 20 bp, Artificial Sequence
  chemically synthesized
tgcactccagcctggcaaca

SEQ ID NO: 146438 - DNA, 20 bp, Artificial Sequence
  chemically synthesized
actgcactccagcctggcaa

SEQ ID NO: 146439 - DNA, 20 bp, Artificial Sequence
  chemically synthesized
gtgttgctctgttgccaggc

SEQ ID NO: 146440 - DNA, 20 bp, Artificial Sequence
  chemically synthesized
gttgctctgttgccaggctg

SEQ ID NO: 146441 - DNA, 20 bp, Artificial Sequence
  chemically synthesized
cacgccactgcactccagcc

SEQ ID NO: 146442 - DNA, 20 bp, Artificial Sequence
  chemically synthesized
tctgttgccaggctggagtg

SEQ ID NO: 146443 - DNA, 20 bp, Artificial Sequence
  chemically synthesized
gagatcacgccactgcactc

SEQ ID NO: 146444 - DNA, 20 bp, Artificial Sequence
  chemically synthesized
gttgccaggctggagtgcag

SEQ ID NO: 146445 - DNA, 20 bp, Artificial Sequence
  chemically synthesized
ggagtgcagtggcgtgatct

SEQ ID NO: 146446 - DNA, 20 bp, Artificial Sequence
  chemically synthesized
ggcagagattgcagtgagct

SEQ ID NO: 146447 - DNA, 20 bp, Artificial Sequence
  chemically synthesized
cgcgaggcagagattgcagt

SEQ ID NO: 146448 - DNA, 20 bp, Artificial Sequence
  chemically synthesized
aacccgcgaggcagagattg

SEQ ID NO: 146449 - DNA, 20 bp, Artificial Sequence
  chemically synthesized
tcactgcaatctctgcctcg

SEQ ID NO: 146450 - DNA, 20 bp, Artificial Sequence
  chemically synthesized
tcgcttgaacccgcgaggca

SEQ ID NO: 146451 - DNA, 20 bp, Artificial Sequence
  chemically synthesized
cactgcaatctctgcctcgc

SEQ ID NO: 146452 - DNA, 20 bp, Artificial Sequence
  chemically synthesized
aatcgcttgaacccgcgagg

SEQ ID NO: 146453 - DNA, 20 bp, Artificial Sequence
  chemically synthesized
gggaatcgcttgaacccgcg

SEQ ID NO: 146454 - DNA, 20 bp, Artificial Sequence
  chemically synthesized
ggggaatcgcttgaacccgc

SEQ ID NO: 146455 - DNA, 20 bp, Artificial Sequence
  chemically synthesized
aatctctgcctcgcgggttc

SEQ ID NO: 146456 - DNA, 20 bp, Artificial Sequence
  chemically synthesized
ttcaagcgattcccctgcct

SEQ ID NO: 146457 - DNA, 20 bp, Artificial Sequence
  chemically synthesized
tactcaggaggctgaggcag

SEQ ID NO: 146458 - DNA, 20 bp, Artificial Sequence
  chemically synthesized
atactcaggaggctgaggca

SEQ ID NO: 146459 - DNA, 20 bp, Artificial Sequence
  chemically synthesized
gatactcaggaggctgaggc

SEQ ID NO: 146460 - DNA, 20 bp, Artificial Sequence
  chemically synthesized
agatactcaggaggctgagg

SEQ ID NO: 146461 - DNA, 20 bp, Artificial Sequence
  chemically synthesized
cccagatactcaggaggctg

SEQ ID NO: 146462 - DNA, 20 bp, Artificial Sequence
  chemically synthesized
tcccagatactcaggaggct

SEQ ID NO: 146463 - DNA, 20 bp, Artificial Sequence
  chemically synthesized
ttcccctgcctcagcctcct

SEQ ID NO: 146464 - DNA, 20 bp, Artificial Sequence
  chemically synthesized
tgtagtcccagatactcagg

SEQ ID NO: 146465 - DNA, 20 bp, Artificial Sequence
  chemically synthesized
ctgtagtcccagatactcag

SEQ ID NO: 146466 - DNA, 20 bp, Artificial Sequence
  chemically synthesized
gcctcagcctcctgagtatc

SEQ ID NO: 146467 - DNA, 20 bp, Artificial Sequence
  chemically synthesized
gcctgtagtcccagatactc

SEQ ID NO: 146468 - DNA, 20 bp, Artificial Sequence
  chemically synthesized
cctcagcctcctgagtatct

SEQ ID NO: 146469 - DNA, 20 bp, Artificial Sequence
  chemically synthesized
tgcctgtagtcccagatact

SEQ ID NO: 146470 - DNA, 20 bp, Artificial Sequence
  chemically synthesized
ctcctgagtatctgggacta

SEQ ID NO: 146471 - DNA, 20 bp, Artificial Sequence
  chemically synthesized
tcctgagtatctgggactac

SEQ ID NO: 146472 - DNA, 20 bp, Artificial Sequence
  chemically synthesized
gtggcaaatgcctgtagtcc

SEQ ID NO: 146473 - DNA, 20 bp, Artificial Sequence
  chemically synthesized
ggcatggtggcaaatgcctg

SEQ ID NO: 146474 - DNA, 20 bp, Artificial Sequence
  chemically synthesized
aaaaaattagttgggcatgg

SEQ ID NO: 146475 - DNA, 20 bp, Artificial Sequence
  chemically synthesized
tacaaaaaattagttgggca

SEQ ID NO: 146476 - DNA, 20 bp, Artificial Sequence
  chemically synthesized
taaagtacaaaaaattagtt

SEQ ID NO: 146477 - DNA, 20 bp, Artificial Sequence
  chemically synthesized
ctaaagtacaaaaaattagt

SEQ ID NO: 146478 - DNA, 20 bp, Artificial Sequence
  chemically synthesized
tccactaaagtacaaaaaat

SEQ ID NO: 146479 - DNA, 20 bp, Artificial Sequence
  chemically synthesized
ccaactaattttttgtactt

SEQ ID NO: 146480 - DNA, 20 bp, Artificial Sequence
  chemically synthesized
actaattttttgtactttag

SEQ ID NO: 146481 - DNA, 20 bp, Artificial Sequence
  chemically synthesized
taattttttgtactttagtg

SEQ ID NO: 146482 - DNA, 20 bp, Artificial Sequence
  chemically synthesized
gtgaaaccccgtctccacta

SEQ ID NO: 146483 - DNA, 20 bp, Artificial Sequence
  chemically synthesized
tttttgtactttagtggaga

SEQ ID NO: 146484 - DNA, 20 bp, Artificial Sequence
  chemically synthesized
ttttgtactttagtggagac

SEQ ID NO: 146485 - DNA, 20 bp, Artificial Sequence
  chemically synthesized
tttgtactttagtggagacg

SEQ ID NO: 146486 - DNA, 20 bp, Artificial Sequence
  chemically synthesized
gagacggggtttcaccatgt

SEQ ID NO: 146487 - DNA, 20 bp, Artificial Sequence
  chemically synthesized
cggggtttcaccatgttggc

SEQ ID NO: 146488 - DNA, 20 bp, Artificial Sequence
  chemically synthesized
cgagaccatcctggccaaca

SEQ ID NO: 146489 - DNA, 20 bp, Artificial Sequence
  chemically synthesized
ggggtttcaccatgttggcc

SEQ ID NO: 146490 - DNA, 20 bp, Artificial Sequence
  chemically synthesized
tttcaccatgttggccagga

SEQ ID NO: 146491 - DNA, 20 bp, Artificial Sequence
  chemically synthesized
tcaggagatcgagaccatcc

SEQ ID NO: 146492 - DNA, 20 bp, Artificial Sequence
  chemically synthesized
gatcacgaggtcaggagatc

SEQ ID NO: 146493 - DNA, 20 bp, Artificial Sequence
  chemically synthesized
caggcagatcacgaggtcag

SEQ ID NO: 146494 - DNA, 20 bp, Artificial Sequence
  chemically synthesized
ggcaggcagatcacgaggtc

SEQ ID NO: 146495 - DNA, 20 bp, Artificial Sequence
  chemically synthesized
aggcaggcagatcacgaggt

SEQ ID NO: 146496 - DNA, 20 bp, Artificial Sequence
  chemically synthesized
gccgaggcaggcagatcacg

SEQ ID NO: 146497 - DNA, 20 bp, Artificial Sequence
  chemically synthesized
ggccgaggcaggcagatcac

SEQ ID NO: 146498 - DNA, 20 bp, Artificial Sequence
  chemically synthesized
acctcgtgatctgcctgcct

SEQ ID NO: 146499 - DNA, 20 bp, Artificial Sequence
  chemically synthesized
ctttgggaggccgaggcagg

SEQ ID NO: 146500 - DNA, 20 bp, Artificial Sequence
  chemically synthesized
gcactttgggaggccgaggc

SEQ ID NO: 146501 - DNA, 20 bp, Artificial Sequence
  chemically synthesized
agcactttgggaggccgagg

SEQ ID NO: 146502 - DNA, 20 bp, Artificial Sequence
  chemically synthesized
cccagcactttgggaggccg

SEQ ID NO: 146503 - DNA, 20 bp, Artificial Sequence
  chemically synthesized
tcccagcactttgggaggcc

SEQ ID NO: 146504 - DNA, 20 bp, Artificial Sequence
  chemically synthesized
ctgcctgcctcggcctccca

SEQ ID NO: 146505 - DNA, 20 bp, Artificial Sequence
  chemically synthesized
tgtaatcccagcactttggg

SEQ ID NO: 146506 - DNA, 20 bp, Artificial Sequence
  chemically synthesized
ctgtaatcccagcactttgg

SEQ ID NO: 146507 - DNA, 20 bp, Artificial Sequence
  chemically synthesized
gcctcggcctcccaaagtgc

SEQ ID NO: 146508 - DNA, 20 bp, Artificial Sequence
  chemically synthesized
gcctgtaatcccagcacttt

SEQ ID NO: 146509 - DNA, 20 bp, Artificial Sequence
  chemically synthesized
cctcggcctcccaaagtgct

SEQ ID NO: 146510 - DNA, 20 bp, Artificial Sequence
  chemically synthesized
tgcctgtaatcccagcactt

SEQ ID NO: 146511 - DNA, 20 bp, Artificial Sequence
  chemically synthesized
ctcccaaagtgctgggatta

SEQ ID NO: 146512 - DNA, 20 bp, Artificial Sequence
  chemically synthesized
tcccaaagtgctgggattac

SEQ ID NO: 146513 - DNA, 20 bp, Artificial Sequence
  chemically synthesized
gtggctcatgcctgtaatcc

SEQ ID NO: 146514 - DNA, 20 bp, Artificial Sequence
  chemically synthesized
agtgctgggattacaggcat

SEQ ID NO: 146515 - DNA, 20 bp, Artificial Sequence
  chemically synthesized
caggcatgagccaccatgcc

SEQ ID NO: 146516 - DNA, 20 bp, Artificial Sequence
  chemically synthesized
gataaataggccgggcatgg

SEQ ID NO: 146517 - DNA, 20 bp, Artificial Sequence
  chemically synthesized
taagataaataggccgggca

SEQ ID NO: 146518 - DNA, 20 bp, Artificial Sequence
  chemically synthesized
taaaataagataaataggcc

SEQ ID NO: 146519 - DNA, 20 bp, Artificial Sequence
  chemically synthesized
ataaaataagataaataggc

SEQ ID NO: 146520 - DNA, 20 bp, Artificial Sequence
  chemically synthesized
tacaataaaataagataaat

SEQ ID NO: 146521 - DNA, 20 bp, Artificial Sequence
  chemically synthesized
atacaataaaataagataaa

SEQ ID NO: 146522 - DNA, 20 bp, Artificial Sequence
  chemically synthesized
tgtgatatatacaataaaat

SEQ ID NO: 146523 - DNA, 20 bp, Artificial Sequence
  chemically synthesized
aacgcatctgaaagtgcagt

SEQ ID NO: 146524 - DNA, 20 bp, Artificial Sequence
  chemically synthesized
attgattcttactgcacttt

SEQ ID NO: 146525 - DNA, 20 bp, Artificial Sequence
  chemically synthesized
ggtaaacgcatctgaaagtg

SEQ ID NO: 146526 - DNA, 20 bp, Artificial Sequence
  chemically synthesized
ataaaggtaaacgcatctga

SEQ ID NO: 146527 - DNA, 20 bp, Artificial Sequence
  chemically synthesized
accgcatatgtgttagataa

SEQ ID NO: 146528 - DNA, 20 bp, Artificial Sequence
  chemically synthesized
aaccgcatatgtgttagata

SEQ ID NO: 146529 - DNA, 20 bp, Artificial Sequence
  chemically synthesized
agaaagaaccgcatatgtgt

SEQ ID NO: 146530 - DNA, 20 bp, Artificial Sequence
  chemically synthesized
acctttatctaacacatatg

SEQ ID NO: 146531 - DNA, 20 bp, Artificial Sequence
  chemically synthesized
ctatgacatggtggaaaaga

SEQ ID NO: 146532 - DNA, 20 bp, Artificial Sequence
  chemically synthesized
agtactatgacatggtggaa

SEQ ID NO: 146533 - DNA, 20 bp, Artificial Sequence
  chemically synthesized
tttctagtactatgacatgg

SEQ ID NO: 146534 - DNA, 20 bp, Artificial Sequence
  chemically synthesized
ctttcttttccaccatgtca

SEQ ID NO: 146535 - DNA, 20 bp, Artificial Sequence
  chemically synthesized
atatttctagtactatgaca

SEQ ID NO: 146536 - DNA, 20 bp, Artificial Sequence
  chemically synthesized
tttccaccatgtcatagtac

SEQ ID NO: 146537 - DNA, 20 bp, Artificial Sequence
  chemically synthesized
aggtgatttgcatatatttc

SEQ ID NO: 146538 - DNA, 20 bp, Artificial Sequence
  chemically synthesized
tatatgcaaatcaccttttt

SEQ ID NO: 146539 - DNA, 20 bp, Artificial Sequence
  chemically synthesized
agcctacacttcactgaaaa

SEQ ID NO: 146540 - DNA, 20 bp, Artificial Sequence
  chemically synthesized
cagcctacacttcactgaaa

SEQ ID NO: 146541 - DNA, 20 bp, Artificial Sequence
  chemically synthesized
gcaaatcacctttttcagtg

SEQ ID NO: 146542 - DNA, 20 bp, Artificial Sequence
  chemically synthesized
tcacctttttcagtgaagtg

SEQ ID NO: 146543 - DNA, 20 bp, Artificial Sequence
  chemically synthesized
cacctttttcagtgaagtgt

SEQ ID NO: 146544 - DNA, 20 bp, Artificial Sequence
  chemically synthesized
tttttcagtgaagtgtaggc

SEQ ID NO: 146545 - DNA, 20 bp, Artificial Sequence
  chemically synthesized
tcagtgaagtgtaggctggt

SEQ ID NO: 146546 - DNA, 20 bp, Artificial Sequence
  chemically synthesized
aaaccactaacaaatctgac

SEQ ID NO: 146547 - DNA, 20 bp, Artificial Sequence
  chemically synthesized
tgtaggctggtcagatttgt

SEQ ID NO: 146548 - DNA, 20 bp, Artificial Sequence
  chemically synthesized
aggctggtcagatttgttag

SEQ ID NO: 146549 - DNA, 20 bp, Artificial Sequence
  chemically synthesized
gatttgttagtggttttgta

SEQ ID NO: 146550 - DNA, 20 bp, Artificial Sequence
  chemically synthesized
ttagtggttttgtacagtct

SEQ ID NO: 146551 - DNA, 20 bp, Artificial Sequence
  chemically synthesized
agaactgtgaacaggttgct

SEQ ID NO: 146552 - DNA, 20 bp, Artificial Sequence
  chemically synthesized
cagtctgagcaacctgttca

SEQ ID NO: 146553 - DNA, 20 bp, Artificial Sequence
  chemically synthesized
tgacccttagaactgtgaac

SEQ ID NO: 146554 - DNA, 20 bp, Artificial Sequence
  chemically synthesized
ctgacccttagaactgtgaa

SEQ ID NO: 146555 - DNA, 20 bp, Artificial Sequence
  chemically synthesized
agcaacctgttcacagttct

SEQ ID NO: 146556 - DNA, 20 bp, Artificial Sequence
  chemically synthesized
gcaacctgttcacagttcta

SEQ ID NO: 146557 - DNA, 20 bp, Artificial Sequence
  chemically synthesized
caacctgttcacagttctaa

SEQ ID NO: 146558 - DNA, 20 bp, Artificial Sequence
  chemically synthesized
ctgttcacagttctaagggt

SEQ ID NO: 146559 - DNA, 20 bp, Artificial Sequence
  chemically synthesized
tgttcacagttctaagggtc

SEQ ID NO: 146560 - DNA, 20 bp, Artificial Sequence
  chemically synthesized
atacgaccctgcctgaccct

SEQ ID NO: 146561 - DNA, 20 bp, Artificial Sequence
  chemically synthesized
tcacagttctaagggtcagg

SEQ ID NO: 146562 - DNA, 20 bp, Artificial Sequence
  chemically synthesized
cacagttctaagggtcaggc

SEQ ID NO: 146563 - DNA, 20 bp, Artificial Sequence
  chemically synthesized
acagttctaagggtcaggca

SEQ ID NO: 146564 - DNA, 20 bp, Artificial Sequence
  chemically synthesized
cagggtcgtattgttgtgcc

SEQ ID NO: 146565 - DNA, 20 bp, Artificial Sequence
  chemically synthesized
agggtcgtattgttgtgcca

SEQ ID NO: 146566 - DNA, 20 bp, Artificial Sequence
  chemically synthesized
gacttaacaggaaatatcct

SEQ ID NO: 146567 - DNA, 20 bp, Artificial Sequence
  chemically synthesized
tgccaaggatatttcctgtt

SEQ ID NO: 146568 - DNA, 20 bp, Artificial Sequence
  chemically synthesized
ttttaaaatattgacttaac

SEQ ID NO: 146569 - DNA, 20 bp, Artificial Sequence
  chemically synthesized
cttttaaaatattgacttaa

SEQ ID NO: 146570 - DNA, 20 bp, Artificial Sequence
  chemically synthesized
ctgttaagtcaatattttaa

SEQ ID NO: 146571 - DNA, 20 bp, Artificial Sequence
  chemically synthesized
tcaatattttaaaagactga

SEQ ID NO: 146572 - DNA, 20 bp, Artificial Sequence
  chemically synthesized
aatattttaaaagactgaaa

SEQ ID NO: 146573 - DNA, 20 bp, Artificial Sequence
  chemically synthesized
atattttaaaagactgaaag

SEQ ID NO: 146574 - DNA, 20 bp, Artificial Sequence
  chemically synthesized
tagcaaaacaaatcctcttt

SEQ ID NO: 146575 - DNA, 20 bp, Artificial Sequence
  chemically synthesized
gaaagaggatttgttttgct

SEQ ID NO: 146576 - DNA, 20 bp, Artificial Sequence
  chemically synthesized
aagaggatttgttttgctaa

SEQ ID NO: 146577 - DNA, 20 bp, Artificial Sequence
  chemically synthesized
attatggattcaggcactct

SEQ ID NO: 146578 - DNA, 20 bp, Artificial Sequence
  chemically synthesized
tcgttctagattatggattc

SEQ ID NO: 146579 - DNA, 20 bp, Artificial Sequence
  chemically synthesized
ttcgttctagattatggatt

SEQ ID NO: 146580 - DNA, 20 bp, Artificial Sequence
  chemically synthesized
gagtgcctgaatccataatc

SEQ ID NO: 146581 - DNA, 20 bp, Artificial Sequence
  chemically synthesized
tacccgttcgttctagatta

SEQ ID NO: 146582 - DNA, 20 bp, Artificial Sequence
  chemically synthesized
aatccataatctagaacgaa

SEQ ID NO: 146583 - DNA, 20 bp, Artificial Sequence
  chemically synthesized
aactctttacccgttcgttc

SEQ ID NO: 146584 - DNA, 20 bp, Artificial Sequence
  chemically synthesized
atccataatctagaacgaac

SEQ ID NO: 146585 - DNA, 20 bp, Artificial Sequence
  chemically synthesized
taatctagaacgaacgggta

SEQ ID NO: 146586 - DNA, 20 bp, Artificial Sequence
  chemically synthesized
atctagaacgaacgggtaaa

SEQ ID NO: 146587 - DNA, 20 bp, Artificial Sequence
  chemically synthesized
agaacgaacgggtaaagagt

SEQ ID NO: 146588 - DNA, 20 bp, Artificial Sequence
  chemically synthesized
gaacgaacgggtaaagagtt

SEQ ID NO: 146589 - DNA, 20 bp, Artificial Sequence
  chemically synthesized
aggatatataaattattaca

SEQ ID NO: 146590 - DNA, 20 bp, Artificial Sequence
  chemically synthesized
tagaattttcaatgatgttc

SEQ ID NO: 146591 - DNA, 20 bp, Artificial Sequence
  chemically synthesized
agaattttcaatgatgttct

SEQ ID NO: 146592 - DNA, 20 bp, Artificial Sequence
  chemically synthesized
ttttcaatgatgttctgggc

SEQ ID NO: 146593 - DNA, 20 bp, Artificial Sequence
  chemically synthesized
tttcaatgatgttctgggct

SEQ ID NO: 146594 - DNA, 20 bp, Artificial Sequence
  chemically synthesized
tgacaacaggagacccagcc

SEQ ID NO: 146595 - DNA, 20 bp, Artificial Sequence
  chemically synthesized
agggatgacaacaggagacc

SEQ ID NO: 146596 - DNA, 20 bp, Artificial Sequence
  chemically synthesized
ctccttagggatgacaacag

SEQ ID NO: 146597 - DNA, 20 bp, Artificial Sequence
  chemically synthesized
tgctccttagggatgacaac

SEQ ID NO: 146598 - DNA, 20 bp, Artificial Sequence
  chemically synthesized
atgctccttagggatgacaa

SEQ ID NO: 146599 - DNA, 20 bp, Artificial Sequence
  chemically synthesized
ggtctcctgttgtcatccct

SEQ ID NO: 146600 - DNA, 20 bp, Artificial Sequence
  chemically synthesized
gtctcctgttgtcatcccta

SEQ ID NO: 146601 - DNA, 20 bp, Artificial Sequence
  chemically synthesized
ctcctgttgtcatccctaag

SEQ ID NO: 146602 - DNA, 20 bp, Artificial Sequence
  chemically synthesized
gccatttcccatgctcctta

SEQ ID NO: 146603 - DNA, 20 bp, Artificial Sequence
  chemically synthesized
agccatttcccatgctcctt

SEQ ID NO: 146604 - DNA, 20 bp, Artificial Sequence
  chemically synthesized
gttgtcatccctaaggagca

SEQ ID NO: 146605 - DNA, 20 bp, Artificial Sequence
  chemically synthesized
aagccatttcccatgctcct

SEQ ID NO: 146606 - DNA, 20 bp, Artificial Sequence
  chemically synthesized
ttgtcatccctaaggagcat

SEQ ID NO: 146607 - DNA, 20 bp, Artificial Sequence
  chemically synthesized
tccctaaggagcatgggaaa

SEQ ID NO: 146608 - DNA, 20 bp, Artificial Sequence
  chemically synthesized
atgggaaatggcttcccctc

SEQ ID NO: 146609 - DNA, 20 bp, Artificial Sequence
  chemically synthesized
atttccgccagctggagggg

SEQ ID NO: 146610 - DNA, 20 bp, Artificial Sequence
  chemically synthesized
gaaatggcttcccctccagc

SEQ ID NO: 146611 - DNA, 20 bp, Artificial Sequence
  chemically synthesized
aggatttccgccagctggag

SEQ ID NO: 146612 - DNA, 20 bp, Artificial Sequence
  chemically synthesized
aaggatttccgccagctgga

SEQ ID NO: 146613 - DNA, 20 bp, Artificial Sequence
  chemically synthesized
aaaggatttccgccagctgg

SEQ ID NO: 146614 - DNA, 20 bp, Artificial Sequence
  chemically synthesized
atggcttcccctccagctgg

SEQ ID NO: 146615 - DNA, 20 bp, Artificial Sequence
  chemically synthesized
gaaaggatttccgccagctg

SEQ ID NO: 146616 - DNA, 20 bp, Artificial Sequence
  chemically synthesized
gggaaaggatttccgccagc

SEQ ID NO: 146617 - DNA, 20 bp, Artificial Sequence
  chemically synthesized
acacgggaaaggatttccgc

SEQ ID NO: 146618 - DNA, 20 bp, Artificial Sequence
  chemically synthesized
ttaaatagggtacacgggaa

SEQ ID NO: 146619 - DNA, 20 bp, Artificial Sequence
  chemically synthesized
attaaatagggtacacggga

SEQ ID NO: 146620 - DNA, 20 bp, Artificial Sequence
  chemically synthesized
taagattaaatagggtacac

SEQ ID NO: 146621 - DNA, 20 bp, Artificial Sequence
  chemically synthesized
ttaagattaaatagggtaca

SEQ ID NO: 146622 - DNA, 20 bp, Artificial Sequence
  chemically synthesized
cttggggttaagattaaata

SEQ ID NO: 146623 - DNA, 20 bp, Artificial Sequence
  chemically synthesized
acttggggttaagattaaat

SEQ ID NO: 146624 - DNA, 20 bp, Artificial Sequence
  chemically synthesized
gacttggggttaagattaaa

SEQ ID NO: 146625 - DNA, 20 bp, Artificial Sequence
  chemically synthesized
ccctatttaatcttaacccc

SEQ ID NO: 146626 - DNA, 20 bp, Artificial Sequence
  chemically synthesized
gcatgaacagacttggggtt

SEQ ID NO: 146627 - DNA, 20 bp, Artificial Sequence
  chemically synthesized
cccaggcatgaacagacttg

SEQ ID NO: 146628 - DNA, 20 bp, Artificial Sequence
  chemically synthesized
gcccaggcatgaacagactt

SEQ ID NO: 146629 - DNA, 20 bp, Artificial Sequence
  chemically synthesized
tgcccaggcatgaacagact

SEQ ID NO: 146630 - DNA, 20 bp, Artificial Sequence
  chemically synthesized
ggtgaatgcccaggcatgaa

SEQ ID NO: 146631 - DNA, 20 bp, Artificial Sequence
  chemically synthesized
accccaagtctgttcatgcc

SEQ ID NO: 146632 - DNA, 20 bp, Artificial Sequence
  chemically synthesized
ccccaagtctgttcatgcct

SEQ ID NO: 146633 - DNA, 20 bp, Artificial Sequence
  chemically synthesized
aagaaacggggtgaatgccc

SEQ ID NO: 146634 - DNA, 20 bp, Artificial Sequence
  chemically synthesized
taagaaacggggtgaatgcc

SEQ ID NO: 146635 - DNA, 20 bp, Artificial Sequence
  chemically synthesized
agataggggcataagaaacg

SEQ ID NO: 146636 - DNA, 20 bp, Artificial Sequence
  chemically synthesized
aagataggggcataagaaac

SEQ ID NO: 146637 - DNA, 20 bp, Artificial Sequence
  chemically synthesized
caagataggggcataagaaa

SEQ ID NO: 146638 - DNA, 20 bp, Artificial Sequence
  chemically synthesized
gtaacccaagataggggcat

SEQ ID NO: 146639 - DNA, 20 bp, Artificial Sequence
  chemically synthesized
cgtttcttatgcccctatct

SEQ ID NO: 146640 - DNA, 20 bp, Artificial Sequence
  chemically synthesized
gtttcttatgcccctatctt

SEQ ID NO: 146641 - DNA, 20 bp, Artificial Sequence
  chemically synthesized
cttcttgtaacccaagatag

SEQ ID NO: 146642 - DNA, 20 bp, Artificial Sequence
  chemically synthesized
gcttcttgtaacccaagata

SEQ ID NO: 146643 - DNA, 20 bp, Artificial Sequence
  chemically synthesized
agcttcttgtaacccaagat

SEQ ID NO: 146644 - DNA, 20 bp, Artificial Sequence
  chemically synthesized
cagcttcttgtaacccaaga

SEQ ID NO: 146645 - DNA, 20 bp, Artificial Sequence
  chemically synthesized
atgcccctatcttgggttac

SEQ ID NO: 146646 - DNA, 20 bp, Artificial Sequence
  chemically synthesized
gagccagcttcttgtaaccc

SEQ ID NO: 146647 - DNA, 20 bp, Artificial Sequence
  chemically synthesized
cccctatcttgggttacaag

SEQ ID NO: 146648 - DNA, 20 bp, Artificial Sequence
  chemically synthesized
tatcttgggttacaagaagc

SEQ ID NO: 146649 - DNA, 20 bp, Artificial Sequence
  chemically synthesized
gggttacaagaagctggctc

SEQ ID NO: 146650 - DNA, 20 bp, Artificial Sequence
  chemically synthesized
gaaccagctaataccagagc

SEQ ID NO: 146651 - DNA, 20 bp, Artificial Sequence
  chemically synthesized
caagaagctggctctggtat

SEQ ID NO: 146652 - DNA, 20 bp, Artificial Sequence
  chemically synthesized
atctgaaccagctaatacca

SEQ ID NO: 146653 - DNA, 20 bp, Artificial Sequence
  chemically synthesized
agatctgaaccagctaatac

SEQ ID NO: 146654 - DNA, 20 bp, Artificial Sequence
  chemically synthesized
aagctggctctggtattagc

SEQ ID NO: 146655 - DNA, 20 bp, Artificial Sequence
  chemically synthesized
ggctctggtattagctggtt

SEQ ID NO: 146656 - DNA, 20 bp, Artificial Sequence
  chemically synthesized
agagaggctgagatctgaac

SEQ ID NO: 146657 - DNA, 20 bp, Artificial Sequence
  chemically synthesized
gtattagctggttcagatct

SEQ ID NO: 146658 - DNA, 20 bp, Artificial Sequence
  chemically synthesized
ctgaggtggttagagaggct

SEQ ID NO: 146659 - DNA, 20 bp, Artificial Sequence
  chemically synthesized
agtctctgaggtggttagag

SEQ ID NO: 146660 - DNA, 20 bp, Artificial Sequence
  chemically synthesized
tagtctctgaggtggttaga

SEQ ID NO: 146661 - DNA, 20 bp, Artificial Sequence
  chemically synthesized
cttagtctctgaggtggtta

SEQ ID NO: 146662 - DNA, 20 bp, Artificial Sequence
  chemically synthesized
ctcagcctctctaaccacct

SEQ ID NO: 146663 - DNA, 20 bp, Artificial Sequence
  chemically synthesized
cccttagtctctgaggtggt

SEQ ID NO: 146664 - DNA, 20 bp, Artificial Sequence
  chemically synthesized
cagcctctctaaccacctca

SEQ ID NO: 146665 - DNA, 20 bp, Artificial Sequence
  chemically synthesized
aatacccttagtctctgagg

SEQ ID NO: 146666 - DNA, 20 bp, Artificial Sequence
  chemically synthesized
aagaatacccttagtctctg

SEQ ID NO: 146667 - DNA, 20 bp, Artificial Sequence
  chemically synthesized
ctctaaccacctcagagact

SEQ ID NO: 146668 - DNA, 20 bp, Artificial Sequence
  chemically synthesized
gaagaatacccttagtctct

SEQ ID NO: 146669 - DNA, 20 bp, Artificial Sequence
  chemically synthesized
tctaaccacctcagagacta

SEQ ID NO: 146670 - DNA, 20 bp, Artificial Sequence
  chemically synthesized
ctaaccacctcagagactaa

SEQ ID NO: 146671 - DNA, 20 bp, Artificial Sequence
  chemically synthesized
ggacttgagaagaataccct

SEQ ID NO: 146672 - DNA, 20 bp, Artificial Sequence
  chemically synthesized
agactaagggtattcttctc

SEQ ID NO: 146673 - DNA, 20 bp, Artificial Sequence
  chemically synthesized
attcctccaatggacttgag

SEQ ID NO: 146674 - DNA, 20 bp, Artificial Sequence
  chemically synthesized
acaattcctccaatggactt

SEQ ID NO: 146675 - DNA, 20 bp, Artificial Sequence
  chemically synthesized
ggtattcttctcaagtccat

SEQ ID NO: 146676 - DNA, 20 bp, Artificial Sequence
  chemically synthesized
tattcttctcaagtccattg

SEQ ID NO: 146677 - DNA, 20 bp, Artificial Sequence
  chemically synthesized
attcttctcaagtccattgg

SEQ ID NO: 146678 - DNA, 20 bp, Artificial Sequence
  chemically synthesized
ggaaaagacaattcctccaa

SEQ ID NO: 146679 - DNA, 20 bp, Artificial Sequence
  chemically synthesized
gtaaggaccctaggcaggaa

SEQ ID NO: 146680 - DNA, 20 bp, Artificial Sequence
  chemically synthesized
aggaattgtcttttcctgcc

SEQ ID NO: 146681 - DNA, 20 bp, Artificial Sequence
  chemically synthesized
ggaattgtcttttcctgcct

SEQ ID NO: 146682 - DNA, 20 bp, Artificial Sequence
  chemically synthesized
gaattgtcttttcctgccta

SEQ ID NO: 146683 - DNA, 20 bp, Artificial Sequence
  chemically synthesized
tttcagtaaggaccctaggc

SEQ ID NO: 146684 - DNA, 20 bp, Artificial Sequence
  chemically synthesized
ttttcagtaaggaccctagg

SEQ ID NO: 146685 - DNA, 20 bp, Artificial Sequence
  chemically synthesized
ctattttcagtaaggaccct

SEQ ID NO: 146686 - DNA, 20 bp, Artificial Sequence
  chemically synthesized
actattttcagtaaggaccc

SEQ ID NO: 146687 - DNA, 20 bp, Artificial Sequence
  chemically synthesized
cagaaagactattttcagta

SEQ ID NO: 146688 - DNA, 20 bp, Artificial Sequence
  chemically synthesized
tcagaaagactattttcagt

SEQ ID NO: 146689 - DNA, 20 bp, Artificial Sequence
  chemically synthesized
cctagggtccttactgaaaa

SEQ ID NO: 146690 - DNA, 20 bp, Artificial Sequence
  chemically synthesized
aacatcagaaagactatttt

SEQ ID NO: 146691 - DNA, 20 bp, Artificial Sequence
  chemically synthesized
tttaatagcataacatcaga

SEQ ID NO: 146692 - DNA, 20 bp, Artificial Sequence
  chemically synthesized
aacctttaatagcataacat

SEQ ID NO: 146693 - DNA, 20 bp, Artificial Sequence
  chemically synthesized
tttctgatgttatgctatta

SEQ ID NO: 146694 - DNA, 20 bp, Artificial Sequence
  chemically synthesized
ttctgatgttatgctattaa

SEQ ID NO: 146695 - DNA, 20 bp, Artificial Sequence
  chemically synthesized
gttactggaggaacctttaa

SEQ ID NO: 146696 - DNA, 20 bp, Artificial Sequence
  chemically synthesized
tatgctattaaaggttcctc

SEQ ID NO: 146697 - DNA, 20 bp, Artificial Sequence
  chemically synthesized
attaaaggttcctccagtaa

SEQ ID NO: 146698 - DNA, 20 bp, Artificial Sequence
  chemically synthesized
ccacccaaatctgttactgg

SEQ ID NO: 146699 - DNA, 20 bp, Artificial Sequence
  chemically synthesized
cccacccaaatctgttactg

SEQ ID NO: 146700 - DNA, 20 bp, Artificial Sequence
  chemically synthesized
aacccacccaaatctgttac

SEQ ID NO: 146701 - DNA, 20 bp, Artificial Sequence
  chemically synthesized
ggttcctccagtaacagatt

SEQ ID NO: 146702 - DNA, 20 bp, Artificial Sequence
  chemically synthesized
gttcctccagtaacagattt

SEQ ID NO: 146703 - DNA, 20 bp, Artificial Sequence
  chemically synthesized
cctccagtaacagatttggg

SEQ ID NO: 146704 - DNA, 20 bp, Artificial Sequence
  chemically synthesized
ctccagtaacagatttgggt

SEQ ID NO: 146705 - DNA, 20 bp, Artificial Sequence
  chemically synthesized
ggttctggcataaggtgatt

SEQ ID NO: 146706 - DNA, 20 bp, Artificial Sequence
  chemically synthesized
tttgctcaatcaccttatgc

SEQ ID NO: 146707 - DNA, 20 bp, Artificial Sequence
  chemically synthesized
atacatctggttctggcata

SEQ ID NO: 146708 - DNA, 20 bp, Artificial Sequence
  chemically synthesized
aatacatctggttctggcat

SEQ ID NO: 146709 - DNA, 20 bp, Artificial Sequence
  chemically synthesized
caatcaccttatgccagaac

SEQ ID NO: 146710 - DNA, 20 bp, Artificial Sequence
  chemically synthesized
cattgtaatacatctggttc

SEQ ID NO: 146711 - DNA, 20 bp, Artificial Sequence
  chemically synthesized
tttgtacattgtaatacatc

SEQ ID NO: 146712 - DNA, 20 bp, Artificial Sequence
  chemically synthesized
acaaaattaaactgtatatc

SEQ ID NO: 146713 - DNA, 20 bp, Artificial Sequence
  chemically synthesized
caaaattaaactgtatatct

SEQ ID NO: 146714 - DNA, 20 bp, Artificial Sequence
  chemically synthesized
tatctgtctacctagatata

SEQ ID NO: 146715 - DNA, 20 bp, Artificial Sequence
  chemically synthesized
aattaaactgtatatctagg

SEQ ID NO: 146716 - DNA, 20 bp, Artificial Sequence
  chemically synthesized
aaactgtatatctaggtaga

SEQ ID NO: 146717 - DNA, 20 bp, Artificial Sequence
  chemically synthesized
tgtgtatctatctgtctacc

SEQ ID NO: 146718 - DNA, 20 bp, Artificial Sequence
  chemically synthesized
tgtatatctaggtagacaga

SEQ ID NO: 146719 - DNA, 20 bp, Artificial Sequence
  chemically synthesized
tgtgtgtgtgtgtgtgtgta

SEQ ID NO: 146720 - DNA, 20 bp, Artificial Sequence
  chemically synthesized
tgtgtgtgtgtgtgtgtaaa

SEQ ID NO: 146721 - DNA, 20 bp, Artificial Sequence
  chemically synthesized
tgtgtgtgtgtgtgtaaaga

SEQ ID NO: 146722 - DNA, 20 bp, Artificial Sequence
  chemically synthesized
tgtgtgtgtgtaaagagaga

SEQ ID NO: 146723 - DNA, 20 bp, Artificial Sequence
  chemically synthesized
tgtgtgtaaagagagacaga

SEQ ID NO: 146724 - DNA, 20 bp, Artificial Sequence
  chemically synthesized
tgtgtaaagagagacagaca

SEQ ID NO: 146725 - DNA, 20 bp, Artificial Sequence
  chemically synthesized
taaagagagacagacagaga

SEQ ID NO: 146726 - DNA, 20 bp, Artificial Sequence
  chemically synthesized
aagagagacagacagagaca

SEQ ID NO: 146727 - DNA, 20 bp, Artificial Sequence
  chemically synthesized
gagacagacagagacagagc

SEQ ID NO: 146728 - DNA, 20 bp, Artificial Sequence
  chemically synthesized
gacagacagagacagagcaa

SEQ ID NO: 146729 - DNA, 20 bp, Artificial Sequence
  chemically synthesized
cagacagagacagagcaaga

SEQ ID NO: 146730 - DNA, 20 bp, Artificial Sequence
  chemically synthesized
gacagagacagagcaagaga

SEQ ID NO: 146731 - DNA, 20 bp, Artificial Sequence
  chemically synthesized
cagagacagagcaagagaga

SEQ ID NO: 146732 - DNA, 20 bp, Artificial Sequence
  chemically synthesized
gagacagagcaagagagaga

SEQ ID NO: 146733 - DNA, 20 bp, Artificial Sequence
  chemically synthesized
agacagagcaagagagagag

SEQ ID NO: 146734 - DNA, 20 bp, Artificial Sequence
  chemically synthesized
gacagagcaagagagagaga

SEQ ID NO: 146735 - DNA, 20 bp, Artificial Sequence
  chemically synthesized
agagagagagggcatctgaa

SEQ ID NO: 146736 - DNA, 20 bp, Artificial Sequence
  chemically synthesized
tagtatgtcctcagactatt

SEQ ID NO: 146737 - DNA, 20 bp, Artificial Sequence
  chemically synthesized
agagggcatctgaatagtct

SEQ ID NO: 146738 - DNA, 20 bp, Artificial Sequence
  chemically synthesized
gagggcatctgaatagtctg

SEQ ID NO: 146739 - DNA, 20 bp, Artificial Sequence
  chemically synthesized
tatgctacatagtatgtcct

SEQ ID NO: 146740 - DNA, 20 bp, Artificial Sequence
  chemically synthesized
tagtctgaggacatactatg

SEQ ID NO: 146741 - DNA, 20 bp, Artificial Sequence
  chemically synthesized
gagaaaggtattatgctaca

SEQ ID NO: 146742 - DNA, 20 bp, Artificial Sequence
  chemically synthesized
ttctaatgaatgcatgagaa

SEQ ID NO: 146743 - DNA, 20 bp, Artificial Sequence
  chemically synthesized
tttctaatgaatgcatgaga

SEQ ID NO: 146744 - DNA, 20 bp, Artificial Sequence
  chemically synthesized
taattttctaatgaatgcat

SEQ ID NO: 146745 - DNA, 20 bp, Artificial Sequence
  chemically synthesized
tacctttctcatgcattcat

SEQ ID NO: 146746 - DNA, 20 bp, Artificial Sequence
  chemically synthesized
ggaaaaccacaattttagta

SEQ ID NO: 146747 - DNA, 20 bp, Artificial Sequence
  chemically synthesized
agggaaaaccacaattttag

SEQ ID NO: 146748 - DNA, 20 bp, Artificial Sequence
  chemically synthesized
aaatgactctactaaaattg

SEQ ID NO: 146749 - DNA, 20 bp, Artificial Sequence
  chemically synthesized
tggagggaaaaccacaattt

SEQ ID NO: 146750 - DNA, 20 bp, Artificial Sequence
  chemically synthesized
aaattgtggttttccctcca

SEQ ID NO: 146751 - DNA, 20 bp, Artificial Sequence
  chemically synthesized
tctgtctgcttaactatgga

SEQ ID NO: 146752 - DNA, 20 bp, Artificial Sequence
  chemically synthesized
ttctgtctgcttaactatgg

SEQ ID NO: 146753 - DNA, 20 bp, Artificial Sequence
  chemically synthesized
gtggttttccctccatagtt

SEQ ID NO: 146754 - DNA, 20 bp, Artificial Sequence
  chemically synthesized
tttctgtctgcttaactatg

SEQ ID NO: 146755 - DNA, 20 bp, Artificial Sequence
  chemically synthesized
attttctgtctgcttaacta

SEQ ID NO: 146756 - DNA, 20 bp, Artificial Sequence
  chemically synthesized
gttttccctccatagttaag

SEQ ID NO: 146757 - DNA, 20 bp, Artificial Sequence
  chemically synthesized
tccctccatagttaagcaga

SEQ ID NO: 146758 - DNA, 20 bp, Artificial Sequence
  chemically synthesized
agttaagcagacagaaaatc

SEQ ID NO: 146759 - DNA, 20 bp, Artificial Sequence
  chemically synthesized
acagaaaatcaagctcaaaa

SEQ ID NO: 146760 - DNA, 20 bp, Artificial Sequence
  chemically synthesized
caattcatttcaactatttt

SEQ ID NO: 146761 - DNA, 20 bp, Artificial Sequence
  chemically synthesized
caaaatagttgaaatgaatt

SEQ ID NO: 146762 - DNA, 20 bp, Artificial Sequence
  chemically synthesized
tagttgaaatgaattgagtt

SEQ ID NO: 146763 - DNA, 20 bp, Artificial Sequence
  chemically synthesized
atgaattgagtttggcacac

SEQ ID NO: 146764 - DNA, 20 bp, Artificial Sequence
  chemically synthesized
ttgagtttggcacaccagaa

SEQ ID NO: 146765 - DNA, 20 bp, Artificial Sequence
  chemically synthesized
agtttggcacaccagaatgg

SEQ ID NO: 146766 - DNA, 20 bp, Artificial Sequence
  chemically synthesized
tgttattcatgctaccattc

SEQ ID NO: 146767 - DNA, 20 bp, Artificial Sequence
  chemically synthesized
cagaatggtagcatgaataa

SEQ ID NO: 146768 - DNA, 20 bp, Artificial Sequence
  chemically synthesized
aatggtagcatgaataacag

SEQ ID NO: 146769 - DNA, 20 bp, Artificial Sequence
  chemically synthesized
atggtagcatgaataacagt

SEQ ID NO: 146770 - DNA, 20 bp, Artificial Sequence
  chemically synthesized
agcaaagctgtggtttgcaa

SEQ ID NO: 146771 - DNA, 20 bp, Artificial Sequence
  chemically synthesized
taatatactattgcaaacca

SEQ ID NO: 146772 - DNA, 20 bp, Artificial Sequence
  chemically synthesized
aaatactcagagcaaagctg

SEQ ID NO: 146773 - DNA, 20 bp, Artificial Sequence
  chemically synthesized
gcaaaccacagctttgctct

SEQ ID NO: 146774 - DNA, 20 bp, Artificial Sequence
  chemically synthesized
ttaacaaaatactcagagca

SEQ ID NO: 146775 - DNA, 20 bp, Artificial Sequence
  chemically synthesized
tttaattaacaaaatactca

SEQ ID NO: 146776 - DNA, 20 bp, Artificial Sequence
  chemically synthesized
cttttaattaacaaaatact

SEQ ID NO: 146777 - DNA, 20 bp, Artificial Sequence
  chemically synthesized
ctgagtattttgttaattaa

SEQ ID NO: 146778 - DNA, 20 bp, Artificial Sequence
  chemically synthesized
tgagtattttgttaattaaa

SEQ ID NO: 146779 - DNA, 20 bp, Artificial Sequence
  chemically synthesized
ttttgttaattaaaaggtgt

SEQ ID NO: 146780 - DNA, 20 bp, Artificial Sequence
  chemically synthesized
taattaaaaggtgttggctt

SEQ ID NO: 146781 - DNA, 20 bp, Artificial Sequence
  chemically synthesized
aattaaaaggtgttggcttt

SEQ ID NO: 146782 - DNA, 20 bp, Artificial Sequence
  chemically synthesized
taaaaggtgttggctttagg

SEQ ID NO: 146783 - DNA, 20 bp, Artificial Sequence
  chemically synthesized
aaaaggtgttggctttagga

SEQ ID NO: 146784 - DNA, 20 bp, Artificial Sequence
  chemically synthesized
aaaataagagttccttccta

SEQ ID NO: 146785 - DNA, 20 bp, Artificial Sequence
  chemically synthesized
caaacacttgaaaaaaataa

SEQ ID NO: 146786 - DNA, 20 bp, Artificial Sequence
  chemically synthesized
ttcaaacacttgaaaaaaat

SEQ ID NO: 146787 - DNA, 20 bp, Artificial Sequence
  chemically synthesized
aaggaactcttatttttttc

SEQ ID NO: 146788 - DNA, 20 bp, Artificial Sequence
  chemically synthesized
ttatttttttcaagtgtttg

SEQ ID NO: 146789 - DNA, 20 bp, Artificial Sequence
  chemically synthesized
gtgtttgaagaacacttctc

SEQ ID NO: 146790 - DNA, 20 bp, Artificial Sequence
  chemically synthesized
attaaattttcagactagag

SEQ ID NO: 146791 - DNA, 20 bp, Artificial Sequence
  chemically synthesized
ccaattaaattttcagacta

SEQ ID NO: 146792 - DNA, 20 bp, Artificial Sequence
  chemically synthesized
aaccaattaaattttcagac

SEQ ID NO: 146793 - DNA, 20 bp, Artificial Sequence
  chemically synthesized
cctgaaaccaattaaatttt

SEQ ID NO: 146794 - DNA, 20 bp, Artificial Sequence
  chemically synthesized
ctctagtctgaaaatttaat

SEQ ID NO: 146795 - DNA, 20 bp, Artificial Sequence
  chemically synthesized
tctgaaaatttaattggttt

SEQ ID NO: 146796 - DNA, 20 bp, Artificial Sequence
  chemically synthesized
ctgaaaatttaattggtttc

SEQ ID NO: 146797 - DNA, 20 bp, Artificial Sequence
  chemically synthesized
tgaaaatttaattggtttca

SEQ ID NO: 146798 - DNA, 20 bp, Artificial Sequence
  chemically synthesized
gaaaatttaattggtttcag

SEQ ID NO: 146799 - DNA, 20 bp, Artificial Sequence
  chemically synthesized
tggtttcaggggtacatgat

SEQ ID NO: 146800 - DNA, 20 bp, Artificial Sequence
  chemically synthesized
ttcaggggtacatgattagt

SEQ ID NO: 146801 - DNA, 20 bp, Artificial Sequence
  chemically synthesized
tacatgattagtcagactaa

SEQ ID NO: 146802 - DNA, 20 bp, Artificial Sequence
  chemically synthesized
aaagctctaagtaaagctgt

SEQ ID NO: 146803 - DNA, 20 bp, Artificial Sequence
  chemically synthesized
gtcagactaacagctttact

SEQ ID NO: 146804 - DNA, 20 bp, Artificial Sequence
  chemically synthesized
cagactaacagctttactta

SEQ ID NO: 146805 - DNA, 20 bp, Artificial Sequence
  chemically synthesized
ctcctttaaagctctaagta

SEQ ID NO: 146806 - DNA, 20 bp, Artificial Sequence
  chemically synthesized
agtagctcctttaaagctct

SEQ ID NO: 146807 - DNA, 20 bp, Artificial Sequence
  chemically synthesized
cagctttacttagagcttta

SEQ ID NO: 146808 - DNA, 20 bp, Artificial Sequence
  chemically synthesized
agctttacttagagctttaa

SEQ ID NO: 146809 - DNA, 20 bp, Artificial Sequence
  chemically synthesized
ctttacttagagctttaaag

SEQ ID NO: 146810 - DNA, 20 bp, Artificial Sequence
  chemically synthesized
aagatttagtagctccttta

SEQ ID NO: 146811 - DNA, 20 bp, Artificial Sequence
  chemically synthesized
gtgtgttttaaaagatttag

SEQ ID NO: 146812 - DNA, 20 bp, Artificial Sequence
  chemically synthesized
tgtgtgtgttttaaaagatt

SEQ ID NO: 146813 - DNA, 20 bp, Artificial Sequence
  chemically synthesized
acattgtgtgtgtgttttaa

SEQ ID NO: 146814 - DNA, 20 bp, Artificial Sequence
  chemically synthesized
aaacacacacacaatgtgtt

SEQ ID NO: 146815 - DNA, 20 bp, Artificial Sequence
  chemically synthesized
tgtttggcatatttcctttg

SEQ ID NO: 146816 - DNA, 20 bp, Artificial Sequence
  chemically synthesized
accatgtgtgaatacttcaa

SEQ ID NO: 146817 - DNA, 20 bp, Artificial Sequence
  chemically synthesized
aaccatgtgtgaatacttca

SEQ ID NO: 146818 - DNA, 20 bp, Artificial Sequence
  chemically synthesized
tcctttgaagtattcacaca

SEQ ID NO: 146819 - DNA, 20 bp, Artificial Sequence
  chemically synthesized
aaaggagacctgtgaattac

SEQ ID NO: 146820 - DNA, 20 bp, Artificial Sequence
  chemically synthesized
catggttttcctgtaattca

SEQ ID NO: 146821 - DNA, 20 bp, Artificial Sequence
  chemically synthesized
caaaggagacctgtgaatta

SEQ ID NO: 146822 - DNA, 20 bp, Artificial Sequence
  chemically synthesized
atggttttcctgtaattcac

SEQ ID NO: 146823 - DNA, 20 bp, Artificial Sequence
  chemically synthesized
tgtaattcacaggtctcctt

SEQ ID NO: 146824 - DNA, 20 bp, Artificial Sequence
  chemically synthesized
tgctttcttatcaaccaaag

SEQ ID NO: 146825 - DNA, 20 bp, Artificial Sequence
  chemically synthesized
cttgctttcttatcaaccaa

SEQ ID NO: 146826 - DNA, 20 bp, Artificial Sequence
  chemically synthesized
tcttgctttcttatcaacca

SEQ ID NO: 146827 - DNA, 20 bp, Artificial Sequence
  chemically synthesized
acaggtctcctttggttgat

SEQ ID NO: 146828 - DNA, 20 bp, Artificial Sequence
  chemically synthesized
gtctcctttggttgataaga

SEQ ID NO: 146829 - DNA, 20 bp, Artificial Sequence
  chemically synthesized
cctttggttgataagaaagc

SEQ ID NO: 146830 - DNA, 20 bp, Artificial Sequence
  chemically synthesized
ttggttgataagaaagcaag

SEQ ID NO: 146831 - DNA, 20 bp, Artificial Sequence
  chemically synthesized
agaagcacatactctatttc

SEQ ID NO: 146832 - DNA, 20 bp, Artificial Sequence
  chemically synthesized
attcaacaaagctagaaata

SEQ ID NO: 146833 - DNA, 20 bp, Artificial Sequence
  chemically synthesized
tcattcaacaaagctagaaa

SEQ ID NO: 146834 - DNA, 20 bp, Artificial Sequence
  chemically synthesized
ccacattcattcaacaaagc

SEQ ID NO: 146835 - DNA, 20 bp, Artificial Sequence
  chemically synthesized
ttacccacattcattcaaca

SEQ ID NO: 146836 - DNA, 20 bp, Artificial Sequence
  chemically synthesized
ctagctttgttgaatgaatg

SEQ ID NO: 146837 - DNA, 20 bp, Artificial Sequence
  chemically synthesized
tagctttgttgaatgaatgt

SEQ ID NO: 146838 - DNA, 20 bp, Artificial Sequence
  chemically synthesized
aaaagtgaagcaaacaaaaa

SEQ ID NO: 146839 - DNA, 20 bp, Artificial Sequence
  chemically synthesized
atttttcaaatataaaagtg

SEQ ID NO: 146840 - DNA, 20 bp, Artificial Sequence
  chemically synthesized
gagtgatttttcaaatataa

SEQ ID NO: 146841 - DNA, 20 bp, Artificial Sequence
  chemically synthesized
aataacttattttgtaagtt

SEQ ID NO: 146842 - DNA, 20 bp, Artificial Sequence
  chemically synthesized
aatcactcaacttacaaaat

SEQ ID NO: 146843 - DNA, 20 bp, Artificial Sequence
  chemically synthesized
agcccaataacttattttgt

SEQ ID NO: 146844 - DNA, 20 bp, Artificial Sequence
  chemically synthesized
caacttacaaaataagttat

SEQ ID NO: 146845 - DNA, 20 bp, Artificial Sequence
  chemically synthesized
aacttacaaaataagttatt

SEQ ID NO: 146846 - DNA, 20 bp, Artificial Sequence
  chemically synthesized
tctcatagaattgttaatgt

SEQ ID NO: 146847 - DNA, 20 bp, Artificial Sequence
  chemically synthesized
gctcacattaacaattctat

SEQ ID NO: 146848 - DNA, 20 bp, Artificial Sequence
  chemically synthesized
tcacattaacaattctatga

SEQ ID NO: 146849 - DNA, 20 bp, Artificial Sequence
  chemically synthesized
actttttagatattctctca

SEQ ID NO: 146850 - DNA, 20 bp, Artificial Sequence
  chemically synthesized
tctatgagagaatatctaaa

SEQ ID NO: 146851 - DNA, 20 bp, Artificial Sequence
  chemically synthesized
gaatatctaacagcactttt

SEQ ID NO: 146852 - DNA, 20 bp, Artificial Sequence
  chemically synthesized
gaatatctaaaaagtgctgt

SEQ ID NO: 146853 - DNA, 20 bp, Artificial Sequence
  chemically synthesized
aggaggaagggaatatctaa

SEQ ID NO: 146854 - DNA, 20 bp, Artificial Sequence
  chemically synthesized
catggaatgataaggaggaa

SEQ ID NO: 146855 - DNA, 20 bp, Artificial Sequence
  chemically synthesized
acatggaatgataaggagga

SEQ ID NO: 146856 - DNA, 20 bp, Artificial Sequence
  chemically synthesized
gacatggaatgataaggagg

SEQ ID NO: 146857 - DNA, 20 bp, Artificial Sequence
  chemically synthesized
gttgacatggaatgataagg

SEQ ID NO: 146858 - DNA, 20 bp, Artificial Sequence
  chemically synthesized
tgttgacatggaatgataag

SEQ ID NO: 146859 - DNA, 20 bp, Artificial Sequence
  chemically synthesized
cctgttgacatggaatgata

SEQ ID NO: 146860 - DNA, 20 bp, Artificial Sequence
  chemically synthesized
tcctgttgacatggaatgat

SEQ ID NO: 146861 - DNA, 20 bp, Artificial Sequence
  chemically synthesized
tccttatcattccatgtcaa

SEQ ID NO: 146862 - DNA, 20 bp, Artificial Sequence
  chemically synthesized
ccttatcattccatgtcaac

SEQ ID NO: 146863 - DNA, 20 bp, Artificial Sequence
  chemically synthesized
acattgctctcctgttgaca

SEQ ID NO: 146864 - DNA, 20 bp, Artificial Sequence
  chemically synthesized
ttatcattccatgtcaacag

SEQ ID NO: 146865 - DNA, 20 bp, Artificial Sequence
  chemically synthesized
atcattccatgtcaacagga

SEQ ID NO: 146866 - DNA, 20 bp, Artificial Sequence
  chemically synthesized
ttataccccatagtattaaa

SEQ ID NO: 146867 - DNA, 20 bp, Artificial Sequence
  chemically synthesized
tgcattactatttaatacta

SEQ ID NO: 146868 - DNA, 20 bp, Artificial Sequence
  chemically synthesized
gcattactatttaatactat

SEQ ID NO: 146869 - DNA, 20 bp, Artificial Sequence
  chemically synthesized
cattactatttaatactatg

SEQ ID NO: 146870 - DNA, 20 bp, Artificial Sequence
  chemically synthesized
acaatctttcttatacccca

SEQ ID NO: 146871 - DNA, 20 bp, Artificial Sequence
  chemically synthesized
tatttaatactatggggtat

SEQ ID NO: 146872 - DNA, 20 bp, Artificial Sequence
  chemically synthesized
taatactatggggtataaga

SEQ ID NO: 146873 - DNA, 20 bp, Artificial Sequence
  chemically synthesized
tggggtataagaaagattgt

SEQ ID NO: 146874 - DNA, 20 bp, Artificial Sequence
  chemically synthesized
tttatctactagtgagatgg

SEQ ID NO: 146875 - DNA, 20 bp, Artificial Sequence
  chemically synthesized
gttagcgacttccatctcac

SEQ ID NO: 146876 - DNA, 20 bp, Artificial Sequence
  chemically synthesized
tattttatctactagtgaga

SEQ ID NO: 146877 - DNA, 20 bp, Artificial Sequence
  chemically synthesized
agcgacttccatctcactag

SEQ ID NO: 146878 - DNA, 20 bp, Artificial Sequence
  chemically synthesized
gagttattttatctactagt

SEQ ID NO: 146879 - DNA, 20 bp, Artificial Sequence
  chemically synthesized
aggagagttattttatctac

SEQ ID NO: 146880 - DNA, 20 bp, Artificial Sequence
  chemically synthesized
aatgttgcttacatggagga

SEQ ID NO: 146881 - DNA, 20 bp, Artificial Sequence
  chemically synthesized
ccaatgttgcttacatggag

SEQ ID NO: 146882 - DNA, 20 bp, Artificial Sequence
  chemically synthesized
aaaataactctcctccatgt

SEQ ID NO: 146883 - DNA, 20 bp, Artificial Sequence
  chemically synthesized
ctccaatgttgcttacatgg

SEQ ID NO: 146884 - DNA, 20 bp, Artificial Sequence
  chemically synthesized
tctccaatgttgcttacatg

SEQ ID NO: 146885 - DNA, 20 bp, Artificial Sequence
  chemically synthesized
attctccaatgttgcttaca

SEQ ID NO: 146886 - DNA, 20 bp, Artificial Sequence
  chemically synthesized
ctcctccatgtaagcaacat

SEQ ID NO: 146887 - DNA, 20 bp, Artificial Sequence
  chemically synthesized
cctccatgtaagcaacattg

SEQ ID NO: 146888 - DNA, 20 bp, Artificial Sequence
  chemically synthesized
catcctttcaaatattcaaa

SEQ ID NO: 146889 - DNA, 20 bp, Artificial Sequence
  chemically synthesized
ttttctttttgaatatttga

SEQ ID NO: 146890 - DNA, 20 bp, Artificial Sequence
  chemically synthesized
tttctttttgaatatttgaa

SEQ ID NO: 146891 - DNA, 20 bp, Artificial Sequence
  chemically synthesized
tttttgaatatttgaaagga

SEQ ID NO: 146892 - DNA, 20 bp, Artificial Sequence
  chemically synthesized
atatttgaaaggatggcatt

SEQ ID NO: 146893 - DNA, 20 bp, Artificial Sequence
  chemically synthesized
tttggattaatgaattccgt

SEQ ID NO: 146894 - DNA, 20 bp, Artificial Sequence
  chemically synthesized
gaagttctcttgaattctta

SEQ ID NO: 146895 - DNA, 20 bp, Artificial Sequence
  chemically synthesized
aatgaattccgtaagaattc

SEQ ID NO: 146896 - DNA, 20 bp, Artificial Sequence
  chemically synthesized
tgaattccgtaagaattcaa

SEQ ID NO: 146897 - DNA, 20 bp, Artificial Sequence
  chemically synthesized
agaattcaagagaacttctg

SEQ ID NO: 146898 - DNA, 20 bp, Artificial Sequence
  chemically synthesized
tgatttcaaattttcttcag

SEQ ID NO: 146899 - DNA, 20 bp, Artificial Sequence
  chemically synthesized
acatgatttcaaattttctt

SEQ ID NO: 146900 - DNA, 20 bp, Artificial Sequence
  chemically synthesized
agaaaatttgaaatcatgtc

SEQ ID NO: 146901 - DNA, 20 bp, Artificial Sequence
  chemically synthesized
tgaaatcatgtctagattct

SEQ ID NO: 146902 - DNA, 20 bp, Artificial Sequence
  chemically synthesized
agattgtctttcttagaatc

SEQ ID NO: 146903 - DNA, 20 bp, Artificial Sequence
  chemically synthesized
atcatgtctagattctaaga

SEQ ID NO: 146904 - DNA, 20 bp, Artificial Sequence
  chemically synthesized
acacaatagattgtctttct

SEQ ID NO: 146905 - DNA, 20 bp, Artificial Sequence
  chemically synthesized
aagaaagacaatctattgtg

SEQ ID NO: 146906 - DNA, 20 bp, Artificial Sequence
  chemically synthesized
agaaagacaatctattgtgt

SEQ ID NO: 146907 - DNA, 20 bp, Artificial Sequence
  chemically synthesized
attcttccttacctacacaa

SEQ ID NO: 146908 - DNA, 20 bp, Artificial Sequence
  chemically synthesized
agacaatctattgtgtaggt

SEQ ID NO: 146909 - DNA, 20 bp, Artificial Sequence
  chemically synthesized
gacaatctattgtgtaggta

SEQ ID NO: 146910 - DNA, 20 bp, Artificial Sequence
  chemically synthesized
aatctattgtgtaggtaagg

SEQ ID NO: 146911 - DNA, 20 bp, Artificial Sequence
  chemically synthesized
gactgtaaatatttagaggg

SEQ ID NO: 146912 - DNA, 20 bp, Artificial Sequence
  chemically synthesized
gcagactgtaaatatttaga

SEQ ID NO: 146913 - DNA, 20 bp, Artificial Sequence
  chemically synthesized
tgcagactgtaaatatttag

SEQ ID NO: 146914 - DNA, 20 bp, Artificial Sequence
  chemically synthesized
gtgcagactgtaaatattta

SEQ ID NO: 146915 - DNA, 20 bp, Artificial Sequence
  chemically synthesized
atgtgcagactgtaaatatt

SEQ ID NO: 146916 - DNA, 20 bp, Artificial Sequence
  chemically synthesized
gtcttccctctaaatattta

SEQ ID NO: 146917 - DNA, 20 bp, Artificial Sequence
  chemically synthesized
tatttacagtctgcacatac

SEQ ID NO: 146918 - DNA, 20 bp, Artificial Sequence
  chemically synthesized
aattttccaacttgtatgtg

SEQ ID NO: 146919 - DNA, 20 bp, Artificial Sequence
  chemically synthesized
tacagtctgcacatacaagt

SEQ ID NO: 146920 - DNA, 20 bp, Artificial Sequence
  chemically synthesized
gcacatacaagttggaaaat

SEQ ID NO: 146921 - DNA, 20 bp, Artificial Sequence
  chemically synthesized
aataagtgtttatgtgttca

SEQ ID NO: 146922 - DNA, 20 bp, Artificial Sequence
  chemically synthesized
aaaagaaagcagacaaaaat

SEQ ID NO: 146923 - DNA, 20 bp, Artificial Sequence
  chemically synthesized
tagagtgacagaaaagaaag

SEQ ID NO: 146924 - DNA, 20 bp, Artificial Sequence
  chemically synthesized
ctttagagtgacagaaaaga

SEQ ID NO: 146925 - DNA, 20 bp, Artificial Sequence
  chemically synthesized
tactctttagagtgacagaa

SEQ ID NO: 146926 - DNA, 20 bp, Artificial Sequence
  chemically synthesized
ttatttactctttagagtga

SEQ ID NO: 146927 - DNA, 20 bp, Artificial Sequence
  chemically synthesized
ctttcttttctgtcactcta

SEQ ID NO: 146928 - DNA, 20 bp, Artificial Sequence
  chemically synthesized
ttcttttctgtcactctaaa

SEQ ID NO: 146929 - DNA, 20 bp, Artificial Sequence
  chemically synthesized
tatattttatttactcttta

SEQ ID NO: 146930 - DNA, 20 bp, Artificial Sequence
  chemically synthesized
catatattttatttactctt

SEQ ID NO: 146931 - DNA, 20 bp, Artificial Sequence
  chemically synthesized
aaatgagaattattgatgtt

SEQ ID NO: 146932 - DNA, 20 bp, Artificial Sequence
  chemically synthesized
aaaatgagaattattgatgt

SEQ ID NO: 146933 - DNA, 20 bp, Artificial Sequence
  chemically synthesized
aacatcaataattctcattt

SEQ ID NO: 146934 - DNA, 20 bp, Artificial Sequence
  chemically synthesized
agcatttatttttctaaaat

SEQ ID NO: 146935 - DNA, 20 bp, Artificial Sequence
  chemically synthesized
gccttgcctatgtagagtac

SEQ ID NO: 146936 - DNA, 20 bp, Artificial Sequence
  chemically synthesized
ataaatgcttgtactctaca

SEQ ID NO: 146937 - DNA, 20 bp, Artificial Sequence
  chemically synthesized
taaatgcttgtactctacat

SEQ ID NO: 146938 - DNA, 20 bp, Artificial Sequence
  chemically synthesized
actccggccttgcctatgta

SEQ ID NO: 146939 - DNA, 20 bp, Artificial Sequence
  chemically synthesized
tgcttgtactctacataggc

SEQ ID NO: 146940 - DNA, 20 bp, Artificial Sequence
  chemically synthesized
gtactccggccttgcctatg

SEQ ID NO: 146941 - DNA, 20 bp, Artificial Sequence
  chemically synthesized
gcttgtactctacataggca

SEQ ID NO: 146942 - DNA, 20 bp, Artificial Sequence
  chemically synthesized
gtactctacataggcaaggc

SEQ ID NO: 146943 - DNA, 20 bp, Artificial Sequence
  chemically synthesized
actctacataggcaaggccg

SEQ ID NO: 146944 - DNA, 20 bp, Artificial Sequence
  chemically synthesized
cataggcaaggccggagtac

SEQ ID NO: 146945 - DNA, 20 bp, Artificial Sequence
  chemically synthesized
atccttgagttccagtactc

SEQ ID NO: 146946 - DNA, 20 bp, Artificial Sequence
  chemically synthesized
aggccggagtactggaactc

SEQ ID NO: 146947 - DNA, 20 bp, Artificial Sequence
  chemically synthesized
ggccggagtactggaactca

SEQ ID NO: 146948 - DNA, 20 bp, Artificial Sequence
  chemically synthesized
tatcatgaatccttgagttc

SEQ ID NO: 146949 - DNA, 20 bp, Artificial Sequence
  chemically synthesized
aatggttatcatgaatcctt

SEQ ID NO: 146950 - DNA, 20 bp, Artificial Sequence
  chemically synthesized
cttaaatccagaaatacaaa

SEQ ID NO: 146951 - DNA, 20 bp, Artificial Sequence
  chemically synthesized
atgataaccatttgtatttc

SEQ ID NO: 146952 - DNA, 20 bp, Artificial Sequence
  chemically synthesized
ccatttgtatttctggattt

SEQ ID NO: 146953 - DNA, 20 bp, Artificial Sequence
  chemically synthesized
acatttttttttcttaaatc

SEQ ID NO: 146954 - DNA, 20 bp, Artificial Sequence
  chemically synthesized
atttaagaaaaaaaaatgtt

SEQ ID NO: 146955 - DNA, 20 bp, Artificial Sequence
  chemically synthesized
agaaaaaaaaatgttaagtt

SEQ ID NO: 146956 - DNA, 20 bp, Artificial Sequence
  chemically synthesized
gaaaaaaaaatgttaagttt

SEQ ID NO: 146957 - DNA, 20 bp, Artificial Sequence
  chemically synthesized
aaaaaaaatgttaagtttgg

SEQ ID NO: 146958 - DNA, 20 bp, Artificial Sequence
  chemically synthesized
aatgttaagtttgggagcta

SEQ ID NO: 146959 - DNA, 20 bp, Artificial Sequence
  chemically synthesized
cattaagctttaaaaatcca

SEQ ID NO: 146960 - DNA, 20 bp, Artificial Sequence
  chemically synthesized
ttgggagctatggattttta

SEQ ID NO: 146961 - DNA, 20 bp, Artificial Sequence
  chemically synthesized
tatggatttttaaagcttaa

SEQ ID NO: 146962 - DNA, 20 bp, Artificial Sequence
  chemically synthesized
tgtaagcaaatagcaccatt

SEQ ID NO: 146963 - DNA, 20 bp, Artificial Sequence
  chemically synthesized
tctattaaaatgtaagcaaa

SEQ ID NO: 146964 - DNA, 20 bp, Artificial Sequence
  chemically synthesized
gaaagaatctattaaaatgt

SEQ ID NO: 146965 - DNA, 20 bp, Artificial Sequence
  chemically synthesized
gctatttgcttacattttaa

SEQ ID NO: 146966 - DNA, 20 bp, Artificial Sequence
  chemically synthesized
ttatatttttaatagcaaga

SEQ ID NO: 146967 - DNA, 20 bp, Artificial Sequence
  chemically synthesized
tggattatatttttaatagc

SEQ ID NO: 146968 - DNA, 20 bp, Artificial Sequence
  chemically synthesized
tatttggattatatttttaa

SEQ ID NO: 146969 - DNA, 20 bp, Artificial Sequence
  chemically synthesized
agtagtagcaaatatttatt

SEQ ID NO: 146970 - DNA, 20 bp, Artificial Sequence
  chemically synthesized
attatcttacttgtaagtag

SEQ ID NO: 146971 - DNA, 20 bp, Artificial Sequence
  chemically synthesized
aaatatttgctactacttac

SEQ ID NO: 146972 - DNA, 20 bp, Artificial Sequence
  chemically synthesized
gcaattatcttacttgtaag

SEQ ID NO: 146973 - DNA, 20 bp, Artificial Sequence
  chemically synthesized
atttgctactacttacaagt

SEQ ID NO: 146974 - DNA, 20 bp, Artificial Sequence
  chemically synthesized
gtggcaattatcttacttgt

SEQ ID NO: 146975 - DNA, 20 bp, Artificial Sequence
  chemically synthesized
gggggtgatggcagtgttgg

SEQ ID NO: 146976 - DNA, 20 bp, Artificial Sequence
  chemically synthesized
gatgggggtgatggcagtgt

SEQ ID NO: 146977 - DNA, 20 bp, Artificial Sequence
  chemically synthesized
gtaaatgatgggggtgatgg

SEQ ID NO: 146978 - DNA, 20 bp, Artificial Sequence
  chemically synthesized
tgagtaaatgatgggggtga

SEQ ID NO: 146979 - DNA, 20 bp, Artificial Sequence
  chemically synthesized
aatcactgagtaaatgatgg

SEQ ID NO: 146980 - DNA, 20 bp, Artificial Sequence
  chemically synthesized
gaatcactgagtaaatgatg

SEQ ID NO: 146981 - DNA, 20 bp, Artificial Sequence
  chemically synthesized
agaatcactgagtaaatgat

SEQ ID NO: 146982 - DNA, 20 bp, Artificial Sequence
  chemically synthesized
aagaatcactgagtaaatga

SEQ ID NO: 146983 - DNA, 20 bp, Artificial Sequence
  chemically synthesized
catcacccccatcatttact

SEQ ID NO: 146984 - DNA, 20 bp, Artificial Sequence
  chemically synthesized
cctagcacataagaatcact

SEQ ID NO: 146985 - DNA, 20 bp, Artificial Sequence
  chemically synthesized
actcagtgattcttatgtgc

SEQ ID NO: 146986 - DNA, 20 bp, Artificial Sequence
  chemically synthesized
ctcagtgattcttatgtgct

SEQ ID NO: 146987 - DNA, 20 bp, Artificial Sequence
  chemically synthesized
aagaaccttgcctagcacat

SEQ ID NO: 146988 - DNA, 20 bp, Artificial Sequence
  chemically synthesized
gtgattcttatgtgctaggc

SEQ ID NO: 146989 - DNA, 20 bp, Artificial Sequence
  chemically synthesized
tgattcttatgtgctaggca

SEQ ID NO: 146990 - DNA, 20 bp, Artificial Sequence
  chemically synthesized
ggtttatgaagaaccttgcc

SEQ ID NO: 146991 - DNA, 20 bp, Artificial Sequence
  chemically synthesized
gaaataaaagagggtttatg

SEQ ID NO: 146992 - DNA, 20 bp, Artificial Sequence
  chemically synthesized
ggtaaaggtgaaataaaaga

SEQ ID NO: 146993 - DNA, 20 bp, Artificial Sequence
  chemically synthesized
tggtaaaggtgaaataaaag

SEQ ID NO: 146994 - DNA, 20 bp, Artificial Sequence
  chemically synthesized
ttggtaaaggtgaaataaaa

SEQ ID NO: 146995 - DNA, 20 bp, Artificial Sequence
  chemically synthesized
gtttggtaaaggtgaaataa

SEQ ID NO: 146996 - DNA, 20 bp, Artificial Sequence
  chemically synthesized
ccctgaagatggtttggtaa

SEQ ID NO: 146997 - DNA, 20 bp, Artificial Sequence
  chemically synthesized
accctgaagatggtttggta

SEQ ID NO: 146998 - DNA, 20 bp, Artificial Sequence
  chemically synthesized
catctaccctgaagatggtt

SEQ ID NO: 146999 - DNA, 20 bp, Artificial Sequence
  chemically synthesized
cacctttaccaaaccatctt

SEQ ID NO: 147000 - DNA, 20 bp, Artificial Sequence
  chemically synthesized
acctttaccaaaccatcttc

SEQ ID NO: 147001 - DNA, 20 bp, Artificial Sequence
  chemically synthesized
cctttaccaaaccatcttca

SEQ ID NO: 147002 - DNA, 20 bp, Artificial Sequence
  chemically synthesized
gataacatctaccctgaaga

SEQ ID NO: 147003 - DNA, 20 bp, Artificial Sequence
  chemically synthesized
ttaccaaaccatcttcaggg

SEQ ID NO: 147004 - DNA, 20 bp, Artificial Sequence
  chemically synthesized
ggatgataacatctaccctg

SEQ ID NO: 147005 - DNA, 20 bp, Artificial Sequence
  chemically synthesized
ttcgttaccttggtaaaagg

SEQ ID NO: 147006 - DNA, 20 bp, Artificial Sequence
  chemically synthesized
tttcgttaccttggtaaaag

SEQ ID NO: 147007 - DNA, 20 bp, Artificial Sequence
  chemically synthesized
gttatcatcccccttttacc

SEQ ID NO: 147008 - DNA, 20 bp, Artificial Sequence
  chemically synthesized
gtttcgttaccttggtaaaa

SEQ ID NO: 147009 - DNA, 20 bp, Artificial Sequence
  chemically synthesized
ttatcatcccccttttacca

SEQ ID NO: 147010 - DNA, 20 bp, Artificial Sequence
  chemically synthesized
agtttcgttaccttggtaaa

SEQ ID NO: 147011 - DNA, 20 bp, Artificial Sequence
  chemically synthesized
aagtttcgttaccttggtaa

SEQ ID NO: 147012 - DNA, 20 bp, Artificial Sequence
  chemically synthesized
ctgaacaagtttcgttacct

SEQ ID NO: 147013 - DNA, 20 bp, Artificial Sequence
  chemically synthesized
ccaaggtaacgaaacttgtt

SEQ ID NO: 147014 - DNA, 20 bp, Artificial Sequence
  chemically synthesized
caaggtaacgaaacttgttc

SEQ ID NO: 147015 - DNA, 20 bp, Artificial Sequence
  chemically synthesized
gttaatgtgagatcctgaac

SEQ ID NO: 147016 - DNA, 20 bp, Artificial Sequence
  chemically synthesized
gaaacatcacttgttaatgt

SEQ ID NO: 147017 - DNA, 20 bp, Artificial Sequence
  chemically synthesized
gttcaggatctcacattaac

SEQ ID NO: 147018 - DNA, 20 bp, Artificial Sequence
  chemically synthesized
cattaacaagtgatgtttcc

SEQ ID NO: 147019 - DNA, 20 bp, Artificial Sequence
  chemically synthesized
agtggttaagcacattgtct

SEQ ID NO: 147020 - DNA, 20 bp, Artificial Sequence
  chemically synthesized
tagaaatatgtgcagtggtt

SEQ ID NO: 147021 - DNA, 20 bp, Artificial Sequence
  chemically synthesized
attcttagaaatatgtgcag

SEQ ID NO: 147022 - DNA, 20 bp, Artificial Sequence
  chemically synthesized
atgattcttagaaatatgtg

SEQ ID NO: 147023 - DNA, 20 bp, Artificial Sequence
  chemically synthesized
taaccactgcacatatttct

SEQ ID NO: 147024 - DNA, 20 bp, Artificial Sequence
  chemically synthesized
gcacatatttctaagaatca

SEQ ID NO: 147025 - DNA, 20 bp, Artificial Sequence
  chemically synthesized
acctgatgtcctatgattct

SEQ ID NO: 147026 - DNA, 20 bp, Artificial Sequence
  chemically synthesized
cacatatttctaagaatcat

SEQ ID NO: 147027 - DNA, 20 bp, Artificial Sequence
  chemically synthesized
ttctaagaatcataggacat

SEQ ID NO: 147028 - DNA, 20 bp, Artificial Sequence
  chemically synthesized
tctaagaatcataggacatc

SEQ ID NO: 147029 - DNA, 20 bp, Artificial Sequence
  chemically synthesized
attgaatgagacatgtaaga

SEQ ID NO: 147030 - DNA, 20 bp, Artificial Sequence
  chemically synthesized
gcatattgaatgagacatgt

SEQ ID NO: 147031 - DNA, 20 bp, Artificial Sequence
  chemically synthesized
ataattcttgcatattgaat

SEQ ID NO: 147032 - DNA, 20 bp, Artificial Sequence
  chemically synthesized
acatgtctcattcaatatgc

SEQ ID NO: 147033 - DNA, 20 bp, Artificial Sequence
  chemically synthesized
tatagctcttagaagtattt

SEQ ID NO: 147034 - DNA, 20 bp, Artificial Sequence
  chemically synthesized
ttaatcactcaaatacttct

SEQ ID NO: 147035 - DNA, 20 bp, Artificial Sequence
  chemically synthesized
aatcactcaaatacttctaa

SEQ ID NO: 147036 - DNA, 20 bp, Artificial Sequence
  chemically synthesized
ttataagctatagctcttag

SEQ ID NO: 147037 - DNA, 20 bp, Artificial Sequence
  chemically synthesized
tcaaatacttctaagagcta

SEQ ID NO: 147038 - DNA, 20 bp, Artificial Sequence
  chemically synthesized
atattataagctatagctct

SEQ ID NO: 147039 - DNA, 20 bp, Artificial Sequence
  chemically synthesized
ataccatatattataagcta

SEQ ID NO: 147040 - DNA, 20 bp, Artificial Sequence
  chemically synthesized
tcatggataccatatattat

SEQ ID NO: 147041 - DNA, 20 bp, Artificial Sequence
  chemically synthesized
gagctatagcttataatata

SEQ ID NO: 147042 - DNA, 20 bp, Artificial Sequence
  chemically synthesized
tggatattagatatatttca

SEQ ID NO: 147043 - DNA, 20 bp, Artificial Sequence
  chemically synthesized
tcccaaattaaaatggatat

SEQ ID NO: 147044 - DNA, 20 bp, Artificial Sequence
  chemically synthesized
tcttctctcccaaattaaaa

SEQ ID NO: 147045 - DNA, 20 bp, Artificial Sequence
  chemically synthesized
atctaatatccattttaatt

SEQ ID NO: 147046 - DNA, 20 bp, Artificial Sequence
  chemically synthesized
tctaatatccattttaattt

SEQ ID NO: 147047 - DNA, 20 bp, Artificial Sequence
  chemically synthesized
taatatccattttaatttgg

SEQ ID NO: 147048 - DNA, 20 bp, Artificial Sequence
  chemically synthesized
atatccattttaatttggga

SEQ ID NO: 147049 - DNA, 20 bp, Artificial Sequence
  chemically synthesized
tccattttaatttgggagag

SEQ ID NO: 147050 - DNA, 20 bp, Artificial Sequence
  chemically synthesized
ggagagaagatcatttgata

SEQ ID NO: 147051 - DNA, 20 bp, Artificial Sequence
  chemically synthesized
tgttacaatccatattttta

SEQ ID NO: 147052 - DNA, 20 bp, Artificial Sequence
  chemically synthesized
ttgatatagctataaaaata

SEQ ID NO: 147053 - DNA, 20 bp, Artificial Sequence
  chemically synthesized
aaatatggattgtaacaatc

SEQ ID NO: 147054 - DNA, 20 bp, Artificial Sequence
  chemically synthesized
ttgtaacaatcaagcgcatc

SEQ ID NO: 147055 - DNA, 20 bp, Artificial Sequence
  chemically synthesized
tttaagttgtgagtggatgc

SEQ ID NO: 147056 - DNA, 20 bp, Artificial Sequence
  chemically synthesized
ggtaatatttaagttgtgag

SEQ ID NO: 147057 - DNA, 20 bp, Artificial Sequence
  chemically synthesized
aagggtaatatttaagttgt

SEQ ID NO: 147058 - DNA, 20 bp, Artificial Sequence
  chemically synthesized
atttctcaagggtaatattt

SEQ ID NO: 147059 - DNA, 20 bp, Artificial Sequence
  chemically synthesized
acaacttaaatattaccctt

SEQ ID NO: 147060 - DNA, 20 bp, Artificial Sequence
  chemically synthesized
aggttggagatatttctcaa

SEQ ID NO: 147061 - DNA, 20 bp, Artificial Sequence
  chemically synthesized
caggttggagatatttctca

SEQ ID NO: 147062 - DNA, 20 bp, Artificial Sequence
  chemically synthesized
tcaggttggagatatttctc

SEQ ID NO: 147063 - DNA, 20 bp, Artificial Sequence
  chemically synthesized
atatgtttaaagtcaggttg

SEQ ID NO: 147064 - DNA, 20 bp, Artificial Sequence
  chemically synthesized
ggatatgtttaaagtcaggt

SEQ ID NO: 147065 - DNA, 20 bp, Artificial Sequence
  chemically synthesized
ggaaggatatgtttaaagtc

SEQ ID NO: 147066 - DNA, 20 bp, Artificial Sequence
  chemically synthesized
aggaaggatatgtttaaagt

SEQ ID NO: 147067 - DNA, 20 bp, Artificial Sequence
  chemically synthesized
gtgaaggaaggatatgttta

SEQ ID NO: 147068 - DNA, 20 bp, Artificial Sequence
  chemically synthesized
ctattcaagttagtgaagga

SEQ ID NO: 147069 - DNA, 20 bp, Artificial Sequence
  chemically synthesized
tctattcaagttagtgaagg

SEQ ID NO: 147070 - DNA, 20 bp, Artificial Sequence
  chemically synthesized
ttctctattcaagttagtga

SEQ ID NO: 147071 - DNA, 20 bp, Artificial Sequence
  chemically synthesized
tttctctattcaagttagtg

SEQ ID NO: 147072 - DNA, 20 bp, Artificial Sequence
  chemically synthesized
ccttccttcactaacttgaa

SEQ ID NO: 147073 - DNA, 20 bp, Artificial Sequence
  chemically synthesized
gattatttctctattcaagt

SEQ ID NO: 147074 - DNA, 20 bp, Artificial Sequence
  chemically synthesized
ttccttcactaacttgaata

SEQ ID NO: 147075 - DNA, 20 bp, Artificial Sequence
  chemically synthesized
caatgattatttctctattc

SEQ ID NO: 147076 - DNA, 20 bp, Artificial Sequence
  chemically synthesized
atgccaactaaaacaggaaa

SEQ ID NO: 147077 - DNA, 20 bp, Artificial Sequence
  chemically synthesized
gatgccaactaaaacaggaa

SEQ ID NO: 147078 - DNA, 20 bp, Artificial Sequence
  chemically synthesized
atcattgccttttcctgttt

SEQ ID NO: 147079 - DNA, 20 bp, Artificial Sequence
  chemically synthesized
tagatgatgccaactaaaac

SEQ ID NO: 147080 - DNA, 20 bp, Artificial Sequence
  chemically synthesized
ttgccttttcctgttttagt

SEQ ID NO: 147081 - DNA, 20 bp, Artificial Sequence
  chemically synthesized
ttagatgatgccaactaaaa

SEQ ID NO: 147082 - DNA, 20 bp, Artificial Sequence
  chemically synthesized
tgttttagttggcatcatct

SEQ ID NO: 147083 - DNA, 20 bp, Artificial Sequence
  chemically synthesized
gttagttatagaagggcact

SEQ ID NO: 147084 - DNA, 20 bp, Artificial Sequence
  chemically synthesized
atataatgttagttatagaa

SEQ ID NO: 147085 - DNA, 20 bp, Artificial Sequence
  chemically synthesized
catataatgttagttataga

SEQ ID NO: 147086 - DNA, 20 bp, Artificial Sequence
  chemically synthesized
tcatataatgttagttatag

SEQ ID NO: 147087 - DNA, 20 bp, Artificial Sequence
  chemically synthesized
aattcatataatgttagtta

SEQ ID NO: 147088 - DNA, 20 bp, Artificial Sequence
  chemically synthesized
tagatgaattcatataatgt

SEQ ID NO: 147089 - DNA, 20 bp, Artificial Sequence
  chemically synthesized
tgcttttcactgagcgcatg

SEQ ID NO: 147090 - DNA, 20 bp, Artificial Sequence
  chemically synthesized
tgaattcatctacatgcgct

SEQ ID NO: 147091 - DNA, 20 bp, Artificial Sequence
  chemically synthesized
atctacatgcgctcagtgaa

SEQ ID NO: 147092 - DNA, 20 bp, Artificial Sequence
  chemically synthesized
gagaaaccctgcttttcact

SEQ ID NO: 147093 - DNA, 20 bp, Artificial Sequence
  chemically synthesized
tacatgcgctcagtgaaaag

SEQ ID NO: 147094 - DNA, 20 bp, Artificial Sequence
  chemically synthesized
acatgcgctcagtgaaaagc

SEQ ID NO: 147095 - DNA, 20 bp, Artificial Sequence
  chemically synthesized
catgcgctcagtgaaaagca

SEQ ID NO: 147096 - DNA, 20 bp, Artificial Sequence
  chemically synthesized
aaagcagggtttctcaatct

SEQ ID NO: 147097 - DNA, 20 bp, Artificial Sequence
  chemically synthesized
atgtcaatagtgctgagatt

SEQ ID NO: 147098 - DNA, 20 bp, Artificial Sequence
  chemically synthesized
acaaaaatgtcaatagtgct

SEQ ID NO: 147099 - DNA, 20 bp, Artificial Sequence
  chemically synthesized
atctgggacaaaaatgtcaa

SEQ ID NO: 147100 - DNA, 20 bp, Artificial Sequence
  chemically synthesized
cactattgacatttttgtcc

SEQ ID NO: 147101 - DNA, 20 bp, Artificial Sequence
  chemically synthesized
ctcacgacaaaaaattatct

SEQ ID NO: 147102 - DNA, 20 bp, Artificial Sequence
  chemically synthesized
actcacgacaaaaaattatc

SEQ ID NO: 147103 - DNA, 20 bp, Artificial Sequence
  chemically synthesized
cccagataattttttgtcgt

SEQ ID NO: 147104 - DNA, 20 bp, Artificial Sequence
  chemically synthesized
agataattttttgtcgtgag

SEQ ID NO: 147105 - DNA, 20 bp, Artificial Sequence
  chemically synthesized
tgatcctacaatgcacagga

SEQ ID NO: 147106 - DNA, 20 bp, Artificial Sequence
  chemically synthesized
attctgatcctacaatgcac

SEQ ID NO: 147107 - DNA, 20 bp, Artificial Sequence
  chemically synthesized
agtggctgtcctgtgcattg

SEQ ID NO: 147108 - DNA, 20 bp, Artificial Sequence
  chemically synthesized
aattctgatcctacaatgca

SEQ ID NO: 147109 - DNA, 20 bp, Artificial Sequence
  chemically synthesized
gtggctgtcctgtgcattgt

SEQ ID NO: 147110 - DNA, 20 bp, Artificial Sequence
  chemically synthesized
tgtcctgtgcattgtaggat

SEQ ID NO: 147111 - DNA, 20 bp, Artificial Sequence
  chemically synthesized
gtaggatcagaattgcttgt

SEQ ID NO: 147112 - DNA, 20 bp, Artificial Sequence
  chemically synthesized
ctctggccagagatactgac

SEQ ID NO: 147113 - DNA, 20 bp, Artificial Sequence
  chemically synthesized
gaattgcttgtcagtatctc

SEQ ID NO: 147114 - DNA, 20 bp, Artificial Sequence
  chemically synthesized
tgcttgtcagtatctctggc

SEQ ID NO: 147115 - DNA, 20 bp, Artificial Sequence
  chemically synthesized
cttgtcagtatctctggcca

SEQ ID NO: 147116 - DNA, 20 bp, Artificial Sequence
  chemically synthesized
ctaggagggagctctggcca

SEQ ID NO: 147117 - DNA, 20 bp, Artificial Sequence
  chemically synthesized
atctaggagggagctctggc

SEQ ID NO: 147118 - DNA, 20 bp, Artificial Sequence
  chemically synthesized
gtacatctaggagggagctc

SEQ ID NO: 147119 - DNA, 20 bp, Artificial Sequence
  chemically synthesized
ctctggccagagctccctcc

SEQ ID NO: 147120 - DNA, 20 bp, Artificial Sequence
  chemically synthesized
ttggttgtacatctaggagg

SEQ ID NO: 147121 - DNA, 20 bp, Artificial Sequence
  chemically synthesized
ttttggttgtacatctagga

SEQ ID NO: 147122 - DNA, 20 bp, Artificial Sequence
  chemically synthesized
tttttggttgtacatctagg

SEQ ID NO: 147123 - DNA, 20 bp, Artificial Sequence
  chemically synthesized
atttttggttgtacatctag

SEQ ID NO: 147124 - DNA, 20 bp, Artificial Sequence
  chemically synthesized
acatttttggttgtacatct

SEQ ID NO: 147125 - DNA, 20 bp, Artificial Sequence
  chemically synthesized
gacatttttggttgtacatc

SEQ ID NO: 147126 - DNA, 20 bp, Artificial Sequence
  chemically synthesized
gtaatgtcaggagacatttt

SEQ ID NO: 147127 - DNA, 20 bp, Artificial Sequence
  chemically synthesized
gagacatttggtaatgtcag

SEQ ID NO: 147128 - DNA, 20 bp, Artificial Sequence
  chemically synthesized
aggagacatttggtaatgtc

SEQ ID NO: 147129 - DNA, 20 bp, Artificial Sequence
  chemically synthesized
caggagacatttggtaatgt

SEQ ID NO: 147130 - DNA, 20 bp, Artificial Sequence
  chemically synthesized
ttctttcctcaggagacatt

SEQ ID NO: 147131 - DNA, 20 bp, Artificial Sequence
  chemically synthesized
gacattaccaaatgtctcct

SEQ ID NO: 147132 - DNA, 20 bp, Artificial Sequence
  chemically synthesized
acattaccaaatgtctcctg

SEQ ID NO: 147133 - DNA, 20 bp, Artificial Sequence
  chemically synthesized
taccaaatgtctcctgagga

SEQ ID NO: 147134 - DNA, 20 bp, Artificial Sequence
  chemically synthesized
agcaatttttctttcctcag

SEQ ID NO: 147135 - DNA, 20 bp, Artificial Sequence
  chemically synthesized
taagcaatttttctttcctc

SEQ ID NO: 147136 - DNA, 20 bp, Artificial Sequence
  chemically synthesized
ataagcaatttttctttcct

SEQ ID NO: 147137 - DNA, 20 bp, Artificial Sequence
  chemically synthesized
gaggaaagaaaaattgctta

SEQ ID NO: 147138 - DNA, 20 bp, Artificial Sequence
  chemically synthesized
aagaaaaattgcttatggtt

SEQ ID NO: 147139 - DNA, 20 bp, Artificial Sequence
  chemically synthesized
attgagacatgctcaaccat

SEQ ID NO: 147140 - DNA, 20 bp, Artificial Sequence
  chemically synthesized
gttgagcatgtctcaattaa

SEQ ID NO: 147141 - DNA, 20 bp, Artificial Sequence
  chemically synthesized
ttgagcatgtctcaattaaa

SEQ ID NO: 147142 - DNA, 20 bp, Artificial Sequence
  chemically synthesized
gatggaaaatccttttaatt

SEQ ID NO: 147143 - DNA, 20 bp, Artificial Sequence
  chemically synthesized
ggtgggtgggtagggagaga

SEQ ID NO: 147144 - DNA, 20 bp, Artificial Sequence
  chemically synthesized
gagaggtgggtgggtaggga

SEQ ID NO: 147145 - DNA, 20 bp, Artificial Sequence
  chemically synthesized
ttgagaggtgggtgggtagg

SEQ ID NO: 147146 - DNA, 20 bp, Artificial Sequence
  chemically synthesized
atttgagaggtgggtgggta

SEQ ID NO: 147147 - DNA, 20 bp, Artificial Sequence
  chemically synthesized
tatttgagaggtgggtgggt

SEQ ID NO: 147148 - DNA, 20 bp, Artificial Sequence
  chemically synthesized
ctatttgagaggtgggtggg

SEQ ID NO: 147149 - DNA, 20 bp, Artificial Sequence
  chemically synthesized
cagctatttgagaggtgggt

SEQ ID NO: 147150 - DNA, 20 bp, Artificial Sequence
  chemically synthesized
gcagctatttgagaggtggg

SEQ ID NO: 147151 - DNA, 20 bp, Artificial Sequence
  chemically synthesized
taagcagctatttgagaggt

SEQ ID NO: 147152 - DNA, 20 bp, Artificial Sequence
  chemically synthesized
ctaagcagctatttgagagg

SEQ ID NO: 147153 - DNA, 20 bp, Artificial Sequence
  chemically synthesized
ctacccacccacctctcaaa

SEQ ID NO: 147154 - DNA, 20 bp, Artificial Sequence
  chemically synthesized
attctaagcagctatttgag

SEQ ID NO: 147155 - DNA, 20 bp, Artificial Sequence
  chemically synthesized
aattctaagcagctatttga

SEQ ID NO: 147156 - DNA, 20 bp, Artificial Sequence
  chemically synthesized
caaattctaagcagctattt

SEQ ID NO: 147157 - DNA, 20 bp, Artificial Sequence
  chemically synthesized
ccacctctcaaatagctgct

SEQ ID NO: 147158 - DNA, 20 bp, Artificial Sequence
  chemically synthesized
tttccagcacaaattctaag

SEQ ID NO: 147159 - DNA, 20 bp, Artificial Sequence
  chemically synthesized
tgatttccagcacaaattct

SEQ ID NO: 147160 - DNA, 20 bp, Artificial Sequence
  chemically synthesized
tagctgcttagaatttgtgc

SEQ ID NO: 147161 - DNA, 20 bp, Artificial Sequence
  chemically synthesized
ggataggcataaatgatttc

SEQ ID NO: 147162 - DNA, 20 bp, Artificial Sequence
  chemically synthesized
tgagaaaaaaaaaattggat

SEQ ID NO: 147163 - DNA, 20 bp, Artificial Sequence
  chemically synthesized
atgagaaaaaaaaaattgga

SEQ ID NO: 147164 - DNA, 20 bp, Artificial Sequence
  chemically synthesized
aggaatgagaaaaaaaaaat

SEQ ID NO: 147165 - DNA, 20 bp, Artificial Sequence
  chemically synthesized
attttttttttctcattcct

SEQ ID NO: 147166 - DNA, 20 bp, Artificial Sequence
  chemically synthesized
aatttctacttctgaggaat

SEQ ID NO: 147167 - DNA, 20 bp, Artificial Sequence
  chemically synthesized
ttttttttctcattcctcag

SEQ ID NO: 147168 - DNA, 20 bp, Artificial Sequence
  chemically synthesized
tttttctcattcctcagaag

SEQ ID NO: 147169 - DNA, 20 bp, Artificial Sequence
  chemically synthesized
tctcttaatttctacttctg

SEQ ID NO: 147170 - DNA, 20 bp, Artificial Sequence
  chemically synthesized
ttctcttaatttctacttct

SEQ ID NO: 147171 - DNA, 20 bp, Artificial Sequence
  chemically synthesized
attcctcagaagtagaaatt

SEQ ID NO: 147172 - DNA, 20 bp, Artificial Sequence
  chemically synthesized
tcctcagaagtagaaattaa

SEQ ID NO: 147173 - DNA, 20 bp, Artificial Sequence
  chemically synthesized
agaaattaagagaaattgtt

SEQ ID NO: 147174 - DNA, 20 bp, Artificial Sequence
  chemically synthesized
gaaattaagagaaattgtta

SEQ ID NO: 147175 - DNA, 20 bp, Artificial Sequence
  chemically synthesized
aaattaagagaaattgttaa

SEQ ID NO: 147176 - DNA, 20 bp, Artificial Sequence
  chemically synthesized
caatatcatgttggaaagag

SEQ ID NO: 147177 - DNA, 20 bp, Artificial Sequence
  chemically synthesized
gcccaatatcatgttggaaa

SEQ ID NO: 147178 - DNA, 20 bp, Artificial Sequence
  chemically synthesized
ctgcccaatatcatgttgga

SEQ ID NO: 147179 - DNA, 20 bp, Artificial Sequence
  chemically synthesized
gtgcctgcccaatatcatgt

SEQ ID NO: 147180 - DNA, 20 bp, Artificial Sequence
  chemically synthesized
ttctctttccaacatgatat

SEQ ID NO: 147181 - DNA, 20 bp, Artificial Sequence
  chemically synthesized
tctctttccaacatgatatt

SEQ ID NO: 147182 - DNA, 20 bp, Artificial Sequence
  chemically synthesized
ctttccaacatgatattggg

SEQ ID NO: 147183 - DNA, 20 bp, Artificial Sequence
  chemically synthesized
tttccaacatgatattgggc

SEQ ID NO: 147184 - DNA, 20 bp, Artificial Sequence
  chemically synthesized
atgatattgggcaggcactg

SEQ ID NO: 147185 - DNA, 20 bp, Artificial Sequence
  chemically synthesized
tggtttacttatggatactt

SEQ ID NO: 147186 - DNA, 20 bp, Artificial Sequence
  chemically synthesized
gcaggcactgaagtatccat

SEQ ID NO: 147187 - DNA, 20 bp, Artificial Sequence
  chemically synthesized
ataagtttgtggtttactta

SEQ ID NO: 147188 - DNA, 20 bp, Artificial Sequence
  chemically synthesized
ccttggcagccataagtttg

SEQ ID NO: 147189 - DNA, 20 bp, Artificial Sequence
  chemically synthesized
ataagtaaaccacaaactta

SEQ ID NO: 147190 - DNA, 20 bp, Artificial Sequence
  chemically synthesized
tattattccttggcagccat

SEQ ID NO: 147191 - DNA, 20 bp, Artificial Sequence
  chemically synthesized
accacaaacttatggctgcc

SEQ ID NO: 147192 - DNA, 20 bp, Artificial Sequence
  chemically synthesized
ccacaaacttatggctgcca

SEQ ID NO: 147193 - DNA, 20 bp, Artificial Sequence
  chemically synthesized
tattatttattattccttgg

SEQ ID NO: 147194 - DNA, 20 bp, Artificial Sequence
  chemically synthesized
taatattatttattattcct

SEQ ID NO: 147195 - DNA, 20 bp, Artificial Sequence
  chemically synthesized
gaataataaataatattaca

SEQ ID NO: 147196 - DNA, 20 bp, Artificial Sequence
  chemically synthesized
aataataaataatattacac

SEQ ID NO: 147197 - DNA, 20 bp, Artificial Sequence
  chemically synthesized
atattacacaggaactgtct

SEQ ID NO: 147198 - DNA, 20 bp, Artificial Sequence
  chemically synthesized
tgtcatttttgtcactaaga

SEQ ID NO: 147199 - DNA, 20 bp, Artificial Sequence
  chemically synthesized
atgttgtcatttttgtcact

SEQ ID NO: 147200 - DNA, 20 bp, Artificial Sequence
  chemically synthesized
aaaaatgacaacatctctgc

SEQ ID NO: 147201 - DNA, 20 bp, Artificial Sequence
  chemically synthesized
aaatgacaacatctctgctg

SEQ ID NO: 147202 - DNA, 20 bp, Artificial Sequence
  chemically synthesized
atgacaacatctctgctgga

SEQ ID NO: 147203 - DNA, 20 bp, Artificial Sequence
  chemically synthesized
tggacatttactctccagca

SEQ ID NO: 147204 - DNA, 20 bp, Artificial Sequence
  chemically synthesized
tgtggacatttactctccag

SEQ ID NO: 147205 - DNA, 20 bp, Artificial Sequence
  chemically synthesized
atctgtggacatttactctc

SEQ ID NO: 147206 - DNA, 20 bp, Artificial Sequence
  chemically synthesized
tgctggagagtaaatgtcca

SEQ ID NO: 147207 - DNA, 20 bp, Artificial Sequence
  chemically synthesized
agatgcaagaggagaatctg

SEQ ID NO: 147208 - DNA, 20 bp, Artificial Sequence
  chemically synthesized
caaaagtgtagatgcaagag

SEQ ID NO: 147209 - DNA, 20 bp, Artificial Sequence
  chemically synthesized
gacaaaagtgtagatgcaag

SEQ ID NO: 147210 - DNA, 20 bp, Artificial Sequence
  chemically synthesized
tgacaaaagtgtagatgcaa

SEQ ID NO: 147211 - DNA, 20 bp, Artificial Sequence
  chemically synthesized
cttgacaaaagtgtagatgc

SEQ ID NO: 147212 - DNA, 20 bp, Artificial Sequence
  chemically synthesized
aatatctcttgacaaaagtg

SEQ ID NO: 147213 - DNA, 20 bp, Artificial Sequence
  chemically synthesized
cttgcatctacacttttgtc

SEQ ID NO: 147214 - DNA, 20 bp, Artificial Sequence
  chemically synthesized
tgcatctacacttttgtcaa

SEQ ID NO: 147215 - DNA, 20 bp, Artificial Sequence
  chemically synthesized
tctggaatatctcttgacaa

SEQ ID NO: 147216 - DNA, 20 bp, Artificial Sequence
  chemically synthesized
acttttgtcaagagatattc

SEQ ID NO: 147217 - DNA, 20 bp, Artificial Sequence
  chemically synthesized
tggctcttaatgggagaatc

SEQ ID NO: 147218 - DNA, 20 bp, Artificial Sequence
  chemically synthesized
atattccagattctcccatt

SEQ ID NO: 147219 - DNA, 20 bp, Artificial Sequence
  chemically synthesized
attccagattctcccattaa

SEQ ID NO: 147220 - DNA, 20 bp, Artificial Sequence
  chemically synthesized
cagactatggctcttaatgg

SEQ ID NO: 147221 - DNA, 20 bp, Artificial Sequence
  chemically synthesized
aacagactatggctcttaat

SEQ ID NO: 147222 - DNA, 20 bp, Artificial Sequence
  chemically synthesized
aaacagactatggctcttaa

SEQ ID NO: 147223 - DNA, 20 bp, Artificial Sequence
  chemically synthesized
gattctcccattaagagcca

SEQ ID NO: 147224 - DNA, 20 bp, Artificial Sequence
  chemically synthesized
aggagtggagaaacagacta

SEQ ID NO: 147225 - DNA, 20 bp, Artificial Sequence
  chemically synthesized
atattcaaggagtggagaaa

SEQ ID NO: 147226 - DNA, 20 bp, Artificial Sequence
  chemically synthesized
caatccatattcaaggagtg

SEQ ID NO: 147227 - DNA, 20 bp, Artificial Sequence
  chemically synthesized
accaatccatattcaaggag

SEQ ID NO: 147228 - DNA, 20 bp, Artificial Sequence
  chemically synthesized
ttgaccaatccatattcaag

SEQ ID NO: 147229 - DNA, 20 bp, Artificial Sequence
  chemically synthesized
gtttctccactccttgaata

SEQ ID NO: 147230 - DNA, 20 bp, Artificial Sequence
  chemically synthesized
acttgaccaatccatattca

SEQ ID NO: 147231 - DNA, 20 bp, Artificial Sequence
  chemically synthesized
gacttgaccaatccatattc

SEQ ID NO: 147232 - DNA, 20 bp, Artificial Sequence
  chemically synthesized
tccactccttgaatatggat

SEQ ID NO: 147233 - DNA, 20 bp, Artificial Sequence
  chemically synthesized
tccttgaatatggattggtc

SEQ ID NO: 147234 - DNA, 20 bp, Artificial Sequence
  chemically synthesized
attggtcaagtcacttgttt

SEQ ID NO: 147235 - DNA, 20 bp, Artificial Sequence
  chemically synthesized
gatacctcattagccgaaac

SEQ ID NO: 147236 - DNA, 20 bp, Artificial Sequence
  chemically synthesized
agtcacttgtttcggctaat

SEQ ID NO: 147237 - DNA, 20 bp, Artificial Sequence
  chemically synthesized
gtcacttgtttcggctaatg

SEQ ID NO: 147238 - DNA, 20 bp, Artificial Sequence
  chemically synthesized
catgtttgctgatacctcat

SEQ ID NO: 147239 - DNA, 20 bp, Artificial Sequence
  chemically synthesized
tgtttcggctaatgaggtat

SEQ ID NO: 147240 - DNA, 20 bp, Artificial Sequence
  chemically synthesized
ggtatcagcaaacatgacat

SEQ ID NO: 147241 - DNA, 20 bp, Artificial Sequence
  chemically synthesized
atcagcaaacatgacataag

SEQ ID NO: 147242 - DNA, 20 bp, Artificial Sequence
  chemically synthesized
cagcaaacatgacataagca

SEQ ID NO: 147243 - DNA, 20 bp, Artificial Sequence
  chemically synthesized
agcaaacatgacataagcag

SEQ ID NO: 147244 - DNA, 20 bp, Artificial Sequence
  chemically synthesized
cccaacacccaagcattgtt

SEQ ID NO: 147245 - DNA, 20 bp, Artificial Sequence
  chemically synthesized
agcagaggcttaacaatgct

SEQ ID NO: 147246 - DNA, 20 bp, Artificial Sequence
  chemically synthesized
gcagaggcttaacaatgctt

SEQ ID NO: 147247 - DNA, 20 bp, Artificial Sequence
  chemically synthesized
gcttaacaatgcttgggtgt

SEQ ID NO: 147248 - DNA, 20 bp, Artificial Sequence
  chemically synthesized
cttaacaatgcttgggtgtt

SEQ ID NO: 147249 - DNA, 20 bp, Artificial Sequence
  chemically synthesized
ccaagcatagcccaacaccc

SEQ ID NO: 147250 - DNA, 20 bp, Artificial Sequence
  chemically synthesized
cttgggtgttgggctatgct

SEQ ID NO: 147251 - DNA, 20 bp, Artificial Sequence
  chemically synthesized
cggtggaagagttccaagca

SEQ ID NO: 147252 - DNA, 20 bp, Artificial Sequence
  chemically synthesized
catagcggtggaagagttcc

SEQ ID NO: 147253 - DNA, 20 bp, Artificial Sequence
  chemically synthesized
atagttccatagcggtggaa

SEQ ID NO: 147254 - DNA, 20 bp, Artificial Sequence
  chemically synthesized
gcatagttccatagcggtgg

SEQ ID NO: 147255 - DNA, 20 bp, Artificial Sequence
  chemically synthesized
ttggaactcttccaccgcta

SEQ ID NO: 147256 - DNA, 20 bp, Artificial Sequence
  chemically synthesized
ctagcatagttccatagcgg

SEQ ID NO: 147257 - DNA, 20 bp, Artificial Sequence
  chemically synthesized
aggctagcatagttccatag

SEQ ID NO: 147258 - DNA, 20 bp, Artificial Sequence
  chemically synthesized
atcaggctagcatagttcca

SEQ ID NO: 147259 - DNA, 20 bp, Artificial Sequence
  chemically synthesized
ccaccgctatggaactatgc

SEQ ID NO: 147260 - DNA, 20 bp, Artificial Sequence
  chemically synthesized
aattattcatcaggctagca

SEQ ID NO: 147261 - DNA, 20 bp, Artificial Sequence
  chemically synthesized
cctgtaattattcatcaggc

SEQ ID NO: 147262 - DNA, 20 bp, Artificial Sequence
  chemically synthesized
cttgcctgtaattattcatc

SEQ ID NO: 147263 - DNA, 20 bp, Artificial Sequence
  chemically synthesized
acttgcctgtaattattcat

SEQ ID NO: 147264 - DNA, 20 bp, Artificial Sequence
  chemically synthesized
gctagcctgatgaataatta

SEQ ID NO: 147265 - DNA, 20 bp, Artificial Sequence
  chemically synthesized
ctagcctgatgaataattac

SEQ ID NO: 147266 - DNA, 20 bp, Artificial Sequence
  chemically synthesized
cctgatgaataattacaggc

SEQ ID NO: 147267 - DNA, 20 bp, Artificial Sequence
  chemically synthesized
gttgagacggtgtgggtgac

SEQ ID NO: 147268 - DNA, 20 bp, Artificial Sequence
  chemically synthesized
agttgagacggtgtgggtga

SEQ ID NO: 147269 - DNA, 20 bp, Artificial Sequence
  chemically synthesized
gttataagttgagacggtgt

SEQ ID NO: 147270 - DNA, 20 bp, Artificial Sequence
  chemically synthesized
ggttataagttgagacggtg

SEQ ID NO: 147271 - DNA, 20 bp, Artificial Sequence
  chemically synthesized
tttttggttataagttgaga

SEQ ID NO: 147272 - DNA, 20 bp, Artificial Sequence
  chemically synthesized
taactttttggttataagtt

SEQ ID NO: 147273 - DNA, 20 bp, Artificial Sequence
  chemically synthesized
tggtataactttttggttat

SEQ ID NO: 147274 - DNA, 20 bp, Artificial Sequence
  chemically synthesized
cgtctcaacttataaccaaa

SEQ ID NO: 147275 - DNA, 20 bp, Artificial Sequence
  chemically synthesized
atatgtctggtataactttt

SEQ ID NO: 147276 - DNA, 20 bp, Artificial Sequence
  chemically synthesized
ttataaccaaaaagttatac

SEQ ID NO: 147277 - DNA, 20 bp, Artificial Sequence
  chemically synthesized
acatgtggcattcatatgtc

SEQ ID NO: 147278 - DNA, 20 bp, Artificial Sequence
  chemically synthesized
agacatatgaatgccacatg

SEQ ID NO: 147279 - DNA, 20 bp, Artificial Sequence
  chemically synthesized
tggtagttgatgaccacatg

SEQ ID NO: 147280 - DNA, 20 bp, Artificial Sequence
  chemically synthesized
cacatgtggtcatcaactac

SEQ ID NO: 147281 - DNA, 20 bp, Artificial Sequence
  chemically synthesized
atgcactcgtggtcagctgg

SEQ ID NO: 147282 - DNA, 20 bp, Artificial Sequence
  chemically synthesized
ttcatgcactcgtggtcagc

SEQ ID NO: 147283 - DNA, 20 bp, Artificial Sequence
  chemically synthesized
atcaactaccagctgaccac

SEQ ID NO: 147284 - DNA, 20 bp, Artificial Sequence
  chemically synthesized
ctcattcatgcactcgtggt

SEQ ID NO: 147285 - DNA, 20 bp, Artificial Sequence
  chemically synthesized
tgtgctcattcatgcactcg

SEQ ID NO: 147286 - DNA, 20 bp, Artificial Sequence
  chemically synthesized
ctgaccacgagtgcatgaat

SEQ ID NO: 147287 - DNA, 20 bp, Artificial Sequence
  chemically synthesized
cacgagtgcatgaatgagca

SEQ ID NO: 147288 - DNA, 20 bp, Artificial Sequence
  chemically synthesized
gtgcatgaatgagcacagct

SEQ ID NO: 147289 - DNA, 20 bp, Artificial Sequence
  chemically synthesized
tgaatgagcacagctgagtc

SEQ ID NO: 147290 - DNA, 20 bp, Artificial Sequence
  chemically synthesized
ggcgattcttttgctagact

SEQ ID NO: 147291 - DNA, 20 bp, Artificial Sequence
  chemically synthesized
agcacagctgagtctagcaa

SEQ ID NO: 147292 - DNA, 20 bp, Artificial Sequence
  chemically synthesized
catcgaggcgattcttttgc

SEQ ID NO: 147293 - DNA, 20 bp, Artificial Sequence
  chemically synthesized
gcttggggcttggttcatcg

SEQ ID NO: 147294 - DNA, 20 bp, Artificial Sequence
  chemically synthesized
tgcttggggcttggttcatc

SEQ ID NO: 147295 - DNA, 20 bp, Artificial Sequence
  chemically synthesized
aagaatcgcctcgatgaacc

SEQ ID NO: 147296 - DNA, 20 bp, Artificial Sequence
  chemically synthesized
gcctcgatgaaccaagcccc

SEQ ID NO: 147297 - DNA, 20 bp, Artificial Sequence
  chemically synthesized
tcttgattctgcttggggct

SEQ ID NO: 147298 - DNA, 20 bp, Artificial Sequence
  chemically synthesized
tcgatgaaccaagccccaag

SEQ ID NO: 147299 - DNA, 20 bp, Artificial Sequence
  chemically synthesized
atgattcttgattctgcttg

SEQ ID NO: 147300 - DNA, 20 bp, Artificial Sequence
  chemically synthesized
catgattcttgattctgctt

SEQ ID NO: 147301 - DNA, 20 bp, Artificial Sequence
  chemically synthesized
tcatgattcttgattctgct

SEQ ID NO: 147302 - DNA, 20 bp, Artificial Sequence
  chemically synthesized
accaagccccaagcagaatc

SEQ ID NO: 147303 - DNA, 20 bp, Artificial Sequence
  chemically synthesized
caagcagaatcaagaatcat

SEQ ID NO: 147304 - DNA, 20 bp, Artificial Sequence
  chemically synthesized
taagaatcattttttttttt

SEQ ID NO: 147305 - DNA, 20 bp, Artificial Sequence
  chemically synthesized
aaaaaaatgattcttatttt

SEQ ID NO: 147306 - DNA, 20 bp, Artificial Sequence
  chemically synthesized
caaatgtagagacttaaaat

SEQ ID NO: 147307 - DNA, 20 bp, Artificial Sequence
  chemically synthesized
ttattttaagtctctacatt

SEQ ID NO: 147308 - DNA, 20 bp, Artificial Sequence
  chemically synthesized
tattttaagtctctacattt

SEQ ID NO: 147309 - DNA, 20 bp, Artificial Sequence
  chemically synthesized
aacaagctaccccaaatgta

SEQ ID NO: 147310 - DNA, 20 bp, Artificial Sequence
  chemically synthesized
attttaagtctctacatttg

SEQ ID NO: 147311 - DNA, 20 bp, Artificial Sequence
  chemically synthesized
gtaacaagctaccccaaatg

SEQ ID NO: 147312 - DNA, 20 bp, Artificial Sequence
  chemically synthesized
ttaagtctctacatttgggg

SEQ ID NO: 147313 - DNA, 20 bp, Artificial Sequence
  chemically synthesized
atttggggtagcttgttaca

SEQ ID NO: 147314 - DNA, 20 bp, Artificial Sequence
  chemically synthesized
gctatctattgctgtgtaac

SEQ ID NO: 147315 - DNA, 20 bp, Artificial Sequence
  chemically synthesized
ggtagcttgttacacagcaa

SEQ ID NO: 147316 - DNA, 20 bp, Artificial Sequence
  chemically synthesized
gcttgttacacagcaataga

SEQ ID NO: 147317 - DNA, 20 bp, Artificial Sequence
  chemically synthesized
acagcaatagatagctgaca

SEQ ID NO: 147318 - DNA, 20 bp, Artificial Sequence
  chemically synthesized
ggtaaaaatggatgctgtgt

SEQ ID NO: 147319 - DNA, 20 bp, Artificial Sequence
  chemically synthesized
aagtgtttaacaggtaaaaa

SEQ ID NO: 147320 - DNA, 20 bp, Artificial Sequence
  chemically synthesized
tttgcgtacaagtgtttaac

SEQ ID NO: 147321 - DNA, 20 bp, Artificial Sequence
  chemically synthesized
ttttgcgtacaagtgtttaa

SEQ ID NO: 147322 - DNA, 20 bp, Artificial Sequence
  chemically synthesized
ttaaatcctgttttgcgtac

SEQ ID NO: 147323 - DNA, 20 bp, Artificial Sequence
  chemically synthesized
ttaaacacttgtacgcaaaa

SEQ ID NO: 147324 - DNA, 20 bp, Artificial Sequence
  chemically synthesized
taaacacttgtacgcaaaac

SEQ ID NO: 147325 - DNA, 20 bp, Artificial Sequence
  chemically synthesized
aatttctgtggtaatgggaa

SEQ ID NO: 147326 - DNA, 20 bp, Artificial Sequence
  chemically synthesized
taatttctgtggtaatggga

SEQ ID NO: 147327 - DNA, 20 bp, Artificial Sequence
  chemically synthesized
ttaatttctgtggtaatggg

SEQ ID NO: 147328 - DNA, 20 bp, Artificial Sequence
  chemically synthesized
aaattcccttcccattacca

SEQ ID NO: 147329 - DNA, 20 bp, Artificial Sequence
  chemically synthesized
cttttaatttctgtggtaat

SEQ ID NO: 147330 - DNA, 20 bp, Artificial Sequence
  chemically synthesized
tcttttaatttctgtggtaa

SEQ ID NO: 147331 - DNA, 20 bp, Artificial Sequence
  chemically synthesized
catttttcttttaatttctg

SEQ ID NO: 147332 - DNA, 20 bp, Artificial Sequence
  chemically synthesized
cccattaccacagaaattaa

SEQ ID NO: 147333 - DNA, 20 bp, Artificial Sequence
  chemically synthesized
ttaaaagaaaaatgcttatc

SEQ ID NO: 147334 - DNA, 20 bp, Artificial Sequence
  chemically synthesized
aaagaaaaatgcttatccag

SEQ ID NO: 147335 - DNA, 20 bp, Artificial Sequence
  chemically synthesized
ctgtgttctctctgctggat

SEQ ID NO: 147336 - DNA, 20 bp, Artificial Sequence
  chemically synthesized
agaaaaatgcttatccagca

SEQ ID NO: 147337 - DNA, 20 bp, Artificial Sequence
  chemically synthesized
aaaaatgcttatccagcaga

SEQ ID NO: 147338 - DNA, 20 bp, Artificial Sequence
  chemically synthesized
tccagctgtgttctctctgc

SEQ ID NO: 147339 - DNA, 20 bp, Artificial Sequence
  chemically synthesized
cttatccagcagagagaaca

SEQ ID NO: 147340 - DNA, 20 bp, Artificial Sequence
  chemically synthesized
tccagcagagagaacacagc

SEQ ID NO: 147341 - DNA, 20 bp, Artificial Sequence
  chemically synthesized
cagagagaacacagctggaa

SEQ ID NO: 147342 - DNA, 20 bp, Artificial Sequence
  chemically synthesized
gagaacacagctggaaaaga

SEQ ID NO: 147343 - DNA, 20 bp, Artificial Sequence
  chemically synthesized
cttaaagactccgtcttttc

SEQ ID NO: 147344 - DNA, 20 bp, Artificial Sequence
  chemically synthesized
gaacacagctggaaaagacg

SEQ ID NO: 147345 - DNA, 20 bp, Artificial Sequence
  chemically synthesized
ctggaaaagacggagtcttt

SEQ ID NO: 147346 - DNA, 20 bp, Artificial Sequence
  chemically synthesized
ccattccacattttaactta

SEQ ID NO: 147347 - DNA, 20 bp, Artificial Sequence
  chemically synthesized
ggagtctttaagttaaaatg

SEQ ID NO: 147348 - DNA, 20 bp, Artificial Sequence
  chemically synthesized
ctttaagttaaaatgtggaa

SEQ ID NO: 147349 - DNA, 20 bp, Artificial Sequence
  chemically synthesized
aaatgtggaatggaattcca

SEQ ID NO: 147350 - DNA, 20 bp, Artificial Sequence
  chemically synthesized
atgtggaatggaattccaca

SEQ ID NO: 147351 - DNA, 20 bp, Artificial Sequence
  chemically synthesized
gaatggaattccacagagaa

SEQ ID NO: 147352 - DNA, 20 bp, Artificial Sequence
  chemically synthesized
tgtgaatcttccattctctg

SEQ ID NO: 147353 - DNA, 20 bp, Artificial Sequence
  chemically synthesized
tggaattccacagagaatgg

SEQ ID NO: 147354 - DNA, 20 bp, Artificial Sequence
  chemically synthesized
cagagaatggaagattcaca

SEQ ID NO: 147355 - DNA, 20 bp, Artificial Sequence
  chemically synthesized
gattcacatagtcactctat

SEQ ID NO: 147356 - DNA, 20 bp, Artificial Sequence
  chemically synthesized
attcacatagtcactctatg

SEQ ID NO: 147357 - DNA, 20 bp, Artificial Sequence
  chemically synthesized
cctgatttattgacctcata

SEQ ID NO: 147358 - DNA, 20 bp, Artificial Sequence
  chemically synthesized
tgcctgatttattgacctca

SEQ ID NO: 147359 - DNA, 20 bp, Artificial Sequence
  chemically synthesized
actctatgaggtcaataaat

SEQ ID NO: 147360 - DNA, 20 bp, Artificial Sequence
  chemically synthesized
ctctatgaggtcaataaatc

SEQ ID NO: 147361 - DNA, 20 bp, Artificial Sequence
  chemically synthesized
tatgaggtcaataaatcagg

SEQ ID NO: 147362 - DNA, 20 bp, Artificial Sequence
  chemically synthesized
aggtcaataaatcaggcagc

SEQ ID NO: 147363 - DNA, 20 bp, Artificial Sequence
  chemically synthesized
tcaaatatcctgtcaaatgc

SEQ ID NO: 147364 - DNA, 20 bp, Artificial Sequence
  chemically synthesized
atcaggcagccagcatttga

SEQ ID NO: 147365 - DNA, 20 bp, Artificial Sequence
  chemically synthesized
tcaggcagccagcatttgac

SEQ ID NO: 147366 - DNA, 20 bp, Artificial Sequence
  chemically synthesized
agcatttgacaggatatttg

SEQ ID NO: 147367 - DNA, 20 bp, Artificial Sequence
  chemically synthesized
tttgacaggatatttgaaga

SEQ ID NO: 147368 - DNA, 20 bp, Artificial Sequence
  chemically synthesized
tttgaagaaagtaacacttt

SEQ ID NO: 147369 - DNA, 20 bp, Artificial Sequence
  chemically synthesized
gaagaaagtaacacttttag

SEQ ID NO: 147370 - DNA, 20 bp, Artificial Sequence
  chemically synthesized
taatagtgagtttctgctaa

SEQ ID NO: 147371 - DNA, 20 bp, Artificial Sequence
  chemically synthesized
ggtcttagtgcattaatagt

SEQ ID NO: 147372 - DNA, 20 bp, Artificial Sequence
  chemically synthesized
caaaggtcttagtgcattaa

SEQ ID NO: 147373 - DNA, 20 bp, Artificial Sequence
  chemically synthesized
aaactcactattaatgcact

SEQ ID NO: 147374 - DNA, 20 bp, Artificial Sequence
  chemically synthesized
tttttcatatacaaaggtct

SEQ ID NO: 147375 - DNA, 20 bp, Artificial Sequence
  chemically synthesized
tctacttttttcatatacaa

SEQ ID NO: 147376 - DNA, 20 bp, Artificial Sequence
  chemically synthesized
ctctacttttttcatataca

SEQ ID NO: 147377 - DNA, 20 bp, Artificial Sequence
  chemically synthesized
aagacctttgtatatgaaaa

SEQ ID NO: 147378 - DNA, 20 bp, Artificial Sequence
  chemically synthesized
acctttgtatatgaaaaaag

SEQ ID NO: 147379 - DNA, 20 bp, Artificial Sequence
  chemically synthesized
ctttgtatatgaaaaaagta

SEQ ID NO: 147380 - DNA, 20 bp, Artificial Sequence
  chemically synthesized
aaagtagagtatgtaataat

SEQ ID NO: 147381 - DNA, 20 bp, Artificial Sequence
  chemically synthesized
agtagagtatgtaataataa

SEQ ID NO: 147382 - DNA, 20 bp, Artificial Sequence
  chemically synthesized
agtatgtaataataagagcc

SEQ ID NO: 147383 - DNA, 20 bp, Artificial Sequence
  chemically synthesized
atgtaataataagagccaag

SEQ ID NO: 147384 - DNA, 20 bp, Artificial Sequence
  chemically synthesized
taataataagagccaagaag

SEQ ID NO: 147385 - DNA, 20 bp, Artificial Sequence
  chemically synthesized
aataataagagccaagaagt

SEQ ID NO: 147386 - DNA, 20 bp, Artificial Sequence
  chemically synthesized
gcactgggctgcctacttct

SEQ ID NO: 147387 - DNA, 20 bp, Artificial Sequence
  chemically synthesized
aataagagccaagaagtagg

SEQ ID NO: 147388 - DNA, 20 bp, Artificial Sequence
  chemically synthesized
gagccaagaagtaggcagcc

SEQ ID NO: 147389 - DNA, 20 bp, Artificial Sequence
  chemically synthesized
aagaagtaggcagcccagtg

SEQ ID NO: 147390 - DNA, 20 bp, Artificial Sequence
  chemically synthesized
aagtaggcagcccagtgcag

SEQ ID NO: 147391 - DNA, 20 bp, Artificial Sequence
  chemically synthesized
cttcccttgtcttctgcact

SEQ ID NO: 147392 - DNA, 20 bp, Artificial Sequence
  chemically synthesized
tcttcccttgtcttctgcac

SEQ ID NO: 147393 - DNA, 20 bp, Artificial Sequence
  chemically synthesized
ggcagcccagtgcagaagac

SEQ ID NO: 147394 - DNA, 20 bp, Artificial Sequence
  chemically synthesized
gcagcccagtgcagaagaca

SEQ ID NO: 147395 - DNA, 20 bp, Artificial Sequence
  chemically synthesized
cagcccagtgcagaagacaa

SEQ ID NO: 147396 - DNA, 20 bp, Artificial Sequence
  chemically synthesized
cccagtgcagaagacaaggg

SEQ ID NO: 147397 - DNA, 20 bp, Artificial Sequence
  chemically synthesized
gcagaagacaagggaagaaa

SEQ ID NO: 147398 - DNA, 20 bp, Artificial Sequence
  chemically synthesized
aagacaagggaagaaaaagc

SEQ ID NO: 147399 - DNA, 20 bp, Artificial Sequence
  chemically synthesized
gtctttattatggtttcatc

SEQ ID NO: 147400 - DNA, 20 bp, Artificial Sequence
  chemically synthesized
agccagatgaaaccataata

SEQ ID NO: 147401 - DNA, 20 bp, Artificial Sequence
  chemically synthesized
caatagcgtggtctttatta

SEQ ID NO: 147402 - DNA, 20 bp, Artificial Sequence
  chemically synthesized
accacccttcatcaatagcg

SEQ ID NO: 147403 - DNA, 20 bp, Artificial Sequence
  chemically synthesized
taaagaccacgctattgatg

SEQ ID NO: 147404 - DNA, 20 bp, Artificial Sequence
  chemically synthesized
aaagaccacgctattgatga

SEQ ID NO: 147405 - DNA, 20 bp, Artificial Sequence
  chemically synthesized
tgatgaccacccttcatcaa

SEQ ID NO: 147406 - DNA, 20 bp, Artificial Sequence
  chemically synthesized
aagaccacgctattgatgaa

SEQ ID NO: 147407 - DNA, 20 bp, Artificial Sequence
  chemically synthesized
accacgctattgatgaaggg

SEQ ID NO: 147408 - DNA, 20 bp, Artificial Sequence
  chemically synthesized
atcaattgcaaaactgatat

SEQ ID NO: 147409 - DNA, 20 bp, Artificial Sequence
  chemically synthesized
tatggattttattctgatat

SEQ ID NO: 147410 - DNA, 20 bp, Artificial Sequence
  chemically synthesized
gttatactcaaatggttata

SEQ ID NO: 147411 - DNA, 20 bp, Artificial Sequence
  chemically synthesized
taaaatccatataaccattt

SEQ ID NO: 147412 - DNA, 20 bp, Artificial Sequence
  chemically synthesized
tctagctggttatactcaaa

SEQ ID NO: 147413 - DNA, 20 bp, Artificial Sequence
  chemically synthesized
tataaccatttgagtataac

SEQ ID NO: 147414 - DNA, 20 bp, Artificial Sequence
  chemically synthesized
accatttgagtataaccagc

SEQ ID NO: 147415 - DNA, 20 bp, Artificial Sequence
  chemically synthesized
catttgagtataaccagcta

SEQ ID NO: 147416 - DNA, 20 bp, Artificial Sequence
  chemically synthesized
actacacaatgttctctagc

SEQ ID NO: 147417 - DNA, 20 bp, Artificial Sequence
  chemically synthesized
aagaactacacaatgttctc

SEQ ID NO: 147418 - DNA, 20 bp, Artificial Sequence
  chemically synthesized
accagctagagaacattgtg

SEQ ID NO: 147419 - DNA, 20 bp, Artificial Sequence
  chemically synthesized
acattgtgtagttcttatta

SEQ ID NO: 147420 - DNA, 20 bp, Artificial Sequence
  chemically synthesized
agcagtgtattttctgtaat

SEQ ID NO: 147421 - DNA, 20 bp, Artificial Sequence
  chemically synthesized
tcagaattttggtagaatag

SEQ ID NO: 147422 - DNA, 20 bp, Artificial Sequence
  chemically synthesized
tgctcagaattttggtagaa

SEQ ID NO: 147423 - DNA, 20 bp, Artificial Sequence
  chemically synthesized
taaggtgctcagaattttgg

SEQ ID NO: 147424 - DNA, 20 bp, Artificial Sequence
  chemically synthesized
tgctattctaccaaaattct

SEQ ID NO: 147425 - DNA, 20 bp, Artificial Sequence
  chemically synthesized
ttttaaggtgctcagaattt

SEQ ID NO: 147426 - DNA, 20 bp, Artificial Sequence
  chemically synthesized
caggagttttttaaggtgct

SEQ ID NO: 147427 - DNA, 20 bp, Artificial Sequence
  chemically synthesized
tttaattcaggagtttttta

SEQ ID NO: 147428 - DNA, 20 bp, Artificial Sequence
  chemically synthesized
atttaattcaggagtttttt

SEQ ID NO: 147429 - DNA, 20 bp, Artificial Sequence
  chemically synthesized
gaataaattatttaattcag

SEQ ID NO: 147430 - DNA, 20 bp, Artificial Sequence
  chemically synthesized
cagaataaattatttaattc

SEQ ID NO: 147431 - DNA, 20 bp, Artificial Sequence
  chemically synthesized
tcagaataaattatttaatt

SEQ ID NO: 147432 - DNA, 20 bp, Artificial Sequence
  chemically synthesized
ttaaataatttattctgatt

SEQ ID NO: 147433 - DNA, 20 bp, Artificial Sequence
  chemically synthesized
taaataatttattctgattt

SEQ ID NO: 147434 - DNA, 20 bp, Artificial Sequence
  chemically synthesized
ttgaataaacaaacccaaat

SEQ ID NO: 147435 - DNA, 20 bp, Artificial Sequence
  chemically synthesized
gtttattcaattttttaaaa

SEQ ID NO: 147436 - DNA, 20 bp, Artificial Sequence
  chemically synthesized
ttattcaattttttaaaata

SEQ ID NO: 147437 - DNA, 20 bp, Artificial Sequence
  chemically synthesized
gtctctaacattcaggtagg

SEQ ID NO: 147438 - DNA, 20 bp, Artificial Sequence
  chemically synthesized
tgtctctaacattcaggtag

SEQ ID NO: 147439 - DNA, 20 bp, Artificial Sequence
  chemically synthesized
cttgtctctaacattcaggt

SEQ ID NO: 147440 - DNA, 20 bp, Artificial Sequence
  chemically synthesized
tcttgtctctaacattcagg

SEQ ID NO: 147441 - DNA, 20 bp, Artificial Sequence
  chemically synthesized
agttcctcctacctgaatgt

SEQ ID NO: 147442 - DNA, 20 bp, Artificial Sequence
  chemically synthesized
gagtcttgtctctaacattc

SEQ ID NO: 147443 - DNA, 20 bp, Artificial Sequence
  chemically synthesized
ttcctcctacctgaatgtta

SEQ ID NO: 147444 - DNA, 20 bp, Artificial Sequence
  chemically synthesized
agagtcttgtctctaacatt

SEQ ID NO: 147445 - DNA, 20 bp, Artificial Sequence
  chemically synthesized
cctacctgaatgttagagac

SEQ ID NO: 147446 - DNA, 20 bp, Artificial Sequence
  chemically synthesized
atgttagagacaagactctg

SEQ ID NO: 147447 - DNA, 20 bp, Artificial Sequence
  chemically synthesized
tttgcttagttttcactgca

SEQ ID NO: 147448 - DNA, 20 bp, Artificial Sequence
  chemically synthesized
attttgcttagttttcactg

SEQ ID NO: 147449 - DNA, 20 bp, Artificial Sequence
  chemically synthesized
aagactctgcagtgaaaact

SEQ ID NO: 147450 - DNA, 20 bp, Artificial Sequence
  chemically synthesized
actgcttacctcattttgct

SEQ ID NO: 147451 - DNA, 20 bp, Artificial Sequence
  chemically synthesized
cagtgaaaactaagcaaaat

SEQ ID NO: 147452 - DNA, 20 bp, Artificial Sequence
  chemically synthesized
agtgaaaactaagcaaaatg

SEQ ID NO: 147453 - DNA, 20 bp, Artificial Sequence
  chemically synthesized
aaaactaagcaaaatgaggt

SEQ ID NO: 147454 - DNA, 20 bp, Artificial Sequence
  chemically synthesized
actaagcaaaatgaggtaag

SEQ ID NO: 147455 - DNA, 20 bp, Artificial Sequence
  chemically synthesized
gaggtaagcagtgttttcta

SEQ ID NO: 147456 - DNA, 20 bp, Artificial Sequence
  chemically synthesized
gcagtgttttctacagaatt

SEQ ID NO: 147457 - DNA, 20 bp, Artificial Sequence
  chemically synthesized
gagatttagactgaattctg

SEQ ID NO: 147458 - DNA, 20 bp, Artificial Sequence
  chemically synthesized
tcccaaacaaataagagatt

SEQ ID NO: 147459 - DNA, 20 bp, Artificial Sequence
  chemically synthesized
tagctctcccaaacaaataa

SEQ ID NO: 147460 - DNA, 20 bp, Artificial Sequence
  chemically synthesized
gtctaaatctcttatttgtt

SEQ ID NO: 147461 - DNA, 20 bp, Artificial Sequence
  chemically synthesized
cgtagctctcccaaacaaat

SEQ ID NO: 147462 - DNA, 20 bp, Artificial Sequence
  chemically synthesized
tctaaatctcttatttgttt

SEQ ID NO: 147463 - DNA, 20 bp, Artificial Sequence
  chemically synthesized
taaatctcttatttgtttgg

SEQ ID NO: 147464 - DNA, 20 bp, Artificial Sequence
  chemically synthesized
aatctcttatttgtttggga

SEQ ID NO: 147465 - DNA, 20 bp, Artificial Sequence
  chemically synthesized
ttctgcttaaggtgaaaacg

SEQ ID NO: 147466 - DNA, 20 bp, Artificial Sequence
  chemically synthesized
gagagctacgttttcacctt

SEQ ID NO: 147467 - DNA, 20 bp, Artificial Sequence
  chemically synthesized
agctacgttttcaccttaag

SEQ ID NO: 147468 - DNA, 20 bp, Artificial Sequence
  chemically synthesized
actaattatttttctgctta

SEQ ID NO: 147469 - DNA, 20 bp, Artificial Sequence
  chemically synthesized
cactaattatttttctgctt

SEQ ID NO: 147470 - DNA, 20 bp, Artificial Sequence
  chemically synthesized
accttaagcagaaaaataat

SEQ ID NO: 147471 - DNA, 20 bp, Artificial Sequence
  chemically synthesized
taattagtgatgtgttttga

SEQ ID NO: 147472 - DNA, 20 bp, Artificial Sequence
  chemically synthesized
aaagttgttatataatgaat

SEQ ID NO: 147473 - DNA, 20 bp, Artificial Sequence
  chemically synthesized
gagggcctgacacatggtag

SEQ ID NO: 147474 - DNA, 20 bp, Artificial Sequence
  chemically synthesized
tgagggcctgacacatggta

SEQ ID NO: 147475 - DNA, 20 bp, Artificial Sequence
  chemically synthesized
tgtgagggcctgacacatgg

SEQ ID NO: 147476 - DNA, 20 bp, Artificial Sequence
  chemically synthesized
taagatcctctaccatgtgt

SEQ ID NO: 147477 - DNA, 20 bp, Artificial Sequence
  chemically synthesized
aagatcctctaccatgtgtc

SEQ ID NO: 147478 - DNA, 20 bp, Artificial Sequence
  chemically synthesized
gcttgtgagggcctgacaca

SEQ ID NO: 147479 - DNA, 20 bp, Artificial Sequence
  chemically synthesized
accatgtgtcaggccctcac

SEQ ID NO: 147480 - DNA, 20 bp, Artificial Sequence
  chemically synthesized
ctggtggatgaggcttgtga

SEQ ID NO: 147481 - DNA, 20 bp, Artificial Sequence
  chemically synthesized
tctggtggatgaggcttgtg

SEQ ID NO: 147482 - DNA, 20 bp, Artificial Sequence
  chemically synthesized
ctctggtggatgaggcttgt

SEQ ID NO: 147483 - DNA, 20 bp, Artificial Sequence
  chemically synthesized
ccctcacaagcctcatccac

SEQ ID NO: 147484 - DNA, 20 bp, Artificial Sequence
  chemically synthesized
atcatctcctctggtggatg

SEQ ID NO: 147485 - DNA, 20 bp, Artificial Sequence
  chemically synthesized
tatcatctcctctggtggat

SEQ ID NO: 147486 - DNA, 20 bp, Artificial Sequence
  chemically synthesized
ctcacaagcctcatccacca

SEQ ID NO: 147487 - DNA, 20 bp, Artificial Sequence
  chemically synthesized
tcacaagcctcatccaccag

SEQ ID NO: 147488 - DNA, 20 bp, Artificial Sequence
  chemically synthesized
acaagcctcatccaccagag

SEQ ID NO: 147489 - DNA, 20 bp, Artificial Sequence
  chemically synthesized
tagcttatcatctcctctgg

SEQ ID NO: 147490 - DNA, 20 bp, Artificial Sequence
  chemically synthesized
aaatagcttatcatctcctc

SEQ ID NO: 147491 - DNA, 20 bp, Artificial Sequence
  chemically synthesized
catccaccagaggagatgat

SEQ ID NO: 147492 - DNA, 20 bp, Artificial Sequence
  chemically synthesized
gaggagatgataagctattt

SEQ ID NO: 147493 - DNA, 20 bp, Artificial Sequence
  chemically synthesized
attctgatacttatctcaaa

SEQ ID NO: 147494 - DNA, 20 bp, Artificial Sequence
  chemically synthesized
gatgataagctatttgagat

SEQ ID NO: 147495 - DNA, 20 bp, Artificial Sequence
  chemically synthesized
aagctatttgagataagtat

SEQ ID NO: 147496 - DNA, 20 bp, Artificial Sequence
  chemically synthesized
ttggtcttgtgaggaaggaa

SEQ ID NO: 147497 - DNA, 20 bp, Artificial Sequence
  chemically synthesized
atcatcttttccttcctcac

SEQ ID NO: 147498 - DNA, 20 bp, Artificial Sequence
  chemically synthesized
gacctttggtcttgtgagga

SEQ ID NO: 147499 - DNA, 20 bp, Artificial Sequence
  chemically synthesized
agacctttggtcttgtgagg

SEQ ID NO: 147500 - DNA, 20 bp, Artificial Sequence
  chemically synthesized
ttcagacctttggtcttgtg

SEQ ID NO: 147501 - DNA, 20 bp, Artificial Sequence
  chemically synthesized
tttcagacctttggtcttgt

SEQ ID NO: 147502 - DNA, 20 bp, Artificial Sequence
  chemically synthesized
tttccttcctcacaagacca

SEQ ID NO: 147503 - DNA, 20 bp, Artificial Sequence
  chemically synthesized
ttccttcctcacaagaccaa

SEQ ID NO: 147504 - DNA, 20 bp, Artificial Sequence
  chemically synthesized
cctgttatttttcagacctt

SEQ ID NO: 147505 - DNA, 20 bp, Artificial Sequence
  chemically synthesized
attgagaccctgttattttt

SEQ ID NO: 147506 - DNA, 20 bp, Artificial Sequence
  chemically synthesized
accaaaggtctgaaaaataa

SEQ ID NO: 147507 - DNA, 20 bp, Artificial Sequence
  chemically synthesized
ccaaaggtctgaaaaataac

SEQ ID NO: 147508 - DNA, 20 bp, Artificial Sequence
  chemically synthesized
caaaggtctgaaaaataaca

SEQ ID NO: 147509 - DNA, 20 bp, Artificial Sequence
  chemically synthesized
aacaacaacaaattttgatt

SEQ ID NO: 147510 - DNA, 20 bp, Artificial Sequence
  chemically synthesized
tttgttgttgttttcacaat

SEQ ID NO: 147511 - DNA, 20 bp, Artificial Sequence
  chemically synthesized
gttgttttcacaattagaat

SEQ ID NO: 147512 - DNA, 20 bp, Artificial Sequence
  chemically synthesized
ttgttttcacaattagaatg

SEQ ID NO: 147513 - DNA, 20 bp, Artificial Sequence
  chemically synthesized
tcacaattagaatgaggtgc

SEQ ID NO: 147514 - DNA, 20 bp, Artificial Sequence
  chemically synthesized
ggtgcaagttgcaatgtact

SEQ ID NO: 147515 - DNA, 20 bp, Artificial Sequence
  chemically synthesized
gcaagttgcaatgtactaag

SEQ ID NO: 147516 - DNA, 20 bp, Artificial Sequence
  chemically synthesized
aagttgcaatgtactaagca

SEQ ID NO: 147517 - DNA, 20 bp, Artificial Sequence
  chemically synthesized
ttacacttaaggactctgct

SEQ ID NO: 147518 - DNA, 20 bp, Artificial Sequence
  chemically synthesized
atgtactaagcagagtcctt

SEQ ID NO: 147519 - DNA, 20 bp, Artificial Sequence
  chemically synthesized
agagaacgagattacactta

SEQ ID NO: 147520 - DNA, 20 bp, Artificial Sequence
  chemically synthesized
gagagaacgagattacactt

SEQ ID NO: 147521 - DNA, 20 bp, Artificial Sequence
  chemically synthesized
tatatatttagagagagaac

SEQ ID NO: 147522 - DNA, 20 bp, Artificial Sequence
  chemically synthesized
tgcatatatatatttagaga

SEQ ID NO: 147523 - DNA, 20 bp, Artificial Sequence
  chemically synthesized
tatgcatatatatatttaga

SEQ ID NO: 147524 - DNA, 20 bp, Artificial Sequence
  chemically synthesized
catatgcatatatatattta

SEQ ID NO: 147525 - DNA, 20 bp, Artificial Sequence
  chemically synthesized
tacatatgcatatatatatt

SEQ ID NO: 147526 - DNA, 20 bp, Artificial Sequence
  chemically synthesized
tatatatgcatatgtatata

SEQ ID NO: 147527 - DNA, 20 bp, Artificial Sequence
  chemically synthesized
tctctctaaatatatatatt

SEQ ID NO: 147528 - DNA, 20 bp, Artificial Sequence
  chemically synthesized
atagtctaaatatatatatt

SEQ ID NO: 147529 - DNA, 20 bp, Artificial Sequence
  chemically synthesized
agtctaaatatatatattta

SEQ ID NO: 147530 - DNA, 20 bp, Artificial Sequence
  chemically synthesized
tctaaatatatatatttaga

SEQ ID NO: 147531 - DNA, 20 bp, Artificial Sequence
  chemically synthesized
taaatatatatatttagaga

SEQ ID NO: 147532 - DNA, 20 bp, Artificial Sequence
  chemically synthesized
tatatatatttagagagaga

SEQ ID NO: 147533 - DNA, 20 bp, Artificial Sequence
  chemically synthesized
tatatatttagagagagaca

SEQ ID NO: 147534 - DNA, 20 bp, Artificial Sequence
  chemically synthesized
atatttagagagagacagag

SEQ ID NO: 147535 - DNA, 20 bp, Artificial Sequence
  chemically synthesized
agttatataaattaatataa

SEQ ID NO: 147536 - DNA, 20 bp, Artificial Sequence
  chemically synthesized
ttatataaattaatataaca

SEQ ID NO: 147537 - DNA, 20 bp, Artificial Sequence
  chemically synthesized
agttatgtaactgtgattta

SEQ ID NO: 147538 - DNA, 20 bp, Artificial Sequence
  chemically synthesized
tctgaggaaactgtaaatca

SEQ ID NO: 147539 - DNA, 20 bp, Artificial Sequence
  chemically synthesized
actgtgatttacagtttcct

SEQ ID NO: 147540 - DNA, 20 bp, Artificial Sequence
  chemically synthesized
tgtgatttacagtttcctca

SEQ ID NO: 147541 - DNA, 20 bp, Artificial Sequence
  chemically synthesized
agttctagattgaaactctg

SEQ ID NO: 147542 - DNA, 20 bp, Artificial Sequence
  chemically synthesized
aagttctagattgaaactct

SEQ ID NO: 147543 - DNA, 20 bp, Artificial Sequence
  chemically synthesized
gtttcctcagagtttcaatc

SEQ ID NO: 147544 - DNA, 20 bp, Artificial Sequence
  chemically synthesized
ttttctcactgatgaagttc

SEQ ID NO: 147545 - DNA, 20 bp, Artificial Sequence
  chemically synthesized
gtttcaatctagaacttcat

SEQ ID NO: 147546 - DNA, 20 bp, Artificial Sequence
  chemically synthesized
caatctagaacttcatcagt

SEQ ID NO: 147547 - DNA, 20 bp, Artificial Sequence
  chemically synthesized
cctcttttttctcactgatg

SEQ ID NO: 147548 - DNA, 20 bp, Artificial Sequence
  chemically synthesized
gaacttcatcagtgagaaaa

SEQ ID NO: 147549 - DNA, 20 bp, Artificial Sequence
  chemically synthesized
acttcatcagtgagaaaaaa

SEQ ID NO: 147550 - DNA, 20 bp, Artificial Sequence
  chemically synthesized
cttcatcagtgagaaaaaag

SEQ ID NO: 147551 - DNA, 20 bp, Artificial Sequence
  chemically synthesized
tgagaaaaaagaggaaccat

SEQ ID NO: 147552 - DNA, 20 bp, Artificial Sequence
  chemically synthesized
tcgcatttacattgcactaa

SEQ ID NO: 147553 - DNA, 20 bp, Artificial Sequence
  chemically synthesized
gtaaatgcgacaatattaaa

SEQ ID NO: 147554 - DNA, 20 bp, Artificial Sequence
  chemically synthesized
tattaaatagtcttaaaatg

SEQ ID NO: 147555 - DNA, 20 bp, Artificial Sequence
  chemically synthesized
accaaaagaatctacatttt

SEQ ID NO: 147556 - DNA, 20 bp, Artificial Sequence
  chemically synthesized
tcttaaaatgtagattcttt

SEQ ID NO: 147557 - DNA, 20 bp, Artificial Sequence
  chemically synthesized
ttataattgatttgaaccaa

SEQ ID NO: 147558 - DNA, 20 bp, Artificial Sequence
  chemically synthesized
caattataatatatttgcac

SEQ ID NO: 147559 - DNA, 20 bp, Artificial Sequence
  chemically synthesized
taatatatttgcacaagatc

SEQ ID NO: 147560 - DNA, 20 bp, Artificial Sequence
  chemically synthesized
atatttgcacaagatctgga

SEQ ID NO: 147561 - DNA, 20 bp, Artificial Sequence
  chemically synthesized
aaaggcatttttatgctgtc

SEQ ID NO: 147562 - DNA, 20 bp, Artificial Sequence
  chemically synthesized
acagcataaaaatgcctttt

SEQ ID NO: 147563 - DNA, 20 bp, Artificial Sequence
  chemically synthesized
aatgcagaaaatgactaaaa

SEQ ID NO: 147564 - DNA, 20 bp, Artificial Sequence
  chemically synthesized
caatgcagaaaatgactaaa

SEQ ID NO: 147565 - DNA, 20 bp, Artificial Sequence
  chemically synthesized
tttttagtcattttctgcat

SEQ ID NO: 147566 - DNA, 20 bp, Artificial Sequence
  chemically synthesized
ggtatgatgaggaaccaatg

SEQ ID NO: 147567 - DNA, 20 bp, Artificial Sequence
  chemically synthesized
cacaccagagtggtatgatg

SEQ ID NO: 147568 - DNA, 20 bp, Artificial Sequence
  chemically synthesized
ccacaccagagtggtatgat

SEQ ID NO: 147569 - DNA, 20 bp, Artificial Sequence
  chemically synthesized
ggttcctcatcataccactc

SEQ ID NO: 147570 - DNA, 20 bp, Artificial Sequence
  chemically synthesized
tttccctatccacaccagag

SEQ ID NO: 147571 - DNA, 20 bp, Artificial Sequence
  chemically synthesized
ctcatcataccactctggtg

SEQ ID NO: 147572 - DNA, 20 bp, Artificial Sequence
  chemically synthesized
tgttttccctatccacacca

SEQ ID NO: 147573 - DNA, 20 bp, Artificial Sequence
  chemically synthesized
tcataccactctggtgtgga

SEQ ID NO: 147574 - DNA, 20 bp, Artificial Sequence
  chemically synthesized
catgttttccctatccacac

SEQ ID NO: 147575 - DNA, 20 bp, Artificial Sequence
  chemically synthesized
cataccactctggtgtggat

SEQ ID NO: 147576 - DNA, 20 bp, Artificial Sequence
  chemically synthesized
ataccactctggtgtggata

SEQ ID NO: 147577 - DNA, 20 bp, Artificial Sequence
  chemically synthesized
tttcccgttctataaattga

SEQ ID NO: 147578 - DNA, 20 bp, Artificial Sequence
  chemically synthesized
acatgattactatcaattta

SEQ ID NO: 147579 - DNA, 20 bp, Artificial Sequence
  chemically synthesized
attactatcaatttatagaa

SEQ ID NO: 147580 - DNA, 20 bp, Artificial Sequence
  chemically synthesized
ttactatcaatttatagaac

SEQ ID NO: 147581 - DNA, 20 bp, Artificial Sequence
  chemically synthesized
atagaacgggaaactaaatt

SEQ ID NO: 147582 - DNA, 20 bp, Artificial Sequence
  chemically synthesized
tattttaatttatctgaatt

SEQ ID NO: 147583 - DNA, 20 bp, Artificial Sequence
  chemically synthesized
ataaattaaaatacttcttc

SEQ ID NO: 147584 - DNA, 20 bp, Artificial Sequence
  chemically synthesized
actaaatgttgatcttgaag

SEQ ID NO: 147585 - DNA, 20 bp, Artificial Sequence
  chemically synthesized
tttactaaatgttgatcttg

SEQ ID NO: 147586 - DNA, 20 bp, Artificial Sequence
  chemically synthesized
acttcttcaagatcaacatt

SEQ ID NO: 147587 - DNA, 20 bp, Artificial Sequence
  chemically synthesized
aagatcaacatttagtaaat

SEQ ID NO: 147588 - DNA, 20 bp, Artificial Sequence
  chemically synthesized
acatttagtaaattagatga

SEQ ID NO: 147589 - DNA, 20 bp, Artificial Sequence
  chemically synthesized
catttagtaaattagatgaa

SEQ ID NO: 147590 - DNA, 20 bp, Artificial Sequence
  chemically synthesized
taaattagatgaaaggttct

SEQ ID NO: 147591 - DNA, 20 bp, Artificial Sequence
  chemically synthesized
ttcttaaaatacagatttct

SEQ ID NO: 147592 - DNA, 20 bp, Artificial Sequence
  chemically synthesized
ttctgagaaatctgtatttt

SEQ ID NO: 147593 - DNA, 20 bp, Artificial Sequence
  chemically synthesized
gagcctttcttcttaaaata

SEQ ID NO: 147594 - DNA, 20 bp, Artificial Sequence
  chemically synthesized
tgagaaatctgtattttaag

SEQ ID NO: 147595 - DNA, 20 bp, Artificial Sequence
  chemically synthesized
aaatctgtattttaagaaga

SEQ ID NO: 147596 - DNA, 20 bp, Artificial Sequence
  chemically synthesized
aatctgtattttaagaagaa

SEQ ID NO: 147597 - DNA, 20 bp, Artificial Sequence
  chemically synthesized
attttaagaagaaaggctct

SEQ ID NO: 147598 - DNA, 20 bp, Artificial Sequence
  chemically synthesized
ttttaagaagaaaggctctg

SEQ ID NO: 147599 - DNA, 20 bp, Artificial Sequence
  chemically synthesized
aagaagaaaggctctgaggt

SEQ ID NO: 147600 - DNA, 20 bp, Artificial Sequence
  chemically synthesized
cttattaattactcacctca

SEQ ID NO: 147601 - DNA, 20 bp, Artificial Sequence
  chemically synthesized
tccttattaattactcacct

SEQ ID NO: 147602 - DNA, 20 bp, Artificial Sequence
  chemically synthesized
ctctgaggtgagtaattaat

SEQ ID NO: 147603 - DNA, 20 bp, Artificial Sequence
  chemically synthesized
tctgaggtgagtaattaata

SEQ ID NO: 147604 - DNA, 20 bp, Artificial Sequence
  chemically synthesized
aaaatcaggttaattgtttt

SEQ ID NO: 147605 - DNA, 20 bp, Artificial Sequence
  chemically synthesized
tccttgcccattttaaaatc

SEQ ID NO: 147606 - DNA, 20 bp, Artificial Sequence
  chemically synthesized
atccttgcccattttaaaat

SEQ ID NO: 147607 - DNA, 20 bp, Artificial Sequence
  chemically synthesized
caattaacctgattttaaaa

SEQ ID NO: 147608 - DNA, 20 bp, Artificial Sequence
  chemically synthesized
aattaacctgattttaaaat

SEQ ID NO: 147609 - DNA, 20 bp, Artificial Sequence
  chemically synthesized
aacctgattttaaaatgggc

SEQ ID NO: 147610 - DNA, 20 bp, Artificial Sequence
  chemically synthesized
acctgattttaaaatgggca

SEQ ID NO: 147611 - DNA, 20 bp, Artificial Sequence
  chemically synthesized
aaaatgggcaaggatttaaa

SEQ ID NO: 147612 - DNA, 20 bp, Artificial Sequence
  chemically synthesized
tttaaatagacatttctcca

SEQ ID NO: 147613 - DNA, 20 bp, Artificial Sequence
  chemically synthesized
ctgtgtatatattttctttg

SEQ ID NO: 147614 - DNA, 20 bp, Artificial Sequence
  chemically synthesized
ggctgtgtatatattttctt

SEQ ID NO: 147615 - DNA, 20 bp, Artificial Sequence
  chemically synthesized
ctccaaagaaaatatataca

SEQ ID NO: 147616 - DNA, 20 bp, Artificial Sequence
  chemically synthesized
aaaatatatacacagccaac

SEQ ID NO: 147617 - DNA, 20 bp, Artificial Sequence
  chemically synthesized
gtatgttttcagatgcttgt

SEQ ID NO: 147618 - DNA, 20 bp, Artificial Sequence
  chemically synthesized
gacgatgttgagtatgtttt

SEQ ID NO: 147619 - DNA, 20 bp, Artificial Sequence
  chemically synthesized
ccccgatgattgacgatgtt

SEQ ID NO: 147620 - DNA, 20 bp, Artificial Sequence
  chemically synthesized
tactcaacatcgtcaatcat

SEQ ID NO: 147621 - DNA, 20 bp, Artificial Sequence
  chemically synthesized
actcaacatcgtcaatcatc

SEQ ID NO: 147622 - DNA, 20 bp, Artificial Sequence
  chemically synthesized
ctcaacatcgtcaatcatcg

SEQ ID NO: 147623 - DNA, 20 bp, Artificial Sequence
  chemically synthesized
tcatcggggaaatgcaaatg

SEQ ID NO: 147624 - DNA, 20 bp, Artificial Sequence
  chemically synthesized
tgaagaacgaaaaccacaat

SEQ ID NO: 147625 - DNA, 20 bp, Artificial Sequence
  chemically synthesized
tgtgaggtaatatctcattg

SEQ ID NO: 147626 - DNA, 20 bp, Artificial Sequence
  chemically synthesized
tggtcatcctcatggttgtg

SEQ ID NO: 147627 - DNA, 20 bp, Artificial Sequence
  chemically synthesized
gtggtcatcctcatggttgt

SEQ ID NO: 147628 - DNA, 20 bp, Artificial Sequence
  chemically synthesized
agatattacctcacaaccat

SEQ ID NO: 147629 - DNA, 20 bp, Artificial Sequence
  chemically synthesized
gatattacctcacaaccatg

SEQ ID NO: 147630 - DNA, 20 bp, Artificial Sequence
  chemically synthesized
tatgatcgtggtcatcctca

SEQ ID NO: 147631 - DNA, 20 bp, Artificial Sequence
  chemically synthesized
ttattttctgtttatgatcg

SEQ ID NO: 147632 - DNA, 20 bp, Artificial Sequence
  chemically synthesized
aggatgaccacgatcataaa

SEQ ID NO: 147633 - DNA, 20 bp, Artificial Sequence
  chemically synthesized
aaacagaaaataacatgtgc

SEQ ID NO: 147634 - DNA, 20 bp, Artificial Sequence
  chemically synthesized
agaaaataacatgtgctggc

SEQ ID NO: 147635 - DNA, 20 bp, Artificial Sequence
  chemically synthesized
gaaaataacatgtgctggca

SEQ ID NO: 147636 - DNA, 20 bp, Artificial Sequence
  chemically synthesized
cagtttctccacatccttgc

SEQ ID NO: 147637 - DNA, 20 bp, Artificial Sequence
  chemically synthesized
aacatgtgctggcaaggatg

SEQ ID NO: 147638 - DNA, 20 bp, Artificial Sequence
  chemically synthesized
catgtgctggcaaggatgtg

SEQ ID NO: 147639 - DNA, 20 bp, Artificial Sequence
  chemically synthesized
ccaacaatgcagaagtgttt

SEQ ID NO: 147640 - DNA, 20 bp, Artificial Sequence
  chemically synthesized
cattcccaccaacaatgcag

SEQ ID NO: 147641 - DNA, 20 bp, Artificial Sequence
  chemically synthesized
ctgaaacacttctgcattgt

SEQ ID NO: 147642 - DNA, 20 bp, Artificial Sequence
  chemically synthesized
tcacattcccaccaacaatg

SEQ ID NO: 147643 - DNA, 20 bp, Artificial Sequence
  chemically synthesized
aaacacttctgcattgttgg

SEQ ID NO: 147644 - DNA, 20 bp, Artificial Sequence
  chemically synthesized
aacacttctgcattgttggt

SEQ ID NO: 147645 - DNA, 20 bp, Artificial Sequence
  chemically synthesized
attgttggtgggaatgtgaa

SEQ ID NO: 147646 - DNA, 20 bp, Artificial Sequence
  chemically synthesized
ttgttggtgggaatgtgaaa

SEQ ID NO: 147647 - DNA, 20 bp, Artificial Sequence
  chemically synthesized
ggtgggaatgtgaaaaggtg

SEQ ID NO: 147648 - DNA, 20 bp, Artificial Sequence
  chemically synthesized
gtgaaaaggtgtagccacta

SEQ ID NO: 147649 - DNA, 20 bp, Artificial Sequence
  chemically synthesized
ttccatacggttttccatag

SEQ ID NO: 147650 - DNA, 20 bp, Artificial Sequence
  chemically synthesized
aacttccatacggttttcca

SEQ ID NO: 147651 - DNA, 20 bp, Artificial Sequence
  chemically synthesized
agccactatggaaaaccgta

SEQ ID NO: 147652 - DNA, 20 bp, Artificial Sequence
  chemically synthesized
cactatggaaaaccgtatgg

SEQ ID NO: 147653 - DNA, 20 bp, Artificial Sequence
  chemically synthesized
tgttttgaggaacttccata

SEQ ID NO: 147654 - DNA, 20 bp, Artificial Sequence
  chemically synthesized
aattctatttttatgttttg

SEQ ID NO: 147655 - DNA, 20 bp, Artificial Sequence
  chemically synthesized
taattctatttttatgtttt

SEQ ID NO: 147656 - DNA, 20 bp, Artificial Sequence
  chemically synthesized
agttcctcaaaacataaaaa

SEQ ID NO: 147657 - DNA, 20 bp, Artificial Sequence
  chemically synthesized
aatagaattatcatataatc

SEQ ID NO: 147658 - DNA, 20 bp, Artificial Sequence
  chemically synthesized
tatttttattttttgaggac

SEQ ID NO: 147659 - DNA, 20 bp, Artificial Sequence
  chemically synthesized
aattctatttttattttttg

SEQ ID NO: 147660 - DNA, 20 bp, Artificial Sequence
  chemically synthesized
taattctatttttatttttt

SEQ ID NO: 147661 - DNA, 20 bp, Artificial Sequence
  chemically synthesized
cagtcctcaaaaaataaaaa

SEQ ID NO: 147662 - DNA, 20 bp, Artificial Sequence
  chemically synthesized
aatagaattatcatataatc

SEQ ID NO: 147663 - DNA, 20 bp, Artificial Sequence
  chemically synthesized
acacccagaaatgggattgc

SEQ ID NO: 147664 - DNA, 20 bp, Artificial Sequence
  chemically synthesized
taatccagcaatcccatttc

SEQ ID NO: 147665 - DNA, 20 bp, Artificial Sequence
  chemically synthesized
aatccagcaatcccatttct

SEQ ID NO: 147666 - DNA, 20 bp, Artificial Sequence
  chemically synthesized
ctaaccgtacacccagaaat

SEQ ID NO: 147667 - DNA, 20 bp, Artificial Sequence
  chemically synthesized
actaaccgtacacccagaaa

SEQ ID NO: 147668 - DNA, 20 bp, Artificial Sequence
  chemically synthesized
caatcccatttctgggtgta

SEQ ID NO: 147669 - DNA, 20 bp, Artificial Sequence
  chemically synthesized
ttggggactaaccgtacacc

SEQ ID NO: 147670 - DNA, 20 bp, Artificial Sequence
  chemically synthesized
cccatttctgggtgtacggt

SEQ ID NO: 147671 - DNA, 20 bp, Artificial Sequence
  chemically synthesized
agttagaccttagtaagttg

SEQ ID NO: 147672 - DNA, 20 bp, Artificial Sequence
  chemically synthesized
aagttagaccttagtaagtt

SEQ ID NO: 147673 - DNA, 20 bp, Artificial Sequence
  chemically synthesized
cggttagtccccaacttact

SEQ ID NO: 147674 - DNA, 20 bp, Artificial Sequence
  chemically synthesized
caagttagaccttagtaagt

SEQ ID NO: 147675 - DNA, 20 bp, Artificial Sequence
  chemically synthesized
ggttagtccccaacttacta

SEQ ID NO: 147676 - DNA, 20 bp, Artificial Sequence
  chemically synthesized
attacaagttagaccttagt

SEQ ID NO: 147677 - DNA, 20 bp, Artificial Sequence
  chemically synthesized
aaaaattacaagttagacct

SEQ ID NO: 147678 - DNA, 20 bp, Artificial Sequence
  chemically synthesized
aaagtccaaaaattacaagt

SEQ ID NO: 147679 - DNA, 20 bp, Artificial Sequence
  chemically synthesized
ttgtaaagtccaaaaattac

SEQ ID NO: 147680 - DNA, 20 bp, Artificial Sequence
  chemically synthesized
aaggtctaacttgtaatttt

SEQ ID NO: 147681 - DNA, 20 bp, Artificial Sequence
  chemically synthesized
gtaatttttggactttacaa

SEQ ID NO: 147682 - DNA, 20 bp, Artificial Sequence
  chemically synthesized
atcgctttcacaccattgta

SEQ ID NO: 147683 - DNA, 20 bp, Artificial Sequence
  chemically synthesized
tggactttacaatggtgtga

SEQ ID NO: 147684 - DNA, 20 bp, Artificial Sequence
  chemically synthesized
gaaagcgatatgcattcatt

SEQ ID NO: 147685 - DNA, 20 bp, Artificial Sequence
  chemically synthesized
aaaattcaaaatttgaagta

SEQ ID NO: 147686 - DNA, 20 bp, Artificial Sequence
  chemically synthesized
agatcaaaattcaaaatttg

SEQ ID NO: 147687 - DNA, 20 bp, Artificial Sequence
  chemically synthesized
ttttgaattttgatcttttc

SEQ ID NO: 147688 - DNA, 20 bp, Artificial Sequence
  chemically synthesized
tttgaattttgatcttttct

SEQ ID NO: 147689 - DNA, 20 bp, Artificial Sequence
  chemically synthesized
ttgaattttgatcttttcta

SEQ ID NO: 147690 - DNA, 20 bp, Artificial Sequence
  chemically synthesized
catatttactagccctagaa

SEQ ID NO: 147691 - DNA, 20 bp, Artificial Sequence
  chemically synthesized
attttgatcttttctagggc

SEQ ID NO: 147692 - DNA, 20 bp, Artificial Sequence
  chemically synthesized
tactgcatatttactagccc

SEQ ID NO: 147693 - DNA, 20 bp, Artificial Sequence
  chemically synthesized
gtatcatactgcatatttac

SEQ ID NO: 147694 - DNA, 20 bp, Artificial Sequence
  chemically synthesized
ttctagggctagtaaatatg

SEQ ID NO: 147695 - DNA, 20 bp, Artificial Sequence
  chemically synthesized
caacccaatatgtcagaaga

SEQ ID NO: 147696 - DNA, 20 bp, Artificial Sequence
  chemically synthesized
tgcaacccaatatgtcagaa

SEQ ID NO: 147697 - DNA, 20 bp, Artificial Sequence
  chemically synthesized
gctgcaacccaatatgtcag

SEQ ID NO: 147698 - DNA, 20 bp, Artificial Sequence
  chemically synthesized
gatactctcttctgacatat

SEQ ID NO: 147699 - DNA, 20 bp, Artificial Sequence
  chemically synthesized
atactctcttctgacatatt

SEQ ID NO: 147700 - DNA, 20 bp, Artificial Sequence
  chemically synthesized
catgctgcaacccaatatgt

SEQ ID NO: 147701 - DNA, 20 bp, Artificial Sequence
  chemically synthesized
tcttctgacatattgggttg

SEQ ID NO: 147702 - DNA, 20 bp, Artificial Sequence
  chemically synthesized
tgcagcatgatatttatcat

SEQ ID NO: 147703 - DNA, 20 bp, Artificial Sequence
  chemically synthesized
gcagcatgatatttatcatg

SEQ ID NO: 147704 - DNA, 20 bp, Artificial Sequence
  chemically synthesized
ttgcaacacagtacatagta

SEQ ID NO: 147705 - DNA, 20 bp, Artificial Sequence
  chemically synthesized
tcttgcaacacagtacatag

SEQ ID NO: 147706 - DNA, 20 bp, Artificial Sequence
  chemically synthesized
tcatcttgcaacacagtaca

SEQ ID NO: 147707 - DNA, 20 bp, Artificial Sequence
  chemically synthesized
tctactatgtactgtgttgc

SEQ ID NO: 147708 - DNA, 20 bp, Artificial Sequence
  chemically synthesized
ggcaaaatcatcttgcaaca

SEQ ID NO: 147709 - DNA, 20 bp, Artificial Sequence
  chemically synthesized
tgttgcaagatgattttgcc

SEQ ID NO: 147710 - DNA, 20 bp, Artificial Sequence
  chemically synthesized
atgtagattacagtacatct

SEQ ID NO: 147711 - DNA, 20 bp, Artificial Sequence
  chemically synthesized
catgtagattacagtacatc

SEQ ID NO: 147712 - DNA, 20 bp, Artificial Sequence
  chemically synthesized
ttatcagaacatgtagatta

SEQ ID NO: 147713 - DNA, 20 bp, Artificial Sequence
  chemically synthesized
ttaaatgttatcagaacatg

SEQ ID NO: 147714 - DNA, 20 bp, Artificial Sequence
  chemically synthesized
tagcatactttaaatgttat

SEQ ID NO: 147715 - DNA, 20 bp, Artificial Sequence
  chemically synthesized
acatgttctgataacattta

SEQ ID NO: 147716 - DNA, 20 bp, Artificial Sequence
  chemically synthesized
tgataacatttaaagtatgc

SEQ ID NO: 147717 - DNA, 20 bp, Artificial Sequence
  chemically synthesized
catttaaagtatgctagact

SEQ ID NO: 147718 - DNA, 20 bp, Artificial Sequence
  chemically synthesized
ccaaacatcattgcttagtc

SEQ ID NO: 147719 - DNA, 20 bp, Artificial Sequence
  chemically synthesized
agctaccaaacatcattgct

SEQ ID NO: 147720 - DNA, 20 bp, Artificial Sequence
  chemically synthesized
ctagactaagcaatgatgtt

SEQ ID NO: 147721 - DNA, 20 bp, Artificial Sequence
  chemically synthesized
gactaagcaatgatgtttgg

SEQ ID NO: 147722 - DNA, 20 bp, Artificial Sequence
  chemically synthesized
agcaatgatgtttggtagct

SEQ ID NO: 147723 - DNA, 20 bp, Artificial Sequence
  chemically synthesized
gcaatgatgtttggtagctt

SEQ ID NO: 147724 - DNA, 20 bp, Artificial Sequence
  chemically synthesized
aaaattaatttaatatgcct

SEQ ID NO: 147725 - DNA, 20 bp, Artificial Sequence
  chemically synthesized
atgatattttcaacttatga

SEQ ID NO: 147726 - DNA, 20 bp, Artificial Sequence
  chemically synthesized
tgatattttcaacttatgat

SEQ ID NO: 147727 - DNA, 20 bp, Artificial Sequence
  chemically synthesized
catcccaatcagcccatcat

SEQ ID NO: 147728 - DNA, 20 bp, Artificial Sequence
  chemically synthesized
tcaacttatgatgggctgat

SEQ ID NO: 147729 - DNA, 20 bp, Artificial Sequence
  chemically synthesized
caacttatgatgggctgatt

SEQ ID NO: 147730 - DNA, 20 bp, Artificial Sequence
  chemically synthesized
cactgggattacatcccaat

SEQ ID NO: 147731 - DNA, 20 bp, Artificial Sequence
  chemically synthesized
ggctgattgggatgtaatcc

SEQ ID NO: 147732 - DNA, 20 bp, Artificial Sequence
  chemically synthesized
gatgctcattgatttacact

SEQ ID NO: 147733 - DNA, 20 bp, Artificial Sequence
  chemically synthesized
agatgctcattgatttacac

SEQ ID NO: 147734 - DNA, 20 bp, Artificial Sequence
  chemically synthesized
taatcccagtgtaaatcaat

SEQ ID NO: 147735 - DNA, 20 bp, Artificial Sequence
  chemically synthesized
ttttaattcttttggatata

SEQ ID NO: 147736 - DNA, 20 bp, Artificial Sequence
  chemically synthesized
atgagcatctgtatatccaa

SEQ ID NO: 147737 - DNA, 20 bp, Artificial Sequence
  chemically synthesized
gatcctgtttttaattcttt

SEQ ID NO: 147738 - DNA, 20 bp, Artificial Sequence
  chemically synthesized
atatccaaaagaattaaaaa

SEQ ID NO: 147739 - DNA, 20 bp, Artificial Sequence
  chemically synthesized
tatccaaaagaattaaaaac

SEQ ID NO: 147740 - DNA, 20 bp, Artificial Sequence
  chemically synthesized
gaattaaaaacaggatctta

SEQ ID NO: 147741 - DNA, 20 bp, Artificial Sequence
  chemically synthesized
attaaaaacaggatcttaaa

SEQ ID NO: 147742 - DNA, 20 bp, Artificial Sequence
  chemically synthesized
gagtgtgcaaatatctcttt

SEQ ID NO: 147743 - DNA, 20 bp, Artificial Sequence
  chemically synthesized
aattatgccgcagttaatat

SEQ ID NO: 147744 - DNA, 20 bp, Artificial Sequence
  chemically synthesized
ttgcacactcatattaactg

SEQ ID NO: 147745 - DNA, 20 bp, Artificial Sequence
  chemically synthesized
ggctattgtgaattatgccg

SEQ ID NO: 147746 - DNA, 20 bp, Artificial Sequence
  chemically synthesized
aactgcggcataattcacaa

SEQ ID NO: 147747 - DNA, 20 bp, Artificial Sequence
  chemically synthesized
ttcacaatagccaaaaattg

SEQ ID NO: 147748 - DNA, 20 bp, Artificial Sequence
  chemically synthesized
attttagttacttcaatttt

SEQ ID NO: 147749 - DNA, 20 bp, Artificial Sequence
  chemically synthesized
ttatcaatcaatggacattt

SEQ ID NO: 147750 - DNA, 20 bp, Artificial Sequence
  chemically synthesized
ttaatccgtttatcaatcaa

SEQ ID NO: 147751 - DNA, 20 bp, Artificial Sequence
  chemically synthesized
aatgtccattgattgataaa

SEQ ID NO: 147752 - DNA, 20 bp, Artificial Sequence
  chemically synthesized
gataaacggattaaaaaatg

SEQ ID NO: 147753 - DNA, 20 bp, Artificial Sequence
  chemically synthesized
acggattaaaaaatgtggta

SEQ ID NO: 147754 - DNA, 20 bp, Artificial Sequence
  chemically synthesized
cggattaaaaaatgtggtat

SEQ ID NO: 147755 - DNA, 20 bp, Artificial Sequence
  chemically synthesized
aaatgtggtataggacacaa

SEQ ID NO: 147756 - DNA, 20 bp, Artificial Sequence
  chemically synthesized
cacaacggaatattattact

SEQ ID NO: 147757 - DNA, 20 bp, Artificial Sequence
  chemically synthesized
ttccttctttttttgtggcc

SEQ ID NO: 147758 - DNA, 20 bp, Artificial Sequence
  chemically synthesized
ttattactcggccacaaaaa

SEQ ID NO: 147759 - DNA, 20 bp, Artificial Sequence
  chemically synthesized
aggatttccttctttttttg

SEQ ID NO: 147760 - DNA, 20 bp, Artificial Sequence
  chemically synthesized
ttactcggccacaaaaaaag

SEQ ID NO: 147761 - DNA, 20 bp, Artificial Sequence
  chemically synthesized
tactcggccacaaaaaaaga

SEQ ID NO: 147762 - DNA, 20 bp, Artificial Sequence
  chemically synthesized
cccatgttgtagcataggaa

SEQ ID NO: 147763 - DNA, 20 bp, Artificial Sequence
  chemically synthesized
acccatgttgtagcatagga

SEQ ID NO: 147764 - DNA, 20 bp, Artificial Sequence
  chemically synthesized
gtacacccatgttgtagcat

SEQ ID NO: 147765 - DNA, 20 bp, Artificial Sequence
  chemically synthesized
ggtacacccatgttgtagca

SEQ ID NO: 147766 - DNA, 20 bp, Artificial Sequence
  chemically synthesized
tcctttcctatgctacaaca

SEQ ID NO: 147767 - DNA, 20 bp, Artificial Sequence
  chemically synthesized
cctttcctatgctacaacat

SEQ ID NO: 147768 - DNA, 20 bp, Artificial Sequence
  chemically synthesized
ttcaaggtacacccatgttg

SEQ ID NO: 147769 - DNA, 20 bp, Artificial Sequence
  chemically synthesized
tacaacatgggtgtaccttg

SEQ ID NO: 147770 - DNA, 20 bp, Artificial Sequence
  chemically synthesized
cacttagcataatgtcttca

SEQ ID NO: 147771 - DNA, 20 bp, Artificial Sequence
  chemically synthesized
tcacttagcataatgtcttc

SEQ ID NO: 147772 - DNA, 20 bp, Artificial Sequence
  chemically synthesized
taccttgaagacattatgct

SEQ ID NO: 147773 - DNA, 20 bp, Artificial Sequence
  chemically synthesized
tatgactggcttatttcact

SEQ ID NO: 147774 - DNA, 20 bp, Artificial Sequence
  chemically synthesized
gacattatgctaagtgaaat

SEQ ID NO: 147775 - DNA, 20 bp, Artificial Sequence
  chemically synthesized
ttatgctaagtgaaataagc

SEQ ID NO: 147776 - DNA, 20 bp, Artificial Sequence
  chemically synthesized
agtatttgtcattttatgac

SEQ ID NO: 147777 - DNA, 20 bp, Artificial Sequence
  chemically synthesized
atcatataaaaggaagcatg

SEQ ID NO: 147778 - DNA, 20 bp, Artificial Sequence
  chemically synthesized
tagatacatcatataaaagg

SEQ ID NO: 147779 - DNA, 20 bp, Artificial Sequence
  chemically synthesized
ctttagatacatcatataaa

SEQ ID NO: 147780 - DNA, 20 bp, Artificial Sequence
  chemically synthesized
actttagatacatcatataa

SEQ ID NO: 147781 - DNA, 20 bp, Artificial Sequence
  chemically synthesized
ccttttatatgatgtatcta

SEQ ID NO: 147782 - DNA, 20 bp, Artificial Sequence
  chemically synthesized
tttatatgatgtatctaaag

SEQ ID NO: 147783 - DNA, 20 bp, Artificial Sequence
  chemically synthesized
tctaaagagtttaactactt

SEQ ID NO: 147784 - DNA, 20 bp, Artificial Sequence
  chemically synthesized
tctaaagtagttaaactctt

SEQ ID NO: 147785 - DNA, 20 bp, Artificial Sequence
  chemically synthesized
taaagtagttaaactcttta

SEQ ID NO: 147786 - DNA, 20 bp, Artificial Sequence
  chemically synthesized
ctctactttctgtctctaaa

SEQ ID NO: 147787 - DNA, 20 bp, Artificial Sequence
  chemically synthesized
gtagttaaactctttagaga

SEQ ID NO: 147788 - DNA, 20 bp, Artificial Sequence
  chemically synthesized
cactctactttctgtctcta

SEQ ID NO: 147789 - DNA, 20 bp, Artificial Sequence
  chemically synthesized
ttaaactctttagagacaga

SEQ ID NO: 147790 - DNA, 20 bp, Artificial Sequence
  chemically synthesized
aactctttagagacagaaag

SEQ ID NO: 147791 - DNA, 20 bp, Artificial Sequence
  chemically synthesized
ctctttagagacagaaagta

SEQ ID NO: 147792 - DNA, 20 bp, Artificial Sequence
  chemically synthesized
tttagagacagaaagtagag

SEQ ID NO: 147793 - DNA, 20 bp, Artificial Sequence
  chemically synthesized
aagtagagtggtcatattgc

SEQ ID NO: 147794 - DNA, 20 bp, Artificial Sequence
  chemically synthesized
agtggtcatattgccagtgc

SEQ ID NO: 147795 - DNA, 20 bp, Artificial Sequence
  chemically synthesized
gtggtcatattgccagtgct

SEQ ID NO: 147796 - DNA, 20 bp, Artificial Sequence
  chemically synthesized
tggtcatattgccagtgctg

SEQ ID NO: 147797 - DNA, 20 bp, Artificial Sequence
  chemically synthesized
tgctccctgtaccccagcac

SEQ ID NO: 147798 - DNA, 20 bp, Artificial Sequence
  chemically synthesized
atattgccagtgctggggta

SEQ ID NO: 147799 - DNA, 20 bp, Artificial Sequence
  chemically synthesized
tattgccagtgctggggtac

SEQ ID NO: 147800 - DNA, 20 bp, Artificial Sequence
  chemically synthesized
attgccagtgctggggtaca

SEQ ID NO: 147801 - DNA, 20 bp, Artificial Sequence
  chemically synthesized
tcccattgctccctgtaccc

SEQ ID NO: 147802 - DNA, 20 bp, Artificial Sequence
  chemically synthesized
tgccagtgctggggtacagg

SEQ ID NO: 147803 - DNA, 20 bp, Artificial Sequence
  chemically synthesized
tgctggggtacagggagcaa

SEQ ID NO: 147804 - DNA, 20 bp, Artificial Sequence
  chemically synthesized
gctggggtacagggagcaat

SEQ ID NO: 147805 - DNA, 20 bp, Artificial Sequence
  chemically synthesized
tggggtacagggagcaatgg

SEQ ID NO: 147806 - DNA, 20 bp, Artificial Sequence
  chemically synthesized
agggagcaatgggagctctt

SEQ ID NO: 147807 - DNA, 20 bp, Artificial Sequence
  chemically synthesized
gagcaatgggagctcttcag

SEQ ID NO: 147808 - DNA, 20 bp, Artificial Sequence
  chemically synthesized
agcaatgggagctcttcagt

SEQ ID NO: 147809 - DNA, 20 bp, Artificial Sequence
  chemically synthesized
gaaactccaaacccactgaa

SEQ ID NO: 147810 - DNA, 20 bp, Artificial Sequence
  chemically synthesized
ccgaaactccaaacccactg

SEQ ID NO: 147811 - DNA, 20 bp, Artificial Sequence
  chemically synthesized
tgggagctcttcagtgggtt

SEQ ID NO: 147812 - DNA, 20 bp, Artificial Sequence
  chemically synthesized
ggagctcttcagtgggtttg

SEQ ID NO: 147813 - DNA, 20 bp, Artificial Sequence
  chemically synthesized
cttcagtgggtttggagttt

SEQ ID NO: 147814 - DNA, 20 bp, Artificial Sequence
  chemically synthesized
gggtttggagtttcggattt

SEQ ID NO: 147815 - DNA, 20 bp, Artificial Sequence
  chemically synthesized
gtttggagtttcggatttga

SEQ ID NO: 147816 - DNA, 20 bp, Artificial Sequence
  chemically synthesized
tttgagagatgaaaacattc

SEQ ID NO: 147817 - DNA, 20 bp, Artificial Sequence
  chemically synthesized
tgagagatgaaaacattcta

SEQ ID NO: 147818 - DNA, 20 bp, Artificial Sequence
  chemically synthesized
attgttattcaacagatctc

SEQ ID NO: 147819 - DNA, 20 bp, Artificial Sequence
  chemically synthesized
atacatacattgttattcaa

SEQ ID NO: 147820 - DNA, 20 bp, Artificial Sequence
  chemically synthesized
gttgaataacaatgtatgta

SEQ ID NO: 147821 - DNA, 20 bp, Artificial Sequence
  chemically synthesized
gtatgtatagttaacactac

SEQ ID NO: 147822 - DNA, 20 bp, Artificial Sequence
  chemically synthesized
gttttatgtgtacaaaccag

SEQ ID NO: 147823 - DNA, 20 bp, Artificial Sequence
  chemically synthesized
actgttttatgtgtacaaac

SEQ ID NO: 147824 - DNA, 20 bp, Artificial Sequence
  chemically synthesized
actggtttgtacacataaaa

SEQ ID NO: 147825 - DNA, 20 bp, Artificial Sequence
  chemically synthesized
tttgtacacataaaacagtt

SEQ ID NO: 147826 - DNA, 20 bp, Artificial Sequence
  chemically synthesized
tacacataaaacagttaagc

SEQ ID NO: 147827 - DNA, 20 bp, Artificial Sequence
  chemically synthesized
ataaaacagttaagctggca

SEQ ID NO: 147828 - DNA, 20 bp, Artificial Sequence
  chemically synthesized
ccacataatacaaactttgc

SEQ ID NO: 147829 - DNA, 20 bp, Artificial Sequence
  chemically synthesized
ctggcaaagtttgtattatg

SEQ ID NO: 147830 - DNA, 20 bp, Artificial Sequence
  chemically synthesized
tggcaaagtttgtattatgt

SEQ ID NO: 147831 - DNA, 20 bp, Artificial Sequence
  chemically synthesized
aaagtataatttaaaaaatg

SEQ ID NO: 147832 - DNA, 20 bp, Artificial Sequence
  chemically synthesized
cattttttaaattatacttt

SEQ ID NO: 147833 - DNA, 20 bp, Artificial Sequence
  chemically synthesized
ttaaattatactttaagttc

SEQ ID NO: 147834 - DNA, 20 bp, Artificial Sequence
  chemically synthesized
cacatgtatcccagaactta

SEQ ID NO: 147835 - DNA, 20 bp, Artificial Sequence
  chemically synthesized
taaattatactttaagttct

SEQ ID NO: 147836 - DNA, 20 bp, Artificial Sequence
  chemically synthesized
tacattctgcacatgtatcc

SEQ ID NO: 147837 - DNA, 20 bp, Artificial Sequence
  chemically synthesized
taagttctgggatacatgtg

SEQ ID NO: 147838 - DNA, 20 bp, Artificial Sequence
  chemically synthesized
ggatacatgtgcagaatgta

SEQ ID NO: 147839 - DNA, 20 bp, Artificial Sequence
  chemically synthesized
gatacatgtgcagaatgtac

SEQ ID NO: 147840 - DNA, 20 bp, Artificial Sequence
  chemically synthesized
gaatgtacaggtttgctacg

SEQ ID NO: 147841 - DNA, 20 bp, Artificial Sequence
  chemically synthesized
aatgtacaggtttgctacgt

SEQ ID NO: 147842 - DNA, 20 bp, Artificial Sequence
  chemically synthesized
atggcacgtgtatacctacg

SEQ ID NO: 147843 - DNA, 20 bp, Artificial Sequence
  chemically synthesized
acgtaggtatacacgtgcca

SEQ ID NO: 147844 - DNA, 20 bp, Artificial Sequence
  chemically synthesized
taggtatacacgtgccatgg

SEQ ID NO: 147845 - DNA, 20 bp, Artificial Sequence
  chemically synthesized
atgggtacagcaaaccacca

SEQ ID NO: 147846 - DNA, 20 bp, Artificial Sequence
  chemically synthesized
agatgaagggttgatgggta

SEQ ID NO: 147847 - DNA, 20 bp, Artificial Sequence
  chemically synthesized
aatgtagatgaagggttgat

SEQ ID NO: 147848 - DNA, 20 bp, Artificial Sequence
  chemically synthesized
taatgtagatgaagggttga

SEQ ID NO: 147849 - DNA, 20 bp, Artificial Sequence
  chemically synthesized
aaatacctaatgtagatgaa

SEQ ID NO: 147850 - DNA, 20 bp, Artificial Sequence
  chemically synthesized
gaaatacctaatgtagatga

SEQ ID NO: 147851 - DNA, 20 bp, Artificial Sequence
  chemically synthesized
agaaatacctaatgtagatg

SEQ ID NO: 147852 - DNA, 20 bp, Artificial Sequence
  chemically synthesized
catcaacccttcatctacat

SEQ ID NO: 147853 - DNA, 20 bp, Artificial Sequence
  chemically synthesized
atcaacccttcatctacatt

SEQ ID NO: 147854 - DNA, 20 bp, Artificial Sequence
  chemically synthesized
gttaggagaaatacctaatg

SEQ ID NO: 147855 - DNA, 20 bp, Artificial Sequence
  chemically synthesized
agagggagggataacgttag

SEQ ID NO: 147856 - DNA, 20 bp, Artificial Sequence
  chemically synthesized
gcagagggagggataacgtt

SEQ ID NO: 147857 - DNA, 20 bp, Artificial Sequence
  chemically synthesized
ggcagagggagggataacgt

SEQ ID NO: 147858 - DNA, 20 bp, Artificial Sequence
  chemically synthesized
gggattggggggcagaggga

SEQ ID NO: 147859 - DNA, 20 bp, Artificial Sequence
  chemically synthesized
ggggattggggggcagaggg

SEQ ID NO: 147860 - DNA, 20 bp, Artificial Sequence
  chemically synthesized
gggggattggggggcagagg

SEQ ID NO: 147861 - DNA, 20 bp, Artificial Sequence
  chemically synthesized
ttgggggattggggggcaga

SEQ ID NO: 147862 - DNA, 20 bp, Artificial Sequence
  chemically synthesized
gttgggggattggggggcag

SEQ ID NO: 147863 - DNA, 20 bp, Artificial Sequence
  chemically synthesized
agttgggggattggggggca

SEQ ID NO: 147864 - DNA, 20 bp, Artificial Sequence
  chemically synthesized
ccagttgggggattgggggg

SEQ ID NO: 147865 - DNA, 20 bp, Artificial Sequence
  chemically synthesized
acaccagttgggggattggg

SEQ ID NO: 147866 - DNA, 20 bp, Artificial Sequence
  chemically synthesized
cacaccagttgggggattgg

SEQ ID NO: 147867 - DNA, 20 bp, Artificial Sequence
  chemically synthesized
acacaccagttgggggattg

SEQ ID NO: 147868 - DNA, 20 bp, Artificial Sequence
  chemically synthesized
cacacaccagttgggggatt

SEQ ID NO: 147869 - DNA, 20 bp, Artificial Sequence
  chemically synthesized
tcacacaccagttgggggat

SEQ ID NO: 147870 - DNA, 20 bp, Artificial Sequence
  chemically synthesized
ctgccccccaatcccccaac

SEQ ID NO: 147871 - DNA, 20 bp, Artificial Sequence
  chemically synthesized
gaacatcacacaccagttgg

SEQ ID NO: 147872 - DNA, 20 bp, Artificial Sequence
  chemically synthesized
ggaacatcacacaccagttg

SEQ ID NO: 147873 - DNA, 20 bp, Artificial Sequence
  chemically synthesized
gggaacatcacacaccagtt

SEQ ID NO: 147874 - DNA, 20 bp, Artificial Sequence
  chemically synthesized
ggggaacatcacacaccagt

SEQ ID NO: 147875 - DNA, 20 bp, Artificial Sequence
  chemically synthesized
gggaggggaacatcacacac

SEQ ID NO: 147876 - DNA, 20 bp, Artificial Sequence
  chemically synthesized
aacacatggagatgggggag

SEQ ID NO: 147877 - DNA, 20 bp, Artificial Sequence
  chemically synthesized
gaacacatggagatggggga

SEQ ID NO: 147878 - DNA, 20 bp, Artificial Sequence
  chemically synthesized
agaacacatggagatggggg

SEQ ID NO: 147879 - DNA, 20 bp, Artificial Sequence
  chemically synthesized
gagaacacatggagatgggg

SEQ ID NO: 147880 - DNA, 20 bp, Artificial Sequence
  chemically synthesized
atgagaacacatggagatgg

SEQ ID NO: 147881 - DNA, 20 bp, Artificial Sequence
  chemically synthesized
gatgagaacacatggagatg

SEQ ID NO: 147882 - DNA, 20 bp, Artificial Sequence
  chemically synthesized
cgatgagaacacatggagat

SEQ ID NO: 147883 - DNA, 20 bp, Artificial Sequence
  chemically synthesized
acgatgagaacacatggaga

SEQ ID NO: 147884 - DNA, 20 bp, Artificial Sequence
  chemically synthesized
ttgaacgatgagaacacatg

SEQ ID NO: 147885 - DNA, 20 bp, Artificial Sequence
  chemically synthesized
agttgaacgatgagaacaca

SEQ ID NO: 147886 - DNA, 20 bp, Artificial Sequence
  chemically synthesized
ataagtgggagttgaacgat

SEQ ID NO: 147887 - DNA, 20 bp, Artificial Sequence
  chemically synthesized
atgttctcactcataagtgg

SEQ ID NO: 147888 - DNA, 20 bp, Artificial Sequence
  chemically synthesized
atcgttcaactcccacttat

SEQ ID NO: 147889 - DNA, 20 bp, Artificial Sequence
  chemically synthesized
gcatgttctcactcataagt

SEQ ID NO: 147890 - DNA, 20 bp, Artificial Sequence
  chemically synthesized
cgcatgttctcactcataag

SEQ ID NO: 147891 - DNA, 20 bp, Artificial Sequence
  chemically synthesized
ttcaactcccacttatgagt

SEQ ID NO: 147892 - DNA, 20 bp, Artificial Sequence
  chemically synthesized
caccgcatgttctcactcat

SEQ ID NO: 147893 - DNA, 20 bp, Artificial Sequence
  chemically synthesized
cacttatgagtgagaacatg

SEQ ID NO: 147894 - DNA, 20 bp, Artificial Sequence
  chemically synthesized
gagtgagaacatgcggtgtt

SEQ ID NO: 147895 - DNA, 20 bp, Artificial Sequence
  chemically synthesized
tcagcaaactaacacaggaa

SEQ ID NO: 147896 - DNA, 20 bp, Artificial Sequence
  chemically synthesized
ttggttttctgttcctgtgt

SEQ ID NO: 147897 - DNA, 20 bp, Artificial Sequence
  chemically synthesized
cattctcagcaaactaacac

SEQ ID NO: 147898 - DNA, 20 bp, Artificial Sequence
  chemically synthesized
tcattctcagcaaactaaca

SEQ ID NO: 147899 - DNA, 20 bp, Artificial Sequence
  chemically synthesized
tgttcctgtgttagtttgct

SEQ ID NO: 147900 - DNA, 20 bp, Artificial Sequence
  chemically synthesized
tgttagtttgctgagaatga

SEQ ID NO: 147901 - DNA, 20 bp, Artificial Sequence
  chemically synthesized
aagctggaaaccatcattct

SEQ ID NO: 147902 - DNA, 20 bp, Artificial Sequence
  chemically synthesized
ttgctgagaatgatggtttc

SEQ ID NO: 147903 - DNA, 20 bp, Artificial Sequence
  chemically synthesized
tgtaaggacatggatgaagc

SEQ ID NO: 147904 - DNA, 20 bp, Artificial Sequence
  chemically synthesized
cctttgtaaggacatggatg

SEQ ID NO: 147905 - DNA, 20 bp, Artificial Sequence
  chemically synthesized
tcgtgtcctttgtaaggaca

SEQ ID NO: 147906 - DNA, 20 bp, Artificial Sequence
  chemically synthesized
gcttcatccatgtccttaca

SEQ ID NO: 147907 - DNA, 20 bp, Artificial Sequence
  chemically synthesized
cttcatccatgtccttacaa

SEQ ID NO: 147908 - DNA, 20 bp, Artificial Sequence
  chemically synthesized
atgcgttcgtgtcctttgta

SEQ ID NO: 147909 - DNA, 20 bp, Artificial Sequence
  chemically synthesized
gatgcgttcgtgtcctttgt

SEQ ID NO: 147910 - DNA, 20 bp, Artificial Sequence
  chemically synthesized
cacgaacgcatcctttttta

SEQ ID NO: 147911 - DNA, 20 bp, Artificial Sequence
  chemically synthesized
atactatgcagccataaaaa

SEQ ID NO: 147912 - DNA, 20 bp, Artificial Sequence
  chemically synthesized
aatactatgcagccataaaa

SEQ ID NO: 147913 - DNA, 20 bp, Artificial Sequence
  chemically synthesized
catccttttttatggctgca

SEQ ID NO: 147914 - DNA, 20 bp, Artificial Sequence
  chemically synthesized
atacaccatagaatactatg

SEQ ID NO: 147915 - DNA, 20 bp, Artificial Sequence
  chemically synthesized
tatggctgcatagtattcta

SEQ ID NO: 147916 - DNA, 20 bp, Artificial Sequence
  chemically synthesized
aatgtggcacatatacacca

SEQ ID NO: 147917 - DNA, 20 bp, Artificial Sequence
  chemically synthesized
tagactggatacagaaaatg

SEQ ID NO: 147918 - DNA, 20 bp, Artificial Sequence
  chemically synthesized
tgtgccacattttctgtatc

SEQ ID NO: 147919 - DNA, 20 bp, Artificial Sequence
  chemically synthesized
catcaataatagactggata

SEQ ID NO: 147920 - DNA, 20 bp, Artificial Sequence
  chemically synthesized
aatgtccatcaataatagac

SEQ ID NO: 147921 - DNA, 20 bp, Artificial Sequence
  chemically synthesized
tgtatccagtctattattga

SEQ ID NO: 147922 - DNA, 20 bp, Artificial Sequence
  chemically synthesized
acccaaatgtccatcaataa

SEQ ID NO: 147923 - DNA, 20 bp, Artificial Sequence
  chemically synthesized
gtctattattgatggacatt

SEQ ID NO: 147924 - DNA, 20 bp, Artificial Sequence
  chemically synthesized
tctattattgatggacattt

SEQ ID NO: 147925 - DNA, 20 bp, Artificial Sequence
  chemically synthesized
ttattgatggacatttgggt

SEQ ID NO: 147926 - DNA, 20 bp, Artificial Sequence
  chemically synthesized
tggacatttgggttggttcc

SEQ ID NO: 147927 - DNA, 20 bp, Artificial Sequence
  chemically synthesized
tgtttacaatagcaaagact

SEQ ID NO: 147928 - DNA, 20 bp, Artificial Sequence
  chemically synthesized
cagcactgtttacaatagca

SEQ ID NO: 147929 - DNA, 20 bp, Artificial Sequence
  chemically synthesized
caagtctttgctattgtaaa

SEQ ID NO: 147930 - DNA, 20 bp, Artificial Sequence
  chemically synthesized
tgttgcagcactgtttacaa

SEQ ID NO: 147931 - DNA, 20 bp, Artificial Sequence
  chemically synthesized
atgcacacgtacgtttgttg

SEQ ID NO: 147932 - DNA, 20 bp, Artificial Sequence
  chemically synthesized
tacgtgtgcatgtgtcttta

SEQ ID NO: 147933 - DNA, 20 bp, Artificial Sequence
  chemically synthesized
gtgtgcatgtgtctttacag

SEQ ID NO: 147934 - DNA, 20 bp, Artificial Sequence
  chemically synthesized
ttataaatcattctactgta

SEQ ID NO: 147935 - DNA, 20 bp, Artificial Sequence
  chemically synthesized
tagaatgatttataatcctt

SEQ ID NO: 147936 - DNA, 20 bp, Artificial Sequence
  chemically synthesized
agaatgatttataatccttt

SEQ ID NO: 147937 - DNA, 20 bp, Artificial Sequence
  chemically synthesized
attactgggtatatacccaa

SEQ ID NO: 147938 - DNA, 20 bp, Artificial Sequence
  chemically synthesized
cattactgggtatataccca

SEQ ID NO: 147939 - DNA, 20 bp, Artificial Sequence
  chemically synthesized
taatcctttgggtatatacc

SEQ ID NO: 147940 - DNA, 20 bp, Artificial Sequence
  chemically synthesized
tttgggtatatacccagtaa

SEQ ID NO: 147941 - DNA, 20 bp, Artificial Sequence
  chemically synthesized
ttgggtatatacccagtaat

SEQ ID NO: 147942 - DNA, 20 bp, Artificial Sequence
  chemically synthesized
aactcagccatcccattact

SEQ ID NO: 147943 - DNA, 20 bp, Artificial Sequence
  chemically synthesized
taactcagccatcccattac

SEQ ID NO: 147944 - DNA, 20 bp, Artificial Sequence
  chemically synthesized
gtatatacccagtaatggga

SEQ ID NO: 147945 - DNA, 20 bp, Artificial Sequence
  chemically synthesized
tacccagtaatgggatggct

SEQ ID NO: 147946 - DNA, 20 bp, Artificial Sequence
  chemically synthesized
aatgggatggctgagttaaa

SEQ ID NO: 147947 - DNA, 20 bp, Artificial Sequence
  chemically synthesized
accagaaataccatttaact

SEQ ID NO: 147948 - DNA, 20 bp, Artificial Sequence
  chemically synthesized
gctgagttaaatggtatttc

SEQ ID NO: 147949 - DNA, 20 bp, Artificial Sequence
  chemically synthesized
ttaaatggtatttctggttg

SEQ ID NO: 147950 - DNA, 20 bp, Artificial Sequence
  chemically synthesized
attcctcaaggatctacaac

SEQ ID NO: 147951 - DNA, 20 bp, Artificial Sequence
  chemically synthesized
atttctggttgtagatcctt

SEQ ID NO: 147952 - DNA, 20 bp, Artificial Sequence
  chemically synthesized
tttctggttgtagatccttg

SEQ ID NO: 147953 - DNA, 20 bp, Artificial Sequence
  chemically synthesized
gaccgtgtggcgattcctca

SEQ ID NO: 147954 - DNA, 20 bp, Artificial Sequence
  chemically synthesized
agaccgtgtggcgattcctc

SEQ ID NO: 147955 - DNA, 20 bp, Artificial Sequence
  chemically synthesized
atccttgaggaatcgccaca

SEQ ID NO: 147956 - DNA, 20 bp, Artificial Sequence
  chemically synthesized
aaccattgtggaagaccgtg

SEQ ID NO: 147957 - DNA, 20 bp, Artificial Sequence
  chemically synthesized
cgccacacggtcttccacaa

SEQ ID NO: 147958 - DNA, 20 bp, Artificial Sequence
  chemically synthesized
aattacttcaaccattgtgg

SEQ ID NO: 147959 - DNA, 20 bp, Artificial Sequence
  chemically synthesized
gtgaattacttcaaccattg

SEQ ID NO: 147960 - DNA, 20 bp, Artificial Sequence
  chemically synthesized
acggtcttccacaatggttg

SEQ ID NO: 147961 - DNA, 20 bp, Artificial Sequence
  chemically synthesized
gtaattcacactcccaccaa

SEQ ID NO: 147962 - DNA, 20 bp, Artificial Sequence
  chemically synthesized
cgcttttacactgttggtgg

SEQ ID NO: 147963 - DNA, 20 bp, Artificial Sequence
  chemically synthesized
aacgcttttacactgttggt

SEQ ID NO: 147964 - DNA, 20 bp, Artificial Sequence
  chemically synthesized
gaacgcttttacactgttgg

SEQ ID NO: 147965 - DNA, 20 bp, Artificial Sequence
  chemically synthesized
taggaacgcttttacactgt

SEQ ID NO: 147966 - DNA, 20 bp, Artificial Sequence
  chemically synthesized
cactcccaccaacagtgtaa

SEQ ID NO: 147967 - DNA, 20 bp, Artificial Sequence
  chemically synthesized
tggagaggatgtggagaaat

SEQ ID NO: 147968 - DNA, 20 bp, Artificial Sequence
  chemically synthesized
ctggagaggatgtggagaaa

SEQ ID NO: 147969 - DNA, 20 bp, Artificial Sequence
  chemically synthesized
cagatgctggagaggatgtg

SEQ ID NO: 147970 - DNA, 20 bp, Artificial Sequence
  chemically synthesized
aacagatgctggagaggatg

SEQ ID NO: 147971 - DNA, 20 bp, Artificial Sequence
  chemically synthesized
ctatttctccacatcctctc

SEQ ID NO: 147972 - DNA, 20 bp, Artificial Sequence
  chemically synthesized
ggaaacaacagatgctggag

SEQ ID NO: 147973 - DNA, 20 bp, Artificial Sequence
  chemically synthesized
aggaaacaacagatgctgga

SEQ ID NO: 147974 - DNA, 20 bp, Artificial Sequence
  chemically synthesized
tcaggaaacaacagatgctg

SEQ ID NO: 147975 - DNA, 20 bp, Artificial Sequence
  chemically synthesized
agtcaggaaacaacagatgc

SEQ ID NO: 147976 - DNA, 20 bp, Artificial Sequence
  chemically synthesized
attaaaaagtcaggaaacaa

SEQ ID NO: 147977 - DNA, 20 bp, Artificial Sequence
  chemically synthesized
aaggcgatcattaaaaagtc

SEQ ID NO: 147978 - DNA, 20 bp, Artificial Sequence
  chemically synthesized
aaaggcgatcattaaaaagt

SEQ ID NO: 147979 - DNA, 20 bp, Artificial Sequence
  chemically synthesized
ttagaaaggcgatcattaaa

SEQ ID NO: 147980 - DNA, 20 bp, Artificial Sequence
  chemically synthesized
ccatctcacatcagttagaa

SEQ ID NO: 147981 - DNA, 20 bp, Artificial Sequence
  chemically synthesized
accatctcacatcagttaga

SEQ ID NO: 147982 - DNA, 20 bp, Artificial Sequence
  chemically synthesized
agataccatctcacatcagt

SEQ ID NO: 147983 - DNA, 20 bp, Artificial Sequence
  chemically synthesized
atcgcctttctaactgatgt

SEQ ID NO: 147984 - DNA, 20 bp, Artificial Sequence
  chemically synthesized
aatgagataccatctcacat

SEQ ID NO: 147985 - DNA, 20 bp, Artificial Sequence
  chemically synthesized
cctttctaactgatgtgaga

SEQ ID NO: 147986 - DNA, 20 bp, Artificial Sequence
  chemically synthesized
tgtgagatggtatctcattg

SEQ ID NO: 147987 - DNA, 20 bp, Artificial Sequence
  chemically synthesized
atgcaaatcaaaaccgcaat

SEQ ID NO: 147988 - DNA, 20 bp, Artificial Sequence
  chemically synthesized
atttgcatttctctaatgac

SEQ ID NO: 147989 - DNA, 20 bp, Artificial Sequence
  chemically synthesized
ctcatcatcactggtcatta

SEQ ID NO: 147990 - DNA, 20 bp, Artificial Sequence
  chemically synthesized
agctcatcatcactggtcat

SEQ ID NO: 147991 - DNA, 20 bp, Artificial Sequence
  chemically synthesized
gaaaaaaagctcatcatcac

SEQ ID NO: 147992 - DNA, 20 bp, Artificial Sequence
  chemically synthesized
ctctaatgaccagtgatgat

SEQ ID NO: 147993 - DNA, 20 bp, Artificial Sequence
  chemically synthesized
gccaaaagacacatgaaaaa

SEQ ID NO: 147994 - DNA, 20 bp, Artificial Sequence
  chemically synthesized
gctttttttcatgtgtcttt

SEQ ID NO: 147995 - DNA, 20 bp, Artificial Sequence
  chemically synthesized
gaagacatttatgtggccaa

SEQ ID NO: 147996 - DNA, 20 bp, Artificial Sequence
  chemically synthesized
ctcaaaagaagacatttatg

SEQ ID NO: 147997 - DNA, 20 bp, Artificial Sequence
  chemically synthesized
ccacataaatgtcttctttt

SEQ ID NO: 147998 - DNA, 20 bp, Artificial Sequence
  chemically synthesized
aaacagactcttctcaaaag

SEQ ID NO: 147999 - DNA, 20 bp, Artificial Sequence
  chemically synthesized
cataaatgtcttcttttgag

SEQ ID NO: 148000 - DNA, 20 bp, Artificial Sequence
  chemically synthesized
taaatgtcttcttttgagaa

SEQ ID NO: 148001 - DNA, 20 bp, Artificial Sequence
  chemically synthesized
tataaacagactcttctcaa

SEQ ID NO: 148002 - DNA, 20 bp, Artificial Sequence
  chemically synthesized
aagtgggggaaggatataaa

SEQ ID NO: 148003 - DNA, 20 bp, Artificial Sequence
  chemically synthesized
ccccatcaaaaagtggggga

SEQ ID NO: 148004 - DNA, 20 bp, Artificial Sequence
  chemically synthesized
accccatcaaaaagtggggg

SEQ ID NO: 148005 - DNA, 20 bp, Artificial Sequence
  chemically synthesized
acaaccccatcaaaaagtgg

SEQ ID NO: 148006 - DNA, 20 bp, Artificial Sequence
  chemically synthesized
aacaaccccatcaaaaagtg

SEQ ID NO: 148007 - DNA, 20 bp, Artificial Sequence
  chemically synthesized
aaacaaccccatcaaaaagt

SEQ ID NO: 148008 - DNA, 20 bp, Artificial Sequence
  chemically synthesized
caaacaaccccatcaaaaag

SEQ ID NO: 148009 - DNA, 20 bp, Artificial Sequence
  chemically synthesized
atccttcccccactttttga

SEQ ID NO: 148010 - DNA, 20 bp, Artificial Sequence
  chemically synthesized
tccttcccccactttttgat

SEQ ID NO: 148011 - DNA, 20 bp, Artificial Sequence
  chemically synthesized
ccttcccccactttttgatg

SEQ ID NO: 148012 - DNA, 20 bp, Artificial Sequence
  chemically synthesized
aaacaaacaaccccatcaaa

SEQ ID NO: 148013 - DNA, 20 bp, Artificial Sequence
  chemically synthesized
tgtggtttaatcaaatttac

SEQ ID NO: 148014 - DNA, 20 bp, Artificial Sequence
  chemically synthesized
ttcccttttaaaataaaatg

SEQ ID NO: 148015 - DNA, 20 bp, Artificial Sequence
  chemically synthesized
taaaccacattttattttaa

SEQ ID NO: 148016 - DNA, 20 bp, Artificial Sequence
  chemically synthesized
aaaccacattttattttaaa

SEQ ID NO: 148017 - DNA, 20 bp, Artificial Sequence
  chemically synthesized
aaccacattttattttaaaa

SEQ ID NO: 148018 - DNA, 20 bp, Artificial Sequence
  chemically synthesized
ttattttaaaagggaattca

SEQ ID NO: 148019 - DNA, 20 bp, Artificial Sequence
  chemically synthesized
ttaaaagggaattcatagac

SEQ ID NO: 148020 - DNA, 20 bp, Artificial Sequence
  chemically synthesized
taaaagggaattcatagacc

SEQ ID NO: 148021 - DNA, 20 bp, Artificial Sequence
  chemically synthesized
taaaaagtccacaattcacc

SEQ ID NO: 148022 - DNA, 20 bp, Artificial Sequence
  chemically synthesized
ttcatagaccaggtgaattg

SEQ ID NO: 148023 - DNA, 20 bp, Artificial Sequence
  chemically synthesized
actcagaagggaattttaaa

SEQ ID NO: 148024 - DNA, 20 bp, Artificial Sequence
  chemically synthesized
actttttaaaattcccttct

SEQ ID NO: 148025 - DNA, 20 bp, Artificial Sequence
  chemically synthesized
taaatctccttaactcagaa

SEQ ID NO: 148026 - DNA, 20 bp, Artificial Sequence
  chemically synthesized
ttaaatctccttaactcaga

SEQ ID NO: 148027 - DNA, 20 bp, Artificial Sequence
  chemically synthesized
ttaaaattcccttctgagtt

SEQ ID NO: 148028 - DNA, 20 bp, Artificial Sequence
  chemically synthesized
tttaaatctccttaactcag

SEQ ID NO: 148029 - DNA, 20 bp, Artificial Sequence
  chemically synthesized
taaaattcccttctgagtta

SEQ ID NO: 148030 - DNA, 20 bp, Artificial Sequence
  chemically synthesized
aaattcccttctgagttaag

SEQ ID NO: 148031 - DNA, 20 bp, Artificial Sequence
  chemically synthesized
tcttttaaatctccttaact

SEQ ID NO: 148032 - DNA, 20 bp, Artificial Sequence
  chemically synthesized
tctgagttaaggagatttaa

SEQ ID NO: 148033 - DNA, 20 bp, Artificial Sequence
  chemically synthesized
tgagttaaggagatttaaaa

SEQ ID NO: 148034 - DNA, 20 bp, Artificial Sequence
  chemically synthesized
gatttaaaagagattttttt

SEQ ID NO: 148035 - DNA, 20 bp, Artificial Sequence
  chemically synthesized
ttacaggatgatatttatta

SEQ ID NO: 148036 - DNA, 20 bp, Artificial Sequence
  chemically synthesized
tcagaaccattggaatttac

SEQ ID NO: 148037 - DNA, 20 bp, Artificial Sequence
  chemically synthesized
atcagaaccattggaattta

SEQ ID NO: 148038 - DNA, 20 bp, Artificial Sequence
  chemically synthesized
tatcatcctgtaaattccaa

SEQ ID NO: 148039 - DNA, 20 bp, Artificial Sequence
  chemically synthesized
ccttaatatatcagaaccat

SEQ ID NO: 148040 - DNA, 20 bp, Artificial Sequence
  chemically synthesized
tccaatggttctgatatatt

SEQ ID NO: 148041 - DNA, 20 bp, Artificial Sequence
  chemically synthesized
tccactgggccttaatatat

SEQ ID NO: 148042 - DNA, 20 bp, Artificial Sequence
  chemically synthesized
ccaatggttctgatatatta

SEQ ID NO: 148043 - DNA, 20 bp, Artificial Sequence
  chemically synthesized
ggttctgatatattaaggcc

SEQ ID NO: 148044 - DNA, 20 bp, Artificial Sequence
  chemically synthesized
tctgatatattaaggcccag

SEQ ID NO: 148045 - DNA, 20 bp, Artificial Sequence
  chemically synthesized
taaatcgattattttccact

SEQ ID NO: 148046 - DNA, 20 bp, Artificial Sequence
  chemically synthesized
ataaatcgattattttccac

SEQ ID NO: 148047 - DNA, 20 bp, Artificial Sequence
  chemically synthesized
ggatgcaagtaggagtagtg

SEQ ID NO: 148048 - DNA, 20 bp, Artificial Sequence
  chemically synthesized
aggatgcaagtaggagtagt

SEQ ID NO: 148049 - DNA, 20 bp, Artificial Sequence
  chemically synthesized
aatgaggatgcaagtaggag

SEQ ID NO: 148050 - DNA, 20 bp, Artificial Sequence
  chemically synthesized
tgcaatgaggatgcaagtag

SEQ ID NO: 148051 - DNA, 20 bp, Artificial Sequence
  chemically synthesized
attgcaatgaggatgcaagt

SEQ ID NO: 148052 - DNA, 20 bp, Artificial Sequence
  chemically synthesized
tattgcaatgaggatgcaag

SEQ ID NO: 148053 - DNA, 20 bp, Artificial Sequence
  chemically synthesized
aaatattgcaatgaggatgc

SEQ ID NO: 148054 - DNA, 20 bp, Artificial Sequence
  chemically synthesized
accccacaaatattgcaatg

SEQ ID NO: 148055 - DNA, 20 bp, Artificial Sequence
  chemically synthesized
taccccacaaatattgcaat

SEQ ID NO: 148056 - DNA, 20 bp, Artificial Sequence
  chemically synthesized
catcctcattgcaatatttg

SEQ ID NO: 148057 - DNA, 20 bp, Artificial Sequence
  chemically synthesized
atcctcattgcaatatttgt

SEQ ID NO: 148058 - DNA, 20 bp, Artificial Sequence
  chemically synthesized
tcctcattgcaatatttgtg

SEQ ID NO: 148059 - DNA, 20 bp, Artificial Sequence
  chemically synthesized
cattgcaatatttgtggggt

SEQ ID NO: 148060 - DNA, 20 bp, Artificial Sequence
  chemically synthesized
tgcaatatttgtggggtaag

SEQ ID NO: 148061 - DNA, 20 bp, Artificial Sequence
  chemically synthesized
gtggggtaagcagaatatgc

SEQ ID NO: 148062 - DNA, 20 bp, Artificial Sequence
  chemically synthesized
tatccactacagagaggcac

SEQ ID NO: 148063 - DNA, 20 bp, Artificial Sequence
  chemically synthesized
aatatgccagtgcctctctg

SEQ ID NO: 148064 - DNA, 20 bp, Artificial Sequence
  chemically synthesized
ttacagtatccactacagag

SEQ ID NO: 148065 - DNA, 20 bp, Artificial Sequence
  chemically synthesized
atgccagtgcctctctgtag

SEQ ID NO: 148066 - DNA, 20 bp, Artificial Sequence
  chemically synthesized
attacagtatccactacaga

SEQ ID NO: 148067 - DNA, 20 bp, Artificial Sequence
  chemically synthesized
gcattacagtatccactaca

SEQ ID NO: 148068 - DNA, 20 bp, Artificial Sequence
  chemically synthesized
aagcattacagtatccacta

SEQ ID NO: 148069 - DNA, 20 bp, Artificial Sequence
  chemically synthesized
aggatcttgatgaagcatta

SEQ ID NO: 148070 - DNA, 20 bp, Artificial Sequence
  chemically synthesized
ggatactgtaatgcttcatc

SEQ ID NO: 148071 - DNA, 20 bp, Artificial Sequence
  chemically synthesized
tccagaagaggatcttgatg

SEQ ID NO: 148072 - DNA, 20 bp, Artificial Sequence
  chemically synthesized
gcttcatcaagatcctcttc

SEQ ID NO: 148073 - DNA, 20 bp, Artificial Sequence
  chemically synthesized
ttcatcaagatcctcttctg

SEQ ID NO: 148074 - DNA, 20 bp, Artificial Sequence
  chemically synthesized
gggtgcatcgactccagaag

SEQ ID NO: 148075 - DNA, 20 bp, Artificial Sequence
  chemically synthesized
tgggtgcatcgactccagaa

SEQ ID NO: 148076 - DNA, 20 bp, Artificial Sequence
  chemically synthesized
tgtgggtgcatcgactccag

SEQ ID NO: 148077 - DNA, 20 bp, Artificial Sequence
  chemically synthesized
tagtgtgggtgcatcgactc

SEQ ID NO: 148078 - DNA, 20 bp, Artificial Sequence
  chemically synthesized
aggaataatattggtagtgt

SEQ ID NO: 148079 - DNA, 20 bp, Artificial Sequence
  chemically synthesized
taggaataatattggtagtg

SEQ ID NO: 148080 - DNA, 20 bp, Artificial Sequence
  chemically synthesized
aatactaggaataatattgg

SEQ ID NO: 148081 - DNA, 20 bp, Artificial Sequence
  chemically synthesized
acaaatactaggaataatat

SEQ ID NO: 148082 - DNA, 20 bp, Artificial Sequence
  chemically synthesized
cacactaccaatattattcc

SEQ ID NO: 148083 - DNA, 20 bp, Artificial Sequence
  chemically synthesized
gcaaccacaccacaaatact

SEQ ID NO: 148084 - DNA, 20 bp, Artificial Sequence
  chemically synthesized
aatattattcctagtatttg

SEQ ID NO: 148085 - DNA, 20 bp, Artificial Sequence
  chemically synthesized
tgcaaccacaccacaaatac

SEQ ID NO: 148086 - DNA, 20 bp, Artificial Sequence
  chemically synthesized
tattcctagtatttgtggtg

SEQ ID NO: 148087 - DNA, 20 bp, Artificial Sequence
  chemically synthesized
tggtgtggttgcattgactc

SEQ ID NO: 148088 - DNA, 20 bp, Artificial Sequence
  chemically synthesized
ttgtagatattattattctg

SEQ ID NO: 148089 - DNA, 20 bp, Artificial Sequence
  chemically synthesized
ttttgtagatattattattc

SEQ ID NO: 148090 - DNA, 20 bp, Artificial Sequence
  chemically synthesized
cagaataataatatctacaa

SEQ ID NO: 148091 - DNA, 20 bp, Artificial Sequence
  chemically synthesized
agaataataatatctacaaa

SEQ ID NO: 148092 - DNA, 20 bp, Artificial Sequence
  chemically synthesized
atgcagctgtgatccttttg

SEQ ID NO: 148093 - DNA, 20 bp, Artificial Sequence
  chemically synthesized
taatatctacaaaaggatca

SEQ ID NO: 148094 - DNA, 20 bp, Artificial Sequence
  chemically synthesized
gcaggcaccagggagaaatg

SEQ ID NO: 148095 - DNA, 20 bp, Artificial Sequence
  chemically synthesized
atcacagctgcatttctccc

SEQ ID NO: 148096 - DNA, 20 bp, Artificial Sequence
  chemically synthesized
agccaagagcaggcaccagg

SEQ ID NO: 148097 - DNA, 20 bp, Artificial Sequence
  chemically synthesized
ctagccaagagcaggcacca

SEQ ID NO: 148098 - DNA, 20 bp, Artificial Sequence
  chemically synthesized
actagccaagagcaggcacc

SEQ ID NO: 148099 - DNA, 20 bp, Artificial Sequence
  chemically synthesized
cactagccaagagcaggcac

SEQ ID NO: 148100 - DNA, 20 bp, Artificial Sequence
  chemically synthesized
ttctccctggtgcctgctct

SEQ ID NO: 148101 - DNA, 20 bp, Artificial Sequence
  chemically synthesized
tctttgcactagccaagagc

SEQ ID NO: 148102 - DNA, 20 bp, Artificial Sequence
  chemically synthesized
atctttgcactagccaagag

SEQ ID NO: 148103 - DNA, 20 bp, Artificial Sequence
  chemically synthesized
ccctggtgcctgctcttggc

SEQ ID NO: 148104 - DNA, 20 bp, Artificial Sequence
  chemically synthesized
tgtatctttgcactagccaa

SEQ ID NO: 148105 - DNA, 20 bp, Artificial Sequence
  chemically synthesized
tttgtatctttgcactagcc

SEQ ID NO: 148106 - DNA, 20 bp, Artificial Sequence
  chemically synthesized
gcctgctcttggctagtgca

SEQ ID NO: 148107 - DNA, 20 bp, Artificial Sequence
  chemically synthesized
agacttttgtatctttgcac

SEQ ID NO: 148108 - DNA, 20 bp, Artificial Sequence
  chemically synthesized
tggctagtgcaaagatacaa

SEQ ID NO: 148109 - DNA, 20 bp, Artificial Sequence
  chemically synthesized
ccaaattgaggcaaatgggc

SEQ ID NO: 148110 - DNA, 20 bp, Artificial Sequence
  chemically synthesized
tctaccaaattgaggcaaat

SEQ ID NO: 148111 - DNA, 20 bp, Artificial Sequence
  chemically synthesized
ttctaccaaattgaggcaaa

SEQ ID NO: 148112 - DNA, 20 bp, Artificial Sequence
  chemically synthesized
ctcgcccatttgcctcaatt

SEQ ID NO: 148113 - DNA, 20 bp, Artificial Sequence
  chemically synthesized
ttcagagttctaccaaattg

SEQ ID NO: 148114 - DNA, 20 bp, Artificial Sequence
  chemically synthesized
gcccatttgcctcaatttgg

SEQ ID NO: 148115 - DNA, 20 bp, Artificial Sequence
  chemically synthesized
tttcagagttctaccaaatt

SEQ ID NO: 148116 - DNA, 20 bp, Artificial Sequence
  chemically synthesized
tcaatttggtagaactctga

SEQ ID NO: 148117 - DNA, 20 bp, Artificial Sequence
  chemically synthesized
ggagctgggatggtctttca

SEQ ID NO: 148118 - DNA, 20 bp, Artificial Sequence
  chemically synthesized
ctggagctgggatggtcttt

SEQ ID NO: 148119 - DNA, 20 bp, Artificial Sequence
  chemically synthesized
agaactctgaaagaccatcc

SEQ ID NO: 148120 - DNA, 20 bp, Artificial Sequence
  chemically synthesized
cagggacactggagctggga

SEQ ID NO: 148121 - DNA, 20 bp, Artificial Sequence
  chemically synthesized
ctgaaagaccatcccagctc

SEQ ID NO: 148122 - DNA, 20 bp, Artificial Sequence
  chemically synthesized
gtgacagggacactggagct

SEQ ID NO: 148123 - DNA, 20 bp, Artificial Sequence
  chemically synthesized
tgtgacagggacactggagc

SEQ ID NO: 148124 - DNA, 20 bp, Artificial Sequence
  chemically synthesized
cccatgtgacagggacactg

SEQ ID NO: 148125 - DNA, 20 bp, Artificial Sequence
  chemically synthesized
agcccatgtgacagggacac

SEQ ID NO: 148126 - DNA, 20 bp, Artificial Sequence
  chemically synthesized
gctccagtgtccctgtcaca

SEQ ID NO: 148127 - DNA, 20 bp, Artificial Sequence
  chemically synthesized
aggcttcagcccatgtgaca

SEQ ID NO: 148128 - DNA, 20 bp, Artificial Sequence
  chemically synthesized
ctccagtgtccctgtcacat

SEQ ID NO: 148129 - DNA, 20 bp, Artificial Sequence
  chemically synthesized
gaggcttcagcccatgtgac

SEQ ID NO: 148130 - DNA, 20 bp, Artificial Sequence
  chemically synthesized
tgaggcttcagcccatgtga

SEQ ID NO: 148131 - DNA, 20 bp, Artificial Sequence
  chemically synthesized
tgtccctgtcacatgggctg

SEQ ID NO: 148132 - DNA, 20 bp, Artificial Sequence
  chemically synthesized
tgtcacatgggctgaagcct

SEQ ID NO: 148133 - DNA, 20 bp, Artificial Sequence
  chemically synthesized
tgcagttgctactgaggctt

SEQ ID NO: 148134 - DNA, 20 bp, Artificial Sequence
  chemically synthesized
cacatgggctgaagcctcag

SEQ ID NO: 148135 - DNA, 20 bp, Artificial Sequence
  chemically synthesized
ccacactgcagttgctactg

SEQ ID NO: 148136 - DNA, 20 bp, Artificial Sequence
  chemically synthesized
tccacactgcagttgctact

SEQ ID NO: 148137 - DNA, 20 bp, Artificial Sequence
  chemically synthesized
tgaagcctcagtagcaactg

SEQ ID NO: 148138 - DNA, 20 bp, Artificial Sequence
  chemically synthesized
cctcagtagcaactgcagtg

SEQ ID NO: 148139 - DNA, 20 bp, Artificial Sequence
  chemically synthesized
agaaaagctcatccacactg

SEQ ID NO: 148140 - DNA, 20 bp, Artificial Sequence
  chemically synthesized
gtagcaactgcagtgtggat

SEQ ID NO: 148141 - DNA, 20 bp, Artificial Sequence
  chemically synthesized
gcagtattgggcagagagaa

SEQ ID NO: 148142 - DNA, 20 bp, Artificial Sequence
  chemically synthesized
aggaggcagtattgggcaga

SEQ ID NO: 148143 - DNA, 20 bp, Artificial Sequence
  chemically synthesized
gaaggaggcagtattgggca

SEQ ID NO: 148144 - DNA, 20 bp, Artificial Sequence
  chemically synthesized
gtgaaggaggcagtattggg

SEQ ID NO: 148145 - DNA, 20 bp, Artificial Sequence
  chemically synthesized
gaagtgaaggaggcagtatt

SEQ ID NO: 148146 - DNA, 20 bp, Artificial Sequence
  chemically synthesized
ggaagtgaaggaggcagtat

SEQ ID NO: 148147 - DNA, 20 bp, Artificial Sequence
  chemically synthesized
ttataaggaagtgaaggagg

SEQ ID NO: 148148 - DNA, 20 bp, Artificial Sequence
  chemically synthesized
tatttataaggaagtgaagg

SEQ ID NO: 148149 - DNA, 20 bp, Artificial Sequence
  chemically synthesized
ctatttataaggaagtgaag

SEQ ID NO: 148150 - DNA, 20 bp, Artificial Sequence
  chemically synthesized
tgctatttataaggaagtga

SEQ ID NO: 148151 - DNA, 20 bp, Artificial Sequence
  chemically synthesized
ttgctatttataaggaagtg

SEQ ID NO: 148152 - DNA, 20 bp, Artificial Sequence
  chemically synthesized
tattgttgctatttataagg

SEQ ID NO: 148153 - DNA, 20 bp, Artificial Sequence
  chemically synthesized
ctccttcacttccttataaa

SEQ ID NO: 148154 - DNA, 20 bp, Artificial Sequence
  chemically synthesized
aagtattgttgctatttata

SEQ ID NO: 148155 - DNA, 20 bp, Artificial Sequence
  chemically synthesized
gaagtattgttgctatttat

SEQ ID NO: 148156 - DNA, 20 bp, Artificial Sequence
  chemically synthesized
cacacagaaagtattttgag

SEQ ID NO: 148157 - DNA, 20 bp, Artificial Sequence
  chemically synthesized
ttgcacacagaaagtatttt

SEQ ID NO: 148158 - DNA, 20 bp, Artificial Sequence
  chemically synthesized
gacaaaaagttgcacacaga

SEQ ID NO: 148159 - DNA, 20 bp, Artificial Sequence
  chemically synthesized
ctgagacaaaaagttgcaca

SEQ ID NO: 148160 - DNA, 20 bp, Artificial Sequence
  chemically synthesized
ctgtgtgcaactttttgtct

SEQ ID NO: 148161 - DNA, 20 bp, Artificial Sequence
  chemically synthesized
gcaacagtctctgagacaaa

SEQ ID NO: 148162 - DNA, 20 bp, Artificial Sequence
  chemically synthesized
gtgtgcaactttttgtctca

SEQ ID NO: 148163 - DNA, 20 bp, Artificial Sequence
  chemically synthesized
attccttggcaacagtctct

SEQ ID NO: 148164 - DNA, 20 bp, Artificial Sequence
  chemically synthesized
ttgtctcagagactgttgcc

SEQ ID NO: 148165 - DNA, 20 bp, Artificial Sequence
  chemically synthesized
tgtctcagagactgttgcca

SEQ ID NO: 148166 - DNA, 20 bp, Artificial Sequence
  chemically synthesized
gagatgagattccttggcaa

SEQ ID NO: 148167 - DNA, 20 bp, Artificial Sequence
  chemically synthesized
gtgtcagagatgagattcct

SEQ ID NO: 148168 - DNA, 20 bp, Artificial Sequence
  chemically synthesized
agagatacggtgtcagagat

SEQ ID NO: 148169 - DNA, 20 bp, Artificial Sequence
  chemically synthesized
agaccagagatacggtgtca

SEQ ID NO: 148170 - DNA, 20 bp, Artificial Sequence
  chemically synthesized
atagaccagagatacggtgt

SEQ ID NO: 148171 - DNA, 20 bp, Artificial Sequence
  chemically synthesized
catctctgacaccgtatctc

SEQ ID NO: 148172 - DNA, 20 bp, Artificial Sequence
  chemically synthesized
acgtaaatagaccagagata

SEQ ID NO: 148173 - DNA, 20 bp, Artificial Sequence
  chemically synthesized
actattacgtaaatagacca

SEQ ID NO: 148174 - DNA, 20 bp, Artificial Sequence
  chemically synthesized
aaactattacgtaaatagac

SEQ ID NO: 148175 - DNA, 20 bp, Artificial Sequence
  chemically synthesized
aaaacaaactattacgtaaa

SEQ ID NO: 148176 - DNA, 20 bp, Artificial Sequence
  chemically synthesized
tctctggtctatttacgtaa

SEQ ID NO: 148177 - DNA, 20 bp, Artificial Sequence
  chemically synthesized
aatagtttgtttttaataca

SEQ ID NO: 148178 - DNA, 20 bp, Artificial Sequence
  chemically synthesized
agtttgtttttaatacatag

SEQ ID NO: 148179 - DNA, 20 bp, Artificial Sequence
  chemically synthesized
tagaagtaatatgatttttt

SEQ ID NO: 148180 - DNA, 20 bp, Artificial Sequence
  chemically synthesized
agaagtaatatgattttttc

SEQ ID NO: 148181 - DNA, 20 bp, Artificial Sequence
  chemically synthesized
tgattttttcaggcattcga

SEQ ID NO: 148182 - DNA, 20 bp, Artificial Sequence
  chemically synthesized
ttttttcaggcattcgatag

SEQ ID NO: 148183 - DNA, 20 bp, Artificial Sequence
  chemically synthesized
cgatagtagaatatttttta

SEQ ID NO: 148184 - DNA, 20 bp, Artificial Sequence
  chemically synthesized
tattttttaaagttaattat

SEQ ID NO: 148185 - DNA, 20 bp, Artificial Sequence
  chemically synthesized
ttttaaagttaattataagc

SEQ ID NO: 148186 - DNA, 20 bp, Artificial Sequence
  chemically synthesized
tttaaagttaattataagcc

SEQ ID NO: 148187 - DNA, 20 bp, Artificial Sequence
  chemically synthesized
taattataagccaggcgctg

SEQ ID NO: 148188 - DNA, 20 bp, Artificial Sequence
  chemically synthesized
caggcatgagccacagcgcc

SEQ ID NO: 148189 - DNA, 20 bp, Artificial Sequence
  chemically synthesized
ggtattacaggcatgagcca

SEQ ID NO: 148190 - DNA, 20 bp, Artificial Sequence
  chemically synthesized
agtgctggtattacaggcat

SEQ ID NO: 148191 - DNA, 20 bp, Artificial Sequence
  chemically synthesized
gtggctcatgcctgtaatac

SEQ ID NO: 148192 - DNA, 20 bp, Artificial Sequence
  chemically synthesized
tcccaaagtgctggtattac

SEQ ID NO: 148193 - DNA, 20 bp, Artificial Sequence
  chemically synthesized
ctcccaaagtgctggtatta

SEQ ID NO: 148194 - DNA, 20 bp, Artificial Sequence
  chemically synthesized
tgcctgtaataccagcactt

SEQ ID NO: 148195 - DNA, 20 bp, Artificial Sequence
  chemically synthesized
gcctgtaataccagcacttt

SEQ ID NO: 148196 - DNA, 20 bp, Artificial Sequence
  chemically synthesized
acctcagcctcccaaagtgc

SEQ ID NO: 148197 - DNA, 20 bp, Artificial Sequence
  chemically synthesized
ctgtaataccagcactttgg

SEQ ID NO: 148198 - DNA, 20 bp, Artificial Sequence
  chemically synthesized
tgtaataccagcactttggg

SEQ ID NO: 148199 - DNA, 20 bp, Artificial Sequence
  chemically synthesized
tctaccacctcagcctccca

SEQ ID NO: 148200 - DNA, 20 bp, Artificial Sequence
  chemically synthesized
taccagcactttgggaggct

SEQ ID NO: 148201 - DNA, 20 bp, Artificial Sequence
  chemically synthesized
accagcactttgggaggctg

SEQ ID NO: 148202 - DNA, 20 bp, Artificial Sequence
  chemically synthesized
agcactttgggaggctgagg

SEQ ID NO: 148203 - DNA, 20 bp, Artificial Sequence
  chemically synthesized
actttgggaggctgaggtgg

SEQ ID NO: 148204 - DNA, 20 bp, Artificial Sequence
  chemically synthesized
cctcaggtgttctaccacct

SEQ ID NO: 148205 - DNA, 20 bp, Artificial Sequence
  chemically synthesized
gctgaggtggtagaacacct

SEQ ID NO: 148206 - DNA, 20 bp, Artificial Sequence
  chemically synthesized
ctgaggtggtagaacacctg

SEQ ID NO: 148207 - DNA, 20 bp, Artificial Sequence
  chemically synthesized
gtggtagaacacctgaggtc

SEQ ID NO: 148208 - DNA, 20 bp, Artificial Sequence
  chemically synthesized
ggccttgaactccggacctc

SEQ ID NO: 148209 - DNA, 20 bp, Artificial Sequence
  chemically synthesized
ggtagaacacctgaggtccg

SEQ ID NO: 148210 - DNA, 20 bp, Artificial Sequence
  chemically synthesized
tggccttgaactccggacct

SEQ ID NO: 148211 - DNA, 20 bp, Artificial Sequence
  chemically synthesized
acacctgaggtccggagttc

SEQ ID NO: 148212 - DNA, 20 bp, Artificial Sequence
  chemically synthesized
cacctgaggtccggagttca

SEQ ID NO: 148213 - DNA, 20 bp, Artificial Sequence
  chemically synthesized
atcaggctggccttgaactc

SEQ ID NO: 148214 - DNA, 20 bp, Artificial Sequence
  chemically synthesized
tgaggtccggagttcaaggc

SEQ ID NO: 148215 - DNA, 20 bp, Artificial Sequence
  chemically synthesized
tttcaccataatgatcaggc

SEQ ID NO: 148216 - DNA, 20 bp, Artificial Sequence
  chemically synthesized
agggtttcaccataatgatc

SEQ ID NO: 148217 - DNA, 20 bp, Artificial Sequence
  chemically synthesized
caaggccagcctgatcatta

SEQ ID NO: 148218 - DNA, 20 bp, Artificial Sequence
  chemically synthesized
cagggtttcaccataatgat

SEQ ID NO: 148219 - DNA, 20 bp, Artificial Sequence
  chemically synthesized
ttgtacttttagtagagaca

SEQ ID NO: 148220 - DNA, 20 bp, Artificial Sequence
  chemically synthesized
tttgtacttttagtagagac

SEQ ID NO: 148221 - DNA, 20 bp, Artificial Sequence
  chemically synthesized
ttttgtacttttagtagaga

SEQ ID NO: 148222 - DNA, 20 bp, Artificial Sequence
  chemically synthesized
tgaaaccctgtctctactaa

SEQ ID NO: 148223 - DNA, 20 bp, Artificial Sequence
  chemically synthesized
ctaattttgtacttttagta

SEQ ID NO: 148224 - DNA, 20 bp, Artificial Sequence
  chemically synthesized
ggctaattttgtacttttag

SEQ ID NO: 148225 - DNA, 20 bp, Artificial Sequence
  chemically synthesized
cctggctaattttgtacttt

SEQ ID NO: 148226 - DNA, 20 bp, Artificial Sequence
  chemically synthesized
ctctactaaaagtacaaaat

SEQ ID NO: 148227 - DNA, 20 bp, Artificial Sequence
  chemically synthesized
actaaaagtacaaaattagc

SEQ ID NO: 148228 - DNA, 20 bp, Artificial Sequence
  chemically synthesized
ctaaaagtacaaaattagcc

SEQ ID NO: 148229 - DNA, 20 bp, Artificial Sequence
  chemically synthesized
agtacaaaattagccaggcg

SEQ ID NO: 148230 - DNA, 20 bp, Artificial Sequence
  chemically synthesized
acaaaattagccaggcgtgg

SEQ ID NO: 148231 - DNA, 20 bp, Artificial Sequence
  chemically synthesized
cagccatgcaccaccacgcc

SEQ ID NO: 148232 - DNA, 20 bp, Artificial Sequence
  chemically synthesized
tagccaggcgtggtggtgca

SEQ ID NO: 148233 - DNA, 20 bp, Artificial Sequence
  chemically synthesized
gtggtgcatggctgtaatcc

SEQ ID NO: 148234 - DNA, 20 bp, Artificial Sequence
  chemically synthesized
ctcccaagtagctgggatta

SEQ ID NO: 148235 - DNA, 20 bp, Artificial Sequence
  chemically synthesized
tggctgtaatcccagctact

SEQ ID NO: 148236 - DNA, 20 bp, Artificial Sequence
  chemically synthesized
cctcagcctcccaagtagct

SEQ ID NO: 148237 - DNA, 20 bp, Artificial Sequence
  chemically synthesized
ggctgtaatcccagctactt

SEQ ID NO: 148238 - DNA, 20 bp, Artificial Sequence
  chemically synthesized
gcctcagcctcccaagtagc

SEQ ID NO: 148239 - DNA, 20 bp, Artificial Sequence
  chemically synthesized
ctgtaatcccagctacttgg

SEQ ID NO: 148240 - DNA, 20 bp, Artificial Sequence
  chemically synthesized
tgtaatcccagctacttggg

SEQ ID NO: 148241 - DNA, 20 bp, Artificial Sequence
  chemically synthesized
tcctgcctcagcctcccaag

SEQ ID NO: 148242 - DNA, 20 bp, Artificial Sequence
  chemically synthesized
ttctcctgcctcagcctccc

SEQ ID NO: 148243 - DNA, 20 bp, Artificial Sequence
  chemically synthesized
tcccagctacttgggaggct

SEQ ID NO: 148244 - DNA, 20 bp, Artificial Sequence
  chemically synthesized
cccagctacttgggaggctg

SEQ ID NO: 148245 - DNA, 20 bp, Artificial Sequence
  chemically synthesized
agctacttgggaggctgagg

SEQ ID NO: 148246 - DNA, 20 bp, Artificial Sequence
  chemically synthesized
gctacttgggaggctgaggc

SEQ ID NO: 148247 - DNA, 20 bp, Artificial Sequence
  chemically synthesized
tacttgggaggctgaggcag

SEQ ID NO: 148248 - DNA, 20 bp, Artificial Sequence
  chemically synthesized
ttcaagtgattctcctgcct

SEQ ID NO: 148249 - DNA, 20 bp, Artificial Sequence
  chemically synthesized
caggagaatcacttgaaact

SEQ ID NO: 148250 - DNA, 20 bp, Artificial Sequence
  chemically synthesized
aacctccacctcttagtttc

SEQ ID NO: 148251 - DNA, 20 bp, Artificial Sequence
  chemically synthesized
ggagaatcacttgaaactaa

SEQ ID NO: 148252 - DNA, 20 bp, Artificial Sequence
  chemically synthesized
gagaatcacttgaaactaag

SEQ ID NO: 148253 - DNA, 20 bp, Artificial Sequence
  chemically synthesized
aatcacttgaaactaagagg

SEQ ID NO: 148254 - DNA, 20 bp, Artificial Sequence
  chemically synthesized
tcacttgaaactaagaggtg

SEQ ID NO: 148255 - DNA, 20 bp, Artificial Sequence
  chemically synthesized
tcactgcaacctccacctct

SEQ ID NO: 148256 - DNA, 20 bp, Artificial Sequence
  chemically synthesized
cacttgaaactaagaggtgg

SEQ ID NO: 148257 - DNA, 20 bp, Artificial Sequence
  chemically synthesized
aaactaagaggtggaggttg

SEQ ID NO: 148258 - DNA, 20 bp, Artificial Sequence
  chemically synthesized
taagaggtggaggttgcagt

SEQ ID NO: 148259 - DNA, 20 bp, Artificial Sequence
  chemically synthesized
ggtggaggttgcagtgagct

SEQ ID NO: 148260 - DNA, 20 bp, Artificial Sequence
  chemically synthesized
ggagtgcaatggcatgatct

SEQ ID NO: 148261 - DNA, 20 bp, Artificial Sequence
  chemically synthesized
tctcccaggctggagtgcaa

SEQ ID NO: 148262 - DNA, 20 bp, Artificial Sequence
  chemically synthesized
gagatcatgccattgcactc

SEQ ID NO: 148263 - DNA, 20 bp, Artificial Sequence
  chemically synthesized
catgccattgcactccagcc

SEQ ID NO: 148264 - DNA, 20 bp, Artificial Sequence
  chemically synthesized
atgccattgcactccagcct

SEQ ID NO: 148265 - DNA, 20 bp, Artificial Sequence
  chemically synthesized
ttgctttgtctcccaggctg

SEQ ID NO: 148266 - DNA, 20 bp, Artificial Sequence
  chemically synthesized
gccattgcactccagcctgg

SEQ ID NO: 148267 - DNA, 20 bp, Artificial Sequence
  chemically synthesized
tcttgctttgtctcccaggc

SEQ ID NO: 148268 - DNA, 20 bp, Artificial Sequence
  chemically synthesized
tgattcttgctttgtctccc

SEQ ID NO: 148269 - DNA, 20 bp, Artificial Sequence
  chemically synthesized
gcactccagcctgggagaca

SEQ ID NO: 148270 - DNA, 20 bp, Artificial Sequence
  chemically synthesized
atgattcttgctttgtctcc

SEQ ID NO: 148271 - DNA, 20 bp, Artificial Sequence
  chemically synthesized
tccagcctgggagacaaagc

SEQ ID NO: 148272 - DNA, 20 bp, Artificial Sequence
  chemically synthesized
actttttatttatttattta

SEQ ID NO: 148273 - DNA, 20 bp, Artificial Sequence
  chemically synthesized
taactttttatttatttatt

SEQ ID NO: 148274 - DNA, 20 bp, Artificial Sequence
  chemically synthesized
tctctaaataaataaataaa

SEQ ID NO: 148275 - DNA, 20 bp, Artificial Sequence
  chemically synthesized
ataaaaagttaattatttat

SEQ ID NO: 148276 - DNA, 20 bp, Artificial Sequence
  chemically synthesized
atactttttgtcatttttta

SEQ ID NO: 148277 - DNA, 20 bp, Artificial Sequence
  chemically synthesized
gcatactttttgtcattttt

SEQ ID NO: 148278 - DNA, 20 bp, Artificial Sequence
  chemically synthesized
atgctctaaaaaatgacaaa

SEQ ID NO: 148279 - DNA, 20 bp, Artificial Sequence
  chemically synthesized
aaaaaatgacaaaaagtatg

SEQ ID NO: 148280 - DNA, 20 bp, Artificial Sequence
  chemically synthesized
aaaatgacaaaaagtatgca

SEQ ID NO: 148281 - DNA, 20 bp, Artificial Sequence
  chemically synthesized
aaatgacaaaaagtatgcag

SEQ ID NO: 148282 - DNA, 20 bp, Artificial Sequence
  chemically synthesized
aaaagtatgcagaggattgt

SEQ ID NO: 148283 - DNA, 20 bp, Artificial Sequence
  chemically synthesized
tgttggcatatttattgttt

SEQ ID NO: 148284 - DNA, 20 bp, Artificial Sequence
  chemically synthesized
gttggcatatttattgttta

SEQ ID NO: 148285 - DNA, 20 bp, Artificial Sequence
  chemically synthesized
ttggcatatttattgtttaa

SEQ ID NO: 148286 - DNA, 20 bp, Artificial Sequence
  chemically synthesized
ttattgtttaagggcttata

SEQ ID NO: 148287 - DNA, 20 bp, Artificial Sequence
  chemically synthesized
ttgtttaagggcttataaag

SEQ ID NO: 148288 - DNA, 20 bp, Artificial Sequence
  chemically synthesized
ggagtgtaaaactactttat

SEQ ID NO: 148289 - DNA, 20 bp, Artificial Sequence
  chemically synthesized
taaagtagttttacactcct

SEQ ID NO: 148290 - DNA, 20 bp, Artificial Sequence
  chemically synthesized
aaagtagttttacactcctt

SEQ ID NO: 148291 - DNA, 20 bp, Artificial Sequence
  chemically synthesized
gaaactcaaatatacccaag

SEQ ID NO: 148292 - DNA, 20 bp, Artificial Sequence
  chemically synthesized
ttgaaactcaaatataccca

SEQ ID NO: 148293 - DNA, 20 bp, Artificial Sequence
  chemically synthesized
attgaaactcaaatataccc

SEQ ID NO: 148294 - DNA, 20 bp, Artificial Sequence
  chemically synthesized
tacactccttgggtatattt

SEQ ID NO: 148295 - DNA, 20 bp, Artificial Sequence
  chemically synthesized
tttgagtttcaatgtatcat

SEQ ID NO: 148296 - DNA, 20 bp, Artificial Sequence
  chemically synthesized
tgagtttcaatgtatcatca

SEQ ID NO: 148297 - DNA, 20 bp, Artificial Sequence
  chemically synthesized
tgcatatttcacataagaaa

SEQ ID NO: 148298 - DNA, 20 bp, Artificial Sequence
  chemically synthesized
gaagtgtgcatatttcacat

SEQ ID NO: 148299 - DNA, 20 bp, Artificial Sequence
  chemically synthesized
atgggtcttttagttacagg

SEQ ID NO: 148300 - DNA, 20 bp, Artificial Sequence
  chemically synthesized
ctcatgggtcttttagttac

SEQ ID NO: 148301 - DNA, 20 bp, Artificial Sequence
  chemically synthesized
tgcacacttcctgtaactaa

SEQ ID NO: 148302 - DNA, 20 bp, Artificial Sequence
  chemically synthesized
gctcatgggtcttttagtta

SEQ ID NO: 148303 - DNA, 20 bp, Artificial Sequence
  chemically synthesized
tgtcaagctcatgggtcttt

SEQ ID NO: 148304 - DNA, 20 bp, Artificial Sequence
  chemically synthesized
cctgtaactaaaagacccat

SEQ ID NO: 148305 - DNA, 20 bp, Artificial Sequence
  chemically synthesized
gttgaatttgtcaagctcat

SEQ ID NO: 148306 - DNA, 20 bp, Artificial Sequence
  chemically synthesized
agttgaatttgtcaagctca

SEQ ID NO: 148307 - DNA, 20 bp, Artificial Sequence
  chemically synthesized
cttcagcagttgaatttgtc

SEQ ID NO: 148308 - DNA, 20 bp, Artificial Sequence
  chemically synthesized
cttgacaaattcaactgctg

SEQ ID NO: 148309 - DNA, 20 bp, Artificial Sequence
  chemically synthesized
gacggagttcaagacttcag

SEQ ID NO: 148310 - DNA, 20 bp, Artificial Sequence
  chemically synthesized
gaagacggagttcaagactt

SEQ ID NO: 148311 - DNA, 20 bp, Artificial Sequence
  chemically synthesized
tcattatgaagacggagttc

SEQ ID NO: 148312 - DNA, 20 bp, Artificial Sequence
  chemically synthesized
ccaaggtcattatgaagacg

SEQ ID NO: 148313 - DNA, 20 bp, Artificial Sequence
  chemically synthesized
ttccaaggtcattatgaaga

SEQ ID NO: 148314 - DNA, 20 bp, Artificial Sequence
  chemically synthesized
acatttccaaggtcattatg

SEQ ID NO: 148315 - DNA, 20 bp, Artificial Sequence
  chemically synthesized
ctccgtcttcataatgacct

SEQ ID NO: 148316 - DNA, 20 bp, Artificial Sequence
  chemically synthesized
agatagcagttacatttcca

SEQ ID NO: 148317 - DNA, 20 bp, Artificial Sequence
  chemically synthesized
aagatagcagttacatttcc

SEQ ID NO: 148318 - DNA, 20 bp, Artificial Sequence
  chemically synthesized
ggaaatgtaactgctatctt

SEQ ID NO: 148319 - DNA, 20 bp, Artificial Sequence
  chemically synthesized
ttcaaaccaacttaagatag

SEQ ID NO: 148320 - DNA, 20 bp, Artificial Sequence
  chemically synthesized
cacttcaaaccaacttaaga

SEQ ID NO: 148321 - DNA, 20 bp, Artificial Sequence
  chemically synthesized
atgtaactgctatcttaagt

SEQ ID NO: 148322 - DNA, 20 bp, Artificial Sequence
  chemically synthesized
cagtcacttcaaaccaactt

SEQ ID NO: 148323 - DNA, 20 bp, Artificial Sequence
  chemically synthesized
tgctatcttaagttggtttg

SEQ ID NO: 148324 - DNA, 20 bp, Artificial Sequence
  chemically synthesized
aactcaagtttagttcaata

SEQ ID NO: 148325 - DNA, 20 bp, Artificial Sequence
  chemically synthesized
gactgtattgaactaaactt

SEQ ID NO: 148326 - DNA, 20 bp, Artificial Sequence
  chemically synthesized
agaacgttaaaactcaagtt

SEQ ID NO: 148327 - DNA, 20 bp, Artificial Sequence
  chemically synthesized
gacccagaacgttaaaactc

SEQ ID NO: 148328 - DNA, 20 bp, Artificial Sequence
  chemically synthesized
aaacttgagttttaacgttc

SEQ ID NO: 148329 - DNA, 20 bp, Artificial Sequence
  chemically synthesized
aacttgagttttaacgttct

SEQ ID NO: 148330 - DNA, 20 bp, Artificial Sequence
  chemically synthesized
tgagttttaacgttctgggt

SEQ ID NO: 148331 - DNA, 20 bp, Artificial Sequence
  chemically synthesized
tcataacatgtttactgacc

SEQ ID NO: 148332 - DNA, 20 bp, Artificial Sequence
  chemically synthesized
agtaaacatgttatgaattg

SEQ ID NO: 148333 - DNA, 20 bp, Artificial Sequence
  chemically synthesized
gtaaacatgttatgaattgc

SEQ ID NO: 148334 - DNA, 20 bp, Artificial Sequence
  chemically synthesized
catgttatgaattgcaggta

SEQ ID NO: 148335 - DNA, 20 bp, Artificial Sequence
  chemically synthesized
ggaaaacacactaactgaaa

SEQ ID NO: 148336 - DNA, 20 bp, Artificial Sequence
  chemically synthesized
gctagttccactatttcagt

SEQ ID NO: 148337 - DNA, 20 bp, Artificial Sequence
  chemically synthesized
aaacacactaactgaaatag

SEQ ID NO: 148338 - DNA, 20 bp, Artificial Sequence
  chemically synthesized
tgtagctagttccactattt

SEQ ID NO: 148339 - DNA, 20 bp, Artificial Sequence
  chemically synthesized
actaactgaaatagtggaac

SEQ ID NO: 148340 - DNA, 20 bp, Artificial Sequence
  chemically synthesized
taaattgattttgatgtagc

SEQ ID NO: 148341 - DNA, 20 bp, Artificial Sequence
  chemically synthesized
aacataaattgattttgatg

SEQ ID NO: 148342 - DNA, 20 bp, Artificial Sequence
  chemically synthesized
ttatgtttttatttaacttg

SEQ ID NO: 148343 - DNA, 20 bp, Artificial Sequence
  chemically synthesized
ggcatagtatggttttctac

SEQ ID NO: 148344 - DNA, 20 bp, Artificial Sequence
  chemically synthesized
tcgcacttctgggcatagta

SEQ ID NO: 148345 - DNA, 20 bp, Artificial Sequence
  chemically synthesized
gtagaaaaccatactatgcc

SEQ ID NO: 148346 - DNA, 20 bp, Artificial Sequence
  chemically synthesized
gaaaaccatactatgcccag

SEQ ID NO: 148347 - DNA, 20 bp, Artificial Sequence
  chemically synthesized
agttgtcgcacttctgggca

SEQ ID NO: 148348 - DNA, 20 bp, Artificial Sequence
  chemically synthesized
ttggtagttgtcgcacttct

SEQ ID NO: 148349 - DNA, 20 bp, Artificial Sequence
  chemically synthesized
gttggtagttgtcgcacttc

SEQ ID NO: 148350 - DNA, 20 bp, Artificial Sequence
  chemically synthesized
gatctcttttgtatggttgg

SEQ ID NO: 148351 - DNA, 20 bp, Artificial Sequence
  chemically synthesized
tttgatctcttttgtatggt

SEQ ID NO: 148352 - DNA, 20 bp, Artificial Sequence
  chemically synthesized
gacaactaccaaccatacaa

SEQ ID NO: 148353 - DNA, 20 bp, Artificial Sequence
  chemically synthesized
caactaccaaccatacaaaa

SEQ ID NO: 148354 - DNA, 20 bp, Artificial Sequence
  chemically synthesized
tgattttgatctcttttgta

SEQ ID NO: 148355 - DNA, 20 bp, Artificial Sequence
  chemically synthesized
atacaaaagagatcaaaatc

SEQ ID NO: 148356 - DNA, 20 bp, Artificial Sequence
  chemically synthesized
tacaaaagagatcaaaatca

SEQ ID NO: 148357 - DNA, 20 bp, Artificial Sequence
  chemically synthesized
acaaaagagatcaaaatcaa

SEQ ID NO: 148358 - DNA, 20 bp, Artificial Sequence
  chemically synthesized
caaaagagatcaaaatcaag

SEQ ID NO: 148359 - DNA, 20 bp, Artificial Sequence
  chemically synthesized
aaagagatcaaaatcaaggg

SEQ ID NO: 148360 - DNA, 20 bp, Artificial Sequence
  chemically synthesized
tcaaaatcaaggggagaaaa

SEQ ID NO: 148361 - DNA, 20 bp, Artificial Sequence
  chemically synthesized
caaaatcaaggggagaaaac

SEQ ID NO: 148362 - DNA, 20 bp, Artificial Sequence
  chemically synthesized
gaaaacaggtaacacttacg

SEQ ID NO: 148363 - DNA, 20 bp, Artificial Sequence
  chemically synthesized
aaaacaggtaacacttacgt

SEQ ID NO: 148364 - DNA, 20 bp, Artificial Sequence
  chemically synthesized
acaagcaatttttcctacgt

SEQ ID NO: 148365 - DNA, 20 bp, Artificial Sequence
  chemically synthesized
acgtaggaaaaattgcttgt

SEQ ID NO: 148366 - DNA, 20 bp, Artificial Sequence
  chemically synthesized
taggaaaaattgcttgttag

SEQ ID NO: 148367 - DNA, 20 bp, Artificial Sequence
  chemically synthesized
ttatttgttgtgcttctaac

SEQ ID NO: 148368 - DNA, 20 bp, Artificial Sequence
  chemically synthesized
aagcacaacaaataaaaatt

SEQ ID NO: 148369 - DNA, 20 bp, Artificial Sequence
  chemically synthesized
aatttggtgtttgtttcttt

SEQ ID NO: 148370 - DNA, 20 bp, Artificial Sequence
  chemically synthesized
ggtttggcagggatgtctta

SEQ ID NO: 148371 - DNA, 20 bp, Artificial Sequence
  chemically synthesized
gaatttgagatggtttggca

SEQ ID NO: 148372 - DNA, 20 bp, Artificial Sequence
  chemically synthesized
agaatttgagatggtttggc

SEQ ID NO: 148373 - DNA, 20 bp, Artificial Sequence
  chemically synthesized
aagaatttgagatggtttgg

SEQ ID NO: 148374 - DNA, 20 bp, Artificial Sequence
  chemically synthesized
aaaaagaatttgagatggtt

SEQ ID NO: 148375 - DNA, 20 bp, Artificial Sequence
  chemically synthesized
cgttcaaaaagaatttgaga

SEQ ID NO: 148376 - DNA, 20 bp, Artificial Sequence
  chemically synthesized
catacgttcaaaaagaattt

SEQ ID NO: 148377 - DNA, 20 bp, Artificial Sequence
  chemically synthesized
ttacctttcatacgttcaaa

SEQ ID NO: 148378 - DNA, 20 bp, Artificial Sequence
  chemically synthesized
aattctttttgaacgtatga

SEQ ID NO: 148379 - DNA, 20 bp, Artificial Sequence
  chemically synthesized
attctttttgaacgtatgaa

SEQ ID NO: 148380 - DNA, 20 bp, Artificial Sequence
  chemically synthesized
aggtaatcataaataaaaca

SEQ ID NO: 148381 - DNA, 20 bp, Artificial Sequence
  chemically synthesized
tcataaataaaacatggttt

SEQ ID NO: 148382 - DNA, 20 bp, Artificial Sequence
  chemically synthesized
taaataaaacatggtttcag

SEQ ID NO: 148383 - DNA, 20 bp, Artificial Sequence
  chemically synthesized
gaggaacattgttatttcaa

SEQ ID NO: 148384 - DNA, 20 bp, Artificial Sequence
  chemically synthesized
attgaaataacaatgttcct

SEQ ID NO: 148385 - DNA, 20 bp, Artificial Sequence
  chemically synthesized
tgaaataacaatgttcctca

SEQ ID NO: 148386 - DNA, 20 bp, Artificial Sequence
  chemically synthesized
actgtcatgctaatgctctg

SEQ ID NO: 148387 - DNA, 20 bp, Artificial Sequence
  chemically synthesized
aacaatgttcctcagagcat

SEQ ID NO: 148388 - DNA, 20 bp, Artificial Sequence
  chemically synthesized
aactgtcatgctaatgctct

SEQ ID NO: 148389 - DNA, 20 bp, Artificial Sequence
  chemically synthesized
tcctcagagcattagcatga

SEQ ID NO: 148390 - DNA, 20 bp, Artificial Sequence
  chemically synthesized
ttcaagtccaagacaatagg

SEQ ID NO: 148391 - DNA, 20 bp, Artificial Sequence
  chemically synthesized
gcacatacttcctattgtct

SEQ ID NO: 148392 - DNA, 20 bp, Artificial Sequence
  chemically synthesized
agattcaagtccaagacaat

SEQ ID NO: 148393 - DNA, 20 bp, Artificial Sequence
  chemically synthesized
gagattcaagtccaagacaa

SEQ ID NO: 148394 - DNA, 20 bp, Artificial Sequence
  chemically synthesized
agacaatgagattcaagtcc

SEQ ID NO: 148395 - DNA, 20 bp, Artificial Sequence
  chemically synthesized
ggattaagacaatgagattc

SEQ ID NO: 148396 - DNA, 20 bp, Artificial Sequence
  chemically synthesized
atcaaaaggattaagacaat

SEQ ID NO: 148397 - DNA, 20 bp, Artificial Sequence
  chemically synthesized
acccattcatcaaaaggatt

SEQ ID NO: 148398 - DNA, 20 bp, Artificial Sequence
  chemically synthesized
ttttaaacccattcatcaaa

SEQ ID NO: 148399 - DNA, 20 bp, Artificial Sequence
  chemically synthesized
attttaaacccattcatcaa

SEQ ID NO: 148400 - DNA, 20 bp, Artificial Sequence
  chemically synthesized
gtcttaatccttttgatgaa

SEQ ID NO: 148401 - DNA, 20 bp, Artificial Sequence
  chemically synthesized
tcttaatccttttgatgaat

SEQ ID NO: 148402 - DNA, 20 bp, Artificial Sequence
  chemically synthesized
tgatgaatgggtttaaaatt

SEQ ID NO: 148403 - DNA, 20 bp, Artificial Sequence
  chemically synthesized
atgaatgggtttaaaattaa

SEQ ID NO: 148404 - DNA, 20 bp, Artificial Sequence
  chemically synthesized
ggtttaaaattaagagtgta

SEQ ID NO: 148405 - DNA, 20 bp, Artificial Sequence
  chemically synthesized
tttaaaattaagagtgtaaa

SEQ ID NO: 148406 - DNA, 20 bp, Artificial Sequence
  chemically synthesized
ttaagagtgtaaagagtgta

SEQ ID NO: 148407 - DNA, 20 bp, Artificial Sequence
  chemically synthesized
agtgtaaagagtgtatggaa

SEQ ID NO: 148408 - DNA, 20 bp, Artificial Sequence
  chemically synthesized
agagtgtatggaaaagctgt

SEQ ID NO: 148409 - DNA, 20 bp, Artificial Sequence
  chemically synthesized
aaccatttactgtgggctca

SEQ ID NO: 148410 - DNA, 20 bp, Artificial Sequence
  chemically synthesized
atggaaaagctgtgagccca

SEQ ID NO: 148411 - DNA, 20 bp, Artificial Sequence
  chemically synthesized
cttcagaaaccatttactgt

SEQ ID NO: 148412 - DNA, 20 bp, Artificial Sequence
  chemically synthesized
agctgtgagcccacagtaaa

SEQ ID NO: 148413 - DNA, 20 bp, Artificial Sequence
  chemically synthesized
acttcagaaaccatttactg

SEQ ID NO: 148414 - DNA, 20 bp, Artificial Sequence
  chemically synthesized
cccacagtaaatggtttctg

SEQ ID NO: 148415 - DNA, 20 bp, Artificial Sequence
  chemically synthesized
acagtaaatggtttctgaag

SEQ ID NO: 148416 - DNA, 20 bp, Artificial Sequence
  chemically synthesized
agttggatatgtttctactt

SEQ ID NO: 148417 - DNA, 20 bp, Artificial Sequence
  chemically synthesized
tctttctgaataaacagagt

SEQ ID NO: 148418 - DNA, 20 bp, Artificial Sequence
  chemically synthesized
cagatctttctgaataaaca

SEQ ID NO: 148419 - DNA, 20 bp, Artificial Sequence
  chemically synthesized
catatccaactctgtttatt

SEQ ID NO: 148420 - DNA, 20 bp, Artificial Sequence
  chemically synthesized
cacagatctttctgaataaa

SEQ ID NO: 148421 - DNA, 20 bp, Artificial Sequence
  chemically synthesized
tccaactctgtttattcaga

SEQ ID NO: 148422 - DNA, 20 bp, Artificial Sequence
  chemically synthesized
tttattcagaaagatctgtg

SEQ ID NO: 148423 - DNA, 20 bp, Artificial Sequence
  chemically synthesized
actgtaataatacagcttca

SEQ ID NO: 148424 - DNA, 20 bp, Artificial Sequence
  chemically synthesized
atgaagcaactgtaataata

SEQ ID NO: 148425 - DNA, 20 bp, Artificial Sequence
  chemically synthesized
tctgtgaagctgtattatta

SEQ ID NO: 148426 - DNA, 20 bp, Artificial Sequence
  chemically synthesized
gcaaaaataagttcataatg

SEQ ID NO: 148427 - DNA, 20 bp, Artificial Sequence
  chemically synthesized
cctttgtaagcagcaaaaat

SEQ ID NO: 148428 - DNA, 20 bp, Artificial Sequence
  chemically synthesized
acttatttttgctgcttaca

SEQ ID NO: 148429 - DNA, 20 bp, Artificial Sequence
  chemically synthesized
cttatttttgctgcttacaa

SEQ ID NO: 148430 - DNA, 20 bp, Artificial Sequence
  chemically synthesized
tgggatttcccctttgtaag

SEQ ID NO: 148431 - DNA, 20 bp, Artificial Sequence
  chemically synthesized
ttatttttgctgcttacaaa

SEQ ID NO: 148432 - DNA, 20 bp, Artificial Sequence
  chemically synthesized
tatttttgctgcttacaaag

SEQ ID NO: 148433 - DNA, 20 bp, Artificial Sequence
  chemically synthesized
tgatgggatttcccctttgt

SEQ ID NO: 148434 - DNA, 20 bp, Artificial Sequence
  chemically synthesized
ttacaaaggggaaatcccat

SEQ ID NO: 148435 - DNA, 20 bp, Artificial Sequence
  chemically synthesized
aaggggaaatcccatcagat

SEQ ID NO: 148436 - DNA, 20 bp, Artificial Sequence
  chemically synthesized
tatcttagccctgatctgat

SEQ ID NO: 148437 - DNA, 20 bp, Artificial Sequence
  chemically synthesized
aggggaaatcccatcagatc

SEQ ID NO: 148438 - DNA, 20 bp, Artificial Sequence
  chemically synthesized
ttatcttagccctgatctga

SEQ ID NO: 148439 - DNA, 20 bp, Artificial Sequence
  chemically synthesized
ggggaaatcccatcagatca

SEQ ID NO: 148440 - DNA, 20 bp, Artificial Sequence
  chemically synthesized
aatcccatcagatcagggct

SEQ ID NO: 148441 - DNA, 20 bp, Artificial Sequence
  chemically synthesized
tgtttaaaaaggaattatct

SEQ ID NO: 148442 - DNA, 20 bp, Artificial Sequence
  chemically synthesized
gatttactgattgtttaaaa

SEQ ID NO: 148443 - DNA, 20 bp, Artificial Sequence
  chemically synthesized
tgatttactgattgtttaaa

SEQ ID NO: 148444 - DNA, 20 bp, Artificial Sequence
  chemically synthesized
ataattcctttttaaacaat

SEQ ID NO: 148445 - DNA, 20 bp, Artificial Sequence
  chemically synthesized
aaaaagtactagtgtaaaca

SEQ ID NO: 148446 - DNA, 20 bp, Artificial Sequence
  chemically synthesized
gaaaaagtactagtgtaaac

SEQ ID NO: 148447 - DNA, 20 bp, Artificial Sequence
  chemically synthesized
tatttaaaccttgtttacac

SEQ ID NO: 148448 - DNA, 20 bp, Artificial Sequence
  chemically synthesized
cgccatcatggaaaaagtac

SEQ ID NO: 148449 - DNA, 20 bp, Artificial Sequence
  chemically synthesized
aaacaacgccatcatggaaa

SEQ ID NO: 148450 - DNA, 20 bp, Artificial Sequence
  chemically synthesized
cactagtactttttccatga

SEQ ID NO: 148451 - DNA, 20 bp, Artificial Sequence
  chemically synthesized
tatgtaaaacaacgccatca

SEQ ID NO: 148452 - DNA, 20 bp, Artificial Sequence
  chemically synthesized
aacaaatttaacaagattga

SEQ ID NO: 148453 - DNA, 20 bp, Artificial Sequence
  chemically synthesized
tgagtcctaacaaatttaac

SEQ ID NO: 148454 - DNA, 20 bp, Artificial Sequence
  chemically synthesized
ttcaatcttgttaaatttgt

SEQ ID NO: 148455 - DNA, 20 bp, Artificial Sequence
  chemically synthesized
tcaatcttgttaaatttgtt

SEQ ID NO: 148456 - DNA, 20 bp, Artificial Sequence
  chemically synthesized
atttgttaggactcattttg

SEQ ID NO: 148457 - DNA, 20 bp, Artificial Sequence
  chemically synthesized
catatgttaggccacaaaat

SEQ ID NO: 148458 - DNA, 20 bp, Artificial Sequence
  chemically synthesized
ttcagggtagatcatatgtt

SEQ ID NO: 148459 - DNA, 20 bp, Artificial Sequence
  chemically synthesized
cttcagggtagatcatatgt

SEQ ID NO: 148460 - DNA, 20 bp, Artificial Sequence
  chemically synthesized
ctaacatatgatctaccctg

SEQ ID NO: 148461 - DNA, 20 bp, Artificial Sequence
  chemically synthesized
caagaaacaattcttcaggg

SEQ ID NO: 148462 - DNA, 20 bp, Artificial Sequence
  chemically synthesized
gcacaagaaacaattcttca

SEQ ID NO: 148463 - DNA, 20 bp, Artificial Sequence
  chemically synthesized
tgcacaagaaacaattcttc

SEQ ID NO: 148464 - DNA, 20 bp, Artificial Sequence
  chemically synthesized
gtgcacaagaaacaattctt

SEQ ID NO: 148465 - DNA, 20 bp, Artificial Sequence
  chemically synthesized
tacattcttatcaagtgcac

SEQ ID NO: 148466 - DNA, 20 bp, Artificial Sequence
  chemically synthesized
ttgtttcttgtgcacttgat

SEQ ID NO: 148467 - DNA, 20 bp, Artificial Sequence
  chemically synthesized
ggagaatatacattcttatc

SEQ ID NO: 148468 - DNA, 20 bp, Artificial Sequence
  chemically synthesized
aatgtatattctcctgctgt

SEQ ID NO: 148469 - DNA, 20 bp, Artificial Sequence
  chemically synthesized
tacatctcatctaacagcag

SEQ ID NO: 148470 - DNA, 20 bp, Artificial Sequence
  chemically synthesized
agtacatctcatctaacagc

SEQ ID NO: 148471 - DNA, 20 bp, Artificial Sequence
  chemically synthesized
cagtacatctcatctaacag

SEQ ID NO: 148472 - DNA, 20 bp, Artificial Sequence
  chemically synthesized
atattctcctgctgttagat

SEQ ID NO: 148473 - DNA, 20 bp, Artificial Sequence
  chemically synthesized
atacagtacatctcatctaa

SEQ ID NO: 148474 - DNA, 20 bp, Artificial Sequence
  chemically synthesized
atagacctagcagacatata

SEQ ID NO: 148475 - DNA, 20 bp, Artificial Sequence
  chemically synthesized
gatgtactgtatatgtctgc

SEQ ID NO: 148476 - DNA, 20 bp, Artificial Sequence
  chemically synthesized
atgtactgtatatgtctgct

SEQ ID NO: 148477 - DNA, 20 bp, Artificial Sequence
  chemically synthesized
tttagatcaaatagacctag

SEQ ID NO: 148478 - DNA, 20 bp, Artificial Sequence
  chemically synthesized
tgctttagatcaaatagacc

SEQ ID NO: 148479 - DNA, 20 bp, Artificial Sequence
  chemically synthesized
actttatgctttagatcaaa

SEQ ID NO: 148480 - DNA, 20 bp, Artificial Sequence
  chemically synthesized
tgctaggtctatttgatcta

SEQ ID NO: 148481 - DNA, 20 bp, Artificial Sequence
  chemically synthesized
tctatttgatctaaagcata

SEQ ID NO: 148482 - DNA, 20 bp, Artificial Sequence
  chemically synthesized
atgcattggactttatgctt

SEQ ID NO: 148483 - DNA, 20 bp, Artificial Sequence
  chemically synthesized
aaaaatcaataagaatgcat

SEQ ID NO: 148484 - DNA, 20 bp, Artificial Sequence
  chemically synthesized
atccacattaaaaaatcaat

SEQ ID NO: 148485 - DNA, 20 bp, Artificial Sequence
  chemically synthesized
ttcttattgattttttaatg

SEQ ID NO: 148486 - DNA, 20 bp, Artificial Sequence
  chemically synthesized
accccaaattcaacaataga

SEQ ID NO: 148487 - DNA, 20 bp, Artificial Sequence
  chemically synthesized
ttctaccccaaattcaacaa

SEQ ID NO: 148488 - DNA, 20 bp, Artificial Sequence
  chemically synthesized
tttctgtctattgttgaatt

SEQ ID NO: 148489 - DNA, 20 bp, Artificial Sequence
  chemically synthesized
ttctgtctattgttgaattt

SEQ ID NO: 148490 - DNA, 20 bp, Artificial Sequence
  chemically synthesized
tctgtctattgttgaatttg

SEQ ID NO: 148491 - DNA, 20 bp, Artificial Sequence
  chemically synthesized
gtctattgttgaatttgggg

SEQ ID NO: 148492 - DNA, 20 bp, Artificial Sequence
  chemically synthesized
tattgttgaatttggggtag

SEQ ID NO: 148493 - DNA, 20 bp, Artificial Sequence
  chemically synthesized
ctacagtacaataatagtag

SEQ ID NO: 148494 - DNA, 20 bp, Artificial Sequence
  chemically synthesized
actacagtacaataatagta

SEQ ID NO: 148495 - DNA, 20 bp, Artificial Sequence
  chemically synthesized
aactacagtacaataatagt

SEQ ID NO: 148496 - DNA, 20 bp, Artificial Sequence
  chemically synthesized
aaactacagtacaataatag

SEQ ID NO: 148497 - DNA, 20 bp, Artificial Sequence
  chemically synthesized
gacaaactacagtacaataa

SEQ ID NO: 148498 - DNA, 20 bp, Artificial Sequence
  chemically synthesized
cccctactattattgtactg

SEQ ID NO: 148499 - DNA, 20 bp, Artificial Sequence
  chemically synthesized
aaaaagaaagagacaaacta

SEQ ID NO: 148500 - DNA, 20 bp, Artificial Sequence
  chemically synthesized
tataaagtgataaaaagaaa

SEQ ID NO: 148501 - DNA, 20 bp, Artificial Sequence
  chemically synthesized
aatataaagtgataaaaaga

SEQ ID NO: 148502 - DNA, 20 bp, Artificial Sequence
  chemically synthesized
agcaaatataaagtgataaa

SEQ ID NO: 148503 - DNA, 20 bp, Artificial Sequence
  chemically synthesized
aaatatataaagcaaatata

SEQ ID NO: 148504 - DNA, 20 bp, Artificial Sequence
  chemically synthesized
ttggagtacctaaatatata

SEQ ID NO: 148505 - DNA, 20 bp, Artificial Sequence
  chemically synthesized
ttatatttgctttatatatt

SEQ ID NO: 148506 - DNA, 20 bp, Artificial Sequence
  chemically synthesized
tatatttgctttatatattt

SEQ ID NO: 148507 - DNA, 20 bp, Artificial Sequence
  chemically synthesized
atatttaggtactccaatgt

SEQ ID NO: 148508 - DNA, 20 bp, Artificial Sequence
  chemically synthesized
tatttaggtactccaatgtt

SEQ ID NO: 148509 - DNA, 20 bp, Artificial Sequence
  chemically synthesized
tatatatgcacccaacattg

SEQ ID NO: 148510 - DNA, 20 bp, Artificial Sequence
  chemically synthesized
aatatatatgcacccaacat

SEQ ID NO: 148511 - DNA, 20 bp, Artificial Sequence
  chemically synthesized
aaaggatcaattcatcaaga

SEQ ID NO: 148512 - DNA, 20 bp, Artificial Sequence
  chemically synthesized
aaaaggatcaattcatcaag

SEQ ID NO: 148513 - DNA, 20 bp, Artificial Sequence
  chemically synthesized
gataaaaggatcaattcatc

SEQ ID NO: 148514 - DNA, 20 bp, Artificial Sequence
  chemically synthesized
ggtcattaaataatgataaa

SEQ ID NO: 148515 - DNA, 20 bp, Artificial Sequence
  chemically synthesized
aggtcattaaataatgataa

SEQ ID NO: 148516 - DNA, 20 bp, Artificial Sequence
  chemically synthesized
aaactaaaaagacacaaaga

SEQ ID NO: 148517 - DNA, 20 bp, Artificial Sequence
  chemically synthesized
aaaactaaaaagacacaaag

SEQ ID NO: 148518 - DNA, 20 bp, Artificial Sequence
  chemically synthesized
tcaaaaactaaaaagacaca

SEQ ID NO: 148519 - DNA, 20 bp, Artificial Sequence
  chemically synthesized
tgaccttctttgtgtctttt

SEQ ID NO: 148520 - DNA, 20 bp, Artificial Sequence
  chemically synthesized
tttaaaaatcaaaaactaaa

SEQ ID NO: 148521 - DNA, 20 bp, Artificial Sequence
  chemically synthesized
tttttagtttttgattttta

SEQ ID NO: 148522 - DNA, 20 bp, Artificial Sequence
  chemically synthesized
atacttctattagacaaaat

SEQ ID NO: 148523 - DNA, 20 bp, Artificial Sequence
  chemically synthesized
catacttctattagacaaaa

SEQ ID NO: 148524 - DNA, 20 bp, Artificial Sequence
  chemically synthesized
ttaaagcctattttgtctaa

SEQ ID NO: 148525 - DNA, 20 bp, Artificial Sequence
  chemically synthesized
aagcctattttgtctaatag

SEQ ID NO: 148526 - DNA, 20 bp, Artificial Sequence
  chemically synthesized
ggggatagccatacttctat

SEQ ID NO: 148527 - DNA, 20 bp, Artificial Sequence
  chemically synthesized
tattttgtctaatagaagta

SEQ ID NO: 148528 - DNA, 20 bp, Artificial Sequence
  chemically synthesized
aaaccaaaagagaatgggga

SEQ ID NO: 148529 - DNA, 20 bp, Artificial Sequence
  chemically synthesized
atggaaaccaaaagagaatg

SEQ ID NO: 148530 - DNA, 20 bp, Artificial Sequence
  chemically synthesized
aatggaaaccaaaagagaat

SEQ ID NO: 148531 - DNA, 20 bp, Artificial Sequence
  chemically synthesized
aaatggaaaccaaaagagaa

SEQ ID NO: 148532 - DNA, 20 bp, Artificial Sequence
  chemically synthesized
tggctatccccattctcttt

SEQ ID NO: 148533 - DNA, 20 bp, Artificial Sequence
  chemically synthesized
catgcaaatggaaaccaaaa

SEQ ID NO: 148534 - DNA, 20 bp, Artificial Sequence
  chemically synthesized
tccatgcaaatggaaaccaa

SEQ ID NO: 148535 - DNA, 20 bp, Artificial Sequence
  chemically synthesized
tcttttggtttccatttgca

SEQ ID NO: 148536 - DNA, 20 bp, Artificial Sequence
  chemically synthesized
tattttggtttccatgcaaa

SEQ ID NO: 148537 - DNA, 20 bp, Artificial Sequence
  chemically synthesized
agagatagaaaaagatattt

SEQ ID NO: 148538 - DNA, 20 bp, Artificial Sequence
  chemically synthesized
tgaaatagaagagatagaaa

SEQ ID NO: 148539 - DNA, 20 bp, Artificial Sequence
  chemically synthesized
gttgactgaaatagaagaga

SEQ ID NO: 148540 - DNA, 20 bp, Artificial Sequence
  chemically synthesized
acatgttgactgaaatagaa

SEQ ID NO: 148541 - DNA, 20 bp, Artificial Sequence
  chemically synthesized
tttttctatctcttctattt

SEQ ID NO: 148542 - DNA, 20 bp, Artificial Sequence
  chemically synthesized
acacatgttgactgaaatag

SEQ ID NO: 148543 - DNA, 20 bp, Artificial Sequence
  chemically synthesized
aggacacatgttgactgaaa

SEQ ID NO: 148544 - DNA, 20 bp, Artificial Sequence
  chemically synthesized
tcagtcaacatgtgtcctaa

SEQ ID NO: 148545 - DNA, 20 bp, Artificial Sequence
  chemically synthesized
agagactcacgtcatctttt

SEQ ID NO: 148546 - DNA, 20 bp, Artificial Sequence
  chemically synthesized
aagagactcacgtcatcttt

SEQ ID NO: 148547 - DNA, 20 bp, Artificial Sequence
  chemically synthesized
tgtgtcctaaaagatgacgt

SEQ ID NO: 148548 - DNA, 20 bp, Artificial Sequence
  chemically synthesized
aagatgacgtgagtctctta

SEQ ID NO: 148549 - DNA, 20 bp, Artificial Sequence
  chemically synthesized
agatgacgtgagtctcttat

SEQ ID NO: 148550 - DNA, 20 bp, Artificial Sequence
  chemically synthesized
tgacgtgagtctcttatggg

SEQ ID NO: 148551 - DNA, 20 bp, Artificial Sequence
  chemically synthesized
caactacatgctgcccataa

SEQ ID NO: 148552 - DNA, 20 bp, Artificial Sequence
  chemically synthesized
ctcaactacatgctgcccat

SEQ ID NO: 148553 - DNA, 20 bp, Artificial Sequence
  chemically synthesized
agtctcttatgggcagcatg

SEQ ID NO: 148554 - DNA, 20 bp, Artificial Sequence
  chemically synthesized
cttatgggcagcatgtagtt

SEQ ID NO: 148555 - DNA, 20 bp, Artificial Sequence
  chemically synthesized
gccaaatggattaaaacaac

SEQ ID NO: 148556 - DNA, 20 bp, Artificial Sequence
  chemically synthesized
tcttgttgttttaatccatt

SEQ ID NO: 148557 - DNA, 20 bp, Artificial Sequence
  chemically synthesized
ctaaagatagagtggccaaa

SEQ ID NO: 148558 - DNA, 20 bp, Artificial Sequence
  chemically synthesized
tcaccagtctaaagatagag

SEQ ID NO: 148559 - DNA, 20 bp, Artificial Sequence
  chemically synthesized
ccatttggccactctatctt

SEQ ID NO: 148560 - DNA, 20 bp, Artificial Sequence
  chemically synthesized
aattcaccagtctaaagata

SEQ ID NO: 148561 - DNA, 20 bp, Artificial Sequence
  chemically synthesized
taaattcaccagtctaaaga

SEQ ID NO: 148562 - DNA, 20 bp, Artificial Sequence
  chemically synthesized
tggccactctatctttagac

SEQ ID NO: 148563 - DNA, 20 bp, Artificial Sequence
  chemically synthesized
ggattaaattcaccagtcta

SEQ ID NO: 148564 - DNA, 20 bp, Artificial Sequence
  chemically synthesized
tgtaaatggattaaattcac

SEQ ID NO: 148565 - DNA, 20 bp, Artificial Sequence
  chemically synthesized
atatttactttgaatgtaaa

SEQ ID NO: 148566 - DNA, 20 bp, Artificial Sequence
  chemically synthesized
atttaatccatttacattca

SEQ ID NO: 148567 - DNA, 20 bp, Artificial Sequence
  chemically synthesized
acattcaaagtaaatattga

SEQ ID NO: 148568 - DNA, 20 bp, Artificial Sequence
  chemically synthesized
cattcaaagtaaatattgat

SEQ ID NO: 148569 - DNA, 20 bp, Artificial Sequence
  chemically synthesized
tcaaagtaaatattgatagg

SEQ ID NO: 148570 - DNA, 20 bp, Artificial Sequence
  chemically synthesized
caaagtaaatattgataggt

SEQ ID NO: 148571 - DNA, 20 bp, Artificial Sequence
  chemically synthesized
aacaactttttaaatggcag

SEQ ID NO: 148572 - DNA, 20 bp, Artificial Sequence
  chemically synthesized
gaaaacaactttttaaatgg

SEQ ID NO: 148573 - DNA, 20 bp, Artificial Sequence
  chemically synthesized
atttactactgccatttaaa

SEQ ID NO: 148574 - DNA, 20 bp, Artificial Sequence
  chemically synthesized
ttagaaaacaactttttaaa

SEQ ID NO: 148575 - DNA, 20 bp, Artificial Sequence
  chemically synthesized
caaaggatctacaaaacaat

SEQ ID NO: 148576 - DNA, 20 bp, Artificial Sequence
  chemically synthesized
gttgttttctaattgttttg

SEQ ID NO: 148577 - DNA, 20 bp, Artificial Sequence
  chemically synthesized
aaaaaaggcatatagaacaa

SEQ ID NO: 148578 - DNA, 20 bp, Artificial Sequence
  chemically synthesized
aaaaaaaggcatatagaaca

SEQ ID NO: 148579 - DNA, 20 bp, Artificial Sequence
  chemically synthesized
agacaacaaaaaaaggcata

SEQ ID NO: 148580 - DNA, 20 bp, Artificial Sequence
  chemically synthesized
taaaagaagacaacaaaaaa

SEQ ID NO: 148581 - DNA, 20 bp, Artificial Sequence
  chemically synthesized
ataaaagaagacaacaaaaa

SEQ ID NO: 148582 - DNA, 20 bp, Artificial Sequence
  chemically synthesized
ttttttgttgtcttctttta

SEQ ID NO: 148583 - DNA, 20 bp, Artificial Sequence
  chemically synthesized
aaacagtcaaaccataaaag

SEQ ID NO: 148584 - DNA, 20 bp, Artificial Sequence
  chemically synthesized
gcaaaacagtcaaaccataa

SEQ ID NO: 148585 - DNA, 20 bp, Artificial Sequence
  chemically synthesized
tatggtttgactgttttgct

SEQ ID NO: 148586 - DNA, 20 bp, Artificial Sequence
  chemically synthesized
aagtatactactgagcaaaa

SEQ ID NO: 148587 - DNA, 20 bp, Artificial Sequence
  chemically synthesized
ggtttgactgttttgctcag

SEQ ID NO: 148588 - DNA, 20 bp, Artificial Sequence
  chemically synthesized
aggaatcaaagtatactact

SEQ ID NO: 148589 - DNA, 20 bp, Artificial Sequence
  chemically synthesized
aggtaaaaagtaaggaatca

SEQ ID NO: 148590 - DNA, 20 bp, Artificial Sequence
  chemically synthesized
tatacaaaaggtaaaaagta

SEQ ID NO: 148591 - DNA, 20 bp, Artificial Sequence
  chemically synthesized
atatacaaaaggtaaaaagt

SEQ ID NO: 148592 - DNA, 20 bp, Artificial Sequence
  chemically synthesized
gtagatatacaaaaggtaaa

SEQ ID NO: 148593 - DNA, 20 bp, Artificial Sequence
  chemically synthesized
acctatagtagatatacaaa

SEQ ID NO: 148594 - DNA, 20 bp, Artificial Sequence
  chemically synthesized
aacctatagtagatatacaa

SEQ ID NO: 148595 - DNA, 20 bp, Artificial Sequence
  chemically synthesized
taccttttgtatatctacta

SEQ ID NO: 148596 - DNA, 20 bp, Artificial Sequence
  chemically synthesized
accttttgtatatctactat

SEQ ID NO: 148597 - DNA, 20 bp, Artificial Sequence
  chemically synthesized
gcaaaagcaaaaacctatag

SEQ ID NO: 148598 - DNA, 20 bp, Artificial Sequence
  chemically synthesized
gtagcaaaagcaaaaaccta

SEQ ID NO: 148599 - DNA, 20 bp, Artificial Sequence
  chemically synthesized
gcaaaaacctatagtagcaa

SEQ ID NO: 148600 - DNA, 20 bp, Artificial Sequence
  chemically synthesized
ggtttttgcttttgctacta

SEQ ID NO: 148601 - DNA, 20 bp, Artificial Sequence
  chemically synthesized
gtttttgcttttgctactat

SEQ ID NO: 148602 - DNA, 20 bp, Artificial Sequence
  chemically synthesized
agaaaagcaaaaacctatag

SEQ ID NO: 148603 - DNA, 20 bp, Artificial Sequence
  chemically synthesized
taaagaaaagcaaaaaccta

SEQ ID NO: 148604 - DNA, 20 bp, Artificial Sequence
  chemically synthesized
cttacgtaagatgtaaagaa

SEQ ID NO: 148605 - DNA, 20 bp, Artificial Sequence
  chemically synthesized
aaacccttacgtaagatgta

SEQ ID NO: 148606 - DNA, 20 bp, Artificial Sequence
  chemically synthesized
cttttctttacatcttacgt

SEQ ID NO: 148607 - DNA, 20 bp, Artificial Sequence
  chemically synthesized
ttttctttacatcttacgta

SEQ ID NO: 148608 - DNA, 20 bp, Artificial Sequence
  chemically synthesized
tttctttacatcttacgtaa

SEQ ID NO: 148609 - DNA, 20 bp, Artificial Sequence
  chemically synthesized
agcttaaaaaacccttacgt

SEQ ID NO: 148610 - DNA, 20 bp, Artificial Sequence
  chemically synthesized
atcttacgtaagggtttttt

SEQ ID NO: 148611 - DNA, 20 bp, Artificial Sequence
  chemically synthesized
tacgtaagggttttttaagc

SEQ ID NO: 148612 - DNA, 20 bp, Artificial Sequence
  chemically synthesized
aatcaaagttaagttattac

SEQ ID NO: 148613 - DNA, 20 bp, Artificial Sequence
  chemically synthesized
ttttgtatgcaatcaaagtt

SEQ ID NO: 148614 - DNA, 20 bp, Artificial Sequence
  chemically synthesized
tagagttttgtatgcaatca

SEQ ID NO: 148615 - DNA, 20 bp, Artificial Sequence
  chemically synthesized
attagggaagtaagcgtgta

SEQ ID NO: 148616 - DNA, 20 bp, Artificial Sequence
  chemically synthesized
ggattagggaagtaagcgtg

SEQ ID NO: 148617 - DNA, 20 bp, Artificial Sequence
  chemically synthesized
aaaatgtggattagggaagt

SEQ ID NO: 148618 - DNA, 20 bp, Artificial Sequence
  chemically synthesized
ttacaaaatgtggattaggg

SEQ ID NO: 148619 - DNA, 20 bp, Artificial Sequence
  chemically synthesized
aaattacaaaatgtggatta

SEQ ID NO: 148620 - DNA, 20 bp, Artificial Sequence
  chemically synthesized
gaaattacaaaatgtggatt

SEQ ID NO: 148621 - DNA, 20 bp, Artificial Sequence
  chemically synthesized
tgaaattacaaaatgtggat

SEQ ID NO: 148622 - DNA, 20 bp, Artificial Sequence
  chemically synthesized
gacattgaaattacaaaatg

SEQ ID NO: 148623 - DNA, 20 bp, Artificial Sequence
  chemically synthesized
acaaattataaagaagatat

SEQ ID NO: 148624 - DNA, 20 bp, Artificial Sequence
  chemically synthesized
gacaaattataaagaagata

SEQ ID NO: 148625 - DNA, 20 bp, Artificial Sequence
  chemically synthesized
aaaagagacaaattataaag

SEQ ID NO: 148626 - DNA, 20 bp, Artificial Sequence
  chemically synthesized
gttaaaagagacaaattata

SEQ ID NO: 148627 - DNA, 20 bp, Artificial Sequence
  chemically synthesized
gctacaataattggttaaaa

SEQ ID NO: 148628 - DNA, 20 bp, Artificial Sequence
  chemically synthesized
tagctacaataattggttaa

SEQ ID NO: 148629 - DNA, 20 bp, Artificial Sequence
  chemically synthesized
tctcttttaaccaattattg

SEQ ID NO: 148630 - DNA, 20 bp, Artificial Sequence
  chemically synthesized
gtgcttatagctacaataat

SEQ ID NO: 148631 - DNA, 20 bp, Artificial Sequence
  chemically synthesized
taaccaattattgtagctat

SEQ ID NO: 148632 - DNA, 20 bp, Artificial Sequence
  chemically synthesized
ctcacatcccaatgtgctta

SEQ ID NO: 148633 - DNA, 20 bp, Artificial Sequence
  chemically synthesized
tattgtagctataagcacat

SEQ ID NO: 148634 - DNA, 20 bp, Artificial Sequence
  chemically synthesized
attgtagctataagcacatt

SEQ ID NO: 148635 - DNA, 20 bp, Artificial Sequence
  chemically synthesized
ctataagcacattgggatgt

SEQ ID NO: 148636 - DNA, 20 bp, Artificial Sequence
  chemically synthesized
ataagcacattgggatgtga

SEQ ID NO: 148637 - DNA, 20 bp, Artificial Sequence
  chemically synthesized
tgggatgtgagagttctttt

SEQ ID NO: 148638 - DNA, 20 bp, Artificial Sequence
  chemically synthesized
gatgtgagagttctttttag

SEQ ID NO: 148639 - DNA, 20 bp, Artificial Sequence
  chemically synthesized
tgtgagagttctttttagta

SEQ ID NO: 148640 - DNA, 20 bp, Artificial Sequence
  chemically synthesized
tttgtgtgatctctactaaa

SEQ ID NO: 148641 - DNA, 20 bp, Artificial Sequence
  chemically synthesized
tcattgaaaattttattttc

SEQ ID NO: 148642 - DNA, 20 bp, Artificial Sequence
  chemically synthesized
tgaaaataaaattttcaatg

SEQ ID NO: 148643 - DNA, 20 bp, Artificial Sequence
  chemically synthesized
ttttcaatgaagttatattt

SEQ ID NO: 148644 - DNA, 20 bp, Artificial Sequence
  chemically synthesized
atttaagattcaattattcc

SEQ ID NO: 148645 - DNA, 20 bp, Artificial Sequence
  chemically synthesized
tttaagattcaattattcca

SEQ ID NO: 148646 - DNA, 20 bp, Artificial Sequence
  chemically synthesized
gattcaattattccaaggta

SEQ ID NO: 148647 - DNA, 20 bp, Artificial Sequence
  chemically synthesized
ctttgtaattaactttacct

SEQ ID NO: 148648 - DNA, 20 bp, Artificial Sequence
  chemically synthesized
ccaaggtaaagttaattaca

SEQ ID NO: 148649 - DNA, 20 bp, Artificial Sequence
  chemically synthesized
gtaaagttaattacaaagtc

SEQ ID NO: 148650 - DNA, 20 bp, Artificial Sequence
  chemically synthesized
gttaattacaaagtccagaa

SEQ ID NO: 148651 - DNA, 20 bp, Artificial Sequence
  chemically synthesized
aatagcatgattttccattc

SEQ ID NO: 148652 - DNA, 20 bp, Artificial Sequence
  chemically synthesized
ttttctactaatgaaaaaaa

SEQ ID NO: 148653 - DNA, 20 bp, Artificial Sequence
  chemically synthesized
aatcatgctatttttttcat

SEQ ID NO: 148654 - DNA, 20 bp, Artificial Sequence
  chemically synthesized
catgctatttttttcattag

SEQ ID NO: 148655 - DNA, 20 bp, Artificial Sequence
  chemically synthesized
aaaaagaaacatcattttta

SEQ ID NO: 148656 - DNA, 20 bp, Artificial Sequence
  chemically synthesized
aaaaaagaaacatcattttt

SEQ ID NO: 148657 - DNA, 20 bp, Artificial Sequence
  chemically synthesized
aatgatgtttcttttttcct

SEQ ID NO: 148658 - DNA, 20 bp, Artificial Sequence
  chemically synthesized
atctagatatcttaggaaaa

SEQ ID NO: 148659 - DNA, 20 bp, Artificial Sequence
  chemically synthesized
agttcttatctagatatctt

SEQ ID NO: 148660 - DNA, 20 bp, Artificial Sequence
  chemically synthesized
ttcttttttcctaagatatc

SEQ ID NO: 148661 - DNA, 20 bp, Artificial Sequence
  chemically synthesized
tagttcttatctagatatct

SEQ ID NO: 148662 - DNA, 20 bp, Artificial Sequence
  chemically synthesized
ttttcctaagatatctagat

SEQ ID NO: 148663 - DNA, 20 bp, Artificial Sequence
  chemically synthesized
ttttacttttagttcttatc

SEQ ID NO: 148664 - DNA, 20 bp, Artificial Sequence
  chemically synthesized
gatatctagataagaactaa

SEQ ID NO: 148665 - DNA, 20 bp, Artificial Sequence
  chemically synthesized
gaggaaatacattttacttt

SEQ ID NO: 148666 - DNA, 20 bp, Artificial Sequence
  chemically synthesized
agattgtaattttacagtag

SEQ ID NO: 148667 - DNA, 20 bp, Artificial Sequence
  chemically synthesized
tagattgtaattttacagta

SEQ ID NO: 148668 - DNA, 20 bp, Artificial Sequence
  chemically synthesized
tatagattgtaattttacag

SEQ ID NO: 148669 - DNA, 20 bp, Artificial Sequence
  chemically synthesized
taatatagattgtaatttta

SEQ ID NO: 148670 - DNA, 20 bp, Artificial Sequence
  chemically synthesized
tttaaaataatggattaata

SEQ ID NO: 148671 - DNA, 20 bp, Artificial Sequence
  chemically synthesized
atctttttgttttaaaataa

SEQ ID NO: 148672 - DNA, 20 bp, Artificial Sequence
  chemically synthesized
atccattattttaaaacaaa

SEQ ID NO: 148673 - DNA, 20 bp, Artificial Sequence
  chemically synthesized
ttttaaaacaaaaagatacg

SEQ ID NO: 148674 - DNA, 20 bp, Artificial Sequence
  chemically synthesized
tttaaaacaaaaagatacga

SEQ ID NO: 148675 - DNA, 20 bp, Artificial Sequence
  chemically synthesized
ttaaaacaaaaagatacgaa

SEQ ID NO: 148676 - DNA, 20 bp, Artificial Sequence
  chemically synthesized
aaaacaaaaagatacgaagg

SEQ ID NO: 148677 - DNA, 20 bp, Artificial Sequence
  chemically synthesized
gaagggagaaaatttttatc

SEQ ID NO: 148678 - DNA, 20 bp, Artificial Sequence
  chemically synthesized
aagttatgttacaaaatctc

SEQ ID NO: 148679 - DNA, 20 bp, Artificial Sequence
  chemically synthesized
taatttcatgcaataagcta

SEQ ID NO: 148680 - DNA, 20 bp, Artificial Sequence
  chemically synthesized
tttaatttcatgcaataagc

SEQ ID NO: 148681 - DNA, 20 bp, Artificial Sequence
  chemically synthesized
gtggtttaatttcatgcaat

SEQ ID NO: 148682 - DNA, 20 bp, Artificial Sequence
  chemically synthesized
catgaaattaaaccacataa

SEQ ID NO: 148683 - DNA, 20 bp, Artificial Sequence
  chemically synthesized
ggtttattatttcttttatg

SEQ ID NO: 148684 - DNA, 20 bp, Artificial Sequence
  chemically synthesized
gagttaatgttgtttcagtt

SEQ ID NO: 148685 - DNA, 20 bp, Artificial Sequence
  chemically synthesized
ggagttaatgttgtttcagt

SEQ ID NO: 148686 - DNA, 20 bp, Artificial Sequence
  chemically synthesized
gataggagttaatgttgttt

SEQ ID NO: 148687 - DNA, 20 bp, Artificial Sequence
  chemically synthesized
aaacaacattaactcctatc

SEQ ID NO: 148688 - DNA, 20 bp, Artificial Sequence
  chemically synthesized
aacaacattaactcctatct

SEQ ID NO: 148689 - DNA, 20 bp, Artificial Sequence
  chemically synthesized
acaacattaactcctatcta

SEQ ID NO: 148690 - DNA, 20 bp, Artificial Sequence
  chemically synthesized
gtttgataaaccctagatag

SEQ ID NO: 148691 - DNA, 20 bp, Artificial Sequence
  chemically synthesized
tagtttgataaaccctagat

SEQ ID NO: 148692 - DNA, 20 bp, Artificial Sequence
  chemically synthesized
gtagtttgataaaccctaga

SEQ ID NO: 148693 - DNA, 20 bp, Artificial Sequence
  chemically synthesized
ttctgtagtttgataaaccc

SEQ ID NO: 148694 - DNA, 20 bp, Artificial Sequence
  chemically synthesized
atctagggtttatcaaacta

SEQ ID NO: 148695 - DNA, 20 bp, Artificial Sequence
  chemically synthesized
gtttatcaaactacagaaaa

SEQ ID NO: 148696 - DNA, 20 bp, Artificial Sequence
  chemically synthesized
cctttcctttctgttttctg

SEQ ID NO: 148697 - DNA, 20 bp, Artificial Sequence
  chemically synthesized
atcaaactacagaaaacaga

SEQ ID NO: 148698 - DNA, 20 bp, Artificial Sequence
  chemically synthesized
tcaaactacagaaaacagaa

SEQ ID NO: 148699 - DNA, 20 bp, Artificial Sequence
  chemically synthesized
actacagaaaacagaaagga

SEQ ID NO: 148700 - DNA, 20 bp, Artificial Sequence
  chemically synthesized
ctacagaaaacagaaaggaa

SEQ ID NO: 148701 - DNA, 20 bp, Artificial Sequence
  chemically synthesized
ggaaaggaattatacatctt

SEQ ID NO: 148702 - DNA, 20 bp, Artificial Sequence
  chemically synthesized
atttagtagttatgtttctc

SEQ ID NO: 148703 - DNA, 20 bp, Artificial Sequence
  chemically synthesized
tagtttccaccagtatttag

SEQ ID NO: 148704 - DNA, 20 bp, Artificial Sequence
  chemically synthesized
gaaacataactactaaatac

SEQ ID NO: 148705 - DNA, 20 bp, Artificial Sequence
  chemically synthesized
gtatagtttccaccagtatt

SEQ ID NO: 148706 - DNA, 20 bp, Artificial Sequence
  chemically synthesized
acataactactaaatactgg

SEQ ID NO: 148707 - DNA, 20 bp, Artificial Sequence
  chemically synthesized
tgcacatgtatagtttccac

SEQ ID NO: 148708 - DNA, 20 bp, Artificial Sequence
  chemically synthesized
ttcaaaactatgcacatgta

SEQ ID NO: 148709 - DNA, 20 bp, Artificial Sequence
  chemically synthesized
gtggaaactatacatgtgca

SEQ ID NO: 148710 - DNA, 20 bp, Artificial Sequence
  chemically synthesized
acatgtgcatagttttgaat

SEQ ID NO: 148711 - DNA, 20 bp, Artificial Sequence
  chemically synthesized
ccatttacagggcaaaaatg

SEQ ID NO: 148712 - DNA, 20 bp, Artificial Sequence
  chemically synthesized
cttcatttttgccctgtaaa

SEQ ID NO: 148713 - DNA, 20 bp, Artificial Sequence
  chemically synthesized
cattctttccaccatttaca

SEQ ID NO: 148714 - DNA, 20 bp, Artificial Sequence
  chemically synthesized
tcattctttccaccatttac

SEQ ID NO: 148715 - DNA, 20 bp, Artificial Sequence
  chemically synthesized
catttttgccctgtaaatgg

SEQ ID NO: 148716 - DNA, 20 bp, Artificial Sequence
  chemically synthesized
ttcattctttccaccattta

SEQ ID NO: 148717 - DNA, 20 bp, Artificial Sequence
  chemically synthesized
tttgccctgtaaatggtgga

SEQ ID NO: 148718 - DNA, 20 bp, Artificial Sequence
  chemically synthesized
aatggtggaaagaatgaaaa

SEQ ID NO: 148719 - DNA, 20 bp, Artificial Sequence
  chemically synthesized
aagaatgaaaaaagtcacta

SEQ ID NO: 148720 - DNA, 20 bp, Artificial Sequence
  chemically synthesized
aaaagtaggaaacagagctt

SEQ ID NO: 148721 - DNA, 20 bp, Artificial Sequence
  chemically synthesized
tagtacaaaagtaggaaaca

SEQ ID NO: 148722 - DNA, 20 bp, Artificial Sequence
  chemically synthesized
attagtacaaaagtaggaaa

SEQ ID NO: 148723 - DNA, 20 bp, Artificial Sequence
  chemically synthesized
ctttgaattagtacaaaagt

SEQ ID NO: 148724 - DNA, 20 bp, Artificial Sequence
  chemically synthesized
cctttgaattagtacaaaag

SEQ ID NO: 148725 - DNA, 20 bp, Artificial Sequence
  chemically synthesized
atgcctttgaattagtacaa

SEQ ID NO: 148726 - DNA, 20 bp, Artificial Sequence
  chemically synthesized
cctacttttgtactaattca

SEQ ID NO: 148727 - DNA, 20 bp, Artificial Sequence
  chemically synthesized
ctacttttgtactaattcaa

SEQ ID NO: 148728 - DNA, 20 bp, Artificial Sequence
  chemically synthesized
gcataatcatgcctttgaat

SEQ ID NO: 148729 - DNA, 20 bp, Artificial Sequence
  chemically synthesized
gtagaaatagttattaagta

SEQ ID NO: 148730 - DNA, 20 bp, Artificial Sequence
  chemically synthesized
tttaagtagaaatagttatt

SEQ ID NO: 148731 - DNA, 20 bp, Artificial Sequence
  chemically synthesized
taacaatttttaagtagaaa

SEQ ID NO: 148732 - DNA, 20 bp, Artificial Sequence
  chemically synthesized
aatgattaacaatttttaag

SEQ ID NO: 148733 - DNA, 20 bp, Artificial Sequence
  chemically synthesized
cacaatgattaacaattttt

SEQ ID NO: 148734 - DNA, 20 bp, Artificial Sequence
  chemically synthesized
ccacagaaaatatatacatt

SEQ ID NO: 148735 - DNA, 20 bp, Artificial Sequence
  chemically synthesized
tccacagaaaatatatacat

SEQ ID NO: 148736 - DNA, 20 bp, Artificial Sequence
  chemically synthesized
cctaatgtatatattttctg

SEQ ID NO: 148737 - DNA, 20 bp, Artificial Sequence
  chemically synthesized
gttcacgttcttgtattcca

SEQ ID NO: 148738 - DNA, 20 bp, Artificial Sequence
  chemically synthesized
atatattttctgtggaatac

SEQ ID NO: 148739 - DNA, 20 bp, Artificial Sequence
  chemically synthesized
gtggaatacaagaacgtgaa

SEQ ID NO: 148740 - DNA, 20 bp, Artificial Sequence
  chemically synthesized
ggaatacaagaacgtgaaca

SEQ ID NO: 148741 - DNA, 20 bp, Artificial Sequence
  chemically synthesized
gaatacaagaacgtgaacag

SEQ ID NO: 148742 - DNA, 20 bp, Artificial Sequence
  chemically synthesized
caagaacgtgaacagaggca

SEQ ID NO: 148743 - DNA, 20 bp, Artificial Sequence
  chemically synthesized
agaacgtgaacagaggcaaa

SEQ ID NO: 148744 - DNA, 20 bp, Artificial Sequence
  chemically synthesized
cgtgaacagaggcaaagagc

SEQ ID NO: 148745 - DNA, 20 bp, Artificial Sequence
  chemically synthesized
gtgaacagaggcaaagagct

SEQ ID NO: 148746 - DNA, 20 bp, Artificial Sequence
  chemically synthesized
aacagaggcaaagagctagg

SEQ ID NO: 148747 - DNA, 20 bp, Artificial Sequence
  chemically synthesized
gaggcaaagagctaggtaga

SEQ ID NO: 148748 - DNA, 20 bp, Artificial Sequence
  chemically synthesized
tggaaattggtctttctacc

SEQ ID NO: 148749 - DNA, 20 bp, Artificial Sequence
  chemically synthesized
ggtagaaagaccaatttcca

SEQ ID NO: 148750 - DNA, 20 bp, Artificial Sequence
  chemically synthesized
cctactttctctttggaaat

SEQ ID NO: 148751 - DNA, 20 bp, Artificial Sequence
  chemically synthesized
tagaaagaccaatttccaaa

SEQ ID NO: 148752 - DNA, 20 bp, Artificial Sequence
  chemically synthesized
aagaccaatttccaaagaga

SEQ ID NO: 148753 - DNA, 20 bp, Artificial Sequence
  chemically synthesized
aactaaccctactttctctt

SEQ ID NO: 148754 - DNA, 20 bp, Artificial Sequence
  chemically synthesized
accaatttccaaagagaaag

SEQ ID NO: 148755 - DNA, 20 bp, Artificial Sequence
  chemically synthesized
ccaatttccaaagagaaagt

SEQ ID NO: 148756 - DNA, 20 bp, Artificial Sequence
  chemically synthesized
caatttccaaagagaaagta

SEQ ID NO: 148757 - DNA, 20 bp, Artificial Sequence
  chemically synthesized
ttccaaagagaaagtagggt

SEQ ID NO: 148758 - DNA, 20 bp, Artificial Sequence
  chemically synthesized
aagtagggttagtttactac

SEQ ID NO: 148759 - DNA, 20 bp, Artificial Sequence
  chemically synthesized
agtagggttagtttactact

SEQ ID NO: 148760 - DNA, 20 bp, Artificial Sequence
  chemically synthesized
gtagggttagtttactactg

SEQ ID NO: 148761 - DNA, 20 bp, Artificial Sequence
  chemically synthesized
tagggttagtttactactgg

SEQ ID NO: 148762 - DNA, 20 bp, Artificial Sequence
  chemically synthesized
tgggaatgtgaggcccccag

SEQ ID NO: 148763 - DNA, 20 bp, Artificial Sequence
  chemically synthesized
gaatgggaatgtgaggcccc

SEQ ID NO: 148764 - DNA, 20 bp, Artificial Sequence
  chemically synthesized
tcagattgaatgggaatgtg

SEQ ID NO: 148765 - DNA, 20 bp, Artificial Sequence
  chemically synthesized
gtcagattgaatgggaatgt

SEQ ID NO: 148766 - DNA, 20 bp, Artificial Sequence
  chemically synthesized
acttttacgtcagattgaat

SEQ ID NO: 148767 - DNA, 20 bp, Artificial Sequence
  chemically synthesized
cacttttacgtcagattgaa

SEQ ID NO: 148768 - DNA, 20 bp, Artificial Sequence
  chemically synthesized
tcccattcaatctgacgtaa

SEQ ID NO: 148769 - DNA, 20 bp, Artificial Sequence
  chemically synthesized
cttcaattccacttttacgt

SEQ ID NO: 148770 - DNA, 20 bp, Artificial Sequence
  chemically synthesized
cattcaatctgacgtaaaag

SEQ ID NO: 148771 - DNA, 20 bp, Artificial Sequence
  chemically synthesized
ctgacgtaaaagtggaattg

SEQ ID NO: 148772 - DNA, 20 bp, Artificial Sequence
  chemically synthesized
tgacgtaaaagtggaattga

SEQ ID NO: 148773 - DNA, 20 bp, Artificial Sequence
  chemically synthesized
gacgtaaaagtggaattgaa

SEQ ID NO: 148774 - DNA, 20 bp, Artificial Sequence
  chemically synthesized
aagtggaattgaagggcata

SEQ ID NO: 148775 - DNA, 20 bp, Artificial Sequence
  chemically synthesized
agtggaattgaagggcatat

SEQ ID NO: 148776 - DNA, 20 bp, Artificial Sequence
  chemically synthesized
attgaagggcatatgggctg

SEQ ID NO: 148777 - DNA, 20 bp, Artificial Sequence
  chemically synthesized
ggcatatgggctgaagttat

SEQ ID NO: 148778 - DNA, 20 bp, Artificial Sequence
  chemically synthesized
aatacagtctctgataactt

SEQ ID NO: 148779 - DNA, 20 bp, Artificial Sequence
  chemically synthesized
catatgggctgaagttatca

SEQ ID NO: 148780 - DNA, 20 bp, Artificial Sequence
  chemically synthesized
gattatccattttagcaata

SEQ ID NO: 148781 - DNA, 20 bp, Artificial Sequence
  chemically synthesized
cagagactgtattgctaaaa

SEQ ID NO: 148782 - DNA, 20 bp, Artificial Sequence
  chemically synthesized
taggggaagattatccattt

SEQ ID NO: 148783 - DNA, 20 bp, Artificial Sequence
  chemically synthesized
gcccccattgtcaatagggg

SEQ ID NO: 148784 - DNA, 20 bp, Artificial Sequence
  chemically synthesized
caggcccccattgtcaatag

SEQ ID NO: 148785 - DNA, 20 bp, Artificial Sequence
  chemically synthesized
acaggcccccattgtcaata

SEQ ID NO: 148786 - DNA, 20 bp, Artificial Sequence
  chemically synthesized
cacaggcccccattgtcaat

SEQ ID NO: 148787 - DNA, 20 bp, Artificial Sequence
  chemically synthesized
taatcttcccctattgacaa

SEQ ID NO: 148788 - DNA, 20 bp, Artificial Sequence
  chemically synthesized
ccacaggcccccattgtcaa

SEQ ID NO: 148789 - DNA, 20 bp, Artificial Sequence
  chemically synthesized
aatcttcccctattgacaat

SEQ ID NO: 148790 - DNA, 20 bp, Artificial Sequence
  chemically synthesized
atcttcccctattgacaatg

SEQ ID NO: 148791 - DNA, 20 bp, Artificial Sequence
  chemically synthesized
tcttcccctattgacaatgg

SEQ ID NO: 148792 - DNA, 20 bp, Artificial Sequence
  chemically synthesized
ctattgacaatgggggcctg

SEQ ID NO: 148793 - DNA, 20 bp, Artificial Sequence
  chemically synthesized
cacctaattttggtagccac

SEQ ID NO: 148794 - DNA, 20 bp, Artificial Sequence
  chemically synthesized
tcacctaattttggtagcca

SEQ ID NO: 148795 - DNA, 20 bp, Artificial Sequence
  chemically synthesized
gggcctgtggctaccaaaat

SEQ ID NO: 148796 - DNA, 20 bp, Artificial Sequence
  chemically synthesized
ttcaagtcacctaattttgg

SEQ ID NO: 148797 - DNA, 20 bp, Artificial Sequence
  chemically synthesized
ggcctgtggctaccaaaatt

SEQ ID NO: 148798 - DNA, 20 bp, Artificial Sequence
  chemically synthesized
ctgttcaagtcacctaattt

SEQ ID NO: 148799 - DNA, 20 bp, Artificial Sequence
  chemically synthesized
ccaaaattaggtgacttgaa

SEQ ID NO: 148800 - DNA, 20 bp, Artificial Sequence
  chemically synthesized
tgttatggttttatctgttc

SEQ ID NO: 148801 - DNA, 20 bp, Artificial Sequence
  chemically synthesized
tgaacagataaaaccataac

SEQ ID NO: 148802 - DNA, 20 bp, Artificial Sequence
  chemically synthesized
gaaaggatccgaacttgtta

SEQ ID NO: 148803 - DNA, 20 bp, Artificial Sequence
  chemically synthesized
agataaaaccataacaagtt

SEQ ID NO: 148804 - DNA, 20 bp, Artificial Sequence
  chemically synthesized
tttgaaaatagatgcatgaa

SEQ ID NO: 148805 - DNA, 20 bp, Artificial Sequence
  chemically synthesized
ttttgaaaatagatgcatga

SEQ ID NO: 148806 - DNA, 20 bp, Artificial Sequence
  chemically synthesized
caaaatatcatttttgaaaa

SEQ ID NO: 148807 - DNA, 20 bp, Artificial Sequence
  chemically synthesized
tattttcaaaaatgatattt

SEQ ID NO: 148808 - DNA, 20 bp, Artificial Sequence
  chemically synthesized
aaaaatgatattttggtgat

SEQ ID NO: 148809 - DNA, 20 bp, Artificial Sequence
  chemically synthesized
tattttggtgattagtgaat

SEQ ID NO: 148810 - DNA, 20 bp, Artificial Sequence
  chemically synthesized
tttattattatgataaaaat

SEQ ID NO: 148811 - DNA, 20 bp, Artificial Sequence
  chemically synthesized
ttattatgataaaaatgagt

SEQ ID NO: 148812 - DNA, 20 bp, Artificial Sequence
  chemically synthesized
taaattatttataaaaacgt

SEQ ID NO: 148813 - DNA, 20 bp, Artificial Sequence
  chemically synthesized
actgaaaactaagtttttga

SEQ ID NO: 148814 - DNA, 20 bp, Artificial Sequence
  chemically synthesized
aacgtaagctatcaaaaact

SEQ ID NO: 148815 - DNA, 20 bp, Artificial Sequence
  chemically synthesized
gctatcaaaaacttagtttt

SEQ ID NO: 148816 - DNA, 20 bp, Artificial Sequence
  chemically synthesized
ttttcatggcactgaaaact

SEQ ID NO: 148817 - DNA, 20 bp, Artificial Sequence
  chemically synthesized
tactataacctatattttca

SEQ ID NO: 148818 - DNA, 20 bp, Artificial Sequence
  chemically synthesized
ttttcagtgccatgaaaata

SEQ ID NO: 148819 - DNA, 20 bp, Artificial Sequence
  chemically synthesized
tttcagtgccatgaaaatat

SEQ ID NO: 148820 - DNA, 20 bp, Artificial Sequence
  chemically synthesized
tgccatgaaaatataggtta

SEQ ID NO: 148821 - DNA, 20 bp, Artificial Sequence
  chemically synthesized
ataggttatagtaacttgtg

SEQ ID NO: 148822 - DNA, 20 bp, Artificial Sequence
  chemically synthesized
accttcctgaagatcttcac

SEQ ID NO: 148823 - DNA, 20 bp, Artificial Sequence
  chemically synthesized
tagtaacttgtgaagatctt

SEQ ID NO: 148824 - DNA, 20 bp, Artificial Sequence
  chemically synthesized
agtaacttgtgaagatcttc

SEQ ID NO: 148825 - DNA, 20 bp, Artificial Sequence
  chemically synthesized
aacttgtgaagatcttcagg

SEQ ID NO: 148826 - DNA, 20 bp, Artificial Sequence
  chemically synthesized
acttgtgaagatcttcagga

SEQ ID NO: 148827 - DNA, 20 bp, Artificial Sequence
  chemically synthesized
agtataaattaaccttcctg

SEQ ID NO: 148828 - DNA, 20 bp, Artificial Sequence
  chemically synthesized
catctatggtttagaatgta

SEQ ID NO: 148829 - DNA, 20 bp, Artificial Sequence
  chemically synthesized
atactgtacattctaaacca

SEQ ID NO: 148830 - DNA, 20 bp, Artificial Sequence
  chemically synthesized
cagatgtagcatctatggtt

SEQ ID NO: 148831 - DNA, 20 bp, Artificial Sequence
  chemically synthesized
attaccagatgtagcatcta

SEQ ID NO: 148832 - DNA, 20 bp, Artificial Sequence
  chemically synthesized
taaaccatagatgctacatc

SEQ ID NO: 148833 - DNA, 20 bp, Artificial Sequence
  chemically synthesized
caacttaatattaccagatg

SEQ ID NO: 148834 - DNA, 20 bp, Artificial Sequence
  chemically synthesized
ccttcccaacttaatattac

SEQ ID NO: 148835 - DNA, 20 bp, Artificial Sequence
  chemically synthesized
atgctacatctggtaatatt

SEQ ID NO: 148836 - DNA, 20 bp, Artificial Sequence
  chemically synthesized
tacatctggtaatattaagt

SEQ ID NO: 148837 - DNA, 20 bp, Artificial Sequence
  chemically synthesized
acatctggtaatattaagtt

SEQ ID NO: 148838 - DNA, 20 bp, Artificial Sequence
  chemically synthesized
tctggtaatattaagttggg

SEQ ID NO: 148839 - DNA, 20 bp, Artificial Sequence
  chemically synthesized
ctggtaatattaagttggga

SEQ ID NO: 148840 - DNA, 20 bp, Artificial Sequence
  chemically synthesized
tggtaatattaagttgggaa

SEQ ID NO: 148841 - DNA, 20 bp, Artificial Sequence
  chemically synthesized
aagttgggaagggatttatc

SEQ ID NO: 148842 - DNA, 20 bp, Artificial Sequence
  chemically synthesized
agttgggaagggatttatct

SEQ ID NO: 148843 - DNA, 20 bp, Artificial Sequence
  chemically synthesized
gataaatgatggtgttttcc

SEQ ID NO: 148844 - DNA, 20 bp, Artificial Sequence
  chemically synthesized
ttggtttaattgataaatga

SEQ ID NO: 148845 - DNA, 20 bp, Artificial Sequence
  chemically synthesized
catcatttatcaattaaacc

SEQ ID NO: 148846 - DNA, 20 bp, Artificial Sequence
  chemically synthesized
atcatttatcaattaaacca

SEQ ID NO: 148847 - DNA, 20 bp, Artificial Sequence
  chemically synthesized
atttatcaattaaaccaagg

SEQ ID NO: 148848 - DNA, 20 bp, Artificial Sequence
  chemically synthesized
ctattcaaccttttctgcct

SEQ ID NO: 148849 - DNA, 20 bp, Artificial Sequence
  chemically synthesized
tcaattaaaccaaggcagaa

SEQ ID NO: 148850 - DNA, 20 bp, Artificial Sequence
  chemically synthesized
caattaaaccaaggcagaaa

SEQ ID NO: 148851 - DNA, 20 bp, Artificial Sequence
  chemically synthesized
ccaaggcagaaaaggttgaa

SEQ ID NO: 148852 - DNA, 20 bp, Artificial Sequence
  chemically synthesized
ggctatggtttgggggtttt

SEQ ID NO: 148853 - DNA, 20 bp, Artificial Sequence
  chemically synthesized
tggctatggtttgggggttt

SEQ ID NO: 148854 - DNA, 20 bp, Artificial Sequence
  chemically synthesized
tcttgttggctatggtttgg

SEQ ID NO: 148855 - DNA, 20 bp, Artificial Sequence
  chemically synthesized
tgcccaaaacccccaaacca

SEQ ID NO: 148856 - DNA, 20 bp, Artificial Sequence
  chemically synthesized
ctcttgttggctatggtttg

SEQ ID NO: 148857 - DNA, 20 bp, Artificial Sequence
  chemically synthesized
tctcttgttggctatggttt

SEQ ID NO: 148858 - DNA, 20 bp, Artificial Sequence
  chemically synthesized
atctcttgttggctatggtt

SEQ ID NO: 148859 - DNA, 20 bp, Artificial Sequence
  chemically synthesized
atttgatctcttgttggcta

SEQ ID NO: 148860 - DNA, 20 bp, Artificial Sequence
  chemically synthesized
acccccaaaccatagccaac

SEQ ID NO: 148861 - DNA, 20 bp, Artificial Sequence
  chemically synthesized
ccccaaaccatagccaacaa

SEQ ID NO: 148862 - DNA, 20 bp, Artificial Sequence
  chemically synthesized
gtcctcatttgatctcttgt

SEQ ID NO: 148863 - DNA, 20 bp, Artificial Sequence
  chemically synthesized
tagccaacaagagatcaaat

SEQ ID NO: 148864 - DNA, 20 bp, Artificial Sequence
  chemically synthesized
agccaacaagagatcaaatg

SEQ ID NO: 148865 - DNA, 20 bp, Artificial Sequence
  chemically synthesized
acaagagatcaaatgaggac

SEQ ID NO: 148866 - DNA, 20 bp, Artificial Sequence
  chemically synthesized
atcaaatgaggactagatcc

SEQ ID NO: 148867 - DNA, 20 bp, Artificial Sequence
  chemically synthesized
tcaaatgaggactagatccc

SEQ ID NO: 148868 - DNA, 20 bp, Artificial Sequence
  chemically synthesized
gaattaataaacctgggatc

SEQ ID NO: 148869 - DNA, 20 bp, Artificial Sequence
  chemically synthesized
gattgggaattaataaacct

SEQ ID NO: 148870 - DNA, 20 bp, Artificial Sequence
  chemically synthesized
ggattgggaattaataaacc

SEQ ID NO: 148871 - DNA, 20 bp, Artificial Sequence
  chemically synthesized
aggtttattaattcccaatc

SEQ ID NO: 148872 - DNA, 20 bp, Artificial Sequence
  chemically synthesized
tgttaaaagatcactggatt

SEQ ID NO: 148873 - DNA, 20 bp, Artificial Sequence
  chemically synthesized
ctgttaaaagatcactggat

SEQ ID NO: 148874 - DNA, 20 bp, Artificial Sequence
  chemically synthesized
aggcactgttaaaagatcac

SEQ ID NO: 148875 - DNA, 20 bp, Artificial Sequence
  chemically synthesized
ccaatccagtgatcttttaa

SEQ ID NO: 148876 - DNA, 20 bp, Artificial Sequence
  chemically synthesized
tgtaaaccaggcactgttaa

SEQ ID NO: 148877 - DNA, 20 bp, Artificial Sequence
  chemically synthesized
agtgatcttttaacagtgcc

SEQ ID NO: 148878 - DNA, 20 bp, Artificial Sequence
  chemically synthesized
tgctcatgatattgtaaacc

SEQ ID NO: 148879 - DNA, 20 bp, Artificial Sequence
  chemically synthesized
atgctcatgatattgtaaac

SEQ ID NO: 148880 - DNA, 20 bp, Artificial Sequence
  chemically synthesized
tgcctggtttacaatatcat

SEQ ID NO: 148881 - DNA, 20 bp, Artificial Sequence
  chemically synthesized
taacatttttaatatttcag

SEQ ID NO: 148882 - DNA, 20 bp, Artificial Sequence
  chemically synthesized
acgtaacatttttaatattt

SEQ ID NO: 148883 - DNA, 20 bp, Artificial Sequence
  chemically synthesized
agatataaagttattatata

SEQ ID NO: 148884 - DNA, 20 bp, Artificial Sequence
  chemically synthesized
ctagatataaagttattata

SEQ ID NO: 148885 - DNA, 20 bp, Artificial Sequence
  chemically synthesized
ctatataataactttatatc

SEQ ID NO: 148886 - DNA, 20 bp, Artificial Sequence
  chemically synthesized
atctacgcatgctagatata

SEQ ID NO: 148887 - DNA, 20 bp, Artificial Sequence
  chemically synthesized
aactttatatctagcatgcg

SEQ ID NO: 148888 - DNA, 20 bp, Artificial Sequence
  chemically synthesized
ttttctcaatctacgcatgc

SEQ ID NO: 148889 - DNA, 20 bp, Artificial Sequence
  chemically synthesized
atatctagcatgcgtagatt

SEQ ID NO: 148890 - DNA, 20 bp, Artificial Sequence
  chemically synthesized
catgcgtagattgagaaaaa

SEQ ID NO: 148891 - DNA, 20 bp, Artificial Sequence
  chemically synthesized
aatattactgaattcagaat

SEQ ID NO: 148892 - DNA, 20 bp, Artificial Sequence
  chemically synthesized
aaatcaacttattctgaatt

SEQ ID NO: 148893 - DNA, 20 bp, Artificial Sequence
  chemically synthesized
tattacaatattactgaatt

SEQ ID NO: 148894 - DNA, 20 bp, Artificial Sequence
  chemically synthesized
aattttgcatttattaattg

SEQ ID NO: 148895 - DNA, 20 bp, Artificial Sequence
  chemically synthesized
tttgcatttattaattgcag

SEQ ID NO: 148896 - DNA, 20 bp, Artificial Sequence
  chemically synthesized
tagacattttttaagtgatg

SEQ ID NO: 148897 - DNA, 20 bp, Artificial Sequence
  chemically synthesized
acatgtagtagacatttttt

SEQ ID NO: 148898 - DNA, 20 bp, Artificial Sequence
  chemically synthesized
cattacccacaaacatgtag

SEQ ID NO: 148899 - DNA, 20 bp, Artificial Sequence
  chemically synthesized
atgcattacccacaaacatg

SEQ ID NO: 148900 - DNA, 20 bp, Artificial Sequence
  chemically synthesized
aaatgtctactacatgtttg

SEQ ID NO: 148901 - DNA, 20 bp, Artificial Sequence
  chemically synthesized
aatgtctactacatgtttgt

SEQ ID NO: 148902 - DNA, 20 bp, Artificial Sequence
  chemically synthesized
gtgttgtctgtgaatcaaag

SEQ ID NO: 148903 - DNA, 20 bp, Artificial Sequence
  chemically synthesized
aagtgttgtctgtgaatcaa

SEQ ID NO: 148904 - DNA, 20 bp, Artificial Sequence
  chemically synthesized
tgcatcactcctttgattca

SEQ ID NO: 148905 - DNA, 20 bp, Artificial Sequence
  chemically synthesized
caagtgttgtctgtgaatca

SEQ ID NO: 148906 - DNA, 20 bp, Artificial Sequence
  chemically synthesized
ttgattcacagacaacactt

SEQ ID NO: 148907 - DNA, 20 bp, Artificial Sequence
  chemically synthesized
tgattcacagacaacacttg

SEQ ID NO: 148908 - DNA, 20 bp, Artificial Sequence
  chemically synthesized
ttcacagacaacacttgagg

SEQ ID NO: 148909 - DNA, 20 bp, Artificial Sequence
  chemically synthesized
ctcaaatccacaaccacctc

SEQ ID NO: 148910 - DNA, 20 bp, Artificial Sequence
  chemically synthesized
gacaacacttgaggtggttg

SEQ ID NO: 148911 - DNA, 20 bp, Artificial Sequence
  chemically synthesized
cttgaggtggttgtggattt

SEQ ID NO: 148912 - DNA, 20 bp, Artificial Sequence
  chemically synthesized
gatttgagaatttctttcaa

SEQ ID NO: 148913 - DNA, 20 bp, Artificial Sequence
  chemically synthesized
aaatttcccaggaccattga

SEQ ID NO: 148914 - DNA, 20 bp, Artificial Sequence
  chemically synthesized
agaatttctttcaatggtcc

SEQ ID NO: 148915 - DNA, 20 bp, Artificial Sequence
  chemically synthesized
gaatttctttcaatggtcct

SEQ ID NO: 148916 - DNA, 20 bp, Artificial Sequence
  chemically synthesized
ggatatagctaaaatttccc

SEQ ID NO: 148917 - DNA, 20 bp, Artificial Sequence
  chemically synthesized
tggatatagctaaaatttcc

SEQ ID NO: 148918 - DNA, 20 bp, Artificial Sequence
  chemically synthesized
tcaatggtcctgggaaattt

SEQ ID NO: 148919 - DNA, 20 bp, Artificial Sequence
  chemically synthesized
tgggaaattttagctatatc

SEQ ID NO: 148920 - DNA, 20 bp, Artificial Sequence
  chemically synthesized
ctcaacctgtgtgctggata

SEQ ID NO: 148921 - DNA, 20 bp, Artificial Sequence
  chemically synthesized
ttttagctatatccagcaca

SEQ ID NO: 148922 - DNA, 20 bp, Artificial Sequence
  chemically synthesized
tttagctatatccagcacac

SEQ ID NO: 148923 - DNA, 20 bp, Artificial Sequence
  chemically synthesized
gaagttctcaacctgtgtgc

SEQ ID NO: 148924 - DNA, 20 bp, Artificial Sequence
  chemically synthesized
ctatatccagcacacaggtt

SEQ ID NO: 148925 - DNA, 20 bp, Artificial Sequence
  chemically synthesized
ggcagagaccaacattatag

SEQ ID NO: 148926 - DNA, 20 bp, Artificial Sequence
  chemically synthesized
gttgagaacttctataatgt

SEQ ID NO: 148927 - DNA, 20 bp, Artificial Sequence
  chemically synthesized
caaggcagagaccaacatta

SEQ ID NO: 148928 - DNA, 20 bp, Artificial Sequence
  chemically synthesized
aagagtaatgttgcaaggca

SEQ ID NO: 148929 - DNA, 20 bp, Artificial Sequence
  chemically synthesized
ttaagagtaatgttgcaagg

SEQ ID NO: 148930 - DNA, 20 bp, Artificial Sequence
  chemically synthesized
tggttaagagtaatgttgca

SEQ ID NO: 148931 - DNA, 20 bp, Artificial Sequence
  chemically synthesized
ttggttaagagtaatgttgc

SEQ ID NO: 148932 - DNA, 20 bp, Artificial Sequence
  chemically synthesized
ttttaaagatatttggttaa

SEQ ID NO: 148933 - DNA, 20 bp, Artificial Sequence
  chemically synthesized
acttttaaagatatttggtt

SEQ ID NO: 148934 - DNA, 20 bp, Artificial Sequence
  chemically synthesized
gtacgacttttaaagatatt

SEQ ID NO: 148935 - DNA, 20 bp, Artificial Sequence
  chemically synthesized
tcttaaccaaatatctttaa

SEQ ID NO: 148936 - DNA, 20 bp, Artificial Sequence
  chemically synthesized
agtaaagagtacgactttta

SEQ ID NO: 148937 - DNA, 20 bp, Artificial Sequence
  chemically synthesized
aaatcaactctaagagtaaa

SEQ ID NO: 148938 - DNA, 20 bp, Artificial Sequence
  chemically synthesized
aaagtcgtactctttactct

SEQ ID NO: 148939 - DNA, 20 bp, Artificial Sequence
  chemically synthesized
tgaaatcaactctaagagta

SEQ ID NO: 148940 - DNA, 20 bp, Artificial Sequence
  chemically synthesized
agtcgtactctttactctta

SEQ ID NO: 148941 - DNA, 20 bp, Artificial Sequence
  chemically synthesized
gaaactgaaatcaactctaa

SEQ ID NO: 148942 - DNA, 20 bp, Artificial Sequence
  chemically synthesized
atgaaactgaaatcaactct

SEQ ID NO: 148943 - DNA, 20 bp, Artificial Sequence
  chemically synthesized
tttactcttagagttgattt

SEQ ID NO: 148944 - DNA, 20 bp, Artificial Sequence
  chemically synthesized
atgattgagatatcattgtt

SEQ ID NO: 148945 - DNA, 20 bp, Artificial Sequence
  chemically synthesized
caacccattgtcaaatgatt

SEQ ID NO: 148946 - DNA, 20 bp, Artificial Sequence
  chemically synthesized
atatctcaatcatttgacaa

SEQ ID NO: 148947 - DNA, 20 bp, Artificial Sequence
  chemically synthesized
tatctcaatcatttgacaat

SEQ ID NO: 148948 - DNA, 20 bp, Artificial Sequence
  chemically synthesized
aatcatttgacaatgggttg

SEQ ID NO: 148949 - DNA, 20 bp, Artificial Sequence
  chemically synthesized
tttgacaatgggttgtggca

SEQ ID NO: 148950 - DNA, 20 bp, Artificial Sequence
  chemically synthesized
ataaaaatatttagacaatt

SEQ ID NO: 148951 - DNA, 20 bp, Artificial Sequence
  chemically synthesized
taaaaaaatataaaaatatt

SEQ ID NO: 148952 - DNA, 20 bp, Artificial Sequence
  chemically synthesized
ttttatatttttttataaat

SEQ ID NO: 148953 - DNA, 20 bp, Artificial Sequence
  chemically synthesized
ttataaattagaaccaacta

SEQ ID NO: 148954 - DNA, 20 bp, Artificial Sequence
  chemically synthesized
tataaattagaaccaactaa

SEQ ID NO: 148955 - DNA, 20 bp, Artificial Sequence
  chemically synthesized
ttatattgacaacctttagt

SEQ ID NO: 148956 - DNA, 20 bp, Artificial Sequence
  chemically synthesized
actcttatattgacaacctt

SEQ ID NO: 148957 - DNA, 20 bp, Artificial Sequence
  chemically synthesized
caactaaaggttgtcaatat

SEQ ID NO: 148958 - DNA, 20 bp, Artificial Sequence
  chemically synthesized
actaaaggttgtcaatataa

SEQ ID NO: 148959 - DNA, 20 bp, Artificial Sequence
  chemically synthesized
aaaagcactttggaatgcga

SEQ ID NO: 148960 - DNA, 20 bp, Artificial Sequence
  chemically synthesized
agaaaagcactttggaatgc

SEQ ID NO: 148961 - DNA, 20 bp, Artificial Sequence
  chemically synthesized
aagagtactctcgcattcca

SEQ ID NO: 148962 - DNA, 20 bp, Artificial Sequence
  chemically synthesized
tctcactcagaaaagcactt

SEQ ID NO: 148963 - DNA, 20 bp, Artificial Sequence
  chemically synthesized
gcattccaaagtgcttttct

SEQ ID NO: 148964 - DNA, 20 bp, Artificial Sequence
  chemically synthesized
gcaccctctctcactcagaa

SEQ ID NO: 148965 - DNA, 20 bp, Artificial Sequence
  chemically synthesized
tccaaagtgcttttctgagt

SEQ ID NO: 148966 - DNA, 20 bp, Artificial Sequence
  chemically synthesized
caaagtgcttttctgagtga

SEQ ID NO: 148967 - DNA, 20 bp, Artificial Sequence
  chemically synthesized
aagtgcttttctgagtgaga

SEQ ID NO: 148968 - DNA, 20 bp, Artificial Sequence
  chemically synthesized
actgtgcaccctctctcact

SEQ ID NO: 148969 - DNA, 20 bp, Artificial Sequence
  chemically synthesized
agtgcttttctgagtgagag

SEQ ID NO: 148970 - DNA, 20 bp, Artificial Sequence
  chemically synthesized
gtgcttttctgagtgagaga

SEQ ID NO: 148971 - DNA, 20 bp, Artificial Sequence
  chemically synthesized
tctgagtgagagagggtgca

SEQ ID NO: 148972 - DNA, 20 bp, Artificial Sequence
  chemically synthesized
agtgagagagggtgcacagt

SEQ ID NO: 148973 - DNA, 20 bp, Artificial Sequence
  chemically synthesized
agagggtgcacagtcagaac

SEQ ID NO: 148974 - DNA, 20 bp, Artificial Sequence
  chemically synthesized
atagcaaaattcaagcacac

SEQ ID NO: 148975 - DNA, 20 bp, Artificial Sequence
  chemically synthesized
gaagttaaatagcaaaattc

SEQ ID NO: 148976 - DNA, 20 bp, Artificial Sequence
  chemically synthesized
taaaggtgaatgaagttaaa

SEQ ID NO: 148977 - DNA, 20 bp, Artificial Sequence
  chemically synthesized
cagatatgtaaaggtgaatg

SEQ ID NO: 148978 - DNA, 20 bp, Artificial Sequence
  chemically synthesized
caggggctacagatatgtaa

SEQ ID NO: 148979 - DNA, 20 bp, Artificial Sequence
  chemically synthesized
tcaggggctacagatatgta

SEQ ID NO: 148980 - DNA, 20 bp, Artificial Sequence
  chemically synthesized
cattcacctttacatatctg

SEQ ID NO: 148981 - DNA, 20 bp, Artificial Sequence
  chemically synthesized
gatattcatgtcaggggcta

SEQ ID NO: 148982 - DNA, 20 bp, Artificial Sequence
  chemically synthesized
aagatagatattcatgtcag

SEQ ID NO: 148983 - DNA, 20 bp, Artificial Sequence
  chemically synthesized
gaagatagatattcatgtca

SEQ ID NO: 148984 - DNA, 20 bp, Artificial Sequence
  chemically synthesized
tgaagatagatattcatgtc

SEQ ID NO: 148985 - DNA, 20 bp, Artificial Sequence
  chemically synthesized
ctgaagatagatattcatgt

SEQ ID NO: 148986 - DNA, 20 bp, Artificial Sequence
  chemically synthesized
ctgacatgaatatctatctt

SEQ ID NO: 148987 - DNA, 20 bp, Artificial Sequence
  chemically synthesized
tgacatgaatatctatcttc

SEQ ID NO: 148988 - DNA, 20 bp, Artificial Sequence
  chemically synthesized
ttcactcacttgcctgaaga

SEQ ID NO: 148989 - DNA, 20 bp, Artificial Sequence
  chemically synthesized
atgaatatctatcttcaggc

SEQ ID NO: 148990 - DNA, 20 bp, Artificial Sequence
  chemically synthesized
aatattcactcacttgcctg

SEQ ID NO: 148991 - DNA, 20 bp, Artificial Sequence
  chemically synthesized
atatctatcttcaggcaagt

SEQ ID NO: 148992 - DNA, 20 bp, Artificial Sequence
  chemically synthesized
accagtatcatcacagatgt

SEQ ID NO: 148993 - DNA, 20 bp, Artificial Sequence
  chemically synthesized
ctatcctaccagtatcatca

SEQ ID NO: 148994 - DNA, 20 bp, Artificial Sequence
  chemically synthesized
gccaacatctgtgatgatac

SEQ ID NO: 148995 - DNA, 20 bp, Artificial Sequence
  chemically synthesized
aacatctgtgatgatactgg

SEQ ID NO: 148996 - DNA, 20 bp, Artificial Sequence
  chemically synthesized
acatctgtgatgatactggt

SEQ ID NO: 148997 - DNA, 20 bp, Artificial Sequence
  chemically synthesized
ctgtgatgatactggtagga

SEQ ID NO: 148998 - DNA, 20 bp, Artificial Sequence
  chemically synthesized
tgtgatgatactggtaggat

SEQ ID NO: 148999 - DNA, 20 bp, Artificial Sequence
  chemically synthesized
tgcccccatccctatcctac

SEQ ID NO: 149000 - DNA, 20 bp, Artificial Sequence
  chemically synthesized
gtgatgatactggtaggata

SEQ ID NO: 149001 - DNA, 20 bp, Artificial Sequence
  chemically synthesized
tgatactggtaggataggga

SEQ ID NO: 149002 - DNA, 20 bp, Artificial Sequence
  chemically synthesized
gatactggtaggatagggat

SEQ ID NO: 149003 - DNA, 20 bp, Artificial Sequence
  chemically synthesized
atactggtaggatagggatg

SEQ ID NO: 149004 - DNA, 20 bp, Artificial Sequence
  chemically synthesized
tactggtaggatagggatgg

SEQ ID NO: 149005 - DNA, 20 bp, Artificial Sequence
  chemically synthesized
atagggatgggggcaaaaca

SEQ ID NO: 149006 - DNA, 20 bp, Artificial Sequence
  chemically synthesized
tagggatgggggcaaaacaa

SEQ ID NO: 149007 - DNA, 20 bp, Artificial Sequence
  chemically synthesized
ggtattggatatggtcatat

SEQ ID NO: 149008 - DNA, 20 bp, Artificial Sequence
  chemically synthesized
aggtattggatatggtcata

SEQ ID NO: 149009 - DNA, 20 bp, Artificial Sequence
  chemically synthesized
gagaattcaggtattggata

SEQ ID NO: 149010 - DNA, 20 bp, Artificial Sequence
  chemically synthesized
gtggaagagaattcaggtat

SEQ ID NO: 149011 - DNA, 20 bp, Artificial Sequence
  chemically synthesized
agtaaagtggaagagaattc

SEQ ID NO: 149012 - DNA, 20 bp, Artificial Sequence
  chemically synthesized
aagtaaagtggaagagaatt

SEQ ID NO: 149013 - DNA, 20 bp, Artificial Sequence
  chemically synthesized
tttctgtaagtaaagtggaa

SEQ ID NO: 149014 - DNA, 20 bp, Artificial Sequence
  chemically synthesized
actttctgtaagtaaagtgg

SEQ ID NO: 149015 - DNA, 20 bp, Artificial Sequence
  chemically synthesized
atcactttctgtaagtaaag

SEQ ID NO: 149016 - DNA, 20 bp, Artificial Sequence
  chemically synthesized
attctcttccactttactta

SEQ ID NO: 149017 - DNA, 20 bp, Artificial Sequence
  chemically synthesized
gaaatcactttctgtaagta

SEQ ID NO: 149018 - DNA, 20 bp, Artificial Sequence
  chemically synthesized
tcttccactttacttacaga

SEQ ID NO: 149019 - DNA, 20 bp, Artificial Sequence
  chemically synthesized
agtgggaaatcactttctgt

SEQ ID NO: 149020 - DNA, 20 bp, Artificial Sequence
  chemically synthesized
gtacttttggggtaagcagt

SEQ ID NO: 149021 - DNA, 20 bp, Artificial Sequence
  chemically synthesized
tgtacttttggggtaagcag

SEQ ID NO: 149022 - DNA, 20 bp, Artificial Sequence
  chemically synthesized
atgtgtacttttggggtaag

SEQ ID NO: 149023 - DNA, 20 bp, Artificial Sequence
  chemically synthesized
tttcccactgcttaccccaa

SEQ ID NO: 149024 - DNA, 20 bp, Artificial Sequence
  chemically synthesized
acaatgtgtacttttggggt

SEQ ID NO: 149025 - DNA, 20 bp, Artificial Sequence
  chemically synthesized
tgacacaatgtgtacttttg

SEQ ID NO: 149026 - DNA, 20 bp, Artificial Sequence
  chemically synthesized
ttgacacaatgtgtactttt

SEQ ID NO: 149027 - DNA, 20 bp, Artificial Sequence
  chemically synthesized
tttgacacaatgtgtacttt

SEQ ID NO: 149028 - DNA, 20 bp, Artificial Sequence
  chemically synthesized
aagtacacattgtgtcaaac

SEQ ID NO: 149029 - DNA, 20 bp, Artificial Sequence
  chemically synthesized
acacattgtgtcaaactagc

SEQ ID NO: 149030 - DNA, 20 bp, Artificial Sequence
  chemically synthesized
tattacataaagagactggc

SEQ ID NO: 149031 - DNA, 20 bp, Artificial Sequence
  chemically synthesized
tgggtattacataaagagac

SEQ ID NO: 149032 - DNA, 20 bp, Artificial Sequence
  chemically synthesized
catattgggtattacataaa

SEQ ID NO: 149033 - DNA, 20 bp, Artificial Sequence
  chemically synthesized
agcatattgggtattacata

SEQ ID NO: 149034 - DNA, 20 bp, Artificial Sequence
  chemically synthesized
gtaaagagtgaaagcatatt

SEQ ID NO: 149035 - DNA, 20 bp, Artificial Sequence
  chemically synthesized
tgtaaagagtgaaagcatat

SEQ ID NO: 149036 - DNA, 20 bp, Artificial Sequence
  chemically synthesized
atttattttgtaaagagtga

SEQ ID NO: 149037 - DNA, 20 bp, Artificial Sequence
  chemically synthesized
ggataaatttattttgtaaa

SEQ ID NO: 149038 - DNA, 20 bp, Artificial Sequence
  chemically synthesized
aaggataaatttattttgta

SEQ ID NO: 149039 - DNA, 20 bp, Artificial Sequence
  chemically synthesized
aaaaagtctaagaaacaaca

SEQ ID NO: 149040 - DNA, 20 bp, Artificial Sequence
  chemically synthesized
aaaaaagtctaagaaacaac

SEQ ID NO: 149041 - DNA, 20 bp, Artificial Sequence
  chemically synthesized
aatttatccttgttgtttct

SEQ ID NO: 149042 - DNA, 20 bp, Artificial Sequence
  chemically synthesized
atgggtgcaaaaaaaagtct

SEQ ID NO: 149043 - DNA, 20 bp, Artificial Sequence
  chemically synthesized
aataaaatgggtgcaaaaaa

SEQ ID NO: 149044 - DNA, 20 bp, Artificial Sequence
  chemically synthesized
acattagtaaggaataaaat

SEQ ID NO: 149045 - DNA, 20 bp, Artificial Sequence
  chemically synthesized
gacattagtaaggaataaaa

SEQ ID NO: 149046 - DNA, 20 bp, Artificial Sequence
  chemically synthesized
tgtgatcgtagacattagta

SEQ ID NO: 149047 - DNA, 20 bp, Artificial Sequence
  chemically synthesized
ttgtgatcgtagacattagt

SEQ ID NO: 149048 - DNA, 20 bp, Artificial Sequence
  chemically synthesized
aagattgtgatcgtagacat

SEQ ID NO: 149049 - DNA, 20 bp, Artificial Sequence
  chemically synthesized
ttcacagaagattgtgatcg

SEQ ID NO: 149050 - DNA, 20 bp, Artificial Sequence
  chemically synthesized
tacgatcacaatcttctgtg

SEQ ID NO: 149051 - DNA, 20 bp, Artificial Sequence
  chemically synthesized
tgtcaacaaagacttcacag

SEQ ID NO: 149052 - DNA, 20 bp, Artificial Sequence
  chemically synthesized
agttgtcaacaaagacttca

SEQ ID NO: 149053 - DNA, 20 bp, Artificial Sequence
  chemically synthesized
gttaactagagttgtcaaca

SEQ ID NO: 149054 - DNA, 20 bp, Artificial Sequence
  chemically synthesized
gaagtctttgttgacaactc

SEQ ID NO: 149055 - DNA, 20 bp, Artificial Sequence
  chemically synthesized
aagactgtatgggttaacta

SEQ ID NO: 149056 - DNA, 20 bp, Artificial Sequence
  chemically synthesized
agaagactgtatgggttaac

SEQ ID NO: 149057 - DNA, 20 bp, Artificial Sequence
  chemically synthesized
acaactctagttaacccata

SEQ ID NO: 149058 - DNA, 20 bp, Artificial Sequence
  chemically synthesized
gtttggaaagaagactgtat

SEQ ID NO: 149059 - DNA, 20 bp, Artificial Sequence
  chemically synthesized
agtttggaaagaagactgta

SEQ ID NO: 149060 - DNA, 20 bp, Artificial Sequence
  chemically synthesized
caacataggagtttggaaag

SEQ ID NO: 149061 - DNA, 20 bp, Artificial Sequence
  chemically synthesized
aatcaacataggagtttgga

SEQ ID NO: 149062 - DNA, 20 bp, Artificial Sequence
  chemically synthesized
ctgaaatcaacataggagtt

SEQ ID NO: 149063 - DNA, 20 bp, Artificial Sequence
  chemically synthesized
taagactgaaatcaacatag

SEQ ID NO: 149064 - DNA, 20 bp, Artificial Sequence
  chemically synthesized
tgtaagactgaaatcaacat

SEQ ID NO: 149065 - DNA, 20 bp, Artificial Sequence
  chemically synthesized
atgtaagactgaaatcaaca

SEQ ID NO: 149066 - DNA, 20 bp, Artificial Sequence
  chemically synthesized
ccaaactcctatgttgattt

SEQ ID NO: 149067 - DNA, 20 bp, Artificial Sequence
  chemically synthesized
aataatataaataaatatgt

SEQ ID NO: 149068 - DNA, 20 bp, Artificial Sequence
  chemically synthesized
gtagaattttacaattgaga

SEQ ID NO: 149069 - DNA, 20 bp, Artificial Sequence
  chemically synthesized
aattgtagaattttacaatt

SEQ ID NO: 149070 - DNA, 20 bp, Artificial Sequence
  chemically synthesized
caattgtaaaattctacaat

SEQ ID NO: 149071 - DNA, 20 bp, Artificial Sequence
  chemically synthesized
ttgtaaaattctacaattgg

SEQ ID NO: 149072 - DNA, 20 bp, Artificial Sequence
  chemically synthesized
ccataatttccttccaattg

SEQ ID NO: 149073 - DNA, 20 bp, Artificial Sequence
  chemically synthesized
tgtaaaattctacaattgga

SEQ ID NO: 149074 - DNA, 20 bp, Artificial Sequence
  chemically synthesized
ctacaattggaaggaaatta

SEQ ID NO: 149075 - DNA, 20 bp, Artificial Sequence
  chemically synthesized
aagattttaaagttcagcat

SEQ ID NO: 149076 - DNA, 20 bp, Artificial Sequence
  chemically synthesized
aggagaaagattttaaagtt

SEQ ID NO: 149077 - DNA, 20 bp, Artificial Sequence
  chemically synthesized
ctcaaaggagaaagatttta

SEQ ID NO: 149078 - DNA, 20 bp, Artificial Sequence
  chemically synthesized
tttacaatgctcaaaggaga

SEQ ID NO: 149079 - DNA, 20 bp, Artificial Sequence
  chemically synthesized
ctttaaaatctttctccttt

SEQ ID NO: 149080 - DNA, 20 bp, Artificial Sequence
  chemically synthesized
aagatttacaatgctcaaag

SEQ ID NO: 149081 - DNA, 20 bp, Artificial Sequence
  chemically synthesized
ctaagatttacaatgctcaa

SEQ ID NO: 149082 - DNA, 20 bp, Artificial Sequence
  chemically synthesized
tctaagatttacaatgctca

SEQ ID NO: 149083 - DNA, 20 bp, Artificial Sequence
  chemically synthesized
cctttgagcattgtaaatct

SEQ ID NO: 149084 - DNA, 20 bp, Artificial Sequence
  chemically synthesized
tatgtaaagcatttcagtct

SEQ ID NO: 149085 - DNA, 20 bp, Artificial Sequence
  chemically synthesized
aaattatatgtaaagcattt

SEQ ID NO: 149086 - DNA, 20 bp, Artificial Sequence
  chemically synthesized
catctactaaattatatgta

SEQ ID NO: 149087 - DNA, 20 bp, Artificial Sequence
  chemically synthesized
gaaatgctttacatataatt

SEQ ID NO: 149088 - DNA, 20 bp, Artificial Sequence
  chemically synthesized
atgctttacatataatttag

SEQ ID NO: 149089 - DNA, 20 bp, Artificial Sequence
  chemically synthesized
agtagatgtttaatattctc

SEQ ID NO: 149090 - DNA, 20 bp, Artificial Sequence
  chemically synthesized
tagatgtttaatattctcaa

SEQ ID NO: 149091 - DNA, 20 bp, Artificial Sequence
  chemically synthesized
agatgtttaatattctcaag

SEQ ID NO: 149092 - DNA, 20 bp, Artificial Sequence
  chemically synthesized
gactcttaggcatacctctt

SEQ ID NO: 149093 - DNA, 20 bp, Artificial Sequence
  chemically synthesized
tattctcaagaggtatgcct

SEQ ID NO: 149094 - DNA, 20 bp, Artificial Sequence
  chemically synthesized
ttctcaagaggtatgcctaa

SEQ ID NO: 149095 - DNA, 20 bp, Artificial Sequence
  chemically synthesized
tttgatttgcaaagactctt

SEQ ID NO: 149096 - DNA, 20 bp, Artificial Sequence
  chemically synthesized
ttttgatttgcaaagactct

SEQ ID NO: 149097 - DNA, 20 bp, Artificial Sequence
  chemically synthesized
aatctgctttttgatttgca

SEQ ID NO: 149098 - DNA, 20 bp, Artificial Sequence
  chemically synthesized
aagagtctttgcaaatcaaa

SEQ ID NO: 149099 - DNA, 20 bp, Artificial Sequence
  chemically synthesized
agtctttgcaaatcaaaaag

SEQ ID NO: 149100 - DNA, 20 bp, Artificial Sequence
  chemically synthesized
agcagatttatatgatctga

SEQ ID NO: 149101 - DNA, 20 bp, Artificial Sequence
  chemically synthesized
taactcctaagtaagactat

SEQ ID NO: 149102 - DNA, 20 bp, Artificial Sequence
  chemically synthesized
tatgatctgatagtcttact

SEQ ID NO: 149103 - DNA, 20 bp, Artificial Sequence
  chemically synthesized
atgatctgatagtcttactt

SEQ ID NO: 149104 - DNA, 20 bp, Artificial Sequence
  chemically synthesized
gatctgatagtcttacttag

SEQ ID NO: 149105 - DNA, 20 bp, Artificial Sequence
  chemically synthesized
gaatcccttaactcctaagt

SEQ ID NO: 149106 - DNA, 20 bp, Artificial Sequence
  chemically synthesized
gatagtcttacttaggagtt

SEQ ID NO: 149107 - DNA, 20 bp, Artificial Sequence
  chemically synthesized
ggatgaatcccttaactcct

SEQ ID NO: 149108 - DNA, 20 bp, Artificial Sequence
  chemically synthesized
atagtcttacttaggagtta

SEQ ID NO: 149109 - DNA, 20 bp, Artificial Sequence
  chemically synthesized
tagtcttacttaggagttaa

SEQ ID NO: 149110 - DNA, 20 bp, Artificial Sequence
  chemically synthesized
ttaagggattcatccctgcc

SEQ ID NO: 149111 - DNA, 20 bp, Artificial Sequence
  chemically synthesized
agggattcatccctgcccag

SEQ ID NO: 149112 - DNA, 20 bp, Artificial Sequence
  chemically synthesized
tactgggaaactactgggca

SEQ ID NO: 149113 - DNA, 20 bp, Artificial Sequence
  chemically synthesized
gtactgggaaactactgggc

SEQ ID NO: 149114 - DNA, 20 bp, Artificial Sequence
  chemically synthesized
tgtactgggaaactactggg

SEQ ID NO: 149115 - DNA, 20 bp, Artificial Sequence
  chemically synthesized
tcatgtactgggaaactact

SEQ ID NO: 149116 - DNA, 20 bp, Artificial Sequence
  chemically synthesized
ttcatgtactgggaaactac

SEQ ID NO: 149117 - DNA, 20 bp, Artificial Sequence
  chemically synthesized
atccctgcccagtagtttcc

SEQ ID NO: 149118 - DNA, 20 bp, Artificial Sequence
  chemically synthesized
cagtactaatttcatgtact

SEQ ID NO: 149119 - DNA, 20 bp, Artificial Sequence
  chemically synthesized
ccagtactaatttcatgtac

SEQ ID NO: 149120 - DNA, 20 bp, Artificial Sequence
  chemically synthesized
agtttcccagtacatgaaat

SEQ ID NO: 149121 - DNA, 20 bp, Artificial Sequence
  chemically synthesized
ccagtacatgaaattagtac

SEQ ID NO: 149122 - DNA, 20 bp, Artificial Sequence
  chemically synthesized
agtacatgaaattagtactg

SEQ ID NO: 149123 - DNA, 20 bp, Artificial Sequence
  chemically synthesized
gtacatgaaattagtactgg

SEQ ID NO: 149124 - DNA, 20 bp, Artificial Sequence
  chemically synthesized
taacatgtaaggaaggcctc

SEQ ID NO: 149125 - DNA, 20 bp, Artificial Sequence
  chemically synthesized
gtggttctaacatgtaagga

SEQ ID NO: 149126 - DNA, 20 bp, Artificial Sequence
  chemically synthesized
ggtggttctaacatgtaagg

SEQ ID NO: 149127 - DNA, 20 bp, Artificial Sequence
  chemically synthesized
tggaggccttccttacatgt

SEQ ID NO: 149128 - DNA, 20 bp, Artificial Sequence
  chemically synthesized
ttgggtggttctaacatgta

SEQ ID NO: 149129 - DNA, 20 bp, Artificial Sequence
  chemically synthesized
attgggtggttctaacatgt

SEQ ID NO: 149130 - DNA, 20 bp, Artificial Sequence
  chemically synthesized
gatcctattgggtaattggg

SEQ ID NO: 149131 - DNA, 20 bp, Artificial Sequence
  chemically synthesized
attgatcctattgggtaatt

SEQ ID NO: 149132 - DNA, 20 bp, Artificial Sequence
  chemically synthesized
cattgatcctattgggtaat

SEQ ID NO: 149133 - DNA, 20 bp, Artificial Sequence
  chemically synthesized
agaaccacccaattacccaa

SEQ ID NO: 149134 - DNA, 20 bp, Artificial Sequence
  chemically synthesized
gaaccacccaattacccaat

SEQ ID NO: 149135 - DNA, 20 bp, Artificial Sequence
  chemically synthesized
ttaatagcattgatcctatt

SEQ ID NO: 149136 - DNA, 20 bp, Artificial Sequence
  chemically synthesized
tttaatagcattgatcctat

SEQ ID NO: 149137 - DNA, 20 bp, Artificial Sequence
  chemically synthesized
gtgatttctaatgtgtttaa

SEQ ID NO: 149138 - DNA, 20 bp, Artificial Sequence
  chemically synthesized
atcaatgctattaaacacat

SEQ ID NO: 149139 - DNA, 20 bp, Artificial Sequence
  chemically synthesized
ttagaaatcactacatatca

SEQ ID NO: 149140 - DNA, 20 bp, Artificial Sequence
  chemically synthesized
ttctaaaggtccatgatatg

SEQ ID NO: 149141 - DNA, 20 bp, Artificial Sequence
  chemically synthesized
cactacatatcatggacctt

SEQ ID NO: 149142 - DNA, 20 bp, Artificial Sequence
  chemically synthesized
acatatcatggacctttaga

SEQ ID NO: 149143 - DNA, 20 bp, Artificial Sequence
  chemically synthesized
gataaaatattgctttctaa

SEQ ID NO: 149144 - DNA, 20 bp, Artificial Sequence
  chemically synthesized
tgataaaatattgctttcta

SEQ ID NO: 149145 - DNA, 20 bp, Artificial Sequence
  chemically synthesized
aatattttatcacttcatat

SEQ ID NO: 149146 - DNA, 20 bp, Artificial Sequence
  chemically synthesized
taagctaaataactcatatg

SEQ ID NO: 149147 - DNA, 20 bp, Artificial Sequence
  chemically synthesized
atcacttcatatgagttatt

SEQ ID NO: 149148 - DNA, 20 bp, Artificial Sequence
  chemically synthesized
ttcatatgagttatttagct

SEQ ID NO: 149149 - DNA, 20 bp, Artificial Sequence
  chemically synthesized
tcatatgagttatttagctt

SEQ ID NO: 149150 - DNA, 20 bp, Artificial Sequence
  chemically synthesized
aaatggcaaaacattgtcct

SEQ ID NO: 149151 - DNA, 20 bp, Artificial Sequence
  chemically synthesized
ctcataatctaaataagaaa

SEQ ID NO: 149152 - DNA, 20 bp, Artificial Sequence
  chemically synthesized
atgttttgccatttcttatt

SEQ ID NO: 149153 - DNA, 20 bp, Artificial Sequence
  chemically synthesized
acatttctcataatctaaat

SEQ ID NO: 149154 - DNA, 20 bp, Artificial Sequence
  chemically synthesized
ccatttcttatttagattat

SEQ ID NO: 149155 - DNA, 20 bp, Artificial Sequence
  chemically synthesized
taagaaataatttttaaaat

SEQ ID NO: 149156 - DNA, 20 bp, Artificial Sequence
  chemically synthesized
tcattttaaaaattatttct

SEQ ID NO: 149157 - DNA, 20 bp, Artificial Sequence
  chemically synthesized
tcagaatgatgtgatatact

SEQ ID NO: 149158 - DNA, 20 bp, Artificial Sequence
  chemically synthesized
tttgctttagtgcagataat

SEQ ID NO: 149159 - DNA, 20 bp, Artificial Sequence
  chemically synthesized
cattctgattatctgcacta

SEQ ID NO: 149160 - DNA, 20 bp, Artificial Sequence
  chemically synthesized
tggaagattttgctttagtg

SEQ ID NO: 149161 - DNA, 20 bp, Artificial Sequence
  chemically synthesized
atgtttggaagattttgctt

SEQ ID NO: 149162 - DNA, 20 bp, Artificial Sequence
  chemically synthesized
gaaaactcctttatgtttgg

SEQ ID NO: 149163 - DNA, 20 bp, Artificial Sequence
  chemically synthesized
agcaaaatcttccaaacata

SEQ ID NO: 149164 - DNA, 20 bp, Artificial Sequence
  chemically synthesized
gcaaaatcttccaaacataa

SEQ ID NO: 149165 - DNA, 20 bp, Artificial Sequence
  chemically synthesized
tttgaaaactcctttatgtt

SEQ ID NO: 149166 - DNA, 20 bp, Artificial Sequence
  chemically synthesized
aaaatcttccaaacataaag

SEQ ID NO: 149167 - DNA, 20 bp, Artificial Sequence
  chemically synthesized
ttcaaaatatgttctaccat

SEQ ID NO: 149168 - DNA, 20 bp, Artificial Sequence
  chemically synthesized
gtcatgctaatttctaatgg

SEQ ID NO: 149169 - DNA, 20 bp, Artificial Sequence
  chemically synthesized
gccgtcatgctaatttctaa

SEQ ID NO: 149170 - DNA, 20 bp, Artificial Sequence
  chemically synthesized
tatgttctaccattagaaat

SEQ ID NO: 149171 - DNA, 20 bp, Artificial Sequence
  chemically synthesized
accattagaaattagcatga

SEQ ID NO: 149172 - DNA, 20 bp, Artificial Sequence
  chemically synthesized
aaatatgttaaatgaaaata

SEQ ID NO: 149173 - DNA, 20 bp, Artificial Sequence
  chemically synthesized
tcatttaacatattttacaa

SEQ ID NO: 149174 - DNA, 20 bp, Artificial Sequence
  chemically synthesized
catttaacatattttacaaa

SEQ ID NO: 149175 - DNA, 20 bp, Artificial Sequence
  chemically synthesized
tattttacaaaaggaaataa

SEQ ID NO: 149176 - DNA, 20 bp, Artificial Sequence
  chemically synthesized
attttacaaaaggaaataat

SEQ ID NO: 149177 - DNA, 20 bp, Artificial Sequence
  chemically synthesized
gaaataataggttcatgaat

SEQ ID NO: 149178 - DNA, 20 bp, Artificial Sequence
  chemically synthesized
taataggttcatgaatgaga

SEQ ID NO: 149179 - DNA, 20 bp, Artificial Sequence
  chemically synthesized
atcaaagacacgacagaaaa

SEQ ID NO: 149180 - DNA, 20 bp, Artificial Sequence
  chemically synthesized
tcagattatcaaagacacga

SEQ ID NO: 149181 - DNA, 20 bp, Artificial Sequence
  chemically synthesized
agactaaattcagattatca

SEQ ID NO: 149182 - DNA, 20 bp, Artificial Sequence
  chemically synthesized
tgtctttgataatctgaatt

SEQ ID NO: 149183 - DNA, 20 bp, Artificial Sequence
  chemically synthesized
ctattctgttagactaaatt

SEQ ID NO: 149184 - DNA, 20 bp, Artificial Sequence
  chemically synthesized
ataatctgaatttagtctaa

SEQ ID NO: 149185 - DNA, 20 bp, Artificial Sequence
  chemically synthesized
ctgaatttagtctaacagaa

SEQ ID NO: 149186 - DNA, 20 bp, Artificial Sequence
  chemically synthesized
ttaaatgaaagctattctgt

SEQ ID NO: 149187 - DNA, 20 bp, Artificial Sequence
  chemically synthesized
taacagaatagctttcattt

SEQ ID NO: 149188 - DNA, 20 bp, Artificial Sequence
  chemically synthesized
cagtaataatacttaaatga

SEQ ID NO: 149189 - DNA, 20 bp, Artificial Sequence
  chemically synthesized
ttactaagttagtaattatt

SEQ ID NO: 149190 - DNA, 20 bp, Artificial Sequence
  chemically synthesized
ttactgaataattactaact

SEQ ID NO: 149191 - DNA, 20 bp, Artificial Sequence
  chemically synthesized
gtataaaccctttactaagt

SEQ ID NO: 149192 - DNA, 20 bp, Artificial Sequence
  chemically synthesized
gaataattactaacttagta

SEQ ID NO: 149193 - DNA, 20 bp, Artificial Sequence
  chemically synthesized
aataattactaacttagtaa

SEQ ID NO: 149194 - DNA, 20 bp, Artificial Sequence
  chemically synthesized
ataattactaacttagtaaa

SEQ ID NO: 149195 - DNA, 20 bp, Artificial Sequence
  chemically synthesized
gtaggtataaaccctttact

SEQ ID NO: 149196 - DNA, 20 bp, Artificial Sequence
  chemically synthesized
gtaaagggtttatacctact

SEQ ID NO: 149197 - DNA, 20 bp, Artificial Sequence
  chemically synthesized
atcctgcttcgttactaagt

SEQ ID NO: 149198 - DNA, 20 bp, Artificial Sequence
  chemically synthesized
tatcctgcttcgttactaag

SEQ ID NO: 149199 - DNA, 20 bp, Artificial Sequence
  chemically synthesized
tttatacctacttagtaacg

SEQ ID NO: 149200 - DNA, 20 bp, Artificial Sequence
  chemically synthesized
aaatatcctgcttcgttact

SEQ ID NO: 149201 - DNA, 20 bp, Artificial Sequence
  chemically synthesized
atacctacttagtaacgaag

SEQ ID NO: 149202 - DNA, 20 bp, Artificial Sequence
  chemically synthesized
tacctacttagtaacgaagc

SEQ ID NO: 149203 - DNA, 20 bp, Artificial Sequence
  chemically synthesized
cgagttccacaaaggggtca

SEQ ID NO: 149204 - DNA, 20 bp, Artificial Sequence
  chemically synthesized
gcgagttccacaaaggggtc

SEQ ID NO: 149205 - DNA, 20 bp, Artificial Sequence
  chemically synthesized
tgcgagttccacaaaggggt

SEQ ID NO: 149206 - DNA, 20 bp, Artificial Sequence
  chemically synthesized
atatttccctgacccctttg

SEQ ID NO: 149207 - DNA, 20 bp, Artificial Sequence
  chemically synthesized
ctgttgcgagttccacaaag

SEQ ID NO: 149208 - DNA, 20 bp, Artificial Sequence
  chemically synthesized
cctgttgcgagttccacaaa

SEQ ID NO: 149209 - DNA, 20 bp, Artificial Sequence
  chemically synthesized
ccctgttgcgagttccacaa

SEQ ID NO: 149210 - DNA, 20 bp, Artificial Sequence
  chemically synthesized
cccctgttgcgagttccaca

SEQ ID NO: 149211 - DNA, 20 bp, Artificial Sequence
  chemically synthesized
cccctttgtggaactcgcaa

SEQ ID NO: 149212 - DNA, 20 bp, Artificial Sequence
  chemically synthesized
ccctttgtggaactcgcaac

SEQ ID NO: 149213 - DNA, 20 bp, Artificial Sequence
  chemically synthesized
cctttgtggaactcgcaaca

SEQ ID NO: 149214 - DNA, 20 bp, Artificial Sequence
  chemically synthesized
ctttgtggaactcgcaacag

SEQ ID NO: 149215 - DNA, 20 bp, Artificial Sequence
  chemically synthesized
aaataaggcacccctgttgc

SEQ ID NO: 149216 - DNA, 20 bp, Artificial Sequence
  chemically synthesized
agcagtgggctaagtaaata

SEQ ID NO: 149217 - DNA, 20 bp, Artificial Sequence
  chemically synthesized
acaggggtgccttatttact

SEQ ID NO: 149218 - DNA, 20 bp, Artificial Sequence
  chemically synthesized
gagcagtgggctaagtaaat

SEQ ID NO: 149219 - DNA, 20 bp, Artificial Sequence
  chemically synthesized
ggagttgagagcagtgggct

SEQ ID NO: 149220 - DNA, 20 bp, Artificial Sequence
  chemically synthesized
agtgaggagttgagagcagt

SEQ ID NO: 149221 - DNA, 20 bp, Artificial Sequence
  chemically synthesized
cagtgaggagttgagagcag

SEQ ID NO: 149222 - DNA, 20 bp, Artificial Sequence
  chemically synthesized
ctccagtgaggagttgagag

SEQ ID NO: 149223 - DNA, 20 bp, Artificial Sequence
  chemically synthesized
tccctccagtgaggagttga

SEQ ID NO: 149224 - DNA, 20 bp, Artificial Sequence
  chemically synthesized
actccctccagtgaggagtt

SEQ ID NO: 149225 - DNA, 20 bp, Artificial Sequence
  chemically synthesized
cactgctctcaactcctcac

SEQ ID NO: 149226 - DNA, 20 bp, Artificial Sequence
  chemically synthesized
ctgctctcaactcctcactg

SEQ ID NO: 149227 - DNA, 20 bp, Artificial Sequence
  chemically synthesized
tgcacactccctccagtgag

SEQ ID NO: 149228 - DNA, 20 bp, Artificial Sequence
  chemically synthesized
tgctctcaactcctcactgg

SEQ ID NO: 149229 - DNA, 20 bp, Artificial Sequence
  chemically synthesized
gctctcaactcctcactgga

SEQ ID NO: 149230 - DNA, 20 bp, Artificial Sequence
  chemically synthesized
cttgcacactccctccagtg

SEQ ID NO: 149231 - DNA, 20 bp, Artificial Sequence
  chemically synthesized
gcttgcacactccctccagt

SEQ ID NO: 149232 - DNA, 20 bp, Artificial Sequence
  chemically synthesized
tctcaactcctcactggagg

SEQ ID NO: 149233 - DNA, 20 bp, Artificial Sequence
  chemically synthesized
gtttgcttgcacactccctc

SEQ ID NO: 149234 - DNA, 20 bp, Artificial Sequence
  chemically synthesized
cctcactggagggagtgtgc

SEQ ID NO: 149235 - DNA, 20 bp, Artificial Sequence
  chemically synthesized
gagggagtgtgcaagcaaac

SEQ ID NO: 149236 - DNA, 20 bp, Artificial Sequence
  chemically synthesized
agggagtgtgcaagcaaacg

SEQ ID NO: 149237 - DNA, 20 bp, Artificial Sequence
  chemically synthesized
gagtgtgcaagcaaacgagg

SEQ ID NO: 149238 - DNA, 20 bp, Artificial Sequence
  chemically synthesized
agtgtgcaagcaaacgaggt

SEQ ID NO: 149239 - DNA, 20 bp, Artificial Sequence
  chemically synthesized
caagcaaacgaggtgggaac

SEQ ID NO: 149240 - DNA, 20 bp, Artificial Sequence
  chemically synthesized
agcaaacgaggtgggaactg

SEQ ID NO: 149241 - DNA, 20 bp, Artificial Sequence
  chemically synthesized
gctccagtgctcatgcactc

SEQ ID NO: 149242 - DNA, 20 bp, Artificial Sequence
  chemically synthesized
aggtgggaactggagtgcat

SEQ ID NO: 149243 - DNA, 20 bp, Artificial Sequence
  chemically synthesized
gaactggagtgcatgagcac

SEQ ID NO: 149244 - DNA, 20 bp, Artificial Sequence
  chemically synthesized
actggagtgcatgagcactg

SEQ ID NO: 149245 - DNA, 20 bp, Artificial Sequence
  chemically synthesized
ggagtgcatgagcactggag

SEQ ID NO: 149246 - DNA, 20 bp, Artificial Sequence
  chemically synthesized
cctccacctagatgctgctc

SEQ ID NO: 149247 - DNA, 20 bp, Artificial Sequence
  chemically synthesized
atgagcactggagcagcatc

SEQ ID NO: 149248 - DNA, 20 bp, Artificial Sequence
  chemically synthesized
tgagcactggagcagcatct

SEQ ID NO: 149249 - DNA, 20 bp, Artificial Sequence
  chemically synthesized
gcactggagcagcatctagg

SEQ ID NO: 149250 - DNA, 20 bp, Artificial Sequence
  chemically synthesized
actggagcagcatctaggtg

SEQ ID NO: 149251 - DNA, 20 bp, Artificial Sequence
  chemically synthesized
ctggagcagcatctaggtgg

SEQ ID NO: 149252 - DNA, 20 bp, Artificial Sequence
  chemically synthesized
gggtcgcagacgcctccacc

SEQ ID NO: 149253 - DNA, 20 bp, Artificial Sequence
  chemically synthesized
ctctggggcttcaggggtcg

SEQ ID NO: 149254 - DNA, 20 bp, Artificial Sequence
  chemically synthesized
ggaggcgtctgcgacccctg

SEQ ID NO: 149255 - DNA, 20 bp, Artificial Sequence
  chemically synthesized
cacaccctctggggcttcag

SEQ ID NO: 149256 - DNA, 20 bp, Artificial Sequence
  chemically synthesized
acacaccctctggggcttca

SEQ ID NO: 149257 - DNA, 20 bp, Artificial Sequence
  chemically synthesized
gtctgcgacccctgaagccc

SEQ ID NO: 149258 - DNA, 20 bp, Artificial Sequence
  chemically synthesized
aacacaccctctggggcttc

SEQ ID NO: 149259 - DNA, 20 bp, Artificial Sequence
  chemically synthesized
taacacaccctctggggctt

SEQ ID NO: 149260 - DNA, 20 bp, Artificial Sequence
  chemically synthesized
ctgcgacccctgaagcccca

SEQ ID NO: 149261 - DNA, 20 bp, Artificial Sequence
  chemically synthesized
tgcgacccctgaagccccag

SEQ ID NO: 149262 - DNA, 20 bp, Artificial Sequence
  chemically synthesized
gcgacccctgaagccccaga

SEQ ID NO: 149263 - DNA, 20 bp, Artificial Sequence
  chemically synthesized
gcactgtaacacaccctctg

SEQ ID NO: 149264 - DNA, 20 bp, Artificial Sequence
  chemically synthesized
agcactgtaacacaccctct

SEQ ID NO: 149265 - DNA, 20 bp, Artificial Sequence
  chemically synthesized
gagcactgtaacacaccctc

SEQ ID NO: 149266 - DNA, 20 bp, Artificial Sequence
  chemically synthesized
aagccccagagggtgtgtta

SEQ ID NO: 149267 - DNA, 20 bp, Artificial Sequence
  chemically synthesized
ggtgtgttacagtgctctgt

SEQ ID NO: 149268 - DNA, 20 bp, Artificial Sequence
  chemically synthesized
cgtggatggcagagctaaca

SEQ ID NO: 149269 - DNA, 20 bp, Artificial Sequence
  chemically synthesized
tccgtggatggcagagctaa

SEQ ID NO: 149270 - DNA, 20 bp, Artificial Sequence
  chemically synthesized
taagctgtccgtggatggca

SEQ ID NO: 149271 - DNA, 20 bp, Artificial Sequence
  chemically synthesized
tctgttagctctgccatcca

SEQ ID NO: 149272 - DNA, 20 bp, Artificial Sequence
  chemically synthesized
cctaagctgtccgtggatgg

SEQ ID NO: 149273 - DNA, 20 bp, Artificial Sequence
  chemically synthesized
acgcctaagctgtccgtgga

SEQ ID NO: 149274 - DNA, 20 bp, Artificial Sequence
  chemically synthesized
ttagctctgccatccacgga

SEQ ID NO: 149275 - DNA, 20 bp, Artificial Sequence
  chemically synthesized
gttaacgcctaagctgtccg

SEQ ID NO: 149276 - DNA, 20 bp, Artificial Sequence
  chemically synthesized
tctgccatccacggacagct

SEQ ID NO: 149277 - DNA, 20 bp, Artificial Sequence
  chemically synthesized
ctgccatccacggacagctt

SEQ ID NO: 149278 - DNA, 20 bp, Artificial Sequence
  chemically synthesized
ccactgagctgttaacgcct

SEQ ID NO: 149279 - DNA, 20 bp, Artificial Sequence
  chemically synthesized
acggacagcttaggcgttaa

SEQ ID NO: 149280 - DNA, 20 bp, Artificial Sequence
  chemically synthesized
cagcttaggcgttaacagct

SEQ ID NO: 149281 - DNA, 20 bp, Artificial Sequence
  chemically synthesized
cttaggcgttaacagctcag

SEQ ID NO: 149282 - DNA, 20 bp, Artificial Sequence
  chemically synthesized
ttaggcgttaacagctcagt

SEQ ID NO: 149283 - DNA, 20 bp, Artificial Sequence
  chemically synthesized
gaaaagacaaatggcccact

SEQ ID NO: 149284 - DNA, 20 bp, Artificial Sequence
  chemically synthesized
gcctcctgtgaaaagacaaa

SEQ ID NO: 149285 - DNA, 20 bp, Artificial Sequence
  chemically synthesized
gtgggccatttgtcttttca

SEQ ID NO: 149286 - DNA, 20 bp, Artificial Sequence
  chemically synthesized
tgggccatttgtcttttcac

SEQ ID NO: 149287 - DNA, 20 bp, Artificial Sequence
  chemically synthesized
ggccatttgtcttttcacag

SEQ ID NO: 149288 - DNA, 20 bp, Artificial Sequence
  chemically synthesized
gggcagctgcctcctgtgaa

SEQ ID NO: 149289 - DNA, 20 bp, Artificial Sequence
  chemically synthesized
gccatttgtcttttcacagg

SEQ ID NO: 149290 - DNA, 20 bp, Artificial Sequence
  chemically synthesized
atttgtcttttcacaggagg

SEQ ID NO: 149291 - DNA, 20 bp, Artificial Sequence
  chemically synthesized
ttgcccttgctggtggaggg

SEQ ID NO: 149292 - DNA, 20 bp, Artificial Sequence
  chemically synthesized
aggaggcagctgccctccac

SEQ ID NO: 149293 - DNA, 20 bp, Artificial Sequence
  chemically synthesized
cctttgcccttgctggtgga

SEQ ID NO: 149294 - DNA, 20 bp, Artificial Sequence
  chemically synthesized
ccctttgcccttgctggtgg

SEQ ID NO: 149295 - DNA, 20 bp, Artificial Sequence
  chemically synthesized
ggcagctgccctccaccagc

SEQ ID NO: 149296 - DNA, 20 bp, Artificial Sequence
  chemically synthesized
gccctttgcccttgctggtg

SEQ ID NO: 149297 - DNA, 20 bp, Artificial Sequence
  chemically synthesized
gcagctgccctccaccagca

SEQ ID NO: 149298 - DNA, 20 bp, Artificial Sequence
  chemically synthesized
cagctgccctccaccagcaa

SEQ ID NO: 149299 - DNA, 20 bp, Artificial Sequence
  chemically synthesized
aggccctttgcccttgctgg

SEQ ID NO: 149300 - DNA, 20 bp, Artificial Sequence
  chemically synthesized
aaaaggccctttgcccttgc

SEQ ID NO: 149301 - DNA, 20 bp, Artificial Sequence
  chemically synthesized
gccctccaccagcaagggca

SEQ ID NO: 149302 - DNA, 20 bp, Artificial Sequence
  chemically synthesized
ccctccaccagcaagggcaa

SEQ ID NO: 149303 - DNA, 20 bp, Artificial Sequence
  chemically synthesized
cctccaccagcaagggcaaa

SEQ ID NO: 149304 - DNA, 20 bp, Artificial Sequence
  chemically synthesized
gccacaagtgtgaatacaaa

SEQ ID NO: 149305 - DNA, 20 bp, Artificial Sequence
  chemically synthesized
agccacaagtgtgaatacaa

SEQ ID NO: 149306 - DNA, 20 bp, Artificial Sequence
  chemically synthesized
gccttttgtattcacacttg

SEQ ID NO: 149307 - DNA, 20 bp, Artificial Sequence
  chemically synthesized
gacaagagctcaggagccac

SEQ ID NO: 149308 - DNA, 20 bp, Artificial Sequence
  chemically synthesized
tattcacacttgtggctcct

SEQ ID NO: 149309 - DNA, 20 bp, Artificial Sequence
  chemically synthesized
gatgctggacaagagctcag

SEQ ID NO: 149310 - DNA, 20 bp, Artificial Sequence
  chemically synthesized
tagatgctggacaagagctc

SEQ ID NO: 149311 - DNA, 20 bp, Artificial Sequence
  chemically synthesized
ctagatgctggacaagagct

SEQ ID NO: 149312 - DNA, 20 bp, Artificial Sequence
  chemically synthesized
gtggctcctgagctcttgtc

SEQ ID NO: 149313 - DNA, 20 bp, Artificial Sequence
  chemically synthesized
tttccctagatgctggacaa

SEQ ID NO: 149314 - DNA, 20 bp, Artificial Sequence
  chemically synthesized
attttccctagatgctggac

SEQ ID NO: 149315 - DNA, 20 bp, Artificial Sequence
  chemically synthesized
ctgagctcttgtccagcatc

SEQ ID NO: 149316 - DNA, 20 bp, Artificial Sequence
  chemically synthesized
tgagctcttgtccagcatct

SEQ ID NO: 149317 - DNA, 20 bp, Artificial Sequence
  chemically synthesized
gagctcttgtccagcatcta

SEQ ID NO: 149318 - DNA, 20 bp, Artificial Sequence
  chemically synthesized
acctcattttccctagatgc

SEQ ID NO: 149319 - DNA, 20 bp, Artificial Sequence
  chemically synthesized
tcatgtgacctcattttccc

SEQ ID NO: 149320 - DNA, 20 bp, Artificial Sequence
  chemically synthesized
gtccagcatctagggaaaat

SEQ ID NO: 149321 - DNA, 20 bp, Artificial Sequence
  chemically synthesized
tccagcatctagggaaaatg

SEQ ID NO: 149322 - DNA, 20 bp, Artificial Sequence
  chemically synthesized
gaggtcacatgaacaaattg

SEQ ID NO: 149323 - DNA, 20 bp, Artificial Sequence
  chemically synthesized
aggtcacatgaacaaattga

SEQ ID NO: 149324 - DNA, 20 bp, Artificial Sequence
  chemically synthesized
aattgaaggattgtaaatgt

SEQ ID NO: 149325 - DNA, 20 bp, Artificial Sequence
  chemically synthesized
attgaaggattgtaaatgtg

SEQ ID NO: 149326 - DNA, 20 bp, Artificial Sequence
  chemically synthesized
ttgaaggattgtaaatgtga

SEQ ID NO: 149327 - DNA, 20 bp, Artificial Sequence
  chemically synthesized
agggattgtactgccgatga

SEQ ID NO: 149328 - DNA, 20 bp, Artificial Sequence
  chemically synthesized
ctgagagccactttcatcgg

SEQ ID NO: 149329 - DNA, 20 bp, Artificial Sequence
  chemically synthesized
gattgtactgccgatgaaag

SEQ ID NO: 149330 - DNA, 20 bp, Artificial Sequence
  chemically synthesized
ccactgagagccactttcat

SEQ ID NO: 149331 - DNA, 20 bp, Artificial Sequence
  chemically synthesized
ctgccgatgaaagtggctct

SEQ ID NO: 149332 - DNA, 20 bp, Artificial Sequence
  chemically synthesized
ccgatgaaagtggctctcag

SEQ ID NO: 149333 - DNA, 20 bp, Artificial Sequence
  chemically synthesized
cgatgaaagtggctctcagt

SEQ ID NO: 149334 - DNA, 20 bp, Artificial Sequence
  chemically synthesized
tcagctccccttcccactga

SEQ ID NO: 149335 - DNA, 20 bp, Artificial Sequence
  chemically synthesized
tgaaagtggctctcagtggg

SEQ ID NO: 149336 - DNA, 20 bp, Artificial Sequence
  chemically synthesized
gaaagtggctctcagtggga

SEQ ID NO: 149337 - DNA, 20 bp, Artificial Sequence
  chemically synthesized
tttcagctccccttcccact

SEQ ID NO: 149338 - DNA, 20 bp, Artificial Sequence
  chemically synthesized
aaagtggctctcagtgggaa

SEQ ID NO: 149339 - DNA, 20 bp, Artificial Sequence
  chemically synthesized
aagtggctctcagtgggaag

SEQ ID NO: 149340 - DNA, 20 bp, Artificial Sequence
  chemically synthesized
gtggctctcagtgggaaggg

SEQ ID NO: 149341 - DNA, 20 bp, Artificial Sequence
  chemically synthesized
cagtgggaaggggagctgaa

SEQ ID NO: 149342 - DNA, 20 bp, Artificial Sequence
  chemically synthesized
agtgggaaggggagctgaaa

SEQ ID NO: 149343 - DNA, 20 bp, Artificial Sequence
  chemically synthesized
gtgggaaggggagctgaaaa

SEQ ID NO: 149344 - DNA, 20 bp, Artificial Sequence
  chemically synthesized
tgggaaggggagctgaaaag

SEQ ID NO: 149345 - DNA, 20 bp, Artificial Sequence
  chemically synthesized
tgccacccccatcccctttt

SEQ ID NO: 149346 - DNA, 20 bp, Artificial Sequence
  chemically synthesized
aaggggagctgaaaagggga

SEQ ID NO: 149347 - DNA, 20 bp, Artificial Sequence
  chemically synthesized
aggggagctgaaaaggggat

SEQ ID NO: 149348 - DNA, 20 bp, Artificial Sequence
  chemically synthesized
ggggagctgaaaaggggatg

SEQ ID NO: 149349 - DNA, 20 bp, Artificial Sequence
  chemically synthesized
gggagctgaaaaggggatgg

SEQ ID NO: 149350 - DNA, 20 bp, Artificial Sequence
  chemically synthesized
agctgaaaaggggatggggg

SEQ ID NO: 149351 - DNA, 20 bp, Artificial Sequence
  chemically synthesized
gaaaaggggatgggggtggc

SEQ ID NO: 149352 - DNA, 20 bp, Artificial Sequence
  chemically synthesized
tggcaagtaatcttcccctg

SEQ ID NO: 149353 - DNA, 20 bp, Artificial Sequence
  chemically synthesized
atccggctggacttcagggg

SEQ ID NO: 149354 - DNA, 20 bp, Artificial Sequence
  chemically synthesized
agaatccggctggacttcag

SEQ ID NO: 149355 - DNA, 20 bp, Artificial Sequence
  chemically synthesized
agtaatcttcccctgaagtc

SEQ ID NO: 149356 - DNA, 20 bp, Artificial Sequence
  chemically synthesized
aagaatccggctggacttca

SEQ ID NO: 149357 - DNA, 20 bp, Artificial Sequence
  chemically synthesized
gaagaatccggctggacttc

SEQ ID NO: 149358 - DNA, 20 bp, Artificial Sequence
  chemically synthesized
agaagaatccggctggactt

SEQ ID NO: 149359 - DNA, 20 bp, Artificial Sequence
  chemically synthesized
atcttcccctgaagtccagc

SEQ ID NO: 149360 - DNA, 20 bp, Artificial Sequence
  chemically synthesized
actttagagaagaatccggc

SEQ ID NO: 149361 - DNA, 20 bp, Artificial Sequence
  chemically synthesized
cataactttagagaagaatc

SEQ ID NO: 149362 - DNA, 20 bp, Artificial Sequence
  chemically synthesized
tccagccggattcttctcta

SEQ ID NO: 149363 - DNA, 20 bp, Artificial Sequence
  chemically synthesized
ttgatggcataactttagag

SEQ ID NO: 149364 - DNA, 20 bp, Artificial Sequence
  chemically synthesized
aacttgatggcataacttta

SEQ ID NO: 149365 - DNA, 20 bp, Artificial Sequence
  chemically synthesized
acaacttgatggcataactt

SEQ ID NO: 149366 - DNA, 20 bp, Artificial Sequence
  chemically synthesized
ttctctaaagttatgccatc

SEQ ID NO: 149367 - DNA, 20 bp, Artificial Sequence
  chemically synthesized
acttcagagggacaacttga

SEQ ID NO: 149368 - DNA, 20 bp, Artificial Sequence
  chemically synthesized
gccatcaagttgtccctctg

SEQ ID NO: 149369 - DNA, 20 bp, Artificial Sequence
  chemically synthesized
agaagcagcttgacttcaga

SEQ ID NO: 149370 - DNA, 20 bp, Artificial Sequence
  chemically synthesized
gagaagcagcttgacttcag

SEQ ID NO: 149371 - DNA, 20 bp, Artificial Sequence
  chemically synthesized
caagttgtccctctgaagtc

SEQ ID NO: 149372 - DNA, 20 bp, Artificial Sequence
  chemically synthesized
agagaagcagcttgacttca

SEQ ID NO: 149373 - DNA, 20 bp, Artificial Sequence
  chemically synthesized
agagagaagcagcttgactt

SEQ ID NO: 149374 - DNA, 20 bp, Artificial Sequence
  chemically synthesized
agctggacatcagagagaag

SEQ ID NO: 149375 - DNA, 20 bp, Artificial Sequence
  chemically synthesized
tacagctggacatcagagag

SEQ ID NO: 149376 - DNA, 20 bp, Artificial Sequence
  chemically synthesized
gactacagctggacatcaga

SEQ ID NO: 149377 - DNA, 20 bp, Artificial Sequence
  chemically synthesized
agctgcttctctctgatgtc

SEQ ID NO: 149378 - DNA, 20 bp, Artificial Sequence
  chemically synthesized
aggactacagctggacatca

SEQ ID NO: 149379 - DNA, 20 bp, Artificial Sequence
  chemically synthesized
acaggactacagctggacat

SEQ ID NO: 149380 - DNA, 20 bp, Artificial Sequence
  chemically synthesized
ttctctctgatgtccagctg

SEQ ID NO: 149381 - DNA, 20 bp, Artificial Sequence
  chemically synthesized
ctggtagacaggactacagc

SEQ ID NO: 149382 - DNA, 20 bp, Artificial Sequence
  chemically synthesized
tcagctggtagacaggacta

SEQ ID NO: 149383 - DNA, 20 bp, Artificial Sequence
  chemically synthesized
ccagctgtagtcctgtctac

SEQ ID NO: 149384 - DNA, 20 bp, Artificial Sequence
  chemically synthesized
cccagactcagctggtagac

SEQ ID NO: 149385 - DNA, 20 bp, Artificial Sequence
  chemically synthesized
ccccagactcagctggtaga

SEQ ID NO: 149386 - DNA, 20 bp, Artificial Sequence
  chemically synthesized
tgtagtcctgtctaccagct

SEQ ID NO: 149387 - DNA, 20 bp, Artificial Sequence
  chemically synthesized
aaaaccccagactcagctgg

SEQ ID NO: 149388 - DNA, 20 bp, Artificial Sequence
  chemically synthesized
ataaaaaccccagactcagc

SEQ ID NO: 149389 - DNA, 20 bp, Artificial Sequence
  chemically synthesized
tcctgtctaccagctgagtc

SEQ ID NO: 149390 - DNA, 20 bp, Artificial Sequence
  chemically synthesized
cctgtctaccagctgagtct

SEQ ID NO: 149391 - DNA, 20 bp, Artificial Sequence
  chemically synthesized
ctgtctaccagctgagtctg

SEQ ID NO: 149392 - DNA, 20 bp, Artificial Sequence
  chemically synthesized
gcctataaaaaccccagact

SEQ ID NO: 149393 - DNA, 20 bp, Artificial Sequence
  chemically synthesized
tcctgtgcctataaaaaccc

SEQ ID NO: 149394 - DNA, 20 bp, Artificial Sequence
  chemically synthesized
agctgagtctggggttttta

SEQ ID NO: 149395 - DNA, 20 bp, Artificial Sequence
  chemically synthesized
gctgagtctggggtttttat

SEQ ID NO: 149396 - DNA, 20 bp, Artificial Sequence
  chemically synthesized
gtctggggtttttataggca

SEQ ID NO: 149397 - DNA, 20 bp, Artificial Sequence
  chemically synthesized
tctggggtttttataggcac

SEQ ID NO: 149398 - DNA, 20 bp, Artificial Sequence
  chemically synthesized
gggtttttataggcacagga

SEQ ID NO: 149399 - DNA, 20 bp, Artificial Sequence
  chemically synthesized
ggtttttataggcacaggat

SEQ ID NO: 149400 - DNA, 20 bp, Artificial Sequence
  chemically synthesized
gtttttataggcacaggatg

SEQ ID NO: 149401 - DNA, 20 bp, Artificial Sequence
  chemically synthesized
tttataggcacaggatgggg

SEQ ID NO: 149402 - DNA, 20 bp, Artificial Sequence
  chemically synthesized
ttataggcacaggatggggt

SEQ ID NO: 149403 - DNA, 20 bp, Artificial Sequence
  chemically synthesized
tataggcacaggatggggtg

SEQ ID NO: 149404 - DNA, 20 bp, Artificial Sequence
  chemically synthesized
aggcacaggatggggtgggg

SEQ ID NO: 149405 - DNA, 20 bp, Artificial Sequence
  chemically synthesized
ggcacaggatggggtggggt

SEQ ID NO: 149406 - DNA, 20 bp, Artificial Sequence
  chemically synthesized
gcacaggatggggtggggtg

SEQ ID NO: 149407 - DNA, 20 bp, Artificial Sequence
  chemically synthesized
gatggggtggggtggggcca

SEQ ID NO: 149408 - DNA, 20 bp, Artificial Sequence
  chemically synthesized
atggggtggggtggggccat

SEQ ID NO: 149409 - DNA, 20 bp, Artificial Sequence
  chemically synthesized
gggtggggtggggccatggg

SEQ ID NO: 149410 - DNA, 20 bp, Artificial Sequence
  chemically synthesized
gcctttttctaaaccaccca

SEQ ID NO: 149411 - DNA, 20 bp, Artificial Sequence
  chemically synthesized
gggtggggccatgggtggtt

SEQ ID NO: 149412 - DNA, 20 bp, Artificial Sequence
  chemically synthesized
ggccatgggtggtttagaaa

SEQ ID NO: 149413 - DNA, 20 bp, Artificial Sequence
  chemically synthesized
gccatgggtggtttagaaaa

SEQ ID NO: 149414 - DNA, 20 bp, Artificial Sequence
  chemically synthesized
tttagaaaaaggcaacattc

SEQ ID NO: 149415 - DNA, 20 bp, Artificial Sequence
  chemically synthesized
agaaaaaggcaacattcgag

SEQ ID NO: 149416 - DNA, 20 bp, Artificial Sequence
  chemically synthesized
gaaaaaggcaacattcgagc

SEQ ID NO: 149417 - DNA, 20 bp, Artificial Sequence
  chemically synthesized
caacattcgagcaggaaaac

SEQ ID NO: 149418 - DNA, 20 bp, Artificial Sequence
  chemically synthesized
aacattcgagcaggaaaact

SEQ ID NO: 149419 - DNA, 20 bp, Artificial Sequence
  chemically synthesized
gagcaggaaaactgggatat

SEQ ID NO: 149420 - DNA, 20 bp, Artificial Sequence
  chemically synthesized
caaagtgggaacttatatcc

SEQ ID NO: 149421 - DNA, 20 bp, Artificial Sequence
  chemically synthesized
gggatataagttcccacttt

SEQ ID NO: 149422 - DNA, 20 bp, Artificial Sequence
  chemically synthesized
ctgaaaccgcagctcaaagt

SEQ ID NO: 149423 - DNA, 20 bp, Artificial Sequence
  chemically synthesized
cctgaaaccgcagctcaaag

SEQ ID NO: 149424 - DNA, 20 bp, Artificial Sequence
  chemically synthesized
taagttcccactttgagctg

SEQ ID NO: 149425 - DNA, 20 bp, Artificial Sequence
  chemically synthesized
aagcctgaaaccgcagctca

SEQ ID NO: 149426 - DNA, 20 bp, Artificial Sequence
  chemically synthesized
cccactttgagctgcggttt

SEQ ID NO: 149427 - DNA, 20 bp, Artificial Sequence
  chemically synthesized
ccactttgagctgcggtttc

SEQ ID NO: 149428 - DNA, 20 bp, Artificial Sequence
  chemically synthesized
agccaaaaagcctgaaaccg

SEQ ID NO: 149429 - DNA, 20 bp, Artificial Sequence
  chemically synthesized
agctgcggtttcaggctttt

SEQ ID NO: 149430 - DNA, 20 bp, Artificial Sequence
  chemically synthesized
aaccccaccctcaagccaaa

SEQ ID NO: 149431 - DNA, 20 bp, Artificial Sequence
  chemically synthesized
ggtttcaggctttttggctt

SEQ ID NO: 149432 - DNA, 20 bp, Artificial Sequence
  chemically synthesized
gtttcaggctttttggcttg

SEQ ID NO: 149433 - DNA, 20 bp, Artificial Sequence
  chemically synthesized
tttcaggctttttggcttga

SEQ ID NO: 149434 - DNA, 20 bp, Artificial Sequence
  chemically synthesized
caggctttttggcttgaggg

SEQ ID NO: 149435 - DNA, 20 bp, Artificial Sequence
  chemically synthesized
aggctttttggcttgagggt

SEQ ID NO: 149436 - DNA, 20 bp, Artificial Sequence
  chemically synthesized
ggctttttggcttgagggtg

SEQ ID NO: 149437 - DNA, 20 bp, Artificial Sequence
  chemically synthesized
ccagcgaaaaccccaccctc

SEQ ID NO: 149438 - DNA, 20 bp, Artificial Sequence
  chemically synthesized
cttgagggtggggttttcgc

SEQ ID NO: 149439 - DNA, 20 bp, Artificial Sequence
  chemically synthesized
ttgagggtggggttttcgct

SEQ ID NO: 149440 - DNA, 20 bp, Artificial Sequence
  chemically synthesized
tgagggtggggttttcgctg

SEQ ID NO: 149441 - DNA, 20 bp, Artificial Sequence
  chemically synthesized
ggcagaaaagggatggtccc

SEQ ID NO: 149442 - DNA, 20 bp, Artificial Sequence
  chemically synthesized
agctctaggcagaaaaggga

SEQ ID NO: 149443 - DNA, 20 bp, Artificial Sequence
  chemically synthesized
gagaagctctaggcagaaaa

SEQ ID NO: 149444 - DNA, 20 bp, Artificial Sequence
  chemically synthesized
agagaagctctaggcagaaa

SEQ ID NO: 149445 - DNA, 20 bp, Artificial Sequence
  chemically synthesized
gggaccatcccttttctgcc

SEQ ID NO: 149446 - DNA, 20 bp, Artificial Sequence
  chemically synthesized
cagagaagctctaggcagaa

SEQ ID NO: 149447 - DNA, 20 bp, Artificial Sequence
  chemically synthesized
gaccatcccttttctgccta

SEQ ID NO: 149448 - DNA, 20 bp, Artificial Sequence
  chemically synthesized
ggaggcagagaagctctagg

SEQ ID NO: 149449 - DNA, 20 bp, Artificial Sequence
  chemically synthesized
gcaggaggcagagaagctct

SEQ ID NO: 149450 - DNA, 20 bp, Artificial Sequence
  chemically synthesized
ggcaggaggcagagaagctc

SEQ ID NO: 149451 - DNA, 20 bp, Artificial Sequence
  chemically synthesized
gatagcggcaggaggcagag

SEQ ID NO: 149452 - DNA, 20 bp, Artificial Sequence
  chemically synthesized
actgatagcggcaggaggca

SEQ ID NO: 149453 - DNA, 20 bp, Artificial Sequence
  chemically synthesized
gtactgatagcggcaggagg

SEQ ID NO: 149454 - DNA, 20 bp, Artificial Sequence
  chemically synthesized
ctcgtactgatagcggcagg

SEQ ID NO: 149455 - DNA, 20 bp, Artificial Sequence
  chemically synthesized
tctcgtactgatagcggcag

SEQ ID NO: 149456 - DNA, 20 bp, Artificial Sequence
  chemically synthesized
actctcgtactgatagcggc

SEQ ID NO: 149457 - DNA, 20 bp, Artificial Sequence
  chemically synthesized
tctctgcctcctgccgctat

SEQ ID NO: 149458 - DNA, 20 bp, Artificial Sequence
  chemically synthesized
aactctcgtactgatagcgg

SEQ ID NO: 149459 - DNA, 20 bp, Artificial Sequence
  chemically synthesized
cacaactctcgtactgatag

SEQ ID NO: 149460 - DNA, 20 bp, Artificial Sequence
  chemically synthesized
cctcctgccgctatcagtac

SEQ ID NO: 149461 - DNA, 20 bp, Artificial Sequence
  chemically synthesized
ttacacaactctcgtactga

SEQ ID NO: 149462 - DNA, 20 bp, Artificial Sequence
  chemically synthesized
tcctgccgctatcagtacga

SEQ ID NO: 149463 - DNA, 20 bp, Artificial Sequence
  chemically synthesized
aggagcacctgtatcaatat

SEQ ID NO: 149464 - DNA, 20 bp, Artificial Sequence
  chemically synthesized
gaggagcacctgtatcaata

SEQ ID NO: 149465 - DNA, 20 bp, Artificial Sequence
  chemically synthesized
tgtaaatgcctatattgata

SEQ ID NO: 149466 - DNA, 20 bp, Artificial Sequence
  chemically synthesized
gtaaatgcctatattgatac

SEQ ID NO: 149467 - DNA, 20 bp, Artificial Sequence
  chemically synthesized
taatcccattgtacgttgag

SEQ ID NO: 149468 - DNA, 20 bp, Artificial Sequence
  chemically synthesized
aataatcccattgtacgttg

SEQ ID NO: 149469 - DNA, 20 bp, Artificial Sequence
  chemically synthesized
aaataatcccattgtacgtt

SEQ ID NO: 149470 - DNA, 20 bp, Artificial Sequence
  chemically synthesized
aggtgctcctcaacgtacaa

SEQ ID NO: 149471 - DNA, 20 bp, Artificial Sequence
  chemically synthesized
ggtgctcctcaacgtacaat

SEQ ID NO: 149472 - DNA, 20 bp, Artificial Sequence
  chemically synthesized
caacgtatgatgggtttatc

SEQ ID NO: 149473 - DNA, 20 bp, Artificial Sequence
  chemically synthesized
tcaacgtatgatgggtttat

SEQ ID NO: 149474 - DNA, 20 bp, Artificial Sequence
  chemically synthesized
tgatgttttcaacgtatgat

SEQ ID NO: 149475 - DNA, 20 bp, Artificial Sequence
  chemically synthesized
atgatgttttcaacgtatga

SEQ ID NO: 149476 - DNA, 20 bp, Artificial Sequence
  chemically synthesized
taaattgaaaaacccatcat

SEQ ID NO: 149477 - DNA, 20 bp, Artificial Sequence
  chemically synthesized
tgatgttttcaacttatgat

SEQ ID NO: 149478 - DNA, 20 bp, Artificial Sequence
  chemically synthesized
atgatgttttcaacttatga

SEQ ID NO: 149479 - DNA, 20 bp, Artificial Sequence
  chemically synthesized
gcaatgatgttcagtaggtt

SEQ ID NO: 149480 - DNA, 20 bp, Artificial Sequence
  chemically synthesized
agcaatgatgttcagtaggt

SEQ ID NO: 149481 - DNA, 20 bp, Artificial Sequence
  chemically synthesized
gctaagcaatgatgttcagt

SEQ ID NO: 149482 - DNA, 20 bp, Artificial Sequence
  chemically synthesized
ggctaagcaatgatgttcag

SEQ ID NO: 149483 - DNA, 20 bp, Artificial Sequence
  chemically synthesized
ctaggctaagcaatgatgtt

SEQ ID NO: 149484 - DNA, 20 bp, Artificial Sequence
  chemically synthesized
acctactgaacatcattgct

SEQ ID NO: 149485 - DNA, 20 bp, Artificial Sequence
  chemically synthesized
ctgaacatcattgcttagcc

SEQ ID NO: 149486 - DNA, 20 bp, Artificial Sequence
  chemically synthesized
tgttgaaggtaggctaggct

SEQ ID NO: 149487 - DNA, 20 bp, Artificial Sequence
  chemically synthesized
gaccatgttgaaggtaggct

SEQ ID NO: 149488 - DNA, 20 bp, Artificial Sequence
  chemically synthesized
tgaccatgttgaaggtaggc

SEQ ID NO: 149489 - DNA, 20 bp, Artificial Sequence
  chemically synthesized
gttctgaccatgttgaaggt

SEQ ID NO: 149490 - DNA, 20 bp, Artificial Sequence
  chemically synthesized
tgttctgaccatgttgaagg

SEQ ID NO: 149491 - DNA, 20 bp, Artificial Sequence
  chemically synthesized
agcctagcctaccttcaaca

SEQ ID NO: 149492 - DNA, 20 bp, Artificial Sequence
  chemically synthesized
aagtgttctgaccatgttga

SEQ ID NO: 149493 - DNA, 20 bp, Artificial Sequence
  chemically synthesized
taagtgttctgaccatgttg

SEQ ID NO: 149494 - DNA, 20 bp, Artificial Sequence
  chemically synthesized
tagcctaccttcaacatggt

SEQ ID NO: 149495 - DNA, 20 bp, Artificial Sequence
  chemically synthesized
catggtcagaacacttacat

SEQ ID NO: 149496 - DNA, 20 bp, Artificial Sequence
  chemically synthesized
gcccaactgtaggctaatgt

SEQ ID NO: 149497 - DNA, 20 bp, Artificial Sequence
  chemically synthesized
agaacacttacattagccta

SEQ ID NO: 149498 - DNA, 20 bp, Artificial Sequence
  chemically synthesized
cacttacattagcctacagt

SEQ ID NO: 149499 - DNA, 20 bp, Artificial Sequence
  chemically synthesized
acttacattagcctacagtt

SEQ ID NO: 149500 - DNA, 20 bp, Artificial Sequence
  chemically synthesized
agatgattttgcccaactgt

SEQ ID NO: 149501 - DNA, 20 bp, Artificial Sequence
  chemically synthesized
tagatgattttgcccaactg

SEQ ID NO: 149502 - DNA, 20 bp, Artificial Sequence
  chemically synthesized
gggcaaaatcatctaacaca

SEQ ID NO: 149503 - DNA, 20 bp, Artificial Sequence
  chemically synthesized
taataaaataggctttgtgt

SEQ ID NO: 149504 - DNA, 20 bp, Artificial Sequence
  chemically synthesized
ttcaacacctttaataaaat

SEQ ID NO: 149505 - DNA, 20 bp, Artificial Sequence
  chemically synthesized
gttcaacacctttaataaaa

SEQ ID NO: 149506 - DNA, 20 bp, Artificial Sequence
  chemically synthesized
acacaaagcctattttatta

SEQ ID NO: 149507 - DNA, 20 bp, Artificial Sequence
  chemically synthesized
cacaaagcctattttattaa

SEQ ID NO: 149508 - DNA, 20 bp, Artificial Sequence
  chemically synthesized
cagtattcaataaattacat

SEQ ID NO: 149509 - DNA, 20 bp, Artificial Sequence
  chemically synthesized
tctgcttttcatgttcaata

SEQ ID NO: 149510 - DNA, 20 bp, Artificial Sequence
  chemically synthesized
aatactgtattgaacatgaa

SEQ ID NO: 149511 - DNA, 20 bp, Artificial Sequence
  chemically synthesized
actgtattgaacatgaaaag

SEQ ID NO: 149512 - DNA, 20 bp, Artificial Sequence
  chemically synthesized
attgaacatgaaaagcagaa

SEQ ID NO: 149513 - DNA, 20 bp, Artificial Sequence
  chemically synthesized
gaaaagcagaacagttgtat

SEQ ID NO: 149514 - DNA, 20 bp, Artificial Sequence
  chemically synthesized
aacagttgtatgagtacttg

SEQ ID NO: 149515 - DNA, 20 bp, Artificial Sequence
  chemically synthesized
ctcagtagaaatcatacttc

SEQ ID NO: 149516 - DNA, 20 bp, Artificial Sequence
  chemically synthesized
cttgaagtatgatttctact

SEQ ID NO: 149517 - DNA, 20 bp, Artificial Sequence
  chemically synthesized
tgaaagtaatatgcactcag

SEQ ID NO: 149518 - DNA, 20 bp, Artificial Sequence
  chemically synthesized
gtgtgaaagtaatatgcact

SEQ ID NO: 149519 - DNA, 20 bp, Artificial Sequence
  chemically synthesized
tttattttacaatggtgtga

SEQ ID NO: 149520 - DNA, 20 bp, Artificial Sequence
  chemically synthesized
aggatatttttattttacaa

SEQ ID NO: 149521 - DNA, 20 bp, Artificial Sequence
  chemically synthesized
ttgtaaaataaaaatatcct

SEQ ID NO: 149522 - DNA, 20 bp, Artificial Sequence
  chemically synthesized
gatttacaatggttcggctt

SEQ ID NO: 149523 - DNA, 20 bp, Artificial Sequence
  chemically synthesized
tgatttacaatggttcggct

SEQ ID NO: 149524 - DNA, 20 bp, Artificial Sequence
  chemically synthesized
tgttttgatttacaatggtt

SEQ ID NO: 149525 - DNA, 20 bp, Artificial Sequence
  chemically synthesized
aaaaatgttttgatttacaa

SEQ ID NO: 149526 - DNA, 20 bp, Artificial Sequence
  chemically synthesized
attgtaaatcaaaacatttt

SEQ ID NO: 149527 - DNA, 20 bp, Artificial Sequence
  chemically synthesized
aaatcaaaacatttttagat

SEQ ID NO: 149528 - DNA, 20 bp, Artificial Sequence
  chemically synthesized
aatcaaaacatttttagatt

SEQ ID NO: 149529 - DNA, 20 bp, Artificial Sequence
  chemically synthesized
gaaataaagaaatatacaga

SEQ ID NO: 149530 - DNA, 20 bp, Artificial Sequence
  chemically synthesized
agaaataaagaaatatacag

SEQ ID NO: 149531 - DNA, 20 bp, Artificial Sequence
  chemically synthesized
gagaaataaagaaatataca

SEQ ID NO: 149532 - DNA, 20 bp, Artificial Sequence
  chemically synthesized
ctgagaaataaagaaatata

SEQ ID NO: 149533 - DNA, 20 bp, Artificial Sequence
  chemically synthesized
ctgtatatttctttatttct

SEQ ID NO: 149534 - DNA, 20 bp, Artificial Sequence
  chemically synthesized
tgtcaagggcctgagaaata

SEQ ID NO: 149535 - DNA, 20 bp, Artificial Sequence
  chemically synthesized
tgtatatttctttatttctc

SEQ ID NO: 149536 - DNA, 20 bp, Artificial Sequence
  chemically synthesized
tctccttttgtcaagggcct

SEQ ID NO: 149537 - DNA, 20 bp, Artificial Sequence
  chemically synthesized
atttctcaggcccttgacaa

SEQ ID NO: 149538 - DNA, 20 bp, Artificial Sequence
  chemically synthesized
caattatctccttttgtcaa

SEQ ID NO: 149539 - DNA, 20 bp, Artificial Sequence
  chemically synthesized
tttctcaggcccttgacaaa

SEQ ID NO: 149540 - DNA, 20 bp, Artificial Sequence
  chemically synthesized
tcaattatctccttttgtca

SEQ ID NO: 149541 - DNA, 20 bp, Artificial Sequence
  chemically synthesized
ttcaattatctccttttgtc

SEQ ID NO: 149542 - DNA, 20 bp, Artificial Sequence
  chemically synthesized
tctcaggcccttgacaaaag

SEQ ID NO: 149543 - DNA, 20 bp, Artificial Sequence
  chemically synthesized
ttgacaaaaggagataattg

SEQ ID NO: 149544 - DNA, 20 bp, Artificial Sequence
  chemically synthesized
gttcactgtttaataaaaat

SEQ ID NO: 149545 - DNA, 20 bp, Artificial Sequence
  chemically synthesized
gcattcttatttttattaaa

SEQ ID NO: 149546 - DNA, 20 bp, Artificial Sequence
  chemically synthesized
agtgaacatatgtgctaaca

SEQ ID NO: 149547 - DNA, 20 bp, Artificial Sequence
  chemically synthesized
gtgaacatatgtgctaacaa

SEQ ID NO: 149548 - DNA, 20 bp, Artificial Sequence
  chemically synthesized
tgaatataattttcctttgt

SEQ ID NO: 149549 - DNA, 20 bp, Artificial Sequence
  chemically synthesized
taacaaaggaaaattatatt

SEQ ID NO: 149550 - DNA, 20 bp, Artificial Sequence
  chemically synthesized
acaaaggaaaattatattca

SEQ ID NO: 149551 - DNA, 20 bp, Artificial Sequence
  chemically synthesized
aaaattatattcagagaaat

SEQ ID NO: 149552 - DNA, 20 bp, Artificial Sequence
  chemically synthesized
ttcctgtgtaatacaagggc

SEQ ID NO: 149553 - DNA, 20 bp, Artificial Sequence
  chemically synthesized
gcacttcctgtgtaatacaa

SEQ ID NO: 149554 - DNA, 20 bp, Artificial Sequence
  chemically synthesized
agcacttcctgtgtaataca

SEQ ID NO: 149555 - DNA, 20 bp, Artificial Sequence
  chemically synthesized
tagcacttcctgtgtaatac

SEQ ID NO: 149556 - DNA, 20 bp, Artificial Sequence
  chemically synthesized
gcacttgcccttgtattaca

SEQ ID NO: 149557 - DNA, 20 bp, Artificial Sequence
  chemically synthesized
cacttgcccttgtattacac

SEQ ID NO: 149558 - DNA, 20 bp, Artificial Sequence
  chemically synthesized
ttgcccttgtattacacagg

SEQ ID NO: 149559 - DNA, 20 bp, Artificial Sequence
  chemically synthesized
tattacacaggaagtgctaa

SEQ ID NO: 149560 - DNA, 20 bp, Artificial Sequence
  chemically synthesized
actctaaagagtaaagcttt

SEQ ID NO: 149561 - DNA, 20 bp, Artificial Sequence
  chemically synthesized
gtgctaaaagctttactctt

SEQ ID NO: 149562 - DNA, 20 bp, Artificial Sequence
  chemically synthesized
gcatttaactctaaagagta

SEQ ID NO: 149563 - DNA, 20 bp, Artificial Sequence
  chemically synthesized
gctaaaagctttactcttta

SEQ ID NO: 149564 - DNA, 20 bp, Artificial Sequence
  chemically synthesized
tcttagcatttaactctaaa

SEQ ID NO: 149565 - DNA, 20 bp, Artificial Sequence
  chemically synthesized
tttcttagcatttaactcta

SEQ ID NO: 149566 - DNA, 20 bp, Artificial Sequence
  chemically synthesized
actctttagagttaaatgct

SEQ ID NO: 149567 - DNA, 20 bp, Artificial Sequence
  chemically synthesized
gagttaaatgctaagaaatt

SEQ ID NO: 149568 - DNA, 20 bp, Artificial Sequence
  chemically synthesized
ctataccaatctaaatttct

SEQ ID NO: 149569 - DNA, 20 bp, Artificial Sequence
  chemically synthesized
aaatgctaagaaatttagat

SEQ ID NO: 149570 - DNA, 20 bp, Artificial Sequence
  chemically synthesized
ctaagaaatttagattggta

SEQ ID NO: 149571 - DNA, 20 bp, Artificial Sequence
  chemically synthesized
taagaaatttagattggtat

SEQ ID NO: 149572 - DNA, 20 bp, Artificial Sequence
  chemically synthesized
gattggtataggttacatac

SEQ ID NO: 149573 - DNA, 20 bp, Artificial Sequence
  chemically synthesized
tttcaagatatagaattgtc

SEQ ID NO: 149574 - DNA, 20 bp, Artificial Sequence
  chemically synthesized
ttttcaagatatagaattgt

SEQ ID NO: 149575 - DNA, 20 bp, Artificial Sequence
  chemically synthesized
agattttttttttcaagata

SEQ ID NO: 149576 - DNA, 20 bp, Artificial Sequence
  chemically synthesized
aatgttagattttttttttc

SEQ ID NO: 149577 - DNA, 20 bp, Artificial Sequence
  chemically synthesized
agtctcagataatacaatgt

SEQ ID NO: 149578 - DNA, 20 bp, Artificial Sequence
  chemically synthesized
aatctaacattgtattatct

SEQ ID NO: 149579 - DNA, 20 bp, Artificial Sequence
  chemically synthesized
cattgtattatctgagacta

SEQ ID NO: 149580 - DNA, 20 bp, Artificial Sequence
  chemically synthesized
gtccaactgtgctgtagtct

SEQ ID NO: 149581 - DNA, 20 bp, Artificial Sequence
  chemically synthesized
tattatctgagactacagca

SEQ ID NO: 149582 - DNA, 20 bp, Artificial Sequence
  chemically synthesized
aaaccagtccaactgtgctg

SEQ ID NO: 149583 - DNA, 20 bp, Artificial Sequence
  chemically synthesized
atctgagactacagcacagt

SEQ ID NO: 149584 - DNA, 20 bp, Artificial Sequence
  chemically synthesized
agactacagcacagttggac

SEQ ID NO: 149585 - DNA, 20 bp, Artificial Sequence
  chemically synthesized
acagcacagttggactggtt

SEQ ID NO: 149586 - DNA, 20 bp, Artificial Sequence
  chemically synthesized
accctagttttagtctaaac

SEQ ID NO: 149587 - DNA, 20 bp, Artificial Sequence
  chemically synthesized
ggactggtttagactaaaac

SEQ ID NO: 149588 - DNA, 20 bp, Artificial Sequence
  chemically synthesized
gactggtttagactaaaact

SEQ ID NO: 149589 - DNA, 20 bp, Artificial Sequence
  chemically synthesized
actggtttagactaaaacta

SEQ ID NO: 149590 - DNA, 20 bp, Artificial Sequence
  chemically synthesized
cacttcccttaccctagttt

SEQ ID NO: 149591 - DNA, 20 bp, Artificial Sequence
  chemically synthesized
gtttagactaaaactagggt

SEQ ID NO: 149592 - DNA, 20 bp, Artificial Sequence
  chemically synthesized
tttagactaaaactagggta

SEQ ID NO: 149593 - DNA, 20 bp, Artificial Sequence
  chemically synthesized
ttagactaaaactagggtaa

SEQ ID NO: 149594 - DNA, 20 bp, Artificial Sequence
  chemically synthesized
taacaccacttcccttaccc

SEQ ID NO: 149595 - DNA, 20 bp, Artificial Sequence
  chemically synthesized
gactaaaactagggtaaggg

SEQ ID NO: 149596 - DNA, 20 bp, Artificial Sequence
  chemically synthesized
taaaactagggtaagggaag

SEQ ID NO: 149597 - DNA, 20 bp, Artificial Sequence
  chemically synthesized
agtggtgttaaaattgattg

SEQ ID NO: 149598 - DNA, 20 bp, Artificial Sequence
  chemically synthesized
ttaaaattgattgaagatta

SEQ ID NO: 149599 - DNA, 20 bp, Artificial Sequence
  chemically synthesized
atagtatacgtctaaaatct

SEQ ID NO: 149600 - DNA, 20 bp, Artificial Sequence
  chemically synthesized
tagtatacgtctaaaatctt

SEQ ID NO: 149601 - DNA, 20 bp, Artificial Sequence
  chemically synthesized
attaatgatgcccaagattt

SEQ ID NO: 149602 - DNA, 20 bp, Artificial Sequence
  chemically synthesized
gggctttattaatgatgccc

SEQ ID NO: 149603 - DNA, 20 bp, Artificial Sequence
  chemically synthesized
aatcttgggcatcattaata

SEQ ID NO: 149604 - DNA, 20 bp, Artificial Sequence
  chemically synthesized
gcaataagtccaagtagagt

SEQ ID NO: 149605 - DNA, 20 bp, Artificial Sequence
  chemically synthesized
ttaataaagcccactctact

SEQ ID NO: 149606 - DNA, 20 bp, Artificial Sequence
  chemically synthesized
agcaataagtccaagtagag

SEQ ID NO: 149607 - DNA, 20 bp, Artificial Sequence
  chemically synthesized
tagagcaataagtccaagta

SEQ ID NO: 149608 - DNA, 20 bp, Artificial Sequence
  chemically synthesized
aatagagcaataagtccaag

SEQ ID NO: 149609 - DNA, 20 bp, Artificial Sequence
  chemically synthesized
atgaatagagcaataagtcc

SEQ ID NO: 149610 - DNA, 20 bp, Artificial Sequence
  chemically synthesized
aaggatatgaatagagcaat

SEQ ID NO: 149611 - DNA, 20 bp, Artificial Sequence
  chemically synthesized
tttcagaaaggatatgaata

SEQ ID NO: 149612 - DNA, 20 bp, Artificial Sequence
  chemically synthesized
tctttcagaaaggatatgaa

SEQ ID NO: 149613 - DNA, 20 bp, Artificial Sequence
  chemically synthesized
tctattcatatcctttctga

SEQ ID NO: 149614 - DNA, 20 bp, Artificial Sequence
  chemically synthesized
aggtagtttatctttcagaa

SEQ ID NO: 149615 - DNA, 20 bp, Artificial Sequence
  chemically synthesized
gaggtagtttatctttcaga

SEQ ID NO: 149616 - DNA, 20 bp, Artificial Sequence
  chemically synthesized
ttttgaggtagtttatcttt

SEQ ID NO: 149617 - DNA, 20 bp, Artificial Sequence
  chemically synthesized
ttgggtcctgaattttgagg

SEQ ID NO: 149618 - DNA, 20 bp, Artificial Sequence
  chemically synthesized
agataaactacctcaaaatt

SEQ ID NO: 149619 - DNA, 20 bp, Artificial Sequence
  chemically synthesized
ctattgggtcctgaattttg

SEQ ID NO: 149620 - DNA, 20 bp, Artificial Sequence
  chemically synthesized
gataaactacctcaaaattc

SEQ ID NO: 149621 - DNA, 20 bp, Artificial Sequence
  chemically synthesized
actattgggtcctgaatttt

SEQ ID NO: 149622 - DNA, 20 bp, Artificial Sequence
  chemically synthesized
cctcaaaattcaggacccaa

SEQ ID NO: 149623 - DNA, 20 bp, Artificial Sequence
  chemically synthesized
aataatagtatattactatt

SEQ ID NO: 149624 - DNA, 20 bp, Artificial Sequence
  chemically synthesized
caataatagtatattactat

SEQ ID NO: 149625 - DNA, 20 bp, Artificial Sequence
  chemically synthesized
atagtaatatactattattg

SEQ ID NO: 149626 - DNA, 20 bp, Artificial Sequence
  chemically synthesized
tcatggcatctccgcaataa

SEQ ID NO: 149627 - DNA, 20 bp, Artificial Sequence
  chemically synthesized
agtaatatactattattgcg

SEQ ID NO: 149628 - DNA, 20 bp, Artificial Sequence
  chemically synthesized
acagccccaggaatgtttca

SEQ ID NO: 149629 - DNA, 20 bp, Artificial Sequence
  chemically synthesized
gagatgccatgaaacattcc

SEQ ID NO: 149630 - DNA, 20 bp, Artificial Sequence
  chemically synthesized
agatgccatgaaacattcct

SEQ ID NO: 149631 - DNA, 20 bp, Artificial Sequence
  chemically synthesized
gatgccatgaaacattcctg

SEQ ID NO: 149632 - DNA, 20 bp, Artificial Sequence
  chemically synthesized
atcatcccgatcacagcccc

SEQ ID NO: 149633 - DNA, 20 bp, Artificial Sequence
  chemically synthesized
aatcatcccgatcacagccc

SEQ ID NO: 149634 - DNA, 20 bp, Artificial Sequence
  chemically synthesized
aacattcctggggctgtgat

SEQ ID NO: 149635 - DNA, 20 bp, Artificial Sequence
  chemically synthesized
acattcctggggctgtgatc

SEQ ID NO: 149636 - DNA, 20 bp, Artificial Sequence
  chemically synthesized
cctctcaatcatcccgatca

SEQ ID NO: 149637 - DNA, 20 bp, Artificial Sequence
  chemically synthesized
gggctgtgatcgggatgatt

SEQ ID NO: 149638 - DNA, 20 bp, Artificial Sequence
  chemically synthesized
gctgtgatcgggatgattga

SEQ ID NO: 149639 - DNA, 20 bp, Artificial Sequence
  chemically synthesized
ctgtgatcgggatgattgag

SEQ ID NO: 149640 - DNA, 20 bp, Artificial Sequence
  chemically synthesized
gtgatcgggatgattgagag

SEQ ID NO: 149641 - DNA, 20 bp, Artificial Sequence
  chemically synthesized
cacatccacttttcagcatt

SEQ ID NO: 149642 - DNA, 20 bp, Artificial Sequence
  chemically synthesized
gaggagcgctaaatgctgaa

SEQ ID NO: 149643 - DNA, 20 bp, Artificial Sequence
  chemically synthesized
gagcgctaaatgctgaaaag

SEQ ID NO: 149644 - DNA, 20 bp, Artificial Sequence
  chemically synthesized
ccctggtcacatccactttt

SEQ ID NO: 149645 - DNA, 20 bp, Artificial Sequence
  chemically synthesized
tgctgaaaagtggatgtgac

SEQ ID NO: 149646 - DNA, 20 bp, Artificial Sequence
  chemically synthesized
gctgaaaagtggatgtgacc

SEQ ID NO: 149647 - DNA, 20 bp, Artificial Sequence
  chemically synthesized
ctgaaaagtggatgtgacca

SEQ ID NO: 149648 - DNA, 20 bp, Artificial Sequence
  chemically synthesized
aagtggatgtgaccagggaa

SEQ ID NO: 149649 - DNA, 20 bp, Artificial Sequence
  chemically synthesized
caaacagctaagccattccc

SEQ ID NO: 149650 - DNA, 20 bp, Artificial Sequence
  chemically synthesized
gatgtgaccagggaatggct

SEQ ID NO: 149651 - DNA, 20 bp, Artificial Sequence
  chemically synthesized
ttttacactggcaaacagct

SEQ ID NO: 149652 - DNA, 20 bp, Artificial Sequence
  chemically synthesized
ggaatggcttagctgtttgc

SEQ ID NO: 149653 - DNA, 20 bp, Artificial Sequence
  chemically synthesized
ttattttttacactggcaaa

SEQ ID NO: 149654 - DNA, 20 bp, Artificial Sequence
  chemically synthesized
tatcaagttattttttacac

SEQ ID NO: 149655 - DNA, 20 bp, Artificial Sequence
  chemically synthesized
tgctgcttaatgttgatatc

SEQ ID NO: 149656 - DNA, 20 bp, Artificial Sequence
  chemically synthesized
aataacttgatatcaacatt

SEQ ID NO: 149657 - DNA, 20 bp, Artificial Sequence
  chemically synthesized
aacttgatatcaacattaag

SEQ ID NO: 149658 - DNA, 20 bp, Artificial Sequence
  chemically synthesized
ttgatatcaacattaagcag

SEQ ID NO: 149659 - DNA, 20 bp, Artificial Sequence
  chemically synthesized
tcaacattaagcagcagctg

SEQ ID NO: 149660 - DNA, 20 bp, Artificial Sequence
  chemically synthesized
taaactattaaaagattctt

SEQ ID NO: 149661 - DNA, 20 bp, Artificial Sequence
  chemically synthesized
gcagctgaagaatcttttaa

SEQ ID NO: 149662 - DNA, 20 bp, Artificial Sequence
  chemically synthesized
aaaagtgcctaaactattaa

SEQ ID NO: 149663 - DNA, 20 bp, Artificial Sequence
  chemically synthesized
tgaagaatcttttaatagtt

SEQ ID NO: 149664 - DNA, 20 bp, Artificial Sequence
  chemically synthesized
gaagaatcttttaatagttt

SEQ ID NO: 149665 - DNA, 20 bp, Artificial Sequence
  chemically synthesized
ataactgaaggatttagaaa

SEQ ID NO: 149666 - DNA, 20 bp, Artificial Sequence
  chemically synthesized
ggcactttttctaaatcctt

SEQ ID NO: 149667 - DNA, 20 bp, Artificial Sequence
  chemically synthesized
tgaagcataactgaaggatt

SEQ ID NO: 149668 - DNA, 20 bp, Artificial Sequence
  chemically synthesized
aatcggtgaagcataactga

SEQ ID NO: 149669 - DNA, 20 bp, Artificial Sequence
  chemically synthesized
taatcggtgaagcataactg

SEQ ID NO: 149670 - DNA, 20 bp, Artificial Sequence
  chemically synthesized
tcttaataatttaatcggtg

SEQ ID NO: 149671 - DNA, 20 bp, Artificial Sequence
  chemically synthesized
gaggttcttaataatttaat

SEQ ID NO: 149672 - DNA, 20 bp, Artificial Sequence
  chemically synthesized
gcttcaccgattaaattatt

SEQ ID NO: 149673 - DNA, 20 bp, Artificial Sequence
  chemically synthesized
attattaagaacctctgatc

SEQ ID NO: 149674 - DNA, 20 bp, Artificial Sequence
  chemically synthesized
atatgaaatagctagatcag

SEQ ID NO: 149675 - DNA, 20 bp, Artificial Sequence
  chemically synthesized
aatatgaaatagctagatca

SEQ ID NO: 149676 - DNA, 20 bp, Artificial Sequence
  chemically synthesized
aaaatatgaaatagctagat

SEQ ID NO: 149677 - DNA, 20 bp, Artificial Sequence
  chemically synthesized
catctaaaatatgaaatagc

SEQ ID NO: 149678 - DNA, 20 bp, Artificial Sequence
  chemically synthesized
ctcacatctaaaatatgaaa

SEQ ID NO: 149679 - DNA, 20 bp, Artificial Sequence
  chemically synthesized
gatctagctatttcatattt

SEQ ID NO: 149680 - DNA, 20 bp, Artificial Sequence
  chemically synthesized
ctatttcatattttagatgt

SEQ ID NO: 149681 - DNA, 20 bp, Artificial Sequence
  chemically synthesized
tcatattttagatgtgagtg

SEQ ID NO: 149682 - DNA, 20 bp, Artificial Sequence
  chemically synthesized
gaaatcattttcattgttca

SEQ ID NO: 149683 - DNA, 20 bp, Artificial Sequence
  chemically synthesized
taggtttaattttaaaaaac

SEQ ID NO: 149684 - DNA, 20 bp, Artificial Sequence
  chemically synthesized
ttgttttttaaaattaaacc

SEQ ID NO: 149685 - DNA, 20 bp, Artificial Sequence
  chemically synthesized
gttttttaaaattaaaccta

SEQ ID NO: 149686 - DNA, 20 bp, Artificial Sequence
  chemically synthesized
ttttttaaaattaaacctag

SEQ ID NO: 149687 - DNA, 20 bp, Artificial Sequence
  chemically synthesized
agattatctcagcgtcctct

SEQ ID NO: 149688 - DNA, 20 bp, Artificial Sequence
  chemically synthesized
gagattatctcagcgtcctc

SEQ ID NO: 149689 - DNA, 20 bp, Artificial Sequence
  chemically synthesized
aattaaacctagaggacgct

SEQ ID NO: 149690 - DNA, 20 bp, Artificial Sequence
  chemically synthesized
ctaataaaaagagattatct

SEQ ID NO: 149691 - DNA, 20 bp, Artificial Sequence
  chemically synthesized
ctgagataatctctttttat

SEQ ID NO: 149692 - DNA, 20 bp, Artificial Sequence
  chemically synthesized
ttctgcagacctaataaaaa

SEQ ID NO: 149693 - DNA, 20 bp, Artificial Sequence
  chemically synthesized
tgagataatctctttttatt

SEQ ID NO: 149694 - DNA, 20 bp, Artificial Sequence
  chemically synthesized
gtttctgcagacctaataaa

SEQ ID NO: 149695 - DNA, 20 bp, Artificial Sequence
  chemically synthesized
atctctttttattaggtctg

SEQ ID NO: 149696 - DNA, 20 bp, Artificial Sequence
  chemically synthesized
tggtgtattcttggtttctg

SEQ ID NO: 149697 - DNA, 20 bp, Artificial Sequence
  chemically synthesized
ttattaggtctgcagaaacc

SEQ ID NO: 149698 - DNA, 20 bp, Artificial Sequence
  chemically synthesized
ttcagcatttggtgtattct

SEQ ID NO: 149699 - DNA, 20 bp, Artificial Sequence
  chemically synthesized
ccatgcagctattcagcatt

SEQ ID NO: 149700 - DNA, 20 bp, Artificial Sequence
  chemically synthesized
agaatacaccaaatgctgaa

SEQ ID NO: 149701 - DNA, 20 bp, Artificial Sequence
  chemically synthesized
gatacttccatgcagctatt

SEQ ID NO: 149702 - DNA, 20 bp, Artificial Sequence
  chemically synthesized
ccaaatgctgaatagctgca

SEQ ID NO: 149703 - DNA, 20 bp, Artificial Sequence
  chemically synthesized
aatgctgaatagctgcatgg

SEQ ID NO: 149704 - DNA, 20 bp, Artificial Sequence
  chemically synthesized
aggcaagtgatacttccatg

SEQ ID NO: 149705 - DNA, 20 bp, Artificial Sequence
  chemically synthesized
taatacaatattgtcaaggc

SEQ ID NO: 149706 - DNA, 20 bp, Artificial Sequence
  chemically synthesized
atcataatacaatattgtca

SEQ ID NO: 149707 - DNA, 20 bp, Artificial Sequence
  chemically synthesized
tatcataatacaatattgtc

SEQ ID NO: 149708 - DNA, 20 bp, Artificial Sequence
  chemically synthesized
tgacaatattgtattatgat

SEQ ID NO: 149709 - DNA, 20 bp, Artificial Sequence
  chemically synthesized
aatattgtattatgataagc

SEQ ID NO: 149710 - DNA, 20 bp, Artificial Sequence
  chemically synthesized
aaaaaaaaaaaaagaggaac

SEQ ID NO: 149711 - DNA, 20 bp, Artificial Sequence
  chemically synthesized
aacttaaaaaaaaaaaaaag

SEQ ID NO: 149712 - DNA, 20 bp, Artificial Sequence
  chemically synthesized
caacttaaaaaaaaaaaaaa

SEQ ID NO: 149713 - DNA, 20 bp, Artificial Sequence
  chemically synthesized
ctcaacttaaaaaaaaaaaa

SEQ ID NO: 149714 - DNA, 20 bp, Artificial Sequence
  chemically synthesized
ttcctctttttttttttttt

SEQ ID NO: 149715 - DNA, 20 bp, Artificial Sequence
  chemically synthesized
cttttttttttttttaagtt

SEQ ID NO: 149716 - DNA, 20 bp, Artificial Sequence
  chemically synthesized
tttttttaagttgagctata

SEQ ID NO: 149717 - DNA, 20 bp, Artificial Sequence
  chemically synthesized
aacattaattggaatctata

SEQ ID NO: 149718 - DNA, 20 bp, Artificial Sequence
  chemically synthesized
attggtttaacaacattaat

SEQ ID NO: 149719 - DNA, 20 bp, Artificial Sequence
  chemically synthesized
ctggccattttttaaacaat

SEQ ID NO: 149720 - DNA, 20 bp, Artificial Sequence
  chemically synthesized
taaaccaattgtttaaaaaa

SEQ ID NO: 149721 - DNA, 20 bp, Artificial Sequence
  chemically synthesized
ccaattgtttaaaaaatggc

SEQ ID NO: 149722 - DNA, 20 bp, Artificial Sequence
  chemically synthesized
aattgtttaaaaaatggcca

SEQ ID NO: 149723 - DNA, 20 bp, Artificial Sequence
  chemically synthesized
attgtttaaaaaatggccag

SEQ ID NO: 149724 - DNA, 20 bp, Artificial Sequence
  chemically synthesized
taaaagccagtagaagcctc

SEQ ID NO: 149725 - DNA, 20 bp, Artificial Sequence
  chemically synthesized
aaatggccagaggcttctac

SEQ ID NO: 149726 - DNA, 20 bp, Artificial Sequence
  chemically synthesized
ctccatctaaaagccagtag

SEQ ID NO: 149727 - DNA, 20 bp, Artificial Sequence
  chemically synthesized
ggcctccatctaaaagccag

SEQ ID NO: 149728 - DNA, 20 bp, Artificial Sequence
  chemically synthesized
cagaggcttctactggcttt

SEQ ID NO: 149729 - DNA, 20 bp, Artificial Sequence
  chemically synthesized
cttggcctccatctaaaagc

SEQ ID NO: 149730 - DNA, 20 bp, Artificial Sequence
  chemically synthesized
ggcttctactggcttttaga

SEQ ID NO: 149731 - DNA, 20 bp, Artificial Sequence
  chemically synthesized
cttctactggcttttagatg

SEQ ID NO: 149732 - DNA, 20 bp, Artificial Sequence
  chemically synthesized
atatcttggcctccatctaa

SEQ ID NO: 149733 - DNA, 20 bp, Artificial Sequence
  chemically synthesized
ttctactggcttttagatgg

SEQ ID NO: 149734 - DNA, 20 bp, Artificial Sequence
  chemically synthesized
ctggcttttagatggaggcc

SEQ ID NO: 149735 - DNA, 20 bp, Artificial Sequence
  chemically synthesized
tctttgacgcaatcatatct

SEQ ID NO: 149736 - DNA, 20 bp, Artificial Sequence
  chemically synthesized
gccaagatatgattgcgtca

SEQ ID NO: 149737 - DNA, 20 bp, Artificial Sequence
  chemically synthesized
atatgattgcgtcaaagatc

SEQ ID NO: 149738 - DNA, 20 bp, Artificial Sequence
  chemically synthesized
attgcgtcaaagatcaagat

SEQ ID NO: 149739 - DNA, 20 bp, Artificial Sequence
  chemically synthesized
ttgcgtcaaagatcaagata

SEQ ID NO: 149740 - DNA, 20 bp, Artificial Sequence
  chemically synthesized
tcaaagatcaagataaggat

SEQ ID NO: 149741 - DNA, 20 bp, Artificial Sequence
  chemically synthesized
taaggatcagaaacgaaatt

SEQ ID NO: 149742 - DNA, 20 bp, Artificial Sequence
  chemically synthesized
aaggatcagaaacgaaattt

SEQ ID NO: 149743 - DNA, 20 bp, Artificial Sequence
  chemically synthesized
gatcagaaacgaaatttagg

SEQ ID NO: 149744 - DNA, 20 bp, Artificial Sequence
  chemically synthesized
tcagaaacgaaatttaggaa

SEQ ID NO: 149745 - DNA, 20 bp, Artificial Sequence
  chemically synthesized
atttagtcattcacattggg

SEQ ID NO: 149746 - DNA, 20 bp, Artificial Sequence
  chemically synthesized
aatttagtcattcacattgg

SEQ ID NO: 149747 - DNA, 20 bp, Artificial Sequence
  chemically synthesized
acaatttagtcattcacatt

SEQ ID NO: 149748 - DNA, 20 bp, Artificial Sequence
  chemically synthesized
tacaatttagtcattcacat

SEQ ID NO: 149749 - DNA, 20 bp, Artificial Sequence
  chemically synthesized
aaagttaatcatatacaatt

SEQ ID NO: 149750 - DNA, 20 bp, Artificial Sequence
  chemically synthesized
aacgagaagtatttttagaa

SEQ ID NO: 149751 - DNA, 20 bp, Artificial Sequence
  chemically synthesized
atgacaacgagaagtatttt

SEQ ID NO: 149752 - DNA, 20 bp, Artificial Sequence
  chemically synthesized
ataaactaaatgacaacgag

SEQ ID NO: 149753 - DNA, 20 bp, Artificial Sequence
  chemically synthesized
tttataaactaaatgacaac

SEQ ID NO: 149754 - DNA, 20 bp, Artificial Sequence
  chemically synthesized
aaatacttctcgttgtcatt

SEQ ID NO: 149755 - DNA, 20 bp, Artificial Sequence
  chemically synthesized
gttgtcatttagtttataaa

SEQ ID NO: 149756 - DNA, 20 bp, Artificial Sequence
  chemically synthesized
tttagtttataaatagcttg

SEQ ID NO: 149757 - DNA, 20 bp, Artificial Sequence
  chemically synthesized
aggaagacaatattatctgc

SEQ ID NO: 149758 - DNA, 20 bp, Artificial Sequence
  chemically synthesized
cagataatattgtcttccta

SEQ ID NO: 149759 - DNA, 20 bp, Artificial Sequence
  chemically synthesized
agataatattgtcttcctat

SEQ ID NO: 149760 - DNA, 20 bp, Artificial Sequence
  chemically synthesized
ttgttcaacgaacctatagg

SEQ ID NO: 149761 - DNA, 20 bp, Artificial Sequence
  chemically synthesized
tatttgttcaacgaacctat

SEQ ID NO: 149762 - DNA, 20 bp, Artificial Sequence
  chemically synthesized
atatttgttcaacgaaccta

SEQ ID NO: 149763 - DNA, 20 bp, Artificial Sequence
  chemically synthesized
ttcgttgaacaaatattaac

SEQ ID NO: 149764 - DNA, 20 bp, Artificial Sequence
  chemically synthesized
tcgttgaacaaatattaact

SEQ ID NO: 149765 - DNA, 20 bp, Artificial Sequence
  chemically synthesized
acactgggcccaaaggtacc

SEQ ID NO: 149766 - DNA, 20 bp, Artificial Sequence
  chemically synthesized
aaatattaactgggtacctt

SEQ ID NO: 149767 - DNA, 20 bp, Artificial Sequence
  chemically synthesized
aatattaactgggtaccttt

SEQ ID NO: 149768 - DNA, 20 bp, Artificial Sequence
  chemically synthesized
taactgggtacctttgggcc

SEQ ID NO: 149769 - DNA, 20 bp, Artificial Sequence
  chemically synthesized
tggggtgacactgggcccaa

SEQ ID NO: 149770 - DNA, 20 bp, Artificial Sequence
  chemically synthesized
ttggggtgacactgggccca

SEQ ID NO: 149771 - DNA, 20 bp, Artificial Sequence
  chemically synthesized
cactccattggggtgacact

SEQ ID NO: 149772 - DNA, 20 bp, Artificial Sequence
  chemically synthesized
tcactccattggggtgacac

SEQ ID NO: 149773 - DNA, 20 bp, Artificial Sequence
  chemically synthesized
tgggcccagtgtcaccccaa

SEQ ID NO: 149774 - DNA, 20 bp, Artificial Sequence
  chemically synthesized
ggcccagtgtcaccccaatg

SEQ ID NO: 149775 - DNA, 20 bp, Artificial Sequence
  chemically synthesized
caacaatattcactccattg

SEQ ID NO: 149776 - DNA, 20 bp, Artificial Sequence
  chemically synthesized
ccaacaatattcactccatt

SEQ ID NO: 149777 - DNA, 20 bp, Artificial Sequence
  chemically synthesized
accaacaatattcactccat

SEQ ID NO: 149778 - DNA, 20 bp, Artificial Sequence
  chemically synthesized
cccaatggagtgaatattgt

SEQ ID NO: 149779 - DNA, 20 bp, Artificial Sequence
  chemically synthesized
aatggagtgaatattgttgg

SEQ ID NO: 149780 - DNA, 20 bp, Artificial Sequence
  chemically synthesized
tctttgaatggaagttgttt

SEQ ID NO: 149781 - DNA, 20 bp, Artificial Sequence
  chemically synthesized
gcttaaacaacttccattca

SEQ ID NO: 149782 - DNA, 20 bp, Artificial Sequence
  chemically synthesized
gtagggatatctttgaatgg

SEQ ID NO: 149783 - DNA, 20 bp, Artificial Sequence
  chemically synthesized
ggtgtagggatatctttgaa

SEQ ID NO: 149784 - DNA, 20 bp, Artificial Sequence
  chemically synthesized
agaatttcagagtgggtgta

SEQ ID NO: 149785 - DNA, 20 bp, Artificial Sequence
  chemically synthesized
cagaatttcagagtgggtgt

SEQ ID NO: 149786 - DNA, 20 bp, Artificial Sequence
  chemically synthesized
gcagaatttcagagtgggtg

SEQ ID NO: 149787 - DNA, 20 bp, Artificial Sequence
  chemically synthesized
agaaagcagaatttcagagt

SEQ ID NO: 149788 - DNA, 20 bp, Artificial Sequence
  chemically synthesized
tagaaagcagaatttcagag

SEQ ID NO: 149789 - DNA, 20 bp, Artificial Sequence
  chemically synthesized
tcctagaaagcagaatttca

SEQ ID NO: 149790 - DNA, 20 bp, Artificial Sequence
  chemically synthesized
tctcctagaaagcagaattt

SEQ ID NO: 149791 - DNA, 20 bp, Artificial Sequence
  chemically synthesized
cactctgaaattctgctttc

SEQ ID NO: 149792 - DNA, 20 bp, Artificial Sequence
  chemically synthesized
actctgaaattctgctttct

SEQ ID NO: 149793 - DNA, 20 bp, Artificial Sequence
  chemically synthesized
attggaattctcctagaaag

SEQ ID NO: 149794 - DNA, 20 bp, Artificial Sequence
  chemically synthesized
tctgaaattctgctttctag

SEQ ID NO: 149795 - DNA, 20 bp, Artificial Sequence
  chemically synthesized
acaattggaattctcctaga

SEQ ID NO: 149796 - DNA, 20 bp, Artificial Sequence
  chemically synthesized
gaagacaattggaattctcc

SEQ ID NO: 149797 - DNA, 20 bp, Artificial Sequence
  chemically synthesized
cgtagaaacttgaagacaat

SEQ ID NO: 149798 - DNA, 20 bp, Artificial Sequence
  chemically synthesized
ggagaattccaattgtcttc

SEQ ID NO: 149799 - DNA, 20 bp, Artificial Sequence
  chemically synthesized
atggattccgtagaaacttg

SEQ ID NO: 149800 - DNA, 20 bp, Artificial Sequence
  chemically synthesized
caattgtcttcaagtttcta

SEQ ID NO: 149801 - DNA, 20 bp, Artificial Sequence
  chemically synthesized
agaactgaggatggattccg

SEQ ID NO: 149802 - DNA, 20 bp, Artificial Sequence
  chemically synthesized
gtttctacggaatccatcct

SEQ ID NO: 149803 - DNA, 20 bp, Artificial Sequence
  chemically synthesized
tccatctccagaactgagga

SEQ ID NO: 149804 - DNA, 20 bp, Artificial Sequence
  chemically synthesized
acggaatccatcctcagttc

SEQ ID NO: 149805 - DNA, 20 bp, Artificial Sequence
  chemically synthesized
taaatccatctccagaactg

SEQ ID NO: 149806 - DNA, 20 bp, Artificial Sequence
  chemically synthesized
ggaatccatcctcagttctg

SEQ ID NO: 149807 - DNA, 20 bp, Artificial Sequence
  chemically synthesized
ctaaatccatctccagaact

SEQ ID NO: 149808 - DNA, 20 bp, Artificial Sequence
  chemically synthesized
tccatcctcagttctggaga

SEQ ID NO: 149809 - DNA, 20 bp, Artificial Sequence
  chemically synthesized
ggtgaatctaaatccatctc

SEQ ID NO: 149810 - DNA, 20 bp, Artificial Sequence
  chemically synthesized
ctcagttctggagatggatt

SEQ ID NO: 149811 - DNA, 20 bp, Artificial Sequence
  chemically synthesized
tggcttagaatcgaagattt

SEQ ID NO: 149812 - DNA, 20 bp, Artificial Sequence
  chemically synthesized
ctggcttagaatcgaagatt

SEQ ID NO: 149813 - DNA, 20 bp, Artificial Sequence
  chemically synthesized
tcacctaaatcttcgattct

SEQ ID NO: 149814 - DNA, 20 bp, Artificial Sequence
  chemically synthesized
tcttgactggcttagaatcg

SEQ ID NO: 149815 - DNA, 20 bp, Artificial Sequence
  chemically synthesized
ctaaatcttcgattctaagc

SEQ ID NO: 149816 - DNA, 20 bp, Artificial Sequence
  chemically synthesized
tgagattatcttgactggct

SEQ ID NO: 149817 - DNA, 20 bp, Artificial Sequence
  chemically synthesized
tcttcgattctaagccagtc

SEQ ID NO: 149818 - DNA, 20 bp, Artificial Sequence
  chemically synthesized
gaggatgagattatcttgac

SEQ ID NO: 149819 - DNA, 20 bp, Artificial Sequence
  chemically synthesized
tcaagataatctcatcctct

SEQ ID NO: 149820 - DNA, 20 bp, Artificial Sequence
  chemically synthesized
tcttcctgaaccaagaggat

SEQ ID NO: 149821 - DNA, 20 bp, Artificial Sequence
  chemically synthesized
ataatctcatcctcttggtt

SEQ ID NO: 149822 - DNA, 20 bp, Artificial Sequence
  chemically synthesized
acttttcttcctgaaccaag

SEQ ID NO: 149823 - DNA, 20 bp, Artificial Sequence
  chemically synthesized
taatctcatcctcttggttc

SEQ ID NO: 149824 - DNA, 20 bp, Artificial Sequence
  chemically synthesized
aacttttcttcctgaaccaa

SEQ ID NO: 149825 - DNA, 20 bp, Artificial Sequence
  chemically synthesized
taaacttttcttcctgaacc

SEQ ID NO: 149826 - DNA, 20 bp, Artificial Sequence
  chemically synthesized
tctcatcctcttggttcagg

SEQ ID NO: 149827 - DNA, 20 bp, Artificial Sequence
  chemically synthesized
tcctcttggttcaggaagaa

SEQ ID NO: 149828 - DNA, 20 bp, Artificial Sequence
  chemically synthesized
gaagaaaagtttaaatcaac

SEQ ID NO: 149829 - DNA, 20 bp, Artificial Sequence
  chemically synthesized
ttcagaatggtttcataagc

SEQ ID NO: 149830 - DNA, 20 bp, Artificial Sequence
  chemically synthesized
atgattcagaatggtttcat

SEQ ID NO: 149831 - DNA, 20 bp, Artificial Sequence
  chemically synthesized
gtactaaagatgattcagaa

SEQ ID NO: 149832 - DNA, 20 bp, Artificial Sequence
  chemically synthesized
ctattgtactaaagatgatt

SEQ ID NO: 149833 - DNA, 20 bp, Artificial Sequence
  chemically synthesized
aaaccattctgaatcatctt

SEQ ID NO: 149834 - DNA, 20 bp, Artificial Sequence
  chemically synthesized
atatatctactattgtacta

SEQ ID NO: 149835 - DNA, 20 bp, Artificial Sequence
  chemically synthesized
ctgaatcatctttagtacaa

SEQ ID NO: 149836 - DNA, 20 bp, Artificial Sequence
  chemically synthesized
aatcatctttagtacaatag

SEQ ID NO: 149837 - DNA, 20 bp, Artificial Sequence
  chemically synthesized
gtatcattagtatatgtatt

SEQ ID NO: 149838 - DNA, 20 bp, Artificial Sequence
  chemically synthesized
tgtatcattagtatatgtat

SEQ ID NO: 149839 - DNA, 20 bp, Artificial Sequence
  chemically synthesized
taatacatatactaatgata

SEQ ID NO: 149840 - DNA, 20 bp, Artificial Sequence
  chemically synthesized
ttgtgtatctactgtatcat

SEQ ID NO: 149841 - DNA, 20 bp, Artificial Sequence
  chemically synthesized
tacatatactaatgatacag

SEQ ID NO: 149842 - DNA, 20 bp, Artificial Sequence
  chemically synthesized
aattttgattgttcttatct

SEQ ID NO: 149843 - DNA, 20 bp, Artificial Sequence
  chemically synthesized
attttgattgttcttatctg

SEQ ID NO: 149844 - DNA, 20 bp, Artificial Sequence
  chemically synthesized
ttttgattgttcttatctga

SEQ ID NO: 149845 - DNA, 20 bp, Artificial Sequence
  chemically synthesized
cagagatttcaccctcagat

SEQ ID NO: 149846 - DNA, 20 bp, Artificial Sequence
  chemically synthesized
agattcagagatttcaccct

SEQ ID NO: 149847 - DNA, 20 bp, Artificial Sequence
  chemically synthesized
acacttacctcacagattca

SEQ ID NO: 149848 - DNA, 20 bp, Artificial Sequence
  chemically synthesized
ggtgaaatctctgaatctgt

SEQ ID NO: 149849 - DNA, 20 bp, Artificial Sequence
  chemically synthesized
aaacacttacctcacagatt

SEQ ID NO: 149850 - DNA, 20 bp, Artificial Sequence
  chemically synthesized
gtgaaatctctgaatctgtg

SEQ ID NO: 149851 - DNA, 20 bp, Artificial Sequence
  chemically synthesized
aatctctgaatctgtgaggt

SEQ ID NO: 149852 - DNA, 20 bp, Artificial Sequence
  chemically synthesized
agacataaacacttacctca

SEQ ID NO: 149853 - DNA, 20 bp, Artificial Sequence
  chemically synthesized
ataatttcttgttacagtga

SEQ ID NO: 149854 - DNA, 20 bp, Artificial Sequence
  chemically synthesized
acataatttcttgttacagt

SEQ ID NO: 149855 - DNA, 20 bp, Artificial Sequence
  chemically synthesized
tttatgtctctcactgtaac

SEQ ID NO: 149856 - DNA, 20 bp, Artificial Sequence
  chemically synthesized
ggtaacataatttcttgtta

SEQ ID NO: 149857 - DNA, 20 bp, Artificial Sequence
  chemically synthesized
gatgactgccagcaacaaat

SEQ ID NO: 149858 - DNA, 20 bp, Artificial Sequence
  chemically synthesized
agatgactgccagcaacaaa

SEQ ID NO: 149859 - DNA, 20 bp, Artificial Sequence
  chemically synthesized
ttatgttacccatttgttgc

SEQ ID NO: 149860 - DNA, 20 bp, Artificial Sequence
  chemically synthesized
tgttacccatttgttgctgg

SEQ ID NO: 149861 - DNA, 20 bp, Artificial Sequence
  chemically synthesized
ccaggttccaagatgactgc

SEQ ID NO: 149862 - DNA, 20 bp, Artificial Sequence
  chemically synthesized
tttgttgctggcagtcatct

SEQ ID NO: 149863 - DNA, 20 bp, Artificial Sequence
  chemically synthesized
ctggcagtcatcttggaacc

SEQ ID NO: 149864 - DNA, 20 bp, Artificial Sequence
  chemically synthesized
ctagttgccctccaggttcc

SEQ ID NO: 149865 - DNA, 20 bp, Artificial Sequence
  chemically synthesized
ggcagtcatcttggaacctg

SEQ ID NO: 149866 - DNA, 20 bp, Artificial Sequence
  chemically synthesized
gcagtcatcttggaacctgg

SEQ ID NO: 149867 - DNA, 20 bp, Artificial Sequence
  chemically synthesized
cagtcatcttggaacctgga

SEQ ID NO: 149868 - DNA, 20 bp, Artificial Sequence
  chemically synthesized
ctcctcactagttgccctcc

SEQ ID NO: 149869 - DNA, 20 bp, Artificial Sequence
  chemically synthesized
cctcctcactagttgccctc

SEQ ID NO: 149870 - DNA, 20 bp, Artificial Sequence
  chemically synthesized
cttggaacctggagggcaac

SEQ ID NO: 149871 - DNA, 20 bp, Artificial Sequence
  chemically synthesized
gaacctggagggcaactagt

SEQ ID NO: 149872 - DNA, 20 bp, Artificial Sequence
  chemically synthesized
aacctggagggcaactagtg

SEQ ID NO: 149873 - DNA, 20 bp, Artificial Sequence
  chemically synthesized
cctggagggcaactagtgag

SEQ ID NO: 149874 - DNA, 20 bp, Artificial Sequence
  chemically synthesized
ctggagggcaactagtgagg

SEQ ID NO: 149875 - DNA, 20 bp, Artificial Sequence
  chemically synthesized
gtcagctttgacctcctcac

SEQ ID NO: 149876 - DNA, 20 bp, Artificial Sequence
  chemically synthesized
ggcaactagtgaggaggtca

SEQ ID NO: 149877 - DNA, 20 bp, Artificial Sequence
  chemically synthesized
tgaggaggtcaaagctgacg

SEQ ID NO: 149878 - DNA, 20 bp, Artificial Sequence
  chemically synthesized
aggaggtcaaagctgacgca

SEQ ID NO: 149879 - DNA, 20 bp, Artificial Sequence
  chemically synthesized
cctgatttttttctctgcgt

SEQ ID NO: 149880 - DNA, 20 bp, Artificial Sequence
  chemically synthesized
gctgacgcagagaaaaaaat

SEQ ID NO: 149881 - DNA, 20 bp, Artificial Sequence
  chemically synthesized
ctgacgcagagaaaaaaatc

SEQ ID NO: 149882 - DNA, 20 bp, Artificial Sequence
  chemically synthesized
cagagaaaaaaatcaggaca

SEQ ID NO: 149883 - DNA, 20 bp, Artificial Sequence
  chemically synthesized
gaaaaaaatcaggacaaaga

SEQ ID NO: 149884 - DNA, 20 bp, Artificial Sequence
  chemically synthesized
aatcaggacaaagaaagtca

SEQ ID NO: 149885 - DNA, 20 bp, Artificial Sequence
  chemically synthesized
tcaggacaaagaaagtcata

SEQ ID NO: 149886 - DNA, 20 bp, Artificial Sequence
  chemically synthesized
gacaaagaaagtcatagaga

SEQ ID NO: 149887 - DNA, 20 bp, Artificial Sequence
  chemically synthesized
caaagaaagtcatagagaaa

SEQ ID NO: 149888 - DNA, 20 bp, Artificial Sequence
  chemically synthesized
aagtcatagagaaagagtga

SEQ ID NO: 149889 - DNA, 20 bp, Artificial Sequence
  chemically synthesized
gtcatagagaaagagtgaca

SEQ ID NO: 149890 - DNA, 20 bp, Artificial Sequence
  chemically synthesized
ctccagatgaagtacaagca

SEQ ID NO: 149891 - DNA, 20 bp, Artificial Sequence
  chemically synthesized
ggctccagatgaagtacaag

SEQ ID NO: 149892 - DNA, 20 bp, Artificial Sequence
  chemically synthesized
gctggctccagatgaagtac

SEQ ID NO: 149893 - DNA, 20 bp, Artificial Sequence
  chemically synthesized
agctctgcttgtacttcatc

SEQ ID NO: 149894 - DNA, 20 bp, Artificial Sequence
  chemically synthesized
ctctgcttgtacttcatctg

SEQ ID NO: 149895 - DNA, 20 bp, Artificial Sequence
  chemically synthesized
gttaaagctggctccagatg

SEQ ID NO: 149896 - DNA, 20 bp, Artificial Sequence
  chemically synthesized
gcttgtacttcatctggagc

SEQ ID NO: 149897 - DNA, 20 bp, Artificial Sequence
  chemically synthesized
tcagaggttaaagctggctc

SEQ ID NO: 149898 - DNA, 20 bp, Artificial Sequence
  chemically synthesized
ggaagttcagaggttaaagc

SEQ ID NO: 149899 - DNA, 20 bp, Artificial Sequence
  chemically synthesized
aactggaagttcagaggtta

SEQ ID NO: 149900 - DNA, 20 bp, Artificial Sequence
  chemically synthesized
tcacataactggaagttcag

SEQ ID NO: 149901 - DNA, 20 bp, Artificial Sequence
  chemically synthesized
ctcacataactggaagttca

SEQ ID NO: 149902 - DNA, 20 bp, Artificial Sequence
  chemically synthesized
agctttaacctctgaacttc

SEQ ID NO: 149903 - DNA, 20 bp, Artificial Sequence
  chemically synthesized
aactcacataactggaagtt

SEQ ID NO: 149904 - DNA, 20 bp, Artificial Sequence
  chemically synthesized
aattcaactcacataactgg

SEQ ID NO: 149905 - DNA, 20 bp, Artificial Sequence
  chemically synthesized
ctctgaacttccagttatgt

SEQ ID NO: 149906 - DNA, 20 bp, Artificial Sequence
  chemically synthesized
aataattcaactcacataac

SEQ ID NO: 149907 - DNA, 20 bp, Artificial Sequence
  chemically synthesized
ttgaattattcttatttttg

SEQ ID NO: 149908 - DNA, 20 bp, Artificial Sequence
  chemically synthesized
ttcaaagtggcttcaaaaat

SEQ ID NO: 149909 - DNA, 20 bp, Artificial Sequence
  chemically synthesized
tatttttgaagccactttga

SEQ ID NO: 149910 - DNA, 20 bp, Artificial Sequence
  chemically synthesized
aagagaatgcactttcaaag

SEQ ID NO: 149911 - DNA, 20 bp, Artificial Sequence
  chemically synthesized
agaaagagaatgcactttca

SEQ ID NO: 149912 - DNA, 20 bp, Artificial Sequence
  chemically synthesized
aaagtgcattctctttcttg

SEQ ID NO: 149913 - DNA, 20 bp, Artificial Sequence
  chemically synthesized
atgctttgggctgcaagaaa

SEQ ID NO: 149914 - DNA, 20 bp, Artificial Sequence
  chemically synthesized
agatgctttgggctgcaaga

SEQ ID NO: 149915 - DNA, 20 bp, Artificial Sequence
  chemically synthesized
gttaagatgctttgggctgc

SEQ ID NO: 149916 - DNA, 20 bp, Artificial Sequence
  chemically synthesized
attctctttcttgcagccca

SEQ ID NO: 149917 - DNA, 20 bp, Artificial Sequence
  chemically synthesized
tttaatagttaagatgcttt

SEQ ID NO: 149918 - DNA, 20 bp, Artificial Sequence
  chemically synthesized
atttaatagttaagatgctt

SEQ ID NO: 149919 - DNA, 20 bp, Artificial Sequence
  chemically synthesized
tggtgacatatttaatagtt

SEQ ID NO: 149920 - DNA, 20 bp, Artificial Sequence
  chemically synthesized
taccctggtgacatatttaa

SEQ ID NO: 149921 - DNA, 20 bp, Artificial Sequence
  chemically synthesized
ttaactattaaatatgtcac

SEQ ID NO: 149922 - DNA, 20 bp, Artificial Sequence
  chemically synthesized
taactattaaatatgtcacc

SEQ ID NO: 149923 - DNA, 20 bp, Artificial Sequence
  chemically synthesized
aactattaaatatgtcacca

SEQ ID NO: 149924 - DNA, 20 bp, Artificial Sequence
  chemically synthesized
ttggcatatttatgttaccc

SEQ ID NO: 149925 - DNA, 20 bp, Artificial Sequence
  chemically synthesized
attttactgagattaattgt

SEQ ID NO: 149926 - DNA, 20 bp, Artificial Sequence
  chemically synthesized
aatatgccaacaattaatct

SEQ ID NO: 149927 - DNA, 20 bp, Artificial Sequence
  chemically synthesized
aagtatcataatattttact

SEQ ID NO: 149928 - DNA, 20 bp, Artificial Sequence
  chemically synthesized
tattatgatacttgctgaaa

SEQ ID NO: 149929 - DNA, 20 bp, Artificial Sequence
  chemically synthesized
aaatttactcctatttcagc

SEQ ID NO: 149930 - DNA, 20 bp, Artificial Sequence
  chemically synthesized
attatgatacttgctgaaat

SEQ ID NO: 149931 - DNA, 20 bp, Artificial Sequence
  chemically synthesized
tatgatacttgctgaaatag

SEQ ID NO: 149932 - DNA, 20 bp, Artificial Sequence
  chemically synthesized
tttaaaatttactcctattt

SEQ ID NO: 149933 - DNA, 20 bp, Artificial Sequence
  chemically synthesized
taaattttaaaatgataata

SEQ ID NO: 149934 - DNA, 20 bp, Artificial Sequence
  chemically synthesized
aattttaaaatgataatatg

SEQ ID NO: 149935 - DNA, 20 bp, Artificial Sequence
  chemically synthesized
ttttaaaatgataatatgga

SEQ ID NO: 149936 - DNA, 20 bp, Artificial Sequence
  chemically synthesized
ttaaaatgataatatggaga

SEQ ID NO: 149937 - DNA, 20 bp, Artificial Sequence
  chemically synthesized
aaatgataatatggagagag

SEQ ID NO: 149938 - DNA, 20 bp, Artificial Sequence
  chemically synthesized
gagaagcacatgcattcccc

SEQ ID NO: 149939 - DNA, 20 bp, Artificial Sequence
  chemically synthesized
gaagcacatgcattcccctg

SEQ ID NO: 149940 - DNA, 20 bp, Artificial Sequence
  chemically synthesized
aagcacatgcattcccctgg

SEQ ID NO: 149941 - DNA, 20 bp, Artificial Sequence
  chemically synthesized
tttcctacttagtcctccag

SEQ ID NO: 149942 - DNA, 20 bp, Artificial Sequence
  chemically synthesized
ttttcctacttagtcctcca

SEQ ID NO: 149943 - DNA, 20 bp, Artificial Sequence
  chemically synthesized
tttttcctacttagtcctcc

SEQ ID NO: 149944 - DNA, 20 bp, Artificial Sequence
  chemically synthesized
atgcattcccctggaggact

SEQ ID NO: 149945 - DNA, 20 bp, Artificial Sequence
  chemically synthesized
ttttttcctacttagtcctc

SEQ ID NO: 149946 - DNA, 20 bp, Artificial Sequence
  chemically synthesized
cattcccctggaggactaag

SEQ ID NO: 149947 - DNA, 20 bp, Artificial Sequence
  chemically synthesized
attcccctggaggactaagt

SEQ ID NO: 149948 - DNA, 20 bp, Artificial Sequence
  chemically synthesized
taagtaccttttttcctact

SEQ ID NO: 149949 - DNA, 20 bp, Artificial Sequence
  chemically synthesized
tggaggactaagtaggaaaa

SEQ ID NO: 149950 - DNA, 20 bp, Artificial Sequence
  chemically synthesized
ggaggactaagtaggaaaaa

SEQ ID NO: 149951 - DNA, 20 bp, Artificial Sequence
  chemically synthesized
gtttataatattatttgtgt

SEQ ID NO: 149952 - DNA, 20 bp, Artificial Sequence
  chemically synthesized
cacaaataatattataaact

SEQ ID NO: 149953 - DNA, 20 bp, Artificial Sequence
  chemically synthesized
taaacttaccattacattct

SEQ ID NO: 149954 - DNA, 20 bp, Artificial Sequence
  chemically synthesized
attataaactgagaatgtaa

SEQ ID NO: 149955 - DNA, 20 bp, Artificial Sequence
  chemically synthesized
taaactgagaatgtaatggt

SEQ ID NO: 149956 - DNA, 20 bp, Artificial Sequence
  chemically synthesized
atgtaatggtaagtttacca

SEQ ID NO: 149957 - DNA, 20 bp, Artificial Sequence
  chemically synthesized
gtaatggtaagtttaccaaa

SEQ ID NO: 149958 - DNA, 20 bp, Artificial Sequence
  chemically synthesized
atttgtcataataggctctt

SEQ ID NO: 149959 - DNA, 20 bp, Artificial Sequence
  chemically synthesized
agaaatacatttgtcataat

SEQ ID NO: 149960 - DNA, 20 bp, Artificial Sequence
  chemically synthesized
tagaaatacatttgtcataa

SEQ ID NO: 149961 - DNA, 20 bp, Artificial Sequence
  chemically synthesized
tattatgacaaatgtatttc

SEQ ID NO: 149962 - DNA, 20 bp, Artificial Sequence
  chemically synthesized
gacaaatgtatttctagcaa

SEQ ID NO: 149963 - DNA, 20 bp, Artificial Sequence
  chemically synthesized
acaaatgtatttctagcaaa

SEQ ID NO: 149964 - DNA, 20 bp, Artificial Sequence
  chemically synthesized
acatatattcttccttttgc

SEQ ID NO: 149965 - DNA, 20 bp, Artificial Sequence
  chemically synthesized
aatgtatttctagcaaaagg

SEQ ID NO: 149966 - DNA, 20 bp, Artificial Sequence
  chemically synthesized
aaaaggaagaatatatgtta

SEQ ID NO: 149967 - DNA, 20 bp, Artificial Sequence
  chemically synthesized
agaatatatgttaaagtata

SEQ ID NO: 149968 - DNA, 20 bp, Artificial Sequence
  chemically synthesized
gaatatatgttaaagtataa

SEQ ID NO: 149969 - DNA, 20 bp, Artificial Sequence
  chemically synthesized
tatatgttaaagtataaagg

SEQ ID NO: 149970 - DNA, 20 bp, Artificial Sequence
  chemically synthesized
taaagtataaaggcagcaat

SEQ ID NO: 149971 - DNA, 20 bp, Artificial Sequence
  chemically synthesized
taaaggcagcaattggtgat

SEQ ID NO: 149972 - DNA, 20 bp, Artificial Sequence
  chemically synthesized
aaaggcagcaattggtgatt

SEQ ID NO: 149973 - DNA, 20 bp, Artificial Sequence
  chemically synthesized
aaggcagcaattggtgatta

SEQ ID NO: 149974 - DNA, 20 bp, Artificial Sequence
  chemically synthesized
ggcagcaattggtgattagg

SEQ ID NO: 149975 - DNA, 20 bp, Artificial Sequence
  chemically synthesized
ggtgattagggagttacaaa

SEQ ID NO: 149976 - DNA, 20 bp, Artificial Sequence
  chemically synthesized
ttagggagttacaaatagtt

SEQ ID NO: 149977 - DNA, 20 bp, Artificial Sequence
  chemically synthesized
ctcctctctcttgaaaaatc

SEQ ID NO: 149978 - DNA, 20 bp, Artificial Sequence
  chemically synthesized
ttagtattacttgatttttc

SEQ ID NO: 149979 - DNA, 20 bp, Artificial Sequence
  chemically synthesized
agtattacttgatttttcaa

SEQ ID NO: 149980 - DNA, 20 bp, Artificial Sequence
  chemically synthesized
tattacttgatttttcaaga

SEQ ID NO: 149981 - DNA, 20 bp, Artificial Sequence
  chemically synthesized
ttacttgatttttcaagaga

SEQ ID NO: 149982 - DNA, 20 bp, Artificial Sequence
  chemically synthesized
tacttgatttttcaagagag

SEQ ID NO: 149983 - DNA, 20 bp, Artificial Sequence
  chemically synthesized
cttgatttttcaagagagag

SEQ ID NO: 149984 - DNA, 20 bp, Artificial Sequence
  chemically synthesized
ttgatttttcaagagagagg

SEQ ID NO: 149985 - DNA, 20 bp, Artificial Sequence
  chemically synthesized
tgatttttcaagagagagga

SEQ ID NO: 149986 - DNA, 20 bp, Artificial Sequence
  chemically synthesized
tttttcaagagagaggaggg

SEQ ID NO: 149987 - DNA, 20 bp, Artificial Sequence
  chemically synthesized
aagagagaggagggaagatg

SEQ ID NO: 149988 - DNA, 20 bp, Artificial Sequence
  chemically synthesized
agagagaggagggaagatgt

SEQ ID NO: 149989 - DNA, 20 bp, Artificial Sequence
  chemically synthesized
ggaagatgtaggaaataccc

SEQ ID NO: 149990 - DNA, 20 bp, Artificial Sequence
  chemically synthesized
gatgtaggaaataccctaga

SEQ ID NO: 149991 - DNA, 20 bp, Artificial Sequence
  chemically synthesized
ggtacctactagtctatcta

SEQ ID NO: 149992 - DNA, 20 bp, Artificial Sequence
  chemically synthesized
tggtacctactagtctatct

SEQ ID NO: 149993 - DNA, 20 bp, Artificial Sequence
  chemically synthesized
aggaaataccctagatagac

SEQ ID NO: 149994 - DNA, 20 bp, Artificial Sequence
  chemically synthesized
ttggtacctactagtctatc

SEQ ID NO: 149995 - DNA, 20 bp, Artificial Sequence
  chemically synthesized
aaataccctagatagactag

SEQ ID NO: 149996 - DNA, 20 bp, Artificial Sequence
  chemically synthesized
aataccctagatagactagt

SEQ ID NO: 149997 - DNA, 20 bp, Artificial Sequence
  chemically synthesized
ttcatggatttggtacctac

SEQ ID NO: 149998 - DNA, 20 bp, Artificial Sequence
  chemically synthesized
cacaaggccgttcatggatt

SEQ ID NO: 149999 - DNA, 20 bp, Artificial Sequence
  chemically synthesized
gtaggtaccaaatccatgaa

SEQ ID NO: 150000 - DNA, 20 bp, Artificial Sequence
  chemically synthesized
ttggtacacaaggccgttca

SEQ ID NO: 150001 - DNA, 20 bp, Artificial Sequence
  chemically synthesized
atttttcagcttggtacaca

SEQ ID NO: 150002 - DNA, 20 bp, Artificial Sequence
  chemically synthesized
catgaacggccttgtgtacc

SEQ ID NO: 150003 - DNA, 20 bp, Artificial Sequence
  chemically synthesized
aatttttcagcttggtacac

SEQ ID NO: 150004 - DNA, 20 bp, Artificial Sequence
  chemically synthesized
aaaagctaaatttttcagct

SEQ ID NO: 150005 - DNA, 20 bp, Artificial Sequence
  chemically synthesized
gtgtaccaagctgaaaaatt

SEQ ID NO: 150006 - DNA, 20 bp, Artificial Sequence
  chemically synthesized
aggataaaagctaaattttt

SEQ ID NO: 150007 - DNA, 20 bp, Artificial Sequence
  chemically synthesized
gaaaaatttagcttttatcc

SEQ ID NO: 150008 - DNA, 20 bp, Artificial Sequence
  chemically synthesized
ctctttctcttctaggataa

SEQ ID NO: 150009 - DNA, 20 bp, Artificial Sequence
  chemically synthesized
aaatttagcttttatcctag

SEQ ID NO: 150010 - DNA, 20 bp, Artificial Sequence
  chemically synthesized
atttagcttttatcctagaa

SEQ ID NO: 150011 - DNA, 20 bp, Artificial Sequence
  chemically synthesized
aatagttctctttctcttct

SEQ ID NO: 150012 - DNA, 20 bp, Artificial Sequence
  chemically synthesized
agcttttatcctagaagaga

SEQ ID NO: 150013 - DNA, 20 bp, Artificial Sequence
  chemically synthesized
taatagttctctttctcttc

SEQ ID NO: 150014 - DNA, 20 bp, Artificial Sequence
  chemically synthesized
cttttatcctagaagagaaa

SEQ ID NO: 150015 - DNA, 20 bp, Artificial Sequence
  chemically synthesized
tattagtaaaggttgtataa

SEQ ID NO: 150016 - DNA, 20 bp, Artificial Sequence
  chemically synthesized
caatcataatgtattagtaa

SEQ ID NO: 150017 - DNA, 20 bp, Artificial Sequence
  chemically synthesized
ccaatcataatgtattagta

SEQ ID NO: 150018 - DNA, 20 bp, Artificial Sequence
  chemically synthesized
acatgccaatcataatgtat

SEQ ID NO: 150019 - DNA, 20 bp, Artificial Sequence
  chemically synthesized
ctttactaatacattatgat

SEQ ID NO: 150020 - DNA, 20 bp, Artificial Sequence
  chemically synthesized
attatgattggcatgttaaa

SEQ ID NO: 150021 - DNA, 20 bp, Artificial Sequence
  chemically synthesized
gattggcatgttaaaaagtg

SEQ ID NO: 150022 - DNA, 20 bp, Artificial Sequence
  chemically synthesized
gttaaaaagtgtagttttaa

SEQ ID NO: 150023 - DNA, 20 bp, Artificial Sequence
  chemically synthesized
gtgtagttttaatggatttg

SEQ ID NO: 150024 - DNA, 20 bp, Artificial Sequence
  chemically synthesized
ttaatggatttgcagtgtac

SEQ ID NO: 150025 - DNA, 20 bp, Artificial Sequence
  chemically synthesized
ggatttgcagtgtacaagat

SEQ ID NO: 150026 - DNA, 20 bp, Artificial Sequence
  chemically synthesized
tgcagtgtacaagatgagct

SEQ ID NO: 150027 - DNA, 20 bp, Artificial Sequence
  chemically synthesized
cagtgtacaagatgagctga

SEQ ID NO: 150028 - DNA, 20 bp, Artificial Sequence
  chemically synthesized
gtacaagatgagctgagaga

SEQ ID NO: 150029 - DNA, 20 bp, Artificial Sequence
  chemically synthesized
tcactagtttttctgtctct

SEQ ID NO: 150030 - DNA, 20 bp, Artificial Sequence
  chemically synthesized
gagctgagagacagaaaaac

SEQ ID NO: 150031 - DNA, 20 bp, Artificial Sequence
  chemically synthesized
gagagacagaaaaactagtg

SEQ ID NO: 150032 - DNA, 20 bp, Artificial Sequence
  chemically synthesized
gagacagaaaaactagtgaa

SEQ ID NO: 150033 - DNA, 20 bp, Artificial Sequence
  chemically synthesized
agacagaaaaactagtgaag

SEQ ID NO: 150034 - DNA, 20 bp, Artificial Sequence
  chemically synthesized
cttctacaaaacctcttcac

SEQ ID NO: 150035 - DNA, 20 bp, Artificial Sequence
  chemically synthesized
aaactagtgaagaggttttg

SEQ ID NO: 150036 - DNA, 20 bp, Artificial Sequence
  chemically synthesized
ctagtgaagaggttttgtag

SEQ ID NO: 150037 - DNA, 20 bp, Artificial Sequence
  chemically synthesized
tgttttctcattcattcaga

SEQ ID NO: 150038 - DNA, 20 bp, Artificial Sequence
  chemically synthesized
aagatgctatctgaatgaat

SEQ ID NO: 150039 - DNA, 20 bp, Artificial Sequence
  chemically synthesized
attttgttttctcattcatt

SEQ ID NO: 150040 - DNA, 20 bp, Artificial Sequence
  chemically synthesized
tgaatgagaaaacaaaattg

SEQ ID NO: 150041 - DNA, 20 bp, Artificial Sequence
  chemically synthesized
acaaaattgcagtgctaaat

SEQ ID NO: 150042 - DNA, 20 bp, Artificial Sequence
  chemically synthesized
aaaattgcagtgctaaataa

SEQ ID NO: 150043 - DNA, 20 bp, Artificial Sequence
  chemically synthesized
gaaatttcttatctcttatt

SEQ ID NO: 150044 - DNA, 20 bp, Artificial Sequence
  chemically synthesized
tgcagtgctaaataagagat

SEQ ID NO: 150045 - DNA, 20 bp, Artificial Sequence
  chemically synthesized
aataagagataagaaatttc

SEQ ID NO: 150046 - DNA, 20 bp, Artificial Sequence
  chemically synthesized
tcgatcttgttaagacaaat

SEQ ID NO: 150047 - DNA, 20 bp, Artificial Sequence
  chemically synthesized
tcaagcttatttgtcttaac

SEQ ID NO: 150048 - DNA, 20 bp, Artificial Sequence
  chemically synthesized
ccaatcctttcgatcttgtt

SEQ ID NO: 150049 - DNA, 20 bp, Artificial Sequence
  chemically synthesized
atttgtcttaacaagatcga

SEQ ID NO: 150050 - DNA, 20 bp, Artificial Sequence
  chemically synthesized
tttgtcttaacaagatcgaa

SEQ ID NO: 150051 - DNA, 20 bp, Artificial Sequence
  chemically synthesized
cttaacaagatcgaaaggat

SEQ ID NO: 150052 - DNA, 20 bp, Artificial Sequence
  chemically synthesized
aaaggattggtaatttatcg

SEQ ID NO: 150053 - DNA, 20 bp, Artificial Sequence
  chemically synthesized
aaggattggtaatttatcgt

SEQ ID NO: 150054 - DNA, 20 bp, Artificial Sequence
  chemically synthesized
aggattggtaatttatcgtg

SEQ ID NO: 150055 - DNA, 20 bp, Artificial Sequence
  chemically synthesized
ttatcgtggggcttaatatt

SEQ ID NO: 150056 - DNA, 20 bp, Artificial Sequence
  chemically synthesized
tatcgtggggcttaatatta

SEQ ID NO: 150057 - DNA, 20 bp, Artificial Sequence
  chemically synthesized
tttctttattccttaatatt

SEQ ID NO: 150058 - DNA, 20 bp, Artificial Sequence
  chemically synthesized
gggcttaatattaaggaata

SEQ ID NO: 150059 - DNA, 20 bp, Artificial Sequence
  chemically synthesized
ttaatattaaggaataaaga

SEQ ID NO: 150060 - DNA, 20 bp, Artificial Sequence
  chemically synthesized
ttaaggaataaagaaagtgc

SEQ ID NO: 150061 - DNA, 20 bp, Artificial Sequence
  chemically synthesized
taaaaatcaggaagtttttc

SEQ ID NO: 150062 - DNA, 20 bp, Artificial Sequence
  chemically synthesized
tggccatgttaaaaatcagg

SEQ ID NO: 150063 - DNA, 20 bp, Artificial Sequence
  chemically synthesized
gactggccatgttaaaaatc

SEQ ID NO: 150064 - DNA, 20 bp, Artificial Sequence
  chemically synthesized
ggactggccatgttaaaaat

SEQ ID NO: 150065 - DNA, 20 bp, Artificial Sequence
  chemically synthesized
aaacttcctgatttttaaca

SEQ ID NO: 150066 - DNA, 20 bp, Artificial Sequence
  chemically synthesized
ttcctgatttttaacatggc

SEQ ID NO: 150067 - DNA, 20 bp, Artificial Sequence
  chemically synthesized
ttttaacatggccagtccat

SEQ ID NO: 150068 - DNA, 20 bp, Artificial Sequence
  chemically synthesized
aatgacacaatctaatggac

SEQ ID NO: 150069 - DNA, 20 bp, Artificial Sequence
  chemically synthesized
ttgtgaatgacacaatctaa

SEQ ID NO: 150070 - DNA, 20 bp, Artificial Sequence
  chemically synthesized
gattgtgtcattcacaaaaa

SEQ ID NO: 150071 - DNA, 20 bp, Artificial Sequence
  chemically synthesized
attgtgtcattcacaaaaat

SEQ ID NO: 150072 - DNA, 20 bp, Artificial Sequence
  chemically synthesized
ttgtgtcattcacaaaaata

SEQ ID NO: 150073 - DNA, 20 bp, Artificial Sequence
  chemically synthesized
attcacaaaaatagggaata

SEQ ID NO: 150074 - DNA, 20 bp, Artificial Sequence
  chemically synthesized
acaaaaatagggaatatagt

SEQ ID NO: 150075 - DNA, 20 bp, Artificial Sequence
  chemically synthesized
aaaaatagggaatatagtaa

SEQ ID NO: 150076 - DNA, 20 bp, Artificial Sequence
  chemically synthesized
aaaatagggaatatagtaag

SEQ ID NO: 150077 - DNA, 20 bp, Artificial Sequence
  chemically synthesized
agggaatatagtaagaggaa

SEQ ID NO: 150078 - DNA, 20 bp, Artificial Sequence
  chemically synthesized
tagtaagaggaatagatttt

SEQ ID NO: 150079 - DNA, 20 bp, Artificial Sequence
  chemically synthesized
acatcaattttacatatcct

SEQ ID NO: 150080 - DNA, 20 bp, Artificial Sequence
  chemically synthesized
caattttacatatcctgagt

SEQ ID NO: 150081 - DNA, 20 bp, Artificial Sequence
  chemically synthesized
tccacaggtatttctaactc

SEQ ID NO: 150082 - DNA, 20 bp, Artificial Sequence
  chemically synthesized
ttccacaggtatttctaact

SEQ ID NO: 150083 - DNA, 20 bp, Artificial Sequence
  chemically synthesized
tcctgagttagaaatacctg

SEQ ID NO: 150084 - DNA, 20 bp, Artificial Sequence
  chemically synthesized
ctaccacgtagatgttccac

SEQ ID NO: 150085 - DNA, 20 bp, Artificial Sequence
  chemically synthesized
gctaccacgtagatgttcca

SEQ ID NO: 150086 - DNA, 20 bp, Artificial Sequence
  chemically synthesized
atacctgtggaacatctacg

SEQ ID NO: 150087 - DNA, 20 bp, Artificial Sequence
  chemically synthesized
cctgtggaacatctacgtgg

SEQ ID NO: 150088 - DNA, 20 bp, Artificial Sequence
  chemically synthesized
cctgctgacaagctaccacg

SEQ ID NO: 150089 - DNA, 20 bp, Artificial Sequence
  chemically synthesized
acatctacgtggtagcttgt

SEQ ID NO: 150090 - DNA, 20 bp, Artificial Sequence
  chemically synthesized
tctacgtggtagcttgtcag

SEQ ID NO: 150091 - DNA, 20 bp, Artificial Sequence
  chemically synthesized
ctacgtggtagcttgtcagc

SEQ ID NO: 150092 - DNA, 20 bp, Artificial Sequence
  chemically synthesized
tcatattttcacctgctgac

SEQ ID NO: 150093 - DNA, 20 bp, Artificial Sequence
  chemically synthesized
ttgtcagcaggtgaaaatat

SEQ ID NO: 150094 - DNA, 20 bp, Artificial Sequence
  chemically synthesized
agcaggtgaaaatatgagtt

SEQ ID NO: 150095 - DNA, 20 bp, Artificial Sequence
  chemically synthesized
aaaatatgagtttggaattg

SEQ ID NO: 150096 - DNA, 20 bp, Artificial Sequence
  chemically synthesized
aatatgagtttggaattgaa

SEQ ID NO: 150097 - DNA, 20 bp, Artificial Sequence
  chemically synthesized
tatgagtttggaattgaaga

SEQ ID NO: 150098 - DNA, 20 bp, Artificial Sequence
  chemically synthesized
gagtttggaattgaagagag

SEQ ID NO: 150099 - DNA, 20 bp, Artificial Sequence
  chemically synthesized
ttgaagagagaagcctgaac

SEQ ID NO: 150100 - DNA, 20 bp, Artificial Sequence
  chemically synthesized
gaagagagaagcctgaacta

SEQ ID NO: 150101 - DNA, 20 bp, Artificial Sequence
  chemically synthesized
ccaatgattatctctagttc

SEQ ID NO: 150102 - DNA, 20 bp, Artificial Sequence
  chemically synthesized
gccaatgattatctctagtt

SEQ ID NO: 150103 - DNA, 20 bp, Artificial Sequence
  chemically synthesized
actatgccaatgattatctc

SEQ ID NO: 150104 - DNA, 20 bp, Artificial Sequence
  chemically synthesized
cctgaactagagataatcat

SEQ ID NO: 150105 - DNA, 20 bp, Artificial Sequence
  chemically synthesized
actagagataatcattggca

SEQ ID NO: 150106 - DNA, 20 bp, Artificial Sequence
  chemically synthesized
gataatcattggcatagttt

SEQ ID NO: 150107 - DNA, 20 bp, Artificial Sequence
  chemically synthesized
aatcattggcatagtttcag

SEQ ID NO: 150108 - DNA, 20 bp, Artificial Sequence
  chemically synthesized
agtttcagtagtcttaatct

SEQ ID NO: 150109 - DNA, 20 bp, Artificial Sequence
  chemically synthesized
ttattagagaatctaagatt

SEQ ID NO: 150110 - DNA, 20 bp, Artificial Sequence
  chemically synthesized
ttccatttattagagaatct

SEQ ID NO: 150111 - DNA, 20 bp, Artificial Sequence
  chemically synthesized
atcttagattctctaataaa

SEQ ID NO: 150112 - DNA, 20 bp, Artificial Sequence
  chemically synthesized
actaccaattccatttatta

SEQ ID NO: 150113 - DNA, 20 bp, Artificial Sequence
  chemically synthesized
ttactaccaattccatttat

SEQ ID NO: 150114 - DNA, 20 bp, Artificial Sequence
  chemically synthesized
gattctctaataaatggaat

SEQ ID NO: 150115 - DNA, 20 bp, Artificial Sequence
  chemically synthesized
tctctaataaatggaattgg

SEQ ID NO: 150116 - DNA, 20 bp, Artificial Sequence
  chemically synthesized
gtagtaaaattatttgaatt

SEQ ID NO: 150117 - DNA, 20 bp, Artificial Sequence
  chemically synthesized
tttgaattaagataatgcta

SEQ ID NO: 150118 - DNA, 20 bp, Artificial Sequence
  chemically synthesized
attaagataatgctatagtt

SEQ ID NO: 150119 - DNA, 20 bp, Artificial Sequence
  chemically synthesized
aggggacaacatctgaacta

SEQ ID NO: 150120 - DNA, 20 bp, Artificial Sequence
  chemically synthesized
tttcaacatgagatttggag

SEQ ID NO: 150121 - DNA, 20 bp, Artificial Sequence
  chemically synthesized
atttcaacatgagatttgga

SEQ ID NO: 150122 - DNA, 20 bp, Artificial Sequence
  chemically synthesized
aatttcaacatgagatttgg

SEQ ID NO: 150123 - DNA, 20 bp, Artificial Sequence
  chemically synthesized
aaatttcaacatgagatttg

SEQ ID NO: 150124 - DNA, 20 bp, Artificial Sequence
  chemically synthesized
tcaaatttcaacatgagatt

SEQ ID NO: 150125 - DNA, 20 bp, Artificial Sequence
  chemically synthesized
tgaggatcaaatttcaacat

SEQ ID NO: 150126 - DNA, 20 bp, Artificial Sequence
  chemically synthesized
tgaaatttgatcctcaatat

SEQ ID NO: 150127 - DNA, 20 bp, Artificial Sequence
  chemically synthesized
aagccccacctccaatattg

SEQ ID NO: 150128 - DNA, 20 bp, Artificial Sequence
  chemically synthesized
aaatttgatcctcaatattg

SEQ ID NO: 150129 - DNA, 20 bp, Artificial Sequence
  chemically synthesized
taagccccacctccaatatt

SEQ ID NO: 150130 - DNA, 20 bp, Artificial Sequence
  chemically synthesized
aatttgatcctcaatattgg

SEQ ID NO: 150131 - DNA, 20 bp, Artificial Sequence
  chemically synthesized
ttgatcctcaatattggagg

SEQ ID NO: 150132 - DNA, 20 bp, Artificial Sequence
  chemically synthesized
tgatcctcaatattggaggt

SEQ ID NO: 150133 - DNA, 20 bp, Artificial Sequence
  chemically synthesized
gatcctcaatattggaggtg

SEQ ID NO: 150134 - DNA, 20 bp, Artificial Sequence
  chemically synthesized
atattggaggtggggcttaa

SEQ ID NO: 150135 - DNA, 20 bp, Artificial Sequence
  chemically synthesized
tattggaggtggggcttaac

SEQ ID NO: 150136 - DNA, 20 bp, Artificial Sequence
  chemically synthesized
tggaggtggggcttaacggg

SEQ ID NO: 150137 - DNA, 20 bp, Artificial Sequence
  chemically synthesized
atgaccccacacttcccgtt

SEQ ID NO: 150138 - DNA, 20 bp, Artificial Sequence
  chemically synthesized
gtggggcttaacgggaagtg

SEQ ID NO: 150139 - DNA, 20 bp, Artificial Sequence
  chemically synthesized
tggggcttaacgggaagtgt

SEQ ID NO: 150140 - DNA, 20 bp, Artificial Sequence
  chemically synthesized
ggggcttaacgggaagtgtg

SEQ ID NO: 150141 - DNA, 20 bp, Artificial Sequence
  chemically synthesized
taacgggaagtgtggggtca

SEQ ID NO: 150142 - DNA, 20 bp, Artificial Sequence
  chemically synthesized
aacgggaagtgtggggtcat

SEQ ID NO: 150143 - DNA, 20 bp, Artificial Sequence
  chemically synthesized
acgggaagtgtggggtcatg

SEQ ID NO: 150144 - DNA, 20 bp, Artificial Sequence
  chemically synthesized
cgggaagtgtggggtcatgg

SEQ ID NO: 150145 - DNA, 20 bp, Artificial Sequence
  chemically synthesized
gaagtgtggggtcatggggg

SEQ ID NO: 150146 - DNA, 20 bp, Artificial Sequence
  chemically synthesized
gggggtggatccttcttgaa

SEQ ID NO: 150147 - DNA, 20 bp, Artificial Sequence
  chemically synthesized
gggcattaagccattcaaga

SEQ ID NO: 150148 - DNA, 20 bp, Artificial Sequence
  chemically synthesized
agggcattaagccattcaag

SEQ ID NO: 150149 - DNA, 20 bp, Artificial Sequence
  chemically synthesized
ggaagggcattaagccattc

SEQ ID NO: 150150 - DNA, 20 bp, Artificial Sequence
  chemically synthesized
ctgcccccaggaagggcatt

SEQ ID NO: 150151 - DNA, 20 bp, Artificial Sequence
  chemically synthesized
gaatggcttaatgcccttcc

SEQ ID NO: 150152 - DNA, 20 bp, Artificial Sequence
  chemically synthesized
aatggcttaatgcccttcct

SEQ ID NO: 150153 - DNA, 20 bp, Artificial Sequence
  chemically synthesized
atggcttaatgcccttcctg

SEQ ID NO: 150154 - DNA, 20 bp, Artificial Sequence
  chemically synthesized
tggcttaatgcccttcctgg

SEQ ID NO: 150155 - DNA, 20 bp, Artificial Sequence
  chemically synthesized
actcaacctgcccccaggaa

SEQ ID NO: 150156 - DNA, 20 bp, Artificial Sequence
  chemically synthesized
cactcaacctgcccccagga

SEQ ID NO: 150157 - DNA, 20 bp, Artificial Sequence
  chemically synthesized
tcactcaacctgcccccagg

SEQ ID NO: 150158 - DNA, 20 bp, Artificial Sequence
  chemically synthesized
cttaatgcccttcctggggg

SEQ ID NO: 150159 - DNA, 20 bp, Artificial Sequence
  chemically synthesized
ttaatgcccttcctgggggc

SEQ ID NO: 150160 - DNA, 20 bp, Artificial Sequence
  chemically synthesized
cagtcactcaacctgccccc

SEQ ID NO: 150161 - DNA, 20 bp, Artificial Sequence
  chemically synthesized
gcagtcactcaacctgcccc

SEQ ID NO: 150162 - DNA, 20 bp, Artificial Sequence
  chemically synthesized
gcccttcctgggggcaggtt

SEQ ID NO: 150163 - DNA, 20 bp, Artificial Sequence
  chemically synthesized
gcagaacctaacagaatgag

SEQ ID NO: 150164 - DNA, 20 bp, Artificial Sequence
  chemically synthesized
tgagtgactgctcattctgt

SEQ ID NO: 150165 - DNA, 20 bp, Artificial Sequence
  chemically synthesized
cttgcagaacctaacagaat

SEQ ID NO: 150166 - DNA, 20 bp, Artificial Sequence
  chemically synthesized
gagtgactgctcattctgtt

SEQ ID NO: 150167 - DNA, 20 bp, Artificial Sequence
  chemically synthesized
ctagctcttgcagaacctaa

SEQ ID NO: 150168 - DNA, 20 bp, Artificial Sequence
  chemically synthesized
ctcattctgttaggttctgc

SEQ ID NO: 150169 - DNA, 20 bp, Artificial Sequence
  chemically synthesized
cattctgttaggttctgcaa

SEQ ID NO: 150170 - DNA, 20 bp, Artificial Sequence
  chemically synthesized
ctgttaggttctgcaagagc

SEQ ID NO: 150171 - DNA, 20 bp, Artificial Sequence
  chemically synthesized
tatttggcaactagctcttg

SEQ ID NO: 150172 - DNA, 20 bp, Artificial Sequence
  chemically synthesized
ccaggctgttatttggcaac

SEQ ID NO: 150173 - DNA, 20 bp, Artificial Sequence
  chemically synthesized
aagagctagttgccaaataa

SEQ ID NO: 150174 - DNA, 20 bp, Artificial Sequence
  chemically synthesized
ggaagtgccaggctgttatt

SEQ ID NO: 150175 - DNA, 20 bp, Artificial Sequence
  chemically synthesized
ctagttgccaaataacagcc

SEQ ID NO: 150176 - DNA, 20 bp, Artificial Sequence
  chemically synthesized
agagagagaggggaagtgcc

SEQ ID NO: 150177 - DNA, 20 bp, Artificial Sequence
  chemically synthesized
aagagagagaggggaagtgc

SEQ ID NO: 150178 - DNA, 20 bp, Artificial Sequence
  chemically synthesized
ataaacaagagagagagggg

SEQ ID NO: 150179 - DNA, 20 bp, Artificial Sequence
  chemically synthesized
agcataaacaagagagagag

SEQ ID NO: 150180 - DNA, 20 bp, Artificial Sequence
  chemically synthesized
gagcataaacaagagagaga

SEQ ID NO: 150181 - DNA, 20 bp, Artificial Sequence
  chemically synthesized
agagcataaacaagagagag

SEQ ID NO: 150182 - DNA, 20 bp, Artificial Sequence
  chemically synthesized
gagagcataaacaagagaga

SEQ ID NO: 150183 - DNA, 20 bp, Artificial Sequence
  chemically synthesized
tagagagcataaacaagaga

SEQ ID NO: 150184 - DNA, 20 bp, Artificial Sequence
  chemically synthesized
gttagagagcataaacaaga

SEQ ID NO: 150185 - DNA, 20 bp, Artificial Sequence
  chemically synthesized
tggttagagagcataaacaa

SEQ ID NO: 150186 - DNA, 20 bp, Artificial Sequence
  chemically synthesized
catggttagagagcataaac

SEQ ID NO: 150187 - DNA, 20 bp, Artificial Sequence
  chemically synthesized
gtagagatcacatggttaga

SEQ ID NO: 150188 - DNA, 20 bp, Artificial Sequence
  chemically synthesized
gtgtagagatcacatggtta

SEQ ID NO: 150189 - DNA, 20 bp, Artificial Sequence
  chemically synthesized
gtgtgtagagatcacatggt

SEQ ID NO: 150190 - DNA, 20 bp, Artificial Sequence
  chemically synthesized
gctggtgtgtagagatcaca

SEQ ID NO: 150191 - DNA, 20 bp, Artificial Sequence
  chemically synthesized
accatgtgatctctacacac

SEQ ID NO: 150192 - DNA, 20 bp, Artificial Sequence
  chemically synthesized
caaaggggagctggtgtgta

SEQ ID NO: 150193 - DNA, 20 bp, Artificial Sequence
  chemically synthesized
ggcaaaggggagctggtgtg

SEQ ID NO: 150194 - DNA, 20 bp, Artificial Sequence
  chemically synthesized
ggtgaagggcaaaggggagc

SEQ ID NO: 150195 - DNA, 20 bp, Artificial Sequence
  chemically synthesized
tcatggtgaagggcaaaggg

SEQ ID NO: 150196 - DNA, 20 bp, Artificial Sequence
  chemically synthesized
attcatggtgaagggcaaag

SEQ ID NO: 150197 - DNA, 20 bp, Artificial Sequence
  chemically synthesized
cattcatggtgaagggcaaa

SEQ ID NO: 150198 - DNA, 20 bp, Artificial Sequence
  chemically synthesized
ccattcatggtgaagggcaa

SEQ ID NO: 150199 - DNA, 20 bp, Artificial Sequence
  chemically synthesized
tccattcatggtgaagggca

SEQ ID NO: 150200 - DNA, 20 bp, Artificial Sequence
  chemically synthesized
cttcttccattcatggtgaa

SEQ ID NO: 150201 - DNA, 20 bp, Artificial Sequence
  chemically synthesized
gcttcttccattcatggtga

SEQ ID NO: 150202 - DNA, 20 bp, Artificial Sequence
  chemically synthesized
ggcttcttccattcatggtg

SEQ ID NO: 150203 - DNA, 20 bp, Artificial Sequence
  chemically synthesized
cctttgcccttcaccatgaa

SEQ ID NO: 150204 - DNA, 20 bp, Artificial Sequence
  chemically synthesized
ttgcccttcaccatgaatgg

SEQ ID NO: 150205 - DNA, 20 bp, Artificial Sequence
  chemically synthesized
cctcaggcttcttccattca

SEQ ID NO: 150206 - DNA, 20 bp, Artificial Sequence
  chemically synthesized
cccttcaccatgaatggaag

SEQ ID NO: 150207 - DNA, 20 bp, Artificial Sequence
  chemically synthesized
accatgaatggaagaagcct

SEQ ID NO: 150208 - DNA, 20 bp, Artificial Sequence
  chemically synthesized
ccatgaatggaagaagcctg

SEQ ID NO: 150209 - DNA, 20 bp, Artificial Sequence
  chemically synthesized
caacttctcatgagggcctc

SEQ ID NO: 150210 - DNA, 20 bp, Artificial Sequence
  chemically synthesized
ccaacttctcatgagggcct

SEQ ID NO: 150211 - DNA, 20 bp, Artificial Sequence
  chemically synthesized
aagaagcctgaggccctcat

SEQ ID NO: 150212 - DNA, 20 bp, Artificial Sequence
  chemically synthesized
aagcctgaggccctcatgag

SEQ ID NO: 150213 - DNA, 20 bp, Artificial Sequence
  chemically synthesized
ccactaccaacttctcatga

SEQ ID NO: 150214 - DNA, 20 bp, Artificial Sequence
  chemically synthesized
accactaccaacttctcatg

SEQ ID NO: 150215 - DNA, 20 bp, Artificial Sequence
  chemically synthesized
caccactaccaacttctcat

SEQ ID NO: 150216 - DNA, 20 bp, Artificial Sequence
  chemically synthesized
ctgaggccctcatgagaagt

SEQ ID NO: 150217 - DNA, 20 bp, Artificial Sequence
  chemically synthesized
aggccctcatgagaagttgg

SEQ ID NO: 150218 - DNA, 20 bp, Artificial Sequence
  chemically synthesized
ccctcatgagaagttggtag

SEQ ID NO: 150219 - DNA, 20 bp, Artificial Sequence
  chemically synthesized
gcaggctgtacaaaaaagca

SEQ ID NO: 150220 - DNA, 20 bp, Artificial Sequence
  chemically synthesized
tggtgccatgcttttttgta

SEQ ID NO: 150221 - DNA, 20 bp, Artificial Sequence
  chemically synthesized
gttctgcaggctgtacaaaa

SEQ ID NO: 150222 - DNA, 20 bp, Artificial Sequence
  chemically synthesized
atgcttttttgtacagcctg

SEQ ID NO: 150223 - DNA, 20 bp, Artificial Sequence
  chemically synthesized
tatttggctcatggttctgc

SEQ ID NO: 150224 - DNA, 20 bp, Artificial Sequence
  chemically synthesized
ttatttggctcatggttctg

SEQ ID NO: 150225 - DNA, 20 bp, Artificial Sequence
  chemically synthesized
tgtacagcctgcagaaccat

SEQ ID NO: 150226 - DNA, 20 bp, Artificial Sequence
  chemically synthesized
tggaaggtttatttggctca

SEQ ID NO: 150227 - DNA, 20 bp, Artificial Sequence
  chemically synthesized
taaagaatggaaggtttatt

SEQ ID NO: 150228 - DNA, 20 bp, Artificial Sequence
  chemically synthesized
ggcaatttataaagaatgga

SEQ ID NO: 150229 - DNA, 20 bp, Artificial Sequence
  chemically synthesized
gggcaatttataaagaatgg

SEQ ID NO: 150230 - DNA, 20 bp, Artificial Sequence
  chemically synthesized
actgggcaatttataaagaa

SEQ ID NO: 150231 - DNA, 20 bp, Artificial Sequence
  chemically synthesized
cagagactgggcaatttata

SEQ ID NO: 150232 - DNA, 20 bp, Artificial Sequence
  chemically synthesized
tccattctttataaattgcc

SEQ ID NO: 150233 - DNA, 20 bp, Artificial Sequence
  chemically synthesized
tttataaattgcccagtctc

SEQ ID NO: 150234 - DNA, 20 bp, Artificial Sequence
  chemically synthesized
ataaaggaatgccagagact

SEQ ID NO: 150235 - DNA, 20 bp, Artificial Sequence
  chemically synthesized
tataaaggaatgccagagac

SEQ ID NO: 150236 - DNA, 20 bp, Artificial Sequence
  chemically synthesized
gttgctataaaggaatgcca

SEQ ID NO: 150237 - DNA, 20 bp, Artificial Sequence
  chemically synthesized
atgttgctataaaggaatgc

SEQ ID NO: 150238 - DNA, 20 bp, Artificial Sequence
  chemically synthesized
cagtctctggcattccttta

SEQ ID NO: 150239 - DNA, 20 bp, Artificial Sequence
  chemically synthesized
gttcatgtatgttgctataa

SEQ ID NO: 150240 - DNA, 20 bp, Artificial Sequence
  chemically synthesized
tgttcatgtatgttgctata

SEQ ID NO: 150241 - DNA, 20 bp, Artificial Sequence
  chemically synthesized
tatagcaacatacatgaaca

SEQ ID NO: 150242 - DNA, 20 bp, Artificial Sequence
  chemically synthesized
gcaacatacatgaacaaaga

SEQ ID NO: 150243 - DNA, 20 bp, Artificial Sequence
  chemically synthesized
catacatgaacaaagacaga

SEQ ID NO: 150244 - DNA, 20 bp, Artificial Sequence
  chemically synthesized
ttgtggcaaacagcacataa

SEQ ID NO: 150245 - DNA, 20 bp, Artificial Sequence
  chemically synthesized
aaattttttattgtggcaaa

SEQ ID NO: 150246 - DNA, 20 bp, Artificial Sequence
  chemically synthesized
tttttttaaattttttattg

SEQ ID NO: 150247 - DNA, 20 bp, Artificial Sequence
  chemically synthesized
aatttaaaaaaattgacaat

SEQ ID NO: 150248 - DNA, 20 bp, Artificial Sequence
  chemically synthesized
aaaaaaattgacaataagta

SEQ ID NO: 150249 - DNA, 20 bp, Artificial Sequence
  chemically synthesized
aaaaaattgacaataagtac

SEQ ID NO: 150250 - DNA, 20 bp, Artificial Sequence
  chemically synthesized
aattgacaataagtacagga

SEQ ID NO: 150251 - DNA, 20 bp, Artificial Sequence
  chemically synthesized
attgacaataagtacaggat

SEQ ID NO: 150252 - DNA, 20 bp, Artificial Sequence
  chemically synthesized
aataagtacaggataggtga

SEQ ID NO: 150253 - DNA, 20 bp, Artificial Sequence
  chemically synthesized
caggataggtgatggccaat

SEQ ID NO: 150254 - DNA, 20 bp, Artificial Sequence
  chemically synthesized
taggtgatggccaatcagcc

SEQ ID NO: 150255 - DNA, 20 bp, Artificial Sequence
  chemically synthesized
tggccagcatcttggctgat

SEQ ID NO: 150256 - DNA, 20 bp, Artificial Sequence
  chemically synthesized
tggccaatcagccaagatgc

SEQ ID NO: 150257 - DNA, 20 bp, Artificial Sequence
  chemically synthesized
ttgctctatggccagcatct

SEQ ID NO: 150258 - DNA, 20 bp, Artificial Sequence
  chemically synthesized
atcagccaagatgctggcca

SEQ ID NO: 150259 - DNA, 20 bp, Artificial Sequence
  chemically synthesized
cagccaagatgctggccata

SEQ ID NO: 150260 - DNA, 20 bp, Artificial Sequence
  chemically synthesized
agtctgcattgctctatggc

SEQ ID NO: 150261 - DNA, 20 bp, Artificial Sequence
  chemically synthesized
tcctagtctgcattgctcta

SEQ ID NO: 150262 - DNA, 20 bp, Artificial Sequence
  chemically synthesized
atgctggccatagagcaatg

SEQ ID NO: 150263 - DNA, 20 bp, Artificial Sequence
  chemically synthesized
ggccatagagcaatgcagac

SEQ ID NO: 150264 - DNA, 20 bp, Artificial Sequence
  chemically synthesized
gccatagagcaatgcagact

SEQ ID NO: 150265 - DNA, 20 bp, Artificial Sequence
  chemically synthesized
agagcaatgcagactaggaa

SEQ ID NO: 150266 - DNA, 20 bp, Artificial Sequence
  chemically synthesized
gagcaatgcagactaggaat

SEQ ID NO: 150267 - DNA, 20 bp, Artificial Sequence
  chemically synthesized
cctggaagttaacccattcc

SEQ ID NO: 150268 - DNA, 20 bp, Artificial Sequence
  chemically synthesized
actaggaatgggttaacttc

SEQ ID NO: 150269 - DNA, 20 bp, Artificial Sequence
  chemically synthesized
ctaggaatgggttaacttcc

SEQ ID NO: 150270 - DNA, 20 bp, Artificial Sequence
  chemically synthesized
tcagtgttaatatcacctgg

SEQ ID NO: 150271 - DNA, 20 bp, Artificial Sequence
  chemically synthesized
tcttcagtgttaatatcacc

SEQ ID NO: 150272 - DNA, 20 bp, Artificial Sequence
  chemically synthesized
tccaggtgatattaacactg

SEQ ID NO: 150273 - DNA, 20 bp, Artificial Sequence
  chemically synthesized
caggtgatattaacactgaa

SEQ ID NO: 150274 - DNA, 20 bp, Artificial Sequence
  chemically synthesized
aggtgatattaacactgaag

SEQ ID NO: 150275 - DNA, 20 bp, Artificial Sequence
  chemically synthesized
ggtgatattaacactgaaga

SEQ ID NO: 150276 - DNA, 20 bp, Artificial Sequence
  chemically synthesized
ttttccctgttagccctctt

SEQ ID NO: 150277 - DNA, 20 bp, Artificial Sequence
  chemically synthesized
ttaacactgaagagggctaa

SEQ ID NO: 150278 - DNA, 20 bp, Artificial Sequence
  chemically synthesized
taacactgaagagggctaac

SEQ ID NO: 150279 - DNA, 20 bp, Artificial Sequence
  chemically synthesized
aacactgaagagggctaaca

SEQ ID NO: 150280 - DNA, 20 bp, Artificial Sequence
  chemically synthesized
tagtttacttttttccctgt

SEQ ID NO: 150281 - DNA, 20 bp, Artificial Sequence
  chemically synthesized
aagagggctaacagggaaaa

SEQ ID NO: 150282 - DNA, 20 bp, Artificial Sequence
  chemically synthesized
aacagggaaaaaagtaaact

SEQ ID NO: 150283 - DNA, 20 bp, Artificial Sequence
  chemically synthesized
agggaaaaaagtaaactaag

SEQ ID NO: 150284 - DNA, 20 bp, Artificial Sequence
  chemically synthesized
cacttccaaccatttctact

SEQ ID NO: 150285 - DNA, 20 bp, Artificial Sequence
  chemically synthesized
aaaagtaaactaagtagaaa

SEQ ID NO: 150286 - DNA, 20 bp, Artificial Sequence
  chemically synthesized
gtaaactaagtagaaatggt

SEQ ID NO: 150287 - DNA, 20 bp, Artificial Sequence
  chemically synthesized
aactaagtagaaatggttgg

SEQ ID NO: 150288 - DNA, 20 bp, Artificial Sequence
  chemically synthesized
gaaatggttggaagtgacca

SEQ ID NO: 150289 - DNA, 20 bp, Artificial Sequence
  chemically synthesized
aatggttggaagtgaccaca

SEQ ID NO: 150290 - DNA, 20 bp, Artificial Sequence
  chemically synthesized
tggtttttcagtgatctctg

SEQ ID NO: 150291 - DNA, 20 bp, Artificial Sequence
  chemically synthesized
tctggtttggtttggttttt

SEQ ID NO: 150292 - DNA, 20 bp, Artificial Sequence
  chemically synthesized
gcacattctctggtttggtt

SEQ ID NO: 150293 - DNA, 20 bp, Artificial Sequence
  chemically synthesized
actgaaaaaccaaaccaaac

SEQ ID NO: 150294 - DNA, 20 bp, Artificial Sequence
  chemically synthesized
tgaaaaaccaaaccaaacca

SEQ ID NO: 150295 - DNA, 20 bp, Artificial Sequence
  chemically synthesized
agattgcacattctctggtt

SEQ ID NO: 150296 - DNA, 20 bp, Artificial Sequence
  chemically synthesized
ttctgagattgcacattctc

SEQ ID NO: 150297 - DNA, 20 bp, Artificial Sequence
  chemically synthesized
aaccagagaatgtgcaatct

SEQ ID NO: 150298 - DNA, 20 bp, Artificial Sequence
  chemically synthesized
tctctattgtgttagtttct

SEQ ID NO: 150299 - DNA, 20 bp, Artificial Sequence
  chemically synthesized
aatctcagaaactaacacaa

SEQ ID NO: 150300 - DNA, 20 bp, Artificial Sequence
  chemically synthesized
atttaaattctctattgtgt

SEQ ID NO: 150301 - DNA, 20 bp, Artificial Sequence
  chemically synthesized
tctcagaaactaacacaata

SEQ ID NO: 150302 - DNA, 20 bp, Artificial Sequence
  chemically synthesized
acaatagagaatttaaattg

SEQ ID NO: 150303 - DNA, 20 bp, Artificial Sequence
  chemically synthesized
aatagagaatttaaattgaa

SEQ ID NO: 150304 - DNA, 20 bp, Artificial Sequence
  chemically synthesized
atagagaatttaaattgaag

SEQ ID NO: 150305 - DNA, 20 bp, Artificial Sequence
  chemically synthesized
tagagaatttaaattgaaga

SEQ ID NO: 150306 - DNA, 20 bp, Artificial Sequence
  chemically synthesized
gaatttaaattgaagaggga

SEQ ID NO: 150307 - DNA, 20 bp, Artificial Sequence
  chemically synthesized
aatttaaattgaagagggat

SEQ ID NO: 150308 - DNA, 20 bp, Artificial Sequence
  chemically synthesized
gaagagggataggtgatcct

SEQ ID NO: 150309 - DNA, 20 bp, Artificial Sequence
  chemically synthesized
aagagggataggtgatcctt

SEQ ID NO: 150310 - DNA, 20 bp, Artificial Sequence
  chemically synthesized
gggataggtgatccttgggt

SEQ ID NO: 150311 - DNA, 20 bp, Artificial Sequence
  chemically synthesized
cctttaaatagtcttaccca

SEQ ID NO: 150312 - DNA, 20 bp, Artificial Sequence
  chemically synthesized
gcctttaaatagtcttaccc

SEQ ID NO: 150313 - DNA, 20 bp, Artificial Sequence
  chemically synthesized
tccttgggtaagactattta

SEQ ID NO: 150314 - DNA, 20 bp, Artificial Sequence
  chemically synthesized
ccttgggtaagactatttaa

SEQ ID NO: 150315 - DNA, 20 bp, Artificial Sequence
  chemically synthesized
tcaccctcagtgcctttaaa

SEQ ID NO: 150316 - DNA, 20 bp, Artificial Sequence
  chemically synthesized
taagactatttaaaggcact

SEQ ID NO: 150317 - DNA, 20 bp, Artificial Sequence
  chemically synthesized
aagactatttaaaggcactg

SEQ ID NO: 150318 - DNA, 20 bp, Artificial Sequence
  chemically synthesized
agactatttaaaggcactga

SEQ ID NO: 150319 - DNA, 20 bp, Artificial Sequence
  chemically synthesized
tatttaaaggcactgagggt

SEQ ID NO: 150320 - DNA, 20 bp, Artificial Sequence
  chemically synthesized
gggttctgtaatctcaccct

SEQ ID NO: 150321 - DNA, 20 bp, Artificial Sequence
  chemically synthesized
aggcactgagggtgagatta

SEQ ID NO: 150322 - DNA, 20 bp, Artificial Sequence
  chemically synthesized
agggtgagattacagaaccc

SEQ ID NO: 150323 - DNA, 20 bp, Artificial Sequence
  chemically synthesized
gagattacagaaccctagca

SEQ ID NO: 150324 - DNA, 20 bp, Artificial Sequence
  chemically synthesized
agattacagaaccctagcaa

SEQ ID NO: 150325 - DNA, 20 bp, Artificial Sequence
  chemically synthesized
gattacagaaccctagcaaa

SEQ ID NO: 150326 - DNA, 20 bp, Artificial Sequence
  chemically synthesized
aactgttttgccctttgcta

SEQ ID NO: 150327 - DNA, 20 bp, Artificial Sequence
  chemically synthesized
taactgttttgccctttgct

SEQ ID NO: 150328 - DNA, 20 bp, Artificial Sequence
  chemically synthesized
ttaactgttttgccctttgc

SEQ ID NO: 150329 - DNA, 20 bp, Artificial Sequence
  chemically synthesized
aaccctagcaaagggcaaaa

SEQ ID NO: 150330 - DNA, 20 bp, Artificial Sequence
  chemically synthesized
ttaataaataaaatcttgtc

SEQ ID NO: 150331 - DNA, 20 bp, Artificial Sequence
  chemically synthesized
ataaataaaatcttgtccag

SEQ ID NO: 150332 - DNA, 20 bp, Artificial Sequence
  chemically synthesized
ttagtattaatctactggac

SEQ ID NO: 150333 - DNA, 20 bp, Artificial Sequence
  chemically synthesized
cgtaattagtattaatctac

SEQ ID NO: 150334 - DNA, 20 bp, Artificial Sequence
  chemically synthesized
gtattaatttaagacgtaat

SEQ ID NO: 150335 - DNA, 20 bp, Artificial Sequence
  chemically synthesized
cacatggtgagtattaattt

SEQ ID NO: 150336 - DNA, 20 bp, Artificial Sequence
  chemically synthesized
tttaaattgcatcacatggt

SEQ ID NO: 150337 - DNA, 20 bp, Artificial Sequence
  chemically synthesized
gttttttaaattgcatcaca

SEQ ID NO: 150338 - DNA, 20 bp, Artificial Sequence
  chemically synthesized
aaaaaacaattatatttacc

SEQ ID NO: 150339 - DNA, 20 bp, Artificial Sequence
  chemically synthesized
attatatttaccaagaatgt

SEQ ID NO: 150340 - DNA, 20 bp, Artificial Sequence
  chemically synthesized
cacattttacctaacattct

SEQ ID NO: 150341 - DNA, 20 bp, Artificial Sequence
  chemically synthesized
ttatatttaccaagaatgtt

SEQ ID NO: 150342 - DNA, 20 bp, Artificial Sequence
  chemically synthesized
aggtaaaatgtgcataaaaa

SEQ ID NO: 150343 - DNA, 20 bp, Artificial Sequence
  chemically synthesized
aattattaatatattaggtc

SEQ ID NO: 150344 - DNA, 20 bp, Artificial Sequence
  chemically synthesized
gttcaaattattaatatatt

SEQ ID NO: 150345 - DNA, 20 bp, Artificial Sequence
  chemically synthesized
agttcaaattattaatatat

SEQ ID NO: 150346 - DNA, 20 bp, Artificial Sequence
  chemically synthesized
tatattaataatttgaactc

SEQ ID NO: 150347 - DNA, 20 bp, Artificial Sequence
  chemically synthesized
attaataatttgaactcaag

SEQ ID NO: 150348 - DNA, 20 bp, Artificial Sequence
  chemically synthesized
cttactatagtttgcttctt

SEQ ID NO: 150349 - DNA, 20 bp, Artificial Sequence
  chemically synthesized
tgaactcaagaagcaaacta

SEQ ID NO: 150350 - DNA, 20 bp, Artificial Sequence
  chemically synthesized
ctcaagaagcaaactatagt

SEQ ID NO: 150351 - DNA, 20 bp, Artificial Sequence
  chemically synthesized
ctactctgtctttcttacta

SEQ ID NO: 150352 - DNA, 20 bp, Artificial Sequence
  chemically synthesized
agaagcaaactatagtaaga

SEQ ID NO: 150353 - DNA, 20 bp, Artificial Sequence
  chemically synthesized
gcaaactatagtaagaaaga

SEQ ID NO: 150354 - DNA, 20 bp, Artificial Sequence
  chemically synthesized
aaactatagtaagaaagaca

SEQ ID NO: 150355 - DNA, 20 bp, Artificial Sequence
  chemically synthesized
ctatagtaagaaagacagag

SEQ ID NO: 150356 - DNA, 20 bp, Artificial Sequence
  chemically synthesized
agtaagaaagacagagtaga

SEQ ID NO: 150357 - DNA, 20 bp, Artificial Sequence
  chemically synthesized
agacagagtagaaagttttc

SEQ ID NO: 150358 - DNA, 20 bp, Artificial Sequence
  chemically synthesized
gtagaaagttttcaagtcaa

SEQ ID NO: 150359 - DNA, 20 bp, Artificial Sequence
  chemically synthesized
ttcaagtcaatggattactg

SEQ ID NO: 150360 - DNA, 20 bp, Artificial Sequence
  chemically synthesized
caagtcaatggattactgaa

SEQ ID NO: 150361 - DNA, 20 bp, Artificial Sequence
  chemically synthesized
tgcctgtcacatgtactctt

SEQ ID NO: 150362 - DNA, 20 bp, Artificial Sequence
  chemically synthesized
ttactgaagagtacatgtga

SEQ ID NO: 150363 - DNA, 20 bp, Artificial Sequence
  chemically synthesized
tactgaagagtacatgtgac

SEQ ID NO: 150364 - DNA, 20 bp, Artificial Sequence
  chemically synthesized
tgtgacaggcaaataaacac

SEQ ID NO: 150365 - DNA, 20 bp, Artificial Sequence
  chemically synthesized
gacaggcaaataaacactgg

SEQ ID NO: 150366 - DNA, 20 bp, Artificial Sequence
  chemically synthesized
tccttaatatatttatctac

SEQ ID NO: 150367 - DNA, 20 bp, Artificial Sequence
  chemically synthesized
cactggtagataaatatatt

SEQ ID NO: 150368 - DNA, 20 bp, Artificial Sequence
  chemically synthesized
actggtagataaatatatta

SEQ ID NO: 150369 - DNA, 20 bp, Artificial Sequence
  chemically synthesized
gataaatatattaaggaatt

SEQ ID NO: 150370 - DNA, 20 bp, Artificial Sequence
  chemically synthesized
taaatatattaaggaatttg

SEQ ID NO: 150371 - DNA, 20 bp, Artificial Sequence
  chemically synthesized
atatattaaggaatttggag

SEQ ID NO: 150372 - DNA, 20 bp, Artificial Sequence
  chemically synthesized
tattaaggaatttggagtgg

SEQ ID NO: 150373 - DNA, 20 bp, Artificial Sequence
  chemically synthesized
ttgtcatcctatatgtcaga

SEQ ID NO: 150374 - DNA, 20 bp, Artificial Sequence
  chemically synthesized
ggcagattctttctgacata

SEQ ID NO: 150375 - DNA, 20 bp, Artificial Sequence
  chemically synthesized
gcagattctttctgacatat

SEQ ID NO: 150376 - DNA, 20 bp, Artificial Sequence
  chemically synthesized
ttctttgtcatcctatatgt

SEQ ID NO: 150377 - DNA, 20 bp, Artificial Sequence
  chemically synthesized
ttctgacatataggatgaca

SEQ ID NO: 150378 - DNA, 20 bp, Artificial Sequence
  chemically synthesized
acaaagaatgtaaaaaatga

SEQ ID NO: 150379 - DNA, 20 bp, Artificial Sequence
  chemically synthesized
gaatgtaaaaaatgaaagac

SEQ ID NO: 150380 - DNA, 20 bp, Artificial Sequence
  chemically synthesized
atctcctctgatttttgttc

SEQ ID NO: 150381 - DNA, 20 bp, Artificial Sequence
  chemically synthesized
tgaaagactggaacaaaaat

SEQ ID NO: 150382 - DNA, 20 bp, Artificial Sequence
  chemically synthesized
aaagactggaacaaaaatca

SEQ ID NO: 150383 - DNA, 20 bp, Artificial Sequence
  chemically synthesized
aagactggaacaaaaatcag

SEQ ID NO: 150384 - DNA, 20 bp, Artificial Sequence
  chemically synthesized
gactggaacaaaaatcagag

SEQ ID NO: 150385 - DNA, 20 bp, Artificial Sequence
  chemically synthesized
gaacaaaaatcagaggagat

SEQ ID NO: 150386 - DNA, 20 bp, Artificial Sequence
  chemically synthesized
aacaaaaatcagaggagata

SEQ ID NO: 150387 - DNA, 20 bp, Artificial Sequence
  chemically synthesized
acaaaaatcagaggagataa

SEQ ID NO: 150388 - DNA, 20 bp, Artificial Sequence
  chemically synthesized
gaggagataagggacatata

SEQ ID NO: 150389 - DNA, 20 bp, Artificial Sequence
  chemically synthesized
gacatataaagtgaaatata

SEQ ID NO: 150390 - DNA, 20 bp, Artificial Sequence
  chemically synthesized
taaagtgaaatataaagaac

SEQ ID NO: 150391 - DNA, 20 bp, Artificial Sequence
  chemically synthesized
aaagtgaaatataaagaacc

SEQ ID NO: 150392 - DNA, 20 bp, Artificial Sequence
  chemically synthesized
gtgaaatataaagaaccagg

SEQ ID NO: 150393 - DNA, 20 bp, Artificial Sequence
  chemically synthesized
ttaccacctataaatcttcc

SEQ ID NO: 150394 - DNA, 20 bp, Artificial Sequence
  chemically synthesized
taaagaaccaggaagattta

SEQ ID NO: 150395 - DNA, 20 bp, Artificial Sequence
  chemically synthesized
aaagaaccaggaagatttat

SEQ ID NO: 150396 - DNA, 20 bp, Artificial Sequence
  chemically synthesized
gaaccaggaagatttatagg

SEQ ID NO: 150397 - DNA, 20 bp, Artificial Sequence
  chemically synthesized
caggaagatttataggtggt

SEQ ID NO: 150398 - DNA, 20 bp, Artificial Sequence
  chemically synthesized
gatttataggtggtaagaat

SEQ ID NO: 150399 - DNA, 20 bp, Artificial Sequence
  chemically synthesized
ttataggtggtaagaattgg

SEQ ID NO: 150400 - DNA, 20 bp, Artificial Sequence
  chemically synthesized
aagaattggaagtgaccaac

SEQ ID NO: 150401 - DNA, 20 bp, Artificial Sequence
  chemically synthesized
tttgttttcttgaaaccagt

SEQ ID NO: 150402 - DNA, 20 bp, Artificial Sequence
  chemically synthesized
ggaagtgaccaactggtttc

SEQ ID NO: 150403 - DNA, 20 bp, Artificial Sequence
  chemically synthesized
attctttgttttcttgaaac

SEQ ID NO: 150404 - DNA, 20 bp, Artificial Sequence
  chemically synthesized
caactggtttcaagaaaaca

SEQ ID NO: 150405 - DNA, 20 bp, Artificial Sequence
  chemically synthesized
tcaagaaaacaaagaatctt

SEQ ID NO: 150406 - DNA, 20 bp, Artificial Sequence
  chemically synthesized
gaaaacaaagaatcttcagt

SEQ ID NO: 150407 - DNA, 20 bp, Artificial Sequence
  chemically synthesized
aaacaaagaatcttcagtga

SEQ ID NO: 150408 - DNA, 20 bp, Artificial Sequence
  chemically synthesized
aacaaagaatcttcagtgag

SEQ ID NO: 150409 - DNA, 20 bp, Artificial Sequence
  chemically synthesized
gtcttcagctcctctcactg

SEQ ID NO: 150410 - DNA, 20 bp, Artificial Sequence
  chemically synthesized
caaagaatcttcagtgagag

SEQ ID NO: 150411 - DNA, 20 bp, Artificial Sequence
  chemically synthesized
atcttcagtgagaggagctg

SEQ ID NO: 150412 - DNA, 20 bp, Artificial Sequence
  chemically synthesized
tcagtgagaggagctgaaga

SEQ ID NO: 150413 - DNA, 20 bp, Artificial Sequence
  chemically synthesized
cagtgagaggagctgaagac

SEQ ID NO: 150414 - DNA, 20 bp, Artificial Sequence
  chemically synthesized
tgccacatcacgcctgtctt

SEQ ID NO: 150415 - DNA, 20 bp, Artificial Sequence
  chemically synthesized
agctgaagacaggcgtgatg

SEQ ID NO: 150416 - DNA, 20 bp, Artificial Sequence
  chemically synthesized
gatgtggcaacctccaaaaa

SEQ ID NO: 150417 - DNA, 20 bp, Artificial Sequence
  chemically synthesized
cactttaagtctttttttgg

SEQ ID NO: 150418 - DNA, 20 bp, Artificial Sequence
  chemically synthesized
tcactttaagtctttttttg

SEQ ID NO: 150419 - DNA, 20 bp, Artificial Sequence
  chemically synthesized
attcactttaagtctttttt

SEQ ID NO: 150420 - DNA, 20 bp, Artificial Sequence
  chemically synthesized
aacctccaaaaaaagactta

SEQ ID NO: 150421 - DNA, 20 bp, Artificial Sequence
  chemically synthesized
gtagcggaaaaattcacttt

SEQ ID NO: 150422 - DNA, 20 bp, Artificial Sequence
  chemically synthesized
acaaaaaaatattgcagtag

SEQ ID NO: 150423 - DNA, 20 bp, Artificial Sequence
  chemically synthesized
agaacaaaaaaatattgcag

SEQ ID NO: 150424 - DNA, 20 bp, Artificial Sequence
  chemically synthesized
ttgagaacaaaaaaatattg

SEQ ID NO: 150425 - DNA, 20 bp, Artificial Sequence
  chemically synthesized
gaaaagcaaaaatattgttt

SEQ ID NO: 150426 - DNA, 20 bp, Artificial Sequence
  chemically synthesized
tatttccacctataaaagaa

SEQ ID NO: 150427 - DNA, 20 bp, Artificial Sequence
  chemically synthesized
atatttttgcttttctttta

SEQ ID NO: 150428 - DNA, 20 bp, Artificial Sequence
  chemically synthesized
tatttttgcttttcttttat

SEQ ID NO: 150429 - DNA, 20 bp, Artificial Sequence
  chemically synthesized
ttttgcttttcttttatagg

SEQ ID NO: 150430 - DNA, 20 bp, Artificial Sequence
  chemically synthesized
ctcactatttccacctataa

SEQ ID NO: 150431 - DNA, 20 bp, Artificial Sequence
  chemically synthesized
ttttcttttataggtggaaa

SEQ ID NO: 150432 - DNA, 20 bp, Artificial Sequence
  chemically synthesized
cttttataggtggaaatagt

SEQ ID NO: 150433 - DNA, 20 bp, Artificial Sequence
  chemically synthesized
ttttataggtggaaatagtg

SEQ ID NO: 150434 - DNA, 20 bp, Artificial Sequence
  chemically synthesized
ggtggaaatagtgaggatga

SEQ ID NO: 150435 - DNA, 20 bp, Artificial Sequence
  chemically synthesized
gaggatgatagtacactgaa

SEQ ID NO: 150436 - DNA, 20 bp, Artificial Sequence
  chemically synthesized
agaaccatgaaatgtctttt

SEQ ID NO: 150437 - DNA, 20 bp, Artificial Sequence
  chemically synthesized
tacactgaaaagacatttca

SEQ ID NO: 150438 - DNA, 20 bp, Artificial Sequence
  chemically synthesized
atattttacaatttgaatgt

SEQ ID NO: 150439 - DNA, 20 bp, Artificial Sequence
  chemically synthesized
attcaaattgtaaaatatat

SEQ ID NO: 150440 - DNA, 20 bp, Artificial Sequence
  chemically synthesized
ttcaaattgtaaaatatatc

SEQ ID NO: 150441 - DNA, 20 bp, Artificial Sequence
  chemically synthesized
gaaattttaaaagggggatg

SEQ ID NO: 150442 - DNA, 20 bp, Artificial Sequence
  chemically synthesized
accatagaaattttaaaagg

SEQ ID NO: 150443 - DNA, 20 bp, Artificial Sequence
  chemically synthesized
taccatagaaattttaaaag

SEQ ID NO: 150444 - DNA, 20 bp, Artificial Sequence
  chemically synthesized
gtaccatagaaattttaaaa

SEQ ID NO: 150445 - DNA, 20 bp, Artificial Sequence
  chemically synthesized
agtaccatagaaattttaaa

SEQ ID NO: 150446 - DNA, 20 bp, Artificial Sequence
  chemically synthesized
aagtaccatagaaattttaa

SEQ ID NO: 150447 - DNA, 20 bp, Artificial Sequence
  chemically synthesized
tcccccttttaaaatttcta

SEQ ID NO: 150448 - DNA, 20 bp, Artificial Sequence
  chemically synthesized
tttgagactcaaaagtacca

SEQ ID NO: 150449 - DNA, 20 bp, Artificial Sequence
  chemically synthesized
aaaatttctatggtactttt

SEQ ID NO: 150450 - DNA, 20 bp, Artificial Sequence
  chemically synthesized
cccttgattttgagactcaa

SEQ ID NO: 150451 - DNA, 20 bp, Artificial Sequence
  chemically synthesized
tacttttgagtctcaaaatc

SEQ ID NO: 150452 - DNA, 20 bp, Artificial Sequence
  chemically synthesized
acttttgagtctcaaaatca

SEQ ID NO: 150453 - DNA, 20 bp, Artificial Sequence
  chemically synthesized
attagttttcccttgatttt

SEQ ID NO: 150454 - DNA, 20 bp, Artificial Sequence
  chemically synthesized
cttttgagtctcaaaatcaa

SEQ ID NO: 150455 - DNA, 20 bp, Artificial Sequence
  chemically synthesized
tgtatgagcttcaaaagtat

SEQ ID NO: 150456 - DNA, 20 bp, Artificial Sequence
  chemically synthesized
agggaaaactaatacttttg

SEQ ID NO: 150457 - DNA, 20 bp, Artificial Sequence
  chemically synthesized
aaaaactgtatgagcttcaa

SEQ ID NO: 150458 - DNA, 20 bp, Artificial Sequence
  chemically synthesized
taatacttttgaagctcata

SEQ ID NO: 150459 - DNA, 20 bp, Artificial Sequence
  chemically synthesized
ttctagaacaaaaactgtat

SEQ ID NO: 150460 - DNA, 20 bp, Artificial Sequence
  chemically synthesized
agctcatacagtttttgttc

SEQ ID NO: 150461 - DNA, 20 bp, Artificial Sequence
  chemically synthesized
tcatacagtttttgttctag

SEQ ID NO: 150462 - DNA, 20 bp, Artificial Sequence
  chemically synthesized
cacaaaaaagacaaaacttc

SEQ ID NO: 150463 - DNA, 20 bp, Artificial Sequence
  chemically synthesized
agaagttttgtcttttttgt

SEQ ID NO: 150464 - DNA, 20 bp, Artificial Sequence
  chemically synthesized
gtaaatttatgctcacaaaa

SEQ ID NO: 150465 - DNA, 20 bp, Artificial Sequence
  chemically synthesized
tttgtgagcataaatttacc

SEQ ID NO: 150466 - DNA, 20 bp, Artificial Sequence
  chemically synthesized
gtgagcataaatttacccag

SEQ ID NO: 150467 - DNA, 20 bp, Artificial Sequence
  chemically synthesized
tgagcataaatttacccagt

SEQ ID NO: 150468 - DNA, 20 bp, Artificial Sequence
  chemically synthesized
atcttcttcctgaacccact

SEQ ID NO: 150469 - DNA, 20 bp, Artificial Sequence
  chemically synthesized
ataaatttacccagtgggtt

SEQ ID NO: 150470 - DNA, 20 bp, Artificial Sequence
  chemically synthesized
catcttcttcctgaacccac

SEQ ID NO: 150471 - DNA, 20 bp, Artificial Sequence
  chemically synthesized
taaatttacccagtgggttc

SEQ ID NO: 150472 - DNA, 20 bp, Artificial Sequence
  chemically synthesized
atttacccagtgggttcagg

SEQ ID NO: 150473 - DNA, 20 bp, Artificial Sequence
  chemically synthesized
tacccagtgggttcaggaag

SEQ ID NO: 150474 - DNA, 20 bp, Artificial Sequence
  chemically synthesized
agtgggttcaggaagaagat

SEQ ID NO: 150475 - DNA, 20 bp, Artificial Sequence
  chemically synthesized
atgagtatttttttttttca

SEQ ID NO: 150476 - DNA, 20 bp, Artificial Sequence
  chemically synthesized
tttttttcaaagcaaacaac

SEQ ID NO: 150477 - DNA, 20 bp, Artificial Sequence
  chemically synthesized
tttcaaagcaaacaacgaga

SEQ ID NO: 150478 - DNA, 20 bp, Artificial Sequence
  chemically synthesized
caaagcaaacaacgagacag

SEQ ID NO: 150479 - DNA, 20 bp, Artificial Sequence
  chemically synthesized
aaagcaaacaacgagacagc

SEQ ID NO: 150480 - DNA, 20 bp, Artificial Sequence
  chemically synthesized
agcaaacaacgagacagcag

SEQ ID NO: 150481 - DNA, 20 bp, Artificial Sequence
  chemically synthesized
gcaaacaacgagacagcagg

SEQ ID NO: 150482 - DNA, 20 bp, Artificial Sequence
  chemically synthesized
acgagacagcaggaggttga

SEQ ID NO: 150483 - DNA, 20 bp, Artificial Sequence
  chemically synthesized
gaggttgaaagttctccaca

SEQ ID NO: 150484 - DNA, 20 bp, Artificial Sequence
  chemically synthesized
ggttgaaagttctccacatg

SEQ ID NO: 150485 - DNA, 20 bp, Artificial Sequence
  chemically synthesized
ttgagtgacaactccatgtg

SEQ ID NO: 150486 - DNA, 20 bp, Artificial Sequence
  chemically synthesized
gcttgagtgacaactccatg

SEQ ID NO: 150487 - DNA, 20 bp, Artificial Sequence
  chemically synthesized
tccacatggagttgtcactc

SEQ ID NO: 150488 - DNA, 20 bp, Artificial Sequence
  chemically synthesized
tgattttgatgtcagtgctt

SEQ ID NO: 150489 - DNA, 20 bp, Artificial Sequence
  chemically synthesized
cttttcattgattttgatgt

SEQ ID NO: 150490 - DNA, 20 bp, Artificial Sequence
  chemically synthesized
ctgacatcaaaatcaatgaa

SEQ ID NO: 150491 - DNA, 20 bp, Artificial Sequence
  chemically synthesized
acatcaaaatcaatgaaaag

SEQ ID NO: 150492 - DNA, 20 bp, Artificial Sequence
  chemically synthesized
aaatcaatgaaaagtggctc

SEQ ID NO: 150493 - DNA, 20 bp, Artificial Sequence
  chemically synthesized
ttatacttagcacaagactg

SEQ ID NO: 150494 - DNA, 20 bp, Artificial Sequence
  chemically synthesized
aattatacttagcacaagac

SEQ ID NO: 150495 - DNA, 20 bp, Artificial Sequence
  chemically synthesized
agtggctccagtcttgtgct

SEQ ID NO: 150496 - DNA, 20 bp, Artificial Sequence
  chemically synthesized
ctacaaattatacttagcac

SEQ ID NO: 150497 - DNA, 20 bp, Artificial Sequence
  chemically synthesized
tctctgctacaaattatact

SEQ ID NO: 150498 - DNA, 20 bp, Artificial Sequence
  chemically synthesized
cttgtgctaagtataatttg

SEQ ID NO: 150499 - DNA, 20 bp, Artificial Sequence
  chemically synthesized
gtgctaagtataatttgtag

SEQ ID NO: 150500 - DNA, 20 bp, Artificial Sequence
  chemically synthesized
gctaagtataatttgtagca

SEQ ID NO: 150501 - DNA, 20 bp, Artificial Sequence
  chemically synthesized
taagtataatttgtagcaga

SEQ ID NO: 150502 - DNA, 20 bp, Artificial Sequence
  chemically synthesized
aagtataatttgtagcagag

SEQ ID NO: 150503 - DNA, 20 bp, Artificial Sequence
  chemically synthesized
tataatttgtagcagagagg

SEQ ID NO: 150504 - DNA, 20 bp, Artificial Sequence
  chemically synthesized
atttgtagcagagaggaagt

SEQ ID NO: 150505 - DNA, 20 bp, Artificial Sequence
  chemically synthesized
ttgtagcagagaggaagttg

SEQ ID NO: 150506 - DNA, 20 bp, Artificial Sequence
  chemically synthesized
tgtagcagagaggaagttgg

SEQ ID NO: 150507 - DNA, 20 bp, Artificial Sequence
  chemically synthesized
cagagaggaagttggaggca

SEQ ID NO: 150508 - DNA, 20 bp, Artificial Sequence
  chemically synthesized
ggaagttggaggcaaagtgt

SEQ ID NO: 150509 - DNA, 20 bp, Artificial Sequence
  chemically synthesized
gaagttggaggcaaagtgtg

SEQ ID NO: 150510 - DNA, 20 bp, Artificial Sequence
  chemically synthesized
agttggaggcaaagtgtgag

SEQ ID NO: 150511 - DNA, 20 bp, Artificial Sequence
  chemically synthesized
tggaggcaaagtgtgaggag

SEQ ID NO: 150512 - DNA, 20 bp, Artificial Sequence
  chemically synthesized
gaggcaaagtgtgaggagaa

SEQ ID NO: 150513 - DNA, 20 bp, Artificial Sequence
  chemically synthesized
ggcaaagtgtgaggagaaga

SEQ ID NO: 150514 - DNA, 20 bp, Artificial Sequence
  chemically synthesized
agtgtgaggagaagagagct

SEQ ID NO: 150515 - DNA, 20 bp, Artificial Sequence
  chemically synthesized
gagaagagagctgagaaaaa

SEQ ID NO: 150516 - DNA, 20 bp, Artificial Sequence
  chemically synthesized
atctgactatctatttttct

SEQ ID NO: 150517 - DNA, 20 bp, Artificial Sequence
  chemically synthesized
agagagctgagaaaaataga

SEQ ID NO: 150518 - DNA, 20 bp, Artificial Sequence
  chemically synthesized
agctgagaaaaatagatagt

SEQ ID NO: 150519 - DNA, 20 bp, Artificial Sequence
  chemically synthesized
aaaatagatagtcagatatt

SEQ ID NO: 150520 - DNA, 20 bp, Artificial Sequence
  chemically synthesized
agtcagatattcagcaaaca

SEQ ID NO: 150521 - DNA, 20 bp, Artificial Sequence
  chemically synthesized
gtcagatattcagcaaacac

SEQ ID NO: 150522 - DNA, 20 bp, Artificial Sequence
  chemically synthesized
tcagatattcagcaaacaca

SEQ ID NO: 150523 - DNA, 20 bp, Artificial Sequence
  chemically synthesized
cagatattcagcaaacacag

SEQ ID NO: 150524 - DNA, 20 bp, Artificial Sequence
  chemically synthesized
cagcaaacacaggggaaata

SEQ ID NO: 150525 - DNA, 20 bp, Artificial Sequence
  chemically synthesized
gcaaacacaggggaaataaa

SEQ ID NO: 150526 - DNA, 20 bp, Artificial Sequence
  chemically synthesized
caaacacaggggaaataaag

SEQ ID NO: 150527 - DNA, 20 bp, Artificial Sequence
  chemically synthesized
ataaagaggaataaacccta

SEQ ID NO: 150528 - DNA, 20 bp, Artificial Sequence
  chemically synthesized
agaggaataaaccctaaagt

SEQ ID NO: 150529 - DNA, 20 bp, Artificial Sequence
  chemically synthesized
ggatcattttgccaacttta

SEQ ID NO: 150530 - DNA, 20 bp, Artificial Sequence
  chemically synthesized
tggatcattttgccaacttt

SEQ ID NO: 150531 - DNA, 20 bp, Artificial Sequence
  chemically synthesized
ttggatcattttgccaactt

SEQ ID NO: 150532 - DNA, 20 bp, Artificial Sequence
  chemically synthesized
acttcattccatttggaatt

SEQ ID NO: 150533 - DNA, 20 bp, Artificial Sequence
  chemically synthesized
aaaatgatccaaattccaaa

SEQ ID NO: 150534 - DNA, 20 bp, Artificial Sequence
  chemically synthesized
tttttttacttcattccatt

SEQ ID NO: 150535 - DNA, 20 bp, Artificial Sequence
  chemically synthesized
tccaaattccaaatggaatg

SEQ ID NO: 150536 - DNA, 20 bp, Artificial Sequence
  chemically synthesized
tgaagtaaaaaaaaaaaaaa

SEQ ID NO: 150537 - DNA, 20 bp, Artificial Sequence
  chemically synthesized
agtaaaaaaaaaaaaaaaag

SEQ ID NO: 150538 - DNA, 20 bp, Artificial Sequence
  chemically synthesized
aaaaaaaaaaaaaaaagtgg

SEQ ID NO: 150539 - DNA, 20 bp, Artificial Sequence
  chemically synthesized
aaaaaagtggcagcaccatg

SEQ ID NO: 150540 - DNA, 20 bp, Artificial Sequence
  chemically synthesized
ccagtgatgtttgcactaca

SEQ ID NO: 150541 - DNA, 20 bp, Artificial Sequence
  chemically synthesized
ccatgtagtgcaaacatcac

SEQ ID NO: 150542 - DNA, 20 bp, Artificial Sequence
  chemically synthesized
agtgcaaacatcactggact

SEQ ID NO: 150543 - DNA, 20 bp, Artificial Sequence
  chemically synthesized
ttgtcaaatgattctcagtc

SEQ ID NO: 150544 - DNA, 20 bp, Artificial Sequence
  chemically synthesized
gtctgttgtcaaatgattct

SEQ ID NO: 150545 - DNA, 20 bp, Artificial Sequence
  chemically synthesized
gactgagaatcatttgacaa

SEQ ID NO: 150546 - DNA, 20 bp, Artificial Sequence
  chemically synthesized
tcatttgacaacagacactc

SEQ ID NO: 150547 - DNA, 20 bp, Artificial Sequence
  chemically synthesized
catttgacaacagacactct

SEQ ID NO: 150548 - DNA, 20 bp, Artificial Sequence
  chemically synthesized
tttgacaacagacactctgg

SEQ ID NO: 150549 - DNA, 20 bp, Artificial Sequence
  chemically synthesized
ccagatcaagtagactccca

SEQ ID NO: 150550 - DNA, 20 bp, Artificial Sequence
  chemically synthesized
gcccagatcaagtagactcc

SEQ ID NO: 150551 - DNA, 20 bp, Artificial Sequence
  chemically synthesized
ctctgggagtctacttgatc

SEQ ID NO: 150552 - DNA, 20 bp, Artificial Sequence
  chemically synthesized
agaatggtgcccagatcaag

SEQ ID NO: 150553 - DNA, 20 bp, Artificial Sequence
  chemically synthesized
tctgggagtctacttgatct

SEQ ID NO: 150554 - DNA, 20 bp, Artificial Sequence
  chemically synthesized
cctagaatggtgcccagatc

SEQ ID NO: 150555 - DNA, 20 bp, Artificial Sequence
  chemically synthesized
ccagtgcctagaatggtgcc

SEQ ID NO: 150556 - DNA, 20 bp, Artificial Sequence
  chemically synthesized
acttgatctgggcaccattc

SEQ ID NO: 150557 - DNA, 20 bp, Artificial Sequence
  chemically synthesized
cttgatctgggcaccattct

SEQ ID NO: 150558 - DNA, 20 bp, Artificial Sequence
  chemically synthesized
tgtactcccagtgcctagaa

SEQ ID NO: 150559 - DNA, 20 bp, Artificial Sequence
  chemically synthesized
ctgggcaccattctaggcac

SEQ ID NO: 150560 - DNA, 20 bp, Artificial Sequence
  chemically synthesized
tgggcaccattctaggcact

SEQ ID NO: 150561 - DNA, 20 bp, Artificial Sequence
  chemically synthesized
accactgtactcccagtgcc

SEQ ID NO: 150562 - DNA, 20 bp, Artificial Sequence
  chemically synthesized
ggcaccattctaggcactgg

SEQ ID NO: 150563 - DNA, 20 bp, Artificial Sequence
  chemically synthesized
cattctaggcactgggagta

SEQ ID NO: 150564 - DNA, 20 bp, Artificial Sequence
  chemically synthesized
cacatttaccactgtactcc

SEQ ID NO: 150565 - DNA, 20 bp, Artificial Sequence
  chemically synthesized
tctaggcactgggagtacag

SEQ ID NO: 150566 - DNA, 20 bp, Artificial Sequence
  chemically synthesized
tgggagtacagtggtaaatg

SEQ ID NO: 150567 - DNA, 20 bp, Artificial Sequence
  chemically synthesized
gtacagtggtaaatgtggca

SEQ ID NO: 150568 - DNA, 20 bp, Artificial Sequence
  chemically synthesized
tacagtggtaaatgtggcac

SEQ ID NO: 150569 - DNA, 20 bp, Artificial Sequence
  chemically synthesized
ggtaaatgtggcacaggcaa

SEQ ID NO: 150570 - DNA, 20 bp, Artificial Sequence
  chemically synthesized
tggcacaggcaatggcctca

SEQ ID NO: 150571 - DNA, 20 bp, Artificial Sequence
  chemically synthesized
atcacaatataaattccatg

SEQ ID NO: 150572 - DNA, 20 bp, Artificial Sequence
  chemically synthesized
tatcacaatataaattccat

SEQ ID NO: 150573 - DNA, 20 bp, Artificial Sequence
  chemically synthesized
atggaatttatattgtgata

SEQ ID NO: 150574 - DNA, 20 bp, Artificial Sequence
  chemically synthesized
atttatattgtgatatagaa

SEQ ID NO: 150575 - DNA, 20 bp, Artificial Sequence
  chemically synthesized
ttatattgtgatatagaaaa

SEQ ID NO: 150576 - DNA, 20 bp, Artificial Sequence
  chemically synthesized
attgtgatatagaaaagaga

SEQ ID NO: 150577 - DNA, 20 bp, Artificial Sequence
  chemically synthesized
ttgtgatatagaaaagagac

SEQ ID NO: 150578 - DNA, 20 bp, Artificial Sequence
  chemically synthesized
atatacatttaacatcattt

SEQ ID NO: 150579 - DNA, 20 bp, Artificial Sequence
  chemically synthesized
catcattttagattatatga

SEQ ID NO: 150580 - DNA, 20 bp, Artificial Sequence
  chemically synthesized
atcattttagattatatgaa

SEQ ID NO: 150581 - DNA, 20 bp, Artificial Sequence
  chemically synthesized
attttagattatatgaaagg

SEQ ID NO: 150582 - DNA, 20 bp, Artificial Sequence
  chemically synthesized
agattatatgaaaggcagta

SEQ ID NO: 150583 - DNA, 20 bp, Artificial Sequence
  chemically synthesized
tgaaaggcagtaaagcaaaa

SEQ ID NO: 150584 - DNA, 20 bp, Artificial Sequence
  chemically synthesized
aaaggcagtaaagcaaaaca

SEQ ID NO: 150585 - DNA, 20 bp, Artificial Sequence
  chemically synthesized
gcagtaaagcaaaacagagc

SEQ ID NO: 150586 - DNA, 20 bp, Artificial Sequence
  chemically synthesized
cagtaaagcaaaacagagcc

SEQ ID NO: 150587 - DNA, 20 bp, Artificial Sequence
  chemically synthesized
gcaaaacagagccaggaaaa

SEQ ID NO: 150588 - DNA, 20 bp, Artificial Sequence
  chemically synthesized
tcactctcttacttttttcc

SEQ ID NO: 150589 - DNA, 20 bp, Artificial Sequence
  chemically synthesized
aacagagccaggaaaaaagt

SEQ ID NO: 150590 - DNA, 20 bp, Artificial Sequence
  chemically synthesized
cagagccaggaaaaaagtaa

SEQ ID NO: 150591 - DNA, 20 bp, Artificial Sequence
  chemically synthesized
gagccaggaaaaaagtaaga

SEQ ID NO: 150592 - DNA, 20 bp, Artificial Sequence
  chemically synthesized
caggaaaaaagtaagagagt

SEQ ID NO: 150593 - DNA, 20 bp, Artificial Sequence
  chemically synthesized
ggaaaaaagtaagagagtga

SEQ ID NO: 150594 - DNA, 20 bp, Artificial Sequence
  chemically synthesized
gaaaaaagtaagagagtgag

SEQ ID NO: 150595 - DNA, 20 bp, Artificial Sequence
  chemically synthesized
aaaaaagtaagagagtgaga

SEQ ID NO: 150596 - DNA, 20 bp, Artificial Sequence
  chemically synthesized
taagagagtgagagggttgc

SEQ ID NO: 150597 - DNA, 20 bp, Artificial Sequence
  chemically synthesized
agagtgagagggttgcaagt

SEQ ID NO: 150598 - DNA, 20 bp, Artificial Sequence
  chemically synthesized
gagtgagagggttgcaagtt

SEQ ID NO: 150599 - DNA, 20 bp, Artificial Sequence
  chemically synthesized
gagagggttgcaagttgggc

SEQ ID NO: 150600 - DNA, 20 bp, Artificial Sequence
  chemically synthesized
agagggttgcaagttgggct

SEQ ID NO: 150601 - DNA, 20 bp, Artificial Sequence
  chemically synthesized
gagggttgcaagttgggcta

SEQ ID NO: 150602 - DNA, 20 bp, Artificial Sequence
  chemically synthesized
ggctagtttttcatagaccc

SEQ ID NO: 150603 - DNA, 20 bp, Artificial Sequence
  chemically synthesized
agctaagggctagtttttca

SEQ ID NO: 150604 - DNA, 20 bp, Artificial Sequence
  chemically synthesized
ggctagggtctatgaaaaac

SEQ ID NO: 150605 - DNA, 20 bp, Artificial Sequence
  chemically synthesized
gtctatgaaaaactagccct

SEQ ID NO: 150606 - DNA, 20 bp, Artificial Sequence
  chemically synthesized
cttcataatgagctaagggc

SEQ ID NO: 150607 - DNA, 20 bp, Artificial Sequence
  chemically synthesized
aaaccttcataatgagctaa

SEQ ID NO: 150608 - DNA, 20 bp, Artificial Sequence
  chemically synthesized
caaaccttcataatgagcta

SEQ ID NO: 150609 - DNA, 20 bp, Artificial Sequence
  chemically synthesized
ccaaaccttcataatgagct

SEQ ID NO: 150610 - DNA, 20 bp, Artificial Sequence
  chemically synthesized
ctagcccttagctcattatg

SEQ ID NO: 150611 - DNA, 20 bp, Artificial Sequence
  chemically synthesized
tagcccttagctcattatga

SEQ ID NO: 150612 - DNA, 20 bp, Artificial Sequence
  chemically synthesized
ctcatccaaaccttcataat

SEQ ID NO: 150613 - DNA, 20 bp, Artificial Sequence
  chemically synthesized
cttagctcattatgaaggtt

SEQ ID NO: 150614 - DNA, 20 bp, Artificial Sequence
  chemically synthesized
ctcattatgaaggtttggat

SEQ ID NO: 150615 - DNA, 20 bp, Artificial Sequence
  chemically synthesized
aggaaatttagagggataaa

SEQ ID NO: 150616 - DNA, 20 bp, Artificial Sequence
  chemically synthesized
gggagctaaggaaatttaga

SEQ ID NO: 150617 - DNA, 20 bp, Artificial Sequence
  chemically synthesized
ggggagctaaggaaatttag

SEQ ID NO: 150618 - DNA, 20 bp, Artificial Sequence
  chemically synthesized
aggggagctaaggaaattta

SEQ ID NO: 150619 - DNA, 20 bp, Artificial Sequence
  chemically synthesized
ctaggggagctaaggaaatt

SEQ ID NO: 150620 - DNA, 20 bp, Artificial Sequence
  chemically synthesized
tttatccctctaaatttcct

SEQ ID NO: 150621 - DNA, 20 bp, Artificial Sequence
  chemically synthesized
aaagctagctaggggagcta

SEQ ID NO: 150622 - DNA, 20 bp, Artificial Sequence
  chemically synthesized
caaagctagctaggggagct

SEQ ID NO: 150623 - DNA, 20 bp, Artificial Sequence
  chemically synthesized
ctaaatttccttagctcccc

SEQ ID NO: 150624 - DNA, 20 bp, Artificial Sequence
  chemically synthesized
atttccttagctcccctagc

SEQ ID NO: 150625 - DNA, 20 bp, Artificial Sequence
  chemically synthesized
agagacaaagctagctaggg

SEQ ID NO: 150626 - DNA, 20 bp, Artificial Sequence
  chemically synthesized
ccagagacaaagctagctag

SEQ ID NO: 150627 - DNA, 20 bp, Artificial Sequence
  chemically synthesized
tccagagacaaagctagcta

SEQ ID NO: 150628 - DNA, 20 bp, Artificial Sequence
  chemically synthesized
ttccagagacaaagctagct

SEQ ID NO: 150629 - DNA, 20 bp, Artificial Sequence
  chemically synthesized
gttccagagacaaagctagc

SEQ ID NO: 150630 - DNA, 20 bp, Artificial Sequence
  chemically synthesized
tcttgttccagagacaaagc

SEQ ID NO: 150631 - DNA, 20 bp, Artificial Sequence
  chemically synthesized
cccctagctagctttgtctc

SEQ ID NO: 150632 - DNA, 20 bp, Artificial Sequence
  chemically synthesized
gtcatcttgttccagagaca

SEQ ID NO: 150633 - DNA, 20 bp, Artificial Sequence
  chemically synthesized
gctagctttgtctctggaac

SEQ ID NO: 150634 - DNA, 20 bp, Artificial Sequence
  chemically synthesized
taaactgtcatcttgttcca

SEQ ID NO: 150635 - DNA, 20 bp, Artificial Sequence
  chemically synthesized
aataaactgtcatcttgttc

SEQ ID NO: 150636 - DNA, 20 bp, Artificial Sequence
  chemically synthesized
ttgtctctggaacaagatga

SEQ ID NO: 150637 - DNA, 20 bp, Artificial Sequence
  chemically synthesized
tatgtaaagaaatggaaata

SEQ ID NO: 150638 - DNA, 20 bp, Artificial Sequence
  chemically synthesized
agaggaagtatgtaaagaaa

SEQ ID NO: 150639 - DNA, 20 bp, Artificial Sequence
  chemically synthesized
agtaaaagaggaagtatgta

SEQ ID NO: 150640 - DNA, 20 bp, Artificial Sequence
  chemically synthesized
agtagtagcagtaaaagagg

SEQ ID NO: 150641 - DNA, 20 bp, Artificial Sequence
  chemically synthesized
atgagtagtagcagtaaaag

SEQ ID NO: 150642 - DNA, 20 bp, Artificial Sequence
  chemically synthesized
aatgagtagtagcagtaaaa

SEQ ID NO: 150643 - DNA, 20 bp, Artificial Sequence
  chemically synthesized
agaatgagtagtagcagtaa

SEQ ID NO: 150644 - DNA, 20 bp, Artificial Sequence
  chemically synthesized
aagtggagaatgagtagtag

SEQ ID NO: 150645 - DNA, 20 bp, Artificial Sequence
  chemically synthesized
gagaagtggagaatgagtag

SEQ ID NO: 150646 - DNA, 20 bp, Artificial Sequence
  chemically synthesized
aaagagaagtggagaatgag

SEQ ID NO: 150647 - DNA, 20 bp, Artificial Sequence
  chemically synthesized
gaaaaagagaagtggagaat

SEQ ID NO: 150648 - DNA, 20 bp, Artificial Sequence
  chemically synthesized
gggagtgaaaaagagaagtg

SEQ ID NO: 150649 - DNA, 20 bp, Artificial Sequence
  chemically synthesized
aggggagtgaaaaagagaag

SEQ ID NO: 150650 - DNA, 20 bp, Artificial Sequence
  chemically synthesized
caaaggggagtgaaaaagag

SEQ ID NO: 150651 - DNA, 20 bp, Artificial Sequence
  chemically synthesized
taccaaaggggagtgaaaaa

SEQ ID NO: 150652 - DNA, 20 bp, Artificial Sequence
  chemically synthesized
agtaccaaaggggagtgaaa

SEQ ID NO: 150653 - DNA, 20 bp, Artificial Sequence
  chemically synthesized
ttctctttttcactcccctt

SEQ ID NO: 150654 - DNA, 20 bp, Artificial Sequence
  chemically synthesized
aaacaaggagtaccaaaggg

SEQ ID NO: 150655 - DNA, 20 bp, Artificial Sequence
  chemically synthesized
ggaaacaaggagtaccaaag

SEQ ID NO: 150656 - DNA, 20 bp, Artificial Sequence
  chemically synthesized
tggaaacaaggagtaccaaa

SEQ ID NO: 150657 - DNA, 20 bp, Artificial Sequence
  chemically synthesized
ctggaaacaaggagtaccaa

SEQ ID NO: 150658 - DNA, 20 bp, Artificial Sequence
  chemically synthesized
tctggaaacaaggagtacca

SEQ ID NO: 150659 - DNA, 20 bp, Artificial Sequence
  chemically synthesized
cagagtcttctggaaacaag

SEQ ID NO: 150660 - DNA, 20 bp, Artificial Sequence
  chemically synthesized
cctttggtactccttgtttc

SEQ ID NO: 150661 - DNA, 20 bp, Artificial Sequence
  chemically synthesized
atcagagtcttctggaaaca

SEQ ID NO: 150662 - DNA, 20 bp, Artificial Sequence
  chemically synthesized
gatcagagtcttctggaaac

SEQ ID NO: 150663 - DNA, 20 bp, Artificial Sequence
  chemically synthesized
ttggtactccttgtttccag

SEQ ID NO: 150664 - DNA, 20 bp, Artificial Sequence
  chemically synthesized
agctggggatcagagtcttc

SEQ ID NO: 150665 - DNA, 20 bp, Artificial Sequence
  chemically synthesized
ttccagaagactctgatccc

SEQ ID NO: 150666 - DNA, 20 bp, Artificial Sequence
  chemically synthesized
aacccttgagctggggatca

SEQ ID NO: 150667 - DNA, 20 bp, Artificial Sequence
  chemically synthesized
ggaacccttgagctggggat

SEQ ID NO: 150668 - DNA, 20 bp, Artificial Sequence
  chemically synthesized
aagactctgatccccagctc

SEQ ID NO: 150669 - DNA, 20 bp, Artificial Sequence
  chemically synthesized
agactctgatccccagctca

SEQ ID NO: 150670 - DNA, 20 bp, Artificial Sequence
  chemically synthesized
gagaaggaacccttgagctg

SEQ ID NO: 150671 - DNA, 20 bp, Artificial Sequence
  chemically synthesized
gactctgatccccagctcaa

SEQ ID NO: 150672 - DNA, 20 bp, Artificial Sequence
  chemically synthesized
agagaaggaacccttgagct

SEQ ID NO: 150673 - DNA, 20 bp, Artificial Sequence
  chemically synthesized
cagagaaggaacccttgagc

SEQ ID NO: 150674 - DNA, 20 bp, Artificial Sequence
  chemically synthesized
agtacagagaaggaaccctt

SEQ ID NO: 150675 - DNA, 20 bp, Artificial Sequence
  chemically synthesized
agcaagactcagtacagaga

SEQ ID NO: 150676 - DNA, 20 bp, Artificial Sequence
  chemically synthesized
gagcaagactcagtacagag

SEQ ID NO: 150677 - DNA, 20 bp, Artificial Sequence
  chemically synthesized
aagggttccttctctgtact

SEQ ID NO: 150678 - DNA, 20 bp, Artificial Sequence
  chemically synthesized
tacgagcaagactcagtaca

SEQ ID NO: 150679 - DNA, 20 bp, Artificial Sequence
  chemically synthesized
attacgagcaagactcagta

SEQ ID NO: 150680 - DNA, 20 bp, Artificial Sequence
  chemically synthesized
agataattacgagcaagact

SEQ ID NO: 150681 - DNA, 20 bp, Artificial Sequence
  chemically synthesized
tacacaagataattacgagc

SEQ ID NO: 150682 - DNA, 20 bp, Artificial Sequence
  chemically synthesized
aagttacacaagataattac

SEQ ID NO: 150683 - DNA, 20 bp, Artificial Sequence
  chemically synthesized
tagaaatcctgaagttacac

SEQ ID NO: 150684 - DNA, 20 bp, Artificial Sequence
  chemically synthesized
gtaattatcttgtgtaactt

SEQ ID NO: 150685 - DNA, 20 bp, Artificial Sequence
  chemically synthesized
taattatcttgtgtaacttc

SEQ ID NO: 150686 - DNA, 20 bp, Artificial Sequence
  chemically synthesized
tgttcaatatagaaatcctg

SEQ ID NO: 150687 - DNA, 20 bp, Artificial Sequence
  chemically synthesized
aatcagcgtattgttcaata

SEQ ID NO: 150688 - DNA, 20 bp, Artificial Sequence
  chemically synthesized
aggaaggcagaaatagaaat

SEQ ID NO: 150689 - DNA, 20 bp, Artificial Sequence
  chemically synthesized
atgaatgaggaaggcagaaa

SEQ ID NO: 150690 - DNA, 20 bp, Artificial Sequence
  chemically synthesized
ctgggaatgaatgaggaagg

SEQ ID NO: 150691 - DNA, 20 bp, Artificial Sequence
  chemically synthesized
tacctgggaatgaatgagga

SEQ ID NO: 150692 - DNA, 20 bp, Artificial Sequence
  chemically synthesized
ttacctgggaatgaatgagg

SEQ ID NO: 150693 - DNA, 20 bp, Artificial Sequence
  chemically synthesized
ccattacctgggaatgaatg

SEQ ID NO: 150694 - DNA, 20 bp, Artificial Sequence
  chemically synthesized
cccattacctgggaatgaat

SEQ ID NO: 150695 - DNA, 20 bp, Artificial Sequence
  chemically synthesized
ctgccttcctcattcattcc

SEQ ID NO: 150696 - DNA, 20 bp, Artificial Sequence
  chemically synthesized
tgccttcctcattcattccc

SEQ ID NO: 150697 - DNA, 20 bp, Artificial Sequence
  chemically synthesized
cctcattcattcccaggtaa

SEQ ID NO: 150698 - DNA, 20 bp, Artificial Sequence
  chemically synthesized
ctcattcattcccaggtaat

SEQ ID NO: 150699 - DNA, 20 bp, Artificial Sequence
  chemically synthesized
tcattgaatccccattacct

SEQ ID NO: 150700 - DNA, 20 bp, Artificial Sequence
  chemically synthesized
tcattcattcccaggtaatg

SEQ ID NO: 150701 - DNA, 20 bp, Artificial Sequence
  chemically synthesized
ttcattgaatccccattacc

SEQ ID NO: 150702 - DNA, 20 bp, Artificial Sequence
  chemically synthesized
gggattcaatgaaaatcgac

SEQ ID NO: 150703 - DNA, 20 bp, Artificial Sequence
  chemically synthesized
gattcaatgaaaatcgacaa

SEQ ID NO: 150704 - DNA, 20 bp, Artificial Sequence
  chemically synthesized
attcaatgaaaatcgacaag

SEQ ID NO: 150705 - DNA, 20 bp, Artificial Sequence
  chemically synthesized
ttcaatgaaaatcgacaaga

SEQ ID NO: 150706 - DNA, 20 bp, Artificial Sequence
  chemically synthesized
tcaatgaaaatcgacaagag

SEQ ID NO: 150707 - DNA, 20 bp, Artificial Sequence
  chemically synthesized
aaatcgacaagaggggatgt

SEQ ID NO: 150708 - DNA, 20 bp, Artificial Sequence
  chemically synthesized
agaggggatgttggttgtat

SEQ ID NO: 150709 - DNA, 20 bp, Artificial Sequence
  chemically synthesized
tcttcatagcagcatgagaa

SEQ ID NO: 150710 - DNA, 20 bp, Artificial Sequence
  chemically synthesized
gtatttcttcatagcagcat

SEQ ID NO: 150711 - DNA, 20 bp, Artificial Sequence
  chemically synthesized
tctgttctcatgctgctatg

SEQ ID NO: 150712 - DNA, 20 bp, Artificial Sequence
  chemically synthesized
tctcgggtatttcttcatag

SEQ ID NO: 150713 - DNA, 20 bp, Artificial Sequence
  chemically synthesized
cagtctcgggtatttcttca

SEQ ID NO: 150714 - DNA, 20 bp, Artificial Sequence
  chemically synthesized
gctgctatgaagaaataccc

SEQ ID NO: 150715 - DNA, 20 bp, Artificial Sequence
  chemically synthesized
tatgaagaaatacccgagac

SEQ ID NO: 150716 - DNA, 20 bp, Artificial Sequence
  chemically synthesized
atgaagaaatacccgagact

SEQ ID NO: 150717 - DNA, 20 bp, Artificial Sequence
  chemically synthesized
ttcataaattacccagtctc

SEQ ID NO: 150718 - DNA, 20 bp, Artificial Sequence
  chemically synthesized
cttcataaattacccagtct

SEQ ID NO: 150719 - DNA, 20 bp, Artificial Sequence
  chemically synthesized
tgttttcttcataaattacc

SEQ ID NO: 150720 - DNA, 20 bp, Artificial Sequence
  chemically synthesized
ccgagactgggtaatttatg

SEQ ID NO: 150721 - DNA, 20 bp, Artificial Sequence
  chemically synthesized
tgggtaatttatgaagaaaa

SEQ ID NO: 150722 - DNA, 20 bp, Artificial Sequence
  chemically synthesized
aattgattcaccattctgca

SEQ ID NO: 150723 - DNA, 20 bp, Artificial Sequence
  chemically synthesized
gcctccccagccatgcagaa

SEQ ID NO: 150724 - DNA, 20 bp, Artificial Sequence
  chemically synthesized
gattcaccattctgcatggc

SEQ ID NO: 150725 - DNA, 20 bp, Artificial Sequence
  chemically synthesized
attcaccattctgcatggct

SEQ ID NO: 150726 - DNA, 20 bp, Artificial Sequence
  chemically synthesized
ctgaggcctccccagccatg

SEQ ID NO: 150727 - DNA, 20 bp, Artificial Sequence
  chemically synthesized
ttcaccattctgcatggctg

SEQ ID NO: 150728 - DNA, 20 bp, Artificial Sequence
  chemically synthesized
caccattctgcatggctggg

SEQ ID NO: 150729 - DNA, 20 bp, Artificial Sequence
  chemically synthesized
accattctgcatggctgggg

SEQ ID NO: 150730 - DNA, 20 bp, Artificial Sequence
  chemically synthesized
taagtttcctgaggcctccc

SEQ ID NO: 150731 - DNA, 20 bp, Artificial Sequence
  chemically synthesized
ctgcatggctggggaggcct

SEQ ID NO: 150732 - DNA, 20 bp, Artificial Sequence
  chemically synthesized
tgcatggctggggaggcctc

SEQ ID NO: 150733 - DNA, 20 bp, Artificial Sequence
  chemically synthesized
ccatgattgtaagtttcctg

SEQ ID NO: 150734 - DNA, 20 bp, Artificial Sequence
  chemically synthesized
gccatgattgtaagtttcct

SEQ ID NO: 150735 - DNA, 20 bp, Artificial Sequence
  chemically synthesized
cctcaggaaacttacaatca

SEQ ID NO: 150736 - DNA, 20 bp, Artificial Sequence
  chemically synthesized
gtgccttctgccatgattgt

SEQ ID NO: 150737 - DNA, 20 bp, Artificial Sequence
  chemically synthesized
caggaaacttacaatcatgg

SEQ ID NO: 150738 - DNA, 20 bp, Artificial Sequence
  chemically synthesized
gaaacttacaatcatggcag

SEQ ID NO: 150739 - DNA, 20 bp, Artificial Sequence
  chemically synthesized
aaacttacaatcatggcaga

SEQ ID NO: 150740 - DNA, 20 bp, Artificial Sequence
  chemically synthesized
tggcagaaggcacctcttca

SEQ ID NO: 150741 - DNA, 20 bp, Artificial Sequence
  chemically synthesized
ggcagaaggcacctcttcac

SEQ ID NO: 150742 - DNA, 20 bp, Artificial Sequence
  chemically synthesized
gcagaaggcacctcttcaca

SEQ ID NO: 150743 - DNA, 20 bp, Artificial Sequence
  chemically synthesized
cctcctgccaccctgtgaag

SEQ ID NO: 150744 - DNA, 20 bp, Artificial Sequence
  chemically synthesized
ccctcctgccaccctgtgaa

SEQ ID NO: 150745 - DNA, 20 bp, Artificial Sequence
  chemically synthesized
gaaggcacctcttcacaggg

SEQ ID NO: 150746 - DNA, 20 bp, Artificial Sequence
  chemically synthesized
ctccctcctgccaccctgtg

SEQ ID NO: 150747 - DNA, 20 bp, Artificial Sequence
  chemically synthesized
ggcacctcttcacagggtgg

SEQ ID NO: 150748 - DNA, 20 bp, Artificial Sequence
  chemically synthesized
gcacctcttcacagggtggc

SEQ ID NO: 150749 - DNA, 20 bp, Artificial Sequence
  chemically synthesized
acctcttcacagggtggcag

SEQ ID NO: 150750 - DNA, 20 bp, Artificial Sequence
  chemically synthesized
cctcttcacagggtggcagg

SEQ ID NO: 150751 - DNA, 20 bp, Artificial Sequence
  chemically synthesized
ctcttcacagggtggcagga

SEQ ID NO: 150752 - DNA, 20 bp, Artificial Sequence
  chemically synthesized
cttcacagggtggcaggagg

SEQ ID NO: 150753 - DNA, 20 bp, Artificial Sequence
  chemically synthesized
agggtggcaggagggagaat

SEQ ID NO: 150754 - DNA, 20 bp, Artificial Sequence
  chemically synthesized
gcaggagggagaatgagtgc

SEQ ID NO: 150755 - DNA, 20 bp, Artificial Sequence
  chemically synthesized
ggagggagaatgagtgccag

SEQ ID NO: 150756 - DNA, 20 bp, Artificial Sequence
  chemically synthesized
gagggagaatgagtgccagc

SEQ ID NO: 150757 - DNA, 20 bp, Artificial Sequence
  chemically synthesized
agggagaatgagtgccagca

SEQ ID NO: 150758 - DNA, 20 bp, Artificial Sequence
  chemically synthesized
gggagaatgagtgccagcag

SEQ ID NO: 150759 - DNA, 20 bp, Artificial Sequence
  chemically synthesized
gtgtctggcgtttcccctgc

SEQ ID NO: 150760 - DNA, 20 bp, Artificial Sequence
  chemically synthesized
agtgccagcaggggaaacgc

SEQ ID NO: 150761 - DNA, 20 bp, Artificial Sequence
  chemically synthesized
ctgatggttttataagtgtc

SEQ ID NO: 150762 - DNA, 20 bp, Artificial Sequence
  chemically synthesized
atgagatctgatggttttat

SEQ ID NO: 150763 - DNA, 20 bp, Artificial Sequence
  chemically synthesized
ccagacacttataaaaccat

SEQ ID NO: 150764 - DNA, 20 bp, Artificial Sequence
  chemically synthesized
tgatttcacatgagatctga

SEQ ID NO: 150765 - DNA, 20 bp, Artificial Sequence
  chemically synthesized
gatagtgggtgatttcacat

SEQ ID NO: 150766 - DNA, 20 bp, Artificial Sequence
  chemically synthesized
catgctattctcatgatagt

SEQ ID NO: 150767 - DNA, 20 bp, Artificial Sequence
  chemically synthesized
gtgaaatcacccactatcat

SEQ ID NO: 150768 - DNA, 20 bp, Artificial Sequence
  chemically synthesized
ccatgctattctcatgatag

SEQ ID NO: 150769 - DNA, 20 bp, Artificial Sequence
  chemically synthesized
cccccatgctattctcatga

SEQ ID NO: 150770 - DNA, 20 bp, Artificial Sequence
  chemically synthesized
atcacccactatcatgagaa

SEQ ID NO: 150771 - DNA, 20 bp, Artificial Sequence
  chemically synthesized
ccactatcatgagaatagca

SEQ ID NO: 150772 - DNA, 20 bp, Artificial Sequence
  chemically synthesized
cactatcatgagaatagcat

SEQ ID NO: 150773 - DNA, 20 bp, Artificial Sequence
  chemically synthesized
actatcatgagaatagcatg

SEQ ID NO: 150774 - DNA, 20 bp, Artificial Sequence
  chemically synthesized
ctatcatgagaatagcatgg

SEQ ID NO: 150775 - DNA, 20 bp, Artificial Sequence
  chemically synthesized
aggtaattgaatcatggagg

SEQ ID NO: 150776 - DNA, 20 bp, Artificial Sequence
  chemically synthesized
gagaggtaattgaatcatgg

SEQ ID NO: 150777 - DNA, 20 bp, Artificial Sequence
  chemically synthesized
tgagaggtaattgaatcatg

SEQ ID NO: 150778 - DNA, 20 bp, Artificial Sequence
  chemically synthesized
agtgagaggtaattgaatca

SEQ ID NO: 150779 - DNA, 20 bp, Artificial Sequence
  chemically synthesized
atgattcaattacctctcac

SEQ ID NO: 150780 - DNA, 20 bp, Artificial Sequence
  chemically synthesized
tgattcaattacctctcact

SEQ ID NO: 150781 - DNA, 20 bp, Artificial Sequence
  chemically synthesized
catgggagggacccagtgag

SEQ ID NO: 150782 - DNA, 20 bp, Artificial Sequence
  chemically synthesized
tcatgggagggacccagtga

SEQ ID NO: 150783 - DNA, 20 bp, Artificial Sequence
  chemically synthesized
tgtcatgggagggacccagt

SEQ ID NO: 150784 - DNA, 20 bp, Artificial Sequence
  chemically synthesized
caggtgtcatgggagggacc

SEQ ID NO: 150785 - DNA, 20 bp, Artificial Sequence
  chemically synthesized
aatccccaggtgtcatggga

SEQ ID NO: 150786 - DNA, 20 bp, Artificial Sequence
  chemically synthesized
aaatccccaggtgtcatggg

SEQ ID NO: 150787 - DNA, 20 bp, Artificial Sequence
  chemically synthesized
aaaatccccaggtgtcatgg

SEQ ID NO: 150788 - DNA, 20 bp, Artificial Sequence
  chemically synthesized
ccaaaatccccaggtgtcat

SEQ ID NO: 150789 - DNA, 20 bp, Artificial Sequence
  chemically synthesized
tgggtccctcccatgacacc

SEQ ID NO: 150790 - DNA, 20 bp, Artificial Sequence
  chemically synthesized
tccaaaatccccaggtgtca

SEQ ID NO: 150791 - DNA, 20 bp, Artificial Sequence
  chemically synthesized
gggtccctcccatgacacct

SEQ ID NO: 150792 - DNA, 20 bp, Artificial Sequence
  chemically synthesized
ggtccctcccatgacacctg

SEQ ID NO: 150793 - DNA, 20 bp, Artificial Sequence
  chemically synthesized
ttgtaatctccaaaatcccc

SEQ ID NO: 150794 - DNA, 20 bp, Artificial Sequence
  chemically synthesized
cccatgacacctggggattt

SEQ ID NO: 150795 - DNA, 20 bp, Artificial Sequence
  chemically synthesized
attgtaatctccaaaatccc

SEQ ID NO: 150796 - DNA, 20 bp, Artificial Sequence
  chemically synthesized
catgacacctggggattttg

SEQ ID NO: 150797 - DNA, 20 bp, Artificial Sequence
  chemically synthesized
gattttggagattacaattc

SEQ ID NO: 150798 - DNA, 20 bp, Artificial Sequence
  chemically synthesized
attttggagattacaattca

SEQ ID NO: 150799 - DNA, 20 bp, Artificial Sequence
  chemically synthesized
tggagattacaattcaaggt

SEQ ID NO: 150800 - DNA, 20 bp, Artificial Sequence
  chemically synthesized
ttacaattcaaggtgagatt

SEQ ID NO: 150801 - DNA, 20 bp, Artificial Sequence
  chemically synthesized
tacaattcaaggtgagattt

SEQ ID NO: 150802 - DNA, 20 bp, Artificial Sequence
  chemically synthesized
aattcaaggtgagatttggg

SEQ ID NO: 150803 - DNA, 20 bp, Artificial Sequence
  chemically synthesized
attcaaggtgagatttgggt

SEQ ID NO: 150804 - DNA, 20 bp, Artificial Sequence
  chemically synthesized
ttcaaggtgagatttgggtg

SEQ ID NO: 150805 - DNA, 20 bp, Artificial Sequence
  chemically synthesized
gtgagatttgggtggggaca

SEQ ID NO: 150806 - DNA, 20 bp, Artificial Sequence
  chemically synthesized
aggagcagaatgatatgttt

SEQ ID NO: 150807 - DNA, 20 bp, Artificial Sequence
  chemically synthesized
aaaacatatcattctgctcc

SEQ ID NO: 150808 - DNA, 20 bp, Artificial Sequence
  chemically synthesized
gatttgggaggggccaggag

SEQ ID NO: 150809 - DNA, 20 bp, Artificial Sequence
  chemically synthesized
tgagatttgggaggggccag

SEQ ID NO: 150810 - DNA, 20 bp, Artificial Sequence
  chemically synthesized
catgagatttgggaggggcc

SEQ ID NO: 150811 - DNA, 20 bp, Artificial Sequence
  chemically synthesized
acatgagatttgggaggggc

SEQ ID NO: 150812 - DNA, 20 bp, Artificial Sequence
  chemically synthesized
gatgacatgagatttgggag

SEQ ID NO: 150813 - DNA, 20 bp, Artificial Sequence
  chemically synthesized
tgatgacatgagatttggga

SEQ ID NO: 150814 - DNA, 20 bp, Artificial Sequence
  chemically synthesized
gtgatgacatgagatttggg

SEQ ID NO: 150815 - DNA, 20 bp, Artificial Sequence
  chemically synthesized
tgtgatgacatgagatttgg

SEQ ID NO: 150816 - DNA, 20 bp, Artificial Sequence
  chemically synthesized
aatgtgatgacatgagattt

SEQ ID NO: 150817 - DNA, 20 bp, Artificial Sequence
  chemically synthesized
aaatgtgatgacatgagatt

SEQ ID NO: 150818 - DNA, 20 bp, Artificial Sequence
  chemically synthesized
gttttgaaatgtgatgacat

SEQ ID NO: 150819 - DNA, 20 bp, Artificial Sequence
  chemically synthesized
acacaataatgccttcccaa

SEQ ID NO: 150820 - DNA, 20 bp, Artificial Sequence
  chemically synthesized
actttgggtgactgttggga

SEQ ID NO: 150821 - DNA, 20 bp, Artificial Sequence
  chemically synthesized
gactttgggtgactgttggg

SEQ ID NO: 150822 - DNA, 20 bp, Artificial Sequence
  chemically synthesized
taagactttgggtgactgtt

SEQ ID NO: 150823 - DNA, 20 bp, Artificial Sequence
  chemically synthesized
ttaagactttgggtgactgt

SEQ ID NO: 150824 - DNA, 20 bp, Artificial Sequence
  chemically synthesized
gccttcccaacagtcaccca

SEQ ID NO: 150825 - DNA, 20 bp, Artificial Sequence
  chemically synthesized
ttggaatgagttaagacttt

SEQ ID NO: 150826 - DNA, 20 bp, Artificial Sequence
  chemically synthesized
gttggaatgagttaagactt

SEQ ID NO: 150827 - DNA, 20 bp, Artificial Sequence
  chemically synthesized
ggttaatgttggaatgagtt

SEQ ID NO: 150828 - DNA, 20 bp, Artificial Sequence
  chemically synthesized
ttttgggttaatgttggaat

SEQ ID NO: 150829 - DNA, 20 bp, Artificial Sequence
  chemically synthesized
ttggacttttgggttaatgt

SEQ ID NO: 150830 - DNA, 20 bp, Artificial Sequence
  chemically synthesized
tcattccaacattaacccaa

SEQ ID NO: 150831 - DNA, 20 bp, Artificial Sequence
  chemically synthesized
aactttggacttggactttt

SEQ ID NO: 150832 - DNA, 20 bp, Artificial Sequence
  chemically synthesized
caacattaacccaaaagtcc

SEQ ID NO: 150833 - DNA, 20 bp, Artificial Sequence
  chemically synthesized
aaactttggacttggacttt

SEQ ID NO: 150834 - DNA, 20 bp, Artificial Sequence
  chemically synthesized
aacccaaaagtccaagtcca

SEQ ID NO: 150835 - DNA, 20 bp, Artificial Sequence
  chemically synthesized
cttagatgaaactttggact

SEQ ID NO: 150836 - DNA, 20 bp, Artificial Sequence
  chemically synthesized
ctttgccttagatgaaactt

SEQ ID NO: 150837 - DNA, 20 bp, Artificial Sequence
  chemically synthesized
ccaagtccaaagtttcatct

SEQ ID NO: 150838 - DNA, 20 bp, Artificial Sequence
  chemically synthesized
caagtccaaagtttcatcta

SEQ ID NO: 150839 - DNA, 20 bp, Artificial Sequence
  chemically synthesized
ccaaagtttcatctaaggca

SEQ ID NO: 150840 - DNA, 20 bp, Artificial Sequence
  chemically synthesized
ggatgggacttgctttgcct

SEQ ID NO: 150841 - DNA, 20 bp, Artificial Sequence
  chemically synthesized
agtttcatctaaggcaaagc

SEQ ID NO: 150842 - DNA, 20 bp, Artificial Sequence
  chemically synthesized
tttcaggctcataggcggat

SEQ ID NO: 150843 - DNA, 20 bp, Artificial Sequence
  chemically synthesized
ttttcaggctcataggcgga

SEQ ID NO: 150844 - DNA, 20 bp, Artificial Sequence
  chemically synthesized
agcaagtcccatccgcctat

SEQ ID NO: 150845 - DNA, 20 bp, Artificial Sequence
  chemically synthesized
tggattttcaggctcatagg

SEQ ID NO: 150846 - DNA, 20 bp, Artificial Sequence
  chemically synthesized
ttttggattttcaggctcat

SEQ ID NO: 150847 - DNA, 20 bp, Artificial Sequence
  chemically synthesized
gttttggattttcaggctca

SEQ ID NO: 150848 - DNA, 20 bp, Artificial Sequence
  chemically synthesized
ctaacttgttttggattttc

SEQ ID NO: 150849 - DNA, 20 bp, Artificial Sequence
  chemically synthesized
actaacttgttttggatttt

SEQ ID NO: 150850 - DNA, 20 bp, Artificial Sequence
  chemically synthesized
tgagcctgaaaatccaaaac

SEQ ID NO: 150851 - DNA, 20 bp, Artificial Sequence
  chemically synthesized
tggaagtaactaacttgttt

SEQ ID NO: 150852 - DNA, 20 bp, Artificial Sequence
  chemically synthesized
cctgaaaatccaaaacaagt

SEQ ID NO: 150853 - DNA, 20 bp, Artificial Sequence
  chemically synthesized
caaaacaagttagttacttc

SEQ ID NO: 150854 - DNA, 20 bp, Artificial Sequence
  chemically synthesized
aaaacaagttagttacttcc

SEQ ID NO: 150855 - DNA, 20 bp, Artificial Sequence
  chemically synthesized
taccccccattgtatcctgg

SEQ ID NO: 150856 - DNA, 20 bp, Artificial Sequence
  chemically synthesized
ctgtaccccccattgtatcc

SEQ ID NO: 150857 - DNA, 20 bp, Artificial Sequence
  chemically synthesized
tagttacttccaggatacaa

SEQ ID NO: 150858 - DNA, 20 bp, Artificial Sequence
  chemically synthesized
agttacttccaggatacaat

SEQ ID NO: 150859 - DNA, 20 bp, Artificial Sequence
  chemically synthesized
gttacttccaggatacaatg

SEQ ID NO: 150860 - DNA, 20 bp, Artificial Sequence
  chemically synthesized
ttacttccaggatacaatgg

SEQ ID NO: 150861 - DNA, 20 bp, Artificial Sequence
  chemically synthesized
tacttccaggatacaatggg

SEQ ID NO: 150862 - DNA, 20 bp, Artificial Sequence
  chemically synthesized
ccaggatacaatggggggta

SEQ ID NO: 150863 - DNA, 20 bp, Artificial Sequence
  chemically synthesized
caggatacaatggggggtac

SEQ ID NO: 150864 - DNA, 20 bp, Artificial Sequence
  chemically synthesized
acaatggggggtacaggcat

SEQ ID NO: 150865 - DNA, 20 bp, Artificial Sequence
  chemically synthesized
caatggggggtacaggcatt

SEQ ID NO: 150866 - DNA, 20 bp, Artificial Sequence
  chemically synthesized
caatttctcccattcggaac

SEQ ID NO: 150867 - DNA, 20 bp, Artificial Sequence
  chemically synthesized
gtaaatacacctgttccgaa

SEQ ID NO: 150868 - DNA, 20 bp, Artificial Sequence
  chemically synthesized
ccaatttctcccattcggaa

SEQ ID NO: 150869 - DNA, 20 bp, Artificial Sequence
  chemically synthesized
taaatacacctgttccgaat

SEQ ID NO: 150870 - DNA, 20 bp, Artificial Sequence
  chemically synthesized
aatacacctgttccgaatgg

SEQ ID NO: 150871 - DNA, 20 bp, Artificial Sequence
  chemically synthesized
tttggccaatttctcccatt

SEQ ID NO: 150872 - DNA, 20 bp, Artificial Sequence
  chemically synthesized
ctgttccgaatgggagaaat

SEQ ID NO: 150873 - DNA, 20 bp, Artificial Sequence
  chemically synthesized
gggagaaattggccaaaata

SEQ ID NO: 150874 - DNA, 20 bp, Artificial Sequence
  chemically synthesized
ggagaaattggccaaaataa

SEQ ID NO: 150875 - DNA, 20 bp, Artificial Sequence
  chemically synthesized
gagaaattggccaaaataaa

SEQ ID NO: 150876 - DNA, 20 bp, Artificial Sequence
  chemically synthesized
ggcctgtaacccctttattt

SEQ ID NO: 150877 - DNA, 20 bp, Artificial Sequence
  chemically synthesized
agaaattggccaaaataaag

SEQ ID NO: 150878 - DNA, 20 bp, Artificial Sequence
  chemically synthesized
tggccaaaataaaggggtta

SEQ ID NO: 150879 - DNA, 20 bp, Artificial Sequence
  chemically synthesized
ggccaaaataaaggggttac

SEQ ID NO: 150880 - DNA, 20 bp, Artificial Sequence
  chemically synthesized
aggggttacaggccacatgc

SEQ ID NO: 150881 - DNA, 20 bp, Artificial Sequence
  chemically synthesized
ttggatttaagacttgcatg

SEQ ID NO: 150882 - DNA, 20 bp, Artificial Sequence
  chemically synthesized
atgactgccctattggattt

SEQ ID NO: 150883 - DNA, 20 bp, Artificial Sequence
  chemically synthesized
catgcaagtcttaaatccaa

SEQ ID NO: 150884 - DNA, 20 bp, Artificial Sequence
  chemically synthesized
atgcaagtcttaaatccaat

SEQ ID NO: 150885 - DNA, 20 bp, Artificial Sequence
  chemically synthesized
tgcaagtcttaaatccaata

SEQ ID NO: 150886 - DNA, 20 bp, Artificial Sequence
  chemically synthesized
aagtcttaaatccaataggg

SEQ ID NO: 150887 - DNA, 20 bp, Artificial Sequence
  chemically synthesized
aagtgtaatgactgccctat

SEQ ID NO: 150888 - DNA, 20 bp, Artificial Sequence
  chemically synthesized
gagatcatttgggcagttca

SEQ ID NO: 150889 - DNA, 20 bp, Artificial Sequence
  chemically synthesized
gtcaaaggagatcatttggg

SEQ ID NO: 150890 - DNA, 20 bp, Artificial Sequence
  chemically synthesized
gtagtcaaaggagatcattt

SEQ ID NO: 150891 - DNA, 20 bp, Artificial Sequence
  chemically synthesized
tgtagtcaaaggagatcatt

SEQ ID NO: 150892 - DNA, 20 bp, Artificial Sequence
  chemically synthesized
tgtgagacatgtagtcaaag

SEQ ID NO: 150893 - DNA, 20 bp, Artificial Sequence
  chemically synthesized
gatgtgagacatgtagtcaa

SEQ ID NO: 150894 - DNA, 20 bp, Artificial Sequence
  chemically synthesized
ggatgtgagacatgtagtca

SEQ ID NO: 150895 - DNA, 20 bp, Artificial Sequence
  chemically synthesized
tgacctggatgtgagacatg

SEQ ID NO: 150896 - DNA, 20 bp, Artificial Sequence
  chemically synthesized
ttgactacatgtctcacatc

SEQ ID NO: 150897 - DNA, 20 bp, Artificial Sequence
  chemically synthesized
tgactacatgtctcacatcc

SEQ ID NO: 150898 - DNA, 20 bp, Artificial Sequence
  chemically synthesized
catcagcatgacctggatgt

SEQ ID NO: 150899 - DNA, 20 bp, Artificial Sequence
  chemically synthesized
cctcttgcatcagcatgacc

SEQ ID NO: 150900 - DNA, 20 bp, Artificial Sequence
  chemically synthesized
catccaggtcatgctgatgc

SEQ ID NO: 150901 - DNA, 20 bp, Artificial Sequence
  chemically synthesized
tccaggtcatgctgatgcaa

SEQ ID NO: 150902 - DNA, 20 bp, Artificial Sequence
  chemically synthesized
ccaggtcatgctgatgcaag

SEQ ID NO: 150903 - DNA, 20 bp, Artificial Sequence
  chemically synthesized
tgggagcccacctcttgcat

SEQ ID NO: 150904 - DNA, 20 bp, Artificial Sequence
  chemically synthesized
ggtcatgctgatgcaagagg

SEQ ID NO: 150905 - DNA, 20 bp, Artificial Sequence
  chemically synthesized
gtcatgctgatgcaagaggt

SEQ ID NO: 150906 - DNA, 20 bp, Artificial Sequence
  chemically synthesized
atgcaagaggtgggctccca

SEQ ID NO: 150907 - DNA, 20 bp, Artificial Sequence
  chemically synthesized
agagctgcccaaggccatgg

SEQ ID NO: 150908 - DNA, 20 bp, Artificial Sequence
  chemically synthesized
gaggtgggctcccatggcct

SEQ ID NO: 150909 - DNA, 20 bp, Artificial Sequence
  chemically synthesized
gcagagctgcccaaggccat

SEQ ID NO: 150910 - DNA, 20 bp, Artificial Sequence
  chemically synthesized
aggtgggctcccatggcctt

SEQ ID NO: 150911 - DNA, 20 bp, Artificial Sequence
  chemically synthesized
ggcagagctgcccaaggcca

SEQ ID NO: 150912 - DNA, 20 bp, Artificial Sequence
  chemically synthesized
tgggctcccatggccttggg

SEQ ID NO: 150913 - DNA, 20 bp, Artificial Sequence
  chemically synthesized
cacaagggcagagctgccca

SEQ ID NO: 150914 - DNA, 20 bp, Artificial Sequence
  chemically synthesized
ccacaagggcagagctgccc

SEQ ID NO: 150915 - DNA, 20 bp, Artificial Sequence
  chemically synthesized
cctgcaaagccacaagggca

SEQ ID NO: 150916 - DNA, 20 bp, Artificial Sequence
  chemically synthesized
cttgggcagctctgcccttg

SEQ ID NO: 150917 - DNA, 20 bp, Artificial Sequence
  chemically synthesized
accctgcaaagccacaaggg

SEQ ID NO: 150918 - DNA, 20 bp, Artificial Sequence
  chemically synthesized
tgtaccctgcaaagccacaa

SEQ ID NO: 150919 - DNA, 20 bp, Artificial Sequence
  chemically synthesized
ctgtaccctgcaaagccaca

SEQ ID NO: 150920 - DNA, 20 bp, Artificial Sequence
  chemically synthesized
gctgtaccctgcaaagccac

SEQ ID NO: 150921 - DNA, 20 bp, Artificial Sequence
  chemically synthesized
gctctgcccttgtggctttg

SEQ ID NO: 150922 - DNA, 20 bp, Artificial Sequence
  chemically synthesized
ctctgcccttgtggctttgc

SEQ ID NO: 150923 - DNA, 20 bp, Artificial Sequence
  chemically synthesized
tctgcccttgtggctttgca

SEQ ID NO: 150924 - DNA, 20 bp, Artificial Sequence
  chemically synthesized
ggagggggctgtaccctgca

SEQ ID NO: 150925 - DNA, 20 bp, Artificial Sequence
  chemically synthesized
ccttgtggctttgcagggta

SEQ ID NO: 150926 - DNA, 20 bp, Artificial Sequence
  chemically synthesized
tgcagggtacagccccctcc

SEQ ID NO: 150927 - DNA, 20 bp, Artificial Sequence
  chemically synthesized
ccatgatagcagctgggagg

SEQ ID NO: 150928 - DNA, 20 bp, Artificial Sequence
  chemically synthesized
gccatgatagcagctgggag

SEQ ID NO: 150929 - DNA, 20 bp, Artificial Sequence
  chemically synthesized
agccatgatagcagctggga

SEQ ID NO: 150930 - DNA, 20 bp, Artificial Sequence
  chemically synthesized
tagccatgatagcagctggg

SEQ ID NO: 150931 - DNA, 20 bp, Artificial Sequence
  chemically synthesized
ctagccatgatagcagctgg

SEQ ID NO: 150932 - DNA, 20 bp, Artificial Sequence
  chemically synthesized
tgctagccatgatagcagct

SEQ ID NO: 150933 - DNA, 20 bp, Artificial Sequence
  chemically synthesized
gtgctagccatgatagcagc

SEQ ID NO: 150934 - DNA, 20 bp, Artificial Sequence
  chemically synthesized
ccccctcccagctgctatca

SEQ ID NO: 150935 - DNA, 20 bp, Artificial Sequence
  chemically synthesized
ctcagtgctagccatgatag

SEQ ID NO: 150936 - DNA, 20 bp, Artificial Sequence
  chemically synthesized
ctcccagctgctatcatggc

SEQ ID NO: 150937 - DNA, 20 bp, Artificial Sequence
  chemically synthesized
atactcagtgctagccatga

SEQ ID NO: 150938 - DNA, 20 bp, Artificial Sequence
  chemically synthesized
ctgctatcatggctagcact

SEQ ID NO: 150939 - DNA, 20 bp, Artificial Sequence
  chemically synthesized
aagctgcagatactcagtgc

SEQ ID NO: 150940 - DNA, 20 bp, Artificial Sequence
  chemically synthesized
ctagaaaagctgcagatact

SEQ ID NO: 150941 - DNA, 20 bp, Artificial Sequence
  chemically synthesized
tggctagcactgagtatctg

SEQ ID NO: 150942 - DNA, 20 bp, Artificial Sequence
  chemically synthesized
ccatgcatctagaaaagctg

SEQ ID NO: 150943 - DNA, 20 bp, Artificial Sequence
  chemically synthesized
ctgagtatctgcagcttttc

SEQ ID NO: 150944 - DNA, 20 bp, Artificial Sequence
  chemically synthesized
tttgaaccatgcatctagaa

SEQ ID NO: 150945 - DNA, 20 bp, Artificial Sequence
  chemically synthesized
ctgcagcttttctagatgca

SEQ ID NO: 150946 - DNA, 20 bp, Artificial Sequence
  chemically synthesized
gatagtttgaaccatgcatc

SEQ ID NO: 150947 - DNA, 20 bp, Artificial Sequence
  chemically synthesized
agatgcatggttcaaactat

SEQ ID NO: 150948 - DNA, 20 bp, Artificial Sequence
  chemically synthesized
agaatagtcagaaatgctga

SEQ ID NO: 150949 - DNA, 20 bp, Artificial Sequence
  chemically synthesized
atcagcatttctgactattc

SEQ ID NO: 150950 - DNA, 20 bp, Artificial Sequence
  chemically synthesized
catccaaaccccagaatagt

SEQ ID NO: 150951 - DNA, 20 bp, Artificial Sequence
  chemically synthesized
tcagcatttctgactattct

SEQ ID NO: 150952 - DNA, 20 bp, Artificial Sequence
  chemically synthesized
cagcatttctgactattctg

SEQ ID NO: 150953 - DNA, 20 bp, Artificial Sequence
  chemically synthesized
ccatcatccaaaccccagaa

SEQ ID NO: 150954 - DNA, 20 bp, Artificial Sequence
  chemically synthesized
tttctgactattctggggtt

SEQ ID NO: 150955 - DNA, 20 bp, Artificial Sequence
  chemically synthesized
gaccaccatcatccaaaccc

SEQ ID NO: 150956 - DNA, 20 bp, Artificial Sequence
  chemically synthesized
ctattctggggtttggatga

SEQ ID NO: 150957 - DNA, 20 bp, Artificial Sequence
  chemically synthesized
ttctggggtttggatgatgg

SEQ ID NO: 150958 - DNA, 20 bp, Artificial Sequence
  chemically synthesized
tgatggtggtcctcttctca

SEQ ID NO: 150959 - DNA, 20 bp, Artificial Sequence
  chemically synthesized
cctagtggagctgtgagaag

SEQ ID NO: 150960 - DNA, 20 bp, Artificial Sequence
  chemically synthesized
gcctagtggagctgtgagaa

SEQ ID NO: 150961 - DNA, 20 bp, Artificial Sequence
  chemically synthesized
ctgcctagtggagctgtgag

SEQ ID NO: 150962 - DNA, 20 bp, Artificial Sequence
  chemically synthesized
gcactgcctagtggagctgt

SEQ ID NO: 150963 - DNA, 20 bp, Artificial Sequence
  chemically synthesized
tcctcttctcacagctccac

SEQ ID NO: 150964 - DNA, 20 bp, Artificial Sequence
  chemically synthesized
cctcttctcacagctccact

SEQ ID NO: 150965 - DNA, 20 bp, Artificial Sequence
  chemically synthesized
cttctcacagctccactagg

SEQ ID NO: 150966 - DNA, 20 bp, Artificial Sequence
  chemically synthesized
cactggggcactgcctagtg

SEQ ID NO: 150967 - DNA, 20 bp, Artificial Sequence
  chemically synthesized
cccactggggcactgcctag

SEQ ID NO: 150968 - DNA, 20 bp, Artificial Sequence
  chemically synthesized
gtccccactggggcactgcc

SEQ ID NO: 150969 - DNA, 20 bp, Artificial Sequence
  chemically synthesized
agctccactaggcagtgccc

SEQ ID NO: 150970 - DNA, 20 bp, Artificial Sequence
  chemically synthesized
tccactaggcagtgccccag

SEQ ID NO: 150971 - DNA, 20 bp, Artificial Sequence
  chemically synthesized
ccactaggcagtgccccagt

SEQ ID NO: 150972 - DNA, 20 bp, Artificial Sequence
  chemically synthesized
cactaggcagtgccccagtg

SEQ ID NO: 150973 - DNA, 20 bp, Artificial Sequence
  chemically synthesized
tccacacagagtccccactg

SEQ ID NO: 150974 - DNA, 20 bp, Artificial Sequence
  chemically synthesized
ctccacacagagtccccact

SEQ ID NO: 150975 - DNA, 20 bp, Artificial Sequence
  chemically synthesized
gctccacacagagtccccac

SEQ ID NO: 150976 - DNA, 20 bp, Artificial Sequence
  chemically synthesized
gccccagtggggactctgtg

SEQ ID NO: 150977 - DNA, 20 bp, Artificial Sequence
  chemically synthesized
cccagtggggactctgtgtg

SEQ ID NO: 150978 - DNA, 20 bp, Artificial Sequence
  chemically synthesized
tggggtcggagctccacaca

SEQ ID NO: 150979 - DNA, 20 bp, Artificial Sequence
  chemically synthesized
tgtggggtcggagctccaca

SEQ ID NO: 150980 - DNA, 20 bp, Artificial Sequence
  chemically synthesized
agaaggaaaatgtggggtcg

SEQ ID NO: 150981 - DNA, 20 bp, Artificial Sequence
  chemically synthesized
gcagaaggaaaatgtggggt

SEQ ID NO: 150982 - DNA, 20 bp, Artificial Sequence
  chemically synthesized
cagtgcagaaggaaaatgtg

SEQ ID NO: 150983 - DNA, 20 bp, Artificial Sequence
  chemically synthesized
acagtgcagaaggaaaatgt

SEQ ID NO: 150984 - DNA, 20 bp, Artificial Sequence
  chemically synthesized
gacagtgcagaaggaaaatg

SEQ ID NO: 150985 - DNA, 20 bp, Artificial Sequence
  chemically synthesized
ctctgctgggacagtgcaga

SEQ ID NO: 150986 - DNA, 20 bp, Artificial Sequence
  chemically synthesized
tctctgctgggacagtgcag

SEQ ID NO: 150987 - DNA, 20 bp, Artificial Sequence
  chemically synthesized
acctctctgctgggacagtg

SEQ ID NO: 150988 - DNA, 20 bp, Artificial Sequence
  chemically synthesized
attttccttctgcactgtcc

SEQ ID NO: 150989 - DNA, 20 bp, Artificial Sequence
  chemically synthesized
ttccttctgcactgtcccag

SEQ ID NO: 150990 - DNA, 20 bp, Artificial Sequence
  chemically synthesized
ggaaaacctctctgctggga

SEQ ID NO: 150991 - DNA, 20 bp, Artificial Sequence
  chemically synthesized
ccttctgcactgtcccagca

SEQ ID NO: 150992 - DNA, 20 bp, Artificial Sequence
  chemically synthesized
ttctgcactgtcccagcaga

SEQ ID NO: 150993 - DNA, 20 bp, Artificial Sequence
  chemically synthesized
tctgcactgtcccagcagag

SEQ ID NO: 150994 - DNA, 20 bp, Artificial Sequence
  chemically synthesized
tcatggaaaacctctctgct

SEQ ID NO: 150995 - DNA, 20 bp, Artificial Sequence
  chemically synthesized
ctcatggaaaacctctctgc

SEQ ID NO: 150996 - DNA, 20 bp, Artificial Sequence
  chemically synthesized
ccagcagagaggttttccat

SEQ ID NO: 150997 - DNA, 20 bp, Artificial Sequence
  chemically synthesized
cagcagagaggttttccatg

SEQ ID NO: 150998 - DNA, 20 bp, Artificial Sequence
  chemically synthesized
agcagagaggttttccatga

SEQ ID NO: 150999 - DNA, 20 bp, Artificial Sequence
  chemically synthesized
ctgcaggggcagggccctca

SEQ ID NO: 151000 - DNA, 20 bp, Artificial Sequence
  chemically synthesized
agaagtttgctgcaggggca

SEQ ID NO: 151001 - DNA, 20 bp, Artificial Sequence
  chemically synthesized
ccatgagggccctgcccctg

SEQ ID NO: 151002 - DNA, 20 bp, Artificial Sequence
  chemically synthesized
cagaagtttgctgcaggggc

SEQ ID NO: 151003 - DNA, 20 bp, Artificial Sequence
  chemically synthesized
gcagaagtttgctgcagggg

SEQ ID NO: 151004 - DNA, 20 bp, Artificial Sequence
  chemically synthesized
caggcagaagtttgctgcag

SEQ ID NO: 151005 - DNA, 20 bp, Artificial Sequence
  chemically synthesized
ccaggcagaagtttgctgca

SEQ ID NO: 151006 - DNA, 20 bp, Artificial Sequence
  chemically synthesized
tccaggcagaagtttgctgc

SEQ ID NO: 151007 - DNA, 20 bp, Artificial Sequence
  chemically synthesized
gtccaggcagaagtttgctg

SEQ ID NO: 151008 - DNA, 20 bp, Artificial Sequence
  chemically synthesized
ccctgcagcaaacttctgcc

SEQ ID NO: 151009 - DNA, 20 bp, Artificial Sequence
  chemically synthesized
aagcctaggtgtccaggcag

SEQ ID NO: 151010 - DNA, 20 bp, Artificial Sequence
  chemically synthesized
gaaaagcctaggtgtccagg

SEQ ID NO: 151011 - DNA, 20 bp, Artificial Sequence
  chemically synthesized
caaacttctgcctggacacc

SEQ ID NO: 151012 - DNA, 20 bp, Artificial Sequence
  chemically synthesized
atggaaaagcctaggtgtcc

SEQ ID NO: 151013 - DNA, 20 bp, Artificial Sequence
  chemically synthesized
aaacttctgcctggacacct

SEQ ID NO: 151014 - DNA, 20 bp, Artificial Sequence
  chemically synthesized
tatggaaaagcctaggtgtc

SEQ ID NO: 151015 - DNA, 20 bp, Artificial Sequence
  chemically synthesized
gaggatgtatggaaaagcct

SEQ ID NO: 151016 - DNA, 20 bp, Artificial Sequence
  chemically synthesized
agaggatgtatggaaaagcc

SEQ ID NO: 151017 - DNA, 20 bp, Artificial Sequence
  chemically synthesized
aattcagaggatgtatggaa

SEQ ID NO: 151018 - DNA, 20 bp, Artificial Sequence
  chemically synthesized
cctagaattcagaggatgta

SEQ ID NO: 151019 - DNA, 20 bp, Artificial Sequence
  chemically synthesized
aacctctgcctagaattcag

SEQ ID NO: 151020 - DNA, 20 bp, Artificial Sequence
  chemically synthesized
tccatacatcctctgaattc

SEQ ID NO: 151021 - DNA, 20 bp, Artificial Sequence
  chemically synthesized
caacctctgcctagaattca

SEQ ID NO: 151022 - DNA, 20 bp, Artificial Sequence
  chemically synthesized
ccatacatcctctgaattct

SEQ ID NO: 151023 - DNA, 20 bp, Artificial Sequence
  chemically synthesized
tgcaacctctgcctagaatt

SEQ ID NO: 151024 - DNA, 20 bp, Artificial Sequence
  chemically synthesized
tacatcctctgaattctagg

SEQ ID NO: 151025 - DNA, 20 bp, Artificial Sequence
  chemically synthesized
catcctctgaattctaggca

SEQ ID NO: 151026 - DNA, 20 bp, Artificial Sequence
  chemically synthesized
atcctctgaattctaggcag

SEQ ID NO: 151027 - DNA, 20 bp, Artificial Sequence
  chemically synthesized
tgaggtttgcaacctctgcc

SEQ ID NO: 151028 - DNA, 20 bp, Artificial Sequence
  chemically synthesized
tggacagaagtcaagaattg

SEQ ID NO: 151029 - DNA, 20 bp, Artificial Sequence
  chemically synthesized
ttggacagaagtcaagaatt

SEQ ID NO: 151030 - DNA, 20 bp, Artificial Sequence
  chemically synthesized
cctggggttggacagaagtc

SEQ ID NO: 151031 - DNA, 20 bp, Artificial Sequence
  chemically synthesized
ttgggcctggggttggacag

SEQ ID NO: 151032 - DNA, 20 bp, Artificial Sequence
  chemically synthesized
gtgttgggcctggggttgga

SEQ ID NO: 151033 - DNA, 20 bp, Artificial Sequence
  chemically synthesized
tcttgacttctgtccaaccc

SEQ ID NO: 151034 - DNA, 20 bp, Artificial Sequence
  chemically synthesized
cttgacttctgtccaacccc

SEQ ID NO: 151035 - DNA, 20 bp, Artificial Sequence
  chemically synthesized
tgtggtgttgggcctggggt

SEQ ID NO: 151036 - DNA, 20 bp, Artificial Sequence
  chemically synthesized
tacatgtggtgttgggcctg

SEQ ID NO: 151037 - DNA, 20 bp, Artificial Sequence
  chemically synthesized
ttacatgtggtgttgggcct

SEQ ID NO: 151038 - DNA, 20 bp, Artificial Sequence
  chemically synthesized
cttacatgtggtgttgggcc

SEQ ID NO: 151039 - DNA, 20 bp, Artificial Sequence
  chemically synthesized
agtggcttacatgtggtgtt

SEQ ID NO: 151040 - DNA, 20 bp, Artificial Sequence
  chemically synthesized
tagtggcttacatgtggtgt

SEQ ID NO: 151041 - DNA, 20 bp, Artificial Sequence
  chemically synthesized
ccaggcccaacaccacatgt

SEQ ID NO: 151042 - DNA, 20 bp, Artificial Sequence
  chemically synthesized
aggccttagtggcttacatg

SEQ ID NO: 151043 - DNA, 20 bp, Artificial Sequence
  chemically synthesized
aacaccacatgtaagccact

SEQ ID NO: 151044 - DNA, 20 bp, Artificial Sequence
  chemically synthesized
acaccacatgtaagccacta

SEQ ID NO: 151045 - DNA, 20 bp, Artificial Sequence
  chemically synthesized
tcagagggtgcaggccttag

SEQ ID NO: 151046 - DNA, 20 bp, Artificial Sequence
  chemically synthesized
gcttcagagggtgcaggcct

SEQ ID NO: 151047 - DNA, 20 bp, Artificial Sequence
  chemically synthesized
gctgttgcttcagagggtgc

SEQ ID NO: 151048 - DNA, 20 bp, Artificial Sequence
  chemically synthesized
ggctgttgcttcagagggtg

SEQ ID NO: 151049 - DNA, 20 bp, Artificial Sequence
  chemically synthesized
actaaggcctgcaccctctg

SEQ ID NO: 151050 - DNA, 20 bp, Artificial Sequence
  chemically synthesized
gctcaggctgttgcttcaga

SEQ ID NO: 151051 - DNA, 20 bp, Artificial Sequence
  chemically synthesized
agctcaggctgttgcttcag

SEQ ID NO: 151052 - DNA, 20 bp, Artificial Sequence
  chemically synthesized
cagctcaggctgttgcttca

SEQ ID NO: 151053 - DNA, 20 bp, Artificial Sequence
  chemically synthesized
gcctgcaccctctgaagcaa

SEQ ID NO: 151054 - DNA, 20 bp, Artificial Sequence
  chemically synthesized
tacagctcaggctgttgctt

SEQ ID NO: 151055 - DNA, 20 bp, Artificial Sequence
  chemically synthesized
accctctgaagcaacagcct

SEQ ID NO: 151056 - DNA, 20 bp, Artificial Sequence
  chemically synthesized
aagaagccaaagtacagctc

SEQ ID NO: 151057 - DNA, 20 bp, Artificial Sequence
  chemically synthesized
aaagaagccaaagtacagct

SEQ ID NO: 151058 - DNA, 20 bp, Artificial Sequence
  chemically synthesized
caacagcctgagctgtactt

SEQ ID NO: 151059 - DNA, 20 bp, Artificial Sequence
  chemically synthesized
ggctcaaagaagccaaagta

SEQ ID NO: 151060 - DNA, 20 bp, Artificial Sequence
  chemically synthesized
gctgtggctcaaagaagcca

SEQ ID NO: 151061 - DNA, 20 bp, Artificial Sequence
  chemically synthesized
agctgtactttggcttcttt

SEQ ID NO: 151062 - DNA, 20 bp, Artificial Sequence
  chemically synthesized
ataccagctgtggctcaaag

SEQ ID NO: 151063 - DNA, 20 bp, Artificial Sequence
  chemically synthesized
actttggcttctttgagcca

SEQ ID NO: 151064 - DNA, 20 bp, Artificial Sequence
  chemically synthesized
tgcataccagctgtggctca

SEQ ID NO: 151065 - DNA, 20 bp, Artificial Sequence
  chemically synthesized
tggcttctttgagccacagc

SEQ ID NO: 151066 - DNA, 20 bp, Artificial Sequence
  chemically synthesized
cgtgccctgcataccagctg

SEQ ID NO: 151067 - DNA, 20 bp, Artificial Sequence
  chemically synthesized
tttgagccacagctggtatg

SEQ ID NO: 151068 - DNA, 20 bp, Artificial Sequence
  chemically synthesized
ttgagccacagctggtatgc

SEQ ID NO: 151069 - DNA, 20 bp, Artificial Sequence
  chemically synthesized
tgagccacagctggtatgca

SEQ ID NO: 151070 - DNA, 20 bp, Artificial Sequence
  chemically synthesized
ggacttcgtgccctgcatac

SEQ ID NO: 151071 - DNA, 20 bp, Artificial Sequence
  chemically synthesized
cagctggtatgcagggcacg

SEQ ID NO: 151072 - DNA, 20 bp, Artificial Sequence
  chemically synthesized
tatgcagggcacgaagtcct

SEQ ID NO: 151073 - DNA, 20 bp, Artificial Sequence
  chemically synthesized
gtgctgctttgtggagtctc

SEQ ID NO: 151074 - DNA, 20 bp, Artificial Sequence
  chemically synthesized
cgtgctgctttgtggagtct

SEQ ID NO: 151075 - DNA, 20 bp, Artificial Sequence
  chemically synthesized
cgaagtcctgagactccaca

SEQ ID NO: 151076 - DNA, 20 bp, Artificial Sequence
  chemically synthesized
agtcctgagactccacaaag

SEQ ID NO: 151077 - DNA, 20 bp, Artificial Sequence
  chemically synthesized
cagggccgtgctgctttgtg

SEQ ID NO: 151078 - DNA, 20 bp, Artificial Sequence
  chemically synthesized
cacagggccgtgctgctttg

SEQ ID NO: 151079 - DNA, 20 bp, Artificial Sequence
  chemically synthesized
tgagactccacaaagcagca

SEQ ID NO: 151080 - DNA, 20 bp, Artificial Sequence
  chemically synthesized
aagcagcacggccctgtgcc

SEQ ID NO: 151081 - DNA, 20 bp, Artificial Sequence
  chemically synthesized
ggtttcacgggccaggcaca

SEQ ID NO: 151082 - DNA, 20 bp, Artificial Sequence
  chemically synthesized
tggtttcacgggccaggcac

SEQ ID NO: 151083 - DNA, 20 bp, Artificial Sequence
  chemically synthesized
atggtttcacgggccaggca

SEQ ID NO: 151084 - DNA, 20 bp, Artificial Sequence
  chemically synthesized
aaaacatggtttcacgggcc

SEQ ID NO: 151085 - DNA, 20 bp, Artificial Sequence
  chemically synthesized
gaaaacatggtttcacgggc

SEQ ID NO: 151086 - DNA, 20 bp, Artificial Sequence
  chemically synthesized
aaaggaaaacatggtttcac

SEQ ID NO: 151087 - DNA, 20 bp, Artificial Sequence
  chemically synthesized
aaaaggaaaacatggtttca

SEQ ID NO: 151088 - DNA, 20 bp, Artificial Sequence
  chemically synthesized
agaggcctaaaaggaaaaca

SEQ ID NO: 151089 - DNA, 20 bp, Artificial Sequence
  chemically synthesized
gtgaaaccatgttttccttt

SEQ ID NO: 151090 - DNA, 20 bp, Artificial Sequence
  chemically synthesized
tgaaaccatgttttcctttt

SEQ ID NO: 151091 - DNA, 20 bp, Artificial Sequence
  chemically synthesized
cacaagcccagaggcctaaa

SEQ ID NO: 151092 - DNA, 20 bp, Artificial Sequence
  chemically synthesized
tcacaagcccagaggcctaa

SEQ ID NO: 151093 - DNA, 20 bp, Artificial Sequence
  chemically synthesized
atgttttccttttaggcctc

SEQ ID NO: 151094 - DNA, 20 bp, Artificial Sequence
  chemically synthesized
tgttttccttttaggcctct

SEQ ID NO: 151095 - DNA, 20 bp, Artificial Sequence
  chemically synthesized
ccctcccatcacaagcccag

SEQ ID NO: 151096 - DNA, 20 bp, Artificial Sequence
  chemically synthesized
cccctcccatcacaagccca

SEQ ID NO: 151097 - DNA, 20 bp, Artificial Sequence
  chemically synthesized
agcccctcccatcacaagcc

SEQ ID NO: 151098 - DNA, 20 bp, Artificial Sequence
  chemically synthesized
ttaggcctctgggcttgtga

SEQ ID NO: 151099 - DNA, 20 bp, Artificial Sequence
  chemically synthesized
taggcctctgggcttgtgat

SEQ ID NO: 151100 - DNA, 20 bp, Artificial Sequence
  chemically synthesized
ggcctctgggcttgtgatgg

SEQ ID NO: 151101 - DNA, 20 bp, Artificial Sequence
  chemically synthesized
atggcagcccctcccatcac

SEQ ID NO: 151102 - DNA, 20 bp, Artificial Sequence
  chemically synthesized
gcctctgggcttgtgatggg

SEQ ID NO: 151103 - DNA, 20 bp, Artificial Sequence
  chemically synthesized
cctctgggcttgtgatggga

SEQ ID NO: 151104 - DNA, 20 bp, Artificial Sequence
  chemically synthesized
ctctgggcttgtgatgggag

SEQ ID NO: 151105 - DNA, 20 bp, Artificial Sequence
  chemically synthesized
tgatgggaggggctgccatt

SEQ ID NO: 151106 - DNA, 20 bp, Artificial Sequence
  chemically synthesized
catgtcagaggtcttaatgg

SEQ ID NO: 151107 - DNA, 20 bp, Artificial Sequence
  chemically synthesized
gggcatgtcagaggtcttaa

SEQ ID NO: 151108 - DNA, 20 bp, Artificial Sequence
  chemically synthesized
atgtctccagggcatgtcag

SEQ ID NO: 151109 - DNA, 20 bp, Artificial Sequence
  chemically synthesized
gatgtctccagggcatgtca

SEQ ID NO: 151110 - DNA, 20 bp, Artificial Sequence
  chemically synthesized
aagatgtctccagggcatgt

SEQ ID NO: 151111 - DNA, 20 bp, Artificial Sequence
  chemically synthesized
ttaagacctctgacatgccc

SEQ ID NO: 151112 - DNA, 20 bp, Artificial Sequence
  chemically synthesized
aagacctctgacatgccctg

SEQ ID NO: 151113 - DNA, 20 bp, Artificial Sequence
  chemically synthesized
caatggggaagatgtctcca

SEQ ID NO: 151114 - DNA, 20 bp, Artificial Sequence
  chemically synthesized
acaatggggaagatgtctcc

SEQ ID NO: 151115 - DNA, 20 bp, Artificial Sequence
  chemically synthesized
gacaatggggaagatgtctc

SEQ ID NO: 151116 - DNA, 20 bp, Artificial Sequence
  chemically synthesized
taagcgccaagacaatgggg

SEQ ID NO: 151117 - DNA, 20 bp, Artificial Sequence
  chemically synthesized
tgttaagcgccaagacaatg

SEQ ID NO: 151118 - DNA, 20 bp, Artificial Sequence
  chemically synthesized
agacatcttccccattgtct

SEQ ID NO: 151119 - DNA, 20 bp, Artificial Sequence
  chemically synthesized
atgttaagcgccaagacaat

SEQ ID NO: 151120 - DNA, 20 bp, Artificial Sequence
  chemically synthesized
aatgttaagcgccaagacaa

SEQ ID NO: 151121 - DNA, 20 bp, Artificial Sequence
  chemically synthesized
ggagccaaatgttaagcgcc

SEQ ID NO: 151122 - DNA, 20 bp, Artificial Sequence
  chemically synthesized
ttgtcttggcgcttaacatt

SEQ ID NO: 151123 - DNA, 20 bp, Artificial Sequence
  chemically synthesized
aagtaaaggagccaaatgtt

SEQ ID NO: 151124 - DNA, 20 bp, Artificial Sequence
  chemically synthesized
agaactttgcttaagtaaag

SEQ ID NO: 151125 - DNA, 20 bp, Artificial Sequence
  chemically synthesized
aacatttggctcctttactt

SEQ ID NO: 151126 - DNA, 20 bp, Artificial Sequence
  chemically synthesized
gcagaactttgcttaagtaa

SEQ ID NO: 151127 - DNA, 20 bp, Artificial Sequence
  chemically synthesized
tgcagaactttgcttaagta

SEQ ID NO: 151128 - DNA, 20 bp, Artificial Sequence
  chemically synthesized
ttggctcctttacttaagca

SEQ ID NO: 151129 - DNA, 20 bp, Artificial Sequence
  chemically synthesized
ctggctgcagaactttgctt

SEQ ID NO: 151130 - DNA, 20 bp, Artificial Sequence
  chemically synthesized
tttacttaagcaaagttctg

SEQ ID NO: 151131 - DNA, 20 bp, Artificial Sequence
  chemically synthesized
cttaagcaaagttctgcagc

SEQ ID NO: 151132 - DNA, 20 bp, Artificial Sequence
  chemically synthesized
tgagaaatacaagctggctg

SEQ ID NO: 151133 - DNA, 20 bp, Artificial Sequence
  chemically synthesized
attttctgagaaatacaagc

SEQ ID NO: 151134 - DNA, 20 bp, Artificial Sequence
  chemically synthesized
acccattttctgagaaatac

SEQ ID NO: 151135 - DNA, 20 bp, Artificial Sequence
  chemically synthesized
tgcagccagcttgtatttct

SEQ ID NO: 151136 - DNA, 20 bp, Artificial Sequence
  chemically synthesized
agcttgtatttctcagaaaa

SEQ ID NO: 151137 - DNA, 20 bp, Artificial Sequence
  chemically synthesized
gcttgtatttctcagaaaat

SEQ ID NO: 151138 - DNA, 20 bp, Artificial Sequence
  chemically synthesized
aaaagaaaaacccattttct

SEQ ID NO: 151139 - DNA, 20 bp, Artificial Sequence
  chemically synthesized
agcctaacaatgtgatagaa

SEQ ID NO: 151140 - DNA, 20 bp, Artificial Sequence
  chemically synthesized
tctgcagcctaacaatgtga

SEQ ID NO: 151141 - DNA, 20 bp, Artificial Sequence
  chemically synthesized
tttcttttctatcacattgt

SEQ ID NO: 151142 - DNA, 20 bp, Artificial Sequence
  chemically synthesized
ttcttttctatcacattgtt

SEQ ID NO: 151143 - DNA, 20 bp, Artificial Sequence
  chemically synthesized
tctatcacattgttaggctg

SEQ ID NO: 151144 - DNA, 20 bp, Artificial Sequence
  chemically synthesized
atcaaagtttggaaaatctg

SEQ ID NO: 151145 - DNA, 20 bp, Artificial Sequence
  chemically synthesized
ggaagcagagcatcaaagtt

SEQ ID NO: 151146 - DNA, 20 bp, Artificial Sequence
  chemically synthesized
taaagggaagcagagcatca

SEQ ID NO: 151147 - DNA, 20 bp, Artificial Sequence
  chemically synthesized
ctttgttttaaagggaagca

SEQ ID NO: 151148 - DNA, 20 bp, Artificial Sequence
  chemically synthesized
aactttgttttaaagggaag

SEQ ID NO: 151149 - DNA, 20 bp, Artificial Sequence
  chemically synthesized
tggaactttgttttaaaggg

SEQ ID NO: 151150 - DNA, 20 bp, Artificial Sequence
  chemically synthesized
aattggaactttgttttaaa

SEQ ID NO: 151151 - DNA, 20 bp, Artificial Sequence
  chemically synthesized
aaattggaactttgttttaa

SEQ ID NO: 151152 - DNA, 20 bp, Artificial Sequence
  chemically synthesized
ctctgcttccctttaaaaca

SEQ ID NO: 151153 - DNA, 20 bp, Artificial Sequence
  chemically synthesized
gaaattggaactttgtttta

SEQ ID NO: 151154 - DNA, 20 bp, Artificial Sequence
  chemically synthesized
ttaaaacaaagttccaattt

SEQ ID NO: 151155 - DNA, 20 bp, Artificial Sequence
  chemically synthesized
tgagagagatgatctgaaat

SEQ ID NO: 151156 - DNA, 20 bp, Artificial Sequence
  chemically synthesized
aatttcagatcatctctctc

SEQ ID NO: 151157 - DNA, 20 bp, Artificial Sequence
  chemically synthesized
gtggaaatttgaacttgaga

SEQ ID NO: 151158 - DNA, 20 bp, Artificial Sequence
  chemically synthesized
ctgtggaaatttgaacttga

SEQ ID NO: 151159 - DNA, 20 bp, Artificial Sequence
  chemically synthesized
atctgtggaaatttgaactt

SEQ ID NO: 151160 - DNA, 20 bp, Artificial Sequence
  chemically synthesized
ctctcaagttcaaatttcca

SEQ ID NO: 151161 - DNA, 20 bp, Artificial Sequence
  chemically synthesized
tcccctggcctagagatctg

SEQ ID NO: 151162 - DNA, 20 bp, Artificial Sequence
  chemically synthesized
ttcaaatttccacagatctc

SEQ ID NO: 151163 - DNA, 20 bp, Artificial Sequence
  chemically synthesized
tcaaatttccacagatctct

SEQ ID NO: 151164 - DNA, 20 bp, Artificial Sequence
  chemically synthesized
atttccacagatctctaggc

SEQ ID NO: 151165 - DNA, 20 bp, Artificial Sequence
  chemically synthesized
tttccacagatctctaggcc

SEQ ID NO: 151166 - DNA, 20 bp, Artificial Sequence
  chemically synthesized
ttccacagatctctaggcca

SEQ ID NO: 151167 - DNA, 20 bp, Artificial Sequence
  chemically synthesized
cagcattttcccctggccta

SEQ ID NO: 151168 - DNA, 20 bp, Artificial Sequence
  chemically synthesized
tccacagatctctaggccag

SEQ ID NO: 151169 - DNA, 20 bp, Artificial Sequence
  chemically synthesized
ggcagcattttcccctggcc

SEQ ID NO: 151170 - DNA, 20 bp, Artificial Sequence
  chemically synthesized
agactggcagcattttcccc

SEQ ID NO: 151171 - DNA, 20 bp, Artificial Sequence
  chemically synthesized
aggccaggggaaaatgctgc

SEQ ID NO: 151172 - DNA, 20 bp, Artificial Sequence
  chemically synthesized
agctttagcaaagagactgg

SEQ ID NO: 151173 - DNA, 20 bp, Artificial Sequence
  chemically synthesized
ctaagctttagcaaagagac

SEQ ID NO: 151174 - DNA, 20 bp, Artificial Sequence
  chemically synthesized
tgctgccagtctctttgcta

SEQ ID NO: 151175 - DNA, 20 bp, Artificial Sequence
  chemically synthesized
tgttgctaagctttagcaaa

SEQ ID NO: 151176 - DNA, 20 bp, Artificial Sequence
  chemically synthesized
actgttgctaagctttagca

SEQ ID NO: 151177 - DNA, 20 bp, Artificial Sequence
  chemically synthesized
ccagtctctttgctaaagct

SEQ ID NO: 151178 - DNA, 20 bp, Artificial Sequence
  chemically synthesized
aggacactgttgctaagctt

SEQ ID NO: 151179 - DNA, 20 bp, Artificial Sequence
  chemically synthesized
tctttgctaaagcttagcaa

SEQ ID NO: 151180 - DNA, 20 bp, Artificial Sequence
  chemically synthesized
gagcaaaggacactgttgct

SEQ ID NO: 151181 - DNA, 20 bp, Artificial Sequence
  chemically synthesized
agcaacagtgtcctttgctc

SEQ ID NO: 151182 - DNA, 20 bp, Artificial Sequence
  chemically synthesized
cttcttgggaactggagcaa

SEQ ID NO: 151183 - DNA, 20 bp, Artificial Sequence
  chemically synthesized
acttcttgggaactggagca

SEQ ID NO: 151184 - DNA, 20 bp, Artificial Sequence
  chemically synthesized
taggaacttcttgggaactg

SEQ ID NO: 151185 - DNA, 20 bp, Artificial Sequence
  chemically synthesized
tgtcctttgctccagttccc

SEQ ID NO: 151186 - DNA, 20 bp, Artificial Sequence
  chemically synthesized
attaggaacttcttgggaac

SEQ ID NO: 151187 - DNA, 20 bp, Artificial Sequence
  chemically synthesized
cctttgctccagttcccaag

SEQ ID NO: 151188 - DNA, 20 bp, Artificial Sequence
  chemically synthesized
atggagattaggaacttctt

SEQ ID NO: 151189 - DNA, 20 bp, Artificial Sequence
  chemically synthesized
gatggagattaggaacttct

SEQ ID NO: 151190 - DNA, 20 bp, Artificial Sequence
  chemically synthesized
ggtggtctcagatggagatt

SEQ ID NO: 151191 - DNA, 20 bp, Artificial Sequence
  chemically synthesized
aggtggtctcagatggagat

SEQ ID NO: 151192 - DNA, 20 bp, Artificial Sequence
  chemically synthesized
gaagttcctaatctccatct

SEQ ID NO: 151193 - DNA, 20 bp, Artificial Sequence
  chemically synthesized
ggctgaggtggtctcagatg

SEQ ID NO: 151194 - DNA, 20 bp, Artificial Sequence
  chemically synthesized
caggctgaggtggtctcaga

SEQ ID NO: 151195 - DNA, 20 bp, Artificial Sequence
  chemically synthesized
agtccaggctgaggtggtct

SEQ ID NO: 151196 - DNA, 20 bp, Artificial Sequence
  chemically synthesized
atctccatctgagaccacct

SEQ ID NO: 151197 - DNA, 20 bp, Artificial Sequence
  chemically synthesized
cgatgaagtccaggctgagg

SEQ ID NO: 151198 - DNA, 20 bp, Artificial Sequence
  chemically synthesized
catctgagaccacctcagcc

SEQ ID NO: 151199 - DNA, 20 bp, Artificial Sequence
  chemically synthesized
ggacgatgaagtccaggctg

SEQ ID NO: 151200 - DNA, 20 bp, Artificial Sequence
  chemically synthesized
tggacgatgaagtccaggct

SEQ ID NO: 151201 - DNA, 20 bp, Artificial Sequence
  chemically synthesized
tgatgtggacgatgaagtcc

SEQ ID NO: 151202 - DNA, 20 bp, Artificial Sequence
  chemically synthesized
gtgatgtggacgatgaagtc

SEQ ID NO: 151203 - DNA, 20 bp, Artificial Sequence
  chemically synthesized
cgatggtgatgtggacgatg

SEQ ID NO: 151204 - DNA, 20 bp, Artificial Sequence
  chemically synthesized
ccaaaatgccgatggtgatg

SEQ ID NO: 151205 - DNA, 20 bp, Artificial Sequence
  chemically synthesized
ttcatcgtccacatcaccat

SEQ ID NO: 151206 - DNA, 20 bp, Artificial Sequence
  chemically synthesized
ggttttgaccaaaatgccga

SEQ ID NO: 151207 - DNA, 20 bp, Artificial Sequence
  chemically synthesized
ccacatcaccatcggcattt

SEQ ID NO: 151208 - DNA, 20 bp, Artificial Sequence
  chemically synthesized
tttggtcaaaaccattcaac

SEQ ID NO: 151209 - DNA, 20 bp, Artificial Sequence
  chemically synthesized
cttcctagagacttgttgaa

SEQ ID NO: 151210 - DNA, 20 bp, Artificial Sequence
  chemically synthesized
aaaaccattcaacaagtctc

SEQ ID NO: 151211 - DNA, 20 bp, Artificial Sequence
  chemically synthesized
aaaccattcaacaagtctct

SEQ ID NO: 151212 - DNA, 20 bp, Artificial Sequence
  chemically synthesized
ccattcaacaagtctctagg

SEQ ID NO: 151213 - DNA, 20 bp, Artificial Sequence
  chemically synthesized
ggaaaatttgaaacttccta

SEQ ID NO: 151214 - DNA, 20 bp, Artificial Sequence
  chemically synthesized
tgggaaaatttgaaacttcc

SEQ ID NO: 151215 - DNA, 20 bp, Artificial Sequence
  chemically synthesized
agaagatgacaggaaaatgt

SEQ ID NO: 151216 - DNA, 20 bp, Artificial Sequence
  chemically synthesized
tagaagatgacaggaaaatg

SEQ ID NO: 151217 - DNA, 20 bp, Artificial Sequence
  chemically synthesized
ttggagggctagaagatgac

SEQ ID NO: 151218 - DNA, 20 bp, Artificial Sequence
  chemically synthesized
tttggagggctagaagatga

SEQ ID NO: 151219 - DNA, 20 bp, Artificial Sequence
  chemically synthesized
cacattttcctgtcatcttc

SEQ ID NO: 151220 - DNA, 20 bp, Artificial Sequence
  chemically synthesized
ggaacagtttggagggctag

SEQ ID NO: 151221 - DNA, 20 bp, Artificial Sequence
  chemically synthesized
gttggaacagtttggagggc

SEQ ID NO: 151222 - DNA, 20 bp, Artificial Sequence
  chemically synthesized
acaggttggaacagtttgga

SEQ ID NO: 151223 - DNA, 20 bp, Artificial Sequence
  chemically synthesized
cacaggttggaacagtttgg

SEQ ID NO: 151224 - DNA, 20 bp, Artificial Sequence
  chemically synthesized
gcacaggttggaacagtttg

SEQ ID NO: 151225 - DNA, 20 bp, Artificial Sequence
  chemically synthesized
aggcacaggttggaacagtt

SEQ ID NO: 151226 - DNA, 20 bp, Artificial Sequence
  chemically synthesized
gtaagaggcacaggttggaa

SEQ ID NO: 151227 - DNA, 20 bp, Artificial Sequence
  chemically synthesized
actgggtaagaggcacaggt

SEQ ID NO: 151228 - DNA, 20 bp, Artificial Sequence
  chemically synthesized
tggaactgggtaagaggcac

SEQ ID NO: 151229 - DNA, 20 bp, Artificial Sequence
  chemically synthesized
ttggaactgggtaagaggca

SEQ ID NO: 151230 - DNA, 20 bp, Artificial Sequence
  chemically synthesized
tccaacctgtgcctcttacc

SEQ ID NO: 151231 - DNA, 20 bp, Artificial Sequence
  chemically synthesized
gtgacttggaactgggtaag

SEQ ID NO: 151232 - DNA, 20 bp, Artificial Sequence
  chemically synthesized
agtgacttggaactgggtaa

SEQ ID NO: 151233 - DNA, 20 bp, Artificial Sequence
  chemically synthesized
gaagtgacttggaactgggt

SEQ ID NO: 151234 - DNA, 20 bp, Artificial Sequence
  chemically synthesized
tgtgcctcttacccagttcc

SEQ ID NO: 151235 - DNA, 20 bp, Artificial Sequence
  chemically synthesized
tgtggaagtgacttggaact

SEQ ID NO: 151236 - DNA, 20 bp, Artificial Sequence
  chemically synthesized
atgtggaagtgacttggaac

SEQ ID NO: 151237 - DNA, 20 bp, Artificial Sequence
  chemically synthesized
ctgaaaatgtggaagtgact

SEQ ID NO: 151238 - DNA, 20 bp, Artificial Sequence
  chemically synthesized
aaatatacctgaaaatgtgg

SEQ ID NO: 151239 - DNA, 20 bp, Artificial Sequence
  chemically synthesized
ccaagtcacttccacatttt

SEQ ID NO: 151240 - DNA, 20 bp, Artificial Sequence
  chemically synthesized
caagtcacttccacattttc

SEQ ID NO: 151241 - DNA, 20 bp, Artificial Sequence
  chemically synthesized
tgtaaatatacctgaaaatg

SEQ ID NO: 151242 - DNA, 20 bp, Artificial Sequence
  chemically synthesized
cacattttcaggtatattta

SEQ ID NO: 151243 - DNA, 20 bp, Artificial Sequence
  chemically synthesized
aattggtactgcagagagtg

SEQ ID NO: 151244 - DNA, 20 bp, Artificial Sequence
  chemically synthesized
aaattggtactgcagagagt

SEQ ID NO: 151245 - DNA, 20 bp, Artificial Sequence
  chemically synthesized
cagcaataccccactctctg

SEQ ID NO: 151246 - DNA, 20 bp, Artificial Sequence
  chemically synthesized
taaattggtactgcagagag

SEQ ID NO: 151247 - DNA, 20 bp, Artificial Sequence
  chemically synthesized
cagtaaattggtactgcaga

SEQ ID NO: 151248 - DNA, 20 bp, Artificial Sequence
  chemically synthesized
tacagtaaattggtactgca

SEQ ID NO: 151249 - DNA, 20 bp, Artificial Sequence
  chemically synthesized
aatacagtaaattggtactg

SEQ ID NO: 151250 - DNA, 20 bp, Artificial Sequence
  chemically synthesized
aacggactaatacagtaaat

SEQ ID NO: 151251 - DNA, 20 bp, Artificial Sequence
  chemically synthesized
gcagtaccaatttactgtat

SEQ ID NO: 151252 - DNA, 20 bp, Artificial Sequence
  chemically synthesized
agcatgagaacggactaata

SEQ ID NO: 151253 - DNA, 20 bp, Artificial Sequence
  chemically synthesized
tcttcatagcagcatgagaa

SEQ ID NO: 151254 - DNA, 20 bp, Artificial Sequence
  chemically synthesized
gtatttcttcatagcagcat

SEQ ID NO: 151255 - DNA, 20 bp, Artificial Sequence
  chemically synthesized
tccgttctcatgctgctatg

SEQ ID NO: 151256 - DNA, 20 bp, Artificial Sequence
  chemically synthesized
tcttgggtatttcttcatag

SEQ ID NO: 151257 - DNA, 20 bp, Artificial Sequence
  chemically synthesized
cggtcttgggtatttcttca

SEQ ID NO: 151258 - DNA, 20 bp, Artificial Sequence
  chemically synthesized
gctgctatgaagaaataccc

SEQ ID NO: 151259 - DNA, 20 bp, Artificial Sequence
  chemically synthesized
tatgaagaaatacccaagac

SEQ ID NO: 151260 - DNA, 20 bp, Artificial Sequence
  chemically synthesized
atgaagaaatacccaagacc

SEQ ID NO: 151261 - DNA, 20 bp, Artificial Sequence
  chemically synthesized
tttataaattacccggtctt

SEQ ID NO: 151262 - DNA, 20 bp, Artificial Sequence
  chemically synthesized
ctttataaattacccggtct

SEQ ID NO: 151263 - DNA, 20 bp, Artificial Sequence
  chemically synthesized
tcttttctttataaattacc

SEQ ID NO: 151264 - DNA, 20 bp, Artificial Sequence
  chemically synthesized
ccaagaccgggtaatttata

SEQ ID NO: 151265 - DNA, 20 bp, Artificial Sequence
  chemically synthesized
accgggtaatttataaagaa

SEQ ID NO: 151266 - DNA, 20 bp, Artificial Sequence
  chemically synthesized
cgggtaatttataaagaaaa

SEQ ID NO: 151267 - DNA, 20 bp, Artificial Sequence
  chemically synthesized
gggtaatttataaagaaaag

SEQ ID NO: 151268 - DNA, 20 bp, Artificial Sequence
  chemically synthesized
tataaagaaaagaggtttaa

SEQ ID NO: 151269 - DNA, 20 bp, Artificial Sequence
  chemically synthesized
aaagaggtttaatagactca

SEQ ID NO: 151270 - DNA, 20 bp, Artificial Sequence
  chemically synthesized
ctgaagccatgcggaactgt

SEQ ID NO: 151271 - DNA, 20 bp, Artificial Sequence
  chemically synthesized
aatagactcacagttccgca

SEQ ID NO: 151272 - DNA, 20 bp, Artificial Sequence
  chemically synthesized
cggaggcctctgaagccatg

SEQ ID NO: 151273 - DNA, 20 bp, Artificial Sequence
  chemically synthesized
ctcacagttccgcatggctt

SEQ ID NO: 151274 - DNA, 20 bp, Artificial Sequence
  chemically synthesized
cacagttccgcatggcttca

SEQ ID NO: 151275 - DNA, 20 bp, Artificial Sequence
  chemically synthesized
acagttccgcatggcttcag

SEQ ID NO: 151276 - DNA, 20 bp, Artificial Sequence
  chemically synthesized
taagtttccggaggcctctg

SEQ ID NO: 151277 - DNA, 20 bp, Artificial Sequence
  chemically synthesized
cgcatggcttcagaggcctc

SEQ ID NO: 151278 - DNA, 20 bp, Artificial Sequence
  chemically synthesized
ccatgattgtaagtttccgg

SEQ ID NO: 151279 - DNA, 20 bp, Artificial Sequence
  chemically synthesized
tccatgattgtaagtttccg

SEQ ID NO: 151280 - DNA, 20 bp, Artificial Sequence
  chemically synthesized
cctccatgattgtaagtttc

SEQ ID NO: 151281 - DNA, 20 bp, Artificial Sequence
  chemically synthesized
cctccggaaacttacaatca

SEQ ID NO: 151282 - DNA, 20 bp, Artificial Sequence
  chemically synthesized
gtgccttcctccatgattgt

SEQ ID NO: 151283 - DNA, 20 bp, Artificial Sequence
  chemically synthesized
tccggaaacttacaatcatg

SEQ ID NO: 151284 - DNA, 20 bp, Artificial Sequence
  chemically synthesized
ccggaaacttacaatcatgg

SEQ ID NO: 151285 - DNA, 20 bp, Artificial Sequence
  chemically synthesized
gaaacttacaatcatggagg

SEQ ID NO: 151286 - DNA, 20 bp, Artificial Sequence
  chemically synthesized
aaacttacaatcatggagga

SEQ ID NO: 151287 - DNA, 20 bp, Artificial Sequence
  chemically synthesized
tggaggaaggcaccttttca

SEQ ID NO: 151288 - DNA, 20 bp, Artificial Sequence
  chemically synthesized
ggaggaaggcaccttttcac

SEQ ID NO: 151289 - DNA, 20 bp, Artificial Sequence
  chemically synthesized
gaggaaggcaccttttcaca

SEQ ID NO: 151290 - DNA, 20 bp, Artificial Sequence
  chemically synthesized
tctcctatcaccctgtgaaa

SEQ ID NO: 151291 - DNA, 20 bp, Artificial Sequence
  chemically synthesized
ctctcctatcaccctgtgaa

SEQ ID NO: 151292 - DNA, 20 bp, Artificial Sequence
  chemically synthesized
ggcaccttttcacagggtga

SEQ ID NO: 151293 - DNA, 20 bp, Artificial Sequence
  chemically synthesized
gcaccttttcacagggtgat

SEQ ID NO: 151294 - DNA, 20 bp, Artificial Sequence
  chemically synthesized
accttttcacagggtgatag

SEQ ID NO: 151295 - DNA, 20 bp, Artificial Sequence
  chemically synthesized
cttttcacagggtgatagga

SEQ ID NO: 151296 - DNA, 20 bp, Artificial Sequence
  chemically synthesized
tttcacagggtgataggaga

SEQ ID NO: 151297 - DNA, 20 bp, Artificial Sequence
  chemically synthesized
agggtgataggagagagaat

SEQ ID NO: 151298 - DNA, 20 bp, Artificial Sequence
  chemically synthesized
ataggagagagaatgagtgc

SEQ ID NO: 151299 - DNA, 20 bp, Artificial Sequence
  chemically synthesized
gagagagaatgagtgccagc

SEQ ID NO: 151300 - DNA, 20 bp, Artificial Sequence
  chemically synthesized
agagagaatgagtgccagca

SEQ ID NO: 151301 - DNA, 20 bp, Artificial Sequence
  chemically synthesized
gagagaatgagtgccagcaa

SEQ ID NO: 151302 - DNA, 20 bp, Artificial Sequence
  chemically synthesized
gcatctggcatttcccttgc

SEQ ID NO: 151303 - DNA, 20 bp, Artificial Sequence
  chemically synthesized
agtgccagcaagggaaatgc

SEQ ID NO: 151304 - DNA, 20 bp, Artificial Sequence
  chemically synthesized
ctgatggttttataagcatc

SEQ ID NO: 151305 - DNA, 20 bp, Artificial Sequence
  chemically synthesized
atgagatctgatggttttat

SEQ ID NO: 151306 - DNA, 20 bp, Artificial Sequence
  chemically synthesized
ccagatgcttataaaaccat

SEQ ID NO: 151307 - DNA, 20 bp, Artificial Sequence
  chemically synthesized
tgagttctcatgagatctga

SEQ ID NO: 151308 - DNA, 20 bp, Artificial Sequence
  chemically synthesized
ataaaaccatcagatctcat

SEQ ID NO: 151309 - DNA, 20 bp, Artificial Sequence
  chemically synthesized
gatagtgaatgagttctcat

SEQ ID NO: 151310 - DNA, 20 bp, Artificial Sequence
  chemically synthesized
ctgttgtcgtgatagtgaat

SEQ ID NO: 151311 - DNA, 20 bp, Artificial Sequence
  chemically synthesized
cccccatgctgttgtcgtga

SEQ ID NO: 151312 - DNA, 20 bp, Artificial Sequence
  chemically synthesized
ctcattcactatcacgacaa

SEQ ID NO: 151313 - DNA, 20 bp, Artificial Sequence
  chemically synthesized
tcactatcacgacaacagca

SEQ ID NO: 151314 - DNA, 20 bp, Artificial Sequence
  chemically synthesized
cactatcacgacaacagcat

SEQ ID NO: 151315 - DNA, 20 bp, Artificial Sequence
  chemically synthesized
actatcacgacaacagcatg

SEQ ID NO: 151316 - DNA, 20 bp, Artificial Sequence
  chemically synthesized
ctatcacgacaacagcatgg

SEQ ID NO: 151317 - DNA, 20 bp, Artificial Sequence
  chemically synthesized
tatcacgacaacagcatggg

SEQ ID NO: 151318 - DNA, 20 bp, Artificial Sequence
  chemically synthesized
gggggaagtaattgaatcat

SEQ ID NO: 151319 - DNA, 20 bp, Artificial Sequence
  chemically synthesized
agggggaagtaattgaatca

SEQ ID NO: 151320 - DNA, 20 bp, Artificial Sequence
  chemically synthesized
atgattcaattacttccccc

SEQ ID NO: 151321 - DNA, 20 bp, Artificial Sequence
  chemically synthesized
tgattcaattacttccccct

SEQ ID NO: 151322 - DNA, 20 bp, Artificial Sequence
  chemically synthesized
tgtgggagggacccaggggg

SEQ ID NO: 151323 - DNA, 20 bp, Artificial Sequence
  chemically synthesized
tgttgtgggagggacccagg

SEQ ID NO: 151324 - DNA, 20 bp, Artificial Sequence
  chemically synthesized
gtgttgtgggagggacccag

SEQ ID NO: 151325 - DNA, 20 bp, Artificial Sequence
  chemically synthesized
tgtgttgtgggagggaccca

SEQ ID NO: 151326 - DNA, 20 bp, Artificial Sequence
  chemically synthesized
atgtgttgtgggagggaccc

SEQ ID NO: 151327 - DNA, 20 bp, Artificial Sequence
  chemically synthesized
catgtgttgtgggagggacc

SEQ ID NO: 151328 - DNA, 20 bp, Artificial Sequence
  chemically synthesized
aattcccatgtgttgtggga

SEQ ID NO: 151329 - DNA, 20 bp, Artificial Sequence
  chemically synthesized
taattcccatgtgttgtggg

SEQ ID NO: 151330 - DNA, 20 bp, Artificial Sequence
  chemically synthesized
gtaattcccatgtgttgtgg

SEQ ID NO: 151331 - DNA, 20 bp, Artificial Sequence
  chemically synthesized
ctgtaattcccatgtgttgt

SEQ ID NO: 151332 - DNA, 20 bp, Artificial Sequence
  chemically synthesized
tgggtccctcccacaacaca

SEQ ID NO: 151333 - DNA, 20 bp, Artificial Sequence
  chemically synthesized
cctgtaattcccatgtgttg

SEQ ID NO: 151334 - DNA, 20 bp, Artificial Sequence
  chemically synthesized
gggtccctcccacaacacat

SEQ ID NO: 151335 - DNA, 20 bp, Artificial Sequence
  chemically synthesized
cccacaacacatgggaatta

SEQ ID NO: 151336 - DNA, 20 bp, Artificial Sequence
  chemically synthesized
ccacaacacatgggaattac

SEQ ID NO: 151337 - DNA, 20 bp, Artificial Sequence
  chemically synthesized
cacaacacatgggaattaca

SEQ ID NO: 151338 - DNA, 20 bp, Artificial Sequence
  chemically synthesized
aattacagggattacaattc

SEQ ID NO: 151339 - DNA, 20 bp, Artificial Sequence
  chemically synthesized
attacagggattacaattca

SEQ ID NO: 151340 - DNA, 20 bp, Artificial Sequence
  chemically synthesized
cagggattacaattcaaggt

SEQ ID NO: 151341 - DNA, 20 bp, Artificial Sequence
  chemically synthesized
ttacaattcaaggtgagatt

SEQ ID NO: 151342 - DNA, 20 bp, Artificial Sequence
  chemically synthesized
tacaattcaaggtgagattt

SEQ ID NO: 151343 - DNA, 20 bp, Artificial Sequence
  chemically synthesized
aattcaaggtgagatttggg

SEQ ID NO: 151344 - DNA, 20 bp, Artificial Sequence
  chemically synthesized
attcaaggtgagatttgggt

SEQ ID NO: 151345 - DNA, 20 bp, Artificial Sequence
  chemically synthesized
ttcaaggtgagatttgggtg

SEQ ID NO: 151346 - DNA, 20 bp, Artificial Sequence
  chemically synthesized
gtgagatttgggtggggaca

SEQ ID NO: 151347 - DNA, 20 bp, Artificial Sequence
  chemically synthesized
ctttgaccaatgatatggtt

SEQ ID NO: 151348 - DNA, 20 bp, Artificial Sequence
  chemically synthesized
acacagccaaaccatatcat

SEQ ID NO: 151349 - DNA, 20 bp, Artificial Sequence
  chemically synthesized
gtgccctttgaccaatgata

SEQ ID NO: 151350 - DNA, 20 bp, Artificial Sequence
  chemically synthesized
ccaaaccatatcattggtca

SEQ ID NO: 151351 - DNA, 20 bp, Artificial Sequence
  chemically synthesized
caaaccatatcattggtcaa

SEQ ID NO: 151352 - DNA, 20 bp, Artificial Sequence
  chemically synthesized
aaaccatatcattggtcaaa

SEQ ID NO: 151353 - DNA, 20 bp, Artificial Sequence
  chemically synthesized
ggtcaaagggcacaaacttt

SEQ ID NO: 151354 - DNA, 20 bp, Artificial Sequence
  chemically synthesized
cccagacatcttataactga

SEQ ID NO: 151355 - DNA, 20 bp, Artificial Sequence
  chemically synthesized
gggcacaaactttcagttat

SEQ ID NO: 151356 - DNA, 20 bp, Artificial Sequence
  chemically synthesized
actttcagttataagatgtc

SEQ ID NO: 151357 - DNA, 20 bp, Artificial Sequence
  chemically synthesized
ctttcagttataagatgtct

SEQ ID NO: 151358 - DNA, 20 bp, Artificial Sequence
  chemically synthesized
tttcagttataagatgtctg

SEQ ID NO: 151359 - DNA, 20 bp, Artificial Sequence
  chemically synthesized
cataatgtacattagatccc

SEQ ID NO: 151360 - DNA, 20 bp, Artificial Sequence
  chemically synthesized
atagtaaccataatgtacat

SEQ ID NO: 151361 - DNA, 20 bp, Artificial Sequence
  chemically synthesized
tggggatctaatgtacatta

SEQ ID NO: 151362 - DNA, 20 bp, Artificial Sequence
  chemically synthesized
aatgtacattatggttacta

SEQ ID NO: 151363 - DNA, 20 bp, Artificial Sequence
  chemically synthesized
cagtaaagtattattaacta

SEQ ID NO: 151364 - DNA, 20 bp, Artificial Sequence
  chemically synthesized
caaatttcaagtaaacagta

SEQ ID NO: 151365 - DNA, 20 bp, Artificial Sequence
  chemically synthesized
tgtagcaaatttcaagtaaa

SEQ ID NO: 151366 - DNA, 20 bp, Artificial Sequence
  chemically synthesized
ccagtcttgtagcaaatttc

SEQ ID NO: 151367 - DNA, 20 bp, Artificial Sequence
  chemically synthesized
gtttacttgaaatttgctac

SEQ ID NO: 151368 - DNA, 20 bp, Artificial Sequence
  chemically synthesized
cttgaaatttgctacaagac

SEQ ID NO: 151369 - DNA, 20 bp, Artificial Sequence
  chemically synthesized
acacttaagatccagtcttg

SEQ ID NO: 151370 - DNA, 20 bp, Artificial Sequence
  chemically synthesized
ttgctacaagactggatctt

SEQ ID NO: 151371 - DNA, 20 bp, Artificial Sequence
  chemically synthesized
ggatgaggacacttaagatc

SEQ ID NO: 151372 - DNA, 20 bp, Artificial Sequence
  chemically synthesized
ggggggggatgaggacactt

SEQ ID NO: 151373 - DNA, 20 bp, Artificial Sequence
  chemically synthesized
tgtgttgggggggggggatg

SEQ ID NO: 151374 - DNA, 20 bp, Artificial Sequence
  chemically synthesized
gtgtgttgggggggggggat

SEQ ID NO: 151375 - DNA, 20 bp, Artificial Sequence
  chemically synthesized
tgtgtgtgtgttgggggggg

SEQ ID NO: 151376 - DNA, 20 bp, Artificial Sequence
  chemically synthesized
ttgtgtgtgtgttggggggg

SEQ ID NO: 151377 - DNA, 20 bp, Artificial Sequence
  chemically synthesized
attgtgtgtgtgttgggggg

SEQ ID NO: 151378 - DNA, 20 bp, Artificial Sequence
  chemically synthesized
tattgtgtgtgtgttggggg

SEQ ID NO: 151379 - DNA, 20 bp, Artificial Sequence
  chemically synthesized
ctattgtgtgtgtgttgggg

SEQ ID NO: 151380 - DNA, 20 bp, Artificial Sequence
  chemically synthesized
actattgtgtgtgtgttggg

SEQ ID NO: 151381 - DNA, 20 bp, Artificial Sequence
  chemically synthesized
tactattgtgtgtgtgttgg

SEQ ID NO: 151382 - DNA, 20 bp, Artificial Sequence
  chemically synthesized
ttactattgtgtgtgtgttg

SEQ ID NO: 151383 - DNA, 20 bp, Artificial Sequence
  chemically synthesized
gttactattgtgtgtgtgtt

SEQ ID NO: 151384 - DNA, 20 bp, Artificial Sequence
  chemically synthesized
agttactattgtgtgtgtgt

SEQ ID NO: 151385 - DNA, 20 bp, Artificial Sequence
  chemically synthesized
cccccccaacacacacacaa

SEQ ID NO: 151386 - DNA, 20 bp, Artificial Sequence
  chemically synthesized
aatacatctagcacaagaaa

SEQ ID NO: 151387 - DNA, 20 bp, Artificial Sequence
  chemically synthesized
atagtaactatttcttgtgc

SEQ ID NO: 151388 - DNA, 20 bp, Artificial Sequence
  chemically synthesized
ttaattaatacatctagcac

SEQ ID NO: 151389 - DNA, 20 bp, Artificial Sequence
  chemically synthesized
atcaaattaattaatacatc

SEQ ID NO: 151390 - DNA, 20 bp, Artificial Sequence
  chemically synthesized
tgtattaattaatttgattg

SEQ ID NO: 151391 - DNA, 20 bp, Artificial Sequence
  chemically synthesized
gtggtaatcatctcacaata

SEQ ID NO: 151392 - DNA, 20 bp, Artificial Sequence
  chemically synthesized
attttatatgactatattgt

SEQ ID NO: 151393 - DNA, 20 bp, Artificial Sequence
  chemically synthesized
ataaaaactgtatgtattca

SEQ ID NO: 151394 - DNA, 20 bp, Artificial Sequence
  chemically synthesized
aataaaaactgtatgtattc

SEQ ID NO: 151395 - DNA, 20 bp, Artificial Sequence
  chemically synthesized
ttgtataccttgaatacata

SEQ ID NO: 151396 - DNA, 20 bp, Artificial Sequence
  chemically synthesized
agctttattgaagtataatt

SEQ ID NO: 151397 - DNA, 20 bp, Artificial Sequence
  chemically synthesized
ttctcaattatacttcaata

SEQ ID NO: 151398 - DNA, 20 bp, Artificial Sequence
  chemically synthesized
ctccttacctagctttattg

SEQ ID NO: 151399 - DNA, 20 bp, Artificial Sequence
  chemically synthesized
caattatacttcaataaagc

SEQ ID NO: 151400 - DNA, 20 bp, Artificial Sequence
  chemically synthesized
aattatacttcaataaagct

SEQ ID NO: 151401 - DNA, 20 bp, Artificial Sequence
  chemically synthesized
atacttcaataaagctaggt

SEQ ID NO: 151402 - DNA, 20 bp, Artificial Sequence
  chemically synthesized
tacttcaataaagctaggta

SEQ ID NO: 151403 - DNA, 20 bp, Artificial Sequence
  chemically synthesized
cttcaataaagctaggtaag

SEQ ID NO: 151404 - DNA, 20 bp, Artificial Sequence
  chemically synthesized
ttcaataaagctaggtaagg

SEQ ID NO: 151405 - DNA, 20 bp, Artificial Sequence
  chemically synthesized
tactctgcctcctccttacc

SEQ ID NO: 151406 - DNA, 20 bp, Artificial Sequence
  chemically synthesized
caataaagctaggtaaggag

SEQ ID NO: 151407 - DNA, 20 bp, Artificial Sequence
  chemically synthesized
aataaagctaggtaaggagg

SEQ ID NO: 151408 - DNA, 20 bp, Artificial Sequence
  chemically synthesized
aaagctaggtaaggaggagg

SEQ ID NO: 151409 - DNA, 20 bp, Artificial Sequence
  chemically synthesized
agctaggtaaggaggaggca

SEQ ID NO: 151410 - DNA, 20 bp, Artificial Sequence
  chemically synthesized
aggaggcagagtatgtcctc

SEQ ID NO: 151411 - DNA, 20 bp, Artificial Sequence
  chemically synthesized
aggcagagtatgtcctcaag

SEQ ID NO: 151412 - DNA, 20 bp, Artificial Sequence
  chemically synthesized
actcaattgtgagcttcttg

SEQ ID NO: 151413 - DNA, 20 bp, Artificial Sequence
  chemically synthesized
tactcaattgtgagcttctt

SEQ ID NO: 151414 - DNA, 20 bp, Artificial Sequence
  chemically synthesized
tcctcaagaagctcacaatt

SEQ ID NO: 151415 - DNA, 20 bp, Artificial Sequence
  chemically synthesized
tgttccccctactcaattgt

SEQ ID NO: 151416 - DNA, 20 bp, Artificial Sequence
  chemically synthesized
tcaagaagctcacaattgag

SEQ ID NO: 151417 - DNA, 20 bp, Artificial Sequence
  chemically synthesized
caagaagctcacaattgagt

SEQ ID NO: 151418 - DNA, 20 bp, Artificial Sequence
  chemically synthesized
aagaagctcacaattgagta

SEQ ID NO: 151419 - DNA, 20 bp, Artificial Sequence
  chemically synthesized
agaagctcacaattgagtag

SEQ ID NO: 151420 - DNA, 20 bp, Artificial Sequence
  chemically synthesized
gaagctcacaattgagtagg

SEQ ID NO: 151421 - DNA, 20 bp, Artificial Sequence
  chemically synthesized
caaatcttatatttatttgt

SEQ ID NO: 151422 - DNA, 20 bp, Artificial Sequence
  chemically synthesized
ccaaatcttatatttatttg

SEQ ID NO: 151423 - DNA, 20 bp, Artificial Sequence
  chemically synthesized
attgtcccacaaataaatat

SEQ ID NO: 151424 - DNA, 20 bp, Artificial Sequence
  chemically synthesized
ccacaaataaatataagatt

SEQ ID NO: 151425 - DNA, 20 bp, Artificial Sequence
  chemically synthesized
ataagatttggtgtgtgctc

SEQ ID NO: 151426 - DNA, 20 bp, Artificial Sequence
  chemically synthesized
agatttggtgtgtgctctgg

SEQ ID NO: 151427 - DNA, 20 bp, Artificial Sequence
  chemically synthesized
atttggtgtgtgctctggaa

SEQ ID NO: 151428 - DNA, 20 bp, Artificial Sequence
  chemically synthesized
tttggtgtgtgctctggaag

SEQ ID NO: 151429 - DNA, 20 bp, Artificial Sequence
  chemically synthesized
ctatttatactcctcttcca

SEQ ID NO: 151430 - DNA, 20 bp, Artificial Sequence
  chemically synthesized
tggtgtgtgctctggaagag

SEQ ID NO: 151431 - DNA, 20 bp, Artificial Sequence
  chemically synthesized
cactatttatactcctcttc

SEQ ID NO: 151432 - DNA, 20 bp, Artificial Sequence
  chemically synthesized
ctctggaagaggagtataaa

SEQ ID NO: 151433 - DNA, 20 bp, Artificial Sequence
  chemically synthesized
ccaaactaggttagtgtaaa

SEQ ID NO: 151434 - DNA, 20 bp, Artificial Sequence
  chemically synthesized
tagtgccatttacactaacc

SEQ ID NO: 151435 - DNA, 20 bp, Artificial Sequence
  chemically synthesized
ccttacctcccaaactaggt

SEQ ID NO: 151436 - DNA, 20 bp, Artificial Sequence
  chemically synthesized
ccatttacactaacctagtt

SEQ ID NO: 151437 - DNA, 20 bp, Artificial Sequence
  chemically synthesized
catttacactaacctagttt

SEQ ID NO: 151438 - DNA, 20 bp, Artificial Sequence
  chemically synthesized
tttacactaacctagtttgg

SEQ ID NO: 151439 - DNA, 20 bp, Artificial Sequence
  chemically synthesized
cgctccttacctcccaaact

SEQ ID NO: 151440 - DNA, 20 bp, Artificial Sequence
  chemically synthesized
ttacactaacctagtttggg

SEQ ID NO: 151441 - DNA, 20 bp, Artificial Sequence
  chemically synthesized
acgctccttacctcccaaac

SEQ ID NO: 151442 - DNA, 20 bp, Artificial Sequence
  chemically synthesized
actaacctagtttgggaggt

SEQ ID NO: 151443 - DNA, 20 bp, Artificial Sequence
  chemically synthesized
ctaacctagtttgggaggta

SEQ ID NO: 151444 - DNA, 20 bp, Artificial Sequence
  chemically synthesized
aacctagtttgggaggtaag

SEQ ID NO: 151445 - DNA, 20 bp, Artificial Sequence
  chemically synthesized
aggtaaggagcgtctttcct

SEQ ID NO: 151446 - DNA, 20 bp, Artificial Sequence
  chemically synthesized
ctcaaatgttatactcagga

SEQ ID NO: 151447 - DNA, 20 bp, Artificial Sequence
  chemically synthesized
tcagctcaaatgttatactc

SEQ ID NO: 151448 - DNA, 20 bp, Artificial Sequence
  chemically synthesized
ctcagctcaaatgttatact

SEQ ID NO: 151449 - DNA, 20 bp, Artificial Sequence
  chemically synthesized
ctttcctgagtataacattt

SEQ ID NO: 151450 - DNA, 20 bp, Artificial Sequence
  chemically synthesized
ctgagtataacatttgagct

SEQ ID NO: 151451 - DNA, 20 bp, Artificial Sequence
  chemically synthesized
cctactcacttttcaggtct

SEQ ID NO: 151452 - DNA, 20 bp, Artificial Sequence
  chemically synthesized
catttgagctgagacctgaa

SEQ ID NO: 151453 - DNA, 20 bp, Artificial Sequence
  chemically synthesized
tgagctgagacctgaaaagt

SEQ ID NO: 151454 - DNA, 20 bp, Artificial Sequence
  chemically synthesized
ctcatacctactcacttttc

SEQ ID NO: 151455 - DNA, 20 bp, Artificial Sequence
  chemically synthesized
cctcatacctactcactttt

SEQ ID NO: 151456 - DNA, 20 bp, Artificial Sequence
  chemically synthesized
gctgagacctgaaaagtgag

SEQ ID NO: 151457 - DNA, 20 bp, Artificial Sequence
  chemically synthesized
ctgagacctgaaaagtgagt

SEQ ID NO: 151458 - DNA, 20 bp, Artificial Sequence
  chemically synthesized
cctgaaaagtgagtaggtat

SEQ ID NO: 151459 - DNA, 20 bp, Artificial Sequence
  chemically synthesized
ctgaaaagtgagtaggtatg

SEQ ID NO: 151460 - DNA, 20 bp, Artificial Sequence
  chemically synthesized
gtatgaggtcaaaaattcaa

SEQ ID NO: 151461 - DNA, 20 bp, Artificial Sequence
  chemically synthesized
tatgaggtcaaaaattcaaa

SEQ ID NO: 151462 - DNA, 20 bp, Artificial Sequence
  chemically synthesized
aggtcaaaaattcaaaagga

SEQ ID NO: 151463 - DNA, 20 bp, Artificial Sequence
  chemically synthesized
caaaaggatagtgtctcaat

SEQ ID NO: 151464 - DNA, 20 bp, Artificial Sequence
  chemically synthesized
aaaggatagtgtctcaatca

SEQ ID NO: 151465 - DNA, 20 bp, Artificial Sequence
  chemically synthesized
aggatagtgtctcaatcaga

SEQ ID NO: 151466 - DNA, 20 bp, Artificial Sequence
  chemically synthesized
acatattggtctctctgatt

SEQ ID NO: 151467 - DNA, 20 bp, Artificial Sequence
  chemically synthesized
tttaaagccattgcacatat

SEQ ID NO: 151468 - DNA, 20 bp, Artificial Sequence
  chemically synthesized
agagagaccaatatgtgcaa

SEQ ID NO: 151469 - DNA, 20 bp, Artificial Sequence
  chemically synthesized
tgtgcaatggctttaaaaaa

SEQ ID NO: 151470 - DNA, 20 bp, Artificial Sequence
  chemically synthesized
tgcttattttctgtttttta

SEQ ID NO: 151471 - DNA, 20 bp, Artificial Sequence
  chemically synthesized
ggctttaaaaaacagaaaat

SEQ ID NO: 151472 - DNA, 20 bp, Artificial Sequence
  chemically synthesized
cagaaaataagcactttcat

SEQ ID NO: 151473 - DNA, 20 bp, Artificial Sequence
  chemically synthesized
tagttttgttttgcttatga

SEQ ID NO: 151474 - DNA, 20 bp, Artificial Sequence
  chemically synthesized
tttcataagcaaaacaaaac

SEQ ID NO: 151475 - DNA, 20 bp, Artificial Sequence
  chemically synthesized
ttcataagcaaaacaaaact

SEQ ID NO: 151476 - DNA, 20 bp, Artificial Sequence
  chemically synthesized
cataagcaaaacaaaactag

SEQ ID NO: 151477 - DNA, 20 bp, Artificial Sequence
  chemically synthesized
ataagcaaaacaaaactagg

SEQ ID NO: 151478 - DNA, 20 bp, Artificial Sequence
  chemically synthesized
taagcaaaacaaaactagga

SEQ ID NO: 151479 - DNA, 20 bp, Artificial Sequence
  chemically synthesized
agcaaaacaaaactaggagg

SEQ ID NO: 151480 - DNA, 20 bp, Artificial Sequence
  chemically synthesized
gcaaaacaaaactaggaggg

SEQ ID NO: 151481 - DNA, 20 bp, Artificial Sequence
  chemically synthesized
ctccacattgacctccctcc

SEQ ID NO: 151482 - DNA, 20 bp, Artificial Sequence
  chemically synthesized
aactaggagggaggtcaatg

SEQ ID NO: 151483 - DNA, 20 bp, Artificial Sequence
  chemically synthesized
ctaggagggaggtcaatgtg

SEQ ID NO: 151484 - DNA, 20 bp, Artificial Sequence
  chemically synthesized
agggaggtcaatgtggagat

SEQ ID NO: 151485 - DNA, 20 bp, Artificial Sequence
  chemically synthesized
ggaggtcaatgtggagataa

SEQ ID NO: 151486 - DNA, 20 bp, Artificial Sequence
  chemically synthesized
aggtcaatgtggagataaga

SEQ ID NO: 151487 - DNA, 20 bp, Artificial Sequence
  chemically synthesized
caatgtggagataagagagt

SEQ ID NO: 151488 - DNA, 20 bp, Artificial Sequence
  chemically synthesized
tgtggagataagagagtaag

SEQ ID NO: 151489 - DNA, 20 bp, Artificial Sequence
  chemically synthesized
ataagagagtaagtagttca

SEQ ID NO: 151490 - DNA, 20 bp, Artificial Sequence
  chemically synthesized
agtaagtagttcacagtatc

SEQ ID NO: 151491 - DNA, 20 bp, Artificial Sequence
  chemically synthesized
tagttcacagtatctggtat

SEQ ID NO: 151492 - DNA, 20 bp, Artificial Sequence
  chemically synthesized
agttcacagtatctggtata

SEQ ID NO: 151493 - DNA, 20 bp, Artificial Sequence
  chemically synthesized
ccatttcatcatccttatac

SEQ ID NO: 151494 - DNA, 20 bp, Artificial Sequence
  chemically synthesized
ctggtataaggatgatgaaa

SEQ ID NO: 151495 - DNA, 20 bp, Artificial Sequence
  chemically synthesized
tataaggatgatgaaatgga

SEQ ID NO: 151496 - DNA, 20 bp, Artificial Sequence
  chemically synthesized
ataaggatgatgaaatggaa

SEQ ID NO: 151497 - DNA, 20 bp, Artificial Sequence
  chemically synthesized
taaggatgatgaaatggaaa

SEQ ID NO: 151498 - DNA, 20 bp, Artificial Sequence
  chemically synthesized
tggaaagggtcacactatac

SEQ ID NO: 151499 - DNA, 20 bp, Artificial Sequence
  chemically synthesized
atatcccacaggatcttgta

SEQ ID NO: 151500 - DNA, 20 bp, Artificial Sequence
  chemically synthesized
tcacactatacaagatcctg

SEQ ID NO: 151501 - DNA, 20 bp, Artificial Sequence
  chemically synthesized
cacactatacaagatcctgt

SEQ ID NO: 151502 - DNA, 20 bp, Artificial Sequence
  chemically synthesized
aaaaagaaatgatatcccac

SEQ ID NO: 151503 - DNA, 20 bp, Artificial Sequence
  chemically synthesized
aaaaaagaaatgatatccca

SEQ ID NO: 151504 - DNA, 20 bp, Artificial Sequence
  chemically synthesized
caaaataaaaatttcaaaaa

SEQ ID NO: 151505 - DNA, 20 bp, Artificial Sequence
  chemically synthesized
ttttttgaaatttttatttt

SEQ ID NO: 151506 - DNA, 20 bp, Artificial Sequence
  chemically synthesized
aatttttattttgagataaa

SEQ ID NO: 151507 - DNA, 20 bp, Artificial Sequence
  chemically synthesized
tttattttgagataaatggt

SEQ ID NO: 151508 - DNA, 20 bp, Artificial Sequence
  chemically synthesized
ttattttgagataaatggta

SEQ ID NO: 151509 - DNA, 20 bp, Artificial Sequence
  chemically synthesized
tgagataaatggtaaggtac

SEQ ID NO: 151510 - DNA, 20 bp, Artificial Sequence
  chemically synthesized
agataaatggtaaggtactg

SEQ ID NO: 151511 - DNA, 20 bp, Artificial Sequence
  chemically synthesized
gaactctgtttaaaatgctc

SEQ ID NO: 151512 - DNA, 20 bp, Artificial Sequence
  chemically synthesized
aggtactggagcattttaaa

SEQ ID NO: 151513 - DNA, 20 bp, Artificial Sequence
  chemically synthesized
gtactggagcattttaaaca

SEQ ID NO: 151514 - DNA, 20 bp, Artificial Sequence
  chemically synthesized
aatataaatttgatgacaga

SEQ ID NO: 151515 - DNA, 20 bp, Artificial Sequence
  chemically synthesized
tcaaaatataaatttgatga

SEQ ID NO: 151516 - DNA, 20 bp, Artificial Sequence
  chemically synthesized
ttatattttgaattttcaca

SEQ ID NO: 151517 - DNA, 20 bp, Artificial Sequence
  chemically synthesized
ttttgaattttcacacagct

SEQ ID NO: 151518 - DNA, 20 bp, Artificial Sequence
  chemically synthesized
tttcacacagctaagatgca

SEQ ID NO: 151519 - DNA, 20 bp, Artificial Sequence
  chemically synthesized
ttcttctctcctatgcatct

SEQ ID NO: 151520 - DNA, 20 bp, Artificial Sequence
  chemically synthesized
ttcacacagctaagatgcat

SEQ ID NO: 151521 - DNA, 20 bp, Artificial Sequence
  chemically synthesized
cacacagctaagatgcatag

SEQ ID NO: 151522 - DNA, 20 bp, Artificial Sequence
  chemically synthesized
cacagctaagatgcatagga

SEQ ID NO: 151523 - DNA, 20 bp, Artificial Sequence
  chemically synthesized
agctaagatgcataggagag

SEQ ID NO: 151524 - DNA, 20 bp, Artificial Sequence
  chemically synthesized
ataggagagaagaaatgaat

SEQ ID NO: 151525 - DNA, 20 bp, Artificial Sequence
  chemically synthesized
taggagagaagaaatgaatg

SEQ ID NO: 151526 - DNA, 20 bp, Artificial Sequence
  chemically synthesized
ggagagaagaaatgaatgag

SEQ ID NO: 151527 - DNA, 20 bp, Artificial Sequence
  chemically synthesized
agagaagaaatgaatgagga

SEQ ID NO: 151528 - DNA, 20 bp, Artificial Sequence
  chemically synthesized
agaaatgaatgaggagagat

SEQ ID NO: 151529 - DNA, 20 bp, Artificial Sequence
  chemically synthesized
gaaatgaatgaggagagatt

SEQ ID NO: 151530 - DNA, 20 bp, Artificial Sequence
  chemically synthesized
gaatgaggagagattaggtt

SEQ ID NO: 151531 - DNA, 20 bp, Artificial Sequence
  chemically synthesized
gagagattaggtttggatga

SEQ ID NO: 151532 - DNA, 20 bp, Artificial Sequence
  chemically synthesized
gtaacactatgcaggttatt

SEQ ID NO: 151533 - DNA, 20 bp, Artificial Sequence
  chemically synthesized
tgtaacactatgcaggttat

SEQ ID NO: 151534 - DNA, 20 bp, Artificial Sequence
  chemically synthesized
atttaacccaataacctgca

SEQ ID NO: 151535 - DNA, 20 bp, Artificial Sequence
  chemically synthesized
tttcacttgtaacactatgc

SEQ ID NO: 151536 - DNA, 20 bp, Artificial Sequence
  chemically synthesized
ctttcacttgtaacactatg

SEQ ID NO: 151537 - DNA, 20 bp, Artificial Sequence
  chemically synthesized
aataacctgcatagtgttac

SEQ ID NO: 151538 - DNA, 20 bp, Artificial Sequence
  chemically synthesized
ctgcatagtgttacaagtga

SEQ ID NO: 151539 - DNA, 20 bp, Artificial Sequence
  chemically synthesized
tgcatagtgttacaagtgaa

SEQ ID NO: 151540 - DNA, 20 bp, Artificial Sequence
  chemically synthesized
atagtgttacaagtgaaagg

SEQ ID NO: 151541 - DNA, 20 bp, Artificial Sequence
  chemically synthesized
tagtgttacaagtgaaaggt

SEQ ID NO: 151542 - DNA, 20 bp, Artificial Sequence
  chemically synthesized
caagtgaaaggtgggactat

SEQ ID NO: 151543 - DNA, 20 bp, Artificial Sequence
  chemically synthesized
cattgcctcagagtgactaa

SEQ ID NO: 151544 - DNA, 20 bp, Artificial Sequence
  chemically synthesized
gtgggactattagtcactct

SEQ ID NO: 151545 - DNA, 20 bp, Artificial Sequence
  chemically synthesized
tgggactattagtcactctg

SEQ ID NO: 151546 - DNA, 20 bp, Artificial Sequence
  chemically synthesized
tgctttatgtcattgcctca

SEQ ID NO: 151547 - DNA, 20 bp, Artificial Sequence
  chemically synthesized
catgctttatgtcattgcct

SEQ ID NO: 151548 - DNA, 20 bp, Artificial Sequence
  chemically synthesized
cactctgaggcaatgacata

SEQ ID NO: 151549 - DNA, 20 bp, Artificial Sequence
  chemically synthesized
gacataaagcatgttttctc

SEQ ID NO: 151550 - DNA, 20 bp, Artificial Sequence
  chemically synthesized
acataaagcatgttttctct

SEQ ID NO: 151551 - DNA, 20 bp, Artificial Sequence
  chemically synthesized
tcatagtcttgatttgccta

SEQ ID NO: 151552 - DNA, 20 bp, Artificial Sequence
  chemically synthesized
gatcatagtcttgatttgcc

SEQ ID NO: 151553 - DNA, 20 bp, Artificial Sequence
  chemically synthesized
atgttttctctaggcaaatc

SEQ ID NO: 151554 - DNA, 20 bp, Artificial Sequence
  chemically synthesized
gtcttatattaggatgatca

SEQ ID NO: 151555 - DNA, 20 bp, Artificial Sequence
  chemically synthesized
gactatgatcatcctaatat

SEQ ID NO: 151556 - DNA, 20 bp, Artificial Sequence
  chemically synthesized
tgttacagtagtcttatatt

SEQ ID NO: 151557 - DNA, 20 bp, Artificial Sequence
  chemically synthesized
ctgttacagtagtcttatat

SEQ ID NO: 151558 - DNA, 20 bp, Artificial Sequence
  chemically synthesized
ctaatataagactactgtaa

SEQ ID NO: 151559 - DNA, 20 bp, Artificial Sequence
  chemically synthesized
tctttcctggactgttacag

SEQ ID NO: 151560 - DNA, 20 bp, Artificial Sequence
  chemically synthesized
atctctttcctggactgtta

SEQ ID NO: 151561 - DNA, 20 bp, Artificial Sequence
  chemically synthesized
ataagactactgtaacagtc

SEQ ID NO: 151562 - DNA, 20 bp, Artificial Sequence
  chemically synthesized
taagactactgtaacagtcc

SEQ ID NO: 151563 - DNA, 20 bp, Artificial Sequence
  chemically synthesized
actactgtaacagtccagga

SEQ ID NO: 151564 - DNA, 20 bp, Artificial Sequence
  chemically synthesized
tactgtaacagtccaggaaa

SEQ ID NO: 151565 - DNA, 20 bp, Artificial Sequence
  chemically synthesized
caatctcatcatctctttcc

SEQ ID NO: 151566 - DNA, 20 bp, Artificial Sequence
  chemically synthesized
cagtccaggaaagagatgat

SEQ ID NO: 151567 - DNA, 20 bp, Artificial Sequence
  chemically synthesized
aaagagatgatgagattgta

SEQ ID NO: 151568 - DNA, 20 bp, Artificial Sequence
  chemically synthesized
aagagatgatgagattgtac

SEQ ID NO: 151569 - DNA, 20 bp, Artificial Sequence
  chemically synthesized
agagatgatgagattgtaca

SEQ ID NO: 151570 - DNA, 20 bp, Artificial Sequence
  chemically synthesized
gagatgatgagattgtacag

SEQ ID NO: 151571 - DNA, 20 bp, Artificial Sequence
  chemically synthesized
tgagattgtacaggggtatg

SEQ ID NO: 151572 - DNA, 20 bp, Artificial Sequence
  chemically synthesized
gagattgtacaggggtatgc

SEQ ID NO: 151573 - DNA, 20 bp, Artificial Sequence
  chemically synthesized
caggataaatctaaaaatga

SEQ ID NO: 151574 - DNA, 20 bp, Artificial Sequence
  chemically synthesized
cttggttcagctttcatttt

SEQ ID NO: 151575 - DNA, 20 bp, Artificial Sequence
  chemically synthesized
ctaaaaatgaaagctgaacc

SEQ ID NO: 151576 - DNA, 20 bp, Artificial Sequence
  chemically synthesized
ctcctaaatatttcttggtt

SEQ ID NO: 151577 - DNA, 20 bp, Artificial Sequence
  chemically synthesized
ttttgctcctaaatatttct

SEQ ID NO: 151578 - DNA, 20 bp, Artificial Sequence
  chemically synthesized
aagctgaaccaagaaatatt

SEQ ID NO: 151579 - DNA, 20 bp, Artificial Sequence
  chemically synthesized
agctgaaccaagaaatattt

SEQ ID NO: 151580 - DNA, 20 bp, Artificial Sequence
  chemically synthesized
ctgaaccaagaaatatttag

SEQ ID NO: 151581 - DNA, 20 bp, Artificial Sequence
  chemically synthesized
gcaaaaaaatcaactgaact

SEQ ID NO: 151582 - DNA, 20 bp, Artificial Sequence
  chemically synthesized
aaaaaatcaactgaacttag

SEQ ID NO: 151583 - DNA, 20 bp, Artificial Sequence
  chemically synthesized
tggacatccaccactaagtt

SEQ ID NO: 151584 - DNA, 20 bp, Artificial Sequence
  chemically synthesized
aaatcaactgaacttagtgg

SEQ ID NO: 151585 - DNA, 20 bp, Artificial Sequence
  chemically synthesized
cctgctggacatccaccact

SEQ ID NO: 151586 - DNA, 20 bp, Artificial Sequence
  chemically synthesized
tgaacttagtggtggatgtc

SEQ ID NO: 151587 - DNA, 20 bp, Artificial Sequence
  chemically synthesized
acttagtggtggatgtccag

SEQ ID NO: 151588 - DNA, 20 bp, Artificial Sequence
  chemically synthesized
cttagtggtggatgtccagc

SEQ ID NO: 151589 - DNA, 20 bp, Artificial Sequence
  chemically synthesized
ttagtggtggatgtccagca

SEQ ID NO: 151590 - DNA, 20 bp, Artificial Sequence
  chemically synthesized
tagtggtggatgtccagcag

SEQ ID NO: 151591 - DNA, 20 bp, Artificial Sequence
  chemically synthesized
ccttcccacctcacccctgc

SEQ ID NO: 151592 - DNA, 20 bp, Artificial Sequence
  chemically synthesized
ggtggatgtccagcaggggt

SEQ ID NO: 151593 - DNA, 20 bp, Artificial Sequence
  chemically synthesized
gtggatgtccagcaggggtg

SEQ ID NO: 151594 - DNA, 20 bp, Artificial Sequence
  chemically synthesized
gatgtccagcaggggtgagg

SEQ ID NO: 151595 - DNA, 20 bp, Artificial Sequence
  chemically synthesized
atgtccagcaggggtgaggt

SEQ ID NO: 151596 - DNA, 20 bp, Artificial Sequence
  chemically synthesized
tccagcaggggtgaggtggg

SEQ ID NO: 151597 - DNA, 20 bp, Artificial Sequence
  chemically synthesized
ccagcaggggtgaggtggga

SEQ ID NO: 151598 - DNA, 20 bp, Artificial Sequence
  chemically synthesized
gggtgaggtgggaaggtttt

SEQ ID NO: 151599 - DNA, 20 bp, Artificial Sequence
  chemically synthesized
aggttttaagaatgaccccc

SEQ ID NO: 151600 - DNA, 20 bp, Artificial Sequence
  chemically synthesized
atccagtaacaaaatcttgg

SEQ ID NO: 151601 - DNA, 20 bp, Artificial Sequence
  chemically synthesized
tatccagtaacaaaatcttg

SEQ ID NO: 151602 - DNA, 20 bp, Artificial Sequence
  chemically synthesized
ctatccagtaacaaaatctt

SEQ ID NO: 151603 - DNA, 20 bp, Artificial Sequence
  chemically synthesized
gctatccagtaacaaaatct

SEQ ID NO: 151604 - DNA, 20 bp, Artificial Sequence
  chemically synthesized
gacccccaagattttgttac

SEQ ID NO: 151605 - DNA, 20 bp, Artificial Sequence
  chemically synthesized
cccaagattttgttactgga

SEQ ID NO: 151606 - DNA, 20 bp, Artificial Sequence
  chemically synthesized
gattttgttactggatagct

SEQ ID NO: 151607 - DNA, 20 bp, Artificial Sequence
  chemically synthesized
tgtagcaccacttagctatc

SEQ ID NO: 151608 - DNA, 20 bp, Artificial Sequence
  chemically synthesized
tttgttactggatagctaag

SEQ ID NO: 151609 - DNA, 20 bp, Artificial Sequence
  chemically synthesized
tcaggttttgtagcaccact

SEQ ID NO: 151610 - DNA, 20 bp, Artificial Sequence
  chemically synthesized
attcctttcttcaggttttg

SEQ ID NO: 151611 - DNA, 20 bp, Artificial Sequence
  chemically synthesized
aagtggtgctacaaaacctg

SEQ ID NO: 151612 - DNA, 20 bp, Artificial Sequence
  chemically synthesized
ggtgctacaaaacctgaaga

SEQ ID NO: 151613 - DNA, 20 bp, Artificial Sequence
  chemically synthesized
gtgctacaaaacctgaagaa

SEQ ID NO: 151614 - DNA, 20 bp, Artificial Sequence
  chemically synthesized
cctgatatattcctttcttc

SEQ ID NO: 151615 - DNA, 20 bp, Artificial Sequence
  chemically synthesized
ccctgatatattcctttctt

SEQ ID NO: 151616 - DNA, 20 bp, Artificial Sequence
  chemically synthesized
acctgaagaaaggaatatat

SEQ ID NO: 151617 - DNA, 20 bp, Artificial Sequence
  chemically synthesized
cctgaagaaaggaatatatc

SEQ ID NO: 151618 - DNA, 20 bp, Artificial Sequence
  chemically synthesized
ctgaagaaaggaatatatca

SEQ ID NO: 151619 - DNA, 20 bp, Artificial Sequence
  chemically synthesized
tgaagaaaggaatatatcag

SEQ ID NO: 151620 - DNA, 20 bp, Artificial Sequence
  chemically synthesized
agaaaggaatatatcagggg

SEQ ID NO: 151621 - DNA, 20 bp, Artificial Sequence
  chemically synthesized
gaaaggaatatatcagggga

SEQ ID NO: 151622 - DNA, 20 bp, Artificial Sequence
  chemically synthesized
ggggaaggtcatgcatttca

SEQ ID NO: 151623 - DNA, 20 bp, Artificial Sequence
  chemically synthesized
gaaggtcatgcatttcatag

SEQ ID NO: 151624 - DNA, 20 bp, Artificial Sequence
  chemically synthesized
catgcatttcatagcagtaa

SEQ ID NO: 151625 - DNA, 20 bp, Artificial Sequence
  chemically synthesized
tcatagcagtaaaagatcat

SEQ ID NO: 151626 - DNA, 20 bp, Artificial Sequence
  chemically synthesized
aagatcatgagattattttt

SEQ ID NO: 151627 - DNA, 20 bp, Artificial Sequence
  chemically synthesized
agattatttttgagacatct

SEQ ID NO: 151628 - DNA, 20 bp, Artificial Sequence
  chemically synthesized
ttatttttgagacatctaag

SEQ ID NO: 151629 - DNA, 20 bp, Artificial Sequence
  chemically synthesized
gcctactcaacagttccact

SEQ ID NO: 151630 - DNA, 20 bp, Artificial Sequence
  chemically synthesized
gacatctaagtggaactgtt

SEQ ID NO: 151631 - DNA, 20 bp, Artificial Sequence
  chemically synthesized
atctaagtggaactgttgag

SEQ ID NO: 151632 - DNA, 20 bp, Artificial Sequence
  chemically synthesized
tctaagtggaactgttgagt

SEQ ID NO: 151633 - DNA, 20 bp, Artificial Sequence
  chemically synthesized
atatttaactgcctactcaa

SEQ ID NO: 151634 - DNA, 20 bp, Artificial Sequence
  chemically synthesized
aagtggaactgttgagtagg

SEQ ID NO: 151635 - DNA, 20 bp, Artificial Sequence
  chemically synthesized
tgagtaggcagttaaatatg

SEQ ID NO: 151636 - DNA, 20 bp, Artificial Sequence
  chemically synthesized
aggcagttaaatatgcagta

SEQ ID NO: 151637 - DNA, 20 bp, Artificial Sequence
  chemically synthesized
taaatatgcagtatggaata

SEQ ID NO: 151638 - DNA, 20 bp, Artificial Sequence
  chemically synthesized
aatatgcagtatggaataca

SEQ ID NO: 151639 - DNA, 20 bp, Artificial Sequence
  chemically synthesized
atatgcagtatggaatacag

SEQ ID NO: 151640 - DNA, 20 bp, Artificial Sequence
  chemically synthesized
aagactttaaggcatgaaaa

SEQ ID NO: 151641 - DNA, 20 bp, Artificial Sequence
  chemically synthesized
ggaacttttttcatgcctta

SEQ ID NO: 151642 - DNA, 20 bp, Artificial Sequence
  chemically synthesized
tgaaagaggagaagacttta

SEQ ID NO: 151643 - DNA, 20 bp, Artificial Sequence
  chemically synthesized
ctgaaagaggagaagacttt

SEQ ID NO: 151644 - DNA, 20 bp, Artificial Sequence
  chemically synthesized
aaatggaactgaaagaggag

SEQ ID NO: 151645 - DNA, 20 bp, Artificial Sequence
  chemically synthesized
cttaaagtcttctcctcttt

SEQ ID NO: 151646 - DNA, 20 bp, Artificial Sequence
  chemically synthesized
gaaaaatggaactgaaagag

SEQ ID NO: 151647 - DNA, 20 bp, Artificial Sequence
  chemically synthesized
aagaaaaatggaactgaaag

SEQ ID NO: 151648 - DNA, 20 bp, Artificial Sequence
  chemically synthesized
taagaaaaatggaactgaaa

SEQ ID NO: 151649 - DNA, 20 bp, Artificial Sequence
  chemically synthesized
aataagaaaaatggaactga

SEQ ID NO: 151650 - DNA, 20 bp, Artificial Sequence
  chemically synthesized
aaagacaacaataagaaaaa

SEQ ID NO: 151651 - DNA, 20 bp, Artificial Sequence
  chemically synthesized
ggggacccaaagacaacaat

SEQ ID NO: 151652 - DNA, 20 bp, Artificial Sequence
  chemically synthesized
atttttcttattgttgtctt

SEQ ID NO: 151653 - DNA, 20 bp, Artificial Sequence
  chemically synthesized
tttttcttattgttgtcttt

SEQ ID NO: 151654 - DNA, 20 bp, Artificial Sequence
  chemically synthesized
ccctgttttcaggggaccca

SEQ ID NO: 151655 - DNA, 20 bp, Artificial Sequence
  chemically synthesized
gtctttgggtcccctgaaaa

SEQ ID NO: 151656 - DNA, 20 bp, Artificial Sequence
  chemically synthesized
catccaggccctgttttcag

SEQ ID NO: 151657 - DNA, 20 bp, Artificial Sequence
  chemically synthesized
tctttgggtcccctgaaaac

SEQ ID NO: 151658 - DNA, 20 bp, Artificial Sequence
  chemically synthesized
tcatccaggccctgttttca

SEQ ID NO: 151659 - DNA, 20 bp, Artificial Sequence
  chemically synthesized
ctttgggtcccctgaaaaca

SEQ ID NO: 151660 - DNA, 20 bp, Artificial Sequence
  chemically synthesized
ctcatccaggccctgttttc

SEQ ID NO: 151661 - DNA, 20 bp, Artificial Sequence
  chemically synthesized
cctcatccaggccctgtttt

SEQ ID NO: 151662 - DNA, 20 bp, Artificial Sequence
  chemically synthesized
ggtcccctgaaaacagggcc

SEQ ID NO: 151663 - DNA, 20 bp, Artificial Sequence
  chemically synthesized
cctgaaaacagggcctggat

SEQ ID NO: 151664 - DNA, 20 bp, Artificial Sequence
  chemically synthesized
ctgaaaacagggcctggatg

SEQ ID NO: 151665 - DNA, 20 bp, Artificial Sequence
  chemically synthesized
ctgtacccaagtcctcatcc

SEQ ID NO: 151666 - DNA, 20 bp, Artificial Sequence
  chemically synthesized
tctgtacccaagtcctcatc

SEQ ID NO: 151667 - DNA, 20 bp, Artificial Sequence
  chemically synthesized
acagggcctggatgaggact

SEQ ID NO: 151668 - DNA, 20 bp, Artificial Sequence
  chemically synthesized
cagggcctggatgaggactt

SEQ ID NO: 151669 - DNA, 20 bp, Artificial Sequence
  chemically synthesized
cctggatgaggacttgggta

SEQ ID NO: 151670 - DNA, 20 bp, Artificial Sequence
  chemically synthesized
caaatgagctatctgtaccc

SEQ ID NO: 151671 - DNA, 20 bp, Artificial Sequence
  chemically synthesized
gatgaggacttgggtacaga

SEQ ID NO: 151672 - DNA, 20 bp, Artificial Sequence
  chemically synthesized
ttgggtacagatagctcatt

SEQ ID NO: 151673 - DNA, 20 bp, Artificial Sequence
  chemically synthesized
ggtacagatagctcatttgg

SEQ ID NO: 151674 - DNA, 20 bp, Artificial Sequence
  chemically synthesized
ctagggatcagcttccaaat

SEQ ID NO: 151675 - DNA, 20 bp, Artificial Sequence
  chemically synthesized
ctcatttggaagctgatccc

SEQ ID NO: 151676 - DNA, 20 bp, Artificial Sequence
  chemically synthesized
tcatttggaagctgatccct

SEQ ID NO: 151677 - DNA, 20 bp, Artificial Sequence
  chemically synthesized
cattcttgcttcctagggat

SEQ ID NO: 151678 - DNA, 20 bp, Artificial Sequence
  chemically synthesized
tttggaagctgatccctagg

SEQ ID NO: 151679 - DNA, 20 bp, Artificial Sequence
  chemically synthesized
tttttcattcttgcttccta

SEQ ID NO: 151680 - DNA, 20 bp, Artificial Sequence
  chemically synthesized
gaagctgatccctaggaagc

SEQ ID NO: 151681 - DNA, 20 bp, Artificial Sequence
  chemically synthesized
gtttttcattcttgcttcct

SEQ ID NO: 151682 - DNA, 20 bp, Artificial Sequence
  chemically synthesized
ggtttttcattcttgcttcc

SEQ ID NO: 151683 - DNA, 20 bp, Artificial Sequence
  chemically synthesized
aagcaagaatgaaaaaccaa

SEQ ID NO: 151684 - DNA, 20 bp, Artificial Sequence
  chemically synthesized
gcaagaatgaaaaaccaaaa

SEQ ID NO: 151685 - DNA, 20 bp, Artificial Sequence
  chemically synthesized
gaatgaaaaaccaaaagagt

SEQ ID NO: 151686 - DNA, 20 bp, Artificial Sequence
  chemically synthesized
ccccctctgtctcactcttt

SEQ ID NO: 151687 - DNA, 20 bp, Artificial Sequence
  chemically synthesized
gaaaaaccaaaagagtgaga

SEQ ID NO: 151688 - DNA, 20 bp, Artificial Sequence
  chemically synthesized
aaaaccaaaagagtgagaca

SEQ ID NO: 151689 - DNA, 20 bp, Artificial Sequence
  chemically synthesized
aaaccaaaagagtgagacag

SEQ ID NO: 151690 - DNA, 20 bp, Artificial Sequence
  chemically synthesized
aaccaaaagagtgagacaga

SEQ ID NO: 151691 - DNA, 20 bp, Artificial Sequence
  chemically synthesized
accaaaagagtgagacagag

SEQ ID NO: 151692 - DNA, 20 bp, Artificial Sequence
  chemically synthesized
ccaaaagagtgagacagagg

SEQ ID NO: 151693 - DNA, 20 bp, Artificial Sequence
  chemically synthesized
aaaagagtgagacagagggg

SEQ ID NO: 151694 - DNA, 20 bp, Artificial Sequence
  chemically synthesized
aaagagtgagacagaggggg

SEQ ID NO: 151695 - DNA, 20 bp, Artificial Sequence
  chemically synthesized
ttgatgataatacatttgat

SEQ ID NO: 151696 - DNA, 20 bp, Artificial Sequence
  chemically synthesized
caatcaaatgtattatcatc

SEQ ID NO: 151697 - DNA, 20 bp, Artificial Sequence
  chemically synthesized
aatcaaatgtattatcatca

SEQ ID NO: 151698 - DNA, 20 bp, Artificial Sequence
  chemically synthesized
tatcatcaaggtaatgctta

SEQ ID NO: 151699 - DNA, 20 bp, Artificial Sequence
  chemically synthesized
atacagtccccatggtccat

SEQ ID NO: 151700 - DNA, 20 bp, Artificial Sequence
  chemically synthesized
aaggtaatgcttatggacca

SEQ ID NO: 151701 - DNA, 20 bp, Artificial Sequence
  chemically synthesized
aggtaatgcttatggaccat

SEQ ID NO: 151702 - DNA, 20 bp, Artificial Sequence
  chemically synthesized
ggtaatgcttatggaccatg

SEQ ID NO: 151703 - DNA, 20 bp, Artificial Sequence
  chemically synthesized
ctgtcaaaatacagtcccca

SEQ ID NO: 151704 - DNA, 20 bp, Artificial Sequence
  chemically synthesized
acaaaagttctgtcaaaata

SEQ ID NO: 151705 - DNA, 20 bp, Artificial Sequence
  chemically synthesized
ccatggggactgtattttga

SEQ ID NO: 151706 - DNA, 20 bp, Artificial Sequence
  chemically synthesized
tgattctcaggaacatacaa

SEQ ID NO: 151707 - DNA, 20 bp, Artificial Sequence
  chemically synthesized
cagaacttttgtatgttcct

SEQ ID NO: 151708 - DNA, 20 bp, Artificial Sequence
  chemically synthesized
gggaattctctgtgattctc

SEQ ID NO: 151709 - DNA, 20 bp, Artificial Sequence
  chemically synthesized
ttgtatgttcctgagaatca

SEQ ID NO: 151710 - DNA, 20 bp, Artificial Sequence
  chemically synthesized
ggggaattctctgtgattct

SEQ ID NO: 151711 - DNA, 20 bp, Artificial Sequence
  chemically synthesized
gtatgttcctgagaatcaca

SEQ ID NO: 151712 - DNA, 20 bp, Artificial Sequence
  chemically synthesized
ctattccttccgggggcaag

SEQ ID NO: 151713 - DNA, 20 bp, Artificial Sequence
  chemically synthesized
cagagaattccccttgcccc

SEQ ID NO: 151714 - DNA, 20 bp, Artificial Sequence
  chemically synthesized
actattccttccgggggcaa

SEQ ID NO: 151715 - DNA, 20 bp, Artificial Sequence
  chemically synthesized
cactattccttccgggggca

SEQ ID NO: 151716 - DNA, 20 bp, Artificial Sequence
  chemically synthesized
ccactattccttccgggggc

SEQ ID NO: 151717 - DNA, 20 bp, Artificial Sequence
  chemically synthesized
agaattccccttgcccccgg

SEQ ID NO: 151718 - DNA, 20 bp, Artificial Sequence
  chemically synthesized
gaattccccttgcccccgga

SEQ ID NO: 151719 - DNA, 20 bp, Artificial Sequence
  chemically synthesized
ttaaccactattccttccgg

SEQ ID NO: 151720 - DNA, 20 bp, Artificial Sequence
  chemically synthesized
tttaaccactattccttccg

SEQ ID NO: 151721 - DNA, 20 bp, Artificial Sequence
  chemically synthesized
ttttaaccactattccttcc

SEQ ID NO: 151722 - DNA, 20 bp, Artificial Sequence
  chemically synthesized
ccccttgcccccggaaggaa

SEQ ID NO: 151723 - DNA, 20 bp, Artificial Sequence
  chemically synthesized
tttttaaccactattccttc

SEQ ID NO: 151724 - DNA, 20 bp, Artificial Sequence
  chemically synthesized
cttgcccccggaaggaatag

SEQ ID NO: 151725 - DNA, 20 bp, Artificial Sequence
  chemically synthesized
agtggttaaaaatatatcca

SEQ ID NO: 151726 - DNA, 20 bp, Artificial Sequence
  chemically synthesized
gtggttaaaaatatatccat

SEQ ID NO: 151727 - DNA, 20 bp, Artificial Sequence
  chemically synthesized
ccaatggagatgggagccca

SEQ ID NO: 151728 - DNA, 20 bp, Artificial Sequence
  chemically synthesized
ccttcaaccaatggagatgg

SEQ ID NO: 151729 - DNA, 20 bp, Artificial Sequence
  chemically synthesized
aaccttcaaccaatggagat

SEQ ID NO: 151730 - DNA, 20 bp, Artificial Sequence
  chemically synthesized
ccatgggctcccatctccat

SEQ ID NO: 151731 - DNA, 20 bp, Artificial Sequence
  chemically synthesized
caaccttcaaccaatggaga

SEQ ID NO: 151732 - DNA, 20 bp, Artificial Sequence
  chemically synthesized
tgagcaaccttcaaccaatg

SEQ ID NO: 151733 - DNA, 20 bp, Artificial Sequence
  chemically synthesized
gctcccatctccattggttg

SEQ ID NO: 151734 - DNA, 20 bp, Artificial Sequence
  chemically synthesized
agtgagcaaccttcaaccaa

SEQ ID NO: 151735 - DNA, 20 bp, Artificial Sequence
  chemically synthesized
ctcccatctccattggttga

SEQ ID NO: 151736 - DNA, 20 bp, Artificial Sequence
  chemically synthesized
cccttgaagttttagtgagt

SEQ ID NO: 151737 - DNA, 20 bp, Artificial Sequence
  chemically synthesized
ctcacccttgaagttttagt

SEQ ID NO: 151738 - DNA, 20 bp, Artificial Sequence
  chemically synthesized
tgctcactcactaaaacttc

SEQ ID NO: 151739 - DNA, 20 bp, Artificial Sequence
  chemically synthesized
ctttctcacccttgaagttt

SEQ ID NO: 151740 - DNA, 20 bp, Artificial Sequence
  chemically synthesized
gctcactcactaaaacttca

SEQ ID NO: 151741 - DNA, 20 bp, Artificial Sequence
  chemically synthesized
ctcactcactaaaacttcaa

SEQ ID NO: 151742 - DNA, 20 bp, Artificial Sequence
  chemically synthesized
ctcactaaaacttcaagggt

SEQ ID NO: 151743 - DNA, 20 bp, Artificial Sequence
  chemically synthesized
tgtgagctttctcacccttg

SEQ ID NO: 151744 - DNA, 20 bp, Artificial Sequence
  chemically synthesized
ctaaaacttcaagggtgaga

SEQ ID NO: 151745 - DNA, 20 bp, Artificial Sequence
  chemically synthesized
caggagcccacagattttgt

SEQ ID NO: 151746 - DNA, 20 bp, Artificial Sequence
  chemically synthesized
gagaaagctcacaaaatctg

SEQ ID NO: 151747 - DNA, 20 bp, Artificial Sequence
  chemically synthesized
agaaagctcacaaaatctgt

SEQ ID NO: 151748 - DNA, 20 bp, Artificial Sequence
  chemically synthesized
tctgacatcccaggagccca

SEQ ID NO: 151749 - DNA, 20 bp, Artificial Sequence
  chemically synthesized
tcacaaaatctgtgggctcc

SEQ ID NO: 151750 - DNA, 20 bp, Artificial Sequence
  chemically synthesized
cacaaaatctgtgggctcct

SEQ ID NO: 151751 - DNA, 20 bp, Artificial Sequence
  chemically synthesized
ggacttctctgacatcccag

SEQ ID NO: 151752 - DNA, 20 bp, Artificial Sequence
  chemically synthesized
tctgtgggctcctgggatgt

SEQ ID NO: 151753 - DNA, 20 bp, Artificial Sequence
  chemically synthesized
agggacttctctgacatccc

SEQ ID NO: 151754 - DNA, 20 bp, Artificial Sequence
  chemically synthesized
aagggacttctctgacatcc

SEQ ID NO: 151755 - DNA, 20 bp, Artificial Sequence
  chemically synthesized
tgtgggctcctgggatgtca

SEQ ID NO: 151756 - DNA, 20 bp, Artificial Sequence
  chemically synthesized
gggctcctgggatgtcagag

SEQ ID NO: 151757 - DNA, 20 bp, Artificial Sequence
  chemically synthesized
gggatgtcagagaagtccct

SEQ ID NO: 151758 - DNA, 20 bp, Artificial Sequence
  chemically synthesized
tgtcagagaagtcccttaga

SEQ ID NO: 151759 - DNA, 20 bp, Artificial Sequence
  chemically synthesized
tttttctactttctatctaa

SEQ ID NO: 151760 - DNA, 20 bp, Artificial Sequence
  chemically synthesized
atttttctactttctatcta

SEQ ID NO: 151761 - DNA, 20 bp, Artificial Sequence
  chemically synthesized
agagaagtcccttagataga

SEQ ID NO: 151762 - DNA, 20 bp, Artificial Sequence
  chemically synthesized
catttttctactttctatct

SEQ ID NO: 151763 - DNA, 20 bp, Artificial Sequence
  chemically synthesized
gaagtcccttagatagaaag

SEQ ID NO: 151764 - DNA, 20 bp, Artificial Sequence
  chemically synthesized
ttagatagaaagtagaaaaa

SEQ ID NO: 151765 - DNA, 20 bp, Artificial Sequence
  chemically synthesized
tagatagaaagtagaaaaat

SEQ ID NO: 151766 - DNA, 20 bp, Artificial Sequence
  chemically synthesized
gatagaaagtagaaaaatgg

SEQ ID NO: 151767 - DNA, 20 bp, Artificial Sequence
  chemically synthesized
agcatcccatgtcaagggaa

SEQ ID NO: 151768 - DNA, 20 bp, Artificial Sequence
  chemically synthesized
tgggagccattcccttgaca

SEQ ID NO: 151769 - DNA, 20 bp, Artificial Sequence
  chemically synthesized
gggagccattcccttgacat

SEQ ID NO: 151770 - DNA, 20 bp, Artificial Sequence
  chemically synthesized
ctgacagcatcccatgtcaa

SEQ ID NO: 151771 - DNA, 20 bp, Artificial Sequence
  chemically synthesized
gctgacagcatcccatgtca

SEQ ID NO: 151772 - DNA, 20 bp, Artificial Sequence
  chemically synthesized
agctgacagcatcccatgtc

SEQ ID NO: 151773 - DNA, 20 bp, Artificial Sequence
  chemically synthesized
cccttgacatgggatgctgt

SEQ ID NO: 151774 - DNA, 20 bp, Artificial Sequence
  chemically synthesized
acatgggatgctgtcagcta

SEQ ID NO: 151775 - DNA, 20 bp, Artificial Sequence
  chemically synthesized
tcagacttgcctttagctga

SEQ ID NO: 151776 - DNA, 20 bp, Artificial Sequence
  chemically synthesized
catgggatgctgtcagctaa

SEQ ID NO: 151777 - DNA, 20 bp, Artificial Sequence
  chemically synthesized
ggatgctgtcagctaaaggc

SEQ ID NO: 151778 - DNA, 20 bp, Artificial Sequence
  chemically synthesized
tgtgagttcagacttgcctt

SEQ ID NO: 151779 - DNA, 20 bp, Artificial Sequence
  chemically synthesized
tggacagccctgtgtgagtt

SEQ ID NO: 151780 - DNA, 20 bp, Artificial Sequence
  chemically synthesized
aaggcaagtctgaactcaca

SEQ ID NO: 151781 - DNA, 20 bp, Artificial Sequence
  chemically synthesized
aggcaagtctgaactcacac

SEQ ID NO: 151782 - DNA, 20 bp, Artificial Sequence
  chemically synthesized
ggcaagtctgaactcacaca

SEQ ID NO: 151783 - DNA, 20 bp, Artificial Sequence
  chemically synthesized
tgcagtggacagccctgtgt

SEQ ID NO: 151784 - DNA, 20 bp, Artificial Sequence
  chemically synthesized
tcacacagggctgtccactg

SEQ ID NO: 151785 - DNA, 20 bp, Artificial Sequence
  chemically synthesized
gcagttgcagctgcagtgga

SEQ ID NO: 151786 - DNA, 20 bp, Artificial Sequence
  chemically synthesized
cactgcagttgcagctgcag

SEQ ID NO: 151787 - DNA, 20 bp, Artificial Sequence
  chemically synthesized
ctgcactgcagttgcagctg

SEQ ID NO: 151788 - DNA, 20 bp, Artificial Sequence
  chemically synthesized
gtccactgcagctgcaactg

SEQ ID NO: 151789 - DNA, 20 bp, Artificial Sequence
  chemically synthesized
attttcctgcactgcagttg

SEQ ID NO: 151790 - DNA, 20 bp, Artificial Sequence
  chemically synthesized
ctgcagctgcaactgcagtg

SEQ ID NO: 151791 - DNA, 20 bp, Artificial Sequence
  chemically synthesized
tgcagctgcaactgcagtgc

SEQ ID NO: 151792 - DNA, 20 bp, Artificial Sequence
  chemically synthesized
cacgccattttcctgcactg

SEQ ID NO: 151793 - DNA, 20 bp, Artificial Sequence
  chemically synthesized
gcaactgcagtgcaggaaaa

SEQ ID NO: 151794 - DNA, 20 bp, Artificial Sequence
  chemically synthesized
aggaaaatggcgtgtgactc

SEQ ID NO: 151795 - DNA, 20 bp, Artificial Sequence
  chemically synthesized
ggaaaatggcgtgtgactcc

SEQ ID NO: 151796 - DNA, 20 bp, Artificial Sequence
  chemically synthesized
tggcgtgtgactccaggcac

SEQ ID NO: 151797 - DNA, 20 bp, Artificial Sequence
  chemically synthesized
acagattcccctggtgcctg

SEQ ID NO: 151798 - DNA, 20 bp, Artificial Sequence
  chemically synthesized
ggcgtgtgactccaggcacc

SEQ ID NO: 151799 - DNA, 20 bp, Artificial Sequence
  chemically synthesized
gcgtgtgactccaggcacca

SEQ ID NO: 151800 - DNA, 20 bp, Artificial Sequence
  chemically synthesized
taacagattcccctggtgcc

SEQ ID NO: 151801 - DNA, 20 bp, Artificial Sequence
  chemically synthesized
cgtgtgactccaggcaccag

SEQ ID NO: 151802 - DNA, 20 bp, Artificial Sequence
  chemically synthesized
acaattgtaacagattcccc

SEQ ID NO: 151803 - DNA, 20 bp, Artificial Sequence
  chemically synthesized
gattatcatcacaattgtaa

SEQ ID NO: 151804 - DNA, 20 bp, Artificial Sequence
  chemically synthesized
caattgtgatgataatcttt

SEQ ID NO: 151805 - DNA, 20 bp, Artificial Sequence
  chemically synthesized
ttgtgatgataatcttttgg

SEQ ID NO: 151806 - DNA, 20 bp, Artificial Sequence
  chemically synthesized
aagaaaataaaagcttccaa

SEQ ID NO: 151807 - DNA, 20 bp, Artificial Sequence
  chemically synthesized
ttcactgtaaaagaaaataa

SEQ ID NO: 151808 - DNA, 20 bp, Artificial Sequence
  chemically synthesized
gaagcttttattttctttta

SEQ ID NO: 151809 - DNA, 20 bp, Artificial Sequence
  chemically synthesized
taagacagatttcactgtaa

SEQ ID NO: 151810 - DNA, 20 bp, Artificial Sequence
  chemically synthesized
gtaatcatctatagataaga

SEQ ID NO: 151811 - DNA, 20 bp, Artificial Sequence
  chemically synthesized
agtgaaatctgtcttatcta

SEQ ID NO: 151812 - DNA, 20 bp, Artificial Sequence
  chemically synthesized
ctatgtaatcatctatagat

SEQ ID NO: 151813 - DNA, 20 bp, Artificial Sequence
  chemically synthesized
acgttctatgtaatcatcta

SEQ ID NO: 151814 - DNA, 20 bp, Artificial Sequence
  chemically synthesized
cttatctatagatgattaca

SEQ ID NO: 151815 - DNA, 20 bp, Artificial Sequence
  chemically synthesized
ttacatagaacgtacacata

SEQ ID NO: 151816 - DNA, 20 bp, Artificial Sequence
  chemically synthesized
gaacgtacacataaagtgtg

SEQ ID NO: 151817 - DNA, 20 bp, Artificial Sequence
  chemically synthesized
aagtgtgaagaataattata

SEQ ID NO: 151818 - DNA, 20 bp, Artificial Sequence
  chemically synthesized
attggggttgtatttacata

SEQ ID NO: 151819 - DNA, 20 bp, Artificial Sequence
  chemically synthesized
atgtaaatacaaccccaatc

SEQ ID NO: 151820 - DNA, 20 bp, Artificial Sequence
  chemically synthesized
agtattctatttcttgattg

SEQ ID NO: 151821 - DNA, 20 bp, Artificial Sequence
  chemically synthesized
cagtattctatttcttgatt

SEQ ID NO: 151822 - DNA, 20 bp, Artificial Sequence
  chemically synthesized
gcagtattctatttcttgat

SEQ ID NO: 151823 - DNA, 20 bp, Artificial Sequence
  chemically synthesized
atacaaccccaatcaagaaa

SEQ ID NO: 151824 - DNA, 20 bp, Artificial Sequence
  chemically synthesized
gggtggggtcaaggtattag

SEQ ID NO: 151825 - DNA, 20 bp, Artificial Sequence
  chemically synthesized
caagggtggggtcaaggtat

SEQ ID NO: 151826 - DNA, 20 bp, Artificial Sequence
  chemically synthesized
ggaacacaagggtggggtca

SEQ ID NO: 151827 - DNA, 20 bp, Artificial Sequence
  chemically synthesized
gggaacacaagggtggggtc

SEQ ID NO: 151828 - DNA, 20 bp, Artificial Sequence
  chemically synthesized
ctgtggggaacacaagggtg

SEQ ID NO: 151829 - DNA, 20 bp, Artificial Sequence
  chemically synthesized
gctgtggggaacacaagggt

SEQ ID NO: 151830 - DNA, 20 bp, Artificial Sequence
  chemically synthesized
tgctgtggggaacacaaggg

SEQ ID NO: 151831 - DNA, 20 bp, Artificial Sequence
  chemically synthesized
ttgtgctgtggggaacacaa

SEQ ID NO: 151832 - DNA, 20 bp, Artificial Sequence
  chemically synthesized
attgtgctgtggggaacaca

SEQ ID NO: 151833 - DNA, 20 bp, Artificial Sequence
  chemically synthesized
gattgtgctgtggggaacac

SEQ ID NO: 151834 - DNA, 20 bp, Artificial Sequence
  chemically synthesized
ccccacccttgtgttcccca

SEQ ID NO: 151835 - DNA, 20 bp, Artificial Sequence
  chemically synthesized
atggaggcgattgtgctgtg

SEQ ID NO: 151836 - DNA, 20 bp, Artificial Sequence
  chemically synthesized
gatggaggcgattgtgctgt

SEQ ID NO: 151837 - DNA, 20 bp, Artificial Sequence
  chemically synthesized
agatggaggcgattgtgctg

SEQ ID NO: 151838 - DNA, 20 bp, Artificial Sequence
  chemically synthesized
ggttacttccagggagatgg

SEQ ID NO: 151839 - DNA, 20 bp, Artificial Sequence
  chemically synthesized
tggttacttccagggagatg

SEQ ID NO: 151840 - DNA, 20 bp, Artificial Sequence
  chemically synthesized
cacaatcgcctccatctccc

SEQ ID NO: 151841 - DNA, 20 bp, Artificial Sequence
  chemically synthesized
aatggttacttccagggaga

SEQ ID NO: 151842 - DNA, 20 bp, Artificial Sequence
  chemically synthesized
aatcgcctccatctccctgg

SEQ ID NO: 151843 - DNA, 20 bp, Artificial Sequence
  chemically synthesized
ggagaatggttacttccagg

SEQ ID NO: 151844 - DNA, 20 bp, Artificial Sequence
  chemically synthesized
caggagaatggttacttcca

SEQ ID NO: 151845 - DNA, 20 bp, Artificial Sequence
  chemically synthesized
tcaggagaatggttacttcc

SEQ ID NO: 151846 - DNA, 20 bp, Artificial Sequence
  chemically synthesized
ttcaggagaatggttacttc

SEQ ID NO: 151847 - DNA, 20 bp, Artificial Sequence
  chemically synthesized
aggagaaaaattcaggagaa

SEQ ID NO: 151848 - DNA, 20 bp, Artificial Sequence
  chemically synthesized
agaaaaggagaaaaattcag

SEQ ID NO: 151849 - DNA, 20 bp, Artificial Sequence
  chemically synthesized
aaagaaaaggagaaaaattc

SEQ ID NO: 151850 - DNA, 20 bp, Artificial Sequence
  chemically synthesized
aaaagaaaaggagaaaaatt

SEQ ID NO: 151851 - DNA, 20 bp, Artificial Sequence
  chemically synthesized
ggagggaaagaaaagaaaag

SEQ ID NO: 151852 - DNA, 20 bp, Artificial Sequence
  chemically synthesized
agggagggaaagaaaagaaa

SEQ ID NO: 151853 - DNA, 20 bp, Artificial Sequence
  chemically synthesized
gagggagggaaagaaaagaa

SEQ ID NO: 151854 - DNA, 20 bp, Artificial Sequence
  chemically synthesized
ggagggagggagggaaagaa

SEQ ID NO: 151855 - DNA, 20 bp, Artificial Sequence
  chemically synthesized
gggagggagggagggaggga

SEQ ID NO: 151856 - DNA, 20 bp, Artificial Sequence
  chemically synthesized
gggagggagggagggaggga

SEQ ID NO: 151857 - DNA, 20 bp, Artificial Sequence
  chemically synthesized
agggagggagggagggaggg

SEQ ID NO: 151858 - DNA, 20 bp, Artificial Sequence
  chemically synthesized
gagggagggagggagggagg

SEQ ID NO: 151859 - DNA, 20 bp, Artificial Sequence
  chemically synthesized
gggagggagggagggaggga

SEQ ID NO: 151860 - DNA, 20 bp, Artificial Sequence
  chemically synthesized
agggagggagggagggaggg

SEQ ID NO: 151861 - DNA, 20 bp, Artificial Sequence
  chemically synthesized
aagggagggagggagggagg

SEQ ID NO: 151862 - DNA, 20 bp, Artificial Sequence
  chemically synthesized
ggaagggagggagggaggga

SEQ ID NO: 151863 - DNA, 20 bp, Artificial Sequence
  chemically synthesized
aggaagggagggagggaggg

SEQ ID NO: 151864 - DNA, 20 bp, Artificial Sequence
  chemically synthesized
aaggaagggagggagggagg

SEQ ID NO: 151865 - DNA, 20 bp, Artificial Sequence
  chemically synthesized
ggaaggaagggagggaggga

SEQ ID NO: 151866 - DNA, 20 bp, Artificial Sequence
  chemically synthesized
aggaaggaagggagggaggg

SEQ ID NO: 151867 - DNA, 20 bp, Artificial Sequence
  chemically synthesized
aaggaaggaagggagggagg

SEQ ID NO: 151868 - DNA, 20 bp, Artificial Sequence
  chemically synthesized
gaaaggaaggaagggaggga

SEQ ID NO: 151869 - DNA, 20 bp, Artificial Sequence
  chemically synthesized
agaaaggaaggaagggaggg

SEQ ID NO: 151870 - DNA, 20 bp, Artificial Sequence
  chemically synthesized
aagaaaggaaggaagggagg

SEQ ID NO: 151871 - DNA, 20 bp, Artificial Sequence
  chemically synthesized
caaagaaaggaaggaaggga

SEQ ID NO: 151872 - DNA, 20 bp, Artificial Sequence
  chemically synthesized
acaaagaaaggaaggaaggg

SEQ ID NO: 151873 - DNA, 20 bp, Artificial Sequence
  chemically synthesized
gacaaagaaaggaaggaagg

SEQ ID NO: 151874 - DNA, 20 bp, Artificial Sequence
  chemically synthesized
aagacaaagaaaggaaggaa

SEQ ID NO: 151875 - DNA, 20 bp, Artificial Sequence
  chemically synthesized
gaagacaaagaaaggaagga

SEQ ID NO: 151876 - DNA, 20 bp, Artificial Sequence
  chemically synthesized
ggaagacaaagaaaggaagg

SEQ ID NO: 151877 - DNA, 20 bp, Artificial Sequence
  chemically synthesized
agaggaagacaaagaaagga

SEQ ID NO: 151878 - DNA, 20 bp, Artificial Sequence
  chemically synthesized
gagaggaagacaaagaaagg

SEQ ID NO: 151879 - DNA, 20 bp, Artificial Sequence
  chemically synthesized
agagagaggaagacaaagaa

SEQ ID NO: 151880 - DNA, 20 bp, Artificial Sequence
  chemically synthesized
gagagagaggaagacaaaga

SEQ ID NO: 151881 - DNA, 20 bp, Artificial Sequence
  chemically synthesized
gaaagagagagaggaagaca

SEQ ID NO: 151882 - DNA, 20 bp, Artificial Sequence
  chemically synthesized
aacagagaaagagagagagg

SEQ ID NO: 151883 - DNA, 20 bp, Artificial Sequence
  chemically synthesized
agaaacagagaaagagagag

SEQ ID NO: 151884 - DNA, 20 bp, Artificial Sequence
  chemically synthesized
gagaaacagagaaagagaga

SEQ ID NO: 151885 - DNA, 20 bp, Artificial Sequence
  chemically synthesized
gagagaaacagagaaagaga

SEQ ID NO: 151886 - DNA, 20 bp, Artificial Sequence
  chemically synthesized
gagagagaaacagagaaaga

SEQ ID NO: 151887 - DNA, 20 bp, Artificial Sequence
  chemically synthesized
gagagagagaaacagagaaa

SEQ ID NO: 151888 - DNA, 20 bp, Artificial Sequence
  chemically synthesized
gagagagagagaaacagaga

SEQ ID NO: 151889 - DNA, 20 bp, Artificial Sequence
  chemically synthesized
gagagagagagagagaaaca

SEQ ID NO: 151890 - DNA, 20 bp, Artificial Sequence
  chemically synthesized
gagagagagagagagagaaa

SEQ ID NO: 151891 - DNA, 20 bp, Artificial Sequence
  chemically synthesized
gagagagagagagagagaga

SEQ ID NO: 151892 - DNA, 20 bp, Artificial Sequence
  chemically synthesized
aagagagagagagagagaga

SEQ ID NO: 151893 - DNA, 20 bp, Artificial Sequence
  chemically synthesized
gaaagagagagagagagaga

SEQ ID NO: 151894 - DNA, 20 bp, Artificial Sequence
  chemically synthesized
aagaaagagagagagagaga

SEQ ID NO: 151895 - DNA, 20 bp, Artificial Sequence
  chemically synthesized
aaaagaaagagagagagaga

SEQ ID NO: 151896 - DNA, 20 bp, Artificial Sequence
  chemically synthesized
taaaaagaaagagagagaga

SEQ ID NO: 151897 - DNA, 20 bp, Artificial Sequence
  chemically synthesized
aataaaaagaaagagagaga

SEQ ID NO: 151898 - DNA, 20 bp, Artificial Sequence
  chemically synthesized
aaaataaaaagaaagagaga

SEQ ID NO: 151899 - DNA, 20 bp, Artificial Sequence
  chemically synthesized
aaaaaataaaaagaaagaga

SEQ ID NO: 151900 - DNA, 20 bp, Artificial Sequence
  chemically synthesized
tcaaaaaataaaaagaaaga

SEQ ID NO: 151901 - DNA, 20 bp, Artificial Sequence
  chemically synthesized
tctcaaaaaataaaaagaaa

SEQ ID NO: 151902 - DNA, 20 bp, Artificial Sequence
  chemically synthesized
cgtctcaaaaaataaaaaga

SEQ ID NO: 151903 - DNA, 20 bp, Artificial Sequence
  chemically synthesized
actccgtctcaaaaaataaa

SEQ ID NO: 151904 - DNA, 20 bp, Artificial Sequence
  chemically synthesized
tctctttctttttatttttt

SEQ ID NO: 151905 - DNA, 20 bp, Artificial Sequence
  chemically synthesized
tttctttttattttttgaga

SEQ ID NO: 151906 - DNA, 20 bp, Artificial Sequence
  chemically synthesized
tctttttattttttgagacg

SEQ ID NO: 151907 - DNA, 20 bp, Artificial Sequence
  chemically synthesized
cgctccagcctgggcaacaa

SEQ ID NO: 151908 - DNA, 20 bp, Artificial Sequence
  chemically synthesized
ggagtttcactcttgttgcc

SEQ ID NO: 151909 - DNA, 20 bp, Artificial Sequence
  chemically synthesized
gagtttcactcttgttgccc

SEQ ID NO: 151910 - DNA, 20 bp, Artificial Sequence
  chemically synthesized
tgcgctccagcctgggcaac

SEQ ID NO: 151911 - DNA, 20 bp, Artificial Sequence
  chemically synthesized
ttcactcttgttgcccaggc

SEQ ID NO: 151912 - DNA, 20 bp, Artificial Sequence
  chemically synthesized
cactcttgttgcccaggctg

SEQ ID NO: 151913 - DNA, 20 bp, Artificial Sequence
  chemically synthesized
gtgccattgcgctccagcct

SEQ ID NO: 151914 - DNA, 20 bp, Artificial Sequence
  chemically synthesized
tgtgccattgcgctccagcc

SEQ ID NO: 151915 - DNA, 20 bp, Artificial Sequence
  chemically synthesized
aagattgtgccattgcgctc

SEQ ID NO: 151916 - DNA, 20 bp, Artificial Sequence
  chemically synthesized
ttgcccaggctggagcgcaa

SEQ ID NO: 151917 - DNA, 20 bp, Artificial Sequence
  chemically synthesized
ggagcgcaatggcacaatct

SEQ ID NO: 151918 - DNA, 20 bp, Artificial Sequence
  chemically synthesized
ggtggaggttgcggtgagcc

SEQ ID NO: 151919 - DNA, 20 bp, Artificial Sequence
  chemically synthesized
caggaggtggaggttgcggt

SEQ ID NO: 151920 - DNA, 20 bp, Artificial Sequence
  chemically synthesized
aacccaggaggtggaggttg

SEQ ID NO: 151921 - DNA, 20 bp, Artificial Sequence
  chemically synthesized
cgcttgaacccaggaggtgg

SEQ ID NO: 151922 - DNA, 20 bp, Artificial Sequence
  chemically synthesized
tcaccgcaacctccacctcc

SEQ ID NO: 151923 - DNA, 20 bp, Artificial Sequence
  chemically synthesized
tcgcttgaacccaggaggtg

SEQ ID NO: 151924 - DNA, 20 bp, Artificial Sequence
  chemically synthesized
caccgcaacctccacctcct

SEQ ID NO: 151925 - DNA, 20 bp, Artificial Sequence
  chemically synthesized
aatcgcttgaacccaggagg

SEQ ID NO: 151926 - DNA, 20 bp, Artificial Sequence
  chemically synthesized
gagaatcgcttgaacccagg

SEQ ID NO: 151927 - DNA, 20 bp, Artificial Sequence
  chemically synthesized
ggagaatcgcttgaacccag

SEQ ID NO: 151928 - DNA, 20 bp, Artificial Sequence
  chemically synthesized
aacctccacctcctgggttc

SEQ ID NO: 151929 - DNA, 20 bp, Artificial Sequence
  chemically synthesized
caggagaatcgcttgaaccc

SEQ ID NO: 151930 - DNA, 20 bp, Artificial Sequence
  chemically synthesized
gcaggagaatcgcttgaacc

SEQ ID NO: 151931 - DNA, 20 bp, Artificial Sequence
  chemically synthesized
ttcaagcgattctcctgcct

SEQ ID NO: 151932 - DNA, 20 bp, Artificial Sequence
  chemically synthesized
tactcgggaggctgaggcag

SEQ ID NO: 151933 - DNA, 20 bp, Artificial Sequence
  chemically synthesized
gctactcgggaggctgaggc

SEQ ID NO: 151934 - DNA, 20 bp, Artificial Sequence
  chemically synthesized
agctactcgggaggctgagg

SEQ ID NO: 151935 - DNA, 20 bp, Artificial Sequence
  chemically synthesized
cccagctactcgggaggctg

SEQ ID NO: 151936 - DNA, 20 bp, Artificial Sequence
  chemically synthesized
tcccagctactcgggaggct

SEQ ID NO: 151937 - DNA, 20 bp, Artificial Sequence
  chemically synthesized
ttctcctgcctcagcctccc

SEQ ID NO: 151938 - DNA, 20 bp, Artificial Sequence
  chemically synthesized
tcctgcctcagcctcccgag

SEQ ID NO: 151939 - DNA, 20 bp, Artificial Sequence
  chemically synthesized
tgtaatcccagctactcggg

SEQ ID NO: 151940 - DNA, 20 bp, Artificial Sequence
  chemically synthesized
ctgtaatcccagctactcgg

SEQ ID NO: 151941 - DNA, 20 bp, Artificial Sequence
  chemically synthesized
gcctcagcctcccgagtagc

SEQ ID NO: 151942 - DNA, 20 bp, Artificial Sequence
  chemically synthesized
gcctgtaatcccagctactc

SEQ ID NO: 151943 - DNA, 20 bp, Artificial Sequence
  chemically synthesized
cctcagcctcccgagtagct

SEQ ID NO: 151944 - DNA, 20 bp, Artificial Sequence
  chemically synthesized
tgcctgtaatcccagctact

SEQ ID NO: 151945 - DNA, 20 bp, Artificial Sequence
  chemically synthesized
ctcccgagtagctgggatta

SEQ ID NO: 151946 - DNA, 20 bp, Artificial Sequence
  chemically synthesized
tcccgagtagctgggattac

SEQ ID NO: 151947 - DNA, 20 bp, Artificial Sequence
  chemically synthesized
gtggcgcatgcctgtaatcc

SEQ ID NO: 151948 - DNA, 20 bp, Artificial Sequence
  chemically synthesized
caggcatgcgccaccatgcc

SEQ ID NO: 151949 - DNA, 20 bp, Artificial Sequence
  chemically synthesized
acaaaatcagccaggcatgg

SEQ ID NO: 151950 - DNA, 20 bp, Artificial Sequence
  chemically synthesized
aatacaaaatcagccaggca

SEQ ID NO: 151951 - DNA, 20 bp, Artificial Sequence
  chemically synthesized
ctaaaaatacaaaatcagcc

SEQ ID NO: 151952 - DNA, 20 bp, Artificial Sequence
  chemically synthesized
actaaaaatacaaaatcagc

SEQ ID NO: 151953 - DNA, 20 bp, Artificial Sequence
  chemically synthesized
ctctactaaaaatacaaaat

SEQ ID NO: 151954 - DNA, 20 bp, Artificial Sequence
  chemically synthesized
cctggctgattttgtatttt

SEQ ID NO: 151955 - DNA, 20 bp, Artificial Sequence
  chemically synthesized
ggctgattttgtatttttag

SEQ ID NO: 151956 - DNA, 20 bp, Artificial Sequence
  chemically synthesized
ctgattttgtatttttagta

SEQ ID NO: 151957 - DNA, 20 bp, Artificial Sequence
  chemically synthesized
ttgtatttttagtagagaca

SEQ ID NO: 151958 - DNA, 20 bp, Artificial Sequence
  chemically synthesized
gagacacggtttctccatgt

SEQ ID NO: 151959 - DNA, 20 bp, Artificial Sequence
  chemically synthesized
agaccagcctgaccaacatg

SEQ ID NO: 151960 - DNA, 20 bp, Artificial Sequence
  chemically synthesized
cacggtttctccatgttggt

SEQ ID NO: 151961 - DNA, 20 bp, Artificial Sequence
  chemically synthesized
tgagaccagcctgaccaaca

SEQ ID NO: 151962 - DNA, 20 bp, Artificial Sequence
  chemically synthesized
acggtttctccatgttggtc

SEQ ID NO: 151963 - DNA, 20 bp, Artificial Sequence
  chemically synthesized
tttctccatgttggtcaggc

SEQ ID NO: 151964 - DNA, 20 bp, Artificial Sequence
  chemically synthesized
tgaggtcgggagtttgagac

SEQ ID NO: 151965 - DNA, 20 bp, Artificial Sequence
  chemically synthesized
tcacctgaggtcgggagttt

SEQ ID NO: 151966 - DNA, 20 bp, Artificial Sequence
  chemically synthesized
tggtctcaaactcccgacct

SEQ ID NO: 151967 - DNA, 20 bp, Artificial Sequence
  chemically synthesized
ggtggatcacctgaggtcgg

SEQ ID NO: 151968 - DNA, 20 bp, Artificial Sequence
  chemically synthesized
ggtctcaaactcccgacctc

SEQ ID NO: 151969 - DNA, 20 bp, Artificial Sequence
  chemically synthesized
tgggtggatcacctgaggtc

SEQ ID NO: 151970 - DNA, 20 bp, Artificial Sequence
  chemically synthesized
gtgggtggatcacctgaggt

SEQ ID NO: 151971 - DNA, 20 bp, Artificial Sequence
  chemically synthesized
cgaggtgggtggatcacctg

SEQ ID NO: 151972 - DNA, 20 bp, Artificial Sequence
  chemically synthesized
ccgaggtgggtggatcacct

SEQ ID NO: 151973 - DNA, 20 bp, Artificial Sequence
  chemically synthesized
ctcaggtgatccacccacct

SEQ ID NO: 151974 - DNA, 20 bp, Artificial Sequence
  chemically synthesized
ctttggggggccgaggtggg

SEQ ID NO: 151975 - DNA, 20 bp, Artificial Sequence
  chemically synthesized
acactttggggggccgaggt

SEQ ID NO: 151976 - DNA, 20 bp, Artificial Sequence
  chemically synthesized
aacactttggggggccgagg

SEQ ID NO: 151977 - DNA, 20 bp, Artificial Sequence
  chemically synthesized
cccaacactttggggggccg

SEQ ID NO: 151978 - DNA, 20 bp, Artificial Sequence
  chemically synthesized
tcccaacactttggggggcc

SEQ ID NO: 151979 - DNA, 20 bp, Artificial Sequence
  chemically synthesized
ccacccacctcggcccccca

SEQ ID NO: 151980 - DNA, 20 bp, Artificial Sequence
  chemically synthesized
tgtaatcccaacactttggg

SEQ ID NO: 151981 - DNA, 20 bp, Artificial Sequence
  chemically synthesized
ctgtaatcccaacactttgg

SEQ ID NO: 151982 - DNA, 20 bp, Artificial Sequence
  chemically synthesized
cctgtaatcccaacactttg

SEQ ID NO: 151983 - DNA, 20 bp, Artificial Sequence
  chemically synthesized
acctcggccccccaaagtgt

SEQ ID NO: 151984 - DNA, 20 bp, Artificial Sequence
  chemically synthesized
gcctgtaatcccaacacttt

SEQ ID NO: 151985 - DNA, 20 bp, Artificial Sequence
  chemically synthesized
cctcggccccccaaagtgtt

SEQ ID NO: 151986 - DNA, 20 bp, Artificial Sequence
  chemically synthesized
cgcctgtaatcccaacactt

SEQ ID NO: 151987 - DNA, 20 bp, Artificial Sequence
  chemically synthesized
cccccaaagtgttgggatta

SEQ ID NO: 151988 - DNA, 20 bp, Artificial Sequence
  chemically synthesized
ccccaaagtgttgggattac

SEQ ID NO: 151989 - DNA, 20 bp, Artificial Sequence
  chemically synthesized
agtgttgggattacaggcgt

SEQ ID NO: 151990 - DNA, 20 bp, Artificial Sequence
  chemically synthesized
caggcgtgagccaccgtgcc

SEQ ID NO: 151991 - DNA, 20 bp, Artificial Sequence
  chemically synthesized
aaaggagaggccaggcacgg

SEQ ID NO: 151992 - DNA, 20 bp, Artificial Sequence
  chemically synthesized
gtaaaaggagaggccaggca

SEQ ID NO: 151993 - DNA, 20 bp, Artificial Sequence
  chemically synthesized
aaaaagtaaaaggagaggcc

SEQ ID NO: 151994 - DNA, 20 bp, Artificial Sequence
  chemically synthesized
taaaaagtaaaaggagaggc

SEQ ID NO: 151995 - DNA, 20 bp, Artificial Sequence
  chemically synthesized
caggtaaaaagtaaaaggag

SEQ ID NO: 151996 - DNA, 20 bp, Artificial Sequence
  chemically synthesized
gcaggtaaaaagtaaaagga

SEQ ID NO: 151997 - DNA, 20 bp, Artificial Sequence
  chemically synthesized
cagcaggtaaaaagtaaaag

SEQ ID NO: 151998 - DNA, 20 bp, Artificial Sequence
  chemically synthesized
ggcagcaggtaaaaagtaaa

SEQ ID NO: 151999 - DNA, 20 bp, Artificial Sequence
  chemically synthesized
aggcagcaggtaaaaagtaa

SEQ ID NO: 152000 - DNA, 20 bp, Artificial Sequence
  chemically synthesized
tggagaaggcagcaggtaaa

SEQ ID NO: 152001 - DNA, 20 bp, Artificial Sequence
  chemically synthesized
tctaggctggagaaggcagc

SEQ ID NO: 152002 - DNA, 20 bp, Artificial Sequence
  chemically synthesized
atctaggctggagaaggcag

SEQ ID NO: 152003 - DNA, 20 bp, Artificial Sequence
  chemically synthesized
tttttacctgctgccttctc

SEQ ID NO: 152004 - DNA, 20 bp, Artificial Sequence
  chemically synthesized
aacatctaggctggagaagg

SEQ ID NO: 152005 - DNA, 20 bp, Artificial Sequence
  chemically synthesized
ctaaacatctaggctggaga

SEQ ID NO: 152006 - DNA, 20 bp, Artificial Sequence
  chemically synthesized
cctaaacatctaggctggag

SEQ ID NO: 152007 - DNA, 20 bp, Artificial Sequence
  chemically synthesized
acctgctgccttctccagcc

SEQ ID NO: 152008 - DNA, 20 bp, Artificial Sequence
  chemically synthesized
acacctaaacatctaggctg

SEQ ID NO: 152009 - DNA, 20 bp, Artificial Sequence
  chemically synthesized
gaacacctaaacatctaggc

SEQ ID NO: 152010 - DNA, 20 bp, Artificial Sequence
  chemically synthesized
ccttctccagcctagatgtt

SEQ ID NO: 152011 - DNA, 20 bp, Artificial Sequence
  chemically synthesized
gtaagaacacctaaacatct

SEQ ID NO: 152012 - DNA, 20 bp, Artificial Sequence
  chemically synthesized
cttctccagcctagatgttt

SEQ ID NO: 152013 - DNA, 20 bp, Artificial Sequence
  chemically synthesized
ggtaagaacacctaaacatc

SEQ ID NO: 152014 - DNA, 20 bp, Artificial Sequence
  chemically synthesized
gtttaggtgttcttaccctc

SEQ ID NO: 152015 - DNA, 20 bp, Artificial Sequence
  chemically synthesized
aaagctgaagtctcgagggt

SEQ ID NO: 152016 - DNA, 20 bp, Artificial Sequence
  chemically synthesized
aaacaaagctgaagtctcga

SEQ ID NO: 152017 - DNA, 20 bp, Artificial Sequence
  chemically synthesized
aaaacaaagctgaagtctcg

SEQ ID NO: 152018 - DNA, 20 bp, Artificial Sequence
  chemically synthesized
tgttcttaccctcgagactt

SEQ ID NO: 152019 - DNA, 20 bp, Artificial Sequence
  chemically synthesized
taaaacaaagctgaagtctc

SEQ ID NO: 152020 - DNA, 20 bp, Artificial Sequence
  chemically synthesized
gttatgataaaacaaagctg

SEQ ID NO: 152021 - DNA, 20 bp, Artificial Sequence
  chemically synthesized
accagcgttatgataaaaca

SEQ ID NO: 152022 - DNA, 20 bp, Artificial Sequence
  chemically synthesized
gctttgttttatcataacgc

SEQ ID NO: 152023 - DNA, 20 bp, Artificial Sequence
  chemically synthesized
atatggatgccagagttaac

SEQ ID NO: 152024 - DNA, 20 bp, Artificial Sequence
  chemically synthesized
atcataacgctggttaactc

SEQ ID NO: 152025 - DNA, 20 bp, Artificial Sequence
  chemically synthesized
ggctaaaaatatggatgcca

SEQ ID NO: 152026 - DNA, 20 bp, Artificial Sequence
  chemically synthesized
taggctaaaaatatggatgc

SEQ ID NO: 152027 - DNA, 20 bp, Artificial Sequence
  chemically synthesized
aactctggcatccatatttt

SEQ ID NO: 152028 - DNA, 20 bp, Artificial Sequence
  chemically synthesized
agaagtttaggctaaaaata

SEQ ID NO: 152029 - DNA, 20 bp, Artificial Sequence
  chemically synthesized
atgagtcaggagagaagttt

SEQ ID NO: 152030 - DNA, 20 bp, Artificial Sequence
  chemically synthesized
tatgagtcaggagagaagtt

SEQ ID NO: 152031 - DNA, 20 bp, Artificial Sequence
  chemically synthesized
gagcatatgagtcaggagag

SEQ ID NO: 152032 - DNA, 20 bp, Artificial Sequence
  chemically synthesized
actgagcatatgagtcagga

SEQ ID NO: 152033 - DNA, 20 bp, Artificial Sequence
  chemically synthesized
taactgagcatatgagtcag

SEQ ID NO: 152034 - DNA, 20 bp, Artificial Sequence
  chemically synthesized
ggtaactgagcatatgagtc

SEQ ID NO: 152035 - DNA, 20 bp, Artificial Sequence
  chemically synthesized
aggtaactgagcatatgagt

SEQ ID NO: 152036 - DNA, 20 bp, Artificial Sequence
  chemically synthesized
tctctcctgactcatatgct

SEQ ID NO: 152037 - DNA, 20 bp, Artificial Sequence
  chemically synthesized
actgaggtaactgagcatat

SEQ ID NO: 152038 - DNA, 20 bp, Artificial Sequence
  chemically synthesized
gcaaggccactgaggtaact

SEQ ID NO: 152039 - DNA, 20 bp, Artificial Sequence
  chemically synthesized
actcatatgctcagttacct

SEQ ID NO: 152040 - DNA, 20 bp, Artificial Sequence
  chemically synthesized
catatgctcagttacctcag

SEQ ID NO: 152041 - DNA, 20 bp, Artificial Sequence
  chemically synthesized
ctagttttgcaaggccactg

SEQ ID NO: 152042 - DNA, 20 bp, Artificial Sequence
  chemically synthesized
tctagttttgcaaggccact

SEQ ID NO: 152043 - DNA, 20 bp, Artificial Sequence
  chemically synthesized
tttagacatctagttttgca

SEQ ID NO: 152044 - DNA, 20 bp, Artificial Sequence
  chemically synthesized
cctcagtggccttgcaaaac

SEQ ID NO: 152045 - DNA, 20 bp, Artificial Sequence
  chemically synthesized
ttttagacatctagttttgc

SEQ ID NO: 152046 - DNA, 20 bp, Artificial Sequence
  chemically synthesized
tgagttcaattttagacatc

SEQ ID NO: 152047 - DNA, 20 bp, Artificial Sequence
  chemically synthesized
gggaactgtgagttcaattt

SEQ ID NO: 152048 - DNA, 20 bp, Artificial Sequence
  chemically synthesized
gatgtctaaaattgaactca

SEQ ID NO: 152049 - DNA, 20 bp, Artificial Sequence
  chemically synthesized
ttagggttcaggggaactgt

SEQ ID NO: 152050 - DNA, 20 bp, Artificial Sequence
  chemically synthesized
tggagtattttagggttcag

SEQ ID NO: 152051 - DNA, 20 bp, Artificial Sequence
  chemically synthesized
atggagtattttagggttca

SEQ ID NO: 152052 - DNA, 20 bp, Artificial Sequence
  chemically synthesized
tatggagtattttagggttc

SEQ ID NO: 152053 - DNA, 20 bp, Artificial Sequence
  chemically synthesized
ctatggagtattttagggtt

SEQ ID NO: 152054 - DNA, 20 bp, Artificial Sequence
  chemically synthesized
ctaaactatggagtatttta

SEQ ID NO: 152055 - DNA, 20 bp, Artificial Sequence
  chemically synthesized
actaaactatggagtatttt

SEQ ID NO: 152056 - DNA, 20 bp, Artificial Sequence
  chemically synthesized
tactaaactatggagtattt

SEQ ID NO: 152057 - DNA, 20 bp, Artificial Sequence
  chemically synthesized
ctgaaccctaaaatactcca

SEQ ID NO: 152058 - DNA, 20 bp, Artificial Sequence
  chemically synthesized
ccctaaaatactccatagtt

SEQ ID NO: 152059 - DNA, 20 bp, Artificial Sequence
  chemically synthesized
gtagaaattactaaactatg

SEQ ID NO: 152060 - DNA, 20 bp, Artificial Sequence
  chemically synthesized
tggtagaaattactaaacta

SEQ ID NO: 152061 - DNA, 20 bp, Artificial Sequence
  chemically synthesized
tagtttagtaatttctacca

SEQ ID NO: 152062 - DNA, 20 bp, Artificial Sequence
  chemically synthesized
ataaaccgagtagaccgtgg

SEQ ID NO: 152063 - DNA, 20 bp, Artificial Sequence
  chemically synthesized
ttgataaaccgagtagaccg

SEQ ID NO: 152064 - DNA, 20 bp, Artificial Sequence
  chemically synthesized
aatttctaccacggtctact

SEQ ID NO: 152065 - DNA, 20 bp, Artificial Sequence
  chemically synthesized
atttggcttgataaaccgag

SEQ ID NO: 152066 - DNA, 20 bp, Artificial Sequence
  chemically synthesized
ggcatttggcttgataaacc

SEQ ID NO: 152067 - DNA, 20 bp, Artificial Sequence
  chemically synthesized
cacggtctactcggtttatc

SEQ ID NO: 152068 - DNA, 20 bp, Artificial Sequence
  chemically synthesized
ggtttatcaagccaaatgcc

SEQ ID NO: 152069 - DNA, 20 bp, Artificial Sequence
  chemically synthesized
gtttatcaagccaaatgcct

SEQ ID NO: 152070 - DNA, 20 bp, Artificial Sequence
  chemically synthesized
gaatagaacacccaggcatt

SEQ ID NO: 152071 - DNA, 20 bp, Artificial Sequence
  chemically synthesized
agaacgcgaatagaacaccc

SEQ ID NO: 152072 - DNA, 20 bp, Artificial Sequence
  chemically synthesized
gagaacgcgaatagaacacc

SEQ ID NO: 152073 - DNA, 20 bp, Artificial Sequence
  chemically synthesized
agagatacagagaacgcgaa

SEQ ID NO: 152074 - DNA, 20 bp, Artificial Sequence
  chemically synthesized
acataaaatggagagataca

SEQ ID NO: 152075 - DNA, 20 bp, Artificial Sequence
  chemically synthesized
ggacataaaatggagagata

SEQ ID NO: 152076 - DNA, 20 bp, Artificial Sequence
  chemically synthesized
ctgattggacataaaatgga

SEQ ID NO: 152077 - DNA, 20 bp, Artificial Sequence
  chemically synthesized
aactgattggacataaaatg

SEQ ID NO: 152078 - DNA, 20 bp, Artificial Sequence
  chemically synthesized
gtaactgattggacataaaa

SEQ ID NO: 152079 - DNA, 20 bp, Artificial Sequence
  chemically synthesized
ctctccattttatgtccaat

SEQ ID NO: 152080 - DNA, 20 bp, Artificial Sequence
  chemically synthesized
aacaggccctggtaactgat

SEQ ID NO: 152081 - DNA, 20 bp, Artificial Sequence
  chemically synthesized
ttttatgtccaatcagttac

SEQ ID NO: 152082 - DNA, 20 bp, Artificial Sequence
  chemically synthesized
tttatgtccaatcagttacc

SEQ ID NO: 152083 - DNA, 20 bp, Artificial Sequence
  chemically synthesized
ttatgtccaatcagttacca

SEQ ID NO: 152084 - DNA, 20 bp, Artificial Sequence
  chemically synthesized
cacgtggaaacaacaggccc

SEQ ID NO: 152085 - DNA, 20 bp, Artificial Sequence
  chemically synthesized
acttggcacgtggaaacaac

SEQ ID NO: 152086 - DNA, 20 bp, Artificial Sequence
  chemically synthesized
tacttggcacgtggaaacaa

SEQ ID NO: 152087 - DNA, 20 bp, Artificial Sequence
  chemically synthesized
gcctgttgtttccacgtgcc

SEQ ID NO: 152088 - DNA, 20 bp, Artificial Sequence
  chemically synthesized
ttcaagtgatacttggcacg

SEQ ID NO: 152089 - DNA, 20 bp, Artificial Sequence
  chemically synthesized
agacagattcaagtgatact

SEQ ID NO: 152090 - DNA, 20 bp, Artificial Sequence
  chemically synthesized
gagacaaagtagacagattc

SEQ ID NO: 152091 - DNA, 20 bp, Artificial Sequence
  chemically synthesized
gggaatggagacaaagtaga

SEQ ID NO: 152092 - DNA, 20 bp, Artificial Sequence
  chemically synthesized
taaagggaatggagacaaag

SEQ ID NO: 152093 - DNA, 20 bp, Artificial Sequence
  chemically synthesized
taataaagggaatggagaca

SEQ ID NO: 152094 - DNA, 20 bp, Artificial Sequence
  chemically synthesized
aagaagtaataaagggaatg

SEQ ID NO: 152095 - DNA, 20 bp, Artificial Sequence
  chemically synthesized
taaagaagtaataaagggaa

SEQ ID NO: 152096 - DNA, 20 bp, Artificial Sequence
  chemically synthesized
taaactaaagaagtaataaa

SEQ ID NO: 152097 - DNA, 20 bp, Artificial Sequence
  chemically synthesized
ctaaactaaagaagtaataa

SEQ ID NO: 152098 - DNA, 20 bp, Artificial Sequence
  chemically synthesized
cctaaactaaagaagtaata

SEQ ID NO: 152099 - DNA, 20 bp, Artificial Sequence
  chemically synthesized
cattccctttattacttctt

SEQ ID NO: 152100 - DNA, 20 bp, Artificial Sequence
  chemically synthesized
aataatgacctaaactaaag

SEQ ID NO: 152101 - DNA, 20 bp, Artificial Sequence
  chemically synthesized
cctttattacttctttagtt

SEQ ID NO: 152102 - DNA, 20 bp, Artificial Sequence
  chemically synthesized
ctttattacttctttagttt

SEQ ID NO: 152103 - DNA, 20 bp, Artificial Sequence
  chemically synthesized
gataataatgacctaaacta

SEQ ID NO: 152104 - DNA, 20 bp, Artificial Sequence
  chemically synthesized
tattccagtggttcaggtga

SEQ ID NO: 152105 - DNA, 20 bp, Artificial Sequence
  chemically synthesized
ttatctatcacctgaaccac

SEQ ID NO: 152106 - DNA, 20 bp, Artificial Sequence
  chemically synthesized
ggaggctattccagtggttc

SEQ ID NO: 152107 - DNA, 20 bp, Artificial Sequence
  chemically synthesized
tggaggctattccagtggtt

SEQ ID NO: 152108 - DNA, 20 bp, Artificial Sequence
  chemically synthesized
tatcacctgaaccactggaa

SEQ ID NO: 152109 - DNA, 20 bp, Artificial Sequence
  chemically synthesized
aactttggaggctattccag

SEQ ID NO: 152110 - DNA, 20 bp, Artificial Sequence
  chemically synthesized
agcaactttggaggctattc

SEQ ID NO: 152111 - DNA, 20 bp, Artificial Sequence
  chemically synthesized
aaccactggaatagcctcca

SEQ ID NO: 152112 - DNA, 20 bp, Artificial Sequence
  chemically synthesized
ttggataagagcaactttgg

SEQ ID NO: 152113 - DNA, 20 bp, Artificial Sequence
  chemically synthesized
attggataagagcaactttg

SEQ ID NO: 152114 - DNA, 20 bp, Artificial Sequence
  chemically synthesized
tgattggataagagcaactt

SEQ ID NO: 152115 - DNA, 20 bp, Artificial Sequence
  chemically synthesized
ataggtaactgattggataa

SEQ ID NO: 152116 - DNA, 20 bp, Artificial Sequence
  chemically synthesized
caaagttgctcttatccaat

SEQ ID NO: 152117 - DNA, 20 bp, Artificial Sequence
  chemically synthesized
gaataggtaactgattggat

SEQ ID NO: 152118 - DNA, 20 bp, Artificial Sequence
  chemically synthesized
ctgaagaataggtaactgat

SEQ ID NO: 152119 - DNA, 20 bp, Artificial Sequence
  chemically synthesized
ccaatcagttacctattctt

SEQ ID NO: 152120 - DNA, 20 bp, Artificial Sequence
  chemically synthesized
gattactctggctgaagaat

SEQ ID NO: 152121 - DNA, 20 bp, Artificial Sequence
  chemically synthesized
ggattactctggctgaagaa

SEQ ID NO: 152122 - DNA, 20 bp, Artificial Sequence
  chemically synthesized
tcagttacctattcttcagc

SEQ ID NO: 152123 - DNA, 20 bp, Artificial Sequence
  chemically synthesized
agttacctattcttcagcca

SEQ ID NO: 152124 - DNA, 20 bp, Artificial Sequence
  chemically synthesized
tagagggattactctggctg

SEQ ID NO: 152125 - DNA, 20 bp, Artificial Sequence
  chemically synthesized
gggttttagagggattactc

SEQ ID NO: 152126 - DNA, 20 bp, Artificial Sequence
  chemically synthesized
gagcatatttgggttttaga

SEQ ID NO: 152127 - DNA, 20 bp, Artificial Sequence
  chemically synthesized
tgagcatatttgggttttag

SEQ ID NO: 152128 - DNA, 20 bp, Artificial Sequence
  chemically synthesized
atgagcatatttgggtttta

SEQ ID NO: 152129 - DNA, 20 bp, Artificial Sequence
  chemically synthesized
acatgagcatatttgggttt

SEQ ID NO: 152130 - DNA, 20 bp, Artificial Sequence
  chemically synthesized
ctagtgacatgagcatattt

SEQ ID NO: 152131 - DNA, 20 bp, Artificial Sequence
  chemically synthesized
actagtgacatgagcatatt

SEQ ID NO: 152132 - DNA, 20 bp, Artificial Sequence
  chemically synthesized
cccaaatatgctcatgtcac

SEQ ID NO: 152133 - DNA, 20 bp, Artificial Sequence
  chemically synthesized
tgtagagagactagtgacat

SEQ ID NO: 152134 - DNA, 20 bp, Artificial Sequence
  chemically synthesized
ctgaagcattgtagagagac

SEQ ID NO: 152135 - DNA, 20 bp, Artificial Sequence
  chemically synthesized
agccactgaagcattgtaga

SEQ ID NO: 152136 - DNA, 20 bp, Artificial Sequence
  chemically synthesized
aaagccactgaagcattgta

SEQ ID NO: 152137 - DNA, 20 bp, Artificial Sequence
  chemically synthesized
tgaaagccactgaagcattg

SEQ ID NO: 152138 - DNA, 20 bp, Artificial Sequence
  chemically synthesized
ctagtctctctacaatgctt

SEQ ID NO: 152139 - DNA, 20 bp, Artificial Sequence
  chemically synthesized
gtctctctacaatgcttcag

SEQ ID NO: 152140 - DNA, 20 bp, Artificial Sequence
  chemically synthesized
agggtaattgaaagccactg

SEQ ID NO: 152141 - DNA, 20 bp, Artificial Sequence
  chemically synthesized
tttatttgaagggtaattga

SEQ ID NO: 152142 - DNA, 20 bp, Artificial Sequence
  chemically synthesized
tcaaacacattttatttgaa

SEQ ID NO: 152143 - DNA, 20 bp, Artificial Sequence
  chemically synthesized
atcaaacacattttatttga

SEQ ID NO: 152144 - DNA, 20 bp, Artificial Sequence
  chemically synthesized
aatcaaacacattttatttg

SEQ ID NO: 152145 - DNA, 20 bp, Artificial Sequence
  chemically synthesized
ctgcattttaagacatgtta

SEQ ID NO: 152146 - DNA, 20 bp, Artificial Sequence
  chemically synthesized
aactgcattttaagacatgt

SEQ ID NO: 152147 - DNA, 20 bp, Artificial Sequence
  chemically synthesized
ctctaacatgtcttaaaatg

SEQ ID NO: 152148 - DNA, 20 bp, Artificial Sequence
  chemically synthesized
atgttcgcaaactgcatttt

SEQ ID NO: 152149 - DNA, 20 bp, Artificial Sequence
  chemically synthesized
tgcgaacatgcatgcatttc

SEQ ID NO: 152150 - DNA, 20 bp, Artificial Sequence
  chemically synthesized
gaggacattccagatgatgc

SEQ ID NO: 152151 - DNA, 20 bp, Artificial Sequence
  chemically synthesized
catgcatttccagcatcatc

SEQ ID NO: 152152 - DNA, 20 bp, Artificial Sequence
  chemically synthesized
atgtgtcagggaggacattc

SEQ ID NO: 152153 - DNA, 20 bp, Artificial Sequence
  chemically synthesized
tgaggagcgatgtgtcaggg

SEQ ID NO: 152154 - DNA, 20 bp, Artificial Sequence
  chemically synthesized
gtgaggagcgatgtgtcagg

SEQ ID NO: 152155 - DNA, 20 bp, Artificial Sequence
  chemically synthesized
gggtgaggagcgatgtgtca

SEQ ID NO: 152156 - DNA, 20 bp, Artificial Sequence
  chemically synthesized
tgggtgaggagcgatgtgtc

SEQ ID NO: 152157 - DNA, 20 bp, Artificial Sequence
  chemically synthesized
atgggtgaggagcgatgtgt

SEQ ID NO: 152158 - DNA, 20 bp, Artificial Sequence
  chemically synthesized
tggggttgggaatgggtgag

SEQ ID NO: 152159 - DNA, 20 bp, Artificial Sequence
  chemically synthesized
gttggggttgggaatgggtg

SEQ ID NO: 152160 - DNA, 20 bp, Artificial Sequence
  chemically synthesized
agttggggttgggaatgggt

SEQ ID NO: 152161 - DNA, 20 bp, Artificial Sequence
  chemically synthesized
actgagttggggttgggaat

SEQ ID NO: 152162 - DNA, 20 bp, Artificial Sequence
  chemically synthesized
cactgagttggggttgggaa

SEQ ID NO: 152163 - DNA, 20 bp, Artificial Sequence
  chemically synthesized
tgaagcactgagttggggtt

SEQ ID NO: 152164 - DNA, 20 bp, Artificial Sequence
  chemically synthesized
ctgaagcactgagttggggt

SEQ ID NO: 152165 - DNA, 20 bp, Artificial Sequence
  chemically synthesized
acccattcccaaccccaact

SEQ ID NO: 152166 - DNA, 20 bp, Artificial Sequence
  chemically synthesized
atggctgaagcactgagttg

SEQ ID NO: 152167 - DNA, 20 bp, Artificial Sequence
  chemically synthesized
tatggctgaagcactgagtt

SEQ ID NO: 152168 - DNA, 20 bp, Artificial Sequence
  chemically synthesized
gtatggctgaagcactgagt

SEQ ID NO: 152169 - DNA, 20 bp, Artificial Sequence
  chemically synthesized
ccaaccccaactcagtgctt

SEQ ID NO: 152170 - DNA, 20 bp, Artificial Sequence
  chemically synthesized
atcagtatggctgaagcact

SEQ ID NO: 152171 - DNA, 20 bp, Artificial Sequence
  chemically synthesized
taaaaatatcagtatggctg

SEQ ID NO: 152172 - DNA, 20 bp, Artificial Sequence
  chemically synthesized
acgttttaaaaatatcagta

SEQ ID NO: 152173 - DNA, 20 bp, Artificial Sequence
  chemically synthesized
ctagcacgttttaaaaatat

SEQ ID NO: 152174 - DNA, 20 bp, Artificial Sequence
  chemically synthesized
ctgatatttttaaaacgtgc

SEQ ID NO: 152175 - DNA, 20 bp, Artificial Sequence
  chemically synthesized
tgatatttttaaaacgtgct

SEQ ID NO: 152176 - DNA, 20 bp, Artificial Sequence
  chemically synthesized
gttggaggcaaaatggagcc

SEQ ID NO: 152177 - DNA, 20 bp, Artificial Sequence
  chemically synthesized
taacagttggaggcaaaatg

SEQ ID NO: 152178 - DNA, 20 bp, Artificial Sequence
  chemically synthesized
agtaacagttggaggcaaaa

SEQ ID NO: 152179 - DNA, 20 bp, Artificial Sequence
  chemically synthesized
gagaaacaagtaacagttgg

SEQ ID NO: 152180 - DNA, 20 bp, Artificial Sequence
  chemically synthesized
agagaaacaagtaacagttg

SEQ ID NO: 152181 - DNA, 20 bp, Artificial Sequence
  chemically synthesized
caagagaaacaagtaacagt

SEQ ID NO: 152182 - DNA, 20 bp, Artificial Sequence
  chemically synthesized
caggcaagagaaacaagtaa

SEQ ID NO: 152183 - DNA, 20 bp, Artificial Sequence
  chemically synthesized
gtgttccaggcaagagaaac

SEQ ID NO: 152184 - DNA, 20 bp, Artificial Sequence
  chemically synthesized
tgttacttgtttctcttgcc

SEQ ID NO: 152185 - DNA, 20 bp, Artificial Sequence
  chemically synthesized
ggggagagtgttccaggcaa

SEQ ID NO: 152186 - DNA, 20 bp, Artificial Sequence
  chemically synthesized
taggggagagtgttccaggc

SEQ ID NO: 152187 - DNA, 20 bp, Artificial Sequence
  chemically synthesized
caagtaggggagagtgttcc

SEQ ID NO: 152188 - DNA, 20 bp, Artificial Sequence
  chemically synthesized
acaagtaggggagagtgttc

SEQ ID NO: 152189 - DNA, 20 bp, Artificial Sequence
  chemically synthesized
ctaggcaaacaagtagggga

SEQ ID NO: 152190 - DNA, 20 bp, Artificial Sequence
  chemically synthesized
acctaggcaaacaagtaggg

SEQ ID NO: 152191 - DNA, 20 bp, Artificial Sequence
  chemically synthesized
gtacctaggcaaacaagtag

SEQ ID NO: 152192 - DNA, 20 bp, Artificial Sequence
  chemically synthesized
tgtacctaggcaaacaagta

SEQ ID NO: 152193 - DNA, 20 bp, Artificial Sequence
  chemically synthesized
gtgtacctaggcaaacaagt

SEQ ID NO: 152194 - DNA, 20 bp, Artificial Sequence
  chemically synthesized
ggtgtacctaggcaaacaag

SEQ ID NO: 152195 - DNA, 20 bp, Artificial Sequence
  chemically synthesized
ctctcccctacttgtttgcc

SEQ ID NO: 152196 - DNA, 20 bp, Artificial Sequence
  chemically synthesized
gtaggtgtacctaggcaaac

SEQ ID NO: 152197 - DNA, 20 bp, Artificial Sequence
  chemically synthesized
tctcccctacttgtttgcct

SEQ ID NO: 152198 - DNA, 20 bp, Artificial Sequence
  chemically synthesized
aaggataagtaggtgtacct

SEQ ID NO: 152199 - DNA, 20 bp, Artificial Sequence
  chemically synthesized
gaaggataagtaggtgtacc

SEQ ID NO: 152200 - DNA, 20 bp, Artificial Sequence
  chemically synthesized
atgagacttgaaggataagt

SEQ ID NO: 152201 - DNA, 20 bp, Artificial Sequence
  chemically synthesized
gatgagacttgaaggataag

SEQ ID NO: 152202 - DNA, 20 bp, Artificial Sequence
  chemically synthesized
ggtacacctacttatccttc

SEQ ID NO: 152203 - DNA, 20 bp, Artificial Sequence
  chemically synthesized
gaagatgagacttgaaggat

SEQ ID NO: 152204 - DNA, 20 bp, Artificial Sequence
  chemically synthesized
aatttgaagatgagacttga

SEQ ID NO: 152205 - DNA, 20 bp, Artificial Sequence
  chemically synthesized
aaatttgaagatgagacttg

SEQ ID NO: 152206 - DNA, 20 bp, Artificial Sequence
  chemically synthesized
aaaaaaggaaatttgaagat

SEQ ID NO: 152207 - DNA, 20 bp, Artificial Sequence
  chemically synthesized
aaaaaaaaaaaggaaatttg

SEQ ID NO: 152208 - DNA, 20 bp, Artificial Sequence
  chemically synthesized
tctggaaaaaaaaaaaaaaa

SEQ ID NO: 152209 - DNA, 20 bp, Artificial Sequence
  chemically synthesized
ttctggaaaaaaaaaaaaaa

SEQ ID NO: 152210 - DNA, 20 bp, Artificial Sequence
  chemically synthesized
tccttttttttttttttttc

SEQ ID NO: 152211 - DNA, 20 bp, Artificial Sequence
  chemically synthesized
cgatgtcagaggaaaaattc

SEQ ID NO: 152212 - DNA, 20 bp, Artificial Sequence
  chemically synthesized
ttgcaacagagcgatgtcag

SEQ ID NO: 152213 - DNA, 20 bp, Artificial Sequence
  chemically synthesized
attgcaacagagcgatgtca

SEQ ID NO: 152214 - DNA, 20 bp, Artificial Sequence
  chemically synthesized
gtattgcaacagagcgatgt

SEQ ID NO: 152215 - DNA, 20 bp, Artificial Sequence
  chemically synthesized
cagtctggagtattgcaaca

SEQ ID NO: 152216 - DNA, 20 bp, Artificial Sequence
  chemically synthesized
cccagtctggagtattgcaa

SEQ ID NO: 152217 - DNA, 20 bp, Artificial Sequence
  chemically synthesized
atcgctctgttgcaatactc

SEQ ID NO: 152218 - DNA, 20 bp, Artificial Sequence
  chemically synthesized
tctgttgcaatactccagac

SEQ ID NO: 152219 - DNA, 20 bp, Artificial Sequence
  chemically synthesized
ctgttgcaatactccagact

SEQ ID NO: 152220 - DNA, 20 bp, Artificial Sequence
  chemically synthesized
gaatcacctcacccagtctg

SEQ ID NO: 152221 - DNA, 20 bp, Artificial Sequence
  chemically synthesized
aagaatcacctcacccagtc

SEQ ID NO: 152222 - DNA, 20 bp, Artificial Sequence
  chemically synthesized
tgcaatactccagactgggt

SEQ ID NO: 152223 - DNA, 20 bp, Artificial Sequence
  chemically synthesized
gcaatactccagactgggtg

SEQ ID NO: 152224 - DNA, 20 bp, Artificial Sequence
  chemically synthesized
tcaggaagaatcacctcacc

SEQ ID NO: 152225 - DNA, 20 bp, Artificial Sequence
  chemically synthesized
aatactagggaagaatcagg

SEQ ID NO: 152226 - DNA, 20 bp, Artificial Sequence
  chemically synthesized
tagaatactagggaagaatc

SEQ ID NO: 152227 - DNA, 20 bp, Artificial Sequence
  chemically synthesized
gtagaatactagggaagaat

SEQ ID NO: 152228 - DNA, 20 bp, Artificial Sequence
  chemically synthesized
gattcttcctgattcttccc

SEQ ID NO: 152229 - DNA, 20 bp, Artificial Sequence
  chemically synthesized
taggatgtagaatactaggg

SEQ ID NO: 152230 - DNA, 20 bp, Artificial Sequence
  chemically synthesized
tactaggatgtagaatacta

SEQ ID NO: 152231 - DNA, 20 bp, Artificial Sequence
  chemically synthesized
atactaggatgtagaatact

SEQ ID NO: 152232 - DNA, 20 bp, Artificial Sequence
  chemically synthesized
aatactaggatgtagaatac

SEQ ID NO: 152233 - DNA, 20 bp, Artificial Sequence
  chemically synthesized
ttccctagtattctacatcc

SEQ ID NO: 152234 - DNA, 20 bp, Artificial Sequence
  chemically synthesized
acgtgacaaatactaggatg

SEQ ID NO: 152235 - DNA, 20 bp, Artificial Sequence
  chemically synthesized
aactgtacgtgacaaatact

SEQ ID NO: 152236 - DNA, 20 bp, Artificial Sequence
  chemically synthesized
taactgtacgtgacaaatac

SEQ ID NO: 152237 - DNA, 20 bp, Artificial Sequence
  chemically synthesized
atcctagtatttgtcacgta

SEQ ID NO: 152238 - DNA, 20 bp, Artificial Sequence
  chemically synthesized
atttgtcacgtacagttatt

SEQ ID NO: 152239 - DNA, 20 bp, Artificial Sequence
  chemically synthesized
tatttagttttcttactttc

SEQ ID NO: 152240 - DNA, 20 bp, Artificial Sequence
  chemically synthesized
atttagttttcttactttct

SEQ ID NO: 152241 - DNA, 20 bp, Artificial Sequence
  chemically synthesized
ttcctagactcctagaaagt

SEQ ID NO: 152242 - DNA, 20 bp, Artificial Sequence
  chemically synthesized
ttagttttcttactttctag

SEQ ID NO: 152243 - DNA, 20 bp, Artificial Sequence
  chemically synthesized
gtgattcctagactcctaga

SEQ ID NO: 152244 - DNA, 20 bp, Artificial Sequence
  chemically synthesized
tttcttactttctaggagtc

SEQ ID NO: 152245 - DNA, 20 bp, Artificial Sequence
  chemically synthesized
ttcttactttctaggagtct

SEQ ID NO: 152246 - DNA, 20 bp, Artificial Sequence
  chemically synthesized
aagcgtgattcctagactcc

SEQ ID NO: 152247 - DNA, 20 bp, Artificial Sequence
  chemically synthesized
atcaagataagcgtgattcc

SEQ ID NO: 152248 - DNA, 20 bp, Artificial Sequence
  chemically synthesized
gatacaatatggatcaagat

SEQ ID NO: 152249 - DNA, 20 bp, Artificial Sequence
  chemically synthesized
ctagggatacaatatggatc

SEQ ID NO: 152250 - DNA, 20 bp, Artificial Sequence
  chemically synthesized
tagattctagggatacaata

SEQ ID NO: 152251 - DNA, 20 bp, Artificial Sequence
  chemically synthesized
cttgatccatattgtatccc

SEQ ID NO: 152252 - DNA, 20 bp, Artificial Sequence
  chemically synthesized
ctcctgtgtgttagattcta

SEQ ID NO: 152253 - DNA, 20 bp, Artificial Sequence
  chemically synthesized
cctcctgtgtgttagattct

SEQ ID NO: 152254 - DNA, 20 bp, Artificial Sequence
  chemically synthesized
ccctcctgtgtgttagattc

SEQ ID NO: 152255 - DNA, 20 bp, Artificial Sequence
  chemically synthesized
tatccctagaatctaacaca

SEQ ID NO: 152256 - DNA, 20 bp, Artificial Sequence
  chemically synthesized
atccctagaatctaacacac

SEQ ID NO: 152257 - DNA, 20 bp, Artificial Sequence
  chemically synthesized
ctgtgtgccctcctgtgtgt

SEQ ID NO: 152258 - DNA, 20 bp, Artificial Sequence
  chemically synthesized
ccctagaatctaacacacag

SEQ ID NO: 152259 - DNA, 20 bp, Artificial Sequence
  chemically synthesized
cctagaatctaacacacagg

SEQ ID NO: 152260 - DNA, 20 bp, Artificial Sequence
  chemically synthesized
ctagaatctaacacacagga

SEQ ID NO: 152261 - DNA, 20 bp, Artificial Sequence
  chemically synthesized
ctaacacacaggagggcaca

SEQ ID NO: 152262 - DNA, 20 bp, Artificial Sequence
  chemically synthesized
atctgacaaataatttatta

SEQ ID NO: 152263 - DNA, 20 bp, Artificial Sequence
  chemically synthesized
aatctgacaaataatttatt

SEQ ID NO: 152264 - DNA, 20 bp, Artificial Sequence
  chemically synthesized
atccttaataaattatttgt

SEQ ID NO: 152265 - DNA, 20 bp, Artificial Sequence
  chemically synthesized
taataaattatttgtcagat

SEQ ID NO: 152266 - DNA, 20 bp, Artificial Sequence
  chemically synthesized
gattagtatattgataaatt

SEQ ID NO: 152267 - DNA, 20 bp, Artificial Sequence
  chemically synthesized
attagtatattgataaatta

SEQ ID NO: 152268 - DNA, 20 bp, Artificial Sequence
  chemically synthesized
gataaattaaggatacaaat

SEQ ID NO: 152269 - DNA, 20 bp, Artificial Sequence
  chemically synthesized
ggatacaaatgagtaaccta

SEQ ID NO: 152270 - DNA, 20 bp, Artificial Sequence
  chemically synthesized
aaatgagtaacctacagtta

SEQ ID NO: 152271 - DNA, 20 bp, Artificial Sequence
  chemically synthesized
gcagttccttctttaactgt

SEQ ID NO: 152272 - DNA, 20 bp, Artificial Sequence
  chemically synthesized
tgcagttccttctttaactg

SEQ ID NO: 152273 - DNA, 20 bp, Artificial Sequence
  chemically synthesized
tgagtaacctacagttaaag

SEQ ID NO: 152274 - DNA, 20 bp, Artificial Sequence
  chemically synthesized
gagtaacctacagttaaaga

SEQ ID NO: 152275 - DNA, 20 bp, Artificial Sequence
  chemically synthesized
agttaaagaaggaactgcac

SEQ ID NO: 152276 - DNA, 20 bp, Artificial Sequence
  chemically synthesized
actatttgacttaactggtg

SEQ ID NO: 152277 - DNA, 20 bp, Artificial Sequence
  chemically synthesized
aagaaggaactgcaccagtt

SEQ ID NO: 152278 - DNA, 20 bp, Artificial Sequence
  chemically synthesized
agtacactatttgacttaac

SEQ ID NO: 152279 - DNA, 20 bp, Artificial Sequence
  chemically synthesized
actgcaccagttaagtcaaa

SEQ ID NO: 152280 - DNA, 20 bp, Artificial Sequence
  chemically synthesized
agttaagtcaaatagtgtac

SEQ ID NO: 152281 - DNA, 20 bp, Artificial Sequence
  chemically synthesized
tcaaatagtgtactggaaaa

SEQ ID NO: 152282 - DNA, 20 bp, Artificial Sequence
  chemically synthesized
ggggataagaagccattttc

SEQ ID NO: 152283 - DNA, 20 bp, Artificial Sequence
  chemically synthesized
gtcaccatcagggggataag

SEQ ID NO: 152284 - DNA, 20 bp, Artificial Sequence
  chemically synthesized
gatgtcaccatcagggggat

SEQ ID NO: 152285 - DNA, 20 bp, Artificial Sequence
  chemically synthesized
atggcttcttatccccctga

SEQ ID NO: 152286 - DNA, 20 bp, Artificial Sequence
  chemically synthesized
caggagatgtcaccatcagg

SEQ ID NO: 152287 - DNA, 20 bp, Artificial Sequence
  chemically synthesized
gcaggagatgtcaccatcag

SEQ ID NO: 152288 - DNA, 20 bp, Artificial Sequence
  chemically synthesized
agcaggagatgtcaccatca

SEQ ID NO: 152289 - DNA, 20 bp, Artificial Sequence
  chemically synthesized
cagcaggagatgtcaccatc

SEQ ID NO: 152290 - DNA, 20 bp, Artificial Sequence
  chemically synthesized
gcagcaggagatgtcaccat

SEQ ID NO: 152291 - DNA, 20 bp, Artificial Sequence
  chemically synthesized
tatatagttacaggcagcag

SEQ ID NO: 152292 - DNA, 20 bp, Artificial Sequence
  chemically synthesized
attatatagttacaggcagc

SEQ ID NO: 152293 - DNA, 20 bp, Artificial Sequence
  chemically synthesized
aattatatagttacaggcag

SEQ ID NO: 152294 - DNA, 20 bp, Artificial Sequence
  chemically synthesized
ttaaattatatagttacagg

SEQ ID NO: 152295 - DNA, 20 bp, Artificial Sequence
  chemically synthesized
gagttaaattatatagttac

SEQ ID NO: 152296 - DNA, 20 bp, Artificial Sequence
  chemically synthesized
agagttaaattatatagtta

SEQ ID NO: 152297 - DNA, 20 bp, Artificial Sequence
  chemically synthesized
ttaggaagagttaaattata

SEQ ID NO: 152298 - DNA, 20 bp, Artificial Sequence
  chemically synthesized
aataatgaattagttaggaa

SEQ ID NO: 152299 - DNA, 20 bp, Artificial Sequence
  chemically synthesized
taaataatgaattagttagg

SEQ ID NO: 152300 - DNA, 20 bp, Artificial Sequence
  chemically synthesized
atttaaataatgaattagtt

SEQ ID NO: 152301 - DNA, 20 bp, Artificial Sequence
  chemically synthesized
catttaaataatgaattagt

SEQ ID NO: 152302 - DNA, 20 bp, Artificial Sequence
  chemically synthesized
ctatcatttaaataatgaat

SEQ ID NO: 152303 - DNA, 20 bp, Artificial Sequence
  chemically synthesized
ctaattcattatttaaatga

SEQ ID NO: 152304 - DNA, 20 bp, Artificial Sequence
  chemically synthesized
ttcattatttaaatgatagt

SEQ ID NO: 152305 - DNA, 20 bp, Artificial Sequence
  chemically synthesized
atttaaatgatagtcagttg

SEQ ID NO: 152306 - DNA, 20 bp, Artificial Sequence
  chemically synthesized
taaatgatagtcagttgaag

SEQ ID NO: 152307 - DNA, 20 bp, Artificial Sequence
  chemically synthesized
cagttgaagtggcattatca

SEQ ID NO: 152308 - DNA, 20 bp, Artificial Sequence
  chemically synthesized
cgtcatagattagcagaaaa

SEQ ID NO: 152309 - DNA, 20 bp, Artificial Sequence
  chemically synthesized
agcgtcatagattagcagaa

SEQ ID NO: 152310 - DNA, 20 bp, Artificial Sequence
  chemically synthesized
aaagcagcgtcatagattag

SEQ ID NO: 152311 - DNA, 20 bp, Artificial Sequence
  chemically synthesized
cccaaagcagcgtcatagat

SEQ ID NO: 152312 - DNA, 20 bp, Artificial Sequence
  chemically synthesized
ggtctcccaaagcagcgtca

SEQ ID NO: 152313 - DNA, 20 bp, Artificial Sequence
  chemically synthesized
gctaatctatgacgctgctt

SEQ ID NO: 152314 - DNA, 20 bp, Artificial Sequence
  chemically synthesized
ctaatctatgacgctgcttt

SEQ ID NO: 152315 - DNA, 20 bp, Artificial Sequence
  chemically synthesized
aatctatgacgctgctttgg

SEQ ID NO: 152316 - DNA, 20 bp, Artificial Sequence
  chemically synthesized
ggtagaatggtctcccaaag

SEQ ID NO: 152317 - DNA, 20 bp, Artificial Sequence
  chemically synthesized
aaaggtagaatggtctccca

SEQ ID NO: 152318 - DNA, 20 bp, Artificial Sequence
  chemically synthesized
atacttgtacaaaggtagaa

SEQ ID NO: 152319 - DNA, 20 bp, Artificial Sequence
  chemically synthesized
atggcatacttgtacaaagg

SEQ ID NO: 152320 - DNA, 20 bp, Artificial Sequence
  chemically synthesized
agaccattctacctttgtac

SEQ ID NO: 152321 - DNA, 20 bp, Artificial Sequence
  chemically synthesized
gaaatggcatacttgtacaa

SEQ ID NO: 152322 - DNA, 20 bp, Artificial Sequence
  chemically synthesized
tgaaatggcatacttgtaca

SEQ ID NO: 152323 - DNA, 20 bp, Artificial Sequence
  chemically synthesized
ttgtacaagtatgccatttc

SEQ ID NO: 152324 - DNA, 20 bp, Artificial Sequence
  chemically synthesized
gctttctttgaaacttgaaa

SEQ ID NO: 152325 - DNA, 20 bp, Artificial Sequence
  chemically synthesized
gtatgccatttcaagtttca

SEQ ID NO: 152326 - DNA, 20 bp, Artificial Sequence
  chemically synthesized
gccatttcaagtttcaaaga

SEQ ID NO: 152327 - DNA, 20 bp, Artificial Sequence
  chemically synthesized
ttcaagtttcaaagaaagct

SEQ ID NO: 152328 - DNA, 20 bp, Artificial Sequence
  chemically synthesized
tttcaaagaaagctgagatg

SEQ ID NO: 152329 - DNA, 20 bp, Artificial Sequence
  chemically synthesized
aaatgttatacaccacatct

SEQ ID NO: 152330 - DNA, 20 bp, Artificial Sequence
  chemically synthesized
gtgtataacattttaatctc

SEQ ID NO: 152331 - DNA, 20 bp, Artificial Sequence
  chemically synthesized
aattactgctcatagttctc

SEQ ID NO: 152332 - DNA, 20 bp, Artificial Sequence
  chemically synthesized
attttaatctcgagaactat

SEQ ID NO: 152333 - DNA, 20 bp, Artificial Sequence
  chemically synthesized
ttaatctcgagaactatgag

SEQ ID NO: 152334 - DNA, 20 bp, Artificial Sequence
  chemically synthesized
ggaaatctaattactgctca

SEQ ID NO: 152335 - DNA, 20 bp, Artificial Sequence
  chemically synthesized
cgagaactatgagcagtaat

SEQ ID NO: 152336 - DNA, 20 bp, Artificial Sequence
  chemically synthesized
agtaataatttcgatattat

SEQ ID NO: 152337 - DNA, 20 bp, Artificial Sequence
  chemically synthesized
aagtaataatttcgatatta

SEQ ID NO: 152338 - DNA, 20 bp, Artificial Sequence
  chemically synthesized
tcgaaattattacttctact

SEQ ID NO: 152339 - DNA, 20 bp, Artificial Sequence
  chemically synthesized
cgaaattattacttctactt

SEQ ID NO: 152340 - DNA, 20 bp, Artificial Sequence
  chemically synthesized
ccttaaatatacctaagtag

SEQ ID NO: 152341 - DNA, 20 bp, Artificial Sequence
  chemically synthesized
tacccttaaatatacctaag

SEQ ID NO: 152342 - DNA, 20 bp, Artificial Sequence
  chemically synthesized
aagtacccttaaatatacct

SEQ ID NO: 152343 - DNA, 20 bp, Artificial Sequence
  chemically synthesized
acttctacttaggtatattt

SEQ ID NO: 152344 - DNA, 20 bp, Artificial Sequence
  chemically synthesized
cttctacttaggtatattta

SEQ ID NO: 152345 - DNA, 20 bp, Artificial Sequence
  chemically synthesized
ttctacttaggtatatttaa

SEQ ID NO: 152346 - DNA, 20 bp, Artificial Sequence
  chemically synthesized
tcccatatatttagatattg

SEQ ID NO: 152347 - DNA, 20 bp, Artificial Sequence
  chemically synthesized
tacttcaatatctaaatata

SEQ ID NO: 152348 - DNA, 20 bp, Artificial Sequence
  chemically synthesized
acttcaatatctaaatatat

SEQ ID NO: 152349 - DNA, 20 bp, Artificial Sequence
  chemically synthesized
gactataagtcccatatatt

SEQ ID NO: 152350 - DNA, 20 bp, Artificial Sequence
  chemically synthesized
atctaaatatatgggactta

SEQ ID NO: 152351 - DNA, 20 bp, Artificial Sequence
  chemically synthesized
ttctaaattctcatgactat

SEQ ID NO: 152352 - DNA, 20 bp, Artificial Sequence
  chemically synthesized
tatatgggacttatagtcat

SEQ ID NO: 152353 - DNA, 20 bp, Artificial Sequence
  chemically synthesized
gacttatagtcatgagaatt

SEQ ID NO: 152354 - DNA, 20 bp, Artificial Sequence
  chemically synthesized
catgagaatttagaaaatct

SEQ ID NO: 152355 - DNA, 20 bp, Artificial Sequence
  chemically synthesized
aatttagaaaatctaagacc

SEQ ID NO: 152356 - DNA, 20 bp, Artificial Sequence
  chemically synthesized
gaaaggggataactaggtct

SEQ ID NO: 152357 - DNA, 20 bp, Artificial Sequence
  chemically synthesized
tacaaagaaaggggataact

SEQ ID NO: 152358 - DNA, 20 bp, Artificial Sequence
  chemically synthesized
atacaaagaaaggggataac

SEQ ID NO: 152359 - DNA, 20 bp, Artificial Sequence
  chemically synthesized
atcaaaaaatacaaagaaag

SEQ ID NO: 152360 - DNA, 20 bp, Artificial Sequence
  chemically synthesized
catcaaaaaatacaaagaaa

SEQ ID NO: 152361 - DNA, 20 bp, Artificial Sequence
  chemically synthesized
gcatcaaaaaatacaaagaa

SEQ ID NO: 152362 - DNA, 20 bp, Artificial Sequence
  chemically synthesized
agcatcaaaaaatacaaaga

SEQ ID NO: 152363 - DNA, 20 bp, Artificial Sequence
  chemically synthesized
tctcagcatcaaaaaataca

SEQ ID NO: 152364 - DNA, 20 bp, Artificial Sequence
  chemically synthesized
tctttgtattttttgatgct

SEQ ID NO: 152365 - DNA, 20 bp, Artificial Sequence
  chemically synthesized
tgtattttttgatgctgaga

SEQ ID NO: 152366 - DNA, 20 bp, Artificial Sequence
  chemically synthesized
gtattttttgatgctgagat

SEQ ID NO: 152367 - DNA, 20 bp, Artificial Sequence
  chemically synthesized
tggataacgttttcctatct

SEQ ID NO: 152368 - DNA, 20 bp, Artificial Sequence
  chemically synthesized
agataggaaaacgttatcca

SEQ ID NO: 152369 - DNA, 20 bp, Artificial Sequence
  chemically synthesized
aggaaaacgttatccaaagt

SEQ ID NO: 152370 - DNA, 20 bp, Artificial Sequence
  chemically synthesized
taaaacatttgttctcactt

SEQ ID NO: 152371 - DNA, 20 bp, Artificial Sequence
  chemically synthesized
caaagtgagaacaaatgttt

SEQ ID NO: 152372 - DNA, 20 bp, Artificial Sequence
  chemically synthesized
aaagtgagaacaaatgtttt

SEQ ID NO: 152373 - DNA, 20 bp, Artificial Sequence
  chemically synthesized
agaacaaatgttttaggctc

SEQ ID NO: 152374 - DNA, 20 bp, Artificial Sequence
  chemically synthesized
gtagttatataaaaggactc

SEQ ID NO: 152375 - DNA, 20 bp, Artificial Sequence
  chemically synthesized
atgagtagtagttatataaa

SEQ ID NO: 152376 - DNA, 20 bp, Artificial Sequence
  chemically synthesized
gatgagtagtagttatataa

SEQ ID NO: 152377 - DNA, 20 bp, Artificial Sequence
  chemically synthesized
tttgaaaaaatgatgagtag

SEQ ID NO: 152378 - DNA, 20 bp, Artificial Sequence
  chemically synthesized
tcatttgaaaaaatgatgag

SEQ ID NO: 152379 - DNA, 20 bp, Artificial Sequence
  chemically synthesized
ctatcatttgaaaaaatgat

SEQ ID NO: 152380 - DNA, 20 bp, Artificial Sequence
  chemically synthesized
ctcatcattttttcaaatga

SEQ ID NO: 152381 - DNA, 20 bp, Artificial Sequence
  chemically synthesized
atcattttttcaaatgatag

SEQ ID NO: 152382 - DNA, 20 bp, Artificial Sequence
  chemically synthesized
aatgatagtggaacactctt

SEQ ID NO: 152383 - DNA, 20 bp, Artificial Sequence
  chemically synthesized
tgatagtggaacactcttaa

SEQ ID NO: 152384 - DNA, 20 bp, Artificial Sequence
  chemically synthesized
atacctggtacaactcttaa

SEQ ID NO: 152385 - DNA, 20 bp, Artificial Sequence
  chemically synthesized
aaatacctggtacaactctt

SEQ ID NO: 152386 - DNA, 20 bp, Artificial Sequence
  chemically synthesized
aacactcttaagagttgtac

SEQ ID NO: 152387 - DNA, 20 bp, Artificial Sequence
  chemically synthesized
acactcttaagagttgtacc

SEQ ID NO: 152388 - DNA, 20 bp, Artificial Sequence
  chemically synthesized
ataaagagatgtgaaatacc

SEQ ID NO: 152389 - DNA, 20 bp, Artificial Sequence
  chemically synthesized
ccactcatggaaagaataaa

SEQ ID NO: 152390 - DNA, 20 bp, Artificial Sequence
  chemically synthesized
agccactcatggaaagaata

SEQ ID NO: 152391 - DNA, 20 bp, Artificial Sequence
  chemically synthesized
catctctttattctttccat

SEQ ID NO: 152392 - DNA, 20 bp, Artificial Sequence
  chemically synthesized
tttataaagccactcatgga

SEQ ID NO: 152393 - DNA, 20 bp, Artificial Sequence
  chemically synthesized
ctctttattctttccatgag

SEQ ID NO: 152394 - DNA, 20 bp, Artificial Sequence
  chemically synthesized
gacatttataaagccactca

SEQ ID NO: 152395 - DNA, 20 bp, Artificial Sequence
  chemically synthesized
gcatagaatggacatttata

SEQ ID NO: 152396 - DNA, 20 bp, Artificial Sequence
  chemically synthesized
accacttacttagcatagaa

SEQ ID NO: 152397 - DNA, 20 bp, Artificial Sequence
  chemically synthesized
ataaatgtccattctatgct

SEQ ID NO: 152398 - DNA, 20 bp, Artificial Sequence
  chemically synthesized
agaataccacttacttagca

SEQ ID NO: 152399 - DNA, 20 bp, Artificial Sequence
  chemically synthesized
atgtccattctatgctaagt

SEQ ID NO: 152400 - DNA, 20 bp, Artificial Sequence
  chemically synthesized
tccattctatgctaagtaag

SEQ ID NO: 152401 - DNA, 20 bp, Artificial Sequence
  chemically synthesized
aacaaagaataccacttact

SEQ ID NO: 152402 - DNA, 20 bp, Artificial Sequence
  chemically synthesized
taagtggtattctttgttct

SEQ ID NO: 152403 - DNA, 20 bp, Artificial Sequence
  chemically synthesized
attaatgcttactcagaaca

SEQ ID NO: 152404 - DNA, 20 bp, Artificial Sequence
  chemically synthesized
tggtattctttgttctgagt

SEQ ID NO: 152405 - DNA, 20 bp, Artificial Sequence
  chemically synthesized
cagtgttattaatgcttact

SEQ ID NO: 152406 - DNA, 20 bp, Artificial Sequence
  chemically synthesized
aaaatatttcttatcatcag

SEQ ID NO: 152407 - DNA, 20 bp, Artificial Sequence
  chemically synthesized
ttaataacactgctgatgat

SEQ ID NO: 152408 - DNA, 20 bp, Artificial Sequence
  chemically synthesized
gaaaaaatatttcttatcat

SEQ ID NO: 152409 - DNA, 20 bp, Artificial Sequence
  chemically synthesized
ataagaaatattttttcccc

SEQ ID NO: 152410 - DNA, 20 bp, Artificial Sequence
  chemically synthesized
aagaaatattttttcccctg

SEQ ID NO: 152411 - DNA, 20 bp, Artificial Sequence
  chemically synthesized
agaaatattttttcccctgg

SEQ ID NO: 152412 - DNA, 20 bp, Artificial Sequence
  chemically synthesized
aatattttttcccctggagg

SEQ ID NO: 152413 - DNA, 20 bp, Artificial Sequence
  chemically synthesized
cttcttaaggcttcctccag

SEQ ID NO: 152414 - DNA, 20 bp, Artificial Sequence
  chemically synthesized
tcttcttaaggcttcctcca

SEQ ID NO: 152415 - DNA, 20 bp, Artificial Sequence
  chemically synthesized
atcttcttaaggcttcctcc

SEQ ID NO: 152416 - DNA, 20 bp, Artificial Sequence
  chemically synthesized
aatcttcttaaggcttcctc

SEQ ID NO: 152417 - DNA, 20 bp, Artificial Sequence
  chemically synthesized
tttcccctggaggaagcctt

SEQ ID NO: 152418 - DNA, 20 bp, Artificial Sequence
  chemically synthesized
cccctggaggaagccttaag

SEQ ID NO: 152419 - DNA, 20 bp, Artificial Sequence
  chemically synthesized
gtgtttccctaatcttctta

SEQ ID NO: 152420 - DNA, 20 bp, Artificial Sequence
  chemically synthesized
tgtgtttccctaatcttctt

SEQ ID NO: 152421 - DNA, 20 bp, Artificial Sequence
  chemically synthesized
ggaggaagccttaagaagat

SEQ ID NO: 152422 - DNA, 20 bp, Artificial Sequence
  chemically synthesized
gaggaagccttaagaagatt

SEQ ID NO: 152423 - DNA, 20 bp, Artificial Sequence
  chemically synthesized
aggaagccttaagaagatta

SEQ ID NO: 152424 - DNA, 20 bp, Artificial Sequence
  chemically synthesized
tgtagctaataaagggaata

SEQ ID NO: 152425 - DNA, 20 bp, Artificial Sequence
  chemically synthesized
acaatctatattccctttat

SEQ ID NO: 152426 - DNA, 20 bp, Artificial Sequence
  chemically synthesized
gattccttgtagctaataaa

SEQ ID NO: 152427 - DNA, 20 bp, Artificial Sequence
  chemically synthesized
agattccttgtagctaataa

SEQ ID NO: 152428 - DNA, 20 bp, Artificial Sequence
  chemically synthesized
tagattccttgtagctaata

SEQ ID NO: 152429 - DNA, 20 bp, Artificial Sequence
  chemically synthesized
atattccctttattagctac

SEQ ID NO: 152430 - DNA, 20 bp, Artificial Sequence
  chemically synthesized
tattccctttattagctaca

SEQ ID NO: 152431 - DNA, 20 bp, Artificial Sequence
  chemically synthesized
actagtcaatagattccttg

SEQ ID NO: 152432 - DNA, 20 bp, Artificial Sequence
  chemically synthesized
gctacaaggaatctattgac

SEQ ID NO: 152433 - DNA, 20 bp, Artificial Sequence
  chemically synthesized
tttagataaatactagtcaa

SEQ ID NO: 152434 - DNA, 20 bp, Artificial Sequence
  chemically synthesized
cccctgttttagataaatac

SEQ ID NO: 152435 - DNA, 20 bp, Artificial Sequence
  chemically synthesized
tgactagtatttatctaaaa

SEQ ID NO: 152436 - DNA, 20 bp, Artificial Sequence
  chemically synthesized
gactagtatttatctaaaac

SEQ ID NO: 152437 - DNA, 20 bp, Artificial Sequence
  chemically synthesized
actagtatttatctaaaaca

SEQ ID NO: 152438 - DNA, 20 bp, Artificial Sequence
  chemically synthesized
ctagtatttatctaaaacag

SEQ ID NO: 152439 - DNA, 20 bp, Artificial Sequence
  chemically synthesized
tagttcactgacccctgttt

SEQ ID NO: 152440 - DNA, 20 bp, Artificial Sequence
  chemically synthesized
tatttatctaaaacaggggt

SEQ ID NO: 152441 - DNA, 20 bp, Artificial Sequence
  chemically synthesized
aaacaggggtcagtgaacta

SEQ ID NO: 152442 - DNA, 20 bp, Artificial Sequence
  chemically synthesized
ggtcagtgaactacggcttg

SEQ ID NO: 152443 - DNA, 20 bp, Artificial Sequence
  chemically synthesized
tggatttggcccacaagccg

SEQ ID NO: 152444 - DNA, 20 bp, Artificial Sequence
  chemically synthesized
gtcagtgaactacggcttgt

SEQ ID NO: 152445 - DNA, 20 bp, Artificial Sequence
  chemically synthesized
gttggttggatttggcccac

SEQ ID NO: 152446 - DNA, 20 bp, Artificial Sequence
  chemically synthesized
aacaggcagttggttggatt

SEQ ID NO: 152447 - DNA, 20 bp, Artificial Sequence
  chemically synthesized
tgcaagaacaggcagttggt

SEQ ID NO: 152448 - DNA, 20 bp, Artificial Sequence
  chemically synthesized
tgtttgcaagaacaggcagt

SEQ ID NO: 152449 - DNA, 20 bp, Artificial Sequence
  chemically synthesized
agtgtgtttgcaagaacagg

SEQ ID NO: 152450 - DNA, 20 bp, Artificial Sequence
  chemically synthesized
aaaagtgtgtttgcaagaac

SEQ ID NO: 152451 - DNA, 20 bp, Artificial Sequence
  chemically synthesized
taaaagtgtgtttgcaagaa

SEQ ID NO: 152452 - DNA, 20 bp, Artificial Sequence
  chemically synthesized
tccaataaaagtgtgtttgc

SEQ ID NO: 152453 - DNA, 20 bp, Artificial Sequence
  chemically synthesized
tcttgcaaacacacttttat

SEQ ID NO: 152454 - DNA, 20 bp, Artificial Sequence
  chemically synthesized
gtgtggctgtgttccaataa

SEQ ID NO: 152455 - DNA, 20 bp, Artificial Sequence
  chemically synthesized
aacacacttttattggaaca

SEQ ID NO: 152456 - DNA, 20 bp, Artificial Sequence
  chemically synthesized
agtttgtaaatgcataagtg

SEQ ID NO: 152457 - DNA, 20 bp, Artificial Sequence
  chemically synthesized
taggcagtttgtaaatgcat

SEQ ID NO: 152458 - DNA, 20 bp, Artificial Sequence
  chemically synthesized
atgcatttacaaactgccta

SEQ ID NO: 152459 - DNA, 20 bp, Artificial Sequence
  chemically synthesized
aggtgcaaagcagccatagg

SEQ ID NO: 152460 - DNA, 20 bp, Artificial Sequence
  chemically synthesized
atgaggtgcaaagcagccat

SEQ ID NO: 152461 - DNA, 20 bp, Artificial Sequence
  chemically synthesized
aatgaggtgcaaagcagcca

SEQ ID NO: 152462 - DNA, 20 bp, Artificial Sequence
  chemically synthesized
tctgctaatgaggtgcaaag

SEQ ID NO: 152463 - DNA, 20 bp, Artificial Sequence
  chemically synthesized
aactctgctaatgaggtgca

SEQ ID NO: 152464 - DNA, 20 bp, Artificial Sequence
  chemically synthesized
atggctgctttgcacctcat

SEQ ID NO: 152465 - DNA, 20 bp, Artificial Sequence
  chemically synthesized
gctgctttgcacctcattag

SEQ ID NO: 152466 - DNA, 20 bp, Artificial Sequence
  chemically synthesized
gttactcaactctgctaatg

SEQ ID NO: 152467 - DNA, 20 bp, Artificial Sequence
  chemically synthesized
tgctttgcacctcattagca

SEQ ID NO: 152468 - DNA, 20 bp, Artificial Sequence
  chemically synthesized
agttactcaactctgctaat

SEQ ID NO: 152469 - DNA, 20 bp, Artificial Sequence
  chemically synthesized
tgcacctcattagcagagtt

SEQ ID NO: 152470 - DNA, 20 bp, Artificial Sequence
  chemically synthesized
agagttgagtaacttcaaca

SEQ ID NO: 152471 - DNA, 20 bp, Artificial Sequence
  chemically synthesized
aagccagaagatctttgttg

SEQ ID NO: 152472 - DNA, 20 bp, Artificial Sequence
  chemically synthesized
taacttcaacaaagatcttc

SEQ ID NO: 152473 - DNA, 20 bp, Artificial Sequence
  chemically synthesized
ttttgggttttacaagccag

SEQ ID NO: 152474 - DNA, 20 bp, Artificial Sequence
  chemically synthesized
atattttgggttttacaagc

SEQ ID NO: 152475 - DNA, 20 bp, Artificial Sequence
  chemically synthesized
gtaaatattttgggttttac

SEQ ID NO: 152476 - DNA, 20 bp, Artificial Sequence
  chemically synthesized
agccagatagtaaatatttt

SEQ ID NO: 152477 - DNA, 20 bp, Artificial Sequence
  chemically synthesized
aagccagatagtaaatattt

SEQ ID NO: 152478 - DNA, 20 bp, Artificial Sequence
  chemically synthesized
aacccaaaatatttactatc

SEQ ID NO: 152479 - DNA, 20 bp, Artificial Sequence
  chemically synthesized
tttttctgtaaaaagccaga

SEQ ID NO: 152480 - DNA, 20 bp, Artificial Sequence
  chemically synthesized
caattttttctgtaaaaagc

SEQ ID NO: 152481 - DNA, 20 bp, Artificial Sequence
  chemically synthesized
atttactatctggcttttta

SEQ ID NO: 152482 - DNA, 20 bp, Artificial Sequence
  chemically synthesized
ttgccaattttttctgtaaa

SEQ ID NO: 152483 - DNA, 20 bp, Artificial Sequence
  chemically synthesized
tggctttttacagaaaaaat

SEQ ID NO: 152484 - DNA, 20 bp, Artificial Sequence
  chemically synthesized
cttcaagaaggttttggtcg

SEQ ID NO: 152485 - DNA, 20 bp, Artificial Sequence
  chemically synthesized
aagtcacttcaagaaggttt

SEQ ID NO: 152486 - DNA, 20 bp, Artificial Sequence
  chemically synthesized
cttcgaccaaaaccttcttg

SEQ ID NO: 152487 - DNA, 20 bp, Artificial Sequence
  chemically synthesized
taatgtaagtcacttcaaga

SEQ ID NO: 152488 - DNA, 20 bp, Artificial Sequence
  chemically synthesized
gtaatgtaagtcacttcaag

SEQ ID NO: 152489 - DNA, 20 bp, Artificial Sequence
  chemically synthesized
ttagtaatgtaagtcacttc

SEQ ID NO: 152490 - DNA, 20 bp, Artificial Sequence
  chemically synthesized
gaggtataggttagtaatgt

SEQ ID NO: 152491 - DNA, 20 bp, Artificial Sequence
  chemically synthesized
tttcagcgggaggtataggt

SEQ ID NO: 152492 - DNA, 20 bp, Artificial Sequence
  chemically synthesized
actgtttcagcgggaggtat

SEQ ID NO: 152493 - DNA, 20 bp, Artificial Sequence
  chemically synthesized
tactgtttcagcgggaggta

SEQ ID NO: 152494 - DNA, 20 bp, Artificial Sequence
  chemically synthesized
taatttactgtttcagcggg

SEQ ID NO: 152495 - DNA, 20 bp, Artificial Sequence
  chemically synthesized
ataatttactgtttcagcgg

SEQ ID NO: 152496 - DNA, 20 bp, Artificial Sequence
  chemically synthesized
acctatacctcccgctgaaa

SEQ ID NO: 152497 - DNA, 20 bp, Artificial Sequence
  chemically synthesized
atataatttactgtttcagc

SEQ ID NO: 152498 - DNA, 20 bp, Artificial Sequence
  chemically synthesized
tatataatttactgtttcag

SEQ ID NO: 152499 - DNA, 20 bp, Artificial Sequence
  chemically synthesized
gtttatataatttactgttt

SEQ ID NO: 152500 - DNA, 20 bp, Artificial Sequence
  chemically synthesized
atatttataaagtcaattat

SEQ ID NO: 152501 - DNA, 20 bp, Artificial Sequence
  chemically synthesized
ataaaaaatccatatttata

SEQ ID NO: 152502 - DNA, 20 bp, Artificial Sequence
  chemically synthesized
aataattgactttataaata

SEQ ID NO: 152503 - DNA, 20 bp, Artificial Sequence
  chemically synthesized
atcttggaagacacgatttg

SEQ ID NO: 152504 - DNA, 20 bp, Artificial Sequence
  chemically synthesized
aatcttggaagacacgattt

SEQ ID NO: 152505 - DNA, 20 bp, Artificial Sequence
  chemically synthesized
tgcctcaaatcgtgtcttcc

SEQ ID NO: 152506 - DNA, 20 bp, Artificial Sequence
  chemically synthesized
ggatgccatttgaatcttgg

SEQ ID NO: 152507 - DNA, 20 bp, Artificial Sequence
  chemically synthesized
aggggatgccatttgaatct

SEQ ID NO: 152508 - DNA, 20 bp, Artificial Sequence
  chemically synthesized
cgtgtcttccaagattcaaa

SEQ ID NO: 152509 - DNA, 20 bp, Artificial Sequence
  chemically synthesized
tcataatacattgcaattag

SEQ ID NO: 152510 - DNA, 20 bp, Artificial Sequence
  chemically synthesized
atcataatacattgcaatta

SEQ ID NO: 152511 - DNA, 20 bp, Artificial Sequence
  chemically synthesized
aatcataatacattgcaatt

SEQ ID NO: 152512 - DNA, 20 bp, Artificial Sequence
  chemically synthesized
aaatcataatacattgcaat

SEQ ID NO: 152513 - DNA, 20 bp, Artificial Sequence
  chemically synthesized
aattgcaatgtattatgatt

SEQ ID NO: 152514 - DNA, 20 bp, Artificial Sequence
  chemically synthesized
ctaactacagtagtgagaac

SEQ ID NO: 152515 - DNA, 20 bp, Artificial Sequence
  chemically synthesized
aattcttgttctcactactg

SEQ ID NO: 152516 - DNA, 20 bp, Artificial Sequence
  chemically synthesized
tttcttctaactacagtagt

SEQ ID NO: 152517 - DNA, 20 bp, Artificial Sequence
  chemically synthesized
cttgttctcactactgtagt

SEQ ID NO: 152518 - DNA, 20 bp, Artificial Sequence
  chemically synthesized
catttttcttctaactacag

SEQ ID NO: 152519 - DNA, 20 bp, Artificial Sequence
  chemically synthesized
gttctcactactgtagttag

SEQ ID NO: 152520 - DNA, 20 bp, Artificial Sequence
  chemically synthesized
gtccatttttcttctaacta

SEQ ID NO: 152521 - DNA, 20 bp, Artificial Sequence
  chemically synthesized
tactgtagttagaagaaaaa

SEQ ID NO: 152522 - DNA, 20 bp, Artificial Sequence
  chemically synthesized
tagttagaagaaaaatggac

SEQ ID NO: 152523 - DNA, 20 bp, Artificial Sequence
  chemically synthesized
agttagaagaaaaatggact

SEQ ID NO: 152524 - DNA, 20 bp, Artificial Sequence
  chemically synthesized
atcttttctcttcgtattcc

SEQ ID NO: 152525 - DNA, 20 bp, Artificial Sequence
  chemically synthesized
aaaaatggactaggaatacg

SEQ ID NO: 152526 - DNA, 20 bp, Artificial Sequence
  chemically synthesized
aaatggactaggaatacgaa

SEQ ID NO: 152527 - DNA, 20 bp, Artificial Sequence
  chemically synthesized
gactaggaatacgaagagaa

SEQ ID NO: 152528 - DNA, 20 bp, Artificial Sequence
  chemically synthesized
gaataagaggagaatcagga

SEQ ID NO: 152529 - DNA, 20 bp, Artificial Sequence
  chemically synthesized
aactgaataagaggagaatc

SEQ ID NO: 152530 - DNA, 20 bp, Artificial Sequence
  chemically synthesized
aaactgaataagaggagaat

SEQ ID NO: 152531 - DNA, 20 bp, Artificial Sequence
  chemically synthesized
ttgaggaaactgaataagag

SEQ ID NO: 152532 - DNA, 20 bp, Artificial Sequence
  chemically synthesized
gtcctgattctcctcttatt

SEQ ID NO: 152533 - DNA, 20 bp, Artificial Sequence
  chemically synthesized
agttgaggaaactgaataag

SEQ ID NO: 152534 - DNA, 20 bp, Artificial Sequence
  chemically synthesized
cagttgaggaaactgaataa

SEQ ID NO: 152535 - DNA, 20 bp, Artificial Sequence
  chemically synthesized
cgcagttgaggaaactgaat

SEQ ID NO: 152536 - DNA, 20 bp, Artificial Sequence
  chemically synthesized
ttattcagtttcctcaactg

SEQ ID NO: 152537 - DNA, 20 bp, Artificial Sequence
  chemically synthesized
tattcagtttcctcaactgc

SEQ ID NO: 152538 - DNA, 20 bp, Artificial Sequence
  chemically synthesized
attataaattcccgcagttg

SEQ ID NO: 152539 - DNA, 20 bp, Artificial Sequence
  chemically synthesized
gattataaattcccgcagtt

SEQ ID NO: 152540 - DNA, 20 bp, Artificial Sequence
  chemically synthesized
atgaagattataaattcccg

SEQ ID NO: 152541 - DNA, 20 bp, Artificial Sequence
  chemically synthesized
aatttataatcttcattctt

SEQ ID NO: 152542 - DNA, 20 bp, Artificial Sequence
  chemically synthesized
taaaatttcccttaagaatg

SEQ ID NO: 152543 - DNA, 20 bp, Artificial Sequence
  chemically synthesized
atttataatcttcattctta

SEQ ID NO: 152544 - DNA, 20 bp, Artificial Sequence
  chemically synthesized
tttataatcttcattcttaa

SEQ ID NO: 152545 - DNA, 20 bp, Artificial Sequence
  chemically synthesized
tattatctaaaatttccctt

SEQ ID NO: 152546 - DNA, 20 bp, Artificial Sequence
  chemically synthesized
ttcattcttaagggaaattt

SEQ ID NO: 152547 - DNA, 20 bp, Artificial Sequence
  chemically synthesized
caattttattattttttgat

SEQ ID NO: 152548 - DNA, 20 bp, Artificial Sequence
  chemically synthesized
tttattattttttgatcaga

SEQ ID NO: 152549 - DNA, 20 bp, Artificial Sequence
  chemically synthesized
atattttgttttcttcactc

SEQ ID NO: 152550 - DNA, 20 bp, Artificial Sequence
  chemically synthesized
tattttgttttcttcactct

SEQ ID NO: 152551 - DNA, 20 bp, Artificial Sequence
  chemically synthesized
attttgttttcttcactcta

SEQ ID NO: 152552 - DNA, 20 bp, Artificial Sequence
  chemically synthesized
agttagtgaaccctagagtg

SEQ ID NO: 152553 - DNA, 20 bp, Artificial Sequence
  chemically synthesized
actgtagttagtgaacccta

SEQ ID NO: 152554 - DNA, 20 bp, Artificial Sequence
  chemically synthesized
tgactgtagttagtgaaccc

SEQ ID NO: 152555 - DNA, 20 bp, Artificial Sequence
  chemically synthesized
actctagggttcactaacta

SEQ ID NO: 152556 - DNA, 20 bp, Artificial Sequence
  chemically synthesized
aaacaagttatgactgtagt

SEQ ID NO: 152557 - DNA, 20 bp, Artificial Sequence
  chemically synthesized
actgaaacaagttatgactg

SEQ ID NO: 152558 - DNA, 20 bp, Artificial Sequence
  chemically synthesized
actacagtcataacttgttt

SEQ ID NO: 152559 - DNA, 20 bp, Artificial Sequence
  chemically synthesized
acatgaatatcaactgaaac

SEQ ID NO: 152560 - DNA, 20 bp, Artificial Sequence
  chemically synthesized
ttcagttgatattcatgtga

SEQ ID NO: 152561 - DNA, 20 bp, Artificial Sequence
  chemically synthesized
gaacaaatgatacatttgat

SEQ ID NO: 152562 - DNA, 20 bp, Artificial Sequence
  chemically synthesized
gatcaaatgtatcatttgtt

SEQ ID NO: 152563 - DNA, 20 bp, Artificial Sequence
  chemically synthesized
aaggaataaattggaggtag

SEQ ID NO: 152564 - DNA, 20 bp, Artificial Sequence
  chemically synthesized
ctcaaggaataaattggagg

SEQ ID NO: 152565 - DNA, 20 bp, Artificial Sequence
  chemically synthesized
acactcaaggaataaattgg

SEQ ID NO: 152566 - DNA, 20 bp, Artificial Sequence
  chemically synthesized
cacactcaaggaataaattg

SEQ ID NO: 152567 - DNA, 20 bp, Artificial Sequence
  chemically synthesized
tgcacactcaaggaataaat

SEQ ID NO: 152568 - DNA, 20 bp, Artificial Sequence
  chemically synthesized
ctacctccaatttattcctt

SEQ ID NO: 152569 - DNA, 20 bp, Artificial Sequence
  chemically synthesized
taccaagggatgcacactca

SEQ ID NO: 152570 - DNA, 20 bp, Artificial Sequence
  chemically synthesized
ataccaagggatgcacactc

SEQ ID NO: 152571 - DNA, 20 bp, Artificial Sequence
  chemically synthesized
ttccttgagtgtgcatccct

SEQ ID NO: 152572 - DNA, 20 bp, Artificial Sequence
  chemically synthesized
tgagtgtgcatcccttggta

SEQ ID NO: 152573 - DNA, 20 bp, Artificial Sequence
  chemically synthesized
tcagcaataagccataccaa

SEQ ID NO: 152574 - DNA, 20 bp, Artificial Sequence
  chemically synthesized
gtcagcaataagccatacca

SEQ ID NO: 152575 - DNA, 20 bp, Artificial Sequence
  chemically synthesized
ggtcagcaataagccatacc

SEQ ID NO: 152576 - DNA, 20 bp, Artificial Sequence
  chemically synthesized
gaaataatgaggtcagcaat

SEQ ID NO: 152577 - DNA, 20 bp, Artificial Sequence
  chemically synthesized
gtgggcagaaataatgaggt

SEQ ID NO: 152578 - DNA, 20 bp, Artificial Sequence
  chemically synthesized
ctgcgtgggcagaaataatg

SEQ ID NO: 152579 - DNA, 20 bp, Artificial Sequence
  chemically synthesized
cctgcgtgggcagaaataat

SEQ ID NO: 152580 - DNA, 20 bp, Artificial Sequence
  chemically synthesized
cctcattatttctgcccacg

SEQ ID NO: 152581 - DNA, 20 bp, Artificial Sequence
  chemically synthesized
ctcattatttctgcccacgc

SEQ ID NO: 152582 - DNA, 20 bp, Artificial Sequence
  chemically synthesized
agtggatagacctgcgtggg

SEQ ID NO: 152583 - DNA, 20 bp, Artificial Sequence
  chemically synthesized
atgagtggatagacctgcgt

SEQ ID NO: 152584 - DNA, 20 bp, Artificial Sequence
  chemically synthesized
aatgagtggatagacctgcg

SEQ ID NO: 152585 - DNA, 20 bp, Artificial Sequence
  chemically synthesized
gattgagatgaatgagtgga

SEQ ID NO: 152586 - DNA, 20 bp, Artificial Sequence
  chemically synthesized
agtggattgagatgaatgag

SEQ ID NO: 152587 - DNA, 20 bp, Artificial Sequence
  chemically synthesized
gcaagtggattgagatgaat

SEQ ID NO: 152588 - DNA, 20 bp, Artificial Sequence
  chemically synthesized
gccatggatgcaagtggatt

SEQ ID NO: 152589 - DNA, 20 bp, Artificial Sequence
  chemically synthesized
agcaaggccatggatgcaag

SEQ ID NO: 152590 - DNA, 20 bp, Artificial Sequence
  chemically synthesized
tctcaatccacttgcatcca

SEQ ID NO: 152591 - DNA, 20 bp, Artificial Sequence
  chemically synthesized
gtgagcaaggccatggatgc

SEQ ID NO: 152592 - DNA, 20 bp, Artificial Sequence
  chemically synthesized
acccagtgtgagcaaggcca

SEQ ID NO: 152593 - DNA, 20 bp, Artificial Sequence
  chemically synthesized
agtaaaacccagtgtgagca

SEQ ID NO: 152594 - DNA, 20 bp, Artificial Sequence
  chemically synthesized
tagtaaaacccagtgtgagc

SEQ ID NO: 152595 - DNA, 20 bp, Artificial Sequence
  chemically synthesized
atccatggccttgctcacac

SEQ ID NO: 152596 - DNA, 20 bp, Artificial Sequence
  chemically synthesized
tccatggccttgctcacact

SEQ ID NO: 152597 - DNA, 20 bp, Artificial Sequence
  chemically synthesized
attatagtaaaacccagtgt

SEQ ID NO: 152598 - DNA, 20 bp, Artificial Sequence
  chemically synthesized
tgaagcattatagtaaaacc

SEQ ID NO: 152599 - DNA, 20 bp, Artificial Sequence
  chemically synthesized
tggataaatctgaagcatta

SEQ ID NO: 152600 - DNA, 20 bp, Artificial Sequence
  chemically synthesized
tgggttttactataatgctt

SEQ ID NO: 152601 - DNA, 20 bp, Artificial Sequence
  chemically synthesized
ttctcatctggataaatctg

SEQ ID NO: 152602 - DNA, 20 bp, Artificial Sequence
  chemically synthesized
tataatgcttcagatttatc

SEQ ID NO: 152603 - DNA, 20 bp, Artificial Sequence
  chemically synthesized
tgcttcagatttatccagat

SEQ ID NO: 152604 - DNA, 20 bp, Artificial Sequence
  chemically synthesized
tggaatttatttttctcatc

SEQ ID NO: 152605 - DNA, 20 bp, Artificial Sequence
  chemically synthesized
cagatgagaaaaataaattc

SEQ ID NO: 152606 - DNA, 20 bp, Artificial Sequence
  chemically synthesized
gagaaaaataaattccagcc

SEQ ID NO: 152607 - DNA, 20 bp, Artificial Sequence
  chemically synthesized
aaaaataaattccagccaag

SEQ ID NO: 152608 - DNA, 20 bp, Artificial Sequence
  chemically synthesized
acttaagcatgcttcttggc

SEQ ID NO: 152609 - DNA, 20 bp, Artificial Sequence
  chemically synthesized
tcccacttaagcatgcttct

SEQ ID NO: 152610 - DNA, 20 bp, Artificial Sequence
  chemically synthesized
tccagccaagaagcatgctt

SEQ ID NO: 152611 - DNA, 20 bp, Artificial Sequence
  chemically synthesized
agccaagaagcatgcttaag

SEQ ID NO: 152612 - DNA, 20 bp, Artificial Sequence
  chemically synthesized
gccaagaagcatgcttaagt

SEQ ID NO: 152613 - DNA, 20 bp, Artificial Sequence
  chemically synthesized
ctctagccagtgtcccactt

SEQ ID NO: 152614 - DNA, 20 bp, Artificial Sequence
  chemically synthesized
agcatgcttaagtgggacac

SEQ ID NO: 152615 - DNA, 20 bp, Artificial Sequence
  chemically synthesized
tgcttaagtgggacactggc

SEQ ID NO: 152616 - DNA, 20 bp, Artificial Sequence
  chemically synthesized
cttaagtgggacactggcta

SEQ ID NO: 152617 - DNA, 20 bp, Artificial Sequence
  chemically synthesized
ttaagtgggacactggctag

SEQ ID NO: 152618 - DNA, 20 bp, Artificial Sequence
  chemically synthesized
ttgttgacctttcctctagc

SEQ ID NO: 152619 - DNA, 20 bp, Artificial Sequence
  chemically synthesized
gtgggacactggctagagga

SEQ ID NO: 152620 - DNA, 20 bp, Artificial Sequence
  chemically synthesized
tgggacactggctagaggaa

SEQ ID NO: 152621 - DNA, 20 bp, Artificial Sequence
  chemically synthesized
gatattgttgacctttcctc

SEQ ID NO: 152622 - DNA, 20 bp, Artificial Sequence
  chemically synthesized
tcaacaatatccattatgat

SEQ ID NO: 152623 - DNA, 20 bp, Artificial Sequence
  chemically synthesized
ggtgttaccacttatcataa

SEQ ID NO: 152624 - DNA, 20 bp, Artificial Sequence
  chemically synthesized
acaatatccattatgataag

SEQ ID NO: 152625 - DNA, 20 bp, Artificial Sequence
  chemically synthesized
aataaaaagggagttaacag

SEQ ID NO: 152626 - DNA, 20 bp, Artificial Sequence
  chemically synthesized
aaataaaaagggagttaaca

SEQ ID NO: 152627 - DNA, 20 bp, Artificial Sequence
  chemically synthesized
taaaataaaaagggagttaa

SEQ ID NO: 152628 - DNA, 20 bp, Artificial Sequence
  chemically synthesized
atttctgtaaaataaaaagg

SEQ ID NO: 152629 - DNA, 20 bp, Artificial Sequence
  chemically synthesized
aaatttctgtaaaataaaaa

SEQ ID NO: 152630 - DNA, 20 bp, Artificial Sequence
  chemically synthesized
aaaatttctgtaaaataaaa

SEQ ID NO: 152631 - DNA, 20 bp, Artificial Sequence
  chemically synthesized
taaaatttctgtaaaataaa

SEQ ID NO: 152632 - DNA, 20 bp, Artificial Sequence
  chemically synthesized
ttaactccctttttatttta

SEQ ID NO: 152633 - DNA, 20 bp, Artificial Sequence
  chemically synthesized
acagaaattttattatcatc

SEQ ID NO: 152634 - DNA, 20 bp, Artificial Sequence
  chemically synthesized
aattttattatcatctagtc

SEQ ID NO: 152635 - DNA, 20 bp, Artificial Sequence
  chemically synthesized
aatactaaaagtcactggac

SEQ ID NO: 152636 - DNA, 20 bp, Artificial Sequence
  chemically synthesized
ttaaaaatactaaaagtcac

SEQ ID NO: 152637 - DNA, 20 bp, Artificial Sequence
  chemically synthesized
tcatctagtccagtgacttt

SEQ ID NO: 152638 - DNA, 20 bp, Artificial Sequence
  chemically synthesized
gtatgctttaaaaatactaa

SEQ ID NO: 152639 - DNA, 20 bp, Artificial Sequence
  chemically synthesized
agtgacttttagtattttta

SEQ ID NO: 152640 - DNA, 20 bp, Artificial Sequence
  chemically synthesized
aagcatacaacccttttttc

SEQ ID NO: 152641 - DNA, 20 bp, Artificial Sequence
  chemically synthesized
taggagctcacttgaaaaaa

SEQ ID NO: 152642 - DNA, 20 bp, Artificial Sequence
  chemically synthesized
ttaggagctcacttgaaaaa

SEQ ID NO: 152643 - DNA, 20 bp, Artificial Sequence
  chemically synthesized
cttaggagctcacttgaaaa

SEQ ID NO: 152644 - DNA, 20 bp, Artificial Sequence
  chemically synthesized
atacaacccttttttcaagt

SEQ ID NO: 152645 - DNA, 20 bp, Artificial Sequence
  chemically synthesized
cttttttcaagtgagctcct

SEQ ID NO: 152646 - DNA, 20 bp, Artificial Sequence
  chemically synthesized
ttttcaagtgagctcctaag

SEQ ID NO: 152647 - DNA, 20 bp, Artificial Sequence
  chemically synthesized
cataccggatttcttcttag

SEQ ID NO: 152648 - DNA, 20 bp, Artificial Sequence
  chemically synthesized
cacataccggatttcttctt

SEQ ID NO: 152649 - DNA, 20 bp, Artificial Sequence
  chemically synthesized
tcacataccggatttcttct

SEQ ID NO: 152650 - DNA, 20 bp, Artificial Sequence
  chemically synthesized
tgagctcctaagaagaaatc

SEQ ID NO: 152651 - DNA, 20 bp, Artificial Sequence
  chemically synthesized
aagaagaaatccggtatgtg

SEQ ID NO: 152652 - DNA, 20 bp, Artificial Sequence
  chemically synthesized
cctttttaggcttcacatac

SEQ ID NO: 152653 - DNA, 20 bp, Artificial Sequence
  chemically synthesized
tccggtatgtgaagcctaaa

SEQ ID NO: 152654 - DNA, 20 bp, Artificial Sequence
  chemically synthesized
ccggtatgtgaagcctaaaa

SEQ ID NO: 152655 - DNA, 20 bp, Artificial Sequence
  chemically synthesized
cggtatgtgaagcctaaaaa

SEQ ID NO: 152656 - DNA, 20 bp, Artificial Sequence
  chemically synthesized
ctgttgctctcgcccttttt

SEQ ID NO: 152657 - DNA, 20 bp, Artificial Sequence
  chemically synthesized
tctgttgctctcgccctttt

SEQ ID NO: 152658 - DNA, 20 bp, Artificial Sequence
  chemically synthesized
atgtgaagcctaaaaagggc

SEQ ID NO: 152659 - DNA, 20 bp, Artificial Sequence
  chemically synthesized
gtgaagcctaaaaagggcga

SEQ ID NO: 152660 - DNA, 20 bp, Artificial Sequence
  chemically synthesized
cctaaaaagggcgagagcaa

SEQ ID NO: 152661 - DNA, 20 bp, Artificial Sequence
  chemically synthesized
aaagggcgagagcaacagac

SEQ ID NO: 152662 - DNA, 20 bp, Artificial Sequence
  chemically synthesized
ctcccatctgcaatttcaac

SEQ ID NO: 152663 - DNA, 20 bp, Artificial Sequence
  chemically synthesized
caacagactggttgaaattg

SEQ ID NO: 152664 - DNA, 20 bp, Artificial Sequence
  chemically synthesized
agactggttgaaattgcaga

SEQ ID NO: 152665 - DNA, 20 bp, Artificial Sequence
  chemically synthesized
gactggttgaaattgcagat

SEQ ID NO: 152666 - DNA, 20 bp, Artificial Sequence
  chemically synthesized
ctggttgaaattgcagatgg

SEQ ID NO: 152667 - DNA, 20 bp, Artificial Sequence
  chemically synthesized
tggttgaaattgcagatggg

SEQ ID NO: 152668 - DNA, 20 bp, Artificial Sequence
  chemically synthesized
gaaattgcagatgggaggca

SEQ ID NO: 152669 - DNA, 20 bp, Artificial Sequence
  chemically synthesized
aaattgcagatgggaggcaa

SEQ ID NO: 152670 - DNA, 20 bp, Artificial Sequence
  chemically synthesized
aattgcagatgggaggcaaa

SEQ ID NO: 152671 - DNA, 20 bp, Artificial Sequence
  chemically synthesized
tgcagatgggaggcaaaggg

SEQ ID NO: 152672 - DNA, 20 bp, Artificial Sequence
  chemically synthesized
agggaagtatgaacatatgt

SEQ ID NO: 152673 - DNA, 20 bp, Artificial Sequence
  chemically synthesized
ggaagtatgaacatatgttg

SEQ ID NO: 152674 - DNA, 20 bp, Artificial Sequence
  chemically synthesized
gaagtatgaacatatgttgg

SEQ ID NO: 152675 - DNA, 20 bp, Artificial Sequence
  chemically synthesized
cttcggccgtcaaaagggta

SEQ ID NO: 152676 - DNA, 20 bp, Artificial Sequence
  chemically synthesized
cccttcggccgtcaaaaggg

SEQ ID NO: 152677 - DNA, 20 bp, Artificial Sequence
  chemically synthesized
aggaaactctacccttttga

SEQ ID NO: 152678 - DNA, 20 bp, Artificial Sequence
  chemically synthesized
gtccccttcggccgtcaaaa

SEQ ID NO: 152679 - DNA, 20 bp, Artificial Sequence
  chemically synthesized
cgtccccttcggccgtcaaa

SEQ ID NO: 152680 - DNA, 20 bp, Artificial Sequence
  chemically synthesized
gcgtccccttcggccgtcaa

SEQ ID NO: 152681 - DNA, 20 bp, Artificial Sequence
  chemically synthesized
ctctacccttttgacggccg

SEQ ID NO: 152682 - DNA, 20 bp, Artificial Sequence
  chemically synthesized
tctacccttttgacggccga

SEQ ID NO: 152683 - DNA, 20 bp, Artificial Sequence
  chemically synthesized
ctacccttttgacggccgaa

SEQ ID NO: 152684 - DNA, 20 bp, Artificial Sequence
  chemically synthesized
tacccttttgacggccgaag

SEQ ID NO: 152685 - DNA, 20 bp, Artificial Sequence
  chemically synthesized
cttctggaaagcgtcccctt

SEQ ID NO: 152686 - DNA, 20 bp, Artificial Sequence
  chemically synthesized
cggccgaaggggacgctttc

SEQ ID NO: 152687 - DNA, 20 bp, Artificial Sequence
  chemically synthesized
ccgaaggggacgctttccag

SEQ ID NO: 152688 - DNA, 20 bp, Artificial Sequence
  chemically synthesized
gaaggggacgctttccagaa

SEQ ID NO: 152689 - DNA, 20 bp, Artificial Sequence
  chemically synthesized
agttcatcacctcttctgga

SEQ ID NO: 152690 - DNA, 20 bp, Artificial Sequence
  chemically synthesized
aaggggacgctttccagaag

SEQ ID NO: 152691 - DNA, 20 bp, Artificial Sequence
  chemically synthesized
atagagttcatcacctcttc

SEQ ID NO: 152692 - DNA, 20 bp, Artificial Sequence
  chemically synthesized
tcacacaaaccagaaacata

SEQ ID NO: 152693 - DNA, 20 bp, Artificial Sequence
  chemically synthesized
ggtgatgaactctatgtttc

SEQ ID NO: 152694 - DNA, 20 bp, Artificial Sequence
  chemically synthesized
aatcacacaaaccagaaaca

SEQ ID NO: 152695 - DNA, 20 bp, Artificial Sequence
  chemically synthesized
cttcaatcaatcacacaaac

SEQ ID NO: 152696 - DNA, 20 bp, Artificial Sequence
  chemically synthesized
ctggtttgtgtgattgattg

SEQ ID NO: 152697 - DNA, 20 bp, Artificial Sequence
  chemically synthesized
tgtgtgattgattgaagttc

SEQ ID NO: 152698 - DNA, 20 bp, Artificial Sequence
  chemically synthesized
tcgtagaaatgaatatgggc

SEQ ID NO: 152699 - DNA, 20 bp, Artificial Sequence
  chemically synthesized
gaaatcgtagaaatgaatat

SEQ ID NO: 152700 - DNA, 20 bp, Artificial Sequence
  chemically synthesized
tgaaatcgtagaaatgaata

SEQ ID NO: 152701 - DNA, 20 bp, Artificial Sequence
  chemically synthesized
ttgcctacagcatgaaatcg

SEQ ID NO: 152702 - DNA, 20 bp, Artificial Sequence
  chemically synthesized
atttctacgatttcatgctg

SEQ ID NO: 152703 - DNA, 20 bp, Artificial Sequence
  chemically synthesized
tttctacgatttcatgctgt

SEQ ID NO: 152704 - DNA, 20 bp, Artificial Sequence
  chemically synthesized
taagtggacccaattgccta

SEQ ID NO: 152705 - DNA, 20 bp, Artificial Sequence
  chemically synthesized
gatttcatgctgtaggcaat

SEQ ID NO: 152706 - DNA, 20 bp, Artificial Sequence
  chemically synthesized
atttcatgctgtaggcaatt

SEQ ID NO: 152707 - DNA, 20 bp, Artificial Sequence
  chemically synthesized
cggtggctgtggtgaataag

SEQ ID NO: 152708 - DNA, 20 bp, Artificial Sequence
  chemically synthesized
gttcggtggctgtggtgaat

SEQ ID NO: 152709 - DNA, 20 bp, Artificial Sequence
  chemically synthesized
ttgggtccacttattcacca

SEQ ID NO: 152710 - DNA, 20 bp, Artificial Sequence
  chemically synthesized
ttttctttgttcggtggctg

SEQ ID NO: 152711 - DNA, 20 bp, Artificial Sequence
  chemically synthesized
ttcaccacagccaccgaaca

SEQ ID NO: 152712 - DNA, 20 bp, Artificial Sequence
  chemically synthesized
ctagtgttttctttgttcgg

SEQ ID NO: 152713 - DNA, 20 bp, Artificial Sequence
  chemically synthesized
tttctagtgttttctttgtt

SEQ ID NO: 152714 - DNA, 20 bp, Artificial Sequence
  chemically synthesized
ccaccgaacaaagaaaacac

SEQ ID NO: 152715 - DNA, 20 bp, Artificial Sequence
  chemically synthesized
gattctctgaaagtattttc

SEQ ID NO: 152716 - DNA, 20 bp, Artificial Sequence
  chemically synthesized
aaaacactagaaaatacttt

SEQ ID NO: 152717 - DNA, 20 bp, Artificial Sequence
  chemically synthesized
aacactagaaaatactttca

SEQ ID NO: 152718 - DNA, 20 bp, Artificial Sequence
  chemically synthesized
gttcagacctgattctctga

SEQ ID NO: 152719 - DNA, 20 bp, Artificial Sequence
  chemically synthesized
agaaaatactttcagagaat

SEQ ID NO: 152720 - DNA, 20 bp, Artificial Sequence
  chemically synthesized
gaaaatactttcagagaatc

SEQ ID NO: 152721 - DNA, 20 bp, Artificial Sequence
  chemically synthesized
ggaaaattcttttttgtgtt

SEQ ID NO: 152722 - DNA, 20 bp, Artificial Sequence
  chemically synthesized
aatcaggtctgaacacaaaa

SEQ ID NO: 152723 - DNA, 20 bp, Artificial Sequence
  chemically synthesized
aacacaaaaaagaattttcc

SEQ ID NO: 152724 - DNA, 20 bp, Artificial Sequence
  chemically synthesized
acacaaaaaagaattttcca

SEQ ID NO: 152725 - DNA, 20 bp, Artificial Sequence
  chemically synthesized
cacaaaaaagaattttccaa

SEQ ID NO: 152726 - DNA, 20 bp, Artificial Sequence
  chemically synthesized
caaaaaagaattttccaagg

SEQ ID NO: 152727 - DNA, 20 bp, Artificial Sequence
  chemically synthesized
taagggcaccacgactccct

SEQ ID NO: 152728 - DNA, 20 bp, Artificial Sequence
  chemically synthesized
agaattttccaagggagtcg

SEQ ID NO: 152729 - DNA, 20 bp, Artificial Sequence
  chemically synthesized
aagggagtcgtggtgccctt

SEQ ID NO: 152730 - DNA, 20 bp, Artificial Sequence
  chemically synthesized
agcacttcatttaatcttaa

SEQ ID NO: 152731 - DNA, 20 bp, Artificial Sequence
  chemically synthesized
cagcacttcatttaatctta

SEQ ID NO: 152732 - DNA, 20 bp, Artificial Sequence
  chemically synthesized
acagcacttcatttaatctt

SEQ ID NO: 152733 - DNA, 20 bp, Artificial Sequence
  chemically synthesized
ggtgcccttaagattaaatg

SEQ ID NO: 152734 - DNA, 20 bp, Artificial Sequence
  chemically synthesized
attaaataaatatgtttaaa

SEQ ID NO: 152735 - DNA, 20 bp, Artificial Sequence
  chemically synthesized
atttaattgattttgacttg

SEQ ID NO: 152736 - DNA, 20 bp, Artificial Sequence
  chemically synthesized
taattgattttgacttgcag

SEQ ID NO: 152737 - DNA, 20 bp, Artificial Sequence
  chemically synthesized
aattgattttgacttgcagc

SEQ ID NO: 152738 - DNA, 20 bp, Artificial Sequence
  chemically synthesized
attgattttgacttgcagca

SEQ ID NO: 152739 - DNA, 20 bp, Artificial Sequence
  chemically synthesized
atagtccagcaccctgctgc

SEQ ID NO: 152740 - DNA, 20 bp, Artificial Sequence
  chemically synthesized
tttgacttgcagcagggtgc

SEQ ID NO: 152741 - DNA, 20 bp, Artificial Sequence
  chemically synthesized
tgcagcagggtgctggacta

SEQ ID NO: 152742 - DNA, 20 bp, Artificial Sequence
  chemically synthesized
atctatagggtaccatagtc

SEQ ID NO: 152743 - DNA, 20 bp, Artificial Sequence
  chemically synthesized
ggaaaatctatagggtacca

SEQ ID NO: 152744 - DNA, 20 bp, Artificial Sequence
  chemically synthesized
tgctggactatggtacccta

SEQ ID NO: 152745 - DNA, 20 bp, Artificial Sequence
  chemically synthesized
gtagatctggaaaatctata

SEQ ID NO: 152746 - DNA, 20 bp, Artificial Sequence
  chemically synthesized
agtagatctggaaaatctat

SEQ ID NO: 152747 - DNA, 20 bp, Artificial Sequence
  chemically synthesized
aagtagatctggaaaatcta

SEQ ID NO: 152748 - DNA, 20 bp, Artificial Sequence
  chemically synthesized
atggtaccctatagattttc

SEQ ID NO: 152749 - DNA, 20 bp, Artificial Sequence
  chemically synthesized
agaattacaaaaagtagatc

SEQ ID NO: 152750 - DNA, 20 bp, Artificial Sequence
  chemically synthesized
agcagcagaattacaaaaag

SEQ ID NO: 152751 - DNA, 20 bp, Artificial Sequence
  chemically synthesized
tacagcagcagaattacaaa

SEQ ID NO: 152752 - DNA, 20 bp, Artificial Sequence
  chemically synthesized
tcaaaaagccagtacagcag

SEQ ID NO: 152753 - DNA, 20 bp, Artificial Sequence
  chemically synthesized
ttgtaattctgctgctgtac

SEQ ID NO: 152754 - DNA, 20 bp, Artificial Sequence
  chemically synthesized
aggtcaaaaagccagtacag

SEQ ID NO: 152755 - DNA, 20 bp, Artificial Sequence
  chemically synthesized
tcaaggtcaaaaagccagta

SEQ ID NO: 152756 - DNA, 20 bp, Artificial Sequence
  chemically synthesized
tcaattcaaggtcaaaaagc

SEQ ID NO: 152757 - DNA, 20 bp, Artificial Sequence
  chemically synthesized
actgtcaattcaaggtcaaa

SEQ ID NO: 152758 - DNA, 20 bp, Artificial Sequence
  chemically synthesized
catctgtaactgtcaattca

SEQ ID NO: 152759 - DNA, 20 bp, Artificial Sequence
  chemically synthesized
gctttttgaccttgaattga

SEQ ID NO: 152760 - DNA, 20 bp, Artificial Sequence
  chemically synthesized
acatctgtaactgtcaattc

SEQ ID NO: 152761 - DNA, 20 bp, Artificial Sequence
  chemically synthesized
tgaccttgaattgacagtta

SEQ ID NO: 152762 - DNA, 20 bp, Artificial Sequence
  chemically synthesized
tgaattgacagttacagatg

SEQ ID NO: 152763 - DNA, 20 bp, Artificial Sequence
  chemically synthesized
gaattgacagttacagatgt

SEQ ID NO: 152764 - DNA, 20 bp, Artificial Sequence
  chemically synthesized
attgacagttacagatgtgg

SEQ ID NO: 152765 - DNA, 20 bp, Artificial Sequence
  chemically synthesized
cagatgtgggagaataaata

SEQ ID NO: 152766 - DNA, 20 bp, Artificial Sequence
  chemically synthesized
gtgggagaataaataaagct

SEQ ID NO: 152767 - DNA, 20 bp, Artificial Sequence
  chemically synthesized
ggagaataaataaagctaag

SEQ ID NO: 152768 - DNA, 20 bp, Artificial Sequence
  chemically synthesized
tctcccacagtgttactact

SEQ ID NO: 152769 - DNA, 20 bp, Artificial Sequence
  chemically synthesized
aaagctaagtagtaacactg

SEQ ID NO: 152770 - DNA, 20 bp, Artificial Sequence
  chemically synthesized
aagctaagtagtaacactgt

SEQ ID NO: 152771 - DNA, 20 bp, Artificial Sequence
  chemically synthesized
gctaagtagtaacactgtgg

SEQ ID NO: 152772 - DNA, 20 bp, Artificial Sequence
  chemically synthesized
tgataggcttgattctccca

SEQ ID NO: 152773 - DNA, 20 bp, Artificial Sequence
  chemically synthesized
agtaacactgtgggagaatc

SEQ ID NO: 152774 - DNA, 20 bp, Artificial Sequence
  chemically synthesized
gaaaaagacattaagatgat

SEQ ID NO: 152775 - DNA, 20 bp, Artificial Sequence
  chemically synthesized
agaaaaagacattaagatga

SEQ ID NO: 152776 - DNA, 20 bp, Artificial Sequence
  chemically synthesized
tcaggagagaaaaagacatt

SEQ ID NO: 152777 - DNA, 20 bp, Artificial Sequence
  chemically synthesized
gaaggcaatcaggagagaaa

SEQ ID NO: 152778 - DNA, 20 bp, Artificial Sequence
  chemically synthesized
agaatagaaggcaatcagga

SEQ ID NO: 152779 - DNA, 20 bp, Artificial Sequence
  chemically synthesized
ctagaatagaaggcaatcag

SEQ ID NO: 152780 - DNA, 20 bp, Artificial Sequence
  chemically synthesized
ctctagaatagaaggcaatc

SEQ ID NO: 152781 - DNA, 20 bp, Artificial Sequence
  chemically synthesized
cctctagaatagaaggcaat

SEQ ID NO: 152782 - DNA, 20 bp, Artificial Sequence
  chemically synthesized
ctcctgattgccttctattc

SEQ ID NO: 152783 - DNA, 20 bp, Artificial Sequence
  chemically synthesized
tttggctcctctagaataga

SEQ ID NO: 152784 - DNA, 20 bp, Artificial Sequence
  chemically synthesized
ttttggctcctctagaatag

SEQ ID NO: 152785 - DNA, 20 bp, Artificial Sequence
  chemically synthesized
cctgattgccttctattcta

SEQ ID NO: 152786 - DNA, 20 bp, Artificial Sequence
  chemically synthesized
ctgattgccttctattctag

SEQ ID NO: 152787 - DNA, 20 bp, Artificial Sequence
  chemically synthesized
tttttttggctcctctagaa

SEQ ID NO: 152788 - DNA, 20 bp, Artificial Sequence
  chemically synthesized
gattgccttctattctagag

SEQ ID NO: 152789 - DNA, 20 bp, Artificial Sequence
  chemically synthesized
ttttctttttttggctcctc

SEQ ID NO: 152790 - DNA, 20 bp, Artificial Sequence
  chemically synthesized
tattctagaggagccaaaaa

SEQ ID NO: 152791 - DNA, 20 bp, Artificial Sequence
  chemically synthesized
tttcttttcttttctttttt

SEQ ID NO: 152792 - DNA, 20 bp, Artificial Sequence
  chemically synthesized
tagaggagccaaaaaaagaa

SEQ ID NO: 152793 - DNA, 20 bp, Artificial Sequence
  chemically synthesized
gagccaaaaaaagaaaagaa

SEQ ID NO: 152794 - DNA, 20 bp, Artificial Sequence
  chemically synthesized
aaaaaaagaaaagaaaagaa

SEQ ID NO: 152795 - DNA, 20 bp, Artificial Sequence
  chemically synthesized
aagaaaagaaaagaaaagaa

SEQ ID NO: 152796 - DNA, 20 bp, Artificial Sequence
  chemically synthesized
acggaagtggtttcaatatg

SEQ ID NO: 152797 - DNA, 20 bp, Artificial Sequence
  chemically synthesized
taacctcagagttacggaag

SEQ ID NO: 152798 - DNA, 20 bp, Artificial Sequence
  chemically synthesized
ctataacctcagagttacgg

SEQ ID NO: 152799 - DNA, 20 bp, Artificial Sequence
  chemically synthesized
gaaaccacttccgtaactct

SEQ ID NO: 152800 - DNA, 20 bp, Artificial Sequence
  chemically synthesized
atactataacctcagagtta

SEQ ID NO: 152801 - DNA, 20 bp, Artificial Sequence
  chemically synthesized
aaaccacttccgtaactctg

SEQ ID NO: 152802 - DNA, 20 bp, Artificial Sequence
  chemically synthesized
agcttaatactataacctca

SEQ ID NO: 152803 - DNA, 20 bp, Artificial Sequence
  chemically synthesized
cttccgtaactctgaggtta

SEQ ID NO: 152804 - DNA, 20 bp, Artificial Sequence
  chemically synthesized
gaagcttaatactataacct

SEQ ID NO: 152805 - DNA, 20 bp, Artificial Sequence
  chemically synthesized
aactctgaggttatagtatt

SEQ ID NO: 152806 - DNA, 20 bp, Artificial Sequence
  chemically synthesized
ggttatagtattaagcttca

SEQ ID NO: 152807 - DNA, 20 bp, Artificial Sequence
  chemically synthesized
gttatagtattaagcttcaa

SEQ ID NO: 152808 - DNA, 20 bp, Artificial Sequence
  chemically synthesized
cttaagtagtagtacctttg

SEQ ID NO: 152809 - DNA, 20 bp, Artificial Sequence
  chemically synthesized
cttcaaaggtactactactt

SEQ ID NO: 152810 - DNA, 20 bp, Artificial Sequence
  chemically synthesized
ttcaaaggtactactactta

SEQ ID NO: 152811 - DNA, 20 bp, Artificial Sequence
  chemically synthesized
tggaattgggccttaagtag

SEQ ID NO: 152812 - DNA, 20 bp, Artificial Sequence
  chemically synthesized
gggtggaattgggccttaag

SEQ ID NO: 152813 - DNA, 20 bp, Artificial Sequence
  chemically synthesized
cgtgggtggaattgggcctt

SEQ ID NO: 152814 - DNA, 20 bp, Artificial Sequence
  chemically synthesized
aaatctccgtgggtggaatt

SEQ ID NO: 152815 - DNA, 20 bp, Artificial Sequence
  chemically synthesized
taaatctccgtgggtggaat

SEQ ID NO: 152816 - DNA, 20 bp, Artificial Sequence
  chemically synthesized
ttaaggcccaattccaccca

SEQ ID NO: 152817 - DNA, 20 bp, Artificial Sequence
  chemically synthesized
aaggcccaattccacccacg

SEQ ID NO: 152818 - DNA, 20 bp, Artificial Sequence
  chemically synthesized
ttttattaaatctccgtggg

SEQ ID NO: 152819 - DNA, 20 bp, Artificial Sequence
  chemically synthesized
atcttttattaaatctccgt

SEQ ID NO: 152820 - DNA, 20 bp, Artificial Sequence
  chemically synthesized
aatcttttattaaatctccg

SEQ ID NO: 152821 - DNA, 20 bp, Artificial Sequence
  chemically synthesized
cacccacggagatttaataa

SEQ ID NO: 152822 - DNA, 20 bp, Artificial Sequence
  chemically synthesized
cggagatttaataaaagatt

SEQ ID NO: 152823 - DNA, 20 bp, Artificial Sequence
  chemically synthesized
gatttagatgtcatgcaaaa

SEQ ID NO: 152824 - DNA, 20 bp, Artificial Sequence
  chemically synthesized
agatgtcatgcaaaacggaa

SEQ ID NO: 152825 - DNA, 20 bp, Artificial Sequence
  chemically synthesized
gtcatgcaaaacggaaaaga

SEQ ID NO: 152826 - DNA, 20 bp, Artificial Sequence
  chemically synthesized
tcatgcaaaacggaaaagaa

SEQ ID NO: 152827 - DNA, 20 bp, Artificial Sequence
  chemically synthesized
catgcaaaacggaaaagaaa

SEQ ID NO: 152828 - DNA, 20 bp, Artificial Sequence
  chemically synthesized
atgcaaaacggaaaagaaag

SEQ ID NO: 152829 - DNA, 20 bp, Artificial Sequence
  chemically synthesized
caaaacggaaaagaaagggg

SEQ ID NO: 152830 - DNA, 20 bp, Artificial Sequence
  chemically synthesized
aaacggaaaagaaaggggaa

SEQ ID NO: 152831 - DNA, 20 bp, Artificial Sequence
  chemically synthesized
acggaaaagaaaggggaaga

SEQ ID NO: 152832 - DNA, 20 bp, Artificial Sequence
  chemically synthesized
ggaaaagaaaggggaagaga

SEQ ID NO: 152833 - DNA, 20 bp, Artificial Sequence
  chemically synthesized
tattgttgtttaatttcatt

SEQ ID NO: 152834 - DNA, 20 bp, Artificial Sequence
  chemically synthesized
catttggaaaatatgtacaa

SEQ ID NO: 152835 - DNA, 20 bp, Artificial Sequence
  chemically synthesized
gtacaaaagcatgcacaata

SEQ ID NO: 152836 - DNA, 20 bp, Artificial Sequence
  chemically synthesized
caaaagcatgcacaatatgg

SEQ ID NO: 152837 - DNA, 20 bp, Artificial Sequence
  chemically synthesized
catgcacaatatggtagaat

SEQ ID NO: 152838 - DNA, 20 bp, Artificial Sequence
  chemically synthesized
caatatggtagaattggtcc

SEQ ID NO: 152839 - DNA, 20 bp, Artificial Sequence
  chemically synthesized
atatggtagaattggtccta

SEQ ID NO: 152840 - DNA, 20 bp, Artificial Sequence
  chemically synthesized
atgaagactccatatactct

SEQ ID NO: 152841 - DNA, 20 bp, Artificial Sequence
  chemically synthesized
agaattggtcctagagtata

SEQ ID NO: 152842 - DNA, 20 bp, Artificial Sequence
  chemically synthesized
aatgaagactccatatactc

SEQ ID NO: 152843 - DNA, 20 bp, Artificial Sequence
  chemically synthesized
aattggtcctagagtatatg

SEQ ID NO: 152844 - DNA, 20 bp, Artificial Sequence
  chemically synthesized
gtatatggagtcttcattca

SEQ ID NO: 152845 - DNA, 20 bp, Artificial Sequence
  chemically synthesized
ggtcatgcagtctatgaatg

SEQ ID NO: 152846 - DNA, 20 bp, Artificial Sequence
  chemically synthesized
cattcatagactgcatgacc

SEQ ID NO: 152847 - DNA, 20 bp, Artificial Sequence
  chemically synthesized
catactgaatcttggtcatg

SEQ ID NO: 152848 - DNA, 20 bp, Artificial Sequence
  chemically synthesized
tagactgcatgaccaagatt

SEQ ID NO: 152849 - DNA, 20 bp, Artificial Sequence
  chemically synthesized
atgttaaacatactgaatct

SEQ ID NO: 152850 - DNA, 20 bp, Artificial Sequence
  chemically synthesized
gattcagtatgtttaacata

SEQ ID NO: 152851 - DNA, 20 bp, Artificial Sequence
  chemically synthesized
attcagtatgtttaacataa

SEQ ID NO: 152852 - DNA, 20 bp, Artificial Sequence
  chemically synthesized
tatgtttaacataaaggtaa

SEQ ID NO: 152853 - DNA, 20 bp, Artificial Sequence
  chemically synthesized
tttaacataaaggtaaaaga

SEQ ID NO: 152854 - DNA, 20 bp, Artificial Sequence
  chemically synthesized
ttaacataaaggtaaaagac

SEQ ID NO: 152855 - DNA, 20 bp, Artificial Sequence
  chemically synthesized
agacaggcatgaactttata

SEQ ID NO: 152856 - DNA, 20 bp, Artificial Sequence
  chemically synthesized
cttgaacctgagtctttata

SEQ ID NO: 152857 - DNA, 20 bp, Artificial Sequence
  chemically synthesized
gcatgaactttataaagact

SEQ ID NO: 152858 - DNA, 20 bp, Artificial Sequence
  chemically synthesized
catgaactttataaagactc

SEQ ID NO: 152859 - DNA, 20 bp, Artificial Sequence
  chemically synthesized
ctttataaagactcaggttc

SEQ ID NO: 152860 - DNA, 20 bp, Artificial Sequence
  chemically synthesized
tttataaagactcaggttca

SEQ ID NO: 152861 - DNA, 20 bp, Artificial Sequence
  chemically synthesized
cacagcatggccttgaacct

SEQ ID NO: 152862 - DNA, 20 bp, Artificial Sequence
  chemically synthesized
gctactaagtgggcacagca

SEQ ID NO: 152863 - DNA, 20 bp, Artificial Sequence
  chemically synthesized
acccagctactaagtgggca

SEQ ID NO: 152864 - DNA, 20 bp, Artificial Sequence
  chemically synthesized
aaggccatgctgtgcccact

SEQ ID NO: 152865 - DNA, 20 bp, Artificial Sequence
  chemically synthesized
gccatgctgtgcccacttag

SEQ ID NO: 152866 - DNA, 20 bp, Artificial Sequence
  chemically synthesized
aaaacacccagctactaagt

SEQ ID NO: 152867 - DNA, 20 bp, Artificial Sequence
  chemically synthesized
aaaaacacccagctactaag

SEQ ID NO: 152868 - DNA, 20 bp, Artificial Sequence
  chemically synthesized
tgctgtgcccacttagtagc

SEQ ID NO: 152869 - DNA, 20 bp, Artificial Sequence
  chemically synthesized
gctgtgcccacttagtagct

SEQ ID NO: 152870 - DNA, 20 bp, Artificial Sequence
  chemically synthesized
tccaaaaacacccagctact

SEQ ID NO: 152871 - DNA, 20 bp, Artificial Sequence
  chemically synthesized
aatggttatccaaaaacacc

SEQ ID NO: 152872 - DNA, 20 bp, Artificial Sequence
  chemically synthesized
acttagtagctgggtgtttt

SEQ ID NO: 152873 - DNA, 20 bp, Artificial Sequence
  chemically synthesized
ttttggataaccattctctc

SEQ ID NO: 152874 - DNA, 20 bp, Artificial Sequence
  chemically synthesized
aaatgaaagcctagagagaa

SEQ ID NO: 152875 - DNA, 20 bp, Artificial Sequence
  chemically synthesized
tttggataaccattctctct

SEQ ID NO: 152876 - DNA, 20 bp, Artificial Sequence
  chemically synthesized
agaggaaatgaaagcctaga

SEQ ID NO: 152877 - DNA, 20 bp, Artificial Sequence
  chemically synthesized
tgagaggaaatgaaagccta

SEQ ID NO: 152878 - DNA, 20 bp, Artificial Sequence
  chemically synthesized
catgagaggaaatgaaagcc

SEQ ID NO: 152879 - DNA, 20 bp, Artificial Sequence
  chemically synthesized
ttcaccatgagaggaaatga

SEQ ID NO: 152880 - DNA, 20 bp, Artificial Sequence
  chemically synthesized
taggctttcatttcctctca

SEQ ID NO: 152881 - DNA, 20 bp, Artificial Sequence
  chemically synthesized
ttattatttttcaccatgag

SEQ ID NO: 152882 - DNA, 20 bp, Artificial Sequence
  chemically synthesized
attattatttttcaccatga

SEQ ID NO: 152883 - DNA, 20 bp, Artificial Sequence
  chemically synthesized
ttattattatttttcaccat

SEQ ID NO: 152884 - DNA, 20 bp, Artificial Sequence
  chemically synthesized
ggtgaaaaataataataatg

SEQ ID NO: 152885 - DNA, 20 bp, Artificial Sequence
  chemically synthesized
taatgtagtacctatttcat

SEQ ID NO: 152886 - DNA, 20 bp, Artificial Sequence
  chemically synthesized
ttacagcagccttatgaaat

SEQ ID NO: 152887 - DNA, 20 bp, Artificial Sequence
  chemically synthesized
aatgtagtacctatttcata

SEQ ID NO: 152888 - DNA, 20 bp, Artificial Sequence
  chemically synthesized
cttacagcagccttatgaaa

SEQ ID NO: 152889 - DNA, 20 bp, Artificial Sequence
  chemically synthesized
ctatttcataaggctgctgt

SEQ ID NO: 152890 - DNA, 20 bp, Artificial Sequence
  chemically synthesized
ttttctgtttaatcttacag

SEQ ID NO: 152891 - DNA, 20 bp, Artificial Sequence
  chemically synthesized
catttttctgtttaatctta

SEQ ID NO: 152892 - DNA, 20 bp, Artificial Sequence
  chemically synthesized
aaggctgctgtaagattaaa

SEQ ID NO: 152893 - DNA, 20 bp, Artificial Sequence
  chemically synthesized
attaaacagaaaaatgcaca

SEQ ID NO: 152894 - DNA, 20 bp, Artificial Sequence
  chemically synthesized
aaaaatgcacaaagaatact

SEQ ID NO: 152895 - DNA, 20 bp, Artificial Sequence
  chemically synthesized
tctgtaccaggcattttgcc

SEQ ID NO: 152896 - DNA, 20 bp, Artificial Sequence
  chemically synthesized
agaatacttggcaaaatgcc

SEQ ID NO: 152897 - DNA, 20 bp, Artificial Sequence
  chemically synthesized
acttggcaaaatgcctggta

SEQ ID NO: 152898 - DNA, 20 bp, Artificial Sequence
  chemically synthesized
ttggcaaaatgcctggtaca

SEQ ID NO: 152899 - DNA, 20 bp, Artificial Sequence
  chemically synthesized
ttaatgccttgctctgtacc

SEQ ID NO: 152900 - DNA, 20 bp, Artificial Sequence
  chemically synthesized
attaatgccttgctctgtac

SEQ ID NO: 152901 - DNA, 20 bp, Artificial Sequence
  chemically synthesized
caaaatgcctggtacagagc

SEQ ID NO: 152902 - DNA, 20 bp, Artificial Sequence
  chemically synthesized
aaaatgcctggtacagagca

SEQ ID NO: 152903 - DNA, 20 bp, Artificial Sequence
  chemically synthesized
agcaaggcattaatgcgtgt

SEQ ID NO: 152904 - DNA, 20 bp, Artificial Sequence
  chemically synthesized
cattaatgcgtgttagccct

SEQ ID NO: 152905 - DNA, 20 bp, Artificial Sequence
  chemically synthesized
catacctaatatttatctta

SEQ ID NO: 152906 - DNA, 20 bp, Artificial Sequence
  chemically synthesized
acatacctaatatttatctt

SEQ ID NO: 152907 - DNA, 20 bp, Artificial Sequence
  chemically synthesized
aacatacctaatatttatct

SEQ ID NO: 152908 - DNA, 20 bp, Artificial Sequence
  chemically synthesized
gttagccctaagataaatat

SEQ ID NO: 152909 - DNA, 20 bp, Artificial Sequence
  chemically synthesized
ttagccctaagataaatatt

SEQ ID NO: 152910 - DNA, 20 bp, Artificial Sequence
  chemically synthesized
agataaatattaggtatgtt

SEQ ID NO: 152911 - DNA, 20 bp, Artificial Sequence
  chemically synthesized
gataaatattaggtatgttc

SEQ ID NO: 152912 - DNA, 20 bp, Artificial Sequence
  chemically synthesized
gtatgttcgggtcaatgcaa

SEQ ID NO: 152913 - DNA, 20 bp, Artificial Sequence
  chemically synthesized
gttcgggtcaatgcaaaagc

SEQ ID NO: 152914 - DNA, 20 bp, Artificial Sequence
  chemically synthesized
ttcgggtcaatgcaaaagct

SEQ ID NO: 152915 - DNA, 20 bp, Artificial Sequence
  chemically synthesized
tcgggtcaatgcaaaagcta

SEQ ID NO: 152916 - DNA, 20 bp, Artificial Sequence
  chemically synthesized
cgggtcaatgcaaaagctag

SEQ ID NO: 152917 - DNA, 20 bp, Artificial Sequence
  chemically synthesized
gggtcaatgcaaaagctagg

SEQ ID NO: 152918 - DNA, 20 bp, Artificial Sequence
  chemically synthesized
ttcatttcgattattccccc

SEQ ID NO: 152919 - DNA, 20 bp, Artificial Sequence
  chemically synthesized
agggggaataatcgaaatga

SEQ ID NO: 152920 - DNA, 20 bp, Artificial Sequence
  chemically synthesized
gggaataatcgaaatgaaag

SEQ ID NO: 152921 - DNA, 20 bp, Artificial Sequence
  chemically synthesized
ggaataatcgaaatgaaagc

SEQ ID NO: 152922 - DNA, 20 bp, Artificial Sequence
  chemically synthesized
gcaggtattatttttgaaaa

SEQ ID NO: 152923 - DNA, 20 bp, Artificial Sequence
  chemically synthesized
atttttgaaaatggctatga

SEQ ID NO: 152924 - DNA, 20 bp, Artificial Sequence
  chemically synthesized
tttttgaaaatggctatgat

SEQ ID NO: 152925 - DNA, 20 bp, Artificial Sequence
  chemically synthesized
agtaatatataggcctatca

SEQ ID NO: 152926 - DNA, 20 bp, Artificial Sequence
  chemically synthesized
gttctattccagtaatatat

SEQ ID NO: 152927 - DNA, 20 bp, Artificial Sequence
  chemically synthesized
ggttctattccagtaatata

SEQ ID NO: 152928 - DNA, 20 bp, Artificial Sequence
  chemically synthesized
atgataggcctatatattac

SEQ ID NO: 152929 - DNA, 20 bp, Artificial Sequence
  chemically synthesized
aggcctatatattactggaa

SEQ ID NO: 152930 - DNA, 20 bp, Artificial Sequence
  chemically synthesized
ctcacagtttggttctattc

SEQ ID NO: 152931 - DNA, 20 bp, Artificial Sequence
  chemically synthesized
ctggaatagaaccaaactgt

SEQ ID NO: 152932 - DNA, 20 bp, Artificial Sequence
  chemically synthesized
gtctctaaggtctcacagtt

SEQ ID NO: 152933 - DNA, 20 bp, Artificial Sequence
  chemically synthesized
ggagggtctctaaggtctca

SEQ ID NO: 152934 - DNA, 20 bp, Artificial Sequence
  chemically synthesized
agaaccaaactgtgagacct

SEQ ID NO: 152935 - DNA, 20 bp, Artificial Sequence
  chemically synthesized
aaccaaactgtgagacctta

SEQ ID NO: 152936 - DNA, 20 bp, Artificial Sequence
  chemically synthesized
actctcctggagggtctcta

SEQ ID NO: 152937 - DNA, 20 bp, Artificial Sequence
  chemically synthesized
aactctcctggagggtctct

SEQ ID NO: 152938 - DNA, 20 bp, Artificial Sequence
  chemically synthesized
gtgagaccttagagaccctc

SEQ ID NO: 152939 - DNA, 20 bp, Artificial Sequence
  chemically synthesized
tgagaccttagagaccctcc

SEQ ID NO: 152940 - DNA, 20 bp, Artificial Sequence
  chemically synthesized
agaccttagagaccctccag

SEQ ID NO: 152941 - DNA, 20 bp, Artificial Sequence
  chemically synthesized
accttagagaccctccagga

SEQ ID NO: 152942 - DNA, 20 bp, Artificial Sequence
  chemically synthesized
tcatgtttaactctcctgga

SEQ ID NO: 152943 - DNA, 20 bp, Artificial Sequence
  chemically synthesized
ttcatgtttaactctcctgg

SEQ ID NO: 152944 - DNA, 20 bp, Artificial Sequence
  chemically synthesized
cttcatgtttaactctcctg

SEQ ID NO: 152945 - DNA, 20 bp, Artificial Sequence
  chemically synthesized
cacttcatgtttaactctcc

SEQ ID NO: 152946 - DNA, 20 bp, Artificial Sequence
  chemically synthesized
ctccaggagagttaaacatg

SEQ ID NO: 152947 - DNA, 20 bp, Artificial Sequence
  chemically synthesized
acataagtctgatgtaaatc

SEQ ID NO: 152948 - DNA, 20 bp, Artificial Sequence
  chemically synthesized
aacataagtctgatgtaaat

SEQ ID NO: 152949 - DNA, 20 bp, Artificial Sequence
  chemically synthesized
ttgttttgcctgatttacat

SEQ ID NO: 152950 - DNA, 20 bp, Artificial Sequence
  chemically synthesized
aaggggtgctttaacaacat

SEQ ID NO: 152951 - DNA, 20 bp, Artificial Sequence
  chemically synthesized
acatcagacttatgttgtta

SEQ ID NO: 152952 - DNA, 20 bp, Artificial Sequence
  chemically synthesized
atgcttcatattgaaaaaag

SEQ ID NO: 152953 - DNA, 20 bp, Artificial Sequence
  chemically synthesized
aatgcttcatattgaaaaaa

SEQ ID NO: 152954 - DNA, 20 bp, Artificial Sequence
  chemically synthesized
aaatgcttcatattgaaaaa

SEQ ID NO: 152955 - DNA, 20 bp, Artificial Sequence
  chemically synthesized
taaatgcttcatattgaaaa

SEQ ID NO: 152956 - DNA, 20 bp, Artificial Sequence
  chemically synthesized
gcaccccttttttcaatatg

SEQ ID NO: 152957 - DNA, 20 bp, Artificial Sequence
  chemically synthesized
atatgaagcatttattcacc

SEQ ID NO: 152958 - DNA, 20 bp, Artificial Sequence
  chemically synthesized
gcatttattcacccagataa

SEQ ID NO: 152959 - DNA, 20 bp, Artificial Sequence
  chemically synthesized
tggatttgtatccattatct

SEQ ID NO: 152960 - DNA, 20 bp, Artificial Sequence
  chemically synthesized
atggatttgtatccattatc

SEQ ID NO: 152961 - DNA, 20 bp, Artificial Sequence
  chemically synthesized
ccaaggaacatttgaatgca

SEQ ID NO: 152962 - DNA, 20 bp, Artificial Sequence
  chemically synthesized
ccatgcattcaaatgttcct

SEQ ID NO: 152963 - DNA, 20 bp, Artificial Sequence
  chemically synthesized
atgcattcaaatgttccttg

SEQ ID NO: 152964 - DNA, 20 bp, Artificial Sequence
  chemically synthesized
attcaaatgttccttggagt

SEQ ID NO: 152965 - DNA, 20 bp, Artificial Sequence
  chemically synthesized
catcttgatctctgactcca

SEQ ID NO: 152966 - DNA, 20 bp, Artificial Sequence
  chemically synthesized
tcaaatgttccttggagtca

SEQ ID NO: 152967 - DNA, 20 bp, Artificial Sequence
  chemically synthesized
ccatcttgatctctgactcc

SEQ ID NO: 152968 - DNA, 20 bp, Artificial Sequence
  chemically synthesized
gttccttggagtcagagatc

SEQ ID NO: 152969 - DNA, 20 bp, Artificial Sequence
  chemically synthesized
cttggagtcagagatcaaga

SEQ ID NO: 152970 - DNA, 20 bp, Artificial Sequence
  chemically synthesized
gagatcaagatggaaatccc

SEQ ID NO: 152971 - DNA, 20 bp, Artificial Sequence
  chemically synthesized
cgcaaatctctatgattctg

SEQ ID NO: 152972 - DNA, 20 bp, Artificial Sequence
  chemically synthesized
gatggaaatccccagaatca

SEQ ID NO: 152973 - DNA, 20 bp, Artificial Sequence
  chemically synthesized
acgcaaatctctatgattct

SEQ ID NO: 152974 - DNA, 20 bp, Artificial Sequence
  chemically synthesized
gacgcaaatctctatgattc

SEQ ID NO: 152975 - DNA, 20 bp, Artificial Sequence
  chemically synthesized
tggaaatccccagaatcata

SEQ ID NO: 152976 - DNA, 20 bp, Artificial Sequence
  chemically synthesized
agagatttgcgtctgtaaac

SEQ ID NO: 152977 - DNA, 20 bp, Artificial Sequence
  chemically synthesized
gaatataataagccagttta

SEQ ID NO: 152978 - DNA, 20 bp, Artificial Sequence
  chemically synthesized
tgaatgtgaatataataagc

SEQ ID NO: 152979 - DNA, 20 bp, Artificial Sequence
  chemically synthesized
tctttgaatgtgaatataat

SEQ ID NO: 152980 - DNA, 20 bp, Artificial Sequence
  chemically synthesized
gcttattatattcacattca

SEQ ID NO: 152981 - DNA, 20 bp, Artificial Sequence
  chemically synthesized
ttattatattcacattcaaa

SEQ ID NO: 152982 - DNA, 20 bp, Artificial Sequence
  chemically synthesized
tattatattcacattcaaag

SEQ ID NO: 152983 - DNA, 20 bp, Artificial Sequence
  chemically synthesized
atattcacattcaaagaggt

SEQ ID NO: 152984 - DNA, 20 bp, Artificial Sequence
  chemically synthesized
ttcacattcaaagaggttgg

SEQ ID NO: 152985 - DNA, 20 bp, Artificial Sequence
  chemically synthesized
tcacattcaaagaggttgga

SEQ ID NO: 152986 - DNA, 20 bp, Artificial Sequence
  chemically synthesized
cacattcaaagaggttggaa

SEQ ID NO: 152987 - DNA, 20 bp, Artificial Sequence
  chemically synthesized
acattcaaagaggttggaag

SEQ ID NO: 152988 - DNA, 20 bp, Artificial Sequence
  chemically synthesized
ttcaaagaggttggaagggg

SEQ ID NO: 152989 - DNA, 20 bp, Artificial Sequence
  chemically synthesized
gaggttggaaggggcagtgt

SEQ ID NO: 152990 - DNA, 20 bp, Artificial Sequence
  chemically synthesized
ggcagtgtcagctttttaac

SEQ ID NO: 152991 - DNA, 20 bp, Artificial Sequence
  chemically synthesized
atgaaaagattctagttaaa

SEQ ID NO: 152992 - DNA, 20 bp, Artificial Sequence
  chemically synthesized
gagaagtaatgaaaagattc

SEQ ID NO: 152993 - DNA, 20 bp, Artificial Sequence
  chemically synthesized
caacagggagaagtaatgaa

SEQ ID NO: 152994 - DNA, 20 bp, Artificial Sequence
  chemically synthesized
gttgcaaccccaacagggag

SEQ ID NO: 152995 - DNA, 20 bp, Artificial Sequence
  chemically synthesized
ttttcattacttctccctgt

SEQ ID NO: 152996 - DNA, 20 bp, Artificial Sequence
  chemically synthesized
tttcattacttctccctgtt

SEQ ID NO: 152997 - DNA, 20 bp, Artificial Sequence
  chemically synthesized
ttcattacttctccctgttg

SEQ ID NO: 152998 - DNA, 20 bp, Artificial Sequence
  chemically synthesized
tgtgttgcaaccccaacagg

SEQ ID NO: 152999 - DNA, 20 bp, Artificial Sequence
  chemically synthesized
catgtgttgcaaccccaaca

SEQ ID NO: 153000 - DNA, 20 bp, Artificial Sequence
  chemically synthesized
gcatgtgttgcaaccccaac

SEQ ID NO: 153001 - DNA, 20 bp, Artificial Sequence
  chemically synthesized
agcatgtgttgcaaccccaa

SEQ ID NO: 153002 - DNA, 20 bp, Artificial Sequence
  chemically synthesized
ggggttgcaacacatgctgt

SEQ ID NO: 153003 - DNA, 20 bp, Artificial Sequence
  chemically synthesized
gaatctctggaggtcactca

SEQ ID NO: 153004 - DNA, 20 bp, Artificial Sequence
  chemically synthesized
cacatgctgtgagtgacctc

SEQ ID NO: 153005 - DNA, 20 bp, Artificial Sequence
  chemically synthesized
catgctgtgagtgacctcca

SEQ ID NO: 153006 - DNA, 20 bp, Artificial Sequence
  chemically synthesized
acagcttgaggaatctctgg

SEQ ID NO: 153007 - DNA, 20 bp, Artificial Sequence
  chemically synthesized
tacagcttgaggaatctctg

SEQ ID NO: 153008 - DNA, 20 bp, Artificial Sequence
  chemically synthesized
catacagcttgaggaatctc

SEQ ID NO: 153009 - DNA, 20 bp, Artificial Sequence
  chemically synthesized
gtgacctccagagattcctc

SEQ ID NO: 153010 - DNA, 20 bp, Artificial Sequence
  chemically synthesized
tgctgcctgcatacagcttg

SEQ ID NO: 153011 - DNA, 20 bp, Artificial Sequence
  chemically synthesized
ttgctgcctgcatacagctt

SEQ ID NO: 153012 - DNA, 20 bp, Artificial Sequence
  chemically synthesized
gagattcctcaagctgtatg

SEQ ID NO: 153013 - DNA, 20 bp, Artificial Sequence
  chemically synthesized
agattcctcaagctgtatgc

SEQ ID NO: 153014 - DNA, 20 bp, Artificial Sequence
  chemically synthesized
ttcaatttgctgcctgcata

SEQ ID NO: 153015 - DNA, 20 bp, Artificial Sequence
  chemically synthesized
ttcctcaagctgtatgcagg

SEQ ID NO: 153016 - DNA, 20 bp, Artificial Sequence
  chemically synthesized
aggcagcaaattgaatctga

SEQ ID NO: 153017 - DNA, 20 bp, Artificial Sequence
  chemically synthesized
aacttgtctaataaagcttt

SEQ ID NO: 153018 - DNA, 20 bp, Artificial Sequence
  chemically synthesized
attgaatctgaaagctttat

SEQ ID NO: 153019 - DNA, 20 bp, Artificial Sequence
  chemically synthesized
caagaaaaacttgtctaata

SEQ ID NO: 153020 - DNA, 20 bp, Artificial Sequence
  chemically synthesized
atctgaaagctttattagac

SEQ ID NO: 153021 - DNA, 20 bp, Artificial Sequence
  chemically synthesized
gacaagtttttcttgtcttt

SEQ ID NO: 153022 - DNA, 20 bp, Artificial Sequence
  chemically synthesized
actcccaccagctgaaagac

SEQ ID NO: 153023 - DNA, 20 bp, Artificial Sequence
  chemically synthesized
agtttttcttgtctttcagc

SEQ ID NO: 153024 - DNA, 20 bp, Artificial Sequence
  chemically synthesized
catccactcccaccagctga

SEQ ID NO: 153025 - DNA, 20 bp, Artificial Sequence
  chemically synthesized
ttttcttgtctttcagctgg

SEQ ID NO: 153026 - DNA, 20 bp, Artificial Sequence
  chemically synthesized
tttcttgtctttcagctggt

SEQ ID NO: 153027 - DNA, 20 bp, Artificial Sequence
  chemically synthesized
tcttgtctttcagctggtgg

SEQ ID NO: 153028 - DNA, 20 bp, Artificial Sequence
  chemically synthesized
tgtctttcagctggtgggag

SEQ ID NO: 153029 - DNA, 20 bp, Artificial Sequence
  chemically synthesized
caactgacatccactcccac

SEQ ID NO: 153030 - DNA, 20 bp, Artificial Sequence
  chemically synthesized
cagctggtgggagtggatgt

SEQ ID NO: 153031 - DNA, 20 bp, Artificial Sequence
  chemically synthesized
ggagtggatgtcagttgtat

SEQ ID NO: 153032 - DNA, 20 bp, Artificial Sequence
  chemically synthesized
tcaggacccagtttcacaag

SEQ ID NO: 153033 - DNA, 20 bp, Artificial Sequence
  chemically synthesized
aataaaacttcttgtgaaac

SEQ ID NO: 153034 - DNA, 20 bp, Artificial Sequence
  chemically synthesized
aggtcaggacccagtttcac

SEQ ID NO: 153035 - DNA, 20 bp, Artificial Sequence
  chemically synthesized
ataaaacttcttgtgaaact

SEQ ID NO: 153036 - DNA, 20 bp, Artificial Sequence
  chemically synthesized
tttttttcaaggtcaggacc

SEQ ID NO: 153037 - DNA, 20 bp, Artificial Sequence
  chemically synthesized
tgagcttttttttcaaggtc

SEQ ID NO: 153038 - DNA, 20 bp, Artificial Sequence
  chemically synthesized
ttgagcttttttttcaaggt

SEQ ID NO: 153039 - DNA, 20 bp, Artificial Sequence
  chemically synthesized
cgatttgagcttttttttca

SEQ ID NO: 153040 - DNA, 20 bp, Artificial Sequence
  chemically synthesized
gggtcctgaccttgaaaaaa

SEQ ID NO: 153041 - DNA, 20 bp, Artificial Sequence
  chemically synthesized
tcgatttgagcttttttttc

SEQ ID NO: 153042 - DNA, 20 bp, Artificial Sequence
  chemically synthesized
tgaaaaaaaagctcaaatcg

SEQ ID NO: 153043 - DNA, 20 bp, Artificial Sequence
  chemically synthesized
tgaattgtacacttcgattt

SEQ ID NO: 153044 - DNA, 20 bp, Artificial Sequence
  chemically synthesized
gaagtgtacaattcaatcct

SEQ ID NO: 153045 - DNA, 20 bp, Artificial Sequence
  chemically synthesized
aacaaataagcacataactc

SEQ ID NO: 153046 - DNA, 20 bp, Artificial Sequence
  chemically synthesized
taacaaataagcacataact

SEQ ID NO: 153047 - DNA, 20 bp, Artificial Sequence
  chemically synthesized
ctgcacactgtttaacaaat

SEQ ID NO: 153048 - DNA, 20 bp, Artificial Sequence
  chemically synthesized
ttatgtgcttatttgttaaa

SEQ ID NO: 153049 - DNA, 20 bp, Artificial Sequence
  chemically synthesized
cttatttgttaaacagtgtg

SEQ ID NO: 153050 - DNA, 20 bp, Artificial Sequence
  chemically synthesized
ttatttgttaaacagtgtgc

SEQ ID NO: 153051 - DNA, 20 bp, Artificial Sequence
  chemically synthesized
ttaaacagtgtgcaggttca

SEQ ID NO: 153052 - DNA, 20 bp, Artificial Sequence
  chemically synthesized
taaacagtgtgcaggttcaa

SEQ ID NO: 153053 - DNA, 20 bp, Artificial Sequence
  chemically synthesized
agtgtgcaggttcaaaggaa

SEQ ID NO: 153054 - DNA, 20 bp, Artificial Sequence
  chemically synthesized
gtgtgcaggttcaaaggaaa

SEQ ID NO: 153055 - DNA, 20 bp, Artificial Sequence
  chemically synthesized
tgtgcaggttcaaaggaaaa

SEQ ID NO: 153056 - DNA, 20 bp, Artificial Sequence
  chemically synthesized
aaagggcatattttacctta

SEQ ID NO: 153057 - DNA, 20 bp, Artificial Sequence
  chemically synthesized
tgttgattcttatttcttta

SEQ ID NO: 153058 - DNA, 20 bp, Artificial Sequence
  chemically synthesized
ttgttgattcttatttcttt

SEQ ID NO: 153059 - DNA, 20 bp, Artificial Sequence
  chemically synthesized
atattttaccttaaagaaat

SEQ ID NO: 153060 - DNA, 20 bp, Artificial Sequence
  chemically synthesized
agaatcaacaataaaaataa

SEQ ID NO: 153061 - DNA, 20 bp, Artificial Sequence
  chemically synthesized
gaatcaacaataaaaataat

SEQ ID NO: 153062 - DNA, 20 bp, Artificial Sequence
  chemically synthesized
atcaacaataaaaataatag

SEQ ID NO: 153063 - DNA, 20 bp, Artificial Sequence
  chemically synthesized
taagttcagcatgatcaaaa

SEQ ID NO: 153064 - DNA, 20 bp, Artificial Sequence
  chemically synthesized
tgttttgatcatgctgaact

SEQ ID NO: 153065 - DNA, 20 bp, Artificial Sequence
  chemically synthesized
gcacttttgcttactaagtt

SEQ ID NO: 153066 - DNA, 20 bp, Artificial Sequence
  chemically synthesized
ttgatcatgctgaacttagt

SEQ ID NO: 153067 - DNA, 20 bp, Artificial Sequence
  chemically synthesized
gataggcacttttgcttact

SEQ ID NO: 153068 - DNA, 20 bp, Artificial Sequence
  chemically synthesized
atgctgaacttagtaagcaa

SEQ ID NO: 153069 - DNA, 20 bp, Artificial Sequence
  chemically synthesized
taactatgtgatttggtgat

SEQ ID NO: 153070 - DNA, 20 bp, Artificial Sequence
  chemically synthesized
ataactatgtgatttggtga

SEQ ID NO: 153071 - DNA, 20 bp, Artificial Sequence
  chemically synthesized
gtgcctatcaccaaatcaca

SEQ ID NO: 153072 - DNA, 20 bp, Artificial Sequence
  chemically synthesized
cttttcataactatgtgatt

SEQ ID NO: 153073 - DNA, 20 bp, Artificial Sequence
  chemically synthesized
ccaaatcacatagttatgaa

SEQ ID NO: 153074 - DNA, 20 bp, Artificial Sequence
  chemically synthesized
gaaaagtatgctaataatcg

SEQ ID NO: 153075 - DNA, 20 bp, Artificial Sequence
  chemically synthesized
ggaattgtttcttcgattat

SEQ ID NO: 153076 - DNA, 20 bp, Artificial Sequence
  chemically synthesized
cttgtcatactgaagtgaat

SEQ ID NO: 153077 - DNA, 20 bp, Artificial Sequence
  chemically synthesized
gaaacaattcccattcactt

SEQ ID NO: 153078 - DNA, 20 bp, Artificial Sequence
  chemically synthesized
tcttgtcatactgaagtgaa

SEQ ID NO: 153079 - DNA, 20 bp, Artificial Sequence
  chemically synthesized
atagttttcttgtcatactg

SEQ ID NO: 153080 - DNA, 20 bp, Artificial Sequence
  chemically synthesized
cccattcacttcagtatgac

SEQ ID NO: 153081 - DNA, 20 bp, Artificial Sequence
  chemically synthesized
atgttcattatggattataa

SEQ ID NO: 153082 - DNA, 20 bp, Artificial Sequence
  chemically synthesized
atgttctataatgttcatta

SEQ ID NO: 153083 - DNA, 20 bp, Artificial Sequence
  chemically synthesized
ataatccataatgaacatta

SEQ ID NO: 153084 - DNA, 20 bp, Artificial Sequence
  chemically synthesized
gtgtattcatacatttcttt

SEQ ID NO: 153085 - DNA, 20 bp, Artificial Sequence
  chemically synthesized
aggactcttctttattctca

SEQ ID NO: 153086 - DNA, 20 bp, Artificial Sequence
  chemically synthesized
catacatttctttgagaata

SEQ ID NO: 153087 - DNA, 20 bp, Artificial Sequence
  chemically synthesized
acatttctttgagaataaag

SEQ ID NO: 153088 - DNA, 20 bp, Artificial Sequence
  chemically synthesized
atttctttgagaataaagaa

SEQ ID NO: 153089 - DNA, 20 bp, Artificial Sequence
  chemically synthesized
ttgagaataaagaagagtcc

SEQ ID NO: 153090 - DNA, 20 bp, Artificial Sequence
  chemically synthesized
tgagaataaagaagagtcct

SEQ ID NO: 153091 - DNA, 20 bp, Artificial Sequence
  chemically synthesized
caatgtcccttcattttccc

SEQ ID NO: 153092 - DNA, 20 bp, Artificial Sequence
  chemically synthesized
ccaatgtcccttcattttcc

SEQ ID NO: 153093 - DNA, 20 bp, Artificial Sequence
  chemically synthesized
agaagagtcctgggaaaatg

SEQ ID NO: 153094 - DNA, 20 bp, Artificial Sequence
  chemically synthesized
gaagagtcctgggaaaatga

SEQ ID NO: 153095 - DNA, 20 bp, Artificial Sequence
  chemically synthesized
aagagtcctgggaaaatgaa

SEQ ID NO: 153096 - DNA, 20 bp, Artificial Sequence
  chemically synthesized
ctgggaaaatgaagggacat

SEQ ID NO: 153097 - DNA, 20 bp, Artificial Sequence
  chemically synthesized
gggaaaatgaagggacattg

SEQ ID NO: 153098 - DNA, 20 bp, Artificial Sequence
  chemically synthesized
aatgaagggacattggagat

SEQ ID NO: 153099 - DNA, 20 bp, Artificial Sequence
  chemically synthesized
aagggacattggagattggc

SEQ ID NO: 153100 - DNA, 20 bp, Artificial Sequence
  chemically synthesized
aatattgaaataaaacaaac

SEQ ID NO: 153101 - DNA, 20 bp, Artificial Sequence
  chemically synthesized
gattttatatgtatatatga

SEQ ID NO: 153102 - DNA, 20 bp, Artificial Sequence
  chemically synthesized
gagattttatatgtatatat

SEQ ID NO: 153103 - DNA, 20 bp, Artificial Sequence
  chemically synthesized
ataaactcatatatatataa

SEQ ID NO: 153104 - DNA, 20 bp, Artificial Sequence
  chemically synthesized
atataaactcatatatatat

SEQ ID NO: 153105 - DNA, 20 bp, Artificial Sequence
  chemically synthesized
aaaatctcttatatatatat

SEQ ID NO: 153106 - DNA, 20 bp, Artificial Sequence
  chemically synthesized
gtttatatataaatatatat

SEQ ID NO: 153107 - DNA, 20 bp, Artificial Sequence
  chemically synthesized
gtttatatataaatatatat

SEQ ID NO: 153108 - DNA, 20 bp, Artificial Sequence
  chemically synthesized
atatgagtttatatatatat

SEQ ID NO: 153109 - DNA, 20 bp, Artificial Sequence
  chemically synthesized
gtttatatataaatatatat

SEQ ID NO: 153110 - DNA, 20 bp, Artificial Sequence
  chemically synthesized
tatatatgagtttatatata

SEQ ID NO: 153111 - DNA, 20 bp, Artificial Sequence
  chemically synthesized
tctctatatagtttttatat

SEQ ID NO: 153112 - DNA, 20 bp, Artificial Sequence
  chemically synthesized
atctctatatagtttttata

SEQ ID NO: 153113 - DNA, 20 bp, Artificial Sequence
  chemically synthesized
tttcctatataaaaactata

SEQ ID NO: 153114 - DNA, 20 bp, Artificial Sequence
  chemically synthesized
tcctatataaaaactatata

SEQ ID NO: 153115 - DNA, 20 bp, Artificial Sequence
  chemically synthesized
cagatagctatatctctata

SEQ ID NO: 153116 - DNA, 20 bp, Artificial Sequence
  chemically synthesized
ataaaaactatatagagata

SEQ ID NO: 153117 - DNA, 20 bp, Artificial Sequence
  chemically synthesized
tatatggttatatatacaga

SEQ ID NO: 153118 - DNA, 20 bp, Artificial Sequence
  chemically synthesized
actatatatggttatatata

SEQ ID NO: 153119 - DNA, 20 bp, Artificial Sequence
  chemically synthesized
tctgtatatataaccatata

SEQ ID NO: 153120 - DNA, 20 bp, Artificial Sequence
  chemically synthesized
atattacatgtcactatata

SEQ ID NO: 153121 - DNA, 20 bp, Artificial Sequence
  chemically synthesized
atatatatataaactatata

SEQ ID NO: 153122 - DNA, 20 bp, Artificial Sequence
  chemically synthesized
tatagacatataactgtata

SEQ ID NO: 153123 - DNA, 20 bp, Artificial Sequence
  chemically synthesized
tatacagttatatgtctata

SEQ ID NO: 153124 - DNA, 20 bp, Artificial Sequence
  chemically synthesized
actatatatatatagctata

SEQ ID NO: 153125 - DNA, 20 bp, Artificial Sequence
  chemically synthesized
attacatcactatatatata

SEQ ID NO: 153126 - DNA, 20 bp, Artificial Sequence
  chemically synthesized
tctatatagctatatatata

SEQ ID NO: 153127 - DNA, 20 bp, Artificial Sequence
  chemically synthesized
atatatatagtgatgtaatt

SEQ ID NO: 153128 - DNA, 20 bp, Artificial Sequence
  chemically synthesized
tagtgatgtaatttagttcc

SEQ ID NO: 153129 - DNA, 20 bp, Artificial Sequence
  chemically synthesized
gttctccaatattaaaaacc

SEQ ID NO: 153130 - DNA, 20 bp, Artificial Sequence
  chemically synthesized
tgttctccaatattaaaaac

SEQ ID NO: 153131 - DNA, 20 bp, Artificial Sequence
  chemically synthesized
tagttcctggtttttaatat

SEQ ID NO: 153132 - DNA, 20 bp, Artificial Sequence
  chemically synthesized
gttcctggtttttaatattg

SEQ ID NO: 153133 - DNA, 20 bp, Artificial Sequence
  chemically synthesized
taatattggagaacaattat

SEQ ID NO: 153134 - DNA, 20 bp, Artificial Sequence
  chemically synthesized
aacaattatgagtttttttg

SEQ ID NO: 153135 - DNA, 20 bp, Artificial Sequence
  chemically synthesized
acaattatgagtttttttga

SEQ ID NO: 153136 - DNA, 20 bp, Artificial Sequence
  chemically synthesized
tgaaggtgtgataattattc

SEQ ID NO: 153137 - DNA, 20 bp, Artificial Sequence
  chemically synthesized
aggtgtgataattattccag

SEQ ID NO: 153138 - DNA, 20 bp, Artificial Sequence
  chemically synthesized
tgtgataattattccagaag

SEQ ID NO: 153139 - DNA, 20 bp, Artificial Sequence
  chemically synthesized
gtgataattattccagaagt

SEQ ID NO: 153140 - DNA, 20 bp, Artificial Sequence
  chemically synthesized
ctactttcaattcctacttc

SEQ ID NO: 153141 - DNA, 20 bp, Artificial Sequence
  chemically synthesized
attccagaagtaggaattga

SEQ ID NO: 153142 - DNA, 20 bp, Artificial Sequence
  chemically synthesized
ccagaagtaggaattgaaag

SEQ ID NO: 153143 - DNA, 20 bp, Artificial Sequence
  chemically synthesized
aacctacaataggaaaaaaa

SEQ ID NO: 153144 - DNA, 20 bp, Artificial Sequence
  chemically synthesized
tgactttttttttcctattg

SEQ ID NO: 153145 - DNA, 20 bp, Artificial Sequence
  chemically synthesized
gactttttttttcctattgt

SEQ ID NO: 153146 - DNA, 20 bp, Artificial Sequence
  chemically synthesized
ttgcaatataaacctacaat

SEQ ID NO: 153147 - DNA, 20 bp, Artificial Sequence
  chemically synthesized
attgcaatataaacctacaa

SEQ ID NO: 153148 - DNA, 20 bp, Artificial Sequence
  chemically synthesized
gtaggtttatattgcaattt

SEQ ID NO: 153149 - DNA, 20 bp, Artificial Sequence
  chemically synthesized
ggtttatattgcaatttaag

SEQ ID NO: 153150 - DNA, 20 bp, Artificial Sequence
  chemically synthesized
gtttatattgcaatttaagt

SEQ ID NO: 153151 - DNA, 20 bp, Artificial Sequence
  chemically synthesized
attgcaatttaagtgggtac

SEQ ID NO: 153152 - DNA, 20 bp, Artificial Sequence
  chemically synthesized
aatttaagtgggtactggta

SEQ ID NO: 153153 - DNA, 20 bp, Artificial Sequence
  chemically synthesized
taagtgggtactggtatagt

SEQ ID NO: 153154 - DNA, 20 bp, Artificial Sequence
  chemically synthesized
gctagcagcactaactatac

SEQ ID NO: 153155 - DNA, 20 bp, Artificial Sequence
  chemically synthesized
actggtatagttagtgctgc

SEQ ID NO: 153156 - DNA, 20 bp, Artificial Sequence
  chemically synthesized
tatttaggtaaaattgctag

SEQ ID NO: 153157 - DNA, 20 bp, Artificial Sequence
  chemically synthesized
taatatttaggtaaaattgc

SEQ ID NO: 153158 - DNA, 20 bp, Artificial Sequence
  chemically synthesized
tagcaattttacctaaatat

SEQ ID NO: 153159 - DNA, 20 bp, Artificial Sequence
  chemically synthesized
agcaattttacctaaatatt

SEQ ID NO: 153160 - DNA, 20 bp, Artificial Sequence
  chemically synthesized
atctaggtatcctaatattt

SEQ ID NO: 153161 - DNA, 20 bp, Artificial Sequence
  chemically synthesized
aatctaggtatcctaatatt

SEQ ID NO: 153162 - DNA, 20 bp, Artificial Sequence
  chemically synthesized
tacctaaatattaggatacc

SEQ ID NO: 153163 - DNA, 20 bp, Artificial Sequence
  chemically synthesized
gttcattagacaaacaatct

SEQ ID NO: 153164 - DNA, 20 bp, Artificial Sequence
  chemically synthesized
agttcattagacaaacaatc

SEQ ID NO: 153165 - DNA, 20 bp, Artificial Sequence
  chemically synthesized
gattgtttgtctaatgaact

SEQ ID NO: 153166 - DNA, 20 bp, Artificial Sequence
  chemically synthesized
ccagcccatgctgagttcat

SEQ ID NO: 153167 - DNA, 20 bp, Artificial Sequence
  chemically synthesized
tttgtctaatgaactcagca

SEQ ID NO: 153168 - DNA, 20 bp, Artificial Sequence
  chemically synthesized
ttgtctaatgaactcagcat

SEQ ID NO: 153169 - DNA, 20 bp, Artificial Sequence
  chemically synthesized
agtgcttgccagcccatgct

SEQ ID NO: 153170 - DNA, 20 bp, Artificial Sequence
  chemically synthesized
ctaatgaactcagcatgggc

SEQ ID NO: 153171 - DNA, 20 bp, Artificial Sequence
  chemically synthesized
tgaactcagcatgggctggc

SEQ ID NO: 153172 - DNA, 20 bp, Artificial Sequence
  chemically synthesized
cttatttccaaagtgcttgc

SEQ ID NO: 153173 - DNA, 20 bp, Artificial Sequence
  chemically synthesized
gcatgggctggcaagcactt

SEQ ID NO: 153174 - DNA, 20 bp, Artificial Sequence
  chemically synthesized
ctggcaagcactttggaaat

SEQ ID NO: 153175 - DNA, 20 bp, Artificial Sequence
  chemically synthesized
atgttttactcttatttcca

SEQ ID NO: 153176 - DNA, 20 bp, Artificial Sequence
  chemically synthesized
ggcaagcactttggaaataa

SEQ ID NO: 153177 - DNA, 20 bp, Artificial Sequence
  chemically synthesized
atattttcataaaaatactg

SEQ ID NO: 153178 - DNA, 20 bp, Artificial Sequence
  chemically synthesized
ttcataaaaatactgaagat

SEQ ID NO: 153179 - DNA, 20 bp, Artificial Sequence
  chemically synthesized
cataaaaatactgaagatga

SEQ ID NO: 153180 - DNA, 20 bp, Artificial Sequence
  chemically synthesized
tttattccttctctcatctt

SEQ ID NO: 153181 - DNA, 20 bp, Artificial Sequence
  chemically synthesized
aaaaatactgaagatgagag

SEQ ID NO: 153182 - DNA, 20 bp, Artificial Sequence
  chemically synthesized
aaaatactgaagatgagaga

SEQ ID NO: 153183 - DNA, 20 bp, Artificial Sequence
  chemically synthesized
ccttcctcttaaaattcata

SEQ ID NO: 153184 - DNA, 20 bp, Artificial Sequence
  chemically synthesized
accttcctcttaaaattcat

SEQ ID NO: 153185 - DNA, 20 bp, Artificial Sequence
  chemically synthesized
gaataaaccttatgaatttt

SEQ ID NO: 153186 - DNA, 20 bp, Artificial Sequence
  chemically synthesized
ataaaccttatgaattttaa

SEQ ID NO: 153187 - DNA, 20 bp, Artificial Sequence
  chemically synthesized
taaaccttatgaattttaag

SEQ ID NO: 153188 - DNA, 20 bp, Artificial Sequence
  chemically synthesized
accttatgaattttaagagg

SEQ ID NO: 153189 - DNA, 20 bp, Artificial Sequence
  chemically synthesized
ccttatgaattttaagagga

SEQ ID NO: 153190 - DNA, 20 bp, Artificial Sequence
  chemically synthesized
tatgaattttaagaggaagg

SEQ ID NO: 153191 - DNA, 20 bp, Artificial Sequence
  chemically synthesized
taagaggaaggtagcatgta

SEQ ID NO: 153192 - DNA, 20 bp, Artificial Sequence
  chemically synthesized
gaggaaggtagcatgtaaag

SEQ ID NO: 153193 - DNA, 20 bp, Artificial Sequence
  chemically synthesized
ggaaggtagcatgtaaagca

SEQ ID NO: 153194 - DNA, 20 bp, Artificial Sequence
  chemically synthesized
gaaggtagcatgtaaagcag

SEQ ID NO: 153195 - DNA, 20 bp, Artificial Sequence
  chemically synthesized
tgtgtcttgaaatcaaattt

SEQ ID NO: 153196 - DNA, 20 bp, Artificial Sequence
  chemically synthesized
aggttctcaaatttgatttc

SEQ ID NO: 153197 - DNA, 20 bp, Artificial Sequence
  chemically synthesized
tcaaatttgatttcaagaca

SEQ ID NO: 153198 - DNA, 20 bp, Artificial Sequence
  chemically synthesized
tttgatttcaagacacagtc

SEQ ID NO: 153199 - DNA, 20 bp, Artificial Sequence
  chemically synthesized
ttcaagacacagtcaagaat

SEQ ID NO: 153200 - DNA, 20 bp, Artificial Sequence
  chemically synthesized
tcaagacacagtcaagaatg

SEQ ID NO: 153201 - DNA, 20 bp, Artificial Sequence
  chemically synthesized
caagacacagtcaagaatga

SEQ ID NO: 153202 - DNA, 20 bp, Artificial Sequence
  chemically synthesized
acagtcaagaatgagggttt

SEQ ID NO: 153203 - DNA, 20 bp, Artificial Sequence
  chemically synthesized
cagtcaagaatgagggttta

SEQ ID NO: 153204 - DNA, 20 bp, Artificial Sequence
  chemically synthesized
gtcaagaatgagggtttaag

SEQ ID NO: 153205 - DNA, 20 bp, Artificial Sequence
  chemically synthesized
agaatgagggtttaaggaga

SEQ ID NO: 153206 - DNA, 20 bp, Artificial Sequence
  chemically synthesized
gaatgagggtttaaggagat

SEQ ID NO: 153207 - DNA, 20 bp, Artificial Sequence
  chemically synthesized
aatgagggtttaaggagata

SEQ ID NO: 153208 - DNA, 20 bp, Artificial Sequence
  chemically synthesized
atgagggtttaaggagatag

SEQ ID NO: 153209 - DNA, 20 bp, Artificial Sequence
  chemically synthesized
aaggagataggggttatatc

SEQ ID NO: 153210 - DNA, 20 bp, Artificial Sequence
  chemically synthesized
gataggggttatatctggcc

SEQ ID NO: 153211 - DNA, 20 bp, Artificial Sequence
  chemically synthesized
aggggttatatctggcctgg

SEQ ID NO: 153212 - DNA, 20 bp, Artificial Sequence
  chemically synthesized
ttgatgcaaatcttccaggc

SEQ ID NO: 153213 - DNA, 20 bp, Artificial Sequence
  chemically synthesized
ggcattgatgcaaatcttcc

SEQ ID NO: 153214 - DNA, 20 bp, Artificial Sequence
  chemically synthesized
tggcattgatgcaaatcttc

SEQ ID NO: 153215 - DNA, 20 bp, Artificial Sequence
  chemically synthesized
gaagatttgcatcaatgcca

SEQ ID NO: 153216 - DNA, 20 bp, Artificial Sequence
  chemically synthesized
gatcaaagagggatattcta

SEQ ID NO: 153217 - DNA, 20 bp, Artificial Sequence
  chemically synthesized
attacagtgctgatcaaaga

SEQ ID NO: 153218 - DNA, 20 bp, Artificial Sequence
  chemically synthesized
atagaatatccctctttgat

SEQ ID NO: 153219 - DNA, 20 bp, Artificial Sequence
  chemically synthesized
gattacagtgctgatcaaag

SEQ ID NO: 153220 - DNA, 20 bp, Artificial Sequence
  chemically synthesized
agattacagtgctgatcaaa

SEQ ID NO: 153221 - DNA, 20 bp, Artificial Sequence
  chemically synthesized
taagattacagtgctgatca

SEQ ID NO: 153222 - DNA, 20 bp, Artificial Sequence
  chemically synthesized
gccctatttttttaagatta

SEQ ID NO: 153223 - DNA, 20 bp, Artificial Sequence
  chemically synthesized
gcactgtaatcttaaaaaaa

SEQ ID NO: 153224 - DNA, 20 bp, Artificial Sequence
  chemically synthesized
gtagtaagccctattttttt

SEQ ID NO: 153225 - DNA, 20 bp, Artificial Sequence
  chemically synthesized
cactgtaatcttaaaaaaat

SEQ ID NO: 153226 - DNA, 20 bp, Artificial Sequence
  chemically synthesized
actgtaatcttaaaaaaata

SEQ ID NO: 153227 - DNA, 20 bp, Artificial Sequence
  chemically synthesized
aaaaaatagggcttactact

SEQ ID NO: 153228 - DNA, 20 bp, Artificial Sequence
  chemically synthesized
atcttcacaatctcagtagt

SEQ ID NO: 153229 - DNA, 20 bp, Artificial Sequence
  chemically synthesized
atatatcttcacaatctcag

SEQ ID NO: 153230 - DNA, 20 bp, Artificial Sequence
  chemically synthesized
tatatatatcttcacaatct

SEQ ID NO: 153231 - DNA, 20 bp, Artificial Sequence
  chemically synthesized
ggcttactactgagattgtg

SEQ ID NO: 153232 - DNA, 20 bp, Artificial Sequence
  chemically synthesized
agatatatatatatatctgt

SEQ ID NO: 153233 - DNA, 20 bp, Artificial Sequence
  chemically synthesized
ccctgctgagacacagctga

SEQ ID NO: 153234 - DNA, 20 bp, Artificial Sequence
  chemically synthesized
tatatctgtcagctgtgtct

SEQ ID NO: 153235 - DNA, 20 bp, Artificial Sequence
  chemically synthesized
ctttgttccctgctgagaca

SEQ ID NO: 153236 - DNA, 20 bp, Artificial Sequence
  chemically synthesized
atctgtcagctgtgtctcag

SEQ ID NO: 153237 - DNA, 20 bp, Artificial Sequence
  chemically synthesized
tctgtcagctgtgtctcagc

SEQ ID NO: 153238 - DNA, 20 bp, Artificial Sequence
  chemically synthesized
ctgtcagctgtgtctcagca

SEQ ID NO: 153239 - DNA, 20 bp, Artificial Sequence
  chemically synthesized
tctcaactttgttccctgct

SEQ ID NO: 153240 - DNA, 20 bp, Artificial Sequence
  chemically synthesized
ctgtgtctcagcagggaaca

SEQ ID NO: 153241 - DNA, 20 bp, Artificial Sequence
  chemically synthesized
tctcagcagggaacaaagtt

SEQ ID NO: 153242 - DNA, 20 bp, Artificial Sequence
  chemically synthesized
ggaacaaagttgagatatat

SEQ ID NO: 153243 - DNA, 20 bp, Artificial Sequence
  chemically synthesized
tgagatatataagaatgctg

SEQ ID NO: 153244 - DNA, 20 bp, Artificial Sequence
  chemically synthesized
agatatataagaatgctgaa

SEQ ID NO: 153245 - DNA, 20 bp, Artificial Sequence
  chemically synthesized
agtttaatttcagtgctctt

SEQ ID NO: 153246 - DNA, 20 bp, Artificial Sequence
  chemically synthesized
acatctcctgagtttaattt

SEQ ID NO: 153247 - DNA, 20 bp, Artificial Sequence
  chemically synthesized
aagagcactgaaattaaact

SEQ ID NO: 153248 - DNA, 20 bp, Artificial Sequence
  chemically synthesized
agagcactgaaattaaactc

SEQ ID NO: 153249 - DNA, 20 bp, Artificial Sequence
  chemically synthesized
agcactgaaattaaactcag

SEQ ID NO: 153250 - DNA, 20 bp, Artificial Sequence
  chemically synthesized
gacccaaccccacatctcct

SEQ ID NO: 153251 - DNA, 20 bp, Artificial Sequence
  chemically synthesized
gaaattaaactcaggagatg

SEQ ID NO: 153252 - DNA, 20 bp, Artificial Sequence
  chemically synthesized
aaattaaactcaggagatgt

SEQ ID NO: 153253 - DNA, 20 bp, Artificial Sequence
  chemically synthesized
aattaaactcaggagatgtg

SEQ ID NO: 153254 - DNA, 20 bp, Artificial Sequence
  chemically synthesized
aaactcaggagatgtggggt

SEQ ID NO: 153255 - DNA, 20 bp, Artificial Sequence
  chemically synthesized
aactcaggagatgtggggtt

SEQ ID NO: 153256 - DNA, 20 bp, Artificial Sequence
  chemically synthesized
aggagatgtggggttgggtc

SEQ ID NO: 153257 - DNA, 20 bp, Artificial Sequence
  chemically synthesized
agctgtttagtggcagaatc

SEQ ID NO: 153258 - DNA, 20 bp, Artificial Sequence
  chemically synthesized
cttgaccagctgtttagtgg

SEQ ID NO: 153259 - DNA, 20 bp, Artificial Sequence
  chemically synthesized
gtccagattctgccactaaa

SEQ ID NO: 153260 - DNA, 20 bp, Artificial Sequence
  chemically synthesized
gtgcttgaccagctgtttag

SEQ ID NO: 153261 - DNA, 20 bp, Artificial Sequence
  chemically synthesized
agattctgccactaaacagc

SEQ ID NO: 153262 - DNA, 20 bp, Artificial Sequence
  chemically synthesized
cgcgtgcttgaccagctgtt

SEQ ID NO: 153263 - DNA, 20 bp, Artificial Sequence
  chemically synthesized
ctgccactaaacagctggtc

SEQ ID NO: 153264 - DNA, 20 bp, Artificial Sequence
  chemically synthesized
taaatgatcgcgtgcttgac

SEQ ID NO: 153265 - DNA, 20 bp, Artificial Sequence
  chemically synthesized
acgcgatcatttaatcttct

SEQ ID NO: 153266 - DNA, 20 bp, Artificial Sequence
  chemically synthesized
gtaataataataataccaag

SEQ ID NO: 153267 - DNA, 20 bp, Artificial Sequence
  chemically synthesized
catgtaataataataatacc

SEQ ID NO: 153268 - DNA, 20 bp, Artificial Sequence
  chemically synthesized
ttggtattattattattaca

SEQ ID NO: 153269 - DNA, 20 bp, Artificial Sequence
  chemically synthesized
tggtattattattattacat

SEQ ID NO: 153270 - DNA, 20 bp, Artificial Sequence
  chemically synthesized
tattattattattacatggg

SEQ ID NO: 153271 - DNA, 20 bp, Artificial Sequence
  chemically synthesized
attattattattacatggga

SEQ ID NO: 153272 - DNA, 20 bp, Artificial Sequence
  chemically synthesized
gtgaacatatattttacaga

SEQ ID NO: 153273 - DNA, 20 bp, Artificial Sequence
  chemically synthesized
tcaagtgaacatatatttta

SEQ ID NO: 153274 - DNA, 20 bp, Artificial Sequence
  chemically synthesized
tgcactaatattttttggtc

SEQ ID NO: 153275 - DNA, 20 bp, Artificial Sequence
  chemically synthesized
ggtattgcactaatattttt

SEQ ID NO: 153276 - DNA, 20 bp, Artificial Sequence
  chemically synthesized
ttcacttgaccaaaaaatat

SEQ ID NO: 153277 - DNA, 20 bp, Artificial Sequence
  chemically synthesized
ttcaatgactagcatatggt

SEQ ID NO: 153278 - DNA, 20 bp, Artificial Sequence
  chemically synthesized
attcaatgactagcatatgg

SEQ ID NO: 153279 - DNA, 20 bp, Artificial Sequence
  chemically synthesized
gtgcaatacctaccatatgc

SEQ ID NO: 153280 - DNA, 20 bp, Artificial Sequence
  chemically synthesized
ttaattcaatgactagcata

SEQ ID NO: 153281 - DNA, 20 bp, Artificial Sequence
  chemically synthesized
tctagctttaattcaatgac

SEQ ID NO: 153282 - DNA, 20 bp, Artificial Sequence
  chemically synthesized
atatgctagtcattgaatta

SEQ ID NO: 153283 - DNA, 20 bp, Artificial Sequence
  chemically synthesized
gctagtcattgaattaaagc

SEQ ID NO: 153284 - DNA, 20 bp, Artificial Sequence
  chemically synthesized
tgccaaataccaggtgtgtc

SEQ ID NO: 153285 - DNA, 20 bp, Artificial Sequence
  chemically synthesized
gaattaaagctagacacacc

SEQ ID NO: 153286 - DNA, 20 bp, Artificial Sequence
  chemically synthesized
agctagacacacctggtatt

SEQ ID NO: 153287 - DNA, 20 bp, Artificial Sequence
  chemically synthesized
acgtttacatgccaaatacc

SEQ ID NO: 153288 - DNA, 20 bp, Artificial Sequence
  chemically synthesized
tacgtttacatgccaaatac

SEQ ID NO: 153289 - DNA, 20 bp, Artificial Sequence
  chemically synthesized
tggtatttggcatgtaaacg

SEQ ID NO: 153290 - DNA, 20 bp, Artificial Sequence
  chemically synthesized
ggtatttggcatgtaaacgt

SEQ ID NO: 153291 - DNA, 20 bp, Artificial Sequence
  chemically synthesized
ttggcatgtaaacgtaggaa

SEQ ID NO: 153292 - DNA, 20 bp, Artificial Sequence
  chemically synthesized
tggcatgtaaacgtaggaaa

SEQ ID NO: 153293 - DNA, 20 bp, Artificial Sequence
  chemically synthesized
ggcatgtaaacgtaggaaaa

SEQ ID NO: 153294 - DNA, 20 bp, Artificial Sequence
  chemically synthesized
acgtaggaaaagggtatata

SEQ ID NO: 153295 - DNA, 20 bp, Artificial Sequence
  chemically synthesized
catgactctgtcacatcata

SEQ ID NO: 153296 - DNA, 20 bp, Artificial Sequence
  chemically synthesized
atatagactttatgatgtga

SEQ ID NO: 153297 - DNA, 20 bp, Artificial Sequence
  chemically synthesized
atagactttatgatgtgaca

SEQ ID NO: 153298 - DNA, 20 bp, Artificial Sequence
  chemically synthesized
tttatgatgtgacagagtca

SEQ ID NO: 153299 - DNA, 20 bp, Artificial Sequence
  chemically synthesized
ttatgatgtgacagagtcat

SEQ ID NO: 153300 - DNA, 20 bp, Artificial Sequence
  chemically synthesized
tgatgtgacagagtcatggg

SEQ ID NO: 153301 - DNA, 20 bp, Artificial Sequence
  chemically synthesized
tgacagagtcatgggaagac

SEQ ID NO: 153302 - DNA, 20 bp, Artificial Sequence
  chemically synthesized
catgggaagaccagtaatta

SEQ ID NO: 153303 - DNA, 20 bp, Artificial Sequence
  chemically synthesized
ggatgctgttccataattac

SEQ ID NO: 153304 - DNA, 20 bp, Artificial Sequence
  chemically synthesized
gaagaccagtaattatggaa

SEQ ID NO: 153305 - DNA, 20 bp, Artificial Sequence
  chemically synthesized
tggaacagcatccaattctg

SEQ ID NO: 153306 - DNA, 20 bp, Artificial Sequence
  chemically synthesized
tctgttgtgggcttcagaat

SEQ ID NO: 153307 - DNA, 20 bp, Artificial Sequence
  chemically synthesized
tatttttctgttgtgggctt

SEQ ID NO: 153308 - DNA, 20 bp, Artificial Sequence
  chemically synthesized
tccaattctgaagcccacaa

SEQ ID NO: 153309 - DNA, 20 bp, Artificial Sequence
  chemically synthesized
ccatactatttttctgttgt

SEQ ID NO: 153310 - DNA, 20 bp, Artificial Sequence
  chemically synthesized
tccatactatttttctgttg

SEQ ID NO: 153311 - DNA, 20 bp, Artificial Sequence
  chemically synthesized
tgaagcccacaacagaaaaa

SEQ ID NO: 153312 - DNA, 20 bp, Artificial Sequence
  chemically synthesized
cccacaacagaaaaatagta

SEQ ID NO: 153313 - DNA, 20 bp, Artificial Sequence
  chemically synthesized
aaaatagtatggaaaacact

SEQ ID NO: 153314 - DNA, 20 bp, Artificial Sequence
  chemically synthesized
atagtatggaaaacacttgg

SEQ ID NO: 153315 - DNA, 20 bp, Artificial Sequence
  chemically synthesized
tagtatggaaaacacttgga

SEQ ID NO: 153316 - DNA, 20 bp, Artificial Sequence
  chemically synthesized
agtatggaaaacacttggaa

SEQ ID NO: 153317 - DNA, 20 bp, Artificial Sequence
  chemically synthesized
atggaaaacacttggaaggg

SEQ ID NO: 153318 - DNA, 20 bp, Artificial Sequence
  chemically synthesized
ggccctcctcctacccttcc

SEQ ID NO: 153319 - DNA, 20 bp, Artificial Sequence
  chemically synthesized
tggaaaacacttggaagggt

SEQ ID NO: 153320 - DNA, 20 bp, Artificial Sequence
  chemically synthesized
gaaaacacttggaagggtag

SEQ ID NO: 153321 - DNA, 20 bp, Artificial Sequence
  chemically synthesized
aaaacacttggaagggtagg

SEQ ID NO: 153322 - DNA, 20 bp, Artificial Sequence
  chemically synthesized
aacacttggaagggtaggag

SEQ ID NO: 153323 - DNA, 20 bp, Artificial Sequence
  chemically synthesized
acacttggaagggtaggagg

SEQ ID NO: 153324 - DNA, 20 bp, Artificial Sequence
  chemically synthesized
cacttggaagggtaggagga

SEQ ID NO: 153325 - DNA, 20 bp, Artificial Sequence
  chemically synthesized
gaagggtaggaggagggcca

SEQ ID NO: 153326 - DNA, 20 bp, Artificial Sequence
  chemically synthesized
agggtaggaggagggccaca

SEQ ID NO: 153327 - DNA, 20 bp, Artificial Sequence
  chemically synthesized
tcaaatttttaacgtctctg

SEQ ID NO: 153328 - DNA, 20 bp, Artificial Sequence
  chemically synthesized
cacagagacgttaaaaattt

SEQ ID NO: 153329 - DNA, 20 bp, Artificial Sequence
  chemically synthesized
gacgttaaaaatttgagaaa

SEQ ID NO: 153330 - DNA, 20 bp, Artificial Sequence
  chemically synthesized
cccatggtctggcaacaaaa

SEQ ID NO: 153331 - DNA, 20 bp, Artificial Sequence
  chemically synthesized
agaaacagctgttttgttgc

SEQ ID NO: 153332 - DNA, 20 bp, Artificial Sequence
  chemically synthesized
gctgttttgttgccagacca

SEQ ID NO: 153333 - DNA, 20 bp, Artificial Sequence
  chemically synthesized
ctgttttgttgccagaccat

SEQ ID NO: 153334 - DNA, 20 bp, Artificial Sequence
  chemically synthesized
tgttttgttgccagaccatg

SEQ ID NO: 153335 - DNA, 20 bp, Artificial Sequence
  chemically synthesized
tcagatgagtccccatggtc

SEQ ID NO: 153336 - DNA, 20 bp, Artificial Sequence
  chemically synthesized
ttaaatcagatgagtcccca

SEQ ID NO: 153337 - DNA, 20 bp, Artificial Sequence
  chemically synthesized
ttttctatcttaaatcagat

SEQ ID NO: 153338 - DNA, 20 bp, Artificial Sequence
  chemically synthesized
catggggactcatctgattt

SEQ ID NO: 153339 - DNA, 20 bp, Artificial Sequence
  chemically synthesized
ttttcttttctatcttaaat

SEQ ID NO: 153340 - DNA, 20 bp, Artificial Sequence
  chemically synthesized
gggactcatctgatttaaga

SEQ ID NO: 153341 - DNA, 20 bp, Artificial Sequence
  chemically synthesized
tcatctgatttaagatagaa

SEQ ID NO: 153342 - DNA, 20 bp, Artificial Sequence
  chemically synthesized
tgatttaagatagaaaagaa

SEQ ID NO: 153343 - DNA, 20 bp, Artificial Sequence
  chemically synthesized
tttaagatagaaaagaaaag

SEQ ID NO: 153344 - DNA, 20 bp, Artificial Sequence
  chemically synthesized
ttaagatagaaaagaaaagt

SEQ ID NO: 153345 - DNA, 20 bp, Artificial Sequence
  chemically synthesized
agatagaaaagaaaagtggg

SEQ ID NO: 153346 - DNA, 20 bp, Artificial Sequence
  chemically synthesized
gatagaaaagaaaagtggga

SEQ ID NO: 153347 - DNA, 20 bp, Artificial Sequence
  chemically synthesized
tagaaaagaaaagtgggaag

SEQ ID NO: 153348 - DNA, 20 bp, Artificial Sequence
  chemically synthesized
gtgggaaggagattaaataa

SEQ ID NO: 153349 - DNA, 20 bp, Artificial Sequence
  chemically synthesized
agattaaataacagacctca

SEQ ID NO: 153350 - DNA, 20 bp, Artificial Sequence
  chemically synthesized
tcgacagtgttcattctttg

SEQ ID NO: 153351 - DNA, 20 bp, Artificial Sequence
  chemically synthesized
ttcgacagtgttcattcttt

SEQ ID NO: 153352 - DNA, 20 bp, Artificial Sequence
  chemically synthesized
atgcttactgtacatttcga

SEQ ID NO: 153353 - DNA, 20 bp, Artificial Sequence
  chemically synthesized
atgaacactgtcgaaatgta

SEQ ID NO: 153354 - DNA, 20 bp, Artificial Sequence
  chemically synthesized
acactgtcgaaatgtacagt

SEQ ID NO: 153355 - DNA, 20 bp, Artificial Sequence
  chemically synthesized
taaattatttttattcgaat

SEQ ID NO: 153356 - DNA, 20 bp, Artificial Sequence
  chemically synthesized
ctaaattatttttattcgaa

SEQ ID NO: 153357 - DNA, 20 bp, Artificial Sequence
  chemically synthesized
ctattcgaataaaaataatt

SEQ ID NO: 153358 - DNA, 20 bp, Artificial Sequence
  chemically synthesized
tcgaataaaaataatttaga

SEQ ID NO: 153359 - DNA, 20 bp, Artificial Sequence
  chemically synthesized
aaaataatttagacagtaac

SEQ ID NO: 153360 - DNA, 20 bp, Artificial Sequence
  chemically synthesized
tttagacagtaactggaact

SEQ ID NO: 153361 - DNA, 20 bp, Artificial Sequence
  chemically synthesized
ttagacagtaactggaactt

SEQ ID NO: 153362 - DNA, 20 bp, Artificial Sequence
  chemically synthesized
caactacctaacctaagttc

SEQ ID NO: 153363 - DNA, 20 bp, Artificial Sequence
  chemically synthesized
acagtaactggaacttaggt

SEQ ID NO: 153364 - DNA, 20 bp, Artificial Sequence
  chemically synthesized
cagtaactggaacttaggtt

SEQ ID NO: 153365 - DNA, 20 bp, Artificial Sequence
  chemically synthesized
gtttttcaactacctaacct

SEQ ID NO: 153366 - DNA, 20 bp, Artificial Sequence
  chemically synthesized
taactggaacttaggttagg

SEQ ID NO: 153367 - DNA, 20 bp, Artificial Sequence
  chemically synthesized
taggtagttgaaaaactgtc

SEQ ID NO: 153368 - DNA, 20 bp, Artificial Sequence
  chemically synthesized
agttgaaaaactgtcaagta

SEQ ID NO: 153369 - DNA, 20 bp, Artificial Sequence
  chemically synthesized
taccaatctgctatacttga

SEQ ID NO: 153370 - DNA, 20 bp, Artificial Sequence
  chemically synthesized
tgaaaaactgtcaagtatag

SEQ ID NO: 153371 - DNA, 20 bp, Artificial Sequence
  chemically synthesized
aactgtcaagtatagcagat

SEQ ID NO: 153372 - DNA, 20 bp, Artificial Sequence
  chemically synthesized
tgtcaagtatagcagattgg

SEQ ID NO: 153373 - DNA, 20 bp, Artificial Sequence
  chemically synthesized
taaaaagtgaagagcagatg

SEQ ID NO: 153374 - DNA, 20 bp, Artificial Sequence
  chemically synthesized
cttaaaaagtgaagagcaga

SEQ ID NO: 153375 - DNA, 20 bp, Artificial Sequence
  chemically synthesized
tcttcttaaaaagtgaagag

SEQ ID NO: 153376 - DNA, 20 bp, Artificial Sequence
  chemically synthesized
ctctcttcttaaaaagtgaa

SEQ ID NO: 153377 - DNA, 20 bp, Artificial Sequence
  chemically synthesized
aactctcttcttaaaaagtg

SEQ ID NO: 153378 - DNA, 20 bp, Artificial Sequence
  chemically synthesized
ccatctgctcttcacttttt

SEQ ID NO: 153379 - DNA, 20 bp, Artificial Sequence
  chemically synthesized
tctgctcttcactttttaag

SEQ ID NO: 153380 - DNA, 20 bp, Artificial Sequence
  chemically synthesized
ctgccaactctcttcttaaa

SEQ ID NO: 153381 - DNA, 20 bp, Artificial Sequence
  chemically synthesized
tgctcttcactttttaagaa

SEQ ID NO: 153382 - DNA, 20 bp, Artificial Sequence
  chemically synthesized
ctcttcactttttaagaaga

SEQ ID NO: 153383 - DNA, 20 bp, Artificial Sequence
  chemically synthesized
tcactttttaagaagagagt

SEQ ID NO: 153384 - DNA, 20 bp, Artificial Sequence
  chemically synthesized
ctttttaagaagagagttgg

SEQ ID NO: 153385 - DNA, 20 bp, Artificial Sequence
  chemically synthesized
gagttggcagttacgcttct

SEQ ID NO: 153386 - DNA, 20 bp, Artificial Sequence
  chemically synthesized
tctattagaagcaatcttag

SEQ ID NO: 153387 - DNA, 20 bp, Artificial Sequence
  chemically synthesized
cattctattagaagcaatct

SEQ ID NO: 153388 - DNA, 20 bp, Artificial Sequence
  chemically synthesized
gcttctaagattgcttctaa

SEQ ID NO: 153389 - DNA, 20 bp, Artificial Sequence
  chemically synthesized
aaaggctctcattctattag

SEQ ID NO: 153390 - DNA, 20 bp, Artificial Sequence
  chemically synthesized
aagattgcttctaatagaat

SEQ ID NO: 153391 - DNA, 20 bp, Artificial Sequence
  chemically synthesized
aggaaaggctctcattctat

SEQ ID NO: 153392 - DNA, 20 bp, Artificial Sequence
  chemically synthesized
gattgcttctaatagaatga

SEQ ID NO: 153393 - DNA, 20 bp, Artificial Sequence
  chemically synthesized
atagaatgagagcctttcct

SEQ ID NO: 153394 - DNA, 20 bp, Artificial Sequence
  chemically synthesized
cttttccactatctcaggaa

SEQ ID NO: 153395 - DNA, 20 bp, Artificial Sequence
  chemically synthesized
tcttttccactatctcagga

SEQ ID NO: 153396 - DNA, 20 bp, Artificial Sequence
  chemically synthesized
aatgagagcctttcctgaga

SEQ ID NO: 153397 - DNA, 20 bp, Artificial Sequence
  chemically synthesized
gagagcctttcctgagatag

SEQ ID NO: 153398 - DNA, 20 bp, Artificial Sequence
  chemically synthesized
tctttcttttccactatctc

SEQ ID NO: 153399 - DNA, 20 bp, Artificial Sequence
  chemically synthesized
ttctttcttttccactatct

SEQ ID NO: 153400 - DNA, 20 bp, Artificial Sequence
  chemically synthesized
cctttcctgagatagtggaa

SEQ ID NO: 153401 - DNA, 20 bp, Artificial Sequence
  chemically synthesized
tcctgagatagtggaaaaga

SEQ ID NO: 153402 - DNA, 20 bp, Artificial Sequence
  chemically synthesized
tggtctgaaaagtatttgaa

SEQ ID NO: 153403 - DNA, 20 bp, Artificial Sequence
  chemically synthesized
atgactgttcaaatactttt

SEQ ID NO: 153404 - DNA, 20 bp, Artificial Sequence
  chemically synthesized
ttttaagattgtggtctgaa

SEQ ID NO: 153405 - DNA, 20 bp, Artificial Sequence
  chemically synthesized
aattgtcgattttaagattg

SEQ ID NO: 153406 - DNA, 20 bp, Artificial Sequence
  chemically synthesized
gtacttcaattgtcgatttt

SEQ ID NO: 153407 - DNA, 20 bp, Artificial Sequence
  chemically synthesized
aatcttaaaatcgacaattg

SEQ ID NO: 153408 - DNA, 20 bp, Artificial Sequence
  chemically synthesized
atttcgaaaggaaattgtag

SEQ ID NO: 153409 - DNA, 20 bp, Artificial Sequence
  chemically synthesized
aagatttcgaaaggaaattg

SEQ ID NO: 153410 - DNA, 20 bp, Artificial Sequence
  chemically synthesized
gagagaaacaagatttcgaa

SEQ ID NO: 153411 - DNA, 20 bp, Artificial Sequence
  chemically synthesized
agagagaaacaagatttcga

SEQ ID NO: 153412 - DNA, 20 bp, Artificial Sequence
  chemically synthesized
ctttaccttcagagagaaac

SEQ ID NO: 153413 - DNA, 20 bp, Artificial Sequence
  chemically synthesized
cgaaatcttgtttctctctg

SEQ ID NO: 153414 - DNA, 20 bp, Artificial Sequence
  chemically synthesized
gaaatcttgtttctctctga

SEQ ID NO: 153415 - DNA, 20 bp, Artificial Sequence
  chemically synthesized
aatataactttaccttcaga

SEQ ID NO: 153416 - DNA, 20 bp, Artificial Sequence
  chemically synthesized
tgaatataactttaccttca

SEQ ID NO: 153417 - DNA, 20 bp, Artificial Sequence
  chemically synthesized
cttgtttctctctgaaggta

SEQ ID NO: 153418 - DNA, 20 bp, Artificial Sequence
  chemically synthesized
attgaatataactttacctt

SEQ ID NO: 153419 - DNA, 20 bp, Artificial Sequence
  chemically synthesized
tattcaattttaaaactatt

SEQ ID NO: 153420 - DNA, 20 bp, Artificial Sequence
  chemically synthesized
aattttaaaactattcagtg

SEQ ID NO: 153421 - DNA, 20 bp, Artificial Sequence
  chemically synthesized
tttcctaaaacttcactgaa

SEQ ID NO: 153422 - DNA, 20 bp, Artificial Sequence
  chemically synthesized
aaaactattcagtgaagttt

SEQ ID NO: 153423 - DNA, 20 bp, Artificial Sequence
  chemically synthesized
aaactattcagtgaagtttt

SEQ ID NO: 153424 - DNA, 20 bp, Artificial Sequence
  chemically synthesized
agtgaagttttaggaaatat

SEQ ID NO: 153425 - DNA, 20 bp, Artificial Sequence
  chemically synthesized
gtgaagttttaggaaatatt

SEQ ID NO: 153426 - DNA, 20 bp, Artificial Sequence
  chemically synthesized
aatattaggaatacatgttg

SEQ ID NO: 153427 - DNA, 20 bp, Artificial Sequence
  chemically synthesized
accctaccgctcaaaatgga

SEQ ID NO: 153428 - DNA, 20 bp, Artificial Sequence
  chemically synthesized
atgttgaagccttccatttt

SEQ ID NO: 153429 - DNA, 20 bp, Artificial Sequence
  chemically synthesized
taccctaccgctcaaaatgg

SEQ ID NO: 153430 - DNA, 20 bp, Artificial Sequence
  chemically synthesized
ttgaagccttccattttgag

SEQ ID NO: 153431 - DNA, 20 bp, Artificial Sequence
  chemically synthesized
aagtaccctaccgctcaaaa

SEQ ID NO: 153432 - DNA, 20 bp, Artificial Sequence
  chemically synthesized
aagccttccattttgagcgg

SEQ ID NO: 153433 - DNA, 20 bp, Artificial Sequence
  chemically synthesized
agccttccattttgagcggt

SEQ ID NO: 153434 - DNA, 20 bp, Artificial Sequence
  chemically synthesized
gccttccattttgagcggta

SEQ ID NO: 153435 - DNA, 20 bp, Artificial Sequence
  chemically synthesized
ttaggcatatttatgagagt

SEQ ID NO: 153436 - DNA, 20 bp, Artificial Sequence
  chemically synthesized
ctatttaggcatatttatga

SEQ ID NO: 153437 - DNA, 20 bp, Artificial Sequence
  chemically synthesized
aactatttaggcatatttat

SEQ ID NO: 153438 - DNA, 20 bp, Artificial Sequence
  chemically synthesized
ctctcataaatatgcctaaa

SEQ ID NO: 153439 - DNA, 20 bp, Artificial Sequence
  chemically synthesized
ccaagaaaccagaactattt

SEQ ID NO: 153440 - DNA, 20 bp, Artificial Sequence
  chemically synthesized
accaagaaaccagaactatt

SEQ ID NO: 153441 - DNA, 20 bp, Artificial Sequence
  chemically synthesized
taaatatgcctaaatagttc

SEQ ID NO: 153442 - DNA, 20 bp, Artificial Sequence
  chemically synthesized
cctaaatagttctggtttct

SEQ ID NO: 153443 - DNA, 20 bp, Artificial Sequence
  chemically synthesized
tcatactctgaccaagaaac

SEQ ID NO: 153444 - DNA, 20 bp, Artificial Sequence
  chemically synthesized
aatagttctggtttcttggt

SEQ ID NO: 153445 - DNA, 20 bp, Artificial Sequence
  chemically synthesized
tagttctggtttcttggtca

SEQ ID NO: 153446 - DNA, 20 bp, Artificial Sequence
  chemically synthesized
ttgactgtcatactctgacc

SEQ ID NO: 153447 - DNA, 20 bp, Artificial Sequence
  chemically synthesized
gtttcttggtcagagtatga

SEQ ID NO: 153448 - DNA, 20 bp, Artificial Sequence
  chemically synthesized
ttggtcagagtatgacagtc

SEQ ID NO: 153449 - DNA, 20 bp, Artificial Sequence
  chemically synthesized
gagtatgacagtcaagatta

SEQ ID NO: 153450 - DNA, 20 bp, Artificial Sequence
  chemically synthesized
caagattatggtatactctg

SEQ ID NO: 153451 - DNA, 20 bp, Artificial Sequence
  chemically synthesized
ttttgcttgaaatcactaca

SEQ ID NO: 153452 - DNA, 20 bp, Artificial Sequence
  chemically synthesized
acttttgcttgaaatcacta

SEQ ID NO: 153453 - DNA, 20 bp, Artificial Sequence
  chemically synthesized
gtatactctgtagtgatttc

SEQ ID NO: 153454 - DNA, 20 bp, Artificial Sequence
  chemically synthesized
tctgtagtgatttcaagcaa

SEQ ID NO: 153455 - DNA, 20 bp, Artificial Sequence
  chemically synthesized
caagcaaaagtcctttcttg

SEQ ID NO: 153456 - DNA, 20 bp, Artificial Sequence
  chemically synthesized
tatttaacactcttcaagaa

SEQ ID NO: 153457 - DNA, 20 bp, Artificial Sequence
  chemically synthesized
agcaaaagtcctttcttgaa

SEQ ID NO: 153458 - DNA, 20 bp, Artificial Sequence
  chemically synthesized
ctatttaacactcttcaaga

SEQ ID NO: 153459 - DNA, 20 bp, Artificial Sequence
  chemically synthesized
tatgctatttaacactcttc

SEQ ID NO: 153460 - DNA, 20 bp, Artificial Sequence
  chemically synthesized
ctttcttgaagagtgttaaa

SEQ ID NO: 153461 - DNA, 20 bp, Artificial Sequence
  chemically synthesized
tgaagagtgttaaatagcat

SEQ ID NO: 153462 - DNA, 20 bp, Artificial Sequence
  chemically synthesized
agagtgttaaatagcataag

SEQ ID NO: 153463 - DNA, 20 bp, Artificial Sequence
  chemically synthesized
gagtgttaaatagcataaga

SEQ ID NO: 153464 - DNA, 20 bp, Artificial Sequence
  chemically synthesized
taaatagcataagaaggtta

SEQ ID NO: 153465 - DNA, 20 bp, Artificial Sequence
  chemically synthesized
tagcataagaaggttaaagt

SEQ ID NO: 153466 - DNA, 20 bp, Artificial Sequence
  chemically synthesized
cagaaataaaatgttaatta

SEQ ID NO: 153467 - DNA, 20 bp, Artificial Sequence
  chemically synthesized
acctatgtcctgcattttaa

SEQ ID NO: 153468 - DNA, 20 bp, Artificial Sequence
  chemically synthesized
attttatttctgttaaaatg

SEQ ID NO: 153469 - DNA, 20 bp, Artificial Sequence
  chemically synthesized
ttttatttctgttaaaatgc

SEQ ID NO: 153470 - DNA, 20 bp, Artificial Sequence
  chemically synthesized
ttctgttaaaatgcaggaca

SEQ ID NO: 153471 - DNA, 20 bp, Artificial Sequence
  chemically synthesized
tctgttaaaatgcaggacat

SEQ ID NO: 153472 - DNA, 20 bp, Artificial Sequence
  chemically synthesized
atcaaaaaatctctaatcat

SEQ ID NO: 153473 - DNA, 20 bp, Artificial Sequence
  chemically synthesized
aacatcaattctgatgatta

SEQ ID NO: 153474 - DNA, 20 bp, Artificial Sequence
  chemically synthesized
ctaacatcaattctgatgat

SEQ ID NO: 153475 - DNA, 20 bp, Artificial Sequence
  chemically synthesized
ctaatcatcagaattgatgt

SEQ ID NO: 153476 - DNA, 20 bp, Artificial Sequence
  chemically synthesized
tcatttctaggaaaaagaga

SEQ ID NO: 153477 - DNA, 20 bp, Artificial Sequence
  chemically synthesized
atcatttctaggaaaaagag

SEQ ID NO: 153478 - DNA, 20 bp, Artificial Sequence
  chemically synthesized
tgttagccttctctttttcc

SEQ ID NO: 153479 - DNA, 20 bp, Artificial Sequence
  chemically synthesized
ttcatcatttctaggaaaaa

SEQ ID NO: 153480 - DNA, 20 bp, Artificial Sequence
  chemically synthesized
agttcatcatttctaggaaa

SEQ ID NO: 153481 - DNA, 20 bp, Artificial Sequence
  chemically synthesized
aactctagttcatcatttct

SEQ ID NO: 153482 - DNA, 20 bp, Artificial Sequence
  chemically synthesized
aaactctagttcatcatttc

SEQ ID NO: 153483 - DNA, 20 bp, Artificial Sequence
  chemically synthesized
ttttcctagaaatgatgaac

SEQ ID NO: 153484 - DNA, 20 bp, Artificial Sequence
  chemically synthesized
ttcctagaaatgatgaacta

SEQ ID NO: 153485 - DNA, 20 bp, Artificial Sequence
  chemically synthesized
tgatgaaggaagagaaactc

SEQ ID NO: 153486 - DNA, 20 bp, Artificial Sequence
  chemically synthesized
ggtctgaactgatgaaggaa

SEQ ID NO: 153487 - DNA, 20 bp, Artificial Sequence
  chemically synthesized
tagagtttctcttccttcat

SEQ ID NO: 153488 - DNA, 20 bp, Artificial Sequence
  chemically synthesized
ggggtctgaactgatgaagg

SEQ ID NO: 153489 - DNA, 20 bp, Artificial Sequence
  chemically synthesized
tttggggtctgaactgatga

SEQ ID NO: 153490 - DNA, 20 bp, Artificial Sequence
  chemically synthesized
ctttggggtctgaactgatg

SEQ ID NO: 153491 - DNA, 20 bp, Artificial Sequence
  chemically synthesized
tttctcttccttcatcagtt

SEQ ID NO: 153492 - DNA, 20 bp, Artificial Sequence
  chemically synthesized
cttcatcagttcagacccca

SEQ ID NO: 153493 - DNA, 20 bp, Artificial Sequence
  chemically synthesized
ccagttagggttgtgctttg

SEQ ID NO: 153494 - DNA, 20 bp, Artificial Sequence
  chemically synthesized
tccagttagggttgtgcttt

SEQ ID NO: 153495 - DNA, 20 bp, Artificial Sequence
  chemically synthesized
ttccagttagggttgtgctt

SEQ ID NO: 153496 - DNA, 20 bp, Artificial Sequence
  chemically synthesized
ccccaaagcacaaccctaac

SEQ ID NO: 153497 - DNA, 20 bp, Artificial Sequence
  chemically synthesized
atggttaccatttccagtta

SEQ ID NO: 153498 - DNA, 20 bp, Artificial Sequence
  chemically synthesized
catggttaccatttccagtt

SEQ ID NO: 153499 - DNA, 20 bp, Artificial Sequence
  chemically synthesized
gcatggttaccatttccagt

SEQ ID NO: 153500 - DNA, 20 bp, Artificial Sequence
  chemically synthesized
agcacaaccctaactggaaa

SEQ ID NO: 153501 - DNA, 20 bp, Artificial Sequence
  chemically synthesized
tattgcatggttaccatttc

SEQ ID NO: 153502 - DNA, 20 bp, Artificial Sequence
  chemically synthesized
cttttggtagttttattgca

SEQ ID NO: 153503 - DNA, 20 bp, Artificial Sequence
  chemically synthesized
ccatgcaataaaactaccaa

SEQ ID NO: 153504 - DNA, 20 bp, Artificial Sequence
  chemically synthesized
catgcaataaaactaccaaa

SEQ ID NO: 153505 - DNA, 20 bp, Artificial Sequence
  chemically synthesized
tccctctcttaaccttttgg

SEQ ID NO: 153506 - DNA, 20 bp, Artificial Sequence
  chemically synthesized
aataaaactaccaaaaggtt

SEQ ID NO: 153507 - DNA, 20 bp, Artificial Sequence
  chemically synthesized
ttctccctctcttaaccttt

SEQ ID NO: 153508 - DNA, 20 bp, Artificial Sequence
  chemically synthesized
taaaactaccaaaaggttaa

SEQ ID NO: 153509 - DNA, 20 bp, Artificial Sequence
  chemically synthesized
aaactaccaaaaggttaaga

SEQ ID NO: 153510 - DNA, 20 bp, Artificial Sequence
  chemically synthesized
aactaccaaaaggttaagag

SEQ ID NO: 153511 - DNA, 20 bp, Artificial Sequence
  chemically synthesized
actaccaaaaggttaagaga

SEQ ID NO: 153512 - DNA, 20 bp, Artificial Sequence
  chemically synthesized
taccaaaaggttaagagagg

SEQ ID NO: 153513 - DNA, 20 bp, Artificial Sequence
  chemically synthesized
caaaaggttaagagagggag

SEQ ID NO: 153514 - DNA, 20 bp, Artificial Sequence
  chemically synthesized
aggttaagagagggagaaga

SEQ ID NO: 153515 - DNA, 20 bp, Artificial Sequence
  chemically synthesized
ggttaagagagggagaagaa

SEQ ID NO: 153516 - DNA, 20 bp, Artificial Sequence
  chemically synthesized
gttaagagagggagaagaaa

SEQ ID NO: 153517 - DNA, 20 bp, Artificial Sequence
  chemically synthesized
taattatccattttgtgatg

SEQ ID NO: 153518 - DNA, 20 bp, Artificial Sequence
  chemically synthesized
aagggaacttcatcacaaaa

SEQ ID NO: 153519 - DNA, 20 bp, Artificial Sequence
  chemically synthesized
agtatttagtattcagcatt

SEQ ID NO: 153520 - DNA, 20 bp, Artificial Sequence
  chemically synthesized
actgtttagtatttagtatt

SEQ ID NO: 153521 - DNA, 20 bp, Artificial Sequence
  chemically synthesized
aacttctactgtttagtatt

SEQ ID NO: 153522 - DNA, 20 bp, Artificial Sequence
  chemically synthesized
gctgaatactaaatactaaa

SEQ ID NO: 153523 - DNA, 20 bp, Artificial Sequence
  chemically synthesized
gaatactaaatactaaacag

SEQ ID NO: 153524 - DNA, 20 bp, Artificial Sequence
  chemically synthesized
aatgtgaaacttctactgtt

SEQ ID NO: 153525 - DNA, 20 bp, Artificial Sequence
  chemically synthesized
tactaaatactaaacagtag

SEQ ID NO: 153526 - DNA, 20 bp, Artificial Sequence
  chemically synthesized
gttaacatccaagacagtga

SEQ ID NO: 153527 - DNA, 20 bp, Artificial Sequence
  chemically synthesized
ttcacattctatcactgtct

SEQ ID NO: 153528 - DNA, 20 bp, Artificial Sequence
  chemically synthesized
atcattgttaacatccaaga

SEQ ID NO: 153529 - DNA, 20 bp, Artificial Sequence
  chemically synthesized
tggcatcattgttaacatcc

SEQ ID NO: 153530 - DNA, 20 bp, Artificial Sequence
  chemically synthesized
tgttaacaatgatgccactg

SEQ ID NO: 153531 - DNA, 20 bp, Artificial Sequence
  chemically synthesized
taacaggaaaggcactacag

SEQ ID NO: 153532 - DNA, 20 bp, Artificial Sequence
  chemically synthesized
ggttaacaggaaaggcacta

SEQ ID NO: 153533 - DNA, 20 bp, Artificial Sequence
  chemically synthesized
tgctcactggttaacaggaa

SEQ ID NO: 153534 - DNA, 20 bp, Artificial Sequence
  chemically synthesized
atgctcactggttaacagga

SEQ ID NO: 153535 - DNA, 20 bp, Artificial Sequence
  chemically synthesized
gtagtgcctttcctgttaac

SEQ ID NO: 153536 - DNA, 20 bp, Artificial Sequence
  chemically synthesized
aacaatgctcactggttaac

SEQ ID NO: 153537 - DNA, 20 bp, Artificial Sequence
  chemically synthesized
caacaatgctcactggttaa

SEQ ID NO: 153538 - DNA, 20 bp, Artificial Sequence
  chemically synthesized
tgcctttcctgttaaccagt

SEQ ID NO: 153539 - DNA, 20 bp, Artificial Sequence
  chemically synthesized
ggtccttcaacaatgctcac

SEQ ID NO: 153540 - DNA, 20 bp, Artificial Sequence
  chemically synthesized
ttaaccagtgagcattgttg

SEQ ID NO: 153541 - DNA, 20 bp, Artificial Sequence
  chemically synthesized
taaccagtgagcattgttga

SEQ ID NO: 153542 - DNA, 20 bp, Artificial Sequence
  chemically synthesized
gtgagcattgttgaaggacc

SEQ ID NO: 153543 - DNA, 20 bp, Artificial Sequence
  chemically synthesized
cattgttgaaggacctggcc

SEQ ID NO: 153544 - DNA, 20 bp, Artificial Sequence
  chemically synthesized
attgttgaaggacctggcct

SEQ ID NO: 153545 - DNA, 20 bp, Artificial Sequence
  chemically synthesized
ggggtccctggtcccaggcc

SEQ ID NO: 153546 - DNA, 20 bp, Artificial Sequence
  chemically synthesized
gggggtccctggtcccaggc

SEQ ID NO: 153547 - DNA, 20 bp, Artificial Sequence
  chemically synthesized
tgaaggacctggcctgggac

SEQ ID NO: 153548 - DNA, 20 bp, Artificial Sequence
  chemically synthesized
gaaggacctggcctgggacc

SEQ ID NO: 153549 - DNA, 20 bp, Artificial Sequence
  chemically synthesized
aaggacctggcctgggacca

SEQ ID NO: 153550 - DNA, 20 bp, Artificial Sequence
  chemically synthesized
agtagggggtccctggtccc

SEQ ID NO: 153551 - DNA, 20 bp, Artificial Sequence
  chemically synthesized
cagtagggggtccctggtcc

SEQ ID NO: 153552 - DNA, 20 bp, Artificial Sequence
  chemically synthesized
tgaaggcagtagggggtccc

SEQ ID NO: 153553 - DNA, 20 bp, Artificial Sequence
  chemically synthesized
ctttccatgaaggcagtagg

SEQ ID NO: 153554 - DNA, 20 bp, Artificial Sequence
  chemically synthesized
tctttccatgaaggcagtag

SEQ ID NO: 153555 - DNA, 20 bp, Artificial Sequence
  chemically synthesized
gtctttccatgaaggcagta

SEQ ID NO: 153556 - DNA, 20 bp, Artificial Sequence
  chemically synthesized
agtctttccatgaaggcagt

SEQ ID NO: 153557 - DNA, 20 bp, Artificial Sequence
  chemically synthesized
aagtctttccatgaaggcag

SEQ ID NO: 153558 - DNA, 20 bp, Artificial Sequence
  chemically synthesized
gggaccccctactgccttca

SEQ ID NO: 153559 - DNA, 20 bp, Artificial Sequence
  chemically synthesized
aggaagtctttccatgaagg

SEQ ID NO: 153560 - DNA, 20 bp, Artificial Sequence
  chemically synthesized
ccccctactgccttcatgga

SEQ ID NO: 153561 - DNA, 20 bp, Artificial Sequence
  chemically synthesized
agaaggaagtctttccatga

SEQ ID NO: 153562 - DNA, 20 bp, Artificial Sequence
  chemically synthesized
cagaaggaagtctttccatg

SEQ ID NO: 153563 - DNA, 20 bp, Artificial Sequence
  chemically synthesized
ttctcacactcatcagaagg

SEQ ID NO: 153564 - DNA, 20 bp, Artificial Sequence
  chemically synthesized
tggaaagacttccttctgat

SEQ ID NO: 153565 - DNA, 20 bp, Artificial Sequence
  chemically synthesized
cacttctcacactcatcaga

SEQ ID NO: 153566 - DNA, 20 bp, Artificial Sequence
  chemically synthesized
gcacttctcacactcatcag

SEQ ID NO: 153567 - DNA, 20 bp, Artificial Sequence
  chemically synthesized
ccagcacttctcacactcat

SEQ ID NO: 153568 - DNA, 20 bp, Artificial Sequence
  chemically synthesized
gacttccttctgatgagtgt

SEQ ID NO: 153569 - DNA, 20 bp, Artificial Sequence
  chemically synthesized
ttccttctgatgagtgtgag

SEQ ID NO: 153570 - DNA, 20 bp, Artificial Sequence
  chemically synthesized
ctgatgagtgtgagaagtgc

SEQ ID NO: 153571 - DNA, 20 bp, Artificial Sequence
  chemically synthesized
tgatgagtgtgagaagtgct

SEQ ID NO: 153572 - DNA, 20 bp, Artificial Sequence
  chemically synthesized
gatgagtgtgagaagtgctg

SEQ ID NO: 153573 - DNA, 20 bp, Artificial Sequence
  chemically synthesized
agccctggctggtgaggccc

SEQ ID NO: 153574 - DNA, 20 bp, Artificial Sequence
  chemically synthesized
gagaagtgctggggcctcac

SEQ ID NO: 153575 - DNA, 20 bp, Artificial Sequence
  chemically synthesized
agtgctggggcctcaccagc

SEQ ID NO: 153576 - DNA, 20 bp, Artificial Sequence
  chemically synthesized
acagaaagccctggctggtg

SEQ ID NO: 153577 - DNA, 20 bp, Artificial Sequence
  chemically synthesized
gtgctggggcctcaccagcc

SEQ ID NO: 153578 - DNA, 20 bp, Artificial Sequence
  chemically synthesized
aacagaaagccctggctggt

SEQ ID NO: 153579 - DNA, 20 bp, Artificial Sequence
  chemically synthesized
tgctggggcctcaccagcca

SEQ ID NO: 153580 - DNA, 20 bp, Artificial Sequence
  chemically synthesized
tgacaacagaaagccctggc

SEQ ID NO: 153581 - DNA, 20 bp, Artificial Sequence
  chemically synthesized
ggagtgacaacagaaagccc

SEQ ID NO: 153582 - DNA, 20 bp, Artificial Sequence
  chemically synthesized
gaaaggggagtgacaacaga

SEQ ID NO: 153583 - DNA, 20 bp, Artificial Sequence
  chemically synthesized
tgtagaaaggggagtgacaa

SEQ ID NO: 153584 - DNA, 20 bp, Artificial Sequence
  chemically synthesized
gtgtcacactgtagaaaggg

SEQ ID NO: 153585 - DNA, 20 bp, Artificial Sequence
  chemically synthesized
tgttgtcactcccctttcta

SEQ ID NO: 153586 - DNA, 20 bp, Artificial Sequence
  chemically synthesized
atgtgtcacactgtagaaag

SEQ ID NO: 153587 - DNA, 20 bp, Artificial Sequence
  chemically synthesized
gatgtgtcacactgtagaaa

SEQ ID NO: 153588 - DNA, 20 bp, Artificial Sequence
  chemically synthesized
agatgtgtcacactgtagaa

SEQ ID NO: 153589 - DNA, 20 bp, Artificial Sequence
  chemically synthesized
gagatgtgtcacactgtaga

SEQ ID NO: 153590 - DNA, 20 bp, Artificial Sequence
  chemically synthesized
taatgagatgtgtcacactg

SEQ ID NO: 153591 - DNA, 20 bp, Artificial Sequence
  chemically synthesized
aagagtgcttgaaatataat

SEQ ID NO: 153592 - DNA, 20 bp, Artificial Sequence
  chemically synthesized
gacacatctcattatatttc

SEQ ID NO: 153593 - DNA, 20 bp, Artificial Sequence
  chemically synthesized
tgtatgtatcagtgaggtaa

SEQ ID NO: 153594 - DNA, 20 bp, Artificial Sequence
  chemically synthesized
tttgtatgtatcagtgaggt

SEQ ID NO: 153595 - DNA, 20 bp, Artificial Sequence
  chemically synthesized
catatttgtatgtatcagtg

SEQ ID NO: 153596 - DNA, 20 bp, Artificial Sequence
  chemically synthesized
tcatatttgtatgtatcagt

SEQ ID NO: 153597 - DNA, 20 bp, Artificial Sequence
  chemically synthesized
aaattcatatttgtatgtat

SEQ ID NO: 153598 - DNA, 20 bp, Artificial Sequence
  chemically synthesized
taaattaattaattaatgtc

SEQ ID NO: 153599 - DNA, 20 bp, Artificial Sequence
  chemically synthesized
aattaattaattaatgtcaa

SEQ ID NO: 153600 - DNA, 20 bp, Artificial Sequence
  chemically synthesized
attaattaatgtcaagagtt

SEQ ID NO: 153601 - DNA, 20 bp, Artificial Sequence
  chemically synthesized
ttaattaatgtcaagagtta

SEQ ID NO: 153602 - DNA, 20 bp, Artificial Sequence
  chemically synthesized
aattaatgtcaagagttaag

SEQ ID NO: 153603 - DNA, 20 bp, Artificial Sequence
  chemically synthesized
caagagttaaggagtctctc

SEQ ID NO: 153604 - DNA, 20 bp, Artificial Sequence
  chemically synthesized
aaggccttggagcagctgga

SEQ ID NO: 153605 - DNA, 20 bp, Artificial Sequence
  chemically synthesized
gcaaggccttggagcagctg

SEQ ID NO: 153606 - DNA, 20 bp, Artificial Sequence
  chemically synthesized
ctgcaaggccttggagcagc

SEQ ID NO: 153607 - DNA, 20 bp, Artificial Sequence
  chemically synthesized
ggagtctctccagctgctcc

SEQ ID NO: 153608 - DNA, 20 bp, Artificial Sequence
  chemically synthesized
gagtctctccagctgctcca

SEQ ID NO: 153609 - DNA, 20 bp, Artificial Sequence
  chemically synthesized
gatactgcaaggccttggag

SEQ ID NO: 153610 - DNA, 20 bp, Artificial Sequence
  chemically synthesized
caagatactgcaaggccttg

SEQ ID NO: 153611 - DNA, 20 bp, Artificial Sequence
  chemically synthesized
cccaagatactgcaaggcct

SEQ ID NO: 153612 - DNA, 20 bp, Artificial Sequence
  chemically synthesized
ccagctgctccaaggccttg

SEQ ID NO: 153613 - DNA, 20 bp, Artificial Sequence
  chemically synthesized
ccctatcccaagatactgca

SEQ ID NO: 153614 - DNA, 20 bp, Artificial Sequence
  chemically synthesized
accctatcccaagatactgc

SEQ ID NO: 153615 - DNA, 20 bp, Artificial Sequence
  chemically synthesized
tccaaggccttgcagtatct

SEQ ID NO: 153616 - DNA, 20 bp, Artificial Sequence
  chemically synthesized
ccaaggccttgcagtatctt

SEQ ID NO: 153617 - DNA, 20 bp, Artificial Sequence
  chemically synthesized
ggccttgcagtatcttggga

SEQ ID NO: 153618 - DNA, 20 bp, Artificial Sequence
  chemically synthesized
gccttgcagtatcttgggat

SEQ ID NO: 153619 - DNA, 20 bp, Artificial Sequence
  chemically synthesized
ccttgcagtatcttgggata

SEQ ID NO: 153620 - DNA, 20 bp, Artificial Sequence
  chemically synthesized
tccattttaaaccctatccc

SEQ ID NO: 153621 - DNA, 20 bp, Artificial Sequence
  chemically synthesized
tcttgggatagggtttaaaa

SEQ ID NO: 153622 - DNA, 20 bp, Artificial Sequence
  chemically synthesized
aaatggatttattttgttat

SEQ ID NO: 153623 - DNA, 20 bp, Artificial Sequence
  chemically synthesized
ttttgttattggaactgatt

SEQ ID NO: 153624 - DNA, 20 bp, Artificial Sequence
  chemically synthesized
tttgttattggaactgatta

SEQ ID NO: 153625 - DNA, 20 bp, Artificial Sequence
  chemically synthesized
ttgttattggaactgattaa

SEQ ID NO: 153626 - DNA, 20 bp, Artificial Sequence
  chemically synthesized
aaaatgtgaagacccttaat

SEQ ID NO: 153627 - DNA, 20 bp, Artificial Sequence
  chemically synthesized
gcttttgtacaaaaaatgtg

SEQ ID NO: 153628 - DNA, 20 bp, Artificial Sequence
  chemically synthesized
tcttcacattttttgtacaa

SEQ ID NO: 153629 - DNA, 20 bp, Artificial Sequence
  chemically synthesized
aagtctaatacgtcaggagc

SEQ ID NO: 153630 - DNA, 20 bp, Artificial Sequence
  chemically synthesized
ctcaaagtctaatacgtcag

SEQ ID NO: 153631 - DNA, 20 bp, Artificial Sequence
  chemically synthesized
aaagcttgctcctgacgtat

SEQ ID NO: 153632 - DNA, 20 bp, Artificial Sequence
  chemically synthesized
tcctcaaagtctaatacgtc

SEQ ID NO: 153633 - DNA, 20 bp, Artificial Sequence
  chemically synthesized
ttcctcaaagtctaatacgt

SEQ ID NO: 153634 - DNA, 20 bp, Artificial Sequence
  chemically synthesized
ctcctgacgtattagacttt

SEQ ID NO: 153635 - DNA, 20 bp, Artificial Sequence
  chemically synthesized
tcctgacgtattagactttg

SEQ ID NO: 153636 - DNA, 20 bp, Artificial Sequence
  chemically synthesized
tgacgtattagactttgagg

SEQ ID NO: 153637 - DNA, 20 bp, Artificial Sequence
  chemically synthesized
aaaccttgaaaacttcctca

SEQ ID NO: 153638 - DNA, 20 bp, Artificial Sequence
  chemically synthesized
tagactttgaggaagttttc

SEQ ID NO: 153639 - DNA, 20 bp, Artificial Sequence
  chemically synthesized
agactttgaggaagttttca

SEQ ID NO: 153640 - DNA, 20 bp, Artificial Sequence
  chemically synthesized
ttgaggaagttttcaaggtt

SEQ ID NO: 153641 - DNA, 20 bp, Artificial Sequence
  chemically synthesized
gaggaagttttcaaggttta

SEQ ID NO: 153642 - DNA, 20 bp, Artificial Sequence
  chemically synthesized
attgccggttttatagttac

SEQ ID NO: 153643 - DNA, 20 bp, Artificial Sequence
  chemically synthesized
tattgccggttttatagtta

SEQ ID NO: 153644 - DNA, 20 bp, Artificial Sequence
  chemically synthesized
agagcctgtaactataaaac

SEQ ID NO: 153645 - DNA, 20 bp, Artificial Sequence
  chemically synthesized
ctatactattgccggtttta

SEQ ID NO: 153646 - DNA, 20 bp, Artificial Sequence
  chemically synthesized
tgtaactataaaaccggcaa

SEQ ID NO: 153647 - DNA, 20 bp, Artificial Sequence
  chemically synthesized
cgacatggctatactattgc

SEQ ID NO: 153648 - DNA, 20 bp, Artificial Sequence
  chemically synthesized
ctataaaaccggcaatagta

SEQ ID NO: 153649 - DNA, 20 bp, Artificial Sequence
  chemically synthesized
caatagtatagccatgtcgt

SEQ ID NO: 153650 - DNA, 20 bp, Artificial Sequence
  chemically synthesized
tgctaaaaacacttacgaca

SEQ ID NO: 153651 - DNA, 20 bp, Artificial Sequence
  chemically synthesized
agccatgtcgtaagtgtttt

SEQ ID NO: 153652 - DNA, 20 bp, Artificial Sequence
  chemically synthesized
catgtcgtaagtgtttttag

SEQ ID NO: 153653 - DNA, 20 bp, Artificial Sequence
  chemically synthesized
tgtcgtaagtgtttttagca

SEQ ID NO: 153654 - DNA, 20 bp, Artificial Sequence
  chemically synthesized
cagagaaatcatctgttaat

SEQ ID NO: 153655 - DNA, 20 bp, Artificial Sequence
  chemically synthesized
agagaaatcatctgttaatg

SEQ ID NO: 153656 - DNA, 20 bp, Artificial Sequence
  chemically synthesized
atctttttcttcctcattaa

SEQ ID NO: 153657 - DNA, 20 bp, Artificial Sequence
  chemically synthesized
gaaatcatctgttaatgagg

SEQ ID NO: 153658 - DNA, 20 bp, Artificial Sequence
  chemically synthesized
atctgttaatgaggaagaaa

SEQ ID NO: 153659 - DNA, 20 bp, Artificial Sequence
  chemically synthesized
taatgaggaagaaaaagatt

SEQ ID NO: 153660 - DNA, 20 bp, Artificial Sequence
  chemically synthesized
aagaaaaagatttggcctca

SEQ ID NO: 153661 - DNA, 20 bp, Artificial Sequence
  chemically synthesized
taggcaaataaatttccgtg

SEQ ID NO: 153662 - DNA, 20 bp, Artificial Sequence
  chemically synthesized
ttaggcaaataaatttccgt

SEQ ID NO: 153663 - DNA, 20 bp, Artificial Sequence
  chemically synthesized
aatttatttgcctaatccta

SEQ ID NO: 153664 - DNA, 20 bp, Artificial Sequence
  chemically synthesized
tcaggtgaacctttaggatt

SEQ ID NO: 153665 - DNA, 20 bp, Artificial Sequence
  chemically synthesized
atttatttgcctaatcctaa

SEQ ID NO: 153666 - DNA, 20 bp, Artificial Sequence
  chemically synthesized
ttcaggtgaacctttaggat

SEQ ID NO: 153667 - DNA, 20 bp, Artificial Sequence
  chemically synthesized
tctgcttcaggtgaaccttt

SEQ ID NO: 153668 - DNA, 20 bp, Artificial Sequence
  chemically synthesized
ttctgcttcaggtgaacctt

SEQ ID NO: 153669 - DNA, 20 bp, Artificial Sequence
  chemically synthesized
taatcctaaaggttcacctg

SEQ ID NO: 153670 - DNA, 20 bp, Artificial Sequence
  chemically synthesized
tcctaaaggttcacctgaag

SEQ ID NO: 153671 - DNA, 20 bp, Artificial Sequence
  chemically synthesized
tccactgttgattctgcttc

SEQ ID NO: 153672 - DNA, 20 bp, Artificial Sequence
  chemically synthesized
ttccactgttgattctgctt

SEQ ID NO: 153673 - DNA, 20 bp, Artificial Sequence
  chemically synthesized
ttcacctgaagcagaatcaa

SEQ ID NO: 153674 - DNA, 20 bp, Artificial Sequence
  chemically synthesized
acctgaagcagaatcaacag

SEQ ID NO: 153675 - DNA, 20 bp, Artificial Sequence
  chemically synthesized
cagtggaaacataaccacaa

SEQ ID NO: 153676 - DNA, 20 bp, Artificial Sequence
  chemically synthesized
agtggaaacataaccacaac

SEQ ID NO: 153677 - DNA, 20 bp, Artificial Sequence
  chemically synthesized
acccacaccctttcctgttg

SEQ ID NO: 153678 - DNA, 20 bp, Artificial Sequence
  chemically synthesized
gaaacataaccacaacagga

SEQ ID NO: 153679 - DNA, 20 bp, Artificial Sequence
  chemically synthesized
aaacataaccacaacaggaa

SEQ ID NO: 153680 - DNA, 20 bp, Artificial Sequence
  chemically synthesized
aacataaccacaacaggaaa

SEQ ID NO: 153681 - DNA, 20 bp, Artificial Sequence
  chemically synthesized
aaccacaacaggaaagggtg

SEQ ID NO: 153682 - DNA, 20 bp, Artificial Sequence
  chemically synthesized
accacaacaggaaagggtgt

SEQ ID NO: 153683 - DNA, 20 bp, Artificial Sequence
  chemically synthesized
atagaaacatggcaggggag

SEQ ID NO: 153684 - DNA, 20 bp, Artificial Sequence
  chemically synthesized
aatagaaacatggcagggga

SEQ ID NO: 153685 - DNA, 20 bp, Artificial Sequence
  chemically synthesized
taatagaaacatggcagggg

SEQ ID NO: 153686 - DNA, 20 bp, Artificial Sequence
  chemically synthesized
ttaatagaaacatggcaggg

SEQ ID NO: 153687 - DNA, 20 bp, Artificial Sequence
  chemically synthesized
cattaatagaaacatggcag

SEQ ID NO: 153688 - DNA, 20 bp, Artificial Sequence
  chemically synthesized
tcattaatagaaacatggca

SEQ ID NO: 153689 - DNA, 20 bp, Artificial Sequence
  chemically synthesized
ctcattaatagaaacatggc

SEQ ID NO: 153690 - DNA, 20 bp, Artificial Sequence
  chemically synthesized
tctcattaatagaaacatgg

SEQ ID NO: 153691 - DNA, 20 bp, Artificial Sequence
  chemically synthesized
ccttctcattaatagaaaca

SEQ ID NO: 153692 - DNA, 20 bp, Artificial Sequence
  chemically synthesized
cctgccatgtttctattaat

SEQ ID NO: 153693 - DNA, 20 bp, Artificial Sequence
  chemically synthesized
gtcctgatccttctcattaa

SEQ ID NO: 153694 - DNA, 20 bp, Artificial Sequence
  chemically synthesized
gccatgtttctattaatgag

SEQ ID NO: 153695 - DNA, 20 bp, Artificial Sequence
  chemically synthesized
ccatgtttctattaatgaga

SEQ ID NO: 153696 - DNA, 20 bp, Artificial Sequence
  chemically synthesized
tttctattaatgagaaggat

SEQ ID NO: 153697 - DNA, 20 bp, Artificial Sequence
  chemically synthesized
ttctattaatgagaaggatc

SEQ ID NO: 153698 - DNA, 20 bp, Artificial Sequence
  chemically synthesized
aatgagaaggatcaggaccc

SEQ ID NO: 153699 - DNA, 20 bp, Artificial Sequence
  chemically synthesized
tgagaaggatcaggacccaa

SEQ ID NO: 153700 - DNA, 20 bp, Artificial Sequence
  chemically synthesized
agaaggatcaggacccaaga

SEQ ID NO: 153701 - DNA, 20 bp, Artificial Sequence
  chemically synthesized
gaaggatcaggacccaagag

SEQ ID NO: 153702 - DNA, 20 bp, Artificial Sequence
  chemically synthesized
tgcattcttattcctctctt

SEQ ID NO: 153703 - DNA, 20 bp, Artificial Sequence
  chemically synthesized
ttgcattcttattcctctct

SEQ ID NO: 153704 - DNA, 20 bp, Artificial Sequence
  chemically synthesized
tcaggacccaagagaggaat

SEQ ID NO: 153705 - DNA, 20 bp, Artificial Sequence
  chemically synthesized
caagagaggaataagaatgc

SEQ ID NO: 153706 - DNA, 20 bp, Artificial Sequence
  chemically synthesized
aggaaaaagaggatggcaat

SEQ ID NO: 153707 - DNA, 20 bp, Artificial Sequence
  chemically synthesized
gcagcaaaggaaaaagagga

SEQ ID NO: 153708 - DNA, 20 bp, Artificial Sequence
  chemically synthesized
atctgcagcaaaggaaaaag

SEQ ID NO: 153709 - DNA, 20 bp, Artificial Sequence
  chemically synthesized
tatctgcagcaaaggaaaaa

SEQ ID NO: 153710 - DNA, 20 bp, Artificial Sequence
  chemically synthesized
tttatctgcagcaaaggaaa

SEQ ID NO: 153711 - DNA, 20 bp, Artificial Sequence
  chemically synthesized
atcctctttttcctttgctg

SEQ ID NO: 153712 - DNA, 20 bp, Artificial Sequence
  chemically synthesized
ccttcgtttatctgcagcaa

SEQ ID NO: 153713 - DNA, 20 bp, Artificial Sequence
  chemically synthesized
gccttcgtttatctgcagca

SEQ ID NO: 153714 - DNA, 20 bp, Artificial Sequence
  chemically synthesized
aaatggccttcgtttatctg

SEQ ID NO: 153715 - DNA, 20 bp, Artificial Sequence
  chemically synthesized
tcctttgctgcagataaacg

SEQ ID NO: 153716 - DNA, 20 bp, Artificial Sequence
  chemically synthesized
cctttgctgcagataaacga

SEQ ID NO: 153717 - DNA, 20 bp, Artificial Sequence
  chemically synthesized
gatcattttttttgtgaaaa

SEQ ID NO: 153718 - DNA, 20 bp, Artificial Sequence
  chemically synthesized
cacaaaaaaaatgatcactg

SEQ ID NO: 153719 - DNA, 20 bp, Artificial Sequence
  chemically synthesized
caataccctacatttatctg

SEQ ID NO: 153720 - DNA, 20 bp, Artificial Sequence
  chemically synthesized
atgatcactgcagataaatg

SEQ ID NO: 153721 - DNA, 20 bp, Artificial Sequence
  chemically synthesized
tgatcactgcagataaatgt

SEQ ID NO: 153722 - DNA, 20 bp, Artificial Sequence
  chemically synthesized
gatcactgcagataaatgta

SEQ ID NO: 153723 - DNA, 20 bp, Artificial Sequence
  chemically synthesized
taaattgcaaaaaaaaaaaa

SEQ ID NO: 153724 - DNA, 20 bp, Artificial Sequence
  chemically synthesized
attttttttttttgcaattt

SEQ ID NO: 153725 - DNA, 20 bp, Artificial Sequence
  chemically synthesized
tttgcaatttaagccaacaa

SEQ ID NO: 153726 - DNA, 20 bp, Artificial Sequence
  chemically synthesized
gcaatttaagccaacaaaag

SEQ ID NO: 153727 - DNA, 20 bp, Artificial Sequence
  chemically synthesized
tcttgtcatactacttttgt

SEQ ID NO: 153728 - DNA, 20 bp, Artificial Sequence
  chemically synthesized
gccaacaaaagtagtatgac

SEQ ID NO: 153729 - DNA, 20 bp, Artificial Sequence
  chemically synthesized
caacaaaagtagtatgacaa

SEQ ID NO: 153730 - DNA, 20 bp, Artificial Sequence
  chemically synthesized
agtatgacaagagtacattt

SEQ ID NO: 153731 - DNA, 20 bp, Artificial Sequence
  chemically synthesized
caagagtacatttaagtgcc

SEQ ID NO: 153732 - DNA, 20 bp, Artificial Sequence
  chemically synthesized
agttaaagcatgaggttact

SEQ ID NO: 153733 - DNA, 20 bp, Artificial Sequence
  chemically synthesized
atctaggcagttaaagcatg

SEQ ID NO: 153734 - DNA, 20 bp, Artificial Sequence
  chemically synthesized
tatctaggcagttaaagcat

SEQ ID NO: 153735 - DNA, 20 bp, Artificial Sequence
  chemically synthesized
tttaaatatctaggcagtta

SEQ ID NO: 153736 - DNA, 20 bp, Artificial Sequence
  chemically synthesized
aacctcatgctttaactgcc

SEQ ID NO: 153737 - DNA, 20 bp, Artificial Sequence
  chemically synthesized
taatactttaaatatctagg

SEQ ID NO: 153738 - DNA, 20 bp, Artificial Sequence
  chemically synthesized
caataatactttaaatatct

SEQ ID NO: 153739 - DNA, 20 bp, Artificial Sequence
  chemically synthesized
tcaataatactttaaatatc

SEQ ID NO: 153740 - DNA, 20 bp, Artificial Sequence
  chemically synthesized
tttaactgcctagatattta

SEQ ID NO: 153741 - DNA, 20 bp, Artificial Sequence
  chemically synthesized
tatttaaagtattattgaaa

SEQ ID NO: 153742 - DNA, 20 bp, Artificial Sequence
  chemically synthesized
aagtattattgaaatggaaa

SEQ ID NO: 153743 - DNA, 20 bp, Artificial Sequence
  chemically synthesized
cacctctacaaagttaaata

SEQ ID NO: 153744 - DNA, 20 bp, Artificial Sequence
  chemically synthesized
gaatgctttatttaactttg

SEQ ID NO: 153745 - DNA, 20 bp, Artificial Sequence
  chemically synthesized
atgctttatttaactttgta

SEQ ID NO: 153746 - DNA, 20 bp, Artificial Sequence
  chemically synthesized
tgctttatttaactttgtag

SEQ ID NO: 153747 - DNA, 20 bp, Artificial Sequence
  chemically synthesized
gaacttcactcacctctaca

SEQ ID NO: 153748 - DNA, 20 bp, Artificial Sequence
  chemically synthesized
ttatttaactttgtagaggt

SEQ ID NO: 153749 - DNA, 20 bp, Artificial Sequence
  chemically synthesized
taactttgtagaggtgagtg

SEQ ID NO: 153750 - DNA, 20 bp, Artificial Sequence
  chemically synthesized
ttaaaatgtataaatcacca

SEQ ID NO: 153751 - DNA, 20 bp, Artificial Sequence
  chemically synthesized
tatggctgcatagtattcca

SEQ ID NO: 153752 - DNA, 20 bp, Artificial Sequence
  chemically synthesized
aatcaccatggaatactatg

SEQ ID NO: 153753 - DNA, 20 bp, Artificial Sequence
  chemically synthesized
catcattttttatggctgca

SEQ ID NO: 153754 - DNA, 20 bp, Artificial Sequence
  chemically synthesized
catgaactcatcatttttta

SEQ ID NO: 153755 - DNA, 20 bp, Artificial Sequence
  chemically synthesized
atgcagccataaaaaatgat

SEQ ID NO: 153756 - DNA, 20 bp, Artificial Sequence
  chemically synthesized
tgatgagttcatgtcctttg

SEQ ID NO: 153757 - DNA, 20 bp, Artificial Sequence
  chemically synthesized
gatgagttcatgtcctttgt

SEQ ID NO: 153758 - DNA, 20 bp, Artificial Sequence
  chemically synthesized
atgagttcatgtcctttgta

SEQ ID NO: 153759 - DNA, 20 bp, Artificial Sequence
  chemically synthesized
cttcatccatatccctacaa

SEQ ID NO: 153760 - DNA, 20 bp, Artificial Sequence
  chemically synthesized
gcttcatccatatccctaca

SEQ ID NO: 153761 - DNA, 20 bp, Artificial Sequence
  chemically synthesized
tcatgtcctttgtagggata

SEQ ID NO: 153762 - DNA, 20 bp, Artificial Sequence
  chemically synthesized
cctttgtagggatatggatg

SEQ ID NO: 153763 - DNA, 20 bp, Artificial Sequence
  chemically synthesized
ttgctgagaatgatggttta

SEQ ID NO: 153764 - DNA, 20 bp, Artificial Sequence
  chemically synthesized
aagctgtaaaccatcattct

SEQ ID NO: 153765 - DNA, 20 bp, Artificial Sequence
  chemically synthesized
cgatagtttgctgagaatga

SEQ ID NO: 153766 - DNA, 20 bp, Artificial Sequence
  chemically synthesized
tgtccttgcgatagtttgct

SEQ ID NO: 153767 - DNA, 20 bp, Artificial Sequence
  chemically synthesized
cattctcagcaaactatcgc

SEQ ID NO: 153768 - DNA, 20 bp, Artificial Sequence
  chemically synthesized
attctcagcaaactatcgca

SEQ ID NO: 153769 - DNA, 20 bp, Artificial Sequence
  chemically synthesized
ttggttttttgtccttgcga

SEQ ID NO: 153770 - DNA, 20 bp, Artificial Sequence
  chemically synthesized
gagtgagaatatgcggtgtt

SEQ ID NO: 153771 - DNA, 20 bp, Artificial Sequence
  chemically synthesized
cacctgtgagtgagaatatg

SEQ ID NO: 153772 - DNA, 20 bp, Artificial Sequence
  chemically synthesized
acaccgcatattctcactca

SEQ ID NO: 153773 - DNA, 20 bp, Artificial Sequence
  chemically synthesized
caccgcatattctcactcac

SEQ ID NO: 153774 - DNA, 20 bp, Artificial Sequence
  chemically synthesized
ttcaattcccacctgtgagt

SEQ ID NO: 153775 - DNA, 20 bp, Artificial Sequence
  chemically synthesized
cgcatattctcactcacagg

SEQ ID NO: 153776 - DNA, 20 bp, Artificial Sequence
  chemically synthesized
gcatattctcactcacaggt

SEQ ID NO: 153777 - DNA, 20 bp, Artificial Sequence
  chemically synthesized
attgttcaattcccacctgt

SEQ ID NO: 153778 - DNA, 20 bp, Artificial Sequence
  chemically synthesized
acaggtgggaattgaacaat

SEQ ID NO: 153779 - DNA, 20 bp, Artificial Sequence
  chemically synthesized
aattgaacaatgagaacaca

SEQ ID NO: 153780 - DNA, 20 bp, Artificial Sequence
  chemically synthesized
acaatgagaacacatggtca

SEQ ID NO: 153781 - DNA, 20 bp, Artificial Sequence
  chemically synthesized
caatgagaacacatggtcac

SEQ ID NO: 153782 - DNA, 20 bp, Artificial Sequence
  chemically synthesized
tgagaacacatggtcacagg

SEQ ID NO: 153783 - DNA, 20 bp, Artificial Sequence
  chemically synthesized
gagaacacatggtcacagga

SEQ ID NO: 153784 - DNA, 20 bp, Artificial Sequence
  chemically synthesized
agaacacatggtcacaggaa

SEQ ID NO: 153785 - DNA, 20 bp, Artificial Sequence
  chemically synthesized
gaacacatggtcacaggaag

SEQ ID NO: 153786 - DNA, 20 bp, Artificial Sequence
  chemically synthesized
ggaaggggaacatcacacac

SEQ ID NO: 153787 - DNA, 20 bp, Artificial Sequence
  chemically synthesized
gaaggggaacatcacacact

SEQ ID NO: 153788 - DNA, 20 bp, Artificial Sequence
  chemically synthesized
aaggggaacatcacacactg

SEQ ID NO: 153789 - DNA, 20 bp, Artificial Sequence
  chemically synthesized
ccccaccccacagcaggccc

SEQ ID NO: 153790 - DNA, 20 bp, Artificial Sequence
  chemically synthesized
tcacacactggggcctgctg

SEQ ID NO: 153791 - DNA, 20 bp, Artificial Sequence
  chemically synthesized
cacacactggggcctgctgt

SEQ ID NO: 153792 - DNA, 20 bp, Artificial Sequence
  chemically synthesized
acacactggggcctgctgtg

SEQ ID NO: 153793 - DNA, 20 bp, Artificial Sequence
  chemically synthesized
ccctccccccaccccacagc

SEQ ID NO: 153794 - DNA, 20 bp, Artificial Sequence
  chemically synthesized
cccctccccccaccccacag

SEQ ID NO: 153795 - DNA, 20 bp, Artificial Sequence
  chemically synthesized
cactggggcctgctgtgggg

SEQ ID NO: 153796 - DNA, 20 bp, Artificial Sequence
  chemically synthesized
actggggcctgctgtggggt

SEQ ID NO: 153797 - DNA, 20 bp, Artificial Sequence
  chemically synthesized
ctggggcctgctgtggggtg

SEQ ID NO: 153798 - DNA, 20 bp, Artificial Sequence
  chemically synthesized
tcccccctccccccacccca

SEQ ID NO: 153799 - DNA, 20 bp, Artificial Sequence
  chemically synthesized
tggggcctgctgtggggtgg

SEQ ID NO: 153800 - DNA, 20 bp, Artificial Sequence
  chemically synthesized
ggggcctgctgtggggtggg

SEQ ID NO: 153801 - DNA, 20 bp, Artificial Sequence
  chemically synthesized
ggcctgctgtggggtggggg

SEQ ID NO: 153802 - DNA, 20 bp, Artificial Sequence
  chemically synthesized
gcctgctgtggggtgggggg

SEQ ID NO: 153803 - DNA, 20 bp, Artificial Sequence
  chemically synthesized
cctgctgtggggtgggggga

SEQ ID NO: 153804 - DNA, 20 bp, Artificial Sequence
  chemically synthesized
ctgctgtggggtggggggag

SEQ ID NO: 153805 - DNA, 20 bp, Artificial Sequence
  chemically synthesized
tgctgtggggtggggggagg

SEQ ID NO: 153806 - DNA, 20 bp, Artificial Sequence
  chemically synthesized
gctgtggggtggggggaggg

SEQ ID NO: 153807 - DNA, 20 bp, Artificial Sequence
  chemically synthesized
tgtggggtggggggaggggg

SEQ ID NO: 153808 - DNA, 20 bp, Artificial Sequence
  chemically synthesized
gtggggtggggggagggggg

SEQ ID NO: 153809 - DNA, 20 bp, Artificial Sequence
  chemically synthesized
tggggtggggggagggggga

SEQ ID NO: 153810 - DNA, 20 bp, Artificial Sequence
  chemically synthesized
gtggggggaggggggaggga

SEQ ID NO: 153811 - DNA, 20 bp, Artificial Sequence
  chemically synthesized
ggaggggggagggatagcat

SEQ ID NO: 153812 - DNA, 20 bp, Artificial Sequence
  chemically synthesized
gaggggggagggatagcatt

SEQ ID NO: 153813 - DNA, 20 bp, Artificial Sequence
  chemically synthesized
ggggggagggatagcattag

SEQ ID NO: 153814 - DNA, 20 bp, Artificial Sequence
  chemically synthesized
ttaactcgtcattgaacatt

SEQ ID NO: 153815 - DNA, 20 bp, Artificial Sequence
  chemically synthesized
attaactcgtcattgaacat

SEQ ID NO: 153816 - DNA, 20 bp, Artificial Sequence
  chemically synthesized
tatacctaatgttcaatgac

SEQ ID NO: 153817 - DNA, 20 bp, Artificial Sequence
  chemically synthesized
aatgttcaatgacgagttaa

SEQ ID NO: 153818 - DNA, 20 bp, Artificial Sequence
  chemically synthesized
atgttcaatgacgagttaat

SEQ ID NO: 153819 - DNA, 20 bp, Artificial Sequence
  chemically synthesized
caatgacgagttaatgggtg

SEQ ID NO: 153820 - DNA, 20 bp, Artificial Sequence
  chemically synthesized
atgggtgcagcacaccaaca

SEQ ID NO: 153821 - DNA, 20 bp, Artificial Sequence
  chemically synthesized
tatatatacatgtgccatgt

SEQ ID NO: 153822 - DNA, 20 bp, Artificial Sequence
  chemically synthesized
gcacatgtatatatatgtaa

SEQ ID NO: 153823 - DNA, 20 bp, Artificial Sequence
  chemically synthesized
ggtacatgtgcacaatgtgc

SEQ ID NO: 153824 - DNA, 20 bp, Artificial Sequence
  chemically synthesized
gggtacatgtgcacaatgtg

SEQ ID NO: 153825 - DNA, 20 bp, Artificial Sequence
  chemically synthesized
ttattatactttaagtttta

SEQ ID NO: 153826 - DNA, 20 bp, Artificial Sequence
  chemically synthesized
tttattatactttaagtttt

SEQ ID NO: 153827 - DNA, 20 bp, Artificial Sequence
  chemically synthesized
cacatgtaccctaaaactta

SEQ ID NO: 153828 - DNA, 20 bp, Artificial Sequence
  chemically synthesized
ttttattatactttaagttt

SEQ ID NO: 153829 - DNA, 20 bp, Artificial Sequence
  chemically synthesized
acttttttttattatacttt

SEQ ID NO: 153830 - DNA, 20 bp, Artificial Sequence
  chemically synthesized
acttaaagtataataaaaaa

SEQ ID NO: 153831 - DNA, 20 bp, Artificial Sequence
  chemically synthesized
aagtataataaaaaaaagtt

SEQ ID NO: 153832 - DNA, 20 bp, Artificial Sequence
  chemically synthesized
aaataaataaaacaaataaa

SEQ ID NO: 153833 - DNA, 20 bp, Artificial Sequence
  chemically synthesized
aataaataaaacaaataaaa

SEQ ID NO: 153834 - DNA, 20 bp, Artificial Sequence
  chemically synthesized
gtataaataaccttatatgt

SEQ ID NO: 153835 - DNA, 20 bp, Artificial Sequence
  chemically synthesized
atatcaaatcctcacatata

SEQ ID NO: 153836 - DNA, 20 bp, Artificial Sequence
  chemically synthesized
tataaataaccttatatgtg

SEQ ID NO: 153837 - DNA, 20 bp, Artificial Sequence
  chemically synthesized
aatatcaaatcctcacatat

SEQ ID NO: 153838 - DNA, 20 bp, Artificial Sequence
  chemically synthesized
gatttgatattcaatttaaa

SEQ ID NO: 153839 - DNA, 20 bp, Artificial Sequence
  chemically synthesized
tttgatattcaatttaaata

SEQ ID NO: 153840 - DNA, 20 bp, Artificial Sequence
  chemically synthesized
atcttcatttgaattttttg

SEQ ID NO: 153841 - DNA, 20 bp, Artificial Sequence
  chemically synthesized
gacttcaaaaaattcaaatg

SEQ ID NO: 153842 - DNA, 20 bp, Artificial Sequence
  chemically synthesized
ccatgtatcaagcagtgatt

SEQ ID NO: 153843 - DNA, 20 bp, Artificial Sequence
  chemically synthesized
tcagtgcaccatgtatcaag

SEQ ID NO: 153844 - DNA, 20 bp, Artificial Sequence
  chemically synthesized
ctaaatcactgcttgataca

SEQ ID NO: 153845 - DNA, 20 bp, Artificial Sequence
  chemically synthesized
taatcagtgcaccatgtatc

SEQ ID NO: 153846 - DNA, 20 bp, Artificial Sequence
  chemically synthesized
atacatggtgcactgattaa

SEQ ID NO: 153847 - DNA, 20 bp, Artificial Sequence
  chemically synthesized
ccagagcttatgctattaat

SEQ ID NO: 153848 - DNA, 20 bp, Artificial Sequence
  chemically synthesized
ggtgcactgattaatagcat

SEQ ID NO: 153849 - DNA, 20 bp, Artificial Sequence
  chemically synthesized
ctgattaatagcataagctc

SEQ ID NO: 153850 - DNA, 20 bp, Artificial Sequence
  chemically synthesized
aataagtctctatgattcca

SEQ ID NO: 153851 - DNA, 20 bp, Artificial Sequence
  chemically synthesized
tagcataagctctggaatca

SEQ ID NO: 153852 - DNA, 20 bp, Artificial Sequence
  chemically synthesized
aaaataagtctctatgattc

SEQ ID NO: 153853 - DNA, 20 bp, Artificial Sequence
  chemically synthesized
gcataagctctggaatcata

SEQ ID NO: 153854 - DNA, 20 bp, Artificial Sequence
  chemically synthesized
cagagtgggtattcaaaaat

SEQ ID NO: 153855 - DNA, 20 bp, Artificial Sequence
  chemically synthesized
gagctagtcagtgacagagt

SEQ ID NO: 153856 - DNA, 20 bp, Artificial Sequence
  chemically synthesized
agagctagtcagtgacagag

SEQ ID NO: 153857 - DNA, 20 bp, Artificial Sequence
  chemically synthesized
tacagagctagtcagtgaca

SEQ ID NO: 153858 - DNA, 20 bp, Artificial Sequence
  chemically synthesized
gttacagagctagtcagtga

SEQ ID NO: 153859 - DNA, 20 bp, Artificial Sequence
  chemically synthesized
atacccactctgtcactgac

SEQ ID NO: 153860 - DNA, 20 bp, Artificial Sequence
  chemically synthesized
tccaaggttacagagctagt

SEQ ID NO: 153861 - DNA, 20 bp, Artificial Sequence
  chemically synthesized
tttgtccaaggttacagagc

SEQ ID NO: 153862 - DNA, 20 bp, Artificial Sequence
  chemically synthesized
ataatttgtccaaggttaca

SEQ ID NO: 153863 - DNA, 20 bp, Artificial Sequence
  chemically synthesized
actgactagctctgtaacct

SEQ ID NO: 153864 - DNA, 20 bp, Artificial Sequence
  chemically synthesized
aaataatttgtccaaggtta

SEQ ID NO: 153865 - DNA, 20 bp, Artificial Sequence
  chemically synthesized
aaggttaaataatttgtcca

SEQ ID NO: 153866 - DNA, 20 bp, Artificial Sequence
  chemically synthesized
aaaggttaaataatttgtcc

SEQ ID NO: 153867 - DNA, 20 bp, Artificial Sequence
  chemically synthesized
gagataaccaagggtcagaa

SEQ ID NO: 153868 - DNA, 20 bp, Artificial Sequence
  chemically synthesized
tgagataaccaagggtcaga

SEQ ID NO: 153869 - DNA, 20 bp, Artificial Sequence
  chemically synthesized
tatttaacctttctgaccct

SEQ ID NO: 153870 - DNA, 20 bp, Artificial Sequence
  chemically synthesized
tagatgagataaccaagggt

SEQ ID NO: 153871 - DNA, 20 bp, Artificial Sequence
  chemically synthesized
tttatagatgagataaccaa

SEQ ID NO: 153872 - DNA, 20 bp, Artificial Sequence
  chemically synthesized
ttttatagatgagataacca

SEQ ID NO: 153873 - DNA, 20 bp, Artificial Sequence
  chemically synthesized
attttatagatgagataacc

SEQ ID NO: 153874 - DNA, 20 bp, Artificial Sequence
  chemically synthesized
gcaattcccattttatagat

SEQ ID NO: 153875 - DNA, 20 bp, Artificial Sequence
  chemically synthesized
tggttatctcatctataaaa

SEQ ID NO: 153876 - DNA, 20 bp, Artificial Sequence
  chemically synthesized
ggttatctcatctataaaat

SEQ ID NO: 153877 - DNA, 20 bp, Artificial Sequence
  chemically synthesized
atgttgcaattcccatttta

SEQ ID NO: 153878 - DNA, 20 bp, Artificial Sequence
  chemically synthesized
ttgcaacataacttactcaa

SEQ ID NO: 153879 - DNA, 20 bp, Artificial Sequence
  chemically synthesized
tgcaacataacttactcaaa

SEQ ID NO: 153880 - DNA, 20 bp, Artificial Sequence
  chemically synthesized
cacagttataccttttgagt

SEQ ID NO: 153881 - DNA, 20 bp, Artificial Sequence
  chemically synthesized
gtgccacagttatacctttt

SEQ ID NO: 153882 - DNA, 20 bp, Artificial Sequence
  chemically synthesized
ttactcaaaaggtataactg

SEQ ID NO: 153883 - DNA, 20 bp, Artificial Sequence
  chemically synthesized
aagtcttagaattagtgcca

SEQ ID NO: 153884 - DNA, 20 bp, Artificial Sequence
  chemically synthesized
ataactgtggcactaattct

SEQ ID NO: 153885 - DNA, 20 bp, Artificial Sequence
  chemically synthesized
attaatacaagtcttagaat

SEQ ID NO: 153886 - DNA, 20 bp, Artificial Sequence
  chemically synthesized
acctaaattaatacaagtct

SEQ ID NO: 153887 - DNA, 20 bp, Artificial Sequence
  chemically synthesized
gagcaaacctaaattaatac

SEQ ID NO: 153888 - DNA, 20 bp, Artificial Sequence
  chemically synthesized
ttctaagacttgtattaatt

SEQ ID NO: 153889 - DNA, 20 bp, Artificial Sequence
  chemically synthesized
tctaagacttgtattaattt

SEQ ID NO: 153890 - DNA, 20 bp, Artificial Sequence
  chemically synthesized
tgtattaatttaggtttgct

SEQ ID NO: 153891 - DNA, 20 bp, Artificial Sequence
  chemically synthesized
attaatttaggtttgctcag

SEQ ID NO: 153892 - DNA, 20 bp, Artificial Sequence
  chemically synthesized
aatttaggtttgctcagaag

SEQ ID NO: 153893 - DNA, 20 bp, Artificial Sequence
  chemically synthesized
ttgtctcagggtctacttct

SEQ ID NO: 153894 - DNA, 20 bp, Artificial Sequence
  chemically synthesized
tttgctcagaagtagaccct

SEQ ID NO: 153895 - DNA, 20 bp, Artificial Sequence
  chemically synthesized
tcagaagtagaccctgagac

SEQ ID NO: 153896 - DNA, 20 bp, Artificial Sequence
  chemically synthesized
cagaagtagaccctgagaca

SEQ ID NO: 153897 - DNA, 20 bp, Artificial Sequence
  chemically synthesized
gtatttaaatccttgtctca

SEQ ID NO: 153898 - DNA, 20 bp, Artificial Sequence
  chemically synthesized
tgtatttaaatccttgtctc

SEQ ID NO: 153899 - DNA, 20 bp, Artificial Sequence
  chemically synthesized
ttgtatttaaatccttgtct

SEQ ID NO: 153900 - DNA, 20 bp, Artificial Sequence
  chemically synthesized
ttaaatacaaataattcaat

SEQ ID NO: 153901 - DNA, 20 bp, Artificial Sequence
  chemically synthesized
taaatacaaataattcaatt

SEQ ID NO: 153902 - DNA, 20 bp, Artificial Sequence
  chemically synthesized
aatacaaataattcaattgg

SEQ ID NO: 153903 - DNA, 20 bp, Artificial Sequence
  chemically synthesized
attcaattgggagctgatcc

SEQ ID NO: 153904 - DNA, 20 bp, Artificial Sequence
  chemically synthesized
ctaccatggctttctgggat

SEQ ID NO: 153905 - DNA, 20 bp, Artificial Sequence
  chemically synthesized
aattgggagctgatcccaga

SEQ ID NO: 153906 - DNA, 20 bp, Artificial Sequence
  chemically synthesized
ctcttctaccatggctttct

SEQ ID NO: 153907 - DNA, 20 bp, Artificial Sequence
  chemically synthesized
tctcttctaccatggctttc

SEQ ID NO: 153908 - DNA, 20 bp, Artificial Sequence
  chemically synthesized
gagctgatcccagaaagcca

SEQ ID NO: 153909 - DNA, 20 bp, Artificial Sequence
  chemically synthesized
ctgatcccagaaagccatgg

SEQ ID NO: 153910 - DNA, 20 bp, Artificial Sequence
  chemically synthesized
atcccagaaagccatggtag

SEQ ID NO: 153911 - DNA, 20 bp, Artificial Sequence
  chemically synthesized
ctctatcttctcttctacca

SEQ ID NO: 153912 - DNA, 20 bp, Artificial Sequence
  chemically synthesized
cccagaaagccatggtagaa

SEQ ID NO: 153913 - DNA, 20 bp, Artificial Sequence
  chemically synthesized
agaaagccatggtagaagag

SEQ ID NO: 153914 - DNA, 20 bp, Artificial Sequence
  chemically synthesized
agccatggtagaagagaaga

SEQ ID NO: 153915 - DNA, 20 bp, Artificial Sequence
  chemically synthesized
ccatggtagaagagaagata

SEQ ID NO: 153916 - DNA, 20 bp, Artificial Sequence
  chemically synthesized
tagaagagaagatagagctg

SEQ ID NO: 153917 - DNA, 20 bp, Artificial Sequence
  chemically synthesized
gaagagaagatagagctgca

SEQ ID NO: 153918 - DNA, 20 bp, Artificial Sequence
  chemically synthesized
tatatgtatcttcagctctg

SEQ ID NO: 153919 - DNA, 20 bp, Artificial Sequence
  chemically synthesized
aagatagagctgcagagctg

SEQ ID NO: 153920 - DNA, 20 bp, Artificial Sequence
  chemically synthesized
gacagatatatatgtatctt

SEQ ID NO: 153921 - DNA, 20 bp, Artificial Sequence
  chemically synthesized
gaagatacatatatatctgt

SEQ ID NO: 153922 - DNA, 20 bp, Artificial Sequence
  chemically synthesized
ccctgctgagatacaactga

SEQ ID NO: 153923 - DNA, 20 bp, Artificial Sequence
  chemically synthesized
tatatctgtcagttgtatct

SEQ ID NO: 153924 - DNA, 20 bp, Artificial Sequence
  chemically synthesized
atctgtcagttgtatctcag

SEQ ID NO: 153925 - DNA, 20 bp, Artificial Sequence
  chemically synthesized
tctgtcagttgtatctcagc

SEQ ID NO: 153926 - DNA, 20 bp, Artificial Sequence
  chemically synthesized
ctgtcagttgtatctcagca

SEQ ID NO: 153927 - DNA, 20 bp, Artificial Sequence
  chemically synthesized
tctcaactttgttccctgct

SEQ ID NO: 153928 - DNA, 20 bp, Artificial Sequence
  chemically synthesized
ttgtatctcagcagggaaca

SEQ ID NO: 153929 - DNA, 20 bp, Artificial Sequence
  chemically synthesized
tctcagcagggaacaaagtt

SEQ ID NO: 153930 - DNA, 20 bp, Artificial Sequence
  chemically synthesized
ggaacaaagttgagatatat

SEQ ID NO: 153931 - DNA, 20 bp, Artificial Sequence
  chemically synthesized
tgagatatatgagaatactg

SEQ ID NO: 153932 - DNA, 20 bp, Artificial Sequence
  chemically synthesized
agatatatgagaatactgaa

SEQ ID NO: 153933 - DNA, 20 bp, Artificial Sequence
  chemically synthesized
gatatatgagaatactgaag

SEQ ID NO: 153934 - DNA, 20 bp, Artificial Sequence
  chemically synthesized
agtttgatttcagtcctctt

SEQ ID NO: 153935 - DNA, 20 bp, Artificial Sequence
  chemically synthesized
acatctcctgagtttgattt

SEQ ID NO: 153936 - DNA, 20 bp, Artificial Sequence
  chemically synthesized
aagaggactgaaatcaaact

SEQ ID NO: 153937 - DNA, 20 bp, Artificial Sequence
  chemically synthesized
agaggactgaaatcaaactc

SEQ ID NO: 153938 - DNA, 20 bp, Artificial Sequence
  chemically synthesized
aggactgaaatcaaactcag

SEQ ID NO: 153939 - DNA, 20 bp, Artificial Sequence
  chemically synthesized
gacccaaccccacatctcct

SEQ ID NO: 153940 - DNA, 20 bp, Artificial Sequence
  chemically synthesized
gaaatcaaactcaggagatg

SEQ ID NO: 153941 - DNA, 20 bp, Artificial Sequence
  chemically synthesized
aaatcaaactcaggagatgt

SEQ ID NO: 153942 - DNA, 20 bp, Artificial Sequence
  chemically synthesized
aatcaaactcaggagatgtg

SEQ ID NO: 153943 - DNA, 20 bp, Artificial Sequence
  chemically synthesized
aaactcaggagatgtggggt

SEQ ID NO: 153944 - DNA, 20 bp, Artificial Sequence
  chemically synthesized
aactcaggagatgtggggtt

SEQ ID NO: 153945 - DNA, 20 bp, Artificial Sequence
  chemically synthesized
aggagatgtggggttgggtc

SEQ ID NO: 153946 - DNA, 20 bp, Artificial Sequence
  chemically synthesized
cttcccattttggcagaatc

SEQ ID NO: 153947 - DNA, 20 bp, Artificial Sequence
  chemically synthesized
gggtccagattctgccaaaa

SEQ ID NO: 153948 - DNA, 20 bp, Artificial Sequence
  chemically synthesized
ggtccagattctgccaaaat

SEQ ID NO: 153949 - DNA, 20 bp, Artificial Sequence
  chemically synthesized
aggctttcttcccattttgg

SEQ ID NO: 153950 - DNA, 20 bp, Artificial Sequence
  chemically synthesized
ccagattctgccaaaatggg

SEQ ID NO: 153951 - DNA, 20 bp, Artificial Sequence
  chemically synthesized
tgtaggctttcttcccattt

SEQ ID NO: 153952 - DNA, 20 bp, Artificial Sequence
  chemically synthesized
attctgccaaaatgggaaga

SEQ ID NO: 153953 - DNA, 20 bp, Artificial Sequence
  chemically synthesized
tgggaagaaagcctacacat

SEQ ID NO: 153954 - DNA, 20 bp, Artificial Sequence
  chemically synthesized
taggcttccttccgatgtgt

SEQ ID NO: 153955 - DNA, 20 bp, Artificial Sequence
  chemically synthesized
ataggcttccttccgatgtg

SEQ ID NO: 153956 - DNA, 20 bp, Artificial Sequence
  chemically synthesized
gaagaaagcctacacatcgg

SEQ ID NO: 153957 - DNA, 20 bp, Artificial Sequence
  chemically synthesized
aagaaagcctacacatcgga

SEQ ID NO: 153958 - DNA, 20 bp, Artificial Sequence
  chemically synthesized
aaagcctacacatcggaagg

SEQ ID NO: 153959 - DNA, 20 bp, Artificial Sequence
  chemically synthesized
catcggaaggaagcctatac

SEQ ID NO: 153960 - DNA, 20 bp, Artificial Sequence
  chemically synthesized
atcggaaggaagcctatacg

SEQ ID NO: 153961 - DNA, 20 bp, Artificial Sequence
  chemically synthesized
cttattagcatgcctcgtat

SEQ ID NO: 153962 - DNA, 20 bp, Artificial Sequence
  chemically synthesized
acttattagcatgcctcgta

SEQ ID NO: 153963 - DNA, 20 bp, Artificial Sequence
  chemically synthesized
cctatacgaggcatgctaat

SEQ ID NO: 153964 - DNA, 20 bp, Artificial Sequence
  chemically synthesized
acaatgataagcatacttat

SEQ ID NO: 153965 - DNA, 20 bp, Artificial Sequence
  chemically synthesized
aataagtatgcttatcattg

SEQ ID NO: 153966 - DNA, 20 bp, Artificial Sequence
  chemically synthesized
gggcagttgaccacaatgat

SEQ ID NO: 153967 - DNA, 20 bp, Artificial Sequence
  chemically synthesized
aaaatctccagtgaattggg

SEQ ID NO: 153968 - DNA, 20 bp, Artificial Sequence
  chemically synthesized
tggtcaactgcccaattcac

SEQ ID NO: 153969 - DNA, 20 bp, Artificial Sequence
  chemically synthesized
ctaaaaatctccagtgaatt

SEQ ID NO: 153970 - DNA, 20 bp, Artificial Sequence
  chemically synthesized
actaaaaatctccagtgaat

SEQ ID NO: 153971 - DNA, 20 bp, Artificial Sequence
  chemically synthesized
gtcaactgcccaattcactg

SEQ ID NO: 153972 - DNA, 20 bp, Artificial Sequence
  chemically synthesized
tgttccacactaaaaatctc

SEQ ID NO: 153973 - DNA, 20 bp, Artificial Sequence
  chemically synthesized
cccaattcactggagatttt

SEQ ID NO: 153974 - DNA, 20 bp, Artificial Sequence
  chemically synthesized
ttcactggagatttttagtg

SEQ ID NO: 153975 - DNA, 20 bp, Artificial Sequence
  chemically synthesized
ttttagtgtggaacatgcat

SEQ ID NO: 153976 - DNA, 20 bp, Artificial Sequence
  chemically synthesized
ttagtgtggaacatgcattg

SEQ ID NO: 153977 - DNA, 20 bp, Artificial Sequence
  chemically synthesized
tagtgtggaacatgcattgg

SEQ ID NO: 153978 - DNA, 20 bp, Artificial Sequence
  chemically synthesized
gcattggaggtgtcctaccc

SEQ ID NO: 153979 - DNA, 20 bp, Artificial Sequence
  chemically synthesized
cattggaggtgtcctaccca

SEQ ID NO: 153980 - DNA, 20 bp, Artificial Sequence
  chemically synthesized
attggaggtgtcctacccaa

SEQ ID NO: 153981 - DNA, 20 bp, Artificial Sequence
  chemically synthesized
ttggaggtgtcctacccaag

SEQ ID NO: 153982 - DNA, 20 bp, Artificial Sequence
  chemically synthesized
accttcttctccccttgggt

SEQ ID NO: 153983 - DNA, 20 bp, Artificial Sequence
  chemically synthesized
caccttcttctccccttggg

SEQ ID NO: 153984 - DNA, 20 bp, Artificial Sequence
  chemically synthesized
ggaggtgtcctacccaaggg

SEQ ID NO: 153985 - DNA, 20 bp, Artificial Sequence
  chemically synthesized
tcccaccttcttctcccctt

SEQ ID NO: 153986 - DNA, 20 bp, Artificial Sequence
  chemically synthesized
ggtgtcctacccaaggggag

SEQ ID NO: 153987 - DNA, 20 bp, Artificial Sequence
  chemically synthesized
atcccaccttcttctcccct

SEQ ID NO: 153988 - DNA, 20 bp, Artificial Sequence
  chemically synthesized
gtcctacccaaggggagaag

SEQ ID NO: 153989 - DNA, 20 bp, Artificial Sequence
  chemically synthesized
tcctacccaaggggagaaga

SEQ ID NO: 153990 - DNA, 20 bp, Artificial Sequence
  chemically synthesized
tacccaaggggagaagaagg

SEQ ID NO: 153991 - DNA, 20 bp, Artificial Sequence
  chemically synthesized
acccaaggggagaagaaggt

SEQ ID NO: 153992 - DNA, 20 bp, Artificial Sequence
  chemically synthesized
aggtgggatatttattgata

SEQ ID NO: 153993 - DNA, 20 bp, Artificial Sequence
  chemically synthesized
ggatatttattgatatggtt

SEQ ID NO: 153994 - DNA, 20 bp, Artificial Sequence
  chemically synthesized
atgagatttgggtgagaaca

SEQ ID NO: 153995 - DNA, 20 bp, Artificial Sequence
  chemically synthesized
attcaagatgagatttgggt

SEQ ID NO: 153996 - DNA, 20 bp, Artificial Sequence
  chemically synthesized
tacaattcaagatgagattt

SEQ ID NO: 153997 - DNA, 20 bp, Artificial Sequence
  chemically synthesized
ttacaattcaagatgagatt

SEQ ID NO: 153998 - DNA, 20 bp, Artificial Sequence
  chemically synthesized
ttggagttacaattcaagat

SEQ ID NO: 153999 - DNA, 20 bp, Artificial Sequence
  chemically synthesized
gattattggagttacaattc

SEQ ID NO: 154000 - DNA, 20 bp, Artificial Sequence
  chemically synthesized
acaacacgtggggattattg

SEQ ID NO: 154001 - DNA, 20 bp, Artificial Sequence
  chemically synthesized
ccacaacacgtggggattat

SEQ ID NO: 154002 - DNA, 20 bp, Artificial Sequence
  chemically synthesized
ggtccctcccacaacacgtg

SEQ ID NO: 154003 - DNA, 20 bp, Artificial Sequence
  chemically synthesized
tggtccctcccacaacacgt

SEQ ID NO: 154004 - DNA, 20 bp, Artificial Sequence
  chemically synthesized
ccaataatccccacgtgttg

SEQ ID NO: 154005 - DNA, 20 bp, Artificial Sequence
  chemically synthesized
atggtccctcccacaacacg

SEQ ID NO: 154006 - DNA, 20 bp, Artificial Sequence
  chemically synthesized
caataatccccacgtgttgt

SEQ ID NO: 154007 - DNA, 20 bp, Artificial Sequence
  chemically synthesized
ataatccccacgtgttgtgg

SEQ ID NO: 154008 - DNA, 20 bp, Artificial Sequence
  chemically synthesized
taatccccacgtgttgtggg

SEQ ID NO: 154009 - DNA, 20 bp, Artificial Sequence
  chemically synthesized
aatccccacgtgttgtggga

SEQ ID NO: 154010 - DNA, 20 bp, Artificial Sequence
  chemically synthesized
gtgttgtgggagggaccatg

SEQ ID NO: 154011 - DNA, 20 bp, Artificial Sequence
  chemically synthesized
tgttgtgggagggaccatgt

SEQ ID NO: 154012 - DNA, 20 bp, Artificial Sequence
  chemically synthesized
ttgtgggagggaccatgtgg

SEQ ID NO: 154013 - DNA, 20 bp, Artificial Sequence
  chemically synthesized
tgtgggagggaccatgtggg

SEQ ID NO: 154014 - DNA, 20 bp, Artificial Sequence
  chemically synthesized
tgattcagttacctcccaca

SEQ ID NO: 154015 - DNA, 20 bp, Artificial Sequence
  chemically synthesized
tgtgggaggtaactgaatca

SEQ ID NO: 154016 - DNA, 20 bp, Artificial Sequence
  chemically synthesized
gtgggaggtaactgaatcat

SEQ ID NO: 154017 - DNA, 20 bp, Artificial Sequence
  chemically synthesized
tgggaggtaactgaatcatg

SEQ ID NO: 154018 - DNA, 20 bp, Artificial Sequence
  chemically synthesized
aaaaccccacccccatgatt

SEQ ID NO: 154019 - DNA, 20 bp, Artificial Sequence
  chemically synthesized
gggaggtaactgaatcatgg

SEQ ID NO: 154020 - DNA, 20 bp, Artificial Sequence
  chemically synthesized
aggtaactgaatcatggggg

SEQ ID NO: 154021 - DNA, 20 bp, Artificial Sequence
  chemically synthesized
ggtaactgaatcatgggggt

SEQ ID NO: 154022 - DNA, 20 bp, Artificial Sequence
  chemically synthesized
gtaactgaatcatgggggtg

SEQ ID NO: 154023 - DNA, 20 bp, Artificial Sequence
  chemically synthesized
cactatcaggagaacagcac

SEQ ID NO: 154024 - DNA, 20 bp, Artificial Sequence
  chemically synthesized
tcactatcaggagaacagca

SEQ ID NO: 154025 - DNA, 20 bp, Artificial Sequence
  chemically synthesized
cttattcactatcaggagaa

SEQ ID NO: 154026 - DNA, 20 bp, Artificial Sequence
  chemically synthesized
ttcctgtgctgttctcctga

SEQ ID NO: 154027 - DNA, 20 bp, Artificial Sequence
  chemically synthesized
tgagacttattcactatcag

SEQ ID NO: 154028 - DNA, 20 bp, Artificial Sequence
  chemically synthesized
catgagacttattcactatc

SEQ ID NO: 154029 - DNA, 20 bp, Artificial Sequence
  chemically synthesized
tcatgagacttattcactat

SEQ ID NO: 154030 - DNA, 20 bp, Artificial Sequence
  chemically synthesized
ctgttctcctgatagtgaat

SEQ ID NO: 154031 - DNA, 20 bp, Artificial Sequence
  chemically synthesized
tgatagtgaataagtctcat

SEQ ID NO: 154032 - DNA, 20 bp, Artificial Sequence
  chemically synthesized
ataaaaccatcagatctcat

SEQ ID NO: 154033 - DNA, 20 bp, Artificial Sequence
  chemically synthesized
ataagtctcatgagatctga

SEQ ID NO: 154034 - DNA, 20 bp, Artificial Sequence
  chemically synthesized
actgctctttataaaaccat

SEQ ID NO: 154035 - DNA, 20 bp, Artificial Sequence
  chemically synthesized
tgagatctgatggttttata

SEQ ID NO: 154036 - DNA, 20 bp, Artificial Sequence
  chemically synthesized
agatctgatggttttataaa

SEQ ID NO: 154037 - DNA, 20 bp, Artificial Sequence
  chemically synthesized
tctgatggttttataaagag

SEQ ID NO: 154038 - DNA, 20 bp, Artificial Sequence
  chemically synthesized
caggcaagagagcatgtgca

SEQ ID NO: 154039 - DNA, 20 bp, Artificial Sequence
  chemically synthesized
gcaggcaagagagcatgtgc

SEQ ID NO: 154040 - DNA, 20 bp, Artificial Sequence
  chemically synthesized
agcaggcaagagagcatgtg

SEQ ID NO: 154041 - DNA, 20 bp, Artificial Sequence
  chemically synthesized
ttacatgacagcaggcaaga

SEQ ID NO: 154042 - DNA, 20 bp, Artificial Sequence
  chemically synthesized
tcttacatgacagcaggcaa

SEQ ID NO: 154043 - DNA, 20 bp, Artificial Sequence
  chemically synthesized
cttcttacatgacagcaggc

SEQ ID NO: 154044 - DNA, 20 bp, Artificial Sequence
  chemically synthesized
ggcacttcttacatgacagc

SEQ ID NO: 154045 - DNA, 20 bp, Artificial Sequence
  chemically synthesized
aggcacttcttacatgacag

SEQ ID NO: 154046 - DNA, 20 bp, Artificial Sequence
  chemically synthesized
tctcttgcctgctgtcatgt

SEQ ID NO: 154047 - DNA, 20 bp, Artificial Sequence
  chemically synthesized
cagaggcacttcttacatga

SEQ ID NO: 154048 - DNA, 20 bp, Artificial Sequence
  chemically synthesized
cttgcctgctgtcatgtaag

SEQ ID NO: 154049 - DNA, 20 bp, Artificial Sequence
  chemically synthesized
agaaggcgaaggaagagcag

SEQ ID NO: 154050 - DNA, 20 bp, Artificial Sequence
  chemically synthesized
cagaaggcgaaggaagagca

SEQ ID NO: 154051 - DNA, 20 bp, Artificial Sequence
  chemically synthesized
ggcagaaggcgaaggaagag

SEQ ID NO: 154052 - DNA, 20 bp, Artificial Sequence
  chemically synthesized
catggcagaaggcgaaggaa

SEQ ID NO: 154053 - DNA, 20 bp, Artificial Sequence
  chemically synthesized
atcatggcagaaggcgaagg

SEQ ID NO: 154054 - DNA, 20 bp, Artificial Sequence
  chemically synthesized
acaatcatggcagaaggcga

SEQ ID NO: 154055 - DNA, 20 bp, Artificial Sequence
  chemically synthesized
cacaatcatggcagaaggcg

SEQ ID NO: 154056 - DNA, 20 bp, Artificial Sequence
  chemically synthesized
ggcctcacaatcatggcaga

SEQ ID NO: 154057 - DNA, 20 bp, Artificial Sequence
  chemically synthesized
aggcctcacaatcatggcag

SEQ ID NO: 154058 - DNA, 20 bp, Artificial Sequence
  chemically synthesized
gagaggcctcacaatcatgg

SEQ ID NO: 154059 - DNA, 20 bp, Artificial Sequence
  chemically synthesized
tcgccttctgccatgattgt

SEQ ID NO: 154060 - DNA, 20 bp, Artificial Sequence
  chemically synthesized
ctggagaggcctcacaatca

SEQ ID NO: 154061 - DNA, 20 bp, Artificial Sequence
  chemically synthesized
cgccttctgccatgattgtg

SEQ ID NO: 154062 - DNA, 20 bp, Artificial Sequence
  chemically synthesized
ccatgattgtgaggcctctc

SEQ ID NO: 154063 - DNA, 20 bp, Artificial Sequence
  chemically synthesized
acagttccacatggctggag

SEQ ID NO: 154064 - DNA, 20 bp, Artificial Sequence
  chemically synthesized
cacagttccacatggctgga

SEQ ID NO: 154065 - DNA, 20 bp, Artificial Sequence
  chemically synthesized
ctcacagttccacatggctg

SEQ ID NO: 154066 - DNA, 20 bp, Artificial Sequence
  chemically synthesized
gtgaggcctctccagccatg

SEQ ID NO: 154067 - DNA, 20 bp, Artificial Sequence
  chemically synthesized
gactcacagttccacatggc

SEQ ID NO: 154068 - DNA, 20 bp, Artificial Sequence
  chemically synthesized
aatggactcacagttccaca

SEQ ID NO: 154069 - DNA, 20 bp, Artificial Sequence
  chemically synthesized
ctccagccatgtggaactgt

SEQ ID NO: 154070 - DNA, 20 bp, Artificial Sequence
  chemically synthesized
aaagaagtttaatggactca

SEQ ID NO: 154071 - DNA, 20 bp, Artificial Sequence
  chemically synthesized
tacaggaaaaagaagtttaa

SEQ ID NO: 154072 - DNA, 20 bp, Artificial Sequence
  chemically synthesized
ataatttatacaggaaaaag

SEQ ID NO: 154073 - DNA, 20 bp, Artificial Sequence
  chemically synthesized
tggataatttatacaggaaa

SEQ ID NO: 154074 - DNA, 20 bp, Artificial Sequence
  chemically synthesized
cgagactggataatttatac

SEQ ID NO: 154075 - DNA, 20 bp, Artificial Sequence
  chemically synthesized
ccgagactggataatttata

SEQ ID NO: 154076 - DNA, 20 bp, Artificial Sequence
  chemically synthesized
tttttcctgtataaattatc

SEQ ID NO: 154077 - DNA, 20 bp, Artificial Sequence
  chemically synthesized
ctgtataaattatccagtct

SEQ ID NO: 154078 - DNA, 20 bp, Artificial Sequence
  chemically synthesized
tgtataaattatccagtctc

SEQ ID NO: 154079 - DNA, 20 bp, Artificial Sequence
  chemically synthesized
tatgaagaaatacccgagac

SEQ ID NO: 154080 - DNA, 20 bp, Artificial Sequence
  chemically synthesized
actgctatgaagaaataccc

SEQ ID NO: 154081 - DNA, 20 bp, Artificial Sequence
  chemically synthesized
cagtctcgggtatttcttca

SEQ ID NO: 154082 - DNA, 20 bp, Artificial Sequence
  chemically synthesized
tctcgggtatttcttcatag

SEQ ID NO: 154083 - DNA, 20 bp, Artificial Sequence
  chemically synthesized
atagttttcatactgctatg

SEQ ID NO: 154084 - DNA, 20 bp, Artificial Sequence
  chemically synthesized
atagcagtatgaaaactatg

SEQ ID NO: 154085 - DNA, 20 bp, Artificial Sequence
  chemically synthesized
gataaaggtgttggtcttca

SEQ ID NO: 154086 - DNA, 20 bp, Artificial Sequence
  chemically synthesized
aagctgggggataaaggtgt

SEQ ID NO: 154087 - DNA, 20 bp, Artificial Sequence
  chemically synthesized
ggacaaaagctgggggataa

SEQ ID NO: 154088 - DNA, 20 bp, Artificial Sequence
  chemically synthesized
agaccaacacctttatcccc

SEQ ID NO: 154089 - DNA, 20 bp, Artificial Sequence
  chemically synthesized
tggacaaaagctgggggata

SEQ ID NO: 154090 - DNA, 20 bp, Artificial Sequence
  chemically synthesized
aaccaatggacaaaagctgg

SEQ ID NO: 154091 - DNA, 20 bp, Artificial Sequence
  chemically synthesized
taaccaatggacaaaagctg

SEQ ID NO: 154092 - DNA, 20 bp, Artificial Sequence
  chemically synthesized
ttaaccaatggacaaaagct

SEQ ID NO: 154093 - DNA, 20 bp, Artificial Sequence
  chemically synthesized
cttaaccaatggacaaaagc

SEQ ID NO: 154094 - DNA, 20 bp, Artificial Sequence
  chemically synthesized
agcacttaaccaatggacaa

SEQ ID NO: 154095 - DNA, 20 bp, Artificial Sequence
  chemically synthesized
atcccccagcttttgtccat

SEQ ID NO: 154096 - DNA, 20 bp, Artificial Sequence
  chemically synthesized
ccagcttttgtccattggtt

SEQ ID NO: 154097 - DNA, 20 bp, Artificial Sequence
  chemically synthesized
ctggaatagcacttaaccaa

SEQ ID NO: 154098 - DNA, 20 bp, Artificial Sequence
  chemically synthesized
ccattggttaagtgctattc

SEQ ID NO: 154099 - DNA, 20 bp, Artificial Sequence
  chemically synthesized
attggttaagtgctattcca

SEQ ID NO: 154100 - DNA, 20 bp, Artificial Sequence
  chemically synthesized
ggaggagattatctctggaa

SEQ ID NO: 154101 - DNA, 20 bp, Artificial Sequence
  chemically synthesized
gctggggaggagattatctc

SEQ ID NO: 154102 - DNA, 20 bp, Artificial Sequence
  chemically synthesized
tccagagataatctcctccc

SEQ ID NO: 154103 - DNA, 20 bp, Artificial Sequence
  chemically synthesized
gcaggctggaagctggggag

SEQ ID NO: 154104 - DNA, 20 bp, Artificial Sequence
  chemically synthesized
gagcaggctggaagctgggg

SEQ ID NO: 154105 - DNA, 20 bp, Artificial Sequence
  chemically synthesized
agagcaggctggaagctggg

SEQ ID NO: 154106 - DNA, 20 bp, Artificial Sequence
  chemically synthesized
ataatctcctccccagcttc

SEQ ID NO: 154107 - DNA, 20 bp, Artificial Sequence
  chemically synthesized
gcagagcaggctggaagctg

SEQ ID NO: 154108 - DNA, 20 bp, Artificial Sequence
  chemically synthesized
tgcagagcaggctggaagct

SEQ ID NO: 154109 - DNA, 20 bp, Artificial Sequence
  chemically synthesized
ttgcagagcaggctggaagc

SEQ ID NO: 154110 - DNA, 20 bp, Artificial Sequence
  chemically synthesized
ccacttgcagagcaggctgg

SEQ ID NO: 154111 - DNA, 20 bp, Artificial Sequence
  chemically synthesized
ctcccacttgcagagcaggc

SEQ ID NO: 154112 - DNA, 20 bp, Artificial Sequence
  chemically synthesized
cagcttccagcctgctctgc

SEQ ID NO: 154113 - DNA, 20 bp, Artificial Sequence
  chemically synthesized
agctctcccacttgcagagc

SEQ ID NO: 154114 - DNA, 20 bp, Artificial Sequence
  chemically synthesized
tagctctcccacttgcagag

SEQ ID NO: 154115 - DNA, 20 bp, Artificial Sequence
  chemically synthesized
cttccagcctgctctgcaag

SEQ ID NO: 154116 - DNA, 20 bp, Artificial Sequence
  chemically synthesized
ttccagcctgctctgcaagt

SEQ ID NO: 154117 - DNA, 20 bp, Artificial Sequence
  chemically synthesized
gagtagctctcccacttgca

SEQ ID NO: 154118 - DNA, 20 bp, Artificial Sequence
  chemically synthesized
ccagcctgctctgcaagtgg

SEQ ID NO: 154119 - DNA, 20 bp, Artificial Sequence
  chemically synthesized
aggagtagctctcccacttg

SEQ ID NO: 154120 - DNA, 20 bp, Artificial Sequence
  chemically synthesized
agcctgctctgcaagtggga

SEQ ID NO: 154121 - DNA, 20 bp, Artificial Sequence
  chemically synthesized
aagtgggagagctactccta

SEQ ID NO: 154122 - DNA, 20 bp, Artificial Sequence
  chemically synthesized
agtgggagagctactcctac

SEQ ID NO: 154123 - DNA, 20 bp, Artificial Sequence
  chemically synthesized
cctttctctgcctgtaggag

SEQ ID NO: 154124 - DNA, 20 bp, Artificial Sequence
  chemically synthesized
gggagagctactcctacagg

SEQ ID NO: 154125 - DNA, 20 bp, Artificial Sequence
  chemically synthesized
agtcctttctctgcctgtag

SEQ ID NO: 154126 - DNA, 20 bp, Artificial Sequence
  chemically synthesized
gagagctactcctacaggca

SEQ ID NO: 154127 - DNA, 20 bp, Artificial Sequence
  chemically synthesized
tgagtcctttctctgcctgt

SEQ ID NO: 154128 - DNA, 20 bp, Artificial Sequence
  chemically synthesized
ctgagtcctttctctgcctg

SEQ ID NO: 154129 - DNA, 20 bp, Artificial Sequence
  chemically synthesized
gctactcctacaggcagaga

SEQ ID NO: 154130 - DNA, 20 bp, Artificial Sequence
  chemically synthesized
ctactcctacaggcagagaa

SEQ ID NO: 154131 - DNA, 20 bp, Artificial Sequence
  chemically synthesized
ctacaggcagagaaaggact

SEQ ID NO: 154132 - DNA, 20 bp, Artificial Sequence
  chemically synthesized
tacaggcagagaaaggactc

SEQ ID NO: 154133 - DNA, 20 bp, Artificial Sequence
  chemically synthesized
aggcagagaaaggactcagg

SEQ ID NO: 154134 - DNA, 20 bp, Artificial Sequence
  chemically synthesized
aagtacctgtgagtcttcct

SEQ ID NO: 154135 - DNA, 20 bp, Artificial Sequence
  chemically synthesized
aaaggactcaggaagactca

SEQ ID NO: 154136 - DNA, 20 bp, Artificial Sequence
  chemically synthesized
aaggactcaggaagactcac

SEQ ID NO: 154137 - DNA, 20 bp, Artificial Sequence
  chemically synthesized
gtctaactacaagtacctgt

SEQ ID NO: 154138 - DNA, 20 bp, Artificial Sequence
  chemically synthesized
ggaagactcacaggtacttg

SEQ ID NO: 154139 - DNA, 20 bp, Artificial Sequence
  chemically synthesized
gactcacaggtacttgtagt

SEQ ID NO: 154140 - DNA, 20 bp, Artificial Sequence
  chemically synthesized
accatgaagcgtctaactac

SEQ ID NO: 154141 - DNA, 20 bp, Artificial Sequence
  chemically synthesized
acttgtagttagacgcttca

SEQ ID NO: 154142 - DNA, 20 bp, Artificial Sequence
  chemically synthesized
cagccttcctataaaccatg

SEQ ID NO: 154143 - DNA, 20 bp, Artificial Sequence
  chemically synthesized
gttagacgcttcatggttta

SEQ ID NO: 154144 - DNA, 20 bp, Artificial Sequence
  chemically synthesized
ttagacgcttcatggtttat

SEQ ID NO: 154145 - DNA, 20 bp, Artificial Sequence
  chemically synthesized
gacgcttcatggtttatagg

SEQ ID NO: 154146 - DNA, 20 bp, Artificial Sequence
  chemically synthesized
acgcttcatggtttatagga

SEQ ID NO: 154147 - DNA, 20 bp, Artificial Sequence
  chemically synthesized
tcatggtttataggaaggct

SEQ ID NO: 154148 - DNA, 20 bp, Artificial Sequence
  chemically synthesized
ttataggaaggctgagtgct

SEQ ID NO: 154149 - DNA, 20 bp, Artificial Sequence
  chemically synthesized
tataggaaggctgagtgcta

SEQ ID NO: 154150 - DNA, 20 bp, Artificial Sequence
  chemically synthesized
acccatttccccttagcact

SEQ ID NO: 154151 - DNA, 20 bp, Artificial Sequence
  chemically synthesized
ataggaaggctgagtgctaa

SEQ ID NO: 154152 - DNA, 20 bp, Artificial Sequence
  chemically synthesized
taggaaggctgagtgctaag

SEQ ID NO: 154153 - DNA, 20 bp, Artificial Sequence
  chemically synthesized
gtgggctacccatttcccct

SEQ ID NO: 154154 - DNA, 20 bp, Artificial Sequence
  chemically synthesized
ggctgagtgctaaggggaaa

SEQ ID NO: 154155 - DNA, 20 bp, Artificial Sequence
  chemically synthesized
gctgagtgctaaggggaaat

SEQ ID NO: 154156 - DNA, 20 bp, Artificial Sequence
  chemically synthesized
gagtgctaaggggaaatggg

SEQ ID NO: 154157 - DNA, 20 bp, Artificial Sequence
  chemically synthesized
ggggaaatgggtagcccact

SEQ ID NO: 154158 - DNA, 20 bp, Artificial Sequence
  chemically synthesized
gggaaatgggtagcccacta

SEQ ID NO: 154159 - DNA, 20 bp, Artificial Sequence
  chemically synthesized
ggaaatgggtagcccactaa

SEQ ID NO: 154160 - DNA, 20 bp, Artificial Sequence
  chemically synthesized
agatagatttgacccttagt

SEQ ID NO: 154161 - DNA, 20 bp, Artificial Sequence
  chemically synthesized
aagatagatttgacccttag

SEQ ID NO: 154162 - DNA, 20 bp, Artificial Sequence
  chemically synthesized
ggtaagatagatttgaccct

SEQ ID NO: 154163 - DNA, 20 bp, Artificial Sequence
  chemically synthesized
cagaaacgaggcaggtaaga

SEQ ID NO: 154164 - DNA, 20 bp, Artificial Sequence
  chemically synthesized
tttacagaaacgaggcaggt

SEQ ID NO: 154165 - DNA, 20 bp, Artificial Sequence
  chemically synthesized
tttatttacagaaacgaggc

SEQ ID NO: 154166 - DNA, 20 bp, Artificial Sequence
  chemically synthesized
ctttatttacagaaacgagg

SEQ ID NO: 154167 - DNA, 20 bp, Artificial Sequence
  chemically synthesized
acactttatttacagaaacg

SEQ ID NO: 154168 - DNA, 20 bp, Artificial Sequence
  chemically synthesized
gacactttatttacagaaac

SEQ ID NO: 154169 - DNA, 20 bp, Artificial Sequence
  chemically synthesized
ctgcctcgtttctgtaaata

SEQ ID NO: 154170 - DNA, 20 bp, Artificial Sequence
  chemically synthesized
ctccagtgacactttattta

SEQ ID NO: 154171 - DNA, 20 bp, Artificial Sequence
  chemically synthesized
ttctgtaaataaagtgtcac

SEQ ID NO: 154172 - DNA, 20 bp, Artificial Sequence
  chemically synthesized
ctgtaaataaagtgtcactg

SEQ ID NO: 154173 - DNA, 20 bp, Artificial Sequence
  chemically synthesized
aataaagtgtcactggagca

SEQ ID NO: 154174 - DNA, 20 bp, Artificial Sequence
  chemically synthesized
aaagggacatggctgtgctc

SEQ ID NO: 154175 - DNA, 20 bp, Artificial Sequence
  chemically synthesized
aatacctaaataaagggaca

SEQ ID NO: 154176 - DNA, 20 bp, Artificial Sequence
  chemically synthesized
cacagccatgtccctttatt

SEQ ID NO: 154177 - DNA, 20 bp, Artificial Sequence
  chemically synthesized
acagccatgtccctttattt

SEQ ID NO: 154178 - DNA, 20 bp, Artificial Sequence
  chemically synthesized
acagacaatacctaaataaa

SEQ ID NO: 154179 - DNA, 20 bp, Artificial Sequence
  chemically synthesized
cacagacaatacctaaataa

SEQ ID NO: 154180 - DNA, 20 bp, Artificial Sequence
  chemically synthesized
ccacagacaatacctaaata

SEQ ID NO: 154181 - DNA, 20 bp, Artificial Sequence
  chemically synthesized
ctttatttaggtattgtctg

SEQ ID NO: 154182 - DNA, 20 bp, Artificial Sequence
  chemically synthesized
taggtattgtctgtggcttt

SEQ ID NO: 154183 - DNA, 20 bp, Artificial Sequence
  chemically synthesized
tcattgtatactaaaagcca

SEQ ID NO: 154184 - DNA, 20 bp, Artificial Sequence
  chemically synthesized
actctgtcattgtatactaa

SEQ ID NO: 154185 - DNA, 20 bp, Artificial Sequence
  chemically synthesized
tggcttttagtatacaatga

SEQ ID NO: 154186 - DNA, 20 bp, Artificial Sequence
  chemically synthesized
gcttttagtatacaatgaca

SEQ ID NO: 154187 - DNA, 20 bp, Artificial Sequence
  chemically synthesized
tttctgctttatgggtcatg

SEQ ID NO: 154188 - DNA, 20 bp, Artificial Sequence
  chemically synthesized
agttgaccacatgacccata

SEQ ID NO: 154189 - DNA, 20 bp, Artificial Sequence
  chemically synthesized
tgaccacatgacccataaag

SEQ ID NO: 154190 - DNA, 20 bp, Artificial Sequence
  chemically synthesized
ctagatattttctgctttat

SEQ ID NO: 154191 - DNA, 20 bp, Artificial Sequence
  chemically synthesized
actagatattttctgcttta

SEQ ID NO: 154192 - DNA, 20 bp, Artificial Sequence
  chemically synthesized
cccataaagcagaaaatatc

SEQ ID NO: 154193 - DNA, 20 bp, Artificial Sequence
  chemically synthesized
aagcagaaaatatctagtat

SEQ ID NO: 154194 - DNA, 20 bp, Artificial Sequence
  chemically synthesized
tttctgcaaaggaccgatac

SEQ ID NO: 154195 - DNA, 20 bp, Artificial Sequence
  chemically synthesized
tatctagtatcggtcctttg

SEQ ID NO: 154196 - DNA, 20 bp, Artificial Sequence
  chemically synthesized
tcaacagactgtttctgcaa

SEQ ID NO: 154197 - DNA, 20 bp, Artificial Sequence
  chemically synthesized
atcaacagactgtttctgca

SEQ ID NO: 154198 - DNA, 20 bp, Artificial Sequence
  chemically synthesized
gtatcggtcctttgcagaaa

SEQ ID NO: 154199 - DNA, 20 bp, Artificial Sequence
  chemically synthesized
ccaactatataagggatcaa

SEQ ID NO: 154200 - DNA, 20 bp, Artificial Sequence
  chemically synthesized
cagtctgttgatcccttata

SEQ ID NO: 154201 - DNA, 20 bp, Artificial Sequence
  chemically synthesized
ttgtgctaccaactatataa

SEQ ID NO: 154202 - DNA, 20 bp, Artificial Sequence
  chemically synthesized
gttgtgctaccaactatata

SEQ ID NO: 154203 - DNA, 20 bp, Artificial Sequence
  chemically synthesized
ctgttgatcccttatatagt

SEQ ID NO: 154204 - DNA, 20 bp, Artificial Sequence
  chemically synthesized
agttgtgctaccaactatat

SEQ ID NO: 154205 - DNA, 20 bp, Artificial Sequence
  chemically synthesized
ttgatcccttatatagttgg

SEQ ID NO: 154206 - DNA, 20 bp, Artificial Sequence
  chemically synthesized
atatagttggtagcacaact

SEQ ID NO: 154207 - DNA, 20 bp, Artificial Sequence
  chemically synthesized
tggtagcacaactgagatat

SEQ ID NO: 154208 - DNA, 20 bp, Artificial Sequence
  chemically synthesized
aagcctaaattctgatatct

SEQ ID NO: 154209 - DNA, 20 bp, Artificial Sequence
  chemically synthesized
acaactgagatatcagaatt

SEQ ID NO: 154210 - DNA, 20 bp, Artificial Sequence
  chemically synthesized
caactgagatatcagaattt

SEQ ID NO: 154211 - DNA, 20 bp, Artificial Sequence
  chemically synthesized
gcacagtattggaggtcaag

SEQ ID NO: 154212 - DNA, 20 bp, Artificial Sequence
  chemically synthesized
aaagcacagtattggaggtc

SEQ ID NO: 154213 - DNA, 20 bp, Artificial Sequence
  chemically synthesized
ttaggaaagcacagtattgg

SEQ ID NO: 154214 - DNA, 20 bp, Artificial Sequence
  chemically synthesized
attaggaaagcacagtattg

SEQ ID NO: 154215 - DNA, 20 bp, Artificial Sequence
  chemically synthesized
taattaggaaagcacagtat

SEQ ID NO: 154216 - DNA, 20 bp, Artificial Sequence
  chemically synthesized
caagtgtaattaggaaagca

SEQ ID NO: 154217 - DNA, 20 bp, Artificial Sequence
  chemically synthesized
agtctcaagtgtaattagga

SEQ ID NO: 154218 - DNA, 20 bp, Artificial Sequence
  chemically synthesized
agcaagtctcaagtgtaatt

SEQ ID NO: 154219 - DNA, 20 bp, Artificial Sequence
  chemically synthesized
gagcaagtctcaagtgtaat

SEQ ID NO: 154220 - DNA, 20 bp, Artificial Sequence
  chemically synthesized
gtgctttcctaattacactt

SEQ ID NO: 154221 - DNA, 20 bp, Artificial Sequence
  chemically synthesized
gtttggagagagcaagtctc

SEQ ID NO: 154222 - DNA, 20 bp, Artificial Sequence
  chemically synthesized
taattaagtttggagagagc

SEQ ID NO: 154223 - DNA, 20 bp, Artificial Sequence
  chemically synthesized
cctgtaattaagtttggaga

SEQ ID NO: 154224 - DNA, 20 bp, Artificial Sequence
  chemically synthesized
ttcctgtaattaagtttgga

SEQ ID NO: 154225 - DNA, 20 bp, Artificial Sequence
  chemically synthesized
tcttcctgtaattaagtttg

SEQ ID NO: 154226 - DNA, 20 bp, Artificial Sequence
  chemically synthesized
tctcttcctgtaattaagtt

SEQ ID NO: 154227 - DNA, 20 bp, Artificial Sequence
  chemically synthesized
gctctctccaaacttaatta

SEQ ID NO: 154228 - DNA, 20 bp, Artificial Sequence
  chemically synthesized
ctctctccaaacttaattac

SEQ ID NO: 154229 - DNA, 20 bp, Artificial Sequence
  chemically synthesized
aatcatctcttcctgtaatt

SEQ ID NO: 154230 - DNA, 20 bp, Artificial Sequence
  chemically synthesized
tctccaaacttaattacagg

SEQ ID NO: 154231 - DNA, 20 bp, Artificial Sequence
  chemically synthesized
tccaaacttaattacaggaa

SEQ ID NO: 154232 - DNA, 20 bp, Artificial Sequence
  chemically synthesized
acaggaagagatgattttac

SEQ ID NO: 154233 - DNA, 20 bp, Artificial Sequence
  chemically synthesized
ttttctagttgattaaacac

SEQ ID NO: 154234 - DNA, 20 bp, Artificial Sequence
  chemically synthesized
tttaccagtgtttaatcaac

SEQ ID NO: 154235 - DNA, 20 bp, Artificial Sequence
  chemically synthesized
gcgcccggcccagagttttc

SEQ ID NO: 154236 - DNA, 20 bp, Artificial Sequence
  chemically synthesized
tttaatcaactagaaaactc

SEQ ID NO: 154237 - DNA, 20 bp, Artificial Sequence
  chemically synthesized
ttaatcaactagaaaactct

SEQ ID NO: 154238 - DNA, 20 bp, Artificial Sequence
  chemically synthesized
tcaactagaaaactctgggc

SEQ ID NO: 154239 - DNA, 20 bp, Artificial Sequence
  chemically synthesized
caactagaaaactctgggcc

SEQ ID NO: 154240 - DNA, 20 bp, Artificial Sequence
  chemically synthesized
gagccaccgcgcccggccca

SEQ ID NO: 154241 - DNA, 20 bp, Artificial Sequence
  chemically synthesized
gtgagccaccgcgcccggcc

SEQ ID NO: 154242 - DNA, 20 bp, Artificial Sequence
  chemically synthesized
agaaaactctgggccgggcg

SEQ ID NO: 154243 - DNA, 20 bp, Artificial Sequence
  chemically synthesized
aaactctgggccgggcgcgg

SEQ ID NO: 154244 - DNA, 20 bp, Artificial Sequence
  chemically synthesized
caggcgtgagccaccgcgcc

SEQ ID NO: 154245 - DNA, 20 bp, Artificial Sequence
  chemically synthesized
agtgctgggattacaggcgt

SEQ ID NO: 154246 - DNA, 20 bp, Artificial Sequence
  chemically synthesized
gtggctcacgcctgtaatcc

SEQ ID NO: 154247 - DNA, 20 bp, Artificial Sequence
  chemically synthesized
ttccaaagtgctgggattac

SEQ ID NO: 154248 - DNA, 20 bp, Artificial Sequence
  chemically synthesized
cttccaaagtgctgggatta

SEQ ID NO: 154249 - DNA, 20 bp, Artificial Sequence
  chemically synthesized
cgcctgtaatcccagcactt

SEQ ID NO: 154250 - DNA, 20 bp, Artificial Sequence
  chemically synthesized
cctcggccttccaaagtgct

SEQ ID NO: 154251 - DNA, 20 bp, Artificial Sequence
  chemically synthesized
gcctcggccttccaaagtgc

SEQ ID NO: 154252 - DNA, 20 bp, Artificial Sequence
  chemically synthesized
ctgtaatcccagcactttgg

SEQ ID NO: 154253 - DNA, 20 bp, Artificial Sequence
  chemically synthesized
tgtaatcccagcactttgga

SEQ ID NO: 154254 - DNA, 20 bp, Artificial Sequence
  chemically synthesized
ccgcccgcctcggccttcca

SEQ ID NO: 154255 - DNA, 20 bp, Artificial Sequence
  chemically synthesized
tcccagcactttggaaggcc

SEQ ID NO: 154256 - DNA, 20 bp, Artificial Sequence
  chemically synthesized
cccagcactttggaaggccg

SEQ ID NO: 154257 - DNA, 20 bp, Artificial Sequence
  chemically synthesized
agcactttggaaggccgagg

SEQ ID NO: 154258 - DNA, 20 bp, Artificial Sequence
  chemically synthesized
gcactttggaaggccgaggc

SEQ ID NO: 154259 - DNA, 20 bp, Artificial Sequence
  chemically synthesized
ctttggaaggccgaggcggg

SEQ ID NO: 154260 - DNA, 20 bp, Artificial Sequence
  chemically synthesized
acctcgtgatccgcccgcct

SEQ ID NO: 154261 - DNA, 20 bp, Artificial Sequence
  chemically synthesized
ggccgaggcgggcggatcac

SEQ ID NO: 154262 - DNA, 20 bp, Artificial Sequence
  chemically synthesized
gccgaggcgggcggatcacg

SEQ ID NO: 154263 - DNA, 20 bp, Artificial Sequence
  chemically synthesized
aggcgggcggatcacgaggt

SEQ ID NO: 154264 - DNA, 20 bp, Artificial Sequence
  chemically synthesized
ggcgggcggatcacgaggtc

SEQ ID NO: 154265 - DNA, 20 bp, Artificial Sequence
  chemically synthesized
cgggcggatcacgaggtcag

SEQ ID NO: 154266 - DNA, 20 bp, Artificial Sequence
  chemically synthesized
gatcacgaggtcaggagatc

SEQ ID NO: 154267 - DNA, 20 bp, Artificial Sequence
  chemically synthesized
tcaggagatcgagaccatcc

SEQ ID NO: 154268 - DNA, 20 bp, Artificial Sequence
  chemically synthesized
tttcactgtgttagccagga

SEQ ID NO: 154269 - DNA, 20 bp, Artificial Sequence
  chemically synthesized
ggggtttcactgtgttagcc

SEQ ID NO: 154270 - DNA, 20 bp, Artificial Sequence
  chemically synthesized
cgagaccatcctggctaaca

SEQ ID NO: 154271 - DNA, 20 bp, Artificial Sequence
  chemically synthesized
cggggtttcactgtgttagc

SEQ ID NO: 154272 - DNA, 20 bp, Artificial Sequence
  chemically synthesized
gagacggggtttcactgtgt

SEQ ID NO: 154273 - DNA, 20 bp, Artificial Sequence
  chemically synthesized
tgtgttttttagtagagacg

SEQ ID NO: 154274 - DNA, 20 bp, Artificial Sequence
  chemically synthesized
ttgtgttttttagtagagac

SEQ ID NO: 154275 - DNA, 20 bp, Artificial Sequence
  chemically synthesized
tttgtgttttttagtagaga

SEQ ID NO: 154276 - DNA, 20 bp, Artificial Sequence
  chemically synthesized
tttttttgtgttttttagta

SEQ ID NO: 154277 - DNA, 20 bp, Artificial Sequence
  chemically synthesized
aatttttttgtgttttttag

SEQ ID NO: 154278 - DNA, 20 bp, Artificial Sequence
  chemically synthesized
gctaatttttttgtgttttt

SEQ ID NO: 154279 - DNA, 20 bp, Artificial Sequence
  chemically synthesized
actaaaaaacacaaaaaaat

SEQ ID NO: 154280 - DNA, 20 bp, Artificial Sequence
  chemically synthesized
aaaaacacaaaaaaattagc

SEQ ID NO: 154281 - DNA, 20 bp, Artificial Sequence
  chemically synthesized
aaaacacaaaaaaattagcc

SEQ ID NO: 154282 - DNA, 20 bp, Artificial Sequence
  chemically synthesized
acaaaaaaattagccgggcg

SEQ ID NO: 154283 - DNA, 20 bp, Artificial Sequence
  chemically synthesized
aaaaaattagccgggcgtgg

SEQ ID NO: 154284 - DNA, 20 bp, Artificial Sequence
  chemically synthesized
caggcgcccgccaccacgcc

SEQ ID NO: 154285 - DNA, 20 bp, Artificial Sequence
  chemically synthesized
aaattagccgggcgtggtgg

SEQ ID NO: 154286 - DNA, 20 bp, Artificial Sequence
  chemically synthesized
aattagccgggcgtggtggc

SEQ ID NO: 154287 - DNA, 20 bp, Artificial Sequence
  chemically synthesized
ggcgtggtggcgggcgcctg

SEQ ID NO: 154288 - DNA, 20 bp, Artificial Sequence
  chemically synthesized
gtggcgggcgcctgtagtcc

SEQ ID NO: 154289 - DNA, 20 bp, Artificial Sequence
  chemically synthesized
tcccccgtagctgggactac

SEQ ID NO: 154290 - DNA, 20 bp, Artificial Sequence
  chemically synthesized
ctcccccgtagctgggacta

SEQ ID NO: 154291 - DNA, 20 bp, Artificial Sequence
  chemically synthesized
ggcgcctgtagtcccagcta

SEQ ID NO: 154292 - DNA, 20 bp, Artificial Sequence
  chemically synthesized
gcgcctgtagtcccagctac

SEQ ID NO: 154293 - DNA, 20 bp, Artificial Sequence
  chemically synthesized
cgcctgtagtcccagctacg

SEQ ID NO: 154294 - DNA, 20 bp, Artificial Sequence
  chemically synthesized
cctcagcctcccccgtagct

SEQ ID NO: 154295 - DNA, 20 bp, Artificial Sequence
  chemically synthesized
gcctgtagtcccagctacgg

SEQ ID NO: 154296 - DNA, 20 bp, Artificial Sequence
  chemically synthesized
gcctcagcctcccccgtagc

SEQ ID NO: 154297 - DNA, 20 bp, Artificial Sequence
  chemically synthesized
ctgtagtcccagctacgggg

SEQ ID NO: 154298 - DNA, 20 bp, Artificial Sequence
  chemically synthesized
tgtagtcccagctacggggg

SEQ ID NO: 154299 - DNA, 20 bp, Artificial Sequence
  chemically synthesized
tcctgcctcagcctcccccg

SEQ ID NO: 154300 - DNA, 20 bp, Artificial Sequence
  chemically synthesized
tcccagctacgggggaggct

SEQ ID NO: 154301 - DNA, 20 bp, Artificial Sequence
  chemically synthesized
cccagctacgggggaggctg

SEQ ID NO: 154302 - DNA, 20 bp, Artificial Sequence
  chemically synthesized
agctacgggggaggctgagg

SEQ ID NO: 154303 - DNA, 20 bp, Artificial Sequence
  chemically synthesized
gctacgggggaggctgaggc

SEQ ID NO: 154304 - DNA, 20 bp, Artificial Sequence
  chemically synthesized
tacgggggaggctgaggcag

SEQ ID NO: 154305 - DNA, 20 bp, Artificial Sequence
  chemically synthesized
ttcacgccattctcctgcct

SEQ ID NO: 154306 - DNA, 20 bp, Artificial Sequence
  chemically synthesized
gggaggctgaggcaggagaa

SEQ ID NO: 154307 - DNA, 20 bp, Artificial Sequence
  chemically synthesized
gcaggagaatggcgtgaacc

SEQ ID NO: 154308 - DNA, 20 bp, Artificial Sequence
  chemically synthesized
caggagaatggcgtgaaccc

SEQ ID NO: 154309 - DNA, 20 bp, Artificial Sequence
  chemically synthesized
ggagaatggcgtgaacccgg

SEQ ID NO: 154310 - DNA, 20 bp, Artificial Sequence
  chemically synthesized
gagaatggcgtgaacccggg

SEQ ID NO: 154311 - DNA, 20 bp, Artificial Sequence
  chemically synthesized
aatggcgtgaacccgggagg

SEQ ID NO: 154312 - DNA, 20 bp, Artificial Sequence
  chemically synthesized
cactgcaagctccgcctccc

SEQ ID NO: 154313 - DNA, 20 bp, Artificial Sequence
  chemically synthesized
tggcgtgaacccgggaggcg

SEQ ID NO: 154314 - DNA, 20 bp, Artificial Sequence
  chemically synthesized
tcactgcaagctccgcctcc

SEQ ID NO: 154315 - DNA, 20 bp, Artificial Sequence
  chemically synthesized
aacccgggaggcggagcttg

SEQ ID NO: 154316 - DNA, 20 bp, Artificial Sequence
  chemically synthesized
cgggaggcggagcttgcagt

SEQ ID NO: 154317 - DNA, 20 bp, Artificial Sequence
  chemically synthesized
gcgcgatctcggctcactgc

SEQ ID NO: 154318 - DNA, 20 bp, Artificial Sequence
  chemically synthesized
ggcggagcttgcagtgagcc

SEQ ID NO: 154319 - DNA, 20 bp, Artificial Sequence
  chemically synthesized
ggagtgcagtggcgcgatct

SEQ ID NO: 154320 - DNA, 20 bp, Artificial Sequence
  chemically synthesized
tcgcccaggctggagtgcag

SEQ ID NO: 154321 - DNA, 20 bp, Artificial Sequence
  chemically synthesized
gagatcgcgccactgcactc

SEQ ID NO: 154322 - DNA, 20 bp, Artificial Sequence
  chemically synthesized
ctgtcgcccaggctggagtg

SEQ ID NO: 154323 - DNA, 20 bp, Artificial Sequence
  chemically synthesized
cgcgccactgcactccagcc

SEQ ID NO: 154324 - DNA, 20 bp, Artificial Sequence
  chemically synthesized
gcgccactgcactccagcct

SEQ ID NO: 154325 - DNA, 20 bp, Artificial Sequence
  chemically synthesized
tcactctgtcgcccaggctg

SEQ ID NO: 154326 - DNA, 20 bp, Artificial Sequence
  chemically synthesized
tctcactctgtcgcccaggc

SEQ ID NO: 154327 - DNA, 20 bp, Artificial Sequence
  chemically synthesized
ctgcactccagcctgggcga

SEQ ID NO: 154328 - DNA, 20 bp, Artificial Sequence
  chemically synthesized
ggagtctcactctgtcgccc

SEQ ID NO: 154329 - DNA, 20 bp, Artificial Sequence
  chemically synthesized
gcactccagcctgggcgaca

SEQ ID NO: 154330 - DNA, 20 bp, Artificial Sequence
  chemically synthesized
cggagtctcactctgtcgcc

SEQ ID NO: 154331 - DNA, 20 bp, Artificial Sequence
  chemically synthesized
tccagcctgggcgacagagt

SEQ ID NO: 154332 - DNA, 20 bp, Artificial Sequence
  chemically synthesized
ttttttttttttttgagacg

SEQ ID NO: 154333 - DNA, 20 bp, Artificial Sequence
  chemically synthesized
ttttttttttttttttgaga

SEQ ID NO: 154334 - DNA, 20 bp, Artificial Sequence
  chemically synthesized
tttttttttttttttttttt

SEQ ID NO: 154335 - DNA, 20 bp, Artificial Sequence
  chemically synthesized
aaaaaaaaaaaaaaaaaaaa

SEQ ID NO: 154336 - DNA, 20 bp, Artificial Sequence
  chemically synthesized
aaaaagaaaactctgttaac

SEQ ID NO: 154337 - DNA, 20 bp, Artificial Sequence
  chemically synthesized
tatagaagagccagttaaca

SEQ ID NO: 154338 - DNA, 20 bp, Artificial Sequence
  chemically synthesized
catatagaagagccagttaa

SEQ ID NO: 154339 - DNA, 20 bp, Artificial Sequence
  chemically synthesized
atatggacatatagaagagc

SEQ ID NO: 154340 - DNA, 20 bp, Artificial Sequence
  chemically synthesized
ttgtatatggacatatagaa

SEQ ID NO: 154341 - DNA, 20 bp, Artificial Sequence
  chemically synthesized
cattgtatatggacatatag

SEQ ID NO: 154342 - DNA, 20 bp, Artificial Sequence
  chemically synthesized
acccattgtatatggacata

SEQ ID NO: 154343 - DNA, 20 bp, Artificial Sequence
  chemically synthesized
ttctatatgtccatatacaa

SEQ ID NO: 154344 - DNA, 20 bp, Artificial Sequence
  chemically synthesized
aatgaataacccattgtata

SEQ ID NO: 154345 - DNA, 20 bp, Artificial Sequence
  chemically synthesized
tctatatgtccatatacaat

SEQ ID NO: 154346 - DNA, 20 bp, Artificial Sequence
  chemically synthesized
acaatgggttattcattcca

SEQ ID NO: 154347 - DNA, 20 bp, Artificial Sequence
  chemically synthesized
atgtctcttggtaataacta

SEQ ID NO: 154348 - DNA, 20 bp, Artificial Sequence
  chemically synthesized
ttcattccatagttattacc

SEQ ID NO: 154349 - DNA, 20 bp, Artificial Sequence
  chemically synthesized
cattccatagttattaccaa

SEQ ID NO: 154350 - DNA, 20 bp, Artificial Sequence
  chemically synthesized
tatttgattcaaatgtctct

SEQ ID NO: 154351 - DNA, 20 bp, Artificial Sequence
  chemically synthesized
ttgaatcaaatatcctgatt

SEQ ID NO: 154352 - DNA, 20 bp, Artificial Sequence
  chemically synthesized
gaatcaaatatcctgatttg

SEQ ID NO: 154353 - DNA, 20 bp, Artificial Sequence
  chemically synthesized
taatgtgaagactccaaatc

SEQ ID NO: 154354 - DNA, 20 bp, Artificial Sequence
  chemically synthesized
ttaatgtgaagactccaaat

SEQ ID NO: 154355 - DNA, 20 bp, Artificial Sequence
  chemically synthesized
tgatttggagtcttcacatt

SEQ ID NO: 154356 - DNA, 20 bp, Artificial Sequence
  chemically synthesized
atatagacatgcttaatgtg

SEQ ID NO: 154357 - DNA, 20 bp, Artificial Sequence
  chemically synthesized
tttttgaaagaaattgcata

SEQ ID NO: 154358 - DNA, 20 bp, Artificial Sequence
  chemically synthesized
acccgatttagcatttttga

SEQ ID NO: 154359 - DNA, 20 bp, Artificial Sequence
  chemically synthesized
ttctttcaaaaatgctaaat

SEQ ID NO: 154360 - DNA, 20 bp, Artificial Sequence
  chemically synthesized
tctttcaaaaatgctaaatc

SEQ ID NO: 154361 - DNA, 20 bp, Artificial Sequence
  chemically synthesized
atgttctacaatacccgatt

SEQ ID NO: 154362 - DNA, 20 bp, Artificial Sequence
  chemically synthesized
aaatgctaaatcgggtattg

SEQ ID NO: 154363 - DNA, 20 bp, Artificial Sequence
  chemically synthesized
ttgtagaacattaatgttct

SEQ ID NO: 154364 - DNA, 20 bp, Artificial Sequence
  chemically synthesized
tgtagaacattaatgttctc

SEQ ID NO: 154365 - DNA, 20 bp, Artificial Sequence
  chemically synthesized
aacattaatgttctcaggcc

SEQ ID NO: 154366 - DNA, 20 bp, Artificial Sequence
  chemically synthesized
atccacaagctgctgggcct

SEQ ID NO: 154367 - DNA, 20 bp, Artificial Sequence
  chemically synthesized
attaatgttctcaggcccag

SEQ ID NO: 154368 - DNA, 20 bp, Artificial Sequence
  chemically synthesized
tttcttatccacaagctgct

SEQ ID NO: 154369 - DNA, 20 bp, Artificial Sequence
  chemically synthesized
ctttcttatccacaagctgc

SEQ ID NO: 154370 - DNA, 20 bp, Artificial Sequence
  chemically synthesized
ttctcaggcccagcagcttg

SEQ ID NO: 154371 - DNA, 20 bp, Artificial Sequence
  chemically synthesized
aggcccagcagcttgtggat

SEQ ID NO: 154372 - DNA, 20 bp, Artificial Sequence
  chemically synthesized
gtgaatcctttcttatccac

SEQ ID NO: 154373 - DNA, 20 bp, Artificial Sequence
  chemically synthesized
ccagcagcttgtggataaga

SEQ ID NO: 154374 - DNA, 20 bp, Artificial Sequence
  chemically synthesized
cagcagcttgtggataagaa

SEQ ID NO: 154375 - DNA, 20 bp, Artificial Sequence
  chemically synthesized
ttcacattgacatttacaac

SEQ ID NO: 154376 - DNA, 20 bp, Artificial Sequence
  chemically synthesized
acatttacaaccagatttgc

SEQ ID NO: 154377 - DNA, 20 bp, Artificial Sequence
  chemically synthesized
aggcaaagagccagcaaatc

SEQ ID NO: 154378 - DNA, 20 bp, Artificial Sequence
  chemically synthesized
ggcagatggaggcaaagagc

SEQ ID NO: 154379 - DNA, 20 bp, Artificial Sequence
  chemically synthesized
gcatggcagatggaggcaaa

SEQ ID NO: 154380 - DNA, 20 bp, Artificial Sequence
  chemically synthesized
ttgcatggcagatggaggca

SEQ ID NO: 154381 - DNA, 20 bp, Artificial Sequence
  chemically synthesized
aaggcttgcatggcagatgg

SEQ ID NO: 154382 - DNA, 20 bp, Artificial Sequence
  chemically synthesized
gaaggcttgcatggcagatg

SEQ ID NO: 154383 - DNA, 20 bp, Artificial Sequence
  chemically synthesized
ctgaaggcttgcatggcaga

SEQ ID NO: 154384 - DNA, 20 bp, Artificial Sequence
  chemically synthesized
tttgcctccatctgccatgc

SEQ ID NO: 154385 - DNA, 20 bp, Artificial Sequence
  chemically synthesized
gggtctgaaggcttgcatgg

SEQ ID NO: 154386 - DNA, 20 bp, Artificial Sequence
  chemically synthesized
catgggtctgaaggcttgca

SEQ ID NO: 154387 - DNA, 20 bp, Artificial Sequence
  chemically synthesized
ccatctgccatgcaagcctt

SEQ ID NO: 154388 - DNA, 20 bp, Artificial Sequence
  chemically synthesized
aggactttgcatgggtctga

SEQ ID NO: 154389 - DNA, 20 bp, Artificial Sequence
  chemically synthesized
caggactttgcatgggtctg

SEQ ID NO: 154390 - DNA, 20 bp, Artificial Sequence
  chemically synthesized
caagccttcagacccatgca

SEQ ID NO: 154391 - DNA, 20 bp, Artificial Sequence
  chemically synthesized
aggtagacaggactttgcat

SEQ ID NO: 154392 - DNA, 20 bp, Artificial Sequence
  chemically synthesized
taggtagacaggactttgca

SEQ ID NO: 154393 - DNA, 20 bp, Artificial Sequence
  chemically synthesized
tcacaatcatttaggtagac

SEQ ID NO: 154394 - DNA, 20 bp, Artificial Sequence
  chemically synthesized
ttcacaatcatttaggtaga

SEQ ID NO: 154395 - DNA, 20 bp, Artificial Sequence
  chemically synthesized
gactttcacaatcatttagg

SEQ ID NO: 154396 - DNA, 20 bp, Artificial Sequence
  chemically synthesized
agagactttcacaatcattt

SEQ ID NO: 154397 - DNA, 20 bp, Artificial Sequence
  chemically synthesized
tagagactttcacaatcatt

SEQ ID NO: 154398 - DNA, 20 bp, Artificial Sequence
  chemically synthesized
gtctacctaaatgattgtga

SEQ ID NO: 154399 - DNA, 20 bp, Artificial Sequence
  chemically synthesized
taaatgattgtgaaagtctc

SEQ ID NO: 154400 - DNA, 20 bp, Artificial Sequence
  chemically synthesized
aatgattgtgaaagtctcta

SEQ ID NO: 154401 - DNA, 20 bp, Artificial Sequence
  chemically synthesized
atgattgtgaaagtctctag

SEQ ID NO: 154402 - DNA, 20 bp, Artificial Sequence
  chemically synthesized
aaaagccataagttcctcta

SEQ ID NO: 154403 - DNA, 20 bp, Artificial Sequence
  chemically synthesized
agaaaagccataagttcctc

SEQ ID NO: 154404 - DNA, 20 bp, Artificial Sequence
  chemically synthesized
aaagtctctagaggaactta

SEQ ID NO: 154405 - DNA, 20 bp, Artificial Sequence
  chemically synthesized
cctctgagaagaaaagccat

SEQ ID NO: 154406 - DNA, 20 bp, Artificial Sequence
  chemically synthesized
gaacttatggcttttcttct

SEQ ID NO: 154407 - DNA, 20 bp, Artificial Sequence
  chemically synthesized
gatgagacctctgagaagaa

SEQ ID NO: 154408 - DNA, 20 bp, Artificial Sequence
  chemically synthesized
acttatggcttttcttctca

SEQ ID NO: 154409 - DNA, 20 bp, Artificial Sequence
  chemically synthesized
cttatggcttttcttctcag

SEQ ID NO: 154410 - DNA, 20 bp, Artificial Sequence
  chemically synthesized
tcctggatgagacctctgag

SEQ ID NO: 154411 - DNA, 20 bp, Artificial Sequence
  chemically synthesized
tgttcctggatgagacctct

SEQ ID NO: 154412 - DNA, 20 bp, Artificial Sequence
  chemically synthesized
ttcttctcagaggtctcatc

SEQ ID NO: 154413 - DNA, 20 bp, Artificial Sequence
  chemically synthesized
tcttctcagaggtctcatcc

SEQ ID NO: 154414 - DNA, 20 bp, Artificial Sequence
  chemically synthesized
gctgttcagtgttcctggat

SEQ ID NO: 154415 - DNA, 20 bp, Artificial Sequence
  chemically synthesized
gcagagctgttcagtgttcc

SEQ ID NO: 154416 - DNA, 20 bp, Artificial Sequence
  chemically synthesized
tctcatccaggaacactgaa

SEQ ID NO: 154417 - DNA, 20 bp, Artificial Sequence
  chemically synthesized
atttgccctgcagagctgtt

SEQ ID NO: 154418 - DNA, 20 bp, Artificial Sequence
  chemically synthesized
aggaacactgaacagctctg

SEQ ID NO: 154419 - DNA, 20 bp, Artificial Sequence
  chemically synthesized
ggaacactgaacagctctgc

SEQ ID NO: 154420 - DNA, 20 bp, Artificial Sequence
  chemically synthesized
gaacactgaacagctctgca

SEQ ID NO: 154421 - DNA, 20 bp, Artificial Sequence
  chemically synthesized
caggcagtatttgccctgca

SEQ ID NO: 154422 - DNA, 20 bp, Artificial Sequence
  chemically synthesized
accaggcagtatttgccctg

SEQ ID NO: 154423 - DNA, 20 bp, Artificial Sequence
  chemically synthesized
tctgcagggcaaatactgcc

SEQ ID NO: 154424 - DNA, 20 bp, Artificial Sequence
  chemically synthesized
agggcaaatactgcctggtt

SEQ ID NO: 154425 - DNA, 20 bp, Artificial Sequence
  chemically synthesized
ggacaacacactaaaccagg

SEQ ID NO: 154426 - DNA, 20 bp, Artificial Sequence
  chemically synthesized
gatggacaacacactaaacc

SEQ ID NO: 154427 - DNA, 20 bp, Artificial Sequence
  chemically synthesized
agatggacaacacactaaac

SEQ ID NO: 154428 - DNA, 20 bp, Artificial Sequence
  chemically synthesized
agcttagaagttcaaggaga

SEQ ID NO: 154429 - DNA, 20 bp, Artificial Sequence
  chemically synthesized
ttatagcttagaagttcaag

SEQ ID NO: 154430 - DNA, 20 bp, Artificial Sequence
  chemically synthesized
tgttatagcttagaagttca

SEQ ID NO: 154431 - DNA, 20 bp, Artificial Sequence
  chemically synthesized
atgttatagcttagaagttc

SEQ ID NO: 154432 - DNA, 20 bp, Artificial Sequence
  chemically synthesized
gtccatctccttgaacttct

SEQ ID NO: 154433 - DNA, 20 bp, Artificial Sequence
  chemically synthesized
ccgaggatgttatagcttag

SEQ ID NO: 154434 - DNA, 20 bp, Artificial Sequence
  chemically synthesized
accccgaggatgttatagct

SEQ ID NO: 154435 - DNA, 20 bp, Artificial Sequence
  chemically synthesized
tccccaccccgaggatgtta

SEQ ID NO: 154436 - DNA, 20 bp, Artificial Sequence
  chemically synthesized
cttctaagctataacatcct

SEQ ID NO: 154437 - DNA, 20 bp, Artificial Sequence
  chemically synthesized
ttctaagctataacatcctc

SEQ ID NO: 154438 - DNA, 20 bp, Artificial Sequence
  chemically synthesized
tctaagctataacatcctcg

SEQ ID NO: 154439 - DNA, 20 bp, Artificial Sequence
  chemically synthesized
aagctataacatcctcgggg

SEQ ID NO: 154440 - DNA, 20 bp, Artificial Sequence
  chemically synthesized
agctataacatcctcggggt

SEQ ID NO: 154441 - DNA, 20 bp, Artificial Sequence
  chemically synthesized
gctataacatcctcggggtg

SEQ ID NO: 154442 - DNA, 20 bp, Artificial Sequence
  chemically synthesized
ctccccatctccccaccccg

SEQ ID NO: 154443 - DNA, 20 bp, Artificial Sequence
  chemically synthesized
actccccatctccccacccc

SEQ ID NO: 154444 - DNA, 20 bp, Artificial Sequence
  chemically synthesized
tataacatcctcggggtggg

SEQ ID NO: 154445 - DNA, 20 bp, Artificial Sequence
  chemically synthesized
acatcctcggggtggggaga

SEQ ID NO: 154446 - DNA, 20 bp, Artificial Sequence
  chemically synthesized
catcctcggggtggggagat

SEQ ID NO: 154447 - DNA, 20 bp, Artificial Sequence
  chemically synthesized
atcctcggggtggggagatg

SEQ ID NO: 154448 - DNA, 20 bp, Artificial Sequence
  chemically synthesized
cctcggggtggggagatggg

SEQ ID NO: 154449 - DNA, 20 bp, Artificial Sequence
  chemically synthesized
cggggtggggagatggggag

SEQ ID NO: 154450 - DNA, 20 bp, Artificial Sequence
  chemically synthesized
gggtggggagatggggagta

SEQ ID NO: 154451 - DNA, 20 bp, Artificial Sequence
  chemically synthesized
ggtggggagatggggagtag

SEQ ID NO: 154452 - DNA, 20 bp, Artificial Sequence
  chemically synthesized
gggagtagaggtgctaaaat

SEQ ID NO: 154453 - DNA, 20 bp, Artificial Sequence
  chemically synthesized
aagggaaatccatcttattt

SEQ ID NO: 154454 - DNA, 20 bp, Artificial Sequence
  chemically synthesized
gtagaggtgctaaaataaga

SEQ ID NO: 154455 - DNA, 20 bp, Artificial Sequence
  chemically synthesized
aaataagatggatttccctt

SEQ ID NO: 154456 - DNA, 20 bp, Artificial Sequence
  chemically synthesized
ccagtgctgtgaatgctaaa

SEQ ID NO: 154457 - DNA, 20 bp, Artificial Sequence
  chemically synthesized
tccagtgctgtgaatgctaa

SEQ ID NO: 154458 - DNA, 20 bp, Artificial Sequence
  chemically synthesized
atccagtgctgtgaatgcta

SEQ ID NO: 154459 - DNA, 20 bp, Artificial Sequence
  chemically synthesized
ggatttccctttagcattca

SEQ ID NO: 154460 - DNA, 20 bp, Artificial Sequence
  chemically synthesized
ccctttagcattcacagcac

SEQ ID NO: 154461 - DNA, 20 bp, Artificial Sequence
  chemically synthesized
agtgggattccaatgagatc

SEQ ID NO: 154462 - DNA, 20 bp, Artificial Sequence
  chemically synthesized
ttcacagcactggatctcat

SEQ ID NO: 154463 - DNA, 20 bp, Artificial Sequence
  chemically synthesized
gcaaggagtgggattccaat

SEQ ID NO: 154464 - DNA, 20 bp, Artificial Sequence
  chemically synthesized
tgctgtgtgcagcaaggagt

SEQ ID NO: 154465 - DNA, 20 bp, Artificial Sequence
  chemically synthesized
ctgctgtgtgcagcaaggag

SEQ ID NO: 154466 - DNA, 20 bp, Artificial Sequence
  chemically synthesized
cttctgctgtgtgcagcaag

SEQ ID NO: 154467 - DNA, 20 bp, Artificial Sequence
  chemically synthesized
cccttctgctgtgtgcagca

SEQ ID NO: 154468 - DNA, 20 bp, Artificial Sequence
  chemically synthesized
tcccttctgctgtgtgcagc

SEQ ID NO: 154469 - DNA, 20 bp, Artificial Sequence
  chemically synthesized
atcccactccttgctgcaca

SEQ ID NO: 154470 - DNA, 20 bp, Artificial Sequence
  chemically synthesized
ccactccttgctgcacacag

SEQ ID NO: 154471 - DNA, 20 bp, Artificial Sequence
  chemically synthesized
ttcatcccttctgctgtgtg

SEQ ID NO: 154472 - DNA, 20 bp, Artificial Sequence
  chemically synthesized
ctccttgctgcacacagcag

SEQ ID NO: 154473 - DNA, 20 bp, Artificial Sequence
  chemically synthesized
tccttgctgcacacagcaga

SEQ ID NO: 154474 - DNA, 20 bp, Artificial Sequence
  chemically synthesized
ccttgctgcacacagcagaa

SEQ ID NO: 154475 - DNA, 20 bp, Artificial Sequence
  chemically synthesized
cagacatacagtgagtgggg

SEQ ID NO: 154476 - DNA, 20 bp, Artificial Sequence
  chemically synthesized
ccacagacatacagtgagtg

SEQ ID NO: 154477 - DNA, 20 bp, Artificial Sequence
  chemically synthesized
accacagacatacagtgagt

SEQ ID NO: 154478 - DNA, 20 bp, Artificial Sequence
  chemically synthesized
taccacagacatacagtgag

SEQ ID NO: 154479 - DNA, 20 bp, Artificial Sequence
  chemically synthesized
tactaccacagacatacagt

SEQ ID NO: 154480 - DNA, 20 bp, Artificial Sequence
  chemically synthesized
gaactactaccacagacata

SEQ ID NO: 154481 - DNA, 20 bp, Artificial Sequence
  chemically synthesized
ccccactcactgtatgtctg

SEQ ID NO: 154482 - DNA, 20 bp, Artificial Sequence
  chemically synthesized
cactcactgtatgtctgtgg

SEQ ID NO: 154483 - DNA, 20 bp, Artificial Sequence
  chemically synthesized
tcactgtatgtctgtggtag

SEQ ID NO: 154484 - DNA, 20 bp, Artificial Sequence
  chemically synthesized
tgctttgagaactactacca

SEQ ID NO: 154485 - DNA, 20 bp, Artificial Sequence
  chemically synthesized
gtctgtggtagtagttctca

SEQ ID NO: 154486 - DNA, 20 bp, Artificial Sequence
  chemically synthesized
tggtagtagttctcaaagca

SEQ ID NO: 154487 - DNA, 20 bp, Artificial Sequence
  chemically synthesized
ggtagtagttctcaaagcat

SEQ ID NO: 154488 - DNA, 20 bp, Artificial Sequence
  chemically synthesized
ctgatgctggcctatgcttt

SEQ ID NO: 154489 - DNA, 20 bp, Artificial Sequence
  chemically synthesized
gtagttctcaaagcataggc

SEQ ID NO: 154490 - DNA, 20 bp, Artificial Sequence
  chemically synthesized
ctcaaagcataggccagcat

SEQ ID NO: 154491 - DNA, 20 bp, Artificial Sequence
  chemically synthesized
ttcctaggttatgctgatgc

SEQ ID NO: 154492 - DNA, 20 bp, Artificial Sequence
  chemically synthesized
aggccagcatcagcataacc

SEQ ID NO: 154493 - DNA, 20 bp, Artificial Sequence
  chemically synthesized
ggccagcatcagcataacct

SEQ ID NO: 154494 - DNA, 20 bp, Artificial Sequence
  chemically synthesized
tgcatctctgaaaagttcct

SEQ ID NO: 154495 - DNA, 20 bp, Artificial Sequence
  chemically synthesized
ttgcatctctgaaaagttcc

SEQ ID NO: 154496 - DNA, 20 bp, Artificial Sequence
  chemically synthesized
agcataacctaggaactttt

SEQ ID NO: 154497 - DNA, 20 bp, Artificial Sequence
  chemically synthesized
cataacctaggaacttttca

SEQ ID NO: 154498 - DNA, 20 bp, Artificial Sequence
  chemically synthesized
ccaagacttgcatctctgaa

SEQ ID NO: 154499 - DNA, 20 bp, Artificial Sequence
  chemically synthesized
taggaacttttcagagatgc

SEQ ID NO: 154500 - DNA, 20 bp, Artificial Sequence
  chemically synthesized
cttttcagagatgcaagtct

SEQ ID NO: 154501 - DNA, 20 bp, Artificial Sequence
  chemically synthesized
tcagagatgcaagtcttggc

SEQ ID NO: 154502 - DNA, 20 bp, Artificial Sequence
  chemically synthesized
cagagatgcaagtcttggct

SEQ ID NO: 154503 - DNA, 20 bp, Artificial Sequence
  chemically synthesized
gtgagccactgtgcccagcc

SEQ ID NO: 154504 - DNA, 20 bp, Artificial Sequence
  chemically synthesized
atgcaagtcttggctgggca

SEQ ID NO: 154505 - DNA, 20 bp, Artificial Sequence
  chemically synthesized
caagtcttggctgggcacag

SEQ ID NO: 154506 - DNA, 20 bp, Artificial Sequence
  chemically synthesized
caggcgtgagccactgtgcc

SEQ ID NO: 154507 - DNA, 20 bp, Artificial Sequence
  chemically synthesized
agtgctgggattacaggcgt

SEQ ID NO: 154508 - DNA, 20 bp, Artificial Sequence
  chemically synthesized
gtggctcacgcctgtaatcc

SEQ ID NO: 154509 - DNA, 20 bp, Artificial Sequence
  chemically synthesized
tcccatagtgctgggattac

SEQ ID NO: 154510 - DNA, 20 bp, Artificial Sequence
  chemically synthesized
ctcccatagtgctgggatta

SEQ ID NO: 154511 - DNA, 20 bp, Artificial Sequence
  chemically synthesized
cgcctgtaatcccagcacta

SEQ ID NO: 154512 - DNA, 20 bp, Artificial Sequence
  chemically synthesized
cctcagcctcccatagtgct

SEQ ID NO: 154513 - DNA, 20 bp, Artificial Sequence
  chemically synthesized
gcctgtaatcccagcactat

SEQ ID NO: 154514 - DNA, 20 bp, Artificial Sequence
  chemically synthesized
gcctcagcctcccatagtgc

SEQ ID NO: 154515 - DNA, 20 bp, Artificial Sequence
  chemically synthesized
ctgtaatcccagcactatgg

SEQ ID NO: 154516 - DNA, 20 bp, Artificial Sequence
  chemically synthesized
tgtaatcccagcactatggg

SEQ ID NO: 154517 - DNA, 20 bp, Artificial Sequence
  chemically synthesized
ccacctgcctcagcctccca

SEQ ID NO: 154518 - DNA, 20 bp, Artificial Sequence
  chemically synthesized
tcccagcactatgggaggct

SEQ ID NO: 154519 - DNA, 20 bp, Artificial Sequence
  chemically synthesized
cccagcactatgggaggctg

SEQ ID NO: 154520 - DNA, 20 bp, Artificial Sequence
  chemically synthesized
agcactatgggaggctgagg

SEQ ID NO: 154521 - DNA, 20 bp, Artificial Sequence
  chemically synthesized
gcactatgggaggctgaggc

SEQ ID NO: 154522 - DNA, 20 bp, Artificial Sequence
  chemically synthesized
ctatgggaggctgaggcagg

SEQ ID NO: 154523 - DNA, 20 bp, Artificial Sequence
  chemically synthesized
ctcaggtgatccacctgcct

SEQ ID NO: 154524 - DNA, 20 bp, Artificial Sequence
  chemically synthesized
ctgaggcaggtggatcacct

SEQ ID NO: 154525 - DNA, 20 bp, Artificial Sequence
  chemically synthesized
tgaggcaggtggatcacctg

SEQ ID NO: 154526 - DNA, 20 bp, Artificial Sequence
  chemically synthesized
gcaggtggatcacctgaggt

SEQ ID NO: 154527 - DNA, 20 bp, Artificial Sequence
  chemically synthesized
caggtggatcacctgaggtc

SEQ ID NO: 154528 - DNA, 20 bp, Artificial Sequence
  chemically synthesized
ggtctcgaactcctgacctc

SEQ ID NO: 154529 - DNA, 20 bp, Artificial Sequence
  chemically synthesized
ggtggatcacctgaggtcag

SEQ ID NO: 154530 - DNA, 20 bp, Artificial Sequence
  chemically synthesized
tggtctcgaactcctgacct

SEQ ID NO: 154531 - DNA, 20 bp, Artificial Sequence
  chemically synthesized
tcacctgaggtcaggagttc

SEQ ID NO: 154532 - DNA, 20 bp, Artificial Sequence
  chemically synthesized
tgaggtcaggagttcgagac

SEQ ID NO: 154533 - DNA, 20 bp, Artificial Sequence
  chemically synthesized
tttcaccatgttggtcaggc

SEQ ID NO: 154534 - DNA, 20 bp, Artificial Sequence
  chemically synthesized
agggtttcaccatgttggtc

SEQ ID NO: 154535 - DNA, 20 bp, Artificial Sequence
  chemically synthesized
cgagaccagcctgaccaaca

SEQ ID NO: 154536 - DNA, 20 bp, Artificial Sequence
  chemically synthesized
cagggtttcaccatgttggt

SEQ ID NO: 154537 - DNA, 20 bp, Artificial Sequence
  chemically synthesized
gagacagggtttcaccatgt

SEQ ID NO: 154538 - DNA, 20 bp, Artificial Sequence
  chemically synthesized
ttgtatttttagtagagaca

SEQ ID NO: 154539 - DNA, 20 bp, Artificial Sequence
  chemically synthesized
tttgtatttttagtagagac

SEQ ID NO: 154540 - DNA, 20 bp, Artificial Sequence
  chemically synthesized
ttttgtatttttagtagaga

SEQ ID NO: 154541 - DNA, 20 bp, Artificial Sequence
  chemically synthesized
taatttttgtatttttagta

SEQ ID NO: 154542 - DNA, 20 bp, Artificial Sequence
  chemically synthesized
gctaatttttgtatttttag

SEQ ID NO: 154543 - DNA, 20 bp, Artificial Sequence
  chemically synthesized
ctggctaatttttgtatttt

SEQ ID NO: 154544 - DNA, 20 bp, Artificial Sequence
  chemically synthesized
tctactaaaaatacaaaaat

SEQ ID NO: 154545 - DNA, 20 bp, Artificial Sequence
  chemically synthesized
ctaaaaatacaaaaattagc

SEQ ID NO: 154546 - DNA, 20 bp, Artificial Sequence
  chemically synthesized
taaaaatacaaaaattagcc

SEQ ID NO: 154547 - DNA, 20 bp, Artificial Sequence
  chemically synthesized
atacaaaaattagccaggcg

SEQ ID NO: 154548 - DNA, 20 bp, Artificial Sequence
  chemically synthesized
caaaaattagccaggcgtgg

SEQ ID NO: 154549 - DNA, 20 bp, Artificial Sequence
  chemically synthesized
taggcacccgccaccacgcc

SEQ ID NO: 154550 - DNA, 20 bp, Artificial Sequence
  chemically synthesized
aaattagccaggcgtggtgg

SEQ ID NO: 154551 - DNA, 20 bp, Artificial Sequence
  chemically synthesized
aattagccaggcgtggtggc

SEQ ID NO: 154552 - DNA, 20 bp, Artificial Sequence
  chemically synthesized
gtggcgggtgcctataatcc

SEQ ID NO: 154553 - DNA, 20 bp, Artificial Sequence
  chemically synthesized
tcctgagtagctaggattat

SEQ ID NO: 154554 - DNA, 20 bp, Artificial Sequence
  chemically synthesized
ctcctgagtagctaggatta

SEQ ID NO: 154555 - DNA, 20 bp, Artificial Sequence
  chemically synthesized
tgcctataatcctagctact

SEQ ID NO: 154556 - DNA, 20 bp, Artificial Sequence
  chemically synthesized
cctcagcctcctgagtagct

SEQ ID NO: 154557 - DNA, 20 bp, Artificial Sequence
  chemically synthesized
gcctataatcctagctactc

SEQ ID NO: 154558 - DNA, 20 bp, Artificial Sequence
  chemically synthesized
gcctcagcctcctgagtagc

SEQ ID NO: 154559 - DNA, 20 bp, Artificial Sequence
  chemically synthesized
ctataatcctagctactcag

SEQ ID NO: 154560 - DNA, 20 bp, Artificial Sequence
  chemically synthesized
tataatcctagctactcagg

SEQ ID NO: 154561 - DNA, 20 bp, Artificial Sequence
  chemically synthesized
tcctgcctcagcctcctgag

SEQ ID NO: 154562 - DNA, 20 bp, Artificial Sequence
  chemically synthesized
ttctcctgcctcagcctcct

SEQ ID NO: 154563 - DNA, 20 bp, Artificial Sequence
  chemically synthesized
tcctagctactcaggaggct

SEQ ID NO: 154564 - DNA, 20 bp, Artificial Sequence
  chemically synthesized
cctagctactcaggaggctg

SEQ ID NO: 154565 - DNA, 20 bp, Artificial Sequence
  chemically synthesized
agctactcaggaggctgagg

SEQ ID NO: 154566 - DNA, 20 bp, Artificial Sequence
  chemically synthesized
gctactcaggaggctgaggc

SEQ ID NO: 154567 - DNA, 20 bp, Artificial Sequence
  chemically synthesized
tactcaggaggctgaggcag

SEQ ID NO: 154568 - DNA, 20 bp, Artificial Sequence
  chemically synthesized
ttgaagcggttctcctgcct

SEQ ID NO: 154569 - DNA, 20 bp, Artificial Sequence
  chemically synthesized
ctctgcctcctgggttgaag

SEQ ID NO: 154570 - DNA, 20 bp, Artificial Sequence
  chemically synthesized
gcaggagaaccgcttcaacc

SEQ ID NO: 154571 - DNA, 20 bp, Artificial Sequence
  chemically synthesized
caggagaaccgcttcaaccc

SEQ ID NO: 154572 - DNA, 20 bp, Artificial Sequence
  chemically synthesized
aacctctgcctcctgggttg

SEQ ID NO: 154573 - DNA, 20 bp, Artificial Sequence
  chemically synthesized
ggagaaccgcttcaacccag

SEQ ID NO: 154574 - DNA, 20 bp, Artificial Sequence
  chemically synthesized
gagaaccgcttcaacccagg

SEQ ID NO: 154575 - DNA, 20 bp, Artificial Sequence
  chemically synthesized
aaccgcttcaacccaggagg

SEQ ID NO: 154576 - DNA, 20 bp, Artificial Sequence
  chemically synthesized
cacagcaacctctgcctcct

SEQ ID NO: 154577 - DNA, 20 bp, Artificial Sequence
  chemically synthesized
ccgcttcaacccaggaggca

SEQ ID NO: 154578 - DNA, 20 bp, Artificial Sequence
  chemically synthesized
tcacagcaacctctgcctcc

SEQ ID NO: 154579 - DNA, 20 bp, Artificial Sequence
  chemically synthesized
cgcttcaacccaggaggcag

SEQ ID NO: 154580 - DNA, 20 bp, Artificial Sequence
  chemically synthesized
caggaggcagaggttgctgt

SEQ ID NO: 154581 - DNA, 20 bp, Artificial Sequence
  chemically synthesized
ggcagaggttgctgtgagcc

SEQ ID NO: 154582 - DNA, 20 bp, Artificial Sequence
  chemically synthesized
agtggtgcaatctcggctca

SEQ ID NO: 154583 - DNA, 20 bp, Artificial Sequence
  chemically synthesized
ggagtgcagtggtgcaatct

SEQ ID NO: 154584 - DNA, 20 bp, Artificial Sequence
  chemically synthesized
tcacccaggctggagtgcag

SEQ ID NO: 154585 - DNA, 20 bp, Artificial Sequence
  chemically synthesized
gagattgcaccactgcactc

SEQ ID NO: 154586 - DNA, 20 bp, Artificial Sequence
  chemically synthesized
ctgtcacccaggctggagtg

SEQ ID NO: 154587 - DNA, 20 bp, Artificial Sequence
  chemically synthesized
tgcaccactgcactccagcc

SEQ ID NO: 154588 - DNA, 20 bp, Artificial Sequence
  chemically synthesized
gcaccactgcactccagcct

SEQ ID NO: 154589 - DNA, 20 bp, Artificial Sequence
  chemically synthesized
ttgctctgtcacccaggctg

SEQ ID NO: 154590 - DNA, 20 bp, Artificial Sequence
  chemically synthesized
tcttgctctgtcacccaggc

SEQ ID NO: 154591 - DNA, 20 bp, Artificial Sequence
  chemically synthesized
ctgcactccagcctgggtga

SEQ ID NO: 154592 - DNA, 20 bp, Artificial Sequence
  chemically synthesized
tgagtcttgctctgtcaccc

SEQ ID NO: 154593 - DNA, 20 bp, Artificial Sequence
  chemically synthesized
gcactccagcctgggtgaca

SEQ ID NO: 154594 - DNA, 20 bp, Artificial Sequence
  chemically synthesized
ctgagtcttgctctgtcacc

SEQ ID NO: 154595 - DNA, 20 bp, Artificial Sequence
  chemically synthesized
tccagcctgggtgacagagc

SEQ ID NO: 154596 - DNA, 20 bp, Artificial Sequence
  chemically synthesized
ctgggtgacagagcaagact

SEQ ID NO: 154597 - DNA, 20 bp, Artificial Sequence
  chemically synthesized
ctctctttttttttgagact

SEQ ID NO: 154598 - DNA, 20 bp, Artificial Sequence
  chemically synthesized
aagactcagtctcaaaaaaa

SEQ ID NO: 154599 - DNA, 20 bp, Artificial Sequence
  chemically synthesized
ctctctctctcttttttttt

SEQ ID NO: 154600 - DNA, 20 bp, Artificial Sequence
  chemically synthesized
gactcagtctcaaaaaaaaa

SEQ ID NO: 154601 - DNA, 20 bp, Artificial Sequence
  chemically synthesized
ctcagtctcaaaaaaaaaga

SEQ ID NO: 154602 - DNA, 20 bp, Artificial Sequence
  chemically synthesized
cagtctcaaaaaaaaagaga

SEQ ID NO: 154603 - DNA, 20 bp, Artificial Sequence
  chemically synthesized
gtctcaaaaaaaaagagaga

SEQ ID NO: 154604 - DNA, 20 bp, Artificial Sequence
  chemically synthesized
ctcaaaaaaaaagagagaga

SEQ ID NO: 154605 - DNA, 20 bp, Artificial Sequence
  chemically synthesized
caaaaaaaaagagagagaga

SEQ ID NO: 154606 - DNA, 20 bp, Artificial Sequence
  chemically synthesized
aaaagagagagagagagatg

SEQ ID NO: 154607 - DNA, 20 bp, Artificial Sequence
  chemically synthesized
aaagagagagagagagatgc

SEQ ID NO: 154608 - DNA, 20 bp, Artificial Sequence
  chemically synthesized
gagagatgcaggtctcaccc

SEQ ID NO: 154609 - DNA, 20 bp, Artificial Sequence
  chemically synthesized
gagatgcaggtctcacccca

SEQ ID NO: 154610 - DNA, 20 bp, Artificial Sequence
  chemically synthesized
tgatttactagctctggggt

SEQ ID NO: 154611 - DNA, 20 bp, Artificial Sequence
  chemically synthesized
tgcaggtctcaccccagagc

SEQ ID NO: 154612 - DNA, 20 bp, Artificial Sequence
  chemically synthesized
tttctgatttactagctctg

SEQ ID NO: 154613 - DNA, 20 bp, Artificial Sequence
  chemically synthesized
gtttctgatttactagctct

SEQ ID NO: 154614 - DNA, 20 bp, Artificial Sequence
  chemically synthesized
agtttctgatttactagctc

SEQ ID NO: 154615 - DNA, 20 bp, Artificial Sequence
  chemically synthesized
tcaccccagagctagtaaat

SEQ ID NO: 154616 - DNA, 20 bp, Artificial Sequence
  chemically synthesized
ccccagagtttctgatttac

SEQ ID NO: 154617 - DNA, 20 bp, Artificial Sequence
  chemically synthesized
agctagtaaatcagaaactc

SEQ ID NO: 154618 - DNA, 20 bp, Artificial Sequence
  chemically synthesized
gctagtaaatcagaaactct

SEQ ID NO: 154619 - DNA, 20 bp, Artificial Sequence
  chemically synthesized
ctagtaaatcagaaactctg

SEQ ID NO: 154620 - DNA, 20 bp, Artificial Sequence
  chemically synthesized
attactgggcttcaacccca

SEQ ID NO: 154621 - DNA, 20 bp, Artificial Sequence
  chemically synthesized
aatcagaaactctggggttg

SEQ ID NO: 154622 - DNA, 20 bp, Artificial Sequence
  chemically synthesized
agattactgggcttcaaccc

SEQ ID NO: 154623 - DNA, 20 bp, Artificial Sequence
  chemically synthesized
gaaactctggggttgaagcc

SEQ ID NO: 154624 - DNA, 20 bp, Artificial Sequence
  chemically synthesized
ttcgcaaagtatagattact

SEQ ID NO: 154625 - DNA, 20 bp, Artificial Sequence
  chemically synthesized
cttcgcaaagtatagattac

SEQ ID NO: 154626 - DNA, 20 bp, Artificial Sequence
  chemically synthesized
acccagttcttcgcaaagta

SEQ ID NO: 154627 - DNA, 20 bp, Artificial Sequence
  chemically synthesized
ccagtaatctatactttgcg

SEQ ID NO: 154628 - DNA, 20 bp, Artificial Sequence
  chemically synthesized
gaaccacccagttcttcgca

SEQ ID NO: 154629 - DNA, 20 bp, Artificial Sequence
  chemically synthesized
atctatactttgcgaagaac

SEQ ID NO: 154630 - DNA, 20 bp, Artificial Sequence
  chemically synthesized
tctatactttgcgaagaact

SEQ ID NO: 154631 - DNA, 20 bp, Artificial Sequence
  chemically synthesized
atactttgcgaagaactggg

SEQ ID NO: 154632 - DNA, 20 bp, Artificial Sequence
  chemically synthesized
taccatgcgttagaaccacc

SEQ ID NO: 154633 - DNA, 20 bp, Artificial Sequence
  chemically synthesized
aactgggtggttctaacgca

SEQ ID NO: 154634 - DNA, 20 bp, Artificial Sequence
  chemically synthesized
tctcaaaaattaccatgcgt

SEQ ID NO: 154635 - DNA, 20 bp, Artificial Sequence
  chemically synthesized
tctaacgcatggtaattttt

SEQ ID NO: 154636 - DNA, 20 bp, Artificial Sequence
  chemically synthesized
catggtaatttttgagaatt

SEQ ID NO: 154637 - DNA, 20 bp, Artificial Sequence
  chemically synthesized
gtaatttttgagaattaagt

SEQ ID NO: 154638 - DNA, 20 bp, Artificial Sequence
  chemically synthesized
tttgagaattaagttggatt

SEQ ID NO: 154639 - DNA, 20 bp, Artificial Sequence
  chemically synthesized
aaactggagatcaaaagtgt

SEQ ID NO: 154640 - DNA, 20 bp, Artificial Sequence
  chemically synthesized
ggagggaaactggagatcaa

SEQ ID NO: 154641 - DNA, 20 bp, Artificial Sequence
  chemically synthesized
agaccaacacttttgatctc

SEQ ID NO: 154642 - DNA, 20 bp, Artificial Sequence
  chemically synthesized
ggggaaaaggagggaaactg

SEQ ID NO: 154643 - DNA, 20 bp, Artificial Sequence
  chemically synthesized
ttggggaaaaggagggaaac

SEQ ID NO: 154644 - DNA, 20 bp, Artificial Sequence
  chemically synthesized
cactacattggggaaaagga

SEQ ID NO: 154645 - DNA, 20 bp, Artificial Sequence
  chemically synthesized
tcactacattggggaaaagg

SEQ ID NO: 154646 - DNA, 20 bp, Artificial Sequence
  chemically synthesized
atcactacattggggaaaag

SEQ ID NO: 154647 - DNA, 20 bp, Artificial Sequence
  chemically synthesized
aaatcactacattggggaaa

SEQ ID NO: 154648 - DNA, 20 bp, Artificial Sequence
  chemically synthesized
caaatcactacattggggaa

SEQ ID NO: 154649 - DNA, 20 bp, Artificial Sequence
  chemically synthesized
ttccctccttttccccaatg

SEQ ID NO: 154650 - DNA, 20 bp, Artificial Sequence
  chemically synthesized
atacacaaatcactacattg

SEQ ID NO: 154651 - DNA, 20 bp, Artificial Sequence
  chemically synthesized
tatacacaaatcactacatt

SEQ ID NO: 154652 - DNA, 20 bp, Artificial Sequence
  chemically synthesized
ttatacacaaatcactacat

SEQ ID NO: 154653 - DNA, 20 bp, Artificial Sequence
  chemically synthesized
tagtgatttgtgtataaata

SEQ ID NO: 154654 - DNA, 20 bp, Artificial Sequence
  chemically synthesized
gtatgcatattggggataga

SEQ ID NO: 154655 - DNA, 20 bp, Artificial Sequence
  chemically synthesized
ggtatgcatattggggatag

SEQ ID NO: 154656 - DNA, 20 bp, Artificial Sequence
  chemically synthesized
aggggtatgcatattgggga

SEQ ID NO: 154657 - DNA, 20 bp, Artificial Sequence
  chemically synthesized
tcaaaggggtatgcatattg

SEQ ID NO: 154658 - DNA, 20 bp, Artificial Sequence
  chemically synthesized
atcaaaggggtatgcatatt

SEQ ID NO: 154659 - DNA, 20 bp, Artificial Sequence
  chemically synthesized
tatcaaaggggtatgcatat

SEQ ID NO: 154660 - DNA, 20 bp, Artificial Sequence
  chemically synthesized
tgccacatcgcatatcaaag

SEQ ID NO: 154661 - DNA, 20 bp, Artificial Sequence
  chemically synthesized
atgccacatcgcatatcaaa

SEQ ID NO: 154662 - DNA, 20 bp, Artificial Sequence
  chemically synthesized
gatgccacatcgcatatcaa

SEQ ID NO: 154663 - DNA, 20 bp, Artificial Sequence
  chemically synthesized
agatgccacatcgcatatca

SEQ ID NO: 154664 - DNA, 20 bp, Artificial Sequence
  chemically synthesized
tacccctttgatatgcgatg

SEQ ID NO: 154665 - DNA, 20 bp, Artificial Sequence
  chemically synthesized
acttcatctcgtgaaaggag

SEQ ID NO: 154666 - DNA, 20 bp, Artificial Sequence
  chemically synthesized
ttacttcatctcgtgaaagg

SEQ ID NO: 154667 - DNA, 20 bp, Artificial Sequence
  chemically synthesized
gtggcatctcctcctttcac

SEQ ID NO: 154668 - DNA, 20 bp, Artificial Sequence
  chemically synthesized
attacttcatctcgtgaaag

SEQ ID NO: 154669 - DNA, 20 bp, Artificial Sequence
  chemically synthesized
aaattacttcatctcgtgaa

SEQ ID NO: 154670 - DNA, 20 bp, Artificial Sequence
  chemically synthesized
gaaattacttcatctcgtga

SEQ ID NO: 154671 - DNA, 20 bp, Artificial Sequence
  chemically synthesized
tctcctcctttcacgagatg

SEQ ID NO: 154672 - DNA, 20 bp, Artificial Sequence
  chemically synthesized
cagcccagattcaagagatg

SEQ ID NO: 154673 - DNA, 20 bp, Artificial Sequence
  chemically synthesized
tcagcccagattcaagagat

SEQ ID NO: 154674 - DNA, 20 bp, Artificial Sequence
  chemically synthesized
atttcctcatctcttgaatc

SEQ ID NO: 154675 - DNA, 20 bp, Artificial Sequence
  chemically synthesized
aaagatcagcccagattcaa

SEQ ID NO: 154676 - DNA, 20 bp, Artificial Sequence
  chemically synthesized
tttcctcatctcttgaatct

SEQ ID NO: 154677 - DNA, 20 bp, Artificial Sequence
  chemically synthesized
caaaagatcagcccagattc

SEQ ID NO: 154678 - DNA, 20 bp, Artificial Sequence
  chemically synthesized
agcacctcaaaagatcagcc

SEQ ID NO: 154679 - DNA, 20 bp, Artificial Sequence
  chemically synthesized
tgaatctgggctgatctttt

SEQ ID NO: 154680 - DNA, 20 bp, Artificial Sequence
  chemically synthesized
gtcaaagcacctcaaaagat

SEQ ID NO: 154681 - DNA, 20 bp, Artificial Sequence
  chemically synthesized
gaatctgggctgatcttttg

SEQ ID NO: 154682 - DNA, 20 bp, Artificial Sequence
  chemically synthesized
tattggtcaaagcacctcaa

SEQ ID NO: 154683 - DNA, 20 bp, Artificial Sequence
  chemically synthesized
ctgctaagttatattggtca

SEQ ID NO: 154684 - DNA, 20 bp, Artificial Sequence
  chemically synthesized
ttacttctgctaagttatat

SEQ ID NO: 154685 - DNA, 20 bp, Artificial Sequence
  chemically synthesized
gtgctttgaccaatataact

SEQ ID NO: 154686 - DNA, 20 bp, Artificial Sequence
  chemically synthesized
ctttgaccaatataacttag

SEQ ID NO: 154687 - DNA, 20 bp, Artificial Sequence
  chemically synthesized
tgaccaatataacttagcag

SEQ ID NO: 154688 - DNA, 20 bp, Artificial Sequence
  chemically synthesized
acgtgtaggttacttctgct

SEQ ID NO: 154689 - DNA, 20 bp, Artificial Sequence
  chemically synthesized
gcctaggctttgaaacgtgt

SEQ ID NO: 154690 - DNA, 20 bp, Artificial Sequence
  chemically synthesized
tgcctaggctttgaaacgtg

SEQ ID NO: 154691 - DNA, 20 bp, Artificial Sequence
  chemically synthesized
gaagtaacctacacgtttca

SEQ ID NO: 154692 - DNA, 20 bp, Artificial Sequence
  chemically synthesized
aacctacacgtttcaaagcc

SEQ ID NO: 154693 - DNA, 20 bp, Artificial Sequence
  chemically synthesized
acctacacgtttcaaagcct

SEQ ID NO: 154694 - DNA, 20 bp, Artificial Sequence
  chemically synthesized
acgtttcaaagcctaggcat

SEQ ID NO: 154695 - DNA, 20 bp, Artificial Sequence
  chemically synthesized
tacaagaccttctgatgcct

SEQ ID NO: 154696 - DNA, 20 bp, Artificial Sequence
  chemically synthesized
ctacaagaccttctgatgcc

SEQ ID NO: 154697 - DNA, 20 bp, Artificial Sequence
  chemically synthesized
tttcaaagcctaggcatcag

SEQ ID NO: 154698 - DNA, 20 bp, Artificial Sequence
  chemically synthesized
ttcaaagcctaggcatcaga

SEQ ID NO: 154699 - DNA, 20 bp, Artificial Sequence
  chemically synthesized
ctaggcatcagaaggtcttg

SEQ ID NO: 154700 - DNA, 20 bp, Artificial Sequence
  chemically synthesized
agagggcgggtggaagctac

SEQ ID NO: 154701 - DNA, 20 bp, Artificial Sequence
  chemically synthesized
ttccaagagagggcgggtgg

SEQ ID NO: 154702 - DNA, 20 bp, Artificial Sequence
  chemically synthesized
gttttccaagagagggcggg

SEQ ID NO: 154703 - DNA, 20 bp, Artificial Sequence
  chemically synthesized
gcagttttccaagagagggc

SEQ ID NO: 154704 - DNA, 20 bp, Artificial Sequence
  chemically synthesized
ggcagttttccaagagaggg

SEQ ID NO: 154705 - DNA, 20 bp, Artificial Sequence
  chemically synthesized
agcttccacccgccctctct

SEQ ID NO: 154706 - DNA, 20 bp, Artificial Sequence
  chemically synthesized
cagggcagttttccaagaga

SEQ ID NO: 154707 - DNA, 20 bp, Artificial Sequence
  chemically synthesized
tcagggcagttttccaagag

SEQ ID NO: 154708 - DNA, 20 bp, Artificial Sequence
  chemically synthesized
ctcagggcagttttccaaga

SEQ ID NO: 154709 - DNA, 20 bp, Artificial Sequence
  chemically synthesized
ttctcagggcagttttccaa

SEQ ID NO: 154710 - DNA, 20 bp, Artificial Sequence
  chemically synthesized
tattctcagggcagttttcc

SEQ ID NO: 154711 - DNA, 20 bp, Artificial Sequence
  chemically synthesized
ctctcttggaaaactgccct

SEQ ID NO: 154712 - DNA, 20 bp, Artificial Sequence
  chemically synthesized
attacatggtattctcaggg

SEQ ID NO: 154713 - DNA, 20 bp, Artificial Sequence
  chemically synthesized
ttcattacatggtattctca

SEQ ID NO: 154714 - DNA, 20 bp, Artificial Sequence
  chemically synthesized
cttcattacatggtattctc

SEQ ID NO: 154715 - DNA, 20 bp, Artificial Sequence
  chemically synthesized
gcttcattacatggtattct

SEQ ID NO: 154716 - DNA, 20 bp, Artificial Sequence
  chemically synthesized
cctgagaataccatgtaatg

SEQ ID NO: 154717 - DNA, 20 bp, Artificial Sequence
  chemically synthesized
ctagattaggcttcattaca

SEQ ID NO: 154718 - DNA, 20 bp, Artificial Sequence
  chemically synthesized
ccatgtaatgaagcctaatc

SEQ ID NO: 154719 - DNA, 20 bp, Artificial Sequence
  chemically synthesized
atcatcctgtaggctagatt

SEQ ID NO: 154720 - DNA, 20 bp, Artificial Sequence
  chemically synthesized
catcatcctgtaggctagat

SEQ ID NO: 154721 - DNA, 20 bp, Artificial Sequence
  chemically synthesized
atgaagcctaatctagccta

SEQ ID NO: 154722 - DNA, 20 bp, Artificial Sequence
  chemically synthesized
tgaagcctaatctagcctac

SEQ ID NO: 154723 - DNA, 20 bp, Artificial Sequence
  chemically synthesized
ccactcatcatcctgtaggc

SEQ ID NO: 154724 - DNA, 20 bp, Artificial Sequence
  chemically synthesized
aaggccactcatcatcctgt

SEQ ID NO: 154725 - DNA, 20 bp, Artificial Sequence
  chemically synthesized
taaggccactcatcatcctg

SEQ ID NO: 154726 - DNA, 20 bp, Artificial Sequence
  chemically synthesized
aatctagcctacaggatgat

SEQ ID NO: 154727 - DNA, 20 bp, Artificial Sequence
  chemically synthesized
ctagcctacaggatgatgag

SEQ ID NO: 154728 - DNA, 20 bp, Artificial Sequence
  chemically synthesized
ggatgatgagtggccttatg

SEQ ID NO: 154729 - DNA, 20 bp, Artificial Sequence
  chemically synthesized
cagaaccttgattcttcata

SEQ ID NO: 154730 - DNA, 20 bp, Artificial Sequence
  chemically synthesized
gcagaaccttgattcttcat

SEQ ID NO: 154731 - DNA, 20 bp, Artificial Sequence
  chemically synthesized
gagtggccttatgaagaatc

SEQ ID NO: 154732 - DNA, 20 bp, Artificial Sequence
  chemically synthesized
agtggccttatgaagaatca

SEQ ID NO: 154733 - DNA, 20 bp, Artificial Sequence
  chemically synthesized
aatcaaggttctgcaaccaa

SEQ ID NO: 154734 - DNA, 20 bp, Artificial Sequence
  chemically synthesized
tgacagctggctgttggttg

SEQ ID NO: 154735 - DNA, 20 bp, Artificial Sequence
  chemically synthesized
aaggttctgcaaccaacagc

SEQ ID NO: 154736 - DNA, 20 bp, Artificial Sequence
  chemically synthesized
gatatctgacagctggctgt

SEQ ID NO: 154737 - DNA, 20 bp, Artificial Sequence
  chemically synthesized
tgcaaccaacagccagctgt

SEQ ID NO: 154738 - DNA, 20 bp, Artificial Sequence
  chemically synthesized
tctctcagatatctgacagc

SEQ ID NO: 154739 - DNA, 20 bp, Artificial Sequence
  chemically synthesized
gcactctctcagatatctga

SEQ ID NO: 154740 - DNA, 20 bp, Artificial Sequence
  chemically synthesized
cagccagctgtcagatatct

SEQ ID NO: 154741 - DNA, 20 bp, Artificial Sequence
  chemically synthesized
gccagctgtcagatatctga

SEQ ID NO: 154742 - DNA, 20 bp, Artificial Sequence
  chemically synthesized
cagctgtcagatatctgaga

SEQ ID NO: 154743 - DNA, 20 bp, Artificial Sequence
  chemically synthesized
tggtctaaaatgcactctct

SEQ ID NO: 154744 - DNA, 20 bp, Artificial Sequence
  chemically synthesized
atatctgagagagtgcattt

SEQ ID NO: 154745 - DNA, 20 bp, Artificial Sequence
  chemically synthesized
agagtgcattttagaccatc

SEQ ID NO: 154746 - DNA, 20 bp, Artificial Sequence
  chemically synthesized
gcaagtgaacaggagctaga

SEQ ID NO: 154747 - DNA, 20 bp, Artificial Sequence
  chemically synthesized
tctagcaagtgaacaggagc

SEQ ID NO: 154748 - DNA, 20 bp, Artificial Sequence
  chemically synthesized
gttatctagcaagtgaacag

SEQ ID NO: 154749 - DNA, 20 bp, Artificial Sequence
  chemically synthesized
cagttatctagcaagtgaac

SEQ ID NO: 154750 - DNA, 20 bp, Artificial Sequence
  chemically synthesized
gcagttatctagcaagtgaa

SEQ ID NO: 154751 - DNA, 20 bp, Artificial Sequence
  chemically synthesized
tctagctcctgttcacttgc

SEQ ID NO: 154752 - DNA, 20 bp, Artificial Sequence
  chemically synthesized
tgtggatgcagttatctagc

SEQ ID NO: 154753 - DNA, 20 bp, Artificial Sequence
  chemically synthesized
cttatgtggatgcagttatc

SEQ ID NO: 154754 - DNA, 20 bp, Artificial Sequence
  chemically synthesized
tggtgttacttatgtggatg

SEQ ID NO: 154755 - DNA, 20 bp, Artificial Sequence
  chemically synthesized
ctagataactgcatccacat

SEQ ID NO: 154756 - DNA, 20 bp, Artificial Sequence
  chemically synthesized
cttgcttggtgttacttatg

SEQ ID NO: 154757 - DNA, 20 bp, Artificial Sequence
  chemically synthesized
gcatccacataagtaacacc

SEQ ID NO: 154758 - DNA, 20 bp, Artificial Sequence
  chemically synthesized
ccacataagtaacaccaagc

SEQ ID NO: 154759 - DNA, 20 bp, Artificial Sequence
  chemically synthesized
gttattctgatggtcttgct

SEQ ID NO: 154760 - DNA, 20 bp, Artificial Sequence
  chemically synthesized
gtaacaccaagcaagaccat

SEQ ID NO: 154761 - DNA, 20 bp, Artificial Sequence
  chemically synthesized
tagctggatagttattctga

SEQ ID NO: 154762 - DNA, 20 bp, Artificial Sequence
  chemically synthesized
agaccatcagaataactatc

SEQ ID NO: 154763 - DNA, 20 bp, Artificial Sequence
  chemically synthesized
ttgctctgtgattagctgga

SEQ ID NO: 154764 - DNA, 20 bp, Artificial Sequence
  chemically synthesized
aagtttgctctgtgattagc

SEQ ID NO: 154765 - DNA, 20 bp, Artificial Sequence
  chemically synthesized
aataactatccagctaatca

SEQ ID NO: 154766 - DNA, 20 bp, Artificial Sequence
  chemically synthesized
taactatccagctaatcaca

SEQ ID NO: 154767 - DNA, 20 bp, Artificial Sequence
  chemically synthesized
tctgaagtttgctctgtgat

SEQ ID NO: 154768 - DNA, 20 bp, Artificial Sequence
  chemically synthesized
gctaatcacagagcaaactt

SEQ ID NO: 154769 - DNA, 20 bp, Artificial Sequence
  chemically synthesized
ctcataattctgtgtgtctg

SEQ ID NO: 154770 - DNA, 20 bp, Artificial Sequence
  chemically synthesized
cagagcaaacttcagacaca

SEQ ID NO: 154771 - DNA, 20 bp, Artificial Sequence
  chemically synthesized
cttcagacacacagaattat

SEQ ID NO: 154772 - DNA, 20 bp, Artificial Sequence
  chemically synthesized
aaaacttaacagttcaaaac

SEQ ID NO: 154773 - DNA, 20 bp, Artificial Sequence
  chemically synthesized
atcactcgttttgaactgtt

SEQ ID NO: 154774 - DNA, 20 bp, Artificial Sequence
  chemically synthesized
agaagcaccccaaaacttaa

SEQ ID NO: 154775 - DNA, 20 bp, Artificial Sequence
  chemically synthesized
cgttttgaactgttaagttt

SEQ ID NO: 154776 - DNA, 20 bp, Artificial Sequence
  chemically synthesized
gttttgaactgttaagtttt

SEQ ID NO: 154777 - DNA, 20 bp, Artificial Sequence
  chemically synthesized
ttttgaactgttaagttttg

SEQ ID NO: 154778 - DNA, 20 bp, Artificial Sequence
  chemically synthesized
cagtttctattgttgcatag

SEQ ID NO: 154779 - DNA, 20 bp, Artificial Sequence
  chemically synthesized
tatcagtttctattgttgca

SEQ ID NO: 154780 - DNA, 20 bp, Artificial Sequence
  chemically synthesized
ggggtgcttctatgcaacaa

SEQ ID NO: 154781 - DNA, 20 bp, Artificial Sequence
  chemically synthesized
tgcaacaatagaaactgata

SEQ ID NO: 154782 - DNA, 20 bp, Artificial Sequence
  chemically synthesized
acaatagaaactgatatgga

SEQ ID NO: 154783 - DNA, 20 bp, Artificial Sequence
  chemically synthesized
gcttagacacctgtccatat

SEQ ID NO: 154784 - DNA, 20 bp, Artificial Sequence
  chemically synthesized
caatagaaactgatatggac

SEQ ID NO: 154785 - DNA, 20 bp, Artificial Sequence
  chemically synthesized
actgatatggacaggtgtct

SEQ ID NO: 154786 - DNA, 20 bp, Artificial Sequence
  chemically synthesized
aacttgcaattgttgttgct

SEQ ID NO: 154787 - DNA, 20 bp, Artificial Sequence
  chemically synthesized
gtctaagcaacaacaattgc

SEQ ID NO: 154788 - DNA, 20 bp, Artificial Sequence
  chemically synthesized
atcaacatactggaaaaaaa

SEQ ID NO: 154789 - DNA, 20 bp, Artificial Sequence
  chemically synthesized
caagttttgctttttttttc

SEQ ID NO: 154790 - DNA, 20 bp, Artificial Sequence
  chemically synthesized
atcaggacaaatcaacatac

SEQ ID NO: 154791 - DNA, 20 bp, Artificial Sequence
  chemically synthesized
tataaattgttttaattatc

SEQ ID NO: 154792 - DNA, 20 bp, Artificial Sequence
  chemically synthesized
gtataaattgttttaattat

SEQ ID NO: 154793 - DNA, 20 bp, Artificial Sequence
  chemically synthesized
gataattaaaacaatttata

SEQ ID NO: 154794 - DNA, 20 bp, Artificial Sequence
  chemically synthesized
ttaaaacaatttatacagct

SEQ ID NO: 154795 - DNA, 20 bp, Artificial Sequence
  chemically synthesized
taaaacaatttatacagctc

SEQ ID NO: 154796 - DNA, 20 bp, Artificial Sequence
  chemically synthesized
acaatttatacagctcaggc

SEQ ID NO: 154797 - DNA, 20 bp, Artificial Sequence
  chemically synthesized
caatttatacagctcaggca

SEQ ID NO: 154798 - DNA, 20 bp, Artificial Sequence
  chemically synthesized
ataatggggtggccttgcct

SEQ ID NO: 154799 - DNA, 20 bp, Artificial Sequence
  chemically synthesized
aattataaattataatgggg

SEQ ID NO: 154800 - DNA, 20 bp, Artificial Sequence
  chemically synthesized
ttaaattataaattataatg

SEQ ID NO: 154801 - DNA, 20 bp, Artificial Sequence
  chemically synthesized
cttaaattataaattataat

SEQ ID NO: 154802 - DNA, 20 bp, Artificial Sequence
  chemically synthesized
acttaaattataaattataa

SEQ ID NO: 154803 - DNA, 20 bp, Artificial Sequence
  chemically synthesized
cccattataatttataattt

SEQ ID NO: 154804 - DNA, 20 bp, Artificial Sequence
  chemically synthesized
ttataatttataatttaagt

SEQ ID NO: 154805 - DNA, 20 bp, Artificial Sequence
  chemically synthesized
taatttataatttaagtaag

SEQ ID NO: 154806 - DNA, 20 bp, Artificial Sequence
  chemically synthesized
taatttaagtaagcagccac

SEQ ID NO: 154807 - DNA, 20 bp, Artificial Sequence
  chemically synthesized
aatttaagtaagcagccaca

SEQ ID NO: 154808 - DNA, 20 bp, Artificial Sequence
  chemically synthesized
ttaagtaagcagccacaagg

SEQ ID NO: 154809 - DNA, 20 bp, Artificial Sequence
  chemically synthesized
cactaaaccaaactaccttg

SEQ ID NO: 154810 - DNA, 20 bp, Artificial Sequence
  chemically synthesized
taagcagccacaaggtagtt

SEQ ID NO: 154811 - DNA, 20 bp, Artificial Sequence
  chemically synthesized
agccacaaggtagtttggtt

SEQ ID NO: 154812 - DNA, 20 bp, Artificial Sequence
  chemically synthesized
tagtgttcataaaacaaaac

SEQ ID NO: 154813 - DNA, 20 bp, Artificial Sequence
  chemically synthesized
taaaacaaaacaagcaactt

SEQ ID NO: 154814 - DNA, 20 bp, Artificial Sequence
  chemically synthesized
aaaacaaaacaagcaacttt

SEQ ID NO: 154815 - DNA, 20 bp, Artificial Sequence
  chemically synthesized
aaacaagcaactttaggcct

SEQ ID NO: 154816 - DNA, 20 bp, Artificial Sequence
  chemically synthesized
gatgtagaagctgaggccta

SEQ ID NO: 154817 - DNA, 20 bp, Artificial Sequence
  chemically synthesized
ttttatagatgtagaagctg

SEQ ID NO: 154818 - DNA, 20 bp, Artificial Sequence
  chemically synthesized
cttttatagatgtagaagct

SEQ ID NO: 154819 - DNA, 20 bp, Artificial Sequence
  chemically synthesized
ttcttcttttatagatgtag

SEQ ID NO: 154820 - DNA, 20 bp, Artificial Sequence
  chemically synthesized
gtattcttcttttatagatg

SEQ ID NO: 154821 - DNA, 20 bp, Artificial Sequence
  chemically synthesized
ctcagcttctacatctataa

SEQ ID NO: 154822 - DNA, 20 bp, Artificial Sequence
  chemically synthesized
agcttctacatctataaaag

SEQ ID NO: 154823 - DNA, 20 bp, Artificial Sequence
  chemically synthesized
agttgagtattcttctttta

SEQ ID NO: 154824 - DNA, 20 bp, Artificial Sequence
  chemically synthesized
ataaaagaagaatactcaac

SEQ ID NO: 154825 - DNA, 20 bp, Artificial Sequence
  chemically synthesized
attgcaattattatctagtt

SEQ ID NO: 154826 - DNA, 20 bp, Artificial Sequence
  chemically synthesized
taattattgcaattattatc

SEQ ID NO: 154827 - DNA, 20 bp, Artificial Sequence
  chemically synthesized
ataattgcaataattattcc

SEQ ID NO: 154828 - DNA, 20 bp, Artificial Sequence
  chemically synthesized
tgcaataattattccaagtt

SEQ ID NO: 154829 - DNA, 20 bp, Artificial Sequence
  chemically synthesized
gaaccatagaaatccaaact

SEQ ID NO: 154830 - DNA, 20 bp, Artificial Sequence
  chemically synthesized
attccaagtttggatttcta

SEQ ID NO: 154831 - DNA, 20 bp, Artificial Sequence
  chemically synthesized
gtttggatttctatggttct

SEQ ID NO: 154832 - DNA, 20 bp, Artificial Sequence
  chemically synthesized
atttgaatttcttagaacca

SEQ ID NO: 154833 - DNA, 20 bp, Artificial Sequence
  chemically synthesized
ttcactctatttgaatttct

SEQ ID NO: 154834 - DNA, 20 bp, Artificial Sequence
  chemically synthesized
atggttctaagaaattcaaa

SEQ ID NO: 154835 - DNA, 20 bp, Artificial Sequence
  chemically synthesized
ggttctaagaaattcaaata

SEQ ID NO: 154836 - DNA, 20 bp, Artificial Sequence
  chemically synthesized
acttaagaagtagaaaaaat

SEQ ID NO: 154837 - DNA, 20 bp, Artificial Sequence
  chemically synthesized
accaattttttctacttctt

SEQ ID NO: 154838 - DNA, 20 bp, Artificial Sequence
  chemically synthesized
tgttttttctacttaagaag

SEQ ID NO: 154839 - DNA, 20 bp, Artificial Sequence
  chemically synthesized
aattttttctacttcttaag

SEQ ID NO: 154840 - DNA, 20 bp, Artificial Sequence
  chemically synthesized
ctgtgttttttctacttaag

SEQ ID NO: 154841 - DNA, 20 bp, Artificial Sequence
  chemically synthesized
tttctgtgttttttctactt

SEQ ID NO: 154842 - DNA, 20 bp, Artificial Sequence
  chemically synthesized
cttcttaagtagaaaaaaca

SEQ ID NO: 154843 - DNA, 20 bp, Artificial Sequence
  chemically synthesized
aagtagaaaaaacacagaaa

SEQ ID NO: 154844 - DNA, 20 bp, Artificial Sequence
  chemically synthesized
agtagaaaaaacacagaaac

SEQ ID NO: 154845 - DNA, 20 bp, Artificial Sequence
  chemically synthesized
gaaaaaacacagaaacaggc

SEQ ID NO: 154846 - DNA, 20 bp, Artificial Sequence
  chemically synthesized
aacacagaaacaggccagtc

SEQ ID NO: 154847 - DNA, 20 bp, Artificial Sequence
  chemically synthesized
acacagaaacaggccagtca

SEQ ID NO: 154848 - DNA, 20 bp, Artificial Sequence
  chemically synthesized
cagaaacaggccagtcaagg

SEQ ID NO: 154849 - DNA, 20 bp, Artificial Sequence
  chemically synthesized
caggcatgagccaccttgac

SEQ ID NO: 154850 - DNA, 20 bp, Artificial Sequence
  chemically synthesized
agtgctgggattacaggcat

SEQ ID NO: 154851 - DNA, 20 bp, Artificial Sequence
  chemically synthesized
gtggctcatgcctgtaatcc

SEQ ID NO: 154852 - DNA, 20 bp, Artificial Sequence
  chemically synthesized
tctcaaagtgctgggattac

SEQ ID NO: 154853 - DNA, 20 bp, Artificial Sequence
  chemically synthesized
ctctcaaagtgctgggatta

SEQ ID NO: 154854 - DNA, 20 bp, Artificial Sequence
  chemically synthesized
cctcagcctctcaaagtgct

SEQ ID NO: 154855 - DNA, 20 bp, Artificial Sequence
  chemically synthesized
gcctgtaatcccagcacttt

SEQ ID NO: 154856 - DNA, 20 bp, Artificial Sequence
  chemically synthesized
gcctcagcctctcaaagtgc

SEQ ID NO: 154857 - DNA, 20 bp, Artificial Sequence
  chemically synthesized
ctgtaatcccagcactttga

SEQ ID NO: 154858 - DNA, 20 bp, Artificial Sequence
  chemically synthesized
tgtaatcccagcactttgag

SEQ ID NO: 154859 - DNA, 20 bp, Artificial Sequence
  chemically synthesized
ccgcctgcctcagcctctca

SEQ ID NO: 154860 - DNA, 20 bp, Artificial Sequence
  chemically synthesized
tcccagcactttgagaggct

SEQ ID NO: 154861 - DNA, 20 bp, Artificial Sequence
  chemically synthesized
cccagcactttgagaggctg

SEQ ID NO: 154862 - DNA, 20 bp, Artificial Sequence
  chemically synthesized
agcactttgagaggctgagg

SEQ ID NO: 154863 - DNA, 20 bp, Artificial Sequence
  chemically synthesized
gcactttgagaggctgaggc

SEQ ID NO: 154864 - DNA, 20 bp, Artificial Sequence
  chemically synthesized
ctttgagaggctgaggcagg

SEQ ID NO: 154865 - DNA, 20 bp, Artificial Sequence
  chemically synthesized
ctcaagtgatccgcctgcct

SEQ ID NO: 154866 - DNA, 20 bp, Artificial Sequence
  chemically synthesized
ctgaggcaggcggatcactt

SEQ ID NO: 154867 - DNA, 20 bp, Artificial Sequence
  chemically synthesized
tgaggcaggcggatcacttg

SEQ ID NO: 154868 - DNA, 20 bp, Artificial Sequence
  chemically synthesized
gcaggcggatcacttgaggt

SEQ ID NO: 154869 - DNA, 20 bp, Artificial Sequence
  chemically synthesized
caggcggatcacttgaggtc

SEQ ID NO: 154870 - DNA, 20 bp, Artificial Sequence
  chemically synthesized
ggtcttaaactcctgacctc

SEQ ID NO: 154871 - DNA, 20 bp, Artificial Sequence
  chemically synthesized
ggcggatcacttgaggtcag

SEQ ID NO: 154872 - DNA, 20 bp, Artificial Sequence
  chemically synthesized
tcacttgaggtcaggagttt

SEQ ID NO: 154873 - DNA, 20 bp, Artificial Sequence
  chemically synthesized
tgaggtcaggagtttaagac

SEQ ID NO: 154874 - DNA, 20 bp, Artificial Sequence
  chemically synthesized
ttgctccatgttgatcaggc

SEQ ID NO: 154875 - DNA, 20 bp, Artificial Sequence
  chemically synthesized
ggggttgctccatgttgatc

SEQ ID NO: 154876 - DNA, 20 bp, Artificial Sequence
  chemically synthesized
taagaccagcctgatcaaca

SEQ ID NO: 154877 - DNA, 20 bp, Artificial Sequence
  chemically synthesized
cggggttgctccatgttgat

SEQ ID NO: 154878 - DNA, 20 bp, Artificial Sequence
  chemically synthesized
agaccagcctgatcaacatg

SEQ ID NO: 154879 - DNA, 20 bp, Artificial Sequence
  chemically synthesized
ttgtagttttagtaaagacg

SEQ ID NO: 154880 - DNA, 20 bp, Artificial Sequence
  chemically synthesized
tttgtagttttagtaaagac

SEQ ID NO: 154881 - DNA, 20 bp, Artificial Sequence
  chemically synthesized
ttttgtagttttagtaaaga

SEQ ID NO: 154882 - DNA, 20 bp, Artificial Sequence
  chemically synthesized
taatttttgtagttttagta

SEQ ID NO: 154883 - DNA, 20 bp, Artificial Sequence
  chemically synthesized
ccagctaatttttgtagttt

SEQ ID NO: 154884 - DNA, 20 bp, Artificial Sequence
  chemically synthesized
tttactaaaactacaaaaat

SEQ ID NO: 154885 - DNA, 20 bp, Artificial Sequence
  chemically synthesized
ccatgcccagctaatttttg

SEQ ID NO: 154886 - DNA, 20 bp, Artificial Sequence
  chemically synthesized
ctaaaactacaaaaattagc

SEQ ID NO: 154887 - DNA, 20 bp, Artificial Sequence
  chemically synthesized
taaaactacaaaaattagct

SEQ ID NO: 154888 - DNA, 20 bp, Artificial Sequence
  chemically synthesized
ctacaaaaattagctgggca

SEQ ID NO: 154889 - DNA, 20 bp, Artificial Sequence
  chemically synthesized
caaaaattagctgggcatgg

SEQ ID NO: 154890 - DNA, 20 bp, Artificial Sequence
  chemically synthesized
caggtgcgcaccaccatgcc

SEQ ID NO: 154891 - DNA, 20 bp, Artificial Sequence
  chemically synthesized
ggtggtgcgcacctgtatcc

SEQ ID NO: 154892 - DNA, 20 bp, Artificial Sequence
  chemically synthesized
ctcccaagtagctgggatac

SEQ ID NO: 154893 - DNA, 20 bp, Artificial Sequence
  chemically synthesized
cctcccaagtagctgggata

SEQ ID NO: 154894 - DNA, 20 bp, Artificial Sequence
  chemically synthesized
gcacctgtatcccagctact

SEQ ID NO: 154895 - DNA, 20 bp, Artificial Sequence
  chemically synthesized
cctcagcctcccaagtagct

SEQ ID NO: 154896 - DNA, 20 bp, Artificial Sequence
  chemically synthesized
cacctgtatcccagctactt

SEQ ID NO: 154897 - DNA, 20 bp, Artificial Sequence
  chemically synthesized
gcctcagcctcccaagtagc

SEQ ID NO: 154898 - DNA, 20 bp, Artificial Sequence
  chemically synthesized
cctgtatcccagctacttgg

SEQ ID NO: 154899 - DNA, 20 bp, Artificial Sequence
  chemically synthesized
ctgtatcccagctacttggg

SEQ ID NO: 154900 - DNA, 20 bp, Artificial Sequence
  chemically synthesized
tcctgcctcagcctcccaag

SEQ ID NO: 154901 - DNA, 20 bp, Artificial Sequence
  chemically synthesized
ttctcctgcctcagcctccc

SEQ ID NO: 154902 - DNA, 20 bp, Artificial Sequence
  chemically synthesized
tcccagctacttgggaggct

SEQ ID NO: 154903 - DNA, 20 bp, Artificial Sequence
  chemically synthesized
cccagctacttgggaggctg

SEQ ID NO: 154904 - DNA, 20 bp, Artificial Sequence
  chemically synthesized
agctacttgggaggctgagg

SEQ ID NO: 154905 - DNA, 20 bp, Artificial Sequence
  chemically synthesized
gctacttgggaggctgaggc

SEQ ID NO: 154906 - DNA, 20 bp, Artificial Sequence
  chemically synthesized
tacttgggaggctgaggcag

SEQ ID NO: 154907 - DNA, 20 bp, Artificial Sequence
  chemically synthesized
ttcaagcgattctcctgcct

SEQ ID NO: 154908 - DNA, 20 bp, Artificial Sequence
  chemically synthesized
aacctctgcctttcaggttc

SEQ ID NO: 154909 - DNA, 20 bp, Artificial Sequence
  chemically synthesized
ggagaatcgcttgaacctga

SEQ ID NO: 154910 - DNA, 20 bp, Artificial Sequence
  chemically synthesized
gagaatcgcttgaacctgaa

SEQ ID NO: 154911 - DNA, 20 bp, Artificial Sequence
  chemically synthesized
aatcgcttgaacctgaaagg

SEQ ID NO: 154912 - DNA, 20 bp, Artificial Sequence
  chemically synthesized
tactacaacctctgcctttc

SEQ ID NO: 154913 - DNA, 20 bp, Artificial Sequence
  chemically synthesized
tcgcttgaacctgaaaggca

SEQ ID NO: 154914 - DNA, 20 bp, Artificial Sequence
  chemically synthesized
ttactacaacctctgccttt

SEQ ID NO: 154915 - DNA, 20 bp, Artificial Sequence
  chemically synthesized
cgcttgaacctgaaaggcag

SEQ ID NO: 154916 - DNA, 20 bp, Artificial Sequence
  chemically synthesized
aacctgaaaggcagaggttg

SEQ ID NO: 154917 - DNA, 20 bp, Artificial Sequence
  chemically synthesized
ggcagaggttgtagtaaacc

SEQ ID NO: 154918 - DNA, 20 bp, Artificial Sequence
  chemically synthesized
ggagtgcagtggtgcgatct

SEQ ID NO: 154919 - DNA, 20 bp, Artificial Sequence
  chemically synthesized
ttgcccaggctggagtgcag

SEQ ID NO: 154920 - DNA, 20 bp, Artificial Sequence
  chemically synthesized
gagatcgcaccactgcactc

SEQ ID NO: 154921 - DNA, 20 bp, Artificial Sequence
  chemically synthesized
ctgttgcccaggctggagtg

SEQ ID NO: 154922 - DNA, 20 bp, Artificial Sequence
  chemically synthesized
cgcaccactgcactccagcc

SEQ ID NO: 154923 - DNA, 20 bp, Artificial Sequence
  chemically synthesized
gcaccactgcactccagcct

SEQ ID NO: 154924 - DNA, 20 bp, Artificial Sequence
  chemically synthesized
ttgctctgttgcccaggctg

SEQ ID NO: 154925 - DNA, 20 bp, Artificial Sequence
  chemically synthesized
tcttgctctgttgcccaggc

SEQ ID NO: 154926 - DNA, 20 bp, Artificial Sequence
  chemically synthesized
ctgcactccagcctgggcaa

SEQ ID NO: 154927 - DNA, 20 bp, Artificial Sequence
  chemically synthesized
agaatcttgctctgttgccc

SEQ ID NO: 154928 - DNA, 20 bp, Artificial Sequence
  chemically synthesized
gcactccagcctgggcaaca

SEQ ID NO: 154929 - DNA, 20 bp, Artificial Sequence
  chemically synthesized
cagaatcttgctctgttgcc

SEQ ID NO: 154930 - DNA, 20 bp, Artificial Sequence
  chemically synthesized
tccagcctgggcaacagagc

SEQ ID NO: 154931 - DNA, 20 bp, Artificial Sequence
  chemically synthesized
gtgtgtgtgtgtgtgtgtga

SEQ ID NO: 154932 - DNA, 20 bp, Artificial Sequence
  chemically synthesized
cacacacacacacacacaca

SEQ ID NO: 154933 - DNA, 20 bp, Artificial Sequence
  chemically synthesized
acacacacacacaaagaaaa

SEQ ID NO: 154934 - DNA, 20 bp, Artificial Sequence
  chemically synthesized
acacacacaaagaaaaaaga

SEQ ID NO: 154935 - DNA, 20 bp, Artificial Sequence
  chemically synthesized
acacaaagaaaaaagaaaga

SEQ ID NO: 154936 - DNA, 20 bp, Artificial Sequence
  chemically synthesized
aagaaaaaagaaagaaagaa

SEQ ID NO: 154937 - DNA, 20 bp, Artificial Sequence
  chemically synthesized
aagaaagaaaagaaaaaaca

SEQ ID NO: 154938 - DNA, 20 bp, Artificial Sequence
  chemically synthesized
atctggagtaaaagtgatac

SEQ ID NO: 154939 - DNA, 20 bp, Artificial Sequence
  chemically synthesized
aacttgtatcacttttactc

SEQ ID NO: 154940 - DNA, 20 bp, Artificial Sequence
  chemically synthesized
cttaaatttatctggagtaa

SEQ ID NO: 154941 - DNA, 20 bp, Artificial Sequence
  chemically synthesized
ctcaatcttaaatttatctg

SEQ ID NO: 154942 - DNA, 20 bp, Artificial Sequence
  chemically synthesized
aactcaatcttaaatttatc

SEQ ID NO: 154943 - DNA, 20 bp, Artificial Sequence
  chemically synthesized
cttttactccagataaattt

SEQ ID NO: 154944 - DNA, 20 bp, Artificial Sequence
  chemically synthesized
ctccagataaatttaagatt

SEQ ID NO: 154945 - DNA, 20 bp, Artificial Sequence
  chemically synthesized
agttaaattatattaactgc

SEQ ID NO: 154946 - DNA, 20 bp, Artificial Sequence
  chemically synthesized
aaattatattaactgctggc

SEQ ID NO: 154947 - DNA, 20 bp, Artificial Sequence
  chemically synthesized
atacagatgcagctggccag

SEQ ID NO: 154948 - DNA, 20 bp, Artificial Sequence
  chemically synthesized
cagatacagatgcagctggc

SEQ ID NO: 154949 - DNA, 20 bp, Artificial Sequence
  chemically synthesized
attacagatacagatgcagc

SEQ ID NO: 154950 - DNA, 20 bp, Artificial Sequence
  chemically synthesized
gaaaattacagatacagatg

SEQ ID NO: 154951 - DNA, 20 bp, Artificial Sequence
  chemically synthesized
ctaatggaaaattacagata

SEQ ID NO: 154952 - DNA, 20 bp, Artificial Sequence
  chemically synthesized
aagaacctaatggaaaatta

SEQ ID NO: 154953 - DNA, 20 bp, Artificial Sequence
  chemically synthesized
ctgtatctgtaattttccat

SEQ ID NO: 154954 - DNA, 20 bp, Artificial Sequence
  chemically synthesized
tgtatctgtaattttccatt

SEQ ID NO: 154955 - DNA, 20 bp, Artificial Sequence
  chemically synthesized
ctctctgtccaagaacctaa

SEQ ID NO: 154956 - DNA, 20 bp, Artificial Sequence
  chemically synthesized
gtaattttccattaggttct

SEQ ID NO: 154957 - DNA, 20 bp, Artificial Sequence
  chemically synthesized
ttttccattaggttcttgga

SEQ ID NO: 154958 - DNA, 20 bp, Artificial Sequence
  chemically synthesized
ttccattaggttcttggaca

SEQ ID NO: 154959 - DNA, 20 bp, Artificial Sequence
  chemically synthesized
ccattaggttcttggacaga

SEQ ID NO: 154960 - DNA, 20 bp, Artificial Sequence
  chemically synthesized
tttacactatctctctgtcc

SEQ ID NO: 154961 - DNA, 20 bp, Artificial Sequence
  chemically synthesized
taggttcttggacagagaga

SEQ ID NO: 154962 - DNA, 20 bp, Artificial Sequence
  chemically synthesized
ttggacagagagatagtgta

SEQ ID NO: 154963 - DNA, 20 bp, Artificial Sequence
  chemically synthesized
cagagagatagtgtaaagca

SEQ ID NO: 154964 - DNA, 20 bp, Artificial Sequence
  chemically synthesized
acagcctgtgttttgttttg

SEQ ID NO: 154965 - DNA, 20 bp, Artificial Sequence
  chemically synthesized
cacagccacaaaacaaaaca

SEQ ID NO: 154966 - DNA, 20 bp, Artificial Sequence
  chemically synthesized
acagccacaaaacaaaacac

SEQ ID NO: 154967 - DNA, 20 bp, Artificial Sequence
  chemically synthesized
acaaaacaaaacacaggctg

SEQ ID NO: 154968 - DNA, 20 bp, Artificial Sequence
  chemically synthesized
aaaacaaaacacaggctgtg

SEQ ID NO: 154969 - DNA, 20 bp, Artificial Sequence
  chemically synthesized
agtccacatgtcaagctcca

SEQ ID NO: 154970 - DNA, 20 bp, Artificial Sequence
  chemically synthesized
aggctgtggagcttgacatg

SEQ ID NO: 154971 - DNA, 20 bp, Artificial Sequence
  chemically synthesized
agggtttcagtccacatgtc

SEQ ID NO: 154972 - DNA, 20 bp, Artificial Sequence
  chemically synthesized
aagcaagcaagcaagggttt

SEQ ID NO: 154973 - DNA, 20 bp, Artificial Sequence
  chemically synthesized
gctagaaagcaagcaagcaa

SEQ ID NO: 154974 - DNA, 20 bp, Artificial Sequence
  chemically synthesized
agctagaaagcaagcaagca

SEQ ID NO: 154975 - DNA, 20 bp, Artificial Sequence
  chemically synthesized
cagctagaaagcaagcaagc

SEQ ID NO: 154976 - DNA, 20 bp, Artificial Sequence
  chemically synthesized
cacacagctagaaagcaagc

SEQ ID NO: 154977 - DNA, 20 bp, Artificial Sequence
  chemically synthesized
acccttgcttgcttgctttc

SEQ ID NO: 154978 - DNA, 20 bp, Artificial Sequence
  chemically synthesized
aggccacacagctagaaagc

SEQ ID NO: 154979 - DNA, 20 bp, Artificial Sequence
  chemically synthesized
attaaggccacacagctaga

SEQ ID NO: 154980 - DNA, 20 bp, Artificial Sequence
  chemically synthesized
ttgcttgctttctagctgtg

SEQ ID NO: 154981 - DNA, 20 bp, Artificial Sequence
  chemically synthesized
ctagattaaggccacacagc

SEQ ID NO: 154982 - DNA, 20 bp, Artificial Sequence
  chemically synthesized
atagctagattaaggccaca

SEQ ID NO: 154983 - DNA, 20 bp, Artificial Sequence
  chemically synthesized
ctagctgtgtggccttaatc

SEQ ID NO: 154984 - DNA, 20 bp, Artificial Sequence
  chemically synthesized
gaggggagatagctagatta

SEQ ID NO: 154985 - DNA, 20 bp, Artificial Sequence
  chemically synthesized
agaggggagatagctagatt

SEQ ID NO: 154986 - DNA, 20 bp, Artificial Sequence
  chemically synthesized
aggtttagaggggagatagc

SEQ ID NO: 154987 - DNA, 20 bp, Artificial Sequence
  chemically synthesized
cctgaggtttagaggggaga

SEQ ID NO: 154988 - DNA, 20 bp, Artificial Sequence
  chemically synthesized
ggagcctgaggtttagaggg

SEQ ID NO: 154989 - DNA, 20 bp, Artificial Sequence
  chemically synthesized
aaggagcctgaggtttagag

SEQ ID NO: 154990 - DNA, 20 bp, Artificial Sequence
  chemically synthesized
taaggagcctgaggtttaga

SEQ ID NO: 154991 - DNA, 20 bp, Artificial Sequence
  chemically synthesized
ttaaggagcctgaggtttag

SEQ ID NO: 154992 - DNA, 20 bp, Artificial Sequence
  chemically synthesized
gctatctcccctctaaacct

SEQ ID NO: 154993 - DNA, 20 bp, Artificial Sequence
  chemically synthesized
attaaggagcctgaggttta

SEQ ID NO: 154994 - DNA, 20 bp, Artificial Sequence
  chemically synthesized
ctatctcccctctaaacctc

SEQ ID NO: 154995 - DNA, 20 bp, Artificial Sequence
  chemically synthesized
agattaaggagcctgaggtt

SEQ ID NO: 154996 - DNA, 20 bp, Artificial Sequence
  chemically synthesized
tttaaagattaaggagcctg

SEQ ID NO: 154997 - DNA, 20 bp, Artificial Sequence
  chemically synthesized
ttttaaagattaaggagcct

SEQ ID NO: 154998 - DNA, 20 bp, Artificial Sequence
  chemically synthesized
gataatttttaaagattaag

SEQ ID NO: 154999 - DNA, 20 bp, Artificial Sequence
  chemically synthesized
tagataatttttaaagatta

SEQ ID NO: 155000 - DNA, 20 bp, Artificial Sequence
  chemically synthesized
atagataatttttaaagatt

SEQ ID NO: 155001 - DNA, 20 bp, Artificial Sequence
  chemically synthesized
gaacatatagataattttta

SEQ ID NO: 155002 - DNA, 20 bp, Artificial Sequence
  chemically synthesized
aaataactgcaaagaacata

SEQ ID NO: 155003 - DNA, 20 bp, Artificial Sequence
  chemically synthesized
aattatctatatgttctttg

SEQ ID NO: 155004 - DNA, 20 bp, Artificial Sequence
  chemically synthesized
ttatcctcaaaataactgca

SEQ ID NO: 155005 - DNA, 20 bp, Artificial Sequence
  chemically synthesized
atgttctttgcagttatttt

SEQ ID NO: 155006 - DNA, 20 bp, Artificial Sequence
  chemically synthesized
tgttctttgcagttattttg

SEQ ID NO: 155007 - DNA, 20 bp, Artificial Sequence
  chemically synthesized
ttgcagttattttgaggata

SEQ ID NO: 155008 - DNA, 20 bp, Artificial Sequence
  chemically synthesized
ggataaagacatatatgtta

SEQ ID NO: 155009 - DNA, 20 bp, Artificial Sequence
  chemically synthesized
gacatatatgttaaagctac

SEQ ID NO: 155010 - DNA, 20 bp, Artificial Sequence
  chemically synthesized
agaagctacacatatacttg

SEQ ID NO: 155011 - DNA, 20 bp, Artificial Sequence
  chemically synthesized
taaagctacaagtatatgtg

SEQ ID NO: 155012 - DNA, 20 bp, Artificial Sequence
  chemically synthesized
tcctactattaaatatgtag

SEQ ID NO: 155013 - DNA, 20 bp, Artificial Sequence
  chemically synthesized
cattcctactattaaatatg

SEQ ID NO: 155014 - DNA, 20 bp, Artificial Sequence
  chemically synthesized
tgtagcttctacatatttaa

SEQ ID NO: 155015 - DNA, 20 bp, Artificial Sequence
  chemically synthesized
agcttctacatatttaatag

SEQ ID NO: 155016 - DNA, 20 bp, Artificial Sequence
  chemically synthesized
gcttctacatatttaatagt

SEQ ID NO: 155017 - DNA, 20 bp, Artificial Sequence
  chemically synthesized
atttaatagtaggaatgcaa

SEQ ID NO: 155018 - DNA, 20 bp, Artificial Sequence
  chemically synthesized
gaatttataattcattatag

SEQ ID NO: 155019 - DNA, 20 bp, Artificial Sequence
  chemically synthesized
atagaatttataattcatta

SEQ ID NO: 155020 - DNA, 20 bp, Artificial Sequence
  chemically synthesized
tgtactgtattacaatgtaa

SEQ ID NO: 155021 - DNA, 20 bp, Artificial Sequence
  chemically synthesized
aattctattacattgtaata

SEQ ID NO: 155022 - DNA, 20 bp, Artificial Sequence
  chemically synthesized
atgaaataataaacatatac

SEQ ID NO: 155023 - DNA, 20 bp, Artificial Sequence
  chemically synthesized
aaataataaacatatacaag

SEQ ID NO: 155024 - DNA, 20 bp, Artificial Sequence
  chemically synthesized
acaagaagcataatacaaat

SEQ ID NO: 155025 - DNA, 20 bp, Artificial Sequence
  chemically synthesized
aaataaatgcaatataaaaa

SEQ ID NO: 155026 - DNA, 20 bp, Artificial Sequence
  chemically synthesized
ctgacttgcaggaagttaat

SEQ ID NO: 155027 - DNA, 20 bp, Artificial Sequence
  chemically synthesized
atttctgattaacttcctgc

SEQ ID NO: 155028 - DNA, 20 bp, Artificial Sequence
  chemically synthesized
ccgacttcctgacttgcagg

SEQ ID NO: 155029 - DNA, 20 bp, Artificial Sequence
  chemically synthesized
ctgattaacttcctgcaagt

SEQ ID NO: 155030 - DNA, 20 bp, Artificial Sequence
  chemically synthesized
tgattaacttcctgcaagtc

SEQ ID NO: 155031 - DNA, 20 bp, Artificial Sequence
  chemically synthesized
ttcccgacttcctgacttgc

SEQ ID NO: 155032 - DNA, 20 bp, Artificial Sequence
  chemically synthesized
attcccgacttcctgacttg

SEQ ID NO: 155033 - DNA, 20 bp, Artificial Sequence
  chemically synthesized
ttaacttcctgcaagtcagg

SEQ ID NO: 155034 - DNA, 20 bp, Artificial Sequence
  chemically synthesized
cttcctgcaagtcaggaagt

SEQ ID NO: 155035 - DNA, 20 bp, Artificial Sequence
  chemically synthesized
ttcctgcaagtcaggaagtc

SEQ ID NO: 155036 - DNA, 20 bp, Artificial Sequence
  chemically synthesized
gcaagtcaggaagtcgggaa

SEQ ID NO: 155037 - DNA, 20 bp, Artificial Sequence
  chemically synthesized
gtagttcaaatatcagaata

SEQ ID NO: 155038 - DNA, 20 bp, Artificial Sequence
  chemically synthesized
tactgtggtagttcaaatat

SEQ ID NO: 155039 - DNA, 20 bp, Artificial Sequence
  chemically synthesized
ttctgatatttgaactacca

SEQ ID NO: 155040 - DNA, 20 bp, Artificial Sequence
  chemically synthesized
ttcttttttctttactgtgg

SEQ ID NO: 155041 - DNA, 20 bp, Artificial Sequence
  chemically synthesized
atatttgaactaccacagta

SEQ ID NO: 155042 - DNA, 20 bp, Artificial Sequence
  chemically synthesized
attttcttttttctttactg

SEQ ID NO: 155043 - DNA, 20 bp, Artificial Sequence
  chemically synthesized
aactaccacagtaaagaaaa

SEQ ID NO: 155044 - DNA, 20 bp, Artificial Sequence
  chemically synthesized
agagctgcttttattaaaat

SEQ ID NO: 155045 - DNA, 20 bp, Artificial Sequence
  chemically synthesized
agaaaatcttattttaataa

SEQ ID NO: 155046 - DNA, 20 bp, Artificial Sequence
  chemically synthesized
aaatcttattttaataaaag

SEQ ID NO: 155047 - DNA, 20 bp, Artificial Sequence
  chemically synthesized
aaggtagtcatttaaattca

SEQ ID NO: 155048 - DNA, 20 bp, Artificial Sequence
  chemically synthesized
aaaaggtagtcatttaaatt

SEQ ID NO: 155049 - DNA, 20 bp, Artificial Sequence
  chemically synthesized
atgaaaaaaaaaacaaaagg

SEQ ID NO: 155050 - DNA, 20 bp, Artificial Sequence
  chemically synthesized
tgaatgaaaaaaaaaacaaa

SEQ ID NO: 155051 - DNA, 20 bp, Artificial Sequence
  chemically synthesized
ttgaatgaaaaaaaaaacaa

SEQ ID NO: 155052 - DNA, 20 bp, Artificial Sequence
  chemically synthesized
acagatctgagcattaagtc

SEQ ID NO: 155053 - DNA, 20 bp, Artificial Sequence
  chemically synthesized
taacatcttgacttaatgct

SEQ ID NO: 155054 - DNA, 20 bp, Artificial Sequence
  chemically synthesized
ccgaaacagatctgagcatt

SEQ ID NO: 155055 - DNA, 20 bp, Artificial Sequence
  chemically synthesized
tagcaaaccgaaacagatct

SEQ ID NO: 155056 - DNA, 20 bp, Artificial Sequence
  chemically synthesized
cttaatgctcagatctgttt

SEQ ID NO: 155057 - DNA, 20 bp, Artificial Sequence
  chemically synthesized
tcctctttagcaaaccgaaa

SEQ ID NO: 155058 - DNA, 20 bp, Artificial Sequence
  chemically synthesized
agatctgtttcggtttgcta

SEQ ID NO: 155059 - DNA, 20 bp, Artificial Sequence
  chemically synthesized
atctgtttcggtttgctaaa

SEQ ID NO: 155060 - DNA, 20 bp, Artificial Sequence
  chemically synthesized
tctgtttcggtttgctaaag

SEQ ID NO: 155061 - DNA, 20 bp, Artificial Sequence
  chemically synthesized
caggtgcttttcatcctctt

SEQ ID NO: 155062 - DNA, 20 bp, Artificial Sequence
  chemically synthesized
ggtttgctaaagaggatgaa

SEQ ID NO: 155063 - DNA, 20 bp, Artificial Sequence
  chemically synthesized
gatgaaaagcacctgctttt

SEQ ID NO: 155064 - DNA, 20 bp, Artificial Sequence
  chemically synthesized
agaggaattttctcaaaagc

SEQ ID NO: 155065 - DNA, 20 bp, Artificial Sequence
  chemically synthesized
aagaggaattttctcaaaag

SEQ ID NO: 155066 - DNA, 20 bp, Artificial Sequence
  chemically synthesized
ggaaagaggaattttctcaa

SEQ ID NO: 155067 - DNA, 20 bp, Artificial Sequence
  chemically synthesized
aaaaaagaattaagggaaag

SEQ ID NO: 155068 - DNA, 20 bp, Artificial Sequence
  chemically synthesized
taaaaaagaattaagggaaa

SEQ ID NO: 155069 - DNA, 20 bp, Artificial Sequence
  chemically synthesized
gctaaaaaagaattaaggga

SEQ ID NO: 155070 - DNA, 20 bp, Artificial Sequence
  chemically synthesized
agtagctaaaaaagaattaa

SEQ ID NO: 155071 - DNA, 20 bp, Artificial Sequence
  chemically synthesized
tagtagctaaaaaagaatta

SEQ ID NO: 155072 - DNA, 20 bp, Artificial Sequence
  chemically synthesized
gtagtagctaaaaaagaatt

SEQ ID NO: 155073 - DNA, 20 bp, Artificial Sequence
  chemically synthesized
tctttcccttaattcttttt

SEQ ID NO: 155074 - DNA, 20 bp, Artificial Sequence
  chemically synthesized
agttgtggtagtagctaaaa

SEQ ID NO: 155075 - DNA, 20 bp, Artificial Sequence
  chemically synthesized
agctggcagagttgtggtag

SEQ ID NO: 155076 - DNA, 20 bp, Artificial Sequence
  chemically synthesized
gatagctggcagagttgtgg

SEQ ID NO: 155077 - DNA, 20 bp, Artificial Sequence
  chemically synthesized
ggtgatagctggcagagttg

SEQ ID NO: 155078 - DNA, 20 bp, Artificial Sequence
  chemically synthesized
agctactaccacaactctgc

SEQ ID NO: 155079 - DNA, 20 bp, Artificial Sequence
  chemically synthesized
ctgtttggtgatagctggca

SEQ ID NO: 155080 - DNA, 20 bp, Artificial Sequence
  chemically synthesized
agctgtttggtgatagctgg

SEQ ID NO: 155081 - DNA, 20 bp, Artificial Sequence
  chemically synthesized
caaagctgtttggtgatagc

SEQ ID NO: 155082 - DNA, 20 bp, Artificial Sequence
  chemically synthesized
agctcaaagctgtttggtga

SEQ ID NO: 155083 - DNA, 20 bp, Artificial Sequence
  chemically synthesized
ctctgccagctatcaccaaa

SEQ ID NO: 155084 - DNA, 20 bp, Artificial Sequence
  chemically synthesized
gccctcagctcaaagctgtt

SEQ ID NO: 155085 - DNA, 20 bp, Artificial Sequence
  chemically synthesized
agctatcaccaaacagcttt

SEQ ID NO: 155086 - DNA, 20 bp, Artificial Sequence
  chemically synthesized
tcaccaaacagctttgagct

SEQ ID NO: 155087 - DNA, 20 bp, Artificial Sequence
  chemically synthesized
caccaaacagctttgagctg

SEQ ID NO: 155088 - DNA, 20 bp, Artificial Sequence
  chemically synthesized
ctgggaatgccctcagctca

SEQ ID NO: 155089 - DNA, 20 bp, Artificial Sequence
  chemically synthesized
accaaacagctttgagctga

SEQ ID NO: 155090 - DNA, 20 bp, Artificial Sequence
  chemically synthesized
ggagagtctgggaatgccct

SEQ ID NO: 155091 - DNA, 20 bp, Artificial Sequence
  chemically synthesized
ctttgagctgagggcattcc

SEQ ID NO: 155092 - DNA, 20 bp, Artificial Sequence
  chemically synthesized
gctgccagtatggagagtct

SEQ ID NO: 155093 - DNA, 20 bp, Artificial Sequence
  chemically synthesized
tgctgccagtatggagagtc

SEQ ID NO: 155094 - DNA, 20 bp, Artificial Sequence
  chemically synthesized
cattcccagactctccatac

SEQ ID NO: 155095 - DNA, 20 bp, Artificial Sequence
  chemically synthesized
cacattgctgccagtatgga

SEQ ID NO: 155096 - DNA, 20 bp, Artificial Sequence
  chemically synthesized
tccacattgctgccagtatg

SEQ ID NO: 155097 - DNA, 20 bp, Artificial Sequence
  chemically synthesized
tcccagactctccatactgg

SEQ ID NO: 155098 - DNA, 20 bp, Artificial Sequence
  chemically synthesized
cctccacattgctgccagta

SEQ ID NO: 155099 - DNA, 20 bp, Artificial Sequence
  chemically synthesized
tatgtcctccacattgctgc

SEQ ID NO: 155100 - DNA, 20 bp, Artificial Sequence
  chemically synthesized
tctccatactggcagcaatg

SEQ ID NO: 155101 - DNA, 20 bp, Artificial Sequence
  chemically synthesized
tccatactggcagcaatgtg

SEQ ID NO: 155102 - DNA, 20 bp, Artificial Sequence
  chemically synthesized
ccatactggcagcaatgtgg

SEQ ID NO: 155103 - DNA, 20 bp, Artificial Sequence
  chemically synthesized
tggcagcaatgtggaggaca

SEQ ID NO: 155104 - DNA, 20 bp, Artificial Sequence
  chemically synthesized
ggcagcaatgtggaggacat

SEQ ID NO: 155105 - DNA, 20 bp, Artificial Sequence
  chemically synthesized
cagcaatgtggaggacatag

SEQ ID NO: 155106 - DNA, 20 bp, Artificial Sequence
  chemically synthesized
caatgtggaggacataggag

SEQ ID NO: 155107 - DNA, 20 bp, Artificial Sequence
  chemically synthesized
tggaggacataggagaagac

SEQ ID NO: 155108 - DNA, 20 bp, Artificial Sequence
  chemically synthesized
gaggacataggagaagacaa

SEQ ID NO: 155109 - DNA, 20 bp, Artificial Sequence
  chemically synthesized
gacataggagaagacaagag

SEQ ID NO: 155110 - DNA, 20 bp, Artificial Sequence
  chemically synthesized
ataggagaagacaagagtgg

SEQ ID NO: 155111 - DNA, 20 bp, Artificial Sequence
  chemically synthesized
taggagaagacaagagtggt

SEQ ID NO: 155112 - DNA, 20 bp, Artificial Sequence
  chemically synthesized
aggagaagacaagagtggtg

SEQ ID NO: 155113 - DNA, 20 bp, Artificial Sequence
  chemically synthesized
ggagaagacaagagtggtgg

SEQ ID NO: 155114 - DNA, 20 bp, Artificial Sequence
  chemically synthesized
gagaagacaagagtggtggg

SEQ ID NO: 155115 - DNA, 20 bp, Artificial Sequence
  chemically synthesized
caagagtggtggggggtgat

SEQ ID NO: 155116 - DNA, 20 bp, Artificial Sequence
  chemically synthesized
gggtgatgagaccctcatgt

SEQ ID NO: 155117 - DNA, 20 bp, Artificial Sequence
  chemically synthesized
ggtgatgagaccctcatgtt

SEQ ID NO: 155118 - DNA, 20 bp, Artificial Sequence
  chemically synthesized
cttccttctccccaacatga

SEQ ID NO: 155119 - DNA, 20 bp, Artificial Sequence
  chemically synthesized
gtgatgagaccctcatgttg

SEQ ID NO: 155120 - DNA, 20 bp, Artificial Sequence
  chemically synthesized
acttccttctccccaacatg

SEQ ID NO: 155121 - DNA, 20 bp, Artificial Sequence
  chemically synthesized
tacttccttctccccaacat

SEQ ID NO: 155122 - DNA, 20 bp, Artificial Sequence
  chemically synthesized
gatgagaccctcatgttggg

SEQ ID NO: 155123 - DNA, 20 bp, Artificial Sequence
  chemically synthesized
gagaccctcatgttggggag

SEQ ID NO: 155124 - DNA, 20 bp, Artificial Sequence
  chemically synthesized
agaccctcatgttggggaga

SEQ ID NO: 155125 - DNA, 20 bp, Artificial Sequence
  chemically synthesized
ccctcatgttggggagaagg

SEQ ID NO: 155126 - DNA, 20 bp, Artificial Sequence
  chemically synthesized
tcatgttggggagaaggaag

SEQ ID NO: 155127 - DNA, 20 bp, Artificial Sequence
  chemically synthesized
catgttggggagaaggaagt

SEQ ID NO: 155128 - DNA, 20 bp, Artificial Sequence
  chemically synthesized
atgttggggagaaggaagta

SEQ ID NO: 155129 - DNA, 20 bp, Artificial Sequence
  chemically synthesized
ttggggagaaggaagtaggg

SEQ ID NO: 155130 - DNA, 20 bp, Artificial Sequence
  chemically synthesized
gaagtagggcagtgctatga

SEQ ID NO: 155131 - DNA, 20 bp, Artificial Sequence
  chemically synthesized
tgagagatactcatctttca

SEQ ID NO: 155132 - DNA, 20 bp, Artificial Sequence
  chemically synthesized
agggcagtgctatgaaagat

SEQ ID NO: 155133 - DNA, 20 bp, Artificial Sequence
  chemically synthesized
tgaaagatgagtatctctca

SEQ ID NO: 155134 - DNA, 20 bp, Artificial Sequence
  chemically synthesized
aagtgtgatggaagccatga

SEQ ID NO: 155135 - DNA, 20 bp, Artificial Sequence
  chemically synthesized
ggaagtgtgatggaagccat

SEQ ID NO: 155136 - DNA, 20 bp, Artificial Sequence
  chemically synthesized
ggtcaggggaagtgtgatgg

SEQ ID NO: 155137 - DNA, 20 bp, Artificial Sequence
  chemically synthesized
gtgggtcaggggaagtgtga

SEQ ID NO: 155138 - DNA, 20 bp, Artificial Sequence
  chemically synthesized
ctagaggagtgggtcagggg

SEQ ID NO: 155139 - DNA, 20 bp, Artificial Sequence
  chemically synthesized
agactagaggagtgggtcag

SEQ ID NO: 155140 - DNA, 20 bp, Artificial Sequence
  chemically synthesized
gagactagaggagtgggtca

SEQ ID NO: 155141 - DNA, 20 bp, Artificial Sequence
  chemically synthesized
tgagactagaggagtgggtc

SEQ ID NO: 155142 - DNA, 20 bp, Artificial Sequence
  chemically synthesized
gtgagactagaggagtgggt

SEQ ID NO: 155143 - DNA, 20 bp, Artificial Sequence
  chemically synthesized
cttcccctgacccactcctc

SEQ ID NO: 155144 - DNA, 20 bp, Artificial Sequence
  chemically synthesized
atcagtgagactagaggagt

SEQ ID NO: 155145 - DNA, 20 bp, Artificial Sequence
  chemically synthesized
gatcagtgagactagaggag

SEQ ID NO: 155146 - DNA, 20 bp, Artificial Sequence
  chemically synthesized
ggagatcagtgagactagag

SEQ ID NO: 155147 - DNA, 20 bp, Artificial Sequence
  chemically synthesized
aaggagatcagtgagactag

SEQ ID NO: 155148 - DNA, 20 bp, Artificial Sequence
  chemically synthesized
taaggagatcagtgagacta

SEQ ID NO: 155149 - DNA, 20 bp, Artificial Sequence
  chemically synthesized
attaaggagatcagtgagac

SEQ ID NO: 155150 - DNA, 20 bp, Artificial Sequence
  chemically synthesized
ggaatattaaggagatcagt

SEQ ID NO: 155151 - DNA, 20 bp, Artificial Sequence
  chemically synthesized
tgacggaatattaaggagat

SEQ ID NO: 155152 - DNA, 20 bp, Artificial Sequence
  chemically synthesized
caagatgacggaatattaag

SEQ ID NO: 155153 - DNA, 20 bp, Artificial Sequence
  chemically synthesized
aacaagatgacggaatatta

SEQ ID NO: 155154 - DNA, 20 bp, Artificial Sequence
  chemically synthesized
gaacaagatgacggaatatt

SEQ ID NO: 155155 - DNA, 20 bp, Artificial Sequence
  chemically synthesized
ctgaagtaggaacaagatga

SEQ ID NO: 155156 - DNA, 20 bp, Artificial Sequence
  chemically synthesized
aacgatactgaagtaggaac

SEQ ID NO: 155157 - DNA, 20 bp, Artificial Sequence
  chemically synthesized
ccgtcatcttgttcctactt

SEQ ID NO: 155158 - DNA, 20 bp, Artificial Sequence
  chemically synthesized
ctgagcaacgatactgaagt

SEQ ID NO: 155159 - DNA, 20 bp, Artificial Sequence
  chemically synthesized
actgagcaacgatactgaag

SEQ ID NO: 155160 - DNA, 20 bp, Artificial Sequence
  chemically synthesized
aagactgagcaacgatactg

SEQ ID NO: 155161 - DNA, 20 bp, Artificial Sequence
  chemically synthesized
cctacttcagtatcgttgct

SEQ ID NO: 155162 - DNA, 20 bp, Artificial Sequence
  chemically synthesized
aggcagggagagaaaagact

SEQ ID NO: 155163 - DNA, 20 bp, Artificial Sequence
  chemically synthesized
tattccaggcagggagagaa

SEQ ID NO: 155164 - DNA, 20 bp, Artificial Sequence
  chemically synthesized
aaaattattccaggcaggga

SEQ ID NO: 155165 - DNA, 20 bp, Artificial Sequence
  chemically synthesized
cagtcttttctctccctgcc

SEQ ID NO: 155166 - DNA, 20 bp, Artificial Sequence
  chemically synthesized
ggaaaattattccaggcagg

SEQ ID NO: 155167 - DNA, 20 bp, Artificial Sequence
  chemically synthesized
tgggaaaattattccaggca

SEQ ID NO: 155168 - DNA, 20 bp, Artificial Sequence
  chemically synthesized
ctgggaaaattattccaggc

SEQ ID NO: 155169 - DNA, 20 bp, Artificial Sequence
  chemically synthesized
tctgggaaaattattccagg

SEQ ID NO: 155170 - DNA, 20 bp, Artificial Sequence
  chemically synthesized
atttctgggaaaattattcc

SEQ ID NO: 155171 - DNA, 20 bp, Artificial Sequence
  chemically synthesized
tatttctgggaaaattattc

SEQ ID NO: 155172 - DNA, 20 bp, Artificial Sequence
  chemically synthesized
cctgcctggaataattttcc

SEQ ID NO: 155173 - DNA, 20 bp, Artificial Sequence
  chemically synthesized
agtgagcctggtgtatttct

SEQ ID NO: 155174 - DNA, 20 bp, Artificial Sequence
  chemically synthesized
aagtgagcctggtgtatttc

SEQ ID NO: 155175 - DNA, 20 bp, Artificial Sequence
  chemically synthesized
taattttcccagaaatacac

SEQ ID NO: 155176 - DNA, 20 bp, Artificial Sequence
  chemically synthesized
aattttcccagaaatacacc

SEQ ID NO: 155177 - DNA, 20 bp, Artificial Sequence
  chemically synthesized
tgtaagtgaggaagtgagcc

SEQ ID NO: 155178 - DNA, 20 bp, Artificial Sequence
  chemically synthesized
actgatgtaagtgaggaagt

SEQ ID NO: 155179 - DNA, 20 bp, Artificial Sequence
  chemically synthesized
gaaaactgatgtaagtgagg

SEQ ID NO: 155180 - DNA, 20 bp, Artificial Sequence
  chemically synthesized
tcagaaaactgatgtaagtg

SEQ ID NO: 155181 - DNA, 20 bp, Artificial Sequence
  chemically synthesized
atcagaaaactgatgtaagt

SEQ ID NO: 155182 - DNA, 20 bp, Artificial Sequence
  chemically synthesized
gctcacttcctcacttacat

SEQ ID NO: 155183 - DNA, 20 bp, Artificial Sequence
  chemically synthesized
gaacatcagaaaactgatgt

SEQ ID NO: 155184 - DNA, 20 bp, Artificial Sequence
  chemically synthesized
cttgtctgttaagagaacat

SEQ ID NO: 155185 - DNA, 20 bp, Artificial Sequence
  chemically synthesized
gttttctgatgttctcttaa

SEQ ID NO: 155186 - DNA, 20 bp, Artificial Sequence
  chemically synthesized
cagggaagcttgtctgttaa

SEQ ID NO: 155187 - DNA, 20 bp, Artificial Sequence
  chemically synthesized
ctgatgttctcttaacagac

SEQ ID NO: 155188 - DNA, 20 bp, Artificial Sequence
  chemically synthesized
gtcagggaagcttgtctgtt

SEQ ID NO: 155189 - DNA, 20 bp, Artificial Sequence
  chemically synthesized
tgtctatagtgtggtcaggg

SEQ ID NO: 155190 - DNA, 20 bp, Artificial Sequence
  chemically synthesized
tattgtctatagtgtggtca

SEQ ID NO: 155191 - DNA, 20 bp, Artificial Sequence
  chemically synthesized
ttattgtctatagtgtggtc

SEQ ID NO: 155192 - DNA, 20 bp, Artificial Sequence
  chemically synthesized
attattgtctatagtgtggt

SEQ ID NO: 155193 - DNA, 20 bp, Artificial Sequence
  chemically synthesized
aagcttccctgaccacacta

SEQ ID NO: 155194 - DNA, 20 bp, Artificial Sequence
  chemically synthesized
gggtattattgtctatagtg

SEQ ID NO: 155195 - DNA, 20 bp, Artificial Sequence
  chemically synthesized
gatgagggtattattgtcta

SEQ ID NO: 155196 - DNA, 20 bp, Artificial Sequence
  chemically synthesized
taagcagggagatgggatga

SEQ ID NO: 155197 - DNA, 20 bp, Artificial Sequence
  chemically synthesized
ctaagcagggagatgggatg

SEQ ID NO: 155198 - DNA, 20 bp, Artificial Sequence
  chemically synthesized
actaagcagggagatgggat

SEQ ID NO: 155199 - DNA, 20 bp, Artificial Sequence
  chemically synthesized
gaacaactaagcagggagat

SEQ ID NO: 155200 - DNA, 20 bp, Artificial Sequence
  chemically synthesized
agaacaactaagcagggaga

SEQ ID NO: 155201 - DNA, 20 bp, Artificial Sequence
  chemically synthesized
cctcatcccatctccctgct

SEQ ID NO: 155202 - DNA, 20 bp, Artificial Sequence
  chemically synthesized
acagagaacaactaagcagg

SEQ ID NO: 155203 - DNA, 20 bp, Artificial Sequence
  chemically synthesized
ttacagagaacaactaagca

SEQ ID NO: 155204 - DNA, 20 bp, Artificial Sequence
  chemically synthesized
attacagagaacaactaagc

SEQ ID NO: 155205 - DNA, 20 bp, Artificial Sequence
  chemically synthesized
cattacagagaacaactaag

SEQ ID NO: 155206 - DNA, 20 bp, Artificial Sequence
  chemically synthesized
caccattacagagaacaact

SEQ ID NO: 155207 - DNA, 20 bp, Artificial Sequence
  chemically synthesized
tgcttagttgttctctgtaa

SEQ ID NO: 155208 - DNA, 20 bp, Artificial Sequence
  chemically synthesized
atttgagaaacaccattaca

SEQ ID NO: 155209 - DNA, 20 bp, Artificial Sequence
  chemically synthesized
acatttgagaaacaccatta

SEQ ID NO: 155210 - DNA, 20 bp, Artificial Sequence
  chemically synthesized
taatggtgtttctcaaatgt

SEQ ID NO: 155211 - DNA, 20 bp, Artificial Sequence
  chemically synthesized
tcctgtgcacactgacattt

SEQ ID NO: 155212 - DNA, 20 bp, Artificial Sequence
  chemically synthesized
ttctcaaatgtcagtgtgca

SEQ ID NO: 155213 - DNA, 20 bp, Artificial Sequence
  chemically synthesized
tctcaaatgtcagtgtgcac

SEQ ID NO: 155214 - DNA, 20 bp, Artificial Sequence
  chemically synthesized
cagtgtgcacaggattcacc

SEQ ID NO: 155215 - DNA, 20 bp, Artificial Sequence
  chemically synthesized
agtgtgcacaggattcacct

SEQ ID NO: 155216 - DNA, 20 bp, Artificial Sequence
  chemically synthesized
gtgtgcacaggattcacctg

SEQ ID NO: 155217 - DNA, 20 bp, Artificial Sequence
  chemically synthesized
tgcattttaatagaatcccc

SEQ ID NO: 155218 - DNA, 20 bp, Artificial Sequence
  chemically synthesized
ctgcattttaatagaatccc

SEQ ID NO: 155219 - DNA, 20 bp, Artificial Sequence
  chemically synthesized
aatcacaatctgcattttaa

SEQ ID NO: 155220 - DNA, 20 bp, Artificial Sequence
  chemically synthesized
ctggggattctattaaaatg

SEQ ID NO: 155221 - DNA, 20 bp, Artificial Sequence
  chemically synthesized
ttaaaatgcagattgtgatt

SEQ ID NO: 155222 - DNA, 20 bp, Artificial Sequence
  chemically synthesized
aaatgcagattgtgattcag

SEQ ID NO: 155223 - DNA, 20 bp, Artificial Sequence
  chemically synthesized
aatgcagattgtgattcagt

SEQ ID NO: 155224 - DNA, 20 bp, Artificial Sequence
  chemically synthesized
agattgtgattcagtgggtc

SEQ ID NO: 155225 - DNA, 20 bp, Artificial Sequence
  chemically synthesized
gattgtgattcagtgggtct

SEQ ID NO: 155226 - DNA, 20 bp, Artificial Sequence
  chemically synthesized
gtgattcagtgggtctagga

SEQ ID NO: 155227 - DNA, 20 bp, Artificial Sequence
  chemically synthesized
tgattcagtgggtctaggat

SEQ ID NO: 155228 - DNA, 20 bp, Artificial Sequence
  chemically synthesized
gattcagtgggtctaggata

SEQ ID NO: 155229 - DNA, 20 bp, Artificial Sequence
  chemically synthesized
attcagtgggtctaggatag

SEQ ID NO: 155230 - DNA, 20 bp, Artificial Sequence
  chemically synthesized
agaatctgaggcccctatcc

SEQ ID NO: 155231 - DNA, 20 bp, Artificial Sequence
  chemically synthesized
tgggtctaggataggggcct

SEQ ID NO: 155232 - DNA, 20 bp, Artificial Sequence
  chemically synthesized
tgttagacacacagaatctg

SEQ ID NO: 155233 - DNA, 20 bp, Artificial Sequence
  chemically synthesized
ttgttagacacacagaatct

SEQ ID NO: 155234 - DNA, 20 bp, Artificial Sequence
  chemically synthesized
atgggtatttgttagacaca

SEQ ID NO: 155235 - DNA, 20 bp, Artificial Sequence
  chemically synthesized
tgatgtcaatgggtatttgt

SEQ ID NO: 155236 - DNA, 20 bp, Artificial Sequence
  chemically synthesized
gtctacagattgatgtcaat

SEQ ID NO: 155237 - DNA, 20 bp, Artificial Sequence
  chemically synthesized
agtctacagattgatgtcaa

SEQ ID NO: 155238 - DNA, 20 bp, Artificial Sequence
  chemically synthesized
tacccattgacatcaatctg

SEQ ID NO: 155239 - DNA, 20 bp, Artificial Sequence
  chemically synthesized
gtgctgtagagtgtagtcta

SEQ ID NO: 155240 - DNA, 20 bp, Artificial Sequence
  chemically synthesized
aatctgtagactacactcta

SEQ ID NO: 155241 - DNA, 20 bp, Artificial Sequence
  chemically synthesized
attataagtgctgtagagtg

SEQ ID NO: 155242 - DNA, 20 bp, Artificial Sequence
  chemically synthesized
caataattataagtgctgta

SEQ ID NO: 155243 - DNA, 20 bp, Artificial Sequence
  chemically synthesized
ctcaataattataagtgctg

SEQ ID NO: 155244 - DNA, 20 bp, Artificial Sequence
  chemically synthesized
tatactgtctcaataattat

SEQ ID NO: 155245 - DNA, 20 bp, Artificial Sequence
  chemically synthesized
ctacagcacttataattatt

SEQ ID NO: 155246 - DNA, 20 bp, Artificial Sequence
  chemically synthesized
agcacttataattattgaga

SEQ ID NO: 155247 - DNA, 20 bp, Artificial Sequence
  chemically synthesized
acagtatatattttcttcat

SEQ ID NO: 155248 - DNA, 20 bp, Artificial Sequence
  chemically synthesized
agaaagacaataaactaatg

SEQ ID NO: 155249 - DNA, 20 bp, Artificial Sequence
  chemically synthesized
tatattgtaattgaaagaga

SEQ ID NO: 155250 - DNA, 20 bp, Artificial Sequence
  chemically synthesized
aacatatattgtaattgaaa

SEQ ID NO: 155251 - DNA, 20 bp, Artificial Sequence
  chemically synthesized
aaaacatatattgtaattga

SEQ ID NO: 155252 - DNA, 20 bp, Artificial Sequence
  chemically synthesized
ttacaatatatgttttatga

SEQ ID NO: 155253 - DNA, 20 bp, Artificial Sequence
  chemically synthesized
tacaatatatgttttatgaa

SEQ ID NO: 155254 - DNA, 20 bp, Artificial Sequence
  chemically synthesized
caatatatgttttatgaaag

SEQ ID NO: 155255 - DNA, 20 bp, Artificial Sequence
  chemically synthesized
atatatgttttatgaaagga

SEQ ID NO: 155256 - DNA, 20 bp, Artificial Sequence
  chemically synthesized
gcgagtacagcatagaataa

SEQ ID NO: 155257 - DNA, 20 bp, Artificial Sequence
  chemically synthesized
ctggtgctgcgagtacagca

SEQ ID NO: 155258 - DNA, 20 bp, Artificial Sequence
  chemically synthesized
tttattctatgctgtactcg

SEQ ID NO: 155259 - DNA, 20 bp, Artificial Sequence
  chemically synthesized
tcatactggtgctgcgagta

SEQ ID NO: 155260 - DNA, 20 bp, Artificial Sequence
  chemically synthesized
ctatgctgtactcgcagcac

SEQ ID NO: 155261 - DNA, 20 bp, Artificial Sequence
  chemically synthesized
gagcatcatactggtgctgc

SEQ ID NO: 155262 - DNA, 20 bp, Artificial Sequence
  chemically synthesized
ccatgtgttgagcatcatac

SEQ ID NO: 155263 - DNA, 20 bp, Artificial Sequence
  chemically synthesized
ccagtatgatgctcaacaca

SEQ ID NO: 155264 - DNA, 20 bp, Artificial Sequence
  chemically synthesized
tttattaacttccatgtgtt

SEQ ID NO: 155265 - DNA, 20 bp, Artificial Sequence
  chemically synthesized
gtatgatgctcaacacatgg

SEQ ID NO: 155266 - DNA, 20 bp, Artificial Sequence
  chemically synthesized
cacatggaagttaataaata

SEQ ID NO: 155267 - DNA, 20 bp, Artificial Sequence
  chemically synthesized
atggaagttaataaataaag

SEQ ID NO: 155268 - DNA, 20 bp, Artificial Sequence
  chemically synthesized
ggatgaattatatatgttgc

SEQ ID NO: 155269 - DNA, 20 bp, Artificial Sequence
  chemically synthesized
tgaattatatatgttgctgg

SEQ ID NO: 155270 - DNA, 20 bp, Artificial Sequence
  chemically synthesized
gaagttccagttttgacttc

SEQ ID NO: 155271 - DNA, 20 bp, Artificial Sequence
  chemically synthesized
atgttgctggaagtcaaaac

SEQ ID NO: 155272 - DNA, 20 bp, Artificial Sequence
  chemically synthesized
gaaaaatacattggaagttc

SEQ ID NO: 155273 - DNA, 20 bp, Artificial Sequence
  chemically synthesized
ttataagaaaaatacattgg

SEQ ID NO: 155274 - DNA, 20 bp, Artificial Sequence
  chemically synthesized
tgtttataagaaaaatacat

SEQ ID NO: 155275 - DNA, 20 bp, Artificial Sequence
  chemically synthesized
ctaaatgtaacaatgtttat

SEQ ID NO: 155276 - DNA, 20 bp, Artificial Sequence
  chemically synthesized
cttataaacattgttacatt

SEQ ID NO: 155277 - DNA, 20 bp, Artificial Sequence
  chemically synthesized
ttataaacattgttacattt

SEQ ID NO: 155278 - DNA, 20 bp, Artificial Sequence
  chemically synthesized
aaacattgttacatttaggt

SEQ ID NO: 155279 - DNA, 20 bp, Artificial Sequence
  chemically synthesized
taggtaagttacacgttaaa

SEQ ID NO: 155280 - DNA, 20 bp, Artificial Sequence
  chemically synthesized
gttacacgttaaatggattt

SEQ ID NO: 155281 - DNA, 20 bp, Artificial Sequence
  chemically synthesized
ttaaatggatttcggcgccc

SEQ ID NO: 155282 - DNA, 20 bp, Artificial Sequence
  chemically synthesized
ggatttcggcgccctggttt

SEQ ID NO: 155283 - DNA, 20 bp, Artificial Sequence
  chemically synthesized
gtaggaaggctccaaaacca

SEQ ID NO: 155284 - DNA, 20 bp, Artificial Sequence
  chemically synthesized
atttcggcgccctggttttg

SEQ ID NO: 155285 - DNA, 20 bp, Artificial Sequence
  chemically synthesized
ggtaggaaggctccaaaacc

SEQ ID NO: 155286 - DNA, 20 bp, Artificial Sequence
  chemically synthesized
tggtaggaaggctccaaaac

SEQ ID NO: 155287 - DNA, 20 bp, Artificial Sequence
  chemically synthesized
ccacgttacacatggtagga

SEQ ID NO: 155288 - DNA, 20 bp, Artificial Sequence
  chemically synthesized
gccacgttacacatggtagg

SEQ ID NO: 155289 - DNA, 20 bp, Artificial Sequence
  chemically synthesized
taagccacgttacacatggt

SEQ ID NO: 155290 - DNA, 20 bp, Artificial Sequence
  chemically synthesized
ataagccacgttacacatgg

SEQ ID NO: 155291 - DNA, 20 bp, Artificial Sequence
  chemically synthesized
catataagccacgttacaca

SEQ ID NO: 155292 - DNA, 20 bp, Artificial Sequence
  chemically synthesized
ccttcctaccatgtgtaacg

SEQ ID NO: 155293 - DNA, 20 bp, Artificial Sequence
  chemically synthesized
catgtgtaacgtggcttata

SEQ ID NO: 155294 - DNA, 20 bp, Artificial Sequence
  chemically synthesized
atgtgtaacgtggcttatat

SEQ ID NO: 155295 - DNA, 20 bp, Artificial Sequence
  chemically synthesized
catgagtttatgtcccatat

SEQ ID NO: 155296 - DNA, 20 bp, Artificial Sequence
  chemically synthesized
tatatgggacataaactcat

SEQ ID NO: 155297 - DNA, 20 bp, Artificial Sequence
  chemically synthesized
gggacataaactcatgagtt

SEQ ID NO: 155298 - DNA, 20 bp, Artificial Sequence
  chemically synthesized
ttgttaaactctgaactcat

SEQ ID NO: 155299 - DNA, 20 bp, Artificial Sequence
  chemically synthesized
gacataaactcatgagttca

SEQ ID NO: 155300 - DNA, 20 bp, Artificial Sequence
  chemically synthesized
atgttccaatgatgttttat

SEQ ID NO: 155301 - DNA, 20 bp, Artificial Sequence
  chemically synthesized
acaaacttataaaacatcat

SEQ ID NO: 155302 - DNA, 20 bp, Artificial Sequence
  chemically synthesized
attggaacataatctcttca

SEQ ID NO: 155303 - DNA, 20 bp, Artificial Sequence
  chemically synthesized
tggaacataatctcttcatg

SEQ ID NO: 155304 - DNA, 20 bp, Artificial Sequence
  chemically synthesized
agactctgtaactccatgaa

SEQ ID NO: 155305 - DNA, 20 bp, Artificial Sequence
  chemically synthesized
tcagactctgtaactccatg

SEQ ID NO: 155306 - DNA, 20 bp, Artificial Sequence
  chemically synthesized
ataatctcttcatggagtta

SEQ ID NO: 155307 - DNA, 20 bp, Artificial Sequence
  chemically synthesized
aatctcttcatggagttaca

SEQ ID NO: 155308 - DNA, 20 bp, Artificial Sequence
  chemically synthesized
ttcatggagttacagagtct

SEQ ID NO: 155309 - DNA, 20 bp, Artificial Sequence
  chemically synthesized
tcatggagttacagagtctg

SEQ ID NO: 155310 - DNA, 20 bp, Artificial Sequence
  chemically synthesized
gtctctggtaggttcagcct

SEQ ID NO: 155311 - DNA, 20 bp, Artificial Sequence
  chemically synthesized
gagtctgaggctgaacctac

SEQ ID NO: 155312 - DNA, 20 bp, Artificial Sequence
  chemically synthesized
ctggctgtctctggtaggtt

SEQ ID NO: 155313 - DNA, 20 bp, Artificial Sequence
  chemically synthesized
gtctgaggctgaacctacca

SEQ ID NO: 155314 - DNA, 20 bp, Artificial Sequence
  chemically synthesized
gttttctggctgtctctggt

SEQ ID NO: 155315 - DNA, 20 bp, Artificial Sequence
  chemically synthesized
gaggctgaacctaccagaga

SEQ ID NO: 155316 - DNA, 20 bp, Artificial Sequence
  chemically synthesized
tgttttctggctgtctctgg

SEQ ID NO: 155317 - DNA, 20 bp, Artificial Sequence
  chemically synthesized
gtctgttttctggctgtctc

SEQ ID NO: 155318 - DNA, 20 bp, Artificial Sequence
  chemically synthesized
ctgaacctaccagagacagc

SEQ ID NO: 155319 - DNA, 20 bp, Artificial Sequence
  chemically synthesized
taccagagacagccagaaaa

SEQ ID NO: 155320 - DNA, 20 bp, Artificial Sequence
  chemically synthesized
atttattggtgtctgttttc

SEQ ID NO: 155321 - DNA, 20 bp, Artificial Sequence
  chemically synthesized
gttcctatgttatcatttat

SEQ ID NO: 155322 - DNA, 20 bp, Artificial Sequence
  chemically synthesized
gacaccaataaatgataaca

SEQ ID NO: 155323 - DNA, 20 bp, Artificial Sequence
  chemically synthesized
acaccaataaatgataacat

SEQ ID NO: 155324 - DNA, 20 bp, Artificial Sequence
  chemically synthesized
gttccctcagcgcatatgca

SEQ ID NO: 155325 - DNA, 20 bp, Artificial Sequence
  chemically synthesized
acaaactatgcatatgcgct

SEQ ID NO: 155326 - DNA, 20 bp, Artificial Sequence
  chemically synthesized
caaactatgcatatgcgctg

SEQ ID NO: 155327 - DNA, 20 bp, Artificial Sequence
  chemically synthesized
aaactatgcatatgcgctga

SEQ ID NO: 155328 - DNA, 20 bp, Artificial Sequence
  chemically synthesized
gctgtaatttttggttccct

SEQ ID NO: 155329 - DNA, 20 bp, Artificial Sequence
  chemically synthesized
gctgagggaaccaaaaatta

SEQ ID NO: 155330 - DNA, 20 bp, Artificial Sequence
  chemically synthesized
tttttatgagctgtaatttt

SEQ ID NO: 155331 - DNA, 20 bp, Artificial Sequence
  chemically synthesized
tcaggtttatttgtttttat

SEQ ID NO: 155332 - DNA, 20 bp, Artificial Sequence
  chemically synthesized
aaaaacaaataaacctgaca

SEQ ID NO: 155333 - DNA, 20 bp, Artificial Sequence
  chemically synthesized
gggttatactcaactgtgtc

SEQ ID NO: 155334 - DNA, 20 bp, Artificial Sequence
  chemically synthesized
agggttatactcaactgtgt

SEQ ID NO: 155335 - DNA, 20 bp, Artificial Sequence
  chemically synthesized
caaataaacctgacacagtt

SEQ ID NO: 155336 - DNA, 20 bp, Artificial Sequence
  chemically synthesized
agttgagtataaccctgata

SEQ ID NO: 155337 - DNA, 20 bp, Artificial Sequence
  chemically synthesized
acactgaaattgctgtatca

SEQ ID NO: 155338 - DNA, 20 bp, Artificial Sequence
  chemically synthesized
gacactgaaattgctgtatc

SEQ ID NO: 155339 - DNA, 20 bp, Artificial Sequence
  chemically synthesized
ggacactgaaattgctgtat

SEQ ID NO: 155340 - DNA, 20 bp, Artificial Sequence
  chemically synthesized
taaccctgatacagcaattt

SEQ ID NO: 155341 - DNA, 20 bp, Artificial Sequence
  chemically synthesized
atacagcaatttcagtgtcc

SEQ ID NO: 155342 - DNA, 20 bp, Artificial Sequence
  chemically synthesized
ttttttttttttgtcaatct

SEQ ID NO: 155343 - DNA, 20 bp, Artificial Sequence
  chemically synthesized
gttttttttttttgtcaatc

SEQ ID NO: 155344 - DNA, 20 bp, Artificial Sequence
  chemically synthesized
ctttggagacttaagcatta

SEQ ID NO: 155345 - DNA, 20 bp, Artificial Sequence
  chemically synthesized
aaaaaaaaaccataatgctt

SEQ ID NO: 155346 - DNA, 20 bp, Artificial Sequence
  chemically synthesized
tttaacgactttggagactt

SEQ ID NO: 155347 - DNA, 20 bp, Artificial Sequence
  chemically synthesized
ccataatgcttaagtctcca

SEQ ID NO: 155348 - DNA, 20 bp, Artificial Sequence
  chemically synthesized
agttagatttaacgactttg

SEQ ID NO: 155349 - DNA, 20 bp, Artificial Sequence
  chemically synthesized
agagttagatttaacgactt

SEQ ID NO: 155350 - DNA, 20 bp, Artificial Sequence
  chemically synthesized
tactcggcagtcatcagagt

SEQ ID NO: 155351 - DNA, 20 bp, Artificial Sequence
  chemically synthesized
ggattactcggcagtcatca

SEQ ID NO: 155352 - DNA, 20 bp, Artificial Sequence
  chemically synthesized
tgggattactcggcagtcat

SEQ ID NO: 155353 - DNA, 20 bp, Artificial Sequence
  chemically synthesized
atctaactctgatgactgcc

SEQ ID NO: 155354 - DNA, 20 bp, Artificial Sequence
  chemically synthesized
tgccctctgggattactcgg

SEQ ID NO: 155355 - DNA, 20 bp, Artificial Sequence
  chemically synthesized
atgtgccctctgggattact

SEQ ID NO: 155356 - DNA, 20 bp, Artificial Sequence
  chemically synthesized
tgatgactgccgagtaatcc

SEQ ID NO: 155357 - DNA, 20 bp, Artificial Sequence
  chemically synthesized
atgactgccgagtaatccca

SEQ ID NO: 155358 - DNA, 20 bp, Artificial Sequence
  chemically synthesized
tgactgccgagtaatcccag

SEQ ID NO: 155359 - DNA, 20 bp, Artificial Sequence
  chemically synthesized
gactgccgagtaatcccaga

SEQ ID NO: 155360 - DNA, 20 bp, Artificial Sequence
  chemically synthesized
gtgcatctcatgtgccctct

SEQ ID NO: 155361 - DNA, 20 bp, Artificial Sequence
  chemically synthesized
agtgcatctcatgtgccctc

SEQ ID NO: 155362 - DNA, 20 bp, Artificial Sequence
  chemically synthesized
agtaatcccagagggcacat

SEQ ID NO: 155363 - DNA, 20 bp, Artificial Sequence
  chemically synthesized
cacatgagatgcactgtccc

SEQ ID NO: 155364 - DNA, 20 bp, Artificial Sequence
  chemically synthesized
gaagccctacaatctgggga

SEQ ID NO: 155365 - DNA, 20 bp, Artificial Sequence
  chemically synthesized
gatgcactgtccccagattg

SEQ ID NO: 155366 - DNA, 20 bp, Artificial Sequence
  chemically synthesized
aaaagaagccctacaatctg

SEQ ID NO: 155367 - DNA, 20 bp, Artificial Sequence
  chemically synthesized
atgcactgtccccagattgt

SEQ ID NO: 155368 - DNA, 20 bp, Artificial Sequence
  chemically synthesized
taaaagaagccctacaatct

SEQ ID NO: 155369 - DNA, 20 bp, Artificial Sequence
  chemically synthesized
tgcactgtccccagattgta

SEQ ID NO: 155370 - DNA, 20 bp, Artificial Sequence
  chemically synthesized
ttaaaagaagccctacaatc

SEQ ID NO: 155371 - DNA, 20 bp, Artificial Sequence
  chemically synthesized
aatagtgcttggattaaaag

SEQ ID NO: 155372 - DNA, 20 bp, Artificial Sequence
  chemically synthesized
tgtagggcttcttttaatcc

SEQ ID NO: 155373 - DNA, 20 bp, Artificial Sequence
  chemically synthesized
ataaatagtgcttggattaa

SEQ ID NO: 155374 - DNA, 20 bp, Artificial Sequence
  chemically synthesized
tagaaggcataaatagtgct

SEQ ID NO: 155375 - DNA, 20 bp, Artificial Sequence
  chemically synthesized
aattcattagaaggcataaa

SEQ ID NO: 155376 - DNA, 20 bp, Artificial Sequence
  chemically synthesized
cacaatcataattcattaga

SEQ ID NO: 155377 - DNA, 20 bp, Artificial Sequence
  chemically synthesized
gcacaatcataattcattag

SEQ ID NO: 155378 - DNA, 20 bp, Artificial Sequence
  chemically synthesized
gtagcacaatcataattcat

SEQ ID NO: 155379 - DNA, 20 bp, Artificial Sequence
  chemically synthesized
gaattatgattgtgctaccc

SEQ ID NO: 155380 - DNA, 20 bp, Artificial Sequence
  chemically synthesized
tggaagaatcacagctgggg

SEQ ID NO: 155381 - DNA, 20 bp, Artificial Sequence
  chemically synthesized
aactggaagaatcacagctg

SEQ ID NO: 155382 - DNA, 20 bp, Artificial Sequence
  chemically synthesized
gaactggaagaatcacagct

SEQ ID NO: 155383 - DNA, 20 bp, Artificial Sequence
  chemically synthesized
tgaactggaagaatcacagc

SEQ ID NO: 155384 - DNA, 20 bp, Artificial Sequence
  chemically synthesized
atactgaactggaagaatca

SEQ ID NO: 155385 - DNA, 20 bp, Artificial Sequence
  chemically synthesized
taccccagctgtgattcttc

SEQ ID NO: 155386 - DNA, 20 bp, Artificial Sequence
  chemically synthesized
cagctgtgattcttccagtt

SEQ ID NO: 155387 - DNA, 20 bp, Artificial Sequence
  chemically synthesized
gtagaaaaatactgaactgg

SEQ ID NO: 155388 - DNA, 20 bp, Artificial Sequence
  chemically synthesized
caagtagaaaaatactgaac

SEQ ID NO: 155389 - DNA, 20 bp, Artificial Sequence
  chemically synthesized
gatttttattttatgtcaag

SEQ ID NO: 155390 - DNA, 20 bp, Artificial Sequence
  chemically synthesized
gttgatttttattttatgtc

SEQ ID NO: 155391 - DNA, 20 bp, Artificial Sequence
  chemically synthesized
ataaaaatcaactttacctg

SEQ ID NO: 155392 - DNA, 20 bp, Artificial Sequence
  chemically synthesized
ggtgactggttcttcaggta

SEQ ID NO: 155393 - DNA, 20 bp, Artificial Sequence
  chemically synthesized
atcaactttacctgaagaac

SEQ ID NO: 155394 - DNA, 20 bp, Artificial Sequence
  chemically synthesized
agcatggtgactggttcttc

SEQ ID NO: 155395 - DNA, 20 bp, Artificial Sequence
  chemically synthesized
aagcatggtgactggttctt

SEQ ID NO: 155396 - DNA, 20 bp, Artificial Sequence
  chemically synthesized
aagcattaaagcatggtgac

SEQ ID NO: 155397 - DNA, 20 bp, Artificial Sequence
  chemically synthesized
atgattgaagcattaaagca

SEQ ID NO: 155398 - DNA, 20 bp, Artificial Sequence
  chemically synthesized
atcaaatgattgaagcatta

SEQ ID NO: 155399 - DNA, 20 bp, Artificial Sequence
  chemically synthesized
tttcaaagatcaaatgattg

SEQ ID NO: 155400 - DNA, 20 bp, Artificial Sequence
  chemically synthesized
tcaatcatttgatctttgaa

SEQ ID NO: 155401 - DNA, 20 bp, Artificial Sequence
  chemically synthesized
atcatttgatctttgaaaag

SEQ ID NO: 155402 - DNA, 20 bp, Artificial Sequence
  chemically synthesized
tttgccttgtctgcttttca

SEQ ID NO: 155403 - DNA, 20 bp, Artificial Sequence
  chemically synthesized
ttgatctttgaaaagcagac

SEQ ID NO: 155404 - DNA, 20 bp, Artificial Sequence
  chemically synthesized
tgatctttgaaaagcagaca

SEQ ID NO: 155405 - DNA, 20 bp, Artificial Sequence
  chemically synthesized
aaaacaaaaaacaacaccca

SEQ ID NO: 155406 - DNA, 20 bp, Artificial Sequence
  chemically synthesized
gcagaactaaaaacatcttt

SEQ ID NO: 155407 - DNA, 20 bp, Artificial Sequence
  chemically synthesized
ggcagaactaaaaacatctt

SEQ ID NO: 155408 - DNA, 20 bp, Artificial Sequence
  chemically synthesized
acaacacccaaagatgtttt

SEQ ID NO: 155409 - DNA, 20 bp, Artificial Sequence
  chemically synthesized
tgtaccattccataattagg

SEQ ID NO: 155410 - DNA, 20 bp, Artificial Sequence
  chemically synthesized
tttttagttctgcctaatta

SEQ ID NO: 155411 - DNA, 20 bp, Artificial Sequence
  chemically synthesized
tgctgtaccattccataatt

SEQ ID NO: 155412 - DNA, 20 bp, Artificial Sequence
  chemically synthesized
ttgctgtaccattccataat

SEQ ID NO: 155413 - DNA, 20 bp, Artificial Sequence
  chemically synthesized
agttctgcctaattatggaa

SEQ ID NO: 155414 - DNA, 20 bp, Artificial Sequence
  chemically synthesized
tgcctaattatggaatggta

SEQ ID NO: 155415 - DNA, 20 bp, Artificial Sequence
  chemically synthesized
aattatggaatggtacagca

SEQ ID NO: 155416 - DNA, 20 bp, Artificial Sequence
  chemically synthesized
tatggaatggtacagcaaag

SEQ ID NO: 155417 - DNA, 20 bp, Artificial Sequence
  chemically synthesized
ggtacagcaaagaagttttc

SEQ ID NO: 155418 - DNA, 20 bp, Artificial Sequence
  chemically synthesized
gactctcaggggaaagaggc

SEQ ID NO: 155419 - DNA, 20 bp, Artificial Sequence
  chemically synthesized
ctttgactctcaggggaaag

SEQ ID NO: 155420 - DNA, 20 bp, Artificial Sequence
  chemically synthesized
gctttgactctcaggggaaa

SEQ ID NO: 155421 - DNA, 20 bp, Artificial Sequence
  chemically synthesized
ttttctggcctctttcccct

SEQ ID NO: 155422 - DNA, 20 bp, Artificial Sequence
  chemically synthesized
tggctttgactctcagggga

SEQ ID NO: 155423 - DNA, 20 bp, Artificial Sequence
  chemically synthesized
ttctggcctctttcccctga

SEQ ID NO: 155424 - DNA, 20 bp, Artificial Sequence
  chemically synthesized
atgctggctttgactctcag

SEQ ID NO: 155425 - DNA, 20 bp, Artificial Sequence
  chemically synthesized
aatgctggctttgactctca

SEQ ID NO: 155426 - DNA, 20 bp, Artificial Sequence
  chemically synthesized
taatgctggctttgactctc

SEQ ID NO: 155427 - DNA, 20 bp, Artificial Sequence
  chemically synthesized
cctctttcccctgagagtca

SEQ ID NO: 155428 - DNA, 20 bp, Artificial Sequence
  chemically synthesized
ttaatgctggctttgactct

SEQ ID NO: 155429 - DNA, 20 bp, Artificial Sequence
  chemically synthesized
tttcccctgagagtcaaagc

SEQ ID NO: 155430 - DNA, 20 bp, Artificial Sequence
  chemically synthesized
tctcatggcaatgttaatgc

SEQ ID NO: 155431 - DNA, 20 bp, Artificial Sequence
  chemically synthesized
gccagcattaacattgccat

SEQ ID NO: 155432 - DNA, 20 bp, Artificial Sequence
  chemically synthesized
aaggtattcataaattctca

SEQ ID NO: 155433 - DNA, 20 bp, Artificial Sequence
  chemically synthesized
cctcttcagttgttgataga

SEQ ID NO: 155434 - DNA, 20 bp, Artificial Sequence
  chemically synthesized
tcctcttcagttgttgatag

SEQ ID NO: 155435 - DNA, 20 bp, Artificial Sequence
  chemically synthesized
ctttcctcttcagttgttga

SEQ ID NO: 155436 - DNA, 20 bp, Artificial Sequence
  chemically synthesized
ataccttctatcaacaactg

SEQ ID NO: 155437 - DNA, 20 bp, Artificial Sequence
  chemically synthesized
accttctatcaacaactgaa

SEQ ID NO: 155438 - DNA, 20 bp, Artificial Sequence
  chemically synthesized
ccttctatcaacaactgaag

SEQ ID NO: 155439 - DNA, 20 bp, Artificial Sequence
  chemically synthesized
ctatcaacaactgaagagga

SEQ ID NO: 155440 - DNA, 20 bp, Artificial Sequence
  chemically synthesized
attttattttctttcctctt

SEQ ID NO: 155441 - DNA, 20 bp, Artificial Sequence
  chemically synthesized
gaagaggaaagaaaataaaa

SEQ ID NO: 155442 - DNA, 20 bp, Artificial Sequence
  chemically synthesized
ttgttttcactgcatatttt

SEQ ID NO: 155443 - DNA, 20 bp, Artificial Sequence
  chemically synthesized
taaaatagactgaaaatatg

SEQ ID NO: 155444 - DNA, 20 bp, Artificial Sequence
  chemically synthesized
aaaatatgcagtgaaaacaa

SEQ ID NO: 155445 - DNA, 20 bp, Artificial Sequence
  chemically synthesized
gaaaacaaaagttaaaacta

SEQ ID NO: 155446 - DNA, 20 bp, Artificial Sequence
  chemically synthesized
aatatttcctcatttagctg

SEQ ID NO: 155447 - DNA, 20 bp, Artificial Sequence
  chemically synthesized
agttaaaactacagctaaat

SEQ ID NO: 155448 - DNA, 20 bp, Artificial Sequence
  chemically synthesized
gttaaaactacagctaaatg

SEQ ID NO: 155449 - DNA, 20 bp, Artificial Sequence
  chemically synthesized
gggaggaatatttcctcatt

SEQ ID NO: 155450 - DNA, 20 bp, Artificial Sequence
  chemically synthesized
tgaggaaatattcctccccc

SEQ ID NO: 155451 - DNA, 20 bp, Artificial Sequence
  chemically synthesized
accacaagctgacttggggg

SEQ ID NO: 155452 - DNA, 20 bp, Artificial Sequence
  chemically synthesized
gaccacaagctgacttgggg

SEQ ID NO: 155453 - DNA, 20 bp, Artificial Sequence
  chemically synthesized
gaaatattcctcccccaagt

SEQ ID NO: 155454 - DNA, 20 bp, Artificial Sequence
  chemically synthesized
aggaccacaagctgacttgg

SEQ ID NO: 155455 - DNA, 20 bp, Artificial Sequence
  chemically synthesized
gaggaccacaagctgacttg

SEQ ID NO: 155456 - DNA, 20 bp, Artificial Sequence
  chemically synthesized
ggaggaccacaagctgactt

SEQ ID NO: 155457 - DNA, 20 bp, Artificial Sequence
  chemically synthesized
gggaggaccacaagctgact

SEQ ID NO: 155458 - DNA, 20 bp, Artificial Sequence
  chemically synthesized
tcctcccccaagtcagcttg

SEQ ID NO: 155459 - DNA, 20 bp, Artificial Sequence
  chemically synthesized
aaatggattgggaggaccac

SEQ ID NO: 155460 - DNA, 20 bp, Artificial Sequence
  chemically synthesized
aaaaagaaaaatggattggg

SEQ ID NO: 155461 - DNA, 20 bp, Artificial Sequence
  chemically synthesized
gaaaaagaaaaatggattgg

SEQ ID NO: 155462 - DNA, 20 bp, Artificial Sequence
  chemically synthesized
aagaaaaagaaaaatggatt

SEQ ID NO: 155463 - DNA, 20 bp, Artificial Sequence
  chemically synthesized
caagaaaaagaaaaatggat

SEQ ID NO: 155464 - DNA, 20 bp, Artificial Sequence
  chemically synthesized
tagttcaagaaaaagaaaaa

SEQ ID NO: 155465 - DNA, 20 bp, Artificial Sequence
  chemically synthesized
cccatttttagttcaagaaa

SEQ ID NO: 155466 - DNA, 20 bp, Artificial Sequence
  chemically synthesized
agctctcccatttttagttc

SEQ ID NO: 155467 - DNA, 20 bp, Artificial Sequence
  chemically synthesized
tctttttcttgaactaaaaa

SEQ ID NO: 155468 - DNA, 20 bp, Artificial Sequence
  chemically synthesized
ctttttcttgaactaaaaat

SEQ ID NO: 155469 - DNA, 20 bp, Artificial Sequence
  chemically synthesized
ttttcttgaactaaaaatgg

SEQ ID NO: 155470 - DNA, 20 bp, Artificial Sequence
  chemically synthesized
tttaagagctctcccatttt

SEQ ID NO: 155471 - DNA, 20 bp, Artificial Sequence
  chemically synthesized
ttcttgaactaaaaatggga

SEQ ID NO: 155472 - DNA, 20 bp, Artificial Sequence
  chemically synthesized
cccatttgcaaacaatttaa

SEQ ID NO: 155473 - DNA, 20 bp, Artificial Sequence
  chemically synthesized
gtcccatttgcaaacaattt

SEQ ID NO: 155474 - DNA, 20 bp, Artificial Sequence
  chemically synthesized
gctcttaaattgtttgcaaa

SEQ ID NO: 155475 - DNA, 20 bp, Artificial Sequence
  chemically synthesized
ctcttaaattgtttgcaaat

SEQ ID NO: 155476 - DNA, 20 bp, Artificial Sequence
  chemically synthesized
taaattgtttgcaaatggga

SEQ ID NO: 155477 - DNA, 20 bp, Artificial Sequence
  chemically synthesized
aaattgtttgcaaatgggac

SEQ ID NO: 155478 - DNA, 20 bp, Artificial Sequence
  chemically synthesized
aattgtttgcaaatgggaca

SEQ ID NO: 155479 - DNA, 20 bp, Artificial Sequence
  chemically synthesized
ttgtttgcaaatgggacagg

SEQ ID NO: 155480 - DNA, 20 bp, Artificial Sequence
  chemically synthesized
gtttgcaaatgggacaggga

SEQ ID NO: 155481 - DNA, 20 bp, Artificial Sequence
  chemically synthesized
tttgcaaatgggacagggag

SEQ ID NO: 155482 - DNA, 20 bp, Artificial Sequence
  chemically synthesized
aatgggacagggagaggtgc

SEQ ID NO: 155483 - DNA, 20 bp, Artificial Sequence
  chemically synthesized
gggacagggagaggtgctag

SEQ ID NO: 155484 - DNA, 20 bp, Artificial Sequence
  chemically synthesized
ggacagggagaggtgctagt

SEQ ID NO: 155485 - DNA, 20 bp, Artificial Sequence
  chemically synthesized
agaaacacacacagtcctac

SEQ ID NO: 155486 - DNA, 20 bp, Artificial Sequence
  chemically synthesized
agaaaccacagaaacacaca

SEQ ID NO: 155487 - DNA, 20 bp, Artificial Sequence
  chemically synthesized
taggactgtgtgtgtttctg

SEQ ID NO: 155488 - DNA, 20 bp, Artificial Sequence
  chemically synthesized
tacaaaaatcacagaaacca

SEQ ID NO: 155489 - DNA, 20 bp, Artificial Sequence
  chemically synthesized
aagtatgtctacaaaaatca

SEQ ID NO: 155490 - DNA, 20 bp, Artificial Sequence
  chemically synthesized
tgtggtttctgtgatttttg

SEQ ID NO: 155491 - DNA, 20 bp, Artificial Sequence
  chemically synthesized
cattgttcctgaagagggac

SEQ ID NO: 155492 - DNA, 20 bp, Artificial Sequence
  chemically synthesized
tagacatacttgtccctctt

SEQ ID NO: 155493 - DNA, 20 bp, Artificial Sequence
  chemically synthesized
agacatacttgtccctcttc

SEQ ID NO: 155494 - DNA, 20 bp, Artificial Sequence
  chemically synthesized
gtgtgcattgttcctgaaga

SEQ ID NO: 155495 - DNA, 20 bp, Artificial Sequence
  chemically synthesized
tgtgtgcattgttcctgaag

SEQ ID NO: 155496 - DNA, 20 bp, Artificial Sequence
  chemically synthesized
atgtgtgcattgttcctgaa

SEQ ID NO: 155497 - DNA, 20 bp, Artificial Sequence
  chemically synthesized
ggatgtgtgcattgttcctg

SEQ ID NO: 155498 - DNA, 20 bp, Artificial Sequence
  chemically synthesized
aggaacaatgcacacatccc

SEQ ID NO: 155499 - DNA, 20 bp, Artificial Sequence
  chemically synthesized
atgcacacatccctggatgc

SEQ ID NO: 155500 - DNA, 20 bp, Artificial Sequence
  chemically synthesized
accaatattcctagcatcca

SEQ ID NO: 155501 - DNA, 20 bp, Artificial Sequence
  chemically synthesized
tgcacacatccctggatgct

SEQ ID NO: 155502 - DNA, 20 bp, Artificial Sequence
  chemically synthesized
aaccaatattcctagcatcc

SEQ ID NO: 155503 - DNA, 20 bp, Artificial Sequence
  chemically synthesized
caaccaatattcctagcatc

SEQ ID NO: 155504 - DNA, 20 bp, Artificial Sequence
  chemically synthesized
tccctggatgctaggaatat

SEQ ID NO: 155505 - DNA, 20 bp, Artificial Sequence
  chemically synthesized
ccattaacaaccaatattcc

SEQ ID NO: 155506 - DNA, 20 bp, Artificial Sequence
  chemically synthesized
ctaggaatattggttgttaa

SEQ ID NO: 155507 - DNA, 20 bp, Artificial Sequence
  chemically synthesized
tgttaatggtgttccttact

SEQ ID NO: 155508 - DNA, 20 bp, Artificial Sequence
  chemically synthesized
gccgaaggcaattcttagta

SEQ ID NO: 155509 - DNA, 20 bp, Artificial Sequence
  chemically synthesized
ggccgaaggcaattcttagt

SEQ ID NO: 155510 - DNA, 20 bp, Artificial Sequence
  chemically synthesized
ctgaggccgaaggcaattct

SEQ ID NO: 155511 - DNA, 20 bp, Artificial Sequence
  chemically synthesized
tccttactaagaattgcctt

SEQ ID NO: 155512 - DNA, 20 bp, Artificial Sequence
  chemically synthesized
ctaagaattgccttcggcct

SEQ ID NO: 155513 - DNA, 20 bp, Artificial Sequence
  chemically synthesized
gacaagttttctgaggccga

SEQ ID NO: 155514 - DNA, 20 bp, Artificial Sequence
  chemically synthesized
ggacaagttttctgaggccg

SEQ ID NO: 155515 - DNA, 20 bp, Artificial Sequence
  chemically synthesized
caacttggacaagttttctg

SEQ ID NO: 155516 - DNA, 20 bp, Artificial Sequence
  chemically synthesized
acaacttggacaagttttct

SEQ ID NO: 155517 - DNA, 20 bp, Artificial Sequence
  chemically synthesized
cggcctcagaaaacttgtcc

SEQ ID NO: 155518 - DNA, 20 bp, Artificial Sequence
  chemically synthesized
agtggaaggacaacttggac

SEQ ID NO: 155519 - DNA, 20 bp, Artificial Sequence
  chemically synthesized
ctgagagtggaaggacaact

SEQ ID NO: 155520 - DNA, 20 bp, Artificial Sequence
  chemically synthesized
ggctgctgcctgagagtgga

SEQ ID NO: 155521 - DNA, 20 bp, Artificial Sequence
  chemically synthesized
ccaagttgtccttccactct

SEQ ID NO: 155522 - DNA, 20 bp, Artificial Sequence
  chemically synthesized
tggctgctgcctgagagtgg

SEQ ID NO: 155523 - DNA, 20 bp, Artificial Sequence
  chemically synthesized
caagttgtccttccactctc

SEQ ID NO: 155524 - DNA, 20 bp, Artificial Sequence
  chemically synthesized
ggctggctgctgcctgagag

SEQ ID NO: 155525 - DNA, 20 bp, Artificial Sequence
  chemically synthesized
gttgtccttccactctcagg

SEQ ID NO: 155526 - DNA, 20 bp, Artificial Sequence
  chemically synthesized
aggggctggctgctgcctga

SEQ ID NO: 155527 - DNA, 20 bp, Artificial Sequence
  chemically synthesized
gtccttccactctcaggcag

SEQ ID NO: 155528 - DNA, 20 bp, Artificial Sequence
  chemically synthesized
ccaggggctggctgctgcct

SEQ ID NO: 155529 - DNA, 20 bp, Artificial Sequence
  chemically synthesized
ttccactctcaggcagcagc

SEQ ID NO: 155530 - DNA, 20 bp, Artificial Sequence
  chemically synthesized
ctcaggcagcagccagcccc

SEQ ID NO: 155531 - DNA, 20 bp, Artificial Sequence
  chemically synthesized
gccagccattggccaggggc

SEQ ID NO: 155532 - DNA, 20 bp, Artificial Sequence
  chemically synthesized
tccagccagccattggccag

SEQ ID NO: 155533 - DNA, 20 bp, Artificial Sequence
  chemically synthesized
agcagccagcccctggccaa

SEQ ID NO: 155534 - DNA, 20 bp, Artificial Sequence
  chemically synthesized
atccagccagccattggcca

SEQ ID NO: 155535 - DNA, 20 bp, Artificial Sequence
  chemically synthesized
gatccagccagccattggcc

SEQ ID NO: 155536 - DNA, 20 bp, Artificial Sequence
  chemically synthesized
tgatccagccagccattggc

SEQ ID NO: 155537 - DNA, 20 bp, Artificial Sequence
  chemically synthesized
gccagcccctggccaatggc

SEQ ID NO: 155538 - DNA, 20 bp, Artificial Sequence
  chemically synthesized
ttcctgatccagccagccat

SEQ ID NO: 155539 - DNA, 20 bp, Artificial Sequence
  chemically synthesized
gcccctggccaatggctggc

SEQ ID NO: 155540 - DNA, 20 bp, Artificial Sequence
  chemically synthesized
tggccaatggctggctggat

SEQ ID NO: 155541 - DNA, 20 bp, Artificial Sequence
  chemically synthesized
ccttgtattcctgatccagc

SEQ ID NO: 155542 - DNA, 20 bp, Artificial Sequence
  chemically synthesized
ggccaatggctggctggatc

SEQ ID NO: 155543 - DNA, 20 bp, Artificial Sequence
  chemically synthesized
tggcccttgtattcctgatc

SEQ ID NO: 155544 - DNA, 20 bp, Artificial Sequence
  chemically synthesized
gctggctggatcaggaatac

SEQ ID NO: 155545 - DNA, 20 bp, Artificial Sequence
  chemically synthesized
ctggctggatcaggaataca

SEQ ID NO: 155546 - DNA, 20 bp, Artificial Sequence
  chemically synthesized
tggctggatcaggaatacaa

SEQ ID NO: 155547 - DNA, 20 bp, Artificial Sequence
  chemically synthesized
tggatcaggaatacaagggc

SEQ ID NO: 155548 - DNA, 20 bp, Artificial Sequence
  chemically synthesized
ggatcaggaatacaagggcc

SEQ ID NO: 155549 - DNA, 20 bp, Artificial Sequence
  chemically synthesized
tgaattgcaggcagtgggcc

SEQ ID NO: 155550 - DNA, 20 bp, Artificial Sequence
  chemically synthesized
tgtcctgaattgcaggcagt

SEQ ID NO: 155551 - DNA, 20 bp, Artificial Sequence
  chemically synthesized
ctgtcctgaattgcaggcag

SEQ ID NO: 155552 - DNA, 20 bp, Artificial Sequence
  chemically synthesized
gagctgtcctgaattgcagg

SEQ ID NO: 155553 - DNA, 20 bp, Artificial Sequence
  chemically synthesized
caggcccactgcctgcaatt

SEQ ID NO: 155554 - DNA, 20 bp, Artificial Sequence
  chemically synthesized
aggcccactgcctgcaattc

SEQ ID NO: 155555 - DNA, 20 bp, Artificial Sequence
  chemically synthesized
gcagagctgtcctgaattgc

SEQ ID NO: 155556 - DNA, 20 bp, Artificial Sequence
  chemically synthesized
tgcagagctgtcctgaattg

SEQ ID NO: 155557 - DNA, 20 bp, Artificial Sequence
  chemically synthesized
ccactgcctgcaattcagga

SEQ ID NO: 155558 - DNA, 20 bp, Artificial Sequence
  chemically synthesized
caattcaggacagctctgca

SEQ ID NO: 155559 - DNA, 20 bp, Artificial Sequence
  chemically synthesized
acatctgggctggctgtgca

SEQ ID NO: 155560 - DNA, 20 bp, Artificial Sequence
  chemically synthesized
tcaggacagctctgcacagc

SEQ ID NO: 155561 - DNA, 20 bp, Artificial Sequence
  chemically synthesized
ctacatctgggctggctgtg

SEQ ID NO: 155562 - DNA, 20 bp, Artificial Sequence
  chemically synthesized
acagctctgcacagccagcc

SEQ ID NO: 155563 - DNA, 20 bp, Artificial Sequence
  chemically synthesized
caggagccctacatctgggc

SEQ ID NO: 155564 - DNA, 20 bp, Artificial Sequence
  chemically synthesized
ctgcacagccagcccagatg

SEQ ID NO: 155565 - DNA, 20 bp, Artificial Sequence
  chemically synthesized
tgcacagccagcccagatgt

SEQ ID NO: 155566 - DNA, 20 bp, Artificial Sequence
  chemically synthesized
gcacagccagcccagatgta

SEQ ID NO: 155567 - DNA, 20 bp, Artificial Sequence
  chemically synthesized
ctcgcaggagccctacatct

SEQ ID NO: 155568 - DNA, 20 bp, Artificial Sequence
  chemically synthesized
tctcgcaggagccctacatc

SEQ ID NO: 155569 - DNA, 20 bp, Artificial Sequence
  chemically synthesized
cccagatgtagggctcctgc

SEQ ID NO: 155570 - DNA, 20 bp, Artificial Sequence
  chemically synthesized
ggcctaagccagtctcgcag

SEQ ID NO: 155571 - DNA, 20 bp, Artificial Sequence
  chemically synthesized
atgtagggctcctgcgagac

SEQ ID NO: 155572 - DNA, 20 bp, Artificial Sequence
  chemically synthesized
gaggcctaagccagtctcgc

SEQ ID NO: 155573 - DNA, 20 bp, Artificial Sequence
  chemically synthesized
agaggcctaagccagtctcg

SEQ ID NO: 155574 - DNA, 20 bp, Artificial Sequence
  chemically synthesized
gggctcctgcgagactggct

SEQ ID NO: 155575 - DNA, 20 bp, Artificial Sequence
  chemically synthesized
ggctcctgcgagactggctt

SEQ ID NO: 155576 - DNA, 20 bp, Artificial Sequence
  chemically synthesized
tctgcagcagaggcctaagc

SEQ ID NO: 155577 - DNA, 20 bp, Artificial Sequence
  chemically synthesized
tttgtctgcagcagaggcct

SEQ ID NO: 155578 - DNA, 20 bp, Artificial Sequence
  chemically synthesized
actggcttaggcctctgctg

SEQ ID NO: 155579 - DNA, 20 bp, Artificial Sequence
  chemically synthesized
atgtgatttgtctgcagcag

SEQ ID NO: 155580 - DNA, 20 bp, Artificial Sequence
  chemically synthesized
aatgtgatttgtctgcagca

SEQ ID NO: 155581 - DNA, 20 bp, Artificial Sequence
  chemically synthesized
gaaatgtgatttgtctgcag

SEQ ID NO: 155582 - DNA, 20 bp, Artificial Sequence
  chemically synthesized
tctgaaatgtgatttgtctg

SEQ ID NO: 155583 - DNA, 20 bp, Artificial Sequence
  chemically synthesized
gctgcagacaaatcacattt

SEQ ID NO: 155584 - DNA, 20 bp, Artificial Sequence
  chemically synthesized
gcacaagggagattgtggga

SEQ ID NO: 155585 - DNA, 20 bp, Artificial Sequence
  chemically synthesized
gagcacaagggagattgtgg

SEQ ID NO: 155586 - DNA, 20 bp, Artificial Sequence
  chemically synthesized
aagagcacaagggagattgt

SEQ ID NO: 155587 - DNA, 20 bp, Artificial Sequence
  chemically synthesized
gaagagcacaagggagattg

SEQ ID NO: 155588 - DNA, 20 bp, Artificial Sequence
  chemically synthesized
aggaagagaagagcacaagg

SEQ ID NO: 155589 - DNA, 20 bp, Artificial Sequence
  chemically synthesized
caaggaagagaagagcacaa

SEQ ID NO: 155590 - DNA, 20 bp, Artificial Sequence
  chemically synthesized
acaaggaagagaagagcaca

SEQ ID NO: 155591 - DNA, 20 bp, Artificial Sequence
  chemically synthesized
cacaaggaagagaagagcac

SEQ ID NO: 155592 - DNA, 20 bp, Artificial Sequence
  chemically synthesized
tacacccacaaggaagagaa

SEQ ID NO: 155593 - DNA, 20 bp, Artificial Sequence
  chemically synthesized
gatacacccacaaggaagag

SEQ ID NO: 155594 - DNA, 20 bp, Artificial Sequence
  chemically synthesized
ttgtgctcttctcttccttg

SEQ ID NO: 155595 - DNA, 20 bp, Artificial Sequence
  chemically synthesized
ggagatacacccacaaggaa

SEQ ID NO: 155596 - DNA, 20 bp, Artificial Sequence
  chemically synthesized
tgtgctcttctcttccttgt

SEQ ID NO: 155597 - DNA, 20 bp, Artificial Sequence
  chemically synthesized
ctggagatacacccacaagg

SEQ ID NO: 155598 - DNA, 20 bp, Artificial Sequence
  chemically synthesized
tctctggagatacacccaca

SEQ ID NO: 155599 - DNA, 20 bp, Artificial Sequence
  chemically synthesized
ttctctggagatacacccac

SEQ ID NO: 155600 - DNA, 20 bp, Artificial Sequence
  chemically synthesized
cttccttgtgggtgtatctc

SEQ ID NO: 155601 - DNA, 20 bp, Artificial Sequence
  chemically synthesized
tccttgtgggtgtatctcca

SEQ ID NO: 155602 - DNA, 20 bp, Artificial Sequence
  chemically synthesized
gatatggggagtgttctctg

SEQ ID NO: 155603 - DNA, 20 bp, Artificial Sequence
  chemically synthesized
gggatatggggagtgttctc

SEQ ID NO: 155604 - DNA, 20 bp, Artificial Sequence
  chemically synthesized
gcatgacaacgggatatggg

SEQ ID NO: 155605 - DNA, 20 bp, Artificial Sequence
  chemically synthesized
ttgcatgacaacgggatatg

SEQ ID NO: 155606 - DNA, 20 bp, Artificial Sequence
  chemically synthesized
gttgcatgacaacgggatat

SEQ ID NO: 155607 - DNA, 20 bp, Artificial Sequence
  chemically synthesized
tgttgcatgacaacgggata

SEQ ID NO: 155608 - DNA, 20 bp, Artificial Sequence
  chemically synthesized
tcaaagtgttgcatgacaac

SEQ ID NO: 155609 - DNA, 20 bp, Artificial Sequence
  chemically synthesized
ttcaaagtgttgcatgacaa

SEQ ID NO: 155610 - DNA, 20 bp, Artificial Sequence
  chemically synthesized
tgtcatgcaacactttgaat

SEQ ID NO: 155611 - DNA, 20 bp, Artificial Sequence
  chemically synthesized
tcatgcaacactttgaatca

SEQ ID NO: 155612 - DNA, 20 bp, Artificial Sequence
  chemically synthesized
tggaaattgactctgattca

SEQ ID NO: 155613 - DNA, 20 bp, Artificial Sequence
  chemically synthesized
ttgaatcagagtcaatttcc

SEQ ID NO: 155614 - DNA, 20 bp, Artificial Sequence
  chemically synthesized
tgaatcagagtcaatttcca

SEQ ID NO: 155615 - DNA, 20 bp, Artificial Sequence
  chemically synthesized
aagtcttagagtacattcct

SEQ ID NO: 155616 - DNA, 20 bp, Artificial Sequence
  chemically synthesized
atttccaaggaatgtactct

SEQ ID NO: 155617 - DNA, 20 bp, Artificial Sequence
  chemically synthesized
tgactgtgcaaaaagtctta

SEQ ID NO: 155618 - DNA, 20 bp, Artificial Sequence
  chemically synthesized
attgactgtgcaaaaagtct

SEQ ID NO: 155619 - DNA, 20 bp, Artificial Sequence
  chemically synthesized
gtactctaagactttttgca

SEQ ID NO: 155620 - DNA, 20 bp, Artificial Sequence
  chemically synthesized
tgtgttattgactgtgcaaa

SEQ ID NO: 155621 - DNA, 20 bp, Artificial Sequence
  chemically synthesized
tttgcacagtcaataacaca

SEQ ID NO: 155622 - DNA, 20 bp, Artificial Sequence
  chemically synthesized
ttgcacagtcaataacacaa

SEQ ID NO: 155623 - DNA, 20 bp, Artificial Sequence
  chemically synthesized
caaaggtttatctctatctt

SEQ ID NO: 155624 - DNA, 20 bp, Artificial Sequence
  chemically synthesized
ttgtttcaattctaaagata

SEQ ID NO: 155625 - DNA, 20 bp, Artificial Sequence
  chemically synthesized
atttgtttcaattctaaaga

SEQ ID NO: 155626 - DNA, 20 bp, Artificial Sequence
  chemically synthesized
gaaaatttgtttcaattcta

SEQ ID NO: 155627 - DNA, 20 bp, Artificial Sequence
  chemically synthesized
aacaaattttctctctcacc

SEQ ID NO: 155628 - DNA, 20 bp, Artificial Sequence
  chemically synthesized
gaagtgatgactgggtgaga

SEQ ID NO: 155629 - DNA, 20 bp, Artificial Sequence
  chemically synthesized
atgaagtgatgactgggtga

SEQ ID NO: 155630 - DNA, 20 bp, Artificial Sequence
  chemically synthesized
ctatgaagtgatgactgggt

SEQ ID NO: 155631 - DNA, 20 bp, Artificial Sequence
  chemically synthesized
gcaactatgaagtgatgact

SEQ ID NO: 155632 - DNA, 20 bp, Artificial Sequence
  chemically synthesized
tgcaactatgaagtgatgac

SEQ ID NO: 155633 - DNA, 20 bp, Artificial Sequence
  chemically synthesized
ctcacccagtcatcacttca

SEQ ID NO: 155634 - DNA, 20 bp, Artificial Sequence
  chemically synthesized
tgttcaaaagtgcaactatg

SEQ ID NO: 155635 - DNA, 20 bp, Artificial Sequence
  chemically synthesized
ggctctagctatttgttcaa

SEQ ID NO: 155636 - DNA, 20 bp, Artificial Sequence
  chemically synthesized
tagttgcacttttgaacaaa

SEQ ID NO: 155637 - DNA, 20 bp, Artificial Sequence
  chemically synthesized
tgcacttttgaacaaatagc

SEQ ID NO: 155638 - DNA, 20 bp, Artificial Sequence
  chemically synthesized
cacttttgaacaaatagcta

SEQ ID NO: 155639 - DNA, 20 bp, Artificial Sequence
  chemically synthesized
tgaacaaatagctagagcca

SEQ ID NO: 155640 - DNA, 20 bp, Artificial Sequence
  chemically synthesized
gatcccattctctttggctc

SEQ ID NO: 155641 - DNA, 20 bp, Artificial Sequence
  chemically synthesized
aacaaatagctagagccaaa

SEQ ID NO: 155642 - DNA, 20 bp, Artificial Sequence
  chemically synthesized
atagctagagccaaagagaa

SEQ ID NO: 155643 - DNA, 20 bp, Artificial Sequence
  chemically synthesized
atactggatcccattctctt

SEQ ID NO: 155644 - DNA, 20 bp, Artificial Sequence
  chemically synthesized
tagctagagccaaagagaat

SEQ ID NO: 155645 - DNA, 20 bp, Artificial Sequence
  chemically synthesized
gagccaaagagaatgggatc

SEQ ID NO: 155646 - DNA, 20 bp, Artificial Sequence
  chemically synthesized
attggagcctgtaagtatac

SEQ ID NO: 155647 - DNA, 20 bp, Artificial Sequence
  chemically synthesized
aatgggatccagtatactta

SEQ ID NO: 155648 - DNA, 20 bp, Artificial Sequence
  chemically synthesized
atgggatccagtatacttac

SEQ ID NO: 155649 - DNA, 20 bp, Artificial Sequence
  chemically synthesized
tgaccactattggagcctgt

SEQ ID NO: 155650 - DNA, 20 bp, Artificial Sequence
  chemically synthesized
agtatacttacaggctccaa

SEQ ID NO: 155651 - DNA, 20 bp, Artificial Sequence
  chemically synthesized
atacttacaggctccaatag

SEQ ID NO: 155652 - DNA, 20 bp, Artificial Sequence
  chemically synthesized
tcctggactgaccactattg

SEQ ID NO: 155653 - DNA, 20 bp, Artificial Sequence
  chemically synthesized
gctcctggactgaccactat

SEQ ID NO: 155654 - DNA, 20 bp, Artificial Sequence
  chemically synthesized
ttacaggctccaatagtggt

SEQ ID NO: 155655 - DNA, 20 bp, Artificial Sequence
  chemically synthesized
ggctccaatagtggtcagtc

SEQ ID NO: 155656 - DNA, 20 bp, Artificial Sequence
  chemically synthesized
gctccaatagtggtcagtcc

SEQ ID NO: 155657 - DNA, 20 bp, Artificial Sequence
  chemically synthesized
tccaatagtggtcagtccag

SEQ ID NO: 155658 - DNA, 20 bp, Artificial Sequence
  chemically synthesized
atagtggtcagtccaggagc

SEQ ID NO: 155659 - DNA, 20 bp, Artificial Sequence
  chemically synthesized
tagtggtcagtccaggagct

SEQ ID NO: 155660 - DNA, 20 bp, Artificial Sequence
  chemically synthesized
aagcagcctgacctagctcc

SEQ ID NO: 155661 - DNA, 20 bp, Artificial Sequence
  chemically synthesized
ggtcagtccaggagctaggt

SEQ ID NO: 155662 - DNA, 20 bp, Artificial Sequence
  chemically synthesized
gtcagtccaggagctaggtc

SEQ ID NO: 155663 - DNA, 20 bp, Artificial Sequence
  chemically synthesized
gagggcaaagcagcctgacc

SEQ ID NO: 155664 - DNA, 20 bp, Artificial Sequence
  chemically synthesized
ttcaagagctgagggcaaag

SEQ ID NO: 155665 - DNA, 20 bp, Artificial Sequence
  chemically synthesized
aggtcaggctgctttgccct

SEQ ID NO: 155666 - DNA, 20 bp, Artificial Sequence
  chemically synthesized
tacttcaagagctgagggca

SEQ ID NO: 155667 - DNA, 20 bp, Artificial Sequence
  chemically synthesized
ccgtttacttcaagagctga

SEQ ID NO: 155668 - DNA, 20 bp, Artificial Sequence
  chemically synthesized
accgtttacttcaagagctg

SEQ ID NO: 155669 - DNA, 20 bp, Artificial Sequence
  chemically synthesized
aaccgtttacttcaagagct

SEQ ID NO: 155670 - DNA, 20 bp, Artificial Sequence
  chemically synthesized
tgctttgccctcagctcttg

SEQ ID NO: 155671 - DNA, 20 bp, Artificial Sequence
  chemically synthesized
cggtaaaccgtttacttcaa

SEQ ID NO: 155672 - DNA, 20 bp, Artificial Sequence
  chemically synthesized
ggcggtaaaccgtttacttc

SEQ ID NO: 155673 - DNA, 20 bp, Artificial Sequence
  chemically synthesized
ccctcagctcttgaagtaaa

SEQ ID NO: 155674 - DNA, 20 bp, Artificial Sequence
  chemically synthesized
tctgagctctgagtggaagg

SEQ ID NO: 155675 - DNA, 20 bp, Artificial Sequence
  chemically synthesized
acggtttaccgccttccact

SEQ ID NO: 155676 - DNA, 20 bp, Artificial Sequence
  chemically synthesized
agatctgagctctgagtgga

SEQ ID NO: 155677 - DNA, 20 bp, Artificial Sequence
  chemically synthesized
ggtttaccgccttccactca

SEQ ID NO: 155678 - DNA, 20 bp, Artificial Sequence
  chemically synthesized
aagatctgagctctgagtgg

SEQ ID NO: 155679 - DNA, 20 bp, Artificial Sequence
  chemically synthesized
tagaagatctgagctctgag

SEQ ID NO: 155680 - DNA, 20 bp, Artificial Sequence
  chemically synthesized
accgccttccactcagagct

SEQ ID NO: 155681 - DNA, 20 bp, Artificial Sequence
  chemically synthesized
agttagaagatctgagctct

SEQ ID NO: 155682 - DNA, 20 bp, Artificial Sequence
  chemically synthesized
aagaggaagttagaagatct

SEQ ID NO: 155683 - DNA, 20 bp, Artificial Sequence
  chemically synthesized
tctgttaaagaggaagttag

SEQ ID NO: 155684 - DNA, 20 bp, Artificial Sequence
  chemically synthesized
ttttctgttaaagaggaagt

SEQ ID NO: 155685 - DNA, 20 bp, Artificial Sequence
  chemically synthesized
atgcttttctgttaaagagg

SEQ ID NO: 155686 - DNA, 20 bp, Artificial Sequence
  chemically synthesized
tcttctaacttcctctttaa

SEQ ID NO: 155687 - DNA, 20 bp, Artificial Sequence
  chemically synthesized
tgtatgcttttctgttaaag

SEQ ID NO: 155688 - DNA, 20 bp, Artificial Sequence
  chemically synthesized
gtgtatgcttttctgttaaa

SEQ ID NO: 155689 - DNA, 20 bp, Artificial Sequence
  chemically synthesized
atgtgtatgcttttctgtta

SEQ ID NO: 155690 - DNA, 20 bp, Artificial Sequence
  chemically synthesized
taacttcctctttaacagaa

SEQ ID NO: 155691 - DNA, 20 bp, Artificial Sequence
  chemically synthesized
cttcaaagtgttaatcgaat

SEQ ID NO: 155692 - DNA, 20 bp, Artificial Sequence
  chemically synthesized
cttattcgattaacactttg

SEQ ID NO: 155693 - DNA, 20 bp, Artificial Sequence
  chemically synthesized
atgttcatgaattatcttca

SEQ ID NO: 155694 - DNA, 20 bp, Artificial Sequence
  chemically synthesized
atatattcaccaaatggatt

SEQ ID NO: 155695 - DNA, 20 bp, Artificial Sequence
  chemically synthesized
catgaacatcttaatccatt

SEQ ID NO: 155696 - DNA, 20 bp, Artificial Sequence
  chemically synthesized
ccaataatatattcaccaaa

SEQ ID NO: 155697 - DNA, 20 bp, Artificial Sequence
  chemically synthesized
ccatttggtgaatatattat

SEQ ID NO: 155698 - DNA, 20 bp, Artificial Sequence
  chemically synthesized
aatttagaagtaaaatataa

SEQ ID NO: 155699 - DNA, 20 bp, Artificial Sequence
  chemically synthesized
acccactaaagttaatttag

SEQ ID NO: 155700 - DNA, 20 bp, Artificial Sequence
  chemically synthesized
tctacccactaaagttaatt

SEQ ID NO: 155701 - DNA, 20 bp, Artificial Sequence
  chemically synthesized
ttttacttctaaattaactt

SEQ ID NO: 155702 - DNA, 20 bp, Artificial Sequence
  chemically synthesized
tacttctaaattaactttag

SEQ ID NO: 155703 - DNA, 20 bp, Artificial Sequence
  chemically synthesized
acttctaaattaactttagt

SEQ ID NO: 155704 - DNA, 20 bp, Artificial Sequence
  chemically synthesized
tctaaattaactttagtggg

SEQ ID NO: 155705 - DNA, 20 bp, Artificial Sequence
  chemically synthesized
aaaagaaattctacccacta

SEQ ID NO: 155706 - DNA, 20 bp, Artificial Sequence
  chemically synthesized
agtgggtagaatttctttta

SEQ ID NO: 155707 - DNA, 20 bp, Artificial Sequence
  chemically synthesized
gtgggtagaatttcttttaa

SEQ ID NO: 155708 - DNA, 20 bp, Artificial Sequence
  chemically synthesized
aataattataattcctttaa

SEQ ID NO: 155709 - DNA, 20 bp, Artificial Sequence
  chemically synthesized
taaaggaattataattattt

SEQ ID NO: 155710 - DNA, 20 bp, Artificial Sequence
  chemically synthesized
ataaatatttgtagggtggt

SEQ ID NO: 155711 - DNA, 20 bp, Artificial Sequence
  chemically synthesized
attgataaatatttgtaggg

SEQ ID NO: 155712 - DNA, 20 bp, Artificial Sequence
  chemically synthesized
gcaattgataaatatttgta

SEQ ID NO: 155713 - DNA, 20 bp, Artificial Sequence
  chemically synthesized
agcaattgataaatatttgt

SEQ ID NO: 155714 - DNA, 20 bp, Artificial Sequence
  chemically synthesized
gagcaattgataaatatttg

SEQ ID NO: 155715 - DNA, 20 bp, Artificial Sequence
  chemically synthesized
ggagaaagggtttttgtatg

SEQ ID NO: 155716 - DNA, 20 bp, Artificial Sequence
  chemically synthesized
ctggagaaagggtttttgta

SEQ ID NO: 155717 - DNA, 20 bp, Artificial Sequence
  chemically synthesized
ccatacaaaaaccctttctc

SEQ ID NO: 155718 - DNA, 20 bp, Artificial Sequence
  chemically synthesized
catacaaaaaccctttctcc

SEQ ID NO: 155719 - DNA, 20 bp, Artificial Sequence
  chemically synthesized
taaaattatgcctggagaaa

SEQ ID NO: 155720 - DNA, 20 bp, Artificial Sequence
  chemically synthesized
ataaaattatgcctggagaa

SEQ ID NO: 155721 - DNA, 20 bp, Artificial Sequence
  chemically synthesized
aataaaattatgcctggaga

SEQ ID NO: 155722 - DNA, 20 bp, Artificial Sequence
  chemically synthesized
tttaaataaaattatgcctg

SEQ ID NO: 155723 - DNA, 20 bp, Artificial Sequence
  chemically synthesized
cctttaaataaaattatgcc

SEQ ID NO: 155724 - DNA, 20 bp, Artificial Sequence
  chemically synthesized
tccaggcataattttattta

SEQ ID NO: 155725 - DNA, 20 bp, Artificial Sequence
  chemically synthesized
ccaggcataattttatttaa

SEQ ID NO: 155726 - DNA, 20 bp, Artificial Sequence
  chemically synthesized
ggcataattttatttaaagg

SEQ ID NO: 155727 - DNA, 20 bp, Artificial Sequence
  chemically synthesized
ataattttatttaaaggaag

SEQ ID NO: 155728 - DNA, 20 bp, Artificial Sequence
  chemically synthesized
aattttatttaaaggaagta

SEQ ID NO: 155729 - DNA, 20 bp, Artificial Sequence
  chemically synthesized
aggaagtagagtgcaaacat

SEQ ID NO: 155730 - DNA, 20 bp, Artificial Sequence
  chemically synthesized
gagagggaactgttttttgt

SEQ ID NO: 155731 - DNA, 20 bp, Artificial Sequence
  chemically synthesized
gaaaacaaaccaacaaaaaa

SEQ ID NO: 155732 - DNA, 20 bp, Artificial Sequence
  chemically synthesized
aacaaaaaacagttccctct

SEQ ID NO: 155733 - DNA, 20 bp, Artificial Sequence
  chemically synthesized
aattaagctagttgctgaga

SEQ ID NO: 155734 - DNA, 20 bp, Artificial Sequence
  chemically synthesized
gaattaagctagttgctgag

SEQ ID NO: 155735 - DNA, 20 bp, Artificial Sequence
  chemically synthesized
agaattaagctagttgctga

SEQ ID NO: 155736 - DNA, 20 bp, Artificial Sequence
  chemically synthesized
aacagttccctctcagcaac

SEQ ID NO: 155737 - DNA, 20 bp, Artificial Sequence
  chemically synthesized
caagaattaagctagttgct

SEQ ID NO: 155738 - DNA, 20 bp, Artificial Sequence
  chemically synthesized
atactcttcaagaattaagc

SEQ ID NO: 155739 - DNA, 20 bp, Artificial Sequence
  chemically synthesized
atagatactcttcaagaatt

SEQ ID NO: 155740 - DNA, 20 bp, Artificial Sequence
  chemically synthesized
agcaactagcttaattcttg

SEQ ID NO: 155741 - DNA, 20 bp, Artificial Sequence
  chemically synthesized
caactagcttaattcttgaa

SEQ ID NO: 155742 - DNA, 20 bp, Artificial Sequence
  chemically synthesized
aaccacaatagatactcttc

SEQ ID NO: 155743 - DNA, 20 bp, Artificial Sequence
  chemically synthesized
ttcttgaagagtatctattg

SEQ ID NO: 155744 - DNA, 20 bp, Artificial Sequence
  chemically synthesized
attttagtatgcaaccacaa

SEQ ID NO: 155745 - DNA, 20 bp, Artificial Sequence
  chemically synthesized
taaagttatctggataattt

SEQ ID NO: 155746 - DNA, 20 bp, Artificial Sequence
  chemically synthesized
ggttgcatactaaaattatc

SEQ ID NO: 155747 - DNA, 20 bp, Artificial Sequence
  chemically synthesized
aggattttcctaaagttatc

SEQ ID NO: 155748 - DNA, 20 bp, Artificial Sequence
  chemically synthesized
taaaattatccagataactt

SEQ ID NO: 155749 - DNA, 20 bp, Artificial Sequence
  chemically synthesized
aaaattatccagataacttt

SEQ ID NO: 155750 - DNA, 20 bp, Artificial Sequence
  chemically synthesized
agtacattaggattttccta

SEQ ID NO: 155751 - DNA, 20 bp, Artificial Sequence
  chemically synthesized
ttaggaaaatcctaatgtac

SEQ ID NO: 155752 - DNA, 20 bp, Artificial Sequence
  chemically synthesized
tgggggtgagccagtacatt

SEQ ID NO: 155753 - DNA, 20 bp, Artificial Sequence
  chemically synthesized
ctgggggtgagccagtacat

SEQ ID NO: 155754 - DNA, 20 bp, Artificial Sequence
  chemically synthesized
ataattgactgggggtgagc

SEQ ID NO: 155755 - DNA, 20 bp, Artificial Sequence
  chemically synthesized
ctaatgtactggctcacccc

SEQ ID NO: 155756 - DNA, 20 bp, Artificial Sequence
  chemically synthesized
tgatataattgactgggggt

SEQ ID NO: 155757 - DNA, 20 bp, Artificial Sequence
  chemically synthesized
actctgatataattgactgg

SEQ ID NO: 155758 - DNA, 20 bp, Artificial Sequence
  chemically synthesized
gactctgatataattgactg

SEQ ID NO: 155759 - DNA, 20 bp, Artificial Sequence
  chemically synthesized
agactctgatataattgact

SEQ ID NO: 155760 - DNA, 20 bp, Artificial Sequence
  chemically synthesized
gagactctgatataattgac

SEQ ID NO: 155761 - DNA, 20 bp, Artificial Sequence
  chemically synthesized
tcacccccagtcaattatat

SEQ ID NO: 155762 - DNA, 20 bp, Artificial Sequence
  chemically synthesized
acccccagtcaattatatca

SEQ ID NO: 155763 - DNA, 20 bp, Artificial Sequence
  chemically synthesized
aattatatcagagtctctta

SEQ ID NO: 155764 - DNA, 20 bp, Artificial Sequence
  chemically synthesized
attatatcagagtctcttaa

SEQ ID NO: 155765 - DNA, 20 bp, Artificial Sequence
  chemically synthesized
ttatatcagagtctcttaaa

SEQ ID NO: 155766 - DNA, 20 bp, Artificial Sequence
  chemically synthesized
atatcagagtctcttaaagg

SEQ ID NO: 155767 - DNA, 20 bp, Artificial Sequence
  chemically synthesized
actgcagcccctccctttaa

SEQ ID NO: 155768 - DNA, 20 bp, Artificial Sequence
  chemically synthesized
tatcagagtctcttaaaggg

SEQ ID NO: 155769 - DNA, 20 bp, Artificial Sequence
  chemically synthesized
atcagagtctcttaaaggga

SEQ ID NO: 155770 - DNA, 20 bp, Artificial Sequence
  chemically synthesized
ccactgcagcccctcccttt

SEQ ID NO: 155771 - DNA, 20 bp, Artificial Sequence
  chemically synthesized
tcagagtctcttaaagggag

SEQ ID NO: 155772 - DNA, 20 bp, Artificial Sequence
  chemically synthesized
tctcttaaagggaggggctg

SEQ ID NO: 155773 - DNA, 20 bp, Artificial Sequence
  chemically synthesized
cttaaagggaggggctgcag

SEQ ID NO: 155774 - DNA, 20 bp, Artificial Sequence
  chemically synthesized
gcatattcccgtgtccactg

SEQ ID NO: 155775 - DNA, 20 bp, Artificial Sequence
  chemically synthesized
gggaggggctgcagtggaca

SEQ ID NO: 155776 - DNA, 20 bp, Artificial Sequence
  chemically synthesized
ggaggggctgcagtggacac

SEQ ID NO: 155777 - DNA, 20 bp, Artificial Sequence
  chemically synthesized
ggacacgggaatatgctact

SEQ ID NO: 155778 - DNA, 20 bp, Artificial Sequence
  chemically synthesized
acacgggaatatgctactca

SEQ ID NO: 155779 - DNA, 20 bp, Artificial Sequence
  chemically synthesized
tctttgaagggggctctgag

SEQ ID NO: 155780 - DNA, 20 bp, Artificial Sequence
  chemically synthesized
ctttctttgaagggggctct

SEQ ID NO: 155781 - DNA, 20 bp, Artificial Sequence
  chemically synthesized
gctactcagagcccccttca

SEQ ID NO: 155782 - DNA, 20 bp, Artificial Sequence
  chemically synthesized
caagagtctttctttgaagg

SEQ ID NO: 155783 - DNA, 20 bp, Artificial Sequence
  chemically synthesized
acaagagtctttctttgaag

SEQ ID NO: 155784 - DNA, 20 bp, Artificial Sequence
  chemically synthesized
aacaagagtctttctttgaa

SEQ ID NO: 155785 - DNA, 20 bp, Artificial Sequence
  chemically synthesized
ctcagagcccccttcaaaga

SEQ ID NO: 155786 - DNA, 20 bp, Artificial Sequence
  chemically synthesized
gaacaagagtctttctttga

SEQ ID NO: 155787 - DNA, 20 bp, Artificial Sequence
  chemically synthesized
agaacaagagtctttctttg

SEQ ID NO: 155788 - DNA, 20 bp, Artificial Sequence
  chemically synthesized
tcaaagaaagactcttgttc

SEQ ID NO: 155789 - DNA, 20 bp, Artificial Sequence
  chemically synthesized
atttccatcatctagaacaa

SEQ ID NO: 155790 - DNA, 20 bp, Artificial Sequence
  chemically synthesized
tcatttccatcatctagaac

SEQ ID NO: 155791 - DNA, 20 bp, Artificial Sequence
  chemically synthesized
aagactcttgttctagatga

SEQ ID NO: 155792 - DNA, 20 bp, Artificial Sequence
  chemically synthesized
ctgacatcatttccatcatc

SEQ ID NO: 155793 - DNA, 20 bp, Artificial Sequence
  chemically synthesized
ctagatgatggaaatgatgt

SEQ ID NO: 155794 - DNA, 20 bp, Artificial Sequence
  chemically synthesized
gatgatggaaatgatgtcag

SEQ ID NO: 155795 - DNA, 20 bp, Artificial Sequence
  chemically synthesized
agtagacattcttcaactgt

SEQ ID NO: 155796 - DNA, 20 bp, Artificial Sequence
  chemically synthesized
cctgaagggactgacagttg

SEQ ID NO: 155797 - DNA, 20 bp, Artificial Sequence
  chemically synthesized
gcagtccctgaagggactga

SEQ ID NO: 155798 - DNA, 20 bp, Artificial Sequence
  chemically synthesized
tcttcaactgtcagtccctt

SEQ ID NO: 155799 - DNA, 20 bp, Artificial Sequence
  chemically synthesized
cttcaactgtcagtcccttc

SEQ ID NO: 155800 - DNA, 20 bp, Artificial Sequence
  chemically synthesized
ttcaactgtcagtcccttca

SEQ ID NO: 155801 - DNA, 20 bp, Artificial Sequence
  chemically synthesized
cagctcaggcagtccctgaa

SEQ ID NO: 155802 - DNA, 20 bp, Artificial Sequence
  chemically synthesized
gcagctcaggcagtccctga

SEQ ID NO: 155803 - DNA, 20 bp, Artificial Sequence
  chemically synthesized
tgcagctcaggcagtccctg

SEQ ID NO: 155804 - DNA, 20 bp, Artificial Sequence
  chemically synthesized
agtcccttcagggactgcct

SEQ ID NO: 155805 - DNA, 20 bp, Artificial Sequence
  chemically synthesized
gcagctctctgcagctcagg

SEQ ID NO: 155806 - DNA, 20 bp, Artificial Sequence
  chemically synthesized
ttcagggactgcctgagctg

SEQ ID NO: 155807 - DNA, 20 bp, Artificial Sequence
  chemically synthesized
aaggcagctctctgcagctc

SEQ ID NO: 155808 - DNA, 20 bp, Artificial Sequence
  chemically synthesized
cagggactgcctgagctgca

SEQ ID NO: 155809 - DNA, 20 bp, Artificial Sequence
  chemically synthesized
caaggcagctctctgcagct

SEQ ID NO: 155810 - DNA, 20 bp, Artificial Sequence
  chemically synthesized
gggactgcctgagctgcaga

SEQ ID NO: 155811 - DNA, 20 bp, Artificial Sequence
  chemically synthesized
ttggacaaggcagctctctg

SEQ ID NO: 155812 - DNA, 20 bp, Artificial Sequence
  chemically synthesized
aggcatgaacttggacaagg

SEQ ID NO: 155813 - DNA, 20 bp, Artificial Sequence
  chemically synthesized
tgcagagagctgccttgtcc

SEQ ID NO: 155814 - DNA, 20 bp, Artificial Sequence
  chemically synthesized
gaaaggcatgaacttggaca

SEQ ID NO: 155815 - DNA, 20 bp, Artificial Sequence
  chemically synthesized
ggaaaggcatgaacttggac

SEQ ID NO: 155816 - DNA, 20 bp, Artificial Sequence
  chemically synthesized
cctggggaaaggcatgaact

SEQ ID NO: 155817 - DNA, 20 bp, Artificial Sequence
  chemically synthesized
tccaagttcatgcctttccc

SEQ ID NO: 155818 - DNA, 20 bp, Artificial Sequence
  chemically synthesized
ccaagttcatgcctttcccc

SEQ ID NO: 155819 - DNA, 20 bp, Artificial Sequence
  chemically synthesized
aatgagggctgcctggggaa

SEQ ID NO: 155820 - DNA, 20 bp, Artificial Sequence
  chemically synthesized
gaatgagggctgcctgggga

SEQ ID NO: 155821 - DNA, 20 bp, Artificial Sequence
  chemically synthesized
agttcatgcctttccccagg

SEQ ID NO: 155822 - DNA, 20 bp, Artificial Sequence
  chemically synthesized
cactgaatgagggctgcctg

SEQ ID NO: 155823 - DNA, 20 bp, Artificial Sequence
  chemically synthesized
tcactgaatgagggctgcct

SEQ ID NO: 155824 - DNA, 20 bp, Artificial Sequence
  chemically synthesized
gtcactgaatgagggctgcc

SEQ ID NO: 155825 - DNA, 20 bp, Artificial Sequence
  chemically synthesized
ttccccaggcagccctcatt

SEQ ID NO: 155826 - DNA, 20 bp, Artificial Sequence
  chemically synthesized
cttcatcagtcactgaatga

SEQ ID NO: 155827 - DNA, 20 bp, Artificial Sequence
  chemically synthesized
ccttcatcagtcactgaatg

SEQ ID NO: 155828 - DNA, 20 bp, Artificial Sequence
  chemically synthesized
accttcatcagtcactgaat

SEQ ID NO: 155829 - DNA, 20 bp, Artificial Sequence
  chemically synthesized
ccctcattcagtgactgatg

SEQ ID NO: 155830 - DNA, 20 bp, Artificial Sequence
  chemically synthesized
cctcattcagtgactgatga

SEQ ID NO: 155831 - DNA, 20 bp, Artificial Sequence
  chemically synthesized
ctctatactttcaccttcat

SEQ ID NO: 155832 - DNA, 20 bp, Artificial Sequence
  chemically synthesized
tcagtgactgatgaaggtga

SEQ ID NO: 155833 - DNA, 20 bp, Artificial Sequence
  chemically synthesized
gactgatgaaggtgaaagta

SEQ ID NO: 155834 - DNA, 20 bp, Artificial Sequence
  chemically synthesized
ctgatgaaggtgaaagtata

SEQ ID NO: 155835 - DNA, 20 bp, Artificial Sequence
  chemically synthesized
tgatgaaggtgaaagtatag

SEQ ID NO: 155836 - DNA, 20 bp, Artificial Sequence
  chemically synthesized
gaaagtatagaggcctaatt

SEQ ID NO: 155837 - DNA, 20 bp, Artificial Sequence
  chemically synthesized
gtcctgctttgagccaaatt

SEQ ID NO: 155838 - DNA, 20 bp, Artificial Sequence
  chemically synthesized
tgtcctgctttgagccaaat

SEQ ID NO: 155839 - DNA, 20 bp, Artificial Sequence
  chemically synthesized
tagaggcctaatttggctca

SEQ ID NO: 155840 - DNA, 20 bp, Artificial Sequence
  chemically synthesized
aggcctaatttggctcaaag

SEQ ID NO: 155841 - DNA, 20 bp, Artificial Sequence
  chemically synthesized
ggcctaatttggctcaaagc

SEQ ID NO: 155842 - DNA, 20 bp, Artificial Sequence
  chemically synthesized
cttcaaacttgtcctgcttt

SEQ ID NO: 155843 - DNA, 20 bp, Artificial Sequence
  chemically synthesized
aatttggctcaaagcaggac

SEQ ID NO: 155844 - DNA, 20 bp, Artificial Sequence
  chemically synthesized
ctcaaagcaggacaagtttg

SEQ ID NO: 155845 - DNA, 20 bp, Artificial Sequence
  chemically synthesized
tcaaagcaggacaagtttga

SEQ ID NO: 155846 - DNA, 20 bp, Artificial Sequence
  chemically synthesized
caaagcaggacaagtttgaa

SEQ ID NO: 155847 - DNA, 20 bp, Artificial Sequence
  chemically synthesized
acaagtttgaagggctactt

SEQ ID NO: 155848 - DNA, 20 bp, Artificial Sequence
  chemically synthesized
ggggagctctgcagctgaag

SEQ ID NO: 155849 - DNA, 20 bp, Artificial Sequence
  chemically synthesized
ttgaagggctacttcagctg

SEQ ID NO: 155850 - DNA, 20 bp, Artificial Sequence
  chemically synthesized
cacggggagctctgcagctg

SEQ ID NO: 155851 - DNA, 20 bp, Artificial Sequence
  chemically synthesized
gaagggctacttcagctgca

SEQ ID NO: 155852 - DNA, 20 bp, Artificial Sequence
  chemically synthesized
ttatgccacggggagctctg

SEQ ID NO: 155853 - DNA, 20 bp, Artificial Sequence
  chemically synthesized
ttcagctgcagagctccccg

SEQ ID NO: 155854 - DNA, 20 bp, Artificial Sequence
  chemically synthesized
ggcttgccttatgccacggg

SEQ ID NO: 155855 - DNA, 20 bp, Artificial Sequence
  chemically synthesized
caggcttgccttatgccacg

SEQ ID NO: 155856 - DNA, 20 bp, Artificial Sequence
  chemically synthesized
tgcagagctccccgtggcat

SEQ ID NO: 155857 - DNA, 20 bp, Artificial Sequence
  chemically synthesized
acaggcttgccttatgccac

SEQ ID NO: 155858 - DNA, 20 bp, Artificial Sequence
  chemically synthesized
gcagagctccccgtggcata

SEQ ID NO: 155859 - DNA, 20 bp, Artificial Sequence
  chemically synthesized
tacaggcttgccttatgcca

SEQ ID NO: 155860 - DNA, 20 bp, Artificial Sequence
  chemically synthesized
agctccccgtggcataaggc

SEQ ID NO: 155861 - DNA, 20 bp, Artificial Sequence
  chemically synthesized
gcataaggcaagcctgtata

SEQ ID NO: 155862 - DNA, 20 bp, Artificial Sequence
  chemically synthesized
gcacaccactggccatatac

SEQ ID NO: 155863 - DNA, 20 bp, Artificial Sequence
  chemically synthesized
agcacaccactggccatata

SEQ ID NO: 155864 - DNA, 20 bp, Artificial Sequence
  chemically synthesized
aaggcaagcctgtatatggc

SEQ ID NO: 155865 - DNA, 20 bp, Artificial Sequence
  chemically synthesized
gcaagcctgtatatggccag

SEQ ID NO: 155866 - DNA, 20 bp, Artificial Sequence
  chemically synthesized
tacatctaccagcacaccac

SEQ ID NO: 155867 - DNA, 20 bp, Artificial Sequence
  chemically synthesized
gtatatggccagtggtgtgc

SEQ ID NO: 155868 - DNA, 20 bp, Artificial Sequence
  chemically synthesized
tatggccagtggtgtgctgg

SEQ ID NO: 155869 - DNA, 20 bp, Artificial Sequence
  chemically synthesized
tccagttgatatacatctac

SEQ ID NO: 155870 - DNA, 20 bp, Artificial Sequence
  chemically synthesized
gctggtagatgtatatcaac

SEQ ID NO: 155871 - DNA, 20 bp, Artificial Sequence
  chemically synthesized
acaccctgagatcagagatc

SEQ ID NO: 155872 - DNA, 20 bp, Artificial Sequence
  chemically synthesized
atcaactggatctctgatct

SEQ ID NO: 155873 - DNA, 20 bp, Artificial Sequence
  chemically synthesized
tcaactggatctctgatctc

SEQ ID NO: 155874 - DNA, 20 bp, Artificial Sequence
  chemically synthesized
ttttaaacaccctgagatca

SEQ ID NO: 155875 - DNA, 20 bp, Artificial Sequence
  chemically synthesized
caactggatctctgatctca

SEQ ID NO: 155876 - DNA, 20 bp, Artificial Sequence
  chemically synthesized
gtttttaaacaccctgagat

SEQ ID NO: 155877 - DNA, 20 bp, Artificial Sequence
  chemically synthesized
aaggtgtttttaaacaccct

SEQ ID NO: 155878 - DNA, 20 bp, Artificial Sequence
  chemically synthesized
gtttaaaaacaccttgtttt

SEQ ID NO: 155879 - DNA, 20 bp, Artificial Sequence
  chemically synthesized
attggcaaacactaaaaaca

SEQ ID NO: 155880 - DNA, 20 bp, Artificial Sequence
  chemically synthesized
aattggcaaacactaaaaac

SEQ ID NO: 155881 - DNA, 20 bp, Artificial Sequence
  chemically synthesized
ttagtgtttgccaatttctg

SEQ ID NO: 155882 - DNA, 20 bp, Artificial Sequence
  chemically synthesized
aatatttacaccacagaaat

SEQ ID NO: 155883 - DNA, 20 bp, Artificial Sequence
  chemically synthesized
tggtaggaatatttacacca

SEQ ID NO: 155884 - DNA, 20 bp, Artificial Sequence
  chemically synthesized
tggtgtaaatattcctacca

SEQ ID NO: 155885 - DNA, 20 bp, Artificial Sequence
  chemically synthesized
aatttaaatttaaccgtggt

SEQ ID NO: 155886 - DNA, 20 bp, Artificial Sequence
  chemically synthesized
taatttaaatttaaccgtgg

SEQ ID NO: 155887 - DNA, 20 bp, Artificial Sequence
  chemically synthesized
tggtaatttaaatttaaccg

SEQ ID NO: 155888 - DNA, 20 bp, Artificial Sequence
  chemically synthesized
acggttaaatttaaattacc

SEQ ID NO: 155889 - DNA, 20 bp, Artificial Sequence
  chemically synthesized
gttaaatttaaattaccaag

SEQ ID NO: 155890 - DNA, 20 bp, Artificial Sequence
  chemically synthesized
gccacttgatgttatcttct

SEQ ID NO: 155891 - DNA, 20 bp, Artificial Sequence
  chemically synthesized
attaccaagaagataacatc

SEQ ID NO: 155892 - DNA, 20 bp, Artificial Sequence
  chemically synthesized
accaagaagataacatcaag

SEQ ID NO: 155893 - DNA, 20 bp, Artificial Sequence
  chemically synthesized
tatattgccaggcatttttt

SEQ ID NO: 155894 - DNA, 20 bp, Artificial Sequence
  chemically synthesized
caagtggctcaaaaaatgcc

SEQ ID NO: 155895 - DNA, 20 bp, Artificial Sequence
  chemically synthesized
cggcctactgttatattgcc

SEQ ID NO: 155896 - DNA, 20 bp, Artificial Sequence
  chemically synthesized
acggcctactgttatattgc

SEQ ID NO: 155897 - DNA, 20 bp, Artificial Sequence
  chemically synthesized
aaaaatgcctggcaatataa

SEQ ID NO: 155898 - DNA, 20 bp, Artificial Sequence
  chemically synthesized
aatgcctggcaatataacag

SEQ ID NO: 155899 - DNA, 20 bp, Artificial Sequence
  chemically synthesized
atgcctggcaatataacagt

SEQ ID NO: 155900 - DNA, 20 bp, Artificial Sequence
  chemically synthesized
atataacagtaggccgtcct

SEQ ID NO: 155901 - DNA, 20 bp, Artificial Sequence
  chemically synthesized
gaagtggaaccagctcagga

SEQ ID NO: 155902 - DNA, 20 bp, Artificial Sequence
  chemically synthesized
aacagtaggccgtcctgagc

SEQ ID NO: 155903 - DNA, 20 bp, Artificial Sequence
  chemically synthesized
cagtgaagtggaaccagctc

SEQ ID NO: 155904 - DNA, 20 bp, Artificial Sequence
  chemically synthesized
ccagtgaagtggaaccagct

SEQ ID NO: 155905 - DNA, 20 bp, Artificial Sequence
  chemically synthesized
gctgcccagtgaagtggaac

SEQ ID NO: 155906 - DNA, 20 bp, Artificial Sequence
  chemically synthesized
ctgagctggttccacttcac

SEQ ID NO: 155907 - DNA, 20 bp, Artificial Sequence
  chemically synthesized
tgagctggttccacttcact

SEQ ID NO: 155908 - DNA, 20 bp, Artificial Sequence
  chemically synthesized
tagctagctgcccagtgaag

SEQ ID NO: 155909 - DNA, 20 bp, Artificial Sequence
  chemically synthesized
gctggttccacttcactggg

SEQ ID NO: 155910 - DNA, 20 bp, Artificial Sequence
  chemically synthesized
gtatagctagctgcccagtg

SEQ ID NO: 155911 - DNA, 20 bp, Artificial Sequence
  chemically synthesized
gttccacttcactgggcagc

SEQ ID NO: 155912 - DNA, 20 bp, Artificial Sequence
  chemically synthesized
ttatcgtatagctagctgcc

SEQ ID NO: 155913 - DNA, 20 bp, Artificial Sequence
  chemically synthesized
gctataaattatcgtatagc

SEQ ID NO: 155914 - DNA, 20 bp, Artificial Sequence
  chemically synthesized
gctggctataaattatcgta

SEQ ID NO: 155915 - DNA, 20 bp, Artificial Sequence
  chemically synthesized
gctagctatacgataattta

SEQ ID NO: 155916 - DNA, 20 bp, Artificial Sequence
  chemically synthesized
gctatacgataatttatagc

SEQ ID NO: 155917 - DNA, 20 bp, Artificial Sequence
  chemically synthesized
atacgataatttatagccag

SEQ ID NO: 155918 - DNA, 20 bp, Artificial Sequence
  chemically synthesized
cacttctgctcacattctgc

SEQ ID NO: 155919 - DNA, 20 bp, Artificial Sequence
  chemically synthesized
atttatagccagcagaatgt

SEQ ID NO: 155920 - DNA, 20 bp, Artificial Sequence
  chemically synthesized
tatagccagcagaatgtgag

SEQ ID NO: 155921 - DNA, 20 bp, Artificial Sequence
  chemically synthesized
agccagcagaatgtgagcag

SEQ ID NO: 155922 - DNA, 20 bp, Artificial Sequence
  chemically synthesized
tgagcagaagtgttgtttgt

SEQ ID NO: 155923 - DNA, 20 bp, Artificial Sequence
  chemically synthesized
agaagtgttgtttgtcagtt

SEQ ID NO: 155924 - DNA, 20 bp, Artificial Sequence
  chemically synthesized
gaagtgttgtttgtcagttt

SEQ ID NO: 155925 - DNA, 20 bp, Artificial Sequence
  chemically synthesized
aagtgttgtttgtcagtttg

SEQ ID NO: 155926 - DNA, 20 bp, Artificial Sequence
  chemically synthesized
ttgtttgtcagtttggggct

SEQ ID NO: 155927 - DNA, 20 bp, Artificial Sequence
  chemically synthesized
tgtttgtcagtttggggctg

SEQ ID NO: 155928 - DNA, 20 bp, Artificial Sequence
  chemically synthesized
cactaaatttttcaaagcct

SEQ ID NO: 155929 - DNA, 20 bp, Artificial Sequence
  chemically synthesized
aaacctcactaaatttttca

SEQ ID NO: 155930 - DNA, 20 bp, Artificial Sequence
  chemically synthesized
ggctgaggctttgaaaaatt

SEQ ID NO: 155931 - DNA, 20 bp, Artificial Sequence
  chemically synthesized
gaggctttgaaaaatttagt

SEQ ID NO: 155932 - DNA, 20 bp, Artificial Sequence
  chemically synthesized
aggctttgaaaaatttagtg

SEQ ID NO: 155933 - DNA, 20 bp, Artificial Sequence
  chemically synthesized
aatagaaaggaaaaaaaatg

SEQ ID NO: 155934 - DNA, 20 bp, Artificial Sequence
  chemically synthesized
ttctgcttccagcaatagaa

SEQ ID NO: 155935 - DNA, 20 bp, Artificial Sequence
  chemically synthesized
cttctgcttccagcaataga

SEQ ID NO: 155936 - DNA, 20 bp, Artificial Sequence
  chemically synthesized
ttttttttcctttctattgc

SEQ ID NO: 155937 - DNA, 20 bp, Artificial Sequence
  chemically synthesized
tttttcctttctattgctgg

SEQ ID NO: 155938 - DNA, 20 bp, Artificial Sequence
  chemically synthesized
gagtcttctgcttccagcaa

SEQ ID NO: 155939 - DNA, 20 bp, Artificial Sequence
  chemically synthesized
ttcctttctattgctggaag

SEQ ID NO: 155940 - DNA, 20 bp, Artificial Sequence
  chemically synthesized
ctttctattgctggaagcag

SEQ ID NO: 155941 - DNA, 20 bp, Artificial Sequence
  chemically synthesized
acctaagagtcttctgcttc

SEQ ID NO: 155942 - DNA, 20 bp, Artificial Sequence
  chemically synthesized
tgctggaagcagaagactct

SEQ ID NO: 155943 - DNA, 20 bp, Artificial Sequence
  chemically synthesized
gctggaagcagaagactctt

SEQ ID NO: 155944 - DNA, 20 bp, Artificial Sequence
  chemically synthesized
agatttgccgtaggacctaa

SEQ ID NO: 155945 - DNA, 20 bp, Artificial Sequence
  chemically synthesized
aaagatttgccgtaggacct

SEQ ID NO: 155946 - DNA, 20 bp, Artificial Sequence
  chemically synthesized
cagaagactcttaggtccta

SEQ ID NO: 155947 - DNA, 20 bp, Artificial Sequence
  chemically synthesized
aagttgtaaagatttgccgt

SEQ ID NO: 155948 - DNA, 20 bp, Artificial Sequence
  chemically synthesized
taagttgtaaagatttgccg

SEQ ID NO: 155949 - DNA, 20 bp, Artificial Sequence
  chemically synthesized
tctctcctcagtaagttgta

SEQ ID NO: 155950 - DNA, 20 bp, Artificial Sequence
  chemically synthesized
gcaaatctttacaacttact

SEQ ID NO: 155951 - DNA, 20 bp, Artificial Sequence
  chemically synthesized
caaatctttacaacttactg

SEQ ID NO: 155952 - DNA, 20 bp, Artificial Sequence
  chemically synthesized
aatctttacaacttactgag

SEQ ID NO: 155953 - DNA, 20 bp, Artificial Sequence
  chemically synthesized
gacttaattctctcctcagt

SEQ ID NO: 155954 - DNA, 20 bp, Artificial Sequence
  chemically synthesized
tctttacaacttactgagga

SEQ ID NO: 155955 - DNA, 20 bp, Artificial Sequence
  chemically synthesized
ttaggacttaattctctcct

SEQ ID NO: 155956 - DNA, 20 bp, Artificial Sequence
  chemically synthesized
aacttactgaggagagaatt

SEQ ID NO: 155957 - DNA, 20 bp, Artificial Sequence
  chemically synthesized
agaattaagtcctaacgccc

SEQ ID NO: 155958 - DNA, 20 bp, Artificial Sequence
  chemically synthesized
aacaactgccctagggcgtt

SEQ ID NO: 155959 - DNA, 20 bp, Artificial Sequence
  chemically synthesized
gaattaagtcctaacgccct

SEQ ID NO: 155960 - DNA, 20 bp, Artificial Sequence
  chemically synthesized
gaacaactgccctagggcgt

SEQ ID NO: 155961 - DNA, 20 bp, Artificial Sequence
  chemically synthesized
aattaagtcctaacgcccta

SEQ ID NO: 155962 - DNA, 20 bp, Artificial Sequence
  chemically synthesized
taagtcctaacgccctaggg

SEQ ID NO: 155963 - DNA, 20 bp, Artificial Sequence
  chemically synthesized
gtatgagaacaactgcccta

SEQ ID NO: 155964 - DNA, 20 bp, Artificial Sequence
  chemically synthesized
agtatgagaacaactgccct

SEQ ID NO: 155965 - DNA, 20 bp, Artificial Sequence
  chemically synthesized
aagtatgagaacaactgccc

SEQ ID NO: 155966 - DNA, 20 bp, Artificial Sequence
  chemically synthesized
gggcagttgttctcatactt

SEQ ID NO: 155967 - DNA, 20 bp, Artificial Sequence
  chemically synthesized
ggcagttgttctcatacttt

SEQ ID NO: 155968 - DNA, 20 bp, Artificial Sequence
  chemically synthesized
ttctgttgatcctaaagtat

SEQ ID NO: 155969 - DNA, 20 bp, Artificial Sequence
  chemically synthesized
aggtgattctgttgatccta

SEQ ID NO: 155970 - DNA, 20 bp, Artificial Sequence
  chemically synthesized
ttctcatactttaggatcaa

SEQ ID NO: 155971 - DNA, 20 bp, Artificial Sequence
  chemically synthesized
ttaggatcaacagaatcacc

SEQ ID NO: 155972 - DNA, 20 bp, Artificial Sequence
  chemically synthesized
aggatcaacagaatcacctg

SEQ ID NO: 155973 - DNA, 20 bp, Artificial Sequence
  chemically synthesized
cagcaattagcaaggtctcc

SEQ ID NO: 155974 - DNA, 20 bp, Artificial Sequence
  chemically synthesized
gcagcaattagcaaggtctc

SEQ ID NO: 155975 - DNA, 20 bp, Artificial Sequence
  chemically synthesized
ctaccatgcagcaattagca

SEQ ID NO: 155976 - DNA, 20 bp, Artificial Sequence
  chemically synthesized
gctaccatgcagcaattagc

SEQ ID NO: 155977 - DNA, 20 bp, Artificial Sequence
  chemically synthesized
cggggctaccatgcagcaat

SEQ ID NO: 155978 - DNA, 20 bp, Artificial Sequence
  chemically synthesized
agaccttgctaattgctgca

SEQ ID NO: 155979 - DNA, 20 bp, Artificial Sequence
  chemically synthesized
ccttgctaattgctgcatgg

SEQ ID NO: 155980 - DNA, 20 bp, Artificial Sequence
  chemically synthesized
agaactccggggctaccatg

SEQ ID NO: 155981 - DNA, 20 bp, Artificial Sequence
  chemically synthesized
taattgctgcatggtagccc

SEQ ID NO: 155982 - DNA, 20 bp, Artificial Sequence
  chemically synthesized
attgctgcatggtagccccg

SEQ ID NO: 155983 - DNA, 20 bp, Artificial Sequence
  chemically synthesized
ctactaaatccagaactccg

SEQ ID NO: 155984 - DNA, 20 bp, Artificial Sequence
  chemically synthesized
gcatggtagccccggagttc

SEQ ID NO: 155985 - DNA, 20 bp, Artificial Sequence
  chemically synthesized
tctactaaatccagaactcc

SEQ ID NO: 155986 - DNA, 20 bp, Artificial Sequence
  chemically synthesized
atctactaaatccagaactc

SEQ ID NO: 155987 - DNA, 20 bp, Artificial Sequence
  chemically synthesized
tagccccggagttctggatt

SEQ ID NO: 155988 - DNA, 20 bp, Artificial Sequence
  chemically synthesized
ccccggagttctggatttag

SEQ ID NO: 155989 - DNA, 20 bp, Artificial Sequence
  chemically synthesized
cacccagtatctactaaatc

SEQ ID NO: 155990 - DNA, 20 bp, Artificial Sequence
  chemically synthesized
gttctggatttagtagatac

SEQ ID NO: 155991 - DNA, 20 bp, Artificial Sequence
  chemically synthesized
ttctggatttagtagatact

SEQ ID NO: 155992 - DNA, 20 bp, Artificial Sequence
  chemically synthesized
tggatttagtagatactggg

SEQ ID NO: 155993 - DNA, 20 bp, Artificial Sequence
  chemically synthesized
gatttagtagatactgggtg

SEQ ID NO: 155994 - DNA, 20 bp, Artificial Sequence
  chemically synthesized
gcaaattattgggctccacc

SEQ ID NO: 155995 - DNA, 20 bp, Artificial Sequence
  chemically synthesized
tgttaaaaatgcaaattatt

SEQ ID NO: 155996 - DNA, 20 bp, Artificial Sequence
  chemically synthesized
ttgttaaaaatgcaaattat

SEQ ID NO: 155997 - DNA, 20 bp, Artificial Sequence
  chemically synthesized
ttgcatttttaacaattttc

SEQ ID NO: 155998 - DNA, 20 bp, Artificial Sequence
  chemically synthesized
tgcatttttaacaattttcc

SEQ ID NO: 155999 - DNA, 20 bp, Artificial Sequence
  chemically synthesized
atttttaacaattttccagg

SEQ ID NO: 156000 - DNA, 20 bp, Artificial Sequence
  chemically synthesized
caatcagcatcaacaccacc

SEQ ID NO: 156001 - DNA, 20 bp, Artificial Sequence
  chemically synthesized
aggattttgtcatgaacaat

SEQ ID NO: 156002 - DNA, 20 bp, Artificial Sequence
  chemically synthesized
attgttcatgacaaaatcct

SEQ ID NO: 156003 - DNA, 20 bp, Artificial Sequence
  chemically synthesized
ttaggtgtaatagatatctt

SEQ ID NO: 156004 - DNA, 20 bp, Artificial Sequence
  chemically synthesized
attaggtgtaatagatatct

SEQ ID NO: 156005 - DNA, 20 bp, Artificial Sequence
  chemically synthesized
aggtaactgattaggtgtaa

SEQ ID NO: 156006 - DNA, 20 bp, Artificial Sequence
  chemically synthesized
agatatctattacacctaat

SEQ ID NO: 156007 - DNA, 20 bp, Artificial Sequence
  chemically synthesized
aaatgctcaggtaactgatt

SEQ ID NO: 156008 - DNA, 20 bp, Artificial Sequence
  chemically synthesized
taaatgctcaggtaactgat

SEQ ID NO: 156009 - DNA, 20 bp, Artificial Sequence
  chemically synthesized
ttacacctaatcagttacct

SEQ ID NO: 156010 - DNA, 20 bp, Artificial Sequence
  chemically synthesized
ctagtctatgataaatgctc

SEQ ID NO: 156011 - DNA, 20 bp, Artificial Sequence
  chemically synthesized
tctagtctatgataaatgct

SEQ ID NO: 156012 - DNA, 20 bp, Artificial Sequence
  chemically synthesized
agttacctgagcatttatca

SEQ ID NO: 156013 - DNA, 20 bp, Artificial Sequence
  chemically synthesized
cctgagcatttatcatagac

SEQ ID NO: 156014 - DNA, 20 bp, Artificial Sequence
  chemically synthesized
tctcaagaatggtacatatc

SEQ ID NO: 156015 - DNA, 20 bp, Artificial Sequence
  chemically synthesized
actagatatgtaccattctt

SEQ ID NO: 156016 - DNA, 20 bp, Artificial Sequence
  chemically synthesized
gtctattatgttctcaagaa

SEQ ID NO: 156017 - DNA, 20 bp, Artificial Sequence
  chemically synthesized
tgagggtctattatgttctc

SEQ ID NO: 156018 - DNA, 20 bp, Artificial Sequence
  chemically synthesized
taccattcttgagaacataa

SEQ ID NO: 156019 - DNA, 20 bp, Artificial Sequence
  chemically synthesized
ttgagaacataatagaccct

SEQ ID NO: 156020 - DNA, 20 bp, Artificial Sequence
  chemically synthesized
tcctattgaaaatgatctga

SEQ ID NO: 156021 - DNA, 20 bp, Artificial Sequence
  chemically synthesized
atcctattgaaaatgatctg

SEQ ID NO: 156022 - DNA, 20 bp, Artificial Sequence
  chemically synthesized
aatcctattgaaaatgatct

SEQ ID NO: 156023 - DNA, 20 bp, Artificial Sequence
  chemically synthesized
gaccctcagatcattttcaa

SEQ ID NO: 156024 - DNA, 20 bp, Artificial Sequence
  chemically synthesized
accctcagatcattttcaat

SEQ ID NO: 156025 - DNA, 20 bp, Artificial Sequence
  chemically synthesized
ctctgctcgggtttcgcaag

SEQ ID NO: 156026 - DNA, 20 bp, Artificial Sequence
  chemically synthesized
tctctgctcgggtttcgcaa

SEQ ID NO: 156027 - DNA, 20 bp, Artificial Sequence
  chemically synthesized
tttctctgctcgggtttcgc

SEQ ID NO: 156028 - DNA, 20 bp, Artificial Sequence
  chemically synthesized
ttcatcctcttgcgaaaccc

SEQ ID NO: 156029 - DNA, 20 bp, Artificial Sequence
  chemically synthesized
atcctcttgcgaaacccgag

SEQ ID NO: 156030 - DNA, 20 bp, Artificial Sequence
  chemically synthesized
cctcttgcgaaacccgagca

SEQ ID NO: 156031 - DNA, 20 bp, Artificial Sequence
  chemically synthesized
ttggtagcttttctctgctc

SEQ ID NO: 156032 - DNA, 20 bp, Artificial Sequence
  chemically synthesized
cttggtagcttttctctgct

SEQ ID NO: 156033 - DNA, 20 bp, Artificial Sequence
  chemically synthesized
tgcgaaacccgagcagagaa

SEQ ID NO: 156034 - DNA, 20 bp, Artificial Sequence
  chemically synthesized
ccgagcagagaaaagctacc

SEQ ID NO: 156035 - DNA, 20 bp, Artificial Sequence
  chemically synthesized
cgagcagagaaaagctacca

SEQ ID NO: 156036 - DNA, 20 bp, Artificial Sequence
  chemically synthesized
gagcagagaaaagctaccaa

SEQ ID NO: 156037 - DNA, 20 bp, Artificial Sequence
  chemically synthesized
tctgcctgccattcccttgg

SEQ ID NO: 156038 - DNA, 20 bp, Artificial Sequence
  chemically synthesized
gagaaaagctaccaagggaa

SEQ ID NO: 156039 - DNA, 20 bp, Artificial Sequence
  chemically synthesized
tcctctgcctgccattccct

SEQ ID NO: 156040 - DNA, 20 bp, Artificial Sequence
  chemically synthesized
aaaagctaccaagggaatgg

SEQ ID NO: 156041 - DNA, 20 bp, Artificial Sequence
  chemically synthesized
aaagctaccaagggaatggc

SEQ ID NO: 156042 - DNA, 20 bp, Artificial Sequence
  chemically synthesized
gctaccaagggaatggcagg

SEQ ID NO: 156043 - DNA, 20 bp, Artificial Sequence
  chemically synthesized
taccaagggaatggcaggca

SEQ ID NO: 156044 - DNA, 20 bp, Artificial Sequence
  chemically synthesized
accaagggaatggcaggcag

SEQ ID NO: 156045 - DNA, 20 bp, Artificial Sequence
  chemically synthesized
aagggaatggcaggcagagg

SEQ ID NO: 156046 - DNA, 20 bp, Artificial Sequence
  chemically synthesized
ggaatggcaggcagaggaag

SEQ ID NO: 156047 - DNA, 20 bp, Artificial Sequence
  chemically synthesized
aggcagaggaagaagatgaa

SEQ ID NO: 156048 - DNA, 20 bp, Artificial Sequence
  chemically synthesized
ggcagaggaagaagatgaac

SEQ ID NO: 156049 - DNA, 20 bp, Artificial Sequence
  chemically synthesized
ggaagaagatgaacaggacc

SEQ ID NO: 156050 - DNA, 20 bp, Artificial Sequence
  chemically synthesized
gaagaagatgaacaggacct

SEQ ID NO: 156051 - DNA, 20 bp, Artificial Sequence
  chemically synthesized
atatgttattgcagaaacct

SEQ ID NO: 156052 - DNA, 20 bp, Artificial Sequence
  chemically synthesized
catatgttattgcagaaacc

SEQ ID NO: 156053 - DNA, 20 bp, Artificial Sequence
  chemically synthesized
ctttcttacatatgttattg

SEQ ID NO: 156054 - DNA, 20 bp, Artificial Sequence
  chemically synthesized
gtttctgcaataacatatgt

SEQ ID NO: 156055 - DNA, 20 bp, Artificial Sequence
  chemically synthesized
ctgcaataacatatgtaaga

SEQ ID NO: 156056 - DNA, 20 bp, Artificial Sequence
  chemically synthesized
atgtaagaaagctgcttgac

SEQ ID NO: 156057 - DNA, 20 bp, Artificial Sequence
  chemically synthesized
tgtaagaaagctgcttgact

SEQ ID NO: 156058 - DNA, 20 bp, Artificial Sequence
  chemically synthesized
cgtatgttttcctagtcaag

SEQ ID NO: 156059 - DNA, 20 bp, Artificial Sequence
  chemically synthesized
cagcgtatgttttcctagtc

SEQ ID NO: 156060 - DNA, 20 bp, Artificial Sequence
  chemically synthesized
caacccagcgtatgttttcc

SEQ ID NO: 156061 - DNA, 20 bp, Artificial Sequence
  chemically synthesized
ttgactaggaaaacatacgc

SEQ ID NO: 156062 - DNA, 20 bp, Artificial Sequence
  chemically synthesized
tgactaggaaaacatacgct

SEQ ID NO: 156063 - DNA, 20 bp, Artificial Sequence
  chemically synthesized
ttcttgctcacatgacaacc

SEQ ID NO: 156064 - DNA, 20 bp, Artificial Sequence
  chemically synthesized
catacgctgggttgtcatgt

SEQ ID NO: 156065 - DNA, 20 bp, Artificial Sequence
  chemically synthesized
cgctgggttgtcatgtgagc

SEQ ID NO: 156066 - DNA, 20 bp, Artificial Sequence
  chemically synthesized
ggttgtcatgtgagcaagaa

SEQ ID NO: 156067 - DNA, 20 bp, Artificial Sequence
  chemically synthesized
tcagtggcttaacacaatag

SEQ ID NO: 156068 - DNA, 20 bp, Artificial Sequence
  chemically synthesized
tttcagtggcttaacacaat

SEQ ID NO: 156069 - DNA, 20 bp, Artificial Sequence
  chemically synthesized
aaaagaactcctattgtgtt

SEQ ID NO: 156070 - DNA, 20 bp, Artificial Sequence
  chemically synthesized
atttcagtggcttaacacaa

SEQ ID NO: 156071 - DNA, 20 bp, Artificial Sequence
  chemically synthesized
taatgaactaaatatttcag

SEQ ID NO: 156072 - DNA, 20 bp, Artificial Sequence
  chemically synthesized
tgttaagccactgaaatatt

SEQ ID NO: 156073 - DNA, 20 bp, Artificial Sequence
  chemically synthesized
ttgtaatgaactaaatattt

SEQ ID NO: 156074 - DNA, 20 bp, Artificial Sequence
  chemically synthesized
tgaaatatttagttcattac

SEQ ID NO: 156075 - DNA, 20 bp, Artificial Sequence
  chemically synthesized
aatatttagttcattacaag

SEQ ID NO: 156076 - DNA, 20 bp, Artificial Sequence
  chemically synthesized
tacaagcagcaataccttac

SEQ ID NO: 156077 - DNA, 20 bp, Artificial Sequence
  chemically synthesized
ctagtgctactatactggta

SEQ ID NO: 156078 - DNA, 20 bp, Artificial Sequence
  chemically synthesized
gcagcaataccttaccagta

SEQ ID NO: 156079 - DNA, 20 bp, Artificial Sequence
  chemically synthesized
actagtgctactatactggt

SEQ ID NO: 156080 - DNA, 20 bp, Artificial Sequence
  chemically synthesized
gcaataccttaccagtatag

SEQ ID NO: 156081 - DNA, 20 bp, Artificial Sequence
  chemically synthesized
tgtgactagtgctactatac

SEQ ID NO: 156082 - DNA, 20 bp, Artificial Sequence
  chemically synthesized
ccttaccagtatagtagcac

SEQ ID NO: 156083 - DNA, 20 bp, Artificial Sequence
  chemically synthesized
tatagtagcactagtcacaa

SEQ ID NO: 156084 - DNA, 20 bp, Artificial Sequence
  chemically synthesized
actggtaaagcttttgtgac

SEQ ID NO: 156085 - DNA, 20 bp, Artificial Sequence
  chemically synthesized
actagtcacaaaagctttac

SEQ ID NO: 156086 - DNA, 20 bp, Artificial Sequence
  chemically synthesized
atctcttataggcactggta

SEQ ID NO: 156087 - DNA, 20 bp, Artificial Sequence
  chemically synthesized
ctattatctcttataggcac

SEQ ID NO: 156088 - DNA, 20 bp, Artificial Sequence
  chemically synthesized
aaagctttaccagtgcctat

SEQ ID NO: 156089 - DNA, 20 bp, Artificial Sequence
  chemically synthesized
agctttaccagtgcctataa

SEQ ID NO: 156090 - DNA, 20 bp, Artificial Sequence
  chemically synthesized
acgcagctattatctcttat

SEQ ID NO: 156091 - DNA, 20 bp, Artificial Sequence
  chemically synthesized
aacgcagctattatctctta

SEQ ID NO: 156092 - DNA, 20 bp, Artificial Sequence
  chemically synthesized
ccagtgcctataagagataa

SEQ ID NO: 156093 - DNA, 20 bp, Artificial Sequence
  chemically synthesized
tttacagtgatacaaaaacg

SEQ ID NO: 156094 - DNA, 20 bp, Artificial Sequence
  chemically synthesized
aaggtaagcataggaattta

SEQ ID NO: 156095 - DNA, 20 bp, Artificial Sequence
  chemically synthesized
attcctcataaggtaagcat

SEQ ID NO: 156096 - DNA, 20 bp, Artificial Sequence
  chemically synthesized
tattcctcataaggtaagca

SEQ ID NO: 156097 - DNA, 20 bp, Artificial Sequence
  chemically synthesized
aattcctatgcttaccttat

SEQ ID NO: 156098 - DNA, 20 bp, Artificial Sequence
  chemically synthesized
atttgtattcctcataaggt

SEQ ID NO: 156099 - DNA, 20 bp, Artificial Sequence
  chemically synthesized
attcctatgcttaccttatg

SEQ ID NO: 156100 - DNA, 20 bp, Artificial Sequence
  chemically synthesized
agttatttgtattcctcata

SEQ ID NO: 156101 - DNA, 20 bp, Artificial Sequence
  chemically synthesized
aagttatttgtattcctcat

SEQ ID NO: 156102 - DNA, 20 bp, Artificial Sequence
  chemically synthesized
aaccaaacccgacatcaatc

SEQ ID NO: 156103 - DNA, 20 bp, Artificial Sequence
  chemically synthesized
acaaataacttgattgatgt

SEQ ID NO: 156104 - DNA, 20 bp, Artificial Sequence
  chemically synthesized
caaataacttgattgatgtc

SEQ ID NO: 156105 - DNA, 20 bp, Artificial Sequence
  chemically synthesized
aacttgattgatgtcgggtt

SEQ ID NO: 156106 - DNA, 20 bp, Artificial Sequence
  chemically synthesized
tttggttaaaataaatacat

SEQ ID NO: 156107 - DNA, 20 bp, Artificial Sequence
  chemically synthesized
ggttaaaataaatacattag

SEQ ID NO: 156108 - DNA, 20 bp, Artificial Sequence
  chemically synthesized
attagcagaaattgcatttc

SEQ ID NO: 156109 - DNA, 20 bp, Artificial Sequence
  chemically synthesized
gaaattgcatttctagtctg

SEQ ID NO: 156110 - DNA, 20 bp, Artificial Sequence
  chemically synthesized
ccaactctgattcttcagac

SEQ ID NO: 156111 - DNA, 20 bp, Artificial Sequence
  chemically synthesized
gcatttctagtctgaagaat

SEQ ID NO: 156112 - DNA, 20 bp, Artificial Sequence
  chemically synthesized
cttttccaactctgattctt

SEQ ID NO: 156113 - DNA, 20 bp, Artificial Sequence
  chemically synthesized
atttctagtctgaagaatca

SEQ ID NO: 156114 - DNA, 20 bp, Artificial Sequence
  chemically synthesized
ctagtctgaagaatcagagt

SEQ ID NO: 156115 - DNA, 20 bp, Artificial Sequence
  chemically synthesized
ctgaagaatcagagttggaa

SEQ ID NO: 156116 - DNA, 20 bp, Artificial Sequence
  chemically synthesized
gaagaatcagagttggaaaa

SEQ ID NO: 156117 - DNA, 20 bp, Artificial Sequence
  chemically synthesized
aatcagagttggaaaagagc

SEQ ID NO: 156118 - DNA, 20 bp, Artificial Sequence
  chemically synthesized
tttaaagagtttgtagtttc

SEQ ID NO: 156119 - DNA, 20 bp, Artificial Sequence
  chemically synthesized
attcctatttaaagagtttg

SEQ ID NO: 156120 - DNA, 20 bp, Artificial Sequence
  chemically synthesized
gaaactacaaactctttaaa

SEQ ID NO: 156121 - DNA, 20 bp, Artificial Sequence
  chemically synthesized
aaactacaaactctttaaat

SEQ ID NO: 156122 - DNA, 20 bp, Artificial Sequence
  chemically synthesized
tcattccattcctatttaaa

SEQ ID NO: 156123 - DNA, 20 bp, Artificial Sequence
  chemically synthesized
gttcattccattcctattta

SEQ ID NO: 156124 - DNA, 20 bp, Artificial Sequence
  chemically synthesized
acaaactctttaaataggaa

SEQ ID NO: 156125 - DNA, 20 bp, Artificial Sequence
  chemically synthesized
tgaaacattccagttaggtt

SEQ ID NO: 156126 - DNA, 20 bp, Artificial Sequence
  chemically synthesized
tggaatgaacccaacctaac

SEQ ID NO: 156127 - DNA, 20 bp, Artificial Sequence
  chemically synthesized
atgaaacattccagttaggt

SEQ ID NO: 156128 - DNA, 20 bp, Artificial Sequence
  chemically synthesized
gtatatgaaacattccagtt

SEQ ID NO: 156129 - DNA, 20 bp, Artificial Sequence
  chemically synthesized
tgtatatgaaacattccagt

SEQ ID NO: 156130 - DNA, 20 bp, Artificial Sequence
  chemically synthesized
aacgtgtatatgaaacattc

SEQ ID NO: 156131 - DNA, 20 bp, Artificial Sequence
  chemically synthesized
aatgtttcatatacacgttg

SEQ ID NO: 156132 - DNA, 20 bp, Artificial Sequence
  chemically synthesized
attcgcattaaattaatgat

SEQ ID NO: 156133 - DNA, 20 bp, Artificial Sequence
  chemically synthesized
ttctggaataaataaagtaa

SEQ ID NO: 156134 - DNA, 20 bp, Artificial Sequence
  chemically synthesized
ttatttttctggaataaata

SEQ ID NO: 156135 - DNA, 20 bp, Artificial Sequence
  chemically synthesized
aaccattactttatttattc

SEQ ID NO: 156136 - DNA, 20 bp, Artificial Sequence
  chemically synthesized
cacctgaacaattatttttc

SEQ ID NO: 156137 - DNA, 20 bp, Artificial Sequence
  chemically synthesized
attccagaaaaataattgtt

SEQ ID NO: 156138 - DNA, 20 bp, Artificial Sequence
  chemically synthesized
ttccagaaaaataattgttc

SEQ ID NO: 156139 - DNA, 20 bp, Artificial Sequence
  chemically synthesized
gcacaaagtctggcacagag

SEQ ID NO: 156140 - DNA, 20 bp, Artificial Sequence
  chemically synthesized
gttcaggtgctactctgtgc

SEQ ID NO: 156141 - DNA, 20 bp, Artificial Sequence
  chemically synthesized
ctggcacaaagtctggcaca

SEQ ID NO: 156142 - DNA, 20 bp, Artificial Sequence
  chemically synthesized
aactggcacaaagtctggca

SEQ ID NO: 156143 - DNA, 20 bp, Artificial Sequence
  chemically synthesized
ttagtaactggcacaaagtc

SEQ ID NO: 156144 - DNA, 20 bp, Artificial Sequence
  chemically synthesized
ctctgtgccagactttgtgc

SEQ ID NO: 156145 - DNA, 20 bp, Artificial Sequence
  chemically synthesized
taagcttagtaactggcaca

SEQ ID NO: 156146 - DNA, 20 bp, Artificial Sequence
  chemically synthesized
cagactttgtgccagttact

SEQ ID NO: 156147 - DNA, 20 bp, Artificial Sequence
  chemically synthesized
agttttgtaagcttagtaac

SEQ ID NO: 156148 - DNA, 20 bp, Artificial Sequence
  chemically synthesized
gaacttcagttttgtaagct

SEQ ID NO: 156149 - DNA, 20 bp, Artificial Sequence
  chemically synthesized
gttacgaacttcagttttgt

SEQ ID NO: 156150 - DNA, 20 bp, Artificial Sequence
  chemically synthesized
ttactaagcttacaaaactg

SEQ ID NO: 156151 - DNA, 20 bp, Artificial Sequence
  chemically synthesized
tgcttagaggttacgaactt

SEQ ID NO: 156152 - DNA, 20 bp, Artificial Sequence
  chemically synthesized
aactgaagttcgtaacctct

SEQ ID NO: 156153 - DNA, 20 bp, Artificial Sequence
  chemically synthesized
acatgtctgtgaatgcttag

SEQ ID NO: 156154 - DNA, 20 bp, Artificial Sequence
  chemically synthesized
tacatgtctgtgaatgctta

SEQ ID NO: 156155 - DNA, 20 bp, Artificial Sequence
  chemically synthesized
cttacatgtctgtgaatgct

SEQ ID NO: 156156 - DNA, 20 bp, Artificial Sequence
  chemically synthesized
tcgtaacctctaagcattca

SEQ ID NO: 156157 - DNA, 20 bp, Artificial Sequence
  chemically synthesized
ctaagcattcacagacatgt

SEQ ID NO: 156158 - DNA, 20 bp, Artificial Sequence
  chemically synthesized
tcacagacatgtaagtaaat

SEQ ID NO: 156159 - DNA, 20 bp, Artificial Sequence
  chemically synthesized
gacatgtaagtaaattagaa

SEQ ID NO: 156160 - DNA, 20 bp, Artificial Sequence
  chemically synthesized
catgtaagtaaattagaaca

SEQ ID NO: 156161 - DNA, 20 bp, Artificial Sequence
  chemically synthesized
gtaaattagaacagagattt

SEQ ID NO: 156162 - DNA, 20 bp, Artificial Sequence
  chemically synthesized
taaattagaacagagatttt

SEQ ID NO: 156163 - DNA, 20 bp, Artificial Sequence
  chemically synthesized
gaaaaaataatgatttcaac

SEQ ID NO: 156164 - DNA, 20 bp, Artificial Sequence
  chemically synthesized
atgatttcaacaagacacct

SEQ ID NO: 156165 - DNA, 20 bp, Artificial Sequence
  chemically synthesized
tgatttcaacaagacacctc

SEQ ID NO: 156166 - DNA, 20 bp, Artificial Sequence
  chemically synthesized
gatttcaacaagacacctcg

SEQ ID NO: 156167 - DNA, 20 bp, Artificial Sequence
  chemically synthesized
atttcaacaagacacctcgg

SEQ ID NO: 156168 - DNA, 20 bp, Artificial Sequence
  chemically synthesized
tgagttaagctgttcccccg

SEQ ID NO: 156169 - DNA, 20 bp, Artificial Sequence
  chemically synthesized
aacaagacacctcgggggaa

SEQ ID NO: 156170 - DNA, 20 bp, Artificial Sequence
  chemically synthesized
ctgagttaagctgttccccc

SEQ ID NO: 156171 - DNA, 20 bp, Artificial Sequence
  chemically synthesized
ctcgggggaacagcttaact

SEQ ID NO: 156172 - DNA, 20 bp, Artificial Sequence
  chemically synthesized
tgacctctccaggctgagtt

SEQ ID NO: 156173 - DNA, 20 bp, Artificial Sequence
  chemically synthesized
gggaacagcttaactcagcc

SEQ ID NO: 156174 - DNA, 20 bp, Artificial Sequence
  chemically synthesized
gaacagcttaactcagcctg

SEQ ID NO: 156175 - DNA, 20 bp, Artificial Sequence
  chemically synthesized
cctattgacctctccaggct

SEQ ID NO: 156176 - DNA, 20 bp, Artificial Sequence
  chemically synthesized
acagcttaactcagcctgga

SEQ ID NO: 156177 - DNA, 20 bp, Artificial Sequence
  chemically synthesized
cagcttaactcagcctggag

SEQ ID NO: 156178 - DNA, 20 bp, Artificial Sequence
  chemically synthesized
ggtaacctattgacctctcc

SEQ ID NO: 156179 - DNA, 20 bp, Artificial Sequence
  chemically synthesized
gggtaacctattgacctctc

SEQ ID NO: 156180 - DNA, 20 bp, Artificial Sequence
  chemically synthesized
actcagcctggagaggtcaa

SEQ ID NO: 156181 - DNA, 20 bp, Artificial Sequence
  chemically synthesized
ctcagcctggagaggtcaat

SEQ ID NO: 156182 - DNA, 20 bp, Artificial Sequence
  chemically synthesized
ggtcaataggttacccacaa

SEQ ID NO: 156183 - DNA, 20 bp, Artificial Sequence
  chemically synthesized
attcaaatgttagcttttgt

SEQ ID NO: 156184 - DNA, 20 bp, Artificial Sequence
  chemically synthesized
aattcaaatgttagcttttg

SEQ ID NO: 156185 - DNA, 20 bp, Artificial Sequence
  chemically synthesized
ttcaaaataaattcaaatgt

SEQ ID NO: 156186 - DNA, 20 bp, Artificial Sequence
  chemically synthesized
aacatttgaatttattttga

SEQ ID NO: 156187 - DNA, 20 bp, Artificial Sequence
  chemically synthesized
aatttattttgaaagacgac

SEQ ID NO: 156188 - DNA, 20 bp, Artificial Sequence
  chemically synthesized
atttattttgaaagacgact

SEQ ID NO: 156189 - DNA, 20 bp, Artificial Sequence
  chemically synthesized
tattttgaaagacgactagg

SEQ ID NO: 156190 - DNA, 20 bp, Artificial Sequence
  chemically synthesized
ggccccttctgaaaacttcc

SEQ ID NO: 156191 - DNA, 20 bp, Artificial Sequence
  chemically synthesized
aaagacgactaggaagtttt

SEQ ID NO: 156192 - DNA, 20 bp, Artificial Sequence
  chemically synthesized
gacgactaggaagttttcag

SEQ ID NO: 156193 - DNA, 20 bp, Artificial Sequence
  chemically synthesized
acgactaggaagttttcaga

SEQ ID NO: 156194 - DNA, 20 bp, Artificial Sequence
  chemically synthesized
cgactaggaagttttcagaa

SEQ ID NO: 156195 - DNA, 20 bp, Artificial Sequence
  chemically synthesized
gactaggaagttttcagaag

SEQ ID NO: 156196 - DNA, 20 bp, Artificial Sequence
  chemically synthesized
gttttcagaaggggccattc

SEQ ID NO: 156197 - DNA, 20 bp, Artificial Sequence
  chemically synthesized
ttttccacctggcgcttgaa

SEQ ID NO: 156198 - DNA, 20 bp, Artificial Sequence
  chemically synthesized
agaaggggccattcaagcgc

SEQ ID NO: 156199 - DNA, 20 bp, Artificial Sequence
  chemically synthesized
gaaggggccattcaagcgcc

SEQ ID NO: 156200 - DNA, 20 bp, Artificial Sequence
  chemically synthesized
ggggccattcaagcgccagg

SEQ ID NO: 156201 - DNA, 20 bp, Artificial Sequence
  chemically synthesized
tgaaatgccctttttccacc

SEQ ID NO: 156202 - DNA, 20 bp, Artificial Sequence
  chemically synthesized
attcaagcgccaggtggaaa

SEQ ID NO: 156203 - DNA, 20 bp, Artificial Sequence
  chemically synthesized
ttcaagcgccaggtggaaaa

SEQ ID NO: 156204 - DNA, 20 bp, Artificial Sequence
  chemically synthesized
tcaagcgccaggtggaaaaa

SEQ ID NO: 156205 - DNA, 20 bp, Artificial Sequence
  chemically synthesized
caggtggaaaaagggcattt

SEQ ID NO: 156206 - DNA, 20 bp, Artificial Sequence
  chemically synthesized
tggaaaaagggcatttcaga

SEQ ID NO: 156207 - DNA, 20 bp, Artificial Sequence
  chemically synthesized
aaaaagggcatttcagacag

SEQ ID NO: 156208 - DNA, 20 bp, Artificial Sequence
  chemically synthesized
aaaagggcatttcagacaga

SEQ ID NO: 156209 - DNA, 20 bp, Artificial Sequence
  chemically synthesized
acctcttgccattttgcacg

SEQ ID NO: 156210 - DNA, 20 bp, Artificial Sequence
  chemically synthesized
aaggaaaactacgtgcaaaa

SEQ ID NO: 156211 - DNA, 20 bp, Artificial Sequence
  chemically synthesized
aaaactacgtgcaaaatggc

SEQ ID NO: 156212 - DNA, 20 bp, Artificial Sequence
  chemically synthesized
aactacgtgcaaaatggcaa

SEQ ID NO: 156213 - DNA, 20 bp, Artificial Sequence
  chemically synthesized
actacgtgcaaaatggcaag

SEQ ID NO: 156214 - DNA, 20 bp, Artificial Sequence
  chemically synthesized
gcaaaatggcaagaggtatc

SEQ ID NO: 156215 - DNA, 20 bp, Artificial Sequence
  chemically synthesized
agaggtatcgagccttaaaa

SEQ ID NO: 156216 - DNA, 20 bp, Artificial Sequence
  chemically synthesized
cacactgcatttctttttta

SEQ ID NO: 156217 - DNA, 20 bp, Artificial Sequence
  chemically synthesized
acacactgcatttctttttt

SEQ ID NO: 156218 - DNA, 20 bp, Artificial Sequence
  chemically synthesized
cgagccttaaaaaagaaatg

SEQ ID NO: 156219 - DNA, 20 bp, Artificial Sequence
  chemically synthesized
aaaagaaatgcagtgtgtcc

SEQ ID NO: 156220 - DNA, 20 bp, Artificial Sequence
  chemically synthesized
tgcagtgtgtcctggctatc

SEQ ID NO: 156221 - DNA, 20 bp, Artificial Sequence
  chemically synthesized
acactgtagtctagatagcc

SEQ ID NO: 156222 - DNA, 20 bp, Artificial Sequence
  chemically synthesized
aacactgtagtctagatagc

SEQ ID NO: 156223 - DNA, 20 bp, Artificial Sequence
  chemically synthesized
tgtaaacactgtagtctaga

SEQ ID NO: 156224 - DNA, 20 bp, Artificial Sequence
  chemically synthesized
tgtcctggctatctagacta

SEQ ID NO: 156225 - DNA, 20 bp, Artificial Sequence
  chemically synthesized
tacttgtaaacactgtagtc

SEQ ID NO: 156226 - DNA, 20 bp, Artificial Sequence
  chemically synthesized
atcattacttgtaaacactg

SEQ ID NO: 156227 - DNA, 20 bp, Artificial Sequence
  chemically synthesized
atctagactacagtgtttac

SEQ ID NO: 156228 - DNA, 20 bp, Artificial Sequence
  chemically synthesized
agtgtttacaagtaatgata

SEQ ID NO: 156229 - DNA, 20 bp, Artificial Sequence
  chemically synthesized
tgtttacaagtaatgataca

SEQ ID NO: 156230 - DNA, 20 bp, Artificial Sequence
  chemically synthesized
aagtaatgatacagagctgc

SEQ ID NO: 156231 - DNA, 20 bp, Artificial Sequence
  chemically synthesized
cttaataaattgcattcttg

SEQ ID NO: 156232 - DNA, 20 bp, Artificial Sequence
  chemically synthesized
ctgcaagaatgcaatttatt

SEQ ID NO: 156233 - DNA, 20 bp, Artificial Sequence
  chemically synthesized
tttattaagaccttgtaatg

SEQ ID NO: 156234 - DNA, 20 bp, Artificial Sequence
  chemically synthesized
tgtaatagtcccacattaca

SEQ ID NO: 156235 - DNA, 20 bp, Artificial Sequence
  chemically synthesized
ttattaagaccttgtaatgt

SEQ ID NO: 156236 - DNA, 20 bp, Artificial Sequence
  chemically synthesized
atgtaatagtcccacattac

SEQ ID NO: 156237 - DNA, 20 bp, Artificial Sequence
  chemically synthesized
ggttttagaagagaatgtaa

SEQ ID NO: 156238 - DNA, 20 bp, Artificial Sequence
  chemically synthesized
tctactctgtggttttagaa

SEQ ID NO: 156239 - DNA, 20 bp, Artificial Sequence
  chemically synthesized
catctactctgtggttttag

SEQ ID NO: 156240 - DNA, 20 bp, Artificial Sequence
  chemically synthesized
tacattctcttctaaaacca

SEQ ID NO: 156241 - DNA, 20 bp, Artificial Sequence
  chemically synthesized
ttccatctactctgtggttt

SEQ ID NO: 156242 - DNA, 20 bp, Artificial Sequence
  chemically synthesized
cattctcttctaaaaccaca

SEQ ID NO: 156243 - DNA, 20 bp, Artificial Sequence
  chemically synthesized
tctcttctaaaaccacagag

SEQ ID NO: 156244 - DNA, 20 bp, Artificial Sequence
  chemically synthesized
aaacacttccatctactctg

SEQ ID NO: 156245 - DNA, 20 bp, Artificial Sequence
  chemically synthesized
ttctaaaaccacagagtaga

SEQ ID NO: 156246 - DNA, 20 bp, Artificial Sequence
  chemically synthesized
taaaaccacagagtagatgg

SEQ ID NO: 156247 - DNA, 20 bp, Artificial Sequence
  chemically synthesized
acagagtagatggaagtgtt

SEQ ID NO: 156248 - DNA, 20 bp, Artificial Sequence
  chemically synthesized
agagtagatggaagtgttta

SEQ ID NO: 156249 - DNA, 20 bp, Artificial Sequence
  chemically synthesized
gtagatggaagtgtttagag

SEQ ID NO: 156250 - DNA, 20 bp, Artificial Sequence
  chemically synthesized
gatggaagtgtttagagaag

SEQ ID NO: 156251 - DNA, 20 bp, Artificial Sequence
  chemically synthesized
tggaagtgtttagagaagaa

SEQ ID NO: 156252 - DNA, 20 bp, Artificial Sequence
  chemically synthesized
aaaacacgaatcgtatcata

SEQ ID NO: 156253 - DNA, 20 bp, Artificial Sequence
  chemically synthesized
acgattcgtgttttgcattg

SEQ ID NO: 156254 - DNA, 20 bp, Artificial Sequence
  chemically synthesized
gattcgtgttttgcattgtg

SEQ ID NO: 156255 - DNA, 20 bp, Artificial Sequence
  chemically synthesized
attcgtgttttgcattgtgg

SEQ ID NO: 156256 - DNA, 20 bp, Artificial Sequence
  chemically synthesized
ttgcattgtggaggctttat

SEQ ID NO: 156257 - DNA, 20 bp, Artificial Sequence
  chemically synthesized
cattgtggaggctttatcag

SEQ ID NO: 156258 - DNA, 20 bp, Artificial Sequence
  chemically synthesized
attgtggaggctttatcaga

SEQ ID NO: 156259 - DNA, 20 bp, Artificial Sequence
  chemically synthesized
atctctgcacccttctgata

SEQ ID NO: 156260 - DNA, 20 bp, Artificial Sequence
  chemically synthesized
ttgtggaggctttatcagaa

SEQ ID NO: 156261 - DNA, 20 bp, Artificial Sequence
  chemically synthesized
gaggctttatcagaagggtg

SEQ ID NO: 156262 - DNA, 20 bp, Artificial Sequence
  chemically synthesized
ggctttatcagaagggtgca

SEQ ID NO: 156263 - DNA, 20 bp, Artificial Sequence
  chemically synthesized
tcagaagggtgcagagatac

SEQ ID NO: 156264 - DNA, 20 bp, Artificial Sequence
  chemically synthesized
aagggtgcagagatacaagt

SEQ ID NO: 156265 - DNA, 20 bp, Artificial Sequence
  chemically synthesized
agggtgcagagatacaagtt

SEQ ID NO: 156266 - DNA, 20 bp, Artificial Sequence
  chemically synthesized
ggtgcagagatacaagttgg

SEQ ID NO: 156267 - DNA, 20 bp, Artificial Sequence
  chemically synthesized
gtgcagagatacaagttggg

SEQ ID NO: 156268 - DNA, 20 bp, Artificial Sequence
  chemically synthesized
tacaagttgggaggctaaca

SEQ ID NO: 156269 - DNA, 20 bp, Artificial Sequence
  chemically synthesized
tcccactccagttaccatgt

SEQ ID NO: 156270 - DNA, 20 bp, Artificial Sequence
  chemically synthesized
tgggaggctaacatggtaac

SEQ ID NO: 156271 - DNA, 20 bp, Artificial Sequence
  chemically synthesized
ggaggctaacatggtaactg

SEQ ID NO: 156272 - DNA, 20 bp, Artificial Sequence
  chemically synthesized
ggctaacatggtaactggag

SEQ ID NO: 156273 - DNA, 20 bp, Artificial Sequence
  chemically synthesized
gctaacatggtaactggagt

SEQ ID NO: 156274 - DNA, 20 bp, Artificial Sequence
  chemically synthesized
aacatggtaactggagtggg

SEQ ID NO: 156275 - DNA, 20 bp, Artificial Sequence
  chemically synthesized
cagctgaccacttcccactc

SEQ ID NO: 156276 - DNA, 20 bp, Artificial Sequence
  chemically synthesized
atggtaactggagtgggaag

SEQ ID NO: 156277 - DNA, 20 bp, Artificial Sequence
  chemically synthesized
taactggagtgggaagtggt

SEQ ID NO: 156278 - DNA, 20 bp, Artificial Sequence
  chemically synthesized
tggagtgggaagtggtcagc

SEQ ID NO: 156279 - DNA, 20 bp, Artificial Sequence
  chemically synthesized
ggaagtggtcagctggactg

SEQ ID NO: 156280 - DNA, 20 bp, Artificial Sequence
  chemically synthesized
gaagtggtcagctggactga

SEQ ID NO: 156281 - DNA, 20 bp, Artificial Sequence
  chemically synthesized
tatggccaaagccttcagtc

SEQ ID NO: 156282 - DNA, 20 bp, Artificial Sequence
  chemically synthesized
gtcagctggactgaaggctt

SEQ ID NO: 156283 - DNA, 20 bp, Artificial Sequence
  chemically synthesized
ttctgtatggccaaagcctt

SEQ ID NO: 156284 - DNA, 20 bp, Artificial Sequence
  chemically synthesized
tgcctttttctgtatggcca

SEQ ID NO: 156285 - DNA, 20 bp, Artificial Sequence
  chemically synthesized
gactgaaggctttggccata

SEQ ID NO: 156286 - DNA, 20 bp, Artificial Sequence
  chemically synthesized
cccctctgcctttttctgta

SEQ ID NO: 156287 - DNA, 20 bp, Artificial Sequence
  chemically synthesized
aggctttggccatacagaaa

SEQ ID NO: 156288 - DNA, 20 bp, Artificial Sequence
  chemically synthesized
ggctttggccatacagaaaa

SEQ ID NO: 156289 - DNA, 20 bp, Artificial Sequence
  chemically synthesized
tttggccatacagaaaaagg

SEQ ID NO: 156290 - DNA, 20 bp, Artificial Sequence
  chemically synthesized
tggccatacagaaaaaggca

SEQ ID NO: 156291 - DNA, 20 bp, Artificial Sequence
  chemically synthesized
ggccatacagaaaaaggcag

SEQ ID NO: 156292 - DNA, 20 bp, Artificial Sequence
  chemically synthesized
gccatacagaaaaaggcaga

SEQ ID NO: 156293 - DNA, 20 bp, Artificial Sequence
  chemically synthesized
ccatacagaaaaaggcagag

SEQ ID NO: 156294 - DNA, 20 bp, Artificial Sequence
  chemically synthesized
aaatctcaactatcaaaggc

SEQ ID NO: 156295 - DNA, 20 bp, Artificial Sequence
  chemically synthesized
tgtatttttcttgcctttga

SEQ ID NO: 156296 - DNA, 20 bp, Artificial Sequence
  chemically synthesized
ctcaaaatctcaactatcaa

SEQ ID NO: 156297 - DNA, 20 bp, Artificial Sequence
  chemically synthesized
gctcaaaatctcaactatca

SEQ ID NO: 156298 - DNA, 20 bp, Artificial Sequence
  chemically synthesized
ttttcttgcctttgatagtt

SEQ ID NO: 156299 - DNA, 20 bp, Artificial Sequence
  chemically synthesized
cctttgatagttgagatttt

SEQ ID NO: 156300 - DNA, 20 bp, Artificial Sequence
  chemically synthesized
tgatagttgagattttgagc

SEQ ID NO: 156301 - DNA, 20 bp, Artificial Sequence
  chemically synthesized
agtttctcttcgtcgtttac

SEQ ID NO: 156302 - DNA, 20 bp, Artificial Sequence
  chemically synthesized
ttttgagctggtaaacgacg

SEQ ID NO: 156303 - DNA, 20 bp, Artificial Sequence
  chemically synthesized
ttgagctggtaaacgacgaa

SEQ ID NO: 156304 - DNA, 20 bp, Artificial Sequence
  chemically synthesized
ggaagaaacaatttgatggc

SEQ ID NO: 156305 - DNA, 20 bp, Artificial Sequence
  chemically synthesized
aactggaagaaacaatttga

SEQ ID NO: 156306 - DNA, 20 bp, Artificial Sequence
  chemically synthesized
tgccatcaaattgtttcttc

SEQ ID NO: 156307 - DNA, 20 bp, Artificial Sequence
  chemically synthesized
caaattgtttcttccagttg

SEQ ID NO: 156308 - DNA, 20 bp, Artificial Sequence
  chemically synthesized
tcatcatatcccacaactgg

SEQ ID NO: 156309 - DNA, 20 bp, Artificial Sequence
  chemically synthesized
aaattgtttcttccagttgt

SEQ ID NO: 156310 - DNA, 20 bp, Artificial Sequence
  chemically synthesized
acctcatcatatcccacaac

SEQ ID NO: 156311 - DNA, 20 bp, Artificial Sequence
  chemically synthesized
ttccagttgtgggatatgat

SEQ ID NO: 156312 - DNA, 20 bp, Artificial Sequence
  chemically synthesized
tccagttgtgggatatgatg

SEQ ID NO: 156313 - DNA, 20 bp, Artificial Sequence
  chemically synthesized
gattgatcagattatttgaa

SEQ ID NO: 156314 - DNA, 20 bp, Artificial Sequence
  chemically synthesized
aagattgatcagattatttg

SEQ ID NO: 156315 - DNA, 20 bp, Artificial Sequence
  chemically synthesized
ttaaagaataaaagattgat

SEQ ID NO: 156316 - DNA, 20 bp, Artificial Sequence
  chemically synthesized
tactatgaattaaagaataa

SEQ ID NO: 156317 - DNA, 20 bp, Artificial Sequence
  chemically synthesized
atcttttattctttaattca

SEQ ID NO: 156318 - DNA, 20 bp, Artificial Sequence
  chemically synthesized
tcagggggtactatgaatta

SEQ ID NO: 156319 - DNA, 20 bp, Artificial Sequence
  chemically synthesized
gaaaaaggagaaaaatcagg

SEQ ID NO: 156320 - DNA, 20 bp, Artificial Sequence
  chemically synthesized
ggaaaaaggagaaaaatcag

SEQ ID NO: 156321 - DNA, 20 bp, Artificial Sequence
  chemically synthesized
aggaaaaaggagaaaaatca

SEQ ID NO: 156322 - DNA, 20 bp, Artificial Sequence
  chemically synthesized
aaggaaaaaggagaaaaatc

SEQ ID NO: 156323 - DNA, 20 bp, Artificial Sequence
  chemically synthesized
aaaggaaaaaggagaaaaat

SEQ ID NO: 156324 - DNA, 20 bp, Artificial Sequence
  chemically synthesized
caaaggtaaaaaggaaaaag

SEQ ID NO: 156325 - DNA, 20 bp, Artificial Sequence
  chemically synthesized
aacaaaggtaaaaaggaaaa

SEQ ID NO: 156326 - DNA, 20 bp, Artificial Sequence
  chemically synthesized
taacaaaggtaaaaaggaaa

SEQ ID NO: 156327 - DNA, 20 bp, Artificial Sequence
  chemically synthesized
ggcatctaacaaaggtaaaa

SEQ ID NO: 156328 - DNA, 20 bp, Artificial Sequence
  chemically synthesized
gggcatctaacaaaggtaaa

SEQ ID NO: 156329 - DNA, 20 bp, Artificial Sequence
  chemically synthesized
tttttcctttttacctttgt

SEQ ID NO: 156330 - DNA, 20 bp, Artificial Sequence
  chemically synthesized
tgtgcctgggcatctaacaa

SEQ ID NO: 156331 - DNA, 20 bp, Artificial Sequence
  chemically synthesized
gtgtgcctgggcatctaaca

SEQ ID NO: 156332 - DNA, 20 bp, Artificial Sequence
  chemically synthesized
ttttacctttgttagatgcc

SEQ ID NO: 156333 - DNA, 20 bp, Artificial Sequence
  chemically synthesized
tttacctttgttagatgccc

SEQ ID NO: 156334 - DNA, 20 bp, Artificial Sequence
  chemically synthesized
gctggtactgaggtgtgcct

SEQ ID NO: 156335 - DNA, 20 bp, Artificial Sequence
  chemically synthesized
agctggtactgaggtgtgcc

SEQ ID NO: 156336 - DNA, 20 bp, Artificial Sequence
  chemically synthesized
ttagatgcccaggcacacct

SEQ ID NO: 156337 - DNA, 20 bp, Artificial Sequence
  chemically synthesized
gcccaggcacacctcagtac

SEQ ID NO: 156338 - DNA, 20 bp, Artificial Sequence
  chemically synthesized
atgaatgtgagctggtactg

SEQ ID NO: 156339 - DNA, 20 bp, Artificial Sequence
  chemically synthesized
aatgaatgtgagctggtact

SEQ ID NO: 156340 - DNA, 20 bp, Artificial Sequence
  chemically synthesized
ataaggaaatgaatgtgagc

SEQ ID NO: 156341 - DNA, 20 bp, Artificial Sequence
  chemically synthesized
ccaaataaggaaatgaatgt

SEQ ID NO: 156342 - DNA, 20 bp, Artificial Sequence
  chemically synthesized
ctcacattcatttccttatt

SEQ ID NO: 156343 - DNA, 20 bp, Artificial Sequence
  chemically synthesized
gttagtcctctttccaaata

SEQ ID NO: 156344 - DNA, 20 bp, Artificial Sequence
  chemically synthesized
cattcatttccttatttgga

SEQ ID NO: 156345 - DNA, 20 bp, Artificial Sequence
  chemically synthesized
agttagtcctctttccaaat

SEQ ID NO: 156346 - DNA, 20 bp, Artificial Sequence
  chemically synthesized
ttcatttccttatttggaaa

SEQ ID NO: 156347 - DNA, 20 bp, Artificial Sequence
  chemically synthesized
tcatttccttatttggaaag

SEQ ID NO: 156348 - DNA, 20 bp, Artificial Sequence
  chemically synthesized
tggaaagaggactaactttc

SEQ ID NO: 156349 - DNA, 20 bp, Artificial Sequence
  chemically synthesized
tctgtaatgagctagaaagt

SEQ ID NO: 156350 - DNA, 20 bp, Artificial Sequence
  chemically synthesized
ggcgtctgtaatgagctaga

SEQ ID NO: 156351 - DNA, 20 bp, Artificial Sequence
  chemically synthesized
aaggggcgtctgtaatgagc

SEQ ID NO: 156352 - DNA, 20 bp, Artificial Sequence
  chemically synthesized
actaactttctagctcatta

SEQ ID NO: 156353 - DNA, 20 bp, Artificial Sequence
  chemically synthesized
ggggaaggggcgtctgtaat

SEQ ID NO: 156354 - DNA, 20 bp, Artificial Sequence
  chemically synthesized
aagtggagaggaaggggaag

SEQ ID NO: 156355 - DNA, 20 bp, Artificial Sequence
  chemically synthesized
caagtggagaggaaggggaa

SEQ ID NO: 156356 - DNA, 20 bp, Artificial Sequence
  chemically synthesized
tcaagtggagaggaagggga

SEQ ID NO: 156357 - DNA, 20 bp, Artificial Sequence
  chemically synthesized
atcaagtggagaggaagggg

SEQ ID NO: 156358 - DNA, 20 bp, Artificial Sequence
  chemically synthesized
aaaatcaagtggagaggaag

SEQ ID NO: 156359 - DNA, 20 bp, Artificial Sequence
  chemically synthesized
taaaatcaagtggagaggaa

SEQ ID NO: 156360 - DNA, 20 bp, Artificial Sequence
  chemically synthesized
gtaaaatcaagtggagagga

SEQ ID NO: 156361 - DNA, 20 bp, Artificial Sequence
  chemically synthesized
cgtaaaatcaagtggagagg

SEQ ID NO: 156362 - DNA, 20 bp, Artificial Sequence
  chemically synthesized
gcacgtaaaatcaagtggag

SEQ ID NO: 156363 - DNA, 20 bp, Artificial Sequence
  chemically synthesized
ggcacgtaaaatcaagtgga

SEQ ID NO: 156364 - DNA, 20 bp, Artificial Sequence
  chemically synthesized
tgggcacgtaaaatcaagtg

SEQ ID NO: 156365 - DNA, 20 bp, Artificial Sequence
  chemically synthesized
ggtgggcacgtaaaatcaag

SEQ ID NO: 156366 - DNA, 20 bp, Artificial Sequence
  chemically synthesized
tagggtgggcacgtaaaatc

SEQ ID NO: 156367 - DNA, 20 bp, Artificial Sequence
  chemically synthesized
ttgatttttttagatagggt

SEQ ID NO: 156368 - DNA, 20 bp, Artificial Sequence
  chemically synthesized
tttgatttttttagataggg

SEQ ID NO: 156369 - DNA, 20 bp, Artificial Sequence
  chemically synthesized
acatttgatttttttagata

SEQ ID NO: 156370 - DNA, 20 bp, Artificial Sequence
  chemically synthesized
aacatttgatttttttagat

SEQ ID NO: 156371 - DNA, 20 bp, Artificial Sequence
  chemically synthesized
aaacatttgatttttttaga

SEQ ID NO: 156372 - DNA, 20 bp, Artificial Sequence
  chemically synthesized
ggctaaacatttgatttttt

SEQ ID NO: 156373 - DNA, 20 bp, Artificial Sequence
  chemically synthesized
atctaaaaaaatcaaatgtt

SEQ ID NO: 156374 - DNA, 20 bp, Artificial Sequence
  chemically synthesized
aaatcaaatgtttagccaac

SEQ ID NO: 156375 - DNA, 20 bp, Artificial Sequence
  chemically synthesized
aatcaaatgtttagccaact

SEQ ID NO: 156376 - DNA, 20 bp, Artificial Sequence
  chemically synthesized
caatctaaactaatcccagt

SEQ ID NO: 156377 - DNA, 20 bp, Artificial Sequence
  chemically synthesized
aatgtttagccaactgggat

SEQ ID NO: 156378 - DNA, 20 bp, Artificial Sequence
  chemically synthesized
cgtacaatctaaactaatcc

SEQ ID NO: 156379 - DNA, 20 bp, Artificial Sequence
  chemically synthesized
ttagccaactgggattagtt

SEQ ID NO: 156380 - DNA, 20 bp, Artificial Sequence
  chemically synthesized
tagattgtacgacccaaccc

SEQ ID NO: 156381 - DNA, 20 bp, Artificial Sequence
  chemically synthesized
tccccccattggctggggtt

SEQ ID NO: 156382 - DNA, 20 bp, Artificial Sequence
  chemically synthesized
ttccccccattggctggggt

SEQ ID NO: 156383 - DNA, 20 bp, Artificial Sequence
  chemically synthesized
tacgacccaaccccagccaa

SEQ ID NO: 156384 - DNA, 20 bp, Artificial Sequence
  chemically synthesized
ccctttccccccattggctg

SEQ ID NO: 156385 - DNA, 20 bp, Artificial Sequence
  chemically synthesized
acgacccaaccccagccaat

SEQ ID NO: 156386 - DNA, 20 bp, Artificial Sequence
  chemically synthesized
accctttccccccattggct

SEQ ID NO: 156387 - DNA, 20 bp, Artificial Sequence
  chemically synthesized
cgacccaaccccagccaatg

SEQ ID NO: 156388 - DNA, 20 bp, Artificial Sequence
  chemically synthesized
taccctttccccccattggc

SEQ ID NO: 156389 - DNA, 20 bp, Artificial Sequence
  chemically synthesized
gacccaaccccagccaatgg

SEQ ID NO: 156390 - DNA, 20 bp, Artificial Sequence
  chemically synthesized
acccaaccccagccaatggg

SEQ ID NO: 156391 - DNA, 20 bp, Artificial Sequence
  chemically synthesized
cctgtaccctttccccccat

SEQ ID NO: 156392 - DNA, 20 bp, Artificial Sequence
  chemically synthesized
aaccccagccaatgggggga

SEQ ID NO: 156393 - DNA, 20 bp, Artificial Sequence
  chemically synthesized
accccagccaatggggggaa

SEQ ID NO: 156394 - DNA, 20 bp, Artificial Sequence
  chemically synthesized
ccccagccaatggggggaaa

SEQ ID NO: 156395 - DNA, 20 bp, Artificial Sequence
  chemically synthesized
gccaatggggggaaagggta

SEQ ID NO: 156396 - DNA, 20 bp, Artificial Sequence
  chemically synthesized
ccaatggggggaaagggtac

SEQ ID NO: 156397 - DNA, 20 bp, Artificial Sequence
  chemically synthesized
caatggggggaaagggtaca

SEQ ID NO: 156398 - DNA, 20 bp, Artificial Sequence
  chemically synthesized
aatggggggaaagggtacag

SEQ ID NO: 156399 - DNA, 20 bp, Artificial Sequence
  chemically synthesized
ggggggaaagggtacagggg

SEQ ID NO: 156400 - DNA, 20 bp, Artificial Sequence
  chemically synthesized
gggggaaagggtacaggggc

SEQ ID NO: 156401 - DNA, 20 bp, Artificial Sequence
  chemically synthesized
tacaggggcaggacttgcgt

SEQ ID NO: 156402 - DNA, 20 bp, Artificial Sequence
  chemically synthesized
acaggggcaggacttgcgtc

SEQ ID NO: 156403 - DNA, 20 bp, Artificial Sequence
  chemically synthesized
agagcctttattcctgacgc

SEQ ID NO: 156404 - DNA, 20 bp, Artificial Sequence
  chemically synthesized
caggacttgcgtcaggaata

SEQ ID NO: 156405 - DNA, 20 bp, Artificial Sequence
  chemically synthesized
aggacttgcgtcaggaataa

SEQ ID NO: 156406 - DNA, 20 bp, Artificial Sequence
  chemically synthesized
acctgaacaaaggggcatga

SEQ ID NO: 156407 - DNA, 20 bp, Artificial Sequence
  chemically synthesized
acacctgaacaaaggggcat

SEQ ID NO: 156408 - DNA, 20 bp, Artificial Sequence
  chemically synthesized
ggctctcatgcccctttgtt

SEQ ID NO: 156409 - DNA, 20 bp, Artificial Sequence
  chemically synthesized
gagagcacacctgaacaaag

SEQ ID NO: 156410 - DNA, 20 bp, Artificial Sequence
  chemically synthesized
gctctcatgcccctttgttc

SEQ ID NO: 156411 - DNA, 20 bp, Artificial Sequence
  chemically synthesized
tgagagcacacctgaacaaa

SEQ ID NO: 156412 - DNA, 20 bp, Artificial Sequence
  chemically synthesized
atgagagcacacctgaacaa

SEQ ID NO: 156413 - DNA, 20 bp, Artificial Sequence
  chemically synthesized
catgagagcacacctgaaca

SEQ ID NO: 156414 - DNA, 20 bp, Artificial Sequence
  chemically synthesized
tttgttcaggtgtgctctca

SEQ ID NO: 156415 - DNA, 20 bp, Artificial Sequence
  chemically synthesized
tccttggccagttgccatga

SEQ ID NO: 156416 - DNA, 20 bp, Artificial Sequence
  chemically synthesized
cctccttggccagttgccat

SEQ ID NO: 156417 - DNA, 20 bp, Artificial Sequence
  chemically synthesized
aggtgtgctctcatggcaac

SEQ ID NO: 156418 - DNA, 20 bp, Artificial Sequence
  chemically synthesized
tgctctcatggcaactggcc

SEQ ID NO: 156419 - DNA, 20 bp, Artificial Sequence
  chemically synthesized
gctctcatggcaactggcca

SEQ ID NO: 156420 - DNA, 20 bp, Artificial Sequence
  chemically synthesized
tctcatggcaactggccaag

SEQ ID NO: 156421 - DNA, 20 bp, Artificial Sequence
  chemically synthesized
ctcatggcaactggccaagg

SEQ ID NO: 156422 - DNA, 20 bp, Artificial Sequence
  chemically synthesized
cagaggggtgcctccttggc

SEQ ID NO: 156423 - DNA, 20 bp, Artificial Sequence
  chemically synthesized
tgcacagaggggtgcctcct

SEQ ID NO: 156424 - DNA, 20 bp, Artificial Sequence
  chemically synthesized
caaggaggcacccctctgtg

SEQ ID NO: 156425 - DNA, 20 bp, Artificial Sequence
  chemically synthesized
aattttacttctgcacagag

SEQ ID NO: 156426 - DNA, 20 bp, Artificial Sequence
  chemically synthesized
caattttacttctgcacaga

SEQ ID NO: 156427 - DNA, 20 bp, Artificial Sequence
  chemically synthesized
gcaattttacttctgcacag

SEQ ID NO: 156428 - DNA, 20 bp, Artificial Sequence
  chemically synthesized
ggaggcacccctctgtgcag

SEQ ID NO: 156429 - DNA, 20 bp, Artificial Sequence
  chemically synthesized
agcaattttacttctgcaca

SEQ ID NO: 156430 - DNA, 20 bp, Artificial Sequence
  chemically synthesized
aaagcaattttacttctgca

SEQ ID NO: 156431 - DNA, 20 bp, Artificial Sequence
  chemically synthesized
agaagtaaaattgctttgct

SEQ ID NO: 156432 - DNA, 20 bp, Artificial Sequence
  chemically synthesized
cgaacaaaggattcttagca

SEQ ID NO: 156433 - DNA, 20 bp, Artificial Sequence
  chemically synthesized
acactcgaacaaaggattct

SEQ ID NO: 156434 - DNA, 20 bp, Artificial Sequence
  chemically synthesized
ttgctaagaatcctttgttc

SEQ ID NO: 156435 - DNA, 20 bp, Artificial Sequence
  chemically synthesized
gacattgaacactcgaacaa

SEQ ID NO: 156436 - DNA, 20 bp, Artificial Sequence
  chemically synthesized
ggacattgaacactcgaaca

SEQ ID NO: 156437 - DNA, 20 bp, Artificial Sequence
  chemically synthesized
gttcgagtgttcaatgtcct

SEQ ID NO: 156438 - DNA, 20 bp, Artificial Sequence
  chemically synthesized
ttcgagtgttcaatgtcctc

SEQ ID NO: 156439 - DNA, 20 bp, Artificial Sequence
  chemically synthesized
gaataatgctcaaaatcctg

SEQ ID NO: 156440 - DNA, 20 bp, Artificial Sequence
  chemically synthesized
ggaataatgctcaaaatcct

SEQ ID NO: 156441 - DNA, 20 bp, Artificial Sequence
  chemically synthesized
ttcaatgtcctcaggatttt

SEQ ID NO: 156442 - DNA, 20 bp, Artificial Sequence
  chemically synthesized
tttgagcattattcctaaca

SEQ ID NO: 156443 - DNA, 20 bp, Artificial Sequence
  chemically synthesized
ctgacagggtagactgtgtt

SEQ ID NO: 156444 - DNA, 20 bp, Artificial Sequence
  chemically synthesized
gctgacagggtagactgtgt

SEQ ID NO: 156445 - DNA, 20 bp, Artificial Sequence
  chemically synthesized
cctaacacagtctaccctgt

SEQ ID NO: 156446 - DNA, 20 bp, Artificial Sequence
  chemically synthesized
aaagacacatgctgacaggg

SEQ ID NO: 156447 - DNA, 20 bp, Artificial Sequence
  chemically synthesized
tggaaagacacatgctgaca

SEQ ID NO: 156448 - DNA, 20 bp, Artificial Sequence
  chemically synthesized
ctggaaagacacatgctgac

SEQ ID NO: 156449 - DNA, 20 bp, Artificial Sequence
  chemically synthesized
actggaaagacacatgctga

SEQ ID NO: 156450 - DNA, 20 bp, Artificial Sequence
  chemically synthesized
cctgtcagcatgtgtctttc

SEQ ID NO: 156451 - DNA, 20 bp, Artificial Sequence
  chemically synthesized
tcagcatgtgtctttccagt

SEQ ID NO: 156452 - DNA, 20 bp, Artificial Sequence
  chemically synthesized
gggcacatagtctgactgga

SEQ ID NO: 156453 - DNA, 20 bp, Artificial Sequence
  chemically synthesized
cgaagggcacatagtctgac

SEQ ID NO: 156454 - DNA, 20 bp, Artificial Sequence
  chemically synthesized
cctgccttgcgaagggcaca

SEQ ID NO: 156455 - DNA, 20 bp, Artificial Sequence
  chemically synthesized
tcagactatgtgcccttcgc

SEQ ID NO: 156456 - DNA, 20 bp, Artificial Sequence
  chemically synthesized
cagactatgtgcccttcgca

SEQ ID NO: 156457 - DNA, 20 bp, Artificial Sequence
  chemically synthesized
actcagtcctgccttgcgaa

SEQ ID NO: 156458 - DNA, 20 bp, Artificial Sequence
  chemically synthesized
gactcagtcctgccttgcga

SEQ ID NO: 156459 - DNA, 20 bp, Artificial Sequence
  chemically synthesized
actatgtgcccttcgcaagg

SEQ ID NO: 156460 - DNA, 20 bp, Artificial Sequence
  chemically synthesized
ggactcagtcctgccttgcg

SEQ ID NO: 156461 - DNA, 20 bp, Artificial Sequence
  chemically synthesized
ctatgtgcccttcgcaaggc

SEQ ID NO: 156462 - DNA, 20 bp, Artificial Sequence
  chemically synthesized
gcccttcgcaaggcaggact

SEQ ID NO: 156463 - DNA, 20 bp, Artificial Sequence
  chemically synthesized
cgtacaaggcatagaggact

SEQ ID NO: 156464 - DNA, 20 bp, Artificial Sequence
  chemically synthesized
aaacatcgtacaaggcatag

SEQ ID NO: 156465 - DNA, 20 bp, Artificial Sequence
  chemically synthesized
aaaacatcgtacaaggcata

SEQ ID NO: 156466 - DNA, 20 bp, Artificial Sequence
  chemically synthesized
agaaaacatcgtacaaggca

SEQ ID NO: 156467 - DNA, 20 bp, Artificial Sequence
  chemically synthesized
tataaagaaaacatcgtaca

SEQ ID NO: 156468 - DNA, 20 bp, Artificial Sequence
  chemically synthesized
atataaagaaaacatcgtac

SEQ ID NO: 156469 - DNA, 20 bp, Artificial Sequence
  chemically synthesized
tacgatgttttctttatatc

SEQ ID NO: 156470 - DNA, 20 bp, Artificial Sequence
  chemically synthesized
gaagcactagactggatata

SEQ ID NO: 156471 - DNA, 20 bp, Artificial Sequence
  chemically synthesized
tgttttctttatatccagtc

SEQ ID NO: 156472 - DNA, 20 bp, Artificial Sequence
  chemically synthesized
cttattaggaagcactagac

SEQ ID NO: 156473 - DNA, 20 bp, Artificial Sequence
  chemically synthesized
ctcctcttattaggaagcac

SEQ ID NO: 156474 - DNA, 20 bp, Artificial Sequence
  chemically synthesized
ccagtctagtgcttcctaat

SEQ ID NO: 156475 - DNA, 20 bp, Artificial Sequence
  chemically synthesized
actgaactcctcttattagg

SEQ ID NO: 156476 - DNA, 20 bp, Artificial Sequence
  chemically synthesized
agtctagtgcttcctaataa

SEQ ID NO: 156477 - DNA, 20 bp, Artificial Sequence
  chemically synthesized
gtctagtgcttcctaataag

SEQ ID NO: 156478 - DNA, 20 bp, Artificial Sequence
  chemically synthesized
tttactgaactcctcttatt

SEQ ID NO: 156479 - DNA, 20 bp, Artificial Sequence
  chemically synthesized
ctagtgcttcctaataagag

SEQ ID NO: 156480 - DNA, 20 bp, Artificial Sequence
  chemically synthesized
atttactgaactcctcttat

SEQ ID NO: 156481 - DNA, 20 bp, Artificial Sequence
  chemically synthesized
gcttcctaataagaggagtt

SEQ ID NO: 156482 - DNA, 20 bp, Artificial Sequence
  chemically synthesized
tcatttaattttattcaatt

SEQ ID NO: 156483 - DNA, 20 bp, Artificial Sequence
  chemically synthesized
tctcttttcctttattcaag

SEQ ID NO: 156484 - DNA, 20 bp, Artificial Sequence
  chemically synthesized
tgaaaattgctacttgaata

SEQ ID NO: 156485 - DNA, 20 bp, Artificial Sequence
  chemically synthesized
gaaaattgctacttgaataa

SEQ ID NO: 156486 - DNA, 20 bp, Artificial Sequence
  chemically synthesized
ctttctcttttcctttattc

SEQ ID NO: 156487 - DNA, 20 bp, Artificial Sequence
  chemically synthesized
ttgctacttgaataaaggaa

SEQ ID NO: 156488 - DNA, 20 bp, Artificial Sequence
  chemically synthesized
gctacttgaataaaggaaaa

SEQ ID NO: 156489 - DNA, 20 bp, Artificial Sequence
  chemically synthesized
cttgaataaaggaaaagaga

SEQ ID NO: 156490 - DNA, 20 bp, Artificial Sequence
  chemically synthesized
tgaataaaggaaaagagaaa

SEQ ID NO: 156491 - DNA, 20 bp, Artificial Sequence
  chemically synthesized
gaaaagagaaagagataaat

SEQ ID NO: 156492 - DNA, 20 bp, Artificial Sequence
  chemically synthesized
ttgaagtcaagttgggggaa

SEQ ID NO: 156493 - DNA, 20 bp, Artificial Sequence
  chemically synthesized
tcacattgaagtcaagttgg

SEQ ID NO: 156494 - DNA, 20 bp, Artificial Sequence
  chemically synthesized
ttcacattgaagtcaagttg

SEQ ID NO: 156495 - DNA, 20 bp, Artificial Sequence
  chemically synthesized
gttcacattgaagtcaagtt

SEQ ID NO: 156496 - DNA, 20 bp, Artificial Sequence
  chemically synthesized
agttcacattgaagtcaagt

SEQ ID NO: 156497 - DNA, 20 bp, Artificial Sequence
  chemically synthesized
atgtagttcacattgaagtc

SEQ ID NO: 156498 - DNA, 20 bp, Artificial Sequence
  chemically synthesized
atggtatgtagttcacattg

SEQ ID NO: 156499 - DNA, 20 bp, Artificial Sequence
  chemically synthesized
tcaatgtgaactacatacca

SEQ ID NO: 156500 - DNA, 20 bp, Artificial Sequence
  chemically synthesized
ataaagtcatccatggtatg

SEQ ID NO: 156501 - DNA, 20 bp, Artificial Sequence
  chemically synthesized
tatatatataaagtcatcca

SEQ ID NO: 156502 - DNA, 20 bp, Artificial Sequence
  chemically synthesized
tcaagtcccatatatatata

SEQ ID NO: 156503 - DNA, 20 bp, Artificial Sequence
  chemically synthesized
tggatgactttatatatata

SEQ ID NO: 156504 - DNA, 20 bp, Artificial Sequence
  chemically synthesized
ggatgactttatatatatat

SEQ ID NO: 156505 - DNA, 20 bp, Artificial Sequence
  chemically synthesized
ttatatatatatgggacttg

SEQ ID NO: 156506 - DNA, 20 bp, Artificial Sequence
  chemically synthesized
tatatatatatgggacttga

SEQ ID NO: 156507 - DNA, 20 bp, Artificial Sequence
  chemically synthesized
tatatatatgggacttgaag

SEQ ID NO: 156508 - DNA, 20 bp, Artificial Sequence
  chemically synthesized
aaacctacataggctccttc

SEQ ID NO: 156509 - DNA, 20 bp, Artificial Sequence
  chemically synthesized
gggacttgaaggagcctatg

SEQ ID NO: 156510 - DNA, 20 bp, Artificial Sequence
  chemically synthesized
ggacttgaaggagcctatgt

SEQ ID NO: 156511 - DNA, 20 bp, Artificial Sequence
  chemically synthesized
cacgcctggaaaacctacat

SEQ ID NO: 156512 - DNA, 20 bp, Artificial Sequence
  chemically synthesized
gcacgcctggaaaacctaca

SEQ ID NO: 156513 - DNA, 20 bp, Artificial Sequence
  chemically synthesized
aggagcctatgtaggttttc

SEQ ID NO: 156514 - DNA, 20 bp, Artificial Sequence
  chemically synthesized
ggagcctatgtaggttttcc

SEQ ID NO: 156515 - DNA, 20 bp, Artificial Sequence
  chemically synthesized
taataaaatgattgcacgcc

SEQ ID NO: 156516 - DNA, 20 bp, Artificial Sequence
  chemically synthesized
caggcgtgcaatcattttat

SEQ ID NO: 156517 - DNA, 20 bp, Artificial Sequence
  chemically synthesized
aggcgtgcaatcattttatt

SEQ ID NO: 156518 - DNA, 20 bp, Artificial Sequence
  chemically synthesized
cctgtctcaaaagaaaaaat

SEQ ID NO: 156519 - DNA, 20 bp, Artificial Sequence
  chemically synthesized
ttaggcttattttttctttt

SEQ ID NO: 156520 - DNA, 20 bp, Artificial Sequence
  chemically synthesized
gcttattttttcttttgaga

SEQ ID NO: 156521 - DNA, 20 bp, Artificial Sequence
  chemically synthesized
cttattttttcttttgagac

SEQ ID NO: 156522 - DNA, 20 bp, Artificial Sequence
  chemically synthesized
agagtgagaccctgtctcaa

SEQ ID NO: 156523 - DNA, 20 bp, Artificial Sequence
  chemically synthesized
ttattttttcttttgagaca

SEQ ID NO: 156524 - DNA, 20 bp, Artificial Sequence
  chemically synthesized
tcccgcctgggtgacagagt

SEQ ID NO: 156525 - DNA, 20 bp, Artificial Sequence
  chemically synthesized
cagggtctcactctgtcacc

SEQ ID NO: 156526 - DNA, 20 bp, Artificial Sequence
  chemically synthesized
gctctcccgcctgggtgaca

SEQ ID NO: 156527 - DNA, 20 bp, Artificial Sequence
  chemically synthesized
agggtctcactctgtcaccc

SEQ ID NO: 156528 - DNA, 20 bp, Artificial Sequence
  chemically synthesized
ctgctctcccgcctgggtga

SEQ ID NO: 156529 - DNA, 20 bp, Artificial Sequence
  chemically synthesized
gtctcactctgtcacccagg

SEQ ID NO: 156530 - DNA, 20 bp, Artificial Sequence
  chemically synthesized
tctcactctgtcacccaggc

SEQ ID NO: 156531 - DNA, 20 bp, Artificial Sequence
  chemically synthesized
tcactctgtcacccaggcgg

SEQ ID NO: 156532 - DNA, 20 bp, Artificial Sequence
  chemically synthesized
ttgccactgctctcccgcct

SEQ ID NO: 156533 - DNA, 20 bp, Artificial Sequence
  chemically synthesized
actctgtcacccaggcggga

SEQ ID NO: 156534 - DNA, 20 bp, Artificial Sequence
  chemically synthesized
cttgccactgctctcccgcc

SEQ ID NO: 156535 - DNA, 20 bp, Artificial Sequence
  chemically synthesized
ctgtcacccaggcgggagag

SEQ ID NO: 156536 - DNA, 20 bp, Artificial Sequence
  chemically synthesized
tcacccaggcgggagagcag

SEQ ID NO: 156537 - DNA, 20 bp, Artificial Sequence
  chemically synthesized
ccaggcgggagagcagtggc

SEQ ID NO: 156538 - DNA, 20 bp, Artificial Sequence
  chemically synthesized
ggagagcagtggcaagatct

SEQ ID NO: 156539 - DNA, 20 bp, Artificial Sequence
  chemically synthesized
agtcgaggctgcagtgagcc

SEQ ID NO: 156540 - DNA, 20 bp, Artificial Sequence
  chemically synthesized
ggcaagatctcggctcactg

SEQ ID NO: 156541 - DNA, 20 bp, Artificial Sequence
  chemically synthesized
taggaagtcgaggctgcagt

SEQ ID NO: 156542 - DNA, 20 bp, Artificial Sequence
  chemically synthesized
tgcctaggaagtcgaggctg

SEQ ID NO: 156543 - DNA, 20 bp, Artificial Sequence
  chemically synthesized
gaggattgcctaggaagtcg

SEQ ID NO: 156544 - DNA, 20 bp, Artificial Sequence
  chemically synthesized
tcactgcagcctcgacttcc

SEQ ID NO: 156545 - DNA, 20 bp, Artificial Sequence
  chemically synthesized
ggaggattgcctaggaagtc

SEQ ID NO: 156546 - DNA, 20 bp, Artificial Sequence
  chemically synthesized
cactgcagcctcgacttcct

SEQ ID NO: 156547 - DNA, 20 bp, Artificial Sequence
  chemically synthesized
aggtgggaggattgcctagg

SEQ ID NO: 156548 - DNA, 20 bp, Artificial Sequence
  chemically synthesized
ctgaggtgggaggattgcct

SEQ ID NO: 156549 - DNA, 20 bp, Artificial Sequence
  chemically synthesized
gctgaggtgggaggattgcc

SEQ ID NO: 156550 - DNA, 20 bp, Artificial Sequence
  chemically synthesized
cctaggcaatcctcccacct

SEQ ID NO: 156551 - DNA, 20 bp, Artificial Sequence
  chemically synthesized
actcaggaggctgaggtggg

SEQ ID NO: 156552 - DNA, 20 bp, Artificial Sequence
  chemically synthesized
tactcaggaggctgaggtgg

SEQ ID NO: 156553 - DNA, 20 bp, Artificial Sequence
  chemically synthesized
gctactcaggaggctgaggt

SEQ ID NO: 156554 - DNA, 20 bp, Artificial Sequence
  chemically synthesized
agctactcaggaggctgagg

SEQ ID NO: 156555 - DNA, 20 bp, Artificial Sequence
  chemically synthesized
agtagctactcaggaggctg

SEQ ID NO: 156556 - DNA, 20 bp, Artificial Sequence
  chemically synthesized
gagtagctactcaggaggct

SEQ ID NO: 156557 - DNA, 20 bp, Artificial Sequence
  chemically synthesized
tcctcccacctcagcctcct

SEQ ID NO: 156558 - DNA, 20 bp, Artificial Sequence
  chemically synthesized
tcccacctcagcctcctgag

SEQ ID NO: 156559 - DNA, 20 bp, Artificial Sequence
  chemically synthesized
gtactgagtagctactcagg

SEQ ID NO: 156560 - DNA, 20 bp, Artificial Sequence
  chemically synthesized
agtactgagtagctactcag

SEQ ID NO: 156561 - DNA, 20 bp, Artificial Sequence
  chemically synthesized
gtagtactgagtagctactc

SEQ ID NO: 156562 - DNA, 20 bp, Artificial Sequence
  chemically synthesized
agtagtactgagtagctact

SEQ ID NO: 156563 - DNA, 20 bp, Artificial Sequence
  chemically synthesized
cagcctcctgagtagctact

SEQ ID NO: 156564 - DNA, 20 bp, Artificial Sequence
  chemically synthesized
tactcagtagtagtactgag

SEQ ID NO: 156565 - DNA, 20 bp, Artificial Sequence
  chemically synthesized
tactactcagtagtagtact

SEQ ID NO: 156566 - DNA, 20 bp, Artificial Sequence
  chemically synthesized
agctactcagtactactact

SEQ ID NO: 156567 - DNA, 20 bp, Artificial Sequence
  chemically synthesized
tcagtagtactactcagtag

SEQ ID NO: 156568 - DNA, 20 bp, Artificial Sequence
  chemically synthesized
tactcagtactactactgag

SEQ ID NO: 156569 - DNA, 20 bp, Artificial Sequence
  chemically synthesized
tactcagtagtactactcag

SEQ ID NO: 156570 - DNA, 20 bp, Artificial Sequence
  chemically synthesized
atgtactcagtagtactact

SEQ ID NO: 156571 - DNA, 20 bp, Artificial Sequence
  chemically synthesized
tactactgagtagtactact

SEQ ID NO: 156572 - DNA, 20 bp, Artificial Sequence
  chemically synthesized
ataaaaatgtatgtactcag

SEQ ID NO: 156573 - DNA, 20 bp, Artificial Sequence
  chemically synthesized
tacataaaaatgtatgtact

SEQ ID NO: 156574 - DNA, 20 bp, Artificial Sequence
  chemically synthesized
tgagtacatacatttttatg

SEQ ID NO: 156575 - DNA, 20 bp, Artificial Sequence
  chemically synthesized
agtacatacatttttatgta

SEQ ID NO: 156576 - DNA, 20 bp, Artificial Sequence
  chemically synthesized
catacatttttatgtagaga

SEQ ID NO: 156577 - DNA, 20 bp, Artificial Sequence
  chemically synthesized
atacatttttatgtagagac

SEQ ID NO: 156578 - DNA, 20 bp, Artificial Sequence
  chemically synthesized
tacatttttatgtagagacg

SEQ ID NO: 156579 - DNA, 20 bp, Artificial Sequence
  chemically synthesized
cggggttttgccatgttgcc

SEQ ID NO: 156580 - DNA, 20 bp, Artificial Sequence
  chemically synthesized
tgagaccagcctgggcaaca

SEQ ID NO: 156581 - DNA, 20 bp, Artificial Sequence
  chemically synthesized
ggggttttgccatgttgccc

SEQ ID NO: 156582 - DNA, 20 bp, Artificial Sequence
  chemically synthesized
ttttgccatgttgcccaggc

SEQ ID NO: 156583 - DNA, 20 bp, Artificial Sequence
  chemically synthesized
caggagtttgagaccagcct

SEQ ID NO: 156584 - DNA, 20 bp, Artificial Sequence
  chemically synthesized
ccaggagtttgagaccagcc

SEQ ID NO: 156585 - DNA, 20 bp, Artificial Sequence
  chemically synthesized
ggagtccaggagtttgagac

SEQ ID NO: 156586 - DNA, 20 bp, Artificial Sequence
  chemically synthesized
ccaggctggtctcaaactcc

SEQ ID NO: 156587 - DNA, 20 bp, Artificial Sequence
  chemically synthesized
tcactggagtccaggagttt

SEQ ID NO: 156588 - DNA, 20 bp, Artificial Sequence
  chemically synthesized
ggcagatcactggagtccag

SEQ ID NO: 156589 - DNA, 20 bp, Artificial Sequence
  chemically synthesized
ggtctcaaactcctggactc

SEQ ID NO: 156590 - DNA, 20 bp, Artificial Sequence
  chemically synthesized
tgggcagatcactggagtcc

SEQ ID NO: 156591 - DNA, 20 bp, Artificial Sequence
  chemically synthesized
atgggcagatcactggagtc

SEQ ID NO: 156592 - DNA, 20 bp, Artificial Sequence
  chemically synthesized
ctgggatgggcagatcactg

SEQ ID NO: 156593 - DNA, 20 bp, Artificial Sequence
  chemically synthesized
ggctgggatgggcagatcac

SEQ ID NO: 156594 - DNA, 20 bp, Artificial Sequence
  chemically synthesized
ctccagtgatctgcccatcc

SEQ ID NO: 156595 - DNA, 20 bp, Artificial Sequence
  chemically synthesized
ctttgggaggctgggatggg

SEQ ID NO: 156596 - DNA, 20 bp, Artificial Sequence
  chemically synthesized
gcgctttgggaggctgggat

SEQ ID NO: 156597 - DNA, 20 bp, Artificial Sequence
  chemically synthesized
agcgctttgggaggctggga

SEQ ID NO: 156598 - DNA, 20 bp, Artificial Sequence
  chemically synthesized
ttccagcgctttgggaggct

SEQ ID NO: 156599 - DNA, 20 bp, Artificial Sequence
  chemically synthesized
attccagcgctttgggaggc

SEQ ID NO: 156600 - DNA, 20 bp, Artificial Sequence
  chemically synthesized
ctgcccatcccagcctccca

SEQ ID NO: 156601 - DNA, 20 bp, Artificial Sequence
  chemically synthesized
tgtaattccagcgctttggg

SEQ ID NO: 156602 - DNA, 20 bp, Artificial Sequence
  chemically synthesized
ctgtaattccagcgctttgg

SEQ ID NO: 156603 - DNA, 20 bp, Artificial Sequence
  chemically synthesized
atcccagcctcccaaagcgc

SEQ ID NO: 156604 - DNA, 20 bp, Artificial Sequence
  chemically synthesized
acctgtaattccagcgcttt

SEQ ID NO: 156605 - DNA, 20 bp, Artificial Sequence
  chemically synthesized
cacctgtaattccagcgctt

SEQ ID NO: 156606 - DNA, 20 bp, Artificial Sequence
  chemically synthesized
ctcccaaagcgctggaatta

SEQ ID NO: 156607 - DNA, 20 bp, Artificial Sequence
  chemically synthesized
tcccaaagcgctggaattac

SEQ ID NO: 156608 - DNA, 20 bp, Artificial Sequence
  chemically synthesized
gtggctcacacctgtaattc

SEQ ID NO: 156609 - DNA, 20 bp, Artificial Sequence
  chemically synthesized
agcgctggaattacaggtgt

SEQ ID NO: 156610 - DNA, 20 bp, Artificial Sequence
  chemically synthesized
caggtgtgagccaccacacc

SEQ ID NO: 156611 - DNA, 20 bp, Artificial Sequence
  chemically synthesized
cctaataaggctgggtgtgg

SEQ ID NO: 156612 - DNA, 20 bp, Artificial Sequence
  chemically synthesized
aagcctaataaggctgggtg

SEQ ID NO: 156613 - DNA, 20 bp, Artificial Sequence
  chemically synthesized
tataaaagcctaataaggct

SEQ ID NO: 156614 - DNA, 20 bp, Artificial Sequence
  chemically synthesized
gccaccacacccagccttat

SEQ ID NO: 156615 - DNA, 20 bp, Artificial Sequence
  chemically synthesized
ttataaaagcctaataaggc

SEQ ID NO: 156616 - DNA, 20 bp, Artificial Sequence
  chemically synthesized
ccaccacacccagccttatt

SEQ ID NO: 156617 - DNA, 20 bp, Artificial Sequence
  chemically synthesized
ggatttataaaagcctaata

SEQ ID NO: 156618 - DNA, 20 bp, Artificial Sequence
  chemically synthesized
aggatttataaaagcctaat

SEQ ID NO: 156619 - DNA, 20 bp, Artificial Sequence
  chemically synthesized
gtttggttcaggatttataa

SEQ ID NO: 156620 - DNA, 20 bp, Artificial Sequence
  chemically synthesized
ttttaaatacagtttggttc

SEQ ID NO: 156621 - DNA, 20 bp, Artificial Sequence
  chemically synthesized
tttttaaatacagtttggtt

SEQ ID NO: 156622 - DNA, 20 bp, Artificial Sequence
  chemically synthesized
attactttttaaatacagtt

SEQ ID NO: 156623 - DNA, 20 bp, Artificial Sequence
  chemically synthesized
atgagattactttttaaata

SEQ ID NO: 156624 - DNA, 20 bp, Artificial Sequence
  chemically synthesized
tgaaccaaactgtatttaaa

SEQ ID NO: 156625 - DNA, 20 bp, Artificial Sequence
  chemically synthesized
gtatttaaaaagtaatctca

SEQ ID NO: 156626 - DNA, 20 bp, Artificial Sequence
  chemically synthesized
taaaaagtaatctcatagac

SEQ ID NO: 156627 - DNA, 20 bp, Artificial Sequence
  chemically synthesized
aaaaagtaatctcatagact

SEQ ID NO: 156628 - DNA, 20 bp, Artificial Sequence
  chemically synthesized
aatttgtgaccctagtctat

SEQ ID NO: 156629 - DNA, 20 bp, Artificial Sequence
  chemically synthesized
aaaagtaatctcatagacta

SEQ ID NO: 156630 - DNA, 20 bp, Artificial Sequence
  chemically synthesized
gggacctgaatttgtgaccc

SEQ ID NO: 156631 - DNA, 20 bp, Artificial Sequence
  chemically synthesized
atagactagggtcacaaatt

SEQ ID NO: 156632 - DNA, 20 bp, Artificial Sequence
  chemically synthesized
tagactagggtcacaaattc

SEQ ID NO: 156633 - DNA, 20 bp, Artificial Sequence
  chemically synthesized
gtcacaaattcaggtcccta

SEQ ID NO: 156634 - DNA, 20 bp, Artificial Sequence
  chemically synthesized
tcacaaattcaggtccctat

SEQ ID NO: 156635 - DNA, 20 bp, Artificial Sequence
  chemically synthesized
cacaaattcaggtccctata

SEQ ID NO: 156636 - DNA, 20 bp, Artificial Sequence
  chemically synthesized
gttacaacctagtccctata

SEQ ID NO: 156637 - DNA, 20 bp, Artificial Sequence
  chemically synthesized
tgttacaacctagtccctat

SEQ ID NO: 156638 - DNA, 20 bp, Artificial Sequence
  chemically synthesized
attcaggtccctatagggac

SEQ ID NO: 156639 - DNA, 20 bp, Artificial Sequence
  chemically synthesized
ttgttacaacctagtcccta

SEQ ID NO: 156640 - DNA, 20 bp, Artificial Sequence
  chemically synthesized
ttcaggtccctatagggact

SEQ ID NO: 156641 - DNA, 20 bp, Artificial Sequence
  chemically synthesized
ttcttccctttgttacaacc

SEQ ID NO: 156642 - DNA, 20 bp, Artificial Sequence
  chemically synthesized
atagggactaggttgtaaca

SEQ ID NO: 156643 - DNA, 20 bp, Artificial Sequence
  chemically synthesized
tagggactaggttgtaacaa

SEQ ID NO: 156644 - DNA, 20 bp, Artificial Sequence
  chemically synthesized
agggactaggttgtaacaaa

SEQ ID NO: 156645 - DNA, 20 bp, Artificial Sequence
  chemically synthesized
gactaggttgtaacaaaggg

SEQ ID NO: 156646 - DNA, 20 bp, Artificial Sequence
  chemically synthesized
gttgtaacaaagggaagaat

SEQ ID NO: 156647 - DNA, 20 bp, Artificial Sequence
  chemically synthesized
atagctctctgatttagaca

SEQ ID NO: 156648 - DNA, 20 bp, Artificial Sequence
  chemically synthesized
tatagctctctgatttagac

SEQ ID NO: 156649 - DNA, 20 bp, Artificial Sequence
  chemically synthesized
agaataagccttgtctaaat

SEQ ID NO: 156650 - DNA, 20 bp, Artificial Sequence
  chemically synthesized
aataagccttgtctaaatca

SEQ ID NO: 156651 - DNA, 20 bp, Artificial Sequence
  chemically synthesized
taagccttgtctaaatcaga

SEQ ID NO: 156652 - DNA, 20 bp, Artificial Sequence
  chemically synthesized
gaagttatagctctctgatt

SEQ ID NO: 156653 - DNA, 20 bp, Artificial Sequence
  chemically synthesized
aaatcagagagctataactt

SEQ ID NO: 156654 - DNA, 20 bp, Artificial Sequence
  chemically synthesized
agcagccacatctgaagtta

SEQ ID NO: 156655 - DNA, 20 bp, Artificial Sequence
  chemically synthesized
gagagctataacttcagatg

SEQ ID NO: 156656 - DNA, 20 bp, Artificial Sequence
  chemically synthesized
gcagtcagcagccacatctg

SEQ ID NO: 156657 - DNA, 20 bp, Artificial Sequence
  chemically synthesized
acctttctgttggcagtcag

SEQ ID NO: 156658 - DNA, 20 bp, Artificial Sequence
  chemically synthesized
cccacctttctgttggcagt

SEQ ID NO: 156659 - DNA, 20 bp, Artificial Sequence
  chemically synthesized
atgtggctgctgactgccaa

SEQ ID NO: 156660 - DNA, 20 bp, Artificial Sequence
  chemically synthesized
tatgcccacctttctgttgg

SEQ ID NO: 156661 - DNA, 20 bp, Artificial Sequence
  chemically synthesized
ggctgctgactgccaacaga

SEQ ID NO: 156662 - DNA, 20 bp, Artificial Sequence
  chemically synthesized
gctgctgactgccaacagaa

SEQ ID NO: 156663 - DNA, 20 bp, Artificial Sequence
  chemically synthesized
acttatgcccacctttctgt

SEQ ID NO: 156664 - DNA, 20 bp, Artificial Sequence
  chemically synthesized
gctgactgccaacagaaagg

SEQ ID NO: 156665 - DNA, 20 bp, Artificial Sequence
  chemically synthesized
ctgactgccaacagaaaggt

SEQ ID NO: 156666 - DNA, 20 bp, Artificial Sequence
  chemically synthesized
gccaacagaaaggtgggcat

SEQ ID NO: 156667 - DNA, 20 bp, Artificial Sequence
  chemically synthesized
aaaggtgggcataagttaaa

SEQ ID NO: 156668 - DNA, 20 bp, Artificial Sequence
  chemically synthesized
ataagttaaaaagcaaaaca

SEQ ID NO: 156669 - DNA, 20 bp, Artificial Sequence
  chemically synthesized
gtgagggaatatgatcagca

SEQ ID NO: 156670 - DNA, 20 bp, Artificial Sequence
  chemically synthesized
ggtgagggaatatgatcagc

SEQ ID NO: 156671 - DNA, 20 bp, Artificial Sequence
  chemically synthesized
tggtgagggaatatgatcag

SEQ ID NO: 156672 - DNA, 20 bp, Artificial Sequence
  chemically synthesized
cactggtgagggaatatgat

SEQ ID NO: 156673 - DNA, 20 bp, Artificial Sequence
  chemically synthesized
tgctgatcatattccctcac

SEQ ID NO: 156674 - DNA, 20 bp, Artificial Sequence
  chemically synthesized
tctccggtatacactggtga

SEQ ID NO: 156675 - DNA, 20 bp, Artificial Sequence
  chemically synthesized
ttctccggtatacactggtg

SEQ ID NO: 156676 - DNA, 20 bp, Artificial Sequence
  chemically synthesized
cttctccggtatacactggt

SEQ ID NO: 156677 - DNA, 20 bp, Artificial Sequence
  chemically synthesized
gaaacttctccggtatacac

SEQ ID NO: 156678 - DNA, 20 bp, Artificial Sequence
  chemically synthesized
attccctcaccagtgtatac

SEQ ID NO: 156679 - DNA, 20 bp, Artificial Sequence
  chemically synthesized
tccctcaccagtgtataccg

SEQ ID NO: 156680 - DNA, 20 bp, Artificial Sequence
  chemically synthesized
ctcaccagtgtataccggag

SEQ ID NO: 156681 - DNA, 20 bp, Artificial Sequence
  chemically synthesized
gaatgtgagagaaacttctc

SEQ ID NO: 156682 - DNA, 20 bp, Artificial Sequence
  chemically synthesized
ttatgaccttaagaatgtga

SEQ ID NO: 156683 - DNA, 20 bp, Artificial Sequence
  chemically synthesized
ccttatgaccttaagaatgt

SEQ ID NO: 156684 - DNA, 20 bp, Artificial Sequence
  chemically synthesized
gaagtttctctcacattctt

SEQ ID NO: 156685 - DNA, 20 bp, Artificial Sequence
  chemically synthesized
aagtttctctcacattctta

SEQ ID NO: 156686 - DNA, 20 bp, Artificial Sequence
  chemically synthesized
ttgtacttccttatgacctt

SEQ ID NO: 156687 - DNA, 20 bp, Artificial Sequence
  chemically synthesized
tctcacattcttaaggtcat

SEQ ID NO: 156688 - DNA, 20 bp, Artificial Sequence
  chemically synthesized
ctcacattcttaaggtcata

SEQ ID NO: 156689 - DNA, 20 bp, Artificial Sequence
  chemically synthesized
acattcttaaggtcataagg

SEQ ID NO: 156690 - DNA, 20 bp, Artificial Sequence
  chemically synthesized
ttaaggtcataaggaagtac

SEQ ID NO: 156691 - DNA, 20 bp, Artificial Sequence
  chemically synthesized
ggtcataaggaagtacaaga

SEQ ID NO: 156692 - DNA, 20 bp, Artificial Sequence
  chemically synthesized
gaaagtttgttgctgcattg

SEQ ID NO: 156693 - DNA, 20 bp, Artificial Sequence
  chemically synthesized
aaagtttgttgctgcattgt

SEQ ID NO: 156694 - DNA, 20 bp, Artificial Sequence
  chemically synthesized
aagtttgttgctgcattgtg

SEQ ID NO: 156695 - DNA, 20 bp, Artificial Sequence
  chemically synthesized
ggcctcaattccccacaatg

SEQ ID NO: 156696 - DNA, 20 bp, Artificial Sequence
  chemically synthesized
ttgctgcattgtggggaatt

SEQ ID NO: 156697 - DNA, 20 bp, Artificial Sequence
  chemically synthesized
tgctgcattgtggggaattg

SEQ ID NO: 156698 - DNA, 20 bp, Artificial Sequence
  chemically synthesized
gtggggaattgaggccaaca

SEQ ID NO: 156699 - DNA, 20 bp, Artificial Sequence
  chemically synthesized
tggggaattgaggccaacat

SEQ ID NO: 156700 - DNA, 20 bp, Artificial Sequence
  chemically synthesized
tttcacatacatacccatgt

SEQ ID NO: 156701 - DNA, 20 bp, Artificial Sequence
  chemically synthesized
caacatgggtatgtatgtga

SEQ ID NO: 156702 - DNA, 20 bp, Artificial Sequence
  chemically synthesized
gggtatgtatgtgaaagaaa

SEQ ID NO: 156703 - DNA, 20 bp, Artificial Sequence
  chemically synthesized
tgtatgtgaaagaaatggat

SEQ ID NO: 156704 - DNA, 20 bp, Artificial Sequence
  chemically synthesized
gtatgtgaaagaaatggata

SEQ ID NO: 156705 - DNA, 20 bp, Artificial Sequence
  chemically synthesized
tatgtgaaagaaatggataa

SEQ ID NO: 156706 - DNA, 20 bp, Artificial Sequence
  chemically synthesized
gaaatggataagggtatatg

SEQ ID NO: 156707 - DNA, 20 bp, Artificial Sequence
  chemically synthesized
aatggataagggtatatgta

SEQ ID NO: 156708 - DNA, 20 bp, Artificial Sequence
  chemically synthesized
agggtatatgtagagcaatg

SEQ ID NO: 156709 - DNA, 20 bp, Artificial Sequence
  chemically synthesized
tatatgtagagcaatgtgga

SEQ ID NO: 156710 - DNA, 20 bp, Artificial Sequence
  chemically synthesized
aactccatctaaaaaaaaaa

SEQ ID NO: 156711 - DNA, 20 bp, Artificial Sequence
  chemically synthesized
atttttttcttttttttttt

SEQ ID NO: 156712 - DNA, 20 bp, Artificial Sequence
  chemically synthesized
ttttcttttttttttttaga

SEQ ID NO: 156713 - DNA, 20 bp, Artificial Sequence
  chemically synthesized
ttcttttttttttttagatg

SEQ ID NO: 156714 - DNA, 20 bp, Artificial Sequence
  chemically synthesized
cattccagccagggcaacaa

SEQ ID NO: 156715 - DNA, 20 bp, Artificial Sequence
  chemically synthesized
gagtttcactgttgttgccc

SEQ ID NO: 156716 - DNA, 20 bp, Artificial Sequence
  chemically synthesized
ttcactgttgttgccctggc

SEQ ID NO: 156717 - DNA, 20 bp, Artificial Sequence
  chemically synthesized
tcaccactgcattccagcca

SEQ ID NO: 156718 - DNA, 20 bp, Artificial Sequence
  chemically synthesized
ctcaccactgcattccagcc

SEQ ID NO: 156719 - DNA, 20 bp, Artificial Sequence
  chemically synthesized
tctcaccactgcattccagc

SEQ ID NO: 156720 - DNA, 20 bp, Artificial Sequence
  chemically synthesized
ttgttgccctggctggaatg

SEQ ID NO: 156721 - DNA, 20 bp, Artificial Sequence
  chemically synthesized
aagatctcaccactgcattc

SEQ ID NO: 156722 - DNA, 20 bp, Artificial Sequence
  chemically synthesized
ttgccctggctggaatgcag

SEQ ID NO: 156723 - DNA, 20 bp, Artificial Sequence
  chemically synthesized
cctggctggaatgcagtggt

SEQ ID NO: 156724 - DNA, 20 bp, Artificial Sequence
  chemically synthesized
ggaatgcagtggtgagatct

SEQ ID NO: 156725 - DNA, 20 bp, Artificial Sequence
  chemically synthesized
ggcaaaggttgcagtgagcc

SEQ ID NO: 156726 - DNA, 20 bp, Artificial Sequence
  chemically synthesized
caggaggcaaaggttgcagt

SEQ ID NO: 156727 - DNA, 20 bp, Artificial Sequence
  chemically synthesized
aacccaggaggcaaaggttg

SEQ ID NO: 156728 - DNA, 20 bp, Artificial Sequence
  chemically synthesized
cacttgaacccaggaggcaa

SEQ ID NO: 156729 - DNA, 20 bp, Artificial Sequence
  chemically synthesized
tcactgcaacctttgcctcc

SEQ ID NO: 156730 - DNA, 20 bp, Artificial Sequence
  chemically synthesized
tcacttgaacccaggaggca

SEQ ID NO: 156731 - DNA, 20 bp, Artificial Sequence
  chemically synthesized
cactgcaacctttgcctcct

SEQ ID NO: 156732 - DNA, 20 bp, Artificial Sequence
  chemically synthesized
gagaatcacttgaacccagg

SEQ ID NO: 156733 - DNA, 20 bp, Artificial Sequence
  chemically synthesized
ggagaatcacttgaacccag

SEQ ID NO: 156734 - DNA, 20 bp, Artificial Sequence
  chemically synthesized
aacctttgcctcctgggttc

SEQ ID NO: 156735 - DNA, 20 bp, Artificial Sequence
  chemically synthesized
caggagaatcacttgaaccc

SEQ ID NO: 156736 - DNA, 20 bp, Artificial Sequence
  chemically synthesized
gcaggagaatcacttgaacc

SEQ ID NO: 156737 - DNA, 20 bp, Artificial Sequence
  chemically synthesized
ttcaagtgattctcctgcct

SEQ ID NO: 156738 - DNA, 20 bp, Artificial Sequence
  chemically synthesized
ctaccgggaggctgaggcag

SEQ ID NO: 156739 - DNA, 20 bp, Artificial Sequence
  chemically synthesized
agctaccgggaggctgaggc

SEQ ID NO: 156740 - DNA, 20 bp, Artificial Sequence
  chemically synthesized
cagctaccgggaggctgagg

SEQ ID NO: 156741 - DNA, 20 bp, Artificial Sequence
  chemically synthesized
tcccagctaccgggaggctg

SEQ ID NO: 156742 - DNA, 20 bp, Artificial Sequence
  chemically synthesized
attctcctgcctcagcctcc

SEQ ID NO: 156743 - DNA, 20 bp, Artificial Sequence
  chemically synthesized
atcccagctaccgggaggct

SEQ ID NO: 156744 - DNA, 20 bp, Artificial Sequence
  chemically synthesized
ctcctgcctcagcctcccgg

SEQ ID NO: 156745 - DNA, 20 bp, Artificial Sequence
  chemically synthesized
ctgtaatcccagctaccggg

SEQ ID NO: 156746 - DNA, 20 bp, Artificial Sequence
  chemically synthesized
cctgtaatcccagctaccgg

SEQ ID NO: 156747 - DNA, 20 bp, Artificial Sequence
  chemically synthesized
tgcctcagcctcccggtagc

SEQ ID NO: 156748 - DNA, 20 bp, Artificial Sequence
  chemically synthesized
gcctcagcctcccggtagct

SEQ ID NO: 156749 - DNA, 20 bp, Artificial Sequence
  chemically synthesized
agcctgtaatcccagctacc

SEQ ID NO: 156750 - DNA, 20 bp, Artificial Sequence
  chemically synthesized
gagcctgtaatcccagctac

SEQ ID NO: 156751 - DNA, 20 bp, Artificial Sequence
  chemically synthesized
cctcccggtagctgggatta

SEQ ID NO: 156752 - DNA, 20 bp, Artificial Sequence
  chemically synthesized
ctcccggtagctgggattac

SEQ ID NO: 156753 - DNA, 20 bp, Artificial Sequence
  chemically synthesized
gtggtgcgagcctgtaatcc

SEQ ID NO: 156754 - DNA, 20 bp, Artificial Sequence
  chemically synthesized
ttacccgggtgtggtggtgc

SEQ ID NO: 156755 - DNA, 20 bp, Artificial Sequence
  chemically synthesized
caggctcgcaccaccacacc

SEQ ID NO: 156756 - DNA, 20 bp, Artificial Sequence
  chemically synthesized
caaaaattacccgggtgtgg

SEQ ID NO: 156757 - DNA, 20 bp, Artificial Sequence
  chemically synthesized
aggctcgcaccaccacaccc

SEQ ID NO: 156758 - DNA, 20 bp, Artificial Sequence
  chemically synthesized
atacaaaaattacccgggtg

SEQ ID NO: 156759 - DNA, 20 bp, Artificial Sequence
  chemically synthesized
acaaaatacaaaaattaccc

SEQ ID NO: 156760 - DNA, 20 bp, Artificial Sequence
  chemically synthesized
tacaaaatacaaaaattacc

SEQ ID NO: 156761 - DNA, 20 bp, Artificial Sequence
  chemically synthesized
tattttgtatttcaccatgt

SEQ ID NO: 156762 - DNA, 20 bp, Artificial Sequence
  chemically synthesized
ttgtatttcaccatgttggc

SEQ ID NO: 156763 - DNA, 20 bp, Artificial Sequence
  chemically synthesized
tcaaggcagcctggccaaca

SEQ ID NO: 156764 - DNA, 20 bp, Artificial Sequence
  chemically synthesized
tgtatttcaccatgttggcc

SEQ ID NO: 156765 - DNA, 20 bp, Artificial Sequence
  chemically synthesized
gtcaggagttcaaggcagcc

SEQ ID NO: 156766 - DNA, 20 bp, Artificial Sequence
  chemically synthesized
ctgaggtcaggagttcaagg

SEQ ID NO: 156767 - DNA, 20 bp, Artificial Sequence
  chemically synthesized
catctgaggtcaggagttca

SEQ ID NO: 156768 - DNA, 20 bp, Artificial Sequence
  chemically synthesized
tcatctgaggtcaggagttc

SEQ ID NO: 156769 - DNA, 20 bp, Artificial Sequence
  chemically synthesized
ctgccttgaactcctgacct

SEQ ID NO: 156770 - DNA, 20 bp, Artificial Sequence
  chemically synthesized
ggcagatcatctgaggtcag

SEQ ID NO: 156771 - DNA, 20 bp, Artificial Sequence
  chemically synthesized
tgggcagatcatctgaggtc

SEQ ID NO: 156772 - DNA, 20 bp, Artificial Sequence
  chemically synthesized
atgggcagatcatctgaggt

SEQ ID NO: 156773 - DNA, 20 bp, Artificial Sequence
  chemically synthesized
caagatgggcagatcatctg

SEQ ID NO: 156774 - DNA, 20 bp, Artificial Sequence
  chemically synthesized
ccaagatgggcagatcatct

SEQ ID NO: 156775 - DNA, 20 bp, Artificial Sequence
  chemically synthesized
ctcagatgatctgcccatct

SEQ ID NO: 156776 - DNA, 20 bp, Artificial Sequence
  chemically synthesized
cattgggaggccaagatggg

SEQ ID NO: 156777 - DNA, 20 bp, Artificial Sequence
  chemically synthesized
gcacattgggaggccaagat

SEQ ID NO: 156778 - DNA, 20 bp, Artificial Sequence
  chemically synthesized
agcacattgggaggccaaga

SEQ ID NO: 156779 - DNA, 20 bp, Artificial Sequence
  chemically synthesized
tcccagcacattgggaggcc

SEQ ID NO: 156780 - DNA, 20 bp, Artificial Sequence
  chemically synthesized
tgcaatcccagcacattggg

SEQ ID NO: 156781 - DNA, 20 bp, Artificial Sequence
  chemically synthesized
ctgcaatcccagcacattgg

SEQ ID NO: 156782 - DNA, 20 bp, Artificial Sequence
  chemically synthesized
atcttggcctcccaatgtgc

SEQ ID NO: 156783 - DNA, 20 bp, Artificial Sequence
  chemically synthesized
gcctgcaatcccagcacatt

SEQ ID NO: 156784 - DNA, 20 bp, Artificial Sequence
  chemically synthesized
tcttggcctcccaatgtgct

SEQ ID NO: 156785 - DNA, 20 bp, Artificial Sequence
  chemically synthesized
tgcctgcaatcccagcacat

SEQ ID NO: 156786 - DNA, 20 bp, Artificial Sequence
  chemically synthesized
ctcccaatgtgctgggattg

SEQ ID NO: 156787 - DNA, 20 bp, Artificial Sequence
  chemically synthesized
tcccaatgtgctgggattgc

SEQ ID NO: 156788 - DNA, 20 bp, Artificial Sequence
  chemically synthesized
gtggctcatgcctgcaatcc

SEQ ID NO: 156789 - DNA, 20 bp, Artificial Sequence
  chemically synthesized
tgtgctgggattgcaggcat

SEQ ID NO: 156790 - DNA, 20 bp, Artificial Sequence
  chemically synthesized
caggcatgagccactgcgcc

SEQ ID NO: 156791 - DNA, 20 bp, Artificial Sequence
  chemically synthesized
ccacccatggccgggcgcag

SEQ ID NO: 156792 - DNA, 20 bp, Artificial Sequence
  chemically synthesized
gatccacccatggccgggcg

SEQ ID NO: 156793 - DNA, 20 bp, Artificial Sequence
  chemically synthesized
tgagccactgcgcccggcca

SEQ ID NO: 156794 - DNA, 20 bp, Artificial Sequence
  chemically synthesized
gagccactgcgcccggccat

SEQ ID NO: 156795 - DNA, 20 bp, Artificial Sequence
  chemically synthesized
ttaaagatccacccatggcc

SEQ ID NO: 156796 - DNA, 20 bp, Artificial Sequence
  chemically synthesized
tttaaagatccacccatggc

SEQ ID NO: 156797 - DNA, 20 bp, Artificial Sequence
  chemically synthesized
ccactgcgcccggccatggg

SEQ ID NO: 156798 - DNA, 20 bp, Artificial Sequence
  chemically synthesized
gtgttttaaagatccaccca

SEQ ID NO: 156799 - DNA, 20 bp, Artificial Sequence
  chemically synthesized
acattcataattgtgtttta

SEQ ID NO: 156800 - DNA, 20 bp, Artificial Sequence
  chemically synthesized
taaaacacaattatgaatgt

SEQ ID NO: 156801 - DNA, 20 bp, Artificial Sequence
  chemically synthesized
cacaattatgaatgttagaa

SEQ ID NO: 156802 - DNA, 20 bp, Artificial Sequence
  chemically synthesized
ttatgaatgttagaaaagct

SEQ ID NO: 156803 - DNA, 20 bp, Artificial Sequence
  chemically synthesized
tgttagaaaagctaagaaac

SEQ ID NO: 156804 - DNA, 20 bp, Artificial Sequence
  chemically synthesized
gtgctataaatcttgtttct

SEQ ID NO: 156805 - DNA, 20 bp, Artificial Sequence
  chemically synthesized
aagctaagaaacaagattta

SEQ ID NO: 156806 - DNA, 20 bp, Artificial Sequence
  chemically synthesized
acaagatttatagcacaatg

SEQ ID NO: 156807 - DNA, 20 bp, Artificial Sequence
  chemically synthesized
agtatattttaaatttataa

SEQ ID NO: 156808 - DNA, 20 bp, Artificial Sequence
  chemically synthesized
ttttaaaatatattatttat

SEQ ID NO: 156809 - DNA, 20 bp, Artificial Sequence
  chemically synthesized
ttataaataatatattttaa

SEQ ID NO: 156810 - DNA, 20 bp, Artificial Sequence
  chemically synthesized
tataaataatatattttaaa

SEQ ID NO: 156811 - DNA, 20 bp, Artificial Sequence
  chemically synthesized
taatatattttaaaaggata

SEQ ID NO: 156812 - DNA, 20 bp, Artificial Sequence
  chemically synthesized
tatattttaaaaggataaag

SEQ ID NO: 156813 - DNA, 20 bp, Artificial Sequence
  chemically synthesized
atattttaaaaggataaagc

SEQ ID NO: 156814 - DNA, 20 bp, Artificial Sequence
  chemically synthesized
tttaaaaggataaagcagga

SEQ ID NO: 156815 - DNA, 20 bp, Artificial Sequence
  chemically synthesized
aggataaagcaggaaagaaa

SEQ ID NO: 156816 - DNA, 20 bp, Artificial Sequence
  chemically synthesized
ggataaagcaggaaagaaac

SEQ ID NO: 156817 - DNA, 20 bp, Artificial Sequence
  chemically synthesized
aagcaggaaagaaacaggaa

SEQ ID NO: 156818 - DNA, 20 bp, Artificial Sequence
  chemically synthesized
gcaggaaagaaacaggaata

SEQ ID NO: 156819 - DNA, 20 bp, Artificial Sequence
  chemically synthesized
gagatattattgtcacattt

SEQ ID NO: 156820 - DNA, 20 bp, Artificial Sequence
  chemically synthesized
atttcagtaattttgctaat

SEQ ID NO: 156821 - DNA, 20 bp, Artificial Sequence
  chemically synthesized
ggttatgtttaataaccgat

SEQ ID NO: 156822 - DNA, 20 bp, Artificial Sequence
  chemically synthesized
taaaatttaatttatattaa

SEQ ID NO: 156823 - DNA, 20 bp, Artificial Sequence
  chemically synthesized
aatataaaataaactgtgct

SEQ ID NO: 156824 - DNA, 20 bp, Artificial Sequence
  chemically synthesized
attatcttttgttcttagca

SEQ ID NO: 156825 - DNA, 20 bp, Artificial Sequence
  chemically synthesized
ataaactgtgctaagaacaa

SEQ ID NO: 156826 - DNA, 20 bp, Artificial Sequence
  chemically synthesized
tatatattatcttttgttct

SEQ ID NO: 156827 - DNA, 20 bp, Artificial Sequence
  chemically synthesized
taagaacaaaagataatata

SEQ ID NO: 156828 - DNA, 20 bp, Artificial Sequence
  chemically synthesized
aacaaaagataatatatagt

SEQ ID NO: 156829 - DNA, 20 bp, Artificial Sequence
  chemically synthesized
ctgatgatagttaaattagg

SEQ ID NO: 156830 - DNA, 20 bp, Artificial Sequence
  chemically synthesized
gcactgatgatagttaaatt

SEQ ID NO: 156831 - DNA, 20 bp, Artificial Sequence
  chemically synthesized
agcactgatgatagttaaat

SEQ ID NO: 156832 - DNA, 20 bp, Artificial Sequence
  chemically synthesized
cttcctaatttaactatcat

SEQ ID NO: 156833 - DNA, 20 bp, Artificial Sequence
  chemically synthesized
agtctcaagagcactgatga

SEQ ID NO: 156834 - DNA, 20 bp, Artificial Sequence
  chemically synthesized
taactatcatcagtgctctt

SEQ ID NO: 156835 - DNA, 20 bp, Artificial Sequence
  chemically synthesized
cacaatagacatagtctcaa

SEQ ID NO: 156836 - DNA, 20 bp, Artificial Sequence
  chemically synthesized
gacacaatagacatagtctc

SEQ ID NO: 156837 - DNA, 20 bp, Artificial Sequence
  chemically synthesized
gatgtcagacacaatagaca

SEQ ID NO: 156838 - DNA, 20 bp, Artificial Sequence
  chemically synthesized
tgacttgatgtcagacacaa

SEQ ID NO: 156839 - DNA, 20 bp, Artificial Sequence
  chemically synthesized
tgtctattgtgtctgacatc

SEQ ID NO: 156840 - DNA, 20 bp, Artificial Sequence
  chemically synthesized
gccttgatttgacttgatgt

SEQ ID NO: 156841 - DNA, 20 bp, Artificial Sequence
  chemically synthesized
gtctgacatcaagtcaaatc

SEQ ID NO: 156842 - DNA, 20 bp, Artificial Sequence
  chemically synthesized
tctgacatcaagtcaaatca

SEQ ID NO: 156843 - DNA, 20 bp, Artificial Sequence
  chemically synthesized
attctggataaaaacattga

SEQ ID NO: 156844 - DNA, 20 bp, Artificial Sequence
  chemically synthesized
aggctttcaatgtttttatc

SEQ ID NO: 156845 - DNA, 20 bp, Artificial Sequence
  chemically synthesized
aatatttacatcatgcattc

SEQ ID NO: 156846 - DNA, 20 bp, Artificial Sequence
  chemically synthesized
tgcatgatgtaaatatttac

SEQ ID NO: 156847 - DNA, 20 bp, Artificial Sequence
  chemically synthesized
agttacatttattgatatgc

SEQ ID NO: 156848 - DNA, 20 bp, Artificial Sequence
  chemically synthesized
ctgatttttaataaataaaa

SEQ ID NO: 156849 - DNA, 20 bp, Artificial Sequence
  chemically synthesized
cttttttatttattaaaaat

SEQ ID NO: 156850 - DNA, 20 bp, Artificial Sequence
  chemically synthesized
ttttgtttgcttttgggttc

SEQ ID NO: 156851 - DNA, 20 bp, Artificial Sequence
  chemically synthesized
aaaatcagtcttgaacccaa

SEQ ID NO: 156852 - DNA, 20 bp, Artificial Sequence
  chemically synthesized
attattttttgtttgctttt

SEQ ID NO: 156853 - DNA, 20 bp, Artificial Sequence
  chemically synthesized
cattattttttgtttgcttt

SEQ ID NO: 156854 - DNA, 20 bp, Artificial Sequence
  chemically synthesized
caaaaaataatgcctctgat

SEQ ID NO: 156855 - DNA, 20 bp, Artificial Sequence
  chemically synthesized
tggttttcctgactaatcag

SEQ ID NO: 156856 - DNA, 20 bp, Artificial Sequence
  chemically synthesized
gtggttttcctgactaatca

SEQ ID NO: 156857 - DNA, 20 bp, Artificial Sequence
  chemically synthesized
aaataatgcctctgattagt

SEQ ID NO: 156858 - DNA, 20 bp, Artificial Sequence
  chemically synthesized
aataatgcctctgattagtc

SEQ ID NO: 156859 - DNA, 20 bp, Artificial Sequence
  chemically synthesized
gggtggttttcctgactaat

SEQ ID NO: 156860 - DNA, 20 bp, Artificial Sequence
  chemically synthesized
ttagtcaggaaaaccaccct

SEQ ID NO: 156861 - DNA, 20 bp, Artificial Sequence
  chemically synthesized
gtcaggaaaaccacccttgg

SEQ ID NO: 156862 - DNA, 20 bp, Artificial Sequence
  chemically synthesized
tgagtgatgacttccaaggg

SEQ ID NO: 156863 - DNA, 20 bp, Artificial Sequence
  chemically synthesized
ccgtgagtgatgacttccaa

SEQ ID NO: 156864 - DNA, 20 bp, Artificial Sequence
  chemically synthesized
tccgtgagtgatgacttcca

SEQ ID NO: 156865 - DNA, 20 bp, Artificial Sequence
  chemically synthesized
ttccgtgagtgatgacttcc

SEQ ID NO: 156866 - DNA, 20 bp, Artificial Sequence
  chemically synthesized
cccttggaagtcatcactca

SEQ ID NO: 156867 - DNA, 20 bp, Artificial Sequence
  chemically synthesized
ttggaagtcatcactcacgg

SEQ ID NO: 156868 - DNA, 20 bp, Artificial Sequence
  chemically synthesized
gacaggaaaatatcttccgt

SEQ ID NO: 156869 - DNA, 20 bp, Artificial Sequence
  chemically synthesized
ttaggttctgatgtcaggac

SEQ ID NO: 156870 - DNA, 20 bp, Artificial Sequence
  chemically synthesized
tttaggttctgatgtcagga

SEQ ID NO: 156871 - DNA, 20 bp, Artificial Sequence
  chemically synthesized
atattttcctgtcctgacat

SEQ ID NO: 156872 - DNA, 20 bp, Artificial Sequence
  chemically synthesized
agtgtttaggttctgatgtc

SEQ ID NO: 156873 - DNA, 20 bp, Artificial Sequence
  chemically synthesized
tagtgtttaggttctgatgt

SEQ ID NO: 156874 - DNA, 20 bp, Artificial Sequence
  chemically synthesized
atatttaatttttagtgttt

SEQ ID NO: 156875 - DNA, 20 bp, Artificial Sequence
  chemically synthesized
aatatttaatttttagtgtt

SEQ ID NO: 156876 - DNA, 20 bp, Artificial Sequence
  chemically synthesized
ctcttagaatatttaatttt

SEQ ID NO: 156877 - DNA, 20 bp, Artificial Sequence
  chemically synthesized
cactaaaaattaaatattct

SEQ ID NO: 156878 - DNA, 20 bp, Artificial Sequence
  chemically synthesized
ctaaaaattaaatattctaa

SEQ ID NO: 156879 - DNA, 20 bp, Artificial Sequence
  chemically synthesized
aattaaatattctaagagac

SEQ ID NO: 156880 - DNA, 20 bp, Artificial Sequence
  chemically synthesized
tatattactcactagtctct

SEQ ID NO: 156881 - DNA, 20 bp, Artificial Sequence
  chemically synthesized
aaatattctaagagactagt

SEQ ID NO: 156882 - DNA, 20 bp, Artificial Sequence
  chemically synthesized
agatcaaatatattactcac

SEQ ID NO: 156883 - DNA, 20 bp, Artificial Sequence
  chemically synthesized
gagtaatatatttgatcttc

SEQ ID NO: 156884 - DNA, 20 bp, Artificial Sequence
  chemically synthesized
aaacttcacagggaaaccag

SEQ ID NO: 156885 - DNA, 20 bp, Artificial Sequence
  chemically synthesized
cagaaacttcacagggaaac

SEQ ID NO: 156886 - DNA, 20 bp, Artificial Sequence
  chemically synthesized
gatcttctggtttccctgtg

SEQ ID NO: 156887 - DNA, 20 bp, Artificial Sequence
  chemically synthesized
agggttacagaaacttcaca

SEQ ID NO: 156888 - DNA, 20 bp, Artificial Sequence
  chemically synthesized
tagggttacagaaacttcac

SEQ ID NO: 156889 - DNA, 20 bp, Artificial Sequence
  chemically synthesized
gtagggttacagaaacttca

SEQ ID NO: 156890 - DNA, 20 bp, Artificial Sequence
  chemically synthesized
attctgtctttgtagggtta

SEQ ID NO: 156891 - DNA, 20 bp, Artificial Sequence
  chemically synthesized
gaagtttctgtaaccctaca

SEQ ID NO: 156892 - DNA, 20 bp, Artificial Sequence
  chemically synthesized
tttagtattctgtctttgta

SEQ ID NO: 156893 - DNA, 20 bp, Artificial Sequence
  chemically synthesized
tttctgtaaccctacaaaga

SEQ ID NO: 156894 - DNA, 20 bp, Artificial Sequence
  chemically synthesized
ttttagtattctgtctttgt

SEQ ID NO: 156895 - DNA, 20 bp, Artificial Sequence
  chemically synthesized
cttttagtattctgtctttg

SEQ ID NO: 156896 - DNA, 20 bp, Artificial Sequence
  chemically synthesized
ctacaaagacagaatactaa

SEQ ID NO: 156897 - DNA, 20 bp, Artificial Sequence
  chemically synthesized
tgattacttctcattgcttt

SEQ ID NO: 156898 - DNA, 20 bp, Artificial Sequence
  chemically synthesized
gacagaatactaaaagcaat

SEQ ID NO: 156899 - DNA, 20 bp, Artificial Sequence
  chemically synthesized
agaatactaaaagcaatgag

SEQ ID NO: 156900 - DNA, 20 bp, Artificial Sequence
  chemically synthesized
agaagtaatcattctgataa

SEQ ID NO: 156901 - DNA, 20 bp, Artificial Sequence
  chemically synthesized
ctattgctactttctgttat

SEQ ID NO: 156902 - DNA, 20 bp, Artificial Sequence
  chemically synthesized
gtaatcattctgataacaga

SEQ ID NO: 156903 - DNA, 20 bp, Artificial Sequence
  chemically synthesized
atcattctgataacagaaag

SEQ ID NO: 156904 - DNA, 20 bp, Artificial Sequence
  chemically synthesized
ctgataacagaaagtagcaa

SEQ ID NO: 156905 - DNA, 20 bp, Artificial Sequence
  chemically synthesized
tgataacagaaagtagcaat

SEQ ID NO: 156906 - DNA, 20 bp, Artificial Sequence
  chemically synthesized
ataacagaaagtagcaatag

SEQ ID NO: 156907 - DNA, 20 bp, Artificial Sequence
  chemically synthesized
aacatgaaaaacttaaaact

SEQ ID NO: 156908 - DNA, 20 bp, Artificial Sequence
  chemically synthesized
ttaccacatttctcagtttt

SEQ ID NO: 156909 - DNA, 20 bp, Artificial Sequence
  chemically synthesized
aaacttaaaactgagaaatg

SEQ ID NO: 156910 - DNA, 20 bp, Artificial Sequence
  chemically synthesized
actaagattaccacatttct

SEQ ID NO: 156911 - DNA, 20 bp, Artificial Sequence
  chemically synthesized
actgagaaatgtggtaatct

SEQ ID NO: 156912 - DNA, 20 bp, Artificial Sequence
  chemically synthesized
catttcattgataaatgact

SEQ ID NO: 156913 - DNA, 20 bp, Artificial Sequence
  chemically synthesized
aatgaaatgacctttcaaca

SEQ ID NO: 156914 - DNA, 20 bp, Artificial Sequence
  chemically synthesized
agatttcatcccatgttgaa

SEQ ID NO: 156915 - DNA, 20 bp, Artificial Sequence
  chemically synthesized
atgaaatgacctttcaacat

SEQ ID NO: 156916 - DNA, 20 bp, Artificial Sequence
  chemically synthesized
gagatttcatcccatgttga

SEQ ID NO: 156917 - DNA, 20 bp, Artificial Sequence
  chemically synthesized
taaattaaatggtgtaggat

SEQ ID NO: 156918 - DNA, 20 bp, Artificial Sequence
  chemically synthesized
tcctataaattaaatggtgt

SEQ ID NO: 156919 - DNA, 20 bp, Artificial Sequence
  chemically synthesized
ttcctataaattaaatggtg

SEQ ID NO: 156920 - DNA, 20 bp, Artificial Sequence
  chemically synthesized
gtgatttcctataaattaaa

SEQ ID NO: 156921 - DNA, 20 bp, Artificial Sequence
  chemically synthesized
atcctacaccatttaattta

SEQ ID NO: 156922 - DNA, 20 bp, Artificial Sequence
  chemically synthesized
tcctacaccatttaatttat

SEQ ID NO: 156923 - DNA, 20 bp, Artificial Sequence
  chemically synthesized
ctctctatctcagcacatat

SEQ ID NO: 156924 - DNA, 20 bp, Artificial Sequence
  chemically synthesized
tctctctatctcagcacata

SEQ ID NO: 156925 - DNA, 20 bp, Artificial Sequence
  chemically synthesized
ggaaatcacctatatgtgct

SEQ ID NO: 156926 - DNA, 20 bp, Artificial Sequence
  chemically synthesized
atcacctatatgtgctgaga

SEQ ID NO: 156927 - DNA, 20 bp, Artificial Sequence
  chemically synthesized
cacctatatgtgctgagata

SEQ ID NO: 156928 - DNA, 20 bp, Artificial Sequence
  chemically synthesized
cctatatgtgctgagataga

SEQ ID NO: 156929 - DNA, 20 bp, Artificial Sequence
  chemically synthesized
ctctccttttctctctatct

SEQ ID NO: 156930 - DNA, 20 bp, Artificial Sequence
  chemically synthesized
atgtgctgagatagagagaa

SEQ ID NO: 156931 - DNA, 20 bp, Artificial Sequence
  chemically synthesized
tgtgctgagatagagagaaa

SEQ ID NO: 156932 - DNA, 20 bp, Artificial Sequence
  chemically synthesized
tgctgagatagagagaaaag

SEQ ID NO: 156933 - DNA, 20 bp, Artificial Sequence
  chemically synthesized
ctgagatagagagaaaagga

SEQ ID NO: 156934 - DNA, 20 bp, Artificial Sequence
  chemically synthesized
gatagagagaaaaggagaga

SEQ ID NO: 156935 - DNA, 20 bp, Artificial Sequence
  chemically synthesized
gagaaaaggagagatagtga

SEQ ID NO: 156936 - DNA, 20 bp, Artificial Sequence
  chemically synthesized
aaggagagatagtgatagat

SEQ ID NO: 156937 - DNA, 20 bp, Artificial Sequence
  chemically synthesized
aggagagatagtgatagatt

SEQ ID NO: 156938 - DNA, 20 bp, Artificial Sequence
  chemically synthesized
ggagagatagtgatagatta

SEQ ID NO: 156939 - DNA, 20 bp, Artificial Sequence
  chemically synthesized
gggattgatttaaatactgc

SEQ ID NO: 156940 - DNA, 20 bp, Artificial Sequence
  chemically synthesized
ggattgatttaaatactgct

SEQ ID NO: 156941 - DNA, 20 bp, Artificial Sequence
  chemically synthesized
gattgatttaaatactgctg

SEQ ID NO: 156942 - DNA, 20 bp, Artificial Sequence
  chemically synthesized
attgatttaaatactgctgg

SEQ ID NO: 156943 - DNA, 20 bp, Artificial Sequence
  chemically synthesized
aaagatgggcatacccccag

SEQ ID NO: 156944 - DNA, 20 bp, Artificial Sequence
  chemically synthesized
tggaaagatgggcatacccc

SEQ ID NO: 156945 - DNA, 20 bp, Artificial Sequence
  chemically synthesized
tgcttactgagtggaaagat

SEQ ID NO: 156946 - DNA, 20 bp, Artificial Sequence
  chemically synthesized
atgcttactgagtggaaaga

SEQ ID NO: 156947 - DNA, 20 bp, Artificial Sequence
  chemically synthesized
ggtatgcccatctttccact

SEQ ID NO: 156948 - DNA, 20 bp, Artificial Sequence
  chemically synthesized
caatatgcttactgagtgga

SEQ ID NO: 156949 - DNA, 20 bp, Artificial Sequence
  chemically synthesized
tgcccatctttccactcagt

SEQ ID NO: 156950 - DNA, 20 bp, Artificial Sequence
  chemically synthesized
ggggcaatatgcttactgag

SEQ ID NO: 156951 - DNA, 20 bp, Artificial Sequence
  chemically synthesized
tgaggggcaatatgcttact

SEQ ID NO: 156952 - DNA, 20 bp, Artificial Sequence
  chemically synthesized
tcagtaagcatattgcccct

SEQ ID NO: 156953 - DNA, 20 bp, Artificial Sequence
  chemically synthesized
ctctttatcctcattctgag

SEQ ID NO: 156954 - DNA, 20 bp, Artificial Sequence
  chemically synthesized
agcatattgcccctcagaat

SEQ ID NO: 156955 - DNA, 20 bp, Artificial Sequence
  chemically synthesized
tctctttatcctcattctga

SEQ ID NO: 156956 - DNA, 20 bp, Artificial Sequence
  chemically synthesized
gcatattgcccctcagaatg

SEQ ID NO: 156957 - DNA, 20 bp, Artificial Sequence
  chemically synthesized
ctctctttatcctcattctg

SEQ ID NO: 156958 - DNA, 20 bp, Artificial Sequence
  chemically synthesized
tctctctttatcctcattct

SEQ ID NO: 156959 - DNA, 20 bp, Artificial Sequence
  chemically synthesized
tgcccctcagaatgaggata

SEQ ID NO: 156960 - DNA, 20 bp, Artificial Sequence
  chemically synthesized
cccctcagaatgaggataaa

SEQ ID NO: 156961 - DNA, 20 bp, Artificial Sequence
  chemically synthesized
cctcagaatgaggataaaga

SEQ ID NO: 156962 - DNA, 20 bp, Artificial Sequence
  chemically synthesized
atgaggataaagagagatca

SEQ ID NO: 156963 - DNA, 20 bp, Artificial Sequence
  chemically synthesized
aactggtagaaacatagaaa

SEQ ID NO: 156964 - DNA, 20 bp, Artificial Sequence
  chemically synthesized
taagtcaactggtagaaaca

SEQ ID NO: 156965 - DNA, 20 bp, Artificial Sequence
  chemically synthesized
tgctgtttctatgtttctac

SEQ ID NO: 156966 - DNA, 20 bp, Artificial Sequence
  chemically synthesized
gtggaacctaagtcaactgg

SEQ ID NO: 156967 - DNA, 20 bp, Artificial Sequence
  chemically synthesized
tatgtttctaccagttgact

SEQ ID NO: 156968 - DNA, 20 bp, Artificial Sequence
  chemically synthesized
agagtggaacctaagtcaac

SEQ ID NO: 156969 - DNA, 20 bp, Artificial Sequence
  chemically synthesized
atgtttctaccagttgactt

SEQ ID NO: 156970 - DNA, 20 bp, Artificial Sequence
  chemically synthesized
atgagaagagagtggaacct

SEQ ID NO: 156971 - DNA, 20 bp, Artificial Sequence
  chemically synthesized
cttacaccatgagaagagag

SEQ ID NO: 156972 - DNA, 20 bp, Artificial Sequence
  chemically synthesized
atacttacaccatgagaaga

SEQ ID NO: 156973 - DNA, 20 bp, Artificial Sequence
  chemically synthesized
taggttccactctcttctca

SEQ ID NO: 156974 - DNA, 20 bp, Artificial Sequence
  chemically synthesized
agatacttacaccatgagaa

SEQ ID NO: 156975 - DNA, 20 bp, Artificial Sequence
  chemically synthesized
tgagatacttacaccatgag

SEQ ID NO: 156976 - DNA, 20 bp, Artificial Sequence
  chemically synthesized
ccactctcttctcatggtgt

SEQ ID NO: 156977 - DNA, 20 bp, Artificial Sequence
  chemically synthesized
cactgagatacttacaccat

SEQ ID NO: 156978 - DNA, 20 bp, Artificial Sequence
  chemically synthesized
ttctcatggtgtaagtatct

SEQ ID NO: 156979 - DNA, 20 bp, Artificial Sequence
  chemically synthesized
taaagctaactcaaatcact

SEQ ID NO: 156980 - DNA, 20 bp, Artificial Sequence
  chemically synthesized
tgtaagtatctcagtgattt

SEQ ID NO: 156981 - DNA, 20 bp, Artificial Sequence
  chemically synthesized
agtatctcagtgatttgagt

SEQ ID NO: 156982 - DNA, 20 bp, Artificial Sequence
  chemically synthesized
atacatacctttaagtatta

SEQ ID NO: 156983 - DNA, 20 bp, Artificial Sequence
  chemically synthesized
tgagttagctttaatactta

SEQ ID NO: 156984 - DNA, 20 bp, Artificial Sequence
  chemically synthesized
gagttagctttaatacttaa

SEQ ID NO: 156985 - DNA, 20 bp, Artificial Sequence
  chemically synthesized
taagataaatacataccttt

SEQ ID NO: 156986 - DNA, 20 bp, Artificial Sequence
  chemically synthesized
aaaggtatgtatttatctta

SEQ ID NO: 156987 - DNA, 20 bp, Artificial Sequence
  chemically synthesized
tatgtatttatcttacagtc

SEQ ID NO: 156988 - DNA, 20 bp, Artificial Sequence
  chemically synthesized
gcttttagaagctagactgt

SEQ ID NO: 156989 - DNA, 20 bp, Artificial Sequence
  chemically synthesized
gttaatttgcttttagaagc

SEQ ID NO: 156990 - DNA, 20 bp, Artificial Sequence
  chemically synthesized
tcttacagtctagcttctaa

SEQ ID NO: 156991 - DNA, 20 bp, Artificial Sequence
  chemically synthesized
agtggttaatttgcttttag

SEQ ID NO: 156992 - DNA, 20 bp, Artificial Sequence
  chemically synthesized
tgaagtggttaatttgcttt

SEQ ID NO: 156993 - DNA, 20 bp, Artificial Sequence
  chemically synthesized
agcaaattaaccacttcaac

SEQ ID NO: 156994 - DNA, 20 bp, Artificial Sequence
  chemically synthesized
cagttgagacccagttgaag

SEQ ID NO: 156995 - DNA, 20 bp, Artificial Sequence
  chemically synthesized
gcaaattaaccacttcaact

SEQ ID NO: 156996 - DNA, 20 bp, Artificial Sequence
  chemically synthesized
cttcagttgagacccagttg

SEQ ID NO: 156997 - DNA, 20 bp, Artificial Sequence
  chemically synthesized
ccctttcttcagttgagacc

SEQ ID NO: 156998 - DNA, 20 bp, Artificial Sequence
  chemically synthesized
cttcaactgggtctcaactg

SEQ ID NO: 156999 - DNA, 20 bp, Artificial Sequence
  chemically synthesized
aaagcaccctttcttcagtt

SEQ ID NO: 157000 - DNA, 20 bp, Artificial Sequence
  chemically synthesized
aactgggtctcaactgaaga

SEQ ID NO: 157001 - DNA, 20 bp, Artificial Sequence
  chemically synthesized
actgggtctcaactgaagaa

SEQ ID NO: 157002 - DNA, 20 bp, Artificial Sequence
  chemically synthesized
ctgggtctcaactgaagaaa

SEQ ID NO: 157003 - DNA, 20 bp, Artificial Sequence
  chemically synthesized
aattcaaagcaccctttctt

SEQ ID NO: 157004 - DNA, 20 bp, Artificial Sequence
  chemically synthesized
tatgaggaacatgaaattca

SEQ ID NO: 157005 - DNA, 20 bp, Artificial Sequence
  chemically synthesized
tagtgatacagtgttatatg

SEQ ID NO: 157006 - DNA, 20 bp, Artificial Sequence
  chemically synthesized
ttagtgatacagtgttatat

SEQ ID NO: 157007 - DNA, 20 bp, Artificial Sequence
  chemically synthesized
ttttgctctgtttagtgata

SEQ ID NO: 157008 - DNA, 20 bp, Artificial Sequence
  chemically synthesized
tataacactgtatcactaaa

SEQ ID NO: 157009 - DNA, 20 bp, Artificial Sequence
  chemically synthesized
taacactgtatcactaaaca

SEQ ID NO: 157010 - DNA, 20 bp, Artificial Sequence
  chemically synthesized
acatcaatttttgctctgtt

SEQ ID NO: 157011 - DNA, 20 bp, Artificial Sequence
  chemically synthesized
taacttttcttaattttcag

SEQ ID NO: 157012 - DNA, 20 bp, Artificial Sequence
  chemically synthesized
ttaacttttcttaattttca

SEQ ID NO: 157013 - DNA, 20 bp, Artificial Sequence
  chemically synthesized
taacgacacccctgaaaatt

SEQ ID NO: 157014 - DNA, 20 bp, Artificial Sequence
  chemically synthesized
attaacttttcttaattttc

SEQ ID NO: 157015 - DNA, 20 bp, Artificial Sequence
  chemically synthesized
aattaacttttcttaatttt

SEQ ID NO: 157016 - DNA, 20 bp, Artificial Sequence
  chemically synthesized
acacccctgaaaattaagaa

SEQ ID NO: 157017 - DNA, 20 bp, Artificial Sequence
  chemically synthesized
agttaatttacattgtgatt

SEQ ID NO: 157018 - DNA, 20 bp, Artificial Sequence
  chemically synthesized
tttacattgtgatttagaat

SEQ ID NO: 157019 - DNA, 20 bp, Artificial Sequence
  chemically synthesized
acattgtgatttagaatcag

SEQ ID NO: 157020 - DNA, 20 bp, Artificial Sequence
  chemically synthesized
tgatttagaatcagaagtct

SEQ ID NO: 157021 - DNA, 20 bp, Artificial Sequence
  chemically synthesized
gatttagaatcagaagtctt

SEQ ID NO: 157022 - DNA, 20 bp, Artificial Sequence
  chemically synthesized
gtgaattaggaacgaaacct

SEQ ID NO: 157023 - DNA, 20 bp, Artificial Sequence
  chemically synthesized
acaaccagtagtagtgaatt

SEQ ID NO: 157024 - DNA, 20 bp, Artificial Sequence
  chemically synthesized
cacaaccagtagtagtgaat

SEQ ID NO: 157025 - DNA, 20 bp, Artificial Sequence
  chemically synthesized
cgttcctaattcactactac

SEQ ID NO: 157026 - DNA, 20 bp, Artificial Sequence
  chemically synthesized
aaggatcacacaaccagtag

SEQ ID NO: 157027 - DNA, 20 bp, Artificial Sequence
  chemically synthesized
tccaaggatcacacaaccag

SEQ ID NO: 157028 - DNA, 20 bp, Artificial Sequence
  chemically synthesized
ttttccaaggatcacacaac

SEQ ID NO: 157029 - DNA, 20 bp, Artificial Sequence
  chemically synthesized
actactggttgtgtgatcct

SEQ ID NO: 157030 - DNA, 20 bp, Artificial Sequence
  chemically synthesized
gtgacccatctcattttcca

SEQ ID NO: 157031 - DNA, 20 bp, Artificial Sequence
  chemically synthesized
ttgtgtgatccttggaaaat

SEQ ID NO: 157032 - DNA, 20 bp, Artificial Sequence
  chemically synthesized
agtgacccatctcattttcc

SEQ ID NO: 157033 - DNA, 20 bp, Artificial Sequence
  chemically synthesized
gtgatccttggaaaatgaga

SEQ ID NO: 157034 - DNA, 20 bp, Artificial Sequence
  chemically synthesized
tgatccttggaaaatgagat

SEQ ID NO: 157035 - DNA, 20 bp, Artificial Sequence
  chemically synthesized
ggaaaatgagatgggtcact

SEQ ID NO: 157036 - DNA, 20 bp, Artificial Sequence
  chemically synthesized
gtttcaaggatgataaatct

SEQ ID NO: 157037 - DNA, 20 bp, Artificial Sequence
  chemically synthesized
gatttatcatccttgaaaca

SEQ ID NO: 157038 - DNA, 20 bp, Artificial Sequence
  chemically synthesized
attattatatccatgtttca

SEQ ID NO: 157039 - DNA, 20 bp, Artificial Sequence
  chemically synthesized
tattattatatccatgtttc

SEQ ID NO: 157040 - DNA, 20 bp, Artificial Sequence
  chemically synthesized
caacaaagctatgagttagg

SEQ ID NO: 157041 - DNA, 20 bp, Artificial Sequence
  chemically synthesized
taataataccacctaactca

SEQ ID NO: 157042 - DNA, 20 bp, Artificial Sequence
  chemically synthesized
ctccaacaaagctatgagtt

SEQ ID NO: 157043 - DNA, 20 bp, Artificial Sequence
  chemically synthesized
tctccaacaaagctatgagt

SEQ ID NO: 157044 - DNA, 20 bp, Artificial Sequence
  chemically synthesized
agtttctccaacaaagctat

SEQ ID NO: 157045 - DNA, 20 bp, Artificial Sequence
  chemically synthesized
cacctaactcatagctttgt

SEQ ID NO: 157046 - DNA, 20 bp, Artificial Sequence
  chemically synthesized
cctaactcatagctttgttg

SEQ ID NO: 157047 - DNA, 20 bp, Artificial Sequence
  chemically synthesized
ctcgtttagtttctccaaca

SEQ ID NO: 157048 - DNA, 20 bp, Artificial Sequence
  chemically synthesized
ctttgttggagaaactaaac

SEQ ID NO: 157049 - DNA, 20 bp, Artificial Sequence
  chemically synthesized
accatataaaatatctcgtt

SEQ ID NO: 157050 - DNA, 20 bp, Artificial Sequence
  chemically synthesized
actaaacgagatattttata

SEQ ID NO: 157051 - DNA, 20 bp, Artificial Sequence
  chemically synthesized
ttatagtgctttgtagttca

SEQ ID NO: 157052 - DNA, 20 bp, Artificial Sequence
  chemically synthesized
taaaaatgctgtgaactaca

SEQ ID NO: 157053 - DNA, 20 bp, Artificial Sequence
  chemically synthesized
aacaaatttatagtgctttg

SEQ ID NO: 157054 - DNA, 20 bp, Artificial Sequence
  chemically synthesized
atatctaaccaacaaattta

SEQ ID NO: 157055 - DNA, 20 bp, Artificial Sequence
  chemically synthesized
acaaagcactataaatttgt

SEQ ID NO: 157056 - DNA, 20 bp, Artificial Sequence
  chemically synthesized
agcactataaatttgttggt

SEQ ID NO: 157057 - DNA, 20 bp, Artificial Sequence
  chemically synthesized
atattatgcgctgctcaatg

SEQ ID NO: 157058 - DNA, 20 bp, Artificial Sequence
  chemically synthesized
ttctgttttgcttcattgag

SEQ ID NO: 157059 - DNA, 20 bp, Artificial Sequence
  chemically synthesized
atcttctgttttgcttcatt

SEQ ID NO: 157060 - DNA, 20 bp, Artificial Sequence
  chemically synthesized
cgctgctcaatgaagcaaaa

SEQ ID NO: 157061 - DNA, 20 bp, Artificial Sequence
  chemically synthesized
tgctcaatgaagcaaaacag

SEQ ID NO: 157062 - DNA, 20 bp, Artificial Sequence
  chemically synthesized
aagcaaaacagaagatattc

SEQ ID NO: 157063 - DNA, 20 bp, Artificial Sequence
  chemically synthesized
aaacagaagatattcaagaa

SEQ ID NO: 157064 - DNA, 20 bp, Artificial Sequence
  chemically synthesized
aagaaaagttctcattaaaa

SEQ ID NO: 157065 - DNA, 20 bp, Artificial Sequence
  chemically synthesized
tttatcgtaactattttaat

SEQ ID NO: 157066 - DNA, 20 bp, Artificial Sequence
  chemically synthesized
agttacgataaaattttttt

SEQ ID NO: 157067 - DNA, 20 bp, Artificial Sequence
  chemically synthesized
tttttttcagtgctttatta

SEQ ID NO: 157068 - DNA, 20 bp, Artificial Sequence
  chemically synthesized
ttttttcagtgctttattaa

SEQ ID NO: 157069 - DNA, 20 bp, Artificial Sequence
  chemically synthesized
taaaacctagtcctttaata

SEQ ID NO: 157070 - DNA, 20 bp, Artificial Sequence
  chemically synthesized
tcagtgctttattaaaggac

SEQ ID NO: 157071 - DNA, 20 bp, Artificial Sequence
  chemically synthesized
cagtgctttattaaaggact

SEQ ID NO: 157072 - DNA, 20 bp, Artificial Sequence
  chemically synthesized
tttattaaaggactaggttt

SEQ ID NO: 157073 - DNA, 20 bp, Artificial Sequence
  chemically synthesized
ttttctaggtaactaaaacc

SEQ ID NO: 157074 - DNA, 20 bp, Artificial Sequence
  chemically synthesized
aggactaggttttagttacc

SEQ ID NO: 157075 - DNA, 20 bp, Artificial Sequence
  chemically synthesized
gtacaaacatgttattttct

SEQ ID NO: 157076 - DNA, 20 bp, Artificial Sequence
  chemically synthesized
tgtacaaacatgttattttc

SEQ ID NO: 157077 - DNA, 20 bp, Artificial Sequence
  chemically synthesized
gagtttatgtattaataaaa

SEQ ID NO: 157078 - DNA, 20 bp, Artificial Sequence
  chemically synthesized
tagagtttatgtattaataa

SEQ ID NO: 157079 - DNA, 20 bp, Artificial Sequence
  chemically synthesized
attaatacataaactctaaa

SEQ ID NO: 157080 - DNA, 20 bp, Artificial Sequence
  chemically synthesized
gtaaatggacagactattta

SEQ ID NO: 157081 - DNA, 20 bp, Artificial Sequence
  chemically synthesized
gagtaaatggacagactatt

SEQ ID NO: 157082 - DNA, 20 bp, Artificial Sequence
  chemically synthesized
ataatattagagtaaatgga

SEQ ID NO: 157083 - DNA, 20 bp, Artificial Sequence
  chemically synthesized
aaagataatattagagtaaa

SEQ ID NO: 157084 - DNA, 20 bp, Artificial Sequence
  chemically synthesized
gagtgggaaagataatatta

SEQ ID NO: 157085 - DNA, 20 bp, Artificial Sequence
  chemically synthesized
aagagtgggaaagataatat

SEQ ID NO: 157086 - DNA, 20 bp, Artificial Sequence
  chemically synthesized
atctggaaataagagtggga

SEQ ID NO: 157087 - DNA, 20 bp, Artificial Sequence
  chemically synthesized
acctatctggaaataagagt

SEQ ID NO: 157088 - DNA, 20 bp, Artificial Sequence
  chemically synthesized
tacctatctggaaataagag

SEQ ID NO: 157089 - DNA, 20 bp, Artificial Sequence
  chemically synthesized
atctttcccactcttatttc

SEQ ID NO: 157090 - DNA, 20 bp, Artificial Sequence
  chemically synthesized
atttacctatctggaaataa

SEQ ID NO: 157091 - DNA, 20 bp, Artificial Sequence
  chemically synthesized
tcatttacctatctggaaat

SEQ ID NO: 157092 - DNA, 20 bp, Artificial Sequence
  chemically synthesized
ttcccactcttatttccaga

SEQ ID NO: 157093 - DNA, 20 bp, Artificial Sequence
  chemically synthesized
tcccactcttatttccagat

SEQ ID NO: 157094 - DNA, 20 bp, Artificial Sequence
  chemically synthesized
taacccctcatttacctatc

SEQ ID NO: 157095 - DNA, 20 bp, Artificial Sequence
  chemically synthesized
ttatttccagataggtaaat

SEQ ID NO: 157096 - DNA, 20 bp, Artificial Sequence
  chemically synthesized
tatttccagataggtaaatg

SEQ ID NO: 157097 - DNA, 20 bp, Artificial Sequence
  chemically synthesized
atttccagataggtaaatga

SEQ ID NO: 157098 - DNA, 20 bp, Artificial Sequence
  chemically synthesized
tttccagataggtaaatgag

SEQ ID NO: 157099 - DNA, 20 bp, Artificial Sequence
  chemically synthesized
cacctctacattagagatta

SEQ ID NO: 157100 - DNA, 20 bp, Artificial Sequence
  chemically synthesized
ggttactataatctctaatg

SEQ ID NO: 157101 - DNA, 20 bp, Artificial Sequence
  chemically synthesized
ttactataatctctaatgta

SEQ ID NO: 157102 - DNA, 20 bp, Artificial Sequence
  chemically synthesized
aaaaatccacctctacatta

SEQ ID NO: 157103 - DNA, 20 bp, Artificial Sequence
  chemically synthesized
tactataatctctaatgtag

SEQ ID NO: 157104 - DNA, 20 bp, Artificial Sequence
  chemically synthesized
ttaaaaatccacctctacat

SEQ ID NO: 157105 - DNA, 20 bp, Artificial Sequence
  chemically synthesized
tataatctctaatgtagagg

SEQ ID NO: 157106 - DNA, 20 bp, Artificial Sequence
  chemically synthesized
ggtggatttttaaaattaaa

SEQ ID NO: 157107 - DNA, 20 bp, Artificial Sequence
  chemically synthesized
agacatttgtgatacattgg

SEQ ID NO: 157108 - DNA, 20 bp, Artificial Sequence
  chemically synthesized
ctcagacatttgtgatacat

SEQ ID NO: 157109 - DNA, 20 bp, Artificial Sequence
  chemically synthesized
ccaatgtatcacaaatgtct

SEQ ID NO: 157110 - DNA, 20 bp, Artificial Sequence
  chemically synthesized
caatgtatcacaaatgtctg

SEQ ID NO: 157111 - DNA, 20 bp, Artificial Sequence
  chemically synthesized
ttgacccattgcagtgtcct

SEQ ID NO: 157112 - DNA, 20 bp, Artificial Sequence
  chemically synthesized
aatgtctgaggacactgcaa

SEQ ID NO: 157113 - DNA, 20 bp, Artificial Sequence
  chemically synthesized
atgtctgaggacactgcaat

SEQ ID NO: 157114 - DNA, 20 bp, Artificial Sequence
  chemically synthesized
attgaacctttgacccattg

SEQ ID NO: 157115 - DNA, 20 bp, Artificial Sequence
  chemically synthesized
gaggacactgcaatgggtca

SEQ ID NO: 157116 - DNA, 20 bp, Artificial Sequence
  chemically synthesized
aggacactgcaatgggtcaa

SEQ ID NO: 157117 - DNA, 20 bp, Artificial Sequence
  chemically synthesized
caatgggtcaaaggttcaat

SEQ ID NO: 157118 - DNA, 20 bp, Artificial Sequence
  chemically synthesized
ggtcaaaggttcaataagct

SEQ ID NO: 157119 - DNA, 20 bp, Artificial Sequence
  chemically synthesized
attggaaattatacagttct

SEQ ID NO: 157120 - DNA, 20 bp, Artificial Sequence
  chemically synthesized
ataaaagattggaaattata

SEQ ID NO: 157121 - DNA, 20 bp, Artificial Sequence
  chemically synthesized
tgctaataattataaaagat

SEQ ID NO: 157122 - DNA, 20 bp, Artificial Sequence
  chemically synthesized
gtatttgctaataattataa

SEQ ID NO: 157123 - DNA, 20 bp, Artificial Sequence
  chemically synthesized
ttccaatcttttataattat

SEQ ID NO: 157124 - DNA, 20 bp, Artificial Sequence
  chemically synthesized
aaaaactgtagtcatttcat

SEQ ID NO: 157125 - DNA, 20 bp, Artificial Sequence
  chemically synthesized
aaatacttatgaaatgacta

SEQ ID NO: 157126 - DNA, 20 bp, Artificial Sequence
  chemically synthesized
aacagccaaatcaaaaactg

SEQ ID NO: 157127 - DNA, 20 bp, Artificial Sequence
  chemically synthesized
aatgactacagtttttgatt

SEQ ID NO: 157128 - DNA, 20 bp, Artificial Sequence
  chemically synthesized
agcaagattgtttttgtgaa

SEQ ID NO: 157129 - DNA, 20 bp, Artificial Sequence
  chemically synthesized
caaactcttgaaaaagtagc

SEQ ID NO: 157130 - DNA, 20 bp, Artificial Sequence
  chemically synthesized
aacaatcttgctactttttc

SEQ ID NO: 157131 - DNA, 20 bp, Artificial Sequence
  chemically synthesized
acaccaaactcttgaaaaag

SEQ ID NO: 157132 - DNA, 20 bp, Artificial Sequence
  chemically synthesized
caatcttgctactttttcaa

SEQ ID NO: 157133 - DNA, 20 bp, Artificial Sequence
  chemically synthesized
agtacaccaaactcttgaaa

SEQ ID NO: 157134 - DNA, 20 bp, Artificial Sequence
  chemically synthesized
ttgctactttttcaagagtt

SEQ ID NO: 157135 - DNA, 20 bp, Artificial Sequence
  chemically synthesized
ttcaagagtttggtgtactg

SEQ ID NO: 157136 - DNA, 20 bp, Artificial Sequence
  chemically synthesized
caagagtttggtgtactgta

SEQ ID NO: 157137 - DNA, 20 bp, Artificial Sequence
  chemically synthesized
aataatccatttcaactcta

SEQ ID NO: 157138 - DNA, 20 bp, Artificial Sequence
  chemically synthesized
ggtgtactgtagagttgaaa

SEQ ID NO: 157139 - DNA, 20 bp, Artificial Sequence
  chemically synthesized
ggattatttatatattatac

SEQ ID NO: 157140 - DNA, 20 bp, Artificial Sequence
  chemically synthesized
caaaatgaagcaaaacaaaa

SEQ ID NO: 157141 - DNA, 20 bp, Artificial Sequence
  chemically synthesized
gagaagtgaaaagcaaaatg

SEQ ID NO: 157142 - DNA, 20 bp, Artificial Sequence
  chemically synthesized
gcaaatgccagagaagtgaa

SEQ ID NO: 157143 - DNA, 20 bp, Artificial Sequence
  chemically synthesized
cattttgcttttcacttctc

SEQ ID NO: 157144 - DNA, 20 bp, Artificial Sequence
  chemically synthesized
aatatgggcaaatgccagag

SEQ ID NO: 157145 - DNA, 20 bp, Artificial Sequence
  chemically synthesized
gaaaatatgggcaaatgcca

SEQ ID NO: 157146 - DNA, 20 bp, Artificial Sequence
  chemically synthesized
ttgaaaatatgggcaaatgc

SEQ ID NO: 157147 - DNA, 20 bp, Artificial Sequence
  chemically synthesized
gatgagagaattgaaaatat

SEQ ID NO: 157148 - DNA, 20 bp, Artificial Sequence
  chemically synthesized
tgatgagagaattgaaaata

SEQ ID NO: 157149 - DNA, 20 bp, Artificial Sequence
  chemically synthesized
cagcttaattggaatgatga

SEQ ID NO: 157150 - DNA, 20 bp, Artificial Sequence
  chemically synthesized
tacagcttaattggaatgat

SEQ ID NO: 157151 - DNA, 20 bp, Artificial Sequence
  chemically synthesized
attctctcatcattccaatt

SEQ ID NO: 157152 - DNA, 20 bp, Artificial Sequence
  chemically synthesized
aatgaattttacagcttaat

SEQ ID NO: 157153 - DNA, 20 bp, Artificial Sequence
  chemically synthesized
tgttatgcaaatgaatttta

SEQ ID NO: 157154 - DNA, 20 bp, Artificial Sequence
  chemically synthesized
tttgcataacaaaaaatgtt

SEQ ID NO: 157155 - DNA, 20 bp, Artificial Sequence
  chemically synthesized
taacaaaaaatgtttggctg

SEQ ID NO: 157156 - DNA, 20 bp, Artificial Sequence
  chemically synthesized
aaatgtttggctgtagcaac

SEQ ID NO: 157157 - DNA, 20 bp, Artificial Sequence
  chemically synthesized
gaacacctgactagttgcta

SEQ ID NO: 157158 - DNA, 20 bp, Artificial Sequence
  chemically synthesized
gtttggctgtagcaactagt

SEQ ID NO: 157159 - DNA, 20 bp, Artificial Sequence
  chemically synthesized
tttggctgtagcaactagtc

SEQ ID NO: 157160 - DNA, 20 bp, Artificial Sequence
  chemically synthesized
ttatatgatgaacacctgac

SEQ ID NO: 157161 - DNA, 20 bp, Artificial Sequence
  chemically synthesized
ttcatcatataataaaattt

SEQ ID NO: 157162 - DNA, 20 bp, Artificial Sequence
  chemically synthesized
atcatataataaaatttaag

SEQ ID NO: 157163 - DNA, 20 bp, Artificial Sequence
  chemically synthesized
aaaatttaagcagtgctcaa

SEQ ID NO: 157164 - DNA, 20 bp, Artificial Sequence
  chemically synthesized
accttttacagatttctatt

SEQ ID NO: 157165 - DNA, 20 bp, Artificial Sequence
  chemically synthesized
tgctcaatagaaatctgtaa

SEQ ID NO: 157166 - DNA, 20 bp, Artificial Sequence
  chemically synthesized
gctcaatagaaatctgtaaa

SEQ ID NO: 157167 - DNA, 20 bp, Artificial Sequence
  chemically synthesized
ttgcaaattgttacctttta

SEQ ID NO: 157168 - DNA, 20 bp, Artificial Sequence
  chemically synthesized
aatacatgttaatcatctat

SEQ ID NO: 157169 - DNA, 20 bp, Artificial Sequence
  chemically synthesized
gatttccttaaatttgctta

SEQ ID NO: 157170 - DNA, 20 bp, Artificial Sequence
  chemically synthesized
aatcatctataagcaaattt

SEQ ID NO: 157171 - DNA, 20 bp, Artificial Sequence
  chemically synthesized
atcatctataagcaaattta

SEQ ID NO: 157172 - DNA, 20 bp, Artificial Sequence
  chemically synthesized
caaatttaaggaaatcaaat

SEQ ID NO: 157173 - DNA, 20 bp, Artificial Sequence
  chemically synthesized
atttaaataagttgggattt

SEQ ID NO: 157174 - DNA, 20 bp, Artificial Sequence
  chemically synthesized
atacgctatttaaataagtt

SEQ ID NO: 157175 - DNA, 20 bp, Artificial Sequence
  chemically synthesized
gatacgctatttaaataagt

SEQ ID NO: 157176 - DNA, 20 bp, Artificial Sequence
  chemically synthesized
taaatcccaacttatttaaa

SEQ ID NO: 157177 - DNA, 20 bp, Artificial Sequence
  chemically synthesized
cactgatacgctatttaaat

SEQ ID NO: 157178 - DNA, 20 bp, Artificial Sequence
  chemically synthesized
aacttatttaaatagcgtat

SEQ ID NO: 157179 - DNA, 20 bp, Artificial Sequence
  chemically synthesized
ttatttaaatagcgtatcag

SEQ ID NO: 157180 - DNA, 20 bp, Artificial Sequence
  chemically synthesized
tatttaaatagcgtatcagt

SEQ ID NO: 157181 - DNA, 20 bp, Artificial Sequence
  chemically synthesized
atagcgtatcagtgggataa

SEQ ID NO: 157182 - DNA, 20 bp, Artificial Sequence
  chemically synthesized
tcagtgggataatagttatc

SEQ ID NO: 157183 - DNA, 20 bp, Artificial Sequence
  chemically synthesized
atggagatgtagtcaagaat

SEQ ID NO: 157184 - DNA, 20 bp, Artificial Sequence
  chemically synthesized
tatggagatgtagtcaagaa

SEQ ID NO: 157185 - DNA, 20 bp, Artificial Sequence
  chemically synthesized
aaaattatggagatgtagtc

SEQ ID NO: 157186 - DNA, 20 bp, Artificial Sequence
  chemically synthesized
gttttaaaattatggagatg

SEQ ID NO: 157187 - DNA, 20 bp, Artificial Sequence
  chemically synthesized
ttcaaagttttaaaattatg

SEQ ID NO: 157188 - DNA, 20 bp, Artificial Sequence
  chemically synthesized
tattcaaagttttaaaatta

SEQ ID NO: 157189 - DNA, 20 bp, Artificial Sequence
  chemically synthesized
caatttagttagcatattca

SEQ ID NO: 157190 - DNA, 20 bp, Artificial Sequence
  chemically synthesized
ccttggacctgcaatttagt

SEQ ID NO: 157191 - DNA, 20 bp, Artificial Sequence
  chemically synthesized
tgaatatgctaactaaattg

SEQ ID NO: 157192 - DNA, 20 bp, Artificial Sequence
  chemically synthesized
gaatatgctaactaaattgc

SEQ ID NO: 157193 - DNA, 20 bp, Artificial Sequence
  chemically synthesized
aaaaccttggacctgcaatt

SEQ ID NO: 157194 - DNA, 20 bp, Artificial Sequence
  chemically synthesized
gctaactaaattgcaggtcc

SEQ ID NO: 157195 - DNA, 20 bp, Artificial Sequence
  chemically synthesized
ctaactaaattgcaggtcca

SEQ ID NO: 157196 - DNA, 20 bp, Artificial Sequence
  chemically synthesized
agctcttgtgcggaaaacct

SEQ ID NO: 157197 - DNA, 20 bp, Artificial Sequence
  chemically synthesized
aggtccaaggttttccgcac

SEQ ID NO: 157198 - DNA, 20 bp, Artificial Sequence
  chemically synthesized
gtccaaggttttccgcacaa

SEQ ID NO: 157199 - DNA, 20 bp, Artificial Sequence
  chemically synthesized
ttgagtttggagctcttgtg

SEQ ID NO: 157200 - DNA, 20 bp, Artificial Sequence
  chemically synthesized
aattcactctgttgagtttg

SEQ ID NO: 157201 - DNA, 20 bp, Artificial Sequence
  chemically synthesized
cacaagagctccaaactcaa

SEQ ID NO: 157202 - DNA, 20 bp, Artificial Sequence
  chemically synthesized
cgaattcactctgttgagtt

SEQ ID NO: 157203 - DNA, 20 bp, Artificial Sequence
  chemically synthesized
caagagctccaaactcaaca

SEQ ID NO: 157204 - DNA, 20 bp, Artificial Sequence
  chemically synthesized
gaacacgaattcactctgtt

SEQ ID NO: 157205 - DNA, 20 bp, Artificial Sequence
  chemically synthesized
gaattcgtgttctaccaaaa

SEQ ID NO: 157206 - DNA, 20 bp, Artificial Sequence
  chemically synthesized
ccaaagtttatccattttgg

SEQ ID NO: 157207 - DNA, 20 bp, Artificial Sequence
  chemically synthesized
ttcccaaagtttatccattt

SEQ ID NO: 157208 - DNA, 20 bp, Artificial Sequence
  chemically synthesized
ctaccaaaatggataaactt

SEQ ID NO: 157209 - DNA, 20 bp, Artificial Sequence
  chemically synthesized
taccaaaatggataaacttt

SEQ ID NO: 157210 - DNA, 20 bp, Artificial Sequence
  chemically synthesized
tacaaacaaaagaattccca

SEQ ID NO: 157211 - DNA, 20 bp, Artificial Sequence
  chemically synthesized
atttttccatttacaaacaa

SEQ ID NO: 157212 - DNA, 20 bp, Artificial Sequence
  chemically synthesized
ggaattcttttgtttgtaaa

SEQ ID NO: 157213 - DNA, 20 bp, Artificial Sequence
  chemically synthesized
ttgtttgtaaatggaaaaat

SEQ ID NO: 157214 - DNA, 20 bp, Artificial Sequence
  chemically synthesized
tggaaaaatcagatttatta

SEQ ID NO: 157215 - DNA, 20 bp, Artificial Sequence
  chemically synthesized
ggaaaaatcagatttattat

SEQ ID NO: 157216 - DNA, 20 bp, Artificial Sequence
  chemically synthesized
tttattataggtgacttttg

SEQ ID NO: 157217 - DNA, 20 bp, Artificial Sequence
  chemically synthesized
agaataatgctcagctgcaa

SEQ ID NO: 157218 - DNA, 20 bp, Artificial Sequence
  chemically synthesized
tataggtgacttttgcagct

SEQ ID NO: 157219 - DNA, 20 bp, Artificial Sequence
  chemically synthesized
atacaatggagaataatgct

SEQ ID NO: 157220 - DNA, 20 bp, Artificial Sequence
  chemically synthesized
caagcaaagtatatacaatg

SEQ ID NO: 157221 - DNA, 20 bp, Artificial Sequence
  chemically synthesized
ttcaagcaaagtatatacaa

SEQ ID NO: 157222 - DNA, 20 bp, Artificial Sequence
  chemically synthesized
ttaatgaatattttcaagca

SEQ ID NO: 157223 - DNA, 20 bp, Artificial Sequence
  chemically synthesized
aacatttaatgaatattttc

SEQ ID NO: 157224 - DNA, 20 bp, Artificial Sequence
  chemically synthesized
gaaaatattcattaaatgtt

SEQ ID NO: 157225 - DNA, 20 bp, Artificial Sequence
  chemically synthesized
agaaatttcatagtttgata

SEQ ID NO: 157226 - DNA, 20 bp, Artificial Sequence
  chemically synthesized
ttcataaagcagaaatttca

SEQ ID NO: 157227 - DNA, 20 bp, Artificial Sequence
  chemically synthesized
tatgaaatttctgctttatg

SEQ ID NO: 157228 - DNA, 20 bp, Artificial Sequence
  chemically synthesized
aattcctgttcttcataaag

SEQ ID NO: 157229 - DNA, 20 bp, Artificial Sequence
  chemically synthesized
actaattcctgttcttcata

SEQ ID NO: 157230 - DNA, 20 bp, Artificial Sequence
  chemically synthesized
aatttctgctttatgaagaa

SEQ ID NO: 157231 - DNA, 20 bp, Artificial Sequence
  chemically synthesized
atttctgctttatgaagaac

SEQ ID NO: 157232 - DNA, 20 bp, Artificial Sequence
  chemically synthesized
gctttatgaagaacaggaat

SEQ ID NO: 157233 - DNA, 20 bp, Artificial Sequence
  chemically synthesized
gaagaacaggaattagttac

SEQ ID NO: 157234 - DNA, 20 bp, Artificial Sequence
  chemically synthesized
caggaattagttacaagaaa

SEQ ID NO: 157235 - DNA, 20 bp, Artificial Sequence
  chemically synthesized
gaaaaagtgatttctgaata

SEQ ID NO: 157236 - DNA, 20 bp, Artificial Sequence
  chemically synthesized
tttaaaaggaaagctatatt

SEQ ID NO: 157237 - DNA, 20 bp, Artificial Sequence
  chemically synthesized
cattttaaattttaaaagga

SEQ ID NO: 157238 - DNA, 20 bp, Artificial Sequence
  chemically synthesized
tatccattttaaattttaaa

SEQ ID NO: 157239 - DNA, 20 bp, Artificial Sequence
  chemically synthesized
ttatccattttaaattttaa

SEQ ID NO: 157240 - DNA, 20 bp, Artificial Sequence
  chemically synthesized
tttccttttaaaatttaaaa

SEQ ID NO: 157241 - DNA, 20 bp, Artificial Sequence
  chemically synthesized
tttaaaatggataaatattt

SEQ ID NO: 157242 - DNA, 20 bp, Artificial Sequence
  chemically synthesized
ttaaaatggataaatattta

SEQ ID NO: 157243 - DNA, 20 bp, Artificial Sequence
  chemically synthesized
tggataaatatttaaggtga

SEQ ID NO: 157244 - DNA, 20 bp, Artificial Sequence
  chemically synthesized
tgatcaaatcagagtgattg

SEQ ID NO: 157245 - DNA, 20 bp, Artificial Sequence
  chemically synthesized
aatatataatgatcaaatca

SEQ ID NO: 157246 - DNA, 20 bp, Artificial Sequence
  chemically synthesized
ataatatataatgatcaaat

SEQ ID NO: 157247 - DNA, 20 bp, Artificial Sequence
  chemically synthesized
cacaagtgatattttgatac

SEQ ID NO: 157248 - DNA, 20 bp, Artificial Sequence
  chemically synthesized
ttgtatcaaaatatcacttg

SEQ ID NO: 157249 - DNA, 20 bp, Artificial Sequence
  chemically synthesized
caaaatatcacttgtggtaa

SEQ ID NO: 157250 - DNA, 20 bp, Artificial Sequence
  chemically synthesized
tttttccgtccttttaccac

SEQ ID NO: 157251 - DNA, 20 bp, Artificial Sequence
  chemically synthesized
aaaatatcacttgtggtaaa

SEQ ID NO: 157252 - DNA, 20 bp, Artificial Sequence
  chemically synthesized
tatcacttgtggtaaaagga

SEQ ID NO: 157253 - DNA, 20 bp, Artificial Sequence
  chemically synthesized
ttgtggtaaaaggacggaaa

SEQ ID NO: 157254 - DNA, 20 bp, Artificial Sequence
  chemically synthesized
ttttggttcccatttgcatg

SEQ ID NO: 157255 - DNA, 20 bp, Artificial Sequence
  chemically synthesized
aaaaagatactccatgcaaa

SEQ ID NO: 157256 - DNA, 20 bp, Artificial Sequence
  chemically synthesized
aaaagatactccatgcaaat

SEQ ID NO: 157257 - DNA, 20 bp, Artificial Sequence
  chemically synthesized
gcttttggttcccatttgca

SEQ ID NO: 157258 - DNA, 20 bp, Artificial Sequence
  chemically synthesized
tccatgcaaatgggaaccaa

SEQ ID NO: 157259 - DNA, 20 bp, Artificial Sequence
  chemically synthesized
tgcaaatgggaaccaaaagc

SEQ ID NO: 157260 - DNA, 20 bp, Artificial Sequence
  chemically synthesized
tagctactcctgcttgcttt

SEQ ID NO: 157261 - DNA, 20 bp, Artificial Sequence
  chemically synthesized
aaatgggaaccaaaagcaag

SEQ ID NO: 157262 - DNA, 20 bp, Artificial Sequence
  chemically synthesized
aatgggaaccaaaagcaagc

SEQ ID NO: 157263 - DNA, 20 bp, Artificial Sequence
  chemically synthesized
tgggaaccaaaagcaagcag

SEQ ID NO: 157264 - DNA, 20 bp, Artificial Sequence
  chemically synthesized
gaaccaaaagcaagcaggag

SEQ ID NO: 157265 - DNA, 20 bp, Artificial Sequence
  chemically synthesized
cattttgtctgatataagaa

SEQ ID NO: 157266 - DNA, 20 bp, Artificial Sequence
  chemically synthesized
aggagtagctattcttatat

SEQ ID NO: 157267 - DNA, 20 bp, Artificial Sequence
  chemically synthesized
aagcccattttgtctgatat

SEQ ID NO: 157268 - DNA, 20 bp, Artificial Sequence
  chemically synthesized
tattcttatatcagacaaaa

SEQ ID NO: 157269 - DNA, 20 bp, Artificial Sequence
  chemically synthesized
attcttatatcagacaaaat

SEQ ID NO: 157270 - DNA, 20 bp, Artificial Sequence
  chemically synthesized
atcagacaaaatgggcttta

SEQ ID NO: 157271 - DNA, 20 bp, Artificial Sequence
  chemically synthesized
tatttacggttattgcttta

SEQ ID NO: 157272 - DNA, 20 bp, Artificial Sequence
  chemically synthesized
aaagcaataaccgtaaataa

SEQ ID NO: 157273 - DNA, 20 bp, Artificial Sequence
  chemically synthesized
ctttctttatcttttattta

SEQ ID NO: 157274 - DNA, 20 bp, Artificial Sequence
  chemically synthesized
ataaccgtaaataaaagata

SEQ ID NO: 157275 - DNA, 20 bp, Artificial Sequence
  chemically synthesized
ccgtaaataaaagataaaga

SEQ ID NO: 157276 - DNA, 20 bp, Artificial Sequence
  chemically synthesized
aagacattgtataatgataa

SEQ ID NO: 157277 - DNA, 20 bp, Artificial Sequence
  chemically synthesized
agacattgtataatgataaa

SEQ ID NO: 157278 - DNA, 20 bp, Artificial Sequence
  chemically synthesized
ttgtataatgataaaaggat

SEQ ID NO: 157279 - DNA, 20 bp, Artificial Sequence
  chemically synthesized
gataaaaggattagtccaac

SEQ ID NO: 157280 - DNA, 20 bp, Artificial Sequence
  chemically synthesized
aaaaggattagtccaacaag

SEQ ID NO: 157281 - DNA, 20 bp, Artificial Sequence
  chemically synthesized
tgtagtaaatatcttcttgt

SEQ ID NO: 157282 - DNA, 20 bp, Artificial Sequence
  chemically synthesized
caacaagaagatatttacta

SEQ ID NO: 157283 - DNA, 20 bp, Artificial Sequence
  chemically synthesized
tgcatataaattgagtactg

SEQ ID NO: 157284 - DNA, 20 bp, Artificial Sequence
  chemically synthesized
gtgttaggtgcatataaatt

SEQ ID NO: 157285 - DNA, 20 bp, Artificial Sequence
  chemically synthesized
aatttatatgcacctaacac

SEQ ID NO: 157286 - DNA, 20 bp, Artificial Sequence
  chemically synthesized
aagctaggagcaccagtgtt

SEQ ID NO: 157287 - DNA, 20 bp, Artificial Sequence
  chemically synthesized
aaagctaggagcaccagtgt

SEQ ID NO: 157288 - DNA, 20 bp, Artificial Sequence
  chemically synthesized
gcacctaacactggtgctcc

SEQ ID NO: 157289 - DNA, 20 bp, Artificial Sequence
  chemically synthesized
ttttataaagctaggagcac

SEQ ID NO: 157290 - DNA, 20 bp, Artificial Sequence
  chemically synthesized
ctattgttttataaagctag

SEQ ID NO: 157291 - DNA, 20 bp, Artificial Sequence
  chemically synthesized
tactattgttttataaagct

SEQ ID NO: 157292 - DNA, 20 bp, Artificial Sequence
  chemically synthesized
gtactattgttttataaagc

SEQ ID NO: 157293 - DNA, 20 bp, Artificial Sequence
  chemically synthesized
tctagtactattgttttata

SEQ ID NO: 157294 - DNA, 20 bp, Artificial Sequence
  chemically synthesized
ctcctagctttataaaacaa

SEQ ID NO: 157295 - DNA, 20 bp, Artificial Sequence
  chemically synthesized
gctttataaaacaatagtac

SEQ ID NO: 157296 - DNA, 20 bp, Artificial Sequence
  chemically synthesized
aaaacaatagtactagacct

SEQ ID NO: 157297 - DNA, 20 bp, Artificial Sequence
  chemically synthesized
tctatctcatttcttaggtc

SEQ ID NO: 157298 - DNA, 20 bp, Artificial Sequence
  chemically synthesized
tagtactagacctaagaaat

SEQ ID NO: 157299 - DNA, 20 bp, Artificial Sequence
  chemically synthesized
tgctgtctatctcatttctt

SEQ ID NO: 157300 - DNA, 20 bp, Artificial Sequence
  chemically synthesized
ttgctgtctatctcatttct

SEQ ID NO: 157301 - DNA, 20 bp, Artificial Sequence
  chemically synthesized
actagacctaagaaatgaga

SEQ ID NO: 157302 - DNA, 20 bp, Artificial Sequence
  chemically synthesized
gacctaagaaatgagataga

SEQ ID NO: 157303 - DNA, 20 bp, Artificial Sequence
  chemically synthesized
gatagacagcaatgcaataa

SEQ ID NO: 157304 - DNA, 20 bp, Artificial Sequence
  chemically synthesized
agacagcaatgcaataatag

SEQ ID NO: 157305 - DNA, 20 bp, Artificial Sequence
  chemically synthesized
gacagcaatgcaataatagt

SEQ ID NO: 157306 - DNA, 20 bp, Artificial Sequence
  chemically synthesized
acagcaatgcaataatagtg

SEQ ID NO: 157307 - DNA, 20 bp, Artificial Sequence
  chemically synthesized
cagcaatgcaataatagtgg

SEQ ID NO: 157308 - DNA, 20 bp, Artificial Sequence
  chemically synthesized
gtgctgtaaatggagtattg

SEQ ID NO: 157309 - DNA, 20 bp, Artificial Sequence
  chemically synthesized
ggacttcaatactccattta

SEQ ID NO: 157310 - DNA, 20 bp, Artificial Sequence
  chemically synthesized
cctgtctagtgctgtaaatg

SEQ ID NO: 157311 - DNA, 20 bp, Artificial Sequence
  chemically synthesized
gacctgtctagtgctgtaaa

SEQ ID NO: 157312 - DNA, 20 bp, Artificial Sequence
  chemically synthesized
caatactccatttacagcac

SEQ ID NO: 157313 - DNA, 20 bp, Artificial Sequence
  chemically synthesized
actccatttacagcactaga

SEQ ID NO: 157314 - DNA, 20 bp, Artificial Sequence
  chemically synthesized
ctccatttacagcactagac

SEQ ID NO: 157315 - DNA, 20 bp, Artificial Sequence
  chemically synthesized
ttttgtttcagtgacctgtc

SEQ ID NO: 157316 - DNA, 20 bp, Artificial Sequence
  chemically synthesized
tctttgttaagtttttgttt

SEQ ID NO: 157317 - DNA, 20 bp, Artificial Sequence
  chemically synthesized
actgaaacaaaaacttaaca

SEQ ID NO: 157318 - DNA, 20 bp, Artificial Sequence
  chemically synthesized
aagtccattgtttctttgtt

SEQ ID NO: 157319 - DNA, 20 bp, Artificial Sequence
  chemically synthesized
aaaacttaacaaagaaacaa

SEQ ID NO: 157320 - DNA, 20 bp, Artificial Sequence
  chemically synthesized
tttgttctagggtgtaattt

SEQ ID NO: 157321 - DNA, 20 bp, Artificial Sequence
  chemically synthesized
aatggacttaaattacaccc

SEQ ID NO: 157322 - DNA, 20 bp, Artificial Sequence
  chemically synthesized
tgttaagtccatttgttcta

SEQ ID NO: 157323 - DNA, 20 bp, Artificial Sequence
  chemically synthesized
ctgttaagtccatttgttct

SEQ ID NO: 157324 - DNA, 20 bp, Artificial Sequence
  chemically synthesized
aaattacaccctagaacaaa

SEQ ID NO: 157325 - DNA, 20 bp, Artificial Sequence
  chemically synthesized
tctgttaagtccatttgttc

SEQ ID NO: 157326 - DNA, 20 bp, Artificial Sequence
  chemically synthesized
cctagaacaaatggacttaa

SEQ ID NO: 157327 - DNA, 20 bp, Artificial Sequence
  chemically synthesized
atgttctgtaaatatctgtt

SEQ ID NO: 157328 - DNA, 20 bp, Artificial Sequence
  chemically synthesized
atggacttaacagatattta

SEQ ID NO: 157329 - DNA, 20 bp, Artificial Sequence
  chemically synthesized
tatattctataattgttagg

SEQ ID NO: 157330 - DNA, 20 bp, Artificial Sequence
  chemically synthesized
atgtatattctataattgtt

SEQ ID NO: 157331 - DNA, 20 bp, Artificial Sequence
  chemically synthesized
aacattcttcctaacaatta

SEQ ID NO: 157332 - DNA, 20 bp, Artificial Sequence
  chemically synthesized
aatgtatattctataattgt

SEQ ID NO: 157333 - DNA, 20 bp, Artificial Sequence
  chemically synthesized
tatagaatatacattcttat

SEQ ID NO: 157334 - DNA, 20 bp, Artificial Sequence
  chemically synthesized
agaatatacattcttatcag

SEQ ID NO: 157335 - DNA, 20 bp, Artificial Sequence
  chemically synthesized
agaatggtccatctgctgat

SEQ ID NO: 157336 - DNA, 20 bp, Artificial Sequence
  chemically synthesized
tatacattcttatcagcaga

SEQ ID NO: 157337 - DNA, 20 bp, Artificial Sequence
  chemically synthesized
cagcagatggaccattctcc

SEQ ID NO: 157338 - DNA, 20 bp, Artificial Sequence
  chemically synthesized
gtatgacctgtcttggagaa

SEQ ID NO: 157339 - DNA, 20 bp, Artificial Sequence
  chemically synthesized
agatggaccattctccaaga

SEQ ID NO: 157340 - DNA, 20 bp, Artificial Sequence
  chemically synthesized
gatggaccattctccaagac

SEQ ID NO: 157341 - DNA, 20 bp, Artificial Sequence
  chemically synthesized
ctcttgtatgacctgtcttg

SEQ ID NO: 157342 - DNA, 20 bp, Artificial Sequence
  chemically synthesized
gtctcttgtatgacctgtct

SEQ ID NO: 157343 - DNA, 20 bp, Artificial Sequence
  chemically synthesized
ttctccaagacaggtcatac

SEQ ID NO: 157344 - DNA, 20 bp, Artificial Sequence
  chemically synthesized
ctccaagacaggtcatacaa

SEQ ID NO: 157345 - DNA, 20 bp, Artificial Sequence
  chemically synthesized
aggtcatacaagagaccaca

SEQ ID NO: 157346 - DNA, 20 bp, Artificial Sequence
  chemically synthesized
ctaaatttattaagactttg

SEQ ID NO: 157347 - DNA, 20 bp, Artificial Sequence
  chemically synthesized
ttgattttcctaaatttatt

SEQ ID NO: 157348 - DNA, 20 bp, Artificial Sequence
  chemically synthesized
ccacaaagtcttaataaatt

SEQ ID NO: 157349 - DNA, 20 bp, Artificial Sequence
  chemically synthesized
cacaaagtcttaataaattt

SEQ ID NO: 157350 - DNA, 20 bp, Artificial Sequence
  chemically synthesized
aggaaaatcaaaatcatatc

SEQ ID NO: 157351 - DNA, 20 bp, Artificial Sequence
  chemically synthesized
aatcatatcaagtatcttct

SEQ ID NO: 157352 - DNA, 20 bp, Artificial Sequence
  chemically synthesized
ttattccactgtggtctgag

SEQ ID NO: 157353 - DNA, 20 bp, Artificial Sequence
  chemically synthesized
tcaagtatcttctcagacca

SEQ ID NO: 157354 - DNA, 20 bp, Artificial Sequence
  chemically synthesized
gttttattccactgtggtct

SEQ ID NO: 157355 - DNA, 20 bp, Artificial Sequence
  chemically synthesized
agtatcttctcagaccacag

SEQ ID NO: 157356 - DNA, 20 bp, Artificial Sequence
  chemically synthesized
tttttagttttattccactg

SEQ ID NO: 157357 - DNA, 20 bp, Artificial Sequence
  chemically synthesized
ttccttttggagttgatttt

SEQ ID NO: 157358 - DNA, 20 bp, Artificial Sequence
  chemically synthesized
aaactaaaaatcaactccaa

SEQ ID NO: 157359 - DNA, 20 bp, Artificial Sequence
  chemically synthesized
aactaaaaatcaactccaaa

SEQ ID NO: 157360 - DNA, 20 bp, Artificial Sequence
  chemically synthesized
agttttgagggttccttttg

SEQ ID NO: 157361 - DNA, 20 bp, Artificial Sequence
  chemically synthesized
atagttttgagggttccttt

SEQ ID NO: 157362 - DNA, 20 bp, Artificial Sequence
  chemically synthesized
atgtgtttgtatagttttga

SEQ ID NO: 157363 - DNA, 20 bp, Artificial Sequence
  chemically synthesized
catgtgtttgtatagttttg

SEQ ID NO: 157364 - DNA, 20 bp, Artificial Sequence
  chemically synthesized
ccatgtgtttgtatagtttt

SEQ ID NO: 157365 - DNA, 20 bp, Artificial Sequence
  chemically synthesized
ttaatttccatgtgtttgta

SEQ ID NO: 157366 - DNA, 20 bp, Artificial Sequence
  chemically synthesized
ctcaaaactatacaaacaca

SEQ ID NO: 157367 - DNA, 20 bp, Artificial Sequence
  chemically synthesized
tatacaaacacatggaaatt

SEQ ID NO: 157368 - DNA, 20 bp, Artificial Sequence
  chemically synthesized
accccaaaatcattcaagag

SEQ ID NO: 157369 - DNA, 20 bp, Artificial Sequence
  chemically synthesized
ttaaccccaaaatcattcaa

SEQ ID NO: 157370 - DNA, 20 bp, Artificial Sequence
  chemically synthesized
tgttaaccccaaaatcattc

SEQ ID NO: 157371 - DNA, 20 bp, Artificial Sequence
  chemically synthesized
aatctgctcttgaatgattt

SEQ ID NO: 157372 - DNA, 20 bp, Artificial Sequence
  chemically synthesized
atctgctcttgaatgatttt

SEQ ID NO: 157373 - DNA, 20 bp, Artificial Sequence
  chemically synthesized
tctgctcttgaatgattttg

SEQ ID NO: 157374 - DNA, 20 bp, Artificial Sequence
  chemically synthesized
ttggggttaacaatgaaatt

SEQ ID NO: 157375 - DNA, 20 bp, Artificial Sequence
  chemically synthesized
ggttaacaatgaaattgaga

SEQ ID NO: 157376 - DNA, 20 bp, Artificial Sequence
  chemically synthesized
atattttttgaaatgattaa

SEQ ID NO: 157377 - DNA, 20 bp, Artificial Sequence
  chemically synthesized
cacaatttatcaaaacctct

SEQ ID NO: 157378 - DNA, 20 bp, Artificial Sequence
  chemically synthesized
ctgtttttgctgtatctcag

SEQ ID NO: 157379 - DNA, 20 bp, Artificial Sequence
  chemically synthesized
ttatcaaaacctctgagata

SEQ ID NO: 157380 - DNA, 20 bp, Artificial Sequence
  chemically synthesized
actgtttttgctgtatctca

SEQ ID NO: 157381 - DNA, 20 bp, Artificial Sequence
  chemically synthesized
gcactgtttttgctgtatct

SEQ ID NO: 157382 - DNA, 20 bp, Artificial Sequence
  chemically synthesized
cctctgagatacagcaaaaa

SEQ ID NO: 157383 - DNA, 20 bp, Artificial Sequence
  chemically synthesized
gatacagcaaaaacagtgct

SEQ ID NO: 157384 - DNA, 20 bp, Artificial Sequence
  chemically synthesized
tacagcaaaaacagtgctaa

SEQ ID NO: 157385 - DNA, 20 bp, Artificial Sequence
  chemically synthesized
acagcaaaaacagtgctaag

SEQ ID NO: 157386 - DNA, 20 bp, Artificial Sequence
  chemically synthesized
caaaaacagtgctaagagga

SEQ ID NO: 157387 - DNA, 20 bp, Artificial Sequence
  chemically synthesized
aacactatgaactttcctct

SEQ ID NO: 157388 - DNA, 20 bp, Artificial Sequence
  chemically synthesized
agtgctaagaggaaagttca

SEQ ID NO: 157389 - DNA, 20 bp, Artificial Sequence
  chemically synthesized
ctctttcagaatttttgatg

SEQ ID NO: 157390 - DNA, 20 bp, Artificial Sequence
  chemically synthesized
tactacatcaaaaattctga

SEQ ID NO: 157391 - DNA, 20 bp, Artificial Sequence
  chemically synthesized
ctacatcaaaaattctgaaa

SEQ ID NO: 157392 - DNA, 20 bp, Artificial Sequence
  chemically synthesized
gttgtcaatttgtgctcttt

SEQ ID NO: 157393 - DNA, 20 bp, Artificial Sequence
  chemically synthesized
gttccttgaaatgtgacatt

SEQ ID NO: 157394 - DNA, 20 bp, Artificial Sequence
  chemically synthesized
agttccttgaaatgtgacat

SEQ ID NO: 157395 - DNA, 20 bp, Artificial Sequence
  chemically synthesized
acaacctaatgtcacatttc

SEQ ID NO: 157396 - DNA, 20 bp, Artificial Sequence
  chemically synthesized
caacctaatgtcacatttca

SEQ ID NO: 157397 - DNA, 20 bp, Artificial Sequence
  chemically synthesized
aatgtcacatttcaaggaac

SEQ ID NO: 157398 - DNA, 20 bp, Artificial Sequence
  chemically synthesized
tgtcacatttcaaggaacta

SEQ ID NO: 157399 - DNA, 20 bp, Artificial Sequence
  chemically synthesized
tttcaaggaactagagaaac

SEQ ID NO: 157400 - DNA, 20 bp, Artificial Sequence
  chemically synthesized
ttagtttgttcttgtttctc

SEQ ID NO: 157401 - DNA, 20 bp, Artificial Sequence
  chemically synthesized
tcttctgctggatttgagtt

SEQ ID NO: 157402 - DNA, 20 bp, Artificial Sequence
  chemically synthesized
gaacaaactaaactcaaatc

SEQ ID NO: 157403 - DNA, 20 bp, Artificial Sequence
  chemically synthesized
tcttttcttctgctggattt

SEQ ID NO: 157404 - DNA, 20 bp, Artificial Sequence
  chemically synthesized
caaactaaactcaaatccag

SEQ ID NO: 157405 - DNA, 20 bp, Artificial Sequence
  chemically synthesized
actaaactcaaatccagcag

SEQ ID NO: 157406 - DNA, 20 bp, Artificial Sequence
  chemically synthesized
tgttatttcttttcttctgc

SEQ ID NO: 157407 - DNA, 20 bp, Artificial Sequence
  chemically synthesized
actcaaatccagcagaagaa

SEQ ID NO: 157408 - DNA, 20 bp, Artificial Sequence
  chemically synthesized
gcagaagaaaagaaataaca

SEQ ID NO: 157409 - DNA, 20 bp, Artificial Sequence
  chemically synthesized
aaaagaaataacaaagatca

SEQ ID NO: 157410 - DNA, 20 bp, Artificial Sequence
  chemically synthesized
agaaataacaaagatcaaag

SEQ ID NO: 157411 - DNA, 20 bp, Artificial Sequence
  chemically synthesized
gatcaaagcagaactaaatg

SEQ ID NO: 157412 - DNA, 20 bp, Artificial Sequence
  chemically synthesized
ttttttgtttcaacttcatt

SEQ ID NO: 157413 - DNA, 20 bp, Artificial Sequence
  chemically synthesized
caaaatataaatgaaacaaa

SEQ ID NO: 157414 - DNA, 20 bp, Artificial Sequence
  chemically synthesized
gaaacaaatagttctttgaa

SEQ ID NO: 157415 - DNA, 20 bp, Artificial Sequence
  chemically synthesized
caattttgtttatcttttca

SEQ ID NO: 157416 - DNA, 20 bp, Artificial Sequence
  chemically synthesized
gaaaagataaacaaaattga

SEQ ID NO: 157417 - DNA, 20 bp, Artificial Sequence
  chemically synthesized
aaacaaaattgatagaccat

SEQ ID NO: 157418 - DNA, 20 bp, Artificial Sequence
  chemically synthesized
aaaattgatagaccattagc

SEQ ID NO: 157419 - DNA, 20 bp, Artificial Sequence
  chemically synthesized
tccttggttaatcttgctaa

SEQ ID NO: 157420 - DNA, 20 bp, Artificial Sequence
  chemically synthesized
gaccattagcaagattaacc

SEQ ID NO: 157421 - DNA, 20 bp, Artificial Sequence
  chemically synthesized
accattagcaagattaacca

SEQ ID NO: 157422 - DNA, 20 bp, Artificial Sequence
  chemically synthesized
ttagcaagattaaccaagga

SEQ ID NO: 157423 - DNA, 20 bp, Artificial Sequence
  chemically synthesized
gcaagattaaccaaggaaag

SEQ ID NO: 157424 - DNA, 20 bp, Artificial Sequence
  chemically synthesized
aatcttctctcttctttcct

SEQ ID NO: 157425 - DNA, 20 bp, Artificial Sequence
  chemically synthesized
aagattaaccaaggaaagaa

SEQ ID NO: 157426 - DNA, 20 bp, Artificial Sequence
  chemically synthesized
gattaaccaaggaaagaaga

SEQ ID NO: 157427 - DNA, 20 bp, Artificial Sequence
  chemically synthesized
taaccaaggaaagaagagag

SEQ ID NO: 157428 - DNA, 20 bp, Artificial Sequence
  chemically synthesized
agaagagagaagattcaaat

SEQ ID NO: 157429 - DNA, 20 bp, Artificial Sequence
  chemically synthesized
gagaagattcaaataagctc

SEQ ID NO: 157430 - DNA, 20 bp, Artificial Sequence
  chemically synthesized
aagattcaaataagctcaag

SEQ ID NO: 157431 - DNA, 20 bp, Artificial Sequence
  chemically synthesized
ttccagtttcatttctactt

SEQ ID NO: 157432 - DNA, 20 bp, Artificial Sequence
  chemically synthesized
agctcaagtagaaatgaaac

SEQ ID NO: 157433 - DNA, 20 bp, Artificial Sequence
  chemically synthesized
gatgtaggttgtagtgtttc

SEQ ID NO: 157434 - DNA, 20 bp, Artificial Sequence
  chemically synthesized
tatttttgtgatgtaggttg

SEQ ID NO: 157435 - DNA, 20 bp, Artificial Sequence
  chemically synthesized
cttttgtatttttgtgatgt

SEQ ID NO: 157436 - DNA, 20 bp, Artificial Sequence
  chemically synthesized
tcttttgtatttttgtgatg

SEQ ID NO: 157437 - DNA, 20 bp, Artificial Sequence
  chemically synthesized
cctacatcacaaaaatacaa

SEQ ID NO: 157438 - DNA, 20 bp, Artificial Sequence
  chemically synthesized
cataaaggtgttcatagtag

SEQ ID NO: 157439 - DNA, 20 bp, Artificial Sequence
  chemically synthesized
gtgcataaaggtgttcatag

SEQ ID NO: 157440 - DNA, 20 bp, Artificial Sequence
  chemically synthesized
tgtgtgcataaaggtgttca

SEQ ID NO: 157441 - DNA, 20 bp, Artificial Sequence
  chemically synthesized
tttctagtttgtgtgcataa

SEQ ID NO: 157442 - DNA, 20 bp, Artificial Sequence
  chemically synthesized
ttttctagtttgtgtgcata

SEQ ID NO: 157443 - DNA, 20 bp, Artificial Sequence
  chemically synthesized
acacctttatgcacacaaac

SEQ ID NO: 157444 - DNA, 20 bp, Artificial Sequence
  chemically synthesized
tgcacacaaactagaaaatc

SEQ ID NO: 157445 - DNA, 20 bp, Artificial Sequence
  chemically synthesized
tccatttcctctagattttc

SEQ ID NO: 157446 - DNA, 20 bp, Artificial Sequence
  chemically synthesized
cacacaaactagaaaatcta

SEQ ID NO: 157447 - DNA, 20 bp, Artificial Sequence
  chemically synthesized
acacaaactagaaaatctag

SEQ ID NO: 157448 - DNA, 20 bp, Artificial Sequence
  chemically synthesized
actagaaaatctagaggaaa

SEQ ID NO: 157449 - DNA, 20 bp, Artificial Sequence
  chemically synthesized
aggaatgtatccatttcctc

SEQ ID NO: 157450 - DNA, 20 bp, Artificial Sequence
  chemically synthesized
agaggaaatggatacattcc

SEQ ID NO: 157451 - DNA, 20 bp, Artificial Sequence
  chemically synthesized
taggagggttgtgtgtttcc

SEQ ID NO: 157452 - DNA, 20 bp, Artificial Sequence
  chemically synthesized
ctaggagggttgtgtgtttc

SEQ ID NO: 157453 - DNA, 20 bp, Artificial Sequence
  chemically synthesized
ctggaaacacacaaccctcc

SEQ ID NO: 157454 - DNA, 20 bp, Artificial Sequence
  chemically synthesized
cttcttgatttaaactagga

SEQ ID NO: 157455 - DNA, 20 bp, Artificial Sequence
  chemically synthesized
tcttcttgatttaaactagg

SEQ ID NO: 157456 - DNA, 20 bp, Artificial Sequence
  chemically synthesized
ttcttcttgatttaaactag

SEQ ID NO: 157457 - DNA, 20 bp, Artificial Sequence
  chemically synthesized
atttcttcttgatttaaact

SEQ ID NO: 157458 - DNA, 20 bp, Artificial Sequence
  chemically synthesized
tatttcttcttgatttaaac

SEQ ID NO: 157459 - DNA, 20 bp, Artificial Sequence
  chemically synthesized
caaccctcctagtttaaatc

SEQ ID NO: 157460 - DNA, 20 bp, Artificial Sequence
  chemically synthesized
ccctcctagtttaaatcaag

SEQ ID NO: 157461 - DNA, 20 bp, Artificial Sequence
  chemically synthesized
tagtttaaatcaagaagaaa

SEQ ID NO: 157462 - DNA, 20 bp, Artificial Sequence
  chemically synthesized
gcgcccagccaaagcgttca

SEQ ID NO: 157463 - DNA, 20 bp, Artificial Sequence
  chemically synthesized
cgcgcccagccaaagcgttc

SEQ ID NO: 157464 - DNA, 20 bp, Artificial Sequence
  chemically synthesized
aatagaaaccctgaacgctt

SEQ ID NO: 157465 - DNA, 20 bp, Artificial Sequence
  chemically synthesized
ccgcgcccagccaaagcgtt

SEQ ID NO: 157466 - DNA, 20 bp, Artificial Sequence
  chemically synthesized
gaaaccctgaacgctttggc

SEQ ID NO: 157467 - DNA, 20 bp, Artificial Sequence
  chemically synthesized
aaaccctgaacgctttggct

SEQ ID NO: 157468 - DNA, 20 bp, Artificial Sequence
  chemically synthesized
tgagccaccgcgcccagcca

SEQ ID NO: 157469 - DNA, 20 bp, Artificial Sequence
  chemically synthesized
ctgaacgctttggctgggcg

SEQ ID NO: 157470 - DNA, 20 bp, Artificial Sequence
  chemically synthesized
aacgctttggctgggcgcgg

SEQ ID NO: 157471 - DNA, 20 bp, Artificial Sequence
  chemically synthesized
cagacgtgagccaccgcgcc

SEQ ID NO: 157472 - DNA, 20 bp, Artificial Sequence
  chemically synthesized
agtgctaaaatcacagacgt

SEQ ID NO: 157473 - DNA, 20 bp, Artificial Sequence
  chemically synthesized
gtggctcacgtctgtgattt

SEQ ID NO: 157474 - DNA, 20 bp, Artificial Sequence
  chemically synthesized
ctcccaaagtgctaaaatca

SEQ ID NO: 157475 - DNA, 20 bp, Artificial Sequence
  chemically synthesized
cgtctgtgattttagcactt

SEQ ID NO: 157476 - DNA, 20 bp, Artificial Sequence
  chemically synthesized
gtctgtgattttagcacttt

SEQ ID NO: 157477 - DNA, 20 bp, Artificial Sequence
  chemically synthesized
ctgtgattttagcactttgg

SEQ ID NO: 157478 - DNA, 20 bp, Artificial Sequence
  chemically synthesized
tgtgattttagcactttggg

SEQ ID NO: 157479 - DNA, 20 bp, Artificial Sequence
  chemically synthesized
ccacctgcctcagcctccca

SEQ ID NO: 157480 - DNA, 20 bp, Artificial Sequence
  chemically synthesized
ttttagcactttgggaggct

SEQ ID NO: 157481 - DNA, 20 bp, Artificial Sequence
  chemically synthesized
tttagcactttgggaggctg

SEQ ID NO: 157482 - DNA, 20 bp, Artificial Sequence
  chemically synthesized
agcactttgggaggctgagg

SEQ ID NO: 157483 - DNA, 20 bp, Artificial Sequence
  chemically synthesized
gcactttgggaggctgaggc

SEQ ID NO: 157484 - DNA, 20 bp, Artificial Sequence
  chemically synthesized
ctttgggaggctgaggcagg

SEQ ID NO: 157485 - DNA, 20 bp, Artificial Sequence
  chemically synthesized
acctagtgatccacctgcct

SEQ ID NO: 157486 - DNA, 20 bp, Artificial Sequence
  chemically synthesized
ggctgaggcaggtggatcac

SEQ ID NO: 157487 - DNA, 20 bp, Artificial Sequence
  chemically synthesized
gctgaggcaggtggatcact

SEQ ID NO: 157488 - DNA, 20 bp, Artificial Sequence
  chemically synthesized
aggcaggtggatcactaggt

SEQ ID NO: 157489 - DNA, 20 bp, Artificial Sequence
  chemically synthesized
ggcaggtggatcactaggtc

SEQ ID NO: 157490 - DNA, 20 bp, Artificial Sequence
  chemically synthesized
caggtggatcactaggtcag

SEQ ID NO: 157491 - DNA, 20 bp, Artificial Sequence
  chemically synthesized
caggtctcgaactcctgacc

SEQ ID NO: 157492 - DNA, 20 bp, Artificial Sequence
  chemically synthesized
gatcactaggtcaggagttc

SEQ ID NO: 157493 - DNA, 20 bp, Artificial Sequence
  chemically synthesized
tcaggagttcgagacctgcc

SEQ ID NO: 157494 - DNA, 20 bp, Artificial Sequence
  chemically synthesized
tttcactgtgttggccaggc

SEQ ID NO: 157495 - DNA, 20 bp, Artificial Sequence
  chemically synthesized
gtttcactgtgttggccagg

SEQ ID NO: 157496 - DNA, 20 bp, Artificial Sequence
  chemically synthesized
ggagtttcactgtgttggcc

SEQ ID NO: 157497 - DNA, 20 bp, Artificial Sequence
  chemically synthesized
cgagacctgcctggccaaca

SEQ ID NO: 157498 - DNA, 20 bp, Artificial Sequence
  chemically synthesized
cggagtttcactgtgttggc

SEQ ID NO: 157499 - DNA, 20 bp, Artificial Sequence
  chemically synthesized
gagtcggagtttcactgtgt

SEQ ID NO: 157500 - DNA, 20 bp, Artificial Sequence
  chemically synthesized
ttgtatttttagtagagtcg

SEQ ID NO: 157501 - DNA, 20 bp, Artificial Sequence
  chemically synthesized
ttttgtatttttagtagagt

SEQ ID NO: 157502 - DNA, 20 bp, Artificial Sequence
  chemically synthesized
taatttttgtatttttagta

SEQ ID NO: 157503 - DNA, 20 bp, Artificial Sequence
  chemically synthesized
gctaatttttgtatttttag

SEQ ID NO: 157504 - DNA, 20 bp, Artificial Sequence
  chemically synthesized
ccagctaatttttgtatttt

SEQ ID NO: 157505 - DNA, 20 bp, Artificial Sequence
  chemically synthesized
tctactaaaaatacaaaaat

SEQ ID NO: 157506 - DNA, 20 bp, Artificial Sequence
  chemically synthesized
ctaaaaatacaaaaattagc

SEQ ID NO: 157507 - DNA, 20 bp, Artificial Sequence
  chemically synthesized
taaaaatacaaaaattagct

SEQ ID NO: 157508 - DNA, 20 bp, Artificial Sequence
  chemically synthesized
atacaaaaattagctgggcg

SEQ ID NO: 157509 - DNA, 20 bp, Artificial Sequence
  chemically synthesized
caaaaattagctgggcgtgg

SEQ ID NO: 157510 - DNA, 20 bp, Artificial Sequence
  chemically synthesized
caggtgcccaccaccacgcc

SEQ ID NO: 157511 - DNA, 20 bp, Artificial Sequence
  chemically synthesized
aaattagctgggcgtggtgg

SEQ ID NO: 157512 - DNA, 20 bp, Artificial Sequence
  chemically synthesized
aattagctgggcgtggtggt

SEQ ID NO: 157513 - DNA, 20 bp, Artificial Sequence
  chemically synthesized
gtggtgggcacctgtaatct

SEQ ID NO: 157514 - DNA, 20 bp, Artificial Sequence
  chemically synthesized
tcccaagtagctgagattac

SEQ ID NO: 157515 - DNA, 20 bp, Artificial Sequence
  chemically synthesized
ctcccaagtagctgagatta

SEQ ID NO: 157516 - DNA, 20 bp, Artificial Sequence
  chemically synthesized
cacctgtaatctcagctact

SEQ ID NO: 157517 - DNA, 20 bp, Artificial Sequence
  chemically synthesized
cctcagcctcccaagtagct

SEQ ID NO: 157518 - DNA, 20 bp, Artificial Sequence
  chemically synthesized
acctgtaatctcagctactt

SEQ ID NO: 157519 - DNA, 20 bp, Artificial Sequence
  chemically synthesized
ctgtaatctcagctacttgg

SEQ ID NO: 157520 - DNA, 20 bp, Artificial Sequence
  chemically synthesized
tgtaatctcagctacttggg

SEQ ID NO: 157521 - DNA, 20 bp, Artificial Sequence
  chemically synthesized
tcctgcctcagcctcccaag

SEQ ID NO: 157522 - DNA, 20 bp, Artificial Sequence
  chemically synthesized
ttctcctgcctcagcctccc

SEQ ID NO: 157523 - DNA, 20 bp, Artificial Sequence
  chemically synthesized
tctcagctacttgggaggct

SEQ ID NO: 157524 - DNA, 20 bp, Artificial Sequence
  chemically synthesized
ctcagctacttgggaggctg

SEQ ID NO: 157525 - DNA, 20 bp, Artificial Sequence
  chemically synthesized
agctacttgggaggctgagg

SEQ ID NO: 157526 - DNA, 20 bp, Artificial Sequence
  chemically synthesized
gctacttgggaggctgaggc

SEQ ID NO: 157527 - DNA, 20 bp, Artificial Sequence
  chemically synthesized
tacttgggaggctgaggcag

SEQ ID NO: 157528 - DNA, 20 bp, Artificial Sequence
  chemically synthesized
ttcaagtaattctcctgcct

SEQ ID NO: 157529 - DNA, 20 bp, Artificial Sequence
  chemically synthesized
gcaggagaattacttgaaac

SEQ ID NO: 157530 - DNA, 20 bp, Artificial Sequence
  chemically synthesized
aacctccaccttccagtttc

SEQ ID NO: 157531 - DNA, 20 bp, Artificial Sequence
  chemically synthesized
ggagaattacttgaaactgg

SEQ ID NO: 157532 - DNA, 20 bp, Artificial Sequence
  chemically synthesized
gagaattacttgaaactgga

SEQ ID NO: 157533 - DNA, 20 bp, Artificial Sequence
  chemically synthesized
aattacttgaaactggaagg

SEQ ID NO: 157534 - DNA, 20 bp, Artificial Sequence
  chemically synthesized
ttacttgaaactggaaggtg

SEQ ID NO: 157535 - DNA, 20 bp, Artificial Sequence
  chemically synthesized
tcactgcaacctccaccttc

SEQ ID NO: 157536 - DNA, 20 bp, Artificial Sequence
  chemically synthesized
tacttgaaactggaaggtgg

SEQ ID NO: 157537 - DNA, 20 bp, Artificial Sequence
  chemically synthesized
aaactggaaggtggaggttg

SEQ ID NO: 157538 - DNA, 20 bp, Artificial Sequence
  chemically synthesized
tggaaggtggaggttgcagt

SEQ ID NO: 157539 - DNA, 20 bp, Artificial Sequence
  chemically synthesized
ggtggaggttgcagtgagcc

SEQ ID NO: 157540 - DNA, 20 bp, Artificial Sequence
  chemically synthesized
ttagtgctgtggcatgatct

SEQ ID NO: 157541 - DNA, 20 bp, Artificial Sequence
  chemically synthesized
agtgagccaagatcatgcca

SEQ ID NO: 157542 - DNA, 20 bp, Artificial Sequence
  chemically synthesized
tcacctaggctttagtgctg

SEQ ID NO: 157543 - DNA, 20 bp, Artificial Sequence
  chemically synthesized
aagatcatgccacagcacta

SEQ ID NO: 157544 - DNA, 20 bp, Artificial Sequence
  chemically synthesized
catgccacagcactaaagcc

SEQ ID NO: 157545 - DNA, 20 bp, Artificial Sequence
  chemically synthesized
atgccacagcactaaagcct

SEQ ID NO: 157546 - DNA, 20 bp, Artificial Sequence
  chemically synthesized
ttgctctttcacctaggctt

SEQ ID NO: 157547 - DNA, 20 bp, Artificial Sequence
  chemically synthesized
cagcactaaagcctaggtga

SEQ ID NO: 157548 - DNA, 20 bp, Artificial Sequence
  chemically synthesized
ggagttttgctctttcacct

SEQ ID NO: 157549 - DNA, 20 bp, Artificial Sequence
  chemically synthesized
gcactaaagcctaggtgaaa

SEQ ID NO: 157550 - DNA, 20 bp, Artificial Sequence
  chemically synthesized
tggagttttgctctttcacc

SEQ ID NO: 157551 - DNA, 20 bp, Artificial Sequence
  chemically synthesized
ttttttttttttttgagatg

SEQ ID NO: 157552 - DNA, 20 bp, Artificial Sequence
  chemically synthesized
ttttttttttttttttgaga

SEQ ID NO: 157553 - DNA, 20 bp, Artificial Sequence
  chemically synthesized
tctttttttttttttttttt

SEQ ID NO: 157554 - DNA, 20 bp, Artificial Sequence
  chemically synthesized
tctcaaaaaaaaaaaaaaaa

SEQ ID NO: 157555 - DNA, 20 bp, Artificial Sequence
  chemically synthesized
aaaaaaaaaaaaaaaaaaga

SEQ ID NO: 157556 - DNA, 20 bp, Artificial Sequence
  chemically synthesized
gctcgttactggtatgttca

SEQ ID NO: 157557 - DNA, 20 bp, Artificial Sequence
  chemically synthesized
tgctcgttactggtatgttc

SEQ ID NO: 157558 - DNA, 20 bp, Artificial Sequence
  chemically synthesized
gaaagaaaccctgaacatac

SEQ ID NO: 157559 - DNA, 20 bp, Artificial Sequence
  chemically synthesized
ctgctcgttactggtatgtt

SEQ ID NO: 157560 - DNA, 20 bp, Artificial Sequence
  chemically synthesized
accctgaacataccagtaac

SEQ ID NO: 157561 - DNA, 20 bp, Artificial Sequence
  chemically synthesized
tcaaccttgctgctcgttac

SEQ ID NO: 157562 - DNA, 20 bp, Artificial Sequence
  chemically synthesized
ctgaacataccagtaacgag

SEQ ID NO: 157563 - DNA, 20 bp, Artificial Sequence
  chemically synthesized
acataccagtaacgagcagc

SEQ ID NO: 157564 - DNA, 20 bp, Artificial Sequence
  chemically synthesized
cataccagtaacgagcagca

SEQ ID NO: 157565 - DNA, 20 bp, Artificial Sequence
  chemically synthesized
cgagcagcaaggttgaatat

SEQ ID NO: 157566 - DNA, 20 bp, Artificial Sequence
  chemically synthesized
atttaaaaattgccaaaaaa

SEQ ID NO: 157567 - DNA, 20 bp, Artificial Sequence
  chemically synthesized
tctggtcctggacttttttt

SEQ ID NO: 157568 - DNA, 20 bp, Artificial Sequence
  chemically synthesized
aaaattgccaaaaaaaagtc

SEQ ID NO: 157569 - DNA, 20 bp, Artificial Sequence
  chemically synthesized
aaattgccaaaaaaaagtcc

SEQ ID NO: 157570 - DNA, 20 bp, Artificial Sequence
  chemically synthesized
gccaaaaaaaagtccaggac

SEQ ID NO: 157571 - DNA, 20 bp, Artificial Sequence
  chemically synthesized
gctgtgaatccatctggtcc

SEQ ID NO: 157572 - DNA, 20 bp, Artificial Sequence
  chemically synthesized
aaaaaaagtccaggaccaga

SEQ ID NO: 157573 - DNA, 20 bp, Artificial Sequence
  chemically synthesized
aattcagctgtgaatccatc

SEQ ID NO: 157574 - DNA, 20 bp, Artificial Sequence
  chemically synthesized
tccaggaccagatggattca

SEQ ID NO: 157575 - DNA, 20 bp, Artificial Sequence
  chemically synthesized
tttgaatgtctggtagaatt

SEQ ID NO: 157576 - DNA, 20 bp, Artificial Sequence
  chemically synthesized
gattcacagctgaattctac

SEQ ID NO: 157577 - DNA, 20 bp, Artificial Sequence
  chemically synthesized
attcttctttgaatgtctgg

SEQ ID NO: 157578 - DNA, 20 bp, Artificial Sequence
  chemically synthesized
ccaattcttctttgaatgtc

SEQ ID NO: 157579 - DNA, 20 bp, Artificial Sequence
  chemically synthesized
tgaattctaccagacattca

SEQ ID NO: 157580 - DNA, 20 bp, Artificial Sequence
  chemically synthesized
attctaccagacattcaaag

SEQ ID NO: 157581 - DNA, 20 bp, Artificial Sequence
  chemically synthesized
ccagacattcaaagaagaat

SEQ ID NO: 157582 - DNA, 20 bp, Artificial Sequence
  chemically synthesized
tgaaatagtttcattataat

SEQ ID NO: 157583 - DNA, 20 bp, Artificial Sequence
  chemically synthesized
ttataatgaaactatttcaa

SEQ ID NO: 157584 - DNA, 20 bp, Artificial Sequence
  chemically synthesized
tccctctttatcttttgaaa

SEQ ID NO: 157585 - DNA, 20 bp, Artificial Sequence
  chemically synthesized
tgaaactatttcaaaagata

SEQ ID NO: 157586 - DNA, 20 bp, Artificial Sequence
  chemically synthesized
aaactatttcaaaagataaa

SEQ ID NO: 157587 - DNA, 20 bp, Artificial Sequence
  chemically synthesized
aactatttcaaaagataaag

SEQ ID NO: 157588 - DNA, 20 bp, Artificial Sequence
  chemically synthesized
actatttcaaaagataaaga

SEQ ID NO: 157589 - DNA, 20 bp, Artificial Sequence
  chemically synthesized
cttcatagaatgatttaggg

SEQ ID NO: 157590 - DNA, 20 bp, Artificial Sequence
  chemically synthesized
acttcatagaatgatttagg

SEQ ID NO: 157591 - DNA, 20 bp, Artificial Sequence
  chemically synthesized
tgacttcatagaatgattta

SEQ ID NO: 157592 - DNA, 20 bp, Artificial Sequence
  chemically synthesized
ctgacttcatagaatgattt

SEQ ID NO: 157593 - DNA, 20 bp, Artificial Sequence
  chemically synthesized
actgacttcatagaatgatt

SEQ ID NO: 157594 - DNA, 20 bp, Artificial Sequence
  chemically synthesized
cctccctaaatcattctatg

SEQ ID NO: 157595 - DNA, 20 bp, Artificial Sequence
  chemically synthesized
cctaaatcattctatgaagt

SEQ ID NO: 157596 - DNA, 20 bp, Artificial Sequence
  chemically synthesized
ttagggtgatactgacttca

SEQ ID NO: 157597 - DNA, 20 bp, Artificial Sequence
  chemically synthesized
cttttctggttttggtatta

SEQ ID NO: 157598 - DNA, 20 bp, Artificial Sequence
  chemically synthesized
ccttttctggttttggtatt

SEQ ID NO: 157599 - DNA, 20 bp, Artificial Sequence
  chemically synthesized
tccttttctggttttggtat

SEQ ID NO: 157600 - DNA, 20 bp, Artificial Sequence
  chemically synthesized
tatcaccctaataccaaaac

SEQ ID NO: 157601 - DNA, 20 bp, Artificial Sequence
  chemically synthesized
gttatttccttttctggttt

SEQ ID NO: 157602 - DNA, 20 bp, Artificial Sequence
  chemically synthesized
ccctaataccaaaaccagaa

SEQ ID NO: 157603 - DNA, 20 bp, Artificial Sequence
  chemically synthesized
cctaataccaaaaccagaaa

SEQ ID NO: 157604 - DNA, 20 bp, Artificial Sequence
  chemically synthesized
ttttttgttatttccttttc

SEQ ID NO: 157605 - DNA, 20 bp, Artificial Sequence
  chemically synthesized
cagaaaaggaaataacaaaa

SEQ ID NO: 157606 - DNA, 20 bp, Artificial Sequence
  chemically synthesized
aaaggaaataacaaaaaaga

SEQ ID NO: 157607 - DNA, 20 bp, Artificial Sequence
  chemically synthesized
ggaaataacaaaaaagaaag

SEQ ID NO: 157608 - DNA, 20 bp, Artificial Sequence
  chemically synthesized
aataacaaaaaagaaagcag

SEQ ID NO: 157609 - DNA, 20 bp, Artificial Sequence
  chemically synthesized
agaaagcagcagcacaaaaa

SEQ ID NO: 157610 - DNA, 20 bp, Artificial Sequence
  chemically synthesized
aagcagcagcacaaaaatag

SEQ ID NO: 157611 - DNA, 20 bp, Artificial Sequence
  chemically synthesized
gcagcacaatttgcaattgc

SEQ ID NO: 157612 - DNA, 20 bp, Artificial Sequence
  chemically synthesized
caatttgcaattgcaagata

SEQ ID NO: 157613 - DNA, 20 bp, Artificial Sequence
  chemically synthesized
gcaagatatggaaccaaccc

SEQ ID NO: 157614 - DNA, 20 bp, Artificial Sequence
  chemically synthesized
tggtcgatggacacttgggt

SEQ ID NO: 157615 - DNA, 20 bp, Artificial Sequence
  chemically synthesized
tcattggtcgatggacactt

SEQ ID NO: 157616 - DNA, 20 bp, Artificial Sequence
  chemically synthesized
ttcattggtcgatggacact

SEQ ID NO: 157617 - DNA, 20 bp, Artificial Sequence
  chemically synthesized
tttatccattcattggtcga

SEQ ID NO: 157618 - DNA, 20 bp, Artificial Sequence
  chemically synthesized
agtgtccatcgaccaatgaa

SEQ ID NO: 157619 - DNA, 20 bp, Artificial Sequence
  chemically synthesized
cattttctttatccattcat

SEQ ID NO: 157620 - DNA, 20 bp, Artificial Sequence
  chemically synthesized
catcgaccaatgaatggata

SEQ ID NO: 157621 - DNA, 20 bp, Artificial Sequence
  chemically synthesized
atgaatggataaagaaaatg

SEQ ID NO: 157622 - DNA, 20 bp, Artificial Sequence
  chemically synthesized
aatgtggtatctatatacca

SEQ ID NO: 157623 - DNA, 20 bp, Artificial Sequence
  chemically synthesized
gagtaatattccatggtata

SEQ ID NO: 157624 - DNA, 20 bp, Artificial Sequence
  chemically synthesized
tatggctgagtaatattcca

SEQ ID NO: 157625 - DNA, 20 bp, Artificial Sequence
  chemically synthesized
atataccatggaatattact

SEQ ID NO: 157626 - DNA, 20 bp, Artificial Sequence
  chemically synthesized
agagattcttttttatggct

SEQ ID NO: 157627 - DNA, 20 bp, Artificial Sequence
  chemically synthesized
aatattactcagccataaaa

SEQ ID NO: 157628 - DNA, 20 bp, Artificial Sequence
  chemically synthesized
gcaaaagagattctttttta

SEQ ID NO: 157629 - DNA, 20 bp, Artificial Sequence
  chemically synthesized
ataaaaaagaatctcttttg

SEQ ID NO: 157630 - DNA, 20 bp, Artificial Sequence
  chemically synthesized
ccattcaagttgctgcaaaa

SEQ ID NO: 157631 - DNA, 20 bp, Artificial Sequence
  chemically synthesized
ctccattcaagttgctgcaa

SEQ ID NO: 157632 - DNA, 20 bp, Artificial Sequence
  chemically synthesized
ctcttttgcagcaacttgaa

SEQ ID NO: 157633 - DNA, 20 bp, Artificial Sequence
  chemically synthesized
cttttgcagcaacttgaatg

SEQ ID NO: 157634 - DNA, 20 bp, Artificial Sequence
  chemically synthesized
agtggctgccagctccattc

SEQ ID NO: 157635 - DNA, 20 bp, Artificial Sequence
  chemically synthesized
tgcagcaacttgaatggagc

SEQ ID NO: 157636 - DNA, 20 bp, Artificial Sequence
  chemically synthesized
agcaacttgaatggagctgg

SEQ ID NO: 157637 - DNA, 20 bp, Artificial Sequence
  chemically synthesized
ttacttggaatagtggctgc

SEQ ID NO: 157638 - DNA, 20 bp, Artificial Sequence
  chemically synthesized
gagctggcagccactattcc

SEQ ID NO: 157639 - DNA, 20 bp, Artificial Sequence
  chemically synthesized
agttactttacttggaatag

SEQ ID NO: 157640 - DNA, 20 bp, Artificial Sequence
  chemically synthesized
ctgagttactttacttggaa

SEQ ID NO: 157641 - DNA, 20 bp, Artificial Sequence
  chemically synthesized
ggcagccactattccaagta

SEQ ID NO: 157642 - DNA, 20 bp, Artificial Sequence
  chemically synthesized
cgttcctgagttactttact

SEQ ID NO: 157643 - DNA, 20 bp, Artificial Sequence
  chemically synthesized
ctattccaagtaaagtaact

SEQ ID NO: 157644 - DNA, 20 bp, Artificial Sequence
  chemically synthesized
tattccaagtaaagtaactc

SEQ ID NO: 157645 - DNA, 20 bp, Artificial Sequence
  chemically synthesized
caagtaaagtaactcaggaa

SEQ ID NO: 157646 - DNA, 20 bp, Artificial Sequence
  chemically synthesized
gtatttagttttccgttcct

SEQ ID NO: 157647 - DNA, 20 bp, Artificial Sequence
  chemically synthesized
gagtgagaacatatggtatt

SEQ ID NO: 157648 - DNA, 20 bp, Artificial Sequence
  chemically synthesized
cacttacgagtgagaacata

SEQ ID NO: 157649 - DNA, 20 bp, Artificial Sequence
  chemically synthesized
taccatatgttctcactcgt

SEQ ID NO: 157650 - DNA, 20 bp, Artificial Sequence
  chemically synthesized
cttagctcccacttacgagt

SEQ ID NO: 157651 - DNA, 20 bp, Artificial Sequence
  chemically synthesized
catatgttctcactcgtaag

SEQ ID NO: 157652 - DNA, 20 bp, Artificial Sequence
  chemically synthesized
atatgttctcactcgtaagt

SEQ ID NO: 157653 - DNA, 20 bp, Artificial Sequence
  chemically synthesized
atagcttagctcccacttac

SEQ ID NO: 157654 - DNA, 20 bp, Artificial Sequence
  chemically synthesized
atgttctcactcgtaagtgg

SEQ ID NO: 157655 - DNA, 20 bp, Artificial Sequence
  chemically synthesized
ctcactcgtaagtgggagct

SEQ ID NO: 157656 - DNA, 20 bp, Artificial Sequence
  chemically synthesized
gtaagtgggagctaagctat

SEQ ID NO: 157657 - DNA, 20 bp, Artificial Sequence
  chemically synthesized
taagtgggagctaagctatg

SEQ ID NO: 157658 - DNA, 20 bp, Artificial Sequence
  chemically synthesized
gtctttgtatcctcatagct

SEQ ID NO: 157659 - DNA, 20 bp, Artificial Sequence
  chemically synthesized
cgtatgtctttgtatcctca

SEQ ID NO: 157660 - DNA, 20 bp, Artificial Sequence
  chemically synthesized
agctaagctatgaggataca

SEQ ID NO: 157661 - DNA, 20 bp, Artificial Sequence
  chemically synthesized
tatgaggatacaaagacata

SEQ ID NO: 157662 - DNA, 20 bp, Artificial Sequence
  chemically synthesized
tgaggatacaaagacatacg

SEQ ID NO: 157663 - DNA, 20 bp, Artificial Sequence
  chemically synthesized
agacatacggagtgatacaa

SEQ ID NO: 157664 - DNA, 20 bp, Artificial Sequence
  chemically synthesized
cggagtgatacaatggactt

SEQ ID NO: 157665 - DNA, 20 bp, Artificial Sequence
  chemically synthesized
ggagtgatacaatggacttt

SEQ ID NO: 157666 - DNA, 20 bp, Artificial Sequence
  chemically synthesized
gagtgatacaatggactttg

SEQ ID NO: 157667 - DNA, 20 bp, Artificial Sequence
  chemically synthesized
ctccccacttagagtcccca

SEQ ID NO: 157668 - DNA, 20 bp, Artificial Sequence
  chemically synthesized
caatggactttggggactct

SEQ ID NO: 157669 - DNA, 20 bp, Artificial Sequence
  chemically synthesized
tggactttggggactctaag

SEQ ID NO: 157670 - DNA, 20 bp, Artificial Sequence
  chemically synthesized
ggactttggggactctaagt

SEQ ID NO: 157671 - DNA, 20 bp, Artificial Sequence
  chemically synthesized
gactttggggactctaagtg

SEQ ID NO: 157672 - DNA, 20 bp, Artificial Sequence
  chemically synthesized
actcccaagctccccactta

SEQ ID NO: 157673 - DNA, 20 bp, Artificial Sequence
  chemically synthesized
ctttggggactctaagtggg

SEQ ID NO: 157674 - DNA, 20 bp, Artificial Sequence
  chemically synthesized
tcactcccaagctccccact

SEQ ID NO: 157675 - DNA, 20 bp, Artificial Sequence
  chemically synthesized
gggactctaagtggggagct

SEQ ID NO: 157676 - DNA, 20 bp, Artificial Sequence
  chemically synthesized
ggactctaagtggggagctt

SEQ ID NO: 157677 - DNA, 20 bp, Artificial Sequence
  chemically synthesized
actctaagtggggagcttgg

SEQ ID NO: 157678 - DNA, 20 bp, Artificial Sequence
  chemically synthesized
taagtggggagcttgggagt

SEQ ID NO: 157679 - DNA, 20 bp, Artificial Sequence
  chemically synthesized
aagtggggagcttgggagtg

SEQ ID NO: 157680 - DNA, 20 bp, Artificial Sequence
  chemically synthesized
ttatcccttacctcactccc

SEQ ID NO: 157681 - DNA, 20 bp, Artificial Sequence
  chemically synthesized
ggggagcttgggagtgaggt

SEQ ID NO: 157682 - DNA, 20 bp, Artificial Sequence
  chemically synthesized
gggagcttgggagtgaggta

SEQ ID NO: 157683 - DNA, 20 bp, Artificial Sequence
  chemically synthesized
ggagcttgggagtgaggtaa

SEQ ID NO: 157684 - DNA, 20 bp, Artificial Sequence
  chemically synthesized
gggagtgaggtaagggataa

SEQ ID NO: 157685 - DNA, 20 bp, Artificial Sequence
  chemically synthesized
agggataaaagactatttat

SEQ ID NO: 157686 - DNA, 20 bp, Artificial Sequence
  chemically synthesized
gggataaaagactatttatt

SEQ ID NO: 157687 - DNA, 20 bp, Artificial Sequence
  chemically synthesized
tatatactgtacccaataaa

SEQ ID NO: 157688 - DNA, 20 bp, Artificial Sequence
  chemically synthesized
aaaagactatttattgggta

SEQ ID NO: 157689 - DNA, 20 bp, Artificial Sequence
  chemically synthesized
tatttattgggtacagtata

SEQ ID NO: 157690 - DNA, 20 bp, Artificial Sequence
  chemically synthesized
tgggtacagtatatagtact

SEQ ID NO: 157691 - DNA, 20 bp, Artificial Sequence
  chemically synthesized
gggtacagtatatagtactc

SEQ ID NO: 157692 - DNA, 20 bp, Artificial Sequence
  chemically synthesized
agtatatagtactcaggaaa

SEQ ID NO: 157693 - DNA, 20 bp, Artificial Sequence
  chemically synthesized
tttttatgtatccatttcct

SEQ ID NO: 157694 - DNA, 20 bp, Artificial Sequence
  chemically synthesized
aatggatacataaaaaattt

SEQ ID NO: 157695 - DNA, 20 bp, Artificial Sequence
  chemically synthesized
aatttcagaattcgccacta

SEQ ID NO: 157696 - DNA, 20 bp, Artificial Sequence
  chemically synthesized
tacatggatgagttctatag

SEQ ID NO: 157697 - DNA, 20 bp, Artificial Sequence
  chemically synthesized
ggttacatggatgagttcta

SEQ ID NO: 157698 - DNA, 20 bp, Artificial Sequence
  chemically synthesized
tggtttttggttacatggat

SEQ ID NO: 157699 - DNA, 20 bp, Artificial Sequence
  chemically synthesized
ataggtggtttttggttaca

SEQ ID NO: 157700 - DNA, 20 bp, Artificial Sequence
  chemically synthesized
ttgggggtataggtggtttt

SEQ ID NO: 157701 - DNA, 20 bp, Artificial Sequence
  chemically synthesized
agtagttttgggggtatagg

SEQ ID NO: 157702 - DNA, 20 bp, Artificial Sequence
  chemically synthesized
ttcagtagttttgggggtat

SEQ ID NO: 157703 - DNA, 20 bp, Artificial Sequence
  chemically synthesized
tttcagtagttttgggggta

SEQ ID NO: 157704 - DNA, 20 bp, Artificial Sequence
  chemically synthesized
tataatttcagtagttttgg

SEQ ID NO: 157705 - DNA, 20 bp, Artificial Sequence
  chemically synthesized
ttataatttcagtagttttg

SEQ ID NO: 157706 - DNA, 20 bp, Artificial Sequence
  chemically synthesized
tttataatttcagtagtttt

SEQ ID NO: 157707 - DNA, 20 bp, Artificial Sequence
  chemically synthesized
ttttataatttcagtagttt

SEQ ID NO: 157708 - DNA, 20 bp, Artificial Sequence
  chemically synthesized
cttattttttataatttcag

SEQ ID NO: 157709 - DNA, 20 bp, Artificial Sequence
  chemically synthesized
ttgcttattttttataattt

SEQ ID NO: 157710 - DNA, 20 bp, Artificial Sequence
  chemically synthesized
ctactgaaattataaaaaat

SEQ ID NO: 157711 - DNA, 20 bp, Artificial Sequence
  chemically synthesized
catatttatttgtgcggtac

SEQ ID NO: 157712 - DNA, 20 bp, Artificial Sequence
  chemically synthesized
attgtacatatttatttgtg

SEQ ID NO: 157713 - DNA, 20 bp, Artificial Sequence
  chemically synthesized
taaaaaaaaattttttaatt

SEQ ID NO: 157714 - DNA, 20 bp, Artificial Sequence
  chemically synthesized
attttttaattaagtttcct

SEQ ID NO: 157715 - DNA, 20 bp, Artificial Sequence
  chemically synthesized
ttttttaattaagtttccta

SEQ ID NO: 157716 - DNA, 20 bp, Artificial Sequence
  chemically synthesized
tttaattaagtttcctaagg

SEQ ID NO: 157717 - DNA, 20 bp, Artificial Sequence
  chemically synthesized
gccacaattgtagctacctt

SEQ ID NO: 157718 - DNA, 20 bp, Artificial Sequence
  chemically synthesized
agccacaattgtagctacct

SEQ ID NO: 157719 - DNA, 20 bp, Artificial Sequence
  chemically synthesized
tcctaaggtagctacaattg

SEQ ID NO: 157720 - DNA, 20 bp, Artificial Sequence
  chemically synthesized
caagaaagcagccacaattg

SEQ ID NO: 157721 - DNA, 20 bp, Artificial Sequence
  chemically synthesized
aaaaatatgaggcaagaaag

SEQ ID NO: 157722 - DNA, 20 bp, Artificial Sequence
  chemically synthesized
ccaaaaaatatgaggcaaga

SEQ ID NO: 157723 - DNA, 20 bp, Artificial Sequence
  chemically synthesized
atatccaaaaaatatgaggc

SEQ ID NO: 157724 - DNA, 20 bp, Artificial Sequence
  chemically synthesized
ttaaatatccaaaaaatatg

SEQ ID NO: 157725 - DNA, 20 bp, Artificial Sequence
  chemically synthesized
tttaaatatccaaaaaatat

SEQ ID NO: 157726 - DNA, 20 bp, Artificial Sequence
  chemically synthesized
ctttcttgcctcatattttt

SEQ ID NO: 157727 - DNA, 20 bp, Artificial Sequence
  chemically synthesized
tttttatgttttctatcatt

SEQ ID NO: 157728 - DNA, 20 bp, Artificial Sequence
  chemically synthesized
ttttttccttgtcttaatga

SEQ ID NO: 157729 - DNA, 20 bp, Artificial Sequence
  chemically synthesized
atgttttctatcattaagac

SEQ ID NO: 157730 - DNA, 20 bp, Artificial Sequence
  chemically synthesized
tgttttctatcattaagaca

SEQ ID NO: 157731 - DNA, 20 bp, Artificial Sequence
  chemically synthesized
tatcattaagacaaggaaaa

SEQ ID NO: 157732 - DNA, 20 bp, Artificial Sequence
  chemically synthesized
agacaaggaaaaaagccttc

SEQ ID NO: 157733 - DNA, 20 bp, Artificial Sequence
  chemically synthesized
aaataatatctatttctaga

SEQ ID NO: 157734 - DNA, 20 bp, Artificial Sequence
  chemically synthesized
ggaaaaaagccttctagaaa

SEQ ID NO: 157735 - DNA, 20 bp, Artificial Sequence
  chemically synthesized
caaataatatctatttctag

SEQ ID NO: 157736 - DNA, 20 bp, Artificial Sequence
  chemically synthesized
catcaaataatatctatttc

SEQ ID NO: 157737 - DNA, 20 bp, Artificial Sequence
  chemically synthesized
gaaatagatattatttgatg

SEQ ID NO: 157738 - DNA, 20 bp, Artificial Sequence
  chemically synthesized
gatattatttgatgtagaat

SEQ ID NO: 157739 - DNA, 20 bp, Artificial Sequence
  chemically synthesized
ttatttgatgtagaataagt

SEQ ID NO: 157740 - DNA, 20 bp, Artificial Sequence
  chemically synthesized
tatttgatgtagaataagta

SEQ ID NO: 157741 - DNA, 20 bp, Artificial Sequence
  chemically synthesized
aaaaaatcatttgtttaaaa

SEQ ID NO: 157742 - DNA, 20 bp, Artificial Sequence
  chemically synthesized
atttgtttaaaaaagtaaac

SEQ ID NO: 157743 - DNA, 20 bp, Artificial Sequence
  chemically synthesized
taaaaaagtaaactagaata

SEQ ID NO: 157744 - DNA, 20 bp, Artificial Sequence
  chemically synthesized
tagagtttaaaactatattc

SEQ ID NO: 157745 - DNA, 20 bp, Artificial Sequence
  chemically synthesized
tatagttttaaactctattt

SEQ ID NO: 157746 - DNA, 20 bp, Artificial Sequence
  chemically synthesized
gaaaatctcaaactcaaata

SEQ ID NO: 157747 - DNA, 20 bp, Artificial Sequence
  chemically synthesized
ttgaaaatctcaaactcaaa

SEQ ID NO: 157748 - DNA, 20 bp, Artificial Sequence
  chemically synthesized
tttaaactctatttgagttt

SEQ ID NO: 157749 - DNA, 20 bp, Artificial Sequence
  chemically synthesized
aaaaatatatcttgtgtcaa

SEQ ID NO: 157750 - DNA, 20 bp, Artificial Sequence
  chemically synthesized
tgcatgccaaccattgacac

SEQ ID NO: 157751 - DNA, 20 bp, Artificial Sequence
  chemically synthesized
atatatcttgtgtcaatggt

SEQ ID NO: 157752 - DNA, 20 bp, Artificial Sequence
  chemically synthesized
agagtcctttatttattcag

SEQ ID NO: 157753 - DNA, 20 bp, Artificial Sequence
  chemically synthesized
ggtagagtcctttatttatt

SEQ ID NO: 157754 - DNA, 20 bp, Artificial Sequence
  chemically synthesized
taatatctactgaataaata

SEQ ID NO: 157755 - DNA, 20 bp, Artificial Sequence
  chemically synthesized
aatatctactgaataaataa

SEQ ID NO: 157756 - DNA, 20 bp, Artificial Sequence
  chemically synthesized
taaataaaggactctaccta

SEQ ID NO: 157757 - DNA, 20 bp, Artificial Sequence
  chemically synthesized
tatatatacagccgtaggta

SEQ ID NO: 157758 - DNA, 20 bp, Artificial Sequence
  chemically synthesized
tgtatatatacagccgtagg

SEQ ID NO: 157759 - DNA, 20 bp, Artificial Sequence
  chemically synthesized
gcctgtatatatacagccgt

SEQ ID NO: 157760 - DNA, 20 bp, Artificial Sequence
  chemically synthesized
tgcctgtatatatacagccg

SEQ ID NO: 157761 - DNA, 20 bp, Artificial Sequence
  chemically synthesized
aatgtatgcctgtatatata

SEQ ID NO: 157762 - DNA, 20 bp, Artificial Sequence
  chemically synthesized
tacctacggctgtatatata

SEQ ID NO: 157763 - DNA, 20 bp, Artificial Sequence
  chemically synthesized
acctacggctgtatatatac

SEQ ID NO: 157764 - DNA, 20 bp, Artificial Sequence
  chemically synthesized
acaaagagacatagatgttt

SEQ ID NO: 157765 - DNA, 20 bp, Artificial Sequence
  chemically synthesized
aagagagagacaaagagaca

SEQ ID NO: 157766 - DNA, 20 bp, Artificial Sequence
  chemically synthesized
cacttaaagagagagacaaa

SEQ ID NO: 157767 - DNA, 20 bp, Artificial Sequence
  chemically synthesized
tacacttaaagagagagaca

SEQ ID NO: 157768 - DNA, 20 bp, Artificial Sequence
  chemically synthesized
gtctctttgtctctctcttt

SEQ ID NO: 157769 - DNA, 20 bp, Artificial Sequence
  chemically synthesized
attagttacacttaaagaga

SEQ ID NO: 157770 - DNA, 20 bp, Artificial Sequence
  chemically synthesized
gtattagttacacttaaaga

SEQ ID NO: 157771 - DNA, 20 bp, Artificial Sequence
  chemically synthesized
ttgtattagttacacttaaa

SEQ ID NO: 157772 - DNA, 20 bp, Artificial Sequence
  chemically synthesized
agttgtattagttacactta

SEQ ID NO: 157773 - DNA, 20 bp, Artificial Sequence
  chemically synthesized
cctcttgtcctcagttgtat

SEQ ID NO: 157774 - DNA, 20 bp, Artificial Sequence
  chemically synthesized
taagtgtaactaatacaact

SEQ ID NO: 157775 - DNA, 20 bp, Artificial Sequence
  chemically synthesized
aagtgtaactaatacaactg

SEQ ID NO: 157776 - DNA, 20 bp, Artificial Sequence
  chemically synthesized
taactaatacaactgaggac

SEQ ID NO: 157777 - DNA, 20 bp, Artificial Sequence
  chemically synthesized
actaatacaactgaggacaa

SEQ ID NO: 157778 - DNA, 20 bp, Artificial Sequence
  chemically synthesized
tgaatttcacctcttgtcct

SEQ ID NO: 157779 - DNA, 20 bp, Artificial Sequence
  chemically synthesized
ctaatacaactgaggacaag

SEQ ID NO: 157780 - DNA, 20 bp, Artificial Sequence
  chemically synthesized
gaaattagggaagcatttta

SEQ ID NO: 157781 - DNA, 20 bp, Artificial Sequence
  chemically synthesized
ctgaaattagggaagcattt

SEQ ID NO: 157782 - DNA, 20 bp, Artificial Sequence
  chemically synthesized
agctcatgctgaaattaggg

SEQ ID NO: 157783 - DNA, 20 bp, Artificial Sequence
  chemically synthesized
ctaaaatgcttccctaattt

SEQ ID NO: 157784 - DNA, 20 bp, Artificial Sequence
  chemically synthesized
agtagctcatgctgaaatta

SEQ ID NO: 157785 - DNA, 20 bp, Artificial Sequence
  chemically synthesized
cagtagctcatgctgaaatt

SEQ ID NO: 157786 - DNA, 20 bp, Artificial Sequence
  chemically synthesized
tcagtagctcatgctgaaat

SEQ ID NO: 157787 - DNA, 20 bp, Artificial Sequence
  chemically synthesized
tgcttccctaatttcagcat

SEQ ID NO: 157788 - DNA, 20 bp, Artificial Sequence
  chemically synthesized
taatttcagcatgagctact

SEQ ID NO: 157789 - DNA, 20 bp, Artificial Sequence
  chemically synthesized
gaaaagtctcatgtactcag

SEQ ID NO: 157790 - DNA, 20 bp, Artificial Sequence
  chemically synthesized
gcatgagctactgagtacat

SEQ ID NO: 157791 - DNA, 20 bp, Artificial Sequence
  chemically synthesized
agtgaaaagtctcatgtact

SEQ ID NO: 157792 - DNA, 20 bp, Artificial Sequence
  chemically synthesized
tgagagaatatttgagtgaa

SEQ ID NO: 157793 - DNA, 20 bp, Artificial Sequence
  chemically synthesized
tcttttctgagagaatattt

SEQ ID NO: 157794 - DNA, 20 bp, Artificial Sequence
  chemically synthesized
ttttcactcaaatattctct

SEQ ID NO: 157795 - DNA, 20 bp, Artificial Sequence
  chemically synthesized
actcaaatattctctcagaa

SEQ ID NO: 157796 - DNA, 20 bp, Artificial Sequence
  chemically synthesized
gagccaactttcttttctga

SEQ ID NO: 157797 - DNA, 20 bp, Artificial Sequence
  chemically synthesized
atgagccaactttcttttct

SEQ ID NO: 157798 - DNA, 20 bp, Artificial Sequence
  chemically synthesized
aaatattctctcagaaaaga

SEQ ID NO: 157799 - DNA, 20 bp, Artificial Sequence
  chemically synthesized
attctctcagaaaagaaagt

SEQ ID NO: 157800 - DNA, 20 bp, Artificial Sequence
  chemically synthesized
aagaaagttggctcatattc

SEQ ID NO: 157801 - DNA, 20 bp, Artificial Sequence
  chemically synthesized
tagtataaagtcttgaatat

SEQ ID NO: 157802 - DNA, 20 bp, Artificial Sequence
  chemically synthesized
gagacataagagatagtata

SEQ ID NO: 157803 - DNA, 20 bp, Artificial Sequence
  chemically synthesized
aataattgagacataagaga

SEQ ID NO: 157804 - DNA, 20 bp, Artificial Sequence
  chemically synthesized
ataaaataattgagacataa

SEQ ID NO: 157805 - DNA, 20 bp, Artificial Sequence
  chemically synthesized
gaataaaataattgagacat

SEQ ID NO: 157806 - DNA, 20 bp, Artificial Sequence
  chemically synthesized
tggttccgaataaaataatt

SEQ ID NO: 157807 - DNA, 20 bp, Artificial Sequence
  chemically synthesized
tatgtctcaattattttatt

SEQ ID NO: 157808 - DNA, 20 bp, Artificial Sequence
  chemically synthesized
caggctaatatacaacattg

SEQ ID NO: 157809 - DNA, 20 bp, Artificial Sequence
  chemically synthesized
ggaaccacaatgttgtatat

SEQ ID NO: 157810 - DNA, 20 bp, Artificial Sequence
  chemically synthesized
acatctcttgaggttatttc

SEQ ID NO: 157811 - DNA, 20 bp, Artificial Sequence
  chemically synthesized
cacatctcttgaggttattt

SEQ ID NO: 157812 - DNA, 20 bp, Artificial Sequence
  chemically synthesized
tattagcctgaaataacctc

SEQ ID NO: 157813 - DNA, 20 bp, Artificial Sequence
  chemically synthesized
ttagcctgaaataacctcaa

SEQ ID NO: 157814 - DNA, 20 bp, Artificial Sequence
  chemically synthesized
tgtaagcatcacatctcttg

SEQ ID NO: 157815 - DNA, 20 bp, Artificial Sequence
  chemically synthesized
atgtaagcatcacatctctt

SEQ ID NO: 157816 - DNA, 20 bp, Artificial Sequence
  chemically synthesized
aagagatgtgatgcttacat

SEQ ID NO: 157817 - DNA, 20 bp, Artificial Sequence
  chemically synthesized
ttctgtcagaatacttatgt

SEQ ID NO: 157818 - DNA, 20 bp, Artificial Sequence
  chemically synthesized
tgcttacataagtattctga

SEQ ID NO: 157819 - DNA, 20 bp, Artificial Sequence
  chemically synthesized
tttaattaagcaaattctgt

SEQ ID NO: 157820 - DNA, 20 bp, Artificial Sequence
  chemically synthesized
acagaatttgcttaattaaa

SEQ ID NO: 157821 - DNA, 20 bp, Artificial Sequence
  chemically synthesized
ctttgcctccctttttaatt

SEQ ID NO: 157822 - DNA, 20 bp, Artificial Sequence
  chemically synthesized
cagaatttgcttaattaaaa

SEQ ID NO: 157823 - DNA, 20 bp, Artificial Sequence
  chemically synthesized
agaatttgcttaattaaaaa

SEQ ID NO: 157824 - DNA, 20 bp, Artificial Sequence
  chemically synthesized
aatttgcttaattaaaaagg

SEQ ID NO: 157825 - DNA, 20 bp, Artificial Sequence
  chemically synthesized
atttgcttaattaaaaaggg

SEQ ID NO: 157826 - DNA, 20 bp, Artificial Sequence
  chemically synthesized
cttaattaaaaagggaggca

SEQ ID NO: 157827 - DNA, 20 bp, Artificial Sequence
  chemically synthesized
attaaaaagggaggcaaaga

SEQ ID NO: 157828 - DNA, 20 bp, Artificial Sequence
  chemically synthesized
aaagaaagttgataaatctt

SEQ ID NO: 157829 - DNA, 20 bp, Artificial Sequence
  chemically synthesized
tacattaggaatgattgcta

SEQ ID NO: 157830 - DNA, 20 bp, Artificial Sequence
  chemically synthesized
tagcaatcattcctaatgta

SEQ ID NO: 157831 - DNA, 20 bp, Artificial Sequence
  chemically synthesized
tgattgtgaagctatacatt

SEQ ID NO: 157832 - DNA, 20 bp, Artificial Sequence
  chemically synthesized
gtgattgtgaagctatacat

SEQ ID NO: 157833 - DNA, 20 bp, Artificial Sequence
  chemically synthesized
ctctgccacgagtgattgtg

SEQ ID NO: 157834 - DNA, 20 bp, Artificial Sequence
  chemically synthesized
tatagcttcacaatcactcg

SEQ ID NO: 157835 - DNA, 20 bp, Artificial Sequence
  chemically synthesized
agcttcacaatcactcgtgg

SEQ ID NO: 157836 - DNA, 20 bp, Artificial Sequence
  chemically synthesized
cttcacaatcactcgtggca

SEQ ID NO: 157837 - DNA, 20 bp, Artificial Sequence
  chemically synthesized
tttacaatgatctctgccac

SEQ ID NO: 157838 - DNA, 20 bp, Artificial Sequence
  chemically synthesized
tggcagagatcattgtaaac

SEQ ID NO: 157839 - DNA, 20 bp, Artificial Sequence
  chemically synthesized
cattgtaaacgagtctttca

SEQ ID NO: 157840 - DNA, 20 bp, Artificial Sequence
  chemically synthesized
ctttttaacaaattctttga

SEQ ID NO: 157841 - DNA, 20 bp, Artificial Sequence
  chemically synthesized
ctttcaaagaatttgttaaa

SEQ ID NO: 157842 - DNA, 20 bp, Artificial Sequence
  chemically synthesized
tttctgctttttaagttgtt

SEQ ID NO: 157843 - DNA, 20 bp, Artificial Sequence
  chemically synthesized
aaaaagccaaacaacttaaa

SEQ ID NO: 157844 - DNA, 20 bp, Artificial Sequence
  chemically synthesized
aagccaaacaacttaaaaag

SEQ ID NO: 157845 - DNA, 20 bp, Artificial Sequence
  chemically synthesized
acatattctttctgcttttt

SEQ ID NO: 157846 - DNA, 20 bp, Artificial Sequence
  chemically synthesized
caaacaacttaaaaagcaga

SEQ ID NO: 157847 - DNA, 20 bp, Artificial Sequence
  chemically synthesized
aaaaagcagaaagaatatgt

SEQ ID NO: 157848 - DNA, 20 bp, Artificial Sequence
  chemically synthesized
gaaagaatatgttagtctat

SEQ ID NO: 157849 - DNA, 20 bp, Artificial Sequence
  chemically synthesized
aaagaatatgttagtctatt

SEQ ID NO: 157850 - DNA, 20 bp, Artificial Sequence
  chemically synthesized
gatcttttaaaaattcccaa

SEQ ID NO: 157851 - DNA, 20 bp, Artificial Sequence
  chemically synthesized
agtctattgggaatttttaa

SEQ ID NO: 157852 - DNA, 20 bp, Artificial Sequence
  chemically synthesized
aatttttaaaagatcacatc

SEQ ID NO: 157853 - DNA, 20 bp, Artificial Sequence
  chemically synthesized
tttaaaagatcacatctggc

SEQ ID NO: 157854 - DNA, 20 bp, Artificial Sequence
  chemically synthesized
ttaaaagatcacatctggct

SEQ ID NO: 157855 - DNA, 20 bp, Artificial Sequence
  chemically synthesized
cgtgagccactgcacccagc

SEQ ID NO: 157856 - DNA, 20 bp, Artificial Sequence
  chemically synthesized
agatcacatctggctgggtg

SEQ ID NO: 157857 - DNA, 20 bp, Artificial Sequence
  chemically synthesized
tcacatctggctgggtgcag

SEQ ID NO: 157858 - DNA, 20 bp, Artificial Sequence
  chemically synthesized
caggcgtgagccactgcacc

SEQ ID NO: 157859 - DNA, 20 bp, Artificial Sequence
  chemically synthesized
agtcctgggattacaggcgt

SEQ ID NO: 157860 - DNA, 20 bp, Artificial Sequence
  chemically synthesized
gtggctcacgcctgtaatcc

SEQ ID NO: 157861 - DNA, 20 bp, Artificial Sequence
  chemically synthesized
tcccaaagtcctgggattac

SEQ ID NO: 157862 - DNA, 20 bp, Artificial Sequence
  chemically synthesized
tggctcacgcctgtaatccc

SEQ ID NO: 157863 - DNA, 20 bp, Artificial Sequence
  chemically synthesized
ctcccaaagtcctgggatta

SEQ ID NO: 157864 - DNA, 20 bp, Artificial Sequence
  chemically synthesized
cgcctgtaatcccaggactt

SEQ ID NO: 157865 - DNA, 20 bp, Artificial Sequence
  chemically synthesized
cctcggcctcccaaagtcct

SEQ ID NO: 157866 - DNA, 20 bp, Artificial Sequence
  chemically synthesized
gcctgtaatcccaggacttt

SEQ ID NO: 157867 - DNA, 20 bp, Artificial Sequence
  chemically synthesized
gcctcggcctcccaaagtcc

SEQ ID NO: 157868 - DNA, 20 bp, Artificial Sequence
  chemically synthesized
ctgtaatcccaggactttgg

SEQ ID NO: 157869 - DNA, 20 bp, Artificial Sequence
  chemically synthesized
tgtaatcccaggactttggg

SEQ ID NO: 157870 - DNA, 20 bp, Artificial Sequence
  chemically synthesized
caggctgcctcggcctccca

SEQ ID NO: 157871 - DNA, 20 bp, Artificial Sequence
  chemically synthesized
tcccaggactttgggaggcc

SEQ ID NO: 157872 - DNA, 20 bp, Artificial Sequence
  chemically synthesized
cccaggactttgggaggccg

SEQ ID NO: 157873 - DNA, 20 bp, Artificial Sequence
  chemically synthesized
aggactttgggaggccgagg

SEQ ID NO: 157874 - DNA, 20 bp, Artificial Sequence
  chemically synthesized
ctcaggtgatcaggctgcct

SEQ ID NO: 157875 - DNA, 20 bp, Artificial Sequence
  chemically synthesized
actcccgacctcaggtgatc

SEQ ID NO: 157876 - DNA, 20 bp, Artificial Sequence
  chemically synthesized
ccgaggcagcctgatcacct

SEQ ID NO: 157877 - DNA, 20 bp, Artificial Sequence
  chemically synthesized
aactcccgacctcaggtgat

SEQ ID NO: 157878 - DNA, 20 bp, Artificial Sequence
  chemically synthesized
cgaggcagcctgatcacctg

SEQ ID NO: 157879 - DNA, 20 bp, Artificial Sequence
  chemically synthesized
gcagcctgatcacctgaggt

SEQ ID NO: 157880 - DNA, 20 bp, Artificial Sequence
  chemically synthesized
cagcctgatcacctgaggtc

SEQ ID NO: 157881 - DNA, 20 bp, Artificial Sequence
  chemically synthesized
ggtctcgaactcccgacctc

SEQ ID NO: 157882 - DNA, 20 bp, Artificial Sequence
  chemically synthesized
gcctgatcacctgaggtcgg

SEQ ID NO: 157883 - DNA, 20 bp, Artificial Sequence
  chemically synthesized
tggtctcgaactcccgacct

SEQ ID NO: 157884 - DNA, 20 bp, Artificial Sequence
  chemically synthesized
tcacctgaggtcgggagttc

SEQ ID NO: 157885 - DNA, 20 bp, Artificial Sequence
  chemically synthesized
tgaggtcgggagttcgagac

SEQ ID NO: 157886 - DNA, 20 bp, Artificial Sequence
  chemically synthesized
tttctccacgttggtcaagc

SEQ ID NO: 157887 - DNA, 20 bp, Artificial Sequence
  chemically synthesized
ggggtttctccacgttggtc

SEQ ID NO: 157888 - DNA, 20 bp, Artificial Sequence
  chemically synthesized
cgagaccagcttgaccaacg

SEQ ID NO: 157889 - DNA, 20 bp, Artificial Sequence
  chemically synthesized
agaccagcttgaccaacgtg

SEQ ID NO: 157890 - DNA, 20 bp, Artificial Sequence
  chemically synthesized
gagatggggtttctccacgt

SEQ ID NO: 157891 - DNA, 20 bp, Artificial Sequence
  chemically synthesized
ttgtatttttagtagagatg

SEQ ID NO: 157892 - DNA, 20 bp, Artificial Sequence
  chemically synthesized
tttgtatttttagtagagat

SEQ ID NO: 157893 - DNA, 20 bp, Artificial Sequence
  chemically synthesized
ttttgtatttttagtagaga

SEQ ID NO: 157894 - DNA, 20 bp, Artificial Sequence
  chemically synthesized
ctaattttgtatttttagta

SEQ ID NO: 157895 - DNA, 20 bp, Artificial Sequence
  chemically synthesized
agctaattttgtatttttag

SEQ ID NO: 157896 - DNA, 20 bp, Artificial Sequence
  chemically synthesized
cccagctaattttgtatttt

SEQ ID NO: 157897 - DNA, 20 bp, Artificial Sequence
  chemically synthesized
ctctactaaaaatacaaaat

SEQ ID NO: 157898 - DNA, 20 bp, Artificial Sequence
  chemically synthesized
actaaaaatacaaaattagc

SEQ ID NO: 157899 - DNA, 20 bp, Artificial Sequence
  chemically synthesized
ctaaaaatacaaaattagct

SEQ ID NO: 157900 - DNA, 20 bp, Artificial Sequence
  chemically synthesized
aatacaaaattagctgggca

SEQ ID NO: 157901 - DNA, 20 bp, Artificial Sequence
  chemically synthesized
acaaaattagctgggcatgg

SEQ ID NO: 157902 - DNA, 20 bp, Artificial Sequence
  chemically synthesized
caggcgcccaccaccatgcc

SEQ ID NO: 157903 - DNA, 20 bp, Artificial Sequence
  chemically synthesized
aaattagctgggcatggtgg

SEQ ID NO: 157904 - DNA, 20 bp, Artificial Sequence
  chemically synthesized
aattagctgggcatggtggt

SEQ ID NO: 157905 - DNA, 20 bp, Artificial Sequence
  chemically synthesized
gtggtgggcgcctgtaatcc

SEQ ID NO: 157906 - DNA, 20 bp, Artificial Sequence
  chemically synthesized
ttccaagtagctgggattac

SEQ ID NO: 157907 - DNA, 20 bp, Artificial Sequence
  chemically synthesized
cttccaagtagctgggatta

SEQ ID NO: 157908 - DNA, 20 bp, Artificial Sequence
  chemically synthesized
cgcctgtaatcccagctact

SEQ ID NO: 157909 - DNA, 20 bp, Artificial Sequence
  chemically synthesized
cctcagccttccaagtagct

SEQ ID NO: 157910 - DNA, 20 bp, Artificial Sequence
  chemically synthesized
gcctcagccttccaagtagc

SEQ ID NO: 157911 - DNA, 20 bp, Artificial Sequence
  chemically synthesized
ctgtaatcccagctacttgg

SEQ ID NO: 157912 - DNA, 20 bp, Artificial Sequence
  chemically synthesized
tgtaatcccagctacttgga

SEQ ID NO: 157913 - DNA, 20 bp, Artificial Sequence
  chemically synthesized
tcctgcctcagccttccaag

SEQ ID NO: 157914 - DNA, 20 bp, Artificial Sequence
  chemically synthesized
ttctcctgcctcagccttcc

SEQ ID NO: 157915 - DNA, 20 bp, Artificial Sequence
  chemically synthesized
tcccagctacttggaaggct

SEQ ID NO: 157916 - DNA, 20 bp, Artificial Sequence
  chemically synthesized
cccagctacttggaaggctg

SEQ ID NO: 157917 - DNA, 20 bp, Artificial Sequence
  chemically synthesized
agctacttggaaggctgagg

SEQ ID NO: 157918 - DNA, 20 bp, Artificial Sequence
  chemically synthesized
gctacttggaaggctgaggc

SEQ ID NO: 157919 - DNA, 20 bp, Artificial Sequence
  chemically synthesized
tacttggaaggctgaggcag

SEQ ID NO: 157920 - DNA, 20 bp, Artificial Sequence
  chemically synthesized
ttcaagcgattctcctgcct

SEQ ID NO: 157921 - DNA, 20 bp, Artificial Sequence
  chemically synthesized
gcaggagaatcgcttgaacc

SEQ ID NO: 157922 - DNA, 20 bp, Artificial Sequence
  chemically synthesized
caggagaatcgcttgaacct

SEQ ID NO: 157923 - DNA, 20 bp, Artificial Sequence
  chemically synthesized
aacctacacctcccaggttc

SEQ ID NO: 157924 - DNA, 20 bp, Artificial Sequence
  chemically synthesized
ggagaatcgcttgaacctgg

SEQ ID NO: 157925 - DNA, 20 bp, Artificial Sequence
  chemically synthesized
gagaatcgcttgaacctggg

SEQ ID NO: 157926 - DNA, 20 bp, Artificial Sequence
  chemically synthesized
caccgcaacctacacctccc

SEQ ID NO: 157927 - DNA, 20 bp, Artificial Sequence
  chemically synthesized
tcgcttgaacctgggaggtg

SEQ ID NO: 157928 - DNA, 20 bp, Artificial Sequence
  chemically synthesized
tcaccgcaacctacacctcc

SEQ ID NO: 157929 - DNA, 20 bp, Artificial Sequence
  chemically synthesized
cgcttgaacctgggaggtgt

SEQ ID NO: 157930 - DNA, 20 bp, Artificial Sequence
  chemically synthesized
aacctgggaggtgtaggttg

SEQ ID NO: 157931 - DNA, 20 bp, Artificial Sequence
  chemically synthesized
tgggaggtgtaggttgcggt

SEQ ID NO: 157932 - DNA, 20 bp, Artificial Sequence
  chemically synthesized
ggtgtaggttgcggtgagcc

SEQ ID NO: 157933 - DNA, 20 bp, Artificial Sequence
  chemically synthesized
ggagtgcggtggcgcgatct

SEQ ID NO: 157934 - DNA, 20 bp, Artificial Sequence
  chemically synthesized
ttgcccaggctggagtgcgg

SEQ ID NO: 157935 - DNA, 20 bp, Artificial Sequence
  chemically synthesized
gagatcgcgccaccgcactc

SEQ ID NO: 157936 - DNA, 20 bp, Artificial Sequence
  chemically synthesized
ttgttgcccaggctggagtg

SEQ ID NO: 157937 - DNA, 20 bp, Artificial Sequence
  chemically synthesized
cgcgccaccgcactccagcc

SEQ ID NO: 157938 - DNA, 20 bp, Artificial Sequence
  chemically synthesized
gcgccaccgcactccagcct

SEQ ID NO: 157939 - DNA, 20 bp, Artificial Sequence
  chemically synthesized
cgctcttgttgcccaggctg

SEQ ID NO: 157940 - DNA, 20 bp, Artificial Sequence
  chemically synthesized
ttcgctcttgttgcccaggc

SEQ ID NO: 157941 - DNA, 20 bp, Artificial Sequence
  chemically synthesized
cgcactccagcctgggcaac

SEQ ID NO: 157942 - DNA, 20 bp, Artificial Sequence
  chemically synthesized
gagtttcgctcttgttgccc

SEQ ID NO: 157943 - DNA, 20 bp, Artificial Sequence
  chemically synthesized
ggagtttcgctcttgttgcc

SEQ ID NO: 157944 - DNA, 20 bp, Artificial Sequence
  chemically synthesized
cactccagcctgggcaacaa

SEQ ID NO: 157945 - DNA, 20 bp, Artificial Sequence
  chemically synthesized
gtttgtttgtttttgagacg

SEQ ID NO: 157946 - DNA, 20 bp, Artificial Sequence
  chemically synthesized
ttgtttgtttgtttttgaga

SEQ ID NO: 157947 - DNA, 20 bp, Artificial Sequence
  chemically synthesized
ttggttgtttgtttgttttt

SEQ ID NO: 157948 - DNA, 20 bp, Artificial Sequence
  chemically synthesized
atttttcttagatatgattt

SEQ ID NO: 157949 - DNA, 20 bp, Artificial Sequence
  chemically synthesized
aaacaaccaaaatcatatct

SEQ ID NO: 157950 - DNA, 20 bp, Artificial Sequence
  chemically synthesized
actgtttttttcatttttct

SEQ ID NO: 157951 - DNA, 20 bp, Artificial Sequence
  chemically synthesized
tctaagaaaaatgaaaaaaa

SEQ ID NO: 157952 - DNA, 20 bp, Artificial Sequence
  chemically synthesized
atacccattcacaaaatatt

SEQ ID NO: 157953 - DNA, 20 bp, Artificial Sequence
  chemically synthesized
aatacccattcacaaaatat

SEQ ID NO: 157954 - DNA, 20 bp, Artificial Sequence
  chemically synthesized
ttttcctaatattttgtgaa

SEQ ID NO: 157955 - DNA, 20 bp, Artificial Sequence
  chemically synthesized
tttcctaatattttgtgaat

SEQ ID NO: 157956 - DNA, 20 bp, Artificial Sequence
  chemically synthesized
tattttgtgaatgggtattg

SEQ ID NO: 157957 - DNA, 20 bp, Artificial Sequence
  chemically synthesized
tgtgaatgggtattgaagtt

SEQ ID NO: 157958 - DNA, 20 bp, Artificial Sequence
  chemically synthesized
gtgaatgggtattgaagttt

SEQ ID NO: 157959 - DNA, 20 bp, Artificial Sequence
  chemically synthesized
gaagtttgggataaaaattt

SEQ ID NO: 157960 - DNA, 20 bp, Artificial Sequence
  chemically synthesized
tgggataaaaatttcagcga

SEQ ID NO: 157961 - DNA, 20 bp, Artificial Sequence
  chemically synthesized
aaaatttcagcgacagcatt

SEQ ID NO: 157962 - DNA, 20 bp, Artificial Sequence
  chemically synthesized
agcattgagaacgtgaaaaa

SEQ ID NO: 157963 - DNA, 20 bp, Artificial Sequence
  chemically synthesized
gtgaaaaatagctctgctga

SEQ ID NO: 157964 - DNA, 20 bp, Artificial Sequence
  chemically synthesized
ccagctgccagctatcagca

SEQ ID NO: 157965 - DNA, 20 bp, Artificial Sequence
  chemically synthesized
tgccagctgccagctatcag

SEQ ID NO: 157966 - DNA, 20 bp, Artificial Sequence
  chemically synthesized
aaaatagctctgctgatagc

SEQ ID NO: 157967 - DNA, 20 bp, Artificial Sequence
  chemically synthesized
agctgccagctgccagctat

SEQ ID NO: 157968 - DNA, 20 bp, Artificial Sequence
  chemically synthesized
atagctctgctgatagctgg

SEQ ID NO: 157969 - DNA, 20 bp, Artificial Sequence
  chemically synthesized
ctctgctgatagctggcagc

SEQ ID NO: 157970 - DNA, 20 bp, Artificial Sequence
  chemically synthesized
cctagctagctgccagctgc

SEQ ID NO: 157971 - DNA, 20 bp, Artificial Sequence
  chemically synthesized
tgctgatagctggcagctgg

SEQ ID NO: 157972 - DNA, 20 bp, Artificial Sequence
  chemically synthesized
gatagctggcagctggcagc

SEQ ID NO: 157973 - DNA, 20 bp, Artificial Sequence
  chemically synthesized
atcatggcctagctagctgc

SEQ ID NO: 157974 - DNA, 20 bp, Artificial Sequence
  chemically synthesized
gctggcagctggcagctagc

SEQ ID NO: 157975 - DNA, 20 bp, Artificial Sequence
  chemically synthesized
ctggcagctggcagctagct

SEQ ID NO: 157976 - DNA, 20 bp, Artificial Sequence
  chemically synthesized
tgggaccatcatggcctagc

SEQ ID NO: 157977 - DNA, 20 bp, Artificial Sequence
  chemically synthesized
cagctgggaccatcatggcc

SEQ ID NO: 157978 - DNA, 20 bp, Artificial Sequence
  chemically synthesized
ggcagctagctaggccatga

SEQ ID NO: 157979 - DNA, 20 bp, Artificial Sequence
  chemically synthesized
acatccagctgggaccatca

SEQ ID NO: 157980 - DNA, 20 bp, Artificial Sequence
  chemically synthesized
tagctaggccatgatggtcc

SEQ ID NO: 157981 - DNA, 20 bp, Artificial Sequence
  chemically synthesized
taggccatgatggtcccagc

SEQ ID NO: 157982 - DNA, 20 bp, Artificial Sequence
  chemically synthesized
gtgttttttaacatccagct

SEQ ID NO: 157983 - DNA, 20 bp, Artificial Sequence
  chemically synthesized
agtgttttttaacatccagc

SEQ ID NO: 157984 - DNA, 20 bp, Artificial Sequence
  chemically synthesized
tatgagtgttttttaacatc

SEQ ID NO: 157985 - DNA, 20 bp, Artificial Sequence
  chemically synthesized
tggatgttaaaaaacactca

SEQ ID NO: 157986 - DNA, 20 bp, Artificial Sequence
  chemically synthesized
tctgcctagtttatttctat

SEQ ID NO: 157987 - DNA, 20 bp, Artificial Sequence
  chemically synthesized
aaacactcatagaaataaac

SEQ ID NO: 157988 - DNA, 20 bp, Artificial Sequence
  chemically synthesized
aacactcatagaaataaact

SEQ ID NO: 157989 - DNA, 20 bp, Artificial Sequence
  chemically synthesized
actcatagaaataaactagg

SEQ ID NO: 157990 - DNA, 20 bp, Artificial Sequence
  chemically synthesized
ggggtggccttgtgtctgcc

SEQ ID NO: 157991 - DNA, 20 bp, Artificial Sequence
  chemically synthesized
gaaataaactaggcagacac

SEQ ID NO: 157992 - DNA, 20 bp, Artificial Sequence
  chemically synthesized
aaataaactaggcagacaca

SEQ ID NO: 157993 - DNA, 20 bp, Artificial Sequence
  chemically synthesized
gcagacacaaggccacccca

SEQ ID NO: 157994 - DNA, 20 bp, Artificial Sequence
  chemically synthesized
tttcaaacacggccatgggg

SEQ ID NO: 157995 - DNA, 20 bp, Artificial Sequence
  chemically synthesized
ttgtttcaaacacggccatg

SEQ ID NO: 157996 - DNA, 20 bp, Artificial Sequence
  chemically synthesized
cttgtttcaaacacggccat

SEQ ID NO: 157997 - DNA, 20 bp, Artificial Sequence
  chemically synthesized
tcttgtttcaaacacggcca

SEQ ID NO: 157998 - DNA, 20 bp, Artificial Sequence
  chemically synthesized
tctctgtcttgtttcaaaca

SEQ ID NO: 157999 - DNA, 20 bp, Artificial Sequence
  chemically synthesized
cccatggccgtgtttgaaac

SEQ ID NO: 158000 - DNA, 20 bp, Artificial Sequence
  chemically synthesized
tggccgtgtttgaaacaaga

SEQ ID NO: 158001 - DNA, 20 bp, Artificial Sequence
  chemically synthesized
gccgtgtttgaaacaagaca

SEQ ID NO: 158002 - DNA, 20 bp, Artificial Sequence
  chemically synthesized
gtttgaaacaagacagagac

SEQ ID NO: 158003 - DNA, 20 bp, Artificial Sequence
  chemically synthesized
tttgaaacaagacagagaca

SEQ ID NO: 158004 - DNA, 20 bp, Artificial Sequence
  chemically synthesized
tcatttctgtgatagcagaa

SEQ ID NO: 158005 - DNA, 20 bp, Artificial Sequence
  chemically synthesized
gtcatttctgtgatagcaga

SEQ ID NO: 158006 - DNA, 20 bp, Artificial Sequence
  chemically synthesized
acaaggcctttctgctatca

SEQ ID NO: 158007 - DNA, 20 bp, Artificial Sequence
  chemically synthesized
attagtcatttctgtgatag

SEQ ID NO: 158008 - DNA, 20 bp, Artificial Sequence
  chemically synthesized
catattagtcatttctgtga

SEQ ID NO: 158009 - DNA, 20 bp, Artificial Sequence
  chemically synthesized
atcacagaaatgactaatat

SEQ ID NO: 158010 - DNA, 20 bp, Artificial Sequence
  chemically synthesized
tcacagaaatgactaatatg

SEQ ID NO: 158011 - DNA, 20 bp, Artificial Sequence
  chemically synthesized
ggagcagcaatgcctcatat

SEQ ID NO: 158012 - DNA, 20 bp, Artificial Sequence
  chemically synthesized
acacgtcgttggtaaaggag

SEQ ID NO: 158013 - DNA, 20 bp, Artificial Sequence
  chemically synthesized
tagacacgtcgttggtaaag

SEQ ID NO: 158014 - DNA, 20 bp, Artificial Sequence
  chemically synthesized
gctagacacgtcgttggtaa

SEQ ID NO: 158015 - DNA, 20 bp, Artificial Sequence
  chemically synthesized
ggctagacacgtcgttggta

SEQ ID NO: 158016 - DNA, 20 bp, Artificial Sequence
  chemically synthesized
agtagggctagacacgtcgt

SEQ ID NO: 158017 - DNA, 20 bp, Artificial Sequence
  chemically synthesized
tcctttaccaacgacgtgtc

SEQ ID NO: 158018 - DNA, 20 bp, Artificial Sequence
  chemically synthesized
agatgagattaaagtagggc

SEQ ID NO: 158019 - DNA, 20 bp, Artificial Sequence
  chemically synthesized
tagaagatgagattaaagta

SEQ ID NO: 158020 - DNA, 20 bp, Artificial Sequence
  chemically synthesized
ctagaagatgagattaaagt

SEQ ID NO: 158021 - DNA, 20 bp, Artificial Sequence
  chemically synthesized
tctagaagatgagattaaag

SEQ ID NO: 158022 - DNA, 20 bp, Artificial Sequence
  chemically synthesized
ttatctagaagatgagatta

SEQ ID NO: 158023 - DNA, 20 bp, Artificial Sequence
  chemically synthesized
cctactttaatctcatcttc

SEQ ID NO: 158024 - DNA, 20 bp, Artificial Sequence
  chemically synthesized
ttagtgtttatctagaagat

SEQ ID NO: 158025 - DNA, 20 bp, Artificial Sequence
  chemically synthesized
gtatcttagtgtttatctag

SEQ ID NO: 158026 - DNA, 20 bp, Artificial Sequence
  chemically synthesized
taggtatcttagtgtttatc

SEQ ID NO: 158027 - DNA, 20 bp, Artificial Sequence
  chemically synthesized
tcatcttctagataaacact

SEQ ID NO: 158028 - DNA, 20 bp, Artificial Sequence
  chemically synthesized
aatgtagtgattaggtatct

SEQ ID NO: 158029 - DNA, 20 bp, Artificial Sequence
  chemically synthesized
acagagtcaatgtagtgatt

SEQ ID NO: 158030 - DNA, 20 bp, Artificial Sequence
  chemically synthesized
aacagagtcaatgtagtgat

SEQ ID NO: 158031 - DNA, 20 bp, Artificial Sequence
  chemically synthesized
ttcaagaaacagagtcaatg

SEQ ID NO: 158032 - DNA, 20 bp, Artificial Sequence
  chemically synthesized
ttagatgctttcaagaaaca

SEQ ID NO: 158033 - DNA, 20 bp, Artificial Sequence
  chemically synthesized
gattagatgctttcaagaaa

SEQ ID NO: 158034 - DNA, 20 bp, Artificial Sequence
  chemically synthesized
acattgactctgtttcttga

SEQ ID NO: 158035 - DNA, 20 bp, Artificial Sequence
  chemically synthesized
tttctggattagatgctttc

SEQ ID NO: 158036 - DNA, 20 bp, Artificial Sequence
  chemically synthesized
tttcttgaaagcatctaatc

SEQ ID NO: 158037 - DNA, 20 bp, Artificial Sequence
  chemically synthesized
agtagaagccatttctggat

SEQ ID NO: 158038 - DNA, 20 bp, Artificial Sequence
  chemically synthesized
gaaagcatctaatccagaaa

SEQ ID NO: 158039 - DNA, 20 bp, Artificial Sequence
  chemically synthesized
cagaaagtagaagccatttc

SEQ ID NO: 158040 - DNA, 20 bp, Artificial Sequence
  chemically synthesized
aggaggaattcagaaagtag

SEQ ID NO: 158041 - DNA, 20 bp, Artificial Sequence
  chemically synthesized
ctaaggaggaattcagaaag

SEQ ID NO: 158042 - DNA, 20 bp, Artificial Sequence
  chemically synthesized
attctaaggaggaattcaga

SEQ ID NO: 158043 - DNA, 20 bp, Artificial Sequence
  chemically synthesized
catgattctaaggaggaatt

SEQ ID NO: 158044 - DNA, 20 bp, Artificial Sequence
  chemically synthesized
ctactttctgaattcctcct

SEQ ID NO: 158045 - DNA, 20 bp, Artificial Sequence
  chemically synthesized
ctggctgcatgattctaagg

SEQ ID NO: 158046 - DNA, 20 bp, Artificial Sequence
  chemically synthesized
gctggctgcatgattctaag

SEQ ID NO: 158047 - DNA, 20 bp, Artificial Sequence
  chemically synthesized
cagctggctgcatgattcta

SEQ ID NO: 158048 - DNA, 20 bp, Artificial Sequence
  chemically synthesized
tcagctggctgcatgattct

SEQ ID NO: 158049 - DNA, 20 bp, Artificial Sequence
  chemically synthesized
aattcctccttagaatcatg

SEQ ID NO: 158050 - DNA, 20 bp, Artificial Sequence
  chemically synthesized
cctccttagaatcatgcagc

SEQ ID NO: 158051 - DNA, 20 bp, Artificial Sequence
  chemically synthesized
agcttcttacagagttcagc

SEQ ID NO: 158052 - DNA, 20 bp, Artificial Sequence
  chemically synthesized
aaaaagcttcttacagagtt

SEQ ID NO: 158053 - DNA, 20 bp, Artificial Sequence
  chemically synthesized
tgcagccagctgaactctgt

SEQ ID NO: 158054 - DNA, 20 bp, Artificial Sequence
  chemically synthesized
agccagctgaactctgtaag

SEQ ID NO: 158055 - DNA, 20 bp, Artificial Sequence
  chemically synthesized
attggaaaaagcttcttaca

SEQ ID NO: 158056 - DNA, 20 bp, Artificial Sequence
  chemically synthesized
gcattggaaaaagcttctta

SEQ ID NO: 158057 - DNA, 20 bp, Artificial Sequence
  chemically synthesized
cagtaagagggcattggaaa

SEQ ID NO: 158058 - DNA, 20 bp, Artificial Sequence
  chemically synthesized
gcatctcagtaagagggcat

SEQ ID NO: 158059 - DNA, 20 bp, Artificial Sequence
  chemically synthesized
ttttccaatgccctcttact

SEQ ID NO: 158060 - DNA, 20 bp, Artificial Sequence
  chemically synthesized
gtgtgggcatctcagtaaga

SEQ ID NO: 158061 - DNA, 20 bp, Artificial Sequence
  chemically synthesized
agtgtgggcatctcagtaag

SEQ ID NO: 158062 - DNA, 20 bp, Artificial Sequence
  chemically synthesized
gagtgtgggcatctcagtaa

SEQ ID NO: 158063 - DNA, 20 bp, Artificial Sequence
  chemically synthesized
cagagtgtgggcatctcagt

SEQ ID NO: 158064 - DNA, 20 bp, Artificial Sequence
  chemically synthesized
acttcagagtgtgggcatct

SEQ ID NO: 158065 - DNA, 20 bp, Artificial Sequence
  chemically synthesized
cgtaaaacacttcagagtgt

SEQ ID NO: 158066 - DNA, 20 bp, Artificial Sequence
  chemically synthesized
actgagatgcccacactctg

SEQ ID NO: 158067 - DNA, 20 bp, Artificial Sequence
  chemically synthesized
gcgtaaaacacttcagagtg

SEQ ID NO: 158068 - DNA, 20 bp, Artificial Sequence
  chemically synthesized
caagagcgtaaaacacttca

SEQ ID NO: 158069 - DNA, 20 bp, Artificial Sequence
  chemically synthesized
agcaagagcgtaaaacactt

SEQ ID NO: 158070 - DNA, 20 bp, Artificial Sequence
  chemically synthesized
tatttaccttattgcagcaa

SEQ ID NO: 158071 - DNA, 20 bp, Artificial Sequence
  chemically synthesized
aatatttaccttattgcagc

SEQ ID NO: 158072 - DNA, 20 bp, Artificial Sequence
  chemically synthesized
ttttacgctcttgctgcaat

SEQ ID NO: 158073 - DNA, 20 bp, Artificial Sequence
  chemically synthesized
tttacgctcttgctgcaata

SEQ ID NO: 158074 - DNA, 20 bp, Artificial Sequence
  chemically synthesized
taagaatatttaccttattg

SEQ ID NO: 158075 - DNA, 20 bp, Artificial Sequence
  chemically synthesized
atatctgtaatcaaaaaatt

SEQ ID NO: 158076 - DNA, 20 bp, Artificial Sequence
  chemically synthesized
tattcttaattttttgatta

SEQ ID NO: 158077 - DNA, 20 bp, Artificial Sequence
  chemically synthesized
agatatgttgcttgtaatct

SEQ ID NO: 158078 - DNA, 20 bp, Artificial Sequence
  chemically synthesized
agccctctggccaagattac

SEQ ID NO: 158079 - DNA, 20 bp, Artificial Sequence
  chemically synthesized
atgttgcttgtaatcttggc

SEQ ID NO: 158080 - DNA, 20 bp, Artificial Sequence
  chemically synthesized
gttgcttgtaatcttggcca

SEQ ID NO: 158081 - DNA, 20 bp, Artificial Sequence
  chemically synthesized
ttgcttgtaatcttggccag

SEQ ID NO: 158082 - DNA, 20 bp, Artificial Sequence
  chemically synthesized
tgcttgtaatcttggccaga

SEQ ID NO: 158083 - DNA, 20 bp, Artificial Sequence
  chemically synthesized
actctgaaagccctctggcc

SEQ ID NO: 158084 - DNA, 20 bp, Artificial Sequence
  chemically synthesized
ataatactctgaaagccctc

SEQ ID NO: 158085 - DNA, 20 bp, Artificial Sequence
  chemically synthesized
aatcttggccagagggcttt

SEQ ID NO: 158086 - DNA, 20 bp, Artificial Sequence
  chemically synthesized
tcttggccagagggctttca

SEQ ID NO: 158087 - DNA, 20 bp, Artificial Sequence
  chemically synthesized
atccctacataatactctga

SEQ ID NO: 158088 - DNA, 20 bp, Artificial Sequence
  chemically synthesized
agggctttcagagtattatg

SEQ ID NO: 158089 - DNA, 20 bp, Artificial Sequence
  chemically synthesized
gggctttcagagtattatgt

SEQ ID NO: 158090 - DNA, 20 bp, Artificial Sequence
  chemically synthesized
ggctttcagagtattatgta

SEQ ID NO: 158091 - DNA, 20 bp, Artificial Sequence
  chemically synthesized
ttgctaagttatttgtaata

SEQ ID NO: 158092 - DNA, 20 bp, Artificial Sequence
  chemically synthesized
atgccatattacaaataact

SEQ ID NO: 158093 - DNA, 20 bp, Artificial Sequence
  chemically synthesized
catattacaaataacttagc

SEQ ID NO: 158094 - DNA, 20 bp, Artificial Sequence
  chemically synthesized
atattacaaataacttagca

SEQ ID NO: 158095 - DNA, 20 bp, Artificial Sequence
  chemically synthesized
gtagagctcatcaccttgct

SEQ ID NO: 158096 - DNA, 20 bp, Artificial Sequence
  chemically synthesized
aaataacttagcaaggtgat

SEQ ID NO: 158097 - DNA, 20 bp, Artificial Sequence
  chemically synthesized
atgtatattctagaattgta

SEQ ID NO: 158098 - DNA, 20 bp, Artificial Sequence
  chemically synthesized
ggtgatgagctctacaattc

SEQ ID NO: 158099 - DNA, 20 bp, Artificial Sequence
  chemically synthesized
gtatgtatattctagaattg

SEQ ID NO: 158100 - DNA, 20 bp, Artificial Sequence
  chemically synthesized
aacccttcgtatgtatattc

SEQ ID NO: 158101 - DNA, 20 bp, Artificial Sequence
  chemically synthesized
aattctagaatatacatacg

SEQ ID NO: 158102 - DNA, 20 bp, Artificial Sequence
  chemically synthesized
attctagaatatacatacga

SEQ ID NO: 158103 - DNA, 20 bp, Artificial Sequence
  chemically synthesized
ttctagaatatacatacgaa

SEQ ID NO: 158104 - DNA, 20 bp, Artificial Sequence
  chemically synthesized
ttcataaaatataaatgtgc

SEQ ID NO: 158105 - DNA, 20 bp, Artificial Sequence
  chemically synthesized
tcataaaatataaatgtgcc

SEQ ID NO: 158106 - DNA, 20 bp, Artificial Sequence
  chemically synthesized
cacactcatttagaaatacc

SEQ ID NO: 158107 - DNA, 20 bp, Artificial Sequence
  chemically synthesized
tgtgccaggtatttctaaat

SEQ ID NO: 158108 - DNA, 20 bp, Artificial Sequence
  chemically synthesized
tataaaataacacactcatt

SEQ ID NO: 158109 - DNA, 20 bp, Artificial Sequence
  chemically synthesized
tgtgttattttataaaatgt

SEQ ID NO: 158110 - DNA, 20 bp, Artificial Sequence
  chemically synthesized
aaaatgtaagactgcaaata

SEQ ID NO: 158111 - DNA, 20 bp, Artificial Sequence
  chemically synthesized
gagtagcatttccatatttg

SEQ ID NO: 158112 - DNA, 20 bp, Artificial Sequence
  chemically synthesized
tatggaaatgctactcaatt

SEQ ID NO: 158113 - DNA, 20 bp, Artificial Sequence
  chemically synthesized
tattcaatttcttaattgag

SEQ ID NO: 158114 - DNA, 20 bp, Artificial Sequence
  chemically synthesized
ttatattcaatttcttaatt

SEQ ID NO: 158115 - DNA, 20 bp, Artificial Sequence
  chemically synthesized
attaagaaattgaatataat

SEQ ID NO: 158116 - DNA, 20 bp, Artificial Sequence
  chemically synthesized
aaacatttagaaatatggat

SEQ ID NO: 158117 - DNA, 20 bp, Artificial Sequence
  chemically synthesized
aacataaacatttagaaata

SEQ ID NO: 158118 - DNA, 20 bp, Artificial Sequence
  chemically synthesized
aacttgtaaacataaacatt

SEQ ID NO: 158119 - DNA, 20 bp, Artificial Sequence
  chemically synthesized
ttctaaatgtttatgtttac

SEQ ID NO: 158120 - DNA, 20 bp, Artificial Sequence
  chemically synthesized
aaaatttataatagattttt

SEQ ID NO: 158121 - DNA, 20 bp, Artificial Sequence
  chemically synthesized
aaaaatttataatagatttt

SEQ ID NO: 158122 - DNA, 20 bp, Artificial Sequence
  chemically synthesized
agaagagaaaaaatttataa

SEQ ID NO: 158123 - DNA, 20 bp, Artificial Sequence
  chemically synthesized
taaattttttctcttctcat

SEQ ID NO: 158124 - DNA, 20 bp, Artificial Sequence
  chemically synthesized
cttcactttcccaatgagaa

SEQ ID NO: 158125 - DNA, 20 bp, Artificial Sequence
  chemically synthesized
aaattttttctcttctcatt

SEQ ID NO: 158126 - DNA, 20 bp, Artificial Sequence
  chemically synthesized
agcttcactttcccaatgag

SEQ ID NO: 158127 - DNA, 20 bp, Artificial Sequence
  chemically synthesized
tttttctcttctcattggga

SEQ ID NO: 158128 - DNA, 20 bp, Artificial Sequence
  chemically synthesized
gagagcttcactttcccaat

SEQ ID NO: 158129 - DNA, 20 bp, Artificial Sequence
  chemically synthesized
ctcttctcattgggaaagtg

SEQ ID NO: 158130 - DNA, 20 bp, Artificial Sequence
  chemically synthesized
gggaaagtgaagctctcctc

SEQ ID NO: 158131 - DNA, 20 bp, Artificial Sequence
  chemically synthesized
ccaatgcataaacttgagga

SEQ ID NO: 158132 - DNA, 20 bp, Artificial Sequence
  chemically synthesized
tcccaatgcataaacttgag

SEQ ID NO: 158133 - DNA, 20 bp, Artificial Sequence
  chemically synthesized
aatcccaatgcataaacttg

SEQ ID NO: 158134 - DNA, 20 bp, Artificial Sequence
  chemically synthesized
taatcccaatgcataaactt

SEQ ID NO: 158135 - DNA, 20 bp, Artificial Sequence
  chemically synthesized
ctctcctcaagtttatgcat

SEQ ID NO: 158136 - DNA, 20 bp, Artificial Sequence
  chemically synthesized
tctcctcaagtttatgcatt

SEQ ID NO: 158137 - DNA, 20 bp, Artificial Sequence
  chemically synthesized
tcaagtttatgcattgggat

SEQ ID NO: 158138 - DNA, 20 bp, Artificial Sequence
  chemically synthesized
aaaaagtcttggagtataag

SEQ ID NO: 158139 - DNA, 20 bp, Artificial Sequence
  chemically synthesized
aaaaaagtcttggagtataa

SEQ ID NO: 158140 - DNA, 20 bp, Artificial Sequence
  chemically synthesized
tattcaacctcttatactcc

SEQ ID NO: 158141 - DNA, 20 bp, Artificial Sequence
  chemically synthesized
aaaaaaaagtcttggagtat

SEQ ID NO: 158142 - DNA, 20 bp, Artificial Sequence
  chemically synthesized
caactgaaaaaaaagtcttg

SEQ ID NO: 158143 - DNA, 20 bp, Artificial Sequence
  chemically synthesized
tacaactgaaaaaaaagtct

SEQ ID NO: 158144 - DNA, 20 bp, Artificial Sequence
  chemically synthesized
atactccaagactttttttt

SEQ ID NO: 158145 - DNA, 20 bp, Artificial Sequence
  chemically synthesized
ttgctttacaactgaaaaaa

SEQ ID NO: 158146 - DNA, 20 bp, Artificial Sequence
  chemically synthesized
agacttttttttcagttgta

SEQ ID NO: 158147 - DNA, 20 bp, Artificial Sequence
  chemically synthesized
ataaataaataaataaatac

SEQ ID NO: 158148 - DNA, 20 bp, Artificial Sequence
  chemically synthesized
gtatttatttatttatttat

SEQ ID NO: 158149 - DNA, 20 bp, Artificial Sequence
  chemically synthesized
ttatttatttatttatgaga

SEQ ID NO: 158150 - DNA, 20 bp, Artificial Sequence
  chemically synthesized
atttatttatttatgagatg

SEQ ID NO: 158151 - DNA, 20 bp, Artificial Sequence
  chemically synthesized
tccagcctgggtgacagagt

SEQ ID NO: 158152 - DNA, 20 bp, Artificial Sequence
  chemically synthesized
tggagtctcactctgtcacc

SEQ ID NO: 158153 - DNA, 20 bp, Artificial Sequence
  chemically synthesized
gcactccagcctgggtgaca

SEQ ID NO: 158154 - DNA, 20 bp, Artificial Sequence
  chemically synthesized
ggagtctcactctgtcaccc

SEQ ID NO: 158155 - DNA, 20 bp, Artificial Sequence
  chemically synthesized
ctgcactccagcctgggtga

SEQ ID NO: 158156 - DNA, 20 bp, Artificial Sequence
  chemically synthesized
tctcactctgtcacccaggc

SEQ ID NO: 158157 - DNA, 20 bp, Artificial Sequence
  chemically synthesized
tcactctgtcacccaggctg

SEQ ID NO: 158158 - DNA, 20 bp, Artificial Sequence
  chemically synthesized
acgccactgcactccagcct

SEQ ID NO: 158159 - DNA, 20 bp, Artificial Sequence
  chemically synthesized
cacgccactgcactccagcc

SEQ ID NO: 158160 - DNA, 20 bp, Artificial Sequence
  chemically synthesized
ctgtcacccaggctggagtg

SEQ ID NO: 158161 - DNA, 20 bp, Artificial Sequence
  chemically synthesized
gagatcacgccactgcactc

SEQ ID NO: 158162 - DNA, 20 bp, Artificial Sequence
  chemically synthesized
tcacccaggctggagtgcag

SEQ ID NO: 158163 - DNA, 20 bp, Artificial Sequence
  chemically synthesized
ggagtgcagtggcgtgatct

SEQ ID NO: 158164 - DNA, 20 bp, Artificial Sequence
  chemically synthesized
ggcagagcttgcagtgagct

SEQ ID NO: 158165 - DNA, 20 bp, Artificial Sequence
  chemically synthesized
gcgtgatctcagctcactgc

SEQ ID NO: 158166 - DNA, 20 bp, Artificial Sequence
  chemically synthesized
cgggaggcagagcttgcagt

SEQ ID NO: 158167 - DNA, 20 bp, Artificial Sequence
  chemically synthesized
aacccgggaggcagagcttg

SEQ ID NO: 158168 - DNA, 20 bp, Artificial Sequence
  chemically synthesized
tcactgcaagctctgcctcc

SEQ ID NO: 158169 - DNA, 20 bp, Artificial Sequence
  chemically synthesized
tggcatgaacccgggaggca

SEQ ID NO: 158170 - DNA, 20 bp, Artificial Sequence
  chemically synthesized
cactgcaagctctgcctccc

SEQ ID NO: 158171 - DNA, 20 bp, Artificial Sequence
  chemically synthesized
aatggcatgaacccgggagg

SEQ ID NO: 158172 - DNA, 20 bp, Artificial Sequence
  chemically synthesized
gagaatggcatgaacccggg

SEQ ID NO: 158173 - DNA, 20 bp, Artificial Sequence
  chemically synthesized
ggagaatggcatgaacccgg

SEQ ID NO: 158174 - DNA, 20 bp, Artificial Sequence
  chemically synthesized
caggagaatggcatgaaccc

SEQ ID NO: 158175 - DNA, 20 bp, Artificial Sequence
  chemically synthesized
gcaggagaatggcatgaacc

SEQ ID NO: 158176 - DNA, 20 bp, Artificial Sequence
  chemically synthesized
gggaggctgaggcaggagaa

SEQ ID NO: 158177 - DNA, 20 bp, Artificial Sequence
  chemically synthesized
ttcatgccattctcctgcct

SEQ ID NO: 158178 - DNA, 20 bp, Artificial Sequence
  chemically synthesized
tactcgggaggctgaggcag

SEQ ID NO: 158179 - DNA, 20 bp, Artificial Sequence
  chemically synthesized
gctactcgggaggctgaggc

SEQ ID NO: 158180 - DNA, 20 bp, Artificial Sequence
  chemically synthesized
agctactcgggaggctgagg

SEQ ID NO: 158181 - DNA, 20 bp, Artificial Sequence
  chemically synthesized
cccagctactcgggaggctg

SEQ ID NO: 158182 - DNA, 20 bp, Artificial Sequence
  chemically synthesized
tcccagctactcgggaggct

SEQ ID NO: 158183 - DNA, 20 bp, Artificial Sequence
  chemically synthesized
ttctcctgcctcagcctccc

SEQ ID NO: 158184 - DNA, 20 bp, Artificial Sequence
  chemically synthesized
tcctgcctcagcctcccgag

SEQ ID NO: 158185 - DNA, 20 bp, Artificial Sequence
  chemically synthesized
tgtagtcccagctactcggg

SEQ ID NO: 158186 - DNA, 20 bp, Artificial Sequence
  chemically synthesized
ctgtagtcccagctactcgg

SEQ ID NO: 158187 - DNA, 20 bp, Artificial Sequence
  chemically synthesized
gcctcagcctcccgagtagc

SEQ ID NO: 158188 - DNA, 20 bp, Artificial Sequence
  chemically synthesized
atctgtagtcccagctactc

SEQ ID NO: 158189 - DNA, 20 bp, Artificial Sequence
  chemically synthesized
cctcagcctcccgagtagct

SEQ ID NO: 158190 - DNA, 20 bp, Artificial Sequence
  chemically synthesized
catctgtagtcccagctact

SEQ ID NO: 158191 - DNA, 20 bp, Artificial Sequence
  chemically synthesized
ctcccgagtagctgggacta

SEQ ID NO: 158192 - DNA, 20 bp, Artificial Sequence
  chemically synthesized
gtggcaggcatctgtagtcc

SEQ ID NO: 158193 - DNA, 20 bp, Artificial Sequence
  chemically synthesized
ggcttggtggcaggcatctg

SEQ ID NO: 158194 - DNA, 20 bp, Artificial Sequence
  chemically synthesized
gactacagatgcctgccacc

SEQ ID NO: 158195 - DNA, 20 bp, Artificial Sequence
  chemically synthesized
aattagccgggcttggtggc

SEQ ID NO: 158196 - DNA, 20 bp, Artificial Sequence
  chemically synthesized
aaattagccgggcttggtgg

SEQ ID NO: 158197 - DNA, 20 bp, Artificial Sequence
  chemically synthesized
cagatgcctgccaccaagcc

SEQ ID NO: 158198 - DNA, 20 bp, Artificial Sequence
  chemically synthesized
acaaaattagccgggcttgg

SEQ ID NO: 158199 - DNA, 20 bp, Artificial Sequence
  chemically synthesized
aaaacaaaattagccgggct

SEQ ID NO: 158200 - DNA, 20 bp, Artificial Sequence
  chemically synthesized
atacaaaaacaaaattagcc

SEQ ID NO: 158201 - DNA, 20 bp, Artificial Sequence
  chemically synthesized
aatacaaaaacaaaattagc

SEQ ID NO: 158202 - DNA, 20 bp, Artificial Sequence
  chemically synthesized
taaaaatacaaaaacaaaat

SEQ ID NO: 158203 - DNA, 20 bp, Artificial Sequence
  chemically synthesized
taattttgtttttgtatttt

SEQ ID NO: 158204 - DNA, 20 bp, Artificial Sequence
  chemically synthesized
ttttgtttttgtatttttag

SEQ ID NO: 158205 - DNA, 20 bp, Artificial Sequence
  chemically synthesized
ttgtttttgtatttttagta

SEQ ID NO: 158206 - DNA, 20 bp, Artificial Sequence
  chemically synthesized
ttttgtatttttagtagaga

SEQ ID NO: 158207 - DNA, 20 bp, Artificial Sequence
  chemically synthesized
tttgtatttttagtagagat

SEQ ID NO: 158208 - DNA, 20 bp, Artificial Sequence
  chemically synthesized
ttgtatttttagtagagatg

SEQ ID NO: 158209 - DNA, 20 bp, Artificial Sequence
  chemically synthesized
gagatggggtttcaccatgt

SEQ ID NO: 158210 - DNA, 20 bp, Artificial Sequence
  chemically synthesized
tggggtttcaccatgttagc

SEQ ID NO: 158211 - DNA, 20 bp, Artificial Sequence
  chemically synthesized
cgagaccatcctggctaaca

SEQ ID NO: 158212 - DNA, 20 bp, Artificial Sequence
  chemically synthesized
ggggtttcaccatgttagcc

SEQ ID NO: 158213 - DNA, 20 bp, Artificial Sequence
  chemically synthesized
tttcaccatgttagccagga

SEQ ID NO: 158214 - DNA, 20 bp, Artificial Sequence
  chemically synthesized
tcaggagatcgagaccatcc

SEQ ID NO: 158215 - DNA, 20 bp, Artificial Sequence
  chemically synthesized
gatcacaaagtcaggagatc

SEQ ID NO: 158216 - DNA, 20 bp, Artificial Sequence
  chemically synthesized
tgggcggatcacaaagtcag

SEQ ID NO: 158217 - DNA, 20 bp, Artificial Sequence
  chemically synthesized
ggtgggcggatcacaaagtc

SEQ ID NO: 158218 - DNA, 20 bp, Artificial Sequence
  chemically synthesized
aggtgggcggatcacaaagt

SEQ ID NO: 158219 - DNA, 20 bp, Artificial Sequence
  chemically synthesized
gccaaggtgggcggatcaca

SEQ ID NO: 158220 - DNA, 20 bp, Artificial Sequence
  chemically synthesized
actttgtgatccgcccacct

SEQ ID NO: 158221 - DNA, 20 bp, Artificial Sequence
  chemically synthesized
ctttgggaggccaaggtggg

SEQ ID NO: 158222 - DNA, 20 bp, Artificial Sequence
  chemically synthesized
gcactttgggaggccaaggt

SEQ ID NO: 158223 - DNA, 20 bp, Artificial Sequence
  chemically synthesized
agcactttgggaggccaagg

SEQ ID NO: 158224 - DNA, 20 bp, Artificial Sequence
  chemically synthesized
accagcactttgggaggcca

SEQ ID NO: 158225 - DNA, 20 bp, Artificial Sequence
  chemically synthesized
taccagcactttgggaggcc

SEQ ID NO: 158226 - DNA, 20 bp, Artificial Sequence
  chemically synthesized
ccgcccaccttggcctccca

SEQ ID NO: 158227 - DNA, 20 bp, Artificial Sequence
  chemically synthesized
tgtaataccagcactttggg

SEQ ID NO: 158228 - DNA, 20 bp, Artificial Sequence
  chemically synthesized
ctgtaataccagcactttgg

SEQ ID NO: 158229 - DNA, 20 bp, Artificial Sequence
  chemically synthesized
accttggcctcccaaagtgc

SEQ ID NO: 158230 - DNA, 20 bp, Artificial Sequence
  chemically synthesized
gcctgtaataccagcacttt

SEQ ID NO: 158231 - DNA, 20 bp, Artificial Sequence
  chemically synthesized
cgcctgtaataccagcactt

SEQ ID NO: 158232 - DNA, 20 bp, Artificial Sequence
  chemically synthesized
ctcccaaagtgctggtatta

SEQ ID NO: 158233 - DNA, 20 bp, Artificial Sequence
  chemically synthesized
tcccaaagtgctggtattac

SEQ ID NO: 158234 - DNA, 20 bp, Artificial Sequence
  chemically synthesized
gtggctcgcgcctgtaatac

SEQ ID NO: 158235 - DNA, 20 bp, Artificial Sequence
  chemically synthesized
agtgctggtattacaggcgc

SEQ ID NO: 158236 - DNA, 20 bp, Artificial Sequence
  chemically synthesized
caggcgcgagccaccgcgcc

SEQ ID NO: 158237 - DNA, 20 bp, Artificial Sequence
  chemically synthesized
aagtttgcgactgggcgcgg

SEQ ID NO: 158238 - DNA, 20 bp, Artificial Sequence
  chemically synthesized
tacaagtttgcgactgggcg

SEQ ID NO: 158239 - DNA, 20 bp, Artificial Sequence
  chemically synthesized
taaattacaagtttgcgact

SEQ ID NO: 158240 - DNA, 20 bp, Artificial Sequence
  chemically synthesized
ttaaattacaagtttgcgac

SEQ ID NO: 158241 - DNA, 20 bp, Artificial Sequence
  chemically synthesized
attttatttttttaaattac

SEQ ID NO: 158242 - DNA, 20 bp, Artificial Sequence
  chemically synthesized
ataatttataagtaaatgca

SEQ ID NO: 158243 - DNA, 20 bp, Artificial Sequence
  chemically synthesized
agaggcatttaataatttat

SEQ ID NO: 158244 - DNA, 20 bp, Artificial Sequence
  chemically synthesized
aaagaagataacaatattag

SEQ ID NO: 158245 - DNA, 20 bp, Artificial Sequence
  chemically synthesized
gaaagaagataacaatatta

SEQ ID NO: 158246 - DNA, 20 bp, Artificial Sequence
  chemically synthesized
tagaaagaagataacaatat

SEQ ID NO: 158247 - DNA, 20 bp, Artificial Sequence
  chemically synthesized
taatattgttatcttctttc

SEQ ID NO: 158248 - DNA, 20 bp, Artificial Sequence
  chemically synthesized
gggagaggacttctagaaag

SEQ ID NO: 158249 - DNA, 20 bp, Artificial Sequence
  chemically synthesized
tattgttatcttctttctag

SEQ ID NO: 158250 - DNA, 20 bp, Artificial Sequence
  chemically synthesized
gttgggagaggacttctaga

SEQ ID NO: 158251 - DNA, 20 bp, Artificial Sequence
  chemically synthesized
ataagttgggagaggacttc

SEQ ID NO: 158252 - DNA, 20 bp, Artificial Sequence
  chemically synthesized
acaccagaataagttgggag

SEQ ID NO: 158253 - DNA, 20 bp, Artificial Sequence
  chemically synthesized
aacaccagaataagttggga

SEQ ID NO: 158254 - DNA, 20 bp, Artificial Sequence
  chemically synthesized
ataacaccagaataagttgg

SEQ ID NO: 158255 - DNA, 20 bp, Artificial Sequence
  chemically synthesized
caataacaccagaataagtt

SEQ ID NO: 158256 - DNA, 20 bp, Artificial Sequence
  chemically synthesized
ccaataacaccagaataagt

SEQ ID NO: 158257 - DNA, 20 bp, Artificial Sequence
  chemically synthesized
agtcctctcccaacttattc

SEQ ID NO: 158258 - DNA, 20 bp, Artificial Sequence
  chemically synthesized
catgccaataacaccagaat

SEQ ID NO: 158259 - DNA, 20 bp, Artificial Sequence
  chemically synthesized
ccaacttattctggtgttat

SEQ ID NO: 158260 - DNA, 20 bp, Artificial Sequence
  chemically synthesized
aatttccatgccaataacac

SEQ ID NO: 158261 - DNA, 20 bp, Artificial Sequence
  chemically synthesized
ttattctggtgttattggca

SEQ ID NO: 158262 - DNA, 20 bp, Artificial Sequence
  chemically synthesized
ggaaattgtgctcaataaat

SEQ ID NO: 158263 - DNA, 20 bp, Artificial Sequence
  chemically synthesized
ttttgactgactcatttatt

SEQ ID NO: 158264 - DNA, 20 bp, Artificial Sequence
  chemically synthesized
attgtgctcaataaatgagt

SEQ ID NO: 158265 - DNA, 20 bp, Artificial Sequence
  chemically synthesized
aataaatgagtcagtcaaaa

SEQ ID NO: 158266 - DNA, 20 bp, Artificial Sequence
  chemically synthesized
aattgtcccctgaaatgaac

SEQ ID NO: 158267 - DNA, 20 bp, Artificial Sequence
  chemically synthesized
caaaatagacttgttcattt

SEQ ID NO: 158268 - DNA, 20 bp, Artificial Sequence
  chemically synthesized
aaaatagacttgttcatttc

SEQ ID NO: 158269 - DNA, 20 bp, Artificial Sequence
  chemically synthesized
aaatagacttgttcatttca

SEQ ID NO: 158270 - DNA, 20 bp, Artificial Sequence
  chemically synthesized
aatagacttgttcatttcag

SEQ ID NO: 158271 - DNA, 20 bp, Artificial Sequence
  chemically synthesized
agaaatcaatagagagataa

SEQ ID NO: 158272 - DNA, 20 bp, Artificial Sequence
  chemically synthesized
tagcaacagaaatcaataga

SEQ ID NO: 158273 - DNA, 20 bp, Artificial Sequence
  chemically synthesized
tgtagcaacagaaatcaata

SEQ ID NO: 158274 - DNA, 20 bp, Artificial Sequence
  chemically synthesized
cttgtagcaacagaaatcaa

SEQ ID NO: 158275 - DNA, 20 bp, Artificial Sequence
  chemically synthesized
ctattgatttctgttgctac

SEQ ID NO: 158276 - DNA, 20 bp, Artificial Sequence
  chemically synthesized
tgtaacttcacttgtagcaa

SEQ ID NO: 158277 - DNA, 20 bp, Artificial Sequence
  chemically synthesized
gatttctgttgctacaagtg

SEQ ID NO: 158278 - DNA, 20 bp, Artificial Sequence
  chemically synthesized
acctggtgtaacttcacttg

SEQ ID NO: 158279 - DNA, 20 bp, Artificial Sequence
  chemically synthesized
tgctacaagtgaagttacac

SEQ ID NO: 158280 - DNA, 20 bp, Artificial Sequence
  chemically synthesized
gctacaagtgaagttacacc

SEQ ID NO: 158281 - DNA, 20 bp, Artificial Sequence
  chemically synthesized
tgaagttacaccaggtaaat

SEQ ID NO: 158282 - DNA, 20 bp, Artificial Sequence
  chemically synthesized
tgcgtacaatctcatttacc

SEQ ID NO: 158283 - DNA, 20 bp, Artificial Sequence
  chemically synthesized
ggtaaatgagattgtacgca

SEQ ID NO: 158284 - DNA, 20 bp, Artificial Sequence
  chemically synthesized
aaatgagattgtacgcatgg

SEQ ID NO: 158285 - DNA, 20 bp, Artificial Sequence
  chemically synthesized
gcagatgatttatgaaatcc

SEQ ID NO: 158286 - DNA, 20 bp, Artificial Sequence
  chemically synthesized
attacacttaaaacaatact

SEQ ID NO: 158287 - DNA, 20 bp, Artificial Sequence
  chemically synthesized
tgaaatccaagtattgtttt

SEQ ID NO: 158288 - DNA, 20 bp, Artificial Sequence
  chemically synthesized
aagtgtaattatatttattt

SEQ ID NO: 158289 - DNA, 20 bp, Artificial Sequence
  chemically synthesized
caggtcaaatggtatttcat

SEQ ID NO: 158290 - DNA, 20 bp, Artificial Sequence
  chemically synthesized
ccacggtatagcaggtcaaa

SEQ ID NO: 158291 - DNA, 20 bp, Artificial Sequence
  chemically synthesized
agatttatccacggtatagc

SEQ ID NO: 158292 - DNA, 20 bp, Artificial Sequence
  chemically synthesized
aagatttatccacggtatag

SEQ ID NO: 158293 - DNA, 20 bp, Artificial Sequence
  chemically synthesized
ccatttgacctgctataccg

SEQ ID NO: 158294 - DNA, 20 bp, Artificial Sequence
  chemically synthesized
ctcaagatttatccacggta

SEQ ID NO: 158295 - DNA, 20 bp, Artificial Sequence
  chemically synthesized
tgcatctcaagatttatcca

SEQ ID NO: 158296 - DNA, 20 bp, Artificial Sequence
  chemically synthesized
ctataccgtggataaatctt

SEQ ID NO: 158297 - DNA, 20 bp, Artificial Sequence
  chemically synthesized
tcacaaaagatgtgcatctc

SEQ ID NO: 158298 - DNA, 20 bp, Artificial Sequence
  chemically synthesized
ttgagatgcacatcttttgt

SEQ ID NO: 158299 - DNA, 20 bp, Artificial Sequence
  chemically synthesized
ctttaatatattactcacaa

SEQ ID NO: 158300 - DNA, 20 bp, Artificial Sequence
  chemically synthesized
cttttgtgagtaatatatta

SEQ ID NO: 158301 - DNA, 20 bp, Artificial Sequence
  chemically synthesized
agtaatatattaaagattgt

SEQ ID NO: 158302 - DNA, 20 bp, Artificial Sequence
  chemically synthesized
gtaatatattaaagattgtt

SEQ ID NO: 158303 - DNA, 20 bp, Artificial Sequence
  chemically synthesized
ttaggcaaaaaataaaccct

SEQ ID NO: 158304 - DNA, 20 bp, Artificial Sequence
  chemically synthesized
taggcaaaaaataaacccta

SEQ ID NO: 158305 - DNA, 20 bp, Artificial Sequence
  chemically synthesized
gcaaaaaataaaccctaagg

SEQ ID NO: 158306 - DNA, 20 bp, Artificial Sequence
  chemically synthesized
catttttaaaaacttcctta

SEQ ID NO: 158307 - DNA, 20 bp, Artificial Sequence
  chemically synthesized
acatttttaaaaacttcctt

SEQ ID NO: 158308 - DNA, 20 bp, Artificial Sequence
  chemically synthesized
aacatttttaaaaacttcct

SEQ ID NO: 158309 - DNA, 20 bp, Artificial Sequence
  chemically synthesized
aggaagtttttaaaaatgtt

SEQ ID NO: 158310 - DNA, 20 bp, Artificial Sequence
  chemically synthesized
aaatgttaagatgttgatgt

SEQ ID NO: 158311 - DNA, 20 bp, Artificial Sequence
  chemically synthesized
tgttaagatgttgatgttgg

SEQ ID NO: 158312 - DNA, 20 bp, Artificial Sequence
  chemically synthesized
taagatgttgatgttggcag

SEQ ID NO: 158313 - DNA, 20 bp, Artificial Sequence
  chemically synthesized
tggcagtagaacaaactcat

SEQ ID NO: 158314 - DNA, 20 bp, Artificial Sequence
  chemically synthesized
ggcagtagaacaaactcatt

SEQ ID NO: 158315 - DNA, 20 bp, Artificial Sequence
  chemically synthesized
cagtagaacaaactcattgg

SEQ ID NO: 158316 - DNA, 20 bp, Artificial Sequence
  chemically synthesized
ctgtttttttttctcccaat

SEQ ID NO: 158317 - DNA, 20 bp, Artificial Sequence
  chemically synthesized
ctcattgggagaaaaaaaaa

SEQ ID NO: 158318 - DNA, 20 bp, Artificial Sequence
  chemically synthesized
gaaaaaaaaacagcttcatc

SEQ ID NO: 158319 - DNA, 20 bp, Artificial Sequence
  chemically synthesized
tgttgttaattaactagatg

SEQ ID NO: 158320 - DNA, 20 bp, Artificial Sequence
  chemically synthesized
ctgttttgttgttaattaac

SEQ ID NO: 158321 - DNA, 20 bp, Artificial Sequence
  chemically synthesized
ctagttaattaacaacaaaa

SEQ ID NO: 158322 - DNA, 20 bp, Artificial Sequence
  chemically synthesized
ttaattaacaacaaaacagc

SEQ ID NO: 158323 - DNA, 20 bp, Artificial Sequence
  chemically synthesized
taattaacaacaaaacagct

SEQ ID NO: 158324 - DNA, 20 bp, Artificial Sequence
  chemically synthesized
ccagggatgattcattttcc

SEQ ID NO: 158325 - DNA, 20 bp, Artificial Sequence
  chemically synthesized
ctgggaaaatgaatcatccc

SEQ ID NO: 158326 - DNA, 20 bp, Artificial Sequence
  chemically synthesized
attacagtcagtcacaacca

SEQ ID NO: 158327 - DNA, 20 bp, Artificial Sequence
  chemically synthesized
aattacagtcagtcacaacc

SEQ ID NO: 158328 - DNA, 20 bp, Artificial Sequence
  chemically synthesized
caattacagtcagtcacaac

SEQ ID NO: 158329 - DNA, 20 bp, Artificial Sequence
  chemically synthesized
tagtcattttcaattacagt

SEQ ID NO: 158330 - DNA, 20 bp, Artificial Sequence
  chemically synthesized
tcattagtcattttcaatta

SEQ ID NO: 158331 - DNA, 20 bp, Artificial Sequence
  chemically synthesized
ctgcaaaatgacagcatcat

SEQ ID NO: 158332 - DNA, 20 bp, Artificial Sequence
  chemically synthesized
agatatgaactgcaaaatga

SEQ ID NO: 158333 - DNA, 20 bp, Artificial Sequence
  chemically synthesized
ctaatgatgctgtcattttg

SEQ ID NO: 158334 - DNA, 20 bp, Artificial Sequence
  chemically synthesized
tcattttgcagttcatatct

SEQ ID NO: 158335 - DNA, 20 bp, Artificial Sequence
  chemically synthesized
cattttgcagttcatatctg

SEQ ID NO: 158336 - DNA, 20 bp, Artificial Sequence
  chemically synthesized
tcttccaggcatcatttcct

SEQ ID NO: 158337 - DNA, 20 bp, Artificial Sequence
  chemically synthesized
atatctgaggaaatgatgcc

SEQ ID NO: 158338 - DNA, 20 bp, Artificial Sequence
  chemically synthesized
tctgaggaaatgatgcctgg

SEQ ID NO: 158339 - DNA, 20 bp, Artificial Sequence
  chemically synthesized
gagggcaattataatcttcc

SEQ ID NO: 158340 - DNA, 20 bp, Artificial Sequence
  chemically synthesized
agagggcaattataatcttc

SEQ ID NO: 158341 - DNA, 20 bp, Artificial Sequence
  chemically synthesized
ctgtagacaaatggtcaaga

SEQ ID NO: 158342 - DNA, 20 bp, Artificial Sequence
  chemically synthesized
gctgtagacaaatggtcaag

SEQ ID NO: 158343 - DNA, 20 bp, Artificial Sequence
  chemically synthesized
tgctgtagacaaatggtcaa

SEQ ID NO: 158344 - DNA, 20 bp, Artificial Sequence
  chemically synthesized
attgctgtagacaaatggtc

SEQ ID NO: 158345 - DNA, 20 bp, Artificial Sequence
  chemically synthesized
aaataattgctgtagacaaa

SEQ ID NO: 158346 - DNA, 20 bp, Artificial Sequence
  chemically synthesized
ccctcttgaccatttgtcta

SEQ ID NO: 158347 - DNA, 20 bp, Artificial Sequence
  chemically synthesized
ttaacacaaaataattgctg

SEQ ID NO: 158348 - DNA, 20 bp, Artificial Sequence
  chemically synthesized
acagcaattattttgtgtta

SEQ ID NO: 158349 - DNA, 20 bp, Artificial Sequence
  chemically synthesized
cagcaattattttgtgttaa

SEQ ID NO: 158350 - DNA, 20 bp, Artificial Sequence
  chemically synthesized
aattattttgtgttaaaggt

SEQ ID NO: 158351 - DNA, 20 bp, Artificial Sequence
  chemically synthesized
attattttgtgttaaaggtt

SEQ ID NO: 158352 - DNA, 20 bp, Artificial Sequence
  chemically synthesized
ttttgtgttaaaggttggga

SEQ ID NO: 158353 - DNA, 20 bp, Artificial Sequence
  chemically synthesized
aaggttgggatggaacgctt

SEQ ID NO: 158354 - DNA, 20 bp, Artificial Sequence
  chemically synthesized
gaactttctgtatttggcca

SEQ ID NO: 158355 - DNA, 20 bp, Artificial Sequence
  chemically synthesized
tggaacgctttggccaaata

SEQ ID NO: 158356 - DNA, 20 bp, Artificial Sequence
  chemically synthesized
tgtgaggaactttctgtatt

SEQ ID NO: 158357 - DNA, 20 bp, Artificial Sequence
  chemically synthesized
acgctttggccaaatacaga

SEQ ID NO: 158358 - DNA, 20 bp, Artificial Sequence
  chemically synthesized
atgtaacagaaaaaggtgtg

SEQ ID NO: 158359 - DNA, 20 bp, Artificial Sequence
  chemically synthesized
aatgtaacagaaaaaggtgt

SEQ ID NO: 158360 - DNA, 20 bp, Artificial Sequence
  chemically synthesized
tttttcaatgtaacagaaaa

SEQ ID NO: 158361 - DNA, 20 bp, Artificial Sequence
  chemically synthesized
atttttcaatgtaacagaaa

SEQ ID NO: 158362 - DNA, 20 bp, Artificial Sequence
  chemically synthesized
tgaattatttttcaatgtaa

SEQ ID NO: 158363 - DNA, 20 bp, Artificial Sequence
  chemically synthesized
gttacattgaaaaataattc

SEQ ID NO: 158364 - DNA, 20 bp, Artificial Sequence
  chemically synthesized
tacattgaaaaataattcaa

SEQ ID NO: 158365 - DNA, 20 bp, Artificial Sequence
  chemically synthesized
attgaaaaataattcaagag

SEQ ID NO: 158366 - DNA, 20 bp, Artificial Sequence
  chemically synthesized
aaaaataattcaagagcagt

SEQ ID NO: 158367 - DNA, 20 bp, Artificial Sequence
  chemically synthesized
cagtaagtaaaacatattac

SEQ ID NO: 158368 - DNA, 20 bp, Artificial Sequence
  chemically synthesized
agtaagtaaaacatattact

SEQ ID NO: 158369 - DNA, 20 bp, Artificial Sequence
  chemically synthesized
aaatgttacttacacaaacc

SEQ ID NO: 158370 - DNA, 20 bp, Artificial Sequence
  chemically synthesized
acatattactaggtttgtgt

SEQ ID NO: 158371 - DNA, 20 bp, Artificial Sequence
  chemically synthesized
acattttttgataatataaa

SEQ ID NO: 158372 - DNA, 20 bp, Artificial Sequence
  chemically synthesized
tttttgataatataaaaagt

SEQ ID NO: 158373 - DNA, 20 bp, Artificial Sequence
  chemically synthesized
gataatataaaaagttagca

SEQ ID NO: 158374 - DNA, 20 bp, Artificial Sequence
  chemically synthesized
aaaaagttagcaaagcaaac

SEQ ID NO: 158375 - DNA, 20 bp, Artificial Sequence
  chemically synthesized
agttagcaaagcaaaccagc

SEQ ID NO: 158376 - DNA, 20 bp, Artificial Sequence
  chemically synthesized
agtgataaaatgaagccagc

SEQ ID NO: 158377 - DNA, 20 bp, Artificial Sequence
  chemically synthesized
ctaaagtgataaaatgaagc

SEQ ID NO: 158378 - DNA, 20 bp, Artificial Sequence
  chemically synthesized
ctttctaaagtgataaaatg

SEQ ID NO: 158379 - DNA, 20 bp, Artificial Sequence
  chemically synthesized
ctggcttcattttatcactt

SEQ ID NO: 158380 - DNA, 20 bp, Artificial Sequence
  chemically synthesized
cttcattttatcactttaga

SEQ ID NO: 158381 - DNA, 20 bp, Artificial Sequence
  chemically synthesized
aatgtcttggttactttcta

SEQ ID NO: 158382 - DNA, 20 bp, Artificial Sequence
  chemically synthesized
tatcactttagaaagtaacc

SEQ ID NO: 158383 - DNA, 20 bp, Artificial Sequence
  chemically synthesized
taatggaattttaaatgtct

SEQ ID NO: 158384 - DNA, 20 bp, Artificial Sequence
  chemically synthesized
attagaactgagagcattaa

SEQ ID NO: 158385 - DNA, 20 bp, Artificial Sequence
  chemically synthesized
taaaattccattaatgctct

SEQ ID NO: 158386 - DNA, 20 bp, Artificial Sequence
  chemically synthesized
ctgccatgtattagaactga

SEQ ID NO: 158387 - DNA, 20 bp, Artificial Sequence
  chemically synthesized
acctgccatgtattagaact

SEQ ID NO: 158388 - DNA, 20 bp, Artificial Sequence
  chemically synthesized
atgctctcagttctaataca

SEQ ID NO: 158389 - DNA, 20 bp, Artificial Sequence
  chemically synthesized
ttacatcacctgccatgtat

SEQ ID NO: 158390 - DNA, 20 bp, Artificial Sequence
  chemically synthesized
ctctcagttctaatacatgg

SEQ ID NO: 158391 - DNA, 20 bp, Artificial Sequence
  chemically synthesized
tctcagttctaatacatggc

SEQ ID NO: 158392 - DNA, 20 bp, Artificial Sequence
  chemically synthesized
taatacatggcaggtgatgt

SEQ ID NO: 158393 - DNA, 20 bp, Artificial Sequence
  chemically synthesized
gcaggtgatgtaagcattga

SEQ ID NO: 158394 - DNA, 20 bp, Artificial Sequence
  chemically synthesized
gtacataaacatatttttaa

SEQ ID NO: 158395 - DNA, 20 bp, Artificial Sequence
  chemically synthesized
tatttttaaaagttaactga

SEQ ID NO: 158396 - DNA, 20 bp, Artificial Sequence
  chemically synthesized
ttaaaagttaactgaaagtg

SEQ ID NO: 158397 - DNA, 20 bp, Artificial Sequence
  chemically synthesized
aagttggaaaactacacttt

SEQ ID NO: 158398 - DNA, 20 bp, Artificial Sequence
  chemically synthesized
aaagtgtagttttccaactt

SEQ ID NO: 158399 - DNA, 20 bp, Artificial Sequence
  chemically synthesized
tactcatttttaacttaagt

SEQ ID NO: 158400 - DNA, 20 bp, Artificial Sequence
  chemically synthesized
ttcatactcatttttaactt

SEQ ID NO: 158401 - DNA, 20 bp, Artificial Sequence
  chemically synthesized
ttccaacttaagttaaaaat

SEQ ID NO: 158402 - DNA, 20 bp, Artificial Sequence
  chemically synthesized
ttaaaaatgagtatgaatac

SEQ ID NO: 158403 - DNA, 20 bp, Artificial Sequence
  chemically synthesized
tgagtatgaatacaagaaaa

SEQ ID NO: 158404 - DNA, 20 bp, Artificial Sequence
  chemically synthesized
tgtcttgagcttaagcattt

SEQ ID NO: 158405 - DNA, 20 bp, Artificial Sequence
  chemically synthesized
aaaatggcacctaaatgctt

SEQ ID NO: 158406 - DNA, 20 bp, Artificial Sequence
  chemically synthesized
ctgtcttgagcttaagcatt

SEQ ID NO: 158407 - DNA, 20 bp, Artificial Sequence
  chemically synthesized
gcacctaaatgcttaagctc

SEQ ID NO: 158408 - DNA, 20 bp, Artificial Sequence
  chemically synthesized
tttttaactgtcttgagctt

SEQ ID NO: 158409 - DNA, 20 bp, Artificial Sequence
  chemically synthesized
ctaaatgcttaagctcaaga

SEQ ID NO: 158410 - DNA, 20 bp, Artificial Sequence
  chemically synthesized
attgtatttttaactgtctt

SEQ ID NO: 158411 - DNA, 20 bp, Artificial Sequence
  chemically synthesized
aataaaaatcaaataacaaa

SEQ ID NO: 158412 - DNA, 20 bp, Artificial Sequence
  chemically synthesized
ataacaaatggcttcttttg

SEQ ID NO: 158413 - DNA, 20 bp, Artificial Sequence
  chemically synthesized
aacaatataaactacaaaag

SEQ ID NO: 158414 - DNA, 20 bp, Artificial Sequence
  chemically synthesized
aacaacaatataaactacaa

SEQ ID NO: 158415 - DNA, 20 bp, Artificial Sequence
  chemically synthesized
gtttatattgttgttactga

SEQ ID NO: 158416 - DNA, 20 bp, Artificial Sequence
  chemically synthesized
tatattgttgttactgatag

SEQ ID NO: 158417 - DNA, 20 bp, Artificial Sequence
  chemically synthesized
gcagcaaaaacaactgctat

SEQ ID NO: 158418 - DNA, 20 bp, Artificial Sequence
  chemically synthesized
cccatttagcagtttaaaag

SEQ ID NO: 158419 - DNA, 20 bp, Artificial Sequence
  chemically synthesized
caccccatttagcagtttaa

SEQ ID NO: 158420 - DNA, 20 bp, Artificial Sequence
  chemically synthesized
gctgcttttaaactgctaaa

SEQ ID NO: 158421 - DNA, 20 bp, Artificial Sequence
  chemically synthesized
ctgcttttaaactgctaaat

SEQ ID NO: 158422 - DNA, 20 bp, Artificial Sequence
  chemically synthesized
tgcttttaaactgctaaatg

SEQ ID NO: 158423 - DNA, 20 bp, Artificial Sequence
  chemically synthesized
ctcaatagcaccccatttag

SEQ ID NO: 158424 - DNA, 20 bp, Artificial Sequence
  chemically synthesized
gtcctcaatagcaccccatt

SEQ ID NO: 158425 - DNA, 20 bp, Artificial Sequence
  chemically synthesized
ctgctaaatggggtgctatt

SEQ ID NO: 158426 - DNA, 20 bp, Artificial Sequence
  chemically synthesized
tgctaaatggggtgctattg

SEQ ID NO: 158427 - DNA, 20 bp, Artificial Sequence
  chemically synthesized
agtaataactaggtcctcaa

SEQ ID NO: 158428 - DNA, 20 bp, Artificial Sequence
  chemically synthesized
atggggtgctattgaggacc

SEQ ID NO: 158429 - DNA, 20 bp, Artificial Sequence
  chemically synthesized
ttttccacacagtaataact

SEQ ID NO: 158430 - DNA, 20 bp, Artificial Sequence
  chemically synthesized
tttttccacacagtaataac

SEQ ID NO: 158431 - DNA, 20 bp, Artificial Sequence
  chemically synthesized
aggacctagttattactgtg

SEQ ID NO: 158432 - DNA, 20 bp, Artificial Sequence
  chemically synthesized
atgtgttccatttttccaca

SEQ ID NO: 158433 - DNA, 20 bp, Artificial Sequence
  chemically synthesized
gttattactgtgtggaaaaa

SEQ ID NO: 158434 - DNA, 20 bp, Artificial Sequence
  chemically synthesized
tggaaaaatggaacacatta

SEQ ID NO: 158435 - DNA, 20 bp, Artificial Sequence
  chemically synthesized
cattaatgccatagatgaaa

SEQ ID NO: 158436 - DNA, 20 bp, Artificial Sequence
  chemically synthesized
attaaagactatttcatcta

SEQ ID NO: 158437 - DNA, 20 bp, Artificial Sequence
  chemically synthesized
aatatattacattaatgcca

SEQ ID NO: 158438 - DNA, 20 bp, Artificial Sequence
  chemically synthesized
ttttgctaaagttatagttt

SEQ ID NO: 158439 - DNA, 20 bp, Artificial Sequence
  chemically synthesized
ttataccaaaactataactt

SEQ ID NO: 158440 - DNA, 20 bp, Artificial Sequence
  chemically synthesized
ttaaaattttgctaaagtta

SEQ ID NO: 158441 - DNA, 20 bp, Artificial Sequence
  chemically synthesized
aattgtttaaaattttgcta

SEQ ID NO: 158442 - DNA, 20 bp, Artificial Sequence
  chemically synthesized
aacaatttatataactcata

SEQ ID NO: 158443 - DNA, 20 bp, Artificial Sequence
  chemically synthesized
atttatataactcatatagt

SEQ ID NO: 158444 - DNA, 20 bp, Artificial Sequence
  chemically synthesized
ttactgaagactgactatat

SEQ ID NO: 158445 - DNA, 20 bp, Artificial Sequence
  chemically synthesized
taactcatatagtcagtctt

SEQ ID NO: 158446 - DNA, 20 bp, Artificial Sequence
  chemically synthesized
cttaacttcagaaattactg

SEQ ID NO: 158447 - DNA, 20 bp, Artificial Sequence
  chemically synthesized
tcagtcttcagtaatttctg

SEQ ID NO: 158448 - DNA, 20 bp, Artificial Sequence
  chemically synthesized
cttcagtaatttctgaagtt

SEQ ID NO: 158449 - DNA, 20 bp, Artificial Sequence
  chemically synthesized
ttatttcttcatcttaactt

SEQ ID NO: 158450 - DNA, 20 bp, Artificial Sequence
  chemically synthesized
taatttctgaagttaagatg

SEQ ID NO: 158451 - DNA, 20 bp, Artificial Sequence
  chemically synthesized
aataacatacaaataaataa

SEQ ID NO: 158452 - DNA, 20 bp, Artificial Sequence
  chemically synthesized
aataaataaaagtatgtgtg

SEQ ID NO: 158453 - DNA, 20 bp, Artificial Sequence
  chemically synthesized
aataaaagtatgtgtgtaga

SEQ ID NO: 158454 - DNA, 20 bp, Artificial Sequence
  chemically synthesized
ataaaagtatgtgtgtagat

SEQ ID NO: 158455 - DNA, 20 bp, Artificial Sequence
  chemically synthesized
taaaagtatgtgtgtagatg

SEQ ID NO: 158456 - DNA, 20 bp, Artificial Sequence
  chemically synthesized
aaaagtatgtgtgtagatgg

SEQ ID NO: 158457 - DNA, 20 bp, Artificial Sequence
  chemically synthesized
aagtatgtgtgtagatgggg

SEQ ID NO: 158458 - DNA, 20 bp, Artificial Sequence
  chemically synthesized
agtatgtgtgtagatggggg

SEQ ID NO: 158459 - DNA, 20 bp, Artificial Sequence
  chemically synthesized
atgtgtgtagatgggggagg

SEQ ID NO: 158460 - DNA, 20 bp, Artificial Sequence
  chemically synthesized
tgtgtgtagatgggggagga

SEQ ID NO: 158461 - DNA, 20 bp, Artificial Sequence
  chemically synthesized
gtgtgtagatgggggaggaa

SEQ ID NO: 158462 - DNA, 20 bp, Artificial Sequence
  chemically synthesized
tgtgtagatgggggaggaag

SEQ ID NO: 158463 - DNA, 20 bp, Artificial Sequence
  chemically synthesized
gtgtagatgggggaggaagg

SEQ ID NO: 158464 - DNA, 20 bp, Artificial Sequence
  chemically synthesized
gtagatgggggaggaagggg

SEQ ID NO: 158465 - DNA, 20 bp, Artificial Sequence
  chemically synthesized
agatgggggaggaaggggga

SEQ ID NO: 158466 - DNA, 20 bp, Artificial Sequence
  chemically synthesized
atgggggaggaagggggaga

SEQ ID NO: 158467 - DNA, 20 bp, Artificial Sequence
  chemically synthesized
gggggaggaagggggagaga

SEQ ID NO: 158468 - DNA, 20 bp, Artificial Sequence
  chemically synthesized
gggaggaagggggagagaga

SEQ ID NO: 158469 - DNA, 20 bp, Artificial Sequence
  chemically synthesized
gaggaagggggagagagaga

SEQ ID NO: 158470 - DNA, 20 bp, Artificial Sequence
  chemically synthesized
ggaagggggagagagagaga

SEQ ID NO: 158471 - DNA, 20 bp, Artificial Sequence
  chemically synthesized
aagggggagagagagagaga

SEQ ID NO: 158472 - DNA, 20 bp, Artificial Sequence
  chemically synthesized
gggggagagagagagagaga

SEQ ID NO: 158473 - DNA, 20 bp, Artificial Sequence
  chemically synthesized
ggggagagagagagagagag

SEQ ID NO: 158474 - DNA, 20 bp, Artificial Sequence
  chemically synthesized
gggagagagagagagagaga

SEQ ID NO: 158475 - DNA, 20 bp, Artificial Sequence
  chemically synthesized
gagagagagagagagagagg

SEQ ID NO: 158476 - DNA, 20 bp, Artificial Sequence
  chemically synthesized
gagagagagagagagaggga

SEQ ID NO: 158477 - DNA, 20 bp, Artificial Sequence
  chemically synthesized
gagagagagagagagggaga

SEQ ID NO: 158478 - DNA, 20 bp, Artificial Sequence
  chemically synthesized
agagagagagagagggagag

SEQ ID NO: 158479 - DNA, 20 bp, Artificial Sequence
  chemically synthesized
gagagagagagagggagaga

SEQ ID NO: 158480 - DNA, 20 bp, Artificial Sequence
  chemically synthesized
gagagagagagggagagagg

SEQ ID NO: 158481 - DNA, 20 bp, Artificial Sequence
  chemically synthesized
gagagagagggagagaggga

SEQ ID NO: 158482 - DNA, 20 bp, Artificial Sequence
  chemically synthesized
gagagagggagagagggaga

SEQ ID NO: 158483 - DNA, 20 bp, Artificial Sequence
  chemically synthesized
agagagggagagagggagag

SEQ ID NO: 158484 - DNA, 20 bp, Artificial Sequence
  chemically synthesized
gagagggagagagggagaga

SEQ ID NO: 158485 - DNA, 20 bp, Artificial Sequence
  chemically synthesized
gagggagagagggagagagg

SEQ ID NO: 158486 - DNA, 20 bp, Artificial Sequence
  chemically synthesized
gggagagagggagagaggga

SEQ ID NO: 158487 - DNA, 20 bp, Artificial Sequence
  chemically synthesized
gagagagggagagagggaga

SEQ ID NO: 158488 - DNA, 20 bp, Artificial Sequence
  chemically synthesized
agagagggagagagggagag

SEQ ID NO: 158489 - DNA, 20 bp, Artificial Sequence
  chemically synthesized
gagagggagagagggagaga

SEQ ID NO: 158490 - DNA, 20 bp, Artificial Sequence
  chemically synthesized
gagggagagagggagagagg

SEQ ID NO: 158491 - DNA, 20 bp, Artificial Sequence
  chemically synthesized
gggagagagggagagaggga

SEQ ID NO: 158492 - DNA, 20 bp, Artificial Sequence
  chemically synthesized
gagagagggagagagggaga

SEQ ID NO: 158493 - DNA, 20 bp, Artificial Sequence
  chemically synthesized
agagagggagagagggagag

SEQ ID NO: 158494 - DNA, 20 bp, Artificial Sequence
  chemically synthesized
gagagggagagagggagaga

SEQ ID NO: 158495 - DNA, 20 bp, Artificial Sequence
  chemically synthesized
gagggagagagggagagagg

SEQ ID NO: 158496 - DNA, 20 bp, Artificial Sequence
  chemically synthesized
gggagagagggagagaggga

SEQ ID NO: 158497 - DNA, 20 bp, Artificial Sequence
  chemically synthesized
gagagagggagagagggaga

SEQ ID NO: 158498 - DNA, 20 bp, Artificial Sequence
  chemically synthesized
agagagggagagagggagag

SEQ ID NO: 158499 - DNA, 20 bp, Artificial Sequence
  chemically synthesized
gagagggagagagggagaga

SEQ ID NO: 158500 - DNA, 20 bp, Artificial Sequence
  chemically synthesized
gagggagagagggagagagg

SEQ ID NO: 158501 - DNA, 20 bp, Artificial Sequence
  chemically synthesized
gggagagagggagagaggga

SEQ ID NO: 158502 - DNA, 20 bp, Artificial Sequence
  chemically synthesized
gagagagggagagagggaga

SEQ ID NO: 158503 - DNA, 20 bp, Artificial Sequence
  chemically synthesized
agagggagagagggagagag

SEQ ID NO: 158504 - DNA, 20 bp, Artificial Sequence
  chemically synthesized
agggagagagggagagagtg

SEQ ID NO: 158505 - DNA, 20 bp, Artificial Sequence
  chemically synthesized
ggagagagggagagagtgga

SEQ ID NO: 158506 - DNA, 20 bp, Artificial Sequence
  chemically synthesized
gagagagggagagagtggag

SEQ ID NO: 158507 - DNA, 20 bp, Artificial Sequence
  chemically synthesized
agagagggagagagtggaga

SEQ ID NO: 158508 - DNA, 20 bp, Artificial Sequence
  chemically synthesized
agagggagagagtggagagg

SEQ ID NO: 158509 - DNA, 20 bp, Artificial Sequence
  chemically synthesized
gagggagagagtggagaggg

SEQ ID NO: 158510 - DNA, 20 bp, Artificial Sequence
  chemically synthesized
agggagagagtggagaggga

SEQ ID NO: 158511 - DNA, 20 bp, Artificial Sequence
  chemically synthesized
ggagagagtggagagggagg

SEQ ID NO: 158512 - DNA, 20 bp, Artificial Sequence
  chemically synthesized
gagagagtggagagggaggg

SEQ ID NO: 158513 - DNA, 20 bp, Artificial Sequence
  chemically synthesized
agagagtggagagggaggga

SEQ ID NO: 158514 - DNA, 20 bp, Artificial Sequence
  chemically synthesized
agtggagagggagggaggga

SEQ ID NO: 158515 - DNA, 20 bp, Artificial Sequence
  chemically synthesized
tggagagggagggagggaaa

SEQ ID NO: 158516 - DNA, 20 bp, Artificial Sequence
  chemically synthesized
gagagggagggagggaaaga

SEQ ID NO: 158517 - DNA, 20 bp, Artificial Sequence
  chemically synthesized
gagggagggagggaaagaga

SEQ ID NO: 158518 - DNA, 20 bp, Artificial Sequence
  chemically synthesized
gggagggagggaaagagaga

SEQ ID NO: 158519 - DNA, 20 bp, Artificial Sequence
  chemically synthesized
gagggagggaaagagagaga

SEQ ID NO: 158520 - DNA, 20 bp, Artificial Sequence
  chemically synthesized
gggagggaaagagagagaga

SEQ ID NO: 158521 - DNA, 20 bp, Artificial Sequence
  chemically synthesized
gagggaaagagagagagaga

SEQ ID NO: 158522 - DNA, 20 bp, Artificial Sequence
  chemically synthesized
gggaaagagagagagagaga

SEQ ID NO: 158523 - DNA, 20 bp, Artificial Sequence
  chemically synthesized
gaaagagagagagagagaga

SEQ ID NO: 158524 - DNA, 20 bp, Artificial Sequence
  chemically synthesized
aagagagagagagagagaga

SEQ ID NO: 158525 - DNA, 20 bp, Artificial Sequence
  chemically synthesized
gagagagagagagagagaga

SEQ ID NO: 158526 - DNA, 20 bp, Artificial Sequence
  chemically synthesized
gagagagagagagagagaca

SEQ ID NO: 158527 - DNA, 20 bp, Artificial Sequence
  chemically synthesized
gagagagagagagagacaga

SEQ ID NO: 158528 - DNA, 20 bp, Artificial Sequence
  chemically synthesized
gagagagagagagacagaga

SEQ ID NO: 158529 - DNA, 20 bp, Artificial Sequence
  chemically synthesized
gagagagagagacagagaga

SEQ ID NO: 158530 - DNA, 20 bp, Artificial Sequence
  chemically synthesized
gagagagacagagagagaga

SEQ ID NO: 158531 - DNA, 20 bp, Artificial Sequence
  chemically synthesized
gagagacagagagagagaaa

SEQ ID NO: 158532 - DNA, 20 bp, Artificial Sequence
  chemically synthesized
gagacagagagagagaaaga

SEQ ID NO: 158533 - DNA, 20 bp, Artificial Sequence
  chemically synthesized
gagagagagaaagagagttg

SEQ ID NO: 158534 - DNA, 20 bp, Artificial Sequence
  chemically synthesized
gagagttgaagtgctaaaca

SEQ ID NO: 158535 - DNA, 20 bp, Artificial Sequence
  chemically synthesized
aatacctctccatctttgtt

SEQ ID NO: 158536 - DNA, 20 bp, Artificial Sequence
  chemically synthesized
gttgaagtgctaaacaaaga

SEQ ID NO: 158537 - DNA, 20 bp, Artificial Sequence
  chemically synthesized
tgaagtgctaaacaaagatg

SEQ ID NO: 158538 - DNA, 20 bp, Artificial Sequence
  chemically synthesized
aagtgctaaacaaagatgga

SEQ ID NO: 158539 - DNA, 20 bp, Artificial Sequence
  chemically synthesized
agtgctaaacaaagatggag

SEQ ID NO: 158540 - DNA, 20 bp, Artificial Sequence
  chemically synthesized
gtatttgatcatacgatcct

SEQ ID NO: 158541 - DNA, 20 bp, Artificial Sequence
  chemically synthesized
aaaataactggaaaaatctt

SEQ ID NO: 158542 - DNA, 20 bp, Artificial Sequence
  chemically synthesized
caaaataactggaaaaatct

SEQ ID NO: 158543 - DNA, 20 bp, Artificial Sequence
  chemically synthesized
atacgatcctaagatttttc

SEQ ID NO: 158544 - DNA, 20 bp, Artificial Sequence
  chemically synthesized
aatctctgctgcaaaataac

SEQ ID NO: 158545 - DNA, 20 bp, Artificial Sequence
  chemically synthesized
agatttttccagttattttg

SEQ ID NO: 158546 - DNA, 20 bp, Artificial Sequence
  chemically synthesized
tttttccagttattttgcag

SEQ ID NO: 158547 - DNA, 20 bp, Artificial Sequence
  chemically synthesized
tttccagttattttgcagca

SEQ ID NO: 158548 - DNA, 20 bp, Artificial Sequence
  chemically synthesized
agttattttgcagcagagat

SEQ ID NO: 158549 - DNA, 20 bp, Artificial Sequence
  chemically synthesized
taatactaatgacgtatagg

SEQ ID NO: 158550 - DNA, 20 bp, Artificial Sequence
  chemically synthesized
tgataatactaatgacgtat

SEQ ID NO: 158551 - DNA, 20 bp, Artificial Sequence
  chemically synthesized
atgataatactaatgacgta

SEQ ID NO: 158552 - DNA, 20 bp, Artificial Sequence
  chemically synthesized
tagtactacctatacgtcat

SEQ ID NO: 158553 - DNA, 20 bp, Artificial Sequence
  chemically synthesized
aatatgtatttgacctttta

SEQ ID NO: 158554 - DNA, 20 bp, Artificial Sequence
  chemically synthesized
atatgtatttgaccttttac

SEQ ID NO: 158555 - DNA, 20 bp, Artificial Sequence
  chemically synthesized
ctttgaggacttcctgtaaa

SEQ ID NO: 158556 - DNA, 20 bp, Artificial Sequence
  chemically synthesized
tgtatttgaccttttacagg

SEQ ID NO: 158557 - DNA, 20 bp, Artificial Sequence
  chemically synthesized
tctttgaggacttcctgtaa

SEQ ID NO: 158558 - DNA, 20 bp, Artificial Sequence
  chemically synthesized
ccttttacaggaagtcctca

SEQ ID NO: 158559 - DNA, 20 bp, Artificial Sequence
  chemically synthesized
caacttctttattttctttg

SEQ ID NO: 158560 - DNA, 20 bp, Artificial Sequence
  chemically synthesized
ccaacttctttattttcttt

SEQ ID NO: 158561 - DNA, 20 bp, Artificial Sequence
  chemically synthesized
ggaagtcctcaaagaaaata

SEQ ID NO: 158562 - DNA, 20 bp, Artificial Sequence
  chemically synthesized
agtcctcaaagaaaataaag

SEQ ID NO: 158563 - DNA, 20 bp, Artificial Sequence
  chemically synthesized
ctcaaagaaaataaagaagt

SEQ ID NO: 158564 - DNA, 20 bp, Artificial Sequence
  chemically synthesized
aagaaaataaagaagttggt

SEQ ID NO: 158565 - DNA, 20 bp, Artificial Sequence
  chemically synthesized
aaataaagaagttggttagt

SEQ ID NO: 158566 - DNA, 20 bp, Artificial Sequence
  chemically synthesized
ataaagaagttggttagtca

SEQ ID NO: 158567 - DNA, 20 bp, Artificial Sequence
  chemically synthesized
gttagtcagagattttaaaa

SEQ ID NO: 158568 - DNA, 20 bp, Artificial Sequence
  chemically synthesized
agagattttaaaaaagaaac

SEQ ID NO: 158569 - DNA, 20 bp, Artificial Sequence
  chemically synthesized
tttcaaagatggtatatttc

SEQ ID NO: 158570 - DNA, 20 bp, Artificial Sequence
  chemically synthesized
atttcttttattttcaaaga

SEQ ID NO: 158571 - DNA, 20 bp, Artificial Sequence
  chemically synthesized
taagatttcttttattttca

SEQ ID NO: 158572 - DNA, 20 bp, Artificial Sequence
  chemically synthesized
tataccatctttgaaaataa

SEQ ID NO: 158573 - DNA, 20 bp, Artificial Sequence
  chemically synthesized
tgaaaataaaagaaatctta

SEQ ID NO: 158574 - DNA, 20 bp, Artificial Sequence
  chemically synthesized
aaataaaagaaatcttaaag

SEQ ID NO: 158575 - DNA, 20 bp, Artificial Sequence
  chemically synthesized
ttcacttcgtcaacttcttt

SEQ ID NO: 158576 - DNA, 20 bp, Artificial Sequence
  chemically synthesized
aaatcttaaagaagttgacg

SEQ ID NO: 158577 - DNA, 20 bp, Artificial Sequence
  chemically synthesized
ttaaagaagttgacgaagtg

SEQ ID NO: 158578 - DNA, 20 bp, Artificial Sequence
  chemically synthesized
taaagaagttgacgaagtga

SEQ ID NO: 158579 - DNA, 20 bp, Artificial Sequence
  chemically synthesized
gaagttgacgaagtgaagga

SEQ ID NO: 158580 - DNA, 20 bp, Artificial Sequence
  chemically synthesized
gttgacgaagtgaaggaaag

SEQ ID NO: 158581 - DNA, 20 bp, Artificial Sequence
  chemically synthesized
acgaagtgaaggaaagaaga

SEQ ID NO: 158582 - DNA, 20 bp, Artificial Sequence
  chemically synthesized
gaagtgaaggaaagaagaaa

SEQ ID NO: 158583 - DNA, 20 bp, Artificial Sequence
  chemically synthesized
aagtgaaggaaagaagaaag

SEQ ID NO: 158584 - DNA, 20 bp, Artificial Sequence
  chemically synthesized
gaaggaaagaagaaagagga

SEQ ID NO: 158585 - DNA, 20 bp, Artificial Sequence
  chemically synthesized
gaagaaagaggaaagaaact

SEQ ID NO: 158586 - DNA, 20 bp, Artificial Sequence
  chemically synthesized
gaaagaggaaagaaactgag

SEQ ID NO: 158587 - DNA, 20 bp, Artificial Sequence
  chemically synthesized
aaagaggaaagaaactgagc

SEQ ID NO: 158588 - DNA, 20 bp, Artificial Sequence
  chemically synthesized
aagaggaaagaaactgagca

SEQ ID NO: 158589 - DNA, 20 bp, Artificial Sequence
  chemically synthesized
aagctgggttcatccctgct

SEQ ID NO: 158590 - DNA, 20 bp, Artificial Sequence
  chemically synthesized
aaactgagcagggatgaacc

SEQ ID NO: 158591 - DNA, 20 bp, Artificial Sequence
  chemically synthesized
ctgagttctgattggaagct

SEQ ID NO: 158592 - DNA, 20 bp, Artificial Sequence
  chemically synthesized
gctgagttctgattggaagc

SEQ ID NO: 158593 - DNA, 20 bp, Artificial Sequence
  chemically synthesized
ggatgaacccagcttccaat

SEQ ID NO: 158594 - DNA, 20 bp, Artificial Sequence
  chemically synthesized
ccaagctgagttctgattgg

SEQ ID NO: 158595 - DNA, 20 bp, Artificial Sequence
  chemically synthesized
ctcccaagctgagttctgat

SEQ ID NO: 158596 - DNA, 20 bp, Artificial Sequence
  chemically synthesized
cccagcttccaatcagaact

SEQ ID NO: 158597 - DNA, 20 bp, Artificial Sequence
  chemically synthesized
cttccaatcagaactcagct

SEQ ID NO: 158598 - DNA, 20 bp, Artificial Sequence
  chemically synthesized
ttccaatcagaactcagctt

SEQ ID NO: 158599 - DNA, 20 bp, Artificial Sequence
  chemically synthesized
ccaatcagaactcagcttgg

SEQ ID NO: 158600 - DNA, 20 bp, Artificial Sequence
  chemically synthesized
ctacgctcacctcccaagct

SEQ ID NO: 158601 - DNA, 20 bp, Artificial Sequence
  chemically synthesized
caatcagaactcagcttggg

SEQ ID NO: 158602 - DNA, 20 bp, Artificial Sequence
  chemically synthesized
cagaactcagcttgggaggt

SEQ ID NO: 158603 - DNA, 20 bp, Artificial Sequence
  chemically synthesized
agctcctacgctcacctccc

SEQ ID NO: 158604 - DNA, 20 bp, Artificial Sequence
  chemically synthesized
ctcagcttgggaggtgagcg

SEQ ID NO: 158605 - DNA, 20 bp, Artificial Sequence
  chemically synthesized
tcagcttgggaggtgagcgt

SEQ ID NO: 158606 - DNA, 20 bp, Artificial Sequence
  chemically synthesized
agcttgggaggtgagcgtag

SEQ ID NO: 158607 - DNA, 20 bp, Artificial Sequence
  chemically synthesized
tgggaggtgagcgtaggagc

SEQ ID NO: 158608 - DNA, 20 bp, Artificial Sequence
  chemically synthesized
aggtgagcgtaggagctgga

SEQ ID NO: 158609 - DNA, 20 bp, Artificial Sequence
  chemically synthesized
gagcgtaggagctggacaga

SEQ ID NO: 158610 - DNA, 20 bp, Artificial Sequence
  chemically synthesized
agcgtaggagctggacagac

SEQ ID NO: 158611 - DNA, 20 bp, Artificial Sequence
  chemically synthesized
catcagacagcctgtctgtc

SEQ ID NO: 158612 - DNA, 20 bp, Artificial Sequence
  chemically synthesized
gacagacaggctgtctgatg

SEQ ID NO: 158613 - DNA, 20 bp, Artificial Sequence
  chemically synthesized
cctccgcattctgcatcaga

SEQ ID NO: 158614 - DNA, 20 bp, Artificial Sequence
  chemically synthesized
ggcacctccgcattctgcat

SEQ ID NO: 158615 - DNA, 20 bp, Artificial Sequence
  chemically synthesized
aggctgtctgatgcagaatg

SEQ ID NO: 158616 - DNA, 20 bp, Artificial Sequence
  chemically synthesized
gctgtctgatgcagaatgcg

SEQ ID NO: 158617 - DNA, 20 bp, Artificial Sequence
  chemically synthesized
ctgtctgatgcagaatgcgg

SEQ ID NO: 158618 - DNA, 20 bp, Artificial Sequence
  chemically synthesized
gcagaatgcggaggtgccaa

SEQ ID NO: 158619 - DNA, 20 bp, Artificial Sequence
  chemically synthesized
atgcggaggtgccaatagac

SEQ ID NO: 158620 - DNA, 20 bp, Artificial Sequence
  chemically synthesized
taggaaattgacttgtctat

SEQ ID NO: 158621 - DNA, 20 bp, Artificial Sequence
  chemically synthesized
aatagacaagtcaatttcct

SEQ ID NO: 158622 - DNA, 20 bp, Artificial Sequence
  chemically synthesized
caagtcaatttcctaagaaa

SEQ ID NO: 158623 - DNA, 20 bp, Artificial Sequence
  chemically synthesized
agggagcaattctgtttctt

SEQ ID NO: 158624 - DNA, 20 bp, Artificial Sequence
  chemically synthesized
cagggagcaattctgtttct

SEQ ID NO: 158625 - DNA, 20 bp, Artificial Sequence
  chemically synthesized
ctaattaaagacacatcagg

SEQ ID NO: 158626 - DNA, 20 bp, Artificial Sequence
  chemically synthesized
ttctaattaaagacacatca

SEQ ID NO: 158627 - DNA, 20 bp, Artificial Sequence
  chemically synthesized
attctaattaaagacacatc

SEQ ID NO: 158628 - DNA, 20 bp, Artificial Sequence
  chemically synthesized
cattctaattaaagacacat

SEQ ID NO: 158629 - DNA, 20 bp, Artificial Sequence
  chemically synthesized
ctccctgatgtgtctttaat

SEQ ID NO: 158630 - DNA, 20 bp, Artificial Sequence
  chemically synthesized
gcttacaaacattctaatta

SEQ ID NO: 158631 - DNA, 20 bp, Artificial Sequence
  chemically synthesized
tctttaattagaatgtttgt

SEQ ID NO: 158632 - DNA, 20 bp, Artificial Sequence
  chemically synthesized
ttaattagaatgtttgtaag

SEQ ID NO: 158633 - DNA, 20 bp, Artificial Sequence
  chemically synthesized
attagaatgtttgtaagcgg

SEQ ID NO: 158634 - DNA, 20 bp, Artificial Sequence
  chemically synthesized
ctagtatttaaatgcataat

SEQ ID NO: 158635 - DNA, 20 bp, Artificial Sequence
  chemically synthesized
ctaattatgcatttaaatac

SEQ ID NO: 158636 - DNA, 20 bp, Artificial Sequence
  chemically synthesized
cacgatgtatatgcaagatc

SEQ ID NO: 158637 - DNA, 20 bp, Artificial Sequence
  chemically synthesized
atctctcacgatgtatatgc

SEQ ID NO: 158638 - DNA, 20 bp, Artificial Sequence
  chemically synthesized
agatcttgcatatacatcgt

SEQ ID NO: 158639 - DNA, 20 bp, Artificial Sequence
  chemically synthesized
atcttgcatatacatcgtga

SEQ ID NO: 158640 - DNA, 20 bp, Artificial Sequence
  chemically synthesized
agattttcattttcttttta

SEQ ID NO: 158641 - DNA, 20 bp, Artificial Sequence
  chemically synthesized
agaaaatgatattctttaaa

SEQ ID NO: 158642 - DNA, 20 bp, Artificial Sequence
  chemically synthesized
tggaaactgtaataattatg

SEQ ID NO: 158643 - DNA, 20 bp, Artificial Sequence
  chemically synthesized
cattttcttcataattatta

SEQ ID NO: 158644 - DNA, 20 bp, Artificial Sequence
  chemically synthesized
ttttttgggggaggtgcatt

SEQ ID NO: 158645 - DNA, 20 bp, Artificial Sequence
  chemically synthesized
ctgtttttgttttttggggg

SEQ ID NO: 158646 - DNA, 20 bp, Artificial Sequence
  chemically synthesized
tctgtttttgttttttgggg

SEQ ID NO: 158647 - DNA, 20 bp, Artificial Sequence
  chemically synthesized
tttctgtttttgttttttgg

SEQ ID NO: 158648 - DNA, 20 bp, Artificial Sequence
  chemically synthesized
gtttctgtttttgttttttg

SEQ ID NO: 158649 - DNA, 20 bp, Artificial Sequence
  chemically synthesized
tgtttctgtttttgtttttt

SEQ ID NO: 158650 - DNA, 20 bp, Artificial Sequence
  chemically synthesized
gtgtttctgtttttgttttt

SEQ ID NO: 158651 - DNA, 20 bp, Artificial Sequence
  chemically synthesized
cctcccccaaaaaacaaaaa

SEQ ID NO: 158652 - DNA, 20 bp, Artificial Sequence
  chemically synthesized
cctgcagcacattttcatga

SEQ ID NO: 158653 - DNA, 20 bp, Artificial Sequence
  chemically synthesized
agcctgcagcacattttcat

SEQ ID NO: 158654 - DNA, 20 bp, Artificial Sequence
  chemically synthesized
tctctcatgaaaatgtgctg

SEQ ID NO: 158655 - DNA, 20 bp, Artificial Sequence
  chemically synthesized
ctctcatgaaaatgtgctgc

SEQ ID NO: 158656 - DNA, 20 bp, Artificial Sequence
  chemically synthesized
aaatgagtctgagtagcctg

SEQ ID NO: 158657 - DNA, 20 bp, Artificial Sequence
  chemically synthesized
aaaatgtgctgcaggctact

SEQ ID NO: 158658 - DNA, 20 bp, Artificial Sequence
  chemically synthesized
gaagaggaaatgagtctgag

SEQ ID NO: 158659 - DNA, 20 bp, Artificial Sequence
  chemically synthesized
atagaagaggaaatgagtct

SEQ ID NO: 158660 - DNA, 20 bp, Artificial Sequence
  chemically synthesized
ctcttaatagaagaggaaat

SEQ ID NO: 158661 - DNA, 20 bp, Artificial Sequence
  chemically synthesized
ttgttacctcttaatagaag

SEQ ID NO: 158662 - DNA, 20 bp, Artificial Sequence
  chemically synthesized
gactcatttcctcttctatt

SEQ ID NO: 158663 - DNA, 20 bp, Artificial Sequence
  chemically synthesized
cttgttacctcttaatagaa

SEQ ID NO: 158664 - DNA, 20 bp, Artificial Sequence
  chemically synthesized
ctcatttcctcttctattaa

SEQ ID NO: 158665 - DNA, 20 bp, Artificial Sequence
  chemically synthesized
gtcttgttacctcttaatag

SEQ ID NO: 158666 - DNA, 20 bp, Artificial Sequence
  chemically synthesized
tcatttcctcttctattaag

SEQ ID NO: 158667 - DNA, 20 bp, Artificial Sequence
  chemically synthesized
tgggtcttgttacctcttaa

SEQ ID NO: 158668 - DNA, 20 bp, Artificial Sequence
  chemically synthesized
ctcttctattaagaggtaac

SEQ ID NO: 158669 - DNA, 20 bp, Artificial Sequence
  chemically synthesized
tattaagaggtaacaagacc

SEQ ID NO: 158670 - DNA, 20 bp, Artificial Sequence
  chemically synthesized
ttaagaggtaacaagaccca

SEQ ID NO: 158671 - DNA, 20 bp, Artificial Sequence
  chemically synthesized
aggtaacaagacccagagtg

SEQ ID NO: 158672 - DNA, 20 bp, Artificial Sequence
  chemically synthesized
taatgcctcttcttcactct

SEQ ID NO: 158673 - DNA, 20 bp, Artificial Sequence
  chemically synthesized
ataatgcctcttcttcactc

SEQ ID NO: 158674 - DNA, 20 bp, Artificial Sequence
  chemically synthesized
taacaagacccagagtgaag

SEQ ID NO: 158675 - DNA, 20 bp, Artificial Sequence
  chemically synthesized
acaagacccagagtgaagaa

SEQ ID NO: 158676 - DNA, 20 bp, Artificial Sequence
  chemically synthesized
caagacccagagtgaagaag

SEQ ID NO: 158677 - DNA, 20 bp, Artificial Sequence
  chemically synthesized
tgaagaagaggcattataaa

SEQ ID NO: 158678 - DNA, 20 bp, Artificial Sequence
  chemically synthesized
gaagaagaggcattataaat

SEQ ID NO: 158679 - DNA, 20 bp, Artificial Sequence
  chemically synthesized
aaattttaaattttgatata

SEQ ID NO: 158680 - DNA, 20 bp, Artificial Sequence
  chemically synthesized
aattttgatatatggactca

SEQ ID NO: 158681 - DNA, 20 bp, Artificial Sequence
  chemically synthesized
acaaagcctttttaaacttt

SEQ ID NO: 158682 - DNA, 20 bp, Artificial Sequence
  chemically synthesized
atatggactcaaagtttaaa

SEQ ID NO: 158683 - DNA, 20 bp, Artificial Sequence
  chemically synthesized
tatggactcaaagtttaaaa

SEQ ID NO: 158684 - DNA, 20 bp, Artificial Sequence
  chemically synthesized
gctctgatagaacgtgaaca

SEQ ID NO: 158685 - DNA, 20 bp, Artificial Sequence
  chemically synthesized
aggctttgttcacgttctat

SEQ ID NO: 158686 - DNA, 20 bp, Artificial Sequence
  chemically synthesized
gctttgttcacgttctatca

SEQ ID NO: 158687 - DNA, 20 bp, Artificial Sequence
  chemically synthesized
aggacactccattgctctga

SEQ ID NO: 158688 - DNA, 20 bp, Artificial Sequence
  chemically synthesized
ttcacgttctatcagagcaa

SEQ ID NO: 158689 - DNA, 20 bp, Artificial Sequence
  chemically synthesized
cacgttctatcagagcaatg

SEQ ID NO: 158690 - DNA, 20 bp, Artificial Sequence
  chemically synthesized
cagagcaatggagtgtcctt

SEQ ID NO: 158691 - DNA, 20 bp, Artificial Sequence
  chemically synthesized
gttagagatgatttttctga

SEQ ID NO: 158692 - DNA, 20 bp, Artificial Sequence
  chemically synthesized
ggttagagatgatttttctg

SEQ ID NO: 158693 - DNA, 20 bp, Artificial Sequence
  chemically synthesized
aaatttatttttaaaggtta

SEQ ID NO: 158694 - DNA, 20 bp, Artificial Sequence
  chemically synthesized
aaaaatttatttttaaaggt

SEQ ID NO: 158695 - DNA, 20 bp, Artificial Sequence
  chemically synthesized
gatcaaaaatttatttttaa

SEQ ID NO: 158696 - DNA, 20 bp, Artificial Sequence
  chemically synthesized
ggatcaaaaatttattttta

SEQ ID NO: 158697 - DNA, 20 bp, Artificial Sequence
  chemically synthesized
aaataaatttttgatccatg

SEQ ID NO: 158698 - DNA, 20 bp, Artificial Sequence
  chemically synthesized
ataaatttttgatccatgca

SEQ ID NO: 158699 - DNA, 20 bp, Artificial Sequence
  chemically synthesized
gggctgtttaaatctctgca

SEQ ID NO: 158700 - DNA, 20 bp, Artificial Sequence
  chemically synthesized
gatccatgcagagatttaaa

SEQ ID NO: 158701 - DNA, 20 bp, Artificial Sequence
  chemically synthesized
agagatttaaacagccctca

SEQ ID NO: 158702 - DNA, 20 bp, Artificial Sequence
  chemically synthesized
tacaaggcagaaagctgtga

SEQ ID NO: 158703 - DNA, 20 bp, Artificial Sequence
  chemically synthesized
atacaaggcagaaagctgtg

SEQ ID NO: 158704 - DNA, 20 bp, Artificial Sequence
  chemically synthesized
aatacaaggcagaaagctgt

SEQ ID NO: 158705 - DNA, 20 bp, Artificial Sequence
  chemically synthesized
acccagcaatacaaggcaga

SEQ ID NO: 158706 - DNA, 20 bp, Artificial Sequence
  chemically synthesized
tgacacccagcaatacaagg

SEQ ID NO: 158707 - DNA, 20 bp, Artificial Sequence
  chemically synthesized
acatgacacccagcaataca

SEQ ID NO: 158708 - DNA, 20 bp, Artificial Sequence
  chemically synthesized
agctttctgccttgtattgc

SEQ ID NO: 158709 - DNA, 20 bp, Artificial Sequence
  chemically synthesized
aacatgacacccagcaatac

SEQ ID NO: 158710 - DNA, 20 bp, Artificial Sequence
  chemically synthesized
gctttctgccttgtattgct

SEQ ID NO: 158711 - DNA, 20 bp, Artificial Sequence
  chemically synthesized
acagttttgaacatgacacc

SEQ ID NO: 158712 - DNA, 20 bp, Artificial Sequence
  chemically synthesized
ggtgtcatgttcaaaactgt

SEQ ID NO: 158713 - DNA, 20 bp, Artificial Sequence
  chemically synthesized
gtgtcatgttcaaaactgtg

SEQ ID NO: 158714 - DNA, 20 bp, Artificial Sequence
  chemically synthesized
aggctcaaaaaatgacctca

SEQ ID NO: 158715 - DNA, 20 bp, Artificial Sequence
  chemically synthesized
aaactgtgaggtcatttttt

SEQ ID NO: 158716 - DNA, 20 bp, Artificial Sequence
  chemically synthesized
gaggtcattttttgagcctc

SEQ ID NO: 158717 - DNA, 20 bp, Artificial Sequence
  chemically synthesized
aggtcattttttgagcctct

SEQ ID NO: 158718 - DNA, 20 bp, Artificial Sequence
  chemically synthesized
cggtagcctgaaacacctag

SEQ ID NO: 158719 - DNA, 20 bp, Artificial Sequence
  chemically synthesized
gcggtagcctgaaacaccta

SEQ ID NO: 158720 - DNA, 20 bp, Artificial Sequence
  chemically synthesized
ttttgagcctctaggtgttt

SEQ ID NO: 158721 - DNA, 20 bp, Artificial Sequence
  chemically synthesized
ttgcggtagcctgaaacacc

SEQ ID NO: 158722 - DNA, 20 bp, Artificial Sequence
  chemically synthesized
tttgagcctctaggtgtttc

SEQ ID NO: 158723 - DNA, 20 bp, Artificial Sequence
  chemically synthesized
agattagctggggtttgcgg

SEQ ID NO: 158724 - DNA, 20 bp, Artificial Sequence
  chemically synthesized
tttcaggctaccgcaaaccc

SEQ ID NO: 158725 - DNA, 20 bp, Artificial Sequence
  chemically synthesized
tgaagattagctggggtttg

SEQ ID NO: 158726 - DNA, 20 bp, Artificial Sequence
  chemically synthesized
aaacatctgaagattagctg

SEQ ID NO: 158727 - DNA, 20 bp, Artificial Sequence
  chemically synthesized
gaaacatctgaagattagct

SEQ ID NO: 158728 - DNA, 20 bp, Artificial Sequence
  chemically synthesized
ggaaacatctgaagattagc

SEQ ID NO: 158729 - DNA, 20 bp, Artificial Sequence
  chemically synthesized
cgcaaaccccagctaatctt

SEQ ID NO: 158730 - DNA, 20 bp, Artificial Sequence
  chemically synthesized
ccttggaaacatctgaagat

SEQ ID NO: 158731 - DNA, 20 bp, Artificial Sequence
  chemically synthesized
catgaccttggaaacatctg

SEQ ID NO: 158732 - DNA, 20 bp, Artificial Sequence
  chemically synthesized
gctaatcttcagatgtttcc

SEQ ID NO: 158733 - DNA, 20 bp, Artificial Sequence
  chemically synthesized
ctaatcttcagatgtttcca

SEQ ID NO: 158734 - DNA, 20 bp, Artificial Sequence
  chemically synthesized
ttcagatgtttccaaggtca

SEQ ID NO: 158735 - DNA, 20 bp, Artificial Sequence
  chemically synthesized
tttgctgtggaccatgacct

SEQ ID NO: 158736 - DNA, 20 bp, Artificial Sequence
  chemically synthesized
gtttccaaggtcatggtcca

SEQ ID NO: 158737 - DNA, 20 bp, Artificial Sequence
  chemically synthesized
aaggtcatggtccacagcaa

SEQ ID NO: 158738 - DNA, 20 bp, Artificial Sequence
  chemically synthesized
ctcacgcacaacttttgctg

SEQ ID NO: 158739 - DNA, 20 bp, Artificial Sequence
  chemically synthesized
ccacagcaaaagttgtgcgt

SEQ ID NO: 158740 - DNA, 20 bp, Artificial Sequence
  chemically synthesized
aattatggggtttaaaaaaa

SEQ ID NO: 158741 - DNA, 20 bp, Artificial Sequence
  chemically synthesized
agaatgatttgagaattatg

SEQ ID NO: 158742 - DNA, 20 bp, Artificial Sequence
  chemically synthesized
aagaatgatttgagaattat

SEQ ID NO: 158743 - DNA, 20 bp, Artificial Sequence
  chemically synthesized
caagaatgatttgagaatta

SEQ ID NO: 158744 - DNA, 20 bp, Artificial Sequence
  chemically synthesized
caaaaatgcaagaatgattt

SEQ ID NO: 158745 - DNA, 20 bp, Artificial Sequence
  chemically synthesized
gttgataggggcaaaaatgc

SEQ ID NO: 158746 - DNA, 20 bp, Artificial Sequence
  chemically synthesized
tatatatatcaagttgatag

SEQ ID NO: 158747 - DNA, 20 bp, Artificial Sequence
  chemically synthesized
atatatatatcaagttgata

SEQ ID NO: 158748 - DNA, 20 bp, Artificial Sequence
  chemically synthesized
tatatatatatcaagttgat

SEQ ID NO: 158749 - DNA, 20 bp, Artificial Sequence
  chemically synthesized
atatatatatatcaagttga

SEQ ID NO: 158750 - DNA, 20 bp, Artificial Sequence
  chemically synthesized
tctcaaaatatatatatatc

SEQ ID NO: 158751 - DNA, 20 bp, Artificial Sequence
  chemically synthesized
acttgatatatatatatttt

SEQ ID NO: 158752 - DNA, 20 bp, Artificial Sequence
  chemically synthesized
gatatatatatattttgaga

SEQ ID NO: 158753 - DNA, 20 bp, Artificial Sequence
  chemically synthesized
tatatatatattttgagacg

SEQ ID NO: 158754 - DNA, 20 bp, Artificial Sequence
  chemically synthesized
cactccagcctgggcgacac

SEQ ID NO: 158755 - DNA, 20 bp, Artificial Sequence
  chemically synthesized
ggagtttcgctcgtgtcgcc

SEQ ID NO: 158756 - DNA, 20 bp, Artificial Sequence
  chemically synthesized
gagtttcgctcgtgtcgccc

SEQ ID NO: 158757 - DNA, 20 bp, Artificial Sequence
  chemically synthesized
ttcgctcgtgtcgcccaggc

SEQ ID NO: 158758 - DNA, 20 bp, Artificial Sequence
  chemically synthesized
cgctcgtgtcgcccaggctg

SEQ ID NO: 158759 - DNA, 20 bp, Artificial Sequence
  chemically synthesized
gcgctgttgcactccagcct

SEQ ID NO: 158760 - DNA, 20 bp, Artificial Sequence
  chemically synthesized
cgcgctgttgcactccagcc

SEQ ID NO: 158761 - DNA, 20 bp, Artificial Sequence
  chemically synthesized
gagatcgcgctgttgcactc

SEQ ID NO: 158762 - DNA, 20 bp, Artificial Sequence
  chemically synthesized
tcgcccaggctggagtgcaa

SEQ ID NO: 158763 - DNA, 20 bp, Artificial Sequence
  chemically synthesized
ggagtgcaacagcgcgatct

SEQ ID NO: 158764 - DNA, 20 bp, Artificial Sequence
  chemically synthesized
ggcagaagttgcagtgagcc

SEQ ID NO: 158765 - DNA, 20 bp, Artificial Sequence
  chemically synthesized
cgagaggcagaagttgcagt

SEQ ID NO: 158766 - DNA, 20 bp, Artificial Sequence
  chemically synthesized
aacccgagaggcagaagttg

SEQ ID NO: 158767 - DNA, 20 bp, Artificial Sequence
  chemically synthesized
cacttgaacccgagaggcag

SEQ ID NO: 158768 - DNA, 20 bp, Artificial Sequence
  chemically synthesized
tcactgcaacttctgcctct

SEQ ID NO: 158769 - DNA, 20 bp, Artificial Sequence
  chemically synthesized
cactgcaacttctgcctctc

SEQ ID NO: 158770 - DNA, 20 bp, Artificial Sequence
  chemically synthesized
aatcacttgaacccgagagg

SEQ ID NO: 158771 - DNA, 20 bp, Artificial Sequence
  chemically synthesized
gagaatcacttgaacccgag

SEQ ID NO: 158772 - DNA, 20 bp, Artificial Sequence
  chemically synthesized
ggagaatcacttgaacccga

SEQ ID NO: 158773 - DNA, 20 bp, Artificial Sequence
  chemically synthesized
aacttctgcctctcgggttc

SEQ ID NO: 158774 - DNA, 20 bp, Artificial Sequence
  chemically synthesized
caggagaatcacttgaaccc

SEQ ID NO: 158775 - DNA, 20 bp, Artificial Sequence
  chemically synthesized
ttcaagtgattctcctgcct

SEQ ID NO: 158776 - DNA, 20 bp, Artificial Sequence
  chemically synthesized
tacttgggaggctgaggcag

SEQ ID NO: 158777 - DNA, 20 bp, Artificial Sequence
  chemically synthesized
gctacttgggaggctgaggc

SEQ ID NO: 158778 - DNA, 20 bp, Artificial Sequence
  chemically synthesized
agctacttgggaggctgagg

SEQ ID NO: 158779 - DNA, 20 bp, Artificial Sequence
  chemically synthesized
cccagctacttgggaggctg

SEQ ID NO: 158780 - DNA, 20 bp, Artificial Sequence
  chemically synthesized
tcccagctacttgggaggct

SEQ ID NO: 158781 - DNA, 20 bp, Artificial Sequence
  chemically synthesized
ttctcctgcctcagcctccc

SEQ ID NO: 158782 - DNA, 20 bp, Artificial Sequence
  chemically synthesized
tcctgcctcagcctcccaag

SEQ ID NO: 158783 - DNA, 20 bp, Artificial Sequence
  chemically synthesized
tgtaatcccagctacttggg

SEQ ID NO: 158784 - DNA, 20 bp, Artificial Sequence
  chemically synthesized
ctgtaatcccagctacttgg

SEQ ID NO: 158785 - DNA, 20 bp, Artificial Sequence
  chemically synthesized
gcctcagcctcccaagtagc

SEQ ID NO: 158786 - DNA, 20 bp, Artificial Sequence
  chemically synthesized
gcctgtaatcccagctactt

SEQ ID NO: 158787 - DNA, 20 bp, Artificial Sequence
  chemically synthesized
cctcagcctcccaagtagct

SEQ ID NO: 158788 - DNA, 20 bp, Artificial Sequence
  chemically synthesized
cgcctgtaatcccagctact

SEQ ID NO: 158789 - DNA, 20 bp, Artificial Sequence
  chemically synthesized
ctcccaagtagctgggatta

SEQ ID NO: 158790 - DNA, 20 bp, Artificial Sequence
  chemically synthesized
tcccaagtagctgggattac

SEQ ID NO: 158791 - DNA, 20 bp, Artificial Sequence
  chemically synthesized
gtggcaggcgcctgtaatcc

SEQ ID NO: 158792 - DNA, 20 bp, Artificial Sequence
  chemically synthesized
attacaggcgcctgccacca

SEQ ID NO: 158793 - DNA, 20 bp, Artificial Sequence
  chemically synthesized
aatgagccagctgtggtggc

SEQ ID NO: 158794 - DNA, 20 bp, Artificial Sequence
  chemically synthesized
aaatgagccagctgtggtgg

SEQ ID NO: 158795 - DNA, 20 bp, Artificial Sequence
  chemically synthesized
caggcgcctgccaccacagc

SEQ ID NO: 158796 - DNA, 20 bp, Artificial Sequence
  chemically synthesized
tgaaaatgagccagctgtgg

SEQ ID NO: 158797 - DNA, 20 bp, Artificial Sequence
  chemically synthesized
atatgaaaatgagccagctg

SEQ ID NO: 158798 - DNA, 20 bp, Artificial Sequence
  chemically synthesized
ctaaaaatatgaaaatgagc

SEQ ID NO: 158799 - DNA, 20 bp, Artificial Sequence
  chemically synthesized
tctactaaaaatatgaaaat

SEQ ID NO: 158800 - DNA, 20 bp, Artificial Sequence
  chemically synthesized
ctggctcattttcatatttt

SEQ ID NO: 158801 - DNA, 20 bp, Artificial Sequence
  chemically synthesized
gctcattttcatatttttag

SEQ ID NO: 158802 - DNA, 20 bp, Artificial Sequence
  chemically synthesized
tcattttcatatttttagta

SEQ ID NO: 158803 - DNA, 20 bp, Artificial Sequence
  chemically synthesized
tttcatatttttagtagaga

SEQ ID NO: 158804 - DNA, 20 bp, Artificial Sequence
  chemically synthesized
ttcatatttttagtagagac

SEQ ID NO: 158805 - DNA, 20 bp, Artificial Sequence
  chemically synthesized
tcatatttttagtagagaca

SEQ ID NO: 158806 - DNA, 20 bp, Artificial Sequence
  chemically synthesized
gagacagggtttcaccatgt

SEQ ID NO: 158807 - DNA, 20 bp, Artificial Sequence
  chemically synthesized
cagggtttcaccatgttggc

SEQ ID NO: 158808 - DNA, 20 bp, Artificial Sequence
  chemically synthesized
cgagacctgcctggccaaca

SEQ ID NO: 158809 - DNA, 20 bp, Artificial Sequence
  chemically synthesized
agggtttcaccatgttggcc

SEQ ID NO: 158810 - DNA, 20 bp, Artificial Sequence
  chemically synthesized
gtttcaccatgttggccagg

SEQ ID NO: 158811 - DNA, 20 bp, Artificial Sequence
  chemically synthesized
tttcaccatgttggccaggc

SEQ ID NO: 158812 - DNA, 20 bp, Artificial Sequence
  chemically synthesized
tcaggagttcgagacctgcc

SEQ ID NO: 158813 - DNA, 20 bp, Artificial Sequence
  chemically synthesized
tcacctgaggtcaggagttc

SEQ ID NO: 158814 - DNA, 20 bp, Artificial Sequence
  chemically synthesized
aggtctcgaactcctgacct

SEQ ID NO: 158815 - DNA, 20 bp, Artificial Sequence
  chemically synthesized
ggcggatcacctgaggtcag

SEQ ID NO: 158816 - DNA, 20 bp, Artificial Sequence
  chemically synthesized
ggtctcgaactcctgacctc

SEQ ID NO: 158817 - DNA, 20 bp, Artificial Sequence
  chemically synthesized
caggcggatcacctgaggtc

SEQ ID NO: 158818 - DNA, 20 bp, Artificial Sequence
  chemically synthesized
gcaggcggatcacctgaggt

SEQ ID NO: 158819 - DNA, 20 bp, Artificial Sequence
  chemically synthesized
cgaggcaggcggatcacctg

SEQ ID NO: 158820 - DNA, 20 bp, Artificial Sequence
  chemically synthesized
ccgaggcaggcggatcacct

SEQ ID NO: 158821 - DNA, 20 bp, Artificial Sequence
  chemically synthesized
ctcaggtgatccgcctgcct

SEQ ID NO: 158822 - DNA, 20 bp, Artificial Sequence
  chemically synthesized
ctttgcgaggccgaggcagg

SEQ ID NO: 158823 - DNA, 20 bp, Artificial Sequence
  chemically synthesized
gcactttgcgaggccgaggc

SEQ ID NO: 158824 - DNA, 20 bp, Artificial Sequence
  chemically synthesized
agcactttgcgaggccgagg

SEQ ID NO: 158825 - DNA, 20 bp, Artificial Sequence
  chemically synthesized
cccagcactttgcgaggccg

SEQ ID NO: 158826 - DNA, 20 bp, Artificial Sequence
  chemically synthesized
tcccagcactttgcgaggcc

SEQ ID NO: 158827 - DNA, 20 bp, Artificial Sequence
  chemically synthesized
ccgcctgcctcggcctcgca

SEQ ID NO: 158828 - DNA, 20 bp, Artificial Sequence
  chemically synthesized
tataatcccagcactttgcg

SEQ ID NO: 158829 - DNA, 20 bp, Artificial Sequence
  chemically synthesized
ctataatcccagcactttgc

SEQ ID NO: 158830 - DNA, 20 bp, Artificial Sequence
  chemically synthesized
gcctcggcctcgcaaagtgc

SEQ ID NO: 158831 - DNA, 20 bp, Artificial Sequence
  chemically synthesized
cctcggcctcgcaaagtgct

SEQ ID NO: 158832 - DNA, 20 bp, Artificial Sequence
  chemically synthesized
ctcgcaaagtgctgggatta

SEQ ID NO: 158833 - DNA, 20 bp, Artificial Sequence
  chemically synthesized
tcgcaaagtgctgggattat

SEQ ID NO: 158834 - DNA, 20 bp, Artificial Sequence
  chemically synthesized
gtggctcatgcctataatcc

SEQ ID NO: 158835 - DNA, 20 bp, Artificial Sequence
  chemically synthesized
agtgctgggattataggcat

SEQ ID NO: 158836 - DNA, 20 bp, Artificial Sequence
  chemically synthesized
taggcatgagccaccatgcc

SEQ ID NO: 158837 - DNA, 20 bp, Artificial Sequence
  chemically synthesized
atcaagttggctgggcatgg

SEQ ID NO: 158838 - DNA, 20 bp, Artificial Sequence
  chemically synthesized
catatcaagttggctgggca

SEQ ID NO: 158839 - DNA, 20 bp, Artificial Sequence
  chemically synthesized
atcaacatatcaagttggct

SEQ ID NO: 158840 - DNA, 20 bp, Artificial Sequence
  chemically synthesized
aatcaacatatcaagttggc

SEQ ID NO: 158841 - DNA, 20 bp, Artificial Sequence
  chemically synthesized
gaaaaatcaacatatcaagt

SEQ ID NO: 158842 - DNA, 20 bp, Artificial Sequence
  chemically synthesized
tggagaaaaatcaacatatc

SEQ ID NO: 158843 - DNA, 20 bp, Artificial Sequence
  chemically synthesized
gttgatttttctccaaatcc

SEQ ID NO: 158844 - DNA, 20 bp, Artificial Sequence
  chemically synthesized
ccatttctcccttggatttg

SEQ ID NO: 158845 - DNA, 20 bp, Artificial Sequence
  chemically synthesized
ttgatttttctccaaatcca

SEQ ID NO: 158846 - DNA, 20 bp, Artificial Sequence
  chemically synthesized
tgatttttctccaaatccaa

SEQ ID NO: 158847 - DNA, 20 bp, Artificial Sequence
  chemically synthesized
tcccatttctcccttggatt

SEQ ID NO: 158848 - DNA, 20 bp, Artificial Sequence
  chemically synthesized
atttttctccaaatccaagg

SEQ ID NO: 158849 - DNA, 20 bp, Artificial Sequence
  chemically synthesized
ctgtcttcccatttctccct

SEQ ID NO: 158850 - DNA, 20 bp, Artificial Sequence
  chemically synthesized
ctccaaatccaagggagaaa

SEQ ID NO: 158851 - DNA, 20 bp, Artificial Sequence
  chemically synthesized
tccaaatccaagggagaaat

SEQ ID NO: 158852 - DNA, 20 bp, Artificial Sequence
  chemically synthesized
aaatccaagggagaaatggg

SEQ ID NO: 158853 - DNA, 20 bp, Artificial Sequence
  chemically synthesized
ccaagggagaaatgggaaga

SEQ ID NO: 158854 - DNA, 20 bp, Artificial Sequence
  chemically synthesized
caagggagaaatgggaagac

SEQ ID NO: 158855 - DNA, 20 bp, Artificial Sequence
  chemically synthesized
acaggaataaattttccctt

SEQ ID NO: 158856 - DNA, 20 bp, Artificial Sequence
  chemically synthesized
aataaattttcccttaagtt

SEQ ID NO: 158857 - DNA, 20 bp, Artificial Sequence
  chemically synthesized
ttgggagaagctgaacttaa

SEQ ID NO: 158858 - DNA, 20 bp, Artificial Sequence
  chemically synthesized
attgggagaagctgaactta

SEQ ID NO: 158859 - DNA, 20 bp, Artificial Sequence
  chemically synthesized
cattgggagaagctgaactt

SEQ ID NO: 158860 - DNA, 20 bp, Artificial Sequence
  chemically synthesized
tcaatttgacacattgggag

SEQ ID NO: 158861 - DNA, 20 bp, Artificial Sequence
  chemically synthesized
ctctcaatttgacacattgg

SEQ ID NO: 158862 - DNA, 20 bp, Artificial Sequence
  chemically synthesized
ttctctcaatttgacacatt

SEQ ID NO: 158863 - DNA, 20 bp, Artificial Sequence
  chemically synthesized
tttctctcaatttgacacat

SEQ ID NO: 158864 - DNA, 20 bp, Artificial Sequence
  chemically synthesized
ttctcccaatgtgtcaaatt

SEQ ID NO: 158865 - DNA, 20 bp, Artificial Sequence
  chemically synthesized
ctcccaatgtgtcaaattga

SEQ ID NO: 158866 - DNA, 20 bp, Artificial Sequence
  chemically synthesized
tgtgtcaaattgagagaaaa

SEQ ID NO: 158867 - DNA, 20 bp, Artificial Sequence
  chemically synthesized
gtgtcaaattgagagaaaat

SEQ ID NO: 158868 - DNA, 20 bp, Artificial Sequence
  chemically synthesized
tgtcaaattgagagaaaata

SEQ ID NO: 158869 - DNA, 20 bp, Artificial Sequence
  chemically synthesized
attgagagaaaatagggaaa

SEQ ID NO: 158870 - DNA, 20 bp, Artificial Sequence
  chemically synthesized
ttgagagaaaatagggaaac

SEQ ID NO: 158871 - DNA, 20 bp, Artificial Sequence
  chemically synthesized
tgagagaaaatagggaaaca

SEQ ID NO: 158872 - DNA, 20 bp, Artificial Sequence
  chemically synthesized
gagaaaatagggaaacaggg

SEQ ID NO: 158873 - DNA, 20 bp, Artificial Sequence
  chemically synthesized
agaaaatagggaaacaggga

SEQ ID NO: 158874 - DNA, 20 bp, Artificial Sequence
  chemically synthesized
aaaatagggaaacagggaag

SEQ ID NO: 158875 - DNA, 20 bp, Artificial Sequence
  chemically synthesized
cagggaaggagaaaaaaaaa

SEQ ID NO: 158876 - DNA, 20 bp, Artificial Sequence
  chemically synthesized
agggaaggagaaaaaaaaaa

SEQ ID NO: 158877 - DNA, 20 bp, Artificial Sequence
  chemically synthesized
gaaggagaaaaaaaaaaagg

SEQ ID NO: 158878 - DNA, 20 bp, Artificial Sequence
  chemically synthesized
aaggagaaaaaaaaaaagga

SEQ ID NO: 158879 - DNA, 20 bp, Artificial Sequence
  chemically synthesized
aaaaaaaggaaggaaaaaaa

SEQ ID NO: 158880 - DNA, 20 bp, Artificial Sequence
  chemically synthesized
aaaaccatttttgtagcaga

SEQ ID NO: 158881 - DNA, 20 bp, Artificial Sequence
  chemically synthesized
ccttaaaaccatttttgtag

SEQ ID NO: 158882 - DNA, 20 bp, Artificial Sequence
  chemically synthesized
agtgctgtctgctacaaaaa

SEQ ID NO: 158883 - DNA, 20 bp, Artificial Sequence
  chemically synthesized
aacccttaaaaccatttttg

SEQ ID NO: 158884 - DNA, 20 bp, Artificial Sequence
  chemically synthesized
tctgctacaaaaatggtttt

SEQ ID NO: 158885 - DNA, 20 bp, Artificial Sequence
  chemically synthesized
ctgctacaaaaatggtttta

SEQ ID NO: 158886 - DNA, 20 bp, Artificial Sequence
  chemically synthesized
tgctacaaaaatggttttaa

SEQ ID NO: 158887 - DNA, 20 bp, Artificial Sequence
  chemically synthesized
aatggttttaagggttgtga

SEQ ID NO: 158888 - DNA, 20 bp, Artificial Sequence
  chemically synthesized
tggttttaagggttgtgaaa

SEQ ID NO: 158889 - DNA, 20 bp, Artificial Sequence
  chemically synthesized
ttttaagggttgtgaaagag

SEQ ID NO: 158890 - DNA, 20 bp, Artificial Sequence
  chemically synthesized
tttaagggttgtgaaagaga

SEQ ID NO: 158891 - DNA, 20 bp, Artificial Sequence
  chemically synthesized
agggttgtgaaagagaagga

SEQ ID NO: 158892 - DNA, 20 bp, Artificial Sequence
  chemically synthesized
gtgaaagagaaggaaagcaa

SEQ ID NO: 158893 - DNA, 20 bp, Artificial Sequence
  chemically synthesized
agaaggaaagcaacagctcc

SEQ ID NO: 158894 - DNA, 20 bp, Artificial Sequence
  chemically synthesized
aaataaaaagaaagaaccag

SEQ ID NO: 158895 - DNA, 20 bp, Artificial Sequence
  chemically synthesized
tgaaataaaaagaaagaacc

SEQ ID NO: 158896 - DNA, 20 bp, Artificial Sequence
  chemically synthesized
ctgaaataaaaagaaagaac

SEQ ID NO: 158897 - DNA, 20 bp, Artificial Sequence
  chemically synthesized
acttttctgaaataaaaaga

SEQ ID NO: 158898 - DNA, 20 bp, Artificial Sequence
  chemically synthesized
ctggttctttctttttattt

SEQ ID NO: 158899 - DNA, 20 bp, Artificial Sequence
  chemically synthesized
aattacttttctgaaataaa

SEQ ID NO: 158900 - DNA, 20 bp, Artificial Sequence
  chemically synthesized
tctttctttttatttcagaa

SEQ ID NO: 158901 - DNA, 20 bp, Artificial Sequence
  chemically synthesized
atgcattagtgatgtaaaag

SEQ ID NO: 158902 - DNA, 20 bp, Artificial Sequence
  chemically synthesized
tgatgcattagtgatgtaaa

SEQ ID NO: 158903 - DNA, 20 bp, Artificial Sequence
  chemically synthesized
ctgatgcattagtgatgtaa

SEQ ID NO: 158904 - DNA, 20 bp, Artificial Sequence
  chemically synthesized
cttttacatcactaatgcat

SEQ ID NO: 158905 - DNA, 20 bp, Artificial Sequence
  chemically synthesized
tctgcttcctgctgatgcat

SEQ ID NO: 158906 - DNA, 20 bp, Artificial Sequence
  chemically synthesized
ttacatcactaatgcatcag

SEQ ID NO: 158907 - DNA, 20 bp, Artificial Sequence
  chemically synthesized
tacatcactaatgcatcagc

SEQ ID NO: 158908 - DNA, 20 bp, Artificial Sequence
  chemically synthesized
atcactaatgcatcagcagg

SEQ ID NO: 158909 - DNA, 20 bp, Artificial Sequence
  chemically synthesized
actaatgcatcagcaggaag

SEQ ID NO: 158910 - DNA, 20 bp, Artificial Sequence
  chemically synthesized
cagcaggaagcagatatgct

SEQ ID NO: 158911 - DNA, 20 bp, Artificial Sequence
  chemically synthesized
agcaggaagcagatatgctc

SEQ ID NO: 158912 - DNA, 20 bp, Artificial Sequence
  chemically synthesized
gaagcagatatgctcaggca

SEQ ID NO: 158913 - DNA, 20 bp, Artificial Sequence
  chemically synthesized
aactgggatctgccatgcct

SEQ ID NO: 158914 - DNA, 20 bp, Artificial Sequence
  chemically synthesized
gcagatatgctcaggcatgg

SEQ ID NO: 158915 - DNA, 20 bp, Artificial Sequence
  chemically synthesized
tgctcaggcatggcagatcc

SEQ ID NO: 158916 - DNA, 20 bp, Artificial Sequence
  chemically synthesized
gccacttggagatcagaact

SEQ ID NO: 158917 - DNA, 20 bp, Artificial Sequence
  chemically synthesized
ggccacttggagatcagaac

SEQ ID NO: 158918 - DNA, 20 bp, Artificial Sequence
  chemically synthesized
agatcccagttctgatctcc

SEQ ID NO: 158919 - DNA, 20 bp, Artificial Sequence
  chemically synthesized
ctactgggccacttggagat

SEQ ID NO: 158920 - DNA, 20 bp, Artificial Sequence
  chemically synthesized
tcccagttctgatctccaag

SEQ ID NO: 158921 - DNA, 20 bp, Artificial Sequence
  chemically synthesized
ctcaactactgggccacttg

SEQ ID NO: 158922 - DNA, 20 bp, Artificial Sequence
  chemically synthesized
gttctgatctccaagtggcc

SEQ ID NO: 158923 - DNA, 20 bp, Artificial Sequence
  chemically synthesized
cactcaactactgggccact

SEQ ID NO: 158924 - DNA, 20 bp, Artificial Sequence
  chemically synthesized
ctgatctccaagtggcccag

SEQ ID NO: 158925 - DNA, 20 bp, Artificial Sequence
  chemically synthesized
ctccaagtggcccagtagtt

SEQ ID NO: 158926 - DNA, 20 bp, Artificial Sequence
  chemically synthesized
cacccacacactcaactact

SEQ ID NO: 158927 - DNA, 20 bp, Artificial Sequence
  chemically synthesized
ccacccacacactcaactac

SEQ ID NO: 158928 - DNA, 20 bp, Artificial Sequence
  chemically synthesized
tggcccagtagttgagtgtg

SEQ ID NO: 158929 - DNA, 20 bp, Artificial Sequence
  chemically synthesized
ggcccagtagttgagtgtgt

SEQ ID NO: 158930 - DNA, 20 bp, Artificial Sequence
  chemically synthesized
ccagtagttgagtgtgtggg

SEQ ID NO: 158931 - DNA, 20 bp, Artificial Sequence
  chemically synthesized
agtagttgagtgtgtgggtg

SEQ ID NO: 158932 - DNA, 20 bp, Artificial Sequence
  chemically synthesized
gtagttgagtgtgtgggtgg

SEQ ID NO: 158933 - DNA, 20 bp, Artificial Sequence
  chemically synthesized
tgtgtgggtggaggtgcgat

SEQ ID NO: 158934 - DNA, 20 bp, Artificial Sequence
  chemically synthesized
tgggtggaggtgcgataagt

SEQ ID NO: 158935 - DNA, 20 bp, Artificial Sequence
  chemically synthesized
aggtgcgataagttagcatc

SEQ ID NO: 158936 - DNA, 20 bp, Artificial Sequence
  chemically synthesized
ataagttagcatcaagcatt

SEQ ID NO: 158937 - DNA, 20 bp, Artificial Sequence
  chemically synthesized
gattgttttatacataatga

SEQ ID NO: 158938 - DNA, 20 bp, Artificial Sequence
  chemically synthesized
aatgaaagcaaaaattttct

SEQ ID NO: 158939 - DNA, 20 bp, Artificial Sequence
  chemically synthesized
gaaagcaaaaattttctcag

SEQ ID NO: 158940 - DNA, 20 bp, Artificial Sequence
  chemically synthesized
gatcttaattaaaagccact

SEQ ID NO: 158941 - DNA, 20 bp, Artificial Sequence
  chemically synthesized
tttctcagtggcttttaatt

SEQ ID NO: 158942 - DNA, 20 bp, Artificial Sequence
  chemically synthesized
gagagagagatcttaattaa

SEQ ID NO: 158943 - DNA, 20 bp, Artificial Sequence
  chemically synthesized
ctttgtaaaagagagagaga

SEQ ID NO: 158944 - DNA, 20 bp, Artificial Sequence
  chemically synthesized
gcctttgtaaaagagagaga

SEQ ID NO: 158945 - DNA, 20 bp, Artificial Sequence
  chemically synthesized
gtgcctttgtaaaagagaga

SEQ ID NO: 158946 - DNA, 20 bp, Artificial Sequence
  chemically synthesized
ttgtgcctttgtaaaagaga

SEQ ID NO: 158947 - DNA, 20 bp, Artificial Sequence
  chemically synthesized
ttttgtgcctttgtaaaaga

SEQ ID NO: 158948 - DNA, 20 bp, Artificial Sequence
  chemically synthesized
ctctctctctctcttttaca

SEQ ID NO: 158949 - DNA, 20 bp, Artificial Sequence
  chemically synthesized
acttttgtgcctttgtaaaa

SEQ ID NO: 158950 - DNA, 20 bp, Artificial Sequence
  chemically synthesized
tctctctctctcttttacaa

SEQ ID NO: 158951 - DNA, 20 bp, Artificial Sequence
  chemically synthesized
ttacttttgtgcctttgtaa

SEQ ID NO: 158952 - DNA, 20 bp, Artificial Sequence
  chemically synthesized
tctcttttacaaaggcacaa

SEQ ID NO: 158953 - DNA, 20 bp, Artificial Sequence
  chemically synthesized
ttacaaaggcacaaaagtaa

SEQ ID NO: 158954 - DNA, 20 bp, Artificial Sequence
  chemically synthesized
tcacaaaggtacatgtaatt

SEQ ID NO: 158955 - DNA, 20 bp, Artificial Sequence
  chemically synthesized
ctaattgttagagatcacaa

SEQ ID NO: 158956 - DNA, 20 bp, Artificial Sequence
  chemically synthesized
actaattgttagagatcaca

SEQ ID NO: 158957 - DNA, 20 bp, Artificial Sequence
  chemically synthesized
cctttgtgatctctaacaat

SEQ ID NO: 158958 - DNA, 20 bp, Artificial Sequence
  chemically synthesized
aggtttgtcactaattgtta

SEQ ID NO: 158959 - DNA, 20 bp, Artificial Sequence
  chemically synthesized
taaggtttgtcactaattgt

SEQ ID NO: 158960 - DNA, 20 bp, Artificial Sequence
  chemically synthesized
tagtgacaaaccttaattca

SEQ ID NO: 158961 - DNA, 20 bp, Artificial Sequence
  chemically synthesized
tggtgtatgactatgaatta

SEQ ID NO: 158962 - DNA, 20 bp, Artificial Sequence
  chemically synthesized
atggtgtatgactatgaatt

SEQ ID NO: 158963 - DNA, 20 bp, Artificial Sequence
  chemically synthesized
aattcatagtcatacaccat

SEQ ID NO: 158964 - DNA, 20 bp, Artificial Sequence
  chemically synthesized
attcatagtcatacaccata

SEQ ID NO: 158965 - DNA, 20 bp, Artificial Sequence
  chemically synthesized
ctcaaagactttatgcctta

SEQ ID NO: 158966 - DNA, 20 bp, Artificial Sequence
  chemically synthesized
gtcatacaccataaggcata

SEQ ID NO: 158967 - DNA, 20 bp, Artificial Sequence
  chemically synthesized
ccataaggcataaagtcttt

SEQ ID NO: 158968 - DNA, 20 bp, Artificial Sequence
  chemically synthesized
cataaggcataaagtctttg

SEQ ID NO: 158969 - DNA, 20 bp, Artificial Sequence
  chemically synthesized
ctactctttgttgatcctca

SEQ ID NO: 158970 - DNA, 20 bp, Artificial Sequence
  chemically synthesized
aaagtctttgaggatcaaca

SEQ ID NO: 158971 - DNA, 20 bp, Artificial Sequence
  chemically synthesized
agtctttgaggatcaacaaa

SEQ ID NO: 158972 - DNA, 20 bp, Artificial Sequence
  chemically synthesized
ctttgaggatcaacaaagag

SEQ ID NO: 158973 - DNA, 20 bp, Artificial Sequence
  chemically synthesized
gaggatcaacaaagagtaga

SEQ ID NO: 158974 - DNA, 20 bp, Artificial Sequence
  chemically synthesized
caagccatgcagtgcacaaa

SEQ ID NO: 158975 - DNA, 20 bp, Artificial Sequence
  chemically synthesized
ttgtccatttgtgcactgca

SEQ ID NO: 158976 - DNA, 20 bp, Artificial Sequence
  chemically synthesized
tttcattgtagcaagccatg

SEQ ID NO: 158977 - DNA, 20 bp, Artificial Sequence
  chemically synthesized
atggtgactttcattgtagc

SEQ ID NO: 158978 - DNA, 20 bp, Artificial Sequence
  chemically synthesized
tgcatggcttgctacaatga

SEQ ID NO: 158979 - DNA, 20 bp, Artificial Sequence
  chemically synthesized
taatatggtgactttcattg

SEQ ID NO: 158980 - DNA, 20 bp, Artificial Sequence
  chemically synthesized
agccctcagagcagttaata

SEQ ID NO: 158981 - DNA, 20 bp, Artificial Sequence
  chemically synthesized
gtcaccatattaactgctct

SEQ ID NO: 158982 - DNA, 20 bp, Artificial Sequence
  chemically synthesized
tcaccatattaactgctctg

SEQ ID NO: 158983 - DNA, 20 bp, Artificial Sequence
  chemically synthesized
caccatattaactgctctga

SEQ ID NO: 158984 - DNA, 20 bp, Artificial Sequence
  chemically synthesized
aagaaagccagccctcagag

SEQ ID NO: 158985 - DNA, 20 bp, Artificial Sequence
  chemically synthesized
atattaactgctctgagggc

SEQ ID NO: 158986 - DNA, 20 bp, Artificial Sequence
  chemically synthesized
ctgaagaaagccagccctca

SEQ ID NO: 158987 - DNA, 20 bp, Artificial Sequence
  chemically synthesized
ttctgaagaaagccagccct

SEQ ID NO: 158988 - DNA, 20 bp, Artificial Sequence
  chemically synthesized
gttgatgttctgaagaaagc

SEQ ID NO: 158989 - DNA, 20 bp, Artificial Sequence
  chemically synthesized
ctctgagggctggctttctt

SEQ ID NO: 158990 - DNA, 20 bp, Artificial Sequence
  chemically synthesized
ttccgttgatgttctgaaga

SEQ ID NO: 158991 - DNA, 20 bp, Artificial Sequence
  chemically synthesized
gagtttccgttgatgttctg

SEQ ID NO: 158992 - DNA, 20 bp, Artificial Sequence
  chemically synthesized
ggctttcttcagaacatcaa

SEQ ID NO: 158993 - DNA, 20 bp, Artificial Sequence
  chemically synthesized
cctgaaagcagcaaatttca

SEQ ID NO: 158994 - DNA, 20 bp, Artificial Sequence
  chemically synthesized
gtcctgaaagcagcaaattt

SEQ ID NO: 158995 - DNA, 20 bp, Artificial Sequence
  chemically synthesized
actctgaaatttgctgcttt

SEQ ID NO: 158996 - DNA, 20 bp, Artificial Sequence
  chemically synthesized
ctctgaaatttgctgctttc

SEQ ID NO: 158997 - DNA, 20 bp, Artificial Sequence
  chemically synthesized
gctaggcaaagtcctgaaag

SEQ ID NO: 158998 - DNA, 20 bp, Artificial Sequence
  chemically synthesized
agagctaggcaaagtcctga

SEQ ID NO: 158999 - DNA, 20 bp, Artificial Sequence
  chemically synthesized
gctgctttcaggactttgcc

SEQ ID NO: 159000 - DNA, 20 bp, Artificial Sequence
  chemically synthesized
ttagttggaagagctaggca

SEQ ID NO: 159001 - DNA, 20 bp, Artificial Sequence
  chemically synthesized
agtatttagttggaagagct

SEQ ID NO: 159002 - DNA, 20 bp, Artificial Sequence
  chemically synthesized
cagtatttagttggaagagc

SEQ ID NO: 159003 - DNA, 20 bp, Artificial Sequence
  chemically synthesized
tgctcagtatttagttggaa

SEQ ID NO: 159004 - DNA, 20 bp, Artificial Sequence
  chemically synthesized
tgtgctcagtatttagttgg

SEQ ID NO: 159005 - DNA, 20 bp, Artificial Sequence
  chemically synthesized
caatgtgctcagtatttagt

SEQ ID NO: 159006 - DNA, 20 bp, Artificial Sequence
  chemically synthesized
agctcttccaactaaatact

SEQ ID NO: 159007 - DNA, 20 bp, Artificial Sequence
  chemically synthesized
ctaacaatgtgctcagtatt

SEQ ID NO: 159008 - DNA, 20 bp, Artificial Sequence
  chemically synthesized
tcataagctaacaatgtgct

SEQ ID NO: 159009 - DNA, 20 bp, Artificial Sequence
  chemically synthesized
ctaaatactgagcacattgt

SEQ ID NO: 159010 - DNA, 20 bp, Artificial Sequence
  chemically synthesized
ccagtataatcatttttcat

SEQ ID NO: 159011 - DNA, 20 bp, Artificial Sequence
  chemically synthesized
cttatgaaaaatgattatac

SEQ ID NO: 159012 - DNA, 20 bp, Artificial Sequence
  chemically synthesized
ttatgaaaaatgattatact

SEQ ID NO: 159013 - DNA, 20 bp, Artificial Sequence
  chemically synthesized
gtttgtatccagttcaagcc

SEQ ID NO: 159014 - DNA, 20 bp, Artificial Sequence
  chemically synthesized
tgattatactgggcttgaac

SEQ ID NO: 159015 - DNA, 20 bp, Artificial Sequence
  chemically synthesized
aagtagtttgtatccagttc

SEQ ID NO: 159016 - DNA, 20 bp, Artificial Sequence
  chemically synthesized
ctagaaaagtagtttgtatc

SEQ ID NO: 159017 - DNA, 20 bp, Artificial Sequence
  chemically synthesized
ctggatacaaactacttttc

SEQ ID NO: 159018 - DNA, 20 bp, Artificial Sequence
  chemically synthesized
actccaaaaatctagaaaag

SEQ ID NO: 159019 - DNA, 20 bp, Artificial Sequence
  chemically synthesized
accactccaaaaatctagaa

SEQ ID NO: 159020 - DNA, 20 bp, Artificial Sequence
  chemically synthesized
aaactacttttctagatttt

SEQ ID NO: 159021 - DNA, 20 bp, Artificial Sequence
  chemically synthesized
ttgcaaccactccaaaaatc

SEQ ID NO: 159022 - DNA, 20 bp, Artificial Sequence
  chemically synthesized
actacttttctagatttttg

SEQ ID NO: 159023 - DNA, 20 bp, Artificial Sequence
  chemically synthesized
acttttctagatttttggag

SEQ ID NO: 159024 - DNA, 20 bp, Artificial Sequence
  chemically synthesized
tgcaatatatttctgaataa

SEQ ID NO: 159025 - DNA, 20 bp, Artificial Sequence
  chemically synthesized
gatatcaacatacttttatt

SEQ ID NO: 159026 - DNA, 20 bp, Artificial Sequence
  chemically synthesized
taaaagtatgttgatatcta

SEQ ID NO: 159027 - DNA, 20 bp, Artificial Sequence
  chemically synthesized
aaagtatgttgatatctaca

SEQ ID NO: 159028 - DNA, 20 bp, Artificial Sequence
  chemically synthesized
gaaaatcacaggtttctctg

SEQ ID NO: 159029 - DNA, 20 bp, Artificial Sequence
  chemically synthesized
caccagacactgaaaatcac

SEQ ID NO: 159030 - DNA, 20 bp, Artificial Sequence
  chemically synthesized
acagagaaacctgtgatttt

SEQ ID NO: 159031 - DNA, 20 bp, Artificial Sequence
  chemically synthesized
acaccagacactgaaaatca

SEQ ID NO: 159032 - DNA, 20 bp, Artificial Sequence
  chemically synthesized
aacctgtgattttcagtgtc

SEQ ID NO: 159033 - DNA, 20 bp, Artificial Sequence
  chemically synthesized
gattttcagtgtctggtgtt

SEQ ID NO: 159034 - DNA, 20 bp, Artificial Sequence
  chemically synthesized
tgagcttaatgtccaaacac

SEQ ID NO: 159035 - DNA, 20 bp, Artificial Sequence
  chemically synthesized
gtgtctggtgtttggacatt

SEQ ID NO: 159036 - DNA, 20 bp, Artificial Sequence
  chemically synthesized
tggtgtttggacattaagct

SEQ ID NO: 159037 - DNA, 20 bp, Artificial Sequence
  chemically synthesized
ggtgtttggacattaagctc

SEQ ID NO: 159038 - DNA, 20 bp, Artificial Sequence
  chemically synthesized
tagagttgaagtttgcacct

SEQ ID NO: 159039 - DNA, 20 bp, Artificial Sequence
  chemically synthesized
cttttccttaggtagagttg

SEQ ID NO: 159040 - DNA, 20 bp, Artificial Sequence
  chemically synthesized
tgcaaacttcaactctacct

SEQ ID NO: 159041 - DNA, 20 bp, Artificial Sequence
  chemically synthesized
gcaaacttcaactctaccta

SEQ ID NO: 159042 - DNA, 20 bp, Artificial Sequence
  chemically synthesized
aagagacttttccttaggta

SEQ ID NO: 159043 - DNA, 20 bp, Artificial Sequence
  chemically synthesized
acaagagacttttccttagg

SEQ ID NO: 159044 - DNA, 20 bp, Artificial Sequence
  chemically synthesized
cttcaactctacctaaggaa

SEQ ID NO: 159045 - DNA, 20 bp, Artificial Sequence
  chemically synthesized
cttacaagagacttttcctt

SEQ ID NO: 159046 - DNA, 20 bp, Artificial Sequence
  chemically synthesized
gcttacaagagacttttcct

SEQ ID NO: 159047 - DNA, 20 bp, Artificial Sequence
  chemically synthesized
cctaaggaaaagtctcttgt

SEQ ID NO: 159048 - DNA, 20 bp, Artificial Sequence
  chemically synthesized
gttttccttacagcttacaa

SEQ ID NO: 159049 - DNA, 20 bp, Artificial Sequence
  chemically synthesized
ttgttttccttacagcttac

SEQ ID NO: 159050 - DNA, 20 bp, Artificial Sequence
  chemically synthesized
aaaagtctcttgtaagctgt

SEQ ID NO: 159051 - DNA, 20 bp, Artificial Sequence
  chemically synthesized
aaagtctcttgtaagctgta

SEQ ID NO: 159052 - DNA, 20 bp, Artificial Sequence
  chemically synthesized
aagattgtttgttttcctta

SEQ ID NO: 159053 - DNA, 20 bp, Artificial Sequence
  chemically synthesized
aaggaaaacaaacaatcttc

SEQ ID NO: 159054 - DNA, 20 bp, Artificial Sequence
  chemically synthesized
ggcccaagcttcatttctag

SEQ ID NO: 159055 - DNA, 20 bp, Artificial Sequence
  chemically synthesized
caaacaatcttctagaaatg

SEQ ID NO: 159056 - DNA, 20 bp, Artificial Sequence
  chemically synthesized
cttggcccaagcttcatttc

SEQ ID NO: 159057 - DNA, 20 bp, Artificial Sequence
  chemically synthesized
aatcttctagaaatgaagct

SEQ ID NO: 159058 - DNA, 20 bp, Artificial Sequence
  chemically synthesized
atcttctagaaatgaagctt

SEQ ID NO: 159059 - DNA, 20 bp, Artificial Sequence
  chemically synthesized
ctagaaatgaagcttgggcc

SEQ ID NO: 159060 - DNA, 20 bp, Artificial Sequence
  chemically synthesized
gtttcccttgcgcttggccc

SEQ ID NO: 159061 - DNA, 20 bp, Artificial Sequence
  chemically synthesized
atgaagcttgggccaagcgc

SEQ ID NO: 159062 - DNA, 20 bp, Artificial Sequence
  chemically synthesized
tgaagcttgggccaagcgca

SEQ ID NO: 159063 - DNA, 20 bp, Artificial Sequence
  chemically synthesized
gaagcttgggccaagcgcaa

SEQ ID NO: 159064 - DNA, 20 bp, Artificial Sequence
  chemically synthesized
tgcttagtttcccttgcgct

SEQ ID NO: 159065 - DNA, 20 bp, Artificial Sequence
  chemically synthesized
ggccaagcgcaagggaaact

SEQ ID NO: 159066 - DNA, 20 bp, Artificial Sequence
  chemically synthesized
caagcgcaagggaaactaag

SEQ ID NO: 159067 - DNA, 20 bp, Artificial Sequence
  chemically synthesized
ctgtctctaaggtcgctgct

SEQ ID NO: 159068 - DNA, 20 bp, Artificial Sequence
  chemically synthesized
gggaaactaagcagcgacct

SEQ ID NO: 159069 - DNA, 20 bp, Artificial Sequence
  chemically synthesized
gaaactaagcagcgacctta

SEQ ID NO: 159070 - DNA, 20 bp, Artificial Sequence
  chemically synthesized
ctaagcagcgaccttagaga

SEQ ID NO: 159071 - DNA, 20 bp, Artificial Sequence
  chemically synthesized
tgacttagattctgtctcta

SEQ ID NO: 159072 - DNA, 20 bp, Artificial Sequence
  chemically synthesized
atgacttagattctgtctct

SEQ ID NO: 159073 - DNA, 20 bp, Artificial Sequence
  chemically synthesized
cgaccttagagacagaatct

SEQ ID NO: 159074 - DNA, 20 bp, Artificial Sequence
  chemically synthesized
tagagacagaatctaagtca

SEQ ID NO: 159075 - DNA, 20 bp, Artificial Sequence
  chemically synthesized
caaacaacattaccatgact

SEQ ID NO: 159076 - DNA, 20 bp, Artificial Sequence
  chemically synthesized
gtcatggtaatgttgtttgc

SEQ ID NO: 159077 - DNA, 20 bp, Artificial Sequence
  chemically synthesized
tcatggtaatgttgtttgca

SEQ ID NO: 159078 - DNA, 20 bp, Artificial Sequence
  chemically synthesized
tgttgtttgcaaggacaaac

SEQ ID NO: 159079 - DNA, 20 bp, Artificial Sequence
  chemically synthesized
ataacctcattatacagaac

SEQ ID NO: 159080 - DNA, 20 bp, Artificial Sequence
  chemically synthesized
acaaactggttctgtataat

SEQ ID NO: 159081 - DNA, 20 bp, Artificial Sequence
  chemically synthesized
caaactggttctgtataatg

SEQ ID NO: 159082 - DNA, 20 bp, Artificial Sequence
  chemically synthesized
aggtcaataacctcattata

SEQ ID NO: 159083 - DNA, 20 bp, Artificial Sequence
  chemically synthesized
aaactgcttgaaaacagttc

SEQ ID NO: 159084 - DNA, 20 bp, Artificial Sequence
  chemically synthesized
aaaactgcttgaaaacagtt

SEQ ID NO: 159085 - DNA, 20 bp, Artificial Sequence
  chemically synthesized
tattgacctgaactgttttc

SEQ ID NO: 159086 - DNA, 20 bp, Artificial Sequence
  chemically synthesized
tgtttaaaactgcttgaaaa

SEQ ID NO: 159087 - DNA, 20 bp, Artificial Sequence
  chemically synthesized
tgacctgaactgttttcaag

SEQ ID NO: 159088 - DNA, 20 bp, Artificial Sequence
  chemically synthesized
tttcaagcagttttaaacat

SEQ ID NO: 159089 - DNA, 20 bp, Artificial Sequence
  chemically synthesized
ttcaagcagttttaaacatg

SEQ ID NO: 159090 - DNA, 20 bp, Artificial Sequence
  chemically synthesized
gcagttttaaacatgaggac

SEQ ID NO: 159091 - DNA, 20 bp, Artificial Sequence
  chemically synthesized
cagttttaaacatgaggacg

SEQ ID NO: 159092 - DNA, 20 bp, Artificial Sequence
  chemically synthesized
ggacgaggttcattgtatcc

SEQ ID NO: 159093 - DNA, 20 bp, Artificial Sequence
  chemically synthesized
ctcagttaatgttgcaggct

SEQ ID NO: 159094 - DNA, 20 bp, Artificial Sequence
  chemically synthesized
ggtttctcagttaatgttgc

SEQ ID NO: 159095 - DNA, 20 bp, Artificial Sequence
  chemically synthesized
tggtttctcagttaatgttg

SEQ ID NO: 159096 - DNA, 20 bp, Artificial Sequence
  chemically synthesized
ccaagcctgcaacattaact

SEQ ID NO: 159097 - DNA, 20 bp, Artificial Sequence
  chemically synthesized
gcaacattaactgagaaacc

SEQ ID NO: 159098 - DNA, 20 bp, Artificial Sequence
  chemically synthesized
attgatcagtcttggtttct

SEQ ID NO: 159099 - DNA, 20 bp, Artificial Sequence
  chemically synthesized
ggctgtttattgatcagtct

SEQ ID NO: 159100 - DNA, 20 bp, Artificial Sequence
  chemically synthesized
aatcatggctgtttattgat

SEQ ID NO: 159101 - DNA, 20 bp, Artificial Sequence
  chemically synthesized
aaccaagactgatcaataaa

SEQ ID NO: 159102 - DNA, 20 bp, Artificial Sequence
  chemically synthesized
tcaataaacagccatgatta

SEQ ID NO: 159103 - DNA, 20 bp, Artificial Sequence
  chemically synthesized
caataaacagccatgattac

SEQ ID NO: 159104 - DNA, 20 bp, Artificial Sequence
  chemically synthesized
ttcctgagatcctgtaatca

SEQ ID NO: 159105 - DNA, 20 bp, Artificial Sequence
  chemically synthesized
cagccatgattacaggatct

SEQ ID NO: 159106 - DNA, 20 bp, Artificial Sequence
  chemically synthesized
agccatgattacaggatctc

SEQ ID NO: 159107 - DNA, 20 bp, Artificial Sequence
  chemically synthesized
ccattatgatgaaggttcct

SEQ ID NO: 159108 - DNA, 20 bp, Artificial Sequence
  chemically synthesized
aatggctcccattatgatga

SEQ ID NO: 159109 - DNA, 20 bp, Artificial Sequence
  chemically synthesized
taatggctcccattatgatg

SEQ ID NO: 159110 - DNA, 20 bp, Artificial Sequence
  chemically synthesized
ctcaggaaccttcatcataa

SEQ ID NO: 159111 - DNA, 20 bp, Artificial Sequence
  chemically synthesized
tcaggaaccttcatcataat

SEQ ID NO: 159112 - DNA, 20 bp, Artificial Sequence
  chemically synthesized
aggaaccttcatcataatgg

SEQ ID NO: 159113 - DNA, 20 bp, Artificial Sequence
  chemically synthesized
gtacctgaccagaattataa

SEQ ID NO: 159114 - DNA, 20 bp, Artificial Sequence
  chemically synthesized
aatgggagccattataattc

SEQ ID NO: 159115 - DNA, 20 bp, Artificial Sequence
  chemically synthesized
ggagccattataattctggt

SEQ ID NO: 159116 - DNA, 20 bp, Artificial Sequence
  chemically synthesized
gagccattataattctggtc

SEQ ID NO: 159117 - DNA, 20 bp, Artificial Sequence
  chemically synthesized
cctgattctctgtacctgac

SEQ ID NO: 159118 - DNA, 20 bp, Artificial Sequence
  chemically synthesized
attataattctggtcaggta

SEQ ID NO: 159119 - DNA, 20 bp, Artificial Sequence
  chemically synthesized
tataattctggtcaggtaca

SEQ ID NO: 159120 - DNA, 20 bp, Artificial Sequence
  chemically synthesized
tctggtcaggtacagagaat

SEQ ID NO: 159121 - DNA, 20 bp, Artificial Sequence
  chemically synthesized
ctggtcaggtacagagaatc

SEQ ID NO: 159122 - DNA, 20 bp, Artificial Sequence
  chemically synthesized
gctaaatatacgttagcagt

SEQ ID NO: 159123 - DNA, 20 bp, Artificial Sequence
  chemically synthesized
tgctaaatatacgttagcag

SEQ ID NO: 159124 - DNA, 20 bp, Artificial Sequence
  chemically synthesized
cagtgctaaatatacgttag

SEQ ID NO: 159125 - DNA, 20 bp, Artificial Sequence
  chemically synthesized
gtccagtgctaaatatacgt

SEQ ID NO: 159126 - DNA, 20 bp, Artificial Sequence
  chemically synthesized
acctactgctaacgtatatt

SEQ ID NO: 159127 - DNA, 20 bp, Artificial Sequence
  chemically synthesized
tgctaacgtatatttagcac

SEQ ID NO: 159128 - DNA, 20 bp, Artificial Sequence
  chemically synthesized
tccatttgcaaatgagagtc

SEQ ID NO: 159129 - DNA, 20 bp, Artificial Sequence
  chemically synthesized
tggcttccatttgcaaatga

SEQ ID NO: 159130 - DNA, 20 bp, Artificial Sequence
  chemically synthesized
aatggcttccatttgcaaat

SEQ ID NO: 159131 - DNA, 20 bp, Artificial Sequence
  chemically synthesized
actggactctcatttgcaaa

SEQ ID NO: 159132 - DNA, 20 bp, Artificial Sequence
  chemically synthesized
ggactctcatttgcaaatgg

SEQ ID NO: 159133 - DNA, 20 bp, Artificial Sequence
  chemically synthesized
tgcaaatggaagccattgat

SEQ ID NO: 159134 - DNA, 20 bp, Artificial Sequence
  chemically synthesized
ttcaaaaaatagctaatcaa

SEQ ID NO: 159135 - DNA, 20 bp, Artificial Sequence
  chemically synthesized
ccaggtcagttttcaaaaaa

SEQ ID NO: 159136 - DNA, 20 bp, Artificial Sequence
  chemically synthesized
ctattttttgaaaactgacc

SEQ ID NO: 159137 - DNA, 20 bp, Artificial Sequence
  chemically synthesized
agggagatggaaagccaggt

SEQ ID NO: 159138 - DNA, 20 bp, Artificial Sequence
  chemically synthesized
aaggagggagatggaaagcc

SEQ ID NO: 159139 - DNA, 20 bp, Artificial Sequence
  chemically synthesized
taaggagggagatggaaagc

SEQ ID NO: 159140 - DNA, 20 bp, Artificial Sequence
  chemically synthesized
tacataaggagggagatgga

SEQ ID NO: 159141 - DNA, 20 bp, Artificial Sequence
  chemically synthesized
ctattacataaggagggaga

SEQ ID NO: 159142 - DNA, 20 bp, Artificial Sequence
  chemically synthesized
caggctattacataaggagg

SEQ ID NO: 159143 - DNA, 20 bp, Artificial Sequence
  chemically synthesized
cacaggctattacataagga

SEQ ID NO: 159144 - DNA, 20 bp, Artificial Sequence
  chemically synthesized
tcacaggctattacataagg

SEQ ID NO: 159145 - DNA, 20 bp, Artificial Sequence
  chemically synthesized
ttcacaggctattacataag

SEQ ID NO: 159146 - DNA, 20 bp, Artificial Sequence
  chemically synthesized
ccatctccctccttatgtaa

SEQ ID NO: 159147 - DNA, 20 bp, Artificial Sequence
  chemically synthesized
tattcacaggctattacata

SEQ ID NO: 159148 - DNA, 20 bp, Artificial Sequence
  chemically synthesized
ttattcacaggctattacat

SEQ ID NO: 159149 - DNA, 20 bp, Artificial Sequence
  chemically synthesized
tctaggtcacatttattcac

SEQ ID NO: 159150 - DNA, 20 bp, Artificial Sequence
  chemically synthesized
gtctaggtcacatttattca

SEQ ID NO: 159151 - DNA, 20 bp, Artificial Sequence
  chemically synthesized
gcctgtgaataaatgtgacc

SEQ ID NO: 159152 - DNA, 20 bp, Artificial Sequence
  chemically synthesized
ccatatccatgttgaagtct

SEQ ID NO: 159153 - DNA, 20 bp, Artificial Sequence
  chemically synthesized
tccatatccatgttgaagtc

SEQ ID NO: 159154 - DNA, 20 bp, Artificial Sequence
  chemically synthesized
atgtgacctagacttcaaca

SEQ ID NO: 159155 - DNA, 20 bp, Artificial Sequence
  chemically synthesized
tcttctccatatccatgttg

SEQ ID NO: 159156 - DNA, 20 bp, Artificial Sequence
  chemically synthesized
cctagacttcaacatggata

SEQ ID NO: 159157 - DNA, 20 bp, Artificial Sequence
  chemically synthesized
tagacttcaacatggatatg

SEQ ID NO: 159158 - DNA, 20 bp, Artificial Sequence
  chemically synthesized
acttcaacatggatatggag

SEQ ID NO: 159159 - DNA, 20 bp, Artificial Sequence
  chemically synthesized
tggatatggagaagaaaaaa

SEQ ID NO: 159160 - DNA, 20 bp, Artificial Sequence
  chemically synthesized
atatggagaagaaaaaaaag

SEQ ID NO: 159161 - DNA, 20 bp, Artificial Sequence
  chemically synthesized
ggagaagaaaaaaaagtaga

SEQ ID NO: 159162 - DNA, 20 bp, Artificial Sequence
  chemically synthesized
gagaagaaaaaaaagtagaa

SEQ ID NO: 159163 - DNA, 20 bp, Artificial Sequence
  chemically synthesized
aaaagtagaaaggtttatcc

SEQ ID NO: 159164 - DNA, 20 bp, Artificial Sequence
  chemically synthesized
aaagtagaaaggtttatccc

SEQ ID NO: 159165 - DNA, 20 bp, Artificial Sequence
  chemically synthesized
tagaaaggtttatcccaggc

SEQ ID NO: 159166 - DNA, 20 bp, Artificial Sequence
  chemically synthesized
ctttggcaaaaagctggcct

SEQ ID NO: 159167 - DNA, 20 bp, Artificial Sequence
  chemically synthesized
tctttggcaaaaagctggcc

SEQ ID NO: 159168 - DNA, 20 bp, Artificial Sequence
  chemically synthesized
ttatttctttggcaaaaagc

SEQ ID NO: 159169 - DNA, 20 bp, Artificial Sequence
  chemically synthesized
cccaggccagctttttgcca

SEQ ID NO: 159170 - DNA, 20 bp, Artificial Sequence
  chemically synthesized
ttgcttatttctttggcaaa

SEQ ID NO: 159171 - DNA, 20 bp, Artificial Sequence
  chemically synthesized
cagctttttgccaaagaaat

SEQ ID NO: 159172 - DNA, 20 bp, Artificial Sequence
  chemically synthesized
catgtaattgcttatttctt

SEQ ID NO: 159173 - DNA, 20 bp, Artificial Sequence
  chemically synthesized
tttattgggtcaagaatttt

SEQ ID NO: 159174 - DNA, 20 bp, Artificial Sequence
  chemically synthesized
cttcagtattttattgggtc

SEQ ID NO: 159175 - DNA, 20 bp, Artificial Sequence
  chemically synthesized
tgaggcttcagtattttatt

SEQ ID NO: 159176 - DNA, 20 bp, Artificial Sequence
  chemically synthesized
ttgaggcttcagtattttat

SEQ ID NO: 159177 - DNA, 20 bp, Artificial Sequence
  chemically synthesized
cttgacccaataaaatactg

SEQ ID NO: 159178 - DNA, 20 bp, Artificial Sequence
  chemically synthesized
taaaatcggcattgaggctt

SEQ ID NO: 159179 - DNA, 20 bp, Artificial Sequence
  chemically synthesized
aaagagtaaaatcggcattg

SEQ ID NO: 159180 - DNA, 20 bp, Artificial Sequence
  chemically synthesized
aaaagagtaaaatcggcatt

SEQ ID NO: 159181 - DNA, 20 bp, Artificial Sequence
  chemically synthesized
ttcttataaaagagtaaaat

SEQ ID NO: 159182 - DNA, 20 bp, Artificial Sequence
  chemically synthesized
tgccgattttactcttttat

SEQ ID NO: 159183 - DNA, 20 bp, Artificial Sequence
  chemically synthesized
tgttgctctttcttataaaa

SEQ ID NO: 159184 - DNA, 20 bp, Artificial Sequence
  chemically synthesized
tttgttgctctttcttataa

SEQ ID NO: 159185 - DNA, 20 bp, Artificial Sequence
  chemically synthesized
gattttactcttttataaga

SEQ ID NO: 159186 - DNA, 20 bp, Artificial Sequence
  chemically synthesized
ttttactcttttataagaaa

SEQ ID NO: 159187 - DNA, 20 bp, Artificial Sequence
  chemically synthesized
ttttataagaaagagcaaca

SEQ ID NO: 159188 - DNA, 20 bp, Artificial Sequence
  chemically synthesized
taagaaagagcaacaaagaa

SEQ ID NO: 159189 - DNA, 20 bp, Artificial Sequence
  chemically synthesized
aaagagcaacaaagaaaaga

SEQ ID NO: 159190 - DNA, 20 bp, Artificial Sequence
  chemically synthesized
aagagcaacaaagaaaagaa

SEQ ID NO: 159191 - DNA, 20 bp, Artificial Sequence
  chemically synthesized
aacaaagaaaagaaaggtca

SEQ ID NO: 159192 - DNA, 20 bp, Artificial Sequence
  chemically synthesized
agctgtaaagaatcacaata

SEQ ID NO: 159193 - DNA, 20 bp, Artificial Sequence
  chemically synthesized
gaccatattgtgattcttta

SEQ ID NO: 159194 - DNA, 20 bp, Artificial Sequence
  chemically synthesized
gtctgtctccaacagctgta

SEQ ID NO: 159195 - DNA, 20 bp, Artificial Sequence
  chemically synthesized
ttgtgattctttacagctgt

SEQ ID NO: 159196 - DNA, 20 bp, Artificial Sequence
  chemically synthesized
gtgattctttacagctgttg

SEQ ID NO: 159197 - DNA, 20 bp, Artificial Sequence
  chemically synthesized
ttctttacagctgttggaga

SEQ ID NO: 159198 - DNA, 20 bp, Artificial Sequence
  chemically synthesized
atcatagtgtctgtctccaa

SEQ ID NO: 159199 - DNA, 20 bp, Artificial Sequence
  chemically synthesized
tggagacagacactatgatg

SEQ ID NO: 159200 - DNA, 20 bp, Artificial Sequence
  chemically synthesized
caaatcaagctactgcatca

SEQ ID NO: 159201 - DNA, 20 bp, Artificial Sequence
  chemically synthesized
agacagacactatgatgcag

SEQ ID NO: 159202 - DNA, 20 bp, Artificial Sequence
  chemically synthesized
tgtttggtttaattcaaatc

SEQ ID NO: 159203 - DNA, 20 bp, Artificial Sequence
  chemically synthesized
ttgatgcttttcatattgtt

SEQ ID NO: 159204 - DNA, 20 bp, Artificial Sequence
  chemically synthesized
attaaaccaaacaatatgaa

SEQ ID NO: 159205 - DNA, 20 bp, Artificial Sequence
  chemically synthesized
caaacaatatgaaaagcatc

SEQ ID NO: 159206 - DNA, 20 bp, Artificial Sequence
  chemically synthesized
aaacaatatgaaaagcatca

SEQ ID NO: 159207 - DNA, 20 bp, Artificial Sequence
  chemically synthesized
aatatgaaaagcatcaaggc

SEQ ID NO: 159208 - DNA, 20 bp, Artificial Sequence
  chemically synthesized
tgaaaagcatcaaggctggc

SEQ ID NO: 159209 - DNA, 20 bp, Artificial Sequence
  chemically synthesized
agcatcaaggctggcaagca

SEQ ID NO: 159210 - DNA, 20 bp, Artificial Sequence
  chemically synthesized
ggctttattgctttgcttgc

SEQ ID NO: 159211 - DNA, 20 bp, Artificial Sequence
  chemically synthesized
ggctggcaagcaaagcaata

SEQ ID NO: 159212 - DNA, 20 bp, Artificial Sequence
  chemically synthesized
agcaaagcaataaagcccca

SEQ ID NO: 159213 - DNA, 20 bp, Artificial Sequence
  chemically synthesized
aaggtagattaaattctttg

SEQ ID NO: 159214 - DNA, 20 bp, Artificial Sequence
  chemically synthesized
caaggtagattaaattcttt

SEQ ID NO: 159215 - DNA, 20 bp, Artificial Sequence
  chemically synthesized
tcaaggtagattaaattctt

SEQ ID NO: 159216 - DNA, 20 bp, Artificial Sequence
  chemically synthesized
aaagaatttaatctaccttg

SEQ ID NO: 159217 - DNA, 20 bp, Artificial Sequence
  chemically synthesized
aagaatttaatctaccttga

SEQ ID NO: 159218 - DNA, 20 bp, Artificial Sequence
  chemically synthesized
aagtagtcccaccttcaagg

SEQ ID NO: 159219 - DNA, 20 bp, Artificial Sequence
  chemically synthesized
aatttaatctaccttgaagg

SEQ ID NO: 159220 - DNA, 20 bp, Artificial Sequence
  chemically synthesized
atttaatctaccttgaaggt

SEQ ID NO: 159221 - DNA, 20 bp, Artificial Sequence
  chemically synthesized
caaaagtagtcccaccttca

SEQ ID NO: 159222 - DNA, 20 bp, Artificial Sequence
  chemically synthesized
acaaaagtagtcccaccttc

SEQ ID NO: 159223 - DNA, 20 bp, Artificial Sequence
  chemically synthesized
tgctgccatcaatacaaaag

SEQ ID NO: 159224 - DNA, 20 bp, Artificial Sequence
  chemically synthesized
gtgtgctgccatcaatacaa

SEQ ID NO: 159225 - DNA, 20 bp, Artificial Sequence
  chemically synthesized
tgggactacttttgtattga

SEQ ID NO: 159226 - DNA, 20 bp, Artificial Sequence
  chemically synthesized
gactacttttgtattgatgg

SEQ ID NO: 159227 - DNA, 20 bp, Artificial Sequence
  chemically synthesized
ttgtattgatggcagcacac

SEQ ID NO: 159228 - DNA, 20 bp, Artificial Sequence
  chemically synthesized
tgtattgatggcagcacacc

SEQ ID NO: 159229 - DNA, 20 bp, Artificial Sequence
  chemically synthesized
ttgatggcagcacaccagga

SEQ ID NO: 159230 - DNA, 20 bp, Artificial Sequence
  chemically synthesized
taaaggactcatttctgtcc

SEQ ID NO: 159231 - DNA, 20 bp, Artificial Sequence
  chemically synthesized
cagcacaccaggacagaaat

SEQ ID NO: 159232 - DNA, 20 bp, Artificial Sequence
  chemically synthesized
ggacagaaatgagtccttta

SEQ ID NO: 159233 - DNA, 20 bp, Artificial Sequence
  chemically synthesized
ttaacgagtcattgctttaa

SEQ ID NO: 159234 - DNA, 20 bp, Artificial Sequence
  chemically synthesized
attaacgagtcattgcttta

SEQ ID NO: 159235 - DNA, 20 bp, Artificial Sequence
  chemically synthesized
ttaaagcaatgactcgttaa

SEQ ID NO: 159236 - DNA, 20 bp, Artificial Sequence
  chemically synthesized
gtgatcttaaggctattaac

SEQ ID NO: 159237 - DNA, 20 bp, Artificial Sequence
  chemically synthesized
aatgactcgttaatagcctt

SEQ ID NO: 159238 - DNA, 20 bp, Artificial Sequence
  chemically synthesized
atttatatattgtgatctta

SEQ ID NO: 159239 - DNA, 20 bp, Artificial Sequence
  chemically synthesized
tatttatatattgtgatctt

SEQ ID NO: 159240 - DNA, 20 bp, Artificial Sequence
  chemically synthesized
ttaagatcacaatatataaa

SEQ ID NO: 159241 - DNA, 20 bp, Artificial Sequence
  chemically synthesized
taagatcacaatatataaat

SEQ ID NO: 159242 - DNA, 20 bp, Artificial Sequence
  chemically synthesized
aataggatatgctgatcaaa

SEQ ID NO: 159243 - DNA, 20 bp, Artificial Sequence
  chemically synthesized
ggcaaagctgtctttttgat

SEQ ID NO: 159244 - DNA, 20 bp, Artificial Sequence
  chemically synthesized
ggatatgctgatcaaaaaga

SEQ ID NO: 159245 - DNA, 20 bp, Artificial Sequence
  chemically synthesized
atactgtaatagcagaggca

SEQ ID NO: 159246 - DNA, 20 bp, Artificial Sequence
  chemically synthesized
tggccatactgtaatagcag

SEQ ID NO: 159247 - DNA, 20 bp, Artificial Sequence
  chemically synthesized
ctggccatactgtaatagca

SEQ ID NO: 159248 - DNA, 20 bp, Artificial Sequence
  chemically synthesized
cagctttgcctctgctatta

SEQ ID NO: 159249 - DNA, 20 bp, Artificial Sequence
  chemically synthesized
tactggccatactgtaatag

SEQ ID NO: 159250 - DNA, 20 bp, Artificial Sequence
  chemically synthesized
aaatactggccatactgtaa

SEQ ID NO: 159251 - DNA, 20 bp, Artificial Sequence
  chemically synthesized
ttgcctctgctattacagta

SEQ ID NO: 159252 - DNA, 20 bp, Artificial Sequence
  chemically synthesized
ctctgctattacagtatggc

SEQ ID NO: 159253 - DNA, 20 bp, Artificial Sequence
  chemically synthesized
aataacttgtaaggaaatac

SEQ ID NO: 159254 - DNA, 20 bp, Artificial Sequence
  chemically synthesized
tatggccagtatttccttac

SEQ ID NO: 159255 - DNA, 20 bp, Artificial Sequence
  chemically synthesized
aatcagtgaaataacttgta

SEQ ID NO: 159256 - DNA, 20 bp, Artificial Sequence
  chemically synthesized
taatcagtgaaataacttgt

SEQ ID NO: 159257 - DNA, 20 bp, Artificial Sequence
  chemically synthesized
tgacgtggactatttataat

SEQ ID NO: 159258 - DNA, 20 bp, Artificial Sequence
  chemically synthesized
gttatttcactgattataaa

SEQ ID NO: 159259 - DNA, 20 bp, Artificial Sequence
  chemically synthesized
ttataaatagtccacgtcaa

SEQ ID NO: 159260 - DNA, 20 bp, Artificial Sequence
  chemically synthesized
ttgtacatttgccattgacg

SEQ ID NO: 159261 - DNA, 20 bp, Artificial Sequence
  chemically synthesized
cgtcaatggcaaatgtacaa

SEQ ID NO: 159262 - DNA, 20 bp, Artificial Sequence
  chemically synthesized
gtcaatggcaaatgtacaac

SEQ ID NO: 159263 - DNA, 20 bp, Artificial Sequence
  chemically synthesized
tcaatggcaaatgtacaaca

SEQ ID NO: 159264 - DNA, 20 bp, Artificial Sequence
  chemically synthesized
caatggcaaatgtacaacag

SEQ ID NO: 159265 - DNA, 20 bp, Artificial Sequence
  chemically synthesized
tggcaaatgtacaacagggg

SEQ ID NO: 159266 - DNA, 20 bp, Artificial Sequence
  chemically synthesized
ggggaagcataacccattat

SEQ ID NO: 159267 - DNA, 20 bp, Artificial Sequence
  chemically synthesized
gggaagcataacccattatg

SEQ ID NO: 159268 - DNA, 20 bp, Artificial Sequence
  chemically synthesized
aatatccattacctcataat

SEQ ID NO: 159269 - DNA, 20 bp, Artificial Sequence
  chemically synthesized
caatatccattacctcataa

SEQ ID NO: 159270 - DNA, 20 bp, Artificial Sequence
  chemically synthesized
cataacccattatgaggtaa

SEQ ID NO: 159271 - DNA, 20 bp, Artificial Sequence
  chemically synthesized
tatgaggtaatggatattgc

SEQ ID NO: 159272 - DNA, 20 bp, Artificial Sequence
  chemically synthesized
tgaggtaatggatattgcta

SEQ ID NO: 159273 - DNA, 20 bp, Artificial Sequence
  chemically synthesized
gaggtaatggatattgctag

SEQ ID NO: 159274 - DNA, 20 bp, Artificial Sequence
  chemically synthesized
gaaggtaatgaagcaacctc

SEQ ID NO: 159275 - DNA, 20 bp, Artificial Sequence
  chemically synthesized
ctcagccagtgaaggtaatg

SEQ ID NO: 159276 - DNA, 20 bp, Artificial Sequence
  chemically synthesized
ggttgcttcattaccttcac

SEQ ID NO: 159277 - DNA, 20 bp, Artificial Sequence
  chemically synthesized
accagccactcagccagtga

SEQ ID NO: 159278 - DNA, 20 bp, Artificial Sequence
  chemically synthesized
aaccagccactcagccagtg

SEQ ID NO: 159279 - DNA, 20 bp, Artificial Sequence
  chemically synthesized
cttcattaccttcactggct

SEQ ID NO: 159280 - DNA, 20 bp, Artificial Sequence
  chemically synthesized
cattaccttcactggctgag

SEQ ID NO: 159281 - DNA, 20 bp, Artificial Sequence
  chemically synthesized
ggaaaaaccagccactcagc

SEQ ID NO: 159282 - DNA, 20 bp, Artificial Sequence
  chemically synthesized
accttcactggctgagtggc

SEQ ID NO: 159283 - DNA, 20 bp, Artificial Sequence
  chemically synthesized
acaaggaaaaaccagccact

SEQ ID NO: 159284 - DNA, 20 bp, Artificial Sequence
  chemically synthesized
gcatttgtacaaggaaaaac

SEQ ID NO: 159285 - DNA, 20 bp, Artificial Sequence
  chemically synthesized
taaagggcagcatttgtaca

SEQ ID NO: 159286 - DNA, 20 bp, Artificial Sequence
  chemically synthesized
ctaaagggcagcatttgtac

SEQ ID NO: 159287 - DNA, 20 bp, Artificial Sequence
  chemically synthesized
cttgtacaaatgctgccctt

SEQ ID NO: 159288 - DNA, 20 bp, Artificial Sequence
  chemically synthesized
aagagattttgtctaaaggg

SEQ ID NO: 159289 - DNA, 20 bp, Artificial Sequence
  chemically synthesized
tggaagagattttgtctaaa

SEQ ID NO: 159290 - DNA, 20 bp, Artificial Sequence
  chemically synthesized
gtggaagagattttgtctaa

SEQ ID NO: 159291 - DNA, 20 bp, Artificial Sequence
  chemically synthesized
tgtggaagagattttgtcta

SEQ ID NO: 159292 - DNA, 20 bp, Artificial Sequence
  chemically synthesized
ctaaacaaccggatgtggaa

SEQ ID NO: 159293 - DNA, 20 bp, Artificial Sequence
  chemically synthesized
gacaaaatctcttccacatc

SEQ ID NO: 159294 - DNA, 20 bp, Artificial Sequence
  chemically synthesized
agctaaacaaccggatgtgg

SEQ ID NO: 159295 - DNA, 20 bp, Artificial Sequence
  chemically synthesized
tcaagctaaacaaccggatg

SEQ ID NO: 159296 - DNA, 20 bp, Artificial Sequence
  chemically synthesized
ctcttccacatccggttgtt

SEQ ID NO: 159297 - DNA, 20 bp, Artificial Sequence
  chemically synthesized
agcagttcaagctaaacaac

SEQ ID NO: 159298 - DNA, 20 bp, Artificial Sequence
  chemically synthesized
ggaaactgaaatagcagttc

SEQ ID NO: 159299 - DNA, 20 bp, Artificial Sequence
  chemically synthesized
tttagcttgaactgctattt

SEQ ID NO: 159300 - DNA, 20 bp, Artificial Sequence
  chemically synthesized
tccccaggaaactgaaatag

SEQ ID NO: 159301 - DNA, 20 bp, Artificial Sequence
  chemically synthesized
ttttccccaggaaactgaaa

SEQ ID NO: 159302 - DNA, 20 bp, Artificial Sequence
  chemically synthesized
gaactgctatttcagtttcc

SEQ ID NO: 159303 - DNA, 20 bp, Artificial Sequence
  chemically synthesized
aactgctatttcagtttcct

SEQ ID NO: 159304 - DNA, 20 bp, Artificial Sequence
  chemically synthesized
actgctatttcagtttcctg

SEQ ID NO: 159305 - DNA, 20 bp, Artificial Sequence
  chemically synthesized
tatttcagtttcctggggaa

SEQ ID NO: 159306 - DNA, 20 bp, Artificial Sequence
  chemically synthesized
ctatatgggttcttttcccc

SEQ ID NO: 159307 - DNA, 20 bp, Artificial Sequence
  chemically synthesized
actatatgggttcttttccc

SEQ ID NO: 159308 - DNA, 20 bp, Artificial Sequence
  chemically synthesized
cctggggaaaagaacccata

SEQ ID NO: 159309 - DNA, 20 bp, Artificial Sequence
  chemically synthesized
gaagttaatctgcactatat

SEQ ID NO: 159310 - DNA, 20 bp, Artificial Sequence
  chemically synthesized
ggaaaagaacccatatagtg

SEQ ID NO: 159311 - DNA, 20 bp, Artificial Sequence
  chemically synthesized
tgaagttaatctgcactata

SEQ ID NO: 159312 - DNA, 20 bp, Artificial Sequence
  chemically synthesized
tatagtgcagattaacttca

SEQ ID NO: 159313 - DNA, 20 bp, Artificial Sequence
  chemically synthesized
gtgcagattaacttcacagt

SEQ ID NO: 159314 - DNA, 20 bp, Artificial Sequence
  chemically synthesized
taattttattgctaactgtg

SEQ ID NO: 159315 - DNA, 20 bp, Artificial Sequence
  chemically synthesized
tccaagggtatatttaaatt

SEQ ID NO: 159316 - DNA, 20 bp, Artificial Sequence
  chemically synthesized
actaaatttaaatataccct

SEQ ID NO: 159317 - DNA, 20 bp, Artificial Sequence
  chemically synthesized
taaatttaaatatacccttg

SEQ ID NO: 159318 - DNA, 20 bp, Artificial Sequence
  chemically synthesized
aatacatgtggagtctccaa

SEQ ID NO: 159319 - DNA, 20 bp, Artificial Sequence
  chemically synthesized
caatacatgtggagtctcca

SEQ ID NO: 159320 - DNA, 20 bp, Artificial Sequence
  chemically synthesized
gcaatacatgtggagtctcc

SEQ ID NO: 159321 - DNA, 20 bp, Artificial Sequence
  chemically synthesized
attgatctgcaatacatgtg

SEQ ID NO: 159322 - DNA, 20 bp, Artificial Sequence
  chemically synthesized
aaattgatctgcaatacatg

SEQ ID NO: 159323 - DNA, 20 bp, Artificial Sequence
  chemically synthesized
tggagactccacatgtattg

SEQ ID NO: 159324 - DNA, 20 bp, Artificial Sequence
  chemically synthesized
attgcagatcaatttctgcc

SEQ ID NO: 159325 - DNA, 20 bp, Artificial Sequence
  chemically synthesized
ttgtgcccttatgtaccagg

SEQ ID NO: 159326 - DNA, 20 bp, Artificial Sequence
  chemically synthesized
tcaatttctgcctggtacat

SEQ ID NO: 159327 - DNA, 20 bp, Artificial Sequence
  chemically synthesized
tttttgtgcccttatgtacc

SEQ ID NO: 159328 - DNA, 20 bp, Artificial Sequence
  chemically synthesized
caatttctgcctggtacata

SEQ ID NO: 159329 - DNA, 20 bp, Artificial Sequence
  chemically synthesized
atttttgtgcccttatgtac

SEQ ID NO: 159330 - DNA, 20 bp, Artificial Sequence
  chemically synthesized
aatttctgcctggtacataa

SEQ ID NO: 159331 - DNA, 20 bp, Artificial Sequence
  chemically synthesized
tacataagggcacaaaaatg

SEQ ID NO: 159332 - DNA, 20 bp, Artificial Sequence
  chemically synthesized
gggcacaaaaatgtagcttt

SEQ ID NO: 159333 - DNA, 20 bp, Artificial Sequence
  chemically synthesized
caaaaatgtagcttttggtg

SEQ ID NO: 159334 - DNA, 20 bp, Artificial Sequence
  chemically synthesized
gtttcttttctctgcaccaa

SEQ ID NO: 159335 - DNA, 20 bp, Artificial Sequence
  chemically synthesized
aaaatgtagcttttggtgca

SEQ ID NO: 159336 - DNA, 20 bp, Artificial Sequence
  chemically synthesized
gtagcttttggtgcagagaa

SEQ ID NO: 159337 - DNA, 20 bp, Artificial Sequence
  chemically synthesized
tttggtgcagagaaaagaaa

SEQ ID NO: 159338 - DNA, 20 bp, Artificial Sequence
  chemically synthesized
tggtgcagagaaaagaaaca

SEQ ID NO: 159339 - DNA, 20 bp, Artificial Sequence
  chemically synthesized
atattggatgaatttttttt

SEQ ID NO: 159340 - DNA, 20 bp, Artificial Sequence
  chemically synthesized
tatataattcaagaagatat

SEQ ID NO: 159341 - DNA, 20 bp, Artificial Sequence
  chemically synthesized
tgagtattatataattcaag

SEQ ID NO: 159342 - DNA, 20 bp, Artificial Sequence
  chemically synthesized
atatgagtattatataattc

SEQ ID NO: 159343 - DNA, 20 bp, Artificial Sequence
  chemically synthesized
tgaattatataatactcata

SEQ ID NO: 159344 - DNA, 20 bp, Artificial Sequence
  chemically synthesized
taatgcctgtgtttctatat

SEQ ID NO: 159345 - DNA, 20 bp, Artificial Sequence
  chemically synthesized
ataatactcatatagaaaca

SEQ ID NO: 159346 - DNA, 20 bp, Artificial Sequence
  chemically synthesized
taatactcatatagaaacac

SEQ ID NO: 159347 - DNA, 20 bp, Artificial Sequence
  chemically synthesized
cattttacttttttgaaaag

SEQ ID NO: 159348 - DNA, 20 bp, Artificial Sequence
  chemically synthesized
gcattaactacttttcaaaa

SEQ ID NO: 159349 - DNA, 20 bp, Artificial Sequence
  chemically synthesized
ttgcattttacttttttgaa

SEQ ID NO: 159350 - DNA, 20 bp, Artificial Sequence
  chemically synthesized
taatttatatgaataaacac

SEQ ID NO: 159351 - DNA, 20 bp, Artificial Sequence
  chemically synthesized
atatgaataaacactagttt

SEQ ID NO: 159352 - DNA, 20 bp, Artificial Sequence
  chemically synthesized
gagattattgtagctaaaac

SEQ ID NO: 159353 - DNA, 20 bp, Artificial Sequence
  chemically synthesized
taggattattgagattattg

SEQ ID NO: 159354 - DNA, 20 bp, Artificial Sequence
  chemically synthesized
aaatgaacattaggattatt

SEQ ID NO: 159355 - DNA, 20 bp, Artificial Sequence
  chemically synthesized
tataaagtaaaatgaacatt

SEQ ID NO: 159356 - DNA, 20 bp, Artificial Sequence
  chemically synthesized
gtataaagtaaaatgaacat

SEQ ID NO: 159357 - DNA, 20 bp, Artificial Sequence
  chemically synthesized
tgtaaaacaataagtgtata

SEQ ID NO: 159358 - DNA, 20 bp, Artificial Sequence
  chemically synthesized
acagaattttgtaaaacaat

SEQ ID NO: 159359 - DNA, 20 bp, Artificial Sequence
  chemically synthesized
gttttacaaaattctgtgtt

SEQ ID NO: 159360 - DNA, 20 bp, Artificial Sequence
  chemically synthesized
tttatatccaatactaaaca

SEQ ID NO: 159361 - DNA, 20 bp, Artificial Sequence
  chemically synthesized
caaaattctgtgtttagtat

SEQ ID NO: 159362 - DNA, 20 bp, Artificial Sequence
  chemically synthesized
aaataattttgacagtgatg

SEQ ID NO: 159363 - DNA, 20 bp, Artificial Sequence
  chemically synthesized
tggaaagaaaataattttga

SEQ ID NO: 159364 - DNA, 20 bp, Artificial Sequence
  chemically synthesized
tcaaaattattttctttcca

SEQ ID NO: 159365 - DNA, 20 bp, Artificial Sequence
  chemically synthesized
caaaattattttctttccaa

SEQ ID NO: 159366 - DNA, 20 bp, Artificial Sequence
  chemically synthesized
aaaattattttctttccaaa

SEQ ID NO: 159367 - DNA, 20 bp, Artificial Sequence
  chemically synthesized
ttaagtgtttaccctttgga

SEQ ID NO: 159368 - DNA, 20 bp, Artificial Sequence
  chemically synthesized
tgctttaagtgtttaccctt

SEQ ID NO: 159369 - DNA, 20 bp, Artificial Sequence
  chemically synthesized
ttccaaagggtaaacactta

SEQ ID NO: 159370 - DNA, 20 bp, Artificial Sequence
  chemically synthesized
aagggtaaacacttaaagca

SEQ ID NO: 159371 - DNA, 20 bp, Artificial Sequence
  chemically synthesized
aagctttgatactgtgcttt

SEQ ID NO: 159372 - DNA, 20 bp, Artificial Sequence
  chemically synthesized
acacttaaagcacagtatca

SEQ ID NO: 159373 - DNA, 20 bp, Artificial Sequence
  chemically synthesized
ttgactcattaataaataat

SEQ ID NO: 159374 - DNA, 20 bp, Artificial Sequence
  chemically synthesized
aaagcttattatttattaat

SEQ ID NO: 159375 - DNA, 20 bp, Artificial Sequence
  chemically synthesized
ttatttattaatgagtcaaa

SEQ ID NO: 159376 - DNA, 20 bp, Artificial Sequence
  chemically synthesized
tatttattaatgagtcaaac

SEQ ID NO: 159377 - DNA, 20 bp, Artificial Sequence
  chemically synthesized
tgagtcaaacaggccttctg

SEQ ID NO: 159378 - DNA, 20 bp, Artificial Sequence
  chemically synthesized
aaaattaatcgttcttcaga

SEQ ID NO: 159379 - DNA, 20 bp, Artificial Sequence
  chemically synthesized
caaaattaatcgttcttcag

SEQ ID NO: 159380 - DNA, 20 bp, Artificial Sequence
  chemically synthesized
aaacaaaattaatcgttctt

SEQ ID NO: 159381 - DNA, 20 bp, Artificial Sequence
  chemically synthesized
gtttattatttgcttttctt

SEQ ID NO: 159382 - DNA, 20 bp, Artificial Sequence
  chemically synthesized
gccttctccagactgaagaa

SEQ ID NO: 159383 - DNA, 20 bp, Artificial Sequence
  chemically synthesized
ttatttgcttttcttcagtc

SEQ ID NO: 159384 - DNA, 20 bp, Artificial Sequence
  chemically synthesized
atttgcttttcttcagtctg

SEQ ID NO: 159385 - DNA, 20 bp, Artificial Sequence
  chemically synthesized
cttcagccttctccagactg

SEQ ID NO: 159386 - DNA, 20 bp, Artificial Sequence
  chemically synthesized
tgcttttcttcagtctggag

SEQ ID NO: 159387 - DNA, 20 bp, Artificial Sequence
  chemically synthesized
gcttttcttcagtctggaga

SEQ ID NO: 159388 - DNA, 20 bp, Artificial Sequence
  chemically synthesized
tgtcatgcttcagccttctc

SEQ ID NO: 159389 - DNA, 20 bp, Artificial Sequence
  chemically synthesized
cttcagtctggagaaggctg

SEQ ID NO: 159390 - DNA, 20 bp, Artificial Sequence
  chemically synthesized
gatttttttttgtcatgctt

SEQ ID NO: 159391 - DNA, 20 bp, Artificial Sequence
  chemically synthesized
catgacaaaaaaaaatcctt

SEQ ID NO: 159392 - DNA, 20 bp, Artificial Sequence
  chemically synthesized
atgacaaaaaaaaatccttc

SEQ ID NO: 159393 - DNA, 20 bp, Artificial Sequence
  chemically synthesized
gcttatattcatatacctga

SEQ ID NO: 159394 - DNA, 20 bp, Artificial Sequence
  chemically synthesized
tgcttatattcatatacctg

SEQ ID NO: 159395 - DNA, 20 bp, Artificial Sequence
  chemically synthesized
tccttcaggtatatgaatat

SEQ ID NO: 159396 - DNA, 20 bp, Artificial Sequence
  chemically synthesized
caagagagctagtcagcaga

SEQ ID NO: 159397 - DNA, 20 bp, Artificial Sequence
  chemically synthesized
ttttgttactgtctgctgac

SEQ ID NO: 159398 - DNA, 20 bp, Artificial Sequence
  chemically synthesized
tcatcaagagagctagtcag

SEQ ID NO: 159399 - DNA, 20 bp, Artificial Sequence
  chemically synthesized
gtctcatcaagagagctagt

SEQ ID NO: 159400 - DNA, 20 bp, Artificial Sequence
  chemically synthesized
tgtcgtctcatcaagagagc

SEQ ID NO: 159401 - DNA, 20 bp, Artificial Sequence
  chemically synthesized
tgctgactagctctcttgat

SEQ ID NO: 159402 - DNA, 20 bp, Artificial Sequence
  chemically synthesized
cttttgtcgtctcatcaaga

SEQ ID NO: 159403 - DNA, 20 bp, Artificial Sequence
  chemically synthesized
ttcttttgtcgtctcatcaa

SEQ ID NO: 159404 - DNA, 20 bp, Artificial Sequence
  chemically synthesized
aattcttttgtcgtctcatc

SEQ ID NO: 159405 - DNA, 20 bp, Artificial Sequence
  chemically synthesized
ctctcttgatgagacgacaa

SEQ ID NO: 159406 - DNA, 20 bp, Artificial Sequence
  chemically synthesized
gagacgacaaaagaattgtg

SEQ ID NO: 159407 - DNA, 20 bp, Artificial Sequence
  chemically synthesized
aaagaattgtgcagaaattg

SEQ ID NO: 159408 - DNA, 20 bp, Artificial Sequence
  chemically synthesized
ttgtgcagaaattgaagctg

SEQ ID NO: 159409 - DNA, 20 bp, Artificial Sequence
  chemically synthesized
tgtgcagaaattgaagctga

SEQ ID NO: 159410 - DNA, 20 bp, Artificial Sequence
  chemically synthesized
gcagaaattgaagctgaagg

SEQ ID NO: 159411 - DNA, 20 bp, Artificial Sequence
  chemically synthesized
atatttaacttcacttcctt

SEQ ID NO: 159412 - DNA, 20 bp, Artificial Sequence
  chemically synthesized
aattgaagctgaaggaagtg

SEQ ID NO: 159413 - DNA, 20 bp, Artificial Sequence
  chemically synthesized
ggaagtgaagttaaatatta

SEQ ID NO: 159414 - DNA, 20 bp, Artificial Sequence
  chemically synthesized
agtgaagttaaatattacag

SEQ ID NO: 159415 - DNA, 20 bp, Artificial Sequence
  chemically synthesized
aaatattacagaagactttt

SEQ ID NO: 159416 - DNA, 20 bp, Artificial Sequence
  chemically synthesized
attacagaagactttttgga

SEQ ID NO: 159417 - DNA, 20 bp, Artificial Sequence
  chemically synthesized
taacaagtgttccatccaaa

SEQ ID NO: 159418 - DNA, 20 bp, Artificial Sequence
  chemically synthesized
actctatcctagtgtttaac

SEQ ID NO: 159419 - DNA, 20 bp, Artificial Sequence
  chemically synthesized
atggaacacttgttaaacac

SEQ ID NO: 159420 - DNA, 20 bp, Artificial Sequence
  chemically synthesized
tggaacacttgttaaacact

SEQ ID NO: 159421 - DNA, 20 bp, Artificial Sequence
  chemically synthesized
acacttgttaaacactagga

SEQ ID NO: 159422 - DNA, 20 bp, Artificial Sequence
  chemically synthesized
acttgttaaacactaggata

SEQ ID NO: 159423 - DNA, 20 bp, Artificial Sequence
  chemically synthesized
gattaattgatactctatcc

SEQ ID NO: 159424 - DNA, 20 bp, Artificial Sequence
  chemically synthesized
gagtatcaattaatcaatgt

SEQ ID NO: 159425 - DNA, 20 bp, Artificial Sequence
  chemically synthesized
agtatcaattaatcaatgtc

SEQ ID NO: 159426 - DNA, 20 bp, Artificial Sequence
  chemically synthesized
aattaatcaatgtcaggcat

SEQ ID NO: 159427 - DNA, 20 bp, Artificial Sequence
  chemically synthesized
aatcaatgtcaggcatcagt

SEQ ID NO: 159428 - DNA, 20 bp, Artificial Sequence
  chemically synthesized
atcaatgtcaggcatcagtc

SEQ ID NO: 159429 - DNA, 20 bp, Artificial Sequence
  chemically synthesized
tcaatgtcaggcatcagtca

SEQ ID NO: 159430 - DNA, 20 bp, Artificial Sequence
  chemically synthesized
gtcaggcatcagtcagggcc

SEQ ID NO: 159431 - DNA, 20 bp, Artificial Sequence
  chemically synthesized
tcaggcatcagtcagggcct

SEQ ID NO: 159432 - DNA, 20 bp, Artificial Sequence
  chemically synthesized
ctctctggggaagattgccc

SEQ ID NO: 159433 - DNA, 20 bp, Artificial Sequence
  chemically synthesized
gctctctggggaagattgcc

SEQ ID NO: 159434 - DNA, 20 bp, Artificial Sequence
  chemically synthesized
agggcctgggcaatcttccc

SEQ ID NO: 159435 - DNA, 20 bp, Artificial Sequence
  chemically synthesized
ggcctgggcaatcttcccca

SEQ ID NO: 159436 - DNA, 20 bp, Artificial Sequence
  chemically synthesized
cctgggcaatcttccccaga

SEQ ID NO: 159437 - DNA, 20 bp, Artificial Sequence
  chemically synthesized
tcaggagctgctctctgggg

SEQ ID NO: 159438 - DNA, 20 bp, Artificial Sequence
  chemically synthesized
gggcaatcttccccagagag

SEQ ID NO: 159439 - DNA, 20 bp, Artificial Sequence
  chemically synthesized
taatcaggagctgctctctg

SEQ ID NO: 159440 - DNA, 20 bp, Artificial Sequence
  chemically synthesized
ttaatcaggagctgctctct

SEQ ID NO: 159441 - DNA, 20 bp, Artificial Sequence
  chemically synthesized
gttaatcaggagctgctctc

SEQ ID NO: 159442 - DNA, 20 bp, Artificial Sequence
  chemically synthesized
gagagatacgggttaatcag

SEQ ID NO: 159443 - DNA, 20 bp, Artificial Sequence
  chemically synthesized
aagagagatacgggttaatc

SEQ ID NO: 159444 - DNA, 20 bp, Artificial Sequence
  chemically synthesized
gaagagagatacgggttaat

SEQ ID NO: 159445 - DNA, 20 bp, Artificial Sequence
  chemically synthesized
ggagggaggaagagagatac

SEQ ID NO: 159446 - DNA, 20 bp, Artificial Sequence
  chemically synthesized
gggagggaggaagagagata

SEQ ID NO: 159447 - DNA, 20 bp, Artificial Sequence
  chemically synthesized
gggtaggggagggaggaaga

SEQ ID NO: 159448 - DNA, 20 bp, Artificial Sequence
  chemically synthesized
cggggtaggggagggaggaa

SEQ ID NO: 159449 - DNA, 20 bp, Artificial Sequence
  chemically synthesized
tccggggtaggggagggagg

SEQ ID NO: 159450 - DNA, 20 bp, Artificial Sequence
  chemically synthesized
ggctccggggtaggggaggg

SEQ ID NO: 159451 - DNA, 20 bp, Artificial Sequence
  chemically synthesized
aggctccggggtaggggagg

SEQ ID NO: 159452 - DNA, 20 bp, Artificial Sequence
  chemically synthesized
ggaggctccggggtagggga

SEQ ID NO: 159453 - DNA, 20 bp, Artificial Sequence
  chemically synthesized
gggaggctccggggtagggg

SEQ ID NO: 159454 - DNA, 20 bp, Artificial Sequence
  chemically synthesized
tgggaggctccggggtaggg

SEQ ID NO: 159455 - DNA, 20 bp, Artificial Sequence
  chemically synthesized
tcttcctccctcccctaccc

SEQ ID NO: 159456 - DNA, 20 bp, Artificial Sequence
  chemically synthesized
gctgggaggctccggggtag

SEQ ID NO: 159457 - DNA, 20 bp, Artificial Sequence
  chemically synthesized
ttcctccctcccctaccccg

SEQ ID NO: 159458 - DNA, 20 bp, Artificial Sequence
  chemically synthesized
tgctgggaggctccggggta

SEQ ID NO: 159459 - DNA, 20 bp, Artificial Sequence
  chemically synthesized
gtgctgggaggctccggggt

SEQ ID NO: 159460 - DNA, 20 bp, Artificial Sequence
  chemically synthesized
agtgctgggaggctccgggg

SEQ ID NO: 159461 - DNA, 20 bp, Artificial Sequence
  chemically synthesized
agcagtgctgggaggctccg

SEQ ID NO: 159462 - DNA, 20 bp, Artificial Sequence
  chemically synthesized
cagcagtgctgggaggctcc

SEQ ID NO: 159463 - DNA, 20 bp, Artificial Sequence
  chemically synthesized
acagcagtgctgggaggctc

SEQ ID NO: 159464 - DNA, 20 bp, Artificial Sequence
  chemically synthesized
tcccctaccccggagcctcc

SEQ ID NO: 159465 - DNA, 20 bp, Artificial Sequence
  chemically synthesized
ttaaacacagcagtgctggg

SEQ ID NO: 159466 - DNA, 20 bp, Artificial Sequence
  chemically synthesized
cttaaacacagcagtgctgg

SEQ ID NO: 159467 - DNA, 20 bp, Artificial Sequence
  chemically synthesized
cacttaaacacagcagtgct

SEQ ID NO: 159468 - DNA, 20 bp, Artificial Sequence
  chemically synthesized
acacttaaacacagcagtgc

SEQ ID NO: 159469 - DNA, 20 bp, Artificial Sequence
  chemically synthesized
acggagacacttaaacacag

SEQ ID NO: 159470 - DNA, 20 bp, Artificial Sequence
  chemically synthesized
ctcccagcactgctgtgttt

SEQ ID NO: 159471 - DNA, 20 bp, Artificial Sequence
  chemically synthesized
ggcacggagacacttaaaca

SEQ ID NO: 159472 - DNA, 20 bp, Artificial Sequence
  chemically synthesized
acgaaggaaacagtggcacg

SEQ ID NO: 159473 - DNA, 20 bp, Artificial Sequence
  chemically synthesized
atacgaaggaaacagtggca

SEQ ID NO: 159474 - DNA, 20 bp, Artificial Sequence
  chemically synthesized
acagtatacgaaggaaacag

SEQ ID NO: 159475 - DNA, 20 bp, Artificial Sequence
  chemically synthesized
aacacagtatacgaaggaaa

SEQ ID NO: 159476 - DNA, 20 bp, Artificial Sequence
  chemically synthesized
ggtacaaacacagtatacga

SEQ ID NO: 159477 - DNA, 20 bp, Artificial Sequence
  chemically synthesized
aggtacaaacacagtatacg

SEQ ID NO: 159478 - DNA, 20 bp, Artificial Sequence
  chemically synthesized
agagggaacaggtacaaaca

SEQ ID NO: 159479 - DNA, 20 bp, Artificial Sequence
  chemically synthesized
ctaatgaactgagagggaac

SEQ ID NO: 159480 - DNA, 20 bp, Artificial Sequence
  chemically synthesized
actaatgaactgagagggaa

SEQ ID NO: 159481 - DNA, 20 bp, Artificial Sequence
  chemically synthesized
tgtttgtacctgttccctct

SEQ ID NO: 159482 - DNA, 20 bp, Artificial Sequence
  chemically synthesized
ttcctactaatgaactgaga

SEQ ID NO: 159483 - DNA, 20 bp, Artificial Sequence
  chemically synthesized
tttcctactaatgaactgag

SEQ ID NO: 159484 - DNA, 20 bp, Artificial Sequence
  chemically synthesized
atttcctactaatgaactga

SEQ ID NO: 159485 - DNA, 20 bp, Artificial Sequence
  chemically synthesized
cctgttccctctcagttcat

SEQ ID NO: 159486 - DNA, 20 bp, Artificial Sequence
  chemically synthesized
ggatttcctactaatgaact

SEQ ID NO: 159487 - DNA, 20 bp, Artificial Sequence
  chemically synthesized
gttccctctcagttcattag

SEQ ID NO: 159488 - DNA, 20 bp, Artificial Sequence
  chemically synthesized
ttccctctcagttcattagt

SEQ ID NO: 159489 - DNA, 20 bp, Artificial Sequence
  chemically synthesized
gtatgagattatagtaattt

SEQ ID NO: 159490 - DNA, 20 bp, Artificial Sequence
  chemically synthesized
agtatgagattatagtaatt

SEQ ID NO: 159491 - DNA, 20 bp, Artificial Sequence
  chemically synthesized
tactgggcagtatgagatta

SEQ ID NO: 159492 - DNA, 20 bp, Artificial Sequence
  chemically synthesized
gagactgtactgggcagtat

SEQ ID NO: 159493 - DNA, 20 bp, Artificial Sequence
  chemically synthesized
tactataatctcatactgcc

SEQ ID NO: 159494 - DNA, 20 bp, Artificial Sequence
  chemically synthesized
taatctcatactgcccagta

SEQ ID NO: 159495 - DNA, 20 bp, Artificial Sequence
  chemically synthesized
ttgcaagagactgtactggg

SEQ ID NO: 159496 - DNA, 20 bp, Artificial Sequence
  chemically synthesized
aaattgcaagagactgtact

SEQ ID NO: 159497 - DNA, 20 bp, Artificial Sequence
  chemically synthesized
taaattgcaagagactgtac

SEQ ID NO: 159498 - DNA, 20 bp, Artificial Sequence
  chemically synthesized
tgagcacccgtaaattgcaa

SEQ ID NO: 159499 - DNA, 20 bp, Artificial Sequence
  chemically synthesized
gctgagcacccgtaaattgc

SEQ ID NO: 159500 - DNA, 20 bp, Artificial Sequence
  chemically synthesized
gtacagtctcttgcaattta

SEQ ID NO: 159501 - DNA, 20 bp, Artificial Sequence
  chemically synthesized
tacagtctcttgcaatttac

SEQ ID NO: 159502 - DNA, 20 bp, Artificial Sequence
  chemically synthesized
tcttgcaatttacgggtgct

SEQ ID NO: 159503 - DNA, 20 bp, Artificial Sequence
  chemically synthesized
ctatctcaagagcatgtgct

SEQ ID NO: 159504 - DNA, 20 bp, Artificial Sequence
  chemically synthesized
ggtgctcagcacatgctctt

SEQ ID NO: 159505 - DNA, 20 bp, Artificial Sequence
  chemically synthesized
ctcagcacatgctcttgaga

SEQ ID NO: 159506 - DNA, 20 bp, Artificial Sequence
  chemically synthesized
aaaaaaatagtctatctcaa

SEQ ID NO: 159507 - DNA, 20 bp, Artificial Sequence
  chemically synthesized
ggaaaaaaatagtctatctc

SEQ ID NO: 159508 - DNA, 20 bp, Artificial Sequence
  chemically synthesized
taataagaactggaaaaaaa

SEQ ID NO: 159509 - DNA, 20 bp, Artificial Sequence
  chemically synthesized
tgagatagactatttttttc

SEQ ID NO: 159510 - DNA, 20 bp, Artificial Sequence
  chemically synthesized
gtatttattataataagaac

SEQ ID NO: 159511 - DNA, 20 bp, Artificial Sequence
  chemically synthesized
ctgctggtatttattataat

SEQ ID NO: 159512 - DNA, 20 bp, Artificial Sequence
  chemically synthesized
gttcttattataataaatac

SEQ ID NO: 159513 - DNA, 20 bp, Artificial Sequence
  chemically synthesized
cttattataataaataccag

SEQ ID NO: 159514 - DNA, 20 bp, Artificial Sequence
  chemically synthesized
ccaaagtgcctgtttgctgc

SEQ ID NO: 159515 - DNA, 20 bp, Artificial Sequence
  chemically synthesized
taataaataccagcagcaaa

SEQ ID NO: 159516 - DNA, 20 bp, Artificial Sequence
  chemically synthesized
aataaataccagcagcaaac

SEQ ID NO: 159517 - DNA, 20 bp, Artificial Sequence
  chemically synthesized
ccagcagcaaacaggcactt

SEQ ID NO: 159518 - DNA, 20 bp, Artificial Sequence
  chemically synthesized
gttatgtacaattttgacca

SEQ ID NO: 159519 - DNA, 20 bp, Artificial Sequence
  chemically synthesized
taaccattaacacatgaggt

SEQ ID NO: 159520 - DNA, 20 bp, Artificial Sequence
  chemically synthesized
tacataaccattaacacatg

SEQ ID NO: 159521 - DNA, 20 bp, Artificial Sequence
  chemically synthesized
atacataaccattaacacat

SEQ ID NO: 159522 - DNA, 20 bp, Artificial Sequence
  chemically synthesized
taactaacctcatgtgttaa

SEQ ID NO: 159523 - DNA, 20 bp, Artificial Sequence
  chemically synthesized
ctaaactactgttataaagg

SEQ ID NO: 159524 - DNA, 20 bp, Artificial Sequence
  chemically synthesized
aaatttcacttcctttataa

SEQ ID NO: 159525 - DNA, 20 bp, Artificial Sequence
  chemically synthesized
tagctaaactactgttataa

SEQ ID NO: 159526 - DNA, 20 bp, Artificial Sequence
  chemically synthesized
gtagctaaactactgttata

SEQ ID NO: 159527 - DNA, 20 bp, Artificial Sequence
  chemically synthesized
tttcacttcctttataacag

SEQ ID NO: 159528 - DNA, 20 bp, Artificial Sequence
  chemically synthesized
cttcctttataacagtagtt

SEQ ID NO: 159529 - DNA, 20 bp, Artificial Sequence
  chemically synthesized
taatagttcttcatgtaaag

SEQ ID NO: 159530 - DNA, 20 bp, Artificial Sequence
  chemically synthesized
tagtttagctactttacatg

SEQ ID NO: 159531 - DNA, 20 bp, Artificial Sequence
  chemically synthesized
aattaatagttcttcatgta

SEQ ID NO: 159532 - DNA, 20 bp, Artificial Sequence
  chemically synthesized
gcagtaagaccatcaattaa

SEQ ID NO: 159533 - DNA, 20 bp, Artificial Sequence
  chemically synthesized
catgaagaactattaattga

SEQ ID NO: 159534 - DNA, 20 bp, Artificial Sequence
  chemically synthesized
ttttcttggcaaggggcagt

SEQ ID NO: 159535 - DNA, 20 bp, Artificial Sequence
  chemically synthesized
tgtgttttcttggcaagggg

SEQ ID NO: 159536 - DNA, 20 bp, Artificial Sequence
  chemically synthesized
tggtcttactgccccttgcc

SEQ ID NO: 159537 - DNA, 20 bp, Artificial Sequence
  chemically synthesized
caatgtgttttcttggcaag

SEQ ID NO: 159538 - DNA, 20 bp, Artificial Sequence
  chemically synthesized
acaatgtgttttcttggcaa

SEQ ID NO: 159539 - DNA, 20 bp, Artificial Sequence
  chemically synthesized
aacaatgtgttttcttggca

SEQ ID NO: 159540 - DNA, 20 bp, Artificial Sequence
  chemically synthesized
gaacaatgtgttttcttggc

SEQ ID NO: 159541 - DNA, 20 bp, Artificial Sequence
  chemically synthesized
cagggaacaatgtgttttct

SEQ ID NO: 159542 - DNA, 20 bp, Artificial Sequence
  chemically synthesized
ttccgggtgctgcattttca

SEQ ID NO: 159543 - DNA, 20 bp, Artificial Sequence
  chemically synthesized
cacattgttccctgaaaatg

SEQ ID NO: 159544 - DNA, 20 bp, Artificial Sequence
  chemically synthesized
attccgggtgctgcattttc

SEQ ID NO: 159545 - DNA, 20 bp, Artificial Sequence
  chemically synthesized
cattccgggtgctgcatttt

SEQ ID NO: 159546 - DNA, 20 bp, Artificial Sequence
  chemically synthesized
ttccctgaaaatgcagcacc

SEQ ID NO: 159547 - DNA, 20 bp, Artificial Sequence
  chemically synthesized
caaagacatacagtcattcc

SEQ ID NO: 159548 - DNA, 20 bp, Artificial Sequence
  chemically synthesized
gcaaagacatacagtcattc

SEQ ID NO: 159549 - DNA, 20 bp, Artificial Sequence
  chemically synthesized
ctacctctagcaaagacata

SEQ ID NO: 159550 - DNA, 20 bp, Artificial Sequence
  chemically synthesized
gaatgactgtatgtctttgc

SEQ ID NO: 159551 - DNA, 20 bp, Artificial Sequence
  chemically synthesized
atgactgtatgtctttgcta

SEQ ID NO: 159552 - DNA, 20 bp, Artificial Sequence
  chemically synthesized
tgactgtatgtctttgctag

SEQ ID NO: 159553 - DNA, 20 bp, Artificial Sequence
  chemically synthesized
agctatttctacctctagca

SEQ ID NO: 159554 - DNA, 20 bp, Artificial Sequence
  chemically synthesized
ctgtatgtctttgctagagg

SEQ ID NO: 159555 - DNA, 20 bp, Artificial Sequence
  chemically synthesized
atcagagctatttctacctc

SEQ ID NO: 159556 - DNA, 20 bp, Artificial Sequence
  chemically synthesized
gtctttgctagaggtagaaa

SEQ ID NO: 159557 - DNA, 20 bp, Artificial Sequence
  chemically synthesized
ggtagaaatagctctgatct

SEQ ID NO: 159558 - DNA, 20 bp, Artificial Sequence
  chemically synthesized
ttattcctcatctgagatca

SEQ ID NO: 159559 - DNA, 20 bp, Artificial Sequence
  chemically synthesized
ccttattcctcatctgagat

SEQ ID NO: 159560 - DNA, 20 bp, Artificial Sequence
  chemically synthesized
aaatagctctgatctcagat

SEQ ID NO: 159561 - DNA, 20 bp, Artificial Sequence
  chemically synthesized
aatagctctgatctcagatg

SEQ ID NO: 159562 - DNA, 20 bp, Artificial Sequence
  chemically synthesized
attttccttattcctcatct

SEQ ID NO: 159563 - DNA, 20 bp, Artificial Sequence
  chemically synthesized
tctgatctcagatgaggaat

SEQ ID NO: 159564 - DNA, 20 bp, Artificial Sequence
  chemically synthesized
ctgatctcagatgaggaata

SEQ ID NO: 159565 - DNA, 20 bp, Artificial Sequence
  chemically synthesized
gatgaggaataaggaaaatc

SEQ ID NO: 159566 - DNA, 20 bp, Artificial Sequence
  chemically synthesized
tggaattcagtaagtaaaac

SEQ ID NO: 159567 - DNA, 20 bp, Artificial Sequence
  chemically synthesized
ggacctatttggaattcagt

SEQ ID NO: 159568 - DNA, 20 bp, Artificial Sequence
  chemically synthesized
ctggggacctatttggaatt

SEQ ID NO: 159569 - DNA, 20 bp, Artificial Sequence
  chemically synthesized
tttacttactgaattccaaa

SEQ ID NO: 159570 - DNA, 20 bp, Artificial Sequence
  chemically synthesized
ttacttactgaattccaaat

SEQ ID NO: 159571 - DNA, 20 bp, Artificial Sequence
  chemically synthesized
atagtggctggggacctatt

SEQ ID NO: 159572 - DNA, 20 bp, Artificial Sequence
  chemically synthesized
ctgaattccaaataggtccc

SEQ ID NO: 159573 - DNA, 20 bp, Artificial Sequence
  chemically synthesized
gggtgaatttatagtggctg

SEQ ID NO: 159574 - DNA, 20 bp, Artificial Sequence
  chemically synthesized
agggtgaatttatagtggct

SEQ ID NO: 159575 - DNA, 20 bp, Artificial Sequence
  chemically synthesized
aagggtgaatttatagtggc

SEQ ID NO: 159576 - DNA, 20 bp, Artificial Sequence
  chemically synthesized
attcaagggtgaatttatag

SEQ ID NO: 159577 - DNA, 20 bp, Artificial Sequence
  chemically synthesized
ggtattcaagggtgaattta

SEQ ID NO: 159578 - DNA, 20 bp, Artificial Sequence
  chemically synthesized
tttgcaaatgcggtattcaa

SEQ ID NO: 159579 - DNA, 20 bp, Artificial Sequence
  chemically synthesized
ttttgcaaatgcggtattca

SEQ ID NO: 159580 - DNA, 20 bp, Artificial Sequence
  chemically synthesized
tttttgcaaatgcggtattc

SEQ ID NO: 159581 - DNA, 20 bp, Artificial Sequence
  chemically synthesized
aaaatgtttttttgcaaatg

SEQ ID NO: 159582 - DNA, 20 bp, Artificial Sequence
  chemically synthesized
gcatttgcaaaaaaacattt

SEQ ID NO: 159583 - DNA, 20 bp, Artificial Sequence
  chemically synthesized
tgcaaaaaaacattttggtg

SEQ ID NO: 159584 - DNA, 20 bp, Artificial Sequence
  chemically synthesized
aaacattttggtgtagtaaa

SEQ ID NO: 159585 - DNA, 20 bp, Artificial Sequence
  chemically synthesized
tggtgtagtaaatggtgata

SEQ ID NO: 159586 - DNA, 20 bp, Artificial Sequence
  chemically synthesized
attttctcttaaagtatttt

SEQ ID NO: 159587 - DNA, 20 bp, Artificial Sequence
  chemically synthesized
atatggtctcaaaatacttt

SEQ ID NO: 159588 - DNA, 20 bp, Artificial Sequence
  chemically synthesized
atggtctcaaaatactttaa

SEQ ID NO: 159589 - DNA, 20 bp, Artificial Sequence
  chemically synthesized
atatattttattttctctta

SEQ ID NO: 159590 - DNA, 20 bp, Artificial Sequence
  chemically synthesized
aaaataaaatatattattct

SEQ ID NO: 159591 - DNA, 20 bp, Artificial Sequence
  chemically synthesized
aaataaaatatattattcta

SEQ ID NO: 159592 - DNA, 20 bp, Artificial Sequence
  chemically synthesized
taaaatatattattctaagg

SEQ ID NO: 159593 - DNA, 20 bp, Artificial Sequence
  chemically synthesized
aatatattattctaaggaag

SEQ ID NO: 159594 - DNA, 20 bp, Artificial Sequence
  chemically synthesized
tgctcttttctctacttcct

SEQ ID NO: 159595 - DNA, 20 bp, Artificial Sequence
  chemically synthesized
tatattattctaaggaagta

SEQ ID NO: 159596 - DNA, 20 bp, Artificial Sequence
  chemically synthesized
tattctaaggaagtagagaa

SEQ ID NO: 159597 - DNA, 20 bp, Artificial Sequence
  chemically synthesized
ttctaaggaagtagagaaaa

SEQ ID NO: 159598 - DNA, 20 bp, Artificial Sequence
  chemically synthesized
tagagaaaagagcatatctt

SEQ ID NO: 159599 - DNA, 20 bp, Artificial Sequence
  chemically synthesized
gaaaagagcatatcttcagc

SEQ ID NO: 159600 - DNA, 20 bp, Artificial Sequence
  chemically synthesized
aaaagagcatatcttcagca

SEQ ID NO: 159601 - DNA, 20 bp, Artificial Sequence
  chemically synthesized
aaatcatttttaccttgctg

SEQ ID NO: 159602 - DNA, 20 bp, Artificial Sequence
  chemically synthesized
cagcaaggtaaaaatgattt

SEQ ID NO: 159603 - DNA, 20 bp, Artificial Sequence
  chemically synthesized
aggtaaaaatgatttaagaa

SEQ ID NO: 159604 - DNA, 20 bp, Artificial Sequence
  chemically synthesized
ggtaaaaatgatttaagaaa

SEQ ID NO: 159605 - DNA, 20 bp, Artificial Sequence
  chemically synthesized
tgatttaagaaaaggaaaaa

SEQ ID NO: 159606 - DNA, 20 bp, Artificial Sequence
  chemically synthesized
aaatgtataggttgaaaatt

SEQ ID NO: 159607 - DNA, 20 bp, Artificial Sequence
  chemically synthesized
tacataaatgataaatgtat

SEQ ID NO: 159608 - DNA, 20 bp, Artificial Sequence
  chemically synthesized
atacataaatgataaatgta

SEQ ID NO: 159609 - DNA, 20 bp, Artificial Sequence
  chemically synthesized
atatttggcctggtaattta

SEQ ID NO: 159610 - DNA, 20 bp, Artificial Sequence
  chemically synthesized
ttatgtataccataaattac

SEQ ID NO: 159611 - DNA, 20 bp, Artificial Sequence
  chemically synthesized
tatgtataccataaattacc

SEQ ID NO: 159612 - DNA, 20 bp, Artificial Sequence
  chemically synthesized
ttgtacatgtatatttggcc

SEQ ID NO: 159613 - DNA, 20 bp, Artificial Sequence
  chemically synthesized
agacattgtacatgtatatt

SEQ ID NO: 159614 - DNA, 20 bp, Artificial Sequence
  chemically synthesized
ataatttcaaatgtataatt

SEQ ID NO: 159615 - DNA, 20 bp, Artificial Sequence
  chemically synthesized
cattacacatataaactgac

SEQ ID NO: 159616 - DNA, 20 bp, Artificial Sequence
  chemically synthesized
agtgctttaagttaacttgt

SEQ ID NO: 159617 - DNA, 20 bp, Artificial Sequence
  chemically synthesized
taaactgacaagttaactta

SEQ ID NO: 159618 - DNA, 20 bp, Artificial Sequence
  chemically synthesized
aatggtggtgacagtgcttt

SEQ ID NO: 159619 - DNA, 20 bp, Artificial Sequence
  chemically synthesized
tacaaaatgaatggtggtga

SEQ ID NO: 159620 - DNA, 20 bp, Artificial Sequence
  chemically synthesized
aacacatacaaaatgaatgg

SEQ ID NO: 159621 - DNA, 20 bp, Artificial Sequence
  chemically synthesized
agaaacacatacaaaatgaa

SEQ ID NO: 159622 - DNA, 20 bp, Artificial Sequence
  chemically synthesized
cattttgtatgtgtttctct

SEQ ID NO: 159623 - DNA, 20 bp, Artificial Sequence
  chemically synthesized
gtatgtgtttctctaagaca

SEQ ID NO: 159624 - DNA, 20 bp, Artificial Sequence
  chemically synthesized
gaaaatagtgctttgtctta

SEQ ID NO: 159625 - DNA, 20 bp, Artificial Sequence
  chemically synthesized
tagaaaatagtgctttgtct

SEQ ID NO: 159626 - DNA, 20 bp, Artificial Sequence
  chemically synthesized
gtcagtgaataaatagaaaa

SEQ ID NO: 159627 - DNA, 20 bp, Artificial Sequence
  chemically synthesized
cccagctgtcagtgaataaa

SEQ ID NO: 159628 - DNA, 20 bp, Artificial Sequence
  chemically synthesized
attttctatttattcactga

SEQ ID NO: 159629 - DNA, 20 bp, Artificial Sequence
  chemically synthesized
tctatttattcactgacagc

SEQ ID NO: 159630 - DNA, 20 bp, Artificial Sequence
  chemically synthesized
ctatttattcactgacagct

SEQ ID NO: 159631 - DNA, 20 bp, Artificial Sequence
  chemically synthesized
acaagaaaagtcccagctgt

SEQ ID NO: 159632 - DNA, 20 bp, Artificial Sequence
  chemically synthesized
aactatcacaagaaaagtcc

SEQ ID NO: 159633 - DNA, 20 bp, Artificial Sequence
  chemically synthesized
atcaataactatcacaagaa

SEQ ID NO: 159634 - DNA, 20 bp, Artificial Sequence
  chemically synthesized
agctgggacttttcttgtga

SEQ ID NO: 159635 - DNA, 20 bp, Artificial Sequence
  chemically synthesized
gctatatcaataactatcac

SEQ ID NO: 159636 - DNA, 20 bp, Artificial Sequence
  chemically synthesized
tcttgtgatagttattgata

SEQ ID NO: 159637 - DNA, 20 bp, Artificial Sequence
  chemically synthesized
ttattgatatagctaattac

SEQ ID NO: 159638 - DNA, 20 bp, Artificial Sequence
  chemically synthesized
cattgtctattaccagtaat

SEQ ID NO: 159639 - DNA, 20 bp, Artificial Sequence
  chemically synthesized
atatagctaattactggtaa

SEQ ID NO: 159640 - DNA, 20 bp, Artificial Sequence
  chemically synthesized
cagaaaacattgtctattac

SEQ ID NO: 159641 - DNA, 20 bp, Artificial Sequence
  chemically synthesized
aatagacaatgttttctgat

SEQ ID NO: 159642 - DNA, 20 bp, Artificial Sequence
  chemically synthesized
acagctatgatgaagctaat

SEQ ID NO: 159643 - DNA, 20 bp, Artificial Sequence
  chemically synthesized
ttttctgattagcttcatca

SEQ ID NO: 159644 - DNA, 20 bp, Artificial Sequence
  chemically synthesized
tatagtctacagctatgatg

SEQ ID NO: 159645 - DNA, 20 bp, Artificial Sequence
  chemically synthesized
gattagcttcatcatagctg

SEQ ID NO: 159646 - DNA, 20 bp, Artificial Sequence
  chemically synthesized
atcatcaataatatagtcta

SEQ ID NO: 159647 - DNA, 20 bp, Artificial Sequence
  chemically synthesized
ctatgctatcatcaataata

SEQ ID NO: 159648 - DNA, 20 bp, Artificial Sequence
  chemically synthesized
gtagactatattattgatga

SEQ ID NO: 159649 - DNA, 20 bp, Artificial Sequence
  chemically synthesized
ctatattattgatgatagca

SEQ ID NO: 159650 - DNA, 20 bp, Artificial Sequence
  chemically synthesized
aatagtagtcattatacgaa

SEQ ID NO: 159651 - DNA, 20 bp, Artificial Sequence
  chemically synthesized
gggttggggaaggcaaatag

SEQ ID NO: 159652 - DNA, 20 bp, Artificial Sequence
  chemically synthesized
tcagggttggggaaggcaaa

SEQ ID NO: 159653 - DNA, 20 bp, Artificial Sequence
  chemically synthesized
gttggaatcagggttgggga

SEQ ID NO: 159654 - DNA, 20 bp, Artificial Sequence
  chemically synthesized
tgttggaatcagggttgggg

SEQ ID NO: 159655 - DNA, 20 bp, Artificial Sequence
  chemically synthesized
atctgttggaatcagggttg

SEQ ID NO: 159656 - DNA, 20 bp, Artificial Sequence
  chemically synthesized
aatctgttggaatcagggtt

SEQ ID NO: 159657 - DNA, 20 bp, Artificial Sequence
  chemically synthesized
caatctgttggaatcagggt

SEQ ID NO: 159658 - DNA, 20 bp, Artificial Sequence
  chemically synthesized
gtggcaatctgttggaatca

SEQ ID NO: 159659 - DNA, 20 bp, Artificial Sequence
  chemically synthesized
agtggcaatctgttggaatc

SEQ ID NO: 159660 - DNA, 20 bp, Artificial Sequence
  chemically synthesized
ttccccaaccctgattccaa

SEQ ID NO: 159661 - DNA, 20 bp, Artificial Sequence
  chemically synthesized
aagtggcaatctgttggaat

SEQ ID NO: 159662 - DNA, 20 bp, Artificial Sequence
  chemically synthesized
tctgtaaagtggcaatctgt

SEQ ID NO: 159663 - DNA, 20 bp, Artificial Sequence
  chemically synthesized
tccaacagattgccacttta

SEQ ID NO: 159664 - DNA, 20 bp, Artificial Sequence
  chemically synthesized
tcattttcttatctgtaaag

SEQ ID NO: 159665 - DNA, 20 bp, Artificial Sequence
  chemically synthesized
cagattgccactttacagat

SEQ ID NO: 159666 - DNA, 20 bp, Artificial Sequence
  chemically synthesized
gcttcattttcttatctgta

SEQ ID NO: 159667 - DNA, 20 bp, Artificial Sequence
  chemically synthesized
actttacagataagaaaatg

SEQ ID NO: 159668 - DNA, 20 bp, Artificial Sequence
  chemically synthesized
tacagataagaaaatgaagc

SEQ ID NO: 159669 - DNA, 20 bp, Artificial Sequence
  chemically synthesized
acagataagaaaatgaagca

SEQ ID NO: 159670 - DNA, 20 bp, Artificial Sequence
  chemically synthesized
cagataagaaaatgaagcaa

SEQ ID NO: 159671 - DNA, 20 bp, Artificial Sequence
  chemically synthesized
ataagaaaatgaagcaaggg

SEQ ID NO: 159672 - DNA, 20 bp, Artificial Sequence
  chemically synthesized
taagaaaatgaagcaagggt

SEQ ID NO: 159673 - DNA, 20 bp, Artificial Sequence
  chemically synthesized
gaaaatgaagcaagggtggg

SEQ ID NO: 159674 - DNA, 20 bp, Artificial Sequence
  chemically synthesized
aaaatgaagcaagggtgggt

SEQ ID NO: 159675 - DNA, 20 bp, Artificial Sequence
  chemically synthesized
tgaagcaagggtgggtggga

SEQ ID NO: 159676 - DNA, 20 bp, Artificial Sequence
  chemically synthesized
agcaagggtgggtgggatag

SEQ ID NO: 159677 - DNA, 20 bp, Artificial Sequence
  chemically synthesized
ggtgggtgggatagtagtga

SEQ ID NO: 159678 - DNA, 20 bp, Artificial Sequence
  chemically synthesized
gggtgggatagtagtgacgg

SEQ ID NO: 159679 - DNA, 20 bp, Artificial Sequence
  chemically synthesized
ggtagtgacaatgatgtgaa

SEQ ID NO: 159680 - DNA, 20 bp, Artificial Sequence
  chemically synthesized
catcccacgaggttgtgggc

SEQ ID NO: 159681 - DNA, 20 bp, Artificial Sequence
  chemically synthesized
cccacatcccacgaggttgt

SEQ ID NO: 159682 - DNA, 20 bp, Artificial Sequence
  chemically synthesized
tcccacatcccacgaggttg

SEQ ID NO: 159683 - DNA, 20 bp, Artificial Sequence
  chemically synthesized
atagcttgcccacaacctcg

SEQ ID NO: 159684 - DNA, 20 bp, Artificial Sequence
  chemically synthesized
tagcttgcccacaacctcgt

SEQ ID NO: 159685 - DNA, 20 bp, Artificial Sequence
  chemically synthesized
taactctcccacatcccacg

SEQ ID NO: 159686 - DNA, 20 bp, Artificial Sequence
  chemically synthesized
ttaactctcccacatcccac

SEQ ID NO: 159687 - DNA, 20 bp, Artificial Sequence
  chemically synthesized
gcccacaacctcgtgggatg

SEQ ID NO: 159688 - DNA, 20 bp, Artificial Sequence
  chemically synthesized
cccacaacctcgtgggatgt

SEQ ID NO: 159689 - DNA, 20 bp, Artificial Sequence
  chemically synthesized
cacaacctcgtgggatgtgg

SEQ ID NO: 159690 - DNA, 20 bp, Artificial Sequence
  chemically synthesized
caacctcgtgggatgtggga

SEQ ID NO: 159691 - DNA, 20 bp, Artificial Sequence
  chemically synthesized
ggagagttaatattcaaaca

SEQ ID NO: 159692 - DNA, 20 bp, Artificial Sequence
  chemically synthesized
agttaatattcaaacacagc

SEQ ID NO: 159693 - DNA, 20 bp, Artificial Sequence
  chemically synthesized
gttaatattcaaacacagct

SEQ ID NO: 159694 - DNA, 20 bp, Artificial Sequence
  chemically synthesized
ataaactttggattcagacc

SEQ ID NO: 159695 - DNA, 20 bp, Artificial Sequence
  chemically synthesized
cacagctaggtctgaatcca

SEQ ID NO: 159696 - DNA, 20 bp, Artificial Sequence
  chemically synthesized
aatagtataaactttggatt

SEQ ID NO: 159697 - DNA, 20 bp, Artificial Sequence
  chemically synthesized
actgccaatagtataaactt

SEQ ID NO: 159698 - DNA, 20 bp, Artificial Sequence
  chemically synthesized
gaatccaaagtttatactat

SEQ ID NO: 159699 - DNA, 20 bp, Artificial Sequence
  chemically synthesized
tccaaagtttatactattgg

SEQ ID NO: 159700 - DNA, 20 bp, Artificial Sequence
  chemically synthesized
aaagtttatactattggcag

SEQ ID NO: 159701 - DNA, 20 bp, Artificial Sequence
  chemically synthesized
gtagctgttactactgccaa

SEQ ID NO: 159702 - DNA, 20 bp, Artificial Sequence
  chemically synthesized
tatactattggcagtagtaa

SEQ ID NO: 159703 - DNA, 20 bp, Artificial Sequence
  chemically synthesized
tgttgtaagatatgaagacg

SEQ ID NO: 159704 - DNA, 20 bp, Artificial Sequence
  chemically synthesized
ttaagttgttgtaagatatg

SEQ ID NO: 159705 - DNA, 20 bp, Artificial Sequence
  chemically synthesized
atatgttattaagttgttgt

SEQ ID NO: 159706 - DNA, 20 bp, Artificial Sequence
  chemically synthesized
aatcatttggatatgttatt

SEQ ID NO: 159707 - DNA, 20 bp, Artificial Sequence
  chemically synthesized
cataatttgatcaaatcatt

SEQ ID NO: 159708 - DNA, 20 bp, Artificial Sequence
  chemically synthesized
gatcaaattatgttatttct

SEQ ID NO: 159709 - DNA, 20 bp, Artificial Sequence
  chemically synthesized
ttatgttatttctaagcatt

SEQ ID NO: 159710 - DNA, 20 bp, Artificial Sequence
  chemically synthesized
aagtaaaatttcttaatgct

SEQ ID NO: 159711 - DNA, 20 bp, Artificial Sequence
  chemically synthesized
caaacagattcagatggtga

SEQ ID NO: 159712 - DNA, 20 bp, Artificial Sequence
  chemically synthesized
taatatcaaacagattcaga

SEQ ID NO: 159713 - DNA, 20 bp, Artificial Sequence
  chemically synthesized
gtgataatatcaaacagatt

SEQ ID NO: 159714 - DNA, 20 bp, Artificial Sequence
  chemically synthesized
gcatatgtgataatatcaaa

SEQ ID NO: 159715 - DNA, 20 bp, Artificial Sequence
  chemically synthesized
gagaggtagggcatgttttt

SEQ ID NO: 159716 - DNA, 20 bp, Artificial Sequence
  chemically synthesized
tctctattatcagagaggta

SEQ ID NO: 159717 - DNA, 20 bp, Artificial Sequence
  chemically synthesized
ttctctattatcagagaggt

SEQ ID NO: 159718 - DNA, 20 bp, Artificial Sequence
  chemically synthesized
attctctattatcagagagg

SEQ ID NO: 159719 - DNA, 20 bp, Artificial Sequence
  chemically synthesized
gtgattctctattatcagag

SEQ ID NO: 159720 - DNA, 20 bp, Artificial Sequence
  chemically synthesized
agtgattctctattatcaga

SEQ ID NO: 159721 - DNA, 20 bp, Artificial Sequence
  chemically synthesized
atgccctacctctctgataa

SEQ ID NO: 159722 - DNA, 20 bp, Artificial Sequence
  chemically synthesized
atagtgattctctattatca

SEQ ID NO: 159723 - DNA, 20 bp, Artificial Sequence
  chemically synthesized
gccctacctctctgataata

SEQ ID NO: 159724 - DNA, 20 bp, Artificial Sequence
  chemically synthesized
ccatagtgattctctattat

SEQ ID NO: 159725 - DNA, 20 bp, Artificial Sequence
  chemically synthesized
ctgataatagagaatcacta

SEQ ID NO: 159726 - DNA, 20 bp, Artificial Sequence
  chemically synthesized
tgataatagagaatcactat

SEQ ID NO: 159727 - DNA, 20 bp, Artificial Sequence
  chemically synthesized
aatagagaatcactatgggt

SEQ ID NO: 159728 - DNA, 20 bp, Artificial Sequence
  chemically synthesized
tagagaatcactatgggtca

SEQ ID NO: 159729 - DNA, 20 bp, Artificial Sequence
  chemically synthesized
gcctgtctccctctgaccca

SEQ ID NO: 159730 - DNA, 20 bp, Artificial Sequence
  chemically synthesized
agagaatcactatgggtcag

SEQ ID NO: 159731 - DNA, 20 bp, Artificial Sequence
  chemically synthesized
gagaatcactatgggtcaga

SEQ ID NO: 159732 - DNA, 20 bp, Artificial Sequence
  chemically synthesized
gaatcactatgggtcagagg

SEQ ID NO: 159733 - DNA, 20 bp, Artificial Sequence
  chemically synthesized
cactatgggtcagagggaga

SEQ ID NO: 159734 - DNA, 20 bp, Artificial Sequence
  chemically synthesized
actatgggtcagagggagac

SEQ ID NO: 159735 - DNA, 20 bp, Artificial Sequence
  chemically synthesized
agacaggcaacttaatgcaa

SEQ ID NO: 159736 - DNA, 20 bp, Artificial Sequence
  chemically synthesized
ggaatgacgactgttgcatt

SEQ ID NO: 159737 - DNA, 20 bp, Artificial Sequence
  chemically synthesized
cagtcgtcattcccattcat

SEQ ID NO: 159738 - DNA, 20 bp, Artificial Sequence
  chemically synthesized
tttcaaaaattccaatgaat

SEQ ID NO: 159739 - DNA, 20 bp, Artificial Sequence
  chemically synthesized
ttttcaaaaattccaatgaa

SEQ ID NO: 159740 - DNA, 20 bp, Artificial Sequence
  chemically synthesized
ttggaatttttgaaaaatga

SEQ ID NO: 159741 - DNA, 20 bp, Artificial Sequence
  chemically synthesized
atttttgaaaaatgatagca

SEQ ID NO: 159742 - DNA, 20 bp, Artificial Sequence
  chemically synthesized
taggttggcagtgggaacaa

SEQ ID NO: 159743 - DNA, 20 bp, Artificial Sequence
  chemically synthesized
taagactgtaggttggcagt

SEQ ID NO: 159744 - DNA, 20 bp, Artificial Sequence
  chemically synthesized
ataagactgtaggttggcag

SEQ ID NO: 159745 - DNA, 20 bp, Artificial Sequence
  chemically synthesized
taaataagactgtaggttgg

SEQ ID NO: 159746 - DNA, 20 bp, Artificial Sequence
  chemically synthesized
ttgttcccactgccaaccta

SEQ ID NO: 159747 - DNA, 20 bp, Artificial Sequence
  chemically synthesized
gtttaaataagactgtaggt

SEQ ID NO: 159748 - DNA, 20 bp, Artificial Sequence
  chemically synthesized
aacagtttaaataagactgt

SEQ ID NO: 159749 - DNA, 20 bp, Artificial Sequence
  chemically synthesized
gaacagtttaaataagactg

SEQ ID NO: 159750 - DNA, 20 bp, Artificial Sequence
  chemically synthesized
ggagttggaacagtttaaat

SEQ ID NO: 159751 - DNA, 20 bp, Artificial Sequence
  chemically synthesized
aggaagcaaaggagttggaa

SEQ ID NO: 159752 - DNA, 20 bp, Artificial Sequence
  chemically synthesized
gaaggaggaagcaaaggagt

SEQ ID NO: 159753 - DNA, 20 bp, Artificial Sequence
  chemically synthesized
ttttgaaggaggaagcaaag

SEQ ID NO: 159754 - DNA, 20 bp, Artificial Sequence
  chemically synthesized
tgttttgaaggaggaagcaa

SEQ ID NO: 159755 - DNA, 20 bp, Artificial Sequence
  chemically synthesized
gtgttttgaaggaggaagca

SEQ ID NO: 159756 - DNA, 20 bp, Artificial Sequence
  chemically synthesized
gtgatgtgttttgaaggagg

SEQ ID NO: 159757 - DNA, 20 bp, Artificial Sequence
  chemically synthesized
attgtgatgtgttttgaagg

SEQ ID NO: 159758 - DNA, 20 bp, Artificial Sequence
  chemically synthesized
aattgtgatgtgttttgaag

SEQ ID NO: 159759 - DNA, 20 bp, Artificial Sequence
  chemically synthesized
ttaattgtgatgtgttttga

SEQ ID NO: 159760 - DNA, 20 bp, Artificial Sequence
  chemically synthesized
attaattgtgatgtgttttg

SEQ ID NO: 159761 - DNA, 20 bp, Artificial Sequence
  chemically synthesized
tcacattatgtgtatatgta

SEQ ID NO: 159762 - DNA, 20 bp, Artificial Sequence
  chemically synthesized
tatagttttgaccattccta

SEQ ID NO: 159763 - DNA, 20 bp, Artificial Sequence
  chemically synthesized
agaggataattctttaggaa

SEQ ID NO: 159764 - DNA, 20 bp, Artificial Sequence
  chemically synthesized
ctcatagaggataattcttt

SEQ ID NO: 159765 - DNA, 20 bp, Artificial Sequence
  chemically synthesized
tctcatagaggataattctt

SEQ ID NO: 159766 - DNA, 20 bp, Artificial Sequence
  chemically synthesized
cctaaagaattatcctctat

SEQ ID NO: 159767 - DNA, 20 bp, Artificial Sequence
  chemically synthesized
taaagaattatcctctatga

SEQ ID NO: 159768 - DNA, 20 bp, Artificial Sequence
  chemically synthesized
tatgggtcttactctcatag

SEQ ID NO: 159769 - DNA, 20 bp, Artificial Sequence
  chemically synthesized
ttatgggtcttactctcata

SEQ ID NO: 159770 - DNA, 20 bp, Artificial Sequence
  chemically synthesized
gaattatcctctatgagagt

SEQ ID NO: 159771 - DNA, 20 bp, Artificial Sequence
  chemically synthesized
agttatgggtcttactctca

SEQ ID NO: 159772 - DNA, 20 bp, Artificial Sequence
  chemically synthesized
tgagtgaacaaggtagttat

SEQ ID NO: 159773 - DNA, 20 bp, Artificial Sequence
  chemically synthesized
atgagtgaacaaggtagtta

SEQ ID NO: 159774 - DNA, 20 bp, Artificial Sequence
  chemically synthesized
agggatatgagtgaacaagg

SEQ ID NO: 159775 - DNA, 20 bp, Artificial Sequence
  chemically synthesized
tccagggatatgagtgaaca

SEQ ID NO: 159776 - DNA, 20 bp, Artificial Sequence
  chemically synthesized
ttccagggatatgagtgaac

SEQ ID NO: 159777 - DNA, 20 bp, Artificial Sequence
  chemically synthesized
accttgttcactcatatccc

SEQ ID NO: 159778 - DNA, 20 bp, Artificial Sequence
  chemically synthesized
ttaggcacttccagggatat

SEQ ID NO: 159779 - DNA, 20 bp, Artificial Sequence
  chemically synthesized
ttgttcactcatatccctgg

SEQ ID NO: 159780 - DNA, 20 bp, Artificial Sequence
  chemically synthesized
ctatgtgttaggcacttcca

SEQ ID NO: 159781 - DNA, 20 bp, Artificial Sequence
  chemically synthesized
actatgtgttaggcacttcc

SEQ ID NO: 159782 - DNA, 20 bp, Artificial Sequence
  chemically synthesized
tactatgtgttaggcacttc

SEQ ID NO: 159783 - DNA, 20 bp, Artificial Sequence
  chemically synthesized
ccctggaagtgcctaacaca

SEQ ID NO: 159784 - DNA, 20 bp, Artificial Sequence
  chemically synthesized
tttagcacttactatgtgtt

SEQ ID NO: 159785 - DNA, 20 bp, Artificial Sequence
  chemically synthesized
gtttagcacttactatgtgt

SEQ ID NO: 159786 - DNA, 20 bp, Artificial Sequence
  chemically synthesized
ggaagtgcctaacacatagt

SEQ ID NO: 159787 - DNA, 20 bp, Artificial Sequence
  chemically synthesized
ccgttcaacggttttttgtt

SEQ ID NO: 159788 - DNA, 20 bp, Artificial Sequence
  chemically synthesized
ctaaacaaaaaaccgttgaa

SEQ ID NO: 159789 - DNA, 20 bp, Artificial Sequence
  chemically synthesized
taaacaaaaaaccgttgaac

SEQ ID NO: 159790 - DNA, 20 bp, Artificial Sequence
  chemically synthesized
gtatttatttgcccgttcaa

SEQ ID NO: 159791 - DNA, 20 bp, Artificial Sequence
  chemically synthesized
ccataggctcaaagttgcaa

SEQ ID NO: 159792 - DNA, 20 bp, Artificial Sequence
  chemically synthesized
ataaatactgttgcaacttt

SEQ ID NO: 159793 - DNA, 20 bp, Artificial Sequence
  chemically synthesized
actcaattcccataggctca

SEQ ID NO: 159794 - DNA, 20 bp, Artificial Sequence
  chemically synthesized
ctgttgcaactttgagccta

SEQ ID NO: 159795 - DNA, 20 bp, Artificial Sequence
  chemically synthesized
tgttgcaactttgagcctat

SEQ ID NO: 159796 - DNA, 20 bp, Artificial Sequence
  chemically synthesized
actcttaactcaattcccat

SEQ ID NO: 159797 - DNA, 20 bp, Artificial Sequence
  chemically synthesized
cactcttaactcaattccca

SEQ ID NO: 159798 - DNA, 20 bp, Artificial Sequence
  chemically synthesized
actttgagcctatgggaatt

SEQ ID NO: 159799 - DNA, 20 bp, Artificial Sequence
  chemically synthesized
gagcctatgggaattgagtt

SEQ ID NO: 159800 - DNA, 20 bp, Artificial Sequence
  chemically synthesized
gcctatgggaattgagttaa

SEQ ID NO: 159801 - DNA, 20 bp, Artificial Sequence
  chemically synthesized
gagttaagagtgtgtattac

SEQ ID NO: 159802 - DNA, 20 bp, Artificial Sequence
  chemically synthesized
gttaagagtgtgtattacta

SEQ ID NO: 159803 - DNA, 20 bp, Artificial Sequence
  chemically synthesized
tctgcgtgaacaaatgtctc

SEQ ID NO: 159804 - DNA, 20 bp, Artificial Sequence
  chemically synthesized
actagagacatttgttcacg

SEQ ID NO: 159805 - DNA, 20 bp, Artificial Sequence
  chemically synthesized
gagacatttgttcacgcaga

SEQ ID NO: 159806 - DNA, 20 bp, Artificial Sequence
  chemically synthesized
ttgttcacgcagacagtcga

SEQ ID NO: 159807 - DNA, 20 bp, Artificial Sequence
  chemically synthesized
tgttcacgcagacagtcgaa

SEQ ID NO: 159808 - DNA, 20 bp, Artificial Sequence
  chemically synthesized
gcagacagtcgaaaggttca

SEQ ID NO: 159809 - DNA, 20 bp, Artificial Sequence
  chemically synthesized
cagtcgaaaggttcatggca

SEQ ID NO: 159810 - DNA, 20 bp, Artificial Sequence
  chemically synthesized
cagattatttagaaagaaaa

SEQ ID NO: 159811 - DNA, 20 bp, Artificial Sequence
  chemically synthesized
actctagcagattatttaga

SEQ ID NO: 159812 - DNA, 20 bp, Artificial Sequence
  chemically synthesized
tttaactctagcagattatt

SEQ ID NO: 159813 - DNA, 20 bp, Artificial Sequence
  chemically synthesized
tttctttctaaataatctgc

SEQ ID NO: 159814 - DNA, 20 bp, Artificial Sequence
  chemically synthesized
tctttctaaataatctgcta

SEQ ID NO: 159815 - DNA, 20 bp, Artificial Sequence
  chemically synthesized
gactctgtatttaactctag

SEQ ID NO: 159816 - DNA, 20 bp, Artificial Sequence
  chemically synthesized
gtagactctgtatttaactc

SEQ ID NO: 159817 - DNA, 20 bp, Artificial Sequence
  chemically synthesized
taatctgctagagttaaata

SEQ ID NO: 159818 - DNA, 20 bp, Artificial Sequence
  chemically synthesized
atctgctagagttaaataca

SEQ ID NO: 159819 - DNA, 20 bp, Artificial Sequence
  chemically synthesized
gaaatccaaaagcagaagag

SEQ ID NO: 159820 - DNA, 20 bp, Artificial Sequence
  chemically synthesized
cgggaaatccaaaagcagaa

SEQ ID NO: 159821 - DNA, 20 bp, Artificial Sequence
  chemically synthesized
agagtctactcttctgcttt

SEQ ID NO: 159822 - DNA, 20 bp, Artificial Sequence
  chemically synthesized
tacgggaaatccaaaagcag

SEQ ID NO: 159823 - DNA, 20 bp, Artificial Sequence
  chemically synthesized
cattacgggaaatccaaaag

SEQ ID NO: 159824 - DNA, 20 bp, Artificial Sequence
  chemically synthesized
aatcattacgggaaatccaa

SEQ ID NO: 159825 - DNA, 20 bp, Artificial Sequence
  chemically synthesized
tttgcaaaaaaaatcattac

SEQ ID NO: 159826 - DNA, 20 bp, Artificial Sequence
  chemically synthesized
ttttgcaaaaaaaatcatta

SEQ ID NO: 159827 - DNA, 20 bp, Artificial Sequence
  chemically synthesized
ttgttgtaatcaataacgtg

SEQ ID NO: 159828 - DNA, 20 bp, Artificial Sequence
  chemically synthesized
tattgattacaacaatgtct

SEQ ID NO: 159829 - DNA, 20 bp, Artificial Sequence
  chemically synthesized
gtcatagaaatgagttttct

SEQ ID NO: 159830 - DNA, 20 bp, Artificial Sequence
  chemically synthesized
ttttaatttgtcatagaaat

SEQ ID NO: 159831 - DNA, 20 bp, Artificial Sequence
  chemically synthesized
aatcccattttaatttgtca

SEQ ID NO: 159832 - DNA, 20 bp, Artificial Sequence
  chemically synthesized
atttctatgacaaattaaaa

SEQ ID NO: 159833 - DNA, 20 bp, Artificial Sequence
  chemically synthesized
tttctatgacaaattaaaat

SEQ ID NO: 159834 - DNA, 20 bp, Artificial Sequence
  chemically synthesized
agtcaatgaaaggattaatt

SEQ ID NO: 159835 - DNA, 20 bp, Artificial Sequence
  chemically synthesized
gtttaaaggaagtcaatgaa

SEQ ID NO: 159836 - DNA, 20 bp, Artificial Sequence
  chemically synthesized
agtttaaaggaagtcaatga

SEQ ID NO: 159837 - DNA, 20 bp, Artificial Sequence
  chemically synthesized
atggaattttagtttaaagg

SEQ ID NO: 159838 - DNA, 20 bp, Artificial Sequence
  chemically synthesized
taaatggaattttagtttaa

SEQ ID NO: 159839 - DNA, 20 bp, Artificial Sequence
  chemically synthesized
ataaatggaattttagttta

SEQ ID NO: 159840 - DNA, 20 bp, Artificial Sequence
  chemically synthesized
atgtgggataaatggaattt

SEQ ID NO: 159841 - DNA, 20 bp, Artificial Sequence
  chemically synthesized
gaagaaaaatgtgggataaa

SEQ ID NO: 159842 - DNA, 20 bp, Artificial Sequence
  chemically synthesized
tcagctaagaagaaaaatgt

SEQ ID NO: 159843 - DNA, 20 bp, Artificial Sequence
  chemically synthesized
ttcagctaagaagaaaaatg

SEQ ID NO: 159844 - DNA, 20 bp, Artificial Sequence
  chemically synthesized
ttatcccacatttttcttct

SEQ ID NO: 159845 - DNA, 20 bp, Artificial Sequence
  chemically synthesized
attatacaaattcagctaag

SEQ ID NO: 159846 - DNA, 20 bp, Artificial Sequence
  chemically synthesized
taaattatacaaattcagct

SEQ ID NO: 159847 - DNA, 20 bp, Artificial Sequence
  chemically synthesized
gagattaaattatacaaatt

SEQ ID NO: 159848 - DNA, 20 bp, Artificial Sequence
  chemically synthesized
tgtataatttaatctccatc

SEQ ID NO: 159849 - DNA, 20 bp, Artificial Sequence
  chemically synthesized
ttctcttggattgctagatg

SEQ ID NO: 159850 - DNA, 20 bp, Artificial Sequence
  chemically synthesized
tgttctcttggattgctaga

SEQ ID NO: 159851 - DNA, 20 bp, Artificial Sequence
  chemically synthesized
taatctccatctagcaatcc

SEQ ID NO: 159852 - DNA, 20 bp, Artificial Sequence
  chemically synthesized
gtgatgttctcttggattgc

SEQ ID NO: 159853 - DNA, 20 bp, Artificial Sequence
  chemically synthesized
atctccatctagcaatccaa

SEQ ID NO: 159854 - DNA, 20 bp, Artificial Sequence
  chemically synthesized
ttgtatttgtgatgttctct

SEQ ID NO: 159855 - DNA, 20 bp, Artificial Sequence
  chemically synthesized
catcacaaatacaaatgttt

SEQ ID NO: 159856 - DNA, 20 bp, Artificial Sequence
  chemically synthesized
gttttagcatttatatgatt

SEQ ID NO: 159857 - DNA, 20 bp, Artificial Sequence
  chemically synthesized
gaggtcccacattcagatgt

SEQ ID NO: 159858 - DNA, 20 bp, Artificial Sequence
  chemically synthesized
atataaccaacatctgaatg

SEQ ID NO: 159859 - DNA, 20 bp, Artificial Sequence
  chemically synthesized
tataaccaacatctgaatgt

SEQ ID NO: 159860 - DNA, 20 bp, Artificial Sequence
  chemically synthesized
ctgattagaggtcccacatt

SEQ ID NO: 159861 - DNA, 20 bp, Artificial Sequence
  chemically synthesized
ctgaatgtgggacctctaat

SEQ ID NO: 159862 - DNA, 20 bp, Artificial Sequence
  chemically synthesized
tgaatgtgggacctctaatc

SEQ ID NO: 159863 - DNA, 20 bp, Artificial Sequence
  chemically synthesized
gttataaagtacctgattag

SEQ ID NO: 159864 - DNA, 20 bp, Artificial Sequence
  chemically synthesized
agttataaagtacctgatta

SEQ ID NO: 159865 - DNA, 20 bp, Artificial Sequence
  chemically synthesized
atagttataaagtacctgat

SEQ ID NO: 159866 - DNA, 20 bp, Artificial Sequence
  chemically synthesized
cttcaagtgcaatagttata

SEQ ID NO: 159867 - DNA, 20 bp, Artificial Sequence
  chemically synthesized
ttactatgcttcaagtgcaa

SEQ ID NO: 159868 - DNA, 20 bp, Artificial Sequence
  chemically synthesized
ctttataactattgcacttg

SEQ ID NO: 159869 - DNA, 20 bp, Artificial Sequence
  chemically synthesized
taactattgcacttgaagca

SEQ ID NO: 159870 - DNA, 20 bp, Artificial Sequence
  chemically synthesized
ataaatgtttactatgcttc

SEQ ID NO: 159871 - DNA, 20 bp, Artificial Sequence
  chemically synthesized
gaagcatagtaaacatttat

SEQ ID NO: 159872 - DNA, 20 bp, Artificial Sequence
  chemically synthesized
ttagttttgatttgtaattc

SEQ ID NO: 159873 - DNA, 20 bp, Artificial Sequence
  chemically synthesized
gttttgatttgtaattccag

SEQ ID NO: 159874 - DNA, 20 bp, Artificial Sequence
  chemically synthesized
ttgatttgtaattccagtag

SEQ ID NO: 159875 - DNA, 20 bp, Artificial Sequence
  chemically synthesized
gatttgtaattccagtagaa

SEQ ID NO: 159876 - DNA, 20 bp, Artificial Sequence
  chemically synthesized
ttccaagtttactcttctac

SEQ ID NO: 159877 - DNA, 20 bp, Artificial Sequence
  chemically synthesized
ttccagtagaagagtaaact

SEQ ID NO: 159878 - DNA, 20 bp, Artificial Sequence
  chemically synthesized
agtagaagagtaaacttgga

SEQ ID NO: 159879 - DNA, 20 bp, Artificial Sequence
  chemically synthesized
gtagaagagtaaacttggaa

SEQ ID NO: 159880 - DNA, 20 bp, Artificial Sequence
  chemically synthesized
tatgatcctccagcctttcc

SEQ ID NO: 159881 - DNA, 20 bp, Artificial Sequence
  chemically synthesized
aagagtaaacttggaaaggc

SEQ ID NO: 159882 - DNA, 20 bp, Artificial Sequence
  chemically synthesized
gagtaaacttggaaaggctg

SEQ ID NO: 159883 - DNA, 20 bp, Artificial Sequence
  chemically synthesized
agtaaacttggaaaggctgg

SEQ ID NO: 159884 - DNA, 20 bp, Artificial Sequence
  chemically synthesized
gtataggaaatatgatcctc

SEQ ID NO: 159885 - DNA, 20 bp, Artificial Sequence
  chemically synthesized
agaagtttttagatttgtat

SEQ ID NO: 159886 - DNA, 20 bp, Artificial Sequence
  chemically synthesized
tagaagtttttagatttgta

SEQ ID NO: 159887 - DNA, 20 bp, Artificial Sequence
  chemically synthesized
ttaatactcatagaagtttt

SEQ ID NO: 159888 - DNA, 20 bp, Artificial Sequence
  chemically synthesized
acaaatctaaaaacttctat

SEQ ID NO: 159889 - DNA, 20 bp, Artificial Sequence
  chemically synthesized
acaggttttaatactcatag

SEQ ID NO: 159890 - DNA, 20 bp, Artificial Sequence
  chemically synthesized
atcacaggttttaatactca

SEQ ID NO: 159891 - DNA, 20 bp, Artificial Sequence
  chemically synthesized
tttccatgctagtacatcac

SEQ ID NO: 159892 - DNA, 20 bp, Artificial Sequence
  chemically synthesized
ttttccatgctagtacatca

SEQ ID NO: 159893 - DNA, 20 bp, Artificial Sequence
  chemically synthesized
tattaaaacctgtgatgtac

SEQ ID NO: 159894 - DNA, 20 bp, Artificial Sequence
  chemically synthesized
aaacctgtgatgtactagca

SEQ ID NO: 159895 - DNA, 20 bp, Artificial Sequence
  chemically synthesized
aaagatgagcttttccatgc

SEQ ID NO: 159896 - DNA, 20 bp, Artificial Sequence
  chemically synthesized
tgtgatgtactagcatggaa

SEQ ID NO: 159897 - DNA, 20 bp, Artificial Sequence
  chemically synthesized
gagtgtttgaaaggaaagat

SEQ ID NO: 159898 - DNA, 20 bp, Artificial Sequence
  chemically synthesized
agtgggagtgtttgaaagga

SEQ ID NO: 159899 - DNA, 20 bp, Artificial Sequence
  chemically synthesized
gtgaagtgggagtgtttgaa

SEQ ID NO: 159900 - DNA, 20 bp, Artificial Sequence
  chemically synthesized
agtgaagtgggagtgtttga

SEQ ID NO: 159901 - DNA, 20 bp, Artificial Sequence
  chemically synthesized
gaaaaagaaaagtgaagtgg

SEQ ID NO: 159902 - DNA, 20 bp, Artificial Sequence
  chemically synthesized
gtgaaaaagaaaagtgaagt

SEQ ID NO: 159903 - DNA, 20 bp, Artificial Sequence
  chemically synthesized
agtgaaaaagaaaagtgaag

SEQ ID NO: 159904 - DNA, 20 bp, Artificial Sequence
  chemically synthesized
atgagtgaaaaagaaaagtg

SEQ ID NO: 159905 - DNA, 20 bp, Artificial Sequence
  chemically synthesized
gctcgatgagtgaaaaagaa

SEQ ID NO: 159906 - DNA, 20 bp, Artificial Sequence
  chemically synthesized
cctatgctcgatgagtgaaa

SEQ ID NO: 159907 - DNA, 20 bp, Artificial Sequence
  chemically synthesized
acttttctttttcactcatc

SEQ ID NO: 159908 - DNA, 20 bp, Artificial Sequence
  chemically synthesized
attgacttcctatgctcgat

SEQ ID NO: 159909 - DNA, 20 bp, Artificial Sequence
  chemically synthesized
tctttttcactcatcgagca

SEQ ID NO: 159910 - DNA, 20 bp, Artificial Sequence
  chemically synthesized
ctttttcactcatcgagcat

SEQ ID NO: 159911 - DNA, 20 bp, Artificial Sequence
  chemically synthesized
tttcactcatcgagcatagg

SEQ ID NO: 159912 - DNA, 20 bp, Artificial Sequence
  chemically synthesized
taaatttaagggaatatgag

SEQ ID NO: 159913 - DNA, 20 bp, Artificial Sequence
  chemically synthesized
attaaatttaagggaatatg

SEQ ID NO: 159914 - DNA, 20 bp, Artificial Sequence
  chemically synthesized
cattaaatttaagggaatat

SEQ ID NO: 159915 - DNA, 20 bp, Artificial Sequence
  chemically synthesized
gagggacacattaaatttaa

SEQ ID NO: 159916 - DNA, 20 bp, Artificial Sequence
  chemically synthesized
agagggacacattaaattta

SEQ ID NO: 159917 - DNA, 20 bp, Artificial Sequence
  chemically synthesized
cagagggacacattaaattt

SEQ ID NO: 159918 - DNA, 20 bp, Artificial Sequence
  chemically synthesized
gatctgtattgggggacaga

SEQ ID NO: 159919 - DNA, 20 bp, Artificial Sequence
  chemically synthesized
tgatctgtattgggggacag

SEQ ID NO: 159920 - DNA, 20 bp, Artificial Sequence
  chemically synthesized
atgatctgtattgggggaca

SEQ ID NO: 159921 - DNA, 20 bp, Artificial Sequence
  chemically synthesized
aaatgatctgtattggggga

SEQ ID NO: 159922 - DNA, 20 bp, Artificial Sequence
  chemically synthesized
tgtccctctgtcccccaata

SEQ ID NO: 159923 - DNA, 20 bp, Artificial Sequence
  chemically synthesized
atacaaatgatctgtattgg

SEQ ID NO: 159924 - DNA, 20 bp, Artificial Sequence
  chemically synthesized
aatacaaatgatctgtattg

SEQ ID NO: 159925 - DNA, 20 bp, Artificial Sequence
  chemically synthesized
aaatacaaatgatctgtatt

SEQ ID NO: 159926 - DNA, 20 bp, Artificial Sequence
  chemically synthesized
caaatacaaatgatctgtat

SEQ ID NO: 159927 - DNA, 20 bp, Artificial Sequence
  chemically synthesized
aatactatgaaaacaaaagt

SEQ ID NO: 159928 - DNA, 20 bp, Artificial Sequence
  chemically synthesized
tataaatactatgaaaacaa

SEQ ID NO: 159929 - DNA, 20 bp, Artificial Sequence
  chemically synthesized
tgatctaacttttgttttca

SEQ ID NO: 159930 - DNA, 20 bp, Artificial Sequence
  chemically synthesized
agtttggtgttcagtgcaaa

SEQ ID NO: 159931 - DNA, 20 bp, Artificial Sequence
  chemically synthesized
tagtttggtgttcagtgcaa

SEQ ID NO: 159932 - DNA, 20 bp, Artificial Sequence
  chemically synthesized
aatataagtagtttggtgtt

SEQ ID NO: 159933 - DNA, 20 bp, Artificial Sequence
  chemically synthesized
ttggaataatataagtagtt

SEQ ID NO: 159934 - DNA, 20 bp, Artificial Sequence
  chemically synthesized
aaaggttggaataatataag

SEQ ID NO: 159935 - DNA, 20 bp, Artificial Sequence
  chemically synthesized
tttaaaggttggaataatat

SEQ ID NO: 159936 - DNA, 20 bp, Artificial Sequence
  chemically synthesized
tataaatcttttttaaaggt

SEQ ID NO: 159937 - DNA, 20 bp, Artificial Sequence
  chemically synthesized
tattattccaacctttaaaa

SEQ ID NO: 159938 - DNA, 20 bp, Artificial Sequence
  chemically synthesized
gaaatataaatcttttttaa

SEQ ID NO: 159939 - DNA, 20 bp, Artificial Sequence
  chemically synthesized
agaaatataaatctttttta

SEQ ID NO: 159940 - DNA, 20 bp, Artificial Sequence
  chemically synthesized
aagatttatatttctaaaat

SEQ ID NO: 159941 - DNA, 20 bp, Artificial Sequence
  chemically synthesized
gatttatatttctaaaattg

SEQ ID NO: 159942 - DNA, 20 bp, Artificial Sequence
  chemically synthesized
ttgaatacgcactccaattt

SEQ ID NO: 159943 - DNA, 20 bp, Artificial Sequence
  chemically synthesized
aaattggagtgcgtattcaa

SEQ ID NO: 159944 - DNA, 20 bp, Artificial Sequence
  chemically synthesized
tattgaatagatgatgcagc

SEQ ID NO: 159945 - DNA, 20 bp, Artificial Sequence
  chemically synthesized
atattgaatagatgatgcag

SEQ ID NO: 159946 - DNA, 20 bp, Artificial Sequence
  chemically synthesized
aatatattgaatagatgatg

SEQ ID NO: 159947 - DNA, 20 bp, Artificial Sequence
  chemically synthesized
tagcttataaatatattgaa

SEQ ID NO: 159948 - DNA, 20 bp, Artificial Sequence
  chemically synthesized
catctattcaatatatttat

SEQ ID NO: 159949 - DNA, 20 bp, Artificial Sequence
  chemically synthesized
tattcaatatatttataagc

SEQ ID NO: 159950 - DNA, 20 bp, Artificial Sequence
  chemically synthesized
ttcaatatatttataagcta

SEQ ID NO: 159951 - DNA, 20 bp, Artificial Sequence
  chemically synthesized
tatatttataagctagagat

SEQ ID NO: 159952 - DNA, 20 bp, Artificial Sequence
  chemically synthesized
atatttataagctagagatt

SEQ ID NO: 159953 - DNA, 20 bp, Artificial Sequence
  chemically synthesized
tagtgctgtatcccaatctc

SEQ ID NO: 159954 - DNA, 20 bp, Artificial Sequence
  chemically synthesized
ataagctagagattgggata

SEQ ID NO: 159955 - DNA, 20 bp, Artificial Sequence
  chemically synthesized
tagagattgggatacagcac

SEQ ID NO: 159956 - DNA, 20 bp, Artificial Sequence
  chemically synthesized
attgtaaattgaaaattttc

SEQ ID NO: 159957 - DNA, 20 bp, Artificial Sequence
  chemically synthesized
gtatatacatatatgtgtat

SEQ ID NO: 159958 - DNA, 20 bp, Artificial Sequence
  chemically synthesized
atacacatacacatatgtgt

SEQ ID NO: 159959 - DNA, 20 bp, Artificial Sequence
  chemically synthesized
cacatacacatatgtgtgag

SEQ ID NO: 159960 - DNA, 20 bp, Artificial Sequence
  chemically synthesized
catatgtgtgagtggatata

SEQ ID NO: 159961 - DNA, 20 bp, Artificial Sequence
  chemically synthesized
gacacatgtatgtatatgta

SEQ ID NO: 159962 - DNA, 20 bp, Artificial Sequence
  chemically synthesized
acacatgtatgtatatgtac

SEQ ID NO: 159963 - DNA, 20 bp, Artificial Sequence
  chemically synthesized
aggcaaaactcagtaaaatg

SEQ ID NO: 159964 - DNA, 20 bp, Artificial Sequence
  chemically synthesized
aaggcaaaactcagtaaaat

SEQ ID NO: 159965 - DNA, 20 bp, Artificial Sequence
  chemically synthesized
caggtatacctcattttact

SEQ ID NO: 159966 - DNA, 20 bp, Artificial Sequence
  chemically synthesized
agagccaataaggcaaaact

SEQ ID NO: 159967 - DNA, 20 bp, Artificial Sequence
  chemically synthesized
tttactgagttttgccttat

SEQ ID NO: 159968 - DNA, 20 bp, Artificial Sequence
  chemically synthesized
cagtatctgcagagccaata

SEQ ID NO: 159969 - DNA, 20 bp, Artificial Sequence
  chemically synthesized
gcagtatctgcagagccaat

SEQ ID NO: 159970 - DNA, 20 bp, Artificial Sequence
  chemically synthesized
gttttgccttattggctctg

SEQ ID NO: 159971 - DNA, 20 bp, Artificial Sequence
  chemically synthesized
aaaaaaaagcagtatctgca

SEQ ID NO: 159972 - DNA, 20 bp, Artificial Sequence
  chemically synthesized
aaaaaaaaaagcagtatctg

SEQ ID NO: 159973 - DNA, 20 bp, Artificial Sequence
  chemically synthesized
aaaaaaaaaaaaaaaaaaag

SEQ ID NO: 159974 - DNA, 20 bp, Artificial Sequence
  chemically synthesized
taaaaaaaaaaaaaaaaaaa

SEQ ID NO: 159975 - DNA, 20 bp, Artificial Sequence
  chemically synthesized
ttttttttttttacaaactg

SEQ ID NO: 159976 - DNA, 20 bp, Artificial Sequence
  chemically synthesized
tttttttttttacaaactga

SEQ ID NO: 159977 - DNA, 20 bp, Artificial Sequence
  chemically synthesized
gcagggttgctacaaacctt

SEQ ID NO: 159978 - DNA, 20 bp, Artificial Sequence
  chemically synthesized
ttttacaaactgaaggtttg

SEQ ID NO: 159979 - DNA, 20 bp, Artificial Sequence
  chemically synthesized
gtttgtagcaaccctgcatc

SEQ ID NO: 159980 - DNA, 20 bp, Artificial Sequence
  chemically synthesized
tgatagacttgcttgatgca

SEQ ID NO: 159981 - DNA, 20 bp, Artificial Sequence
  chemically synthesized
ctgatagacttgcttgatgc

SEQ ID NO: 159982 - DNA, 20 bp, Artificial Sequence
  chemically synthesized
gctgatagacttgcttgatg

SEQ ID NO: 159983 - DNA, 20 bp, Artificial Sequence
  chemically synthesized
gtagcaaccctgcatcaagc

SEQ ID NO: 159984 - DNA, 20 bp, Artificial Sequence
  chemically synthesized
cctgcatcaagcaagtctat

SEQ ID NO: 159985 - DNA, 20 bp, Artificial Sequence
  chemically synthesized
ggtgttggaaatgttgctga

SEQ ID NO: 159986 - DNA, 20 bp, Artificial Sequence
  chemically synthesized
atgaagtaagcacatggtgt

SEQ ID NO: 159987 - DNA, 20 bp, Artificial Sequence
  chemically synthesized
agagacatgaagtaagcaca

SEQ ID NO: 159988 - DNA, 20 bp, Artificial Sequence
  chemically synthesized
gtgacacagagacatgaagt

SEQ ID NO: 159989 - DNA, 20 bp, Artificial Sequence
  chemically synthesized
aattgtgacacagagacatg

SEQ ID NO: 159990 - DNA, 20 bp, Artificial Sequence
  chemically synthesized
aattatcaaattgtgacaca

SEQ ID NO: 159991 - DNA, 20 bp, Artificial Sequence
  chemically synthesized
agaattatcaaattgtgaca

SEQ ID NO: 159992 - DNA, 20 bp, Artificial Sequence
  chemically synthesized
gaaaaagcttgaaatattgt

SEQ ID NO: 159993 - DNA, 20 bp, Artificial Sequence
  chemically synthesized
gataattctcacaatatttc

SEQ ID NO: 159994 - DNA, 20 bp, Artificial Sequence
  chemically synthesized
cagttataaaaatattgaaa

SEQ ID NO: 159995 - DNA, 20 bp, Artificial Sequence
  chemically synthesized
caatatttttataactgtta

SEQ ID NO: 159996 - DNA, 20 bp, Artificial Sequence
  chemically synthesized
ctgattacccatcaccataa

SEQ ID NO: 159997 - DNA, 20 bp, Artificial Sequence
  chemically synthesized
ttttataactgttatggtga

SEQ ID NO: 159998 - DNA, 20 bp, Artificial Sequence
  chemically synthesized
tttataactgttatggtgat

SEQ ID NO: 159999 - DNA, 20 bp, Artificial Sequence
  chemically synthesized
ctgttatggtgatgggtaat

SEQ ID NO: 160000 - DNA, 20 bp, Artificial Sequence
  chemically synthesized
ctattaaaatagtaacatca

SEQ ID NO: 160001 - DNA, 20 bp, Artificial Sequence
  chemically synthesized
ctttgatgttactattttaa

SEQ ID NO: 160002 - DNA, 20 bp, Artificial Sequence
  chemically synthesized
gcaccctgaaactattaaaa

SEQ ID NO: 160003 - DNA, 20 bp, Artificial Sequence
  chemically synthesized
tgttactattttaatagttt

SEQ ID NO: 160004 - DNA, 20 bp, Artificial Sequence
  chemically synthesized
gttactattttaatagtttc

SEQ ID NO: 160005 - DNA, 20 bp, Artificial Sequence
  chemically synthesized
ttactattttaatagtttca

SEQ ID NO: 160006 - DNA, 20 bp, Artificial Sequence
  chemically synthesized
tagtttcagggtgccacaaa

SEQ ID NO: 160007 - DNA, 20 bp, Artificial Sequence
  chemically synthesized
tcctatatgggcactgtttg

SEQ ID NO: 160008 - DNA, 20 bp, Artificial Sequence
  chemically synthesized
tgccacaaacagtgcccata

SEQ ID NO: 160009 - DNA, 20 bp, Artificial Sequence
  chemically synthesized
gccacaaacagtgcccatat

SEQ ID NO: 160010 - DNA, 20 bp, Artificial Sequence
  chemically synthesized
ttaagtttgccatcctatat

SEQ ID NO: 160011 - DNA, 20 bp, Artificial Sequence
  chemically synthesized
caaacagtgcccatatagga

SEQ ID NO: 160012 - DNA, 20 bp, Artificial Sequence
  chemically synthesized
attaagtttgccatcctata

SEQ ID NO: 160013 - DNA, 20 bp, Artificial Sequence
  chemically synthesized
aatacatacattaatggatt

SEQ ID NO: 160014 - DNA, 20 bp, Artificial Sequence
  chemically synthesized
gttcagaatacatacattaa

SEQ ID NO: 160015 - DNA, 20 bp, Artificial Sequence
  chemically synthesized
tgactggtcagtggagcgtt

SEQ ID NO: 160016 - DNA, 20 bp, Artificial Sequence
  chemically synthesized
attctgaacgctccactgac

SEQ ID NO: 160017 - DNA, 20 bp, Artificial Sequence
  chemically synthesized
agggggatgactggtcagtg

SEQ ID NO: 160018 - DNA, 20 bp, Artificial Sequence
  chemically synthesized
gtagggggatgactggtcag

SEQ ID NO: 160019 - DNA, 20 bp, Artificial Sequence
  chemically synthesized
gaggtagggggatgactggt

SEQ ID NO: 160020 - DNA, 20 bp, Artificial Sequence
  chemically synthesized
aagagaggtagggggatgac

SEQ ID NO: 160021 - DNA, 20 bp, Artificial Sequence
  chemically synthesized
aggagaggaagagaggtagg

SEQ ID NO: 160022 - DNA, 20 bp, Artificial Sequence
  chemically synthesized
aaggagaggaagagaggtag

SEQ ID NO: 160023 - DNA, 20 bp, Artificial Sequence
  chemically synthesized
caaggagaggaagagaggta

SEQ ID NO: 160024 - DNA, 20 bp, Artificial Sequence
  chemically synthesized
ccaaggagaggaagagaggt

SEQ ID NO: 160025 - DNA, 20 bp, Artificial Sequence
  chemically synthesized
cccaaggagaggaagagagg

SEQ ID NO: 160026 - DNA, 20 bp, Artificial Sequence
  chemically synthesized
aggcccaaggagaggaagag

SEQ ID NO: 160027 - DNA, 20 bp, Artificial Sequence
  chemically synthesized
gaggcccaaggagaggaaga

SEQ ID NO: 160028 - DNA, 20 bp, Artificial Sequence
  chemically synthesized
gggaggcccaaggagaggaa

SEQ ID NO: 160029 - DNA, 20 bp, Artificial Sequence
  chemically synthesized
tagggaggcccaaggagagg

SEQ ID NO: 160030 - DNA, 20 bp, Artificial Sequence
  chemically synthesized
cctacctctcttcctctcct

SEQ ID NO: 160031 - DNA, 20 bp, Artificial Sequence
  chemically synthesized
ctacctctcttcctctcctt

SEQ ID NO: 160032 - DNA, 20 bp, Artificial Sequence
  chemically synthesized
gaatagggaggcccaaggag

SEQ ID NO: 160033 - DNA, 20 bp, Artificial Sequence
  chemically synthesized
agaatagggaggcccaagga

SEQ ID NO: 160034 - DNA, 20 bp, Artificial Sequence
  chemically synthesized
tcagaatagggaggcccaag

SEQ ID NO: 160035 - DNA, 20 bp, Artificial Sequence
  chemically synthesized
tctcagaatagggaggccca

SEQ ID NO: 160036 - DNA, 20 bp, Artificial Sequence
  chemically synthesized
gtctcagaatagggaggccc

SEQ ID NO: 160037 - DNA, 20 bp, Artificial Sequence
  chemically synthesized
tgttgtgtctcagaataggg

SEQ ID NO: 160038 - DNA, 20 bp, Artificial Sequence
  chemically synthesized
ttgttgtgtctcagaatagg

SEQ ID NO: 160039 - DNA, 20 bp, Artificial Sequence
  chemically synthesized
tccttgggcctccctattct

SEQ ID NO: 160040 - DNA, 20 bp, Artificial Sequence
  chemically synthesized
tattgttgtgtctcagaata

SEQ ID NO: 160041 - DNA, 20 bp, Artificial Sequence
  chemically synthesized
atattgttgtgtctcagaat

SEQ ID NO: 160042 - DNA, 20 bp, Artificial Sequence
  chemically synthesized
aatattgttgtgtctcagaa

SEQ ID NO: 160043 - DNA, 20 bp, Artificial Sequence
  chemically synthesized
atttcaatattgttgtgtct

SEQ ID NO: 160044 - DNA, 20 bp, Artificial Sequence
  chemically synthesized
caacaatattgaaattatgc

SEQ ID NO: 160045 - DNA, 20 bp, Artificial Sequence
  chemically synthesized
gccatagtacggttattaac

SEQ ID NO: 160046 - DNA, 20 bp, Artificial Sequence
  chemically synthesized
gccagttaataaccgtacta

SEQ ID NO: 160047 - DNA, 20 bp, Artificial Sequence
  chemically synthesized
aacatttagaggccatagta

SEQ ID NO: 160048 - DNA, 20 bp, Artificial Sequence
  chemically synthesized
ccttgaacatttagaggcca

SEQ ID NO: 160049 - DNA, 20 bp, Artificial Sequence
  chemically synthesized
gttttcccttgaacatttag

SEQ ID NO: 160050 - DNA, 20 bp, Artificial Sequence
  chemically synthesized
tgttttcccttgaacattta

SEQ ID NO: 160051 - DNA, 20 bp, Artificial Sequence
  chemically synthesized
actatggcctctaaatgttc

SEQ ID NO: 160052 - DNA, 20 bp, Artificial Sequence
  chemically synthesized
cttgttttcccttgaacatt

SEQ ID NO: 160053 - DNA, 20 bp, Artificial Sequence
  chemically synthesized
ctatggcctctaaatgttca

SEQ ID NO: 160054 - DNA, 20 bp, Artificial Sequence
  chemically synthesized
tatggcctctaaatgttcaa

SEQ ID NO: 160055 - DNA, 20 bp, Artificial Sequence
  chemically synthesized
ctaaatgttcaagggaaaac

SEQ ID NO: 160056 - DNA, 20 bp, Artificial Sequence
  chemically synthesized
aaatgttcaagggaaaacaa

SEQ ID NO: 160057 - DNA, 20 bp, Artificial Sequence
  chemically synthesized
tagcttttgatttaaagtga

SEQ ID NO: 160058 - DNA, 20 bp, Artificial Sequence
  chemically synthesized
tctagcttttgatttaaagt

SEQ ID NO: 160059 - DNA, 20 bp, Artificial Sequence
  chemically synthesized
catttctagcttttgattta

SEQ ID NO: 160060 - DNA, 20 bp, Artificial Sequence
  chemically synthesized
tgtctctcactttaaatcaa

SEQ ID NO: 160061 - DNA, 20 bp, Artificial Sequence
  chemically synthesized
tctcactttaaatcaaaagc

SEQ ID NO: 160062 - DNA, 20 bp, Artificial Sequence
  chemically synthesized
taaccaagcttaatcatttc

SEQ ID NO: 160063 - DNA, 20 bp, Artificial Sequence
  chemically synthesized
atcaaaagctagaaatgatt

SEQ ID NO: 160064 - DNA, 20 bp, Artificial Sequence
  chemically synthesized
aagctagaaatgattaagct

SEQ ID NO: 160065 - DNA, 20 bp, Artificial Sequence
  chemically synthesized
tagaaatgattaagcttggt

SEQ ID NO: 160066 - DNA, 20 bp, Artificial Sequence
  chemically synthesized
agaaatgattaagcttggtt

SEQ ID NO: 160067 - DNA, 20 bp, Artificial Sequence
  chemically synthesized
aatgattaagcttggttagg

SEQ ID NO: 160068 - DNA, 20 bp, Artificial Sequence
  chemically synthesized
ttcgacatgccttcctaacc

SEQ ID NO: 160069 - DNA, 20 bp, Artificial Sequence
  chemically synthesized
atgattaagcttggttagga

SEQ ID NO: 160070 - DNA, 20 bp, Artificial Sequence
  chemically synthesized
tggttaggaaggcatgtcga

SEQ ID NO: 160071 - DNA, 20 bp, Artificial Sequence
  chemically synthesized
aggaaggcatgtcgaaagcc

SEQ ID NO: 160072 - DNA, 20 bp, Artificial Sequence
  chemically synthesized
gaaggcatgtcgaaagccaa

SEQ ID NO: 160073 - DNA, 20 bp, Artificial Sequence
  chemically synthesized
aggcatgtcgaaagccaaga

SEQ ID NO: 160074 - DNA, 20 bp, Artificial Sequence
  chemically synthesized
ggcatgtcgaaagccaagag

SEQ ID NO: 160075 - DNA, 20 bp, Artificial Sequence
  chemically synthesized
gcctagcttccagcctctct

SEQ ID NO: 160076 - DNA, 20 bp, Artificial Sequence
  chemically synthesized
tgtcgaaagccaagagaggc

SEQ ID NO: 160077 - DNA, 20 bp, Artificial Sequence
  chemically synthesized
cgaaagccaagagaggctgg

SEQ ID NO: 160078 - DNA, 20 bp, Artificial Sequence
  chemically synthesized
agccaagagaggctggaagc

SEQ ID NO: 160079 - DNA, 20 bp, Artificial Sequence
  chemically synthesized
gccaagagaggctggaagct

SEQ ID NO: 160080 - DNA, 20 bp, Artificial Sequence
  chemically synthesized
ggcacaagaggcctagcttc

SEQ ID NO: 160081 - DNA, 20 bp, Artificial Sequence
  chemically synthesized
gctaacgggcacaagaggcc

SEQ ID NO: 160082 - DNA, 20 bp, Artificial Sequence
  chemically synthesized
acttagctaacgggcacaag

SEQ ID NO: 160083 - DNA, 20 bp, Artificial Sequence
  chemically synthesized
aacttagctaacgggcacaa

SEQ ID NO: 160084 - DNA, 20 bp, Artificial Sequence
  chemically synthesized
acaacttagctaacgggcac

SEQ ID NO: 160085 - DNA, 20 bp, Artificial Sequence
  chemically synthesized
gctaggcctcttgtgcccgt

SEQ ID NO: 160086 - DNA, 20 bp, Artificial Sequence
  chemically synthesized
gcctcttgtgcccgttagct

SEQ ID NO: 160087 - DNA, 20 bp, Artificial Sequence
  chemically synthesized
gcattcacaacttagctaac

SEQ ID NO: 160088 - DNA, 20 bp, Artificial Sequence
  chemically synthesized
tgcattcacaacttagctaa

SEQ ID NO: 160089 - DNA, 20 bp, Artificial Sequence
  chemically synthesized
tttcctttgcattcacaact

SEQ ID NO: 160090 - DNA, 20 bp, Artificial Sequence
  chemically synthesized
ttagctaagttgtgaatgca

SEQ ID NO: 160091 - DNA, 20 bp, Artificial Sequence
  chemically synthesized
tagctaagttgtgaatgcaa

SEQ ID NO: 160092 - DNA, 20 bp, Artificial Sequence
  chemically synthesized
atgcaaaggaaaaattcttg

SEQ ID NO: 160093 - DNA, 20 bp, Artificial Sequence
  chemically synthesized
tggcacttttaattttcttc

SEQ ID NO: 160094 - DNA, 20 bp, Artificial Sequence
  chemically synthesized
aaattcttgaagaaaattaa

SEQ ID NO: 160095 - DNA, 20 bp, Artificial Sequence
  chemically synthesized
ttgaagaaaattaaaagtgc

SEQ ID NO: 160096 - DNA, 20 bp, Artificial Sequence
  chemically synthesized
gaaaattaaaagtgccagtc

SEQ ID NO: 160097 - DNA, 20 bp, Artificial Sequence
  chemically synthesized
catttgcatgttcactagac

SEQ ID NO: 160098 - DNA, 20 bp, Artificial Sequence
  chemically synthesized
gttatcatttgcatgttcac

SEQ ID NO: 160099 - DNA, 20 bp, Artificial Sequence
  chemically synthesized
tgaacatgcaaatgataaca

SEQ ID NO: 160100 - DNA, 20 bp, Artificial Sequence
  chemically synthesized
acatgcaaatgataacaaag

SEQ ID NO: 160101 - DNA, 20 bp, Artificial Sequence
  chemically synthesized
caaatgataacaaagcagaa

SEQ ID NO: 160102 - DNA, 20 bp, Artificial Sequence
  chemically synthesized
cattctccatattaacaata

SEQ ID NO: 160103 - DNA, 20 bp, Artificial Sequence
  chemically synthesized
acattctccatattaacaat

SEQ ID NO: 160104 - DNA, 20 bp, Artificial Sequence
  chemically synthesized
gaacagccttattgttaata

SEQ ID NO: 160105 - DNA, 20 bp, Artificial Sequence
  chemically synthesized
acagccttattgttaatatg

SEQ ID NO: 160106 - DNA, 20 bp, Artificial Sequence
  chemically synthesized
tgttaatatggagaatgtct

SEQ ID NO: 160107 - DNA, 20 bp, Artificial Sequence
  chemically synthesized
taatatggagaatgtcttag

SEQ ID NO: 160108 - DNA, 20 bp, Artificial Sequence
  chemically synthesized
tggagaatgtcttagtggtc

SEQ ID NO: 160109 - DNA, 20 bp, Artificial Sequence
  chemically synthesized
gatcttctgtccagaccact

SEQ ID NO: 160110 - DNA, 20 bp, Artificial Sequence
  chemically synthesized
gaatgtcttagtggtctgga

SEQ ID NO: 160111 - DNA, 20 bp, Artificial Sequence
  chemically synthesized
tgtcttagtggtctggacag

SEQ ID NO: 160112 - DNA, 20 bp, Artificial Sequence
  chemically synthesized
ggctgttttgatcttctgtc

SEQ ID NO: 160113 - DNA, 20 bp, Artificial Sequence
  chemically synthesized
gtctggacagaagatcaaaa

SEQ ID NO: 160114 - DNA, 20 bp, Artificial Sequence
  chemically synthesized
tttggcttaggagaatgttg

SEQ ID NO: 160115 - DNA, 20 bp, Artificial Sequence
  chemically synthesized
aacagccacaacattctcct

SEQ ID NO: 160116 - DNA, 20 bp, Artificial Sequence
  chemically synthesized
tggattaggctttggcttag

SEQ ID NO: 160117 - DNA, 20 bp, Artificial Sequence
  chemically synthesized
cacaacattctcctaagcca

SEQ ID NO: 160118 - DNA, 20 bp, Artificial Sequence
  chemically synthesized
tctggattaggctttggctt

SEQ ID NO: 160119 - DNA, 20 bp, Artificial Sequence
  chemically synthesized
ctctggattaggctttggct

SEQ ID NO: 160120 - DNA, 20 bp, Artificial Sequence
  chemically synthesized
ccttgctctggattaggctt

SEQ ID NO: 160121 - DNA, 20 bp, Artificial Sequence
  chemically synthesized
tcctaagccaaagcctaatc

SEQ ID NO: 160122 - DNA, 20 bp, Artificial Sequence
  chemically synthesized
ctaagccaaagcctaatcca

SEQ ID NO: 160123 - DNA, 20 bp, Artificial Sequence
  chemically synthesized
attgggccttgctctggatt

SEQ ID NO: 160124 - DNA, 20 bp, Artificial Sequence
  chemically synthesized
aattgggccttgctctggat

SEQ ID NO: 160125 - DNA, 20 bp, Artificial Sequence
  chemically synthesized
gccaaagcctaatccagagc

SEQ ID NO: 160126 - DNA, 20 bp, Artificial Sequence
  chemically synthesized
ccaaagcctaatccagagca

SEQ ID NO: 160127 - DNA, 20 bp, Artificial Sequence
  chemically synthesized
aacagaattgggccttgctc

SEQ ID NO: 160128 - DNA, 20 bp, Artificial Sequence
  chemically synthesized
tcatacaactgaacagaatt

SEQ ID NO: 160129 - DNA, 20 bp, Artificial Sequence
  chemically synthesized
ttcatacaactgaacagaat

SEQ ID NO: 160130 - DNA, 20 bp, Artificial Sequence
  chemically synthesized
gagcaaggcccaattctgtt

SEQ ID NO: 160131 - DNA, 20 bp, Artificial Sequence
  chemically synthesized
tcagcattcatacaactgaa

SEQ ID NO: 160132 - DNA, 20 bp, Artificial Sequence
  chemically synthesized
tgttcagttgtatgaatgct

SEQ ID NO: 160133 - DNA, 20 bp, Artificial Sequence
  chemically synthesized
ttcagttgtatgaatgctga

SEQ ID NO: 160134 - DNA, 20 bp, Artificial Sequence
  chemically synthesized
cagttgtatgaatgctgaga

SEQ ID NO: 160135 - DNA, 20 bp, Artificial Sequence
  chemically synthesized
agttgtatgaatgctgagag

SEQ ID NO: 160136 - DNA, 20 bp, Artificial Sequence
  chemically synthesized
tacaatttcctcacctctct

SEQ ID NO: 160137 - DNA, 20 bp, Artificial Sequence
  chemically synthesized
gtatgaatgctgagagaggt

SEQ ID NO: 160138 - DNA, 20 bp, Artificial Sequence
  chemically synthesized
tatgaatgctgagagaggtg

SEQ ID NO: 160139 - DNA, 20 bp, Artificial Sequence
  chemically synthesized
tgagagaggtgaggaaattg

SEQ ID NO: 160140 - DNA, 20 bp, Artificial Sequence
  chemically synthesized
gagaggtgaggaaattgtag

SEQ ID NO: 160141 - DNA, 20 bp, Artificial Sequence
  chemically synthesized
gtgaggaaattgtagaagaa

SEQ ID NO: 160142 - DNA, 20 bp, Artificial Sequence
  chemically synthesized
ggaaattgtagaagaaaagt

SEQ ID NO: 160143 - DNA, 20 bp, Artificial Sequence
  chemically synthesized
aattgtagaagaaaagttgg

SEQ ID NO: 160144 - DNA, 20 bp, Artificial Sequence
  chemically synthesized
gtagaagaaaagttggaagc

SEQ ID NO: 160145 - DNA, 20 bp, Artificial Sequence
  chemically synthesized
gaagaaaagttggaagccag

SEQ ID NO: 160146 - DNA, 20 bp, Artificial Sequence
  chemically synthesized
agaaaagttggaagccagca

SEQ ID NO: 160147 - DNA, 20 bp, Artificial Sequence
  chemically synthesized
gaaaagttggaagccagcag

SEQ ID NO: 160148 - DNA, 20 bp, Artificial Sequence
  chemically synthesized
cctcatgaacaaacctctgc

SEQ ID NO: 160149 - DNA, 20 bp, Artificial Sequence
  chemically synthesized
gccagcagaggtttgttcat

SEQ ID NO: 160150 - DNA, 20 bp, Artificial Sequence
  chemically synthesized
ccagcagaggtttgttcatg

SEQ ID NO: 160151 - DNA, 20 bp, Artificial Sequence
  chemically synthesized
gaggtttgttcatgaggctt

SEQ ID NO: 160152 - DNA, 20 bp, Artificial Sequence
  chemically synthesized
aggtttgttcatgaggcttt

SEQ ID NO: 160153 - DNA, 20 bp, Artificial Sequence
  chemically synthesized
gttcatgaggctttaggacg

SEQ ID NO: 160154 - DNA, 20 bp, Artificial Sequence
  chemically synthesized
acggagagggcttcgtccta

SEQ ID NO: 160155 - DNA, 20 bp, Artificial Sequence
  chemically synthesized
tcacttttatgttacggaga

SEQ ID NO: 160156 - DNA, 20 bp, Artificial Sequence
  chemically synthesized
ttcacttttatgttacggag

SEQ ID NO: 160157 - DNA, 20 bp, Artificial Sequence
  chemically synthesized
tttcacttttatgttacgga

SEQ ID NO: 160158 - DNA, 20 bp, Artificial Sequence
  chemically synthesized
cctttcacttttatgttacg

SEQ ID NO: 160159 - DNA, 20 bp, Artificial Sequence
  chemically synthesized
cacctttcacttttatgtta

SEQ ID NO: 160160 - DNA, 20 bp, Artificial Sequence
  chemically synthesized
aagccctctccgtaacataa

SEQ ID NO: 160161 - DNA, 20 bp, Artificial Sequence
  chemically synthesized
tctccgtaacataaaagtga

SEQ ID NO: 160162 - DNA, 20 bp, Artificial Sequence
  chemically synthesized
ctccgtaacataaaagtgaa

SEQ ID NO: 160163 - DNA, 20 bp, Artificial Sequence
  chemically synthesized
cgtaacataaaagtgaaagg

SEQ ID NO: 160164 - DNA, 20 bp, Artificial Sequence
  chemically synthesized
taacataaaagtgaaaggtg

SEQ ID NO: 160165 - DNA, 20 bp, Artificial Sequence
  chemically synthesized
aaagtgaaaggtggagcaac

SEQ ID NO: 160166 - DNA, 20 bp, Artificial Sequence
  chemically synthesized
ggtggagcaacaagtgctga

SEQ ID NO: 160167 - DNA, 20 bp, Artificial Sequence
  chemically synthesized
tggagcaacaagtgctgatg

SEQ ID NO: 160168 - DNA, 20 bp, Artificial Sequence
  chemically synthesized
agcaacaagtgctgatggag

SEQ ID NO: 160169 - DNA, 20 bp, Artificial Sequence
  chemically synthesized
gtttgctgcagcttctccat

SEQ ID NO: 160170 - DNA, 20 bp, Artificial Sequence
  chemically synthesized
aagtgctgatggagaagctg

SEQ ID NO: 160171 - DNA, 20 bp, Artificial Sequence
  chemically synthesized
atcttctggatagtttgctg

SEQ ID NO: 160172 - DNA, 20 bp, Artificial Sequence
  chemically synthesized
agaagctgcagcaaactatc

SEQ ID NO: 160173 - DNA, 20 bp, Artificial Sequence
  chemically synthesized
agctgcagcaaactatccag

SEQ ID NO: 160174 - DNA, 20 bp, Artificial Sequence
  chemically synthesized
tattagcttgatcttctgga

SEQ ID NO: 160175 - DNA, 20 bp, Artificial Sequence
  chemically synthesized
agcaaactatccagaagatc

SEQ ID NO: 160176 - DNA, 20 bp, Artificial Sequence
  chemically synthesized
tagatattagcttgatcttc

SEQ ID NO: 160177 - DNA, 20 bp, Artificial Sequence
  chemically synthesized
agaagatcaagctaatatct

SEQ ID NO: 160178 - DNA, 20 bp, Artificial Sequence
  chemically synthesized
accttcatcatcttagatat

SEQ ID NO: 160179 - DNA, 20 bp, Artificial Sequence
  chemically synthesized
tgtagctaccttcatcatct

SEQ ID NO: 160180 - DNA, 20 bp, Artificial Sequence
  chemically synthesized
agctaatatctaagatgatg

SEQ ID NO: 160181 - DNA, 20 bp, Artificial Sequence
  chemically synthesized
gctaatatctaagatgatga

SEQ ID NO: 160182 - DNA, 20 bp, Artificial Sequence
  chemically synthesized
aatatctaagatgatgaagg

SEQ ID NO: 160183 - DNA, 20 bp, Artificial Sequence
  chemically synthesized
tgaaaatctgttgtttagtg

SEQ ID NO: 160184 - DNA, 20 bp, Artificial Sequence
  chemically synthesized
aaggtagctacactaaacaa

SEQ ID NO: 160185 - DNA, 20 bp, Artificial Sequence
  chemically synthesized
tacactgaaaatctgttgtt

SEQ ID NO: 160186 - DNA, 20 bp, Artificial Sequence
  chemically synthesized
tacactaaacaacagatttt

SEQ ID NO: 160187 - DNA, 20 bp, Artificial Sequence
  chemically synthesized
taaacaacagattttcagtg

SEQ ID NO: 160188 - DNA, 20 bp, Artificial Sequence
  chemically synthesized
acagattttcagtgtagatg

SEQ ID NO: 160189 - DNA, 20 bp, Artificial Sequence
  chemically synthesized
gattttcagtgtagatgaag

SEQ ID NO: 160190 - DNA, 20 bp, Artificial Sequence
  chemically synthesized
tagatgaagcagtcttctat

SEQ ID NO: 160191 - DNA, 20 bp, Artificial Sequence
  chemically synthesized
atggcatctttttccaatag

SEQ ID NO: 160192 - DNA, 20 bp, Artificial Sequence
  chemically synthesized
aagcagtcttctattggaaa

SEQ ID NO: 160193 - DNA, 20 bp, Artificial Sequence
  chemically synthesized
tagatggcatctttttccaa

SEQ ID NO: 160194 - DNA, 20 bp, Artificial Sequence
  chemically synthesized
tattggaaaaagatgccatc

SEQ ID NO: 160195 - DNA, 20 bp, Artificial Sequence
  chemically synthesized
attggaaaaagatgccatct

SEQ ID NO: 160196 - DNA, 20 bp, Artificial Sequence
  chemically synthesized
ctagctatgaaagtcctaga

SEQ ID NO: 160197 - DNA, 20 bp, Artificial Sequence
  chemically synthesized
ctctctagctatgaaagtcc

SEQ ID NO: 160198 - DNA, 20 bp, Artificial Sequence
  chemically synthesized
gatgccatctaggactttca

SEQ ID NO: 160199 - DNA, 20 bp, Artificial Sequence
  chemically synthesized
ccatctaggactttcatagc

SEQ ID NO: 160200 - DNA, 20 bp, Artificial Sequence
  chemically synthesized
tgacttctctctagctatga

SEQ ID NO: 160201 - DNA, 20 bp, Artificial Sequence
  chemically synthesized
atctaggactttcatagcta

SEQ ID NO: 160202 - DNA, 20 bp, Artificial Sequence
  chemically synthesized
ctaggactttcatagctaga

SEQ ID NO: 160203 - DNA, 20 bp, Artificial Sequence
  chemically synthesized
ggactttcatagctagagag

SEQ ID NO: 160204 - DNA, 20 bp, Artificial Sequence
  chemically synthesized
gccaggcattgacttctctc

SEQ ID NO: 160205 - DNA, 20 bp, Artificial Sequence
  chemically synthesized
gctagagagaagtcaatgcc

SEQ ID NO: 160206 - DNA, 20 bp, Artificial Sequence
  chemically synthesized
tcctttgaactttcgaagcc

SEQ ID NO: 160207 - DNA, 20 bp, Artificial Sequence
  chemically synthesized
aagtcaatgcctggcttcga

SEQ ID NO: 160208 - DNA, 20 bp, Artificial Sequence
  chemically synthesized
gtcctttgaactttcgaagc

SEQ ID NO: 160209 - DNA, 20 bp, Artificial Sequence
  chemically synthesized
gcctgtcctttgaactttcg

SEQ ID NO: 160210 - DNA, 20 bp, Artificial Sequence
  chemically synthesized
tgcctggcttcgaaagttca

SEQ ID NO: 160211 - DNA, 20 bp, Artificial Sequence
  chemically synthesized
gcctggcttcgaaagttcaa

SEQ ID NO: 160212 - DNA, 20 bp, Artificial Sequence
  chemically synthesized
ggcttcgaaagttcaaagga

SEQ ID NO: 160213 - DNA, 20 bp, Artificial Sequence
  chemically synthesized
gcttcgaaagttcaaaggac

SEQ ID NO: 160214 - DNA, 20 bp, Artificial Sequence
  chemically synthesized
ttagcccctcaaaagagagt

SEQ ID NO: 160215 - DNA, 20 bp, Artificial Sequence
  chemically synthesized
ggacaggctgactctctttt

SEQ ID NO: 160216 - DNA, 20 bp, Artificial Sequence
  chemically synthesized
gacaggctgactctcttttg

SEQ ID NO: 160217 - DNA, 20 bp, Artificial Sequence
  chemically synthesized
tgcattagcccctcaaaaga

SEQ ID NO: 160218 - DNA, 20 bp, Artificial Sequence
  chemically synthesized
acaggctgactctcttttga

SEQ ID NO: 160219 - DNA, 20 bp, Artificial Sequence
  chemically synthesized
caggctgactctcttttgag

SEQ ID NO: 160220 - DNA, 20 bp, Artificial Sequence
  chemically synthesized
attgcattagcccctcaaaa

SEQ ID NO: 160221 - DNA, 20 bp, Artificial Sequence
  chemically synthesized
caattgcattagcccctcaa

SEQ ID NO: 160222 - DNA, 20 bp, Artificial Sequence
  chemically synthesized
ttgaaagtcatcaattgcat

SEQ ID NO: 160223 - DNA, 20 bp, Artificial Sequence
  chemically synthesized
caattgatgactttcaattg

SEQ ID NO: 160224 - DNA, 20 bp, Artificial Sequence
  chemically synthesized
tgagcattgtcttcaattga

SEQ ID NO: 160225 - DNA, 20 bp, Artificial Sequence
  chemically synthesized
ggatttttggaatagtaaat

SEQ ID NO: 160226 - DNA, 20 bp, Artificial Sequence
  chemically synthesized
gggccctaggatttttggaa

SEQ ID NO: 160227 - DNA, 20 bp, Artificial Sequence
  chemically synthesized
atttactattccaaaaatcc

SEQ ID NO: 160228 - DNA, 20 bp, Artificial Sequence
  chemically synthesized
cttaagggccctaggatttt

SEQ ID NO: 160229 - DNA, 20 bp, Artificial Sequence
  chemically synthesized
tttactattccaaaaatcct

SEQ ID NO: 160230 - DNA, 20 bp, Artificial Sequence
  chemically synthesized
ttactattccaaaaatccta

SEQ ID NO: 160231 - DNA, 20 bp, Artificial Sequence
  chemically synthesized
agcataatcttaagggccct

SEQ ID NO: 160232 - DNA, 20 bp, Artificial Sequence
  chemically synthesized
tagcataatcttaagggccc

SEQ ID NO: 160233 - DNA, 20 bp, Artificial Sequence
  chemically synthesized
ccaaaaatcctagggccctt

SEQ ID NO: 160234 - DNA, 20 bp, Artificial Sequence
  chemically synthesized
gtctattagcataatcttaa

SEQ ID NO: 160235 - DNA, 20 bp, Artificial Sequence
  chemically synthesized
agtctattagcataatctta

SEQ ID NO: 160236 - DNA, 20 bp, Artificial Sequence
  chemically synthesized
gagtctattagcataatctt

SEQ ID NO: 160237 - DNA, 20 bp, Artificial Sequence
  chemically synthesized
ggcccttaagattatgctaa

SEQ ID NO: 160238 - DNA, 20 bp, Artificial Sequence
  chemically synthesized
agagcataggcagagtctat

SEQ ID NO: 160239 - DNA, 20 bp, Artificial Sequence
  chemically synthesized
ccctttatagagcataggca

SEQ ID NO: 160240 - DNA, 20 bp, Artificial Sequence
  chemically synthesized
ttccctttatagagcatagg

SEQ ID NO: 160241 - DNA, 20 bp, Artificial Sequence
  chemically synthesized
ttgttccctttatagagcat

SEQ ID NO: 160242 - DNA, 20 bp, Artificial Sequence
  chemically synthesized
gttgttccctttatagagca

SEQ ID NO: 160243 - DNA, 20 bp, Artificial Sequence
  chemically synthesized
gactctgcctatgctctata

SEQ ID NO: 160244 - DNA, 20 bp, Artificial Sequence
  chemically synthesized
actctgcctatgctctataa

SEQ ID NO: 160245 - DNA, 20 bp, Artificial Sequence
  chemically synthesized
ctctgcctatgctctataaa

SEQ ID NO: 160246 - DNA, 20 bp, Artificial Sequence
  chemically synthesized
gctttgttgttccctttata

SEQ ID NO: 160247 - DNA, 20 bp, Artificial Sequence
  chemically synthesized
aggctttgttgttcccttta

SEQ ID NO: 160248 - DNA, 20 bp, Artificial Sequence
  chemically synthesized
gctctataaagggaacaaca

SEQ ID NO: 160249 - DNA, 20 bp, Artificial Sequence
  chemically synthesized
ataaagggaacaacaaagcc

SEQ ID NO: 160250 - DNA, 20 bp, Artificial Sequence
  chemically synthesized
gaacaacaaagcctggatga

SEQ ID NO: 160251 - DNA, 20 bp, Artificial Sequence
  chemically synthesized
aaagagatgtgctatcatcc

SEQ ID NO: 160252 - DNA, 20 bp, Artificial Sequence
  chemically synthesized
taaagagatgtgctatcatc

SEQ ID NO: 160253 - DNA, 20 bp, Artificial Sequence
  chemically synthesized
gatgatagcacatctcttta

SEQ ID NO: 160254 - DNA, 20 bp, Artificial Sequence
  chemically synthesized
taagtaaaccatgctgtaaa

SEQ ID NO: 160255 - DNA, 20 bp, Artificial Sequence
  chemically synthesized
tagcacatctctttacagca

SEQ ID NO: 160256 - DNA, 20 bp, Artificial Sequence
  chemically synthesized
agtaagtaaaccatgctgta

SEQ ID NO: 160257 - DNA, 20 bp, Artificial Sequence
  chemically synthesized
gtgggcctaaaatattcagt

SEQ ID NO: 160258 - DNA, 20 bp, Artificial Sequence
  chemically synthesized
ggtttacttactgaatattt

SEQ ID NO: 160259 - DNA, 20 bp, Artificial Sequence
  chemically synthesized
gccagtgggcctaaaatatt

SEQ ID NO: 160260 - DNA, 20 bp, Artificial Sequence
  chemically synthesized
gtttacttactgaatatttt

SEQ ID NO: 160261 - DNA, 20 bp, Artificial Sequence
  chemically synthesized
actgaatattttaggcccac

SEQ ID NO: 160262 - DNA, 20 bp, Artificial Sequence
  chemically synthesized
gtgcaataggtatggccagt

SEQ ID NO: 160263 - DNA, 20 bp, Artificial Sequence
  chemically synthesized
tgtgcaataggtatggccag

SEQ ID NO: 160264 - DNA, 20 bp, Artificial Sequence
  chemically synthesized
ttctgtgcaataggtatggc

SEQ ID NO: 160265 - DNA, 20 bp, Artificial Sequence
  chemically synthesized
tttcttctgtgcaataggta

SEQ ID NO: 160266 - DNA, 20 bp, Artificial Sequence
  chemically synthesized
cactggccatacctattgca

SEQ ID NO: 160267 - DNA, 20 bp, Artificial Sequence
  chemically synthesized
gattttttcttctgtgcaat

SEQ ID NO: 160268 - DNA, 20 bp, Artificial Sequence
  chemically synthesized
agattttttcttctgtgcaa

SEQ ID NO: 160269 - DNA, 20 bp, Artificial Sequence
  chemically synthesized
tggccatacctattgcacag

SEQ ID NO: 160270 - DNA, 20 bp, Artificial Sequence
  chemically synthesized
caagcagtaatatattgaaa

SEQ ID NO: 160271 - DNA, 20 bp, Artificial Sequence
  chemically synthesized
aacaagcagtaatatattga

SEQ ID NO: 160272 - DNA, 20 bp, Artificial Sequence
  chemically synthesized
ccaggtgcattatcaacaag

SEQ ID NO: 160273 - DNA, 20 bp, Artificial Sequence
  chemically synthesized
tgaccaggtgcattatcaac

SEQ ID NO: 160274 - DNA, 20 bp, Artificial Sequence
  chemically synthesized
ctgcttgttgataatgcacc

SEQ ID NO: 160275 - DNA, 20 bp, Artificial Sequence
  chemically synthesized
ttgttgataatgcacctggt

SEQ ID NO: 160276 - DNA, 20 bp, Artificial Sequence
  chemically synthesized
atcagacctcttggctgacc

SEQ ID NO: 160277 - DNA, 20 bp, Artificial Sequence
  chemically synthesized
gataatgcacctggtcagcc

SEQ ID NO: 160278 - DNA, 20 bp, Artificial Sequence
  chemically synthesized
catcagacctcttggctgac

SEQ ID NO: 160279 - DNA, 20 bp, Artificial Sequence
  chemically synthesized
taatgcacctggtcagccaa

SEQ ID NO: 160280 - DNA, 20 bp, Artificial Sequence
  chemically synthesized
aatgcacctggtcagccaag

SEQ ID NO: 160281 - DNA, 20 bp, Artificial Sequence
  chemically synthesized
tacatcttcatcagacctct

SEQ ID NO: 160282 - DNA, 20 bp, Artificial Sequence
  chemically synthesized
gtcagccaagaggtctgatg

SEQ ID NO: 160283 - DNA, 20 bp, Artificial Sequence
  chemically synthesized
atctcttggtacatcttcat

SEQ ID NO: 160284 - DNA, 20 bp, Artificial Sequence
  chemically synthesized
aggtctgatgaagatgtacc

SEQ ID NO: 160285 - DNA, 20 bp, Artificial Sequence
  chemically synthesized
gtctgatgaagatgtaccaa

SEQ ID NO: 160286 - DNA, 20 bp, Artificial Sequence
  chemically synthesized
ggcataaaaacaaaatctct

SEQ ID NO: 160287 - DNA, 20 bp, Artificial Sequence
  chemically synthesized
agaatggatgttgtgttagc

SEQ ID NO: 160288 - DNA, 20 bp, Artificial Sequence
  chemically synthesized
cagaatggatgttgtgttag

SEQ ID NO: 160289 - DNA, 20 bp, Artificial Sequence
  chemically synthesized
ctgcagaatggatgttgtgt

SEQ ID NO: 160290 - DNA, 20 bp, Artificial Sequence
  chemically synthesized
ctaacacaacatccattctg

SEQ ID NO: 160291 - DNA, 20 bp, Artificial Sequence
  chemically synthesized
tttgtccaaggactgcagaa

SEQ ID NO: 160292 - DNA, 20 bp, Artificial Sequence
  chemically synthesized
aacatccattctgcagtcct

SEQ ID NO: 160293 - DNA, 20 bp, Artificial Sequence
  chemically synthesized
actcctttgtccaaggactg

SEQ ID NO: 160294 - DNA, 20 bp, Artificial Sequence
  chemically synthesized
cattctgcagtccttggaca

SEQ ID NO: 160295 - DNA, 20 bp, Artificial Sequence
  chemically synthesized
attctgcagtccttggacaa

SEQ ID NO: 160296 - DNA, 20 bp, Artificial Sequence
  chemically synthesized
tgaaatgactcctttgtcca

SEQ ID NO: 160297 - DNA, 20 bp, Artificial Sequence
  chemically synthesized
ctgaaatgactcctttgtcc

SEQ ID NO: 160298 - DNA, 20 bp, Artificial Sequence
  chemically synthesized
tctgcagtccttggacaaag

SEQ ID NO: 160299 - DNA, 20 bp, Artificial Sequence
  chemically synthesized
cttggacaaaggagtcattt

SEQ ID NO: 160300 - DNA, 20 bp, Artificial Sequence
  chemically synthesized
aaggagtcatttcagctctc

SEQ ID NO: 160301 - DNA, 20 bp, Artificial Sequence
  chemically synthesized
ttttaaagaataagacttga

SEQ ID NO: 160302 - DNA, 20 bp, Artificial Sequence
  chemically synthesized
ctttttaaagaataagactt

SEQ ID NO: 160303 - DNA, 20 bp, Artificial Sequence
  chemically synthesized
aaatgtactttttaaagaat

SEQ ID NO: 160304 - DNA, 20 bp, Artificial Sequence
  chemically synthesized
ctcaagtcttattctttaaa

SEQ ID NO: 160305 - DNA, 20 bp, Artificial Sequence
  chemically synthesized
cttacaaaatgtacttttta

SEQ ID NO: 160306 - DNA, 20 bp, Artificial Sequence
  chemically synthesized
ctttaaaaagtacattttgt

SEQ ID NO: 160307 - DNA, 20 bp, Artificial Sequence
  chemically synthesized
tttaaaaagtacattttgta

SEQ ID NO: 160308 - DNA, 20 bp, Artificial Sequence
  chemically synthesized
aagtacattttgtaaggcta

SEQ ID NO: 160309 - DNA, 20 bp, Artificial Sequence
  chemically synthesized
atcgctacctagggcagcta

SEQ ID NO: 160310 - DNA, 20 bp, Artificial Sequence
  chemically synthesized
ttgtaaggctatagctgccc

SEQ ID NO: 160311 - DNA, 20 bp, Artificial Sequence
  chemically synthesized
tgtaaggctatagctgccct

SEQ ID NO: 160312 - DNA, 20 bp, Artificial Sequence
  chemically synthesized
aaggctatagctgccctagg

SEQ ID NO: 160313 - DNA, 20 bp, Artificial Sequence
  chemically synthesized
agaggaatcgctacctaggg

SEQ ID NO: 160314 - DNA, 20 bp, Artificial Sequence
  chemically synthesized
atcagaggaatcgctaccta

SEQ ID NO: 160315 - DNA, 20 bp, Artificial Sequence
  chemically synthesized
catcagaggaatcgctacct

SEQ ID NO: 160316 - DNA, 20 bp, Artificial Sequence
  chemically synthesized
ccatcagaggaatcgctacc

SEQ ID NO: 160317 - DNA, 20 bp, Artificial Sequence
  chemically synthesized
ctaggtagcgattcctctga

SEQ ID NO: 160318 - DNA, 20 bp, Artificial Sequence
  chemically synthesized
agtttacccagatccatcag

SEQ ID NO: 160319 - DNA, 20 bp, Artificial Sequence
  chemically synthesized
cagtttacccagatccatca

SEQ ID NO: 160320 - DNA, 20 bp, Artificial Sequence
  chemically synthesized
agcgattcctctgatggatc

SEQ ID NO: 160321 - DNA, 20 bp, Artificial Sequence
  chemically synthesized
ttcagtttacccagatccat

SEQ ID NO: 160322 - DNA, 20 bp, Artificial Sequence
  chemically synthesized
gcgattcctctgatggatct

SEQ ID NO: 160323 - DNA, 20 bp, Artificial Sequence
  chemically synthesized
cagaagattttcagtttacc

SEQ ID NO: 160324 - DNA, 20 bp, Artificial Sequence
  chemically synthesized
agtcctttccagaagatttt

SEQ ID NO: 160325 - DNA, 20 bp, Artificial Sequence
  chemically synthesized
tgggtaaactgaaaatcttc

SEQ ID NO: 160326 - DNA, 20 bp, Artificial Sequence
  chemically synthesized
taaactgaaaatcttctgga

SEQ ID NO: 160327 - DNA, 20 bp, Artificial Sequence
  chemically synthesized
aaactgaaaatcttctggaa

SEQ ID NO: 160328 - DNA, 20 bp, Artificial Sequence
  chemically synthesized
gaatggtgagtcctttccag

SEQ ID NO: 160329 - DNA, 20 bp, Artificial Sequence
  chemically synthesized
ctggaatggtgagtcctttc

SEQ ID NO: 160330 - DNA, 20 bp, Artificial Sequence
  chemically synthesized
ctggaaaggactcaccattc

SEQ ID NO: 160331 - DNA, 20 bp, Artificial Sequence
  chemically synthesized
ttaatggcatctggaatggt

SEQ ID NO: 160332 - DNA, 20 bp, Artificial Sequence
  chemically synthesized
tttcttaatggcatctggaa

SEQ ID NO: 160333 - DNA, 20 bp, Artificial Sequence
  chemically synthesized
caaattttcttaatggcatc

SEQ ID NO: 160334 - DNA, 20 bp, Artificial Sequence
  chemically synthesized
tcaccattccagatgccatt

SEQ ID NO: 160335 - DNA, 20 bp, Artificial Sequence
  chemically synthesized
tgaatcacaaattttcttaa

SEQ ID NO: 160336 - DNA, 20 bp, Artificial Sequence
  chemically synthesized
ttaagaaaatttgtgattca

SEQ ID NO: 160337 - DNA, 20 bp, Artificial Sequence
  chemically synthesized
gaaaatttgtgattcataga

SEQ ID NO: 160338 - DNA, 20 bp, Artificial Sequence
  chemically synthesized
aaatttgtgattcatagaaa

SEQ ID NO: 160339 - DNA, 20 bp, Artificial Sequence
  chemically synthesized
aatttgtgattcatagaaag

SEQ ID NO: 160340 - DNA, 20 bp, Artificial Sequence
  chemically synthesized
gaggtaaatatcaacattac

SEQ ID NO: 160341 - DNA, 20 bp, Artificial Sequence
  chemically synthesized
aggtaaatatcaacattaca

SEQ ID NO: 160342 - DNA, 20 bp, Artificial Sequence
  chemically synthesized
tatcaacattacaaggtgtt

SEQ ID NO: 160343 - DNA, 20 bp, Artificial Sequence
  chemically synthesized
caacattacaaggtgtttgg

SEQ ID NO: 160344 - DNA, 20 bp, Artificial Sequence
  chemically synthesized
cattacaaggtgtttggaag

SEQ ID NO: 160345 - DNA, 20 bp, Artificial Sequence
  chemically synthesized
tcataggcattcatgagggt

SEQ ID NO: 160346 - DNA, 20 bp, Artificial Sequence
  chemically synthesized
accctcataggcattcatga

SEQ ID NO: 160347 - DNA, 20 bp, Artificial Sequence
  chemically synthesized
gaccctcataggcattcatg

SEQ ID NO: 160348 - DNA, 20 bp, Artificial Sequence
  chemically synthesized
ggaccctcataggcattcat

SEQ ID NO: 160349 - DNA, 20 bp, Artificial Sequence
  chemically synthesized
caaccctcatgaatgcctat

SEQ ID NO: 160350 - DNA, 20 bp, Artificial Sequence
  chemically synthesized
aaccctcatgaatgcctatg

SEQ ID NO: 160351 - DNA, 20 bp, Artificial Sequence
  chemically synthesized
accctcatgaatgcctatga

SEQ ID NO: 160352 - DNA, 20 bp, Artificial Sequence
  chemically synthesized
ctaaagtcttggaccctcat

SEQ ID NO: 160353 - DNA, 20 bp, Artificial Sequence
  chemically synthesized
actaaagtcttggaccctca

SEQ ID NO: 160354 - DNA, 20 bp, Artificial Sequence
  chemically synthesized
atgaatgcctatgagggtcc

SEQ ID NO: 160355 - DNA, 20 bp, Artificial Sequence
  chemically synthesized
cctatgagggtccaagactt

SEQ ID NO: 160356 - DNA, 20 bp, Artificial Sequence
  chemically synthesized
gacttcccctactaaagtct

SEQ ID NO: 160357 - DNA, 20 bp, Artificial Sequence
  chemically synthesized
atgagggtccaagactttag

SEQ ID NO: 160358 - DNA, 20 bp, Artificial Sequence
  chemically synthesized
tgagggtccaagactttagt

SEQ ID NO: 160359 - DNA, 20 bp, Artificial Sequence
  chemically synthesized
gagggtccaagactttagta

SEQ ID NO: 160360 - DNA, 20 bp, Artificial Sequence
  chemically synthesized
agggtccaagactttagtag

SEQ ID NO: 160361 - DNA, 20 bp, Artificial Sequence
  chemically synthesized
tccagtgacttcccctacta

SEQ ID NO: 160362 - DNA, 20 bp, Artificial Sequence
  chemically synthesized
gtccaagactttagtagggg

SEQ ID NO: 160363 - DNA, 20 bp, Artificial Sequence
  chemically synthesized
actttagtaggggaagtcac

SEQ ID NO: 160364 - DNA, 20 bp, Artificial Sequence
  chemically synthesized
gtaggggaagtcactggatg

SEQ ID NO: 160365 - DNA, 20 bp, Artificial Sequence
  chemically synthesized
aggggaagtcactggatgtg

SEQ ID NO: 160366 - DNA, 20 bp, Artificial Sequence
  chemically synthesized
cttgcaattttctccacatc

SEQ ID NO: 160367 - DNA, 20 bp, Artificial Sequence
  chemically synthesized
ctggatgtggagaaaattgc

SEQ ID NO: 160368 - DNA, 20 bp, Artificial Sequence
  chemically synthesized
ggatgtggagaaaattgcaa

SEQ ID NO: 160369 - DNA, 20 bp, Artificial Sequence
  chemically synthesized
ggagaaaattgcaagagaac

SEQ ID NO: 160370 - DNA, 20 bp, Artificial Sequence
  chemically synthesized
attgcaagagaactagaata

SEQ ID NO: 160371 - DNA, 20 bp, Artificial Sequence
  chemically synthesized
cttcaggctccactttattc

SEQ ID NO: 160372 - DNA, 20 bp, Artificial Sequence
  chemically synthesized
gcaagagaactagaataaag

SEQ ID NO: 160373 - DNA, 20 bp, Artificial Sequence
  chemically synthesized
aagagaactagaataaagtg

SEQ ID NO: 160374 - DNA, 20 bp, Artificial Sequence
  chemically synthesized
ctagaataaagtggagcctg

SEQ ID NO: 160375 - DNA, 20 bp, Artificial Sequence
  chemically synthesized
tagaataaagtggagcctga

SEQ ID NO: 160376 - DNA, 20 bp, Artificial Sequence
  chemically synthesized
ggccattcagttacaccttc

SEQ ID NO: 160377 - DNA, 20 bp, Artificial Sequence
  chemically synthesized
cggccattcagttacacctt

SEQ ID NO: 160378 - DNA, 20 bp, Artificial Sequence
  chemically synthesized
agcctgaaggtgtaactgaa

SEQ ID NO: 160379 - DNA, 20 bp, Artificial Sequence
  chemically synthesized
attatgagatgacggccatt

SEQ ID NO: 160380 - DNA, 20 bp, Artificial Sequence
  chemically synthesized
gaagtttcattatgagatga

SEQ ID NO: 160381 - DNA, 20 bp, Artificial Sequence
  chemically synthesized
atccattgaagtttcattat

SEQ ID NO: 160382 - DNA, 20 bp, Artificial Sequence
  chemically synthesized
atctcataatgaaacttcaa

SEQ ID NO: 160383 - DNA, 20 bp, Artificial Sequence
  chemically synthesized
tagcaactcttcatccattg

SEQ ID NO: 160384 - DNA, 20 bp, Artificial Sequence
  chemically synthesized
taatgaaacttcaatggatg

SEQ ID NO: 160385 - DNA, 20 bp, Artificial Sequence
  chemically synthesized
atgaaacttcaatggatgaa

SEQ ID NO: 160386 - DNA, 20 bp, Artificial Sequence
  chemically synthesized
ggatgaagagttgctactta

SEQ ID NO: 160387 - DNA, 20 bp, Artificial Sequence
  chemically synthesized
ttgttttgctcatctataag

SEQ ID NO: 160388 - DNA, 20 bp, Artificial Sequence
  chemically synthesized
aagagttgctacttatagat

SEQ ID NO: 160389 - DNA, 20 bp, Artificial Sequence
  chemically synthesized
actttgttttgctcatctat

SEQ ID NO: 160390 - DNA, 20 bp, Artificial Sequence
  chemically synthesized
acttatagatgagcaaaaca

SEQ ID NO: 160391 - DNA, 20 bp, Artificial Sequence
  chemically synthesized
gcaaaacaaagtgttttcat

SEQ ID NO: 160392 - DNA, 20 bp, Artificial Sequence
  chemically synthesized
aacaaagtgttttcatgaga

SEQ ID NO: 160393 - DNA, 20 bp, Artificial Sequence
  chemically synthesized
catgagacagaatctactcc

SEQ ID NO: 160394 - DNA, 20 bp, Artificial Sequence
  chemically synthesized
tacagcgtcttcaccaggag

SEQ ID NO: 160395 - DNA, 20 bp, Artificial Sequence
  chemically synthesized
gacagaatctactcctggtg

SEQ ID NO: 160396 - DNA, 20 bp, Artificial Sequence
  chemically synthesized
gtttacagcgtcttcaccag

SEQ ID NO: 160397 - DNA, 20 bp, Artificial Sequence
  chemically synthesized
ttgtttacagcgtcttcacc

SEQ ID NO: 160398 - DNA, 20 bp, Artificial Sequence
  chemically synthesized
attgtttacagcgtcttcac

SEQ ID NO: 160399 - DNA, 20 bp, Artificial Sequence
  chemically synthesized
tgtcatttcaacattgttta

SEQ ID NO: 160400 - DNA, 20 bp, Artificial Sequence
  chemically synthesized
acaatgttgaaatgacaaca

SEQ ID NO: 160401 - DNA, 20 bp, Artificial Sequence
  chemically synthesized
caatgttgaaatgacaacaa

SEQ ID NO: 160402 - DNA, 20 bp, Artificial Sequence
  chemically synthesized
aatgttgaaatgacaacaaa

SEQ ID NO: 160403 - DNA, 20 bp, Artificial Sequence
  chemically synthesized
tgaaatgacaacaaagggtt

SEQ ID NO: 160404 - DNA, 20 bp, Artificial Sequence
  chemically synthesized
tttagaatattctgtaaact

SEQ ID NO: 160405 - DNA, 20 bp, Artificial Sequence
  chemically synthesized
tgctttaccaactaagttta

SEQ ID NO: 160406 - DNA, 20 bp, Artificial Sequence
  chemically synthesized
gaatattctgtaaacttagt

SEQ ID NO: 160407 - DNA, 20 bp, Artificial Sequence
  chemically synthesized
ctgctgctgctttaccaact

SEQ ID NO: 160408 - DNA, 20 bp, Artificial Sequence
  chemically synthesized
ttctgtaaacttagttggta

SEQ ID NO: 160409 - DNA, 20 bp, Artificial Sequence
  chemically synthesized
tgtaaacttagttggtaaag

SEQ ID NO: 160410 - DNA, 20 bp, Artificial Sequence
  chemically synthesized
aaacttagttggtaaagcag

SEQ ID NO: 160411 - DNA, 20 bp, Artificial Sequence
  chemically synthesized
cttagttggtaaagcagcag

SEQ ID NO: 160412 - DNA, 20 bp, Artificial Sequence
  chemically synthesized
ttagttggtaaagcagcagc

SEQ ID NO: 160413 - DNA, 20 bp, Artificial Sequence
  chemically synthesized
tagttggtaaagcagcagca

SEQ ID NO: 160414 - DNA, 20 bp, Artificial Sequence
  chemically synthesized
gtaaagcagcagcagggtat

SEQ ID NO: 160415 - DNA, 20 bp, Artificial Sequence
  chemically synthesized
aaagcagcagcagggtatga

SEQ ID NO: 160416 - DNA, 20 bp, Artificial Sequence
  chemically synthesized
atctttcaaaaatgaggtca

SEQ ID NO: 160417 - DNA, 20 bp, Artificial Sequence
  chemically synthesized
gatctttcaaaaatgaggtc

SEQ ID NO: 160418 - DNA, 20 bp, Artificial Sequence
  chemically synthesized
cagtagatctttcaaaaatg

SEQ ID NO: 160419 - DNA, 20 bp, Artificial Sequence
  chemically synthesized
acagtagatctttcaaaaat

SEQ ID NO: 160420 - DNA, 20 bp, Artificial Sequence
  chemically synthesized
agccttgacctcatttttga

SEQ ID NO: 160421 - DNA, 20 bp, Artificial Sequence
  chemically synthesized
catttttgaaagatctactg

SEQ ID NO: 160422 - DNA, 20 bp, Artificial Sequence
  chemically synthesized
atttttgaaagatctactgt

SEQ ID NO: 160423 - DNA, 20 bp, Artificial Sequence
  chemically synthesized
tgataacattttacccacag

SEQ ID NO: 160424 - DNA, 20 bp, Artificial Sequence
  chemically synthesized
atttgataacattttaccca

SEQ ID NO: 160425 - DNA, 20 bp, Artificial Sequence
  chemically synthesized
tttcacaaaagatttttatg

SEQ ID NO: 160426 - DNA, 20 bp, Artificial Sequence
  chemically synthesized
ttggttgatttttttcacaa

SEQ ID NO: 160427 - DNA, 20 bp, Artificial Sequence
  chemically synthesized
gtgaaaaaaatcaaccaaca

SEQ ID NO: 160428 - DNA, 20 bp, Artificial Sequence
  chemically synthesized
aaccatgaggtttgctatgt

SEQ ID NO: 160429 - DNA, 20 bp, Artificial Sequence
  chemically synthesized
aaccaacatagcaaacctca

SEQ ID NO: 160430 - DNA, 20 bp, Artificial Sequence
  chemically synthesized
cttagaataaaacaaccatg

SEQ ID NO: 160431 - DNA, 20 bp, Artificial Sequence
  chemically synthesized
tcttagaataaaacaaccat

SEQ ID NO: 160432 - DNA, 20 bp, Artificial Sequence
  chemically synthesized
cctcatggttgttttattct

SEQ ID NO: 160433 - DNA, 20 bp, Artificial Sequence
  chemically synthesized
gttgttttattctaagaaat

SEQ ID NO: 160434 - DNA, 20 bp, Artificial Sequence
  chemically synthesized
gagtgactatgccaatttct

SEQ ID NO: 160435 - DNA, 20 bp, Artificial Sequence
  chemically synthesized
tttattctaagaaattggca

SEQ ID NO: 160436 - DNA, 20 bp, Artificial Sequence
  chemically synthesized
tagtaactgttgaaaggttg

SEQ ID NO: 160437 - DNA, 20 bp, Artificial Sequence
  chemically synthesized
agtagtaactgttgaaaggt

SEQ ID NO: 160438 - DNA, 20 bp, Artificial Sequence
  chemically synthesized
tagtcactccaacctttcaa

SEQ ID NO: 160439 - DNA, 20 bp, Artificial Sequence
  chemically synthesized
tcagagtagtaactgttgaa

SEQ ID NO: 160440 - DNA, 20 bp, Artificial Sequence
  chemically synthesized
atcagagtagtaactgttga

SEQ ID NO: 160441 - DNA, 20 bp, Artificial Sequence
  chemically synthesized
tcaacagttactactctgat

SEQ ID NO: 160442 - DNA, 20 bp, Artificial Sequence
  chemically synthesized
tagctgctgaccgatcagag

SEQ ID NO: 160443 - DNA, 20 bp, Artificial Sequence
  chemically synthesized
agatagctgctgaccgatca

SEQ ID NO: 160444 - DNA, 20 bp, Artificial Sequence
  chemically synthesized
cagttactactctgatcggt

SEQ ID NO: 160445 - DNA, 20 bp, Artificial Sequence
  chemically synthesized
ggagatagctgctgaccgat

SEQ ID NO: 160446 - DNA, 20 bp, Artificial Sequence
  chemically synthesized
ttactactctgatcggtcag

SEQ ID NO: 160447 - DNA, 20 bp, Artificial Sequence
  chemically synthesized
gggtcttgccttgacggaga

SEQ ID NO: 160448 - DNA, 20 bp, Artificial Sequence
  chemically synthesized
ggtcagcagctatctccgtc

SEQ ID NO: 160449 - DNA, 20 bp, Artificial Sequence
  chemically synthesized
gtcagcagctatctccgtca

SEQ ID NO: 160450 - DNA, 20 bp, Artificial Sequence
  chemically synthesized
tggagggtcttgccttgacg

SEQ ID NO: 160451 - DNA, 20 bp, Artificial Sequence
  chemically synthesized
gcagctatctccgtcaaggc

SEQ ID NO: 160452 - DNA, 20 bp, Artificial Sequence
  chemically synthesized
gatggagggtcttgccttga

SEQ ID NO: 160453 - DNA, 20 bp, Artificial Sequence
  chemically synthesized
gtcaaggcaagaccctccat

SEQ ID NO: 160454 - DNA, 20 bp, Artificial Sequence
  chemically synthesized
ttaatctttttgctgatgga

SEQ ID NO: 160455 - DNA, 20 bp, Artificial Sequence
  chemically synthesized
cttaatctttttgctgatgg

SEQ ID NO: 160456 - DNA, 20 bp, Artificial Sequence
  chemically synthesized
tcttaatctttttgctgatg

SEQ ID NO: 160457 - DNA, 20 bp, Artificial Sequence
  chemically synthesized
agtcttaatctttttgctga

SEQ ID NO: 160458 - DNA, 20 bp, Artificial Sequence
  chemically synthesized
caagaccctccatcagcaaa

SEQ ID NO: 160459 - DNA, 20 bp, Artificial Sequence
  chemically synthesized
cctccatcagcaaaaagatt

SEQ ID NO: 160460 - DNA, 20 bp, Artificial Sequence
  chemically synthesized
aaaaagattaagactcattg

SEQ ID NO: 160461 - DNA, 20 bp, Artificial Sequence
  chemically synthesized
aaaagattaagactcattga

SEQ ID NO: 160462 - DNA, 20 bp, Artificial Sequence
  chemically synthesized
cagtcatctgagccttcaat

SEQ ID NO: 160463 - DNA, 20 bp, Artificial Sequence
  chemically synthesized
attaagactcattgaaggct

SEQ ID NO: 160464 - DNA, 20 bp, Artificial Sequence
  chemically synthesized
aagcttgctagcagtcatct

SEQ ID NO: 160465 - DNA, 20 bp, Artificial Sequence
  chemically synthesized
ttgaaggctcagatgactgc

SEQ ID NO: 160466 - DNA, 20 bp, Artificial Sequence
  chemically synthesized
aggctcagatgactgctagc

SEQ ID NO: 160467 - DNA, 20 bp, Artificial Sequence
  chemically synthesized
ttgttgctaaagcttgctag

SEQ ID NO: 160468 - DNA, 20 bp, Artificial Sequence
  chemically synthesized
actttgttgctaaagcttgc

SEQ ID NO: 160469 - DNA, 20 bp, Artificial Sequence
  chemically synthesized
agatgactgctagcaagctt

SEQ ID NO: 160470 - DNA, 20 bp, Artificial Sequence
  chemically synthesized
aaaaaaatactttgttgcta

SEQ ID NO: 160471 - DNA, 20 bp, Artificial Sequence
  chemically synthesized
gctagcaagctttagcaaca

SEQ ID NO: 160472 - DNA, 20 bp, Artificial Sequence
  chemically synthesized
aataatttcaactattgttt

SEQ ID NO: 160473 - DNA, 20 bp, Artificial Sequence
  chemically synthesized
accccttaaatctaaaacaa

SEQ ID NO: 160474 - DNA, 20 bp, Artificial Sequence
  chemically synthesized
tcaactattgttttagattt

SEQ ID NO: 160475 - DNA, 20 bp, Artificial Sequence
  chemically synthesized
caactattgttttagattta

SEQ ID NO: 160476 - DNA, 20 bp, Artificial Sequence
  chemically synthesized
aactattgttttagatttaa

SEQ ID NO: 160477 - DNA, 20 bp, Artificial Sequence
  chemically synthesized
actattgttttagatttaag

SEQ ID NO: 160478 - DNA, 20 bp, Artificial Sequence
  chemically synthesized
agatttaaggggtacatgtg

SEQ ID NO: 160479 - DNA, 20 bp, Artificial Sequence
  chemically synthesized
gatttaaggggtacatgtgc

SEQ ID NO: 160480 - DNA, 20 bp, Artificial Sequence
  chemically synthesized
tgttacatttatatatttat

SEQ ID NO: 160481 - DNA, 20 bp, Artificial Sequence
  chemically synthesized
gttacatttatatatttatt

SEQ ID NO: 160482 - DNA, 20 bp, Artificial Sequence
  chemically synthesized
tatatttattgggtgatact

SEQ ID NO: 160483 - DNA, 20 bp, Artificial Sequence
  chemically synthesized
atatttattgggtgatactg

SEQ ID NO: 160484 - DNA, 20 bp, Artificial Sequence
  chemically synthesized
tattgggtgatactgaggtt

SEQ ID NO: 160485 - DNA, 20 bp, Artificial Sequence
  chemically synthesized
ttgggtgatactgaggtttg

SEQ ID NO: 160486 - DNA, 20 bp, Artificial Sequence
  chemically synthesized
atccatcatactccaaacct

SEQ ID NO: 160487 - DNA, 20 bp, Artificial Sequence
  chemically synthesized
tactgaggtttggagtatga

SEQ ID NO: 160488 - DNA, 20 bp, Artificial Sequence
  chemically synthesized
gtatgatggatcctgtcact

SEQ ID NO: 160489 - DNA, 20 bp, Artificial Sequence
  chemically synthesized
gtgcgcactatctcagtgac

SEQ ID NO: 160490 - DNA, 20 bp, Artificial Sequence
  chemically synthesized
ggtgcgcactatctcagtga

SEQ ID NO: 160491 - DNA, 20 bp, Artificial Sequence
  chemically synthesized
gatggatcctgtcactgaga

SEQ ID NO: 160492 - DNA, 20 bp, Artificial Sequence
  chemically synthesized
agatacggtgcgcactatct

SEQ ID NO: 160493 - DNA, 20 bp, Artificial Sequence
  chemically synthesized
atagtgcgcaccgtatctaa

SEQ ID NO: 160494 - DNA, 20 bp, Artificial Sequence
  chemically synthesized
gaaaaactaactattagata

SEQ ID NO: 160495 - DNA, 20 bp, Artificial Sequence
  chemically synthesized
tgcgcaccgtatctaatagt

SEQ ID NO: 160496 - DNA, 20 bp, Artificial Sequence
  chemically synthesized
agagttgaaaaactaactat

SEQ ID NO: 160497 - DNA, 20 bp, Artificial Sequence
  chemically synthesized
aagagataaggaaggggcaa

SEQ ID NO: 160498 - DNA, 20 bp, Artificial Sequence
  chemically synthesized
ggaagagataaggaaggggc

SEQ ID NO: 160499 - DNA, 20 bp, Artificial Sequence
  chemically synthesized
taggggaagagataaggaag

SEQ ID NO: 160500 - DNA, 20 bp, Artificial Sequence
  chemically synthesized
gtaggggaagagataaggaa

SEQ ID NO: 160501 - DNA, 20 bp, Artificial Sequence
  chemically synthesized
agtaggggaagagataagga

SEQ ID NO: 160502 - DNA, 20 bp, Artificial Sequence
  chemically synthesized
tagtaggggaagagataagg

SEQ ID NO: 160503 - DNA, 20 bp, Artificial Sequence
  chemically synthesized
aactagtaggggaagagata

SEQ ID NO: 160504 - DNA, 20 bp, Artificial Sequence
  chemically synthesized
aaactagtaggggaagagat

SEQ ID NO: 160505 - DNA, 20 bp, Artificial Sequence
  chemically synthesized
actggaaactagtaggggaa

SEQ ID NO: 160506 - DNA, 20 bp, Artificial Sequence
  chemically synthesized
ttccttatctcttcccctac

SEQ ID NO: 160507 - DNA, 20 bp, Artificial Sequence
  chemically synthesized
atactggaaactagtagggg

SEQ ID NO: 160508 - DNA, 20 bp, Artificial Sequence
  chemically synthesized
tacatactggaaactagtag

SEQ ID NO: 160509 - DNA, 20 bp, Artificial Sequence
  chemically synthesized
gtacatactggaaactagta

SEQ ID NO: 160510 - DNA, 20 bp, Artificial Sequence
  chemically synthesized
agtacatactggaaactagt

SEQ ID NO: 160511 - DNA, 20 bp, Artificial Sequence
  chemically synthesized
cagtacatactggaaactag

SEQ ID NO: 160512 - DNA, 20 bp, Artificial Sequence
  chemically synthesized
tctcttcccctactagtttc

SEQ ID NO: 160513 - DNA, 20 bp, Artificial Sequence
  chemically synthesized
caacagtacatactggaaac

SEQ ID NO: 160514 - DNA, 20 bp, Artificial Sequence
  chemically synthesized
aagatggcaacagtacatac

SEQ ID NO: 160515 - DNA, 20 bp, Artificial Sequence
  chemically synthesized
catggacataaagatggcaa

SEQ ID NO: 160516 - DNA, 20 bp, Artificial Sequence
  chemically synthesized
ggcactcatggacataaaga

SEQ ID NO: 160517 - DNA, 20 bp, Artificial Sequence
  chemically synthesized
attgggcactcatggacata

SEQ ID NO: 160518 - DNA, 20 bp, Artificial Sequence
  chemically synthesized
gttgccatctttatgtccat

SEQ ID NO: 160519 - DNA, 20 bp, Artificial Sequence
  chemically synthesized
gcctaaacattgggcactca

SEQ ID NO: 160520 - DNA, 20 bp, Artificial Sequence
  chemically synthesized
gtccatgagtgcccaatgtt

SEQ ID NO: 160521 - DNA, 20 bp, Artificial Sequence
  chemically synthesized
tccatgagtgcccaatgttt

SEQ ID NO: 160522 - DNA, 20 bp, Artificial Sequence
  chemically synthesized
tataagtgggcctaaacatt

SEQ ID NO: 160523 - DNA, 20 bp, Artificial Sequence
  chemically synthesized
ttataagtgggcctaaacat

SEQ ID NO: 160524 - DNA, 20 bp, Artificial Sequence
  chemically synthesized
caatgtttaggcccacttat

SEQ ID NO: 160525 - DNA, 20 bp, Artificial Sequence
  chemically synthesized
ctttgttctcacttataagt

SEQ ID NO: 160526 - DNA, 20 bp, Artificial Sequence
  chemically synthesized
actttgttctcacttataag

SEQ ID NO: 160527 - DNA, 20 bp, Artificial Sequence
  chemically synthesized
gtttaggcccacttataagt

SEQ ID NO: 160528 - DNA, 20 bp, Artificial Sequence
  chemically synthesized
accactttgttctcacttat

SEQ ID NO: 160529 - DNA, 20 bp, Artificial Sequence
  chemically synthesized
cccacttataagtgagaaca

SEQ ID NO: 160530 - DNA, 20 bp, Artificial Sequence
  chemically synthesized
acttataagtgagaacaaag

SEQ ID NO: 160531 - DNA, 20 bp, Artificial Sequence
  chemically synthesized
agtgagaacaaagtggtatt

SEQ ID NO: 160532 - DNA, 20 bp, Artificial Sequence
  chemically synthesized
cgtaaatgaattagtaggaa

SEQ ID NO: 160533 - DNA, 20 bp, Artificial Sequence
  chemically synthesized
attatcgtaaatgaattagt

SEQ ID NO: 160534 - DNA, 20 bp, Artificial Sequence
  chemically synthesized
cattatcgtaaatgaattag

SEQ ID NO: 160535 - DNA, 20 bp, Artificial Sequence
  chemically synthesized
ggccattatcgtaaatgaat

SEQ ID NO: 160536 - DNA, 20 bp, Artificial Sequence
  chemically synthesized
tactaattcatttacgataa

SEQ ID NO: 160537 - DNA, 20 bp, Artificial Sequence
  chemically synthesized
tcatttacgataatggcctc

SEQ ID NO: 160538 - DNA, 20 bp, Artificial Sequence
  chemically synthesized
agcaacatgcatgcaactgg

SEQ ID NO: 160539 - DNA, 20 bp, Artificial Sequence
  chemically synthesized
tagcaacatgcatgcaactg

SEQ ID NO: 160540 - DNA, 20 bp, Artificial Sequence
  chemically synthesized
tgtagcaacatgcatgcaac

SEQ ID NO: 160541 - DNA, 20 bp, Artificial Sequence
  chemically synthesized
gttgcatgcatgttgctaca

SEQ ID NO: 160542 - DNA, 20 bp, Artificial Sequence
  chemically synthesized
ttgcatgcatgttgctacaa

SEQ ID NO: 160543 - DNA, 20 bp, Artificial Sequence
  chemically synthesized
gaatgaaattatgtcctttg

SEQ ID NO: 160544 - DNA, 20 bp, Artificial Sequence
  chemically synthesized
cataatttcattctttttaa

SEQ ID NO: 160545 - DNA, 20 bp, Artificial Sequence
  chemically synthesized
aatactacacaaccattaaa

SEQ ID NO: 160546 - DNA, 20 bp, Artificial Sequence
  chemically synthesized
cattctttttaatggttgtg

SEQ ID NO: 160547 - DNA, 20 bp, Artificial Sequence
  chemically synthesized
tggactggatgaagaaaatg

SEQ ID NO: 160548 - DNA, 20 bp, Artificial Sequence
  chemically synthesized
tgtaccacattttcttcatc

SEQ ID NO: 160549 - DNA, 20 bp, Artificial Sequence
  chemically synthesized
catcaatggtggactggatg

SEQ ID NO: 160550 - DNA, 20 bp, Artificial Sequence
  chemically synthesized
gatgaccatcaatggtggac

SEQ ID NO: 160551 - DNA, 20 bp, Artificial Sequence
  chemically synthesized
ttcatccagtccaccattga

SEQ ID NO: 160552 - DNA, 20 bp, Artificial Sequence
  chemically synthesized
acctagatgaccatcaatgg

SEQ ID NO: 160553 - DNA, 20 bp, Artificial Sequence
  chemically synthesized
tcaacctagatgaccatcaa

SEQ ID NO: 160554 - DNA, 20 bp, Artificial Sequence
  chemically synthesized
gtccaccattgatggtcatc

SEQ ID NO: 160555 - DNA, 20 bp, Artificial Sequence
  chemically synthesized
tccaccattgatggtcatct

SEQ ID NO: 160556 - DNA, 20 bp, Artificial Sequence
  chemically synthesized
gaaaagccaaggaatcaacc

SEQ ID NO: 160557 - DNA, 20 bp, Artificial Sequence
  chemically synthesized
ggtcatctaggttgattcct

SEQ ID NO: 160558 - DNA, 20 bp, Artificial Sequence
  chemically synthesized
tattcacaatagaaaagcca

SEQ ID NO: 160559 - DNA, 20 bp, Artificial Sequence
  chemically synthesized
ctattcacaatagaaaagcc

SEQ ID NO: 160560 - DNA, 20 bp, Artificial Sequence
  chemically synthesized
cagcactattcacaatagaa

SEQ ID NO: 160561 - DNA, 20 bp, Artificial Sequence
  chemically synthesized
cttggcttttctattgtgaa

SEQ ID NO: 160562 - DNA, 20 bp, Artificial Sequence
  chemically synthesized
cactgcagcactattcacaa

SEQ ID NO: 160563 - DNA, 20 bp, Artificial Sequence
  chemically synthesized
ttctattgtgaatagtgctg

SEQ ID NO: 160564 - DNA, 20 bp, Artificial Sequence
  chemically synthesized
atgcacttgtatgttcactg

SEQ ID NO: 160565 - DNA, 20 bp, Artificial Sequence
  chemically synthesized
tagtgctgcagtgaacatac

SEQ ID NO: 160566 - DNA, 20 bp, Artificial Sequence
  chemically synthesized
tacaagtgcatgtgtctttt

SEQ ID NO: 160567 - DNA, 20 bp, Artificial Sequence
  chemically synthesized
aagtgcatgtgtctttttgg

SEQ ID NO: 160568 - DNA, 20 bp, Artificial Sequence
  chemically synthesized
aaataaatcattctaccaaa

SEQ ID NO: 160569 - DNA, 20 bp, Artificial Sequence
  chemically synthesized
tagaatgatttatttacttt

SEQ ID NO: 160570 - DNA, 20 bp, Artificial Sequence
  chemically synthesized
attactgagtatatatccaa

SEQ ID NO: 160571 - DNA, 20 bp, Artificial Sequence
  chemically synthesized
tttacttttggatatatact

SEQ ID NO: 160572 - DNA, 20 bp, Artificial Sequence
  chemically synthesized
tttggatatatactcagtaa

SEQ ID NO: 160573 - DNA, 20 bp, Artificial Sequence
  chemically synthesized
ttggatatatactcagtaat

SEQ ID NO: 160574 - DNA, 20 bp, Artificial Sequence
  chemically synthesized
aacccagcaatcccattact

SEQ ID NO: 160575 - DNA, 20 bp, Artificial Sequence
  chemically synthesized
atactcagtaatgggattgc

SEQ ID NO: 160576 - DNA, 20 bp, Artificial Sequence
  chemically synthesized
tactcagtaatgggattgct

SEQ ID NO: 160577 - DNA, 20 bp, Artificial Sequence
  chemically synthesized
aaatgcactgtcattcaacc

SEQ ID NO: 160578 - DNA, 20 bp, Artificial Sequence
  chemically synthesized
gggattgctgggttgaatga

SEQ ID NO: 160579 - DNA, 20 bp, Artificial Sequence
  chemically synthesized
gttgaatgacagtgcatttt

SEQ ID NO: 160580 - DNA, 20 bp, Artificial Sequence
  chemically synthesized
atgacagtgcattttaagtt

SEQ ID NO: 160581 - DNA, 20 bp, Artificial Sequence
  chemically synthesized
ccactgtggaaagcagtttg

SEQ ID NO: 160582 - DNA, 20 bp, Artificial Sequence
  chemically synthesized
cccactgtggaaagcagttt

SEQ ID NO: 160583 - DNA, 20 bp, Artificial Sequence
  chemically synthesized
acccactgtggaaagcagtt

SEQ ID NO: 160584 - DNA, 20 bp, Artificial Sequence
  chemically synthesized
aatccccaaactgctttcca

SEQ ID NO: 160585 - DNA, 20 bp, Artificial Sequence
  chemically synthesized
agttcacccactgtggaaag

SEQ ID NO: 160586 - DNA, 20 bp, Artificial Sequence
  chemically synthesized
ccccaaactgctttccacag

SEQ ID NO: 160587 - DNA, 20 bp, Artificial Sequence
  chemically synthesized
attagttcacccactgtgga

SEQ ID NO: 160588 - DNA, 20 bp, Artificial Sequence
  chemically synthesized
cccaaactgctttccacagt

SEQ ID NO: 160589 - DNA, 20 bp, Artificial Sequence
  chemically synthesized
gtacattagttcacccactg

SEQ ID NO: 160590 - DNA, 20 bp, Artificial Sequence
  chemically synthesized
ctgttggtgggagtgtacat

SEQ ID NO: 160591 - DNA, 20 bp, Artificial Sequence
  chemically synthesized
ctaatgtacactcccaccaa

SEQ ID NO: 160592 - DNA, 20 bp, Artificial Sequence
  chemically synthesized
acattatacgctgttggtgg

SEQ ID NO: 160593 - DNA, 20 bp, Artificial Sequence
  chemically synthesized
gaacattatacgctgttggt

SEQ ID NO: 160594 - DNA, 20 bp, Artificial Sequence
  chemically synthesized
ggaacattatacgctgttgg

SEQ ID NO: 160595 - DNA, 20 bp, Artificial Sequence
  chemically synthesized
aagggaacattatacgctgt

SEQ ID NO: 160596 - DNA, 20 bp, Artificial Sequence
  chemically synthesized
tggtgaggctgcagagaaaa

SEQ ID NO: 160597 - DNA, 20 bp, Artificial Sequence
  chemically synthesized
ttggtgaggctgcagagaaa

SEQ ID NO: 160598 - DNA, 20 bp, Artificial Sequence
  chemically synthesized
ataatgttcccttttctctg

SEQ ID NO: 160599 - DNA, 20 bp, Artificial Sequence
  chemically synthesized
gttggtgaggctgcagagaa

SEQ ID NO: 160600 - DNA, 20 bp, Artificial Sequence
  chemically synthesized
tagatgttggtgaggctgca

SEQ ID NO: 160601 - DNA, 20 bp, Artificial Sequence
  chemically synthesized
aatagatgttggtgaggctg

SEQ ID NO: 160602 - DNA, 20 bp, Artificial Sequence
  chemically synthesized
aaacacaatagatgttggtg

SEQ ID NO: 160603 - DNA, 20 bp, Artificial Sequence
  chemically synthesized
aaaacacaatagatgttggt

SEQ ID NO: 160604 - DNA, 20 bp, Artificial Sequence
  chemically synthesized
actcaaaacacaatagatgt

SEQ ID NO: 160605 - DNA, 20 bp, Artificial Sequence
  chemically synthesized
atcaaaaactcaaaacacaa

SEQ ID NO: 160606 - DNA, 20 bp, Artificial Sequence
  chemically synthesized
accaacatctattgtgtttt

SEQ ID NO: 160607 - DNA, 20 bp, Artificial Sequence
  chemically synthesized
gtgttttgagtttttgataa

SEQ ID NO: 160608 - DNA, 20 bp, Artificial Sequence
  chemically synthesized
tgttttgagtttttgataat

SEQ ID NO: 160609 - DNA, 20 bp, Artificial Sequence
  chemically synthesized
ttgataataggcattctgac

SEQ ID NO: 160610 - DNA, 20 bp, Artificial Sequence
  chemically synthesized
agataccatctcacaccagt

SEQ ID NO: 160611 - DNA, 20 bp, Artificial Sequence
  chemically synthesized
ataggcattctgactggtgt

SEQ ID NO: 160612 - DNA, 20 bp, Artificial Sequence
  chemically synthesized
aatgagataccatctcacac

SEQ ID NO: 160613 - DNA, 20 bp, Artificial Sequence
  chemically synthesized
gcattctgactggtgtgaga

SEQ ID NO: 160614 - DNA, 20 bp, Artificial Sequence
  chemically synthesized
tgtgagatggtatctcattg

SEQ ID NO: 160615 - DNA, 20 bp, Artificial Sequence
  chemically synthesized
atgcaaatcaaaaccacaat

SEQ ID NO: 160616 - DNA, 20 bp, Artificial Sequence
  chemically synthesized
atttgcatttctctaatgat

SEQ ID NO: 160617 - DNA, 20 bp, Artificial Sequence
  chemically synthesized
ctccacatcactcatcatta

SEQ ID NO: 160618 - DNA, 20 bp, Artificial Sequence
  chemically synthesized
tgctccacatcactcatcat

SEQ ID NO: 160619 - DNA, 20 bp, Artificial Sequence
  chemically synthesized
ttctctaatgatgagtgatg

SEQ ID NO: 160620 - DNA, 20 bp, Artificial Sequence
  chemically synthesized
ctctaatgatgagtgatgtg

SEQ ID NO: 160621 - DNA, 20 bp, Artificial Sequence
  chemically synthesized
gagcattttttcatatctgt

SEQ ID NO: 160622 - DNA, 20 bp, Artificial Sequence
  chemically synthesized
gaagacaaacgggtggctaa

SEQ ID NO: 160623 - DNA, 20 bp, Artificial Sequence
  chemically synthesized
ctcaaaagaagacaaacggg

SEQ ID NO: 160624 - DNA, 20 bp, Artificial Sequence
  chemically synthesized
cttctcaaaagaagacaaac

SEQ ID NO: 160625 - DNA, 20 bp, Artificial Sequence
  chemically synthesized
acttctcaaaagaagacaaa

SEQ ID NO: 160626 - DNA, 20 bp, Artificial Sequence
  chemically synthesized
ccacccgtttgtcttctttt

SEQ ID NO: 160627 - DNA, 20 bp, Artificial Sequence
  chemically synthesized
atatagatacttctcaaaag

SEQ ID NO: 160628 - DNA, 20 bp, Artificial Sequence
  chemically synthesized
cccgtttgtcttcttttgag

SEQ ID NO: 160629 - DNA, 20 bp, Artificial Sequence
  chemically synthesized
aatatatagatacttctcaa

SEQ ID NO: 160630 - DNA, 20 bp, Artificial Sequence
  chemically synthesized
gggcaaaagacatgaatata

SEQ ID NO: 160631 - DNA, 20 bp, Artificial Sequence
  chemically synthesized
cccatgtaaaaagtgggcaa

SEQ ID NO: 160632 - DNA, 20 bp, Artificial Sequence
  chemically synthesized
gataaccccatgtaaaaagt

SEQ ID NO: 160633 - DNA, 20 bp, Artificial Sequence
  chemically synthesized
agataaccccatgtaaaaag

SEQ ID NO: 160634 - DNA, 20 bp, Artificial Sequence
  chemically synthesized
tcttttgcccactttttaca

SEQ ID NO: 160635 - DNA, 20 bp, Artificial Sequence
  chemically synthesized
cttttgcccactttttacat

SEQ ID NO: 160636 - DNA, 20 bp, Artificial Sequence
  chemically synthesized
cgcagataaccccatgtaaa

SEQ ID NO: 160637 - DNA, 20 bp, Artificial Sequence
  chemically synthesized
ttttgcccactttttacatg

SEQ ID NO: 160638 - DNA, 20 bp, Artificial Sequence
  chemically synthesized
ggaacttaacaagcaaaacg

SEQ ID NO: 160639 - DNA, 20 bp, Artificial Sequence
  chemically synthesized
ttatctgcgttttgcttgtt

SEQ ID NO: 160640 - DNA, 20 bp, Artificial Sequence
  chemically synthesized
taatctatagggaacttaac

SEQ ID NO: 160641 - DNA, 20 bp, Artificial Sequence
  chemically synthesized
tttgcttgttaagttcccta

SEQ ID NO: 160642 - DNA, 20 bp, Artificial Sequence
  chemically synthesized
tctaatatccataatctata

SEQ ID NO: 160643 - DNA, 20 bp, Artificial Sequence
  chemically synthesized
atctaatatccataatctat

SEQ ID NO: 160644 - DNA, 20 bp, Artificial Sequence
  chemically synthesized
gttaagttccctatagatta

SEQ ID NO: 160645 - DNA, 20 bp, Artificial Sequence
  chemically synthesized
gatctaatatccataatcta

SEQ ID NO: 160646 - DNA, 20 bp, Artificial Sequence
  chemically synthesized
tccctatagattatggatat

SEQ ID NO: 160647 - DNA, 20 bp, Artificial Sequence
  chemically synthesized
gatattagatctttgtctga

SEQ ID NO: 160648 - DNA, 20 bp, Artificial Sequence
  chemically synthesized
cacaaactatccatcagaca

SEQ ID NO: 160649 - DNA, 20 bp, Artificial Sequence
  chemically synthesized
ttagatctttgtctgatgga

SEQ ID NO: 160650 - DNA, 20 bp, Artificial Sequence
  chemically synthesized
aatatacacaaactatccat

SEQ ID NO: 160651 - DNA, 20 bp, Artificial Sequence
  chemically synthesized
acagacaacccacaagatga

SEQ ID NO: 160652 - DNA, 20 bp, Artificial Sequence
  chemically synthesized
gtatattttctctcatcttg

SEQ ID NO: 160653 - DNA, 20 bp, Artificial Sequence
  chemically synthesized
tatattttctctcatcttgt

SEQ ID NO: 160654 - DNA, 20 bp, Artificial Sequence
  chemically synthesized
aaacagacaacccacaagat

SEQ ID NO: 160655 - DNA, 20 bp, Artificial Sequence
  chemically synthesized
agagtaaacagacaacccac

SEQ ID NO: 160656 - DNA, 20 bp, Artificial Sequence
  chemically synthesized
gaaactatcaacagagtaaa

SEQ ID NO: 160657 - DNA, 20 bp, Artificial Sequence
  chemically synthesized
ttgtctgtttactctgttga

SEQ ID NO: 160658 - DNA, 20 bp, Artificial Sequence
  chemically synthesized
agcaaaagaaactatcaaca

SEQ ID NO: 160659 - DNA, 20 bp, Artificial Sequence
  chemically synthesized
acagcaaaagaaactatcaa

SEQ ID NO: 160660 - DNA, 20 bp, Artificial Sequence
  chemically synthesized
aaagagcttctacacagcaa

SEQ ID NO: 160661 - DNA, 20 bp, Artificial Sequence
  chemically synthesized
tgatagtttcttttgctgtg

SEQ ID NO: 160662 - DNA, 20 bp, Artificial Sequence
  chemically synthesized
tagtttcttttgctgtgtag

SEQ ID NO: 160663 - DNA, 20 bp, Artificial Sequence
  chemically synthesized
taaactaaagagcttctaca

SEQ ID NO: 160664 - DNA, 20 bp, Artificial Sequence
  chemically synthesized
tttgctgtgtagaagctctt

SEQ ID NO: 160665 - DNA, 20 bp, Artificial Sequence
  chemically synthesized
tgggatctaattaaactaaa

SEQ ID NO: 160666 - DNA, 20 bp, Artificial Sequence
  chemically synthesized
agtgggatctaattaaacta

SEQ ID NO: 160667 - DNA, 20 bp, Artificial Sequence
  chemically synthesized
tagaagctctttagtttaat

SEQ ID NO: 160668 - DNA, 20 bp, Artificial Sequence
  chemically synthesized
aaaaccaaaaattaacaagt

SEQ ID NO: 160669 - DNA, 20 bp, Artificial Sequence
  chemically synthesized
caaaaccaaaaattaacaag

SEQ ID NO: 160670 - DNA, 20 bp, Artificial Sequence
  chemically synthesized
taacaaaaccaaaaattaac

SEQ ID NO: 160671 - DNA, 20 bp, Artificial Sequence
  chemically synthesized
agatcccacttgttaatttt

SEQ ID NO: 160672 - DNA, 20 bp, Artificial Sequence
  chemically synthesized
gttttgttacatttgctttt

SEQ ID NO: 160673 - DNA, 20 bp, Artificial Sequence
  chemically synthesized
ttttgttacatttgctttta

SEQ ID NO: 160674 - DNA, 20 bp, Artificial Sequence
  chemically synthesized
attcatgactaagtccttaa

SEQ ID NO: 160675 - DNA, 20 bp, Artificial Sequence
  chemically synthesized
tacatttgcttttaaggact

SEQ ID NO: 160676 - DNA, 20 bp, Artificial Sequence
  chemically synthesized
ttcagaaagaattcatgact

SEQ ID NO: 160677 - DNA, 20 bp, Artificial Sequence
  chemically synthesized
ttagtcatgaattctttctg

SEQ ID NO: 160678 - DNA, 20 bp, Artificial Sequence
  chemically synthesized
tagtcatgaattctttctga

SEQ ID NO: 160679 - DNA, 20 bp, Artificial Sequence
  chemically synthesized
tctggacatcagccttcaga

SEQ ID NO: 160680 - DNA, 20 bp, Artificial Sequence
  chemically synthesized
ctattctggacatcagcctt

SEQ ID NO: 160681 - DNA, 20 bp, Artificial Sequence
  chemically synthesized
tctttctgaaggctgatgtc

SEQ ID NO: 160682 - DNA, 20 bp, Artificial Sequence
  chemically synthesized
ggaaatactattctggacat

SEQ ID NO: 160683 - DNA, 20 bp, Artificial Sequence
  chemically synthesized
ctgaaggctgatgtccagaa

SEQ ID NO: 160684 - DNA, 20 bp, Artificial Sequence
  chemically synthesized
aaacctaggaaatactattc

SEQ ID NO: 160685 - DNA, 20 bp, Artificial Sequence
  chemically synthesized
atgtccagaatagtatttcc

SEQ ID NO: 160686 - DNA, 20 bp, Artificial Sequence
  chemically synthesized
tgtccagaatagtatttcct

SEQ ID NO: 160687 - DNA, 20 bp, Artificial Sequence
  chemically synthesized
agaatcgcagaagaaaacct

SEQ ID NO: 160688 - DNA, 20 bp, Artificial Sequence
  chemically synthesized
aagaatcgcagaagaaaacc

SEQ ID NO: 160689 - DNA, 20 bp, Artificial Sequence
  chemically synthesized
tcaaactagaagaatcgcag

SEQ ID NO: 160690 - DNA, 20 bp, Artificial Sequence
  chemically synthesized
atctcaaactagaagaatcg

SEQ ID NO: 160691 - DNA, 20 bp, Artificial Sequence
  chemically synthesized
gttttcttctgcgattcttc

SEQ ID NO: 160692 - DNA, 20 bp, Artificial Sequence
  chemically synthesized
ttctgcgattcttctagttt

SEQ ID NO: 160693 - DNA, 20 bp, Artificial Sequence
  chemically synthesized
acaataaaatctcaaactag

SEQ ID NO: 160694 - DNA, 20 bp, Artificial Sequence
  chemically synthesized
aatacaataaaatctcaaac

SEQ ID NO: 160695 - DNA, 20 bp, Artificial Sequence
  chemically synthesized
tgtattgtattgtatttatt

SEQ ID NO: 160696 - DNA, 20 bp, Artificial Sequence
  chemically synthesized
gtattgtattgtatttattt

SEQ ID NO: 160697 - DNA, 20 bp, Artificial Sequence
  chemically synthesized
tattgtattgtatttattta

SEQ ID NO: 160698 - DNA, 20 bp, Artificial Sequence
  chemically synthesized
gtattgtatttatttaggga

SEQ ID NO: 160699 - DNA, 20 bp, Artificial Sequence
  chemically synthesized
attgtatttatttagggacg

SEQ ID NO: 160700 - DNA, 20 bp, Artificial Sequence
  chemically synthesized
cttcagcctgacaacagagc

SEQ ID NO: 160701 - DNA, 20 bp, Artificial Sequence
  chemically synthesized
acggagtctcgctctgttgt

SEQ ID NO: 160702 - DNA, 20 bp, Artificial Sequence
  chemically synthesized
cggagtctcgctctgttgtc

SEQ ID NO: 160703 - DNA, 20 bp, Artificial Sequence
  chemically synthesized
tgcacttcagcctgacaaca

SEQ ID NO: 160704 - DNA, 20 bp, Artificial Sequence
  chemically synthesized
actgcacttcagcctgacaa

SEQ ID NO: 160705 - DNA, 20 bp, Artificial Sequence
  chemically synthesized
ctcgctctgttgtcaggctg

SEQ ID NO: 160706 - DNA, 20 bp, Artificial Sequence
  chemically synthesized
tctgttgtcaggctgaagtg

SEQ ID NO: 160707 - DNA, 20 bp, Artificial Sequence
  chemically synthesized
tgcactgcgccactgcactt

SEQ ID NO: 160708 - DNA, 20 bp, Artificial Sequence
  chemically synthesized
gttgtcaggctgaagtgcag

SEQ ID NO: 160709 - DNA, 20 bp, Artificial Sequence
  chemically synthesized
caggctgaagtgcagtggcg

SEQ ID NO: 160710 - DNA, 20 bp, Artificial Sequence
  chemically synthesized
tgcagtggcgcagtgcaatc

SEQ ID NO: 160711 - DNA, 20 bp, Artificial Sequence
  chemically synthesized
gcagtggcgcagtgcaatct

SEQ ID NO: 160712 - DNA, 20 bp, Artificial Sequence
  chemically synthesized
gtcggaggttgcagtgagcc

SEQ ID NO: 160713 - DNA, 20 bp, Artificial Sequence
  chemically synthesized
agggagtcggaggttgcagt

SEQ ID NO: 160714 - DNA, 20 bp, Artificial Sequence
  chemically synthesized
agccagggagtcggaggttg

SEQ ID NO: 160715 - DNA, 20 bp, Artificial Sequence
  chemically synthesized
cgcttgagccagggagtcgg

SEQ ID NO: 160716 - DNA, 20 bp, Artificial Sequence
  chemically synthesized
ccgcttgagccagggagtcg

SEQ ID NO: 160717 - DNA, 20 bp, Artificial Sequence
  chemically synthesized
cactgcaacctccgactccc

SEQ ID NO: 160718 - DNA, 20 bp, Artificial Sequence
  chemically synthesized
aaccgcttgagccagggagt

SEQ ID NO: 160719 - DNA, 20 bp, Artificial Sequence
  chemically synthesized
ggagaaccgcttgagccagg

SEQ ID NO: 160720 - DNA, 20 bp, Artificial Sequence
  chemically synthesized
aacctccgactccctggctc

SEQ ID NO: 160721 - DNA, 20 bp, Artificial Sequence
  chemically synthesized
caggagaaccgcttgagcca

SEQ ID NO: 160722 - DNA, 20 bp, Artificial Sequence
  chemically synthesized
gcaggagaaccgcttgagcc

SEQ ID NO: 160723 - DNA, 20 bp, Artificial Sequence
  chemically synthesized
ctccgactccctggctcaag

SEQ ID NO: 160724 - DNA, 20 bp, Artificial Sequence
  chemically synthesized
ggcaggagaaccgcttgagc

SEQ ID NO: 160725 - DNA, 20 bp, Artificial Sequence
  chemically synthesized
ctgaggcaggagaaccgctt

SEQ ID NO: 160726 - DNA, 20 bp, Artificial Sequence
  chemically synthesized
ctcaagcggttctcctgcct

SEQ ID NO: 160727 - DNA, 20 bp, Artificial Sequence
  chemically synthesized
tacttgggaggctgaggcag

SEQ ID NO: 160728 - DNA, 20 bp, Artificial Sequence
  chemically synthesized
gctacttgggaggctgaggc

SEQ ID NO: 160729 - DNA, 20 bp, Artificial Sequence
  chemically synthesized
agctacttgggaggctgagg

SEQ ID NO: 160730 - DNA, 20 bp, Artificial Sequence
  chemically synthesized
cccagctacttgggaggctg

SEQ ID NO: 160731 - DNA, 20 bp, Artificial Sequence
  chemically synthesized
tcccagctacttgggaggct

SEQ ID NO: 160732 - DNA, 20 bp, Artificial Sequence
  chemically synthesized
ttctcctgcctcagcctccc

SEQ ID NO: 160733 - DNA, 20 bp, Artificial Sequence
  chemically synthesized
tcctgcctcagcctcccaag

SEQ ID NO: 160734 - DNA, 20 bp, Artificial Sequence
  chemically synthesized
tgtaatcccagctacttggg

SEQ ID NO: 160735 - DNA, 20 bp, Artificial Sequence
  chemically synthesized
ctgtaatcccagctacttgg

SEQ ID NO: 160736 - DNA, 20 bp, Artificial Sequence
  chemically synthesized
gcctcagcctcccaagtagc

SEQ ID NO: 160737 - DNA, 20 bp, Artificial Sequence
  chemically synthesized
ccctgtaatcccagctactt

SEQ ID NO: 160738 - DNA, 20 bp, Artificial Sequence
  chemically synthesized
cctcagcctcccaagtagct

SEQ ID NO: 160739 - DNA, 20 bp, Artificial Sequence
  chemically synthesized
tccctgtaatcccagctact

SEQ ID NO: 160740 - DNA, 20 bp, Artificial Sequence
  chemically synthesized
ctcccaagtagctgggatta

SEQ ID NO: 160741 - DNA, 20 bp, Artificial Sequence
  chemically synthesized
tcccaagtagctgggattac

SEQ ID NO: 160742 - DNA, 20 bp, Artificial Sequence
  chemically synthesized
ctggcgcatccctgtaatcc

SEQ ID NO: 160743 - DNA, 20 bp, Artificial Sequence
  chemically synthesized
cccaagtagctgggattaca

SEQ ID NO: 160744 - DNA, 20 bp, Artificial Sequence
  chemically synthesized
ctgggattacagggatgcgc

SEQ ID NO: 160745 - DNA, 20 bp, Artificial Sequence
  chemically synthesized
cagggatgcgccagcatgcc

SEQ ID NO: 160746 - DNA, 20 bp, Artificial Sequence
  chemically synthesized
aaaaaattagctgggcatgc

SEQ ID NO: 160747 - DNA, 20 bp, Artificial Sequence
  chemically synthesized
aaaatacaaaaaaattagct

SEQ ID NO: 160748 - DNA, 20 bp, Artificial Sequence
  chemically synthesized
aaaaatacaaaaaaattagc

SEQ ID NO: 160749 - DNA, 20 bp, Artificial Sequence
  chemically synthesized
tactaaaaatacaaaaaaat

SEQ ID NO: 160750 - DNA, 20 bp, Artificial Sequence
  chemically synthesized
agctaatttttttgtatttt

SEQ ID NO: 160751 - DNA, 20 bp, Artificial Sequence
  chemically synthesized
taatttttttgtatttttag

SEQ ID NO: 160752 - DNA, 20 bp, Artificial Sequence
  chemically synthesized
atttttttgtatttttagta

SEQ ID NO: 160753 - DNA, 20 bp, Artificial Sequence
  chemically synthesized
ttttgtatttttagtagaga

SEQ ID NO: 160754 - DNA, 20 bp, Artificial Sequence
  chemically synthesized
tttgtatttttagtagagac

SEQ ID NO: 160755 - DNA, 20 bp, Artificial Sequence
  chemically synthesized
ttgtatttttagtagagacg

SEQ ID NO: 160756 - DNA, 20 bp, Artificial Sequence
  chemically synthesized
gagacggggtttcaccatgt

SEQ ID NO: 160757 - DNA, 20 bp, Artificial Sequence
  chemically synthesized
cggggtttcaccatgttggc

SEQ ID NO: 160758 - DNA, 20 bp, Artificial Sequence
  chemically synthesized
tgacaccatcctggccaaca

SEQ ID NO: 160759 - DNA, 20 bp, Artificial Sequence
  chemically synthesized
ggggtttcaccatgttggcc

SEQ ID NO: 160760 - DNA, 20 bp, Artificial Sequence
  chemically synthesized
tttcaccatgttggccagga

SEQ ID NO: 160761 - DNA, 20 bp, Artificial Sequence
  chemically synthesized
tcaggagattgacaccatcc

SEQ ID NO: 160762 - DNA, 20 bp, Artificial Sequence
  chemically synthesized
caggtggatcacgaggtcag

SEQ ID NO: 160763 - DNA, 20 bp, Artificial Sequence
  chemically synthesized
agcaggtggatcacgaggtc

SEQ ID NO: 160764 - DNA, 20 bp, Artificial Sequence
  chemically synthesized
aagcaggtggatcacgaggt

SEQ ID NO: 160765 - DNA, 20 bp, Artificial Sequence
  chemically synthesized
gctgaagcaggtggatcacg

SEQ ID NO: 160766 - DNA, 20 bp, Artificial Sequence
  chemically synthesized
ggctgaagcaggtggatcac

SEQ ID NO: 160767 - DNA, 20 bp, Artificial Sequence
  chemically synthesized
acctcgtgatccacctgctt

SEQ ID NO: 160768 - DNA, 20 bp, Artificial Sequence
  chemically synthesized
ctttgggaggctgaagcagg

SEQ ID NO: 160769 - DNA, 20 bp, Artificial Sequence
  chemically synthesized
gcactttgggaggctgaagc

SEQ ID NO: 160770 - DNA, 20 bp, Artificial Sequence
  chemically synthesized
agcactttgggaggctgaag

SEQ ID NO: 160771 - DNA, 20 bp, Artificial Sequence
  chemically synthesized
cccagcactttgggaggctg

SEQ ID NO: 160772 - DNA, 20 bp, Artificial Sequence
  chemically synthesized
ccacctgcttcagcctccca

SEQ ID NO: 160773 - DNA, 20 bp, Artificial Sequence
  chemically synthesized
tgtaatcccagcactttggg

SEQ ID NO: 160774 - DNA, 20 bp, Artificial Sequence
  chemically synthesized
ctgtaatcccagcactttgg

SEQ ID NO: 160775 - DNA, 20 bp, Artificial Sequence
  chemically synthesized
gcttcagcctcccaaagtgc

SEQ ID NO: 160776 - DNA, 20 bp, Artificial Sequence
  chemically synthesized
gcctgtaatcccagcacttt

SEQ ID NO: 160777 - DNA, 20 bp, Artificial Sequence
  chemically synthesized
cttcagcctcccaaagtgct

SEQ ID NO: 160778 - DNA, 20 bp, Artificial Sequence
  chemically synthesized
cgcctgtaatcccagcactt

SEQ ID NO: 160779 - DNA, 20 bp, Artificial Sequence
  chemically synthesized
ctcccaaagtgctgggatta

SEQ ID NO: 160780 - DNA, 20 bp, Artificial Sequence
  chemically synthesized
tcccaaagtgctgggattac

SEQ ID NO: 160781 - DNA, 20 bp, Artificial Sequence
  chemically synthesized
gtggctcacgcctgtaatcc

SEQ ID NO: 160782 - DNA, 20 bp, Artificial Sequence
  chemically synthesized
agtgctgggattacaggcgt

SEQ ID NO: 160783 - DNA, 20 bp, Artificial Sequence
  chemically synthesized
caggcgtgagccaccgcacc

SEQ ID NO: 160784 - DNA, 20 bp, Artificial Sequence
  chemically synthesized
aaaatctcagccaggtgcgg

SEQ ID NO: 160785 - DNA, 20 bp, Artificial Sequence
  chemically synthesized
aataaaatctcagccaggtg

SEQ ID NO: 160786 - DNA, 20 bp, Artificial Sequence
  chemically synthesized
gtgagccaccgcacctggct

SEQ ID NO: 160787 - DNA, 20 bp, Artificial Sequence
  chemically synthesized
aaaaaaataaaatctcagcc

SEQ ID NO: 160788 - DNA, 20 bp, Artificial Sequence
  chemically synthesized
taaaaaaataaaatctcagc

SEQ ID NO: 160789 - DNA, 20 bp, Artificial Sequence
  chemically synthesized
gatttaaaaaaataaaatct

SEQ ID NO: 160790 - DNA, 20 bp, Artificial Sequence
  chemically synthesized
aattaactcaagatggatta

SEQ ID NO: 160791 - DNA, 20 bp, Artificial Sequence
  chemically synthesized
ttaaatctttaatccatctt

SEQ ID NO: 160792 - DNA, 20 bp, Artificial Sequence
  chemically synthesized
atacaaaaattaactcaaga

SEQ ID NO: 160793 - DNA, 20 bp, Artificial Sequence
  chemically synthesized
ctatatacaaaaattaactc

SEQ ID NO: 160794 - DNA, 20 bp, Artificial Sequence
  chemically synthesized
cttgagttaatttttgtata

SEQ ID NO: 160795 - DNA, 20 bp, Artificial Sequence
  chemically synthesized
ttaatttttgtatatagtga

SEQ ID NO: 160796 - DNA, 20 bp, Artificial Sequence
  chemically synthesized
taatttttgtatatagtgaa

SEQ ID NO: 160797 - DNA, 20 bp, Artificial Sequence
  chemically synthesized
tttttgtatatagtgaaagg

SEQ ID NO: 160798 - DNA, 20 bp, Artificial Sequence
  chemically synthesized
ttttgtatatagtgaaaggt

SEQ ID NO: 160799 - DNA, 20 bp, Artificial Sequence
  chemically synthesized
ttgtatatagtgaaaggtag

SEQ ID NO: 160800 - DNA, 20 bp, Artificial Sequence
  chemically synthesized
tatagtgaaaggtaggagtc

SEQ ID NO: 160801 - DNA, 20 bp, Artificial Sequence
  chemically synthesized
cgtatccagaggaatgaaac

SEQ ID NO: 160802 - DNA, 20 bp, Artificial Sequence
  chemically synthesized
ggagtccagtttcattcctc

SEQ ID NO: 160803 - DNA, 20 bp, Artificial Sequence
  chemically synthesized
cagtttcattcctctggata

SEQ ID NO: 160804 - DNA, 20 bp, Artificial Sequence
  chemically synthesized
agctggctaaccgtatccag

SEQ ID NO: 160805 - DNA, 20 bp, Artificial Sequence
  chemically synthesized
tagctggctaaccgtatcca

SEQ ID NO: 160806 - DNA, 20 bp, Artificial Sequence
  chemically synthesized
gatagctggctaaccgtatc

SEQ ID NO: 160807 - DNA, 20 bp, Artificial Sequence
  chemically synthesized
ttcattcctctggatacggt

SEQ ID NO: 160808 - DNA, 20 bp, Artificial Sequence
  chemically synthesized
ttcctctggatacggttagc

SEQ ID NO: 160809 - DNA, 20 bp, Artificial Sequence
  chemically synthesized
atacggttagccagctatcc

SEQ ID NO: 160810 - DNA, 20 bp, Artificial Sequence
  chemically synthesized
ataaacggtgctgggatagc

SEQ ID NO: 160811 - DNA, 20 bp, Artificial Sequence
  chemically synthesized
ctcaataaacggtgctggga

SEQ ID NO: 160812 - DNA, 20 bp, Artificial Sequence
  chemically synthesized
cctactcaataaacggtgct

SEQ ID NO: 160813 - DNA, 20 bp, Artificial Sequence
  chemically synthesized
ccctactcaataaacggtgc

SEQ ID NO: 160814 - DNA, 20 bp, Artificial Sequence
  chemically synthesized
ctatcccagcaccgtttatt

SEQ ID NO: 160815 - DNA, 20 bp, Artificial Sequence
  chemically synthesized
aggactccctactcaataaa

SEQ ID NO: 160816 - DNA, 20 bp, Artificial Sequence
  chemically synthesized
tcccagcaccgtttattgag

SEQ ID NO: 160817 - DNA, 20 bp, Artificial Sequence
  chemically synthesized
cccagcaccgtttattgagt

SEQ ID NO: 160818 - DNA, 20 bp, Artificial Sequence
  chemically synthesized
ccagcaccgtttattgagta

SEQ ID NO: 160819 - DNA, 20 bp, Artificial Sequence
  chemically synthesized
agcaccgtttattgagtagg

SEQ ID NO: 160820 - DNA, 20 bp, Artificial Sequence
  chemically synthesized
aaaaaaaaaaaaatggggaa

SEQ ID NO: 160821 - DNA, 20 bp, Artificial Sequence
  chemically synthesized
aaaaaaaaaaaaaatgggga

SEQ ID NO: 160822 - DNA, 20 bp, Artificial Sequence
  chemically synthesized
aaacaaaaaaaaaaaaaatg

SEQ ID NO: 160823 - DNA, 20 bp, Artificial Sequence
  chemically synthesized
taaacaaaaaaaaaaaaaat

SEQ ID NO: 160824 - DNA, 20 bp, Artificial Sequence
  chemically synthesized
gtaaacaaaaaaaaaaaaaa

SEQ ID NO: 160825 - DNA, 20 bp, Artificial Sequence
  chemically synthesized
tttttttgtttactttgtta

SEQ ID NO: 160826 - DNA, 20 bp, Artificial Sequence
  chemically synthesized
cagccatctgatctttaaca

SEQ ID NO: 160827 - DNA, 20 bp, Artificial Sequence
  chemically synthesized
ttgtttactttgttaaagat

SEQ ID NO: 160828 - DNA, 20 bp, Artificial Sequence
  chemically synthesized
ttactttgttaaagatcaga

SEQ ID NO: 160829 - DNA, 20 bp, Artificial Sequence
  chemically synthesized
tgttaaagatcagatggctg

SEQ ID NO: 160830 - DNA, 20 bp, Artificial Sequence
  chemically synthesized
gttaaagatcagatggctgt

SEQ ID NO: 160831 - DNA, 20 bp, Artificial Sequence
  chemically synthesized
gaaataaagccgcataccta

SEQ ID NO: 160832 - DNA, 20 bp, Artificial Sequence
  chemically synthesized
atcagatggctgtaggtatg

SEQ ID NO: 160833 - DNA, 20 bp, Artificial Sequence
  chemically synthesized
aggtatgcggctttatttct

SEQ ID NO: 160834 - DNA, 20 bp, Artificial Sequence
  chemically synthesized
gaatagagaactcagaaata

SEQ ID NO: 160835 - DNA, 20 bp, Artificial Sequence
  chemically synthesized
gtagaacagaatagagaact

SEQ ID NO: 160836 - DNA, 20 bp, Artificial Sequence
  chemically synthesized
tggaccagtagaacagaata

SEQ ID NO: 160837 - DNA, 20 bp, Artificial Sequence
  chemically synthesized
cttggaccagtagaacagaa

SEQ ID NO: 160838 - DNA, 20 bp, Artificial Sequence
  chemically synthesized
agttctctattctgttctac

SEQ ID NO: 160839 - DNA, 20 bp, Artificial Sequence
  chemically synthesized
agaaacttggaccagtagaa

SEQ ID NO: 160840 - DNA, 20 bp, Artificial Sequence
  chemically synthesized
ctattctgttctactggtcc

SEQ ID NO: 160841 - DNA, 20 bp, Artificial Sequence
  chemically synthesized
aaaacagaaacttggaccag

SEQ ID NO: 160842 - DNA, 20 bp, Artificial Sequence
  chemically synthesized
acaaaaacagaaacttggac

SEQ ID NO: 160843 - DNA, 20 bp, Artificial Sequence
  chemically synthesized
cttctacaaaaacagaaact

SEQ ID NO: 160844 - DNA, 20 bp, Artificial Sequence
  chemically synthesized
ggtccaagtttctgtttttg

SEQ ID NO: 160845 - DNA, 20 bp, Artificial Sequence
  chemically synthesized
gaatgggacttctacaaaaa

SEQ ID NO: 160846 - DNA, 20 bp, Artificial Sequence
  chemically synthesized
ccaagtttctgtttttgtag

SEQ ID NO: 160847 - DNA, 20 bp, Artificial Sequence
  chemically synthesized
tacagttacccaaagagaat

SEQ ID NO: 160848 - DNA, 20 bp, Artificial Sequence
  chemically synthesized
tgtagaagtcccattctctt

SEQ ID NO: 160849 - DNA, 20 bp, Artificial Sequence
  chemically synthesized
ctacagttacccaaagagaa

SEQ ID NO: 160850 - DNA, 20 bp, Artificial Sequence
  chemically synthesized
gtagaagtcccattctcttt

SEQ ID NO: 160851 - DNA, 20 bp, Artificial Sequence
  chemically synthesized
taaggctacagttacccaaa

SEQ ID NO: 160852 - DNA, 20 bp, Artificial Sequence
  chemically synthesized
tataaggctacagttaccca

SEQ ID NO: 160853 - DNA, 20 bp, Artificial Sequence
  chemically synthesized
ccattctctttgggtaactg

SEQ ID NO: 160854 - DNA, 20 bp, Artificial Sequence
  chemically synthesized
caaactatactataaggcta

SEQ ID NO: 160855 - DNA, 20 bp, Artificial Sequence
  chemically synthesized
tttgggtaactgtagcctta

SEQ ID NO: 160856 - DNA, 20 bp, Artificial Sequence
  chemically synthesized
gtaactgtagccttatagta

SEQ ID NO: 160857 - DNA, 20 bp, Artificial Sequence
  chemically synthesized
caacttcaaactatactata

SEQ ID NO: 160858 - DNA, 20 bp, Artificial Sequence
  chemically synthesized
ccaacttcaaactatactat

SEQ ID NO: 160859 - DNA, 20 bp, Artificial Sequence
  chemically synthesized
tagccttatagtatagtttg

SEQ ID NO: 160860 - DNA, 20 bp, Artificial Sequence
  chemically synthesized
cttatagtatagtttgaagt

SEQ ID NO: 160861 - DNA, 20 bp, Artificial Sequence
  chemically synthesized
aatgctaagtgaaaagaata

SEQ ID NO: 160862 - DNA, 20 bp, Artificial Sequence
  chemically synthesized
catgctttattcttttcact

SEQ ID NO: 160863 - DNA, 20 bp, Artificial Sequence
  chemically synthesized
taaaaacaatgctaagtgaa

SEQ ID NO: 160864 - DNA, 20 bp, Artificial Sequence
  chemically synthesized
tgaagagtaaaaacaatgct

SEQ ID NO: 160865 - DNA, 20 bp, Artificial Sequence
  chemically synthesized
ttagcattgtttttactctt

SEQ ID NO: 160866 - DNA, 20 bp, Artificial Sequence
  chemically synthesized
aatctaaaaaacagtctgaa

SEQ ID NO: 160867 - DNA, 20 bp, Artificial Sequence
  chemically synthesized
tgaatctaaaaaacagtctg

SEQ ID NO: 160868 - DNA, 20 bp, Artificial Sequence
  chemically synthesized
ttactcttcagactgttttt

SEQ ID NO: 160869 - DNA, 20 bp, Artificial Sequence
  chemically synthesized
attcatatgaatctaaaaaa

SEQ ID NO: 160870 - DNA, 20 bp, Artificial Sequence
  chemically synthesized
ttttagattcatatgaattt

SEQ ID NO: 160871 - DNA, 20 bp, Artificial Sequence
  chemically synthesized
tttagattcatatgaatttt

SEQ ID NO: 160872 - DNA, 20 bp, Artificial Sequence
  chemically synthesized
gattcatatgaattttagga

SEQ ID NO: 160873 - DNA, 20 bp, Artificial Sequence
  chemically synthesized
actagcaatgtcatttttca

SEQ ID NO: 160874 - DNA, 20 bp, Artificial Sequence
  chemically synthesized
tctgtgaaaaatgacattgc

SEQ ID NO: 160875 - DNA, 20 bp, Artificial Sequence
  chemically synthesized
aaatgacattgctagtttga

SEQ ID NO: 160876 - DNA, 20 bp, Artificial Sequence
  chemically synthesized
aatgacattgctagtttgat

SEQ ID NO: 160877 - DNA, 20 bp, Artificial Sequence
  chemically synthesized
caatgctattcctatcaaac

SEQ ID NO: 160878 - DNA, 20 bp, Artificial Sequence
  chemically synthesized
cattgctagtttgataggaa

SEQ ID NO: 160879 - DNA, 20 bp, Artificial Sequence
  chemically synthesized
taggaatagcattgaatctg

SEQ ID NO: 160880 - DNA, 20 bp, Artificial Sequence
  chemically synthesized
atactgcttaaagcaatcta

SEQ ID NO: 160881 - DNA, 20 bp, Artificial Sequence
  chemically synthesized
ttgaatctgtagattgcttt

SEQ ID NO: 160882 - DNA, 20 bp, Artificial Sequence
  chemically synthesized
aatctgtagattgctttaag

SEQ ID NO: 160883 - DNA, 20 bp, Artificial Sequence
  chemically synthesized
taaaatggacatactgctta

SEQ ID NO: 160884 - DNA, 20 bp, Artificial Sequence
  chemically synthesized
aagaatcaatatcattaaaa

SEQ ID NO: 160885 - DNA, 20 bp, Artificial Sequence
  chemically synthesized
attccatgttaatggaaagg

SEQ ID NO: 160886 - DNA, 20 bp, Artificial Sequence
  chemically synthesized
aacattccatgttaatggaa

SEQ ID NO: 160887 - DNA, 20 bp, Artificial Sequence
  chemically synthesized
aaacattccatgttaatgga

SEQ ID NO: 160888 - DNA, 20 bp, Artificial Sequence
  chemically synthesized
attcttcctttccattaaca

SEQ ID NO: 160889 - DNA, 20 bp, Artificial Sequence
  chemically synthesized
ggagaaacattccatgttaa

SEQ ID NO: 160890 - DNA, 20 bp, Artificial Sequence
  chemically synthesized
atagataacacaaacaaatg

SEQ ID NO: 160891 - DNA, 20 bp, Artificial Sequence
  chemically synthesized
ccatagataacacaaacaaa

SEQ ID NO: 160892 - DNA, 20 bp, Artificial Sequence
  chemically synthesized
ccatttgtttgtgttatcta

SEQ ID NO: 160893 - DNA, 20 bp, Artificial Sequence
  chemically synthesized
aacactgctgaaagaaacca

SEQ ID NO: 160894 - DNA, 20 bp, Artificial Sequence
  chemically synthesized
gtgttatctatggtttcttt

SEQ ID NO: 160895 - DNA, 20 bp, Artificial Sequence
  chemically synthesized
ttatctatggtttctttcag

SEQ ID NO: 160896 - DNA, 20 bp, Artificial Sequence
  chemically synthesized
taactacaaaacactgctga

SEQ ID NO: 160897 - DNA, 20 bp, Artificial Sequence
  chemically synthesized
tttctttcagcagtgttttg

SEQ ID NO: 160898 - DNA, 20 bp, Artificial Sequence
  chemically synthesized
tttcagcagtgttttgtagt

SEQ ID NO: 160899 - DNA, 20 bp, Artificial Sequence
  chemically synthesized
gtgttttgtagttagccctg

SEQ ID NO: 160900 - DNA, 20 bp, Artificial Sequence
  chemically synthesized
gttttgtagttagccctgta

SEQ ID NO: 160901 - DNA, 20 bp, Artificial Sequence
  chemically synthesized
agaagtgaaagatctctaca

SEQ ID NO: 160902 - DNA, 20 bp, Artificial Sequence
  chemically synthesized
aagaagtgaaagatctctac

SEQ ID NO: 160903 - DNA, 20 bp, Artificial Sequence
  chemically synthesized
aaagaagtgaaagatctcta

SEQ ID NO: 160904 - DNA, 20 bp, Artificial Sequence
  chemically synthesized
acatctaaccaaagaagtga

SEQ ID NO: 160905 - DNA, 20 bp, Artificial Sequence
  chemically synthesized
gtagagatctttcacttctt

SEQ ID NO: 160906 - DNA, 20 bp, Artificial Sequence
  chemically synthesized
agatctttcacttctttggt

SEQ ID NO: 160907 - DNA, 20 bp, Artificial Sequence
  chemically synthesized
aggaatacatctaaccaaag

SEQ ID NO: 160908 - DNA, 20 bp, Artificial Sequence
  chemically synthesized
tctaggaatacatctaacca

SEQ ID NO: 160909 - DNA, 20 bp, Artificial Sequence
  chemically synthesized
tctttggttagatgtattcc

SEQ ID NO: 160910 - DNA, 20 bp, Artificial Sequence
  chemically synthesized
ccacaaaaaataaaatatct

SEQ ID NO: 160911 - DNA, 20 bp, Artificial Sequence
  chemically synthesized
accacaaaaaataaaatatc

SEQ ID NO: 160912 - DNA, 20 bp, Artificial Sequence
  chemically synthesized
cctagatattttattttttg

SEQ ID NO: 160913 - DNA, 20 bp, Artificial Sequence
  chemically synthesized
ttttttgtggttattgtaaa

SEQ ID NO: 160914 - DNA, 20 bp, Artificial Sequence
  chemically synthesized
aatagtttgcattcttgatt

SEQ ID NO: 160915 - DNA, 20 bp, Artificial Sequence
  chemically synthesized
ttcaagctgagagccaaatc

SEQ ID NO: 160916 - DNA, 20 bp, Artificial Sequence
  chemically synthesized
tgcattcttgatttggctct

SEQ ID NO: 160917 - DNA, 20 bp, Artificial Sequence
  chemically synthesized
tattgcagtgttcaagctga

SEQ ID NO: 160918 - DNA, 20 bp, Artificial Sequence
  chemically synthesized
gttattgcagtgttcaagct

SEQ ID NO: 160919 - DNA, 20 bp, Artificial Sequence
  chemically synthesized
aatatgttattgcagtgttc

SEQ ID NO: 160920 - DNA, 20 bp, Artificial Sequence
  chemically synthesized
aatttaaaaatatgttattg

SEQ ID NO: 160921 - DNA, 20 bp, Artificial Sequence
  chemically synthesized
caataacatatttttaaatt

SEQ ID NO: 160922 - DNA, 20 bp, Artificial Sequence
  chemically synthesized
aataacatatttttaaatta

SEQ ID NO: 160923 - DNA, 20 bp, Artificial Sequence
  chemically synthesized
ttaaattaaggcatgtacat

SEQ ID NO: 160924 - DNA, 20 bp, Artificial Sequence
  chemically synthesized
aaggcatgtacattagtttt

SEQ ID NO: 160925 - DNA, 20 bp, Artificial Sequence
  chemically synthesized
aggcatgtacattagttttt

SEQ ID NO: 160926 - DNA, 20 bp, Artificial Sequence
  chemically synthesized
gtaatctattaagtatacaa

SEQ ID NO: 160927 - DNA, 20 bp, Artificial Sequence
  chemically synthesized
atacactattgtatacttaa

SEQ ID NO: 160928 - DNA, 20 bp, Artificial Sequence
  chemically synthesized
acactacactgtaatctatt

SEQ ID NO: 160929 - DNA, 20 bp, Artificial Sequence
  chemically synthesized
attgtatacttaatagatta

SEQ ID NO: 160930 - DNA, 20 bp, Artificial Sequence
  chemically synthesized
atacttaatagattacagtg

SEQ ID NO: 160931 - DNA, 20 bp, Artificial Sequence
  chemically synthesized
tcctggtacatatagaagtc

SEQ ID NO: 160932 - DNA, 20 bp, Artificial Sequence
  chemically synthesized
ttcctggtacatatagaagt

SEQ ID NO: 160933 - DNA, 20 bp, Artificial Sequence
  chemically synthesized
tggtttcctggtacatatag

SEQ ID NO: 160934 - DNA, 20 bp, Artificial Sequence
  chemically synthesized
cacctgacttctatatgtac

SEQ ID NO: 160935 - DNA, 20 bp, Artificial Sequence
  chemically synthesized
ttttggtttcctggtacata

SEQ ID NO: 160936 - DNA, 20 bp, Artificial Sequence
  chemically synthesized
acctgacttctatatgtacc

SEQ ID NO: 160937 - DNA, 20 bp, Artificial Sequence
  chemically synthesized
acatgaactttttggtttcc

SEQ ID NO: 160938 - DNA, 20 bp, Artificial Sequence
  chemically synthesized
atatgtaccaggaaaccaaa

SEQ ID NO: 160939 - DNA, 20 bp, Artificial Sequence
  chemically synthesized
agtgagtcacatgaactttt

SEQ ID NO: 160940 - DNA, 20 bp, Artificial Sequence
  chemically synthesized
ccagaccaccataataaagt

SEQ ID NO: 160941 - DNA, 20 bp, Artificial Sequence
  chemically synthesized
tcatgtgactcactttatta

SEQ ID NO: 160942 - DNA, 20 bp, Artificial Sequence
  chemically synthesized
agttccagaccaccataata

SEQ ID NO: 160943 - DNA, 20 bp, Artificial Sequence
  chemically synthesized
tgtgactcactttattatgg

SEQ ID NO: 160944 - DNA, 20 bp, Artificial Sequence
  chemically synthesized
ctcactttattatggtggtc

SEQ ID NO: 160945 - DNA, 20 bp, Artificial Sequence
  chemically synthesized
agacactgaaggttcagttc

SEQ ID NO: 160946 - DNA, 20 bp, Artificial Sequence
  chemically synthesized
gtggtctggaactgaacctt

SEQ ID NO: 160947 - DNA, 20 bp, Artificial Sequence
  chemically synthesized
cctctgagacactgaaggtt

SEQ ID NO: 160948 - DNA, 20 bp, Artificial Sequence
  chemically synthesized
gcatacctctgagacactga

SEQ ID NO: 160949 - DNA, 20 bp, Artificial Sequence
  chemically synthesized
ggcatacctctgagacactg

SEQ ID NO: 160950 - DNA, 20 bp, Artificial Sequence
  chemically synthesized
gaactgaaccttcagtgtct

SEQ ID NO: 160951 - DNA, 20 bp, Artificial Sequence
  chemically synthesized
actgaaccttcagtgtctca

SEQ ID NO: 160952 - DNA, 20 bp, Artificial Sequence
  chemically synthesized
ctgaaccttcagtgtctcag

SEQ ID NO: 160953 - DNA, 20 bp, Artificial Sequence
  chemically synthesized
acatatacaggcatacctct

SEQ ID NO: 160954 - DNA, 20 bp, Artificial Sequence
  chemically synthesized
atatatgtatacacatatac

SEQ ID NO: 160955 - DNA, 20 bp, Artificial Sequence
  chemically synthesized
tatatatgtatacacatata

SEQ ID NO: 160956 - DNA, 20 bp, Artificial Sequence
  chemically synthesized
atatgtatatgtatgctatg

SEQ ID NO: 160957 - DNA, 20 bp, Artificial Sequence
  chemically synthesized
gtatatgtatgctatgaaga

SEQ ID NO: 160958 - DNA, 20 bp, Artificial Sequence
  chemically synthesized
ctctttttaatctttcttca

SEQ ID NO: 160959 - DNA, 20 bp, Artificial Sequence
  chemically synthesized
tgctatgaagaaagattaaa

SEQ ID NO: 160960 - DNA, 20 bp, Artificial Sequence
  chemically synthesized
ctatgaagaaagattaaaaa

SEQ ID NO: 160961 - DNA, 20 bp, Artificial Sequence
  chemically synthesized
gaagaaagattaaaaagagt

SEQ ID NO: 160962 - DNA, 20 bp, Artificial Sequence
  chemically synthesized
gaaagattaaaaagagtaag

SEQ ID NO: 160963 - DNA, 20 bp, Artificial Sequence
  chemically synthesized
aagattaaaaagagtaagta

SEQ ID NO: 160964 - DNA, 20 bp, Artificial Sequence
  chemically synthesized
gattaaaaagagtaagtaga

SEQ ID NO: 160965 - DNA, 20 bp, Artificial Sequence
  chemically synthesized
aaagagtaagtagagagtga

SEQ ID NO: 160966 - DNA, 20 bp, Artificial Sequence
  chemically synthesized
gagtaagtagagagtgacag

SEQ ID NO: 160967 - DNA, 20 bp, Artificial Sequence
  chemically synthesized
agtaagtagagagtgacagt

SEQ ID NO: 160968 - DNA, 20 bp, Artificial Sequence
  chemically synthesized
agtgacagtgggctctattt

SEQ ID NO: 160969 - DNA, 20 bp, Artificial Sequence
  chemically synthesized
gtgacagtgggctctatttt

SEQ ID NO: 160970 - DNA, 20 bp, Artificial Sequence
  chemically synthesized
tgctcacattgcctaaaata

SEQ ID NO: 160971 - DNA, 20 bp, Artificial Sequence
  chemically synthesized
tgtgctcacattgcctaaaa

SEQ ID NO: 160972 - DNA, 20 bp, Artificial Sequence
  chemically synthesized
ggctctattttaggcaatgt

SEQ ID NO: 160973 - DNA, 20 bp, Artificial Sequence
  chemically synthesized
tattttaggcaatgtgagca

SEQ ID NO: 160974 - DNA, 20 bp, Artificial Sequence
  chemically synthesized
tttaggcaatgtgagcacag

SEQ ID NO: 160975 - DNA, 20 bp, Artificial Sequence
  chemically synthesized
ccatttcctgaagagaggag

SEQ ID NO: 160976 - DNA, 20 bp, Artificial Sequence
  chemically synthesized
cagaagactgctcctctctt

SEQ ID NO: 160977 - DNA, 20 bp, Artificial Sequence
  chemically synthesized
attccatttcctgaagagag

SEQ ID NO: 160978 - DNA, 20 bp, Artificial Sequence
  chemically synthesized
agaagactgctcctctcttc

SEQ ID NO: 160979 - DNA, 20 bp, Artificial Sequence
  chemically synthesized
tcattccatttcctgaagag

SEQ ID NO: 160980 - DNA, 20 bp, Artificial Sequence
  chemically synthesized
ttcattccatttcctgaaga

SEQ ID NO: 160981 - DNA, 20 bp, Artificial Sequence
  chemically synthesized
acttcattccatttcctgaa

SEQ ID NO: 160982 - DNA, 20 bp, Artificial Sequence
  chemically synthesized
ctgctcctctcttcaggaaa

SEQ ID NO: 160983 - DNA, 20 bp, Artificial Sequence
  chemically synthesized
tcacttcattccatttcctg

SEQ ID NO: 160984 - DNA, 20 bp, Artificial Sequence
  chemically synthesized
tctcttcaggaaatggaatg

SEQ ID NO: 160985 - DNA, 20 bp, Artificial Sequence
  chemically synthesized
tcaggaaatggaatgaagtg

SEQ ID NO: 160986 - DNA, 20 bp, Artificial Sequence
  chemically synthesized
atggaatgaagtgaagaaat

SEQ ID NO: 160987 - DNA, 20 bp, Artificial Sequence
  chemically synthesized
tgagtcatgtcaacatactg

SEQ ID NO: 160988 - DNA, 20 bp, Artificial Sequence
  chemically synthesized
cctctgcctgaaatagtctt

SEQ ID NO: 160989 - DNA, 20 bp, Artificial Sequence
  chemically synthesized
caacatactgaagactattt

SEQ ID NO: 160990 - DNA, 20 bp, Artificial Sequence
  chemically synthesized
aacatactgaagactatttc

SEQ ID NO: 160991 - DNA, 20 bp, Artificial Sequence
  chemically synthesized
atactgaagactatttcagg

SEQ ID NO: 160992 - DNA, 20 bp, Artificial Sequence
  chemically synthesized
gcttttccctctgcctgaaa

SEQ ID NO: 160993 - DNA, 20 bp, Artificial Sequence
  chemically synthesized
actgaagactatttcaggca

SEQ ID NO: 160994 - DNA, 20 bp, Artificial Sequence
  chemically synthesized
ctgaagactatttcaggcag

SEQ ID NO: 160995 - DNA, 20 bp, Artificial Sequence
  chemically synthesized
tgaagactatttcaggcaga

SEQ ID NO: 160996 - DNA, 20 bp, Artificial Sequence
  chemically synthesized
actatttcaggcagagggaa

SEQ ID NO: 160997 - DNA, 20 bp, Artificial Sequence
  chemically synthesized
tttcaggcagagggaaaagc

SEQ ID NO: 160998 - DNA, 20 bp, Artificial Sequence
  chemically synthesized
aaagcaagttccattgccaa

SEQ ID NO: 160999 - DNA, 20 bp, Artificial Sequence
  chemically synthesized
tcctcaccgccttttggcaa

SEQ ID NO: 161000 - DNA, 20 bp, Artificial Sequence
  chemically synthesized
aagcaagttccattgccaaa

SEQ ID NO: 161001 - DNA, 20 bp, Artificial Sequence
  chemically synthesized
caagttccattgccaaaagg

SEQ ID NO: 161002 - DNA, 20 bp, Artificial Sequence
  chemically synthesized
caaaactcctcaccgccttt

SEQ ID NO: 161003 - DNA, 20 bp, Artificial Sequence
  chemically synthesized
ttccattgccaaaaggcggt

SEQ ID NO: 161004 - DNA, 20 bp, Artificial Sequence
  chemically synthesized
tccattgccaaaaggcggtg

SEQ ID NO: 161005 - DNA, 20 bp, Artificial Sequence
  chemically synthesized
cattgccaaaaggcggtgag

SEQ ID NO: 161006 - DNA, 20 bp, Artificial Sequence
  chemically synthesized
gtgaggagttttgcttgtat

SEQ ID NO: 161007 - DNA, 20 bp, Artificial Sequence
  chemically synthesized
tgaggagttttgcttgtata

SEQ ID NO: 161008 - DNA, 20 bp, Artificial Sequence
  chemically synthesized
actacttcaaatccttatac

SEQ ID NO: 161009 - DNA, 20 bp, Artificial Sequence
  chemically synthesized
tttgcttgtataaggatttg

SEQ ID NO: 161010 - DNA, 20 bp, Artificial Sequence
  chemically synthesized
gcttgtataaggatttgaag

SEQ ID NO: 161011 - DNA, 20 bp, Artificial Sequence
  chemically synthesized
tgtacatatttatgttaaca

SEQ ID NO: 161012 - DNA, 20 bp, Artificial Sequence
  chemically synthesized
tctgtacatatttatgttaa

SEQ ID NO: 161013 - DNA, 20 bp, Artificial Sequence
  chemically synthesized
tctgttaacataaatatgta

SEQ ID NO: 161014 - DNA, 20 bp, Artificial Sequence
  chemically synthesized
taaatatgtacagaatcatt

SEQ ID NO: 161015 - DNA, 20 bp, Artificial Sequence
  chemically synthesized
aaatatgtacagaatcattc

SEQ ID NO: 161016 - DNA, 20 bp, Artificial Sequence
  chemically synthesized
acagaatcattcaggtgtta

SEQ ID NO: 161017 - DNA, 20 bp, Artificial Sequence
  chemically synthesized
agaatcattcaggtgttata

SEQ ID NO: 161018 - DNA, 20 bp, Artificial Sequence
  chemically synthesized
gaatcattcaggtgttatag

SEQ ID NO: 161019 - DNA, 20 bp, Artificial Sequence
  chemically synthesized
cattcaggtgttatagagga

SEQ ID NO: 161020 - DNA, 20 bp, Artificial Sequence
  chemically synthesized
gtgttatagaggacagaata

SEQ ID NO: 161021 - DNA, 20 bp, Artificial Sequence
  chemically synthesized
gagagagagagagagagaga

SEQ ID NO: 161022 - DNA, 20 bp, Artificial Sequence
  chemically synthesized
gagagagagagagagagaga

SEQ ID NO: 161023 - DNA, 20 bp, Artificial Sequence
  chemically synthesized
gagagagagagagagagaga

SEQ ID NO: 161024 - DNA, 20 bp, Artificial Sequence
  chemically synthesized
gagagagagagagagagaga

SEQ ID NO: 161025 - DNA, 20 bp, Artificial Sequence
  chemically synthesized
gagagagagagagagagaga

SEQ ID NO: 161026 - DNA, 20 bp, Artificial Sequence
  chemically synthesized
gagagagagagagagagaga

SEQ ID NO: 161027 - DNA, 20 bp, Artificial Sequence
  chemically synthesized
gagagagagagagagagaga

SEQ ID NO: 161028 - DNA, 20 bp, Artificial Sequence
  chemically synthesized
gagagagagagagagagaga

SEQ ID NO: 161029 - DNA, 20 bp, Artificial Sequence
  chemically synthesized
gagagagagagagagagaga

SEQ ID NO: 161030 - DNA, 20 bp, Artificial Sequence
  chemically synthesized
gagagagagagagagagaga

SEQ ID NO: 161031 - DNA, 20 bp, Artificial Sequence
  chemically synthesized
gagagagagagagagagaga

SEQ ID NO: 161032 - DNA, 20 bp, Artificial Sequence
  chemically synthesized
gagagagagagagagagaga

SEQ ID NO: 161033 - DNA, 20 bp, Artificial Sequence
  chemically synthesized
gagagagagagagagagaga

SEQ ID NO: 161034 - DNA, 20 bp, Artificial Sequence
  chemically synthesized
gagagagagagagagagaga

SEQ ID NO: 161035 - DNA, 20 bp, Artificial Sequence
  chemically synthesized
gggagagagagagagagaga

SEQ ID NO: 161036 - DNA, 20 bp, Artificial Sequence
  chemically synthesized
gagggagagagagagagaga

SEQ ID NO: 161037 - DNA, 20 bp, Artificial Sequence
  chemically synthesized
gagagggagagagagagaga

SEQ ID NO: 161038 - DNA, 20 bp, Artificial Sequence
  chemically synthesized
aggagagggagagagagaga

SEQ ID NO: 161039 - DNA, 20 bp, Artificial Sequence
  chemically synthesized
ggaggagagggagagagaga

SEQ ID NO: 161040 - DNA, 20 bp, Artificial Sequence
  chemically synthesized
cgggaggagagggagagaga

SEQ ID NO: 161041 - DNA, 20 bp, Artificial Sequence
  chemically synthesized
gacgggaggagagggagaga

SEQ ID NO: 161042 - DNA, 20 bp, Artificial Sequence
  chemically synthesized
gggacgggaggagagggaga

SEQ ID NO: 161043 - DNA, 20 bp, Artificial Sequence
  chemically synthesized
gagggacgggaggagaggga

SEQ ID NO: 161044 - DNA, 20 bp, Artificial Sequence
  chemically synthesized
gagagggacgggaggagagg

SEQ ID NO: 161045 - DNA, 20 bp, Artificial Sequence
  chemically synthesized
aagagagggacgggaggaga

SEQ ID NO: 161046 - DNA, 20 bp, Artificial Sequence
  chemically synthesized
aaagagagggacgggaggag

SEQ ID NO: 161047 - DNA, 20 bp, Artificial Sequence
  chemically synthesized
gaaagagagggacgggagga

SEQ ID NO: 161048 - DNA, 20 bp, Artificial Sequence
  chemically synthesized
gagaaagagagggacgggag

SEQ ID NO: 161049 - DNA, 20 bp, Artificial Sequence
  chemically synthesized
gagagaaagagagggacggg

SEQ ID NO: 161050 - DNA, 20 bp, Artificial Sequence
  chemically synthesized
tgagagaaagagagggacgg

SEQ ID NO: 161051 - DNA, 20 bp, Artificial Sequence
  chemically synthesized
cttgagagaaagagagggac

SEQ ID NO: 161052 - DNA, 20 bp, Artificial Sequence
  chemically synthesized
acttgagagaaagagaggga

SEQ ID NO: 161053 - DNA, 20 bp, Artificial Sequence
  chemically synthesized
atcaacttgagagaaagaga

SEQ ID NO: 161054 - DNA, 20 bp, Artificial Sequence
  chemically synthesized
aatcaacttgagagaaagag

SEQ ID NO: 161055 - DNA, 20 bp, Artificial Sequence
  chemically synthesized
caatcaacttgagagaaaga

SEQ ID NO: 161056 - DNA, 20 bp, Artificial Sequence
  chemically synthesized
tacaatcaacttgagagaaa

SEQ ID NO: 161057 - DNA, 20 bp, Artificial Sequence
  chemically synthesized
cccgtccctctctttctctc

SEQ ID NO: 161058 - DNA, 20 bp, Artificial Sequence
  chemically synthesized
tatacaatcaacttgagaga

SEQ ID NO: 161059 - DNA, 20 bp, Artificial Sequence
  chemically synthesized
ggtatatacaatcaacttga

SEQ ID NO: 161060 - DNA, 20 bp, Artificial Sequence
  chemically synthesized
ttggtatatacaatcaactt

SEQ ID NO: 161061 - DNA, 20 bp, Artificial Sequence
  chemically synthesized
tcaagttgattgtatatacc

SEQ ID NO: 161062 - DNA, 20 bp, Artificial Sequence
  chemically synthesized
aagttgattgtatataccaa

SEQ ID NO: 161063 - DNA, 20 bp, Artificial Sequence
  chemically synthesized
gattgtatataccaagagct

SEQ ID NO: 161064 - DNA, 20 bp, Artificial Sequence
  chemically synthesized
attacaaagtactaagctct

SEQ ID NO: 161065 - DNA, 20 bp, Artificial Sequence
  chemically synthesized
aagaaatattacaaagtact

SEQ ID NO: 161066 - DNA, 20 bp, Artificial Sequence
  chemically synthesized
ggtatccaagaaatattaca

SEQ ID NO: 161067 - DNA, 20 bp, Artificial Sequence
  chemically synthesized
tagtactttgtaatatttct

SEQ ID NO: 161068 - DNA, 20 bp, Artificial Sequence
  chemically synthesized
tcaaatcagggttggtatcc

SEQ ID NO: 161069 - DNA, 20 bp, Artificial Sequence
  chemically synthesized
taaaagagtcaaatcagggt

SEQ ID NO: 161070 - DNA, 20 bp, Artificial Sequence
  chemically synthesized
atcttaaaagagtcaaatca

SEQ ID NO: 161071 - DNA, 20 bp, Artificial Sequence
  chemically synthesized
catcttaaaagagtcaaatc

SEQ ID NO: 161072 - DNA, 20 bp, Artificial Sequence
  chemically synthesized
tcatcttaaaagagtcaaat

SEQ ID NO: 161073 - DNA, 20 bp, Artificial Sequence
  chemically synthesized
aaccctgatttgactctttt

SEQ ID NO: 161074 - DNA, 20 bp, Artificial Sequence
  chemically synthesized
ctagagttatcatcttaaaa

SEQ ID NO: 161075 - DNA, 20 bp, Artificial Sequence
  chemically synthesized
cgctagagttatcatcttaa

SEQ ID NO: 161076 - DNA, 20 bp, Artificial Sequence
  chemically synthesized
ctcttttaagatgataactc

SEQ ID NO: 161077 - DNA, 20 bp, Artificial Sequence
  chemically synthesized
ttttaagatgataactctag

SEQ ID NO: 161078 - DNA, 20 bp, Artificial Sequence
  chemically synthesized
taagatgataactctagcgg

SEQ ID NO: 161079 - DNA, 20 bp, Artificial Sequence
  chemically synthesized
ttgcctccaatctgccgcta

SEQ ID NO: 161080 - DNA, 20 bp, Artificial Sequence
  chemically synthesized
tcttgcctccaatctgccgc

SEQ ID NO: 161081 - DNA, 20 bp, Artificial Sequence
  chemically synthesized
tgataactctagcggcagat

SEQ ID NO: 161082 - DNA, 20 bp, Artificial Sequence
  chemically synthesized
ataactctagcggcagattg

SEQ ID NO: 161083 - DNA, 20 bp, Artificial Sequence
  chemically synthesized
taactctagcggcagattgg

SEQ ID NO: 161084 - DNA, 20 bp, Artificial Sequence
  chemically synthesized
tctagcggcagattggaggc

SEQ ID NO: 161085 - DNA, 20 bp, Artificial Sequence
  chemically synthesized
cagattggaggcaagatttt

SEQ ID NO: 161086 - DNA, 20 bp, Artificial Sequence
  chemically synthesized
agattggaggcaagatttta

SEQ ID NO: 161087 - DNA, 20 bp, Artificial Sequence
  chemically synthesized
ggaggcaagattttaaggat

SEQ ID NO: 161088 - DNA, 20 bp, Artificial Sequence
  chemically synthesized
gaggcaagattttaaggata

SEQ ID NO: 161089 - DNA, 20 bp, Artificial Sequence
  chemically synthesized
aggcaagattttaaggataa

SEQ ID NO: 161090 - DNA, 20 bp, Artificial Sequence
  chemically synthesized
ggcaagattttaaggataag

SEQ ID NO: 161091 - DNA, 20 bp, Artificial Sequence
  chemically synthesized
agattttaaggataaggggc

SEQ ID NO: 161092 - DNA, 20 bp, Artificial Sequence
  chemically synthesized
ttttaaggataaggggctgg

SEQ ID NO: 161093 - DNA, 20 bp, Artificial Sequence
  chemically synthesized
taaggataaggggctggtgg

SEQ ID NO: 161094 - DNA, 20 bp, Artificial Sequence
  chemically synthesized
atttcctatgtttcttccac

SEQ ID NO: 161095 - DNA, 20 bp, Artificial Sequence
  chemically synthesized
aggggctggtggaagaaaca

SEQ ID NO: 161096 - DNA, 20 bp, Artificial Sequence
  chemically synthesized
ggggctggtggaagaaacat

SEQ ID NO: 161097 - DNA, 20 bp, Artificial Sequence
  chemically synthesized
agaaacataggaaatgcctt

SEQ ID NO: 161098 - DNA, 20 bp, Artificial Sequence
  chemically synthesized
aaacataggaaatgccttta

SEQ ID NO: 161099 - DNA, 20 bp, Artificial Sequence
  chemically synthesized
aacataggaaatgcctttag

SEQ ID NO: 161100 - DNA, 20 bp, Artificial Sequence
  chemically synthesized
ataagtactcggacctctaa

SEQ ID NO: 161101 - DNA, 20 bp, Artificial Sequence
  chemically synthesized
aataagtactcggacctcta

SEQ ID NO: 161102 - DNA, 20 bp, Artificial Sequence
  chemically synthesized
ggaaatgcctttagaggtcc

SEQ ID NO: 161103 - DNA, 20 bp, Artificial Sequence
  chemically synthesized
ctgtttgttcaataagtact

SEQ ID NO: 161104 - DNA, 20 bp, Artificial Sequence
  chemically synthesized
gctgctcctgtttgttcaat

SEQ ID NO: 161105 - DNA, 20 bp, Artificial Sequence
  chemically synthesized
ccgagtacttattgaacaaa

SEQ ID NO: 161106 - DNA, 20 bp, Artificial Sequence
  chemically synthesized
cgagtacttattgaacaaac

SEQ ID NO: 161107 - DNA, 20 bp, Artificial Sequence
  chemically synthesized
agtacttattgaacaaacag

SEQ ID NO: 161108 - DNA, 20 bp, Artificial Sequence
  chemically synthesized
acttattgaacaaacaggag

SEQ ID NO: 161109 - DNA, 20 bp, Artificial Sequence
  chemically synthesized
ttgaacaaacaggagcagca

SEQ ID NO: 161110 - DNA, 20 bp, Artificial Sequence
  chemically synthesized
acaggagcagcacggatgtt

SEQ ID NO: 161111 - DNA, 20 bp, Artificial Sequence
  chemically synthesized
caggagcagcacggatgttc

SEQ ID NO: 161112 - DNA, 20 bp, Artificial Sequence
  chemically synthesized
gagcagcacggatgttcagg

SEQ ID NO: 161113 - DNA, 20 bp, Artificial Sequence
  chemically synthesized
gaagtattattcctatgttg

SEQ ID NO: 161114 - DNA, 20 bp, Artificial Sequence
  chemically synthesized
cagtcctttatccacaacat

SEQ ID NO: 161115 - DNA, 20 bp, Artificial Sequence
  chemically synthesized
ccagtcctttatccacaaca

SEQ ID NO: 161116 - DNA, 20 bp, Artificial Sequence
  chemically synthesized
ttattcctatgttgtggata

SEQ ID NO: 161117 - DNA, 20 bp, Artificial Sequence
  chemically synthesized
tattcctatgttgtggataa

SEQ ID NO: 161118 - DNA, 20 bp, Artificial Sequence
  chemically synthesized
ctatgttgtggataaaggac

SEQ ID NO: 161119 - DNA, 20 bp, Artificial Sequence
  chemically synthesized
tgttgtggataaaggactgg

SEQ ID NO: 161120 - DNA, 20 bp, Artificial Sequence
  chemically synthesized
gttgtggataaaggactggc

SEQ ID NO: 161121 - DNA, 20 bp, Artificial Sequence
  chemically synthesized
ttttccccatcaagtcctgc

SEQ ID NO: 161122 - DNA, 20 bp, Artificial Sequence
  chemically synthesized
aaaggactggcaggacttga

SEQ ID NO: 161123 - DNA, 20 bp, Artificial Sequence
  chemically synthesized
aaggactggcaggacttgat

SEQ ID NO: 161124 - DNA, 20 bp, Artificial Sequence
  chemically synthesized
aggactggcaggacttgatg

SEQ ID NO: 161125 - DNA, 20 bp, Artificial Sequence
  chemically synthesized
aaattttctttttccccatc

SEQ ID NO: 161126 - DNA, 20 bp, Artificial Sequence
  chemically synthesized
ggcaggacttgatggggaaa

SEQ ID NO: 161127 - DNA, 20 bp, Artificial Sequence
  chemically synthesized
atggggaaaaagaaaatttt

SEQ ID NO: 161128 - DNA, 20 bp, Artificial Sequence
  chemically synthesized
agaaaattttcagaatcacc

SEQ ID NO: 161129 - DNA, 20 bp, Artificial Sequence
  chemically synthesized
tctcccaagttataaaatct

SEQ ID NO: 161130 - DNA, 20 bp, Artificial Sequence
  chemically synthesized
atcaccaagattttataact

SEQ ID NO: 161131 - DNA, 20 bp, Artificial Sequence
  chemically synthesized
tcaccaagattttataactt

SEQ ID NO: 161132 - DNA, 20 bp, Artificial Sequence
  chemically synthesized
accaagattttataacttgg

SEQ ID NO: 161133 - DNA, 20 bp, Artificial Sequence
  chemically synthesized
acccctagacagtttctccc

SEQ ID NO: 161134 - DNA, 20 bp, Artificial Sequence
  chemically synthesized
ataacttgggagaaactgtc

SEQ ID NO: 161135 - DNA, 20 bp, Artificial Sequence
  chemically synthesized
taacttgggagaaactgtct

SEQ ID NO: 161136 - DNA, 20 bp, Artificial Sequence
  chemically synthesized
aacttgggagaaactgtcta

SEQ ID NO: 161137 - DNA, 20 bp, Artificial Sequence
  chemically synthesized
acttgggagaaactgtctag

SEQ ID NO: 161138 - DNA, 20 bp, Artificial Sequence
  chemically synthesized
gtcttccctgtacccctaga

SEQ ID NO: 161139 - DNA, 20 bp, Artificial Sequence
  chemically synthesized
ggagaaactgtctaggggta

SEQ ID NO: 161140 - DNA, 20 bp, Artificial Sequence
  chemically synthesized
gagaaactgtctaggggtac

SEQ ID NO: 161141 - DNA, 20 bp, Artificial Sequence
  chemically synthesized
ctctgtcttccctgtacccc

SEQ ID NO: 161142 - DNA, 20 bp, Artificial Sequence
  chemically synthesized
agaaactgtctaggggtaca

SEQ ID NO: 161143 - DNA, 20 bp, Artificial Sequence
  chemically synthesized
aactgtctaggggtacaggg

SEQ ID NO: 161144 - DNA, 20 bp, Artificial Sequence
  chemically synthesized
gtctaggggtacagggaaga

SEQ ID NO: 161145 - DNA, 20 bp, Artificial Sequence
  chemically synthesized
ctaggggtacagggaagaca

SEQ ID NO: 161146 - DNA, 20 bp, Artificial Sequence
  chemically synthesized
taggggtacagggaagacag

SEQ ID NO: 161147 - DNA, 20 bp, Artificial Sequence
  chemically synthesized
ggggtacagggaagacagag

SEQ ID NO: 161148 - DNA, 20 bp, Artificial Sequence
  chemically synthesized
tattccttccatatagggac

SEQ ID NO: 161149 - DNA, 20 bp, Artificial Sequence
  chemically synthesized
ttattccttccatataggga

SEQ ID NO: 161150 - DNA, 20 bp, Artificial Sequence
  chemically synthesized
cagaggagcctgtccctata

SEQ ID NO: 161151 - DNA, 20 bp, Artificial Sequence
  chemically synthesized
aggagcctgtccctatatgg

SEQ ID NO: 161152 - DNA, 20 bp, Artificial Sequence
  chemically synthesized
aacattattccttccatata

SEQ ID NO: 161153 - DNA, 20 bp, Artificial Sequence
  chemically synthesized
ggagcctgtccctatatgga

SEQ ID NO: 161154 - DNA, 20 bp, Artificial Sequence
  chemically synthesized
aaacattattccttccatat

SEQ ID NO: 161155 - DNA, 20 bp, Artificial Sequence
  chemically synthesized
aaaacattattccttccata

SEQ ID NO: 161156 - DNA, 20 bp, Artificial Sequence
  chemically synthesized
tatggaaggaataatgtttt

SEQ ID NO: 161157 - DNA, 20 bp, Artificial Sequence
  chemically synthesized
atggaaggaataatgttttc

SEQ ID NO: 161158 - DNA, 20 bp, Artificial Sequence
  chemically synthesized
aaggaataatgttttcaggt

SEQ ID NO: 161159 - DNA, 20 bp, Artificial Sequence
  chemically synthesized
ggaataatgttttcaggttg

SEQ ID NO: 161160 - DNA, 20 bp, Artificial Sequence
  chemically synthesized
tgttttcaggttggagacat

SEQ ID NO: 161161 - DNA, 20 bp, Artificial Sequence
  chemically synthesized
tcaggttggagacatgagtc

SEQ ID NO: 161162 - DNA, 20 bp, Artificial Sequence
  chemically synthesized
tttgcatcagtgttaatcac

SEQ ID NO: 161163 - DNA, 20 bp, Artificial Sequence
  chemically synthesized
atttgcatcagtgttaatca

SEQ ID NO: 161164 - DNA, 20 bp, Artificial Sequence
  chemically synthesized
tactttctgtacatttgcat

SEQ ID NO: 161165 - DNA, 20 bp, Artificial Sequence
  chemically synthesized
ttaacactgatgcaaatgta

SEQ ID NO: 161166 - DNA, 20 bp, Artificial Sequence
  chemically synthesized
cactgatgcaaatgtacaga

SEQ ID NO: 161167 - DNA, 20 bp, Artificial Sequence
  chemically synthesized
gtacagaaagtaattgcaaa

SEQ ID NO: 161168 - DNA, 20 bp, Artificial Sequence
  chemically synthesized
cagaaagtaattgcaaaaag

SEQ ID NO: 161169 - DNA, 20 bp, Artificial Sequence
  chemically synthesized
agtaattgcaaaaagaagcg

SEQ ID NO: 161170 - DNA, 20 bp, Artificial Sequence
  chemically synthesized
gcaaaaagaagcgtagtgtg

SEQ ID NO: 161171 - DNA, 20 bp, Artificial Sequence
  chemically synthesized
aagaagcgtagtgtgcagat

SEQ ID NO: 161172 - DNA, 20 bp, Artificial Sequence
  chemically synthesized
agaagcgtagtgtgcagatt

SEQ ID NO: 161173 - DNA, 20 bp, Artificial Sequence
  chemically synthesized
gaagcgtagtgtgcagatta

SEQ ID NO: 161174 - DNA, 20 bp, Artificial Sequence
  chemically synthesized
aagcgtagtgtgcagattag

SEQ ID NO: 161175 - DNA, 20 bp, Artificial Sequence
  chemically synthesized
gtagtgtgcagattaggggt

SEQ ID NO: 161176 - DNA, 20 bp, Artificial Sequence
  chemically synthesized
tagtgtgcagattaggggta

SEQ ID NO: 161177 - DNA, 20 bp, Artificial Sequence
  chemically synthesized
tgcagattaggggtaaggct

SEQ ID NO: 161178 - DNA, 20 bp, Artificial Sequence
  chemically synthesized
taggggtaaggctaagaata

SEQ ID NO: 161179 - DNA, 20 bp, Artificial Sequence
  chemically synthesized
aggggtaaggctaagaatac

SEQ ID NO: 161180 - DNA, 20 bp, Artificial Sequence
  chemically synthesized
tacctccaaacctgtattct

SEQ ID NO: 161181 - DNA, 20 bp, Artificial Sequence
  chemically synthesized
taaggctaagaatacaggtt

SEQ ID NO: 161182 - DNA, 20 bp, Artificial Sequence
  chemically synthesized
aggctaagaatacaggtttg

SEQ ID NO: 161183 - DNA, 20 bp, Artificial Sequence
  chemically synthesized
ggctaagaatacaggtttgg

SEQ ID NO: 161184 - DNA, 20 bp, Artificial Sequence
  chemically synthesized
tacaggtttggaggtaaaaa

SEQ ID NO: 161185 - DNA, 20 bp, Artificial Sequence
  chemically synthesized
aggtttggaggtaaaaatag

SEQ ID NO: 161186 - DNA, 20 bp, Artificial Sequence
  chemically synthesized
ttggaggtaaaaatagtagt

SEQ ID NO: 161187 - DNA, 20 bp, Artificial Sequence
  chemically synthesized
gtagttggacaatattgtcc

SEQ ID NO: 161188 - DNA, 20 bp, Artificial Sequence
  chemically synthesized
gtcactctacaagtatcact

SEQ ID NO: 161189 - DNA, 20 bp, Artificial Sequence
  chemically synthesized
agtcactctacaagtatcac

SEQ ID NO: 161190 - DNA, 20 bp, Artificial Sequence
  chemically synthesized
tattgtcccagtgatacttg

SEQ ID NO: 161191 - DNA, 20 bp, Artificial Sequence
  chemically synthesized
ttgtcccagtgatacttgta

SEQ ID NO: 161192 - DNA, 20 bp, Artificial Sequence
  chemically synthesized
atcctcttcagtcactctac

SEQ ID NO: 161193 - DNA, 20 bp, Artificial Sequence
  chemically synthesized
tgatacttgtagagtgactg

SEQ ID NO: 161194 - DNA, 20 bp, Artificial Sequence
  chemically synthesized
atacttgtagagtgactgaa

SEQ ID NO: 161195 - DNA, 20 bp, Artificial Sequence
  chemically synthesized
tacttgtagagtgactgaag

SEQ ID NO: 161196 - DNA, 20 bp, Artificial Sequence
  chemically synthesized
tgtagagtgactgaagagga

SEQ ID NO: 161197 - DNA, 20 bp, Artificial Sequence
  chemically synthesized
aattctggctctatcctctt

SEQ ID NO: 161198 - DNA, 20 bp, Artificial Sequence
  chemically synthesized
tagagtgactgaagaggata

SEQ ID NO: 161199 - DNA, 20 bp, Artificial Sequence
  chemically synthesized
gtgactgaagaggatagagc

SEQ ID NO: 161200 - DNA, 20 bp, Artificial Sequence
  chemically synthesized
gaagaggatagagccagaat

SEQ ID NO: 161201 - DNA, 20 bp, Artificial Sequence
  chemically synthesized
aagaggatagagccagaatt

SEQ ID NO: 161202 - DNA, 20 bp, Artificial Sequence
  chemically synthesized
tggaggcgaatacctaattc

SEQ ID NO: 161203 - DNA, 20 bp, Artificial Sequence
  chemically synthesized
gaattaggtattcgcctcca

SEQ ID NO: 161204 - DNA, 20 bp, Artificial Sequence
  chemically synthesized
aattaggtattcgcctccac

SEQ ID NO: 161205 - DNA, 20 bp, Artificial Sequence
  chemically synthesized
tttcttctcttatcctgtgg

SEQ ID NO: 161206 - DNA, 20 bp, Artificial Sequence
  chemically synthesized
ctttcttctcttatcctgtg

SEQ ID NO: 161207 - DNA, 20 bp, Artificial Sequence
  chemically synthesized
ggtattcgcctccacaggat

SEQ ID NO: 161208 - DNA, 20 bp, Artificial Sequence
  chemically synthesized
aactttcttctcttatcctg

SEQ ID NO: 161209 - DNA, 20 bp, Artificial Sequence
  chemically synthesized
tattcgcctccacaggataa

SEQ ID NO: 161210 - DNA, 20 bp, Artificial Sequence
  chemically synthesized
tcgcctccacaggataagag

SEQ ID NO: 161211 - DNA, 20 bp, Artificial Sequence
  chemically synthesized
ctccacaggataagagaaga

SEQ ID NO: 161212 - DNA, 20 bp, Artificial Sequence
  chemically synthesized
taagagaagaaagttgaacc

SEQ ID NO: 161213 - DNA, 20 bp, Artificial Sequence
  chemically synthesized
gaagaaagttgaaccaagaa

SEQ ID NO: 161214 - DNA, 20 bp, Artificial Sequence
  chemically synthesized
ctgctctttctatcttttct

SEQ ID NO: 161215 - DNA, 20 bp, Artificial Sequence
  chemically synthesized
aaagttgaaccaagaaaaga

SEQ ID NO: 161216 - DNA, 20 bp, Artificial Sequence
  chemically synthesized
ttgaaccaagaaaagataga

SEQ ID NO: 161217 - DNA, 20 bp, Artificial Sequence
  chemically synthesized
gaaccaagaaaagatagaaa

SEQ ID NO: 161218 - DNA, 20 bp, Artificial Sequence
  chemically synthesized
ccaagaaaagatagaaagag

SEQ ID NO: 161219 - DNA, 20 bp, Artificial Sequence
  chemically synthesized
agaaaagatagaaagagcag

SEQ ID NO: 161220 - DNA, 20 bp, Artificial Sequence
  chemically synthesized
aaaagatagaaagagcagaa

SEQ ID NO: 161221 - DNA, 20 bp, Artificial Sequence
  chemically synthesized
agagcagaagagactgaaac

SEQ ID NO: 161222 - DNA, 20 bp, Artificial Sequence
  chemically synthesized
gtttttacatgttcttgttt

SEQ ID NO: 161223 - DNA, 20 bp, Artificial Sequence
  chemically synthesized
gaacatgtaaaaacccaaaa

SEQ ID NO: 161224 - DNA, 20 bp, Artificial Sequence
  chemically synthesized
catgtaaaaacccaaaatag

SEQ ID NO: 161225 - DNA, 20 bp, Artificial Sequence
  chemically synthesized
tctctcctcacttctatttt

SEQ ID NO: 161226 - DNA, 20 bp, Artificial Sequence
  chemically synthesized
ttctctcctcacttctattt

SEQ ID NO: 161227 - DNA, 20 bp, Artificial Sequence
  chemically synthesized
taaaaacccaaaatagaagt

SEQ ID NO: 161228 - DNA, 20 bp, Artificial Sequence
  chemically synthesized
aaaaacccaaaatagaagtg

SEQ ID NO: 161229 - DNA, 20 bp, Artificial Sequence
  chemically synthesized
aaacccaaaatagaagtgag

SEQ ID NO: 161230 - DNA, 20 bp, Artificial Sequence
  chemically synthesized
acccaaaatagaagtgagga

SEQ ID NO: 161231 - DNA, 20 bp, Artificial Sequence
  chemically synthesized
tgaggagagaattatatgaa

SEQ ID NO: 161232 - DNA, 20 bp, Artificial Sequence
  chemically synthesized
gaggagagaattatatgaaa

SEQ ID NO: 161233 - DNA, 20 bp, Artificial Sequence
  chemically synthesized
aggagagaattatatgaaaa

SEQ ID NO: 161234 - DNA, 20 bp, Artificial Sequence
  chemically synthesized
ggagagaattatatgaaaag

SEQ ID NO: 161235 - DNA, 20 bp, Artificial Sequence
  chemically synthesized
atctgtaatatgtaacatgg

SEQ ID NO: 161236 - DNA, 20 bp, Artificial Sequence
  chemically synthesized
cttatctgtaatatgtaaca

SEQ ID NO: 161237 - DNA, 20 bp, Artificial Sequence
  chemically synthesized
tgccaccatgttacatatta

SEQ ID NO: 161238 - DNA, 20 bp, Artificial Sequence
  chemically synthesized
ccatgttacatattacagat

SEQ ID NO: 161239 - DNA, 20 bp, Artificial Sequence
  chemically synthesized
gttacatattacagataagc

SEQ ID NO: 161240 - DNA, 20 bp, Artificial Sequence
  chemically synthesized
ttacatattacagataagca

SEQ ID NO: 161241 - DNA, 20 bp, Artificial Sequence
  chemically synthesized
catattacagataagcaagg

SEQ ID NO: 161242 - DNA, 20 bp, Artificial Sequence
  chemically synthesized
acagataagcaaggaagctc

SEQ ID NO: 161243 - DNA, 20 bp, Artificial Sequence
  chemically synthesized
tattatttgtattatttctt

SEQ ID NO: 161244 - DNA, 20 bp, Artificial Sequence
  chemically synthesized
cctccaatgaaggatatatt

SEQ ID NO: 161245 - DNA, 20 bp, Artificial Sequence
  chemically synthesized
atactgaatatatccttcat

SEQ ID NO: 161246 - DNA, 20 bp, Artificial Sequence
  chemically synthesized
actgaatatatccttcattg

SEQ ID NO: 161247 - DNA, 20 bp, Artificial Sequence
  chemically synthesized
ctgaatatatccttcattgg

SEQ ID NO: 161248 - DNA, 20 bp, Artificial Sequence
  chemically synthesized
tttcatttaacctccaatga

SEQ ID NO: 161249 - DNA, 20 bp, Artificial Sequence
  chemically synthesized
atttcatttaacctccaatg

SEQ ID NO: 161250 - DNA, 20 bp, Artificial Sequence
  chemically synthesized
cattggaggttaaatgaaat

SEQ ID NO: 161251 - DNA, 20 bp, Artificial Sequence
  chemically synthesized
attggaggttaaatgaaata

SEQ ID NO: 161252 - DNA, 20 bp, Artificial Sequence
  chemically synthesized
ggttttatatccaatgttct

SEQ ID NO: 161253 - DNA, 20 bp, Artificial Sequence
  chemically synthesized
acaaagtaaaccgagaacat

SEQ ID NO: 161254 - DNA, 20 bp, Artificial Sequence
  chemically synthesized
tagtatttacaaagtaaacc

SEQ ID NO: 161255 - DNA, 20 bp, Artificial Sequence
  chemically synthesized
accacgagctagtatttaca

SEQ ID NO: 161256 - DNA, 20 bp, Artificial Sequence
  chemically synthesized
tcggtttactttgtaaatac

SEQ ID NO: 161257 - DNA, 20 bp, Artificial Sequence
  chemically synthesized
actttgtaaatactagctcg

SEQ ID NO: 161258 - DNA, 20 bp, Artificial Sequence
  chemically synthesized
aaatttgggggaccacgagc

SEQ ID NO: 161259 - DNA, 20 bp, Artificial Sequence
  chemically synthesized
tagtaaatttgggggaccac

SEQ ID NO: 161260 - DNA, 20 bp, Artificial Sequence
  chemically synthesized
ggaacatgtagtaaatttgg

SEQ ID NO: 161261 - DNA, 20 bp, Artificial Sequence
  chemically synthesized
gggaacatgtagtaaatttg

SEQ ID NO: 161262 - DNA, 20 bp, Artificial Sequence
  chemically synthesized
tgggaacatgtagtaaattt

SEQ ID NO: 161263 - DNA, 20 bp, Artificial Sequence
  chemically synthesized
atgggaacatgtagtaaatt

SEQ ID NO: 161264 - DNA, 20 bp, Artificial Sequence
  chemically synthesized
attttaaaaatgggaacatg

SEQ ID NO: 161265 - DNA, 20 bp, Artificial Sequence
  chemically synthesized
gtttgctgaattttaaaaat

SEQ ID NO: 161266 - DNA, 20 bp, Artificial Sequence
  chemically synthesized
tgtttgctgaattttaaaaa

SEQ ID NO: 161267 - DNA, 20 bp, Artificial Sequence
  chemically synthesized
atgttcccatttttaaaatt

SEQ ID NO: 161268 - DNA, 20 bp, Artificial Sequence
  chemically synthesized
catttttaaaattcagcaaa

SEQ ID NO: 161269 - DNA, 20 bp, Artificial Sequence
  chemically synthesized
taaaattcagcaaacagatt

SEQ ID NO: 161270 - DNA, 20 bp, Artificial Sequence
  chemically synthesized
aaaattcagcaaacagattt

SEQ ID NO: 161271 - DNA, 20 bp, Artificial Sequence
  chemically synthesized
caaacagatttaggtaacaa

SEQ ID NO: 161272 - DNA, 20 bp, Artificial Sequence
  chemically synthesized
ggtaacaacagtaaacttac

SEQ ID NO: 161273 - DNA, 20 bp, Artificial Sequence
  chemically synthesized
cattgtaagatatatctagt

SEQ ID NO: 161274 - DNA, 20 bp, Artificial Sequence
  chemically synthesized
ctcccattgtaagatatatc

SEQ ID NO: 161275 - DNA, 20 bp, Artificial Sequence
  chemically synthesized
ttactagatatatcttacaa

SEQ ID NO: 161276 - DNA, 20 bp, Artificial Sequence
  chemically synthesized
tactagatatatcttacaat

SEQ ID NO: 161277 - DNA, 20 bp, Artificial Sequence
  chemically synthesized
ctagatatatcttacaatgg

SEQ ID NO: 161278 - DNA, 20 bp, Artificial Sequence
  chemically synthesized
gttatagttgctcccattgt

SEQ ID NO: 161279 - DNA, 20 bp, Artificial Sequence
  chemically synthesized
acaatgggagcaactataac

SEQ ID NO: 161280 - DNA, 20 bp, Artificial Sequence
  chemically synthesized
caatgggagcaactataaca

SEQ ID NO: 161281 - DNA, 20 bp, Artificial Sequence
  chemically synthesized
ttgttttactcaccttgtta

SEQ ID NO: 161282 - DNA, 20 bp, Artificial Sequence
  chemically synthesized
gggagcaactataacaaggt

SEQ ID NO: 161283 - DNA, 20 bp, Artificial Sequence
  chemically synthesized
aggtgagtaaaacaaatgaa

SEQ ID NO: 161284 - DNA, 20 bp, Artificial Sequence
  chemically synthesized
ggtgagtaaaacaaatgaat

SEQ ID NO: 161285 - DNA, 20 bp, Artificial Sequence
  chemically synthesized
atgaatgggaacgtttgctc

SEQ ID NO: 161286 - DNA, 20 bp, Artificial Sequence
  chemically synthesized
gtgtatttcttgattttcca

SEQ ID NO: 161287 - DNA, 20 bp, Artificial Sequence
  chemically synthesized
aacgtttgctctggaaaatc

SEQ ID NO: 161288 - DNA, 20 bp, Artificial Sequence
  chemically synthesized
gtgtgtatttcttgattttc

SEQ ID NO: 161289 - DNA, 20 bp, Artificial Sequence
  chemically synthesized
cacacacacacacaatcttt

SEQ ID NO: 161290 - DNA, 20 bp, Artificial Sequence
  chemically synthesized
acacacacacacaatcttta

SEQ ID NO: 161291 - DNA, 20 bp, Artificial Sequence
  chemically synthesized
acacacacaatctttaagga

SEQ ID NO: 161292 - DNA, 20 bp, Artificial Sequence
  chemically synthesized
ataattaataactatcctta

SEQ ID NO: 161293 - DNA, 20 bp, Artificial Sequence
  chemically synthesized
ttaaggatagttattaatta

SEQ ID NO: 161294 - DNA, 20 bp, Artificial Sequence
  chemically synthesized
aggatagttattaattatgg

SEQ ID NO: 161295 - DNA, 20 bp, Artificial Sequence
  chemically synthesized
attaatactctcataatttt

SEQ ID NO: 161296 - DNA, 20 bp, Artificial Sequence
  chemically synthesized
agaaacaaacctaaaattat

SEQ ID NO: 161297 - DNA, 20 bp, Artificial Sequence
  chemically synthesized
aattaatactctcataattt

SEQ ID NO: 161298 - DNA, 20 bp, Artificial Sequence
  chemically synthesized
aaacaaacctaaaattatga

SEQ ID NO: 161299 - DNA, 20 bp, Artificial Sequence
  chemically synthesized
gttaagaatttttatcatat

SEQ ID NO: 161300 - DNA, 20 bp, Artificial Sequence
  chemically synthesized
tgttaagaatttttatcata

SEQ ID NO: 161301 - DNA, 20 bp, Artificial Sequence
  chemically synthesized
caagacttttttaaaatgtt

SEQ ID NO: 161302 - DNA, 20 bp, Artificial Sequence
  chemically synthesized
aaattcttaacattttaaaa

SEQ ID NO: 161303 - DNA, 20 bp, Artificial Sequence
  chemically synthesized
tgaatttgttacagtgttgc

SEQ ID NO: 161304 - DNA, 20 bp, Artificial Sequence
  chemically synthesized
ccagccttttgaatttgtta

SEQ ID NO: 161305 - DNA, 20 bp, Artificial Sequence
  chemically synthesized
caacactgtaacaaattcaa

SEQ ID NO: 161306 - DNA, 20 bp, Artificial Sequence
  chemically synthesized
aacactgtaacaaattcaaa

SEQ ID NO: 161307 - DNA, 20 bp, Artificial Sequence
  chemically synthesized
ctgtaacaaattcaaaaggc

SEQ ID NO: 161308 - DNA, 20 bp, Artificial Sequence
  chemically synthesized
attttaaaggaagaaatatc

SEQ ID NO: 161309 - DNA, 20 bp, Artificial Sequence
  chemically synthesized
cttgtaagcaattttaaagg

SEQ ID NO: 161310 - DNA, 20 bp, Artificial Sequence
  chemically synthesized
gtacttgtaagcaattttaa

SEQ ID NO: 161311 - DNA, 20 bp, Artificial Sequence
  chemically synthesized
tgtacttgtaagcaatttta

SEQ ID NO: 161312 - DNA, 20 bp, Artificial Sequence
  chemically synthesized
cttcctttaaaattgcttac

SEQ ID NO: 161313 - DNA, 20 bp, Artificial Sequence
  chemically synthesized
tttcactggattgtacttgt

SEQ ID NO: 161314 - DNA, 20 bp, Artificial Sequence
  chemically synthesized
aattgcttacaagtacaatc

SEQ ID NO: 161315 - DNA, 20 bp, Artificial Sequence
  chemically synthesized
taaaggtacagaattttcac

SEQ ID NO: 161316 - DNA, 20 bp, Artificial Sequence
  chemically synthesized
cagtgaaaattctgtacctt

SEQ ID NO: 161317 - DNA, 20 bp, Artificial Sequence
  chemically synthesized
ctgttcattttctaaaggta

SEQ ID NO: 161318 - DNA, 20 bp, Artificial Sequence
  chemically synthesized
tatttctgttcattttctaa

SEQ ID NO: 161319 - DNA, 20 bp, Artificial Sequence
  chemically synthesized
ctatttctgttcattttcta

SEQ ID NO: 161320 - DNA, 20 bp, Artificial Sequence
  chemically synthesized
ctgtacctttagaaaatgaa

SEQ ID NO: 161321 - DNA, 20 bp, Artificial Sequence
  chemically synthesized
ctttagaaaatgaacagaaa

SEQ ID NO: 161322 - DNA, 20 bp, Artificial Sequence
  chemically synthesized
ttggctgcacacaagaaaca

SEQ ID NO: 161323 - DNA, 20 bp, Artificial Sequence
  chemically synthesized
tcatctgtgtttcttgtgtg

SEQ ID NO: 161324 - DNA, 20 bp, Artificial Sequence
  chemically synthesized
ctagtcatttggctgcacac

SEQ ID NO: 161325 - DNA, 20 bp, Artificial Sequence
  chemically synthesized
cttgtgtgcagccaaatgac

SEQ ID NO: 161326 - DNA, 20 bp, Artificial Sequence
  chemically synthesized
agagaaggatgctagtcatt

SEQ ID NO: 161327 - DNA, 20 bp, Artificial Sequence
  chemically synthesized
gagtggatagagaaggatgc

SEQ ID NO: 161328 - DNA, 20 bp, Artificial Sequence
  chemically synthesized
gaatatggagtggatagaga

SEQ ID NO: 161329 - DNA, 20 bp, Artificial Sequence
  chemically synthesized
agaatatggagtggatagag

SEQ ID NO: 161330 - DNA, 20 bp, Artificial Sequence
  chemically synthesized
tgaagaatatggagtggata

SEQ ID NO: 161331 - DNA, 20 bp, Artificial Sequence
  chemically synthesized
attgaagaatatggagtgga

SEQ ID NO: 161332 - DNA, 20 bp, Artificial Sequence
  chemically synthesized
ggtgattgaagaatatggag

SEQ ID NO: 161333 - DNA, 20 bp, Artificial Sequence
  chemically synthesized
atgggtgattgaagaatatg

SEQ ID NO: 161334 - DNA, 20 bp, Artificial Sequence
  chemically synthesized
ttatgggtgattgaagaata

SEQ ID NO: 161335 - DNA, 20 bp, Artificial Sequence
  chemically synthesized
gaactatttatgggtgattg

SEQ ID NO: 161336 - DNA, 20 bp, Artificial Sequence
  chemically synthesized
attcttcaatcacccataaa

SEQ ID NO: 161337 - DNA, 20 bp, Artificial Sequence
  chemically synthesized
tgatttttggaactatttat

SEQ ID NO: 161338 - DNA, 20 bp, Artificial Sequence
  chemically synthesized
atgatttttggaactattta

SEQ ID NO: 161339 - DNA, 20 bp, Artificial Sequence
  chemically synthesized
tatctattcttcatgatttt

SEQ ID NO: 161340 - DNA, 20 bp, Artificial Sequence
  chemically synthesized
aaatagttccaaaaatcatg

SEQ ID NO: 161341 - DNA, 20 bp, Artificial Sequence
  chemically synthesized
gttccaaaaatcatgaagaa

SEQ ID NO: 161342 - DNA, 20 bp, Artificial Sequence
  chemically synthesized
gaagaatagataccactact

SEQ ID NO: 161343 - DNA, 20 bp, Artificial Sequence
  chemically synthesized
tgccagtgccttctgagtag

SEQ ID NO: 161344 - DNA, 20 bp, Artificial Sequence
  chemically synthesized
gaatagataccactactcag

SEQ ID NO: 161345 - DNA, 20 bp, Artificial Sequence
  chemically synthesized
aatagataccactactcaga

SEQ ID NO: 161346 - DNA, 20 bp, Artificial Sequence
  chemically synthesized
atctgccagtgccttctgag

SEQ ID NO: 161347 - DNA, 20 bp, Artificial Sequence
  chemically synthesized
tctatctgccagtgccttct

SEQ ID NO: 161348 - DNA, 20 bp, Artificial Sequence
  chemically synthesized
taccactactcagaaggcac

SEQ ID NO: 161349 - DNA, 20 bp, Artificial Sequence
  chemically synthesized
cactactcagaaggcactgg

SEQ ID NO: 161350 - DNA, 20 bp, Artificial Sequence
  chemically synthesized
actcagaaggcactggcaga

SEQ ID NO: 161351 - DNA, 20 bp, Artificial Sequence
  chemically synthesized
tcctgatcctatctatctgc

SEQ ID NO: 161352 - DNA, 20 bp, Artificial Sequence
  chemically synthesized
agaaggcactggcagataga

SEQ ID NO: 161353 - DNA, 20 bp, Artificial Sequence
  chemically synthesized
gaaggcactggcagatagat

SEQ ID NO: 161354 - DNA, 20 bp, Artificial Sequence
  chemically synthesized
cactggcagatagataggat

SEQ ID NO: 161355 - DNA, 20 bp, Artificial Sequence
  chemically synthesized
actggcagatagataggatc

SEQ ID NO: 161356 - DNA, 20 bp, Artificial Sequence
  chemically synthesized
tggcagatagataggatcag

SEQ ID NO: 161357 - DNA, 20 bp, Artificial Sequence
  chemically synthesized
attccttgtagttgtcaaag

SEQ ID NO: 161358 - DNA, 20 bp, Artificial Sequence
  chemically synthesized
gaaattccttgtagttgtca

SEQ ID NO: 161359 - DNA, 20 bp, Artificial Sequence
  chemically synthesized
gagtctgctttgacaactac

SEQ ID NO: 161360 - DNA, 20 bp, Artificial Sequence
  chemically synthesized
agtctgctttgacaactaca

SEQ ID NO: 161361 - DNA, 20 bp, Artificial Sequence
  chemically synthesized
tgtcttaaggaaattccttg

SEQ ID NO: 161362 - DNA, 20 bp, Artificial Sequence
  chemically synthesized
caactacaaggaatttcctt

SEQ ID NO: 161363 - DNA, 20 bp, Artificial Sequence
  chemically synthesized
atttgtatgtggatgtctta

SEQ ID NO: 161364 - DNA, 20 bp, Artificial Sequence
  chemically synthesized
aatttgtatgtggatgtctt

SEQ ID NO: 161365 - DNA, 20 bp, Artificial Sequence
  chemically synthesized
tattaattaaaatttgtatg

SEQ ID NO: 161366 - DNA, 20 bp, Artificial Sequence
  chemically synthesized
ttaattaataaaattgttat

SEQ ID NO: 161367 - DNA, 20 bp, Artificial Sequence
  chemically synthesized
aattgttattggcgaataaa

SEQ ID NO: 161368 - DNA, 20 bp, Artificial Sequence
  chemically synthesized
tattggcgaataaacagaaa

SEQ ID NO: 161369 - DNA, 20 bp, Artificial Sequence
  chemically synthesized
gaataaacagaaatggcaac

SEQ ID NO: 161370 - DNA, 20 bp, Artificial Sequence
  chemically synthesized
aataaacagaaatggcaaca

SEQ ID NO: 161371 - DNA, 20 bp, Artificial Sequence
  chemically synthesized
aacagaaatggcaacaaggc

SEQ ID NO: 161372 - DNA, 20 bp, Artificial Sequence
  chemically synthesized
tggcaacaaggctggcattt

SEQ ID NO: 161373 - DNA, 20 bp, Artificial Sequence
  chemically synthesized
tacttggactactcaaatgc

SEQ ID NO: 161374 - DNA, 20 bp, Artificial Sequence
  chemically synthesized
caacaaggctggcatttgag

SEQ ID NO: 161375 - DNA, 20 bp, Artificial Sequence
  chemically synthesized
ggctggcatttgagtagtcc

SEQ ID NO: 161376 - DNA, 20 bp, Artificial Sequence
  chemically synthesized
ttggagctctaagtaatact

SEQ ID NO: 161377 - DNA, 20 bp, Artificial Sequence
  chemically synthesized
tgagtagtccaagtattact

SEQ ID NO: 161378 - DNA, 20 bp, Artificial Sequence
  chemically synthesized
agtagtccaagtattactta

SEQ ID NO: 161379 - DNA, 20 bp, Artificial Sequence
  chemically synthesized
acttagtactttggagctct

SEQ ID NO: 161380 - DNA, 20 bp, Artificial Sequence
  chemically synthesized
aagtattacttagagctcca

SEQ ID NO: 161381 - DNA, 20 bp, Artificial Sequence
  chemically synthesized
agcacccacttagtactttg

SEQ ID NO: 161382 - DNA, 20 bp, Artificial Sequence
  chemically synthesized
acttagagctccaaagtact

SEQ ID NO: 161383 - DNA, 20 bp, Artificial Sequence
  chemically synthesized
caagcacccacttagtactt

SEQ ID NO: 161384 - DNA, 20 bp, Artificial Sequence
  chemically synthesized
tagagctccaaagtactaag

SEQ ID NO: 161385 - DNA, 20 bp, Artificial Sequence
  chemically synthesized
agagctccaaagtactaagt

SEQ ID NO: 161386 - DNA, 20 bp, Artificial Sequence
  chemically synthesized
tcatgtagcaagcacccact

SEQ ID NO: 161387 - DNA, 20 bp, Artificial Sequence
  chemically synthesized
tcttcagtccatcatgtagc

SEQ ID NO: 161388 - DNA, 20 bp, Artificial Sequence
  chemically synthesized
agtgggtgcttgctacatga

SEQ ID NO: 161389 - DNA, 20 bp, Artificial Sequence
  chemically synthesized
ctgctcttcagtccatcatg

SEQ ID NO: 161390 - DNA, 20 bp, Artificial Sequence
  chemically synthesized
gcttgctacatgatggactg

SEQ ID NO: 161391 - DNA, 20 bp, Artificial Sequence
  chemically synthesized
ttgctacatgatggactgaa

SEQ ID NO: 161392 - DNA, 20 bp, Artificial Sequence
  chemically synthesized
ctacatgatggactgaagag

SEQ ID NO: 161393 - DNA, 20 bp, Artificial Sequence
  chemically synthesized
tacatgatggactgaagagc

SEQ ID NO: 161394 - DNA, 20 bp, Artificial Sequence
  chemically synthesized
ttggcatgccacctgctctt

SEQ ID NO: 161395 - DNA, 20 bp, Artificial Sequence
  chemically synthesized
atgatggactgaagagcagg

SEQ ID NO: 161396 - DNA, 20 bp, Artificial Sequence
  chemically synthesized
aaaaatatggacatttcatt

SEQ ID NO: 161397 - DNA, 20 bp, Artificial Sequence
  chemically synthesized
cttcctgcaagtgaaaaata

SEQ ID NO: 161398 - DNA, 20 bp, Artificial Sequence
  chemically synthesized
atgtccatatttttcacttg

SEQ ID NO: 161399 - DNA, 20 bp, Artificial Sequence
  chemically synthesized
tgtccatatttttcacttgc

SEQ ID NO: 161400 - DNA, 20 bp, Artificial Sequence
  chemically synthesized
ccatatttttcacttgcagg

SEQ ID NO: 161401 - DNA, 20 bp, Artificial Sequence
  chemically synthesized
gggaatattctacttcctgc

SEQ ID NO: 161402 - DNA, 20 bp, Artificial Sequence
  chemically synthesized
tatttttcacttgcaggaag

SEQ ID NO: 161403 - DNA, 20 bp, Artificial Sequence
  chemically synthesized
aagtagaatattccctgttc

SEQ ID NO: 161404 - DNA, 20 bp, Artificial Sequence
  chemically synthesized
ctattttggtgacttgaaca

SEQ ID NO: 161405 - DNA, 20 bp, Artificial Sequence
  chemically synthesized
gctattttggtgacttgaac

SEQ ID NO: 161406 - DNA, 20 bp, Artificial Sequence
  chemically synthesized
ggctattttggtgacttgaa

SEQ ID NO: 161407 - DNA, 20 bp, Artificial Sequence
  chemically synthesized
ccctgttcaagtcaccaaaa

SEQ ID NO: 161408 - DNA, 20 bp, Artificial Sequence
  chemically synthesized
gactaaatctagggctattt

SEQ ID NO: 161409 - DNA, 20 bp, Artificial Sequence
  chemically synthesized
tcaagtcaccaaaatagccc

SEQ ID NO: 161410 - DNA, 20 bp, Artificial Sequence
  chemically synthesized
caccaaaatagccctagatt

SEQ ID NO: 161411 - DNA, 20 bp, Artificial Sequence
  chemically synthesized
tcaccagaggactaaatcta

SEQ ID NO: 161412 - DNA, 20 bp, Artificial Sequence
  chemically synthesized
ttcaccagaggactaaatct

SEQ ID NO: 161413 - DNA, 20 bp, Artificial Sequence
  chemically synthesized
attcaccagaggactaaatc

SEQ ID NO: 161414 - DNA, 20 bp, Artificial Sequence
  chemically synthesized
tagccctagatttagtcctc

SEQ ID NO: 161415 - DNA, 20 bp, Artificial Sequence
  chemically synthesized
atgcaatgttcattcaccag

SEQ ID NO: 161416 - DNA, 20 bp, Artificial Sequence
  chemically synthesized
tatgcaatgttcattcacca

SEQ ID NO: 161417 - DNA, 20 bp, Artificial Sequence
  chemically synthesized
agtatgcaatgttcattcac

SEQ ID NO: 161418 - DNA, 20 bp, Artificial Sequence
  chemically synthesized
tcaatagagggaaatgatgt

SEQ ID NO: 161419 - DNA, 20 bp, Artificial Sequence
  chemically synthesized
ataggaaacatttcaataga

SEQ ID NO: 161420 - DNA, 20 bp, Artificial Sequence
  chemically synthesized
aataggaaacatttcaatag

SEQ ID NO: 161421 - DNA, 20 bp, Artificial Sequence
  chemically synthesized
taataggaaacatttcaata

SEQ ID NO: 161422 - DNA, 20 bp, Artificial Sequence
  chemically synthesized
ggtaataggaaacatttcaa

SEQ ID NO: 161423 - DNA, 20 bp, Artificial Sequence
  chemically synthesized
tgatagaaggacacggtaat

SEQ ID NO: 161424 - DNA, 20 bp, Artificial Sequence
  chemically synthesized
atgatagaaggacacggtaa

SEQ ID NO: 161425 - DNA, 20 bp, Artificial Sequence
  chemically synthesized
atagtgatgatagaaggaca

SEQ ID NO: 161426 - DNA, 20 bp, Artificial Sequence
  chemically synthesized
atgacaatagtgatgataga

SEQ ID NO: 161427 - DNA, 20 bp, Artificial Sequence
  chemically synthesized
gatgacaatagtgatgatag

SEQ ID NO: 161428 - DNA, 20 bp, Artificial Sequence
  chemically synthesized
aaagatgacaatagtgatga

SEQ ID NO: 161429 - DNA, 20 bp, Artificial Sequence
  chemically synthesized
gaaggatgaaaagatgacaa

SEQ ID NO: 161430 - DNA, 20 bp, Artificial Sequence
  chemically synthesized
ctatgtcattgaaggatgaa

SEQ ID NO: 161431 - DNA, 20 bp, Artificial Sequence
  chemically synthesized
aatctgtactatgtcattga

SEQ ID NO: 161432 - DNA, 20 bp, Artificial Sequence
  chemically synthesized
aaatctgtactatgtcattg

SEQ ID NO: 161433 - DNA, 20 bp, Artificial Sequence
  chemically synthesized
cttttcatccttcaatgaca

SEQ ID NO: 161434 - DNA, 20 bp, Artificial Sequence
  chemically synthesized
catccttcaatgacatagta

SEQ ID NO: 161435 - DNA, 20 bp, Artificial Sequence
  chemically synthesized
aatgacatagtacagatttt

SEQ ID NO: 161436 - DNA, 20 bp, Artificial Sequence
  chemically synthesized
cagattttaagtacccatat

SEQ ID NO: 161437 - DNA, 20 bp, Artificial Sequence
  chemically synthesized
actgagaataaatctcatat

SEQ ID NO: 161438 - DNA, 20 bp, Artificial Sequence
  chemically synthesized
aactgagaataaatctcata

SEQ ID NO: 161439 - DNA, 20 bp, Artificial Sequence
  chemically synthesized
acccatatgagatttattct

SEQ ID NO: 161440 - DNA, 20 bp, Artificial Sequence
  chemically synthesized
gagatttattctcagttcta

SEQ ID NO: 161441 - DNA, 20 bp, Artificial Sequence
  chemically synthesized
tgctctgtttctatagaact

SEQ ID NO: 161442 - DNA, 20 bp, Artificial Sequence
  chemically synthesized
tattctcagttctatagaaa

SEQ ID NO: 161443 - DNA, 20 bp, Artificial Sequence
  chemically synthesized
cacccattgctctgtttcta

SEQ ID NO: 161444 - DNA, 20 bp, Artificial Sequence
  chemically synthesized
ttctcagttctatagaaaca

SEQ ID NO: 161445 - DNA, 20 bp, Artificial Sequence
  chemically synthesized
gttctatagaaacagagcaa

SEQ ID NO: 161446 - DNA, 20 bp, Artificial Sequence
  chemically synthesized
ttctatagaaacagagcaat

SEQ ID NO: 161447 - DNA, 20 bp, Artificial Sequence
  chemically synthesized
agaaacagagcaatgggtga

SEQ ID NO: 161448 - DNA, 20 bp, Artificial Sequence
  chemically synthesized
atgggtgaaagaattcattt

SEQ ID NO: 161449 - DNA, 20 bp, Artificial Sequence
  chemically synthesized
aagtagccacaaagaattta

SEQ ID NO: 161450 - DNA, 20 bp, Artificial Sequence
  chemically synthesized
aaaagtagccacaaagaatt

SEQ ID NO: 161451 - DNA, 20 bp, Artificial Sequence
  chemically synthesized
tttcagctctaaattctttg

SEQ ID NO: 161452 - DNA, 20 bp, Artificial Sequence
  chemically synthesized
gccaaggaaaagtagccaca

SEQ ID NO: 161453 - DNA, 20 bp, Artificial Sequence
  chemically synthesized
aaaaatgtgccaaggaaaag

SEQ ID NO: 161454 - DNA, 20 bp, Artificial Sequence
  chemically synthesized
tctttgtggctacttttcct

SEQ ID NO: 161455 - DNA, 20 bp, Artificial Sequence
  chemically synthesized
tccaaaaatgtgccaaggaa

SEQ ID NO: 161456 - DNA, 20 bp, Artificial Sequence
  chemically synthesized
agttctccaaaaatgtgcca

SEQ ID NO: 161457 - DNA, 20 bp, Artificial Sequence
  chemically synthesized
cagttctccaaaaatgtgcc

SEQ ID NO: 161458 - DNA, 20 bp, Artificial Sequence
  chemically synthesized
acttttccttggcacatttt

SEQ ID NO: 161459 - DNA, 20 bp, Artificial Sequence
  chemically synthesized
ttttccttggcacatttttg

SEQ ID NO: 161460 - DNA, 20 bp, Artificial Sequence
  chemically synthesized
ttggcacatttttggagaac

SEQ ID NO: 161461 - DNA, 20 bp, Artificial Sequence
  chemically synthesized
ggtgcatttaattagaggtc

SEQ ID NO: 161462 - DNA, 20 bp, Artificial Sequence
  chemically synthesized
tcaaaggtgcatttaattag

SEQ ID NO: 161463 - DNA, 20 bp, Artificial Sequence
  chemically synthesized
atcaaaggtgcatttaatta

SEQ ID NO: 161464 - DNA, 20 bp, Artificial Sequence
  chemically synthesized
ctatcaaaggtgcatttaat

SEQ ID NO: 161465 - DNA, 20 bp, Artificial Sequence
  chemically synthesized
ctaattaaatgcacctttga

SEQ ID NO: 161466 - DNA, 20 bp, Artificial Sequence
  chemically synthesized
tttctaaagtgatctatcaa

SEQ ID NO: 161467 - DNA, 20 bp, Artificial Sequence
  chemically synthesized
ctttctaaagtgatctatca

SEQ ID NO: 161468 - DNA, 20 bp, Artificial Sequence
  chemically synthesized
gcacctttgatagatcactt

SEQ ID NO: 161469 - DNA, 20 bp, Artificial Sequence
  chemically synthesized
ctttgatagatcactttaga

SEQ ID NO: 161470 - DNA, 20 bp, Artificial Sequence
  chemically synthesized
tcttcaaaatggtctttcta

SEQ ID NO: 161471 - DNA, 20 bp, Artificial Sequence
  chemically synthesized
actttagaaagaccattttg

SEQ ID NO: 161472 - DNA, 20 bp, Artificial Sequence
  chemically synthesized
gtagaaatttatcttcaaaa

SEQ ID NO: 161473 - DNA, 20 bp, Artificial Sequence
  chemically synthesized
aaatgtagtgaggtaaattg

SEQ ID NO: 161474 - DNA, 20 bp, Artificial Sequence
  chemically synthesized
acctgcaaataaatgtagtg

SEQ ID NO: 161475 - DNA, 20 bp, Artificial Sequence
  chemically synthesized
aacctgcaaataaatgtagt

SEQ ID NO: 161476 - DNA, 20 bp, Artificial Sequence
  chemically synthesized
attcaacctgcaaataaatg

SEQ ID NO: 161477 - DNA, 20 bp, Artificial Sequence
  chemically synthesized
tacctcactacatttatttg

SEQ ID NO: 161478 - DNA, 20 bp, Artificial Sequence
  chemically synthesized
acctcactacatttatttgc

SEQ ID NO: 161479 - DNA, 20 bp, Artificial Sequence
  chemically synthesized
tatttgcaggttgaatttat

SEQ ID NO: 161480 - DNA, 20 bp, Artificial Sequence
  chemically synthesized
aggttgaatttattagttca

SEQ ID NO: 161481 - DNA, 20 bp, Artificial Sequence
  chemically synthesized
tgaatttattagttcaaaga

SEQ ID NO: 161482 - DNA, 20 bp, Artificial Sequence
  chemically synthesized
gaatttattagttcaaagat

SEQ ID NO: 161483 - DNA, 20 bp, Artificial Sequence
  chemically synthesized
ttattagttcaaagataggt

SEQ ID NO: 161484 - DNA, 20 bp, Artificial Sequence
  chemically synthesized
tcaaagataggtcagttatt

SEQ ID NO: 161485 - DNA, 20 bp, Artificial Sequence
  chemically synthesized
caaagataggtcagttatta

SEQ ID NO: 161486 - DNA, 20 bp, Artificial Sequence
  chemically synthesized
aaagataggtcagttattaa

SEQ ID NO: 161487 - DNA, 20 bp, Artificial Sequence
  chemically synthesized
ataggtcagttattaagggc

SEQ ID NO: 161488 - DNA, 20 bp, Artificial Sequence
  chemically synthesized
gggcaagatactattgcttg

SEQ ID NO: 161489 - DNA, 20 bp, Artificial Sequence
  chemically synthesized
acagttgacccttcaagcaa

SEQ ID NO: 161490 - DNA, 20 bp, Artificial Sequence
  chemically synthesized
ggcaagatactattgcttga

SEQ ID NO: 161491 - DNA, 20 bp, Artificial Sequence
  chemically synthesized
gcaagatactattgcttgaa

SEQ ID NO: 161492 - DNA, 20 bp, Artificial Sequence
  chemically synthesized
tttactacagttgacccttc

SEQ ID NO: 161493 - DNA, 20 bp, Artificial Sequence
  chemically synthesized
attgcttgaagggtcaactg

SEQ ID NO: 161494 - DNA, 20 bp, Artificial Sequence
  chemically synthesized
gaagttaattggatttacta

SEQ ID NO: 161495 - DNA, 20 bp, Artificial Sequence
  chemically synthesized
atattttcagtgaagttaat

SEQ ID NO: 161496 - DNA, 20 bp, Artificial Sequence
  chemically synthesized
acgaaagaatattttcagtg

SEQ ID NO: 161497 - DNA, 20 bp, Artificial Sequence
  chemically synthesized
tatgtacgaaagaatatttt

SEQ ID NO: 161498 - DNA, 20 bp, Artificial Sequence
  chemically synthesized
actgaagaaaatatgtacga

SEQ ID NO: 161499 - DNA, 20 bp, Artificial Sequence
  chemically synthesized
tctttcgtacatattttctt

SEQ ID NO: 161500 - DNA, 20 bp, Artificial Sequence
  chemically synthesized
tcgtacatattttcttcagt

SEQ ID NO: 161501 - DNA, 20 bp, Artificial Sequence
  chemically synthesized
tattttccttatactcactg

SEQ ID NO: 161502 - DNA, 20 bp, Artificial Sequence
  chemically synthesized
atattttcttcagtgagtat

SEQ ID NO: 161503 - DNA, 20 bp, Artificial Sequence
  chemically synthesized
tattttcttcagtgagtata

SEQ ID NO: 161504 - DNA, 20 bp, Artificial Sequence
  chemically synthesized
gtataaggaaaataaactgt

SEQ ID NO: 161505 - DNA, 20 bp, Artificial Sequence
  chemically synthesized
ggataattgtcagtttctta

SEQ ID NO: 161506 - DNA, 20 bp, Artificial Sequence
  chemically synthesized
ttaatttttaggataattgt

SEQ ID NO: 161507 - DNA, 20 bp, Artificial Sequence
  chemically synthesized
tcacatattctttaattttt

SEQ ID NO: 161508 - DNA, 20 bp, Artificial Sequence
  chemically synthesized
gacaattatcctaaaaatta

SEQ ID NO: 161509 - DNA, 20 bp, Artificial Sequence
  chemically synthesized
ttcacatattctttaatttt

SEQ ID NO: 161510 - DNA, 20 bp, Artificial Sequence
  chemically synthesized
tgtcacattttatttgcatg

SEQ ID NO: 161511 - DNA, 20 bp, Artificial Sequence
  chemically synthesized
tatgtcacattttatttgca

SEQ ID NO: 161512 - DNA, 20 bp, Artificial Sequence
  chemically synthesized
catgcaaataaaatgtgaca

SEQ ID NO: 161513 - DNA, 20 bp, Artificial Sequence
  chemically synthesized
aaataaaatgtgacatagaa

SEQ ID NO: 161514 - DNA, 20 bp, Artificial Sequence
  chemically synthesized
catagaaaagctaaaaaaca

SEQ ID NO: 161515 - DNA, 20 bp, Artificial Sequence
  chemically synthesized
ttgtttcttgctttgttttt

SEQ ID NO: 161516 - DNA, 20 bp, Artificial Sequence
  chemically synthesized
gaaaagctaaaaaacaaagc

SEQ ID NO: 161517 - DNA, 20 bp, Artificial Sequence
  chemically synthesized
caaagcaagaaacaactcca

SEQ ID NO: 161518 - DNA, 20 bp, Artificial Sequence
  chemically synthesized
catctcatgtggtttctttg

SEQ ID NO: 161519 - DNA, 20 bp, Artificial Sequence
  chemically synthesized
tccatctcatgtggtttctt

SEQ ID NO: 161520 - DNA, 20 bp, Artificial Sequence
  chemically synthesized
caactccaaagaaaccacat

SEQ ID NO: 161521 - DNA, 20 bp, Artificial Sequence
  chemically synthesized
tccaaagaaaccacatgaga

SEQ ID NO: 161522 - DNA, 20 bp, Artificial Sequence
  chemically synthesized
tctgatctttccatctcatg

SEQ ID NO: 161523 - DNA, 20 bp, Artificial Sequence
  chemically synthesized
aagaaaccacatgagatgga

SEQ ID NO: 161524 - DNA, 20 bp, Artificial Sequence
  chemically synthesized
accacatgagatggaaagat

SEQ ID NO: 161525 - DNA, 20 bp, Artificial Sequence
  chemically synthesized
agcacagctaataattttag

SEQ ID NO: 161526 - DNA, 20 bp, Artificial Sequence
  chemically synthesized
gaaaatgctactaaaattat

SEQ ID NO: 161527 - DNA, 20 bp, Artificial Sequence
  chemically synthesized
ttcagcacagctaataattt

SEQ ID NO: 161528 - DNA, 20 bp, Artificial Sequence
  chemically synthesized
gttagttgccattttcagca

SEQ ID NO: 161529 - DNA, 20 bp, Artificial Sequence
  chemically synthesized
attattagctgtgctgaaaa

SEQ ID NO: 161530 - DNA, 20 bp, Artificial Sequence
  chemically synthesized
tagcagttagttgccatttt

SEQ ID NO: 161531 - DNA, 20 bp, Artificial Sequence
  chemically synthesized
aaaatggcaactaactgcta

SEQ ID NO: 161532 - DNA, 20 bp, Artificial Sequence
  chemically synthesized
gttaatatcactatagcagt

SEQ ID NO: 161533 - DNA, 20 bp, Artificial Sequence
  chemically synthesized
agcagttaatatcactatag

SEQ ID NO: 161534 - DNA, 20 bp, Artificial Sequence
  chemically synthesized
cacagcagttaatatcacta

SEQ ID NO: 161535 - DNA, 20 bp, Artificial Sequence
  chemically synthesized
gcttgttaatattatcacag

SEQ ID NO: 161536 - DNA, 20 bp, Artificial Sequence
  chemically synthesized
gtagcttgttaatattatca

SEQ ID NO: 161537 - DNA, 20 bp, Artificial Sequence
  chemically synthesized
actgctgtgataatattaac

SEQ ID NO: 161538 - DNA, 20 bp, Artificial Sequence
  chemically synthesized
gtgataatattaacaagcta

SEQ ID NO: 161539 - DNA, 20 bp, Artificial Sequence
  chemically synthesized
aataaatgttttagcaactg

SEQ ID NO: 161540 - DNA, 20 bp, Artificial Sequence
  chemically synthesized
ttgacatataataaatgttt

SEQ ID NO: 161541 - DNA, 20 bp, Artificial Sequence
  chemically synthesized
gtatgtgtgtatgaaaagca

SEQ ID NO: 161542 - DNA, 20 bp, Artificial Sequence
  chemically synthesized
ggagtgtatgtgtgtatgaa

SEQ ID NO: 161543 - DNA, 20 bp, Artificial Sequence
  chemically synthesized
tacacacatacactcctaca

SEQ ID NO: 161544 - DNA, 20 bp, Artificial Sequence
  chemically synthesized
agataaaactttctttgtag

SEQ ID NO: 161545 - DNA, 20 bp, Artificial Sequence
  chemically synthesized
cacatacactcctacaaaga

SEQ ID NO: 161546 - DNA, 20 bp, Artificial Sequence
  chemically synthesized
ttagataaaactttctttgt

SEQ ID NO: 161547 - DNA, 20 bp, Artificial Sequence
  chemically synthesized
attagataaaactttctttg

SEQ ID NO: 161548 - DNA, 20 bp, Artificial Sequence
  chemically synthesized
gaaagttttatctaatttca

SEQ ID NO: 161549 - DNA, 20 bp, Artificial Sequence
  chemically synthesized
aattgcagcatctgtgaaat

SEQ ID NO: 161550 - DNA, 20 bp, Artificial Sequence
  chemically synthesized
atttcacagatgctgcaatt

SEQ ID NO: 161551 - DNA, 20 bp, Artificial Sequence
  chemically synthesized
ttcacagatgctgcaattga

SEQ ID NO: 161552 - DNA, 20 bp, Artificial Sequence
  chemically synthesized
gacctaatctctctcaattg

SEQ ID NO: 161553 - DNA, 20 bp, Artificial Sequence
  chemically synthesized
cacagatgctgcaattgaga

SEQ ID NO: 161554 - DNA, 20 bp, Artificial Sequence
  chemically synthesized
atgctgcaattgagagagat

SEQ ID NO: 161555 - DNA, 20 bp, Artificial Sequence
  chemically synthesized
tgctgcaattgagagagatt

SEQ ID NO: 161556 - DNA, 20 bp, Artificial Sequence
  chemically synthesized
agagattaggtcaattatcc

SEQ ID NO: 161557 - DNA, 20 bp, Artificial Sequence
  chemically synthesized
atttgcaagccacatggtct

SEQ ID NO: 161558 - DNA, 20 bp, Artificial Sequence
  chemically synthesized
gtcaattatccaagaccatg

SEQ ID NO: 161559 - DNA, 20 bp, Artificial Sequence
  chemically synthesized
tctgccatttgcaagccaca

SEQ ID NO: 161560 - DNA, 20 bp, Artificial Sequence
  chemically synthesized
aagaccatgtggcttgcaaa

SEQ ID NO: 161561 - DNA, 20 bp, Artificial Sequence
  chemically synthesized
atctcaactctgccatttgc

SEQ ID NO: 161562 - DNA, 20 bp, Artificial Sequence
  chemically synthesized
accatgtggcttgcaaatgg

SEQ ID NO: 161563 - DNA, 20 bp, Artificial Sequence
  chemically synthesized
catgtggcttgcaaatggca

SEQ ID NO: 161564 - DNA, 20 bp, Artificial Sequence
  chemically synthesized
ggcttgcaaatggcagagtt

SEQ ID NO: 161565 - DNA, 20 bp, Artificial Sequence
  chemically synthesized
ggcagagttgagattatatc

SEQ ID NO: 161566 - DNA, 20 bp, Artificial Sequence
  chemically synthesized
gcagagttgagattatatcc

SEQ ID NO: 161567 - DNA, 20 bp, Artificial Sequence
  chemically synthesized
gagttgagattatatccagg

SEQ ID NO: 161568 - DNA, 20 bp, Artificial Sequence
  chemically synthesized
atttggtgacacatacttcc

SEQ ID NO: 161569 - DNA, 20 bp, Artificial Sequence
  chemically synthesized
gaaagaaggaaatagagatt

SEQ ID NO: 161570 - DNA, 20 bp, Artificial Sequence
  chemically synthesized
gattcagaaagaaggaaata

SEQ ID NO: 161571 - DNA, 20 bp, Artificial Sequence
  chemically synthesized
cagattcagaaagaaggaaa

SEQ ID NO: 161572 - DNA, 20 bp, Artificial Sequence
  chemically synthesized
acacaacagattcagaaaga

SEQ ID NO: 161573 - DNA, 20 bp, Artificial Sequence
  chemically synthesized
tacacaacagattcagaaag

SEQ ID NO: 161574 - DNA, 20 bp, Artificial Sequence
  chemically synthesized
gtatacacaacagattcaga

SEQ ID NO: 161575 - DNA, 20 bp, Artificial Sequence
  chemically synthesized
cacagtatacacaacagatt

SEQ ID NO: 161576 - DNA, 20 bp, Artificial Sequence
  chemically synthesized
cacacacacagtatacacaa

SEQ ID NO: 161577 - DNA, 20 bp, Artificial Sequence
  chemically synthesized
cgtgtatgcacacacacaca

SEQ ID NO: 161578 - DNA, 20 bp, Artificial Sequence
  chemically synthesized
caattttggaaagaaataat

SEQ ID NO: 161579 - DNA, 20 bp, Artificial Sequence
  chemically synthesized
taagaaacgtcaattttgga

SEQ ID NO: 161580 - DNA, 20 bp, Artificial Sequence
  chemically synthesized
atattaagaaacgtcaattt

SEQ ID NO: 161581 - DNA, 20 bp, Artificial Sequence
  chemically synthesized
gaaataattaacataatatt

SEQ ID NO: 161582 - DNA, 20 bp, Artificial Sequence
  chemically synthesized
gtatttgagttcaagaggag

SEQ ID NO: 161583 - DNA, 20 bp, Artificial Sequence
  chemically synthesized
atgtatttgagttcaagagg

SEQ ID NO: 161584 - DNA, 20 bp, Artificial Sequence
  chemically synthesized
aatgtatttgagttcaagag

SEQ ID NO: 161585 - DNA, 20 bp, Artificial Sequence
  chemically synthesized
agaatgtatttgagttcaag

SEQ ID NO: 161586 - DNA, 20 bp, Artificial Sequence
  chemically synthesized
tagaatgtatttgagttcaa

SEQ ID NO: 161587 - DNA, 20 bp, Artificial Sequence
  chemically synthesized
tgtagaatgtatttgagttc

SEQ ID NO: 161588 - DNA, 20 bp, Artificial Sequence
  chemically synthesized
gaatattgtagaatgtattt

SEQ ID NO: 161589 - DNA, 20 bp, Artificial Sequence
  chemically synthesized
tatattctggaagaatattg

SEQ ID NO: 161590 - DNA, 20 bp, Artificial Sequence
  chemically synthesized
tacattctacaatattcttc

SEQ ID NO: 161591 - DNA, 20 bp, Artificial Sequence
  chemically synthesized
ttctctcatttatattctgg

SEQ ID NO: 161592 - DNA, 20 bp, Artificial Sequence
  chemically synthesized
attttctctcatttatattc

SEQ ID NO: 161593 - DNA, 20 bp, Artificial Sequence
  chemically synthesized
tattcttccagaatataaat

SEQ ID NO: 161594 - DNA, 20 bp, Artificial Sequence
  chemically synthesized
ttcttccagaatataaatga

SEQ ID NO: 161595 - DNA, 20 bp, Artificial Sequence
  chemically synthesized
cattttttgtgagaagggac

SEQ ID NO: 161596 - DNA, 20 bp, Artificial Sequence
  chemically synthesized
tcattttttgtgagaaggga

SEQ ID NO: 161597 - DNA, 20 bp, Artificial Sequence
  chemically synthesized
tatttcattttttgtgagaa

SEQ ID NO: 161598 - DNA, 20 bp, Artificial Sequence
  chemically synthesized
ttatttcattttttgtgaga

SEQ ID NO: 161599 - DNA, 20 bp, Artificial Sequence
  chemically synthesized
tttatttcattttttgtgag

SEQ ID NO: 161600 - DNA, 20 bp, Artificial Sequence
  chemically synthesized
aactttatttcattttttgt

SEQ ID NO: 161601 - DNA, 20 bp, Artificial Sequence
  chemically synthesized
ttctcacaaaaaatgaaata

SEQ ID NO: 161602 - DNA, 20 bp, Artificial Sequence
  chemically synthesized
aaatgaaataaagttttaca

SEQ ID NO: 161603 - DNA, 20 bp, Artificial Sequence
  chemically synthesized
agttttacatagccttgtaa

SEQ ID NO: 161604 - DNA, 20 bp, Artificial Sequence
  chemically synthesized
aaaccctcagagctattaca

SEQ ID NO: 161605 - DNA, 20 bp, Artificial Sequence
  chemically synthesized
gaaaccctcagagctattac

SEQ ID NO: 161606 - DNA, 20 bp, Artificial Sequence
  chemically synthesized
catagccttgtaatagctct

SEQ ID NO: 161607 - DNA, 20 bp, Artificial Sequence
  chemically synthesized
atagccttgtaatagctctg

SEQ ID NO: 161608 - DNA, 20 bp, Artificial Sequence
  chemically synthesized
tagccttgtaatagctctga

SEQ ID NO: 161609 - DNA, 20 bp, Artificial Sequence
  chemically synthesized
cccactaagagaaaccctca

SEQ ID NO: 161610 - DNA, 20 bp, Artificial Sequence
  chemically synthesized
aacccactaagagaaaccct

SEQ ID NO: 161611 - DNA, 20 bp, Artificial Sequence
  chemically synthesized
atagctctgagggtttctct

SEQ ID NO: 161612 - DNA, 20 bp, Artificial Sequence
  chemically synthesized
gctctgagggtttctcttag

SEQ ID NO: 161613 - DNA, 20 bp, Artificial Sequence
  chemically synthesized
ctctgagggtttctcttagt

SEQ ID NO: 161614 - DNA, 20 bp, Artificial Sequence
  chemically synthesized
ggcaatcataaacccactaa

SEQ ID NO: 161615 - DNA, 20 bp, Artificial Sequence
  chemically synthesized
ttggcaatcataaacccact

SEQ ID NO: 161616 - DNA, 20 bp, Artificial Sequence
  chemically synthesized
tgacctggatatcagaggtt

SEQ ID NO: 161617 - DNA, 20 bp, Artificial Sequence
  chemically synthesized
ttctctgacctggatatcag

SEQ ID NO: 161618 - DNA, 20 bp, Artificial Sequence
  chemically synthesized
attgccaaacctctgatatc

SEQ ID NO: 161619 - DNA, 20 bp, Artificial Sequence
  chemically synthesized
gttctctgacctggatatca

SEQ ID NO: 161620 - DNA, 20 bp, Artificial Sequence
  chemically synthesized
ttgccaaacctctgatatcc

SEQ ID NO: 161621 - DNA, 20 bp, Artificial Sequence
  chemically synthesized
cagttctctgacctggatat

SEQ ID NO: 161622 - DNA, 20 bp, Artificial Sequence
  chemically synthesized
caaacctctgatatccaggt

SEQ ID NO: 161623 - DNA, 20 bp, Artificial Sequence
  chemically synthesized
aacctctgatatccaggtca

SEQ ID NO: 161624 - DNA, 20 bp, Artificial Sequence
  chemically synthesized
ctcaaaccagttctctgacc

SEQ ID NO: 161625 - DNA, 20 bp, Artificial Sequence
  chemically synthesized
tgatatccaggtcagagaac

SEQ ID NO: 161626 - DNA, 20 bp, Artificial Sequence
  chemically synthesized
ccaggtcagagaactggttt

SEQ ID NO: 161627 - DNA, 20 bp, Artificial Sequence
  chemically synthesized
gataaaaggtttgctcaaac

SEQ ID NO: 161628 - DNA, 20 bp, Artificial Sequence
  chemically synthesized
gaggccatttgcgagataaa

SEQ ID NO: 161629 - DNA, 20 bp, Artificial Sequence
  chemically synthesized
tgaggccatttgcgagataa

SEQ ID NO: 161630 - DNA, 20 bp, Artificial Sequence
  chemically synthesized
caaaccttttatctcgcaaa

SEQ ID NO: 161631 - DNA, 20 bp, Artificial Sequence
  chemically synthesized
aaagatgtgaggccatttgc

SEQ ID NO: 161632 - DNA, 20 bp, Artificial Sequence
  chemically synthesized
tgaaatcatataaagatgtg

SEQ ID NO: 161633 - DNA, 20 bp, Artificial Sequence
  chemically synthesized
ctgaaatcatataaagatgt

SEQ ID NO: 161634 - DNA, 20 bp, Artificial Sequence
  chemically synthesized
accttatctgaaatcatata

SEQ ID NO: 161635 - DNA, 20 bp, Artificial Sequence
  chemically synthesized
ctcacatctttatatgattt

SEQ ID NO: 161636 - DNA, 20 bp, Artificial Sequence
  chemically synthesized
atctttatatgatttcagat

SEQ ID NO: 161637 - DNA, 20 bp, Artificial Sequence
  chemically synthesized
tctttatatgatttcagata

SEQ ID NO: 161638 - DNA, 20 bp, Artificial Sequence
  chemically synthesized
atatgatttcagataaggtg

SEQ ID NO: 161639 - DNA, 20 bp, Artificial Sequence
  chemically synthesized
tgatttcagataaggtgaag

SEQ ID NO: 161640 - DNA, 20 bp, Artificial Sequence
  chemically synthesized
gatttcagataaggtgaaga

SEQ ID NO: 161641 - DNA, 20 bp, Artificial Sequence
  chemically synthesized
ctatgtttccattttagtgg

SEQ ID NO: 161642 - DNA, 20 bp, Artificial Sequence
  chemically synthesized
gaagaaggccaccactaaaa

SEQ ID NO: 161643 - DNA, 20 bp, Artificial Sequence
  chemically synthesized
tagctatgtttccattttag

SEQ ID NO: 161644 - DNA, 20 bp, Artificial Sequence
  chemically synthesized
aattagctatgtttccattt

SEQ ID NO: 161645 - DNA, 20 bp, Artificial Sequence
  chemically synthesized
ccaccactaaaatggaaaca

SEQ ID NO: 161646 - DNA, 20 bp, Artificial Sequence
  chemically synthesized
aatggaaacatagctaatta

SEQ ID NO: 161647 - DNA, 20 bp, Artificial Sequence
  chemically synthesized
ggaaacatagctaattatag

SEQ ID NO: 161648 - DNA, 20 bp, Artificial Sequence
  chemically synthesized
cacaagccggccactataat

SEQ ID NO: 161649 - DNA, 20 bp, Artificial Sequence
  chemically synthesized
acatagctaattatagtggc

SEQ ID NO: 161650 - DNA, 20 bp, Artificial Sequence
  chemically synthesized
cactttctccttacacaagc

SEQ ID NO: 161651 - DNA, 20 bp, Artificial Sequence
  chemically synthesized
ttatagtggccggcttgtgt

SEQ ID NO: 161652 - DNA, 20 bp, Artificial Sequence
  chemically synthesized
tatagtggccggcttgtgta

SEQ ID NO: 161653 - DNA, 20 bp, Artificial Sequence
  chemically synthesized
tagtggccggcttgtgtaag

SEQ ID NO: 161654 - DNA, 20 bp, Artificial Sequence
  chemically synthesized
tgaacactttctccttacac

SEQ ID NO: 161655 - DNA, 20 bp, Artificial Sequence
  chemically synthesized
ggccggcttgtgtaaggaga

SEQ ID NO: 161656 - DNA, 20 bp, Artificial Sequence
  chemically synthesized
ggagaaagtgttcaacttca

SEQ ID NO: 161657 - DNA, 20 bp, Artificial Sequence
  chemically synthesized
tcttgtctgaatgttctttg

SEQ ID NO: 161658 - DNA, 20 bp, Artificial Sequence
  chemically synthesized
gttcaacttcaaagaacatt

SEQ ID NO: 161659 - DNA, 20 bp, Artificial Sequence
  chemically synthesized
acttcaaagaacattcagac

SEQ ID NO: 161660 - DNA, 20 bp, Artificial Sequence
  chemically synthesized
caaagaacattcagacaaga

SEQ ID NO: 161661 - DNA, 20 bp, Artificial Sequence
  chemically synthesized
ttcagacaagaaagtcgtca

SEQ ID NO: 161662 - DNA, 20 bp, Artificial Sequence
  chemically synthesized
tcagacaagaaagtcgtcat

SEQ ID NO: 161663 - DNA, 20 bp, Artificial Sequence
  chemically synthesized
gtcatgggatttccaccaaa

SEQ ID NO: 161664 - DNA, 20 bp, Artificial Sequence
  chemically synthesized
ttagaaatgagactttttgg

SEQ ID NO: 161665 - DNA, 20 bp, Artificial Sequence
  chemically synthesized
ttattagaaatgagactttt

SEQ ID NO: 161666 - DNA, 20 bp, Artificial Sequence
  chemically synthesized
aatgttctgttattagaaat

SEQ ID NO: 161667 - DNA, 20 bp, Artificial Sequence
  chemically synthesized
aaaagtctcatttctaataa

SEQ ID NO: 161668 - DNA, 20 bp, Artificial Sequence
  chemically synthesized
taatggaaatgttctgttat

SEQ ID NO: 161669 - DNA, 20 bp, Artificial Sequence
  chemically synthesized
aataacagaacatttccatt

SEQ ID NO: 161670 - DNA, 20 bp, Artificial Sequence
  chemically synthesized
ataacagaacatttccatta

SEQ ID NO: 161671 - DNA, 20 bp, Artificial Sequence
  chemically synthesized
ggaggaaaaaaaaaccttaa

SEQ ID NO: 161672 - DNA, 20 bp, Artificial Sequence
  chemically synthesized
acattaagaataaggcatgg

SEQ ID NO: 161673 - DNA, 20 bp, Artificial Sequence
  chemically synthesized
gacattaagaataaggcatg

SEQ ID NO: 161674 - DNA, 20 bp, Artificial Sequence
  chemically synthesized
gggacattaagaataaggca

SEQ ID NO: 161675 - DNA, 20 bp, Artificial Sequence
  chemically synthesized
tggaggggacattaagaata

SEQ ID NO: 161676 - DNA, 20 bp, Artificial Sequence
  chemically synthesized
ttggaggggacattaagaat

SEQ ID NO: 161677 - DNA, 20 bp, Artificial Sequence
  chemically synthesized
cttgcattggaggggacatt

SEQ ID NO: 161678 - DNA, 20 bp, Artificial Sequence
  chemically synthesized
tacacaatcttgcattggag

SEQ ID NO: 161679 - DNA, 20 bp, Artificial Sequence
  chemically synthesized
gtacacaatcttgcattgga

SEQ ID NO: 161680 - DNA, 20 bp, Artificial Sequence
  chemically synthesized
cttaatgtcccctccaatgc

SEQ ID NO: 161681 - DNA, 20 bp, Artificial Sequence
  chemically synthesized
ggtacacaatcttgcattgg

SEQ ID NO: 161682 - DNA, 20 bp, Artificial Sequence
  chemically synthesized
tggtacacaatcttgcattg

SEQ ID NO: 161683 - DNA, 20 bp, Artificial Sequence
  chemically synthesized
cctggtacacaatcttgcat

SEQ ID NO: 161684 - DNA, 20 bp, Artificial Sequence
  chemically synthesized
tccaatgcaagattgtgtac

SEQ ID NO: 161685 - DNA, 20 bp, Artificial Sequence
  chemically synthesized
ccaatgcaagattgtgtacc

SEQ ID NO: 161686 - DNA, 20 bp, Artificial Sequence
  chemically synthesized
aagattgtgtaccaggtgtt

SEQ ID NO: 161687 - DNA, 20 bp, Artificial Sequence
  chemically synthesized
atcataaggatcttaacacc

SEQ ID NO: 161688 - DNA, 20 bp, Artificial Sequence
  chemically synthesized
caaactctcctcgtatcata

SEQ ID NO: 161689 - DNA, 20 bp, Artificial Sequence
  chemically synthesized
tgttaagatccttatgatac

SEQ ID NO: 161690 - DNA, 20 bp, Artificial Sequence
  chemically synthesized
tcaaactctcctcgtatcat

SEQ ID NO: 161691 - DNA, 20 bp, Artificial Sequence
  chemically synthesized
gttaagatccttatgatacg

SEQ ID NO: 161692 - DNA, 20 bp, Artificial Sequence
  chemically synthesized
taagatccttatgatacgag

SEQ ID NO: 161693 - DNA, 20 bp, Artificial Sequence
  chemically synthesized
agatccttatgatacgagga

SEQ ID NO: 161694 - DNA, 20 bp, Artificial Sequence
  chemically synthesized
ggagagtttgattttcttca

SEQ ID NO: 161695 - DNA, 20 bp, Artificial Sequence
  chemically synthesized
agtgaactatcaatactatg

SEQ ID NO: 161696 - DNA, 20 bp, Artificial Sequence
  chemically synthesized
gattttcttcatagtattga

SEQ ID NO: 161697 - DNA, 20 bp, Artificial Sequence
  chemically synthesized
ttgatagttcactacaatgt

SEQ ID NO: 161698 - DNA, 20 bp, Artificial Sequence
  chemically synthesized
tgatagttcactacaatgtc

SEQ ID NO: 161699 - DNA, 20 bp, Artificial Sequence
  chemically synthesized
taaaattatacctgacattg

SEQ ID NO: 161700 - DNA, 20 bp, Artificial Sequence
  chemically synthesized
acaatgtcaggtataatttt

SEQ ID NO: 161701 - DNA, 20 bp, Artificial Sequence
  chemically synthesized
ccctattacctaattaatac

SEQ ID NO: 161702 - DNA, 20 bp, Artificial Sequence
  chemically synthesized
agaaaataacttgtattaat

SEQ ID NO: 161703 - DNA, 20 bp, Artificial Sequence
  chemically synthesized
gaaaataacttgtattaatt

SEQ ID NO: 161704 - DNA, 20 bp, Artificial Sequence
  chemically synthesized
aacttgtattaattaggtaa

SEQ ID NO: 161705 - DNA, 20 bp, Artificial Sequence
  chemically synthesized
acttgtattaattaggtaat

SEQ ID NO: 161706 - DNA, 20 bp, Artificial Sequence
  chemically synthesized
cttgtattaattaggtaata

SEQ ID NO: 161707 - DNA, 20 bp, Artificial Sequence
  chemically synthesized
tgtattaattaggtaatagg

SEQ ID NO: 161708 - DNA, 20 bp, Artificial Sequence
  chemically synthesized
aattaggtaatagggagtaa

SEQ ID NO: 161709 - DNA, 20 bp, Artificial Sequence
  chemically synthesized
agggagtaatggttcaataa

SEQ ID NO: 161710 - DNA, 20 bp, Artificial Sequence
  chemically synthesized
gagtaatggttcaataacag

SEQ ID NO: 161711 - DNA, 20 bp, Artificial Sequence
  chemically synthesized
agtaatggttcaataacagt

SEQ ID NO: 161712 - DNA, 20 bp, Artificial Sequence
  chemically synthesized
taatggttcaataacagtag

SEQ ID NO: 161713 - DNA, 20 bp, Artificial Sequence
  chemically synthesized
ataacagtaggagaatttca

SEQ ID NO: 161714 - DNA, 20 bp, Artificial Sequence
  chemically synthesized
atcagggctggatttcagaa

SEQ ID NO: 161715 - DNA, 20 bp, Artificial Sequence
  chemically synthesized
ctatcagggctggatttcag

SEQ ID NO: 161716 - DNA, 20 bp, Artificial Sequence
  chemically synthesized
tcatggtctcttctgaaatc

SEQ ID NO: 161717 - DNA, 20 bp, Artificial Sequence
  chemically synthesized
aacctatcagggctggattt

SEQ ID NO: 161718 - DNA, 20 bp, Artificial Sequence
  chemically synthesized
cttctgaaatccagccctga

SEQ ID NO: 161719 - DNA, 20 bp, Artificial Sequence
  chemically synthesized
tttcaaaaacctatcagggc

SEQ ID NO: 161720 - DNA, 20 bp, Artificial Sequence
  chemically synthesized
ttctgaaatccagccctgat

SEQ ID NO: 161721 - DNA, 20 bp, Artificial Sequence
  chemically synthesized
tccatttcaaaaacctatca

SEQ ID NO: 161722 - DNA, 20 bp, Artificial Sequence
  chemically synthesized
ctccatttcaaaaacctatc

SEQ ID NO: 161723 - DNA, 20 bp, Artificial Sequence
  chemically synthesized
actccatttcaaaaacctat

SEQ ID NO: 161724 - DNA, 20 bp, Artificial Sequence
  chemically synthesized
gccctgataggtttttgaaa

SEQ ID NO: 161725 - DNA, 20 bp, Artificial Sequence
  chemically synthesized
cctgataggtttttgaaatg

SEQ ID NO: 161726 - DNA, 20 bp, Artificial Sequence
  chemically synthesized
ttttgaaatggagtaactct

SEQ ID NO: 161727 - DNA, 20 bp, Artificial Sequence
  chemically synthesized
aataaaagtaaaggtgctta

SEQ ID NO: 161728 - DNA, 20 bp, Artificial Sequence
  chemically synthesized
taaataaaagtaaaggtgct

SEQ ID NO: 161729 - DNA, 20 bp, Artificial Sequence
  chemically synthesized
taagagataaataaaagtaa

SEQ ID NO: 161730 - DNA, 20 bp, Artificial Sequence
  chemically synthesized
ataagagataaataaaagta

SEQ ID NO: 161731 - DNA, 20 bp, Artificial Sequence
  chemically synthesized
atttaataagagataaataa

SEQ ID NO: 161732 - DNA, 20 bp, Artificial Sequence
  chemically synthesized
ttagtaatgccatttaataa

SEQ ID NO: 161733 - DNA, 20 bp, Artificial Sequence
  chemically synthesized
tttatttatctcttattaaa

SEQ ID NO: 161734 - DNA, 20 bp, Artificial Sequence
  chemically synthesized
tattagtaatgccatttaat

SEQ ID NO: 161735 - DNA, 20 bp, Artificial Sequence
  chemically synthesized
ttaaatggcattactaataa

SEQ ID NO: 161736 - DNA, 20 bp, Artificial Sequence
  chemically synthesized
taaatggcattactaataat

SEQ ID NO: 161737 - DNA, 20 bp, Artificial Sequence
  chemically synthesized
gatcagcaactgcccattat

SEQ ID NO: 161738 - DNA, 20 bp, Artificial Sequence
  chemically synthesized
atggcattactaataatggg

SEQ ID NO: 161739 - DNA, 20 bp, Artificial Sequence
  chemically synthesized
tgggcagttgctgatctgac

SEQ ID NO: 161740 - DNA, 20 bp, Artificial Sequence
  chemically synthesized
tgcttcactgcttgtcagat

SEQ ID NO: 161741 - DNA, 20 bp, Artificial Sequence
  chemically synthesized
gcagttgctgatctgacaag

SEQ ID NO: 161742 - DNA, 20 bp, Artificial Sequence
  chemically synthesized
atctttgcttcactgcttgt

SEQ ID NO: 161743 - DNA, 20 bp, Artificial Sequence
  chemically synthesized
tgctgatctgacaagcagtg

SEQ ID NO: 161744 - DNA, 20 bp, Artificial Sequence
  chemically synthesized
atctgacaagcagtgaagca

SEQ ID NO: 161745 - DNA, 20 bp, Artificial Sequence
  chemically synthesized
acaagcagtgaagcaaagat

SEQ ID NO: 161746 - DNA, 20 bp, Artificial Sequence
  chemically synthesized
aagcaaagattagtgatgaa

SEQ ID NO: 161747 - DNA, 20 bp, Artificial Sequence
  chemically synthesized
gcaaagattagtgatgaaaa

SEQ ID NO: 161748 - DNA, 20 bp, Artificial Sequence
  chemically synthesized
caaagattagtgatgaaaag

SEQ ID NO: 161749 - DNA, 20 bp, Artificial Sequence
  chemically synthesized
agattagtgatgaaaagagg

SEQ ID NO: 161750 - DNA, 20 bp, Artificial Sequence
  chemically synthesized
ggtagaaaaaaaaaaccctt

SEQ ID NO: 161751 - DNA, 20 bp, Artificial Sequence
  chemically synthesized
gtagaaaaaaaaaacccttg

SEQ ID NO: 161752 - DNA, 20 bp, Artificial Sequence
  chemically synthesized
tagaaaaaaaaaacccttga

SEQ ID NO: 161753 - DNA, 20 bp, Artificial Sequence
  chemically synthesized
cttgctacttttaccctcaa

SEQ ID NO: 161754 - DNA, 20 bp, Artificial Sequence
  chemically synthesized
acttgctacttttaccctca

SEQ ID NO: 161755 - DNA, 20 bp, Artificial Sequence
  chemically synthesized
gacttgctacttttaccctc

SEQ ID NO: 161756 - DNA, 20 bp, Artificial Sequence
  chemically synthesized
aaaaaaacccttgagggtaa

SEQ ID NO: 161757 - DNA, 20 bp, Artificial Sequence
  chemically synthesized
aaaacccttgagggtaaaag

SEQ ID NO: 161758 - DNA, 20 bp, Artificial Sequence
  chemically synthesized
cccttgagggtaaaagtagc

SEQ ID NO: 161759 - DNA, 20 bp, Artificial Sequence
  chemically synthesized
tgagggtaaaagtagcaagt

SEQ ID NO: 161760 - DNA, 20 bp, Artificial Sequence
  chemically synthesized
agggtaaaagtagcaagtca

SEQ ID NO: 161761 - DNA, 20 bp, Artificial Sequence
  chemically synthesized
gggtaaaagtagcaagtcag

SEQ ID NO: 161762 - DNA, 20 bp, Artificial Sequence
  chemically synthesized
atgttgaataaatcaattat

SEQ ID NO: 161763 - DNA, 20 bp, Artificial Sequence
  chemically synthesized
caatcggcatgatgtagaat

SEQ ID NO: 161764 - DNA, 20 bp, Artificial Sequence
  chemically synthesized
cacacacaatcggcatgatg

SEQ ID NO: 161765 - DNA, 20 bp, Artificial Sequence
  chemically synthesized
taaacacacgcacacacaat

SEQ ID NO: 161766 - DNA, 20 bp, Artificial Sequence
  chemically synthesized
tgtgtgtgcgtgtgtttaac

SEQ ID NO: 161767 - DNA, 20 bp, Artificial Sequence
  chemically synthesized
cgtgtgtttaactagaaatt

SEQ ID NO: 161768 - DNA, 20 bp, Artificial Sequence
  chemically synthesized
ttctaagaacaccaaatttc

SEQ ID NO: 161769 - DNA, 20 bp, Artificial Sequence
  chemically synthesized
aactagaaatttggtgttct

SEQ ID NO: 161770 - DNA, 20 bp, Artificial Sequence
  chemically synthesized
aaatttggtgttcttagaaa

SEQ ID NO: 161771 - DNA, 20 bp, Artificial Sequence
  chemically synthesized
ttcctttttgtactatttct

SEQ ID NO: 161772 - DNA, 20 bp, Artificial Sequence
  chemically synthesized
gttcttagaaatagtacaaa

SEQ ID NO: 161773 - DNA, 20 bp, Artificial Sequence
  chemically synthesized
ttcttagaaatagtacaaaa

SEQ ID NO: 161774 - DNA, 20 bp, Artificial Sequence
  chemically synthesized
tacaagaaaggaaaacaagg

SEQ ID NO: 161775 - DNA, 20 bp, Artificial Sequence
  chemically synthesized
gagtacaagaaaggaaaaca

SEQ ID NO: 161776 - DNA, 20 bp, Artificial Sequence
  chemically synthesized
tgagtacaagaaaggaaaac

SEQ ID NO: 161777 - DNA, 20 bp, Artificial Sequence
  chemically synthesized
aaagaaattgagtacaagaa

SEQ ID NO: 161778 - DNA, 20 bp, Artificial Sequence
  chemically synthesized
taaagaaattgagtacaaga

SEQ ID NO: 161779 - DNA, 20 bp, Artificial Sequence
  chemically synthesized
aatttaaagaaattgagtac

SEQ ID NO: 161780 - DNA, 20 bp, Artificial Sequence
  chemically synthesized
aatgaaaatttaaagaaatt

SEQ ID NO: 161781 - DNA, 20 bp, Artificial Sequence
  chemically synthesized
gtaggtaaaatgaaaattta

SEQ ID NO: 161782 - DNA, 20 bp, Artificial Sequence
  chemically synthesized
tatattctaaggttattagt

SEQ ID NO: 161783 - DNA, 20 bp, Artificial Sequence
  chemically synthesized
atatattctaaggttattag

SEQ ID NO: 161784 - DNA, 20 bp, Artificial Sequence
  chemically synthesized
attttacctactaataacct

SEQ ID NO: 161785 - DNA, 20 bp, Artificial Sequence
  chemically synthesized
atcatatattctaaggttat

SEQ ID NO: 161786 - DNA, 20 bp, Artificial Sequence
  chemically synthesized
atatataatcatatattcta

SEQ ID NO: 161787 - DNA, 20 bp, Artificial Sequence
  chemically synthesized
tatatataatcatatattct

SEQ ID NO: 161788 - DNA, 20 bp, Artificial Sequence
  chemically synthesized
tatatgattatatatatatt

SEQ ID NO: 161789 - DNA, 20 bp, Artificial Sequence
  chemically synthesized
tattaagaatatatatctca

SEQ ID NO: 161790 - DNA, 20 bp, Artificial Sequence
  chemically synthesized
tcctccttataatgtgcttt

SEQ ID NO: 161791 - DNA, 20 bp, Artificial Sequence
  chemically synthesized
tatatctcaaagcacattat

SEQ ID NO: 161792 - DNA, 20 bp, Artificial Sequence
  chemically synthesized
atatctcaaagcacattata

SEQ ID NO: 161793 - DNA, 20 bp, Artificial Sequence
  chemically synthesized
atctcaaagcacattataag

SEQ ID NO: 161794 - DNA, 20 bp, Artificial Sequence
  chemically synthesized
tctcaaagcacattataagg

SEQ ID NO: 161795 - DNA, 20 bp, Artificial Sequence
  chemically synthesized
atgtttgaacatacatggaa

SEQ ID NO: 161796 - DNA, 20 bp, Artificial Sequence
  chemically synthesized
aatgtttgaacatacatgga

SEQ ID NO: 161797 - DNA, 20 bp, Artificial Sequence
  chemically synthesized
aataaatgtttgaacataca

SEQ ID NO: 161798 - DNA, 20 bp, Artificial Sequence
  chemically synthesized
tgaataaatgtttgtcgaat

SEQ ID NO: 161799 - DNA, 20 bp, Artificial Sequence
  chemically synthesized
tcattcgacaaacatttatt

SEQ ID NO: 161800 - DNA, 20 bp, Artificial Sequence
  chemically synthesized
ctaccccagtgaaacatagt

SEQ ID NO: 161801 - DNA, 20 bp, Artificial Sequence
  chemically synthesized
attcctaccccagtgaaaca

SEQ ID NO: 161802 - DNA, 20 bp, Artificial Sequence
  chemically synthesized
cagtgcttactatgtttcac

SEQ ID NO: 161803 - DNA, 20 bp, Artificial Sequence
  chemically synthesized
agtgcttactatgtttcact

SEQ ID NO: 161804 - DNA, 20 bp, Artificial Sequence
  chemically synthesized
gtgcttactatgtttcactg

SEQ ID NO: 161805 - DNA, 20 bp, Artificial Sequence
  chemically synthesized
cttactatgtttcactgggg

SEQ ID NO: 161806 - DNA, 20 bp, Artificial Sequence
  chemically synthesized
ttactatgtttcactggggt

SEQ ID NO: 161807 - DNA, 20 bp, Artificial Sequence
  chemically synthesized
tgcactccccattcctaccc

SEQ ID NO: 161808 - DNA, 20 bp, Artificial Sequence
  chemically synthesized
atgtttcactggggtaggaa

SEQ ID NO: 161809 - DNA, 20 bp, Artificial Sequence
  chemically synthesized
tgtttcactggggtaggaat

SEQ ID NO: 161810 - DNA, 20 bp, Artificial Sequence
  chemically synthesized
gtttcactggggtaggaatg

SEQ ID NO: 161811 - DNA, 20 bp, Artificial Sequence
  chemically synthesized
ttcactggggtaggaatggg

SEQ ID NO: 161812 - DNA, 20 bp, Artificial Sequence
  chemically synthesized
tggggtaggaatggggagtg

SEQ ID NO: 161813 - DNA, 20 bp, Artificial Sequence
  chemically synthesized
acacaaatatatactacatt

SEQ ID NO: 161814 - DNA, 20 bp, Artificial Sequence
  chemically synthesized
acaaatatatactacattta

SEQ ID NO: 161815 - DNA, 20 bp, Artificial Sequence
  chemically synthesized
tacctgacctgctctaaatg

SEQ ID NO: 161816 - DNA, 20 bp, Artificial Sequence
  chemically synthesized
aatatatactacatttagag

SEQ ID NO: 161817 - DNA, 20 bp, Artificial Sequence
  chemically synthesized
atatatactacatttagagc

SEQ ID NO: 161818 - DNA, 20 bp, Artificial Sequence
  chemically synthesized
atactacatttagagcaggt

SEQ ID NO: 161819 - DNA, 20 bp, Artificial Sequence
  chemically synthesized
tactacatttagagcaggtc

SEQ ID NO: 161820 - DNA, 20 bp, Artificial Sequence
  chemically synthesized
agcaggtcaggtataacaac

SEQ ID NO: 161821 - DNA, 20 bp, Artificial Sequence
  chemically synthesized
gtcaggtataacaactagta

SEQ ID NO: 161822 - DNA, 20 bp, Artificial Sequence
  chemically synthesized
cattatacattgcactttac

SEQ ID NO: 161823 - DNA, 20 bp, Artificial Sequence
  chemically synthesized
tagtaaagtgcaatgtataa

SEQ ID NO: 161824 - DNA, 20 bp, Artificial Sequence
  chemically synthesized
gtaaagtgcaatgtataatg

SEQ ID NO: 161825 - DNA, 20 bp, Artificial Sequence
  chemically synthesized
gtgcaatgtataatggagca

SEQ ID NO: 161826 - DNA, 20 bp, Artificial Sequence
  chemically synthesized
gcaatgtataatggagcaca

SEQ ID NO: 161827 - DNA, 20 bp, Artificial Sequence
  chemically synthesized
atgtataatggagcacagag

SEQ ID NO: 161828 - DNA, 20 bp, Artificial Sequence
  chemically synthesized
tgtataatggagcacagagc

SEQ ID NO: 161829 - DNA, 20 bp, Artificial Sequence
  chemically synthesized
ctatcaaacacaaaagtgat

SEQ ID NO: 161830 - DNA, 20 bp, Artificial Sequence
  chemically synthesized
ttcttgtctatcaaacacaa

SEQ ID NO: 161831 - DNA, 20 bp, Artificial Sequence
  chemically synthesized
ctgatcacttttgtgtttga

SEQ ID NO: 161832 - DNA, 20 bp, Artificial Sequence
  chemically synthesized
cacttttgtgtttgatagac

SEQ ID NO: 161833 - DNA, 20 bp, Artificial Sequence
  chemically synthesized
ttttgtgtttgatagacaag

SEQ ID NO: 161834 - DNA, 20 bp, Artificial Sequence
  chemically synthesized
tttgtgtttgatagacaaga

SEQ ID NO: 161835 - DNA, 20 bp, Artificial Sequence
  chemically synthesized
tgtttgatagacaagaaggt

SEQ ID NO: 161836 - DNA, 20 bp, Artificial Sequence
  chemically synthesized
gtttgatagacaagaaggtc

SEQ ID NO: 161837 - DNA, 20 bp, Artificial Sequence
  chemically synthesized
gatagacaagaaggtcagga

SEQ ID NO: 161838 - DNA, 20 bp, Artificial Sequence
  chemically synthesized
gacaagaaggtcaggacaga

SEQ ID NO: 161839 - DNA, 20 bp, Artificial Sequence
  chemically synthesized
acaagaaggtcaggacagaa

SEQ ID NO: 161840 - DNA, 20 bp, Artificial Sequence
  chemically synthesized
gaaggtcaggacagaaaggc

SEQ ID NO: 161841 - DNA, 20 bp, Artificial Sequence
  chemically synthesized
aaggtcaggacagaaaggct

SEQ ID NO: 161842 - DNA, 20 bp, Artificial Sequence
  chemically synthesized
ggtcaggacagaaaggctgg

SEQ ID NO: 161843 - DNA, 20 bp, Artificial Sequence
  chemically synthesized
caggacagaaaggctgggag

SEQ ID NO: 161844 - DNA, 20 bp, Artificial Sequence
  chemically synthesized
gcatgagctgtttctgctcc

SEQ ID NO: 161845 - DNA, 20 bp, Artificial Sequence
  chemically synthesized
agaaaggctgggagcagaaa

SEQ ID NO: 161846 - DNA, 20 bp, Artificial Sequence
  chemically synthesized
ccccttataatgaggtgcat

SEQ ID NO: 161847 - DNA, 20 bp, Artificial Sequence
  chemically synthesized
cagctcatgcacctcattat

SEQ ID NO: 161848 - DNA, 20 bp, Artificial Sequence
  chemically synthesized
agctcatgcacctcattata

SEQ ID NO: 161849 - DNA, 20 bp, Artificial Sequence
  chemically synthesized
ccgtccatccccttataatg

SEQ ID NO: 161850 - DNA, 20 bp, Artificial Sequence
  chemically synthesized
gctcatgcacctcattataa

SEQ ID NO: 161851 - DNA, 20 bp, Artificial Sequence
  chemically synthesized
gccgtccatccccttataat

SEQ ID NO: 161852 - DNA, 20 bp, Artificial Sequence
  chemically synthesized
ctcatgcacctcattataag

SEQ ID NO: 161853 - DNA, 20 bp, Artificial Sequence
  chemically synthesized
tgcacctcattataagggga

SEQ ID NO: 161854 - DNA, 20 bp, Artificial Sequence
  chemically synthesized
cctcattataaggggatgga

SEQ ID NO: 161855 - DNA, 20 bp, Artificial Sequence
  chemically synthesized
cattataaggggatggacgg

SEQ ID NO: 161856 - DNA, 20 bp, Artificial Sequence
  chemically synthesized
ttataaggggatggacggca

SEQ ID NO: 161857 - DNA, 20 bp, Artificial Sequence
  chemically synthesized
ataaggggatggacggcaga

SEQ ID NO: 161858 - DNA, 20 bp, Artificial Sequence
  chemically synthesized
cggcagagagaatgtattcc

SEQ ID NO: 161859 - DNA, 20 bp, Artificial Sequence
  chemically synthesized
gcagagagaatgtattccaa

SEQ ID NO: 161860 - DNA, 20 bp, Artificial Sequence
  chemically synthesized
cagagagaatgtattccaag

SEQ ID NO: 161861 - DNA, 20 bp, Artificial Sequence
  chemically synthesized
agagagaatgtattccaaga

SEQ ID NO: 161862 - DNA, 20 bp, Artificial Sequence
  chemically synthesized
gcatgttccatgttccctct

SEQ ID NO: 161863 - DNA, 20 bp, Artificial Sequence
  chemically synthesized
atgtattccaagagggaaca

SEQ ID NO: 161864 - DNA, 20 bp, Artificial Sequence
  chemically synthesized
gagggaacatggaacatgca

SEQ ID NO: 161865 - DNA, 20 bp, Artificial Sequence
  chemically synthesized
gaacatggaacatgcaaaga

SEQ ID NO: 161866 - DNA, 20 bp, Artificial Sequence
  chemically synthesized
aacatggaacatgcaaagac

SEQ ID NO: 161867 - DNA, 20 bp, Artificial Sequence
  chemically synthesized
atggaacatgcaaagacagg

SEQ ID NO: 161868 - DNA, 20 bp, Artificial Sequence
  chemically synthesized
gaacatgcaaagacaggaag

SEQ ID NO: 161869 - DNA, 20 bp, Artificial Sequence
  chemically synthesized
catgcaaagacaggaagcag

SEQ ID NO: 161870 - DNA, 20 bp, Artificial Sequence
  chemically synthesized
gcaaagacaggaagcagaag

SEQ ID NO: 161871 - DNA, 20 bp, Artificial Sequence
  chemically synthesized
gacaggaagcagaagaagta

SEQ ID NO: 161872 - DNA, 20 bp, Artificial Sequence
  chemically synthesized
caggaagcagaagaagtacg

SEQ ID NO: 161873 - DNA, 20 bp, Artificial Sequence
  chemically synthesized
agaagtacggagctatcacg

SEQ ID NO: 161874 - DNA, 20 bp, Artificial Sequence
  chemically synthesized
gaagtacggagctatcacgt

SEQ ID NO: 161875 - DNA, 20 bp, Artificial Sequence
  chemically synthesized
aagtacggagctatcacgta

SEQ ID NO: 161876 - DNA, 20 bp, Artificial Sequence
  chemically synthesized
cttcccattcccctacgtga

SEQ ID NO: 161877 - DNA, 20 bp, Artificial Sequence
  chemically synthesized
agtacggagctatcacgtag

SEQ ID NO: 161878 - DNA, 20 bp, Artificial Sequence
  chemically synthesized
ggagctatcacgtaggggaa

SEQ ID NO: 161879 - DNA, 20 bp, Artificial Sequence
  chemically synthesized
gagctatcacgtaggggaat

SEQ ID NO: 161880 - DNA, 20 bp, Artificial Sequence
  chemically synthesized
ctatcacgtaggggaatggg

SEQ ID NO: 161881 - DNA, 20 bp, Artificial Sequence
  chemically synthesized
cgtaggggaatgggaagtaa

SEQ ID NO: 161882 - DNA, 20 bp, Artificial Sequence
  chemically synthesized
taggggaatgggaagtaatg

SEQ ID NO: 161883 - DNA, 20 bp, Artificial Sequence
  chemically synthesized
gggaatgggaagtaatggag

SEQ ID NO: 161884 - DNA, 20 bp, Artificial Sequence
  chemically synthesized
gggaagtaatggagtagaaa

SEQ ID NO: 161885 - DNA, 20 bp, Artificial Sequence
  chemically synthesized
agtaatggagtagaaataga

SEQ ID NO: 161886 - DNA, 20 bp, Artificial Sequence
  chemically synthesized
ggagtagaaatagaaagcaa

SEQ ID NO: 161887 - DNA, 20 bp, Artificial Sequence
  chemically synthesized
tagaaatagaaagcaaaagc

SEQ ID NO: 161888 - DNA, 20 bp, Artificial Sequence
  chemically synthesized
gaaatagaaagcaaaagcca

SEQ ID NO: 161889 - DNA, 20 bp, Artificial Sequence
  chemically synthesized
agaaagcaaaagccagagaa

SEQ ID NO: 161890 - DNA, 20 bp, Artificial Sequence
  chemically synthesized
tacaagatccttcttttctc

SEQ ID NO: 161891 - DNA, 20 bp, Artificial Sequence
  chemically synthesized
aagcaaaagccagagaaaag

SEQ ID NO: 161892 - DNA, 20 bp, Artificial Sequence
  chemically synthesized
agcaaaagccagagaaaaga

SEQ ID NO: 161893 - DNA, 20 bp, Artificial Sequence
  chemically synthesized
cagttctgagggtggtatac

SEQ ID NO: 161894 - DNA, 20 bp, Artificial Sequence
  chemically synthesized
aggatcttgtataccaccct

SEQ ID NO: 161895 - DNA, 20 bp, Artificial Sequence
  chemically synthesized
ctccactacagttctgaggg

SEQ ID NO: 161896 - DNA, 20 bp, Artificial Sequence
  chemically synthesized
cttctccactacagttctga

SEQ ID NO: 161897 - DNA, 20 bp, Artificial Sequence
  chemically synthesized
gcttctccactacagttctg

SEQ ID NO: 161898 - DNA, 20 bp, Artificial Sequence
  chemically synthesized
gtataccaccctcagaactg

SEQ ID NO: 161899 - DNA, 20 bp, Artificial Sequence
  chemically synthesized
agcttctccactacagttct

SEQ ID NO: 161900 - DNA, 20 bp, Artificial Sequence
  chemically synthesized
taccaccctcagaactgtag

SEQ ID NO: 161901 - DNA, 20 bp, Artificial Sequence
  chemically synthesized
ccaccctcagaactgtagtg

SEQ ID NO: 161902 - DNA, 20 bp, Artificial Sequence
  chemically synthesized
ctcttgtagcttctccacta

SEQ ID NO: 161903 - DNA, 20 bp, Artificial Sequence
  chemically synthesized
ccctcagaactgtagtggag

SEQ ID NO: 161904 - DNA, 20 bp, Artificial Sequence
  chemically synthesized
aactgtagtggagaagctac

SEQ ID NO: 161905 - DNA, 20 bp, Artificial Sequence
  chemically synthesized
ctgtagtggagaagctacaa

SEQ ID NO: 161906 - DNA, 20 bp, Artificial Sequence
  chemically synthesized
tcccttatttaaaactcttg

SEQ ID NO: 161907 - DNA, 20 bp, Artificial Sequence
  chemically synthesized
aagctacaagagttttaaat

SEQ ID NO: 161908 - DNA, 20 bp, Artificial Sequence
  chemically synthesized
agctacaagagttttaaata

SEQ ID NO: 161909 - DNA, 20 bp, Artificial Sequence
  chemically synthesized
gctacaagagttttaaataa

SEQ ID NO: 161910 - DNA, 20 bp, Artificial Sequence
  chemically synthesized
aagagttttaaataagggaa

SEQ ID NO: 161911 - DNA, 20 bp, Artificial Sequence
  chemically synthesized
gaagatcaattggaaaacat

SEQ ID NO: 161912 - DNA, 20 bp, Artificial Sequence
  chemically synthesized
tatatatttagaagatcaat

SEQ ID NO: 161913 - DNA, 20 bp, Artificial Sequence
  chemically synthesized
atatattcatatatatttag

SEQ ID NO: 161914 - DNA, 20 bp, Artificial Sequence
  chemically synthesized
aatatatattcatatatatt

SEQ ID NO: 161915 - DNA, 20 bp, Artificial Sequence
  chemically synthesized
tgaatatatatttataaatg

SEQ ID NO: 161916 - DNA, 20 bp, Artificial Sequence
  chemically synthesized
gaatatatatttataaatga

SEQ ID NO: 161917 - DNA, 20 bp, Artificial Sequence
  chemically synthesized
tatatgaatatgtgaataaa

SEQ ID NO: 161918 - DNA, 20 bp, Artificial Sequence
  chemically synthesized
atatgtgaataaatagacat

SEQ ID NO: 161919 - DNA, 20 bp, Artificial Sequence
  chemically synthesized
agaaaaccaagcattaatag

SEQ ID NO: 161920 - DNA, 20 bp, Artificial Sequence
  chemically synthesized
attagaaaaccaagcattaa

SEQ ID NO: 161921 - DNA, 20 bp, Artificial Sequence
  chemically synthesized
taagatctactattaatgct

SEQ ID NO: 161922 - DNA, 20 bp, Artificial Sequence
  chemically synthesized
gcttatttgattagaaaacc

SEQ ID NO: 161923 - DNA, 20 bp, Artificial Sequence
  chemically synthesized
gcttggttttctaatcaaat

SEQ ID NO: 161924 - DNA, 20 bp, Artificial Sequence
  chemically synthesized
ttcagatcagcttatttgat

SEQ ID NO: 161925 - DNA, 20 bp, Artificial Sequence
  chemically synthesized
tatttatatctcattcagat

SEQ ID NO: 161926 - DNA, 20 bp, Artificial Sequence
  chemically synthesized
tcaaataagctgatctgaat

SEQ ID NO: 161927 - DNA, 20 bp, Artificial Sequence
  chemically synthesized
agcaatatttatatctcatt

SEQ ID NO: 161928 - DNA, 20 bp, Artificial Sequence
  chemically synthesized
atgagatataaatattgcta

SEQ ID NO: 161929 - DNA, 20 bp, Artificial Sequence
  chemically synthesized
ataaatattgctacagaaaa

SEQ ID NO: 161930 - DNA, 20 bp, Artificial Sequence
  chemically synthesized
tcttgaatttcttttttctg

SEQ ID NO: 161931 - DNA, 20 bp, Artificial Sequence
  chemically synthesized
gctacagaaaaaagaaattc

SEQ ID NO: 161932 - DNA, 20 bp, Artificial Sequence
  chemically synthesized
gacacttaatgtttacaaaa

SEQ ID NO: 161933 - DNA, 20 bp, Artificial Sequence
  chemically synthesized
acaacttttttgtaaacatt

SEQ ID NO: 161934 - DNA, 20 bp, Artificial Sequence
  chemically synthesized
gttaaaaaaaattaagtgaa

SEQ ID NO: 161935 - DNA, 20 bp, Artificial Sequence
  chemically synthesized
aataaaagttaaaaaaaatt

SEQ ID NO: 161936 - DNA, 20 bp, Artificial Sequence
  chemically synthesized
ttttttttaacttttatttt

SEQ ID NO: 161937 - DNA, 20 bp, Artificial Sequence
  chemically synthesized
tgcacgtgtacttaaaataa

SEQ ID NO: 161938 - DNA, 20 bp, Artificial Sequence
  chemically synthesized
tttattttaagtacacgtgc

SEQ ID NO: 161939 - DNA, 20 bp, Artificial Sequence
  chemically synthesized
acacgtgcaagtttgttaca

SEQ ID NO: 161940 - DNA, 20 bp, Artificial Sequence
  chemically synthesized
cacgtgcaagtttgttacat

SEQ ID NO: 161941 - DNA, 20 bp, Artificial Sequence
  chemically synthesized
cataggtaaacttgtgtcat

SEQ ID NO: 161942 - DNA, 20 bp, Artificial Sequence
  chemically synthesized
acaacaggccctcatgacac

SEQ ID NO: 161943 - DNA, 20 bp, Artificial Sequence
  chemically synthesized
ataggtaaacttgtgtcatg

SEQ ID NO: 161944 - DNA, 20 bp, Artificial Sequence
  chemically synthesized
taggtaaacttgtgtcatga

SEQ ID NO: 161945 - DNA, 20 bp, Artificial Sequence
  chemically synthesized
tgtcatgagggcctgttgta

SEQ ID NO: 161946 - DNA, 20 bp, Artificial Sequence
  chemically synthesized
gacaacataatctgtacaac

SEQ ID NO: 161947 - DNA, 20 bp, Artificial Sequence
  chemically synthesized
tgacaacataatctgtacaa

SEQ ID NO: 161948 - DNA, 20 bp, Artificial Sequence
  chemically synthesized
gtacagattatgttgtcacc

SEQ ID NO: 161949 - DNA, 20 bp, Artificial Sequence
  chemically synthesized
tatgttgtcacccagatatt

SEQ ID NO: 161950 - DNA, 20 bp, Artificial Sequence
  chemically synthesized
gggtactaggcttaatatct

SEQ ID NO: 161951 - DNA, 20 bp, Artificial Sequence
  chemically synthesized
tgggtactaggcttaatatc

SEQ ID NO: 161952 - DNA, 20 bp, Artificial Sequence
  chemically synthesized
tgtcacccagatattaagcc

SEQ ID NO: 161953 - DNA, 20 bp, Artificial Sequence
  chemically synthesized
aaaaataactaatgggtact

SEQ ID NO: 161954 - DNA, 20 bp, Artificial Sequence
  chemically synthesized
aaaaaataactaatgggtac

SEQ ID NO: 161955 - DNA, 20 bp, Artificial Sequence
  chemically synthesized
atattaagcctagtacccat

SEQ ID NO: 161956 - DNA, 20 bp, Artificial Sequence
  chemically synthesized
aaccagaaaaaataactaat

SEQ ID NO: 161957 - DNA, 20 bp, Artificial Sequence
  chemically synthesized
gaaccagaaaaaataactaa

SEQ ID NO: 161958 - DNA, 20 bp, Artificial Sequence
  chemically synthesized
tacccattagttattttttc

SEQ ID NO: 161959 - DNA, 20 bp, Artificial Sequence
  chemically synthesized
gttgggcggagggagagaac

SEQ ID NO: 161960 - DNA, 20 bp, Artificial Sequence
  chemically synthesized
gtggaggttgggcggaggga

SEQ ID NO: 161961 - DNA, 20 bp, Artificial Sequence
  chemically synthesized
gggtggaggttgggcggagg

SEQ ID NO: 161962 - DNA, 20 bp, Artificial Sequence
  chemically synthesized
gagggtggaggttgggcgga

SEQ ID NO: 161963 - DNA, 20 bp, Artificial Sequence
  chemically synthesized
agagggtggaggttgggcgg

SEQ ID NO: 161964 - DNA, 20 bp, Artificial Sequence
  chemically synthesized
cagagggtggaggttgggcg

SEQ ID NO: 161965 - DNA, 20 bp, Artificial Sequence
  chemically synthesized
atcagagggtggaggttggg

SEQ ID NO: 161966 - DNA, 20 bp, Artificial Sequence
  chemically synthesized
cctatcagagggtggaggtt

SEQ ID NO: 161967 - DNA, 20 bp, Artificial Sequence
  chemically synthesized
gcctatcagagggtggaggt

SEQ ID NO: 161968 - DNA, 20 bp, Artificial Sequence
  chemically synthesized
tggggcctatcagagggtgg

SEQ ID NO: 161969 - DNA, 20 bp, Artificial Sequence
  chemically synthesized
atggggcctatcagagggtg

SEQ ID NO: 161970 - DNA, 20 bp, Artificial Sequence
  chemically synthesized
caatggggcctatcagaggg

SEQ ID NO: 161971 - DNA, 20 bp, Artificial Sequence
  chemically synthesized
gcccaacctccaccctctga

SEQ ID NO: 161972 - DNA, 20 bp, Artificial Sequence
  chemically synthesized
cccaacctccaccctctgat

SEQ ID NO: 161973 - DNA, 20 bp, Artificial Sequence
  chemically synthesized
acacaatggggcctatcaga

SEQ ID NO: 161974 - DNA, 20 bp, Artificial Sequence
  chemically synthesized
cacacaatggggcctatcag

SEQ ID NO: 161975 - DNA, 20 bp, Artificial Sequence
  chemically synthesized
acacacaatggggcctatca

SEQ ID NO: 161976 - DNA, 20 bp, Artificial Sequence
  chemically synthesized
caacacacaatggggcctat

SEQ ID NO: 161977 - DNA, 20 bp, Artificial Sequence
  chemically synthesized
caggggaacaacacacaatg

SEQ ID NO: 161978 - DNA, 20 bp, Artificial Sequence
  chemically synthesized
acaggggaacaacacacaat

SEQ ID NO: 161979 - DNA, 20 bp, Artificial Sequence
  chemically synthesized
tacaggggaacaacacacaa

SEQ ID NO: 161980 - DNA, 20 bp, Artificial Sequence
  chemically synthesized
gaacacatggacacatacag

SEQ ID NO: 161981 - DNA, 20 bp, Artificial Sequence
  chemically synthesized
agaacacatggacacataca

SEQ ID NO: 161982 - DNA, 20 bp, Artificial Sequence
  chemically synthesized
gagaacacatggacacatac

SEQ ID NO: 161983 - DNA, 20 bp, Artificial Sequence
  chemically synthesized
tgagaacacatggacacata

SEQ ID NO: 161984 - DNA, 20 bp, Artificial Sequence
  chemically synthesized
agctaagtgatgagaacaca

SEQ ID NO: 161985 - DNA, 20 bp, Artificial Sequence
  chemically synthesized
gtccatgtgttctcatcact

SEQ ID NO: 161986 - DNA, 20 bp, Artificial Sequence
  chemically synthesized
atgagtgggagctaagtgat

SEQ ID NO: 161987 - DNA, 20 bp, Artificial Sequence
  chemically synthesized
gtaagttatgagtgggagct

SEQ ID NO: 161988 - DNA, 20 bp, Artificial Sequence
  chemically synthesized
agtaagtaagttatgagtgg

SEQ ID NO: 161989 - DNA, 20 bp, Artificial Sequence
  chemically synthesized
taagtaagtaagttatgagt

SEQ ID NO: 161990 - DNA, 20 bp, Artificial Sequence
  chemically synthesized
ataagtaagtaagttatgag

SEQ ID NO: 161991 - DNA, 20 bp, Artificial Sequence
  chemically synthesized
cttataagtaagtaagttat

SEQ ID NO: 161992 - DNA, 20 bp, Artificial Sequence
  chemically synthesized
ggcactccttataagtaagt

SEQ ID NO: 161993 - DNA, 20 bp, Artificial Sequence
  chemically synthesized
ctcataacttacttacttat

SEQ ID NO: 161994 - DNA, 20 bp, Artificial Sequence
  chemically synthesized
tcataacttacttacttata

SEQ ID NO: 161995 - DNA, 20 bp, Artificial Sequence
  chemically synthesized
agaaggcactccttataagt

SEQ ID NO: 161996 - DNA, 20 bp, Artificial Sequence
  chemically synthesized
ataacttacttacttataag

SEQ ID NO: 161997 - DNA, 20 bp, Artificial Sequence
  chemically synthesized
tggtagaaggcactccttat

SEQ ID NO: 161998 - DNA, 20 bp, Artificial Sequence
  chemically synthesized
caaaatagccaaatggtaga

SEQ ID NO: 161999 - DNA, 20 bp, Artificial Sequence
  chemically synthesized
acaaaatagccaaatggtag

SEQ ID NO: 162000 - DNA, 20 bp, Artificial Sequence
  chemically synthesized
aaggagtgccttctaccatt

SEQ ID NO: 162001 - DNA, 20 bp, Artificial Sequence
  chemically synthesized
ttgacaaaatagccaaatgg

SEQ ID NO: 162002 - DNA, 20 bp, Artificial Sequence
  chemically synthesized
gggttgacaaaatagccaaa

SEQ ID NO: 162003 - DNA, 20 bp, Artificial Sequence
  chemically synthesized
taattgtggggttgacaaaa

SEQ ID NO: 162004 - DNA, 20 bp, Artificial Sequence
  chemically synthesized
tagaaaaactgttaattgtg

SEQ ID NO: 162005 - DNA, 20 bp, Artificial Sequence
  chemically synthesized
atagaaaaactgttaattgt

SEQ ID NO: 162006 - DNA, 20 bp, Artificial Sequence
  chemically synthesized
tttgtcaaccccacaattaa

SEQ ID NO: 162007 - DNA, 20 bp, Artificial Sequence
  chemically synthesized
gatagaaaaactgttaattg

SEQ ID NO: 162008 - DNA, 20 bp, Artificial Sequence
  chemically synthesized
atcatcaatgatagattaga

SEQ ID NO: 162009 - DNA, 20 bp, Artificial Sequence
  chemically synthesized
ccttatcatcaatgatagat

SEQ ID NO: 162010 - DNA, 20 bp, Artificial Sequence
  chemically synthesized
gtggcccttatcatcaatga

SEQ ID NO: 162011 - DNA, 20 bp, Artificial Sequence
  chemically synthesized
tctaatctatcattgatgat

SEQ ID NO: 162012 - DNA, 20 bp, Artificial Sequence
  chemically synthesized
ctaatctatcattgatgata

SEQ ID NO: 162013 - DNA, 20 bp, Artificial Sequence
  chemically synthesized
taatctatcattgatgataa

SEQ ID NO: 162014 - DNA, 20 bp, Artificial Sequence
  chemically synthesized
cttagtttacataacaatag

SEQ ID NO: 162015 - DNA, 20 bp, Artificial Sequence
  chemically synthesized
tttcttagtttacataacaa

SEQ ID NO: 162016 - DNA, 20 bp, Artificial Sequence
  chemically synthesized
ccactattgttatgtaaact

SEQ ID NO: 162017 - DNA, 20 bp, Artificial Sequence
  chemically synthesized
tattgttatgtaaactaaga

SEQ ID NO: 162018 - DNA, 20 bp, Artificial Sequence
  chemically synthesized
tttttgttttttggctttct

SEQ ID NO: 162019 - DNA, 20 bp, Artificial Sequence
  chemically synthesized
gtgtaggtttttttgttttt

SEQ ID NO: 162020 - DNA, 20 bp, Artificial Sequence
  chemically synthesized
agataatgtttacaaagtgt

SEQ ID NO: 162021 - DNA, 20 bp, Artificial Sequence
  chemically synthesized
tagataatgtttacaaagtg

SEQ ID NO: 162022 - DNA, 20 bp, Artificial Sequence
  chemically synthesized
tacaatagataatgtttaca

SEQ ID NO: 162023 - DNA, 20 bp, Artificial Sequence
  chemically synthesized
acttgagatatatcgtacaa

SEQ ID NO: 162024 - DNA, 20 bp, Artificial Sequence
  chemically synthesized
tctattgtacgatatatctc

SEQ ID NO: 162025 - DNA, 20 bp, Artificial Sequence
  chemically synthesized
tgtacgatatatctcaagtt

SEQ ID NO: 162026 - DNA, 20 bp, Artificial Sequence
  chemically synthesized
tacgatatatctcaagttca

SEQ ID NO: 162027 - DNA, 20 bp, Artificial Sequence
  chemically synthesized
atttcaacacctctgaactt

SEQ ID NO: 162028 - DNA, 20 bp, Artificial Sequence
  chemically synthesized
acgatatatctcaagttcag

SEQ ID NO: 162029 - DNA, 20 bp, Artificial Sequence
  chemically synthesized
tgattcccaaatgcattttt

SEQ ID NO: 162030 - DNA, 20 bp, Artificial Sequence
  chemically synthesized
gaaatactaaaaaatgcatt

SEQ ID NO: 162031 - DNA, 20 bp, Artificial Sequence
  chemically synthesized
aaatactaaaaaatgcattt

SEQ ID NO: 162032 - DNA, 20 bp, Artificial Sequence
  chemically synthesized
ttgggaatcaatgaaatcct

SEQ ID NO: 162033 - DNA, 20 bp, Artificial Sequence
  chemically synthesized
atagtatccacaaatgtctt

SEQ ID NO: 162034 - DNA, 20 bp, Artificial Sequence
  chemically synthesized
catagtatccacaaatgtct

SEQ ID NO: 162035 - DNA, 20 bp, Artificial Sequence
  chemically synthesized
atgaaatcctaagacatttg

SEQ ID NO: 162036 - DNA, 20 bp, Artificial Sequence
  chemically synthesized
taagacatttgtggatacta

SEQ ID NO: 162037 - DNA, 20 bp, Artificial Sequence
  chemically synthesized
atgaactgacaaatcaacca

SEQ ID NO: 162038 - DNA, 20 bp, Artificial Sequence
  chemically synthesized
ggatactatggttgatttgt

SEQ ID NO: 162039 - DNA, 20 bp, Artificial Sequence
  chemically synthesized
cagggcagccatattaagag

SEQ ID NO: 162040 - DNA, 20 bp, Artificial Sequence
  chemically synthesized
gcagggcagccatattaaga

SEQ ID NO: 162041 - DNA, 20 bp, Artificial Sequence
  chemically synthesized
attcatttcctctcttaata

SEQ ID NO: 162042 - DNA, 20 bp, Artificial Sequence
  chemically synthesized
ctgcagggcagccatattaa

SEQ ID NO: 162043 - DNA, 20 bp, Artificial Sequence
  chemically synthesized
cactgcagggcagccatatt

SEQ ID NO: 162044 - DNA, 20 bp, Artificial Sequence
  chemically synthesized
ctcttaatatggctgccctg

SEQ ID NO: 162045 - DNA, 20 bp, Artificial Sequence
  chemically synthesized
gaagtatattcactgcaggg

SEQ ID NO: 162046 - DNA, 20 bp, Artificial Sequence
  chemically synthesized
agggaagtatattcactgca

SEQ ID NO: 162047 - DNA, 20 bp, Artificial Sequence
  chemically synthesized
aagggaagtatattcactgc

SEQ ID NO: 162048 - DNA, 20 bp, Artificial Sequence
  chemically synthesized
gaagggaagtatattcactg

SEQ ID NO: 162049 - DNA, 20 bp, Artificial Sequence
  chemically synthesized
cccaaagtcaatgggaaggg

SEQ ID NO: 162050 - DNA, 20 bp, Artificial Sequence
  chemically synthesized
aagcccaaagtcaatgggaa

SEQ ID NO: 162051 - DNA, 20 bp, Artificial Sequence
  chemically synthesized
caagcccaaagtcaatggga

SEQ ID NO: 162052 - DNA, 20 bp, Artificial Sequence
  chemically synthesized
tcaagcccaaagtcaatggg

SEQ ID NO: 162053 - DNA, 20 bp, Artificial Sequence
  chemically synthesized
cagtcaagcccaaagtcaat

SEQ ID NO: 162054 - DNA, 20 bp, Artificial Sequence
  chemically synthesized
acttcccttcccattgactt

SEQ ID NO: 162055 - DNA, 20 bp, Artificial Sequence
  chemically synthesized
acagtcaagcccaaagtcaa

SEQ ID NO: 162056 - DNA, 20 bp, Artificial Sequence
  chemically synthesized
cttcccttcccattgacttt

SEQ ID NO: 162057 - DNA, 20 bp, Artificial Sequence
  chemically synthesized
aaggtacacagtcaagccca

SEQ ID NO: 162058 - DNA, 20 bp, Artificial Sequence
  chemically synthesized
ttggtcaaaggtacacagtc

SEQ ID NO: 162059 - DNA, 20 bp, Artificial Sequence
  chemically synthesized
gtctattggtcaaaggtaca

SEQ ID NO: 162060 - DNA, 20 bp, Artificial Sequence
  chemically synthesized
gtccatggtctattggtcaa

SEQ ID NO: 162061 - DNA, 20 bp, Artificial Sequence
  chemically synthesized
gactgtgtacctttgaccaa

SEQ ID NO: 162062 - DNA, 20 bp, Artificial Sequence
  chemically synthesized
tgtccatggtctattggtca

SEQ ID NO: 162063 - DNA, 20 bp, Artificial Sequence
  chemically synthesized
tctgtctgtccatggtctat

SEQ ID NO: 162064 - DNA, 20 bp, Artificial Sequence
  chemically synthesized
tacctttgaccaatagacca

SEQ ID NO: 162065 - DNA, 20 bp, Artificial Sequence
  chemically synthesized
tttgaccaatagaccatgga

SEQ ID NO: 162066 - DNA, 20 bp, Artificial Sequence
  chemically synthesized
cagtcccttctgtctgtcca

SEQ ID NO: 162067 - DNA, 20 bp, Artificial Sequence
  chemically synthesized
accaatagaccatggacaga

SEQ ID NO: 162068 - DNA, 20 bp, Artificial Sequence
  chemically synthesized
aatagaccatggacagacag

SEQ ID NO: 162069 - DNA, 20 bp, Artificial Sequence
  chemically synthesized
atagaccatggacagacaga

SEQ ID NO: 162070 - DNA, 20 bp, Artificial Sequence
  chemically synthesized
tagaccatggacagacagaa

SEQ ID NO: 162071 - DNA, 20 bp, Artificial Sequence
  chemically synthesized
gacagacagaagggactgtg

SEQ ID NO: 162072 - DNA, 20 bp, Artificial Sequence
  chemically synthesized
agacagaagggactgtgtgg

SEQ ID NO: 162073 - DNA, 20 bp, Artificial Sequence
  chemically synthesized
tccagctaagagctgccaca

SEQ ID NO: 162074 - DNA, 20 bp, Artificial Sequence
  chemically synthesized
agggactgtgtggcagctct

SEQ ID NO: 162075 - DNA, 20 bp, Artificial Sequence
  chemically synthesized
actgtgtggcagctcttagc

SEQ ID NO: 162076 - DNA, 20 bp, Artificial Sequence
  chemically synthesized
gcctttaaagttccagctaa

SEQ ID NO: 162077 - DNA, 20 bp, Artificial Sequence
  chemically synthesized
ctgcctttaaagttccagct

SEQ ID NO: 162078 - DNA, 20 bp, Artificial Sequence
  chemically synthesized
ttgaactgcctttaaagttc

SEQ ID NO: 162079 - DNA, 20 bp, Artificial Sequence
  chemically synthesized
agctcttagctggaacttta

SEQ ID NO: 162080 - DNA, 20 bp, Artificial Sequence
  chemically synthesized
gctcttagctggaactttaa

SEQ ID NO: 162081 - DNA, 20 bp, Artificial Sequence
  chemically synthesized
cttagctggaactttaaagg

SEQ ID NO: 162082 - DNA, 20 bp, Artificial Sequence
  chemically synthesized
caaatcttgaactgccttta

SEQ ID NO: 162083 - DNA, 20 bp, Artificial Sequence
  chemically synthesized
tggaactttaaaggcagttc

SEQ ID NO: 162084 - DNA, 20 bp, Artificial Sequence
  chemically synthesized
aaaggcagttcaagatttgc

SEQ ID NO: 162085 - DNA, 20 bp, Artificial Sequence
  chemically synthesized
aagataagaacaaggggaac

SEQ ID NO: 162086 - DNA, 20 bp, Artificial Sequence
  chemically synthesized
tgatggaagataagaacaag

SEQ ID NO: 162087 - DNA, 20 bp, Artificial Sequence
  chemically synthesized
atgatggaagataagaacaa

SEQ ID NO: 162088 - DNA, 20 bp, Artificial Sequence
  chemically synthesized
catgatggaagataagaaca

SEQ ID NO: 162089 - DNA, 20 bp, Artificial Sequence
  chemically synthesized
tcatgatggaagataagaac

SEQ ID NO: 162090 - DNA, 20 bp, Artificial Sequence
  chemically synthesized
attctctcatgatggaagat

SEQ ID NO: 162091 - DNA, 20 bp, Artificial Sequence
  chemically synthesized
ttgttcttatcttccatcat

SEQ ID NO: 162092 - DNA, 20 bp, Artificial Sequence
  chemically synthesized
atattattctctcatgatgg

SEQ ID NO: 162093 - DNA, 20 bp, Artificial Sequence
  chemically synthesized
gttcttatcttccatcatga

SEQ ID NO: 162094 - DNA, 20 bp, Artificial Sequence
  chemically synthesized
ggcatattattctctcatga

SEQ ID NO: 162095 - DNA, 20 bp, Artificial Sequence
  chemically synthesized
gagaataatatgccatataa

SEQ ID NO: 162096 - DNA, 20 bp, Artificial Sequence
  chemically synthesized
cggaaagagcagcttttata

SEQ ID NO: 162097 - DNA, 20 bp, Artificial Sequence
  chemically synthesized
caggaccctagcggaaagag

SEQ ID NO: 162098 - DNA, 20 bp, Artificial Sequence
  chemically synthesized
ataaaagctgctctttccgc

SEQ ID NO: 162099 - DNA, 20 bp, Artificial Sequence
  chemically synthesized
tcccaggaccctagcggaaa

SEQ ID NO: 162100 - DNA, 20 bp, Artificial Sequence
  chemically synthesized
taaaagctgctctttccgct

SEQ ID NO: 162101 - DNA, 20 bp, Artificial Sequence
  chemically synthesized
aaaagctgctctttccgcta

SEQ ID NO: 162102 - DNA, 20 bp, Artificial Sequence
  chemically synthesized
catcccaggaccctagcgga

SEQ ID NO: 162103 - DNA, 20 bp, Artificial Sequence
  chemically synthesized
ttctcatcccaggaccctag

SEQ ID NO: 162104 - DNA, 20 bp, Artificial Sequence
  chemically synthesized
tgctctttccgctagggtcc

SEQ ID NO: 162105 - DNA, 20 bp, Artificial Sequence
  chemically synthesized
gctctttccgctagggtcct

SEQ ID NO: 162106 - DNA, 20 bp, Artificial Sequence
  chemically synthesized
gtcttctcatcccaggaccc

SEQ ID NO: 162107 - DNA, 20 bp, Artificial Sequence
  chemically synthesized
ttccgctagggtcctgggat

SEQ ID NO: 162108 - DNA, 20 bp, Artificial Sequence
  chemically synthesized
tctaaatgtcttctcatccc

SEQ ID NO: 162109 - DNA, 20 bp, Artificial Sequence
  chemically synthesized
cgctagggtcctgggatgag

SEQ ID NO: 162110 - DNA, 20 bp, Artificial Sequence
  chemically synthesized
ctctaaatgtcttctcatcc

SEQ ID NO: 162111 - DNA, 20 bp, Artificial Sequence
  chemically synthesized
tcctgggatgagaagacatt

SEQ ID NO: 162112 - DNA, 20 bp, Artificial Sequence
  chemically synthesized
ctgggatgagaagacattta

SEQ ID NO: 162113 - DNA, 20 bp, Artificial Sequence
  chemically synthesized
ggatgagaagacatttagag

SEQ ID NO: 162114 - DNA, 20 bp, Artificial Sequence
  chemically synthesized
tttagagcagatccatattc

SEQ ID NO: 162115 - DNA, 20 bp, Artificial Sequence
  chemically synthesized
ggtcttttcattctagaata

SEQ ID NO: 162116 - DNA, 20 bp, Artificial Sequence
  chemically synthesized
gatccatattctagaatgaa

SEQ ID NO: 162117 - DNA, 20 bp, Artificial Sequence
  chemically synthesized
aagttaaggtcttttcattc

SEQ ID NO: 162118 - DNA, 20 bp, Artificial Sequence
  chemically synthesized
ccacactatgaatcaagtta

SEQ ID NO: 162119 - DNA, 20 bp, Artificial Sequence
  chemically synthesized
tccacactatgaatcaagtt

SEQ ID NO: 162120 - DNA, 20 bp, Artificial Sequence
  chemically synthesized
aaagaccttaacttgattca

SEQ ID NO: 162121 - DNA, 20 bp, Artificial Sequence
  chemically synthesized
tttactccacactatgaatc

SEQ ID NO: 162122 - DNA, 20 bp, Artificial Sequence
  chemically synthesized
ccttaacttgattcatagtg

SEQ ID NO: 162123 - DNA, 20 bp, Artificial Sequence
  chemically synthesized
ttaacttgattcatagtgtg

SEQ ID NO: 162124 - DNA, 20 bp, Artificial Sequence
  chemically synthesized
ttgattcatagtgtggagta

SEQ ID NO: 162125 - DNA, 20 bp, Artificial Sequence
  chemically synthesized
catagtgtggagtaaagctg

SEQ ID NO: 162126 - DNA, 20 bp, Artificial Sequence
  chemically synthesized
atgtgtctgcagatcagctg

SEQ ID NO: 162127 - DNA, 20 bp, Artificial Sequence
  chemically synthesized
gtaaagctgcagctgatctg

SEQ ID NO: 162128 - DNA, 20 bp, Artificial Sequence
  chemically synthesized
tcactcatgtgtctgcagat

SEQ ID NO: 162129 - DNA, 20 bp, Artificial Sequence
  chemically synthesized
attactcactcatgtgtctg

SEQ ID NO: 162130 - DNA, 20 bp, Artificial Sequence
  chemically synthesized
cagctgatctgcagacacat

SEQ ID NO: 162131 - DNA, 20 bp, Artificial Sequence
  chemically synthesized
tgatctgcagacacatgagt

SEQ ID NO: 162132 - DNA, 20 bp, Artificial Sequence
  chemically synthesized
tgtttgttgttatatgtcac

SEQ ID NO: 162133 - DNA, 20 bp, Artificial Sequence
  chemically synthesized
aacaaacaatgacaaaattc

SEQ ID NO: 162134 - DNA, 20 bp, Artificial Sequence
  chemically synthesized
tttgtcattgtttgttactg

SEQ ID NO: 162135 - DNA, 20 bp, Artificial Sequence
  chemically synthesized
tcattgtttgttactgcagc

SEQ ID NO: 162136 - DNA, 20 bp, Artificial Sequence
  chemically synthesized
attgtttgttactgcagcaa

SEQ ID NO: 162137 - DNA, 20 bp, Artificial Sequence
  chemically synthesized
gtaattgtcagctcttgctg

SEQ ID NO: 162138 - DNA, 20 bp, Artificial Sequence
  chemically synthesized
tactataatattgtaattgt

SEQ ID NO: 162139 - DNA, 20 bp, Artificial Sequence
  chemically synthesized
agctgacaattacaatatta

SEQ ID NO: 162140 - DNA, 20 bp, Artificial Sequence
  chemically synthesized
aacaaacaatatgtgatttc

SEQ ID NO: 162141 - DNA, 20 bp, Artificial Sequence
  chemically synthesized
acaaacaatatgtgatttct

SEQ ID NO: 162142 - DNA, 20 bp, Artificial Sequence
  chemically synthesized
ttactttggtttttttgtcc

SEQ ID NO: 162143 - DNA, 20 bp, Artificial Sequence
  chemically synthesized
tttctgggacaaaaaaacca

SEQ ID NO: 162144 - DNA, 20 bp, Artificial Sequence
  chemically synthesized
tgggacaaaaaaaccaaagt

SEQ ID NO: 162145 - DNA, 20 bp, Artificial Sequence
  chemically synthesized
tttatattaaaggcttactt

SEQ ID NO: 162146 - DNA, 20 bp, Artificial Sequence
  chemically synthesized
ccagggcacatttatattaa

SEQ ID NO: 162147 - DNA, 20 bp, Artificial Sequence
  chemically synthesized
accagggcacatttatatta

SEQ ID NO: 162148 - DNA, 20 bp, Artificial Sequence
  chemically synthesized
cctttaatataaatgtgccc

SEQ ID NO: 162149 - DNA, 20 bp, Artificial Sequence
  chemically synthesized
gcagtcaatatatgcgacca

SEQ ID NO: 162150 - DNA, 20 bp, Artificial Sequence
  chemically synthesized
tgcagtcaatatatgcgacc

SEQ ID NO: 162151 - DNA, 20 bp, Artificial Sequence
  chemically synthesized
gtgcagtcaatatatgcgac

SEQ ID NO: 162152 - DNA, 20 bp, Artificial Sequence
  chemically synthesized
gtatggaatgagagatagtg

SEQ ID NO: 162153 - DNA, 20 bp, Artificial Sequence
  chemically synthesized
tttctgtatggaatgagaga

SEQ ID NO: 162154 - DNA, 20 bp, Artificial Sequence
  chemically synthesized
acagtttctgtatggaatga

SEQ ID NO: 162155 - DNA, 20 bp, Artificial Sequence
  chemically synthesized
aaacagtttctgtatggaat

SEQ ID NO: 162156 - DNA, 20 bp, Artificial Sequence
  chemically synthesized
gcactatctctcattccata

SEQ ID NO: 162157 - DNA, 20 bp, Artificial Sequence
  chemically synthesized
tttagcaaacagtttctgta

SEQ ID NO: 162158 - DNA, 20 bp, Artificial Sequence
  chemically synthesized
ttgctacactttttagcaaa

SEQ ID NO: 162159 - DNA, 20 bp, Artificial Sequence
  chemically synthesized
tacagaaactgtttgctaaa

SEQ ID NO: 162160 - DNA, 20 bp, Artificial Sequence
  chemically synthesized
aaactgtttgctaaaaagtg

SEQ ID NO: 162161 - DNA, 20 bp, Artificial Sequence
  chemically synthesized
ttgtttcttgctacactttt

SEQ ID NO: 162162 - DNA, 20 bp, Artificial Sequence
  chemically synthesized
tgtttgctaaaaagtgtagc

SEQ ID NO: 162163 - DNA, 20 bp, Artificial Sequence
  chemically synthesized
gcaagaaacaaaatatgaaa

SEQ ID NO: 162164 - DNA, 20 bp, Artificial Sequence
  chemically synthesized
aaatggaatcaatattgtgt

SEQ ID NO: 162165 - DNA, 20 bp, Artificial Sequence
  chemically synthesized
atggaatcaatattgtgtta

SEQ ID NO: 162166 - DNA, 20 bp, Artificial Sequence
  chemically synthesized
caatctggactgcagaaatc

SEQ ID NO: 162167 - DNA, 20 bp, Artificial Sequence
  chemically synthesized
gtgttagagcctgatttctg

SEQ ID NO: 162168 - DNA, 20 bp, Artificial Sequence
  chemically synthesized
acaatctggactgcagaaat

SEQ ID NO: 162169 - DNA, 20 bp, Artificial Sequence
  chemically synthesized
agagcctgatttctgcagtc

SEQ ID NO: 162170 - DNA, 20 bp, Artificial Sequence
  chemically synthesized
ctgactgacaatctggactg

SEQ ID NO: 162171 - DNA, 20 bp, Artificial Sequence
  chemically synthesized
atttctgcagtccagattgt

SEQ ID NO: 162172 - DNA, 20 bp, Artificial Sequence
  chemically synthesized
tcagagtctgactgacaatc

SEQ ID NO: 162173 - DNA, 20 bp, Artificial Sequence
  chemically synthesized
ctgcagtccagattgtcagt

SEQ ID NO: 162174 - DNA, 20 bp, Artificial Sequence
  chemically synthesized
ccatcagccttcatttgtca

SEQ ID NO: 162175 - DNA, 20 bp, Artificial Sequence
  chemically synthesized
cagtcagactctgacaaatg

SEQ ID NO: 162176 - DNA, 20 bp, Artificial Sequence
  chemically synthesized
atccatcagccttcatttgt

SEQ ID NO: 162177 - DNA, 20 bp, Artificial Sequence
  chemically synthesized
agtcagactctgacaaatga

SEQ ID NO: 162178 - DNA, 20 bp, Artificial Sequence
  chemically synthesized
ctctgacaaatgaaggctga

SEQ ID NO: 162179 - DNA, 20 bp, Artificial Sequence
  chemically synthesized
gacaaatgaaggctgatgga

SEQ ID NO: 162180 - DNA, 20 bp, Artificial Sequence
  chemically synthesized
tgttgtgtttttccatccat

SEQ ID NO: 162181 - DNA, 20 bp, Artificial Sequence
  chemically synthesized
tggaaaaacacaacattgtt

SEQ ID NO: 162182 - DNA, 20 bp, Artificial Sequence
  chemically synthesized
aaacacaacattgttcagtt

SEQ ID NO: 162183 - DNA, 20 bp, Artificial Sequence
  chemically synthesized
ccaacatgagaggaaagaca

SEQ ID NO: 162184 - DNA, 20 bp, Artificial Sequence
  chemically synthesized
agtcacccaacatgagagga

SEQ ID NO: 162185 - DNA, 20 bp, Artificial Sequence
  chemically synthesized
ctttgtctttcctctcatgt

SEQ ID NO: 162186 - DNA, 20 bp, Artificial Sequence
  chemically synthesized
gaacagtcacccaacatgag

SEQ ID NO: 162187 - DNA, 20 bp, Artificial Sequence
  chemically synthesized
tttgtctttcctctcatgtt

SEQ ID NO: 162188 - DNA, 20 bp, Artificial Sequence
  chemically synthesized
agaacagtcacccaacatga

SEQ ID NO: 162189 - DNA, 20 bp, Artificial Sequence
  chemically synthesized
aaagaacagtcacccaacat

SEQ ID NO: 162190 - DNA, 20 bp, Artificial Sequence
  chemically synthesized
attgtagttaagtaaaagaa

SEQ ID NO: 162191 - DNA, 20 bp, Artificial Sequence
  chemically synthesized
acctaattgtagttaagtaa

SEQ ID NO: 162192 - DNA, 20 bp, Artificial Sequence
  chemically synthesized
tagcaaacctaattgtagtt

SEQ ID NO: 162193 - DNA, 20 bp, Artificial Sequence
  chemically synthesized
ttcttttacttaactacaat

SEQ ID NO: 162194 - DNA, 20 bp, Artificial Sequence
  chemically synthesized
tcttttacttaactacaatt

SEQ ID NO: 162195 - DNA, 20 bp, Artificial Sequence
  chemically synthesized
tggtctagcaaacctaattg

SEQ ID NO: 162196 - DNA, 20 bp, Artificial Sequence
  chemically synthesized
ttaactacaattaggtttgc

SEQ ID NO: 162197 - DNA, 20 bp, Artificial Sequence
  chemically synthesized
agagctgtgttgcagtggtc

SEQ ID NO: 162198 - DNA, 20 bp, Artificial Sequence
  chemically synthesized
gaaagagagctgtgttgcag

SEQ ID NO: 162199 - DNA, 20 bp, Artificial Sequence
  chemically synthesized
tttgctagaccactgcaaca

SEQ ID NO: 162200 - DNA, 20 bp, Artificial Sequence
  chemically synthesized
agtgaaagagagctgtgttg

SEQ ID NO: 162201 - DNA, 20 bp, Artificial Sequence
  chemically synthesized
catgcagttatagtgaaaga

SEQ ID NO: 162202 - DNA, 20 bp, Artificial Sequence
  chemically synthesized
agcatgcagttatagtgaaa

SEQ ID NO: 162203 - DNA, 20 bp, Artificial Sequence
  chemically synthesized
acagcatgcagttatagtga

SEQ ID NO: 162204 - DNA, 20 bp, Artificial Sequence
  chemically synthesized
tacttgacagcatgcagtta

SEQ ID NO: 162205 - DNA, 20 bp, Artificial Sequence
  chemically synthesized
ggcacgtacttgacagcatg

SEQ ID NO: 162206 - DNA, 20 bp, Artificial Sequence
  chemically synthesized
cactataactgcatgctgtc

SEQ ID NO: 162207 - DNA, 20 bp, Artificial Sequence
  chemically synthesized
tcaggttggcacgtacttga

SEQ ID NO: 162208 - DNA, 20 bp, Artificial Sequence
  chemically synthesized
tcattctttgtcaatcaggt

SEQ ID NO: 162209 - DNA, 20 bp, Artificial Sequence
  chemically synthesized
cctgtcattctttgtcaatc

SEQ ID NO: 162210 - DNA, 20 bp, Artificial Sequence
  chemically synthesized
acgtgccaacctgattgaca

SEQ ID NO: 162211 - DNA, 20 bp, Artificial Sequence
  chemically synthesized
acctgtcattctttgtcaat

SEQ ID NO: 162212 - DNA, 20 bp, Artificial Sequence
  chemically synthesized
acctgattgacaaagaatga

SEQ ID NO: 162213 - DNA, 20 bp, Artificial Sequence
  chemically synthesized
cctgattgacaaagaatgac

SEQ ID NO: 162214 - DNA, 20 bp, Artificial Sequence
  chemically synthesized
attagttcaaaatgggaaga

SEQ ID NO: 162215 - DNA, 20 bp, Artificial Sequence
  chemically synthesized
tgattagttcaaaatgggaa

SEQ ID NO: 162216 - DNA, 20 bp, Artificial Sequence
  chemically synthesized
cttgattagttcaaaatggg

SEQ ID NO: 162217 - DNA, 20 bp, Artificial Sequence
  chemically synthesized
gcccttgattagttcaaaat

SEQ ID NO: 162218 - DNA, 20 bp, Artificial Sequence
  chemically synthesized
tgcccttgattagttcaaaa

SEQ ID NO: 162219 - DNA, 20 bp, Artificial Sequence
  chemically synthesized
cttcccattttgaactaatc

SEQ ID NO: 162220 - DNA, 20 bp, Artificial Sequence
  chemically synthesized
ttcccattttgaactaatca

SEQ ID NO: 162221 - DNA, 20 bp, Artificial Sequence
  chemically synthesized
tcccattttgaactaatcaa

SEQ ID NO: 162222 - DNA, 20 bp, Artificial Sequence
  chemically synthesized
tttggtgagctgcccttgat

SEQ ID NO: 162223 - DNA, 20 bp, Artificial Sequence
  chemically synthesized
cattttgaactaatcaaggg

SEQ ID NO: 162224 - DNA, 20 bp, Artificial Sequence
  chemically synthesized
taatcaagggcagctcacca

SEQ ID NO: 162225 - DNA, 20 bp, Artificial Sequence
  chemically synthesized
aatcaagggcagctcaccaa

SEQ ID NO: 162226 - DNA, 20 bp, Artificial Sequence
  chemically synthesized
atcaagggcagctcaccaaa

SEQ ID NO: 162227 - DNA, 20 bp, Artificial Sequence
  chemically synthesized
tttttaagtctccctttggt

SEQ ID NO: 162228 - DNA, 20 bp, Artificial Sequence
  chemically synthesized
caagggcagctcaccaaagg

SEQ ID NO: 162229 - DNA, 20 bp, Artificial Sequence
  chemically synthesized
tttttttttaagtctccctt

SEQ ID NO: 162230 - DNA, 20 bp, Artificial Sequence
  chemically synthesized
tctctaagtttttttttttt

SEQ ID NO: 162231 - DNA, 20 bp, Artificial Sequence
  chemically synthesized
agacttaaaaaaaaaaaact

SEQ ID NO: 162232 - DNA, 20 bp, Artificial Sequence
  chemically synthesized
acttaaaaaaaaaaaactta

SEQ ID NO: 162233 - DNA, 20 bp, Artificial Sequence
  chemically synthesized
tttgaaatccataaatctct

SEQ ID NO: 162234 - DNA, 20 bp, Artificial Sequence
  chemically synthesized
aaaaaaaacttagagattta

SEQ ID NO: 162235 - DNA, 20 bp, Artificial Sequence
  chemically synthesized
ttatgctttgtatatttgga

SEQ ID NO: 162236 - DNA, 20 bp, Artificial Sequence
  chemically synthesized
tgcattatgctttgtatatt

SEQ ID NO: 162237 - DNA, 20 bp, Artificial Sequence
  chemically synthesized
ataatctgtccaaatataca

SEQ ID NO: 162238 - DNA, 20 bp, Artificial Sequence
  chemically synthesized
caaatatacaaagcataatg

SEQ ID NO: 162239 - DNA, 20 bp, Artificial Sequence
  chemically synthesized
tgcagcattgatttttaaac

SEQ ID NO: 162240 - DNA, 20 bp, Artificial Sequence
  chemically synthesized
gcattgatttttaaactgga

SEQ ID NO: 162241 - DNA, 20 bp, Artificial Sequence
  chemically synthesized
cacagtttcacaacactttc

SEQ ID NO: 162242 - DNA, 20 bp, Artificial Sequence
  chemically synthesized
gaaagtgttgtgaaactgtg

SEQ ID NO: 162243 - DNA, 20 bp, Artificial Sequence
  chemically synthesized
cttagtagattatatcttca

SEQ ID NO: 162244 - DNA, 20 bp, Artificial Sequence
  chemically synthesized
ctgtgaagatataatctact

SEQ ID NO: 162245 - DNA, 20 bp, Artificial Sequence
  chemically synthesized
atttcaagtatgcagcttag

SEQ ID NO: 162246 - DNA, 20 bp, Artificial Sequence
  chemically synthesized
aacatttcaagtatgcagct

SEQ ID NO: 162247 - DNA, 20 bp, Artificial Sequence
  chemically synthesized
ccttgaacatttcaagtatg

SEQ ID NO: 162248 - DNA, 20 bp, Artificial Sequence
  chemically synthesized
tcactggccttgaacatttc

SEQ ID NO: 162249 - DNA, 20 bp, Artificial Sequence
  chemically synthesized
gctgcatacttgaaatgttc

SEQ ID NO: 162250 - DNA, 20 bp, Artificial Sequence
  chemically synthesized
ctgcatacttgaaatgttca

SEQ ID NO: 162251 - DNA, 20 bp, Artificial Sequence
  chemically synthesized
atacttgaaatgttcaaggc

SEQ ID NO: 162252 - DNA, 20 bp, Artificial Sequence
  chemically synthesized
gaaatgttcaaggccagtga

SEQ ID NO: 162253 - DNA, 20 bp, Artificial Sequence
  chemically synthesized
aatgttcaaggccagtgaaa

SEQ ID NO: 162254 - DNA, 20 bp, Artificial Sequence
  chemically synthesized
acctatgcccactctttcac

SEQ ID NO: 162255 - DNA, 20 bp, Artificial Sequence
  chemically synthesized
gttcaaggccagtgaaagag

SEQ ID NO: 162256 - DNA, 20 bp, Artificial Sequence
  chemically synthesized
ttcaaggccagtgaaagagt

SEQ ID NO: 162257 - DNA, 20 bp, Artificial Sequence
  chemically synthesized
ggccagtgaaagagtgggca

SEQ ID NO: 162258 - DNA, 20 bp, Artificial Sequence
  chemically synthesized
gccagtgaaagagtgggcat

SEQ ID NO: 162259 - DNA, 20 bp, Artificial Sequence
  chemically synthesized
tgggcataggtgtgaccatc

SEQ ID NO: 162260 - DNA, 20 bp, Artificial Sequence
  chemically synthesized
ggcttctggatgttacttga

SEQ ID NO: 162261 - DNA, 20 bp, Artificial Sequence
  chemically synthesized
tgtgaccatcaagtaacatc

SEQ ID NO: 162262 - DNA, 20 bp, Artificial Sequence
  chemically synthesized
gaccatcaagtaacatccag

SEQ ID NO: 162263 - DNA, 20 bp, Artificial Sequence
  chemically synthesized
agagcttccatagaggcttc

SEQ ID NO: 162264 - DNA, 20 bp, Artificial Sequence
  chemically synthesized
gtaacatccagaagcctcta

SEQ ID NO: 162265 - DNA, 20 bp, Artificial Sequence
  chemically synthesized
acatccagaagcctctatgg

SEQ ID NO: 162266 - DNA, 20 bp, Artificial Sequence
  chemically synthesized
aaggtggagagcttccatag

SEQ ID NO: 162267 - DNA, 20 bp, Artificial Sequence
  chemically synthesized
taaggtggagagcttccata

SEQ ID NO: 162268 - DNA, 20 bp, Artificial Sequence
  chemically synthesized
tttaaggtggagagcttcca

SEQ ID NO: 162269 - DNA, 20 bp, Artificial Sequence
  chemically synthesized
aacccccactttaaggtgga

SEQ ID NO: 162270 - DNA, 20 bp, Artificial Sequence
  chemically synthesized
tatggaagctctccacctta

SEQ ID NO: 162271 - DNA, 20 bp, Artificial Sequence
  chemically synthesized
gaaacccccactttaaggtg

SEQ ID NO: 162272 - DNA, 20 bp, Artificial Sequence
  chemically synthesized
ttgaaacccccactttaagg

SEQ ID NO: 162273 - DNA, 20 bp, Artificial Sequence
  chemically synthesized
ggaagctctccaccttaaag

SEQ ID NO: 162274 - DNA, 20 bp, Artificial Sequence
  chemically synthesized
gaagctctccaccttaaagt

SEQ ID NO: 162275 - DNA, 20 bp, Artificial Sequence
  chemically synthesized
aagctctccaccttaaagtg

SEQ ID NO: 162276 - DNA, 20 bp, Artificial Sequence
  chemically synthesized
actttgaaacccccacttta

SEQ ID NO: 162277 - DNA, 20 bp, Artificial Sequence
  chemically synthesized
agctctccaccttaaagtgg

SEQ ID NO: 162278 - DNA, 20 bp, Artificial Sequence
  chemically synthesized
gactttgaaacccccacttt

SEQ ID NO: 162279 - DNA, 20 bp, Artificial Sequence
  chemically synthesized
accttaaagtgggggtttca

SEQ ID NO: 162280 - DNA, 20 bp, Artificial Sequence
  chemically synthesized
tgggggtttcaaagtctttt

SEQ ID NO: 162281 - DNA, 20 bp, Artificial Sequence
  chemically synthesized
gggtttcaaagtctttttgg

SEQ ID NO: 162282 - DNA, 20 bp, Artificial Sequence
  chemically synthesized
gccaaaagaattctgccaaa

SEQ ID NO: 162283 - DNA, 20 bp, Artificial Sequence
  chemically synthesized
tctttttggcagaattcttt

SEQ ID NO: 162284 - DNA, 20 bp, Artificial Sequence
  chemically synthesized
ggtaatatttcatttgccaa

SEQ ID NO: 162285 - DNA, 20 bp, Artificial Sequence
  chemically synthesized
gtgattttttggaagagttt

SEQ ID NO: 162286 - DNA, 20 bp, Artificial Sequence
  chemically synthesized
actcaagtgattttttggaa

SEQ ID NO: 162287 - DNA, 20 bp, Artificial Sequence
  chemically synthesized
tgactcaagtgattttttgg

SEQ ID NO: 162288 - DNA, 20 bp, Artificial Sequence
  chemically synthesized
gaatgactcaagtgattttt

SEQ ID NO: 162289 - DNA, 20 bp, Artificial Sequence
  chemically synthesized
actcttccaaaaaatcactt

SEQ ID NO: 162290 - DNA, 20 bp, Artificial Sequence
  chemically synthesized
caatatttatggaatgactc

SEQ ID NO: 162291 - DNA, 20 bp, Artificial Sequence
  chemically synthesized
aagtaatctgtcaatattta

SEQ ID NO: 162292 - DNA, 20 bp, Artificial Sequence
  chemically synthesized
agtcattccataaatattga

SEQ ID NO: 162293 - DNA, 20 bp, Artificial Sequence
  chemically synthesized
aacaatgtttagcagacaat

SEQ ID NO: 162294 - DNA, 20 bp, Artificial Sequence
  chemically synthesized
gtacctcaaacaatgtttag

SEQ ID NO: 162295 - DNA, 20 bp, Artificial Sequence
  chemically synthesized
ctagtacctcaaacaatgtt

SEQ ID NO: 162296 - DNA, 20 bp, Artificial Sequence
  chemically synthesized
ttgtctgctaaacattgttt

SEQ ID NO: 162297 - DNA, 20 bp, Artificial Sequence
  chemically synthesized
tgtctgctaaacattgtttg

SEQ ID NO: 162298 - DNA, 20 bp, Artificial Sequence
  chemically synthesized
ctaaacattgtttgaggtac

SEQ ID NO: 162299 - DNA, 20 bp, Artificial Sequence
  chemically synthesized
tttattcgctgttacatatc

SEQ ID NO: 162300 - DNA, 20 bp, Artificial Sequence
  chemically synthesized
ttgaggtactagatatgtaa

SEQ ID NO: 162301 - DNA, 20 bp, Artificial Sequence
  chemically synthesized
atatgtaacagcgaataaaa

SEQ ID NO: 162302 - DNA, 20 bp, Artificial Sequence
  chemically synthesized
aagttttatgaggacacaaa

SEQ ID NO: 162303 - DNA, 20 bp, Artificial Sequence
  chemically synthesized
attagaatgtaagttttatg

SEQ ID NO: 162304 - DNA, 20 bp, Artificial Sequence
  chemically synthesized
cattagaatgtaagttttat

SEQ ID NO: 162305 - DNA, 20 bp, Artificial Sequence
  chemically synthesized
cattatcaccattagaatgt

SEQ ID NO: 162306 - DNA, 20 bp, Artificial Sequence
  chemically synthesized
tcataaaacttacattctaa

SEQ ID NO: 162307 - DNA, 20 bp, Artificial Sequence
  chemically synthesized
ttactacacattatcaccat

SEQ ID NO: 162308 - DNA, 20 bp, Artificial Sequence
  chemically synthesized
attctaatggtgataatgtg

SEQ ID NO: 162309 - DNA, 20 bp, Artificial Sequence
  chemically synthesized
atggtgataatgtgtagtaa

SEQ ID NO: 162310 - DNA, 20 bp, Artificial Sequence
  chemically synthesized
ggtgataatgtgtagtaaaa

SEQ ID NO: 162311 - DNA, 20 bp, Artificial Sequence
  chemically synthesized
tgtgtagtaaaagagaaatt

SEQ ID NO: 162312 - DNA, 20 bp, Artificial Sequence
  chemically synthesized
gtgtagtaaaagagaaatta

SEQ ID NO: 162313 - DNA, 20 bp, Artificial Sequence
  chemically synthesized
aaagagaaattaaggtgctt

SEQ ID NO: 162314 - DNA, 20 bp, Artificial Sequence
  chemically synthesized
agagaaattaaggtgctttg

SEQ ID NO: 162315 - DNA, 20 bp, Artificial Sequence
  chemically synthesized
agaaattaaggtgctttgga

SEQ ID NO: 162316 - DNA, 20 bp, Artificial Sequence
  chemically synthesized
ttagcacttttcactctcca

SEQ ID NO: 162317 - DNA, 20 bp, Artificial Sequence
  chemically synthesized
aaggtgctttggagagtgaa

SEQ ID NO: 162318 - DNA, 20 bp, Artificial Sequence
  chemically synthesized
ttggagagtgaaaagtgcta

SEQ ID NO: 162319 - DNA, 20 bp, Artificial Sequence
  chemically synthesized
gtgctttacattttgttctt

SEQ ID NO: 162320 - DNA, 20 bp, Artificial Sequence
  chemically synthesized
gtgctaaagaacaaaatgta

SEQ ID NO: 162321 - DNA, 20 bp, Artificial Sequence
  chemically synthesized
aagaacaaaatgtaaagcac

SEQ ID NO: 162322 - DNA, 20 bp, Artificial Sequence
  chemically synthesized
acaaaatgtaaagcactgga

SEQ ID NO: 162323 - DNA, 20 bp, Artificial Sequence
  chemically synthesized
caaaatgtaaagcactggat

SEQ ID NO: 162324 - DNA, 20 bp, Artificial Sequence
  chemically synthesized
ctaagtctcttattcctatc

SEQ ID NO: 162325 - DNA, 20 bp, Artificial Sequence
  chemically synthesized
gtaaagcactggataggaat

SEQ ID NO: 162326 - DNA, 20 bp, Artificial Sequence
  chemically synthesized
aaagcactggataggaataa

SEQ ID NO: 162327 - DNA, 20 bp, Artificial Sequence
  chemically synthesized
ctggataggaataagagact

SEQ ID NO: 162328 - DNA, 20 bp, Artificial Sequence
  chemically synthesized
tggataggaataagagactt

SEQ ID NO: 162329 - DNA, 20 bp, Artificial Sequence
  chemically synthesized
aggaataagagacttaggta

SEQ ID NO: 162330 - DNA, 20 bp, Artificial Sequence
  chemically synthesized
ggaataagagacttaggtat

SEQ ID NO: 162331 - DNA, 20 bp, Artificial Sequence
  chemically synthesized
gaataagagacttaggtatg

SEQ ID NO: 162332 - DNA, 20 bp, Artificial Sequence
  chemically synthesized
cctccctttgccccatacct

SEQ ID NO: 162333 - DNA, 20 bp, Artificial Sequence
  chemically synthesized
agagacttaggtatggggca

SEQ ID NO: 162334 - DNA, 20 bp, Artificial Sequence
  chemically synthesized
gagacttaggtatggggcaa

SEQ ID NO: 162335 - DNA, 20 bp, Artificial Sequence
  chemically synthesized
agacttaggtatggggcaaa

SEQ ID NO: 162336 - DNA, 20 bp, Artificial Sequence
  chemically synthesized
acttaggtatggggcaaagg

SEQ ID NO: 162337 - DNA, 20 bp, Artificial Sequence
  chemically synthesized
cttaggtatggggcaaaggg

SEQ ID NO: 162338 - DNA, 20 bp, Artificial Sequence
  chemically synthesized
aggtatggggcaaagggagg

SEQ ID NO: 162339 - DNA, 20 bp, Artificial Sequence
  chemically synthesized
gggcaaagggaggtggcatg

SEQ ID NO: 162340 - DNA, 20 bp, Artificial Sequence
  chemically synthesized
gcaaagggaggtggcatgtg

SEQ ID NO: 162341 - DNA, 20 bp, Artificial Sequence
  chemically synthesized
aaagggaggtggcatgtgga

SEQ ID NO: 162342 - DNA, 20 bp, Artificial Sequence
  chemically synthesized
gaggtggcatgtggagagtt

SEQ ID NO: 162343 - DNA, 20 bp, Artificial Sequence
  chemically synthesized
tggcatgtggagagtttaga

SEQ ID NO: 162344 - DNA, 20 bp, Artificial Sequence
  chemically synthesized
gagagtttagaaagtgcctg

SEQ ID NO: 162345 - DNA, 20 bp, Artificial Sequence
  chemically synthesized
agagtttagaaagtgcctgc

SEQ ID NO: 162346 - DNA, 20 bp, Artificial Sequence
  chemically synthesized
gagtttagaaagtgcctgca

SEQ ID NO: 162347 - DNA, 20 bp, Artificial Sequence
  chemically synthesized
ttagaaagtgcctgcaggga

SEQ ID NO: 162348 - DNA, 20 bp, Artificial Sequence
  chemically synthesized
ctcagtgaggctttccctgc

SEQ ID NO: 162349 - DNA, 20 bp, Artificial Sequence
  chemically synthesized
actcagtgaggctttccctg

SEQ ID NO: 162350 - DNA, 20 bp, Artificial Sequence
  chemically synthesized
cctgcagggaaagcctcact

SEQ ID NO: 162351 - DNA, 20 bp, Artificial Sequence
  chemically synthesized
gcagggaaagcctcactgag

SEQ ID NO: 162352 - DNA, 20 bp, Artificial Sequence
  chemically synthesized
taaataccacctactcagtg

SEQ ID NO: 162353 - DNA, 20 bp, Artificial Sequence
  chemically synthesized
cagggaaagcctcactgagt

SEQ ID NO: 162354 - DNA, 20 bp, Artificial Sequence
  chemically synthesized
ttaaataccacctactcagt

SEQ ID NO: 162355 - DNA, 20 bp, Artificial Sequence
  chemically synthesized
ggaaagcctcactgagtagg

SEQ ID NO: 162356 - DNA, 20 bp, Artificial Sequence
  chemically synthesized
ttatttaaataccacctact

SEQ ID NO: 162357 - DNA, 20 bp, Artificial Sequence
  chemically synthesized
gagtaggtggtatttaaata

SEQ ID NO: 162358 - DNA, 20 bp, Artificial Sequence
  chemically synthesized
ggtatttaaataaagatctg

SEQ ID NO: 162359 - DNA, 20 bp, Artificial Sequence
  chemically synthesized
gtatttaaataaagatctga

SEQ ID NO: 162360 - DNA, 20 bp, Artificial Sequence
  chemically synthesized
tttaaataaagatctgaagg

SEQ ID NO: 162361 - DNA, 20 bp, Artificial Sequence
  chemically synthesized
aatcgttccctcacttcctt

SEQ ID NO: 162362 - DNA, 20 bp, Artificial Sequence
  chemically synthesized
aataaagatctgaaggaagt

SEQ ID NO: 162363 - DNA, 20 bp, Artificial Sequence
  chemically synthesized
ataaagatctgaaggaagtg

SEQ ID NO: 162364 - DNA, 20 bp, Artificial Sequence
  chemically synthesized
taaagatctgaaggaagtga

SEQ ID NO: 162365 - DNA, 20 bp, Artificial Sequence
  chemically synthesized
aggaagtgagggaacgattc

SEQ ID NO: 162366 - DNA, 20 bp, Artificial Sequence
  chemically synthesized
aagtgagggaacgattcaag

SEQ ID NO: 162367 - DNA, 20 bp, Artificial Sequence
  chemically synthesized
aacgattcaagtagctatct

SEQ ID NO: 162368 - DNA, 20 bp, Artificial Sequence
  chemically synthesized
acgattcaagtagctatctc

SEQ ID NO: 162369 - DNA, 20 bp, Artificial Sequence
  chemically synthesized
cagattgttctttcctgaga

SEQ ID NO: 162370 - DNA, 20 bp, Artificial Sequence
  chemically synthesized
ttcaagtagctatctcagga

SEQ ID NO: 162371 - DNA, 20 bp, Artificial Sequence
  chemically synthesized
tgcacagattgttctttcct

SEQ ID NO: 162372 - DNA, 20 bp, Artificial Sequence
  chemically synthesized
tcaggaaagaacaatctgtg

SEQ ID NO: 162373 - DNA, 20 bp, Artificial Sequence
  chemically synthesized
aggaaagaacaatctgtgca

SEQ ID NO: 162374 - DNA, 20 bp, Artificial Sequence
  chemically synthesized
ttgcacttgctgtctctgca

SEQ ID NO: 162375 - DNA, 20 bp, Artificial Sequence
  chemically synthesized
aagaacaatctgtgcagaga

SEQ ID NO: 162376 - DNA, 20 bp, Artificial Sequence
  chemically synthesized
acaatctgtgcagagacagc

SEQ ID NO: 162377 - DNA, 20 bp, Artificial Sequence
  chemically synthesized
gtgcagagacagcaagtgca

SEQ ID NO: 162378 - DNA, 20 bp, Artificial Sequence
  chemically synthesized
tgcagagacagcaagtgcaa

SEQ ID NO: 162379 - DNA, 20 bp, Artificial Sequence
  chemically synthesized
gacagcaagtgcaaaggccc

SEQ ID NO: 162380 - DNA, 20 bp, Artificial Sequence
  chemically synthesized
acagcaagtgcaaaggccct

SEQ ID NO: 162381 - DNA, 20 bp, Artificial Sequence
  chemically synthesized
cagcaagtgcaaaggccctg

SEQ ID NO: 162382 - DNA, 20 bp, Artificial Sequence
  chemically synthesized
caagtgcaaaggccctgggg

SEQ ID NO: 162383 - DNA, 20 bp, Artificial Sequence
  chemically synthesized
aagtgcaaaggccctggggc

SEQ ID NO: 162384 - DNA, 20 bp, Artificial Sequence
  chemically synthesized
acacatacactcctgcccca

SEQ ID NO: 162385 - DNA, 20 bp, Artificial Sequence
  chemically synthesized
gtgcaaaggccctggggcag

SEQ ID NO: 162386 - DNA, 20 bp, Artificial Sequence
  chemically synthesized
tacacatacactcctgcccc

SEQ ID NO: 162387 - DNA, 20 bp, Artificial Sequence
  chemically synthesized
atacacatacactcctgccc

SEQ ID NO: 162388 - DNA, 20 bp, Artificial Sequence
  chemically synthesized
gtatgttcaattaaaaaaaa

SEQ ID NO: 162389 - DNA, 20 bp, Artificial Sequence
  chemically synthesized
tatgttcaattaaaaaaaaa

SEQ ID NO: 162390 - DNA, 20 bp, Artificial Sequence
  chemically synthesized
aattaaaaaaaaaaggacac

SEQ ID NO: 162391 - DNA, 20 bp, Artificial Sequence
  chemically synthesized
attaaaaaaaaaaggacacc

SEQ ID NO: 162392 - DNA, 20 bp, Artificial Sequence
  chemically synthesized
ttaaaaaaaaaaggacacca

SEQ ID NO: 162393 - DNA, 20 bp, Artificial Sequence
  chemically synthesized
aaaaaaaaggacaccagggt

SEQ ID NO: 162394 - DNA, 20 bp, Artificial Sequence
  chemically synthesized
aaaaaggacaccagggtgag

SEQ ID NO: 162395 - DNA, 20 bp, Artificial Sequence
  chemically synthesized
tcactagattccactcaccc

SEQ ID NO: 162396 - DNA, 20 bp, Artificial Sequence
  chemically synthesized
acaccagggtgagtggaatc

SEQ ID NO: 162397 - DNA, 20 bp, Artificial Sequence
  chemically synthesized
cagggtgagtggaatctagt

SEQ ID NO: 162398 - DNA, 20 bp, Artificial Sequence
  chemically synthesized
gtgagtggaatctagtgagc

SEQ ID NO: 162399 - DNA, 20 bp, Artificial Sequence
  chemically synthesized
tgagtggaatctagtgagca

SEQ ID NO: 162400 - DNA, 20 bp, Artificial Sequence
  chemically synthesized
actactctccccttgctcac

SEQ ID NO: 162401 - DNA, 20 bp, Artificial Sequence
  chemically synthesized
gagtggaatctagtgagcaa

SEQ ID NO: 162402 - DNA, 20 bp, Artificial Sequence
  chemically synthesized
agtggaatctagtgagcaag

SEQ ID NO: 162403 - DNA, 20 bp, Artificial Sequence
  chemically synthesized
tggaatctagtgagcaaggg

SEQ ID NO: 162404 - DNA, 20 bp, Artificial Sequence
  chemically synthesized
gaatctagtgagcaagggga

SEQ ID NO: 162405 - DNA, 20 bp, Artificial Sequence
  chemically synthesized
tctagtgagcaaggggagag

SEQ ID NO: 162406 - DNA, 20 bp, Artificial Sequence
  chemically synthesized
agtgagcaaggggagagtag

SEQ ID NO: 162407 - DNA, 20 bp, Artificial Sequence
  chemically synthesized
gtgagcaaggggagagtagt

SEQ ID NO: 162408 - DNA, 20 bp, Artificial Sequence
  chemically synthesized
ggggagagtagtaggaatga

SEQ ID NO: 162409 - DNA, 20 bp, Artificial Sequence
  chemically synthesized
agtagtaggaatgatagtca

SEQ ID NO: 162410 - DNA, 20 bp, Artificial Sequence
  chemically synthesized
tagtaggaatgatagtcata

SEQ ID NO: 162411 - DNA, 20 bp, Artificial Sequence
  chemically synthesized
aggaatgatagtcatagagt

SEQ ID NO: 162412 - DNA, 20 bp, Artificial Sequence
  chemically synthesized
ggaatgatagtcatagagtt

SEQ ID NO: 162413 - DNA, 20 bp, Artificial Sequence
  chemically synthesized
gaatgatagtcatagagttg

SEQ ID NO: 162414 - DNA, 20 bp, Artificial Sequence
  chemically synthesized
gatagtcatagagttgggga

SEQ ID NO: 162415 - DNA, 20 bp, Artificial Sequence
  chemically synthesized
tagtcatagagttggggatg

SEQ ID NO: 162416 - DNA, 20 bp, Artificial Sequence
  chemically synthesized
agtcatagagttggggatgg

SEQ ID NO: 162417 - DNA, 20 bp, Artificial Sequence
  chemically synthesized
tcatagagttggggatggag

SEQ ID NO: 162418 - DNA, 20 bp, Artificial Sequence
  chemically synthesized
catagagttggggatggagg

SEQ ID NO: 162419 - DNA, 20 bp, Artificial Sequence
  chemically synthesized
gagttggggatggaggagga

SEQ ID NO: 162420 - DNA, 20 bp, Artificial Sequence
  chemically synthesized
agttggggatggaggaggat

SEQ ID NO: 162421 - DNA, 20 bp, Artificial Sequence
  chemically synthesized
gaggataggtcctgcatctt

SEQ ID NO: 162422 - DNA, 20 bp, Artificial Sequence
  chemically synthesized
caagatccttccaaagatgc

SEQ ID NO: 162423 - DNA, 20 bp, Artificial Sequence
  chemically synthesized
ccaagatccttccaaagatg

SEQ ID NO: 162424 - DNA, 20 bp, Artificial Sequence
  chemically synthesized
gataggtcctgcatctttgg

SEQ ID NO: 162425 - DNA, 20 bp, Artificial Sequence
  chemically synthesized
ataggtcctgcatctttgga

SEQ ID NO: 162426 - DNA, 20 bp, Artificial Sequence
  chemically synthesized
taacagccaagatccttcca

SEQ ID NO: 162427 - DNA, 20 bp, Artificial Sequence
  chemically synthesized
ctgcatctttggaaggatct

SEQ ID NO: 162428 - DNA, 20 bp, Artificial Sequence
  chemically synthesized
tctcactcaggataacagcc

SEQ ID NO: 162429 - DNA, 20 bp, Artificial Sequence
  chemically synthesized
aggatcttggctgttatcct

SEQ ID NO: 162430 - DNA, 20 bp, Artificial Sequence
  chemically synthesized
cctaatctcactcaggataa

SEQ ID NO: 162431 - DNA, 20 bp, Artificial Sequence
  chemically synthesized
tcttggctgttatcctgagt

SEQ ID NO: 162432 - DNA, 20 bp, Artificial Sequence
  chemically synthesized
tatgcttcctaatctcactc

SEQ ID NO: 162433 - DNA, 20 bp, Artificial Sequence
  chemically synthesized
ctatgcttcctaatctcact

SEQ ID NO: 162434 - DNA, 20 bp, Artificial Sequence
  chemically synthesized
gctgttatcctgagtgagat

SEQ ID NO: 162435 - DNA, 20 bp, Artificial Sequence
  chemically synthesized
ctgttatcctgagtgagatt

SEQ ID NO: 162436 - DNA, 20 bp, Artificial Sequence
  chemically synthesized
ttatcctgagtgagattagg

SEQ ID NO: 162437 - DNA, 20 bp, Artificial Sequence
  chemically synthesized
ctgagtgagattaggaagca

SEQ ID NO: 162438 - DNA, 20 bp, Artificial Sequence
  chemically synthesized
tgagtgagattaggaagcat

SEQ ID NO: 162439 - DNA, 20 bp, Artificial Sequence
  chemically synthesized
agtgagattaggaagcatag

SEQ ID NO: 162440 - DNA, 20 bp, Artificial Sequence
  chemically synthesized
tgagattaggaagcatagga

SEQ ID NO: 162441 - DNA, 20 bp, Artificial Sequence
  chemically synthesized
aggaagcataggagagtttt

SEQ ID NO: 162442 - DNA, 20 bp, Artificial Sequence
  chemically synthesized
aagcataggagagttttcag

SEQ ID NO: 162443 - DNA, 20 bp, Artificial Sequence
  chemically synthesized
gcataggagagttttcagca

SEQ ID NO: 162444 - DNA, 20 bp, Artificial Sequence
  chemically synthesized
cataggagagttttcagcag

SEQ ID NO: 162445 - DNA, 20 bp, Artificial Sequence
  chemically synthesized
taggagagttttcagcagag

SEQ ID NO: 162446 - DNA, 20 bp, Artificial Sequence
  chemically synthesized
tgatctgtttaaaaataagt

SEQ ID NO: 162447 - DNA, 20 bp, Artificial Sequence
  chemically synthesized
agaatgatctgtttaaaaat

SEQ ID NO: 162448 - DNA, 20 bp, Artificial Sequence
  chemically synthesized
tgatctgacttatttttaaa

SEQ ID NO: 162449 - DNA, 20 bp, Artificial Sequence
  chemically synthesized
tatttttaaacagatcattc

SEQ ID NO: 162450 - DNA, 20 bp, Artificial Sequence
  chemically synthesized
tctaatcttaatacagcagc

SEQ ID NO: 162451 - DNA, 20 bp, Artificial Sequence
  chemically synthesized
atcattctggctgctgtatt

SEQ ID NO: 162452 - DNA, 20 bp, Artificial Sequence
  chemically synthesized
aaagtctaatcttaatacag

SEQ ID NO: 162453 - DNA, 20 bp, Artificial Sequence
  chemically synthesized
cttaaagtctaatcttaata

SEQ ID NO: 162454 - DNA, 20 bp, Artificial Sequence
  chemically synthesized
tctggctgctgtattaagat

SEQ ID NO: 162455 - DNA, 20 bp, Artificial Sequence
  chemically synthesized
ctgtattaagattagacttt

SEQ ID NO: 162456 - DNA, 20 bp, Artificial Sequence
  chemically synthesized
atctgttctctgcattctta

SEQ ID NO: 162457 - DNA, 20 bp, Artificial Sequence
  chemically synthesized
aagattagactttaagaatg

SEQ ID NO: 162458 - DNA, 20 bp, Artificial Sequence
  chemically synthesized
gattagactttaagaatgca

SEQ ID NO: 162459 - DNA, 20 bp, Artificial Sequence
  chemically synthesized
gactttaagaatgcagagaa

SEQ ID NO: 162460 - DNA, 20 bp, Artificial Sequence
  chemically synthesized
ttaagaatgcagagaacaga

SEQ ID NO: 162461 - DNA, 20 bp, Artificial Sequence
  chemically synthesized
agaatgcagagaacagatgg

SEQ ID NO: 162462 - DNA, 20 bp, Artificial Sequence
  chemically synthesized
gcagagaacagatggcagtt

SEQ ID NO: 162463 - DNA, 20 bp, Artificial Sequence
  chemically synthesized
gaacagatggcagttaagaa

SEQ ID NO: 162464 - DNA, 20 bp, Artificial Sequence
  chemically synthesized
gcagttaagaacagattctt

SEQ ID NO: 162465 - DNA, 20 bp, Artificial Sequence
  chemically synthesized
cagttaagaacagattctta

SEQ ID NO: 162466 - DNA, 20 bp, Artificial Sequence
  chemically synthesized
agttaagaacagattcttaa

SEQ ID NO: 162467 - DNA, 20 bp, Artificial Sequence
  chemically synthesized
gttaagaacagattcttaag

SEQ ID NO: 162468 - DNA, 20 bp, Artificial Sequence
  chemically synthesized
ttaagaacagattcttaagg

SEQ ID NO: 162469 - DNA, 20 bp, Artificial Sequence
  chemically synthesized
aatgcagattgtaccccctt

SEQ ID NO: 162470 - DNA, 20 bp, Artificial Sequence
  chemically synthesized
ggggtacaatctgcattgtt

SEQ ID NO: 162471 - DNA, 20 bp, Artificial Sequence
  chemically synthesized
gtccttccatccaaacaatg

SEQ ID NO: 162472 - DNA, 20 bp, Artificial Sequence
  chemically synthesized
tacaatctgcattgtttgga

SEQ ID NO: 162473 - DNA, 20 bp, Artificial Sequence
  chemically synthesized
aatctgcattgtttggatgg

SEQ ID NO: 162474 - DNA, 20 bp, Artificial Sequence
  chemically synthesized
atctgcattgtttggatgga

SEQ ID NO: 162475 - DNA, 20 bp, Artificial Sequence
  chemically synthesized
aatggcttcaggttttcaca

SEQ ID NO: 162476 - DNA, 20 bp, Artificial Sequence
  chemically synthesized
aaggactttgtgaaaacctg

SEQ ID NO: 162477 - DNA, 20 bp, Artificial Sequence
  chemically synthesized
ttttccaaaataatggcttc

SEQ ID NO: 162478 - DNA, 20 bp, Artificial Sequence
  chemically synthesized
gttttccaaaataatggctt

SEQ ID NO: 162479 - DNA, 20 bp, Artificial Sequence
  chemically synthesized
aaaacctgaagccattattt

SEQ ID NO: 162480 - DNA, 20 bp, Artificial Sequence
  chemically synthesized
tataaagttttccaaaataa

SEQ ID NO: 162481 - DNA, 20 bp, Artificial Sequence
  chemically synthesized
agttaagaactgtatgtata

SEQ ID NO: 162482 - DNA, 20 bp, Artificial Sequence
  chemically synthesized
tttggaaaactttatacata

SEQ ID NO: 162483 - DNA, 20 bp, Artificial Sequence
  chemically synthesized
tatacatacagttcttaact

SEQ ID NO: 162484 - DNA, 20 bp, Artificial Sequence
  chemically synthesized
atacatacagttcttaacta

SEQ ID NO: 162485 - DNA, 20 bp, Artificial Sequence
  chemically synthesized
tacatacagttcttaactaa

SEQ ID NO: 162486 - DNA, 20 bp, Artificial Sequence
  chemically synthesized
cagagctttggcccttagtt

SEQ ID NO: 162487 - DNA, 20 bp, Artificial Sequence
  chemically synthesized
cagttcttaactaagggcca

SEQ ID NO: 162488 - DNA, 20 bp, Artificial Sequence
  chemically synthesized
cagaccagagctttggccct

SEQ ID NO: 162489 - DNA, 20 bp, Artificial Sequence
  chemically synthesized
ttaactaagggccaaagctc

SEQ ID NO: 162490 - DNA, 20 bp, Artificial Sequence
  chemically synthesized
attaaaccagaccagagctt

SEQ ID NO: 162491 - DNA, 20 bp, Artificial Sequence
  chemically synthesized
taagggccaaagctctggtc

SEQ ID NO: 162492 - DNA, 20 bp, Artificial Sequence
  chemically synthesized
gctgctattaaaccagacca

SEQ ID NO: 162493 - DNA, 20 bp, Artificial Sequence
  chemically synthesized
gtgctgctattaaaccagac

SEQ ID NO: 162494 - DNA, 20 bp, Artificial Sequence
  chemically synthesized
aaagctctggtctggtttaa

SEQ ID NO: 162495 - DNA, 20 bp, Artificial Sequence
  chemically synthesized
gtcctgtgctgctattaaac

SEQ ID NO: 162496 - DNA, 20 bp, Artificial Sequence
  chemically synthesized
gctctggtctggtttaatag

SEQ ID NO: 162497 - DNA, 20 bp, Artificial Sequence
  chemically synthesized
ggtctggtttaatagcagca

SEQ ID NO: 162498 - DNA, 20 bp, Artificial Sequence
  chemically synthesized
gtctggtttaatagcagcac

SEQ ID NO: 162499 - DNA, 20 bp, Artificial Sequence
  chemically synthesized
tagcagcacaggacactgct

SEQ ID NO: 162500 - DNA, 20 bp, Artificial Sequence
  chemically synthesized
cagcacaggacactgcttag

SEQ ID NO: 162501 - DNA, 20 bp, Artificial Sequence
  chemically synthesized
taaatgaatgttcttctaag

SEQ ID NO: 162502 - DNA, 20 bp, Artificial Sequence
  chemically synthesized
gtttaaatgaatgttcttct

SEQ ID NO: 162503 - DNA, 20 bp, Artificial Sequence
  chemically synthesized
agaagaacattcatttaaac

SEQ ID NO: 162504 - DNA, 20 bp, Artificial Sequence
  chemically synthesized
ttcatttaaactggtactcc

SEQ ID NO: 162505 - DNA, 20 bp, Artificial Sequence
  chemically synthesized
gcagcaagacctgggagtac

SEQ ID NO: 162506 - DNA, 20 bp, Artificial Sequence
  chemically synthesized
tcatttaaactggtactccc

SEQ ID NO: 162507 - DNA, 20 bp, Artificial Sequence
  chemically synthesized
aggaaggcagcaagacctgg

SEQ ID NO: 162508 - DNA, 20 bp, Artificial Sequence
  chemically synthesized
ttaggaaggcagcaagacct

SEQ ID NO: 162509 - DNA, 20 bp, Artificial Sequence
  chemically synthesized
cttaggaaggcagcaagacc

SEQ ID NO: 162510 - DNA, 20 bp, Artificial Sequence
  chemically synthesized
taaggacttaggaaggcagc

SEQ ID NO: 162511 - DNA, 20 bp, Artificial Sequence
  chemically synthesized
ccaggtcttgctgccttcct

SEQ ID NO: 162512 - DNA, 20 bp, Artificial Sequence
  chemically synthesized
ccagtaaggacttaggaagg

SEQ ID NO: 162513 - DNA, 20 bp, Artificial Sequence
  chemically synthesized
tcaccagtaaggacttagga

SEQ ID NO: 162514 - DNA, 20 bp, Artificial Sequence
  chemically synthesized
ttcaccagtaaggacttagg

SEQ ID NO: 162515 - DNA, 20 bp, Artificial Sequence
  chemically synthesized
ctcttcaccagtaaggactt

SEQ ID NO: 162516 - DNA, 20 bp, Artificial Sequence
  chemically synthesized
actcttcaccagtaaggact

SEQ ID NO: 162517 - DNA, 20 bp, Artificial Sequence
  chemically synthesized
ctgccttcctaagtccttac

SEQ ID NO: 162518 - DNA, 20 bp, Artificial Sequence
  chemically synthesized
gcccatactcttcaccagta

SEQ ID NO: 162519 - DNA, 20 bp, Artificial Sequence
  chemically synthesized
ttcctaagtccttactggtg

SEQ ID NO: 162520 - DNA, 20 bp, Artificial Sequence
  chemically synthesized
agcccatactcttcaccagt

SEQ ID NO: 162521 - DNA, 20 bp, Artificial Sequence
  chemically synthesized
cctaagtccttactggtgaa

SEQ ID NO: 162522 - DNA, 20 bp, Artificial Sequence
  chemically synthesized
caagagcccatactcttcac

SEQ ID NO: 162523 - DNA, 20 bp, Artificial Sequence
  chemically synthesized
gtccttactggtgaagagta

SEQ ID NO: 162524 - DNA, 20 bp, Artificial Sequence
  chemically synthesized
tccttactggtgaagagtat

SEQ ID NO: 162525 - DNA, 20 bp, Artificial Sequence
  chemically synthesized
ggtgaagagtatgggctctt

SEQ ID NO: 162526 - DNA, 20 bp, Artificial Sequence
  chemically synthesized
agagtatgggctcttgagtc

SEQ ID NO: 162527 - DNA, 20 bp, Artificial Sequence
  chemically synthesized
acctagataaccagactcaa

SEQ ID NO: 162528 - DNA, 20 bp, Artificial Sequence
  chemically synthesized
gaacctagataaccagactc

SEQ ID NO: 162529 - DNA, 20 bp, Artificial Sequence
  chemically synthesized
ggctcttgagtctggttatc

SEQ ID NO: 162530 - DNA, 20 bp, Artificial Sequence
  chemically synthesized
gctcttgagtctggttatct

SEQ ID NO: 162531 - DNA, 20 bp, Artificial Sequence
  chemically synthesized
aggattggaacctagataac

SEQ ID NO: 162532 - DNA, 20 bp, Artificial Sequence
  chemically synthesized
ttcatgctaggattggaacc

SEQ ID NO: 162533 - DNA, 20 bp, Artificial Sequence
  chemically synthesized
ggttatctaggttccaatcc

SEQ ID NO: 162534 - DNA, 20 bp, Artificial Sequence
  chemically synthesized
tagtcaattcatgctaggat

SEQ ID NO: 162535 - DNA, 20 bp, Artificial Sequence
  chemically synthesized
ggaaatagtcaattcatgct

SEQ ID NO: 162536 - DNA, 20 bp, Artificial Sequence
  chemically synthesized
tggaaatagtcaattcatgc

SEQ ID NO: 162537 - DNA, 20 bp, Artificial Sequence
  chemically synthesized
catgaattgactatttccaa

SEQ ID NO: 162538 - DNA, 20 bp, Artificial Sequence
  chemically synthesized
catttggtctctgttggaaa

SEQ ID NO: 162539 - DNA, 20 bp, Artificial Sequence
  chemically synthesized
tgaattgactatttccaaca

SEQ ID NO: 162540 - DNA, 20 bp, Artificial Sequence
  chemically synthesized
atgggccatttggtctctgt

SEQ ID NO: 162541 - DNA, 20 bp, Artificial Sequence
  chemically synthesized
tatttccaacagagaccaaa

SEQ ID NO: 162542 - DNA, 20 bp, Artificial Sequence
  chemically synthesized
ttgaggcttcatgggccatt

SEQ ID NO: 162543 - DNA, 20 bp, Artificial Sequence
  chemically synthesized
cagagaccaaatggcccatg

SEQ ID NO: 162544 - DNA, 20 bp, Artificial Sequence
  chemically synthesized
gtcagtttttgaggcttcat

SEQ ID NO: 162545 - DNA, 20 bp, Artificial Sequence
  chemically synthesized
agtcagtttttgaggcttca

SEQ ID NO: 162546 - DNA, 20 bp, Artificial Sequence
  chemically synthesized
aaaatttcagtcagtttttg

SEQ ID NO: 162547 - DNA, 20 bp, Artificial Sequence
  chemically synthesized
aaaaatttcagtcagttttt

SEQ ID NO: 162548 - DNA, 20 bp, Artificial Sequence
  chemically synthesized
ccaaatagaaaaatttcagt

SEQ ID NO: 162549 - DNA, 20 bp, Artificial Sequence
  chemically synthesized
aaggccaaatagaaaaattt

SEQ ID NO: 162550 - DNA, 20 bp, Artificial Sequence
  chemically synthesized
ctgactgaaatttttctatt

SEQ ID NO: 162551 - DNA, 20 bp, Artificial Sequence
  chemically synthesized
tttttctttaaaaggccaaa

SEQ ID NO: 162552 - DNA, 20 bp, Artificial Sequence
  chemically synthesized
tttttctatttggcctttta

SEQ ID NO: 162553 - DNA, 20 bp, Artificial Sequence
  chemically synthesized
ggccaacttttttctttaaa

SEQ ID NO: 162554 - DNA, 20 bp, Artificial Sequence
  chemically synthesized
tggccaacttttttctttaa

SEQ ID NO: 162555 - DNA, 20 bp, Artificial Sequence
  chemically synthesized
atttggccttttaaagaaaa

SEQ ID NO: 162556 - DNA, 20 bp, Artificial Sequence
  chemically synthesized
ggccttttaaagaaaaaagt

SEQ ID NO: 162557 - DNA, 20 bp, Artificial Sequence
  chemically synthesized
ccgtttctctacatcagtgt

SEQ ID NO: 162558 - DNA, 20 bp, Artificial Sequence
  chemically synthesized
aaagttggccaacactgatg

SEQ ID NO: 162559 - DNA, 20 bp, Artificial Sequence
  chemically synthesized
agttggccaacactgatgta

SEQ ID NO: 162560 - DNA, 20 bp, Artificial Sequence
  chemically synthesized
acctaaccgtttctctacat

SEQ ID NO: 162561 - DNA, 20 bp, Artificial Sequence
  chemically synthesized
ccaacactgatgtagagaaa

SEQ ID NO: 162562 - DNA, 20 bp, Artificial Sequence
  chemically synthesized
cactgatgtagagaaacggt

SEQ ID NO: 162563 - DNA, 20 bp, Artificial Sequence
  chemically synthesized
actgatgtagagaaacggtt

SEQ ID NO: 162564 - DNA, 20 bp, Artificial Sequence
  chemically synthesized
tgtagagaaacggttaggtt

SEQ ID NO: 162565 - DNA, 20 bp, Artificial Sequence
  chemically synthesized
gtagagaaacggttaggttc

SEQ ID NO: 162566 - DNA, 20 bp, Artificial Sequence
  chemically synthesized
acggttaggttcaggctctg

SEQ ID NO: 162567 - DNA, 20 bp, Artificial Sequence
  chemically synthesized
tgaaggattttagagccaca

SEQ ID NO: 162568 - DNA, 20 bp, Artificial Sequence
  chemically synthesized
cttgaaggattttagagcca

SEQ ID NO: 162569 - DNA, 20 bp, Artificial Sequence
  chemically synthesized
tgcatacttgaaggatttta

SEQ ID NO: 162570 - DNA, 20 bp, Artificial Sequence
  chemically synthesized
tatgcatacttgaaggattt

SEQ ID NO: 162571 - DNA, 20 bp, Artificial Sequence
  chemically synthesized
ctgtggctctaaaatccttc

SEQ ID NO: 162572 - DNA, 20 bp, Artificial Sequence
  chemically synthesized
gaataattatgcatacttga

SEQ ID NO: 162573 - DNA, 20 bp, Artificial Sequence
  chemically synthesized
ggaataattatgcatacttg

SEQ ID NO: 162574 - DNA, 20 bp, Artificial Sequence
  chemically synthesized
tttgatatatgtttacattg

SEQ ID NO: 162575 - DNA, 20 bp, Artificial Sequence
  chemically synthesized
aataagtacatatatttatg

SEQ ID NO: 162576 - DNA, 20 bp, Artificial Sequence
  chemically synthesized
taataagtacatatatttat

SEQ ID NO: 162577 - DNA, 20 bp, Artificial Sequence
  chemically synthesized
tattttaattgacaaataat

SEQ ID NO: 162578 - DNA, 20 bp, Artificial Sequence
  chemically synthesized
ttaaaataaaataaaaaata

SEQ ID NO: 162579 - DNA, 20 bp, Artificial Sequence
  chemically synthesized
taaaataaaataaaaaatac

SEQ ID NO: 162580 - DNA, 20 bp, Artificial Sequence
  chemically synthesized
aaaataaaataaaaaataca

SEQ ID NO: 162581 - DNA, 20 bp, Artificial Sequence
  chemically synthesized
aaataaaataaaaaatacag

SEQ ID NO: 162582 - DNA, 20 bp, Artificial Sequence
  chemically synthesized
tatttttaataatcaaacat

SEQ ID NO: 162583 - DNA, 20 bp, Artificial Sequence
  chemically synthesized
tatataaggagtttatagaa

SEQ ID NO: 162584 - DNA, 20 bp, Artificial Sequence
  chemically synthesized
gagtctatataaggagttta

SEQ ID NO: 162585 - DNA, 20 bp, Artificial Sequence
  chemically synthesized
ttttctataaactccttata

SEQ ID NO: 162586 - DNA, 20 bp, Artificial Sequence
  chemically synthesized
tttctatgagtctatataag

SEQ ID NO: 162587 - DNA, 20 bp, Artificial Sequence
  chemically synthesized
tctttctatgagtctatata

SEQ ID NO: 162588 - DNA, 20 bp, Artificial Sequence
  chemically synthesized
ctctttctatgagtctatat

SEQ ID NO: 162589 - DNA, 20 bp, Artificial Sequence
  chemically synthesized
aaactccttatatagactca

SEQ ID NO: 162590 - DNA, 20 bp, Artificial Sequence
  chemically synthesized
tccttatatagactcataga

SEQ ID NO: 162591 - DNA, 20 bp, Artificial Sequence
  chemically synthesized
cttatatagactcatagaaa

SEQ ID NO: 162592 - DNA, 20 bp, Artificial Sequence
  chemically synthesized
aattgtttaactctttctat

SEQ ID NO: 162593 - DNA, 20 bp, Artificial Sequence
  chemically synthesized
agagttaaacaatttataat

SEQ ID NO: 162594 - DNA, 20 bp, Artificial Sequence
  chemically synthesized
agagcgagactgtgtcaaaa

SEQ ID NO: 162595 - DNA, 20 bp, Artificial Sequence
  chemically synthesized
atttatttactattttgaca

SEQ ID NO: 162596 - DNA, 20 bp, Artificial Sequence
  chemically synthesized
tccagcctgggcgacagagc

SEQ ID NO: 162597 - DNA, 20 bp, Artificial Sequence
  chemically synthesized
cacagtctcgctctgtcgcc

SEQ ID NO: 162598 - DNA, 20 bp, Artificial Sequence
  chemically synthesized
gcactccagcctgggcgaca

SEQ ID NO: 162599 - DNA, 20 bp, Artificial Sequence
  chemically synthesized
acagtctcgctctgtcgccc

SEQ ID NO: 162600 - DNA, 20 bp, Artificial Sequence
  chemically synthesized
ctgcactccagcctgggcga

SEQ ID NO: 162601 - DNA, 20 bp, Artificial Sequence
  chemically synthesized
tctcgctctgtcgcccaggc

SEQ ID NO: 162602 - DNA, 20 bp, Artificial Sequence
  chemically synthesized
tcgctctgtcgcccaggctg

SEQ ID NO: 162603 - DNA, 20 bp, Artificial Sequence
  chemically synthesized
atgccactgcactccagcct

SEQ ID NO: 162604 - DNA, 20 bp, Artificial Sequence
  chemically synthesized
catgccactgcactccagcc

SEQ ID NO: 162605 - DNA, 20 bp, Artificial Sequence
  chemically synthesized
ctgtcgcccaggctggagtg

SEQ ID NO: 162606 - DNA, 20 bp, Artificial Sequence
  chemically synthesized
gagatcatgccactgcactc

SEQ ID NO: 162607 - DNA, 20 bp, Artificial Sequence
  chemically synthesized
tcgcccaggctggagtgcag

SEQ ID NO: 162608 - DNA, 20 bp, Artificial Sequence
  chemically synthesized
ggagtgcagtggcatgatct

SEQ ID NO: 162609 - DNA, 20 bp, Artificial Sequence
  chemically synthesized
ggcagaggttgcagtgagcc

SEQ ID NO: 162610 - DNA, 20 bp, Artificial Sequence
  chemically synthesized
ggggaggcagaggttgcagt

SEQ ID NO: 162611 - DNA, 20 bp, Artificial Sequence
  chemically synthesized
agctggggaggcagaggttg

SEQ ID NO: 162612 - DNA, 20 bp, Artificial Sequence
  chemically synthesized
cgcttgagctggggaggcag

SEQ ID NO: 162613 - DNA, 20 bp, Artificial Sequence
  chemically synthesized
ccgcttgagctggggaggca

SEQ ID NO: 162614 - DNA, 20 bp, Artificial Sequence
  chemically synthesized
cactgcaacctctgcctccc

SEQ ID NO: 162615 - DNA, 20 bp, Artificial Sequence
  chemically synthesized
aaccgcttgagctggggagg

SEQ ID NO: 162616 - DNA, 20 bp, Artificial Sequence
  chemically synthesized
aagaaccgcttgagctgggg

SEQ ID NO: 162617 - DNA, 20 bp, Artificial Sequence
  chemically synthesized
caagaaccgcttgagctggg

SEQ ID NO: 162618 - DNA, 20 bp, Artificial Sequence
  chemically synthesized
aacctctgcctccccagctc

SEQ ID NO: 162619 - DNA, 20 bp, Artificial Sequence
  chemically synthesized
cacaagaaccgcttgagctg

SEQ ID NO: 162620 - DNA, 20 bp, Artificial Sequence
  chemically synthesized
gcacaagaaccgcttgagct

SEQ ID NO: 162621 - DNA, 20 bp, Artificial Sequence
  chemically synthesized
ctctgcctccccagctcaag

SEQ ID NO: 162622 - DNA, 20 bp, Artificial Sequence
  chemically synthesized
ggcacaagaaccgcttgagc

SEQ ID NO: 162623 - DNA, 20 bp, Artificial Sequence
  chemically synthesized
ctgaggcacaagaaccgctt

SEQ ID NO: 162624 - DNA, 20 bp, Artificial Sequence
  chemically synthesized
ctcaagcggttcttgtgcct

SEQ ID NO: 162625 - DNA, 20 bp, Artificial Sequence
  chemically synthesized
tactctggaggctgaggcac

SEQ ID NO: 162626 - DNA, 20 bp, Artificial Sequence
  chemically synthesized
ggttcttgtgcctcagcctc

SEQ ID NO: 162627 - DNA, 20 bp, Artificial Sequence
  chemically synthesized
ctcagctactctggaggctg

SEQ ID NO: 162628 - DNA, 20 bp, Artificial Sequence
  chemically synthesized
tctcagctactctggaggct

SEQ ID NO: 162629 - DNA, 20 bp, Artificial Sequence
  chemically synthesized
ttcttgtgcctcagcctcca

SEQ ID NO: 162630 - DNA, 20 bp, Artificial Sequence
  chemically synthesized
ttgtgcctcagcctccagag

SEQ ID NO: 162631 - DNA, 20 bp, Artificial Sequence
  chemically synthesized
tgtaatctcagctactctgg

SEQ ID NO: 162632 - DNA, 20 bp, Artificial Sequence
  chemically synthesized
ctgtaatctcagctactctg

SEQ ID NO: 162633 - DNA, 20 bp, Artificial Sequence
  chemically synthesized
gcctgtaatctcagctactc

SEQ ID NO: 162634 - DNA, 20 bp, Artificial Sequence
  chemically synthesized
cctcagcctccagagtagct

SEQ ID NO: 162635 - DNA, 20 bp, Artificial Sequence
  chemically synthesized
ctccagagtagctgagatta

SEQ ID NO: 162636 - DNA, 20 bp, Artificial Sequence
  chemically synthesized
tccagagtagctgagattac

SEQ ID NO: 162637 - DNA, 20 bp, Artificial Sequence
  chemically synthesized
gtggtgcatgcctgtaatct

SEQ ID NO: 162638 - DNA, 20 bp, Artificial Sequence
  chemically synthesized
gattacaggcatgcaccacc

SEQ ID NO: 162639 - DNA, 20 bp, Artificial Sequence
  chemically synthesized
caggcatgcaccaccaagcc

SEQ ID NO: 162640 - DNA, 20 bp, Artificial Sequence
  chemically synthesized
caaaaattagccaggcttgg

SEQ ID NO: 162641 - DNA, 20 bp, Artificial Sequence
  chemically synthesized
acacaaaaattagccaggct

SEQ ID NO: 162642 - DNA, 20 bp, Artificial Sequence
  chemically synthesized
taaaaacacaaaaattagcc

SEQ ID NO: 162643 - DNA, 20 bp, Artificial Sequence
  chemically synthesized
ctaaaaacacaaaaattagc

SEQ ID NO: 162644 - DNA, 20 bp, Artificial Sequence
  chemically synthesized
tgtactaaaaacacaaaaat

SEQ ID NO: 162645 - DNA, 20 bp, Artificial Sequence
  chemically synthesized
ctggctaatttttgtgtttt

SEQ ID NO: 162646 - DNA, 20 bp, Artificial Sequence
  chemically synthesized
taatttttgtgtttttagta

SEQ ID NO: 162647 - DNA, 20 bp, Artificial Sequence
  chemically synthesized
ttttgtgtttttagtacaga

SEQ ID NO: 162648 - DNA, 20 bp, Artificial Sequence
  chemically synthesized
tttgtgtttttagtacagac

SEQ ID NO: 162649 - DNA, 20 bp, Artificial Sequence
  chemically synthesized
ttgtgtttttagtacagacg

SEQ ID NO: 162650 - DNA, 20 bp, Artificial Sequence
  chemically synthesized
cagacggggttttgccatgt

SEQ ID NO: 162651 - DNA, 20 bp, Artificial Sequence
  chemically synthesized
cggggttttgccatgttggc

SEQ ID NO: 162652 - DNA, 20 bp, Artificial Sequence
  chemically synthesized
cgagacgagcctggccaaca

SEQ ID NO: 162653 - DNA, 20 bp, Artificial Sequence
  chemically synthesized
ggggttttgccatgttggcc

SEQ ID NO: 162654 - DNA, 20 bp, Artificial Sequence
  chemically synthesized
ccaggagttcgagacgagcc

SEQ ID NO: 162655 - DNA, 20 bp, Artificial Sequence
  chemically synthesized
tgaggccaggagttcgagac

SEQ ID NO: 162656 - DNA, 20 bp, Artificial Sequence
  chemically synthesized
ccaggctcgtctcgaactcc

SEQ ID NO: 162657 - DNA, 20 bp, Artificial Sequence
  chemically synthesized
tcacttgaggccaggagttc

SEQ ID NO: 162658 - DNA, 20 bp, Artificial Sequence
  chemically synthesized
ggtggatcacttgaggccag

SEQ ID NO: 162659 - DNA, 20 bp, Artificial Sequence
  chemically synthesized
cgtctcgaactcctggcctc

SEQ ID NO: 162660 - DNA, 20 bp, Artificial Sequence
  chemically synthesized
tgggtggatcacttgaggcc

SEQ ID NO: 162661 - DNA, 20 bp, Artificial Sequence
  chemically synthesized
atgggtggatcacttgaggc

SEQ ID NO: 162662 - DNA, 20 bp, Artificial Sequence
  chemically synthesized
cgaaatgggtggatcacttg

SEQ ID NO: 162663 - DNA, 20 bp, Artificial Sequence
  chemically synthesized
ccgaaatgggtggatcactt

SEQ ID NO: 162664 - DNA, 20 bp, Artificial Sequence
  chemically synthesized
ctcaagtgatccacccattt

SEQ ID NO: 162665 - DNA, 20 bp, Artificial Sequence
  chemically synthesized
ctttgagaggccgaaatggg

SEQ ID NO: 162666 - DNA, 20 bp, Artificial Sequence
  chemically synthesized
gcactttgagaggccgaaat

SEQ ID NO: 162667 - DNA, 20 bp, Artificial Sequence
  chemically synthesized
agcactttgagaggccgaaa

SEQ ID NO: 162668 - DNA, 20 bp, Artificial Sequence
  chemically synthesized
ccacccatttcggcctctca

SEQ ID NO: 162669 - DNA, 20 bp, Artificial Sequence
  chemically synthesized
tgtaatcccagcactttgag

SEQ ID NO: 162670 - DNA, 20 bp, Artificial Sequence
  chemically synthesized
ctgtaatcccagcactttga

SEQ ID NO: 162671 - DNA, 20 bp, Artificial Sequence
  chemically synthesized
atttcggcctctcaaagtgc

SEQ ID NO: 162672 - DNA, 20 bp, Artificial Sequence
  chemically synthesized
acctgtaatcccagcacttt

SEQ ID NO: 162673 - DNA, 20 bp, Artificial Sequence
  chemically synthesized
tttcggcctctcaaagtgct

SEQ ID NO: 162674 - DNA, 20 bp, Artificial Sequence
  chemically synthesized
ctctcaaagtgctgggatta

SEQ ID NO: 162675 - DNA, 20 bp, Artificial Sequence
  chemically synthesized
tctcaaagtgctgggattac

SEQ ID NO: 162676 - DNA, 20 bp, Artificial Sequence
  chemically synthesized
gtggctcacacctgtaatcc

SEQ ID NO: 162677 - DNA, 20 bp, Artificial Sequence
  chemically synthesized
agtgctgggattacaggtgt

SEQ ID NO: 162678 - DNA, 20 bp, Artificial Sequence
  chemically synthesized
caggtgtgagccactgcacc

SEQ ID NO: 162679 - DNA, 20 bp, Artificial Sequence
  chemically synthesized
tacaaattggccaggtgcag

SEQ ID NO: 162680 - DNA, 20 bp, Artificial Sequence
  chemically synthesized
aattacaaattggccaggtg

SEQ ID NO: 162681 - DNA, 20 bp, Artificial Sequence
  chemically synthesized
agtataattacaaattggcc

SEQ ID NO: 162682 - DNA, 20 bp, Artificial Sequence
  chemically synthesized
aagtataattacaaattggc

SEQ ID NO: 162683 - DNA, 20 bp, Artificial Sequence
  chemically synthesized
tctaaagtataattacaaat

SEQ ID NO: 162684 - DNA, 20 bp, Artificial Sequence
  chemically synthesized
gccaatttgtaattatactt

SEQ ID NO: 162685 - DNA, 20 bp, Artificial Sequence
  chemically synthesized
caatttgtaattatacttta

SEQ ID NO: 162686 - DNA, 20 bp, Artificial Sequence
  chemically synthesized
tttgtaattatactttagag

SEQ ID NO: 162687 - DNA, 20 bp, Artificial Sequence
  chemically synthesized
tgtaattatactttagagca

SEQ ID NO: 162688 - DNA, 20 bp, Artificial Sequence
  chemically synthesized
gtttgctaacctctgctcta

SEQ ID NO: 162689 - DNA, 20 bp, Artificial Sequence
  chemically synthesized
gtaattatactttagagcag

SEQ ID NO: 162690 - DNA, 20 bp, Artificial Sequence
  chemically synthesized
ttatactttagagcagaggt

SEQ ID NO: 162691 - DNA, 20 bp, Artificial Sequence
  chemically synthesized
atttactatatggtgtttta

SEQ ID NO: 162692 - DNA, 20 bp, Artificial Sequence
  chemically synthesized
attttctataaaacaccata

SEQ ID NO: 162693 - DNA, 20 bp, Artificial Sequence
  chemically synthesized
agtctaaaatatttactata

SEQ ID NO: 162694 - DNA, 20 bp, Artificial Sequence
  chemically synthesized
acaccatatagtaaatattt

SEQ ID NO: 162695 - DNA, 20 bp, Artificial Sequence
  chemically synthesized
agtaaatattttagactttg

SEQ ID NO: 162696 - DNA, 20 bp, Artificial Sequence
  chemically synthesized
gtaaatattttagactttgt

SEQ ID NO: 162697 - DNA, 20 bp, Artificial Sequence
  chemically synthesized
gaatttgagtttggcccaca

SEQ ID NO: 162698 - DNA, 20 bp, Artificial Sequence
  chemically synthesized
acattggcagaatttgagtt

SEQ ID NO: 162699 - DNA, 20 bp, Artificial Sequence
  chemically synthesized
atgccacattggcagaattt

SEQ ID NO: 162700 - DNA, 20 bp, Artificial Sequence
  chemically synthesized
aaactcaaattctgccaatg

SEQ ID NO: 162701 - DNA, 20 bp, Artificial Sequence
  chemically synthesized
ctactttcatgccacattgg

SEQ ID NO: 162702 - DNA, 20 bp, Artificial Sequence
  chemically synthesized
tgactactttcatgccacat

SEQ ID NO: 162703 - DNA, 20 bp, Artificial Sequence
  chemically synthesized
attctgccaatgtggcatga

SEQ ID NO: 162704 - DNA, 20 bp, Artificial Sequence
  chemically synthesized
ctgccaatgtggcatgaaag

SEQ ID NO: 162705 - DNA, 20 bp, Artificial Sequence
  chemically synthesized
caatgtggcatgaaagtagt

SEQ ID NO: 162706 - DNA, 20 bp, Artificial Sequence
  chemically synthesized
aatgtggcatgaaagtagtc

SEQ ID NO: 162707 - DNA, 20 bp, Artificial Sequence
  chemically synthesized
acatttatttgttcatgtat

SEQ ID NO: 162708 - DNA, 20 bp, Artificial Sequence
  chemically synthesized
aatacatgaacaaataaatg

SEQ ID NO: 162709 - DNA, 20 bp, Artificial Sequence
  chemically synthesized
aataaagagttattggaaca

SEQ ID NO: 162710 - DNA, 20 bp, Artificial Sequence
  chemically synthesized
tttcagaaataaagagttat

SEQ ID NO: 162711 - DNA, 20 bp, Artificial Sequence
  chemically synthesized
cacctattttcagaaataaa

SEQ ID NO: 162712 - DNA, 20 bp, Artificial Sequence
  chemically synthesized
tccacctattttcagaaata

SEQ ID NO: 162713 - DNA, 20 bp, Artificial Sequence
  chemically synthesized
taactctttatttctgaaaa

SEQ ID NO: 162714 - DNA, 20 bp, Artificial Sequence
  chemically synthesized
aactctttatttctgaaaat

SEQ ID NO: 162715 - DNA, 20 bp, Artificial Sequence
  chemically synthesized
tttagtcctccacctatttt

SEQ ID NO: 162716 - DNA, 20 bp, Artificial Sequence
  chemically synthesized
tctttatttctgaaaatagg

SEQ ID NO: 162717 - DNA, 20 bp, Artificial Sequence
  chemically synthesized
tttatttctgaaaataggtg

SEQ ID NO: 162718 - DNA, 20 bp, Artificial Sequence
  chemically synthesized
ttatttctgaaaataggtgg

SEQ ID NO: 162719 - DNA, 20 bp, Artificial Sequence
  chemically synthesized
aataggtggaggactaaatg

SEQ ID NO: 162720 - DNA, 20 bp, Artificial Sequence
  chemically synthesized
tatggtccaagggccacatt

SEQ ID NO: 162721 - DNA, 20 bp, Artificial Sequence
  chemically synthesized
ggaggactaaatgtggccct

SEQ ID NO: 162722 - DNA, 20 bp, Artificial Sequence
  chemically synthesized
gtcagcaaactatggtccaa

SEQ ID NO: 162723 - DNA, 20 bp, Artificial Sequence
  chemically synthesized
taaatgtggcccttggacca

SEQ ID NO: 162724 - DNA, 20 bp, Artificial Sequence
  chemically synthesized
agtcagcaaactatggtcca

SEQ ID NO: 162725 - DNA, 20 bp, Artificial Sequence
  chemically synthesized
gagtcagcaaactatggtcc

SEQ ID NO: 162726 - DNA, 20 bp, Artificial Sequence
  chemically synthesized
aagcaagagtcagcaaacta

SEQ ID NO: 162727 - DNA, 20 bp, Artificial Sequence
  chemically synthesized
taatatcctaaagcaagagt

SEQ ID NO: 162728 - DNA, 20 bp, Artificial Sequence
  chemically synthesized
tagtttgctgactcttgctt

SEQ ID NO: 162729 - DNA, 20 bp, Artificial Sequence
  chemically synthesized
agtttgctgactcttgcttt

SEQ ID NO: 162730 - DNA, 20 bp, Artificial Sequence
  chemically synthesized
actgtaatatcctaaagcaa

SEQ ID NO: 162731 - DNA, 20 bp, Artificial Sequence
  chemically synthesized
acactgtaatatcctaaagc

SEQ ID NO: 162732 - DNA, 20 bp, Artificial Sequence
  chemically synthesized
aacaacactgtaatatccta

SEQ ID NO: 162733 - DNA, 20 bp, Artificial Sequence
  chemically synthesized
actcttgctttaggatatta

SEQ ID NO: 162734 - DNA, 20 bp, Artificial Sequence
  chemically synthesized
ttaggatattacagtgttgt

SEQ ID NO: 162735 - DNA, 20 bp, Artificial Sequence
  chemically synthesized
acagtgttgttggaaataat

SEQ ID NO: 162736 - DNA, 20 bp, Artificial Sequence
  chemically synthesized
gttgttggaaataatcagtc

SEQ ID NO: 162737 - DNA, 20 bp, Artificial Sequence
  chemically synthesized
gaaataatcagtctagaaat

SEQ ID NO: 162738 - DNA, 20 bp, Artificial Sequence
  chemically synthesized
aacccagatgttcttatttc

SEQ ID NO: 162739 - DNA, 20 bp, Artificial Sequence
  chemically synthesized
agtctagaaataagaacatc

SEQ ID NO: 162740 - DNA, 20 bp, Artificial Sequence
  chemically synthesized
gtctagaaataagaacatct

SEQ ID NO: 162741 - DNA, 20 bp, Artificial Sequence
  chemically synthesized
aaataagaacatctgggttc

SEQ ID NO: 162742 - DNA, 20 bp, Artificial Sequence
  chemically synthesized
aataagaacatctgggttct

SEQ ID NO: 162743 - DNA, 20 bp, Artificial Sequence
  chemically synthesized
gggctaataagcctagaacc

SEQ ID NO: 162744 - DNA, 20 bp, Artificial Sequence
  chemically synthesized
catctgggttctaggcttat

SEQ ID NO: 162745 - DNA, 20 bp, Artificial Sequence
  chemically synthesized
aactcatgggctaataagcc

SEQ ID NO: 162746 - DNA, 20 bp, Artificial Sequence
  chemically synthesized
gccccaactcatgggctaat

SEQ ID NO: 162747 - DNA, 20 bp, Artificial Sequence
  chemically synthesized
ttctaggcttattagcccat

SEQ ID NO: 162748 - DNA, 20 bp, Artificial Sequence
  chemically synthesized
aggcttattagcccatgagt

SEQ ID NO: 162749 - DNA, 20 bp, Artificial Sequence
  chemically synthesized
ggcttattagcccatgagtt

SEQ ID NO: 162750 - DNA, 20 bp, Artificial Sequence
  chemically synthesized
aatgacttgccccaactcat

SEQ ID NO: 162751 - DNA, 20 bp, Artificial Sequence
  chemically synthesized
gcttattagcccatgagttg

SEQ ID NO: 162752 - DNA, 20 bp, Artificial Sequence
  chemically synthesized
aaatgacttgccccaactca

SEQ ID NO: 162753 - DNA, 20 bp, Artificial Sequence
  chemically synthesized
attagcccatgagttggggc

SEQ ID NO: 162754 - DNA, 20 bp, Artificial Sequence
  chemically synthesized
gcaagtcatttaactgctct

SEQ ID NO: 162755 - DNA, 20 bp, Artificial Sequence
  chemically synthesized
ctgaaacctgaaacttagag

SEQ ID NO: 162756 - DNA, 20 bp, Artificial Sequence
  chemically synthesized
catttaactgctctaagttt

SEQ ID NO: 162757 - DNA, 20 bp, Artificial Sequence
  chemically synthesized
atactgaaacctgaaactta

SEQ ID NO: 162758 - DNA, 20 bp, Artificial Sequence
  chemically synthesized
atttaactgctctaagtttc

SEQ ID NO: 162759 - DNA, 20 bp, Artificial Sequence
  chemically synthesized
agatactgaaacctgaaact

SEQ ID NO: 162760 - DNA, 20 bp, Artificial Sequence
  chemically synthesized
ctgctctaagtttcaggttt

SEQ ID NO: 162761 - DNA, 20 bp, Artificial Sequence
  chemically synthesized
tttcatttattttatattta

SEQ ID NO: 162762 - DNA, 20 bp, Artificial Sequence
  chemically synthesized
tataaaataaatgaaactaa

SEQ ID NO: 162763 - DNA, 20 bp, Artificial Sequence
  chemically synthesized
ttactcacagtaatatctgt

SEQ ID NO: 162764 - DNA, 20 bp, Artificial Sequence
  chemically synthesized
aaactaacagatattactgt

SEQ ID NO: 162765 - DNA, 20 bp, Artificial Sequence
  chemically synthesized
aacagatattactgtgagta

SEQ ID NO: 162766 - DNA, 20 bp, Artificial Sequence
  chemically synthesized
acagatattactgtgagtaa

SEQ ID NO: 162767 - DNA, 20 bp, Artificial Sequence
  chemically synthesized
tgtttttaaccctttactca

SEQ ID NO: 162768 - DNA, 20 bp, Artificial Sequence
  chemically synthesized
cagatattactgtgagtaaa

SEQ ID NO: 162769 - DNA, 20 bp, Artificial Sequence
  chemically synthesized
ttctcatacagatggacaaa

SEQ ID NO: 162770 - DNA, 20 bp, Artificial Sequence
  chemically synthesized
attctcatacagatggacaa

SEQ ID NO: 162771 - DNA, 20 bp, Artificial Sequence
  chemically synthesized
aattctcatacagatggaca

SEQ ID NO: 162772 - DNA, 20 bp, Artificial Sequence
  chemically synthesized
caccctttgtccatctgtat

SEQ ID NO: 162773 - DNA, 20 bp, Artificial Sequence
  chemically synthesized
agtacaaattctcatacaga

SEQ ID NO: 162774 - DNA, 20 bp, Artificial Sequence
  chemically synthesized
tcaaagtacaaattctcata

SEQ ID NO: 162775 - DNA, 20 bp, Artificial Sequence
  chemically synthesized
gggagctagaaagttgatca

SEQ ID NO: 162776 - DNA, 20 bp, Artificial Sequence
  chemically synthesized
ttgtactttgatcaactttc

SEQ ID NO: 162777 - DNA, 20 bp, Artificial Sequence
  chemically synthesized
ctagggagaagggagctaga

SEQ ID NO: 162778 - DNA, 20 bp, Artificial Sequence
  chemically synthesized
ttttctagggagaagggagc

SEQ ID NO: 162779 - DNA, 20 bp, Artificial Sequence
  chemically synthesized
tcagttttctagggagaagg

SEQ ID NO: 162780 - DNA, 20 bp, Artificial Sequence
  chemically synthesized
ctttctagctcccttctccc

SEQ ID NO: 162781 - DNA, 20 bp, Artificial Sequence
  chemically synthesized
tatcagttttctagggagaa

SEQ ID NO: 162782 - DNA, 20 bp, Artificial Sequence
  chemically synthesized
ttatcagttttctagggaga

SEQ ID NO: 162783 - DNA, 20 bp, Artificial Sequence
  chemically synthesized
tttatcagttttctagggag

SEQ ID NO: 162784 - DNA, 20 bp, Artificial Sequence
  chemically synthesized
aactttatcagttttctagg

SEQ ID NO: 162785 - DNA, 20 bp, Artificial Sequence
  chemically synthesized
ccaactttatcagttttcta

SEQ ID NO: 162786 - DNA, 20 bp, Artificial Sequence
  chemically synthesized
tccaactttatcagttttct

SEQ ID NO: 162787 - DNA, 20 bp, Artificial Sequence
  chemically synthesized
ttccaactttatcagttttc

SEQ ID NO: 162788 - DNA, 20 bp, Artificial Sequence
  chemically synthesized
ttctccctagaaaactgata

SEQ ID NO: 162789 - DNA, 20 bp, Artificial Sequence
  chemically synthesized
ccctagaaaactgataaagt

SEQ ID NO: 162790 - DNA, 20 bp, Artificial Sequence
  chemically synthesized
atttgacattccaactttat

SEQ ID NO: 162791 - DNA, 20 bp, Artificial Sequence
  chemically synthesized
agttggaatgtcaaatgtgt

SEQ ID NO: 162792 - DNA, 20 bp, Artificial Sequence
  chemically synthesized
tggaatgtcaaatgtgtgag

SEQ ID NO: 162793 - DNA, 20 bp, Artificial Sequence
  chemically synthesized
ggaatgtcaaatgtgtgagc

SEQ ID NO: 162794 - DNA, 20 bp, Artificial Sequence
  chemically synthesized
gtgagcaggcaacattgctt

SEQ ID NO: 162795 - DNA, 20 bp, Artificial Sequence
  chemically synthesized
tcatttttttttttaatctg

SEQ ID NO: 162796 - DNA, 20 bp, Artificial Sequence
  chemically synthesized
cagattaaaaaaaaaaatga

SEQ ID NO: 162797 - DNA, 20 bp, Artificial Sequence
  chemically synthesized
agattaaaaaaaaaaatgat

SEQ ID NO: 162798 - DNA, 20 bp, Artificial Sequence
  chemically synthesized
gattaaaaaaaaaaatgatg

SEQ ID NO: 162799 - DNA, 20 bp, Artificial Sequence
  chemically synthesized
aaaaaaaaaatgatggggac

SEQ ID NO: 162800 - DNA, 20 bp, Artificial Sequence
  chemically synthesized
ctaaccaaggtgtaatttac

SEQ ID NO: 162801 - DNA, 20 bp, Artificial Sequence
  chemically synthesized
gggactggtaaattacacct

SEQ ID NO: 162802 - DNA, 20 bp, Artificial Sequence
  chemically synthesized
ctggtaaattacaccttggt

SEQ ID NO: 162803 - DNA, 20 bp, Artificial Sequence
  chemically synthesized
tggtaaattacaccttggtt

SEQ ID NO: 162804 - DNA, 20 bp, Artificial Sequence
  chemically synthesized
atatgtagaacacctaacca

SEQ ID NO: 162805 - DNA, 20 bp, Artificial Sequence
  chemically synthesized
catatgtagaacacctaacc

SEQ ID NO: 162806 - DNA, 20 bp, Artificial Sequence
  chemically synthesized
aggtatttatagttcatatg

SEQ ID NO: 162807 - DNA, 20 bp, Artificial Sequence
  chemically synthesized
ggttttccattaggtattta

SEQ ID NO: 162808 - DNA, 20 bp, Artificial Sequence
  chemically synthesized
tatgaactataaatacctaa

SEQ ID NO: 162809 - DNA, 20 bp, Artificial Sequence
  chemically synthesized
cacaattatggttttccatt

SEQ ID NO: 162810 - DNA, 20 bp, Artificial Sequence
  chemically synthesized
ccacaattatggttttccat

SEQ ID NO: 162811 - DNA, 20 bp, Artificial Sequence
  chemically synthesized
ctaatggaaaaccataattg

SEQ ID NO: 162812 - DNA, 20 bp, Artificial Sequence
  chemically synthesized
taatggaaaaccataattgt

SEQ ID NO: 162813 - DNA, 20 bp, Artificial Sequence
  chemically synthesized
ttggggacgccccacaatta

SEQ ID NO: 162814 - DNA, 20 bp, Artificial Sequence
  chemically synthesized
aatggaaaaccataattgtg

SEQ ID NO: 162815 - DNA, 20 bp, Artificial Sequence
  chemically synthesized
cataattgtggggcgtcccc

SEQ ID NO: 162816 - DNA, 20 bp, Artificial Sequence
  chemically synthesized
tacaagaattgttgtacttg

SEQ ID NO: 162817 - DNA, 20 bp, Artificial Sequence
  chemically synthesized
ttacaagaattgttgtactt

SEQ ID NO: 162818 - DNA, 20 bp, Artificial Sequence
  chemically synthesized
gttacaagaattgttgtact

SEQ ID NO: 162819 - DNA, 20 bp, Artificial Sequence
  chemically synthesized
gtacaacaattcttgtaact

SEQ ID NO: 162820 - DNA, 20 bp, Artificial Sequence
  chemically synthesized
aaaaggacatgcttagttac

SEQ ID NO: 162821 - DNA, 20 bp, Artificial Sequence
  chemically synthesized
gtcctcaaaaaggacatgct

SEQ ID NO: 162822 - DNA, 20 bp, Artificial Sequence
  chemically synthesized
taactaagcatgtccttttt

SEQ ID NO: 162823 - DNA, 20 bp, Artificial Sequence
  chemically synthesized
aactaagcatgtcctttttg

SEQ ID NO: 162824 - DNA, 20 bp, Artificial Sequence
  chemically synthesized
agtttccaaggtcctcaaaa

SEQ ID NO: 162825 - DNA, 20 bp, Artificial Sequence
  chemically synthesized
tagtttccaaggtcctcaaa

SEQ ID NO: 162826 - DNA, 20 bp, Artificial Sequence
  chemically synthesized
catgtcctttttgaggacct

SEQ ID NO: 162827 - DNA, 20 bp, Artificial Sequence
  chemically synthesized
gccttgtaacatagtttcca

SEQ ID NO: 162828 - DNA, 20 bp, Artificial Sequence
  chemically synthesized
tgccttgtaacatagtttcc

SEQ ID NO: 162829 - DNA, 20 bp, Artificial Sequence
  chemically synthesized
gaccttggaaactatgttac

SEQ ID NO: 162830 - DNA, 20 bp, Artificial Sequence
  chemically synthesized
accttggaaactatgttaca

SEQ ID NO: 162831 - DNA, 20 bp, Artificial Sequence
  chemically synthesized
gaggccaatgccttgtaaca

SEQ ID NO: 162832 - DNA, 20 bp, Artificial Sequence
  chemically synthesized
gaaactatgttacaaggcat

SEQ ID NO: 162833 - DNA, 20 bp, Artificial Sequence
  chemically synthesized
tgttacaaggcattggcctc

SEQ ID NO: 162834 - DNA, 20 bp, Artificial Sequence
  chemically synthesized
gttacaaggcattggcctct

SEQ ID NO: 162835 - DNA, 20 bp, Artificial Sequence
  chemically synthesized
agaagccttatgcatcccag

SEQ ID NO: 162836 - DNA, 20 bp, Artificial Sequence
  chemically synthesized
tagaagccttatgcatccca

SEQ ID NO: 162837 - DNA, 20 bp, Artificial Sequence
  chemically synthesized
cctagaagccttatgcatcc

SEQ ID NO: 162838 - DNA, 20 bp, Artificial Sequence
  chemically synthesized
cattggcctctgggatgcat

SEQ ID NO: 162839 - DNA, 20 bp, Artificial Sequence
  chemically synthesized
attggcctctgggatgcata

SEQ ID NO: 162840 - DNA, 20 bp, Artificial Sequence
  chemically synthesized
tctgggatgcataaggcttc

SEQ ID NO: 162841 - DNA, 20 bp, Artificial Sequence
  chemically synthesized
ctgggatgcataaggcttct

SEQ ID NO: 162842 - DNA, 20 bp, Artificial Sequence
  chemically synthesized
gatgcataaggcttctaggc

SEQ ID NO: 162843 - DNA, 20 bp, Artificial Sequence
  chemically synthesized
atgcataaggcttctaggcc

SEQ ID NO: 162844 - DNA, 20 bp, Artificial Sequence
  chemically synthesized
ctgggtcaaccctggcctag

SEQ ID NO: 162845 - DNA, 20 bp, Artificial Sequence
  chemically synthesized
tgcataaggcttctaggcca

SEQ ID NO: 162846 - DNA, 20 bp, Artificial Sequence
  chemically synthesized
atgctgggtcaaccctggcc

SEQ ID NO: 162847 - DNA, 20 bp, Artificial Sequence
  chemically synthesized
tcgagatgctgggtcaaccc

SEQ ID NO: 162848 - DNA, 20 bp, Artificial Sequence
  chemically synthesized
cttctaggccagggttgacc

SEQ ID NO: 162849 - DNA, 20 bp, Artificial Sequence
  chemically synthesized
aggaaacaaatcgagatgct

SEQ ID NO: 162850 - DNA, 20 bp, Artificial Sequence
  chemically synthesized
aaggaaacaaatcgagatgc

SEQ ID NO: 162851 - DNA, 20 bp, Artificial Sequence
  chemically synthesized
gcacaggaaggaaacaaatc

SEQ ID NO: 162852 - DNA, 20 bp, Artificial Sequence
  chemically synthesized
gacatctcaggtgcacagga

SEQ ID NO: 162853 - DNA, 20 bp, Artificial Sequence
  chemically synthesized
tgacatctcaggtgcacagg

SEQ ID NO: 162854 - DNA, 20 bp, Artificial Sequence
  chemically synthesized
tcatgacatctcaggtgcac

SEQ ID NO: 162855 - DNA, 20 bp, Artificial Sequence
  chemically synthesized
tgtttccttcctgtgcacct

SEQ ID NO: 162856 - DNA, 20 bp, Artificial Sequence
  chemically synthesized
ctcatgacatctcaggtgca

SEQ ID NO: 162857 - DNA, 20 bp, Artificial Sequence
  chemically synthesized
ccactctctcatgacatctc

SEQ ID NO: 162858 - DNA, 20 bp, Artificial Sequence
  chemically synthesized
tccactctctcatgacatct

SEQ ID NO: 162859 - DNA, 20 bp, Artificial Sequence
  chemically synthesized
ctgtgcacctgagatgtcat

SEQ ID NO: 162860 - DNA, 20 bp, Artificial Sequence
  chemically synthesized
gtgcacctgagatgtcatga

SEQ ID NO: 162861 - DNA, 20 bp, Artificial Sequence
  chemically synthesized
gcacctgagatgtcatgaga

SEQ ID NO: 162862 - DNA, 20 bp, Artificial Sequence
  chemically synthesized
cctgagatgtcatgagagag

SEQ ID NO: 162863 - DNA, 20 bp, Artificial Sequence
  chemically synthesized
agatgtcatgagagagtgga

SEQ ID NO: 162864 - DNA, 20 bp, Artificial Sequence
  chemically synthesized
gatgtcatgagagagtggac

SEQ ID NO: 162865 - DNA, 20 bp, Artificial Sequence
  chemically synthesized
gagagtggacaggtgctgca

SEQ ID NO: 162866 - DNA, 20 bp, Artificial Sequence
  chemically synthesized
tccaagagctattcactttg

SEQ ID NO: 162867 - DNA, 20 bp, Artificial Sequence
  chemically synthesized
gacaggtgctgcaaagtgaa

SEQ ID NO: 162868 - DNA, 20 bp, Artificial Sequence
  chemically synthesized
gctgcaaagtgaatagctct

SEQ ID NO: 162869 - DNA, 20 bp, Artificial Sequence
  chemically synthesized
caaagtgaatagctcttgga

SEQ ID NO: 162870 - DNA, 20 bp, Artificial Sequence
  chemically synthesized
gcacccagggagccatccaa

SEQ ID NO: 162871 - DNA, 20 bp, Artificial Sequence
  chemically synthesized
aagcacccagggagccatcc

SEQ ID NO: 162872 - DNA, 20 bp, Artificial Sequence
  chemically synthesized
atagctcttggatggctccc

SEQ ID NO: 162873 - DNA, 20 bp, Artificial Sequence
  chemically synthesized
tagctcttggatggctccct

SEQ ID NO: 162874 - DNA, 20 bp, Artificial Sequence
  chemically synthesized
caatctctgaagcacccagg

SEQ ID NO: 162875 - DNA, 20 bp, Artificial Sequence
  chemically synthesized
agcaatctctgaagcaccca

SEQ ID NO: 162876 - DNA, 20 bp, Artificial Sequence
  chemically synthesized
tagcaatctctgaagcaccc

SEQ ID NO: 162877 - DNA, 20 bp, Artificial Sequence
  chemically synthesized
ggatggctccctgggtgctt

SEQ ID NO: 162878 - DNA, 20 bp, Artificial Sequence
  chemically synthesized
gtagcaatctctgaagcacc

SEQ ID NO: 162879 - DNA, 20 bp, Artificial Sequence
  chemically synthesized
atggctccctgggtgcttca

SEQ ID NO: 162880 - DNA, 20 bp, Artificial Sequence
  chemically synthesized
agtatgcgtagcaatctctg

SEQ ID NO: 162881 - DNA, 20 bp, Artificial Sequence
  chemically synthesized
tttagtaggatgagtatgcg

SEQ ID NO: 162882 - DNA, 20 bp, Artificial Sequence
  chemically synthesized
gtatctctctttagtaggat

SEQ ID NO: 162883 - DNA, 20 bp, Artificial Sequence
  chemically synthesized
tacgcatactcatcctacta

SEQ ID NO: 162884 - DNA, 20 bp, Artificial Sequence
  chemically synthesized
cgcatactcatcctactaaa

SEQ ID NO: 162885 - DNA, 20 bp, Artificial Sequence
  chemically synthesized
atcgggtatctctctttagt

SEQ ID NO: 162886 - DNA, 20 bp, Artificial Sequence
  chemically synthesized
catactcatcctactaaaga

SEQ ID NO: 162887 - DNA, 20 bp, Artificial Sequence
  chemically synthesized
catcgggtatctctctttag

SEQ ID NO: 162888 - DNA, 20 bp, Artificial Sequence
  chemically synthesized
tagcatcgggtatctctctt

SEQ ID NO: 162889 - DNA, 20 bp, Artificial Sequence
  chemically synthesized
cttagcaggaaggtagcatc

SEQ ID NO: 162890 - DNA, 20 bp, Artificial Sequence
  chemically synthesized
gcttagcaggaaggtagcat

SEQ ID NO: 162891 - DNA, 20 bp, Artificial Sequence
  chemically synthesized
aatatagcttagcaggaagg

SEQ ID NO: 162892 - DNA, 20 bp, Artificial Sequence
  chemically synthesized
cccgatgctaccttcctgct

SEQ ID NO: 162893 - DNA, 20 bp, Artificial Sequence
  chemically synthesized
aggaatatagcttagcagga

SEQ ID NO: 162894 - DNA, 20 bp, Artificial Sequence
  chemically synthesized
taggaatatagcttagcagg

SEQ ID NO: 162895 - DNA, 20 bp, Artificial Sequence
  chemically synthesized
atataggaatatagcttagc

SEQ ID NO: 162896 - DNA, 20 bp, Artificial Sequence
  chemically synthesized
gatataggaatatagcttag

SEQ ID NO: 162897 - DNA, 20 bp, Artificial Sequence
  chemically synthesized
aaggatataggaatatagct

SEQ ID NO: 162898 - DNA, 20 bp, Artificial Sequence
  chemically synthesized
cttagaaggatataggaata

SEQ ID NO: 162899 - DNA, 20 bp, Artificial Sequence
  chemically synthesized
aaaggcacttagaaggatat

SEQ ID NO: 162900 - DNA, 20 bp, Artificial Sequence
  chemically synthesized
caaaggcacttagaaggata

SEQ ID NO: 162901 - DNA, 20 bp, Artificial Sequence
  chemically synthesized
ctatattcctatatccttct

SEQ ID NO: 162902 - DNA, 20 bp, Artificial Sequence
  chemically synthesized
cagtagcaaaggcacttaga

SEQ ID NO: 162903 - DNA, 20 bp, Artificial Sequence
  chemically synthesized
tcagtagcaaaggcacttag

SEQ ID NO: 162904 - DNA, 20 bp, Artificial Sequence
  chemically synthesized
cattcagtagcaaaggcact

SEQ ID NO: 162905 - DNA, 20 bp, Artificial Sequence
  chemically synthesized
atgaccacattcagtagcaa

SEQ ID NO: 162906 - DNA, 20 bp, Artificial Sequence
  chemically synthesized
tatgaccacattcagtagca

SEQ ID NO: 162907 - DNA, 20 bp, Artificial Sequence
  chemically synthesized
agtgcctttgctactgaatg

SEQ ID NO: 162908 - DNA, 20 bp, Artificial Sequence
  chemically synthesized
aatactatgaccacattcag

SEQ ID NO: 162909 - DNA, 20 bp, Artificial Sequence
  chemically synthesized
aacaatactatgaccacatt

SEQ ID NO: 162910 - DNA, 20 bp, Artificial Sequence
  chemically synthesized
tttgctactgaatgtggtca

SEQ ID NO: 162911 - DNA, 20 bp, Artificial Sequence
  chemically synthesized
aatgtggtcatagtattgtt

SEQ ID NO: 162912 - DNA, 20 bp, Artificial Sequence
  chemically synthesized
tgttcagttgcacctaatca

SEQ ID NO: 162913 - DNA, 20 bp, Artificial Sequence
  chemically synthesized
acagtaagtcttctttgatt

SEQ ID NO: 162914 - DNA, 20 bp, Artificial Sequence
  chemically synthesized
tcagttgcacctaatcaaag

SEQ ID NO: 162915 - DNA, 20 bp, Artificial Sequence
  chemically synthesized
aacagtaagtcttctttgat

SEQ ID NO: 162916 - DNA, 20 bp, Artificial Sequence
  chemically synthesized
ttattgtaaaacacaacagt

SEQ ID NO: 162917 - DNA, 20 bp, Artificial Sequence
  chemically synthesized
ttgattattgtaaaacacaa

SEQ ID NO: 162918 - DNA, 20 bp, Artificial Sequence
  chemically synthesized
gttttacaataatcaattat

SEQ ID NO: 162919 - DNA, 20 bp, Artificial Sequence
  chemically synthesized
aacctgttgaaataaaatgt

SEQ ID NO: 162920 - DNA, 20 bp, Artificial Sequence
  chemically synthesized
agactcacattttatttcaa

SEQ ID NO: 162921 - DNA, 20 bp, Artificial Sequence
  chemically synthesized
gactcacattttatttcaac

SEQ ID NO: 162922 - DNA, 20 bp, Artificial Sequence
  chemically synthesized
cacattttatttcaacaggt

SEQ ID NO: 162923 - DNA, 20 bp, Artificial Sequence
  chemically synthesized
aacgtgtcccaatttcagag

SEQ ID NO: 162924 - DNA, 20 bp, Artificial Sequence
  chemically synthesized
caggttagctgctctgaaat

SEQ ID NO: 162925 - DNA, 20 bp, Artificial Sequence
  chemically synthesized
aggttagctgctctgaaatt

SEQ ID NO: 162926 - DNA, 20 bp, Artificial Sequence
  chemically synthesized
taaaacgtgtcccaatttca

SEQ ID NO: 162927 - DNA, 20 bp, Artificial Sequence
  chemically synthesized
tataaaacgtgtcccaattt

SEQ ID NO: 162928 - DNA, 20 bp, Artificial Sequence
  chemically synthesized
gggacacgttttataaatga

SEQ ID NO: 162929 - DNA, 20 bp, Artificial Sequence
  chemically synthesized
ttataaatgatagcgtgtca

SEQ ID NO: 162930 - DNA, 20 bp, Artificial Sequence
  chemically synthesized
tagcgtgtcatagtctaaaa

SEQ ID NO: 162931 - DNA, 20 bp, Artificial Sequence
  chemically synthesized
cgtgtcatagtctaaaacgg

SEQ ID NO: 162932 - DNA, 20 bp, Artificial Sequence
  chemically synthesized
agaaaaatgtgctgccgttt

SEQ ID NO: 162933 - DNA, 20 bp, Artificial Sequence
  chemically synthesized
aaacggcagcacatttttct

SEQ ID NO: 162934 - DNA, 20 bp, Artificial Sequence
  chemically synthesized
ttgttattttatttttcacc

SEQ ID NO: 162935 - DNA, 20 bp, Artificial Sequence
  chemically synthesized
acaatgcatactctaatcaa

SEQ ID NO: 162936 - DNA, 20 bp, Artificial Sequence
  chemically synthesized
ttttaagataccattgatta

SEQ ID NO: 162937 - DNA, 20 bp, Artificial Sequence
  chemically synthesized
gtttttaagataccattgat

SEQ ID NO: 162938 - DNA, 20 bp, Artificial Sequence
  chemically synthesized
aatcaatggtatcttaaaaa

SEQ ID NO: 162939 - DNA, 20 bp, Artificial Sequence
  chemically synthesized
ttccatattttactgttttt

SEQ ID NO: 162940 - DNA, 20 bp, Artificial Sequence
  chemically synthesized
atcttaaaaacagtaaaata

SEQ ID NO: 162941 - DNA, 20 bp, Artificial Sequence
  chemically synthesized
taaaaacagtaaaatatgga

SEQ ID NO: 162942 - DNA, 20 bp, Artificial Sequence
  chemically synthesized
agtaaaatatggaaagtgat

SEQ ID NO: 162943 - DNA, 20 bp, Artificial Sequence
  chemically synthesized
gtaaaatatggaaagtgatc

SEQ ID NO: 162944 - DNA, 20 bp, Artificial Sequence
  chemically synthesized
gaaagtgatcaggcttttca

SEQ ID NO: 162945 - DNA, 20 bp, Artificial Sequence
  chemically synthesized
agtgatcaggcttttcatag

SEQ ID NO: 162946 - DNA, 20 bp, Artificial Sequence
  chemically synthesized
tcatcctgacctactatgaa

SEQ ID NO: 162947 - DNA, 20 bp, Artificial Sequence
  chemically synthesized
gtgatcaggcttttcatagt

SEQ ID NO: 162948 - DNA, 20 bp, Artificial Sequence
  chemically synthesized
tcaggcttttcatagtaggt

SEQ ID NO: 162949 - DNA, 20 bp, Artificial Sequence
  chemically synthesized
caggcttttcatagtaggtc

SEQ ID NO: 162950 - DNA, 20 bp, Artificial Sequence
  chemically synthesized
taggtcaggatgaaatgatt

SEQ ID NO: 162951 - DNA, 20 bp, Artificial Sequence
  chemically synthesized
gaaatgatttagtacatgta

SEQ ID NO: 162952 - DNA, 20 bp, Artificial Sequence
  chemically synthesized
aaatgatttagtacatgtaa

SEQ ID NO: 162953 - DNA, 20 bp, Artificial Sequence
  chemically synthesized
cagtttccaacaaatggtag

SEQ ID NO: 162954 - DNA, 20 bp, Artificial Sequence
  chemically synthesized
agtcagtttccaacaaatgg

SEQ ID NO: 162955 - DNA, 20 bp, Artificial Sequence
  chemically synthesized
gtaatactgctaccatttgt

SEQ ID NO: 162956 - DNA, 20 bp, Artificial Sequence
  chemically synthesized
cttagtcagtttccaacaaa

SEQ ID NO: 162957 - DNA, 20 bp, Artificial Sequence
  chemically synthesized
ccatttgttggaaactgact

SEQ ID NO: 162958 - DNA, 20 bp, Artificial Sequence
  chemically synthesized
gcagagtgtttgcacttagt

SEQ ID NO: 162959 - DNA, 20 bp, Artificial Sequence
  chemically synthesized
catagcagagtgtttgcact

SEQ ID NO: 162960 - DNA, 20 bp, Artificial Sequence
  chemically synthesized
tttatgttaagtgcatagca

SEQ ID NO: 162961 - DNA, 20 bp, Artificial Sequence
  chemically synthesized
gatttatgttaagtgcatag

SEQ ID NO: 162962 - DNA, 20 bp, Artificial Sequence
  chemically synthesized
gatgatttatgttaagtgca

SEQ ID NO: 162963 - DNA, 20 bp, Artificial Sequence
  chemically synthesized
taattaagatgatttatgtt

SEQ ID NO: 162964 - DNA, 20 bp, Artificial Sequence
  chemically synthesized
aatggagattgagattaatt

SEQ ID NO: 162965 - DNA, 20 bp, Artificial Sequence
  chemically synthesized
gaggctctgcaatggagatt

SEQ ID NO: 162966 - DNA, 20 bp, Artificial Sequence
  chemically synthesized
attaatctcaatctccattg

SEQ ID NO: 162967 - DNA, 20 bp, Artificial Sequence
  chemically synthesized
taatctcaatctccattgca

SEQ ID NO: 162968 - DNA, 20 bp, Artificial Sequence
  chemically synthesized
tgctgagaggctctgcaatg

SEQ ID NO: 162969 - DNA, 20 bp, Artificial Sequence
  chemically synthesized
attgctgagaggctctgcaa

SEQ ID NO: 162970 - DNA, 20 bp, Artificial Sequence
  chemically synthesized
atctccattgcagagcctct

SEQ ID NO: 162971 - DNA, 20 bp, Artificial Sequence
  chemically synthesized
atggtaatagtattgctgag

SEQ ID NO: 162972 - DNA, 20 bp, Artificial Sequence
  chemically synthesized
aatggtaatagtattgctga

SEQ ID NO: 162973 - DNA, 20 bp, Artificial Sequence
  chemically synthesized
aaaatggtaatagtattgct

SEQ ID NO: 162974 - DNA, 20 bp, Artificial Sequence
  chemically synthesized
ttaatctgaaaaaatggtaa

SEQ ID NO: 162975 - DNA, 20 bp, Artificial Sequence
  chemically synthesized
caatactattaccatttttt

SEQ ID NO: 162976 - DNA, 20 bp, Artificial Sequence
  chemically synthesized
agttttttaatctgaaaaaa

SEQ ID NO: 162977 - DNA, 20 bp, Artificial Sequence
  chemically synthesized
attttttcagattaaaaaac

SEQ ID NO: 162978 - DNA, 20 bp, Artificial Sequence
  chemically synthesized
tttttcagattaaaaaacta

SEQ ID NO: 162979 - DNA, 20 bp, Artificial Sequence
  chemically synthesized
tttctgacctttcgtgactc

SEQ ID NO: 162980 - DNA, 20 bp, Artificial Sequence
  chemically synthesized
ttaaaaaactagagtcacga

SEQ ID NO: 162981 - DNA, 20 bp, Artificial Sequence
  chemically synthesized
taaaaaactagagtcacgaa

SEQ ID NO: 162982 - DNA, 20 bp, Artificial Sequence
  chemically synthesized
aaactagagtcacgaaaggt

SEQ ID NO: 162983 - DNA, 20 bp, Artificial Sequence
  chemically synthesized
cgaaaggtcagaaacttgcc

SEQ ID NO: 162984 - DNA, 20 bp, Artificial Sequence
  chemically synthesized
gaaaggtcagaaacttgcct

SEQ ID NO: 162985 - DNA, 20 bp, Artificial Sequence
  chemically synthesized
aaaggtcagaaacttgccta

SEQ ID NO: 162986 - DNA, 20 bp, Artificial Sequence
  chemically synthesized
tgttaggttgtgccctaggc

SEQ ID NO: 162987 - DNA, 20 bp, Artificial Sequence
  chemically synthesized
catatgttaggttgtgccct

SEQ ID NO: 162988 - DNA, 20 bp, Artificial Sequence
  chemically synthesized
ccatatgttaggttgtgccc

SEQ ID NO: 162989 - DNA, 20 bp, Artificial Sequence
  chemically synthesized
ctagggcacaacctaacata

SEQ ID NO: 162990 - DNA, 20 bp, Artificial Sequence
  chemically synthesized
tctcagattcaccatatgtt

SEQ ID NO: 162991 - DNA, 20 bp, Artificial Sequence
  chemically synthesized
atctcagattcaccatatgt

SEQ ID NO: 162992 - DNA, 20 bp, Artificial Sequence
  chemically synthesized
acctaacatatggtgaatct

SEQ ID NO: 162993 - DNA, 20 bp, Artificial Sequence
  chemically synthesized
aaagactagggttcaaatct

SEQ ID NO: 162994 - DNA, 20 bp, Artificial Sequence
  chemically synthesized
tgaatctgagatttgaaccc

SEQ ID NO: 162995 - DNA, 20 bp, Artificial Sequence
  chemically synthesized
gatttgcctcagaaagacta

SEQ ID NO: 162996 - DNA, 20 bp, Artificial Sequence
  chemically synthesized
ggatttgcctcagaaagact

SEQ ID NO: 162997 - DNA, 20 bp, Artificial Sequence
  chemically synthesized
aggatttgcctcagaaagac

SEQ ID NO: 162998 - DNA, 20 bp, Artificial Sequence
  chemically synthesized
atttgaaccctagtctttct

SEQ ID NO: 162999 - DNA, 20 bp, Artificial Sequence
  chemically synthesized
tttgaaccctagtctttctg

SEQ ID NO: 163000 - DNA, 20 bp, Artificial Sequence
  chemically synthesized
tatgcaggatttgcctcaga

SEQ ID NO: 163001 - DNA, 20 bp, Artificial Sequence
  chemically synthesized
tatgtatgcaggatttgcct

SEQ ID NO: 163002 - DNA, 20 bp, Artificial Sequence
  chemically synthesized
agcatagtaattatgtatgc

SEQ ID NO: 163003 - DNA, 20 bp, Artificial Sequence
  chemically synthesized
tagcatagtaattatgtatg

SEQ ID NO: 163004 - DNA, 20 bp, Artificial Sequence
  chemically synthesized
catacataattactatgcta

SEQ ID NO: 163005 - DNA, 20 bp, Artificial Sequence
  chemically synthesized
atacataattactatgctac

SEQ ID NO: 163006 - DNA, 20 bp, Artificial Sequence
  chemically synthesized
tacataattactatgctaca

SEQ ID NO: 163007 - DNA, 20 bp, Artificial Sequence
  chemically synthesized
aatccagagaccctgtagca

SEQ ID NO: 163008 - DNA, 20 bp, Artificial Sequence
  chemically synthesized
atttaaatccagagaccctg

SEQ ID NO: 163009 - DNA, 20 bp, Artificial Sequence
  chemically synthesized
ttactatgctacagggtctc

SEQ ID NO: 163010 - DNA, 20 bp, Artificial Sequence
  chemically synthesized
tggtacaatatttaaatcca

SEQ ID NO: 163011 - DNA, 20 bp, Artificial Sequence
  chemically synthesized
attggtacaatatttaaatc

SEQ ID NO: 163012 - DNA, 20 bp, Artificial Sequence
  chemically synthesized
ttaaatattgtaccaataaa

SEQ ID NO: 163013 - DNA, 20 bp, Artificial Sequence
  chemically synthesized
aaataaaacctactttttat

SEQ ID NO: 163014 - DNA, 20 bp, Artificial Sequence
  chemically synthesized
aatattgtaccaataaaaag

SEQ ID NO: 163015 - DNA, 20 bp, Artificial Sequence
  chemically synthesized
atattgtaccaataaaaagt

SEQ ID NO: 163016 - DNA, 20 bp, Artificial Sequence
  chemically synthesized
gttttatttgatgaatccta

SEQ ID NO: 163017 - DNA, 20 bp, Artificial Sequence
  chemically synthesized
atttgatgaatcctacggct

SEQ ID NO: 163018 - DNA, 20 bp, Artificial Sequence
  chemically synthesized
tttgttccgttctgagccgt

SEQ ID NO: 163019 - DNA, 20 bp, Artificial Sequence
  chemically synthesized
ctttgttccgttctgagccg

SEQ ID NO: 163020 - DNA, 20 bp, Artificial Sequence
  chemically synthesized
atgaatcctacggctcagaa

SEQ ID NO: 163021 - DNA, 20 bp, Artificial Sequence
  chemically synthesized
aaactactttgttccgttct

SEQ ID NO: 163022 - DNA, 20 bp, Artificial Sequence
  chemically synthesized
ctacggctcagaacggaaca

SEQ ID NO: 163023 - DNA, 20 bp, Artificial Sequence
  chemically synthesized
cggctcagaacggaacaaag

SEQ ID NO: 163024 - DNA, 20 bp, Artificial Sequence
  chemically synthesized
cggaacaaagtagtttcgat

SEQ ID NO: 163025 - DNA, 20 bp, Artificial Sequence
  chemically synthesized
ggaacaaagtagtttcgatt

SEQ ID NO: 163026 - DNA, 20 bp, Artificial Sequence
  chemically synthesized
tttcgattaggatgtaatgt

SEQ ID NO: 163027 - DNA, 20 bp, Artificial Sequence
  chemically synthesized
gatgtaatgtgagtttcaat

SEQ ID NO: 163028 - DNA, 20 bp, Artificial Sequence
  chemically synthesized
atgtaatgtgagtttcaatc

SEQ ID NO: 163029 - DNA, 20 bp, Artificial Sequence
  chemically synthesized
tgtaatgtgagtttcaatca

SEQ ID NO: 163030 - DNA, 20 bp, Artificial Sequence
  chemically synthesized
gagtttcaatcagggtttct

SEQ ID NO: 163031 - DNA, 20 bp, Artificial Sequence
  chemically synthesized
caatcagggtttctcagctt

SEQ ID NO: 163032 - DNA, 20 bp, Artificial Sequence
  chemically synthesized
atggcaatagggctgaagct

SEQ ID NO: 163033 - DNA, 20 bp, Artificial Sequence
  chemically synthesized
cccaaatggcaatagggctg

SEQ ID NO: 163034 - DNA, 20 bp, Artificial Sequence
  chemically synthesized
tccagtcccaaatggcaata

SEQ ID NO: 163035 - DNA, 20 bp, Artificial Sequence
  chemically synthesized
atccagtcccaaatggcaat

SEQ ID NO: 163036 - DNA, 20 bp, Artificial Sequence
  chemically synthesized
tatccagtcccaaatggcaa

SEQ ID NO: 163037 - DNA, 20 bp, Artificial Sequence
  chemically synthesized
gcttcagccctattgccatt

SEQ ID NO: 163038 - DNA, 20 bp, Artificial Sequence
  chemically synthesized
cttcagccctattgccattt

SEQ ID NO: 163039 - DNA, 20 bp, Artificial Sequence
  chemically synthesized
aataattatccagtcccaaa

SEQ ID NO: 163040 - DNA, 20 bp, Artificial Sequence
  chemically synthesized
gccctattgccatttgggac

SEQ ID NO: 163041 - DNA, 20 bp, Artificial Sequence
  chemically synthesized
cccgacaagaaataattatc

SEQ ID NO: 163042 - DNA, 20 bp, Artificial Sequence
  chemically synthesized
actggataattatttcttgt

SEQ ID NO: 163043 - DNA, 20 bp, Artificial Sequence
  chemically synthesized
ctggataattatttcttgtc

SEQ ID NO: 163044 - DNA, 20 bp, Artificial Sequence
  chemically synthesized
ggataattatttcttgtcgg

SEQ ID NO: 163045 - DNA, 20 bp, Artificial Sequence
  chemically synthesized
tacacagggtagctcccgac

SEQ ID NO: 163046 - DNA, 20 bp, Artificial Sequence
  chemically synthesized
acaccctgcagtacacaggg

SEQ ID NO: 163047 - DNA, 20 bp, Artificial Sequence
  chemically synthesized
aaaacaccctgcagtacaca

SEQ ID NO: 163048 - DNA, 20 bp, Artificial Sequence
  chemically synthesized
caaaacaccctgcagtacac

SEQ ID NO: 163049 - DNA, 20 bp, Artificial Sequence
  chemically synthesized
gggagctaccctgtgtactg

SEQ ID NO: 163050 - DNA, 20 bp, Artificial Sequence
  chemically synthesized
gcaaaacaccctgcagtaca

SEQ ID NO: 163051 - DNA, 20 bp, Artificial Sequence
  chemically synthesized
ggagctaccctgtgtactgc

SEQ ID NO: 163052 - DNA, 20 bp, Artificial Sequence
  chemically synthesized
gagctaccctgtgtactgca

SEQ ID NO: 163053 - DNA, 20 bp, Artificial Sequence
  chemically synthesized
gcatgctgcaaaacaccctg

SEQ ID NO: 163054 - DNA, 20 bp, Artificial Sequence
  chemically synthesized
gtgtactgcagggtgttttg

SEQ ID NO: 163055 - DNA, 20 bp, Artificial Sequence
  chemically synthesized
agggtgttttgcagcatgcc

SEQ ID NO: 163056 - DNA, 20 bp, Artificial Sequence
  chemically synthesized
gcatcttgtgcatagtgacc

SEQ ID NO: 163057 - DNA, 20 bp, Artificial Sequence
  chemically synthesized
ggcatcttgtgcatagtgac

SEQ ID NO: 163058 - DNA, 20 bp, Artificial Sequence
  chemically synthesized
catgcctggtcactatgcac

SEQ ID NO: 163059 - DNA, 20 bp, Artificial Sequence
  chemically synthesized
tgctactggcatcttgtgca

SEQ ID NO: 163060 - DNA, 20 bp, Artificial Sequence
  chemically synthesized
ggtcactatgcacaagatgc

SEQ ID NO: 163061 - DNA, 20 bp, Artificial Sequence
  chemically synthesized
cactatgcacaagatgccag

SEQ ID NO: 163062 - DNA, 20 bp, Artificial Sequence
  chemically synthesized
gggggaggagaaagtgctac

SEQ ID NO: 163063 - DNA, 20 bp, Artificial Sequence
  chemically synthesized
gtcacacatgggggaggaga

SEQ ID NO: 163064 - DNA, 20 bp, Artificial Sequence
  chemically synthesized
ggttgtcacacatgggggag

SEQ ID NO: 163065 - DNA, 20 bp, Artificial Sequence
  chemically synthesized
gtggttgtcacacatggggg

SEQ ID NO: 163066 - DNA, 20 bp, Artificial Sequence
  chemically synthesized
tgtggttgtcacacatgggg

SEQ ID NO: 163067 - DNA, 20 bp, Artificial Sequence
  chemically synthesized
tttgtggttgtcacacatgg

SEQ ID NO: 163068 - DNA, 20 bp, Artificial Sequence
  chemically synthesized
atttgtggttgtcacacatg

SEQ ID NO: 163069 - DNA, 20 bp, Artificial Sequence
  chemically synthesized
tatttgtggttgtcacacat

SEQ ID NO: 163070 - DNA, 20 bp, Artificial Sequence
  chemically synthesized
atatttgtggttgtcacaca

SEQ ID NO: 163071 - DNA, 20 bp, Artificial Sequence
  chemically synthesized
gcaattgctggagatatttg

SEQ ID NO: 163072 - DNA, 20 bp, Artificial Sequence
  chemically synthesized
gtgacaaccacaaatatctc

SEQ ID NO: 163073 - DNA, 20 bp, Artificial Sequence
  chemically synthesized
ggggaatttggcaattgctg

SEQ ID NO: 163074 - DNA, 20 bp, Artificial Sequence
  chemically synthesized
caggggaatttggcaattgc

SEQ ID NO: 163075 - DNA, 20 bp, Artificial Sequence
  chemically synthesized
cagatgattccaggggaatt

SEQ ID NO: 163076 - DNA, 20 bp, Artificial Sequence
  chemically synthesized
cagcaattgccaaattcccc

SEQ ID NO: 163077 - DNA, 20 bp, Artificial Sequence
  chemically synthesized
tctaccacagatgattccag

SEQ ID NO: 163078 - DNA, 20 bp, Artificial Sequence
  chemically synthesized
ctctaccacagatgattcca

SEQ ID NO: 163079 - DNA, 20 bp, Artificial Sequence
  chemically synthesized
tctctaccacagatgattcc

SEQ ID NO: 163080 - DNA, 20 bp, Artificial Sequence
  chemically synthesized
ttctctaccacagatgattc

SEQ ID NO: 163081 - DNA, 20 bp, Artificial Sequence
  chemically synthesized
aattcccctggaatcatctg

SEQ ID NO: 163082 - DNA, 20 bp, Artificial Sequence
  chemically synthesized
tcccctggaatcatctgtgg

SEQ ID NO: 163083 - DNA, 20 bp, Artificial Sequence
  chemically synthesized
ccctggaatcatctgtggta

SEQ ID NO: 163084 - DNA, 20 bp, Artificial Sequence
  chemically synthesized
aatagaatgcttctctacca

SEQ ID NO: 163085 - DNA, 20 bp, Artificial Sequence
  chemically synthesized
tggaatcatctgtggtagag

SEQ ID NO: 163086 - DNA, 20 bp, Artificial Sequence
  chemically synthesized
ttccttcatgtattcaataa

SEQ ID NO: 163087 - DNA, 20 bp, Artificial Sequence
  chemically synthesized
attctattattgaatacatg

SEQ ID NO: 163088 - DNA, 20 bp, Artificial Sequence
  chemically synthesized
ttctattattgaatacatga

SEQ ID NO: 163089 - DNA, 20 bp, Artificial Sequence
  chemically synthesized
atacatgaaggaacaaatga

SEQ ID NO: 163090 - DNA, 20 bp, Artificial Sequence
  chemically synthesized
aatgaaagaatgtctgttca

SEQ ID NO: 163091 - DNA, 20 bp, Artificial Sequence
  chemically synthesized
ctgaaaatacagaccgtgaa

SEQ ID NO: 163092 - DNA, 20 bp, Artificial Sequence
  chemically synthesized
ctgttcacggtctgtatttt

SEQ ID NO: 163093 - DNA, 20 bp, Artificial Sequence
  chemically synthesized
attcatgtacactgaaaata

SEQ ID NO: 163094 - DNA, 20 bp, Artificial Sequence
  chemically synthesized
tatataagagaaaggaagga

SEQ ID NO: 163095 - DNA, 20 bp, Artificial Sequence
  chemically synthesized
gttgtatataagagaaagga

SEQ ID NO: 163096 - DNA, 20 bp, Artificial Sequence
  chemically synthesized
tgttgtatataagagaaagg

SEQ ID NO: 163097 - DNA, 20 bp, Artificial Sequence
  chemically synthesized
caatgttgtatataagagaa

SEQ ID NO: 163098 - DNA, 20 bp, Artificial Sequence
  chemically synthesized
acaatgttgtatataagaga

SEQ ID NO: 163099 - DNA, 20 bp, Artificial Sequence
  chemically synthesized
acatacaatgttgtatataa

SEQ ID NO: 163100 - DNA, 20 bp, Artificial Sequence
  chemically synthesized
ttacatacaatgttgtatat

SEQ ID NO: 163101 - DNA, 20 bp, Artificial Sequence
  chemically synthesized
catctgaaagagtatatgaa

SEQ ID NO: 163102 - DNA, 20 bp, Artificial Sequence
  chemically synthesized
catctgttcatatactcttt

SEQ ID NO: 163103 - DNA, 20 bp, Artificial Sequence
  chemically synthesized
tgataaaagtgcatctgaaa

SEQ ID NO: 163104 - DNA, 20 bp, Artificial Sequence
  chemically synthesized
cgtgataaaagtgcatctga

SEQ ID NO: 163105 - DNA, 20 bp, Artificial Sequence
  chemically synthesized
taagagacatagcgtgataa

SEQ ID NO: 163106 - DNA, 20 bp, Artificial Sequence
  chemically synthesized
caaatgaatgttaagagaca

SEQ ID NO: 163107 - DNA, 20 bp, Artificial Sequence
  chemically synthesized
cacactcaaatgaatgttaa

SEQ ID NO: 163108 - DNA, 20 bp, Artificial Sequence
  chemically synthesized
accacactcaaatgaatgtt

SEQ ID NO: 163109 - DNA, 20 bp, Artificial Sequence
  chemically synthesized
atgtctcttaacattcattt

SEQ ID NO: 163110 - DNA, 20 bp, Artificial Sequence
  chemically synthesized
tcttaacattcatttgagtg

SEQ ID NO: 163111 - DNA, 20 bp, Artificial Sequence
  chemically synthesized
ccatgatggttagaattcat

SEQ ID NO: 163112 - DNA, 20 bp, Artificial Sequence
  chemically synthesized
ctgatgaattctaaccatca

SEQ ID NO: 163113 - DNA, 20 bp, Artificial Sequence
  chemically synthesized
ctgaaacatgccatgatggt

SEQ ID NO: 163114 - DNA, 20 bp, Artificial Sequence
  chemically synthesized
gaaactgaaacatgccatga

SEQ ID NO: 163115 - DNA, 20 bp, Artificial Sequence
  chemically synthesized
ctaaccatcatggcatgttt

SEQ ID NO: 163116 - DNA, 20 bp, Artificial Sequence
  chemically synthesized
tcatggcatgtttcagtttc

SEQ ID NO: 163117 - DNA, 20 bp, Artificial Sequence
  chemically synthesized
tgtttcagtttctggctgaa

SEQ ID NO: 163118 - DNA, 20 bp, Artificial Sequence
  chemically synthesized
gtttcagtttctggctgaat

SEQ ID NO: 163119 - DNA, 20 bp, Artificial Sequence
  chemically synthesized
gatattaggacccattcagc

SEQ ID NO: 163120 - DNA, 20 bp, Artificial Sequence
  chemically synthesized
cagagatattaggacccatt

SEQ ID NO: 163121 - DNA, 20 bp, Artificial Sequence
  chemically synthesized
gtatataatccagagatatt

SEQ ID NO: 163122 - DNA, 20 bp, Artificial Sequence
  chemically synthesized
tgaatgggtcctaatatctc

SEQ ID NO: 163123 - DNA, 20 bp, Artificial Sequence
  chemically synthesized
ggtatataatccagagatat

SEQ ID NO: 163124 - DNA, 20 bp, Artificial Sequence
  chemically synthesized
cttttggggtatataatcca

SEQ ID NO: 163125 - DNA, 20 bp, Artificial Sequence
  chemically synthesized
tccttttggggtatataatc

SEQ ID NO: 163126 - DNA, 20 bp, Artificial Sequence
  chemically synthesized
ctctggattatataccccaa

SEQ ID NO: 163127 - DNA, 20 bp, Artificial Sequence
  chemically synthesized
tctggattatataccccaaa

SEQ ID NO: 163128 - DNA, 20 bp, Artificial Sequence
  chemically synthesized
tgtattccctaatccttttg

SEQ ID NO: 163129 - DNA, 20 bp, Artificial Sequence
  chemically synthesized
ctgtattccctaatcctttt

SEQ ID NO: 163130 - DNA, 20 bp, Artificial Sequence
  chemically synthesized
attatataccccaaaaggat

SEQ ID NO: 163131 - DNA, 20 bp, Artificial Sequence
  chemically synthesized
actgtattccctaatccttt

SEQ ID NO: 163132 - DNA, 20 bp, Artificial Sequence
  chemically synthesized
ttatataccccaaaaggatt

SEQ ID NO: 163133 - DNA, 20 bp, Artificial Sequence
  chemically synthesized
tatataccccaaaaggatta

SEQ ID NO: 163134 - DNA, 20 bp, Artificial Sequence
  chemically synthesized
cccaaaaggattagggaata

SEQ ID NO: 163135 - DNA, 20 bp, Artificial Sequence
  chemically synthesized
aaaaggattagggaatacag

SEQ ID NO: 163136 - DNA, 20 bp, Artificial Sequence
  chemically synthesized
ttagggaatacagtagatct

SEQ ID NO: 163137 - DNA, 20 bp, Artificial Sequence
  chemically synthesized
tagggaatacagtagatcta

SEQ ID NO: 163138 - DNA, 20 bp, Artificial Sequence
  chemically synthesized
aatacagtagatctaaggac

SEQ ID NO: 163139 - DNA, 20 bp, Artificial Sequence
  chemically synthesized
atatgtgcctttctagtcct

SEQ ID NO: 163140 - DNA, 20 bp, Artificial Sequence
  chemically synthesized
cagtagatctaaggactaga

SEQ ID NO: 163141 - DNA, 20 bp, Artificial Sequence
  chemically synthesized
agtagatctaaggactagaa

SEQ ID NO: 163142 - DNA, 20 bp, Artificial Sequence
  chemically synthesized
ttgtttaatatgtgcctttc

SEQ ID NO: 163143 - DNA, 20 bp, Artificial Sequence
  chemically synthesized
gaaaggcacatattaaacaa

SEQ ID NO: 163144 - DNA, 20 bp, Artificial Sequence
  chemically synthesized
gattttgacatatctctgaa

SEQ ID NO: 163145 - DNA, 20 bp, Artificial Sequence
  chemically synthesized
tttgacatatctctgaatag

SEQ ID NO: 163146 - DNA, 20 bp, Artificial Sequence
  chemically synthesized
atatcactggccactattca

SEQ ID NO: 163147 - DNA, 20 bp, Artificial Sequence
  chemically synthesized
aaatatcactggccactatt

SEQ ID NO: 163148 - DNA, 20 bp, Artificial Sequence
  chemically synthesized
acatatctctgaatagtggc

SEQ ID NO: 163149 - DNA, 20 bp, Artificial Sequence
  chemically synthesized
taaaataatgcaaatatcac

SEQ ID NO: 163150 - DNA, 20 bp, Artificial Sequence
  chemically synthesized
tgcattattttaaaccaata

SEQ ID NO: 163151 - DNA, 20 bp, Artificial Sequence
  chemically synthesized
cattattttaaaccaatata

SEQ ID NO: 163152 - DNA, 20 bp, Artificial Sequence
  chemically synthesized
aacttagagatgctctatat

SEQ ID NO: 163153 - DNA, 20 bp, Artificial Sequence
  chemically synthesized
aaccaatatagagcatctct

SEQ ID NO: 163154 - DNA, 20 bp, Artificial Sequence
  chemically synthesized
actatatggataataactta

SEQ ID NO: 163155 - DNA, 20 bp, Artificial Sequence
  chemically synthesized
ttactatatggataataact

SEQ ID NO: 163156 - DNA, 20 bp, Artificial Sequence
  chemically synthesized
tctctaagttattatccata

SEQ ID NO: 163157 - DNA, 20 bp, Artificial Sequence
  chemically synthesized
aaccatgtccaattactata

SEQ ID NO: 163158 - DNA, 20 bp, Artificial Sequence
  chemically synthesized
gttattatccatatagtaat

SEQ ID NO: 163159 - DNA, 20 bp, Artificial Sequence
  chemically synthesized
atccatatagtaattggaca

SEQ ID NO: 163160 - DNA, 20 bp, Artificial Sequence
  chemically synthesized
gtaattggacatggttcttt

SEQ ID NO: 163161 - DNA, 20 bp, Artificial Sequence
  chemically synthesized
aaatattctgttaagactta

SEQ ID NO: 163162 - DNA, 20 bp, Artificial Sequence
  chemically synthesized
catggttctttaagtcttaa

SEQ ID NO: 163163 - DNA, 20 bp, Artificial Sequence
  chemically synthesized
atttaagtaaatattctgtt

SEQ ID NO: 163164 - DNA, 20 bp, Artificial Sequence
  chemically synthesized
tgtttaataataacagattt

SEQ ID NO: 163165 - DNA, 20 bp, Artificial Sequence
  chemically synthesized
cttctagtgtttaataataa

SEQ ID NO: 163166 - DNA, 20 bp, Artificial Sequence
  chemically synthesized
aatctgttattattaaacac

SEQ ID NO: 163167 - DNA, 20 bp, Artificial Sequence
  chemically synthesized
ctgttattattaaacactag

SEQ ID NO: 163168 - DNA, 20 bp, Artificial Sequence
  chemically synthesized
tatctttaaaaagcaacttc

SEQ ID NO: 163169 - DNA, 20 bp, Artificial Sequence
  chemically synthesized
acactagaagttgcttttta

SEQ ID NO: 163170 - DNA, 20 bp, Artificial Sequence
  chemically synthesized
atggctgttttatctttaaa

SEQ ID NO: 163171 - DNA, 20 bp, Artificial Sequence
  chemically synthesized
gttgctttttaaagataaaa

SEQ ID NO: 163172 - DNA, 20 bp, Artificial Sequence
  chemically synthesized
tttaaagataaaacagccat

SEQ ID NO: 163173 - DNA, 20 bp, Artificial Sequence
  chemically synthesized
ttaaagataaaacagccatt

SEQ ID NO: 163174 - DNA, 20 bp, Artificial Sequence
  chemically synthesized
tttaatgaaaattagcctaa

SEQ ID NO: 163175 - DNA, 20 bp, Artificial Sequence
  chemically synthesized
tctttgcttttaatgaaaat

SEQ ID NO: 163176 - DNA, 20 bp, Artificial Sequence
  chemically synthesized
attaggctaattttcattaa

SEQ ID NO: 163177 - DNA, 20 bp, Artificial Sequence
  chemically synthesized
gctaattttcattaaaagca

SEQ ID NO: 163178 - DNA, 20 bp, Artificial Sequence
  chemically synthesized
ttttcattaaaagcaaagaa

SEQ ID NO: 163179 - DNA, 20 bp, Artificial Sequence
  chemically synthesized
ttcattaaaagcaaagaaaa

SEQ ID NO: 163180 - DNA, 20 bp, Artificial Sequence
  chemically synthesized
gtgcatgtcagtcatgaagt

SEQ ID NO: 163181 - DNA, 20 bp, Artificial Sequence
  chemically synthesized
taaagtgcatgtcagtcatg

SEQ ID NO: 163182 - DNA, 20 bp, Artificial Sequence
  chemically synthesized
attttatttaaagtgcatgt

SEQ ID NO: 163183 - DNA, 20 bp, Artificial Sequence
  chemically synthesized
aacatctttaattttattta

SEQ ID NO: 163184 - DNA, 20 bp, Artificial Sequence
  chemically synthesized
atgcactttaaataaaatta

SEQ ID NO: 163185 - DNA, 20 bp, Artificial Sequence
  chemically synthesized
agatgttttgtttttactat

SEQ ID NO: 163186 - DNA, 20 bp, Artificial Sequence
  chemically synthesized
gatgttttgtttttactatt

SEQ ID NO: 163187 - DNA, 20 bp, Artificial Sequence
  chemically synthesized
gattttggtacagaacctaa

SEQ ID NO: 163188 - DNA, 20 bp, Artificial Sequence
  chemically synthesized
taatgactatgattttggta

SEQ ID NO: 163189 - DNA, 20 bp, Artificial Sequence
  chemically synthesized
taggttctgtaccaaaatca

SEQ ID NO: 163190 - DNA, 20 bp, Artificial Sequence
  chemically synthesized
ttagataatgactatgattt

SEQ ID NO: 163191 - DNA, 20 bp, Artificial Sequence
  chemically synthesized
gcacttagaaagagttgttt

SEQ ID NO: 163192 - DNA, 20 bp, Artificial Sequence
  chemically synthesized
tatctaaaacaactctttct

SEQ ID NO: 163193 - DNA, 20 bp, Artificial Sequence
  chemically synthesized
gttatggtagcacttagaaa

SEQ ID NO: 163194 - DNA, 20 bp, Artificial Sequence
  chemically synthesized
tagttatggtagcacttaga

SEQ ID NO: 163195 - DNA, 20 bp, Artificial Sequence
  chemically synthesized
ttattagttatggtagcact

SEQ ID NO: 163196 - DNA, 20 bp, Artificial Sequence
  chemically synthesized
cttgagtttattagttatgg

SEQ ID NO: 163197 - DNA, 20 bp, Artificial Sequence
  chemically synthesized
ttgcttgagtttattagtta

SEQ ID NO: 163198 - DNA, 20 bp, Artificial Sequence
  chemically synthesized
atttgattgcttgagtttat

SEQ ID NO: 163199 - DNA, 20 bp, Artificial Sequence
  chemically synthesized
ctaccataactaataaactc

SEQ ID NO: 163200 - DNA, 20 bp, Artificial Sequence
  chemically synthesized
aattacccatttgattgctt

SEQ ID NO: 163201 - DNA, 20 bp, Artificial Sequence
  chemically synthesized
aataaactcaagcaatcaaa

SEQ ID NO: 163202 - DNA, 20 bp, Artificial Sequence
  chemically synthesized
ataaactcaagcaatcaaat

SEQ ID NO: 163203 - DNA, 20 bp, Artificial Sequence
  chemically synthesized
gtttttttttaaaaaaatac

SEQ ID NO: 163204 - DNA, 20 bp, Artificial Sequence
  chemically synthesized
cgtatttttttaaaaaaaaa

SEQ ID NO: 163205 - DNA, 20 bp, Artificial Sequence
  chemically synthesized
agtattcagaagagagaatg

SEQ ID NO: 163206 - DNA, 20 bp, Artificial Sequence
  chemically synthesized
taggaagagtattcagaaga

SEQ ID NO: 163207 - DNA, 20 bp, Artificial Sequence
  chemically synthesized
tttaggaagagtattcagaa

SEQ ID NO: 163208 - DNA, 20 bp, Artificial Sequence
  chemically synthesized
tgtttaggaagagtattcag

SEQ ID NO: 163209 - DNA, 20 bp, Artificial Sequence
  chemically synthesized
acatgtttaggaagagtatt

SEQ ID NO: 163210 - DNA, 20 bp, Artificial Sequence
  chemically synthesized
ttcctgtacatgtttaggaa

SEQ ID NO: 163211 - DNA, 20 bp, Artificial Sequence
  chemically synthesized
gtttcctgtacatgtttagg

SEQ ID NO: 163212 - DNA, 20 bp, Artificial Sequence
  chemically synthesized
gctgtttcctgtacatgttt

SEQ ID NO: 163213 - DNA, 20 bp, Artificial Sequence
  chemically synthesized
tgctgtttcctgtacatgtt

SEQ ID NO: 163214 - DNA, 20 bp, Artificial Sequence
  chemically synthesized
atactcttcctaaacatgta

SEQ ID NO: 163215 - DNA, 20 bp, Artificial Sequence
  chemically synthesized
tactcttcctaaacatgtac

SEQ ID NO: 163216 - DNA, 20 bp, Artificial Sequence
  chemically synthesized
tcctaaacatgtacaggaaa

SEQ ID NO: 163217 - DNA, 20 bp, Artificial Sequence
  chemically synthesized
tacaggaaacagcaaatata

SEQ ID NO: 163218 - DNA, 20 bp, Artificial Sequence
  chemically synthesized
acaggaaacagcaaatatat

SEQ ID NO: 163219 - DNA, 20 bp, Artificial Sequence
  chemically synthesized
atatatgggtttctgaaatc

SEQ ID NO: 163220 - DNA, 20 bp, Artificial Sequence
  chemically synthesized
tgtgtcctttttcttgattt

SEQ ID NO: 163221 - DNA, 20 bp, Artificial Sequence
  chemically synthesized
gggtttctgaaatcaagaaa

SEQ ID NO: 163222 - DNA, 20 bp, Artificial Sequence
  chemically synthesized
ggtttctgaaatcaagaaaa

SEQ ID NO: 163223 - DNA, 20 bp, Artificial Sequence
  chemically synthesized
aaaggacacattatgtaata

SEQ ID NO: 163224 - DNA, 20 bp, Artificial Sequence
  chemically synthesized
tatgtaataaagccaattcc

SEQ ID NO: 163225 - DNA, 20 bp, Artificial Sequence
  chemically synthesized
atattgagtaaaccaggaat

SEQ ID NO: 163226 - DNA, 20 bp, Artificial Sequence
  chemically synthesized
actgacatattgagtaaacc

SEQ ID NO: 163227 - DNA, 20 bp, Artificial Sequence
  chemically synthesized
gactgacatattgagtaaac

SEQ ID NO: 163228 - DNA, 20 bp, Artificial Sequence
  chemically synthesized
tcctggtttactcaatatgt

SEQ ID NO: 163229 - DNA, 20 bp, Artificial Sequence
  chemically synthesized
cagatgaagactgacatatt

SEQ ID NO: 163230 - DNA, 20 bp, Artificial Sequence
  chemically synthesized
aagacctggtatcacagatg

SEQ ID NO: 163231 - DNA, 20 bp, Artificial Sequence
  chemically synthesized
tcagtcttcatctgtgatac

SEQ ID NO: 163232 - DNA, 20 bp, Artificial Sequence
  chemically synthesized
cagtcttcatctgtgatacc

SEQ ID NO: 163233 - DNA, 20 bp, Artificial Sequence
  chemically synthesized
agtctaaagacctggtatca

SEQ ID NO: 163234 - DNA, 20 bp, Artificial Sequence
  chemically synthesized
catctgtgataccaggtctt

SEQ ID NO: 163235 - DNA, 20 bp, Artificial Sequence
  chemically synthesized
agtgcaacagtctaaagacc

SEQ ID NO: 163236 - DNA, 20 bp, Artificial Sequence
  chemically synthesized
aggctaagtgcaacagtcta

SEQ ID NO: 163237 - DNA, 20 bp, Artificial Sequence
  chemically synthesized
ggtctttagactgttgcact

SEQ ID NO: 163238 - DNA, 20 bp, Artificial Sequence
  chemically synthesized
tgtataaaggctaagtgcaa

SEQ ID NO: 163239 - DNA, 20 bp, Artificial Sequence
  chemically synthesized
gttataagtgtataaaggct

SEQ ID NO: 163240 - DNA, 20 bp, Artificial Sequence
  chemically synthesized
catgagttataagtgtataa

SEQ ID NO: 163241 - DNA, 20 bp, Artificial Sequence
  chemically synthesized
tcatgagttataagtgtata

SEQ ID NO: 163242 - DNA, 20 bp, Artificial Sequence
  chemically synthesized
atatggaaatcatgagttat

SEQ ID NO: 163243 - DNA, 20 bp, Artificial Sequence
  chemically synthesized
gtggaacatatggaaatcat

SEQ ID NO: 163244 - DNA, 20 bp, Artificial Sequence
  chemically synthesized
tggctacttagtggaacata

SEQ ID NO: 163245 - DNA, 20 bp, Artificial Sequence
  chemically synthesized
tgatttccatatgttccact

SEQ ID NO: 163246 - DNA, 20 bp, Artificial Sequence
  chemically synthesized
tttccatatgttccactaag

SEQ ID NO: 163247 - DNA, 20 bp, Artificial Sequence
  chemically synthesized
tagtgaaaatggctacttag

SEQ ID NO: 163248 - DNA, 20 bp, Artificial Sequence
  chemically synthesized
gactagtgaaaatggctact

SEQ ID NO: 163249 - DNA, 20 bp, Artificial Sequence
  chemically synthesized
cactaagtagccattttcac

SEQ ID NO: 163250 - DNA, 20 bp, Artificial Sequence
  chemically synthesized
tttcaggagactagtgaaaa

SEQ ID NO: 163251 - DNA, 20 bp, Artificial Sequence
  chemically synthesized
tcgttgacttttcaggagac

SEQ ID NO: 163252 - DNA, 20 bp, Artificial Sequence
  chemically synthesized
attttcactagtctcctgaa

SEQ ID NO: 163253 - DNA, 20 bp, Artificial Sequence
  chemically synthesized
tcttatcgttgacttttcag

SEQ ID NO: 163254 - DNA, 20 bp, Artificial Sequence
  chemically synthesized
aatcttatcgttgacttttc

SEQ ID NO: 163255 - DNA, 20 bp, Artificial Sequence
  chemically synthesized
aaatcttatcgttgactttt

SEQ ID NO: 163256 - DNA, 20 bp, Artificial Sequence
  chemically synthesized
tctcctgaaaagtcaacgat

SEQ ID NO: 163257 - DNA, 20 bp, Artificial Sequence
  chemically synthesized
aaaagtcaacgataagattt

SEQ ID NO: 163258 - DNA, 20 bp, Artificial Sequence
  chemically synthesized
tcaacgataagattttggat

SEQ ID NO: 163259 - DNA, 20 bp, Artificial Sequence
  chemically synthesized
caacgataagattttggata

SEQ ID NO: 163260 - DNA, 20 bp, Artificial Sequence
  chemically synthesized
agattttggataaggaattg

SEQ ID NO: 163261 - DNA, 20 bp, Artificial Sequence
  chemically synthesized
ggaattgtagacttatatat

SEQ ID NO: 163262 - DNA, 20 bp, Artificial Sequence
  chemically synthesized
gaattgtagacttatatatt

SEQ ID NO: 163263 - DNA, 20 bp, Artificial Sequence
  chemically synthesized
attatatgcacctaatatat

SEQ ID NO: 163264 - DNA, 20 bp, Artificial Sequence
  chemically synthesized
tatattaggtgcatataatc

SEQ ID NO: 163265 - DNA, 20 bp, Artificial Sequence
  chemically synthesized
tctagattctagtagagttc

SEQ ID NO: 163266 - DNA, 20 bp, Artificial Sequence
  chemically synthesized
catataatccagaactctac

SEQ ID NO: 163267 - DNA, 20 bp, Artificial Sequence
  chemically synthesized
gtatattctagattctagta

SEQ ID NO: 163268 - DNA, 20 bp, Artificial Sequence
  chemically synthesized
ctgtatattctagattctag

SEQ ID NO: 163269 - DNA, 20 bp, Artificial Sequence
  chemically synthesized
tccagaactctactagaatc

SEQ ID NO: 163270 - DNA, 20 bp, Artificial Sequence
  chemically synthesized
tgtctgtatattctagattc

SEQ ID NO: 163271 - DNA, 20 bp, Artificial Sequence
  chemically synthesized
ctactagaatctagaatata

SEQ ID NO: 163272 - DNA, 20 bp, Artificial Sequence
  chemically synthesized
tatgagttgtctgtatattc

SEQ ID NO: 163273 - DNA, 20 bp, Artificial Sequence
  chemically synthesized
tttctcttaccgattaatat

SEQ ID NO: 163274 - DNA, 20 bp, Artificial Sequence
  chemically synthesized
tacagacaactcatattaat

SEQ ID NO: 163275 - DNA, 20 bp, Artificial Sequence
  chemically synthesized
gacaactcatattaatcggt

SEQ ID NO: 163276 - DNA, 20 bp, Artificial Sequence
  chemically synthesized
caactcatattaatcggtaa

SEQ ID NO: 163277 - DNA, 20 bp, Artificial Sequence
  chemically synthesized
tcatattaatcggtaagaga

SEQ ID NO: 163278 - DNA, 20 bp, Artificial Sequence
  chemically synthesized
agagaaagtaaacaatccaa

SEQ ID NO: 163279 - DNA, 20 bp, Artificial Sequence
  chemically synthesized
tatttaccccaattttccgt

SEQ ID NO: 163280 - DNA, 20 bp, Artificial Sequence
  chemically synthesized
taaacaatccaacggaaaat

SEQ ID NO: 163281 - DNA, 20 bp, Artificial Sequence
  chemically synthesized
aaacaatccaacggaaaatt

SEQ ID NO: 163282 - DNA, 20 bp, Artificial Sequence
  chemically synthesized
aacaatccaacggaaaattg

SEQ ID NO: 163283 - DNA, 20 bp, Artificial Sequence
  chemically synthesized
aaaattggggtaaatatatg

SEQ ID NO: 163284 - DNA, 20 bp, Artificial Sequence
  chemically synthesized
aattggggtaaatatatgaa

SEQ ID NO: 163285 - DNA, 20 bp, Artificial Sequence
  chemically synthesized
atatatgaagagtcaactca

SEQ ID NO: 163286 - DNA, 20 bp, Artificial Sequence
  chemically synthesized
tatgaagagtcaactcacag

SEQ ID NO: 163287 - DNA, 20 bp, Artificial Sequence
  chemically synthesized
atgaagagtcaactcacaga

SEQ ID NO: 163288 - DNA, 20 bp, Artificial Sequence
  chemically synthesized
ggacagatttttccttctgt

SEQ ID NO: 163289 - DNA, 20 bp, Artificial Sequence
  chemically synthesized
aagttttcaagtttgttgga

SEQ ID NO: 163290 - DNA, 20 bp, Artificial Sequence
  chemically synthesized
gaacaagttttcaagtttgt

SEQ ID NO: 163291 - DNA, 20 bp, Artificial Sequence
  chemically synthesized
ccctggttgaacaagttttc

SEQ ID NO: 163292 - DNA, 20 bp, Artificial Sequence
  chemically synthesized
aacttgaaaacttgttcaac

SEQ ID NO: 163293 - DNA, 20 bp, Artificial Sequence
  chemically synthesized
ttgcatatccctggttgaac

SEQ ID NO: 163294 - DNA, 20 bp, Artificial Sequence
  chemically synthesized
acttgaaaacttgttcaacc

SEQ ID NO: 163295 - DNA, 20 bp, Artificial Sequence
  chemically synthesized
cttgaaaacttgttcaacca

SEQ ID NO: 163296 - DNA, 20 bp, Artificial Sequence
  chemically synthesized
tattttaatttgcatatccc

SEQ ID NO: 163297 - DNA, 20 bp, Artificial Sequence
  chemically synthesized
caccagcagcaagaagtggc

SEQ ID NO: 163298 - DNA, 20 bp, Artificial Sequence
  chemically synthesized
ccaccagcagcaagaagtgg

SEQ ID NO: 163299 - DNA, 20 bp, Artificial Sequence
  chemically synthesized
tttccaccagcagcaagaag

SEQ ID NO: 163300 - DNA, 20 bp, Artificial Sequence
  chemically synthesized
gcttttccaccagcagcaag

SEQ ID NO: 163301 - DNA, 20 bp, Artificial Sequence
  chemically synthesized
ttcctgccacttcttgctgc

SEQ ID NO: 163302 - DNA, 20 bp, Artificial Sequence
  chemically synthesized
attgcttttccaccagcagc

SEQ ID NO: 163303 - DNA, 20 bp, Artificial Sequence
  chemically synthesized
ctgccacttcttgctgctgg

SEQ ID NO: 163304 - DNA, 20 bp, Artificial Sequence
  chemically synthesized
gcaaattgcttttccaccag

SEQ ID NO: 163305 - DNA, 20 bp, Artificial Sequence
  chemically synthesized
acttcttgctgctggtggaa

SEQ ID NO: 163306 - DNA, 20 bp, Artificial Sequence
  chemically synthesized
attgcaaattgcttttccac

SEQ ID NO: 163307 - DNA, 20 bp, Artificial Sequence
  chemically synthesized
aaaaatgtgaatactctaat

SEQ ID NO: 163308 - DNA, 20 bp, Artificial Sequence
  chemically synthesized
aaaatgtgaatactctaatg

SEQ ID NO: 163309 - DNA, 20 bp, Artificial Sequence
  chemically synthesized
gtggaattgttacctcatta

SEQ ID NO: 163310 - DNA, 20 bp, Artificial Sequence
  chemically synthesized
aagtggaattgttacctcat

SEQ ID NO: 163311 - DNA, 20 bp, Artificial Sequence
  chemically synthesized
tgaggtaacaattccacttc

SEQ ID NO: 163312 - DNA, 20 bp, Artificial Sequence
  chemically synthesized
gaggtaacaattccacttct

SEQ ID NO: 163313 - DNA, 20 bp, Artificial Sequence
  chemically synthesized
catatgagaacacctagaag

SEQ ID NO: 163314 - DNA, 20 bp, Artificial Sequence
  chemically synthesized
agacatatgagaacacctag

SEQ ID NO: 163315 - DNA, 20 bp, Artificial Sequence
  chemically synthesized
gatagacatatgagaacacc

SEQ ID NO: 163316 - DNA, 20 bp, Artificial Sequence
  chemically synthesized
gtctcctcagatagacatat

SEQ ID NO: 163317 - DNA, 20 bp, Artificial Sequence
  chemically synthesized
gtgttctcatatgtctatct

SEQ ID NO: 163318 - DNA, 20 bp, Artificial Sequence
  chemically synthesized
tgttctcatatgtctatctg

SEQ ID NO: 163319 - DNA, 20 bp, Artificial Sequence
  chemically synthesized
ttctcatatgtctatctgag

SEQ ID NO: 163320 - DNA, 20 bp, Artificial Sequence
  chemically synthesized
tctctgtaggtctcctcaga

SEQ ID NO: 163321 - DNA, 20 bp, Artificial Sequence
  chemically synthesized
acattctctgtaggtctcct

SEQ ID NO: 163322 - DNA, 20 bp, Artificial Sequence
  chemically synthesized
tgtctatctgaggagaccta

SEQ ID NO: 163323 - DNA, 20 bp, Artificial Sequence
  chemically synthesized
tctatctgaggagacctaca

SEQ ID NO: 163324 - DNA, 20 bp, Artificial Sequence
  chemically synthesized
gctgaaacaacattctctgt

SEQ ID NO: 163325 - DNA, 20 bp, Artificial Sequence
  chemically synthesized
tgctgaaacaacattctctg

SEQ ID NO: 163326 - DNA, 20 bp, Artificial Sequence
  chemically synthesized
acctacagagaatgttgttt

SEQ ID NO: 163327 - DNA, 20 bp, Artificial Sequence
  chemically synthesized
gttgtttcagcattgttcat

SEQ ID NO: 163328 - DNA, 20 bp, Artificial Sequence
  chemically synthesized
ttcagcattgttcattagtg

SEQ ID NO: 163329 - DNA, 20 bp, Artificial Sequence
  chemically synthesized
cagcattgttcattagtgaa

SEQ ID NO: 163330 - DNA, 20 bp, Artificial Sequence
  chemically synthesized
attgttcattagtgaagagc

SEQ ID NO: 163331 - DNA, 20 bp, Artificial Sequence
  chemically synthesized
agtgaataatcagattgttc

SEQ ID NO: 163332 - DNA, 20 bp, Artificial Sequence
  chemically synthesized
ttagattaacagtgaataat

SEQ ID NO: 163333 - DNA, 20 bp, Artificial Sequence
  chemically synthesized
caatgtgcccgttagattaa

SEQ ID NO: 163334 - DNA, 20 bp, Artificial Sequence
  chemically synthesized
attattcactgttaatctaa

SEQ ID NO: 163335 - DNA, 20 bp, Artificial Sequence
  chemically synthesized
ttattcactgttaatctaac

SEQ ID NO: 163336 - DNA, 20 bp, Artificial Sequence
  chemically synthesized
caaacaatcaatgtgcccgt

SEQ ID NO: 163337 - DNA, 20 bp, Artificial Sequence
  chemically synthesized
taacgggcacattgattgtt

SEQ ID NO: 163338 - DNA, 20 bp, Artificial Sequence
  chemically synthesized
aaaagtattcttgattttaa

SEQ ID NO: 163339 - DNA, 20 bp, Artificial Sequence
  chemically synthesized
gtttggtttctattaaaatc

SEQ ID NO: 163340 - DNA, 20 bp, Artificial Sequence
  chemically synthesized
aaaatcaagaatacttttac

SEQ ID NO: 163341 - DNA, 20 bp, Artificial Sequence
  chemically synthesized
atacagaagtaatctggtaa

SEQ ID NO: 163342 - DNA, 20 bp, Artificial Sequence
  chemically synthesized
tttagaatacagaagtaatc

SEQ ID NO: 163343 - DNA, 20 bp, Artificial Sequence
  chemically synthesized
ttaatggctttagaatacag

SEQ ID NO: 163344 - DNA, 20 bp, Artificial Sequence
  chemically synthesized
cagattacttctgtattcta

SEQ ID NO: 163345 - DNA, 20 bp, Artificial Sequence
  chemically synthesized
tttttaatggctttagaata

SEQ ID NO: 163346 - DNA, 20 bp, Artificial Sequence
  chemically synthesized
acaaagatttttaatggctt

SEQ ID NO: 163347 - DNA, 20 bp, Artificial Sequence
  chemically synthesized
atacgaacaaagatttttaa

SEQ ID NO: 163348 - DNA, 20 bp, Artificial Sequence
  chemically synthesized
actccataaaaatacgaaca

SEQ ID NO: 163349 - DNA, 20 bp, Artificial Sequence
  chemically synthesized
aatctttgttcgtattttta

SEQ ID NO: 163350 - DNA, 20 bp, Artificial Sequence
  chemically synthesized
tctttgttcgtatttttatg

SEQ ID NO: 163351 - DNA, 20 bp, Artificial Sequence
  chemically synthesized
tcgtatttttatggagtcca

SEQ ID NO: 163352 - DNA, 20 bp, Artificial Sequence
  chemically synthesized
gactagcttaaatagaactt

SEQ ID NO: 163353 - DNA, 20 bp, Artificial Sequence
  chemically synthesized
tggagtccaaagttctattt

SEQ ID NO: 163354 - DNA, 20 bp, Artificial Sequence
  chemically synthesized
gtccaaagttctatttaagc

SEQ ID NO: 163355 - DNA, 20 bp, Artificial Sequence
  chemically synthesized
ttgcttatgactagcttaaa

SEQ ID NO: 163356 - DNA, 20 bp, Artificial Sequence
  chemically synthesized
gttctatttaagctagtcat

SEQ ID NO: 163357 - DNA, 20 bp, Artificial Sequence
  chemically synthesized
gcattaactttgcttatgac

SEQ ID NO: 163358 - DNA, 20 bp, Artificial Sequence
  chemically synthesized
atttaagctagtcataagca

SEQ ID NO: 163359 - DNA, 20 bp, Artificial Sequence
  chemically synthesized
aatgagtccattatgaatag

SEQ ID NO: 163360 - DNA, 20 bp, Artificial Sequence
  chemically synthesized
gttaatgctactattcataa

SEQ ID NO: 163361 - DNA, 20 bp, Artificial Sequence
  chemically synthesized
ttcaatgagtccattatgaa

SEQ ID NO: 163362 - DNA, 20 bp, Artificial Sequence
  chemically synthesized
tattcataatggactcattg

SEQ ID NO: 163363 - DNA, 20 bp, Artificial Sequence
  chemically synthesized
ttatctttagtatcttcaat

SEQ ID NO: 163364 - DNA, 20 bp, Artificial Sequence
  chemically synthesized
tggactcattgaagatacta

SEQ ID NO: 163365 - DNA, 20 bp, Artificial Sequence
  chemically synthesized
tattgttattttattatctt

SEQ ID NO: 163366 - DNA, 20 bp, Artificial Sequence
  chemically synthesized
aaagtccaatttgttagaga

SEQ ID NO: 163367 - DNA, 20 bp, Artificial Sequence
  chemically synthesized
aactaaagtccaatttgtta

SEQ ID NO: 163368 - DNA, 20 bp, Artificial Sequence
  chemically synthesized
caatactatctctaacaaat

SEQ ID NO: 163369 - DNA, 20 bp, Artificial Sequence
  chemically synthesized
gtaactaaagtccaatttgt

SEQ ID NO: 163370 - DNA, 20 bp, Artificial Sequence
  chemically synthesized
atctctaacaaattggactt

SEQ ID NO: 163371 - DNA, 20 bp, Artificial Sequence
  chemically synthesized
tgtgtatgccattgtaacta

SEQ ID NO: 163372 - DNA, 20 bp, Artificial Sequence
  chemically synthesized
aaattggactttagttacaa

SEQ ID NO: 163373 - DNA, 20 bp, Artificial Sequence
  chemically synthesized
tttagttacaatggcataca

SEQ ID NO: 163374 - DNA, 20 bp, Artificial Sequence
  chemically synthesized
aaaactgaacagatgttatt

SEQ ID NO: 163375 - DNA, 20 bp, Artificial Sequence
  chemically synthesized
atgtccaaataacatctgtt

SEQ ID NO: 163376 - DNA, 20 bp, Artificial Sequence
  chemically synthesized
gtgcttcactcaaaactgaa

SEQ ID NO: 163377 - DNA, 20 bp, Artificial Sequence
  chemically synthesized
aataacatctgttcagtttt

SEQ ID NO: 163378 - DNA, 20 bp, Artificial Sequence
  chemically synthesized
catctgttcagttttgagtg

SEQ ID NO: 163379 - DNA, 20 bp, Artificial Sequence
  chemically synthesized
gttcagttttgagtgaagca

SEQ ID NO: 163380 - DNA, 20 bp, Artificial Sequence
  chemically synthesized
ttcagttttgagtgaagcac

SEQ ID NO: 163381 - DNA, 20 bp, Artificial Sequence
  chemically synthesized
tagtgatttacataattgga

SEQ ID NO: 163382 - DNA, 20 bp, Artificial Sequence
  chemically synthesized
attagtgatttacataattg

SEQ ID NO: 163383 - DNA, 20 bp, Artificial Sequence
  chemically synthesized
gtattagtgatttacataat

SEQ ID NO: 163384 - DNA, 20 bp, Artificial Sequence
  chemically synthesized
attagcatagtaataagtat

SEQ ID NO: 163385 - DNA, 20 bp, Artificial Sequence
  chemically synthesized
tctggtattagcatagtaat

SEQ ID NO: 163386 - DNA, 20 bp, Artificial Sequence
  chemically synthesized
tacgtcttctggtattagca

SEQ ID NO: 163387 - DNA, 20 bp, Artificial Sequence
  chemically synthesized
acttattactatgctaatac

SEQ ID NO: 163388 - DNA, 20 bp, Artificial Sequence
  chemically synthesized
tattactatgctaataccag

SEQ ID NO: 163389 - DNA, 20 bp, Artificial Sequence
  chemically synthesized
tacaatacgtcttctggtat

SEQ ID NO: 163390 - DNA, 20 bp, Artificial Sequence
  chemically synthesized
ctttattacaatacgtcttc

SEQ ID NO: 163391 - DNA, 20 bp, Artificial Sequence
  chemically synthesized
ccagaagacgtattgtaata

SEQ ID NO: 163392 - DNA, 20 bp, Artificial Sequence
  chemically synthesized
cagaagacgtattgtaataa

SEQ ID NO: 163393 - DNA, 20 bp, Artificial Sequence
  chemically synthesized
tatttgatgaaataggtgat

SEQ ID NO: 163394 - DNA, 20 bp, Artificial Sequence
  chemically synthesized
ttaaaattatttgatgaaat

SEQ ID NO: 163395 - DNA, 20 bp, Artificial Sequence
  chemically synthesized
tttaaaattatttgatgaaa

SEQ ID NO: 163396 - DNA, 20 bp, Artificial Sequence
  chemically synthesized
tatttcatcaaataatttta

SEQ ID NO: 163397 - DNA, 20 bp, Artificial Sequence
  chemically synthesized
tcatcaaataattttaaaga

SEQ ID NO: 163398 - DNA, 20 bp, Artificial Sequence
  chemically synthesized
atcaaataattttaaagaca

SEQ ID NO: 163399 - DNA, 20 bp, Artificial Sequence
  chemically synthesized
gtagagaaagtgtggataga

SEQ ID NO: 163400 - DNA, 20 bp, Artificial Sequence
  chemically synthesized
acaagtagagaaagtgtgga

SEQ ID NO: 163401 - DNA, 20 bp, Artificial Sequence
  chemically synthesized
aatgacaagtagagaaagtg

SEQ ID NO: 163402 - DNA, 20 bp, Artificial Sequence
  chemically synthesized
ttgtgaatgacaagtagaga

SEQ ID NO: 163403 - DNA, 20 bp, Artificial Sequence
  chemically synthesized
acttttgtgaatgacaagta

SEQ ID NO: 163404 - DNA, 20 bp, Artificial Sequence
  chemically synthesized
gaacttttgtgaatgacaag

SEQ ID NO: 163405 - DNA, 20 bp, Artificial Sequence
  chemically synthesized
aaggaacttttgtgaatgac

SEQ ID NO: 163406 - DNA, 20 bp, Artificial Sequence
  chemically synthesized
tctctacttgtcattcacaa

SEQ ID NO: 163407 - DNA, 20 bp, Artificial Sequence
  chemically synthesized
aatttttaagatttgtttga

SEQ ID NO: 163408 - DNA, 20 bp, Artificial Sequence
  chemically synthesized
taatttttaagatttgtttg

SEQ ID NO: 163409 - DNA, 20 bp, Artificial Sequence
  chemically synthesized
tgcgcatacttttaattttt

SEQ ID NO: 163410 - DNA, 20 bp, Artificial Sequence
  chemically synthesized
aaacaaatcttaaaaattaa

SEQ ID NO: 163411 - DNA, 20 bp, Artificial Sequence
  chemically synthesized
aaattaaaagtatgcgcaca

SEQ ID NO: 163412 - DNA, 20 bp, Artificial Sequence
  chemically synthesized
agtatgcgcacatggctttg

SEQ ID NO: 163413 - DNA, 20 bp, Artificial Sequence
  chemically synthesized
tactgaaacatgaaactaca

SEQ ID NO: 163414 - DNA, 20 bp, Artificial Sequence
  chemically synthesized
ggctttgtagtttcatgttt

SEQ ID NO: 163415 - DNA, 20 bp, Artificial Sequence
  chemically synthesized
ttgtagtttcatgtttcagt

SEQ ID NO: 163416 - DNA, 20 bp, Artificial Sequence
  chemically synthesized
tgtagtttcatgtttcagta

SEQ ID NO: 163417 - DNA, 20 bp, Artificial Sequence
  chemically synthesized
tagtttcatgtttcagtaag

SEQ ID NO: 163418 - DNA, 20 bp, Artificial Sequence
  chemically synthesized
tcagtaaggagaattttact

SEQ ID NO: 163419 - DNA, 20 bp, Artificial Sequence
  chemically synthesized
cacaataatgtataggatcc

SEQ ID NO: 163420 - DNA, 20 bp, Artificial Sequence
  chemically synthesized
aagcactcacaataatgtat

SEQ ID NO: 163421 - DNA, 20 bp, Artificial Sequence
  chemically synthesized
gaagcactcacaataatgta

SEQ ID NO: 163422 - DNA, 20 bp, Artificial Sequence
  chemically synthesized
tggatcctatacattattgt

SEQ ID NO: 163423 - DNA, 20 bp, Artificial Sequence
  chemically synthesized
attaagaaggcaaaacatgg

SEQ ID NO: 163424 - DNA, 20 bp, Artificial Sequence
  chemically synthesized
agcattaagaaggcaaaaca

SEQ ID NO: 163425 - DNA, 20 bp, Artificial Sequence
  chemically synthesized
aattttggtaagcattaaga

SEQ ID NO: 163426 - DNA, 20 bp, Artificial Sequence
  chemically synthesized
taattttggtaagcattaag

SEQ ID NO: 163427 - DNA, 20 bp, Artificial Sequence
  chemically synthesized
taataattttggtaagcatt

SEQ ID NO: 163428 - DNA, 20 bp, Artificial Sequence
  chemically synthesized
ttgacattaataattttggt

SEQ ID NO: 163429 - DNA, 20 bp, Artificial Sequence
  chemically synthesized
attcttgacattaataattt

SEQ ID NO: 163430 - DNA, 20 bp, Artificial Sequence
  chemically synthesized
ttaccaaaattattaatgtc

SEQ ID NO: 163431 - DNA, 20 bp, Artificial Sequence
  chemically synthesized
aatgtcaagaataccaatct

SEQ ID NO: 163432 - DNA, 20 bp, Artificial Sequence
  chemically synthesized
ccaccatgcctggccaagat

SEQ ID NO: 163433 - DNA, 20 bp, Artificial Sequence
  chemically synthesized
tcaagaataccaatcttggc

SEQ ID NO: 163434 - DNA, 20 bp, Artificial Sequence
  chemically synthesized
caagaataccaatcttggcc

SEQ ID NO: 163435 - DNA, 20 bp, Artificial Sequence
  chemically synthesized
gtgagccaccatgcctggcc

SEQ ID NO: 163436 - DNA, 20 bp, Artificial Sequence
  chemically synthesized
ataccaatcttggccaggca

SEQ ID NO: 163437 - DNA, 20 bp, Artificial Sequence
  chemically synthesized
ccaatcttggccaggcatgg

SEQ ID NO: 163438 - DNA, 20 bp, Artificial Sequence
  chemically synthesized
caggcgtgagccaccatgcc

SEQ ID NO: 163439 - DNA, 20 bp, Artificial Sequence
  chemically synthesized
agtgctgggattacaggcgt

SEQ ID NO: 163440 - DNA, 20 bp, Artificial Sequence
  chemically synthesized
gtggctcacgcctgtaatcc

SEQ ID NO: 163441 - DNA, 20 bp, Artificial Sequence
  chemically synthesized
tccgaaagtgctgggattac

SEQ ID NO: 163442 - DNA, 20 bp, Artificial Sequence
  chemically synthesized
atccgaaagtgctgggatta

SEQ ID NO: 163443 - DNA, 20 bp, Artificial Sequence
  chemically synthesized
cctcagcatccgaaagtgct

SEQ ID NO: 163444 - DNA, 20 bp, Artificial Sequence
  chemically synthesized
gcctgtaatcccagcacttt

SEQ ID NO: 163445 - DNA, 20 bp, Artificial Sequence
  chemically synthesized
gcctcagcatccgaaagtgc

SEQ ID NO: 163446 - DNA, 20 bp, Artificial Sequence
  chemically synthesized
ccgtcagcctcagcatccga

SEQ ID NO: 163447 - DNA, 20 bp, Artificial Sequence
  chemically synthesized
tcccagcactttcggatgct

SEQ ID NO: 163448 - DNA, 20 bp, Artificial Sequence
  chemically synthesized
cccagcactttcggatgctg

SEQ ID NO: 163449 - DNA, 20 bp, Artificial Sequence
  chemically synthesized
ctttcggatgctgaggctga

SEQ ID NO: 163450 - DNA, 20 bp, Artificial Sequence
  chemically synthesized
ctcaagtgatccgtcagcct

SEQ ID NO: 163451 - DNA, 20 bp, Artificial Sequence
  chemically synthesized
cctgacctcaagtgatccgt

SEQ ID NO: 163452 - DNA, 20 bp, Artificial Sequence
  chemically synthesized
ctgaggctgacggatcactt

SEQ ID NO: 163453 - DNA, 20 bp, Artificial Sequence
  chemically synthesized
tgaggctgacggatcacttg

SEQ ID NO: 163454 - DNA, 20 bp, Artificial Sequence
  chemically synthesized
gctgacggatcacttgaggt

SEQ ID NO: 163455 - DNA, 20 bp, Artificial Sequence
  chemically synthesized
ctgacggatcacttgaggtc

SEQ ID NO: 163456 - DNA, 20 bp, Artificial Sequence
  chemically synthesized
ggtctcaaactcctgacctc

SEQ ID NO: 163457 - DNA, 20 bp, Artificial Sequence
  chemically synthesized
gacggatcacttgaggtcag

SEQ ID NO: 163458 - DNA, 20 bp, Artificial Sequence
  chemically synthesized
tcacttgaggtcaggagttt

SEQ ID NO: 163459 - DNA, 20 bp, Artificial Sequence
  chemically synthesized
tgaggtcaggagtttgagac

SEQ ID NO: 163460 - DNA, 20 bp, Artificial Sequence
  chemically synthesized
tcaggagtttgagaccagcc

SEQ ID NO: 163461 - DNA, 20 bp, Artificial Sequence
  chemically synthesized
tttcaccatgttgaccaggc

SEQ ID NO: 163462 - DNA, 20 bp, Artificial Sequence
  chemically synthesized
agggtttcaccatgttgacc

SEQ ID NO: 163463 - DNA, 20 bp, Artificial Sequence
  chemically synthesized
tgagaccagcctggtcaaca

SEQ ID NO: 163464 - DNA, 20 bp, Artificial Sequence
  chemically synthesized
cagggtttcaccatgttgac

SEQ ID NO: 163465 - DNA, 20 bp, Artificial Sequence
  chemically synthesized
ttgtatttttagtagagaca

SEQ ID NO: 163466 - DNA, 20 bp, Artificial Sequence
  chemically synthesized
tttgtatttttagtagagac

SEQ ID NO: 163467 - DNA, 20 bp, Artificial Sequence
  chemically synthesized
ttttgtatttttagtagaga

SEQ ID NO: 163468 - DNA, 20 bp, Artificial Sequence
  chemically synthesized
taatttttgtatttttagta

SEQ ID NO: 163469 - DNA, 20 bp, Artificial Sequence
  chemically synthesized
gctaatttttgtatttttag

SEQ ID NO: 163470 - DNA, 20 bp, Artificial Sequence
  chemically synthesized
ccggctaatttttgtatttt

SEQ ID NO: 163471 - DNA, 20 bp, Artificial Sequence
  chemically synthesized
tctactaaaaatacaaaaat

SEQ ID NO: 163472 - DNA, 20 bp, Artificial Sequence
  chemically synthesized
ctaaaaatacaaaaattagc

SEQ ID NO: 163473 - DNA, 20 bp, Artificial Sequence
  chemically synthesized
taaaaatacaaaaattagcc

SEQ ID NO: 163474 - DNA, 20 bp, Artificial Sequence
  chemically synthesized
atacaaaaattagccgggtg

SEQ ID NO: 163475 - DNA, 20 bp, Artificial Sequence
  chemically synthesized
caaaaattagccgggtgtgg

SEQ ID NO: 163476 - DNA, 20 bp, Artificial Sequence
  chemically synthesized
ctggtgcccaccaccacacc

SEQ ID NO: 163477 - DNA, 20 bp, Artificial Sequence
  chemically synthesized
aaattagccgggtgtggtgg

SEQ ID NO: 163478 - DNA, 20 bp, Artificial Sequence
  chemically synthesized
aattagccgggtgtggtggt

SEQ ID NO: 163479 - DNA, 20 bp, Artificial Sequence
  chemically synthesized
ccgggtgtggtggtgggcac

SEQ ID NO: 163480 - DNA, 20 bp, Artificial Sequence
  chemically synthesized
gtggtgggcaccagtaatcc

SEQ ID NO: 163481 - DNA, 20 bp, Artificial Sequence
  chemically synthesized
tgccaagtagctaggattac

SEQ ID NO: 163482 - DNA, 20 bp, Artificial Sequence
  chemically synthesized
caccagtaatcctagctact

SEQ ID NO: 163483 - DNA, 20 bp, Artificial Sequence
  chemically synthesized
cctcagactgccaagtagct

SEQ ID NO: 163484 - DNA, 20 bp, Artificial Sequence
  chemically synthesized
gcctcagactgccaagtagc

SEQ ID NO: 163485 - DNA, 20 bp, Artificial Sequence
  chemically synthesized
cagtaatcctagctacttgg

SEQ ID NO: 163486 - DNA, 20 bp, Artificial Sequence
  chemically synthesized
tcctgcctcagactgccaag

SEQ ID NO: 163487 - DNA, 20 bp, Artificial Sequence
  chemically synthesized
ttctcctgcctcagactgcc

SEQ ID NO: 163488 - DNA, 20 bp, Artificial Sequence
  chemically synthesized
tcctagctacttggcagtct

SEQ ID NO: 163489 - DNA, 20 bp, Artificial Sequence
  chemically synthesized
cctagctacttggcagtctg

SEQ ID NO: 163490 - DNA, 20 bp, Artificial Sequence
  chemically synthesized
agctacttggcagtctgagg

SEQ ID NO: 163491 - DNA, 20 bp, Artificial Sequence
  chemically synthesized
gctacttggcagtctgaggc

SEQ ID NO: 163492 - DNA, 20 bp, Artificial Sequence
  chemically synthesized
tacttggcagtctgaggcag

SEQ ID NO: 163493 - DNA, 20 bp, Artificial Sequence
  chemically synthesized
ttcaagggattctcctgcct

SEQ ID NO: 163494 - DNA, 20 bp, Artificial Sequence
  chemically synthesized
gcaggagaatcccttgaacc

SEQ ID NO: 163495 - DNA, 20 bp, Artificial Sequence
  chemically synthesized
cctccgcctcctgggttcaa

SEQ ID NO: 163496 - DNA, 20 bp, Artificial Sequence
  chemically synthesized
caggagaatcccttgaaccc

SEQ ID NO: 163497 - DNA, 20 bp, Artificial Sequence
  chemically synthesized
gcctccgcctcctgggttca

SEQ ID NO: 163498 - DNA, 20 bp, Artificial Sequence
  chemically synthesized
agcctccgcctcctgggttc

SEQ ID NO: 163499 - DNA, 20 bp, Artificial Sequence
  chemically synthesized
ggagaatcccttgaacccag

SEQ ID NO: 163500 - DNA, 20 bp, Artificial Sequence
  chemically synthesized
gagaatcccttgaacccagg

SEQ ID NO: 163501 - DNA, 20 bp, Artificial Sequence
  chemically synthesized
aatcccttgaacccaggagg

SEQ ID NO: 163502 - DNA, 20 bp, Artificial Sequence
  chemically synthesized
cactgcagcctccgcctcct

SEQ ID NO: 163503 - DNA, 20 bp, Artificial Sequence
  chemically synthesized
tcccttgaacccaggaggcg

SEQ ID NO: 163504 - DNA, 20 bp, Artificial Sequence
  chemically synthesized
tcactgcagcctccgcctcc

SEQ ID NO: 163505 - DNA, 20 bp, Artificial Sequence
  chemically synthesized
cccttgaacccaggaggcgg

SEQ ID NO: 163506 - DNA, 20 bp, Artificial Sequence
  chemically synthesized
aacccaggaggcggaggctg

SEQ ID NO: 163507 - DNA, 20 bp, Artificial Sequence
  chemically synthesized
caggaggcggaggctgcagt

SEQ ID NO: 163508 - DNA, 20 bp, Artificial Sequence
  chemically synthesized
gctgcgatctcagctcactg

SEQ ID NO: 163509 - DNA, 20 bp, Artificial Sequence
  chemically synthesized
ggcggaggctgcagtgagct

SEQ ID NO: 163510 - DNA, 20 bp, Artificial Sequence
  chemically synthesized
gctgcagtgagctgagatcg

SEQ ID NO: 163511 - DNA, 20 bp, Artificial Sequence
  chemically synthesized
ggagtgcagtgctgcgatct

SEQ ID NO: 163512 - DNA, 20 bp, Artificial Sequence
  chemically synthesized
gagatcgcagcactgcactc

SEQ ID NO: 163513 - DNA, 20 bp, Artificial Sequence
  chemically synthesized
ccatcacccaggctggagtg

SEQ ID NO: 163514 - DNA, 20 bp, Artificial Sequence
  chemically synthesized
cgcagcactgcactccagcc

SEQ ID NO: 163515 - DNA, 20 bp, Artificial Sequence
  chemically synthesized
gcagcactgcactccagcct

SEQ ID NO: 163516 - DNA, 20 bp, Artificial Sequence
  chemically synthesized
ttgctccatcacccaggctg

SEQ ID NO: 163517 - DNA, 20 bp, Artificial Sequence
  chemically synthesized
tcttgctccatcacccaggc

SEQ ID NO: 163518 - DNA, 20 bp, Artificial Sequence
  chemically synthesized
ctgcactccagcctgggtga

SEQ ID NO: 163519 - DNA, 20 bp, Artificial Sequence
  chemically synthesized
ggagtcttgctccatcaccc

SEQ ID NO: 163520 - DNA, 20 bp, Artificial Sequence
  chemically synthesized
gcactccagcctgggtgatg

SEQ ID NO: 163521 - DNA, 20 bp, Artificial Sequence
  chemically synthesized
tggagtcttgctccatcacc

SEQ ID NO: 163522 - DNA, 20 bp, Artificial Sequence
  chemically synthesized
tccagcctgggtgatggagc

SEQ ID NO: 163523 - DNA, 20 bp, Artificial Sequence
  chemically synthesized
gatggagcaagactccacct

SEQ ID NO: 163524 - DNA, 20 bp, Artificial Sequence
  chemically synthesized
ttttttttttttccgaggtg

SEQ ID NO: 163525 - DNA, 20 bp, Artificial Sequence
  chemically synthesized
ttttttttttttttccgagg

SEQ ID NO: 163526 - DNA, 20 bp, Artificial Sequence
  chemically synthesized
tttttttttttttttttccg

SEQ ID NO: 163527 - DNA, 20 bp, Artificial Sequence
  chemically synthesized
ttttttttttttttttttcc

SEQ ID NO: 163528 - DNA, 20 bp, Artificial Sequence
  chemically synthesized
aaaaaaaaaaaaaaaaaaaa

SEQ ID NO: 163529 - DNA, 20 bp, Artificial Sequence
  chemically synthesized
aaaaaaaaaaaaaaaaaaaa

SEQ ID NO: 163530 - DNA, 20 bp, Artificial Sequence
  chemically synthesized
gctggtcattaaaatgagat

SEQ ID NO: 163531 - DNA, 20 bp, Artificial Sequence
  chemically synthesized
aacatgctggtcattaaaat

SEQ ID NO: 163532 - DNA, 20 bp, Artificial Sequence
  chemically synthesized
accaatctcattttaatgac

SEQ ID NO: 163533 - DNA, 20 bp, Artificial Sequence
  chemically synthesized
taattgattatgtaacatgc

SEQ ID NO: 163534 - DNA, 20 bp, Artificial Sequence
  chemically synthesized
caattattataaatgatttt

SEQ ID NO: 163535 - DNA, 20 bp, Artificial Sequence
  chemically synthesized
gttttaatttgaacattaaa

SEQ ID NO: 163536 - DNA, 20 bp, Artificial Sequence
  chemically synthesized
aaattaggctattttaagaa

SEQ ID NO: 163537 - DNA, 20 bp, Artificial Sequence
  chemically synthesized
aattaaaacttttcttaaaa

SEQ ID NO: 163538 - DNA, 20 bp, Artificial Sequence
  chemically synthesized
tatttaaattaggctatttt

SEQ ID NO: 163539 - DNA, 20 bp, Artificial Sequence
  chemically synthesized
catccataattatttaaatt

SEQ ID NO: 163540 - DNA, 20 bp, Artificial Sequence
  chemically synthesized
acatccataattatttaaat

SEQ ID NO: 163541 - DNA, 20 bp, Artificial Sequence
  chemically synthesized
tagcctaatttaaataatta

SEQ ID NO: 163542 - DNA, 20 bp, Artificial Sequence
  chemically synthesized
ataacagggcacaaataata

SEQ ID NO: 163543 - DNA, 20 bp, Artificial Sequence
  chemically synthesized
ggcagttaccgaacataaca

SEQ ID NO: 163544 - DNA, 20 bp, Artificial Sequence
  chemically synthesized
tggcagttaccgaacataac

SEQ ID NO: 163545 - DNA, 20 bp, Artificial Sequence
  chemically synthesized
tatttgtgccctgttatgtt

SEQ ID NO: 163546 - DNA, 20 bp, Artificial Sequence
  chemically synthesized
ttggcagttaccgaacataa

SEQ ID NO: 163547 - DNA, 20 bp, Artificial Sequence
  chemically synthesized
ttgacacaatgaatatttgg

SEQ ID NO: 163548 - DNA, 20 bp, Artificial Sequence
  chemically synthesized
cccttgacacaatgaatatt

SEQ ID NO: 163549 - DNA, 20 bp, Artificial Sequence
  chemically synthesized
tgccaaatattcattgtgtc

SEQ ID NO: 163550 - DNA, 20 bp, Artificial Sequence
  chemically synthesized
gccaaatattcattgtgtca

SEQ ID NO: 163551 - DNA, 20 bp, Artificial Sequence
  chemically synthesized
ccaaatattcattgtgtcaa

SEQ ID NO: 163552 - DNA, 20 bp, Artificial Sequence
  chemically synthesized
caaatattcattgtgtcaag

SEQ ID NO: 163553 - DNA, 20 bp, Artificial Sequence
  chemically synthesized
aaatattcattgtgtcaagg

SEQ ID NO: 163554 - DNA, 20 bp, Artificial Sequence
  chemically synthesized
ttgtgtcaagggggtcacca

SEQ ID NO: 163555 - DNA, 20 bp, Artificial Sequence
  chemically synthesized
aagggggtcaccaaagtgtt

SEQ ID NO: 163556 - DNA, 20 bp, Artificial Sequence
  chemically synthesized
tttccaaattctgaacactt

SEQ ID NO: 163557 - DNA, 20 bp, Artificial Sequence
  chemically synthesized
tcaccaaagtgttcagaatt

SEQ ID NO: 163558 - DNA, 20 bp, Artificial Sequence
  chemically synthesized
tgttcagaatttggaaactg

SEQ ID NO: 163559 - DNA, 20 bp, Artificial Sequence
  chemically synthesized
gaatttggaaactgtagctt

SEQ ID NO: 163560 - DNA, 20 bp, Artificial Sequence
  chemically synthesized
gtttaatacatctgaagcta

SEQ ID NO: 163561 - DNA, 20 bp, Artificial Sequence
  chemically synthesized
ttgcatgtttaatacatctg

SEQ ID NO: 163562 - DNA, 20 bp, Artificial Sequence
  chemically synthesized
atgatacatataaaaaagta

SEQ ID NO: 163563 - DNA, 20 bp, Artificial Sequence
  chemically synthesized
aaatgatacatataaaaaag

SEQ ID NO: 163564 - DNA, 20 bp, Artificial Sequence
  chemically synthesized
tcaaaatgatacatataaaa

SEQ ID NO: 163565 - DNA, 20 bp, Artificial Sequence
  chemically synthesized
tatgtatcattttgaaatta

SEQ ID NO: 163566 - DNA, 20 bp, Artificial Sequence
  chemically synthesized
ttacttagtgtaaatgcatt

SEQ ID NO: 163567 - DNA, 20 bp, Artificial Sequence
  chemically synthesized
aaactgaatgcatttacact

SEQ ID NO: 163568 - DNA, 20 bp, Artificial Sequence
  chemically synthesized
taactgcttcaattattact

SEQ ID NO: 163569 - DNA, 20 bp, Artificial Sequence
  chemically synthesized
tttacactaagtaataattg

SEQ ID NO: 163570 - DNA, 20 bp, Artificial Sequence
  chemically synthesized
acactaagtaataattgaag

SEQ ID NO: 163571 - DNA, 20 bp, Artificial Sequence
  chemically synthesized
aataattgaagcagttaact

SEQ ID NO: 163572 - DNA, 20 bp, Artificial Sequence
  chemically synthesized
aagcagttaacttggcccta

SEQ ID NO: 163573 - DNA, 20 bp, Artificial Sequence
  chemically synthesized
aaaggaaacaccgtagggcc

SEQ ID NO: 163574 - DNA, 20 bp, Artificial Sequence
  chemically synthesized
tttgaaaaggaaacaccgta

SEQ ID NO: 163575 - DNA, 20 bp, Artificial Sequence
  chemically synthesized
ttttgaaaaggaaacaccgt

SEQ ID NO: 163576 - DNA, 20 bp, Artificial Sequence
  chemically synthesized
attttgaaaaggaaacaccg

SEQ ID NO: 163577 - DNA, 20 bp, Artificial Sequence
  chemically synthesized
atctgacatatattttgaaa

SEQ ID NO: 163578 - DNA, 20 bp, Artificial Sequence
  chemically synthesized
tatctgacatatattttgaa

SEQ ID NO: 163579 - DNA, 20 bp, Artificial Sequence
  chemically synthesized
ttccttttcaaaatatatgt

SEQ ID NO: 163580 - DNA, 20 bp, Artificial Sequence
  chemically synthesized
aaatatatgtcagatatata

SEQ ID NO: 163581 - DNA, 20 bp, Artificial Sequence
  chemically synthesized
atatatgtcagatatataca

SEQ ID NO: 163582 - DNA, 20 bp, Artificial Sequence
  chemically synthesized
tatgtcagatatatacagag

SEQ ID NO: 163583 - DNA, 20 bp, Artificial Sequence
  chemically synthesized
atatgtatctgtgcatatag

SEQ ID NO: 163584 - DNA, 20 bp, Artificial Sequence
  chemically synthesized
tatatgtatctgtgcatata

SEQ ID NO: 163585 - DNA, 20 bp, Artificial Sequence
  chemically synthesized
tttaatatcccctatatgca

SEQ ID NO: 163586 - DNA, 20 bp, Artificial Sequence
  chemically synthesized
atatatgtatctgtgcatat

SEQ ID NO: 163587 - DNA, 20 bp, Artificial Sequence
  chemically synthesized
gatatatgtatctgtgcata

SEQ ID NO: 163588 - DNA, 20 bp, Artificial Sequence
  chemically synthesized
atatgatatatgaaatatat

SEQ ID NO: 163589 - DNA, 20 bp, Artificial Sequence
  chemically synthesized
tatgatatatgaaatatata

SEQ ID NO: 163590 - DNA, 20 bp, Artificial Sequence
  chemically synthesized
tcagtatgtgattcatgata

SEQ ID NO: 163591 - DNA, 20 bp, Artificial Sequence
  chemically synthesized
cacatactgaatgaatgaat

SEQ ID NO: 163592 - DNA, 20 bp, Artificial Sequence
  chemically synthesized
cacatactgattcattcatt

SEQ ID NO: 163593 - DNA, 20 bp, Artificial Sequence
  chemically synthesized
cattcagtatgtgaatgcat

SEQ ID NO: 163594 - DNA, 20 bp, Artificial Sequence
  chemically synthesized
agcaatagtgtcagtgggat

SEQ ID NO: 163595 - DNA, 20 bp, Artificial Sequence
  chemically synthesized
ctttgagcaatagtgtcagt

SEQ ID NO: 163596 - DNA, 20 bp, Artificial Sequence
  chemically synthesized
cctttgagcaatagtgtcag

SEQ ID NO: 163597 - DNA, 20 bp, Artificial Sequence
  chemically synthesized
cctcctttgagcaatagtgt

SEQ ID NO: 163598 - DNA, 20 bp, Artificial Sequence
  chemically synthesized
cccactgacactattgctca

SEQ ID NO: 163599 - DNA, 20 bp, Artificial Sequence
  chemically synthesized
cctgaccctcctttgagcaa

SEQ ID NO: 163600 - DNA, 20 bp, Artificial Sequence
  chemically synthesized
ccactgacactattgctcaa

SEQ ID NO: 163601 - DNA, 20 bp, Artificial Sequence
  chemically synthesized
actgacactattgctcaaag

SEQ ID NO: 163602 - DNA, 20 bp, Artificial Sequence
  chemically synthesized
ctgacactattgctcaaagg

SEQ ID NO: 163603 - DNA, 20 bp, Artificial Sequence
  chemically synthesized
tgacactattgctcaaagga

SEQ ID NO: 163604 - DNA, 20 bp, Artificial Sequence
  chemically synthesized
attcttcctgaccctccttt

SEQ ID NO: 163605 - DNA, 20 bp, Artificial Sequence
  chemically synthesized
actattgctcaaaggagggt

SEQ ID NO: 163606 - DNA, 20 bp, Artificial Sequence
  chemically synthesized
ctattgctcaaaggagggtc

SEQ ID NO: 163607 - DNA, 20 bp, Artificial Sequence
  chemically synthesized
ttgctcaaaggagggtcagg

SEQ ID NO: 163608 - DNA, 20 bp, Artificial Sequence
  chemically synthesized
caaaggagggtcaggaagaa

SEQ ID NO: 163609 - DNA, 20 bp, Artificial Sequence
  chemically synthesized
aaaggagggtcaggaagaat

SEQ ID NO: 163610 - DNA, 20 bp, Artificial Sequence
  chemically synthesized
aaggagggtcaggaagaata

SEQ ID NO: 163611 - DNA, 20 bp, Artificial Sequence
  chemically synthesized
aggagggtcaggaagaatag

SEQ ID NO: 163612 - DNA, 20 bp, Artificial Sequence
  chemically synthesized
ggagggtcaggaagaatagg

SEQ ID NO: 163613 - DNA, 20 bp, Artificial Sequence
  chemically synthesized
gagggtcaggaagaataggg

SEQ ID NO: 163614 - DNA, 20 bp, Artificial Sequence
  chemically synthesized
aggggggaaaatgatgtgaa

SEQ ID NO: 163615 - DNA, 20 bp, Artificial Sequence
  chemically synthesized
ggggggaaaatgatgtgaat

SEQ ID NO: 163616 - DNA, 20 bp, Artificial Sequence
  chemically synthesized
aaatgatgtgaataggaaaa

SEQ ID NO: 163617 - DNA, 20 bp, Artificial Sequence
  chemically synthesized
gatgtgaataggaaaacagt

SEQ ID NO: 163618 - DNA, 20 bp, Artificial Sequence
  chemically synthesized
ataggaaaacagtaagcata

SEQ ID NO: 163619 - DNA, 20 bp, Artificial Sequence
  chemically synthesized
gtaagcatatggcaattttg

SEQ ID NO: 163620 - DNA, 20 bp, Artificial Sequence
  chemically synthesized
tatggcaattttgaagtatt

SEQ ID NO: 163621 - DNA, 20 bp, Artificial Sequence
  chemically synthesized
tttgaagtatttggaataca

SEQ ID NO: 163622 - DNA, 20 bp, Artificial Sequence
  chemically synthesized
ttggaatacaaagttattat

SEQ ID NO: 163623 - DNA, 20 bp, Artificial Sequence
  chemically synthesized
atacaaagttattataagtt

SEQ ID NO: 163624 - DNA, 20 bp, Artificial Sequence
  chemically synthesized
aagttattataagttgagta

SEQ ID NO: 163625 - DNA, 20 bp, Artificial Sequence
  chemically synthesized
gttactatgcatttttttgt

SEQ ID NO: 163626 - DNA, 20 bp, Artificial Sequence
  chemically synthesized
acagctgacaaaaaaatgca

SEQ ID NO: 163627 - DNA, 20 bp, Artificial Sequence
  chemically synthesized
aaaaaaatgcatagtaacat

SEQ ID NO: 163628 - DNA, 20 bp, Artificial Sequence
  chemically synthesized
tatcatctactaggcaaagt

SEQ ID NO: 163629 - DNA, 20 bp, Artificial Sequence
  chemically synthesized
taacatcagctaactttgcc

SEQ ID NO: 163630 - DNA, 20 bp, Artificial Sequence
  chemically synthesized
catcagctaactttgcctag

SEQ ID NO: 163631 - DNA, 20 bp, Artificial Sequence
  chemically synthesized
cccctatcatctactaggca

SEQ ID NO: 163632 - DNA, 20 bp, Artificial Sequence
  chemically synthesized
aagtacccctatcatctact

SEQ ID NO: 163633 - DNA, 20 bp, Artificial Sequence
  chemically synthesized
taagtacccctatcatctac

SEQ ID NO: 163634 - DNA, 20 bp, Artificial Sequence
  chemically synthesized
taactttgcctagtagatga

SEQ ID NO: 163635 - DNA, 20 bp, Artificial Sequence
  chemically synthesized
aactttgcctagtagatgat

SEQ ID NO: 163636 - DNA, 20 bp, Artificial Sequence
  chemically synthesized
actttgcctagtagatgata

SEQ ID NO: 163637 - DNA, 20 bp, Artificial Sequence
  chemically synthesized
ctttgcctagtagatgatag

SEQ ID NO: 163638 - DNA, 20 bp, Artificial Sequence
  chemically synthesized
aatacaattctattttatat

SEQ ID NO: 163639 - DNA, 20 bp, Artificial Sequence
  chemically synthesized
ataggggtacttatataaaa

SEQ ID NO: 163640 - DNA, 20 bp, Artificial Sequence
  chemically synthesized
atagaattgtatttgttaat

SEQ ID NO: 163641 - DNA, 20 bp, Artificial Sequence
  chemically synthesized
tagaatcataatatactctt

SEQ ID NO: 163642 - DNA, 20 bp, Artificial Sequence
  chemically synthesized
ttaagttctgtatcactgaa

SEQ ID NO: 163643 - DNA, 20 bp, Artificial Sequence
  chemically synthesized
tattaagttctgtatcactg

SEQ ID NO: 163644 - DNA, 20 bp, Artificial Sequence
  chemically synthesized
taatatactcttcagtgata

SEQ ID NO: 163645 - DNA, 20 bp, Artificial Sequence
  chemically synthesized
gagatttcacttagtatatt

SEQ ID NO: 163646 - DNA, 20 bp, Artificial Sequence
  chemically synthesized
gatacagaacttaatatact

SEQ ID NO: 163647 - DNA, 20 bp, Artificial Sequence
  chemically synthesized
ctatatactgagatttcact

SEQ ID NO: 163648 - DNA, 20 bp, Artificial Sequence
  chemically synthesized
taatatactaagtgaaatct

SEQ ID NO: 163649 - DNA, 20 bp, Artificial Sequence
  chemically synthesized
ctaagtgaaatctcagtata

SEQ ID NO: 163650 - DNA, 20 bp, Artificial Sequence
  chemically synthesized
aatatacaattctatatact

SEQ ID NO: 163651 - DNA, 20 bp, Artificial Sequence
  chemically synthesized
gtatatagaattgtatattc

SEQ ID NO: 163652 - DNA, 20 bp, Artificial Sequence
  chemically synthesized
atatagaattgtatattcaa

SEQ ID NO: 163653 - DNA, 20 bp, Artificial Sequence
  chemically synthesized
tatagaattgtatattcaag

SEQ ID NO: 163654 - DNA, 20 bp, Artificial Sequence
  chemically synthesized
ttcaagaggacatattgcta

SEQ ID NO: 163655 - DNA, 20 bp, Artificial Sequence
  chemically synthesized
tttacggcttagaaatgcca

SEQ ID NO: 163656 - DNA, 20 bp, Artificial Sequence
  chemically synthesized
catattgctatggcatttct

SEQ ID NO: 163657 - DNA, 20 bp, Artificial Sequence
  chemically synthesized
tatgcgttgaatttacggct

SEQ ID NO: 163658 - DNA, 20 bp, Artificial Sequence
  chemically synthesized
aactttatgcgttgaattta

SEQ ID NO: 163659 - DNA, 20 bp, Artificial Sequence
  chemically synthesized
agccgtaaattcaacgcata

SEQ ID NO: 163660 - DNA, 20 bp, Artificial Sequence
  chemically synthesized
taaattcaacgcataaagtt

SEQ ID NO: 163661 - DNA, 20 bp, Artificial Sequence
  chemically synthesized
ttggatgattacatcttcat

SEQ ID NO: 163662 - DNA, 20 bp, Artificial Sequence
  chemically synthesized
ggatgattacatcttcattg

SEQ ID NO: 163663 - DNA, 20 bp, Artificial Sequence
  chemically synthesized
atgattacatcttcattgga

SEQ ID NO: 163664 - DNA, 20 bp, Artificial Sequence
  chemically synthesized
taacatgattctctccaatg

SEQ ID NO: 163665 - DNA, 20 bp, Artificial Sequence
  chemically synthesized
cagtatgaaaatatatcata

SEQ ID NO: 163666 - DNA, 20 bp, Artificial Sequence
  chemically synthesized
agaataaacttagatgttat

SEQ ID NO: 163667 - DNA, 20 bp, Artificial Sequence
  chemically synthesized
ttttcatactgataacatct

SEQ ID NO: 163668 - DNA, 20 bp, Artificial Sequence
  chemically synthesized
atcctaattcagaataaact

SEQ ID NO: 163669 - DNA, 20 bp, Artificial Sequence
  chemically synthesized
catctaagtttattctgaat

SEQ ID NO: 163670 - DNA, 20 bp, Artificial Sequence
  chemically synthesized
atctaagtttattctgaatt

SEQ ID NO: 163671 - DNA, 20 bp, Artificial Sequence
  chemically synthesized
atacttcatatatcctaatt

SEQ ID NO: 163672 - DNA, 20 bp, Artificial Sequence
  chemically synthesized
attctgaattaggatatatg

SEQ ID NO: 163673 - DNA, 20 bp, Artificial Sequence
  chemically synthesized
gtaacattctgaagggtttt

SEQ ID NO: 163674 - DNA, 20 bp, Artificial Sequence
  chemically synthesized
aagtattacttaaaaccctt

SEQ ID NO: 163675 - DNA, 20 bp, Artificial Sequence
  chemically synthesized
aaactatgtaacattctgaa

SEQ ID NO: 163676 - DNA, 20 bp, Artificial Sequence
  chemically synthesized
aaaactatgtaacattctga

SEQ ID NO: 163677 - DNA, 20 bp, Artificial Sequence
  chemically synthesized
caaaactatgtaacattctg

SEQ ID NO: 163678 - DNA, 20 bp, Artificial Sequence
  chemically synthesized
aaacccttcagaatgttaca

SEQ ID NO: 163679 - DNA, 20 bp, Artificial Sequence
  chemically synthesized
agaatgttacatagttttgt

SEQ ID NO: 163680 - DNA, 20 bp, Artificial Sequence
  chemically synthesized
aatgttacatagttttgtta

SEQ ID NO: 163681 - DNA, 20 bp, Artificial Sequence
  chemically synthesized
attatctaaaaaataattta

SEQ ID NO: 163682 - DNA, 20 bp, Artificial Sequence
  chemically synthesized
tgcatctttaaattattttt

SEQ ID NO: 163683 - DNA, 20 bp, Artificial Sequence
  chemically synthesized
gataatatattattatcatt

SEQ ID NO: 163684 - DNA, 20 bp, Artificial Sequence
  chemically synthesized
tccactcatatttgagagtt

SEQ ID NO: 163685 - DNA, 20 bp, Artificial Sequence
  chemically synthesized
aaacttccactcatatttga

SEQ ID NO: 163686 - DNA, 20 bp, Artificial Sequence
  chemically synthesized
ttttctcaactctcaaatat

SEQ ID NO: 163687 - DNA, 20 bp, Artificial Sequence
  chemically synthesized
ttaaacttccactcatattt

SEQ ID NO: 163688 - DNA, 20 bp, Artificial Sequence
  chemically synthesized
tctcaactctcaaatatgag

SEQ ID NO: 163689 - DNA, 20 bp, Artificial Sequence
  chemically synthesized
caactctcaaatatgagtgg

SEQ ID NO: 163690 - DNA, 20 bp, Artificial Sequence
  chemically synthesized
atatgagtggaagtttaaat

SEQ ID NO: 163691 - DNA, 20 bp, Artificial Sequence
  chemically synthesized
gtggaagtttaaattggtat

SEQ ID NO: 163692 - DNA, 20 bp, Artificial Sequence
  chemically synthesized
ttaaattggtatgagttctt

SEQ ID NO: 163693 - DNA, 20 bp, Artificial Sequence
  chemically synthesized
attggtatgagttcttgaga

SEQ ID NO: 163694 - DNA, 20 bp, Artificial Sequence
  chemically synthesized
cactcttcagtttccatctc

SEQ ID NO: 163695 - DNA, 20 bp, Artificial Sequence
  chemically synthesized
agttcttgagatggaaactg

SEQ ID NO: 163696 - DNA, 20 bp, Artificial Sequence
  chemically synthesized
ttcttgagatggaaactgaa

SEQ ID NO: 163697 - DNA, 20 bp, Artificial Sequence
  chemically synthesized
aataaagctatttcactctt

SEQ ID NO: 163698 - DNA, 20 bp, Artificial Sequence
  chemically synthesized
atggaaactgaagagtgaaa

SEQ ID NO: 163699 - DNA, 20 bp, Artificial Sequence
  chemically synthesized
agaagtatctattttaaata

SEQ ID NO: 163700 - DNA, 20 bp, Artificial Sequence
  chemically synthesized
tgaaatagctttatttaaaa

SEQ ID NO: 163701 - DNA, 20 bp, Artificial Sequence
  chemically synthesized
ttaagttttagcattaggag

SEQ ID NO: 163702 - DNA, 20 bp, Artificial Sequence
  chemically synthesized
actttaagttttagcattag

SEQ ID NO: 163703 - DNA, 20 bp, Artificial Sequence
  chemically synthesized
atactttaagttttagcatt

SEQ ID NO: 163704 - DNA, 20 bp, Artificial Sequence
  chemically synthesized
tatactttaagttttagcat

SEQ ID NO: 163705 - DNA, 20 bp, Artificial Sequence
  chemically synthesized
tctcctaatgctaaaactta

SEQ ID NO: 163706 - DNA, 20 bp, Artificial Sequence
  chemically synthesized
ttttattatactttaagttt

SEQ ID NO: 163707 - DNA, 20 bp, Artificial Sequence
  chemically synthesized
tattttttttattatacttt

SEQ ID NO: 163708 - DNA, 20 bp, Artificial Sequence
  chemically synthesized
gtataataaaaaaaataaaa

SEQ ID NO: 163709 - DNA, 20 bp, Artificial Sequence
  chemically synthesized
aataaaatagataattctta

SEQ ID NO: 163710 - DNA, 20 bp, Artificial Sequence
  chemically synthesized
aacactaaaaagaacacttt

SEQ ID NO: 163711 - DNA, 20 bp, Artificial Sequence
  chemically synthesized
aattcttaaagtgttctttt

SEQ ID NO: 163712 - DNA, 20 bp, Artificial Sequence
  chemically synthesized
ataaattattgaacactaaa

SEQ ID NO: 163713 - DNA, 20 bp, Artificial Sequence
  chemically synthesized
tatatgtattatatacatta

SEQ ID NO: 163714 - DNA, 20 bp, Artificial Sequence
  chemically synthesized
tatatacattatagttataa

SEQ ID NO: 163715 - DNA, 20 bp, Artificial Sequence
  chemically synthesized
tatagttataatggcatata

SEQ ID NO: 163716 - DNA, 20 bp, Artificial Sequence
  chemically synthesized
atgttcaaataacatctgtt

SEQ ID NO: 163717 - DNA, 20 bp, Artificial Sequence
  chemically synthesized
atatatttgtcaaaactgaa

SEQ ID NO: 163718 - DNA, 20 bp, Artificial Sequence
  chemically synthesized
tatttcccaatggggagaaa

SEQ ID NO: 163719 - DNA, 20 bp, Artificial Sequence
  chemically synthesized
atttgtctttttctccccat

SEQ ID NO: 163720 - DNA, 20 bp, Artificial Sequence
  chemically synthesized
tttgtctttttctccccatt

SEQ ID NO: 163721 - DNA, 20 bp, Artificial Sequence
  chemically synthesized
ttactttatttcccaatggg

SEQ ID NO: 163722 - DNA, 20 bp, Artificial Sequence
  chemically synthesized
tgttactttatttcccaatg

SEQ ID NO: 163723 - DNA, 20 bp, Artificial Sequence
  chemically synthesized
ttgttactttatttcccaat

SEQ ID NO: 163724 - DNA, 20 bp, Artificial Sequence
  chemically synthesized
tttgttactttatttcccaa

SEQ ID NO: 163725 - DNA, 20 bp, Artificial Sequence
  chemically synthesized
tttctccccattgggaaata

SEQ ID NO: 163726 - DNA, 20 bp, Artificial Sequence
  chemically synthesized
cattgggaaataaagtaaca

SEQ ID NO: 163727 - DNA, 20 bp, Artificial Sequence
  chemically synthesized
aaataaagtaacaaagatta

SEQ ID NO: 163728 - DNA, 20 bp, Artificial Sequence
  chemically synthesized
agtaacaaagattatggcca

SEQ ID NO: 163729 - DNA, 20 bp, Artificial Sequence
  chemically synthesized
aacaaaagcaagataaactg

SEQ ID NO: 163730 - DNA, 20 bp, Artificial Sequence
  chemically synthesized
ctgtgaggaaaaacaaaagc

SEQ ID NO: 163731 - DNA, 20 bp, Artificial Sequence
  chemically synthesized
ggtgctgtgaggaaaaacaa

SEQ ID NO: 163732 - DNA, 20 bp, Artificial Sequence
  chemically synthesized
cttgcttttgtttttcctca

SEQ ID NO: 163733 - DNA, 20 bp, Artificial Sequence
  chemically synthesized
actctctatcaggtgctgtg

SEQ ID NO: 163734 - DNA, 20 bp, Artificial Sequence
  chemically synthesized
aactctctatcaggtgctgt

SEQ ID NO: 163735 - DNA, 20 bp, Artificial Sequence
  chemically synthesized
tttttcctcacagcacctga

SEQ ID NO: 163736 - DNA, 20 bp, Artificial Sequence
  chemically synthesized
tttcctcacagcacctgata

SEQ ID NO: 163737 - DNA, 20 bp, Artificial Sequence
  chemically synthesized
tcctcacagcacctgataga

SEQ ID NO: 163738 - DNA, 20 bp, Artificial Sequence
  chemically synthesized
tacaggtagaactctctatc

SEQ ID NO: 163739 - DNA, 20 bp, Artificial Sequence
  chemically synthesized
ttacaggtagaactctctat

SEQ ID NO: 163740 - DNA, 20 bp, Artificial Sequence
  chemically synthesized
gtgaacttggtgtttacagg

SEQ ID NO: 163741 - DNA, 20 bp, Artificial Sequence
  chemically synthesized
ggagtgaacttggtgtttac

SEQ ID NO: 163742 - DNA, 20 bp, Artificial Sequence
  chemically synthesized
gggagtgaacttggtgttta

SEQ ID NO: 163743 - DNA, 20 bp, Artificial Sequence
  chemically synthesized
gagttctacctgtaaacacc

SEQ ID NO: 163744 - DNA, 20 bp, Artificial Sequence
  chemically synthesized
agtggaggagggagtgaact

SEQ ID NO: 163745 - DNA, 20 bp, Artificial Sequence
  chemically synthesized
ttgtcatttagtggaggagg

SEQ ID NO: 163746 - DNA, 20 bp, Artificial Sequence
  chemically synthesized
cattgtcatttagtggagga

SEQ ID NO: 163747 - DNA, 20 bp, Artificial Sequence
  chemically synthesized
acattgtcatttagtggagg

SEQ ID NO: 163748 - DNA, 20 bp, Artificial Sequence
  chemically synthesized
tacattgtcatttagtggag

SEQ ID NO: 163749 - DNA, 20 bp, Artificial Sequence
  chemically synthesized
gttacattgtcatttagtgg

SEQ ID NO: 163750 - DNA, 20 bp, Artificial Sequence
  chemically synthesized
tgttacattgtcatttagtg

SEQ ID NO: 163751 - DNA, 20 bp, Artificial Sequence
  chemically synthesized
cttgttacattgtcatttag

SEQ ID NO: 163752 - DNA, 20 bp, Artificial Sequence
  chemically synthesized
ccacttgttacattgtcatt

SEQ ID NO: 163753 - DNA, 20 bp, Artificial Sequence
  chemically synthesized
ccactaaatgacaatgtaac

SEQ ID NO: 163754 - DNA, 20 bp, Artificial Sequence
  chemically synthesized
ctaaatgacaatgtaacaag

SEQ ID NO: 163755 - DNA, 20 bp, Artificial Sequence
  chemically synthesized
acaatgtaacaagtggcttc

SEQ ID NO: 163756 - DNA, 20 bp, Artificial Sequence
  chemically synthesized
caaaaagttggagcaacttg

SEQ ID NO: 163757 - DNA, 20 bp, Artificial Sequence
  chemically synthesized
ggatgccttccaaaaagttg

SEQ ID NO: 163758 - DNA, 20 bp, Artificial Sequence
  chemically synthesized
ttcaagttgctccaactttt

SEQ ID NO: 163759 - DNA, 20 bp, Artificial Sequence
  chemically synthesized
aaggatgccttccaaaaagt

SEQ ID NO: 163760 - DNA, 20 bp, Artificial Sequence
  chemically synthesized
aagttgctccaactttttgg

SEQ ID NO: 163761 - DNA, 20 bp, Artificial Sequence
  chemically synthesized
agttgctccaactttttgga

SEQ ID NO: 163762 - DNA, 20 bp, Artificial Sequence
  chemically synthesized
gtataaggatgccttccaaa

SEQ ID NO: 163763 - DNA, 20 bp, Artificial Sequence
  chemically synthesized
gtgattatccattatgtata

SEQ ID NO: 163764 - DNA, 20 bp, Artificial Sequence
  chemically synthesized
cgtgattatccattatgtat

SEQ ID NO: 163765 - DNA, 20 bp, Artificial Sequence
  chemically synthesized
gaaggcatccttatacataa

SEQ ID NO: 163766 - DNA, 20 bp, Artificial Sequence
  chemically synthesized
tggataatcacgcttgtttt

SEQ ID NO: 163767 - DNA, 20 bp, Artificial Sequence
  chemically synthesized
gataatcacgcttgttttta

SEQ ID NO: 163768 - DNA, 20 bp, Artificial Sequence
  chemically synthesized
attatgatacctctaaaaac

SEQ ID NO: 163769 - DNA, 20 bp, Artificial Sequence
  chemically synthesized
ataatcacgcttgtttttag

SEQ ID NO: 163770 - DNA, 20 bp, Artificial Sequence
  chemically synthesized
aggtatcataattacaaatt

SEQ ID NO: 163771 - DNA, 20 bp, Artificial Sequence
  chemically synthesized
aattacaaatttagaattct

SEQ ID NO: 163772 - DNA, 20 bp, Artificial Sequence
  chemically synthesized
agttactgctgaagaacact

SEQ ID NO: 163773 - DNA, 20 bp, Artificial Sequence
  chemically synthesized
ttagaattctaagtgttctt

SEQ ID NO: 163774 - DNA, 20 bp, Artificial Sequence
  chemically synthesized
gaattctaagtgttcttcag

SEQ ID NO: 163775 - DNA, 20 bp, Artificial Sequence
  chemically synthesized
aaatctctgagttactgctg

SEQ ID NO: 163776 - DNA, 20 bp, Artificial Sequence
  chemically synthesized
agtgttcttcagcagtaact

SEQ ID NO: 163777 - DNA, 20 bp, Artificial Sequence
  chemically synthesized
tgttcttcagcagtaactca

SEQ ID NO: 163778 - DNA, 20 bp, Artificial Sequence
  chemically synthesized
aaagggattcttaaatctct

SEQ ID NO: 163779 - DNA, 20 bp, Artificial Sequence
  chemically synthesized
cagcagtaactcagagattt

SEQ ID NO: 163780 - DNA, 20 bp, Artificial Sequence
  chemically synthesized
cagagatttaagaatccctt

SEQ ID NO: 163781 - DNA, 20 bp, Artificial Sequence
  chemically synthesized
tgactatatcagttactaaa

SEQ ID NO: 163782 - DNA, 20 bp, Artificial Sequence
  chemically synthesized
ctgactatatcagttactaa

SEQ ID NO: 163783 - DNA, 20 bp, Artificial Sequence
  chemically synthesized
gctgactatatcagttacta

SEQ ID NO: 163784 - DNA, 20 bp, Artificial Sequence
  chemically synthesized
aatccctttagtaactgata

SEQ ID NO: 163785 - DNA, 20 bp, Artificial Sequence
  chemically synthesized
cctttagtaactgatatagt

SEQ ID NO: 163786 - DNA, 20 bp, Artificial Sequence
  chemically synthesized
cggttctctgctgactatat

SEQ ID NO: 163787 - DNA, 20 bp, Artificial Sequence
  chemically synthesized
ttagtaactgatatagtcag

SEQ ID NO: 163788 - DNA, 20 bp, Artificial Sequence
  chemically synthesized
agtaactgatatagtcagca

SEQ ID NO: 163789 - DNA, 20 bp, Artificial Sequence
  chemically synthesized
tgtattttcatcaggaaata

SEQ ID NO: 163790 - DNA, 20 bp, Artificial Sequence
  chemically synthesized
tctgagcttgtattttcatc

SEQ ID NO: 163791 - DNA, 20 bp, Artificial Sequence
  chemically synthesized
ctctgagcttgtattttcat

SEQ ID NO: 163792 - DNA, 20 bp, Artificial Sequence
  chemically synthesized
gtatttcctgatgaaaatac

SEQ ID NO: 163793 - DNA, 20 bp, Artificial Sequence
  chemically synthesized
tcctgatgaaaatacaagct

SEQ ID NO: 163794 - DNA, 20 bp, Artificial Sequence
  chemically synthesized
ctgatgaaaatacaagctca

SEQ ID NO: 163795 - DNA, 20 bp, Artificial Sequence
  chemically synthesized
cctgctgaccttgtggctct

SEQ ID NO: 163796 - DNA, 20 bp, Artificial Sequence
  chemically synthesized
aaatacaagctcagagccac

SEQ ID NO: 163797 - DNA, 20 bp, Artificial Sequence
  chemically synthesized
aatacaagctcagagccaca

SEQ ID NO: 163798 - DNA, 20 bp, Artificial Sequence
  chemically synthesized
caagctcagagccacaaggt

SEQ ID NO: 163799 - DNA, 20 bp, Artificial Sequence
  chemically synthesized
tctctaccctgctgaccttg

SEQ ID NO: 163800 - DNA, 20 bp, Artificial Sequence
  chemically synthesized
gctcagagccacaaggtcag

SEQ ID NO: 163801 - DNA, 20 bp, Artificial Sequence
  chemically synthesized
ctcagagccacaaggtcagc

SEQ ID NO: 163802 - DNA, 20 bp, Artificial Sequence
  chemically synthesized
tcagagccacaaggtcagca

SEQ ID NO: 163803 - DNA, 20 bp, Artificial Sequence
  chemically synthesized
gagccacaaggtcagcaggg

SEQ ID NO: 163804 - DNA, 20 bp, Artificial Sequence
  chemically synthesized
gccacaaggtcagcagggta

SEQ ID NO: 163805 - DNA, 20 bp, Artificial Sequence
  chemically synthesized
tcagcagggtagagacttat

SEQ ID NO: 163806 - DNA, 20 bp, Artificial Sequence
  chemically synthesized
cagcagggtagagacttatc

SEQ ID NO: 163807 - DNA, 20 bp, Artificial Sequence
  chemically synthesized
cagggtagagacttatcagg

SEQ ID NO: 163808 - DNA, 20 bp, Artificial Sequence
  chemically synthesized
gtgcctcttgtctgcctgat

SEQ ID NO: 163809 - DNA, 20 bp, Artificial Sequence
  chemically synthesized
tagagacttatcaggcagac

SEQ ID NO: 163810 - DNA, 20 bp, Artificial Sequence
  chemically synthesized
gagacttatcaggcagacaa

SEQ ID NO: 163811 - DNA, 20 bp, Artificial Sequence
  chemically synthesized
agacttatcaggcagacaag

SEQ ID NO: 163812 - DNA, 20 bp, Artificial Sequence
  chemically synthesized
gcagacaagaggcactgttc

SEQ ID NO: 163813 - DNA, 20 bp, Artificial Sequence
  chemically synthesized
agacaagaggcactgttcca

SEQ ID NO: 163814 - DNA, 20 bp, Artificial Sequence
  chemically synthesized
acaagaggcactgttccaga

SEQ ID NO: 163815 - DNA, 20 bp, Artificial Sequence
  chemically synthesized
tgaccctctgctctctggaa

SEQ ID NO: 163816 - DNA, 20 bp, Artificial Sequence
  chemically synthesized
agaggcactgttccagagag

SEQ ID NO: 163817 - DNA, 20 bp, Artificial Sequence
  chemically synthesized
aggcactgttccagagagca

SEQ ID NO: 163818 - DNA, 20 bp, Artificial Sequence
  chemically synthesized
tcctctgaccctctgctctc

SEQ ID NO: 163819 - DNA, 20 bp, Artificial Sequence
  chemically synthesized
ggcactgttccagagagcag

SEQ ID NO: 163820 - DNA, 20 bp, Artificial Sequence
  chemically synthesized
gcactgttccagagagcaga

SEQ ID NO: 163821 - DNA, 20 bp, Artificial Sequence
  chemically synthesized
tgttccagagagcagagggt

SEQ ID NO: 163822 - DNA, 20 bp, Artificial Sequence
  chemically synthesized
ttccagagagcagagggtca

SEQ ID NO: 163823 - DNA, 20 bp, Artificial Sequence
  chemically synthesized
tccagagagcagagggtcag

SEQ ID NO: 163824 - DNA, 20 bp, Artificial Sequence
  chemically synthesized
cagagagcagagggtcagag

SEQ ID NO: 163825 - DNA, 20 bp, Artificial Sequence
  chemically synthesized
agagggtcagaggagactgc

SEQ ID NO: 163826 - DNA, 20 bp, Artificial Sequence
  chemically synthesized
gatctctatgcaggtacttg

SEQ ID NO: 163827 - DNA, 20 bp, Artificial Sequence
  chemically synthesized
ggagactgcaagtacctgca

SEQ ID NO: 163828 - DNA, 20 bp, Artificial Sequence
  chemically synthesized
agactgcaagtacctgcata

SEQ ID NO: 163829 - DNA, 20 bp, Artificial Sequence
  chemically synthesized
atgacctgagatctctatgc

SEQ ID NO: 163830 - DNA, 20 bp, Artificial Sequence
  chemically synthesized
catgacctgagatctctatg

SEQ ID NO: 163831 - DNA, 20 bp, Artificial Sequence
  chemically synthesized
aagtacctgcatagagatct

SEQ ID NO: 163832 - DNA, 20 bp, Artificial Sequence
  chemically synthesized
agtacctgcatagagatctc

SEQ ID NO: 163833 - DNA, 20 bp, Artificial Sequence
  chemically synthesized
ggaagcattatacatgacct

SEQ ID NO: 163834 - DNA, 20 bp, Artificial Sequence
  chemically synthesized
agctgggttgacagatgagg

SEQ ID NO: 163835 - DNA, 20 bp, Artificial Sequence
  chemically synthesized
ggcagctgggttgacagatg

SEQ ID NO: 163836 - DNA, 20 bp, Artificial Sequence
  chemically synthesized
tggcagctgggttgacagat

SEQ ID NO: 163837 - DNA, 20 bp, Artificial Sequence
  chemically synthesized
tgcttcctcatctgtcaacc

SEQ ID NO: 163838 - DNA, 20 bp, Artificial Sequence
  chemically synthesized
caaaatggcagctgggttga

SEQ ID NO: 163839 - DNA, 20 bp, Artificial Sequence
  chemically synthesized
tcctctccaaaatggcagct

SEQ ID NO: 163840 - DNA, 20 bp, Artificial Sequence
  chemically synthesized
ctcctctccaaaatggcagc

SEQ ID NO: 163841 - DNA, 20 bp, Artificial Sequence
  chemically synthesized
tgtcaacccagctgccattt

SEQ ID NO: 163842 - DNA, 20 bp, Artificial Sequence
  chemically synthesized
cctgctcctctccaaaatgg

SEQ ID NO: 163843 - DNA, 20 bp, Artificial Sequence
  chemically synthesized
tcaacccagctgccattttg

SEQ ID NO: 163844 - DNA, 20 bp, Artificial Sequence
  chemically synthesized
aacccagctgccattttgga

SEQ ID NO: 163845 - DNA, 20 bp, Artificial Sequence
  chemically synthesized
cctcctgctcctctccaaaa

SEQ ID NO: 163846 - DNA, 20 bp, Artificial Sequence
  chemically synthesized
acccagctgccattttggag

SEQ ID NO: 163847 - DNA, 20 bp, Artificial Sequence
  chemically synthesized
ccagctgccattttggagag

SEQ ID NO: 163848 - DNA, 20 bp, Artificial Sequence
  chemically synthesized
gctgccattttggagaggag

SEQ ID NO: 163849 - DNA, 20 bp, Artificial Sequence
  chemically synthesized
ctgccattttggagaggagc

SEQ ID NO: 163850 - DNA, 20 bp, Artificial Sequence
  chemically synthesized
gccattttggagaggagcag

SEQ ID NO: 163851 - DNA, 20 bp, Artificial Sequence
  chemically synthesized
ccattttggagaggagcagg

SEQ ID NO: 163852 - DNA, 20 bp, Artificial Sequence
  chemically synthesized
attttggagaggagcaggag

SEQ ID NO: 163853 - DNA, 20 bp, Artificial Sequence
  chemically synthesized
tttggagaggagcaggagga

SEQ ID NO: 163854 - DNA, 20 bp, Artificial Sequence
  chemically synthesized
gagaggagcaggaggagagc

SEQ ID NO: 163855 - DNA, 20 bp, Artificial Sequence
  chemically synthesized
agaggagcaggaggagagca

SEQ ID NO: 163856 - DNA, 20 bp, Artificial Sequence
  chemically synthesized
aggagagcaaggaaatctaa

SEQ ID NO: 163857 - DNA, 20 bp, Artificial Sequence
  chemically synthesized
agcaaggaaatctaaaagac

SEQ ID NO: 163858 - DNA, 20 bp, Artificial Sequence
  chemically synthesized
atggataatgaccagtcttt

SEQ ID NO: 163859 - DNA, 20 bp, Artificial Sequence
  chemically synthesized
gggacctcatggataatgac

SEQ ID NO: 163860 - DNA, 20 bp, Artificial Sequence
  chemically synthesized
aaagactggtcattatccat

SEQ ID NO: 163861 - DNA, 20 bp, Artificial Sequence
  chemically synthesized
aagactggtcattatccatg

SEQ ID NO: 163862 - DNA, 20 bp, Artificial Sequence
  chemically synthesized
ttttatgggttgggacctca

SEQ ID NO: 163863 - DNA, 20 bp, Artificial Sequence
  chemically synthesized
ccagtctctttttatgggtt

SEQ ID NO: 163864 - DNA, 20 bp, Artificial Sequence
  chemically synthesized
accagtctctttttatgggt

SEQ ID NO: 163865 - DNA, 20 bp, Artificial Sequence
  chemically synthesized
atgaggtcccaacccataaa

SEQ ID NO: 163866 - DNA, 20 bp, Artificial Sequence
  chemically synthesized
gaggtcccaacccataaaaa

SEQ ID NO: 163867 - DNA, 20 bp, Artificial Sequence
  chemically synthesized
tttcaccagtctctttttat

SEQ ID NO: 163868 - DNA, 20 bp, Artificial Sequence
  chemically synthesized
atttcaccagtctcttttta

SEQ ID NO: 163869 - DNA, 20 bp, Artificial Sequence
  chemically synthesized
cccaacccataaaaagagac

SEQ ID NO: 163870 - DNA, 20 bp, Artificial Sequence
  chemically synthesized
ctctgaaatagtgatttcac

SEQ ID NO: 163871 - DNA, 20 bp, Artificial Sequence
  chemically synthesized
gactggtgaaatcactattt

SEQ ID NO: 163872 - DNA, 20 bp, Artificial Sequence
  chemically synthesized
ctggtgaaatcactatttca

SEQ ID NO: 163873 - DNA, 20 bp, Artificial Sequence
  chemically synthesized
attatcatctcactctgaaa

SEQ ID NO: 163874 - DNA, 20 bp, Artificial Sequence
  chemically synthesized
tgaaatcactatttcagagt

SEQ ID NO: 163875 - DNA, 20 bp, Artificial Sequence
  chemically synthesized
gataattttttctcactgcc

SEQ ID NO: 163876 - DNA, 20 bp, Artificial Sequence
  chemically synthesized
cctttcccatactgggcagt

SEQ ID NO: 163877 - DNA, 20 bp, Artificial Sequence
  chemically synthesized
ttttttctcactgcccagta

SEQ ID NO: 163878 - DNA, 20 bp, Artificial Sequence
  chemically synthesized
taaccctttcccatactggg

SEQ ID NO: 163879 - DNA, 20 bp, Artificial Sequence
  chemically synthesized
tttttctcactgcccagtat

SEQ ID NO: 163880 - DNA, 20 bp, Artificial Sequence
  chemically synthesized
tcataaccctttcccatact

SEQ ID NO: 163881 - DNA, 20 bp, Artificial Sequence
  chemically synthesized
ttcataaccctttcccatac

SEQ ID NO: 163882 - DNA, 20 bp, Artificial Sequence
  chemically synthesized
tctcactgcccagtatggga

SEQ ID NO: 163883 - DNA, 20 bp, Artificial Sequence
  chemically synthesized
ctcactgcccagtatgggaa

SEQ ID NO: 163884 - DNA, 20 bp, Artificial Sequence
  chemically synthesized
tcactgcccagtatgggaaa

SEQ ID NO: 163885 - DNA, 20 bp, Artificial Sequence
  chemically synthesized
cagtatgggaaagggttatg

SEQ ID NO: 163886 - DNA, 20 bp, Artificial Sequence
  chemically synthesized
aaagggttatgaagatcact

SEQ ID NO: 163887 - DNA, 20 bp, Artificial Sequence
  chemically synthesized
aaacttcttcatttatttct

SEQ ID NO: 163888 - DNA, 20 bp, Artificial Sequence
  chemically synthesized
agatcactgagaaataaatg

SEQ ID NO: 163889 - DNA, 20 bp, Artificial Sequence
  chemically synthesized
tcactgagaaataaatgaag

SEQ ID NO: 163890 - DNA, 20 bp, Artificial Sequence
  chemically synthesized
aatgaagaagttttcattct

SEQ ID NO: 163891 - DNA, 20 bp, Artificial Sequence
  chemically synthesized
gggagtcaaatattgattct

SEQ ID NO: 163892 - DNA, 20 bp, Artificial Sequence
  chemically synthesized
gagaatcaatatttgactcc

SEQ ID NO: 163893 - DNA, 20 bp, Artificial Sequence
  chemically synthesized
agttaaatgggtatgtccgg

SEQ ID NO: 163894 - DNA, 20 bp, Artificial Sequence
  chemically synthesized
gaagttaaatgggtatgtcc

SEQ ID NO: 163895 - DNA, 20 bp, Artificial Sequence
  chemically synthesized
agaagttaaatgggtatgtc

SEQ ID NO: 163896 - DNA, 20 bp, Artificial Sequence
  chemically synthesized
atatgcaggagaagttaaat

SEQ ID NO: 163897 - DNA, 20 bp, Artificial Sequence
  chemically synthesized
aatatgcaggagaagttaaa

SEQ ID NO: 163898 - DNA, 20 bp, Artificial Sequence
  chemically synthesized
atacaataaatatgcaggag

SEQ ID NO: 163899 - DNA, 20 bp, Artificial Sequence
  chemically synthesized
tgcatacaataaatatgcag

SEQ ID NO: 163900 - DNA, 20 bp, Artificial Sequence
  chemically synthesized
catgcatacaataaatatgc

SEQ ID NO: 163901 - DNA, 20 bp, Artificial Sequence
  chemically synthesized
tcatgcatacaataaatatg

SEQ ID NO: 163902 - DNA, 20 bp, Artificial Sequence
  chemically synthesized
gcatgaaaatgtatctactt

SEQ ID NO: 163903 - DNA, 20 bp, Artificial Sequence
  chemically synthesized
cactgtcatagattcttaag

SEQ ID NO: 163904 - DNA, 20 bp, Artificial Sequence
  chemically synthesized
aagcactgtcatagattctt

SEQ ID NO: 163905 - DNA, 20 bp, Artificial Sequence
  chemically synthesized
atctacttaagaatctatga

SEQ ID NO: 163906 - DNA, 20 bp, Artificial Sequence
  chemically synthesized
cagtttgaaaagcactgtca

SEQ ID NO: 163907 - DNA, 20 bp, Artificial Sequence
  chemically synthesized
ctgtggaaccacagtttgaa

SEQ ID NO: 163908 - DNA, 20 bp, Artificial Sequence
  chemically synthesized
tgacagtgcttttcaaactg

SEQ ID NO: 163909 - DNA, 20 bp, Artificial Sequence
  chemically synthesized
atttctggtctgtggaacca

SEQ ID NO: 163910 - DNA, 20 bp, Artificial Sequence
  chemically synthesized
cttttcaaactgtggttcca

SEQ ID NO: 163911 - DNA, 20 bp, Artificial Sequence
  chemically synthesized
caaactgtggttccacagac

SEQ ID NO: 163912 - DNA, 20 bp, Artificial Sequence
  chemically synthesized
aaactgttatttctggtctg

SEQ ID NO: 163913 - DNA, 20 bp, Artificial Sequence
  chemically synthesized
gttccacagaccagaaataa

SEQ ID NO: 163914 - DNA, 20 bp, Artificial Sequence
  chemically synthesized
taatgtgaaactgttatttc

SEQ ID NO: 163915 - DNA, 20 bp, Artificial Sequence
  chemically synthesized
acagtttcacattaaatttt

SEQ ID NO: 163916 - DNA, 20 bp, Artificial Sequence
  chemically synthesized
gtttcacattaaattttaag

SEQ ID NO: 163917 - DNA, 20 bp, Artificial Sequence
  chemically synthesized
acattaaattttaagaagca

SEQ ID NO: 163918 - DNA, 20 bp, Artificial Sequence
  chemically synthesized
aattttaagaagcatggctc

SEQ ID NO: 163919 - DNA, 20 bp, Artificial Sequence
  chemically synthesized
ttaagaagcatggctctaga

SEQ ID NO: 163920 - DNA, 20 bp, Artificial Sequence
  chemically synthesized
taagaagcatggctctagat

SEQ ID NO: 163921 - DNA, 20 bp, Artificial Sequence
  chemically synthesized
attctactatatcctatcta

SEQ ID NO: 163922 - DNA, 20 bp, Artificial Sequence
  chemically synthesized
ttattctactatatcctatc

SEQ ID NO: 163923 - DNA, 20 bp, Artificial Sequence
  chemically synthesized
gcatggctctagataggata

SEQ ID NO: 163924 - DNA, 20 bp, Artificial Sequence
  chemically synthesized
tggctctagataggatatag

SEQ ID NO: 163925 - DNA, 20 bp, Artificial Sequence
  chemically synthesized
tagataggatatagtagaat

SEQ ID NO: 163926 - DNA, 20 bp, Artificial Sequence
  chemically synthesized
agataggatatagtagaata

SEQ ID NO: 163927 - DNA, 20 bp, Artificial Sequence
  chemically synthesized
ggatatagtagaataaggaa

SEQ ID NO: 163928 - DNA, 20 bp, Artificial Sequence
  chemically synthesized
tagtagaataaggaatggat

SEQ ID NO: 163929 - DNA, 20 bp, Artificial Sequence
  chemically synthesized
aataaggaatggataagtgt

SEQ ID NO: 163930 - DNA, 20 bp, Artificial Sequence
  chemically synthesized
atggataagtgttagcctcc

SEQ ID NO: 163931 - DNA, 20 bp, Artificial Sequence
  chemically synthesized
taaatgaattaaaatctggg

SEQ ID NO: 163932 - DNA, 20 bp, Artificial Sequence
  chemically synthesized
gtaaatgaattaaaatctgg

SEQ ID NO: 163933 - DNA, 20 bp, Artificial Sequence
  chemically synthesized
atgtaaatgaattaaaatct

SEQ ID NO: 163934 - DNA, 20 bp, Artificial Sequence
  chemically synthesized
tatgtaaatgaattaaaatc

SEQ ID NO: 163935 - DNA, 20 bp, Artificial Sequence
  chemically synthesized
ttaattcatttacatactta

SEQ ID NO: 163936 - DNA, 20 bp, Artificial Sequence
  chemically synthesized
aagataagtgttatatccat

SEQ ID NO: 163937 - DNA, 20 bp, Artificial Sequence
  chemically synthesized
aagtcgtatcatttaaagat

SEQ ID NO: 163938 - DNA, 20 bp, Artificial Sequence
  chemically synthesized
tcacaaagtcgtatcattta

SEQ ID NO: 163939 - DNA, 20 bp, Artificial Sequence
  chemically synthesized
catgaagctgtttattcaca

SEQ ID NO: 163940 - DNA, 20 bp, Artificial Sequence
  chemically synthesized
gatacgactttgtgaataaa

SEQ ID NO: 163941 - DNA, 20 bp, Artificial Sequence
  chemically synthesized
ctcataaagctatattcatg

SEQ ID NO: 163942 - DNA, 20 bp, Artificial Sequence
  chemically synthesized
aataaacagcttcatgaata

SEQ ID NO: 163943 - DNA, 20 bp, Artificial Sequence
  chemically synthesized
cttcatgaatatagctttat

SEQ ID NO: 163944 - DNA, 20 bp, Artificial Sequence
  chemically synthesized
cctttctccattgtctcata

SEQ ID NO: 163945 - DNA, 20 bp, Artificial Sequence
  chemically synthesized
aatatagctttatgagacaa

SEQ ID NO: 163946 - DNA, 20 bp, Artificial Sequence
  chemically synthesized
tatagctttatgagacaatg

SEQ ID NO: 163947 - DNA, 20 bp, Artificial Sequence
  chemically synthesized
gctttatgagacaatggaga

SEQ ID NO: 163948 - DNA, 20 bp, Artificial Sequence
  chemically synthesized
ctttatgagacaatggagaa

SEQ ID NO: 163949 - DNA, 20 bp, Artificial Sequence
  chemically synthesized
tatgagacaatggagaaagg

SEQ ID NO: 163950 - DNA, 20 bp, Artificial Sequence
  chemically synthesized
tcataactttttaaaaaatt

SEQ ID NO: 163951 - DNA, 20 bp, Artificial Sequence
  chemically synthesized
aggtggccaaattttttaaa

SEQ ID NO: 163952 - DNA, 20 bp, Artificial Sequence
  chemically synthesized
attttttaaaaagttatgat

SEQ ID NO: 163953 - DNA, 20 bp, Artificial Sequence
  chemically synthesized
ttttaaaaagttatgattag

SEQ ID NO: 163954 - DNA, 20 bp, Artificial Sequence
  chemically synthesized
tagaagaattgtgttgtttt

SEQ ID NO: 163955 - DNA, 20 bp, Artificial Sequence
  chemically synthesized
ttttaagtattgcaaattgc

SEQ ID NO: 163956 - DNA, 20 bp, Artificial Sequence
  chemically synthesized
agtattgcaaattgcaagtg

SEQ ID NO: 163957 - DNA, 20 bp, Artificial Sequence
  chemically synthesized
tattgcaaattgcaagtgca

SEQ ID NO: 163958 - DNA, 20 bp, Artificial Sequence
  chemically synthesized
gttgggatttcagatacatt

SEQ ID NO: 163959 - DNA, 20 bp, Artificial Sequence
  chemically synthesized
aaaataacacgttgggattt

SEQ ID NO: 163960 - DNA, 20 bp, Artificial Sequence
  chemically synthesized
ttggtagaaaataacacgtt

SEQ ID NO: 163961 - DNA, 20 bp, Artificial Sequence
  chemically synthesized
gttggtagaaaataacacgt

SEQ ID NO: 163962 - DNA, 20 bp, Artificial Sequence
  chemically synthesized
aacgtgttattttctaccaa

SEQ ID NO: 163963 - DNA, 20 bp, Artificial Sequence
  chemically synthesized
ttggtggcattgactgttgg

SEQ ID NO: 163964 - DNA, 20 bp, Artificial Sequence
  chemically synthesized
cccttggtggcattgactgt

SEQ ID NO: 163965 - DNA, 20 bp, Artificial Sequence
  chemically synthesized
taccaacagtcaatgccacc

SEQ ID NO: 163966 - DNA, 20 bp, Artificial Sequence
  chemically synthesized
accaacagtcaatgccacca

SEQ ID NO: 163967 - DNA, 20 bp, Artificial Sequence
  chemically synthesized
ccaacagtcaatgccaccaa

SEQ ID NO: 163968 - DNA, 20 bp, Artificial Sequence
  chemically synthesized
aacagtcaatgccaccaagg

SEQ ID NO: 163969 - DNA, 20 bp, Artificial Sequence
  chemically synthesized
acagtcaatgccaccaaggg

SEQ ID NO: 163970 - DNA, 20 bp, Artificial Sequence
  chemically synthesized
ttgcaagttacctcccttgg

SEQ ID NO: 163971 - DNA, 20 bp, Artificial Sequence
  chemically synthesized
aacttgcaagttacctccct

SEQ ID NO: 163972 - DNA, 20 bp, Artificial Sequence
  chemically synthesized
caccaagggaggtaacttgc

SEQ ID NO: 163973 - DNA, 20 bp, Artificial Sequence
  chemically synthesized
gaggaaggttttaaacttgc

SEQ ID NO: 163974 - DNA, 20 bp, Artificial Sequence
  chemically synthesized
caatggaagttaaatgagga

SEQ ID NO: 163975 - DNA, 20 bp, Artificial Sequence
  chemically synthesized
acaatggaagttaaatgagg

SEQ ID NO: 163976 - DNA, 20 bp, Artificial Sequence
  chemically synthesized
gaaacaatggaagttaaatg

SEQ ID NO: 163977 - DNA, 20 bp, Artificial Sequence
  chemically synthesized
agaaacaatggaagttaaat

SEQ ID NO: 163978 - DNA, 20 bp, Artificial Sequence
  chemically synthesized
acgcggtgcagaaacaatgg

SEQ ID NO: 163979 - DNA, 20 bp, Artificial Sequence
  chemically synthesized
agaacgcggtgcagaaacaa

SEQ ID NO: 163980 - DNA, 20 bp, Artificial Sequence
  chemically synthesized
ttggcagacagaacgcggtg

SEQ ID NO: 163981 - DNA, 20 bp, Artificial Sequence
  chemically synthesized
tttgattggcagacagaacg

SEQ ID NO: 163982 - DNA, 20 bp, Artificial Sequence
  chemically synthesized
ggatggctttgattggcaga

SEQ ID NO: 163983 - DNA, 20 bp, Artificial Sequence
  chemically synthesized
cgcgttctgtctgccaatca

SEQ ID NO: 163984 - DNA, 20 bp, Artificial Sequence
  chemically synthesized
caggggatggctttgattgg

SEQ ID NO: 163985 - DNA, 20 bp, Artificial Sequence
  chemically synthesized
gcccaggggatggctttgat

SEQ ID NO: 163986 - DNA, 20 bp, Artificial Sequence
  chemically synthesized
tgccaatcaaagccatcccc

SEQ ID NO: 163987 - DNA, 20 bp, Artificial Sequence
  chemically synthesized
gccaatcaaagccatcccct

SEQ ID NO: 163988 - DNA, 20 bp, Artificial Sequence
  chemically synthesized
taactataatgcccagggga

SEQ ID NO: 163989 - DNA, 20 bp, Artificial Sequence
  chemically synthesized
ttactaactataatgcccag

SEQ ID NO: 163990 - DNA, 20 bp, Artificial Sequence
  chemically synthesized
tttactaactataatgccca

SEQ ID NO: 163991 - DNA, 20 bp, Artificial Sequence
  chemically synthesized
gtttactaactataatgccc

SEQ ID NO: 163992 - DNA, 20 bp, Artificial Sequence
  chemically synthesized
aagccatcccctgggcatta

SEQ ID NO: 163993 - DNA, 20 bp, Artificial Sequence
  chemically synthesized
ggtttactaactataatgcc

SEQ ID NO: 163994 - DNA, 20 bp, Artificial Sequence
  chemically synthesized
catcccctgggcattatagt

SEQ ID NO: 163995 - DNA, 20 bp, Artificial Sequence
  chemically synthesized
gggcattatagttagtaaac

SEQ ID NO: 163996 - DNA, 20 bp, Artificial Sequence
  chemically synthesized
ggcattatagttagtaaacc

SEQ ID NO: 163997 - DNA, 20 bp, Artificial Sequence
  chemically synthesized
attatagttagtaaaccagg

SEQ ID NO: 163998 - DNA, 20 bp, Artificial Sequence
  chemically synthesized
aagtggatgaatggaccacc

SEQ ID NO: 163999 - DNA, 20 bp, Artificial Sequence
  chemically synthesized
tttctgcttaagtggatgaa

SEQ ID NO: 164000 - DNA, 20 bp, Artificial Sequence
  chemically synthesized
ggtggtccattcatccactt

SEQ ID NO: 164001 - DNA, 20 bp, Artificial Sequence
  chemically synthesized
ggtccattcatccacttaag

SEQ ID NO: 164002 - DNA, 20 bp, Artificial Sequence
  chemically synthesized
tcaaacaatttctgcttaag

SEQ ID NO: 164003 - DNA, 20 bp, Artificial Sequence
  chemically synthesized
ttttcaaacaatttctgctt

SEQ ID NO: 164004 - DNA, 20 bp, Artificial Sequence
  chemically synthesized
agaaattgtttgaaaatgat

SEQ ID NO: 164005 - DNA, 20 bp, Artificial Sequence
  chemically synthesized
aattgtttgaaaatgattgg

SEQ ID NO: 164006 - DNA, 20 bp, Artificial Sequence
  chemically synthesized
tctgtgtggaggagaaaaat

SEQ ID NO: 164007 - DNA, 20 bp, Artificial Sequence
  chemically synthesized
ttctgtgtggaggagaaaaa

SEQ ID NO: 164008 - DNA, 20 bp, Artificial Sequence
  chemically synthesized
tcccatttttctcctccaca

SEQ ID NO: 164009 - DNA, 20 bp, Artificial Sequence
  chemically synthesized
ctttctgattctgtgtggag

SEQ ID NO: 164010 - DNA, 20 bp, Artificial Sequence
  chemically synthesized
ctctttctgattctgtgtgg

SEQ ID NO: 164011 - DNA, 20 bp, Artificial Sequence
  chemically synthesized
tctctttctgattctgtgtg

SEQ ID NO: 164012 - DNA, 20 bp, Artificial Sequence
  chemically synthesized
catctctttctgattctgtg

SEQ ID NO: 164013 - DNA, 20 bp, Artificial Sequence
  chemically synthesized
ttttctcctccacacagaat

SEQ ID NO: 164014 - DNA, 20 bp, Artificial Sequence
  chemically synthesized
ctcctccacacagaatcaga

SEQ ID NO: 164015 - DNA, 20 bp, Artificial Sequence
  chemically synthesized
cctccacacagaatcagaaa

SEQ ID NO: 164016 - DNA, 20 bp, Artificial Sequence
  chemically synthesized
tcagaaagagatgacaccca

SEQ ID NO: 164017 - DNA, 20 bp, Artificial Sequence
  chemically synthesized
cagaaagagatgacacccat

SEQ ID NO: 164018 - DNA, 20 bp, Artificial Sequence
  chemically synthesized
aaagagatgacacccatggg

SEQ ID NO: 164019 - DNA, 20 bp, Artificial Sequence
  chemically synthesized
agagatgacacccatgggca

SEQ ID NO: 164020 - DNA, 20 bp, Artificial Sequence
  chemically synthesized
gaaaactctgctctgcccat

SEQ ID NO: 164021 - DNA, 20 bp, Artificial Sequence
  chemically synthesized
agaaaactctgctctgccca

SEQ ID NO: 164022 - DNA, 20 bp, Artificial Sequence
  chemically synthesized
gatgacacccatgggcagag

SEQ ID NO: 164023 - DNA, 20 bp, Artificial Sequence
  chemically synthesized
tgacacccatgggcagagca

SEQ ID NO: 164024 - DNA, 20 bp, Artificial Sequence
  chemically synthesized
gggcagagcagagttttctt

SEQ ID NO: 164025 - DNA, 20 bp, Artificial Sequence
  chemically synthesized
gcagagcagagttttcttta

SEQ ID NO: 164026 - DNA, 20 bp, Artificial Sequence
  chemically synthesized
ttttttttttatgtactcta

SEQ ID NO: 164027 - DNA, 20 bp, Artificial Sequence
  chemically synthesized
acataaaaaaaaaaaactga

SEQ ID NO: 164028 - DNA, 20 bp, Artificial Sequence
  chemically synthesized
aaaaaaaaaaactgatagca

SEQ ID NO: 164029 - DNA, 20 bp, Artificial Sequence
  chemically synthesized
aacgtcagaagccatgctat

SEQ ID NO: 164030 - DNA, 20 bp, Artificial Sequence
  chemically synthesized
aagttatgagagaacgtcag

SEQ ID NO: 164031 - DNA, 20 bp, Artificial Sequence
  chemically synthesized
aggaagttatgagagaacgt

SEQ ID NO: 164032 - DNA, 20 bp, Artificial Sequence
  chemically synthesized
tactttgaaggaagttatga

SEQ ID NO: 164033 - DNA, 20 bp, Artificial Sequence
  chemically synthesized
aatactttgaaggaagttat

SEQ ID NO: 164034 - DNA, 20 bp, Artificial Sequence
  chemically synthesized
ttctctcataacttccttca

SEQ ID NO: 164035 - DNA, 20 bp, Artificial Sequence
  chemically synthesized
tttagataatactttgaagg

SEQ ID NO: 164036 - DNA, 20 bp, Artificial Sequence
  chemically synthesized
aaatttagataatactttga

SEQ ID NO: 164037 - DNA, 20 bp, Artificial Sequence
  chemically synthesized
gaaatttagataatactttg

SEQ ID NO: 164038 - DNA, 20 bp, Artificial Sequence
  chemically synthesized
tactcctttagaaggaaatt

SEQ ID NO: 164039 - DNA, 20 bp, Artificial Sequence
  chemically synthesized
attatctaaatttccttcta

SEQ ID NO: 164040 - DNA, 20 bp, Artificial Sequence
  chemically synthesized
ttatctaaatttccttctaa

SEQ ID NO: 164041 - DNA, 20 bp, Artificial Sequence
  chemically synthesized
atctaaatttccttctaaag

SEQ ID NO: 164042 - DNA, 20 bp, Artificial Sequence
  chemically synthesized
tccttcactactcctttaga

SEQ ID NO: 164043 - DNA, 20 bp, Artificial Sequence
  chemically synthesized
gtccttcactactcctttag

SEQ ID NO: 164044 - DNA, 20 bp, Artificial Sequence
  chemically synthesized
taaatttccttctaaaggag

SEQ ID NO: 164045 - DNA, 20 bp, Artificial Sequence
  chemically synthesized
gcagtccttcactactcctt

SEQ ID NO: 164046 - DNA, 20 bp, Artificial Sequence
  chemically synthesized
ttccttctaaaggagtagtg

SEQ ID NO: 164047 - DNA, 20 bp, Artificial Sequence
  chemically synthesized
tccttctaaaggagtagtga

SEQ ID NO: 164048 - DNA, 20 bp, Artificial Sequence
  chemically synthesized
aggagtagtgaaggactgct

SEQ ID NO: 164049 - DNA, 20 bp, Artificial Sequence
  chemically synthesized
gaattttagtttttacttag

SEQ ID NO: 164050 - DNA, 20 bp, Artificial Sequence
  chemically synthesized
ttagaattttagtttttact

SEQ ID NO: 164051 - DNA, 20 bp, Artificial Sequence
  chemically synthesized
tttactgcatattagaattt

SEQ ID NO: 164052 - DNA, 20 bp, Artificial Sequence
  chemically synthesized
aaaactaaaattctaatatg

SEQ ID NO: 164053 - DNA, 20 bp, Artificial Sequence
  chemically synthesized
ataatgcttttactgcatat

SEQ ID NO: 164054 - DNA, 20 bp, Artificial Sequence
  chemically synthesized
aaaattctaatatgcagtaa

SEQ ID NO: 164055 - DNA, 20 bp, Artificial Sequence
  chemically synthesized
tgcagtaaaagcattatttc

SEQ ID NO: 164056 - DNA, 20 bp, Artificial Sequence
  chemically synthesized
gtaaaagcattatttcaaga

SEQ ID NO: 164057 - DNA, 20 bp, Artificial Sequence
  chemically synthesized
caagaaagtataaacatatt

SEQ ID NO: 164058 - DNA, 20 bp, Artificial Sequence
  chemically synthesized
aagaaagtataaacatattt

SEQ ID NO: 164059 - DNA, 20 bp, Artificial Sequence
  chemically synthesized
agaaagtataaacatattta

SEQ ID NO: 164060 - DNA, 20 bp, Artificial Sequence
  chemically synthesized
gggtgacaaaatgacttttt

SEQ ID NO: 164061 - DNA, 20 bp, Artificial Sequence
  chemically synthesized
ggtgacaaaatgacttttta

SEQ ID NO: 164062 - DNA, 20 bp, Artificial Sequence
  chemically synthesized
cttttgaaataaaccttaaa

SEQ ID NO: 164063 - DNA, 20 bp, Artificial Sequence
  chemically synthesized
ctttttaaggtttatttcaa

SEQ ID NO: 164064 - DNA, 20 bp, Artificial Sequence
  chemically synthesized
ttaaggtttatttcaaaagc

SEQ ID NO: 164065 - DNA, 20 bp, Artificial Sequence
  chemically synthesized
aaggtttatttcaaaagcaa

SEQ ID NO: 164066 - DNA, 20 bp, Artificial Sequence
  chemically synthesized
tcaaaagcaagagaatgatc

SEQ ID NO: 164067 - DNA, 20 bp, Artificial Sequence
  chemically synthesized
caaaagcaagagaatgatct

SEQ ID NO: 164068 - DNA, 20 bp, Artificial Sequence
  chemically synthesized
aaagcaagagaatgatctag

SEQ ID NO: 164069 - DNA, 20 bp, Artificial Sequence
  chemically synthesized
agcaagagaatgatctagga

SEQ ID NO: 164070 - DNA, 20 bp, Artificial Sequence
  chemically synthesized
caagagaatgatctaggaga

SEQ ID NO: 164071 - DNA, 20 bp, Artificial Sequence
  chemically synthesized
aaagcagttctactctctcc

SEQ ID NO: 164072 - DNA, 20 bp, Artificial Sequence
  chemically synthesized
gagaatgatctaggagagag

SEQ ID NO: 164073 - DNA, 20 bp, Artificial Sequence
  chemically synthesized
aggagagagtagaactgctt

SEQ ID NO: 164074 - DNA, 20 bp, Artificial Sequence
  chemically synthesized
ggagagagtagaactgcttt

SEQ ID NO: 164075 - DNA, 20 bp, Artificial Sequence
  chemically synthesized
agagagtagaactgctttag

SEQ ID NO: 164076 - DNA, 20 bp, Artificial Sequence
  chemically synthesized
tataccattttctcctaaag

SEQ ID NO: 164077 - DNA, 20 bp, Artificial Sequence
  chemically synthesized
tattataccattttctccta

SEQ ID NO: 164078 - DNA, 20 bp, Artificial Sequence
  chemically synthesized
agaactgctttaggagaaaa

SEQ ID NO: 164079 - DNA, 20 bp, Artificial Sequence
  chemically synthesized
aggagaaaatggtataatat

SEQ ID NO: 164080 - DNA, 20 bp, Artificial Sequence
  chemically synthesized
aatggtataatattggtgaa

SEQ ID NO: 164081 - DNA, 20 bp, Artificial Sequence
  chemically synthesized
taatattggtgaatggaaaa

SEQ ID NO: 164082 - DNA, 20 bp, Artificial Sequence
  chemically synthesized
ggtgaatggaaaatagaaat

SEQ ID NO: 164083 - DNA, 20 bp, Artificial Sequence
  chemically synthesized
caaacccaatagaaattaaa

SEQ ID NO: 164084 - DNA, 20 bp, Artificial Sequence
  chemically synthesized
acaaacccaatagaaattaa

SEQ ID NO: 164085 - DNA, 20 bp, Artificial Sequence
  chemically synthesized
tggaaccttttaatttctat

SEQ ID NO: 164086 - DNA, 20 bp, Artificial Sequence
  chemically synthesized
ggaaccttttaatttctatt

SEQ ID NO: 164087 - DNA, 20 bp, Artificial Sequence
  chemically synthesized
catacaagaaacaaacccaa

SEQ ID NO: 164088 - DNA, 20 bp, Artificial Sequence
  chemically synthesized
gggtttgtttcttgtatgtc

SEQ ID NO: 164089 - DNA, 20 bp, Artificial Sequence
  chemically synthesized
taccattcctcttgacatac

SEQ ID NO: 164090 - DNA, 20 bp, Artificial Sequence
  chemically synthesized
gtttgtttcttgtatgtcaa

SEQ ID NO: 164091 - DNA, 20 bp, Artificial Sequence
  chemically synthesized
tttgtttcttgtatgtcaag

SEQ ID NO: 164092 - DNA, 20 bp, Artificial Sequence
  chemically synthesized
ttcttgtatgtcaagaggaa

SEQ ID NO: 164093 - DNA, 20 bp, Artificial Sequence
  chemically synthesized
ggaatggtattctaactgca

SEQ ID NO: 164094 - DNA, 20 bp, Artificial Sequence
  chemically synthesized
tttgttttattctttgcagt

SEQ ID NO: 164095 - DNA, 20 bp, Artificial Sequence
  chemically synthesized
gctatttgttttattctttg

SEQ ID NO: 164096 - DNA, 20 bp, Artificial Sequence
  chemically synthesized
actgcaaagaataaaacaaa

SEQ ID NO: 164097 - DNA, 20 bp, Artificial Sequence
  chemically synthesized
gcaaagaataaaacaaatag

SEQ ID NO: 164098 - DNA, 20 bp, Artificial Sequence
  chemically synthesized
agaataaaacaaatagcagt

SEQ ID NO: 164099 - DNA, 20 bp, Artificial Sequence
  chemically synthesized
aataaaacaaatagcagtga

SEQ ID NO: 164100 - DNA, 20 bp, Artificial Sequence
  chemically synthesized
ataaaacaaatagcagtgag

SEQ ID NO: 164101 - DNA, 20 bp, Artificial Sequence
  chemically synthesized
taaaacaaatagcagtgaga

SEQ ID NO: 164102 - DNA, 20 bp, Artificial Sequence
  chemically synthesized
aaatagcagtgagagggaac

SEQ ID NO: 164103 - DNA, 20 bp, Artificial Sequence
  chemically synthesized
gtgagagggaactggtgtcc

SEQ ID NO: 164104 - DNA, 20 bp, Artificial Sequence
  chemically synthesized
tctttacccatcttggacac

SEQ ID NO: 164105 - DNA, 20 bp, Artificial Sequence
  chemically synthesized
gagggaactggtgtccaaga

SEQ ID NO: 164106 - DNA, 20 bp, Artificial Sequence
  chemically synthesized
agggaactggtgtccaagat

SEQ ID NO: 164107 - DNA, 20 bp, Artificial Sequence
  chemically synthesized
tctaatctctttacccatct

SEQ ID NO: 164108 - DNA, 20 bp, Artificial Sequence
  chemically synthesized
actggtgtccaagatgggta

SEQ ID NO: 164109 - DNA, 20 bp, Artificial Sequence
  chemically synthesized
tggtgtccaagatgggtaaa

SEQ ID NO: 164110 - DNA, 20 bp, Artificial Sequence
  chemically synthesized
tccaagatgggtaaagagat

SEQ ID NO: 164111 - DNA, 20 bp, Artificial Sequence
  chemically synthesized
agatgggtaaagagattaga

SEQ ID NO: 164112 - DNA, 20 bp, Artificial Sequence
  chemically synthesized
taaagagattagaaagcccc

SEQ ID NO: 164113 - DNA, 20 bp, Artificial Sequence
  chemically synthesized
agttaattctgagcagctgg

SEQ ID NO: 164114 - DNA, 20 bp, Artificial Sequence
  chemically synthesized
gagttaattctgagcagctg

SEQ ID NO: 164115 - DNA, 20 bp, Artificial Sequence
  chemically synthesized
ttagaaagcccccagctgct

SEQ ID NO: 164116 - DNA, 20 bp, Artificial Sequence
  chemically synthesized
agagttaattctgagcagct

SEQ ID NO: 164117 - DNA, 20 bp, Artificial Sequence
  chemically synthesized
gagagttaattctgagcagc

SEQ ID NO: 164118 - DNA, 20 bp, Artificial Sequence
  chemically synthesized
tcaagagagttaattctgag

SEQ ID NO: 164119 - DNA, 20 bp, Artificial Sequence
  chemically synthesized
gcatcaagagagttaattct

SEQ ID NO: 164120 - DNA, 20 bp, Artificial Sequence
  chemically synthesized
gtaatttatctgcatcaaga

SEQ ID NO: 164121 - DNA, 20 bp, Artificial Sequence
  chemically synthesized
cagaattaactctcttgatg

SEQ ID NO: 164122 - DNA, 20 bp, Artificial Sequence
  chemically synthesized
atgtaatttatctgcatcaa

SEQ ID NO: 164123 - DNA, 20 bp, Artificial Sequence
  chemically synthesized
agatgtaatttatctgcatc

SEQ ID NO: 164124 - DNA, 20 bp, Artificial Sequence
  chemically synthesized
gatgcagataaattacatct

SEQ ID NO: 164125 - DNA, 20 bp, Artificial Sequence
  chemically synthesized
gccagttgtattagcatact

SEQ ID NO: 164126 - DNA, 20 bp, Artificial Sequence
  chemically synthesized
tctcagtatgctaatacaac

SEQ ID NO: 164127 - DNA, 20 bp, Artificial Sequence
  chemically synthesized
atttgacttgccagttgtat

SEQ ID NO: 164128 - DNA, 20 bp, Artificial Sequence
  chemically synthesized
agtatgctaatacaactggc

SEQ ID NO: 164129 - DNA, 20 bp, Artificial Sequence
  chemically synthesized
tggtttgccatttgacttgc

SEQ ID NO: 164130 - DNA, 20 bp, Artificial Sequence
  chemically synthesized
aatacaactggcaagtcaaa

SEQ ID NO: 164131 - DNA, 20 bp, Artificial Sequence
  chemically synthesized
agtcaaatggcaaaccattg

SEQ ID NO: 164132 - DNA, 20 bp, Artificial Sequence
  chemically synthesized
gtcttcatgagtaaccacaa

SEQ ID NO: 164133 - DNA, 20 bp, Artificial Sequence
  chemically synthesized
aaccattgtggttactcatg

SEQ ID NO: 164134 - DNA, 20 bp, Artificial Sequence
  chemically synthesized
tgcactttcccagtcttcat

SEQ ID NO: 164135 - DNA, 20 bp, Artificial Sequence
  chemically synthesized
ttgtggttactcatgaagac

SEQ ID NO: 164136 - DNA, 20 bp, Artificial Sequence
  chemically synthesized
tgtggttactcatgaagact

SEQ ID NO: 164137 - DNA, 20 bp, Artificial Sequence
  chemically synthesized
gttactcatgaagactggga

SEQ ID NO: 164138 - DNA, 20 bp, Artificial Sequence
  chemically synthesized
aaatcaaaactgcactttcc

SEQ ID NO: 164139 - DNA, 20 bp, Artificial Sequence
  chemically synthesized
tcatgaagactgggaaagtg

SEQ ID NO: 164140 - DNA, 20 bp, Artificial Sequence
  chemically synthesized
agtgcagttttgattttcac

SEQ ID NO: 164141 - DNA, 20 bp, Artificial Sequence
  chemically synthesized
gtgcagttttgattttcaca

SEQ ID NO: 164142 - DNA, 20 bp, Artificial Sequence
  chemically synthesized
tgattttcacaaggaaaaat

SEQ ID NO: 164143 - DNA, 20 bp, Artificial Sequence
  chemically synthesized
ttcacaaggaaaaataagtg

SEQ ID NO: 164144 - DNA, 20 bp, Artificial Sequence
  chemically synthesized
tcacaaggaaaaataagtgt

SEQ ID NO: 164145 - DNA, 20 bp, Artificial Sequence
  chemically synthesized
aagtgtgggaataaaatgtt

SEQ ID NO: 164146 - DNA, 20 bp, Artificial Sequence
  chemically synthesized
ggaataaaatgttaagcttc

SEQ ID NO: 164147 - DNA, 20 bp, Artificial Sequence
  chemically synthesized
taaaatgttaagcttccaga

SEQ ID NO: 164148 - DNA, 20 bp, Artificial Sequence
  chemically synthesized
aatctgaaataactatctgg

SEQ ID NO: 164149 - DNA, 20 bp, Artificial Sequence
  chemically synthesized
ccaaatctgaaataactatc

SEQ ID NO: 164150 - DNA, 20 bp, Artificial Sequence
  chemically synthesized
aagcttccagatagttattt

SEQ ID NO: 164151 - DNA, 20 bp, Artificial Sequence
  chemically synthesized
ccagatagttatttcagatt

SEQ ID NO: 164152 - DNA, 20 bp, Artificial Sequence
  chemically synthesized
atagttatttcagatttggc

SEQ ID NO: 164153 - DNA, 20 bp, Artificial Sequence
  chemically synthesized
tctctttgcattgcattttc

SEQ ID NO: 164154 - DNA, 20 bp, Artificial Sequence
  chemically synthesized
tggctagaaaatgcaatgca

SEQ ID NO: 164155 - DNA, 20 bp, Artificial Sequence
  chemically synthesized
gctagaaaatgcaatgcaaa

SEQ ID NO: 164156 - DNA, 20 bp, Artificial Sequence
  chemically synthesized
agaaaatgcaatgcaaagag

SEQ ID NO: 164157 - DNA, 20 bp, Artificial Sequence
  chemically synthesized
cattacctaaagaaggtttg

SEQ ID NO: 164158 - DNA, 20 bp, Artificial Sequence
  chemically synthesized
gagaagccacaaaccttctt

SEQ ID NO: 164159 - DNA, 20 bp, Artificial Sequence
  chemically synthesized
agaagccacaaaccttcttt

SEQ ID NO: 164160 - DNA, 20 bp, Artificial Sequence
  chemically synthesized
caaaatacattacctaaaga

SEQ ID NO: 164161 - DNA, 20 bp, Artificial Sequence
  chemically synthesized
tcaaaatacattacctaaag

SEQ ID NO: 164162 - DNA, 20 bp, Artificial Sequence
  chemically synthesized
ctttcaaaatacattaccta

SEQ ID NO: 164163 - DNA, 20 bp, Artificial Sequence
  chemically synthesized
ctttaggtaatgtattttga

SEQ ID NO: 164164 - DNA, 20 bp, Artificial Sequence
  chemically synthesized
ggtaatgtattttgaaagaa

SEQ ID NO: 164165 - DNA, 20 bp, Artificial Sequence
  chemically synthesized
gtaatgtattttgaaagaat

SEQ ID NO: 164166 - DNA, 20 bp, Artificial Sequence
  chemically synthesized
aatgtattttgaaagaatgg

SEQ ID NO: 164167 - DNA, 20 bp, Artificial Sequence
  chemically synthesized
tattttgaaagaatgggagt

SEQ ID NO: 164168 - DNA, 20 bp, Artificial Sequence
  chemically synthesized
agaatgggagtcagttgaca

SEQ ID NO: 164169 - DNA, 20 bp, Artificial Sequence
  chemically synthesized
gaatgggagtcagttgacac

SEQ ID NO: 164170 - DNA, 20 bp, Artificial Sequence
  chemically synthesized
gttgacacaggctctttgca

SEQ ID NO: 164171 - DNA, 20 bp, Artificial Sequence
  chemically synthesized
acagggtttgtctttgcaaa

SEQ ID NO: 164172 - DNA, 20 bp, Artificial Sequence
  chemically synthesized
gaacagggtttgtctttgca

SEQ ID NO: 164173 - DNA, 20 bp, Artificial Sequence
  chemically synthesized
tgcaaagacaaaccctgttc

SEQ ID NO: 164174 - DNA, 20 bp, Artificial Sequence
  chemically synthesized
atacattgatggctagaaca

SEQ ID NO: 164175 - DNA, 20 bp, Artificial Sequence
  chemically synthesized
aatacattgatggctagaac

SEQ ID NO: 164176 - DNA, 20 bp, Artificial Sequence
  chemically synthesized
caatacattgatggctagaa

SEQ ID NO: 164177 - DNA, 20 bp, Artificial Sequence
  chemically synthesized
tctaacaatacattgatggc

SEQ ID NO: 164178 - DNA, 20 bp, Artificial Sequence
  chemically synthesized
tttatctaacaatacattga

SEQ ID NO: 164179 - DNA, 20 bp, Artificial Sequence
  chemically synthesized
tctagccatcaatgtattgt

SEQ ID NO: 164180 - DNA, 20 bp, Artificial Sequence
  chemically synthesized
caatgtattgttagataaat

SEQ ID NO: 164181 - DNA, 20 bp, Artificial Sequence
  chemically synthesized
ttagataaataagaaaatga

SEQ ID NO: 164182 - DNA, 20 bp, Artificial Sequence
  chemically synthesized
gaaagcaaatatttacatat

SEQ ID NO: 164183 - DNA, 20 bp, Artificial Sequence
  chemically synthesized
gacaaattgtagcacaagta

SEQ ID NO: 164184 - DNA, 20 bp, Artificial Sequence
  chemically synthesized
atgacaaattgtagcacaag

SEQ ID NO: 164185 - DNA, 20 bp, Artificial Sequence
  chemically synthesized
atgatgacaaattgtagcac

SEQ ID NO: 164186 - DNA, 20 bp, Artificial Sequence
  chemically synthesized
ttcaacatgatgacaaattg

SEQ ID NO: 164187 - DNA, 20 bp, Artificial Sequence
  chemically synthesized
catcatgttgaacttctgtc

SEQ ID NO: 164188 - DNA, 20 bp, Artificial Sequence
  chemically synthesized
atcatgttgaacttctgtcc

SEQ ID NO: 164189 - DNA, 20 bp, Artificial Sequence
  chemically synthesized
tagccatcaatcctggacag

SEQ ID NO: 164190 - DNA, 20 bp, Artificial Sequence
  chemically synthesized
tcttagccatcaatcctgga

SEQ ID NO: 164191 - DNA, 20 bp, Artificial Sequence
  chemically synthesized
gaacttctgtccaggattga

SEQ ID NO: 164192 - DNA, 20 bp, Artificial Sequence
  chemically synthesized
ctcttcttagccatcaatcc

SEQ ID NO: 164193 - DNA, 20 bp, Artificial Sequence
  chemically synthesized
tctgtccaggattgatggct

SEQ ID NO: 164194 - DNA, 20 bp, Artificial Sequence
  chemically synthesized
gtccaggattgatggctaag

SEQ ID NO: 164195 - DNA, 20 bp, Artificial Sequence
  chemically synthesized
ccaggattgatggctaagaa

SEQ ID NO: 164196 - DNA, 20 bp, Artificial Sequence
  chemically synthesized
ggaatggtctttgctcttct

SEQ ID NO: 164197 - DNA, 20 bp, Artificial Sequence
  chemically synthesized
attgatggctaagaagagca

SEQ ID NO: 164198 - DNA, 20 bp, Artificial Sequence
  chemically synthesized
acctttgaattgcataggaa

SEQ ID NO: 164199 - DNA, 20 bp, Artificial Sequence
  chemically synthesized
aactaacctttgaattgcat

SEQ ID NO: 164200 - DNA, 20 bp, Artificial Sequence
  chemically synthesized
aaactaacctttgaattgca

SEQ ID NO: 164201 - DNA, 20 bp, Artificial Sequence
  chemically synthesized
gaccattcctatgcaattca

SEQ ID NO: 164202 - DNA, 20 bp, Artificial Sequence
  chemically synthesized
accattcctatgcaattcaa

SEQ ID NO: 164203 - DNA, 20 bp, Artificial Sequence
  chemically synthesized
ttcctatgcaattcaaaggt

SEQ ID NO: 164204 - DNA, 20 bp, Artificial Sequence
  chemically synthesized
aaggttagttttgatgtttt

SEQ ID NO: 164205 - DNA, 20 bp, Artificial Sequence
  chemically synthesized
aggttagttttgatgttttc

SEQ ID NO: 164206 - DNA, 20 bp, Artificial Sequence
  chemically synthesized
tgttttcaggttataacctt

SEQ ID NO: 164207 - DNA, 20 bp, Artificial Sequence
  chemically synthesized
tcaggttataaccttaagac

SEQ ID NO: 164208 - DNA, 20 bp, Artificial Sequence
  chemically synthesized
acagacagattctagtctta

SEQ ID NO: 164209 - DNA, 20 bp, Artificial Sequence
  chemically synthesized
aacagacagattctagtctt

SEQ ID NO: 164210 - DNA, 20 bp, Artificial Sequence
  chemically synthesized
tttctacaacagacagattc

SEQ ID NO: 164211 - DNA, 20 bp, Artificial Sequence
  chemically synthesized
agactagaatctgtctgttg

SEQ ID NO: 164212 - DNA, 20 bp, Artificial Sequence
  chemically synthesized
tgaatgttttctacaacaga

SEQ ID NO: 164213 - DNA, 20 bp, Artificial Sequence
  chemically synthesized
ttaatgaatgttttctacaa

SEQ ID NO: 164214 - DNA, 20 bp, Artificial Sequence
  chemically synthesized
attcattaaaacctttatca

SEQ ID NO: 164215 - DNA, 20 bp, Artificial Sequence
  chemically synthesized
aacatggttttctatgataa

SEQ ID NO: 164216 - DNA, 20 bp, Artificial Sequence
  chemically synthesized
aaacatggttttctatgata

SEQ ID NO: 164217 - DNA, 20 bp, Artificial Sequence
  chemically synthesized
tacaacttgaagtaaaaaca

SEQ ID NO: 164218 - DNA, 20 bp, Artificial Sequence
  chemically synthesized
gaaaaccatgtttttacttc

SEQ ID NO: 164219 - DNA, 20 bp, Artificial Sequence
  chemically synthesized
caaatatagtttacaacttg

SEQ ID NO: 164220 - DNA, 20 bp, Artificial Sequence
  chemically synthesized
ctttcttactaaggcaaata

SEQ ID NO: 164221 - DNA, 20 bp, Artificial Sequence
  chemically synthesized
gttgtaaactatatttgcct

SEQ ID NO: 164222 - DNA, 20 bp, Artificial Sequence
  chemically synthesized
taaactatatttgccttagt

SEQ ID NO: 164223 - DNA, 20 bp, Artificial Sequence
  chemically synthesized
tattggtctctttcttacta

SEQ ID NO: 164224 - DNA, 20 bp, Artificial Sequence
  chemically synthesized
ctatatttgccttagtaaga

SEQ ID NO: 164225 - DNA, 20 bp, Artificial Sequence
  chemically synthesized
ttattggtctctttcttact

SEQ ID NO: 164226 - DNA, 20 bp, Artificial Sequence
  chemically synthesized
atatttgccttagtaagaaa

SEQ ID NO: 164227 - DNA, 20 bp, Artificial Sequence
  chemically synthesized
aatgttctcttttgggttat

SEQ ID NO: 164228 - DNA, 20 bp, Artificial Sequence
  chemically synthesized
gaaagagaccaataacccaa

SEQ ID NO: 164229 - DNA, 20 bp, Artificial Sequence
  chemically synthesized
aagagaccaataacccaaaa

SEQ ID NO: 164230 - DNA, 20 bp, Artificial Sequence
  chemically synthesized
ttttgccaatgttctctttt

SEQ ID NO: 164231 - DNA, 20 bp, Artificial Sequence
  chemically synthesized
tttttgccaatgttctcttt

SEQ ID NO: 164232 - DNA, 20 bp, Artificial Sequence
  chemically synthesized
aataacccaaaagagaacat

SEQ ID NO: 164233 - DNA, 20 bp, Artificial Sequence
  chemically synthesized
aacattggcaaaaaacaaaa

SEQ ID NO: 164234 - DNA, 20 bp, Artificial Sequence
  chemically synthesized
attggcaaaaaacaaaaaag

SEQ ID NO: 164235 - DNA, 20 bp, Artificial Sequence
  chemically synthesized
aaaaacaaaaaagtagcaaa

SEQ ID NO: 164236 - DNA, 20 bp, Artificial Sequence
  chemically synthesized
aaaaagtagcaaacagtgca

SEQ ID NO: 164237 - DNA, 20 bp, Artificial Sequence
  chemically synthesized
gtagcaaacagtgcatagaa

SEQ ID NO: 164238 - DNA, 20 bp, Artificial Sequence
  chemically synthesized
tagcaaacagtgcatagaaa

SEQ ID NO: 164239 - DNA, 20 bp, Artificial Sequence
  chemically synthesized
ttgaattttttcatgtgttg

SEQ ID NO: 164240 - DNA, 20 bp, Artificial Sequence
  chemically synthesized
gaattctttattcattttgt

SEQ ID NO: 164241 - DNA, 20 bp, Artificial Sequence
  chemically synthesized
attcactcacaaaatgaata

SEQ ID NO: 164242 - DNA, 20 bp, Artificial Sequence
  chemically synthesized
aagaattcaaattaaaatga

SEQ ID NO: 164243 - DNA, 20 bp, Artificial Sequence
  chemically synthesized
gatcttctaaacaagaaaaa

SEQ ID NO: 164244 - DNA, 20 bp, Artificial Sequence
  chemically synthesized
atatcaccatttttcttgtt

SEQ ID NO: 164245 - DNA, 20 bp, Artificial Sequence
  chemically synthesized
tcaccatttttcttgtttag

SEQ ID NO: 164246 - DNA, 20 bp, Artificial Sequence
  chemically synthesized
acctttttgatcttctaaac

SEQ ID NO: 164247 - DNA, 20 bp, Artificial Sequence
  chemically synthesized
ttcttgtttagaagatcaaa

SEQ ID NO: 164248 - DNA, 20 bp, Artificial Sequence
  chemically synthesized
tcttgtttagaagatcaaaa

SEQ ID NO: 164249 - DNA, 20 bp, Artificial Sequence
  chemically synthesized
aaaaaggttgataacacact

SEQ ID NO: 164250 - DNA, 20 bp, Artificial Sequence
  chemically synthesized
aaggttgataacacactgag

SEQ ID NO: 164251 - DNA, 20 bp, Artificial Sequence
  chemically synthesized
aggttgataacacactgagt

SEQ ID NO: 164252 - DNA, 20 bp, Artificial Sequence
  chemically synthesized
tccccatacccgtgcccact

SEQ ID NO: 164253 - DNA, 20 bp, Artificial Sequence
  chemically synthesized
gataacacactgagtgggca

SEQ ID NO: 164254 - DNA, 20 bp, Artificial Sequence
  chemically synthesized
ataacacactgagtgggcac

SEQ ID NO: 164255 - DNA, 20 bp, Artificial Sequence
  chemically synthesized
acactgagtgggcacgggta

SEQ ID NO: 164256 - DNA, 20 bp, Artificial Sequence
  chemically synthesized
cactgagtgggcacgggtat

SEQ ID NO: 164257 - DNA, 20 bp, Artificial Sequence
  chemically synthesized
actgagtgggcacgggtatg

SEQ ID NO: 164258 - DNA, 20 bp, Artificial Sequence
  chemically synthesized
gtgggcacgggtatggggaa

SEQ ID NO: 164259 - DNA, 20 bp, Artificial Sequence
  chemically synthesized
catctcgtcagtattaggaa

SEQ ID NO: 164260 - DNA, 20 bp, Artificial Sequence
  chemically synthesized
acatctcgtcagtattagga

SEQ ID NO: 164261 - DNA, 20 bp, Artificial Sequence
  chemically synthesized
tagaacatctcgtcagtatt

SEQ ID NO: 164262 - DNA, 20 bp, Artificial Sequence
  chemically synthesized
atagaacatctcgtcagtat

SEQ ID NO: 164263 - DNA, 20 bp, Artificial Sequence
  chemically synthesized
aaacctttcctaatactgac

SEQ ID NO: 164264 - DNA, 20 bp, Artificial Sequence
  chemically synthesized
ctcttcatagaacatctcgt

SEQ ID NO: 164265 - DNA, 20 bp, Artificial Sequence
  chemically synthesized
tactgacgagatgttctatg

SEQ ID NO: 164266 - DNA, 20 bp, Artificial Sequence
  chemically synthesized
ctgacgagatgttctatgaa

SEQ ID NO: 164267 - DNA, 20 bp, Artificial Sequence
  chemically synthesized
ttttgccaaattgctcttca

SEQ ID NO: 164268 - DNA, 20 bp, Artificial Sequence
  chemically synthesized
atgttctatgaagagcaatt

SEQ ID NO: 164269 - DNA, 20 bp, Artificial Sequence
  chemically synthesized
atttggcaaaatgtactaac

SEQ ID NO: 164270 - DNA, 20 bp, Artificial Sequence
  chemically synthesized
caaactggcatttgtcttgt

SEQ ID NO: 164271 - DNA, 20 bp, Artificial Sequence
  chemically synthesized
tgtactaacaagacaaatgc

SEQ ID NO: 164272 - DNA, 20 bp, Artificial Sequence
  chemically synthesized
gtcgaatggctgcgtcaaac

SEQ ID NO: 164273 - DNA, 20 bp, Artificial Sequence
  chemically synthesized
agacaaatgccagtttgacg

SEQ ID NO: 164274 - DNA, 20 bp, Artificial Sequence
  chemically synthesized
agtttgacgcagccattcga

SEQ ID NO: 164275 - DNA, 20 bp, Artificial Sequence
  chemically synthesized
ataaattcctagccgtcgaa

SEQ ID NO: 164276 - DNA, 20 bp, Artificial Sequence
  chemically synthesized
tgacgcagccattcgacggc

SEQ ID NO: 164277 - DNA, 20 bp, Artificial Sequence
  chemically synthesized
gacgcagccattcgacggct

SEQ ID NO: 164278 - DNA, 20 bp, Artificial Sequence
  chemically synthesized
atatctatgtgataaattcc

SEQ ID NO: 164279 - DNA, 20 bp, Artificial Sequence
  chemically synthesized
acggctaggaatttatcaca

SEQ ID NO: 164280 - DNA, 20 bp, Artificial Sequence
  chemically synthesized
cgtgtaaaatgatgtgcaca

SEQ ID NO: 164281 - DNA, 20 bp, Artificial Sequence
  chemically synthesized
agttatacattttcttatct

SEQ ID NO: 164282 - DNA, 20 bp, Artificial Sequence
  chemically synthesized
tttcgacttttggctaagat

SEQ ID NO: 164283 - DNA, 20 bp, Artificial Sequence
  chemically synthesized
cattttcttatcttagccaa

SEQ ID NO: 164284 - DNA, 20 bp, Artificial Sequence
  chemically synthesized
gtttgtttcgacttttggct

SEQ ID NO: 164285 - DNA, 20 bp, Artificial Sequence
  chemically synthesized
ctttagtttgtttcgacttt

SEQ ID NO: 164286 - DNA, 20 bp, Artificial Sequence
  chemically synthesized
ccaaaagtcgaaacaaacta

SEQ ID NO: 164287 - DNA, 20 bp, Artificial Sequence
  chemically synthesized
caaaagtcgaaacaaactaa

SEQ ID NO: 164288 - DNA, 20 bp, Artificial Sequence
  chemically synthesized
cactccaattagtgagcctt

SEQ ID NO: 164289 - DNA, 20 bp, Artificial Sequence
  chemically synthesized
caaactaaaggctcactaat

SEQ ID NO: 164290 - DNA, 20 bp, Artificial Sequence
  chemically synthesized
taagcagcactccaattagt

SEQ ID NO: 164291 - DNA, 20 bp, Artificial Sequence
  chemically synthesized
aactaaaggctcactaattg

SEQ ID NO: 164292 - DNA, 20 bp, Artificial Sequence
  chemically synthesized
cacttaagcagcactccaat

SEQ ID NO: 164293 - DNA, 20 bp, Artificial Sequence
  chemically synthesized
cactaattggagtgctgctt

SEQ ID NO: 164294 - DNA, 20 bp, Artificial Sequence
  chemically synthesized
tataccataattcacttaag

SEQ ID NO: 164295 - DNA, 20 bp, Artificial Sequence
  chemically synthesized
ggatataccataattcactt

SEQ ID NO: 164296 - DNA, 20 bp, Artificial Sequence
  chemically synthesized
agtgctgcttaagtgaatta

SEQ ID NO: 164297 - DNA, 20 bp, Artificial Sequence
  chemically synthesized
agtgaattatggtatatcct

SEQ ID NO: 164298 - DNA, 20 bp, Artificial Sequence
  chemically synthesized
attatggtatatccttagaa

SEQ ID NO: 164299 - DNA, 20 bp, Artificial Sequence
  chemically synthesized
ttgcatactattctgttcta

SEQ ID NO: 164300 - DNA, 20 bp, Artificial Sequence
  chemically synthesized
gttgcatactattctgttct

SEQ ID NO: 164301 - DNA, 20 bp, Artificial Sequence
  chemically synthesized
ggtatatccttagaacagaa

SEQ ID NO: 164302 - DNA, 20 bp, Artificial Sequence
  chemically synthesized
tctcttttttttttttttta

SEQ ID NO: 164303 - DNA, 20 bp, Artificial Sequence
  chemically synthesized
caactgtaaaaaaaaaaaaa

SEQ ID NO: 164304 - DNA, 20 bp, Artificial Sequence
  chemically synthesized
actgtaaaaaaaaaaaaaaa

SEQ ID NO: 164305 - DNA, 20 bp, Artificial Sequence
  chemically synthesized
taaaaaaaaaaaaaaagaga

SEQ ID NO: 164306 - DNA, 20 bp, Artificial Sequence
  chemically synthesized
attttctgtattagtagtta

SEQ ID NO: 164307 - DNA, 20 bp, Artificial Sequence
  chemically synthesized
cagttctttaactactaata

SEQ ID NO: 164308 - DNA, 20 bp, Artificial Sequence
  chemically synthesized
gtgattattttctgtattag

SEQ ID NO: 164309 - DNA, 20 bp, Artificial Sequence
  chemically synthesized
caggtgattattttctgtat

SEQ ID NO: 164310 - DNA, 20 bp, Artificial Sequence
  chemically synthesized
acacacacacacacacacac

SEQ ID NO: 164311 - DNA, 20 bp, Artificial Sequence
  chemically synthesized
cacacacacacacacacaca

SEQ ID NO: 164312 - DNA, 20 bp, Artificial Sequence
  chemically synthesized
tatatatacacacacacaca

SEQ ID NO: 164313 - DNA, 20 bp, Artificial Sequence
  chemically synthesized
ctcccttataagaaagggaa

SEQ ID NO: 164314 - DNA, 20 bp, Artificial Sequence
  chemically synthesized
ccctcccttataagaaaggg

SEQ ID NO: 164315 - DNA, 20 bp, Artificial Sequence
  chemically synthesized
tctccctcccttataagaaa

SEQ ID NO: 164316 - DNA, 20 bp, Artificial Sequence
  chemically synthesized
tttactcttccctttcttat

SEQ ID NO: 164317 - DNA, 20 bp, Artificial Sequence
  chemically synthesized
ttctccctcccttataagaa

SEQ ID NO: 164318 - DNA, 20 bp, Artificial Sequence
  chemically synthesized
ttactcttccctttcttata

SEQ ID NO: 164319 - DNA, 20 bp, Artificial Sequence
  chemically synthesized
cttctccctcccttataaga

SEQ ID NO: 164320 - DNA, 20 bp, Artificial Sequence
  chemically synthesized
tactcttccctttcttataa

SEQ ID NO: 164321 - DNA, 20 bp, Artificial Sequence
  chemically synthesized
ctcttccctttcttataagg

SEQ ID NO: 164322 - DNA, 20 bp, Artificial Sequence
  chemically synthesized
tcttccctttcttataaggg

SEQ ID NO: 164323 - DNA, 20 bp, Artificial Sequence
  chemically synthesized
cactcttctccctcccttat

SEQ ID NO: 164324 - DNA, 20 bp, Artificial Sequence
  chemically synthesized
cttccctttcttataaggga

SEQ ID NO: 164325 - DNA, 20 bp, Artificial Sequence
  chemically synthesized
tccctttcttataagggagg

SEQ ID NO: 164326 - DNA, 20 bp, Artificial Sequence
  chemically synthesized
ctttcttataagggagggag

SEQ ID NO: 164327 - DNA, 20 bp, Artificial Sequence
  chemically synthesized
ttcttataagggagggagaa

SEQ ID NO: 164328 - DNA, 20 bp, Artificial Sequence
  chemically synthesized
tgtgtgtgtgtgtgtgtgta

SEQ ID NO: 164329 - DNA, 20 bp, Artificial Sequence
  chemically synthesized
cacacacacacacacacaca

SEQ ID NO: 164330 - DNA, 20 bp, Artificial Sequence
  chemically synthesized
acacacacacacacacacac

SEQ ID NO: 164331 - DNA, 20 bp, Artificial Sequence
  chemically synthesized
acacacacacacaggcattt

SEQ ID NO: 164332 - DNA, 20 bp, Artificial Sequence
  chemically synthesized
tcctccttcataagaaagga

SEQ ID NO: 164333 - DNA, 20 bp, Artificial Sequence
  chemically synthesized
ttcttcctccttcataagaa

SEQ ID NO: 164334 - DNA, 20 bp, Artificial Sequence
  chemically synthesized
ttagtctttcctttcttatg

SEQ ID NO: 164335 - DNA, 20 bp, Artificial Sequence
  chemically synthesized
cttcttcctccttcataaga

SEQ ID NO: 164336 - DNA, 20 bp, Artificial Sequence
  chemically synthesized
tagtctttcctttcttatga

SEQ ID NO: 164337 - DNA, 20 bp, Artificial Sequence
  chemically synthesized
gtctttcctttcttatgaag

SEQ ID NO: 164338 - DNA, 20 bp, Artificial Sequence
  chemically synthesized
tctttcctttcttatgaagg

SEQ ID NO: 164339 - DNA, 20 bp, Artificial Sequence
  chemically synthesized
cactcttcttcctccttcat

SEQ ID NO: 164340 - DNA, 20 bp, Artificial Sequence
  chemically synthesized
ttcctttcttatgaaggagg

SEQ ID NO: 164341 - DNA, 20 bp, Artificial Sequence
  chemically synthesized
ctttcttatgaaggaggaag

SEQ ID NO: 164342 - DNA, 20 bp, Artificial Sequence
  chemically synthesized
ttcttatgaaggaggaagaa

SEQ ID NO: 164343 - DNA, 20 bp, Artificial Sequence
  chemically synthesized
cttggcgagggcagaaggaa

SEQ ID NO: 164344 - DNA, 20 bp, Artificial Sequence
  chemically synthesized
cttggcttggcgagggcaga

SEQ ID NO: 164345 - DNA, 20 bp, Artificial Sequence
  chemically synthesized
ccttggcttggcgagggcag

SEQ ID NO: 164346 - DNA, 20 bp, Artificial Sequence
  chemically synthesized
tttccttggcttggcgaggg

SEQ ID NO: 164347 - DNA, 20 bp, Artificial Sequence
  chemically synthesized
cttttccttctgccctcgcc

SEQ ID NO: 164348 - DNA, 20 bp, Artificial Sequence
  chemically synthesized
ccttttccttggcttggcga

SEQ ID NO: 164349 - DNA, 20 bp, Artificial Sequence
  chemically synthesized
cccttttccttggcttggcg

SEQ ID NO: 164350 - DNA, 20 bp, Artificial Sequence
  chemically synthesized
gcccttttccttggcttggc

SEQ ID NO: 164351 - DNA, 20 bp, Artificial Sequence
  chemically synthesized
ccttctgccctcgccaagcc

SEQ ID NO: 164352 - DNA, 20 bp, Artificial Sequence
  chemically synthesized
cttctgccctcgccaagcca

SEQ ID NO: 164353 - DNA, 20 bp, Artificial Sequence
  chemically synthesized
tgaagcccttttccttggct

SEQ ID NO: 164354 - DNA, 20 bp, Artificial Sequence
  chemically synthesized
gccctcgccaagccaaggaa

SEQ ID NO: 164355 - DNA, 20 bp, Artificial Sequence
  chemically synthesized
ccctcgccaagccaaggaaa

SEQ ID NO: 164356 - DNA, 20 bp, Artificial Sequence
  chemically synthesized
cctcgccaagccaaggaaaa

SEQ ID NO: 164357 - DNA, 20 bp, Artificial Sequence
  chemically synthesized
tcttttgaagcccttttcct

SEQ ID NO: 164358 - DNA, 20 bp, Artificial Sequence
  chemically synthesized
gccaaggaaaagggcttcaa

SEQ ID NO: 164359 - DNA, 20 bp, Artificial Sequence
  chemically synthesized
ttcaaaagatggttcttttg

SEQ ID NO: 164360 - DNA, 20 bp, Artificial Sequence
  chemically synthesized
ttcaaaagaaccatcttttg

SEQ ID NO: 164361 - DNA, 20 bp, Artificial Sequence
  chemically synthesized
tttctgcatccttcaaaaga

SEQ ID NO: 164362 - DNA, 20 bp, Artificial Sequence
  chemically synthesized
tcaaaagaaccatcttttga

SEQ ID NO: 164363 - DNA, 20 bp, Artificial Sequence
  chemically synthesized
actgtttctgcatccttcaa

SEQ ID NO: 164364 - DNA, 20 bp, Artificial Sequence
  chemically synthesized
gaaccatcttttgaaggatg

SEQ ID NO: 164365 - DNA, 20 bp, Artificial Sequence
  chemically synthesized
tcttttgaaggatgcagaaa

SEQ ID NO: 164366 - DNA, 20 bp, Artificial Sequence
  chemically synthesized
ggatgcagaaacagtattta

SEQ ID NO: 164367 - DNA, 20 bp, Artificial Sequence
  chemically synthesized
cagtatttatagtattctaa

SEQ ID NO: 164368 - DNA, 20 bp, Artificial Sequence
  chemically synthesized
atttatagtattctaacagc

SEQ ID NO: 164369 - DNA, 20 bp, Artificial Sequence
  chemically synthesized
cttaaaataaagccagctgt

SEQ ID NO: 164370 - DNA, 20 bp, Artificial Sequence
  chemically synthesized
ttgtcctcttaaaataaagc

SEQ ID NO: 164371 - DNA, 20 bp, Artificial Sequence
  chemically synthesized
ctaacagctggctttatttt

SEQ ID NO: 164372 - DNA, 20 bp, Artificial Sequence
  chemically synthesized
actcttgtcctcttaaaata

SEQ ID NO: 164373 - DNA, 20 bp, Artificial Sequence
  chemically synthesized
aacagctggctttattttaa

SEQ ID NO: 164374 - DNA, 20 bp, Artificial Sequence
  chemically synthesized
acagctggctttattttaag

SEQ ID NO: 164375 - DNA, 20 bp, Artificial Sequence
  chemically synthesized
tggctttattttaagaggac

SEQ ID NO: 164376 - DNA, 20 bp, Artificial Sequence
  chemically synthesized
gctttattttaagaggacaa

SEQ ID NO: 164377 - DNA, 20 bp, Artificial Sequence
  chemically synthesized
ttattttaagaggacaagag

SEQ ID NO: 164378 - DNA, 20 bp, Artificial Sequence
  chemically synthesized
gccttccaagaataggatgt

SEQ ID NO: 164379 - DNA, 20 bp, Artificial Sequence
  chemically synthesized
agccttccaagaataggatg

SEQ ID NO: 164380 - DNA, 20 bp, Artificial Sequence
  chemically synthesized
acacacctacatcctattct

SEQ ID NO: 164381 - DNA, 20 bp, Artificial Sequence
  chemically synthesized
ctgggtagccttccaagaat

SEQ ID NO: 164382 - DNA, 20 bp, Artificial Sequence
  chemically synthesized
cacctacatcctattcttgg

SEQ ID NO: 164383 - DNA, 20 bp, Artificial Sequence
  chemically synthesized
cctgggtagccttccaagaa

SEQ ID NO: 164384 - DNA, 20 bp, Artificial Sequence
  chemically synthesized
acctacatcctattcttgga

SEQ ID NO: 164385 - DNA, 20 bp, Artificial Sequence
  chemically synthesized
agtttcctgggtagccttcc

SEQ ID NO: 164386 - DNA, 20 bp, Artificial Sequence
  chemically synthesized
cctattcttggaaggctacc

SEQ ID NO: 164387 - DNA, 20 bp, Artificial Sequence
  chemically synthesized
ctattcttggaaggctaccc

SEQ ID NO: 164388 - DNA, 20 bp, Artificial Sequence
  chemically synthesized
aaggttttcagtttcctggg

SEQ ID NO: 164389 - DNA, 20 bp, Artificial Sequence
  chemically synthesized
gccaaggttttcagtttcct

SEQ ID NO: 164390 - DNA, 20 bp, Artificial Sequence
  chemically synthesized
tgccaaggttttcagtttcc

SEQ ID NO: 164391 - DNA, 20 bp, Artificial Sequence
  chemically synthesized
acccaggaaactgaaaacct

SEQ ID NO: 164392 - DNA, 20 bp, Artificial Sequence
  chemically synthesized
ccatgtgctgccaaggtttt

SEQ ID NO: 164393 - DNA, 20 bp, Artificial Sequence
  chemically synthesized
caggaaactgaaaaccttgg

SEQ ID NO: 164394 - DNA, 20 bp, Artificial Sequence
  chemically synthesized
tctctccccatgtgctgcca

SEQ ID NO: 164395 - DNA, 20 bp, Artificial Sequence
  chemically synthesized
ttctctccccatgtgctgcc

SEQ ID NO: 164396 - DNA, 20 bp, Artificial Sequence
  chemically synthesized
ctgaaaaccttggcagcaca

SEQ ID NO: 164397 - DNA, 20 bp, Artificial Sequence
  chemically synthesized
tgaaaaccttggcagcacat

SEQ ID NO: 164398 - DNA, 20 bp, Artificial Sequence
  chemically synthesized
gaaaaccttggcagcacatg

SEQ ID NO: 164399 - DNA, 20 bp, Artificial Sequence
  chemically synthesized
aaaccttggcagcacatggg

SEQ ID NO: 164400 - DNA, 20 bp, Artificial Sequence
  chemically synthesized
accttggcagcacatgggga

SEQ ID NO: 164401 - DNA, 20 bp, Artificial Sequence
  chemically synthesized
acatggggagagaaactgtg

SEQ ID NO: 164402 - DNA, 20 bp, Artificial Sequence
  chemically synthesized
attgttgtctttcagccaca

SEQ ID NO: 164403 - DNA, 20 bp, Artificial Sequence
  chemically synthesized
gagagaaactgtgtggctga

SEQ ID NO: 164404 - DNA, 20 bp, Artificial Sequence
  chemically synthesized
tctgttgcattgttgtcttt

SEQ ID NO: 164405 - DNA, 20 bp, Artificial Sequence
  chemically synthesized
gctgaaagacaacaatgcaa

SEQ ID NO: 164406 - DNA, 20 bp, Artificial Sequence
  chemically synthesized
tgaaagacaacaatgcaaca

SEQ ID NO: 164407 - DNA, 20 bp, Artificial Sequence
  chemically synthesized
gaaagacaacaatgcaacag

SEQ ID NO: 164408 - DNA, 20 bp, Artificial Sequence
  chemically synthesized
tcttccagtacaaaattcaa

SEQ ID NO: 164409 - DNA, 20 bp, Artificial Sequence
  chemically synthesized
aatgcttttgaattttgtac

SEQ ID NO: 164410 - DNA, 20 bp, Artificial Sequence
  chemically synthesized
gcttttgaattttgtactgg

SEQ ID NO: 164411 - DNA, 20 bp, Artificial Sequence
  chemically synthesized
ttgaattttgtactggaaga

SEQ ID NO: 164412 - DNA, 20 bp, Artificial Sequence
  chemically synthesized
attgaatagatactttcttc

SEQ ID NO: 164413 - DNA, 20 bp, Artificial Sequence
  chemically synthesized
aattttgtttatttattgaa

SEQ ID NO: 164414 - DNA, 20 bp, Artificial Sequence
  chemically synthesized
aattattattattattatta

SEQ ID NO: 164415 - DNA, 20 bp, Artificial Sequence
  chemically synthesized
attattattattattaaaga

SEQ ID NO: 164416 - DNA, 20 bp, Artificial Sequence
  chemically synthesized
tattattattattaaagatg

SEQ ID NO: 164417 - DNA, 20 bp, Artificial Sequence
  chemically synthesized
tctagcctgggtgacagagc

SEQ ID NO: 164418 - DNA, 20 bp, Artificial Sequence
  chemically synthesized
tggagtcttgctctgtcacc

SEQ ID NO: 164419 - DNA, 20 bp, Artificial Sequence
  chemically synthesized
gcactctagcctgggtgaca

SEQ ID NO: 164420 - DNA, 20 bp, Artificial Sequence
  chemically synthesized
ggagtcttgctctgtcaccc

SEQ ID NO: 164421 - DNA, 20 bp, Artificial Sequence
  chemically synthesized
ctgcactctagcctgggtga

SEQ ID NO: 164422 - DNA, 20 bp, Artificial Sequence
  chemically synthesized
tcttgctctgtcacccaggc

SEQ ID NO: 164423 - DNA, 20 bp, Artificial Sequence
  chemically synthesized
ttgctctgtcacccaggcta

SEQ ID NO: 164424 - DNA, 20 bp, Artificial Sequence
  chemically synthesized
gcaccactgcactctagcct

SEQ ID NO: 164425 - DNA, 20 bp, Artificial Sequence
  chemically synthesized
tgcaccactgcactctagcc

SEQ ID NO: 164426 - DNA, 20 bp, Artificial Sequence
  chemically synthesized
ctgtcacccaggctagagtg

SEQ ID NO: 164427 - DNA, 20 bp, Artificial Sequence
  chemically synthesized
gagattgcaccactgcactc

SEQ ID NO: 164428 - DNA, 20 bp, Artificial Sequence
  chemically synthesized
tcacccaggctagagtgcag

SEQ ID NO: 164429 - DNA, 20 bp, Artificial Sequence
  chemically synthesized
agagtgcagtggtgcaatct

SEQ ID NO: 164430 - DNA, 20 bp, Artificial Sequence
  chemically synthesized
ggcggaggttgcagtgagcc

SEQ ID NO: 164431 - DNA, 20 bp, Artificial Sequence
  chemically synthesized
ctggaggcggaggttgcagt

SEQ ID NO: 164432 - DNA, 20 bp, Artificial Sequence
  chemically synthesized
gaacctggaggcggaggttg

SEQ ID NO: 164433 - DNA, 20 bp, Artificial Sequence
  chemically synthesized
ctcactgcaacctccgcctc

SEQ ID NO: 164434 - DNA, 20 bp, Artificial Sequence
  chemically synthesized
tcccttgaacctggaggcgg

SEQ ID NO: 164435 - DNA, 20 bp, Artificial Sequence
  chemically synthesized
tcactgcaacctccgcctcc

SEQ ID NO: 164436 - DNA, 20 bp, Artificial Sequence
  chemically synthesized
atcccttgaacctggaggcg

SEQ ID NO: 164437 - DNA, 20 bp, Artificial Sequence
  chemically synthesized
gaatcccttgaacctggagg

SEQ ID NO: 164438 - DNA, 20 bp, Artificial Sequence
  chemically synthesized
ggagaatcccttgaacctgg

SEQ ID NO: 164439 - DNA, 20 bp, Artificial Sequence
  chemically synthesized
caacctccgcctccaggttc

SEQ ID NO: 164440 - DNA, 20 bp, Artificial Sequence
  chemically synthesized
aggagaatcccttgaacctg

SEQ ID NO: 164441 - DNA, 20 bp, Artificial Sequence
  chemically synthesized
aacctccgcctccaggttca

SEQ ID NO: 164442 - DNA, 20 bp, Artificial Sequence
  chemically synthesized
acctccgcctccaggttcaa

SEQ ID NO: 164443 - DNA, 20 bp, Artificial Sequence
  chemically synthesized
gcaggagaatcccttgaacc

SEQ ID NO: 164444 - DNA, 20 bp, Artificial Sequence
  chemically synthesized
ttcaagggattctcctgcct

SEQ ID NO: 164445 - DNA, 20 bp, Artificial Sequence
  chemically synthesized
tactcgggaggctgaggcag

SEQ ID NO: 164446 - DNA, 20 bp, Artificial Sequence
  chemically synthesized
gctactcgggaggctgaggc

SEQ ID NO: 164447 - DNA, 20 bp, Artificial Sequence
  chemically synthesized
agctactcgggaggctgagg

SEQ ID NO: 164448 - DNA, 20 bp, Artificial Sequence
  chemically synthesized
cccagctactcgggaggctg

SEQ ID NO: 164449 - DNA, 20 bp, Artificial Sequence
  chemically synthesized
tcccagctactcgggaggct

SEQ ID NO: 164450 - DNA, 20 bp, Artificial Sequence
  chemically synthesized
ttctcctgcctcagcctccc

SEQ ID NO: 164451 - DNA, 20 bp, Artificial Sequence
  chemically synthesized
tcctgcctcagcctcccgag

SEQ ID NO: 164452 - DNA, 20 bp, Artificial Sequence
  chemically synthesized
tctaatcccagctactcggg

SEQ ID NO: 164453 - DNA, 20 bp, Artificial Sequence
  chemically synthesized
ctctaatcccagctactcgg

SEQ ID NO: 164454 - DNA, 20 bp, Artificial Sequence
  chemically synthesized
gcctcagcctcccgagtagc

SEQ ID NO: 164455 - DNA, 20 bp, Artificial Sequence
  chemically synthesized
gcctctaatcccagctactc

SEQ ID NO: 164456 - DNA, 20 bp, Artificial Sequence
  chemically synthesized
cctcagcctcccgagtagct

SEQ ID NO: 164457 - DNA, 20 bp, Artificial Sequence
  chemically synthesized
tgcctctaatcccagctact

SEQ ID NO: 164458 - DNA, 20 bp, Artificial Sequence
  chemically synthesized
gcctcccgagtagctgggat

SEQ ID NO: 164459 - DNA, 20 bp, Artificial Sequence
  chemically synthesized
ctcccgagtagctgggatta

SEQ ID NO: 164460 - DNA, 20 bp, Artificial Sequence
  chemically synthesized
tcccgagtagctgggattag

SEQ ID NO: 164461 - DNA, 20 bp, Artificial Sequence
  chemically synthesized
gtggtgagtgcctctaatcc

SEQ ID NO: 164462 - DNA, 20 bp, Artificial Sequence
  chemically synthesized
aattagctgggcatggtggt

SEQ ID NO: 164463 - DNA, 20 bp, Artificial Sequence
  chemically synthesized
gaggcactcaccaccatgcc

SEQ ID NO: 164464 - DNA, 20 bp, Artificial Sequence
  chemically synthesized
caaaaattagctgggcatgg

SEQ ID NO: 164465 - DNA, 20 bp, Artificial Sequence
  chemically synthesized
atacaaaaattagctgggca

SEQ ID NO: 164466 - DNA, 20 bp, Artificial Sequence
  chemically synthesized
taaaaatacaaaaattagct

SEQ ID NO: 164467 - DNA, 20 bp, Artificial Sequence
  chemically synthesized
ctaaaaatacaaaaattagc

SEQ ID NO: 164468 - DNA, 20 bp, Artificial Sequence
  chemically synthesized
tccactaaaaatacaaaaat

SEQ ID NO: 164469 - DNA, 20 bp, Artificial Sequence
  chemically synthesized
ccagctaatttttgtatttt

SEQ ID NO: 164470 - DNA, 20 bp, Artificial Sequence
  chemically synthesized
gctaatttttgtatttttag

SEQ ID NO: 164471 - DNA, 20 bp, Artificial Sequence
  chemically synthesized
taatttttgtatttttagtg

SEQ ID NO: 164472 - DNA, 20 bp, Artificial Sequence
  chemically synthesized
ttttgtatttttagtggaga

SEQ ID NO: 164473 - DNA, 20 bp, Artificial Sequence
  chemically synthesized
tttgtatttttagtggagac

SEQ ID NO: 164474 - DNA, 20 bp, Artificial Sequence
  chemically synthesized
ttgtatttttagtggagacg

SEQ ID NO: 164475 - DNA, 20 bp, Artificial Sequence
  chemically synthesized
gagacggggtttcatcacct

SEQ ID NO: 164476 - DNA, 20 bp, Artificial Sequence
  chemically synthesized
cggggtttcatcaccttggc

SEQ ID NO: 164477 - DNA, 20 bp, Artificial Sequence
  chemically synthesized
ggggtttcatcaccttggcc

SEQ ID NO: 164478 - DNA, 20 bp, Artificial Sequence
  chemically synthesized
gttccagaccagcctggcca

SEQ ID NO: 164479 - DNA, 20 bp, Artificial Sequence
  chemically synthesized
agttccagaccagcctggcc

SEQ ID NO: 164480 - DNA, 20 bp, Artificial Sequence
  chemically synthesized
tttcatcaccttggccaggc

SEQ ID NO: 164481 - DNA, 20 bp, Artificial Sequence
  chemically synthesized
tcaggagttccagaccagcc

SEQ ID NO: 164482 - DNA, 20 bp, Artificial Sequence
  chemically synthesized
tcaccttggccaggctggtc

SEQ ID NO: 164483 - DNA, 20 bp, Artificial Sequence
  chemically synthesized
cgaggtcaggagttccagac

SEQ ID NO: 164484 - DNA, 20 bp, Artificial Sequence
  chemically synthesized
gatcacgaggtcaggagttc

SEQ ID NO: 164485 - DNA, 20 bp, Artificial Sequence
  chemically synthesized
caggtggatcacgaggtcag

SEQ ID NO: 164486 - DNA, 20 bp, Artificial Sequence
  chemically synthesized
ggcaggtggatcacgaggtc

SEQ ID NO: 164487 - DNA, 20 bp, Artificial Sequence
  chemically synthesized
aggcaggtggatcacgaggt

SEQ ID NO: 164488 - DNA, 20 bp, Artificial Sequence
  chemically synthesized
gctgaggcaggtggatcacg

SEQ ID NO: 164489 - DNA, 20 bp, Artificial Sequence
  chemically synthesized
ggctgaggcaggtggatcac

SEQ ID NO: 164490 - DNA, 20 bp, Artificial Sequence
  chemically synthesized
acctcgtgatccacctgcct

SEQ ID NO: 164491 - DNA, 20 bp, Artificial Sequence
  chemically synthesized
ctttgggaggctgaggcagg

SEQ ID NO: 164492 - DNA, 20 bp, Artificial Sequence
  chemically synthesized
gcactttgggaggctgaggc

SEQ ID NO: 164493 - DNA, 20 bp, Artificial Sequence
  chemically synthesized
agcactttgggaggctgagg

SEQ ID NO: 164494 - DNA, 20 bp, Artificial Sequence
  chemically synthesized
cccagcactttgggaggctg

SEQ ID NO: 164495 - DNA, 20 bp, Artificial Sequence
  chemically synthesized
tcccagcactttgggaggct

SEQ ID NO: 164496 - DNA, 20 bp, Artificial Sequence
  chemically synthesized
ccacctgcctcagcctccca

SEQ ID NO: 164497 - DNA, 20 bp, Artificial Sequence
  chemically synthesized
tgtactcccagcactttggg

SEQ ID NO: 164498 - DNA, 20 bp, Artificial Sequence
  chemically synthesized
ctgtactcccagcactttgg

SEQ ID NO: 164499 - DNA, 20 bp, Artificial Sequence
  chemically synthesized
gcctcagcctcccaaagtgc

SEQ ID NO: 164500 - DNA, 20 bp, Artificial Sequence
  chemically synthesized
acctgtactcccagcacttt

SEQ ID NO: 164501 - DNA, 20 bp, Artificial Sequence
  chemically synthesized
cctcagcctcccaaagtgct

SEQ ID NO: 164502 - DNA, 20 bp, Artificial Sequence
  chemically synthesized
cacctgtactcccagcactt

SEQ ID NO: 164503 - DNA, 20 bp, Artificial Sequence
  chemically synthesized
tcagcctcccaaagtgctgg

SEQ ID NO: 164504 - DNA, 20 bp, Artificial Sequence
  chemically synthesized
ctcccaaagtgctgggagta

SEQ ID NO: 164505 - DNA, 20 bp, Artificial Sequence
  chemically synthesized
tcccaaagtgctgggagtac

SEQ ID NO: 164506 - DNA, 20 bp, Artificial Sequence
  chemically synthesized
atggctcacacctgtactcc

SEQ ID NO: 164507 - DNA, 20 bp, Artificial Sequence
  chemically synthesized
agtgctgggagtacaggtgt

SEQ ID NO: 164508 - DNA, 20 bp, Artificial Sequence
  chemically synthesized
caggtgtgagccattgcgcc

SEQ ID NO: 164509 - DNA, 20 bp, Artificial Sequence
  chemically synthesized
tataaataggccaggcgcaa

SEQ ID NO: 164510 - DNA, 20 bp, Artificial Sequence
  chemically synthesized
aaagataatataaataggcc

SEQ ID NO: 164511 - DNA, 20 bp, Artificial Sequence
  chemically synthesized
taaagataatataaataggc

SEQ ID NO: 164512 - DNA, 20 bp, Artificial Sequence
  chemically synthesized
actttaaagataatataaat

SEQ ID NO: 164513 - DNA, 20 bp, Artificial Sequence
  chemically synthesized
gactttaaagataatataaa

SEQ ID NO: 164514 - DNA, 20 bp, Artificial Sequence
  chemically synthesized
gcctatttatattatcttta

SEQ ID NO: 164515 - DNA, 20 bp, Artificial Sequence
  chemically synthesized
tccctgtataacagacttta

SEQ ID NO: 164516 - DNA, 20 bp, Artificial Sequence
  chemically synthesized
tatctttaaagtctgttata

SEQ ID NO: 164517 - DNA, 20 bp, Artificial Sequence
  chemically synthesized
atctttaaagtctgttatac

SEQ ID NO: 164518 - DNA, 20 bp, Artificial Sequence
  chemically synthesized
tctttaaagtctgttataca

SEQ ID NO: 164519 - DNA, 20 bp, Artificial Sequence
  chemically synthesized
gtaaatttatccctgtataa

SEQ ID NO: 164520 - DNA, 20 bp, Artificial Sequence
  chemically synthesized
gttaattattacaaagttgg

SEQ ID NO: 164521 - DNA, 20 bp, Artificial Sequence
  chemically synthesized
ggttaattattacaaagttg

SEQ ID NO: 164522 - DNA, 20 bp, Artificial Sequence
  chemically synthesized
gggttaattattacaaagtt

SEQ ID NO: 164523 - DNA, 20 bp, Artificial Sequence
  chemically synthesized
tgggttaattattacaaagt

SEQ ID NO: 164524 - DNA, 20 bp, Artificial Sequence
  chemically synthesized
atactgggttaattattaca

SEQ ID NO: 164525 - DNA, 20 bp, Artificial Sequence
  chemically synthesized
caactttgtaataattaacc

SEQ ID NO: 164526 - DNA, 20 bp, Artificial Sequence
  chemically synthesized
tgtatcagtgatgtcatact

SEQ ID NO: 164527 - DNA, 20 bp, Artificial Sequence
  chemically synthesized
ctgtatcagtgatgtcatac

SEQ ID NO: 164528 - DNA, 20 bp, Artificial Sequence
  chemically synthesized
ccagtatgacatcactgata

SEQ ID NO: 164529 - DNA, 20 bp, Artificial Sequence
  chemically synthesized
tgagttaattagtactgtat

SEQ ID NO: 164530 - DNA, 20 bp, Artificial Sequence
  chemically synthesized
tttatagaaaatgagttaat

SEQ ID NO: 164531 - DNA, 20 bp, Artificial Sequence
  chemically synthesized
tgcacagttttatagaaaat

SEQ ID NO: 164532 - DNA, 20 bp, Artificial Sequence
  chemically synthesized
agataatctgcacagtttta

SEQ ID NO: 164533 - DNA, 20 bp, Artificial Sequence
  chemically synthesized
tcattttctataaaactgtg

SEQ ID NO: 164534 - DNA, 20 bp, Artificial Sequence
  chemically synthesized
gaattttaagataatctgca

SEQ ID NO: 164535 - DNA, 20 bp, Artificial Sequence
  chemically synthesized
tcatttttgtttcgaatttt

SEQ ID NO: 164536 - DNA, 20 bp, Artificial Sequence
  chemically synthesized
taaaattcgaaacaaaaatg

SEQ ID NO: 164537 - DNA, 20 bp, Artificial Sequence
  chemically synthesized
tacaatacaaatgataacaa

SEQ ID NO: 164538 - DNA, 20 bp, Artificial Sequence
  chemically synthesized
acaaatgataacaacagttc

SEQ ID NO: 164539 - DNA, 20 bp, Artificial Sequence
  chemically synthesized
tatgcttaagtgttgttttc

SEQ ID NO: 164540 - DNA, 20 bp, Artificial Sequence
  chemically synthesized
agttccagaaaacaacactt

SEQ ID NO: 164541 - DNA, 20 bp, Artificial Sequence
  chemically synthesized
gtgttacgtgtggtatgctt

SEQ ID NO: 164542 - DNA, 20 bp, Artificial Sequence
  chemically synthesized
ttattacattgtgttacgtg

SEQ ID NO: 164543 - DNA, 20 bp, Artificial Sequence
  chemically synthesized
ggtaccaaagaatataacgc

SEQ ID NO: 164544 - DNA, 20 bp, Artificial Sequence
  chemically synthesized
gggtaccaaagaatataacg

SEQ ID NO: 164545 - DNA, 20 bp, Artificial Sequence
  chemically synthesized
ataacctgcgttatattctt

SEQ ID NO: 164546 - DNA, 20 bp, Artificial Sequence
  chemically synthesized
taagatagcatagggtacca

SEQ ID NO: 164547 - DNA, 20 bp, Artificial Sequence
  chemically synthesized
aaatagaataagatagcata

SEQ ID NO: 164548 - DNA, 20 bp, Artificial Sequence
  chemically synthesized
aaaatagaataagatagcat

SEQ ID NO: 164549 - DNA, 20 bp, Artificial Sequence
  chemically synthesized
taaaatagaataagatagca

SEQ ID NO: 164550 - DNA, 20 bp, Artificial Sequence
  chemically synthesized
taaaataaaatagaataaga

SEQ ID NO: 164551 - DNA, 20 bp, Artificial Sequence
  chemically synthesized
tgggtaaaataaaatagaat

SEQ ID NO: 164552 - DNA, 20 bp, Artificial Sequence
  chemically synthesized
atttaatgggtaaaataaaa

SEQ ID NO: 164553 - DNA, 20 bp, Artificial Sequence
  chemically synthesized
attttattttacccattaaa

SEQ ID NO: 164554 - DNA, 20 bp, Artificial Sequence
  chemically synthesized
agttatgaaatccatttaat

SEQ ID NO: 164555 - DNA, 20 bp, Artificial Sequence
  chemically synthesized
gagttatgaaatccatttaa

SEQ ID NO: 164556 - DNA, 20 bp, Artificial Sequence
  chemically synthesized
aaatggatttcataactcat

SEQ ID NO: 164557 - DNA, 20 bp, Artificial Sequence
  chemically synthesized
tggatttcataactcatcag

SEQ ID NO: 164558 - DNA, 20 bp, Artificial Sequence
  chemically synthesized
ggatttcataactcatcagt

SEQ ID NO: 164559 - DNA, 20 bp, Artificial Sequence
  chemically synthesized
gaatcttacaacccactgat

SEQ ID NO: 164560 - DNA, 20 bp, Artificial Sequence
  chemically synthesized
ataactcatcagtgggttgt

SEQ ID NO: 164561 - DNA, 20 bp, Artificial Sequence
  chemically synthesized
tgggttgtaagattctctcc

SEQ ID NO: 164562 - DNA, 20 bp, Artificial Sequence
  chemically synthesized
gggttgtaagattctctccc

SEQ ID NO: 164563 - DNA, 20 bp, Artificial Sequence
  chemically synthesized
ttaagctttcaggcccggga

SEQ ID NO: 164564 - DNA, 20 bp, Artificial Sequence
  chemically synthesized
ccttaagctttcaggcccgg

SEQ ID NO: 164565 - DNA, 20 bp, Artificial Sequence
  chemically synthesized
ctccttaagctttcaggccc

SEQ ID NO: 164566 - DNA, 20 bp, Artificial Sequence
  chemically synthesized
agattctctcccgggcctga

SEQ ID NO: 164567 - DNA, 20 bp, Artificial Sequence
  chemically synthesized
tctccttaagctttcaggcc

SEQ ID NO: 164568 - DNA, 20 bp, Artificial Sequence
  chemically synthesized
actcatctccttaagctttc

SEQ ID NO: 164569 - DNA, 20 bp, Artificial Sequence
  chemically synthesized
tctcccgggcctgaaagctt

SEQ ID NO: 164570 - DNA, 20 bp, Artificial Sequence
  chemically synthesized
tactcatctccttaagcttt

SEQ ID NO: 164571 - DNA, 20 bp, Artificial Sequence
  chemically synthesized
ctcccgggcctgaaagctta

SEQ ID NO: 164572 - DNA, 20 bp, Artificial Sequence
  chemically synthesized
cccgggcctgaaagcttaag

SEQ ID NO: 164573 - DNA, 20 bp, Artificial Sequence
  chemically synthesized
gaggagttactcatctcctt

SEQ ID NO: 164574 - DNA, 20 bp, Artificial Sequence
  chemically synthesized
gcctgaaagcttaaggagat

SEQ ID NO: 164575 - DNA, 20 bp, Artificial Sequence
  chemically synthesized
gaatgggcctgagaaaggag

SEQ ID NO: 164576 - DNA, 20 bp, Artificial Sequence
  chemically synthesized
atgagtaactcctcctttct

SEQ ID NO: 164577 - DNA, 20 bp, Artificial Sequence
  chemically synthesized
aggaatgggcctgagaaagg

SEQ ID NO: 164578 - DNA, 20 bp, Artificial Sequence
  chemically synthesized
tgagtaactcctcctttctc

SEQ ID NO: 164579 - DNA, 20 bp, Artificial Sequence
  chemically synthesized
taggaatgggcctgagaaag

SEQ ID NO: 164580 - DNA, 20 bp, Artificial Sequence
  chemically synthesized
cttaggaatgggcctgagaa

SEQ ID NO: 164581 - DNA, 20 bp, Artificial Sequence
  chemically synthesized
ccttaggaatgggcctgaga

SEQ ID NO: 164582 - DNA, 20 bp, Artificial Sequence
  chemically synthesized
tgtgccttaggaatgggcct

SEQ ID NO: 164583 - DNA, 20 bp, Artificial Sequence
  chemically synthesized
cctttctcaggcccattcct

SEQ ID NO: 164584 - DNA, 20 bp, Artificial Sequence
  chemically synthesized
ctttctcaggcccattccta

SEQ ID NO: 164585 - DNA, 20 bp, Artificial Sequence
  chemically synthesized
tagccttgtgccttaggaat

SEQ ID NO: 164586 - DNA, 20 bp, Artificial Sequence
  chemically synthesized
gtagccttgtgccttaggaa

SEQ ID NO: 164587 - DNA, 20 bp, Artificial Sequence
  chemically synthesized
caggcccattcctaaggcac

SEQ ID NO: 164588 - DNA, 20 bp, Artificial Sequence
  chemically synthesized
ggcaagtagccttgtgcctt

SEQ ID NO: 164589 - DNA, 20 bp, Artificial Sequence
  chemically synthesized
aggcccattcctaaggcaca

SEQ ID NO: 164590 - DNA, 20 bp, Artificial Sequence
  chemically synthesized
aggcaagtagccttgtgcct

SEQ ID NO: 164591 - DNA, 20 bp, Artificial Sequence
  chemically synthesized
aggcacaaggctacttgcct

SEQ ID NO: 164592 - DNA, 20 bp, Artificial Sequence
  chemically synthesized
gtgcatgctgctcaggcaag

SEQ ID NO: 164593 - DNA, 20 bp, Artificial Sequence
  chemically synthesized
cacaaggctacttgcctgag

SEQ ID NO: 164594 - DNA, 20 bp, Artificial Sequence
  chemically synthesized
ccggtgcatgctgctcaggc

SEQ ID NO: 164595 - DNA, 20 bp, Artificial Sequence
  chemically synthesized
ttcgccggtgcatgctgctc

SEQ ID NO: 164596 - DNA, 20 bp, Artificial Sequence
  chemically synthesized
tttcgccggtgcatgctgct

SEQ ID NO: 164597 - DNA, 20 bp, Artificial Sequence
  chemically synthesized
cttgcctgagcagcatgcac

SEQ ID NO: 164598 - DNA, 20 bp, Artificial Sequence
  chemically synthesized
agcagcatgcaccggcgaaa

SEQ ID NO: 164599 - DNA, 20 bp, Artificial Sequence
  chemically synthesized
tcctgcttctgctatttcgc

SEQ ID NO: 164600 - DNA, 20 bp, Artificial Sequence
  chemically synthesized
agcatgcaccggcgaaatag

SEQ ID NO: 164601 - DNA, 20 bp, Artificial Sequence
  chemically synthesized
atgcaccggcgaaatagcag

SEQ ID NO: 164602 - DNA, 20 bp, Artificial Sequence
  chemically synthesized
caccggcgaaatagcagaag

SEQ ID NO: 164603 - DNA, 20 bp, Artificial Sequence
  chemically synthesized
accggcgaaatagcagaagc

SEQ ID NO: 164604 - DNA, 20 bp, Artificial Sequence
  chemically synthesized
ggcgaaatagcagaagcagg

SEQ ID NO: 164605 - DNA, 20 bp, Artificial Sequence
  chemically synthesized
cgaaatagcagaagcaggaa

SEQ ID NO: 164606 - DNA, 20 bp, Artificial Sequence
  chemically synthesized
aaatagcagaagcaggaaga

SEQ ID NO: 164607 - DNA, 20 bp, Artificial Sequence
  chemically synthesized
agcagaagcaggaagagagc

SEQ ID NO: 164608 - DNA, 20 bp, Artificial Sequence
  chemically synthesized
gaagcaggaagagagccggc

SEQ ID NO: 164609 - DNA, 20 bp, Artificial Sequence
  chemically synthesized
gcaggaagagagccggccag

SEQ ID NO: 164610 - DNA, 20 bp, Artificial Sequence
  chemically synthesized
agaggtacttgtcttctggc

SEQ ID NO: 164611 - DNA, 20 bp, Artificial Sequence
  chemically synthesized
aagagagccggccagaagac

SEQ ID NO: 164612 - DNA, 20 bp, Artificial Sequence
  chemically synthesized
cttcagaggtacttgtcttc

SEQ ID NO: 164613 - DNA, 20 bp, Artificial Sequence
  chemically synthesized
ccagaagacaagtacctctg

SEQ ID NO: 164614 - DNA, 20 bp, Artificial Sequence
  chemically synthesized
gcctctttctcgatcttcag

SEQ ID NO: 164615 - DNA, 20 bp, Artificial Sequence
  chemically synthesized
ggcctctttctcgatcttca

SEQ ID NO: 164616 - DNA, 20 bp, Artificial Sequence
  chemically synthesized
gacaagtacctctgaagatc

SEQ ID NO: 164617 - DNA, 20 bp, Artificial Sequence
  chemically synthesized
atggcctctttctcgatctt

SEQ ID NO: 164618 - DNA, 20 bp, Artificial Sequence
  chemically synthesized
agtacctctgaagatcgaga

SEQ ID NO: 164619 - DNA, 20 bp, Artificial Sequence
  chemically synthesized
tacctctgaagatcgagaaa

SEQ ID NO: 164620 - DNA, 20 bp, Artificial Sequence
  chemically synthesized
acctctgaagatcgagaaag

SEQ ID NO: 164621 - DNA, 20 bp, Artificial Sequence
  chemically synthesized
agatcgagaaagaggccatc

SEQ ID NO: 164622 - DNA, 20 bp, Artificial Sequence
  chemically synthesized
gatcgagaaagaggccatcc

SEQ ID NO: 164623 - DNA, 20 bp, Artificial Sequence
  chemically synthesized
actgctgcattgtacccgga

SEQ ID NO: 164624 - DNA, 20 bp, Artificial Sequence
  chemically synthesized
cgtaactgctgcattgtacc

SEQ ID NO: 164625 - DNA, 20 bp, Artificial Sequence
  chemically synthesized
gaggccatccgggtacaatg

SEQ ID NO: 164626 - DNA, 20 bp, Artificial Sequence
  chemically synthesized
gccatccgggtacaatgcag

SEQ ID NO: 164627 - DNA, 20 bp, Artificial Sequence
  chemically synthesized
gtacaatgcagcagttacgt

SEQ ID NO: 164628 - DNA, 20 bp, Artificial Sequence
  chemically synthesized
tacaatgcagcagttacgtc

SEQ ID NO: 164629 - DNA, 20 bp, Artificial Sequence
  chemically synthesized
atgcagcagttacgtcaggc

SEQ ID NO: 164630 - DNA, 20 bp, Artificial Sequence
  chemically synthesized
tgcagcagttacgtcaggcc

SEQ ID NO: 164631 - DNA, 20 bp, Artificial Sequence
  chemically synthesized
cagcagttacgtcaggccag

SEQ ID NO: 164632 - DNA, 20 bp, Artificial Sequence
  chemically synthesized
cctgtaaacaggaagtctcc

SEQ ID NO: 164633 - DNA, 20 bp, Artificial Sequence
  chemically synthesized
tatagtctcctgtaaacagg

SEQ ID NO: 164634 - DNA, 20 bp, Artificial Sequence
  chemically synthesized
gccaggagacttcctgttta

SEQ ID NO: 164635 - DNA, 20 bp, Artificial Sequence
  chemically synthesized
ccaggagacttcctgtttac

SEQ ID NO: 164636 - DNA, 20 bp, Artificial Sequence
  chemically synthesized
ttttatagtctcctgtaaac

SEQ ID NO: 164637 - DNA, 20 bp, Artificial Sequence
  chemically synthesized
aggagacttcctgtttacag

SEQ ID NO: 164638 - DNA, 20 bp, Artificial Sequence
  chemically synthesized
gttttatagtctcctgtaaa

SEQ ID NO: 164639 - DNA, 20 bp, Artificial Sequence
  chemically synthesized
aggactggacaaaggtttta

SEQ ID NO: 164640 - DNA, 20 bp, Artificial Sequence
  chemically synthesized
gagactataaaacctttgtc

SEQ ID NO: 164641 - DNA, 20 bp, Artificial Sequence
  chemically synthesized
cccaagtgaggactggacaa

SEQ ID NO: 164642 - DNA, 20 bp, Artificial Sequence
  chemically synthesized
ccccaagtgaggactggaca

SEQ ID NO: 164643 - DNA, 20 bp, Artificial Sequence
  chemically synthesized
cgttagccccaagtgaggac

SEQ ID NO: 164644 - DNA, 20 bp, Artificial Sequence
  chemically synthesized
acctttgtccagtcctcact

SEQ ID NO: 164645 - DNA, 20 bp, Artificial Sequence
  chemically synthesized
cctttgtccagtcctcactt

SEQ ID NO: 164646 - DNA, 20 bp, Artificial Sequence
  chemically synthesized
ctttgtccagtcctcacttg

SEQ ID NO: 164647 - DNA, 20 bp, Artificial Sequence
  chemically synthesized
aatggcgttagccccaagtg

SEQ ID NO: 164648 - DNA, 20 bp, Artificial Sequence
  chemically synthesized
aaatggcgttagccccaagt

SEQ ID NO: 164649 - DNA, 20 bp, Artificial Sequence
  chemically synthesized
cctaaaatggcgttagcccc

SEQ ID NO: 164650 - DNA, 20 bp, Artificial Sequence
  chemically synthesized
cctcaggcctaaaatggcgt

SEQ ID NO: 164651 - DNA, 20 bp, Artificial Sequence
  chemically synthesized
acttggggctaacgccattt

SEQ ID NO: 164652 - DNA, 20 bp, Artificial Sequence
  chemically synthesized
cttggggctaacgccatttt

SEQ ID NO: 164653 - DNA, 20 bp, Artificial Sequence
  chemically synthesized
gggcagcctcaggcctaaaa

SEQ ID NO: 164654 - DNA, 20 bp, Artificial Sequence
  chemically synthesized
gctaacgccattttaggcct

SEQ ID NO: 164655 - DNA, 20 bp, Artificial Sequence
  chemically synthesized
ctaacgccattttaggcctg

SEQ ID NO: 164656 - DNA, 20 bp, Artificial Sequence
  chemically synthesized
gcctgggtgcgggcagcctc

SEQ ID NO: 164657 - DNA, 20 bp, Artificial Sequence
  chemically synthesized
cgcctgggtgcgggcagcct

SEQ ID NO: 164658 - DNA, 20 bp, Artificial Sequence
  chemically synthesized
aatgagcgcctgggtgcggg

SEQ ID NO: 164659 - DNA, 20 bp, Artificial Sequence
  chemically synthesized
ggcctgaggctgcccgcacc

SEQ ID NO: 164660 - DNA, 20 bp, Artificial Sequence
  chemically synthesized
gcctgaggctgcccgcaccc

SEQ ID NO: 164661 - DNA, 20 bp, Artificial Sequence
  chemically synthesized
tttaatgagcgcctgggtgc

SEQ ID NO: 164662 - DNA, 20 bp, Artificial Sequence
  chemically synthesized
ttttaatgagcgcctgggtg

SEQ ID NO: 164663 - DNA, 20 bp, Artificial Sequence
  chemically synthesized
tgctgttttaatgagcgcct

SEQ ID NO: 164664 - DNA, 20 bp, Artificial Sequence
  chemically synthesized
atgctgttttaatgagcgcc

SEQ ID NO: 164665 - DNA, 20 bp, Artificial Sequence
  chemically synthesized
cacccaggcgctcattaaaa

SEQ ID NO: 164666 - DNA, 20 bp, Artificial Sequence
  chemically synthesized
ccgcaacatgctgttttaat

SEQ ID NO: 164667 - DNA, 20 bp, Artificial Sequence
  chemically synthesized
ctcattaaaacagcatgttg

SEQ ID NO: 164668 - DNA, 20 bp, Artificial Sequence
  chemically synthesized
ttaaaacagcatgttgcggc

SEQ ID NO: 164669 - DNA, 20 bp, Artificial Sequence
  chemically synthesized
taaaacagcatgttgcggcc

SEQ ID NO: 164670 - DNA, 20 bp, Artificial Sequence
  chemically synthesized
acagcatgttgcggccgggt

SEQ ID NO: 164671 - DNA, 20 bp, Artificial Sequence
  chemically synthesized
cagcatgttgcggccgggtg

SEQ ID NO: 164672 - DNA, 20 bp, Artificial Sequence
  chemically synthesized
catgttgcggccgggtgagg

SEQ ID NO: 164673 - DNA, 20 bp, Artificial Sequence
  chemically synthesized
caggcgtgagccacctcacc

SEQ ID NO: 164674 - DNA, 20 bp, Artificial Sequence
  chemically synthesized
agtgctgggattacaggcgt

SEQ ID NO: 164675 - DNA, 20 bp, Artificial Sequence
  chemically synthesized
gtggctcacgcctgtaatcc

SEQ ID NO: 164676 - DNA, 20 bp, Artificial Sequence
  chemically synthesized
tcccagagtgctgggattac

SEQ ID NO: 164677 - DNA, 20 bp, Artificial Sequence
  chemically synthesized
ctcccagagtgctgggatta

SEQ ID NO: 164678 - DNA, 20 bp, Artificial Sequence
  chemically synthesized
cgcctgtaatcccagcactc

SEQ ID NO: 164679 - DNA, 20 bp, Artificial Sequence
  chemically synthesized
cctcggcctcccagagtgct

SEQ ID NO: 164680 - DNA, 20 bp, Artificial Sequence
  chemically synthesized
gcctgtaatcccagcactct

SEQ ID NO: 164681 - DNA, 20 bp, Artificial Sequence
  chemically synthesized
gcctcggcctcccagagtgc

SEQ ID NO: 164682 - DNA, 20 bp, Artificial Sequence
  chemically synthesized
ctgtaatcccagcactctgg

SEQ ID NO: 164683 - DNA, 20 bp, Artificial Sequence
  chemically synthesized
tgtaatcccagcactctggg

SEQ ID NO: 164684 - DNA, 20 bp, Artificial Sequence
  chemically synthesized
ctgcccgcctcggcctccca

SEQ ID NO: 164685 - DNA, 20 bp, Artificial Sequence
  chemically synthesized
tcccagcactctgggaggcc

SEQ ID NO: 164686 - DNA, 20 bp, Artificial Sequence
  chemically synthesized
atctgcccgcctcggcctcc

SEQ ID NO: 164687 - DNA, 20 bp, Artificial Sequence
  chemically synthesized
cccagcactctgggaggccg

SEQ ID NO: 164688 - DNA, 20 bp, Artificial Sequence
  chemically synthesized
agcactctgggaggccgagg

SEQ ID NO: 164689 - DNA, 20 bp, Artificial Sequence
  chemically synthesized
gcactctgggaggccgaggc

SEQ ID NO: 164690 - DNA, 20 bp, Artificial Sequence
  chemically synthesized
ctctgggaggccgaggcggg

SEQ ID NO: 164691 - DNA, 20 bp, Artificial Sequence
  chemically synthesized
acctcatgatctgcccgcct

SEQ ID NO: 164692 - DNA, 20 bp, Artificial Sequence
  chemically synthesized
ggccgaggcgggcagatcat

SEQ ID NO: 164693 - DNA, 20 bp, Artificial Sequence
  chemically synthesized
gccgaggcgggcagatcatg

SEQ ID NO: 164694 - DNA, 20 bp, Artificial Sequence
  chemically synthesized
aggcgggcagatcatgaggt

SEQ ID NO: 164695 - DNA, 20 bp, Artificial Sequence
  chemically synthesized
ggcgggcagatcatgaggtc

SEQ ID NO: 164696 - DNA, 20 bp, Artificial Sequence
  chemically synthesized
cgggcagatcatgaggtcag

SEQ ID NO: 164697 - DNA, 20 bp, Artificial Sequence
  chemically synthesized
gatcatgaggtcaggagatc

SEQ ID NO: 164698 - DNA, 20 bp, Artificial Sequence
  chemically synthesized
tcaggagatcgagaccatcc

SEQ ID NO: 164699 - DNA, 20 bp, Artificial Sequence
  chemically synthesized
tttcaccatgttagccagga

SEQ ID NO: 164700 - DNA, 20 bp, Artificial Sequence
  chemically synthesized
ggggtttcaccatgttagcc

SEQ ID NO: 164701 - DNA, 20 bp, Artificial Sequence
  chemically synthesized
cgagaccatcctggctaaca

SEQ ID NO: 164702 - DNA, 20 bp, Artificial Sequence
  chemically synthesized
cggggtttcaccatgttagc

SEQ ID NO: 164703 - DNA, 20 bp, Artificial Sequence
  chemically synthesized
gaggcggggtttcaccatgt

SEQ ID NO: 164704 - DNA, 20 bp, Artificial Sequence
  chemically synthesized
gtgtatttttagtagaggcg

SEQ ID NO: 164705 - DNA, 20 bp, Artificial Sequence
  chemically synthesized
tgtgtatttttagtagaggc

SEQ ID NO: 164706 - DNA, 20 bp, Artificial Sequence
  chemically synthesized
ttgtgtatttttagtagagg

SEQ ID NO: 164707 - DNA, 20 bp, Artificial Sequence
  chemically synthesized
attttgtgtatttttagtag

SEQ ID NO: 164708 - DNA, 20 bp, Artificial Sequence
  chemically synthesized
aattttgtgtatttttagta

SEQ ID NO: 164709 - DNA, 20 bp, Artificial Sequence
  chemically synthesized
ctaattttgtgtatttttag

SEQ ID NO: 164710 - DNA, 20 bp, Artificial Sequence
  chemically synthesized
cggctaattttgtgtatttt

SEQ ID NO: 164711 - DNA, 20 bp, Artificial Sequence
  chemically synthesized
ctactaaaaatacacaaaat

SEQ ID NO: 164712 - DNA, 20 bp, Artificial Sequence
  chemically synthesized
taaaaatacacaaaattagc

SEQ ID NO: 164713 - DNA, 20 bp, Artificial Sequence
  chemically synthesized
aaaaatacacaaaattagcc

SEQ ID NO: 164714 - DNA, 20 bp, Artificial Sequence
  chemically synthesized
tacacaaaattagccgggcg

SEQ ID NO: 164715 - DNA, 20 bp, Artificial Sequence
  chemically synthesized
acaaaattagccgggcgtgg

SEQ ID NO: 164716 - DNA, 20 bp, Artificial Sequence
  chemically synthesized
caggcgcccgccaccacgcc

SEQ ID NO: 164717 - DNA, 20 bp, Artificial Sequence
  chemically synthesized
aaattagccgggcgtggtgg

SEQ ID NO: 164718 - DNA, 20 bp, Artificial Sequence
  chemically synthesized
aattagccgggcgtggtggc

SEQ ID NO: 164719 - DNA, 20 bp, Artificial Sequence
  chemically synthesized
ggcgtggtggcgggcgcctg

SEQ ID NO: 164720 - DNA, 20 bp, Artificial Sequence
  chemically synthesized
gtggcgggcgcctgtagtcc

SEQ ID NO: 164721 - DNA, 20 bp, Artificial Sequence
  chemically synthesized
tcccgagcagctgggactac

SEQ ID NO: 164722 - DNA, 20 bp, Artificial Sequence
  chemically synthesized
ctcccgagcagctgggacta

SEQ ID NO: 164723 - DNA, 20 bp, Artificial Sequence
  chemically synthesized
cgcctgtagtcccagctgct

SEQ ID NO: 164724 - DNA, 20 bp, Artificial Sequence
  chemically synthesized
cgtcatcctcccgagcagct

SEQ ID NO: 164725 - DNA, 20 bp, Artificial Sequence
  chemically synthesized
gcctgtagtcccagctgctc

SEQ ID NO: 164726 - DNA, 20 bp, Artificial Sequence
  chemically synthesized
gcgtcatcctcccgagcagc

SEQ ID NO: 164727 - DNA, 20 bp, Artificial Sequence
  chemically synthesized
ctgtagtcccagctgctcgg

SEQ ID NO: 164728 - DNA, 20 bp, Artificial Sequence
  chemically synthesized
tgtagtcccagctgctcggg

SEQ ID NO: 164729 - DNA, 20 bp, Artificial Sequence
  chemically synthesized
tcctgcgtcatcctcccgag

SEQ ID NO: 164730 - DNA, 20 bp, Artificial Sequence
  chemically synthesized
ttctcctgcgtcatcctccc

SEQ ID NO: 164731 - DNA, 20 bp, Artificial Sequence
  chemically synthesized
agctgctcgggaggatgacg

SEQ ID NO: 164732 - DNA, 20 bp, Artificial Sequence
  chemically synthesized
gctgctcgggaggatgacgc

SEQ ID NO: 164733 - DNA, 20 bp, Artificial Sequence
  chemically synthesized
tgctcgggaggatgacgcag

SEQ ID NO: 164734 - DNA, 20 bp, Artificial Sequence
  chemically synthesized
gggaggatgacgcaggagaa

SEQ ID NO: 164735 - DNA, 20 bp, Artificial Sequence
  chemically synthesized
gcaggagaatggcgtgaacc

SEQ ID NO: 164736 - DNA, 20 bp, Artificial Sequence
  chemically synthesized
caggagaatggcgtgaaccc

SEQ ID NO: 164737 - DNA, 20 bp, Artificial Sequence
  chemically synthesized
ggagaatggcgtgaacccag

SEQ ID NO: 164738 - DNA, 20 bp, Artificial Sequence
  chemically synthesized
gagaatggcgtgaacccagg

SEQ ID NO: 164739 - DNA, 20 bp, Artificial Sequence
  chemically synthesized
aatggcgtgaacccaggagg

SEQ ID NO: 164740 - DNA, 20 bp, Artificial Sequence
  chemically synthesized
cactgcaagctccgcctcct

SEQ ID NO: 164741 - DNA, 20 bp, Artificial Sequence
  chemically synthesized
tggcgtgaacccaggaggcg

SEQ ID NO: 164742 - DNA, 20 bp, Artificial Sequence
  chemically synthesized
tcactgcaagctccgcctcc

SEQ ID NO: 164743 - DNA, 20 bp, Artificial Sequence
  chemically synthesized
aacccaggaggcggagcttg

SEQ ID NO: 164744 - DNA, 20 bp, Artificial Sequence
  chemically synthesized
caggaggcggagcttgcagt

SEQ ID NO: 164745 - DNA, 20 bp, Artificial Sequence
  chemically synthesized
gcgtgatctcagctcactgc

SEQ ID NO: 164746 - DNA, 20 bp, Artificial Sequence
  chemically synthesized
ggcggagcttgcagtgagct

SEQ ID NO: 164747 - DNA, 20 bp, Artificial Sequence
  chemically synthesized
ggagtgcagtggcgtgatct

SEQ ID NO: 164748 - DNA, 20 bp, Artificial Sequence
  chemically synthesized
tcgcccaggctggagtgcag

SEQ ID NO: 164749 - DNA, 20 bp, Artificial Sequence
  chemically synthesized
gagatcacgccactgcactc

SEQ ID NO: 164750 - DNA, 20 bp, Artificial Sequence
  chemically synthesized
cagtcgcccaggctggagtg

SEQ ID NO: 164751 - DNA, 20 bp, Artificial Sequence
  chemically synthesized
cacgccactgcactccagcc

SEQ ID NO: 164752 - DNA, 20 bp, Artificial Sequence
  chemically synthesized
acgccactgcactccagcct

SEQ ID NO: 164753 - DNA, 20 bp, Artificial Sequence
  chemically synthesized
ttgctcagtcgcccaggctg

SEQ ID NO: 164754 - DNA, 20 bp, Artificial Sequence
  chemically synthesized
tcttgctcagtcgcccaggc

SEQ ID NO: 164755 - DNA, 20 bp, Artificial Sequence
  chemically synthesized
ggagtcttgctcagtcgccc

SEQ ID NO: 164756 - DNA, 20 bp, Artificial Sequence
  chemically synthesized
gcactccagcctgggcgact

SEQ ID NO: 164757 - DNA, 20 bp, Artificial Sequence
  chemically synthesized
cggagtcttgctcagtcgcc

SEQ ID NO: 164758 - DNA, 20 bp, Artificial Sequence
  chemically synthesized
tccagcctgggcgactgagc

SEQ ID NO: 164759 - DNA, 20 bp, Artificial Sequence
  chemically synthesized
gtttgagacggagtcttgct

SEQ ID NO: 164760 - DNA, 20 bp, Artificial Sequence
  chemically synthesized
ttgtttgtttgtttgagacg

SEQ ID NO: 164761 - DNA, 20 bp, Artificial Sequence
  chemically synthesized
ttttgtttgtttgtttgaga

SEQ ID NO: 164762 - DNA, 20 bp, Artificial Sequence
  chemically synthesized
ttttttttgtttgtttgttt

SEQ ID NO: 164763 - DNA, 20 bp, Artificial Sequence
  chemically synthesized
tcaaacaaacaaacaaaaaa

SEQ ID NO: 164764 - DNA, 20 bp, Artificial Sequence
  chemically synthesized
aaacaaaaaaaagatttgac

SEQ ID NO: 164765 - DNA, 20 bp, Artificial Sequence
  chemically synthesized
gcctaccacaggaacaaatc

SEQ ID NO: 164766 - DNA, 20 bp, Artificial Sequence
  chemically synthesized
tttgactggatttgttcctg

SEQ ID NO: 164767 - DNA, 20 bp, Artificial Sequence
  chemically synthesized
gactggatttgttcctgtgg

SEQ ID NO: 164768 - DNA, 20 bp, Artificial Sequence
  chemically synthesized
actggatttgttcctgtggt

SEQ ID NO: 164769 - DNA, 20 bp, Artificial Sequence
  chemically synthesized
tggaatgaagtgcctaccac

SEQ ID NO: 164770 - DNA, 20 bp, Artificial Sequence
  chemically synthesized
ttggaatgaagtgcctacca

SEQ ID NO: 164771 - DNA, 20 bp, Artificial Sequence
  chemically synthesized
tgggcaagaaaattggaatg

SEQ ID NO: 164772 - DNA, 20 bp, Artificial Sequence
  chemically synthesized
caaaaagtgggcaagaaaat

SEQ ID NO: 164773 - DNA, 20 bp, Artificial Sequence
  chemically synthesized
tcattaaccaaaaagtgggc

SEQ ID NO: 164774 - DNA, 20 bp, Artificial Sequence
  chemically synthesized
caattttcttgcccactttt

SEQ ID NO: 164775 - DNA, 20 bp, Artificial Sequence
  chemically synthesized
tctgtcattaaccaaaaagt

SEQ ID NO: 164776 - DNA, 20 bp, Artificial Sequence
  chemically synthesized
gtctgtcattaaccaaaaag

SEQ ID NO: 164777 - DNA, 20 bp, Artificial Sequence
  chemically synthesized
aaagtctgtcattaaccaaa

SEQ ID NO: 164778 - DNA, 20 bp, Artificial Sequence
  chemically synthesized
gcccactttttggttaatga

SEQ ID NO: 164779 - DNA, 20 bp, Artificial Sequence
  chemically synthesized
ttattttgtaaagcggaaga

SEQ ID NO: 164780 - DNA, 20 bp, Artificial Sequence
  chemically synthesized
gcttttattttgtaaagcgg

SEQ ID NO: 164781 - DNA, 20 bp, Artificial Sequence
  chemically synthesized
tgtgcttttattttgtaaag

SEQ ID NO: 164782 - DNA, 20 bp, Artificial Sequence
  chemically synthesized
aggtgtgcttttattttgta

SEQ ID NO: 164783 - DNA, 20 bp, Artificial Sequence
  chemically synthesized
tcttccgctttacaaaataa

SEQ ID NO: 164784 - DNA, 20 bp, Artificial Sequence
  chemically synthesized
accagtgggataggtcagag

SEQ ID NO: 164785 - DNA, 20 bp, Artificial Sequence
  chemically synthesized
caccagtgggataggtcaga

SEQ ID NO: 164786 - DNA, 20 bp, Artificial Sequence
  chemically synthesized
tgcaccagtgggataggtca

SEQ ID NO: 164787 - DNA, 20 bp, Artificial Sequence
  chemically synthesized
aatgcaccagtgggataggt

SEQ ID NO: 164788 - DNA, 20 bp, Artificial Sequence
  chemically synthesized
acctctctgacctatcccac

SEQ ID NO: 164789 - DNA, 20 bp, Artificial Sequence
  chemically synthesized
ctacaatgcaccagtgggat

SEQ ID NO: 164790 - DNA, 20 bp, Artificial Sequence
  chemically synthesized
actacaatgcaccagtggga

SEQ ID NO: 164791 - DNA, 20 bp, Artificial Sequence
  chemically synthesized
cttgactacaatgcaccagt

SEQ ID NO: 164792 - DNA, 20 bp, Artificial Sequence
  chemically synthesized
tcttgactacaatgcaccag

SEQ ID NO: 164793 - DNA, 20 bp, Artificial Sequence
  chemically synthesized
gtatcttgactacaatgcac

SEQ ID NO: 164794 - DNA, 20 bp, Artificial Sequence
  chemically synthesized
cctatcccactggtgcattg

SEQ ID NO: 164795 - DNA, 20 bp, Artificial Sequence
  chemically synthesized
cccactggtgcattgtagtc

SEQ ID NO: 164796 - DNA, 20 bp, Artificial Sequence
  chemically synthesized
gatacatttatgccaaataa

SEQ ID NO: 164797 - DNA, 20 bp, Artificial Sequence
  chemically synthesized
ttttgaattgtacttttatt

SEQ ID NO: 164798 - DNA, 20 bp, Artificial Sequence
  chemically synthesized
aaaagtacaattcaaaatat

SEQ ID NO: 164799 - DNA, 20 bp, Artificial Sequence
  chemically synthesized
ccttgagtaaagaaggattt

SEQ ID NO: 164800 - DNA, 20 bp, Artificial Sequence
  chemically synthesized
gatggtaccttgagtaaaga

SEQ ID NO: 164801 - DNA, 20 bp, Artificial Sequence
  chemically synthesized
tgatggtaccttgagtaaag

SEQ ID NO: 164802 - DNA, 20 bp, Artificial Sequence
  chemically synthesized
actgaaatccttctttactc

SEQ ID NO: 164803 - DNA, 20 bp, Artificial Sequence
  chemically synthesized
ctgaaatccttctttactca

SEQ ID NO: 164804 - DNA, 20 bp, Artificial Sequence
  chemically synthesized
atttgatggtaccttgagta

SEQ ID NO: 164805 - DNA, 20 bp, Artificial Sequence
  chemically synthesized
tgggtatttgatggtacctt

SEQ ID NO: 164806 - DNA, 20 bp, Artificial Sequence
  chemically synthesized
tgagatggatgggtatttga

SEQ ID NO: 164807 - DNA, 20 bp, Artificial Sequence
  chemically synthesized
gaatctattatgagatggat

SEQ ID NO: 164808 - DNA, 20 bp, Artificial Sequence
  chemically synthesized
tgaatctattatgagatgga

SEQ ID NO: 164809 - DNA, 20 bp, Artificial Sequence
  chemically synthesized
aaaatgaatctattatgaga

SEQ ID NO: 164810 - DNA, 20 bp, Artificial Sequence
  chemically synthesized
aatacccatccatctcataa

SEQ ID NO: 164811 - DNA, 20 bp, Artificial Sequence
  chemically synthesized
attgaaaatgaatctattat

SEQ ID NO: 164812 - DNA, 20 bp, Artificial Sequence
  chemically synthesized
attttcaataactatccact

SEQ ID NO: 164813 - DNA, 20 bp, Artificial Sequence
  chemically synthesized
tattaaacatactcagtgga

SEQ ID NO: 164814 - DNA, 20 bp, Artificial Sequence
  chemically synthesized
taattattaaacatactcag

SEQ ID NO: 164815 - DNA, 20 bp, Artificial Sequence
  chemically synthesized
aaataattattaaacatact

SEQ ID NO: 164816 - DNA, 20 bp, Artificial Sequence
  chemically synthesized
gtttaataattatttatcaa

SEQ ID NO: 164817 - DNA, 20 bp, Artificial Sequence
  chemically synthesized
tttaataattatttatcaaa

SEQ ID NO: 164818 - DNA, 20 bp, Artificial Sequence
  chemically synthesized
tatcaaaaggtacatatatt

SEQ ID NO: 164819 - DNA, 20 bp, Artificial Sequence
  chemically synthesized
atcaaaaggtacatatattt

SEQ ID NO: 164820 - DNA, 20 bp, Artificial Sequence
  chemically synthesized
gtacatatatttaggttatt

SEQ ID NO: 164821 - DNA, 20 bp, Artificial Sequence
  chemically synthesized
taggttatttggttattact

SEQ ID NO: 164822 - DNA, 20 bp, Artificial Sequence
  chemically synthesized
gtattaataataaatacact

SEQ ID NO: 164823 - DNA, 20 bp, Artificial Sequence
  chemically synthesized
tctagattgagtagtattta

SEQ ID NO: 164824 - DNA, 20 bp, Artificial Sequence
  chemically synthesized
actttaaatactactcaatc

SEQ ID NO: 164825 - DNA, 20 bp, Artificial Sequence
  chemically synthesized
ttaaaattctctagattgag

SEQ ID NO: 164826 - DNA, 20 bp, Artificial Sequence
  chemically synthesized
tttaaatactactcaatcta

SEQ ID NO: 164827 - DNA, 20 bp, Artificial Sequence
  chemically synthesized
tttttaaaattctctagatt

SEQ ID NO: 164828 - DNA, 20 bp, Artificial Sequence
  chemically synthesized
taagtatttttaaaattctc

SEQ ID NO: 164829 - DNA, 20 bp, Artificial Sequence
  chemically synthesized
tagagaattttaaaaatact

SEQ ID NO: 164830 - DNA, 20 bp, Artificial Sequence
  chemically synthesized
gagaattttaaaaatactta

SEQ ID NO: 164831 - DNA, 20 bp, Artificial Sequence
  chemically synthesized
tcctgtgactacaaggctct

SEQ ID NO: 164832 - DNA, 20 bp, Artificial Sequence
  chemically synthesized
taaaaatacttagagccttg

SEQ ID NO: 164833 - DNA, 20 bp, Artificial Sequence
  chemically synthesized
aacaatttcctgtgactaca

SEQ ID NO: 164834 - DNA, 20 bp, Artificial Sequence
  chemically synthesized
tacttagagccttgtagtca

SEQ ID NO: 164835 - DNA, 20 bp, Artificial Sequence
  chemically synthesized
aaacaatttcctgtgactac

SEQ ID NO: 164836 - DNA, 20 bp, Artificial Sequence
  chemically synthesized
acttagagccttgtagtcac

SEQ ID NO: 164837 - DNA, 20 bp, Artificial Sequence
  chemically synthesized
tgtttttaaaaattgaattt

SEQ ID NO: 164838 - DNA, 20 bp, Artificial Sequence
  chemically synthesized
tttataaaattatatttatg

SEQ ID NO: 164839 - DNA, 20 bp, Artificial Sequence
  chemically synthesized
cacataaatataattttata

SEQ ID NO: 164840 - DNA, 20 bp, Artificial Sequence
  chemically synthesized
aattttataaagaattatga

SEQ ID NO: 164841 - DNA, 20 bp, Artificial Sequence
  chemically synthesized
ttttataaagaattatgata

SEQ ID NO: 164842 - DNA, 20 bp, Artificial Sequence
  chemically synthesized
tataaagaattatgatagag

SEQ ID NO: 164843 - DNA, 20 bp, Artificial Sequence
  chemically synthesized
tttatgctataaagttttat

SEQ ID NO: 164844 - DNA, 20 bp, Artificial Sequence
  chemically synthesized
gagtggctaataaaacttta

SEQ ID NO: 164845 - DNA, 20 bp, Artificial Sequence
  chemically synthesized
tgatacatatttatgctata

SEQ ID NO: 164846 - DNA, 20 bp, Artificial Sequence
  chemically synthesized
gtatcacatatttatcacat

SEQ ID NO: 164847 - DNA, 20 bp, Artificial Sequence
  chemically synthesized
cacattagaatacaattcat

SEQ ID NO: 164848 - DNA, 20 bp, Artificial Sequence
  chemically synthesized
acattagaatacaattcatt

SEQ ID NO: 164849 - DNA, 20 bp, Artificial Sequence
  chemically synthesized
cattagaatacaattcattg

SEQ ID NO: 164850 - DNA, 20 bp, Artificial Sequence
  chemically synthesized
tagaatacaattcattgggg

SEQ ID NO: 164851 - DNA, 20 bp, Artificial Sequence
  chemically synthesized
aaaaatatgatttaaataaa

SEQ ID NO: 164852 - DNA, 20 bp, Artificial Sequence
  chemically synthesized
aaaatatgatttaaataaaa

SEQ ID NO: 164853 - DNA, 20 bp, Artificial Sequence
  chemically synthesized
agctcatatttaataaatag

SEQ ID NO: 164854 - DNA, 20 bp, Artificial Sequence
  chemically synthesized
aaaagctcatatttaataaa

SEQ ID NO: 164855 - DNA, 20 bp, Artificial Sequence
  chemically synthesized
aacttctatttattaaatat

SEQ ID NO: 164856 - DNA, 20 bp, Artificial Sequence
  chemically synthesized
atacttaaaaatacatgaaa

SEQ ID NO: 164857 - DNA, 20 bp, Artificial Sequence
  chemically synthesized
gagctttttcatgtattttt

SEQ ID NO: 164858 - DNA, 20 bp, Artificial Sequence
  chemically synthesized
atgtatttttaagtatatga

SEQ ID NO: 164859 - DNA, 20 bp, Artificial Sequence
  chemically synthesized
tatttttaagtatatgatgg

SEQ ID NO: 164860 - DNA, 20 bp, Artificial Sequence
  chemically synthesized
tggtagacattatattgcaa

SEQ ID NO: 164861 - DNA, 20 bp, Artificial Sequence
  chemically synthesized
cattatattgcaatggtatt

SEQ ID NO: 164862 - DNA, 20 bp, Artificial Sequence
  chemically synthesized
gcaatggtatttggattcca

SEQ ID NO: 164863 - DNA, 20 bp, Artificial Sequence
  chemically synthesized
caatggtatttggattccac

SEQ ID NO: 164864 - DNA, 20 bp, Artificial Sequence
  chemically synthesized
acagtttagaatgtatcccg

SEQ ID NO: 164865 - DNA, 20 bp, Artificial Sequence
  chemically synthesized
aaagggtttatagtacagtt

SEQ ID NO: 164866 - DNA, 20 bp, Artificial Sequence
  chemically synthesized
ttttaaaagggtttatagta

SEQ ID NO: 164867 - DNA, 20 bp, Artificial Sequence
  chemically synthesized
tgacattttaaaagggttta

SEQ ID NO: 164868 - DNA, 20 bp, Artificial Sequence
  chemically synthesized
taaatattgacattttaaaa

SEQ ID NO: 164869 - DNA, 20 bp, Artificial Sequence
  chemically synthesized
gtaaatattgacattttaaa

SEQ ID NO: 164870 - DNA, 20 bp, Artificial Sequence
  chemically synthesized
agtaaatattgacattttaa

SEQ ID NO: 164871 - DNA, 20 bp, Artificial Sequence
  chemically synthesized
gtcaatatttactgtatccc

SEQ ID NO: 164872 - DNA, 20 bp, Artificial Sequence
  chemically synthesized
tcaatatttactgtatccca

SEQ ID NO: 164873 - DNA, 20 bp, Artificial Sequence
  chemically synthesized
tattttctgcccttgggata

SEQ ID NO: 164874 - DNA, 20 bp, Artificial Sequence
  chemically synthesized
caatatttactgtatcccaa

SEQ ID NO: 164875 - DNA, 20 bp, Artificial Sequence
  chemically synthesized
tatttactgtatcccaaggg

SEQ ID NO: 164876 - DNA, 20 bp, Artificial Sequence
  chemically synthesized
gacatctattttctgccctt

SEQ ID NO: 164877 - DNA, 20 bp, Artificial Sequence
  chemically synthesized
tgacatctattttctgccct

SEQ ID NO: 164878 - DNA, 20 bp, Artificial Sequence
  chemically synthesized
tgtatcccaagggcagaaaa

SEQ ID NO: 164879 - DNA, 20 bp, Artificial Sequence
  chemically synthesized
atatctgcttgcacatttta

SEQ ID NO: 164880 - DNA, 20 bp, Artificial Sequence
  chemically synthesized
atgtcatctttaaaatgtgc

SEQ ID NO: 164881 - DNA, 20 bp, Artificial Sequence
  chemically synthesized
tcatctttaaaatgtgcaag

SEQ ID NO: 164882 - DNA, 20 bp, Artificial Sequence
  chemically synthesized
tataaaaaataaaaatattt

SEQ ID NO: 164883 - DNA, 20 bp, Artificial Sequence
  chemically synthesized
tttattttttataaatacaa

SEQ ID NO: 164884 - DNA, 20 bp, Artificial Sequence
  chemically synthesized
acctctattatagtggcatt

SEQ ID NO: 164885 - DNA, 20 bp, Artificial Sequence
  chemically synthesized
tggtctgaatgccactataa

SEQ ID NO: 164886 - DNA, 20 bp, Artificial Sequence
  chemically synthesized
tcaaagaacctctattatag

SEQ ID NO: 164887 - DNA, 20 bp, Artificial Sequence
  chemically synthesized
gtctgaatgccactataata

SEQ ID NO: 164888 - DNA, 20 bp, Artificial Sequence
  chemically synthesized
tctgaatgccactataatag

SEQ ID NO: 164889 - DNA, 20 bp, Artificial Sequence
  chemically synthesized
gcttcaaagaacctctatta

SEQ ID NO: 164890 - DNA, 20 bp, Artificial Sequence
  chemically synthesized
actataatagaggttctttg

SEQ ID NO: 164891 - DNA, 20 bp, Artificial Sequence
  chemically synthesized
agccaaggaagagggcttca

SEQ ID NO: 164892 - DNA, 20 bp, Artificial Sequence
  chemically synthesized
ttctttgaagccctcttcct

SEQ ID NO: 164893 - DNA, 20 bp, Artificial Sequence
  chemically synthesized
ctttgccaagccaaggaaga

SEQ ID NO: 164894 - DNA, 20 bp, Artificial Sequence
  chemically synthesized
tctttgccaagccaaggaag

SEQ ID NO: 164895 - DNA, 20 bp, Artificial Sequence
  chemically synthesized
ctctttgccaagccaaggaa

SEQ ID NO: 164896 - DNA, 20 bp, Artificial Sequence
  chemically synthesized
tcctctttgccaagccaagg

SEQ ID NO: 164897 - DNA, 20 bp, Artificial Sequence
  chemically synthesized
tgaagccctcttccttggct

SEQ ID NO: 164898 - DNA, 20 bp, Artificial Sequence
  chemically synthesized
ttttcctctttgccaagcca

SEQ ID NO: 164899 - DNA, 20 bp, Artificial Sequence
  chemically synthesized
cttttcctctttgccaagcc

SEQ ID NO: 164900 - DNA, 20 bp, Artificial Sequence
  chemically synthesized
ccctcttccttggcttggca

SEQ ID NO: 164901 - DNA, 20 bp, Artificial Sequence
  chemically synthesized
ctcttccttggcttggcaaa

SEQ ID NO: 164902 - DNA, 20 bp, Artificial Sequence
  chemically synthesized
tcttccttggcttggcaaag

SEQ ID NO: 164903 - DNA, 20 bp, Artificial Sequence
  chemically synthesized
gagtgcttttcctctttgcc

SEQ ID NO: 164904 - DNA, 20 bp, Artificial Sequence
  chemically synthesized
cttggcttggcaaagaggaa

SEQ ID NO: 164905 - DNA, 20 bp, Artificial Sequence
  chemically synthesized
tcttatgagggaggggagaa

SEQ ID NO: 164906 - DNA, 20 bp, Artificial Sequence
  chemically synthesized
tttcttatgagggaggggag

SEQ ID NO: 164907 - DNA, 20 bp, Artificial Sequence
  chemically synthesized
ccctttcttatgagggaggg

SEQ ID NO: 164908 - DNA, 20 bp, Artificial Sequence
  chemically synthesized
ttccctttcttatgagggag

SEQ ID NO: 164909 - DNA, 20 bp, Artificial Sequence
  chemically synthesized
gttccctttcttatgaggga

SEQ ID NO: 164910 - DNA, 20 bp, Artificial Sequence
  chemically synthesized
actcttctcccctccctcat

SEQ ID NO: 164911 - DNA, 20 bp, Artificial Sequence
  chemically synthesized
tgttccctttcttatgaggg

SEQ ID NO: 164912 - DNA, 20 bp, Artificial Sequence
  chemically synthesized
ctgttccctttcttatgagg

SEQ ID NO: 164913 - DNA, 20 bp, Artificial Sequence
  chemically synthesized
tactgttccctttcttatga

SEQ ID NO: 164914 - DNA, 20 bp, Artificial Sequence
  chemically synthesized
ttctcccctccctcataaga

SEQ ID NO: 164915 - DNA, 20 bp, Artificial Sequence
  chemically synthesized
ttactgttccctttcttatg

SEQ ID NO: 164916 - DNA, 20 bp, Artificial Sequence
  chemically synthesized
tctcccctccctcataagaa

SEQ ID NO: 164917 - DNA, 20 bp, Artificial Sequence
  chemically synthesized
tttactgttccctttcttat

SEQ ID NO: 164918 - DNA, 20 bp, Artificial Sequence
  chemically synthesized
ctcccctccctcataagaaa

SEQ ID NO: 164919 - DNA, 20 bp, Artificial Sequence
  chemically synthesized
ctccctcataagaaagggaa

SEQ ID NO: 164920 - DNA, 20 bp, Artificial Sequence
  chemically synthesized
cataagaaagggaacagtaa

SEQ ID NO: 164921 - DNA, 20 bp, Artificial Sequence
  chemically synthesized
aaagggaacagtaaaagtca

SEQ ID NO: 164922 - DNA, 20 bp, Artificial Sequence
  chemically synthesized
gggaacagtaaaagtcatag

SEQ ID NO: 164923 - DNA, 20 bp, Artificial Sequence
  chemically synthesized
actaacaatttgttggacat

SEQ ID NO: 164924 - DNA, 20 bp, Artificial Sequence
  chemically synthesized
aaataggactaacaatttgt

SEQ ID NO: 164925 - DNA, 20 bp, Artificial Sequence
  chemically synthesized
tctcatgtccaacaaattgt

SEQ ID NO: 164926 - DNA, 20 bp, Artificial Sequence
  chemically synthesized
ctggaacagatcattcaaat

SEQ ID NO: 164927 - DNA, 20 bp, Artificial Sequence
  chemically synthesized
cctggaacagatcattcaaa

SEQ ID NO: 164928 - DNA, 20 bp, Artificial Sequence
  chemically synthesized
cctatttgaatgatctgttc

SEQ ID NO: 164929 - DNA, 20 bp, Artificial Sequence
  chemically synthesized
ctatttgaatgatctgttcc

SEQ ID NO: 164930 - DNA, 20 bp, Artificial Sequence
  chemically synthesized
ttgaatgagaattcctggaa

SEQ ID NO: 164931 - DNA, 20 bp, Artificial Sequence
  chemically synthesized
gtttcttgaatgagaattcc

SEQ ID NO: 164932 - DNA, 20 bp, Artificial Sequence
  chemically synthesized
tgttccaggaattctcattc

SEQ ID NO: 164933 - DNA, 20 bp, Artificial Sequence
  chemically synthesized
ttgagaacagtttcttgaat

SEQ ID NO: 164934 - DNA, 20 bp, Artificial Sequence
  chemically synthesized
tcattcaagaaactgttctc

SEQ ID NO: 164935 - DNA, 20 bp, Artificial Sequence
  chemically synthesized
gaaaaggataaacttgagaa

SEQ ID NO: 164936 - DNA, 20 bp, Artificial Sequence
  chemically synthesized
ataaggaaaaggataaactt

SEQ ID NO: 164937 - DNA, 20 bp, Artificial Sequence
  chemically synthesized
aacttgcccatataaggaaa

SEQ ID NO: 164938 - DNA, 20 bp, Artificial Sequence
  chemically synthesized
taacttgcccatataaggaa

SEQ ID NO: 164939 - DNA, 20 bp, Artificial Sequence
  chemically synthesized
agtttatccttttccttata

SEQ ID NO: 164940 - DNA, 20 bp, Artificial Sequence
  chemically synthesized
gtttatccttttccttatat

SEQ ID NO: 164941 - DNA, 20 bp, Artificial Sequence
  chemically synthesized
caacctaacttgcccatata

SEQ ID NO: 164942 - DNA, 20 bp, Artificial Sequence
  chemically synthesized
ccaacctaacttgcccatat

SEQ ID NO: 164943 - DNA, 20 bp, Artificial Sequence
  chemically synthesized
atccttttccttatatgggc

SEQ ID NO: 164944 - DNA, 20 bp, Artificial Sequence
  chemically synthesized
ttttccttatatgggcaagt

SEQ ID NO: 164945 - DNA, 20 bp, Artificial Sequence
  chemically synthesized
tttccttatatgggcaagtt

SEQ ID NO: 164946 - DNA, 20 bp, Artificial Sequence
  chemically synthesized
cttatatgggcaagttaggt

SEQ ID NO: 164947 - DNA, 20 bp, Artificial Sequence
  chemically synthesized
aaaagggagtagatggtcat

SEQ ID NO: 164948 - DNA, 20 bp, Artificial Sequence
  chemically synthesized
actccaaaaaagggagtaga

SEQ ID NO: 164949 - DNA, 20 bp, Artificial Sequence
  chemically synthesized
aaacactccaaaaaagggag

SEQ ID NO: 164950 - DNA, 20 bp, Artificial Sequence
  chemically synthesized
tgaccatctactcccttttt

SEQ ID NO: 164951 - DNA, 20 bp, Artificial Sequence
  chemically synthesized
gaaaaacactccaaaaaagg

SEQ ID NO: 164952 - DNA, 20 bp, Artificial Sequence
  chemically synthesized
accatctactcccttttttg

SEQ ID NO: 164953 - DNA, 20 bp, Artificial Sequence
  chemically synthesized
cagaaaaacactccaaaaaa

SEQ ID NO: 164954 - DNA, 20 bp, Artificial Sequence
  chemically synthesized
ccagaaaaacactccaaaaa

SEQ ID NO: 164955 - DNA, 20 bp, Artificial Sequence
  chemically synthesized
accagaaaaacactccaaaa

SEQ ID NO: 164956 - DNA, 20 bp, Artificial Sequence
  chemically synthesized
ccttttttggagtgtttttc

SEQ ID NO: 164957 - DNA, 20 bp, Artificial Sequence
  chemically synthesized
ctacagcagcaagttggtac

SEQ ID NO: 164958 - DNA, 20 bp, Artificial Sequence
  chemically synthesized
atacccctacagcagcaagt

SEQ ID NO: 164959 - DNA, 20 bp, Artificial Sequence
  chemically synthesized
ctggtaccaacttgctgctg

SEQ ID NO: 164960 - DNA, 20 bp, Artificial Sequence
  chemically synthesized
caaaatacccctacagcagc

SEQ ID NO: 164961 - DNA, 20 bp, Artificial Sequence
  chemically synthesized
tggtaccaacttgctgctgt

SEQ ID NO: 164962 - DNA, 20 bp, Artificial Sequence
  chemically synthesized
ggtaccaacttgctgctgta

SEQ ID NO: 164963 - DNA, 20 bp, Artificial Sequence
  chemically synthesized
gtaccaacttgctgctgtag

SEQ ID NO: 164964 - DNA, 20 bp, Artificial Sequence
  chemically synthesized
ccttcaaaatacccctacag

SEQ ID NO: 164965 - DNA, 20 bp, Artificial Sequence
  chemically synthesized
aggccttcaaaataccccta

SEQ ID NO: 164966 - DNA, 20 bp, Artificial Sequence
  chemically synthesized
gctgctgtaggggtattttg

SEQ ID NO: 164967 - DNA, 20 bp, Artificial Sequence
  chemically synthesized
ctgctgtaggggtattttga

SEQ ID NO: 164968 - DNA, 20 bp, Artificial Sequence
  chemically synthesized
aaaaaaaaaaaaaaaaaaaa

SEQ ID NO: 164969 - DNA, 20 bp, Artificial Sequence
  chemically synthesized
aaaaaaaaaaaaaaaaaaaa

SEQ ID NO: 164970 - DNA, 20 bp, Artificial Sequence
  chemically synthesized
ttttttttttttttttttta

SEQ ID NO: 164971 - DNA, 20 bp, Artificial Sequence
  chemically synthesized
ttttttttttttttttaaag

SEQ ID NO: 164972 - DNA, 20 bp, Artificial Sequence
  chemically synthesized
tccggcatggggaatagagc

SEQ ID NO: 164973 - DNA, 20 bp, Artificial Sequence
  chemically synthesized
gcactccggcatggggaata

SEQ ID NO: 164974 - DNA, 20 bp, Artificial Sequence
  chemically synthesized
ctgcactccggcatggggaa

SEQ ID NO: 164975 - DNA, 20 bp, Artificial Sequence
  chemically synthesized
tcttgctctattccccatgc

SEQ ID NO: 164976 - DNA, 20 bp, Artificial Sequence
  chemically synthesized
ttgctctattccccatgccg

SEQ ID NO: 164977 - DNA, 20 bp, Artificial Sequence
  chemically synthesized
caccactgcactccggcatg

SEQ ID NO: 164978 - DNA, 20 bp, Artificial Sequence
  chemically synthesized
acaccactgcactccggcat

SEQ ID NO: 164979 - DNA, 20 bp, Artificial Sequence
  chemically synthesized
cacaccactgcactccggca

SEQ ID NO: 164980 - DNA, 20 bp, Artificial Sequence
  chemically synthesized
ctattccccatgccggagtg

SEQ ID NO: 164981 - DNA, 20 bp, Artificial Sequence
  chemically synthesized
aagatcacaccactgcactc

SEQ ID NO: 164982 - DNA, 20 bp, Artificial Sequence
  chemically synthesized
ttccccatgccggagtgcag

SEQ ID NO: 164983 - DNA, 20 bp, Artificial Sequence
  chemically synthesized
ggagtgcagtggtgtgatct

SEQ ID NO: 164984 - DNA, 20 bp, Artificial Sequence
  chemically synthesized
ggcggaggttgcagtgagcc

SEQ ID NO: 164985 - DNA, 20 bp, Artificial Sequence
  chemically synthesized
caggaggcggaggttgcagt

SEQ ID NO: 164986 - DNA, 20 bp, Artificial Sequence
  chemically synthesized
aacccaggaggcggaggttg

SEQ ID NO: 164987 - DNA, 20 bp, Artificial Sequence
  chemically synthesized
tgcttgaacccaggaggcgg

SEQ ID NO: 164988 - DNA, 20 bp, Artificial Sequence
  chemically synthesized
tcactgcaacctccgcctcc

SEQ ID NO: 164989 - DNA, 20 bp, Artificial Sequence
  chemically synthesized
ttgcttgaacccaggaggcg

SEQ ID NO: 164990 - DNA, 20 bp, Artificial Sequence
  chemically synthesized
cactgcaacctccgcctcct

SEQ ID NO: 164991 - DNA, 20 bp, Artificial Sequence
  chemically synthesized
aattgcttgaacccaggagg

SEQ ID NO: 164992 - DNA, 20 bp, Artificial Sequence
  chemically synthesized
gagaattgcttgaacccagg

SEQ ID NO: 164993 - DNA, 20 bp, Artificial Sequence
  chemically synthesized
tgagaattgcttgaacccag

SEQ ID NO: 164994 - DNA, 20 bp, Artificial Sequence
  chemically synthesized
aacctccgcctcctgggttc

SEQ ID NO: 164995 - DNA, 20 bp, Artificial Sequence
  chemically synthesized
catgagaattgcttgaaccc

SEQ ID NO: 164996 - DNA, 20 bp, Artificial Sequence
  chemically synthesized
gcatgagaattgcttgaacc

SEQ ID NO: 164997 - DNA, 20 bp, Artificial Sequence
  chemically synthesized
ttcaagcaattctcatgcct

SEQ ID NO: 164998 - DNA, 20 bp, Artificial Sequence
  chemically synthesized
tacctgggaggctgaggcat

SEQ ID NO: 164999 - DNA, 20 bp, Artificial Sequence
  chemically synthesized
cccagctacctgggaggctg

SEQ ID NO: 165000 - DNA, 20 bp, Artificial Sequence
  chemically synthesized
attctcatgcctcagcctcc

SEQ ID NO: 165001 - DNA, 20 bp, Artificial Sequence
  chemically synthesized
tcccagctacctgggaggct

SEQ ID NO: 165002 - DNA, 20 bp, Artificial Sequence
  chemically synthesized
ttctcatgcctcagcctccc

SEQ ID NO: 165003 - DNA, 20 bp, Artificial Sequence
  chemically synthesized
tcatgcctcagcctcccagg

SEQ ID NO: 165004 - DNA, 20 bp, Artificial Sequence
  chemically synthesized
tgtagtcccagctacctggg

SEQ ID NO: 165005 - DNA, 20 bp, Artificial Sequence
  chemically synthesized
ctgtagtcccagctacctgg

SEQ ID NO: 165006 - DNA, 20 bp, Artificial Sequence
  chemically synthesized
gcctcagcctcccaggtagc

SEQ ID NO: 165007 - DNA, 20 bp, Artificial Sequence
  chemically synthesized
acctgtagtcccagctacct

SEQ ID NO: 165008 - DNA, 20 bp, Artificial Sequence
  chemically synthesized
cctcagcctcccaggtagct

SEQ ID NO: 165009 - DNA, 20 bp, Artificial Sequence
  chemically synthesized
cacctgtagtcccagctacc

SEQ ID NO: 165010 - DNA, 20 bp, Artificial Sequence
  chemically synthesized
ctcccaggtagctgggacta

SEQ ID NO: 165011 - DNA, 20 bp, Artificial Sequence
  chemically synthesized
tcccaggtagctgggactac

SEQ ID NO: 165012 - DNA, 20 bp, Artificial Sequence
  chemically synthesized
gtggcacgcacctgtagtcc

SEQ ID NO: 165013 - DNA, 20 bp, Artificial Sequence
  chemically synthesized
ggcatggtggcacgcacctg

SEQ ID NO: 165014 - DNA, 20 bp, Artificial Sequence
  chemically synthesized
caggtgcgtgccaccatgcc

SEQ ID NO: 165015 - DNA, 20 bp, Artificial Sequence
  chemically synthesized
aaaaaattagccaggcatgg

SEQ ID NO: 165016 - DNA, 20 bp, Artificial Sequence
  chemically synthesized
tagaaaaaattagccaggca

SEQ ID NO: 165017 - DNA, 20 bp, Artificial Sequence
  chemically synthesized
aaaaatagaaaaaattagcc

SEQ ID NO: 165018 - DNA, 20 bp, Artificial Sequence
  chemically synthesized
taaaaatagaaaaaattagc

SEQ ID NO: 165019 - DNA, 20 bp, Artificial Sequence
  chemically synthesized
ctactaaaaatagaaaaaat

SEQ ID NO: 165020 - DNA, 20 bp, Artificial Sequence
  chemically synthesized
tggctaattttttctatttt

SEQ ID NO: 165021 - DNA, 20 bp, Artificial Sequence
  chemically synthesized
ctaattttttctatttttag

SEQ ID NO: 165022 - DNA, 20 bp, Artificial Sequence
  chemically synthesized
aaccccatctctactaaaaa

SEQ ID NO: 165023 - DNA, 20 bp, Artificial Sequence
  chemically synthesized
aattttttctatttttagta

SEQ ID NO: 165024 - DNA, 20 bp, Artificial Sequence
  chemically synthesized
ttttctatttttagtagaga

SEQ ID NO: 165025 - DNA, 20 bp, Artificial Sequence
  chemically synthesized
tttctatttttagtagagat

SEQ ID NO: 165026 - DNA, 20 bp, Artificial Sequence
  chemically synthesized
ttctatttttagtagagatg

SEQ ID NO: 165027 - DNA, 20 bp, Artificial Sequence
  chemically synthesized
tggggttttgctatattgcc

SEQ ID NO: 165028 - DNA, 20 bp, Artificial Sequence
  chemically synthesized
tgagatcagcctgggcaata

SEQ ID NO: 165029 - DNA, 20 bp, Artificial Sequence
  chemically synthesized
ggggttttgctatattgccc

SEQ ID NO: 165030 - DNA, 20 bp, Artificial Sequence
  chemically synthesized
tgggagtttgagatcagcct

SEQ ID NO: 165031 - DNA, 20 bp, Artificial Sequence
  chemically synthesized
ttgggagtttgagatcagcc

SEQ ID NO: 165032 - DNA, 20 bp, Artificial Sequence
  chemically synthesized
tgagcttgggagtttgagat

SEQ ID NO: 165033 - DNA, 20 bp, Artificial Sequence
  chemically synthesized
ttgcctgagcttgggagttt

SEQ ID NO: 165034 - DNA, 20 bp, Artificial Sequence
  chemically synthesized
caggctgatctcaaactccc

SEQ ID NO: 165035 - DNA, 20 bp, Artificial Sequence
  chemically synthesized
tgatctcaaactcccaagct

SEQ ID NO: 165036 - DNA, 20 bp, Artificial Sequence
  chemically synthesized
ggtggattgcctgagcttgg

SEQ ID NO: 165037 - DNA, 20 bp, Artificial Sequence
  chemically synthesized
gatctcaaactcccaagctc

SEQ ID NO: 165038 - DNA, 20 bp, Artificial Sequence
  chemically synthesized
caggtggattgcctgagctt

SEQ ID NO: 165039 - DNA, 20 bp, Artificial Sequence
  chemically synthesized
gcaggtggattgcctgagct

SEQ ID NO: 165040 - DNA, 20 bp, Artificial Sequence
  chemically synthesized
ccaaagcaggtggattgcct

SEQ ID NO: 165041 - DNA, 20 bp, Artificial Sequence
  chemically synthesized
ctcaggcaatccacctgctt

SEQ ID NO: 165042 - DNA, 20 bp, Artificial Sequence
  chemically synthesized
ctttgggaggccaaagcagg

SEQ ID NO: 165043 - DNA, 20 bp, Artificial Sequence
  chemically synthesized
ggactttgggaggccaaagc

SEQ ID NO: 165044 - DNA, 20 bp, Artificial Sequence
  chemically synthesized
aggactttgggaggccaaag

SEQ ID NO: 165045 - DNA, 20 bp, Artificial Sequence
  chemically synthesized
cctaggactttgggaggcca

SEQ ID NO: 165046 - DNA, 20 bp, Artificial Sequence
  chemically synthesized
ccacctgctttggcctccca

SEQ ID NO: 165047 - DNA, 20 bp, Artificial Sequence
  chemically synthesized
tgtaaccctaggactttggg

SEQ ID NO: 165048 - DNA, 20 bp, Artificial Sequence
  chemically synthesized
ctgtaaccctaggactttgg

SEQ ID NO: 165049 - DNA, 20 bp, Artificial Sequence
  chemically synthesized
gctttggcctcccaaagtcc

SEQ ID NO: 165050 - DNA, 20 bp, Artificial Sequence
  chemically synthesized
gtctgtaaccctaggacttt

SEQ ID NO: 165051 - DNA, 20 bp, Artificial Sequence
  chemically synthesized
ctttggcctcccaaagtcct

SEQ ID NO: 165052 - DNA, 20 bp, Artificial Sequence
  chemically synthesized
cgtctgtaaccctaggactt

SEQ ID NO: 165053 - DNA, 20 bp, Artificial Sequence
  chemically synthesized
tttggcctcccaaagtccta

SEQ ID NO: 165054 - DNA, 20 bp, Artificial Sequence
  chemically synthesized
ctcccaaagtcctagggtta

SEQ ID NO: 165055 - DNA, 20 bp, Artificial Sequence
  chemically synthesized
tagctcacgtctgtaaccct

SEQ ID NO: 165056 - DNA, 20 bp, Artificial Sequence
  chemically synthesized
gtagctcacgtctgtaaccc

SEQ ID NO: 165057 - DNA, 20 bp, Artificial Sequence
  chemically synthesized
agtcctagggttacagacgt

SEQ ID NO: 165058 - DNA, 20 bp, Artificial Sequence
  chemically synthesized
cagacgtgagctaccatgcc

SEQ ID NO: 165059 - DNA, 20 bp, Artificial Sequence
  chemically synthesized
aggctttcagccaggcatgg

SEQ ID NO: 165060 - DNA, 20 bp, Artificial Sequence
  chemically synthesized
attaggctttcagccaggca

SEQ ID NO: 165061 - DNA, 20 bp, Artificial Sequence
  chemically synthesized
gagctaccatgcctggctga

SEQ ID NO: 165062 - DNA, 20 bp, Artificial Sequence
  chemically synthesized
taaaaattaggctttcagcc

SEQ ID NO: 165063 - DNA, 20 bp, Artificial Sequence
  chemically synthesized
ataaaaattaggctttcagc

SEQ ID NO: 165064 - DNA, 20 bp, Artificial Sequence
  chemically synthesized
aacaataaaaattaggcttt

SEQ ID NO: 165065 - DNA, 20 bp, Artificial Sequence
  chemically synthesized
aggtactaacaataaaaatt

SEQ ID NO: 165066 - DNA, 20 bp, Artificial Sequence
  chemically synthesized
gaggtactaacaataaaaat

SEQ ID NO: 165067 - DNA, 20 bp, Artificial Sequence
  chemically synthesized
gaaagcctaatttttattgt

SEQ ID NO: 165068 - DNA, 20 bp, Artificial Sequence
  chemically synthesized
gtatcaggagttatggtaag

SEQ ID NO: 165069 - DNA, 20 bp, Artificial Sequence
  chemically synthesized
tgtatcaggagttatggtaa

SEQ ID NO: 165070 - DNA, 20 bp, Artificial Sequence
  chemically synthesized
gttgtatcaggagttatggt

SEQ ID NO: 165071 - DNA, 20 bp, Artificial Sequence
  chemically synthesized
tcttgttgtatcaggagtta

SEQ ID NO: 165072 - DNA, 20 bp, Artificial Sequence
  chemically synthesized
gacctttcttgttgtatcag

SEQ ID NO: 165073 - DNA, 20 bp, Artificial Sequence
  chemically synthesized
gggacctttcttgttgtatc

SEQ ID NO: 165074 - DNA, 20 bp, Artificial Sequence
  chemically synthesized
accataactcctgatacaac

SEQ ID NO: 165075 - DNA, 20 bp, Artificial Sequence
  chemically synthesized
tgggacctttcttgttgtat

SEQ ID NO: 165076 - DNA, 20 bp, Artificial Sequence
  chemically synthesized
taactcctgatacaacaaga

SEQ ID NO: 165077 - DNA, 20 bp, Artificial Sequence
  chemically synthesized
aactcctgatacaacaagaa

SEQ ID NO: 165078 - DNA, 20 bp, Artificial Sequence
  chemically synthesized
cgtagaaaaagacagtgaat

SEQ ID NO: 165079 - DNA, 20 bp, Artificial Sequence
  chemically synthesized
gcgtagaaaaagacagtgaa

SEQ ID NO: 165080 - DNA, 20 bp, Artificial Sequence
  chemically synthesized
tcctaaggcgtagaaaaaga

SEQ ID NO: 165081 - DNA, 20 bp, Artificial Sequence
  chemically synthesized
catttcctaaggcgtagaaa

SEQ ID NO: 165082 - DNA, 20 bp, Artificial Sequence
  chemically synthesized
cactgtctttttctacgcct

SEQ ID NO: 165083 - DNA, 20 bp, Artificial Sequence
  chemically synthesized
actgtctttttctacgcctt

SEQ ID NO: 165084 - DNA, 20 bp, Artificial Sequence
  chemically synthesized
ggaacacatttcctaaggcg

SEQ ID NO: 165085 - DNA, 20 bp, Artificial Sequence
  chemically synthesized
agatgggaacacatttccta

SEQ ID NO: 165086 - DNA, 20 bp, Artificial Sequence
  chemically synthesized
aagatgggaacacatttcct

SEQ ID NO: 165087 - DNA, 20 bp, Artificial Sequence
  chemically synthesized
taggaaatgtgttcccatct

SEQ ID NO: 165088 - DNA, 20 bp, Artificial Sequence
  chemically synthesized
agataaggcaaaactaagat

SEQ ID NO: 165089 - DNA, 20 bp, Artificial Sequence
  chemically synthesized
tagataaggcaaaactaaga

SEQ ID NO: 165090 - DNA, 20 bp, Artificial Sequence
  chemically synthesized
ctgttagataaggcaaaact

SEQ ID NO: 165091 - DNA, 20 bp, Artificial Sequence
  chemically synthesized
cttagttttgccttatctaa

SEQ ID NO: 165092 - DNA, 20 bp, Artificial Sequence
  chemically synthesized
ccctgggactctgttagata

SEQ ID NO: 165093 - DNA, 20 bp, Artificial Sequence
  chemically synthesized
tccctgggactctgttagat

SEQ ID NO: 165094 - DNA, 20 bp, Artificial Sequence
  chemically synthesized
tagttttgccttatctaaca

SEQ ID NO: 165095 - DNA, 20 bp, Artificial Sequence
  chemically synthesized
gaatttccctgggactctgt

SEQ ID NO: 165096 - DNA, 20 bp, Artificial Sequence
  chemically synthesized
tgccttatctaacagagtcc

SEQ ID NO: 165097 - DNA, 20 bp, Artificial Sequence
  chemically synthesized
gccttatctaacagagtccc

SEQ ID NO: 165098 - DNA, 20 bp, Artificial Sequence
  chemically synthesized
ccttatctaacagagtccca

SEQ ID NO: 165099 - DNA, 20 bp, Artificial Sequence
  chemically synthesized
aaaattgagtgaatttccct

SEQ ID NO: 165100 - DNA, 20 bp, Artificial Sequence
  chemically synthesized
aaaaattgagtgaatttccc

SEQ ID NO: 165101 - DNA, 20 bp, Artificial Sequence
  chemically synthesized
ttcactaaaaatgaaaaatt

SEQ ID NO: 165102 - DNA, 20 bp, Artificial Sequence
  chemically synthesized
ttcactcaatttttcatttt

SEQ ID NO: 165103 - DNA, 20 bp, Artificial Sequence
  chemically synthesized
tcaatttttcatttttagtg

SEQ ID NO: 165104 - DNA, 20 bp, Artificial Sequence
  chemically synthesized
atttttcatttttagtgaag

SEQ ID NO: 165105 - DNA, 20 bp, Artificial Sequence
  chemically synthesized
tttcatttttagtgaagaag

SEQ ID NO: 165106 - DNA, 20 bp, Artificial Sequence
  chemically synthesized
ttcatttttagtgaagaaga

SEQ ID NO: 165107 - DNA, 20 bp, Artificial Sequence
  chemically synthesized
tttttagtgaagaagaaggt

SEQ ID NO: 165108 - DNA, 20 bp, Artificial Sequence
  chemically synthesized
ttttagtgaagaagaaggtc

SEQ ID NO: 165109 - DNA, 20 bp, Artificial Sequence
  chemically synthesized
aagaagaaggtcaggttaaa

SEQ ID NO: 165110 - DNA, 20 bp, Artificial Sequence
  chemically synthesized
agaagaaggtcaggttaaaa

SEQ ID NO: 165111 - DNA, 20 bp, Artificial Sequence
  chemically synthesized
gaagaaggtcaggttaaaaa

SEQ ID NO: 165112 - DNA, 20 bp, Artificial Sequence
  chemically synthesized
aaggtcaggttaaaaagggt

SEQ ID NO: 165113 - DNA, 20 bp, Artificial Sequence
  chemically synthesized
tcaggttaaaaagggtaagt

SEQ ID NO: 165114 - DNA, 20 bp, Artificial Sequence
  chemically synthesized
gtgagttaaacaatatcgta

SEQ ID NO: 165115 - DNA, 20 bp, Artificial Sequence
  chemically synthesized
gttaaacaatatcgtaaagc

SEQ ID NO: 165116 - DNA, 20 bp, Artificial Sequence
  chemically synthesized
aacaatatcgtaaagccagt

SEQ ID NO: 165117 - DNA, 20 bp, Artificial Sequence
  chemically synthesized
atcccagtgctgacacttac

SEQ ID NO: 165118 - DNA, 20 bp, Artificial Sequence
  chemically synthesized
atcgtaaagccagtaagtgt

SEQ ID NO: 165119 - DNA, 20 bp, Artificial Sequence
  chemically synthesized
aagccagtaagtgtcagcac

SEQ ID NO: 165120 - DNA, 20 bp, Artificial Sequence
  chemically synthesized
agccagtaagtgtcagcact

SEQ ID NO: 165121 - DNA, 20 bp, Artificial Sequence
  chemically synthesized
aaaagactaagtttgaatcc

SEQ ID NO: 165122 - DNA, 20 bp, Artificial Sequence
  chemically synthesized
tcagcactgggattcaaact

SEQ ID NO: 165123 - DNA, 20 bp, Artificial Sequence
  chemically synthesized
ggggaaagaaacaaaagact

SEQ ID NO: 165124 - DNA, 20 bp, Artificial Sequence
  chemically synthesized
taataaggggaaagaaacaa

SEQ ID NO: 165125 - DNA, 20 bp, Artificial Sequence
  chemically synthesized
gaagtagaataataagggga

SEQ ID NO: 165126 - DNA, 20 bp, Artificial Sequence
  chemically synthesized
agttgaagtagaataataag

SEQ ID NO: 165127 - DNA, 20 bp, Artificial Sequence
  chemically synthesized
gagttgaagtagaataataa

SEQ ID NO: 165128 - DNA, 20 bp, Artificial Sequence
  chemically synthesized
tgagttgaagtagaataata

SEQ ID NO: 165129 - DNA, 20 bp, Artificial Sequence
  chemically synthesized
ctgagttgaagtagaataat

SEQ ID NO: 165130 - DNA, 20 bp, Artificial Sequence
  chemically synthesized
aaaccattgctgagttgaag

SEQ ID NO: 165131 - DNA, 20 bp, Artificial Sequence
  chemically synthesized
cttattattctacttcaact

SEQ ID NO: 165132 - DNA, 20 bp, Artificial Sequence
  chemically synthesized
caaaaaccattgctgagttg

SEQ ID NO: 165133 - DNA, 20 bp, Artificial Sequence
  chemically synthesized
attctacttcaactcagcaa

SEQ ID NO: 165134 - DNA, 20 bp, Artificial Sequence
  chemically synthesized
caactccaaaaaccattgct

SEQ ID NO: 165135 - DNA, 20 bp, Artificial Sequence
  chemically synthesized
ttcaactcagcaatggtttt

SEQ ID NO: 165136 - DNA, 20 bp, Artificial Sequence
  chemically synthesized
caactcagcaatggtttttg

SEQ ID NO: 165137 - DNA, 20 bp, Artificial Sequence
  chemically synthesized
cagcaatggtttttggagtt

SEQ ID NO: 165138 - DNA, 20 bp, Artificial Sequence
  chemically synthesized
caatggtttttggagttgag

SEQ ID NO: 165139 - DNA, 20 bp, Artificial Sequence
  chemically synthesized
agttgagtagaaaaaacaaa

SEQ ID NO: 165140 - DNA, 20 bp, Artificial Sequence
  chemically synthesized
gagtagaaaaaacaaaaagt

SEQ ID NO: 165141 - DNA, 20 bp, Artificial Sequence
  chemically synthesized
gtagaaaaaacaaaaagtaa

SEQ ID NO: 165142 - DNA, 20 bp, Artificial Sequence
  chemically synthesized
tagaaaaaacaaaaagtaag

SEQ ID NO: 165143 - DNA, 20 bp, Artificial Sequence
  chemically synthesized
aaaaaacaaaaagtaagagg

SEQ ID NO: 165144 - DNA, 20 bp, Artificial Sequence
  chemically synthesized
aaaaagtaagaggaagatta

SEQ ID NO: 165145 - DNA, 20 bp, Artificial Sequence
  chemically synthesized
aagaggaagattatggtacc

SEQ ID NO: 165146 - DNA, 20 bp, Artificial Sequence
  chemically synthesized
tgcttctctttatgaacact

SEQ ID NO: 165147 - DNA, 20 bp, Artificial Sequence
  chemically synthesized
ctgcttctctttatgaacac

SEQ ID NO: 165148 - DNA, 20 bp, Artificial Sequence
  chemically synthesized
tatggtacccagtgttcata

SEQ ID NO: 165149 - DNA, 20 bp, Artificial Sequence
  chemically synthesized
tggtacccagtgttcataaa

SEQ ID NO: 165150 - DNA, 20 bp, Artificial Sequence
  chemically synthesized
tacccagtgttcataaagag

SEQ ID NO: 165151 - DNA, 20 bp, Artificial Sequence
  chemically synthesized
ccagtgttcataaagagaag

SEQ ID NO: 165152 - DNA, 20 bp, Artificial Sequence
  chemically synthesized
tttcatctattagtggaatt

SEQ ID NO: 165153 - DNA, 20 bp, Artificial Sequence
  chemically synthesized
gtttcatctattagtggaat

SEQ ID NO: 165154 - DNA, 20 bp, Artificial Sequence
  chemically synthesized
cagatgcctaattccactaa

SEQ ID NO: 165155 - DNA, 20 bp, Artificial Sequence
  chemically synthesized
tggatagtttcatctattag

SEQ ID NO: 165156 - DNA, 20 bp, Artificial Sequence
  chemically synthesized
ttgtggatagtttcatctat

SEQ ID NO: 165157 - DNA, 20 bp, Artificial Sequence
  chemically synthesized
tgtttgtttaagtttgtgga

SEQ ID NO: 165158 - DNA, 20 bp, Artificial Sequence
  chemically synthesized
agcgtgtttgtttaagtttg

SEQ ID NO: 165159 - DNA, 20 bp, Artificial Sequence
  chemically synthesized
accttgaagcgtgtttgttt

SEQ ID NO: 165160 - DNA, 20 bp, Artificial Sequence
  chemically synthesized
aacttaaacaaacacgcttc

SEQ ID NO: 165161 - DNA, 20 bp, Artificial Sequence
  chemically synthesized
acttaaacaaacacgcttca

SEQ ID NO: 165162 - DNA, 20 bp, Artificial Sequence
  chemically synthesized
tctggcttgataacaccttg

SEQ ID NO: 165163 - DNA, 20 bp, Artificial Sequence
  chemically synthesized
acacgcttcaaggtgttatc

SEQ ID NO: 165164 - DNA, 20 bp, Artificial Sequence
  chemically synthesized
gcttcaaggtgttatcaagc

SEQ ID NO: 165165 - DNA, 20 bp, Artificial Sequence
  chemically synthesized
tctgggcaagagtataattc

SEQ ID NO: 165166 - DNA, 20 bp, Artificial Sequence
  chemically synthesized
gccagaattatactcttgcc

SEQ ID NO: 165167 - DNA, 20 bp, Artificial Sequence
  chemically synthesized
cagaattatactcttgccca

SEQ ID NO: 165168 - DNA, 20 bp, Artificial Sequence
  chemically synthesized
tttaggttgcctctgggcaa

SEQ ID NO: 165169 - DNA, 20 bp, Artificial Sequence
  chemically synthesized
agaattatactcttgcccag

SEQ ID NO: 165170 - DNA, 20 bp, Artificial Sequence
  chemically synthesized
agtttaggttgcctctgggc

SEQ ID NO: 165171 - DNA, 20 bp, Artificial Sequence
  chemically synthesized
cctgagtttaggttgcctct

SEQ ID NO: 165172 - DNA, 20 bp, Artificial Sequence
  chemically synthesized
tcctgagtttaggttgcctc

SEQ ID NO: 165173 - DNA, 20 bp, Artificial Sequence
  chemically synthesized
gcccagaggcaacctaaact

SEQ ID NO: 165174 - DNA, 20 bp, Artificial Sequence
  chemically synthesized
cccagaggcaacctaaactc

SEQ ID NO: 165175 - DNA, 20 bp, Artificial Sequence
  chemically synthesized
aatgtttttctcctgagttt

SEQ ID NO: 165176 - DNA, 20 bp, Artificial Sequence
  chemically synthesized
cagaggcaacctaaactcag

SEQ ID NO: 165177 - DNA, 20 bp, Artificial Sequence
  chemically synthesized
gaatgtttttctcctgagtt

SEQ ID NO: 165178 - DNA, 20 bp, Artificial Sequence
  chemically synthesized
ttattgaatgtttttctcct

SEQ ID NO: 165179 - DNA, 20 bp, Artificial Sequence
  chemically synthesized
acattcaataaatctgtgtt

SEQ ID NO: 165180 - DNA, 20 bp, Artificial Sequence
  chemically synthesized
ttttaccatgcaactgaaca

SEQ ID NO: 165181 - DNA, 20 bp, Artificial Sequence
  chemically synthesized
taaatctgtgttcagttgca

SEQ ID NO: 165182 - DNA, 20 bp, Artificial Sequence
  chemically synthesized
tgtgttcagttgcatggtaa

SEQ ID NO: 165183 - DNA, 20 bp, Artificial Sequence
  chemically synthesized
gtgttcagttgcatggtaaa

SEQ ID NO: 165184 - DNA, 20 bp, Artificial Sequence
  chemically synthesized
tgttcagttgcatggtaaaa

SEQ ID NO: 165185 - DNA, 20 bp, Artificial Sequence
  chemically synthesized
gaataatttgtctttttgtc

SEQ ID NO: 165186 - DNA, 20 bp, Artificial Sequence
  chemically synthesized
gatgacagttactggacaaa

SEQ ID NO: 165187 - DNA, 20 bp, Artificial Sequence
  chemically synthesized
aaacactggatgacagttac

SEQ ID NO: 165188 - DNA, 20 bp, Artificial Sequence
  chemically synthesized
tttgtccagtaactgtcatc

SEQ ID NO: 165189 - DNA, 20 bp, Artificial Sequence
  chemically synthesized
tcctgaaaaacactggatga

SEQ ID NO: 165190 - DNA, 20 bp, Artificial Sequence
  chemically synthesized
gaatgtgtcctgaaaaacac

SEQ ID NO: 165191 - DNA, 20 bp, Artificial Sequence
  chemically synthesized
aactgtcatccagtgttttt

SEQ ID NO: 165192 - DNA, 20 bp, Artificial Sequence
  chemically synthesized
actgtcatccagtgtttttc

SEQ ID NO: 165193 - DNA, 20 bp, Artificial Sequence
  chemically synthesized
attggatatgaaaatatcag

SEQ ID NO: 165194 - DNA, 20 bp, Artificial Sequence
  chemically synthesized
tatattggatatgaaaatat

SEQ ID NO: 165195 - DNA, 20 bp, Artificial Sequence
  chemically synthesized
aaagtttcagtgttttatat

SEQ ID NO: 165196 - DNA, 20 bp, Artificial Sequence
  chemically synthesized
agacctttagaaaaaagttt

SEQ ID NO: 165197 - DNA, 20 bp, Artificial Sequence
  chemically synthesized
aacactgaaacttttttcta

SEQ ID NO: 165198 - DNA, 20 bp, Artificial Sequence
  chemically synthesized
aggaagagacctttagaaaa

SEQ ID NO: 165199 - DNA, 20 bp, Artificial Sequence
  chemically synthesized
acactgaaacttttttctaa

SEQ ID NO: 165200 - DNA, 20 bp, Artificial Sequence
  chemically synthesized
aggaacaaggaagagacctt

SEQ ID NO: 165201 - DNA, 20 bp, Artificial Sequence
  chemically synthesized
gggaggtaaggaacaaggaa

SEQ ID NO: 165202 - DNA, 20 bp, Artificial Sequence
  chemically synthesized
tcgggaggtaaggaacaagg

SEQ ID NO: 165203 - DNA, 20 bp, Artificial Sequence
  chemically synthesized
tgttcgggaggtaaggaaca

SEQ ID NO: 165204 - DNA, 20 bp, Artificial Sequence
  chemically synthesized
gtgttcgggaggtaaggaac

SEQ ID NO: 165205 - DNA, 20 bp, Artificial Sequence
  chemically synthesized
aaagtggtgttcgggaggta

SEQ ID NO: 165206 - DNA, 20 bp, Artificial Sequence
  chemically synthesized
aaaagtggtgttcgggaggt

SEQ ID NO: 165207 - DNA, 20 bp, Artificial Sequence
  chemically synthesized
ttttaaaagtggtgttcggg

SEQ ID NO: 165208 - DNA, 20 bp, Artificial Sequence
  chemically synthesized
tttttaaaagtggtgttcgg

SEQ ID NO: 165209 - DNA, 20 bp, Artificial Sequence
  chemically synthesized
attttttaaaagtggtgttc

SEQ ID NO: 165210 - DNA, 20 bp, Artificial Sequence
  chemically synthesized
aattttttaaaagtggtgtt

SEQ ID NO: 165211 - DNA, 20 bp, Artificial Sequence
  chemically synthesized
taaaaaaaattttttaaaag

SEQ ID NO: 165212 - DNA, 20 bp, Artificial Sequence
  chemically synthesized
ttttaaaaaaaattttttaa

SEQ ID NO: 165213 - DNA, 20 bp, Artificial Sequence
  chemically synthesized
attttttttaaaaatgaaat

SEQ ID NO: 165214 - DNA, 20 bp, Artificial Sequence
  chemically synthesized
ttaaaaatgaaatcagataa

SEQ ID NO: 165215 - DNA, 20 bp, Artificial Sequence
  chemically synthesized
taaaaatgaaatcagataac

SEQ ID NO: 165216 - DNA, 20 bp, Artificial Sequence
  chemically synthesized
atcagataacaggtgaactt

SEQ ID NO: 165217 - DNA, 20 bp, Artificial Sequence
  chemically synthesized
gataacaggtgaacttgagc

SEQ ID NO: 165218 - DNA, 20 bp, Artificial Sequence
  chemically synthesized
agatagatgtgtactagctc

SEQ ID NO: 165219 - DNA, 20 bp, Artificial Sequence
  chemically synthesized
tcccttagatagatgtgtac

SEQ ID NO: 165220 - DNA, 20 bp, Artificial Sequence
  chemically synthesized
gagctagtacacatctatct

SEQ ID NO: 165221 - DNA, 20 bp, Artificial Sequence
  chemically synthesized
agctagtacacatctatcta

SEQ ID NO: 165222 - DNA, 20 bp, Artificial Sequence
  chemically synthesized
gctagtacacatctatctaa

SEQ ID NO: 165223 - DNA, 20 bp, Artificial Sequence
  chemically synthesized
tagtacacatctatctaagg

SEQ ID NO: 165224 - DNA, 20 bp, Artificial Sequence
  chemically synthesized
caaatagtaactcccttaga

SEQ ID NO: 165225 - DNA, 20 bp, Artificial Sequence
  chemically synthesized
aattcaaatagtaactccct

SEQ ID NO: 165226 - DNA, 20 bp, Artificial Sequence
  chemically synthesized
atggataattcaaattcaaa

SEQ ID NO: 165227 - DNA, 20 bp, Artificial Sequence
  chemically synthesized
aatttgaattatccattcta

SEQ ID NO: 165228 - DNA, 20 bp, Artificial Sequence
  chemically synthesized
tcattaaattcactttagaa

SEQ ID NO: 165229 - DNA, 20 bp, Artificial Sequence
  chemically synthesized
taatgtcattaaattcactt

SEQ ID NO: 165230 - DNA, 20 bp, Artificial Sequence
  chemically synthesized
taatgacattaacctctgca

SEQ ID NO: 165231 - DNA, 20 bp, Artificial Sequence
  chemically synthesized
tcacaaaattagctttgcag

SEQ ID NO: 165232 - DNA, 20 bp, Artificial Sequence
  chemically synthesized
ttcacaaaattagctttgca

SEQ ID NO: 165233 - DNA, 20 bp, Artificial Sequence
  chemically synthesized
cattcacaaaattagctttg

SEQ ID NO: 165234 - DNA, 20 bp, Artificial Sequence
  chemically synthesized
gtactcaacattcacaaaat

SEQ ID NO: 165235 - DNA, 20 bp, Artificial Sequence
  chemically synthesized
aagctaattttgtgaatgtt

SEQ ID NO: 165236 - DNA, 20 bp, Artificial Sequence
  chemically synthesized
attcccaattaatcagtcag

SEQ ID NO: 165237 - DNA, 20 bp, Artificial Sequence
  chemically synthesized
ggattcccaattaatcagtc

SEQ ID NO: 165238 - DNA, 20 bp, Artificial Sequence
  chemically synthesized
tggattcccaattaatcagt

SEQ ID NO: 165239 - DNA, 20 bp, Artificial Sequence
  chemically synthesized
tacactcctgactgattaat

SEQ ID NO: 165240 - DNA, 20 bp, Artificial Sequence
  chemically synthesized
acactcctgactgattaatt

SEQ ID NO: 165241 - DNA, 20 bp, Artificial Sequence
  chemically synthesized
ccaatggattcccaattaat

SEQ ID NO: 165242 - DNA, 20 bp, Artificial Sequence
  chemically synthesized
ctgattaattgggaatccat

SEQ ID NO: 165243 - DNA, 20 bp, Artificial Sequence
  chemically synthesized
ttaattgggaatccattggt

SEQ ID NO: 165244 - DNA, 20 bp, Artificial Sequence
  chemically synthesized
taaggagtcagacttaccaa

SEQ ID NO: 165245 - DNA, 20 bp, Artificial Sequence
  chemically synthesized
cgctttcgtgggtaaggagt

SEQ ID NO: 165246 - DNA, 20 bp, Artificial Sequence
  chemically synthesized
tccacgctttcgtgggtaag

SEQ ID NO: 165247 - DNA, 20 bp, Artificial Sequence
  chemically synthesized
cttccacgctttcgtgggta

SEQ ID NO: 165248 - DNA, 20 bp, Artificial Sequence
  chemically synthesized
gcttccacgctttcgtgggt

SEQ ID NO: 165249 - DNA, 20 bp, Artificial Sequence
  chemically synthesized
gtctgactccttacccacga

SEQ ID NO: 165250 - DNA, 20 bp, Artificial Sequence
  chemically synthesized
ccatgcttccacgctttcgt

SEQ ID NO: 165251 - DNA, 20 bp, Artificial Sequence
  chemically synthesized
accatgcttccacgctttcg

SEQ ID NO: 165252 - DNA, 20 bp, Artificial Sequence
  chemically synthesized
actccttacccacgaaagcg

SEQ ID NO: 165253 - DNA, 20 bp, Artificial Sequence
  chemically synthesized
ccttacccacgaaagcgtgg

SEQ ID NO: 165254 - DNA, 20 bp, Artificial Sequence
  chemically synthesized
cccacgaaagcgtggaagca

SEQ ID NO: 165255 - DNA, 20 bp, Artificial Sequence
  chemically synthesized
gcgtggaagcatggtaacat

SEQ ID NO: 165256 - DNA, 20 bp, Artificial Sequence
  chemically synthesized
taacatcagattttgattct

SEQ ID NO: 165257 - DNA, 20 bp, Artificial Sequence
  chemically synthesized
aagaatatactcagattact

SEQ ID NO: 165258 - DNA, 20 bp, Artificial Sequence
  chemically synthesized
attttgattctcagtaatct

SEQ ID NO: 165259 - DNA, 20 bp, Artificial Sequence
  chemically synthesized
tctagactcaagaatatact

SEQ ID NO: 165260 - DNA, 20 bp, Artificial Sequence
  chemically synthesized
agtaatctgagtatattctt

SEQ ID NO: 165261 - DNA, 20 bp, Artificial Sequence
  chemically synthesized
tctgagtatattcttgagtc

SEQ ID NO: 165262 - DNA, 20 bp, Artificial Sequence
  chemically synthesized
tgagtatattcttgagtcta

SEQ ID NO: 165263 - DNA, 20 bp, Artificial Sequence
  chemically synthesized
aagcctgggactctagactc

SEQ ID NO: 165264 - DNA, 20 bp, Artificial Sequence
  chemically synthesized
tattcttgagtctagagtcc

SEQ ID NO: 165265 - DNA, 20 bp, Artificial Sequence
  chemically synthesized
attcttgagtctagagtccc

SEQ ID NO: 165266 - DNA, 20 bp, Artificial Sequence
  chemically synthesized
aacaaagaagcctgggactc

SEQ ID NO: 165267 - DNA, 20 bp, Artificial Sequence
  chemically synthesized
cttttcaaacaaagaagcct

SEQ ID NO: 165268 - DNA, 20 bp, Artificial Sequence
  chemically synthesized
gcttttcaaacaaagaagcc

SEQ ID NO: 165269 - DNA, 20 bp, Artificial Sequence
  chemically synthesized
atgatgcttttcaaacaaag

SEQ ID NO: 165270 - DNA, 20 bp, Artificial Sequence
  chemically synthesized
ccaatgatgcttttcaaaca

SEQ ID NO: 165271 - DNA, 20 bp, Artificial Sequence
  chemically synthesized
cccaggcttctttgtttgaa

SEQ ID NO: 165272 - DNA, 20 bp, Artificial Sequence
  chemically synthesized
ctttgtttgaaaagcatcat

SEQ ID NO: 165273 - DNA, 20 bp, Artificial Sequence
  chemically synthesized
tttgaaaagcatcattggtt

SEQ ID NO: 165274 - DNA, 20 bp, Artificial Sequence
  chemically synthesized
agcatcattggtttagaaca

SEQ ID NO: 165275 - DNA, 20 bp, Artificial Sequence
  chemically synthesized
gaaccaaatgagatttcaat

SEQ ID NO: 165276 - DNA, 20 bp, Artificial Sequence
  chemically synthesized
attcttattgaaatctcatt

SEQ ID NO: 165277 - DNA, 20 bp, Artificial Sequence
  chemically synthesized
aatctgaagttgaaccaaat

SEQ ID NO: 165278 - DNA, 20 bp, Artificial Sequence
  chemically synthesized
aatctcatttggttcaactt

SEQ ID NO: 165279 - DNA, 20 bp, Artificial Sequence
  chemically synthesized
ctctaaatactgaaaatctg

SEQ ID NO: 165280 - DNA, 20 bp, Artificial Sequence
  chemically synthesized
ttggttcaacttcagatttt

SEQ ID NO: 165281 - DNA, 20 bp, Artificial Sequence
  chemically synthesized
aacttcagattttcagtatt

SEQ ID NO: 165282 - DNA, 20 bp, Artificial Sequence
  chemically synthesized
cttcagattttcagtattta

SEQ ID NO: 165283 - DNA, 20 bp, Artificial Sequence
  chemically synthesized
tagagaaatcattttctgta

SEQ ID NO: 165284 - DNA, 20 bp, Artificial Sequence
  chemically synthesized
ctctacaaacgtgatctgta

SEQ ID NO: 165285 - DNA, 20 bp, Artificial Sequence
  chemically synthesized
ttctgtacagatcacgtttg

SEQ ID NO: 165286 - DNA, 20 bp, Artificial Sequence
  chemically synthesized
ctgtacagatcacgtttgta

SEQ ID NO: 165287 - DNA, 20 bp, Artificial Sequence
  chemically synthesized
aaaaaaaggaaacatgaatg

SEQ ID NO: 165288 - DNA, 20 bp, Artificial Sequence
  chemically synthesized
caaaaaaaggaaacatgaat

SEQ ID NO: 165289 - DNA, 20 bp, Artificial Sequence
  chemically synthesized
ggaacagcaacaacaaaaaa

SEQ ID NO: 165290 - DNA, 20 bp, Artificial Sequence
  chemically synthesized
aggaacagcaacaacaaaaa

SEQ ID NO: 165291 - DNA, 20 bp, Artificial Sequence
  chemically synthesized
ttttgttgttgctgttcctt

SEQ ID NO: 165292 - DNA, 20 bp, Artificial Sequence
  chemically synthesized
ggaaagaggcaccgaaggaa

SEQ ID NO: 165293 - DNA, 20 bp, Artificial Sequence
  chemically synthesized
ctggaggaaagaggcaccga

SEQ ID NO: 165294 - DNA, 20 bp, Artificial Sequence
  chemically synthesized
cctggaggaaagaggcaccg

SEQ ID NO: 165295 - DNA, 20 bp, Artificial Sequence
  chemically synthesized
gaatgtctcctggaggaaag

SEQ ID NO: 165296 - DNA, 20 bp, Artificial Sequence
  chemically synthesized
ccttcggtgcctctttcctc

SEQ ID NO: 165297 - DNA, 20 bp, Artificial Sequence
  chemically synthesized
agaatgtctcctggaggaaa

SEQ ID NO: 165298 - DNA, 20 bp, Artificial Sequence
  chemically synthesized
cttcggtgcctctttcctcc

SEQ ID NO: 165299 - DNA, 20 bp, Artificial Sequence
  chemically synthesized
tgagaatgtctcctggagga

SEQ ID NO: 165300 - DNA, 20 bp, Artificial Sequence
  chemically synthesized
tcggtgcctctttcctccag

SEQ ID NO: 165301 - DNA, 20 bp, Artificial Sequence
  chemically synthesized
atagtgagaatgtctcctgg

SEQ ID NO: 165302 - DNA, 20 bp, Artificial Sequence
  chemically synthesized
aatagtgagaatgtctcctg

SEQ ID NO: 165303 - DNA, 20 bp, Artificial Sequence
  chemically synthesized
agaatagtgagaatgtctcc

SEQ ID NO: 165304 - DNA, 20 bp, Artificial Sequence
  chemically synthesized
aggaggagaaacagaatagt

SEQ ID NO: 165305 - DNA, 20 bp, Artificial Sequence
  chemically synthesized
tcagaggaggagaaacagaa

SEQ ID NO: 165306 - DNA, 20 bp, Artificial Sequence
  chemically synthesized
agtcttcagaggaggagaaa

SEQ ID NO: 165307 - DNA, 20 bp, Artificial Sequence
  chemically synthesized
agcagtagtcttcagaggag

SEQ ID NO: 165308 - DNA, 20 bp, Artificial Sequence
  chemically synthesized
attctgtttctcctcctctg

SEQ ID NO: 165309 - DNA, 20 bp, Artificial Sequence
  chemically synthesized
tcagcagtagtcttcagagg

SEQ ID NO: 165310 - DNA, 20 bp, Artificial Sequence
  chemically synthesized
atcagcagtagtcttcagag

SEQ ID NO: 165311 - DNA, 20 bp, Artificial Sequence
  chemically synthesized
taatcagcagtagtcttcag

SEQ ID NO: 165312 - DNA, 20 bp, Artificial Sequence
  chemically synthesized
ctaatcagcagtagtcttca

SEQ ID NO: 165313 - DNA, 20 bp, Artificial Sequence
  chemically synthesized
atctaatcagcagtagtctt

SEQ ID NO: 165314 - DNA, 20 bp, Artificial Sequence
  chemically synthesized
gtgaagcatctaatcagcag

SEQ ID NO: 165315 - DNA, 20 bp, Artificial Sequence
  chemically synthesized
ctctgaagactactgctgat

SEQ ID NO: 165316 - DNA, 20 bp, Artificial Sequence
  chemically synthesized
gaggtgaagcatctaatcag

SEQ ID NO: 165317 - DNA, 20 bp, Artificial Sequence
  chemically synthesized
atagaggtgaagcatctaat

SEQ ID NO: 165318 - DNA, 20 bp, Artificial Sequence
  chemically synthesized
tagtttgtgccatagaggtg

SEQ ID NO: 165319 - DNA, 20 bp, Artificial Sequence
  chemically synthesized
gattagatgcttcacctcta

SEQ ID NO: 165320 - DNA, 20 bp, Artificial Sequence
  chemically synthesized
aagcctagtttgtgccatag

SEQ ID NO: 165321 - DNA, 20 bp, Artificial Sequence
  chemically synthesized
gaagcctagtttgtgccata

SEQ ID NO: 165322 - DNA, 20 bp, Artificial Sequence
  chemically synthesized
gagaagcctagtttgtgcca

SEQ ID NO: 165323 - DNA, 20 bp, Artificial Sequence
  chemically synthesized
ttcacctctatggcacaaac

SEQ ID NO: 165324 - DNA, 20 bp, Artificial Sequence
  chemically synthesized
tcacctctatggcacaaact

SEQ ID NO: 165325 - DNA, 20 bp, Artificial Sequence
  chemically synthesized
aactaacaagaagagaagcc

SEQ ID NO: 165326 - DNA, 20 bp, Artificial Sequence
  chemically synthesized
aatcaaactaacaagaagag

SEQ ID NO: 165327 - DNA, 20 bp, Artificial Sequence
  chemically synthesized
aactaggcttctcttcttgt

SEQ ID NO: 165328 - DNA, 20 bp, Artificial Sequence
  chemically synthesized
aaaaatcaaactaacaagaa

SEQ ID NO: 165329 - DNA, 20 bp, Artificial Sequence
  chemically synthesized
gtaaaaatcaaactaacaag

SEQ ID NO: 165330 - DNA, 20 bp, Artificial Sequence
  chemically synthesized
ttagtaaaaatcaaactaac

SEQ ID NO: 165331 - DNA, 20 bp, Artificial Sequence
  chemically synthesized
tgttagtttgatttttacta

SEQ ID NO: 165332 - DNA, 20 bp, Artificial Sequence
  chemically synthesized
aggccattgaagttcatctt

SEQ ID NO: 165333 - DNA, 20 bp, Artificial Sequence
  chemically synthesized
ttactaaagatgaacttcaa

SEQ ID NO: 165334 - DNA, 20 bp, Artificial Sequence
  chemically synthesized
gttttcggaagaggccattg

SEQ ID NO: 165335 - DNA, 20 bp, Artificial Sequence
  chemically synthesized
agtgcttatgttttcggaag

SEQ ID NO: 165336 - DNA, 20 bp, Artificial Sequence
  chemically synthesized
gagtgcttatgttttcggaa

SEQ ID NO: 165337 - DNA, 20 bp, Artificial Sequence
  chemically synthesized
gggagtgcttatgttttcgg

SEQ ID NO: 165338 - DNA, 20 bp, Artificial Sequence
  chemically synthesized
atggcctcttccgaaaacat

SEQ ID NO: 165339 - DNA, 20 bp, Artificial Sequence
  chemically synthesized
ttagggagtgcttatgtttt

SEQ ID NO: 165340 - DNA, 20 bp, Artificial Sequence
  chemically synthesized
cgaaaacataagcactccct

SEQ ID NO: 165341 - DNA, 20 bp, Artificial Sequence
  chemically synthesized
aacataagcactccctaagc

SEQ ID NO: 165342 - DNA, 20 bp, Artificial Sequence
  chemically synthesized
cttagatgagccagcttagg

SEQ ID NO: 165343 - DNA, 20 bp, Artificial Sequence
  chemically synthesized
gtcttagatgagccagctta

SEQ ID NO: 165344 - DNA, 20 bp, Artificial Sequence
  chemically synthesized
ggtcttagatgagccagctt

SEQ ID NO: 165345 - DNA, 20 bp, Artificial Sequence
  chemically synthesized
aggtcttagatgagccagct

SEQ ID NO: 165346 - DNA, 20 bp, Artificial Sequence
  chemically synthesized
gggagaggtcttagatgagc

SEQ ID NO: 165347 - DNA, 20 bp, Artificial Sequence
  chemically synthesized
ctccctaagctggctcatct

SEQ ID NO: 165348 - DNA, 20 bp, Artificial Sequence
  chemically synthesized
ggaagggagaggtcttagat

SEQ ID NO: 165349 - DNA, 20 bp, Artificial Sequence
  chemically synthesized
tgatgggaagggagaggtct

SEQ ID NO: 165350 - DNA, 20 bp, Artificial Sequence
  chemically synthesized
tggtggtgatgggaagggag

SEQ ID NO: 165351 - DNA, 20 bp, Artificial Sequence
  chemically synthesized
atggtggtgatgggaaggga

SEQ ID NO: 165352 - DNA, 20 bp, Artificial Sequence
  chemically synthesized
gaatggtggtgatgggaagg

SEQ ID NO: 165353 - DNA, 20 bp, Artificial Sequence
  chemically synthesized
aggaatggtggtgatgggaa

SEQ ID NO: 165354 - DNA, 20 bp, Artificial Sequence
  chemically synthesized
gaggaatggtggtgatggga

SEQ ID NO: 165355 - DNA, 20 bp, Artificial Sequence
  chemically synthesized
ggaggaatggtggtgatggg

SEQ ID NO: 165356 - DNA, 20 bp, Artificial Sequence
  chemically synthesized
gaaggaggaatggtggtgat

SEQ ID NO: 165357 - DNA, 20 bp, Artificial Sequence
  chemically synthesized
agaaggaggaatggtggtga

SEQ ID NO: 165358 - DNA, 20 bp, Artificial Sequence
  chemically synthesized
aaaggaagaaggaggaatgg

SEQ ID NO: 165359 - DNA, 20 bp, Artificial Sequence
  chemically synthesized
gtcaaaggaagaaggaggaa

SEQ ID NO: 165360 - DNA, 20 bp, Artificial Sequence
  chemically synthesized
aagtagtcaaaggaagaagg

SEQ ID NO: 165361 - DNA, 20 bp, Artificial Sequence
  chemically synthesized
aaagtagtcaaaggaagaag

SEQ ID NO: 165362 - DNA, 20 bp, Artificial Sequence
  chemically synthesized
caaaagtagtcaaaggaaga

SEQ ID NO: 165363 - DNA, 20 bp, Artificial Sequence
  chemically synthesized
tcaaaagtagtcaaaggaag

SEQ ID NO: 165364 - DNA, 20 bp, Artificial Sequence
  chemically synthesized
agatcaaaagtagtcaaagg

SEQ ID NO: 165365 - DNA, 20 bp, Artificial Sequence
  chemically synthesized
ggaagatcaaaagtagtcaa

SEQ ID NO: 165366 - DNA, 20 bp, Artificial Sequence
  chemically synthesized
gggaagatcaaaagtagtca

SEQ ID NO: 165367 - DNA, 20 bp, Artificial Sequence
  chemically synthesized
gctaaagggaagatcaaaag

SEQ ID NO: 165368 - DNA, 20 bp, Artificial Sequence
  chemically synthesized
ggagctaaagggaagatcaa

SEQ ID NO: 165369 - DNA, 20 bp, Artificial Sequence
  chemically synthesized
actacttttgatcttccctt

SEQ ID NO: 165370 - DNA, 20 bp, Artificial Sequence
  chemically synthesized
gatttaagggagctaaaggg

SEQ ID NO: 165371 - DNA, 20 bp, Artificial Sequence
  chemically synthesized
aaggatttaagggagctaaa

SEQ ID NO: 165372 - DNA, 20 bp, Artificial Sequence
  chemically synthesized
gaaggatttaagggagctaa

SEQ ID NO: 165373 - DNA, 20 bp, Artificial Sequence
  chemically synthesized
tgaaggatttaagggagcta

SEQ ID NO: 165374 - DNA, 20 bp, Artificial Sequence
  chemically synthesized
atatgctgaaggatttaagg

SEQ ID NO: 165375 - DNA, 20 bp, Artificial Sequence
  chemically synthesized
gaatatgctgaaggatttaa

SEQ ID NO: 165376 - DNA, 20 bp, Artificial Sequence
  chemically synthesized
ggaatatgctgaaggattta

SEQ ID NO: 165377 - DNA, 20 bp, Artificial Sequence
  chemically synthesized
aggaatatgctgaaggattt

SEQ ID NO: 165378 - DNA, 20 bp, Artificial Sequence
  chemically synthesized
tttagctcccttaaatcctt

SEQ ID NO: 165379 - DNA, 20 bp, Artificial Sequence
  chemically synthesized
tttgaagaggaatatgctga

SEQ ID NO: 165380 - DNA, 20 bp, Artificial Sequence
  chemically synthesized
gtttgaagaggaatatgctg

SEQ ID NO: 165381 - DNA, 20 bp, Artificial Sequence
  chemically synthesized
gagcaggtacgggtttgaag

SEQ ID NO: 165382 - DNA, 20 bp, Artificial Sequence
  chemically synthesized
ggagcaggtacgggtttgaa

SEQ ID NO: 165383 - DNA, 20 bp, Artificial Sequence
  chemically synthesized
atggagcaggtacgggtttg

SEQ ID NO: 165384 - DNA, 20 bp, Artificial Sequence
  chemically synthesized
caaagagatggagcaggtac

SEQ ID NO: 165385 - DNA, 20 bp, Artificial Sequence
  chemically synthesized
acaaagagatggagcaggta

SEQ ID NO: 165386 - DNA, 20 bp, Artificial Sequence
  chemically synthesized
gatggacaaagagatggagc

SEQ ID NO: 165387 - DNA, 20 bp, Artificial Sequence
  chemically synthesized
ggatggacaaagagatggag

SEQ ID NO: 165388 - DNA, 20 bp, Artificial Sequence
  chemically synthesized
catggatggacaaagagatg

SEQ ID NO: 165389 - DNA, 20 bp, Artificial Sequence
  chemically synthesized
gtcatggatggacaaagaga

SEQ ID NO: 165390 - DNA, 20 bp, Artificial Sequence
  chemically synthesized
gtctgtcatggatggacaaa

SEQ ID NO: 165391 - DNA, 20 bp, Artificial Sequence
  chemically synthesized
aggtctgtcatggatggaca

SEQ ID NO: 165392 - DNA, 20 bp, Artificial Sequence
  chemically synthesized
atctctttgtccatccatga

SEQ ID NO: 165393 - DNA, 20 bp, Artificial Sequence
  chemically synthesized
agagaaaggtctgtcatgga

SEQ ID NO: 165394 - DNA, 20 bp, Artificial Sequence
  chemically synthesized
aggaagagaaaggtctgtca

SEQ ID NO: 165395 - DNA, 20 bp, Artificial Sequence
  chemically synthesized
agactggagtaggaagagaa

SEQ ID NO: 165396 - DNA, 20 bp, Artificial Sequence
  chemically synthesized
gagactggagtaggaagaga

SEQ ID NO: 165397 - DNA, 20 bp, Artificial Sequence
  chemically synthesized
ttgagagactggagtaggaa

SEQ ID NO: 165398 - DNA, 20 bp, Artificial Sequence
  chemically synthesized
agacctttctcttcctactc

SEQ ID NO: 165399 - DNA, 20 bp, Artificial Sequence
  chemically synthesized
agttgagagactggagtagg

SEQ ID NO: 165400 - DNA, 20 bp, Artificial Sequence
  chemically synthesized
gagagttgagagactggagt

SEQ ID NO: 165401 - DNA, 20 bp, Artificial Sequence
  chemically synthesized
agagagttgagagactggag

SEQ ID NO: 165402 - DNA, 20 bp, Artificial Sequence
  chemically synthesized
catagagagttgagagactg

SEQ ID NO: 165403 - DNA, 20 bp, Artificial Sequence
  chemically synthesized
accatagagagttgagagac

SEQ ID NO: 165404 - DNA, 20 bp, Artificial Sequence
  chemically synthesized
tagagaccatagagagttga

SEQ ID NO: 165405 - DNA, 20 bp, Artificial Sequence
  chemically synthesized
tttagagaccatagagagtt

SEQ ID NO: 165406 - DNA, 20 bp, Artificial Sequence
  chemically synthesized
tccagtctctcaactctcta

SEQ ID NO: 165407 - DNA, 20 bp, Artificial Sequence
  chemically synthesized
aacgctttagagaccataga

SEQ ID NO: 165408 - DNA, 20 bp, Artificial Sequence
  chemically synthesized
ataacgctttagagaccata

SEQ ID NO: 165409 - DNA, 20 bp, Artificial Sequence
  chemically synthesized
gcataacgctttagagacca

SEQ ID NO: 165410 - DNA, 20 bp, Artificial Sequence
  chemically synthesized
tcaactctctatggtctcta

SEQ ID NO: 165411 - DNA, 20 bp, Artificial Sequence
  chemically synthesized
gcagggagcataacgcttta

SEQ ID NO: 165412 - DNA, 20 bp, Artificial Sequence
  chemically synthesized
tggcagggagcataacgctt

SEQ ID NO: 165413 - DNA, 20 bp, Artificial Sequence
  chemically synthesized
gagcccccagtagtggcagg

SEQ ID NO: 165414 - DNA, 20 bp, Artificial Sequence
  chemically synthesized
cagagcccccagtagtggca

SEQ ID NO: 165415 - DNA, 20 bp, Artificial Sequence
  chemically synthesized
ccagagcccccagtagtggc

SEQ ID NO: 165416 - DNA, 20 bp, Artificial Sequence
  chemically synthesized
gttatgctccctgccactac

SEQ ID NO: 165417 - DNA, 20 bp, Artificial Sequence
  chemically synthesized
tccagagcccccagtagtgg

SEQ ID NO: 165418 - DNA, 20 bp, Artificial Sequence
  chemically synthesized
ttatgctccctgccactact

SEQ ID NO: 165419 - DNA, 20 bp, Artificial Sequence
  chemically synthesized
tatgctccctgccactactg

SEQ ID NO: 165420 - DNA, 20 bp, Artificial Sequence
  chemically synthesized
atgctccctgccactactgg

SEQ ID NO: 165421 - DNA, 20 bp, Artificial Sequence
  chemically synthesized
ttttccagagcccccagtag

SEQ ID NO: 165422 - DNA, 20 bp, Artificial Sequence
  chemically synthesized
gagttttccagagcccccag

SEQ ID NO: 165423 - DNA, 20 bp, Artificial Sequence
  chemically synthesized
cctgccactactgggggctc

SEQ ID NO: 165424 - DNA, 20 bp, Artificial Sequence
  chemically synthesized
tttgagttttccagagcccc

SEQ ID NO: 165425 - DNA, 20 bp, Artificial Sequence
  chemically synthesized
tctggggtttgagttttcca

SEQ ID NO: 165426 - DNA, 20 bp, Artificial Sequence
  chemically synthesized
cttctggggtttgagttttc

SEQ ID NO: 165427 - DNA, 20 bp, Artificial Sequence
  chemically synthesized
gctctggaaaactcaaaccc

SEQ ID NO: 165428 - DNA, 20 bp, Artificial Sequence
  chemically synthesized
ggtggttgcttctggggttt

SEQ ID NO: 165429 - DNA, 20 bp, Artificial Sequence
  chemically synthesized
ctggaaaactcaaaccccag

SEQ ID NO: 165430 - DNA, 20 bp, Artificial Sequence
  chemically synthesized
acctcaggtggttgcttctg

SEQ ID NO: 165431 - DNA, 20 bp, Artificial Sequence
  chemically synthesized
aacctcaggtggttgcttct

SEQ ID NO: 165432 - DNA, 20 bp, Artificial Sequence
  chemically synthesized
caacctcaggtggttgcttc

SEQ ID NO: 165433 - DNA, 20 bp, Artificial Sequence
  chemically synthesized
aaccccagaagcaaccacct

SEQ ID NO: 165434 - DNA, 20 bp, Artificial Sequence
  chemically synthesized
accccagaagcaaccacctg

SEQ ID NO: 165435 - DNA, 20 bp, Artificial Sequence
  chemically synthesized
ttagctttttcaacctcagg

SEQ ID NO: 165436 - DNA, 20 bp, Artificial Sequence
  chemically synthesized
caattagctttttcaacctc

SEQ ID NO: 165437 - DNA, 20 bp, Artificial Sequence
  chemically synthesized
ccaattagctttttcaacct

SEQ ID NO: 165438 - DNA, 20 bp, Artificial Sequence
  chemically synthesized
gcaaccacctgaggttgaaa

SEQ ID NO: 165439 - DNA, 20 bp, Artificial Sequence
  chemically synthesized
ctgaggttgaaaaagctaat

SEQ ID NO: 165440 - DNA, 20 bp, Artificial Sequence
  chemically synthesized
gtatccagtctgtttccaat

SEQ ID NO: 165441 - DNA, 20 bp, Artificial Sequence
  chemically synthesized
ttgaaaaagctaattggaaa

SEQ ID NO: 165442 - DNA, 20 bp, Artificial Sequence
  chemically synthesized
aaagctaattggaaacagac

SEQ ID NO: 165443 - DNA, 20 bp, Artificial Sequence
  chemically synthesized
atctgaacgtacacggtatc

SEQ ID NO: 165444 - DNA, 20 bp, Artificial Sequence
  chemically synthesized
aaatcccatctgaacgtaca

SEQ ID NO: 165445 - DNA, 20 bp, Artificial Sequence
  chemically synthesized
gactggataccgtgtacgtt

SEQ ID NO: 165446 - DNA, 20 bp, Artificial Sequence
  chemically synthesized
ggataccgtgtacgttcaga

SEQ ID NO: 165447 - DNA, 20 bp, Artificial Sequence
  chemically synthesized
gataccgtgtacgttcagat

SEQ ID NO: 165448 - DNA, 20 bp, Artificial Sequence
  chemically synthesized
gtgtacgttcagatgggatt

SEQ ID NO: 165449 - DNA, 20 bp, Artificial Sequence
  chemically synthesized
gtacgttcagatgggatttg

SEQ ID NO: 165450 - DNA, 20 bp, Artificial Sequence
  chemically synthesized
agatgggatttggagatacc

SEQ ID NO: 165451 - DNA, 20 bp, Artificial Sequence
  chemically synthesized
gggatttggagatacccaga

SEQ ID NO: 165452 - DNA, 20 bp, Artificial Sequence
  chemically synthesized
gagatacctagtggccatct

SEQ ID NO: 165453 - DNA, 20 bp, Artificial Sequence
  chemically synthesized
ggagatacctagtggccatc

SEQ ID NO: 165454 - DNA, 20 bp, Artificial Sequence
  chemically synthesized
ggagatacccagatggccac

SEQ ID NO: 165455 - DNA, 20 bp, Artificial Sequence
  chemically synthesized
gagatacccagatggccact

SEQ ID NO: 165456 - DNA, 20 bp, Artificial Sequence
  chemically synthesized
atgactgaggagatacctag

SEQ ID NO: 165457 - DNA, 20 bp, Artificial Sequence
  chemically synthesized
taaatgactgaggagatacc

SEQ ID NO: 165458 - DNA, 20 bp, Artificial Sequence
  chemically synthesized
atggccactaggtatctcct

SEQ ID NO: 165459 - DNA, 20 bp, Artificial Sequence
  chemically synthesized
aatttgagtaaatgactgag

SEQ ID NO: 165460 - DNA, 20 bp, Artificial Sequence
  chemically synthesized
aaaatttgagtaaatgactg

SEQ ID NO: 165461 - DNA, 20 bp, Artificial Sequence
  chemically synthesized
taaaatttgagtaaatgact

SEQ ID NO: 165462 - DNA, 20 bp, Artificial Sequence
  chemically synthesized
tcagtcatttactcaaattt

SEQ ID NO: 165463 - DNA, 20 bp, Artificial Sequence
  chemically synthesized
gaggctgtgttctaaaattt

SEQ ID NO: 165464 - DNA, 20 bp, Artificial Sequence
  chemically synthesized
tttactcaaattttagaaca

SEQ ID NO: 165465 - DNA, 20 bp, Artificial Sequence
  chemically synthesized
ccctgatatgtaatttatgg

SEQ ID NO: 165466 - DNA, 20 bp, Artificial Sequence
  chemically synthesized
gccctgatatgtaatttatg

SEQ ID NO: 165467 - DNA, 20 bp, Artificial Sequence
  chemically synthesized
ttgccctgatatgtaattta

SEQ ID NO: 165468 - DNA, 20 bp, Artificial Sequence
  chemically synthesized
agcctccataaattacatat

SEQ ID NO: 165469 - DNA, 20 bp, Artificial Sequence
  chemically synthesized
gcctccataaattacatatc

SEQ ID NO: 165470 - DNA, 20 bp, Artificial Sequence
  chemically synthesized
cctccataaattacatatca

SEQ ID NO: 165471 - DNA, 20 bp, Artificial Sequence
  chemically synthesized
taaattacatatcagggcaa

SEQ ID NO: 165472 - DNA, 20 bp, Artificial Sequence
  chemically synthesized
agggcaaaagaaaatcttaa

SEQ ID NO: 165473 - DNA, 20 bp, Artificial Sequence
  chemically synthesized
gggcaaaagaaaatcttaaa

SEQ ID NO: 165474 - DNA, 20 bp, Artificial Sequence
  chemically synthesized
tatttgtggaggagcctttt

SEQ ID NO: 165475 - DNA, 20 bp, Artificial Sequence
  chemically synthesized
ttacatcaatatttgtggag

SEQ ID NO: 165476 - DNA, 20 bp, Artificial Sequence
  chemically synthesized
gtttacatcaatatttgtgg

SEQ ID NO: 165477 - DNA, 20 bp, Artificial Sequence
  chemically synthesized
agtttacatcaatatttgtg

SEQ ID NO: 165478 - DNA, 20 bp, Artificial Sequence
  chemically synthesized
aaagtttacatcaatatttg

SEQ ID NO: 165479 - DNA, 20 bp, Artificial Sequence
  chemically synthesized
caaatattgatgtaaacttt

SEQ ID NO: 165480 - DNA, 20 bp, Artificial Sequence
  chemically synthesized
ctactcaatatgagggctaa

SEQ ID NO: 165481 - DNA, 20 bp, Artificial Sequence
  chemically synthesized
aaacttttagccctcatatt

SEQ ID NO: 165482 - DNA, 20 bp, Artificial Sequence
  chemically synthesized
aattcacctactcaatatga

SEQ ID NO: 165483 - DNA, 20 bp, Artificial Sequence
  chemically synthesized
aaattcacctactcaatatg

SEQ ID NO: 165484 - DNA, 20 bp, Artificial Sequence
  chemically synthesized
taaattcacctactcaatat

SEQ ID NO: 165485 - DNA, 20 bp, Artificial Sequence
  chemically synthesized
cttttagccctcatattgag

SEQ ID NO: 165486 - DNA, 20 bp, Artificial Sequence
  chemically synthesized
ttttagccctcatattgagt

SEQ ID NO: 165487 - DNA, 20 bp, Artificial Sequence
  chemically synthesized
ctagcaaagcttatgaatac

SEQ ID NO: 165488 - DNA, 20 bp, Artificial Sequence
  chemically synthesized
tgaatttaacttgtattcat

SEQ ID NO: 165489 - DNA, 20 bp, Artificial Sequence
  chemically synthesized
cttgtattcataagctttgc

SEQ ID NO: 165490 - DNA, 20 bp, Artificial Sequence
  chemically synthesized
tattcataagctttgctagt

SEQ ID NO: 165491 - DNA, 20 bp, Artificial Sequence
  chemically synthesized
tatttcatagccaactagca

SEQ ID NO: 165492 - DNA, 20 bp, Artificial Sequence
  chemically synthesized
accagtatttcatagccaac

SEQ ID NO: 165493 - DNA, 20 bp, Artificial Sequence
  chemically synthesized
tgtcatataccagtatttca

SEQ ID NO: 165494 - DNA, 20 bp, Artificial Sequence
  chemically synthesized
gctagttggctatgaaatac

SEQ ID NO: 165495 - DNA, 20 bp, Artificial Sequence
  chemically synthesized
gtgaactgtttgtcatatac

SEQ ID NO: 165496 - DNA, 20 bp, Artificial Sequence
  chemically synthesized
aaatactggtatatgacaaa

SEQ ID NO: 165497 - DNA, 20 bp, Artificial Sequence
  chemically synthesized
tatgacaaacagttcacact

SEQ ID NO: 165498 - DNA, 20 bp, Artificial Sequence
  chemically synthesized
gagaaaactaggaattagct

SEQ ID NO: 165499 - DNA, 20 bp, Artificial Sequence
  chemically synthesized
gttcacacttagctaattcc

SEQ ID NO: 165500 - DNA, 20 bp, Artificial Sequence
  chemically synthesized
ttatagagaaaactaggaat

SEQ ID NO: 165501 - DNA, 20 bp, Artificial Sequence
  chemically synthesized
cttattttatagagaaaact

SEQ ID NO: 165502 - DNA, 20 bp, Artificial Sequence
  chemically synthesized
tcttattttatagagaaaac

SEQ ID NO: 165503 - DNA, 20 bp, Artificial Sequence
  chemically synthesized
ttagtaagtcttattttata

SEQ ID NO: 165504 - DNA, 20 bp, Artificial Sequence
  chemically synthesized
cctagttttctctataaaat

SEQ ID NO: 165505 - DNA, 20 bp, Artificial Sequence
  chemically synthesized
cattagtaagtcttatttta

SEQ ID NO: 165506 - DNA, 20 bp, Artificial Sequence
  chemically synthesized
tataaaataagacttactaa

SEQ ID NO: 165507 - DNA, 20 bp, Artificial Sequence
  chemically synthesized
ttatatttttaaccattagt

SEQ ID NO: 165508 - DNA, 20 bp, Artificial Sequence
  chemically synthesized
ttgattatatttttaaccat

SEQ ID NO: 165509 - DNA, 20 bp, Artificial Sequence
  chemically synthesized
atatatgtaaataaaacttc

SEQ ID NO: 165510 - DNA, 20 bp, Artificial Sequence
  chemically synthesized
tttacccctaatgtttctgg

SEQ ID NO: 165511 - DNA, 20 bp, Artificial Sequence
  chemically synthesized
aataaaacttccagaaacat

SEQ ID NO: 165512 - DNA, 20 bp, Artificial Sequence
  chemically synthesized
ccctttacccctaatgtttc

SEQ ID NO: 165513 - DNA, 20 bp, Artificial Sequence
  chemically synthesized
ataaaacttccagaaacatt

SEQ ID NO: 165514 - DNA, 20 bp, Artificial Sequence
  chemically synthesized
taaaacttccagaaacatta

SEQ ID NO: 165515 - DNA, 20 bp, Artificial Sequence
  chemically synthesized
aaaacttccagaaacattag

SEQ ID NO: 165516 - DNA, 20 bp, Artificial Sequence
  chemically synthesized
ttccagaaacattaggggta

SEQ ID NO: 165517 - DNA, 20 bp, Artificial Sequence
  chemically synthesized
tccagaaacattaggggtaa

SEQ ID NO: 165518 - DNA, 20 bp, Artificial Sequence
  chemically synthesized
ccagaaacattaggggtaaa

SEQ ID NO: 165519 - DNA, 20 bp, Artificial Sequence
  chemically synthesized
ccttgtatattttgcataca

SEQ ID NO: 165520 - DNA, 20 bp, Artificial Sequence
  chemically synthesized
actttgtatgcaaaatatac

SEQ ID NO: 165521 - DNA, 20 bp, Artificial Sequence
  chemically synthesized
ctttgtatgcaaaatataca

SEQ ID NO: 165522 - DNA, 20 bp, Artificial Sequence
  chemically synthesized
gcaaaatatacaaggtatgt

SEQ ID NO: 165523 - DNA, 20 bp, Artificial Sequence
  chemically synthesized
atgttggatgtgtttttgtt

SEQ ID NO: 165524 - DNA, 20 bp, Artificial Sequence
  chemically synthesized
tgttggatgtgtttttgtta

SEQ ID NO: 165525 - DNA, 20 bp, Artificial Sequence
  chemically synthesized
atgtgtttttgttaaggaaa

SEQ ID NO: 165526 - DNA, 20 bp, Artificial Sequence
  chemically synthesized
gtgtttttgttaaggaaaaa

SEQ ID NO: 165527 - DNA, 20 bp, Artificial Sequence
  chemically synthesized
agtcattttaatttaggaca

SEQ ID NO: 165528 - DNA, 20 bp, Artificial Sequence
  chemically synthesized
tttcacagtcattttaattt

SEQ ID NO: 165529 - DNA, 20 bp, Artificial Sequence
  chemically synthesized
ttttcacagtcattttaatt

SEQ ID NO: 165530 - DNA, 20 bp, Artificial Sequence
  chemically synthesized
attaaaatgactgtgaaaat

SEQ ID NO: 165531 - DNA, 20 bp, Artificial Sequence
  chemically synthesized
cttcctcttcctcattttca

SEQ ID NO: 165532 - DNA, 20 bp, Artificial Sequence
  chemically synthesized
ttaaaatgactgtgaaaatg

SEQ ID NO: 165533 - DNA, 20 bp, Artificial Sequence
  chemically synthesized
aaatgactgtgaaaatgagg

SEQ ID NO: 165534 - DNA, 20 bp, Artificial Sequence
  chemically synthesized
atgactgtgaaaatgaggaa

SEQ ID NO: 165535 - DNA, 20 bp, Artificial Sequence
  chemically synthesized
tgactgtgaaaatgaggaag

SEQ ID NO: 165536 - DNA, 20 bp, Artificial Sequence
  chemically synthesized
ctgtgaaaatgaggaagagg

SEQ ID NO: 165537 - DNA, 20 bp, Artificial Sequence
  chemically synthesized
tgtgaaaatgaggaagagga

SEQ ID NO: 165538 - DNA, 20 bp, Artificial Sequence
  chemically synthesized
aaatgaggaagaggaaggta

SEQ ID NO: 165539 - DNA, 20 bp, Artificial Sequence
  chemically synthesized
aatgaggaagaggaaggtat

SEQ ID NO: 165540 - DNA, 20 bp, Artificial Sequence
  chemically synthesized
tgccatttccaatgttcatt

SEQ ID NO: 165541 - DNA, 20 bp, Artificial Sequence
  chemically synthesized
gacaaaatctgaatgaacat

SEQ ID NO: 165542 - DNA, 20 bp, Artificial Sequence
  chemically synthesized
atctgaatgaacattggaaa

SEQ ID NO: 165543 - DNA, 20 bp, Artificial Sequence
  chemically synthesized
tgaatgaacattggaaatgg

SEQ ID NO: 165544 - DNA, 20 bp, Artificial Sequence
  chemically synthesized
atgaacattggaaatggcag

SEQ ID NO: 165545 - DNA, 20 bp, Artificial Sequence
  chemically synthesized
tggaaatggcagaagatttg

SEQ ID NO: 165546 - DNA, 20 bp, Artificial Sequence
  chemically synthesized
aaatggcagaagatttgtgg

SEQ ID NO: 165547 - DNA, 20 bp, Artificial Sequence
  chemically synthesized
aatggcagaagatttgtgga

SEQ ID NO: 165548 - DNA, 20 bp, Artificial Sequence
  chemically synthesized
tggcagaagatttgtggaag

SEQ ID NO: 165549 - DNA, 20 bp, Artificial Sequence
  chemically synthesized
gcagaagatttgtggaagga

SEQ ID NO: 165550 - DNA, 20 bp, Artificial Sequence
  chemically synthesized
gaaggagagtcttatgttaa

SEQ ID NO: 165551 - DNA, 20 bp, Artificial Sequence
  chemically synthesized
ccagcattggctattaacat

SEQ ID NO: 165552 - DNA, 20 bp, Artificial Sequence
  chemically synthesized
cttatgttaatagccaatgc

SEQ ID NO: 165553 - DNA, 20 bp, Artificial Sequence
  chemically synthesized
cattccgttttagccagcat

SEQ ID NO: 165554 - DNA, 20 bp, Artificial Sequence
  chemically synthesized
atagccaatgctggctaaaa

SEQ ID NO: 165555 - DNA, 20 bp, Artificial Sequence
  chemically synthesized
taaatccattccgttttagc

SEQ ID NO: 165556 - DNA, 20 bp, Artificial Sequence
  chemically synthesized
cacataaatccattccgttt

SEQ ID NO: 165557 - DNA, 20 bp, Artificial Sequence
  chemically synthesized
caatgctggctaaaacggaa

SEQ ID NO: 165558 - DNA, 20 bp, Artificial Sequence
  chemically synthesized
atactaagggtcatttgtaa

SEQ ID NO: 165559 - DNA, 20 bp, Artificial Sequence
  chemically synthesized
tgatactaagggtcatttgt

SEQ ID NO: 165560 - DNA, 20 bp, Artificial Sequence
  chemically synthesized
aaactcttacaaatgaccct

SEQ ID NO: 165561 - DNA, 20 bp, Artificial Sequence
  chemically synthesized
caatacactgttgatactaa

SEQ ID NO: 165562 - DNA, 20 bp, Artificial Sequence
  chemically synthesized
tcaatacactgttgatacta

SEQ ID NO: 165563 - DNA, 20 bp, Artificial Sequence
  chemically synthesized
atcaatacactgttgatact

SEQ ID NO: 165564 - DNA, 20 bp, Artificial Sequence
  chemically synthesized
caaatgacccttagtatcaa

SEQ ID NO: 165565 - DNA, 20 bp, Artificial Sequence
  chemically synthesized
acagtgtattgatcaaaaat

SEQ ID NO: 165566 - DNA, 20 bp, Artificial Sequence
  chemically synthesized
tattgatcaaaaatgagttg

SEQ ID NO: 165567 - DNA, 20 bp, Artificial Sequence
  chemically synthesized
ttttatcattttttaacaaa

SEQ ID NO: 165568 - DNA, 20 bp, Artificial Sequence
  chemically synthesized
aaaaaatgataaaatattct

SEQ ID NO: 165569 - DNA, 20 bp, Artificial Sequence
  chemically synthesized
ataaaatattcttggattat

SEQ ID NO: 165570 - DNA, 20 bp, Artificial Sequence
  chemically synthesized
aaagagcagaccaataatcc

SEQ ID NO: 165571 - DNA, 20 bp, Artificial Sequence
  chemically synthesized
tcaattttatttcaaaagag

SEQ ID NO: 165572 - DNA, 20 bp, Artificial Sequence
  chemically synthesized
tattcaattttatttcaaaa

SEQ ID NO: 165573 - DNA, 20 bp, Artificial Sequence
  chemically synthesized
tatattcaattttatttcaa

SEQ ID NO: 165574 - DNA, 20 bp, Artificial Sequence
  chemically synthesized
aaataaaattgaatatactt

SEQ ID NO: 165575 - DNA, 20 bp, Artificial Sequence
  chemically synthesized
tcaaaatatgttgcatactt

SEQ ID NO: 165576 - DNA, 20 bp, Artificial Sequence
  chemically synthesized
aaattgcaaaacaattattt

SEQ ID NO: 165577 - DNA, 20 bp, Artificial Sequence
  chemically synthesized
gaaaagatgaaaatgttaat

SEQ ID NO: 165578 - DNA, 20 bp, Artificial Sequence
  chemically synthesized
aacattttcatcttttctat

SEQ ID NO: 165579 - DNA, 20 bp, Artificial Sequence
  chemically synthesized
ttaagagaagaccaatagaa

SEQ ID NO: 165580 - DNA, 20 bp, Artificial Sequence
  chemically synthesized
tcttattaagagaagaccaa

SEQ ID NO: 165581 - DNA, 20 bp, Artificial Sequence
  chemically synthesized
ttgcaatctcttattaagag

SEQ ID NO: 165582 - DNA, 20 bp, Artificial Sequence
  chemically synthesized
tctattggtcttctcttaat

SEQ ID NO: 165583 - DNA, 20 bp, Artificial Sequence
  chemically synthesized
tattggtcttctcttaataa

SEQ ID NO: 165584 - DNA, 20 bp, Artificial Sequence
  chemically synthesized
attttgcaatctcttattaa

SEQ ID NO: 165585 - DNA, 20 bp, Artificial Sequence
  chemically synthesized
aaattttgcaatctcttatt

SEQ ID NO: 165586 - DNA, 20 bp, Artificial Sequence
  chemically synthesized
ttgtttttttttttatattt

SEQ ID NO: 165587 - DNA, 20 bp, Artificial Sequence
  chemically synthesized
tgtttttttttttatatttt

SEQ ID NO: 165588 - DNA, 20 bp, Artificial Sequence
  chemically synthesized
tatattttgggtaatctgta

SEQ ID NO: 165589 - DNA, 20 bp, Artificial Sequence
  chemically synthesized
atattttgggtaatctgtat

SEQ ID NO: 165590 - DNA, 20 bp, Artificial Sequence
  chemically synthesized
aacaatatttgtttcctata

SEQ ID NO: 165591 - DNA, 20 bp, Artificial Sequence
  chemically synthesized
aaacaaatattgtttcttat

SEQ ID NO: 165592 - DNA, 20 bp, Artificial Sequence
  chemically synthesized
acacaggtacttattctgat

SEQ ID NO: 165593 - DNA, 20 bp, Artificial Sequence
  chemically synthesized
atattgtttcttatcagaat

SEQ ID NO: 165594 - DNA, 20 bp, Artificial Sequence
  chemically synthesized
aggacatacaaaatcaacac

SEQ ID NO: 165595 - DNA, 20 bp, Artificial Sequence
  chemically synthesized
aaggacatacaaaatcaaca

SEQ ID NO: 165596 - DNA, 20 bp, Artificial Sequence
  chemically synthesized
ctactttctaaaaaaattca

SEQ ID NO: 165597 - DNA, 20 bp, Artificial Sequence
  chemically synthesized
actactttctaaaaaaattc

SEQ ID NO: 165598 - DNA, 20 bp, Artificial Sequence
  chemically synthesized
tgtatgtccttgaatttttt

SEQ ID NO: 165599 - DNA, 20 bp, Artificial Sequence
  chemically synthesized
tgtccttgaatttttttaga

SEQ ID NO: 165600 - DNA, 20 bp, Artificial Sequence
  chemically synthesized
ccttgaatttttttagaaag

SEQ ID NO: 165601 - DNA, 20 bp, Artificial Sequence
  chemically synthesized
agaaagtagtgttttctctt

SEQ ID NO: 165602 - DNA, 20 bp, Artificial Sequence
  chemically synthesized
agtagtgttttctctttgga

SEQ ID NO: 165603 - DNA, 20 bp, Artificial Sequence
  chemically synthesized
agtttttagttctttccaaa

SEQ ID NO: 165604 - DNA, 20 bp, Artificial Sequence
  chemically synthesized
aaagtttttagttctttcca

SEQ ID NO: 165605 - DNA, 20 bp, Artificial Sequence
  chemically synthesized
cacatgacggtaaaagtttt

SEQ ID NO: 165606 - DNA, 20 bp, Artificial Sequence
  chemically synthesized
agaaggccacatgacggtaa

SEQ ID NO: 165607 - DNA, 20 bp, Artificial Sequence
  chemically synthesized
taaaaacttttaccgtcatg

SEQ ID NO: 165608 - DNA, 20 bp, Artificial Sequence
  chemically synthesized
aaatgtagaaggccacatga

SEQ ID NO: 165609 - DNA, 20 bp, Artificial Sequence
  chemically synthesized
atttcaaaaataaatgtaga

SEQ ID NO: 165610 - DNA, 20 bp, Artificial Sequence
  chemically synthesized
gatttcaaaaataaatgtag

SEQ ID NO: 165611 - DNA, 20 bp, Artificial Sequence
  chemically synthesized
aaagatttcaaaaataaatg

SEQ ID NO: 165612 - DNA, 20 bp, Artificial Sequence
  chemically synthesized
tgtaaccaagatgacaataa

SEQ ID NO: 165613 - DNA, 20 bp, Artificial Sequence
  chemically synthesized
gaaatcttttattgtcatct

SEQ ID NO: 165614 - DNA, 20 bp, Artificial Sequence
  chemically synthesized
ttattgtcatcttggttaca

SEQ ID NO: 165615 - DNA, 20 bp, Artificial Sequence
  chemically synthesized
gcatggctacctatgtaacc

SEQ ID NO: 165616 - DNA, 20 bp, Artificial Sequence
  chemically synthesized
tattgtcatcttggttacat

SEQ ID NO: 165617 - DNA, 20 bp, Artificial Sequence
  chemically synthesized
tgtcatcttggttacatagg

SEQ ID NO: 165618 - DNA, 20 bp, Artificial Sequence
  chemically synthesized
gctcactatgaaagaatgca

SEQ ID NO: 165619 - DNA, 20 bp, Artificial Sequence
  chemically synthesized
ggtagccatgcattctttca

SEQ ID NO: 165620 - DNA, 20 bp, Artificial Sequence
  chemically synthesized
gccatgcattctttcatagt

SEQ ID NO: 165621 - DNA, 20 bp, Artificial Sequence
  chemically synthesized
aggatcattgctcactatga

SEQ ID NO: 165622 - DNA, 20 bp, Artificial Sequence
  chemically synthesized
tagtgagcaatgatcctatt

SEQ ID NO: 165623 - DNA, 20 bp, Artificial Sequence
  chemically synthesized
gtttgaatacttggctgaat

SEQ ID NO: 165624 - DNA, 20 bp, Artificial Sequence
  chemically synthesized
agcaatgatcctattcagcc

SEQ ID NO: 165625 - DNA, 20 bp, Artificial Sequence
  chemically synthesized
ggtttgaatacttggctgaa

SEQ ID NO: 165626 - DNA, 20 bp, Artificial Sequence
  chemically synthesized
tgacaaaaggtttgaatact

SEQ ID NO: 165627 - DNA, 20 bp, Artificial Sequence
  chemically synthesized
aaaggttgtaaaatgacaaa

SEQ ID NO: 165628 - DNA, 20 bp, Artificial Sequence
  chemically synthesized
caaaggttgtaaaatgacaa

SEQ ID NO: 165629 - DNA, 20 bp, Artificial Sequence
  chemically synthesized
tgggaaaagcaaaatatcaa

SEQ ID NO: 165630 - DNA, 20 bp, Artificial Sequence
  chemically synthesized
ctgggaaaagcaaaatatca

SEQ ID NO: 165631 - DNA, 20 bp, Artificial Sequence
  chemically synthesized
ctttgatattttgcttttcc

SEQ ID NO: 165632 - DNA, 20 bp, Artificial Sequence
  chemically synthesized
tttgatattttgcttttccc

SEQ ID NO: 165633 - DNA, 20 bp, Artificial Sequence
  chemically synthesized
tttaagaattgacctgggaa

SEQ ID NO: 165634 - DNA, 20 bp, Artificial Sequence
  chemically synthesized
ttttatttaagaattgacct

SEQ ID NO: 165635 - DNA, 20 bp, Artificial Sequence
  chemically synthesized
attttatttaagaattgacc

SEQ ID NO: 165636 - DNA, 20 bp, Artificial Sequence
  chemically synthesized
gattaaaaaaaattttattt

SEQ ID NO: 165637 - DNA, 20 bp, Artificial Sequence
  chemically synthesized
aataaaattttttttaatct

SEQ ID NO: 165638 - DNA, 20 bp, Artificial Sequence
  chemically synthesized
aattttttttaatctcagat

SEQ ID NO: 165639 - DNA, 20 bp, Artificial Sequence
  chemically synthesized
gaaatttttcaaaccaatct

SEQ ID NO: 165640 - DNA, 20 bp, Artificial Sequence
  chemically synthesized
gattggtttgaaaaatttca

SEQ ID NO: 165641 - DNA, 20 bp, Artificial Sequence
  chemically synthesized
attggtttgaaaaatttcaa

SEQ ID NO: 165642 - DNA, 20 bp, Artificial Sequence
  chemically synthesized
ccttcattttacaagggtgc

SEQ ID NO: 165643 - DNA, 20 bp, Artificial Sequence
  chemically synthesized
tccttcattttacaagggtg

SEQ ID NO: 165644 - DNA, 20 bp, Artificial Sequence
  chemically synthesized
taacatccttcattttacaa

SEQ ID NO: 165645 - DNA, 20 bp, Artificial Sequence
  chemically synthesized
ttaacatccttcattttaca

SEQ ID NO: 165646 - DNA, 20 bp, Artificial Sequence
  chemically synthesized
tttaacatccttcattttac

SEQ ID NO: 165647 - DNA, 20 bp, Artificial Sequence
  chemically synthesized
tcctgcacccttgtaaaatg

SEQ ID NO: 165648 - DNA, 20 bp, Artificial Sequence
  chemically synthesized
cctgcacccttgtaaaatga

SEQ ID NO: 165649 - DNA, 20 bp, Artificial Sequence
  chemically synthesized
tgaaggatgttaaaaataac

SEQ ID NO: 165650 - DNA, 20 bp, Artificial Sequence
  chemically synthesized
gaaggatgttaaaaataact

SEQ ID NO: 165651 - DNA, 20 bp, Artificial Sequence
  chemically synthesized
ctcaacataccaaatgaacc

SEQ ID NO: 165652 - DNA, 20 bp, Artificial Sequence
  chemically synthesized
taaaaataactaggttcatt

SEQ ID NO: 165653 - DNA, 20 bp, Artificial Sequence
  chemically synthesized
ctaggttcatttggtatgtt

SEQ ID NO: 165654 - DNA, 20 bp, Artificial Sequence
  chemically synthesized
ggtatgttgagttgcataaa

SEQ ID NO: 165655 - DNA, 20 bp, Artificial Sequence
  chemically synthesized
gttgcataaaaagctttgac

SEQ ID NO: 165656 - DNA, 20 bp, Artificial Sequence
  chemically synthesized
gcataaaaagctttgacaag

SEQ ID NO: 165657 - DNA, 20 bp, Artificial Sequence
  chemically synthesized
ttcagcatctcttcttgtca

SEQ ID NO: 165658 - DNA, 20 bp, Artificial Sequence
  chemically synthesized
ataaaaagctttgacaagaa

SEQ ID NO: 165659 - DNA, 20 bp, Artificial Sequence
  chemically synthesized
actataacctagtcaaggtt

SEQ ID NO: 165660 - DNA, 20 bp, Artificial Sequence
  chemically synthesized
aagagatgctgaaccttgac

SEQ ID NO: 165661 - DNA, 20 bp, Artificial Sequence
  chemically synthesized
agagatgctgaaccttgact

SEQ ID NO: 165662 - DNA, 20 bp, Artificial Sequence
  chemically synthesized
atacaactataacctagtca

SEQ ID NO: 165663 - DNA, 20 bp, Artificial Sequence
  chemically synthesized
catacaactataacctagtc

SEQ ID NO: 165664 - DNA, 20 bp, Artificial Sequence
  chemically synthesized
gctgaaccttgactaggtta

SEQ ID NO: 165665 - DNA, 20 bp, Artificial Sequence
  chemically synthesized
tgacccatacaactataacc

SEQ ID NO: 165666 - DNA, 20 bp, Artificial Sequence
  chemically synthesized
ttgactaggttatagttgta

SEQ ID NO: 165667 - DNA, 20 bp, Artificial Sequence
  chemically synthesized
tgactaggttatagttgtat

SEQ ID NO: 165668 - DNA, 20 bp, Artificial Sequence
  chemically synthesized
ttgtatgggtcaactattat

SEQ ID NO: 165669 - DNA, 20 bp, Artificial Sequence
  chemically synthesized
tcaagtatttatactaataa

SEQ ID NO: 165670 - DNA, 20 bp, Artificial Sequence
  chemically synthesized
aggatttattataatttttc

SEQ ID NO: 165671 - DNA, 20 bp, Artificial Sequence
  chemically synthesized
gaaaaattataataaatcct

SEQ ID NO: 165672 - DNA, 20 bp, Artificial Sequence
  chemically synthesized
agagcactaacaaagttcta

SEQ ID NO: 165673 - DNA, 20 bp, Artificial Sequence
  chemically synthesized
tagagcactaacaaagttct

SEQ ID NO: 165674 - DNA, 20 bp, Artificial Sequence
  chemically synthesized
ataaatccttagaactttgt

SEQ ID NO: 165675 - DNA, 20 bp, Artificial Sequence
  chemically synthesized
gagcacctagagcactaaca

SEQ ID NO: 165676 - DNA, 20 bp, Artificial Sequence
  chemically synthesized
ttagaactttgttagtgctc

SEQ ID NO: 165677 - DNA, 20 bp, Artificial Sequence
  chemically synthesized
tagaactttgttagtgctct

SEQ ID NO: 165678 - DNA, 20 bp, Artificial Sequence
  chemically synthesized
atggacacctagagcaccta

SEQ ID NO: 165679 - DNA, 20 bp, Artificial Sequence
  chemically synthesized
tgttagtgctctaggtgctc

SEQ ID NO: 165680 - DNA, 20 bp, Artificial Sequence
  chemically synthesized
tcatggacacctagagcacc

SEQ ID NO: 165681 - DNA, 20 bp, Artificial Sequence
  chemically synthesized
gttagtgctctaggtgctct

SEQ ID NO: 165682 - DNA, 20 bp, Artificial Sequence
  chemically synthesized
ggatgtgtcatggacaccta

SEQ ID NO: 165683 - DNA, 20 bp, Artificial Sequence
  chemically synthesized
caggatgtgtcatggacacc

SEQ ID NO: 165684 - DNA, 20 bp, Artificial Sequence
  chemically synthesized
agtagcaccaggatgtgtca

SEQ ID NO: 165685 - DNA, 20 bp, Artificial Sequence
  chemically synthesized
taggtgtccatgacacatcc

SEQ ID NO: 165686 - DNA, 20 bp, Artificial Sequence
  chemically synthesized
ttatcggataaagtagcacc

SEQ ID NO: 165687 - DNA, 20 bp, Artificial Sequence
  chemically synthesized
attatcggataaagtagcac

SEQ ID NO: 165688 - DNA, 20 bp, Artificial Sequence
  chemically synthesized
aatattattatcggataaag

SEQ ID NO: 165689 - DNA, 20 bp, Artificial Sequence
  chemically synthesized
cataatattattatcggata

SEQ ID NO: 165690 - DNA, 20 bp, Artificial Sequence
  chemically synthesized
tgatgacataatattattat

SEQ ID NO: 165691 - DNA, 20 bp, Artificial Sequence
  chemically synthesized
cgataataatattatgtcat

SEQ ID NO: 165692 - DNA, 20 bp, Artificial Sequence
  chemically synthesized
tatgtcatcagtcctaactc

SEQ ID NO: 165693 - DNA, 20 bp, Artificial Sequence
  chemically synthesized
ttaaaataacaactggagtt

SEQ ID NO: 165694 - DNA, 20 bp, Artificial Sequence
  chemically synthesized
tttaaaataacaactggagt

SEQ ID NO: 165695 - DNA, 20 bp, Artificial Sequence
  chemically synthesized
acattttaaaataacaactg

SEQ ID NO: 165696 - DNA, 20 bp, Artificial Sequence
  chemically synthesized
ccacattttaaaataacaac

SEQ ID NO: 165697 - DNA, 20 bp, Artificial Sequence
  chemically synthesized
ccagttgttattttaaaatg

SEQ ID NO: 165698 - DNA, 20 bp, Artificial Sequence
  chemically synthesized
tgttattttaaaatgtggca

SEQ ID NO: 165699 - DNA, 20 bp, Artificial Sequence
  chemically synthesized
tttaaaatgtggcatggcac

SEQ ID NO: 165700 - DNA, 20 bp, Artificial Sequence
  chemically synthesized
ttaaaatgtggcatggcacc

SEQ ID NO: 165701 - DNA, 20 bp, Artificial Sequence
  chemically synthesized
taaaatgtggcatggcacca

SEQ ID NO: 165702 - DNA, 20 bp, Artificial Sequence
  chemically synthesized
caagaaattttttttttccc

SEQ ID NO: 165703 - DNA, 20 bp, Artificial Sequence
  chemically synthesized
aaagatctgattcattcgac

SEQ ID NO: 165704 - DNA, 20 bp, Artificial Sequence
  chemically synthesized
aaatttcttgtcgaatgaat

SEQ ID NO: 165705 - DNA, 20 bp, Artificial Sequence
  chemically synthesized
atgaatcagatctttaatta

SEQ ID NO: 165706 - DNA, 20 bp, Artificial Sequence
  chemically synthesized
acttaaaatggccataatta

SEQ ID NO: 165707 - DNA, 20 bp, Artificial Sequence
  chemically synthesized
tctttaattatggccatttt

SEQ ID NO: 165708 - DNA, 20 bp, Artificial Sequence
  chemically synthesized
gaacgacaaaagacttaaaa

SEQ ID NO: 165709 - DNA, 20 bp, Artificial Sequence
  chemically synthesized
aaactatctgtgaacgacaa

SEQ ID NO: 165710 - DNA, 20 bp, Artificial Sequence
  chemically synthesized
tttaagtcttttgtcgttca

SEQ ID NO: 165711 - DNA, 20 bp, Artificial Sequence
  chemically synthesized
agtcttttgtcgttcacaga

SEQ ID NO: 165712 - DNA, 20 bp, Artificial Sequence
  chemically synthesized
tgtcgttcacagatagtttt

SEQ ID NO: 165713 - DNA, 20 bp, Artificial Sequence
  chemically synthesized
aagagcactcagggaagcat

SEQ ID NO: 165714 - DNA, 20 bp, Artificial Sequence
  chemically synthesized
gtttatgctgatgcttccct

SEQ ID NO: 165715 - DNA, 20 bp, Artificial Sequence
  chemically synthesized
gattgtaagagcactcaggg

SEQ ID NO: 165716 - DNA, 20 bp, Artificial Sequence
  chemically synthesized
actgattgtaagagcactca

SEQ ID NO: 165717 - DNA, 20 bp, Artificial Sequence
  chemically synthesized
aactgattgtaagagcactc

SEQ ID NO: 165718 - DNA, 20 bp, Artificial Sequence
  chemically synthesized
taactgattgtaagagcact

SEQ ID NO: 165719 - DNA, 20 bp, Artificial Sequence
  chemically synthesized
tccctgagtgctcttacaat

SEQ ID NO: 165720 - DNA, 20 bp, Artificial Sequence
  chemically synthesized
tgacctctaactgattgtaa

SEQ ID NO: 165721 - DNA, 20 bp, Artificial Sequence
  chemically synthesized
tctgacctctaactgattgt

SEQ ID NO: 165722 - DNA, 20 bp, Artificial Sequence
  chemically synthesized
tgagtgctcttacaatcagt

SEQ ID NO: 165723 - DNA, 20 bp, Artificial Sequence
  chemically synthesized
agtgctcttacaatcagtta

SEQ ID NO: 165724 - DNA, 20 bp, Artificial Sequence
  chemically synthesized
gtgctcttacaatcagttag

SEQ ID NO: 165725 - DNA, 20 bp, Artificial Sequence
  chemically synthesized
tcttacaatcagttagaggt

SEQ ID NO: 165726 - DNA, 20 bp, Artificial Sequence
  chemically synthesized
aggtcagaatgcatcatctt

SEQ ID NO: 165727 - DNA, 20 bp, Artificial Sequence
  chemically synthesized
aagatggtcctgttttactg

SEQ ID NO: 165728 - DNA, 20 bp, Artificial Sequence
  chemically synthesized
atgcatcatcttcagtaaaa

SEQ ID NO: 165729 - DNA, 20 bp, Artificial Sequence
  chemically synthesized
tgcatcatcttcagtaaaac

SEQ ID NO: 165730 - DNA, 20 bp, Artificial Sequence
  chemically synthesized
agtaaaacaggaccatcttt

SEQ ID NO: 165731 - DNA, 20 bp, Artificial Sequence
  chemically synthesized
cttcctatgggtctcaaaga

SEQ ID NO: 165732 - DNA, 20 bp, Artificial Sequence
  chemically synthesized
agtacttcctatgggtctca

SEQ ID NO: 165733 - DNA, 20 bp, Artificial Sequence
  chemically synthesized
aggaccatctttgagaccca

SEQ ID NO: 165734 - DNA, 20 bp, Artificial Sequence
  chemically synthesized
ggaccatctttgagacccat

SEQ ID NO: 165735 - DNA, 20 bp, Artificial Sequence
  chemically synthesized
ccatctttgagacccatagg

SEQ ID NO: 165736 - DNA, 20 bp, Artificial Sequence
  chemically synthesized
cctgtcgtagtacttcctat

SEQ ID NO: 165737 - DNA, 20 bp, Artificial Sequence
  chemically synthesized
acctgtcgtagtacttccta

SEQ ID NO: 165738 - DNA, 20 bp, Artificial Sequence
  chemically synthesized
acccataggaagtactacga

SEQ ID NO: 165739 - DNA, 20 bp, Artificial Sequence
  chemically synthesized
cccataggaagtactacgac

SEQ ID NO: 165740 - DNA, 20 bp, Artificial Sequence
  chemically synthesized
gtgtcccagagtacctgtcg

SEQ ID NO: 165741 - DNA, 20 bp, Artificial Sequence
  chemically synthesized
aagtactacgacaggtactc

SEQ ID NO: 165742 - DNA, 20 bp, Artificial Sequence
  chemically synthesized
agtactacgacaggtactct

SEQ ID NO: 165743 - DNA, 20 bp, Artificial Sequence
  chemically synthesized
acgacaggtactctgggaca

SEQ ID NO: 165744 - DNA, 20 bp, Artificial Sequence
  chemically synthesized
catcagaagtctgtgtccca

SEQ ID NO: 165745 - DNA, 20 bp, Artificial Sequence
  chemically synthesized
ggcatcagaagtctgtgtcc

SEQ ID NO: 165746 - DNA, 20 bp, Artificial Sequence
  chemically synthesized
tatttaagcaatggcatcag

SEQ ID NO: 165747 - DNA, 20 bp, Artificial Sequence
  chemically synthesized
agttatttaagcaatggcat

SEQ ID NO: 165748 - DNA, 20 bp, Artificial Sequence
  chemically synthesized
tctcgaagttatttaagcaa

SEQ ID NO: 165749 - DNA, 20 bp, Artificial Sequence
  chemically synthesized
gtataatctcgaagttattt

SEQ ID NO: 165750 - DNA, 20 bp, Artificial Sequence
  chemically synthesized
gccattgcttaaataacttc

SEQ ID NO: 165751 - DNA, 20 bp, Artificial Sequence
  chemically synthesized
tgtccaatggtataatctcg

SEQ ID NO: 165752 - DNA, 20 bp, Artificial Sequence
  chemically synthesized
taacttcgagattataccat

SEQ ID NO: 165753 - DNA, 20 bp, Artificial Sequence
  chemically synthesized
cgagattataccattggaca

SEQ ID NO: 165754 - DNA, 20 bp, Artificial Sequence
  chemically synthesized
taaatcctgactttgtccaa

SEQ ID NO: 165755 - DNA, 20 bp, Artificial Sequence
  chemically synthesized
attataccattggacaaagt

SEQ ID NO: 165756 - DNA, 20 bp, Artificial Sequence
  chemically synthesized
ttataccattggacaaagtc

SEQ ID NO: 165757 - DNA, 20 bp, Artificial Sequence
  chemically synthesized
aggatttatgaaactctgtg

SEQ ID NO: 165758 - DNA, 20 bp, Artificial Sequence
  chemically synthesized
atttatgaaactctgtgaag

SEQ ID NO: 165759 - DNA, 20 bp, Artificial Sequence
  chemically synthesized
aactcatcagcttcttcaca

SEQ ID NO: 165760 - DNA, 20 bp, Artificial Sequence
  chemically synthesized
tgaactcatcagcttcttca

SEQ ID NO: 165761 - DNA, 20 bp, Artificial Sequence
  chemically synthesized
aactctgtgaagaagctgat

SEQ ID NO: 165762 - DNA, 20 bp, Artificial Sequence
  chemically synthesized
tagtagtttcatgaactcat

SEQ ID NO: 165763 - DNA, 20 bp, Artificial Sequence
  chemically synthesized
gttcatgaaactactaactc

SEQ ID NO: 165764 - DNA, 20 bp, Artificial Sequence
  chemically synthesized
cttgcttgatcttgagttag

SEQ ID NO: 165765 - DNA, 20 bp, Artificial Sequence
  chemically synthesized
tgtcttgcttgatcttgagt

SEQ ID NO: 165766 - DNA, 20 bp, Artificial Sequence
  chemically synthesized
gaaactactaactcaagatc

SEQ ID NO: 165767 - DNA, 20 bp, Artificial Sequence
  chemically synthesized
ttcttgtcttgcttgatctt

SEQ ID NO: 165768 - DNA, 20 bp, Artificial Sequence
  chemically synthesized
ctactaactcaagatcaagc

SEQ ID NO: 165769 - DNA, 20 bp, Artificial Sequence
  chemically synthesized
aactcaagatcaagcaagac

SEQ ID NO: 165770 - DNA, 20 bp, Artificial Sequence
  chemically synthesized
caagacaagaattaactaca

SEQ ID NO: 165771 - DNA, 20 bp, Artificial Sequence
  chemically synthesized
aagacaagaattaactacat

SEQ ID NO: 165772 - DNA, 20 bp, Artificial Sequence
  chemically synthesized
tcagttcattcaggcccatg

SEQ ID NO: 165773 - DNA, 20 bp, Artificial Sequence
  chemically synthesized
aatcttttatcagttcattc

SEQ ID NO: 165774 - DNA, 20 bp, Artificial Sequence
  chemically synthesized
aaatcttttatcagttcatt

SEQ ID NO: 165775 - DNA, 20 bp, Artificial Sequence
  chemically synthesized
gggcctgaatgaactgataa

SEQ ID NO: 165776 - DNA, 20 bp, Artificial Sequence
  chemically synthesized
gccataatcaaatcttttat

SEQ ID NO: 165777 - DNA, 20 bp, Artificial Sequence
  chemically synthesized
actgataaaagatttgatta

SEQ ID NO: 165778 - DNA, 20 bp, Artificial Sequence
  chemically synthesized
atgaggaatattttaaacaa

SEQ ID NO: 165779 - DNA, 20 bp, Artificial Sequence
  chemically synthesized
aaacagaacattaaaacatg

SEQ ID NO: 165780 - DNA, 20 bp, Artificial Sequence
  chemically synthesized
caaacagaacattaaaacat

SEQ ID NO: 165781 - DNA, 20 bp, Artificial Sequence
  chemically synthesized
cgtttcttgtatttagcaaa

SEQ ID NO: 165782 - DNA, 20 bp, Artificial Sequence
  chemically synthesized
atgttctgtttgctaaatac

SEQ ID NO: 165783 - DNA, 20 bp, Artificial Sequence
  chemically synthesized
ggaaaggcgtttcttgtatt

SEQ ID NO: 165784 - DNA, 20 bp, Artificial Sequence
  chemically synthesized
taacttaagagaaaaaggaa

SEQ ID NO: 165785 - DNA, 20 bp, Artificial Sequence
  chemically synthesized
ataacttaagagaaaaagga

SEQ ID NO: 165786 - DNA, 20 bp, Artificial Sequence
  chemically synthesized
atagataacttaagagaaaa

SEQ ID NO: 165787 - DNA, 20 bp, Artificial Sequence
  chemically synthesized
tatagataacttaagagaaa

SEQ ID NO: 165788 - DNA, 20 bp, Artificial Sequence
  chemically synthesized
acgcctttcctttttctctt

SEQ ID NO: 165789 - DNA, 20 bp, Artificial Sequence
  chemically synthesized
atgagttatagataacttaa

SEQ ID NO: 165790 - DNA, 20 bp, Artificial Sequence
  chemically synthesized
tcatgagttatagataactt

SEQ ID NO: 165791 - DNA, 20 bp, Artificial Sequence
  chemically synthesized
ctctaaattctcatgagtta

SEQ ID NO: 165792 - DNA, 20 bp, Artificial Sequence
  chemically synthesized
ttaagttatctataactcat

SEQ ID NO: 165793 - DNA, 20 bp, Artificial Sequence
  chemically synthesized
agcatactctaaattctcat

SEQ ID NO: 165794 - DNA, 20 bp, Artificial Sequence
  chemically synthesized
atctataactcatgagaatt

SEQ ID NO: 165795 - DNA, 20 bp, Artificial Sequence
  chemically synthesized
ctataactcatgagaattta

SEQ ID NO: 165796 - DNA, 20 bp, Artificial Sequence
  chemically synthesized
ttagagtatgcttttgtaaa

SEQ ID NO: 165797 - DNA, 20 bp, Artificial Sequence
  chemically synthesized
atgtttcattctgtttacaa

SEQ ID NO: 165798 - DNA, 20 bp, Artificial Sequence
  chemically synthesized
agggatcaggcagggataaa

SEQ ID NO: 165799 - DNA, 20 bp, Artificial Sequence
  chemically synthesized
aattttacagggatcaggca

SEQ ID NO: 165800 - DNA, 20 bp, Artificial Sequence
  chemically synthesized
gaattttacagggatcaggc

SEQ ID NO: 165801 - DNA, 20 bp, Artificial Sequence
  chemically synthesized
tgaattttacagggatcagg

SEQ ID NO: 165802 - DNA, 20 bp, Artificial Sequence
  chemically synthesized
ttctgaattttacagggatc

SEQ ID NO: 165803 - DNA, 20 bp, Artificial Sequence
  chemically synthesized
tttctgaattttacagggat

SEQ ID NO: 165804 - DNA, 20 bp, Artificial Sequence
  chemically synthesized
aagaatttctgaattttaca

SEQ ID NO: 165805 - DNA, 20 bp, Artificial Sequence
  chemically synthesized
taagaatttctgaattttac

SEQ ID NO: 165806 - DNA, 20 bp, Artificial Sequence
  chemically synthesized
tgcctgatccctgtaaaatt

SEQ ID NO: 165807 - DNA, 20 bp, Artificial Sequence
  chemically synthesized
gtaagaatttctgaatttta

SEQ ID NO: 165808 - DNA, 20 bp, Artificial Sequence
  chemically synthesized
aaaattcagaaattcttacc

SEQ ID NO: 165809 - DNA, 20 bp, Artificial Sequence
  chemically synthesized
tgaaaataagaatactcggt

SEQ ID NO: 165810 - DNA, 20 bp, Artificial Sequence
  chemically synthesized
gccatgaaaataagaatact

SEQ ID NO: 165811 - DNA, 20 bp, Artificial Sequence
  chemically synthesized
accgagtattcttattttca

SEQ ID NO: 165812 - DNA, 20 bp, Artificial Sequence
  chemically synthesized
aattatattgccatgaaaat

SEQ ID NO: 165813 - DNA, 20 bp, Artificial Sequence
  chemically synthesized
tggcaatataattatttgca

SEQ ID NO: 165814 - DNA, 20 bp, Artificial Sequence
  chemically synthesized
ggcaatataattatttgcat

SEQ ID NO: 165815 - DNA, 20 bp, Artificial Sequence
  chemically synthesized
gttacctaaatatatttatt

SEQ ID NO: 165816 - DNA, 20 bp, Artificial Sequence
  chemically synthesized
ataggctcaataaatatatt

SEQ ID NO: 165817 - DNA, 20 bp, Artificial Sequence
  chemically synthesized
taggctcaataaatatattt

SEQ ID NO: 165818 - DNA, 20 bp, Artificial Sequence
  chemically synthesized
aataaatatatttaggtaac

SEQ ID NO: 165819 - DNA, 20 bp, Artificial Sequence
  chemically synthesized
attgaaaaaaatatataacc

SEQ ID NO: 165820 - DNA, 20 bp, Artificial Sequence
  chemically synthesized
ttgaaaaaaatatataacca

SEQ ID NO: 165821 - DNA, 20 bp, Artificial Sequence
  chemically synthesized
tgacattccagtcaaagcct

SEQ ID NO: 165822 - DNA, 20 bp, Artificial Sequence
  chemically synthesized
tatataaccaaggctttgac

SEQ ID NO: 165823 - DNA, 20 bp, Artificial Sequence
  chemically synthesized
caaatatgacattccagtca

SEQ ID NO: 165824 - DNA, 20 bp, Artificial Sequence
  chemically synthesized
aattctcaaatatgacattc

SEQ ID NO: 165825 - DNA, 20 bp, Artificial Sequence
  chemically synthesized
ttgactggaatgtcatattt

SEQ ID NO: 165826 - DNA, 20 bp, Artificial Sequence
  chemically synthesized
gaatgtcatatttgagaatt

SEQ ID NO: 165827 - DNA, 20 bp, Artificial Sequence
  chemically synthesized
atatttgagaattaagtgca

SEQ ID NO: 165828 - DNA, 20 bp, Artificial Sequence
  chemically synthesized
atttgagaattaagtgcata

SEQ ID NO: 165829 - DNA, 20 bp, Artificial Sequence
  chemically synthesized
gagaattaagtgcatagagt

SEQ ID NO: 165830 - DNA, 20 bp, Artificial Sequence
  chemically synthesized
tgcatagagtcagatgtgac

SEQ ID NO: 165831 - DNA, 20 bp, Artificial Sequence
  chemically synthesized
agtcagatgtgaccagtttt

SEQ ID NO: 165832 - DNA, 20 bp, Artificial Sequence
  chemically synthesized
gtcagatgtgaccagtttta

SEQ ID NO: 165833 - DNA, 20 bp, Artificial Sequence
  chemically synthesized
caagagtagctccttaaaac

SEQ ID NO: 165834 - DNA, 20 bp, Artificial Sequence
  chemically synthesized
cagatgtgaccagttttaag

SEQ ID NO: 165835 - DNA, 20 bp, Artificial Sequence
  chemically synthesized
tagctccatatagtcaagag

SEQ ID NO: 165836 - DNA, 20 bp, Artificial Sequence
  chemically synthesized
tattagctccatatagtcaa

SEQ ID NO: 165837 - DNA, 20 bp, Artificial Sequence
  chemically synthesized
aggagctactcttgactata

SEQ ID NO: 165838 - DNA, 20 bp, Artificial Sequence
  chemically synthesized
tatattagctccatatagtc

SEQ ID NO: 165839 - DNA, 20 bp, Artificial Sequence
  chemically synthesized
gagctactcttgactatatg

SEQ ID NO: 165840 - DNA, 20 bp, Artificial Sequence
  chemically synthesized
gggcttatattagctccata

SEQ ID NO: 165841 - DNA, 20 bp, Artificial Sequence
  chemically synthesized
tgactatatggagctaatat

SEQ ID NO: 165842 - DNA, 20 bp, Artificial Sequence
  chemically synthesized
ttcccaaaaggggcttatat

SEQ ID NO: 165843 - DNA, 20 bp, Artificial Sequence
  chemically synthesized
gagctaatataagccccttt

SEQ ID NO: 165844 - DNA, 20 bp, Artificial Sequence
  chemically synthesized
agctaatataagcccctttt

SEQ ID NO: 165845 - DNA, 20 bp, Artificial Sequence
  chemically synthesized
cgggacagttttcccaaaag

SEQ ID NO: 165846 - DNA, 20 bp, Artificial Sequence
  chemically synthesized
ccgggacagttttcccaaaa

SEQ ID NO: 165847 - DNA, 20 bp, Artificial Sequence
  chemically synthesized
accgggacagttttcccaaa

SEQ ID NO: 165848 - DNA, 20 bp, Artificial Sequence
  chemically synthesized
taccgggacagttttcccaa

SEQ ID NO: 165849 - DNA, 20 bp, Artificial Sequence
  chemically synthesized
cccttttgggaaaactgtcc

SEQ ID NO: 165850 - DNA, 20 bp, Artificial Sequence
  chemically synthesized
ctgtaagccaggtaccggga

SEQ ID NO: 165851 - DNA, 20 bp, Artificial Sequence
  chemically synthesized
gggaaaactgtcccggtacc

SEQ ID NO: 165852 - DNA, 20 bp, Artificial Sequence
  chemically synthesized
aattctgtaagccaggtacc

SEQ ID NO: 165853 - DNA, 20 bp, Artificial Sequence
  chemically synthesized
gaattctgtaagccaggtac

SEQ ID NO: 165854 - DNA, 20 bp, Artificial Sequence
  chemically synthesized
ctgtcccggtacctggctta

SEQ ID NO: 165855 - DNA, 20 bp, Artificial Sequence
  chemically synthesized
gattgggaattctgtaagcc

SEQ ID NO: 165856 - DNA, 20 bp, Artificial Sequence
  chemically synthesized
agattgggaattctgtaagc

SEQ ID NO: 165857 - DNA, 20 bp, Artificial Sequence
  chemically synthesized
tgtaagattgggaattctgt

SEQ ID NO: 165858 - DNA, 20 bp, Artificial Sequence
  chemically synthesized
ccttactcagttgtaagatt

SEQ ID NO: 165859 - DNA, 20 bp, Artificial Sequence
  chemically synthesized
tccttactcagttgtaagat

SEQ ID NO: 165860 - DNA, 20 bp, Artificial Sequence
  chemically synthesized
gaattcccaatcttacaact

SEQ ID NO: 165861 - DNA, 20 bp, Artificial Sequence
  chemically synthesized
gaccttccttactcagttgt

SEQ ID NO: 165862 - DNA, 20 bp, Artificial Sequence
  chemically synthesized
tcccaatcttacaactgagt

SEQ ID NO: 165863 - DNA, 20 bp, Artificial Sequence
  chemically synthesized
cccaatcttacaactgagta

SEQ ID NO: 165864 - DNA, 20 bp, Artificial Sequence
  chemically synthesized
aatcttacaactgagtaagg

SEQ ID NO: 165865 - DNA, 20 bp, Artificial Sequence
  chemically synthesized
aagaatagaccttccttact

SEQ ID NO: 165866 - DNA, 20 bp, Artificial Sequence
  chemically synthesized
atcttacaactgagtaagga

SEQ ID NO: 165867 - DNA, 20 bp, Artificial Sequence
  chemically synthesized
gagtaaggaaggtctattct

SEQ ID NO: 165868 - DNA, 20 bp, Artificial Sequence
  chemically synthesized
agtaaggaaggtctattctt

SEQ ID NO: 165869 - DNA, 20 bp, Artificial Sequence
  chemically synthesized
taaggaaggtctattcttag

SEQ ID NO: 165870 - DNA, 20 bp, Artificial Sequence
  chemically synthesized
tttcctgggtctcctaagaa

SEQ ID NO: 165871 - DNA, 20 bp, Artificial Sequence
  chemically synthesized
cttggtttcctgggtctcct

SEQ ID NO: 165872 - DNA, 20 bp, Artificial Sequence
  chemically synthesized
aggtctattcttaggagacc

SEQ ID NO: 165873 - DNA, 20 bp, Artificial Sequence
  chemically synthesized
ggtctattcttaggagaccc

SEQ ID NO: 165874 - DNA, 20 bp, Artificial Sequence
  chemically synthesized
taaaatacccttggtttcct

SEQ ID NO: 165875 - DNA, 20 bp, Artificial Sequence
  chemically synthesized
cttaggagacccaggaaacc

SEQ ID NO: 165876 - DNA, 20 bp, Artificial Sequence
  chemically synthesized
ctaaaatacccttggtttcc

SEQ ID NO: 165877 - DNA, 20 bp, Artificial Sequence
  chemically synthesized
ttaggagacccaggaaacca

SEQ ID NO: 165878 - DNA, 20 bp, Artificial Sequence
  chemically synthesized
taggagacccaggaaaccaa

SEQ ID NO: 165879 - DNA, 20 bp, Artificial Sequence
  chemically synthesized
ccaggttcctaaaataccct

SEQ ID NO: 165880 - DNA, 20 bp, Artificial Sequence
  chemically synthesized
ccaggaaaccaagggtattt

SEQ ID NO: 165881 - DNA, 20 bp, Artificial Sequence
  chemically synthesized
caggaaaccaagggtatttt

SEQ ID NO: 165882 - DNA, 20 bp, Artificial Sequence
  chemically synthesized
ccaagggtattttaggaacc

SEQ ID NO: 165883 - DNA, 20 bp, Artificial Sequence
  chemically synthesized
tattttaggaacctggaaaa

SEQ ID NO: 165884 - DNA, 20 bp, Artificial Sequence
  chemically synthesized
gctgaagtgttctgttttcc

SEQ ID NO: 165885 - DNA, 20 bp, Artificial Sequence
  chemically synthesized
agctgaagtgttctgttttc

SEQ ID NO: 165886 - DNA, 20 bp, Artificial Sequence
  chemically synthesized
acctggaaaacagaacactt

SEQ ID NO: 165887 - DNA, 20 bp, Artificial Sequence
  chemically synthesized
aatacctatagattcagctg

SEQ ID NO: 165888 - DNA, 20 bp, Artificial Sequence
  chemically synthesized
gaacacttcagctgaatcta

SEQ ID NO: 165889 - DNA, 20 bp, Artificial Sequence
  chemically synthesized
aacacttcagctgaatctat

SEQ ID NO: 165890 - DNA, 20 bp, Artificial Sequence
  chemically synthesized
aagtaaaatacctatagatt

SEQ ID NO: 165891 - DNA, 20 bp, Artificial Sequence
  chemically synthesized
tacctgaagtaaaataccta

SEQ ID NO: 165892 - DNA, 20 bp, Artificial Sequence
  chemically synthesized
aatctataggtattttactt

SEQ ID NO: 165893 - DNA, 20 bp, Artificial Sequence
  chemically synthesized
atctataggtattttacttc

SEQ ID NO: 165894 - DNA, 20 bp, Artificial Sequence
  chemically synthesized
ttgacatcagattttacctg

SEQ ID NO: 165895 - DNA, 20 bp, Artificial Sequence
  chemically synthesized
ttcaggtaaaatctgatgtc

SEQ ID NO: 165896 - DNA, 20 bp, Artificial Sequence
  chemically synthesized
gcaagtcaagaacttgacat

SEQ ID NO: 165897 - DNA, 20 bp, Artificial Sequence
  chemically synthesized
aaagtttaggaaggcaagtc

SEQ ID NO: 165898 - DNA, 20 bp, Artificial Sequence
  chemically synthesized
tctccaaagtttaggaaggc

SEQ ID NO: 165899 - DNA, 20 bp, Artificial Sequence
  chemically synthesized
aaagtctccaaagtttagga

SEQ ID NO: 165900 - DNA, 20 bp, Artificial Sequence
  chemically synthesized
aaaagtctccaaagtttagg

SEQ ID NO: 165901 - DNA, 20 bp, Artificial Sequence
  chemically synthesized
tgacttgccttcctaaactt

SEQ ID NO: 165902 - DNA, 20 bp, Artificial Sequence
  chemically synthesized
tttaaaagtctccaaagttt

SEQ ID NO: 165903 - DNA, 20 bp, Artificial Sequence
  chemically synthesized
acttgccttcctaaactttg

SEQ ID NO: 165904 - DNA, 20 bp, Artificial Sequence
  chemically synthesized
ttttaaaagtctccaaagtt

SEQ ID NO: 165905 - DNA, 20 bp, Artificial Sequence
  chemically synthesized
tgattttttaaaagtctcca

SEQ ID NO: 165906 - DNA, 20 bp, Artificial Sequence
  chemically synthesized
cctcagatttgattttttaa

SEQ ID NO: 165907 - DNA, 20 bp, Artificial Sequence
  chemically synthesized
acttttaaaaaatcaaatct

SEQ ID NO: 165908 - DNA, 20 bp, Artificial Sequence
  chemically synthesized
cttttaaaaaatcaaatctg

SEQ ID NO: 165909 - DNA, 20 bp, Artificial Sequence
  chemically synthesized
gtttaaaaaatatgaaacct

SEQ ID NO: 165910 - DNA, 20 bp, Artificial Sequence
  chemically synthesized
attttttaaactactttatt

SEQ ID NO: 165911 - DNA, 20 bp, Artificial Sequence
  chemically synthesized
tcaatcatacctcaataaag

SEQ ID NO: 165912 - DNA, 20 bp, Artificial Sequence
  chemically synthesized
ttttttaaactactttattg

SEQ ID NO: 165913 - DNA, 20 bp, Artificial Sequence
  chemically synthesized
ttgtcaatcatacctcaata

SEQ ID NO: 165914 - DNA, 20 bp, Artificial Sequence
  chemically synthesized
attgaggtatgattgacaaa

SEQ ID NO: 165915 - DNA, 20 bp, Artificial Sequence
  chemically synthesized
aggtatgattgacaaacaga

SEQ ID NO: 165916 - DNA, 20 bp, Artificial Sequence
  chemically synthesized
ttctatgcattaaatatgta

SEQ ID NO: 165917 - DNA, 20 bp, Artificial Sequence
  chemically synthesized
agctgtacatatttaatgca

SEQ ID NO: 165918 - DNA, 20 bp, Artificial Sequence
  chemically synthesized
tttaatgcatagaacttgat

SEQ ID NO: 165919 - DNA, 20 bp, Artificial Sequence
  chemically synthesized
actttatctccaaactcatc

SEQ ID NO: 165920 - DNA, 20 bp, Artificial Sequence
  chemically synthesized
tgcatagaacttgatgagtt

SEQ ID NO: 165921 - DNA, 20 bp, Artificial Sequence
  chemically synthesized
catagaacttgatgagtttg

SEQ ID NO: 165922 - DNA, 20 bp, Artificial Sequence
  chemically synthesized
acttgatgagtttggagata

SEQ ID NO: 165923 - DNA, 20 bp, Artificial Sequence
  chemically synthesized
tatggcatagattgtggtat

SEQ ID NO: 165924 - DNA, 20 bp, Artificial Sequence
  chemically synthesized
taggtttatggcatagattg

SEQ ID NO: 165925 - DNA, 20 bp, Artificial Sequence
  chemically synthesized
taacgcataggtttatggca

SEQ ID NO: 165926 - DNA, 20 bp, Artificial Sequence
  chemically synthesized
ggaggtaacgcataggttta

SEQ ID NO: 165927 - DNA, 20 bp, Artificial Sequence
  chemically synthesized
aacttttggaggtaacgcat

SEQ ID NO: 165928 - DNA, 20 bp, Artificial Sequence
  chemically synthesized
aaacttttggaggtaacgca

SEQ ID NO: 165929 - DNA, 20 bp, Artificial Sequence
  chemically synthesized
aacctatgcgttacctccaa

SEQ ID NO: 165930 - DNA, 20 bp, Artificial Sequence
  chemically synthesized
aggtgagaggaaacttttgg

SEQ ID NO: 165931 - DNA, 20 bp, Artificial Sequence
  chemically synthesized
aaggtgagaggaaacttttg

SEQ ID NO: 165932 - DNA, 20 bp, Artificial Sequence
  chemically synthesized
ataaggtgagaggaaacttt

SEQ ID NO: 165933 - DNA, 20 bp, Artificial Sequence
  chemically synthesized
gcagtggtacataaggtgag

SEQ ID NO: 165934 - DNA, 20 bp, Artificial Sequence
  chemically synthesized
agcagtggtacataaggtga

SEQ ID NO: 165935 - DNA, 20 bp, Artificial Sequence
  chemically synthesized
ggagcagtggtacataaggt

SEQ ID NO: 165936 - DNA, 20 bp, Artificial Sequence
  chemically synthesized
tttaggagcagtggtacata

SEQ ID NO: 165937 - DNA, 20 bp, Artificial Sequence
  chemically synthesized
ttttaggagcagtggtacat

SEQ ID NO: 165938 - DNA, 20 bp, Artificial Sequence
  chemically synthesized
ctactctcttttaggagcag

SEQ ID NO: 165939 - DNA, 20 bp, Artificial Sequence
  chemically synthesized
ttatgtaccactgctcctaa

SEQ ID NO: 165940 - DNA, 20 bp, Artificial Sequence
  chemically synthesized
ctactactctcttttaggag

SEQ ID NO: 165941 - DNA, 20 bp, Artificial Sequence
  chemically synthesized
atgtaccactgctcctaaaa

SEQ ID NO: 165942 - DNA, 20 bp, Artificial Sequence
  chemically synthesized
atactactactctcttttag

SEQ ID NO: 165943 - DNA, 20 bp, Artificial Sequence
  chemically synthesized
gtaccactgctcctaaaaga

SEQ ID NO: 165944 - DNA, 20 bp, Artificial Sequence
  chemically synthesized
aaatactactactctctttt

SEQ ID NO: 165945 - DNA, 20 bp, Artificial Sequence
  chemically synthesized
aaaatactactactctcttt

SEQ ID NO: 165946 - DNA, 20 bp, Artificial Sequence
  chemically synthesized
ccactgctcctaaaagagag

SEQ ID NO: 165947 - DNA, 20 bp, Artificial Sequence
  chemically synthesized
ctgctcctaaaagagagtag

SEQ ID NO: 165948 - DNA, 20 bp, Artificial Sequence
  chemically synthesized
aagagagtagtagtattttg

SEQ ID NO: 165949 - DNA, 20 bp, Artificial Sequence
  chemically synthesized
gagtagtagtattttgtggt

SEQ ID NO: 165950 - DNA, 20 bp, Artificial Sequence
  chemically synthesized
atttgctgagggcagagttt

SEQ ID NO: 165951 - DNA, 20 bp, Artificial Sequence
  chemically synthesized
gaacacttaaactctgccct

SEQ ID NO: 165952 - DNA, 20 bp, Artificial Sequence
  chemically synthesized
ttagaaatttgctgagggca

SEQ ID NO: 165953 - DNA, 20 bp, Artificial Sequence
  chemically synthesized
aattagaaatttgctgaggg

SEQ ID NO: 165954 - DNA, 20 bp, Artificial Sequence
  chemically synthesized
tacaattagaaatttgctga

SEQ ID NO: 165955 - DNA, 20 bp, Artificial Sequence
  chemically synthesized
gtacaattagaaatttgctg

SEQ ID NO: 165956 - DNA, 20 bp, Artificial Sequence
  chemically synthesized
tgtacaattagaaatttgct

SEQ ID NO: 165957 - DNA, 20 bp, Artificial Sequence
  chemically synthesized
tcagcaaatttctaattgta

SEQ ID NO: 165958 - DNA, 20 bp, Artificial Sequence
  chemically synthesized
acgatactgtactgtacaat

SEQ ID NO: 165959 - DNA, 20 bp, Artificial Sequence
  chemically synthesized
aaatttctaattgtacagta

SEQ ID NO: 165960 - DNA, 20 bp, Artificial Sequence
  chemically synthesized
cagtacagtatcgttaacta

SEQ ID NO: 165961 - DNA, 20 bp, Artificial Sequence
  chemically synthesized
agtacagtatcgttaactat

SEQ ID NO: 165962 - DNA, 20 bp, Artificial Sequence
  chemically synthesized
actgtacagcatagtgccta

SEQ ID NO: 165963 - DNA, 20 bp, Artificial Sequence
  chemically synthesized
actataggcactatgctgta

SEQ ID NO: 165964 - DNA, 20 bp, Artificial Sequence
  chemically synthesized
cagagatatactgtacagca

SEQ ID NO: 165965 - DNA, 20 bp, Artificial Sequence
  chemically synthesized
agtttcagagatatactgta

SEQ ID NO: 165966 - DNA, 20 bp, Artificial Sequence
  chemically synthesized
cacaagctgaataagtttca

SEQ ID NO: 165967 - DNA, 20 bp, Artificial Sequence
  chemically synthesized
atcacaagctgaataagttt

SEQ ID NO: 165968 - DNA, 20 bp, Artificial Sequence
  chemically synthesized
gtatatctctgaaacttatt

SEQ ID NO: 165969 - DNA, 20 bp, Artificial Sequence
  chemically synthesized
tgaagaatcacaagctgaat

SEQ ID NO: 165970 - DNA, 20 bp, Artificial Sequence
  chemically synthesized
aagttttcatgaagaatcac

SEQ ID NO: 165971 - DNA, 20 bp, Artificial Sequence
  chemically synthesized
attagctggaagttttcatg

SEQ ID NO: 165972 - DNA, 20 bp, Artificial Sequence
  chemically synthesized
tgattcttcatgaaaacttc

SEQ ID NO: 165973 - DNA, 20 bp, Artificial Sequence
  chemically synthesized
ttttaagtgtgattagctgg

SEQ ID NO: 165974 - DNA, 20 bp, Artificial Sequence
  chemically synthesized
ctattttaagtgtgattagc

SEQ ID NO: 165975 - DNA, 20 bp, Artificial Sequence
  chemically synthesized
taggctattttaagtgtgat

SEQ ID NO: 165976 - DNA, 20 bp, Artificial Sequence
  chemically synthesized
ccagctaatcacacttaaaa

SEQ ID NO: 165977 - DNA, 20 bp, Artificial Sequence
  chemically synthesized
tttaccaaataggctatttt

SEQ ID NO: 165978 - DNA, 20 bp, Artificial Sequence
  chemically synthesized
cacacttaaaatagcctatt

SEQ ID NO: 165979 - DNA, 20 bp, Artificial Sequence
  chemically synthesized
aaaatggtaatttaccaaat

SEQ ID NO: 165980 - DNA, 20 bp, Artificial Sequence
  chemically synthesized
aaaaatggtaatttaccaaa

SEQ ID NO: 165981 - DNA, 20 bp, Artificial Sequence
  chemically synthesized
ttatataggggtagcaaaaa

SEQ ID NO: 165982 - DNA, 20 bp, Artificial Sequence
  chemically synthesized
cctatttatttatatagggg

SEQ ID NO: 165983 - DNA, 20 bp, Artificial Sequence
  chemically synthesized
tggcctatttatttatatag

SEQ ID NO: 165984 - DNA, 20 bp, Artificial Sequence
  chemically synthesized
ctggcctatttatttatata

SEQ ID NO: 165985 - DNA, 20 bp, Artificial Sequence
  chemically synthesized
actggcctatttatttatat

SEQ ID NO: 165986 - DNA, 20 bp, Artificial Sequence
  chemically synthesized
gactggcctatttatttata

SEQ ID NO: 165987 - DNA, 20 bp, Artificial Sequence
  chemically synthesized
gctacccctatataaataaa

SEQ ID NO: 165988 - DNA, 20 bp, Artificial Sequence
  chemically synthesized
ctacccctatataaataaat

SEQ ID NO: 165989 - DNA, 20 bp, Artificial Sequence
  chemically synthesized
ccctatataaataaataggc

SEQ ID NO: 165990 - DNA, 20 bp, Artificial Sequence
  chemically synthesized
ccttgtttataaaataagac

SEQ ID NO: 165991 - DNA, 20 bp, Artificial Sequence
  chemically synthesized
actttccttgtttataaaat

SEQ ID NO: 165992 - DNA, 20 bp, Artificial Sequence
  chemically synthesized
gccagtcttattttataaac

SEQ ID NO: 165993 - DNA, 20 bp, Artificial Sequence
  chemically synthesized
ccagtcttattttataaaca

SEQ ID NO: 165994 - DNA, 20 bp, Artificial Sequence
  chemically synthesized
tcttattttataaacaagga

SEQ ID NO: 165995 - DNA, 20 bp, Artificial Sequence
  chemically synthesized
tgatcagtgttaatcaaagt

SEQ ID NO: 165996 - DNA, 20 bp, Artificial Sequence
  chemically synthesized
cttttgatcagtgttaatca

SEQ ID NO: 165997 - DNA, 20 bp, Artificial Sequence
  chemically synthesized
ctttgattaacactgatcaa

SEQ ID NO: 165998 - DNA, 20 bp, Artificial Sequence
  chemically synthesized
tttgattaacactgatcaaa

SEQ ID NO: 165999 - DNA, 20 bp, Artificial Sequence
  chemically synthesized
ttgattaacactgatcaaaa

SEQ ID NO: 166000 - DNA, 20 bp, Artificial Sequence
  chemically synthesized
tctaccatcacccttttgat

SEQ ID NO: 166001 - DNA, 20 bp, Artificial Sequence
  chemically synthesized
aacactgatcaaaagggtga

SEQ ID NO: 166002 - DNA, 20 bp, Artificial Sequence
  chemically synthesized
actgatcaaaagggtgatgg

SEQ ID NO: 166003 - DNA, 20 bp, Artificial Sequence
  chemically synthesized
tgatcaaaagggtgatggta

SEQ ID NO: 166004 - DNA, 20 bp, Artificial Sequence
  chemically synthesized
caaaagggtgatggtagaga

SEQ ID NO: 166005 - DNA, 20 bp, Artificial Sequence
  chemically synthesized
aaagggtgatggtagagata

SEQ ID NO: 166006 - DNA, 20 bp, Artificial Sequence
  chemically synthesized
tgatggtagagatagagttt

SEQ ID NO: 166007 - DNA, 20 bp, Artificial Sequence
  chemically synthesized
gatagagtttcagtaaccct

SEQ ID NO: 166008 - DNA, 20 bp, Artificial Sequence
  chemically synthesized
atagagtttcagtaaccctt

SEQ ID NO: 166009 - DNA, 20 bp, Artificial Sequence
  chemically synthesized
tagagtttcagtaacccttg

SEQ ID NO: 166010 - DNA, 20 bp, Artificial Sequence
  chemically synthesized
ctagaatctgataaccccaa

SEQ ID NO: 166011 - DNA, 20 bp, Artificial Sequence
  chemically synthesized
actagaatctgataacccca

SEQ ID NO: 166012 - DNA, 20 bp, Artificial Sequence
  chemically synthesized
gactagaatctgataacccc

SEQ ID NO: 166013 - DNA, 20 bp, Artificial Sequence
  chemically synthesized
tcagtaacccttggggttat

SEQ ID NO: 166014 - DNA, 20 bp, Artificial Sequence
  chemically synthesized
cccttggggttatcagattc

SEQ ID NO: 166015 - DNA, 20 bp, Artificial Sequence
  chemically synthesized
tcaaagacaatgaacaggac

SEQ ID NO: 166016 - DNA, 20 bp, Artificial Sequence
  chemically synthesized
atagatcaaagacaatgaac

SEQ ID NO: 166017 - DNA, 20 bp, Artificial Sequence
  chemically synthesized
aatagatcaaagacaatgaa

SEQ ID NO: 166018 - DNA, 20 bp, Artificial Sequence
  chemically synthesized
aagaaatgcaaaatagatca

SEQ ID NO: 166019 - DNA, 20 bp, Artificial Sequence
  chemically synthesized
gtttacaaagaaatgcaaaa

SEQ ID NO: 166020 - DNA, 20 bp, Artificial Sequence
  chemically synthesized
aaaaaatcatgtcgtttaca

SEQ ID NO: 166021 - DNA, 20 bp, Artificial Sequence
  chemically synthesized
atccagatcaatttacaggt

SEQ ID NO: 166022 - DNA, 20 bp, Artificial Sequence
  chemically synthesized
gatccagatcaatttacagg

SEQ ID NO: 166023 - DNA, 20 bp, Artificial Sequence
  chemically synthesized
caggatccagatcaatttac

SEQ ID NO: 166024 - DNA, 20 bp, Artificial Sequence
  chemically synthesized
gcaggatccagatcaattta

SEQ ID NO: 166025 - DNA, 20 bp, Artificial Sequence
  chemically synthesized
tacctacctgtaaattgatc

SEQ ID NO: 166026 - DNA, 20 bp, Artificial Sequence
  chemically synthesized
atgtgtaagacagcaggatc

SEQ ID NO: 166027 - DNA, 20 bp, Artificial Sequence
  chemically synthesized
gacaaaatgtgtaagacagc

SEQ ID NO: 166028 - DNA, 20 bp, Artificial Sequence
  chemically synthesized
ggacaaaatgtgtaagacag

SEQ ID NO: 166029 - DNA, 20 bp, Artificial Sequence
  chemically synthesized
gacggacaaaatgtgtaaga

SEQ ID NO: 166030 - DNA, 20 bp, Artificial Sequence
  chemically synthesized
taaggacggacaaaatgtgt

SEQ ID NO: 166031 - DNA, 20 bp, Artificial Sequence
  chemically synthesized
aaactgaaaattggtaagga

SEQ ID NO: 166032 - DNA, 20 bp, Artificial Sequence
  chemically synthesized
aaataaactgaaaattggta

SEQ ID NO: 166033 - DNA, 20 bp, Artificial Sequence
  chemically synthesized
gaaataaactgaaaattggt

SEQ ID NO: 166034 - DNA, 20 bp, Artificial Sequence
  chemically synthesized
tgtccgtccttaccaatttt

SEQ ID NO: 166035 - DNA, 20 bp, Artificial Sequence
  chemically synthesized
aaaggaaataaactgaaaat

SEQ ID NO: 166036 - DNA, 20 bp, Artificial Sequence
  chemically synthesized
gaatcgcagccagattgtaa

SEQ ID NO: 166037 - DNA, 20 bp, Artificial Sequence
  chemically synthesized
agtttatttcctttacaatc

SEQ ID NO: 166038 - DNA, 20 bp, Artificial Sequence
  chemically synthesized
agaatcgcagccagattgta

SEQ ID NO: 166039 - DNA, 20 bp, Artificial Sequence
  chemically synthesized
ttaatttggagaatcgcagc

SEQ ID NO: 166040 - DNA, 20 bp, Artificial Sequence
  chemically synthesized
aatgttaatttggagaatcg

SEQ ID NO: 166041 - DNA, 20 bp, Artificial Sequence
  chemically synthesized
aaatttgaaatgttaatttg

SEQ ID NO: 166042 - DNA, 20 bp, Artificial Sequence
  chemically synthesized
aaaaatttgaaatgttaatt

SEQ ID NO: 166043 - DNA, 20 bp, Artificial Sequence
  chemically synthesized
tcaccaagtcaggatggtgg

SEQ ID NO: 166044 - DNA, 20 bp, Artificial Sequence
  chemically synthesized
tgtcaccaagtcaggatggt

SEQ ID NO: 166045 - DNA, 20 bp, Artificial Sequence
  chemically synthesized
gtgtcaccaagtcaggatgg

SEQ ID NO: 166046 - DNA, 20 bp, Artificial Sequence
  chemically synthesized
tcagtgtcaccaagtcagga

SEQ ID NO: 166047 - DNA, 20 bp, Artificial Sequence
  chemically synthesized
tttctcccaccatcctgact

SEQ ID NO: 166048 - DNA, 20 bp, Artificial Sequence
  chemically synthesized
gttctcagtgtcaccaagtc

SEQ ID NO: 166049 - DNA, 20 bp, Artificial Sequence
  chemically synthesized
agttctcagtgtcaccaagt

SEQ ID NO: 166050 - DNA, 20 bp, Artificial Sequence
  chemically synthesized
ttttagttctcagtgtcacc

SEQ ID NO: 166051 - DNA, 20 bp, Artificial Sequence
  chemically synthesized
catcctgacttggtgacact

SEQ ID NO: 166052 - DNA, 20 bp, Artificial Sequence
  chemically synthesized
ggcagtcacgttttagttct

SEQ ID NO: 166053 - DNA, 20 bp, Artificial Sequence
  chemically synthesized
taatatgggcagtcacgttt

SEQ ID NO: 166054 - DNA, 20 bp, Artificial Sequence
  chemically synthesized
tatctcagtaataatatggg

SEQ ID NO: 166055 - DNA, 20 bp, Artificial Sequence
  chemically synthesized
ccttatctcagtaataatat

SEQ ID NO: 166056 - DNA, 20 bp, Artificial Sequence
  chemically synthesized
tccttatctcagtaataata

SEQ ID NO: 166057 - DNA, 20 bp, Artificial Sequence
  chemically synthesized
tgactgcccatattattact

SEQ ID NO: 166058 - DNA, 20 bp, Artificial Sequence
  chemically synthesized
gcccatattattactgagat

SEQ ID NO: 166059 - DNA, 20 bp, Artificial Sequence
  chemically synthesized
cccatattattactgagata

SEQ ID NO: 166060 - DNA, 20 bp, Artificial Sequence
  chemically synthesized
agagaagagagtccttatct

SEQ ID NO: 166061 - DNA, 20 bp, Artificial Sequence
  chemically synthesized
gagataaggactctcttctc

SEQ ID NO: 166062 - DNA, 20 bp, Artificial Sequence
  chemically synthesized
ataagacaacctagagaaga

SEQ ID NO: 166063 - DNA, 20 bp, Artificial Sequence
  chemically synthesized
agataaggactctcttctct

SEQ ID NO: 166064 - DNA, 20 bp, Artificial Sequence
  chemically synthesized
ctataagacaacctagagaa

SEQ ID NO: 166065 - DNA, 20 bp, Artificial Sequence
  chemically synthesized
agctataagacaacctagag

SEQ ID NO: 166066 - DNA, 20 bp, Artificial Sequence
  chemically synthesized
ggcagctataagacaaccta

SEQ ID NO: 166067 - DNA, 20 bp, Artificial Sequence
  chemically synthesized
atggcagctataagacaacc

SEQ ID NO: 166068 - DNA, 20 bp, Artificial Sequence
  chemically synthesized
ctcttctctaggttgtctta

SEQ ID NO: 166069 - DNA, 20 bp, Artificial Sequence
  chemically synthesized
tgtggggaaatggcagctat

SEQ ID NO: 166070 - DNA, 20 bp, Artificial Sequence
  chemically synthesized
tagatattgtggggaaatgg

SEQ ID NO: 166071 - DNA, 20 bp, Artificial Sequence
  chemically synthesized
ctttagatattgtggggaaa

SEQ ID NO: 166072 - DNA, 20 bp, Artificial Sequence
  chemically synthesized
gggcttctttagatattgtg

SEQ ID NO: 166073 - DNA, 20 bp, Artificial Sequence
  chemically synthesized
agggcttctttagatattgt

SEQ ID NO: 166074 - DNA, 20 bp, Artificial Sequence
  chemically synthesized
cagggcttctttagatattg

SEQ ID NO: 166075 - DNA, 20 bp, Artificial Sequence
  chemically synthesized
ccatttccccacaatatcta

SEQ ID NO: 166076 - DNA, 20 bp, Artificial Sequence
  chemically synthesized
tttccccacaatatctaaag

SEQ ID NO: 166077 - DNA, 20 bp, Artificial Sequence
  chemically synthesized
ttctgcttgcagggcttctt

SEQ ID NO: 166078 - DNA, 20 bp, Artificial Sequence
  chemically synthesized
aatatctaaagaagccctgc

SEQ ID NO: 166079 - DNA, 20 bp, Artificial Sequence
  chemically synthesized
atctaaagaagccctgcaag

SEQ ID NO: 166080 - DNA, 20 bp, Artificial Sequence
  chemically synthesized
tcatccagcttctgcttgca

SEQ ID NO: 166081 - DNA, 20 bp, Artificial Sequence
  chemically synthesized
gtcatccagcttctgcttgc

SEQ ID NO: 166082 - DNA, 20 bp, Artificial Sequence
  chemically synthesized
taaagaagccctgcaagcag

SEQ ID NO: 166083 - DNA, 20 bp, Artificial Sequence
  chemically synthesized
agtcatccagcttctgcttg

SEQ ID NO: 166084 - DNA, 20 bp, Artificial Sequence
  chemically synthesized
gaagccctgcaagcagaagc

SEQ ID NO: 166085 - DNA, 20 bp, Artificial Sequence
  chemically synthesized
gtagtttatagcaagtcatc

SEQ ID NO: 166086 - DNA, 20 bp, Artificial Sequence
  chemically synthesized
agtcctttgtagtttatagc

SEQ ID NO: 166087 - DNA, 20 bp, Artificial Sequence
  chemically synthesized
ggtgagtcctttgtagttta

SEQ ID NO: 166088 - DNA, 20 bp, Artificial Sequence
  chemically synthesized
atgacttgctataaactaca

SEQ ID NO: 166089 - DNA, 20 bp, Artificial Sequence
  chemically synthesized
tgacttgctataaactacaa

SEQ ID NO: 166090 - DNA, 20 bp, Artificial Sequence
  chemically synthesized
ctgtggtggtgagtcctttg

SEQ ID NO: 166091 - DNA, 20 bp, Artificial Sequence
  chemically synthesized
ctacaaaggactcaccacca

SEQ ID NO: 166092 - DNA, 20 bp, Artificial Sequence
  chemically synthesized
acataatttgctgtggtggt

SEQ ID NO: 166093 - DNA, 20 bp, Artificial Sequence
  chemically synthesized
ctatacataatttgctgtgg

SEQ ID NO: 166094 - DNA, 20 bp, Artificial Sequence
  chemically synthesized
tgtctatacataatttgctg

SEQ ID NO: 166095 - DNA, 20 bp, Artificial Sequence
  chemically synthesized
ccaccacagcaaattatgta

SEQ ID NO: 166096 - DNA, 20 bp, Artificial Sequence
  chemically synthesized
gtatagacaactttcatgcc

SEQ ID NO: 166097 - DNA, 20 bp, Artificial Sequence
  chemically synthesized
agcagcagctccaggcatga

SEQ ID NO: 166098 - DNA, 20 bp, Artificial Sequence
  chemically synthesized
atagacaactttcatgcctg

SEQ ID NO: 166099 - DNA, 20 bp, Artificial Sequence
  chemically synthesized
gcctacaaagcagcagctcc

SEQ ID NO: 166100 - DNA, 20 bp, Artificial Sequence
  chemically synthesized
ggcctacaaagcagcagctc

SEQ ID NO: 166101 - DNA, 20 bp, Artificial Sequence
  chemically synthesized
ttgcatggcctacaaagcag

SEQ ID NO: 166102 - DNA, 20 bp, Artificial Sequence
  chemically synthesized
tgcctggagctgctgctttg

SEQ ID NO: 166103 - DNA, 20 bp, Artificial Sequence
  chemically synthesized
gcctggagctgctgctttgt

SEQ ID NO: 166104 - DNA, 20 bp, Artificial Sequence
  chemically synthesized
tttttgcatggcctacaaag

SEQ ID NO: 166105 - DNA, 20 bp, Artificial Sequence
  chemically synthesized
aactttttgcatggcctaca

SEQ ID NO: 166106 - DNA, 20 bp, Artificial Sequence
  chemically synthesized
tgctttgtaggccatgcaaa

SEQ ID NO: 166107 - DNA, 20 bp, Artificial Sequence
  chemically synthesized
agtttactgaactttttgca

SEQ ID NO: 166108 - DNA, 20 bp, Artificial Sequence
  chemically synthesized
tgtaggccatgcaaaaagtt

SEQ ID NO: 166109 - DNA, 20 bp, Artificial Sequence
  chemically synthesized
gcatggcacggaagaggttg

SEQ ID NO: 166110 - DNA, 20 bp, Artificial Sequence
  chemically synthesized
gagcatggcacggaagaggt

SEQ ID NO: 166111 - DNA, 20 bp, Artificial Sequence
  chemically synthesized
cttggagcatggcacggaag

SEQ ID NO: 166112 - DNA, 20 bp, Artificial Sequence
  chemically synthesized
tcttggagcatggcacggaa

SEQ ID NO: 166113 - DNA, 20 bp, Artificial Sequence
  chemically synthesized
tttcttggagcatggcacgg

SEQ ID NO: 166114 - DNA, 20 bp, Artificial Sequence
  chemically synthesized
ggatttcttggagcatggca

SEQ ID NO: 166115 - DNA, 20 bp, Artificial Sequence
  chemically synthesized
cctcttccgtgccatgctcc

SEQ ID NO: 166116 - DNA, 20 bp, Artificial Sequence
  chemically synthesized
ccgatggatttcttggagca

SEQ ID NO: 166117 - DNA, 20 bp, Artificial Sequence
  chemically synthesized
gcaatccgatggatttcttg

SEQ ID NO: 166118 - DNA, 20 bp, Artificial Sequence
  chemically synthesized
tagcaatccgatggatttct

SEQ ID NO: 166119 - DNA, 20 bp, Artificial Sequence
  chemically synthesized
ccatgctccaagaaatccat

SEQ ID NO: 166120 - DNA, 20 bp, Artificial Sequence
  chemically synthesized
ggatggcagtagcaatccga

SEQ ID NO: 166121 - DNA, 20 bp, Artificial Sequence
  chemically synthesized
tggtagagtgaggatggcag

SEQ ID NO: 166122 - DNA, 20 bp, Artificial Sequence
  chemically synthesized
agatggtagagtgaggatgg

SEQ ID NO: 166123 - DNA, 20 bp, Artificial Sequence
  chemically synthesized
ctcagatggtagagtgagga

SEQ ID NO: 166124 - DNA, 20 bp, Artificial Sequence
  chemically synthesized
cattctcagatggtagagtg

SEQ ID NO: 166125 - DNA, 20 bp, Artificial Sequence
  chemically synthesized
gcattctcagatggtagagt

SEQ ID NO: 166126 - DNA, 20 bp, Artificial Sequence
  chemically synthesized
gtaggcattctcagatggta

SEQ ID NO: 166127 - DNA, 20 bp, Artificial Sequence
  chemically synthesized
ccatcctcactctaccatct

SEQ ID NO: 166128 - DNA, 20 bp, Artificial Sequence
  chemically synthesized
ctgtaggcattctcagatgg

SEQ ID NO: 166129 - DNA, 20 bp, Artificial Sequence
  chemically synthesized
gggctgtaggcattctcaga

SEQ ID NO: 166130 - DNA, 20 bp, Artificial Sequence
  chemically synthesized
agctgggctgtaggcattct

SEQ ID NO: 166131 - DNA, 20 bp, Artificial Sequence
  chemically synthesized
ctaccatctgagaatgccta

SEQ ID NO: 166132 - DNA, 20 bp, Artificial Sequence
  chemically synthesized
atctgagaatgcctacagcc

SEQ ID NO: 166133 - DNA, 20 bp, Artificial Sequence
  chemically synthesized
attcctagaagctgggctgt

SEQ ID NO: 166134 - DNA, 20 bp, Artificial Sequence
  chemically synthesized
gattcctagaagctgggctg

SEQ ID NO: 166135 - DNA, 20 bp, Artificial Sequence
  chemically synthesized
aatgcctacagcccagcttc

SEQ ID NO: 166136 - DNA, 20 bp, Artificial Sequence
  chemically synthesized
atgcctacagcccagcttct

SEQ ID NO: 166137 - DNA, 20 bp, Artificial Sequence
  chemically synthesized
caaaaagattcctagaagct

SEQ ID NO: 166138 - DNA, 20 bp, Artificial Sequence
  chemically synthesized
tcaaaaagattcctagaagc

SEQ ID NO: 166139 - DNA, 20 bp, Artificial Sequence
  chemically synthesized
caagtcaaaaagattcctag

SEQ ID NO: 166140 - DNA, 20 bp, Artificial Sequence
  chemically synthesized
cagcaagtcaaaaagattcc

SEQ ID NO: 166141 - DNA, 20 bp, Artificial Sequence
  chemically synthesized
ccagagggcagcaagtcaaa

SEQ ID NO: 166142 - DNA, 20 bp, Artificial Sequence
  chemically synthesized
ttttgagtccagagggcagc

SEQ ID NO: 166143 - DNA, 20 bp, Artificial Sequence
  chemically synthesized
ctttttgacttgctgccctc

SEQ ID NO: 166144 - DNA, 20 bp, Artificial Sequence
  chemically synthesized
cagtttttgagtccagaggg

SEQ ID NO: 166145 - DNA, 20 bp, Artificial Sequence
  chemically synthesized
actcagtttttgagtccaga

SEQ ID NO: 166146 - DNA, 20 bp, Artificial Sequence
  chemically synthesized
aactcagtttttgagtccag

SEQ ID NO: 166147 - DNA, 20 bp, Artificial Sequence
  chemically synthesized
aaactcagtttttgagtcca

SEQ ID NO: 166148 - DNA, 20 bp, Artificial Sequence
  chemically synthesized
gcaaactcagtttttgagtc

SEQ ID NO: 166149 - DNA, 20 bp, Artificial Sequence
  chemically synthesized
gccctctggactcaaaaact

SEQ ID NO: 166150 - DNA, 20 bp, Artificial Sequence
  chemically synthesized
agactgcaaactcagttttt

SEQ ID NO: 166151 - DNA, 20 bp, Artificial Sequence
  chemically synthesized
ggactcaaaaactgagtttg

SEQ ID NO: 166152 - DNA, 20 bp, Artificial Sequence
  chemically synthesized
gttgaagcagactgcaaact

SEQ ID NO: 166153 - DNA, 20 bp, Artificial Sequence
  chemically synthesized
acgaagattaatggttgaag

SEQ ID NO: 166154 - DNA, 20 bp, Artificial Sequence
  chemically synthesized
aagacgaagattaatggttg

SEQ ID NO: 166155 - DNA, 20 bp, Artificial Sequence
  chemically synthesized
agaaggaagacgaagattaa

SEQ ID NO: 166156 - DNA, 20 bp, Artificial Sequence
  chemically synthesized
tgaaagttagaaggaagacg

SEQ ID NO: 166157 - DNA, 20 bp, Artificial Sequence
  chemically synthesized
tttccatgaaagttagaagg

SEQ ID NO: 166158 - DNA, 20 bp, Artificial Sequence
  chemically synthesized
agatttccatgaaagttaga

SEQ ID NO: 166159 - DNA, 20 bp, Artificial Sequence
  chemically synthesized
gagatttccatgaaagttag

SEQ ID NO: 166160 - DNA, 20 bp, Artificial Sequence
  chemically synthesized
cgtcttccttctaactttca

SEQ ID NO: 166161 - DNA, 20 bp, Artificial Sequence
  chemically synthesized
aaggagatttccatgaaagt

SEQ ID NO: 166162 - DNA, 20 bp, Artificial Sequence
  chemically synthesized
catgaaggagatttccatga

SEQ ID NO: 166163 - DNA, 20 bp, Artificial Sequence
  chemically synthesized
taatcagacatttcatgaag

SEQ ID NO: 166164 - DNA, 20 bp, Artificial Sequence
  chemically synthesized
agtaatcagacatttcatga

SEQ ID NO: 166165 - DNA, 20 bp, Artificial Sequence
  chemically synthesized
tagtaatcagacatttcatg

SEQ ID NO: 166166 - DNA, 20 bp, Artificial Sequence
  chemically synthesized
ctctgacacttggtagtaat

SEQ ID NO: 166167 - DNA, 20 bp, Artificial Sequence
  chemically synthesized
tgaaatgtctgattactacc

SEQ ID NO: 166168 - DNA, 20 bp, Artificial Sequence
  chemically synthesized
gaacgaactctgacacttgg

SEQ ID NO: 166169 - DNA, 20 bp, Artificial Sequence
  chemically synthesized
gtctgattactaccaagtgt

SEQ ID NO: 166170 - DNA, 20 bp, Artificial Sequence
  chemically synthesized
ctgattactaccaagtgtca

SEQ ID NO: 166171 - DNA, 20 bp, Artificial Sequence
  chemically synthesized
gctgaacgaactctgacact

SEQ ID NO: 166172 - DNA, 20 bp, Artificial Sequence
  chemically synthesized
accaagtgtcagagttcgtt

SEQ ID NO: 166173 - DNA, 20 bp, Artificial Sequence
  chemically synthesized
agtgtcagagttcgttcagc

SEQ ID NO: 166174 - DNA, 20 bp, Artificial Sequence
  chemically synthesized
ggtttctgttgttgaaggac

SEQ ID NO: 166175 - DNA, 20 bp, Artificial Sequence
  chemically synthesized
ttcagctagtccttcaacaa

SEQ ID NO: 166176 - DNA, 20 bp, Artificial Sequence
  chemically synthesized
cagcaggtttctgttgttga

SEQ ID NO: 166177 - DNA, 20 bp, Artificial Sequence
  chemically synthesized
tcagcaggtttctgttgttg

SEQ ID NO: 166178 - DNA, 20 bp, Artificial Sequence
  chemically synthesized
ttcatctagttcatttcagc

SEQ ID NO: 166179 - DNA, 20 bp, Artificial Sequence
  chemically synthesized
gttcatctagttcatttcag

SEQ ID NO: 166180 - DNA, 20 bp, Artificial Sequence
  chemically synthesized
ccagttcatctagttcattt

SEQ ID NO: 166181 - DNA, 20 bp, Artificial Sequence
  chemically synthesized
agaaacctgctgaaatgaac

SEQ ID NO: 166182 - DNA, 20 bp, Artificial Sequence
  chemically synthesized
ctgaaatgaactagatgaac

SEQ ID NO: 166183 - DNA, 20 bp, Artificial Sequence
  chemically synthesized
cttaggaacgccagttcatc

SEQ ID NO: 166184 - DNA, 20 bp, Artificial Sequence
  chemically synthesized
attgaaaaacttaggaacgc

SEQ ID NO: 166185 - DNA, 20 bp, Artificial Sequence
  chemically synthesized
ctagatgaactggcgttcct

SEQ ID NO: 166186 - DNA, 20 bp, Artificial Sequence
  chemically synthesized
gttttcccattgaaaaactt

SEQ ID NO: 166187 - DNA, 20 bp, Artificial Sequence
  chemically synthesized
agttttcccattgaaaaact

SEQ ID NO: 166188 - DNA, 20 bp, Artificial Sequence
  chemically synthesized
ggcgttcctaagtttttcaa

SEQ ID NO: 166189 - DNA, 20 bp, Artificial Sequence
  chemically synthesized
gcgttcctaagtttttcaat

SEQ ID NO: 166190 - DNA, 20 bp, Artificial Sequence
  chemically synthesized
aagtttttcaatgggaaaac

SEQ ID NO: 166191 - DNA, 20 bp, Artificial Sequence
  chemically synthesized
ccattttgttcaagggaaac

SEQ ID NO: 166192 - DNA, 20 bp, Artificial Sequence
  chemically synthesized
caaccctccattttgttcaa

SEQ ID NO: 166193 - DNA, 20 bp, Artificial Sequence
  chemically synthesized
tcaaccctccattttgttca

SEQ ID NO: 166194 - DNA, 20 bp, Artificial Sequence
  chemically synthesized
gtcaaccctccattttgttc

SEQ ID NO: 166195 - DNA, 20 bp, Artificial Sequence
  chemically synthesized
ctggtttcccttgaacaaaa

SEQ ID NO: 166196 - DNA, 20 bp, Artificial Sequence
  chemically synthesized
ggtttcccttgaacaaaatg

SEQ ID NO: 166197 - DNA, 20 bp, Artificial Sequence
  chemically synthesized
gtttcccttgaacaaaatgg

SEQ ID NO: 166198 - DNA, 20 bp, Artificial Sequence
  chemically synthesized
tttcccttgaacaaaatgga

SEQ ID NO: 166199 - DNA, 20 bp, Artificial Sequence
  chemically synthesized
aacaaaatggagggttgaca

SEQ ID NO: 166200 - DNA, 20 bp, Artificial Sequence
  chemically synthesized
aaatggagggttgacaaaga

SEQ ID NO: 166201 - DNA, 20 bp, Artificial Sequence
  chemically synthesized
tcaaactcagggtattttta

SEQ ID NO: 166202 - DNA, 20 bp, Artificial Sequence
  chemically synthesized
gaaagctttaaaaataccct

SEQ ID NO: 166203 - DNA, 20 bp, Artificial Sequence
  chemically synthesized
ctcaaatgtagtcaaactca

SEQ ID NO: 166204 - DNA, 20 bp, Artificial Sequence
  chemically synthesized
tctcaaatgtagtcaaactc

SEQ ID NO: 166205 - DNA, 20 bp, Artificial Sequence
  chemically synthesized
gtctcaaatgtagtcaaact

SEQ ID NO: 166206 - DNA, 20 bp, Artificial Sequence
  chemically synthesized
ccctgagtttgactacattt

SEQ ID NO: 166207 - DNA, 20 bp, Artificial Sequence
  chemically synthesized
gaagaaatctgtctcaaatg

SEQ ID NO: 166208 - DNA, 20 bp, Artificial Sequence
  chemically synthesized
gagtttgactacatttgaga

SEQ ID NO: 166209 - DNA, 20 bp, Artificial Sequence
  chemically synthesized
aggtcaggtctaaagtcagg

SEQ ID NO: 166210 - DNA, 20 bp, Artificial Sequence
  chemically synthesized
gacagatttcttcctgactt

SEQ ID NO: 166211 - DNA, 20 bp, Artificial Sequence
  chemically synthesized
ggaaggtcaggtctaaagtc

SEQ ID NO: 166212 - DNA, 20 bp, Artificial Sequence
  chemically synthesized
aggaaggtcaggtctaaagt

SEQ ID NO: 166213 - DNA, 20 bp, Artificial Sequence
  chemically synthesized
gaaaaggaaggtcaggtcta

SEQ ID NO: 166214 - DNA, 20 bp, Artificial Sequence
  chemically synthesized
gctctaagaaaaggaaggtc

SEQ ID NO: 166215 - DNA, 20 bp, Artificial Sequence
  chemically synthesized
tgctctaagaaaaggaaggt

SEQ ID NO: 166216 - DNA, 20 bp, Artificial Sequence
  chemically synthesized
taaatgctctaagaaaagga

SEQ ID NO: 166217 - DNA, 20 bp, Artificial Sequence
  chemically synthesized
gtaaatgctctaagaaaagg

SEQ ID NO: 166218 - DNA, 20 bp, Artificial Sequence
  chemically synthesized
agacctgaccttccttttct

SEQ ID NO: 166219 - DNA, 20 bp, Artificial Sequence
  chemically synthesized
acctgaccttccttttctta

SEQ ID NO: 166220 - DNA, 20 bp, Artificial Sequence
  chemically synthesized
agagtaaatgctctaagaaa

SEQ ID NO: 166221 - DNA, 20 bp, Artificial Sequence
  chemically synthesized
tagagtaaatgctctaagaa

SEQ ID NO: 166222 - DNA, 20 bp, Artificial Sequence
  chemically synthesized
ttttctagagtaaatgctct

SEQ ID NO: 166223 - DNA, 20 bp, Artificial Sequence
  chemically synthesized
ttttcttagagcatttactc

SEQ ID NO: 166224 - DNA, 20 bp, Artificial Sequence
  chemically synthesized
ataatatataaagttttcta

SEQ ID NO: 166225 - DNA, 20 bp, Artificial Sequence
  chemically synthesized
aaataatatataaagttttc

SEQ ID NO: 166226 - DNA, 20 bp, Artificial Sequence
  chemically synthesized
aagtagagaaataatatata

SEQ ID NO: 166227 - DNA, 20 bp, Artificial Sequence
  chemically synthesized
atttttgtctcaaaaaagta

SEQ ID NO: 166228 - DNA, 20 bp, Artificial Sequence
  chemically synthesized
tattatttctctactttttt

SEQ ID NO: 166229 - DNA, 20 bp, Artificial Sequence
  chemically synthesized
atatttttgtctcaaaaaag

SEQ ID NO: 166230 - DNA, 20 bp, Artificial Sequence
  chemically synthesized
agaatatttttgtctcaaaa

SEQ ID NO: 166231 - DNA, 20 bp, Artificial Sequence
  chemically synthesized
ttgagacaaaaatattctcc

SEQ ID NO: 166232 - DNA, 20 bp, Artificial Sequence
  chemically synthesized
taaaagtggcaagaggctag

SEQ ID NO: 166233 - DNA, 20 bp, Artificial Sequence
  chemically synthesized
tataaaagtggcaagaggct

SEQ ID NO: 166234 - DNA, 20 bp, Artificial Sequence
  chemically synthesized
gtataaaagtggcaagaggc

SEQ ID NO: 166235 - DNA, 20 bp, Artificial Sequence
  chemically synthesized
tgaggtataaaagtggcaag

SEQ ID NO: 166236 - DNA, 20 bp, Artificial Sequence
  chemically synthesized
ctgaggtataaaagtggcaa

SEQ ID NO: 166237 - DNA, 20 bp, Artificial Sequence
  chemically synthesized
tcctgaggtataaaagtggc

SEQ ID NO: 166238 - DNA, 20 bp, Artificial Sequence
  chemically synthesized
ttattcctgaggtataaaag

SEQ ID NO: 166239 - DNA, 20 bp, Artificial Sequence
  chemically synthesized
agtttattcctgaggtataa

SEQ ID NO: 166240 - DNA, 20 bp, Artificial Sequence
  chemically synthesized
ctcttgccacttttatacct

SEQ ID NO: 166241 - DNA, 20 bp, Artificial Sequence
  chemically synthesized
tcttgccacttttatacctc

SEQ ID NO: 166242 - DNA, 20 bp, Artificial Sequence
  chemically synthesized
cttgagaaagtttattcctg

SEQ ID NO: 166243 - DNA, 20 bp, Artificial Sequence
  chemically synthesized
ccttgagaaagtttattcct

SEQ ID NO: 166244 - DNA, 20 bp, Artificial Sequence
  chemically synthesized
cctcaggaataaactttctc

SEQ ID NO: 166245 - DNA, 20 bp, Artificial Sequence
  chemically synthesized
ctcaggaataaactttctca

SEQ ID NO: 166246 - DNA, 20 bp, Artificial Sequence
  chemically synthesized
tagctcccaagtccttgaga

SEQ ID NO: 166247 - DNA, 20 bp, Artificial Sequence
  chemically synthesized
aataaactttctcaaggact

SEQ ID NO: 166248 - DNA, 20 bp, Artificial Sequence
  chemically synthesized
gtgctagctcccaagtcctt

SEQ ID NO: 166249 - DNA, 20 bp, Artificial Sequence
  chemically synthesized
ataaactttctcaaggactt

SEQ ID NO: 166250 - DNA, 20 bp, Artificial Sequence
  chemically synthesized
aaactttctcaaggacttgg

SEQ ID NO: 166251 - DNA, 20 bp, Artificial Sequence
  chemically synthesized
tttctcaaggacttgggagc

SEQ ID NO: 166252 - DNA, 20 bp, Artificial Sequence
  chemically synthesized
atatcaaagtgctagctccc

SEQ ID NO: 166253 - DNA, 20 bp, Artificial Sequence
  chemically synthesized
atgattctatatcaaagtgc

SEQ ID NO: 166254 - DNA, 20 bp, Artificial Sequence
  chemically synthesized
tgggagctagcactttgata

SEQ ID NO: 166255 - DNA, 20 bp, Artificial Sequence
  chemically synthesized
tttttgatgattctatatca

SEQ ID NO: 166256 - DNA, 20 bp, Artificial Sequence
  chemically synthesized
ttgatatagaatcatcaaaa

SEQ ID NO: 166257 - DNA, 20 bp, Artificial Sequence
  chemically synthesized
tatagaatcatcaaaaaaga

SEQ ID NO: 166258 - DNA, 20 bp, Artificial Sequence
  chemically synthesized
aacagaagactagcagattg

SEQ ID NO: 166259 - DNA, 20 bp, Artificial Sequence
  chemically synthesized
aagatagtgccccaatctgc

SEQ ID NO: 166260 - DNA, 20 bp, Artificial Sequence
  chemically synthesized
caacagaagactagcagatt

SEQ ID NO: 166261 - DNA, 20 bp, Artificial Sequence
  chemically synthesized
ccaacagaagactagcagat

SEQ ID NO: 166262 - DNA, 20 bp, Artificial Sequence
  chemically synthesized
tcctcccaacagaagactag

SEQ ID NO: 166263 - DNA, 20 bp, Artificial Sequence
  chemically synthesized
ctatcctcccaacagaagac

SEQ ID NO: 166264 - DNA, 20 bp, Artificial Sequence
  chemically synthesized
ccaatctgctagtcttctgt

SEQ ID NO: 166265 - DNA, 20 bp, Artificial Sequence
  chemically synthesized
caatctgctagtcttctgtt

SEQ ID NO: 166266 - DNA, 20 bp, Artificial Sequence
  chemically synthesized
atctgctagtcttctgttgg

SEQ ID NO: 166267 - DNA, 20 bp, Artificial Sequence
  chemically synthesized
gattcctatcctcccaacag

SEQ ID NO: 166268 - DNA, 20 bp, Artificial Sequence
  chemically synthesized
tctgctagtcttctgttggg

SEQ ID NO: 166269 - DNA, 20 bp, Artificial Sequence
  chemically synthesized
ttagattcctatcctcccaa

SEQ ID NO: 166270 - DNA, 20 bp, Artificial Sequence
  chemically synthesized
ctagtcttctgttgggagga

SEQ ID NO: 166271 - DNA, 20 bp, Artificial Sequence
  chemically synthesized
tagtcttctgttgggaggat

SEQ ID NO: 166272 - DNA, 20 bp, Artificial Sequence
  chemically synthesized
tgattggcacttatcaaagt

SEQ ID NO: 166273 - DNA, 20 bp, Artificial Sequence
  chemically synthesized
gataggaatctaactttgat

SEQ ID NO: 166274 - DNA, 20 bp, Artificial Sequence
  chemically synthesized
ttgctgattggcacttatca

SEQ ID NO: 166275 - DNA, 20 bp, Artificial Sequence
  chemically synthesized
taactttgataagtgccaat

SEQ ID NO: 166276 - DNA, 20 bp, Artificial Sequence
  chemically synthesized
ggccatctgtgtttgctgat

SEQ ID NO: 166277 - DNA, 20 bp, Artificial Sequence
  chemically synthesized
taagtgccaatcagcaaaca

SEQ ID NO: 166278 - DNA, 20 bp, Artificial Sequence
  chemically synthesized
tgccaatcagcaaacacaga

SEQ ID NO: 166279 - DNA, 20 bp, Artificial Sequence
  chemically synthesized
caaacacagatggcctaaat

SEQ ID NO: 166280 - DNA, 20 bp, Artificial Sequence
  chemically synthesized
gttagtcaatgtgcttattt

SEQ ID NO: 166281 - DNA, 20 bp, Artificial Sequence
  chemically synthesized
ggttagtcaatgtgcttatt

SEQ ID NO: 166282 - DNA, 20 bp, Artificial Sequence
  chemically synthesized
ctagatatcaggagggaggt

SEQ ID NO: 166283 - DNA, 20 bp, Artificial Sequence
  chemically synthesized
agtactagatatcaggaggg

SEQ ID NO: 166284 - DNA, 20 bp, Artificial Sequence
  chemically synthesized
aagtactagatatcaggagg

SEQ ID NO: 166285 - DNA, 20 bp, Artificial Sequence
  chemically synthesized
gaaagtactagatatcagga

SEQ ID NO: 166286 - DNA, 20 bp, Artificial Sequence
  chemically synthesized
agaaagtactagatatcagg

SEQ ID NO: 166287 - DNA, 20 bp, Artificial Sequence
  chemically synthesized
gagaaagtactagatatcag

SEQ ID NO: 166288 - DNA, 20 bp, Artificial Sequence
  chemically synthesized
ctaacctccctcctgatatc

SEQ ID NO: 166289 - DNA, 20 bp, Artificial Sequence
  chemically synthesized
gtgagaaagtactagatatc

SEQ ID NO: 166290 - DNA, 20 bp, Artificial Sequence
  chemically synthesized
agtgagaaagtactagatat

SEQ ID NO: 166291 - DNA, 20 bp, Artificial Sequence
  chemically synthesized
atgagttagtgagaaagtac

SEQ ID NO: 166292 - DNA, 20 bp, Artificial Sequence
  chemically synthesized
gctgagatgagttagtgaga

SEQ ID NO: 166293 - DNA, 20 bp, Artificial Sequence
  chemically synthesized
aagtgctgagatgagttagt

SEQ ID NO: 166294 - DNA, 20 bp, Artificial Sequence
  chemically synthesized
ctctaagtgctgagatgagt

SEQ ID NO: 166295 - DNA, 20 bp, Artificial Sequence
  chemically synthesized
actttctcactaactcatct

SEQ ID NO: 166296 - DNA, 20 bp, Artificial Sequence
  chemically synthesized
gagcctctaagtgctgagat

SEQ ID NO: 166297 - DNA, 20 bp, Artificial Sequence
  chemically synthesized
cactaactcatctcagcact

SEQ ID NO: 166298 - DNA, 20 bp, Artificial Sequence
  chemically synthesized
caggagagcctctaagtgct

SEQ ID NO: 166299 - DNA, 20 bp, Artificial Sequence
  chemically synthesized
ctaactcatctcagcactta

SEQ ID NO: 166300 - DNA, 20 bp, Artificial Sequence
  chemically synthesized
taactcatctcagcacttag

SEQ ID NO: 166301 - DNA, 20 bp, Artificial Sequence
  chemically synthesized
taaaaggcaggagagcctct

SEQ ID NO: 166302 - DNA, 20 bp, Artificial Sequence
  chemically synthesized
tgctgaaataaaaggcagga

SEQ ID NO: 166303 - DNA, 20 bp, Artificial Sequence
  chemically synthesized
tctgctgaaataaaaggcag

SEQ ID NO: 166304 - DNA, 20 bp, Artificial Sequence
  chemically synthesized
attctgctgaaataaaaggc

SEQ ID NO: 166305 - DNA, 20 bp, Artificial Sequence
  chemically synthesized
aattctgctgaaataaaagg

SEQ ID NO: 166306 - DNA, 20 bp, Artificial Sequence
  chemically synthesized
ggctctcctgccttttattt

SEQ ID NO: 166307 - DNA, 20 bp, Artificial Sequence
  chemically synthesized
ctcaattctgctgaaataaa

SEQ ID NO: 166308 - DNA, 20 bp, Artificial Sequence
  chemically synthesized
actcaattctgctgaaataa

SEQ ID NO: 166309 - DNA, 20 bp, Artificial Sequence
  chemically synthesized
tctcctgccttttatttcag

SEQ ID NO: 166310 - DNA, 20 bp, Artificial Sequence
  chemically synthesized
ccttttatttcagcagaatt

SEQ ID NO: 166311 - DNA, 20 bp, Artificial Sequence
  chemically synthesized
aacttttgcaatagaggaga

SEQ ID NO: 166312 - DNA, 20 bp, Artificial Sequence
  chemically synthesized
tcaaaacttttgcaatagag

SEQ ID NO: 166313 - DNA, 20 bp, Artificial Sequence
  chemically synthesized
gttcaaaacttttgcaatag

SEQ ID NO: 166314 - DNA, 20 bp, Artificial Sequence
  chemically synthesized
tgttcaaaacttttgcaata

SEQ ID NO: 166315 - DNA, 20 bp, Artificial Sequence
  chemically synthesized
atctgtctcctctattgcaa

SEQ ID NO: 166316 - DNA, 20 bp, Artificial Sequence
  chemically synthesized
tgtgttcaaaacttttgcaa

SEQ ID NO: 166317 - DNA, 20 bp, Artificial Sequence
  chemically synthesized
tattgcaaaagttttgaaca

SEQ ID NO: 166318 - DNA, 20 bp, Artificial Sequence
  chemically synthesized
gcactagacaacagacaaga

SEQ ID NO: 166319 - DNA, 20 bp, Artificial Sequence
  chemically synthesized
aatagcactagacaacagac

SEQ ID NO: 166320 - DNA, 20 bp, Artificial Sequence
  chemically synthesized
agtctttcttgtctgttgtc

SEQ ID NO: 166321 - DNA, 20 bp, Artificial Sequence
  chemically synthesized
agaaaaatagcactagacaa

SEQ ID NO: 166322 - DNA, 20 bp, Artificial Sequence
  chemically synthesized
ttgtcaaagaaaaatagcac

SEQ ID NO: 166323 - DNA, 20 bp, Artificial Sequence
  chemically synthesized
tgagtgttgtcaaagaaaaa

SEQ ID NO: 166324 - DNA, 20 bp, Artificial Sequence
  chemically synthesized
cattgctgtgagtgttgtca

SEQ ID NO: 166325 - DNA, 20 bp, Artificial Sequence
  chemically synthesized
tttttctttgacaacactca

SEQ ID NO: 166326 - DNA, 20 bp, Artificial Sequence
  chemically synthesized
gtgtgtgttcacattgctgt

SEQ ID NO: 166327 - DNA, 20 bp, Artificial Sequence
  chemically synthesized
cacagcaatgtgaacacaca

SEQ ID NO: 166328 - DNA, 20 bp, Artificial Sequence
  chemically synthesized
atgtgaacacacacagtgtt

SEQ ID NO: 166329 - DNA, 20 bp, Artificial Sequence
  chemically synthesized
acagtgttcagtgactttaa

SEQ ID NO: 166330 - DNA, 20 bp, Artificial Sequence
  chemically synthesized
tgttcagtgactttaatggt

SEQ ID NO: 166331 - DNA, 20 bp, Artificial Sequence
  chemically synthesized
attgtagtgactgaccatta

SEQ ID NO: 166332 - DNA, 20 bp, Artificial Sequence
  chemically synthesized
aatggtcagtcactacaatt

SEQ ID NO: 166333 - DNA, 20 bp, Artificial Sequence
  chemically synthesized
actaccaaaggactcaattg

SEQ ID NO: 166334 - DNA, 20 bp, Artificial Sequence
  chemically synthesized
gtcactacaattgagtcctt

SEQ ID NO: 166335 - DNA, 20 bp, Artificial Sequence
  chemically synthesized
actacaattgagtcctttgg

SEQ ID NO: 166336 - DNA, 20 bp, Artificial Sequence
  chemically synthesized
tccacactaaaaactaccaa

SEQ ID NO: 166337 - DNA, 20 bp, Artificial Sequence
  chemically synthesized
atccacactaaaaactacca

SEQ ID NO: 166338 - DNA, 20 bp, Artificial Sequence
  chemically synthesized
ttgagtcctttggtagtttt

SEQ ID NO: 166339 - DNA, 20 bp, Artificial Sequence
  chemically synthesized
tcctttggtagtttttagtg

SEQ ID NO: 166340 - DNA, 20 bp, Artificial Sequence
  chemically synthesized
ttagtgtggatttgacatta

SEQ ID NO: 166341 - DNA, 20 bp, Artificial Sequence
  chemically synthesized
tagtgtggatttgacattat

SEQ ID NO: 166342 - DNA, 20 bp, Artificial Sequence
  chemically synthesized
gctcttccttgcagtataag

SEQ ID NO: 166343 - DNA, 20 bp, Artificial Sequence
  chemically synthesized
tggctcttccttgcagtata

SEQ ID NO: 166344 - DNA, 20 bp, Artificial Sequence
  chemically synthesized
aattatgctccttatactgc

SEQ ID NO: 166345 - DNA, 20 bp, Artificial Sequence
  chemically synthesized
ctggctcttccttgcagtat

SEQ ID NO: 166346 - DNA, 20 bp, Artificial Sequence
  chemically synthesized
attatgctccttatactgca

SEQ ID NO: 166347 - DNA, 20 bp, Artificial Sequence
  chemically synthesized
atgctccttatactgcaagg

SEQ ID NO: 166348 - DNA, 20 bp, Artificial Sequence
  chemically synthesized
gctccttatactgcaaggaa

SEQ ID NO: 166349 - DNA, 20 bp, Artificial Sequence
  chemically synthesized
gctctgctggctcttccttg

SEQ ID NO: 166350 - DNA, 20 bp, Artificial Sequence
  chemically synthesized
cttatactgcaaggaagagc

SEQ ID NO: 166351 - DNA, 20 bp, Artificial Sequence
  chemically synthesized
atactgcaaggaagagccag

SEQ ID NO: 166352 - DNA, 20 bp, Artificial Sequence
  chemically synthesized
actgcaaggaagagccagca

SEQ ID NO: 166353 - DNA, 20 bp, Artificial Sequence
  chemically synthesized
aacatgacatgtggctctgc

SEQ ID NO: 166354 - DNA, 20 bp, Artificial Sequence
  chemically synthesized
ttataaataaacatgacatg

SEQ ID NO: 166355 - DNA, 20 bp, Artificial Sequence
  chemically synthesized
tcatgtttatttataaacca

SEQ ID NO: 166356 - DNA, 20 bp, Artificial Sequence
  chemically synthesized
tgtttatttataaaccacag

SEQ ID NO: 166357 - DNA, 20 bp, Artificial Sequence
  chemically synthesized
gtttatttataaaccacaga

SEQ ID NO: 166358 - DNA, 20 bp, Artificial Sequence
  chemically synthesized
caagaatcactttccttctg

SEQ ID NO: 166359 - DNA, 20 bp, Artificial Sequence
  chemically synthesized
atttataaaccacagaagga

SEQ ID NO: 166360 - DNA, 20 bp, Artificial Sequence
  chemically synthesized
acagaaggaaagtgattctt

SEQ ID NO: 166361 - DNA, 20 bp, Artificial Sequence
  chemically synthesized
cagaaggaaagtgattcttg

SEQ ID NO: 166362 - DNA, 20 bp, Artificial Sequence
  chemically synthesized
agaaggaaagtgattcttga

SEQ ID NO: 166363 - DNA, 20 bp, Artificial Sequence
  chemically synthesized
gaaggaaagtgattcttgag

SEQ ID NO: 166364 - DNA, 20 bp, Artificial Sequence
  chemically synthesized
aggaaagtgattcttgaggg

SEQ ID NO: 166365 - DNA, 20 bp, Artificial Sequence
  chemically synthesized
ggaaagtgattcttgagggg

SEQ ID NO: 166366 - DNA, 20 bp, Artificial Sequence
  chemically synthesized
gggggttttttcctcccctc

SEQ ID NO: 166367 - DNA, 20 bp, Artificial Sequence
  chemically synthesized
tcatcttaatcacagggagg

SEQ ID NO: 166368 - DNA, 20 bp, Artificial Sequence
  chemically synthesized
ttcatcttaatcacagggag

SEQ ID NO: 166369 - DNA, 20 bp, Artificial Sequence
  chemically synthesized
tttcatcttaatcacaggga

SEQ ID NO: 166370 - DNA, 20 bp, Artificial Sequence
  chemically synthesized
ctttcatcttaatcacaggg

SEQ ID NO: 166371 - DNA, 20 bp, Artificial Sequence
  chemically synthesized
actttcatcttaatcacagg

SEQ ID NO: 166372 - DNA, 20 bp, Artificial Sequence
  chemically synthesized
aaaaccccctccctgtgatt

SEQ ID NO: 166373 - DNA, 20 bp, Artificial Sequence
  chemically synthesized
atactttcatcttaatcaca

SEQ ID NO: 166374 - DNA, 20 bp, Artificial Sequence
  chemically synthesized
aatactttcatcttaatcac

SEQ ID NO: 166375 - DNA, 20 bp, Artificial Sequence
  chemically synthesized
aaatactttcatcttaatca

SEQ ID NO: 166376 - DNA, 20 bp, Artificial Sequence
  chemically synthesized
cctccctgtgattaagatga

SEQ ID NO: 166377 - DNA, 20 bp, Artificial Sequence
  chemically synthesized
tgattaagatgaaagtattt

SEQ ID NO: 166378 - DNA, 20 bp, Artificial Sequence
  chemically synthesized
atgaaagtatttcagtcact

SEQ ID NO: 166379 - DNA, 20 bp, Artificial Sequence
  chemically synthesized
cataattttatgttaaggct

SEQ ID NO: 166380 - DNA, 20 bp, Artificial Sequence
  chemically synthesized
ggacacataattttatgtta

SEQ ID NO: 166381 - DNA, 20 bp, Artificial Sequence
  chemically synthesized
gggacacataattttatgtt

SEQ ID NO: 166382 - DNA, 20 bp, Artificial Sequence
  chemically synthesized
attaaaatatgaggtgtggc

SEQ ID NO: 166383 - DNA, 20 bp, Artificial Sequence
  chemically synthesized
tattaaaatatgaggtgtgg

SEQ ID NO: 166384 - DNA, 20 bp, Artificial Sequence
  chemically synthesized
ttttattaaaatatgaggtg

SEQ ID NO: 166385 - DNA, 20 bp, Artificial Sequence
  chemically synthesized
aaactttttattaaaatatg

SEQ ID NO: 166386 - DNA, 20 bp, Artificial Sequence
  chemically synthesized
caaactttttattaaaatat

SEQ ID NO: 166387 - DNA, 20 bp, Artificial Sequence
  chemically synthesized
acacctcatattttaataaa

SEQ ID NO: 166388 - DNA, 20 bp, Artificial Sequence
  chemically synthesized
tcatattttaataaaaagtt

SEQ ID NO: 166389 - DNA, 20 bp, Artificial Sequence
  chemically synthesized
attttaataaaaagtttgga

SEQ ID NO: 166390 - DNA, 20 bp, Artificial Sequence
  chemically synthesized
ttaataaaaagtttggaaag

SEQ ID NO: 166391 - DNA, 20 bp, Artificial Sequence
  chemically synthesized
ataaaaagtttggaaagcag

SEQ ID NO: 166392 - DNA, 20 bp, Artificial Sequence
  chemically synthesized
aaagtttggaaagcagtagt

SEQ ID NO: 166393 - DNA, 20 bp, Artificial Sequence
  chemically synthesized
agcagtagtcagtcttatgt

SEQ ID NO: 166394 - DNA, 20 bp, Artificial Sequence
  chemically synthesized
gtatactatttatctgacat

SEQ ID NO: 166395 - DNA, 20 bp, Artificial Sequence
  chemically synthesized
tcagtcttatgtcagataaa

SEQ ID NO: 166396 - DNA, 20 bp, Artificial Sequence
  chemically synthesized
tcagataaatagtatacctc

SEQ ID NO: 166397 - DNA, 20 bp, Artificial Sequence
  chemically synthesized
tgctttcaataatgagctag

SEQ ID NO: 166398 - DNA, 20 bp, Artificial Sequence
  chemically synthesized
atgctttcaataatgagcta

SEQ ID NO: 166399 - DNA, 20 bp, Artificial Sequence
  chemically synthesized
gaatgctttcaataatgagc

SEQ ID NO: 166400 - DNA, 20 bp, Artificial Sequence
  chemically synthesized
taatgaatgctttcaataat

SEQ ID NO: 166401 - DNA, 20 bp, Artificial Sequence
  chemically synthesized
tacctctagctcattattga

SEQ ID NO: 166402 - DNA, 20 bp, Artificial Sequence
  chemically synthesized
attattgaaagcattcatta

SEQ ID NO: 166403 - DNA, 20 bp, Artificial Sequence
  chemically synthesized
ttattgaaagcattcattaa

SEQ ID NO: 166404 - DNA, 20 bp, Artificial Sequence
  chemically synthesized
tcattaaaggttaaaaacat

SEQ ID NO: 166405 - DNA, 20 bp, Artificial Sequence
  chemically synthesized
taaaaacataagacccttta

SEQ ID NO: 166406 - DNA, 20 bp, Artificial Sequence
  chemically synthesized
cagtttagaatttctataaa

SEQ ID NO: 166407 - DNA, 20 bp, Artificial Sequence
  chemically synthesized
ccagtttagaatttctataa

SEQ ID NO: 166408 - DNA, 20 bp, Artificial Sequence
  chemically synthesized
accagtttagaatttctata

SEQ ID NO: 166409 - DNA, 20 bp, Artificial Sequence
  chemically synthesized
cctttatagaaattctaaac

SEQ ID NO: 166410 - DNA, 20 bp, Artificial Sequence
  chemically synthesized
ctaagatcccgggaccagtt

SEQ ID NO: 166411 - DNA, 20 bp, Artificial Sequence
  chemically synthesized
tagaaattctaaactggtcc

SEQ ID NO: 166412 - DNA, 20 bp, Artificial Sequence
  chemically synthesized
agaaattctaaactggtccc

SEQ ID NO: 166413 - DNA, 20 bp, Artificial Sequence
  chemically synthesized
gaatgctaagatcccgggac

SEQ ID NO: 166414 - DNA, 20 bp, Artificial Sequence
  chemically synthesized
ctaaactggtcccgggatct

SEQ ID NO: 166415 - DNA, 20 bp, Artificial Sequence
  chemically synthesized
taattgaatgctaagatccc

SEQ ID NO: 166416 - DNA, 20 bp, Artificial Sequence
  chemically synthesized
ataattgaatgctaagatcc

SEQ ID NO: 166417 - DNA, 20 bp, Artificial Sequence
  chemically synthesized
agaaatgataattgaatgct

SEQ ID NO: 166418 - DNA, 20 bp, Artificial Sequence
  chemically synthesized
aatatgttgatttcagattt

SEQ ID NO: 166419 - DNA, 20 bp, Artificial Sequence
  chemically synthesized
gacataaaatatgttgattt

SEQ ID NO: 166420 - DNA, 20 bp, Artificial Sequence
  chemically synthesized
acatattttatgtctaaatt

SEQ ID NO: 166421 - DNA, 20 bp, Artificial Sequence
  chemically synthesized
atattttatgtctaaattga

SEQ ID NO: 166422 - DNA, 20 bp, Artificial Sequence
  chemically synthesized
tttcaaatatactctcaatt

SEQ ID NO: 166423 - DNA, 20 bp, Artificial Sequence
  chemically synthesized
tatttgaaaatcaaaattca

SEQ ID NO: 166424 - DNA, 20 bp, Artificial Sequence
  chemically synthesized
atttgaaaatcaaaattcaa

SEQ ID NO: 166425 - DNA, 20 bp, Artificial Sequence
  chemically synthesized
aaattcaaaggcatgccttc

SEQ ID NO: 166426 - DNA, 20 bp, Artificial Sequence
  chemically synthesized
ttcaaaggcatgccttctag

SEQ ID NO: 166427 - DNA, 20 bp, Artificial Sequence
  chemically synthesized
tcaaaggcatgccttctagt

SEQ ID NO: 166428 - DNA, 20 bp, Artificial Sequence
  chemically synthesized
ccatcagtcagcccactaga

SEQ ID NO: 166429 - DNA, 20 bp, Artificial Sequence
  chemically synthesized
cccatcagtcagcccactag

SEQ ID NO: 166430 - DNA, 20 bp, Artificial Sequence
  chemically synthesized
tttcccatcagtcagcccac

SEQ ID NO: 166431 - DNA, 20 bp, Artificial Sequence
  chemically synthesized
ccttctagtgggctgactga

SEQ ID NO: 166432 - DNA, 20 bp, Artificial Sequence
  chemically synthesized
cttctagtgggctgactgat

SEQ ID NO: 166433 - DNA, 20 bp, Artificial Sequence
  chemically synthesized
cacagccctttcccatcagt

SEQ ID NO: 166434 - DNA, 20 bp, Artificial Sequence
  chemically synthesized
tagtgggctgactgatggga

SEQ ID NO: 166435 - DNA, 20 bp, Artificial Sequence
  chemically synthesized
agtgggctgactgatgggaa

SEQ ID NO: 166436 - DNA, 20 bp, Artificial Sequence
  chemically synthesized
taatcacagccctttcccat

SEQ ID NO: 166437 - DNA, 20 bp, Artificial Sequence
  chemically synthesized
gtgggctgactgatgggaaa

SEQ ID NO: 166438 - DNA, 20 bp, Artificial Sequence
  chemically synthesized
gtgaaaattaggcgtaatca

SEQ ID NO: 166439 - DNA, 20 bp, Artificial Sequence
  chemically synthesized
tgatgtagagggtgaaaatt

SEQ ID NO: 166440 - DNA, 20 bp, Artificial Sequence
  chemically synthesized
gtgatgtagagggtgaaaat

SEQ ID NO: 166441 - DNA, 20 bp, Artificial Sequence
  chemically synthesized
caatgagatcgtgatgtaga

SEQ ID NO: 166442 - DNA, 20 bp, Artificial Sequence
  chemically synthesized
tcaatgagatcgtgatgtag

SEQ ID NO: 166443 - DNA, 20 bp, Artificial Sequence
  chemically synthesized
atcaatgagatcgtgatgta

SEQ ID NO: 166444 - DNA, 20 bp, Artificial Sequence
  chemically synthesized
taatcaatgagatcgtgatg

SEQ ID NO: 166445 - DNA, 20 bp, Artificial Sequence
  chemically synthesized
agctgagaaacataatcaat

SEQ ID NO: 166446 - DNA, 20 bp, Artificial Sequence
  chemically synthesized
atctcattgattatgtttct

SEQ ID NO: 166447 - DNA, 20 bp, Artificial Sequence
  chemically synthesized
cacagaacccttagcaagct

SEQ ID NO: 166448 - DNA, 20 bp, Artificial Sequence
  chemically synthesized
attatgtttctcagcttgct

SEQ ID NO: 166449 - DNA, 20 bp, Artificial Sequence
  chemically synthesized
ttatgtttctcagcttgcta

SEQ ID NO: 166450 - DNA, 20 bp, Artificial Sequence
  chemically synthesized
tatgtttctcagcttgctaa

SEQ ID NO: 166451 - DNA, 20 bp, Artificial Sequence
  chemically synthesized
cacctcacagaacccttagc

SEQ ID NO: 166452 - DNA, 20 bp, Artificial Sequence
  chemically synthesized
aaatcacctcacagaaccct

SEQ ID NO: 166453 - DNA, 20 bp, Artificial Sequence
  chemically synthesized
cagcttgctaagggttctgt

SEQ ID NO: 166454 - DNA, 20 bp, Artificial Sequence
  chemically synthesized
agcttgctaagggttctgtg

SEQ ID NO: 166455 - DNA, 20 bp, Artificial Sequence
  chemically synthesized
tcatcttgaaaatcacctca

SEQ ID NO: 166456 - DNA, 20 bp, Artificial Sequence
  chemically synthesized
ggttctgtgaggtgattttc

SEQ ID NO: 166457 - DNA, 20 bp, Artificial Sequence
  chemically synthesized
aagatgaatattgctatttg

SEQ ID NO: 166458 - DNA, 20 bp, Artificial Sequence
  chemically synthesized
agatgaatattgctatttgc

SEQ ID NO: 166459 - DNA, 20 bp, Artificial Sequence
  chemically synthesized
tattcaggaaatcctgcaaa

SEQ ID NO: 166460 - DNA, 20 bp, Artificial Sequence
  chemically synthesized
tatttgcaggatttcctgaa

SEQ ID NO: 166461 - DNA, 20 bp, Artificial Sequence
  chemically synthesized
atttgcaggatttcctgaat

SEQ ID NO: 166462 - DNA, 20 bp, Artificial Sequence
  chemically synthesized
ctcccgaaatattcctattc

SEQ ID NO: 166463 - DNA, 20 bp, Artificial Sequence
  chemically synthesized
actcccgaaatattcctatt

SEQ ID NO: 166464 - DNA, 20 bp, Artificial Sequence
  chemically synthesized
tttcctgaataggaatattt

SEQ ID NO: 166465 - DNA, 20 bp, Artificial Sequence
  chemically synthesized
ttcctgaataggaatatttc

SEQ ID NO: 166466 - DNA, 20 bp, Artificial Sequence
  chemically synthesized
cctgaataggaatatttcgg

SEQ ID NO: 166467 - DNA, 20 bp, Artificial Sequence
  chemically synthesized
gggagtaaattgcacaaacc

SEQ ID NO: 166468 - DNA, 20 bp, Artificial Sequence
  chemically synthesized
aaaattgactgcacattgct

SEQ ID NO: 166469 - DNA, 20 bp, Artificial Sequence
  chemically synthesized
tgcacaaaccaagcaatgtg

SEQ ID NO: 166470 - DNA, 20 bp, Artificial Sequence
  chemically synthesized
tgtgcagtcaattttcactc

SEQ ID NO: 166471 - DNA, 20 bp, Artificial Sequence
  chemically synthesized
ctaatacattgtttatgctg

SEQ ID NO: 166472 - DNA, 20 bp, Artificial Sequence
  chemically synthesized
ttctaatacattgtttatgc

SEQ ID NO: 166473 - DNA, 20 bp, Artificial Sequence
  chemically synthesized
ctccagcataaacaatgtat

SEQ ID NO: 166474 - DNA, 20 bp, Artificial Sequence
  chemically synthesized
ataaacaatgtattagaaca

SEQ ID NO: 166475 - DNA, 20 bp, Artificial Sequence
  chemically synthesized
gtattagaacacagccctta

SEQ ID NO: 166476 - DNA, 20 bp, Artificial Sequence
  chemically synthesized
cagataaaaaaaagctttaa

SEQ ID NO: 166477 - DNA, 20 bp, Artificial Sequence
  chemically synthesized
ccagataaaaaaaagcttta

SEQ ID NO: 166478 - DNA, 20 bp, Artificial Sequence
  chemically synthesized
cccagataaaaaaaagcttt

SEQ ID NO: 166479 - DNA, 20 bp, Artificial Sequence
  chemically synthesized
agtgaaacccagataaaaaa

SEQ ID NO: 166480 - DNA, 20 bp, Artificial Sequence
  chemically synthesized
ccttaaagcttttttttatc

SEQ ID NO: 166481 - DNA, 20 bp, Artificial Sequence
  chemically synthesized
cttaaagcttttttttatct

SEQ ID NO: 166482 - DNA, 20 bp, Artificial Sequence
  chemically synthesized
gctagctgtgtagtgaaacc

SEQ ID NO: 166483 - DNA, 20 bp, Artificial Sequence
  chemically synthesized
tttatctgggtttcactaca

SEQ ID NO: 166484 - DNA, 20 bp, Artificial Sequence
  chemically synthesized
tctgggtttcactacacagc

SEQ ID NO: 166485 - DNA, 20 bp, Artificial Sequence
  chemically synthesized
atgaaatgcagctagctgtg

SEQ ID NO: 166486 - DNA, 20 bp, Artificial Sequence
  chemically synthesized
tcttattgatgaaatgcagc

SEQ ID NO: 166487 - DNA, 20 bp, Artificial Sequence
  chemically synthesized
tcactcttattgatgaaatg

SEQ ID NO: 166488 - DNA, 20 bp, Artificial Sequence
  chemically synthesized
gctagctgcatttcatcaat

SEQ ID NO: 166489 - DNA, 20 bp, Artificial Sequence
  chemically synthesized
tagctgcatttcatcaataa

SEQ ID NO: 166490 - DNA, 20 bp, Artificial Sequence
  chemically synthesized
gcatttcatcaataagagtg

SEQ ID NO: 166491 - DNA, 20 bp, Artificial Sequence
  chemically synthesized
atcaataagagtgaagtacc

SEQ ID NO: 166492 - DNA, 20 bp, Artificial Sequence
  chemically synthesized
aataagagtgaagtaccaag

SEQ ID NO: 166493 - DNA, 20 bp, Artificial Sequence
  chemically synthesized
gagcctcagttttgtctgct

SEQ ID NO: 166494 - DNA, 20 bp, Artificial Sequence
  chemically synthesized
agtaccaagcagacaaaact

SEQ ID NO: 166495 - DNA, 20 bp, Artificial Sequence
  chemically synthesized
gtaccaagcagacaaaactg

SEQ ID NO: 166496 - DNA, 20 bp, Artificial Sequence
  chemically synthesized
gcagacaaaactgaggctca

SEQ ID NO: 166497 - DNA, 20 bp, Artificial Sequence
  chemically synthesized
taccctctctctgtgagcct

SEQ ID NO: 166498 - DNA, 20 bp, Artificial Sequence
  chemically synthesized
agacaaaactgaggctcaca

SEQ ID NO: 166499 - DNA, 20 bp, Artificial Sequence
  chemically synthesized
acaaaactgaggctcacaga

SEQ ID NO: 166500 - DNA, 20 bp, Artificial Sequence
  chemically synthesized
aaaactgaggctcacagaga

SEQ ID NO: 166501 - DNA, 20 bp, Artificial Sequence
  chemically synthesized
atgtaataccctctctctgt

SEQ ID NO: 166502 - DNA, 20 bp, Artificial Sequence
  chemically synthesized
aaactgaggctcacagagag

SEQ ID NO: 166503 - DNA, 20 bp, Artificial Sequence
  chemically synthesized
aactgaggctcacagagaga

SEQ ID NO: 166504 - DNA, 20 bp, Artificial Sequence
  chemically synthesized
ggtattacatatttttctaa

SEQ ID NO: 166505 - DNA, 20 bp, Artificial Sequence
  chemically synthesized
gtattacatatttttctaac

SEQ ID NO: 166506 - DNA, 20 bp, Artificial Sequence
  chemically synthesized
caaactctgagcacacctgt

SEQ ID NO: 166507 - DNA, 20 bp, Artificial Sequence
  chemically synthesized
atttttctaacaggtgtgct

SEQ ID NO: 166508 - DNA, 20 bp, Artificial Sequence
  chemically synthesized
ttttctaacaggtgtgctca

SEQ ID NO: 166509 - DNA, 20 bp, Artificial Sequence
  chemically synthesized
gttttctctagtcaaactct

SEQ ID NO: 166510 - DNA, 20 bp, Artificial Sequence
  chemically synthesized
aggtgtgctcagagtttgac

SEQ ID NO: 166511 - DNA, 20 bp, Artificial Sequence
  chemically synthesized
gtgtgctcagagtttgacta

SEQ ID NO: 166512 - DNA, 20 bp, Artificial Sequence
  chemically synthesized
ttcgggtagtttgttttctc

SEQ ID NO: 166513 - DNA, 20 bp, Artificial Sequence
  chemically synthesized
gagaaaacaaactacccgaa

SEQ ID NO: 166514 - DNA, 20 bp, Artificial Sequence
  chemically synthesized
ctgaggccttgccattcggg

SEQ ID NO: 166515 - DNA, 20 bp, Artificial Sequence
  chemically synthesized
aaacaaactacccgaatggc

SEQ ID NO: 166516 - DNA, 20 bp, Artificial Sequence
  chemically synthesized
ggtctgaggccttgccattc

SEQ ID NO: 166517 - DNA, 20 bp, Artificial Sequence
  chemically synthesized
aacaaactacccgaatggca

SEQ ID NO: 166518 - DNA, 20 bp, Artificial Sequence
  chemically synthesized
gggtctgaggccttgccatt

SEQ ID NO: 166519 - DNA, 20 bp, Artificial Sequence
  chemically synthesized
ctacccgaatggcaaggcct

SEQ ID NO: 166520 - DNA, 20 bp, Artificial Sequence
  chemically synthesized
cctcggaaacaaagggtctg

SEQ ID NO: 166521 - DNA, 20 bp, Artificial Sequence
  chemically synthesized
gcctcggaaacaaagggtct

SEQ ID NO: 166522 - DNA, 20 bp, Artificial Sequence
  chemically synthesized
atagctgcctcggaaacaaa

SEQ ID NO: 166523 - DNA, 20 bp, Artificial Sequence
  chemically synthesized
catagctgcctcggaaacaa

SEQ ID NO: 166524 - DNA, 20 bp, Artificial Sequence
  chemically synthesized
gcctcagaccctttgtttcc

SEQ ID NO: 166525 - DNA, 20 bp, Artificial Sequence
  chemically synthesized
ccatagctgcctcggaaaca

SEQ ID NO: 166526 - DNA, 20 bp, Artificial Sequence
  chemically synthesized
cctcagaccctttgtttccg

SEQ ID NO: 166527 - DNA, 20 bp, Artificial Sequence
  chemically synthesized
cagaccctttgtttccgagg

SEQ ID NO: 166528 - DNA, 20 bp, Artificial Sequence
  chemically synthesized
catggtggccatagctgcct

SEQ ID NO: 166529 - DNA, 20 bp, Artificial Sequence
  chemically synthesized
ctttgtttccgaggcagcta

SEQ ID NO: 166530 - DNA, 20 bp, Artificial Sequence
  chemically synthesized
ttgtctggccatggtggcca

SEQ ID NO: 166531 - DNA, 20 bp, Artificial Sequence
  chemically synthesized
cgaggcagctatggccacca

SEQ ID NO: 166532 - DNA, 20 bp, Artificial Sequence
  chemically synthesized
gcagctatggccaccatggc

SEQ ID NO: 166533 - DNA, 20 bp, Artificial Sequence
  chemically synthesized
cttgccttgtctggccatgg

SEQ ID NO: 166534 - DNA, 20 bp, Artificial Sequence
  chemically synthesized
aaacttgccttgtctggcca

SEQ ID NO: 166535 - DNA, 20 bp, Artificial Sequence
  chemically synthesized
tatggccaccatggccagac

SEQ ID NO: 166536 - DNA, 20 bp, Artificial Sequence
  chemically synthesized
atggccaccatggccagaca

SEQ ID NO: 166537 - DNA, 20 bp, Artificial Sequence
  chemically synthesized
gtaaagaaacttgccttgtc

SEQ ID NO: 166538 - DNA, 20 bp, Artificial Sequence
  chemically synthesized
ccaccatggccagacaaggc

SEQ ID NO: 166539 - DNA, 20 bp, Artificial Sequence
  chemically synthesized
aaggcaagtttctttacatt

SEQ ID NO: 166540 - DNA, 20 bp, Artificial Sequence
  chemically synthesized
aggcaagtttctttacattt

SEQ ID NO: 166541 - DNA, 20 bp, Artificial Sequence
  chemically synthesized
agctccaaatcctaaatgta

SEQ ID NO: 166542 - DNA, 20 bp, Artificial Sequence
  chemically synthesized
gtttctttacatttaggatt

SEQ ID NO: 166543 - DNA, 20 bp, Artificial Sequence
  chemically synthesized
ttctttacatttaggatttg

SEQ ID NO: 166544 - DNA, 20 bp, Artificial Sequence
  chemically synthesized
ttacatttaggatttggagc

SEQ ID NO: 166545 - DNA, 20 bp, Artificial Sequence
  chemically synthesized
tacatttaggatttggagct

SEQ ID NO: 166546 - DNA, 20 bp, Artificial Sequence
  chemically synthesized
acatttaggatttggagcta

SEQ ID NO: 166547 - DNA, 20 bp, Artificial Sequence
  chemically synthesized
catttaggatttggagctag

SEQ ID NO: 166548 - DNA, 20 bp, Artificial Sequence
  chemically synthesized
aggatttggagctaggggcg

SEQ ID NO: 166549 - DNA, 20 bp, Artificial Sequence
  chemically synthesized
tatacgaacagccacgcccc

SEQ ID NO: 166550 - DNA, 20 bp, Artificial Sequence
  chemically synthesized
aaaggaagtagatatacgaa

SEQ ID NO: 166551 - DNA, 20 bp, Artificial Sequence
  chemically synthesized
aagagttaatgcaaaggaag

SEQ ID NO: 166552 - DNA, 20 bp, Artificial Sequence
  chemically synthesized
agaaagagttaatgcaaagg

SEQ ID NO: 166553 - DNA, 20 bp, Artificial Sequence
  chemically synthesized
ttaagaaagagttaatgcaa

SEQ ID NO: 166554 - DNA, 20 bp, Artificial Sequence
  chemically synthesized
cttaagaaagagttaatgca

SEQ ID NO: 166555 - DNA, 20 bp, Artificial Sequence
  chemically synthesized
ctttgcattaactctttctt

SEQ ID NO: 166556 - DNA, 20 bp, Artificial Sequence
  chemically synthesized
tttactaaaatcttaagaaa

SEQ ID NO: 166557 - DNA, 20 bp, Artificial Sequence
  chemically synthesized
cctttactaaaatcttaaga

SEQ ID NO: 166558 - DNA, 20 bp, Artificial Sequence
  chemically synthesized
ttaactctttcttaagattt

SEQ ID NO: 166559 - DNA, 20 bp, Artificial Sequence
  chemically synthesized
aacacctttactaaaatctt

SEQ ID NO: 166560 - DNA, 20 bp, Artificial Sequence
  chemically synthesized
tctttcttaagattttagta

SEQ ID NO: 166561 - DNA, 20 bp, Artificial Sequence
  chemically synthesized
ctttcttaagattttagtaa

SEQ ID NO: 166562 - DNA, 20 bp, Artificial Sequence
  chemically synthesized
atgcccttttttttaacaca

SEQ ID NO: 166563 - DNA, 20 bp, Artificial Sequence
  chemically synthesized
catgcccttttttttaacac

SEQ ID NO: 166564 - DNA, 20 bp, Artificial Sequence
  chemically synthesized
ttttaccttgtgttaaaaaa

SEQ ID NO: 166565 - DNA, 20 bp, Artificial Sequence
  chemically synthesized
tttaccttgtgttaaaaaaa

SEQ ID NO: 166566 - DNA, 20 bp, Artificial Sequence
  chemically synthesized
ttaccttgtgttaaaaaaaa

SEQ ID NO: 166567 - DNA, 20 bp, Artificial Sequence
  chemically synthesized
taaaatttttaaggagtttt

SEQ ID NO: 166568 - DNA, 20 bp, Artificial Sequence
  chemically synthesized
ccaaaaataaaatttttaag

SEQ ID NO: 166569 - DNA, 20 bp, Artificial Sequence
  chemically synthesized
caccaaaaataaaattttta

SEQ ID NO: 166570 - DNA, 20 bp, Artificial Sequence
  chemically synthesized
acaccaaaaataaaattttt

SEQ ID NO: 166571 - DNA, 20 bp, Artificial Sequence
  chemically synthesized
ctccttaaaaattttatttt

SEQ ID NO: 166572 - DNA, 20 bp, Artificial Sequence
  chemically synthesized
aaaattttatttttggtgtt

SEQ ID NO: 166573 - DNA, 20 bp, Artificial Sequence
  chemically synthesized
attttatttttggtgttcag

SEQ ID NO: 166574 - DNA, 20 bp, Artificial Sequence
  chemically synthesized
gtgttcagtagtttgaaact

SEQ ID NO: 166575 - DNA, 20 bp, Artificial Sequence
  chemically synthesized
cagtagtttgaaactaagta

SEQ ID NO: 166576 - DNA, 20 bp, Artificial Sequence
  chemically synthesized
acactagactttgctttact

SEQ ID NO: 166577 - DNA, 20 bp, Artificial Sequence
  chemically synthesized
gtttgaaactaagtaaagca

SEQ ID NO: 166578 - DNA, 20 bp, Artificial Sequence
  chemically synthesized
aaactaagtaaagcaaagtc

SEQ ID NO: 166579 - DNA, 20 bp, Artificial Sequence
  chemically synthesized
attaaagaaagatgggacac

SEQ ID NO: 166580 - DNA, 20 bp, Artificial Sequence
  chemically synthesized
tttttccattaaagaaagat

SEQ ID NO: 166581 - DNA, 20 bp, Artificial Sequence
  chemically synthesized
atttttccattaaagaaaga

SEQ ID NO: 166582 - DNA, 20 bp, Artificial Sequence
  chemically synthesized
agtgtcccatctttctttaa

SEQ ID NO: 166583 - DNA, 20 bp, Artificial Sequence
  chemically synthesized
aactatttttccattaaaga

SEQ ID NO: 166584 - DNA, 20 bp, Artificial Sequence
  chemically synthesized
attaaactatttttccatta

SEQ ID NO: 166585 - DNA, 20 bp, Artificial Sequence
  chemically synthesized
atctttctttaatggaaaaa

SEQ ID NO: 166586 - DNA, 20 bp, Artificial Sequence
  chemically synthesized
aaaaatagtttaattccttt

SEQ ID NO: 166587 - DNA, 20 bp, Artificial Sequence
  chemically synthesized
aatagtttaattcctttaag

SEQ ID NO: 166588 - DNA, 20 bp, Artificial Sequence
  chemically synthesized
tagtttaattcctttaagca

SEQ ID NO: 166589 - DNA, 20 bp, Artificial Sequence
  chemically synthesized
tgctgtattcctctgcttaa

SEQ ID NO: 166590 - DNA, 20 bp, Artificial Sequence
  chemically synthesized
agtttaattcctttaagcag

SEQ ID NO: 166591 - DNA, 20 bp, Artificial Sequence
  chemically synthesized
ctgctgtattcctctgctta

SEQ ID NO: 166592 - DNA, 20 bp, Artificial Sequence
  chemically synthesized
ttcctttaagcagaggaata

SEQ ID NO: 166593 - DNA, 20 bp, Artificial Sequence
  chemically synthesized
ctttaagcagaggaatacag

SEQ ID NO: 166594 - DNA, 20 bp, Artificial Sequence
  chemically synthesized
tttaagcagaggaatacagc

SEQ ID NO: 166595 - DNA, 20 bp, Artificial Sequence
  chemically synthesized
agaggaatacagcaggctgt

SEQ ID NO: 166596 - DNA, 20 bp, Artificial Sequence
  chemically synthesized
gaggaatacagcaggctgta

SEQ ID NO: 166597 - DNA, 20 bp, Artificial Sequence
  chemically synthesized
atataggatattagtcctta

SEQ ID NO: 166598 - DNA, 20 bp, Artificial Sequence
  chemically synthesized
tgatttaagatataggatat

SEQ ID NO: 166599 - DNA, 20 bp, Artificial Sequence
  chemically synthesized
gtttttctgatttaagatat

SEQ ID NO: 166600 - DNA, 20 bp, Artificial Sequence
  chemically synthesized
agtttttctgatttaagata

SEQ ID NO: 166601 - DNA, 20 bp, Artificial Sequence
  chemically synthesized
taatatcctatatcttaaat

SEQ ID NO: 166602 - DNA, 20 bp, Artificial Sequence
  chemically synthesized
ttgcacagtttttctgattt

SEQ ID NO: 166603 - DNA, 20 bp, Artificial Sequence
  chemically synthesized
aatgatttattaagattgca

SEQ ID NO: 166604 - DNA, 20 bp, Artificial Sequence
  chemically synthesized
tcactaataaatgatttatt

SEQ ID NO: 166605 - DNA, 20 bp, Artificial Sequence
  chemically synthesized
aatcttaataaatcatttat

SEQ ID NO: 166606 - DNA, 20 bp, Artificial Sequence
  chemically synthesized
aataaatcatttattagtga

SEQ ID NO: 166607 - DNA, 20 bp, Artificial Sequence
  chemically synthesized
ataaatcatttattagtgaa

SEQ ID NO: 166608 - DNA, 20 bp, Artificial Sequence
  chemically synthesized
tcatttattagtgaaaggaa

SEQ ID NO: 166609 - DNA, 20 bp, Artificial Sequence
  chemically synthesized
tttattagtgaaaggaatgg

SEQ ID NO: 166610 - DNA, 20 bp, Artificial Sequence
  chemically synthesized
ttagtgaaaggaatggaagc

SEQ ID NO: 166611 - DNA, 20 bp, Artificial Sequence
  chemically synthesized
aaaggaatggaagctagaca

SEQ ID NO: 166612 - DNA, 20 bp, Artificial Sequence
  chemically synthesized
aggaatggaagctagacaaa

SEQ ID NO: 166613 - DNA, 20 bp, Artificial Sequence
  chemically synthesized
ggaatggaagctagacaaag

SEQ ID NO: 166614 - DNA, 20 bp, Artificial Sequence
  chemically synthesized
gttttttatccctctttgtc

SEQ ID NO: 166615 - DNA, 20 bp, Artificial Sequence
  chemically synthesized
gaatggaagctagacaaaga

SEQ ID NO: 166616 - DNA, 20 bp, Artificial Sequence
  chemically synthesized
gacaaagagggataaaaaac

SEQ ID NO: 166617 - DNA, 20 bp, Artificial Sequence
  chemically synthesized
acaaagagggataaaaaaca

SEQ ID NO: 166618 - DNA, 20 bp, Artificial Sequence
  chemically synthesized
aaggtaaattattattcaca

SEQ ID NO: 166619 - DNA, 20 bp, Artificial Sequence
  chemically synthesized
aggtaaattattattcacac

SEQ ID NO: 166620 - DNA, 20 bp, Artificial Sequence
  chemically synthesized
cccagcttataattaggaaa

SEQ ID NO: 166621 - DNA, 20 bp, Artificial Sequence
  chemically synthesized
ggtcaccatttcctaattat

SEQ ID NO: 166622 - DNA, 20 bp, Artificial Sequence
  chemically synthesized
caaacccccagcttataatt

SEQ ID NO: 166623 - DNA, 20 bp, Artificial Sequence
  chemically synthesized
tcaaacccccagcttataat

SEQ ID NO: 166624 - DNA, 20 bp, Artificial Sequence
  chemically synthesized
accatttcctaattataagc

SEQ ID NO: 166625 - DNA, 20 bp, Artificial Sequence
  chemically synthesized
ccatttcctaattataagct

SEQ ID NO: 166626 - DNA, 20 bp, Artificial Sequence
  chemically synthesized
catttcctaattataagctg

SEQ ID NO: 166627 - DNA, 20 bp, Artificial Sequence
  chemically synthesized
atttcctaattataagctgg

SEQ ID NO: 166628 - DNA, 20 bp, Artificial Sequence
  chemically synthesized
taattataagctgggggttt

SEQ ID NO: 166629 - DNA, 20 bp, Artificial Sequence
  chemically synthesized
cccaaaaattctcaaacccc

SEQ ID NO: 166630 - DNA, 20 bp, Artificial Sequence
  chemically synthesized
gctgggggtttgagaatttt

SEQ ID NO: 166631 - DNA, 20 bp, Artificial Sequence
  chemically synthesized
ctgggggtttgagaattttt

SEQ ID NO: 166632 - DNA, 20 bp, Artificial Sequence
  chemically synthesized
gggggtttgagaatttttgg

SEQ ID NO: 166633 - DNA, 20 bp, Artificial Sequence
  chemically synthesized
aatttttgggagaaactctc

SEQ ID NO: 166634 - DNA, 20 bp, Artificial Sequence
  chemically synthesized
tcatagatttgatgacttga

SEQ ID NO: 166635 - DNA, 20 bp, Artificial Sequence
  chemically synthesized
aatcatagatttgatgactt

SEQ ID NO: 166636 - DNA, 20 bp, Artificial Sequence
  chemically synthesized
ggaggggaaacataaaatca

SEQ ID NO: 166637 - DNA, 20 bp, Artificial Sequence
  chemically synthesized
tgtgttcaaggtggggggag

SEQ ID NO: 166638 - DNA, 20 bp, Artificial Sequence
  chemically synthesized
ctgtgttcaaggtgggggga

SEQ ID NO: 166639 - DNA, 20 bp, Artificial Sequence
  chemically synthesized
gctgtgttcaaggtgggggg

SEQ ID NO: 166640 - DNA, 20 bp, Artificial Sequence
  chemically synthesized
ggctgtgttcaaggtggggg

SEQ ID NO: 166641 - DNA, 20 bp, Artificial Sequence
  chemically synthesized
gtggctgtgttcaaggtggg

SEQ ID NO: 166642 - DNA, 20 bp, Artificial Sequence
  chemically synthesized
tgtggctgtgttcaaggtgg

SEQ ID NO: 166643 - DNA, 20 bp, Artificial Sequence
  chemically synthesized
ttgtggctgtgttcaaggtg

SEQ ID NO: 166644 - DNA, 20 bp, Artificial Sequence
  chemically synthesized
cttgtggctgtgttcaaggt

SEQ ID NO: 166645 - DNA, 20 bp, Artificial Sequence
  chemically synthesized
gcttgtggctgtgttcaagg

SEQ ID NO: 166646 - DNA, 20 bp, Artificial Sequence
  chemically synthesized
ccctccccccaccttgaaca

SEQ ID NO: 166647 - DNA, 20 bp, Artificial Sequence
  chemically synthesized
tctgcttgtggctgtgttca

SEQ ID NO: 166648 - DNA, 20 bp, Artificial Sequence
  chemically synthesized
ttctgcttgtggctgtgttc

SEQ ID NO: 166649 - DNA, 20 bp, Artificial Sequence
  chemically synthesized
cccaccttgaacacagccac

SEQ ID NO: 166650 - DNA, 20 bp, Artificial Sequence
  chemically synthesized
accttgaacacagccacaag

SEQ ID NO: 166651 - DNA, 20 bp, Artificial Sequence
  chemically synthesized
ttgaacacagccacaagcag

SEQ ID NO: 166652 - DNA, 20 bp, Artificial Sequence
  chemically synthesized
tagcctttttcttctgcttg

SEQ ID NO: 166653 - DNA, 20 bp, Artificial Sequence
  chemically synthesized
acagccacaagcagaagaaa

SEQ ID NO: 166654 - DNA, 20 bp, Artificial Sequence
  chemically synthesized
cagccacaagcagaagaaaa

SEQ ID NO: 166655 - DNA, 20 bp, Artificial Sequence
  chemically synthesized
aagcagaagaaaaaggctaa

SEQ ID NO: 166656 - DNA, 20 bp, Artificial Sequence
  chemically synthesized
gcagaagaaaaaggctaaaa

SEQ ID NO: 166657 - DNA, 20 bp, Artificial Sequence
  chemically synthesized
agacttcaaaaatactcttt

SEQ ID NO: 166658 - DNA, 20 bp, Artificial Sequence
  chemically synthesized
aggctaaaagagtatttttg

SEQ ID NO: 166659 - DNA, 20 bp, Artificial Sequence
  chemically synthesized
tatttttgaagtctgcactc

SEQ ID NO: 166660 - DNA, 20 bp, Artificial Sequence
  chemically synthesized
tttttgaagtctgcactcca

SEQ ID NO: 166661 - DNA, 20 bp, Artificial Sequence
  chemically synthesized
agtttcttatctctggagtg

SEQ ID NO: 166662 - DNA, 20 bp, Artificial Sequence
  chemically synthesized
gaagtctgcactccagagat

SEQ ID NO: 166663 - DNA, 20 bp, Artificial Sequence
  chemically synthesized
ttccgagtttcttatctctg

SEQ ID NO: 166664 - DNA, 20 bp, Artificial Sequence
  chemically synthesized
cattccgagtttcttatctc

SEQ ID NO: 166665 - DNA, 20 bp, Artificial Sequence
  chemically synthesized
cactccagagataagaaact

SEQ ID NO: 166666 - DNA, 20 bp, Artificial Sequence
  chemically synthesized
cagtcctctgagcacattcc

SEQ ID NO: 166667 - DNA, 20 bp, Artificial Sequence
  chemically synthesized
taagaaactcggaatgtgct

SEQ ID NO: 166668 - DNA, 20 bp, Artificial Sequence
  chemically synthesized
agaaactcggaatgtgctca

SEQ ID NO: 166669 - DNA, 20 bp, Artificial Sequence
  chemically synthesized
gaaactcggaatgtgctcag

SEQ ID NO: 166670 - DNA, 20 bp, Artificial Sequence
  chemically synthesized
ctccttggcttcagtcctct

SEQ ID NO: 166671 - DNA, 20 bp, Artificial Sequence
  chemically synthesized
ggaatgtgctcagaggactg

SEQ ID NO: 166672 - DNA, 20 bp, Artificial Sequence
  chemically synthesized
gtgctcagaggactgaagcc

SEQ ID NO: 166673 - DNA, 20 bp, Artificial Sequence
  chemically synthesized
tgctcagaggactgaagcca

SEQ ID NO: 166674 - DNA, 20 bp, Artificial Sequence
  chemically synthesized
ggcagaaaactccttggctt

SEQ ID NO: 166675 - DNA, 20 bp, Artificial Sequence
  chemically synthesized
ctcagaggactgaagccaag

SEQ ID NO: 166676 - DNA, 20 bp, Artificial Sequence
  chemically synthesized
tttcctggcagaaaactcct

SEQ ID NO: 166677 - DNA, 20 bp, Artificial Sequence
  chemically synthesized
gaagccaaggagttttctgc

SEQ ID NO: 166678 - DNA, 20 bp, Artificial Sequence
  chemically synthesized
aagccaaggagttttctgcc

SEQ ID NO: 166679 - DNA, 20 bp, Artificial Sequence
  chemically synthesized
gggagctgcttttttcctgg

SEQ ID NO: 166680 - DNA, 20 bp, Artificial Sequence
  chemically synthesized
ggagttttctgccaggaaaa

SEQ ID NO: 166681 - DNA, 20 bp, Artificial Sequence
  chemically synthesized
agagggagctgcttttttcc

SEQ ID NO: 166682 - DNA, 20 bp, Artificial Sequence
  chemically synthesized
gttttctgccaggaaaaaag

SEQ ID NO: 166683 - DNA, 20 bp, Artificial Sequence
  chemically synthesized
taaatcactgaggggagagg

SEQ ID NO: 166684 - DNA, 20 bp, Artificial Sequence
  chemically synthesized
tttaaatcactgaggggaga

SEQ ID NO: 166685 - DNA, 20 bp, Artificial Sequence
  chemically synthesized
aaagcagctccctctcccct

SEQ ID NO: 166686 - DNA, 20 bp, Artificial Sequence
  chemically synthesized
ttttaaatcactgaggggag

SEQ ID NO: 166687 - DNA, 20 bp, Artificial Sequence
  chemically synthesized
gttttaaatcactgagggga

SEQ ID NO: 166688 - DNA, 20 bp, Artificial Sequence
  chemically synthesized
ttgttttaaatcactgaggg

SEQ ID NO: 166689 - DNA, 20 bp, Artificial Sequence
  chemically synthesized
gcttgttttaaatcactgag

SEQ ID NO: 166690 - DNA, 20 bp, Artificial Sequence
  chemically synthesized
agcttgttttaaatcactga

SEQ ID NO: 166691 - DNA, 20 bp, Artificial Sequence
  chemically synthesized
cagcttgttttaaatcactg

SEQ ID NO: 166692 - DNA, 20 bp, Artificial Sequence
  chemically synthesized
gcagcttgttttaaatcact

SEQ ID NO: 166693 - DNA, 20 bp, Artificial Sequence
  chemically synthesized
tcccctcagtgatttaaaac

SEQ ID NO: 166694 - DNA, 20 bp, Artificial Sequence
  chemically synthesized
cagtgatttaaaacaagctg

SEQ ID NO: 166695 - DNA, 20 bp, Artificial Sequence
  chemically synthesized
agtgatttaaaacaagctgc

SEQ ID NO: 166696 - DNA, 20 bp, Artificial Sequence
  chemically synthesized
tgatttaaaacaagctgcag

SEQ ID NO: 166697 - DNA, 20 bp, Artificial Sequence
  chemically synthesized
gatttaaaacaagctgcagg

SEQ ID NO: 166698 - DNA, 20 bp, Artificial Sequence
  chemically synthesized
gtcatgatatttgcctcctg

SEQ ID NO: 166699 - DNA, 20 bp, Artificial Sequence
  chemically synthesized
gaggcaaatatcatgactct

SEQ ID NO: 166700 - DNA, 20 bp, Artificial Sequence
  chemically synthesized
ctgctgtgtgtagtttctga

SEQ ID NO: 166701 - DNA, 20 bp, Artificial Sequence
  chemically synthesized
cactgctgtgtgtagtttct

SEQ ID NO: 166702 - DNA, 20 bp, Artificial Sequence
  chemically synthesized
tgactctcagaaactacaca

SEQ ID NO: 166703 - DNA, 20 bp, Artificial Sequence
  chemically synthesized
ctctcagaaactacacacag

SEQ ID NO: 166704 - DNA, 20 bp, Artificial Sequence
  chemically synthesized
tcaccactcactgctgtgtg

SEQ ID NO: 166705 - DNA, 20 bp, Artificial Sequence
  chemically synthesized
cagaaactacacacagcagt

SEQ ID NO: 166706 - DNA, 20 bp, Artificial Sequence
  chemically synthesized
aaactacacacagcagtgag

SEQ ID NO: 166707 - DNA, 20 bp, Artificial Sequence
  chemically synthesized
cagcagtgagtggtgacttg

SEQ ID NO: 166708 - DNA, 20 bp, Artificial Sequence
  chemically synthesized
cttttctttatcaaagctac

SEQ ID NO: 166709 - DNA, 20 bp, Artificial Sequence
  chemically synthesized
ggtgacttgtagctttgata

SEQ ID NO: 166710 - DNA, 20 bp, Artificial Sequence
  chemically synthesized
ttaatcacttttctttatca

SEQ ID NO: 166711 - DNA, 20 bp, Artificial Sequence
  chemically synthesized
cttgtagctttgataaagaa

SEQ ID NO: 166712 - DNA, 20 bp, Artificial Sequence
  chemically synthesized
ataaagaaaagtgattaaca

SEQ ID NO: 166713 - DNA, 20 bp, Artificial Sequence
  chemically synthesized
gaaaagtgattaacacagcc

SEQ ID NO: 166714 - DNA, 20 bp, Artificial Sequence
  chemically synthesized
gtgattaacacagccgagta

SEQ ID NO: 166715 - DNA, 20 bp, Artificial Sequence
  chemically synthesized
tttgaagtgaaagccatact

SEQ ID NO: 166716 - DNA, 20 bp, Artificial Sequence
  chemically synthesized
gtccctgcagtttgaagtga

SEQ ID NO: 166717 - DNA, 20 bp, Artificial Sequence
  chemically synthesized
atggctttcacttcaaactg

SEQ ID NO: 166718 - DNA, 20 bp, Artificial Sequence
  chemically synthesized
aaatgggtccctgcagtttg

SEQ ID NO: 166719 - DNA, 20 bp, Artificial Sequence
  chemically synthesized
tggctttcacttcaaactgc

SEQ ID NO: 166720 - DNA, 20 bp, Artificial Sequence
  chemically synthesized
ggctttcacttcaaactgca

SEQ ID NO: 166721 - DNA, 20 bp, Artificial Sequence
  chemically synthesized
ctctgccaaatgggtccctg

SEQ ID NO: 166722 - DNA, 20 bp, Artificial Sequence
  chemically synthesized
tcaaactgcagggacccatt

SEQ ID NO: 166723 - DNA, 20 bp, Artificial Sequence
  chemically synthesized
aactgcagggacccatttgg

SEQ ID NO: 166724 - DNA, 20 bp, Artificial Sequence
  chemically synthesized
cccatagggctctgccaaat

SEQ ID NO: 166725 - DNA, 20 bp, Artificial Sequence
  chemically synthesized
ctgcagggacccatttggca

SEQ ID NO: 166726 - DNA, 20 bp, Artificial Sequence
  chemically synthesized
gcccatagggctctgccaaa

SEQ ID NO: 166727 - DNA, 20 bp, Artificial Sequence
  chemically synthesized
acccatttggcagagcccta

SEQ ID NO: 166728 - DNA, 20 bp, Artificial Sequence
  chemically synthesized
cccatttggcagagccctat

SEQ ID NO: 166729 - DNA, 20 bp, Artificial Sequence
  chemically synthesized
tcgattgtctatggcccata

SEQ ID NO: 166730 - DNA, 20 bp, Artificial Sequence
  chemically synthesized
ttcgattgtctatggcccat

SEQ ID NO: 166731 - DNA, 20 bp, Artificial Sequence
  chemically synthesized
tggcagagccctatgggcca

SEQ ID NO: 166732 - DNA, 20 bp, Artificial Sequence
  chemically synthesized
cttcgattgtctatggccca

SEQ ID NO: 166733 - DNA, 20 bp, Artificial Sequence
  chemically synthesized
attgtgtcttcgattgtcta

SEQ ID NO: 166734 - DNA, 20 bp, Artificial Sequence
  chemically synthesized
ctatgggccatagacaatcg

SEQ ID NO: 166735 - DNA, 20 bp, Artificial Sequence
  chemically synthesized
agacaatcgaagacacaatg

SEQ ID NO: 166736 - DNA, 20 bp, Artificial Sequence
  chemically synthesized
gacaatcgaagacacaatgc

SEQ ID NO: 166737 - DNA, 20 bp, Artificial Sequence
  chemically synthesized
tcattatttgaaaaccattc

SEQ ID NO: 166738 - DNA, 20 bp, Artificial Sequence
  chemically synthesized
cattatttgaaaaccattcc

SEQ ID NO: 166739 - DNA, 20 bp, Artificial Sequence
  chemically synthesized
attatttgaaaaccattccg

SEQ ID NO: 166740 - DNA, 20 bp, Artificial Sequence
  chemically synthesized
ttatttgaaaaccattccgg

SEQ ID NO: 166741 - DNA, 20 bp, Artificial Sequence
  chemically synthesized
tatttgaaaaccattccggg

SEQ ID NO: 166742 - DNA, 20 bp, Artificial Sequence
  chemically synthesized
ccagtctgtgccccccggaa

SEQ ID NO: 166743 - DNA, 20 bp, Artificial Sequence
  chemically synthesized
gaaaaccattccggggggca

SEQ ID NO: 166744 - DNA, 20 bp, Artificial Sequence
  chemically synthesized
ttgtcccagtctgtgccccc

SEQ ID NO: 166745 - DNA, 20 bp, Artificial Sequence
  chemically synthesized
ccattccggggggcacagac

SEQ ID NO: 166746 - DNA, 20 bp, Artificial Sequence
  chemically synthesized
cattccggggggcacagact

SEQ ID NO: 166747 - DNA, 20 bp, Artificial Sequence
  chemically synthesized
gggggcacagactgggacaa

SEQ ID NO: 166748 - DNA, 20 bp, Artificial Sequence
  chemically synthesized
aatcaaaatgacttttgtcc

SEQ ID NO: 166749 - DNA, 20 bp, Artificial Sequence
  chemically synthesized
ggacaaaagtcattttgatt

SEQ ID NO: 166750 - DNA, 20 bp, Artificial Sequence
  chemically synthesized
agtcattttgattgagtaaa

SEQ ID NO: 166751 - DNA, 20 bp, Artificial Sequence
  chemically synthesized
gtcattttgattgagtaaac

SEQ ID NO: 166752 - DNA, 20 bp, Artificial Sequence
  chemically synthesized
tttgaatcccttggtacaaa

SEQ ID NO: 166753 - DNA, 20 bp, Artificial Sequence
  chemically synthesized
aaacaggatctatttgtacc

SEQ ID NO: 166754 - DNA, 20 bp, Artificial Sequence
  chemically synthesized
aacaggatctatttgtacca

SEQ ID NO: 166755 - DNA, 20 bp, Artificial Sequence
  chemically synthesized
acaggatctatttgtaccaa

SEQ ID NO: 166756 - DNA, 20 bp, Artificial Sequence
  chemically synthesized
agatttttttttgaatccct

SEQ ID NO: 166757 - DNA, 20 bp, Artificial Sequence
  chemically synthesized
tcctggaacacatttaagaa

SEQ ID NO: 166758 - DNA, 20 bp, Artificial Sequence
  chemically synthesized
tctcttcctggaacacattt

SEQ ID NO: 166759 - DNA, 20 bp, Artificial Sequence
  chemically synthesized
atcttttcttaaatgtgttc

SEQ ID NO: 166760 - DNA, 20 bp, Artificial Sequence
  chemically synthesized
tcttttcttaaatgtgttcc

SEQ ID NO: 166761 - DNA, 20 bp, Artificial Sequence
  chemically synthesized
tttcttaaatgtgttccagg

SEQ ID NO: 166762 - DNA, 20 bp, Artificial Sequence
  chemically synthesized
tcttaaatgtgttccaggaa

SEQ ID NO: 166763 - DNA, 20 bp, Artificial Sequence
  chemically synthesized
ttaaatgtgttccaggaaga

SEQ ID NO: 166764 - DNA, 20 bp, Artificial Sequence
  chemically synthesized
atgctagctatctctcttcc

SEQ ID NO: 166765 - DNA, 20 bp, Artificial Sequence
  chemically synthesized
atgtgttccaggaagagaga

SEQ ID NO: 166766 - DNA, 20 bp, Artificial Sequence
  chemically synthesized
gttccaggaagagagatagc

SEQ ID NO: 166767 - DNA, 20 bp, Artificial Sequence
  chemically synthesized
gaagagagatagctagcatt

SEQ ID NO: 166768 - DNA, 20 bp, Artificial Sequence
  chemically synthesized
gtttaaaaaatactcaatgc

SEQ ID NO: 166769 - DNA, 20 bp, Artificial Sequence
  chemically synthesized
aatgtgcctctttattataa

SEQ ID NO: 166770 - DNA, 20 bp, Artificial Sequence
  chemically synthesized
ttttttaaactattataata

SEQ ID NO: 166771 - DNA, 20 bp, Artificial Sequence
  chemically synthesized
ttttaaactattataataaa

SEQ ID NO: 166772 - DNA, 20 bp, Artificial Sequence
  chemically synthesized
tttaaactattataataaag

SEQ ID NO: 166773 - DNA, 20 bp, Artificial Sequence
  chemically synthesized
aaagaggcacattttaacca

SEQ ID NO: 166774 - DNA, 20 bp, Artificial Sequence
  chemically synthesized
actcttttaaatgcaatctt

SEQ ID NO: 166775 - DNA, 20 bp, Artificial Sequence
  chemically synthesized
taaccaaagattgcatttaa

SEQ ID NO: 166776 - DNA, 20 bp, Artificial Sequence
  chemically synthesized
accaaagattgcatttaaaa

SEQ ID NO: 166777 - DNA, 20 bp, Artificial Sequence
  chemically synthesized
aaagattgcatttaaaagag

SEQ ID NO: 166778 - DNA, 20 bp, Artificial Sequence
  chemically synthesized
gtagaatgtgcttttaccgt

SEQ ID NO: 166779 - DNA, 20 bp, Artificial Sequence
  chemically synthesized
ctttttgtagctcacggtaa

SEQ ID NO: 166780 - DNA, 20 bp, Artificial Sequence
  chemically synthesized
aaatagctttttgtagctca

SEQ ID NO: 166781 - DNA, 20 bp, Artificial Sequence
  chemically synthesized
cttttaccgtgagctacaaa

SEQ ID NO: 166782 - DNA, 20 bp, Artificial Sequence
  chemically synthesized
caaccagaaatagctttttg

SEQ ID NO: 166783 - DNA, 20 bp, Artificial Sequence
  chemically synthesized
gagctacaaaaagctatttc

SEQ ID NO: 166784 - DNA, 20 bp, Artificial Sequence
  chemically synthesized
tctttcctcccaaccagaaa

SEQ ID NO: 166785 - DNA, 20 bp, Artificial Sequence
  chemically synthesized
tacaaaaagctatttctggt

SEQ ID NO: 166786 - DNA, 20 bp, Artificial Sequence
  chemically synthesized
acaaaaagctatttctggtt

SEQ ID NO: 166787 - DNA, 20 bp, Artificial Sequence
  chemically synthesized
aaaaagctatttctggttgg

SEQ ID NO: 166788 - DNA, 20 bp, Artificial Sequence
  chemically synthesized
aaaagctatttctggttggg

SEQ ID NO: 166789 - DNA, 20 bp, Artificial Sequence
  chemically synthesized
ataaagtctttcctcccaac

SEQ ID NO: 166790 - DNA, 20 bp, Artificial Sequence
  chemically synthesized
gctatttctggttgggagga

SEQ ID NO: 166791 - DNA, 20 bp, Artificial Sequence
  chemically synthesized
tgcgaagaggaaaggtcata

SEQ ID NO: 166792 - DNA, 20 bp, Artificial Sequence
  chemically synthesized
cgtaatattgcgaagaggaa

SEQ ID NO: 166793 - DNA, 20 bp, Artificial Sequence
  chemically synthesized
gcgtaatattgcgaagagga

SEQ ID NO: 166794 - DNA, 20 bp, Artificial Sequence
  chemically synthesized
actggcgtaatattgcgaag

SEQ ID NO: 166795 - DNA, 20 bp, Artificial Sequence
  chemically synthesized
aactggcgtaatattgcgaa

SEQ ID NO: 166796 - DNA, 20 bp, Artificial Sequence
  chemically synthesized
gtaactggcgtaatattgcg

SEQ ID NO: 166797 - DNA, 20 bp, Artificial Sequence
  chemically synthesized
tcctcttcgcaatattacgc

SEQ ID NO: 166798 - DNA, 20 bp, Artificial Sequence
  chemically synthesized
gtatattcttaaaaagtaac

SEQ ID NO: 166799 - DNA, 20 bp, Artificial Sequence
  chemically synthesized
tattacgccagttacttttt

SEQ ID NO: 166800 - DNA, 20 bp, Artificial Sequence
  chemically synthesized
atatccagtatattcttaaa

SEQ ID NO: 166801 - DNA, 20 bp, Artificial Sequence
  chemically synthesized
gttactttttaagaatatac

SEQ ID NO: 166802 - DNA, 20 bp, Artificial Sequence
  chemically synthesized
tttaagaatatactggatat

SEQ ID NO: 166803 - DNA, 20 bp, Artificial Sequence
  chemically synthesized
attctcaattatcttatatc

SEQ ID NO: 166804 - DNA, 20 bp, Artificial Sequence
  chemically synthesized
atactggatataagataatt

SEQ ID NO: 166805 - DNA, 20 bp, Artificial Sequence
  chemically synthesized
atataagataattgagaatt

SEQ ID NO: 166806 - DNA, 20 bp, Artificial Sequence
  chemically synthesized
agataattgagaatttggct

SEQ ID NO: 166807 - DNA, 20 bp, Artificial Sequence
  chemically synthesized
gataattgagaatttggcta

SEQ ID NO: 166808 - DNA, 20 bp, Artificial Sequence
  chemically synthesized
ggcccaatacacaataacct

SEQ ID NO: 166809 - DNA, 20 bp, Artificial Sequence
  chemically synthesized
tggctaaggttattgtgtat

SEQ ID NO: 166810 - DNA, 20 bp, Artificial Sequence
  chemically synthesized
ggctaaggttattgtgtatt

SEQ ID NO: 166811 - DNA, 20 bp, Artificial Sequence
  chemically synthesized
aggttattgtgtattgggcc

SEQ ID NO: 166812 - DNA, 20 bp, Artificial Sequence
  chemically synthesized
aacaagaaagtacagttact

SEQ ID NO: 166813 - DNA, 20 bp, Artificial Sequence
  chemically synthesized
acaaccccaacaagaaagta

SEQ ID NO: 166814 - DNA, 20 bp, Artificial Sequence
  chemically synthesized
aagtaactgtactttcttgt

SEQ ID NO: 166815 - DNA, 20 bp, Artificial Sequence
  chemically synthesized
agtaactgtactttcttgtt

SEQ ID NO: 166816 - DNA, 20 bp, Artificial Sequence
  chemically synthesized
aataaacaaccccaacaaga

SEQ ID NO: 166817 - DNA, 20 bp, Artificial Sequence
  chemically synthesized
gtaactgtactttcttgttg

SEQ ID NO: 166818 - DNA, 20 bp, Artificial Sequence
  chemically synthesized
gctcaataaacaaccccaac

SEQ ID NO: 166819 - DNA, 20 bp, Artificial Sequence
  chemically synthesized
tcttgttggggttgtttatt

SEQ ID NO: 166820 - DNA, 20 bp, Artificial Sequence
  chemically synthesized
tgttggggttgtttattgag

SEQ ID NO: 166821 - DNA, 20 bp, Artificial Sequence
  chemically synthesized
tttattgagcagtgaaaaat

SEQ ID NO: 166822 - DNA, 20 bp, Artificial Sequence
  chemically synthesized
agtgaaaaatcagtattcat

SEQ ID NO: 166823 - DNA, 20 bp, Artificial Sequence
  chemically synthesized
ttcatgagatgtaattgtac

SEQ ID NO: 166824 - DNA, 20 bp, Artificial Sequence
  chemically synthesized
gatgtaattgtactggtgaa

SEQ ID NO: 166825 - DNA, 20 bp, Artificial Sequence
  chemically synthesized
atgtaattgtactggtgaat

SEQ ID NO: 166826 - DNA, 20 bp, Artificial Sequence
  chemically synthesized
tttgactagctcctattcac

SEQ ID NO: 166827 - DNA, 20 bp, Artificial Sequence
  chemically synthesized
gtaattgtactggtgaatag

SEQ ID NO: 166828 - DNA, 20 bp, Artificial Sequence
  chemically synthesized
ttgtactggtgaataggagc

SEQ ID NO: 166829 - DNA, 20 bp, Artificial Sequence
  chemically synthesized
tgtactcagaggtgtttgac

SEQ ID NO: 166830 - DNA, 20 bp, Artificial Sequence
  chemically synthesized
ggagctagtcaaacacctct

SEQ ID NO: 166831 - DNA, 20 bp, Artificial Sequence
  chemically synthesized
ctagtacatattgtactcag

SEQ ID NO: 166832 - DNA, 20 bp, Artificial Sequence
  chemically synthesized
gctagtacatattgtactca

SEQ ID NO: 166833 - DNA, 20 bp, Artificial Sequence
  chemically synthesized
tagctagtacatattgtact

SEQ ID NO: 166834 - DNA, 20 bp, Artificial Sequence
  chemically synthesized
cctctgagtacaatatgtac

SEQ ID NO: 166835 - DNA, 20 bp, Artificial Sequence
  chemically synthesized
gagtacaatatgtactagct

SEQ ID NO: 166836 - DNA, 20 bp, Artificial Sequence
  chemically synthesized
tacaatatgtactagctaag

SEQ ID NO: 166837 - DNA, 20 bp, Artificial Sequence
  chemically synthesized
tgaccatttctccacttagc

SEQ ID NO: 166838 - DNA, 20 bp, Artificial Sequence
  chemically synthesized
caatatgtactagctaagtg

SEQ ID NO: 166839 - DNA, 20 bp, Artificial Sequence
  chemically synthesized
atcctgaccatttctccact

SEQ ID NO: 166840 - DNA, 20 bp, Artificial Sequence
  chemically synthesized
gtactagctaagtggagaaa

SEQ ID NO: 166841 - DNA, 20 bp, Artificial Sequence
  chemically synthesized
tagctaagtggagaaatggt

SEQ ID NO: 166842 - DNA, 20 bp, Artificial Sequence
  chemically synthesized
agctaagtggagaaatggtc

SEQ ID NO: 166843 - DNA, 20 bp, Artificial Sequence
  chemically synthesized
tggagaaatggtcaggatcc

SEQ ID NO: 166844 - DNA, 20 bp, Artificial Sequence
  chemically synthesized
tcagggaagccatcagttct

SEQ ID NO: 166845 - DNA, 20 bp, Artificial Sequence
  chemically synthesized
ggtcaggatcctagaactga

SEQ ID NO: 166846 - DNA, 20 bp, Artificial Sequence
  chemically synthesized
ctcagggaagccatcagttc

SEQ ID NO: 166847 - DNA, 20 bp, Artificial Sequence
  chemically synthesized
catcgtctcagggaagccat

SEQ ID NO: 166848 - DNA, 20 bp, Artificial Sequence
  chemically synthesized
ctagaactgatggcttccct

SEQ ID NO: 166849 - DNA, 20 bp, Artificial Sequence
  chemically synthesized
aacacatcatcgtctcaggg

SEQ ID NO: 166850 - DNA, 20 bp, Artificial Sequence
  chemically synthesized
caaaacacatcatcgtctca

SEQ ID NO: 166851 - DNA, 20 bp, Artificial Sequence
  chemically synthesized
acaaaacacatcatcgtctc

SEQ ID NO: 166852 - DNA, 20 bp, Artificial Sequence
  chemically synthesized
tacaaaacacatcatcgtct

SEQ ID NO: 166853 - DNA, 20 bp, Artificial Sequence
  chemically synthesized
tgatgtgttttgtacgcacc

SEQ ID NO: 166854 - DNA, 20 bp, Artificial Sequence
  chemically synthesized
tgatcacaaggggcaagact

SEQ ID NO: 166855 - DNA, 20 bp, Artificial Sequence
  chemically synthesized
atgatcacaaggggcaagac

SEQ ID NO: 166856 - DNA, 20 bp, Artificial Sequence
  chemically synthesized
catacatgatcacaaggggc

SEQ ID NO: 166857 - DNA, 20 bp, Artificial Sequence
  chemically synthesized
tagtcatacatgatcacaag

SEQ ID NO: 166858 - DNA, 20 bp, Artificial Sequence
  chemically synthesized
ttagtcatacatgatcacaa

SEQ ID NO: 166859 - DNA, 20 bp, Artificial Sequence
  chemically synthesized
tttagtcatacatgatcaca

SEQ ID NO: 166860 - DNA, 20 bp, Artificial Sequence
  chemically synthesized
ttttagtcatacatgatcac

SEQ ID NO: 166861 - DNA, 20 bp, Artificial Sequence
  chemically synthesized
gatcatgtatgactaaaatt

SEQ ID NO: 166862 - DNA, 20 bp, Artificial Sequence
  chemically synthesized
atcatgtatgactaaaattc

SEQ ID NO: 166863 - DNA, 20 bp, Artificial Sequence
  chemically synthesized
tcatgtatgactaaaattca

SEQ ID NO: 166864 - DNA, 20 bp, Artificial Sequence
  chemically synthesized
tgtcccatcaccctgaattt

SEQ ID NO: 166865 - DNA, 20 bp, Artificial Sequence
  chemically synthesized
atgactaaaattcagggtga

SEQ ID NO: 166866 - DNA, 20 bp, Artificial Sequence
  chemically synthesized
tgactaaaattcagggtgat

SEQ ID NO: 166867 - DNA, 20 bp, Artificial Sequence
  chemically synthesized
aattcagggtgatgggacat

SEQ ID NO: 166868 - DNA, 20 bp, Artificial Sequence
  chemically synthesized
tcagggtgatgggacatcag

SEQ ID NO: 166869 - DNA, 20 bp, Artificial Sequence
  chemically synthesized
ggacatcagaagccacgtct

SEQ ID NO: 166870 - DNA, 20 bp, Artificial Sequence
  chemically synthesized
gaagtcttgataccaagacg

SEQ ID NO: 166871 - DNA, 20 bp, Artificial Sequence
  chemically synthesized
agaagccacgtcttggtatc

SEQ ID NO: 166872 - DNA, 20 bp, Artificial Sequence
  chemically synthesized
acagtggaagtcttgatacc

SEQ ID NO: 166873 - DNA, 20 bp, Artificial Sequence
  chemically synthesized
gcacattaaaggcacagtgg

SEQ ID NO: 166874 - DNA, 20 bp, Artificial Sequence
  chemically synthesized
cctgcacattaaaggcacag

SEQ ID NO: 166875 - DNA, 20 bp, Artificial Sequence
  chemically synthesized
cagcctgcacattaaaggca

SEQ ID NO: 166876 - DNA, 20 bp, Artificial Sequence
  chemically synthesized
aacaacagcctgcacattaa

SEQ ID NO: 166877 - DNA, 20 bp, Artificial Sequence
  chemically synthesized
tccactgtgcctttaatgtg

SEQ ID NO: 166878 - DNA, 20 bp, Artificial Sequence
  chemically synthesized
taacaacagcctgcacatta

SEQ ID NO: 166879 - DNA, 20 bp, Artificial Sequence
  chemically synthesized
ccactgtgcctttaatgtgc

SEQ ID NO: 166880 - DNA, 20 bp, Artificial Sequence
  chemically synthesized
ttatacaggatgggtaacaa

SEQ ID NO: 166881 - DNA, 20 bp, Artificial Sequence
  chemically synthesized
tttaagaaattatacaggat

SEQ ID NO: 166882 - DNA, 20 bp, Artificial Sequence
  chemically synthesized
ctttaagaaattatacagga

SEQ ID NO: 166883 - DNA, 20 bp, Artificial Sequence
  chemically synthesized
ttagctttaagaaattatac

SEQ ID NO: 166884 - DNA, 20 bp, Artificial Sequence
  chemically synthesized
gttagctttaagaaattata

SEQ ID NO: 166885 - DNA, 20 bp, Artificial Sequence
  chemically synthesized
ccatcctgtataatttctta

SEQ ID NO: 166886 - DNA, 20 bp, Artificial Sequence
  chemically synthesized
taacaaatttagttagcttt

SEQ ID NO: 166887 - DNA, 20 bp, Artificial Sequence
  chemically synthesized
tacccagtaacaaatttagt

SEQ ID NO: 166888 - DNA, 20 bp, Artificial Sequence
  chemically synthesized
gctttacccagtaacaaatt

SEQ ID NO: 166889 - DNA, 20 bp, Artificial Sequence
  chemically synthesized
aagctaactaaatttgttac

SEQ ID NO: 166890 - DNA, 20 bp, Artificial Sequence
  chemically synthesized
agctaactaaatttgttact

SEQ ID NO: 166891 - DNA, 20 bp, Artificial Sequence
  chemically synthesized
actaaatttgttactgggta

SEQ ID NO: 166892 - DNA, 20 bp, Artificial Sequence
  chemically synthesized
gagacataataggctttacc

SEQ ID NO: 166893 - DNA, 20 bp, Artificial Sequence
  chemically synthesized
ttaaatttacgagacataat

SEQ ID NO: 166894 - DNA, 20 bp, Artificial Sequence
  chemically synthesized
attaaatttacgagacataa

SEQ ID NO: 166895 - DNA, 20 bp, Artificial Sequence
  chemically synthesized
agtctgatgattaaatttac

SEQ ID NO: 166896 - DNA, 20 bp, Artificial Sequence
  chemically synthesized
tgtctcgtaaatttaatcat

SEQ ID NO: 166897 - DNA, 20 bp, Artificial Sequence
  chemically synthesized
ttaatcatcagactgaaccc

SEQ ID NO: 166898 - DNA, 20 bp, Artificial Sequence
  chemically synthesized
cagtggcacagtcttgggtt

SEQ ID NO: 166899 - DNA, 20 bp, Artificial Sequence
  chemically synthesized
tcagccagtggcacagtctt

SEQ ID NO: 166900 - DNA, 20 bp, Artificial Sequence
  chemically synthesized
ctcagccagtggcacagtct

SEQ ID NO: 166901 - DNA, 20 bp, Artificial Sequence
  chemically synthesized
tgaacccaagactgtgccac

SEQ ID NO: 166902 - DNA, 20 bp, Artificial Sequence
  chemically synthesized
agcctgctcagccagtggca

SEQ ID NO: 166903 - DNA, 20 bp, Artificial Sequence
  chemically synthesized
ccaagactgtgccactggct

SEQ ID NO: 166904 - DNA, 20 bp, Artificial Sequence
  chemically synthesized
aactcagcctgctcagccag

SEQ ID NO: 166905 - DNA, 20 bp, Artificial Sequence
  chemically synthesized
agactgtgccactggctgag

SEQ ID NO: 166906 - DNA, 20 bp, Artificial Sequence
  chemically synthesized
gactgtgccactggctgagc

SEQ ID NO: 166907 - DNA, 20 bp, Artificial Sequence
  chemically synthesized
caaaactcagcctgctcagc

SEQ ID NO: 166908 - DNA, 20 bp, Artificial Sequence
  chemically synthesized
agcacaaaactcagcctgct

SEQ ID NO: 166909 - DNA, 20 bp, Artificial Sequence
  chemically synthesized
tgccactggctgagcaggct

SEQ ID NO: 166910 - DNA, 20 bp, Artificial Sequence
  chemically synthesized
catttcactagcacaaaact

SEQ ID NO: 166911 - DNA, 20 bp, Artificial Sequence
  chemically synthesized
gagcaggctgagttttgtgc

SEQ ID NO: 166912 - DNA, 20 bp, Artificial Sequence
  chemically synthesized
acaagtagacatcatttcac

SEQ ID NO: 166913 - DNA, 20 bp, Artificial Sequence
  chemically synthesized
ggcactgtggaagtcacaag

SEQ ID NO: 166914 - DNA, 20 bp, Artificial Sequence
  chemically synthesized
gatggcactgtggaagtcac

SEQ ID NO: 166915 - DNA, 20 bp, Artificial Sequence
  chemically synthesized
atgtctacttgtgacttcca

SEQ ID NO: 166916 - DNA, 20 bp, Artificial Sequence
  chemically synthesized
aagagcagatggcactgtgg

SEQ ID NO: 166917 - DNA, 20 bp, Artificial Sequence
  chemically synthesized
ctcaagagcagatggcactg

SEQ ID NO: 166918 - DNA, 20 bp, Artificial Sequence
  chemically synthesized
agctactcctcaagagcaga

SEQ ID NO: 166919 - DNA, 20 bp, Artificial Sequence
  chemically synthesized
ccacagtgccatctgctctt

SEQ ID NO: 166920 - DNA, 20 bp, Artificial Sequence
  chemically synthesized
cacagtgccatctgctcttg

SEQ ID NO: 166921 - DNA, 20 bp, Artificial Sequence
  chemically synthesized
tgatagctactcctcaagag

SEQ ID NO: 166922 - DNA, 20 bp, Artificial Sequence
  chemically synthesized
cagtgccatctgctcttgag

SEQ ID NO: 166923 - DNA, 20 bp, Artificial Sequence
  chemically synthesized
ttctgatagctactcctcaa

SEQ ID NO: 166924 - DNA, 20 bp, Artificial Sequence
  chemically synthesized
tgccatctgctcttgaggag

SEQ ID NO: 166925 - DNA, 20 bp, Artificial Sequence
  chemically synthesized
cattctgatagctactcctc

SEQ ID NO: 166926 - DNA, 20 bp, Artificial Sequence
  chemically synthesized
tgctcttgaggagtagctat

SEQ ID NO: 166927 - DNA, 20 bp, Artificial Sequence
  chemically synthesized
ttgaggagtagctatcagaa

SEQ ID NO: 166928 - DNA, 20 bp, Artificial Sequence
  chemically synthesized
acttatgtctaccattctga

SEQ ID NO: 166929 - DNA, 20 bp, Artificial Sequence
  chemically synthesized
aggagtagctatcagaatgg

SEQ ID NO: 166930 - DNA, 20 bp, Artificial Sequence
  chemically synthesized
gctatcagaatggtagacat

SEQ ID NO: 166931 - DNA, 20 bp, Artificial Sequence
  chemically synthesized
agaatggtagacataagtgt

SEQ ID NO: 166932 - DNA, 20 bp, Artificial Sequence
  chemically synthesized
gaatggtagacataagtgtc

SEQ ID NO: 166933 - DNA, 20 bp, Artificial Sequence
  chemically synthesized
atggtagacataagtgtcag

SEQ ID NO: 166934 - DNA, 20 bp, Artificial Sequence
  chemically synthesized
tggtagacataagtgtcagg

SEQ ID NO: 166935 - DNA, 20 bp, Artificial Sequence
  chemically synthesized
tagacataagtgtcaggagg

SEQ ID NO: 166936 - DNA, 20 bp, Artificial Sequence
  chemically synthesized
cataagtgtcaggaggaagt

SEQ ID NO: 166937 - DNA, 20 bp, Artificial Sequence
  chemically synthesized
ataagtgtcaggaggaagta

SEQ ID NO: 166938 - DNA, 20 bp, Artificial Sequence
  chemically synthesized
aggaggaagtaaggtaaaca

SEQ ID NO: 166939 - DNA, 20 bp, Artificial Sequence
  chemically synthesized
gaagtaaggtaaacatagtc

SEQ ID NO: 166940 - DNA, 20 bp, Artificial Sequence
  chemically synthesized
acaactaaaatgagttagat

SEQ ID NO: 166941 - DNA, 20 bp, Artificial Sequence
  chemically synthesized
ttgctacaactaaaatgagt

SEQ ID NO: 166942 - DNA, 20 bp, Artificial Sequence
  chemically synthesized
tttgctaatctaactcattt

SEQ ID NO: 166943 - DNA, 20 bp, Artificial Sequence
  chemically synthesized
aagtttgctacaactaaaat

SEQ ID NO: 166944 - DNA, 20 bp, Artificial Sequence
  chemically synthesized
aatctaactcattttagttg

SEQ ID NO: 166945 - DNA, 20 bp, Artificial Sequence
  chemically synthesized
agtaacaaggagatagaggg

SEQ ID NO: 166946 - DNA, 20 bp, Artificial Sequence
  chemically synthesized
atgagtaacaaggagataga

SEQ ID NO: 166947 - DNA, 20 bp, Artificial Sequence
  chemically synthesized
catgagtaacaaggagatag

SEQ ID NO: 166948 - DNA, 20 bp, Artificial Sequence
  chemically synthesized
gcatgagtaacaaggagata

SEQ ID NO: 166949 - DNA, 20 bp, Artificial Sequence
  chemically synthesized
gggcatgagtaacaaggaga

SEQ ID NO: 166950 - DNA, 20 bp, Artificial Sequence
  chemically synthesized
agatgggcatgagtaacaag

SEQ ID NO: 166951 - DNA, 20 bp, Artificial Sequence
  chemically synthesized
gaagatgggcatgagtaaca

SEQ ID NO: 166952 - DNA, 20 bp, Artificial Sequence
  chemically synthesized
ggaagatgggcatgagtaac

SEQ ID NO: 166953 - DNA, 20 bp, Artificial Sequence
  chemically synthesized
agtttcgggaagatgggcat

SEQ ID NO: 166954 - DNA, 20 bp, Artificial Sequence
  chemically synthesized
agtaaaagtttcgggaagat

SEQ ID NO: 166955 - DNA, 20 bp, Artificial Sequence
  chemically synthesized
aagtaaaagtttcgggaaga

SEQ ID NO: 166956 - DNA, 20 bp, Artificial Sequence
  chemically synthesized
gaggaagtaaaagtttcggg

SEQ ID NO: 166957 - DNA, 20 bp, Artificial Sequence
  chemically synthesized
gaagaggaagtaaaagtttc

SEQ ID NO: 166958 - DNA, 20 bp, Artificial Sequence
  chemically synthesized
tgaagaggaagtaaaagttt

SEQ ID NO: 166959 - DNA, 20 bp, Artificial Sequence
  chemically synthesized
ttctagtgaagaggaagtaa

SEQ ID NO: 166960 - DNA, 20 bp, Artificial Sequence
  chemically synthesized
agaatattctagtgaagagg

SEQ ID NO: 166961 - DNA, 20 bp, Artificial Sequence
  chemically synthesized
aacttttacttcctcttcac

SEQ ID NO: 166962 - DNA, 20 bp, Artificial Sequence
  chemically synthesized
ttgagaatattctagtgaag

SEQ ID NO: 166963 - DNA, 20 bp, Artificial Sequence
  chemically synthesized
tttgagaatattctagtgaa

SEQ ID NO: 166964 - DNA, 20 bp, Artificial Sequence
  chemically synthesized
agtttgagaatattctagtg

SEQ ID NO: 166965 - DNA, 20 bp, Artificial Sequence
  chemically synthesized
aaggaagtttgagaatattc

SEQ ID NO: 166966 - DNA, 20 bp, Artificial Sequence
  chemically synthesized
gcaaagggaaaaggaagttt

SEQ ID NO: 166967 - DNA, 20 bp, Artificial Sequence
  chemically synthesized
ctgagagcaaagggaaaagg

SEQ ID NO: 166968 - DNA, 20 bp, Artificial Sequence
  chemically synthesized
gaactgagagcaaagggaaa

SEQ ID NO: 166969 - DNA, 20 bp, Artificial Sequence
  chemically synthesized
ggaactgagagcaaagggaa

SEQ ID NO: 166970 - DNA, 20 bp, Artificial Sequence
  chemically synthesized
ttgctggaactgagagcaaa

SEQ ID NO: 166971 - DNA, 20 bp, Artificial Sequence
  chemically synthesized
cttccttttccctttgctct

SEQ ID NO: 166972 - DNA, 20 bp, Artificial Sequence
  chemically synthesized
tttgctggaactgagagcaa

SEQ ID NO: 166973 - DNA, 20 bp, Artificial Sequence
  chemically synthesized
ttttgctggaactgagagca

SEQ ID NO: 166974 - DNA, 20 bp, Artificial Sequence
  chemically synthesized
tttccctttgctctcagttc

SEQ ID NO: 166975 - DNA, 20 bp, Artificial Sequence
  chemically synthesized
tgttgttttgctggaactga

SEQ ID NO: 166976 - DNA, 20 bp, Artificial Sequence
  chemically synthesized
gctgttgttttgctggaact

SEQ ID NO: 166977 - DNA, 20 bp, Artificial Sequence
  chemically synthesized
ccatttagctgttgttttgc

SEQ ID NO: 166978 - DNA, 20 bp, Artificial Sequence
  chemically synthesized
tctcagttccagcaaaacaa

SEQ ID NO: 166979 - DNA, 20 bp, Artificial Sequence
  chemically synthesized
ccagcaaaacaacagctaaa

SEQ ID NO: 166980 - DNA, 20 bp, Artificial Sequence
  chemically synthesized
agcaaaacaacagctaaatg

SEQ ID NO: 166981 - DNA, 20 bp, Artificial Sequence
  chemically synthesized
ctaacattttaatctccatt

SEQ ID NO: 166982 - DNA, 20 bp, Artificial Sequence
  chemically synthesized
ctaaatggagattaaaatgt

SEQ ID NO: 166983 - DNA, 20 bp, Artificial Sequence
  chemically synthesized
taaatggagattaaaatgtt

SEQ ID NO: 166984 - DNA, 20 bp, Artificial Sequence
  chemically synthesized
atgttaggtttttacaatac

SEQ ID NO: 166985 - DNA, 20 bp, Artificial Sequence
  chemically synthesized
taggtttttacaatactgga

SEQ ID NO: 166986 - DNA, 20 bp, Artificial Sequence
  chemically synthesized
tgttaaatttatttactgtc

SEQ ID NO: 166987 - DNA, 20 bp, Artificial Sequence
  chemically synthesized
gtaaataaatttaacaatta

SEQ ID NO: 166988 - DNA, 20 bp, Artificial Sequence
  chemically synthesized
aattaaagtcaattaaataa

SEQ ID NO: 166989 - DNA, 20 bp, Artificial Sequence
  chemically synthesized
ggataagtaacatttttgag

SEQ ID NO: 166990 - DNA, 20 bp, Artificial Sequence
  chemically synthesized
aaaggataagtaacattttt

SEQ ID NO: 166991 - DNA, 20 bp, Artificial Sequence
  chemically synthesized
aacttcagagtaaaaaggat

SEQ ID NO: 166992 - DNA, 20 bp, Artificial Sequence
  chemically synthesized
tgggcaacttcagagtaaaa

SEQ ID NO: 166993 - DNA, 20 bp, Artificial Sequence
  chemically synthesized
ttgggcaacttcagagtaaa

SEQ ID NO: 166994 - DNA, 20 bp, Artificial Sequence
  chemically synthesized
tacttatcctttttactctg

SEQ ID NO: 166995 - DNA, 20 bp, Artificial Sequence
  chemically synthesized
tgtattgttgggcaacttca

SEQ ID NO: 166996 - DNA, 20 bp, Artificial Sequence
  chemically synthesized
aatgtattgttgggcaactt

SEQ ID NO: 166997 - DNA, 20 bp, Artificial Sequence
  chemically synthesized
ctattaatgaatgtattgtt

SEQ ID NO: 166998 - DNA, 20 bp, Artificial Sequence
  chemically synthesized
tctattaatgaatgtattgt

SEQ ID NO: 166999 - DNA, 20 bp, Artificial Sequence
  chemically synthesized
cccaacaatacattcattaa

SEQ ID NO: 167000 - DNA, 20 bp, Artificial Sequence
  chemically synthesized
agattgtaatttcaacgatt

SEQ ID NO: 167001 - DNA, 20 bp, Artificial Sequence
  chemically synthesized
aacgattcggtttatttgat

SEQ ID NO: 167002 - DNA, 20 bp, Artificial Sequence
  chemically synthesized
tttatttgattggctactta

SEQ ID NO: 167003 - DNA, 20 bp, Artificial Sequence
  chemically synthesized
tatttgccaaaatctttaag

SEQ ID NO: 167004 - DNA, 20 bp, Artificial Sequence
  chemically synthesized
ccttatttgccaaaatcttt

SEQ ID NO: 167005 - DNA, 20 bp, Artificial Sequence
  chemically synthesized
gattggctacttaaagattt

SEQ ID NO: 167006 - DNA, 20 bp, Artificial Sequence
  chemically synthesized
acttaaagattttggcaaat

SEQ ID NO: 167007 - DNA, 20 bp, Artificial Sequence
  chemically synthesized
cttaaagattttggcaaata

SEQ ID NO: 167008 - DNA, 20 bp, Artificial Sequence
  chemically synthesized
taaagattttggcaaataag

SEQ ID NO: 167009 - DNA, 20 bp, Artificial Sequence
  chemically synthesized
gcaaataaggagacgcaaaa

SEQ ID NO: 167010 - DNA, 20 bp, Artificial Sequence
  chemically synthesized
caaataaggagacgcaaaac

SEQ ID NO: 167011 - DNA, 20 bp, Artificial Sequence
  chemically synthesized
aaataaggagacgcaaaacg

SEQ ID NO: 167012 - DNA, 20 bp, Artificial Sequence
  chemically synthesized
taaggagacgcaaaacgggg

SEQ ID NO: 167013 - DNA, 20 bp, Artificial Sequence
  chemically synthesized
aaaacggggcagcatattga

SEQ ID NO: 167014 - DNA, 20 bp, Artificial Sequence
  chemically synthesized
cagcatattgaaagaatctt

SEQ ID NO: 167015 - DNA, 20 bp, Artificial Sequence
  chemically synthesized
tattgaaagaatctttggaa

SEQ ID NO: 167016 - DNA, 20 bp, Artificial Sequence
  chemically synthesized
ctttcaaggaatctattcca

SEQ ID NO: 167017 - DNA, 20 bp, Artificial Sequence
  chemically synthesized
ctttggaatagattccttga

SEQ ID NO: 167018 - DNA, 20 bp, Artificial Sequence
  chemically synthesized
tttggaatagattccttgaa

SEQ ID NO: 167019 - DNA, 20 bp, Artificial Sequence
  chemically synthesized
ttggaatagattccttgaaa

SEQ ID NO: 167020 - DNA, 20 bp, Artificial Sequence
  chemically synthesized
ggaatagattccttgaaagg

SEQ ID NO: 167021 - DNA, 20 bp, Artificial Sequence
  chemically synthesized
atcttcttttctccctttca

SEQ ID NO: 167022 - DNA, 20 bp, Artificial Sequence
  chemically synthesized
gatcttcttttctccctttc

SEQ ID NO: 167023 - DNA, 20 bp, Artificial Sequence
  chemically synthesized
agattccttgaaagggagaa

SEQ ID NO: 167024 - DNA, 20 bp, Artificial Sequence
  chemically synthesized
ttccttgaaagggagaaaag

SEQ ID NO: 167025 - DNA, 20 bp, Artificial Sequence
  chemically synthesized
agggagaaaagaagatcaat

SEQ ID NO: 167026 - DNA, 20 bp, Artificial Sequence
  chemically synthesized
gaagatcaatcagcatttac

SEQ ID NO: 167027 - DNA, 20 bp, Artificial Sequence
  chemically synthesized
aagatcaatcagcatttaca

SEQ ID NO: 167028 - DNA, 20 bp, Artificial Sequence
  chemically synthesized
atcagcatttacaaggacac

SEQ ID NO: 167029 - DNA, 20 bp, Artificial Sequence
  chemically synthesized
agcatttacaaggacactag

SEQ ID NO: 167030 - DNA, 20 bp, Artificial Sequence
  chemically synthesized
atttacaaggacactagaag

SEQ ID NO: 167031 - DNA, 20 bp, Artificial Sequence
  chemically synthesized
tttacaaggacactagaaga

SEQ ID NO: 167032 - DNA, 20 bp, Artificial Sequence
  chemically synthesized
tacaaggacactagaagaag

SEQ ID NO: 167033 - DNA, 20 bp, Artificial Sequence
  chemically synthesized
acaccactatctccttcttc

SEQ ID NO: 167034 - DNA, 20 bp, Artificial Sequence
  chemically synthesized
aggacactagaagaaggaga

SEQ ID NO: 167035 - DNA, 20 bp, Artificial Sequence
  chemically synthesized
acactagaagaaggagatag

SEQ ID NO: 167036 - DNA, 20 bp, Artificial Sequence
  chemically synthesized
aggagatagtggtgttcaat

SEQ ID NO: 167037 - DNA, 20 bp, Artificial Sequence
  chemically synthesized
agatagtggtgttcaattgg

SEQ ID NO: 167038 - DNA, 20 bp, Artificial Sequence
  chemically synthesized
gatagtggtgttcaattggc

SEQ ID NO: 167039 - DNA, 20 bp, Artificial Sequence
  chemically synthesized
tcaattggcaggattgtctg

SEQ ID NO: 167040 - DNA, 20 bp, Artificial Sequence
  chemically synthesized
tgcaggtaagcgtaaggctt

SEQ ID NO: 167041 - DNA, 20 bp, Artificial Sequence
  chemically synthesized
agatactgcaggtaagcgta

SEQ ID NO: 167042 - DNA, 20 bp, Artificial Sequence
  chemically synthesized
gagatactgcaggtaagcgt

SEQ ID NO: 167043 - DNA, 20 bp, Artificial Sequence
  chemically synthesized
tgaagccttacgcttacctg

SEQ ID NO: 167044 - DNA, 20 bp, Artificial Sequence
  chemically synthesized
acgaatgagatactgcaggt

SEQ ID NO: 167045 - DNA, 20 bp, Artificial Sequence
  chemically synthesized
gaatacgaatgagatactgc

SEQ ID NO: 167046 - DNA, 20 bp, Artificial Sequence
  chemically synthesized
agaatacgaatgagatactg

SEQ ID NO: 167047 - DNA, 20 bp, Artificial Sequence
  chemically synthesized
aagacacccagaatacgaat

SEQ ID NO: 167048 - DNA, 20 bp, Artificial Sequence
  chemically synthesized
gcagtatctcattcgtattc

SEQ ID NO: 167049 - DNA, 20 bp, Artificial Sequence
  chemically synthesized
cagtatctcattcgtattct

SEQ ID NO: 167050 - DNA, 20 bp, Artificial Sequence
  chemically synthesized
cattcgtattctgggtgtct

SEQ ID NO: 167051 - DNA, 20 bp, Artificial Sequence
  chemically synthesized
aaagacagtaccaagacacc

SEQ ID NO: 167052 - DNA, 20 bp, Artificial Sequence
  chemically synthesized
caatgaataaagacagtacc

SEQ ID NO: 167053 - DNA, 20 bp, Artificial Sequence
  chemically synthesized
tttaagtcaatgaataaaga

SEQ ID NO: 167054 - DNA, 20 bp, Artificial Sequence
  chemically synthesized
tgtttttaagtcaatgaata

SEQ ID NO: 167055 - DNA, 20 bp, Artificial Sequence
  chemically synthesized
gcttacttgtgagtgttttt

SEQ ID NO: 167056 - DNA, 20 bp, Artificial Sequence
  chemically synthesized
attgacttaaaaacactcac

SEQ ID NO: 167057 - DNA, 20 bp, Artificial Sequence
  chemically synthesized
acttaaaaacactcacaagt

SEQ ID NO: 167058 - DNA, 20 bp, Artificial Sequence
  chemically synthesized
agtaaatgatgcttacttgt

SEQ ID NO: 167059 - DNA, 20 bp, Artificial Sequence
  chemically synthesized
cacaagtaagcatcatttac

SEQ ID NO: 167060 - DNA, 20 bp, Artificial Sequence
  chemically synthesized
aagcatcatttactggatcc

SEQ ID NO: 167061 - DNA, 20 bp, Artificial Sequence
  chemically synthesized
agcatcatttactggatcct

SEQ ID NO: 167062 - DNA, 20 bp, Artificial Sequence
  chemically synthesized
tacacactcagcctaggatc

SEQ ID NO: 167063 - DNA, 20 bp, Artificial Sequence
  chemically synthesized
catttactggatcctaggct

SEQ ID NO: 167064 - DNA, 20 bp, Artificial Sequence
  chemically synthesized
atatcatacacactcagcct

SEQ ID NO: 167065 - DNA, 20 bp, Artificial Sequence
  chemically synthesized
catatcatacacactcagcc

SEQ ID NO: 167066 - DNA, 20 bp, Artificial Sequence
  chemically synthesized
ccactcatatcatacacact

SEQ ID NO: 167067 - DNA, 20 bp, Artificial Sequence
  chemically synthesized
aggctgagtgtgtatgatat

SEQ ID NO: 167068 - DNA, 20 bp, Artificial Sequence
  chemically synthesized
ctgagtgtgtatgatatgag

SEQ ID NO: 167069 - DNA, 20 bp, Artificial Sequence
  chemically synthesized
gagtgtgtatgatatgagtg

SEQ ID NO: 167070 - DNA, 20 bp, Artificial Sequence
  chemically synthesized
tgtgtatgatatgagtggag

SEQ ID NO: 167071 - DNA, 20 bp, Artificial Sequence
  chemically synthesized
gtatgatatgagtggagaag

SEQ ID NO: 167072 - DNA, 20 bp, Artificial Sequence
  chemically synthesized
atgatatgagtggagaagca

SEQ ID NO: 167073 - DNA, 20 bp, Artificial Sequence
  chemically synthesized
gtggagaagcagagataaat

SEQ ID NO: 167074 - DNA, 20 bp, Artificial Sequence
  chemically synthesized
ggagaagcagagataaataa

SEQ ID NO: 167075 - DNA, 20 bp, Artificial Sequence
  chemically synthesized
cactgttctttgagtgcaga

SEQ ID NO: 167076 - DNA, 20 bp, Artificial Sequence
  chemically synthesized
gcactgttctttgagtgcag

SEQ ID NO: 167077 - DNA, 20 bp, Artificial Sequence
  chemically synthesized
tgcactgttctttgagtgca

SEQ ID NO: 167078 - DNA, 20 bp, Artificial Sequence
  chemically synthesized
gagaatgccctctgcactca

SEQ ID NO: 167079 - DNA, 20 bp, Artificial Sequence
  chemically synthesized
tctgcactgttctttgagtg

SEQ ID NO: 167080 - DNA, 20 bp, Artificial Sequence
  chemically synthesized
tgccctctgcactcaaagaa

SEQ ID NO: 167081 - DNA, 20 bp, Artificial Sequence
  chemically synthesized
acacatctgcactgttcttt

SEQ ID NO: 167082 - DNA, 20 bp, Artificial Sequence
  chemically synthesized
tctgcactcaaagaacagtg

SEQ ID NO: 167083 - DNA, 20 bp, Artificial Sequence
  chemically synthesized
cagatgtgtaatgaaatact

SEQ ID NO: 167084 - DNA, 20 bp, Artificial Sequence
  chemically synthesized
agatgtgtaatgaaatactc

SEQ ID NO: 167085 - DNA, 20 bp, Artificial Sequence
  chemically synthesized
cacttaaattttatacacct

SEQ ID NO: 167086 - DNA, 20 bp, Artificial Sequence
  chemically synthesized
tactcaggtgtataaaattt

SEQ ID NO: 167087 - DNA, 20 bp, Artificial Sequence
  chemically synthesized
gtaaatcaacatatgaacaa

SEQ ID NO: 167088 - DNA, 20 bp, Artificial Sequence
  chemically synthesized
taaatcaacatatgaacaat

SEQ ID NO: 167089 - DNA, 20 bp, Artificial Sequence
  chemically synthesized
aatcaacatatgaacaatgg

SEQ ID NO: 167090 - DNA, 20 bp, Artificial Sequence
  chemically synthesized
aacaatgggagatgaataaa

SEQ ID NO: 167091 - DNA, 20 bp, Artificial Sequence
  chemically synthesized
acaatgggagatgaataaaa

SEQ ID NO: 167092 - DNA, 20 bp, Artificial Sequence
  chemically synthesized
agatgaataaaaaggtttat

SEQ ID NO: 167093 - DNA, 20 bp, Artificial Sequence
  chemically synthesized
aggtttataagaaatcctaa

SEQ ID NO: 167094 - DNA, 20 bp, Artificial Sequence
  chemically synthesized
ggtttataagaaatcctaac

SEQ ID NO: 167095 - DNA, 20 bp, Artificial Sequence
  chemically synthesized
gtttataagaaatcctaaca

SEQ ID NO: 167096 - DNA, 20 bp, Artificial Sequence
  chemically synthesized
gtagagttagaatccctgtt

SEQ ID NO: 167097 - DNA, 20 bp, Artificial Sequence
  chemically synthesized
agtagagttagaatccctgt

SEQ ID NO: 167098 - DNA, 20 bp, Artificial Sequence
  chemically synthesized
ttccgtaccccaagtagagt

SEQ ID NO: 167099 - DNA, 20 bp, Artificial Sequence
  chemically synthesized
acagggattctaactctact

SEQ ID NO: 167100 - DNA, 20 bp, Artificial Sequence
  chemically synthesized
cagggattctaactctactt

SEQ ID NO: 167101 - DNA, 20 bp, Artificial Sequence
  chemically synthesized
agggattctaactctacttg

SEQ ID NO: 167102 - DNA, 20 bp, Artificial Sequence
  chemically synthesized
tttcttccgtaccccaagta

SEQ ID NO: 167103 - DNA, 20 bp, Artificial Sequence
  chemically synthesized
gttttcttccgtaccccaag

SEQ ID NO: 167104 - DNA, 20 bp, Artificial Sequence
  chemically synthesized
ttctaactctacttggggta

SEQ ID NO: 167105 - DNA, 20 bp, Artificial Sequence
  chemically synthesized
caagttttcttccgtacccc

SEQ ID NO: 167106 - DNA, 20 bp, Artificial Sequence
  chemically synthesized
taactctacttggggtacgg

SEQ ID NO: 167107 - DNA, 20 bp, Artificial Sequence
  chemically synthesized
ttggggtacggaagaaaact

SEQ ID NO: 167108 - DNA, 20 bp, Artificial Sequence
  chemically synthesized
gggtacggaagaaaacttgg

SEQ ID NO: 167109 - DNA, 20 bp, Artificial Sequence
  chemically synthesized
tcaaagtcattgcgtcttcc

SEQ ID NO: 167110 - DNA, 20 bp, Artificial Sequence
  chemically synthesized
attctttaagaatgaattca

SEQ ID NO: 167111 - DNA, 20 bp, Artificial Sequence
  chemically synthesized
tgactttgaattcattctta

SEQ ID NO: 167112 - DNA, 20 bp, Artificial Sequence
  chemically synthesized
ttgaattcattcttaaagaa

SEQ ID NO: 167113 - DNA, 20 bp, Artificial Sequence
  chemically synthesized
tgaattttcttccattcttt

SEQ ID NO: 167114 - DNA, 20 bp, Artificial Sequence
  chemically synthesized
aattcattcttaaagaatgg

SEQ ID NO: 167115 - DNA, 20 bp, Artificial Sequence
  chemically synthesized
attatatcaaaataaactga

SEQ ID NO: 167116 - DNA, 20 bp, Artificial Sequence
  chemically synthesized
atatcaaaataaactgaaag

SEQ ID NO: 167117 - DNA, 20 bp, Artificial Sequence
  chemically synthesized
cttctttaaatgacttcttt

SEQ ID NO: 167118 - DNA, 20 bp, Artificial Sequence
  chemically synthesized
aaactgaaagaagtcattta

SEQ ID NO: 167119 - DNA, 20 bp, Artificial Sequence
  chemically synthesized
ctgaaagaagtcatttaaag

SEQ ID NO: 167120 - DNA, 20 bp, Artificial Sequence
  chemically synthesized
gaaagaagtcatttaaagaa

SEQ ID NO: 167121 - DNA, 20 bp, Artificial Sequence
  chemically synthesized
aagaagtcatttaaagaaga

SEQ ID NO: 167122 - DNA, 20 bp, Artificial Sequence
  chemically synthesized
tttaaagaagagagaaaacc

SEQ ID NO: 167123 - DNA, 20 bp, Artificial Sequence
  chemically synthesized
aagagagaaaaccaagatca

SEQ ID NO: 167124 - DNA, 20 bp, Artificial Sequence
  chemically synthesized
agagagaaaaccaagatcac

SEQ ID NO: 167125 - DNA, 20 bp, Artificial Sequence
  chemically synthesized
tcatgtcatacctgtgatct

SEQ ID NO: 167126 - DNA, 20 bp, Artificial Sequence
  chemically synthesized
aggtatgacatgaaattaca

SEQ ID NO: 167127 - DNA, 20 bp, Artificial Sequence
  chemically synthesized
atgacatgaaattacatgga

SEQ ID NO: 167128 - DNA, 20 bp, Artificial Sequence
  chemically synthesized
catgaaattacatggatgga

SEQ ID NO: 167129 - DNA, 20 bp, Artificial Sequence
  chemically synthesized
atgaaattacatggatggaa

SEQ ID NO: 167130 - DNA, 20 bp, Artificial Sequence
  chemically synthesized
ttacatggatggaaaggtac

SEQ ID NO: 167131 - DNA, 20 bp, Artificial Sequence
  chemically synthesized
tacatggatggaaaggtacc

SEQ ID NO: 167132 - DNA, 20 bp, Artificial Sequence
  chemically synthesized
tctggccacatcaaattacc

SEQ ID NO: 167133 - DNA, 20 bp, Artificial Sequence
  chemically synthesized
aggtaccaggtaatttgatg

SEQ ID NO: 167134 - DNA, 20 bp, Artificial Sequence
  chemically synthesized
accaggtaatttgatgtggc

SEQ ID NO: 167135 - DNA, 20 bp, Artificial Sequence
  chemically synthesized
tttgatgtggccagactata

SEQ ID NO: 167136 - DNA, 20 bp, Artificial Sequence
  chemically synthesized
agcaatctccccgtatagtc

SEQ ID NO: 167137 - DNA, 20 bp, Artificial Sequence
  chemically synthesized
ttgatgtggccagactatac

SEQ ID NO: 167138 - DNA, 20 bp, Artificial Sequence
  chemically synthesized
tgatgtggccagactatacg

SEQ ID NO: 167139 - DNA, 20 bp, Artificial Sequence
  chemically synthesized
atgtggccagactatacggg

SEQ ID NO: 167140 - DNA, 20 bp, Artificial Sequence
  chemically synthesized
ctgccagcaatctccccgta

SEQ ID NO: 167141 - DNA, 20 bp, Artificial Sequence
  chemically synthesized
agactatacggggagattgc

SEQ ID NO: 167142 - DNA, 20 bp, Artificial Sequence
  chemically synthesized
ctatacggggagattgctgg

SEQ ID NO: 167143 - DNA, 20 bp, Artificial Sequence
  chemically synthesized
ggggagattgctggcagaat

SEQ ID NO: 167144 - DNA, 20 bp, Artificial Sequence
  chemically synthesized
tttctatcttctcattctgc

SEQ ID NO: 167145 - DNA, 20 bp, Artificial Sequence
  chemically synthesized
gagattgctggcagaatgag

SEQ ID NO: 167146 - DNA, 20 bp, Artificial Sequence
  chemically synthesized
ttgctggcagaatgagaaga

SEQ ID NO: 167147 - DNA, 20 bp, Artificial Sequence
  chemically synthesized
tggcagaatgagaagataga

SEQ ID NO: 167148 - DNA, 20 bp, Artificial Sequence
  chemically synthesized
ggcagaatgagaagatagaa

SEQ ID NO: 167149 - DNA, 20 bp, Artificial Sequence
  chemically synthesized
aatgagaagatagaaaggta

SEQ ID NO: 167150 - DNA, 20 bp, Artificial Sequence
  chemically synthesized
gaagatagaaaggtaaagtg

SEQ ID NO: 167151 - DNA, 20 bp, Artificial Sequence
  chemically synthesized
atagaaaggtaaagtgtagt

SEQ ID NO: 167152 - DNA, 20 bp, Artificial Sequence
  chemically synthesized
aggtaaagtgtagtcagtct

SEQ ID NO: 167153 - DNA, 20 bp, Artificial Sequence
  chemically synthesized
gtaaagtgtagtcagtctga

SEQ ID NO: 167154 - DNA, 20 bp, Artificial Sequence
  chemically synthesized
taaagtgtagtcagtctgag

SEQ ID NO: 167155 - DNA, 20 bp, Artificial Sequence
  chemically synthesized
aaagtgtagtcagtctgaga

SEQ ID NO: 167156 - DNA, 20 bp, Artificial Sequence
  chemically synthesized
tagacattgtaaagccctct

SEQ ID NO: 167157 - DNA, 20 bp, Artificial Sequence
  chemically synthesized
gctcttttgtagacattgta

SEQ ID NO: 167158 - DNA, 20 bp, Artificial Sequence
  chemically synthesized
gggctttacaatgtctacaa

SEQ ID NO: 167159 - DNA, 20 bp, Artificial Sequence
  chemically synthesized
gctttacaatgtctacaaaa

SEQ ID NO: 167160 - DNA, 20 bp, Artificial Sequence
  chemically synthesized
ataatgtctgggctcttttg

SEQ ID NO: 167161 - DNA, 20 bp, Artificial Sequence
  chemically synthesized
acaatgtctacaaaagagcc

SEQ ID NO: 167162 - DNA, 20 bp, Artificial Sequence
  chemically synthesized
gttcctaaaatataatgtct

SEQ ID NO: 167163 - DNA, 20 bp, Artificial Sequence
  chemically synthesized
ggttcctaaaatataatgtc

SEQ ID NO: 167164 - DNA, 20 bp, Artificial Sequence
  chemically synthesized
agagcccagacattatattt

SEQ ID NO: 167165 - DNA, 20 bp, Artificial Sequence
  chemically synthesized
gagcccagacattatatttt

SEQ ID NO: 167166 - DNA, 20 bp, Artificial Sequence
  chemically synthesized
ttgaagttgtttatgagatt

SEQ ID NO: 167167 - DNA, 20 bp, Artificial Sequence
  chemically synthesized
attgaagttgtttatgagat

SEQ ID NO: 167168 - DNA, 20 bp, Artificial Sequence
  chemically synthesized
ccaaaattgaagttgtttat

SEQ ID NO: 167169 - DNA, 20 bp, Artificial Sequence
  chemically synthesized
ctcataaacaacttcaattt

SEQ ID NO: 167170 - DNA, 20 bp, Artificial Sequence
  chemically synthesized
agattccttatccaaaattg

SEQ ID NO: 167171 - DNA, 20 bp, Artificial Sequence
  chemically synthesized
aaacaacttcaattttggat

SEQ ID NO: 167172 - DNA, 20 bp, Artificial Sequence
  chemically synthesized
aacaacttcaattttggata

SEQ ID NO: 167173 - DNA, 20 bp, Artificial Sequence
  chemically synthesized
ttgtgcttaatacatattca

SEQ ID NO: 167174 - DNA, 20 bp, Artificial Sequence
  chemically synthesized
ggaatctatgaatatgtatt

SEQ ID NO: 167175 - DNA, 20 bp, Artificial Sequence
  chemically synthesized
tgtattaagcacaattaaaa

SEQ ID NO: 167176 - DNA, 20 bp, Artificial Sequence
  chemically synthesized
gtattaagcacaattaaaac

SEQ ID NO: 167177 - DNA, 20 bp, Artificial Sequence
  chemically synthesized
tattaagcacaattaaaaca

SEQ ID NO: 167178 - DNA, 20 bp, Artificial Sequence
  chemically synthesized
aagcacaattaaaacaggga

SEQ ID NO: 167179 - DNA, 20 bp, Artificial Sequence
  chemically synthesized
cagggatagaaaatgaatca

SEQ ID NO: 167180 - DNA, 20 bp, Artificial Sequence
  chemically synthesized
tcacagtaacaaatatgatg

SEQ ID NO: 167181 - DNA, 20 bp, Artificial Sequence
  chemically synthesized
cacagtaacaaatatgatgc

SEQ ID NO: 167182 - DNA, 20 bp, Artificial Sequence
  chemically synthesized
caaatatgatgcaggcattc

SEQ ID NO: 167183 - DNA, 20 bp, Artificial Sequence
  chemically synthesized
tgcaggcattctagtaacat

SEQ ID NO: 167184 - DNA, 20 bp, Artificial Sequence
  chemically synthesized
cttcattaaacttatgttac

SEQ ID NO: 167185 - DNA, 20 bp, Artificial Sequence
  chemically synthesized
ctagtaacataagtttaatg

SEQ ID NO: 167186 - DNA, 20 bp, Artificial Sequence
  chemically synthesized
tttaatgaagaccttatttc

SEQ ID NO: 167187 - DNA, 20 bp, Artificial Sequence
  chemically synthesized
ctcagcatttactagaaata

SEQ ID NO: 167188 - DNA, 20 bp, Artificial Sequence
  chemically synthesized
cctcagcatttactagaaat

SEQ ID NO: 167189 - DNA, 20 bp, Artificial Sequence
  chemically synthesized
gctttttcctcagcatttac

SEQ ID NO: 167190 - DNA, 20 bp, Artificial Sequence
  chemically synthesized
ccttatttctagtaaatgct

SEQ ID NO: 167191 - DNA, 20 bp, Artificial Sequence
  chemically synthesized
cttatttctagtaaatgctg

SEQ ID NO: 167192 - DNA, 20 bp, Artificial Sequence
  chemically synthesized
tctagtaaatgctgaggaaa

SEQ ID NO: 167193 - DNA, 20 bp, Artificial Sequence
  chemically synthesized
agaatatgttgctttttcct

SEQ ID NO: 167194 - DNA, 20 bp, Artificial Sequence
  chemically synthesized
gaggaaaaagcaacatattc

SEQ ID NO: 167195 - DNA, 20 bp, Artificial Sequence
  chemically synthesized
aataattattattattttac

SEQ ID NO: 167196 - DNA, 20 bp, Artificial Sequence
  chemically synthesized
caacaatgatgatgatgaca

SEQ ID NO: 167197 - DNA, 20 bp, Artificial Sequence
  chemically synthesized
gactaaagtttagtcaagca

SEQ ID NO: 167198 - DNA, 20 bp, Artificial Sequence
  chemically synthesized
tgactaaagtttagtcaagc

SEQ ID NO: 167199 - DNA, 20 bp, Artificial Sequence
  chemically synthesized
ctgactaaagtttagtcaag

SEQ ID NO: 167200 - DNA, 20 bp, Artificial Sequence
  chemically synthesized
agcctgactaaagtttagtc

SEQ ID NO: 167201 - DNA, 20 bp, Artificial Sequence
  chemically synthesized
ttccctgcttgactaaactt

SEQ ID NO: 167202 - DNA, 20 bp, Artificial Sequence
  chemically synthesized
tcagaagcctgactaaagtt

SEQ ID NO: 167203 - DNA, 20 bp, Artificial Sequence
  chemically synthesized
ctgcttgactaaactttagt

SEQ ID NO: 167204 - DNA, 20 bp, Artificial Sequence
  chemically synthesized
tgcttgactaaactttagtc

SEQ ID NO: 167205 - DNA, 20 bp, Artificial Sequence
  chemically synthesized
aaggttcagaagcctgacta

SEQ ID NO: 167206 - DNA, 20 bp, Artificial Sequence
  chemically synthesized
gagcccaggcgaaggttcag

SEQ ID NO: 167207 - DNA, 20 bp, Artificial Sequence
  chemically synthesized
gatgagcccaggcgaaggtt

SEQ ID NO: 167208 - DNA, 20 bp, Artificial Sequence
  chemically synthesized
caggcttctgaaccttcgcc

SEQ ID NO: 167209 - DNA, 20 bp, Artificial Sequence
  chemically synthesized
aggcttctgaaccttcgcct

SEQ ID NO: 167210 - DNA, 20 bp, Artificial Sequence
  chemically synthesized
gcaaagatgagcccaggcga

SEQ ID NO: 167211 - DNA, 20 bp, Artificial Sequence
  chemically synthesized
tgcaaagatgagcccaggcg

SEQ ID NO: 167212 - DNA, 20 bp, Artificial Sequence
  chemically synthesized
gggagtgcaaagatgagccc

SEQ ID NO: 167213 - DNA, 20 bp, Artificial Sequence
  chemically synthesized
ggggagtgcaaagatgagcc

SEQ ID NO: 167214 - DNA, 20 bp, Artificial Sequence
  chemically synthesized
ttacaggggagtgcaaagat

SEQ ID NO: 167215 - DNA, 20 bp, Artificial Sequence
  chemically synthesized
ggattttacaggggagtgca

SEQ ID NO: 167216 - DNA, 20 bp, Artificial Sequence
  chemically synthesized
tgaacctggattttacaggg

SEQ ID NO: 167217 - DNA, 20 bp, Artificial Sequence
  chemically synthesized
gctgaacctggattttacag

SEQ ID NO: 167218 - DNA, 20 bp, Artificial Sequence
  chemically synthesized
tgctgaacctggattttaca

SEQ ID NO: 167219 - DNA, 20 bp, Artificial Sequence
  chemically synthesized
ttgctgaacctggattttac

SEQ ID NO: 167220 - DNA, 20 bp, Artificial Sequence
  chemically synthesized
ttgcactcccctgtaaaatc

SEQ ID NO: 167221 - DNA, 20 bp, Artificial Sequence
  chemically synthesized
tttgctgaacctggatttta

SEQ ID NO: 167222 - DNA, 20 bp, Artificial Sequence
  chemically synthesized
tgcactcccctgtaaaatcc

SEQ ID NO: 167223 - DNA, 20 bp, Artificial Sequence
  chemically synthesized
tcccctgtaaaatccaggtt

SEQ ID NO: 167224 - DNA, 20 bp, Artificial Sequence
  chemically synthesized
acaggcttctttgctgaacc

SEQ ID NO: 167225 - DNA, 20 bp, Artificial Sequence
  chemically synthesized
tgtaaaatccaggttcagca

SEQ ID NO: 167226 - DNA, 20 bp, Artificial Sequence
  chemically synthesized
aaaatccaggttcagcaaag

SEQ ID NO: 167227 - DNA, 20 bp, Artificial Sequence
  chemically synthesized
ggttcagcaaagaagcctgt

SEQ ID NO: 167228 - DNA, 20 bp, Artificial Sequence
  chemically synthesized
agggttcttgtaaaactgac

SEQ ID NO: 167229 - DNA, 20 bp, Artificial Sequence
  chemically synthesized
aagggttcttgtaaaactga

SEQ ID NO: 167230 - DNA, 20 bp, Artificial Sequence
  chemically synthesized
aagaagcctgtcagttttac

SEQ ID NO: 167231 - DNA, 20 bp, Artificial Sequence
  chemically synthesized
gatcaggtaccaaggataaa

SEQ ID NO: 167232 - DNA, 20 bp, Artificial Sequence
  chemically synthesized
ttacaagaaccctttatcct

SEQ ID NO: 167233 - DNA, 20 bp, Artificial Sequence
  chemically synthesized
tgatcaggtaccaaggataa

SEQ ID NO: 167234 - DNA, 20 bp, Artificial Sequence
  chemically synthesized
gtgatcaggtaccaaggata

SEQ ID NO: 167235 - DNA, 20 bp, Artificial Sequence
  chemically synthesized
ctgagggtgatcaggtacca

SEQ ID NO: 167236 - DNA, 20 bp, Artificial Sequence
  chemically synthesized
actgagggtgatcaggtacc

SEQ ID NO: 167237 - DNA, 20 bp, Artificial Sequence
  chemically synthesized
ggagaatactgagggtgatc

SEQ ID NO: 167238 - DNA, 20 bp, Artificial Sequence
  chemically synthesized
tggagaatactgagggtgat

SEQ ID NO: 167239 - DNA, 20 bp, Artificial Sequence
  chemically synthesized
ccttggtacctgatcaccct

SEQ ID NO: 167240 - DNA, 20 bp, Artificial Sequence
  chemically synthesized
ggaatggtggagaatactga

SEQ ID NO: 167241 - DNA, 20 bp, Artificial Sequence
  chemically synthesized
gggaatggtggagaatactg

SEQ ID NO: 167242 - DNA, 20 bp, Artificial Sequence
  chemically synthesized
ggggaatggtggagaatact

SEQ ID NO: 167243 - DNA, 20 bp, Artificial Sequence
  chemically synthesized
acaacccttggggaatggtg

SEQ ID NO: 167244 - DNA, 20 bp, Artificial Sequence
  chemically synthesized
agacaacccttggggaatgg

SEQ ID NO: 167245 - DNA, 20 bp, Artificial Sequence
  chemically synthesized
agtattctccaccattcccc

SEQ ID NO: 167246 - DNA, 20 bp, Artificial Sequence
  chemically synthesized
gtattctccaccattcccca

SEQ ID NO: 167247 - DNA, 20 bp, Artificial Sequence
  chemically synthesized
atcagacaacccttggggaa

SEQ ID NO: 167248 - DNA, 20 bp, Artificial Sequence
  chemically synthesized
tattctccaccattccccaa

SEQ ID NO: 167249 - DNA, 20 bp, Artificial Sequence
  chemically synthesized
atcttatcagacaacccttg

SEQ ID NO: 167250 - DNA, 20 bp, Artificial Sequence
  chemically synthesized
tatcttatcagacaaccctt

SEQ ID NO: 167251 - DNA, 20 bp, Artificial Sequence
  chemically synthesized
ttatcttatcagacaaccct

SEQ ID NO: 167252 - DNA, 20 bp, Artificial Sequence
  chemically synthesized
ttccccaagggttgtctgat

SEQ ID NO: 167253 - DNA, 20 bp, Artificial Sequence
  chemically synthesized
ataggccagggttatcttat

SEQ ID NO: 167254 - DNA, 20 bp, Artificial Sequence
  chemically synthesized
gttgtctgataagataaccc

SEQ ID NO: 167255 - DNA, 20 bp, Artificial Sequence
  chemically synthesized
ttcttgctgaagataggcca

SEQ ID NO: 167256 - DNA, 20 bp, Artificial Sequence
  chemically synthesized
attcttgctgaagataggcc

SEQ ID NO: 167257 - DNA, 20 bp, Artificial Sequence
  chemically synthesized
gattcttgctgaagataggc

SEQ ID NO: 167258 - DNA, 20 bp, Artificial Sequence
  chemically synthesized
agataaccctggcctatctt

SEQ ID NO: 167259 - DNA, 20 bp, Artificial Sequence
  chemically synthesized
acaggattcttgctgaagat

SEQ ID NO: 167260 - DNA, 20 bp, Artificial Sequence
  chemically synthesized
cacaggattcttgctgaaga

SEQ ID NO: 167261 - DNA, 20 bp, Artificial Sequence
  chemically synthesized
aaccctggcctatcttcagc

SEQ ID NO: 167262 - DNA, 20 bp, Artificial Sequence
  chemically synthesized
acctcacaggattcttgctg

SEQ ID NO: 167263 - DNA, 20 bp, Artificial Sequence
  chemically synthesized
atcttcagcaagaatcctgt

SEQ ID NO: 167264 - DNA, 20 bp, Artificial Sequence
  chemically synthesized
tcttcagcaagaatcctgtg

SEQ ID NO: 167265 - DNA, 20 bp, Artificial Sequence
  chemically synthesized
cagcaagaatcctgtgaggt

SEQ ID NO: 167266 - DNA, 20 bp, Artificial Sequence
  chemically synthesized
tctggctaaaccaacctcac

SEQ ID NO: 167267 - DNA, 20 bp, Artificial Sequence
  chemically synthesized
ttctggctaaaccaacctca

SEQ ID NO: 167268 - DNA, 20 bp, Artificial Sequence
  chemically synthesized
agaatcctgtgaggttggtt

SEQ ID NO: 167269 - DNA, 20 bp, Artificial Sequence
  chemically synthesized
tcctgtgaggttggtttagc

SEQ ID NO: 167270 - DNA, 20 bp, Artificial Sequence
  chemically synthesized
atcaggggtaagtgggattc

SEQ ID NO: 167271 - DNA, 20 bp, Artificial Sequence
  chemically synthesized
aggaaacatcaggggtaagt

SEQ ID NO: 167272 - DNA, 20 bp, Artificial Sequence
  chemically synthesized
gaggaaacatcaggggtaag

SEQ ID NO: 167273 - DNA, 20 bp, Artificial Sequence
  chemically synthesized
taagaggaaacatcaggggt

SEQ ID NO: 167274 - DNA, 20 bp, Artificial Sequence
  chemically synthesized
ttattaagaggaaacatcag

SEQ ID NO: 167275 - DNA, 20 bp, Artificial Sequence
  chemically synthesized
attattaagaggaaacatca

SEQ ID NO: 167276 - DNA, 20 bp, Artificial Sequence
  chemically synthesized
aattattaagaggaaacatc

SEQ ID NO: 167277 - DNA, 20 bp, Artificial Sequence
  chemically synthesized
aaattattaagaggaaacat

SEQ ID NO: 167278 - DNA, 20 bp, Artificial Sequence
  chemically synthesized
gtagatggaaaattattaag

SEQ ID NO: 167279 - DNA, 20 bp, Artificial Sequence
  chemically synthesized
agtagatggaaaattattaa

SEQ ID NO: 167280 - DNA, 20 bp, Artificial Sequence
  chemically synthesized
tcagtagatggaaaattatt

SEQ ID NO: 167281 - DNA, 20 bp, Artificial Sequence
  chemically synthesized
gcagtgtaggagtcagtaga

SEQ ID NO: 167282 - DNA, 20 bp, Artificial Sequence
  chemically synthesized
aggagcagtgtaggagtcag

SEQ ID NO: 167283 - DNA, 20 bp, Artificial Sequence
  chemically synthesized
ccaaggagcagtgtaggagt

SEQ ID NO: 167284 - DNA, 20 bp, Artificial Sequence
  chemically synthesized
atagccaaggagcagtgtag

SEQ ID NO: 167285 - DNA, 20 bp, Artificial Sequence
  chemically synthesized
ttatagccaaggagcagtgt

SEQ ID NO: 167286 - DNA, 20 bp, Artificial Sequence
  chemically synthesized
tttatagccaaggagcagtg

SEQ ID NO: 167287 - DNA, 20 bp, Artificial Sequence
  chemically synthesized
ctgactcctacactgctcct

SEQ ID NO: 167288 - DNA, 20 bp, Artificial Sequence
  chemically synthesized
aggaatttatagccaaggag

SEQ ID NO: 167289 - DNA, 20 bp, Artificial Sequence
  chemically synthesized
agtaggaatttatagccaag

SEQ ID NO: 167290 - DNA, 20 bp, Artificial Sequence
  chemically synthesized
gaagtaggaatttatagcca

SEQ ID NO: 167291 - DNA, 20 bp, Artificial Sequence
  chemically synthesized
ggaagtaggaatttatagcc

SEQ ID NO: 167292 - DNA, 20 bp, Artificial Sequence
  chemically synthesized
acagtggaagtaggaattta

SEQ ID NO: 167293 - DNA, 20 bp, Artificial Sequence
  chemically synthesized
aaatacagcacagtggaagt

SEQ ID NO: 167294 - DNA, 20 bp, Artificial Sequence
  chemically synthesized
taaatacagcacagtggaag

SEQ ID NO: 167295 - DNA, 20 bp, Artificial Sequence
  chemically synthesized
ctctaaatacagcacagtgg

SEQ ID NO: 167296 - DNA, 20 bp, Artificial Sequence
  chemically synthesized
caactctaaatacagcacag

SEQ ID NO: 167297 - DNA, 20 bp, Artificial Sequence
  chemically synthesized
gctcaactctaaatacagca

SEQ ID NO: 167298 - DNA, 20 bp, Artificial Sequence
  chemically synthesized
tacttccactgtgctgtatt

SEQ ID NO: 167299 - DNA, 20 bp, Artificial Sequence
  chemically synthesized
cttccactgtgctgtattta

SEQ ID NO: 167300 - DNA, 20 bp, Artificial Sequence
  chemically synthesized
attgggctcaactctaaata

SEQ ID NO: 167301 - DNA, 20 bp, Artificial Sequence
  chemically synthesized
actgtgctgtatttagagtt

SEQ ID NO: 167302 - DNA, 20 bp, Artificial Sequence
  chemically synthesized
aggttggatagagagagatt

SEQ ID NO: 167303 - DNA, 20 bp, Artificial Sequence
  chemically synthesized
gaggttggatagagagagat

SEQ ID NO: 167304 - DNA, 20 bp, Artificial Sequence
  chemically synthesized
tacaggaggttggatagaga

SEQ ID NO: 167305 - DNA, 20 bp, Artificial Sequence
  chemically synthesized
attacaggaggttggataga

SEQ ID NO: 167306 - DNA, 20 bp, Artificial Sequence
  chemically synthesized
gtattacaggaggttggata

SEQ ID NO: 167307 - DNA, 20 bp, Artificial Sequence
  chemically synthesized
gagtattacaggaggttgga

SEQ ID NO: 167308 - DNA, 20 bp, Artificial Sequence
  chemically synthesized
aatggagtattacaggaggt

SEQ ID NO: 167309 - DNA, 20 bp, Artificial Sequence
  chemically synthesized
ctgcaatggagtattacagg

SEQ ID NO: 167310 - DNA, 20 bp, Artificial Sequence
  chemically synthesized
actgcaatggagtattacag

SEQ ID NO: 167311 - DNA, 20 bp, Artificial Sequence
  chemically synthesized
ccactgcaatggagtattac

SEQ ID NO: 167312 - DNA, 20 bp, Artificial Sequence
  chemically synthesized
accactgcaatggagtatta

SEQ ID NO: 167313 - DNA, 20 bp, Artificial Sequence
  chemically synthesized
cctcctgtaatactccattg

SEQ ID NO: 167314 - DNA, 20 bp, Artificial Sequence
  chemically synthesized
gcacagggaccactgcaatg

SEQ ID NO: 167315 - DNA, 20 bp, Artificial Sequence
  chemically synthesized
cctgtaatactccattgcag

SEQ ID NO: 167316 - DNA, 20 bp, Artificial Sequence
  chemically synthesized
aggcacagggaccactgcaa

SEQ ID NO: 167317 - DNA, 20 bp, Artificial Sequence
  chemically synthesized
ggataaccacaataggcaca

SEQ ID NO: 167318 - DNA, 20 bp, Artificial Sequence
  chemically synthesized
aggataaccacaataggcac

SEQ ID NO: 167319 - DNA, 20 bp, Artificial Sequence
  chemically synthesized
caggataaccacaataggca

SEQ ID NO: 167320 - DNA, 20 bp, Artificial Sequence
  chemically synthesized
agtggtccctgtgcctattg

SEQ ID NO: 167321 - DNA, 20 bp, Artificial Sequence
  chemically synthesized
ttattcaggataaccacaat

SEQ ID NO: 167322 - DNA, 20 bp, Artificial Sequence
  chemically synthesized
tttattcaggataaccacaa

SEQ ID NO: 167323 - DNA, 20 bp, Artificial Sequence
  chemically synthesized
tattgtggttatcctgaata

SEQ ID NO: 167324 - DNA, 20 bp, Artificial Sequence
  chemically synthesized
tggtaaggaagactttattc

SEQ ID NO: 167325 - DNA, 20 bp, Artificial Sequence
  chemically synthesized
gtggtaaggaagactttatt

SEQ ID NO: 167326 - DNA, 20 bp, Artificial Sequence
  chemically synthesized
cttgttaaagtgtggtaagg

SEQ ID NO: 167327 - DNA, 20 bp, Artificial Sequence
  chemically synthesized
ttacttgttaaagtgtggta

SEQ ID NO: 167328 - DNA, 20 bp, Artificial Sequence
  chemically synthesized
attacttgttaaagtgtggt

SEQ ID NO: 167329 - DNA, 20 bp, Artificial Sequence
  chemically synthesized
aaatattacttgttaaagtg

SEQ ID NO: 167330 - DNA, 20 bp, Artificial Sequence
  chemically synthesized
cttccttaccacactttaac

SEQ ID NO: 167331 - DNA, 20 bp, Artificial Sequence
  chemically synthesized
agacaaaatattacttgtta

SEQ ID NO: 167332 - DNA, 20 bp, Artificial Sequence
  chemically synthesized
ctcatttggtatcattatta

SEQ ID NO: 167333 - DNA, 20 bp, Artificial Sequence
  chemically synthesized
ctttaataatgataccaaat

SEQ ID NO: 167334 - DNA, 20 bp, Artificial Sequence
  chemically synthesized
tatcactgaattttctcatt

SEQ ID NO: 167335 - DNA, 20 bp, Artificial Sequence
  chemically synthesized
tgataccaaatgagaaaatt

SEQ ID NO: 167336 - DNA, 20 bp, Artificial Sequence
  chemically synthesized
tttgtcttttttaagaaaaa

SEQ ID NO: 167337 - DNA, 20 bp, Artificial Sequence
  chemically synthesized
tattgccatttttcttaaaa

SEQ ID NO: 167338 - DNA, 20 bp, Artificial Sequence
  chemically synthesized
taaatatttttgtctttttt

SEQ ID NO: 167339 - DNA, 20 bp, Artificial Sequence
  chemically synthesized
aaaaaagacaaaaatattta

SEQ ID NO: 167340 - DNA, 20 bp, Artificial Sequence
  chemically synthesized
acaaaaatatttaaagcaaa

SEQ ID NO: 167341 - DNA, 20 bp, Artificial Sequence
  chemically synthesized
gaccatttgacgttcaggta

SEQ ID NO: 167342 - DNA, 20 bp, Artificial Sequence
  chemically synthesized
ggaccatttgacgttcaggt

SEQ ID NO: 167343 - DNA, 20 bp, Artificial Sequence
  chemically synthesized
aggaccatttgacgttcagg

SEQ ID NO: 167344 - DNA, 20 bp, Artificial Sequence
  chemically synthesized
agaaggaccatttgacgttc

SEQ ID NO: 167345 - DNA, 20 bp, Artificial Sequence
  chemically synthesized
aagaaggaccatttgacgtt

SEQ ID NO: 167346 - DNA, 20 bp, Artificial Sequence
  chemically synthesized
ttccctacctgaacgtcaaa

SEQ ID NO: 167347 - DNA, 20 bp, Artificial Sequence
  chemically synthesized
gaacgtcaaatggtccttct

SEQ ID NO: 167348 - DNA, 20 bp, Artificial Sequence
  chemically synthesized
tataaccaaccaaaccaaga

SEQ ID NO: 167349 - DNA, 20 bp, Artificial Sequence
  chemically synthesized
tcaaatggtccttcttggtt

SEQ ID NO: 167350 - DNA, 20 bp, Artificial Sequence
  chemically synthesized
ttataaccaaccaaaccaag

SEQ ID NO: 167351 - DNA, 20 bp, Artificial Sequence
  chemically synthesized
aatttataaccaaccaaacc

SEQ ID NO: 167352 - DNA, 20 bp, Artificial Sequence
  chemically synthesized
atggtccttcttggtttggt

SEQ ID NO: 167353 - DNA, 20 bp, Artificial Sequence
  chemically synthesized
atctcctattaggaatcagt

SEQ ID NO: 167354 - DNA, 20 bp, Artificial Sequence
  chemically synthesized
ggttatctcctattaggaat

SEQ ID NO: 167355 - DNA, 20 bp, Artificial Sequence
  chemically synthesized
aatttccaactgattcctaa

SEQ ID NO: 167356 - DNA, 20 bp, Artificial Sequence
  chemically synthesized
atttccaactgattcctaat

SEQ ID NO: 167357 - DNA, 20 bp, Artificial Sequence
  chemically synthesized
ttccaactgattcctaatag

SEQ ID NO: 167358 - DNA, 20 bp, Artificial Sequence
  chemically synthesized
tgctgtggttatctcctatt

SEQ ID NO: 167359 - DNA, 20 bp, Artificial Sequence
  chemically synthesized
ctgctgtggttatctcctat

SEQ ID NO: 167360 - DNA, 20 bp, Artificial Sequence
  chemically synthesized
ttcctaataggagataacca

SEQ ID NO: 167361 - DNA, 20 bp, Artificial Sequence
  chemically synthesized
ctaataggagataaccacag

SEQ ID NO: 167362 - DNA, 20 bp, Artificial Sequence
  chemically synthesized
ataggagataaccacagcag

SEQ ID NO: 167363 - DNA, 20 bp, Artificial Sequence
  chemically synthesized
agttaaatcatctgctgctg

SEQ ID NO: 167364 - DNA, 20 bp, Artificial Sequence
  chemically synthesized
agatgatttaactgctcttc

SEQ ID NO: 167365 - DNA, 20 bp, Artificial Sequence
  chemically synthesized
gatgatttaactgctcttca

SEQ ID NO: 167366 - DNA, 20 bp, Artificial Sequence
  chemically synthesized
agcttgaagaccttgaagag

SEQ ID NO: 167367 - DNA, 20 bp, Artificial Sequence
  chemically synthesized
aaaagcttgaagaccttgaa

SEQ ID NO: 167368 - DNA, 20 bp, Artificial Sequence
  chemically synthesized
aaaaaagcttgaagaccttg

SEQ ID NO: 167369 - DNA, 20 bp, Artificial Sequence
  chemically synthesized
aactgctcttcaaggtcttc

SEQ ID NO: 167370 - DNA, 20 bp, Artificial Sequence
  chemically synthesized
gcagcttgaaaaaaagcttg

SEQ ID NO: 167371 - DNA, 20 bp, Artificial Sequence
  chemically synthesized
aggtcttcaagctttttttc

SEQ ID NO: 167372 - DNA, 20 bp, Artificial Sequence
  chemically synthesized
accttgggcagcttgaaaaa

SEQ ID NO: 167373 - DNA, 20 bp, Artificial Sequence
  chemically synthesized
agctttttttcaagctgccc

SEQ ID NO: 167374 - DNA, 20 bp, Artificial Sequence
  chemically synthesized
gctttttttcaagctgccca

SEQ ID NO: 167375 - DNA, 20 bp, Artificial Sequence
  chemically synthesized
ctcaaataaaagaccttggg

SEQ ID NO: 167376 - DNA, 20 bp, Artificial Sequence
  chemically synthesized
aagctcaaataaaagacctt

SEQ ID NO: 167377 - DNA, 20 bp, Artificial Sequence
  chemically synthesized
gaagctcaaataaaagacct

SEQ ID NO: 167378 - DNA, 20 bp, Artificial Sequence
  chemically synthesized
ctgcccaaggtcttttattt

SEQ ID NO: 167379 - DNA, 20 bp, Artificial Sequence
  chemically synthesized
agaaattgaagctcaaataa

SEQ ID NO: 167380 - DNA, 20 bp, Artificial Sequence
  chemically synthesized
tgagaaacaaggagaaattg

SEQ ID NO: 167381 - DNA, 20 bp, Artificial Sequence
  chemically synthesized
agctttacctgagaaacaag

SEQ ID NO: 167382 - DNA, 20 bp, Artificial Sequence
  chemically synthesized
ttcaatttctccttgtttct

SEQ ID NO: 167383 - DNA, 20 bp, Artificial Sequence
  chemically synthesized
agagctttacctgagaaaca

SEQ ID NO: 167384 - DNA, 20 bp, Artificial Sequence
  chemically synthesized
tcaatttctccttgtttctc

SEQ ID NO: 167385 - DNA, 20 bp, Artificial Sequence
  chemically synthesized
cagagctttacctgagaaac

SEQ ID NO: 167386 - DNA, 20 bp, Artificial Sequence
  chemically synthesized
ttctccttgtttctcaggta

SEQ ID NO: 167387 - DNA, 20 bp, Artificial Sequence
  chemically synthesized
aggtttccagagctttacct

SEQ ID NO: 167388 - DNA, 20 bp, Artificial Sequence
  chemically synthesized
ttgtttctcaggtaaagctc

SEQ ID NO: 167389 - DNA, 20 bp, Artificial Sequence
  chemically synthesized
attttcctttcaggtttcca

SEQ ID NO: 167390 - DNA, 20 bp, Artificial Sequence
  chemically synthesized
gtattttcctttcaggtttc

SEQ ID NO: 167391 - DNA, 20 bp, Artificial Sequence
  chemically synthesized
gtaaagctctggaaacctga

SEQ ID NO: 167392 - DNA, 20 bp, Artificial Sequence
  chemically synthesized
taaagctctggaaacctgaa

SEQ ID NO: 167393 - DNA, 20 bp, Artificial Sequence
  chemically synthesized
ttaaaatgtattttcctttc

SEQ ID NO: 167394 - DNA, 20 bp, Artificial Sequence
  chemically synthesized
tttaaaatgtattttccttt

SEQ ID NO: 167395 - DNA, 20 bp, Artificial Sequence
  chemically synthesized
aaaggaaaatacattttaaa

SEQ ID NO: 167396 - DNA, 20 bp, Artificial Sequence
  chemically synthesized
aaggaaaatacattttaaaa

SEQ ID NO: 167397 - DNA, 20 bp, Artificial Sequence
  chemically synthesized
taaaaaggtaaataattctc

SEQ ID NO: 167398 - DNA, 20 bp, Artificial Sequence
  chemically synthesized
aaaaaggtaaataattctca

SEQ ID NO: 167399 - DNA, 20 bp, Artificial Sequence
  chemically synthesized
gtaaataattctcaaggcat

SEQ ID NO: 167400 - DNA, 20 bp, Artificial Sequence
  chemically synthesized
aacattttggcttatgcctt

SEQ ID NO: 167401 - DNA, 20 bp, Artificial Sequence
  chemically synthesized
aaatatatttttaaacattt

SEQ ID NO: 167402 - DNA, 20 bp, Artificial Sequence
  chemically synthesized
gtttaaaaatatattttcaa

SEQ ID NO: 167403 - DNA, 20 bp, Artificial Sequence
  chemically synthesized
ttatttatcatgaaatatta

SEQ ID NO: 167404 - DNA, 20 bp, Artificial Sequence
  chemically synthesized
ctaaaataacacaaatcagt

SEQ ID NO: 167405 - DNA, 20 bp, Artificial Sequence
  chemically synthesized
gctgctaaaataacacaaat

SEQ ID NO: 167406 - DNA, 20 bp, Artificial Sequence
  chemically synthesized
cttactgatttgtgttattt

SEQ ID NO: 167407 - DNA, 20 bp, Artificial Sequence
  chemically synthesized
actgatttgtgttattttag

SEQ ID NO: 167408 - DNA, 20 bp, Artificial Sequence
  chemically synthesized
tatttacatatattacatgt

SEQ ID NO: 167409 - DNA, 20 bp, Artificial Sequence
  chemically synthesized
atttacatatattacatgtt

SEQ ID NO: 167410 - DNA, 20 bp, Artificial Sequence
  chemically synthesized
atgaataattttgaatacat

SEQ ID NO: 167411 - DNA, 20 bp, Artificial Sequence
  chemically synthesized
aagcaaagaatttttgtagc

SEQ ID NO: 167412 - DNA, 20 bp, Artificial Sequence
  chemically synthesized
aaagcaaagaatttttgtag

SEQ ID NO: 167413 - DNA, 20 bp, Artificial Sequence
  chemically synthesized
tttaaagcaaagaatttttg

SEQ ID NO: 167414 - DNA, 20 bp, Artificial Sequence
  chemically synthesized
tacaaaaattctttgcttta

SEQ ID NO: 167415 - DNA, 20 bp, Artificial Sequence
  chemically synthesized
gtattagtttctttaaagca

SEQ ID NO: 167416 - DNA, 20 bp, Artificial Sequence
  chemically synthesized
aaaaggtattagtttcttta

SEQ ID NO: 167417 - DNA, 20 bp, Artificial Sequence
  chemically synthesized
ttgaaattccaaaaaggtat

SEQ ID NO: 167418 - DNA, 20 bp, Artificial Sequence
  chemically synthesized
taaagaaactaatacctttt

SEQ ID NO: 167419 - DNA, 20 bp, Artificial Sequence
  chemically synthesized
tgtgttttgaaattccaaaa

SEQ ID NO: 167420 - DNA, 20 bp, Artificial Sequence
  chemically synthesized
gtgtgttttgaaattccaaa

SEQ ID NO: 167421 - DNA, 20 bp, Artificial Sequence
  chemically synthesized
caaaacacacaccttacaca

SEQ ID NO: 167422 - DNA, 20 bp, Artificial Sequence
  chemically synthesized
aaaacacacaccttacacaa

SEQ ID NO: 167423 - DNA, 20 bp, Artificial Sequence
  chemically synthesized
gttggctatgcctttgtgta

SEQ ID NO: 167424 - DNA, 20 bp, Artificial Sequence
  chemically synthesized
agttggctatgcctttgtgt

SEQ ID NO: 167425 - DNA, 20 bp, Artificial Sequence
  chemically synthesized
acacaccttacacaaaggca

SEQ ID NO: 167426 - DNA, 20 bp, Artificial Sequence
  chemically synthesized
tttactttatcagttgcagt

SEQ ID NO: 167427 - DNA, 20 bp, Artificial Sequence
  chemically synthesized
tttctttactttatcagttg

SEQ ID NO: 167428 - DNA, 20 bp, Artificial Sequence
  chemically synthesized
atagccaactgcaactgata

SEQ ID NO: 167429 - DNA, 20 bp, Artificial Sequence
  chemically synthesized
gatgtatttctttactttat

SEQ ID NO: 167430 - DNA, 20 bp, Artificial Sequence
  chemically synthesized
caactgcaactgataaagta

SEQ ID NO: 167431 - DNA, 20 bp, Artificial Sequence
  chemically synthesized
gtaactgagtgaataaatga

SEQ ID NO: 167432 - DNA, 20 bp, Artificial Sequence
  chemically synthesized
acatctttcatttattcact

SEQ ID NO: 167433 - DNA, 20 bp, Artificial Sequence
  chemically synthesized
caccagtatatttagtaact

SEQ ID NO: 167434 - DNA, 20 bp, Artificial Sequence
  chemically synthesized
cactcagttactaaatatac

SEQ ID NO: 167435 - DNA, 20 bp, Artificial Sequence
  chemically synthesized
acacaacacaccagtatatt

SEQ ID NO: 167436 - DNA, 20 bp, Artificial Sequence
  chemically synthesized
gcatataatacacaacacac

SEQ ID NO: 167437 - DNA, 20 bp, Artificial Sequence
  chemically synthesized
aactgcaaaggaagcgcgta

SEQ ID NO: 167438 - DNA, 20 bp, Artificial Sequence
  chemically synthesized
tgccatacgcgcttcctttg

SEQ ID NO: 167439 - DNA, 20 bp, Artificial Sequence
  chemically synthesized
catttttataactgcaaagg

SEQ ID NO: 167440 - DNA, 20 bp, Artificial Sequence
  chemically synthesized
attcatttttataactgcaa

SEQ ID NO: 167441 - DNA, 20 bp, Artificial Sequence
  chemically synthesized
tattcatttttataactgca

SEQ ID NO: 167442 - DNA, 20 bp, Artificial Sequence
  chemically synthesized
ttgcagttataaaaatgaat

SEQ ID NO: 167443 - DNA, 20 bp, Artificial Sequence
  chemically synthesized
gttataaaaatgaataagcc

SEQ ID NO: 167444 - DNA, 20 bp, Artificial Sequence
  chemically synthesized
aatgaataagccaagttatt

SEQ ID NO: 167445 - DNA, 20 bp, Artificial Sequence
  chemically synthesized
ggtgctaatgctgaataact

SEQ ID NO: 167446 - DNA, 20 bp, Artificial Sequence
  chemically synthesized
taagccaagttattcagcat

SEQ ID NO: 167447 - DNA, 20 bp, Artificial Sequence
  chemically synthesized
aagttattcagcattagcac

SEQ ID NO: 167448 - DNA, 20 bp, Artificial Sequence
  chemically synthesized
gaagacctgtgttatatatc

SEQ ID NO: 167449 - DNA, 20 bp, Artificial Sequence
  chemically synthesized
ttagcaccagatatataaca

SEQ ID NO: 167450 - DNA, 20 bp, Artificial Sequence
  chemically synthesized
tagcaccagatatataacac

SEQ ID NO: 167451 - DNA, 20 bp, Artificial Sequence
  chemically synthesized
atcactcatttgggatttag

SEQ ID NO: 167452 - DNA, 20 bp, Artificial Sequence
  chemically synthesized
aaaatcactcatttgggatt

SEQ ID NO: 167453 - DNA, 20 bp, Artificial Sequence
  chemically synthesized
aggtcttctaaatcccaaat

SEQ ID NO: 167454 - DNA, 20 bp, Artificial Sequence
  chemically synthesized
tgaataaaaatcactcattt

SEQ ID NO: 167455 - DNA, 20 bp, Artificial Sequence
  chemically synthesized
ttgaataaaaatcactcatt

SEQ ID NO: 167456 - DNA, 20 bp, Artificial Sequence
  chemically synthesized
gttggtttggttttaatttt

SEQ ID NO: 167457 - DNA, 20 bp, Artificial Sequence
  chemically synthesized
agttggtttggttttaattt

SEQ ID NO: 167458 - DNA, 20 bp, Artificial Sequence
  chemically synthesized
aaacaaaattatagttggtt

SEQ ID NO: 167459 - DNA, 20 bp, Artificial Sequence
  chemically synthesized
tatacaaacaaaattatagt

SEQ ID NO: 167460 - DNA, 20 bp, Artificial Sequence
  chemically synthesized
ttgctatacaaacaaaatta

SEQ ID NO: 167461 - DNA, 20 bp, Artificial Sequence
  chemically synthesized
caactataattttgtttgta

SEQ ID NO: 167462 - DNA, 20 bp, Artificial Sequence
  chemically synthesized
gctagaagcaagtatagtag

SEQ ID NO: 167463 - DNA, 20 bp, Artificial Sequence
  chemically synthesized
aaagctagaagcaagtatag

SEQ ID NO: 167464 - DNA, 20 bp, Artificial Sequence
  chemically synthesized
aagaaagctagaagcaagta

SEQ ID NO: 167465 - DNA, 20 bp, Artificial Sequence
  chemically synthesized
tcttctactatacttgcttc

SEQ ID NO: 167466 - DNA, 20 bp, Artificial Sequence
  chemically synthesized
cataaaagaaagctagaagc

SEQ ID NO: 167467 - DNA, 20 bp, Artificial Sequence
  chemically synthesized
atgacataaaagaaagctag

SEQ ID NO: 167468 - DNA, 20 bp, Artificial Sequence
  chemically synthesized
tccatgacataaaagaaagc

SEQ ID NO: 167469 - DNA, 20 bp, Artificial Sequence
  chemically synthesized
atcttccatgacataaaaga

SEQ ID NO: 167470 - DNA, 20 bp, Artificial Sequence
  chemically synthesized
tacaatcttccatgacataa

SEQ ID NO: 167471 - DNA, 20 bp, Artificial Sequence
  chemically synthesized
tctagctttcttttatgtca

SEQ ID NO: 167472 - DNA, 20 bp, Artificial Sequence
  chemically synthesized
agctttcttttatgtcatgg

SEQ ID NO: 167473 - DNA, 20 bp, Artificial Sequence
  chemically synthesized
tatgtcatggaagattgtaa

SEQ ID NO: 167474 - DNA, 20 bp, Artificial Sequence
  chemically synthesized
atgtcatggaagattgtaaa

SEQ ID NO: 167475 - DNA, 20 bp, Artificial Sequence
  chemically synthesized
tcatggaagattgtaaaagg

SEQ ID NO: 167476 - DNA, 20 bp, Artificial Sequence
  chemically synthesized
caattttccttgtacatgaa

SEQ ID NO: 167477 - DNA, 20 bp, Artificial Sequence
  chemically synthesized
ccaattttccttgtacatga

SEQ ID NO: 167478 - DNA, 20 bp, Artificial Sequence
  chemically synthesized
aaggaagtcccttcatgtac

SEQ ID NO: 167479 - DNA, 20 bp, Artificial Sequence
  chemically synthesized
accaattttccttgtacatg

SEQ ID NO: 167480 - DNA, 20 bp, Artificial Sequence
  chemically synthesized
aggaagtcccttcatgtaca

SEQ ID NO: 167481 - DNA, 20 bp, Artificial Sequence
  chemically synthesized
ccttcatgtacaaggaaaat

SEQ ID NO: 167482 - DNA, 20 bp, Artificial Sequence
  chemically synthesized
catgtacaaggaaaattggt

SEQ ID NO: 167483 - DNA, 20 bp, Artificial Sequence
  chemically synthesized
ggtaagttatgcgtttttgt

SEQ ID NO: 167484 - DNA, 20 bp, Artificial Sequence
  chemically synthesized
ttatgcgtttttgtgagcta

SEQ ID NO: 167485 - DNA, 20 bp, Artificial Sequence
  chemically synthesized
ttactaggactcacaaacta

SEQ ID NO: 167486 - DNA, 20 bp, Artificial Sequence
  chemically synthesized
ttttgtgagctatagtttgt

SEQ ID NO: 167487 - DNA, 20 bp, Artificial Sequence
  chemically synthesized
gagctatagtttgtgagtcc

SEQ ID NO: 167488 - DNA, 20 bp, Artificial Sequence
  chemically synthesized
agtttgtgagtcctagtaaa

SEQ ID NO: 167489 - DNA, 20 bp, Artificial Sequence
  chemically synthesized
accacctgcttctgtttact

SEQ ID NO: 167490 - DNA, 20 bp, Artificial Sequence
  chemically synthesized
aaccacctgcttctgtttac

SEQ ID NO: 167491 - DNA, 20 bp, Artificial Sequence
  chemically synthesized
ttgtgagtcctagtaaacag

SEQ ID NO: 167492 - DNA, 20 bp, Artificial Sequence
  chemically synthesized
tgagtcctagtaaacagaag

SEQ ID NO: 167493 - DNA, 20 bp, Artificial Sequence
  chemically synthesized
gagtcctagtaaacagaagc

SEQ ID NO: 167494 - DNA, 20 bp, Artificial Sequence
  chemically synthesized
tcctagtaaacagaagcagg

SEQ ID NO: 167495 - DNA, 20 bp, Artificial Sequence
  chemically synthesized
gtaaacagaagcaggtggtt

SEQ ID NO: 167496 - DNA, 20 bp, Artificial Sequence
  chemically synthesized
cagaagcaggtggttgagat

SEQ ID NO: 167497 - DNA, 20 bp, Artificial Sequence
  chemically synthesized
aagcaggtggttgagatgag

SEQ ID NO: 167498 - DNA, 20 bp, Artificial Sequence
  chemically synthesized
tggttgagatgagaagtaaa

SEQ ID NO: 167499 - DNA, 20 bp, Artificial Sequence
  chemically synthesized
tgagaagtaaaaagaacatt

SEQ ID NO: 167500 - DNA, 20 bp, Artificial Sequence
  chemically synthesized
agtaaaaagaacatttggat

SEQ ID NO: 167501 - DNA, 20 bp, Artificial Sequence
  chemically synthesized
taaaaagaacatttggatta

SEQ ID NO: 167502 - DNA, 20 bp, Artificial Sequence
  chemically synthesized
aaagaacatttggattagag

SEQ ID NO: 167503 - DNA, 20 bp, Artificial Sequence
  chemically synthesized
tggattagagtagactgtaa

SEQ ID NO: 167504 - DNA, 20 bp, Artificial Sequence
  chemically synthesized
aacctataatcattctgtta

SEQ ID NO: 167505 - DNA, 20 bp, Artificial Sequence
  chemically synthesized
agactgtaacagaatgatta

SEQ ID NO: 167506 - DNA, 20 bp, Artificial Sequence
  chemically synthesized
gactgtaacagaatgattat

SEQ ID NO: 167507 - DNA, 20 bp, Artificial Sequence
  chemically synthesized
gattataggttatttttatt

SEQ ID NO: 167508 - DNA, 20 bp, Artificial Sequence
  chemically synthesized
ttataggttatttttattaa

SEQ ID NO: 167509 - DNA, 20 bp, Artificial Sequence
  chemically synthesized
ggttatttttattaagagat

SEQ ID NO: 167510 - DNA, 20 bp, Artificial Sequence
  chemically synthesized
aaacttccaaggatgatggt

SEQ ID NO: 167511 - DNA, 20 bp, Artificial Sequence
  chemically synthesized
tatatgccaaccatcatcct

SEQ ID NO: 167512 - DNA, 20 bp, Artificial Sequence
  chemically synthesized
tgtgaaacttccaaggatga

SEQ ID NO: 167513 - DNA, 20 bp, Artificial Sequence
  chemically synthesized
atgccaaccatcatccttgg

SEQ ID NO: 167514 - DNA, 20 bp, Artificial Sequence
  chemically synthesized
ctacaaatgtgaaacttcca

SEQ ID NO: 167515 - DNA, 20 bp, Artificial Sequence
  chemically synthesized
tctacaaatgtgaaacttcc

SEQ ID NO: 167516 - DNA, 20 bp, Artificial Sequence
  chemically synthesized
ccttggaagtttcacatttg

SEQ ID NO: 167517 - DNA, 20 bp, Artificial Sequence
  chemically synthesized
cattgttggatggattaagg

SEQ ID NO: 167518 - DNA, 20 bp, Artificial Sequence
  chemically synthesized
tagcattgttggatggatta

SEQ ID NO: 167519 - DNA, 20 bp, Artificial Sequence
  chemically synthesized
gtagcattgttggatggatt

SEQ ID NO: 167520 - DNA, 20 bp, Artificial Sequence
  chemically synthesized
tatgtcgtagcattgttgga

SEQ ID NO: 167521 - DNA, 20 bp, Artificial Sequence
  chemically synthesized
tatctatgtcgtagcattgt

SEQ ID NO: 167522 - DNA, 20 bp, Artificial Sequence
  chemically synthesized
catccaacaatgctacgaca

SEQ ID NO: 167523 - DNA, 20 bp, Artificial Sequence
  chemically synthesized
tcataataatatctatgtcg

SEQ ID NO: 167524 - DNA, 20 bp, Artificial Sequence
  chemically synthesized
catcacccatgtgtgatagt

SEQ ID NO: 167525 - DNA, 20 bp, Artificial Sequence
  chemically synthesized
tcatcacccatgtgtgatag

SEQ ID NO: 167526 - DNA, 20 bp, Artificial Sequence
  chemically synthesized
tatgatcccactatcacaca

SEQ ID NO: 167527 - DNA, 20 bp, Artificial Sequence
  chemically synthesized
acgtcatcacccatgtgtga

SEQ ID NO: 167528 - DNA, 20 bp, Artificial Sequence
  chemically synthesized
atgatcccactatcacacat

SEQ ID NO: 167529 - DNA, 20 bp, Artificial Sequence
  chemically synthesized
tcacacatgggtgatgacgt

SEQ ID NO: 167530 - DNA, 20 bp, Artificial Sequence
  chemically synthesized
cacacatgggtgatgacgtt

SEQ ID NO: 167531 - DNA, 20 bp, Artificial Sequence
  chemically synthesized
acacatgggtgatgacgttg

SEQ ID NO: 167532 - DNA, 20 bp, Artificial Sequence
  chemically synthesized
gggttgaaaaaaacattaaa

SEQ ID NO: 167533 - DNA, 20 bp, Artificial Sequence
  chemically synthesized
ggttgaaaaaaacattaaat

SEQ ID NO: 167534 - DNA, 20 bp, Artificial Sequence
  chemically synthesized
gaaaaaaacattaaataggt

SEQ ID NO: 167535 - DNA, 20 bp, Artificial Sequence
  chemically synthesized
aaaaaaacattaaataggtt

SEQ ID NO: 167536 - DNA, 20 bp, Artificial Sequence
  chemically synthesized
aaaacattaaataggttagg

SEQ ID NO: 167537 - DNA, 20 bp, Artificial Sequence
  chemically synthesized
acattaaataggttaggaag

SEQ ID NO: 167538 - DNA, 20 bp, Artificial Sequence
  chemically synthesized
ggttaggaagcagcatgaca

SEQ ID NO: 167539 - DNA, 20 bp, Artificial Sequence
  chemically synthesized
aagcagcatgacatggtatt

SEQ ID NO: 167540 - DNA, 20 bp, Artificial Sequence
  chemically synthesized
gacatggtattaagcattgt

SEQ ID NO: 167541 - DNA, 20 bp, Artificial Sequence
  chemically synthesized
acatggtattaagcattgtg

SEQ ID NO: 167542 - DNA, 20 bp, Artificial Sequence
  chemically synthesized
gtattaagcattgtgaggtc

SEQ ID NO: 167543 - DNA, 20 bp, Artificial Sequence
  chemically synthesized
attaagcattgtgaggtcta

SEQ ID NO: 167544 - DNA, 20 bp, Artificial Sequence
  chemically synthesized
agcattgtgaggtctagagt

SEQ ID NO: 167545 - DNA, 20 bp, Artificial Sequence
  chemically synthesized
gcattgtgaggtctagagtt

SEQ ID NO: 167546 - DNA, 20 bp, Artificial Sequence
  chemically synthesized
aaatccaagtggcctaactc

SEQ ID NO: 167547 - DNA, 20 bp, Artificial Sequence
  chemically synthesized
aggtctagagttaggccact

SEQ ID NO: 167548 - DNA, 20 bp, Artificial Sequence
  chemically synthesized
aaccagaattgaaatccaag

SEQ ID NO: 167549 - DNA, 20 bp, Artificial Sequence
  chemically synthesized
tagaaccagaattgaaatcc

SEQ ID NO: 167550 - DNA, 20 bp, Artificial Sequence
  chemically synthesized
ggccacttggatttcaattc

SEQ ID NO: 167551 - DNA, 20 bp, Artificial Sequence
  chemically synthesized
ttggatttcaattctggttc

SEQ ID NO: 167552 - DNA, 20 bp, Artificial Sequence
  chemically synthesized
tgttaggcaagaactagaac

SEQ ID NO: 167553 - DNA, 20 bp, Artificial Sequence
  chemically synthesized
ctaaaatgttaggcaagaac

SEQ ID NO: 167554 - DNA, 20 bp, Artificial Sequence
  chemically synthesized
acttggctaaaatgttaggc

SEQ ID NO: 167555 - DNA, 20 bp, Artificial Sequence
  chemically synthesized
ctagttcttgcctaacattt

SEQ ID NO: 167556 - DNA, 20 bp, Artificial Sequence
  chemically synthesized
gaaaacttggctaaaatgtt

SEQ ID NO: 167557 - DNA, 20 bp, Artificial Sequence
  chemically synthesized
agaaaacttggctaaaatgt

SEQ ID NO: 167558 - DNA, 20 bp, Artificial Sequence
  chemically synthesized
tcttgcctaacattttagcc

SEQ ID NO: 167559 - DNA, 20 bp, Artificial Sequence
  chemically synthesized
attgagagttagagaaaact

SEQ ID NO: 167560 - DNA, 20 bp, Artificial Sequence
  chemically synthesized
agaggaggcattgagagtta

SEQ ID NO: 167561 - DNA, 20 bp, Artificial Sequence
  chemically synthesized
acagaggaggcattgagagt

SEQ ID NO: 167562 - DNA, 20 bp, Artificial Sequence
  chemically synthesized
atctacagaggaggcattga

SEQ ID NO: 167563 - DNA, 20 bp, Artificial Sequence
  chemically synthesized
caatctacagaggaggcatt

SEQ ID NO: 167564 - DNA, 20 bp, Artificial Sequence
  chemically synthesized
aactctcaatgcctcctctg

SEQ ID NO: 167565 - DNA, 20 bp, Artificial Sequence
  chemically synthesized
ttgtccccaatctacagagg

SEQ ID NO: 167566 - DNA, 20 bp, Artificial Sequence
  chemically synthesized
attgtccccaatctacagag

SEQ ID NO: 167567 - DNA, 20 bp, Artificial Sequence
  chemically synthesized
tcattgtccccaatctacag

SEQ ID NO: 167568 - DNA, 20 bp, Artificial Sequence
  chemically synthesized
tcaatgcctcctctgtagat

SEQ ID NO: 167569 - DNA, 20 bp, Artificial Sequence
  chemically synthesized
atcattgtccccaatctaca

SEQ ID NO: 167570 - DNA, 20 bp, Artificial Sequence
  chemically synthesized
caatgcctcctctgtagatt

SEQ ID NO: 167571 - DNA, 20 bp, Artificial Sequence
  chemically synthesized
aatgcctcctctgtagattg

SEQ ID NO: 167572 - DNA, 20 bp, Artificial Sequence
  chemically synthesized
ctatcattgtccccaatcta

SEQ ID NO: 167573 - DNA, 20 bp, Artificial Sequence
  chemically synthesized
ctgtagattggggacaatga

SEQ ID NO: 167574 - DNA, 20 bp, Artificial Sequence
  chemically synthesized
caatgatagcacctgcttca

SEQ ID NO: 167575 - DNA, 20 bp, Artificial Sequence
  chemically synthesized
aatgatagcacctgcttcat

SEQ ID NO: 167576 - DNA, 20 bp, Artificial Sequence
  chemically synthesized
taacagtaatcctatgaagc

SEQ ID NO: 167577 - DNA, 20 bp, Artificial Sequence
  chemically synthesized
ctaacagtaatcctatgaag

SEQ ID NO: 167578 - DNA, 20 bp, Artificial Sequence
  chemically synthesized
gtcctaacagtaatcctatg

SEQ ID NO: 167579 - DNA, 20 bp, Artificial Sequence
  chemically synthesized
ctgcttcataggattactgt

SEQ ID NO: 167580 - DNA, 20 bp, Artificial Sequence
  chemically synthesized
tgcttcataggattactgtt

SEQ ID NO: 167581 - DNA, 20 bp, Artificial Sequence
  chemically synthesized
atgacgttactgagtcctaa

SEQ ID NO: 167582 - DNA, 20 bp, Artificial Sequence
  chemically synthesized
ataggattactgttaggact

SEQ ID NO: 167583 - DNA, 20 bp, Artificial Sequence
  chemically synthesized
tgttcagggatgacgttact

SEQ ID NO: 167584 - DNA, 20 bp, Artificial Sequence
  chemically synthesized
attgctctaaggtatgttca

SEQ ID NO: 167585 - DNA, 20 bp, Artificial Sequence
  chemically synthesized
tattgctctaaggtatgttc

SEQ ID NO: 167586 - DNA, 20 bp, Artificial Sequence
  chemically synthesized
gtattgctctaaggtatgtt

SEQ ID NO: 167587 - DNA, 20 bp, Artificial Sequence
  chemically synthesized
cgtcatccctgaacatacct

SEQ ID NO: 167588 - DNA, 20 bp, Artificial Sequence
  chemically synthesized
tcatccctgaacatacctta

SEQ ID NO: 167589 - DNA, 20 bp, Artificial Sequence
  chemically synthesized
tcatgcagagtattgctcta

SEQ ID NO: 167590 - DNA, 20 bp, Artificial Sequence
  chemically synthesized
atcatgcagagtattgctct

SEQ ID NO: 167591 - DNA, 20 bp, Artificial Sequence
  chemically synthesized
ttgtcattcattatcatgca

SEQ ID NO: 167592 - DNA, 20 bp, Artificial Sequence
  chemically synthesized
tattgtcattcattatcatg

SEQ ID NO: 167593 - DNA, 20 bp, Artificial Sequence
  chemically synthesized
catgataatgaatgacaata

SEQ ID NO: 167594 - DNA, 20 bp, Artificial Sequence
  chemically synthesized
tgaatgacaataaagttatt

SEQ ID NO: 167595 - DNA, 20 bp, Artificial Sequence
  chemically synthesized
atgacaataaagttattaag

SEQ ID NO: 167596 - DNA, 20 bp, Artificial Sequence
  chemically synthesized
acaataaagttattaagtag

SEQ ID NO: 167597 - DNA, 20 bp, Artificial Sequence
  chemically synthesized
agtagcagtgattattgctc

SEQ ID NO: 167598 - DNA, 20 bp, Artificial Sequence
  chemically synthesized
ctttatttacatgtaagctt

SEQ ID NO: 167599 - DNA, 20 bp, Artificial Sequence
  chemically synthesized
ctggctctttatttacatgt

SEQ ID NO: 167600 - DNA, 20 bp, Artificial Sequence
  chemically synthesized
ctcaagcttacatgtaaata

SEQ ID NO: 167601 - DNA, 20 bp, Artificial Sequence
  chemically synthesized
caagcttacatgtaaataaa

SEQ ID NO: 167602 - DNA, 20 bp, Artificial Sequence
  chemically synthesized
cttacatgtaaataaagagc

SEQ ID NO: 167603 - DNA, 20 bp, Artificial Sequence
  chemically synthesized
ttacatgtaaataaagagcc

SEQ ID NO: 167604 - DNA, 20 bp, Artificial Sequence
  chemically synthesized
atgtaaataaagagccagga

SEQ ID NO: 167605 - DNA, 20 bp, Artificial Sequence
  chemically synthesized
tgtaaataaagagccaggat

SEQ ID NO: 167606 - DNA, 20 bp, Artificial Sequence
  chemically synthesized
ctacagtgctcagcctatcc

SEQ ID NO: 167607 - DNA, 20 bp, Artificial Sequence
  chemically synthesized
ataaagagccaggataggct

SEQ ID NO: 167608 - DNA, 20 bp, Artificial Sequence
  chemically synthesized
ccaggataggctgagcactg

SEQ ID NO: 167609 - DNA, 20 bp, Artificial Sequence
  chemically synthesized
caggcaagagctacagtgct

SEQ ID NO: 167610 - DNA, 20 bp, Artificial Sequence
  chemically synthesized
gggattacaggcaagagcta

SEQ ID NO: 167611 - DNA, 20 bp, Artificial Sequence
  chemically synthesized
agtgctgggattacaggcaa

SEQ ID NO: 167612 - DNA, 20 bp, Artificial Sequence
  chemically synthesized
aaagtgctgggattacaggc

SEQ ID NO: 167613 - DNA, 20 bp, Artificial Sequence
  chemically synthesized
gtagctcttgcctgtaatcc

SEQ ID NO: 167614 - DNA, 20 bp, Artificial Sequence
  chemically synthesized
tcccaaagtgctgggattac

SEQ ID NO: 167615 - DNA, 20 bp, Artificial Sequence
  chemically synthesized
ctcccaaagtgctgggatta

SEQ ID NO: 167616 - DNA, 20 bp, Artificial Sequence
  chemically synthesized
tgcctgtaatcccagcactt

SEQ ID NO: 167617 - DNA, 20 bp, Artificial Sequence
  chemically synthesized
cctcagcctcccaaagtgct

SEQ ID NO: 167618 - DNA, 20 bp, Artificial Sequence
  chemically synthesized
gcctgtaatcccagcacttt

SEQ ID NO: 167619 - DNA, 20 bp, Artificial Sequence
  chemically synthesized
gcctcagcctcccaaagtgc

SEQ ID NO: 167620 - DNA, 20 bp, Artificial Sequence
  chemically synthesized
ctgtaatcccagcactttgg

SEQ ID NO: 167621 - DNA, 20 bp, Artificial Sequence
  chemically synthesized
tgtaatcccagcactttggg

SEQ ID NO: 167622 - DNA, 20 bp, Artificial Sequence
  chemically synthesized
cctcctgcctcagcctccca

SEQ ID NO: 167623 - DNA, 20 bp, Artificial Sequence
  chemically synthesized
tcccagcactttgggaggct

SEQ ID NO: 167624 - DNA, 20 bp, Artificial Sequence
  chemically synthesized
cccagcactttgggaggctg

SEQ ID NO: 167625 - DNA, 20 bp, Artificial Sequence
  chemically synthesized
agcactttgggaggctgagg

SEQ ID NO: 167626 - DNA, 20 bp, Artificial Sequence
  chemically synthesized
gcactttgggaggctgaggc

SEQ ID NO: 167627 - DNA, 20 bp, Artificial Sequence
  chemically synthesized
actttgggaggctgaggcag

SEQ ID NO: 167628 - DNA, 20 bp, Artificial Sequence
  chemically synthesized
ctttgggaggctgaggcagg

SEQ ID NO: 167629 - DNA, 20 bp, Artificial Sequence
  chemically synthesized
ctcaagcaatcctcctgcct

SEQ ID NO: 167630 - DNA, 20 bp, Artificial Sequence
  chemically synthesized
ctgaggcaggaggattgctt

SEQ ID NO: 167631 - DNA, 20 bp, Artificial Sequence
  chemically synthesized
gcaggaggattgcttgagcc

SEQ ID NO: 167632 - DNA, 20 bp, Artificial Sequence
  chemically synthesized
caggaggattgcttgagccc

SEQ ID NO: 167633 - DNA, 20 bp, Artificial Sequence
  chemically synthesized
ggcctcgaactcctgggctc

SEQ ID NO: 167634 - DNA, 20 bp, Artificial Sequence
  chemically synthesized
ggaggattgcttgagcccag

SEQ ID NO: 167635 - DNA, 20 bp, Artificial Sequence
  chemically synthesized
caggctggcctcgaactcct

SEQ ID NO: 167636 - DNA, 20 bp, Artificial Sequence
  chemically synthesized
ttgcttgagcccaggagttc

SEQ ID NO: 167637 - DNA, 20 bp, Artificial Sequence
  chemically synthesized
ccaggctggcctcgaactcc

SEQ ID NO: 167638 - DNA, 20 bp, Artificial Sequence
  chemically synthesized
tgcttgagcccaggagttcg

SEQ ID NO: 167639 - DNA, 20 bp, Artificial Sequence
  chemically synthesized
tgagcccaggagttcgaggc

SEQ ID NO: 167640 - DNA, 20 bp, Artificial Sequence
  chemically synthesized
ccaggagttcgaggccagcc

SEQ ID NO: 167641 - DNA, 20 bp, Artificial Sequence
  chemically synthesized
tgttgctatgttgtccaggc

SEQ ID NO: 167642 - DNA, 20 bp, Artificial Sequence
  chemically synthesized
ggagtgttgctatgttgtcc

SEQ ID NO: 167643 - DNA, 20 bp, Artificial Sequence
  chemically synthesized
cgaggccagcctggacaaca

SEQ ID NO: 167644 - DNA, 20 bp, Artificial Sequence
  chemically synthesized
gggagtgttgctatgttgtc

SEQ ID NO: 167645 - DNA, 20 bp, Artificial Sequence
  chemically synthesized
ttttttttttgtagagatgg

SEQ ID NO: 167646 - DNA, 20 bp, Artificial Sequence
  chemically synthesized
tgttttttttttgtagagat

SEQ ID NO: 167647 - DNA, 20 bp, Artificial Sequence
  chemically synthesized
ttgttttttttttgtagaga

SEQ ID NO: 167648 - DNA, 20 bp, Artificial Sequence
  chemically synthesized
ttttttgttttttttttgta

SEQ ID NO: 167649 - DNA, 20 bp, Artificial Sequence
  chemically synthesized
ttttttttgttttttttttg

SEQ ID NO: 167650 - DNA, 20 bp, Artificial Sequence
  chemically synthesized
aacaaaacaaaacaaaaaaa

SEQ ID NO: 167651 - DNA, 20 bp, Artificial Sequence
  chemically synthesized
caaaacaaaacaaaaaaaca

SEQ ID NO: 167652 - DNA, 20 bp, Artificial Sequence
  chemically synthesized
acaaaacaaaaaaacagagc

SEQ ID NO: 167653 - DNA, 20 bp, Artificial Sequence
  chemically synthesized
agctttactcttgtttattc

SEQ ID NO: 167654 - DNA, 20 bp, Artificial Sequence
  chemically synthesized
aaaacagagccagaataaac

SEQ ID NO: 167655 - DNA, 20 bp, Artificial Sequence
  chemically synthesized
aacagagccagaataaacaa

SEQ ID NO: 167656 - DNA, 20 bp, Artificial Sequence
  chemically synthesized
agccagaataaacaagagta

SEQ ID NO: 167657 - DNA, 20 bp, Artificial Sequence
  chemically synthesized
aagagtaaagctattttctt

SEQ ID NO: 167658 - DNA, 20 bp, Artificial Sequence
  chemically synthesized
tcttgatattctgaagaaaa

SEQ ID NO: 167659 - DNA, 20 bp, Artificial Sequence
  chemically synthesized
ttttaactcttgatattctg

SEQ ID NO: 167660 - DNA, 20 bp, Artificial Sequence
  chemically synthesized
gctattttcttcagaatatc

SEQ ID NO: 167661 - DNA, 20 bp, Artificial Sequence
  chemically synthesized
tattttcttcagaatatcaa

SEQ ID NO: 167662 - DNA, 20 bp, Artificial Sequence
  chemically synthesized
agaatatcaagagttaaaac

SEQ ID NO: 167663 - DNA, 20 bp, Artificial Sequence
  chemically synthesized
aagagttaaaactggcatcc

SEQ ID NO: 167664 - DNA, 20 bp, Artificial Sequence
  chemically synthesized
aattctttattctgggatgc

SEQ ID NO: 167665 - DNA, 20 bp, Artificial Sequence
  chemically synthesized
aaaactggcatcccagaata

SEQ ID NO: 167666 - DNA, 20 bp, Artificial Sequence
  chemically synthesized
aagtttaaattctttattct

SEQ ID NO: 167667 - DNA, 20 bp, Artificial Sequence
  chemically synthesized
caagtttaaattctttattc

SEQ ID NO: 167668 - DNA, 20 bp, Artificial Sequence
  chemically synthesized
agaatttaaacttgtaatga

SEQ ID NO: 167669 - DNA, 20 bp, Artificial Sequence
  chemically synthesized
tcgtaaagagctatcattac

SEQ ID NO: 167670 - DNA, 20 bp, Artificial Sequence
  chemically synthesized
ttgtaatgatagctctttac

SEQ ID NO: 167671 - DNA, 20 bp, Artificial Sequence
  chemically synthesized
attgttaatagtctcgtaaa

SEQ ID NO: 167672 - DNA, 20 bp, Artificial Sequence
  chemically synthesized
gtattgttaatagtctcgta

SEQ ID NO: 167673 - DNA, 20 bp, Artificial Sequence
  chemically synthesized
tattacagtggtattgttaa

SEQ ID NO: 167674 - DNA, 20 bp, Artificial Sequence
  chemically synthesized
tgtaatattttgtattacag

SEQ ID NO: 167675 - DNA, 20 bp, Artificial Sequence
  chemically synthesized
cagtgtaatattttgtatta

SEQ ID NO: 167676 - DNA, 20 bp, Artificial Sequence
  chemically synthesized
ataaaattttattcatattg

SEQ ID NO: 167677 - DNA, 20 bp, Artificial Sequence
  chemically synthesized
cataatatattattatggaa

SEQ ID NO: 167678 - DNA, 20 bp, Artificial Sequence
  chemically synthesized
ttattcataatatattatta

SEQ ID NO: 167679 - DNA, 20 bp, Artificial Sequence
  chemically synthesized
taatatattatgaataataa

SEQ ID NO: 167680 - DNA, 20 bp, Artificial Sequence
  chemically synthesized
atatattatgaataataata

SEQ ID NO: 167681 - DNA, 20 bp, Artificial Sequence
  chemically synthesized
tattatgaataataatagag

SEQ ID NO: 167682 - DNA, 20 bp, Artificial Sequence
  chemically synthesized
agaagattttaaaaataaac

SEQ ID NO: 167683 - DNA, 20 bp, Artificial Sequence
  chemically synthesized
tgacacactggtatattatc

SEQ ID NO: 167684 - DNA, 20 bp, Artificial Sequence
  chemically synthesized
aaataaactagataatatac

SEQ ID NO: 167685 - DNA, 20 bp, Artificial Sequence
  chemically synthesized
acattgtttatgtgacacac

SEQ ID NO: 167686 - DNA, 20 bp, Artificial Sequence
  chemically synthesized
ataaacaatgtcacatgctt

SEQ ID NO: 167687 - DNA, 20 bp, Artificial Sequence
  chemically synthesized
tatctaaaacaattgttcca

SEQ ID NO: 167688 - DNA, 20 bp, Artificial Sequence
  chemically synthesized
atgctttggaacaattgttt

SEQ ID NO: 167689 - DNA, 20 bp, Artificial Sequence
  chemically synthesized
gttttagatacttttaaaat

SEQ ID NO: 167690 - DNA, 20 bp, Artificial Sequence
  chemically synthesized
tcattagtgacttattttaa

SEQ ID NO: 167691 - DNA, 20 bp, Artificial Sequence
  chemically synthesized
taaaataagtcactaatgaa

SEQ ID NO: 167692 - DNA, 20 bp, Artificial Sequence
  chemically synthesized
ttaaacaatgtactgttcat

SEQ ID NO: 167693 - DNA, 20 bp, Artificial Sequence
  chemically synthesized
tgaacagtacattgtttaat

SEQ ID NO: 167694 - DNA, 20 bp, Artificial Sequence
  chemically synthesized
tacattgtttaattggatgc

SEQ ID NO: 167695 - DNA, 20 bp, Artificial Sequence
  chemically synthesized
cattgtttaattggatgcaa

SEQ ID NO: 167696 - DNA, 20 bp, Artificial Sequence
  chemically synthesized
gtttaattggatgcaagagt

SEQ ID NO: 167697 - DNA, 20 bp, Artificial Sequence
  chemically synthesized
tttaattggatgcaagagtt

SEQ ID NO: 167698 - DNA, 20 bp, Artificial Sequence
  chemically synthesized
taattggatgcaagagttag

SEQ ID NO: 167699 - DNA, 20 bp, Artificial Sequence
  chemically synthesized
gcaagagttaggagatgaaa

SEQ ID NO: 167700 - DNA, 20 bp, Artificial Sequence
  chemically synthesized
aagagttaggagatgaaaaa

SEQ ID NO: 167701 - DNA, 20 bp, Artificial Sequence
  chemically synthesized
gttaggagatgaaaaagaga

SEQ ID NO: 167702 - DNA, 20 bp, Artificial Sequence
  chemically synthesized
atgaaaaagagaaagttgtc

SEQ ID NO: 167703 - DNA, 20 bp, Artificial Sequence
  chemically synthesized
gaaaaaaatcaattaatgta

SEQ ID NO: 167704 - DNA, 20 bp, Artificial Sequence
  chemically synthesized
cagaaaaatgaattttaaac

SEQ ID NO: 167705 - DNA, 20 bp, Artificial Sequence
  chemically synthesized
gtatacgtaaacaatatgta

SEQ ID NO: 167706 - DNA, 20 bp, Artificial Sequence
  chemically synthesized
acatatatacatgcatttac

SEQ ID NO: 167707 - DNA, 20 bp, Artificial Sequence
  chemically synthesized
atatgttgtgaaaaattcat

SEQ ID NO: 167708 - DNA, 20 bp, Artificial Sequence
  chemically synthesized
aaaaattcatgagactgtat

SEQ ID NO: 167709 - DNA, 20 bp, Artificial Sequence
  chemically synthesized
atgttaatcctttgcttata

SEQ ID NO: 167710 - DNA, 20 bp, Artificial Sequence
  chemically synthesized
ttcatgagactgtataagca

SEQ ID NO: 167711 - DNA, 20 bp, Artificial Sequence
  chemically synthesized
tcatgagactgtataagcaa

SEQ ID NO: 167712 - DNA, 20 bp, Artificial Sequence
  chemically synthesized
ataagcaaaggattaacatc

SEQ ID NO: 167713 - DNA, 20 bp, Artificial Sequence
  chemically synthesized
caaaggattaacatccagcc

SEQ ID NO: 167714 - DNA, 20 bp, Artificial Sequence
  chemically synthesized
aaaggattaacatccagcct

SEQ ID NO: 167715 - DNA, 20 bp, Artificial Sequence
  chemically synthesized
tgacctgcaacagcccaggc

SEQ ID NO: 167716 - DNA, 20 bp, Artificial Sequence
  chemically synthesized
agactgacctgcaacagccc

SEQ ID NO: 167717 - DNA, 20 bp, Artificial Sequence
  chemically synthesized
cagactgacctgcaacagcc

SEQ ID NO: 167718 - DNA, 20 bp, Artificial Sequence
  chemically synthesized
acatccagcctgggctgttg

SEQ ID NO: 167719 - DNA, 20 bp, Artificial Sequence
  chemically synthesized
catccagcctgggctgttgc

SEQ ID NO: 167720 - DNA, 20 bp, Artificial Sequence
  chemically synthesized
agtcccagactgacctgcaa

SEQ ID NO: 167721 - DNA, 20 bp, Artificial Sequence
  chemically synthesized
cagcctgggctgttgcaggt

SEQ ID NO: 167722 - DNA, 20 bp, Artificial Sequence
  chemically synthesized
tgggctgttgcaggtcagtc

SEQ ID NO: 167723 - DNA, 20 bp, Artificial Sequence
  chemically synthesized
gggctgttgcaggtcagtct

SEQ ID NO: 167724 - DNA, 20 bp, Artificial Sequence
  chemically synthesized
tgggagcctagggtcagtcc

SEQ ID NO: 167725 - DNA, 20 bp, Artificial Sequence
  chemically synthesized
ggtcagtctgggactgaccc

SEQ ID NO: 167726 - DNA, 20 bp, Artificial Sequence
  chemically synthesized
gtcagtctgggactgaccct

SEQ ID NO: 167727 - DNA, 20 bp, Artificial Sequence
  chemically synthesized
gtgctgtgggagcctagggt

SEQ ID NO: 167728 - DNA, 20 bp, Artificial Sequence
  chemically synthesized
aacagtgctgtgggagccta

SEQ ID NO: 167729 - DNA, 20 bp, Artificial Sequence
  chemically synthesized
aaacagtgctgtgggagcct

SEQ ID NO: 167730 - DNA, 20 bp, Artificial Sequence
  chemically synthesized
gaaacagtgctgtgggagcc

SEQ ID NO: 167731 - DNA, 20 bp, Artificial Sequence
  chemically synthesized
ggactgaccctaggctccca

SEQ ID NO: 167732 - DNA, 20 bp, Artificial Sequence
  chemically synthesized
ccaaggaaacagtgctgtgg

SEQ ID NO: 167733 - DNA, 20 bp, Artificial Sequence
  chemically synthesized
ttccaaggaaacagtgctgt

SEQ ID NO: 167734 - DNA, 20 bp, Artificial Sequence
  chemically synthesized
tttccaaggaaacagtgctg

SEQ ID NO: 167735 - DNA, 20 bp, Artificial Sequence
  chemically synthesized
ctcccacagcactgtttcct

SEQ ID NO: 167736 - DNA, 20 bp, Artificial Sequence
  chemically synthesized
agttagtgtttccaaggaaa

SEQ ID NO: 167737 - DNA, 20 bp, Artificial Sequence
  chemically synthesized
tcttaaagttagtgtttcca

SEQ ID NO: 167738 - DNA, 20 bp, Artificial Sequence
  chemically synthesized
atcttaaagttagtgtttcc

SEQ ID NO: 167739 - DNA, 20 bp, Artificial Sequence
  chemically synthesized
tccttggaaacactaacttt

SEQ ID NO: 167740 - DNA, 20 bp, Artificial Sequence
  chemically synthesized
tttcccattcatcttaaagt

SEQ ID NO: 167741 - DNA, 20 bp, Artificial Sequence
  chemically synthesized
aacatttcccattcatctta

SEQ ID NO: 167742 - DNA, 20 bp, Artificial Sequence
  chemically synthesized
aacactaactttaagatgaa

SEQ ID NO: 167743 - DNA, 20 bp, Artificial Sequence
  chemically synthesized
acactaactttaagatgaat

SEQ ID NO: 167744 - DNA, 20 bp, Artificial Sequence
  chemically synthesized
ttaagatgaatgggaaatgt

SEQ ID NO: 167745 - DNA, 20 bp, Artificial Sequence
  chemically synthesized
taagatgaatgggaaatgtt

SEQ ID NO: 167746 - DNA, 20 bp, Artificial Sequence
  chemically synthesized
tgaatgggaaatgttgggcc

SEQ ID NO: 167747 - DNA, 20 bp, Artificial Sequence
  chemically synthesized
cagttccacacgacaaagcc

SEQ ID NO: 167748 - DNA, 20 bp, Artificial Sequence
  chemically synthesized
gcagttccacacgacaaagc

SEQ ID NO: 167749 - DNA, 20 bp, Artificial Sequence
  chemically synthesized
ttgggcctggctttgtcgtg

SEQ ID NO: 167750 - DNA, 20 bp, Artificial Sequence
  chemically synthesized
aggtgcagttccacacgaca

SEQ ID NO: 167751 - DNA, 20 bp, Artificial Sequence
  chemically synthesized
acagctcctgcgatgaggtg

SEQ ID NO: 167752 - DNA, 20 bp, Artificial Sequence
  chemically synthesized
tgtggaactgcacctcatcg

SEQ ID NO: 167753 - DNA, 20 bp, Artificial Sequence
  chemically synthesized
gtggaactgcacctcatcgc

SEQ ID NO: 167754 - DNA, 20 bp, Artificial Sequence
  chemically synthesized
aactgacagctcctgcgatg

SEQ ID NO: 167755 - DNA, 20 bp, Artificial Sequence
  chemically synthesized
ggaactgcacctcatcgcag

SEQ ID NO: 167756 - DNA, 20 bp, Artificial Sequence
  chemically synthesized
caactgacagctcctgcgat

SEQ ID NO: 167757 - DNA, 20 bp, Artificial Sequence
  chemically synthesized
cacctcatcgcaggagctgt

SEQ ID NO: 167758 - DNA, 20 bp, Artificial Sequence
  chemically synthesized
tcatcgcaggagctgtcagt

SEQ ID NO: 167759 - DNA, 20 bp, Artificial Sequence
  chemically synthesized
aaggactgtattccaactga

SEQ ID NO: 167760 - DNA, 20 bp, Artificial Sequence
  chemically synthesized
aggagctgtcagttggaata

SEQ ID NO: 167761 - DNA, 20 bp, Artificial Sequence
  chemically synthesized
gtcagttggaatacagtcct

SEQ ID NO: 167762 - DNA, 20 bp, Artificial Sequence
  chemically synthesized
attgtagtcacgtggatcca

SEQ ID NO: 167763 - DNA, 20 bp, Artificial Sequence
  chemically synthesized
cattgtagtcacgtggatcc

SEQ ID NO: 167764 - DNA, 20 bp, Artificial Sequence
  chemically synthesized
tttacaccattgtagtcacg

SEQ ID NO: 167765 - DNA, 20 bp, Artificial Sequence
  chemically synthesized
ttggatccacgtgactacaa

SEQ ID NO: 167766 - DNA, 20 bp, Artificial Sequence
  chemically synthesized
atcagtcttttacaccattg

SEQ ID NO: 167767 - DNA, 20 bp, Artificial Sequence
  chemically synthesized
acgtgactacaatggtgtaa

SEQ ID NO: 167768 - DNA, 20 bp, Artificial Sequence
  chemically synthesized
acaatggtgtaaaagactga

SEQ ID NO: 167769 - DNA, 20 bp, Artificial Sequence
  chemically synthesized
caatggtgtaaaagactgat

SEQ ID NO: 167770 - DNA, 20 bp, Artificial Sequence
  chemically synthesized
ccaccacctgtatttcccat

SEQ ID NO: 167771 - DNA, 20 bp, Artificial Sequence
  chemically synthesized
taaaagactgatgggaaata

SEQ ID NO: 167772 - DNA, 20 bp, Artificial Sequence
  chemically synthesized
aaaagactgatgggaaatac

SEQ ID NO: 167773 - DNA, 20 bp, Artificial Sequence
  chemically synthesized
agactgatgggaaatacagg

SEQ ID NO: 167774 - DNA, 20 bp, Artificial Sequence
  chemically synthesized
ctgatgggaaatacaggtgg

SEQ ID NO: 167775 - DNA, 20 bp, Artificial Sequence
  chemically synthesized
acaggtggtggctcctgttg

SEQ ID NO: 167776 - DNA, 20 bp, Artificial Sequence
  chemically synthesized
caggtggtggctcctgttga

SEQ ID NO: 167777 - DNA, 20 bp, Artificial Sequence
  chemically synthesized
gtgcaggtcaccttcaacag

SEQ ID NO: 167778 - DNA, 20 bp, Artificial Sequence
  chemically synthesized
gtgtgcaggtcaccttcaac

SEQ ID NO: 167779 - DNA, 20 bp, Artificial Sequence
  chemically synthesized
agtgtgcaggtcaccttcaa

SEQ ID NO: 167780 - DNA, 20 bp, Artificial Sequence
  chemically synthesized
atgagaggcaagaagtgtgc

SEQ ID NO: 167781 - DNA, 20 bp, Artificial Sequence
  chemically synthesized
aatgagaggcaagaagtgtg

SEQ ID NO: 167782 - DNA, 20 bp, Artificial Sequence
  chemically synthesized
tgccaggaatgagaggcaag

SEQ ID NO: 167783 - DNA, 20 bp, Artificial Sequence
  chemically synthesized
ggctgccaggaatgagaggc

SEQ ID NO: 167784 - DNA, 20 bp, Artificial Sequence
  chemically synthesized
gaaaggctgccaggaatgag

SEQ ID NO: 167785 - DNA, 20 bp, Artificial Sequence
  chemically synthesized
cacttcttgcctctcattcc

SEQ ID NO: 167786 - DNA, 20 bp, Artificial Sequence
  chemically synthesized
ggaaaggctgccaggaatga

SEQ ID NO: 167787 - DNA, 20 bp, Artificial Sequence
  chemically synthesized
agggaaaggctgccaggaat

SEQ ID NO: 167788 - DNA, 20 bp, Artificial Sequence
  chemically synthesized
ttcttgcctctcattcctgg

SEQ ID NO: 167789 - DNA, 20 bp, Artificial Sequence
  chemically synthesized
ccacacagggaaaggctgcc

SEQ ID NO: 167790 - DNA, 20 bp, Artificial Sequence
  chemically synthesized
cccacacagggaaaggctgc

SEQ ID NO: 167791 - DNA, 20 bp, Artificial Sequence
  chemically synthesized
actctcacccacacagggaa

SEQ ID NO: 167792 - DNA, 20 bp, Artificial Sequence
  chemically synthesized
aactctcacccacacaggga

SEQ ID NO: 167793 - DNA, 20 bp, Artificial Sequence
  chemically synthesized
cctggcagcctttccctgtg

SEQ ID NO: 167794 - DNA, 20 bp, Artificial Sequence
  chemically synthesized
ctggcagcctttccctgtgt

SEQ ID NO: 167795 - DNA, 20 bp, Artificial Sequence
  chemically synthesized
gcccaactctcacccacaca

SEQ ID NO: 167796 - DNA, 20 bp, Artificial Sequence
  chemically synthesized
tgcccaactctcacccacac

SEQ ID NO: 167797 - DNA, 20 bp, Artificial Sequence
  chemically synthesized
cagcctttccctgtgtgggt

SEQ ID NO: 167798 - DNA, 20 bp, Artificial Sequence
  chemically synthesized
ttgcccaactctcacccaca

SEQ ID NO: 167799 - DNA, 20 bp, Artificial Sequence
  chemically synthesized
gcctttccctgtgtgggtga

SEQ ID NO: 167800 - DNA, 20 bp, Artificial Sequence
  chemically synthesized
ttccctgtgtgggtgagagt

SEQ ID NO: 167801 - DNA, 20 bp, Artificial Sequence
  chemically synthesized
tccctgtgtgggtgagagtt

SEQ ID NO: 167802 - DNA, 20 bp, Artificial Sequence
  chemically synthesized
tgtgggtgagagttgggcaa

SEQ ID NO: 167803 - DNA, 20 bp, Artificial Sequence
  chemically synthesized
gggtgagagttgggcaaaag

SEQ ID NO: 167804 - DNA, 20 bp, Artificial Sequence
  chemically synthesized
gcaaaagaagcattgtgttt

SEQ ID NO: 167805 - DNA, 20 bp, Artificial Sequence
  chemically synthesized
aagaagcattgtgtttcaga

SEQ ID NO: 167806 - DNA, 20 bp, Artificial Sequence
  chemically synthesized
gcattgtgtttcagatagca

SEQ ID NO: 167807 - DNA, 20 bp, Artificial Sequence
  chemically synthesized
atatctcaattcatgattca

SEQ ID NO: 167808 - DNA, 20 bp, Artificial Sequence
  chemically synthesized
atgtccatgaatcatgaatt

SEQ ID NO: 167809 - DNA, 20 bp, Artificial Sequence
  chemically synthesized
caaaacacaaatcaagcaaa

SEQ ID NO: 167810 - DNA, 20 bp, Artificial Sequence
  chemically synthesized
cacaaaacacaaatcaagca

SEQ ID NO: 167811 - DNA, 20 bp, Artificial Sequence
  chemically synthesized
gaactcacaaaacacaaatc

SEQ ID NO: 167812 - DNA, 20 bp, Artificial Sequence
  chemically synthesized
ttgcttgatttgtgttttgt

SEQ ID NO: 167813 - DNA, 20 bp, Artificial Sequence
  chemically synthesized
cagcaccacaggtgtagtta

SEQ ID NO: 167814 - DNA, 20 bp, Artificial Sequence
  chemically synthesized
cacatccataactacacctg

SEQ ID NO: 167815 - DNA, 20 bp, Artificial Sequence
  chemically synthesized
agagttcagcaccacaggtg

SEQ ID NO: 167816 - DNA, 20 bp, Artificial Sequence
  chemically synthesized
acacaagagttcagcaccac

SEQ ID NO: 167817 - DNA, 20 bp, Artificial Sequence
  chemically synthesized
cacacaagagttcagcacca

SEQ ID NO: 167818 - DNA, 20 bp, Artificial Sequence
  chemically synthesized
cacacacacacacaagagtt

SEQ ID NO: 167819 - DNA, 20 bp, Artificial Sequence
  chemically synthesized
acacacacacacacacacaa

SEQ ID NO: 167820 - DNA, 20 bp, Artificial Sequence
  chemically synthesized
acacacacacacacacacac

SEQ ID NO: 167821 - DNA, 20 bp, Artificial Sequence
  chemically synthesized
tgtgcacgcacgcgcgcaca

SEQ ID NO: 167822 - DNA, 20 bp, Artificial Sequence
  chemically synthesized
gtgcacgcacgcgcgcacac

SEQ ID NO: 167823 - DNA, 20 bp, Artificial Sequence
  chemically synthesized
gcacacaggtatgtgtgatg

SEQ ID NO: 167824 - DNA, 20 bp, Artificial Sequence
  chemically synthesized
cacacaggtatgtgtgatgt

SEQ ID NO: 167825 - DNA, 20 bp, Artificial Sequence
  chemically synthesized
atcatgtattacagacgtag

SEQ ID NO: 167826 - DNA, 20 bp, Artificial Sequence
  chemically synthesized
agatcatgtattacagacgt

SEQ ID NO: 167827 - DNA, 20 bp, Artificial Sequence
  chemically synthesized
tagatcatgtattacagacg

SEQ ID NO: 167828 - DNA, 20 bp, Artificial Sequence
  chemically synthesized
catcattagatcatgtatta

SEQ ID NO: 167829 - DNA, 20 bp, Artificial Sequence
  chemically synthesized
aaataagttgaggacatcat

SEQ ID NO: 167830 - DNA, 20 bp, Artificial Sequence
  chemically synthesized
aatgcttgaaaaataagttg

SEQ ID NO: 167831 - DNA, 20 bp, Artificial Sequence
  chemically synthesized
aaatgcttgaaaaataagtt

SEQ ID NO: 167832 - DNA, 20 bp, Artificial Sequence
  chemically synthesized
atgtcctcaacttatttttc

SEQ ID NO: 167833 - DNA, 20 bp, Artificial Sequence
  chemically synthesized
ctttaaaatgcttgaaaaat

SEQ ID NO: 167834 - DNA, 20 bp, Artificial Sequence
  chemically synthesized
cttatttttcaagcatttta

SEQ ID NO: 167835 - DNA, 20 bp, Artificial Sequence
  chemically synthesized
ttatttttcaagcattttaa

SEQ ID NO: 167836 - DNA, 20 bp, Artificial Sequence
  chemically synthesized
atttttcaagcattttaaag

SEQ ID NO: 167837 - DNA, 20 bp, Artificial Sequence
  chemically synthesized
tttttcaagcattttaaagg

SEQ ID NO: 167838 - DNA, 20 bp, Artificial Sequence
  chemically synthesized
tccaataaaaataaaatgtt

SEQ ID NO: 167839 - DNA, 20 bp, Artificial Sequence
  chemically synthesized
actaaacattttatttttat

SEQ ID NO: 167840 - DNA, 20 bp, Artificial Sequence
  chemically synthesized
ttggatcattttctactcac

SEQ ID NO: 167841 - DNA, 20 bp, Artificial Sequence
  chemically synthesized
tttttacatctacttgtgag

SEQ ID NO: 167842 - DNA, 20 bp, Artificial Sequence
  chemically synthesized
gatcattttctactcacaag

SEQ ID NO: 167843 - DNA, 20 bp, Artificial Sequence
  chemically synthesized
cgctttttacatctacttgt

SEQ ID NO: 167844 - DNA, 20 bp, Artificial Sequence
  chemically synthesized
tactcacaagtagatgtaaa

SEQ ID NO: 167845 - DNA, 20 bp, Artificial Sequence
  chemically synthesized
tagatgtaaaaagcgtttta

SEQ ID NO: 167846 - DNA, 20 bp, Artificial Sequence
  chemically synthesized
catttagatgttgttagttg

SEQ ID NO: 167847 - DNA, 20 bp, Artificial Sequence
  chemically synthesized
tagaggcatttagatgttgt

SEQ ID NO: 167848 - DNA, 20 bp, Artificial Sequence
  chemically synthesized
cttcagagtctagaggcatt

SEQ ID NO: 167849 - DNA, 20 bp, Artificial Sequence
  chemically synthesized
taacaacatctaaatgcctc

SEQ ID NO: 167850 - DNA, 20 bp, Artificial Sequence
  chemically synthesized
tcagtagcttcagagtctag

SEQ ID NO: 167851 - DNA, 20 bp, Artificial Sequence
  chemically synthesized
ctcagtagcttcagagtcta

SEQ ID NO: 167852 - DNA, 20 bp, Artificial Sequence
  chemically synthesized
ctaaatgcctctagactctg

SEQ ID NO: 167853 - DNA, 20 bp, Artificial Sequence
  chemically synthesized
atctcagtagcttcagagtc

SEQ ID NO: 167854 - DNA, 20 bp, Artificial Sequence
  chemically synthesized
ctattatctcagtagcttca

SEQ ID NO: 167855 - DNA, 20 bp, Artificial Sequence
  chemically synthesized
ggctattatctcagtagctt

SEQ ID NO: 167856 - DNA, 20 bp, Artificial Sequence
  chemically synthesized
ctctagactctgaagctact

SEQ ID NO: 167857 - DNA, 20 bp, Artificial Sequence
  chemically synthesized
tatgatggctattatctcag

SEQ ID NO: 167858 - DNA, 20 bp, Artificial Sequence
  chemically synthesized
ctctgaagctactgagataa

SEQ ID NO: 167859 - DNA, 20 bp, Artificial Sequence
  chemically synthesized
aaatatgatggctattatct

SEQ ID NO: 167860 - DNA, 20 bp, Artificial Sequence
  chemically synthesized
gagattttaggaaaatatga

SEQ ID NO: 167861 - DNA, 20 bp, Artificial Sequence
  chemically synthesized
cgctcagttttagagatttt

SEQ ID NO: 167862 - DNA, 20 bp, Artificial Sequence
  chemically synthesized
tcgctcagttttagagattt

SEQ ID NO: 167863 - DNA, 20 bp, Artificial Sequence
  chemically synthesized
ttcctaaaatctctaaaact

SEQ ID NO: 167864 - DNA, 20 bp, Artificial Sequence
  chemically synthesized
gagttcatcgctcagtttta

SEQ ID NO: 167865 - DNA, 20 bp, Artificial Sequence
  chemically synthesized
aggagttcatcgctcagttt

SEQ ID NO: 167866 - DNA, 20 bp, Artificial Sequence
  chemically synthesized
ataaaaaggagttcatcgct

SEQ ID NO: 167867 - DNA, 20 bp, Artificial Sequence
  chemically synthesized
tttcatgatcagataaaaag

SEQ ID NO: 167868 - DNA, 20 bp, Artificial Sequence
  chemically synthesized
aatttcatgatcagataaaa

SEQ ID NO: 167869 - DNA, 20 bp, Artificial Sequence
  chemically synthesized
caatttcatgatcagataaa

SEQ ID NO: 167870 - DNA, 20 bp, Artificial Sequence
  chemically synthesized
aacgtgaacaatttcatgat

SEQ ID NO: 167871 - DNA, 20 bp, Artificial Sequence
  chemically synthesized
gaaattgttcacgtttcatt

SEQ ID NO: 167872 - DNA, 20 bp, Artificial Sequence
  chemically synthesized
aaattgttcacgtttcattt

SEQ ID NO: 167873 - DNA, 20 bp, Artificial Sequence
  chemically synthesized
ttcatttaggcttcatatat

SEQ ID NO: 167874 - DNA, 20 bp, Artificial Sequence
  chemically synthesized
gatttctgtgcttatatatg

SEQ ID NO: 167875 - DNA, 20 bp, Artificial Sequence
  chemically synthesized
ttaggcttcatatataagca

SEQ ID NO: 167876 - DNA, 20 bp, Artificial Sequence
  chemically synthesized
agtcttagttaaatgttata

SEQ ID NO: 167877 - DNA, 20 bp, Artificial Sequence
  chemically synthesized
aatctgtataacatttaact

SEQ ID NO: 167878 - DNA, 20 bp, Artificial Sequence
  chemically synthesized
taacatttaactaagactgc

SEQ ID NO: 167879 - DNA, 20 bp, Artificial Sequence
  chemically synthesized
gataaggaaaccagcagtct

SEQ ID NO: 167880 - DNA, 20 bp, Artificial Sequence
  chemically synthesized
gaggatgataaggaaaccag

SEQ ID NO: 167881 - DNA, 20 bp, Artificial Sequence
  chemically synthesized
tgggaggatgataaggaaac

SEQ ID NO: 167882 - DNA, 20 bp, Artificial Sequence
  chemically synthesized
gatagtatgggaggatgata

SEQ ID NO: 167883 - DNA, 20 bp, Artificial Sequence
  chemically synthesized
ggatagtatgggaggatgat

SEQ ID NO: 167884 - DNA, 20 bp, Artificial Sequence
  chemically synthesized
caaggaagggatagtatggg

SEQ ID NO: 167885 - DNA, 20 bp, Artificial Sequence
  chemically synthesized
acaaggaagggatagtatgg

SEQ ID NO: 167886 - DNA, 20 bp, Artificial Sequence
  chemically synthesized
ttacaaggaagggatagtat

SEQ ID NO: 167887 - DNA, 20 bp, Artificial Sequence
  chemically synthesized
attacaaggaagggatagta

SEQ ID NO: 167888 - DNA, 20 bp, Artificial Sequence
  chemically synthesized
cctctattacaaggaaggga

SEQ ID NO: 167889 - DNA, 20 bp, Artificial Sequence
  chemically synthesized
tttacctctattacaaggaa

SEQ ID NO: 167890 - DNA, 20 bp, Artificial Sequence
  chemically synthesized
ttttacctctattacaagga

SEQ ID NO: 167891 - DNA, 20 bp, Artificial Sequence
  chemically synthesized
gttttacctctattacaagg

SEQ ID NO: 167892 - DNA, 20 bp, Artificial Sequence
  chemically synthesized
atactatcccttccttgtaa

SEQ ID NO: 167893 - DNA, 20 bp, Artificial Sequence
  chemically synthesized
actatcccttccttgtaata

SEQ ID NO: 167894 - DNA, 20 bp, Artificial Sequence
  chemically synthesized
attgttttacctctattaca

SEQ ID NO: 167895 - DNA, 20 bp, Artificial Sequence
  chemically synthesized
ctatcccttccttgtaatag

SEQ ID NO: 167896 - DNA, 20 bp, Artificial Sequence
  chemically synthesized
aattgttttacctctattac

SEQ ID NO: 167897 - DNA, 20 bp, Artificial Sequence
  chemically synthesized
agaggtaaaacaattcctga

SEQ ID NO: 167898 - DNA, 20 bp, Artificial Sequence
  chemically synthesized
ccattacactgttttctgtc

SEQ ID NO: 167899 - DNA, 20 bp, Artificial Sequence
  chemically synthesized
cccattacactgttttctgt

SEQ ID NO: 167900 - DNA, 20 bp, Artificial Sequence
  chemically synthesized
aaacaattcctgacagaaaa

SEQ ID NO: 167901 - DNA, 20 bp, Artificial Sequence
  chemically synthesized
cctgacagaaaacagtgtaa

SEQ ID NO: 167902 - DNA, 20 bp, Artificial Sequence
  chemically synthesized
ctgacagaaaacagtgtaat

SEQ ID NO: 167903 - DNA, 20 bp, Artificial Sequence
  chemically synthesized
cagaaaacagtgtaatgggt

SEQ ID NO: 167904 - DNA, 20 bp, Artificial Sequence
  chemically synthesized
ggtcagatttgactaatatc

SEQ ID NO: 167905 - DNA, 20 bp, Artificial Sequence
  chemically synthesized
catttcattattccagatat

SEQ ID NO: 167906 - DNA, 20 bp, Artificial Sequence
  chemically synthesized
aagctatcatttcattattc

SEQ ID NO: 167907 - DNA, 20 bp, Artificial Sequence
  chemically synthesized
tatctggaataatgaaatga

SEQ ID NO: 167908 - DNA, 20 bp, Artificial Sequence
  chemically synthesized
atgaaatgatagcttatcat

SEQ ID NO: 167909 - DNA, 20 bp, Artificial Sequence
  chemically synthesized
tgaaaatttcgtctcatgat

SEQ ID NO: 167910 - DNA, 20 bp, Artificial Sequence
  chemically synthesized
ttatcatgagacgaaatttt

SEQ ID NO: 167911 - DNA, 20 bp, Artificial Sequence
  chemically synthesized
cctaaagcaacatcataatt

SEQ ID NO: 167912 - DNA, 20 bp, Artificial Sequence
  chemically synthesized
gcttaattatgatgttgctt

SEQ ID NO: 167913 - DNA, 20 bp, Artificial Sequence
  chemically synthesized
cttaattatgatgttgcttt

SEQ ID NO: 167914 - DNA, 20 bp, Artificial Sequence
  chemically synthesized
gatctgagaggataaaccta

SEQ ID NO: 167915 - DNA, 20 bp, Artificial Sequence
  chemically synthesized
ttgctttaggtttatcctct

SEQ ID NO: 167916 - DNA, 20 bp, Artificial Sequence
  chemically synthesized
tgggaaagacaagatctgag

SEQ ID NO: 167917 - DNA, 20 bp, Artificial Sequence
  chemically synthesized
gtgggaaagacaagatctga

SEQ ID NO: 167918 - DNA, 20 bp, Artificial Sequence
  chemically synthesized
tggtgggaaagacaagatct

SEQ ID NO: 167919 - DNA, 20 bp, Artificial Sequence
  chemically synthesized
gttatgatggtgggaaagac

SEQ ID NO: 167920 - DNA, 20 bp, Artificial Sequence
  chemically synthesized
taaatgttatgatggtggga

SEQ ID NO: 167921 - DNA, 20 bp, Artificial Sequence
  chemically synthesized
gaggtaaatgttatgatggt

SEQ ID NO: 167922 - DNA, 20 bp, Artificial Sequence
  chemically synthesized
tgaggtaaatgttatgatgg

SEQ ID NO: 167923 - DNA, 20 bp, Artificial Sequence
  chemically synthesized
gcatgaggtaaatgttatga

SEQ ID NO: 167924 - DNA, 20 bp, Artificial Sequence
  chemically synthesized
atagaaagttaaatagcatg

SEQ ID NO: 167925 - DNA, 20 bp, Artificial Sequence
  chemically synthesized
aatagaaagttaaatagcat

SEQ ID NO: 167926 - DNA, 20 bp, Artificial Sequence
  chemically synthesized
aatgtaaatagaaagttaaa

SEQ ID NO: 167927 - DNA, 20 bp, Artificial Sequence
  chemically synthesized
gaaggagcaatgtaaataga

SEQ ID NO: 167928 - DNA, 20 bp, Artificial Sequence
  chemically synthesized
gtgagaaggagcaatgtaaa

SEQ ID NO: 167929 - DNA, 20 bp, Artificial Sequence
  chemically synthesized
aatcaaaggtcagtgagaag

SEQ ID NO: 167930 - DNA, 20 bp, Artificial Sequence
  chemically synthesized
gaaatcaaaggtcagtgaga

SEQ ID NO: 167931 - DNA, 20 bp, Artificial Sequence
  chemically synthesized
agaaatcaaaggtcagtgag

SEQ ID NO: 167932 - DNA, 20 bp, Artificial Sequence
  chemically synthesized
cccagaaatcaaaggtcagt

SEQ ID NO: 167933 - DNA, 20 bp, Artificial Sequence
  chemically synthesized
ttgacccagaaatcaaaggt

SEQ ID NO: 167934 - DNA, 20 bp, Artificial Sequence
  chemically synthesized
ttgtttgacccagaaatcaa

SEQ ID NO: 167935 - DNA, 20 bp, Artificial Sequence
  chemically synthesized
tctcactgacctttgatttc

SEQ ID NO: 167936 - DNA, 20 bp, Artificial Sequence
  chemically synthesized
cttgtttgacccagaaatca

SEQ ID NO: 167937 - DNA, 20 bp, Artificial Sequence
  chemically synthesized
ctcactgacctttgatttct

SEQ ID NO: 167938 - DNA, 20 bp, Artificial Sequence
  chemically synthesized
ggaacagagcttgtttgacc

SEQ ID NO: 167939 - DNA, 20 bp, Artificial Sequence
  chemically synthesized
ctttgatttctgggtcaaac

SEQ ID NO: 167940 - DNA, 20 bp, Artificial Sequence
  chemically synthesized
gtccatcatatttaggaaca

SEQ ID NO: 167941 - DNA, 20 bp, Artificial Sequence
  chemically synthesized
aggtccatcatatttaggaa

SEQ ID NO: 167942 - DNA, 20 bp, Artificial Sequence
  chemically synthesized
ggtgaaggtccatcatattt

SEQ ID NO: 167943 - DNA, 20 bp, Artificial Sequence
  chemically synthesized
agctctgttcctaaatatga

SEQ ID NO: 167944 - DNA, 20 bp, Artificial Sequence
  chemically synthesized
tggtgaaggtccatcatatt

SEQ ID NO: 167945 - DNA, 20 bp, Artificial Sequence
  chemically synthesized
atatgatggaccttcaccaa

SEQ ID NO: 167946 - DNA, 20 bp, Artificial Sequence
  chemically synthesized
ttttaacaaacttttggtga

SEQ ID NO: 167947 - DNA, 20 bp, Artificial Sequence
  chemically synthesized
tttttaacaaacttttggtg

SEQ ID NO: 167948 - DNA, 20 bp, Artificial Sequence
  chemically synthesized
aattgtttttaacaaacttt

SEQ ID NO: 167949 - DNA, 20 bp, Artificial Sequence
  chemically synthesized
ttaaaaacaatttccaaatt

SEQ ID NO: 167950 - DNA, 20 bp, Artificial Sequence
  chemically synthesized
taaaaacaatttccaaattc

SEQ ID NO: 167951 - DNA, 20 bp, Artificial Sequence
  chemically synthesized
aaaaataataatcctgaatt

SEQ ID NO: 167952 - DNA, 20 bp, Artificial Sequence
  chemically synthesized
gattattattttttcaatgt

SEQ ID NO: 167953 - DNA, 20 bp, Artificial Sequence
  chemically synthesized
tattattttttcaatgtaag

SEQ ID NO: 167954 - DNA, 20 bp, Artificial Sequence
  chemically synthesized
tattttttcaatgtaagaag

SEQ ID NO: 167955 - DNA, 20 bp, Artificial Sequence
  chemically synthesized
taagaagcagtatatgtcta

SEQ ID NO: 167956 - DNA, 20 bp, Artificial Sequence
  chemically synthesized
gaagcagtatatgtctatag

SEQ ID NO: 167957 - DNA, 20 bp, Artificial Sequence
  chemically synthesized
ttttttgtggttgactacta

SEQ ID NO: 167958 - DNA, 20 bp, Artificial Sequence
  chemically synthesized
atacaatttacatttttttg

SEQ ID NO: 167959 - DNA, 20 bp, Artificial Sequence
  chemically synthesized
aaaatgtaaattgtatcctc

SEQ ID NO: 167960 - DNA, 20 bp, Artificial Sequence
  chemically synthesized
aattaaagttatttaacttg

SEQ ID NO: 167961 - DNA, 20 bp, Artificial Sequence
  chemically synthesized
taattaaagttatttaactt

SEQ ID NO: 167962 - DNA, 20 bp, Artificial Sequence
  chemically synthesized
agttaaataactttaattaa

SEQ ID NO: 167963 - DNA, 20 bp, Artificial Sequence
  chemically synthesized
atatttttgtctgttaatta

SEQ ID NO: 167964 - DNA, 20 bp, Artificial Sequence
  chemically synthesized
taattaacagacaaaaatat

SEQ ID NO: 167965 - DNA, 20 bp, Artificial Sequence
  chemically synthesized
agacaaaaatatcagtaaac

SEQ ID NO: 167966 - DNA, 20 bp, Artificial Sequence
  chemically synthesized
ttttgattttttatatagtc

SEQ ID NO: 167967 - DNA, 20 bp, Artificial Sequence
  chemically synthesized
gaagcttttgattttttata

SEQ ID NO: 167968 - DNA, 20 bp, Artificial Sequence
  chemically synthesized
tggactatataaaaaatcaa

SEQ ID NO: 167969 - DNA, 20 bp, Artificial Sequence
  chemically synthesized
tggctcttttggtcgtgcag

SEQ ID NO: 167970 - DNA, 20 bp, Artificial Sequence
  chemically synthesized
ctatggctcttttggtcgtg

SEQ ID NO: 167971 - DNA, 20 bp, Artificial Sequence
  chemically synthesized
aaaagcttctgcacgaccaa

SEQ ID NO: 167972 - DNA, 20 bp, Artificial Sequence
  chemically synthesized
aagcttctgcacgaccaaaa

SEQ ID NO: 167973 - DNA, 20 bp, Artificial Sequence
  chemically synthesized
gattttgcctatggctcttt

SEQ ID NO: 167974 - DNA, 20 bp, Artificial Sequence
  chemically synthesized
ctgcacgaccaaaagagcca

SEQ ID NO: 167975 - DNA, 20 bp, Artificial Sequence
  chemically synthesized
tgcacgaccaaaagagccat

SEQ ID NO: 167976 - DNA, 20 bp, Artificial Sequence
  chemically synthesized
tttgtttttgattttgccta

SEQ ID NO: 167977 - DNA, 20 bp, Artificial Sequence
  chemically synthesized
gtcccttagacatgagtcac

SEQ ID NO: 167978 - DNA, 20 bp, Artificial Sequence
  chemically synthesized
aatgcttgtgactcatgtct

SEQ ID NO: 167979 - DNA, 20 bp, Artificial Sequence
  chemically synthesized
atgcttgtgactcatgtcta

SEQ ID NO: 167980 - DNA, 20 bp, Artificial Sequence
  chemically synthesized
aaaattagtcccttagacat

SEQ ID NO: 167981 - DNA, 20 bp, Artificial Sequence
  chemically synthesized
tgcttgtgactcatgtctaa

SEQ ID NO: 167982 - DNA, 20 bp, Artificial Sequence
  chemically synthesized
tgttaggaaaattagtccct

SEQ ID NO: 167983 - DNA, 20 bp, Artificial Sequence
  chemically synthesized
ctttcatgtgttaggaaaat

SEQ ID NO: 167984 - DNA, 20 bp, Artificial Sequence
  chemically synthesized
cagaaggtctttcatgtgtt

SEQ ID NO: 167985 - DNA, 20 bp, Artificial Sequence
  chemically synthesized
gcagaaggtctttcatgtgt

SEQ ID NO: 167986 - DNA, 20 bp, Artificial Sequence
  chemically synthesized
ctaattttcctaacacatga

SEQ ID NO: 167987 - DNA, 20 bp, Artificial Sequence
  chemically synthesized
cacatgaaagaccttctgca

SEQ ID NO: 167988 - DNA, 20 bp, Artificial Sequence
  chemically synthesized
ttttcttattactttgcaga

SEQ ID NO: 167989 - DNA, 20 bp, Artificial Sequence
  chemically synthesized
tttttcttattactttgcag

SEQ ID NO: 167990 - DNA, 20 bp, Artificial Sequence
  chemically synthesized
gcctttttcttattactttg

SEQ ID NO: 167991 - DNA, 20 bp, Artificial Sequence
  chemically synthesized
aagaccttctgcaaagtaat

SEQ ID NO: 167992 - DNA, 20 bp, Artificial Sequence
  chemically synthesized
ttctgcaaagtaataagaaa

SEQ ID NO: 167993 - DNA, 20 bp, Artificial Sequence
  chemically synthesized
tctgcaaagtaataagaaaa

SEQ ID NO: 167994 - DNA, 20 bp, Artificial Sequence
  chemically synthesized
ccaattttcttttgggttgt

SEQ ID NO: 167995 - DNA, 20 bp, Artificial Sequence
  chemically synthesized
gaaaaaggccaacaacccaa

SEQ ID NO: 167996 - DNA, 20 bp, Artificial Sequence
  chemically synthesized
cttttgtccaattttctttt

SEQ ID NO: 167997 - DNA, 20 bp, Artificial Sequence
  chemically synthesized
tcttttgtccaattttcttt

SEQ ID NO: 167998 - DNA, 20 bp, Artificial Sequence
  chemically synthesized
ccaacaacccaaaagaaaat

SEQ ID NO: 167999 - DNA, 20 bp, Artificial Sequence
  chemically synthesized
cccaaaagaaaattggacaa

SEQ ID NO: 168000 - DNA, 20 bp, Artificial Sequence
  chemically synthesized
aagaaaattggacaaaagat

SEQ ID NO: 168001 - DNA, 20 bp, Artificial Sequence
  chemically synthesized
agaaaattggacaaaagata

SEQ ID NO: 168002 - DNA, 20 bp, Artificial Sequence
  chemically synthesized
aattggacaaaagataagga

SEQ ID NO: 168003 - DNA, 20 bp, Artificial Sequence
  chemically synthesized
caaaagataaggacagttca

SEQ ID NO: 168004 - DNA, 20 bp, Artificial Sequence
  chemically synthesized
gataaggacagttcacagaa

SEQ ID NO: 168005 - DNA, 20 bp, Artificial Sequence
  chemically synthesized
ttcacagaaaagaaaataca

SEQ ID NO: 168006 - DNA, 20 bp, Artificial Sequence
  chemically synthesized
tcacagaaaagaaaatacaa

SEQ ID NO: 168007 - DNA, 20 bp, Artificial Sequence
  chemically synthesized
gaaaatacaaaggattttaa

SEQ ID NO: 168008 - DNA, 20 bp, Artificial Sequence
  chemically synthesized
aaggattttaaaagcatgaa

SEQ ID NO: 168009 - DNA, 20 bp, Artificial Sequence
  chemically synthesized
gattttaaaagcatgaacag

SEQ ID NO: 168010 - DNA, 20 bp, Artificial Sequence
  chemically synthesized
taaaagcatgaacagaagct

SEQ ID NO: 168011 - DNA, 20 bp, Artificial Sequence
  chemically synthesized
catgaacagaagcttagcct

SEQ ID NO: 168012 - DNA, 20 bp, Artificial Sequence
  chemically synthesized
ctctcattattaccaaggct

SEQ ID NO: 168013 - DNA, 20 bp, Artificial Sequence
  chemically synthesized
catttctctcattattacca

SEQ ID NO: 168014 - DNA, 20 bp, Artificial Sequence
  chemically synthesized
tcatttctctcattattacc

SEQ ID NO: 168015 - DNA, 20 bp, Artificial Sequence
  chemically synthesized
agcttagccttggtaataat

SEQ ID NO: 168016 - DNA, 20 bp, Artificial Sequence
  chemically synthesized
cttagccttggtaataatga

SEQ ID NO: 168017 - DNA, 20 bp, Artificial Sequence
  chemically synthesized
ataatgagagaaatgaaaat

SEQ ID NO: 168018 - DNA, 20 bp, Artificial Sequence
  chemically synthesized
aatgagagaaatgaaaatta

SEQ ID NO: 168019 - DNA, 20 bp, Artificial Sequence
  chemically synthesized
ttttgccagtgcaatagatg

SEQ ID NO: 168020 - DNA, 20 bp, Artificial Sequence
  chemically synthesized
tagagcttcatctattgcac

SEQ ID NO: 168021 - DNA, 20 bp, Artificial Sequence
  chemically synthesized
ttgaatttttgccagtgcaa

SEQ ID NO: 168022 - DNA, 20 bp, Artificial Sequence
  chemically synthesized
ctgcagacttgaatttttgc

SEQ ID NO: 168023 - DNA, 20 bp, Artificial Sequence
  chemically synthesized
tattgcactggcaaaaattc

SEQ ID NO: 168024 - DNA, 20 bp, Artificial Sequence
  chemically synthesized
ctggcaaaaattcaagtctg

SEQ ID NO: 168025 - DNA, 20 bp, Artificial Sequence
  chemically synthesized
tggcaaaaattcaagtctgc

SEQ ID NO: 168026 - DNA, 20 bp, Artificial Sequence
  chemically synthesized
ttggcagcatagtgtacctg

SEQ ID NO: 168027 - DNA, 20 bp, Artificial Sequence
  chemically synthesized
tgcaggtacactatgctgcc

SEQ ID NO: 168028 - DNA, 20 bp, Artificial Sequence
  chemically synthesized
ttcccacagccttggcagca

SEQ ID NO: 168029 - DNA, 20 bp, Artificial Sequence
  chemically synthesized
gcaggtacactatgctgcca

SEQ ID NO: 168030 - DNA, 20 bp, Artificial Sequence
  chemically synthesized
gcattttcccacagccttgg

SEQ ID NO: 168031 - DNA, 20 bp, Artificial Sequence
  chemically synthesized
acactatgctgccaaggctg

SEQ ID NO: 168032 - DNA, 20 bp, Artificial Sequence
  chemically synthesized
cactatgctgccaaggctgt

SEQ ID NO: 168033 - DNA, 20 bp, Artificial Sequence
  chemically synthesized
tctgcattttcccacagcct

SEQ ID NO: 168034 - DNA, 20 bp, Artificial Sequence
  chemically synthesized
gaagagtctgcattttccca

SEQ ID NO: 168035 - DNA, 20 bp, Artificial Sequence
  chemically synthesized
gccaaggctgtgggaaaatg

SEQ ID NO: 168036 - DNA, 20 bp, Artificial Sequence
  chemically synthesized
aaaatgcagactcttctacg

SEQ ID NO: 168037 - DNA, 20 bp, Artificial Sequence
  chemically synthesized
ttcccaccagccacgtagaa

SEQ ID NO: 168038 - DNA, 20 bp, Artificial Sequence
  chemically synthesized
acttcccaccagccacgtag

SEQ ID NO: 168039 - DNA, 20 bp, Artificial Sequence
  chemically synthesized
tgcagactcttctacgtggc

SEQ ID NO: 168040 - DNA, 20 bp, Artificial Sequence
  chemically synthesized
tatacttcccaccagccacg

SEQ ID NO: 168041 - DNA, 20 bp, Artificial Sequence
  chemically synthesized
agactcttctacgtggctgg

SEQ ID NO: 168042 - DNA, 20 bp, Artificial Sequence
  chemically synthesized
gactcttctacgtggctggt

SEQ ID NO: 168043 - DNA, 20 bp, Artificial Sequence
  chemically synthesized
tcttctacgtggctggtggg

SEQ ID NO: 168044 - DNA, 20 bp, Artificial Sequence
  chemically synthesized
cacaaatgtatacttcccac

SEQ ID NO: 168045 - DNA, 20 bp, Artificial Sequence
  chemically synthesized
atacatttgtgtacctcttg

SEQ ID NO: 168046 - DNA, 20 bp, Artificial Sequence
  chemically synthesized
catttgtgtacctcttgtgg

SEQ ID NO: 168047 - DNA, 20 bp, Artificial Sequence
  chemically synthesized
gccaaactgccttccacaag

SEQ ID NO: 168048 - DNA, 20 bp, Artificial Sequence
  chemically synthesized
atttgtgtacctcttgtgga

SEQ ID NO: 168049 - DNA, 20 bp, Artificial Sequence
  chemically synthesized
ggccaaactgccttccacaa

SEQ ID NO: 168050 - DNA, 20 bp, Artificial Sequence
  chemically synthesized
atggccaaactgccttccac

SEQ ID NO: 168051 - DNA, 20 bp, Artificial Sequence
  chemically synthesized
tgtgtacctcttgtggaagg

SEQ ID NO: 168052 - DNA, 20 bp, Artificial Sequence
  chemically synthesized
acctcttgtggaaggcagtt

SEQ ID NO: 168053 - DNA, 20 bp, Artificial Sequence
  chemically synthesized
ttacatgctttttatagata

SEQ ID NO: 168054 - DNA, 20 bp, Artificial Sequence
  chemically synthesized
agtttggccatatctataaa

SEQ ID NO: 168055 - DNA, 20 bp, Artificial Sequence
  chemically synthesized
caaagtttacatgcttttta

SEQ ID NO: 168056 - DNA, 20 bp, Artificial Sequence
  chemically synthesized
aaagcatgtaaactttgacc

SEQ ID NO: 168057 - DNA, 20 bp, Artificial Sequence
  chemically synthesized
ggaataaaatttccaggtca

SEQ ID NO: 168058 - DNA, 20 bp, Artificial Sequence
  chemically synthesized
ttcctgggaataaaatttcc

SEQ ID NO: 168059 - DNA, 20 bp, Artificial Sequence
  chemically synthesized
attcctgggaataaaatttc

SEQ ID NO: 168060 - DNA, 20 bp, Artificial Sequence
  chemically synthesized
tgacctggaaattttattcc

SEQ ID NO: 168061 - DNA, 20 bp, Artificial Sequence
  chemically synthesized
gacctggaaattttattccc

SEQ ID NO: 168062 - DNA, 20 bp, Artificial Sequence
  chemically synthesized
aatctacaaaataaattcct

SEQ ID NO: 168063 - DNA, 20 bp, Artificial Sequence
  chemically synthesized
aaatctacaaaataaattcc

SEQ ID NO: 168064 - DNA, 20 bp, Artificial Sequence
  chemically synthesized
attcccaggaatttattttg

SEQ ID NO: 168065 - DNA, 20 bp, Artificial Sequence
  chemically synthesized
ttattttgtagatttgtttc

SEQ ID NO: 168066 - DNA, 20 bp, Artificial Sequence
  chemically synthesized
gtagatttgtttctagaatt

SEQ ID NO: 168067 - DNA, 20 bp, Artificial Sequence
  chemically synthesized
tagatttgtttctagaatta

SEQ ID NO: 168068 - DNA, 20 bp, Artificial Sequence
  chemically synthesized
ctgcacattaaccttaattc

SEQ ID NO: 168069 - DNA, 20 bp, Artificial Sequence
  chemically synthesized
ctagaattaaggttaatgtg

SEQ ID NO: 168070 - DNA, 20 bp, Artificial Sequence
  chemically synthesized
aattaaggttaatgtgcagt

SEQ ID NO: 168071 - DNA, 20 bp, Artificial Sequence
  chemically synthesized
attaaggttaatgtgcagtg

SEQ ID NO: 168072 - DNA, 20 bp, Artificial Sequence
  chemically synthesized
ttaaggttaatgtgcagtga

SEQ ID NO: 168073 - DNA, 20 bp, Artificial Sequence
  chemically synthesized
aggttaatgtgcagtgaggg

SEQ ID NO: 168074 - DNA, 20 bp, Artificial Sequence
  chemically synthesized
gttaatgtgcagtgagggta

SEQ ID NO: 168075 - DNA, 20 bp, Artificial Sequence
  chemically synthesized
aatgtgcagtgagggtagag

SEQ ID NO: 168076 - DNA, 20 bp, Artificial Sequence
  chemically synthesized
agtgagggtagagcagatga

SEQ ID NO: 168077 - DNA, 20 bp, Artificial Sequence
  chemically synthesized
gtgagggtagagcagatgat

SEQ ID NO: 168078 - DNA, 20 bp, Artificial Sequence
  chemically synthesized
agggtagagcagatgatggg

SEQ ID NO: 168079 - DNA, 20 bp, Artificial Sequence
  chemically synthesized
gggtagagcagatgatgggt

SEQ ID NO: 168080 - DNA, 20 bp, Artificial Sequence
  chemically synthesized
ggtagagcagatgatgggta

SEQ ID NO: 168081 - DNA, 20 bp, Artificial Sequence
  chemically synthesized
gagcagatgatgggtagggt

SEQ ID NO: 168082 - DNA, 20 bp, Artificial Sequence
  chemically synthesized
tgttcaaaatataaaaggta

SEQ ID NO: 168083 - DNA, 20 bp, Artificial Sequence
  chemically synthesized
tacattgttcaaaatataaa

SEQ ID NO: 168084 - DNA, 20 bp, Artificial Sequence
  chemically synthesized
ttacattgttcaaaatataa

SEQ ID NO: 168085 - DNA, 20 bp, Artificial Sequence
  chemically synthesized
atgtaaatgcattactgtat

SEQ ID NO: 168086 - DNA, 20 bp, Artificial Sequence
  chemically synthesized
agtgtgagagcagactaata

SEQ ID NO: 168087 - DNA, 20 bp, Artificial Sequence
  chemically synthesized
ctttgttaacagtgtgagag

SEQ ID NO: 168088 - DNA, 20 bp, Artificial Sequence
  chemically synthesized
tgtctttgttaacagtgtga

SEQ ID NO: 168089 - DNA, 20 bp, Artificial Sequence
  chemically synthesized
tatgtctttgttaacagtgt

SEQ ID NO: 168090 - DNA, 20 bp, Artificial Sequence
  chemically synthesized
ctgctctcacactgttaaca

SEQ ID NO: 168091 - DNA, 20 bp, Artificial Sequence
  chemically synthesized
ctcagatatgtctttgttaa

SEQ ID NO: 168092 - DNA, 20 bp, Artificial Sequence
  chemically synthesized
ctgttaacaaagacatatct

SEQ ID NO: 168093 - DNA, 20 bp, Artificial Sequence
  chemically synthesized
aacaaagacatatctgagac

SEQ ID NO: 168094 - DNA, 20 bp, Artificial Sequence
  chemically synthesized
acaaagacatatctgagact

SEQ ID NO: 168095 - DNA, 20 bp, Artificial Sequence
  chemically synthesized
ctttataaatcacccagtct

SEQ ID NO: 168096 - DNA, 20 bp, Artificial Sequence
  chemically synthesized
tctttcctttataaatcacc

SEQ ID NO: 168097 - DNA, 20 bp, Artificial Sequence
  chemically synthesized
ctgagactgggtgatttata

SEQ ID NO: 168098 - DNA, 20 bp, Artificial Sequence
  chemically synthesized
tgagactgggtgatttataa

SEQ ID NO: 168099 - DNA, 20 bp, Artificial Sequence
  chemically synthesized
actgggtgatttataaagga

SEQ ID NO: 168100 - DNA, 20 bp, Artificial Sequence
  chemically synthesized
tgggtgatttataaaggaaa

SEQ ID NO: 168101 - DNA, 20 bp, Artificial Sequence
  chemically synthesized
gggtgatttataaaggaaag

SEQ ID NO: 168102 - DNA, 20 bp, Artificial Sequence
  chemically synthesized
tataaaggaaagaggtttaa

SEQ ID NO: 168103 - DNA, 20 bp, Artificial Sequence
  chemically synthesized
cccccgccatgtagaatggt

SEQ ID NO: 168104 - DNA, 20 bp, Artificial Sequence
  chemically synthesized
aatggactcaccattctaca

SEQ ID NO: 168105 - DNA, 20 bp, Artificial Sequence
  chemically synthesized
cccccccccgccatgtagaa

SEQ ID NO: 168106 - DNA, 20 bp, Artificial Sequence
  chemically synthesized
ggactcaccattctacatgg

SEQ ID NO: 168107 - DNA, 20 bp, Artificial Sequence
  chemically synthesized
gactcaccattctacatggc

SEQ ID NO: 168108 - DNA, 20 bp, Artificial Sequence
  chemically synthesized
actcaccattctacatggcg

SEQ ID NO: 168109 - DNA, 20 bp, Artificial Sequence
  chemically synthesized
tgaggcccccccccgccatg

SEQ ID NO: 168110 - DNA, 20 bp, Artificial Sequence
  chemically synthesized
ctcaccattctacatggcgg

SEQ ID NO: 168111 - DNA, 20 bp, Artificial Sequence
  chemically synthesized
tcaccattctacatggcggg

SEQ ID NO: 168112 - DNA, 20 bp, Artificial Sequence
  chemically synthesized
caccattctacatggcgggg

SEQ ID NO: 168113 - DNA, 20 bp, Artificial Sequence
  chemically synthesized
accattctacatggcggggg

SEQ ID NO: 168114 - DNA, 20 bp, Artificial Sequence
  chemically synthesized
ccattctacatggcgggggg

SEQ ID NO: 168115 - DNA, 20 bp, Artificial Sequence
  chemically synthesized
tgccttctgccatgattgtg

SEQ ID NO: 168116 - DNA, 20 bp, Artificial Sequence
  chemically synthesized
gggggggggcctcacaatca

SEQ ID NO: 168117 - DNA, 20 bp, Artificial Sequence
  chemically synthesized
ttgccttctgccatgattgt

SEQ ID NO: 168118 - DNA, 20 bp, Artificial Sequence
  chemically synthesized
ggggggcctcacaatcatgg

SEQ ID NO: 168119 - DNA, 20 bp, Artificial Sequence
  chemically synthesized
gggcctcacaatcatggcag

SEQ ID NO: 168120 - DNA, 20 bp, Artificial Sequence
  chemically synthesized
ggcctcacaatcatggcaga

SEQ ID NO: 168121 - DNA, 20 bp, Artificial Sequence
  chemically synthesized
cacaatcatggcagaaggca

SEQ ID NO: 168122 - DNA, 20 bp, Artificial Sequence
  chemically synthesized
acaatcatggcagaaggcaa

SEQ ID NO: 168123 - DNA, 20 bp, Artificial Sequence
  chemically synthesized
aatcatggcagaaggcaaag

SEQ ID NO: 168124 - DNA, 20 bp, Artificial Sequence
  chemically synthesized
catggcagaaggcaaaggag

SEQ ID NO: 168125 - DNA, 20 bp, Artificial Sequence
  chemically synthesized
aagcaaaaacacattctaca

SEQ ID NO: 168126 - DNA, 20 bp, Artificial Sequence
  chemically synthesized
caaaaacacattctacatgg

SEQ ID NO: 168127 - DNA, 20 bp, Artificial Sequence
  chemically synthesized
ctctcttccctgctgccatg

SEQ ID NO: 168128 - DNA, 20 bp, Artificial Sequence
  chemically synthesized
aaacacattctacatggcag

SEQ ID NO: 168129 - DNA, 20 bp, Artificial Sequence
  chemically synthesized
aacacattctacatggcagc

SEQ ID NO: 168130 - DNA, 20 bp, Artificial Sequence
  chemically synthesized
acacattctacatggcagca

SEQ ID NO: 168131 - DNA, 20 bp, Artificial Sequence
  chemically synthesized
cattctacatggcagcaggg

SEQ ID NO: 168132 - DNA, 20 bp, Artificial Sequence
  chemically synthesized
ttctacatggcagcagggaa

SEQ ID NO: 168133 - DNA, 20 bp, Artificial Sequence
  chemically synthesized
ctacatggcagcagggaaga

SEQ ID NO: 168134 - DNA, 20 bp, Artificial Sequence
  chemically synthesized
agcagggaagagagcttgct

SEQ ID NO: 168135 - DNA, 20 bp, Artificial Sequence
  chemically synthesized
gcagggaagagagcttgctc

SEQ ID NO: 168136 - DNA, 20 bp, Artificial Sequence
  chemically synthesized
cagggaagagagcttgctca

SEQ ID NO: 168137 - DNA, 20 bp, Artificial Sequence
  chemically synthesized
agggaagagagcttgctcag

SEQ ID NO: 168138 - DNA, 20 bp, Artificial Sequence
  chemically synthesized
aaatgtgagttcccctgagc

SEQ ID NO: 168139 - DNA, 20 bp, Artificial Sequence
  chemically synthesized
ttataaatgtgagttcccct

SEQ ID NO: 168140 - DNA, 20 bp, Artificial Sequence
  chemically synthesized
tctgatagttttataaatgt

SEQ ID NO: 168141 - DNA, 20 bp, Artificial Sequence
  chemically synthesized
actcacatttataaaactat

SEQ ID NO: 168142 - DNA, 20 bp, Artificial Sequence
  chemically synthesized
gtaagtttcacaagatctga

SEQ ID NO: 168143 - DNA, 20 bp, Artificial Sequence
  chemically synthesized
tgataatcagtaagtttcac

SEQ ID NO: 168144 - DNA, 20 bp, Artificial Sequence
  chemically synthesized
ctgttctcctgataatcagt

SEQ ID NO: 168145 - DNA, 20 bp, Artificial Sequence
  chemically synthesized
ttgtgaaacttactgattat

SEQ ID NO: 168146 - DNA, 20 bp, Artificial Sequence
  chemically synthesized
tgtgaaacttactgattatc

SEQ ID NO: 168147 - DNA, 20 bp, Artificial Sequence
  chemically synthesized
catactgttctcctgataat

SEQ ID NO: 168148 - DNA, 20 bp, Artificial Sequence
  chemically synthesized
tgaaacttactgattatcag

SEQ ID NO: 168149 - DNA, 20 bp, Artificial Sequence
  chemically synthesized
cttactgattatcaggagaa

SEQ ID NO: 168150 - DNA, 20 bp, Artificial Sequence
  chemically synthesized
tgattatcaggagaacagta

SEQ ID NO: 168151 - DNA, 20 bp, Artificial Sequence
  chemically synthesized
gattatcaggagaacagtat

SEQ ID NO: 168152 - DNA, 20 bp, Artificial Sequence
  chemically synthesized
attatcaggagaacagtatg

SEQ ID NO: 168153 - DNA, 20 bp, Artificial Sequence
  chemically synthesized
ttatcaggagaacagtatgg

SEQ ID NO: 168154 - DNA, 20 bp, Artificial Sequence
  chemically synthesized
agataattgaatcatggaag

SEQ ID NO: 168155 - DNA, 20 bp, Artificial Sequence
  chemically synthesized
cagataattgaatcatggaa

SEQ ID NO: 168156 - DNA, 20 bp, Artificial Sequence
  chemically synthesized
tgcagataattgaatcatgg

SEQ ID NO: 168157 - DNA, 20 bp, Artificial Sequence
  chemically synthesized
aggtgcagataattgaatca

SEQ ID NO: 168158 - DNA, 20 bp, Artificial Sequence
  chemically synthesized
atgattcaattatctgcacc

SEQ ID NO: 168159 - DNA, 20 bp, Artificial Sequence
  chemically synthesized
gtcaagggtggagccaggtg

SEQ ID NO: 168160 - DNA, 20 bp, Artificial Sequence
  chemically synthesized
cacatgtcaagggtggagcc

SEQ ID NO: 168161 - DNA, 20 bp, Artificial Sequence
  chemically synthesized
ccacatgtcaagggtggagc

SEQ ID NO: 168162 - DNA, 20 bp, Artificial Sequence
  chemically synthesized
atccccacatgtcaagggtg

SEQ ID NO: 168163 - DNA, 20 bp, Artificial Sequence
  chemically synthesized
taatccccacatgtcaaggg

SEQ ID NO: 168164 - DNA, 20 bp, Artificial Sequence
  chemically synthesized
tggtaatccccacatgtcaa

SEQ ID NO: 168165 - DNA, 20 bp, Artificial Sequence
  chemically synthesized
ctggctccacccttgacatg

SEQ ID NO: 168166 - DNA, 20 bp, Artificial Sequence
  chemically synthesized
atggtaatccccacatgtca

SEQ ID NO: 168167 - DNA, 20 bp, Artificial Sequence
  chemically synthesized
tggctccacccttgacatgt

SEQ ID NO: 168168 - DNA, 20 bp, Artificial Sequence
  chemically synthesized
tatggtaatccccacatgtc

SEQ ID NO: 168169 - DNA, 20 bp, Artificial Sequence
  chemically synthesized
ggctccacccttgacatgtg

SEQ ID NO: 168170 - DNA, 20 bp, Artificial Sequence
  chemically synthesized
tgtggggattaccataattc

SEQ ID NO: 168171 - DNA, 20 bp, Artificial Sequence
  chemically synthesized
gtggggattaccataattca

SEQ ID NO: 168172 - DNA, 20 bp, Artificial Sequence
  chemically synthesized
ccaaatctcaccttgaatta

SEQ ID NO: 168173 - DNA, 20 bp, Artificial Sequence
  chemically synthesized
ggattaccataattcaaggt

SEQ ID NO: 168174 - DNA, 20 bp, Artificial Sequence
  chemically synthesized
ccataattcaaggtgagatt

SEQ ID NO: 168175 - DNA, 20 bp, Artificial Sequence
  chemically synthesized
cataattcaaggtgagattt

SEQ ID NO: 168176 - DNA, 20 bp, Artificial Sequence
  chemically synthesized
aattcaaggtgagatttggg

SEQ ID NO: 168177 - DNA, 20 bp, Artificial Sequence
  chemically synthesized
attcaaggtgagatttgggt

SEQ ID NO: 168178 - DNA, 20 bp, Artificial Sequence
  chemically synthesized
ttcaaggtgagatttgggtg

SEQ ID NO: 168179 - DNA, 20 bp, Artificial Sequence
  chemically synthesized
gtgagatttgggtggggaca

SEQ ID NO: 168180 - DNA, 20 bp, Artificial Sequence
  chemically synthesized
caaaagtaattgacatggtt

SEQ ID NO: 168181 - DNA, 20 bp, Artificial Sequence
  chemically synthesized
ttttacaaaagtaattgaca

SEQ ID NO: 168182 - DNA, 20 bp, Artificial Sequence
  chemically synthesized
tattaaataattttttacaa

SEQ ID NO: 168183 - DNA, 20 bp, Artificial Sequence
  chemically synthesized
tttgtaaaaaattatttaat

SEQ ID NO: 168184 - DNA, 20 bp, Artificial Sequence
  chemically synthesized
ttgtaaaaaattatttaata

SEQ ID NO: 168185 - DNA, 20 bp, Artificial Sequence
  chemically synthesized
aataaggaaaactactgtac

SEQ ID NO: 168186 - DNA, 20 bp, Artificial Sequence
  chemically synthesized
aggaagatgagctggtacag

SEQ ID NO: 168187 - DNA, 20 bp, Artificial Sequence
  chemically synthesized
ggtaggaagatgagctggta

SEQ ID NO: 168188 - DNA, 20 bp, Artificial Sequence
  chemically synthesized
tttgtggtaggaagatgagc

SEQ ID NO: 168189 - DNA, 20 bp, Artificial Sequence
  chemically synthesized
acattttgtggtaggaagat

SEQ ID NO: 168190 - DNA, 20 bp, Artificial Sequence
  chemically synthesized
caacaacattttgtggtagg

SEQ ID NO: 168191 - DNA, 20 bp, Artificial Sequence
  chemically synthesized
tctcaacaacattttgtggt

SEQ ID NO: 168192 - DNA, 20 bp, Artificial Sequence
  chemically synthesized
ttctcaacaacattttgtgg

SEQ ID NO: 168193 - DNA, 20 bp, Artificial Sequence
  chemically synthesized
aatttctcaacaacattttg

SEQ ID NO: 168194 - DNA, 20 bp, Artificial Sequence
  chemically synthesized
tcctaccacaaaatgttgtt

SEQ ID NO: 168195 - DNA, 20 bp, Artificial Sequence
  chemically synthesized
attcattattaaaatatgca

SEQ ID NO: 168196 - DNA, 20 bp, Artificial Sequence
  chemically synthesized
ataatgaatcattattattc

SEQ ID NO: 168197 - DNA, 20 bp, Artificial Sequence
  chemically synthesized
tggctttagatatgttatac

SEQ ID NO: 168198 - DNA, 20 bp, Artificial Sequence
  chemically synthesized
attctggtataacatatcta

SEQ ID NO: 168199 - DNA, 20 bp, Artificial Sequence
  chemically synthesized
tataacatatctaaagccat

SEQ ID NO: 168200 - DNA, 20 bp, Artificial Sequence
  chemically synthesized
gcatttttcactgatggctt

SEQ ID NO: 168201 - DNA, 20 bp, Artificial Sequence
  chemically synthesized
ttcagagcatttttcactga

SEQ ID NO: 168202 - DNA, 20 bp, Artificial Sequence
  chemically synthesized
catcagtgaaaaatgctctg

SEQ ID NO: 168203 - DNA, 20 bp, Artificial Sequence
  chemically synthesized
tcagtgaaaaatgctctgaa

SEQ ID NO: 168204 - DNA, 20 bp, Artificial Sequence
  chemically synthesized
ttgccaaagaaaactcttca

SEQ ID NO: 168205 - DNA, 20 bp, Artificial Sequence
  chemically synthesized
tattgccaaagaaaactctt

SEQ ID NO: 168206 - DNA, 20 bp, Artificial Sequence
  chemically synthesized
atgctctgaagagttttctt

SEQ ID NO: 168207 - DNA, 20 bp, Artificial Sequence
  chemically synthesized
accattaagtgatattgcca

SEQ ID NO: 168208 - DNA, 20 bp, Artificial Sequence
  chemically synthesized
tctttggcaatatcacttaa

SEQ ID NO: 168209 - DNA, 20 bp, Artificial Sequence
  chemically synthesized
tggcaatatcacttaatggt

SEQ ID NO: 168210 - DNA, 20 bp, Artificial Sequence
  chemically synthesized
ggcaatatcacttaatggtt

SEQ ID NO: 168211 - DNA, 20 bp, Artificial Sequence
  chemically synthesized
ttgatttccacccaaccatt

SEQ ID NO: 168212 - DNA, 20 bp, Artificial Sequence
  chemically synthesized
aatatcacttaatggttggg

SEQ ID NO: 168213 - DNA, 20 bp, Artificial Sequence
  chemically synthesized
ttaatggttgggtggaaatc

SEQ ID NO: 168214 - DNA, 20 bp, Artificial Sequence
  chemically synthesized
acaaaaaaaatatgtgttaa

SEQ ID NO: 168215 - DNA, 20 bp, Artificial Sequence
  chemically synthesized
aactgttttaaagtgcagaa

SEQ ID NO: 168216 - DNA, 20 bp, Artificial Sequence
  chemically synthesized
gaaactgttttaaagtgcag

SEQ ID NO: 168217 - DNA, 20 bp, Artificial Sequence
  chemically synthesized
ctggaaactgttttaaagtg

SEQ ID NO: 168218 - DNA, 20 bp, Artificial Sequence
  chemically synthesized
tgctcttctgcactttaaaa

SEQ ID NO: 168219 - DNA, 20 bp, Artificial Sequence
  chemically synthesized
gattcctggaaactgtttta

SEQ ID NO: 168220 - DNA, 20 bp, Artificial Sequence
  chemically synthesized
ctgcactttaaaacagtttc

SEQ ID NO: 168221 - DNA, 20 bp, Artificial Sequence
  chemically synthesized
tgcactttaaaacagtttcc

SEQ ID NO: 168222 - DNA, 20 bp, Artificial Sequence
  chemically synthesized
taaaacagtttccaggaatc

SEQ ID NO: 168223 - DNA, 20 bp, Artificial Sequence
  chemically synthesized
tttggaatactctcgattcc

SEQ ID NO: 168224 - DNA, 20 bp, Artificial Sequence
  chemically synthesized
aaacagtttccaggaatcga

SEQ ID NO: 168225 - DNA, 20 bp, Artificial Sequence
  chemically synthesized
atatttttccgtgaagtatt

SEQ ID NO: 168226 - DNA, 20 bp, Artificial Sequence
  chemically synthesized
agagtattccaaatacttca

SEQ ID NO: 168227 - DNA, 20 bp, Artificial Sequence
  chemically synthesized
acctgttatatttttccgtg

SEQ ID NO: 168228 - DNA, 20 bp, Artificial Sequence
  chemically synthesized
tacttcacggaaaaatataa

SEQ ID NO: 168229 - DNA, 20 bp, Artificial Sequence
  chemically synthesized
acttcacggaaaaatataac

SEQ ID NO: 168230 - DNA, 20 bp, Artificial Sequence
  chemically synthesized
cggaaaaatataacaggtgt

SEQ ID NO: 168231 - DNA, 20 bp, Artificial Sequence
  chemically synthesized
ggtgtgagtaatgtataacg

SEQ ID NO: 168232 - DNA, 20 bp, Artificial Sequence
  chemically synthesized
agtaatgtataacgtggaaa

SEQ ID NO: 168233 - DNA, 20 bp, Artificial Sequence
  chemically synthesized
gtataacgtggaaaaagatt

SEQ ID NO: 168234 - DNA, 20 bp, Artificial Sequence
  chemically synthesized
tataacgtggaaaaagatta

SEQ ID NO: 168235 - DNA, 20 bp, Artificial Sequence
  chemically synthesized
aaaaagattaaggtttgtat

SEQ ID NO: 168236 - DNA, 20 bp, Artificial Sequence
  chemically synthesized
gtaaattaatttaaaacaca

SEQ ID NO: 168237 - DNA, 20 bp, Artificial Sequence
  chemically synthesized
actttgatgtgaatgcaaaa

SEQ ID NO: 168238 - DNA, 20 bp, Artificial Sequence
  chemically synthesized
actattttgcattcacatca

SEQ ID NO: 168239 - DNA, 20 bp, Artificial Sequence
  chemically synthesized
tttgcattcacatcaaagta

SEQ ID NO: 168240 - DNA, 20 bp, Artificial Sequence
  chemically synthesized
tatagacacaaacacctgac

SEQ ID NO: 168241 - DNA, 20 bp, Artificial Sequence
  chemically synthesized
aatgatgtattttaccggtc

SEQ ID NO: 168242 - DNA, 20 bp, Artificial Sequence
  chemically synthesized
aaatgatgtattttaccggt

SEQ ID NO: 168243 - DNA, 20 bp, Artificial Sequence
  chemically synthesized
agaaaaatgatgtattttac

SEQ ID NO: 168244 - DNA, 20 bp, Artificial Sequence
  chemically synthesized
ataatacataaaaggattat

SEQ ID NO: 168245 - DNA, 20 bp, Artificial Sequence
  chemically synthesized
atggttttataatacataaa

SEQ ID NO: 168246 - DNA, 20 bp, Artificial Sequence
  chemically synthesized
catggttttataatacataa

SEQ ID NO: 168247 - DNA, 20 bp, Artificial Sequence
  chemically synthesized
aacatgttatatgaagagca

SEQ ID NO: 168248 - DNA, 20 bp, Artificial Sequence
  chemically synthesized
cagggaacatgttatatgaa

SEQ ID NO: 168249 - DNA, 20 bp, Artificial Sequence
  chemically synthesized
cacagggaacatgttatatg

SEQ ID NO: 168250 - DNA, 20 bp, Artificial Sequence
  chemically synthesized
ttcatataacatgttccctg

SEQ ID NO: 168251 - DNA, 20 bp, Artificial Sequence
  chemically synthesized
gtttgttttctttcaccaca

SEQ ID NO: 168252 - DNA, 20 bp, Artificial Sequence
  chemically synthesized
taacatgttccctgtggtga

SEQ ID NO: 168253 - DNA, 20 bp, Artificial Sequence
  chemically synthesized
tgtttgttttctttcaccac

SEQ ID NO: 168254 - DNA, 20 bp, Artificial Sequence
  chemically synthesized
gtgtttgttttctttcacca

SEQ ID NO: 168255 - DNA, 20 bp, Artificial Sequence
  chemically synthesized
gatactaaattaacacataa

SEQ ID NO: 168256 - DNA, 20 bp, Artificial Sequence
  chemically synthesized
agatactaaattaacacata

SEQ ID NO: 168257 - DNA, 20 bp, Artificial Sequence
  chemically synthesized
tagatactaaattaacacat

SEQ ID NO: 168258 - DNA, 20 bp, Artificial Sequence
  chemically synthesized
aattcccttatgtgttaatt

SEQ ID NO: 168259 - DNA, 20 bp, Artificial Sequence
  chemically synthesized
tatgtgttaatttagtatct

SEQ ID NO: 168260 - DNA, 20 bp, Artificial Sequence
  chemically synthesized
aaattaggtcaagatgtgct

SEQ ID NO: 168261 - DNA, 20 bp, Artificial Sequence
  chemically synthesized
atcttgtgtgaaattaggtc

SEQ ID NO: 168262 - DNA, 20 bp, Artificial Sequence
  chemically synthesized
aagtaatcttgtgtgaaatt

SEQ ID NO: 168263 - DNA, 20 bp, Artificial Sequence
  chemically synthesized
aaagtaatcttgtgtgaaat

SEQ ID NO: 168264 - DNA, 20 bp, Artificial Sequence
  chemically synthesized
atcttgacctaatttcacac

SEQ ID NO: 168265 - DNA, 20 bp, Artificial Sequence
  chemically synthesized
agagattgaaagaataagga

SEQ ID NO: 168266 - DNA, 20 bp, Artificial Sequence
  chemically synthesized
attcagagattgaaagaata

SEQ ID NO: 168267 - DNA, 20 bp, Artificial Sequence
  chemically synthesized
cattcagagattgaaagaat

SEQ ID NO: 168268 - DNA, 20 bp, Artificial Sequence
  chemically synthesized
aattaacattcagagattga

SEQ ID NO: 168269 - DNA, 20 bp, Artificial Sequence
  chemically synthesized
acatttgaaattaacattca

SEQ ID NO: 168270 - DNA, 20 bp, Artificial Sequence
  chemically synthesized
atacatttgaaattaacatt

SEQ ID NO: 168271 - DNA, 20 bp, Artificial Sequence
  chemically synthesized
aatgtatatgttttaatatt

SEQ ID NO: 168272 - DNA, 20 bp, Artificial Sequence
  chemically synthesized
atatgttttaatattaagat

SEQ ID NO: 168273 - DNA, 20 bp, Artificial Sequence
  chemically synthesized
tttaatattaagataagcaa

SEQ ID NO: 168274 - DNA, 20 bp, Artificial Sequence
  chemically synthesized
ataagcaaaagtgtctgttt

SEQ ID NO: 168275 - DNA, 20 bp, Artificial Sequence
  chemically synthesized
taatatgtttatttctaaaa

SEQ ID NO: 168276 - DNA, 20 bp, Artificial Sequence
  chemically synthesized
gttttagaaataaacatatt

SEQ ID NO: 168277 - DNA, 20 bp, Artificial Sequence
  chemically synthesized
tagaaataaacatattaaga

SEQ ID NO: 168278 - DNA, 20 bp, Artificial Sequence
  chemically synthesized
tttcataacacaaaacattt

SEQ ID NO: 168279 - DNA, 20 bp, Artificial Sequence
  chemically synthesized
aaaacattttagaaaaatta

SEQ ID NO: 168280 - DNA, 20 bp, Artificial Sequence
  chemically synthesized
tttagaaaaattaaagtgtt

SEQ ID NO: 168281 - DNA, 20 bp, Artificial Sequence
  chemically synthesized
taaagtgttaagcataaaaa

SEQ ID NO: 168282 - DNA, 20 bp, Artificial Sequence
  chemically synthesized
gtgttaagcataaaaatagt

SEQ ID NO: 168283 - DNA, 20 bp, Artificial Sequence
  chemically synthesized
ttaagcataaaaatagtaag

SEQ ID NO: 168284 - DNA, 20 bp, Artificial Sequence
  chemically synthesized
ataaaaatagtaagaagaac

SEQ ID NO: 168285 - DNA, 20 bp, Artificial Sequence
  chemically synthesized
cccacgccaatattttattc

SEQ ID NO: 168286 - DNA, 20 bp, Artificial Sequence
  chemically synthesized
gaagaactggaataaaatat

SEQ ID NO: 168287 - DNA, 20 bp, Artificial Sequence
  chemically synthesized
actggaataaaatattggcg

SEQ ID NO: 168288 - DNA, 20 bp, Artificial Sequence
  chemically synthesized
ctggaataaaatattggcgt

SEQ ID NO: 168289 - DNA, 20 bp, Artificial Sequence
  chemically synthesized
tggaataaaatattggcgtg

SEQ ID NO: 168290 - DNA, 20 bp, Artificial Sequence
  chemically synthesized
aataaaatattggcgtgggg

SEQ ID NO: 168291 - DNA, 20 bp, Artificial Sequence
  chemically synthesized
attggcgtggggaagccttt

SEQ ID NO: 168292 - DNA, 20 bp, Artificial Sequence
  chemically synthesized
ggcgtggggaagccttttag

SEQ ID NO: 168293 - DNA, 20 bp, Artificial Sequence
  chemically synthesized
attctttttttgcttctaaa

SEQ ID NO: 168294 - DNA, 20 bp, Artificial Sequence
  chemically synthesized
tattctttttttgcttctaa

SEQ ID NO: 168295 - DNA, 20 bp, Artificial Sequence
  chemically synthesized
aagccttttagaagcaaaaa

SEQ ID NO: 168296 - DNA, 20 bp, Artificial Sequence
  chemically synthesized
aagcaaaaaaagaatataaa

SEQ ID NO: 168297 - DNA, 20 bp, Artificial Sequence
  chemically synthesized
gattagtggctttaatttat

SEQ ID NO: 168298 - DNA, 20 bp, Artificial Sequence
  chemically synthesized
gcgtattcacttataaatta

SEQ ID NO: 168299 - DNA, 20 bp, Artificial Sequence
  chemically synthesized
tttgttttaattttgattag

SEQ ID NO: 168300 - DNA, 20 bp, Artificial Sequence
  chemically synthesized
tcatttgttttaattttgat

SEQ ID NO: 168301 - DNA, 20 bp, Artificial Sequence
  chemically synthesized
aaattaaaacaaatgacaac

SEQ ID NO: 168302 - DNA, 20 bp, Artificial Sequence
  chemically synthesized
aattaaaacaaatgacaact

SEQ ID NO: 168303 - DNA, 20 bp, Artificial Sequence
  chemically synthesized
atatatgctgcaaatattcc

SEQ ID NO: 168304 - DNA, 20 bp, Artificial Sequence
  chemically synthesized
atgacaactgggaatatttg

SEQ ID NO: 168305 - DNA, 20 bp, Artificial Sequence
  chemically synthesized
ggaatatttgcagcatatat

SEQ ID NO: 168306 - DNA, 20 bp, Artificial Sequence
  chemically synthesized
tttgcagcatatatcagaca

SEQ ID NO: 168307 - DNA, 20 bp, Artificial Sequence
  chemically synthesized
ttgcagcatatatcagacac

SEQ ID NO: 168308 - DNA, 20 bp, Artificial Sequence
  chemically synthesized
tgcagcatatatcagacaca

SEQ ID NO: 168309 - DNA, 20 bp, Artificial Sequence
  chemically synthesized
cagacacagggtaataattt

SEQ ID NO: 168310 - DNA, 20 bp, Artificial Sequence
  chemically synthesized
atataaaaaaatcttttaat

SEQ ID NO: 168311 - DNA, 20 bp, Artificial Sequence
  chemically synthesized
ttcctttttttactcattaa

SEQ ID NO: 168312 - DNA, 20 bp, Artificial Sequence
  chemically synthesized
aatcttttaatgagtaaaaa

SEQ ID NO: 168313 - DNA, 20 bp, Artificial Sequence
  chemically synthesized
atcttttaatgagtaaaaaa

SEQ ID NO: 168314 - DNA, 20 bp, Artificial Sequence
  chemically synthesized
taaaaaaaggaaaaatctac

SEQ ID NO: 168315 - DNA, 20 bp, Artificial Sequence
  chemically synthesized
ttctttatccagttttccag

SEQ ID NO: 168316 - DNA, 20 bp, Artificial Sequence
  chemically synthesized
ggaaaaatctactggaaaac

SEQ ID NO: 168317 - DNA, 20 bp, Artificial Sequence
  chemically synthesized
atgttctttatccagttttc

SEQ ID NO: 168318 - DNA, 20 bp, Artificial Sequence
  chemically synthesized
atctactggaaaactggata

SEQ ID NO: 168319 - DNA, 20 bp, Artificial Sequence
  chemically synthesized
ttctttttatgttctttatc

SEQ ID NO: 168320 - DNA, 20 bp, Artificial Sequence
  chemically synthesized
aactggataaagaacataaa

SEQ ID NO: 168321 - DNA, 20 bp, Artificial Sequence
  chemically synthesized
gaaattgacaaaaatgtaaa

SEQ ID NO: 168322 - DNA, 20 bp, Artificial Sequence
  chemically synthesized
aatgtaaacagccaataaac

SEQ ID NO: 168323 - DNA, 20 bp, Artificial Sequence
  chemically synthesized
ctggattttttcttgtttat

SEQ ID NO: 168324 - DNA, 20 bp, Artificial Sequence
  chemically synthesized
ccaataaacaagaaaaaatc

SEQ ID NO: 168325 - DNA, 20 bp, Artificial Sequence
  chemically synthesized
taaacaagaaaaaatccaga

SEQ ID NO: 168326 - DNA, 20 bp, Artificial Sequence
  chemically synthesized
caagaaaaaatccagacagt

SEQ ID NO: 168327 - DNA, 20 bp, Artificial Sequence
  chemically synthesized
ttcattgattactaactgtc

SEQ ID NO: 168328 - DNA, 20 bp, Artificial Sequence
  chemically synthesized
ttagtaatcaatgaaatgca

SEQ ID NO: 168329 - DNA, 20 bp, Artificial Sequence
  chemically synthesized
tagtaatcaatgaaatgcaa

SEQ ID NO: 168330 - DNA, 20 bp, Artificial Sequence
  chemically synthesized
caatgaaatgcaaaggaaaa

SEQ ID NO: 168331 - DNA, 20 bp, Artificial Sequence
  chemically synthesized
ctaatataatagataaataa

SEQ ID NO: 168332 - DNA, 20 bp, Artificial Sequence
  chemically synthesized
ctattatttatctattatat

SEQ ID NO: 168333 - DNA, 20 bp, Artificial Sequence
  chemically synthesized
ttttacagaaactaatataa

SEQ ID NO: 168334 - DNA, 20 bp, Artificial Sequence
  chemically synthesized
tattatattagtttctgtaa

SEQ ID NO: 168335 - DNA, 20 bp, Artificial Sequence
  chemically synthesized
attatattagtttctgtaaa

SEQ ID NO: 168336 - DNA, 20 bp, Artificial Sequence
  chemically synthesized
actttgacaaagacctttta

SEQ ID NO: 168337 - DNA, 20 bp, Artificial Sequence
  chemically synthesized
tctgtaaaaggtctttgtca

SEQ ID NO: 168338 - DNA, 20 bp, Artificial Sequence
  chemically synthesized
tgttttccagaactttgaca

SEQ ID NO: 168339 - DNA, 20 bp, Artificial Sequence
  chemically synthesized
aaaggtctttgtcaaagttc

SEQ ID NO: 168340 - DNA, 20 bp, Artificial Sequence
  chemically synthesized
ttgtcaaagttctggaaaac

SEQ ID NO: 168341 - DNA, 20 bp, Artificial Sequence
  chemically synthesized
tcataaaattgcttgttttc

SEQ ID NO: 168342 - DNA, 20 bp, Artificial Sequence
  chemically synthesized
agcaattttatgatcttcct

SEQ ID NO: 168343 - DNA, 20 bp, Artificial Sequence
  chemically synthesized
caattttatgatcttccttg

SEQ ID NO: 168344 - DNA, 20 bp, Artificial Sequence
  chemically synthesized
tgtataatagggctccaagg

SEQ ID NO: 168345 - DNA, 20 bp, Artificial Sequence
  chemically synthesized
gactgtataatagggctcca

SEQ ID NO: 168346 - DNA, 20 bp, Artificial Sequence
  chemically synthesized
tgactgtataatagggctcc

SEQ ID NO: 168347 - DNA, 20 bp, Artificial Sequence
  chemically synthesized
ttccttggagccctattata

SEQ ID NO: 168348 - DNA, 20 bp, Artificial Sequence
  chemically synthesized
tggtgaatgactgtataata

SEQ ID NO: 168349 - DNA, 20 bp, Artificial Sequence
  chemically synthesized
gtggtgaatgactgtataat

SEQ ID NO: 168350 - DNA, 20 bp, Artificial Sequence
  chemically synthesized
tgtggtgaatgactgtataa

SEQ ID NO: 168351 - DNA, 20 bp, Artificial Sequence
  chemically synthesized
tacagtcattcaccacattt

SEQ ID NO: 168352 - DNA, 20 bp, Artificial Sequence
  chemically synthesized
tcagtctgttgactgaaatg

SEQ ID NO: 168353 - DNA, 20 bp, Artificial Sequence
  chemically synthesized
attcaccacatttcagtcaa

SEQ ID NO: 168354 - DNA, 20 bp, Artificial Sequence
  chemically synthesized
taatctcataggatcacagt

SEQ ID NO: 168355 - DNA, 20 bp, Artificial Sequence
  chemically synthesized
attgtaatctcataggatca

SEQ ID NO: 168356 - DNA, 20 bp, Artificial Sequence
  chemically synthesized
cagactgactgtgatcctat

SEQ ID NO: 168357 - DNA, 20 bp, Artificial Sequence
  chemically synthesized
cagctccattgtaatctcat

SEQ ID NO: 168358 - DNA, 20 bp, Artificial Sequence
  chemically synthesized
tcagctccattgtaatctca

SEQ ID NO: 168359 - DNA, 20 bp, Artificial Sequence
  chemically synthesized
gtgatcctatgagattacaa

SEQ ID NO: 168360 - DNA, 20 bp, Artificial Sequence
  chemically synthesized
gatcctatgagattacaatg

SEQ ID NO: 168361 - DNA, 20 bp, Artificial Sequence
  chemically synthesized
actaggtaataggaattttt

SEQ ID NO: 168362 - DNA, 20 bp, Artificial Sequence
  chemically synthesized
gctgaaaaattcctattacc

SEQ ID NO: 168363 - DNA, 20 bp, Artificial Sequence
  chemically synthesized
ctgtgacatcactaggtaat

SEQ ID NO: 168364 - DNA, 20 bp, Artificial Sequence
  chemically synthesized
actgtgacatcactaggtaa

SEQ ID NO: 168365 - DNA, 20 bp, Artificial Sequence
  chemically synthesized
cattgcactgtgacatcact

SEQ ID NO: 168366 - DNA, 20 bp, Artificial Sequence
  chemically synthesized
tcattgcactgtgacatcac

SEQ ID NO: 168367 - DNA, 20 bp, Artificial Sequence
  chemically synthesized
cctattacctagtgatgtca

SEQ ID NO: 168368 - DNA, 20 bp, Artificial Sequence
  chemically synthesized
cagcatcaccacaaacgtga

SEQ ID NO: 168369 - DNA, 20 bp, Artificial Sequence
  chemically synthesized
atgaattactctcacgtttg

SEQ ID NO: 168370 - DNA, 20 bp, Artificial Sequence
  chemically synthesized
accagcatcaccacaaacgt

SEQ ID NO: 168371 - DNA, 20 bp, Artificial Sequence
  chemically synthesized
tctcacgtttgtggtgatgc

SEQ ID NO: 168372 - DNA, 20 bp, Artificial Sequence
  chemically synthesized
gtttgtggtgatgctggtgt

SEQ ID NO: 168373 - DNA, 20 bp, Artificial Sequence
  chemically synthesized
tgcagtaggtttgcttacac

SEQ ID NO: 168374 - DNA, 20 bp, Artificial Sequence
  chemically synthesized
tatataactggcagtgcagt

SEQ ID NO: 168375 - DNA, 20 bp, Artificial Sequence
  chemically synthesized
ttatataactggcagtgcag

SEQ ID NO: 168376 - DNA, 20 bp, Artificial Sequence
  chemically synthesized
aagcaaacctactgcactgc

SEQ ID NO: 168377 - DNA, 20 bp, Artificial Sequence
  chemically synthesized
tttttatataactggcagtg

SEQ ID NO: 168378 - DNA, 20 bp, Artificial Sequence
  chemically synthesized
ctgtatttttatataactgg

SEQ ID NO: 168379 - DNA, 20 bp, Artificial Sequence
  chemically synthesized
gtgctgtatttttatataac

SEQ ID NO: 168380 - DNA, 20 bp, Artificial Sequence
  chemically synthesized
ctgccagttatataaaaata

SEQ ID NO: 168381 - DNA, 20 bp, Artificial Sequence
  chemically synthesized
agttatataaaaatacagca

SEQ ID NO: 168382 - DNA, 20 bp, Artificial Sequence
  chemically synthesized
tataaaaatacagcacagac

SEQ ID NO: 168383 - DNA, 20 bp, Artificial Sequence
  chemically synthesized
acagcacagacaagtatgta

SEQ ID NO: 168384 - DNA, 20 bp, Artificial Sequence
  chemically synthesized
agttgtttattatcattatc

SEQ ID NO: 168385 - DNA, 20 bp, Artificial Sequence
  chemically synthesized
tgataataaacaactgttat

SEQ ID NO: 168386 - DNA, 20 bp, Artificial Sequence
  chemically synthesized
gtaaatacataaaccaataa

SEQ ID NO: 168387 - DNA, 20 bp, Artificial Sequence
  chemically synthesized
ttttgaactaattaagaata

SEQ ID NO: 168388 - DNA, 20 bp, Artificial Sequence
  chemically synthesized
gtatttactatattcttaat

SEQ ID NO: 168389 - DNA, 20 bp, Artificial Sequence
  chemically synthesized
tgccttcttttgaactaatt

SEQ ID NO: 168390 - DNA, 20 bp, Artificial Sequence
  chemically synthesized
tatattcttaattagttcaa

SEQ ID NO: 168391 - DNA, 20 bp, Artificial Sequence
  chemically synthesized
attcttaattagttcaaaag

SEQ ID NO: 168392 - DNA, 20 bp, Artificial Sequence
  chemically synthesized
ttcttaattagttcaaaaga

SEQ ID NO: 168393 - DNA, 20 bp, Artificial Sequence
  chemically synthesized
agaaggcattgttatcctat

SEQ ID NO: 168394 - DNA, 20 bp, Artificial Sequence
  chemically synthesized
tcatgaaactatcatctcat

SEQ ID NO: 168395 - DNA, 20 bp, Artificial Sequence
  chemically synthesized
ttcatgaaactatcatctca

SEQ ID NO: 168396 - DNA, 20 bp, Artificial Sequence
  chemically synthesized
attgttatcctatgagatga

SEQ ID NO: 168397 - DNA, 20 bp, Artificial Sequence
  chemically synthesized
tgaatgtttcattgcccatg

SEQ ID NO: 168398 - DNA, 20 bp, Artificial Sequence
  chemically synthesized
ccccactggaaggtcttcat

SEQ ID NO: 168399 - DNA, 20 bp, Artificial Sequence
  chemically synthesized
cccccactggaaggtcttca

SEQ ID NO: 168400 - DNA, 20 bp, Artificial Sequence
  chemically synthesized
cattgcccatgaagaccttc

SEQ ID NO: 168401 - DNA, 20 bp, Artificial Sequence
  chemically synthesized
tgcccatgaagaccttccag

SEQ ID NO: 168402 - DNA, 20 bp, Artificial Sequence
  chemically synthesized
gcccatgaagaccttccagt

SEQ ID NO: 168403 - DNA, 20 bp, Artificial Sequence
  chemically synthesized
cccatgaagaccttccagtg

SEQ ID NO: 168404 - DNA, 20 bp, Artificial Sequence
  chemically synthesized
acatgctgtcccccactgga

SEQ ID NO: 168405 - DNA, 20 bp, Artificial Sequence
  chemically synthesized
ccatgaagaccttccagtgg

SEQ ID NO: 168406 - DNA, 20 bp, Artificial Sequence
  chemically synthesized
cacatgctgtcccccactgg

SEQ ID NO: 168407 - DNA, 20 bp, Artificial Sequence
  chemically synthesized
ttccacatgctgtcccccac

SEQ ID NO: 168408 - DNA, 20 bp, Artificial Sequence
  chemically synthesized
gaagaccttccagtggggga

SEQ ID NO: 168409 - DNA, 20 bp, Artificial Sequence
  chemically synthesized
ttccagtgggggacagcatg

SEQ ID NO: 168410 - DNA, 20 bp, Artificial Sequence
  chemically synthesized
cagtgggggacagcatgtgg

SEQ ID NO: 168411 - DNA, 20 bp, Artificial Sequence
  chemically synthesized
tgggggacagcatgtggaag

SEQ ID NO: 168412 - DNA, 20 bp, Artificial Sequence
  chemically synthesized
gggacagcatgtggaagtgg

SEQ ID NO: 168413 - DNA, 20 bp, Artificial Sequence
  chemically synthesized
cagcatgtggaagtggaaga

SEQ ID NO: 168414 - DNA, 20 bp, Artificial Sequence
  chemically synthesized
agcctaggcctacatgggtc

SEQ ID NO: 168415 - DNA, 20 bp, Artificial Sequence
  chemically synthesized
attgatgatcctgacccatg

SEQ ID NO: 168416 - DNA, 20 bp, Artificial Sequence
  chemically synthesized
gagcctaggcctacatgggt

SEQ ID NO: 168417 - DNA, 20 bp, Artificial Sequence
  chemically synthesized
ttgatgatcctgacccatgt

SEQ ID NO: 168418 - DNA, 20 bp, Artificial Sequence
  chemically synthesized
acatgagcctaggcctacat

SEQ ID NO: 168419 - DNA, 20 bp, Artificial Sequence
  chemically synthesized
cacatgagcctaggcctaca

SEQ ID NO: 168420 - DNA, 20 bp, Artificial Sequence
  chemically synthesized
gatcctgacccatgtaggcc

SEQ ID NO: 168421 - DNA, 20 bp, Artificial Sequence
  chemically synthesized
atcctgacccatgtaggcct

SEQ ID NO: 168422 - DNA, 20 bp, Artificial Sequence
  chemically synthesized
acaaacacgcacatgagcct

SEQ ID NO: 168423 - DNA, 20 bp, Artificial Sequence
  chemically synthesized
cacaaacacgcacatgagcc

SEQ ID NO: 168424 - DNA, 20 bp, Artificial Sequence
  chemically synthesized
taaaacacaaacacgcacat

SEQ ID NO: 168425 - DNA, 20 bp, Artificial Sequence
  chemically synthesized
gtttgtgttttactttttaa

SEQ ID NO: 168426 - DNA, 20 bp, Artificial Sequence
  chemically synthesized
gtttaagcttttctgttaaa

SEQ ID NO: 168427 - DNA, 20 bp, Artificial Sequence
  chemically synthesized
tgttttactttttaacagaa

SEQ ID NO: 168428 - DNA, 20 bp, Artificial Sequence
  chemically synthesized
ttttaacagaaaagcttaaa

SEQ ID NO: 168429 - DNA, 20 bp, Artificial Sequence
  chemically synthesized
ttttaatatttttgctgttt

SEQ ID NO: 168430 - DNA, 20 bp, Artificial Sequence
  chemically synthesized
acagcaaaaatattaaaaat

SEQ ID NO: 168431 - DNA, 20 bp, Artificial Sequence
  chemically synthesized
caaaaatattaaaaataaga

SEQ ID NO: 168432 - DNA, 20 bp, Artificial Sequence
  chemically synthesized
aataagaaagctgctacaat

SEQ ID NO: 168433 - DNA, 20 bp, Artificial Sequence
  chemically synthesized
attttatatccttattgtag

SEQ ID NO: 168434 - DNA, 20 bp, Artificial Sequence
  chemically synthesized
ataagaaagctgctacaata

SEQ ID NO: 168435 - DNA, 20 bp, Artificial Sequence
  chemically synthesized
aatattttatatccttattg

SEQ ID NO: 168436 - DNA, 20 bp, Artificial Sequence
  chemically synthesized
ggatataaaatatttttgta

SEQ ID NO: 168437 - DNA, 20 bp, Artificial Sequence
  chemically synthesized
gatataaaatatttttgtac

SEQ ID NO: 168438 - DNA, 20 bp, Artificial Sequence
  chemically synthesized
gttcaacgtgttcatgtttt

SEQ ID NO: 168439 - DNA, 20 bp, Artificial Sequence
  chemically synthesized
acgtgttcatgttttaagct

SEQ ID NO: 168440 - DNA, 20 bp, Artificial Sequence
  chemically synthesized
tttgactctgtaataacact

SEQ ID NO: 168441 - DNA, 20 bp, Artificial Sequence
  chemically synthesized
ttttaagctaagtgttatta

SEQ ID NO: 168442 - DNA, 20 bp, Artificial Sequence
  chemically synthesized
ttaagctaagtgttattaca

SEQ ID NO: 168443 - DNA, 20 bp, Artificial Sequence
  chemically synthesized
gagtcaaaaacttaaaaaaa

SEQ ID NO: 168444 - DNA, 20 bp, Artificial Sequence
  chemically synthesized
actttataaacttttttttt

SEQ ID NO: 168445 - DNA, 20 bp, Artificial Sequence
  chemically synthesized
acttaaaaaaaaagtttata

SEQ ID NO: 168446 - DNA, 20 bp, Artificial Sequence
  chemically synthesized
aaaaagtttataaagtaaaa

SEQ ID NO: 168447 - DNA, 20 bp, Artificial Sequence
  chemically synthesized
taaagtaaaaaagttactat

SEQ ID NO: 168448 - DNA, 20 bp, Artificial Sequence
  chemically synthesized
taaaaaagttactataagct

SEQ ID NO: 168449 - DNA, 20 bp, Artificial Sequence
  chemically synthesized
aaaaaagttactataagcta

SEQ ID NO: 168450 - DNA, 20 bp, Artificial Sequence
  chemically synthesized
gataagttaaccttagctta

SEQ ID NO: 168451 - DNA, 20 bp, Artificial Sequence
  chemically synthesized
cattaatgataagttaacct

SEQ ID NO: 168452 - DNA, 20 bp, Artificial Sequence
  chemically synthesized
catttattttcattaatgat

SEQ ID NO: 168453 - DNA, 20 bp, Artificial Sequence
  chemically synthesized
ttatcattaatgaaaataaa

SEQ ID NO: 168454 - DNA, 20 bp, Artificial Sequence
  chemically synthesized
tatcattaatgaaaataaat

SEQ ID NO: 168455 - DNA, 20 bp, Artificial Sequence
  chemically synthesized
attaatgaaaataaatgggc

SEQ ID NO: 168456 - DNA, 20 bp, Artificial Sequence
  chemically synthesized
ttaatgaaaataaatgggcc

SEQ ID NO: 168457 - DNA, 20 bp, Artificial Sequence
  chemically synthesized
gaaaataaatgggccaggcg

SEQ ID NO: 168458 - DNA, 20 bp, Artificial Sequence
  chemically synthesized
aataaatgggccaggcgcgg

SEQ ID NO: 168459 - DNA, 20 bp, Artificial Sequence
  chemically synthesized
caggcgtgagccaccgcgcc

SEQ ID NO: 168460 - DNA, 20 bp, Artificial Sequence
  chemically synthesized
agtgctgggattacaggcgt

SEQ ID NO: 168461 - DNA, 20 bp, Artificial Sequence
  chemically synthesized
gtggctcacgcctgtaatcc

SEQ ID NO: 168462 - DNA, 20 bp, Artificial Sequence
  chemically synthesized
tcccaaagtgctgggattac

SEQ ID NO: 168463 - DNA, 20 bp, Artificial Sequence
  chemically synthesized
ctcccaaagtgctgggatta

SEQ ID NO: 168464 - DNA, 20 bp, Artificial Sequence
  chemically synthesized
cgcctgtaatcccagcactt

SEQ ID NO: 168465 - DNA, 20 bp, Artificial Sequence
  chemically synthesized
cctcggcctcccaaagtgct

SEQ ID NO: 168466 - DNA, 20 bp, Artificial Sequence
  chemically synthesized
gcctgtaatcccagcacttt

SEQ ID NO: 168467 - DNA, 20 bp, Artificial Sequence
  chemically synthesized
gcctcggcctcccaaagtgc

SEQ ID NO: 168468 - DNA, 20 bp, Artificial Sequence
  chemically synthesized
ctgtaatcccagcactttgg

SEQ ID NO: 168469 - DNA, 20 bp, Artificial Sequence
  chemically synthesized
tgtaatcccagcactttggg

SEQ ID NO: 168470 - DNA, 20 bp, Artificial Sequence
  chemically synthesized
ccacccgcctcggcctccca

SEQ ID NO: 168471 - DNA, 20 bp, Artificial Sequence
  chemically synthesized
tcccagcactttgggaggcc

SEQ ID NO: 168472 - DNA, 20 bp, Artificial Sequence
  chemically synthesized
cccagcactttgggaggccg

SEQ ID NO: 168473 - DNA, 20 bp, Artificial Sequence
  chemically synthesized
agcactttgggaggccgagg

SEQ ID NO: 168474 - DNA, 20 bp, Artificial Sequence
  chemically synthesized
gcactttgggaggccgaggc

SEQ ID NO: 168475 - DNA, 20 bp, Artificial Sequence
  chemically synthesized
ctttgggaggccgaggcggg

SEQ ID NO: 168476 - DNA, 20 bp, Artificial Sequence
  chemically synthesized
accttgtgatccacccgcct

SEQ ID NO: 168477 - DNA, 20 bp, Artificial Sequence
  chemically synthesized
ggccgaggcgggtggatcac

SEQ ID NO: 168478 - DNA, 20 bp, Artificial Sequence
  chemically synthesized
gccgaggcgggtggatcaca

SEQ ID NO: 168479 - DNA, 20 bp, Artificial Sequence
  chemically synthesized
aggcgggtggatcacaaggt

SEQ ID NO: 168480 - DNA, 20 bp, Artificial Sequence
  chemically synthesized
ggcgggtggatcacaaggtc

SEQ ID NO: 168481 - DNA, 20 bp, Artificial Sequence
  chemically synthesized
cgggtggatcacaaggtcag

SEQ ID NO: 168482 - DNA, 20 bp, Artificial Sequence
  chemically synthesized
ggatcacaaggtcaggagat

SEQ ID NO: 168483 - DNA, 20 bp, Artificial Sequence
  chemically synthesized
gatcacaaggtcaggagatc

SEQ ID NO: 168484 - DNA, 20 bp, Artificial Sequence
  chemically synthesized
tcaggagatcgggaccatcc

SEQ ID NO: 168485 - DNA, 20 bp, Artificial Sequence
  chemically synthesized
tttcaccgtgttagccagga

SEQ ID NO: 168486 - DNA, 20 bp, Artificial Sequence
  chemically synthesized
ggggtttcaccgtgttagcc

SEQ ID NO: 168487 - DNA, 20 bp, Artificial Sequence
  chemically synthesized
cgggaccatcctggctaaca

SEQ ID NO: 168488 - DNA, 20 bp, Artificial Sequence
  chemically synthesized
tggggtttcaccgtgttagc

SEQ ID NO: 168489 - DNA, 20 bp, Artificial Sequence
  chemically synthesized
gagatggggtttcaccgtgt

SEQ ID NO: 168490 - DNA, 20 bp, Artificial Sequence
  chemically synthesized
ttgtatttttagtagagatg

SEQ ID NO: 168491 - DNA, 20 bp, Artificial Sequence
  chemically synthesized
tttgtatttttagtagagat

SEQ ID NO: 168492 - DNA, 20 bp, Artificial Sequence
  chemically synthesized
ttttgtatttttagtagaga

SEQ ID NO: 168493 - DNA, 20 bp, Artificial Sequence
  chemically synthesized
ttttttttgtatttttagta

SEQ ID NO: 168494 - DNA, 20 bp, Artificial Sequence
  chemically synthesized
ttttttttttgtatttttag

SEQ ID NO: 168495 - DNA, 20 bp, Artificial Sequence
  chemically synthesized
tttttttttttttgtatttt

SEQ ID NO: 168496 - DNA, 20 bp, Artificial Sequence
  chemically synthesized
aaatacaaaaaaaaaaaaaa

SEQ ID NO: 168497 - DNA, 20 bp, Artificial Sequence
  chemically synthesized
taggctgcactaaatttatg

SEQ ID NO: 168498 - DNA, 20 bp, Artificial Sequence
  chemically synthesized
aaaatgtgtcctcataaatt

SEQ ID NO: 168499 - DNA, 20 bp, Artificial Sequence
  chemically synthesized
ttaggctgcactaaatttat

SEQ ID NO: 168500 - DNA, 20 bp, Artificial Sequence
  chemically synthesized
gtgtcctcataaatttagtg

SEQ ID NO: 168501 - DNA, 20 bp, Artificial Sequence
  chemically synthesized
tttagtgcagcctaactata

SEQ ID NO: 168502 - DNA, 20 bp, Artificial Sequence
  chemically synthesized
tttacaaacactgtatagtt

SEQ ID NO: 168503 - DNA, 20 bp, Artificial Sequence
  chemically synthesized
gtttacaaacactgtatagt

SEQ ID NO: 168504 - DNA, 20 bp, Artificial Sequence
  chemically synthesized
tacagtttacaaacactgta

SEQ ID NO: 168505 - DNA, 20 bp, Artificial Sequence
  chemically synthesized
tacagtgtttgtaaactgta

SEQ ID NO: 168506 - DNA, 20 bp, Artificial Sequence
  chemically synthesized
cattattgtacggtaccata

SEQ ID NO: 168507 - DNA, 20 bp, Artificial Sequence
  chemically synthesized
aaatctaagacattattgta

SEQ ID NO: 168508 - DNA, 20 bp, Artificial Sequence
  chemically synthesized
ggtaccgtacaataatgtct

SEQ ID NO: 168509 - DNA, 20 bp, Artificial Sequence
  chemically synthesized
ggtgagcaaatgtgaaatct

SEQ ID NO: 168510 - DNA, 20 bp, Artificial Sequence
  chemically synthesized
ggtgagtgagtggtagtggt

SEQ ID NO: 168511 - DNA, 20 bp, Artificial Sequence
  chemically synthesized
agtcggtgagtgagtggtag

SEQ ID NO: 168512 - DNA, 20 bp, Artificial Sequence
  chemically synthesized
gtgagtcggtgagtgagtgg

SEQ ID NO: 168513 - DNA, 20 bp, Artificial Sequence
  chemically synthesized
tgggtgagtcggtgagtgag

SEQ ID NO: 168514 - DNA, 20 bp, Artificial Sequence
  chemically synthesized
ctctgggtgagtcggtgagt

SEQ ID NO: 168515 - DNA, 20 bp, Artificial Sequence
  chemically synthesized
gttgctctgggtgagtcggt

SEQ ID NO: 168516 - DNA, 20 bp, Artificial Sequence
  chemically synthesized
cactcactcaccgactcacc

SEQ ID NO: 168517 - DNA, 20 bp, Artificial Sequence
  chemically synthesized
caaagttgctctgggtgagt

SEQ ID NO: 168518 - DNA, 20 bp, Artificial Sequence
  chemically synthesized
ctcactcaccgactcaccca

SEQ ID NO: 168519 - DNA, 20 bp, Artificial Sequence
  chemically synthesized
gactcaaagttgctctgggt

SEQ ID NO: 168520 - DNA, 20 bp, Artificial Sequence
  chemically synthesized
gcaggactcaaagttgctct

SEQ ID NO: 168521 - DNA, 20 bp, Artificial Sequence
  chemically synthesized
tgcaggactcaaagttgctc

SEQ ID NO: 168522 - DNA, 20 bp, Artificial Sequence
  chemically synthesized
gactcacccagagcaacttt

SEQ ID NO: 168523 - DNA, 20 bp, Artificial Sequence
  chemically synthesized
aatggagcttgcaggactca

SEQ ID NO: 168524 - DNA, 20 bp, Artificial Sequence
  chemically synthesized
agagcaactttgagtcctgc

SEQ ID NO: 168525 - DNA, 20 bp, Artificial Sequence
  chemically synthesized
ttaccatgaatggagcttgc

SEQ ID NO: 168526 - DNA, 20 bp, Artificial Sequence
  chemically synthesized
tttaccatgaatggagcttg

SEQ ID NO: 168527 - DNA, 20 bp, Artificial Sequence
  chemically synthesized
agtcctgcaagctccattca

SEQ ID NO: 168528 - DNA, 20 bp, Artificial Sequence
  chemically synthesized
tacggtatttaccatgaatg

SEQ ID NO: 168529 - DNA, 20 bp, Artificial Sequence
  chemically synthesized
catacggtatttaccatgaa

SEQ ID NO: 168530 - DNA, 20 bp, Artificial Sequence
  chemically synthesized
ttcatggtaaataccgtatg

SEQ ID NO: 168531 - DNA, 20 bp, Artificial Sequence
  chemically synthesized
aaaaatagtacagctgcata

SEQ ID NO: 168532 - DNA, 20 bp, Artificial Sequence
  chemically synthesized
acaaatgataaaaaatagta

SEQ ID NO: 168533 - DNA, 20 bp, Artificial Sequence
  chemically synthesized
agtatacaaatgataaaaaa

SEQ ID NO: 168534 - DNA, 20 bp, Artificial Sequence
  chemically synthesized
gaaaatgtaccgtaaaaata

SEQ ID NO: 168535 - DNA, 20 bp, Artificial Sequence
  chemically synthesized
atttgtatactgtattttta

SEQ ID NO: 168536 - DNA, 20 bp, Artificial Sequence
  chemically synthesized
tacggtacattttctgtgtc

SEQ ID NO: 168537 - DNA, 20 bp, Artificial Sequence
  chemically synthesized
aatatttgtgtatctagaca

SEQ ID NO: 168538 - DNA, 20 bp, Artificial Sequence
  chemically synthesized
cacaacaatatttgtgtatc

SEQ ID NO: 168539 - DNA, 20 bp, Artificial Sequence
  chemically synthesized
tgttgtgtgacaattgacta

SEQ ID NO: 168540 - DNA, 20 bp, Artificial Sequence
  chemically synthesized
tgacaattgactacagtatt

SEQ ID NO: 168541 - DNA, 20 bp, Artificial Sequence
  chemically synthesized
tgtgactttactgaatactg

SEQ ID NO: 168542 - DNA, 20 bp, Artificial Sequence
  chemically synthesized
attgactacagtattcagta

SEQ ID NO: 168543 - DNA, 20 bp, Artificial Sequence
  chemically synthesized
gtattcagtaaagtcacatg

SEQ ID NO: 168544 - DNA, 20 bp, Artificial Sequence
  chemically synthesized
cagtaaagtcacatgcagta

SEQ ID NO: 168545 - DNA, 20 bp, Artificial Sequence
  chemically synthesized
agtaaagtcacatgcagtac

SEQ ID NO: 168546 - DNA, 20 bp, Artificial Sequence
  chemically synthesized
tcacatgcagtacaggtttg

SEQ ID NO: 168547 - DNA, 20 bp, Artificial Sequence
  chemically synthesized
tgcagtacaggtttgtagcc

SEQ ID NO: 168548 - DNA, 20 bp, Artificial Sequence
  chemically synthesized
gcagtacaggtttgtagcct

SEQ ID NO: 168549 - DNA, 20 bp, Artificial Sequence
  chemically synthesized
agtacaggtttgtagcctag

SEQ ID NO: 168550 - DNA, 20 bp, Artificial Sequence
  chemically synthesized
tggtacagcatattgctcct

SEQ ID NO: 168551 - DNA, 20 bp, Artificial Sequence
  chemically synthesized
atggtacagcatattgctcc

SEQ ID NO: 168552 - DNA, 20 bp, Artificial Sequence
  chemically synthesized
gagcaatatgctgtaccata

SEQ ID NO: 168553 - DNA, 20 bp, Artificial Sequence
  chemically synthesized
cacatccaggctatatggta

SEQ ID NO: 168554 - DNA, 20 bp, Artificial Sequence
  chemically synthesized
atatgctgtaccatatagcc

SEQ ID NO: 168555 - DNA, 20 bp, Artificial Sequence
  chemically synthesized
tactgcacatccaggctata

SEQ ID NO: 168556 - DNA, 20 bp, Artificial Sequence
  chemically synthesized
taccatatagcctggatgtg

SEQ ID NO: 168557 - DNA, 20 bp, Artificial Sequence
  chemically synthesized
gtatagcctactgcacatcc

SEQ ID NO: 168558 - DNA, 20 bp, Artificial Sequence
  chemically synthesized
ggtatagcctactgcacatc

SEQ ID NO: 168559 - DNA, 20 bp, Artificial Sequence
  chemically synthesized
catatagcctggatgtgcag

SEQ ID NO: 168560 - DNA, 20 bp, Artificial Sequence
  chemically synthesized
atatagcctggatgtgcagt

SEQ ID NO: 168561 - DNA, 20 bp, Artificial Sequence
  chemically synthesized
ttacacaaagatagatggta

SEQ ID NO: 168562 - DNA, 20 bp, Artificial Sequence
  chemically synthesized
tgtacttacacaaagataga

SEQ ID NO: 168563 - DNA, 20 bp, Artificial Sequence
  chemically synthesized
agagtgtacttacacaaaga

SEQ ID NO: 168564 - DNA, 20 bp, Artificial Sequence
  chemically synthesized
tataccatctatctttgtgt

SEQ ID NO: 168565 - DNA, 20 bp, Artificial Sequence
  chemically synthesized
tcatagagtgtacttacaca

SEQ ID NO: 168566 - DNA, 20 bp, Artificial Sequence
  chemically synthesized
tttgttgttgtataatcata

SEQ ID NO: 168567 - DNA, 20 bp, Artificial Sequence
  chemically synthesized
attttgttgttgtataatca

SEQ ID NO: 168568 - DNA, 20 bp, Artificial Sequence
  chemically synthesized
gttctgaaaaatgtgtcatt

SEQ ID NO: 168569 - DNA, 20 bp, Artificial Sequence
  chemically synthesized
tgttctgaaaaatgtgtcat

SEQ ID NO: 168570 - DNA, 20 bp, Artificial Sequence
  chemically synthesized
tcacctaatgacacattttt

SEQ ID NO: 168571 - DNA, 20 bp, Artificial Sequence
  chemically synthesized
cagaacatatctcatttgtt

SEQ ID NO: 168572 - DNA, 20 bp, Artificial Sequence
  chemically synthesized
tcatgcatttcttaacaaat

SEQ ID NO: 168573 - DNA, 20 bp, Artificial Sequence
  chemically synthesized
caaattactagcaacatata

SEQ ID NO: 168574 - DNA, 20 bp, Artificial Sequence
  chemically synthesized
tgcatgactatatatgttgc

SEQ ID NO: 168575 - DNA, 20 bp, Artificial Sequence
  chemically synthesized
tatatatgttgctagtaatt

SEQ ID NO: 168576 - DNA, 20 bp, Artificial Sequence
  chemically synthesized
ggtctgaattaccaaattac

SEQ ID NO: 168577 - DNA, 20 bp, Artificial Sequence
  chemically synthesized
ttgctagtaatttggtaatt

SEQ ID NO: 168578 - DNA, 20 bp, Artificial Sequence
  chemically synthesized
atttggtaattcagaccgaa

SEQ ID NO: 168579 - DNA, 20 bp, Artificial Sequence
  chemically synthesized
gtaattcagaccgaaaagtt

SEQ ID NO: 168580 - DNA, 20 bp, Artificial Sequence
  chemically synthesized
agggtagaagcttaactttt

SEQ ID NO: 168581 - DNA, 20 bp, Artificial Sequence
  chemically synthesized
gaaaagttaagcttctaccc

SEQ ID NO: 168582 - DNA, 20 bp, Artificial Sequence
  chemically synthesized
gtttgtagtttccagggtag

SEQ ID NO: 168583 - DNA, 20 bp, Artificial Sequence
  chemically synthesized
agtgtttgtagtttccaggg

SEQ ID NO: 168584 - DNA, 20 bp, Artificial Sequence
  chemically synthesized
agtagtgtttgtagtttcca

SEQ ID NO: 168585 - DNA, 20 bp, Artificial Sequence
  chemically synthesized
cagtagtgtttgtagtttcc

SEQ ID NO: 168586 - DNA, 20 bp, Artificial Sequence
  chemically synthesized
tcagtagtgtttgtagtttc

SEQ ID NO: 168587 - DNA, 20 bp, Artificial Sequence
  chemically synthesized
cactgtctcagtagtgtttg

SEQ ID NO: 168588 - DNA, 20 bp, Artificial Sequence
  chemically synthesized
tggaaactacaaacactact

SEQ ID NO: 168589 - DNA, 20 bp, Artificial Sequence
  chemically synthesized
aactacaaacactactgaga

SEQ ID NO: 168590 - DNA, 20 bp, Artificial Sequence
  chemically synthesized
cattttcttcactgtctcag

SEQ ID NO: 168591 - DNA, 20 bp, Artificial Sequence
  chemically synthesized
ttacattttcttcactgtct

SEQ ID NO: 168592 - DNA, 20 bp, Artificial Sequence
  chemically synthesized
caaacactactgagacagtg

SEQ ID NO: 168593 - DNA, 20 bp, Artificial Sequence
  chemically synthesized
gtgaagaaaatgtaaacaaa

SEQ ID NO: 168594 - DNA, 20 bp, Artificial Sequence
  chemically synthesized
gaagaaaatgtaaacaaata

SEQ ID NO: 168595 - DNA, 20 bp, Artificial Sequence
  chemically synthesized
aagaaaatgtaaacaaatag

SEQ ID NO: 168596 - DNA, 20 bp, Artificial Sequence
  chemically synthesized
tttctaattcatgaagaagg

SEQ ID NO: 168597 - DNA, 20 bp, Artificial Sequence
  chemically synthesized
gactttctaattcatgaaga

SEQ ID NO: 168598 - DNA, 20 bp, Artificial Sequence
  chemically synthesized
ggactttctaattcatgaag

SEQ ID NO: 168599 - DNA, 20 bp, Artificial Sequence
  chemically synthesized
ggactaccttcttcatgaat

SEQ ID NO: 168600 - DNA, 20 bp, Artificial Sequence
  chemically synthesized
attggactttctaattcatg

SEQ ID NO: 168601 - DNA, 20 bp, Artificial Sequence
  chemically synthesized
taccttcttcatgaattaga

SEQ ID NO: 168602 - DNA, 20 bp, Artificial Sequence
  chemically synthesized
ggcagatatctttacagtat

SEQ ID NO: 168603 - DNA, 20 bp, Artificial Sequence
  chemically synthesized
ttagaaagtccaatactgta

SEQ ID NO: 168604 - DNA, 20 bp, Artificial Sequence
  chemically synthesized
agagagggcagatatcttta

SEQ ID NO: 168605 - DNA, 20 bp, Artificial Sequence
  chemically synthesized
tagattatttgaagagaggg

SEQ ID NO: 168606 - DNA, 20 bp, Artificial Sequence
  chemically synthesized
ttatagattatttgaagaga

SEQ ID NO: 168607 - DNA, 20 bp, Artificial Sequence
  chemically synthesized
tttatagattatttgaagag

SEQ ID NO: 168608 - DNA, 20 bp, Artificial Sequence
  chemically synthesized
atttatagattatttgaaga

SEQ ID NO: 168609 - DNA, 20 bp, Artificial Sequence
  chemically synthesized
gaatttatagattatttgaa

SEQ ID NO: 168610 - DNA, 20 bp, Artificial Sequence
  chemically synthesized
ttgaatttatagattatttg

SEQ ID NO: 168611 - DNA, 20 bp, Artificial Sequence
  chemically synthesized
ttgagattgcattgaattta

SEQ ID NO: 168612 - DNA, 20 bp, Artificial Sequence
  chemically synthesized
tggttgctgcaattttgatt

SEQ ID NO: 168613 - DNA, 20 bp, Artificial Sequence
  chemically synthesized
tgcaatctcaatcaaaattg

SEQ ID NO: 168614 - DNA, 20 bp, Artificial Sequence
  chemically synthesized
aaattgcagcaaccatttct

SEQ ID NO: 168615 - DNA, 20 bp, Artificial Sequence
  chemically synthesized
tgtcaatttctactaagaaa

SEQ ID NO: 168616 - DNA, 20 bp, Artificial Sequence
  chemically synthesized
ttgcagcaaccatttcttag

SEQ ID NO: 168617 - DNA, 20 bp, Artificial Sequence
  chemically synthesized
ttggcatgtcaatttctact

SEQ ID NO: 168618 - DNA, 20 bp, Artificial Sequence
  chemically synthesized
gaaattgacatgccaatcct

SEQ ID NO: 168619 - DNA, 20 bp, Artificial Sequence
  chemically synthesized
ttacatataaatcttaggat

SEQ ID NO: 168620 - DNA, 20 bp, Artificial Sequence
  chemically synthesized
tgcacttacatataaatctt

SEQ ID NO: 168621 - DNA, 20 bp, Artificial Sequence
  chemically synthesized
ttgcacttacatataaatct

SEQ ID NO: 168622 - DNA, 20 bp, Artificial Sequence
  chemically synthesized
caatcctaagatttatatgt

SEQ ID NO: 168623 - DNA, 20 bp, Artificial Sequence
  chemically synthesized
aagatttatatgtaagtgca

SEQ ID NO: 168624 - DNA, 20 bp, Artificial Sequence
  chemically synthesized
agatttatatgtaagtgcaa

SEQ ID NO: 168625 - DNA, 20 bp, Artificial Sequence
  chemically synthesized
gatttatatgtaagtgcaaa

SEQ ID NO: 168626 - DNA, 20 bp, Artificial Sequence
  chemically synthesized
atatgtaagtgcaaagggct

SEQ ID NO: 168627 - DNA, 20 bp, Artificial Sequence
  chemically synthesized
aaagttgccttggatattct

SEQ ID NO: 168628 - DNA, 20 bp, Artificial Sequence
  chemically synthesized
gcaaagggctaagaatatcc

SEQ ID NO: 168629 - DNA, 20 bp, Artificial Sequence
  chemically synthesized
caaagggctaagaatatcca

SEQ ID NO: 168630 - DNA, 20 bp, Artificial Sequence
  chemically synthesized
gtcgttcttcaaagttgcct

SEQ ID NO: 168631 - DNA, 20 bp, Artificial Sequence
  chemically synthesized
gaatatccaaggcaactttg

SEQ ID NO: 168632 - DNA, 20 bp, Artificial Sequence
  chemically synthesized
ttaaacttcgtcgttcttca

SEQ ID NO: 168633 - DNA, 20 bp, Artificial Sequence
  chemically synthesized
ggcaactttgaagaacgacg

SEQ ID NO: 168634 - DNA, 20 bp, Artificial Sequence
  chemically synthesized
tttgaagaacgacgaagttt

SEQ ID NO: 168635 - DNA, 20 bp, Artificial Sequence
  chemically synthesized
agtttaagaatgtttgccac

SEQ ID NO: 168636 - DNA, 20 bp, Artificial Sequence
  chemically synthesized
taataaatattcatgtctgg

SEQ ID NO: 168637 - DNA, 20 bp, Artificial Sequence
  chemically synthesized
ttataataaatattcatgtc

SEQ ID NO: 168638 - DNA, 20 bp, Artificial Sequence
  chemically synthesized
catgaatatttattataatt

SEQ ID NO: 168639 - DNA, 20 bp, Artificial Sequence
  chemically synthesized
ttattataattaagcctgtg

SEQ ID NO: 168640 - DNA, 20 bp, Artificial Sequence
  chemically synthesized
tattataattaagcctgtgt

SEQ ID NO: 168641 - DNA, 20 bp, Artificial Sequence
  chemically synthesized
ttctcacttcaatcccacac

SEQ ID NO: 168642 - DNA, 20 bp, Artificial Sequence
  chemically synthesized
gttctcacttcaatcccaca

SEQ ID NO: 168643 - DNA, 20 bp, Artificial Sequence
  chemically synthesized
attaagcctgtgtgggattg

SEQ ID NO: 168644 - DNA, 20 bp, Artificial Sequence
  chemically synthesized
agcctgtgtgggattgaagt

SEQ ID NO: 168645 - DNA, 20 bp, Artificial Sequence
  chemically synthesized
gtgagaacaaatcatctata

SEQ ID NO: 168646 - DNA, 20 bp, Artificial Sequence
  chemically synthesized
ataaattaggaaacgctata

SEQ ID NO: 168647 - DNA, 20 bp, Artificial Sequence
  chemically synthesized
gtgacaccatcgtataaatt

SEQ ID NO: 168648 - DNA, 20 bp, Artificial Sequence
  chemically synthesized
agtgacaccatcgtataaat

SEQ ID NO: 168649 - DNA, 20 bp, Artificial Sequence
  chemically synthesized
gcgtttcctaatttatacga

SEQ ID NO: 168650 - DNA, 20 bp, Artificial Sequence
  chemically synthesized
tttatacgatggtgtcactt

SEQ ID NO: 168651 - DNA, 20 bp, Artificial Sequence
  chemically synthesized
tacgatggtgtcacttaagt

SEQ ID NO: 168652 - DNA, 20 bp, Artificial Sequence
  chemically synthesized
agatcatccttttccaactt

SEQ ID NO: 168653 - DNA, 20 bp, Artificial Sequence
  chemically synthesized
tggtgtcacttaagttggaa

SEQ ID NO: 168654 - DNA, 20 bp, Artificial Sequence
  chemically synthesized
ggtgtcacttaagttggaaa

SEQ ID NO: 168655 - DNA, 20 bp, Artificial Sequence
  chemically synthesized
ttggaaaaggatgatctttt

SEQ ID NO: 168656 - DNA, 20 bp, Artificial Sequence
  chemically synthesized
acttggtgctatttactgaa

SEQ ID NO: 168657 - DNA, 20 bp, Artificial Sequence
  chemically synthesized
aggatgatcttttcagtaaa

SEQ ID NO: 168658 - DNA, 20 bp, Artificial Sequence
  chemically synthesized
tcttttcagtaaatagcacc

SEQ ID NO: 168659 - DNA, 20 bp, Artificial Sequence
  chemically synthesized
aaatgactaatcagttaact

SEQ ID NO: 168660 - DNA, 20 bp, Artificial Sequence
  chemically synthesized
atagcaccaagttaactgat

SEQ ID NO: 168661 - DNA, 20 bp, Artificial Sequence
  chemically synthesized
atgtttttcaaatgactaat

SEQ ID NO: 168662 - DNA, 20 bp, Artificial Sequence
  chemically synthesized
gtgtatgatgtggagagtca

SEQ ID NO: 168663 - DNA, 20 bp, Artificial Sequence
  chemically synthesized
tgtgtatgatgtggagagtc

SEQ ID NO: 168664 - DNA, 20 bp, Artificial Sequence
  chemically synthesized
tgttttgtgtatgatgtgga

SEQ ID NO: 168665 - DNA, 20 bp, Artificial Sequence
  chemically synthesized
tatgttttgtgtatgatgtg

SEQ ID NO: 168666 - DNA, 20 bp, Artificial Sequence
  chemically synthesized
tttatgttttgtgtatgatg

SEQ ID NO: 168667 - DNA, 20 bp, Artificial Sequence
  chemically synthesized
catacacaaaacataaattc

SEQ ID NO: 168668 - DNA, 20 bp, Artificial Sequence
  chemically synthesized
attgaggtctgcaaacaatc

SEQ ID NO: 168669 - DNA, 20 bp, Artificial Sequence
  chemically synthesized
cataaattctagattgtttg

SEQ ID NO: 168670 - DNA, 20 bp, Artificial Sequence
  chemically synthesized
tttttttgccttttacattg

SEQ ID NO: 168671 - DNA, 20 bp, Artificial Sequence
  chemically synthesized
gtttgcagacctcaatgtaa

SEQ ID NO: 168672 - DNA, 20 bp, Artificial Sequence
  chemically synthesized
atttttttgccttttacatt

SEQ ID NO: 168673 - DNA, 20 bp, Artificial Sequence
  chemically synthesized
tttgcagacctcaatgtaaa

SEQ ID NO: 168674 - DNA, 20 bp, Artificial Sequence
  chemically synthesized
atgtaaaaggcaaaaaaata

SEQ ID NO: 168675 - DNA, 20 bp, Artificial Sequence
  chemically synthesized
caaaaaaataaagttttcaa

SEQ ID NO: 168676 - DNA, 20 bp, Artificial Sequence
  chemically synthesized
aaagttttcaaaagaaaata

SEQ ID NO: 168677 - DNA, 20 bp, Artificial Sequence
  chemically synthesized
tacattaacctaaaattgtt

SEQ ID NO: 168678 - DNA, 20 bp, Artificial Sequence
  chemically synthesized
gaaaaaaatctcaacaattt

SEQ ID NO: 168679 - DNA, 20 bp, Artificial Sequence
  chemically synthesized
aaaaaaatctcaacaatttt

SEQ ID NO: 168680 - DNA, 20 bp, Artificial Sequence
  chemically synthesized
taatgtattattttttaaac

SEQ ID NO: 168681 - DNA, 20 bp, Artificial Sequence
  chemically synthesized
ttttttaaacaagacataaa

SEQ ID NO: 168682 - DNA, 20 bp, Artificial Sequence
  chemically synthesized
aaacaagacataaaaagcat

SEQ ID NO: 168683 - DNA, 20 bp, Artificial Sequence
  chemically synthesized
cataaaaagcattagccata

SEQ ID NO: 168684 - DNA, 20 bp, Artificial Sequence
  chemically synthesized
ataaaaagcattagccataa

SEQ ID NO: 168685 - DNA, 20 bp, Artificial Sequence
  chemically synthesized
tttatcagtcttttccttta

SEQ ID NO: 168686 - DNA, 20 bp, Artificial Sequence
  chemically synthesized
aagcattagccataaaggaa

SEQ ID NO: 168687 - DNA, 20 bp, Artificial Sequence
  chemically synthesized
ataaatggagtttgatttat

SEQ ID NO: 168688 - DNA, 20 bp, Artificial Sequence
  chemically synthesized
ataaatcaaactccatttat

SEQ ID NO: 168689 - DNA, 20 bp, Artificial Sequence
  chemically synthesized
acaatctttcctgataaatg

SEQ ID NO: 168690 - DNA, 20 bp, Artificial Sequence
  chemically synthesized
taaatcaaactccatttatc

SEQ ID NO: 168691 - DNA, 20 bp, Artificial Sequence
  chemically synthesized
taacaatctttcctgataaa

SEQ ID NO: 168692 - DNA, 20 bp, Artificial Sequence
  chemically synthesized
tcaaactccatttatcagga

SEQ ID NO: 168693 - DNA, 20 bp, Artificial Sequence
  chemically synthesized
atttatcaggaaagattgtt

SEQ ID NO: 168694 - DNA, 20 bp, Artificial Sequence
  chemically synthesized
ttatcaggaaagattgttaa

SEQ ID NO: 168695 - DNA, 20 bp, Artificial Sequence
  chemically synthesized
attgttaagagaaaaaaata

SEQ ID NO: 168696 - DNA, 20 bp, Artificial Sequence
  chemically synthesized
taagagaaaaaaataaagca

SEQ ID NO: 168697 - DNA, 20 bp, Artificial Sequence
  chemically synthesized
gaaaaaaataaagcaaagtt

SEQ ID NO: 168698 - DNA, 20 bp, Artificial Sequence
  chemically synthesized
aaaaaaataaagcaaagttt

SEQ ID NO: 168699 - DNA, 20 bp, Artificial Sequence
  chemically synthesized
aaataaagcaaagtttaggt

SEQ ID NO: 168700 - DNA, 20 bp, Artificial Sequence
  chemically synthesized
agcaaagtttaggttggaaa

SEQ ID NO: 168701 - DNA, 20 bp, Artificial Sequence
  chemically synthesized
aaaaagatattcgcaatgca

SEQ ID NO: 168702 - DNA, 20 bp, Artificial Sequence
  chemically synthesized
cgcaatgcatagatctgaca

SEQ ID NO: 168703 - DNA, 20 bp, Artificial Sequence
  chemically synthesized
gcaatgcatagatctgacaa

SEQ ID NO: 168704 - DNA, 20 bp, Artificial Sequence
  chemically synthesized
tttggatacaagtcctttgt

SEQ ID NO: 168705 - DNA, 20 bp, Artificial Sequence
  chemically synthesized
tgtagaagttatttggatac

SEQ ID NO: 168706 - DNA, 20 bp, Artificial Sequence
  chemically synthesized
ttactgatgtagaagttatt

SEQ ID NO: 168707 - DNA, 20 bp, Artificial Sequence
  chemically synthesized
tatccaaataacttctacat

SEQ ID NO: 168708 - DNA, 20 bp, Artificial Sequence
  chemically synthesized
tctttttcttactgatgtag

SEQ ID NO: 168709 - DNA, 20 bp, Artificial Sequence
  chemically synthesized
caaataacttctacatcagt

SEQ ID NO: 168710 - DNA, 20 bp, Artificial Sequence
  chemically synthesized
ttgtctttttcttactgatg

SEQ ID NO: 168711 - DNA, 20 bp, Artificial Sequence
  chemically synthesized
acttctacatcagtaagaaa

SEQ ID NO: 168712 - DNA, 20 bp, Artificial Sequence
  chemically synthesized
cttttgcccattaaaaataa

SEQ ID NO: 168713 - DNA, 20 bp, Artificial Sequence
  chemically synthesized
aagacaactattatttttaa

SEQ ID NO: 168714 - DNA, 20 bp, Artificial Sequence
  chemically synthesized
agacaactattatttttaat

SEQ ID NO: 168715 - DNA, 20 bp, Artificial Sequence
  chemically synthesized
ctattatttttaatgggcaa

SEQ ID NO: 168716 - DNA, 20 bp, Artificial Sequence
  chemically synthesized
tttgcataatgacttcacat

SEQ ID NO: 168717 - DNA, 20 bp, Artificial Sequence
  chemically synthesized
tgcataatgacttcacataa

SEQ ID NO: 168718 - DNA, 20 bp, Artificial Sequence
  chemically synthesized
tttttatatcctcttatgtg

SEQ ID NO: 168719 - DNA, 20 bp, Artificial Sequence
  chemically synthesized
gcataatgacttcacataag

SEQ ID NO: 168720 - DNA, 20 bp, Artificial Sequence
  chemically synthesized
cacataagaggatataaaaa

SEQ ID NO: 168721 - DNA, 20 bp, Artificial Sequence
  chemically synthesized
ataaaaatggcactaatcgt

SEQ ID NO: 168722 - DNA, 20 bp, Artificial Sequence
  chemically synthesized
taaaaatggcactaatcgtc

SEQ ID NO: 168723 - DNA, 20 bp, Artificial Sequence
  chemically synthesized
atttgcaatcacctgacgat

SEQ ID NO: 168724 - DNA, 20 bp, Artificial Sequence
  chemically synthesized
ccatttaggtgaatgtgaaa

SEQ ID NO: 168725 - DNA, 20 bp, Artificial Sequence
  chemically synthesized
ccatttcacattcacctaaa

SEQ ID NO: 168726 - DNA, 20 bp, Artificial Sequence
  chemically synthesized
ctttatccttttaaccattt

SEQ ID NO: 168727 - DNA, 20 bp, Artificial Sequence
  chemically synthesized
cctttatccttttaaccatt

SEQ ID NO: 168728 - DNA, 20 bp, Artificial Sequence
  chemically synthesized
acattcacctaaatggttaa

SEQ ID NO: 168729 - DNA, 20 bp, Artificial Sequence
  chemically synthesized
cattcacctaaatggttaaa

SEQ ID NO: 168730 - DNA, 20 bp, Artificial Sequence
  chemically synthesized
cctaaatggttaaaaggata

SEQ ID NO: 168731 - DNA, 20 bp, Artificial Sequence
  chemically synthesized
ctaaatggttaaaaggataa

SEQ ID NO: 168732 - DNA, 20 bp, Artificial Sequence
  chemically synthesized
ttgatccacatattcatcaa

SEQ ID NO: 168733 - DNA, 20 bp, Artificial Sequence
  chemically synthesized
agttgatccacatattcatc

SEQ ID NO: 168734 - DNA, 20 bp, Artificial Sequence
  chemically synthesized
acatactcttgatgaatatg

SEQ ID NO: 168735 - DNA, 20 bp, Artificial Sequence
  chemically synthesized
tgatgaatatgtggatcaac

SEQ ID NO: 168736 - DNA, 20 bp, Artificial Sequence
  chemically synthesized
tgaatatgtggatcaactag

SEQ ID NO: 168737 - DNA, 20 bp, Artificial Sequence
  chemically synthesized
ccagcagtatataagacttc

SEQ ID NO: 168738 - DNA, 20 bp, Artificial Sequence
  chemically synthesized
cattttcaccagcagtatat

SEQ ID NO: 168739 - DNA, 20 bp, Artificial Sequence
  chemically synthesized
ctagaagtcttatatactgc

SEQ ID NO: 168740 - DNA, 20 bp, Artificial Sequence
  chemically synthesized
tttcagttcattttcaccag

SEQ ID NO: 168741 - DNA, 20 bp, Artificial Sequence
  chemically synthesized
tcatttcagttcattttcac

SEQ ID NO: 168742 - DNA, 20 bp, Artificial Sequence
  chemically synthesized
gtttttcagtgtggtcattt

SEQ ID NO: 168743 - DNA, 20 bp, Artificial Sequence
  chemically synthesized
caaaaaacagtttttcagtg

SEQ ID NO: 168744 - DNA, 20 bp, Artificial Sequence
  chemically synthesized
atcaccaaaaaacagttttt

SEQ ID NO: 168745 - DNA, 20 bp, Artificial Sequence
  chemically synthesized
cacactgaaaaactgttttt

SEQ ID NO: 168746 - DNA, 20 bp, Artificial Sequence
  chemically synthesized
gctttggaatcaccaaaaaa

SEQ ID NO: 168747 - DNA, 20 bp, Artificial Sequence
  chemically synthesized
actgttttttggtgattcca

SEQ ID NO: 168748 - DNA, 20 bp, Artificial Sequence
  chemically synthesized
aagatgtgtacatttggctt

SEQ ID NO: 168749 - DNA, 20 bp, Artificial Sequence
  chemically synthesized
ggtcataagatgtgtacatt

SEQ ID NO: 168750 - DNA, 20 bp, Artificial Sequence
  chemically synthesized
aatgtacacatcttatgacc

SEQ ID NO: 168751 - DNA, 20 bp, Artificial Sequence
  chemically synthesized
aagtacaatggctaggtcat

SEQ ID NO: 168752 - DNA, 20 bp, Artificial Sequence
  chemically synthesized
tacgtggaagtacaatggct

SEQ ID NO: 168753 - DNA, 20 bp, Artificial Sequence
  chemically synthesized
atacgtggaagtacaatggc

SEQ ID NO: 168754 - DNA, 20 bp, Artificial Sequence
  chemically synthesized
taatatacgtggaagtacaa

SEQ ID NO: 168755 - DNA, 20 bp, Artificial Sequence
  chemically synthesized
tttatttttaatatacgtgg

SEQ ID NO: 168756 - DNA, 20 bp, Artificial Sequence
  chemically synthesized
atatttatttttaatatacg

SEQ ID NO: 168757 - DNA, 20 bp, Artificial Sequence
  chemically synthesized
aataaatatatacatatatg

SEQ ID NO: 168758 - DNA, 20 bp, Artificial Sequence
  chemically synthesized
atatatacatatatgcagca

SEQ ID NO: 168759 - DNA, 20 bp, Artificial Sequence
  chemically synthesized
tatatacatatatgcagcaa

SEQ ID NO: 168760 - DNA, 20 bp, Artificial Sequence
  chemically synthesized
tacatatatgcagcaaagga

SEQ ID NO: 168761 - DNA, 20 bp, Artificial Sequence
  chemically synthesized
acatatatgcagcaaaggac

SEQ ID NO: 168762 - DNA, 20 bp, Artificial Sequence
  chemically synthesized
aaaggacaggaacatcacac

SEQ ID NO: 168763 - DNA, 20 bp, Artificial Sequence
  chemically synthesized
ggggctattaggaaaaatgc

SEQ ID NO: 168764 - DNA, 20 bp, Artificial Sequence
  chemically synthesized
cacaccagcatttttcctaa

SEQ ID NO: 168765 - DNA, 20 bp, Artificial Sequence
  chemically synthesized
gtgtctattatggggctatt

SEQ ID NO: 168766 - DNA, 20 bp, Artificial Sequence
  chemically synthesized
tgtgtctattatggggctat

SEQ ID NO: 168767 - DNA, 20 bp, Artificial Sequence
  chemically synthesized
ttttcctaatagccccataa

SEQ ID NO: 168768 - DNA, 20 bp, Artificial Sequence
  chemically synthesized
attgggctgtgtctattatg

SEQ ID NO: 168769 - DNA, 20 bp, Artificial Sequence
  chemically synthesized
cattgggctgtgtctattat

SEQ ID NO: 168770 - DNA, 20 bp, Artificial Sequence
  chemically synthesized
acattgggctgtgtctatta

SEQ ID NO: 168771 - DNA, 20 bp, Artificial Sequence
  chemically synthesized
taatagccccataatagaca

SEQ ID NO: 168772 - DNA, 20 bp, Artificial Sequence
  chemically synthesized
tctgctaatcaatggacatt

SEQ ID NO: 168773 - DNA, 20 bp, Artificial Sequence
  chemically synthesized
ttctgctaatcaatggacat

SEQ ID NO: 168774 - DNA, 20 bp, Artificial Sequence
  chemically synthesized
acagcccaatgtccattgat

SEQ ID NO: 168775 - DNA, 20 bp, Artificial Sequence
  chemically synthesized
ttatccattctgctaatcaa

SEQ ID NO: 168776 - DNA, 20 bp, Artificial Sequence
  chemically synthesized
gcccaatgtccattgattag

SEQ ID NO: 168777 - DNA, 20 bp, Artificial Sequence
  chemically synthesized
atgtccattgattagcagaa

SEQ ID NO: 168778 - DNA, 20 bp, Artificial Sequence
  chemically synthesized
ttagcagaatggataaactg

SEQ ID NO: 168779 - DNA, 20 bp, Artificial Sequence
  chemically synthesized
tctattgtgtgaatatgcca

SEQ ID NO: 168780 - DNA, 20 bp, Artificial Sequence
  chemically synthesized
actgtggcatattcacacaa

SEQ ID NO: 168781 - DNA, 20 bp, Artificial Sequence
  chemically synthesized
acacaatagaataccataca

SEQ ID NO: 168782 - DNA, 20 bp, Artificial Sequence
  chemically synthesized
tagtttagtttttctatgta

SEQ ID NO: 168783 - DNA, 20 bp, Artificial Sequence
  chemically synthesized
tgcctgtgccatagttagtt

SEQ ID NO: 168784 - DNA, 20 bp, Artificial Sequence
  chemically synthesized
tagaaaaactaaactaacta

SEQ ID NO: 168785 - DNA, 20 bp, Artificial Sequence
  chemically synthesized
gctattgcctgtgccatagt

SEQ ID NO: 168786 - DNA, 20 bp, Artificial Sequence
  chemically synthesized
aaactaaactaactatggca

SEQ ID NO: 168787 - DNA, 20 bp, Artificial Sequence
  chemically synthesized
aactaaactaactatggcac

SEQ ID NO: 168788 - DNA, 20 bp, Artificial Sequence
  chemically synthesized
ctatgctattgcctgtgcca

SEQ ID NO: 168789 - DNA, 20 bp, Artificial Sequence
  chemically synthesized
actaactatggcacaggcaa

SEQ ID NO: 168790 - DNA, 20 bp, Artificial Sequence
  chemically synthesized
ctatggcacaggcaatagca

SEQ ID NO: 168791 - DNA, 20 bp, Artificial Sequence
  chemically synthesized
aatatcacaaaaataatgtt

SEQ ID NO: 168792 - DNA, 20 bp, Artificial Sequence
  chemically synthesized
atcacaaaaataatgttgag

SEQ ID NO: 168793 - DNA, 20 bp, Artificial Sequence
  chemically synthesized
tcacaaaaataatgttgagc

SEQ ID NO: 168794 - DNA, 20 bp, Artificial Sequence
  chemically synthesized
gagcaggacatgtcaaatac

SEQ ID NO: 168795 - DNA, 20 bp, Artificial Sequence
  chemically synthesized
agcaggacatgtcaaataca

SEQ ID NO: 168796 - DNA, 20 bp, Artificial Sequence
  chemically synthesized
gcaggacatgtcaaatacaa

SEQ ID NO: 168797 - DNA, 20 bp, Artificial Sequence
  chemically synthesized
tcaaatacaagggcatatac

SEQ ID NO: 168798 - DNA, 20 bp, Artificial Sequence
  chemically synthesized
ttactataaacagaatcatc

SEQ ID NO: 168799 - DNA, 20 bp, Artificial Sequence
  chemically synthesized
atactggatgattctgttta

SEQ ID NO: 168800 - DNA, 20 bp, Artificial Sequence
  chemically synthesized
gactttgaaattactataaa

SEQ ID NO: 168801 - DNA, 20 bp, Artificial Sequence
  chemically synthesized
ttctgtttatagtaatttca

SEQ ID NO: 168802 - DNA, 20 bp, Artificial Sequence
  chemically synthesized
tttcaaagtcaaaactaatc

SEQ ID NO: 168803 - DNA, 20 bp, Artificial Sequence
  chemically synthesized
ttcaaagtcaaaactaatct

SEQ ID NO: 168804 - DNA, 20 bp, Artificial Sequence
  chemically synthesized
ttgacttctaacacctagat

SEQ ID NO: 168805 - DNA, 20 bp, Artificial Sequence
  chemically synthesized
gtcaaaactaatctaggtgt

SEQ ID NO: 168806 - DNA, 20 bp, Artificial Sequence
  chemically synthesized
ctcttttgacttctaacacc

SEQ ID NO: 168807 - DNA, 20 bp, Artificial Sequence
  chemically synthesized
aaaactaatctaggtgttag

SEQ ID NO: 168808 - DNA, 20 bp, Artificial Sequence
  chemically synthesized
atctaggtgttagaagtcaa

SEQ ID NO: 168809 - DNA, 20 bp, Artificial Sequence
  chemically synthesized
ctaggtgttagaagtcaaaa

SEQ ID NO: 168810 - DNA, 20 bp, Artificial Sequence
  chemically synthesized
gtcaaaagagtgcttatctt

SEQ ID NO: 168811 - DNA, 20 bp, Artificial Sequence
  chemically synthesized
tcaaaagagtgcttatcttt

SEQ ID NO: 168812 - DNA, 20 bp, Artificial Sequence
  chemically synthesized
caccaccctctcccaaagat

SEQ ID NO: 168813 - DNA, 20 bp, Artificial Sequence
  chemically synthesized
aaaagagtgcttatctttgg

SEQ ID NO: 168814 - DNA, 20 bp, Artificial Sequence
  chemically synthesized
aagagtgcttatctttggga

SEQ ID NO: 168815 - DNA, 20 bp, Artificial Sequence
  chemically synthesized
agagtgcttatctttgggag

SEQ ID NO: 168816 - DNA, 20 bp, Artificial Sequence
  chemically synthesized
gagtgcttatctttgggaga

SEQ ID NO: 168817 - DNA, 20 bp, Artificial Sequence
  chemically synthesized
cctgccaccaccctctccca

SEQ ID NO: 168818 - DNA, 20 bp, Artificial Sequence
  chemically synthesized
tgcttatctttgggagaggg

SEQ ID NO: 168819 - DNA, 20 bp, Artificial Sequence
  chemically synthesized
ttatctttgggagagggtgg

SEQ ID NO: 168820 - DNA, 20 bp, Artificial Sequence
  chemically synthesized
tctttgggagagggtggtgg

SEQ ID NO: 168821 - DNA, 20 bp, Artificial Sequence
  chemically synthesized
ctttgggagagggtggtggc

SEQ ID NO: 168822 - DNA, 20 bp, Artificial Sequence
  chemically synthesized
tttgggagagggtggtggca

SEQ ID NO: 168823 - DNA, 20 bp, Artificial Sequence
  chemically synthesized
ttgggagagggtggtggcag

SEQ ID NO: 168824 - DNA, 20 bp, Artificial Sequence
  chemically synthesized
gggagagggtggtggcaggg

SEQ ID NO: 168825 - DNA, 20 bp, Artificial Sequence
  chemically synthesized
gagagggtggtggcagggga

SEQ ID NO: 168826 - DNA, 20 bp, Artificial Sequence
  chemically synthesized
agagggtggtggcaggggag

SEQ ID NO: 168827 - DNA, 20 bp, Artificial Sequence
  chemically synthesized
gcaggggagaggctcataac

SEQ ID NO: 168828 - DNA, 20 bp, Artificial Sequence
  chemically synthesized
caggggagaggctcataact

SEQ ID NO: 168829 - DNA, 20 bp, Artificial Sequence
  chemically synthesized
tcatgttccctcccagttat

SEQ ID NO: 168830 - DNA, 20 bp, Artificial Sequence
  chemically synthesized
ggggagaggctcataactgg

SEQ ID NO: 168831 - DNA, 20 bp, Artificial Sequence
  chemically synthesized
gggagaggctcataactggg

SEQ ID NO: 168832 - DNA, 20 bp, Artificial Sequence
  chemically synthesized
ggagaggctcataactggga

SEQ ID NO: 168833 - DNA, 20 bp, Artificial Sequence
  chemically synthesized
gcccctctcatgttccctcc

SEQ ID NO: 168834 - DNA, 20 bp, Artificial Sequence
  chemically synthesized
tcataactgggagggaacat

SEQ ID NO: 168835 - DNA, 20 bp, Artificial Sequence
  chemically synthesized
ataactgggagggaacatga

SEQ ID NO: 168836 - DNA, 20 bp, Artificial Sequence
  chemically synthesized
taactgggagggaacatgag

SEQ ID NO: 168837 - DNA, 20 bp, Artificial Sequence
  chemically synthesized
aactgggagggaacatgaga

SEQ ID NO: 168838 - DNA, 20 bp, Artificial Sequence
  chemically synthesized
actgggagggaacatgagag

SEQ ID NO: 168839 - DNA, 20 bp, Artificial Sequence
  chemically synthesized
ggaacatgagaggggctcct

SEQ ID NO: 168840 - DNA, 20 bp, Artificial Sequence
  chemically synthesized
gaacatgagaggggctcctg

SEQ ID NO: 168841 - DNA, 20 bp, Artificial Sequence
  chemically synthesized
gaattagaacattacctcag

SEQ ID NO: 168842 - DNA, 20 bp, Artificial Sequence
  chemically synthesized
aagaattagaacattacctc

SEQ ID NO: 168843 - DNA, 20 bp, Artificial Sequence
  chemically synthesized
caagaattagaacattacct

SEQ ID NO: 168844 - DNA, 20 bp, Artificial Sequence
  chemically synthesized
ctaccaccaagttcaagaat

SEQ ID NO: 168845 - DNA, 20 bp, Artificial Sequence
  chemically synthesized
aatgttctaattcttgaact

SEQ ID NO: 168846 - DNA, 20 bp, Artificial Sequence
  chemically synthesized
atgctactaccaccaagttc

SEQ ID NO: 168847 - DNA, 20 bp, Artificial Sequence
  chemically synthesized
gttctaattcttgaacttgg

SEQ ID NO: 168848 - DNA, 20 bp, Artificial Sequence
  chemically synthesized
ctaattcttgaacttggtgg

SEQ ID NO: 168849 - DNA, 20 bp, Artificial Sequence
  chemically synthesized
gtatccatgctactaccacc

SEQ ID NO: 168850 - DNA, 20 bp, Artificial Sequence
  chemically synthesized
attcttgaacttggtggtag

SEQ ID NO: 168851 - DNA, 20 bp, Artificial Sequence
  chemically synthesized
tgaacttggtggtagtagca

SEQ ID NO: 168852 - DNA, 20 bp, Artificial Sequence
  chemically synthesized
ggtagtagcatggatacact

SEQ ID NO: 168853 - DNA, 20 bp, Artificial Sequence
  chemically synthesized
agggatttttaaaaaaaact

SEQ ID NO: 168854 - DNA, 20 bp, Artificial Sequence
  chemically synthesized
atcataagaatagaaattca

SEQ ID NO: 168855 - DNA, 20 bp, Artificial Sequence
  chemically synthesized
aatcataagaatagaaattc

SEQ ID NO: 168856 - DNA, 20 bp, Artificial Sequence
  chemically synthesized
aaatcataagaatagaaatt

SEQ ID NO: 168857 - DNA, 20 bp, Artificial Sequence
  chemically synthesized
aagtacacaaatcataagaa

SEQ ID NO: 168858 - DNA, 20 bp, Artificial Sequence
  chemically synthesized
tagaaaagtacacaaatcat

SEQ ID NO: 168859 - DNA, 20 bp, Artificial Sequence
  chemically synthesized
aagtataaagacacatagaa

SEQ ID NO: 168860 - DNA, 20 bp, Artificial Sequence
  chemically synthesized
aactgaagtataaagacaca

SEQ ID NO: 168861 - DNA, 20 bp, Artificial Sequence
  chemically synthesized
ttctatgtgtctttatactt

SEQ ID NO: 168862 - DNA, 20 bp, Artificial Sequence
  chemically synthesized
attttctaaactgaagtata

SEQ ID NO: 168863 - DNA, 20 bp, Artificial Sequence
  chemically synthesized
tgtgtctttatacttcagtt

SEQ ID NO: 168864 - DNA, 20 bp, Artificial Sequence
  chemically synthesized
ttatcaaattttctaaactg

SEQ ID NO: 168865 - DNA, 20 bp, Artificial Sequence
  chemically synthesized
atttgataaaactactttaa
